United States Patent 10,706,955 (BIOINFORMATIC PROCESSES FOR DETERMINATION OF PEPTIDE BINDING) - sequence listing, part 9

SEQ ID NO: 313661 - protein, 25 aa, Mycobacterium
ITAIWRPDGAHGMYSWAHVLLATAC

SEQ ID NO: 313662 - protein, 18 aa, Mycobacterium
ITALRAGGYQVTMLTGDN

SEQ ID NO: 313663 - protein, 26 aa, Mycobacterium
ITAMGLRFGENIMYYLVVTFTITYLA

SEQ ID NO: 313664 - protein, 23 aa, Mycobacterium
ITAPEAFTAWEYADGYDVAQAVV

SEQ ID NO: 313665 - protein, 26 aa, Mycobacterium
ITAQIAGQVGRLWKLTAALTTDDRTG

SEQ ID NO: 313666 - protein, 26 aa, Mycobacterium
ITARFWRRSGIRIVRRPVTNLVASLM

SEQ ID NO: 313667 - protein, 28 aa, Mycobacterium
ITARVGLALGVAVAVCFVTGLISHFIQH

SEQ ID NO: 313668 - protein, 17 aa, Mycobacterium
ITARWIPYARADLVLGI

SEQ ID NO: 313669 - protein, 25 aa, Mycobacterium
ITASGRMALALAKQHQPAAITLDIG

SEQ ID NO: 313670 - protein, 17 aa, Mycobacterium
ITATTAFGAKYVDLSYP

SEQ ID NO: 313671 - protein, 26 aa, Mycobacterium
ITAVLSRSRLVGWSFAVGVIALLGLP

SEQ ID NO: 313672 - protein, 19 aa, Mycobacterium
ITDDYSFDWFRLAWTVQYP

SEQ ID NO: 313673 - protein, 18 aa, Mycobacterium
ITDGWWVYLAAYALFIGI

SEQ ID NO: 313674 - protein, 23 aa, Mycobacterium
ITDLGALLWARGVDTLIGCAVAL

SEQ ID NO: 313675 - protein, 25 aa, Mycobacterium
ITDLPEGRWAEFLEEPRLAERMAKA

SEQ ID NO: 313676 - protein, 34 aa, Mycobacterium
ITDLPEGRWSEFLDEPRIAARVGAARTRGGYLKD

SEQ ID NO: 313677 - protein, 25 aa, Mycobacterium
ITDLPEGRWSEFLEEPRIAERVANA

SEQ ID NO: 313678 - protein, 26 aa, Mycobacterium
ITDLPEGRWSEFLSEPRIAERVAKAR

SEQ ID NO: 313679 - protein, 25 aa, Mycobacterium
ITDLPEGRWTEFLEEPRLAERVKAA

SEQ ID NO: 313680 - protein, 23 aa, Mycobacterium
ITEFALRPIAAQALEAGRPPRRL

SEQ ID NO: 313681 - protein, 23 aa, Mycobacterium
ITEGFFSPLFFVWLGASLQVREL

SEQ ID NO: 313682 - protein, 25 aa, Mycobacterium
ITEPKKAAAALGWLVEEMEQRYQDM

SEQ ID NO: 313683 - protein, 17 aa, Mycobacterium
ITESALVDSARSRNTVA

SEQ ID NO: 313684 - protein, 17 aa, Mycobacterium
ITESARALVPGMLGSMV

SEQ ID NO: 313685 - protein, 38 aa, Mycobacterium
ITETINLPAGFAIGWAMWPLVAAIVLQAIAAVVVVLLD

SEQ ID NO: 313686 - protein, 40 aa, Mycobacterium
ITETINLPAGFAIGWAMWPLVACSVLQAIAAVVVVLLDAG

SEQ ID NO: 313687 - protein, 20 aa, Mycobacterium
ITFALKRTRTVTVNSEASSA

SEQ ID NO: 313688 - protein, 27 aa, Mycobacterium
ITFFDYQPWLRRRLEDRIGGPATDTVM

SEQ ID NO: 313689 - protein, 23 aa, Mycobacterium
ITFMAWSGVVGFLLGSVTVTLLQ

SEQ ID NO: 313690 - protein, 17 aa, Mycobacterium
ITGDFLLIAAGIGGLGG

SEQ ID NO: 313691 - protein, 24 aa, Mycobacterium
ITGFARIVLLAAILGAALSSSFSV

SEQ ID NO: 313692 - protein, 22 aa, Mycobacterium
ITGGLAFFFGPVVVFWVLATMA

SEQ ID NO: 313693 - protein, 19 aa, Mycobacterium
ITGGLGYAAAFLLISLLLC

SEQ ID NO: 313694 - protein, 28 aa, Mycobacterium
ITGGWLLEHFSWGSIFLVNVPIAVAAMA

SEQ ID NO: 313695 - protein, 23 aa, Mycobacterium
ITGIPFVVAAGWLSSLTGIPVAV

SEQ ID NO: 313696 - protein, 19 aa, Mycobacterium
ITGLLWREATTAGTVRLSR

SEQ ID NO: 313697 - protein, 25 aa, Mycobacterium
ITGLRGVLITLCLTEITSWGVLYYA

SEQ ID NO: 313698 - protein, 18 aa, Mycobacterium
ITGLTFLVIVVMLLFFYR

SEQ ID NO: 313699 - protein, 18 aa, Mycobacterium
ITGMLWREASIAGTVGLL

SEQ ID NO: 313700 - protein, 17 aa, Mycobacterium
ITGPLANRVRALAPGSG

SEQ ID NO: 313701 - protein, 25 aa, Mycobacterium
ITHGPRPGLIIGIAFAATYAGWAWL

SEQ ID NO: 313702 - protein, 17 aa, Mycobacterium
ITIAFTGGRPAMITAAT

SEQ ID NO: 313703 - protein, 20 aa, Mycobacterium
ITIGALWLLYRYYRTRDPLF

SEQ ID NO: 313704 - protein, 28 aa, Mycobacterium
ITIGEAWARVRGRVLALIGLALLEAAGM

SEQ ID NO: 313705 - protein, 20 aa, Mycobacterium
ITIGETWAKIRGRLVPLLGL

SEQ ID NO: 313706 - protein, 21 aa, Mycobacterium
ITIMLVLFFRSIVTTLLILVM

SEQ ID NO: 313707 - protein, 29 aa, Mycobacterium
ITISEAWARVRGRILALIGLALLEGAGLV

SEQ ID NO: 313708 - protein, 18 aa, Mycobacterium
ITKLGWQVARSVTDSTAS

SEQ ID NO: 313709 - protein, 17 aa, Mycobacterium
ITKMCRGVLAGAMLLVL

SEQ ID NO: 313710 - protein, 19 aa, Mycobacterium
ITLACLVALILILPLAALS

SEQ ID NO: 313711 - protein, 17 aa, Mycobacterium
ITLAPWLLTAAILVPLN

SEQ ID NO: 313712 - protein, 17 aa, Mycobacterium
ITLEVLDGPGIPEVLGD

SEQ ID NO: 313713 - protein, 19 aa, Mycobacterium
ITLEVLWTGGISRPPTVLY

SEQ ID NO: 313714 - protein, 21 aa, Mycobacterium
ITLFICCGIGKGSVFKLIPSI

SEQ ID NO: 313715 - protein, 17 aa, Mycobacterium
ITLIVGFLVAVAASLTP

SEQ ID NO: 313716 - protein, 30 aa, Mycobacterium
ITLKRAKGPLVFDLGICLVLVTLPTLALFV

SEQ ID NO: 313717 - protein, 17 aa, Mycobacterium
ITLLLSVVLMMAGVALL

SEQ ID NO: 313718 - protein, 20 aa, Mycobacterium
ITLLPACLGVLGRHVDALGV

SEQ ID NO: 313719 - protein, 25 aa, Mycobacterium
ITLLPALLVLAGRRGWIAPRTDLSR

SEQ ID NO: 313720 - protein, 20 aa, Mycobacterium
ITLNCLWVSLVFGVLATRYR

SEQ ID NO: 313721 - protein, 21 aa, Mycobacterium
ITLPLIPVFMVLIGLATAERS

SEQ ID NO: 313722 - protein, 23 aa, Mycobacterium
ITLPMLRPTMFFVLVTGIVSAAQ

SEQ ID NO: 313723 - protein, 22 aa, Mycobacterium
ITLPVALPLGIGGYVNYRDQSA

SEQ ID NO: 313724 - protein, 18 aa, Mycobacterium
ITLQRSKGALIFDVGICL

SEQ ID NO: 313725 - protein, 18 aa, Mycobacterium
ITLSPAWNLAATSRMSEN

SEQ ID NO: 313726 - protein, 25 aa, Mycobacterium
ITLTGGVVLALLVGRRLWHRFRGQP

SEQ ID NO: 313727 - protein, 17 aa, Mycobacterium
ITLTIYGSTVVQNTPAE

SEQ ID NO: 313728 - protein, 30 aa, Mycobacterium
ITLTVMAIFYLRLPATFGIGTYGVSADFVA

SEQ ID NO: 313729 - protein, 18 aa, Mycobacterium
ITLVGLLALPGYKTNYND

SEQ ID NO: 313730 - protein, 21 aa, Mycobacterium
ITMQHSIAWRSMHSQGRGLFS

SEQ ID NO: 313731 - protein, 25 aa, Mycobacterium
ITMSVPVIGTWLHWALFGGDFPGDI

SEQ ID NO: 313732 - protein, 18 aa, Mycobacterium
ITNSRKAPTLALIVPGVI

SEQ ID NO: 313733 - protein, 17 aa, Mycobacterium
ITPASGWTLVDQGPNRV

SEQ ID NO: 313734 - protein, 18 aa, Mycobacterium
ITPIAVGLTFRFLLNDQL

SEQ ID NO: 313735 - protein, 17 aa, Mycobacterium
ITPKYVKRIPANVAADI

SEQ ID NO: 313736 - protein, 29 aa, Mycobacterium
ITPMLPGMAVFRAVFYFAVEKDFAAGMTQ

SEQ ID NO: 313737 - protein, 29 aa, Mycobacterium
ITPMLPGMAVFRAVYFFAVEDRFGDGLAQ

SEQ ID NO: 313738 - protein, 25 aa, Mycobacterium
ITPREIKLAASYFLATPLIVLTGSA

SEQ ID NO: 313739 - protein, 24 aa, Mycobacterium
ITPREIKLAASYFLVTPLIVLTGT

SEQ ID NO: 313740 - protein, 24 aa, Mycobacterium
ITPREMKLAAGYFLVTPLIVLVGT

SEQ ID NO: 313741 - protein, 17 aa, Mycobacterium
ITPRRRNFIFLALVLGI

SEQ ID NO: 313742 - protein, 20 aa, Mycobacterium
ITQVKLPTGQKCVVPTDAEA

SEQ ID NO: 313743 - protein, 19 aa, Mycobacterium
ITRHLPPWGSAARQPMAAL

SEQ ID NO: 313744 - protein, 43 aa, Mycobacterium
ITRPGNSLIEWLRLPGDFVFILGGVLPFVWIAWTAIRNVRRAP

SEQ ID NO: 313745 - protein, 17 aa, Mycobacterium
ITRRTVIALRWAIEERE

SEQ ID NO: 313746 - protein, 20 aa, Mycobacterium
ITRVRWEFSDGSSVKQQVPV

SEQ ID NO: 313747 - protein, 24 aa, Mycobacterium
ITSLWGNSTIKVMVGFLTLYPAFV

SEQ ID NO: 313748 - protein, 25 aa, Mycobacterium
ITSNELVAWLCIAASVVGVVLLILD

SEQ ID NO: 313749 - protein, 18 aa, Mycobacterium
ITSWGVLYYAFPVLAPRI

SEQ ID NO: 313750 - protein, 18 aa, Mycobacterium
ITSWGVLYYAFTVLSASI

SEQ ID NO: 313751 - protein, 25 aa, Mycobacterium
ITTESFNQMWSLRSDDLVHVMMLRK

SEQ ID NO: 313752 - protein, 30 aa, Mycobacterium
ITTHRWRRIGTAIVRWPAPILITTLAVALI

SEQ ID NO: 313753 - protein, 17 aa, Mycobacterium
ITTLWTYTPENMDKLAD

SEQ ID NO: 313754 - protein, 25 aa, Mycobacterium
ITTMRDLRALLLILHSTLSGLVAQL

SEQ ID NO: 313755 - protein, 18 aa, Mycobacterium
ITTQITEVFGQTRLLRWS

SEQ ID NO: 313756 - protein, 26 aa, Mycobacterium
ITTVSACLLVFVTVWFALRDTARAEA

SEQ ID NO: 313757 - protein, 27 aa, Mycobacterium
ITTWRTGGVTRWRWAGLTTAAFLLLVA

SEQ ID NO: 313758 - protein, 18 aa, Mycobacterium
ITVAAWTTVWVLVGLAVH

SEQ ID NO: 313759 - protein, 25 aa, Mycobacterium
ITVAGVYIQRWWPGIPQWVTALVVL

SEQ ID NO: 313760 - protein, 18 aa, Mycobacterium
ITVAVWTTLWVFVGIAVH

SEQ ID NO: 313761 - protein, 22 aa, Mycobacterium
ITVCSLMFASHVTRYHAARKDH

SEQ ID NO: 313762 - protein, 19 aa, Mycobacterium
ITVGEAIAGMYAYQAFAPN

SEQ ID NO: 313763 - protein, 32 aa, Mycobacterium
ITVGEAWKRLRPRFWPLIGFTVLKMLVFLVGL

SEQ ID NO: 313764 - protein, 26 aa, Mycobacterium
ITVITRGYLMWWRRRPTKSGRWPVPP

SEQ ID NO: 313765 - protein, 24 aa, Mycobacterium
ITVKVDWPNFWSLITSSSSQTALL

SEQ ID NO: 313766 - protein, 29 aa, Mycobacterium
ITVPAIAALVGRANWWPSQGGVPSPKPSL

SEQ ID NO: 313767 - protein, 28 aa, Mycobacterium
ITVPAIASLVGRANWWPGQIGTSPSNSR

SEQ ID NO: 313768 - protein, 27 aa, Mycobacterium
ITVPALATLVGRASWWPSRPGTQRSRS

SEQ ID NO: 313769 - protein, 22 aa, Mycobacterium
ITVPFVPVPIPIQVPSREQPQP

SEQ ID NO: 313770 - protein, 29 aa, Mycobacterium
ITVSFPELRNHLGLAYGFYALCAVLSFLF

SEQ ID NO: 313771 - protein, 27 aa, Mycobacterium
ITVTLELPSTGGLYRFSNVTYRGIEVG

SEQ ID NO: 313772 - protein, 17 aa, Mycobacterium
ITYGWSLMLVVVFCVLY

SEQ ID NO: 313773 - protein, 17 aa, Mycobacterium
ITYLYPTKRSWAQGDRA

SEQ ID NO: 313774 - protein, 35 aa, Mycobacterium
IVAADGSVHRAEWALTEAMRVLIADAVSSANFTAP

SEQ ID NO: 313775 - protein, 31 aa, Mycobacterium
IVAAIGDRARPEWEWLKWLPHNQHPAAADEL

SEQ ID NO: 313776 - protein, 17 aa, Mycobacterium
IVAALFIFALWIATLGF

SEQ ID NO: 313777 - protein, 17 aa, Mycobacterium
IVAALFLYALWVGVLGF

SEQ ID NO: 313778 - protein, 28 aa, Mycobacterium
IVAAPARPGYRTALGARLGVPVEAISVA

SEQ ID NO: 313779 - protein, 26 aa, Mycobacterium
IVAAPPRPGFRAALSARLGVAAELIG

SEQ ID NO: 313780 - protein, 18 aa, Mycobacterium
IVAARVAVSVLFFLYGGK

SEQ ID NO: 313781 - protein, 25 aa, Mycobacterium
IVAASALCFLVGFAGLLWAPLTAPI

SEQ ID NO: 313782 - protein, 19 aa, Mycobacterium
IVAFFAMAVVLAVLVRNAV

SEQ ID NO: 313783 - protein, 21 aa, Mycobacterium
IVAFGLALAWLVTIWASAGLS

SEQ ID NO: 313784 - protein, 20 aa, Mycobacterium
IVAGGCWLLSGAGADRAFSV

SEQ ID NO: 313785 - protein, 22 aa, Mycobacterium
IVAGTCTFLSVPRLTHVLASIP

SEQ ID NO: 313786 - protein, 27 aa, Mycobacterium
IVAHWVWGPGGWLARLGVLDYAGGLVV

SEQ ID NO: 313787 - protein, 17 aa, Mycobacterium
IVAIIPLFFLLRHVGLT

SEQ ID NO: 313788 - protein, 25 aa, Mycobacterium
IVAIVACGWLMLNLAVRTWLFALSW

SEQ ID NO: 313789 - protein, 23 aa, Mycobacterium
IVALAWKHPRFDPAKPGRELPAW

SEQ ID NO: 313790 - protein, 30 aa, Mycobacterium
IVALPFVILVSLIFSRQWKLLGAYAAAGLI

SEQ ID NO: 313791 - protein, 20 aa, Mycobacterium
IVALVVGLLRYRRRRISLAA

SEQ ID NO: 313792 - protein, 17 aa, Mycobacterium
IVAPLYLIGSVIISYAS

SEQ ID NO: 313793 - protein, 18 aa, Mycobacterium
IVAPPFRSPESMATVLYA

SEQ ID NO: 313794 - protein, 17 aa, Mycobacterium
IVASFYAFSSWALIEGN

SEQ ID NO: 313795 - protein, 35 aa, Mycobacterium
IVATMPMLLFCIAFGLSMDYEVFLISRIREYWMAS

SEQ ID NO: 313796 - protein, 39 aa, Mycobacterium
IVAVLVWGVGANLGWWKGLAGLWKWATDASHKAAATSGV

SEQ ID NO: 313797 - protein, 17 aa, Mycobacterium
IVAVVVALIVVGVLVAL

SEQ ID NO: 313798 - protein, 18 aa, Mycobacterium
IVCAGSFYQFASYGSLLV

SEQ ID NO: 313799 - protein, 23 aa, Mycobacterium
IVCASILLAQYVRFGEISNTSGY

SEQ ID NO: 313800 - protein, 26 aa, Mycobacterium
IVCSAGYAGWAWLQPGSFRAWVTEPV

SEQ ID NO: 313801 - protein, 27 aa, Mycobacterium
IVCSAGYAGWAWLQPGSFRAWVTEPVR

SEQ ID NO: 313802 - protein, 18 aa, Mycobacterium
IVDAPGCRVRVTLPQFDN

SEQ ID NO: 313803 - protein, 17 aa, Mycobacterium
IVDCGVYVDGVRLPGKY

SEQ ID NO: 313804 - protein, 21 aa, Mycobacterium
IVDGLICYVGYLFPLWDAKRQ

SEQ ID NO: 313805 - protein, 25 aa, Mycobacterium
IVDKRLTPRWIRYERVDLAVGIVVV

SEQ ID NO: 313806 - protein, 18 aa, Mycobacterium
IVDKRLVWIVDGYTTLDN

SEQ ID NO: 313807 - protein, 21 aa, Mycobacterium
IVDPVAALTWDVPEGPLKPPQ

SEQ ID NO: 313808 - protein, 23 aa, Mycobacterium
IVDRLKELIKYKGYQVPPAELEA

SEQ ID NO: 313809 - protein, 20 aa, Mycobacterium
IVDSVPAPPGIKAHVAGTTV

SEQ ID NO: 313810 - protein, 22 aa, Mycobacterium
IVDTPDGLYCKLPQDSPIGVRG

SEQ ID NO: 313811 - protein, 19 aa, Mycobacterium
IVEHMKPPPGVKTYVTGAA

SEQ ID NO: 313812 - protein, 18 aa, Mycobacterium
IVEKGDGVGGVWRENTYP

SEQ ID NO: 313813 - protein, 23 aa, Mycobacterium
IVELHHWVNILGMHSGYKVTRLF

SEQ ID NO: 313814 - protein, 18 aa, Mycobacterium
IVEMGASLDVLFALIVLG

SEQ ID NO: 313815 - protein, 17 aa, Mycobacterium
IVEPWALHRPFIAWLGW

SEQ ID NO: 313816 - protein, 26 aa, Mycobacterium
IVEQWRPMLICAALVLTSQVADFMLT

SEQ ID NO: 313817 - protein, 17 aa, Mycobacterium
IVETGEIMVFVGRDFVV

SEQ ID NO: 313818 - protein, 26 aa, Mycobacterium
IVFDIEIVFLYPWAVSFDALGTFALV

SEQ ID NO: 313819 - protein, 25 aa, Mycobacterium
IVFDIEIVFLYPWAVSYDALGTFAL

SEQ ID NO: 313820 - protein, 23 aa, Mycobacterium
IVFGARLGGYALLIPAATCAAVA

SEQ ID NO: 313821 - protein, 17 aa, Mycobacterium
IVFGFLFAVHGASKLFA

SEQ ID NO: 313822 - protein, 19 aa, Mycobacterium
IVFIYRPLLFASVNAQVAE

SEQ ID NO: 313823 - protein, 17 aa, Mycobacterium
IVFLACRAAIMFAAGAL

SEQ ID NO: 313824 - protein, 22 aa, Mycobacterium
IVGACTLAAVVVAALLAPMAKI

SEQ ID NO: 313825 - protein, 25 aa, Mycobacterium
IVGALGILVMVVWVGTALTISTAAS

SEQ ID NO: 313826 - protein, 18 aa, Mycobacterium
IVGFCLLVLAIGAVLSFG

SEQ ID NO: 313827 - protein, 24 aa, Mycobacterium
IVGFPGPGWRTLRSREDQIVAERL

SEQ ID NO: 313828 - protein, 20 aa, Mycobacterium
IVGGFTCPPSVFGTFGEVAK

SEQ ID NO: 313829 - protein, 18 aa, Mycobacterium
IVGGIAWGGGATLAGYFL

SEQ ID NO: 313830 - protein, 21 aa, Mycobacterium
IVGGIDWDGHGLLGLEDSLDA

SEQ ID NO: 313831 - protein, 23 aa, Mycobacterium
IVGGIDWDGHGLLGLEDSLDAVL

SEQ ID NO: 313832 - protein, 17 aa, Mycobacterium
IVGGILWGGGVTLAGYF

SEQ ID NO: 313833 - protein, 23 aa, Mycobacterium
IVGGLLAGWLHFRMDYAGHTEVA

SEQ ID NO: 313834 - protein, 23 aa, Mycobacterium
IVGIACMLVWGLFRIFVLDDPLR

SEQ ID NO: 313835 - protein, 18 aa, Mycobacterium
IVGICLLESINYLEHYGL

SEQ ID NO: 313836 - protein, 27 aa, Mycobacterium
IVGLCAVGSLGWALRWAVGPWPSLREA

SEQ ID NO: 313837 - protein, 27 aa, Mycobacterium
IVGLMLVALFGWHAWHRADHPLLDLRL

SEQ ID NO: 313838 - protein, 20 aa, Mycobacterium
IVGLPLILVMGVSRSARTAV

SEQ ID NO: 313839 - protein, 24 aa, Mycobacterium
IVGLSIGGLVVFRKAVSQTRLENA

SEQ ID NO: 313840 - protein, 17 aa, Mycobacterium
IVGLSWAAIGFLYLLWL

SEQ ID NO: 313841 - protein, 28 aa, Mycobacterium
IVGLVRFGYRKRSWLSALGLVMTLVVAT

SEQ ID NO: 313842 - protein, 20 aa, Mycobacterium
IVGPPDLLPRAAAHTDEARF

SEQ ID NO: 313843 - protein, 26 aa, Mycobacterium
IVGSIDWEGYGLLGLEDSLDSALAGK

SEQ ID NO: 313844 - protein, 18 aa, Mycobacterium
IVGSLFMRNAWLGGTIVA

SEQ ID NO: 313845 - protein, 26 aa, Mycobacterium
IVGTGIPFLLGLAFGPQLIRPSLAGP

SEQ ID NO: 313846 - protein, 18 aa, Mycobacterium
IVGTRLATRVGFPSMLLF

SEQ ID NO: 313847 - protein, 31 aa, Mycobacterium
IVGTRLATRVGFPSMLLFLLVGVAVGEDGLG

SEQ ID NO: 313848 - protein, 18 aa, Mycobacterium
IVGTWMHWGLFGGDFPGH

SEQ ID NO: 313849 - protein, 19 aa, Mycobacterium
IVGTWWRYRYDKFGWTSRS

SEQ ID NO: 313850 - protein, 25 aa, Mycobacterium
IVGVFIPMMLGRPAVLMSPVAFMMK

SEQ ID NO: 313851 - protein, 36 aa, Mycobacterium
IVGWIIAPLIYRVRMSKYALPALMGLAFTFGLATLI

SEQ ID NO: 313852 - protein, 24 aa, Mycobacterium
IVGYAVGFVCLFILSGVGNGSIYK

SEQ ID NO: 313853 - protein, 17 aa, Mycobacterium
IVHKLPLVLAIIAVVTF

SEQ ID NO: 313854 - protein, 19 aa, Mycobacterium
IVIALPLLWWRYRHTDREA

SEQ ID NO: 313855 - protein, 21 aa, Mycobacterium
IVIALVFWGPYLVAVAHASLE

SEQ ID NO: 313856 - protein, 17 aa, Mycobacterium
IVIDFAVQMNVWRVIGV

SEQ ID NO: 313857 - protein, 17 aa, Mycobacterium
IVIIIMLLFFYRSIFTV

SEQ ID NO: 313858 - protein, 32 aa, Mycobacterium
IVIKKGHLKWAWIPGVPLLWDLIVTLTASWQK

SEQ ID NO: 313859 - protein, 36 aa, Mycobacterium
IVIKKGLLKWAWIPGLPLLWDLAVTLTASWQKVFSA

SEQ ID NO: 313860 - protein, 18 aa, Mycobacterium
IVILCVLVAIAGLGLFVA

SEQ ID NO: 313861 - protein, 24 aa, Mycobacterium
IVIPVAGVLYMLVRLVRRTVAGTW

SEQ ID NO: 313862 - protein, 17 aa, Mycobacterium
IVIYFVVAIIFPKPWSW

SEQ ID NO: 313863 - protein, 25 aa, Mycobacterium
IVKDDGPMPIRRAIEVIADSCQALN

SEQ ID NO: 313864 - protein, 17 aa, Mycobacterium
IVKSINLSKDWARAVID

SEQ ID NO: 313865 - protein, 24 aa, Mycobacterium
IVKSLNLSKDWARAVVDIPVSVSV

SEQ ID NO: 313866 - protein, 19 aa, Mycobacterium
IVKWWRAGGRAHRGADEPA

SEQ ID NO: 313867 - protein, 24 aa, Mycobacterium
IVLACFGVAFPTMIFVVHRRGIVR

SEQ ID NO: 313868 - protein, 18 aa, Mycobacterium
IVLALANLLWFIFAGLGA

SEQ ID NO: 313869 - protein, 19 aa, Mycobacterium
IVLALANLLWFVFAGFGAL

SEQ ID NO: 313870 - protein, 19 aa, Mycobacterium
IVLALANLLWFVFAGLGAL

SEQ ID NO: 313871 - protein, 26 aa, Mycobacterium
IVLALSGTVPWWFVLTLLARDAALAA

SEQ ID NO: 313872 - protein, 19 aa, Mycobacterium
IVLCALIIRQIYRPREDLV

SEQ ID NO: 313873 - protein, 26 aa, Mycobacterium
IVLDMVRRYGADFGFVSYDQAWLDGL

SEQ ID NO: 313874 - protein, 17 aa, Mycobacterium
IVLERLDVFAAIARSFA

SEQ ID NO: 313875 - protein, 17 aa, Mycobacterium
IVLGAAVGTVFTAFHSA

SEQ ID NO: 313876 - protein, 18 aa, Mycobacterium
IVLGLSGIVPWWFIAALL

SEQ ID NO: 313877 - protein, 20 aa, Mycobacterium
IVLGVISKWVVPPISKVLAE

SEQ ID NO: 313878 - protein, 19 aa, Mycobacterium
IVLHPLWGSVIFFAVMFCF

SEQ ID NO: 313879 - protein, 19 aa, Mycobacterium
IVLIARYVLHRLIDRATTG

SEQ ID NO: 313880 - protein, 18 aa, Mycobacterium
IVLILCRLVQGFATGGEY

SEQ ID NO: 313881 - protein, 18 aa, Mycobacterium
IVLITLVLLAVYRSLVTA

SEQ ID NO: 313882 - protein, 17 aa, Mycobacterium
IVLLAVFTAFIAHSPLH

SEQ ID NO: 313883 - protein, 17 aa, Mycobacterium
IVLLGWMVLGVLSVLGV

SEQ ID NO: 313884 - protein, 19 aa, Mycobacterium
IVLLLFLPAILYWESLNTS

SEQ ID NO: 313885 - protein, 20 aa, Mycobacterium
IVLLLFLPAILYWESLNTSF

SEQ ID NO: 313886 - protein, 17 aa, Mycobacterium
IVLLVWVVLAVLNVVGV

SEQ ID NO: 313887 - protein, 24 aa, Mycobacterium
IVLMACAWLTDTIGIYAIFGAFIL

SEQ ID NO: 313888 - protein, 18 aa, Mycobacterium
IVLMAIWFHFWQDDVRDL

SEQ ID NO: 313889 - protein, 31 aa, Mycobacterium
IVLPDGPIDFGWEIIDATSWQTGQLDEAIAA

SEQ ID NO: 313890 - protein, 17 aa, Mycobacterium
IVLPGAVVFAWLGAVPM

SEQ ID NO: 313891 - protein, 33 aa, Mycobacterium
IVLPPLLALCGKRLFWPFIPKVGATALTESGVW

SEQ ID NO: 313892 - protein, 17 aa, Mycobacterium
IVLPQAMRSVMPNAANE

SEQ ID NO: 313893 - protein, 23 aa, Mycobacterium
IVLRGLLLVAFPKFFASLANDMI

SEQ ID NO: 313894 - protein, 20 aa, Mycobacterium
IVLRHYWKEFLRHLSDIAWG

SEQ ID NO: 313895 - protein, 21 aa, Mycobacterium
IVLSCGALINGVKEFPGPWAL

SEQ ID NO: 313896 - protein, 20 aa, Mycobacterium
IVLSCIVYGMAFDFFNVSGS

SEQ ID NO: 313897 - protein, 21 aa, Mycobacterium
IVLSCVAAVYAGRGVLRAITS

SEQ ID NO: 313898 - protein, 29 aa, Mycobacterium
IVLSSFWGWRGPYGTHPINGFVIAMCLAI

SEQ ID NO: 313899 - protein, 20 aa, Mycobacterium
IVLWGSAGALGFVENDLGFK

SEQ ID NO: 313900 - protein, 22 aa, Mycobacterium
IVLWMLAAYPAFAGIRTAVGSS

SEQ ID NO: 313901 - protein, 17 aa, Mycobacterium
IVLYVLGAWLFALSTSG

SEQ ID NO: 313902 - protein, 18 aa, Mycobacterium
IVMPPLVWSLGPDDAQAI

SEQ ID NO: 313903 - protein, 21 aa, Mycobacterium
IVMRVVDVMFAFPVLLLALAI

SEQ ID NO: 313904 - protein, 17 aa, Mycobacterium
IVMSLGAAFGFSTLIWQ

SEQ ID NO: 313905 - protein, 18 aa, Mycobacterium
IVNKRMVWILDGYTTLDN

SEQ ID NO: 313906 - protein, 18 aa, Mycobacterium
IVNRLFLAVELVFVVLFI

SEQ ID NO: 313907 - protein, 17 aa, Mycobacterium
IVPIAVWVCGVYSAVRG

SEQ ID NO: 313908 - protein, 25 aa, Mycobacterium
IVPICAGIFGVVFGFISLNQIKRTG

SEQ ID NO: 313909 - protein, 19 aa, Mycobacterium
IVPLPWVIQAPRLFAGQIE

SEQ ID NO: 313910 - protein, 17 aa, Mycobacterium
IVPPIVYFVTYRWCIGL

SEQ ID NO: 313911 - protein, 27 aa, Mycobacterium
IVPSLVRLFGTWFWWPTRVFARPLRRQ

SEQ ID NO: 313912 - protein, 18 aa, Mycobacterium
IVPVSSLLRSHAVTSNDK

SEQ ID NO: 313913 - protein, 17 aa, Mycobacterium
IVQGRDLLGEFVSRQAS

SEQ ID NO: 313914 - protein, 24 aa, Mycobacterium
IVQGYQRFNWQVTIVSTVIIIALV

SEQ ID NO: 313915 - protein, 33 aa, Mycobacterium
IVQPFGEYLPMPWLFRHLSGYADRAGHFVPRPG

SEQ ID NO: 313916 - protein, 28 aa, Mycobacterium
IVQVVIRLAVCWLLSRHGLAAGIGDVGI

SEQ ID NO: 313917 - protein, 19 aa, Mycobacterium
IVQYLRYLGGVLHGDLGRA

SEQ ID NO: 313918 - protein, 29 aa, Mycobacterium
IVRLADRYAAWFLPLSLLLASAAWLASGS

SEQ ID NO: 313919 - protein, 22 aa, Mycobacterium
IVRLRHWGRWVGAAVIVAALVL

SEQ ID NO: 313920 - protein, 19 aa, Mycobacterium
IVRPIPFVVLIAALGPITL

SEQ ID NO: 313921 - protein, 26 aa, Mycobacterium
IVRRAPVIVIGLWIGLAAVLALTAPS

SEQ ID NO: 313922 - protein, 23 aa, Mycobacterium
IVRRSNALLDWAYGRQLRYSESM

SEQ ID NO: 313923 - protein, 33 aa, Mycobacterium
IVRSLVVPCLLRLLGPWFWWPTFIRQRPLRQAV

SEQ ID NO: 313924 - protein, 33 aa, Mycobacterium
IVRSLVVPCLLRLLGPWFWWPTFIRQRPLRTPD

SEQ ID NO: 313925 - protein, 22 aa, Mycobacterium
IVSALHRPVPLSGDGSDTDTVI

SEQ ID NO: 313926 - protein, 19 aa, Mycobacterium
IVSDLRVVGQLGMTIGIGL

SEQ ID NO: 313927 - protein, 23 aa, Mycobacterium
IVSEGDIAPPTRVVLRRQRNVQV

SEQ ID NO: 313928 - protein, 17 aa, Mycobacterium
IVSFFVVHNIIGISTFA

SEQ ID NO: 313929 - protein, 17 aa, Mycobacterium
IVSFWLLGFDTAGSPAW

SEQ ID NO: 313930 - protein, 19 aa, Mycobacterium
IVSGVAALVRAKFPQLSAY

SEQ ID NO: 313931 - protein, 20 aa, Mycobacterium
IVSGVAALVRAKFPQLSAYQ

SEQ ID NO: 313932 - protein, 23 aa, Mycobacterium
IVSGVPAALCWSTGPPGDPLSGE

SEQ ID NO: 313933 - protein, 19 aa, Mycobacterium
IVSHLAFDHEIRWIEVVHG

SEQ ID NO: 313934 - protein, 27 aa, Mycobacterium
IVSMLFKLEIARGFLVIALPVGVVVLV

SEQ ID NO: 313935 - protein, 18 aa, Mycobacterium
IVSPAWYSPLVLTVGSIA

SEQ ID NO: 313936 - protein, 26 aa, Mycobacterium
IVSVGRRGEFRYSFDQLRSRGVQVHL

SEQ ID NO: 313937 - protein, 18 aa, Mycobacterium
IVSVRINVLLTYYVNDLF

SEQ ID NO: 313938 - protein, 24 aa, Mycobacterium
IVTAGSLVVHWGTMHDLFAITDTV

SEQ ID NO: 313939 - protein, 17 aa, Mycobacterium
IVTEIFPVFSRKPVFGY

SEQ ID NO: 313940 - protein, 18 aa, Mycobacterium
IVTGALLVFFTLIFLLHG

SEQ ID NO: 313941 - protein, 18 aa, Mycobacterium
IVTGTGWPSQPGLSPVGQ

SEQ ID NO: 313942 - protein, 23 aa, Mycobacterium
IVTICLIVVMLLLVYRAPSTLLV

SEQ ID NO: 313943 - protein, 22 aa, Mycobacterium
IVTIPFGIGMIFYGNIAGGAFV

SEQ ID NO: 313944 - protein, 22 aa, Mycobacterium
IVTIPFGIGMIFYGNIAGGVFV

SEQ ID NO: 313945 - protein, 18 aa, Mycobacterium
IVTLSAWRGIRYTQRRHA

SEQ ID NO: 313946 - protein, 17 aa, Mycobacterium
IVTQWGPAVPFLIAAGG

SEQ ID NO: 313947 - protein, 21 aa, Mycobacterium
IVTSMSRWVRASAWLSQLYPL

SEQ ID NO: 313948 - protein, 22 aa, Mycobacterium
IVTYRSPILWLVPLLVIAFADR

SEQ ID NO: 313949 - protein, 20 aa, Mycobacterium
IVVACGLVLTAIFLLLYRTL

SEQ ID NO: 313950 - protein, 22 aa, Mycobacterium
IVVANALRLLGMPMQSINPAAP

SEQ ID NO: 313951 - protein, 18 aa, Mycobacterium
IVVAVPLGVIAAHKQYSI

SEQ ID NO: 313952 - protein, 26 aa, Mycobacterium
IVVFLCAVLFTIVWWNIDHDRTNWLP

SEQ ID NO: 313953 - protein, 22 aa, Mycobacterium
IVVFYGVVLFWGLPDNNAPTHP

SEQ ID NO: 313954 - protein, 20 aa, Mycobacterium
IVVGVLLILWGAYRWLKRAS

SEQ ID NO: 313955 - protein, 17 aa, Mycobacterium
IVVLALIYQWARVVWSR

SEQ ID NO: 313956 - protein, 18 aa, Mycobacterium
IVVLIAGTVVWFGITDAW

SEQ ID NO: 313957 - protein, 18 aa, Mycobacterium
IVVPTSLAPMMTMAVIIT

SEQ ID NO: 313958 - protein, 19 aa, Mycobacterium
IVVQLLLPFVAGQVLRPKL

SEQ ID NO: 313959 - protein, 20 aa, Mycobacterium
IVVSCYVALVVTNFAWLFPI

SEQ ID NO: 313960 - protein, 20 aa, Mycobacterium
IVVSPAWIFRRGVLAWNGQI

SEQ ID NO: 313961 - protein, 22 aa, Mycobacterium
IVVTCAHCFNALGNEYPQVGGD

SEQ ID NO: 313962 - protein, 20 aa, Mycobacterium
IVVTCPHCFNTIGKEYRQLG

SEQ ID NO: 313963 - protein, 20 aa, Mycobacterium
IVVTCPHCFNTIGREYPQLG

SEQ ID NO: 313964 - protein, 21 aa, Mycobacterium
IVVTCPHCFNTLGREYRQLGA

SEQ ID NO: 313965 - protein, 17 aa, Mycobacterium
IVVTRYLTVPAEDAEPR

SEQ ID NO: 313966 - protein, 17 aa, Mycobacterium
IVVTRYLTVPAEDATPR

SEQ ID NO: 313967 - protein, 25 aa, Mycobacterium
IVVVIAGAVVWFGITSAWKERLDRR

SEQ ID NO: 313968 - protein, 17 aa, Mycobacterium
IVVVLGFAITSLGLAAV

SEQ ID NO: 313969 - protein, 20 aa, Mycobacterium
IVVWVQFRGGFTPKITLTAL

SEQ ID NO: 313970 - protein, 20 aa, Mycobacterium
IVWFHFWQDRVRDLMGVPRL

SEQ ID NO: 313971 - protein, 19 aa, Mycobacterium
IVWTSCVITALGLVILLLF

SEQ ID NO: 313972 - protein, 36 aa, Mycobacterium
IVYAALKLVDVRSFRALARFRRSEVVLAALTAIAVT

SEQ ID NO: 313973 - protein, 26 aa, Mycobacterium
IVYGLGFWKGVLAIVVGNAVLFGYVG

SEQ ID NO: 313974 - protein, 18 aa, Mycobacterium
IVYLSMIILLVFWHTFLM

SEQ ID NO: 313975 - protein, 22 aa, Mycobacterium
IWAEEAWGRYWGWDPKETVSFI

SEQ ID NO: 313976 - protein, 23 aa, Mycobacterium
IWAEEAWGRYWGWDPKETVSFVA

SEQ ID NO: 313977 - protein, 18 aa, Mycobacterium
IWAGANIAPINWILGALG

SEQ ID NO: 313978 - protein, 20 aa, Mycobacterium
IWEGGLGIWGAVAFGAVGAW

SEQ ID NO: 313979 - protein, 39 aa, Mycobacterium
IWGAVALGAVGAWIACRRRGIPLPAFGDAIAPGIVLAQA

SEQ ID NO: 313980 - protein, 24 aa, Mycobacterium
IWGAVALGCVGAWIACRRHGIPLP

SEQ ID NO: 313981 - protein, 29 aa, Mycobacterium
IWGAVALGGVGAWIGCRRHGIPLPAFADA

SEQ ID NO: 313982 - protein, 25 aa, Mycobacterium
IWGVSFPRAMFWTVLGYVLVATVIS

SEQ ID NO: 313983 - protein, 19 aa, Mycobacterium
IWHRSGINIVKRPGAHLAV

SEQ ID NO: 313984 - protein, 17 aa, Mycobacterium
IWHVMAVAFAMGCAAAI

SEQ ID NO: 313985 - protein, 23 aa, Mycobacterium
IWLAHSMPTWAAVLVSTAISLVA

SEQ ID NO: 313986 - protein, 27 aa, Mycobacterium
IWLDRLRTLARRTCVVTLPYAQADLDA

SEQ ID NO: 313987 - protein, 21 aa, Mycobacterium
IWLLHYGNRGWFFPLSIRQVP

SEQ ID NO: 313988 - protein, 26 aa, Mycobacterium
IWLNRLRALAHRTCVAPLPYAQADLD

SEQ ID NO: 313989 - protein, 18 aa, Mycobacterium
IWLSVIVLLPLAAILWQA

SEQ ID NO: 313990 - protein, 23 aa, Mycobacterium
IWLYGDNVGKGYWGRPHETEVSF

SEQ ID NO: 313991 - protein, 28 aa, Mycobacterium
IWQHILHMPLHWLVLPMAIIVMLAVGSD

SEQ ID NO: 313992 - protein, 24 aa, Mycobacterium
IWQHLGDFQLHWVATEFALIVLLA

SEQ ID NO: 313993 - protein, 22 aa, Mycobacterium
IWQHSKHIFVFDMAMLIFLSAA

SEQ ID NO: 313994 - protein, 22 aa, Mycobacterium
IWQHSKHIFVFDMAMLTLLSIA

SEQ ID NO: 313995 - protein, 23 aa, Mycobacterium
IWQYIFGIELYWMVLPMSVIVLL

SEQ ID NO: 313996 - protein, 24 aa, Mycobacterium
IWQYILGIELHWLVMQMAIIVLLA

SEQ ID NO: 313997 - protein, 22 aa, Mycobacterium
IWQYILGINLYWMVLPMSVIVL

SEQ ID NO: 313998 - protein, 28 aa, Mycobacterium
IWRLAAFMVVCTLGLAAMLAIFAQLRFG

SEQ ID NO: 313999 - protein, 30 aa, Mycobacterium
IWRLAIFMVVCTLGLIAMLAIFADLRFGDE

SEQ ID NO: 314000 - protein, 27 aa, Mycobacterium
IWRRASDWWLLLGLFVLFPMTFFGANF

SEQ ID NO: 314001 - protein, 24 aa, Mycobacterium
IWSRISVSVFAAVEFIGRPRGERR

SEQ ID NO: 314002 - protein, 24 aa, Mycobacterium
IWVARLVPIPGIAIRLLAAGLFAG

SEQ ID NO: 314003 - protein, 20 aa, Mycobacterium
IWVGIISVFLGIAMWEVTKR

SEQ ID NO: 314004 - protein, 21 aa, Mycobacterium
IWVSAFLLFPGFTPPMSPRMP

SEQ ID NO: 314005 - protein, 20 aa, Mycobacterium
IWWLAGAGWAIAAALVVLVV

SEQ ID NO: 314006 - protein, 27 aa, Mycobacterium
IYADRRFGLGHGRLFALYVAAYCVGRF

SEQ ID NO: 314007 - protein, 39 aa, Mycobacterium
IYADRRFTLGHGRLFALYVAGYCVGRFCVELLRDDTATH

SEQ ID NO: 314008 - protein, 25 aa, Mycobacterium
IYALACVLFECLTGAPPYRADSAGM

SEQ ID NO: 314009 - protein, 24 aa, Mycobacterium
IYALACVLFECLTGSPPYRSDSAG

SEQ ID NO: 314010 - protein, 18 aa, Mycobacterium
IYALACVLYECLTGQLPF

SEQ ID NO: 314011 - protein, 22 aa, Mycobacterium
IYASQLTPWWLRILGAKIGKDT

SEQ ID NO: 314012 - protein, 24 aa, Mycobacterium
IYDHPRLGSLAGYLDELSPPPEIT

SEQ ID NO: 314013 - protein, 17 aa, Mycobacterium
IYDIALWAVPFGLAGGR

SEQ ID NO: 314014 - protein, 18 aa, Mycobacterium
IYDNGGARIYEWSGKTAQ

SEQ ID NO: 314015 - protein, 23 aa, Mycobacterium
IYDRIPVVAGLVLGLGIAGVGLV

SEQ ID NO: 314016 - protein, 18 aa, Mycobacterium
IYGLAASVLPVWLLLAPR

SEQ ID NO: 314017 - protein, 19 aa, Mycobacterium
IYGLMTWLTLWRVVNERQD

SEQ ID NO: 314018 - protein, 25 aa, Mycobacterium
IYGYHWIHRVQNWLTWLFLATFGVF

SEQ ID NO: 314019 - protein, 17 aa, Mycobacterium
IYIWSLLMALALNKVWR

SEQ ID NO: 314020 - protein, 18 aa, Mycobacterium
IYLLVHWVAPGGMGAGDV

SEQ ID NO: 314021 - protein, 21 aa, Mycobacterium
IYLSNFNRPYALWVPIVLLVP

SEQ ID NO: 314022 - protein, 24 aa, Mycobacterium
IYPLPARASALGWSNGTSFVGSFT

SEQ ID NO: 314023 - protein, 25 aa, Mycobacterium
IYPTWPQMMPWTALWLATLGAAILL

SEQ ID NO: 314024 - protein, 17 aa, Mycobacterium
IYQEVQANFRAGQANSI

SEQ ID NO: 314025 - protein, 20 aa, Mycobacterium
IYRIAKRMRGGEVDEAALER

SEQ ID NO: 314026 - protein, 19 aa, Mycobacterium
IYTWLGVNFSQRFGLTLVG

SEQ ID NO: 314027 - protein, 18 aa, Mycobacterium
IYVASLFGYWWVSSSYPA

SEQ ID NO: 314028 - protein, 25 aa, Mycobacterium
IYYGLPMWLILLLRVVFLLLAVGSL

SEQ ID NO: 314029 - protein, 18 aa, Mycobacterium
IYYPRYLILTAPAAAVIL

SEQ ID NO: 314030 - protein, 17 aa, Mycobacterium
IYYPRYLILTAPGAAVI

SEQ ID NO: 314031 - protein, 26 aa, Mycobacterium
IYYPVSAIMWVWYKAFSFLLGPTNFF

SEQ ID NO: 314032 - protein, 26 aa, Mycobacterium
IYYSPRIFAAMGFTGDFALLGLPALV

SEQ ID NO: 314033 - protein, 26 aa, Mycobacterium
IYYSPRIFAAMGFTGNFALLALPALV

SEQ ID NO: 314034 - protein, 24 aa, Mycobacterium
IYYSPRIFEAMGFTGDFALLGLPA

SEQ ID NO: 314035 - protein, 24 aa, Mycobacterium
IYYSPRIFEAMGFTGNFALLGLPA

SEQ ID NO: 314036 - protein, 20 aa, Mycobacterium
KAAAAWRAAYADPMIASIQP

SEQ ID NO: 314037 - protein, 18 aa, Mycobacterium
KAAAIGAAVGALLWVAPL

SEQ ID NO: 314038 - protein, 18 aa, Mycobacterium
KAAARRVRASNLDDNIDT

SEQ ID NO: 314039 - protein, 21 aa, Mycobacterium
KAALALDGMAIVPGLGAIGRG

SEQ ID NO: 314040 - protein, 17 aa, Mycobacterium
KAALAMTAASWAILGVI

SEQ ID NO: 314041 - protein, 25 aa, Mycobacterium
KAARDTRDSLAIWSNILPITFAALG

SEQ ID NO: 314042 - protein, 20 aa, Mycobacterium
KAAYVAGWMYFFNWAATAIV

SEQ ID NO: 314043 - protein, 35 aa, Mycobacterium
KADSGIWRKVGTVTVRWPGRILVVSSVVVMIGSIT

SEQ ID NO: 314044 - protein, 21 aa, Mycobacterium
KADSWGRKPIFLLGFGVLAAR

SEQ ID NO: 314045 - protein, 20 aa, Mycobacterium
KADTKTGMYWAPDSADYEDA

SEQ ID NO: 314046 - protein, 20 aa, Mycobacterium
KADVKPVWQALRHTDTWVLS

SEQ ID NO: 314047 - protein, 17 aa, Mycobacterium
KADVLLDCFRPGTCERL

SEQ ID NO: 314048 - protein, 36 aa, Mycobacterium
KAEFLYHHFRSLRRWRPRYAYAFGFIDQAARLASAM

SEQ ID NO: 314049 - protein, 23 aa, Mycobacterium
KAEGAWWGWHGAGWFLFTLMVLT

SEQ ID NO: 314050 - protein, 21 aa, Mycobacterium
KAFAYWLDRYELLSNDRSAKP

SEQ ID NO: 314051 - protein, 19 aa, Mycobacterium
KAFFDDVTARLSVVDCPGN

SEQ ID NO: 314052 - protein, 21 aa, Mycobacterium
KAFGWWGGPGFDGFGTSLDDM

SEQ ID NO: 314053 - protein, 21 aa, Mycobacterium
KAGAAGPFLGSIPFPDVDVAR

SEQ ID NO: 314054 - protein, 18 aa, Mycobacterium
KAGDRRRSAIFLGPTAEQ

SEQ ID NO: 314055 - protein, 18 aa, Mycobacterium
KAGDRYLLCSDGLSDPVS

SEQ ID NO: 314056 - protein, 36 aa, Mycobacterium
KAGKPPRKRVFEWGWEVLAALAIAAVFAIAAAQVQL

SEQ ID NO: 314057 - protein, 18 aa, Mycobacterium
KAGSSWLGSPPVRLRRRP

SEQ ID NO: 314058 - protein, 19 aa, Mycobacterium
KAHGARPGALIGQSLGEAA

SEQ ID NO: 314059 - protein, 22 aa, Mycobacterium
KAHGVKSWTALLTMAILLLVYL

SEQ ID NO: 314060 - protein, 32 aa, Mycobacterium
KAHPVIGPWLDRLQAFNVFSSFWFTAIYVLLF

SEQ ID NO: 314061 - protein, 20 aa, Mycobacterium
KAHQVCPVGAVVATKTDLYP

SEQ ID NO: 314062 - protein, 22 aa, Mycobacterium
KAIGKIPMKVGALWDSITGSER

SEQ ID NO: 314063 - protein, 18 aa, Mycobacterium
KAIGRPGILTAINAGKLA

SEQ ID NO: 314064 - protein, 26 aa, Mycobacterium
KAIIYCAAATLIHCYYGYFASGGPVG

SEQ ID NO: 314065 - protein, 18 aa, Mycobacterium
KAILRDVLIRELHPDMDR

SEQ ID NO: 314066 - protein, 18 aa, Mycobacterium
KAIPQWSIALIALVIVLT

SEQ ID NO: 314067 - protein, 21 aa, Mycobacterium
KAIRTVRFWAAPLIITLALMS

SEQ ID NO: 314068 - protein, 18 aa, Mycobacterium
KAISFFLGTAFLVGAPLP

SEQ ID NO: 314069 - protein, 25 aa, Mycobacterium
KAITFARSRIRGIRLTEPIPLRWAK

SEQ ID NO: 314070 - protein, 20 aa, Mycobacterium
KAKAIEFVKKPAVTVSLAGV

SEQ ID NO: 314071 - protein, 17 aa, Mycobacterium
KAKRSRATAALIAVAIV

SEQ ID NO: 314072 - protein, 20 aa, Mycobacterium
KAKSYAGIVAVIAVLGALLA

SEQ ID NO: 314073 - protein, 20 aa, Mycobacterium
KAKVIEFVTKPAVTVTLVGV

SEQ ID NO: 314074 - protein, 19 aa, Mycobacterium
KALAAREGYALEHCYAYSD

SEQ ID NO: 314075 - protein, 18 aa, Mycobacterium
KALAQAFSVRKQLDDAIP

SEQ ID NO: 314076 - protein, 19 aa, Mycobacterium
KALARLEAKPAGKAQKMVS

SEQ ID NO: 314077 - protein, 25 aa, Mycobacterium
KALDARVGFMVGWAVLLDYLFLPLV

SEQ ID NO: 314078 - protein, 22 aa, Mycobacterium
KALEGRPALVLDRVASHEGQVK

SEQ ID NO: 314079 - protein, 23 aa, Mycobacterium
KALEGRSALVLDRVAHHEGQVKL

SEQ ID NO: 314080 - protein, 18 aa, Mycobacterium
KALFDRFAPKGPDGKPSI

SEQ ID NO: 314081 - protein, 18 aa, Mycobacterium
KALFLGFMFAFAIKAPLW

SEQ ID NO: 314082 - protein, 20 aa, Mycobacterium
KALFRLRSLVFAHAQRLDLD

SEQ ID NO: 314083 - protein, 20 aa, Mycobacterium
KALGGWAGFSVAWLYWYFWV

SEQ ID NO: 314084 - protein, 17 aa, Mycobacterium
KALGLAIVNFAIALSAA

SEQ ID NO: 314085 - protein, 25 aa, Mycobacterium
KALPASAVVGLWTFDGHEGRSEVAS

SEQ ID NO: 314086 - protein, 25 aa, Mycobacterium
KALPPTSVVGLWTFDGHEGRSEVPG

SEQ ID NO: 314087 - protein, 18 aa, Mycobacterium
KALPVTSEVGLWTFDGTE

SEQ ID NO: 314088 - protein, 20 aa, Mycobacterium
KALRPRQWVKNVLVLAAPVA

SEQ ID NO: 314089 - protein, 17 aa, Mycobacterium
KALTGLRIVAALWVVLF

SEQ ID NO: 314090 - protein, 21 aa, Mycobacterium
KAMVPHEWYAHGSCSGVTPAV

SEQ ID NO: 314091 - protein, 17 aa, Mycobacterium
KANEILIQIARAEPATG

SEQ ID NO: 314092 - protein, 21 aa, Mycobacterium
KANFLQVFLTWLIFNVLISVG

SEQ ID NO: 314093 - protein, 20 aa, Mycobacterium
KAPPAFAARMVLGAFYGAVF

SEQ ID NO: 314094 - protein, 19 aa, Mycobacterium
KAPPLKLFDVRSAQQAYRY

SEQ ID NO: 314095 - protein, 27 aa, Mycobacterium
KAPPVAWRILVVLGLIGTVLMIVWFHF

SEQ ID NO: 314096 - protein, 18 aa, Mycobacterium
KAPTLALIVPGVIGFALS

SEQ ID NO: 314097 - protein, 17 aa, Mycobacterium
KAPVLALIVPGIVGFLL

SEQ ID NO: 314098 - protein, 24 aa, Mycobacterium
KAQSRRWRLSSALRAYLDLGAMDI

SEQ ID NO: 314099 - protein, 19 aa, Mycobacterium
KARELSHALGVRRAAVITA

SEQ ID NO: 314100 - protein, 21 aa, Mycobacterium
KARGWIHFYACVIAIVTGIVL

SEQ ID NO: 314101 - protein, 33 aa, Mycobacterium
KARHPWPDYRPPRAGQWVPIYGLTSILLGGLPL

SEQ ID NO: 314102 - protein, 25 aa, Mycobacterium
KARSPRTAGVLSYLLTRPSRLERTG

SEQ ID NO: 314103 - protein, 19 aa, Mycobacterium
KARVGDIKKITGFLDTQIA

SEQ ID NO: 314104 - protein, 18 aa, Mycobacterium
KASAWLFDMAMLAVLSIA

SEQ ID NO: 314105 - protein, 19 aa, Mycobacterium
KASAWLFDMAMLGVVSIAY

SEQ ID NO: 314106 - protein, 21 aa, Mycobacterium
KASAWVGALVLGWWIAVLVYL

SEQ ID NO: 314107 - protein, 20 aa, Mycobacterium
KASEVDWVLDRLARQIDDLR

SEQ ID NO: 314108 - protein, 20 aa, Mycobacterium
KASPLGLLVVVVLVIATLFL

SEQ ID NO: 314109 - protein, 18 aa, Mycobacterium
KASPWVLNVSSAWTSSPQ

SEQ ID NO: 314110 - protein, 23 aa, Mycobacterium
KASVGSWRLVRDFADEMRSDLSD

SEQ ID NO: 314111 - protein, 25 aa, Mycobacterium
KATASFGVAPLMLWQQLTKHYTNIS

SEQ ID NO: 314112 - protein, 24 aa, Mycobacterium
KATGRLDPYVRVVAALINVGDGLP

SEQ ID NO: 314113 - protein, 23 aa, Mycobacterium
KATQRDGRWRPLAQVPLRQRQSV

SEQ ID NO: 314114 - protein, 26 aa, Mycobacterium
KATYYCIVVVPAAMVGMSGWQRGKKY

SEQ ID NO: 314115 - protein, 20 aa, Mycobacterium
KAVAELLALAGTKFLVLGAD

SEQ ID NO: 314116 - protein, 22 aa, Mycobacterium
KAVEPITVCLNGDTRDSYSGAD

SEQ ID NO: 314117 - protein, 23 aa, Mycobacterium
KAVFARNPLKWIYLTIAVLAVAS

SEQ ID NO: 314118 - protein, 18 aa, Mycobacterium
KAVGRVGVVLGVVAVAAD

SEQ ID NO: 314119 - protein, 19 aa, Mycobacterium
KAVLPVAAVFLIWDEIAIA

SEQ ID NO: 314120 - protein, 19 aa, Mycobacterium
KAVLVGALLLMGVATAVIG

SEQ ID NO: 314121 - protein, 18 aa, Mycobacterium
KAVMMIIAGLIFAALAGL

SEQ ID NO: 314122 - protein, 28 aa, Mycobacterium
KAVSPKVWGRRGAPLLLVFSVAARLAWT

SEQ ID NO: 314123 - protein, 22 aa, Mycobacterium
KAWTDERWRAHLAVAVGVVVIA

SEQ ID NO: 314124 - protein, 20 aa, Mycobacterium
KAWYVPVGVAGTLGDLKAAE

SEQ ID NO: 314125 - protein, 19 aa, Mycobacterium
KAYLLAKMAVFFVFAIVQS

SEQ ID NO: 314126 - protein, 26 aa, Mycobacterium
KAYQEFRVDDMLAWTTLFIVAMVLIE

SEQ ID NO: 314127 - protein, 20 aa, Mycobacterium
KAYVAGLILTVFSMRVAAAI

SEQ ID NO: 314128 - protein, 18 aa, Mycobacterium
KCNGATLHVSERGYPGSI

SEQ ID NO: 314129 - protein, 27 aa, Mycobacterium
KDAPRNWRLSVDLRRDGDQIKMAKVEF

SEQ ID NO: 314130 - protein, 22 aa, Mycobacterium
KDARNLPGLAIIGVSLVVFVSS

SEQ ID NO: 314131 - protein, 25 aa, Mycobacterium
KDAWMVGFTPSLSTAVWVGTDDGKP

SEQ ID NO: 314132 - protein, 20 aa, Mycobacterium
KDCLRRAECEAKDLDLVVNA

SEQ ID NO: 314133 - protein, 19 aa, Mycobacterium
KDDDGLLCMSSTSAGSHFD

SEQ ID NO: 314134 - protein, 24 aa, Mycobacterium
KDDLAWRDFCLRVADRVILVAGQP

SEQ ID NO: 314135 - protein, 21 aa, Mycobacterium
KDELNSILLLAIWIGVGWIAQ

SEQ ID NO: 314136 - protein, 33 aa, Mycobacterium
KDEPKPRRRPILLAGRSLAALFAVLALVLTGGA

SEQ ID NO: 314137 - protein, 21 aa, Mycobacterium
KDGQLTLDWDDVVQRSVTVVR

SEQ ID NO: 314138 - protein, 24 aa, Mycobacterium
KDHLELGEALGLIDMERGAKVSGS

SEQ ID NO: 314139 - protein, 17 aa, Mycobacterium
KDIGLHVVIARRTSGAS

SEQ ID NO: 314140 - protein, 29 aa, Mycobacterium
KDIIARFNARTGYHLALRAGINTGNVISG

SEQ ID NO: 314141 - protein, 17 aa, Mycobacterium
KDIIAYVRASSETPDPG

SEQ ID NO: 314142 - protein, 25 aa, Mycobacterium
KDKALRRKGTRLGVRTLAIGSGAVL

SEQ ID NO: 314143 - protein, 17 aa, Mycobacterium
KDLGLKIIFGLPGIVLA

SEQ ID NO: 314144 - protein, 21 aa, Mycobacterium
KDLLSGFFILAERQYGFGDLV

SEQ ID NO: 314145 - protein, 20 aa, Mycobacterium
KDLYARLQILPMSFHGRWQS

SEQ ID NO: 314146 - protein, 22 aa, Mycobacterium
KDMRDGSRWDLLIAGVAAVSLI

SEQ ID NO: 314147 - protein, 23 aa, Mycobacterium
KDNKAWNLPVMFKTSQDDPATQS

SEQ ID NO: 314148 - protein, 25 aa, Mycobacterium
KDPYRAVPRAIMWSAAGVGVLYVFA

SEQ ID NO: 314149 - protein, 20 aa, Mycobacterium
KDQERVAAERVIFARMTPEN

SEQ ID NO: 314150 - protein, 18 aa, Mycobacterium
KDQLKEKRLPVIVHTGRE

SEQ ID NO: 314151 - protein, 24 aa, Mycobacterium
KDRLAADVHLVWWMVAVVGFNSLL

SEQ ID NO: 314152 - protein, 25 aa, Mycobacterium
KDSRIAEPVLRELYAALLADGAPFL

SEQ ID NO: 314153 - protein, 19 aa, Mycobacterium
KDTHSRVAEAGRYPVVASI

SEQ ID NO: 314154 - protein, 24 aa, Mycobacterium
KDTRGIIRVHQFDKVEGFVYCRPE

SEQ ID NO: 314155 - protein, 18 aa, Mycobacterium
KDVAGRDAFPASFVVKLD

SEQ ID NO: 314156 - protein, 21 aa, Mycobacterium
KDVVSGLLWPAVAVAAFAACG

SEQ ID NO: 314157 - protein, 24 aa, Mycobacterium
KEALRTAWRPILQIAGLVVIHNVG

SEQ ID NO: 314158 - protein, 26 aa, Mycobacterium
KEAQLWPLVFGRAAAVVVVLIAAVAT

SEQ ID NO: 314159 - protein, 25 aa, Mycobacterium
KEEGLPFWIIFSCAVAIGLGTYLGG

SEQ ID NO: 314160 - protein, 23 aa, Mycobacterium
KEEPREWRLKVTVTEEDGQYKMS

SEQ ID NO: 314161 - protein, 27 aa, Mycobacterium
KEFDTALSMSPDFPGLVDLRTSAVNLR

SEQ ID NO: 314162 - protein, 24 aa, Mycobacterium
KEFTRGRVAAFSIADERSERLVIV

SEQ ID NO: 314163 - protein, 20 aa, Mycobacterium
KEGKAAWSRAMSGALIGFAG

SEQ ID NO: 314164 - protein, 21 aa, Mycobacterium
KEICNLMGLRQLGCSTGTLQD

SEQ ID NO: 314165 - protein, 25 aa, Mycobacterium
KEIVISTKMSQSWSKDQVMEAYLNI

SEQ ID NO: 314166 - protein, 17 aa, Mycobacterium
KELDALLLAAIGLSNSG

SEQ ID NO: 314167 - protein, 17 aa, Mycobacterium
KELGVRTPGKLDWAGTL

SEQ ID NO: 314168 - protein, 19 aa, Mycobacterium
KELVISTKMSGEWSKDAVL

SEQ ID NO: 314169 - protein, 18 aa, Mycobacterium
KELVISTKMSSEWSKDQV

SEQ ID NO: 314170 - protein, 24 aa, Mycobacterium
KENARKFAFRKRVLMGLVGAMVVA

SEQ ID NO: 314171 - protein, 20 aa, Mycobacterium
KENFVSFLLLSLAVAIVAGV

SEQ ID NO: 314172 - protein, 26 aa, Mycobacterium
KEPGRLKRFAARARKRSSGKIVPAVL

SEQ ID NO: 314173 - protein, 20 aa, Mycobacterium
KEPLLIWTLIASLFIGNFLL

SEQ ID NO: 314174 - protein, 20 aa, Mycobacterium
KEPYVPLGTNPWYGDPNQIL

SEQ ID NO: 314175 - protein, 22 aa, Mycobacterium
KEQAIYRREHGIGMSGGAYLAS

SEQ ID NO: 314176 - protein, 19 aa, Mycobacterium
KERDSWLLSLLYVGTFGSF

SEQ ID NO: 314177 - protein, 19 aa, Mycobacterium
KEREFHLALVGALMVAALA

SEQ ID NO: 314178 - protein, 28 aa, Mycobacterium
KERLDRRLDEAAGFAIPFLPRGLDDIPR

SEQ ID NO: 314179 - protein, 17 aa, Mycobacterium
KERPRVIAVDAVPTEVA

SEQ ID NO: 314180 - protein, 18 aa, Mycobacterium
KERSEGWIGKLLAVAGVA

SEQ ID NO: 314181 - protein, 25 aa, Mycobacterium
KESMARGWPVLTFSRPVSLGDRIPV

SEQ ID NO: 314182 - protein, 21 aa, Mycobacterium
KETFPKPGPIGGYAGVPTYVP

SEQ ID NO: 314183 - protein, 24 aa, Mycobacterium
KETLPRPGGLITLAGDQCDGDPRV

SEQ ID NO: 314184 - protein, 22 aa, Mycobacterium
KEWGHRLRAFVVKKDGADLDED

SEQ ID NO: 314185 - protein, 22 aa, Mycobacterium
KEWGHRLRAFVVKKDGSDVDED

SEQ ID NO: 314186 - protein, 26 aa, Mycobacterium
KEYFTGTGIKGRFLAWFYTVVGQVPI

SEQ ID NO: 314187 - protein, 18 aa, Mycobacterium
KFAAWMVFVPVWAVVVYS

SEQ ID NO: 314188 - protein, 17 aa, Mycobacterium
KFAAWMVFVPVWTIAVY

SEQ ID NO: 314189 - protein, 21 aa, Mycobacterium
KFAWLFMRFSGVVLVFLALGH

SEQ ID NO: 314190 - protein, 24 aa, Mycobacterium
KFDDGYEAYREWVLARMIDKGIMP

SEQ ID NO: 314191 - protein, 18 aa, Mycobacterium
KFDPEWVKADGKTCRFNP

SEQ ID NO: 314192 - protein, 19 aa, Mycobacterium
KFFPWPITLDNYRGIFSGN

SEQ ID NO: 314193 - protein, 20 aa, Mycobacterium
KFFTWTGWASPAAWLNTAHQ

SEQ ID NO: 314194 - protein, 30 aa, Mycobacterium
KFGHMFTGMAIRIADVWKITRKVGVQESYG

SEQ ID NO: 314195 - protein, 19 aa, Mycobacterium
KFHRGDMEMVLLVNSDSGV

SEQ ID NO: 314196 - protein, 20 aa, Mycobacterium
KFKRVMKMFLSPDGHAARFI

SEQ ID NO: 314197 - protein, 18 aa, Mycobacterium
KFPNLTAHQVIHRLEATA

SEQ ID NO: 314198 - protein, 24 aa, Mycobacterium
KFREISPLLWVVALGFVLYFARGW

SEQ ID NO: 314199 - protein, 17 aa, Mycobacterium
KFRGARVPISIGDGDRA

SEQ ID NO: 314200 - protein, 17 aa, Mycobacterium
KFSGGAISWDRADNTFT

SEQ ID NO: 314201 - protein, 17 aa, Mycobacterium
KFVPIFRNINKLSRNWF

SEQ ID NO: 314202 - protein, 20 aa, Mycobacterium
KFVRRTIIFNGWNWSVSQAI

SEQ ID NO: 314203 - protein, 27 aa, Mycobacterium
KFYLPPRLVSLYGTEIWDEMTREQQIE

SEQ ID NO: 314204 - protein, 20 aa, Mycobacterium
KFYLPPRLVSLYGTPMWDEM

SEQ ID NO: 314205 - protein, 19 aa, Mycobacterium
KGAASSVAEWVRGQGGKVP

SEQ ID NO: 314206 - protein, 20 aa, Mycobacterium
KGAAWAAVIGLLIVVLVALT

SEQ ID NO: 314207 - protein, 21 aa, Mycobacterium
KGAAWSAVIGLVAVVLIATTI

SEQ ID NO: 314208 - protein, 25 aa, Mycobacterium
KGACPMLDLPLKVFVQRNYTECEHW

SEQ ID NO: 314209 - protein, 25 aa, Mycobacterium
KGALALRLLTIAFFALVYLLPLILW

SEQ ID NO: 314210 - protein, 17 aa, Mycobacterium
KGARSDRGFHMNLDGVL

SEQ ID NO: 314211 - protein, 20 aa, Mycobacterium
KGARTDRGFCMSLDGVLEGK

SEQ ID NO: 314212 - protein, 25 aa, Mycobacterium
KGASQRLADRIARPLVPGIMIAGAA

SEQ ID NO: 314213 - protein, 25 aa, Mycobacterium
KGASQRLADRIARPLVPGIMVTGAL

SEQ ID NO: 314214 - protein, 18 aa, Mycobacterium
KGATFDCDVSIDGAPKHV

SEQ ID NO: 314215 - protein, 21 aa, Mycobacterium
KGCPLFLVVLGSVLALMHFYV

SEQ ID NO: 314216 - protein, 28 aa, Mycobacterium
KGEAGADIFRHFPQVVAVISNMAEKRSL

SEQ ID NO: 314217 - protein, 21 aa, Mycobacterium
KGEATFDGFEKLNHTVEIISN

SEQ ID NO: 314218 - protein, 20 aa, Mycobacterium
KGEPAVQVGKNWSVLAEIPE

SEQ ID NO: 314219 - protein, 22 aa, Mycobacterium
KGEPSLPVVPWVISARSAEALT

SEQ ID NO: 314220 - protein, 20 aa, Mycobacterium
KGFESLRRFQAIAAPIVVGT

SEQ ID NO: 314221 - protein, 26 aa, Mycobacterium
KGGNGCFLKFRVDDVPSGARFYRVHV

SEQ ID NO: 314222 - protein, 17 aa, Mycobacterium
KGGSFSDLAGWPNVHII

SEQ ID NO: 314223 - protein, 27 aa, Mycobacterium
KGGSPTWVIRRHVLKNAAGPALTVTAT

SEQ ID NO: 314224 - protein, 17 aa, Mycobacterium
KGGSTGLGLAIVAAVVK

SEQ ID NO: 314225 - protein, 17 aa, Mycobacterium
KGGSTGLGLAIVSAVVK

SEQ ID NO: 314226 - protein, 25 aa, Mycobacterium
KGHPHVFVIGDLMSVPGVPGMAQGA

SEQ ID NO: 314227 - protein, 17 aa, Mycobacterium
KGIGFLINNARDFLRID

SEQ ID NO: 314228 - protein, 17 aa, Mycobacterium
KGIWQALLGSDAIYFEV

SEQ ID NO: 314229 - protein, 19 aa, Mycobacterium
KGKLGALLDESFKAFNGAG

SEQ ID NO: 314230 - protein, 20 aa, Mycobacterium
KGLFYGGGWAQLERQAVGAF

SEQ ID NO: 314231 - protein, 24 aa, Mycobacterium
KGLGERWGLGAAFVALVTYTAIQV

SEQ ID NO: 314232 - protein, 17 aa, Mycobacterium
KGLGIAGGAKRPGAKKA

SEQ ID NO: 314233 - protein, 19 aa, Mycobacterium
KGLLFFLAVMPQFVNPAAP

SEQ ID NO: 314234 - protein, 17 aa, Mycobacterium
KGLPDAVGGGFVADGKR

SEQ ID NO: 314235 - protein, 19 aa, Mycobacterium
KGLRFGRVRVKIGPPMDFS

SEQ ID NO: 314236 - protein, 23 aa, Mycobacterium
KGLSRPRVVTVHILRNSLIPVVT

SEQ ID NO: 314237 - protein, 19 aa, Mycobacterium
KGLVLLAAVGFDVYNKRKG

SEQ ID NO: 314238 - protein, 23 aa, Mycobacterium
KGNPDVLWWALALGTDFGGNLTA

SEQ ID NO: 314239 - protein, 18 aa, Mycobacterium
KGNPRGIHDWPDLIKENV

SEQ ID NO: 314240 - protein, 22 aa, Mycobacterium
KGPSRWGAHLQLHVSAGIGTSP

SEQ ID NO: 314241 - protein, 28 aa, Mycobacterium
KGQLTFETPMLWAFGFLVTFLLGGLSGV

SEQ ID NO: 314242 - protein, 18 aa, Mycobacterium
KGQWEAAETIGLNYVGTL

SEQ ID NO: 314243 - protein, 18 aa, Mycobacterium
KGQWEAAETIGLTYGKSL

SEQ ID NO: 314244 - protein, 17 aa, Mycobacterium
KGRGRALHAVWSTSDAP

SEQ ID NO: 314245 - protein, 19 aa, Mycobacterium
KGRLARRAGVQNVLVGWSE

SEQ ID NO: 314246 - protein, 22 aa, Mycobacterium
KGRNPLGWGLLGLFFSILTLIV

SEQ ID NO: 314247 - protein, 23 aa, Mycobacterium
KGRPSLSARLVFARNTIRPPHLI

SEQ ID NO: 314248 - protein, 21 aa, Mycobacterium
KGSALSWFSPLAWAQQMRPFV

SEQ ID NO: 314249 - protein, 23 aa, Mycobacterium
KGSARTAVDIALYAAFLGMVLVA

SEQ ID NO: 314250 - protein, 25 aa, Mycobacterium
KGSPEVLASALLRDGDSLTGQVNDM

SEQ ID NO: 314251 - protein, 24 aa, Mycobacterium
KGTFPRLKSALIVEGAGAVVGGAT

SEQ ID NO: 314252 - protein, 19 aa, Mycobacterium
KGTPMAGAQIYLGGTAATY

SEQ ID NO: 314253 - protein, 20 aa, Mycobacterium
KGVALPSFITSSADFYRVDT

SEQ ID NO: 314254 - protein, 18 aa, Mycobacterium
KGVFFGRMLPFFRSFISV

SEQ ID NO: 314255 - protein, 18 aa, Mycobacterium
KGVGKVVGITRPDGNKLT

SEQ ID NO: 314256 - protein, 18 aa, Mycobacterium
KGVHLGRLVELVRPLPQA

SEQ ID NO: 314257 - protein, 24 aa, Mycobacterium
KGVSERRIAVWSADSEDQRLLEET

SEQ ID NO: 314258 - protein, 31 aa, Mycobacterium
KGYLYRRIGASVVRWPVPILVASSAVVMLGA

SEQ ID NO: 314259 - protein, 21 aa, Mycobacterium
KHCISMADLRTAATKSTPATL

SEQ ID NO: 314260 - protein, 19 aa, Mycobacterium
KHCNGVPMCWSLRSIFDAL

SEQ ID NO: 314261 - protein, 21 aa, Mycobacterium
KHETLRMIAEMGLGAGALAVI

SEQ ID NO: 314262 - protein, 26 aa, Mycobacterium
KHEVWTRLIAMIAFSAVAGVTIAALL

SEQ ID NO: 314263 - protein, 31 aa, Mycobacterium
KHGRPFRRRNPRPAIVVVILLAIATAAAWTV

SEQ ID NO: 314264 - protein, 31 aa, Mycobacterium
KHGRPFRRRNPRPAIVVVVLLVVVTAVVWTI

SEQ ID NO: 314265 - protein, 18 aa, Mycobacterium
KHHYHCHHHHGMFHPGGP

SEQ ID NO: 314266 - protein, 24 aa, Mycobacterium
KHIQARRGVTVFGEEPATKACAEC

SEQ ID NO: 314267 - protein, 23 aa, Mycobacterium
KHKVTAMVVVPVMLSRILDAIEK

SEQ ID NO: 314268 - protein, 23 aa, Mycobacterium
KHKVTAMVVVPVMLSRLLDAVEK

SEQ ID NO: 314269 - protein, 33 aa, Mycobacterium
KHPAAARWLRVLAIPVVLFWVIAAAVLNIFVPS

SEQ ID NO: 314270 - protein, 20 aa, Mycobacterium
KHRGELVYLPPAWFASDPPP

SEQ ID NO: 314271 - protein, 20 aa, Mycobacterium
KHRGELVYLPPAWFASYPPP

SEQ ID NO: 314272 - protein, 20 aa, Mycobacterium
KHRMGHRIRLFWAEHSVHHS

SEQ ID NO: 314273 - protein, 20 aa, Mycobacterium
KHRQALASVISWIIVVLVVV

SEQ ID NO: 314274 - protein, 20 aa, Mycobacterium
KHRQALASVISWVSVVIIGI

SEQ ID NO: 314275 - protein, 17 aa, Mycobacterium
KHSPRSSAAVLLDITGS

SEQ ID NO: 314276 - protein, 19 aa, Mycobacterium
KHVVYEVFGPPGTIANINY

SEQ ID NO: 314277 - protein, 21 aa, Mycobacterium
KHVVYEVFGPPGTVANINYLD

SEQ ID NO: 314278 - protein, 20 aa, Mycobacterium
KHYPGRLIFVLFNLLIALVL

SEQ ID NO: 314279 - protein, 18 aa, Mycobacterium
KIAGAIFRVPGIERVQSI

SEQ ID NO: 314280 - protein, 21 aa, Mycobacterium
KIAIAPLFIVWLGFGPSPKIL

SEQ ID NO: 314281 - protein, 18 aa, Mycobacterium
KIDAARVVGATRWQIITK

SEQ ID NO: 314282 - protein, 19 aa, Mycobacterium
KIDACIAIALYPDHCDHPQ

SEQ ID NO: 314283 - protein, 24 aa, Mycobacterium
KIDGDHIRLKFSIGTNTIGTESRL

SEQ ID NO: 314284 - protein, 18 aa, Mycobacterium
KIEGVMALPLPISKINDI

SEQ ID NO: 314285 - protein, 22 aa, Mycobacterium
KIEQRYSVAMVVATLALIVIPL

SEQ ID NO: 314286 - protein, 20 aa, Mycobacterium
KIFGEAEFWFSMIKVTAILG

SEQ ID NO: 314287 - protein, 17 aa, Mycobacterium
KIFGWHGMGEWVVQGIA

SEQ ID NO: 314288 - protein, 18 aa, Mycobacterium
KIGVRLPLLQGVTFATLA

SEQ ID NO: 314289 - protein, 17 aa, Mycobacterium
KIIPIAIVTSVVGVGLF

SEQ ID NO: 314290 - protein, 17 aa, Mycobacterium
KIIQFWIDVPLWLTALI

SEQ ID NO: 314291 - protein, 24 aa, Mycobacterium
KIKPMTGGIRFWARPGTIRLRPWK

SEQ ID NO: 314292 - protein, 17 aa, Mycobacterium
KILAFSLLCGIVGPIFI

SEQ ID NO: 314293 - protein, 18 aa, Mycobacterium
KILLPILLGVVLGGPAAA

SEQ ID NO: 314294 - protein, 18 aa, Mycobacterium
KILRPGRAAGELPPGAVT

SEQ ID NO: 314295 - protein, 25 aa, Mycobacterium
KILRRFSIDELPQFINVLKGDMSVV

SEQ ID NO: 314296 - protein, 17 aa, Mycobacterium
KIMLQNIGLSLAIITIL

SEQ ID NO: 314297 - protein, 24 aa, Mycobacterium
KIPAGSRVWLCLGAINRDGSDATS

SEQ ID NO: 314298 - protein, 17 aa, Mycobacterium
KIPELFGPLGAGIGGQV

SEQ ID NO: 314299 - protein, 17 aa, Mycobacterium
KIPRIIRTFAVPIILVW

SEQ ID NO: 314300 - protein, 27 aa, Mycobacterium
KIQAFVLLCGIVGPIFLVIYFATGADP

SEQ ID NO: 314301 - protein, 17 aa, Mycobacterium
KIQLAIFTVISLSAASL

SEQ ID NO: 314302 - protein, 20 aa, Mycobacterium
KIQPPRPVAVPRPMNAPAPV

SEQ ID NO: 314303 - protein, 33 aa, Mycobacterium
KIQRTISGWVYLHGAWPWLFILGLVAVGAAIWW

SEQ ID NO: 314304 - protein, 20 aa, Mycobacterium
KIRTPFEYFDKGSMATVSRF

SEQ ID NO: 314305 - protein, 18 aa, Mycobacterium
KISLYAFIAMIFGAGILV

SEQ ID NO: 314306 - protein, 17 aa, Mycobacterium
KISMVGYPVMLRDTRDF

SEQ ID NO: 314307 - protein, 20 aa, Mycobacterium
KISRSACAKRYLSAGFEQLE

SEQ ID NO: 314308 - protein, 20 aa, Mycobacterium
KITLPNMKAAIMVALLFRTL

SEQ ID NO: 314309 - protein, 19 aa, Mycobacterium
KITYGWSLLLIVAFTVLLF

SEQ ID NO: 314310 - protein, 17 aa, Mycobacterium
KIVGKLAQFGSGMLQQV

SEQ ID NO: 314311 - protein, 25 aa, Mycobacterium
KIVYPGFPAHDLYLFRLYSFTTQAI

SEQ ID NO: 314312 - protein, 18 aa, Mycobacterium
KIWGNEAAIVYFLGGVGA

SEQ ID NO: 314313 - protein, 18 aa, Mycobacterium
KIWIRFPGFSIQPAEFSK

SEQ ID NO: 314314 - protein, 19 aa, Mycobacterium
KIYDNGGARIYEWRGQSST

SEQ ID NO: 314315 - protein, 21 aa, Mycobacterium
KKAASALAWLVEEMEQRYQDM

SEQ ID NO: 314316 - protein, 19 aa, Mycobacterium
KKAFVWIGLHEPDEFQMQS

SEQ ID NO: 314317 - protein, 26 aa, Mycobacterium
KKDPRKYRLIVTITRDGDQLKMSKVE

SEQ ID NO: 314318 - protein, 17 aa, Mycobacterium
KKFGNTMGYELDIHSDM

SEQ ID NO: 314319 - protein, 18 aa, Mycobacterium
KKFLRYNANKALMNLGYE

SEQ ID NO: 314320 - protein, 17 aa, Mycobacterium
KKFPEFKDVAGKDSFPA

SEQ ID NO: 314321 - protein, 17 aa, Mycobacterium
KKFPEFKDVAGKESFPA

SEQ ID NO: 314322 - protein, 30 aa, Mycobacterium
KKFSISALARRFWIPLLIGAVVFVGAFTVM

SEQ ID NO: 314323 - protein, 19 aa, Mycobacterium
KKGTRSLIVGDWRMIGKCL

SEQ ID NO: 314324 - protein, 18 aa, Mycobacterium
KKHEELRAALATLVPAPP

SEQ ID NO: 314325 - protein, 24 aa, Mycobacterium
KKIARLSLPNGWFRGDDQLVVHIE

SEQ ID NO: 314326 - protein, 20 aa, Mycobacterium
KKKLSSWLPPGPVAVADYPA

SEQ ID NO: 314327 - protein, 20 aa, Mycobacterium
KKLLIMTVVGIVVALLVGGA

SEQ ID NO: 314328 - protein, 19 aa, Mycobacterium
KKLRARVGVEGDKPGQTAD

SEQ ID NO: 314329 - protein, 23 aa, Mycobacterium
KKLRSDETFVYLARAVDPTISDA

SEQ ID NO: 314330 - protein, 26 aa, Mycobacterium
KKMGFGMGEASAFLLSMKNEATTPAM

SEQ ID NO: 314331 - protein, 17 aa, Mycobacterium
KKPIRPVAPEAYALYGL

SEQ ID NO: 314332 - protein, 20 aa, Mycobacterium
KKPKTRRLRRKKGAEADEAE

SEQ ID NO: 314333 - protein, 27 aa, Mycobacterium
KKRRFGRDPVSVLLIFIIVFALIIAGL

SEQ ID NO: 314334 - protein, 21 aa, Mycobacterium
KKSRKNWIIGAAVVAVLLVVA

SEQ ID NO: 314335 - protein, 19 aa, Mycobacterium
KKSRSSRVYTFDADMTLPG

SEQ ID NO: 314336 - protein, 25 aa, Mycobacterium
KKTKRRWGKIVALSLLTAVLLAGAG

SEQ ID NO: 314337 - protein, 25 aa, Mycobacterium
KKTYGVGAKPYWRPPYAKRNAAVDA

SEQ ID NO: 314338 - protein, 19 aa, Mycobacterium
KKVATEWHQLVGAKTVEEI

SEQ ID NO: 314339 - protein, 19 aa, Mycobacterium
KKVKNLRYWILGWLLLAGI

SEQ ID NO: 314340 - protein, 17 aa, Mycobacterium
KKWAIISAIGGVVVAVA

SEQ ID NO: 314341 - protein, 17 aa, Mycobacterium
KKYGPAVAGAFLLAALL

SEQ ID NO: 314342 - protein, 33 aa, Mycobacterium
KLAAAAKLRVTWEMSFLYAIVFGGFVAFANYLP

SEQ ID NO: 314343 - protein, 17 aa, Mycobacterium
KLADPIKYSSLYEDDAD

SEQ ID NO: 314344 - protein, 27 aa, Mycobacterium
KLADWGIRGHMGFLFGLLNQLLLLGIA

SEQ ID NO: 314345 - protein, 19 aa, Mycobacterium
KLAFPGFAVTIVLLVLVLI

SEQ ID NO: 314346 - protein, 23 aa, Mycobacterium
KLAGLTPGRLVPVARFGQLAVWI

SEQ ID NO: 314347 - protein, 22 aa, Mycobacterium
KLAGPWAPVAYILAGVFAGIMA

SEQ ID NO: 314348 - protein, 17 aa, Mycobacterium
KLAGWSITGTIIDKGTR

SEQ ID NO: 314349 - protein, 17 aa, Mycobacterium
KLAGWSITGTILDKTSR

SEQ ID NO: 314350 - protein, 17 aa, Mycobacterium
KLAKGIFRVPGISRVQA

SEQ ID NO: 314351 - protein, 27 aa, Mycobacterium
KLAPTLTRLNSVIAMLEKNRDNLSQAL

SEQ ID NO: 314352 - protein, 19 aa, Mycobacterium
KLASPRAVLTAAIVSLAVG

SEQ ID NO: 314353 - protein, 23 aa, Mycobacterium
KLATYGFQHVVAFYAGAVLVPIL

SEQ ID NO: 314354 - protein, 24 aa, Mycobacterium
KLCGGQWRPARLLVGLGGLALVTP

SEQ ID NO: 314355 - protein, 31 aa, Mycobacterium
KLDDLSERVGWRWRLVWYRAVSELLTGAYDA

SEQ ID NO: 314356 - protein, 19 aa, Mycobacterium
KLDELISAIPAAREEAIDI

SEQ ID NO: 314357 - protein, 19 aa, Mycobacterium
KLDIARGYLAVALPVGTLG

SEQ ID NO: 314358 - protein, 18 aa, Mycobacterium
KLDKLGCRASHTAELRFN

SEQ ID NO: 314359 - protein, 25 aa, Mycobacterium
KLDNGDALVGFTIDGKYALGSDTTA

SEQ ID NO: 314360 - protein, 17 aa, Mycobacterium
KLDPRRRTADQADPAVQ

SEQ ID NO: 314361 - protein, 28 aa, Mycobacterium
KLDVVPARLRRPGAVVLDIDDEDPIFEH

SEQ ID NO: 314362 - protein, 27 aa, Mycobacterium
KLEPVIRLPLALGLVHLLGRIPLPGSA

SEQ ID NO: 314363 - protein, 18 aa, Mycobacterium
KLFDVRSAQQAYRYVSQA

SEQ ID NO: 314364 - protein, 21 aa, Mycobacterium
KLFGELEFWAALIKVIALVIF

SEQ ID NO: 314365 - protein, 20 aa, Mycobacterium
KLFLIGGLALTFGLQNAIAR

SEQ ID NO: 314366 - protein, 20 aa, Mycobacterium
KLGAFALVLLMFTAIIIVVF

SEQ ID NO: 314367 - protein, 23 aa, Mycobacterium
KLGDLPAVDGFANLRGLGVEGDV

SEQ ID NO: 314368 - protein, 20 aa, Mycobacterium
KLGGRQSAILVGAWSASGSV

SEQ ID NO: 314369 - protein, 20 aa, Mycobacterium
KLGLLPLYRRLFGANTLSYF

SEQ ID NO: 314370 - protein, 18 aa, Mycobacterium
KLGNFAISGISTVLLLAV

SEQ ID NO: 314371 - protein, 27 aa, Mycobacterium
KLGPVIRLPLVLGIAELLGRIPLPGSA

SEQ ID NO: 314372 - protein, 24 aa, Mycobacterium
KLGRLSVVEAIVWTTVGSVVGAWI

SEQ ID NO: 314373 - protein, 27 aa, Mycobacterium
KLGWNAATPVLWWVGPLLLYVLLPILD

SEQ ID NO: 314374 - protein, 24 aa, Mycobacterium
KLIMIGCLTVIFTVVLLLLRGLVA

SEQ ID NO: 314375 - protein, 28 aa, Mycobacterium
KLIRTLAVPIILVWVALIAVLNTIVPQL

SEQ ID NO: 314376 - protein, 34 aa, Mycobacterium
KLLGDDCWWAPAWMKRIQVKLGLGEVTLPDERKR

SEQ ID NO: 314377 - protein, 29 aa, Mycobacterium
KLLGDDCWWAPRWMKRIQEKLGLGETELP

SEQ ID NO: 314378 - protein, 29 aa, Mycobacterium
KLLGDDCWWAPRWMKRVQEKLGLGETELP

SEQ ID NO: 314379 - protein, 18 aa, Mycobacterium
KLLLARLSTRKALPLYIA

SEQ ID NO: 314380 - protein, 18 aa, Mycobacterium
KLLLARLSTRKALPLYIG

SEQ ID NO: 314381 - protein, 18 aa, Mycobacterium
KLLRPEMAADHSFQERFR

SEQ ID NO: 314382 - protein, 18 aa, Mycobacterium
KLLRRTGPAAGHRSDPDF

SEQ ID NO: 314383 - protein, 26 aa, Mycobacterium
KLLRTPRPYLYAGILFFATLGAFAVN

SEQ ID NO: 314384 - protein, 25 aa, Mycobacterium
KLLSAFKVPTVWLLLHSGDDVPRGG

SEQ ID NO: 314385 - protein, 25 aa, Mycobacterium
KLLSELRAEFDYVIVDSTPLLAVTD

SEQ ID NO: 314386 - protein, 20 aa, Mycobacterium
KLLVPLALLFLLGMVIRDVL

SEQ ID NO: 314387 - protein, 30 aa, Mycobacterium
KLLVVFGISVLLTFYPGWVTIGLMAALVLT

SEQ ID NO: 314388 - protein, 19 aa, Mycobacterium
KLLWFGLAMIIVFGVVHAL

SEQ ID NO: 314389 - protein, 17 aa, Mycobacterium
KLMATSLALNWLVGPAV

SEQ ID NO: 314390 - protein, 19 aa, Mycobacterium
KLMCALVLLVLCASVVTRI

SEQ ID NO: 314391 - protein, 20 aa, Mycobacterium
KLPGRQSAILFGAWGVTGGI

SEQ ID NO: 314392 - protein, 21 aa, Mycobacterium
KLPTQRPDLRQESGGDPPGSA

SEQ ID NO: 314393 - protein, 19 aa, Mycobacterium
KLPTVLGLTAAVIFVVLFA

SEQ ID NO: 314394 - protein, 19 aa, Mycobacterium
KLQAAGFKGTFTQSETKSL

SEQ ID NO: 314395 - protein, 25 aa, Mycobacterium
KLQFGEGWWTSVYFLAFWITGTSLL

SEQ ID NO: 314396 - protein, 25 aa, Mycobacterium
KLQFGRRSVDLFRVPLRTTRALTKL

SEQ ID NO: 314397 - protein, 20 aa, Mycobacterium
KLQGLASVTFVFTRLLAEGV

SEQ ID NO: 314398 - protein, 24 aa, Mycobacterium
KLQLWVAACLYRYFVDQHEFLHGP

SEQ ID NO: 314399 - protein, 33 aa, Mycobacterium
KLRAAAKLPVTWEMSFLYAVVFGGFVAFSNYLP

SEQ ID NO: 314400 - protein, 19 aa, Mycobacterium
KLRAARPSFRTAQASATYR

SEQ ID NO: 314401 - protein, 17 aa, Mycobacterium
KLRDFAIARGLRIFPGL

SEQ ID NO: 314402 - protein, 24 aa, Mycobacterium
KLRIPLSVGDIVKRVFLGKPLITE

SEQ ID NO: 314403 - protein, 21 aa, Mycobacterium
KLRVKMWLFPALSILTVAGII

SEQ ID NO: 314404 - protein, 20 aa, Mycobacterium
KLRVKMWLFPVLSGLTALGI

SEQ ID NO: 314405 - protein, 24 aa, Mycobacterium
KLSDLMPDQVRWIVLQLCVVVALF

SEQ ID NO: 314406 - protein, 17 aa, Mycobacterium
KLSDLRPDLARLDALFA

SEQ ID NO: 314407 - protein, 25 aa, Mycobacterium
KLSEPVALVGMGCRYPGGADSPESL

SEQ ID NO: 314408 - protein, 25 aa, Mycobacterium
KLSFPASAVPPNWTVFSDDQDPNLI

SEQ ID NO: 314409 - protein, 19 aa, Mycobacterium
KLSLDWVIFGNNWLNGWPG

SEQ ID NO: 314410 - protein, 19 aa, Mycobacterium
KLSRLDVPGIARVLDVAHS

SEQ ID NO: 314411 - protein, 24 aa, Mycobacterium
KLSTLDRFLPVWIGAAMAAGLLLG

SEQ ID NO: 314412 - protein, 24 aa, Mycobacterium
KLSTLDRFLPVWIGVAMAAGLLLG

SEQ ID NO: 314413 - protein, 24 aa, Mycobacterium
KLSTLDRLLPVWIGVAMAAGLLLG

SEQ ID NO: 314414 - protein, 27 aa, Mycobacterium
KLSTNMSRRLWQAWVSPGIDYVEACPG

SEQ ID NO: 314415 - protein, 25 aa, Mycobacterium
KLTGGRTAQAWARRHRHLRAALTPL

SEQ ID NO: 314416 - protein, 25 aa, Mycobacterium
KLTGNRTAQAWARRHRELRAALTPL

SEQ ID NO: 314417 - protein, 24 aa, Mycobacterium
KLTKRQRFWISLYLPLTMRSLANA

SEQ ID NO: 314418 - protein, 19 aa, Mycobacterium
KLTLAQWMTVLAMALGFAV

SEQ ID NO: 314419 - protein, 26 aa, Mycobacterium
KLTNGRTAQAWARRHRQLRAALTPLV

SEQ ID NO: 314420 - protein, 20 aa, Mycobacterium
KLTPATRWGPMLQWILVAAA

SEQ ID NO: 314421 - protein, 19 aa, Mycobacterium
KLTPAVFLLYFLLRRDIHT

SEQ ID NO: 314422 - protein, 19 aa, Mycobacterium
KLTPAVFLLYFLLRRDNRA

SEQ ID NO: 314423 - protein, 27 aa, Mycobacterium
KLTSNISRHDWREWISPDVDYIALCPN

SEQ ID NO: 314424 - protein, 27 aa, Mycobacterium
KLVARIPEWILKALFVFVLLATAAKLL

SEQ ID NO: 314425 - protein, 18 aa, Mycobacterium
KLVLGVIVLGSFIASIDL

SEQ ID NO: 314426 - protein, 24 aa, Mycobacterium
KLYRLRLSYFDGHQRGELLSRVTN

SEQ ID NO: 314427 - protein, 19 aa, Mycobacterium
KMAIGGGVGGLLIAVVVML

SEQ ID NO: 314428 - protein, 19 aa, Mycobacterium
KMCRGVLAGAMLLVLAFVL

SEQ ID NO: 314429 - protein, 20 aa, Mycobacterium
KMLQGFQQWFEKMGFNPATS

SEQ ID NO: 314430 - protein, 28 aa, Mycobacterium
KMLTGWDCPGCGGLRMTHDLLHGDVAAA

SEQ ID NO: 314431 - protein, 17 aa, Mycobacterium
KMNLPWMFFFTGLAIPA

SEQ ID NO: 314432 - protein, 22 aa, Mycobacterium
KMPGQLWVLGGFLLGAVGVEGL

SEQ ID NO: 314433 - protein, 20 aa, Mycobacterium
KMRQNLGWAVGYNVIALPIA

SEQ ID NO: 314434 - protein, 18 aa, Mycobacterium
KMTAARRAASRIVDALTS

SEQ ID NO: 314435 - protein, 18 aa, Mycobacterium
KMTVAITVRDVSLKKTAD

SEQ ID NO: 314436 - protein, 17 aa, Mycobacterium
KMVEDMRDMIPLMESMQ

SEQ ID NO: 314437 - protein, 17 aa, Mycobacterium
KNIPRGILMAMLVLVIT

SEQ ID NO: 314438 - protein, 24 aa, Mycobacterium
KNIPSLRYLSYRLTMNRDGGEWRI

SEQ ID NO: 314439 - protein, 23 aa, Mycobacterium
KNLGYTCVIYLAALQGVRRDLLE

SEQ ID NO: 314440 - protein, 21 aa, Mycobacterium
KNLREAMCYQWPGYGSGRTLD

SEQ ID NO: 314441 - protein, 18 aa, Mycobacterium
KNPGKFKIEVIFNDSKKV

SEQ ID NO: 314442 - protein, 23 aa, Mycobacterium
KNRRATILASVPWFLQDLGLYGI

SEQ ID NO: 314443 - protein, 17 aa, Mycobacterium
KNTSYRIGLKVASPSAS

SEQ ID NO: 314444 - protein, 28 aa, Mycobacterium
KPAGRKRRKWLAGKRMAVTVAVAAALFV

SEQ ID NO: 314445 - protein, 32 aa, Mycobacterium
KPAHSMFWYRSTRFVLRHAVAVGSSVVVLLLL

SEQ ID NO: 314446 - protein, 25 aa, Mycobacterium
KPAIPLSLGDIVKRVFLGKPLITEN

SEQ ID NO: 314447 - protein, 17 aa, Mycobacterium
KPALEKLNLVLDNLLER

SEQ ID NO: 314448 - protein, 24 aa, Mycobacterium
KPAPPRDMVPVWVAAGGLLGALLI

SEQ ID NO: 314449 - protein, 24 aa, Mycobacterium
KPAPRPAAPTTRWLARLRRPTLVL

SEQ ID NO: 314450 - protein, 23 aa, Mycobacterium
KPASSSKPIWPLVAIGVIVVVVL

SEQ ID NO: 314451 - protein, 20 aa, Mycobacterium
KPAWYVVAIVGMFALTAIGS

SEQ ID NO: 314452 - protein, 25 aa, Mycobacterium
KPDGKEVLPSWGVPVLIAALIAAVA

SEQ ID NO: 314453 - protein, 25 aa, Mycobacterium
KPDLEGADQLLLRWRQANDRISSYI

SEQ ID NO: 314454 - protein, 25 aa, Mycobacterium
KPDLEGADQLLLRWRQANDRITSYI

SEQ ID NO: 314455 - protein, 22 aa, Mycobacterium
KPDPSQLSFIFIGNEMNPNGGI

SEQ ID NO: 314456 - protein, 18 aa, Mycobacterium
KPDSVWTGATAMYNCGQN

SEQ ID NO: 314457 - protein, 19 aa, Mycobacterium
KPEREILIRVVPAADALST

SEQ ID NO: 314458 - protein, 21 aa, Mycobacterium
KPFASRFLVQWPELADRIPRT

SEQ ID NO: 314459 - protein, 20 aa, Mycobacterium
KPFFAQGLLNRRAVLKSSYA

SEQ ID NO: 314460 - protein, 20 aa, Mycobacterium
KPFFSQGLINRRAVLKSTYA

SEQ ID NO: 314461 - protein, 24 aa, Mycobacterium
KPFTAGWGCTAFTVNPDGWLATAG

SEQ ID NO: 314462 - protein, 18 aa, Mycobacterium
KPGDVMPSTYLGIWETFN

SEQ ID NO: 314463 - protein, 21 aa, Mycobacterium
KPGEHKWPFAQTAFTSALPWM

SEQ ID NO: 314464 - protein, 18 aa, Mycobacterium
KPGETVRIAGVRVGTVNS

SEQ ID NO: 314465 - protein, 17 aa, Mycobacterium
KPGGWGLSVPSLSGSPF

SEQ ID NO: 314466 - protein, 19 aa, Mycobacterium
KPGLLPWLAGSAVVVIGLG

SEQ ID NO: 314467 - protein, 27 aa, Mycobacterium
KPGLVRLRPAPSLGLPPPLTELAVRSE

SEQ ID NO: 314468 - protein, 28 aa, Mycobacterium
KPGNAVLEWLRLPGDVILIVGGVLPFVW

SEQ ID NO: 314469 - protein, 25 aa, Mycobacterium
KPGPAAIRITRTWYAPVGGVLMALC

SEQ ID NO: 314470 - protein, 22 aa, Mycobacterium
KPGPATVRMSLVITTAPAPNPH

SEQ ID NO: 314471 - protein, 23 aa, Mycobacterium
KPGPRPGALVGNVIWVILFGIWL

SEQ ID NO: 314472 - protein, 22 aa, Mycobacterium
KPGPRPGALVGNVIWVIVAGVW

SEQ ID NO: 314473 - protein, 17 aa, Mycobacterium
KPGPRWDAYLDNQLGSM

SEQ ID NO: 314474 - protein, 18 aa, Mycobacterium
KPGSRAVAAPTLPDFAAI

SEQ ID NO: 314475 - protein, 19 aa, Mycobacterium
KPIGAGLGMASIGFAAAAL

SEQ ID NO: 314476 - protein, 25 aa, Mycobacterium
KPIIRLGHMLVFFFRALAGVPIAVR

SEQ ID NO: 314477 - protein, 19 aa, Mycobacterium
KPIKIGHKVVTGMRGSYGG

SEQ ID NO: 314478 - protein, 18 aa, Mycobacterium
KPILQVIGMFIVFNVGYY

SEQ ID NO: 314479 - protein, 17 aa, Mycobacterium
KPIPAMALIAVAAILDA

SEQ ID NO: 314480 - protein, 24 aa, Mycobacterium
KPIVRLGHMLVFFVRAVAAIPIVL

SEQ ID NO: 314481 - protein, 24 aa, Mycobacterium
KPKLPGEVWVLIVANAVIALGYGV

SEQ ID NO: 314482 - protein, 25 aa, Mycobacterium
KPKRRIKLLLIVASVVLVLDVVTKV

SEQ ID NO: 314483 - protein, 27 aa, Mycobacterium
KPLARNGFASLWSWIFGLVVTEFPLPT

SEQ ID NO: 314484 - protein, 17 aa, Mycobacterium
KPLGFDWHINVALLGSF

SEQ ID NO: 314485 - protein, 21 aa, Mycobacterium
KPLKGGASWWQFIRNSRNPEL

SEQ ID NO: 314486 - protein, 19 aa, Mycobacterium
KPLKLAWAVAVLDICANVT

SEQ ID NO: 314487 - protein, 22 aa, Mycobacterium
KPLREVGSYFALTLDIFTQLVR

SEQ ID NO: 314488 - protein, 17 aa, Mycobacterium
KPLRSVGEFFAMSLDTL

SEQ ID NO: 314489 - protein, 27 aa, Mycobacterium
KPLSWRDRAVKWARIARLSIVVKVAAL

SEQ ID NO: 314490 - protein, 19 aa, Mycobacterium
KPLVPAIMITAAAIAVLGS

SEQ ID NO: 314491 - protein, 20 aa, Mycobacterium
KPPAALWLMELSVRVFGLSG

SEQ ID NO: 314492 - protein, 24 aa, Mycobacterium
KPPPDVFSALTFITLAIFLGAGTG

SEQ ID NO: 314493 - protein, 20 aa, Mycobacterium
KPPRPEGYLDPDAVTQRGGH

SEQ ID NO: 314494 - protein, 20 aa, Mycobacterium
KPPVGAALWKLMERARQIGL

SEQ ID NO: 314495 - protein, 21 aa, Mycobacterium
KPPVWEWKIAAYLFSGGLSAG

SEQ ID NO: 314496 - protein, 22 aa, Mycobacterium
KPQRSTKTIAIIGGIVAAAVVL

SEQ ID NO: 314497 - protein, 20 aa, Mycobacterium
KPQTVHWNLRIDVSEVDGKL

SEQ ID NO: 314498 - protein, 21 aa, Mycobacterium
KPQTVHWNLRLDVANVEGKLM

SEQ ID NO: 314499 - protein, 20 aa, Mycobacterium
KPQTVHWNLRLDVSDVDGKL

SEQ ID NO: 314500 - protein, 20 aa, Mycobacterium
KPQTVHWSLRVEVSDVDGKL

SEQ ID NO: 314501 - protein, 26 aa, Mycobacterium
KPRARWWSPSWWAQKFASRGSKPGAK

SEQ ID NO: 314502 - protein, 22 aa, Mycobacterium
KPRPMVNLLAFWFGGMATGAAV

SEQ ID NO: 314503 - protein, 23 aa, Mycobacterium
KPRSEGWIGKVLAMAGVAVTLVG

SEQ ID NO: 314504 - protein, 20 aa, Mycobacterium
KPRYVRIGFRELVKIHDDRL

SEQ ID NO: 314505 - protein, 26 aa, Mycobacterium
KPSADLGANCQYPASPEPAAKPVKPP

SEQ ID NO: 314506 - protein, 31 aa, Mycobacterium
KPSAYSTGWALWVVLVFIVFQSVAAVGALLL

SEQ ID NO: 314507 - protein, 24 aa, Mycobacterium
KPSERRSAVPAGFDDVIARGMAKQ

SEQ ID NO: 314508 - protein, 25 aa, Mycobacterium
KPSGFDPAIPVGFDAVIARGMAKEP

SEQ ID NO: 314509 - protein, 21 aa, Mycobacterium
KPSMPYRLRVIVHEDDSGRMS

SEQ ID NO: 314510 - protein, 24 aa, Mycobacterium
KPSNLLMVGEGFVYLIDFGLVHEA

SEQ ID NO: 314511 - protein, 21 aa, Mycobacterium
KPSRSAFAWATLALSAVFASR

SEQ ID NO: 314512 - protein, 24 aa, Mycobacterium
KPSWDIQAGYVLRSLHALPRSGTK

SEQ ID NO: 314513 - protein, 18 aa, Mycobacterium
KPSYGMAEATLFVSTTPP

SEQ ID NO: 314514 - protein, 28 aa, Mycobacterium
KPTEAVMTKLRWVLLIVGGVGVAVAAVA

SEQ ID NO: 314515 - protein, 19 aa, Mycobacterium
KPTEIGGYAGVPAPPPPPP

SEQ ID NO: 314516 - protein, 18 aa, Mycobacterium
KPTRSGRRSLPLGNTVAR

SEQ ID NO: 314517 - protein, 21 aa, Mycobacterium
KPVERARALGIWGGVTGISMA

SEQ ID NO: 314518 - protein, 18 aa, Mycobacterium
KPVGGWIDNAFRVVVGSG

SEQ ID NO: 314519 - protein, 23 aa, Mycobacterium
KPVGPHVVGRVFVGGDLTFEAYT

SEQ ID NO: 314520 - protein, 17 aa, Mycobacterium
KPVIFWTPDHGAFVVRG

SEQ ID NO: 314521 - protein, 18 aa, Mycobacterium
KPVLQWRVVDIVVASVLA

SEQ ID NO: 314522 - protein, 19 aa, Mycobacterium
KQIAGHTWNTWGNPAKPLS

SEQ ID NO: 314523 - protein, 19 aa, Mycobacterium
KQLILKRAASEYVAHFPDS

SEQ ID NO: 314524 - protein, 19 aa, Mycobacterium
KQLRTIRNIGVFGVNLVGL

SEQ ID NO: 314525 - protein, 23 aa, Mycobacterium
KQPLVSFLVGFSMLAAGVTSAAG

SEQ ID NO: 314526 - protein, 19 aa, Mycobacterium
KQQVALVIGVLFGSAIIPP

SEQ ID NO: 314527 - protein, 20 aa, Mycobacterium
KQRIWPVLAVAAGYAVACQV

SEQ ID NO: 314528 - protein, 27 aa, Mycobacterium
KQSWLGRFVSTYGWRAYALPVLMVLTV

SEQ ID NO: 314529 - protein, 27 aa, Mycobacterium
KQTWLGRFISTYGWRAYAIPLLVALTV

SEQ ID NO: 314530 - protein, 26 aa, Mycobacterium
KQTWLGRFVSTYGWRAYALPILMVLT

SEQ ID NO: 314531 - protein, 27 aa, Mycobacterium
KQTWLGRFVSTYGWRAYALPVLIVLTV

SEQ ID NO: 314532 - protein, 24 aa, Mycobacterium
KQVRTRLRDEFGFPKSEVHAQAYW

SEQ ID NO: 314533 - protein, 17 aa, Mycobacterium
KQWPSFIRVSGELPRTA

SEQ ID NO: 314534 - protein, 26 aa, Mycobacterium
KQWSRACAWYLTAIGFGAVFVVLKAF

SEQ ID NO: 314535 - protein, 23 aa, Mycobacterium
KRAERGVALWLLLGGFFGLALLL

SEQ ID NO: 314536 - protein, 23 aa, Mycobacterium
KRAERGVALWLLLGGGFGLALLL

SEQ ID NO: 314537 - protein, 23 aa, Mycobacterium
KRAGFGRTPYRPHNIPFVMLGAA

SEQ ID NO: 314538 - protein, 18 aa, Mycobacterium
KRALIIFQIFIYGYLLAM

SEQ ID NO: 314539 - protein, 17 aa, Mycobacterium
KRALLEVTYFTGLGALI

SEQ ID NO: 314540 - protein, 37 aa, Mycobacterium
KRAMRIRTWRRIGAAITRWPGPILAASMAIAIIGLAA

SEQ ID NO: 314541 - protein, 20 aa, Mycobacterium
KRAPTVEICESDRPFEPLAM

SEQ ID NO: 314542 - protein, 20 aa, Mycobacterium
KRASVAQLFKLWGGTLAANL

SEQ ID NO: 314543 - protein, 20 aa, Mycobacterium
KRAVYYLITMALHWTIGGGS

SEQ ID NO: 314544 - protein, 19 aa, Mycobacterium
KRDAERPSMAGFNVPPQVL

SEQ ID NO: 314545 - protein, 24 aa, Mycobacterium
KRDEVEARLALGLPSRQAAAPYLR

SEQ ID NO: 314546 - protein, 20 aa, Mycobacterium
KRDRTHWLYILVIVAVVAGI

SEQ ID NO: 314547 - protein, 35 aa, Mycobacterium
KREKTARPNRSWARYLRRGAMPLLLAGALALSAFL

SEQ ID NO: 314548 - protein, 22 aa, Mycobacterium
KRERDAVELDLRANVAAMSATL

SEQ ID NO: 314549 - protein, 26 aa, Mycobacterium
KREVVELRRCVHPLSVAFGRMQTDNK

SEQ ID NO: 314550 - protein, 28 aa, Mycobacterium
KREVVELRRCVNPLSAAFHRIQVENKDV

SEQ ID NO: 314551 - protein, 23 aa, Mycobacterium
KRFASRTRDEWARTFAGTDACVT

SEQ ID NO: 314552 - protein, 27 aa, Mycobacterium
KRFEREADIAATLWHPHIVGVHDRGED

SEQ ID NO: 314553 - protein, 21 aa, Mycobacterium
KRFGYAALLAPILAAGLVTLI

SEQ ID NO: 314554 - protein, 24 aa, Mycobacterium
KRFLPPRWWSVSPLDGLVAAVLVW

SEQ ID NO: 314555 - protein, 19 aa, Mycobacterium
KRFRKAKAAKNGRPADRPD

SEQ ID NO: 314556 - protein, 19 aa, Mycobacterium
KRFWQGRELFVIIDGATAW

SEQ ID NO: 314557 - protein, 20 aa, Mycobacterium
KRGAAFDAFQRLGDRDNTVG

SEQ ID NO: 314558 - protein, 21 aa, Mycobacterium
KRGAFSLADPVARRFLRDTGV

SEQ ID NO: 314559 - protein, 25 aa, Mycobacterium
KRGALPAPRAVAIVSQVAEALDAAH

SEQ ID NO: 314560 - protein, 20 aa, Mycobacterium
KRGGRSLVLYALPMLAGLSM

SEQ ID NO: 314561 - protein, 26 aa, Mycobacterium
KRGGTPRFGTDTAFDDAVRGMRTRLL

SEQ ID NO: 314562 - protein, 18 aa, Mycobacterium
KRGHRLVFSNGIITLTTL

SEQ ID NO: 314563 - protein, 17 aa, Mycobacterium
KRGHVVVAVDVLDGSPF

SEQ ID NO: 314564 - protein, 20 aa, Mycobacterium
KRGSSWLGSPPMRLRRKPAE

SEQ ID NO: 314565 - protein, 19 aa, Mycobacterium
KRGTVGFSGVAPFSVEAVP

SEQ ID NO: 314566 - protein, 25 aa, Mycobacterium
KRGWLEALLGHFCDPAVALVAPRIV

SEQ ID NO: 314567 - protein, 23 aa, Mycobacterium
KRGYRLVFSNGIITLTALSVTLL

SEQ ID NO: 314568 - protein, 26 aa, Mycobacterium
KRHEEIRVRIGIHMGRSVRRGDDLFG

SEQ ID NO: 314569 - protein, 17 aa, Mycobacterium
KRHLRYPEDLFKVQRTL

SEQ ID NO: 314570 - protein, 21 aa, Mycobacterium
KRIAQLEAFAASQGWMYTAED

SEQ ID NO: 314571 - protein, 19 aa, Mycobacterium
KRIATFASVVVPFMAVVYI

SEQ ID NO: 314572 - protein, 26 aa, Mycobacterium
KRIIPRATMIAVLGVGIFYVFVSWMA

SEQ ID NO: 314573 - protein, 26 aa, Mycobacterium
KRIIPRATMIAVLGVGVFYVFISWMA

SEQ ID NO: 314574 - protein, 22 aa, Mycobacterium
KRINLGTLLREPLVGPLVALVI

SEQ ID NO: 314575 - protein, 18 aa, Mycobacterium
KRIQGHWPPPDLKEGGYF

SEQ ID NO: 314576 - protein, 24 aa, Mycobacterium
KRIQRTAGVPIPIIFGDTASADAL

SEQ ID NO: 314577 - protein, 19 aa, Mycobacterium
KRITARWIPYGRADLVIGI

SEQ ID NO: 314578 - protein, 21 aa, Mycobacterium
KRIVQPFGEYLPWRSFFSKLS

SEQ ID NO: 314579 - protein, 17 aa, Mycobacterium
KRIYAFALSGQGRNADA

SEQ ID NO: 314580 - protein, 17 aa, Mycobacterium
KRKLWYTVSALIVAVSI

SEQ ID NO: 314581 - protein, 17 aa, Mycobacterium
KRKMRVRRWRGIGTAIV

SEQ ID NO: 314582 - protein, 20 aa, Mycobacterium
KRLDHSMIFVFIAGSYTPFA

SEQ ID NO: 314583 - protein, 19 aa, Mycobacterium
KRLEKLGVEIQLSAMVTDV

SEQ ID NO: 314584 - protein, 24 aa, Mycobacterium
KRLGATPLPVWGIIAGKSLAVVTV

SEQ ID NO: 314585 - protein, 18 aa, Mycobacterium
KRLIWPVVVLILVTGLAA

SEQ ID NO: 314586 - protein, 19 aa, Mycobacterium
KRLKPREGGDFGTTEQWRY

SEQ ID NO: 314587 - protein, 18 aa, Mycobacterium
KRLLRLLFRVDAAVFGKR

SEQ ID NO: 314588 - protein, 19 aa, Mycobacterium
KRLRSVHTRLDRLKGSGER

SEQ ID NO: 314589 - protein, 18 aa, Mycobacterium
KRLRVVWFNLVQTATAAG

SEQ ID NO: 314590 - protein, 18 aa, Mycobacterium
KRLSGLLNTSGLPAVLEP

SEQ ID NO: 314591 - protein, 18 aa, Mycobacterium
KRLTVVVISHDFAGLENL

SEQ ID NO: 314592 - protein, 21 aa, Mycobacterium
KRLYEAPALNQAWFVYPPFAT

SEQ ID NO: 314593 - protein, 19 aa, Mycobacterium
KRMLMAMAVVLVGSATAAF

SEQ ID NO: 314594 - protein, 22 aa, Mycobacterium
KRMPGSLSARFDRACAQSSLPE

SEQ ID NO: 314595 - protein, 25 aa, Mycobacterium
KRMSPFWRQMFLTVGIVIAVFGMRL

SEQ ID NO: 314596 - protein, 18 aa, Mycobacterium
KRMVEELDVSRSAQTLLD

SEQ ID NO: 314597 - protein, 21 aa, Mycobacterium
KRNRVTACYFGDGAVAEGAFH

SEQ ID NO: 314598 - protein, 17 aa, Mycobacterium
KRPADFPTLSVLCGVVW

SEQ ID NO: 314599 - protein, 23 aa, Mycobacterium
KRPLRTAWQAGIRLWTAALALTA

SEQ ID NO: 314600 - protein, 26 aa, Mycobacterium
KRPSGKRVAAAVAVVGVLLFVGSAAF

SEQ ID NO: 314601 - protein, 18 aa, Mycobacterium
KRPSLPPTLYGTLPVSPT

SEQ ID NO: 314602 - protein, 26 aa, Mycobacterium
KRRGVTFCSMMRNWGLVFVGNLGGAI

SEQ ID NO: 314603 - protein, 17 aa, Mycobacterium
KRRITVPTAAGFTSSPA

SEQ ID NO: 314604 - protein, 18 aa, Mycobacterium
KRRLRRILIGSVVAILLV

SEQ ID NO: 314605 - protein, 17 aa, Mycobacterium
KRRMMVRRWRWIGTATV

SEQ ID NO: 314606 - protein, 19 aa, Mycobacterium
KRRRIWLLAVASIDVLMVI

SEQ ID NO: 314607 - protein, 19 aa, Mycobacterium
KRRVMQSLDRAGRRRWIGI

SEQ ID NO: 314608 - protein, 20 aa, Mycobacterium
KRRWVIPAIFVLTLCATAYF

SEQ ID NO: 314609 - protein, 18 aa, Mycobacterium
KRTARLVGDVPIYDIVIG

SEQ ID NO: 314610 - protein, 18 aa, Mycobacterium
KRTARLVGEVPIYDIIVG

SEQ ID NO: 314611 - protein, 24 aa, Mycobacterium
KRTPHRVMRILYEQFVAYSRAYVG

SEQ ID NO: 314612 - protein, 18 aa, Mycobacterium
KRTSRIALGKLAINLVAV

SEQ ID NO: 314613 - protein, 20 aa, Mycobacterium
KRVAVLFAGPAMNFLIGIVV

SEQ ID NO: 314614 - protein, 21 aa, Mycobacterium
KRVAVLFAGPAMNFVIGLVLI

SEQ ID NO: 314615 - protein, 36 aa, Mycobacterium
KRVAVLFAGPGMNFVICLVLIYAIAVMWGLPNLHPP

SEQ ID NO: 314616 - protein, 26 aa, Mycobacterium
KRVHLDLGGAVVRADPGLLERVLANL

SEQ ID NO: 314617 - protein, 25 aa, Mycobacterium
KRVLLSYSGSLAFIAGFVNAVGLLL

SEQ ID NO: 314618 - protein, 23 aa, Mycobacterium
KRVRKLHQLRSYRIASVLRVGVV

SEQ ID NO: 314619 - protein, 23 aa, Mycobacterium
KRVRVKFDADRSVVLTTGTRAVV

SEQ ID NO: 314620 - protein, 19 aa, Mycobacterium
KRWGHQWLLVTCWFGVVIW

SEQ ID NO: 314621 - protein, 18 aa, Mycobacterium
KRWGHQWMIITCWMGVLI

SEQ ID NO: 314622 - protein, 22 aa, Mycobacterium
KRWNPRLIVIPGAPLVRDGLYR

SEQ ID NO: 314623 - protein, 23 aa, Mycobacterium
KRWRVDIDGTLSFLLLPRLTNVL

SEQ ID NO: 314624 - protein, 18 aa, Mycobacterium
KRYAWHRFRRIMPAYWIL

SEQ ID NO: 314625 - protein, 29 aa, Mycobacterium
KRYFADGLQYWPWVLLGYFTLGIVIVSLI

SEQ ID NO: 314626 - protein, 30 aa, Mycobacterium
KRYIAADGSIVWCALTAVIVHAPRDQPRCF

SEQ ID NO: 314627 - protein, 26 aa, Mycobacterium
KSAPRIEFDCVTFGYGDHPVLDDVSF

SEQ ID NO: 314628 - protein, 35 aa, Mycobacterium
KSATAAFWVFLAFYVVCAFVTWFVFLRLQEHRAHS

SEQ ID NO: 314629 - protein, 21 aa, Mycobacterium
KSELLRTIALGMIARNSPAVL

SEQ ID NO: 314630 - protein, 21 aa, Mycobacterium
KSELLRTIALGMMVRNPPLTL

SEQ ID NO: 314631 - protein, 21 aa, Mycobacterium
KSERRLAFWLIAPAVLLMLAV

SEQ ID NO: 314632 - protein, 18 aa, Mycobacterium
KSFFMLAFTKIGLMPDGA

SEQ ID NO: 314633 - protein, 17 aa, Mycobacterium
KSFPLAGSVFAYVGRGI

SEQ ID NO: 314634 - protein, 18 aa, Mycobacterium
KSGDTVRIAGIRVGTVKD

SEQ ID NO: 314635 - protein, 18 aa, Mycobacterium
KSGDVMPATYIGIWQTLS

SEQ ID NO: 314636 - protein, 17 aa, Mycobacterium
KSGLGRRGVRTHQLSGR

SEQ ID NO: 314637 - protein, 27 aa, Mycobacterium
KSGRWPVPPRRGGLLALKPLELAILAV

SEQ ID NO: 314638 - protein, 17 aa, Mycobacterium
KSGVRPLVLEFGQGQWK

SEQ ID NO: 314639 - protein, 21 aa, Mycobacterium
KSINLSKDWARAVIDIPVPTG

SEQ ID NO: 314640 - protein, 23 aa, Mycobacterium
KSIRSDNAAVRWIQDTLSVVGFV

SEQ ID NO: 314641 - protein, 19 aa, Mycobacterium
KSIVGRMNWLGGRAELATG

SEQ ID NO: 314642 - protein, 19 aa, Mycobacterium
KSIWLPIVGGLVVVVVVVV

SEQ ID NO: 314643 - protein, 20 aa, Mycobacterium
KSLADGLARFTAELRAADPR

SEQ ID NO: 314644 - protein, 22 aa, Mycobacterium
KSLEGTGFVIAPHRVMSNAHVV

SEQ ID NO: 314645 - protein, 20 aa, Mycobacterium
KSLLLFGGLGAAALVLIVLA

SEQ ID NO: 314646 - protein, 17 aa, Mycobacterium
KSLPLSWAQPAAPAPNA

SEQ ID NO: 314647 - protein, 24 aa, Mycobacterium
KSLTADGGLDWHVVDLAEARNGVD

SEQ ID NO: 314648 - protein, 25 aa, Mycobacterium
KSLTADGSMDWHVLSLDEARSGVDH

SEQ ID NO: 314649 - protein, 21 aa, Mycobacterium
KSLYLRNPVFAEWIEKVDALV

SEQ ID NO: 314650 - protein, 22 aa, Mycobacterium
KSLYLRNPVFAEWIEKVDALVQ

SEQ ID NO: 314651 - protein, 20 aa, Mycobacterium
KSMRIFKSEMREMQSETKAE

SEQ ID NO: 314652 - protein, 20 aa, Mycobacterium
KSMRIFKSEMREMQSETKNQ

SEQ ID NO: 314653 - protein, 20 aa, Mycobacterium
KSNIAFRIALRAESGDDSRE

SEQ ID NO: 314654 - protein, 26 aa, Mycobacterium
KSNRRDALRWVWLGVAGAVAMTLIIF

SEQ ID NO: 314655 - protein, 18 aa, Mycobacterium
KSPCTVNSFASLAQQGYF

SEQ ID NO: 314656 - protein, 18 aa, Mycobacterium
KSPHDLRTPRGLADLEQM

SEQ ID NO: 314657 - protein, 26 aa, Mycobacterium
KSPKGRKLWIAALVAIVGVIVLTAAA

SEQ ID NO: 314658 - protein, 38 aa, Mycobacterium
KSPPRWSSWLRVVFGSALIVYGIYKWLNRRGHGESPKW

SEQ ID NO: 314659 - protein, 21 aa, Mycobacterium
KSPSRTVPRLKIEITDLVHLH

SEQ ID NO: 314660 - protein, 24 aa, Mycobacterium
KSRGTRLAIGLAVVLGIIVVYALS

SEQ ID NO: 314661 - protein, 18 aa, Mycobacterium
KSRLDSVMDNYRGWLNRM

SEQ ID NO: 314662 - protein, 17 aa, Mycobacterium
KSRPGSPAWNHAYVIAA

SEQ ID NO: 314663 - protein, 24 aa, Mycobacterium
KSSFLRAGLLPRLRREDRRFVVMN

SEQ ID NO: 314664 - protein, 17 aa, Mycobacterium
KSSKRSMAIIGGVVGVI

SEQ ID NO: 314665 - protein, 21 aa, Mycobacterium
KSSRVKSTWTTKTISPQAGTE

SEQ ID NO: 314666 - protein, 17 aa, Mycobacterium
KSSTVWQRIAVTAVLAV

SEQ ID NO: 314667 - protein, 18 aa, Mycobacterium
KSTALRALCDRLVRTNDP

SEQ ID NO: 314668 - protein, 25 aa, Mycobacterium
KSTGRLDPRVRVVAAMVNVGDGLPQ

SEQ ID NO: 314669 - protein, 21 aa, Mycobacterium
KSTGRLNDYVRVVADLINVGD

SEQ ID NO: 314670 - protein, 18 aa, Mycobacterium
KSTLVSLICRLRDVTDGA

SEQ ID NO: 314671 - protein, 25 aa, Mycobacterium
KSVVALAFAGGVLFVAENPSRSLQK

SEQ ID NO: 314672 - protein, 30 aa, Mycobacterium
KSWRKVGTAVVRWPIPIILVTGLVAAIGFA

SEQ ID NO: 314673 - protein, 23 aa, Mycobacterium
KSWTHNGLFAFTRVDAGSGVEPD

SEQ ID NO: 314674 - protein, 18 aa, Mycobacterium
KTACAGMVILVVTVLVLT

SEQ ID NO: 314675 - protein, 23 aa, Mycobacterium
KTAELLEGIEFVPPRYIEYRGGS

SEQ ID NO: 314676 - protein, 23 aa, Mycobacterium
KTAGRGFIFFGLLAPNLFATIGI

SEQ ID NO: 314677 - protein, 19 aa, Mycobacterium
KTALFFAAVLPQFADPAVG

SEQ ID NO: 314678 - protein, 18 aa, Mycobacterium
KTAPRLPDGTPFPTLYYL

SEQ ID NO: 314679 - protein, 25 aa, Mycobacterium
KTATGGLVVSEWIRGGSLAEVAATN

SEQ ID NO: 314680 - protein, 17 aa, Mycobacterium
KTAYFDTDFFQVLVTQF

SEQ ID NO: 314681 - protein, 25 aa, Mycobacterium
KTDLYPHWRAVVAANSAHLQRAKIA

SEQ ID NO: 314682 - protein, 21 aa, Mycobacterium
KTEIDYAATVIKGYVHERENA

SEQ ID NO: 314683 - protein, 20 aa, Mycobacterium
KTGAVKVMDFGIARALADAG

SEQ ID NO: 314684 - protein, 20 aa, Mycobacterium
KTGAVKVMDFGIARAVSDAG

SEQ ID NO: 314685 - protein, 25 aa, Mycobacterium
KTGELWFKGPNVMAGYLNNEEATKE

SEQ ID NO: 314686 - protein, 20 aa, Mycobacterium
KTGEVDWVLDRLGREIDALR

SEQ ID NO: 314687 - protein, 18 aa, Mycobacterium
KTGGFGFGMGNVILVTNV

SEQ ID NO: 314688 - protein, 21 aa, Mycobacterium
KTGLARLALHTGVPVIPVAMI

SEQ ID NO: 314689 - protein, 21 aa, Mycobacterium
KTGLARLALQTGVPVIPVAMV

SEQ ID NO: 314690 - protein, 19 aa, Mycobacterium
KTGMLVECIVWGGAAAGIL

SEQ ID NO: 314691 - protein, 34 aa, Mycobacterium
KTIGVFFLLLPFTWNRAGGLDGIRERAGDAVFSL

SEQ ID NO: 314692 - protein, 17 aa, Mycobacterium
KTIRLPPWPDRVPLTKG

SEQ ID NO: 314693 - protein, 19 aa, Mycobacterium
KTITIPLLLALMGSALLVP

SEQ ID NO: 314694 - protein, 25 aa, Mycobacterium
KTKTPVEFDRVLGMLDKLSVSLKGD

SEQ ID NO: 314695 - protein, 17 aa, Mycobacterium
KTLAAYVIPDRWPAEDA

SEQ ID NO: 314696 - protein, 25 aa, Mycobacterium
KTLPPSAVIGLWTFDGHEGRSEVPT

SEQ ID NO: 314697 - protein, 25 aa, Mycobacterium
KTLPPTSAVGLWTFDGREGRTEVPT

SEQ ID NO: 314698 - protein, 19 aa, Mycobacterium
KTLRLFVLLVIAFALIPVG

SEQ ID NO: 314699 - protein, 17 aa, Mycobacterium
KTLRSMLSRNVLAQLGL

SEQ ID NO: 314700 - protein, 22 aa, Mycobacterium
KTLWHRSFWVIPLALVRTVELR

SEQ ID NO: 314701 - protein, 24 aa, Mycobacterium
KTNLRRFVDDVSFVVGKESRDRLK

SEQ ID NO: 314702 - protein, 24 aa, Mycobacterium
KTNVRRFLDDVSFVVLKESRDRLR

SEQ ID NO: 314703 - protein, 24 aa, Mycobacterium
KTNVRRFVDDVAFAVGKESRDRLK

SEQ ID NO: 314704 - protein, 24 aa, Mycobacterium
KTPAWEWKIAAYLFSGGLSAGSAL

SEQ ID NO: 314705 - protein, 18 aa, Mycobacterium
KTPLIGMSMVFGAMALVA

SEQ ID NO: 314706 - protein, 23 aa, Mycobacterium
KTPPRTAAPIFAGRIVMGGLAGA

SEQ ID NO: 314707 - protein, 18 aa, Mycobacterium
KTPPRTAPPVFAVRIILG

SEQ ID NO: 314708 - protein, 18 aa, Mycobacterium
KTPSRKTAIQFGTRLVTG

SEQ ID NO: 314709 - protein, 30 aa, Mycobacterium
KTQLVAMMFALRYRWWVVLSAITVATTAVH

SEQ ID NO: 314710 - protein, 25 aa, Mycobacterium
KTQSLLRVLHDWVRTYHRQILVILF

SEQ ID NO: 314711 - protein, 21 aa, Mycobacterium
KTRADSRWTLVAAAIVLAAIC

SEQ ID NO: 314712 - protein, 18 aa, Mycobacterium
KTRCQAIEVAIGMTIPIA

SEQ ID NO: 314713 - protein, 29 aa, Mycobacterium
KTRGWRRIGTAVVRWPAPILTATCAVSLV

SEQ ID NO: 314714 - protein, 18 aa, Mycobacterium
KTRSQLMFGALGVLLCLL

SEQ ID NO: 314715 - protein, 19 aa, Mycobacterium
KTSERRILCSAAALDRAHE

SEQ ID NO: 314716 - protein, 20 aa, Mycobacterium
KTSEVDWVLDRLGRELDALR

SEQ ID NO: 314717 - protein, 19 aa, Mycobacterium
KTSEVDWVLDRLGRELEEL

SEQ ID NO: 314718 - protein, 19 aa, Mycobacterium
KTTDLRGQFWIWAGANIAP

SEQ ID NO: 314719 - protein, 17 aa, Mycobacterium
KTTLLMQTPGVFFAEDA

SEQ ID NO: 314720 - protein, 18 aa, Mycobacterium
KTTLLRHLIRTVREHSTP

SEQ ID NO: 314721 - protein, 18 aa, Mycobacterium
KTTRPGWWVRQYTFTGTA

SEQ ID NO: 314722 - protein, 25 aa, Mycobacterium
KTVWSRPGTRLGFFTHMTTQFPLTV

SEQ ID NO: 314723 - protein, 17 aa, Mycobacterium
KTWRGRVGYLLRPPGWS

SEQ ID NO: 314724 - protein, 22 aa, Mycobacterium
KVADTLSDWPRYSGHAVAGVSG

SEQ ID NO: 314725 - protein, 23 aa, Mycobacterium
KVAKEIFRIPGISRVQGITRPEG

SEQ ID NO: 314726 - protein, 23 aa, Mycobacterium
KVAVPRFIRRSVPDAGTVISAAR

SEQ ID NO: 314727 - protein, 31 aa, Mycobacterium
KVCKGLEKVPILGWLWSWELALPMSGIAMAT

SEQ ID NO: 314728 - protein, 31 aa, Mycobacterium
KVCKGLEKVPLLGWLWSWELALPMSGIAMAT

SEQ ID NO: 314729 - protein, 18 aa, Mycobacterium
KVEAFYWATITFSQTLGT

SEQ ID NO: 314730 - protein, 19 aa, Mycobacterium
KVEEHIPLGLSNVLRYGYY

SEQ ID NO: 314731 - protein, 34 aa, Mycobacterium
KVEFAGFIAWLAWLFLHLLYLVGHRNRVAAAFSW

SEQ ID NO: 314732 - protein, 22 aa, Mycobacterium
KVENVMLVSAFLAAAALAQAVG

SEQ ID NO: 314733 - protein, 23 aa, Mycobacterium
KVFGCGWLVLLLIGVPWLLSFAQ

SEQ ID NO: 314734 - protein, 22 aa, Mycobacterium
KVFGEVEFWLSLVKVLAIVAMI

SEQ ID NO: 314735 - protein, 17 aa, Mycobacterium
KVFKAAAWVAIVAGIVF

SEQ ID NO: 314736 - protein, 22 aa, Mycobacterium
KVFKAAAWVVIVAGIVFIVAVI

SEQ ID NO: 314737 - protein, 20 aa, Mycobacterium
KVGARIILLNSEFSGPQIKE

SEQ ID NO: 314738 - protein, 19 aa, Mycobacterium
KVGGAAFLIGYGLMAARRA

SEQ ID NO: 314739 - protein, 17 aa, Mycobacterium
KVGYWTQHFQYRNARDG

SEQ ID NO: 314740 - protein, 21 aa, Mycobacterium
KVHEVAVCNPPPKADGSAPAQ

SEQ ID NO: 314741 - protein, 24 aa, Mycobacterium
KVHLHIAGPGLLPFDSEDRVIASV

SEQ ID NO: 314742 - protein, 22 aa, Mycobacterium
KVHRHWGFGGGPHRCIGSHLAR

SEQ ID NO: 314743 - protein, 23 aa, Mycobacterium
KVHRHWGFGGGPHRCLGSHLARI

SEQ ID NO: 314744 - protein, 22 aa, Mycobacterium
KVHRHWGFGGGPHRCLGSHLGR

SEQ ID NO: 314745 - protein, 24 aa, Mycobacterium
KVHTLEVFGALFFAALAVIGLVAT

SEQ ID NO: 314746 - protein, 19 aa, Mycobacterium
KVIATRSKLMSRLSGQGAM

SEQ ID NO: 314747 - protein, 20 aa, Mycobacterium
KVIDMLAIFATLFGSAASLG

SEQ ID NO: 314748 - protein, 20 aa, Mycobacterium
KVIQKLSGLSINRFIAIDFV

SEQ ID NO: 314749 - protein, 17 aa, Mycobacterium
KVISGLVGRASLAYDMW

SEQ ID NO: 314750 - protein, 17 aa, Mycobacterium
KVKVGPVTSEFSGKVHF

SEQ ID NO: 314751 - protein, 17 aa, Mycobacterium
KVLDLTVRLAEVMLSAG

SEQ ID NO: 314752 - protein, 19 aa, Mycobacterium
KVLDLVIRLAEVMLSSGSG

SEQ ID NO: 314753 - protein, 20 aa, Mycobacterium
KVLFICAAAGLAIGSAGLGQ

SEQ ID NO: 314754 - protein, 19 aa, Mycobacterium
KVLGAGFFLGLPVAILVSL

SEQ ID NO: 314755 - protein, 18 aa, Mycobacterium
KVLKHRIRAALTRVETKD

SEQ ID NO: 314756 - protein, 19 aa, Mycobacterium
KVLMVGAFVGIAGFLMLSL

SEQ ID NO: 314757 - protein, 17 aa, Mycobacterium
KVLRGCEVVRQGDPGDR

SEQ ID NO: 314758 - protein, 19 aa, Mycobacterium
KVMAVHNFVDWRLRVGGLV

SEQ ID NO: 314759 - protein, 19 aa, Mycobacterium
KVMAVHNFVDWRVRVGGLV

SEQ ID NO: 314760 - protein, 33 aa, Mycobacterium
KVNQAGVIPVIFASSLLYIPGLITQLVRSGGNK

SEQ ID NO: 314761 - protein, 24 aa, Mycobacterium
KVPAKRLRPGDIIEVHADEVVPAD

SEQ ID NO: 314762 - protein, 33 aa, Mycobacterium
KVPDSWGIALLYLCCSGSFLGFAFAFGQVLQHN

SEQ ID NO: 314763 - protein, 18 aa, Mycobacterium
KVPPRPGAPSGFDTACMV

SEQ ID NO: 314764 - protein, 19 aa, Mycobacterium
KVPTALNMIGRAIGSYGDF

SEQ ID NO: 314765 - protein, 24 aa, Mycobacterium
KVQDFKATYLASGQAHSFESNIQY

SEQ ID NO: 314766 - protein, 21 aa, Mycobacterium
KVQLHISGPGFLPFDSEDRVI

SEQ ID NO: 314767 - protein, 20 aa, Mycobacterium
KVRESAALVIVQFVETMTGI

SEQ ID NO: 314768 - protein, 22 aa, Mycobacterium
KVRLRTLRLIDEMYPDPDSPDR

SEQ ID NO: 314769 - protein, 17 aa, Mycobacterium
KVRRMNFRFGEPAPMKK

SEQ ID NO: 314770 - protein, 24 aa, Mycobacterium
KVRVGDEVLAAGAPLGLRSTVTHG

SEQ ID NO: 314771 - protein, 20 aa, Mycobacterium
KVSALLSVALFFIWMIAVAF

SEQ ID NO: 314772 - protein, 24 aa, Mycobacterium
KVSALPEWALPVLSGSGVAFLAFI

SEQ ID NO: 314773 - protein, 20 aa, Mycobacterium
KVSASVPPHSVWAFDEAVDH

SEQ ID NO: 314774 - protein, 19 aa, Mycobacterium
KVSFLPSMRQYAGNWASAV

SEQ ID NO: 314775 - protein, 17 aa, Mycobacterium
KVSGLWAQGRYAEAQAA

SEQ ID NO: 314776 - protein, 25 aa, Mycobacterium
KVSGSRFYFLTGFGALLQLGLFQLA

SEQ ID NO: 314777 - protein, 24 aa, Mycobacterium
KVSRRGVPHIAILCSSAVGFGCVV

SEQ ID NO: 314778 - protein, 20 aa, Mycobacterium
KVTAAVVVPVMLSRMLDHLE

SEQ ID NO: 314779 - protein, 24 aa, Mycobacterium
KVTALELYLVFPLSNEESTISLVR

SEQ ID NO: 314780 - protein, 38 aa, Mycobacterium
KVTVRRWRRIGAAIVRWPAPILVATCAVALIGLLTLPV

SEQ ID NO: 314781 - protein, 19 aa, Mycobacterium
KVVALAAVAGFLVMSAPAA

SEQ ID NO: 314782 - protein, 26 aa, Mycobacterium
KVVGAALAFLVARSFSSGCAALTGVE

SEQ ID NO: 314783 - protein, 27 aa, Mycobacterium
KVVGSRRIRWPAVAIGVAGVAVILVVA

SEQ ID NO: 314784 - protein, 20 aa, Mycobacterium
KVVSAPSWFSDYVLSVGAVD

SEQ ID NO: 314785 - protein, 20 aa, Mycobacterium
KVVSSPSWFSDYVLSVGAVD

SEQ ID NO: 314786 - protein, 25 aa, Mycobacterium
KVWGFMFLFMWLRATLPRLRYDQFM

SEQ ID NO: 314787 - protein, 21 aa, Mycobacterium
KVWPAGTCLGIDPATNQPTDV

SEQ ID NO: 314788 - protein, 27 aa, Mycobacterium
KWIRVLAVPIILVWVAIIAVLNTVVPQ

SEQ ID NO: 314789 - protein, 22 aa, Mycobacterium
KWLGLTRFGVLYALSGLGGSVL

SEQ ID NO: 314790 - protein, 19 aa, Mycobacterium
KWLHWPQLGLFCYLMTLVV

SEQ ID NO: 314791 - protein, 19 aa, Mycobacterium
KWPVGWMVVLLYAVCVVLR

SEQ ID NO: 314792 - protein, 18 aa, Mycobacterium
KWSAIAMSVVTVAFIASV

SEQ ID NO: 314793 - protein, 21 aa, Mycobacterium
KWSRFVPFTSSMVGNSTGILL

SEQ ID NO: 314794 - protein, 18 aa, Mycobacterium
KWSTLPPMPTARHAEVVA

SEQ ID NO: 314795 - protein, 21 aa, Mycobacterium
KWTDKELLSLAAAAEHPSEHP

SEQ ID NO: 314796 - protein, 25 aa, Mycobacterium
KYAFRKRMLMAMALVLVGSAVAAFE

SEQ ID NO: 314797 - protein, 24 aa, Mycobacterium
KYALPAFLVPFAFVLTENGQGLIG

SEQ ID NO: 314798 - protein, 19 aa, Mycobacterium
KYAQIWWNALAKHEHWTVP

SEQ ID NO: 314799 - protein, 24 aa, Mycobacterium
KYGSYPLLLVFGFFLGIAGTVFAV

SEQ ID NO: 314800 - protein, 18 aa, Mycobacterium
KYHRLGFRELVKIHDERL

SEQ ID NO: 314801 - protein, 19 aa, Mycobacterium
KYLPKAVLFSLTFIALVVG

SEQ ID NO: 314802 - protein, 26 aa, Mycobacterium
KYMEMLNINEAWQFGRGAGVKVAVID

SEQ ID NO: 314803 - protein, 22 aa, Mycobacterium
KYNLRFVWLYIVGSFFIAVSVM

SEQ ID NO: 314804 - protein, 24 aa, Mycobacterium
KYNPEYTCMLLGATWYVDNGGRDA

SEQ ID NO: 314805 - protein, 23 aa, Mycobacterium
KYPRAGGAAVFAERAFGKPLISF

SEQ ID NO: 314806 - protein, 17 aa, Mycobacterium
KYPTGYGATLFESLQDK

SEQ ID NO: 314807 - protein, 19 aa, Mycobacterium
KYQPEWVPRYACYEDARLI

SEQ ID NO: 314808 - protein, 19 aa, Mycobacterium
KYQPEWVPRYACYEDARLV

SEQ ID NO: 314809 - protein, 19 aa, Mycobacterium
KYQPQWVPRYACYEDARVI

SEQ ID NO: 314810 - protein, 17 aa, Mycobacterium
KYREAFKDIAGSGQAPD

SEQ ID NO: 314811 - protein, 26 aa, Mycobacterium
KYRFRARTIAVMSVLMLASAVAALTW

SEQ ID NO: 314812 - protein, 23 aa, Mycobacterium
KYRKETIRVLAEITMGTGALVMI

SEQ ID NO: 314813 - protein, 21 aa, Mycobacterium
KYRLLELLGRGGMGEVWRAYD

SEQ ID NO: 314814 - protein, 23 aa, Mycobacterium
KYRWLVFTGWLLALVPAVYLALT

SEQ ID NO: 314815 - protein, 17 aa, Mycobacterium
KYTGEVAFYCYGEGKVQ

SEQ ID NO: 314816 - protein, 26 aa, Mycobacterium
KYYFMVELPPDFSAAIASPVTGQPKK

SEQ ID NO: 314817 - protein, 24 aa, Mycobacterium
KYYRYCTYAFIPLQMVSLVLACYL

SEQ ID NO: 314818 - protein, 17 aa, Mycobacterium
LAAAACGLQNAMTSNFP

SEQ ID NO: 314819 - protein, 20 aa, Mycobacterium
LAAAACWAGYILLTQKVGDA

SEQ ID NO: 314820 - protein, 19 aa, Mycobacterium
LAAAFAAVLWTCPSALAIE

SEQ ID NO: 314821 - protein, 18 aa, Mycobacterium
LAAAGFVVGALWLALEHL

SEQ ID NO: 314822 - protein, 17 aa, Mycobacterium
LAAAIWVSGRCREVGAA

SEQ ID NO: 314823 - protein, 18 aa, Mycobacterium
LAAALFCRALFVEKVPLR

SEQ ID NO: 314824 - protein, 19 aa, Mycobacterium
LAAALGLLAIIRRPPWPDL

SEQ ID NO: 314825 - protein, 19 aa, Mycobacterium
LAAALKYGSLPLSFESSDA

SEQ ID NO: 314826 - protein, 23 aa, Mycobacterium
LAAALPWLVATVVAPGWAAADAG

SEQ ID NO: 314827 - protein, 21 aa, Mycobacterium
LAAALWLLFANRMGYPVSTTH

SEQ ID NO: 314828 - protein, 20 aa, Mycobacterium
LAAANARLGAPSTIAMPLAG

SEQ ID NO: 314829 - protein, 17 aa, Mycobacterium
LAAAPGWFGVLVALRVT

SEQ ID NO: 314830 - protein, 25 aa, Mycobacterium
LAAAPRPPLGPVWVALLIIGASSGV

SEQ ID NO: 314831 - protein, 24 aa, Mycobacterium
LAAARAEPPVGLILVTIAVPTVLA

SEQ ID NO: 314832 - protein, 17 aa, Mycobacterium
LAAARCIAERLADEMSD

SEQ ID NO: 314833 - protein, 20 aa, Mycobacterium
LAAARFLLGLTVGVSVVVVP

SEQ ID NO: 314834 - protein, 24 aa, Mycobacterium
LAAARGVALLATRPDLPPQDATAM

SEQ ID NO: 314835 - protein, 34 aa, Mycobacterium
LAAAVFLVGWRGTRWWRRGVAVLSIPLCVLCAGL

SEQ ID NO: 314836 - protein, 21 aa, Mycobacterium
LAAAVGTRFMQLRARRSATSP

SEQ ID NO: 314837 - protein, 18 aa, Mycobacterium
LAAAVIWQILQWGGAGYI

SEQ ID NO: 314838 - protein, 18 aa, Mycobacterium
LAAAWRADRITIRATAPG

SEQ ID NO: 314839 - protein, 20 aa, Mycobacterium
LAAAWRMMSAIPAAREARRR

SEQ ID NO: 314840 - protein, 19 aa, Mycobacterium
LAACRRAGIRVAMVTGDHP

SEQ ID NO: 314841 - protein, 18 aa, Mycobacterium
LAACVSAVLAARAVGSAP

SEQ ID NO: 314842 - protein, 19 aa, Mycobacterium
LAADEFKKAAQIFISSDGH

SEQ ID NO: 314843 - protein, 18 aa, Mycobacterium
LAADRTTLIIAHELAIAE

SEQ ID NO: 314844 - protein, 19 aa, Mycobacterium
LAADRWGRKTTLGASILLY

SEQ ID NO: 314845 - protein, 17 aa, Mycobacterium
LAADRWQALLAPVATLV

SEQ ID NO: 314846 - protein, 23 aa, Mycobacterium
LAAEPASLVQSWRTTLARAAALL

SEQ ID NO: 314847 - protein, 18 aa, Mycobacterium
LAAEVMFFHSWVITGRAL

SEQ ID NO: 314848 - protein, 19 aa, Mycobacterium
LAAFGCLYLASTFLPSYAQ

SEQ ID NO: 314849 - protein, 19 aa, Mycobacterium
LAAFGWSIYALFWGTAGVP

SEQ ID NO: 314850 - protein, 24 aa, Mycobacterium
LAAFLLYLRMFFEPMQEISQFFNT

SEQ ID NO: 314851 - protein, 22 aa, Mycobacterium
LAAGAELLWELPMRSVGCGLIV

SEQ ID NO: 314852 - protein, 23 aa, Mycobacterium
LAAGCVFTVLALAGCALLGLLSP

SEQ ID NO: 314853 - protein, 27 aa, Mycobacterium
LAAGGIAWLLGERGMADGCWIAGTVLA

SEQ ID NO: 314854 - protein, 25 aa, Mycobacterium
LAAGGRYRRLWAGGRRIDRVGAATT

SEQ ID NO: 314855 - protein, 25 aa, Mycobacterium
LAAGLAAVCYAELASAVPVSGSSYS

SEQ ID NO: 314856 - protein, 34 aa, Mycobacterium
LAAGMLPILGWRNDFRWALLMTGLVVFAVADVAY

SEQ ID NO: 314857 - protein, 17 aa, Mycobacterium
LAAGNWQALMLPVTTLT

SEQ ID NO: 314858 - protein, 25 aa, Mycobacterium
LAAGTPQLAAAVPFYGPTPDDPDFA

SEQ ID NO: 314859 - protein, 17 aa, Mycobacterium
LAAGVAAPIGFVMPMSA

SEQ ID NO: 314860 - protein, 23 aa, Mycobacterium
LAAGVLAPIGFVLPMSVGAILMS

SEQ ID NO: 314861 - protein, 25 aa, Mycobacterium
LAAGVLAPVGFILPMSVGAVLMSLS

SEQ ID NO: 314862 - protein, 18 aa, Mycobacterium
LAAGVLYPTLGLRLSPMI

SEQ ID NO: 314863 - protein, 23 aa, Mycobacterium
LAAGVVALLAWISRDRSPRLTAA

SEQ ID NO: 314864 - protein, 25 aa, Mycobacterium
LAAHKLENVMLVSAFLAAAALGQAV

SEQ ID NO: 314865 - protein, 18 aa, Mycobacterium
LAAHPRLPREDALKVLPA

SEQ ID NO: 314866 - protein, 27 aa, Mycobacterium
LAAIALVVSVSLLVTRTGSQRLANPAT

SEQ ID NO: 314867 - protein, 17 aa, Mycobacterium
LAAIAVVLMRSEPDPEA

SEQ ID NO: 314868 - protein, 19 aa, Mycobacterium
LAAIKCFAGGAVVSSLATE

SEQ ID NO: 314869 - protein, 18 aa, Mycobacterium
LAAILYNLMRTMCVGVVT

SEQ ID NO: 314870 - protein, 23 aa, Mycobacterium
LAAIYVLWMYQRMMTGPLAPGNE

SEQ ID NO: 314871 - protein, 25 aa, Mycobacterium
LAAKPGGPLALWIAAAALFAMGLWR

SEQ ID NO: 314872 - protein, 20 aa, Mycobacterium
LAAKSGYFGPVPRMVSGAAL

SEQ ID NO: 314873 - protein, 20 aa, Mycobacterium
LAALAAACRRVTEGNFGERI

SEQ ID NO: 314874 - protein, 30 aa, Mycobacterium
LAALAAFELIDWPVAVVIAAGHFLASNHHN

SEQ ID NO: 314875 - protein, 21 aa, Mycobacterium
LAALAISCWALPPLLPYSHTD

SEQ ID NO: 314876 - protein, 20 aa, Mycobacterium
LAALALRFGAFSEHTLSTAV

SEQ ID NO: 314877 - protein, 27 aa, Mycobacterium
LAALCGLCAVAYLVSRHAAGAPAGVAM

SEQ ID NO: 314878 - protein, 21 aa, Mycobacterium
LAALCQPNLFSAHLALQPPGS

SEQ ID NO: 314879 - protein, 18 aa, Mycobacterium
LAALFLDERLNRWRLVAL

SEQ ID NO: 314880 - protein, 20 aa, Mycobacterium
LAALGALMWLRTTIEPSPGF

SEQ ID NO: 314881 - protein, 18 aa, Mycobacterium
LAALGWQAKIHRFPNPAE

SEQ ID NO: 314882 - protein, 37 aa, Mycobacterium
LAALGWSVYALFWGTAGMPGMRHAFEFTVTRTDGTGN

SEQ ID NO: 314883 - protein, 27 aa, Mycobacterium
LAALIRARFPALTARQVMQRIESTAHH

SEQ ID NO: 314884 - protein, 28 aa, Mycobacterium
LAALIRARFPALTARQVMQRITSTAHHP

SEQ ID NO: 314885 - protein, 23 aa, Mycobacterium
LAALLVIAGLCFLWYERPRQQQR

SEQ ID NO: 314886 - protein, 18 aa, Mycobacterium
LAALPQYWLGIVLLVVFA

SEQ ID NO: 314887 - protein, 17 aa, Mycobacterium
LAALSILVGAVGATGPG

SEQ ID NO: 314888 - protein, 18 aa, Mycobacterium
LAALTANGSPDGWFLGMT

SEQ ID NO: 314889 - protein, 18 aa, Mycobacterium
LAALTGTSGWEMYKPWAI

SEQ ID NO: 314890 - protein, 31 aa, Mycobacterium
LAALVAARYLTPWGRQFWRITRGYFVGPTSV

SEQ ID NO: 314891 - protein, 20 aa, Mycobacterium
LAALVAFSGSIDRYLDEHAL

SEQ ID NO: 314892 - protein, 17 aa, Mycobacterium
LAALVSIGSMGLITVGA

SEQ ID NO: 314893 - protein, 25 aa, Mycobacterium
LAALWFWLPEQLRTMHISSPLTELG

SEQ ID NO: 314894 - protein, 23 aa, Mycobacterium
LAAMAVAVVAAYFAIRGSMTVGQ

SEQ ID NO: 314895 - protein, 18 aa, Mycobacterium
LAAMHRRIFAGETGEAGE

SEQ ID NO: 314896 - protein, 26 aa, Mycobacterium
LAAMVPRSSTALSVFSGTLAFVLTIA

SEQ ID NO: 314897 - protein, 27 aa, Mycobacterium
LAANIIGGIDWDGHGLLGLEDSLDSVL

SEQ ID NO: 314898 - protein, 17 aa, Mycobacterium
LAANIVGGIDWDGHGLL

SEQ ID NO: 314899 - protein, 19 aa, Mycobacterium
LAANIVGGIDWDGHGLLGL

SEQ ID NO: 314900 - protein, 25 aa, Mycobacterium
LAANIVGGIDWDGHGLLGLEDSMDA

SEQ ID NO: 314901 - protein, 27 aa, Mycobacterium
LAANLVGGWVIMWLIMLGFPKLHAQTV

SEQ ID NO: 314902 - protein, 19 aa, Mycobacterium
LAANVLKVVTLLSIAFGAL

SEQ ID NO: 314903 - protein, 17 aa, Mycobacterium
LAANVLQLITFRVVQGV

SEQ ID NO: 314904 - protein, 18 aa, Mycobacterium
LAAPLLVRLMLGRDPQVN

SEQ ID NO: 314905 - protein, 24 aa, Mycobacterium
LAAPLRRLTGLSGKTGALAKLTNT

SEQ ID NO: 314906 - protein, 18 aa, Mycobacterium
LAAPLWSEHVAHTLPNEN

SEQ ID NO: 314907 - protein, 35 aa, Mycobacterium
LAAPMIACLVAGCGTWLVYRLTRRVAEKRRREGFR

SEQ ID NO: 314908 - protein, 19 aa, Mycobacterium
LAAPRRVLAVAALIAAAAA

SEQ ID NO: 314909 - protein, 30 aa, Mycobacterium
LAAPVVVWGALPFHRAAWLNLRHGTATMDT

SEQ ID NO: 314910 - protein, 18 aa, Mycobacterium
LAAPWPMPIEDWKSDYAT

SEQ ID NO: 314911 - protein, 25 aa, Mycobacterium
LAAQAGILRPEFRVSAGGALAAALV

SEQ ID NO: 314912 - protein, 21 aa, Mycobacterium
LAAQGLRWWCIKTLGPQWNTR

SEQ ID NO: 314913 - protein, 20 aa, Mycobacterium
LAARALRILPGFYVCLVVTA

SEQ ID NO: 314914 - protein, 20 aa, Mycobacterium
LAARALRILPGFYVCMIVTA

SEQ ID NO: 314915 - protein, 18 aa, Mycobacterium
LAARFCGQFEQPVQLIPA

SEQ ID NO: 314916 - protein, 24 aa, Mycobacterium
LAARGEVYAPLTLVFLFSGSDIVV

SEQ ID NO: 314917 - protein, 17 aa, Mycobacterium
LAARGWRRPTAVAPTGV

SEQ ID NO: 314918 - protein, 17 aa, Mycobacterium
LAARLIRAFSVPIVLFW

SEQ ID NO: 314919 - protein, 27 aa, Mycobacterium
LAARLPSWFPSWGFLSAVIAIGGMQLL

SEQ ID NO: 314920 - protein, 25 aa, Mycobacterium
LAARRFSALALWCFIAMGVSGVINA

SEQ ID NO: 314921 - protein, 17 aa, Mycobacterium
LAARRSAPVAAVLCAVV

SEQ ID NO: 314922 - protein, 18 aa, Mycobacterium
LAASATFLAVVITSSLIT

SEQ ID NO: 314923 - protein, 18 aa, Mycobacterium
LAASFGMSVVVWQYIFGI

SEQ ID NO: 314924 - protein, 17 aa, Mycobacterium
LAASGAMVFAILVILGR

SEQ ID NO: 314925 - protein, 24 aa, Mycobacterium
LAASTWALTVVKLVGAAYLIYLGA

SEQ ID NO: 314926 - protein, 23 aa, Mycobacterium
LAASVLPVWLLLAPRDYLSTFMK

SEQ ID NO: 314927 - protein, 17 aa, Mycobacterium
LAATAAEVAALPLAGED

SEQ ID NO: 314928 - protein, 18 aa, Mycobacterium
LAATIPVAWVLHRLTRPR

SEQ ID NO: 314929 - protein, 19 aa, Mycobacterium
LAATLWHPHIVGVHDRGEF

SEQ ID NO: 314930 - protein, 21 aa, Mycobacterium
LAAVAAIVAVLVWGVGANLGW

SEQ ID NO: 314931 - protein, 20 aa, Mycobacterium
LAAVAAWRGDPDADRSEVVV

SEQ ID NO: 314932 - protein, 26 aa, Mycobacterium
LAAVALPPAICALLLAVPPLGVGTQT

SEQ ID NO: 314933 - protein, 18 aa, Mycobacterium
LAAVAWEVSCLRSERTGR

SEQ ID NO: 314934 - protein, 25 aa, Mycobacterium
LAAVFCVLGVLPLIVLTQLGTIVGL

SEQ ID NO: 314935 - protein, 19 aa, Mycobacterium
LAAVIALVSTVGWGWTLLA

SEQ ID NO: 314936 - protein, 19 aa, Mycobacterium
LAAVIGVPAGLLLGVSTTA

SEQ ID NO: 314937 - protein, 17 aa, Mycobacterium
LAAVLLVGVTGYGCGAI

SEQ ID NO: 314938 - protein, 25 aa, Mycobacterium
LAAVPRPPLGPVWVALLIIGASSGV

SEQ ID NO: 314939 - protein, 21 aa, Mycobacterium
LAAVPRRRRLVIIVFGLTVLA

SEQ ID NO: 314940 - protein, 21 aa, Mycobacterium
LAAVSMFLGFFAWYRGLAIGP

SEQ ID NO: 314941 - protein, 29 aa, Mycobacterium
LAAVVAMAALASWFGFHAYQSHQADQQRK

SEQ ID NO: 314942 - protein, 22 aa, Mycobacterium
LAAVWPAGAGLLIRFTGPEVWW

SEQ ID NO: 314943 - protein, 22 aa, Mycobacterium
LAAWATRPAFRGTAIGITLLVG

SEQ ID NO: 314944 - protein, 23 aa, Mycobacterium
LAAWATRPGFRGATIAITLIVGI

SEQ ID NO: 314945 - protein, 24 aa, Mycobacterium
LAAWATRSGFRAAVIVITLVVGIF

SEQ ID NO: 314946 - protein, 20 aa, Mycobacterium
LAAWAVWEFRGARGAIQATL

SEQ ID NO: 314947 - protein, 19 aa, Mycobacterium
LAAYLFAEAGLRPGDRALL

SEQ ID NO: 314948 - protein, 20 aa, Mycobacterium
LAAYSMAPWIALAVAAVLLV

SEQ ID NO: 314949 - protein, 20 aa, Mycobacterium
LAAYSMAPWIAMAVAAVLLV

SEQ ID NO: 314950 - protein, 18 aa, Mycobacterium
LAAYTKLVEKLRAEKYSV

SEQ ID NO: 314951 - protein, 20 aa, Mycobacterium
LACATKWSGLYFVLFFGVMT

SEQ ID NO: 314952 - protein, 19 aa, Mycobacterium
LACATKWSGLYFVMFFGLM

SEQ ID NO: 314953 - protein, 17 aa, Mycobacterium
LACDLLIPFGYIGSLVS

SEQ ID NO: 314954 - protein, 30 aa, Mycobacterium
LACFTVPPRSVWWWPCVAVIGATVLLMLVN

SEQ ID NO: 314955 - protein, 19 aa, Mycobacterium
LACFVPLLPWIGTLVGPVP

SEQ ID NO: 314956 - protein, 18 aa, Mycobacterium
LACGELIAGAVVTEAVFA

SEQ ID NO: 314957 - protein, 19 aa, Mycobacterium
LACGLCLTGFFLLGYRVLS

SEQ ID NO: 314958 - protein, 19 aa, Mycobacterium
LACGTKWSGLYFIAFFGVL

SEQ ID NO: 314959 - protein, 19 aa, Mycobacterium
LACGTKWSGLYFVVFFGAM

SEQ ID NO: 314960 - protein, 20 aa, Mycobacterium
LACGTKWSGLYFVVFFGVMS

SEQ ID NO: 314961 - protein, 32 aa, Mycobacterium
LACLGAAVGLTWWWWGYRRRGISYVQLTPEGF

SEQ ID NO: 314962 - protein, 24 aa, Mycobacterium
LACNELDGLMVLPGTTRASIERGI

SEQ ID NO: 314963 - protein, 17 aa, Mycobacterium
LACRVSLLVLIASLALM

SEQ ID NO: 314964 - protein, 25 aa, Mycobacterium
LACRWAQAHANLGVWVGYVGAAAEA

SEQ ID NO: 314965 - protein, 19 aa, Mycobacterium
LACVGRWLPAAGLAVDTLA

SEQ ID NO: 314966 - protein, 20 aa, Mycobacterium
LACWATRAGFRVAAIVISLV

SEQ ID NO: 314967 - protein, 24 aa, Mycobacterium
LACYVAAALLAWVRYGRPRTMPAP

SEQ ID NO: 314968 - protein, 21 aa, Mycobacterium
LADAISAYFVPVVIAIAIATF

SEQ ID NO: 314969 - protein, 20 aa, Mycobacterium
LADAISAYFVPVVIATAVAT

SEQ ID NO: 314970 - protein, 18 aa, Mycobacterium
LADARPVWARVLGRRLPE

SEQ ID NO: 314971 - protein, 23 aa, Mycobacterium
LADDLKARVIGFVQKPVVLASLA

SEQ ID NO: 314972 - protein, 17 aa, Mycobacterium
LADGWSAALAKDGVTAG

SEQ ID NO: 314973 - protein, 22 aa, Mycobacterium
LADHLPRLRRELERRLGPEGTD

SEQ ID NO: 314974 - protein, 17 aa, Mycobacterium
LADHLVGGAVLFPGTGF

SEQ ID NO: 314975 - protein, 19 aa, Mycobacterium
LADHVDWSLIDVIRGAPGA

SEQ ID NO: 314976 - protein, 21 aa, Mycobacterium
LADKVGEKFHRPSWVALPVLV

SEQ ID NO: 314977 - protein, 19 aa, Mycobacterium
LADLKKRALVWGDSAVRVA

SEQ ID NO: 314978 - protein, 17 aa, Mycobacterium
LADLSFFVLDDWLRPLQ

SEQ ID NO: 314979 - protein, 27 aa, Mycobacterium
LADLWVFPICLLLGVSVGAFHILWHGR

SEQ ID NO: 314980 - protein, 18 aa, Mycobacterium
LADNAVDIIVHFRGGGVA

SEQ ID NO: 314981 - protein, 28 aa, Mycobacterium
LADNRGRWFFRHLFDLAIVVLPMLRPLR

SEQ ID NO: 314982 - protein, 25 aa, Mycobacterium
LADPEVRLLFSLGLRILERRRHTGT

SEQ ID NO: 314983 - protein, 22 aa, Mycobacterium
LADPFGLGWRLFGLAPDDVSYV

SEQ ID NO: 314984 - protein, 19 aa, Mycobacterium
LADPHGLAFDSADTCYVVD

SEQ ID NO: 314985 - protein, 23 aa, Mycobacterium
LADPRGLPVLSVKQLVVRAVSGE

SEQ ID NO: 314986 - protein, 32 aa, Mycobacterium
LADPRPLRPDWVITRPRLTGICGSDSKQILLD

SEQ ID NO: 314987 - protein, 20 aa, Mycobacterium
LADRAAVYLSGDFGAQYRKF

SEQ ID NO: 314988 - protein, 21 aa, Mycobacterium
LADRLGRPVVYAFGLVFFAVG

SEQ ID NO: 314989 - protein, 22 aa, Mycobacterium
LADRLRRVLPLVNRISGGLLVV

SEQ ID NO: 314990 - protein, 20 aa, Mycobacterium
LADRRCMIYAGTTVVAGTAV

SEQ ID NO: 314991 - protein, 25 aa, Mycobacterium
LADRRLLGRIWRFAARHHRRLAVFV

SEQ ID NO: 314992 - protein, 23 aa, Mycobacterium
LADRTAVVIAHRLSTVQIADRVL

SEQ ID NO: 314993 - protein, 20 aa, Mycobacterium
LADRYGRAGFIPLGLAVAAT

SEQ ID NO: 314994 - protein, 20 aa, Mycobacterium
LADSAFTAGAADPGVTAVAA

SEQ ID NO: 314995 - protein, 24 aa, Mycobacterium
LADTRYTSGNAWIFGLELVGVVTG

SEQ ID NO: 314996 - protein, 22 aa, Mycobacterium
LADTWWQLAILRFIAGVGSGVE

SEQ ID NO: 314997 - protein, 25 aa, Mycobacterium
LADVLGRKRMFVFGVVLFTIASGLC

SEQ ID NO: 314998 - protein, 20 aa, Mycobacterium
LADVLPVYLAIVVGLSLVIL

SEQ ID NO: 314999 - protein, 26 aa, Mycobacterium
LAEAFLPRRIRYAGQVTLALGGLIAA

SEQ ID NO: 315000 - protein, 26 aa, Mycobacterium
LAEAFLPRRLRYGAQVTLALSGLVAA

SEQ ID NO: 315001 - protein, 18 aa, Mycobacterium
LAEAVPRDRGYWVTEDPS

SEQ ID NO: 315002 - protein, 17 aa, Mycobacterium
LAEDVRAGLAPQPQFVI

SEQ ID NO: 315003 - protein, 23 aa, Mycobacterium
LAEDYRTGLPVAEVAQIVTAVAD

SEQ ID NO: 315004 - protein, 24 aa, Mycobacterium
LAEGLRSATFYKLLVAAGLFAFTT

SEQ ID NO: 315005 - protein, 23 aa, Mycobacterium
LAEGSAPRQALIRTMVTAGRTVV

SEQ ID NO: 315006 - protein, 23 aa, Mycobacterium
LAEHLPAALVPRLVQIDELPTRT

SEQ ID NO: 315007 - protein, 29 aa, Mycobacterium
LAEKALAPWHLRVAAFAVDVVPGIAVVAT

SEQ ID NO: 315008 - protein, 29 aa, Mycobacterium
LAEKLFSRWGVRAVFFGRFIALLRIFAGP

SEQ ID NO: 315009 - protein, 30 aa, Mycobacterium
LAELARLAGVREFFDTMVIVENFPSTSSAE

SEQ ID NO: 315010 - protein, 19 aa, Mycobacterium
LAELEYKAPVWGYSAGSLG

SEQ ID NO: 315011 - protein, 22 aa, Mycobacterium
LAELFGTFWLVFGGCGSAIFAA

SEQ ID NO: 315012 - protein, 17 aa, Mycobacterium
LAELMGGPNIAPVQSNL

SEQ ID NO: 315013 - protein, 21 aa, Mycobacterium
LAELQRYAADLSRVPDVSSVS

SEQ ID NO: 315014 - protein, 29 aa, Mycobacterium
LAENNGRTWLLWDGRRSAIDLADRAVAGG

SEQ ID NO: 315015 - protein, 26 aa, Mycobacterium
LAENYLRLNALGAYGSFFNIFYCSTR

SEQ ID NO: 315016 - protein, 26 aa, Mycobacterium
LAENYLRLNALGAYGSFFNIYYCSIR

SEQ ID NO: 315017 - protein, 21 aa, Mycobacterium
LAEPLRLALEHLMDTGEYRTI

SEQ ID NO: 315018 - protein, 18 aa, Mycobacterium
LAERLAVDGRELWNTYGP

SEQ ID NO: 315019 - protein, 21 aa, Mycobacterium
LAERRCMLYAGTTVVAGTAVA

SEQ ID NO: 315020 - protein, 18 aa, Mycobacterium
LAESLPAYMVPTAVVVLD

SEQ ID NO: 315021 - protein, 25 aa, Mycobacterium
LAESYGWRASLAIWALIPAVAVLPW

SEQ ID NO: 315022 - protein, 24 aa, Mycobacterium
LAETIARRLGLTGALGTVAESVDG

SEQ ID NO: 315023 - protein, 25 aa, Mycobacterium
LAETRRRPVCSIAIVIAGGIGCAAV

SEQ ID NO: 315024 - protein, 23 aa, Mycobacterium
LAEVKPDHEAFVFTEYDTRSGDR

SEQ ID NO: 315025 - protein, 21 aa, Mycobacterium
LAEVLDRVWTTLGGFIRTQAL

SEQ ID NO: 315026 - protein, 19 aa, Mycobacterium
LAFACTQAGIAVAIAPALN

SEQ ID NO: 315027 - protein, 23 aa, Mycobacterium
LAFFAQFAIAFVVDKSLSPIESI

SEQ ID NO: 315028 - protein, 27 aa, Mycobacterium
LAFGHQSSYGWLVWVFVAMFGVGLIDL

SEQ ID NO: 315029 - protein, 17 aa, Mycobacterium
LAFGLGAIFGIFVLLVR

SEQ ID NO: 315030 - protein, 18 aa, Mycobacterium
LAFGLMAALLLDATVVRM

SEQ ID NO: 315031 - protein, 17 aa, Mycobacterium
LAFHLGYHSVPFGVMAG

SEQ ID NO: 315032 - protein, 25 aa, Mycobacterium
LAFIGVKLILHWGHVDINPQIPEIN

SEQ ID NO: 315033 - protein, 20 aa, Mycobacterium
LAFLLVFGIFVRRFVDIAIG

SEQ ID NO: 315034 - protein, 20 aa, Mycobacterium
LAFLLVFGIFVRRVSNIVIG

SEQ ID NO: 315035 - protein, 19 aa, Mycobacterium
LAFLPKWSALTALSQTSSL

SEQ ID NO: 315036 - protein, 22 aa, Mycobacterium
LAFLYQRPKAMVPRHTSSHRIT

SEQ ID NO: 315037 - protein, 31 aa, Mycobacterium
LAFMMMPFVLGYDIANAVIYWITHLSAGIVS

SEQ ID NO: 315038 - protein, 28 aa, Mycobacterium
LAFQACFVSAGAVAARFGAAAVAAHQVV

SEQ ID NO: 315039 - protein, 27 aa, Mycobacterium
LAFQACFVSAGAVAARFGASALAAHQV

SEQ ID NO: 315040 - protein, 19 aa, Mycobacterium
LAFQISLFVVILGYGLTAR

SEQ ID NO: 315041 - protein, 17 aa, Mycobacterium
LAFRGVLHGALHRAWGF

SEQ ID NO: 315042 - protein, 17 aa, Mycobacterium
LAFSAVSIVFLFGLQLV

SEQ ID NO: 315043 - protein, 18 aa, Mycobacterium
LAFSIWVSVVLVFYFVWG

SEQ ID NO: 315044 - protein, 23 aa, Mycobacterium
LAFSKPFFDQGLLNRRTVLKSSY

SEQ ID NO: 315045 - protein, 20 aa, Mycobacterium
LAFSVLDEWLQPVSVDVVGE

SEQ ID NO: 315046 - protein, 19 aa, Mycobacterium
LAFTGCERVGKGPERIPEL

SEQ ID NO: 315047 - protein, 19 aa, Mycobacterium
LAFVALIAFVMLLVSVHSM

SEQ ID NO: 315048 - protein, 19 aa, Mycobacterium
LAFVFRFLVLAPLSWLIPA

SEQ ID NO: 315049 - protein, 25 aa, Mycobacterium
LAFVLPFLILVEAFVFTILGLMFSI

SEQ ID NO: 315050 - protein, 20 aa, Mycobacterium
LAFVRRPRRWIKQLATESAY

SEQ ID NO: 315051 - protein, 19 aa, Mycobacterium
LAGAAILLLAGRRCDAWGH

SEQ ID NO: 315052 - protein, 22 aa, Mycobacterium
LAGALCYGWGLGLAQRMGPGTV

SEQ ID NO: 315053 - protein, 25 aa, Mycobacterium
LAGALGAVMAFSFARIGLHSRRNLT

SEQ ID NO: 315054 - protein, 31 aa, Mycobacterium
LAGALPLVMWLRRRPPRLPDTVHAWAYVGLL

SEQ ID NO: 315055 - protein, 24 aa, Mycobacterium
LAGAWGLAEVFGWKHTLNERPNRA

SEQ ID NO: 315056 - protein, 24 aa, Mycobacterium
LAGAWGLSEVFGWQHTLNQRPTRA

SEQ ID NO: 315057 - protein, 24 aa, Mycobacterium
LAGAWGLSEVFGWRHTLNQRPNRA

SEQ ID NO: 315058 - protein, 17 aa, Mycobacterium
LAGCALLGLLSPHVALD

SEQ ID NO: 315059 - protein, 26 aa, Mycobacterium
LAGCASCRAAVAELCGVPALLSQLGA

SEQ ID NO: 315060 - protein, 24 aa, Mycobacterium
LAGDAAHLMPVWQGQGYNSGIRDA

SEQ ID NO: 315061 - protein, 20 aa, Mycobacterium
LAGDLFNLFVGFEVLLAASF

SEQ ID NO: 315062 - protein, 20 aa, Mycobacterium
LAGFAFAWSDSWEYWTETVR

SEQ ID NO: 315063 - protein, 19 aa, Mycobacterium
LAGFCLHATLLGMLAGTNR

SEQ ID NO: 315064 - protein, 17 aa, Mycobacterium
LAGFCVHTTLLGALAGM

SEQ ID NO: 315065 - protein, 17 aa, Mycobacterium
LAGFGWMISSRMVRGMT

SEQ ID NO: 315066 - protein, 18 aa, Mycobacterium
LAGGFGLFGGMAAFSAIG

SEQ ID NO: 315067 - protein, 18 aa, Mycobacterium
LAGGLWIAAAILYGATVS

SEQ ID NO: 315068 - protein, 17 aa, Mycobacterium
LAGGPWQWQRWAPASPW

SEQ ID NO: 315069 - protein, 28 aa, Mycobacterium
LAGGPWRWDRWAPASPWATPPPTVMALG

SEQ ID NO: 315070 - protein, 17 aa, Mycobacterium
LAGGRAIARVVAVRRLR

SEQ ID NO: 315071 - protein, 19 aa, Mycobacterium
LAGHAVAGTVLFPGAGFVE

SEQ ID NO: 315072 - protein, 26 aa, Mycobacterium
LAGHRVSRWEWIWALVLAGALAVVIM

SEQ ID NO: 315073 - protein, 23 aa, Mycobacterium
LAGIAAGIGYRYNVDPLLVRVIF

SEQ ID NO: 315074 - protein, 18 aa, Mycobacterium
LAGIALLVSRQVVVPVRS

SEQ ID NO: 315075 - protein, 27 aa, Mycobacterium
LAGILGLAPADSWPAAVAVGLAAMFTL

SEQ ID NO: 315076 - protein, 21 aa, Mycobacterium
LAGIMGLFVVFPIGGADMPVV

SEQ ID NO: 315077 - protein, 17 aa, Mycobacterium
LAGIPSVIVGLWGAMTF

SEQ ID NO: 315078 - protein, 17 aa, Mycobacterium
LAGIYGMNFDNMPELHW

SEQ ID NO: 315079 - protein, 19 aa, Mycobacterium
LAGIYIAVRYERYMSLAAL

SEQ ID NO: 315080 - protein, 18 aa, Mycobacterium
LAGLAARNAAKEYLGATQ

SEQ ID NO: 315081 - protein, 26 aa, Mycobacterium
LAGLAMLCAHAMFKAALFMVVGIIDH

SEQ ID NO: 315082 - protein, 25 aa, Mycobacterium
LAGLARFVWATAIIWILGGIGTWLI

SEQ ID NO: 315083 - protein, 24 aa, Mycobacterium
LAGLARFVWATAIVWILGGFGTWL

SEQ ID NO: 315084 - protein, 22 aa, Mycobacterium
LAGLDLGNIISIVSGAERIHPA

SEQ ID NO: 315085 - protein, 27 aa, Mycobacterium
LAGLDPRLLHTLSFVVALAIVVTLHVL

SEQ ID NO: 315086 - protein, 18 aa, Mycobacterium
LAGLFATVGILAALRARD

SEQ ID NO: 315087 - protein, 25 aa, Mycobacterium
LAGLICGGVGLLIAGWVAGSFTSRP

SEQ ID NO: 315088 - protein, 19 aa, Mycobacterium
LAGLIGFIGNEWVALYRIG

SEQ ID NO: 315089 - protein, 19 aa, Mycobacterium
LAGLIMFGLQVWGRGGVSP

SEQ ID NO: 315090 - protein, 18 aa, Mycobacterium
LAGLKKFQITVGEAIAGM

SEQ ID NO: 315091 - protein, 24 aa, Mycobacterium
LAGLKRLVSAAAFQHRTDAGYLTE

SEQ ID NO: 315092 - protein, 26 aa, Mycobacterium
LAGLLGPWFWWPLRVRTGPTAEARPN

SEQ ID NO: 315093 - protein, 27 aa, Mycobacterium
LAGLLIVIGIELLKPAHIETALRNGDL

SEQ ID NO: 315094 - protein, 25 aa, Mycobacterium
LAGLPDSLLWRIGDIAAQPPNRIRG

SEQ ID NO: 315095 - protein, 17 aa, Mycobacterium
LAGLPWVAAALIAISLA

SEQ ID NO: 315096 - protein, 25 aa, Mycobacterium
LAGLSRFVWATAIVWILGGLGTWLI

SEQ ID NO: 315097 - protein, 18 aa, Mycobacterium
LAGLVGAVPQVWWGPAEQ

SEQ ID NO: 315098 - protein, 21 aa, Mycobacterium
LAGLVGGLRRPGGARADGAKT

SEQ ID NO: 315099 - protein, 20 aa, Mycobacterium
LAGMATWLTVRGELSVPEAV

SEQ ID NO: 315100 - protein, 17 aa, Mycobacterium
LAGMFLARGMCYVVSVD

SEQ ID NO: 315101 - protein, 28 aa, Mycobacterium
LAGNVAGWFAGWVYMWALVIIMATVAYA

SEQ ID NO: 315102 - protein, 25 aa, Mycobacterium
LAGPDGRPTIHLPLDDPYQAPDGYP

SEQ ID NO: 315103 - protein, 17 aa, Mycobacterium
LAGPGWVLFGAIKQVIG

SEQ ID NO: 315104 - protein, 17 aa, Mycobacterium
LAGPRQVTYSVTGTKAP

SEQ ID NO: 315105 - protein, 18 aa, Mycobacterium
LAGPWTWSPQPPVWVAAV

SEQ ID NO: 315106 - protein, 24 aa, Mycobacterium
LAGQRPGNLPAWLRGSAAIASGYT

SEQ ID NO: 315107 - protein, 17 aa, Mycobacterium
LAGQWLAAVLFGRALLA

SEQ ID NO: 315108 - protein, 17 aa, Mycobacterium
LAGRGVVLTRILGTTLH

SEQ ID NO: 315109 - protein, 19 aa, Mycobacterium
LAGRHHYVLAFARALAVAI

SEQ ID NO: 315110 - protein, 24 aa, Mycobacterium
LAGRLCSTREKLAILFTGRGLVVT

SEQ ID NO: 315111 - protein, 18 aa, Mycobacterium
LAGRQSAILVTAWALSGG

SEQ ID NO: 315112 - protein, 18 aa, Mycobacterium
LAGRSAFEHRAVVVGADR

SEQ ID NO: 315113 - protein, 25 aa, Mycobacterium
LAGRSRGGAVAAVFFALVSGSLWGI

SEQ ID NO: 315114 - protein, 20 aa, Mycobacterium
LAGSLARQGSTPASAGTLPT

SEQ ID NO: 315115 - protein, 20 aa, Mycobacterium
LAGSLFGQIWKRIGDNDPEP

SEQ ID NO: 315116 - protein, 26 aa, Mycobacterium
LAGSLPMTVFVAFQLMFAIITVALIS

SEQ ID NO: 315117 - protein, 23 aa, Mycobacterium
LAGSMTWEILWALILGFALSAMV

SEQ ID NO: 315118 - protein, 23 aa, Mycobacterium
LAGSMTWEILWALIVGFTLSAVV

SEQ ID NO: 315119 - protein, 17 aa, Mycobacterium
LAGSSFLVRFNYDDLKA

SEQ ID NO: 315120 - protein, 20 aa, Mycobacterium
LAGTTGWLAGMWRDLLGAAI

SEQ ID NO: 315121 - protein, 20 aa, Mycobacterium
LAGTTWWSPWTAYLATVDPR

SEQ ID NO: 315122 - protein, 25 aa, Mycobacterium
LAGVMLAFVGVGWALTLPAALFVVG

SEQ ID NO: 315123 - protein, 19 aa, Mycobacterium
LAGVTGWLPLFAVAWLVVG

SEQ ID NO: 315124 - protein, 22 aa, Mycobacterium
LAGVVVLLGAMWASNRLSRKAD

SEQ ID NO: 315125 - protein, 25 aa, Mycobacterium
LAGYGPRAPQLWLPPLDEPIPVSAM

SEQ ID NO: 315126 - protein, 17 aa, Mycobacterium
LAHEFRSSTDLLGLTVP

SEQ ID NO: 315127 - protein, 23 aa, Mycobacterium
LAHLCFLGALVPLAARRPPKPRI

SEQ ID NO: 315128 - protein, 22 aa, Mycobacterium
LAHMKLAWRTGDLAVYAITMVC

SEQ ID NO: 315129 - protein, 23 aa, Mycobacterium
LAHTTRWGSYLSEIDEFDADYFE

SEQ ID NO: 315130 - protein, 17 aa, Mycobacterium
LAIACVAVLAAVLKVSP

SEQ ID NO: 315131 - protein, 19 aa, Mycobacterium
LAIAEAFDTVEIYGAAPSQ

SEQ ID NO: 315132 - protein, 17 aa, Mycobacterium
LAIALAFDEASRRKVDL

SEQ ID NO: 315133 - protein, 23 aa, Mycobacterium
LAIALKYKFGYDDSLDVVGVHLV

SEQ ID NO: 315134 - protein, 17 aa, Mycobacterium
LAIALPSVCLFIDVSPT

SEQ ID NO: 315135 - protein, 27 aa, Mycobacterium
LAIALTAWRVMWFRIHAHPAGDEWHVA

SEQ ID NO: 315136 - protein, 18 aa, Mycobacterium
LAIAMTWLSIEMEPDTPV

SEQ ID NO: 315137 - protein, 17 aa, Mycobacterium
LAIAPGWFGILAAIQVI

SEQ ID NO: 315138 - protein, 22 aa, Mycobacterium
LAIATRGRYYLRRGHDGIDLPM

SEQ ID NO: 315139 - protein, 17 aa, Mycobacterium
LAICVALTVFVPSLEKV

SEQ ID NO: 315140 - protein, 17 aa, Mycobacterium
LAIDIALYTLARLGLAV

SEQ ID NO: 315141 - protein, 28 aa, Mycobacterium
LAIGAATLGGWVLAAFAVRPFKQLARQT

SEQ ID NO: 315142 - protein, 30 aa, Mycobacterium
LAIGDNTWFSWLVVFWLWLTVIFANLAEAV

SEQ ID NO: 315143 - protein, 20 aa, Mycobacterium
LAIGLARWYFGNAQGTKATS

SEQ ID NO: 315144 - protein, 19 aa, Mycobacterium
LAIGMAIGMAAQTARRAHA

SEQ ID NO: 315145 - protein, 19 aa, Mycobacterium
LAIGPVWRVLSPVRALHRF

SEQ ID NO: 315146 - protein, 28 aa, Mycobacterium
LAIGTLRWPRRRALLAFLGVFVVAHIVA

SEQ ID NO: 315147 - protein, 17 aa, Mycobacterium
LAIGVARMARRRAVVRR

SEQ ID NO: 315148 - protein, 32 aa, Mycobacterium
LAIIGRSGGIYGDFFNFYACDVTLKLNGLQPG

SEQ ID NO: 315149 - protein, 19 aa, Mycobacterium
LAIITVLGLIVAYIFRPAG

SEQ ID NO: 315150 - protein, 17 aa, Mycobacterium
LAILGDGFTHWAELLGL

SEQ ID NO: 315151 - protein, 22 aa, Mycobacterium
LAILLCLVLGVAIVTQVRQTES

SEQ ID NO: 315152 - protein, 21 aa, Mycobacterium
LAILYCFAFLLLATLGAGAWS

SEQ ID NO: 315153 - protein, 20 aa, Mycobacterium
LAIPLSFLVLVWVFGGLVAA

SEQ ID NO: 315154 - protein, 17 aa, Mycobacterium
LAIPLVISIATERAARG

SEQ ID NO: 315155 - protein, 20 aa, Mycobacterium
LAISGVAVWQGVRSWQGHDC

SEQ ID NO: 315156 - protein, 23 aa, Mycobacterium
LAISLKYKFGYDDSLDVVGVHLV

SEQ ID NO: 315157 - protein, 25 aa, Mycobacterium
LAISPRITIALARLSPSRPAVDDEE

SEQ ID NO: 315158 - protein, 30 aa, Mycobacterium
LAITFLHFAKLPAMLFGVGRYTVTMELTKS

SEQ ID NO: 315159 - protein, 18 aa, Mycobacterium
LAITGMVAAAAWTIGSNL

SEQ ID NO: 315160 - protein, 17 aa, Mycobacterium
LAITPVKCEAWNPDTGK

SEQ ID NO: 315161 - protein, 18 aa, Mycobacterium
LAIWAQVMIGLWVALGGV

SEQ ID NO: 315162 - protein, 18 aa, Mycobacterium
LAKAGFRAEDATSPDSDV

SEQ ID NO: 315163 - protein, 28 aa, Mycobacterium
LAKDAKDRFDTCHDFAVALAEANKGDES

SEQ ID NO: 315164 - protein, 28 aa, Mycobacterium
LAKGRRTVWIPWALGPAAAVMRLLPAFV

SEQ ID NO: 315165 - protein, 24 aa, Mycobacterium
LAKHPRLPRYDALKVLSASVSTDS

SEQ ID NO: 315166 - protein, 20 aa, Mycobacterium
LAKHQKLEFDSTVNYPLDRQ

SEQ ID NO: 315167 - protein, 19 aa, Mycobacterium
LAKKLPRRALTVLKAESLI

SEQ ID NO: 315168 - protein, 19 aa, Mycobacterium
LAKKLPRRSVTVLKAESLI

SEQ ID NO: 315169 - protein, 17 aa, Mycobacterium
LAKLPHDRIPVLYCKTG

SEQ ID NO: 315170 - protein, 20 aa, Mycobacterium
LAKRLPRRTLTVLKGESLIN

SEQ ID NO: 315171 - protein, 24 aa, Mycobacterium
LAKSAVFCAFAILQSAIVTAIVVA

SEQ ID NO: 315172 - protein, 25 aa, Mycobacterium
LAKVMAVPMAKRFAPAIAAVAAAGL

SEQ ID NO: 315173 - protein, 17 aa, Mycobacterium
LALAAALAREPALLIAD

SEQ ID NO: 315174 - protein, 19 aa, Mycobacterium
LALAARARRRFTRATVGGV

SEQ ID NO: 315175 - protein, 20 aa, Mycobacterium
LALAAVMPRSFHFVAAEVLE

SEQ ID NO: 315176 - protein, 24 aa, Mycobacterium
LALAEGYALAGARVVVASRKADAC

SEQ ID NO: 315177 - protein, 17 aa, Mycobacterium
LALAGSMTWEILWALIL

SEQ ID NO: 315178 - protein, 19 aa, Mycobacterium
LALAIAMTGWRVLRAKVEA

SEQ ID NO: 315179 - protein, 25 aa, Mycobacterium
LALALALLAGFLKWQCSSAPDSTGR

SEQ ID NO: 315180 - protein, 32 aa, Mycobacterium
LALALVVCTVLWPPVRWLRNKGVPPAAAVLVV

SEQ ID NO: 315181 - protein, 17 aa, Mycobacterium
LALAPGWFGVLAAIQVA

SEQ ID NO: 315182 - protein, 17 aa, Mycobacterium
LALASWLLAGYIGAAVA

SEQ ID NO: 315183 - protein, 25 aa, Mycobacterium
LALATVGGFLIDLAVRTSRNATELL

SEQ ID NO: 315184 - protein, 21 aa, Mycobacterium
LALAVRYVLHRAIDRLVQGAR

SEQ ID NO: 315185 - protein, 17 aa, Mycobacterium
LALCGAILQSLLRNPLA

SEQ ID NO: 315186 - protein, 24 aa, Mycobacterium
LALCVSFPPFGWWYIAILAFAVLG

SEQ ID NO: 315187 - protein, 17 aa, Mycobacterium
LALDLVGTFAFGLNGAL

SEQ ID NO: 315188 - protein, 21 aa, Mycobacterium
LALEPVRLVLRRWTRPAPPPT

SEQ ID NO: 315189 - protein, 17 aa, Mycobacterium
LALFAGGVLVNSDLSAL

SEQ ID NO: 315190 - protein, 20 aa, Mycobacterium
LALFALVFAGLWLILTKARK

SEQ ID NO: 315191 - protein, 26 aa, Mycobacterium
LALFGAEIALGFALTAPVVGAVAATA

SEQ ID NO: 315192 - protein, 17 aa, Mycobacterium
LALFIDWLARVVEIIAA

SEQ ID NO: 315193 - protein, 21 aa, Mycobacterium
LALFIGALIIWMLLKPLQTRP

SEQ ID NO: 315194 - protein, 24 aa, Mycobacterium
LALFKAVIFGAIVAVVSAQKGLST

SEQ ID NO: 315195 - protein, 19 aa, Mycobacterium
LALFLVYPMGYLVALALTK

SEQ ID NO: 315196 - protein, 25 aa, Mycobacterium
LALFSVVGLVFFLAHLVAEIRVETM

SEQ ID NO: 315197 - protein, 18 aa, Mycobacterium
LALFVNWLRVLVAHRYEG

SEQ ID NO: 315198 - protein, 17 aa, Mycobacterium
LALGSYWGLVIVPPSVL

SEQ ID NO: 315199 - protein, 17 aa, Mycobacterium
LALGVGVGVGMLEHHLT

SEQ ID NO: 315200 - protein, 22 aa, Mycobacterium
LALGWWQWTRFQSVSGSFQNLG

SEQ ID NO: 315201 - protein, 22 aa, Mycobacterium
LALGWWQWTRFQSVSGTFQNLG

SEQ ID NO: 315202 - protein, 23 aa, Mycobacterium
LALGWWQWTRFQSVSGTFQNLGY

SEQ ID NO: 315203 - protein, 25 aa, Mycobacterium
LALHPRLPRRDVIKVLAEAVTADPE

SEQ ID NO: 315204 - protein, 17 aa, Mycobacterium
LALIAIPVNFNYWVFAL

SEQ ID NO: 315205 - protein, 18 aa, Mycobacterium
LALIEELVAWGGGRLRQP

SEQ ID NO: 315206 - protein, 17 aa, Mycobacterium
LALILKYTIGLRLGAEE

SEQ ID NO: 315207 - protein, 17 aa, Mycobacterium
LALILKYTIGLRLNPEA

SEQ ID NO: 315208 - protein, 19 aa, Mycobacterium
LALILKYTIGLRVGVEEES

SEQ ID NO: 315209 - protein, 25 aa, Mycobacterium
LALILLCAFVFRRVFGRHARAAFVV

SEQ ID NO: 315210 - protein, 26 aa, Mycobacterium
LALINPTWFAWLIVTWLWLTVLFANL

SEQ ID NO: 315211 - protein, 17 aa, Mycobacterium
LALIPVFVYVMLIAHIH

SEQ ID NO: 315212 - protein, 18 aa, Mycobacterium
LALIPVFVYVMLIAPAHG

SEQ ID NO: 315213 - protein, 17 aa, Mycobacterium
LALIVLAVIALVIGALG

SEQ ID NO: 315214 - protein, 19 aa, Mycobacterium
LALLAGLYFFSYRPDREVD

SEQ ID NO: 315215 - protein, 24 aa, Mycobacterium
LALLANLFVPWGIAGADPSLIGIA

SEQ ID NO: 315216 - protein, 17 aa, Mycobacterium
LALLASVSTMVFGAYPW

SEQ ID NO: 315217 - protein, 17 aa, Mycobacterium
LALLAWIALRRRNQCSL

SEQ ID NO: 315218 - protein, 25 aa, Mycobacterium
LALLIVVAVGAVFLGSKLWHSMSGS

SEQ ID NO: 315219 - protein, 18 aa, Mycobacterium
LALLLATLWWLVALTQLR

SEQ ID NO: 315220 - protein, 27 aa, Mycobacterium
LALLLIRAAGWQLSRLVSHPRIDKLDA

SEQ ID NO: 315221 - protein, 21 aa, Mycobacterium
LALLLPWNLQFGVGVPGSDGS

SEQ ID NO: 315222 - protein, 20 aa, Mycobacterium
LALLLVFLFWPWEYKPSGDK

SEQ ID NO: 315223 - protein, 42 aa, Mycobacterium
LALLPILACLALLPARGRTTLPPVAPWCAGPAAGVAVLAALT

SEQ ID NO: 315224 - protein, 24 aa, Mycobacterium
LALLPLLLVLAFVPVRAGAAAGAA

SEQ ID NO: 315225 - protein, 20 aa, Mycobacterium
LALLYWQWRTMPTVIWDVRM

SEQ ID NO: 315226 - protein, 29 aa, Mycobacterium
LALMFGFYVTCFVFVFGVLGVLMRAVAGV

SEQ ID NO: 315227 - protein, 18 aa, Mycobacterium
LALMGRAQHRDDLRAARD

SEQ ID NO: 315228 - protein, 18 aa, Mycobacterium
LALMIWTNVLFDRVGEGT

SEQ ID NO: 315229 - protein, 20 aa, Mycobacterium
LALMTRRWTLAWVALAGSAL

SEQ ID NO: 315230 - protein, 19 aa, Mycobacterium
LALNRRAASSQGHRIGTVT

SEQ ID NO: 315231 - protein, 35 aa, Mycobacterium
LALNTRLRIPVVIGELLAGIVIGRTGFGWIDAFDP

SEQ ID NO: 315232 - protein, 24 aa, Mycobacterium
LALPAHATAAVAIVQVVIRLAVCW

SEQ ID NO: 315233 - protein, 24 aa, Mycobacterium
LALPDRLWRLGVGGGGTFEEVAVR

SEQ ID NO: 315234 - protein, 26 aa, Mycobacterium
LALPFLFWVWMRHLRDDRGYRPPRAF

SEQ ID NO: 315235 - protein, 19 aa, Mycobacterium
LALPFLVWIWMRRLASDHV

SEQ ID NO: 315236 - protein, 22 aa, Mycobacterium
LALPGLAGILLLTGAGGLLGYR

SEQ ID NO: 315237 - protein, 23 aa, Mycobacterium
LALPLSRYPRLSGFTEANDAYLQ

SEQ ID NO: 315238 - protein, 25 aa, Mycobacterium
LALPMLCFPQVLFGGAIVPVDQMAA

SEQ ID NO: 315239 - protein, 24 aa, Mycobacterium
LALPSFLITLAFTFLYGAAGAVNA

SEQ ID NO: 315240 - protein, 18 aa, Mycobacterium
LALRGRFTPAPQHNSPAA

SEQ ID NO: 315241 - protein, 18 aa, Mycobacterium
LALRHHLLKQLDGQLSGA

SEQ ID NO: 315242 - protein, 28 aa, Mycobacterium
LALRREVWIRYAAAVVFSGLAGITTAAL

SEQ ID NO: 315243 - protein, 17 aa, Mycobacterium
LALRTVFTIAPIVFGLD

SEQ ID NO: 315244 - protein, 18 aa, Mycobacterium
LALSGFGALVADARPGDT

SEQ ID NO: 315245 - protein, 17 aa, Mycobacterium
LALSGFVERVADNEPLI

SEQ ID NO: 315246 - protein, 18 aa, Mycobacterium
LALSRPVGLAVVGLVSVL

SEQ ID NO: 315247 - protein, 25 aa, Mycobacterium
LALSRRPATSQGRRIGTVTTMRDST

SEQ ID NO: 315248 - protein, 24 aa, Mycobacterium
LALSWARLTTVFVIDLLILIVASH

SEQ ID NO: 315249 - protein, 19 aa, Mycobacterium
LALTAVFAPFALYAYKRRT

SEQ ID NO: 315250 - protein, 19 aa, Mycobacterium
LALTGLVATAAWTIGSNLN

SEQ ID NO: 315251 - protein, 19 aa, Mycobacterium
LALVAGFVGWKLYQKLTNN

SEQ ID NO: 315252 - protein, 17 aa, Mycobacterium
LALVAMVMIHFSLPGRM

SEQ ID NO: 315253 - protein, 20 aa, Mycobacterium
LALVGYVAVDAWRGEVTAAR

SEQ ID NO: 315254 - protein, 17 aa, Mycobacterium
LALVLFLGHLVRQIRIE

SEQ ID NO: 315255 - protein, 25 aa, Mycobacterium
LALVYFRLRMMRFFFDGENNQLTLS

SEQ ID NO: 315256 - protein, 22 aa, Mycobacterium
LALWRLDRLDGRRMHRLIPTRW

SEQ ID NO: 315257 - protein, 17 aa, Mycobacterium
LALYLLFVFTQTVRHRD

SEQ ID NO: 315258 - protein, 17 aa, Mycobacterium
LALYPGDKVLIMGVRVG

SEQ ID NO: 315259 - protein, 24 aa, Mycobacterium
LALYRSGVGLERIFDALIGGAVAI

SEQ ID NO: 315260 - protein, 18 aa, Mycobacterium
LALYVVASLLIWTQARLL

SEQ ID NO: 315261 - protein, 18 aa, Mycobacterium
LAMAEGFTGYSLPDDLLS

SEQ ID NO: 315262 - protein, 23 aa, Mycobacterium
LAMAMAALGWLPPAAGALLQEGI

SEQ ID NO: 315263 - protein, 19 aa, Mycobacterium
LAMFEGFFGYSLPDDLLSG

SEQ ID NO: 315264 - protein, 22 aa, Mycobacterium
LAMGSIARWTMGRARHRWPTLG

SEQ ID NO: 315265 - protein, 17 aa, Mycobacterium
LAMMVFSKSFSVLRSAV

SEQ ID NO: 315266 - protein, 18 aa, Mycobacterium
LAMMVFSKSFSVLRSAVT

SEQ ID NO: 315267 - protein, 17 aa, Mycobacterium
LAMMVLSKSFSVLRSAM

SEQ ID NO: 315268 - protein, 17 aa, Mycobacterium
LAMPSILVGWRYAAGTA

SEQ ID NO: 315269 - protein, 17 aa, Mycobacterium
LAMRTIRFELPMMAVAA

SEQ ID NO: 315270 - protein, 30 aa, Mycobacterium
LAMSVLGWHYLRLPSVVGMGQYSLEVDLPT

SEQ ID NO: 315271 - protein, 19 aa, Mycobacterium
LAMVCLMTAVSAPMWLLMQ

SEQ ID NO: 315272 - protein, 19 aa, Mycobacterium
LAMVFPVIGAFPFNGHFTV

SEQ ID NO: 315273 - protein, 17 aa, Mycobacterium
LAMWYPPYRPGRANYML

SEQ ID NO: 315274 - protein, 30 aa, Mycobacterium
LANDMGWNFSAAKDMFGWINPVLAALQGNP

SEQ ID NO: 315275 - protein, 19 aa, Mycobacterium
LANFGRIGVIYNKSLEHAL

SEQ ID NO: 315276 - protein, 24 aa, Mycobacterium
LANFGRIGVIYSKSLEQALVIFPA

SEQ ID NO: 315277 - protein, 19 aa, Mycobacterium
LANGLGFLAGATVGYYLLR

SEQ ID NO: 315278 - protein, 18 aa, Mycobacterium
LANHLVDQGCDGLVVSGT

SEQ ID NO: 315279 - protein, 17 aa, Mycobacterium
LANIRRRPERFVLAVLG

SEQ ID NO: 315280 - protein, 20 aa, Mycobacterium
LANKPPWYRSLFVQLLVAIV

SEQ ID NO: 315281 - protein, 23 aa, Mycobacterium
LANLPHPWFDAIGISDRAADAIM

SEQ ID NO: 315282 - protein, 27 aa, Mycobacterium
LANPGLPLWLFVLCAALTGLGGGNYAA

SEQ ID NO: 315283 - protein, 19 aa, Mycobacterium
LANQARRLLAWVDQRPALA

SEQ ID NO: 315284 - protein, 20 aa, Mycobacterium
LANRCAIRAALIRTADEQHR

SEQ ID NO: 315285 - protein, 25 aa, Mycobacterium
LANRLAWAVEAWPAATRIAKSPLSF

SEQ ID NO: 315286 - protein, 25 aa, Mycobacterium
LANRRLLARIWRFAARHHRRLAVFF

SEQ ID NO: 315287 - protein, 17 aa, Mycobacterium
LANRRWVSPVLLVVGIC

SEQ ID NO: 315288 - protein, 17 aa, Mycobacterium
LAPAENWVDLMLAPKQV

SEQ ID NO: 315289 - protein, 25 aa, Mycobacterium
LAPAIAPVALWLNRNLGFIPLFADS

SEQ ID NO: 315290 - protein, 17 aa, Mycobacterium
LAPARTWTGLVYGQLVM

SEQ ID NO: 315291 - protein, 18 aa, Mycobacterium
LAPASGQGRAFGTYGSYK

SEQ ID NO: 315292 - protein, 27 aa, Mycobacterium
LAPDAMPYRGRYRFHGVELVPASVVLH

SEQ ID NO: 315293 - protein, 17 aa, Mycobacterium
LAPEPGIADIPGLVADF

SEQ ID NO: 315294 - protein, 25 aa, Mycobacterium
LAPFSGTDLTGWIDWVVRGSHELFA

SEQ ID NO: 315295 - protein, 25 aa, Mycobacterium
LAPGIKAKAAFVWDKFPKFVLGFLA

SEQ ID NO: 315296 - protein, 26 aa, Mycobacterium
LAPHRGRWFIRHIIDLLIVALPMMRP

SEQ ID NO: 315297 - protein, 17 aa, Mycobacterium
LAPKFQLALEILDDRLS

SEQ ID NO: 315298 - protein, 42 aa, Mycobacterium
LAPKRLGMQYARRWAGLVAPLLRFLAIVTKPVIWGLGQSTDI

SEQ ID NO: 315299 - protein, 22 aa, Mycobacterium
LAPKRWRLAGIGIGIVAGIKLT

SEQ ID NO: 315300 - protein, 18 aa, Mycobacterium
LAPLAASVAVVFVIIFRD

SEQ ID NO: 315301 - protein, 21 aa, Mycobacterium
LAPLRRALALLGREQVADTDD

SEQ ID NO: 315302 - protein, 19 aa, Mycobacterium
LAPLRRVAQTASRVADLPL

SEQ ID NO: 315303 - protein, 27 aa, Mycobacterium
LAPMGRRLGALCIDWLVAYGLALLGLG

SEQ ID NO: 315304 - protein, 22 aa, Mycobacterium
LAPMPSGTYCKIPQDTPANAVR

SEQ ID NO: 315305 - protein, 17 aa, Mycobacterium
LAPNIFAPLGILVAHIY

SEQ ID NO: 315306 - protein, 18 aa, Mycobacterium
LAPPEVLGVPMLIVATVG

SEQ ID NO: 315307 - protein, 25 aa, Mycobacterium
LAPPPAMPPTLAWWASSLQLSGLSA

SEQ ID NO: 315308 - protein, 25 aa, Mycobacterium
LAPQLRPIATWLNRSMGWCFLFADG

SEQ ID NO: 315309 - protein, 24 aa, Mycobacterium
LAPRAPARRALLLLHLSEFDEITG

SEQ ID NO: 315310 - protein, 23 aa, Mycobacterium
LAPRGVPVLNHIRVPALGAGLTL

SEQ ID NO: 315311 - protein, 27 aa, Mycobacterium
LAPRGWVAICALAMAVASHEVVRRLRE

SEQ ID NO: 315312 - protein, 18 aa, Mycobacterium
LAPRLGAWNAGLAAVGAY

SEQ ID NO: 315313 - protein, 20 aa, Mycobacterium
LAPRLRLAALTGALGVLAVT

SEQ ID NO: 315314 - protein, 17 aa, Mycobacterium
LAPSGAPPRLISDTEAA

SEQ ID NO: 315315 - protein, 25 aa, Mycobacterium
LAPSGFSLFGVFWGAFGLVTGAAFG

SEQ ID NO: 315316 - protein, 25 aa, Mycobacterium
LAPSGFSVFGVFWGAFGLVAGAAFG

SEQ ID NO: 315317 - protein, 25 aa, Mycobacterium
LAPSGFSVFGVFWGAFGLVSGAAFG

SEQ ID NO: 315318 - protein, 25 aa, Mycobacterium
LAPSGFSVFGVFWGAFGLVSGAANG

SEQ ID NO: 315319 - protein, 25 aa, Mycobacterium
LAPTKRAGRRWGSYNIFTLWANDVH

SEQ ID NO: 315320 - protein, 17 aa, Mycobacterium
LAPTLQWFVPGHPPTKA

SEQ ID NO: 315321 - protein, 19 aa, Mycobacterium
LAPTLWGWRRTPVLRWFVL

SEQ ID NO: 315322 - protein, 30 aa, Mycobacterium
LAPTTSWYVIRWVIASALAGPLLMTAISLA

SEQ ID NO: 315323 - protein, 29 aa, Mycobacterium
LAPTVWGWRNRPVWRWFVLGSAVGVVGGW

SEQ ID NO: 315324 - protein, 20 aa, Mycobacterium
LAPVAFVVGVAFNRIMAAAR

SEQ ID NO: 315325 - protein, 35 aa, Mycobacterium
LAPYWGNAHSLGLHAVVSCPIGLATRVLAQSGSLL

SEQ ID NO: 315326 - protein, 25 aa, Mycobacterium
LAQAFSIQLICRILGMLASVVSVML

SEQ ID NO: 315327 - protein, 24 aa, Mycobacterium
LAQALGWRTAFVVMGAISVLFVPV

SEQ ID NO: 315328 - protein, 18 aa, Mycobacterium
LAQGFTGFRRLRALFTQR

SEQ ID NO: 315329 - protein, 25 aa, Mycobacterium
LAQGGMVLRGFVERVGDRSPLVAAD

SEQ ID NO: 315330 - protein, 24 aa, Mycobacterium
LAQHPRLPRHDALKVLSLAATADQ

SEQ ID NO: 315331 - protein, 19 aa, Mycobacterium
LAQHPRLPRQDALKVLRPE

SEQ ID NO: 315332 - protein, 25 aa, Mycobacterium
LAQHPRLPRRDALKVLPAAVSADVE

SEQ ID NO: 315333 - protein, 27 aa, Mycobacterium
LAQHPRLPRRDALKVLPPDVSADTAFR

SEQ ID NO: 315334 - protein, 20 aa, Mycobacterium
LAQKERWLPELMTLEKVAAW

SEQ ID NO: 315335 - protein, 18 aa, Mycobacterium
LAQLPDRYPLKGIFHAAG

SEQ ID NO: 315336 - protein, 20 aa, Mycobacterium
LAQLPLRRGILIGAAQILAL

SEQ ID NO: 315337 - protein, 18 aa, Mycobacterium
LAQLRSWRDQGMNLTVAV

SEQ ID NO: 315338 - protein, 27 aa, Mycobacterium
LAQLTVRGWLALVLWIMGATVLLGAVV

SEQ ID NO: 315339 - protein, 18 aa, Mycobacterium
LAQLWPYASGTMRCPQGR

SEQ ID NO: 315340 - protein, 22 aa, Mycobacterium
LAQNRIRTWSNWFDNNTRSARH

SEQ ID NO: 315341 - protein, 18 aa, Mycobacterium
LAQPAKRRSWLAVGAGAF

SEQ ID NO: 315342 - protein, 19 aa, Mycobacterium
LAQRFGAAVGLPYTADPSE

SEQ ID NO: 315343 - protein, 19 aa, Mycobacterium
LAQRWAKVSAVLFAIGAVS

SEQ ID NO: 315344 - protein, 20 aa, Mycobacterium
LAQRYHRDSLVIARNDATAL

SEQ ID NO: 315345 - protein, 21 aa, Mycobacterium
LAQSLGWRTAFVIMGAVSVVL

SEQ ID NO: 315346 - protein, 18 aa, Mycobacterium
LAQVRARSLAAYENQDVP

SEQ ID NO: 315347 - protein, 19 aa, Mycobacterium
LAQVRARSLGAFENQDVPF

SEQ ID NO: 315348 - protein, 23 aa, Mycobacterium
LARARADLVDGFRRHELWLHLGW

SEQ ID NO: 315349 - protein, 26 aa, Mycobacterium
LARDLRLNRDVAIKVLRADLARDPSF

SEQ ID NO: 315350 - protein, 22 aa, Mycobacterium
LARDPRKPMLVLAAIGLTGFSL

SEQ ID NO: 315351 - protein, 22 aa, Mycobacterium
LARDPRKPVLVLAAIGLCGFAV

SEQ ID NO: 315352 - protein, 22 aa, Mycobacterium
LARDPRKPVLVLAATGLCGFAL

SEQ ID NO: 315353 - protein, 26 aa, Mycobacterium
LARELGRPEFLWVLLTVIGMLSAAAL

SEQ ID NO: 315354 - protein, 19 aa, Mycobacterium
LAREPKRLILIVLGAAGTT

SEQ ID NO: 315355 - protein, 29 aa, Mycobacterium
LARERGWEIRDFRTARKAARIGVPSALAL

SEQ ID NO: 315356 - protein, 24 aa, Mycobacterium
LARFDHKRHVPPYALLAAVIVPAS

SEQ ID NO: 315357 - protein, 25 aa, Mycobacterium
LARFDHKRHVPPYSLLIAVIIPAVL

SEQ ID NO: 315358 - protein, 25 aa, Mycobacterium
LARGGYPSLYSWMVGLIVTELPLQT

SEQ ID NO: 315359 - protein, 19 aa, Mycobacterium
LARHPRLPRQDALKILPTS

SEQ ID NO: 315360 - protein, 19 aa, Mycobacterium
LARHPRLPRQDALKVLRPE

SEQ ID NO: 315361 - protein, 19 aa, Mycobacterium
LARLCFAPVSGQLVQRLGE

SEQ ID NO: 315362 - protein, 18 aa, Mycobacterium
LARLNPFLFFLLAATATL

SEQ ID NO: 315363 - protein, 32 aa, Mycobacterium
LARLRDSFFDWEMYRRAIPVLLTTGLPNTLIL

SEQ ID NO: 315364 - protein, 22 aa, Mycobacterium
LARNPRKPVLVLAAIGLIGYSV

SEQ ID NO: 315365 - protein, 20 aa, Mycobacterium
LARNRCSSLRVELQEDVAVL

SEQ ID NO: 315366 - protein, 23 aa, Mycobacterium
LARPNAAWDRPRVVYLQHASDPI

SEQ ID NO: 315367 - protein, 28 aa, Mycobacterium
LARQRGWEVRDFRTARKAARIGVPSALA

SEQ ID NO: 315368 - protein, 23 aa, Mycobacterium
LARRARRVVAANLTIAATFIAVL

SEQ ID NO: 315369 - protein, 23 aa, Mycobacterium
LARRARRVVIANLVMAGAAITTL

SEQ ID NO: 315370 - protein, 27 aa, Mycobacterium
LARRGIRAVQLIFAWMVLSVRLLVARP

SEQ ID NO: 315371 - protein, 23 aa, Mycobacterium
LARRLPAVIATVILLLLACAPVA

SEQ ID NO: 315372 - protein, 21 aa, Mycobacterium
LARRPELRALLRDNPKQIRVF

SEQ ID NO: 315373 - protein, 18 aa, Mycobacterium
LARRRPDGGAARAIAPWY

SEQ ID NO: 315374 - protein, 17 aa, Mycobacterium
LARRRTAFFVPLLGCVA

SEQ ID NO: 315375 - protein, 17 aa, Mycobacterium
LARRTRRRVNIGFVAGG

SEQ ID NO: 315376 - protein, 21 aa, Mycobacterium
LARSRALRMPYYRTLSTVAYW

SEQ ID NO: 315377 - protein, 21 aa, Mycobacterium
LARSRARAVRLLRPLILLPLV

SEQ ID NO: 315378 - protein, 25 aa, Mycobacterium
LARSRARLMRLMRPLILLPLVLPPV

SEQ ID NO: 315379 - protein, 25 aa, Mycobacterium
LARSRARLVRLLRPLILLPLVLPPV

SEQ ID NO: 315380 - protein, 21 aa, Mycobacterium
LARSRVLRMPFYRTLISVGSW

SEQ ID NO: 315381 - protein, 20 aa, Mycobacterium
LARSWPRSLAGQAIALQVIV

SEQ ID NO: 315382 - protein, 18 aa, Mycobacterium
LARTATRMAVPAGSDVIR

SEQ ID NO: 315383 - protein, 23 aa, Mycobacterium
LARTVCVAVDPDLLVTVNEMTQN

SEQ ID NO: 315384 - protein, 21 aa, Mycobacterium
LARWLPRRTSAAIVVAGVGGA

SEQ ID NO: 315385 - protein, 19 aa, Mycobacterium
LASAAAWKSLSGEYASAAA

SEQ ID NO: 315386 - protein, 17 aa, Mycobacterium
LASAATVAFAFLAMVFA

SEQ ID NO: 315387 - protein, 26 aa, Mycobacterium
LASAFAFGCSGPFAKALMTAGWSPTA

SEQ ID NO: 315388 - protein, 21 aa, Mycobacterium
LASAGLSWVLGVALVLMVVAF

SEQ ID NO: 315389 - protein, 18 aa, Mycobacterium
LASALCIGTGGSVGREGP

SEQ ID NO: 315390 - protein, 19 aa, Mycobacterium
LASDSTLARVVRLVAEAQT

SEQ ID NO: 315391 - protein, 18 aa, Mycobacterium
LASELGISDVRAELLPED

SEQ ID NO: 315392 - protein, 26 aa, Mycobacterium
LASELRRLPVDFGIGISAGPVFAGNI

SEQ ID NO: 315393 - protein, 18 aa, Mycobacterium
LASFDRWQRPPILPPGED

SEQ ID NO: 315394 - protein, 18 aa, Mycobacterium
LASFKVTLTISIIVTLVN

SEQ ID NO: 315395 - protein, 19 aa, Mycobacterium
LASFSYLGALVWARYLERG

SEQ ID NO: 315396 - protein, 31 aa, Mycobacterium
LASFVFLALVLRRGMGLGVAYGIWGASGVAM

SEQ ID NO: 315397 - protein, 21 aa, Mycobacterium
LASGDHSLTYVIEAPPVFFAR

SEQ ID NO: 315398 - protein, 21 aa, Mycobacterium
LASGDIVYWLWVPDGQSPSLA

SEQ ID NO: 315399 - protein, 18 aa, Mycobacterium
LASGPYFKVMLANLAPYW

SEQ ID NO: 315400 - protein, 24 aa, Mycobacterium
LASGPYFKVMLVNLIPPTILQPFV

SEQ ID NO: 315401 - protein, 20 aa, Mycobacterium
LASGVMVRTVLAWMLGSGVP

SEQ ID NO: 315402 - protein, 29 aa, Mycobacterium
LASIGLGVAHPWRLLGLVMLPLIAKAARP

SEQ ID NO: 315403 - protein, 23 aa, Mycobacterium
LASILMLYTIVIVRGMRTAIATR

SEQ ID NO: 315404 - protein, 31 aa, Mycobacterium
LASLLFAGGLVPLVGTWGFDQIAWFVPAHWG

SEQ ID NO: 315405 - protein, 23 aa, Mycobacterium
LASLLLAAGLSWAAIEFTHITGL

SEQ ID NO: 315406 - protein, 25 aa, Mycobacterium
LASLNIIAMIWARLTLYGTSGSARV

SEQ ID NO: 315407 - protein, 22 aa, Mycobacterium
LASLRTSLGILFDADLEQRPAL

SEQ ID NO: 315408 - protein, 17 aa, Mycobacterium
LASLVLIAAGAILDAAE

SEQ ID NO: 315409 - protein, 23 aa, Mycobacterium
LASLWSEGARCMALEDRAEREKA

SEQ ID NO: 315410 - protein, 19 aa, Mycobacterium
LASMTMVWLSVLLYVKVGQ

SEQ ID NO: 315411 - protein, 25 aa, Mycobacterium
LASNEFRHPIAWARATLDGVDALLL

SEQ ID NO: 315412 - protein, 17 aa, Mycobacterium
LASNIALLVAFRAVQGF

SEQ ID NO: 315413 - protein, 20 aa, Mycobacterium
LASPFAFSGLSFFHTIEYQM

SEQ ID NO: 315414 - protein, 18 aa, Mycobacterium
LASPMLELIVPVVEAAAQ

SEQ ID NO: 315415 - protein, 18 aa, Mycobacterium
LASPRADARIGLRGAVVL

SEQ ID NO: 315416 - protein, 23 aa, Mycobacterium
LASRLVGWTSGWLMLTASIVTIS

SEQ ID NO: 315417 - protein, 17 aa, Mycobacterium
LASSVFGALLLLPPTRA

SEQ ID NO: 315418 - protein, 17 aa, Mycobacterium
LASTRVAAGVIVVIPLY

SEQ ID NO: 315419 - protein, 18 aa, Mycobacterium
LASVISWIIVVLVVVLTT

SEQ ID NO: 315420 - protein, 17 aa, Mycobacterium
LASVKWGLKDDGLACIA

SEQ ID NO: 315421 - protein, 17 aa, Mycobacterium
LASVVGRYARTTAALSV

SEQ ID NO: 315422 - protein, 23 aa, Mycobacterium
LASWAVVIVLFWLNRMFVSRRPQ

SEQ ID NO: 315423 - protein, 25 aa, Mycobacterium
LASWPHDRLPEFDIYSPRKAAKKTA

SEQ ID NO: 315424 - protein, 26 aa, Mycobacterium
LASWQARAGAFAIDMLPGAGIIVTLA

SEQ ID NO: 315425 - protein, 25 aa, Mycobacterium
LASYRGVPIVGIILVVLTLVYAFMM

SEQ ID NO: 315426 - protein, 18 aa, Mycobacterium
LATAFSLNGVDWAAKVIS

SEQ ID NO: 315427 - protein, 19 aa, Mycobacterium
LATAIAVAVRPTAAQQPVV

SEQ ID NO: 315428 - protein, 18 aa, Mycobacterium
LATALRLMPRWAWRRVKR

SEQ ID NO: 315429 - protein, 29 aa, Mycobacterium
LATFGRRAAKRSSYLHWGRGVEATQSKFW

SEQ ID NO: 315430 - protein, 18 aa, Mycobacterium
LATFTWFVGAGIGFAVYL

SEQ ID NO: 315431 - protein, 23 aa, Mycobacterium
LATGCLRVRASLTVSPDDLVSGE

SEQ ID NO: 315432 - protein, 27 aa, Mycobacterium
LATGVRRWKGHGAQWAMILSGAQSALV

SEQ ID NO: 315433 - protein, 21 aa, Mycobacterium
LATIAALYAFTGFESIANAAE

SEQ ID NO: 315434 - protein, 21 aa, Mycobacterium
LATIWLRTRLMPTWLVVLTYV

SEQ ID NO: 315435 - protein, 24 aa, Mycobacterium
LATLGSWRWIFIVNIPIGIVGFVL

SEQ ID NO: 315436 - protein, 23 aa, Mycobacterium
LATLKGVLLLAVPQSYAAFGESM

SEQ ID NO: 315437 - protein, 26 aa, Mycobacterium
LATLLFGAFANRWLARRTRRRVNIGF

SEQ ID NO: 315438 - protein, 22 aa, Mycobacterium
LATLSLVFAFVFAPAGAVLGHL

SEQ ID NO: 315439 - protein, 33 aa, Mycobacterium
LATLSVAFNLYWRLRYLFVTEVAFGSHDVAVIV

SEQ ID NO: 315440 - protein, 22 aa, Mycobacterium
LATLWGLGALYWAGGLVGFEPA

SEQ ID NO: 315441 - protein, 26 aa, Mycobacterium
LATMMTGGVSLAVWIAGVARELNLLA

SEQ ID NO: 315442 - protein, 26 aa, Mycobacterium
LATPIIRLGHMLVFFVRALLGIPVAI

SEQ ID NO: 315443 - protein, 20 aa, Mycobacterium
LATRALSFWLNPGVPTRITI

SEQ ID NO: 315444 - protein, 23 aa, Mycobacterium
LATRIGDRLVVLIGLLIAAGGFV

SEQ ID NO: 315445 - protein, 22 aa, Mycobacterium
LATRLHPVLFFLASVTATLPLA

SEQ ID NO: 315446 - protein, 19 aa, Mycobacterium
LATRLTMTVLIPVVAVMTV

SEQ ID NO: 315447 - protein, 26 aa, Mycobacterium
LATRVGFPSMLLFLLVGVIVGEDGFG

SEQ ID NO: 315448 - protein, 19 aa, Mycobacterium
LATSWGGIVYPWGSVTIVG

SEQ ID NO: 315449 - protein, 22 aa, Mycobacterium
LATTCALLAWYSLYRTPEAGAA

SEQ ID NO: 315450 - protein, 18 aa, Mycobacterium
LATTRWLVAILENHQQPD

SEQ ID NO: 315451 - protein, 18 aa, Mycobacterium
LATVIRPRLFSEPERENG

SEQ ID NO: 315452 - protein, 19 aa, Mycobacterium
LATWGVQGLVYFRAYRALH

SEQ ID NO: 315453 - protein, 22 aa, Mycobacterium
LATYGFQHVVAFYAGAVVVPII

SEQ ID NO: 315454 - protein, 18 aa, Mycobacterium
LAVAFGWISVGFQSTAVL

SEQ ID NO: 315455 - protein, 23 aa, Mycobacterium
LAVAFVAFVFWPNPTVPADQPNM

SEQ ID NO: 315456 - protein, 25 aa, Mycobacterium
LAVAGSMTWEILWALILGFALSAVV

SEQ ID NO: 315457 - protein, 20 aa, Mycobacterium
LAVAILFLLVRVVRAPIEAQ

SEQ ID NO: 315458 - protein, 23 aa, Mycobacterium
LAVALRTPWIAWLAVAFVIVALY

SEQ ID NO: 315459 - protein, 22 aa, Mycobacterium
LAVASAWCVGLLALFGVLAVRM

SEQ ID NO: 315460 - protein, 22 aa, Mycobacterium
LAVATAVVWTVALTRPAKVHEA

SEQ ID NO: 315461 - protein, 21 aa, Mycobacterium
LAVAVAVQWIANFVVTVTFPP

SEQ ID NO: 315462 - protein, 20 aa, Mycobacterium
LAVAVPAAWAQTHIIDRDGY

SEQ ID NO: 315463 - protein, 17 aa, Mycobacterium
LAVAVPAAWAQTTIIDE

SEQ ID NO: 315464 - protein, 17 aa, Mycobacterium
LAVAVVIGAAFTALVTK

SEQ ID NO: 315465 - protein, 18 aa, Mycobacterium
LAVAVVIGAAFTGLVTAF

SEQ ID NO: 315466 - protein, 18 aa, Mycobacterium
LAVAWPLAAALRAIPGQN

SEQ ID NO: 315467 - protein, 25 aa, Mycobacterium
LAVCLCPVAATFARPVSPPADPEHA

SEQ ID NO: 315468 - protein, 17 aa, Mycobacterium
LAVCPAAIIAAVTAGLL

SEQ ID NO: 315469 - protein, 24 aa, Mycobacterium
LAVCVLAVICLVAILVEESRQRRA

SEQ ID NO: 315470 - protein, 17 aa, Mycobacterium
LAVDIGFALSVVATAAL

SEQ ID NO: 315471 - protein, 18 aa, Mycobacterium
LAVDMGFALSVVATAGLV

SEQ ID NO: 315472 - protein, 23 aa, Mycobacterium
LAVDSWMCAISGRAKQFNMIPYF

SEQ ID NO: 315473 - protein, 24 aa, Mycobacterium
LAVFAICIYGGYFGAAAGVLLLAM

SEQ ID NO: 315474 - protein, 26 aa, Mycobacterium
LAVFFPWNLYFGFRIPGSSNYVLAVL

SEQ ID NO: 315475 - protein, 28 aa, Mycobacterium
LAVFRGFPWKQVIPFILAQVGGAFVAAL

SEQ ID NO: 315476 - protein, 29 aa, Mycobacterium
LAVGADSAWLLGVGRVFSGLALGLAMAVG

SEQ ID NO: 315477 - protein, 19 aa, Mycobacterium
LAVGAEWGGAALLSVEHAP

SEQ ID NO: 315478 - protein, 20 aa, Mycobacterium
LAVGFLGEIVRRCVVAAVGA

SEQ ID NO: 315479 - protein, 20 aa, Mycobacterium
LAVGGEWSGAALLSAEYSPS

SEQ ID NO: 315480 - protein, 19 aa, Mycobacterium
LAVGGGVTFTVLRSRRQRS

SEQ ID NO: 315481 - protein, 17 aa, Mycobacterium
LAVGMAYSAVVAAELFN

SEQ ID NO: 315482 - protein, 17 aa, Mycobacterium
LAVGMAYSSVVAAELFN

SEQ ID NO: 315483 - protein, 18 aa, Mycobacterium
LAVILAWLLIVVVTSRLL

SEQ ID NO: 315484 - protein, 18 aa, Mycobacterium
LAVIRRGVIPASWGGKVK

SEQ ID NO: 315485 - protein, 17 aa, Mycobacterium
LAVLIRYAGGRWWIPVV

SEQ ID NO: 315486 - protein, 24 aa, Mycobacterium
LAVLKAGAAYLAIDPVMPSARIDF

SEQ ID NO: 315487 - protein, 19 aa, Mycobacterium
LAVLLLIMRYRRRRRRAAD

SEQ ID NO: 315488 - protein, 17 aa, Mycobacterium
LAVLMLLPLSAFEAMTP

SEQ ID NO: 315489 - protein, 20 aa, Mycobacterium
LAVLMLLPLSAFEATTALPA

SEQ ID NO: 315490 - protein, 19 aa, Mycobacterium
LAVLRGRIASAYVSSIGMV

SEQ ID NO: 315491 - protein, 18 aa, Mycobacterium
LAVLRPGLPVVLMAVILY

SEQ ID NO: 315492 - protein, 18 aa, Mycobacterium
LAVLSVFAIIAFTAFHAG

SEQ ID NO: 315493 - protein, 18 aa, Mycobacterium
LAVLTIVVVIAFNTFGGG

SEQ ID NO: 315494 - protein, 18 aa, Mycobacterium
LAVLTIVVVIAFNTFGGT

SEQ ID NO: 315495 - protein, 27 aa, Mycobacterium
LAVLVVGLWWRYRYDKFGWTSRSSQIY

SEQ ID NO: 315496 - protein, 20 aa, Mycobacterium
LAVMCIRNFGNAVLLLAIWI

SEQ ID NO: 315497 - protein, 28 aa, Mycobacterium
LAVMIVACLWCARDLWRRGTPAVWCTVA

SEQ ID NO: 315498 - protein, 24 aa, Mycobacterium
LAVPDMPAAPLVFASKPAKTGDDA

SEQ ID NO: 315499 - protein, 24 aa, Mycobacterium
LAVPGLFALAALWLTRGGRIPDQR

SEQ ID NO: 315500 - protein, 19 aa, Mycobacterium
LAVPGRFGPAHIMLAAAGV

SEQ ID NO: 315501 - protein, 36 aa, Mycobacterium
LAVPGVYARLVLLWFLCSAFPIGVIATLVMLRSYGW

SEQ ID NO: 315502 - protein, 17 aa, Mycobacterium
LAVPLLVALFVIADEGH

SEQ ID NO: 315503 - protein, 26 aa, Mycobacterium
LAVPLRVGVAVTLVFVAGGVFGHRDV

SEQ ID NO: 315504 - protein, 24 aa, Mycobacterium
LAVPRTPPAPVIIKPGADAAAQFA

SEQ ID NO: 315505 - protein, 18 aa, Mycobacterium
LAVQCKRLSRPVGAGAVQ

SEQ ID NO: 315506 - protein, 20 aa, Mycobacterium
LAVRFVFYGVPFPGFGSLVS

SEQ ID NO: 315507 - protein, 21 aa, Mycobacterium
LAVRGVRNVPCETVPGKRAPT

SEQ ID NO: 315508 - protein, 17 aa, Mycobacterium
LAVRGWPLRGLAALLAM

SEQ ID NO: 315509 - protein, 20 aa, Mycobacterium
LAVRTWLFALSWMVIGVIVY

SEQ ID NO: 315510 - protein, 25 aa, Mycobacterium
LAVRVEPRVAVSGLRVSVVMVATPV

SEQ ID NO: 315511 - protein, 24 aa, Mycobacterium
LAVSAVAVLLAWIALYVRVSAPIN

SEQ ID NO: 315512 - protein, 29 aa, Mycobacterium
LAVSESVSWPGWAVVGVTLVFGLLIGAVT

SEQ ID NO: 315513 - protein, 17 aa, Mycobacterium
LAVSIYLDARPEPVFAR

SEQ ID NO: 315514 - protein, 18 aa, Mycobacterium
LAVSLGIGAGIGAIFGAP

SEQ ID NO: 315515 - protein, 21 aa, Mycobacterium
LAVSPLPNWLGDSLRAAAAGV

SEQ ID NO: 315516 - protein, 20 aa, Mycobacterium
LAVSVAFLLFYLVCLGETAT

SEQ ID NO: 315517 - protein, 17 aa, Mycobacterium
LAVSYLTTQTVVFLISG

SEQ ID NO: 315518 - protein, 31 aa, Mycobacterium
LAVTGFICHVGWEVSSEIGHRLLDGVDPGVV

SEQ ID NO: 315519 - protein, 19 aa, Mycobacterium
LAVTLEFLGPLTVAIAGSR

SEQ ID NO: 315520 - protein, 19 aa, Mycobacterium
LAVTLVWLYVEILRLLSYF

SEQ ID NO: 315521 - protein, 23 aa, Mycobacterium
LAVTVIALVYAWRQYLKAKERRA

SEQ ID NO: 315522 - protein, 17 aa, Mycobacterium
LAVTWWVIALLHLGRIS

SEQ ID NO: 315523 - protein, 19 aa, Mycobacterium
LAVVAAVCAFAFMNNLAEA

SEQ ID NO: 315524 - protein, 19 aa, Mycobacterium
LAVVAAVCAFAFMNNLSEA

SEQ ID NO: 315525 - protein, 19 aa, Mycobacterium
LAVVAAVCAFGFMNNLTEA

SEQ ID NO: 315526 - protein, 24 aa, Mycobacterium
LAVVAIGCAVGFPLLTTLALQTSS

SEQ ID NO: 315527 - protein, 24 aa, Mycobacterium
LAVVCLSIGLATEFALQRFLMHQL

SEQ ID NO: 315528 - protein, 24 aa, Mycobacterium
LAVVGVPVWAWVLWALVTVAAALL

SEQ ID NO: 315529 - protein, 17 aa, Mycobacterium
LAVVVVLAFARDRLAGP

SEQ ID NO: 315530 - protein, 17 aa, Mycobacterium
LAVVWVLRRKIFSRASR

SEQ ID NO: 315531 - protein, 20 aa, Mycobacterium
LAVVYALIGTIAMEFTTAQA

SEQ ID NO: 315532 - protein, 21 aa, Mycobacterium
LAVWVGLPLWLMAMLLMAALT

SEQ ID NO: 315533 - protein, 20 aa, Mycobacterium
LAWATALMVFFEWGVMVHEL

SEQ ID NO: 315534 - protein, 26 aa, Mycobacterium
LAWGGIREGHRWARNALLISGTVSFL

SEQ ID NO: 315535 - protein, 19 aa, Mycobacterium
LAWLTWRCTERRWARPASH

SEQ ID NO: 315536 - protein, 26 aa, Mycobacterium
LAWMTIDALVWVPRMLYLYGESNKGL

SEQ ID NO: 315537 - protein, 22 aa, Mycobacterium
LAWNGQIAWWLDMVVFGIYQVT

SEQ ID NO: 315538 - protein, 22 aa, Mycobacterium
LAWNGQIAWWLDMVVFGIYTGV

SEQ ID NO: 315539 - protein, 19 aa, Mycobacterium
LAWPADLKVGPDGLGNSPE

SEQ ID NO: 315540 - protein, 17 aa, Mycobacterium
LAWPSSRAQWQRWQPMA

SEQ ID NO: 315541 - protein, 25 aa, Mycobacterium
LAWQWRAHRGPGMVVALSTGMVTAA

SEQ ID NO: 315542 - protein, 22 aa, Mycobacterium
LAWRDSWEYWTDTLLHTDRIGS

SEQ ID NO: 315543 - protein, 20 aa, Mycobacterium
LAWTAPLLGWVWWVYTVAAV

SEQ ID NO: 315544 - protein, 19 aa, Mycobacterium
LAWTHHWVWTVPLMVLLVN

SEQ ID NO: 315545 - protein, 18 aa, Mycobacterium
LAWWLLDALWRPVRGRLA

SEQ ID NO: 315546 - protein, 22 aa, Mycobacterium
LAYATLKWARIDPEMYPELVSA

SEQ ID NO: 315547 - protein, 22 aa, Mycobacterium
LAYCLGLGIPFVLLALGSARAV

SEQ ID NO: 315548 - protein, 22 aa, Mycobacterium
LAYGLGLWWGVLRERNLRALKP

SEQ ID NO: 315549 - protein, 22 aa, Mycobacterium
LAYGVGLGSNWLVQRVGGRSAV

SEQ ID NO: 315550 - protein, 23 aa, Mycobacterium
LAYPIGRRLAAPSVTNPPPAALA

SEQ ID NO: 315551 - protein, 20 aa, Mycobacterium
LAYRTRPVFVPNNDNDPVAR

SEQ ID NO: 315552 - protein, 20 aa, Mycobacterium
LAYRTRPVFVPTAGPNDPVA

SEQ ID NO: 315553 - protein, 20 aa, Mycobacterium
LCAAAYAPYLAWLMQASTDT

SEQ ID NO: 315554 - protein, 18 aa, Mycobacterium
LCAAPVAAVGFVLALFLK

SEQ ID NO: 315555 - protein, 24 aa, Mycobacterium
LCAATLGVLGQRWYSGLGDQPARP

SEQ ID NO: 315556 - protein, 23 aa, Mycobacterium
LCACTEAVLFAWLIHALAHPTPP

SEQ ID NO: 315557 - protein, 23 aa, Mycobacterium
LCAEALGEFVDWSLLDVVNGVAG

SEQ ID NO: 315558 - protein, 26 aa, Mycobacterium
LCALAVGLKFKLGFDDSLDVVGVHLV

SEQ ID NO: 315559 - protein, 26 aa, Mycobacterium
LCALMAGVWFLHWPTRAESIAFSILS

SEQ ID NO: 315560 - protein, 18 aa, Mycobacterium
LCAPPLASAEPGFTPPDT

SEQ ID NO: 315561 - protein, 23 aa, Mycobacterium
LCAPTFAGLAARLGFSCDDAGGL

SEQ ID NO: 315562 - protein, 22 aa, Mycobacterium
LCASFPTLNWWWAAVIAAALLA

SEQ ID NO: 315563 - protein, 24 aa, Mycobacterium
LCASQLVGLGIMRYGLRSEPMHSM

SEQ ID NO: 315564 - protein, 24 aa, Mycobacterium
LCAVAPNIACLIIFRAVQGGGGGI

SEQ ID NO: 315565 - protein, 26 aa, Mycobacterium
LCAVAPNILLLILFRVVQGVGGGMLL

SEQ ID NO: 315566 - protein, 32 aa, Mycobacterium
LCAVLVRGLPGWPVWFALVWAAQEWLKSLVPF

SEQ ID NO: 315567 - protein, 19 aa, Mycobacterium
LCAVTAIISVIVPFAAGLA

SEQ ID NO: 315568 - protein, 17 aa, Mycobacterium
LCCGQRWLSNADPFEVY

SEQ ID NO: 315569 - protein, 18 aa, Mycobacterium
LCDARADVLAALRETLVE

SEQ ID NO: 315570 - protein, 17 aa, Mycobacterium
LCDHHGASLIVTVGHTA

SEQ ID NO: 315571 - protein, 19 aa, Mycobacterium
LCDHPRLYFSRNATPGRDE

SEQ ID NO: 315572 - protein, 21 aa, Mycobacterium
LCDRCLEGFPPTGAARAGNGH

SEQ ID NO: 315573 - protein, 20 aa, Mycobacterium
LCFLAALLPLARRTPVRVAA

SEQ ID NO: 315574 - protein, 28 aa, Mycobacterium
LCGQANWWPSASVESWFRQRFSRSKPDA

SEQ ID NO: 315575 - protein, 19 aa, Mycobacterium
LCGRFRVALELLGLARLML

SEQ ID NO: 315576 - protein, 23 aa, Mycobacterium
LCHLARRSLHHTVLCRDDVPRAI

SEQ ID NO: 315577 - protein, 19 aa, Mycobacterium
LCIAEPLGYFLASLATAVC

SEQ ID NO: 315578 - protein, 23 aa, Mycobacterium
LCIGWCAVNTWIVLDLVMALLGR

SEQ ID NO: 315579 - protein, 25 aa, Mycobacterium
LCILAGLVYVGWRLSRAASEKSRTR

SEQ ID NO: 315580 - protein, 17 aa, Mycobacterium
LCIRGPYVMQGYYKRSR

SEQ ID NO: 315581 - protein, 22 aa, Mycobacterium
LCIVPGLIFGFLAQFAIIAAVD

SEQ ID NO: 315582 - protein, 20 aa, Mycobacterium
LCIVPGLIVSIFALFTTVFI

SEQ ID NO: 315583 - protein, 21 aa, Mycobacterium
LCLACKGCTSDCPVDVDIPTY

SEQ ID NO: 315584 - protein, 20 aa, Mycobacterium
LCLAILLPLGMFLDGISMIL

SEQ ID NO: 315585 - protein, 26 aa, Mycobacterium
LCLHFTRLPYFQTMGVPLAIGMLIVV

SEQ ID NO: 315586 - protein, 18 aa, Mycobacterium
LCLIFIIMLIITRGFVAS

SEQ ID NO: 315587 - protein, 18 aa, Mycobacterium
LCLIFIIMLIITRSFIAA

SEQ ID NO: 315588 - protein, 18 aa, Mycobacterium
LCLIFIIMLILTRALIAA

SEQ ID NO: 315589 - protein, 30 aa, Mycobacterium
LCLRDVPWKRPRVRPAMLVEGLVVGTIVVF

SEQ ID NO: 315590 - protein, 17 aa, Mycobacterium
LCPRSLYLRNGVLETAS

SEQ ID NO: 315591 - protein, 21 aa, Mycobacterium
LCQTNCRARLLTAAQMNDAVA

SEQ ID NO: 315592 - protein, 23 aa, Mycobacterium
LCRLVRLLLWLSVIPVIECSLGG

SEQ ID NO: 315593 - protein, 25 aa, Mycobacterium
LCRPIPRLGGHPALSPEPVSSGIQV

SEQ ID NO: 315594 - protein, 18 aa, Mycobacterium
LCRRHFRPWRLLGGLAVL

SEQ ID NO: 315595 - protein, 22 aa, Mycobacterium
LCVAIIAVIFIKGFGASAPTTD

SEQ ID NO: 315596 - protein, 21 aa, Mycobacterium
LCVALGVPMALVLARSTARLV

SEQ ID NO: 315597 - protein, 21 aa, Mycobacterium
LCVGALLVGLVVAVRVAGLSR

SEQ ID NO: 315598 - protein, 22 aa, Mycobacterium
LCVIAVSIAVGWVRRRPLNGRT

SEQ ID NO: 315599 - protein, 20 aa, Mycobacterium
LCVLAIPLTASIGISVYHDR

SEQ ID NO: 315600 - protein, 17 aa, Mycobacterium
LCVLIAVLAWCIAVLAL

SEQ ID NO: 315601 - protein, 21 aa, Mycobacterium
LCVLSAALALNLWVGYFPTVQ

SEQ ID NO: 315602 - protein, 20 aa, Mycobacterium
LCVLSVPPLAVFVLLVSLIY

SEQ ID NO: 315603 - protein, 21 aa, Mycobacterium
LCYLGFGVPAAMVFLSDYASY

SEQ ID NO: 315604 - protein, 18 aa, Mycobacterium
LDAACDRISDGAVFSGLL

SEQ ID NO: 315605 - protein, 21 aa, Mycobacterium
LDAALAFAVWLSVPGAGRLRG

SEQ ID NO: 315606 - protein, 27 aa, Mycobacterium
LDAARLLTWRASWMAATGVPFERGEGS

SEQ ID NO: 315607 - protein, 19 aa, Mycobacterium
LDAATAWKAEGVRIPVAVN

SEQ ID NO: 315608 - protein, 18 aa, Mycobacterium
LDADGLLDTSLRWQATVI

SEQ ID NO: 315609 - protein, 30 aa, Mycobacterium
LDAELGLAVARRLDCRVVQGYGMSELSPVS

SEQ ID NO: 315610 - protein, 33 aa, Mycobacterium
LDAESPWKLLGRFGYHFSSLIAIVVLLAVGMSA

SEQ ID NO: 315611 - protein, 17 aa, Mycobacterium
LDAFGLPVILAGFLIAI

SEQ ID NO: 315612 - protein, 19 aa, Mycobacterium
LDAFKRLNDTYGHLAGDQA

SEQ ID NO: 315613 - protein, 19 aa, Mycobacterium
LDAFTEFNRTSVIIVGVPI

SEQ ID NO: 315614 - protein, 21 aa, Mycobacterium
LDAGRFRVALFILSAAMTGCF

SEQ ID NO: 315615 - protein, 23 aa, Mycobacterium
LDAHLRLPLRQVMWGTDEGLLES

SEQ ID NO: 315616 - protein, 17 aa, Mycobacterium
LDAIMFAFRRPFQGREF

SEQ ID NO: 315617 - protein, 19 aa, Mycobacterium
LDALDARPILHRILHGQRS

SEQ ID NO: 315618 - protein, 20 aa, Mycobacterium
LDALLAFAVWASVPGTGRLS

SEQ ID NO: 315619 - protein, 18 aa, Mycobacterium
LDALLAIIRRTRAGRSPF

SEQ ID NO: 315620 - protein, 17 aa, Mycobacterium
LDALLLAAIGLSNSGID

SEQ ID NO: 315621 - protein, 25 aa, Mycobacterium
LDALVVAVLVWWQFVGANTSDDGYI

SEQ ID NO: 315622 - protein, 23 aa, Mycobacterium
LDAMPWEPPSVFLMRRGANDTYT

SEQ ID NO: 315623 - protein, 19 aa, Mycobacterium
LDAPTAWVVSPIGMAGKIE

SEQ ID NO: 315624 - protein, 25 aa, Mycobacterium
LDAQPRLAILLGDYAVPVEGRVALL

SEQ ID NO: 315625 - protein, 24 aa, Mycobacterium
LDARIDRWLLPPSETAALQHEVSA

SEQ ID NO: 315626 - protein, 20 aa, Mycobacterium
LDARLPRVVLAAVVGAGLAA

SEQ ID NO: 315627 - protein, 18 aa, Mycobacterium
LDASRADEGRSWFGDTDI

SEQ ID NO: 315628 - protein, 18 aa, Mycobacterium
LDATIGIVHVKQVFEVPR

SEQ ID NO: 315629 - protein, 18 aa, Mycobacterium
LDATISWTSDGIKESVQN

SEQ ID NO: 315630 - protein, 19 aa, Mycobacterium
LDATITWTSDGIKESVQNA

SEQ ID NO: 315631 - protein, 27 aa, Mycobacterium
LDATVVRMFLVPSVMKLLGDDCWWAPR

SEQ ID NO: 315632 - protein, 17 aa, Mycobacterium
LDAVIARGMAKRPEDRY

SEQ ID NO: 315633 - protein, 21 aa, Mycobacterium
LDAVLALAVWLSAPGTGRLRP

SEQ ID NO: 315634 - protein, 17 aa, Mycobacterium
LDAVSLLVAGEPCPGEV

SEQ ID NO: 315635 - protein, 20 aa, Mycobacterium
LDAVTRWQARVIRMDGRRID

SEQ ID NO: 315636 - protein, 22 aa, Mycobacterium
LDAYDVRRFFRRVFGRPEPEPK

SEQ ID NO: 315637 - protein, 17 aa, Mycobacterium
LDAYGVRHLVLASRRGD

SEQ ID NO: 315638 - protein, 25 aa, Mycobacterium
LDCFRPGTCERLGIGPKECEAVNPR

SEQ ID NO: 315639 - protein, 18 aa, Mycobacterium
LDDELRYGTPPAAAARLA

SEQ ID NO: 315640 - protein, 18 aa, Mycobacterium
LDDLPGFLRSHDPGARDE

SEQ ID NO: 315641 - protein, 17 aa, Mycobacterium
LDDLRPYFAGYLPALLS

SEQ ID NO: 315642 - protein, 18 aa, Mycobacterium
LDDPRWIGMLAAVLTVSG

SEQ ID NO: 315643 - protein, 22 aa, Mycobacterium
LDDRAAAVAATLAERGVGAESR

SEQ ID NO: 315644 - protein, 26 aa, Mycobacterium
LDDYLRFLNDWQRPFIGRKTFMDLVT

SEQ ID NO: 315645 - protein, 17 aa, Mycobacterium
LDEALPGVIQRCARTPL

SEQ ID NO: 315646 - protein, 19 aa, Mycobacterium
LDECGACGLWFEQVAGQAS

SEQ ID NO: 315647 - protein, 27 aa, Mycobacterium
LDEDLAWRDVLGLALLAGIGFTVSLLI

SEQ ID NO: 315648 - protein, 25 aa, Mycobacterium
LDEGGDLWCQAALVLAAGAASAGDA

SEQ ID NO: 315649 - protein, 19 aa, Mycobacterium
LDELIGFFVNTLVLRLDLS

SEQ ID NO: 315650 - protein, 20 aa, Mycobacterium
LDELIGFFVNTLVLRVDLAG

SEQ ID NO: 315651 - protein, 27 aa, Mycobacterium
LDERLAKFHFWLTFLGFHATFLVQHWL

SEQ ID NO: 315652 - protein, 17 aa, Mycobacterium
LDERLGKFHFWLTFIGF

SEQ ID NO: 315653 - protein, 23 aa, Mycobacterium
LDFPGRDALFWVYIATLMVPGTV

SEQ ID NO: 315654 - protein, 17 aa, Mycobacterium
LDFTGVALGALFFCVSL

SEQ ID NO: 315655 - protein, 20 aa, Mycobacterium
LDGFCLYPESPLRLANGTVT

SEQ ID NO: 315656 - protein, 17 aa, Mycobacterium
LDGFCSGLADALHGSGV

SEQ ID NO: 315657 - protein, 18 aa, Mycobacterium
LDGFRYLAGHKIVLMSFV

SEQ ID NO: 315658 - protein, 22 aa, Mycobacterium
LDGGAPFYGCYETADGGYVAVG

SEQ ID NO: 315659 - protein, 23 aa, Mycobacterium
LDGGAPFYGCYETADGKYLAVGA

SEQ ID NO: 315660 - protein, 30 aa, Mycobacterium
LDGLALIIGLCWLAIGFVWLAGVTRGFQRP

SEQ ID NO: 315661 - protein, 27 aa, Mycobacterium
LDGLGRYRVVSALSRRGDELIVTGLSM

SEQ ID NO: 315662 - protein, 24 aa, Mycobacterium
LDGLLRPVPPGVVGELYIAGHGVG

SEQ ID NO: 315663 - protein, 18 aa, Mycobacterium
LDGLRPYFTGYLPALLLA

SEQ ID NO: 315664 - protein, 32 aa, Mycobacterium
LDGPPTLGRLLFDWRFDLVLGTAAIVLALVYL

SEQ ID NO: 315665 - protein, 18 aa, Mycobacterium
LDGPSVYHDVFSYLVRAQ

SEQ ID NO: 315666 - protein, 17 aa, Mycobacterium
LDGPVLVITAYRVLPEN

SEQ ID NO: 315667 - protein, 17 aa, Mycobacterium
LDGRRVPVVDIRDGQSI

SEQ ID NO: 315668 - protein, 19 aa, Mycobacterium
LDGSLVRLGRPGWIQPGPL

SEQ ID NO: 315669 - protein, 18 aa, Mycobacterium
LDGTLSFLSLPRLTKTLS

SEQ ID NO: 315670 - protein, 19 aa, Mycobacterium
LDGVVGWSALAGFVASTAA

SEQ ID NO: 315671 - protein, 25 aa, Mycobacterium
LDGWAGVAPPDGWTRADTERIRVAL

SEQ ID NO: 315672 - protein, 20 aa, Mycobacterium
LDGWSLPILLREVFASYYGQ

SEQ ID NO: 315673 - protein, 19 aa, Mycobacterium
LDGYCLYPESPLRLTNGSI

SEQ ID NO: 315674 - protein, 32 aa, Mycobacterium
LDHAVAGWLVHWPWFFGVSVWLIVIFGTSFGW

SEQ ID NO: 315675 - protein, 27 aa, Mycobacterium
LDHELRFAQMFPLARLVRDAMRGAVRP

SEQ ID NO: 315676 - protein, 18 aa, Mycobacterium
LDHRFGWSSVPPAICAAG

SEQ ID NO: 315677 - protein, 19 aa, Mycobacterium
LDHRFGWSSVPTAVCLIGD

SEQ ID NO: 315678 - protein, 17 aa, Mycobacterium
LDHSMIFIFIAGSYTPF

SEQ ID NO: 315679 - protein, 18 aa, Mycobacterium
LDHSMIFLFIAGSYTPFA

SEQ ID NO: 315680 - protein, 22 aa, Mycobacterium
LDHVFTLSVPNLWRETPAPYGP

SEQ ID NO: 315681 - protein, 21 aa, Mycobacterium
LDHVFTLSVPSLWRETPAPYG

SEQ ID NO: 315682 - protein, 21 aa, Mycobacterium
LDHVFTLSVPSMWRETPAPYG

SEQ ID NO: 315683 - protein, 17 aa, Mycobacterium
LDIGPLISYETTFSDLA

SEQ ID NO: 315684 - protein, 21 aa, Mycobacterium
LDILLFYVFFEAMLIPMYFLI

SEQ ID NO: 315685 - protein, 21 aa, Mycobacterium
LDIPAASGFTSEPALGVSAQV

SEQ ID NO: 315686 - protein, 19 aa, Mycobacterium
LDIPGVENFTGELYFTSSW

SEQ ID NO: 315687 - protein, 25 aa, Mycobacterium
LDISSARFWKAVAHHYVRLTYDALA

SEQ ID NO: 315688 - protein, 17 aa, Mycobacterium
LDKEGKAAWSRAMSGAL

SEQ ID NO: 315689 - protein, 18 aa, Mycobacterium
LDKKFWWPLPMTQLWRRT

SEQ ID NO: 315690 - protein, 17 aa, Mycobacterium
LDKLGCRASHTAELKFN

SEQ ID NO: 315691 - protein, 17 aa, Mycobacterium
LDKLGCRASHTAELLLE

SEQ ID NO: 315692 - protein, 22 aa, Mycobacterium
LDKLPWPAPTVFLMRRGAGPGS

SEQ ID NO: 315693 - protein, 21 aa, Mycobacterium
LDKYSPSFFCMMRNYHDVEPK

SEQ ID NO: 315694 - protein, 20 aa, Mycobacterium
LDLAACLAVGYTAFLLCPVE

SEQ ID NO: 315695 - protein, 20 aa, Mycobacterium
LDLAAELGLNTWAVEDAVAP

SEQ ID NO: 315696 - protein, 18 aa, Mycobacterium
LDLAVTIERLLRTHGLPP

SEQ ID NO: 315697 - protein, 17 aa, Mycobacterium
LDLDLSMFVLCSSIAAT

SEQ ID NO: 315698 - protein, 25 aa, Mycobacterium
LDLFMAQRFMLAWRQWLTARLTSDW

SEQ ID NO: 315699 - protein, 19 aa, Mycobacterium
LDLIRGVSLPMIAIFVLGT

SEQ ID NO: 315700 - protein, 21 aa, Mycobacterium
LDLIRGVSLPMIVIFIAGTCV

SEQ ID NO: 315701 - protein, 21 aa, Mycobacterium
LDLPGRPALLGSRGPDGKPYA

SEQ ID NO: 315702 - protein, 28 aa, Mycobacterium
LDLPPILQPFLDYAFGFRRGVDAGQPPD

SEQ ID NO: 315703 - protein, 25 aa, Mycobacterium
LDLRQWWTRVAWLAQRPVLIPGTVR

SEQ ID NO: 315704 - protein, 24 aa, Mycobacterium
LDLSCWRLAYNGAEPVSAATIERF

SEQ ID NO: 315705 - protein, 20 aa, Mycobacterium
LDLSDAVCRPDRCRAVEGNV

SEQ ID NO: 315706 - protein, 19 aa, Mycobacterium
LDLSIAVVAVRTFAISRGV

SEQ ID NO: 315707 - protein, 23 aa, Mycobacterium
LDLSRIDAGLPLDRHDTDLAEIV

SEQ ID NO: 315708 - protein, 23 aa, Mycobacterium
LDLSRIDAGLPLDRHDVDLAALA

SEQ ID NO: 315709 - protein, 22 aa, Mycobacterium
LDLSSWRLAYNGAEPVSPATIE

SEQ ID NO: 315710 - protein, 17 aa, Mycobacterium
LDLVGTFAFGLNGALTA

SEQ ID NO: 315711 - protein, 28 aa, Mycobacterium
LDLVPWAQPVNWWLLLAGFGVFITPVGR

SEQ ID NO: 315712 - protein, 26 aa, Mycobacterium
LDMFGVCLRSGMPVATAALVVAAAAP

SEQ ID NO: 315713 - protein, 20 aa, Mycobacterium
LDMIGLVLLPRMAKRSGHEH

SEQ ID NO: 315714 - protein, 19 aa, Mycobacterium
LDMLAVAGVWVTLCMGVAG

SEQ ID NO: 315715 - protein, 27 aa, Mycobacterium
LDMLGGLAHRMRCTTTFFGIAALGASG

SEQ ID NO: 315716 - protein, 19 aa, Mycobacterium
LDMRLEVGDTLVITGPSGS

SEQ ID NO: 315717 - protein, 19 aa, Mycobacterium
LDNPWGLAVDNMGTVYVGG

SEQ ID NO: 315718 - protein, 29 aa, Mycobacterium
LDPAAAVQAPWPLLRTFAAGPALSREAAL

SEQ ID NO: 315719 - protein, 25 aa, Mycobacterium
LDPENGVVVVAVWFDRGTDTQGRLL

SEQ ID NO: 315720 - protein, 20 aa, Mycobacterium
LDPKRLIEVRGWRRVGTVVV

SEQ ID NO: 315721 - protein, 40 aa, Mycobacterium
LDPKRMIKVRGWRRIGTATVRWPGPIFVASLLIALVGMLV

SEQ ID NO: 315722 - protein, 24 aa, Mycobacterium
LDPLPRWVRPDVLSSGDLVISGVL

SEQ ID NO: 315723 - protein, 17 aa, Mycobacterium
LDPLRRLAVVAVIAAAI

SEQ ID NO: 315724 - protein, 22 aa, Mycobacterium
LDPLRRLTVIAVIAAAIASSTW

SEQ ID NO: 315725 - protein, 25 aa, Mycobacterium
LDPMLRFASLQTVFNRGRTLLIATS

SEQ ID NO: 315726 - protein, 22 aa, Mycobacterium
LDPRAGNMVRAVWFDAPEASGQ

SEQ ID NO: 315727 - protein, 25 aa, Mycobacterium
LDPRQRLRVPIGISDHGVRVDLDLN

SEQ ID NO: 315728 - protein, 24 aa, Mycobacterium
LDPRTLWRNPVMFIVEIGATWATA

SEQ ID NO: 315729 - protein, 23 aa, Mycobacterium
LDPRTLWRNPVMFIVELGAVWST

SEQ ID NO: 315730 - protein, 24 aa, Mycobacterium
LDPSWEAAVALARIHHLAWGPEIV

SEQ ID NO: 315731 - protein, 18 aa, Mycobacterium
LDPSWPAHRRRQVLADSG

SEQ ID NO: 315732 - protein, 22 aa, Mycobacterium
LDPTAAINMAWRAAGGAAGPLG

SEQ ID NO: 315733 - protein, 24 aa, Mycobacterium
LDPTARQAWQWLVTEVPQRSLHNW

SEQ ID NO: 315734 - protein, 21 aa, Mycobacterium
LDPTLRFASLQTVFNRGRSLL

SEQ ID NO: 315735 - protein, 18 aa, Mycobacterium
LDPVDWWRQLSWLPQRSV

SEQ ID NO: 315736 - protein, 18 aa, Mycobacterium
LDPWDVFHQGLALRTGMT

SEQ ID NO: 315737 - protein, 19 aa, Mycobacterium
LDPWDVFHQGLAMRTGMSI

SEQ ID NO: 315738 - protein, 17 aa, Mycobacterium
LDPYVRDGWAFVAIRLT

SEQ ID NO: 315739 - protein, 17 aa, Mycobacterium
LDQAAAFLLTMRNDASS

SEQ ID NO: 315740 - protein, 19 aa, Mycobacterium
LDQGYSYGLLWVAAVAVIV

SEQ ID NO: 315741 - protein, 25 aa, Mycobacterium
LDQLSFAMPARWGYAAAASTVDLRH

SEQ ID NO: 315742 - protein, 25 aa, Mycobacterium
LDQMSWFTPARWGFAASASTVDLIR

SEQ ID NO: 315743 - protein, 22 aa, Mycobacterium
LDQPRVYFGPVIANTSADYAIV

SEQ ID NO: 315744 - protein, 25 aa, Mycobacterium
LDQRRPELVSSIGSLARVLERLSAS

SEQ ID NO: 315745 - protein, 23 aa, Mycobacterium
LDQTAKLVGRMRALGDALTSNMV

SEQ ID NO: 315746 - protein, 25 aa, Mycobacterium
LDRAHPRAVAGFGFSVVAISLIWFS

SEQ ID NO: 315747 - protein, 27 aa, Mycobacterium
LDRAHPRPVVGFGFFVVAIALTWFSIE

SEQ ID NO: 315748 - protein, 19 aa, Mycobacterium
LDRDIGYGILRMSSDQKWR

SEQ ID NO: 315749 - protein, 29 aa, Mycobacterium
LDRDRLVAELPRLAAIPFSSERQFMATLH

SEQ ID NO: 315750 - protein, 25 aa, Mycobacterium
LDRECGWLHVAVIYTREATAETVRP

SEQ ID NO: 315751 - protein, 26 aa, Mycobacterium
LDRFEPEPPRLLLFAFGWGASVAVVL

SEQ ID NO: 315752 - protein, 31 aa, Mycobacterium
LDRFGEKRAPLALAVASLFYAFPIFLDAGFI

SEQ ID NO: 315753 - protein, 22 aa, Mycobacterium
LDRFPRGNLIGIPGAPERMVQN

SEQ ID NO: 315754 - protein, 23 aa, Mycobacterium
LDRFPRGNLIGIPGAPERMVQNP

SEQ ID NO: 315755 - protein, 22 aa, Mycobacterium
LDRFPRGNLIGIPGAPERMVQS

SEQ ID NO: 315756 - protein, 20 aa, Mycobacterium
LDRFSLKRLHQVAIVAVLAT

SEQ ID NO: 315757 - protein, 23 aa, Mycobacterium
LDRGALTAFMSWVESRPSPRAQR

SEQ ID NO: 315758 - protein, 17 aa, Mycobacterium
LDRGFVWVGLHEPDEHQ

SEQ ID NO: 315759 - protein, 25 aa, Mycobacterium
LDRIAKEVFRAPGIARVQSITRPLG

SEQ ID NO: 315760 - protein, 17 aa, Mycobacterium
LDRIAYRTTIFAFPVFG

SEQ ID NO: 315761 - protein, 17 aa, Mycobacterium
LDRKAHISEALKRLPGY

SEQ ID NO: 315762 - protein, 25 aa, Mycobacterium
LDRLHAVPTPAGRLVQLGGVAQSNR

SEQ ID NO: 315763 - protein, 24 aa, Mycobacterium
LDRLRSLMRSVLCSLAVFHNPRDV

SEQ ID NO: 315764 - protein, 19 aa, Mycobacterium
LDRPADFVVGAPIQIVDRV

SEQ ID NO: 315765 - protein, 18 aa, Mycobacterium
LDRPAEFVTGAPLQVVDA

SEQ ID NO: 315766 - protein, 17 aa, Mycobacterium
LDRRLLLGMLAELAAGA

SEQ ID NO: 315767 - protein, 23 aa, Mycobacterium
LDRRPKGTIIFCVAGLTFAFVLL

SEQ ID NO: 315768 - protein, 30 aa, Mycobacterium
LDRRSERQYPFLVMELIEGGTLRELLTERG

SEQ ID NO: 315769 - protein, 17 aa, Mycobacterium
LDRRSRASVLPKAVFAR

SEQ ID NO: 315770 - protein, 26 aa, Mycobacterium
LDRRSRGGGVPINWRSPIAPPQAGGA

SEQ ID NO: 315771 - protein, 26 aa, Mycobacterium
LDRSLKLTRWQSFRLILLPSAMPDIA

SEQ ID NO: 315772 - protein, 23 aa, Mycobacterium
LDRTAKLVGRMRALGDALSANMV

SEQ ID NO: 315773 - protein, 28 aa, Mycobacterium
LDRTDRLLLGGCAVIWLAALGAAVAAVV

SEQ ID NO: 315774 - protein, 20 aa, Mycobacterium
LDRVAKALIRLPGVAMVQSI

SEQ ID NO: 315775 - protein, 29 aa, Mycobacterium
LDRVLEMPDRFPGWVAVVGYGVQSAGLAL

SEQ ID NO: 315776 - protein, 21 aa, Mycobacterium
LDRWLLFNWMRWGRALEYLKI

SEQ ID NO: 315777 - protein, 20 aa, Mycobacterium
LDRYLPLWIGLAMAAGLLLG

SEQ ID NO: 315778 - protein, 18 aa, Mycobacterium
LDSAALVVVGEACPAEVV

SEQ ID NO: 315779 - protein, 17 aa, Mycobacterium
LDSCRELIQNAAQAANG

SEQ ID NO: 315780 - protein, 19 aa, Mycobacterium
LDSGFTMLGLVGIIDALRP

SEQ ID NO: 315781 - protein, 17 aa, Mycobacterium
LDSHDWLVVLTALGSLA

SEQ ID NO: 315782 - protein, 17 aa, Mycobacterium
LDSIALGAGVALSAIES

SEQ ID NO: 315783 - protein, 24 aa, Mycobacterium
LDSLFRLDHLAARLRRNSANLLVL

SEQ ID NO: 315784 - protein, 20 aa, Mycobacterium
LDSRPGRNQPPGAFDLSEVW

SEQ ID NO: 315785 - protein, 25 aa, Mycobacterium
LDSVAPTRPRTWRHAATALLVVGLM

SEQ ID NO: 315786 - protein, 24 aa, Mycobacterium
LDSWRRLRRRPKFVVAAALILLIL

SEQ ID NO: 315787 - protein, 18 aa, Mycobacterium
LDSWSVIADAPWFDLAAR

SEQ ID NO: 315788 - protein, 18 aa, Mycobacterium
LDTGGWLRITDRLKEMIK

SEQ ID NO: 315789 - protein, 28 aa, Mycobacterium
LDTKTPLSFLCYWIIPFGLVGLAAVASR

SEQ ID NO: 315790 - protein, 29 aa, Mycobacterium
LDTKTPLSFVCYWVIPFALLGVAALVSRV

SEQ ID NO: 315791 - protein, 18 aa, Mycobacterium
LDTLKIIAPYALTMAVVG

SEQ ID NO: 315792 - protein, 18 aa, Mycobacterium
LDTLLLNVIGFGRAGVDL

SEQ ID NO: 315793 - protein, 27 aa, Mycobacterium
LDTPEFPWTGLTIFLLIAVFAAAVGTR

SEQ ID NO: 315794 - protein, 19 aa, Mycobacterium
LDTPRVWRGPRLQVDVEAV

SEQ ID NO: 315795 - protein, 25 aa, Mycobacterium
LDTQPRLAILLGDYAVPVEGRINLL

SEQ ID NO: 315796 - protein, 20 aa, Mycobacterium
LDTRFARLILGVAVLEDIVL

SEQ ID NO: 315797 - protein, 34 aa, Mycobacterium
LDTWPGCIAEILMFTGFLWPPVVSRVQAHRDVRR

SEQ ID NO: 315798 - protein, 22 aa, Mycobacterium
LDVAAWPAYKLLALGAGAVVFI

SEQ ID NO: 315799 - protein, 18 aa, Mycobacterium
LDVALLLGDEAYRYPDNL

SEQ ID NO: 315800 - protein, 19 aa, Mycobacterium
LDVARWERSGWRVFRLGAR

SEQ ID NO: 315801 - protein, 20 aa, Mycobacterium
LDVINELRAAGAEAIEVNDA

SEQ ID NO: 315802 - protein, 20 aa, Mycobacterium
LDVINELRAAGAEAIQVSDA

SEQ ID NO: 315803 - protein, 19 aa, Mycobacterium
LDVLDELSRSMVVDVDNAV

SEQ ID NO: 315804 - protein, 27 aa, Mycobacterium
LDVLPSWLSWFGRPGSMATIAVVVSVL

SEQ ID NO: 315805 - protein, 19 aa, Mycobacterium
LDVLRRIATDFDRSQRAAS

SEQ ID NO: 315806 - protein, 19 aa, Mycobacterium
LDVLRRIATDFDRTQKAAS

SEQ ID NO: 315807 - protein, 18 aa, Mycobacterium
LDVPTAWLVAPVQADGRT

SEQ ID NO: 315808 - protein, 18 aa, Mycobacterium
LDVPTAWVVSPVGMNGKF

SEQ ID NO: 315809 - protein, 18 aa, Mycobacterium
LDVSLVISSMVALNAALP

SEQ ID NO: 315810 - protein, 18 aa, Mycobacterium
LDVSNWRIALLGSGAMTL

SEQ ID NO: 315811 - protein, 19 aa, Mycobacterium
LDVVWAAGLVCFAAAGQLA

SEQ ID NO: 315812 - protein, 21 aa, Mycobacterium
LDWATKIAIAVLFFLYGTRLE

SEQ ID NO: 315813 - protein, 30 aa, Mycobacterium
LDWIDELLYRLAYEGSTVPGGWFTISVLAI

SEQ ID NO: 315814 - protein, 17 aa, Mycobacterium
LDWSVWIGVVVLGIIGA

SEQ ID NO: 315815 - protein, 19 aa, Mycobacterium
LDYAMPMRTFGWPRDLPRA

SEQ ID NO: 315816 - protein, 17 aa, Mycobacterium
LDYARDSLIAFQEHHPA

SEQ ID NO: 315817 - protein, 25 aa, Mycobacterium
LDYDPEQRRIAALVLGYTLIIVMIG

SEQ ID NO: 315818 - protein, 17 aa, Mycobacterium
LDYVMRKGWRDCLNNGG

SEQ ID NO: 315819 - protein, 17 aa, Mycobacterium
LDYVPGILLLIGVGLLG

SEQ ID NO: 315820 - protein, 24 aa, Mycobacterium
LDYYLKTHIEYAADKCHGDTRAST

SEQ ID NO: 315821 - protein, 19 aa, Mycobacterium
LEAAVRAMAKRGFVVSRLT

SEQ ID NO: 315822 - protein, 17 aa, Mycobacterium
LEACRRTTGLALPIVCV

SEQ ID NO: 315823 - protein, 19 aa, Mycobacterium
LEADARLRRQLALRYVIFG

SEQ ID NO: 315824 - protein, 17 aa, Mycobacterium
LEAEFGWSRTALSALPL

SEQ ID NO: 315825 - protein, 23 aa, Mycobacterium
LEAEPKIFSWLANFEPMRQVFIG

SEQ ID NO: 315826 - protein, 20 aa, Mycobacterium
LEAFTEFNRLAVIIVGVPIM

SEQ ID NO: 315827 - protein, 17 aa, Mycobacterium
LEAGNFVRIAGVEVGKV

SEQ ID NO: 315828 - protein, 31 aa, Mycobacterium
LEAIHMSWLRFGHGLVLSSIVLWTGVGLMLI

SEQ ID NO: 315829 - protein, 17 aa, Mycobacterium
LEAIKALNIRYIYTSAP

SEQ ID NO: 315830 - protein, 17 aa, Mycobacterium
LEAILPYYGPYRNDVLK

SEQ ID NO: 315831 - protein, 20 aa, Mycobacterium
LEALARWTAPNGILIAPETF

SEQ ID NO: 315832 - protein, 17 aa, Mycobacterium
LEALLATVQAGPWQGPS

SEQ ID NO: 315833 - protein, 19 aa, Mycobacterium
LEAPLKFRAPGVTLPIGLG

SEQ ID NO: 315834 - protein, 19 aa, Mycobacterium
LEAPLKFRAPNVTLQIGLG

SEQ ID NO: 315835 - protein, 17 aa, Mycobacterium
LEAPRPPQHVVAKPVRS

SEQ ID NO: 315836 - protein, 26 aa, Mycobacterium
LEARPLRMAFLLGAAMLIDFRFLAAL

SEQ ID NO: 315837 - protein, 24 aa, Mycobacterium
LEASRTWAQASWRHSMPSVEGPDP

SEQ ID NO: 315838 - protein, 26 aa, Mycobacterium
LEAVGLPKRLWPVLPVVKGASALGLL

SEQ ID NO: 315839 - protein, 21 aa, Mycobacterium
LEAVPPFFRWLATFEPMHQVF

SEQ ID NO: 315840 - protein, 25 aa, Mycobacterium
LEAYGVLFDPEFHIPFIGRWPVLGF

SEQ ID NO: 315841 - protein, 23 aa, Mycobacterium
LEDGRFAFYIKVHHTVIDGVAGF

SEQ ID NO: 315842 - protein, 18 aa, Mycobacterium
LEEGRRWTVEEFRTTHPI

SEQ ID NO: 315843 - protein, 21 aa, Mycobacterium
LEERGRTAVFVGQDGQVVGVL

SEQ ID NO: 315844 - protein, 18 aa, Mycobacterium
LEEYSLARTRRGLRALLS

SEQ ID NO: 315845 - protein, 17 aa, Mycobacterium
LEFAWPTLVLATGIGIC

SEQ ID NO: 315846 - protein, 18 aa, Mycobacterium
LEGAVRAMAKRGFAVSML

SEQ ID NO: 315847 - protein, 24 aa, Mycobacterium
LEGFDFGVGMLMSFFGRAAEKRGQ

SEQ ID NO: 315848 - protein, 19 aa, Mycobacterium
LEGHALRFDDFGNIITDAP

SEQ ID NO: 315849 - protein, 19 aa, Mycobacterium
LEGLTVFGIALTITSGSLY

SEQ ID NO: 315850 - protein, 17 aa, Mycobacterium
LEGPAGQLLSFKIAIPI

SEQ ID NO: 315851 - protein, 29 aa, Mycobacterium
LEGRLVQHLWRWSRMLPEDFVPQSKRTAD

SEQ ID NO: 315852 - protein, 23 aa, Mycobacterium
LEGSDWSWLKWLPHVDIPGQADG

SEQ ID NO: 315853 - protein, 17 aa, Mycobacterium
LEGTELWESLTREQRLE

SEQ ID NO: 315854 - protein, 22 aa, Mycobacterium
LEHAKRVSDLLAQRAGQVNQLI

SEQ ID NO: 315855 - protein, 17 aa, Mycobacterium
LEHASLPYAMGSMGTKI

SEQ ID NO: 315856 - protein, 19 aa, Mycobacterium
LEHGHHWLALGYVAASIAV

SEQ ID NO: 315857 - protein, 17 aa, Mycobacterium
LEHLVMRKPLLLQDLGR

SEQ ID NO: 315858 - protein, 37 aa, Mycobacterium
LEHPGKRAPTVELCNDPRGFVPMAIRQHITGPYPFDP

SEQ ID NO: 315859 - protein, 18 aa, Mycobacterium
LEHSRTALLDAVEQERRR

SEQ ID NO: 315860 - protein, 19 aa, Mycobacterium
LEHYCPKPAAVQPAVYDQK

SEQ ID NO: 315861 - protein, 24 aa, Mycobacterium
LEIAPGVVTRWMKLAVRDKIVDEV

SEQ ID NO: 315862 - protein, 22 aa, Mycobacterium
LEIAPGVVTTWMKLAIRDRILP

SEQ ID NO: 315863 - protein, 18 aa, Mycobacterium
LEIECARLSLIDEAAAER

SEQ ID NO: 315864 - protein, 27 aa, Mycobacterium
LEIHRISGFVLPRGLITVRISPHVDME

SEQ ID NO: 315865 - protein, 18 aa, Mycobacterium
LEIVQRQGFATGNVTTAE

SEQ ID NO: 315866 - protein, 17 aa, Mycobacterium
LEIVVQLLLPFVAGQVL

SEQ ID NO: 315867 - protein, 17 aa, Mycobacterium
LEKAGWHLVFGLSAGLL

SEQ ID NO: 315868 - protein, 17 aa, Mycobacterium
LEKHYLAAVMASGAAVG

SEQ ID NO: 315869 - protein, 17 aa, Mycobacterium
LEKLARVGFAASGVLHL

SEQ ID NO: 315870 - protein, 26 aa, Mycobacterium
LEKNDLRPGWHPVPGISSGTRESGVR

SEQ ID NO: 315871 - protein, 22 aa, Mycobacterium
LEKSAHPWAFLIRSLVGGAMVG

SEQ ID NO: 315872 - protein, 19 aa, Mycobacterium
LEKVAAWAITEPDSGSDAF

SEQ ID NO: 315873 - protein, 26 aa, Mycobacterium
LEKYLDHWPDAFKILNRQGLYGDFFS

SEQ ID NO: 315874 - protein, 18 aa, Mycobacterium
LELALGYNGIDRIVSGGH

SEQ ID NO: 315875 - protein, 20 aa, Mycobacterium
LELDGLWGIVFSPLLHASWE

SEQ ID NO: 315876 - protein, 19 aa, Mycobacterium
LELELAYKPQTLLAYEMNG

SEQ ID NO: 315877 - protein, 20 aa, Mycobacterium
LELFDGAAIAAVIPLLLWIA

SEQ ID NO: 315878 - protein, 25 aa, Mycobacterium
LELFRMSLKDTRWWLGGMAAVTNYS

SEQ ID NO: 315879 - protein, 22 aa, Mycobacterium
LELLFDLTFVIAFGVAASQLAH

SEQ ID NO: 315880 - protein, 21 aa, Mycobacterium
LELLFDLVFVVAVSRASGSLH

SEQ ID NO: 315881 - protein, 17 aa, Mycobacterium
LELLKTATAQRWSSEGN

SEQ ID NO: 315882 - protein, 19 aa, Mycobacterium
LELLRAVLAYYQYAAKETD

SEQ ID NO: 315883 - protein, 22 aa, Mycobacterium
LELPEGPWRLAVGGGGTLEDVL

SEQ ID NO: 315884 - protein, 17 aa, Mycobacterium
LELPEISWGLQINDGQS

SEQ ID NO: 315885 - protein, 17 aa, Mycobacterium
LELRLHDPRDSNVRLVG

SEQ ID NO: 315886 - protein, 21 aa, Mycobacterium
LELRLLPSLIPIGLLAGLSAV

SEQ ID NO: 315887 - protein, 17 aa, Mycobacterium
LELRLQISRVVDGLSSL

SEQ ID NO: 315888 - protein, 20 aa, Mycobacterium
LELTDSPLLLGVTVAGQQLP

SEQ ID NO: 315889 - protein, 19 aa, Mycobacterium
LELTSTMGASRFKTFLKIR

SEQ ID NO: 315890 - protein, 22 aa, Mycobacterium
LELWRSDMVRMVAYGETDARVK

SEQ ID NO: 315891 - protein, 25 aa, Mycobacterium
LELYNGRCGVALFFAALEKVAPDLG

SEQ ID NO: 315892 - protein, 24 aa, Mycobacterium
LEMIMVVGALHFKESRGRGNISAA

SEQ ID NO: 315893 - protein, 24 aa, Mycobacterium
LEMLAPGYRRARSMSKEAFDMVFA

SEQ ID NO: 315894 - protein, 19 aa, Mycobacterium
LEMPLRRTLRYAALLRLPA

SEQ ID NO: 315895 - protein, 17 aa, Mycobacterium
LEMRRIIDRFNRQTGHE

SEQ ID NO: 315896 - protein, 28 aa, Mycobacterium
LEPAAAVLRFLRRVPRDTVVLLDEAYIE

SEQ ID NO: 315897 - protein, 25 aa, Mycobacterium
LEPAGFSVFAVFWGAFGLVTGAANG

SEQ ID NO: 315898 - protein, 25 aa, Mycobacterium
LEPAGFSVFGVFWGAFGLVSGAAFG

SEQ ID NO: 315899 - protein, 17 aa, Mycobacterium
LEPCPRSDEPLAVGQVR

SEQ ID NO: 315900 - protein, 18 aa, Mycobacterium
LEPFAFTVIDVIVLTVFQ

SEQ ID NO: 315901 - protein, 24 aa, Mycobacterium
LEPFRCFYLSAPFVVPKVKEVATT

SEQ ID NO: 315902 - protein, 19 aa, Mycobacterium
LEPFRIGMTVLMLNRPKPL

SEQ ID NO: 315903 - protein, 18 aa, Mycobacterium
LEPGETLALVGSTGAGKS

SEQ ID NO: 315904 - protein, 18 aa, Mycobacterium
LEPGIRFGSLQTVSADGN

SEQ ID NO: 315905 - protein, 41 aa, Mycobacterium
LEPKGMKRARGWRRIGAATVRWPGAVLVMAVVLALVGLLTL

SEQ ID NO: 315906 - protein, 38 aa, Mycobacterium
LEPKRAMRIRAWRRIGTMVVRWPGPILVASLALALVGL

SEQ ID NO: 315907 - protein, 36 aa, Mycobacterium
LEPKRAMRIRGWRKIGAAIVRWPGPILVATMAITLV

SEQ ID NO: 315908 - protein, 36 aa, Mycobacterium
LEPKRAMRIRGWRRLGAFVVRWPGAVLMATVLLSLV

SEQ ID NO: 315909 - protein, 41 aa, Mycobacterium
LEPKRAMRTRGWRKVGAAVVRWPGPILVAAVGLSMIGLLAL

SEQ ID NO: 315910 - protein, 40 aa, Mycobacterium
LEPKRFSRSPGWHRVGTATVRWPGAILVCAVVAALIGLLA

SEQ ID NO: 315911 - protein, 38 aa, Mycobacterium
LEPKRMARVRGWRKIGAAIVRWPGPILIGAVALALVGL

SEQ ID NO: 315912 - protein, 17 aa, Mycobacterium
LEPKRTQRIRGWRKIGA

SEQ ID NO: 315913 - protein, 17 aa, Mycobacterium
LEPNWSMTLVERLDGAA

SEQ ID NO: 315914 - protein, 17 aa, Mycobacterium
LEPPYKGGPVLADNAVI

SEQ ID NO: 315915 - protein, 20 aa, Mycobacterium
LEPRGKLSTTGWRKVGTSVV

SEQ ID NO: 315916 - protein, 17 aa, Mycobacterium
LEPVFLVTVRFTAVAVS

SEQ ID NO: 315917 - protein, 17 aa, Mycobacterium
LEQAVARQSCDIAPIAV

SEQ ID NO: 315918 - protein, 17 aa, Mycobacterium
LEQVIPLMPGAQLTGHQ

SEQ ID NO: 315919 - protein, 25 aa, Mycobacterium
LERIFDPKVFVISFVFNVFVAALIV

SEQ ID NO: 315920 - protein, 30 aa, Mycobacterium
LERLFALRPLHVLRRGWRTDVVHYLVNGAA

SEQ ID NO: 315921 - protein, 18 aa, Mycobacterium
LERLVTFLALGVAAIPAW

SEQ ID NO: 315922 - protein, 28 aa, Mycobacterium
LERPTHWNHFAARAAAAVRSRGAVPLAL

SEQ ID NO: 315923 - protein, 20 aa, Mycobacterium
LERQVRRWGSQWALVRLPDD

SEQ ID NO: 315924 - protein, 24 aa, Mycobacterium
LERQWRARMAGLRTNALVATGATL

SEQ ID NO: 315925 - protein, 25 aa, Mycobacterium
LERRAKQAKTRRIVLIAAGAIVAVA

SEQ ID NO: 315926 - protein, 29 aa, Mycobacterium
LERREHIGEALKRLPAYATALGEVVGSGP

SEQ ID NO: 315927 - protein, 22 aa, Mycobacterium
LERRERIGGTWDLFRYPGVRSD

SEQ ID NO: 315928 - protein, 21 aa, Mycobacterium
LERRSRIGGTWDLHRYPGIRS

SEQ ID NO: 315929 - protein, 26 aa, Mycobacterium
LERRWEIVRFLSPLAVLLIWQAGSAW

SEQ ID NO: 315930 - protein, 17 aa, Mycobacterium
LERWHSRSGADRSAGQT

SEQ ID NO: 315931 - protein, 22 aa, Mycobacterium
LERWTADVLLSLGCTLEQLVAS

SEQ ID NO: 315932 - protein, 24 aa, Mycobacterium
LESEAWSWLKWLPHVDVPGRIDGV

SEQ ID NO: 315933 - protein, 17 aa, Mycobacterium
LESFGYKQELSRQISTV

SEQ ID NO: 315934 - protein, 33 aa, Mycobacterium
LESIHMSWLRFGHGLVLSSIVLWLGVGLMLIAW

SEQ ID NO: 315935 - protein, 31 aa, Mycobacterium; identical to SEQ ID NO: 11497

SEQ ID NO: 315936 - protein, 24 aa, Mycobacterium
LESPTVTVPARWSVDGIEHTGDVA

SEQ ID NO: 315937 - protein, 17 aa, Mycobacterium
LESRLAALGSKIGPAAM

SEQ ID NO: 315938 - protein, 21 aa, Mycobacterium
LESRLAALGSRAAGALPKGPL

SEQ ID NO: 315939 - protein, 23 aa, Mycobacterium
LESRLAALGTRAGAAVMPKGPLP

SEQ ID NO: 315940 - protein, 17 aa, Mycobacterium
LESRYADRLEILHVMSN

SEQ ID NO: 315941 - protein, 17 aa, Mycobacterium
LESVAPKQPTRWRHLPA

SEQ ID NO: 315942 - protein, 26 aa, Mycobacterium
LESYDLSSLRYIMWGATPVNANVAQT

SEQ ID NO: 315943 - protein, 35 aa, Mycobacterium
LETEQSLREPRRAVPEVPASRPARPAPNATAPTAP

SEQ ID NO: 315944 - protein, 23 aa, Mycobacterium
LETGSPYAIEYVWGRQVGDNTIN

SEQ ID NO: 315945 - protein, 30 aa, Mycobacterium
LETIHMSWLRFGHGLVLSSIVLWSGVGLML

SEQ ID NO: 315946 - protein, 19 aa, Mycobacterium
LETLMRPPLTGVLDTLDNA

SEQ ID NO: 315947 - protein, 23 aa, Mycobacterium
LETRLMAVLAVGFGLGVALAVSR

SEQ ID NO: 315948 - protein, 23 aa, Mycobacterium
LETRLMMVLGVGFGLGVALTLSR

SEQ ID NO: 315949 - protein, 24 aa, Mycobacterium
LETYRSATPIAWYLAAAASVSAVA

SEQ ID NO: 315950 - protein, 21 aa, Mycobacterium
LEVAGAIAPFIAVGAVLCLVV

SEQ ID NO: 315951 - protein, 17 aa, Mycobacterium
LEVARIIGIAAIVIALP

SEQ ID NO: 315952 - protein, 24 aa, Mycobacterium
LEVDEPLAYCLPGVRSRVVVSEGT

SEQ ID NO: 315953 - protein, 20 aa, Mycobacterium
LEVLAIKPDICFLWDEAWYA

SEQ ID NO: 315954 - protein, 20 aa, Mycobacterium
LEVLQRWLADDLPAVLVVCT

SEQ ID NO: 315955 - protein, 36 aa, Mycobacterium
LEVPYLRASPWLLWRKRVVWLLVLFVAEAYTGSVLR

SEQ ID NO: 315956 - protein, 29 aa, Mycobacterium
LEVVCVFWPTARRGPLLWLALLSAAATMV

SEQ ID NO: 315957 - protein, 33 aa, Mycobacterium
LEVVEGVGLWLLKRWGEYFAVIATSVFLPLEIH

SEQ ID NO: 315958 - protein, 22 aa, Mycobacterium
LEWYDWMIFGLLAAYLGPQFFA

SEQ ID NO: 315959 - protein, 21 aa, Mycobacterium
LEYEGRRAIGFSADDDTRFVK

SEQ ID NO: 315960 - protein, 20 aa, Mycobacterium
LEYQGAALPKRMNKLGSAGA

SEQ ID NO: 315961 - protein, 17 aa, Mycobacterium
LEYRDVDAFERRRAIWQ

SEQ ID NO: 315962 - protein, 17 aa, Mycobacterium
LFAAAAVVLSLVRRAAT

SEQ ID NO: 315963 - protein, 26 aa, Mycobacterium
LFAAFLRNNVKLIPLVPFPVDHATST

SEQ ID NO: 315964 - protein, 17 aa, Mycobacterium
LFAAIIGSVSFWGSLVA

SEQ ID NO: 315965 - protein, 17 aa, Mycobacterium
LFAAVIGSISFWGSIIA

SEQ ID NO: 315966 - protein, 25 aa, Mycobacterium
LFADEFGWRGPFWKWIAGLDLNVVG

SEQ ID NO: 315967 - protein, 18 aa, Mycobacterium
LFAFFGGFAIMLGAELNA

SEQ ID NO: 315968 - protein, 22 aa, Mycobacterium
LFAGLKGAVPILLGELLRAAHV

SEQ ID NO: 315969 - protein, 31 aa, Mycobacterium
LFAGPAANFVICLVLLYGIALVWGLPDLHPP

SEQ ID NO: 315970 - protein, 24 aa, Mycobacterium
LFAGPAMNFLIGIVVFYGVVLFWG

SEQ ID NO: 315971 - protein, 18 aa, Mycobacterium
LFAGVVAALAFVAVSRTR

SEQ ID NO: 315972 - protein, 24 aa, Mycobacterium
LFAIGRDGLLPSVFAQVNPRTLTP

SEQ ID NO: 315973 - protein, 18 aa, Mycobacterium
LFAIVAGVLLWFSRIRVE

SEQ ID NO: 315974 - protein, 19 aa, Mycobacterium
LFAIWPFTRLVHAFSAPVA

SEQ ID NO: 315975 - protein, 18 aa, Mycobacterium
LFALRFPVFIEAYDQFGW

SEQ ID NO: 315976 - protein, 25 aa, Mycobacterium
LFAMGRDGLLPSMFARVNSHTMTPI

SEQ ID NO: 315977 - protein, 24 aa, Mycobacterium
LFAQANRAAHGWLFGDPASGENGD

SEQ ID NO: 315978 - protein, 25 aa, Mycobacterium
LFAQANRVAHDWLFSEAQSAADGER

SEQ ID NO: 315979 - protein, 27 aa, Mycobacterium
LFAQYGSWRWAFGVLVILTAAMAVLVP

SEQ ID NO: 315980 - protein, 24 aa, Mycobacterium
LFASGGHPVAWVGLGVAALLAVIA

SEQ ID NO: 315981 - protein, 30 aa, Mycobacterium
LFATFILGMFWRRMTATAGWAGLVSGTFAA

SEQ ID NO: 315982 - protein, 18 aa, Mycobacterium
LFATLIVMPYRFRGVAMF

SEQ ID NO: 315983 - protein, 19 aa, Mycobacterium
LFATVVAFWIGRPIITLAF

SEQ ID NO: 315984 - protein, 26 aa, Mycobacterium
LFAYTKICSHLGCPTSLFEQQTYRIL

SEQ ID NO: 315985 - protein, 21 aa, Mycobacterium
LFCNSPFFWIGGFAFGLLATL

SEQ ID NO: 315986 - protein, 18 aa, Mycobacterium
LFCVGLITAYLAARAGTT

SEQ ID NO: 315987 - protein, 17 aa, Mycobacterium
LFDDMEGLREFQLPYAK

SEQ ID NO: 315988 - protein, 18 aa, Mycobacterium
LFDFNVGVMRWRWRVAFY

SEQ ID NO: 315989 - protein, 18 aa, Mycobacterium
LFDKEPLLIWTLIASLFI

SEQ ID NO: 315990 - protein, 20 aa, Mycobacterium
LFDMAMLGVLSVFYVTFVRW

SEQ ID NO: 315991 - protein, 18 aa, Mycobacterium
LFDMAMLGVVSIAYTAIV

SEQ ID NO: 315992 - protein, 39 aa, Mycobacterium
LFDPKRLIKVRGWRRVGTVVVRWPLPVLAATLAVALVGL

SEQ ID NO: 315993 - protein, 41 aa, Mycobacterium
LFDPKRLLKVRGWRRVGTVVVRWPLPVLAATCAVALVGLLA

SEQ ID NO: 315994 - protein, 20 aa, Mycobacterium
LFDRLGRRFPRHFGPGHVAL

SEQ ID NO: 315995 - protein, 17 aa, Mycobacterium
LFEAARLDGAGRVREFV

SEQ ID NO: 315996 - protein, 18 aa, Mycobacterium
LFEACPPLDHAAHPTAAE

SEQ ID NO: 315997 - protein, 22 aa, Mycobacterium
LFEPKRAMRIRSWRKIGTTIVR

SEQ ID NO: 315998 - protein, 18 aa, Mycobacterium
LFESMSIDGASEWSTLWQ

SEQ ID NO: 315999 - protein, 26 aa, Mycobacterium
LFFDRNRLAAFAAMFLGGGVLFSLTV

SEQ ID NO: 316000 - protein, 19 aa, Mycobacterium
LFFGALVLWMVLRPLQSRA

SEQ ID NO: 316001 - protein, 19 aa, Mycobacterium
LFFGALVLWMVLRPLQTRP

SEQ ID NO: 316002 - protein, 30 aa, Mycobacterium
LFFIAYEAFFIPFGFTFWGVMLSAPLWLPL

SEQ ID NO: 316003 - protein, 25 aa, Mycobacterium
LFFSLCIGYAPRLVGLADVGRALAL

SEQ ID NO: 316004 - protein, 22 aa, Mycobacterium
LFFSVGVDGFFALSGFLITRSW

SEQ ID NO: 316005 - protein, 21 aa, Mycobacterium
LFFSVKLGWLPASGRSTVGTE

SEQ ID NO: 316006 - protein, 20 aa, Mycobacterium
LFGELEFWASLIKVLALVTF

SEQ ID NO: 316007 - protein, 22 aa, Mycobacterium
LFGGKVSYLALLVLVLIALLIG

SEQ ID NO: 316008 - protein, 18 aa, Mycobacterium
LFGGLGMTFVGGSVAVSG

SEQ ID NO: 316009 - protein, 24 aa, Mycobacterium
LFGGRGRLAGTFLGALVIAVLGNG

SEQ ID NO: 316010 - protein, 30 aa, Mycobacterium
LFGIVFSLFCFLGFPVLLGGIIWAIVDAIL

SEQ ID NO: 316011 - protein, 25 aa, Mycobacterium
LFGLNLWWSLLAFVVGHVIGGALMA

SEQ ID NO: 316012 - protein, 18 aa, Mycobacterium
LFGLSWPLRHRVVPNEAT

SEQ ID NO: 316013 - protein, 19 aa, Mycobacterium
LFGRNVMFLAVLFAVGMNA

SEQ ID NO: 316014 - protein, 18 aa, Mycobacterium
LFGSAFGTYLMRQFFRTL

SEQ ID NO: 316015 - protein, 23 aa, Mycobacterium
LFGTCLFVWQLAAARRGARGAQA

SEQ ID NO: 316016 - protein, 19 aa, Mycobacterium
LFGTTAMWLAVLFAVGMNV

SEQ ID NO: 316017 - protein, 25 aa, Mycobacterium
LFGVEVPNALPLILSGLRTATLQVV

SEQ ID NO: 316018 - protein, 23 aa, Mycobacterium
LFGWPDGSLSWAFVLSLLAAALA

SEQ ID NO: 316019 - protein, 19 aa, Mycobacterium
LFGYRLFPWTEVVDVSFHE

SEQ ID NO: 316020 - protein, 25 aa, Mycobacterium
LFHGHRYGVEFFAGWLTEYSLSVDN

SEQ ID NO: 316021 - protein, 17 aa, Mycobacterium
LFHVISGNLGYQVEHHL

SEQ ID NO: 316022 - protein, 19 aa, Mycobacterium
LFIAEVFHRGPGIAGLALA

SEQ ID NO: 316023 - protein, 33 aa, Mycobacterium
LFIAFDQLWRWNSIVALVLSVLVILGLVVAVRV

SEQ ID NO: 316024 - protein, 17 aa, Mycobacterium
LFIGSVLAFMLGSLLCA

SEQ ID NO: 316025 - protein, 17 aa, Mycobacterium
LFIGVLFGLLLITGTTI

SEQ ID NO: 316026 - protein, 26 aa, Mycobacterium
LFIIGRIKDLLIVYGRNHSPDDIEAT

SEQ ID NO: 316027 - protein, 25 aa, Mycobacterium
LFILTVAAALAWYLILRRRSPHVVA

SEQ ID NO: 316028 - protein, 28 aa, Mycobacterium
LFIVDWRVALVLLIPVLMYLVMTSSLAV

SEQ ID NO: 316029 - protein, 17 aa, Mycobacterium
LFIVYRSVSTVLLVLAM

SEQ ID NO: 316030 - protein, 26 aa, Mycobacterium
LFKFFTPWGRQFWRITSEYFIGPKSI

SEQ ID NO: 316031 - protein, 17 aa, Mycobacterium
LFLAVAVLVVIAAIAAI

SEQ ID NO: 316032 - protein, 17 aa, Mycobacterium
LFLCIWITGTSILMVSK

SEQ ID NO: 316033 - protein, 17 aa, Mycobacterium
LFLDLNWAAGYSTIVIA

SEQ ID NO: 316034 - protein, 17 aa, Mycobacterium
LFLGFLVLEGFDFGVGM

SEQ ID NO: 316035 - protein, 25 aa, Mycobacterium
LFLGSAFVCLAVWLGKLDRCQPQGD

SEQ ID NO: 316036 - protein, 20 aa, Mycobacterium
LFLGVWLLIWYMRNQVRDRQ

SEQ ID NO: 316037 - protein, 21 aa, Mycobacterium
LFLHTRYWWAGIAIVAVATIV

SEQ ID NO: 316038 - protein, 17 aa, Mycobacterium
LFLIAGLAITFGIQNAT

SEQ ID NO: 316039 - protein, 21 aa, Mycobacterium
LFLNYVWHYTLLQAGFAIAPA

SEQ ID NO: 316040 - protein, 22 aa, Mycobacterium
LFLPIDMWQRMFLAMSALFVVT

SEQ ID NO: 316041 - protein, 28 aa, Mycobacterium
LFLVFGGAVAACLPVMVGGLSIAGALGI

SEQ ID NO: 316042 - protein, 19 aa, Mycobacterium
LFLVLALFTLFSGTPVALA

SEQ ID NO: 316043 - protein, 24 aa, Mycobacterium
LFLVTDAAIMFGIRDADAAAALGL

SEQ ID NO: 316044 - protein, 21 aa, Mycobacterium
LFLWETILAIIAFIAKLAEFI

SEQ ID NO: 316045 - protein, 26 aa, Mycobacterium
LFMGGFLIALAMQRWNLHRRIALLTV

SEQ ID NO: 316046 - protein, 23 aa, Mycobacterium
LFMPSALALLFAMFAVPQLQLYM

SEQ ID NO: 316047 - protein, 22 aa, Mycobacterium
LFMPSTLFLMFVMFGVPQLQLW

SEQ ID NO: 316048 - protein, 17 aa, Mycobacterium
LFMRFSGIVLVFLALGH

SEQ ID NO: 316049 - protein, 23 aa, Mycobacterium
LFMVVALTLTWMVYVTLRRDVAG

SEQ ID NO: 316050 - protein, 25 aa, Mycobacterium
LFMVVSLTLTWLVYVSLRRDVAGDT

SEQ ID NO: 316051 - protein, 18 aa, Mycobacterium
LFNGPAPWHTSLTTSDFG

SEQ ID NO: 316052 - protein, 19 aa, Mycobacterium
LFNIIHLLIFAGLDTVTAS

SEQ ID NO: 316053 - protein, 19 aa, Mycobacterium
LFPDCDARTLADRFERVLS

SEQ ID NO: 316054 - protein, 19 aa, Mycobacterium
LFPPSVRATALAVCNSVGR

SEQ ID NO: 316055 - protein, 21 aa, Mycobacterium
LFPVVQPWYLLWAIIPLAAWA

SEQ ID NO: 316056 - protein, 21 aa, Mycobacterium
LFPVVQPWYLLWAIIPMAAWA

SEQ ID NO: 316057 - protein, 20 aa, Mycobacterium
LFQRGEIMVCSYVLRTGGSY

SEQ ID NO: 316058 - protein, 23 aa, Mycobacterium
LFRELRIGSMAAYRDKVAAGQAA

SEQ ID NO: 316059 - protein, 19 aa, Mycobacterium
LFRPRFIKRMFFAKFPDDL

SEQ ID NO: 316060 - protein, 28 aa, Mycobacterium
LFRPTHPRKFLGLFPFQGLLHAQREQIT

SEQ ID NO: 316061 - protein, 18 aa, Mycobacterium
LFRYPGVRSDSSIFTLSF

SEQ ID NO: 316062 - protein, 25 aa, Mycobacterium
LFSGIGKWGTLPTWTDLAALPDFLG

SEQ ID NO: 316063 - protein, 17 aa, Mycobacterium
LFSGRRWVTTLGAFILA

SEQ ID NO: 316064 - protein, 23 aa, Mycobacterium
LFSHFRPLEIVWNILTDALSTAF

SEQ ID NO: 316065 - protein, 29 aa, Mycobacterium
LFSNLPLLFAVGVAIGFARKADGSTALAA

SEQ ID NO: 316066 - protein, 19 aa, Mycobacterium
LFSPAAVRWAAGGQGDSAS

SEQ ID NO: 316067 - protein, 25 aa, Mycobacterium
LFSRLTMLLRPDWTRTVLARRIAAG

SEQ ID NO: 316068 - protein, 23 aa, Mycobacterium
LFSVLGLSGLVFFLSQYFQLVHG

SEQ ID NO: 316069 - protein, 28 aa, Mycobacterium
LFTAAGYVLWWAVLFPAISVPIIASLVL

SEQ ID NO: 316070 - protein, 17 aa, Mycobacterium
LFTALGITSVVIGLMLQ

SEQ ID NO: 316071 - protein, 30 aa, Mycobacterium
LFTCGIASIIQAVGFWKVGVRLPLLQGVTF

SEQ ID NO: 316072 - protein, 18 aa, Mycobacterium
LFTEGMAGFTIDKVAARS

SEQ ID NO: 316073 - protein, 26 aa, Mycobacterium
LFTIASVLCGIAWDEATLVIARLLQG

SEQ ID NO: 316074 - protein, 21 aa, Mycobacterium
LFTLMCMNDIIALKFHISLNA

SEQ ID NO: 316075 - protein, 18 aa, Mycobacterium
LFTRPQWIALEKSISEIV

SEQ ID NO: 316076 - protein, 20 aa, Mycobacterium
LFTRPRLRIGAAGISVRNLL

SEQ ID NO: 316077 - protein, 23 aa, Mycobacterium
LFTRRTSRLLAVIAVAALAGGLA

SEQ ID NO: 316078 - protein, 18 aa, Mycobacterium
LFTVLLIIGVSAPVSGII

SEQ ID NO: 316079 - protein, 18 aa, Mycobacterium
LFVAAMWVTYALFMGSLR

SEQ ID NO: 316080 - protein, 29 aa, Mycobacterium
LFVACARAVGRWAHRPRVWHVVAVGNGGA

SEQ ID NO: 316081 - protein, 26 aa, Mycobacterium
LFVAFAARLAHRMGRVLPDGNSVTVV

SEQ ID NO: 316082 - protein, 34 aa, Mycobacterium
LFVAFDQLWRWNSIVALVLSVLVILGLVVGVRVV

SEQ ID NO: 316083 - protein, 19 aa, Mycobacterium
LFVAFLMSYFYPIFDAGLT

SEQ ID NO: 316084 - protein, 27 aa, Mycobacterium
LFVAVEAFYLFSCRSLTHSAWRIGVLS

SEQ ID NO: 316085 - protein, 17 aa, Mycobacterium
LFVAVSLNYPFSRYDTV

SEQ ID NO: 316086 - protein, 21 aa, Mycobacterium
LFVFVDWRMHAAVLPPSVFGG

SEQ ID NO: 316087 - protein, 18 aa, Mycobacterium
LFVGAVFLFTLGSLLCAL

SEQ ID NO: 316088 - protein, 18 aa, Mycobacterium
LFVGLSFAALAIYALVPA

SEQ ID NO: 316089 - protein, 19 aa, Mycobacterium
LFVISGLLAAGAVVCLITG

SEQ ID NO: 316090 - protein, 24 aa, Mycobacterium
LFVITSLLSVLGFFAIATYRNASN

SEQ ID NO: 316091 - protein, 25 aa, Mycobacterium
LFVKLIKMMTVPVIFCTVVLGIGKV

SEQ ID NO: 316092 - protein, 26 aa, Mycobacterium
LFVLGFLRFGLPPSDRVELTELGPTR

SEQ ID NO: 316093 - protein, 28 aa, Mycobacterium
LFVLSGMAVGWWVIQRNYYVTEYDGKVS

SEQ ID NO: 316094 - protein, 17 aa, Mycobacterium
LFVMFVITAITMQRERA

SEQ ID NO: 316095 - protein, 25 aa, Mycobacterium
LFVPAALPWYYSWPLAVAAPLAQSR

SEQ ID NO: 316096 - protein, 25 aa, Mycobacterium
LFVPAALPWYYSWPLAVVAPLAQSR

SEQ ID NO: 316097 - protein, 19 aa, Mycobacterium
LFVPEVVLSFTPFHADAAM

SEQ ID NO: 316098 - protein, 23 aa, Mycobacterium
LFVPKLRHWLATAVRPRLKEVLD

SEQ ID NO: 316099 - protein, 26 aa, Mycobacterium
LFVPTLRRWLSTEVRPKLNEVVGDLV

SEQ ID NO: 316100 - protein, 18 aa, Mycobacterium
LFVRSRLIDAAREQADRG

SEQ ID NO: 316101 - protein, 18 aa, Mycobacterium
LFVRSRLVDAAREQAEKG

SEQ ID NO: 316102 - protein, 21 aa, Mycobacterium
LFVSFGVTWFLAHGMTSPLRD

SEQ ID NO: 316103 - protein, 17 aa, Mycobacterium
LFVSWWIAGARYLMAND

SEQ ID NO: 316104 - protein, 24 aa, Mycobacterium
LFVTRTGGVWAFIAVLAVAFFLAS

SEQ ID NO: 316105 - protein, 19 aa, Mycobacterium
LFVVAGVVWWVRQGLAESQ

SEQ ID NO: 316106 - protein, 19 aa, Mycobacterium
LFVVARRWVLALLAVALTV

SEQ ID NO: 316107 - protein, 25 aa, Mycobacterium
LFVVDWRVALVLFAPVLVYLVLTSS

SEQ ID NO: 316108 - protein, 27 aa, Mycobacterium
LFVVDWRVALVLFLPVLVYLVLTSSLT

SEQ ID NO: 316109 - protein, 22 aa, Mycobacterium
LFVVLPLVWAMNSLGWQTGSQA

SEQ ID NO: 316110 - protein, 24 aa, Mycobacterium
LFWQDILGIALHWLVLPMSVIVLL

SEQ ID NO: 316111 - protein, 25 aa, Mycobacterium
LFWQHLVGLHLHWLVLPLTFIILVA

SEQ ID NO: 316112 - protein, 17 aa, Mycobacterium
LFYGEGTSMLFGDAKKS

SEQ ID NO: 316113 - protein, 20 aa, Mycobacterium
LFYLPPEIFQNSDFQLGLSL

SEQ ID NO: 316114 - protein, 17 aa, Mycobacterium
LFYNVVSALTFLVGALL

SEQ ID NO: 316115 - protein, 18 aa, Mycobacterium
LFYPVMIVLVGINAMSVI

SEQ ID NO: 316116 - protein, 24 aa, Mycobacterium
LFYTGYCVLLLLASTLVIIRMPET

SEQ ID NO: 316117 - protein, 19 aa, Mycobacterium
LFYVGAALLTWSRYGRRAV

SEQ ID NO: 316118 - protein, 17 aa, Mycobacterium
LGAAFAFAILASIVIDF

SEQ ID NO: 316119 - protein, 18 aa, Mycobacterium
LGAAIAVALGLWPRLKEY

SEQ ID NO: 316120 - protein, 18 aa, Mycobacterium
LGAAIAVALGLWPRLREY

SEQ ID NO: 316121 - protein, 20 aa, Mycobacterium
LGAALRYAALEKDAVIVAAA

SEQ ID NO: 316122 - protein, 30 aa, Mycobacterium
LGAAPRMSIALARLSPRFATTDFADPGPSD

SEQ ID NO: 316123 - protein, 18 aa, Mycobacterium
LGAAVSVVLPGVVIPIAS

SEQ ID NO: 316124 - protein, 17 aa, Mycobacterium
LGAAVWLLTRLSVTESK

SEQ ID NO: 316125 - protein, 19 aa, Mycobacterium
LGAAWRIMHAIPAAKAARR

SEQ ID NO: 316126 - protein, 20 aa, Mycobacterium
LGADEISAWARVDDTGVGID

SEQ ID NO: 316127 - protein, 17 aa, Mycobacterium
LGAELLAAVGDPALIGS

SEQ ID NO: 316128 - protein, 33 aa, Mycobacterium
LGAELVFAAFLYRRWNLPVAVLAGAAAGVALAV

SEQ ID NO: 316129 - protein, 42 aa, Mycobacterium
LGAEPRLAVPSVYARLVLLWFLCSAFPIAVIASLVVLRSYGW

SEQ ID NO: 316130 - protein, 18 aa, Mycobacterium
LGAFAERAATVGTLKAGQ

SEQ ID NO: 316131 - protein, 18 aa, Mycobacterium
LGAFAFGVAKQAHYLPVL

SEQ ID NO: 316132 - protein, 17 aa, Mycobacterium
LGAFALVLTGYVINDAV

SEQ ID NO: 316133 - protein, 20 aa, Mycobacterium
LGAFILALAPGWFGVLAAIQ

SEQ ID NO: 316134 - protein, 17 aa, Mycobacterium
LGAGALVMIGGTVGVAA

SEQ ID NO: 316135 - protein, 18 aa, Mycobacterium
LGAGAPLFTVFTHDATDT

SEQ ID NO: 316136 - protein, 18 aa, Mycobacterium
LGAGEYKTSIPLRTPADD

SEQ ID NO: 316137 - protein, 24 aa, Mycobacterium
LGAGLPALFALGVRLQAAGAGAIG

SEQ ID NO: 316138 - protein, 32 aa, Mycobacterium
LGAIGLIEWPVLLAVGGGALVLQRIARQQKES

SEQ ID NO: 316139 - protein, 33 aa, Mycobacterium
LGAIPLPHLDAGPFLSYGIQWIAFGIIAPIGLG

SEQ ID NO: 316140 - protein, 32 aa, Mycobacterium
LGAIPLPQLDAGPFLSYGIQWIAFGILAPIGL

SEQ ID NO: 316141 - protein, 17 aa, Mycobacterium
LGAKIGRGVWCETYWLP

SEQ ID NO: 316142 - protein, 19 aa, Mycobacterium
LGALCFPRGKTHPKPVTIG

SEQ ID NO: 316143 - protein, 25 aa, Mycobacterium
LGALFIIIWRCWRVLGFSANAPLAI

SEQ ID NO: 316144 - protein, 29 aa, Mycobacterium
LGALGALIVALVIYAVIQLFSSDDSSSTT

SEQ ID NO: 316145 - protein, 17 aa, Mycobacterium
LGALGLVKRFAKGLVVR

SEQ ID NO: 316146 - protein, 21 aa, Mycobacterium
LGALLMLPGVRGLGPGPVTTG

SEQ ID NO: 316147 - protein, 26 aa, Mycobacterium
LGALLRRLEPDWSMTVIERLDAVAAE

SEQ ID NO: 316148 - protein, 26 aa, Mycobacterium
LGALLRRLQPEWSLTFVERLDAVAAE

SEQ ID NO: 316149 - protein, 24 aa, Mycobacterium
LGALPPERRASAALPVGGGGAAEA

SEQ ID NO: 316150 - protein, 20 aa, Mycobacterium
LGALPPGWVLWRRQVRDRPN

SEQ ID NO: 316151 - protein, 20 aa, Mycobacterium
LGALRLHARLSARRLLPALA

SEQ ID NO: 316152 - protein, 27 aa, Mycobacterium
LGALRQCLRLLPLTCAFIGVAVAGCLV

SEQ ID NO: 316153 - protein, 24 aa, Mycobacterium
LGALRVNWALGLQLFDYTGETAPG

SEQ ID NO: 316154 - protein, 19 aa, Mycobacterium
LGALTFLPTFMQFVDGVSA

SEQ ID NO: 316155 - protein, 18 aa, Mycobacterium
LGALVLGVADWWRRDAAT

SEQ ID NO: 316156 - protein, 17 aa, Mycobacterium
LGALWWSAMPAYLNASN

SEQ ID NO: 316157 - protein, 18 aa, Mycobacterium
LGAMASWSVLGVLLSLYP

SEQ ID NO: 316158 - protein, 17 aa, Mycobacterium
LGAMIEFIAIVRTVAAI

SEQ ID NO: 316159 - protein, 29 aa, Mycobacterium
LGANIYWLGEQWWRPLIAVGAVALGITVI

SEQ ID NO: 316160 - protein, 23 aa, Mycobacterium
LGANWRTCAIAALTAATIDRLGR

SEQ ID NO: 316161 - protein, 17 aa, Mycobacterium
LGAPSTIAMPLAGDPSA

SEQ ID NO: 316162 - protein, 24 aa, Mycobacterium
LGARLPAMPVYAWDPNARGTEDSS

SEQ ID NO: 316163 - protein, 25 aa, Mycobacterium
LGARPDAPGDVYLVGASPELAQVAD

SEQ ID NO: 316164 - protein, 18 aa, Mycobacterium
LGARRMYFAAVGIWSVAT

SEQ ID NO: 316165 - protein, 21 aa, Mycobacterium
LGARVGIAVVVVLAVLTGWLG

SEQ ID NO: 316166 - protein, 28 aa, Mycobacterium
LGASAFWRLRREHVRLVAVGAVIAVVAA

SEQ ID NO: 316167 - protein, 25 aa, Mycobacterium
LGASFPALLPVVLAAAVWNGAFGGI

SEQ ID NO: 316168 - protein, 29 aa, Mycobacterium
LGASGSWIPYYLCELSMRVSDLQYRTVVV

SEQ ID NO: 316169 - protein, 23 aa, Mycobacterium
LGASKLRGAISLFLGLAIGCVGI

SEQ ID NO: 316170 - protein, 18 aa, Mycobacterium
LGATFALVEMRVVLREIL

SEQ ID NO: 316171 - protein, 23 aa, Mycobacterium
LGAVAVIVLVNWISERTRLPSAP

SEQ ID NO: 316172 - protein, 24 aa, Mycobacterium
LGAVCSLAMIVPAARWQRQIAALM

SEQ ID NO: 316173 - protein, 18 aa, Mycobacterium
LGAVFVHWLIFQSLYRIG

SEQ ID NO: 316174 - protein, 19 aa, Mycobacterium
LGAVGIWKAGMFHVLIAVA

SEQ ID NO: 316175 - protein, 18 aa, Mycobacterium
LGAVVFYLALKYTGEFLL

SEQ ID NO: 316176 - protein, 17 aa, Mycobacterium
LGAVVVPVVHFYGRKEL

SEQ ID NO: 316177 - protein, 25 aa, Mycobacterium
LGAWARFAGVAWPRGGKLAHVAVAG

SEQ ID NO: 316178 - protein, 19 aa, Mycobacterium
LGAWLPGQLLQGLGVGATL

SEQ ID NO: 316179 - protein, 28 aa, Mycobacterium
LGCGEGGDAVWLAERGWRVTAVDISHTA

SEQ ID NO: 316180 - protein, 22 aa, Mycobacterium
LGCKRPSFHNSYLATYNRSNVS

SEQ ID NO: 316181 - protein, 23 aa, Mycobacterium
LGCLPMLAQVPVFLGLYHTLMSF

SEQ ID NO: 316182 - protein, 17 aa, Mycobacterium
LGCTLFHLLTGHAPFSD

SEQ ID NO: 316183 - protein, 17 aa, Mycobacterium
LGCTPLDPVGWAQALGA

SEQ ID NO: 316184 - protein, 24 aa, Mycobacterium
LGDAGWPDSVFVFSLYAFLCATAL

SEQ ID NO: 316185 - protein, 19 aa, Mycobacterium
LGDARLFTQFVIRSAAAGA

SEQ ID NO: 316186 - protein, 22 aa, Mycobacterium
LGDEAWVPRRGRGRDGQQPSDS

SEQ ID NO: 316187 - protein, 17 aa, Mycobacterium
LGDHTFALIAIGLIGTW

SEQ ID NO: 316188 - protein, 18 aa, Mycobacterium
LGDLAMLLILVASLSAIG

SEQ ID NO: 316189 - protein, 22 aa, Mycobacterium
LGDLLSRPGVFVFGSNDYFGPR

SEQ ID NO: 316190 - protein, 24 aa, Mycobacterium
LGDLVIFGGYFVIFMIYRAMNPDE

SEQ ID NO: 316191 - protein, 24 aa, Mycobacterium
LGDPRAVAGVGFLLVFMLPALAGY

SEQ ID NO: 316192 - protein, 17 aa, Mycobacterium
LGDRADMVFKGTAVTTG

SEQ ID NO: 316193 - protein, 23 aa, Mycobacterium
LGDRIGRQRVLAIVILLMSASTL

SEQ ID NO: 316194 - protein, 25 aa, Mycobacterium
LGDRLGRKRVLAITILMMAGATLCV

SEQ ID NO: 316195 - protein, 25 aa, Mycobacterium
LGDRLGRKRVLAMTILLMAGATFCV

SEQ ID NO: 316196 - protein, 23 aa, Mycobacterium
LGDRLGRQRVLAIVILLMSAATL

SEQ ID NO: 316197 - protein, 20 aa, Mycobacterium
LGDRLMRRPGRHRADGDGRD

SEQ ID NO: 316198 - protein, 25 aa, Mycobacterium
LGDSARDGLGWLVVAGFAVAVSATL

SEQ ID NO: 316199 - protein, 26 aa, Mycobacterium
LGDSARPGMGWLVAVAFLGAVVSAVA

SEQ ID NO: 316200 - protein, 20 aa, Mycobacterium
LGDSRTDLFGTIKNLQTLVD

SEQ ID NO: 316201 - protein, 26 aa, Mycobacterium
LGDSYSGDTWRMWSYAWEARDTGFHT

SEQ ID NO: 316202 - protein, 18 aa, Mycobacterium
LGDTFRWKGENVATTEVE

SEQ ID NO: 316203 - protein, 19 aa, Mycobacterium
LGDVRFELFVTVAATCVAS

SEQ ID NO: 316204 - protein, 22 aa, Mycobacterium
LGDVWRCLRCGDFTLGEPHGRG

SEQ ID NO: 316205 - protein, 27 aa, Mycobacterium
LGEAIPLRFVTGFALAGVYPVGMKLMA

SEQ ID NO: 316206 - protein, 27 aa, Mycobacterium
LGEHRLRKGAAAAVVDWVRGEGGTVPV

SEQ ID NO: 316207 - protein, 24 aa, Mycobacterium
LGEIAEGALLLFLFSVGHALEGYA

SEQ ID NO: 316208 - protein, 17 aa, Mycobacterium
LGEIERLSIIGGAGDAQ

SEQ ID NO: 316209 - protein, 18 aa, Mycobacterium
LGELKGVVADLQITAHAA

SEQ ID NO: 316210 - protein, 27 aa, Mycobacterium
LGELLTCPFCLDMWVATALVIGLIFAP

SEQ ID NO: 316211 - protein, 32 aa, Mycobacterium
LGELLTCPFCLDMWVATGFAIGLVFAPRYTRL

SEQ ID NO: 316212 - protein, 41 aa, Mycobacterium
LGELLTCPFCLDMWVATGFAIGLVFVPRFTRLIAGVFSALA

SEQ ID NO: 316213 - protein, 22 aa, Mycobacterium
LGELRPAFDDIRPLRHGSIDDA

SEQ ID NO: 316214 - protein, 29 aa, Mycobacterium
LGENDMQAWGWRLPFLVAAPLGLVGIYLR

SEQ ID NO: 316215 - protein, 19 aa, Mycobacterium
LGENPKLILLGVGLGVAAV

SEQ ID NO: 316216 - protein, 19 aa, Mycobacterium
LGEQLRTLITVPLFHVTGC

SEQ ID NO: 316217 - protein, 19 aa, Mycobacterium
LGEQPALWIPGSSISSARL

SEQ ID NO: 316218 - protein, 18 aa, Mycobacterium
LGETLPFDAGKILGLGLA

SEQ ID NO: 316219 - protein, 18 aa, Mycobacterium
LGETYAHASPDLWDALEH

SEQ ID NO: 316220 - protein, 17 aa, Mycobacterium
LGEVKRRGATTFEVTEE

SEQ ID NO: 316221 - protein, 17 aa, Mycobacterium
LGFAHILAYDHVVGADT

SEQ ID NO: 316222 - protein, 17 aa, Mycobacterium
LGFALVFLVARAFSSGS

SEQ ID NO: 316223 - protein, 27 aa, Mycobacterium
LGFAQLPGAPGFRLPTVASPGFPDFGA

SEQ ID NO: 316224 - protein, 25 aa, Mycobacterium
LGFAVARPRGWPEALAAIPAALILV

SEQ ID NO: 316225 - protein, 25 aa, Mycobacterium
LGFAVARPRGWPEALAAVPAAVILI

SEQ ID NO: 316226 - protein, 25 aa, Mycobacterium
LGFDGALPWPAKIGLALSVGLLGGV

SEQ ID NO: 316227 - protein, 25 aa, Mycobacterium
LGFDGGLNWLGKIGVALSVGVLGGV

SEQ ID NO: 316228 - protein, 25 aa, Mycobacterium
LGFEGGLSWAGKIGVALSVGVLGGV

SEQ ID NO: 316229 - protein, 18 aa, Mycobacterium
LGFGCGSGPLTGRFMPPV

SEQ ID NO: 316230 - protein, 17 aa, Mycobacterium
LGFGVLGAMTLRRIALP

SEQ ID NO: 316231 - protein, 18 aa, Mycobacterium
LGFLTVFGVFGALTVSAA

SEQ ID NO: 316232 - protein, 26 aa, Mycobacterium
LGFPFTDHGLRLGVEASLRSLARVAP

SEQ ID NO: 316233 - protein, 17 aa, Mycobacterium
LGFQSEFRRDMSPWANF

SEQ ID NO: 316234 - protein, 20 aa, Mycobacterium
LGFRPLKAAVLALVANTAPV

SEQ ID NO: 316235 - protein, 19 aa, Mycobacterium
LGFTRMPIFQTMGMPCAVG

SEQ ID NO: 316236 - protein, 25 aa, Mycobacterium
LGFVAMALAWRWGGTVKAFVISCTS

SEQ ID NO: 316237 - protein, 24 aa, Mycobacterium
LGFVMPGDIPFQVQLPPGAVVAPQ

SEQ ID NO: 316238 - protein, 24 aa, Mycobacterium
LGFVMPGDIPFQVQLPPTAAVSPQ

SEQ ID NO: 316239 - protein, 24 aa, Mycobacterium
LGFYSPHSWWPIMIALAAATTAVG

SEQ ID NO: 316240 - protein, 19 aa, Mycobacterium
LGGAFYRSLKLSWHADLLS

SEQ ID NO: 316241 - protein, 18 aa, Mycobacterium
LGGALGFGAQRVVQDLLS

SEQ ID NO: 316242 - protein, 22 aa, Mycobacterium
LGGARLLLRLPINRSRGDDASF

SEQ ID NO: 316243 - protein, 20 aa, Mycobacterium
LGGATGELGAPVADQTESGN

SEQ ID NO: 316244 - protein, 25 aa, Mycobacterium
LGGATWRAVWIPAVVVLIGVVVLLA

SEQ ID NO: 316245 - protein, 23 aa, Mycobacterium
LGGDGLALTGFVERTGDPVPIVA

SEQ ID NO: 316246 - protein, 18 aa, Mycobacterium
LGGDLWLSSPGDPAAPLR

SEQ ID NO: 316247 - protein, 17 aa, Mycobacterium
LGGEIMAAGGISRRLIA

SEQ ID NO: 316248 - protein, 19 aa, Mycobacterium
LGGETDWAPGLVALAVLWS

SEQ ID NO: 316249 - protein, 33 aa, Mycobacterium
LGGFCTDYLHWRWAFWINLPISIVVLAVTATAI

SEQ ID NO: 316250 - protein, 19 aa, Mycobacterium
LGGFIRTQALVSFVDAVLI

SEQ ID NO: 316251 - protein, 20 aa, Mycobacterium
LGGFLVPLAYAWSKAQFGSI

SEQ ID NO: 316252 - protein, 17 aa, Mycobacterium
LGGGARAVGSFFGGRIG

SEQ ID NO: 316253 - protein, 25 aa, Mycobacterium
LGGGARLLLPIVLGVLLGGSAAAGT

SEQ ID NO: 316254 - protein, 19 aa, Mycobacterium
LGGGRVAFTAGFPALSPVM

SEQ ID NO: 316255 - protein, 18 aa, Mycobacterium
LGGGVFGLSLGKHVTQSG

SEQ ID NO: 316256 - protein, 19 aa, Mycobacterium
LGGGWWVALAELWPASSRP

SEQ ID NO: 316257 - protein, 19 aa, Mycobacterium
LGGIAVVLSLAFIAIWATL

SEQ ID NO: 316258 - protein, 20 aa, Mycobacterium
LGGIGVMFAVYGRWSQKVGW

SEQ ID NO: 316259 - protein, 19 aa, Mycobacterium
LGGIVVEWRMRRRNTVSAA

SEQ ID NO: 316260 - protein, 24 aa, Mycobacterium
LGGLALAVAVLWWLSVQRDRRQAD

SEQ ID NO: 316261 - protein, 26 aa, Mycobacterium
LGGLGDIASYCLLAAALDKGSVMLVT

SEQ ID NO: 316262 - protein, 18 aa, Mycobacterium
LGGLLIVVVALFLGVDPS

SEQ ID NO: 316263 - protein, 18 aa, Mycobacterium
LGGLLVLPGYRASFDDRN

SEQ ID NO: 316264 - protein, 20 aa, Mycobacterium
LGGLLVLPGYRASFDDRNYL

SEQ ID NO: 316265 - protein, 17 aa, Mycobacterium
LGGLMLMVTGLQVLCAL

SEQ ID NO: 316266 - protein, 39 aa, Mycobacterium
LGGLNYLLCWGLLYQLGICWQAGLLSGRRPIVLAAGSAV

SEQ ID NO: 316267 - protein, 18 aa, Mycobacterium
LGGLPALDSPEIRRDIAA

SEQ ID NO: 316268 - protein, 30 aa, Mycobacterium
LGGLPLMLGALWASARLARRADSTAAEANS

SEQ ID NO: 316269 - protein, 17 aa, Mycobacterium
LGGLRCRASRIVLHPGF

SEQ ID NO: 316270 - protein, 19 aa, Mycobacterium
LGGLTRKAKEIVISTKMSQ

SEQ ID NO: 316271 - protein, 18 aa, Mycobacterium
LGGMLLSGMLTVIVGRAV

SEQ ID NO: 316272 - protein, 20 aa, Mycobacterium
LGGNRPRWLGADIGQRQFYR

SEQ ID NO: 316273 - protein, 23 aa, Mycobacterium
LGGPTGYSGWWWLVAGVCAGAVI

SEQ ID NO: 316274 - protein, 17 aa, Mycobacterium
LGGPVGFAGTITNGTVP

SEQ ID NO: 316275 - protein, 19 aa, Mycobacterium
LGGQPALWIPGSSISAARL

SEQ ID NO: 316276 - protein, 17 aa, Mycobacterium
LGGRPGPGFAARDPKLS

SEQ ID NO: 316277 - protein, 17 aa, Mycobacterium
LGGTVMCRRRFDAQQAM

SEQ ID NO: 316278 - protein, 21 aa, Mycobacterium
LGGVARRWRLLGWSATIGALA

SEQ ID NO: 316279 - protein, 19 aa, Mycobacterium
LGGVEGWTALGCFLAALLA

SEQ ID NO: 316280 - protein, 30 aa, Mycobacterium
LGGVPLLLGALWASARLARRADAAADEANG

SEQ ID NO: 316281 - protein, 28 aa, Mycobacterium
LGGVRRLRWRLATMLAIAAGTYAVLYGV

SEQ ID NO: 316282 - protein, 17 aa, Mycobacterium
LGGVVFGHFGDKYGRKK

SEQ ID NO: 316283 - protein, 18 aa, Mycobacterium
LGGVYDRLAARGYEYGPA

SEQ ID NO: 316284 - protein, 18 aa, Mycobacterium
LGGWPSLIVSIWMLGGLT

SEQ ID NO: 316285 - protein, 18 aa, Mycobacterium
LGGWWPVVLAGGVLVAAV

SEQ ID NO: 316286 - protein, 30 aa, Mycobacterium
LGGYFTDHFTWRWAFWINVPISVVVFFVAA

SEQ ID NO: 316287 - protein, 30 aa, Mycobacterium
LGGYFTDYLTWRWAFWINVPISVVVILVAA

SEQ ID NO: 316288 - protein, 29 aa, Mycobacterium
LGGYFTDYLTWRWAFWVNVPISVVVIFVA

SEQ ID NO: 316289 - protein, 28 aa, Mycobacterium
LGGYGHAREVWWMLAAQLVIVLALIAVL

SEQ ID NO: 316290 - protein, 18 aa, Mycobacterium
LGGYLSSVQIDWSLALAV

SEQ ID NO: 316291 - protein, 18 aa, Mycobacterium
LGHALSGHAVYRTMMMHL

SEQ ID NO: 316292 - protein, 21 aa, Mycobacterium
LGHATDLLFAGMMGRQLPAGT

SEQ ID NO: 316293 - protein, 21 aa, Mycobacterium
LGHATDLLFNGVIGRQLPAGI

SEQ ID NO: 316294 - protein, 18 aa, Mycobacterium
LGHLAFSVLDEWLQPVSV

SEQ ID NO: 316295 - protein, 22 aa, Mycobacterium
LGHPEHLRRLYAEVDGLAGALP

SEQ ID NO: 316296 - protein, 23 aa, Mycobacterium
LGHVVPLPIMLWLKGIDGPIEEF

SEQ ID NO: 316297 - protein, 17 aa, Mycobacterium
LGIAILLGGNWLVCLLA

SEQ ID NO: 316298 - protein, 27 aa, Mycobacterium
LGIARRAGTPISFWEFTRKGVVVTAVS

SEQ ID NO: 316299 - protein, 17 aa, Mycobacterium
LGIDPSLIDSPPMETPD

SEQ ID NO: 316300 - protein, 17 aa, Mycobacterium
LGIDRFLLVQWLAPLAS

SEQ ID NO: 316301 - protein, 19 aa, Mycobacterium
LGIELHWLVLAMSVIILLA

SEQ ID NO: 316302 - protein, 18 aa, Mycobacterium
LGIELHWMTMAFSVIVLL

SEQ ID NO: 316303 - protein, 21 aa, Mycobacterium
LGIEMYRWWRSPSVGPDGARP

SEQ ID NO: 316304 - protein, 20 aa, Mycobacterium
LGIFEIVSSFGIRKASQTLT

SEQ ID NO: 316305 - protein, 21 aa, Mycobacterium
LGIFSALSFWYVPKLGLRLVL

SEQ ID NO: 316306 - protein, 17 aa, Mycobacterium
LGIHLDPATPFSVTVSF

SEQ ID NO: 316307 - protein, 22 aa, Mycobacterium
LGIKGSALMDLLFVAGIVTAIL

SEQ ID NO: 316308 - protein, 22 aa, Mycobacterium
LGILSALSFWYVPKLGLRLVLL

SEQ ID NO: 316309 - protein, 17 aa, Mycobacterium
LGIPLAIGMTVVVLTAL

SEQ ID NO: 316310 - protein, 37 aa, Mycobacterium
LGIPLLVLAWMFRQRVLRLPFSRPLATYAISASPDGV

SEQ ID NO: 316311 - protein, 17 aa, Mycobacterium
LGIPSALGLLVVVAGAM

SEQ ID NO: 316312 - protein, 20 aa, Mycobacterium
LGIRICIVAAVVAALVVVEY

SEQ ID NO: 316313 - protein, 25 aa, Mycobacterium
LGISRGIWRYCERLAGHDIALRGAA

SEQ ID NO: 316314 - protein, 24 aa, Mycobacterium
LGISRISLNFAMFRSAFEQGAQLG

SEQ ID NO: 316315 - protein, 17 aa, Mycobacterium
LGITGPVLRSTGLPHDL

SEQ ID NO: 316316 - protein, 18 aa, Mycobacterium
LGITICSILLGRVAEPAV

SEQ ID NO: 316317 - protein, 18 aa, Mycobacterium
LGITICSILLGRVGEPAV

SEQ ID NO: 316318 - protein, 24 aa, Mycobacterium
LGITRISLNFAMFRSAFEQGAQLG

SEQ ID NO: 316319 - protein, 17 aa, Mycobacterium
LGIVAGVAFVFFGLWTL

SEQ ID NO: 316320 - protein, 17 aa, Mycobacterium
LGIVGWIVLVAFTDGGV

SEQ ID NO: 316321 - protein, 25 aa, Mycobacterium
LGIVIVSLIGWWALSRLLERMRGIP

SEQ ID NO: 316322 - protein, 27 aa, Mycobacterium
LGIWVFKPLRLRATASIAEFDERRRKD

SEQ ID NO: 316323 - protein, 33 aa, Mycobacterium
LGKALYRFALRNRTWWPPPNWVLLWAKTLIVGG

SEQ ID NO: 316324 - protein, 18 aa, Mycobacterium
LGKFGCLLLGYAGAVLLH

SEQ ID NO: 316325 - protein, 17 aa, Mycobacterium
LGKKLLGMRVHGPPGAE

SEQ ID NO: 316326 - protein, 22 aa, Mycobacterium
LGKLHFWLTLIGFHTTFLVQHW

SEQ ID NO: 316327 - protein, 24 aa, Mycobacterium
LGKPDPWWVFLAAFAVLVVSILPW

SEQ ID NO: 316328 - protein, 20 aa, Mycobacterium
LGKPGLELFVDVALTCVASA

SEQ ID NO: 316329 - protein, 26 aa, Mycobacterium
LGKRWGRGVAVFTQLLLLPVAWYLSV

SEQ ID NO: 316330 - protein, 22 aa, Mycobacterium
LGLAAGVFFVWWEQHTDQPALD

SEQ ID NO: 316331 - protein, 19 aa, Mycobacterium
LGLAALAMRLGWLPEGALA

SEQ ID NO: 316332 - protein, 24 aa, Mycobacterium
LGLAEVFGGLLLLLPRTTAAGALV

SEQ ID NO: 316333 - protein, 17 aa, Mycobacterium
LGLAGLSAWLITRAWQM

SEQ ID NO: 316334 - protein, 17 aa, Mycobacterium
LGLAGVYLVFAYSAFGF

SEQ ID NO: 316335 - protein, 17 aa, Mycobacterium
LGLAIAFLLSIAAAFVV

SEQ ID NO: 316336 - protein, 19 aa, Mycobacterium
LGLAIALAGVWSHFPTWLN

SEQ ID NO: 316337 - protein, 17 aa, Mycobacterium
LGLARIRRTGELGRDRA

SEQ ID NO: 316338 - protein, 26 aa, Mycobacterium
LGLCFLPSFICLGIVPVVMGLARDVF

SEQ ID NO: 316339 - protein, 18 aa, Mycobacterium
LGLCGVAAGWGWADGVAG

SEQ ID NO: 316340 - protein, 17 aa, Mycobacterium
LGLDRALPIQFFDYLGG

SEQ ID NO: 316341 - protein, 21 aa, Mycobacterium
LGLDVHRFRAAMFVVVALMVG

SEQ ID NO: 316342 - protein, 23 aa, Mycobacterium
LGLELCIVSAPLGACVLSCVERG

SEQ ID NO: 316343 - protein, 20 aa, Mycobacterium
LGLFPLFVMFVITAITMQRE

SEQ ID NO: 316344 - protein, 22 aa, Mycobacterium
LGLGAALTFLGLRMQRPGHPAP

SEQ ID NO: 316345 - protein, 26 aa, Mycobacterium
LGLGGWASVHLFGFPALDNTAPLFAF

SEQ ID NO: 316346 - protein, 24 aa, Mycobacterium
LGLGMPKTAPWEIVRLLVDGPVLS

SEQ ID NO: 316347 - protein, 25 aa, Mycobacterium
LGLGREHWKPGLGYALAAVAVVASV

SEQ ID NO: 316348 - protein, 19 aa, Mycobacterium
LGLHGGAWAGLLCLLVGSS

SEQ ID NO: 316349 - protein, 24 aa, Mycobacterium
LGLHIPLWLGYAFSTLLIFPLVIY

SEQ ID NO: 316350 - protein, 17 aa, Mycobacterium
LGLIAGAMFIFFGLWTL

SEQ ID NO: 316351 - protein, 23 aa, Mycobacterium
LGLLIFAAVSWRCRPKLRLADDG

SEQ ID NO: 316352 - protein, 18 aa, Mycobacterium
LGLLLMIIGFHAIDFTTP

SEQ ID NO: 316353 - protein, 48 aa, Mycobacterium
LGLLSMAAPMLFGGAWAGWLAFAATVPVQFVAGWPFLVGAVQQARAGS

SEQ ID NO: 316354 - protein, 26 aa, Mycobacterium
LGLLVIAIMVAWRWAPAKAAAVPGPL

SEQ ID NO: 316355 - protein, 26 aa, Mycobacterium
LGLLVIAIMVAWRWAPAKVAPVPGPL

SEQ ID NO: 316356 - protein, 23 aa, Mycobacterium
LGLLWPHIHLPHAWGIAAVALIV

SEQ ID NO: 316357 - protein, 24 aa, Mycobacterium
LGLLWWMMVCWAQPVRNRPDKNVF

SEQ ID NO: 316358 - protein, 24 aa, Mycobacterium
LGLLWWMMVCWSQPLRGRSDHPVF

SEQ ID NO: 316359 - protein, 26 aa, Mycobacterium
LGLLWYAGLPLKVFVSSLFAVVASAI

SEQ ID NO: 316360 - protein, 19 aa, Mycobacterium
LGLMLGRARREGIESWKAA

SEQ ID NO: 316361 - protein, 23 aa, Mycobacterium
LGLMRAIICQLAFSHGPDHVQMV

SEQ ID NO: 316362 - protein, 22 aa, Mycobacterium
LGLMRAIICQLTFSHGPDHVQF

SEQ ID NO: 316363 - protein, 22 aa, Mycobacterium
LGLMRAIICQLTFSHGPDHVQL

SEQ ID NO: 316364 - protein, 24 aa, Mycobacterium
LGLMRAILCELVFFHGPDHLRLVV

SEQ ID NO: 316365 - protein, 24 aa, Mycobacterium
LGLMRAIVCQLAFSHGPDHVRMIV

SEQ ID NO: 316366 - protein, 23 aa, Mycobacterium
LGLPAPVPAPWPILRTLPAGPEL

SEQ ID NO: 316367 - protein, 23 aa, Mycobacterium
LGLPFFILIGLILARQWKLLGAY

SEQ ID NO: 316368 - protein, 27 aa, Mycobacterium
LGLPGFRHSIGLARWWHLGVDVLWLVN

SEQ ID NO: 316369 - protein, 21 aa, Mycobacterium
LGLPGSDRVDVYWHRMGVNIV

SEQ ID NO: 316370 - protein, 17 aa, Mycobacterium
LGLPPFRVPAPRNSAQH

SEQ ID NO: 316371 - protein, 22 aa, Mycobacterium
LGLPPWMVFFGFSVSLIYQFWV

SEQ ID NO: 316372 - protein, 24 aa, Mycobacterium
LGLPQILLCWAMEPLLQALCVVSA

SEQ ID NO: 316373 - protein, 17 aa, Mycobacterium
LGLQIPFGTVWAEEAAF

SEQ ID NO: 316374 - protein, 17 aa, Mycobacterium
LGLQRFPTIDVISEELF

SEQ ID NO: 316375 - protein, 23 aa, Mycobacterium
LGLRSFNYFGWFFLVPGVLAAAV

SEQ ID NO: 316376 - protein, 20 aa, Mycobacterium
LGLRVYLGWITSTGYTYGAL

SEQ ID NO: 316377 - protein, 26 aa, Mycobacterium
LGLSERRRSRRAWAAIGSVAATLLAL

SEQ ID NO: 316378 - protein, 17 aa, Mycobacterium
LGLSIGATNLAAVTADS

SEQ ID NO: 316379 - protein, 25 aa, Mycobacterium
LGLSLGETGSRGMLSAGSVIPVQQT

SEQ ID NO: 316380 - protein, 24 aa, Mycobacterium
LGLSRISLNFAMFRSAFEQGAQLG

SEQ ID NO: 316381 - protein, 26 aa, Mycobacterium
LGLSSLRAGLIAGAIGLAAVLLYSLL

SEQ ID NO: 316382 - protein, 20 aa, Mycobacterium
LGLSVAKGFVEAMGGTISAG

SEQ ID NO: 316383 - protein, 19 aa, Mycobacterium
LGLTDQWLFSRISDDIMNF

SEQ ID NO: 316384 - protein, 27 aa, Mycobacterium
LGLTLLAGGGALVFLSGYVVPRVSSWL

SEQ ID NO: 316385 - protein, 18 aa, Mycobacterium
LGLVLWAPMGGWQLGRHL

SEQ ID NO: 316386 - protein, 17 aa, Mycobacterium
LGLVLWAPMGGWQLSRQ

SEQ ID NO: 316387 - protein, 17 aa, Mycobacterium
LGLVVLLLSRRRPLVQL

SEQ ID NO: 316388 - protein, 24 aa, Mycobacterium
LGLYYLRLPSLVGVGQYTLYAELP

SEQ ID NO: 316389 - protein, 17 aa, Mycobacterium
LGMAVGRIGCHLTEAPG

SEQ ID NO: 316390 - protein, 17 aa, Mycobacterium
LGMFCVIAAVALIAAIT

SEQ ID NO: 316391 - protein, 17 aa, Mycobacterium
LGMGIGWGLYGNTRSPL

SEQ ID NO: 316392 - protein, 33 aa, Mycobacterium
LGMHAAHPVAMLGFMVLISFAFVAATQAINALV

SEQ ID NO: 316393 - protein, 18 aa, Mycobacterium
LGMLAVWSRQTAGDNPGP

SEQ ID NO: 316394 - protein, 22 aa, Mycobacterium
LGMPHWLGVVLIAAIAVAYTGT

SEQ ID NO: 316395 - protein, 25 aa, Mycobacterium
LGMVCAHPPGLLNLVLVDFKGGATF

SEQ ID NO: 316396 - protein, 17 aa, Mycobacterium
LGMVCSQSATVLGYPSP

SEQ ID NO: 316397 - protein, 18 aa, Mycobacterium
LGNARLFTQFVVRSAAAG

SEQ ID NO: 316398 - protein, 18 aa, Mycobacterium
LGNFGRLGIDQGTFGPGV

SEQ ID NO: 316399 - protein, 24 aa, Mycobacterium
LGNGKFFINLPVSVPYKAVEVGST

SEQ ID NO: 316400 - protein, 27 aa, Mycobacterium
LGNGWVATICAVLLLLAGGAVAAGVLS

SEQ ID NO: 316401 - protein, 18 aa, Mycobacterium
LGNLNARKVVVLVNPTTN

SEQ ID NO: 316402 - protein, 18 aa, Mycobacterium
LGNLPVWLRYSGQIVSGY

SEQ ID NO: 316403 - protein, 29 aa, Mycobacterium
LGNLRSAPVPFILAEAAAMPPPVEGAPHL

SEQ ID NO: 316404 - protein, 25 aa, Mycobacterium
LGNLRSAPVPFILAEANPQQPAAPP

SEQ ID NO: 316405 - protein, 21 aa, Mycobacterium
LGNRQAGAFVHLPGVSEAELA

SEQ ID NO: 316406 - protein, 17 aa, Mycobacterium
LGNSWWAYPLILASCTF

SEQ ID NO: 316407 - protein, 37 aa, Mycobacterium
LGNTDLAYEFGFWAGACLPLGLALCLLITGIFFAKPM

SEQ ID NO: 316408 - protein, 24 aa, Mycobacterium
LGNVDLHAFWSAWGPNTISPQWVS

SEQ ID NO: 316409 - protein, 20 aa, Mycobacterium
LGNVSRPCVLVVADKAGHVV

SEQ ID NO: 316410 - protein, 29 aa, Mycobacterium
LGPAAGFFMGWSYWFAWIVTGIADLVAIT

SEQ ID NO: 316411 - protein, 29 aa, Mycobacterium
LGPAAGYFMGWSYWFAWIVAGIADLVAIT

SEQ ID NO: 316412 - protein, 21 aa, Mycobacterium
LGPARRAIRVAVGRRQYDQIT

SEQ ID NO: 316413 - protein, 17 aa, Mycobacterium
LGPEGTDVLFGVVNAST

SEQ ID NO: 316414 - protein, 19 aa, Mycobacterium
LGPELSRLITGTSNLAIDA

SEQ ID NO: 316415 - protein, 20 aa, Mycobacterium
LGPELSRLVSGTAKLATDSR

SEQ ID NO: 316416 - protein, 24 aa, Mycobacterium
LGPGIPLALLYAAKWYVGKIPPVP

SEQ ID NO: 316417 - protein, 17 aa, Mycobacterium
LGPGLQEKLAFVWELPD

SEQ ID NO: 316418 - protein, 24 aa, Mycobacterium
LGPGPRWWGVALLAVGAVTALYGV

SEQ ID NO: 316419 - protein, 17 aa, Mycobacterium
LGPGRRGHFGGGAPGRS

SEQ ID NO: 316420 - protein, 21 aa, Mycobacterium
LGPHEWMWWASYRESIRTAIA

SEQ ID NO: 316421 - protein, 18 aa, Mycobacterium
LGPIRVLITFPDGGAASP

SEQ ID NO: 316422 - protein, 26 aa, Mycobacterium
LGPPPTMPPALAWWAASLQLSGLSVG

SEQ ID NO: 316423 - protein, 17 aa, Mycobacterium
LGPQLGIVKRSILQDWR

SEQ ID NO: 316424 - protein, 17 aa, Mycobacterium
LGPQTGGLVTWRDLTAL

SEQ ID NO: 316425 - protein, 23 aa, Mycobacterium
LGPRAGFAAGAIQLLAYLALAAK

SEQ ID NO: 316426 - protein, 23 aa, Mycobacterium
LGPRELDIAWLIFAHLVFQEIAG

SEQ ID NO: 316427 - protein, 17 aa, Mycobacterium
LGPRLDALDVRRLLRRV

SEQ ID NO: 316428 - protein, 19 aa, Mycobacterium
LGPSLVFVVALALSMAGLA

SEQ ID NO: 316429 - protein, 26 aa, Mycobacterium
LGPVIRLPLVLGLAELLGRIPLPGSA

SEQ ID NO: 316430 - protein, 31 aa, Mycobacterium
LGPVPIRAYALCIIVGIVAALVIGDRRWQAR

SEQ ID NO: 316431 - protein, 23 aa, Mycobacterium
LGPVSARFTGLVQLAAYAALGVG

SEQ ID NO: 316432 - protein, 17 aa, Mycobacterium
LGPVWLAALGYAVACQV

SEQ ID NO: 316433 - protein, 22 aa, Mycobacterium
LGPWFWWPQRVRTRPVPAPWPR

SEQ ID NO: 316434 - protein, 30 aa, Mycobacterium
LGPWLDRLQAFDVFSSFWFTAIYVLLFISL

SEQ ID NO: 316435 - protein, 18 aa, Mycobacterium
LGPYSFRAVFAVFIVVAL

SEQ ID NO: 316436 - protein, 26 aa, Mycobacterium
LGQALGWRSAFGLVVFVGVLTLAALW

SEQ ID NO: 316437 - protein, 18 aa, Mycobacterium
LGQAVGWSDGRMIALLAA

SEQ ID NO: 316438 - protein, 21 aa, Mycobacterium
LGQFFSWIPVISLSYAQIIIG

SEQ ID NO: 316439 - protein, 25 aa, Mycobacterium
LGQGCIHSRVKFDLRHRDGLRTYRN

SEQ ID NO: 316440 - protein, 17 aa, Mycobacterium
LGQPGIDPDSLWLPMRP

SEQ ID NO: 316441 - protein, 21 aa, Mycobacterium
LGQRGKLGVRDVLFGGKVSYL

SEQ ID NO: 316442 - protein, 20 aa, Mycobacterium
LGQRQRLALARVLGSPSPVL

SEQ ID NO: 316443 - protein, 17 aa, Mycobacterium
LGQRQRLGLARALGSNA

SEQ ID NO: 316444 - protein, 17 aa, Mycobacterium
LGQRQRLGLARALGSSA

SEQ ID NO: 316445 - protein, 17 aa, Mycobacterium
LGQRQRLGLARALGSTA

SEQ ID NO: 316446 - protein, 17 aa, Mycobacterium
LGQRQRLGLARVLGSPA

SEQ ID NO: 316447 - protein, 20 aa, Mycobacterium
LGQRQRLGLVRALGAPADVL

SEQ ID NO: 316448 - protein, 22 aa, Mycobacterium
LGQTAKLYIRPVVQAVPAQPKE

SEQ ID NO: 316449 - protein, 25 aa, Mycobacterium
LGQTARLYIRPVMNSMPAQPAAQEP

SEQ ID NO: 316450 - protein, 17 aa, Mycobacterium
LGQTGPSWIGFLAALLA

SEQ ID NO: 316451 - protein, 27 aa, Mycobacterium
LGQVLRLPARFVLGALAGLRMVGLLGQ

SEQ ID NO: 316452 - protein, 28 aa, Mycobacterium
LGRDTRAAIKITTIFGSRYIDLHPTGAG

SEQ ID NO: 316453 - protein, 22 aa, Mycobacterium
LGREHWKTGAGYALAAVGVVLS

SEQ ID NO: 316454 - protein, 25 aa, Mycobacterium
LGREHWRSGAGYALGAVALVGTVIA

SEQ ID NO: 316455 - protein, 25 aa, Mycobacterium
LGREPRGVLEIAYRCPNGEPGVVKT

SEQ ID NO: 316456 - protein, 19 aa, Mycobacterium
LGRFLPIIFTLALAGSLAT

SEQ ID NO: 316457 - protein, 28 aa, Mycobacterium
LGRGAVRGLKMLMWTAVIAVVVVGLGLL

SEQ ID NO: 316458 - protein, 24 aa, Mycobacterium
LGRIDPAFNGFRIAVVSDIHLGPM

SEQ ID NO: 316459 - protein, 26 aa, Mycobacterium
LGRISPRGATPLNFFVGGLQVVTPTV

SEQ ID NO: 316460 - protein, 17 aa, Mycobacterium
LGRPLGRLIDRDNSADE

SEQ ID NO: 316461 - protein, 20 aa, Mycobacterium
LGRQHWRSGMGYALAAVAVV

SEQ ID NO: 316462 - protein, 24 aa, Mycobacterium
LGRQRLAGVPGRALRLAAAALGAG

SEQ ID NO: 316463 - protein, 27 aa, Mycobacterium
LGRRDMGVAFGWSMFNWVADVACLGFA

SEQ ID NO: 316464 - protein, 17 aa, Mycobacterium
LGRRPGITSIVISAVNT

SEQ ID NO: 316465 - protein, 24 aa, Mycobacterium
LGRSWDALCMAWRAVLAHPNEPLA

SEQ ID NO: 316466 - protein, 23 aa, Mycobacterium
LGSAGLYWLGTRWSKGTVVAAER

SEQ ID NO: 316467 - protein, 26 aa, Mycobacterium
LGSALALAGIAAWLITRAWQMPPVLD

SEQ ID NO: 316468 - protein, 25 aa, Mycobacterium
LGSALALAGVSAWLITRASQMPPVL

SEQ ID NO: 316469 - protein, 27 aa, Mycobacterium
LGSALALTAVSAWLITRAWQMPPVLHL

SEQ ID NO: 316470 - protein, 25 aa, Mycobacterium
LGSALKRYGITVLPARNGQAGLDAL

SEQ ID NO: 316471 - protein, 20 aa, Mycobacterium
LGSARAVQGLGWLRRHTRTI

SEQ ID NO: 316472 - protein, 23 aa, Mycobacterium
LGSDPFVAILGFPFIPQAMRHRY

SEQ ID NO: 316473 - protein, 25 aa, Mycobacterium
LGSFSRIGALAAIMLVFTLVFANFF

SEQ ID NO: 316474 - protein, 28 aa, Mycobacterium
LGSGAWWLARLEWELVLAVVTAALLCLL

SEQ ID NO: 316475 - protein, 26 aa, Mycobacterium
LGSGLALAGVSAWLITRAWQMPPVLD

SEQ ID NO: 316476 - protein, 25 aa, Mycobacterium
LGSGVLLRFWDWHAIFWSLGAAGLV

SEQ ID NO: 316477 - protein, 18 aa, Mycobacterium
LGSIAIELILGVALLVLA

SEQ ID NO: 316478 - protein, 17 aa, Mycobacterium
LGSIVFIVASWPVASHS

SEQ ID NO: 316479 - protein, 19 aa, Mycobacterium
LGSIWPLLVAAVITAAAAI

SEQ ID NO: 316480 - protein, 17 aa, Mycobacterium
LGSLFGLFDPKRRVKAR

SEQ ID NO: 316481 - protein, 17 aa, Mycobacterium
LGSLLIVVSTIWLTAWL

SEQ ID NO: 316482 - protein, 21 aa, Mycobacterium
LGSLLQWMFYVGLLVTVADVL

SEQ ID NO: 316483 - protein, 18 aa, Mycobacterium
LGSLLSWMFYVGLLITVA

SEQ ID NO: 316484 - protein, 23 aa, Mycobacterium
LGSLRSAWRLERRRLNRRGKSVW

SEQ ID NO: 316485 - protein, 17 aa, Mycobacterium
LGSMAGQAAFDWLPDIS

SEQ ID NO: 316486 - protein, 31 aa, Mycobacterium
LGSMLLALYWRKARPDLYDRIGSTIFDDREP

SEQ ID NO: 316487 - protein, 17 aa, Mycobacterium
LGSMYGYGISYAVASLS

SEQ ID NO: 316488 - protein, 22 aa, Mycobacterium
LGSNPWRGPPVPVGTPVQDGRN

SEQ ID NO: 316489 - protein, 23 aa, Mycobacterium
LGSPCSIGLLAVILASLTLAPAV

SEQ ID NO: 316490 - protein, 28 aa, Mycobacterium
LGSRYFRLLPRRLVERIVPKPGTGPSES

SEQ ID NO: 316491 - protein, 24 aa, Mycobacterium
LGSTDVCYLSMPMFHSNAVMAGWS

SEQ ID NO: 316492 - protein, 27 aa, Mycobacterium
LGSTLVLRRRFKPATVLADIEKHRATA

SEQ ID NO: 316493 - protein, 24 aa, Mycobacterium
LGSTLVLRRRFKPATVLEDIEKHK

SEQ ID NO: 316494 - protein, 23 aa, Mycobacterium
LGSYNPWPVALIVGIPLVTVGLA

SEQ ID NO: 316495 - protein, 21 aa, Mycobacterium
LGTAAALEFLGPLSVAVIHGR

SEQ ID NO: 316496 - protein, 23 aa, Mycobacterium
LGTACGLSVLLWQDILGLGVQWI

SEQ ID NO: 316497 - protein, 33 aa, Mycobacterium
LGTACGLSVLLWQDILGLGVQWIVIPLSMVILL

SEQ ID NO: 316498 - protein, 24 aa, Mycobacterium
LGTACGLSVLLWQDILGLGVQWVV

SEQ ID NO: 316499 - protein, 22 aa, Mycobacterium
LGTACGLSVLLWQDVLGLGVQW

SEQ ID NO: 316500 - protein, 29 aa, Mycobacterium
LGTAGADVFGRAGPYLARGATDLVGSSQL

SEQ ID NO: 316501 - protein, 24 aa, Mycobacterium
LGTFNRYWLAAAFGVTALVLSAIY

SEQ ID NO: 316502 - protein, 24 aa, Mycobacterium
LGTFNRYWLAAGFGVTALVLSAVY

SEQ ID NO: 316503 - protein, 23 aa, Mycobacterium
LGTGLCRLASLVIAVATGRRIAR

SEQ ID NO: 316504 - protein, 25 aa, Mycobacterium
LGTGRVPFAAAFGIAAVDVVLLVVV

SEQ ID NO: 316505 - protein, 25 aa, Mycobacterium
LGTIAAYLWSLWVLFANAGHTHGDV

SEQ ID NO: 316506 - protein, 25 aa, Mycobacterium
LGTIGRLDVEVSWPTAGITESARAL

SEQ ID NO: 316507 - protein, 20 aa, Mycobacterium
LGTILGGLGIHLDPATPFSV

SEQ ID NO: 316508 - protein, 18 aa, Mycobacterium
LGTKRLVMGSVLLFTLGS

SEQ ID NO: 316509 - protein, 18 aa, Mycobacterium
LGTLAIVCTMSVLRLISF

SEQ ID NO: 316510 - protein, 20 aa, Mycobacterium
LGTLMLGFYVTCAIFIFGVL

SEQ ID NO: 316511 - protein, 18 aa, Mycobacterium
LGTLRVWPSRARAFREID

SEQ ID NO: 316512 - protein, 32 aa, Mycobacterium
LGTQLRRLPVDFGIGVSAGRVFAGNVGAENRY

SEQ ID NO: 316513 - protein, 19 aa, Mycobacterium
LGTRVELRLGDPADSELDR

SEQ ID NO: 316514 - protein, 22 aa, Mycobacterium
LGTSRRSRWARILDEGVAAAVI

SEQ ID NO: 316515 - protein, 24 aa, Mycobacterium
LGTSRRSRWARMFDEGIGATVVQQ

SEQ ID NO: 316516 - protein, 19 aa, Mycobacterium
LGTTVEWYDFFLYATAAGL

SEQ ID NO: 316517 - protein, 19 aa, Mycobacterium
LGTVFVHWLIFQSLYRIGA

SEQ ID NO: 316518 - protein, 25 aa, Mycobacterium
LGTVTLELPAGGGWGEVAFTDADGN

SEQ ID NO: 316519 - protein, 24 aa, Mycobacterium
LGTYNRYWLAAAFGVTALVLSAIY

SEQ ID NO: 316520 - protein, 20 aa, Mycobacterium
LGVAAWGVNAVRVVTDHQAL

SEQ ID NO: 316521 - protein, 25 aa, Mycobacterium
LGVAGLLKRHWVIPILLISALFCSA

SEQ ID NO: 316522 - protein, 17 aa, Mycobacterium
LGVAIGLLLAAALSVWS

SEQ ID NO: 316523 - protein, 18 aa, Mycobacterium
LGVALLAAFGAQGWQQFT

SEQ ID NO: 316524 - protein, 19 aa, Mycobacterium
LGVAMRWVCGAIFVAISAS

SEQ ID NO: 316525 - protein, 17 aa, Mycobacterium
LGVAPSIVVMLFGVMYG

SEQ ID NO: 316526 - protein, 24 aa, Mycobacterium
LGVARLMRFIPRSVMVGFVNALAI

SEQ ID NO: 316527 - protein, 22 aa, Mycobacterium
LGVAVAYLMWRSAVVRSALEPY

SEQ ID NO: 316528 - protein, 25 aa, Mycobacterium
LGVAVLEDIVLWLALAIATSIAAKS

SEQ ID NO: 316529 - protein, 19 aa, Mycobacterium
LGVDSAYVLLGFPLATVSF

SEQ ID NO: 316530 - protein, 17 aa, Mycobacterium
LGVDVFFVLSGFLITSL

SEQ ID NO: 316531 - protein, 18 aa, Mycobacterium
LGVDVLWLLNGVVFYVLL

SEQ ID NO: 316532 - protein, 19 aa, Mycobacterium
LGVEASLRSLARVAPTQRH

SEQ ID NO: 316533 - protein, 19 aa, Mycobacterium
LGVFLLLYPRRSWGPTAWV

SEQ ID NO: 316534 - protein, 19 aa, Mycobacterium
LGVFLMISSTFNKPSAFST

SEQ ID NO: 316535 - protein, 17 aa, Mycobacterium
LGVFPLIVMFLITSITM

SEQ ID NO: 316536 - protein, 20 aa, Mycobacterium
LGVGIALLWSARGPRDGSGA

SEQ ID NO: 316537 - protein, 21 aa, Mycobacterium
LGVGIALLWTVRGGARVYWVL

SEQ ID NO: 316538 - protein, 21 aa, Mycobacterium
LGVGTAGLWLESLWIGAVYRY

SEQ ID NO: 316539 - protein, 19 aa, Mycobacterium
LGVGVGVGMLEHHLTKPVL

SEQ ID NO: 316540 - protein, 17 aa, Mycobacterium
LGVGVGYALANSVFGGT

SEQ ID NO: 316541 - protein, 25 aa, Mycobacterium
LGVHLRNPVLLIMFGLAFLLMGGFV

SEQ ID NO: 316542 - protein, 18 aa, Mycobacterium
LGVKWMSRVNSAGVVCEI

SEQ ID NO: 316543 - protein, 18 aa, Mycobacterium
LGVLFKIILPLSLPALST

SEQ ID NO: 316544 - protein, 25 aa, Mycobacterium
LGVLLWNRPQWRAEIIDSAISQFPL

SEQ ID NO: 316545 - protein, 23 aa, Mycobacterium
LGVLRDGQKWVALAMPAYALAGA

SEQ ID NO: 316546 - protein, 23 aa, Mycobacterium
LGVLRDGQKWVALAMPGYAVSAA

SEQ ID NO: 316547 - protein, 17 aa, Mycobacterium
LGVNVDRALPRSVPARA

SEQ ID NO: 316548 - protein, 18 aa, Mycobacterium
LGVPAFLVPYGWTVLVWG

SEQ ID NO: 316549 - protein, 22 aa, Mycobacterium
LGVPKWKTIVRIVIPTALSGIV

SEQ ID NO: 316550 - protein, 25 aa, Mycobacterium
LGVPKWKTIVSIVFPIAMPGIVSGI

SEQ ID NO: 316551 - protein, 23 aa, Mycobacterium
LGVQARIGLVDAIKLASPTVLLG

SEQ ID NO: 316552 - protein, 21 aa, Mycobacterium
LGVQRRAPSWAKWFQRISPIL

SEQ ID NO: 316553 - protein, 24 aa, Mycobacterium
LGVRLALIIPTAWILMTLVFVLMR

SEQ ID NO: 316554 - protein, 19 aa, Mycobacterium
LGVRLARTLIRLRDTAHEH

SEQ ID NO: 316555 - protein, 25 aa, Mycobacterium
LGVSILLTFYPGWASVGLMLVLLIT

SEQ ID NO: 316556 - protein, 30 aa, Mycobacterium
LGVTGIVEWPILLAVGGGALLLRRMNKKPG

SEQ ID NO: 316557 - protein, 18 aa, Mycobacterium
LGVVAVLVAATLVVVKNL

SEQ ID NO: 316558 - protein, 17 aa, Mycobacterium
LGVVLLIVDALRERQQR

SEQ ID NO: 316559 - protein, 21 aa, Mycobacterium
LGVVSLRGATLLGDSHLSAAS

SEQ ID NO: 316560 - protein, 32 aa, Mycobacterium
LGVVYRTLFMAFLWTIALTFEAGFFLVTVAIP

SEQ ID NO: 316561 - protein, 30 aa, Mycobacterium
LGVWAVNLFKVLLMTGSFACGMAFHNCAAR

SEQ ID NO: 316562 - protein, 17 aa, Mycobacterium
LGVWPMLGVLAALSAAA

SEQ ID NO: 316563 - protein, 18 aa, Mycobacterium
LGVWVVFVLAAASWAVGG

SEQ ID NO: 316564 - protein, 19 aa, Mycobacterium
LGWAARWALGSWPTVRESA

SEQ ID NO: 316565 - protein, 20 aa, Mycobacterium
LGWAGPRARGLLRVLAVTGF

SEQ ID NO: 316566 - protein, 20 aa, Mycobacterium
LGWKLLIPASLVWVLIAAVI

SEQ ID NO: 316567 - protein, 21 aa, Mycobacterium
LGWKLLIPASLVWVLIAAVVR

SEQ ID NO: 316568 - protein, 30 aa, Mycobacterium
LGWLGFDGGLGWPAKIGLALSVGVLGGVGI

SEQ ID NO: 316569 - protein, 27 aa, Mycobacterium
LGWLNYLFCWGMLYQLGIAWQTGLLTG

SEQ ID NO: 316570 - protein, 17 aa, Mycobacterium
LGWLRIAIFAAPAILVS

SEQ ID NO: 316571 - protein, 27 aa, Mycobacterium
LGWPVFPYTRMVRVSLWISVAVVAVLF

SEQ ID NO: 316572 - protein, 25 aa, Mycobacterium
LGWRNVRRRNLGWRMWYGGPWFSTR

SEQ ID NO: 316573 - protein, 26 aa, Mycobacterium
LGWVAERLSYGWGFVISGIVLLIAAV

SEQ ID NO: 316574 - protein, 25 aa, Mycobacterium
LGYADEISRAVVLIAVTVLLVGVAE

SEQ ID NO: 316575 - protein, 24 aa, Mycobacterium
LGYAPGTCRPFLPPKDALASVICD

SEQ ID NO: 316576 - protein, 19 aa, Mycobacterium
LGYCVLALIAFVFGEQKGR

SEQ ID NO: 316577 - protein, 18 aa, Mycobacterium
LGYFGGLNALVGKDKPGP

SEQ ID NO: 316578 - protein, 20 aa, Mycobacterium
LGYKSIRSNNTVLRWMQNAL

SEQ ID NO: 316579 - protein, 18 aa, Mycobacterium
LGYKSIRSNNTVLRWVQN

SEQ ID NO: 316580 - protein, 29 aa, Mycobacterium
LGYLLVNGLYRWFPPITVLTGLSLLAVAI

SEQ ID NO: 316581 - protein, 21 aa, Mycobacterium
LGYLRRQLLVLAAFTTGVLLI

SEQ ID NO: 316582 - protein, 24 aa, Mycobacterium
LGYLYFLVCLWVFRPPAPTVRAKA

SEQ ID NO: 316583 - protein, 24 aa, Mycobacterium
LGYRSRFLPLFIRLIERIQNRRLP

SEQ ID NO: 316584 - protein, 17 aa, Mycobacterium
LGYSVWTLWPVLVLFMP

SEQ ID NO: 316585 - protein, 21 aa, Mycobacterium
LHAAGASRCRVRIAQSRSGSV

SEQ ID NO: 316586 - protein, 18 aa, Mycobacterium
LHAEGLLRPGAVTPAADL

SEQ ID NO: 316587 - protein, 23 aa, Mycobacterium
LHAELWMAALIFPAFTAGAAIGN

SEQ ID NO: 316588 - protein, 18 aa, Mycobacterium
LHAFFGVVLMGTRRVLGA

SEQ ID NO: 316589 - protein, 18 aa, Mycobacterium
LHAFFGVVMMGMKTVLGE

SEQ ID NO: 316590 - protein, 26 aa, Mycobacterium
LHAILGWRPVLLIPLTFALFTPLGVP

SEQ ID NO: 316591 - protein, 17 aa, Mycobacterium
LHAIVWIGVALAVFQQL

SEQ ID NO: 316592 - protein, 24 aa, Mycobacterium
LHALDHGYTYGMLWIAGTAVLVGV

SEQ ID NO: 316593 - protein, 20 aa, Mycobacterium
LHDVTHGWTAPWVLFLAVFC

SEQ ID NO: 316594 - protein, 24 aa, Mycobacterium
LHELTHGMDLAAFVMFSSLAGIAG

SEQ ID NO: 316595 - protein, 22 aa, Mycobacterium
LHEVPILSGLGLTMTGARPGGF

SEQ ID NO: 316596 - protein, 31 aa, Mycobacterium
LHFEDFGPLNARRILHEYGQKYCVFNDDIQG

SEQ ID NO: 316597 - protein, 21 aa, Mycobacterium
LHGCNGCVGDRIMVDKLTYRF

SEQ ID NO: 316598 - protein, 21 aa, Mycobacterium
LHGCNGCVGDRIMVDKMSYRF

SEQ ID NO: 316599 - protein, 24 aa, Mycobacterium
LHGFWVMLFALPFAGLIELIPSAA

SEQ ID NO: 316600 - protein, 27 aa, Mycobacterium
LHGLYRAGGDVVAWSVWVVELLAGMTA

SEQ ID NO: 316601 - protein, 17 aa, Mycobacterium
LHGWPVATWPTKQDTDT

SEQ ID NO: 316602 - protein, 18 aa, Mycobacterium
LHHFRIYVDIAIVVVVLA

SEQ ID NO: 316603 - protein, 18 aa, Mycobacterium
LHHGFRPALVIGAVVVSV

SEQ ID NO: 316604 - protein, 18 aa, Mycobacterium
LHHLGIFSLYMMFFVLCG

SEQ ID NO: 316605 - protein, 26 aa, Mycobacterium
LHKRVPTMHWFNRFVLSISTPIIMRV

SEQ ID NO: 316606 - protein, 18 aa, Mycobacterium
LHLACIWIVAIAVNLSAF

SEQ ID NO: 316607 - protein, 17 aa, Mycobacterium
LHLADSALIDLIRVGDV

SEQ ID NO: 316608 - protein, 19 aa, Mycobacterium
LHLADSALIDLVRVGDVVD

SEQ ID NO: 316609 - protein, 24 aa, Mycobacterium
LHLARLSYFKALGIPSALGLLVVI

SEQ ID NO: 316610 - protein, 19 aa, Mycobacterium
LHLDLRFVNGKSWLVFGPY

SEQ ID NO: 316611 - protein, 21 aa, Mycobacterium
LHLDWGKAGVVVLALLFMALI

SEQ ID NO: 316612 - protein, 19 aa, Mycobacterium
LHLLLPAGERWFIRVVDEA

SEQ ID NO: 316613 - protein, 22 aa, Mycobacterium
LHLPTRRALAYARATRPDVLEA

SEQ ID NO: 316614 - protein, 19 aa, Mycobacterium
LHLVHIAWCTASVVGIAIW

SEQ ID NO: 316615 - protein, 25 aa, Mycobacterium
LHLVPWTVSVNWWLIVVAFVAFVTP

SEQ ID NO: 316616 - protein, 27 aa, Mycobacterium
LHNGYLASCGLNFPRLDSVHRTVEFAV

SEQ ID NO: 316617 - protein, 22 aa, Mycobacterium
LHPAWWTLILVVATLGTIVLTS

SEQ ID NO: 316618 - protein, 19 aa, Mycobacterium
LHPEHWGTFINLRCVCLAP

SEQ ID NO: 316619 - protein, 33 aa, Mycobacterium
LHPIFRSGVLTYEFWLKVGIVALGSRFVLGDIA

SEQ ID NO: 316620 - protein, 19 aa, Mycobacterium
LHPVIAWGGVLLGMLASLL

SEQ ID NO: 316621 - protein, 21 aa, Mycobacterium
LHPVLNLTSARLIAGKAADPT

SEQ ID NO: 316622 - protein, 18 aa, Mycobacterium
LHPVLNLTSARLISGSPD

SEQ ID NO: 316623 - protein, 19 aa, Mycobacterium
LHQLRSYRIVSVLRIGVLV

SEQ ID NO: 316624 - protein, 25 aa, Mycobacterium
LHQQRWAKDLSRAIVLAPMFITPIA

SEQ ID NO: 316625 - protein, 18 aa, Mycobacterium
LHQRLPEQLLHVLAGLLF

SEQ ID NO: 316626 - protein, 23 aa, Mycobacterium
LHQRPGAAGLVFAAFAAGDVSTA

SEQ ID NO: 316627 - protein, 17 aa, Mycobacterium
LHQRWHGVAAIVVSVLG

SEQ ID NO: 316628 - protein, 21 aa, Mycobacterium
LHRAKGGGLSTLFGGGVQSSL

SEQ ID NO: 316629 - protein, 22 aa, Mycobacterium
LHRCAGALADHVDWSLIDVIRG

SEQ ID NO: 316630 - protein, 19 aa, Mycobacterium
LHRDVAIKVLRADLARDPS

SEQ ID NO: 316631 - protein, 26 aa, Mycobacterium
LHRHPHWKRLIGPVFILIVATALASF

SEQ ID NO: 316632 - protein, 23 aa, Mycobacterium
LHRLDAIALYLGFIAVGWLLGYV

SEQ ID NO: 316633 - protein, 25 aa, Mycobacterium
LHRPVKRWYQGIFFTMFYTIILVLQ

SEQ ID NO: 316634 - protein, 25 aa, Mycobacterium
LHRRLGRFESFAAGFSFVSILTTIF

SEQ ID NO: 316635 - protein, 18 aa, Mycobacterium
LHSGCKLVSAAASSSAVS

SEQ ID NO: 316636 - protein, 25 aa, Mycobacterium
LHSHPAHLAGWGFGGVGAGIALSAV

SEQ ID NO: 316637 - protein, 22 aa, Mycobacterium
LHSPRAITFYCLDYGGGKLADL

SEQ ID NO: 316638 - protein, 23 aa, Mycobacterium
LHTLQVIAPYAFGAALVGLLESL

SEQ ID NO: 316639 - protein, 18 aa, Mycobacterium
LHTVSFLVALSIVVTLHV

SEQ ID NO: 316640 - protein, 25 aa, Mycobacterium
LHVDPELLGGLSITVGDEVIDGSIA

SEQ ID NO: 316641 - protein, 28 aa, Mycobacterium
LHVHRRLSFRYGYLHIFVFGAIVATGAG

SEQ ID NO: 316642 - protein, 31 aa, Mycobacterium
LHVSGRRFLLRRVECALLGGDIHTLSARSRT

SEQ ID NO: 316643 - protein, 20 aa, Mycobacterium
LHVVDARFAADLRSRLLRKL

SEQ ID NO: 316644 - protein, 20 aa, Mycobacterium
LHWPENWPLIMLSPTVEPFI

SEQ ID NO: 316645 - protein, 17 aa, Mycobacterium
LHYGYYPALIVGLTLGV

SEQ ID NO: 316646 - protein, 17 aa, Mycobacterium
LHYPVASTILWSLALTA

SEQ ID NO: 316647 - protein, 19 aa, Mycobacterium
LHYQRARMNDLLTQADEMA

SEQ ID NO: 316648 - protein, 21 aa, Mycobacterium
LHYRHELLYYKVLENHLPELM

SEQ ID NO: 316649 - protein, 20 aa, Mycobacterium
LHYRHELLYYKVLIDHLPEL

SEQ ID NO: 316650 - protein, 19 aa, Mycobacterium
LHYRHELLYYKVLTEHLVE

SEQ ID NO: 316651 - protein, 19 aa, Mycobacterium
LIAAGRWDFDPMAEPEQIL

SEQ ID NO: 316652 - protein, 18 aa, Mycobacterium
LIAAVGMTIAVAATLVMI

SEQ ID NO: 316653 - protein, 18 aa, Mycobacterium
LIAGAAIVETVFGWPGMA

SEQ ID NO: 316654 - protein, 18 aa, Mycobacterium
LIAGASCNDAALTHDDAR

SEQ ID NO: 316655 - protein, 19 aa, Mycobacterium
LIAGLLFFFFVLPRWPELN

SEQ ID NO: 316656 - protein, 20 aa, Mycobacterium
LIAHGLRKVFGWWGGTGLSG

SEQ ID NO: 316657 - protein, 23 aa, Mycobacterium
LIALFPPYVMWLPNAIWKSFDLF

SEQ ID NO: 316658 - protein, 19 aa, Mycobacterium
LIALIVYGIIELISDRQGT

SEQ ID NO: 316659 - protein, 24 aa, Mycobacterium
LIALLGGIGIMFAIYGRWSQKVGW

SEQ ID NO: 316660 - protein, 24 aa, Mycobacterium
LIALLGGIGIMFAVYGRWSQKVGW

SEQ ID NO: 316661 - protein, 28 aa, Mycobacterium
LIALLVVAGFGWVGWDFSLVVGAVLVGV

SEQ ID NO: 316662 - protein, 19 aa, Mycobacterium
LIALWRLDRLDGRRLRSLF

SEQ ID NO: 316663 - protein, 24 aa, Mycobacterium
LIAMFPWYIQWFPNAVWKTFDLFV

SEQ ID NO: 316664 - protein, 23 aa, Mycobacterium
LIAMFPWYIQWLPNAVWKTFDLF

SEQ ID NO: 316665 - protein, 17 aa, Mycobacterium
LIAMPILGFGLFGALSG

SEQ ID NO: 316666 - protein, 17 aa, Mycobacterium
LIAPTGWEVGLIRVEDV

SEQ ID NO: 316667 - protein, 18 aa, Mycobacterium
LIAPTGWQVGLIRIEDVV

SEQ ID NO: 316668 - protein, 24 aa, Mycobacterium
LIARQRWIYPVLVVLWAAAGTYIT

SEQ ID NO: 316669 - protein, 19 aa, Mycobacterium
LIASLAVGLIMFFLIGRPL

SEQ ID NO: 316670 - protein, 18 aa, Mycobacterium
LIATGGMGQVWEAVDSRL

SEQ ID NO: 316671 - protein, 26 aa, Mycobacterium
LIATLGLRFYLGWITHTGYTYGALST

SEQ ID NO: 316672 - protein, 25 aa, Mycobacterium
LIATLGLRFYLTWITSTGYTYGALS

SEQ ID NO: 316673 - protein, 23 aa, Mycobacterium
LIAVAVAVLVDFAAKRTREARRA

SEQ ID NO: 316674 - protein, 24 aa, Mycobacterium
LIAVCCYVALVLTNFAWLFPVLTG

SEQ ID NO: 316675 - protein, 28 aa, Mycobacterium
LIAVFGMRLVFPLAIVWVTAGLDPVHAM

SEQ ID NO: 316676 - protein, 26 aa, Mycobacterium
LIAVFRGRLHPIGGLGVALGVTVLLF

SEQ ID NO: 316677 - protein, 20 aa, Mycobacterium
LIAVIAALWVSRADAAVLEW

SEQ ID NO: 316678 - protein, 23 aa, Mycobacterium
LIAVSIGMRLVFGHLDLTTALTV

SEQ ID NO: 316679 - protein, 18 aa, Mycobacterium
LIAWAGFALLTWSLAGVA

SEQ ID NO: 316680 - protein, 17 aa, Mycobacterium
LIAWPDVAGVSFPVGNR

SEQ ID NO: 316681 - protein, 19 aa, Mycobacterium
LIAWSGFALLTWALPGVVI

SEQ ID NO: 316682 - protein, 27 aa, Mycobacterium
LICAGVIAGTVVVGWVISLVMINPFRL

SEQ ID NO: 316683 - protein, 28 aa, Mycobacterium
LICALSIGAAAVFAWLLAAFAVRPFKRL

SEQ ID NO: 316684 - protein, 20 aa, Mycobacterium
LIDAFGWQWIFLINLPIGAL

SEQ ID NO: 316685 - protein, 18 aa, Mycobacterium
LIDDLRLVAPQASVDDVW

SEQ ID NO: 316686 - protein, 26 aa, Mycobacterium
LIDEVGWPMLCVMTIAAGALQIAFGV

SEQ ID NO: 316687 - protein, 33 aa, Mycobacterium
LIDGEVHWALTIPRLGSIIARNSLDAPVPGLDG

SEQ ID NO: 316688 - protein, 24 aa, Mycobacterium
LIDGMTCASCAARIERKLNKLAGV

SEQ ID NO: 316689 - protein, 27 aa, Mycobacterium
LIDGVHEFPGPWALVPVGATLLFILSA

SEQ ID NO: 316690 - protein, 27 aa, Mycobacterium
LIDIAGAWRWTALFAALVTVVSIPVLR

SEQ ID NO: 316691 - protein, 18 aa, Mycobacterium
LIDIFAIFIFYVVGVLLW

SEQ ID NO: 316692 - protein, 19 aa, Mycobacterium
LIDLDGRVLGVVFGAAVDD

SEQ ID NO: 316693 - protein, 20 aa, Mycobacterium
LIDLRLFRNRVVTVANATIV

SEQ ID NO: 316694 - protein, 18 aa, Mycobacterium
LIDLRLFTDRVVRLANLA

SEQ ID NO: 316695 - protein, 19 aa, Mycobacterium
LIDLRLFTNRVVALANSAM

SEQ ID NO: 316696 - protein, 19 aa, Mycobacterium
LIDLRLLKNRAVAAANATR

SEQ ID NO: 316697 - protein, 18 aa, Mycobacterium
LIDLRLLTNRALTLANVA

SEQ ID NO: 316698 - protein, 25 aa, Mycobacterium
LIDRTRTRYGLALTAYSLVNLAITV

SEQ ID NO: 316699 - protein, 19 aa, Mycobacterium
LIDSFGWQWIFLINLPIGV

SEQ ID NO: 316700 - protein, 25 aa, Mycobacterium
LIDTSSWRWIFLINLPIGLVTIVLA

SEQ ID NO: 316701 - protein, 25 aa, Mycobacterium
LIDVLHWPGYLLVVAGVIGGVGSLA

SEQ ID NO: 316702 - protein, 25 aa, Mycobacterium
LIDVLHWPGYLLVVAGVIGTCGSLA

SEQ ID NO: 316703 - protein, 25 aa, Mycobacterium
LIDVLHWPGYLLVVAGVVGACGSLA

SEQ ID NO: 316704 - protein, 18 aa, Mycobacterium
LIEAGPGWFNRVIEAATP

SEQ ID NO: 316705 - protein, 21 aa, Mycobacterium
LIEAMWWLRARALGLRPRVWR

SEQ ID NO: 316706 - protein, 21 aa, Mycobacterium
LIEEFQVLYAARRLRPNETPR

SEQ ID NO: 316707 - protein, 17 aa, Mycobacterium
LIEFCLLAAQYDGLAAT

SEQ ID NO: 316708 - protein, 17 aa, Mycobacterium
LIEGIGVKVLHWVNSVR

SEQ ID NO: 316709 - protein, 18 aa, Mycobacterium
LIEHFSVGSIFWVNVPIA

SEQ ID NO: 316710 - protein, 18 aa, Mycobacterium
LIELALRSGGPDNVTVVV

SEQ ID NO: 316711 - protein, 18 aa, Mycobacterium
LIELDRRLGWDAVSGPAQ

SEQ ID NO: 316712 - protein, 27 aa, Mycobacterium
LIEQPVREWRPAFVPMLPLAGATAATA

SEQ ID NO: 316713 - protein, 18 aa, Mycobacterium
LIEQVGWQMLCLMTLGAG

SEQ ID NO: 316714 - protein, 19 aa, Mycobacterium
LIEQVRPTLPVLLANLTSL

SEQ ID NO: 316715 - protein, 17 aa, Mycobacterium
LIERPERLVIVLVGAGL

SEQ ID NO: 316716 - protein, 24 aa, Mycobacterium
LIESEFPGELAGLFKNLENKGNPW

SEQ ID NO: 316717 - protein, 22 aa, Mycobacterium
LIEVPVLVGLVYVSLALRPRLS

SEQ ID NO: 316718 - protein, 19 aa, Mycobacterium
LIFGLVIAWVLVRDDFVGK

SEQ ID NO: 316719 - protein, 19 aa, Mycobacterium
LIFGWLAFLLVFGIFVRRF

SEQ ID NO: 316720 - protein, 19 aa, Mycobacterium
LIFGWLAFLLVFGIFVRRV

SEQ ID NO: 316721 - protein, 18 aa, Mycobacterium
LIFGWLAFLLVFGLFVRK

SEQ ID NO: 316722 - protein, 25 aa, Mycobacterium
LIFGWLTFLIVFGFFTRTVWEIVVG

SEQ ID NO: 316723 - protein, 25 aa, Mycobacterium
LIFGWLTFLLVFGWFTRNAWQIVVG

SEQ ID NO: 316724 - protein, 24 aa, Mycobacterium
LIFVCAGIIALVYIKVFGVAAPGG

SEQ ID NO: 316725 - protein, 23 aa, Mycobacterium
LIGALCMLGTVWLVVRARSSTRA

SEQ ID NO: 316726 - protein, 17 aa, Mycobacterium
LIGCGQALTAPAWQAIQ

SEQ ID NO: 316727 - protein, 26 aa, Mycobacterium
LIGCSRAWMLAFSWIAMAGIGVLQYG

SEQ ID NO: 316728 - protein, 19 aa, Mycobacterium
LIGFSELHALMAATAVSAT

SEQ ID NO: 316729 - protein, 27 aa, Mycobacterium
LIGHRNRLAAMFAWGISFLGRTRGQMA

SEQ ID NO: 316730 - protein, 24 aa, Mycobacterium
LIGIAWCWLFPIAWAVSGSLKGEG

SEQ ID NO: 316731 - protein, 25 aa, Mycobacterium
LIGIELHWLTLPIAFIVLVGVGCDY

SEQ ID NO: 316732 - protein, 18 aa, Mycobacterium
LIGIFAFFFQNFLSSQLG

SEQ ID NO: 316733 - protein, 26 aa, Mycobacterium
LIGIFSFFGNDLFKSFFDVDVPWIVF

SEQ ID NO: 316734 - protein, 33 aa, Mycobacterium
LIGILVISVIWRLRLALAMSIASAIVFDCIRNW

SEQ ID NO: 316735 - protein, 24 aa, Mycobacterium
LIGLRRLSVTYLRQHPAASLATAG

SEQ ID NO: 316736 - protein, 27 aa, Mycobacterium
LIGLSMLGDLPWWVTAVVLAREIGITL

SEQ ID NO: 316737 - protein, 28 aa, Mycobacterium
LIGLSMLGDLPWWVTVLILAREIGVTVL

SEQ ID NO: 316738 - protein, 29 aa, Mycobacterium
LIGLSMLGELPWWVTIVILVREFGVTVLR

SEQ ID NO: 316739 - protein, 29 aa, Mycobacterium
LIGLSMLGELPWWVTVVILVREFGVTVLR

SEQ ID NO: 316740 - protein, 18 aa, Mycobacterium
LIGLVGFVGFGRIYLGQT

SEQ ID NO: 316741 - protein, 17 aa, Mycobacterium
LIGMAIAVPLGLAVQHA

SEQ ID NO: 316742 - protein, 17 aa, Mycobacterium
LIGSLILAIPVVVISMA

SEQ ID NO: 316743 - protein, 17 aa, Mycobacterium
LIGTAIAIPLGLFVQHA

SEQ ID NO: 316744 - protein, 17 aa, Mycobacterium
LIGYIIAAAPLVMASGL

SEQ ID NO: 316745 - protein, 27 aa, Mycobacterium
LIHDCPKLLQLRTFPTIAIGGARPGAD

SEQ ID NO: 316746 - protein, 25 aa, Mycobacterium
LIHDCPKLLQLRTFPTIAVGGDTDG

SEQ ID NO: 316747 - protein, 29 aa, Mycobacterium
LIHDCPKLVQLRSFPTIAIGGDRPGADRL

SEQ ID NO: 316748 - protein, 19 aa, Mycobacterium
LIHVIDMAMAREVAFRYPD

SEQ ID NO: 316749 - protein, 24 aa, Mycobacterium
LIHWPESWPLVSLSPTVEPFVVFG

SEQ ID NO: 316750 - protein, 24 aa, Mycobacterium
LIIAGLVVRYIWWVVGAAALAGVV

SEQ ID NO: 316751 - protein, 19 aa, Mycobacterium
LIIGWYLQRDRVMRLAQER

SEQ ID NO: 316752 - protein, 22 aa, Mycobacterium
LIIKVRLHAFFSLIVVSVLTGL

SEQ ID NO: 316753 - protein, 18 aa, Mycobacterium
LIILGRLITWFARRHSES

SEQ ID NO: 316754 - protein, 18 aa, Mycobacterium
LIILSFLLGLVLTCALMV

SEQ ID NO: 316755 - protein, 18 aa, Mycobacterium
LIIPLGIVPSWLALASTG

SEQ ID NO: 316756 - protein, 18 aa, Mycobacterium
LIIRDEAVHGFYIGYKCQ

SEQ ID NO: 316757 - protein, 24 aa, Mycobacterium
LIITYRSPVLWLVPLLVIGFADRV

SEQ ID NO: 316758 - protein, 21 aa, Mycobacterium
LIKARSAILHAIRETLVGKGF

SEQ ID NO: 316759 - protein, 20 aa, Mycobacterium
LIKCGVVLVAVFTAFVANSA

SEQ ID NO: 316760 - protein, 30 aa, Mycobacterium
LIKDLELLPTFPFHYKYLRNAVRGDYLNVF

SEQ ID NO: 316761 - protein, 25 aa, Mycobacterium
LIKPAVLVALLFRTLDAFRIFDNIY

SEQ ID NO: 316762 - protein, 17 aa, Mycobacterium
LIKVGGWSGLKDKVIDT

SEQ ID NO: 316763 - protein, 17 aa, Mycobacterium
LILAAFFSGGWRVVMLG

SEQ ID NO: 316764 - protein, 19 aa, Mycobacterium
LILAIALAIAVIFASALAG

SEQ ID NO: 316765 - protein, 17 aa, Mycobacterium
LILALLAFRHFGQGYAI

SEQ ID NO: 316766 - protein, 19 aa, Mycobacterium
LILFLPFLLIMGGFMYFAS

SEQ ID NO: 316767 - protein, 17 aa, Mycobacterium
LILFPPLIVIAYEMFAH

SEQ ID NO: 316768 - protein, 18 aa, Mycobacterium
LILGIALLAVTVFVWASA

SEQ ID NO: 316769 - protein, 17 aa, Mycobacterium
LILIAAGVWGLRRTRDG

SEQ ID NO: 316770 - protein, 18 aa, Mycobacterium
LILIAAIGTILAVRAGDL

SEQ ID NO: 316771 - protein, 23 aa, Mycobacterium
LILIVVAGGFAFSDLVMMKYLAF

SEQ ID NO: 316772 - protein, 23 aa, Mycobacterium
LILIWRLIRRDSVQPAISGFFAV

SEQ ID NO: 316773 - protein, 17 aa, Mycobacterium
LILLPLVLPPVVGGIAL

SEQ ID NO: 316774 - protein, 18 aa, Mycobacterium
LILLPLVLVYGVAQRSFI

SEQ ID NO: 316775 - protein, 18 aa, Mycobacterium
LILLPLVVVYAVAQRAFI

SEQ ID NO: 316776 - protein, 26 aa, Mycobacterium
LILLWGSAGAFGFVERDLGFKIIFGL

SEQ ID NO: 316777 - protein, 24 aa, Mycobacterium
LILLWGSAGALGFVEKDLGLKIIF

SEQ ID NO: 316778 - protein, 18 aa, Mycobacterium
LILPGFWLLVPGSMGLIG

SEQ ID NO: 316779 - protein, 17 aa, Mycobacterium
LILRIVALFYVIALLIV

SEQ ID NO: 316780 - protein, 17 aa, Mycobacterium
LILRLVLGLTLAAHGLN

SEQ ID NO: 316781 - protein, 17 aa, Mycobacterium
LILRLVLGLTMAAHGFN

SEQ ID NO: 316782 - protein, 23 aa, Mycobacterium
LILSSPFLLPAALGLALSAIAFT

SEQ ID NO: 316783 - protein, 17 aa, Mycobacterium
LILVCLVLGLAQYAVYF

SEQ ID NO: 316784 - protein, 26 aa, Mycobacterium
LILVGLRLLQGFAVGGEWAGSALLSA

SEQ ID NO: 316785 - protein, 17 aa, Mycobacterium
LILVMGVSRSARTAVWA

SEQ ID NO: 316786 - protein, 28 aa, Mycobacterium
LILVSPWPVRLFWLLLLALALLIAVDIA

SEQ ID NO: 316787 - protein, 25 aa, Mycobacterium
LIMLLRAVVAPLYLVASVVVSYLSA

SEQ ID NO: 316788 - protein, 18 aa, Mycobacterium
LIMPLIGLWAMVATLRFG

SEQ ID NO: 316789 - protein, 26 aa, Mycobacterium
LIMREARAGDRYLLCSDGLSDPVSQD

SEQ ID NO: 316790 - protein, 23 aa, Mycobacterium
LIMRYRRRRRRAADLAAARRVDP

SEQ ID NO: 316791 - protein, 28 aa, Mycobacterium
LINCGYPLIQRFPLMFFTSAAVLLIGLA

SEQ ID NO: 316792 - protein, 20 aa, Mycobacterium
LINLGPRIGRFLPDGTPVTI

SEQ ID NO: 316793 - protein, 18 aa, Mycobacterium
LINRRWTFQAAPSTARFV

SEQ ID NO: 316794 - protein, 18 aa, Mycobacterium
LIPALPVAMVLAVVTAAT

SEQ ID NO: 316795 - protein, 27 aa, Mycobacterium
LIPANVMWVVWQLWLVVLLAALWKGRR

SEQ ID NO: 316796 - protein, 34 aa, Mycobacterium
LIPANVSWIVWQLWLAVILVALWKGRRMGPLVAE

SEQ ID NO: 316797 - protein, 18 aa, Mycobacterium
LIPGSATLLAWVMLVSAL

SEQ ID NO: 316798 - protein, 25 aa, Mycobacterium
LIPLALGLWAAWKAWRGNDDDDDDD

SEQ ID NO: 316799 - protein, 26 aa, Mycobacterium
LIPLDRTRTPVGFDRVLATVDKLASA

SEQ ID NO: 316800 - protein, 17 aa, Mycobacterium
LIPLFILWFGIGELPKV

SEQ ID NO: 316801 - protein, 17 aa, Mycobacterium
LIPLFIVWFGIGELPKV

SEQ ID NO: 316802 - protein, 18 aa, Mycobacterium
LIPLRIFGNREFAWSSLG

SEQ ID NO: 316803 - protein, 18 aa, Mycobacterium
LIPLTGLTTPWMSYGGSS

SEQ ID NO: 316804 - protein, 17 aa, Mycobacterium
LIPLVIFRDRDFGLCNA

SEQ ID NO: 316805 - protein, 17 aa, Mycobacterium
LIPLVPAAVVALALIVA

SEQ ID NO: 316806 - protein, 23 aa, Mycobacterium
LIPNAPPLTVWFGSVRYVFAPGR

SEQ ID NO: 316807 - protein, 23 aa, Mycobacterium
LIPRIGIASVIAEGFLVLPFGNR

SEQ ID NO: 316808 - protein, 30 aa, Mycobacterium
LIPRQRPNLRFRIVSAWRALRPTLASTASD

SEQ ID NO: 316809 - protein, 18 aa, Mycobacterium
LIPTRWRTVTAVDGVVVG

SEQ ID NO: 316810 - protein, 22 aa, Mycobacterium
LIPVLWILSLSLKPTSSVKDGK

SEQ ID NO: 316811 - protein, 24 aa, Mycobacterium
LIPWSDVVGLSFPVGARWARIDLP

SEQ ID NO: 316812 - protein, 18 aa, Mycobacterium
LIPWSEVVGVSFPPGAQW

SEQ ID NO: 316813 - protein, 22 aa, Mycobacterium
LIQRSGGDLVVIVRNVPVVSAP

SEQ ID NO: 316814 - protein, 25 aa, Mycobacterium
LIQTEFNVALPWSKEVSLSKSATHP

SEQ ID NO: 316815 - protein, 28 aa, Mycobacterium
LIQVWLLELFFVMPLTFFIGKVIDIHGA

SEQ ID NO: 316816 - protein, 23 aa, Mycobacterium
LIRAGFIGVILIILVIAVGLQPE

SEQ ID NO: 316817 - protein, 23 aa, Mycobacterium
LIRKRRIGAVWLTAAGYAVACQV

SEQ ID NO: 316818 - protein, 19 aa, Mycobacterium
LIRLIRRLLPAMVVVLAAC

SEQ ID NO: 316819 - protein, 18 aa, Mycobacterium
LIRSQYPAGMPVAEVVAV

SEQ ID NO: 316820 - protein, 26 aa, Mycobacterium
LIRTLSIPIILFWLGIAIVLNIVTPS

SEQ ID NO: 316821 - protein, 19 aa, Mycobacterium
LIRVAMMYNDQIGYGPTVR

SEQ ID NO: 316822 - protein, 18 aa, Mycobacterium
LISCCGFLAIGQAAPTAI

SEQ ID NO: 316823 - protein, 19 aa, Mycobacterium
LISCGGALVSAWFVAKFAP

SEQ ID NO: 316824 - protein, 24 aa, Mycobacterium
LISFSIWYFWADRFSLLALSVLIG

SEQ ID NO: 316825 - protein, 25 aa, Mycobacterium
LISGPLQLFISCVEEVLQRNQIPQG

SEQ ID NO: 316826 - protein, 26 aa, Mycobacterium
LISGRWPRRRALVLFLSVFIAAHIVG

SEQ ID NO: 316827 - protein, 18 aa, Mycobacterium
LISHLVFHHEIRWIEIVH

SEQ ID NO: 316828 - protein, 17 aa, Mycobacterium
LISIWRRIMSSPLLTLN

SEQ ID NO: 316829 - protein, 22 aa, Mycobacterium
LISLCVVLGMAIALSLLVVAVI

SEQ ID NO: 316830 - protein, 19 aa, Mycobacterium
LISLFYLGFVRWKIRLRGG

SEQ ID NO: 316831 - protein, 23 aa, Mycobacterium
LISLLLCLAVALGADALGSSAKS

SEQ ID NO: 316832 - protein, 22 aa, Mycobacterium
LISRIREYWMASGRTRADNDEA

SEQ ID NO: 316833 - protein, 34 aa, Mycobacterium
LITALCLFTAVFIMLRRKRVPGVARGPAWRLMGV

SEQ ID NO: 316834 - protein, 17 aa, Mycobacterium
LITASWLRHPHLRDYSA

SEQ ID NO: 316835 - protein, 18 aa, Mycobacterium
LITATLLALKPWYPKASV

SEQ ID NO: 316836 - protein, 18 aa, Mycobacterium
LITFPTLVTLGFPPVTAT

SEQ ID NO: 316837 - protein, 18 aa, Mycobacterium
LITIVGCWIMRKIKTRWP

SEQ ID NO: 316838 - protein, 17 aa, Mycobacterium
LITLIIVGLLRYRRRGH

SEQ ID NO: 316839 - protein, 18 aa, Mycobacterium
LITLTGFLLSAVAAIAVF

SEQ ID NO: 316840 - protein, 17 aa, Mycobacterium
LITMLLIGVVLLGLGYS

SEQ ID NO: 316841 - protein, 31 aa, Mycobacterium
LITPEVFSWHLPALIVINGFAAYALFTGHLR

SEQ ID NO: 316842 - protein, 29 aa, Mycobacterium
LITPVMFYVGWPIHRTGWLALAHRSADMN

SEQ ID NO: 316843 - protein, 29 aa, Mycobacterium
LITPVMMYVGWPIHRTGWLALAHRSADMN

SEQ ID NO: 316844 - protein, 25 aa, Mycobacterium
LITRLRLHPFLALLLGSGTLAAAAS

SEQ ID NO: 316845 - protein, 17 aa, Mycobacterium
LITRMPQGWSFAQAAAV

SEQ ID NO: 316846 - protein, 17 aa, Mycobacterium
LITRSGPIFEHAPYAQV

SEQ ID NO: 316847 - protein, 18 aa, Mycobacterium
LITRYEWVALERSISEVV

SEQ ID NO: 316848 - protein, 26 aa, Mycobacterium
LITSLEYIARLALLERAERDGQIEDV

SEQ ID NO: 316849 - protein, 18 aa, Mycobacterium
LITVLAWPQVRRADKLSD

SEQ ID NO: 316850 - protein, 18 aa, Mycobacterium
LIVACLDVSLVISSMVAL

SEQ ID NO: 316851 - protein, 30 aa, Mycobacterium
LIVAIQWRARSWLKRVLPVALIAAVAVTAL

SEQ ID NO: 316852 - protein, 24 aa, Mycobacterium
LIVCAGRLATPWVCAVDTAGRRSV

SEQ ID NO: 316853 - protein, 27 aa, Mycobacterium
LIVCTDAEAILGIGDWGVGGIQIAVGK

SEQ ID NO: 316854 - protein, 17 aa, Mycobacterium
LIVEAMVLLSFSALDVL

SEQ ID NO: 316855 - protein, 17 aa, Mycobacterium
LIVFLILVILLRAIVAP

SEQ ID NO: 316856 - protein, 19 aa, Mycobacterium
LIVGAAWPMIVEQISVKPN

SEQ ID NO: 316857 - protein, 21 aa, Mycobacterium
LIVGFCWALFFNGFLGAKLGV

SEQ ID NO: 316858 - protein, 17 aa, Mycobacterium
LIVKAVNLSKDWARAVV

SEQ ID NO: 316859 - protein, 24 aa, Mycobacterium
LIVKRVYWPVAVWLLLVIAIVHSS

SEQ ID NO: 316860 - protein, 20 aa, Mycobacterium
LIVLFCLAAPLWSEHVAHTL

SEQ ID NO: 316861 - protein, 18 aa, Mycobacterium
LIVMLNFVGILSYDKLRN

SEQ ID NO: 316862 - protein, 24 aa, Mycobacterium
LIVSDRGYFVFLALLPFIMGSLSM

SEQ ID NO: 316863 - protein, 19 aa, Mycobacterium
LIVSRQWKLLGAYAAAAFM

SEQ ID NO: 316864 - protein, 18 aa, Mycobacterium
LIVSRQWKLLGAYAAAAI

SEQ ID NO: 316865 - protein, 30 aa, Mycobacterium
LIVSWIIVMLLTFYWARVVWQRTIVQLAAE

SEQ ID NO: 316866 - protein, 30 aa, Mycobacterium
LIVVAVGAAVLWRARKALGLLGIAVAAVII

SEQ ID NO: 316867 - protein, 22 aa, Mycobacterium
LIVWRRDLRSIVWLLAAQGLAL

SEQ ID NO: 316868 - protein, 20 aa, Mycobacterium
LIWCARHLLQWVHARRSGDL

SEQ ID NO: 316869 - protein, 27 aa, Mycobacterium
LIWNISEVRWLPAILLFSYIDLVGYIP

SEQ ID NO: 316870 - protein, 25 aa, Mycobacterium
LIWQAAHGWPYLRMAAIVAAESERG

SEQ ID NO: 316871 - protein, 27 aa, Mycobacterium
LIWQDLFGFKIHWIVAALSVIILLAVG

SEQ ID NO: 316872 - protein, 17 aa, Mycobacterium
LIWQHLIGIELHWMVLA

SEQ ID NO: 316873 - protein, 25 aa, Mycobacterium
LIWQHLIGLPLHWLVLPLTFIILVA

SEQ ID NO: 316874 - protein, 25 aa, Mycobacterium
LIWQHLLGLELHWLVLAFTLIVLLA

SEQ ID NO: 316875 - protein, 17 aa, Mycobacterium
LIYGTAAALVFPTVFFP

SEQ ID NO: 316876 - protein, 40 aa, Mycobacterium
LIYLDRRFTIGHGRLFASYVALYCVGRFCVELLRDDTATH

SEQ ID NO: 316877 - protein, 25 aa, Mycobacterium
LIYMLPLLLLVALFVLFSRMQSGGR

SEQ ID NO: 316878 - protein, 27 aa, Mycobacterium
LIYMLPLLLLVALFVMFSRMQTGGRMG

SEQ ID NO: 316879 - protein, 17 aa, Mycobacterium
LIYRMFTLEADDVVDDD

SEQ ID NO: 316880 - protein, 25 aa, Mycobacterium
LKAAEARAGALAWQHHEPELAQYAE

SEQ ID NO: 316881 - protein, 17 aa, Mycobacterium
LKAGGATVALLTTSALQ

SEQ ID NO: 316882 - protein, 17 aa, Mycobacterium
LKAGGATVALLTTSQLK

SEQ ID NO: 316883 - protein, 19 aa, Mycobacterium
LKAGQTVRVAGIRVGTVNS

SEQ ID NO: 316884 - protein, 27 aa, Mycobacterium
LKAIRAKTVPIMLGIALVASAALATFV

SEQ ID NO: 316885 - protein, 21 aa, Mycobacterium
LKAIVFGAIVAIVSSQKGLST

SEQ ID NO: 316886 - protein, 17 aa, Mycobacterium
LKALHDMIFELLDDARA

SEQ ID NO: 316887 - protein, 18 aa, Mycobacterium
LKALLAERIAALKPRDGG

SEQ ID NO: 316888 - protein, 19 aa, Mycobacterium
LKATTVFFSPGNEQAAATV

SEQ ID NO: 316889 - protein, 17 aa, Mycobacterium
LKATVEAISAGGGTPLA

SEQ ID NO: 316890 - protein, 21 aa, Mycobacterium
LKAVIYGAIVAVIACQKGLFT

SEQ ID NO: 316891 - protein, 22 aa, Mycobacterium
LKAVLPVAAVFLIWDEIAIAAR

SEQ ID NO: 316892 - protein, 18 aa, Mycobacterium
LKAYKPGDTIAVDYRRKN

SEQ ID NO: 316893 - protein, 17 aa, Mycobacterium
LKDIINRGGENVSSVEV

SEQ ID NO: 316894 - protein, 30 aa, Mycobacterium
LKDLAINCGYPLIERFPLMLFTSAAVLLIG

SEQ ID NO: 316895 - protein, 32 aa, Mycobacterium
LKDLLINCGYPLIERFPLMLGTAGIVLLIGLT

SEQ ID NO: 316896 - protein, 19 aa, Mycobacterium
LKDMREFTGLLAQHDDLLS

SEQ ID NO: 316897 - protein, 23 aa, Mycobacterium
LKDPPAGWWPAHVDPRQWAFDKT

SEQ ID NO: 316898 - protein, 17 aa, Mycobacterium
LKDQIGTRVELRLGDPL

SEQ ID NO: 316899 - protein, 20 aa, Mycobacterium
LKEEIHAGIGTGIIRAMGGS

SEQ ID NO: 316900 - protein, 22 aa, Mycobacterium
LKEKRLPVIVHTGRELTAVETE

SEQ ID NO: 316901 - protein, 17 aa, Mycobacterium
LKGGALGLLSSVVVGLA

SEQ ID NO: 316902 - protein, 20 aa, Mycobacterium
LKGLARMFGEGAYMNAYACD

SEQ ID NO: 316903 - protein, 20 aa, Mycobacterium
LKGNWYLLGPAFVAAIAYVD

SEQ ID NO: 316904 - protein, 17 aa, Mycobacterium
LKGPMWLYPPAEHGAVW

SEQ ID NO: 316905 - protein, 22 aa, Mycobacterium
LKGPSCFTAPELVVRPDLPETL

SEQ ID NO: 316906 - protein, 22 aa, Mycobacterium
LKGPSCFTAPLIPVRPDLPEVL

SEQ ID NO: 316907 - protein, 23 aa, Mycobacterium
LKGPSCFTAPLVVTRPALPDQML

SEQ ID NO: 316908 - protein, 19 aa, Mycobacterium
LKGSGQCYFLQGSPANGTL

SEQ ID NO: 316909 - protein, 18 aa, Mycobacterium
LKGTAGWFDSMGMKPGMF

SEQ ID NO: 316910 - protein, 19 aa, Mycobacterium
LKGTEGYRLSTIALGASAL

SEQ ID NO: 316911 - protein, 21 aa, Mycobacterium
LKGTPLVGGKVYIAGAASTAK

SEQ ID NO: 316912 - protein, 21 aa, Mycobacterium
LKGTPMAGAGIYLGGTASTYK

SEQ ID NO: 316913 - protein, 18 aa, Mycobacterium
LKGVVADLQITAHAAETP

SEQ ID NO: 316914 - protein, 26 aa, Mycobacterium
LKHLRKRLRDEFGFPKADVHAAAYWT

SEQ ID NO: 316915 - protein, 25 aa, Mycobacterium
LKHPWKRARTTFSYLAVAILGNDED

SEQ ID NO: 316916 - protein, 26 aa, Mycobacterium
LKHVRKRLRDAFGFPKSVVHAQAYWT

SEQ ID NO: 316917 - protein, 25 aa, Mycobacterium
LKHVRTRLRDEFGFPKSVIHAQAYW

SEQ ID NO: 316918 - protein, 19 aa, Mycobacterium
LKIGIAVALGCIAAESLLV

SEQ ID NO: 316919 - protein, 18 aa, Mycobacterium
LKIGRRIYAVGGNREAAR

SEQ ID NO: 316920 - protein, 19 aa, Mycobacterium
LKIIAPYALTMAVVGLLES

SEQ ID NO: 316921 - protein, 17 aa, Mycobacterium
LKILDTRFARLILGVAV

SEQ ID NO: 316922 - protein, 21 aa, Mycobacterium
LKIMTWAALVFAPLVVVYQGW

SEQ ID NO: 316923 - protein, 19 aa, Mycobacterium
LKINPLALFTWVFPSVGIF

SEQ ID NO: 316924 - protein, 18 aa, Mycobacterium
LKIPAARRRRFLFVVMPL

SEQ ID NO: 316925 - protein, 20 aa, Mycobacterium
LKITAVTVVIIFAMLLMVYR

SEQ ID NO: 316926 - protein, 20 aa, Mycobacterium
LKITAVTVVIIFTLLLILYR

SEQ ID NO: 316927 - protein, 19 aa, Mycobacterium
LKITYGWSLLLIVTFTVLY

SEQ ID NO: 316928 - protein, 20 aa, Mycobacterium
LKITYGWSLLLIVVFTVLYF

SEQ ID NO: 316929 - protein, 20 aa, Mycobacterium
LKIVGKLAQFGSGMLQQVSE

SEQ ID NO: 316930 - protein, 17 aa, Mycobacterium
LKKLRANGIRRVVMLTG

SEQ ID NO: 316931 - protein, 42 aa, Mycobacterium
LKLAFTAIGTAATWLWNNAITPAWNGIKAVIGVAWEVVSDIF

SEQ ID NO: 316932 - protein, 17 aa, Mycobacterium
LKLDLIRGVSLPMIVIF

SEQ ID NO: 316933 - protein, 26 aa, Mycobacterium
LKLDLIRGVSVWMIVIFIVGTCAIKV

SEQ ID NO: 316934 - protein, 18 aa, Mycobacterium
LKLILAFGTVSQLGFLVV

SEQ ID NO: 316935 - protein, 25 aa, Mycobacterium
LKLPARRIQPASQWRTLPDAPTARL

SEQ ID NO: 316936 - protein, 24 aa, Mycobacterium
LKLPHGYASLLLGCTGLTLTIGAM

SEQ ID NO: 316937 - protein, 20 aa, Mycobacterium
LKLPHPPWWEVVISTVYMSF

SEQ ID NO: 316938 - protein, 22 aa, Mycobacterium
LKLPRPTEVSGMRIVPGDTEPP

SEQ ID NO: 316939 - protein, 27 aa, Mycobacterium
LKLQFGDGWWTSPLFLCIWITGTSILM

SEQ ID NO: 316940 - protein, 19 aa, Mycobacterium
LKLQIVSFNALGFTMPKES

SEQ ID NO: 316941 - protein, 22 aa, Mycobacterium
LKLRESPGLMILGRQGCGKTTA

SEQ ID NO: 316942 - protein, 26 aa, Mycobacterium
LKLTGGRTAQAWARRHRHLRAALTPL

SEQ ID NO: 316943 - protein, 26 aa, Mycobacterium
LKLTGKRVAQAWARRHRTLRAALQQL

SEQ ID NO: 316944 - protein, 17 aa, Mycobacterium
LKLVYDLQLEREISARR

SEQ ID NO: 316945 - protein, 18 aa, Mycobacterium
LKMCWPTAPRWVGVPLYL

SEQ ID NO: 316946 - protein, 20 aa, Mycobacterium
LKMLVFLVGLVLVVGIIGAT

SEQ ID NO: 316947 - protein, 17 aa, Mycobacterium
LKMPAIFVFGFIPMFLT

SEQ ID NO: 316948 - protein, 17 aa, Mycobacterium
LKNGNPWSAVQVAGQGA

SEQ ID NO: 316949 - protein, 19 aa, Mycobacterium
LKNPLNYVLNPSHRVRGEP

SEQ ID NO: 316950 - protein, 18 aa, Mycobacterium
LKPARWAENTMRTNGFAD

SEQ ID NO: 316951 - protein, 18 aa, Mycobacterium
LKPLDYVDHRWGAEQFAP

SEQ ID NO: 316952 - protein, 21 aa, Mycobacterium
LKPLIKGMWRKASKQVLKDYV

SEQ ID NO: 316953 - protein, 19 aa, Mycobacterium
LKPVPVILIVLILISGGIT

SEQ ID NO: 316954 - protein, 19 aa, Mycobacterium
LKQIPDFDLPQGYVPEIKF

SEQ ID NO: 316955 - protein, 24 aa, Mycobacterium
LKQIPDFELPPGYTAYIKFPSKSF

SEQ ID NO: 316956 - protein, 21 aa, Mycobacterium
LKRDCVNAVHGIYYFTEHKEM

SEQ ID NO: 316957 - protein, 22 aa, Mycobacterium
LKRERDAVELDLRANVASMAAT

SEQ ID NO: 316958 - protein, 22 aa, Mycobacterium
LKRERDAVELDLRANVGTMSAT

SEQ ID NO: 316959 - protein, 29 aa, Mycobacterium
LKREVVELRRCVNPLSGAFHRIQIENKDL

SEQ ID NO: 316960 - protein, 19 aa, Mycobacterium
LKRIPDFGLAPGYTPEIQF

SEQ ID NO: 316961 - protein, 22 aa, Mycobacterium
LKRPRMALFHECLVLWMVSYAI

SEQ ID NO: 316962 - protein, 23 aa, Mycobacterium
LKRRELTVVAPLVALLLVLGIYP

SEQ ID NO: 316963 - protein, 19 aa, Mycobacterium
LKRWWTLVVAAAVVAVVAF

SEQ ID NO: 316964 - protein, 29 aa, Mycobacterium
LKRYFAEGLHYWPWVLLGYFTVAIMVVSL

SEQ ID NO: 316965 - protein, 26 aa, Mycobacterium
LKRYGPLPPPRAVAITRQIGSALDAA

SEQ ID NO: 316966 - protein, 21 aa, Mycobacterium
LKSADIGIAMGRSGTEVAREA

SEQ ID NO: 316967 - protein, 21 aa, Mycobacterium
LKSATGLTLPPTVIFDHPTPT

SEQ ID NO: 316968 - protein, 20 aa, Mycobacterium
LKSNETFVYLARAVDPAIAN

SEQ ID NO: 316969 - protein, 18 aa, Mycobacterium
LKSRARRNGLGLLVAAFG

SEQ ID NO: 316970 - protein, 19 aa, Mycobacterium
LKSSWYLLGPAFVAAIAYV

SEQ ID NO: 316971 - protein, 21 aa, Mycobacterium
LKSTVSIVLLGWMVLGVLSVL

SEQ ID NO: 316972 - protein, 21 aa, Mycobacterium
LKSTVSIVLLVWVVLAVLNVV

SEQ ID NO: 316973 - protein, 17 aa, Mycobacterium
LKSYLILERNSTRDFSE

SEQ ID NO: 316974 - protein, 24 aa, Mycobacterium
LKTDVNAALPWTKTVVLNPGVTLS

SEQ ID NO: 316975 - protein, 18 aa, Mycobacterium
LKTMFATLLHHWPVLMLL

SEQ ID NO: 316976 - protein, 19 aa, Mycobacterium
LKTSWYLLGPAFVAAIAYV

SEQ ID NO: 316977 - protein, 26 aa, Mycobacterium
LKTTREFLDRNGGVLTHDIDNLEQVT

SEQ ID NO: 316978 - protein, 19 aa, Mycobacterium
LKTVPKRLSGLLNTSGLPA

SEQ ID NO: 316979 - protein, 18 aa, Mycobacterium
LKVAAADAIKGTPFEGAR

SEQ ID NO: 316980 - protein, 18 aa, Mycobacterium
LKVAECRAEARAWEQHEP

SEQ ID NO: 316981 - protein, 21 aa, Mycobacterium
LKVELPLSIPVLVASLRVVAV

SEQ ID NO: 316982 - protein, 17 aa, Mycobacterium
LKVELPLSIPVLVSGLR

SEQ ID NO: 316983 - protein, 17 aa, Mycobacterium
LKVESREGLANALANPE

SEQ ID NO: 316984 - protein, 17 aa, Mycobacterium
LKVGPSLSKGATTGTPI

SEQ ID NO: 316985 - protein, 17 aa, Mycobacterium
LKVMLRWLNAFVSKPGQ

SEQ ID NO: 316986 - protein, 19 aa, Mycobacterium
LKVSAVVAAPGWDADEVLA

SEQ ID NO: 316987 - protein, 17 aa, Mycobacterium
LKVTFLALAVPILLIGL

SEQ ID NO: 316988 - protein, 21 aa, Mycobacterium
LKYTEGFTRLWPTVGTVGSMI

SEQ ID NO: 316989 - protein, 19 aa, Mycobacterium
LKYYLPRARSRPVAEVAET

SEQ ID NO: 316990 - protein, 18 aa, Mycobacterium
LLAAAACGLQNAMTSNSP

SEQ ID NO: 316991 - protein, 17 aa, Mycobacterium
LLAACLTSGMAVSTAAG

SEQ ID NO: 316992 - protein, 19 aa, Mycobacterium
LLAADARRAGLPVDGVIVT

SEQ ID NO: 316993 - protein, 26 aa, Mycobacterium
LLAAGARPAFIGPLLLMCGVCSLAGL

SEQ ID NO: 316994 - protein, 24 aa, Mycobacterium
LLAAGGRYAALWAAHSRVGRPSPS

SEQ ID NO: 316995 - protein, 18 aa, Mycobacterium
LLAAGLIAVRAYRLKADR

SEQ ID NO: 316996 - protein, 23 aa, Mycobacterium
LLAAIALLVARQIVLPVRSASRI

SEQ ID NO: 316997 - protein, 17 aa, Mycobacterium
LLAASWTHSVWALTGGV

SEQ ID NO: 316998 - protein, 27 aa, Mycobacterium
LLAAWPLLRPRLPRVALSVLLGALSLG

SEQ ID NO: 316999 - protein, 19 aa, Mycobacterium
LLAAWYHFRMDYAGHTEVK

SEQ ID NO: 317000 - protein, 19 aa, Mycobacterium
LLACGCLFALMLFSEDGQT

SEQ ID NO: 317001 - protein, 24 aa, Mycobacterium
LLADQRVGGGIAWAAGEVPLVVVL

SEQ ID NO: 317002 - protein, 19 aa, Mycobacterium
LLAEARPPLSGTIAQLNRL

SEQ ID NO: 317003 - protein, 26 aa, Mycobacterium
LLAEFRVSPVPVMRIFGTWYVNVVRN

SEQ ID NO: 317004 - protein, 20 aa, Mycobacterium
LLAFILTFFVTRTFVRFIRH

SEQ ID NO: 317005 - protein, 17 aa, Mycobacterium
LLAFSVAIGALFAVVFA

SEQ ID NO: 317006 - protein, 18 aa, Mycobacterium
LLAFSVAIGALFAVVFAV

SEQ ID NO: 317007 - protein, 17 aa, Mycobacterium
LLAFWFFAAGWAASKAT

SEQ ID NO: 317008 - protein, 22 aa, Mycobacterium
LLAGFYRGWIDTVLSRIMDVMW

SEQ ID NO: 317009 - protein, 29 aa, Mycobacterium
LLAGGRPILRIVMRRRRLVGTWPLIAPLL

SEQ ID NO: 317010 - protein, 25 aa, Mycobacterium
LLAGLKMTIILTVVSIFFALILGVI

SEQ ID NO: 317011 - protein, 26 aa, Mycobacterium
LLAGLLRYWYLRILRPEVAARIGSIQ

SEQ ID NO: 317012 - protein, 31 aa, Mycobacterium
LLAGWRAIREYDLKLILAFGTVSQLGFITIM

SEQ ID NO: 317013 - protein, 19 aa, Mycobacterium
LLAGWRAVREYDLKLILAF

SEQ ID NO: 317014 - protein, 19 aa, Mycobacterium
LLAHLCFLGAMLPLALGRA

SEQ ID NO: 317015 - protein, 24 aa, Mycobacterium
LLAHLCFLGAMLPMAWGAVPSRPR

SEQ ID NO: 317016 - protein, 18 aa, Mycobacterium
LLAINAKLALLIFATLPM

SEQ ID NO: 317017 - protein, 24 aa, Mycobacterium
LLAIRPELQQALGNQNWAALPGLQ

SEQ ID NO: 317018 - protein, 25 aa, Mycobacterium
LLAKTAVFCGFAILQSTVITAIVVI

SEQ ID NO: 317019 - protein, 24 aa, Mycobacterium
LLALAGAFLLGWVVVVPAMGSHLV

SEQ ID NO: 317020 - protein, 18 aa, Mycobacterium
LLALAGLWVTRRGRIPGQ

SEQ ID NO: 317021 - protein, 17 aa, Mycobacterium
LLALCAAIFMAVGIVVR

SEQ ID NO: 317022 - protein, 19 aa, Mycobacterium
LLALCALAAALGLLATLLL

SEQ ID NO: 317023 - protein, 18 aa, Mycobacterium
LLALFAGSVLRGADLEAL

SEQ ID NO: 317024 - protein, 18 aa, Mycobacterium
LLALFAVAVGFPLCYAAY

SEQ ID NO: 317025 - protein, 25 aa, Mycobacterium
LLALFGGMMWISFASGARSFTGAGS

SEQ ID NO: 317026 - protein, 19 aa, Mycobacterium
LLALFGLFAYTGMRIARRS

SEQ ID NO: 317027 - protein, 20 aa, Mycobacterium
LLALHCTWVSCLFVACARAV

SEQ ID NO: 317028 - protein, 24 aa, Mycobacterium
LLALLIASAYRWPPPGVNDNESDW

SEQ ID NO: 317029 - protein, 19 aa, Mycobacterium
LLALRAVVFTLVMAATFWL

SEQ ID NO: 317030 - protein, 18 aa, Mycobacterium
LLALWVIRAIAHWFQARL

SEQ ID NO: 317031 - protein, 29 aa, Mycobacterium
LLANTWWWRALSGWWAWAHTPNGPGGPTP

SEQ ID NO: 317032 - protein, 20 aa, Mycobacterium
LLAPFRFAIFHLLVWGTFTI

SEQ ID NO: 317033 - protein, 17 aa, Mycobacterium
LLAPRTGLPVFPASLLL

SEQ ID NO: 317034 - protein, 18 aa, Mycobacterium
LLAQAFKRIFGRYRGDAL

SEQ ID NO: 317035 - protein, 25 aa, Mycobacterium
LLAQVPARYPLRGVIHAAGVLDDGL

SEQ ID NO: 317036 - protein, 22 aa, Mycobacterium
LLARGVDWVFPGSFVALRIQGI

SEQ ID NO: 317037 - protein, 19 aa, Mycobacterium
LLASFSLRTESALTEPGLD

SEQ ID NO: 317038 - protein, 33 aa, Mycobacterium
LLASISPLVRWIIKVPREFINSYLFNFPDTSFA

SEQ ID NO: 317039 - protein, 28 aa, Mycobacterium
LLASLPLKRAVVLRGLLSWPEDSAAAHM

SEQ ID NO: 317040 - protein, 25 aa, Mycobacterium
LLASLRDLGCLTLMMSGCPVEDAPF

SEQ ID NO: 317041 - protein, 18 aa, Mycobacterium
LLASPETYVFVWLGFYGG

SEQ ID NO: 317042 - protein, 28 aa, Mycobacterium
LLATGVSVAVAWPLAAMVPRSSTALSVF

SEQ ID NO: 317043 - protein, 18 aa, Mycobacterium
LLATNFFGVNAIPIAFNE

SEQ ID NO: 317044 - protein, 17 aa, Mycobacterium
LLATVRWRRRRARLTTW

SEQ ID NO: 317045 - protein, 17 aa, Mycobacterium
LLAVFLFGCFVFGVLSV

SEQ ID NO: 317046 - protein, 17 aa, Mycobacterium
LLAVIVIAVFYTDELHW

SEQ ID NO: 317047 - protein, 21 aa, Mycobacterium
LLAVLCTWFLQTAMCMYYKAR

SEQ ID NO: 317048 - protein, 26 aa, Mycobacterium
LLAVLRGRLHPIGGLGVALGITVLLF

SEQ ID NO: 317049 - protein, 20 aa, Mycobacterium
LLAWELMALSSLVLLLTNHR

SEQ ID NO: 317050 - protein, 20 aa, Mycobacterium
LLCAISARLQECLGQSDTLA

SEQ ID NO: 317051 - protein, 21 aa, Mycobacterium
LLCAVGRRLSGCLADGDTLAR

SEQ ID NO: 317052 - protein, 25 aa, Mycobacterium
LLCGMFPVLAVFLIFTLSVDVSQLL

SEQ ID NO: 317053 - protein, 19 aa, Mycobacterium
LLCLLFWQRRFFAASAPTF

SEQ ID NO: 317054 - protein, 19 aa, Mycobacterium
LLCREKLAAAIAILRQHKD

SEQ ID NO: 317055 - protein, 19 aa, Mycobacterium
LLCSLWIRRYTWRSRWEAG

SEQ ID NO: 317056 - protein, 25 aa, Mycobacterium
LLDALPPATFVDWRYLALAAGGGLI

SEQ ID NO: 317057 - protein, 26 aa, Mycobacterium
LLDALRRCGLGRWLAGLSDGLSTVLV

SEQ ID NO: 317058 - protein, 23 aa, Mycobacterium
LLDDHWGGGGYERGFEAGRDSAY

SEQ ID NO: 317059 - protein, 26 aa, Mycobacterium
LLDEIRIIACTYVICLNCELFMGPQG

SEQ ID NO: 317060 - protein, 17 aa, Mycobacterium
LLDERDQILALGPRYRQ

SEQ ID NO: 317061 - protein, 17 aa, Mycobacterium
LLDGATIAAVIPLLLWI

SEQ ID NO: 317062 - protein, 22 aa, Mycobacterium
LLDGIKPTLPVLLANLTTIGQI

SEQ ID NO: 317063 - protein, 18 aa, Mycobacterium
LLDLRLFTNRVFARANLT

SEQ ID NO: 317064 - protein, 19 aa, Mycobacterium
LLDLWWHTVYGFDAVLASP

SEQ ID NO: 317065 - protein, 42 aa, Mycobacterium
LLDPRRMIKTRGWRRIGTATVRWPGPVFAASLVIAIVGILIM

SEQ ID NO: 317066 - protein, 42 aa, Mycobacterium
LLDPRRMIKVRGWRRIGTATVRWPGPVFVASLLIALVGMMVV

SEQ ID NO: 317067 - protein, 18 aa, Mycobacterium
LLDQFKPTLPVLLANLTT

SEQ ID NO: 317068 - protein, 19 aa, Mycobacterium
LLDRAEVYGSAVIPPTFSS

SEQ ID NO: 317069 - protein, 17 aa, Mycobacterium
LLDRDGVVIARVSPEDK

SEQ ID NO: 317070 - protein, 19 aa, Mycobacterium
LLDRGVRILLPIARNDEAG

SEQ ID NO: 317071 - protein, 26 aa, Mycobacterium
LLDRLRARYGWFDHVLRAYQRFDGRN

SEQ ID NO: 317072 - protein, 19 aa, Mycobacterium
LLDRPELRALEAGIVLQAY

SEQ ID NO: 317073 - protein, 25 aa, Mycobacterium
LLDSSRLAAGVIHPELRPVYLEETV

SEQ ID NO: 317074 - protein, 24 aa, Mycobacterium
LLDSSRLAAGVIHPELSRVYLEET

SEQ ID NO: 317075 - protein, 26 aa, Mycobacterium
LLDSSRLAAGVLRPDLQRVYLEEEVQ

SEQ ID NO: 317076 - protein, 31 aa, Mycobacterium
LLDSSRLAAGVVKPRAVPVYVDEIAQRALLG

SEQ ID NO: 317077 - protein, 26 aa, Mycobacterium
LLDSSRLAAGVVRPDMRRVYLEETVQ

SEQ ID NO: 317078 - protein, 25 aa, Mycobacterium
LLDSSRLAAGVVRPQLRRVYLEETV

SEQ ID NO: 317079 - protein, 26 aa, Mycobacterium
LLDWATAVQLPWGVLLLFGGGLALSS

SEQ ID NO: 317080 - protein, 19 aa, Mycobacterium
LLDYVPRIVGAVVGTVVCG

SEQ ID NO: 317081 - protein, 19 aa, Mycobacterium
LLEAASLDGASTWRSMREV

SEQ ID NO: 317082 - protein, 18 aa, Mycobacterium
LLEAAVLRVTRGASEEAT

SEQ ID NO: 317083 - protein, 24 aa, Mycobacterium
LLEAVSWAGLLTGMFFKYVPDPGN

SEQ ID NO: 317084 - protein, 18 aa, Mycobacterium
LLECNFGGVAAVVFWVAL

SEQ ID NO: 317085 - protein, 18 aa, Mycobacterium
LLECSWEALEDAGIDPVS

SEQ ID NO: 317086 - protein, 17 aa, Mycobacterium
LLEDWRDNLRWPPASAL

SEQ ID NO: 317087 - protein, 26 aa, Mycobacterium
LLEGFSADLLYEFRLYSVGTQVVMWT

SEQ ID NO: 317088 - protein, 23 aa, Mycobacterium
LLEKGASVSGGWFTLTVLFILAV

SEQ ID NO: 317089 - protein, 17 aa, Mycobacterium
LLELAIGAAVVAKGWSS

SEQ ID NO: 317090 - protein, 21 aa, Mycobacterium
LLELAIPYALHAMSDEERVDI

SEQ ID NO: 317091 - protein, 20 aa, Mycobacterium
LLELATPYALHAVSDEERLD

SEQ ID NO: 317092 - protein, 25 aa, Mycobacterium
LLELRRRVFRHFQRLDLAFHDRYTS

SEQ ID NO: 317093 - protein, 19 aa, Mycobacterium
LLEMPSVELHFERFAAAPV

SEQ ID NO: 317094 - protein, 21 aa, Mycobacterium
LLEQPIRRWRPARVPLLPLAA

SEQ ID NO: 317095 - protein, 17 aa, Mycobacterium
LLERISLTARPGTLTAL

SEQ ID NO: 317096 - protein, 31 aa, Mycobacterium
LLERSGIGAGQWRWPLGEIDRPFDMRRDPLV

SEQ ID NO: 317097 - protein, 19 aa, Mycobacterium
LLESARIDGANSWRTFTTV

SEQ ID NO: 317098 - protein, 33 aa, Mycobacterium
LLESVAPKRPPKWRHVPAILLVASLVLLTIAMA

SEQ ID NO: 317099 - protein, 19 aa, Mycobacterium
LLEVCGRMSIALAGLSPRL

SEQ ID NO: 317100 - protein, 36 aa, Mycobacterium
LLEYVDWRAVFWINVPICALAVLLTAIFVPESKSVT

SEQ ID NO: 317101 - protein, 24 aa, Mycobacterium
LLFAVLRGRLHPVGGLGVALGGTV

SEQ ID NO: 317102 - protein, 27 aa, Mycobacterium
LLFAVLRGRLHPVGGLGVALGITVLLF

SEQ ID NO: 317103 - protein, 17 aa, Mycobacterium
LLFFYRSIFTVIMVFML

SEQ ID NO: 317104 - protein, 29 aa, Mycobacterium
LLFGGRRTDAWGHWLGCAAAVAAFGVGAA

SEQ ID NO: 317105 - protein, 18 aa, Mycobacterium
LLFGLPLLLGGVITGIVS

SEQ ID NO: 317106 - protein, 17 aa, Mycobacterium
LLFGVPWWTLVMSGNAW

SEQ ID NO: 317107 - protein, 18 aa, Mycobacterium
LLFHPINSITAYKGQIIY

SEQ ID NO: 317108 - protein, 27 aa, Mycobacterium
LLFIVGFNFGFGSLVWVYAGESFPSRL

SEQ ID NO: 317109 - protein, 19 aa, Mycobacterium
LLFKDFHALLLGAAVIGAG

SEQ ID NO: 317110 - protein, 22 aa, Mycobacterium
LLFPVVQPWYLLWAIIPLAAWA

SEQ ID NO: 317111 - protein, 22 aa, Mycobacterium
LLFPVVQPWYLLWAIIPMAAWA

SEQ ID NO: 317112 - protein, 23 aa, Mycobacterium
LLFRLIPWIVGAVFIAGCVLAVW

SEQ ID NO: 317113 - protein, 17 aa, Mycobacterium
LLFRVDAAVFGKRLRHR

SEQ ID NO: 317114 - protein, 20 aa, Mycobacterium
LLFRVEFGAGLIKLRGDPCW

SEQ ID NO: 317115 - protein, 17 aa, Mycobacterium
LLFRVEFGAGLIKMRGD

SEQ ID NO: 317116 - protein, 17 aa, Mycobacterium
LLFSVAMTGYILVATHL

SEQ ID NO: 317117 - protein, 17 aa, Mycobacterium
LLFSVGVDGFFALSGFL

SEQ ID NO: 317118 - protein, 24 aa, Mycobacterium
LLGAGMLWAGWYAFNGGSALAAGN

SEQ ID NO: 317119 - protein, 24 aa, Mycobacterium
LLGAGMLWAGWYAFNGGSALSAGN

SEQ ID NO: 317120 - protein, 18 aa, Mycobacterium
LLGAGWAMALLVAALVGG

SEQ ID NO: 317121 - protein, 28 aa, Mycobacterium
LLGAIARRFALSPIPVYLLAGLSLGKGG

SEQ ID NO: 317122 - protein, 28 aa, Mycobacterium
LLGALARRFALSPIPVYLLAGLALGKGG

SEQ ID NO: 317123 - protein, 25 aa, Mycobacterium
LLGALCMLGTLWLVVRARSSTRAGA

SEQ ID NO: 317124 - protein, 18 aa, Mycobacterium
LLGALLIGGGVFGTAMLM

SEQ ID NO: 317125 - protein, 27 aa, Mycobacterium
LLGAPWSVPRAQAYRDGQFLKVVIDEV

SEQ ID NO: 317126 - protein, 24 aa, Mycobacterium
LLGARLEIGVAIFFVLSGLLLFRP

SEQ ID NO: 317127 - protein, 20 aa, Mycobacterium
LLGARYGRRLSGNALRAIIV

SEQ ID NO: 317128 - protein, 34 aa, Mycobacterium
LLGATVVFLACRWAQADGAAPLWVGYVGAAAEAG

SEQ ID NO: 317129 - protein, 25 aa, Mycobacterium
LLGAVCLLGALWLVVRARSSVRAGA

SEQ ID NO: 317130 - protein, 17 aa, Mycobacterium
LLGAYPFIEKKLTGDNA

SEQ ID NO: 317131 - protein, 23 aa, Mycobacterium
LLGCITFAALAGYVAFFHSSHYL

SEQ ID NO: 317132 - protein, 18 aa, Mycobacterium
LLGCTPLGPVGWAQGLGS

SEQ ID NO: 317133 - protein, 28 aa, Mycobacterium
LLGDDCWWAPRWARRLQNKIGLGEIDLP

SEQ ID NO: 317134 - protein, 31 aa, Mycobacterium
LLGDDCWWAPRWMRRLQTRIGLGEIQLPDER

SEQ ID NO: 317135 - protein, 27 aa, Mycobacterium
LLGDDCWWAPRWMRRVQTRIGLGEIQL

SEQ ID NO: 317136 - protein, 20 aa, Mycobacterium
LLGDDFLTTVGWRIPFVASF

SEQ ID NO: 317137 - protein, 23 aa, Mycobacterium
LLGDLRPAFDDVLPVGNGGIDHA

SEQ ID NO: 317138 - protein, 24 aa, Mycobacterium
LLGDQRLGGGIAWAAGELPLVIVM

SEQ ID NO: 317139 - protein, 24 aa, Mycobacterium
LLGDQRLGGGIAWSAGEFPLVIVM

SEQ ID NO: 317140 - protein, 24 aa, Mycobacterium
LLGDRARNAFDLAHRVAPSARLLV

SEQ ID NO: 317141 - protein, 27 aa, Mycobacterium
LLGDRLDAFNVRRFLRRMLRRPEPAPK

SEQ ID NO: 317142 - protein, 25 aa, Mycobacterium
LLGDRLDALNVWKLGRRLLGRPEPP

SEQ ID NO: 317143 - protein, 28 aa, Mycobacterium
LLGEAAVAASGWLLLWFATFWAVQVITI

SEQ ID NO: 317144 - protein, 24 aa, Mycobacterium
LLGEHRGALGWIFAIVLMDASIIG

SEQ ID NO: 317145 - protein, 19 aa, Mycobacterium
LLGGAACWMFLSANSNTVV

SEQ ID NO: 317146 - protein, 17 aa, Mycobacterium
LLGGAALVVAALGVAIA

SEQ ID NO: 317147 - protein, 25 aa, Mycobacterium
LLGGDGRPALTVRAVCRKAALTERY

SEQ ID NO: 317148 - protein, 32 aa, Mycobacterium
LLGGFFTDHMSWRWAFWINVPVGILVLVIAAG

SEQ ID NO: 317149 - protein, 17 aa, Mycobacterium
LLGGIALGGEWGGAVLL

SEQ ID NO: 317150 - protein, 20 aa, Mycobacterium
LLGGICVFAAPVLGLASGIW

SEQ ID NO: 317151 - protein, 18 aa, Mycobacterium
LLGGRFVARHEILGIDGW

SEQ ID NO: 317152 - protein, 17 aa, Mycobacterium
LLGGVFGISLGKHVTQS

SEQ ID NO: 317153 - protein, 32 aa, Mycobacterium
LLGGYFTDCLSWRWAFWINLPVSAVVICVATA

SEQ ID NO: 317154 - protein, 28 aa, Mycobacterium
LLGIAVWLWRRRWFRGLVWTGVLCALAL

SEQ ID NO: 317155 - protein, 19 aa, Mycobacterium
LLGINWQLSLLLGAIVSPT

SEQ ID NO: 317156 - protein, 23 aa, Mycobacterium
LLGKFTFGVLMLRIEETAIGAVI

SEQ ID NO: 317157 - protein, 21 aa, Mycobacterium
LLGLFPLFVMFIITSITMQRE

SEQ ID NO: 317158 - protein, 26 aa, Mycobacterium
LLGLGFAAVIVIGGWALSTESSPGKA

SEQ ID NO: 317159 - protein, 23 aa, Mycobacterium
LLGLLWYAGLPLRVFASSLAAVV

SEQ ID NO: 317160 - protein, 23 aa, Mycobacterium
LLGLPAVLGLGVFCVAGAVVIGA

SEQ ID NO: 317161 - protein, 24 aa, Mycobacterium
LLGLVIGCVVAYALGDMNFDDVAQ

SEQ ID NO: 317162 - protein, 25 aa, Mycobacterium
LLGMPLHEPYLLGCLNARNDLSQIS

SEQ ID NO: 317163 - protein, 30 aa, Mycobacterium
LLGPAAAFYLGWSYWFAWVVTGIADLVAIT

SEQ ID NO: 317164 - protein, 33 aa, Mycobacterium
LLGPDGGWRWHARLFLGTGFCGAFTTYSALALE

SEQ ID NO: 317165 - protein, 26 aa, Mycobacterium
LLGPGIPLALLYAGKWYAAKIPGEPM

SEQ ID NO: 317166 - protein, 19 aa, Mycobacterium
LLGPLRFVGLANWRSVLTD

SEQ ID NO: 317167 - protein, 19 aa, Mycobacterium
LLGPLRFVGLSNWRSVLTD

SEQ ID NO: 317168 - protein, 26 aa, Mycobacterium
LLGPMAGPILGGWLIDDYGWQWIFWI

SEQ ID NO: 317169 - protein, 27 aa, Mycobacterium
LLGPRFIDTYVDWLWFGELGYRSVFTT

SEQ ID NO: 317170 - protein, 24 aa, Mycobacterium
LLGPRLDALNVRRLARRMLGRPEP

SEQ ID NO: 317171 - protein, 23 aa, Mycobacterium
LLGPRLHVLDARRVLHRILHGQR

SEQ ID NO: 317172 - protein, 19 aa, Mycobacterium
LLGPRVMRLPFSRRLATYA

SEQ ID NO: 317173 - protein, 27 aa, Mycobacterium
LLGQASDRFGRRLILQLALAGFAIGSV

SEQ ID NO: 317174 - protein, 19 aa, Mycobacterium
LLGQFSFGVLMLRIEETAI

SEQ ID NO: 317175 - protein, 17 aa, Mycobacterium
LLGQRVDIGMGIGLVIG

SEQ ID NO: 317176 - protein, 19 aa, Mycobacterium
LLGRARAPLAGTVDQLNRL

SEQ ID NO: 317177 - protein, 22 aa, Mycobacterium
LLGRKRLFVYGVVLFTIASGLC

SEQ ID NO: 317178 - protein, 19 aa, Mycobacterium
LLGRSELFTEGFIIPVVTV

SEQ ID NO: 317179 - protein, 22 aa, Mycobacterium
LLGRSELFTEGFLIPVTTVAAK

SEQ ID NO: 317180 - protein, 22 aa, Mycobacterium
LLGSANFELWVAVAATACAATV

SEQ ID NO: 317181 - protein, 19 aa, Mycobacterium
LLGSFSLRAESALIDPGLD

SEQ ID NO: 317182 - protein, 17 aa, Mycobacterium
LLGSGGMGEVYLAKHPR

SEQ ID NO: 317183 - protein, 26 aa, Mycobacterium
LLGSRTVRWDDIDGLRFHRGSWARAR

SEQ ID NO: 317184 - protein, 25 aa, Mycobacterium
LLGTFNRYWLAAAFGVTALVLSAIY

SEQ ID NO: 317185 - protein, 20 aa, Mycobacterium
LLGTLPTHWYLHSVADLEQH

SEQ ID NO: 317186 - protein, 19 aa, Mycobacterium
LLGTPVWLGPLAVGAIVIM

SEQ ID NO: 317187 - protein, 18 aa, Mycobacterium
LLGVALAAYEQWLADESS

SEQ ID NO: 317188 - protein, 21 aa, Mycobacterium
LLGVGLAFVGFRGEPSDNFTI

SEQ ID NO: 317189 - protein, 17 aa, Mycobacterium
LLGVRYALHVSLLAEAQ

SEQ ID NO: 317190 - protein, 26 aa, Mycobacterium
LLGWAGPRGAYLLAFGAFAVGTLVCA

SEQ ID NO: 317191 - protein, 17 aa, Mycobacterium
LLHFGAPRFDVLAICSL

SEQ ID NO: 317192 - protein, 19 aa, Mycobacterium
LLHGLLMHSGNDAAHALAM

SEQ ID NO: 317193 - protein, 27 aa, Mycobacterium
LLHHELEFWWELALLIVIMLLGHWVEM

SEQ ID NO: 317194 - protein, 20 aa, Mycobacterium
LLHIACWIALLAFGLSVPAA

SEQ ID NO: 317195 - protein, 18 aa, Mycobacterium
LLHLGGWAIGATVFIAAG

SEQ ID NO: 317196 - protein, 24 aa, Mycobacterium
LLHLSLRHGQWWLGSAAALSSFTL

SEQ ID NO: 317197 - protein, 25 aa, Mycobacterium
LLHRAKGGGLSSLFGGGVQSSLSGS

SEQ ID NO: 317198 - protein, 17 aa, Mycobacterium
LLHRDVKPANILISDGD

SEQ ID NO: 317199 - protein, 18 aa, Mycobacterium
LLHRDVKPANILVTEPSE

SEQ ID NO: 317200 - protein, 17 aa, Mycobacterium
LLHRDVKPENILVTAPD

SEQ ID NO: 317201 - protein, 20 aa, Mycobacterium
LLHTLSFAIALAIVVTLHVL

SEQ ID NO: 317202 - protein, 25 aa, Mycobacterium
LLHTPAEWLRFWFPDPDGGTSEHQR

SEQ ID NO: 317203 - protein, 25 aa, Mycobacterium
LLIAACLFIAMFILLRRKRVPGVAR

SEQ ID NO: 317204 - protein, 18 aa, Mycobacterium
LLIAFALAWAQHLGTGAA

SEQ ID NO: 317205 - protein, 18 aa, Mycobacterium
LLIAFGVLMGAILQQTGA

SEQ ID NO: 317206 - protein, 18 aa, Mycobacterium
LLIAFLCAAMLVYFVLLG

SEQ ID NO: 317207 - protein, 18 aa, Mycobacterium
LLIALLCVAMLGYFVLLG

SEQ ID NO: 317208 - protein, 37 aa, Mycobacterium
LLIATCLLWITAEWKLRYALTLALFVSFGVTWFLAHG

SEQ ID NO: 317209 - protein, 17 aa, Mycobacterium
LLIAWSLLVLPPRPRPH

SEQ ID NO: 317210 - protein, 17 aa, Mycobacterium
LLIAYPFLEKKLTGDDA

SEQ ID NO: 317211 - protein, 18 aa, Mycobacterium
LLIAYRSITRAIIPLFGV

SEQ ID NO: 317212 - protein, 24 aa, Mycobacterium
LLICSNIFMTFAWYGHLKFKDHPL

SEQ ID NO: 317213 - protein, 19 aa, Mycobacterium
LLICVLPVPNLVRVAVSAL

SEQ ID NO: 317214 - protein, 20 aa, Mycobacterium
LLIEEFQVLYAARRLRPNHM

SEQ ID NO: 317215 - protein, 17 aa, Mycobacterium
LLIERSMGFRLSREDEV

SEQ ID NO: 317216 - protein, 17 aa, Mycobacterium
LLIGAFAVTLGWLPTSG

SEQ ID NO: 317217 - protein, 17 aa, Mycobacterium
LLIGCFGIAAGSLSGAV

SEQ ID NO: 317218 - protein, 23 aa, Mycobacterium
LLIGHGLQKVFGLWGGPGLGGFR

SEQ ID NO: 317219 - protein, 21 aa, Mycobacterium
LLIGLARWYFAKSHPAGESQP

SEQ ID NO: 317220 - protein, 20 aa, Mycobacterium
LLIGLTRWYFGMSHQTTSAP

SEQ ID NO: 317221 - protein, 39 aa, Mycobacterium
LLIGPRLVDTYINWLWFGELGFRGVFTTVLLTRLALFLI

SEQ ID NO: 317222 - protein, 18 aa, Mycobacterium
LLIIGFRLCYGYRHGYYR

SEQ ID NO: 317223 - protein, 17 aa, Mycobacterium
LLIIGSVVGTILGVAIG

SEQ ID NO: 317224 - protein, 21 aa, Mycobacterium
LLIIMGAFMYFASRRQKKAMQ

SEQ ID NO: 317225 - protein, 24 aa, Mycobacterium
LLIKCGVVLLAVFATFIAHPVLHI

SEQ ID NO: 317226 - protein, 19 aa, Mycobacterium
LLILFAGSVLRGADPETLL

SEQ ID NO: 317227 - protein, 17 aa, Mycobacterium
LLILFPIFDAGLRQLKW

SEQ ID NO: 317228 - protein, 25 aa, Mycobacterium
LLILGCASGLCLREGLIDLEAAAPQ

SEQ ID NO: 317229 - protein, 26 aa, Mycobacterium
LLILTYRSPVLWLLPLLVIAFADRVA

SEQ ID NO: 317230 - protein, 25 aa, Mycobacterium
LLINTIPVPMSWEPHATLASALIDL

SEQ ID NO: 317231 - protein, 23 aa, Mycobacterium
LLIPCLLLAWAVAHPGLSFAALV

SEQ ID NO: 317232 - protein, 24 aa, Mycobacterium
LLIPCLLLAWAVSHPGIPFAVLVA

SEQ ID NO: 317233 - protein, 19 aa, Mycobacterium
LLIPVSDLYLFFTWLPSGQ

SEQ ID NO: 317234 - protein, 17 aa, Mycobacterium
LLIRLARGPSVSDRVVA

SEQ ID NO: 317235 - protein, 19 aa, Mycobacterium
LLIRPEMGAGIGAIGIFVF

SEQ ID NO: 317236 - protein, 29 aa, Mycobacterium
LLIRRWRLSDEMALFFGTAVVVILVITLV

SEQ ID NO: 317237 - protein, 18 aa, Mycobacterium
LLITSCYLGAATALAERV

SEQ ID NO: 317238 - protein, 25 aa, Mycobacterium
LLIVIPCWLLPLLASVPVFSRDAYS

SEQ ID NO: 317239 - protein, 18 aa, Mycobacterium
LLIVRPGFVIGRMTEGMA

SEQ ID NO: 317240 - protein, 18 aa, Mycobacterium
LLIVYKLLIGKAVLAVTG

SEQ ID NO: 317241 - protein, 18 aa, Mycobacterium
LLIWQLVYLSGWKPSFVL

SEQ ID NO: 317242 - protein, 17 aa, Mycobacterium
LLIWQTLVQTQRILTRW

SEQ ID NO: 317243 - protein, 19 aa, Mycobacterium
LLIWRRASDGFAFLSTLVV

SEQ ID NO: 317244 - protein, 22 aa, Mycobacterium
LLKFVILLGVASFLTFALTSVM

SEQ ID NO: 317245 - protein, 18 aa, Mycobacterium
LLKLLAMVVGVAMTLVSL

SEQ ID NO: 317246 - protein, 20 aa, Mycobacterium
LLKQRIEDLTALSGRVGQLS

SEQ ID NO: 317247 - protein, 31 aa, Mycobacterium
LLKSTFPILMIGLRMTLILTVVSIAIALVLG

SEQ ID NO: 317248 - protein, 28 aa, Mycobacterium
LLLAAFAVEMALMFAVPAGPAMARSFGF

SEQ ID NO: 317249 - protein, 29 aa, Mycobacterium
LLLAAGSAFLKWQIAWNAESDTARTESVQ

SEQ ID NO: 317250 - protein, 17 aa, Mycobacterium
LLLACIVLRGLATLRAP

SEQ ID NO: 317251 - protein, 17 aa, Mycobacterium
LLLADFGIARALDEATT

SEQ ID NO: 317252 - protein, 28 aa, Mycobacterium
LLLAGALALSAFLGWQQWQQHQVKLAGQ

SEQ ID NO: 317253 - protein, 21 aa, Mycobacterium
LLLAIPFTVLVVFTLNILLVE

SEQ ID NO: 317254 - protein, 18 aa, Mycobacterium
LLLAIPVLIGTSLLIYSL

SEQ ID NO: 317255 - protein, 19 aa, Mycobacterium
LLLALPVPLILAGLAVGIL

SEQ ID NO: 317256 - protein, 20 aa, Mycobacterium
LLLALRFQRGAACTLLALFV

SEQ ID NO: 317257 - protein, 22 aa, Mycobacterium
LLLARAVLSPARIVLLDEPTEH

SEQ ID NO: 317258 - protein, 23 aa, Mycobacterium
LLLARAVLSPARIVLLDEPTEHL

SEQ ID NO: 317259 - protein, 31 aa, Mycobacterium
LLLASTTRFEWLRTFIRSIPPLFSAIPTFWL

SEQ ID NO: 317260 - protein, 19 aa, Mycobacterium
LLLAWPWALLIAASSWVAA

SEQ ID NO: 317261 - protein, 18 aa, Mycobacterium
LLLCALLFTIIWWEVSHS

SEQ ID NO: 317262 - protein, 27 aa, Mycobacterium
LLLCALWCAGVAMLWAHGPNTGLIGAA

SEQ ID NO: 317263 - protein, 18 aa, Mycobacterium
LLLCVVLFTFVWWGVSHS

SEQ ID NO: 317264 - protein, 22 aa, Mycobacterium
LLLDAAAALGWDAAPIPRNAPG

SEQ ID NO: 317265 - protein, 20 aa, Mycobacterium
LLLDAAIGWCPTSLLLHRLG

SEQ ID NO: 317266 - protein, 19 aa, Mycobacterium
LLLDAGVISAPAPRPKFDA

SEQ ID NO: 317267 - protein, 24 aa, Mycobacterium
LLLDALAGRERFSLNDPDDDALAA

SEQ ID NO: 317268 - protein, 17 aa, Mycobacterium
LLLDRVFLGRGVVRTLL

SEQ ID NO: 317269 - protein, 23 aa, Mycobacterium
LLLEPMAGIALFAIVMGVVAGAR

SEQ ID NO: 317270 - protein, 24 aa, Mycobacterium
LLLERFGPVTPPWAVALVHQVAAA

SEQ ID NO: 317271 - protein, 25 aa, Mycobacterium
LLLERFGPVTPPWAVALVHQVASAL

SEQ ID NO: 317272 - protein, 20 aa, Mycobacterium
LLLFCVAGLAFVHGDRVSPA

SEQ ID NO: 317273 - protein, 20 aa, Mycobacterium
LLLFYFLRHWMPFKRPAGDW

SEQ ID NO: 317274 - protein, 19 aa, Mycobacterium
LLLGCGDAVIGINPATDSP

SEQ ID NO: 317275 - protein, 17 aa, Mycobacterium
LLLGFVAFVVTFVVTRT

SEQ ID NO: 317276 - protein, 25 aa, Mycobacterium
LLLGGCRFAKEHLSAAPVATIATGA

SEQ ID NO: 317277 - protein, 18 aa, Mycobacterium
LLLGIAVALAREASDRTV

SEQ ID NO: 317278 - protein, 17 aa, Mycobacterium
LLLGMLVTARFRHPIRW

SEQ ID NO: 317279 - protein, 28 aa, Mycobacterium
LLLGPRLIDTYVDWLWFGELGYRSVFTT

SEQ ID NO: 317280 - protein, 17 aa, Mycobacterium
LLLGRLSPGLGDALSAV

SEQ ID NO: 317281 - protein, 17 aa, Mycobacterium
LLLGTWAALSVREVPSW

SEQ ID NO: 317282 - protein, 24 aa, Mycobacterium
LLLGWGVFCNYGLMLMGLPAAAVL

SEQ ID NO: 317283 - protein, 24 aa, Mycobacterium
LLLGWGVFCNYGLMLMGLPAVAVL

SEQ ID NO: 317284 - protein, 17 aa, Mycobacterium
LLLHIGVMLAFLIIVLH

SEQ ID NO: 317285 - protein, 18 aa, Mycobacterium
LLLIFLFWPWEYKPKEAA

SEQ ID NO: 317286 - protein, 17 aa, Mycobacterium
LLLIGSVVGTALGVAIG

SEQ ID NO: 317287 - protein, 24 aa, Mycobacterium
LLLIYHWARVVWQRTIVQLAAEEQ

SEQ ID NO: 317288 - protein, 26 aa, Mycobacterium
LLLKHKKDLVEWAPNVSYYASALAES

SEQ ID NO: 317289 - protein, 19 aa, Mycobacterium
LLLLACVPLNWIITMIAKG

SEQ ID NO: 317290 - protein, 18 aa, Mycobacterium
LLLLAGLVAFAVMRHRAR

SEQ ID NO: 317291 - protein, 20 aa, Mycobacterium
LLLLCFAAVITIAALFIVEA

SEQ ID NO: 317292 - protein, 24 aa, Mycobacterium
LLLLGLVGQHPWLLVVFGVLGVVA

SEQ ID NO: 317293 - protein, 33 aa, Mycobacterium
LLLLLLPRERWRWWAVRRSIRLLARLTGTAITV

SEQ ID NO: 317294 - protein, 29 aa, Mycobacterium
LLLLLRIVQGFALGGEWAGAVLLAVEHGP

SEQ ID NO: 317295 - protein, 18 aa, Mycobacterium
LLLLPVAWYAAVGSHQLA

SEQ ID NO: 317296 - protein, 21 aa, Mycobacterium
LLLLPVLAWAAFRLEVIGAAL

SEQ ID NO: 317297 - protein, 17 aa, Mycobacterium
LLLLRGADLRRAERLAV

SEQ ID NO: 317298 - protein, 26 aa, Mycobacterium
LLLMCGVCSLAGLWYVGATLDRNPRQ

SEQ ID NO: 317299 - protein, 23 aa, Mycobacterium
LLLMCYENYWNLVAIGIFTPLLI

SEQ ID NO: 317300 - protein, 19 aa, Mycobacterium
LLLMESIAIPLSFVVLVWV

SEQ ID NO: 317301 - protein, 20 aa, Mycobacterium
LLLNAAVGWCPTSLLLHRLG

SEQ ID NO: 317302 - protein, 24 aa, Mycobacterium
LLLNGLVCAIGMVGGYVFSVFLQG

SEQ ID NO: 317303 - protein, 23 aa, Mycobacterium
LLLNSIFGWSWADPIAGLVIAAV

SEQ ID NO: 317304 - protein, 17 aa, Mycobacterium
LLLNSLFGFSWADHVVA

SEQ ID NO: 317305 - protein, 26 aa, Mycobacterium
LLLNTLAGWWWADPLAGYVLVLYALR

SEQ ID NO: 317306 - protein, 18 aa, Mycobacterium
LLLPAGALGDRYGRRGAL

SEQ ID NO: 317307 - protein, 17 aa, Mycobacterium
LLLPDLQAAWRVLHALP

SEQ ID NO: 317308 - protein, 26 aa, Mycobacterium
LLLPDYRIVGALPLAYGIIASGILLH

SEQ ID NO: 317309 - protein, 19 aa, Mycobacterium
LLLPLLNRQWRAVLAAIVV

SEQ ID NO: 317310 - protein, 27 aa, Mycobacterium
LLLPLLNRQWRVFAAAFGIPAFFNLVA

SEQ ID NO: 317311 - protein, 17 aa, Mycobacterium
LLLPSLVPTFAFAHIVL

SEQ ID NO: 317312 - protein, 19 aa, Mycobacterium
LLLQDRFGYALGFDLYSFW

SEQ ID NO: 317313 - protein, 17 aa, Mycobacterium
LLLRIAVGDARDVSAVV

SEQ ID NO: 317314 - protein, 20 aa, Mycobacterium
LLLRSMGYRDALIGALLAGA

SEQ ID NO: 317315 - protein, 17 aa, Mycobacterium
LLLSARVALVVCTLAML

SEQ ID NO: 317316 - protein, 21 aa, Mycobacterium
LLLSLVVFRGLLGRLAIFTSV

SEQ ID NO: 317317 - protein, 23 aa, Mycobacterium
LLLSRRFAHSVGRRRARHLRNHV

SEQ ID NO: 317318 - protein, 19 aa, Mycobacterium
LLLSRRFTRSAGRMRVRHL

SEQ ID NO: 317319 - protein, 18 aa, Mycobacterium
LLLSRRFTRSAGRRRVRQ

SEQ ID NO: 317320 - protein, 26 aa, Mycobacterium
LLLSSLVVGAGWPLVVEQISVRPNAA

SEQ ID NO: 317321 - protein, 25 aa, Mycobacterium
LLLTIPVLLTHQWQLVFVAAALLGA

SEQ ID NO: 317322 - protein, 19 aa, Mycobacterium
LLLTVGGWVTFMVRKSRRQ

SEQ ID NO: 317323 - protein, 17 aa, Mycobacterium
LLLVFGISFEFPLLIIM

SEQ ID NO: 317324 - protein, 19 aa, Mycobacterium
LLLVLICRRQWQPKLVLGA

SEQ ID NO: 317325 - protein, 30 aa, Mycobacterium
LLLVLRIVQGFALGGEWAGAVLLAVEHSPR

SEQ ID NO: 317326 - protein, 17 aa, Mycobacterium
LLLVYRSPITVIMLLLT

SEQ ID NO: 317327 - protein, 19 aa, Mycobacterium
LLLVYRSVITVVVLLLTVG

SEQ ID NO: 317328 - protein, 23 aa, Mycobacterium
LLLWTIGLCLYGLVMGSVVHGIG

SEQ ID NO: 317329 - protein, 21 aa, Mycobacterium
LLLYPRRSWGPTAWVVDSAML

SEQ ID NO: 317330 - protein, 18 aa, Mycobacterium
LLMESIAVPLSFVVLTWV

SEQ ID NO: 317331 - protein, 19 aa, Mycobacterium
LLMFGGWSDVLGRRPLLLT

SEQ ID NO: 317332 - protein, 19 aa, Mycobacterium
LLMGPEALETVWINKDKAF

SEQ ID NO: 317333 - protein, 17 aa, Mycobacterium
LLMIVAIVAVILVGPGR

SEQ ID NO: 317334 - protein, 17 aa, Mycobacterium
LLMLGLWLAGWGAARLV

SEQ ID NO: 317335 - protein, 23 aa, Mycobacterium
LLMLMAGVALFWIVTLVVTAAQG

SEQ ID NO: 317336 - protein, 23 aa, Mycobacterium
LLMLPEMLVFGGGLVVLISGSFL

SEQ ID NO: 317337 - protein, 17 aa, Mycobacterium
LLMPFAGLARLGSIVAM

SEQ ID NO: 317338 - protein, 30 aa, Mycobacterium
LLMPSIATLLGRWFWWPQVVHPRGDNARPR

SEQ ID NO: 317339 - protein, 31 aa, Mycobacterium
LLMPSIATLLGRWFWWPQVVHPRGDNARRPV

SEQ ID NO: 317340 - protein, 30 aa, Mycobacterium
LLMPSIATLLGRWFWWPQVVHPRGDNARRS

SEQ ID NO: 317341 - protein, 30 aa, Mycobacterium
LLMPSIATLLGRWFWWPQVVYPRGDNHFRR

SEQ ID NO: 317342 - protein, 18 aa, Mycobacterium
LLMSISFAALIAAQVAFM

SEQ ID NO: 317343 - protein, 17 aa, Mycobacterium
LLMSISFAALISADVSF

SEQ ID NO: 317344 - protein, 17 aa, Mycobacterium
LLMTGFVGTALLAIGFI

SEQ ID NO: 317345 - protein, 17 aa, Mycobacterium
LLMTGLVIFGLVSIPAA

SEQ ID NO: 317346 - protein, 17 aa, Mycobacterium
LLMVSMPALGLANWYIV

SEQ ID NO: 317347 - protein, 18 aa, Mycobacterium
LLMVVGVVLLQLATGNQL

SEQ ID NO: 317348 - protein, 18 aa, Mycobacterium
LLNENLAAGRLRFTTDYD

SEQ ID NO: 317349 - protein, 27 aa, Mycobacterium
LLNGLVCLIGLSGGYVFSVFLQGVNPG

SEQ ID NO: 317350 - protein, 20 aa, Mycobacterium
LLNGVVLKFAMRSMNSTFAS

SEQ ID NO: 317351 - protein, 19 aa, Mycobacterium
LLNIGEYLQDLTLRRTRRA

SEQ ID NO: 317352 - protein, 18 aa, Mycobacterium
LLNNLPFAQKVAVSDYSR

SEQ ID NO: 317353 - protein, 24 aa, Mycobacterium
LLNNRFLLEPVLNRIGLFGNKIAF

SEQ ID NO: 317354 - protein, 22 aa, Mycobacterium
LLNPTLFLPMAFKQNVTSNTSF

SEQ ID NO: 317355 - protein, 18 aa, Mycobacterium
LLNRQWRALIPAFVVPAV

SEQ ID NO: 317356 - protein, 18 aa, Mycobacterium
LLNRQWRAVLAAIVVPVV

SEQ ID NO: 317357 - protein, 19 aa, Mycobacterium
LLPALALLAFWRRRRKDLG

SEQ ID NO: 317358 - protein, 28 aa, Mycobacterium
LLPASWRPGADWEPLALLLGGSILITLS

SEQ ID NO: 317359 - protein, 25 aa, Mycobacterium
LLPDYRVVGALPLAYAVVVSGSLLK

SEQ ID NO: 317360 - protein, 18 aa, Mycobacterium
LLPGDPLAAMAGDRPLTP

SEQ ID NO: 317361 - protein, 18 aa, Mycobacterium
LLPGLPWAVLLAVACIVV

SEQ ID NO: 317362 - protein, 20 aa, Mycobacterium
LLPGRPGPIVRPNMGDTAGR

SEQ ID NO: 317363 - protein, 20 aa, Mycobacterium
LLPHLFERFVRADKSRSRAA

SEQ ID NO: 317364 - protein, 24 aa, Mycobacterium
LLPIAVLLWEFSRGTVLQGSSAGI

SEQ ID NO: 317365 - protein, 26 aa, Mycobacterium
LLPISGRLTERFGARRVYLVGIACYG

SEQ ID NO: 317366 - protein, 18 aa, Mycobacterium
LLPISWQLGLAALAGVPL

SEQ ID NO: 317367 - protein, 24 aa, Mycobacterium
LLPKPADFPTTWTVDTRTGADRFG

SEQ ID NO: 317368 - protein, 19 aa, Mycobacterium
LLPLIPYLLGFGSLVAGLA

SEQ ID NO: 317369 - protein, 17 aa, Mycobacterium
LLPLLPIASVVLAMHPR

SEQ ID NO: 317370 - protein, 25 aa, Mycobacterium
LLPMWEIVMILLLLAMVGLRDKVIF

SEQ ID NO: 317371 - protein, 30 aa, Mycobacterium
LLPPEAMDTYGWRIPFLIAAPLGLVGLYIR

SEQ ID NO: 317372 - protein, 25 aa, Mycobacterium
LLPPGLRRLAKWTGLVVGVATLAVA

SEQ ID NO: 317373 - protein, 25 aa, Mycobacterium
LLPPGLRRLAKWTGVIVSVATLAVS

SEQ ID NO: 317374 - protein, 27 aa, Mycobacterium
LLPPRSHRWWLGLNVAGALALNHLILT

SEQ ID NO: 317375 - protein, 25 aa, Mycobacterium
LLPRSLKPGPDWEPLGMLVAGAVLI

SEQ ID NO: 317376 - protein, 19 aa, Mycobacterium
LLPSLLATVRWRRRRARLT

SEQ ID NO: 317377 - protein, 19 aa, Mycobacterium
LLPTIGLAGLPWVAAALIA

SEQ ID NO: 317378 - protein, 30 aa, Mycobacterium
LLPTLLATVRWRRRRTRLAIWVASSAAAVF

SEQ ID NO: 317379 - protein, 20 aa, Mycobacterium
LLPVSWQLGLAALGGLPLML

SEQ ID NO: 317380 - protein, 20 aa, Mycobacterium
LLPVTGADEYGDYGPDDDEF

SEQ ID NO: 317381 - protein, 17 aa, Mycobacterium
LLQEIFAGYFGHRLPAA

SEQ ID NO: 317382 - protein, 17 aa, Mycobacterium
LLQGGRNIFAFVTKAFP

SEQ ID NO: 317383 - protein, 53 aa, Mycobacterium
LLQGHWSLLVGYGCLPWIALTVIRLRTATNLGAWCPLAFWIAVAGLTPTGTVL

SEQ ID NO: 317384 - protein, 30 aa, Mycobacterium
LLQGHWSLLVGYGCLPWVATAMLRLRAGSG

SEQ ID NO: 317385 - protein, 19 aa, Mycobacterium
LLQGLIFGTILHWGTRARS

SEQ ID NO: 317386 - protein, 19 aa, Mycobacterium
LLQHSVHAVGLNWDITAES

SEQ ID NO: 317387 - protein, 19 aa, Mycobacterium
LLQIMPLFFFAGAAACLSS

SEQ ID NO: 317388 - protein, 27 aa, Mycobacterium
LLQRLTVAEFFRLVWQFGDGSGQPIHA

SEQ ID NO: 317389 - protein, 26 aa, Mycobacterium
LLQTKRLLIRWARDYVTVIGAIVLPI

SEQ ID NO: 317390 - protein, 20 aa, Mycobacterium
LLRDTRWWLGGLGDIASYCL

SEQ ID NO: 317391 - protein, 24 aa, Mycobacterium
LLREARGLFGGPLFKGIVGDVRKY

SEQ ID NO: 317392 - protein, 18 aa, Mycobacterium
LLREATFELHPALLDQVG

SEQ ID NO: 317393 - protein, 23 aa, Mycobacterium
LLRELAAGPARRVVDDTGAAASS

SEQ ID NO: 317394 - protein, 18 aa, Mycobacterium
LLRGFSFGIDFNGGTTVS

SEQ ID NO: 317395 - protein, 22 aa, Mycobacterium
LLRGMPFALTWWSLTFPVGTFV

SEQ ID NO: 317396 - protein, 19 aa, Mycobacterium
LLRGNVIDLAVAVVIGAAF

SEQ ID NO: 317397 - protein, 27 aa, Mycobacterium
LLRLKVFPLAISLPWGIAPAALPQLPL

SEQ ID NO: 317398 - protein, 19 aa, Mycobacterium
LLRNSRVVLSAAIDVNDGI

SEQ ID NO: 317399 - protein, 28 aa, Mycobacterium
LLRPQWLALFVVVAAFAYLCFTVLAPWQ

SEQ ID NO: 317400 - protein, 30 aa, Mycobacterium
LLRQFRWRVAPGYRPLMTWGTGPTPADGLP

SEQ ID NO: 317401 - protein, 33 aa, Mycobacterium
LLRSRWMTVCVTMVFAVMGAIAYTLLITPQYQA

SEQ ID NO: 317402 - protein, 20 aa, Mycobacterium
LLRTAGEVTGIFSERSKQVN

SEQ ID NO: 317403 - protein, 19 aa, Mycobacterium
LLRTFSFDPARRFHSDDLG

SEQ ID NO: 317404 - protein, 18 aa, Mycobacterium
LLRTVALGMMARNGPEVL

SEQ ID NO: 317405 - protein, 17 aa, Mycobacterium
LLRTVALGMMVRNSPEV

SEQ ID NO: 317406 - protein, 22 aa, Mycobacterium
LLRTVIAPLYLVGSVVVSYFAA

SEQ ID NO: 317407 - protein, 25 aa, Mycobacterium
LLRVEVPNALPLMLGGLRNATLQVV

SEQ ID NO: 317408 - protein, 23 aa, Mycobacterium
LLRVPELYVWILVAIAGTVVQQS

SEQ ID NO: 317409 - protein, 27 aa, Mycobacterium
LLSAAINFVLIAAVVYFFVVLPYNTLR

SEQ ID NO: 317410 - protein, 27 aa, Mycobacterium
LLSAARVPFYIGVGVVTVLLAGVLGWL

SEQ ID NO: 317411 - protein, 23 aa, Mycobacterium
LLSARAALRIGLVMLSVNLALLY

SEQ ID NO: 317412 - protein, 20 aa, Mycobacterium
LLSARLGRPGGWTTTRCVLL

SEQ ID NO: 317413 - protein, 18 aa, Mycobacterium
LLSAVRWRRRRTRVVTWV

SEQ ID NO: 317414 - protein, 31 aa, Mycobacterium
LLSDDQMGSWGWRLPFLVAAPLGLIGVYLRS

SEQ ID NO: 317415 - protein, 32 aa, Mycobacterium
LLSEHSFVTWGWRVPFLFGIALSVVGLFIRLR

SEQ ID NO: 317416 - protein, 25 aa, Mycobacterium
LLSERELRAVLGHELSHVYNRDILI

SEQ ID NO: 317417 - protein, 24 aa, Mycobacterium
LLSEVTKFAALIVFGALLTPEWLS

SEQ ID NO: 317418 - protein, 24 aa, Mycobacterium
LLSFSALILVAAWRMHARQAETPC

SEQ ID NO: 317419 - protein, 17 aa, Mycobacterium
LLSGAGLAFSRAIGEYG

SEQ ID NO: 317420 - protein, 19 aa, Mycobacterium
LLSGFFILVERQYGFGDLV

SEQ ID NO: 317421 - protein, 22 aa, Mycobacterium
LLSGIALLVSRQVVVPVRSASR

SEQ ID NO: 317422 - protein, 17 aa, Mycobacterium
LLSGVGLAFSRAIGEFG

SEQ ID NO: 317423 - protein, 18 aa, Mycobacterium
LLSGWAYDRVGPKSLAAL

SEQ ID NO: 317424 - protein, 22 aa, Mycobacterium
LLSGWLVARWLIMSWTGRVIVW

SEQ ID NO: 317425 - protein, 18 aa, Mycobacterium
LLSHPGLPLWPYLACAAL

SEQ ID NO: 317426 - protein, 18 aa, Mycobacterium
LLSIAFVVAMSRACAGIG

SEQ ID NO: 317427 - protein, 19 aa, Mycobacterium
LLSIPEFANPVQFICGGSF

SEQ ID NO: 317428 - protein, 23 aa, Mycobacterium
LLSIPGFLLAIAIVVLYTARTGS

SEQ ID NO: 317429 - protein, 18 aa, Mycobacterium
LLSIPMGVPLEWNVFMIF

SEQ ID NO: 317430 - protein, 18 aa, Mycobacterium
LLSLMPAPVVQRYREGVQ

SEQ ID NO: 317431 - protein, 26 aa, Mycobacterium
LLSPLRMPLWLGMLVGNLLSSFVMSY

SEQ ID NO: 317432 - protein, 33 aa, Mycobacterium
LLSRLSWPALFSGRWGNSAAMAFAAGLFSATPP

SEQ ID NO: 317433 - protein, 20 aa, Mycobacterium
LLSTAFWYSLTMAIVLMAAV

SEQ ID NO: 317434 - protein, 27 aa, Mycobacterium
LLSTVLFFLRWVGLFWSVPSILGGRED

SEQ ID NO: 317435 - protein, 22 aa, Mycobacterium
LLSWSVVVAVYFVAKVATRRPL

SEQ ID NO: 317436 - protein, 17 aa, Mycobacterium
LLTAAVLVLFTLIFFLY

SEQ ID NO: 317437 - protein, 25 aa, Mycobacterium
LLTAMVMGMVWSRWGRDSWVTRRLP

SEQ ID NO: 317438 - protein, 23 aa, Mycobacterium
LLTARLHGAVSLHVTYADGRGVL

SEQ ID NO: 317439 - protein, 18 aa, Mycobacterium
LLTAWAFSGSLITGLSAI

SEQ ID NO: 317440 - protein, 23 aa, Mycobacterium
LLTDARQAFFTSFAISGVLVVLT

SEQ ID NO: 317441 - protein, 17 aa, Mycobacterium
LLTDHLDPGYAAAAQDG

SEQ ID NO: 317442 - protein, 18 aa, Mycobacterium
LLTEARPPLAGTVDQLNR

SEQ ID NO: 317443 - protein, 21 aa, Mycobacterium
LLTFYPGWVPIAAVALLVVIA

SEQ ID NO: 317444 - protein, 20 aa, Mycobacterium
LLTGCLPLAVGAAAAVPGPM

SEQ ID NO: 317445 - protein, 20 aa, Mycobacterium
LLTGDARAAAWVSATDFYAG

SEQ ID NO: 317446 - protein, 27 aa, Mycobacterium
LLTGGRFRLGVGLGWNAVEYEALGETF

SEQ ID NO: 317447 - protein, 27 aa, Mycobacterium
LLTGGRLRLGVGLGWNAVEYEALGETF

SEQ ID NO: 317448 - protein, 17 aa, Mycobacterium
LLTGWNCPACGGLRMTH

SEQ ID NO: 317449 - protein, 18 aa, Mycobacterium
LLTGYGLGHPSVFADIVG

SEQ ID NO: 317450 - protein, 26 aa, Mycobacterium
LLTHPHHWSMYLAGWIDDLVPGTADQ

SEQ ID NO: 317451 - protein, 25 aa, Mycobacterium
LLTHPHHWSMYLAGWIDNLVPGTAD

SEQ ID NO: 317452 - protein, 24 aa, Mycobacterium
LLTIAVNVLVPWIEFVARSHAVTM

SEQ ID NO: 317453 - protein, 24 aa, Mycobacterium
LLTICDRYARILARRSEQYLDPGC

SEQ ID NO: 317454 - protein, 18 aa, Mycobacterium
LLTIPFTVLVVFTMNILL

SEQ ID NO: 317455 - protein, 17 aa, Mycobacterium
LLTLLFVIGCGQALTAP

SEQ ID NO: 317456 - protein, 26 aa, Mycobacterium
LLTLLLCSILSIGVIGFIGASSGRTA

SEQ ID NO: 317457 - protein, 20 aa, Mycobacterium
LLTPIGWAGVVGVAFLANRI

SEQ ID NO: 317458 - protein, 18 aa, Mycobacterium
LLTPMVFDMGAFVGLHAV

SEQ ID NO: 317459 - protein, 32 aa, Mycobacterium
LLTQRGGGLGSILRLAILGIVMLAVTFALMVA

SEQ ID NO: 317460 - protein, 20 aa, Mycobacterium
LLTRARPPLAGTVDQLNRLA

SEQ ID NO: 317461 - protein, 30 aa, Mycobacterium
LLTRKGLKPWVIPVMGGLLFFVLVYVWLTS

SEQ ID NO: 317462 - protein, 20 aa, Mycobacterium
LLTRLWPVPLLGVVVAIAAG

SEQ ID NO: 317463 - protein, 18 aa, Mycobacterium
LLTRVVVSAAGADRELES

SEQ ID NO: 317464 - protein, 24 aa, Mycobacterium
LLTRYPKALLMCFLITLGGTIAFY

SEQ ID NO: 317465 - protein, 17 aa, Mycobacterium
LLTSVGTAVGWRGAFAV

SEQ ID NO: 317466 - protein, 25 aa, Mycobacterium
LLTTVCSRSAAVGRLEGVDGSRPFC

SEQ ID NO: 317467 - protein, 20 aa, Mycobacterium
LLTVEALDAMVLAAGANAAA

SEQ ID NO: 317468 - protein, 23 aa, Mycobacterium
LLTVVLCAGDWVIRRARGGRQSA

SEQ ID NO: 317469 - protein, 18 aa, Mycobacterium
LLTWCSVERSIATNRLLP

SEQ ID NO: 317470 - protein, 19 aa, Mycobacterium
LLTYLASFGPKLSLDDAQI

SEQ ID NO: 317471 - protein, 18 aa, Mycobacterium
LLVAAWFALFALPLLISA

SEQ ID NO: 317472 - protein, 20 aa, Mycobacterium
LLVAFFVVRAWRRRVKAEKQ

SEQ ID NO: 317473 - protein, 17 aa, Mycobacterium
LLVAFMCVALLVYFALL

SEQ ID NO: 317474 - protein, 19 aa, Mycobacterium
LLVAGRLGDRFGPKNIYVI

SEQ ID NO: 317475 - protein, 19 aa, Mycobacterium
LLVAGRLGDRFGPKNLYLT

SEQ ID NO: 317476 - protein, 23 aa, Mycobacterium
LLVAGWFLYPGVGFIGLLFFVVW

SEQ ID NO: 317477 - protein, 25 aa, Mycobacterium
LLVAIPFTVLVAFTLNILLREIGAA

SEQ ID NO: 317478 - protein, 18 aa, Mycobacterium
LLVARLLLGVAIGVAVVV

SEQ ID NO: 317479 - protein, 27 aa, Mycobacterium
LLVASLAVSGFLGWRQWQDHQVKLAGE

SEQ ID NO: 317480 - protein, 22 aa, Mycobacterium
LLVCAGLPFLGVKWGYPDDRVL

SEQ ID NO: 317481 - protein, 19 aa, Mycobacterium
LLVCDRLAINPSPFLMAEV

SEQ ID NO: 317482 - protein, 18 aa, Mycobacterium
LLVEVGWDGLSMRLVAVR

SEQ ID NO: 317483 - protein, 50 aa, Mycobacterium
LLVFAVLILVDRRFKIGHGRLFALYVAGYCAGRFWIELMRSDTATLLAGI

SEQ ID NO: 317484 - protein, 18 aa, Mycobacterium
LLVFCFMGAIISIFNALP

SEQ ID NO: 317485 - protein, 22 aa, Mycobacterium
LLVGALVASMAWLDRDQSPRFT

SEQ ID NO: 317486 - protein, 29 aa, Mycobacterium
LLVGELVWWERAGLLPLVGVIPYLLFLIL

SEQ ID NO: 317487 - protein, 19 aa, Mycobacterium
LLVGGPFVYLIDFGATPTA

SEQ ID NO: 317488 - protein, 17 aa, Mycobacterium
LLVGIFVIVDWRMHVAV

SEQ ID NO: 317489 - protein, 23 aa, Mycobacterium
LLVGIPMLAGWLLINRGRGEAAL

SEQ ID NO: 317490 - protein, 17 aa, Mycobacterium
LLVGLAIMGMGTGCTMM

SEQ ID NO: 317491 - protein, 32 aa, Mycobacterium
LLVGRKLVWGVAWHRFAAFFNIYFKRNADGSV

SEQ ID NO: 317492 - protein, 19 aa, Mycobacterium
LLVGRLIRRVGMRVTLAIG

SEQ ID NO: 317493 - protein, 18 aa, Mycobacterium
LLVHSWGGVFTLLRVPEL

SEQ ID NO: 317494 - protein, 17 aa, Mycobacterium
LLVIGSLVGTVAGIAAG

SEQ ID NO: 317495 - protein, 29 aa, Mycobacterium
LLVILCAMILRIVAIEWRGKIDDPGWRRW

SEQ ID NO: 317496 - protein, 33 aa, Mycobacterium
LLVILRFIQGFAVGGEWGGAVLLVAEHSPNPSR

SEQ ID NO: 317497 - protein, 19 aa, Mycobacterium
LLVITAIGLTVAFLFKDNG

SEQ ID NO: 317498 - protein, 19 aa, Mycobacterium
LLVIWHLVAKRGAFSPSQL

SEQ ID NO: 317499 - protein, 17 aa, Mycobacterium
LLVKTFERDADWQPSAE

SEQ ID NO: 317500 - protein, 17 aa, Mycobacterium
LLVLAIGAVLSFGTDLL

SEQ ID NO: 317501 - protein, 34 aa, Mycobacterium
LLVLCRLIQGIGIGGEWGGAVLMVVEQDGAEHTR

SEQ ID NO: 317502 - protein, 24 aa, Mycobacterium
LLVLLCRRRWRPGLLMTGLVVAAA

SEQ ID NO: 317503 - protein, 18 aa, Mycobacterium
LLVLRLGLGAALLHAAFL

SEQ ID NO: 317504 - protein, 19 aa, Mycobacterium
LLVMATVCVVLYRNFRRNN

SEQ ID NO: 317505 - protein, 20 aa, Mycobacterium
LLVMSGFGAMVVEARPGTTL

SEQ ID NO: 317506 - protein, 28 aa, Mycobacterium
LLVPAVLIELAFSFVVLFVPPVARLLGQ

SEQ ID NO: 317507 - protein, 24 aa, Mycobacterium
LLVPEALGPLILGYTFVLIGIVDM

SEQ ID NO: 317508 - protein, 26 aa, Mycobacterium
LLVPKAEAFAGYNLENKNVIFGPGVQ

SEQ ID NO: 317509 - protein, 23 aa, Mycobacterium
LLVPLVYLAFIVYLLLGKFTNVV

SEQ ID NO: 317510 - protein, 18 aa, Mycobacterium
LLVPVVDWLDLRRVPRGA

SEQ ID NO: 317511 - protein, 18 aa, Mycobacterium
LLVPWGILMLEPRGARLR

SEQ ID NO: 317512 - protein, 25 aa, Mycobacterium
LLVRAAGWRLNRLVRHRAVDRLDAR

SEQ ID NO: 317513 - protein, 18 aa, Mycobacterium
LLVRLRYGALDFDTVPLA

SEQ ID NO: 317514 - protein, 25 aa, Mycobacterium
LLVSLLVRRRRVWARLTPAAGTVNI

SEQ ID NO: 317515 - protein, 18 aa, Mycobacterium
LLVSTLLVASAWWLFEWE

SEQ ID NO: 317516 - protein, 24 aa, Mycobacterium
LLVVAGLFISRAVIRNNYYVAEFN

SEQ ID NO: 317517 - protein, 18 aa, Mycobacterium
LLVVAVALVTARPIVALL

SEQ ID NO: 317518 - protein, 19 aa, Mycobacterium
LLVVFAISVLLTFYPGWVT

SEQ ID NO: 317519 - protein, 17 aa, Mycobacterium
LLVVFGVSVLLTLYPGW

SEQ ID NO: 317520 - protein, 37 aa, Mycobacterium
LLVVGAAVVWWGWRERRDLFSGFGWLAVLLLAVASAC

SEQ ID NO: 317521 - protein, 19 aa, Mycobacterium
LLVVLGVSILLTFYPGWAS

SEQ ID NO: 317522 - protein, 33 aa, Mycobacterium
LLVVLRFVQGFAVGGEWGGAVLLVAEHSPAKER

SEQ ID NO: 317523 - protein, 18 aa, Mycobacterium
LLVVVATPIWLYRIKALT

SEQ ID NO: 317524 - protein, 20 aa, Mycobacterium
LLVVWAAIYLCWGRGMRPTW

SEQ ID NO: 317525 - protein, 19 aa, Mycobacterium
LLVWRRASDGWAFACTAIV

SEQ ID NO: 317526 - protein, 25 aa, Mycobacterium
LLVWRRASDGWAFTCVALVVAAVVI

SEQ ID NO: 317527 - protein, 22 aa, Mycobacterium
LLVYRSALTMMLPLVTIGSSLV

SEQ ID NO: 317528 - protein, 18 aa, Mycobacterium
LLWFVFAGFGALTLETEA

SEQ ID NO: 317529 - protein, 24 aa, Mycobacterium
LLWNRTWVLGALGSVFAMAQVFLL

SEQ ID NO: 317530 - protein, 17 aa, Mycobacterium
LLWPAYPILLFGKWFRL

SEQ ID NO: 317531 - protein, 23 aa, Mycobacterium
LLWPTVLELMLGWLTDAGKALQP

SEQ ID NO: 317532 - protein, 24 aa, Mycobacterium
LLWQDILGLGVQWIVIPLSMVILL

SEQ ID NO: 317533 - protein, 24 aa, Mycobacterium
LLWQDILGLGVQWVVLPLSIVILL

SEQ ID NO: 317534 - protein, 29 aa, Mycobacterium
LLWQHILHMPLHWLVLPMAVIVMLAVGSD

SEQ ID NO: 317535 - protein, 17 aa, Mycobacterium
LLWQHLIGIELHWLVLS

SEQ ID NO: 317536 - protein, 19 aa, Mycobacterium
LLWQHLIGIELHWLVLSMS

SEQ ID NO: 317537 - protein, 25 aa, Mycobacterium
LLWQYILGINLHWMVLAMAIILLLA

SEQ ID NO: 317538 - protein, 24 aa, Mycobacterium
LLWQYILGVNLHWMVLAMSVIILL

SEQ ID NO: 317539 - protein, 17 aa, Mycobacterium
LLWSFLQAIVMSVVVML

SEQ ID NO: 317540 - protein, 17 aa, Mycobacterium
LLYLRVSAPINHQLIAA

SEQ ID NO: 317541 - protein, 21 aa, Mycobacterium
LLYPRPTCDYVTPRKPVSDAS

SEQ ID NO: 317542 - protein, 22 aa, Mycobacterium
LLYSLIYYRVLGLLTALSLVAS

SEQ ID NO: 317543 - protein, 22 aa, Mycobacterium
LLYSLLYYRVLGLLTALSLIAS

SEQ ID NO: 317544 - protein, 24 aa, Mycobacterium
LLYSLLYYRVLGLLVALSLVAAGA

SEQ ID NO: 317545 - protein, 36 aa, Mycobacterium
LLYVVSGVSIFRLVRYLAREYLLIFATSSSEAVLPR

SEQ ID NO: 317546 - protein, 18 aa, Mycobacterium
LLYWQWRTMPAVVWDVRP

SEQ ID NO: 317547 - protein, 18 aa, Mycobacterium
LLYYAVANASAWTLTATP

SEQ ID NO: 317548 - protein, 38 aa, Mycobacterium
LMAAFYITCVIFIFGVLGALLWAVARVSIFKLARYLAR

SEQ ID NO: 317549 - protein, 24 aa, Mycobacterium
LMAEPVLMIGMIYIWMPLAMGSIA

SEQ ID NO: 317550 - protein, 28 aa, Mycobacterium
LMAGGALGMFLWELRSGTSVETARTMAV

SEQ ID NO: 317551 - protein, 20 aa, Mycobacterium
LMALALNKVWRRHRLAQHGL

SEQ ID NO: 317552 - protein, 20 aa, Mycobacterium
LMALCGLYALIGFPLDDIWH

SEQ ID NO: 317553 - protein, 18 aa, Mycobacterium
LMALGFRPLKAAVLALVA

SEQ ID NO: 317554 - protein, 18 aa, Mycobacterium
LMALGIINECHRLCVAYA

SEQ ID NO: 317555 - protein, 18 aa, Mycobacterium
LMALGIINECHRLCVDYA

SEQ ID NO: 317556 - protein, 19 aa, Mycobacterium
LMALSSLVLLLTNHRRSEV

SEQ ID NO: 317557 - protein, 19 aa, Mycobacterium
LMAMCGLYALIGFPLDDIW

SEQ ID NO: 317558 - protein, 31 aa, Mycobacterium
LMAMFSQWNWWLPRWLGRILPSVDFDRPLPE

SEQ ID NO: 317559 - protein, 37 aa, Mycobacterium
LMAMLPALQFRYWQWASLALAAPVIVWAGRPFHQAAW

SEQ ID NO: 317560 - protein, 18 aa, Mycobacterium
LMATNFFGINAIPIALNE

SEQ ID NO: 317561 - protein, 20 aa, Mycobacterium
LMCSLLFALPINARLFRRRV

SEQ ID NO: 317562 - protein, 44 aa, Mycobacterium
LMDAKRALSTRGWRRVGTAVTRWPVPIIVATSMIAIIGFVSLLT

SEQ ID NO: 317563 - protein, 26 aa, Mycobacterium
LMDLSRLQHEWGFRPAWESTECIDDF

SEQ ID NO: 317564 - protein, 25 aa, Mycobacterium
LMDRIGAYERYWLYPGAENLATFRA

SEQ ID NO: 317565 - protein, 20 aa, Mycobacterium
LMDWDDVIDRNALGFDQLKP

SEQ ID NO: 317566 - protein, 18 aa, Mycobacterium
LMELCFDSTAPAMLPALF

SEQ ID NO: 317567 - protein, 17 aa, Mycobacterium
LMELCFDSTGPAMLPAL

SEQ ID NO: 317568 - protein, 17 aa, Mycobacterium
LMELFNIDERTLNTQGL

SEQ ID NO: 317569 - protein, 45 aa, Mycobacterium
LMEPKRAMRTRGWRRIGTAIVRWPGPILVVSCIATLVGLLALPGY

SEQ ID NO: 317570 - protein, 17 aa, Mycobacterium
LMESIAIPLSFAVLVWV

SEQ ID NO: 317571 - protein, 17 aa, Mycobacterium
LMFDERPLFGFGPATFP

SEQ ID NO: 317572 - protein, 17 aa, Mycobacterium
LMFPRNGLGLTFALAIA

SEQ ID NO: 317573 - protein, 18 aa, Mycobacterium
LMGDLDRLSAGLVASQAE

SEQ ID NO: 317574 - protein, 26 aa, Mycobacterium
LMGGLLVEYFWWGAIFLINVPLALLV

SEQ ID NO: 317575 - protein, 20 aa, Mycobacterium
LMGIMRWYQPAFFRGELLTM

SEQ ID NO: 317576 - protein, 20 aa, Mycobacterium
LMIANPFRAGERIGSLFSTH

SEQ ID NO: 317577 - protein, 24 aa, Mycobacterium
LMIANPFRAGERIGSLFSTHPPIE

SEQ ID NO: 317578 - protein, 17 aa, Mycobacterium
LMIFWPFMQAAIQMAVV

SEQ ID NO: 317579 - protein, 20 aa, Mycobacterium
LMIRQHRFTISVARDELQSG

SEQ ID NO: 317580 - protein, 22 aa, Mycobacterium
LMISFSIWYFWANRLSLPALPV

SEQ ID NO: 317581 - protein, 25 aa, Mycobacterium
LMISRPRPGPSLLAYWIGGLTVCVP

SEQ ID NO: 317582 - protein, 22 aa, Mycobacterium
LMKRLDHSMIFVFIAGSYTPFA

SEQ ID NO: 317583 - protein, 23 aa, Mycobacterium
LMLAITYRSLWTVLFTLLTVGIE

SEQ ID NO: 317584 - protein, 44 aa, Mycobacterium
LMLFAPLRFYGWRIPGLRTLYAFLPRRVQVIPAITSDGRFGWQG

SEQ ID NO: 317585 - protein, 22 aa, Mycobacterium
LMLGKRWGRGLAVITQLLLLPV

SEQ ID NO: 317586 - protein, 17 aa, Mycobacterium
LMLGLAVVRLDGRMPVG

SEQ ID NO: 317587 - protein, 19 aa, Mycobacterium
LMLGVSLLLLMRATTLQER

SEQ ID NO: 317588 - protein, 26 aa, Mycobacterium
LMLLFVYRSAITMLIMLVMVFIELAA

SEQ ID NO: 317589 - protein, 24 aa, Mycobacterium
LMLLLLYRRVLIVLILLATVAIEL

SEQ ID NO: 317590 - protein, 17 aa, Mycobacterium
LMLLPLSAFEAMTPLPA

SEQ ID NO: 317591 - protein, 28 aa, Mycobacterium
LMLPNLATAFGIFFLRQFFLTVPVELED

SEQ ID NO: 317592 - protein, 18 aa, Mycobacterium
LMLRIGEDASWVFDVAPA

SEQ ID NO: 317593 - protein, 19 aa, Mycobacterium
LMLSYWPARNMLSTRQRMN

SEQ ID NO: 317594 - protein, 18 aa, Mycobacterium
LMLYALIIAFAFTTLSTY

SEQ ID NO: 317595 - protein, 17 aa, Mycobacterium
LMMVPFWDVEASVAEVE

SEQ ID NO: 317596 - protein, 21 aa, Mycobacterium
LMNIFLLFWLLAVLFNAMNRI

SEQ ID NO: 317597 - protein, 21 aa, Mycobacterium
LMNMPEAWKESTGVGVVVGVI

SEQ ID NO: 317598 - protein, 28 aa, Mycobacterium
LMNRRAVLKSSYAQFIFLLSGADHDQMD

SEQ ID NO: 317599 - protein, 17 aa, Mycobacterium
LMPAPVVQRYREGVQTV

SEQ ID NO: 317600 - protein, 19 aa, Mycobacterium
LMPEPVVQRYREGEETIAQ

SEQ ID NO: 317601 - protein, 17 aa, Mycobacterium
LMPLATRALSFWLNPGV

SEQ ID NO: 317602 - protein, 23 aa, Mycobacterium
LMPVAGAAIGWGLLNRNRRRGVN

SEQ ID NO: 317603 - protein, 23 aa, Mycobacterium
LMQKPRSTPGYVVVQGAVIFASA

SEQ ID NO: 317604 - protein, 22 aa, Mycobacterium
LMQPQHDWDFWATLPVAAVVAG

SEQ ID NO: 317605 - protein, 26 aa, Mycobacterium
LMRAAVETCRLLPMMVTVAIGLAVLG

SEQ ID NO: 317606 - protein, 22 aa, Mycobacterium
LMREHPHLAAFDRAVRAESNEH

SEQ ID NO: 317607 - protein, 18 aa, Mycobacterium
LMRISRHPAVLGPGGRGG

SEQ ID NO: 317608 - protein, 20 aa, Mycobacterium
LMRLTMMRLWLLDPAMPLWR

SEQ ID NO: 317609 - protein, 17 aa, Mycobacterium
LMRSMLCSLAVFHNPRD

SEQ ID NO: 317610 - protein, 19 aa, Mycobacterium
LMRTFSYDPARRFDSTQLG

SEQ ID NO: 317611 - protein, 17 aa, Mycobacterium
LMRTYAYDATWRFDSTQ

SEQ ID NO: 317612 - protein, 19 aa, Mycobacterium
LMRVVDVMFAFPVLLLALA

SEQ ID NO: 317613 - protein, 17 aa, Mycobacterium
LMSAIGIAGMDRLVQHN

SEQ ID NO: 317614 - protein, 24 aa, Mycobacterium
LMSAKSAALVGVFISVTTVPAAGF

SEQ ID NO: 317615 - protein, 23 aa, Mycobacterium
LMSALCALYLGGILNPMTNLRHF

SEQ ID NO: 317616 - protein, 23 aa, Mycobacterium
LMSALCALYLGGILNPSTNLHHF

SEQ ID NO: 317617 - protein, 17 aa, Mycobacterium
LMSILSIPMLLAPIGGP

SEQ ID NO: 317618 - protein, 25 aa, Mycobacterium
LMSRREALRRLALLGVGGAAATALI

SEQ ID NO: 317619 - protein, 17 aa, Mycobacterium
LMSSALLSGGRSVLVVG

SEQ ID NO: 317620 - protein, 29 aa, Mycobacterium
LMTEEQFLAWGWRVPFLLSAPLVLVGLLI

SEQ ID NO: 317621 - protein, 25 aa, Mycobacterium
LMTEGFPNLFLIAGPHSPSVLSNMA

SEQ ID NO: 317622 - protein, 19 aa, Mycobacterium
LMTGDMFLLMLGGSALVTA

SEQ ID NO: 317623 - protein, 23 aa, Mycobacterium
LMTHDELRFVVGHELGHALSGHA

SEQ ID NO: 317624 - protein, 17 aa, Mycobacterium
LMTNPLLRRFNDLQATT

SEQ ID NO: 317625 - protein, 31 aa, Mycobacterium
LMTPLGWRWAALVWAYALFWFLIEDRVKLAT

SEQ ID NO: 317626 - protein, 25 aa, Mycobacterium
LMTPLRVMFLIGLVFLALGWSTKAA

SEQ ID NO: 317627 - protein, 28 aa, Mycobacterium
LMTPSIAVLLGRWFWWPHHVRPRPIPQR

SEQ ID NO: 317628 - protein, 18 aa, Mycobacterium
LMTRVGYIVMLRVAPPID

SEQ ID NO: 317629 - protein, 18 aa, Mycobacterium
LMTYRFGGLRVLHRELLY

SEQ ID NO: 317630 - protein, 28 aa, Mycobacterium
LMVAASLIVVFGEFRFAAEDKYRATFTD

SEQ ID NO: 317631 - protein, 19 aa, Mycobacterium
LMVASVWAVLEAVRDGRTR

SEQ ID NO: 317632 - protein, 25 aa, Mycobacterium
LMVDRPRYINLIVLLRMTCEVSATV

SEQ ID NO: 317633 - protein, 17 aa, Mycobacterium
LMVFGLGMFFGNLVGGR

SEQ ID NO: 317634 - protein, 31 aa, Mycobacterium
LMVFLSVAYLCWNFGLRQGRRGASIGKSVMG

SEQ ID NO: 317635 - protein, 17 aa, Mycobacterium
LMVGALRARAFASTYEV

SEQ ID NO: 317636 - protein, 19 aa, Mycobacterium
LMVGFAMLGALTFVPMYLR

SEQ ID NO: 317637 - protein, 27 aa, Mycobacterium
LMVGQPLRFSARIGRPMRRDLTVAVLN

SEQ ID NO: 317638 - protein, 21 aa, Mycobacterium
LMVGTAFCYLYARGMLARRGR

SEQ ID NO: 317639 - protein, 21 aa, Mycobacterium
LMVIAGLTWGAGRLGNAVTEP

SEQ ID NO: 317640 - protein, 21 aa, Mycobacterium
LMVIGSLTFFDLIFVLTGGGP

SEQ ID NO: 317641 - protein, 23 aa, Mycobacterium
LMVLAVSVAMVFQGAMYGVLAAF

SEQ ID NO: 317642 - protein, 18 aa, Mycobacterium
LMVLPLVGLWLWGDAPLW

SEQ ID NO: 317643 - protein, 21 aa, Mycobacterium
LMVMLCLYVPPLLVGAHPLVV

SEQ ID NO: 317644 - protein, 17 aa, Mycobacterium
LMVNLTALTWIRFGVWL

SEQ ID NO: 317645 - protein, 20 aa, Mycobacterium
LMVQAPLYFHIHVMIALVLF

SEQ ID NO: 317646 - protein, 28 aa, Mycobacterium
LMVSRVSQLPNIIAIRGLTRPNGEPLEQ

SEQ ID NO: 317647 - protein, 18 aa, Mycobacterium
LMVYGGQISFCLYMVHEL

SEQ ID NO: 317648 - protein, 19 aa, Mycobacterium
LMWDLTVTMTASWQKIFSG

SEQ ID NO: 317649 - protein, 24 aa, Mycobacterium
LMWIGYRQDWGWLHAMDWSLLNAS

SEQ ID NO: 317650 - protein, 19 aa, Mycobacterium
LMWILRRVPAPALRAVVGQ

SEQ ID NO: 317651 - protein, 20 aa, Mycobacterium
LMWILSWLTATPIRVVRAAL

SEQ ID NO: 317652 - protein, 23 aa, Mycobacterium
LMWLCVPVTLGIAFAVMVTTVAL

SEQ ID NO: 317653 - protein, 19 aa, Mycobacterium
LMWLTGRHDVAFGVAVSGR

SEQ ID NO: 317654 - protein, 29 aa, Mycobacterium
LMWTEGLARLWPAWELYVWGHTVPAAFWV

SEQ ID NO: 317655 - protein, 24 aa, Mycobacterium
LMYGEIFTITAFVCVFGAVLGLLV

SEQ ID NO: 317656 - protein, 19 aa, Mycobacterium
LMYGGRTSIYIGLTAALVT

SEQ ID NO: 317657 - protein, 27 aa, Mycobacterium
LNAAAGPLVDSWMCAISGRAKQFGLIQ

SEQ ID NO: 317658 - protein, 17 aa, Mycobacterium
LNAAIGAAVLAQMRSSA

SEQ ID NO: 317659 - protein, 18 aa, Mycobacterium
LNAAMAWYLSEAVGIAFL

SEQ ID NO: 317660 - protein, 18 aa, Mycobacterium
LNAFRLALAIAVILWHSF

SEQ ID NO: 317661 - protein, 17 aa, Mycobacterium
LNAFSFWLFLFGGLVAM

SEQ ID NO: 317662 - protein, 17 aa, Mycobacterium
LNAGEVIERVIERDSPT

SEQ ID NO: 317663 - protein, 17 aa, Mycobacterium
LNAGEVIQRVVERDSPT

SEQ ID NO: 317664 - protein, 18 aa, Mycobacterium
LNAKFVFVGAGGDALPLL

SEQ ID NO: 317665 - protein, 20 aa, Mycobacterium
LNALPMLAAMAWVCADAILL

SEQ ID NO: 317666 - protein, 17 aa, Mycobacterium
LNALSFWLFIFGALIAL

SEQ ID NO: 317667 - protein, 25 aa, Mycobacterium
LNALSFWLFVCGALIALGGFVIPGG

SEQ ID NO: 317668 - protein, 18 aa, Mycobacterium
LNALSWLKQVFLVQLWFQ

SEQ ID NO: 317669 - protein, 48 aa, Mycobacterium
LNAMARTVGYGAPITVAAPAYWSEGQFAALRGALRSQPALAPDGVPAA

SEQ ID NO: 317670 - protein, 24 aa, Mycobacterium
LNAPIPVRYADWVSGAVRGDFGTT

SEQ ID NO: 317671 - protein, 18 aa, Mycobacterium
LNAPNSFGLFSNGGDLMT

SEQ ID NO: 317672 - protein, 17 aa, Mycobacterium
LNATWTWAPTALDRMAV

SEQ ID NO: 317673 - protein, 17 aa, Mycobacterium
LNAYIPLLALGLLSRFT

SEQ ID NO: 317674 - protein, 18 aa, Mycobacterium
LNCTSCHNFTGKGGALSS

SEQ ID NO: 317675 - protein, 23 aa, Mycobacterium
LNDGLALPFVMIFLATAQGAGSD

SEQ ID NO: 317676 - protein, 23 aa, Mycobacterium
LNDGRYAVFVKFHHSLQDGVSAQ

SEQ ID NO: 317677 - protein, 25 aa, Mycobacterium
LNDLCDRLWLIAAIEHYTAVLGDFV

SEQ ID NO: 317678 - protein, 23 aa, Mycobacterium
LNDPFLVRYGKYIVGFLHGDFGT

SEQ ID NO: 317679 - protein, 20 aa, Mycobacterium
LNDPPPCNVGFIPPPLIRSP

SEQ ID NO: 317680 - protein, 19 aa, Mycobacterium
LNDPPPCNVGFLPPPLIRS

SEQ ID NO: 317681 - protein, 18 aa, Mycobacterium
LNDSACELLGIGPDAVGR

SEQ ID NO: 317682 - protein, 26 aa, Mycobacterium
LNDTWWRIPVLLLLAFGNGWAEEIVV

SEQ ID NO: 317683 - protein, 17 aa, Mycobacterium
LNDTYGHLAGDQALAAV

SEQ ID NO: 317684 - protein, 25 aa, Mycobacterium
LNEAFPAGSVDFFFLTASAAGIFGI

SEQ ID NO: 317685 - protein, 17 aa, Mycobacterium
LNEAGALAAVWYARKSP

SEQ ID NO: 317686 - protein, 22 aa, Mycobacterium
LNEAYADVFGLLIEGKSGADRW

SEQ ID NO: 317687 - protein, 19 aa, Mycobacterium
LNEDFPHPFEFAIGVSAGL

SEQ ID NO: 317688 - protein, 17 aa, Mycobacterium
LNESAAFLLSLKRDAAH

SEQ ID NO: 317689 - protein, 18 aa, Mycobacterium
LNETIFRLLQKAASLPGG

SEQ ID NO: 317690 - protein, 23 aa, Mycobacterium
LNFELQRALKIVGSSGVRVMVAT

SEQ ID NO: 317691 - protein, 17 aa, Mycobacterium
LNFPVTITVAYRPSTGV

SEQ ID NO: 317692 - protein, 18 aa, Mycobacterium
LNFSFPTFLRHIRPILGL

SEQ ID NO: 317693 - protein, 23 aa, Mycobacterium
LNFSLSWFATWLEKRMRRSRKGP

SEQ ID NO: 317694 - protein, 17 aa, Mycobacterium
LNGEPPLGPMLLAADAR

SEQ ID NO: 317695 - protein, 22 aa, Mycobacterium
LNGFFFYGGHQYRYYYGSSGTV

SEQ ID NO: 317696 - protein, 24 aa, Mycobacterium
LNGLGGLFFRHLFSHPIQYRRAGL

SEQ ID NO: 317697 - protein, 22 aa, Mycobacterium
LNGYRMPVIDIHDGQSIHVGNP

SEQ ID NO: 317698 - protein, 25 aa, Mycobacterium
LNIACFSGTIASIVAVVLGVVALNQ

SEQ ID NO: 317699 - protein, 24 aa, Mycobacterium
LNIAFALGYPMDFATYVTLLSQTF

SEQ ID NO: 317700 - protein, 17 aa, Mycobacterium
LNIAWAQHCTGQSIELP

SEQ ID NO: 317701 - protein, 17 aa, Mycobacterium
LNILLSAAINFVLIAAV

SEQ ID NO: 317702 - protein, 24 aa, Mycobacterium
LNIPADLNALLGIYYAHGTYQELT

SEQ ID NO: 317703 - protein, 25 aa, Mycobacterium
LNIVMKKLTGWAAIIAVPTAITGFY

SEQ ID NO: 317704 - protein, 23 aa, Mycobacterium
LNKPIPVRYAHWVTHAVRGDFGV

SEQ ID NO: 317705 - protein, 42 aa, Mycobacterium
LNKSPRPSGGIPLLVVLSVLAVAVAIFWIVMRYRASRRRTNA

SEQ ID NO: 317706 - protein, 18 aa, Mycobacterium
LNLALAVPVTLILIASSF

SEQ ID NO: 317707 - protein, 24 aa, Mycobacterium
LNLEVLDVTGPFPKDAVQSALDDL

SEQ ID NO: 317708 - protein, 25 aa, Mycobacterium
LNLGDPPPCLTGFVPPPLMRTPADE

SEQ ID NO: 317709 - protein, 24 aa, Mycobacterium
LNLNPKLGWWLMEIPATVVFLVCY

SEQ ID NO: 317710 - protein, 27 aa, Mycobacterium
LNLPGWGSLRLALPMKGNGDAAFLAGE

SEQ ID NO: 317711 - protein, 17 aa, Mycobacterium
LNLPITFIILVAVGSDY

SEQ ID NO: 317712 - protein, 22 aa, Mycobacterium
LNLPLAPLWARLLRTPRPYLYA

SEQ ID NO: 317713 - protein, 22 aa, Mycobacterium
LNLPPPCSTGFLPAQQQRVPIF

SEQ ID NO: 317714 - protein, 22 aa, Mycobacterium
LNLPPPCTTGFLPAQQQRVPTF

SEQ ID NO: 317715 - protein, 19 aa, Mycobacterium
LNLSWPRPAVFDPTGEHPY

SEQ ID NO: 317716 - protein, 17 aa, Mycobacterium
LNLTSARLIAGKPVNPT

SEQ ID NO: 317717 - protein, 19 aa, Mycobacterium
LNLVIFVLSAHVVFFAGVA

SEQ ID NO: 317718 - protein, 17 aa, Mycobacterium
LNMAALWNLPVLFLCEN

SEQ ID NO: 317719 - protein, 17 aa, Mycobacterium
LNMARPVADGDQIVVGL

SEQ ID NO: 317720 - protein, 17 aa, Mycobacterium
LNMARRVADGEQIVVGI

SEQ ID NO: 317721 - protein, 26 aa, Mycobacterium
LNMIGRAIGSYGDFVNFYACDITLKI

SEQ ID NO: 317722 - protein, 25 aa, Mycobacterium
LNMIGRAIGSYGDFVNFYSCDISLK

SEQ ID NO: 317723 - protein, 25 aa, Mycobacterium
LNMIGRAIGSYGDFVNYYACDITLK

SEQ ID NO: 317724 - protein, 17 aa, Mycobacterium
LNMNGHRPFAGQLLLPN

SEQ ID NO: 317725 - protein, 18 aa, Mycobacterium
LNMPPPRISKRHPKLAHL

SEQ ID NO: 317726 - protein, 24 aa, Mycobacterium
LNMVRLWWDKPWPMRIIALARLPL

SEQ ID NO: 317727 - protein, 18 aa, Mycobacterium
LNPAAGQMVSALWVASTG

SEQ ID NO: 317728 - protein, 17 aa, Mycobacterium
LNPALAVVAAVVCVAIS

SEQ ID NO: 317729 - protein, 36 aa, Mycobacterium
LNPGGWPFPPVPWVNSLASFFGQLGLSPALSTALGW

SEQ ID NO: 317730 - protein, 24 aa, Mycobacterium
LNPRRLAARVPFVVLIISALGLGL

SEQ ID NO: 317731 - protein, 24 aa, Mycobacterium
LNPRTLWRNPVMFIVEVGAVWSTI

SEQ ID NO: 317732 - protein, 17 aa, Mycobacterium
LNPVGAVQWLRKNARVE

SEQ ID NO: 317733 - protein, 17 aa, Mycobacterium
LNQRVLDAATVFPGDVA

SEQ ID NO: 317734 - protein, 29 aa, Mycobacterium
LNRGGRLAAAVLRRTHILAAIVLGLILPK

SEQ ID NO: 317735 - protein, 21 aa, Mycobacterium
LNRLAELHVRLPMIQDGARRI

SEQ ID NO: 317736 - protein, 20 aa, Mycobacterium
LNRNLGWLFLFKKGNVSLAG

SEQ ID NO: 317737 - protein, 26 aa, Mycobacterium
LNRRAVLKSSYAQFIYLLSGADHDQM

SEQ ID NO: 317738 - protein, 20 aa, Mycobacterium
LNRRIRFFVVATIAYNVIEA

SEQ ID NO: 317739 - protein, 29 aa, Mycobacterium
LNRTPDWWPALRWVVLIGSVVVAVLLALR

SEQ ID NO: 317740 - protein, 22 aa, Mycobacterium
LNRVRMLLLTNCTFDGVVYNPL

SEQ ID NO: 317741 - protein, 22 aa, Mycobacterium
LNSCSATLCELARYRLGRRTLR

SEQ ID NO: 317742 - protein, 21 aa, Mycobacterium
LNSDKFVPIFTRLNRLSDKFF

SEQ ID NO: 317743 - protein, 17 aa, Mycobacterium
LNSGLWSGRGKHLLSGG

SEQ ID NO: 317744 - protein, 24 aa, Mycobacterium
LNSLPMLAALAWVAGEAVLLVRTG

SEQ ID NO: 317745 - protein, 30 aa, Mycobacterium
LNSLPMLAALAWVCADAILLVRTGNPRYAV

SEQ ID NO: 317746 - protein, 30 aa, Mycobacterium
LNSLPMLAALAWVCADAVLLIRTGNPRYAV

SEQ ID NO: 317747 - protein, 29 aa, Mycobacterium
LNSLPMLAALAWVCADAVLLVRTGNRRYA

SEQ ID NO: 317748 - protein, 17 aa, Mycobacterium
LNSLPMTVGRVIGPAAG

SEQ ID NO: 317749 - protein, 20 aa, Mycobacterium
LNSPGWRRAMAARTRIDELI

SEQ ID NO: 317750 - protein, 19 aa, Mycobacterium
LNSRLVRYFVKRYTLKRGA

SEQ ID NO: 317751 - protein, 19 aa, Mycobacterium
LNTRMFKYFVKRFALKRGV

SEQ ID NO: 317752 - protein, 24 aa, Mycobacterium
LNTRNVFGPPAWAPVINNVVAIAT

SEQ ID NO: 317753 - protein, 24 aa, Mycobacterium
LNTRNVFGPPAWAPVLNNVVAIAT

SEQ ID NO: 317754 - protein, 24 aa, Mycobacterium
LNTRNVFGPPAWAPVWNNLVAIAT

SEQ ID NO: 317755 - protein, 26 aa, Mycobacterium
LNTWYRAGLFGGLALLPILACLALLP

SEQ ID NO: 317756 - protein, 24 aa, Mycobacterium
LNVAQPLAYCLPGVRSRVVVSEGT

SEQ ID NO: 317757 - protein, 18 aa, Mycobacterium
LNVDESKSVIVLKRSMSS

SEQ ID NO: 317758 - protein, 24 aa, Mycobacterium
LNVDESRSVIVLKRSMSSGYAGIE

SEQ ID NO: 317759 - protein, 21 aa, Mycobacterium
LNVLCGVLLLAGTVMLLLRKM

SEQ ID NO: 317760 - protein, 17 aa, Mycobacterium
LNVLFSYQGNDMYTALQ

SEQ ID NO: 317761 - protein, 18 aa, Mycobacterium
LNVLGCASVAVALQDMSW

SEQ ID NO: 317762 - protein, 22 aa, Mycobacterium
LNVLLWLSYFVMLGLYAVAFGS

SEQ ID NO: 317763 - protein, 25 aa, Mycobacterium
LNVLLWLSYFVMLGLYAVAFGSYGA

SEQ ID NO: 317764 - protein, 21 aa, Mycobacterium
LNVRGAHNMPCETRPGKRAPT

SEQ ID NO: 317765 - protein, 25 aa, Mycobacterium
LNVTLRPSPAVLMLGLPTGLRLVID

SEQ ID NO: 317766 - protein, 23 aa, Mycobacterium
LNVYPRYLPLIPENVDAQIKATT

SEQ ID NO: 317767 - protein, 19 aa, Mycobacterium
LNYPRMRAVLVAIDNTPDG

SEQ ID NO: 317768 - protein, 24 aa, Mycobacterium
LPAAARHLAKWTALVVSLVVLAVT

SEQ ID NO: 317769 - protein, 24 aa, Mycobacterium
LPAAAVLTMCFIVAGIIAPSLARR

SEQ ID NO: 317770 - protein, 23 aa, Mycobacterium
LPAADYRSAQVIKLVSNHAPGDH

SEQ ID NO: 317771 - protein, 23 aa, Mycobacterium
LPADGVVVLCDFGGSGTSVTLAD

SEQ ID NO: 317772 - protein, 21 aa, Mycobacterium
LPADLRLYDYDAFDEAADAED

SEQ ID NO: 317773 - protein, 28 aa, Mycobacterium
LPAEAINSVPVRVGVTIIGAMIVFGLIL

SEQ ID NO: 317774 - protein, 25 aa, Mycobacterium
LPAEAKALVISPNLVSARFIQLTPA

SEQ ID NO: 317775 - protein, 17 aa, Mycobacterium
LPAEAPSSVTAAKMAEA

SEQ ID NO: 317776 - protein, 20 aa, Mycobacterium
LPAEETWTALEFTGSPAEPL

SEQ ID NO: 317777 - protein, 33 aa, Mycobacterium
LPAELPAGPGAVWSQWHSLVFDVSVWEIWGALL

SEQ ID NO: 317778 - protein, 18 aa, Mycobacterium
LPAGHALDLGCGEGGDAV

SEQ ID NO: 317779 - protein, 20 aa, Mycobacterium
LPAGLRLVIDNAIKNAVKHG

SEQ ID NO: 317780 - protein, 19 aa, Mycobacterium
LPAGRWLLAVLAVWSLYRL

SEQ ID NO: 317781 - protein, 19 aa, Mycobacterium
LPAGSPVRLCMAAINRDGT

SEQ ID NO: 317782 - protein, 22 aa, Mycobacterium
LPAGTMRLFFWSGAAPVLDPLP

SEQ ID NO: 317783 - protein, 26 aa, Mycobacterium
LPAGVWRLILIIAFFGGVEILAQSGA

SEQ ID NO: 317784 - protein, 20 aa, Mycobacterium
LPAGYADTYIDGVRWRVRTV

SEQ ID NO: 317785 - protein, 22 aa, Mycobacterium
LPAHLAGACSGVYNSVRLLGAV

SEQ ID NO: 317786 - protein, 21 aa, Mycobacterium
LPAILVVAGPRGWVKPPHEVT

SEQ ID NO: 317787 - protein, 19 aa, Mycobacterium
LPAIMTVTLAIGVQRMSRR

SEQ ID NO: 317788 - protein, 20 aa, Mycobacterium
LPALFSALLTVAGGAPMDEG

SEQ ID NO: 317789 - protein, 18 aa, Mycobacterium
LPALLAIAAVAAVLANVV

SEQ ID NO: 317790 - protein, 19 aa, Mycobacterium
LPALRQTRGQVIFINSGAG

SEQ ID NO: 317791 - protein, 18 aa, Mycobacterium
LPALTALLRPLSAIQVVD

SEQ ID NO: 317792 - protein, 18 aa, Mycobacterium
LPAPLSVHVYRLVWRQVI

SEQ ID NO: 317793 - protein, 18 aa, Mycobacterium
LPAPPTRTVVVQDPGAPA

SEQ ID NO: 317794 - protein, 21 aa, Mycobacterium
LPAPRPFRTAFAAAYAVAYLV

SEQ ID NO: 317795 - protein, 25 aa, Mycobacterium
LPAPVFKAVMILFVIAYFATVVAIS

SEQ ID NO: 317796 - protein, 27 aa, Mycobacterium
LPARGAFGLMFDRVFGALFWGKMFAVV

SEQ ID NO: 317797 - protein, 18 aa, Mycobacterium
LPARGAVGQTAFPLSGNE

SEQ ID NO: 317798 - protein, 19 aa, Mycobacterium
LPARKIQPAAQWRTLPDAP

SEQ ID NO: 317799 - protein, 24 aa, Mycobacterium
LPARQLRWPLGEIDKPFQMRRDPL

SEQ ID NO: 317800 - protein, 21 aa, Mycobacterium
LPARRRGELFLTQGAAGSTLA

SEQ ID NO: 317801 - protein, 20 aa, Mycobacterium
LPARWRRDRSPNRETEPRRD

SEQ ID NO: 317802 - protein, 18 aa, Mycobacterium
LPASFGVDQVRQLAARDT

SEQ ID NO: 317803 - protein, 22 aa, Mycobacterium
LPATGARLKWVRAQGSSAAPAQ

SEQ ID NO: 317804 - protein, 30 aa, Mycobacterium
LPATGRGRALRWVWQALAALLIATVFAAAV

SEQ ID NO: 317805 - protein, 25 aa, Mycobacterium
LPATLCIPLLLAAFWLGNGAAIYRP

SEQ ID NO: 317806 - protein, 19 aa, Mycobacterium
LPATVFVAFQLMFAIITVA

SEQ ID NO: 317807 - protein, 22 aa, Mycobacterium
LPAVEGLRAWAAIGVVITHVAF

SEQ ID NO: 317808 - protein, 21 aa, Mycobacterium
LPAVIRGLIAVAWYGIQTYLA

SEQ ID NO: 317809 - protein, 19 aa, Mycobacterium
LPAVLALTLIFGFAIAAVS

SEQ ID NO: 317810 - protein, 26 aa, Mycobacterium
LPAVLRPGVLVQRVWTRSAPALAALA

SEQ ID NO: 317811 - protein, 17 aa, Mycobacterium
LPAVMMISSAFNTPADW

SEQ ID NO: 317812 - protein, 20 aa, Mycobacterium
LPAVRVRRWLLAPAAAPIHL

SEQ ID NO: 317813 - protein, 17 aa, Mycobacterium
LPAVTVIALGIGSLAVW

SEQ ID NO: 317814 - protein, 18 aa, Mycobacterium
LPAVVVIGVLTALMMPRY

SEQ ID NO: 317815 - protein, 17 aa, Mycobacterium
LPAWPGLLADNALDDDG

SEQ ID NO: 317816 - protein, 17 aa, Mycobacterium
LPCAGAVLIGLGLSVAL

SEQ ID NO: 317817 - protein, 20 aa, Mycobacterium
LPCLPWFIHSNWNFVFAVLP

SEQ ID NO: 317818 - protein, 29 aa, Mycobacterium
LPDAQFLAWGWRLPFLFSAALIVIGLVIR

SEQ ID NO: 317819 - protein, 17 aa, Mycobacterium
LPDDVFVSINISPAAAL

SEQ ID NO: 317820 - protein, 26 aa, Mycobacterium
LPDESVCWRARVVQMDGRRIDLLELT

SEQ ID NO: 317821 - protein, 19 aa, Mycobacterium
LPDGFAVQVDRRVRVLDEG

SEQ ID NO: 317822 - protein, 18 aa, Mycobacterium
LPDGKWSAIAMSVVTVAF

SEQ ID NO: 317823 - protein, 22 aa, Mycobacterium
LPDGLQPISPVLAAILRNTNSY

SEQ ID NO: 317824 - protein, 22 aa, Mycobacterium
LPDGLQPISPVLAALLRNTNSY

SEQ ID NO: 317825 - protein, 18 aa, Mycobacterium
LPDGRHVWEYAPRNGETD

SEQ ID NO: 317826 - protein, 18 aa, Mycobacterium
LPDGTLLRRRLDWGEDNT

SEQ ID NO: 317827 - protein, 25 aa, Mycobacterium
LPDLERMAAIMPELIALMPSQIESM

SEQ ID NO: 317828 - protein, 25 aa, Mycobacterium
LPDLRARGPLWLIILGFSAGVALLA

SEQ ID NO: 317829 - protein, 18 aa, Mycobacterium
LPDLVAVPPTLADHLPRL

SEQ ID NO: 317830 - protein, 17 aa, Mycobacterium
LPDLVAVPPTLIDHLPR

SEQ ID NO: 317831 - protein, 22 aa, Mycobacterium
LPDNSWQGSASYAYASQNTALQ

SEQ ID NO: 317832 - protein, 20 aa, Mycobacterium
LPDPDLRRDEFVAGSVPDDS

SEQ ID NO: 317833 - protein, 23 aa, Mycobacterium
LPDSLRVTAALSRLMDEHEQFAL

SEQ ID NO: 317834 - protein, 19 aa, Mycobacterium
LPDTARWYLLKGRADDARR

SEQ ID NO: 317835 - protein, 23 aa, Mycobacterium
LPDTWPRRVVRWVRITVLIVTAL

SEQ ID NO: 317836 - protein, 21 aa, Mycobacterium
LPEGRPMLDHPLSPLTNPTQP

SEQ ID NO: 317837 - protein, 27 aa, Mycobacterium
LPEIWSNAPPIPGWPASVPSAIAVPPQ

SEQ ID NO: 317838 - protein, 21 aa, Mycobacterium
LPELMTLEKVAAWAITEPDSG

SEQ ID NO: 317839 - protein, 21 aa, Mycobacterium
LPELQRRAADGVLRRGDGTGG

SEQ ID NO: 317840 - protein, 26 aa, Mycobacterium
LPEQLLHLLASLLFLLFGLWMLFEGA

SEQ ID NO: 317841 - protein, 20 aa, Mycobacterium
LPEQLLHVLAGLLFLLFGLW

SEQ ID NO: 317842 - protein, 21 aa, Mycobacterium
LPERDYPGALALTNRIRVPQL

SEQ ID NO: 317843 - protein, 18 aa, Mycobacterium
LPERVIQIAAAALFLLFG

SEQ ID NO: 317844 - protein, 24 aa, Mycobacterium
LPEVEWPTLVFFMGLFVMVAGLTH

SEQ ID NO: 317845 - protein, 33 aa, Mycobacterium
LPEVTAVAYPAHWRPTAVDALRAALSRVPEWSG

SEQ ID NO: 317846 - protein, 17 aa, Mycobacterium
LPEWGRQLCDAIAAMNA

SEQ ID NO: 317847 - protein, 18 aa, Mycobacterium
LPFAEESPVRVCMQQTGM

SEQ ID NO: 317848 - protein, 19 aa, Mycobacterium
LPFKEKWRLPDATALLVGF

SEQ ID NO: 317849 - protein, 23 aa, Mycobacterium
LPFLLIMGGFMYFASRRQKRAMQ

SEQ ID NO: 317850 - protein, 34 aa, Mycobacterium
LPFLLLFRLTCYYYRGAYYRTVWQAPTACAVAEP

SEQ ID NO: 317851 - protein, 19 aa, Mycobacterium
LPFLWNVFTSYRYGEVVTV

SEQ ID NO: 317852 - protein, 22 aa, Mycobacterium
LPFMILIGLIVSRQWKLLGAYA

SEQ ID NO: 317853 - protein, 20 aa, Mycobacterium
LPFMLMWPFWLAAKWCGVSW

SEQ ID NO: 317854 - protein, 17 aa, Mycobacterium
LPFTAGVVLAISAVLSL

SEQ ID NO: 317855 - protein, 27 aa, Mycobacterium
LPFTGLDFPWGLAVDNMGTVYVGSRSS

SEQ ID NO: 317856 - protein, 18 aa, Mycobacterium
LPFTGLKAPAGVAVDSSG

SEQ ID NO: 317857 - protein, 17 aa, Mycobacterium
LPFVWNVFKSWRFGEPV

SEQ ID NO: 317858 - protein, 20 aa, Mycobacterium
LPFYHDMGFFVGIIIPILAG

SEQ ID NO: 317859 - protein, 32 aa, Mycobacterium
LPGAMPNFLVGLRLGLSSAWLSLIFAEMINTT

SEQ ID NO: 317860 - protein, 19 aa, Mycobacterium
LPGAPEFHLATGAGAGLPD

SEQ ID NO: 317861 - protein, 18 aa, Mycobacterium
LPGASGLIALIAANLFVV

SEQ ID NO: 317862 - protein, 22 aa, Mycobacterium
LPGAVLAAVLWQALQWFGATYV

SEQ ID NO: 317863 - protein, 20 aa, Mycobacterium
LPGEVLQDILSRTLRLSRID

SEQ ID NO: 317864 - protein, 18 aa, Mycobacterium
LPGFRGDIRLTRTELNEA

SEQ ID NO: 317865 - protein, 19 aa, Mycobacterium
LPGGIAIPHCRSPYVDTAT

SEQ ID NO: 317866 - protein, 19 aa, Mycobacterium
LPGGIAIPHCRSPYVDTPT

SEQ ID NO: 317867 - protein, 19 aa, Mycobacterium
LPGGLGLGGGSGFGSMPNV

SEQ ID NO: 317868 - protein, 24 aa, Mycobacterium
LPGIGAPVRRVWAATSAAAALIAV

SEQ ID NO: 317869 - protein, 17 aa, Mycobacterium
LPGKAVTGFGVLLWLWL

SEQ ID NO: 317870 - protein, 20 aa, Mycobacterium
LPGKQFEVGRRLRILIIAAL

SEQ ID NO: 317871 - protein, 19 aa, Mycobacterium
LPGLAGLVLGILGMRETRR

SEQ ID NO: 317872 - protein, 17 aa, Mycobacterium
LPGLMSVPLTIAGQIER

SEQ ID NO: 317873 - protein, 26 aa, Mycobacterium
LPGLPNRWMLVGPEGNQGQGWHAMVE

SEQ ID NO: 317874 - protein, 18 aa, Mycobacterium
LPGLPSFPGLPIPGFPNL

SEQ ID NO: 317875 - protein, 17 aa, Mycobacterium
LPGMTVLALGLVLTVTP

SEQ ID NO: 317876 - protein, 17 aa, Mycobacterium
LPGMVAVGLITPNEATW

SEQ ID NO: 317877 - protein, 20 aa, Mycobacterium
LPGPARLAATQGFIAVIMLV

SEQ ID NO: 317878 - protein, 25 aa, Mycobacterium
LPGPAWLRRWWLAVVAAAAATVWLE

SEQ ID NO: 317879 - protein, 19 aa, Mycobacterium
LPGQFGVSWQGHLSGAVAG

SEQ ID NO: 317880 - protein, 20 aa, Mycobacterium
LPGQLDAPVLERGRGLSGGQ

SEQ ID NO: 317881 - protein, 19 aa, Mycobacterium
LPGRGRGTTALRVGAATVW

SEQ ID NO: 317882 - protein, 19 aa, Mycobacterium
LPGRGWAIFIGVISLLAGI

SEQ ID NO: 317883 - protein, 23 aa, Mycobacterium
LPGRGWEIFIGVISLIAGVIMLA

SEQ ID NO: 317884 - protein, 22 aa, Mycobacterium
LPGRGWNIFLGVLSLLAGIVVV

SEQ ID NO: 317885 - protein, 23 aa, Mycobacterium
LPGRGWQIFVGVISLIAGVVVMA

SEQ ID NO: 317886 - protein, 19 aa, Mycobacterium
LPGRGWSIFIGVISLIAGV

SEQ ID NO: 317887 - protein, 19 aa, Mycobacterium
LPGTFGVSWQGHLCGALAG

SEQ ID NO: 317888 - protein, 21 aa, Mycobacterium
LPGYYACLIVTAFAFAPLSVA

SEQ ID NO: 317889 - protein, 24 aa, Mycobacterium
LPHAGRPRMIAVDAVPAAVGATFT

SEQ ID NO: 317890 - protein, 26 aa, Mycobacterium
LPHDRIPVLYCKTGVRSAAALATVRQ

SEQ ID NO: 317891 - protein, 20 aa, Mycobacterium
LPHKIDYAALVPQAPQNDQP

SEQ ID NO: 317892 - protein, 23 aa, Mycobacterium
LPHPDHPSVLLVVGVNGTGKTTT

SEQ ID NO: 317893 - protein, 17 aa, Mycobacterium
LPHVRLLSGSTIDDARE

SEQ ID NO: 317894 - protein, 20 aa, Mycobacterium
LPIAHLLGGGGFSLQLDPRQ

SEQ ID NO: 317895 - protein, 19 aa, Mycobacterium
LPIALPVGIGQYLADQTRL

SEQ ID NO: 317896 - protein, 17 aa, Mycobacterium
LPIAVSLLSLVLLTIAL

SEQ ID NO: 317897 - protein, 20 aa, Mycobacterium
LPIDTILPFMTMFAVSNTAL

SEQ ID NO: 317898 - protein, 23 aa, Mycobacterium
LPIGTMRRFSWAGRAPVLDPLPR

SEQ ID NO: 317899 - protein, 18 aa, Mycobacterium
LPILGLWHLFAGSPDSPE

SEQ ID NO: 317900 - protein, 17 aa, Mycobacterium
LPILLQEIFAAYRGQRL

SEQ ID NO: 317901 - protein, 32 aa, Mycobacterium
LPILVAVIPWLFLRVRFFRRKLTVTALAATPA

SEQ ID NO: 317902 - protein, 19 aa, Mycobacterium
LPIPPSAMKTGLKQIQGRS

SEQ ID NO: 317903 - protein, 17 aa, Mycobacterium
LPIPTFVLPAAPSSAPE

SEQ ID NO: 317904 - protein, 18 aa, Mycobacterium
LPIPTLAGLAILPTADEL

SEQ ID NO: 317905 - protein, 31 aa, Mycobacterium
LPISALLIAVATGFLKWQAASNLLSRAAEIE

SEQ ID NO: 317906 - protein, 30 aa, Mycobacterium
LPISPRRLGWEVAWKPVLVLVVLMYAIVCI

SEQ ID NO: 317907 - protein, 17 aa, Mycobacterium
LPITVVAVRAWWATGRS

SEQ ID NO: 317908 - protein, 17 aa, Mycobacterium
LPITYPYQGGFRDGGAM

SEQ ID NO: 317909 - protein, 26 aa, Mycobacterium
LPIVALMVVAVWLLGVGTLMDLALVQ

SEQ ID NO: 317910 - protein, 20 aa, Mycobacterium
LPIVCVLAIGYAYYGGYLPQ

SEQ ID NO: 317911 - protein, 26 aa, Mycobacterium
LPIVLGLRAAWLAWRDRRTQPAPTDD

SEQ ID NO: 317912 - protein, 24 aa, Mycobacterium
LPIVNASGGPNCRGLPDIPTKQNG

SEQ ID NO: 317913 - protein, 24 aa, Mycobacterium
LPIVNASGGPNCRGLPDLPTKQNG

SEQ ID NO: 317914 - protein, 24 aa, Mycobacterium
LPIVNASGGPNCRGLPDVPSKQYG

SEQ ID NO: 317915 - protein, 25 aa, Mycobacterium
LPIVNASGGPNCRGLPDVPSKQYGG

SEQ ID NO: 317916 - protein, 25 aa, Mycobacterium
LPIWEGADSWPLRAAVAGALVLTLP

SEQ ID NO: 317917 - protein, 21 aa, Mycobacterium
LPKADIGDLVIIPDDISALAP

SEQ ID NO: 317918 - protein, 25 aa, Mycobacterium
LPKDRALEVFEILPPSLQGDLVGAL

SEQ ID NO: 317919 - protein, 25 aa, Mycobacterium
LPKEFRCVSVDLLARQAVVHRRGPV

SEQ ID NO: 317920 - protein, 17 aa, Mycobacterium
LPKHGFFVRLYTGTGAF

SEQ ID NO: 317921 - protein, 21 aa, Mycobacterium
LPKPTAIGAIRLRPSRTEVPA

SEQ ID NO: 317922 - protein, 27 aa, Mycobacterium
LPLAADRGVGWKALRDAGPVVFMNGAY

SEQ ID NO: 317923 - protein, 19 aa, Mycobacterium
LPLACLLTATAGWLAVTAF

SEQ ID NO: 317924 - protein, 20 aa, Mycobacterium
LPLAHLAGGGGFSLVLDARQ

SEQ ID NO: 317925 - protein, 32 aa, Mycobacterium
LPLAKRGGLLLRILRQFHHPLIYVLLVAGAIT

SEQ ID NO: 317926 - protein, 21 aa, Mycobacterium
LPLALAMAGIAWLASGSAVRA

SEQ ID NO: 317927 - protein, 20 aa, Mycobacterium
LPLALAMLALLVYLYTVVLF

SEQ ID NO: 317928 - protein, 24 aa, Mycobacterium
LPLAMPSYLLAYLWVSAFPTAAGF

SEQ ID NO: 317929 - protein, 25 aa, Mycobacterium
LPLAMPSYLLAYLWVSAYPQVAGFW

SEQ ID NO: 317930 - protein, 24 aa, Mycobacterium
LPLARRYLTVMILMWGAGSLPLIF

SEQ ID NO: 317931 - protein, 17 aa, Mycobacterium
LPLASAIGAVFMTAAIT

SEQ ID NO: 317932 - protein, 29 aa, Mycobacterium
LPLATWATACGWAFSLAMIDGFERGFAGR

SEQ ID NO: 317933 - protein, 19 aa, Mycobacterium
LPLCTPVGPIADRLLGWVI

SEQ ID NO: 317934 - protein, 22 aa, Mycobacterium
LPLEELRHSLGREPLVDGVPAG

SEQ ID NO: 317935 - protein, 17 aa, Mycobacterium
LPLELVLTVVPFLIIAV

SEQ ID NO: 317936 - protein, 17 aa, Mycobacterium
LPLEYQGAALPKKMNKL

SEQ ID NO: 317937 - protein, 18 aa, Mycobacterium
LPLFLGIKTWLYPASIAL

SEQ ID NO: 317938 - protein, 21 aa, Mycobacterium
LPLGNLRAGVSYPAMEGEIDD

SEQ ID NO: 317939 - protein, 20 aa, Mycobacterium
LPLGNLRDALSYPAESGSFS

SEQ ID NO: 317940 - protein, 19 aa, Mycobacterium
LPLGVPWLPLIAAPALLAG

SEQ ID NO: 317941 - protein, 20 aa, Mycobacterium
LPLHAFFGVILMGTKSILGE

SEQ ID NO: 317942 - protein, 21 aa, Mycobacterium
LPLIGLIFVLVMVWEVDHWLP

SEQ ID NO: 317943 - protein, 20 aa, Mycobacterium
LPLIPVFMILIGLLTRDRAA

SEQ ID NO: 317944 - protein, 19 aa, Mycobacterium
LPLIPVFMVLIGLATADRS

SEQ ID NO: 317945 - protein, 18 aa, Mycobacterium
LPLLAITVKVDWPNFWSL

SEQ ID NO: 317946 - protein, 30 aa, Mycobacterium
LPLLAVAVKVDWPHFWSLITSPSSLTALAL

SEQ ID NO: 317947 - protein, 25 aa, Mycobacterium
LPLLMGVAIIGMIGIFLSMGIRRMS

SEQ ID NO: 317948 - protein, 21 aa, Mycobacterium
LPLLNRQWRALVAAFVVPLVF

SEQ ID NO: 317949 - protein, 20 aa, Mycobacterium
LPLLPLLVPWGILMLEPRGA

SEQ ID NO: 317950 - protein, 21 aa, Mycobacterium
LPLLVIGVSLAVGRGVLSALG

SEQ ID NO: 317951 - protein, 19 aa, Mycobacterium
LPLLWWRYRHTDREALTGI

SEQ ID NO: 317952 - protein, 17 aa, Mycobacterium
LPLNFLFFAVLAVCTVS

SEQ ID NO: 317953 - protein, 17 aa, Mycobacterium
LPLNGLVTMAAKDLAGR

SEQ ID NO: 317954 - protein, 21 aa, Mycobacterium
LPLPQTIPFLPAYIPQDVDMT

SEQ ID NO: 317955 - protein, 18 aa, Mycobacterium
LPLREIIPAVQRIVAPSD

SEQ ID NO: 317956 - protein, 23 aa, Mycobacterium
LPLRLGPVPFPISALLSGILNAA

SEQ ID NO: 317957 - protein, 17 aa, Mycobacterium
LPLRPEGLRRLSKVDAI

SEQ ID NO: 317958 - protein, 23 aa, Mycobacterium
LPLRSRDRLPLMNSLLGANEDVD

SEQ ID NO: 317959 - protein, 22 aa, Mycobacterium
LPLRSRDRLPLMNTLLGPNEDA

SEQ ID NO: 317960 - protein, 30 aa, Mycobacterium
LPLSYCFYSACALLSALFVLRFVRETKGRE

SEQ ID NO: 317961 - protein, 17 aa, Mycobacterium
LPLTIAGHIERWPFDNY

SEQ ID NO: 317962 - protein, 20 aa, Mycobacterium
LPLTPLQHGLLFQANTSRGN

SEQ ID NO: 317963 - protein, 19 aa, Mycobacterium
LPLVDAVIRSFRLVRGGFW

SEQ ID NO: 317964 - protein, 20 aa, Mycobacterium
LPLVLRKLRVDPAVVSAPMI

SEQ ID NO: 317965 - protein, 21 aa, Mycobacterium
LPLVLTRPVPDPAAPPPSSPG

SEQ ID NO: 317966 - protein, 18 aa, Mycobacterium
LPLVSCLVALVAGLYAFL

SEQ ID NO: 317967 - protein, 27 aa, Mycobacterium
LPLVYGALYLWAFWDPFGHTNKMPVAL

SEQ ID NO: 317968 - protein, 23 aa, Mycobacterium
LPMLAAMCWFVADVVLLDRTGDR

SEQ ID NO: 317969 - protein, 19 aa, Mycobacterium
LPMLPNCWNASLVGLTNVG

SEQ ID NO: 317970 - protein, 30 aa, Mycobacterium
LPMLRPLRLLRLVTLIAVLQRVAGNAIRGR

SEQ ID NO: 317971 - protein, 20 aa, Mycobacterium
LPMVRADIQGLAALGDVYAD

SEQ ID NO: 317972 - protein, 20 aa, Mycobacterium
LPMYLNVAVAVLGFLAYLAS

SEQ ID NO: 317973 - protein, 20 aa, Mycobacterium
LPNGEFSLGLGDPSSCTVGF

SEQ ID NO: 317974 - protein, 21 aa, Mycobacterium
LPNGTFFAVLLIFLIVLGVIA

SEQ ID NO: 317975 - protein, 18 aa, Mycobacterium
LPNQPWREVTRVADRMTP

SEQ ID NO: 317976 - protein, 30 aa, Mycobacterium
LPNSVLRNWPAWLAVYGFFSMDRWLLGHWP

SEQ ID NO: 317977 - protein, 21 aa, Mycobacterium
LPNWREAAVTFWASAFLGAVV

SEQ ID NO: 317978 - protein, 24 aa, Mycobacterium
LPPAASYRSFVTWLSERDQVAAQH

SEQ ID NO: 317979 - protein, 17 aa, Mycobacterium
LPPATPWAPSQMSSAAL

SEQ ID NO: 317980 - protein, 17 aa, Mycobacterium
LPPDTSKAERAQIVAQV

SEQ ID NO: 317981 - protein, 26 aa, Mycobacterium
LPPEGQRPITPAAFAYYVTGNQTPGD

SEQ ID NO: 317982 - protein, 22 aa, Mycobacterium
LPPEVHSALLYAGPGPGPIVAS

SEQ ID NO: 317983 - protein, 18 aa, Mycobacterium
LPPGLRAPFSAAMAQSML

SEQ ID NO: 317984 - protein, 24 aa, Mycobacterium
LPPGPRYGPTPAFAVPHDLGFRLV

SEQ ID NO: 317985 - protein, 18 aa, Mycobacterium
LPPGTSVRLCMAAVNRDD

SEQ ID NO: 317986 - protein, 21 aa, Mycobacterium
LPPHRWRVQREGLTRAYRSLA

SEQ ID NO: 317987 - protein, 18 aa, Mycobacterium
LPPIDQWSGSSFSNLPIG

SEQ ID NO: 317988 - protein, 17 aa, Mycobacterium
LPPLAVGMGMYLPISLT

SEQ ID NO: 317989 - protein, 18 aa, Mycobacterium
LPPLIAYYALRAFGVTPY

SEQ ID NO: 317990 - protein, 21 aa, Mycobacterium
LPPLLKKLRIDPAIVSGPLIA

SEQ ID NO: 317991 - protein, 17 aa, Mycobacterium
LPPLPVLVVVIDEFAEL

SEQ ID NO: 317992 - protein, 21 aa, Mycobacterium
LPPLQARRVFVDGIASALYVG

SEQ ID NO: 317993 - protein, 20 aa, Mycobacterium
LPPLRSAWTALRNPHYHANL

SEQ ID NO: 317994 - protein, 17 aa, Mycobacterium
LPPPRPGVERRLPPYGS

SEQ ID NO: 317995 - protein, 31 aa, Mycobacterium
LPPPVPYPKRRRWPKVLAAVLAVAVLAGVVT

SEQ ID NO: 317996 - protein, 36 aa, Mycobacterium
LPPPVVVLPRPQWNPPRPAWTWPNQRPDVDDDSDDS

SEQ ID NO: 317997 - protein, 23 aa, Mycobacterium
LPPRIRELAILRVAHRRQSAYEW

SEQ ID NO: 317998 - protein, 25 aa, Mycobacterium
LPPRVRELAILRIAHRRGCAYEWTH

SEQ ID NO: 317999 - protein, 19 aa, Mycobacterium
LPPSINFAGPSPYIDFDAM

SEQ ID NO: 318000 - protein, 18 aa, Mycobacterium
LPPSINFAGPSPYIDFDG

SEQ ID NO: 318001 - protein, 17 aa, Mycobacterium
LPPSVNAPSAWSAPPAA

SEQ ID NO: 318002 - protein, 20 aa, Mycobacterium
LPPWPERVPWTAGTKRKPVD

SEQ ID NO: 318003 - protein, 18 aa, Mycobacterium
LPPWPNRVPLTAGDTRTP

SEQ ID NO: 318004 - protein, 24 aa, Mycobacterium
LPQDAIRWVALVALVAIGLGLMFP

SEQ ID NO: 318005 - protein, 21 aa, Mycobacterium
LPQIRELLTLLPTRLRDMENL

SEQ ID NO: 318006 - protein, 17 aa, Mycobacterium
LPQLCRLVEDTEKRYRA

SEQ ID NO: 318007 - protein, 19 aa, Mycobacterium
LPQVLAHARRARKIMLQNI

SEQ ID NO: 318008 - protein, 20 aa, Mycobacterium
LPRALLDPRPVIIAIALGWL

SEQ ID NO: 318009 - protein, 21 aa, Mycobacterium
LPRDGCATCSRAAARPNEPSS

SEQ ID NO: 318010 - protein, 20 aa, Mycobacterium
LPRDHICCGNMGLVETLLTA

SEQ ID NO: 318011 - protein, 18 aa, Mycobacterium
LPRGARMVLDAATVGVVP

SEQ ID NO: 318012 - protein, 20 aa, Mycobacterium
LPRGFKVPLYPVTPVLSVLA

SEQ ID NO: 318013 - protein, 19 aa, Mycobacterium
LPRHDALKVLRANISADPA

SEQ ID NO: 318014 - protein, 25 aa, Mycobacterium
LPRIRYSMILFNWFGVCLIPILILL

SEQ ID NO: 318015 - protein, 17 aa, Mycobacterium
LPRKPFRLPGRATLLTN

SEQ ID NO: 318016 - protein, 22 aa, Mycobacterium
LPRLGMCGGVSWQGHLCGALAG

SEQ ID NO: 318017 - protein, 24 aa, Mycobacterium
LPRLPWWLRPMARFHADDHFISPP

SEQ ID NO: 318018 - protein, 21 aa, Mycobacterium
LPRLTRRSRRLVAASLVIVVL

SEQ ID NO: 318019 - protein, 18 aa, Mycobacterium
LPRNKIWIFDTTRPGELL

SEQ ID NO: 318020 - protein, 24 aa, Mycobacterium
LPRPLPSHRLWIGALLAVTFFAIA

SEQ ID NO: 318021 - protein, 18 aa, Mycobacterium
LPRPPVPLHLALLAVVLP

SEQ ID NO: 318022 - protein, 25 aa, Mycobacterium
LPRPWNPLPCAGVDAGAFGGSFPAP

SEQ ID NO: 318023 - protein, 24 aa, Mycobacterium
LPRPWNPLPCMGLGAGPFGGPSTI

SEQ ID NO: 318024 - protein, 19 aa, Mycobacterium
LPRRTFAPLLGRLLHDRTA

SEQ ID NO: 318025 - protein, 19 aa, Mycobacterium
LPRSLPLADALSRMRRSNS

SEQ ID NO: 318026 - protein, 19 aa, Mycobacterium
LPRTNARGGPGGIPGCWQK

SEQ ID NO: 318027 - protein, 17 aa, Mycobacterium
LPRTTWAAVEARPYALS

SEQ ID NO: 318028 - protein, 20 aa, Mycobacterium
LPRVNARGGPEGRPGCWQPI

SEQ ID NO: 318029 - protein, 30 aa, Mycobacterium
LPRVNARGGPGGAPGCWQAITHDLWPAPSL

SEQ ID NO: 318030 - protein, 32 aa, Mycobacterium
LPRVVPPSFLRRAMPVVIVILIVGMVVALVAS

SEQ ID NO: 318031 - protein, 21 aa, Mycobacterium
LPSADFLAVIALIHASGETQP

SEQ ID NO: 318032 - protein, 22 aa, Mycobacterium
LPSALAALAIRCTVPVELNVDP

SEQ ID NO: 318033 - protein, 21 aa, Mycobacterium
LPSEHLPLLEPLRGIVPAPLL

SEQ ID NO: 318034 - protein, 18 aa, Mycobacterium
LPSGPGQVWSQWHSLVFD

SEQ ID NO: 318035 - protein, 23 aa, Mycobacterium
LPSHLPAPMLPQIVPGALRDLFG

SEQ ID NO: 318036 - protein, 21 aa, Mycobacterium
LPSIEMDPDLVLFVILPPLLY

SEQ ID NO: 318037 - protein, 20 aa, Mycobacterium
LPSIPRWTGMHAALLVVGAA

SEQ ID NO: 318038 - protein, 18 aa, Mycobacterium
LPSLAIVVLAEVWKTTPF

SEQ ID NO: 318039 - protein, 19 aa, Mycobacterium
LPSLPIRPGMVAVLAVLLG

SEQ ID NO: 318040 - protein, 17 aa, Mycobacterium
LPSPVSWFGRPGSMATI

SEQ ID NO: 318041 - protein, 22 aa, Mycobacterium
LPSRIFRVEFAKRGLAPQNLSR

SEQ ID NO: 318042 - protein, 17 aa, Mycobacterium
LPSRWRIQDLIILTLGT

SEQ ID NO: 318043 - protein, 18 aa, Mycobacterium
LPSSLPSLLIPNVPLNLD

SEQ ID NO: 318044 - protein, 19 aa, Mycobacterium
LPSTLALTGLALVLGVVFS

SEQ ID NO: 318045 - protein, 25 aa, Mycobacterium
LPSWGSLRLAMPVAGNGDAAFLAGE

SEQ ID NO: 318046 - protein, 20 aa, Mycobacterium
LPSYMVPVVLVALPRLPLTV

SEQ ID NO: 318047 - protein, 20 aa, Mycobacterium
LPTADLGLAFATILPAYDLS

SEQ ID NO: 318048 - protein, 19 aa, Mycobacterium
LPTALRFGLVDLRRNGVLL

SEQ ID NO: 318049 - protein, 24 aa, Mycobacterium
LPTALRRPAARPLLALAAVAVLVP

SEQ ID NO: 318050 - protein, 20 aa, Mycobacterium
LPTFDWPTDPSWLYRLTQGL

SEQ ID NO: 318051 - protein, 20 aa, Mycobacterium
LPTFDWPTNPSWLYRLTQGL

SEQ ID NO: 318052 - protein, 21 aa, Mycobacterium
LPTGLRLVIDNAIANAVKHGN

SEQ ID NO: 318053 - protein, 17 aa, Mycobacterium
LPTIMMIGGEFNTPSDW

SEQ ID NO: 318054 - protein, 20 aa, Mycobacterium
LPTMRKVILPQAIRTMIPSY

SEQ ID NO: 318055 - protein, 21 aa, Mycobacterium
LPTNACSPEFLARLRDDAPRV

SEQ ID NO: 318056 - protein, 18 aa, Mycobacterium
LPTPLSVHVYRLVWRQII

SEQ ID NO: 318057 - protein, 18 aa, Mycobacterium
LPTPLSVHVYRLVWRQLL

SEQ ID NO: 318058 - protein, 18 aa, Mycobacterium
LPTPLSVHVYRLVWRQVI

SEQ ID NO: 318059 - protein, 24 aa, Mycobacterium
LPTQEYTPWLTRALAFVIDILPYV

SEQ ID NO: 318060 - protein, 24 aa, Mycobacterium
LPTRPEKLGALAPRANARLAAALI

SEQ ID NO: 318061 - protein, 18 aa, Mycobacterium
LPTWAVGLLMGVRTLSNQ

SEQ ID NO: 318062 - protein, 25 aa, Mycobacterium
LPTYAFARRRFWLDGSASAADVGEA

SEQ ID NO: 318063 - protein, 24 aa, Mycobacterium
LPTYGFVRQHFWLPGGSTGSSDAA

SEQ ID NO: 318064 - protein, 17 aa, Mycobacterium
LPTYIKTIYDFSAVDAG

SEQ ID NO: 318065 - protein, 26 aa, Mycobacterium
LPVAARGGLLVRILRQFHHPLIYVLL

SEQ ID NO: 318066 - protein, 20 aa, Mycobacterium
LPVAGLRLGFDELAAQPLST

SEQ ID NO: 318067 - protein, 17 aa, Mycobacterium
LPVAVGFGNGLGAPGGF

SEQ ID NO: 318068 - protein, 19 aa, Mycobacterium
LPVAVGWTIALVVVLAFAG

SEQ ID NO: 318069 - protein, 18 aa, Mycobacterium
LPVAVLFILAMSAVGVYG

SEQ ID NO: 318070 - protein, 17 aa, Mycobacterium
LPVDVASALALAVAIQL

SEQ ID NO: 318071 - protein, 17 aa, Mycobacterium
LPVGALPVIAADLNVSE

SEQ ID NO: 318072 - protein, 18 aa, Mycobacterium
LPVGTAYAIWVGVGAVGT

SEQ ID NO: 318073 - protein, 21 aa, Mycobacterium
LPVIDPRASELPDLEAPRPPQ

SEQ ID NO: 318074 - protein, 21 aa, Mycobacterium
LPVIGPWALYGLLFTIVILFA

SEQ ID NO: 318075 - protein, 25 aa, Mycobacterium
LPVLALMVVAVWLLGVGTLKDLALV

SEQ ID NO: 318076 - protein, 26 aa, Mycobacterium
LPVLALMVVAVWLLGVGTLKDLALVQ

SEQ ID NO: 318077 - protein, 20 aa, Mycobacterium
LPVLFLLLCALWCAGVAMLW

SEQ ID NO: 318078 - protein, 25 aa, Mycobacterium
LPVLGELWAPLGLRLHAVHHLFPKL

SEQ ID NO: 318079 - protein, 18 aa, Mycobacterium
LPVLHGLTPTALNATVEL

SEQ ID NO: 318080 - protein, 26 aa, Mycobacterium
LPVLIGGLLLPLSDLYLFSTWLAPGQ

SEQ ID NO: 318081 - protein, 21 aa, Mycobacterium
LPVLVLLVLWRARRRGPDDPP

SEQ ID NO: 318082 - protein, 17 aa, Mycobacterium
LPVPIPIQLPANQAPQN

SEQ ID NO: 318083 - protein, 23 aa, Mycobacterium
LPVQLGKDWIWLHAARIAATTLP

SEQ ID NO: 318084 - protein, 22 aa, Mycobacterium
LPVQLGKDWVWLHAARVAAPTV

SEQ ID NO: 318085 - protein, 20 aa, Mycobacterium
LPVRARIGVITAVAALSLLW

SEQ ID NO: 318086 - protein, 22 aa, Mycobacterium
LPVRSENQWLTLTGLGDDEETS

SEQ ID NO: 318087 - protein, 29 aa, Mycobacterium
LPVSAGAWLPHYLVWFIGGMMLAVLATMG

SEQ ID NO: 318088 - protein, 17 aa, Mycobacterium
LPVSALWLDATMPALVV

SEQ ID NO: 318089 - protein, 23 aa, Mycobacterium
LPVSVALAWVFGKLGWNAATPVL

SEQ ID NO: 318090 - protein, 19 aa, Mycobacterium
LPVSVPYKAVEVGSTIQGV

SEQ ID NO: 318091 - protein, 19 aa, Mycobacterium
LPVTYRVIAFVKRSEPTYQ

SEQ ID NO: 318092 - protein, 26 aa, Mycobacterium
LPVVALMVVAVWLLGVGTLKDLALVQ

SEQ ID NO: 318093 - protein, 21 aa, Mycobacterium
LPVVFGALSLVVPHRDNPYEA

SEQ ID NO: 318094 - protein, 17 aa, Mycobacterium
LPVVFYSAWIFFDGAWR

SEQ ID NO: 318095 - protein, 18 aa, Mycobacterium
LPVWKKLRAGDWAEAHPS

SEQ ID NO: 318096 - protein, 18 aa, Mycobacterium
LPVWKKLRTGDFAADDAE

SEQ ID NO: 318097 - protein, 17 aa, Mycobacterium
LPVWMVLTVPQRSANAL

SEQ ID NO: 318098 - protein, 19 aa, Mycobacterium
LPWHPGQVTLEYGSRTGEQ

SEQ ID NO: 318099 - protein, 17 aa, Mycobacterium
LPWITWIAFGAWVAIVL

SEQ ID NO: 318100 - protein, 26 aa, Mycobacterium
LPWLAEAEVLYWGDIDTHGFAILDRL

SEQ ID NO: 318101 - protein, 19 aa, Mycobacterium
LPWLAGRLGTPGIPRTALP

SEQ ID NO: 318102 - protein, 17 aa, Mycobacterium
LPWLIRKLHISRFNDDH

SEQ ID NO: 318103 - protein, 17 aa, Mycobacterium
LPWTMIVTPSPGITGGS

SEQ ID NO: 318104 - protein, 26 aa, Mycobacterium
LPWYAIICLPVLFAAGMCLLDTIDGS

SEQ ID NO: 318105 - protein, 29 aa, Mycobacterium
LPYFESLGVPCAIGMLVVVAASLTIGPAV

SEQ ID NO: 318106 - protein, 18 aa, Mycobacterium
LPYFKPLGIPGAVGILVA

SEQ ID NO: 318107 - protein, 17 aa, Mycobacterium
LPYFQTLGIPMAVGMTI

SEQ ID NO: 318108 - protein, 17 aa, Mycobacterium
LPYNLARTWHLQLALFW

SEQ ID NO: 318109 - protein, 24 aa, Mycobacterium
LPYNSGPFGHQWFTVQRTIFRLAF

SEQ ID NO: 318110 - protein, 32 aa, Mycobacterium
LPYNSGRFSKQWLMVHRTIFRLAFPGGKPRRK

SEQ ID NO: 318111 - protein, 18 aa, Mycobacterium
LPYPKWLPPPAPPLGINP

SEQ ID NO: 318112 - protein, 18 aa, Mycobacterium
LPYRGVSVAARYELAFEL

SEQ ID NO: 318113 - protein, 20 aa, Mycobacterium
LPYSVLWLALGVIMILLVVG

SEQ ID NO: 318114 - protein, 17 aa, Mycobacterium
LPYVANRVIGFALADPD

SEQ ID NO: 318115 - protein, 29 aa, Mycobacterium
LPYVMGGAMLGMIAIMFAGGRQLSPYMLM

SEQ ID NO: 318116 - protein, 19 aa, Mycobacterium
LQAAALKAGNPVTVAGIPV

SEQ ID NO: 318117 - protein, 18 aa, Mycobacterium
LQAALPISLQRAGLGLLI

SEQ ID NO: 318118 - protein, 19 aa, Mycobacterium
LQACRRAGVKVAMVTGDHP

SEQ ID NO: 318119 - protein, 37 aa, Mycobacterium
LQAEAALDRVTRPAAPRRRFSLAVVGSAAAAVLAIGG

SEQ ID NO: 318120 - protein, 17 aa, Mycobacterium
LQAFPGTLDPEWRLPYA

SEQ ID NO: 318121 - protein, 18 aa, Mycobacterium
LQAHLDWLLMGAVLIGVD

SEQ ID NO: 318122 - protein, 22 aa, Mycobacterium
LQALVLRFGYLWAALASGLVLL

SEQ ID NO: 318123 - protein, 25 aa, Mycobacterium
LQARPLRVAFVLGVGMLADLRFLVA

SEQ ID NO: 318124 - protein, 20 aa, Mycobacterium
LQAVVLPFVICSYITHLTWE

SEQ ID NO: 318125 - protein, 25 aa, Mycobacterium
LQAYRPELLGGVALVAGTDTFMKEA

SEQ ID NO: 318126 - protein, 24 aa, Mycobacterium
LQCIAEARPFVLLERFELNAWVDA

SEQ ID NO: 318127 - protein, 20 aa, Mycobacterium
LQDDLKRLLAWDTVAQTGVL

SEQ ID NO: 318128 - protein, 22 aa, Mycobacterium
LQDRVSQGLGWLGVLVSDHVGN

SEQ ID NO: 318129 - protein, 18 aa, Mycobacterium
LQEWQTVVGVTFQLFTIV

SEQ ID NO: 318130 - protein, 18 aa, Mycobacterium
LQFGEGWWTSTVFLCVWI

SEQ ID NO: 318131 - protein, 20 aa, Mycobacterium
LQFHPDVCAGVPIVALVGDG

SEQ ID NO: 318132 - protein, 23 aa, Mycobacterium
LQFPGRDALFWVYIATLMVPATV

SEQ ID NO: 318133 - protein, 19 aa, Mycobacterium
LQFTFPLTVENNGGTWMVA

SEQ ID NO: 318134 - protein, 19 aa, Mycobacterium
LQGELHLVVLAAYIFLAVS

SEQ ID NO: 318135 - protein, 25 aa, Mycobacterium
LQGFGRRLSWVLAEVAVVIALVLST

SEQ ID NO: 318136 - protein, 17 aa, Mycobacterium
LQGHWSLLVGYGCLPWV

SEQ ID NO: 318137 - protein, 17 aa, Mycobacterium
LQGLVFGSILHWGSRNA

SEQ ID NO: 318138 - protein, 18 aa, Mycobacterium
LQGPLGAAIDQAADTLDG

SEQ ID NO: 318139 - protein, 19 aa, Mycobacterium
LQHAVRIWLARVLADPHMK

SEQ ID NO: 318140 - protein, 18 aa, Mycobacterium
LQHFRLYVDIAIVVVVLA

SEQ ID NO: 318141 - protein, 24 aa, Mycobacterium
LQHGRRVALALSFGLRTVLALVLI

SEQ ID NO: 318142 - protein, 24 aa, Mycobacterium
LQHTKWGVGIALLFVTLPFVVRAV

SEQ ID NO: 318143 - protein, 21 aa, Mycobacterium
LQIPALLGVGRYPLKAELPAS

SEQ ID NO: 318144 - protein, 24 aa, Mycobacterium
LQIYVVMGAGWVWYRGLQGEPLPA

SEQ ID NO: 318145 - protein, 18 aa, Mycobacterium
LQKIGFRVLFTVGGGILL

SEQ ID NO: 318146 - protein, 25 aa, Mycobacterium
LQKISELYDRVGFAAAGKFNEFDNL

SEQ ID NO: 318147 - protein, 20 aa, Mycobacterium
LQKTRFPGLTVLTSGAVPPN

SEQ ID NO: 318148 - protein, 34 aa, Mycobacterium
LQLALAVALLAWWRGRRVGPLVAEQLPVVVRASE

SEQ ID NO: 318149 - protein, 26 aa, Mycobacterium
LQLASALCRHYWPIALVASVLSKRCR

SEQ ID NO: 318150 - protein, 31 aa, Mycobacterium
LQLASALCRHYWPLALMAATMSRHFRRVVLV

SEQ ID NO: 318151 - protein, 26 aa, Mycobacterium
LQLASALCRHYWPVALLAAALSRHFR

SEQ ID NO: 318152 - protein, 41 aa, Mycobacterium
LQLCSAICRHYWPIAMIAAVLFRRARHAVLVAAVVDGVVDW

SEQ ID NO: 318153 - protein, 25 aa, Mycobacterium
LQLFFSVGVDGFFAISGFLITRSWL

SEQ ID NO: 318154 - protein, 18 aa, Mycobacterium
LQLITFRVVQGVGGGMLL

SEQ ID NO: 318155 - protein, 19 aa, Mycobacterium
LQLLFSIGVDGFFAISGFL

SEQ ID NO: 318156 - protein, 22 aa, Mycobacterium
LQLLGGGPWRLGPVEEKKEPAR

SEQ ID NO: 318157 - protein, 26 aa, Mycobacterium
LQLMHARYAYFAGFLTAAVVLVNAER

SEQ ID NO: 318158 - protein, 25 aa, Mycobacterium
LQLPPRLAQPAAQWRSLPDAPTPRL

SEQ ID NO: 318159 - protein, 35 aa, Mycobacterium
LQLPSLAGIGRYTLKAELPASGGLYPTANVTYRGI

SEQ ID NO: 318160 - protein, 21 aa, Mycobacterium
LQLVLESFAFLLIGLQLPAVV

SEQ ID NO: 318161 - protein, 18 aa, Mycobacterium
LQLWEFLALVLDSLAIAA

SEQ ID NO: 318162 - protein, 17 aa, Mycobacterium
LQLWSFLALVLDSLAIA

SEQ ID NO: 318163 - protein, 19 aa, Mycobacterium
LQLWSFLALVLDSLAIAAQ

SEQ ID NO: 318164 - protein, 18 aa, Mycobacterium
LQMKRWGHQWLLVTCWFG

SEQ ID NO: 318165 - protein, 25 aa, Mycobacterium
LQNPRAFDNMRFWDAGALDGRPLEV

SEQ ID NO: 318166 - protein, 21 aa, Mycobacterium
LQPERLLSWATAIRYQALFTE

SEQ ID NO: 318167 - protein, 18 aa, Mycobacterium
LQPFLPFANGIRFTGVPW

SEQ ID NO: 318168 - protein, 23 aa, Mycobacterium
LQPGEHRMIYIFAGEDGLEPHDI

SEQ ID NO: 318169 - protein, 17 aa, Mycobacterium
LQPGGPVRTVRLFQQPT

SEQ ID NO: 318170 - protein, 25 aa, Mycobacterium
LQPGKLRWLATWGPWAAVGAAAITG

SEQ ID NO: 318171 - protein, 20 aa, Mycobacterium
LQPGPGGAFTGEFTATTSNN

SEQ ID NO: 318172 - protein, 22 aa, Mycobacterium
LQPHARAAMRIHVIEEARHVSF

SEQ ID NO: 318173 - protein, 18 aa, Mycobacterium
LQPIIQRLMRIHVTEEAR

SEQ ID NO: 318174 - protein, 18 aa, Mycobacterium
LQPISPVVAAILRNSNSW

SEQ ID NO: 318175 - protein, 17 aa, Mycobacterium
LQPRVSIGLDQTKFGRP

SEQ ID NO: 318176 - protein, 22 aa, Mycobacterium
LQPVGTLPWWAGIIEFVGGAAI

SEQ ID NO: 318177 - protein, 19 aa, Mycobacterium
LQPWRDLRKQLRKQQVTPE

SEQ ID NO: 318178 - protein, 26 aa, Mycobacterium
LQRARVPMPVLPVSSLLRSHAITLND

SEQ ID NO: 318179 - protein, 25 aa, Mycobacterium
LQRCLHLAPLWAGVAFLPFSATVVF

SEQ ID NO: 318180 - protein, 17 aa, Mycobacterium
LQRDRVMRLAQERVGYT

SEQ ID NO: 318181 - protein, 22 aa, Mycobacterium
LQRGRLEFSRGVAYADYARTVN

SEQ ID NO: 318182 - protein, 19 aa, Mycobacterium
LQRKCRHALLSLGMVIVAL

SEQ ID NO: 318183 - protein, 20 aa, Mycobacterium
LQRPAYKALWDYERQKKAGL

SEQ ID NO: 318184 - protein, 21 aa, Mycobacterium
LQRPHFRMPLAPYSGYLTLAF

SEQ ID NO: 318185 - protein, 21 aa, Mycobacterium
LQRQALRAGLSVRPMIVTLIG

SEQ ID NO: 318186 - protein, 18 aa, Mycobacterium
LQRREFGIRVVVQCGVAV

SEQ ID NO: 318187 - protein, 17 aa, Mycobacterium
LQRRSDAPYACMGGACG

SEQ ID NO: 318188 - protein, 23 aa, Mycobacterium
LQRTPPPPGLRVYVSGAAPLSAD

SEQ ID NO: 318189 - protein, 18 aa, Mycobacterium
LQSIRLAKTAIWVAISSL

SEQ ID NO: 318190 - protein, 17 aa, Mycobacterium
LQSPARFAPYGPGSARA

SEQ ID NO: 318191 - protein, 19 aa, Mycobacterium
LQSRWGVEGQPFPWSIETC

SEQ ID NO: 318192 - protein, 18 aa, Mycobacterium
LQSSPTAMDGLRLPNWGT

SEQ ID NO: 318193 - protein, 25 aa, Mycobacterium
LQSSRPTVWRGIGLRMAENGGSYIY

SEQ ID NO: 318194 - protein, 23 aa, Mycobacterium
LQTAASVPVVFLTAFYGLRVLAE

SEQ ID NO: 318195 - protein, 27 aa, Mycobacterium
LQTDINVALPWTKTVVLDPGVELKSVT

SEQ ID NO: 318196 - protein, 25 aa, Mycobacterium
LQTGSSFKVFALVAALQQGIGLGYQ

SEQ ID NO: 318197 - protein, 17 aa, Mycobacterium
LQTLPPLVAQILQNAGP

SEQ ID NO: 318198 - protein, 22 aa, Mycobacterium
LQTRVGFHYGFGAAAIGMALGL

SEQ ID NO: 318199 - protein, 18 aa, Mycobacterium
LQVARGIVAFLGHLQLLG

SEQ ID NO: 318200 - protein, 23 aa, Mycobacterium
LQVARGLVAFLGMHGIVGLTTFV

SEQ ID NO: 318201 - protein, 23 aa, Mycobacterium
LQVARGLVSFLALNGIVGLTTYV

SEQ ID NO: 318202 - protein, 21 aa, Mycobacterium
LQVGVAVMWLSVIVLLPLAAI

SEQ ID NO: 318203 - protein, 22 aa, Mycobacterium
LQVLCAVGAVYFGARTGTGFGR

SEQ ID NO: 318204 - protein, 24 aa, Mycobacterium
LQVLCAVGAVYFGSRTGMGFGRDL

SEQ ID NO: 318205 - protein, 19 aa, Mycobacterium
LQVLCVIAALALLFTGTIP

SEQ ID NO: 318206 - protein, 18 aa, Mycobacterium
LQVLGASPWGVRDSIPLT

SEQ ID NO: 318207 - protein, 18 aa, Mycobacterium
LQVMPLFFLAGGAAGTYS

SEQ ID NO: 318208 - protein, 20 aa, Mycobacterium
LQVNTIWTARAISVMFPEIK

SEQ ID NO: 318209 - protein, 25 aa, Mycobacterium
LQVPGELLALLLAGQFLPALVLALI

SEQ ID NO: 318210 - protein, 17 aa, Mycobacterium
LQVPRLIAGQITYGDVS

SEQ ID NO: 318211 - protein, 23 aa, Mycobacterium
LQVPRTALGLARITLPPVLAPGQ

SEQ ID NO: 318212 - protein, 24 aa, Mycobacterium
LQVSGRPAILLALTGDDPDRVHAV

SEQ ID NO: 318213 - protein, 32 aa, Mycobacterium
LQVSGYRFLVRRMEHALVRRDVRMIHDPMRSQ

SEQ ID NO: 318214 - protein, 17 aa, Mycobacterium
LQWATWLALANNVFATF

SEQ ID NO: 318215 - protein, 26 aa, Mycobacterium
LQWPLFAWFCVYAYRKFVRYEEEPPP

SEQ ID NO: 318216 - protein, 26 aa, Mycobacterium
LQWPLFAWFCVYAYRKYVRYEEMPPE

SEQ ID NO: 318217 - protein, 26 aa, Mycobacterium
LQWPMFAWFCVYAYRKFVRYEETPPQ

SEQ ID NO: 318218 - protein, 17 aa, Mycobacterium
LQWQRDHILHFGKHDHT

SEQ ID NO: 318219 - protein, 19 aa, Mycobacterium
LQWTRAGEVTVVLPPELAR

SEQ ID NO: 318220 - protein, 17 aa, Mycobacterium
LQYGIAQGNGFKTVTPK

SEQ ID NO: 318221 - protein, 18 aa, Mycobacterium
LRAAADAIRLARSTLRTI

SEQ ID NO: 318222 - protein, 19 aa, Mycobacterium
LRAADMLAAKGIDAVPASA

SEQ ID NO: 318223 - protein, 20 aa, Mycobacterium
LRAALMASIALAAMLSSRRR

SEQ ID NO: 318224 - protein, 19 aa, Mycobacterium
LRAALPARFSITVHYYVAA

SEQ ID NO: 318225 - protein, 17 aa, Mycobacterium
LRAALTDRLPSYMVPVV

SEQ ID NO: 318226 - protein, 29 aa, Mycobacterium
LRAAQRPGPRIAFRPDIEGLRAIAVVAVV

SEQ ID NO: 318227 - protein, 21 aa, Mycobacterium
LRAASGLDRPLVSQFFGYIGS

SEQ ID NO: 318228 - protein, 21 aa, Mycobacterium
LRAATTRFSVRMKHDDRKQTA

SEQ ID NO: 318229 - protein, 22 aa, Mycobacterium
LRAATTRFSVRMKHDDRKQTAA

SEQ ID NO: 318230 - protein, 18 aa, Mycobacterium
LRAAVDAIRLSRRTLATI

SEQ ID NO: 318231 - protein, 20 aa, Mycobacterium
LRADGDGVLAVRTRGAVALA

SEQ ID NO: 318232 - protein, 21 aa, Mycobacterium
LRADLRVAHPLVAQAHVVVRF

SEQ ID NO: 318233 - protein, 20 aa, Mycobacterium
LRAECRRAKERLSTESATHL

SEQ ID NO: 318234 - protein, 22 aa, Mycobacterium
LRAEPLPTPRPVNVRRLPPPGS

SEQ ID NO: 318235 - protein, 17 aa, Mycobacterium
LRAERFGVRLTVVPSAR

SEQ ID NO: 318236 - protein, 17 aa, Mycobacterium
LRAGDWVESADGAGGGV

SEQ ID NO: 318237 - protein, 19 aa, Mycobacterium
LRAGEALSAVTLSAAALGL

SEQ ID NO: 318238 - protein, 20 aa, Mycobacterium
LRAHARFGTCVQREVFDEDN

SEQ ID NO: 318239 - protein, 19 aa, Mycobacterium
LRAHVLYNIAFPGAYLCMS

SEQ ID NO: 318240 - protein, 28 aa, Mycobacterium
LRAHVMATYLSRDWARDWGSLRKFDTLV

SEQ ID NO: 318241 - protein, 28 aa, Mycobacterium
LRAHVMATYLSRDWARDWGSLRQFETLV

SEQ ID NO: 318242 - protein, 32 aa, Mycobacterium; identical to SEQ ID NO: 11628

SEQ ID NO: 318243 - protein, 20 aa, Mycobacterium
LRALKPWEGPRHFVLIDDIG

SEQ ID NO: 318244 - protein, 21 aa, Mycobacterium
LRALLALTVVLGLGYPVFIWL

SEQ ID NO: 318245 - protein, 19 aa, Mycobacterium
LRALLKWLGIPQFGVLDWF

SEQ ID NO: 318246 - protein, 21 aa, Mycobacterium
LRALLVFTVLLGVGYPLLIWL

SEQ ID NO: 318247 - protein, 18 aa, Mycobacterium
LRALPFAVSLSRRSSRVI

SEQ ID NO: 318248 - protein, 24 aa, Mycobacterium
LRALPHNRRPRLIAVDAVPDSVGV

SEQ ID NO: 318249 - protein, 20 aa, Mycobacterium
LRALPTLGMLLLGVLLWGLG

SEQ ID NO: 318250 - protein, 17 aa, Mycobacterium
LRALRPSPLPGQLLTEI

SEQ ID NO: 318251 - protein, 20 aa, Mycobacterium
LRALSVFGLIGCLVLVVTLP

SEQ ID NO: 318252 - protein, 18 aa, Mycobacterium
LRALTALDLLSTRRLDGH

SEQ ID NO: 318253 - protein, 21 aa, Mycobacterium
LRANGIRRIVMLTGDHHDTAE

SEQ ID NO: 318254 - protein, 20 aa, Mycobacterium
LRANGIRRVVMLTGDHPDIA

SEQ ID NO: 318255 - protein, 18 aa, Mycobacterium
LRARRRLERYFAGQLPAR

SEQ ID NO: 318256 - protein, 21 aa, Mycobacterium
LRASALPARVNGPGAGADAPL

SEQ ID NO: 318257 - protein, 19 aa, Mycobacterium
LRATTVFGNKYISFLSPKN

SEQ ID NO: 318258 - protein, 18 aa, Mycobacterium
LRATTVFGNKYVSFTAPE

SEQ ID NO: 318259 - protein, 22 aa, Mycobacterium
LRATTVIVYYLWDRAFVQFDAG

SEQ ID NO: 318260 - protein, 19 aa, Mycobacterium
LRATVFVVVLGFLIQITGI

SEQ ID NO: 318261 - protein, 21 aa, Mycobacterium
LRAVAAFGRKDIRGTYRDPLL

SEQ ID NO: 318262 - protein, 26 aa, Mycobacterium
LRAVADRLGLRINFVGTEFSGLLAQV

SEQ ID NO: 318263 - protein, 23 aa, Mycobacterium
LRAVPNRGLGYGVLRHLHGALDG

SEQ ID NO: 318264 - protein, 23 aa, Mycobacterium
LRAWEFRLKTVAQRFDRDADGAG

SEQ ID NO: 318265 - protein, 21 aa, Mycobacterium
LRAWLPQARSVLMDRETLLAH

SEQ ID NO: 318266 - protein, 23 aa, Mycobacterium
LRCGLDRPAEFVVGSPIQVVDRV

SEQ ID NO: 318267 - protein, 17 aa, Mycobacterium
LRCPAPVAAVLGVLAEA

SEQ ID NO: 318268 - protein, 17 aa, Mycobacterium
LRCPTCFADSSPDLRDV

SEQ ID NO: 318269 - protein, 24 aa, Mycobacterium
LRDACAELRAPLIEVHISNVHARE

SEQ ID NO: 318270 - protein, 17 aa, Mycobacterium
LRDGAWTSVPVRELVPG

SEQ ID NO: 318271 - protein, 20 aa, Mycobacterium
LRDGQKWVALAMPAYAVAGA

SEQ ID NO: 318272 - protein, 18 aa, Mycobacterium
LRDLFGRYVGEDVARRAL

SEQ ID NO: 318273 - protein, 20 aa, Mycobacterium
LRDMPADGGLVFGTAPAEGR

SEQ ID NO: 318274 - protein, 20 aa, Mycobacterium
LRDMPRAIGDIVFGTLTLLG

SEQ ID NO: 318275 - protein, 22 aa, Mycobacterium
LRDNGIRRIVMLTGDHPDIAQV

SEQ ID NO: 318276 - protein, 21 aa, Mycobacterium
LRDNGVRRIVMLTGDHPDIAK

SEQ ID NO: 318277 - protein, 17 aa, Mycobacterium
LRDPFAAAMSQSVLLPA

SEQ ID NO: 318278 - protein, 19 aa, Mycobacterium
LRDRSHRLTITAQFESVSG

SEQ ID NO: 318279 - protein, 17 aa, Mycobacterium
LRDSEGLARDKEPFQVD

SEQ ID NO: 318280 - protein, 18 aa, Mycobacterium
LRDSVVFRKVLERGEAAR

SEQ ID NO: 318281 - protein, 18 aa, Mycobacterium
LRDTRWWLGGLGDIGSYV

SEQ ID NO: 318282 - protein, 20 aa, Mycobacterium
LRDVHRFDPATLWRGQARRD

SEQ ID NO: 318283 - protein, 17 aa, Mycobacterium
LRDWILAAFRPRNGPPS

SEQ ID NO: 318284 - protein, 20 aa, Mycobacterium
LREAPSVPGLPMIVVALAGL

SEQ ID NO: 318285 - protein, 23 aa, Mycobacterium
LREFGNIVFHFSLLGLLVAIAAG

SEQ ID NO: 318286 - protein, 23 aa, Mycobacterium
LREFGNIVFHFSLLGLLVAVAAG

SEQ ID NO: 318287 - protein, 18 aa, Mycobacterium
LREGPGFAQETSRLLDGI

SEQ ID NO: 318288 - protein, 18 aa, Mycobacterium
LREGRLSDALVRISSQFG

SEQ ID NO: 318289 - protein, 19 aa, Mycobacterium
LREGYAMGGLSGHPNIVNI

SEQ ID NO: 318290 - protein, 19 aa, Mycobacterium
LREHWPTRAQSLACVAAGA

SEQ ID NO: 318291 - protein, 19 aa, Mycobacterium
LRELVSRTLAEFDLNAEID

SEQ ID NO: 318292 - protein, 19 aa, Mycobacterium
LRENWSLSGRALGMGMPLT

SEQ ID NO: 318293 - protein, 19 aa, Mycobacterium
LREPFALAMSQSMLLPAFV

SEQ ID NO: 318294 - protein, 22 aa, Mycobacterium
LRESLPLIGFMIVGLLYCRADG

SEQ ID NO: 318295 - protein, 21 aa, Mycobacterium
LRESLPLMGFLVVGLLYCRAD

SEQ ID NO: 318296 - protein, 19 aa, Mycobacterium
LRETPSIPGVPMIVVALAG

SEQ ID NO: 318297 - protein, 18 aa, Mycobacterium
LREVLASKDNKAWNLPVM

SEQ ID NO: 318298 - protein, 19 aa, Mycobacterium
LRFEPMAAATLAFGLNFGA

SEQ ID NO: 318299 - protein, 21 aa, Mycobacterium
LRFGHGLVVSSICMWLGVVLM

SEQ ID NO: 318300 - protein, 26 aa, Mycobacterium
LRFGHGLVVSSILLWTGVALMLIAWL

SEQ ID NO: 318301 - protein, 28 aa, Mycobacterium
LRFGHGLVVSSLLLWGGVALMVLAWVWL

SEQ ID NO: 318302 - protein, 23 aa, Mycobacterium
LRFKDLELRYSRLTRAVALRGAE

SEQ ID NO: 318303 - protein, 29 aa, Mycobacterium
LRFLLGVAEAGLFPGVIYYLSRWFPRDYR

SEQ ID NO: 318304 - protein, 26 aa, Mycobacterium
LRFLQGVGLGGEWAGAVLVVTETSPP

SEQ ID NO: 318305 - protein, 19 aa, Mycobacterium
LRFPLDIPIEDFLFGFAMV

SEQ ID NO: 318306 - protein, 20 aa, Mycobacterium
LRFTGRRLAIYTAIVTICGL

SEQ ID NO: 318307 - protein, 20 aa, Mycobacterium
LRFTGRRLGLYTALITVSVV

SEQ ID NO: 318308 - protein, 21 aa, Mycobacterium
LRFTGRRLSIYTAIVTVSSIA

SEQ ID NO: 318309 - protein, 19 aa, Mycobacterium
LRFVFGAFGRKGLPHPSTR

SEQ ID NO: 318310 - protein, 17 aa, Mycobacterium
LRGALLGGLLLGIMENY

SEQ ID NO: 318311 - protein, 21 aa, Mycobacterium
LRGALTGVFYVVTYIGFALPL

SEQ ID NO: 318312 - protein, 18 aa, Mycobacterium
LRGASFAFRKYSATVSQA

SEQ ID NO: 318313 - protein, 18 aa, Mycobacterium
LRGATLLAGALGLLTLAL

SEQ ID NO: 318314 - protein, 17 aa, Mycobacterium
LRGATVLGFKRRLLHRL

SEQ ID NO: 318315 - protein, 22 aa, Mycobacterium
LRGFGRRPAWVITEIAVVVVLM

SEQ ID NO: 318316 - protein, 22 aa, Mycobacterium
LRGFGRRPSWVLAEIAIAVLLM

SEQ ID NO: 318317 - protein, 23 aa, Mycobacterium
LRGFGVRAGVAAPIIVDGHTWGA

SEQ ID NO: 318318 - protein, 18 aa, Mycobacterium
LRGICGRRREELFTPDGF

SEQ ID NO: 318319 - protein, 17 aa, Mycobacterium
LRGKNTRGWFLASAGAD

SEQ ID NO: 318320 - protein, 24 aa, Mycobacterium
LRGLCRRSREEVFTADGYYCSGDL

SEQ ID NO: 318321 - protein, 19 aa, Mycobacterium
LRGLIGYGVLALVVGAVMV

SEQ ID NO: 318322 - protein, 18 aa, Mycobacterium
LRGLLGRGGMAEVRDGWD

SEQ ID NO: 318323 - protein, 18 aa, Mycobacterium
LRGPHLMQRYYGRSREEC

SEQ ID NO: 318324 - protein, 19 aa, Mycobacterium
LRGRMVEWTQAEYLKAQRY

SEQ ID NO: 318325 - protein, 17 aa, Mycobacterium
LRGRRVLAVALTLPLAM

SEQ ID NO: 318326 - protein, 17 aa, Mycobacterium
LRGRRVLAVVLTLPLAM

SEQ ID NO: 318327 - protein, 17 aa, Mycobacterium
LRGSFVAERVRPQKYRD

SEQ ID NO: 318328 - protein, 18 aa, Mycobacterium
LRGSIAIFDDLLRPIRNY

SEQ ID NO: 318329 - protein, 18 aa, Mycobacterium
LRGSIALFDDFLRPIRNY

SEQ ID NO: 318330 - protein, 24 aa, Mycobacterium
LRGSNLMWYIGLVVVLAVGGGVTF

SEQ ID NO: 318331 - protein, 25 aa, Mycobacterium
LRGSWLGHPVHPLLIFLPLGSWMTA

SEQ ID NO: 318332 - protein, 24 aa, Mycobacterium
LRGSYGGVIMFGMLTSVAGLGMFN

SEQ ID NO: 318333 - protein, 21 aa, Mycobacterium
LRGSYGGVVMIGMLSSVAGLG

SEQ ID NO: 318334 - protein, 19 aa, Mycobacterium
LRGTMSGFFLVGSVLSLAV

SEQ ID NO: 318335 - protein, 19 aa, Mycobacterium
LRGVAFLGWNRSISQIIEP

SEQ ID NO: 318336 - protein, 21 aa, Mycobacterium
LRGVASLAFLPWPVRVLAGRF

SEQ ID NO: 318337 - protein, 20 aa, Mycobacterium
LRGVGRLTIGLLGVATVLLL

SEQ ID NO: 318338 - protein, 24 aa, Mycobacterium
LRGVGVCGGRVRGRVRIVRPDTID

SEQ ID NO: 318339 - protein, 18 aa, Mycobacterium
LRGVPGMRLRSIAMRPDC

SEQ ID NO: 318340 - protein, 17 aa, Mycobacterium
LRGWRTAIRHEDGAASD

SEQ ID NO: 318341 - protein, 20 aa, Mycobacterium
LRHADTWILALLYIGTFGSF

SEQ ID NO: 318342 - protein, 17 aa, Mycobacterium
LRHARPTAVIADGVGAH

SEQ ID NO: 318343 - protein, 17 aa, Mycobacterium
LRHAVRRAGPAIVASNA

SEQ ID NO: 318344 - protein, 22 aa, Mycobacterium
LRHGGTGYVGWGIAAAVVGVAG

SEQ ID NO: 318345 - protein, 20 aa, Mycobacterium
LRHGMPLGVAYGIWAAAGVA

SEQ ID NO: 318346 - protein, 22 aa, Mycobacterium
LRHILPNALAPVLVYATIAVGS

SEQ ID NO: 318347 - protein, 24 aa, Mycobacterium
LRHITRRALPFSVASGALVGLLSV

SEQ ID NO: 318348 - protein, 19 aa, Mycobacterium
LRHLVLPSLTLALAAAAGY

SEQ ID NO: 318349 - protein, 26 aa, Mycobacterium
LRHPLLRWAWSLLRLDFAGVAVGALF

SEQ ID NO: 318350 - protein, 23 aa, Mycobacterium
LRHRLRASTVLTVPVIAMAMIPA

SEQ ID NO: 318351 - protein, 22 aa, Mycobacterium
LRIALVPLFIAEVFHRGPGIAG

SEQ ID NO: 318352 - protein, 20 aa, Mycobacterium
LRIALVPLFVVEVLGEGPGA

SEQ ID NO: 318353 - protein, 20 aa, Mycobacterium
LRIAQALRHRGHVVAMTGDG

SEQ ID NO: 318354 - protein, 20 aa, Mycobacterium
LRIASRVGTGVGFGDDQVFD

SEQ ID NO: 318355 - protein, 17 aa, Mycobacterium
LRIAVKHIPGGAFSTFV

SEQ ID NO: 318356 - protein, 17 aa, Mycobacterium
LRIDPAIVSGPLIATIV

SEQ ID NO: 318357 - protein, 20 aa, Mycobacterium
LRIGSPMFHFGILVVVVGHV

SEQ ID NO: 318358 - protein, 17 aa, Mycobacterium
LRIGWALVNKQSLVSSA

SEQ ID NO: 318359 - protein, 19 aa, Mycobacterium
LRILLPVATVSAMLLIAGG

SEQ ID NO: 318360 - protein, 24 aa, Mycobacterium
LRILPGFYVCLIVTAFVFAPLSVA

SEQ ID NO: 318361 - protein, 18 aa, Mycobacterium
LRISDSVIVFASVMLAQY

SEQ ID NO: 318362 - protein, 24 aa, Mycobacterium
LRISPRIVFVPVIIGALRAADDFS

SEQ ID NO: 318363 - protein, 26 aa, Mycobacterium
LRITGWVRAIFSWRRRHRSTPDIASE

SEQ ID NO: 318364 - protein, 21 aa, Mycobacterium
LRIVDCPDRRISRSAQLLVAK

SEQ ID NO: 318365 - protein, 22 aa, Mycobacterium
LRIVLLPQAFRAVVIPLGSVLI

SEQ ID NO: 318366 - protein, 20 aa, Mycobacterium
LRIVLVPVFVVVLFTEGGHQ

SEQ ID NO: 318367 - protein, 17 aa, Mycobacterium
LRIYLGAAPGVGKTYAM

SEQ ID NO: 318368 - protein, 21 aa, Mycobacterium
LRKAALELCAGQSADLAFEQR

SEQ ID NO: 318369 - protein, 18 aa, Mycobacterium
LRKAAMSYQGNWRDIVLL

SEQ ID NO: 318370 - protein, 23 aa, Mycobacterium
LRKAGYRPLIVVGDPLLMSNDVL

SEQ ID NO: 318371 - protein, 18 aa, Mycobacterium
LRKAPEAEWRDKKRHLWL

SEQ ID NO: 318372 - protein, 18 aa, Mycobacterium
LRKAVMLIGVLAAVVLLV

SEQ ID NO: 318373 - protein, 20 aa, Mycobacterium
LRKGAANAVADWVRTQGGEV

SEQ ID NO: 318374 - protein, 23 aa, Mycobacterium
LRKINALTPWHLVVSIAATVGLG

SEQ ID NO: 318375 - protein, 20 aa, Mycobacterium
LRKLAAAAFSPRAVAAMRSW

SEQ ID NO: 318376 - protein, 21 aa, Mycobacterium
LRKTWKPGSFSLRAATMPVAA

SEQ ID NO: 318377 - protein, 20 aa, Mycobacterium
LRLAALCGVLGALALLASAL

SEQ ID NO: 318378 - protein, 25 aa, Mycobacterium
LRLANTCVIFLFAAAVVVMALHDEG

SEQ ID NO: 318379 - protein, 21 aa, Mycobacterium
LRLASAQHAKAIIVATDDDAS

SEQ ID NO: 318380 - protein, 17 aa, Mycobacterium
LRLASRVLLLQLVLVTL

SEQ ID NO: 318381 - protein, 19 aa, Mycobacterium
LRLAVAVAVLDIFANITML

SEQ ID NO: 318382 - protein, 19 aa, Mycobacterium
LRLCQGFAVGGEWGGATLM

SEQ ID NO: 318383 - protein, 20 aa, Mycobacterium
LRLDGAMFFGAAERISNAIT

SEQ ID NO: 318384 - protein, 24 aa, Mycobacterium
LRLDLPCLLALTMTDELSARGGSI

SEQ ID NO: 318385 - protein, 20 aa, Mycobacterium
LRLEIAVVLAVTFGLSAYTA

SEQ ID NO: 318386 - protein, 17 aa, Mycobacterium
LRLELRLHDPRDSNVRL

SEQ ID NO: 318387 - protein, 18 aa, Mycobacterium
LRLFADRNFSLAGVGIAS

SEQ ID NO: 318388 - protein, 26 aa, Mycobacterium
LRLFRVPELLAGSFLLALLAVVAANF

SEQ ID NO: 318389 - protein, 21 aa, Mycobacterium
LRLGLMIGGSIALIPWITYLA

SEQ ID NO: 318390 - protein, 17 aa, Mycobacterium
LRLHRDVAIKVLRADLA

SEQ ID NO: 318391 - protein, 18 aa, Mycobacterium
LRLIEYLVKKMGFGLDKT

SEQ ID NO: 318392 - protein, 17 aa, Mycobacterium
LRLITFGADVSIFALNL

SEQ ID NO: 318393 - protein, 17 aa, Mycobacterium
LRLKVVDEVTDWKPVGR

SEQ ID NO: 318394 - protein, 17 aa, Mycobacterium
LRLLAPYLGLTLETSTL

SEQ ID NO: 318395 - protein, 30 aa, Mycobacterium
LRLLDTRWMPLPAFVIAMVLLRSSLAGFGH

SEQ ID NO: 318396 - protein, 18 aa, Mycobacterium
LRLLKRLAADPELPRRIR

SEQ ID NO: 318397 - protein, 17 aa, Mycobacterium
LRLLLIGSVVGTALGVA

SEQ ID NO: 318398 - protein, 17 aa, Mycobacterium
LRLLNMTGAVPIVAVIN

SEQ ID NO: 318399 - protein, 23 aa, Mycobacterium
LRLLPVMCVVYFMAYIDRTNVAL

SEQ ID NO: 318400 - protein, 20 aa, Mycobacterium
LRLLQGLAVGAEWGGAALLS

SEQ ID NO: 318401 - protein, 17 aa, Mycobacterium
LRLLSNITWGNGSIVVG

SEQ ID NO: 318402 - protein, 17 aa, Mycobacterium
LRLLTNRALTLANVAMF

SEQ ID NO: 318403 - protein, 20 aa, Mycobacterium
LRLLTRRFEPGPGDPEDTDD

SEQ ID NO: 318404 - protein, 19 aa, Mycobacterium
LRLNIFHLLGYLRAELLLV

SEQ ID NO: 318405 - protein, 17 aa, Mycobacterium
LRLPDPAVITLIIRKGR

SEQ ID NO: 318406 - protein, 19 aa, Mycobacterium
LRLPEHLAAAVAELEGQGR

SEQ ID NO: 318407 - protein, 20 aa, Mycobacterium
LRLPLPAPYVPSRTEALRDR

SEQ ID NO: 318408 - protein, 20 aa, Mycobacterium
LRLPPDTSRADREEVVAQVL

SEQ ID NO: 318409 - protein, 18 aa, Mycobacterium
LRLPTPVASLRTIVIVAA

SEQ ID NO: 318410 - protein, 19 aa, Mycobacterium
LRLPTWPAKLVLLASFAMF

SEQ ID NO: 318411 - protein, 18 aa, Mycobacterium
LRLQISRVVDGLSSLSTE

SEQ ID NO: 318412 - protein, 18 aa, Mycobacterium
LRLRGHADVSMIVLTGLF

SEQ ID NO: 318413 - protein, 22 aa, Mycobacterium
LRLRTDLSYGLYIYAFPTQQML

SEQ ID NO: 318414 - protein, 25 aa, Mycobacterium
LRLRVSGDGVGGWSLTVPEPGSVDA

SEQ ID NO: 318415 - protein, 21 aa, Mycobacterium
LRLSLIPIVLGLLIAVPLGAL

SEQ ID NO: 318416 - protein, 20 aa, Mycobacterium
LRLSLVPILIGLAIAIPCGA

SEQ ID NO: 318417 - protein, 17 aa, Mycobacterium
LRLSQIALFVLLTTFSL

SEQ ID NO: 318418 - protein, 19 aa, Mycobacterium
LRLSRIDKPGVARVLDVLH

SEQ ID NO: 318419 - protein, 24 aa, Mycobacterium
LRLTMMRLWLLRPGMRLWELPLFP

SEQ ID NO: 318420 - protein, 17 aa, Mycobacterium
LRLTPAVCAPIVVDAKH

SEQ ID NO: 318421 - protein, 19 aa, Mycobacterium
LRLVQGLAVGGEWSGAALL

SEQ ID NO: 318422 - protein, 19 aa, Mycobacterium
LRLYLRRDRVGLPLWVMLL

SEQ ID NO: 318423 - protein, 19 aa, Mycobacterium
LRMLRMRHDVTYRTRTEID

SEQ ID NO: 318424 - protein, 20 aa, Mycobacterium
LRMPFYRTVVSLVVWAIGSA

SEQ ID NO: 318425 - protein, 17 aa, Mycobacterium
LRMQETPVFTALQDSGQ

SEQ ID NO: 318426 - protein, 22 aa, Mycobacterium
LRNAGLRYALVRVRDAGSAIGL

SEQ ID NO: 318427 - protein, 20 aa, Mycobacterium
LRNALFDAFGPKGPDGKPSK

SEQ ID NO: 318428 - protein, 17 aa, Mycobacterium
LRNALFDAFGPKGTDGK

SEQ ID NO: 318429 - protein, 22 aa, Mycobacterium
LRNALRTHVGFVRSGMAPQLVP

SEQ ID NO: 318430 - protein, 19 aa, Mycobacterium
LRNALRTNPSLSHGGMPAR

SEQ ID NO: 318431 - protein, 19 aa, Mycobacterium
LRNDFSYGVYIYAFPIQQL

SEQ ID NO: 318432 - protein, 20 aa, Mycobacterium
LRNGECGLALAGGVTVMTTP

SEQ ID NO: 318433 - protein, 17 aa, Mycobacterium
LRNGINRILQFITYLLV

SEQ ID NO: 318434 - protein, 18 aa, Mycobacterium
LRNHIIIVGYGTKGRTAA

SEQ ID NO: 318435 - protein, 19 aa, Mycobacterium
LRNPAGLIAIERVTRHIMA

SEQ ID NO: 318436 - protein, 18 aa, Mycobacterium
LRNPRALADLDQMAERIS

SEQ ID NO: 318437 - protein, 26 aa, Mycobacterium
LRNPSWRPGVWLCSLAVAAAWGGILL

SEQ ID NO: 318438 - protein, 22 aa, Mycobacterium
LRNRPGHVAAFLGVLLGGGTVV

SEQ ID NO: 318439 - protein, 20 aa, Mycobacterium
LRNSNSWGLASPPRLDADLV

SEQ ID NO: 318440 - protein, 21 aa, Mycobacterium
LRNTFPGIILPLAGVAFGTFL

SEQ ID NO: 318441 - protein, 22 aa, Mycobacterium
LRNTHKYSWVSLGVCWLIWVLN

SEQ ID NO: 318442 - protein, 23 aa, Mycobacterium
LRNTRKPIFGVAMITPLVFAGAV

SEQ ID NO: 318443 - protein, 18 aa, Mycobacterium
LRNVHKLGPVIRLPLVLG

SEQ ID NO: 318444 - protein, 19 aa, Mycobacterium
LRNYFYWEKHCYDIPICWS

SEQ ID NO: 318445 - protein, 32 aa, Mycobacterium
LRNYFYWEQHCFDLPACSAIRSVFDALDGVDA

SEQ ID NO: 318446 - protein, 26 aa, Mycobacterium
LRPDLARLDALFARALATEPAGRFRT

SEQ ID NO: 318447 - protein, 21 aa, Mycobacterium
LRPDLARLDTALSRALSADPA

SEQ ID NO: 318448 - protein, 25 aa, Mycobacterium
LRPDRNIYVPLAFHLGYHSLPIGGV

SEQ ID NO: 318449 - protein, 19 aa, Mycobacterium
LRPDSAVVLVFISLKTTSK

SEQ ID NO: 318450 - protein, 26 aa, Mycobacterium
LRPEGLRRLSKVDAIVVDPRVLCTEK

SEQ ID NO: 318451 - protein, 19 aa, Mycobacterium
LRPEIAIALVTLAISPLPP

SEQ ID NO: 318452 - protein, 25 aa, Mycobacterium
LRPETAHTYTRCVGRVAGTAAGVVV

SEQ ID NO: 318453 - protein, 20 aa, Mycobacterium
LRPEVLTSVIDRMGARRRRA

SEQ ID NO: 318454 - protein, 25 aa, Mycobacterium
LRPFIELIRPIPAIALVPLTILLFP

SEQ ID NO: 318455 - protein, 20 aa, Mycobacterium
LRPGLPVVLMAVILYISGAL

SEQ ID NO: 318456 - protein, 18 aa, Mycobacterium
LRPGQPARRPGRRGRRQI

SEQ ID NO: 318457 - protein, 21 aa, Mycobacterium
LRPGRASRVLAHFSTAIEMLV

SEQ ID NO: 318458 - protein, 18 aa, Mycobacterium
LRPGRPSRWLAHVSTAIE

SEQ ID NO: 318459 - protein, 18 aa, Mycobacterium
LRPGWIALALVVIAFTYL

SEQ ID NO: 318460 - protein, 19 aa, Mycobacterium
LRPGWIVLALVVIAFAYLC

SEQ ID NO: 318461 - protein, 23 aa, Mycobacterium
LRPIRNYFYWEPHCDSIPVCQSI

SEQ ID NO: 318462 - protein, 20 aa, Mycobacterium
LRPLADGFIKLIKMLIAPII

SEQ ID NO: 318463 - protein, 35 aa, Mycobacterium
LRPLKNYFYWEPHCFDIPVCFAIRSLFDSLDGIDR

SEQ ID NO: 318464 - protein, 35 aa, Mycobacterium
LRPLKNYFYWEPHCFDIPVCFAMRSLFDSLDGIDS

SEQ ID NO: 318465 - protein, 20 aa, Mycobacterium
LRPLRRLAATAAEVAALPLA

SEQ ID NO: 318466 - protein, 24 aa, Mycobacterium
LRPLRRLAGIAAEVAAMPLTDDDH

SEQ ID NO: 318467 - protein, 17 aa, Mycobacterium
LRPLVGWVTRHSKAAAE

SEQ ID NO: 318468 - protein, 23 aa, Mycobacterium
LRPPFEIAVVLILVMFLAGTLAI

SEQ ID NO: 318469 - protein, 21 aa, Mycobacterium
LRPQFPGGLDATVLLLIVAIV

SEQ ID NO: 318470 - protein, 18 aa, Mycobacterium
LRPRDMFAHRTVEALAPL

SEQ ID NO: 318471 - protein, 18 aa, Mycobacterium
LRPRTLLSKVPFVVLVIG

SEQ ID NO: 318472 - protein, 19 aa, Mycobacterium
LRPSLLPKLMAHVGGTTAE

SEQ ID NO: 318473 - protein, 22 aa, Mycobacterium
LRPTAAPAHRWGLGAFVLVELV

SEQ ID NO: 318474 - protein, 17 aa, Mycobacterium
LRPTTFFLSITVLINSL

SEQ ID NO: 318475 - protein, 17 aa, Mycobacterium
LRPTVAIALVTLAISPL

SEQ ID NO: 318476 - protein, 21 aa, Mycobacterium
LRPVLWVVGFIFVLQVALTGW

SEQ ID NO: 318477 - protein, 17 aa, Mycobacterium
LRPVRADSAIGLPAGGW

SEQ ID NO: 318478 - protein, 20 aa, Mycobacterium
LRPYGPRPAVRELILNDVEE

SEQ ID NO: 318479 - protein, 25 aa, Mycobacterium
LRPYGPRPAVRELLLKNVEEHPAGG

SEQ ID NO: 318480 - protein, 22 aa, Mycobacterium
LRPYGPRPAVRQLLLWDDDDHA

SEQ ID NO: 318481 - protein, 19 aa, Mycobacterium
LRPYLVQVIARPKHEQYAR

SEQ ID NO: 318482 - protein, 32 aa, Mycobacterium
LRQAQIIAAPTFEFFALYGTAAVYYWVICLVL

SEQ ID NO: 318483 - protein, 20 aa, Mycobacterium
LRQLALLWLADQVDAALEKY

SEQ ID NO: 318484 - protein, 23 aa, Mycobacterium
LRQLFTVRIGLRLTEATQTTMVL

SEQ ID NO: 318485 - protein, 19 aa, Mycobacterium
LRQLGCSTGTMADYGPDFG

SEQ ID NO: 318486 - protein, 30 aa, Mycobacterium
LRQLILGGIDGRLWQAITVLVAMTAVALAI

SEQ ID NO: 318487 - protein, 19 aa, Mycobacterium
LRQLRWALSEVQRGNYNAH

SEQ ID NO: 318488 - protein, 18 aa, Mycobacterium
LRQQRIWGASTVVASWQL

SEQ ID NO: 318489 - protein, 21 aa, Mycobacterium
LRRAGAAAVHPVGFDADDLAS

SEQ ID NO: 318490 - protein, 17 aa, Mycobacterium
LRRALQIQHRVVADVVV

SEQ ID NO: 318491 - protein, 21 aa, Mycobacterium
LRRAPQAGGREVLRVEVTAPS

SEQ ID NO: 318492 - protein, 19 aa, Mycobacterium
LRRAVRMAGPAIVASNATV

SEQ ID NO: 318493 - protein, 23 aa, Mycobacterium
LRRDGRPALIVFGSLTCPITESA

SEQ ID NO: 318494 - protein, 18 aa, Mycobacterium
LRRDLTWWDLTVFGVSVV

SEQ ID NO: 318495 - protein, 22 aa, Mycobacterium
LRRDRTSFIIAHRLSTIRDADR

SEQ ID NO: 318496 - protein, 23 aa, Mycobacterium
LRRDRTSFIIAHRLSTIRDADTI

SEQ ID NO: 318497 - protein, 30 aa, Mycobacterium
LRREARSLLISLLRPYRWIVAVLALVVIVE

SEQ ID NO: 318498 - protein, 25 aa, Mycobacterium
LRREFSLGSAFAFAFAFISPIVALY

SEQ ID NO: 318499 - protein, 18 aa, Mycobacterium
LRRFDRLPTAPKEIPAIE

SEQ ID NO: 318500 - protein, 20 aa, Mycobacterium
LRRFGRGRTLGMALGGAVVL

SEQ ID NO: 318501 - protein, 19 aa, Mycobacterium
LRRFLCAHSTVVAPIAIGL

SEQ ID NO: 318502 - protein, 19 aa, Mycobacterium
LRRFSYLLLQVAIALMVII

SEQ ID NO: 318503 - protein, 26 aa, Mycobacterium
LRRGPRVTLWQFHWVVIVATLQITLA

SEQ ID NO: 318504 - protein, 21 aa, Mycobacterium
LRRGRTNFIIAHRLSTVRAAD

SEQ ID NO: 318505 - protein, 18 aa, Mycobacterium
LRRGVAIVNSPLVHIGGV

SEQ ID NO: 318506 - protein, 18 aa, Mycobacterium
LRRGVAIVNSPLVHVGGV

SEQ ID NO: 318507 - protein, 20 aa, Mycobacterium
LRRHILPNIAGPLIVQTSLS

SEQ ID NO: 318508 - protein, 21 aa, Mycobacterium
LRRHPQLRAGFRTVEHAEPEP

SEQ ID NO: 318509 - protein, 19 aa, Mycobacterium
LRRHTRMIQVIGGIALLAV

SEQ ID NO: 318510 - protein, 19 aa, Mycobacterium
LRRIPQFELACGYTPEIDW

SEQ ID NO: 318511 - protein, 17 aa, Mycobacterium
LRRIPSWSKTLRVSSPE

SEQ ID NO: 318512 - protein, 18 aa, Mycobacterium
LRRLARRLLPALIVVLGG

SEQ ID NO: 318513 - protein, 25 aa, Mycobacterium
LRRLGYRSRPLWRPFTRVGTVSAQQ

SEQ ID NO: 318514 - protein, 19 aa, Mycobacterium
LRRLLISLALILAVVIAIV

SEQ ID NO: 318515 - protein, 17 aa, Mycobacterium
LRRLRPLTVTALVAGAV

SEQ ID NO: 318516 - protein, 22 aa, Mycobacterium
LRRMKLVALSFLLGATVVFLAC

SEQ ID NO: 318517 - protein, 25 aa, Mycobacterium
LRRNGIPNTNLRAVAIVGGGASIPL

SEQ ID NO: 318518 - protein, 17 aa, Mycobacterium
LRRNRLRAWEARLEAVM

SEQ ID NO: 318519 - protein, 19 aa, Mycobacterium
LRRPQFRALWVFVLIPVLI

SEQ ID NO: 318520 - protein, 23 aa, Mycobacterium
LRRPQYRPLWVFLLLPVLILLTV

SEQ ID NO: 318521 - protein, 23 aa, Mycobacterium
LRRPQYRPLWVFLLVPVLILLTV

SEQ ID NO: 318522 - protein, 20 aa, Mycobacterium
LRRPQYRSLWVFLLLPVLIL

SEQ ID NO: 318523 - protein, 19 aa, Mycobacterium
LRRPQYRTLWVFVLVPVLI

SEQ ID NO: 318524 - protein, 26 aa, Mycobacterium
LRRRGWIAVMSMRLIPAVPFSVLNYA

SEQ ID NO: 318525 - protein, 32 aa, Mycobacterium
LRRRGWLAIVSLRLIPAVPFSALNYAAGASSV

SEQ ID NO: 318526 - protein, 18 aa, Mycobacterium
LRRRIRITSSLAIVGLIY

SEQ ID NO: 318527 - protein, 19 aa, Mycobacterium
LRRRIRLAVFLVVTVELSG

SEQ ID NO: 318528 - protein, 23 aa, Mycobacterium
LRRRLSAGLLLLIGLAVAGGVAA

SEQ ID NO: 318529 - protein, 22 aa, Mycobacterium
LRRRPAQSVAIAVIVMLGVLLF

SEQ ID NO: 318530 - protein, 26 aa, Mycobacterium
LRRRRFRWCCGAAYTAALSTVTSLAA

SEQ ID NO: 318531 - protein, 20 aa, Mycobacterium
LRRRRRPAKRKPLLPDDQKS

SEQ ID NO: 318532 - protein, 20 aa, Mycobacterium
LRRSILPLLLVASLAVSGFL

SEQ ID NO: 318533 - protein, 20 aa, Mycobacterium
LRRTAARVCRVLAYRLEGSA

SEQ ID NO: 318534 - protein, 26 aa, Mycobacterium
LRRTDCVLIDLRLLKYRSVAAANATR

SEQ ID NO: 318535 - protein, 32 aa, Mycobacterium
LRRTGFLWWRCWPRLIGIWLAGWLVRHWLIKL

SEQ ID NO: 318536 - protein, 25 aa, Mycobacterium
LRRTRPDLERGFRAPWVPVLPIASI

SEQ ID NO: 318537 - protein, 17 aa, Mycobacterium
LRRTRRAISELLRGSQD

SEQ ID NO: 318538 - protein, 20 aa, Mycobacterium
LRRVCPGDIVVLDVLDLDRI

SEQ ID NO: 318539 - protein, 23 aa, Mycobacterium
LRRVDDKVICLVRGKSDEDARRR

SEQ ID NO: 318540 - protein, 23 aa, Mycobacterium
LRRVELPLSLPVIVAGVRTALVL

SEQ ID NO: 318541 - protein, 21 aa, Mycobacterium
LRSAAPVRSRVVAWALWDCGS

SEQ ID NO: 318542 - protein, 17 aa, Mycobacterium
LRSAERLAPLIGQHHRP

SEQ ID NO: 318543 - protein, 18 aa, Mycobacterium
LRSAFLLDTSRFAVHVIE

SEQ ID NO: 318544 - protein, 17 aa, Mycobacterium
LRSAIGLEAQRIRRLGK

SEQ ID NO: 318545 - protein, 17 aa, Mycobacterium
LRSAIGLEAQRLRRQGR

SEQ ID NO: 318546 - protein, 19 aa, Mycobacterium
LRSDCRNAKEALSADTVAT

SEQ ID NO: 318547 - protein, 22 aa, Mycobacterium
LRSDDLVHVMMLRKKPGGPVAV

SEQ ID NO: 318548 - protein, 25 aa, Mycobacterium
LRSELPGCTLVSVGHRSTIDQHHNQ

SEQ ID NO: 318549 - protein, 18 aa, Mycobacterium
LRSGDWGGAAVAAANGLN

SEQ ID NO: 318550 - protein, 24 aa, Mycobacterium
LRSIIAPIYLVLSVVLSYMSALGI

SEQ ID NO: 318551 - protein, 24 aa, Mycobacterium
LRSINARVPLVWPAAIVAIVSMAY

SEQ ID NO: 318552 - protein, 24 aa, Mycobacterium
LRSLAELWPYASGTLCRPDGDNET

SEQ ID NO: 318553 - protein, 24 aa, Mycobacterium
LRSLLCITPSMLIVRLAERRSDLV

SEQ ID NO: 318554 - protein, 21 aa, Mycobacterium
LRSLMRSVLCSLAVFHNPRDL

SEQ ID NO: 318555 - protein, 20 aa, Mycobacterium
LRSPGPLGIIFSLVCIGIAA

SEQ ID NO: 318556 - protein, 28 aa, Mycobacterium
LRSPGVILRLMLAWVLSTAVPLLAIVLA

SEQ ID NO: 318557 - protein, 22 aa, Mycobacterium
LRSQRWWWGTVLLAASIGLQAA

SEQ ID NO: 318558 - protein, 25 aa, Mycobacterium
LRSRIGMVLQDTWLFAGTIYDNIAY

SEQ ID NO: 318559 - protein, 25 aa, Mycobacterium
LRSRIGMVLQDTWLFDGTIADNIAY

SEQ ID NO: 318560 - protein, 25 aa, Mycobacterium
LRSRIGMVLQDTWLFDGTIAENIAY

SEQ ID NO: 318561 - protein, 25 aa, Mycobacterium
LRSRIGMVLQDTWLLAGTIAENIGY

SEQ ID NO: 318562 - protein, 17 aa, Mycobacterium
LRSRIVRIMPGYLVAVV

SEQ ID NO: 318563 - protein, 20 aa, Mycobacterium
LRSRIVRIMPGYVVAVIVIL

SEQ ID NO: 318564 - protein, 18 aa, Mycobacterium
LRSRLLIAVLAVLATSVL

SEQ ID NO: 318565 - protein, 17 aa, Mycobacterium
LRSRVVRIMPAYLVAVV

SEQ ID NO: 318566 - protein, 19 aa, Mycobacterium
LRSRVVRIMPAYVVAVVVI

SEQ ID NO: 318567 - protein, 18 aa, Mycobacterium
LRSRWVTIAAVPRGGGVG

SEQ ID NO: 318568 - protein, 18 aa, Mycobacterium
LRSTRSLDLQYRDDHWKI

SEQ ID NO: 318569 - protein, 27 aa, Mycobacterium
LRSVGVTTLNLWVGVGFVLSPLLIAWS

SEQ ID NO: 318570 - protein, 20 aa, Mycobacterium
LRSVLEPWLTFLRALPPLAY

SEQ ID NO: 318571 - protein, 24 aa, Mycobacterium
LRTAGRGFILFGLLAPNLFATLGI

SEQ ID NO: 318572 - protein, 17 aa, Mycobacterium
LRTALAESLPAYMVPTA

SEQ ID NO: 318573 - protein, 23 aa, Mycobacterium
LRTANNMDLLFAVLPGMAGLVLL

SEQ ID NO: 318574 - protein, 26 aa, Mycobacterium
LRTARAVVLPQWLFSALFTPAIRLTN

SEQ ID NO: 318575 - protein, 26 aa, Mycobacterium
LRTATLQRLLPRLGLTAQADQAAVAA

SEQ ID NO: 318576 - protein, 20 aa, Mycobacterium
LRTAYQKALASNEIDFVWIT

SEQ ID NO: 318577 - protein, 30 aa, Mycobacterium
LRTDGVRASALWLMRGWLPALVAVIAVCAV

SEQ ID NO: 318578 - protein, 24 aa, Mycobacterium
LRTETRSRWILVNLRHDVPASLVV

SEQ ID NO: 318579 - protein, 17 aa, Mycobacterium
LRTGARSSVAVPMFHGF

SEQ ID NO: 318580 - protein, 23 aa, Mycobacterium
LRTGEPAAEMALRAFPATLQLAV

SEQ ID NO: 318581 - protein, 17 aa, Mycobacterium
LRTGIIRAFGGTGGVVT

SEQ ID NO: 318582 - protein, 29 aa, Mycobacterium
LRTGLLRKLSRLPLGWFTARGSGSIKQLL

SEQ ID NO: 318583 - protein, 22 aa, Mycobacterium
LRTIHQNLGWAFGYNTAAIPLA

SEQ ID NO: 318584 - protein, 18 aa, Mycobacterium
LRTIVIVAALSVVAVVIF

SEQ ID NO: 318585 - protein, 18 aa, Mycobacterium
LRTLAGFGSMFPVAAGAV

SEQ ID NO: 318586 - protein, 18 aa, Mycobacterium
LRTLPMVAGLLITSTGSG

SEQ ID NO: 318587 - protein, 18 aa, Mycobacterium
LRTLPMVVGMLVTSTGSG

SEQ ID NO: 318588 - protein, 21 aa, Mycobacterium
LRTMFSAALAIAALAAIESLL

SEQ ID NO: 318589 - protein, 22 aa, Mycobacterium
LRTNPSLSHGGMPARLVPDAVA

SEQ ID NO: 318590 - protein, 18 aa, Mycobacterium
LRTPANMLVLDRIAKNVF

SEQ ID NO: 318591 - protein, 18 aa, Mycobacterium
LRTPDRFARPGPSRRIMT

SEQ ID NO: 318592 - protein, 17 aa, Mycobacterium
LRTPLAAIHGYAELTRQ

SEQ ID NO: 318593 - protein, 18 aa, Mycobacterium
LRTPLTAMRADLDTLRAH

SEQ ID NO: 318594 - protein, 17 aa, Mycobacterium
LRTPLTAMRTNLEVLAT

SEQ ID NO: 318595 - protein, 17 aa, Mycobacterium
LRTPLTAMRTNLEVLHT

SEQ ID NO: 318596 - protein, 24 aa, Mycobacterium
LRTQSRAVLMGALVLITGLVGCFV

SEQ ID NO: 318597 - protein, 22 aa, Mycobacterium
LRTQTWTSYNFFAFWMSDVHSV

SEQ ID NO: 318598 - protein, 18 aa, Mycobacterium
LRTRLLISLAAILLTTIF

SEQ ID NO: 318599 - protein, 18 aa, Mycobacterium
LRTRLLISVAAVLLTTIV

SEQ ID NO: 318600 - protein, 28 aa, Mycobacterium
LRTRLLRAMGPQARRLVVAAPFAGEGTT

SEQ ID NO: 318601 - protein, 25 aa, Mycobacterium
LRTSDGLRLGEPVRLSVHSNAYGKV

SEQ ID NO: 318602 - protein, 19 aa, Mycobacterium
LRTTITWIAVPSVLWIAFA

SEQ ID NO: 318603 - protein, 19 aa, Mycobacterium
LRTVFTIAPIVFGLDKFFN

SEQ ID NO: 318604 - protein, 17 aa, Mycobacterium
LRTVLRSPAGAAFGPVL

SEQ ID NO: 318605 - protein, 38 aa, Mycobacterium
LRTVSRFSWRRPWLVIGSWLAVLVILNLGIPQLETTVA

SEQ ID NO: 318606 - protein, 20 aa, Mycobacterium
LRTVVAPALRLSHTDQQSLV

SEQ ID NO: 318607 - protein, 19 aa, Mycobacterium
LRVAGWMRRGTRTMSRGRK

SEQ ID NO: 318608 - protein, 18 aa, Mycobacterium
LRVALSEMWAHPVELGNY

SEQ ID NO: 318609 - protein, 20 aa, Mycobacterium
LRVALSEMWAHPVQRVGYVR

SEQ ID NO: 318610 - protein, 20 aa, Mycobacterium
LRVAPGAGLTARIDIDTRFI

SEQ ID NO: 318611 - protein, 19 aa, Mycobacterium
LRVARRCAPGRGPIYRGRH

SEQ ID NO: 318612 - protein, 22 aa, Mycobacterium
LRVELPLAVPYILAGLRTSLVL

SEQ ID NO: 318613 - protein, 19 aa, Mycobacterium
LRVEPDAAFGGWLMPVVPP

SEQ ID NO: 318614 - protein, 23 aa, Mycobacterium
LRVETPNALPLILGGLRTATLQI

SEQ ID NO: 318615 - protein, 20 aa, Mycobacterium
LRVFGMPSLIPPVSIPTIAP

SEQ ID NO: 318616 - protein, 17 aa, Mycobacterium
LRVGRDRWFNLLWLIPI

SEQ ID NO: 318617 - protein, 20 aa, Mycobacterium
LRVGVMTPMGFLRDPISWLR

SEQ ID NO: 318618 - protein, 19 aa, Mycobacterium
LRVIAEWNPVSSLAQAMRE

SEQ ID NO: 318619 - protein, 25 aa, Mycobacterium
LRVIQGIAIGGEWGGATLMVTEHAE

SEQ ID NO: 318620 - protein, 17 aa, Mycobacterium
LRVLAIARRCGAPRNAG

SEQ ID NO: 318621 - protein, 21 aa, Mycobacterium
LRVLFQWRWSIATLWFTAVFL

SEQ ID NO: 318622 - protein, 24 aa, Mycobacterium
LRVLPLPRRLAGLLEAESGFNDAP

SEQ ID NO: 318623 - protein, 20 aa, Mycobacterium
LRVLPLPRRVAGLLEAESGF

SEQ ID NO: 318624 - protein, 23 aa, Mycobacterium
LRVLPLPRRVAGLLEAESGFNDA

SEQ ID NO: 318625 - protein, 21 aa, Mycobacterium
LRVMFEPMLIILNGIPKIVLY

SEQ ID NO: 318626 - protein, 17 aa, Mycobacterium
LRVMLIIALVFLALGYS

SEQ ID NO: 318627 - protein, 22 aa, Mycobacterium
LRVPALNALFPSYRTSVLDALG

SEQ ID NO: 318628 - protein, 34 aa, Mycobacterium
LRVPDSWAISFLYLCCSGSFLGFAFAFGQVLVHN

SEQ ID NO: 318629 - protein, 34 aa, Mycobacterium
LRVPDSWGIAFLYLCCSGSFLGFAFAFGQVLQHN

SEQ ID NO: 318630 - protein, 21 aa, Mycobacterium
LRVPELFTLEGHYHFTRGWNV

SEQ ID NO: 318631 - protein, 17 aa, Mycobacterium
LRVQRIIAAAVILTQGG

SEQ ID NO: 318632 - protein, 17 aa, Mycobacterium
LRVSAPINRQLTAGADQ

SEQ ID NO: 318633 - protein, 17 aa, Mycobacterium
LRVSGRLDQVLATAGAE

SEQ ID NO: 318634 - protein, 20 aa, Mycobacterium
LRVSGRLDSVIATFERHHRA

SEQ ID NO: 318635 - protein, 20 aa, Mycobacterium
LRVSQVHPAPGYSREEVLRC

SEQ ID NO: 318636 - protein, 25 aa, Mycobacterium
LRVSRASEYERFRLAAASDGVPTRI

SEQ ID NO: 318637 - protein, 17 aa, Mycobacterium
LRVVGQIGTTIMIGLLF

SEQ ID NO: 318638 - protein, 17 aa, Mycobacterium
LRVVGQLGMTIGIGLVV

SEQ ID NO: 318639 - protein, 29 aa, Mycobacterium
LRVVHRSKCGYLWSHHLPIAARAGLSESE

SEQ ID NO: 318640 - protein, 17 aa, Mycobacterium
LRVVKSFGREDYVFDRF

SEQ ID NO: 318641 - protein, 24 aa, Mycobacterium
LRVVLPGSLPGVFGGLSVGIGVAW

SEQ ID NO: 318642 - protein, 21 aa, Mycobacterium
LRWGLLAVWGPGLVVMLADTD

SEQ ID NO: 318643 - protein, 23 aa, Mycobacterium
LRYFPDLVVVLALLAAVALCAPN

SEQ ID NO: 318644 - protein, 23 aa, Mycobacterium
LRYFPDLVVVLALLAAVALTAAN

SEQ ID NO: 318645 - protein, 22 aa, Mycobacterium
LRYILLPQAFRAVIIPLGSVLI

SEQ ID NO: 318646 - protein, 21 aa, Mycobacterium
LRYLAGDRRSGWFTAGTGLLT

SEQ ID NO: 318647 - protein, 19 aa, Mycobacterium
LRYLHWASGAVRGDFGTTV

SEQ ID NO: 318648 - protein, 21 aa, Mycobacterium
LRYLPDLVLVLALLAAVGLCA

SEQ ID NO: 318649 - protein, 21 aa, Mycobacterium
LRYLPDLVMVLALLTAVGFCA

SEQ ID NO: 318650 - protein, 23 aa, Mycobacterium
LRYLPDLVVVLALLGAVACTAPN

SEQ ID NO: 318651 - protein, 22 aa, Mycobacterium
LRYPEDLFKVQRMLLAKYHVND

SEQ ID NO: 318652 - protein, 23 aa, Mycobacterium
LRYVPKFPGARMRFDLAGAAALT

SEQ ID NO: 318653 - protein, 25 aa, Mycobacterium
LRYYRKEILRLIAQIGMGTGAMAVV

SEQ ID NO: 318654 - protein, 18 aa, Mycobacterium
LSAAIAVALGLWPRLKEY

SEQ ID NO: 318655 - protein, 24 aa, Mycobacterium
LSAAIPAIPAWVFILIAIAIVTVL

SEQ ID NO: 318656 - protein, 19 aa, Mycobacterium
LSAALAMQLFIVVGGVTKL

SEQ ID NO: 318657 - protein, 19 aa, Mycobacterium
LSAALLFPAVVCAVSAVLC

SEQ ID NO: 318658 - protein, 17 aa, Mycobacterium
LSAAPAPVAAAFDEEVR

SEQ ID NO: 318659 - protein, 25 aa, Mycobacterium
LSAARGMVAFLGYFKLIGLSTFATN

SEQ ID NO: 318660 - protein, 23 aa, Mycobacterium
LSAARGMVAFLGYFQLIGLSTFA

SEQ ID NO: 318661 - protein, 19 aa, Mycobacterium
LSAAVVVAVLGLWLLTRPH

SEQ ID NO: 318662 - protein, 25 aa, Mycobacterium
LSADARRPTSASSRKKAPEPDTAEA

SEQ ID NO: 318663 - protein, 18 aa, Mycobacterium
LSAEPALYNEVWSWTTKA

SEQ ID NO: 318664 - protein, 24 aa, Mycobacterium
LSAFIPRWWAQRIADMSGHGSFTK

SEQ ID NO: 318665 - protein, 19 aa, Mycobacterium
LSAFLSYFAQILMAVLMAT

SEQ ID NO: 318666 - protein, 23 aa, Mycobacterium
LSAFLWSLYALFFGTAGTPGMKH

SEQ ID NO: 318667 - protein, 19 aa, Mycobacterium
LSAFRLVYGLLFAAYGSRS

SEQ ID NO: 318668 - protein, 18 aa, Mycobacterium
LSAFVVFSSMAGIVGTPG

SEQ ID NO: 318669 - protein, 26 aa, Mycobacterium
LSAGAVLFLLAGRRLWHRFRGQPDRA

SEQ ID NO: 318670 - protein, 20 aa, Mycobacterium
LSAGIAALVTHEFQSHGVSN

SEQ ID NO: 318671 - protein, 19 aa, Mycobacterium
LSAGSWRDGVGTRRTAAGR

SEQ ID NO: 318672 - protein, 18 aa, Mycobacterium
LSAHAMGAEFGQLKSLAR

SEQ ID NO: 318673 - protein, 17 aa, Mycobacterium
LSAIAMVVFFVSKFTEG

SEQ ID NO: 318674 - protein, 18 aa, Mycobacterium
LSAIPMGVPLEWNVFMIF

SEQ ID NO: 318675 - protein, 18 aa, Mycobacterium
LSAIPMGVPLEWNVFMMF

SEQ ID NO: 318676 - protein, 18 aa, Mycobacterium
LSAIRLALIPVFIYALLV

SEQ ID NO: 318677 - protein, 25 aa, Mycobacterium
LSAIYILWMYQRMMTGPVPPSLSEG

SEQ ID NO: 318678 - protein, 21 aa, Mycobacterium
LSALARTVGYGSPVTIAAPAY

SEQ ID NO: 318679 - protein, 24 aa, Mycobacterium
LSALDRMLPVWIGIAMVAGLLLGR

SEQ ID NO: 318680 - protein, 21 aa, Mycobacterium
LSALERLRDFAVFKAIGTPTR

SEQ ID NO: 318681 - protein, 19 aa, Mycobacterium
LSALGDVVYAFWVPNAQSP

SEQ ID NO: 318682 - protein, 17 aa, Mycobacterium
LSALLLGAASTRRRKQD

SEQ ID NO: 318683 - protein, 19 aa, Mycobacterium
LSALLLGAASTRRRKQDEQ

SEQ ID NO: 318684 - protein, 22 aa, Mycobacterium
LSALLRPLAIQRRTLRLDLPVM

SEQ ID NO: 318685 - protein, 18 aa, Mycobacterium
LSALPTLFIIVDEFSELL

SEQ ID NO: 318686 - protein, 26 aa, Mycobacterium
LSALSRAVGVAWRRSLQLRVVALTLG

SEQ ID NO: 318687 - protein, 19 aa, Mycobacterium
LSALVPWAILALEPSGARL

SEQ ID NO: 318688 - protein, 19 aa, Mycobacterium
LSALWLVVLILAMLAHWLR

SEQ ID NO: 318689 - protein, 24 aa, Mycobacterium
LSAMCARLPVPVIPAPGDPAPSAL

SEQ ID NO: 318690 - protein, 19 aa, Mycobacterium
LSAMLGGWLAVLGGAWFVV

SEQ ID NO: 318691 - protein, 18 aa, Mycobacterium
LSAMPSFGMVLTLIAWGA

SEQ ID NO: 318692 - protein, 17 aa, Mycobacterium
LSAMPSFGMVVTLIAWG

SEQ ID NO: 318693 - protein, 20 aa, Mycobacterium
LSAPGGLAVDSWMCAISGRA

SEQ ID NO: 318694 - protein, 18 aa, Mycobacterium
LSARGLRVLATAVRAGAD

SEQ ID NO: 318695 - protein, 20 aa, Mycobacterium
LSARGLVGLARVITAVTAAG

SEQ ID NO: 318696 - protein, 24 aa, Mycobacterium
LSARMPGWQVIAWGVVLAAPVNLL

SEQ ID NO: 318697 - protein, 22 aa, Mycobacterium
LSARRLLPALALFAAAGMGVTL

SEQ ID NO: 318698 - protein, 25 aa, Mycobacterium
LSATFLFRQQRLWGASTVVASWQLV

SEQ ID NO: 318699 - protein, 29 aa, Mycobacterium
LSATKAALWLSVTAFLALAVLYFVGLDQG

SEQ ID NO: 318700 - protein, 24 aa, Mycobacterium
LSATKAAVWLSLTAFFALVVLYFI

SEQ ID NO: 318701 - protein, 25 aa, Mycobacterium
LSATVMAFVLLRRIPTWQPWLRWVL

SEQ ID NO: 318702 - protein, 33 aa, Mycobacterium
LSAVLCPLLVFGWLGCPELGLPGSAVANVAGQY

SEQ ID NO: 318703 - protein, 24 aa, Mycobacterium
LSAVSSRAGVEIAIDDNGSGVPED

SEQ ID NO: 318704 - protein, 25 aa, Mycobacterium
LSAVSSRAGVEIAIDDNGSGVPEEE

SEQ ID NO: 318705 - protein, 20 aa, Mycobacterium
LSAVSSRAGVEIAVDDNGSG

SEQ ID NO: 318706 - protein, 17 aa, Mycobacterium
LSAWPAWLNLTAAMVVV

SEQ ID NO: 318707 - protein, 19 aa, Mycobacterium
LSAWPSWVNLTAAMMLVFF

SEQ ID NO: 318708 - protein, 21 aa, Mycobacterium
LSAYDKTTCERLWKMPSSGAD

SEQ ID NO: 318709 - protein, 17 aa, Mycobacterium
LSCMAFGTVTAALFLLR

SEQ ID NO: 318710 - protein, 17 aa, Mycobacterium
LSDAAAFLLSMKLNASK

SEQ ID NO: 318711 - protein, 17 aa, Mycobacterium
LSDAALVSRSWGMAFAT

SEQ ID NO: 318712 - protein, 17 aa, Mycobacterium
LSDAALVSRSWGMALAT

SEQ ID NO: 318713 - protein, 25 aa, Mycobacterium
LSDAKKVLSSWLPPGPVAIADYPAV

SEQ ID NO: 318714 - protein, 31 aa, Mycobacterium
LSDAVNLIVRFKDFLIPLVAGLAAYKTVMLA

SEQ ID NO: 318715 - protein, 22 aa, Mycobacterium
LSDDELFFFAVLLLVAGYESTA

SEQ ID NO: 318716 - protein, 22 aa, Mycobacterium
LSDEDGRIAVALGIGAGIGAIF

SEQ ID NO: 318717 - protein, 22 aa, Mycobacterium
LSDETWAALGERLDDRQRMDFV

SEQ ID NO: 318718 - protein, 22 aa, Mycobacterium
LSDETWAALGERLDDRQRMDYV

SEQ ID NO: 318719 - protein, 23 aa, Mycobacterium
LSDGEIDVSAWLALAFGAVLVGQ

SEQ ID NO: 318720 - protein, 24 aa, Mycobacterium
LSDLERGWTLYAHQPVRGIPLDEW

SEQ ID NO: 318721 - protein, 26 aa, Mycobacterium
LSDRLGRRGPLLVGIVACLVASLLCA

SEQ ID NO: 318722 - protein, 31 aa, Mycobacterium
LSDRYGGGWKRARFQVPLVIGYTALSFVSGL

SEQ ID NO: 318723 - protein, 20 aa, Mycobacterium
LSEALFKTAFYAVIAALLVA

SEQ ID NO: 318724 - protein, 21 aa, Mycobacterium
LSEALPALAGALTVNVIAMIE

SEQ ID NO: 318725 - protein, 29 aa, Mycobacterium
LSEATSWPTWAVVAVTLVFALLVGAVVRG

SEQ ID NO: 318726 - protein, 25 aa, Mycobacterium
LSEGAKWDLLIAGIASLCLIFIIML

SEQ ID NO: 318727 - protein, 19 aa, Mycobacterium
LSEGELFAGYTIVRRLGAG

SEQ ID NO: 318728 - protein, 18 aa, Mycobacterium
LSELMGGPDIEPVQSTLQ

SEQ ID NO: 318729 - protein, 26 aa, Mycobacterium
LSERGPRSGLMFLALMCTVAAVASAL

SEQ ID NO: 318730 - protein, 34 aa, Mycobacterium
LSERRYVVLCVHHIPAALLVLLSLEFVPRPRRMR

SEQ ID NO: 318731 - protein, 27 aa, Mycobacterium
LSERSRQGWKIQRWRSRVRNHTIVIGY

SEQ ID NO: 318732 - protein, 28 aa, Mycobacterium
LSERSRQGWKIQRWRSRVRNHTIVIGYG

SEQ ID NO: 318733 - protein, 23 aa, Mycobacterium
LSEVTKFAALIVFGALITPDRLS

SEQ ID NO: 318734 - protein, 23 aa, Mycobacterium
LSFERWAPDMPWEVSTGKAVSPG

SEQ ID NO: 318735 - protein, 18 aa, Mycobacterium
LSFERWAPGMPWEVSTGK

SEQ ID NO: 318736 - protein, 17 aa, Mycobacterium
LSFEVRGGLFVRQIHHW

SEQ ID NO: 318737 - protein, 17 aa, Mycobacterium
LSFGCVAALLAGGVVGG

SEQ ID NO: 318738 - protein, 17 aa, Mycobacterium
LSFGGMFIGLSVYQIEY

SEQ ID NO: 318739 - protein, 25 aa, Mycobacterium
LSFHIAIPICTMAVFTAATALGVLA

SEQ ID NO: 318740 - protein, 17 aa, Mycobacterium
LSFHTRLPVLTVSQPAC

SEQ ID NO: 318741 - protein, 17 aa, Mycobacterium
LSFRLQPTLTILLAAAG

SEQ ID NO: 318742 - protein, 17 aa, Mycobacterium
LSFRLVPTLTVLLAAAG

SEQ ID NO: 318743 - protein, 26 aa, Mycobacterium
LSFTRFTLLMALPWVGVVVTLYAVFR

SEQ ID NO: 318744 - protein, 36 aa, Mycobacterium
LSFTRMPIFQTMGLPCSLGMLISVLIALTLVPAVLT

SEQ ID NO: 318745 - protein, 18 aa, Mycobacterium
LSFTRMPYFQTLGIPCSV

SEQ ID NO: 318746 - protein, 19 aa, Mycobacterium
LSFTRMPYFQTLGVPCAVA

SEQ ID NO: 318747 - protein, 19 aa, Mycobacterium
LSFTRMPYFQTLGVPCSVG

SEQ ID NO: 318748 - protein, 17 aa, Mycobacterium
LSFVRRPLALVGNLVAL

SEQ ID NO: 318749 - protein, 17 aa, Mycobacterium
LSFYAFYSGLGIPLPAG

SEQ ID NO: 318750 - protein, 26 aa, Mycobacterium
LSGAAWGLSSLRVVKDSATLPTSLTS

SEQ ID NO: 318751 - protein, 27 aa, Mycobacterium
LSGACLRIPYTLGIATFGGRNWTTFSA

SEQ ID NO: 318752 - protein, 18 aa, Mycobacterium
LSGAPGWVSLGCFLVALV

SEQ ID NO: 318753 - protein, 21 aa, Mycobacterium
LSGAVSWFIGLFYKSIYTESL

SEQ ID NO: 318754 - protein, 17 aa, Mycobacterium
LSGCGAASFLLYGLLDL

SEQ ID NO: 318755 - protein, 24 aa, Mycobacterium
LSGCSWEDVLGLGWPKGITPQAHY

SEQ ID NO: 318756 - protein, 18 aa, Mycobacterium
LSGDRWTPVLAVASLDGQ

SEQ ID NO: 318757 - protein, 17 aa, Mycobacterium
LSGFAVLAAGLWAGFLW

SEQ ID NO: 318758 - protein, 20 aa, Mycobacterium
LSGFEHPWFFLFFFVVIGLV

SEQ ID NO: 318759 - protein, 21 aa, Mycobacterium
LSGFEHSWFFLFLFVIVGLVA

SEQ ID NO: 318760 - protein, 33 aa, Mycobacterium
LSGFNRYGYDFMGFDRWGYDRWGYDRWGYDRWG

SEQ ID NO: 318761 - protein, 27 aa, Mycobacterium
LSGFVVYRLHGVFGVHRGSFGGGTSGE

SEQ ID NO: 318762 - protein, 26 aa, Mycobacterium
LSGFVVYRLHGVFGVHSGSFGGGTSG

SEQ ID NO: 318763 - protein, 19 aa, Mycobacterium
LSGGAPFYGVYECQDGRFF

SEQ ID NO: 318764 - protein, 19 aa, Mycobacterium
LSGGFLGVDVFFVLSGFLI

SEQ ID NO: 318765 - protein, 19 aa, Mycobacterium
LSGGVEIFGAVVPKTRIFI

SEQ ID NO: 318766 - protein, 24 aa, Mycobacterium
LSGHPVHTWRAAALRNRQQAGSLF

SEQ ID NO: 318767 - protein, 22 aa, Mycobacterium
LSGIVPWWFVAVLLARDGLLAA

SEQ ID NO: 318768 - protein, 21 aa, Mycobacterium
LSGLCAAAYLVCRHAVGTAIG

SEQ ID NO: 318769 - protein, 18 aa, Mycobacterium
LSGLGYVAIFAIPLARKA

SEQ ID NO: 318770 - protein, 29 aa, Mycobacterium
LSGLITEYAGWRWLFLINVPICAFALRAT

SEQ ID NO: 318771 - protein, 18 aa, Mycobacterium
LSGLLGAVQAGAWDGPSA

SEQ ID NO: 318772 - protein, 24 aa, Mycobacterium
LSGLPPAIVVSAEFDPLRDEGDAY

SEQ ID NO: 318773 - protein, 25 aa, Mycobacterium
LSGLSINRFIAIDFVGFAKMVQALG

SEQ ID NO: 318774 - protein, 24 aa, Mycobacterium
LSGLSINRFIAIDFVGFARMVEAL

SEQ ID NO: 318775 - protein, 23 aa, Mycobacterium
LSGLTKRHRTALVHITHYNNEAD

SEQ ID NO: 318776 - protein, 18 aa, Mycobacterium
LSGMAWGALNGVLVAKAR

SEQ ID NO: 318777 - protein, 29 aa, Mycobacterium
LSGPGRYGLDAGRGWAHRPFIGSFVALLT

SEQ ID NO: 318778 - protein, 28 aa, Mycobacterium
LSGPGRYGLDAGRGWAQRPFIGSFVALL

SEQ ID NO: 318779 - protein, 20 aa, Mycobacterium
LSGPLNIFGYEMPRALVFLT

SEQ ID NO: 318780 - protein, 18 aa, Mycobacterium
LSGQPALWIPGSSVSAAR

SEQ ID NO: 318781 - protein, 23 aa, Mycobacterium
LSGRLVGRYGARPSLVAAGILIT

SEQ ID NO: 318782 - protein, 22 aa, Mycobacterium
LSGRRMPAWVTGLAFVSANLGA

SEQ ID NO: 318783 - protein, 22 aa, Mycobacterium
LSGRYRLQRLIATGGMGQVWEA

SEQ ID NO: 318784 - protein, 24 aa, Mycobacterium
LSGSGERLLIYLGIGAALGLLTSW

SEQ ID NO: 318785 - protein, 20 aa, Mycobacterium
LSGVAARTVLSSALLFLVAG

SEQ ID NO: 318786 - protein, 17 aa, Mycobacterium
LSGVPALLSQLGPDEVA

SEQ ID NO: 318787 - protein, 17 aa, Mycobacterium
LSHAYTAVFVIAVVLVV

SEQ ID NO: 318788 - protein, 19 aa, Mycobacterium
LSHCGVVWIITQADPSQPA

SEQ ID NO: 318789 - protein, 26 aa, Mycobacterium
LSHRSRIPFRIAMVVLVAGLVVCAYL

SEQ ID NO: 318790 - protein, 18 aa, Mycobacterium
LSHSSDLNWKSVWDNGWS

SEQ ID NO: 318791 - protein, 23 aa, Mycobacterium
LSHTKPRCGPLLPISDVVVRDGN

SEQ ID NO: 318792 - protein, 22 aa, Mycobacterium
LSIDGPGIFPVLVNVNGTPDYG

SEQ ID NO: 318793 - protein, 17 aa, Mycobacterium
LSIGGLVGALGYAVLSK

SEQ ID NO: 318794 - protein, 17 aa, Mycobacterium
LSIGLAVATVIGMPLGL

SEQ ID NO: 318795 - protein, 34 aa, Mycobacterium
LSILACGYLLYSLHWYTWIAFGGWVGIALIFYLF

SEQ ID NO: 318796 - protein, 17 aa, Mycobacterium
LSIPELFAEQVVRDPGA

SEQ ID NO: 318797 - protein, 24 aa, Mycobacterium
LSIPEQLGLLAFMIIASKGAAGVS

SEQ ID NO: 318798 - protein, 25 aa, Mycobacterium
LSIPIMLWSPMGRDMFGFTVPAPFG

SEQ ID NO: 318799 - protein, 26 aa, Mycobacterium
LSIPLCVLCAGLALNGWVGYFPTALA

SEQ ID NO: 318800 - protein, 29 aa, Mycobacterium
LSIPLCVLCAGMALNGWVGYFPTALAAWN

SEQ ID NO: 318801 - protein, 22 aa, Mycobacterium
LSIRGIGSWIAATVVVWLVTAL

SEQ ID NO: 318802 - protein, 17 aa, Mycobacterium
LSISAALLLASFVAGVV

SEQ ID NO: 318803 - protein, 17 aa, Mycobacterium
LSISTPIIMRVLMGAIM

SEQ ID NO: 318804 - protein, 24 aa, Mycobacterium
LSITASLLIVCFVAGVVVASICRR

SEQ ID NO: 318805 - protein, 36 aa, Mycobacterium
LSIVVKVAALLIVFGFAGLSAYFVWNHSQVTQRQER

SEQ ID NO: 318806 - protein, 26 aa, Mycobacterium
LSIYGGASWLAATVMVWLVTTIGAIL

SEQ ID NO: 318807 - protein, 21 aa, Mycobacterium
LSKRSHKAAGRCVGGQETVAV

SEQ ID NO: 318808 - protein, 25 aa, Mycobacterium
LSKSAIVPMHFWLPGAMAAPTPVSA

SEQ ID NO: 318809 - protein, 17 aa, Mycobacterium
LSLADALARAAIGEPLR

SEQ ID NO: 318810 - protein, 18 aa, Mycobacterium
LSLAELGEDVLLVEGDTR

SEQ ID NO: 318811 - protein, 19 aa, Mycobacterium
LSLAHHRAWQVIGAGVLAN

SEQ ID NO: 318812 - protein, 24 aa, Mycobacterium
LSLARKCFLPVMAGLVLSTVVAII

SEQ ID NO: 318813 - protein, 25 aa, Mycobacterium
LSLFMVVAVALTWMVYVSLRREVAG

SEQ ID NO: 318814 - protein, 24 aa, Mycobacterium
LSLHLPVMLVCGFLLGAAGQFVKL

SEQ ID NO: 318815 - protein, 21 aa, Mycobacterium
LSLHRWDLLGPIEFVGLDNWT

SEQ ID NO: 318816 - protein, 20 aa, Mycobacterium
LSLIGFIAGFGPFYTGKASS

SEQ ID NO: 318817 - protein, 25 aa, Mycobacterium
LSLLDIGCVLILIALLITVQAAQLS

SEQ ID NO: 318818 - protein, 25 aa, Mycobacterium
LSLLGFLIALATLFDGFEGTTVGWG

SEQ ID NO: 318819 - protein, 37 aa, Mycobacterium
LSLLGWGSFLLLWVLQACVFWRGMESIRKFIDFCGPA

SEQ ID NO: 318820 - protein, 19 aa, Mycobacterium
LSLLVSITTVWITWLVRPL

SEQ ID NO: 318821 - protein, 17 aa, Mycobacterium
LSLMIGGSIAMVPWLGY

SEQ ID NO: 318822 - protein, 23 aa, Mycobacterium
LSLPAEIPIAVLTPSIVDVLHVR

SEQ ID NO: 318823 - protein, 24 aa, Mycobacterium
LSLPLCVLCVAAVGVGQGVGVIAR

SEQ ID NO: 318824 - protein, 25 aa, Mycobacterium
LSLPLYLLCGMARRRRLLSQESAVK

SEQ ID NO: 318825 - protein, 30 aa, Mycobacterium
LSLSAARGMIAFLGYHEIIGLSVFATNLLT

SEQ ID NO: 318826 - protein, 22 aa, Mycobacterium
LSLSARWWIVIVSLIVTASSFL

SEQ ID NO: 318827 - protein, 23 aa, Mycobacterium
LSLSVPGTVGFGVPNPMGDAPNE

SEQ ID NO: 318828 - protein, 24 aa, Mycobacterium
LSLSWPRVTAVFLVDIAIMVVASH

SEQ ID NO: 318829 - protein, 21 aa, Mycobacterium
LSLTAAFGALVWIFQDGHLSG

SEQ ID NO: 318830 - protein, 20 aa, Mycobacterium
LSLTAAFGALVWIFQEGHLG

SEQ ID NO: 318831 - protein, 21 aa, Mycobacterium
LSLTAAFGALVWVFQEGHLGG

SEQ ID NO: 318832 - protein, 22 aa, Mycobacterium
LSLTAAFGAMVWIFQDGHLGAL

SEQ ID NO: 318833 - protein, 22 aa, Mycobacterium
LSLTAAFGAMVWIFQDGHLNAL

SEQ ID NO: 318834 - protein, 22 aa, Mycobacterium
LSLTAAFGAMVWIFQDGHLRAL

SEQ ID NO: 318835 - protein, 22 aa, Mycobacterium
LSLTAGFGALVWIFQDGHLGAM

SEQ ID NO: 318836 - protein, 18 aa, Mycobacterium
LSLTGLLDIARLRWQFER

SEQ ID NO: 318837 - protein, 19 aa, Mycobacterium
LSLTVPGGNGFQLPGATAG

SEQ ID NO: 318838 - protein, 17 aa, Mycobacterium
LSLTVPGSNGFHAPGPN

SEQ ID NO: 318839 - protein, 19 aa, Mycobacterium
LSLVASGAMVFAILVLLGR

SEQ ID NO: 318840 - protein, 17 aa, Mycobacterium
LSLVGLLALPGYRTNYN

SEQ ID NO: 318841 - protein, 20 aa, Mycobacterium
LSLYRWDLLGPLRFVGLANW

SEQ ID NO: 318842 - protein, 17 aa, Mycobacterium
LSLYRWDLLGPLRYVGL

SEQ ID NO: 318843 - protein, 18 aa, Mycobacterium
LSLYRWDLLGPLRYVGLA

SEQ ID NO: 318844 - protein, 19 aa, Mycobacterium
LSMLVPILLALGAPVTLAL

SEQ ID NO: 318845 - protein, 17 aa, Mycobacterium
LSMLVPILLVLGAPVTM

SEQ ID NO: 318846 - protein, 19 aa, Mycobacterium
LSMRIPRWVEVTAGEVPAT

SEQ ID NO: 318847 - protein, 19 aa, Mycobacterium
LSMRVSDLQYRTVVVPIMK

SEQ ID NO: 318848 - protein, 24 aa, Mycobacterium
LSMSRRYQPDFSFASYDPAWIDTL

SEQ ID NO: 318849 - protein, 19 aa, Mycobacterium
LSMTLPILIPFVYFSHALN

SEQ ID NO: 318850 - protein, 31 aa, Mycobacterium
LSNAVNLIVRFKDFLIPLVAGLVAYKTVMLA

SEQ ID NO: 318851 - protein, 19 aa, Mycobacterium
LSNEIPLYARLFRITGDEY

SEQ ID NO: 318852 - protein, 18 aa, Mycobacterium
LSNFFGLDLARLLPYNLA

SEQ ID NO: 318853 - protein, 17 aa, Mycobacterium
LSNITWGNGSIVVGGGT

SEQ ID NO: 318854 - protein, 22 aa, Mycobacterium
LSNLLWRRVLRHHDVDAGVGEY

SEQ ID NO: 318855 - protein, 22 aa, Mycobacterium
LSNLLWRRVLRQHDVDAGVGEY

SEQ ID NO: 318856 - protein, 23 aa, Mycobacterium
LSNLLWRRVLRQHNVEAGVSEYT

SEQ ID NO: 318857 - protein, 32 aa, Mycobacterium
LSNLPMGVPLEWNVFFIFSLFYLFGHYGAIQA

SEQ ID NO: 318858 - protein, 32 aa, Mycobacterium
LSNLPMGVPLEWNVFFIFSLFYLFGHYGSIRA

SEQ ID NO: 318859 - protein, 18 aa, Mycobacterium
LSNRGGLNRLFGPLMAAI

SEQ ID NO: 318860 - protein, 21 aa, Mycobacterium
LSNTCAMGMLLSKLPYNRGAS

SEQ ID NO: 318861 - protein, 25 aa, Mycobacterium
LSNVLRYGYYPALIIGLTLGVMILY

SEQ ID NO: 318862 - protein, 17 aa, Mycobacterium
LSPAGEQFLDFEPESDT

SEQ ID NO: 318863 - protein, 21 aa, Mycobacterium
LSPAGEQYINFEAASDAGPYL

SEQ ID NO: 318864 - protein, 24 aa, Mycobacterium
LSPFALAIALSWIARRNKTFRIHL

SEQ ID NO: 318865 - protein, 24 aa, Mycobacterium
LSPGARTAIRVALIALSGALITGL

SEQ ID NO: 318866 - protein, 24 aa, Mycobacterium
LSPLFALMWTRLGKRAPTTPRKFA

SEQ ID NO: 318867 - protein, 17 aa, Mycobacterium
LSPMGTALLCSPMPIAA

SEQ ID NO: 318868 - protein, 18 aa, Mycobacterium
LSPNALRAVIIIVGLIGL

SEQ ID NO: 318869 - protein, 19 aa, Mycobacterium
LSPPIAWLLAVIAVAAAAA

SEQ ID NO: 318870 - protein, 20 aa, Mycobacterium
LSPQACREVEGLLQQSTSTV

SEQ ID NO: 318871 - protein, 23 aa, Mycobacterium
LSPSDRATQEFPQTVPPDQARAE

SEQ ID NO: 318872 - protein, 18 aa, Mycobacterium
LSPSLMMLGWAVIAAAGV

SEQ ID NO: 318873 - protein, 19 aa, Mycobacterium
LSPTALRAVIVVVGLIGLW

SEQ ID NO: 318874 - protein, 18 aa, Mycobacterium
LSPTELVVLSGEELQSRD

SEQ ID NO: 318875 - protein, 17 aa, Mycobacterium
LSPVEWCAVGVVCASLV

SEQ ID NO: 318876 - protein, 17 aa, Mycobacterium
LSPWLNRRNQYVTVSLP

SEQ ID NO: 318877 - protein, 24 aa, Mycobacterium
LSPYEILTVASLVQREATPEDFSK

SEQ ID NO: 318878 - protein, 24 aa, Mycobacterium
LSPYMLMMPLMMIMGTVGFMAGGG

SEQ ID NO: 318879 - protein, 24 aa, Mycobacterium
LSPYMLMMPLMMIVMMVGSLAGGS

SEQ ID NO: 318880 - protein, 24 aa, Mycobacterium
LSPYMLMMPLMMIVMMVGTLAGGS

SEQ ID NO: 318881 - protein, 17 aa, Mycobacterium
LSQAAGRLGDSRTDLFG

SEQ ID NO: 318882 - protein, 21 aa, Mycobacterium
LSQFVPWLLSPILMLGATYLC

SEQ ID NO: 318883 - protein, 17 aa, Mycobacterium
LSQGLRWWCVKSLGRRW

SEQ ID NO: 318884 - protein, 17 aa, Mycobacterium
LSQIALFVLLTTFSLTY

SEQ ID NO: 318885 - protein, 25 aa, Mycobacterium
LSQLADSFLDWDLYKQAIPDLLKTG

SEQ ID NO: 318886 - protein, 24 aa, Mycobacterium
LSQQAQIAWIWPVGPVTLGQIAGE

SEQ ID NO: 318887 - protein, 19 aa, Mycobacterium
LSQRFGRRYTIAFCAVLGL

SEQ ID NO: 318888 - protein, 30 aa, Mycobacterium
LSQTAVPAWREAHPYLPFIFTGSAAASGAG

SEQ ID NO: 318889 - protein, 21 aa, Mycobacterium
LSRAFRPANVEGMTVGEAVGR

SEQ ID NO: 318890 - protein, 17 aa, Mycobacterium
LSRAMVLSVDWFGVVVL

SEQ ID NO: 318891 - protein, 17 aa, Mycobacterium
LSRARRGAHRLVTGTAP

SEQ ID NO: 318892 - protein, 25 aa, Mycobacterium
LSREVLPRLGPAVIASRPALWAAGL

SEQ ID NO: 318893 - protein, 23 aa, Mycobacterium
LSRHFRRVVLVAAVMDGVVDWLR

SEQ ID NO: 318894 - protein, 23 aa, Mycobacterium
LSRIMDVMWAFPVLLLGIALGTA

SEQ ID NO: 318895 - protein, 19 aa, Mycobacterium
LSRIREAWLALPDNTPNRN

SEQ ID NO: 318896 - protein, 24 aa, Mycobacterium
LSRITRRALPFSVASGGLVGLLSM

SEQ ID NO: 318897 - protein, 23 aa, Mycobacterium
LSRLRAGAFVHGLVRNLTSAMFA

SEQ ID NO: 318898 - protein, 19 aa, Mycobacterium
LSRMARAALAIAPVVVHAM

SEQ ID NO: 318899 - protein, 22 aa, Mycobacterium
LSRPLGAAVFGHFGDRLGRKKT

SEQ ID NO: 318900 - protein, 24 aa, Mycobacterium
LSRPPGDETFIWLTLALAGVWAAG

SEQ ID NO: 318901 - protein, 20 aa, Mycobacterium
LSRRAPRPGPDVPVLNHLRV

SEQ ID NO: 318902 - protein, 23 aa, Mycobacterium
LSRRHPMRLLLPFFAVAFGLNVA

SEQ ID NO: 318903 - protein, 17 aa, Mycobacterium
LSRRKLFGAAGVTAAVV

SEQ ID NO: 318904 - protein, 18 aa, Mycobacterium
LSRVRRLIEPALVVSTVG

SEQ ID NO: 318905 - protein, 24 aa, Mycobacterium
LSRYRPGTHLANWRRVGLATWIAD

SEQ ID NO: 318906 - protein, 26 aa, Mycobacterium
LSRYRPRARWSSWRRVGLATWIADAG

SEQ ID NO: 318907 - protein, 20 aa, Mycobacterium
LSSDQWLAFTPPRVPTLKTA

SEQ ID NO: 318908 - protein, 19 aa, Mycobacterium
LSSEQWFAFTPPRVPVLET

SEQ ID NO: 318909 - protein, 17 aa, Mycobacterium
LSSFGWPSVALYMMAGC

SEQ ID NO: 318910 - protein, 20 aa, Mycobacterium
LSSLARALVRKDFVESLRNA

SEQ ID NO: 318911 - protein, 20 aa, Mycobacterium
LSSLARALVRKDFVESLRSA

SEQ ID NO: 318912 - protein, 19 aa, Mycobacterium
LSSLKIVFISGSQLGAELA

SEQ ID NO: 318913 - protein, 26 aa, Mycobacterium
LSSLLLFLLFWQWRTMPAVIWAVSWP

SEQ ID NO: 318914 - protein, 18 aa, Mycobacterium
LSSLMLVAHVSRDQAAHR

SEQ ID NO: 318915 - protein, 17 aa, Mycobacterium
LSSMPGVRDVSQPPLRP

SEQ ID NO: 318916 - protein, 22 aa, Mycobacterium
LSSQDRKAWLLPIGLSGDVGSP

SEQ ID NO: 318917 - protein, 19 aa, Mycobacterium
LSSTGSWRLMLGLAAVPAA

SEQ ID NO: 318918 - protein, 20 aa, Mycobacterium
LSSVALVWFGATAIDAGQMR

SEQ ID NO: 318919 - protein, 19 aa, Mycobacterium
LSSVCQCAPFHPPSRLSLA

SEQ ID NO: 318920 - protein, 17 aa, Mycobacterium
LSSVEWETLLFFAGLFI

SEQ ID NO: 318921 - protein, 18 aa, Mycobacterium
LSTALGWAIFHTLMIFWP

SEQ ID NO: 318922 - protein, 23 aa, Mycobacterium
LSTEGWRAATRFDAGAVPAIGYL

SEQ ID NO: 318923 - protein, 24 aa, Mycobacterium
LSTLDRFLPVWIGLAMAAGLLLGR

SEQ ID NO: 318924 - protein, 23 aa, Mycobacterium
LSTLDRFLPVWIGVAMAAGLLLG

SEQ ID NO: 318925 - protein, 27 aa, Mycobacterium
LSTLLRLEIPLAWPVIMTGVRVSAQML

SEQ ID NO: 318926 - protein, 27 aa, Mycobacterium
LSTPEFPWTGLTIFLLLAVFAAAVATR

SEQ ID NO: 318927 - protein, 18 aa, Mycobacterium
LSTPIWRLVLPITALGVA

SEQ ID NO: 318928 - protein, 18 aa, Mycobacterium
LSTRAMALIAKRGGQHDA

SEQ ID NO: 318929 - protein, 18 aa, Mycobacterium
LSTRAQFALQARPLRVAF

SEQ ID NO: 318930 - protein, 20 aa, Mycobacterium
LSTRKALPLYIAFLAGLGVL

SEQ ID NO: 318931 - protein, 22 aa, Mycobacterium
LSTRKALPLYIGFFAGLGILAG

SEQ ID NO: 318932 - protein, 29 aa, Mycobacterium
LSVAAAFRKIILPLLWPGIVAALLVAFFL

SEQ ID NO: 318933 - protein, 36 aa, Mycobacterium
LSVAACGYILASLHWYTWVAFSGWVVLALVFYFVWG

SEQ ID NO: 318934 - protein, 19 aa, Mycobacterium
LSVADLLAREGANGSRRSR

SEQ ID NO: 318935 - protein, 33 aa, Mycobacterium
LSVAFLANTWWWRALSGWWTWAHTPNGPGGATP

SEQ ID NO: 318936 - protein, 26 aa, Mycobacterium
LSVALAGRFAGFRGLELINLGITTNA

SEQ ID NO: 318937 - protein, 18 aa, Mycobacterium
LSVAPGWFGVLVALRVTS

SEQ ID NO: 318938 - protein, 17 aa, Mycobacterium
LSVARWYTWVIAILGVD

SEQ ID NO: 318939 - protein, 18 aa, Mycobacterium
LSVEPAHALLQVVDNGPG

SEQ ID NO: 318940 - protein, 17 aa, Mycobacterium
LSVEPQVAFFGDNIPLL

SEQ ID NO: 318941 - protein, 19 aa, Mycobacterium
LSVEVGFYLALPLLAFLAR

SEQ ID NO: 318942 - protein, 25 aa, Mycobacterium
LSVEVSFYLALPILALLARRLPVGA

SEQ ID NO: 318943 - protein, 21 aa, Mycobacterium
LSVFRCVYGLLFAAYGSRSLF

SEQ ID NO: 318944 - protein, 17 aa, Mycobacterium
LSVGATLVVARPGGHRE

SEQ ID NO: 318945 - protein, 24 aa, Mycobacterium
LSVGEQISLLAFMMIASKGAAGVT

SEQ ID NO: 318946 - protein, 29 aa, Mycobacterium
LSVGLCAIGVVIGRFQRWNSWDLVTQPDA

SEQ ID NO: 318947 - protein, 18 aa, Mycobacterium
LSVGQFVSMFAFAMYAVF

SEQ ID NO: 318948 - protein, 25 aa, Mycobacterium
LSVIACGYILFSLPWITWIAFGAWV

SEQ ID NO: 318949 - protein, 19 aa, Mycobacterium
LSVIRFRNAIKETRDVGFV

SEQ ID NO: 318950 - protein, 18 aa, Mycobacterium
LSVIRLVLVPVFLYLLLV

SEQ ID NO: 318951 - protein, 21 aa, Mycobacterium
LSVLFAFLMHRRLVFRVRGHV

SEQ ID NO: 318952 - protein, 17 aa, Mycobacterium
LSVLFTYQGNDMMTSFQ

SEQ ID NO: 318953 - protein, 18 aa, Mycobacterium
LSVLGLVLWSPRTTLRGG

SEQ ID NO: 318954 - protein, 26 aa, Mycobacterium
LSVLIANLIRIGFRAGGAGLAATGVA

SEQ ID NO: 318955 - protein, 20 aa, Mycobacterium
LSVLLEFAIQIARLHDKRKA

SEQ ID NO: 318956 - protein, 17 aa, Mycobacterium
LSVLLIVTACLGLLAIL

SEQ ID NO: 318957 - protein, 20 aa, Mycobacterium
LSVLLLFGVLVWLTALGARE

SEQ ID NO: 318958 - protein, 17 aa, Mycobacterium
LSVLVLANFIRDVPGEL

SEQ ID NO: 318959 - protein, 28 aa, Mycobacterium
LSVLVWQYLFGIQLYWVVLALAVILLLA

SEQ ID NO: 318960 - protein, 23 aa, Mycobacterium
LSVPAATRWYLAVPLIITLGLLN

SEQ ID NO: 318961 - protein, 18 aa, Mycobacterium
LSVPLAFATMILVSRFTR

SEQ ID NO: 318962 - protein, 20 aa, Mycobacterium
LSVPQSWAKAAMPRGIELQT

SEQ ID NO: 318963 - protein, 17 aa, Mycobacterium
LSVPTLWRETPAPYGPL

SEQ ID NO: 318964 - protein, 21 aa, Mycobacterium
LSVRLVRALAVSVAFLLFYLV

SEQ ID NO: 318965 - protein, 21 aa, Mycobacterium
LSVSILIAFVASVTFLPAVLV

SEQ ID NO: 318966 - protein, 17 aa, Mycobacterium
LSVVGLFIRLRVMESPE

SEQ ID NO: 318967 - protein, 20 aa, Mycobacterium
LSVVGLGPWLESLPQGLDTV

SEQ ID NO: 318968 - protein, 23 aa, Mycobacterium
LSVVVSWLLFTWMIARLPRQSGR

SEQ ID NO: 318969 - protein, 17 aa, Mycobacterium
LSVVYSAVVWWRIRLKR

SEQ ID NO: 318970 - protein, 24 aa, Mycobacterium
LSWIGFDHGISWISKLGIAASIGV

SEQ ID NO: 318971 - protein, 18 aa, Mycobacterium
LSWLGFDGPLGWAGKLGV

SEQ ID NO: 318972 - protein, 25 aa, Mycobacterium
LSWLGYDGALGWAGKLGVALSVGVL

SEQ ID NO: 318973 - protein, 17 aa, Mycobacterium
LSWPKVLGGGVLTGAWL

SEQ ID NO: 318974 - protein, 22 aa, Mycobacterium
LSYAQSRLWFIDQLHGPSPVYN

SEQ ID NO: 318975 - protein, 19 aa, Mycobacterium
LSYDAAFLLIVFVFLLIIL

SEQ ID NO: 318976 - protein, 19 aa, Mycobacterium
LSYFLDLRGPSVAVDTACS

SEQ ID NO: 318977 - protein, 24 aa, Mycobacterium
LSYGLAAILGFIGVKLMLEALHDN

SEQ ID NO: 318978 - protein, 19 aa, Mycobacterium
LSYLDVCDQVLLMAPGGKT

SEQ ID NO: 318979 - protein, 29 aa, Mycobacterium
LSYLLIHALYRWFPPITVWTGLSLLGVAA

SEQ ID NO: 318980 - protein, 29 aa, Mycobacterium
LSYRLLEKPMRIFSLRTLVAIAALGVMVL

SEQ ID NO: 318981 - protein, 21 aa, Mycobacterium
LSYVLACFLLAIALTVSVTIR

SEQ ID NO: 318982 - protein, 17 aa, Mycobacterium
LTAAFGALVWIFQDGHL

SEQ ID NO: 318983 - protein, 24 aa, Mycobacterium
LTAAIAVGVGVVFLLISILVGNPV

SEQ ID NO: 318984 - protein, 17 aa, Mycobacterium
LTAAIFVTIAFLIIQFT

SEQ ID NO: 318985 - protein, 21 aa, Mycobacterium
LTAAIGFPWAVLVLLASFVLG

SEQ ID NO: 318986 - protein, 26 aa, Mycobacterium
LTAAKELFNIFLIIAIVTAMLGALRE

SEQ ID NO: 318987 - protein, 24 aa, Mycobacterium
LTAALRSPLTWGIVAGLVVGKFVG

SEQ ID NO: 318988 - protein, 17 aa, Mycobacterium
LTAARLGGVAVILPALD

SEQ ID NO: 318989 - protein, 26 aa, Mycobacterium
LTAESRTAGTWAYMAPERMMSDVIDA

SEQ ID NO: 318990 - protein, 17 aa, Mycobacterium
LTAFMIEHGLAVNAHNQ

SEQ ID NO: 318991 - protein, 19 aa, Mycobacterium
LTAGDARSGAKVRTLVDHS

SEQ ID NO: 318992 - protein, 17 aa, Mycobacterium
LTAGLGFGGGCLPKDIR

SEQ ID NO: 318993 - protein, 17 aa, Mycobacterium
LTAHGIDDVMLVSEGHA

SEQ ID NO: 318994 - protein, 17 aa, Mycobacterium
LTAIGIGWGLTWIPYAS

SEQ ID NO: 318995 - protein, 20 aa, Mycobacterium
LTAIMPRLSRNAAAQDTPAV

SEQ ID NO: 318996 - protein, 19 aa, Mycobacterium
LTAIPPLLVLAPFWLLPAS

SEQ ID NO: 318997 - protein, 20 aa, Mycobacterium
LTALASRSGLVLDRGAKVTY

SEQ ID NO: 318998 - protein, 22 aa, Mycobacterium
LTALCSVAAFALGDLTVSACAL

SEQ ID NO: 318999 - protein, 25 aa, Mycobacterium
LTALFLAALLSWAAIELAHLTGLAE

SEQ ID NO: 319000 - protein, 17 aa, Mycobacterium
LTALPEIDARLAARGAP

SEQ ID NO: 319001 - protein, 25 aa, Mycobacterium
LTALRELALLWLADQVDAALAKYRS

SEQ ID NO: 319002 - protein, 24 aa, Mycobacterium
LTALSFATVNGWWYVSNFGVPWSN

SEQ ID NO: 319003 - protein, 23 aa, Mycobacterium
LTALTWVRFGVWLVVGTAIYVGY

SEQ ID NO: 319004 - protein, 19 aa, Mycobacterium
LTANLWKTYVLPGVQGTLT

SEQ ID NO: 319005 - protein, 18 aa, Mycobacterium
LTANTWRHYRLEVNHPLR

SEQ ID NO: 319006 - protein, 28 aa, Mycobacterium
LTAPFDGWVRWLFTVLAAVVFVLTVVNR

SEQ ID NO: 319007 - protein, 19 aa, Mycobacterium
LTAQTGFWIGVLPIALYSL

SEQ ID NO: 319008 - protein, 20 aa, Mycobacterium
LTARALRILPGFYVCLIVTA

SEQ ID NO: 319009 - protein, 19 aa, Mycobacterium
LTARASRRTLLVALMVAFT

SEQ ID NO: 319010 - protein, 17 aa, Mycobacterium
LTARLGAWNGRLLAAGG

SEQ ID NO: 319011 - protein, 19 aa, Mycobacterium
LTARPGMLTAVIGPSGAGK

SEQ ID NO: 319012 - protein, 19 aa, Mycobacterium
LTARPGTLTAIIGGSGAGK

SEQ ID NO: 319013 - protein, 19 aa, Mycobacterium
LTARPGTLTALIGGSGAGK

SEQ ID NO: 319014 - protein, 22 aa, Mycobacterium
LTARPGTLTALIGGSGAGKSTL

SEQ ID NO: 319015 - protein, 22 aa, Mycobacterium
LTARVGERVRIWVLAAGPNRGS

SEQ ID NO: 319016 - protein, 18 aa, Mycobacterium
LTASGFVVFVVWLAVSRY

SEQ ID NO: 319017 - protein, 17 aa, Mycobacterium
LTASWLVIGHLIAGTSN

SEQ ID NO: 319018 - protein, 35 aa, Mycobacterium
LTATASFKSATKWSGASFHDHGNWVIGAPDVLLDS

SEQ ID NO: 319019 - protein, 24 aa, Mycobacterium
LTATCPEMAPAGWNLYAAASTPHP

SEQ ID NO: 319020 - protein, 17 aa, Mycobacterium
LTATLSWTSEGIKDTVA

SEQ ID NO: 319021 - protein, 17 aa, Mycobacterium
LTATLTLENLLATAAAL

SEQ ID NO: 319022 - protein, 18 aa, Mycobacterium
LTAVGWVLAAFAMRQYRA

SEQ ID NO: 319023 - protein, 24 aa, Mycobacterium
LTAVLCLGALFWSFVRPAGSAGQA

SEQ ID NO: 319024 - protein, 17 aa, Mycobacterium
LTAVVTVCFDLIEAVQI

SEQ ID NO: 319025 - protein, 20 aa, Mycobacterium
LTCAVAIPLGIALTRGPVRR

SEQ ID NO: 319026 - protein, 25 aa, Mycobacterium
LTCGMWLPIWILVAIFGGGGTSAVA

SEQ ID NO: 319027 - protein, 19 aa, Mycobacterium
LTCMKELPVTLLLHPTGTD

SEQ ID NO: 319028 - protein, 26 aa, Mycobacterium
LTCYRKQRLGLVWVTLLGYLVASEVP

SEQ ID NO: 319029 - protein, 23 aa, Mycobacterium
LTDARPSLHIRAAAKTYRAKVSG

SEQ ID NO: 319030 - protein, 22 aa, Mycobacterium
LTDAWLWPLSWINVAAAVVFAI

SEQ ID NO: 319031 - protein, 24 aa, Mycobacterium
LTDRVDPRVLLLVYYAGRGVSLLL

SEQ ID NO: 319032 - protein, 25 aa, Mycobacterium
LTDVDTPDGLYCKLPQDSPIGVRGA

SEQ ID NO: 319033 - protein, 19 aa, Mycobacterium
LTEAVPWPLADHPRTAAVS

SEQ ID NO: 319034 - protein, 21 aa, Mycobacterium
LTEFALRPVAAQALAAGPPPR

SEQ ID NO: 319035 - protein, 18 aa, Mycobacterium
LTEFGGRFAEFWRQQEST

SEQ ID NO: 319036 - protein, 24 aa, Mycobacterium
LTEGTRAAIRFADLTGGRYVALEE

SEQ ID NO: 319037 - protein, 23 aa, Mycobacterium
LTEMLRGTMSWTPFVAPSATAGA

SEQ ID NO: 319038 - protein, 24 aa, Mycobacterium
LTENRLRVVCAIPSSTSPLDPFID

SEQ ID NO: 319039 - protein, 24 aa, Mycobacterium
LTERELRAVLGHELSHVYNRDILI

SEQ ID NO: 319040 - protein, 21 aa, Mycobacterium
LTERIKIPVPLLVLIGAAVAV

SEQ ID NO: 319041 - protein, 27 aa, Mycobacterium
LTERSRQALKIQRWRARVRNHTVVVGY

SEQ ID NO: 319042 - protein, 22 aa, Mycobacterium
LTEWEPIGGVTRSNLSGFPSVQ

SEQ ID NO: 319043 - protein, 18 aa, Mycobacterium
LTFAWDFGNYVDAFTLYR

SEQ ID NO: 319044 - protein, 17 aa, Mycobacterium
LTFDFSTALWAPRTIER

SEQ ID NO: 319045 - protein, 25 aa, Mycobacterium
LTFESFRTAWTLQYAVWTLAVLGVL

SEQ ID NO: 319046 - protein, 28 aa, Mycobacterium
LTFETPMLFAIGFLLTFLIGGLTGVLLA

SEQ ID NO: 319047 - protein, 39 aa, Mycobacterium
LTFGAQVRLILRRQVRVFLASRLYLVFLALLPFALGALT

SEQ ID NO: 319048 - protein, 28 aa, Mycobacterium
LTFLAFLCLACLIAAVGVVTDSPVTIVG

SEQ ID NO: 319049 - protein, 21 aa, Mycobacterium
LTFLLVFGLFVRKVWDIVIGL

SEQ ID NO: 319050 - protein, 17 aa, Mycobacterium
LTFPVPVIIAATGPAIA

SEQ ID NO: 319051 - protein, 26 aa, Mycobacterium
LTFSLLRLLTGFGLGASMPNVAALVS

SEQ ID NO: 319052 - protein, 22 aa, Mycobacterium
LTFSVLAAYAFARLQFPGRDAL

SEQ ID NO: 319053 - protein, 23 aa, Mycobacterium
LTFSVLAAYAFARLRFPGRDGLF

SEQ ID NO: 319054 - protein, 24 aa, Mycobacterium
LTFTRMPYFQSMGIPCAAGMLVAV

SEQ ID NO: 319055 - protein, 20 aa, Mycobacterium
LTFYPGWVPIGFTAVLVLVV

SEQ ID NO: 319056 - protein, 19 aa, Mycobacterium
LTGADWRGVRWWRRSLTVL

SEQ ID NO: 319057 - protein, 25 aa, Mycobacterium
LTGAIVWNMLTWLLGIPSSSSMALF

SEQ ID NO: 319058 - protein, 17 aa, Mycobacterium
LTGALLATVAWVVGVVL

SEQ ID NO: 319059 - protein, 18 aa, Mycobacterium
LTGDMFLLMLGGGALAAA

SEQ ID NO: 319060 - protein, 18 aa, Mycobacterium
LTGEIPIIRPDDPPPAPV

SEQ ID NO: 319061 - protein, 21 aa, Mycobacterium
LTGESAPVWKTIGVDDEDTSL

SEQ ID NO: 319062 - protein, 17 aa, Mycobacterium
LTGESVLIRNAHCIEAL

SEQ ID NO: 319063 - protein, 17 aa, Mycobacterium
LTGESVLIRNAHSIEAL

SEQ ID NO: 319064 - protein, 23 aa, Mycobacterium
LTGEYRGGPAYYLSTALSHTAAA

SEQ ID NO: 319065 - protein, 24 aa, Mycobacterium
LTGFARIVLLAAILGAALSSAFSV

SEQ ID NO: 319066 - protein, 24 aa, Mycobacterium
LTGFARVVLLAAILGAALSSAFSV

SEQ ID NO: 319067 - protein, 17 aa, Mycobacterium
LTGFASAFFNVRLIAPG

SEQ ID NO: 319068 - protein, 18 aa, Mycobacterium
LTGFLPASQWRSFVDETP

SEQ ID NO: 319069 - protein, 24 aa, Mycobacterium
LTGFMVLVGLDFLSYRLGKQRNRS

SEQ ID NO: 319070 - protein, 18 aa, Mycobacterium
LTGGLPLLHVDKPQYEGA

SEQ ID NO: 319071 - protein, 18 aa, Mycobacterium
LTGGWLMVRRRAVSVRGF

SEQ ID NO: 319072 - protein, 35 aa, Mycobacterium
LTGHFSVALSLLWNYAMLWFGFVVLPALQIVFDPL

SEQ ID NO: 319073 - protein, 25 aa, Mycobacterium
LTGHSWQVFGALWLYSMAVGGAVTG

SEQ ID NO: 319074 - protein, 23 aa, Mycobacterium
LTGITCFVGFLASYLFNVYFQRG

SEQ ID NO: 319075 - protein, 18 aa, Mycobacterium
LTGKFKDSYTQLVQDVVI

SEQ ID NO: 319076 - protein, 22 aa, Mycobacterium
LTGLLNRRAFYSAVNQLLADTH

SEQ ID NO: 319077 - protein, 27 aa, Mycobacterium
LTGLTWIRFLIWMAIGVVIYFLYGRRR

SEQ ID NO: 319078 - protein, 24 aa, Mycobacterium
LTGLVIGALWAWVAPPIHAVVALT

SEQ ID NO: 319079 - protein, 19 aa, Mycobacterium
LTGMVSRIDTVLVVATSVT

SEQ ID NO: 319080 - protein, 21 aa, Mycobacterium
LTGQPRATFGLPLLSDGIDIV

SEQ ID NO: 319081 - protein, 27 aa, Mycobacterium
LTGRIWRRSGVHIVRKPVIHLVASLTV

SEQ ID NO: 319082 - protein, 17 aa, Mycobacterium
LTGRLGTAPTVWSYAAM

SEQ ID NO: 319083 - protein, 25 aa, Mycobacterium
LTGRTPLPPRRDWELDTLDGELRKK

SEQ ID NO: 319084 - protein, 18 aa, Mycobacterium
LTGRTSIVIAHRLSTVRA

SEQ ID NO: 319085 - protein, 19 aa, Mycobacterium
LTGRWPRYVGAATCLVLIV

SEQ ID NO: 319086 - protein, 20 aa, Mycobacterium
LTGVKSRWVVAAAGVIMILL

SEQ ID NO: 319087 - protein, 20 aa, Mycobacterium
LTGVKSRWVVAAAGVIMMVL

SEQ ID NO: 319088 - protein, 17 aa, Mycobacterium
LTGVWAFVLLNRTPDWW

SEQ ID NO: 319089 - protein, 18 aa, Mycobacterium
LTGWLAWHDIARRTVRAT

SEQ ID NO: 319090 - protein, 21 aa, Mycobacterium
LTGWLGYRAYQSYGVEQQREA

SEQ ID NO: 319091 - protein, 18 aa, Mycobacterium
LTGWRVIRAKVEALSVDG

SEQ ID NO: 319092 - protein, 26 aa, Mycobacterium
LTGYLLAGIHGWRWMLGLATVPAMLL

SEQ ID NO: 319093 - protein, 22 aa, Mycobacterium
LTHGFFKAGLFLGAGSVMHGMN

SEQ ID NO: 319094 - protein, 21 aa, Mycobacterium
LTHGFFKAGLFLGSGAVIHAM

SEQ ID NO: 319095 - protein, 22 aa, Mycobacterium
LTHGFFKAGLFLGSGAVIHAMD

SEQ ID NO: 319096 - protein, 22 aa, Mycobacterium
LTHGFFKAGLFLGSGAVIHAMH

SEQ ID NO: 319097 - protein, 21 aa, Mycobacterium
LTHGFFKAGLFLGSGSVIHAM

SEQ ID NO: 319098 - protein, 26 aa, Mycobacterium
LTHHWVKDLPDHPVWVRGDHARLHQL

SEQ ID NO: 319099 - protein, 19 aa, Mycobacterium
LTHPVPRPLSIPELFAEQV

SEQ ID NO: 319100 - protein, 27 aa, Mycobacterium
LTHSAFRIGIFSNRWIIVGVTVQAVAQ

SEQ ID NO: 319101 - protein, 27 aa, Mycobacterium
LTHSAWRIGVLSNRWIILGVTAQGLAQ

SEQ ID NO: 319102 - protein, 27 aa, Mycobacterium
LTIAALICAAGFVAAIWLPSKSTMPAR

SEQ ID NO: 319103 - protein, 17 aa, Mycobacterium
LTIAFAIGERHQLGPVP

SEQ ID NO: 319104 - protein, 29 aa, Mycobacterium
LTIAGACFCLSLARLDYFHTMGPAVAISM

SEQ ID NO: 319105 - protein, 29 aa, Mycobacterium
LTIAGACFCLSLARLDYFHTMGPAVAVSM

SEQ ID NO: 319106 - protein, 28 aa, Mycobacterium
LTIAGACYCLSFARLNYFHTMGPAVAIA

SEQ ID NO: 319107 - protein, 27 aa, Mycobacterium
LTIAGACYCLTFARLNYFHTMGPAVAI

SEQ ID NO: 319108 - protein, 27 aa, Mycobacterium
LTIAGGYLLVLAMLYGWLFMHRGVAYF

SEQ ID NO: 319109 - protein, 19 aa, Mycobacterium
LTIALLVLHAFLFVVTMLV

SEQ ID NO: 319110 - protein, 17 aa, Mycobacterium
LTIEVGKALAAIPTKVG

SEQ ID NO: 319111 - protein, 17 aa, Mycobacterium
LTIGLVLSALVIASAFA

SEQ ID NO: 319112 - protein, 17 aa, Mycobacterium
LTIIFVFAVVTLQPLAI

SEQ ID NO: 319113 - protein, 18 aa, Mycobacterium
LTIIFVFTVVTLQPLAIY

SEQ ID NO: 319114 - protein, 24 aa, Mycobacterium
LTINASSVAVIWFGGLRIDNGQMQ

SEQ ID NO: 319115 - protein, 23 aa, Mycobacterium
LTIPGLRHVLGMTVGAMAILTSM

SEQ ID NO: 319116 - protein, 17 aa, Mycobacterium
LTIPYTVLLTFIENILL

SEQ ID NO: 319117 - protein, 23 aa, Mycobacterium
LTIPYTVLLTFTFNILLTEFGAA

SEQ ID NO: 319118 - protein, 19 aa, Mycobacterium
LTIRAGEAIHVSWAAANVD

SEQ ID NO: 319119 - protein, 19 aa, Mycobacterium
LTIRGLRITGWVRAIFSWR

SEQ ID NO: 319120 - protein, 20 aa, Mycobacterium
LTIRLAEVMLSSGSGTADVV

SEQ ID NO: 319121 - protein, 22 aa, Mycobacterium
LTKDRTVLVIAHRLHTITGADQ

SEQ ID NO: 319122 - protein, 26 aa, Mycobacterium
LTKGGCPMLDLPIINPFLRREFTECD

SEQ ID NO: 319123 - protein, 17 aa, Mycobacterium
LTKHTGMLLMFSTRSYT

SEQ ID NO: 319124 - protein, 17 aa, Mycobacterium
LTKPVWLVILGVGVLLA

SEQ ID NO: 319125 - protein, 24 aa, Mycobacterium
LTKRFAVGTSQTWARDESSRACSR

SEQ ID NO: 319126 - protein, 19 aa, Mycobacterium
LTKRFPMMGMIDMSNALCR

SEQ ID NO: 319127 - protein, 20 aa, Mycobacterium
LTKRHRMSLVHITHYNSEAE

SEQ ID NO: 319128 - protein, 25 aa, Mycobacterium
LTKRSRWRRLWSRSAPALAAYAAFH

SEQ ID NO: 319129 - protein, 17 aa, Mycobacterium
LTKVPAVTLGFWVVKIL

SEQ ID NO: 319130 - protein, 17 aa, Mycobacterium
LTLAALFLATVVASSLI

SEQ ID NO: 319131 - protein, 17 aa, Mycobacterium
LTLAGSMTWEILWALIV

SEQ ID NO: 319132 - protein, 20 aa, Mycobacterium
LTLAPALLVVGGRFGLFDPR

SEQ ID NO: 319133 - protein, 19 aa, Mycobacterium
LTLAPAVLVIAGRFGLMEP

SEQ ID NO: 319134 - protein, 19 aa, Mycobacterium
LTLAPAVLVVGGRFGAFDP

SEQ ID NO: 319135 - protein, 18 aa, Mycobacterium
LTLAQPAHHGLLWALLLV

SEQ ID NO: 319136 - protein, 19 aa, Mycobacterium
LTLASCMFATFGVSTSLPV

SEQ ID NO: 319137 - protein, 17 aa, Mycobacterium
LTLCETYGWAPGVMGAS

SEQ ID NO: 319138 - protein, 17 aa, Mycobacterium
LTLDLVGTFAFALNGAL

SEQ ID NO: 319139 - protein, 23 aa, Mycobacterium
LTLEVLDVTGPFSKETVQDALNG

SEQ ID NO: 319140 - protein, 18 aa, Mycobacterium
LTLFIRGVLCNWMVSTGV

SEQ ID NO: 319141 - protein, 17 aa, Mycobacterium
LTLFLDLNWAAGYSTIV

SEQ ID NO: 319142 - protein, 36 aa, Mycobacterium
LTLFLLIIAIQWRARPWLKRVLPVALIAAAAVTALS

SEQ ID NO: 319143 - protein, 19 aa, Mycobacterium
LTLGPAVIVIGSRFGLFDP

SEQ ID NO: 319144 - protein, 21 aa, Mycobacterium
LTLGPAVLVVGSFFKLFDPKR

SEQ ID NO: 319145 - protein, 19 aa, Mycobacterium
LTLGPAVLVVGSYFKIFDP

SEQ ID NO: 319146 - protein, 19 aa, Mycobacterium
LTLGPAVVFVGSRFHLFES

SEQ ID NO: 319147 - protein, 33 aa, Mycobacterium
LTLGTWATACGWAFALAMIDGWQRGFAGRLTTK

SEQ ID NO: 319148 - protein, 41 aa, Mycobacterium
LTLHFAAGFFMLWYYGFLWYHFVVMPAWQFVIDPLLVVDAV

SEQ ID NO: 319149 - protein, 25 aa, Mycobacterium
LTLHKPRGYLLYLFLACTDQRQGLY

SEQ ID NO: 319150 - protein, 19 aa, Mycobacterium
LTLHSGPITFCFFVFAFMG

SEQ ID NO: 319151 - protein, 17 aa, Mycobacterium
LTLIFLIMLLLTRSVVA

SEQ ID NO: 319152 - protein, 23 aa, Mycobacterium
LTLLFFEVFPHFPVGVSEVHLIL

SEQ ID NO: 319153 - protein, 24 aa, Mycobacterium
LTLLPALLDLAGRRGLAQPRTVNR

SEQ ID NO: 319154 - protein, 23 aa, Mycobacterium
LTLLPILLGFAAPRGLSVPQTGG

SEQ ID NO: 319155 - protein, 20 aa, Mycobacterium
LTLLRLVLVPIFLLALFAKD

SEQ ID NO: 319156 - protein, 17 aa, Mycobacterium
LTLLRYLLGQLRLSAPD

SEQ ID NO: 319157 - protein, 18 aa, Mycobacterium
LTLLRYLLGQLRLSEPDR

SEQ ID NO: 319158 - protein, 24 aa, Mycobacterium
LTLLSYRSGLALPARWRRDRSPNR

SEQ ID NO: 319159 - protein, 20 aa, Mycobacterium
LTLLVTFCVPWLETVGREHS

SEQ ID NO: 319160 - protein, 17 aa, Mycobacterium
LTLMFALVYAAIAVWTS

SEQ ID NO: 319161 - protein, 21 aa, Mycobacterium
LTLMNVPFYWQQIVTGAVVVV

SEQ ID NO: 319162 - protein, 20 aa, Mycobacterium
LTLPHLRRFIELGTVLGAIY

SEQ ID NO: 319163 - protein, 17 aa, Mycobacterium
LTLPWVIRVLGVQSDDE

SEQ ID NO: 319164 - protein, 17 aa, Mycobacterium
LTLSRLLAGLAPGLDLG

SEQ ID NO: 319165 - protein, 19 aa, Mycobacterium
LTLSRLMSGLAARLSPALS

SEQ ID NO: 319166 - protein, 18 aa, Mycobacterium
LTLTIAGPVRTYFAQRTE

SEQ ID NO: 319167 - protein, 19 aa, Mycobacterium
LTLTIGFGPSFFLKDGVDR

SEQ ID NO: 319168 - protein, 27 aa, Mycobacterium
LTLTLVVMLRISWQITLLALVLVPLFV

SEQ ID NO: 319169 - protein, 24 aa, Mycobacterium
LTLVLRAGMPVGVAYGIWGALGTA

SEQ ID NO: 319170 - protein, 17 aa, Mycobacterium
LTLVLTFVCMAIGIVLG

SEQ ID NO: 319171 - protein, 29 aa, Mycobacterium
LTLWLVRWLLFRVEFGAGLIKMRGDPCWR

SEQ ID NO: 319172 - protein, 19 aa, Mycobacterium
LTLWTIRTLAHWLQARLGQ

SEQ ID NO: 319173 - protein, 17 aa, Mycobacterium
LTMAFAITEPDAGSNSH

SEQ ID NO: 319174 - protein, 18 aa, Mycobacterium
LTMFDDFGGRIPSDKPPI

SEQ ID NO: 319175 - protein, 17 aa, Mycobacterium
LTMFSERAGLVMDPGSK

SEQ ID NO: 319176 - protein, 18 aa, Mycobacterium
LTMIGIAVPAHFLAGLNW

SEQ ID NO: 319177 - protein, 25 aa, Mycobacterium
LTMITALLLYFGWARSDAQSQWMGI

SEQ ID NO: 319178 - protein, 17 aa, Mycobacterium
LTMRADAAISGLVGLAG

SEQ ID NO: 319179 - protein, 26 aa, Mycobacterium
LTMREARAGDRYLLCSDGLSDPVSDE

SEQ ID NO: 319180 - protein, 26 aa, Mycobacterium
LTMREVRAGDRYLLCSDGLSDPVSDE

SEQ ID NO: 319181 - protein, 27 aa, Mycobacterium
LTMRTLRRGMPFALTWWSLTFPVGTFV

SEQ ID NO: 319182 - protein, 17 aa, Mycobacterium
LTMRVFTGLTLLDTIQG

SEQ ID NO: 319183 - protein, 27 aa, Mycobacterium
LTMSGPRPGGFGLLNNRTFEICARGDL

SEQ ID NO: 319184 - protein, 25 aa, Mycobacterium
LTMTGARPGGFGALDGKTNEICAPG

SEQ ID NO: 319185 - protein, 26 aa, Mycobacterium
LTMTGARPGGFGALDSRTNEICAQGD

SEQ ID NO: 319186 - protein, 25 aa, Mycobacterium
LTMTGPRPGGFGALDNRTNQICGSG

SEQ ID NO: 319187 - protein, 18 aa, Mycobacterium
LTMTTLPYFQSMALPCAI

SEQ ID NO: 319188 - protein, 18 aa, Mycobacterium
LTNAALACFAWLTLLIRR

SEQ ID NO: 319189 - protein, 18 aa, Mycobacterium
LTNGVANWIVRRLGVEPA

SEQ ID NO: 319190 - protein, 18 aa, Mycobacterium
LTNLLAFHAADLSFTRFT

SEQ ID NO: 319191 - protein, 18 aa, Mycobacterium
LTNLLAYHVARISFIKFT

SEQ ID NO: 319192 - protein, 17 aa, Mycobacterium
LTNPVQALITWGPFLLA

SEQ ID NO: 319193 - protein, 18 aa, Mycobacterium
LTNQLKLLNLRLQSRNPN

SEQ ID NO: 319194 - protein, 19 aa, Mycobacterium
LTNRLPAYMVPAAVVTLET

SEQ ID NO: 319195 - protein, 24 aa, Mycobacterium
LTNRSRWPAVLAAIVTAELVVDAH

SEQ ID NO: 319196 - protein, 24 aa, Mycobacterium
LTNVLKAFYAALGAKNLEVLNALS

SEQ ID NO: 319197 - protein, 22 aa, Mycobacterium
LTNYLLRDWRVLYAPDAQAYTN

SEQ ID NO: 319198 - protein, 29 aa, Mycobacterium
LTPAIATMLGRWFWWPINIRTRPAPKPFG

SEQ ID NO: 319199 - protein, 20 aa, Mycobacterium
LTPAQRACIWFFAIVSVLFL

SEQ ID NO: 319200 - protein, 19 aa, Mycobacterium
LTPATRWAPLLQWIMAAAA

SEQ ID NO: 319201 - protein, 17 aa, Mycobacterium
LTPAVFLLYFLLRRDGR

SEQ ID NO: 319202 - protein, 17 aa, Mycobacterium
LTPAVFLLYFLLRRDHR

SEQ ID NO: 319203 - protein, 17 aa, Mycobacterium
LTPAVFLLYFLLRRDNR

SEQ ID NO: 319204 - protein, 20 aa, Mycobacterium
LTPDAGFAIAEREVSPKEEG

SEQ ID NO: 319205 - protein, 25 aa, Mycobacterium
LTPDHFAYLVGFGIPDASGVYMAPE

SEQ ID NO: 319206 - protein, 17 aa, Mycobacterium
LTPDLALAYGAVFAEIE

SEQ ID NO: 319207 - protein, 22 aa, Mycobacterium
LTPEGPWAWLALLVAGLAVGIF

SEQ ID NO: 319208 - protein, 35 aa, Mycobacterium
LTPELRIGTLTLWVGFMAVMFSIYLTNTWLPYLFK

SEQ ID NO: 319209 - protein, 18 aa, Mycobacterium
LTPGRGFRNGPFASEIEL

SEQ ID NO: 319210 - protein, 26 aa, Mycobacterium
LTPGWSRLRHAGGYVQTYWMSPRDIS

SEQ ID NO: 319211 - protein, 18 aa, Mycobacterium
LTPIFAWGAAVIIVVAHV

SEQ ID NO: 319212 - protein, 22 aa, Mycobacterium
LTPKHRVVIIGSGFGGLTAAKT

SEQ ID NO: 319213 - protein, 24 aa, Mycobacterium
LTPLIKRPIAFGAVAGLGVGTVGL

SEQ ID NO: 319214 - protein, 18 aa, Mycobacterium
LTPMARYAHWARHNINRC

SEQ ID NO: 319215 - protein, 22 aa, Mycobacterium
LTPPAIRRWGRYATANGALAAS

SEQ ID NO: 319216 - protein, 23 aa, Mycobacterium
LTPPAVRRWGRYATANGALATSA

SEQ ID NO: 319217 - protein, 18 aa, Mycobacterium
LTPPGSFTAIPQHWHDAA

SEQ ID NO: 319218 - protein, 17 aa, Mycobacterium
LTPPPVPEQNGFDAFDD

SEQ ID NO: 319219 - protein, 19 aa, Mycobacterium
LTPPRAVAIITQVASALDA

SEQ ID NO: 319220 - protein, 17 aa, Mycobacterium
LTPRERLARGLTYSTVG

SEQ ID NO: 319221 - protein, 25 aa, Mycobacterium
LTPRMTVLQVLAWVGYLVMVIPAFM

SEQ ID NO: 319222 - protein, 18 aa, Mycobacterium
LTPRRFLSNIVHSYEFTK

SEQ ID NO: 319223 - protein, 29 aa, Mycobacterium
LTPYDLGPAPSWRNLRFARSDIPETATAV

SEQ ID NO: 319224 - protein, 17 aa, Mycobacterium
LTQAIAIFFSTGLIPLD

SEQ ID NO: 319225 - protein, 19 aa, Mycobacterium
LTQLLGVTAAGVWQGSSAT

SEQ ID NO: 319226 - protein, 22 aa, Mycobacterium
LTQRLTDMLTRLPALSDPIPGL

SEQ ID NO: 319227 - protein, 24 aa, Mycobacterium
LTQVCSRSVAVARFEGLEVAAGSR

SEQ ID NO: 319228 - protein, 21 aa, Mycobacterium
LTRAAPYAVVLGQLGPWLTAM

SEQ ID NO: 319229 - protein, 21 aa, Mycobacterium
LTRAGALWTALIMGFLVLIVL

SEQ ID NO: 319230 - protein, 23 aa, Mycobacterium
LTRDEWQLRIHGMTDREVTYRFE

SEQ ID NO: 319231 - protein, 22 aa, Mycobacterium
LTRDRTVLVIAHRLHTITHADQ

SEQ ID NO: 319232 - protein, 38 aa, Mycobacterium
LTRGDGVAGAAGWVILLCLAFSALGKGIGLLRRALAPV

SEQ ID NO: 319233 - protein, 36 aa, Mycobacterium
LTRGDGVAGVLGWVILLCLAFSALGKGITLLRRALA

SEQ ID NO: 319234 - protein, 17 aa, Mycobacterium
LTRKPLRATLMVIAAIV

SEQ ID NO: 319235 - protein, 18 aa, Mycobacterium
LTRLARRSADSGVVMADG

SEQ ID NO: 319236 - protein, 18 aa, Mycobacterium
LTRMGIATTEIRFCDKHG

SEQ ID NO: 319237 - protein, 22 aa, Mycobacterium
LTRRFAVLVLLLCLFGLIMVLL

SEQ ID NO: 319238 - protein, 19 aa, Mycobacterium
LTRRVRLFVLATITYNLIE

SEQ ID NO: 319239 - protein, 29 aa, Mycobacterium
LTRTEFEQLISPPLDRFVTSLQDTLRRNG

SEQ ID NO: 319240 - protein, 18 aa, Mycobacterium
LTRVIEVPYVLPILAQGR

SEQ ID NO: 319241 - protein, 21 aa, Mycobacterium
LTRVKSRWVVAAAGVVMIVLG

SEQ ID NO: 319242 - protein, 20 aa, Mycobacterium
LTSAALATLGIWEWRRTNRS

SEQ ID NO: 319243 - protein, 17 aa, Mycobacterium
LTSAGAIAGMIAGAVVV

SEQ ID NO: 319244 - protein, 18 aa, Mycobacterium
LTSAMNRFRRDFLAAYIS

SEQ ID NO: 319245 - protein, 17 aa, Mycobacterium
LTSAVAVWWLLRSPGPA

SEQ ID NO: 319246 - protein, 17 aa, Mycobacterium
LTSAWYRLPKPDAGHPL

SEQ ID NO: 319247 - protein, 18 aa, Mycobacterium
LTSFAGLGMFNPLSLGAG

SEQ ID NO: 319248 - protein, 17 aa, Mycobacterium
LTSGFVGKFAVFKAAGE

SEQ ID NO: 319249 - protein, 17 aa, Mycobacterium
LTSGWSWAYVSGPFLAA

SEQ ID NO: 319250 - protein, 22 aa, Mycobacterium
LTSGYLGGWLDRALVLVMDALY

SEQ ID NO: 319251 - protein, 23 aa, Mycobacterium
LTSKGEPFWTISGGLCGVIGVAA

SEQ ID NO: 319252 - protein, 21 aa, Mycobacterium
LTSKGPVCYRAEHIGINGQPF

SEQ ID NO: 319253 - protein, 24 aa, Mycobacterium
LTSLFVVGVVALVISLAISIRPTA

SEQ ID NO: 319254 - protein, 23 aa, Mycobacterium
LTSLKAGLIAGAIGLAIVLLYSL

SEQ ID NO: 319255 - protein, 22 aa, Mycobacterium
LTSLRAHSRYGLHVSAQRASSA

SEQ ID NO: 319256 - protein, 25 aa, Mycobacterium
LTSMGAGVLVAWLGGMLLSGMLTVI

SEQ ID NO: 319257 - protein, 23 aa, Mycobacterium
LTSPRIWALALVYFGIAYGLYAL

SEQ ID NO: 319258 - protein, 21 aa, Mycobacterium
LTSVAVPLFFSRDDSARAGRV

SEQ ID NO: 319259 - protein, 17 aa, Mycobacterium
LTSVFVIGVVALVISLA

SEQ ID NO: 319260 - protein, 27 aa, Mycobacterium
LTTACLFPGLVFNYYLVFALPIAALVV

SEQ ID NO: 319261 - protein, 25 aa, Mycobacterium
LTTAEWWRLAAMLASIVGLHLLGWL

SEQ ID NO: 319262 - protein, 17 aa, Mycobacterium
LTTAFAFLLLPQIIFYG

SEQ ID NO: 319263 - protein, 20 aa, Mycobacterium
LTTFAAFTALIVFLFAITGV

SEQ ID NO: 319264 - protein, 20 aa, Mycobacterium
LTTGRLGDRFGPKKMYLIGL

SEQ ID NO: 319265 - protein, 24 aa, Mycobacterium
LTTIHWRRLPTLPAAIVGWAGLAL

SEQ ID NO: 319266 - protein, 21 aa, Mycobacterium
LTTLTGLQWATWLALANNVFA

SEQ ID NO: 319267 - protein, 27 aa, Mycobacterium
LTTLVRLELPLAWPVIMTGVRVSAQML

SEQ ID NO: 319268 - protein, 25 aa, Mycobacterium
LTTPLRRFDLLAAYGTAFSLAAAAQ

SEQ ID NO: 319269 - protein, 24 aa, Mycobacterium
LTTPLRRFDLLIAYGTAFSTAAAA

SEQ ID NO: 319270 - protein, 25 aa, Mycobacterium
LTTPLRRIDLLAGYGTAFSIAAAAQ

SEQ ID NO: 319271 - protein, 18 aa, Mycobacterium
LTTRATALIAERRGSSYP

SEQ ID NO: 319272 - protein, 18 aa, Mycobacterium
LTTVLSFLLVGHYAERLA

SEQ ID NO: 319273 - protein, 18 aa, Mycobacterium
LTVAFEFTVSNGIVSFFV

SEQ ID NO: 319274 - protein, 34 aa, Mycobacterium
LTVAGAMLCLHFTRLNYFSSMGIPSAIGLAVVIA

SEQ ID NO: 319275 - protein, 17 aa, Mycobacterium
LTVCFYVALVITNFAWM

SEQ ID NO: 319276 - protein, 18 aa, Mycobacterium
LTVEQALGYAARMRLPPD

SEQ ID NO: 319277 - protein, 20 aa, Mycobacterium
LTVFALAIVIGYYVIGNVHH

SEQ ID NO: 319278 - protein, 19 aa, Mycobacterium
LTVFTMRIAAGIGFLQMKR

SEQ ID NO: 319279 - protein, 27 aa, Mycobacterium
LTVGGVDSRLWVGIGVLAGLLAASLAT

SEQ ID NO: 319280 - protein, 22 aa, Mycobacterium
LTVGLFLWIAIIWRGIRGKLKG

SEQ ID NO: 319281 - protein, 26 aa, Mycobacterium
LTVIAVVLLLGWSFFYFSDDTRGYKP

SEQ ID NO: 319282 - protein, 26 aa, Mycobacterium
LTVIGVVLLLGWSFFYFSDDTRGYKP

SEQ ID NO: 319283 - protein, 17 aa, Mycobacterium
LTVLAAISLFVAVVVAT

SEQ ID NO: 319284 - protein, 18 aa, Mycobacterium
LTVLRIVLVPVFVVVLFT

SEQ ID NO: 319285 - protein, 28 aa, Mycobacterium
LTVLRLAQGFAVGGEWGGATLMAVEHAT

SEQ ID NO: 319286 - protein, 17 aa, Mycobacterium
LTVMLIIGVSAPVSGII

SEQ ID NO: 319287 - protein, 31 aa, Mycobacterium
LTVPLSIWVTRVIAPRARRLFVEQWAVIGRL

SEQ ID NO: 319288 - protein, 26 aa, Mycobacterium
LTVPLWLRLWRALGIERAARIRTEER

SEQ ID NO: 319289 - protein, 24 aa, Mycobacterium
LTVQEFPNTLVLAISLVFVVIVAS

SEQ ID NO: 319290 - protein, 17 aa, Mycobacterium
LTVRGGCGYEFRLETSC

SEQ ID NO: 319291 - protein, 27 aa, Mycobacterium
LTVRTLRRGMPFALTWWSLTFPVGTFV

SEQ ID NO: 319292 - protein, 20 aa, Mycobacterium
LTVTLVWLYIEILRLLSYLQ

SEQ ID NO: 319293 - protein, 23 aa, Mycobacterium
LTVTSFCWLWLSTNLLSGLLAVA

SEQ ID NO: 319294 - protein, 19 aa, Mycobacterium
LTVVMPRLSRNAAKNDIPA

SEQ ID NO: 319295 - protein, 18 aa, Mycobacterium
LTVVMPRLSRNAASGDGG

SEQ ID NO: 319296 - protein, 25 aa, Mycobacterium
LTVVYRFGARLLMFAIARESHLLRV

SEQ ID NO: 319297 - protein, 24 aa, Mycobacterium
LTVWAGTTMYAFAPGRDVTVGRDI

SEQ ID NO: 319298 - protein, 28 aa, Mycobacterium
LTVWNIARWPLLLVLVVFGVAMLYYVSP

SEQ ID NO: 319299 - protein, 18 aa, Mycobacterium
LTWGIVVGLVVGKLLGIT

SEQ ID NO: 319300 - protein, 35 aa, Mycobacterium
LTWGRRASLRWRDWRFAVIVTLAWFAVTFTFNTIA

SEQ ID NO: 319301 - protein, 17 aa, Mycobacterium
LTWSQVYARACVVADEL

SEQ ID NO: 319302 - protein, 21 aa, Mycobacterium
LTWSSTMWYSTAAVAAVTLLY

SEQ ID NO: 319303 - protein, 26 aa, Mycobacterium
LTWTHYSGWWVFDMVMLGLFGAVAAG

SEQ ID NO: 319304 - protein, 24 aa, Mycobacterium
LTYELPFLLGHPFNLWTATTDPGW

SEQ ID NO: 319305 - protein, 17 aa, Mycobacterium
LTYRQVLPGALAAAVIW

SEQ ID NO: 319306 - protein, 17 aa, Mycobacterium
LVAAAGFYCYVLTHVLY

SEQ ID NO: 319307 - protein, 23 aa, Mycobacterium
LVAAGLGLWAWAPWDDGDDDALP

SEQ ID NO: 319308 - protein, 21 aa, Mycobacterium
LVAAMPRLLSALATVGTVAML

SEQ ID NO: 319309 - protein, 27 aa, Mycobacterium
LVAAREGRAPVVRRSILNLYRDRAPEV

SEQ ID NO: 319310 - protein, 18 aa, Mycobacterium
LVAATGWLGYLLGPPLIG

SEQ ID NO: 319311 - protein, 17 aa, Mycobacterium
LVAAVVVQPDFDESAVR

SEQ ID NO: 319312 - protein, 18 aa, Mycobacterium
LVACAGLVGVILLVVYRS

SEQ ID NO: 319313 - protein, 17 aa, Mycobacterium
LVACKRDVGAAVLAAYV

SEQ ID NO: 319314 - protein, 19 aa, Mycobacterium
LVADRLGHWALLYTAGLTV

SEQ ID NO: 319315 - protein, 29 aa, Mycobacterium
LVADVPWLLLRLRFFRRKLTVTALAATPA

SEQ ID NO: 319316 - protein, 17 aa, Mycobacterium
LVAEAQSILARTRIGSD

SEQ ID NO: 319317 - protein, 19 aa, Mycobacterium
LVAEISMGAGTLAMIGGTL

SEQ ID NO: 319318 - protein, 19 aa, Mycobacterium
LVAEISMGAGTLAMIGGTV

SEQ ID NO: 319319 - protein, 25 aa, Mycobacterium
LVAEWMGTSLLYWINGIVYATFAVM

SEQ ID NO: 319320 - protein, 17 aa, Mycobacterium
LVAFAVMRHRARPGEDD

SEQ ID NO: 319321 - protein, 17 aa, Mycobacterium
LVAGELVTLLSTQLRAV

SEQ ID NO: 319322 - protein, 17 aa, Mycobacterium
LVAGFLMYASFPPTNWW

SEQ ID NO: 319323 - protein, 24 aa, Mycobacterium
LVAGGLLASFSLRTESALTDPGLD

SEQ ID NO: 319324 - protein, 21 aa, Mycobacterium
LVAGGSFLIALFASMRLTFGV

SEQ ID NO: 319325 - protein, 27 aa, Mycobacterium
LVAGGVLTAFGWRWVFFAPVVLASVVL

SEQ ID NO: 319326 - protein, 20 aa, Mycobacterium
LVAGIFRLTASVWRLPLTAS

SEQ ID NO: 319327 - protein, 24 aa, Mycobacterium
LVAGLAWIGIKWVLKLCQGSLSDK

SEQ ID NO: 319328 - protein, 18 aa, Mycobacterium
LVAGRLGDRFGPKNLYLI

SEQ ID NO: 319329 - protein, 21 aa, Mycobacterium
LVAGRLGDRFGPKNVYLIGLA

SEQ ID NO: 319330 - protein, 17 aa, Mycobacterium
LVAGYLFDPQILEGVRL

SEQ ID NO: 319331 - protein, 19 aa, Mycobacterium
LVAHCAFATSLLGAVLAVN

SEQ ID NO: 319332 - protein, 17 aa, Mycobacterium
LVAIAGLGLFVAVQTVR

SEQ ID NO: 319333 - protein, 18 aa, Mycobacterium
LVAIALVRQRWRGQRAVD

SEQ ID NO: 319334 - protein, 20 aa, Mycobacterium
LVAIALVRQRWRGQRAVDTF

SEQ ID NO: 319335 - protein, 22 aa, Mycobacterium
LVAIGILVGRVMRAHMDARPFG

SEQ ID NO: 319336 - protein, 30 aa, Mycobacterium
LVAIGLGLIFPRLEQWLQRPFSRIPHNSIS

SEQ ID NO: 319337 - protein, 18 aa, Mycobacterium
LVAIPIGLIIGHTGRGQL

SEQ ID NO: 319338 - protein, 17 aa, Mycobacterium
LVAIPIGVTLSIQFALL

SEQ ID NO: 319339 - protein, 25 aa, Mycobacterium
LVAIWGLRLSWHIHRKTVGKGEDPR

SEQ ID NO: 319340 - protein, 24 aa, Mycobacterium
LVAKARLATAVPARPGRGMIGQNY

SEQ ID NO: 319341 - protein, 22 aa, Mycobacterium
LVALGRRIHRLAVSHAFHSALM

SEQ ID NO: 319342 - protein, 26 aa, Mycobacterium
LVALILFPMYFLKSFGYAGVAVVFVG

SEQ ID NO: 319343 - protein, 19 aa, Mycobacterium
LVALPARLANMVAGSALGQ

SEQ ID NO: 319344 - protein, 18 aa, Mycobacterium
LVALPIGVTLSIQFALLA

SEQ ID NO: 319345 - protein, 17 aa, Mycobacterium
LVALPLSLGIAIASDAP

SEQ ID NO: 319346 - protein, 17 aa, Mycobacterium
LVALPLSLGIAIASGAP

SEQ ID NO: 319347 - protein, 17 aa, Mycobacterium
LVALPLSLGIAIASNAP

SEQ ID NO: 319348 - protein, 18 aa, Mycobacterium
LVALSLAVGPVWRVISPM

SEQ ID NO: 319349 - protein, 20 aa, Mycobacterium
LVALTYRYLPWRPLPEDSRE

SEQ ID NO: 319350 - protein, 24 aa, Mycobacterium
LVALWRLDQLDGHRMRRLIPANWR

SEQ ID NO: 319351 - protein, 24 aa, Mycobacterium
LVALWRLDQLDGRRMRRLIPANWR

SEQ ID NO: 319352 - protein, 25 aa, Mycobacterium
LVALWRLDRLDGHRMRRWIPQNWRT

SEQ ID NO: 319353 - protein, 26 aa, Mycobacterium
LVAMALFPMYFLKSFAYAGVAVVAFS

SEQ ID NO: 319354 - protein, 17 aa, Mycobacterium
LVAMLLPLLMIGMALVV

SEQ ID NO: 319355 - protein, 26 aa, Mycobacterium
LVANMSHKQWHDWVFPDIDYIRLCPN

SEQ ID NO: 319356 - protein, 22 aa, Mycobacterium
LVANSPFMGWLYGVFSVQTFSS

SEQ ID NO: 319357 - protein, 28 aa, Mycobacterium
LVAPYPWPAVAAMFVIGVAVTFSGVLSE

SEQ ID NO: 319358 - protein, 24 aa, Mycobacterium
LVAQLGVACAVAIAVDATIVRLVL

SEQ ID NO: 319359 - protein, 17 aa, Mycobacterium
LVAQLPFAGIVFALDGV

SEQ ID NO: 319360 - protein, 23 aa, Mycobacterium
LVARELLRRPGIDRIVQVELDPA

SEQ ID NO: 319361 - protein, 18 aa, Mycobacterium
LVARGWRRPTSVAPTGVI

SEQ ID NO: 319362 - protein, 17 aa, Mycobacterium
LVARILLVATMLVATAW

SEQ ID NO: 319363 - protein, 21 aa, Mycobacterium
LVARREMFVLAPLYKDLKKRQ

SEQ ID NO: 319364 - protein, 17 aa, Mycobacterium
LVARRGNVPLLRVGIPA

SEQ ID NO: 319365 - protein, 22 aa, Mycobacterium
LVARTLPGKQFAAGRQLRVLVI

SEQ ID NO: 319366 - protein, 18 aa, Mycobacterium
LVASAKLFQASNIVLLLA

SEQ ID NO: 319367 - protein, 17 aa, Mycobacterium
LVASGAMVFAILVLLGR

SEQ ID NO: 319368 - protein, 26 aa, Mycobacterium
LVASLAVSGFLGWRQWQDHRVRLAGE

SEQ ID NO: 319369 - protein, 24 aa, Mycobacterium
LVATCLGVGLVAFVLVGGITADRI

SEQ ID NO: 319370 - protein, 17 aa, Mycobacterium
LVATNFFGINTIPIAVN

SEQ ID NO: 319371 - protein, 18 aa, Mycobacterium
LVATNFFGLNAIPIALNE

SEQ ID NO: 319372 - protein, 24 aa, Mycobacterium
LVATRAIARRAQRLFVAQWTSIGR

SEQ ID NO: 319373 - protein, 22 aa, Mycobacterium
LVAVAARFSVTFRDVSLLAESH

SEQ ID NO: 319374 - protein, 22 aa, Mycobacterium
LVAVDRAEFLAALSSNTAAGLR

SEQ ID NO: 319375 - protein, 29 aa, Mycobacterium
LVAVFGMRLLFPLLIVWVTAGLDPVRAME

SEQ ID NO: 319376 - protein, 18 aa, Mycobacterium
LVAVFLLYRWRKNGRPDT

SEQ ID NO: 319377 - protein, 19 aa, Mycobacterium
LVAVLVGGVYVLSSTGNTR

SEQ ID NO: 319378 - protein, 24 aa, Mycobacterium
LVAVTLCSIGTWAAFSLDTTVTYS

SEQ ID NO: 319379 - protein, 25 aa, Mycobacterium
LVAVTMCALAAWAAYSLDSTVLYGM

SEQ ID NO: 319380 - protein, 28 aa, Mycobacterium
LVAVVPRFGAWVVAAWLAGIILDLVTGP

SEQ ID NO: 319381 - protein, 32 aa, Mycobacterium
LVAWAEVMLAQLWWQQHGWLPAAVSWGLAAVF

SEQ ID NO: 319382 - protein, 24 aa, Mycobacterium
LVCAIGLSGGYAFSVFLQGVNPGA

SEQ ID NO: 319383 - protein, 21 aa, Mycobacterium
LVCAIGLSGGYVFSVFLQGVN

SEQ ID NO: 319384 - protein, 17 aa, Mycobacterium
LVCGGEFVDYAELLARV

SEQ ID NO: 319385 - protein, 21 aa, Mycobacterium
LVCTLLLIAALTWGAGRVNAR

SEQ ID NO: 319386 - protein, 20 aa, Mycobacterium
LVDGLGWQWIFFVNVPIGVA

SEQ ID NO: 319387 - protein, 19 aa, Mycobacterium
LVDGWGWQWIFYVNVPVGV

SEQ ID NO: 319388 - protein, 28 aa, Mycobacterium
LVDLRPGVLCAIALNLLAGVRMVEDDYI

SEQ ID NO: 319389 - protein, 18 aa, Mycobacterium
LVDRIFRTGTLIIESAAQ

SEQ ID NO: 319390 - protein, 17 aa, Mycobacterium
LVDRLLQHSVHAVGLNW

SEQ ID NO: 319391 - protein, 21 aa, Mycobacterium
LVDRSHPLPVLGFGFSALAIS

SEQ ID NO: 319392 - protein, 19 aa, Mycobacterium
LVDRWAPGRTMVNVYGPTE

SEQ ID NO: 319393 - protein, 24 aa, Mycobacterium
LVDSWMCAISGRAKQFGMIQYFQD

SEQ ID NO: 319394 - protein, 24 aa, Mycobacterium
LVDTLGWEWIFFVNIPIGVLGVAL

SEQ ID NO: 319395 - protein, 28 aa, Mycobacterium
LVDTVPLVVGWLWPLWDPDRRTFADMLL

SEQ ID NO: 319396 - protein, 18 aa, Mycobacterium
LVEAFVPRGHRLRTQLAL

SEQ ID NO: 319397 - protein, 18 aa, Mycobacterium
LVEDLLLLARLDSGRPLE

SEQ ID NO: 319398 - protein, 18 aa, Mycobacterium
LVEDTARIPAAIEELMRY

SEQ ID NO: 319399 - protein, 18 aa, Mycobacterium
LVEGAVGIAREFGVSDAL

SEQ ID NO: 319400 - protein, 21 aa, Mycobacterium
LVEKIRYFVIALLGGVGLLGA

SEQ ID NO: 319401 - protein, 21 aa, Mycobacterium
LVELARPIPAIAMVPVAILLF

SEQ ID NO: 319402 - protein, 18 aa, Mycobacterium
LVEPTILLAVFALSIPAK

SEQ ID NO: 319403 - protein, 18 aa, Mycobacterium
LVEPWALHRPFIPWLGWP

SEQ ID NO: 319404 - protein, 17 aa, Mycobacterium
LVERFERKHLIIASALA

SEQ ID NO: 319405 - protein, 26 aa, Mycobacterium
LVESLGWRWALVVAPAVALLTIPITI

SEQ ID NO: 319406 - protein, 26 aa, Mycobacterium
LVFAFRSSAALAFAFGMAVTGTITIV

SEQ ID NO: 319407 - protein, 24 aa, Mycobacterium
LVFAMRKSWSVLYLLLAAIAGALP

SEQ ID NO: 319408 - protein, 28 aa, Mycobacterium
LVFFAADHPWRWFLIGFMVLFHLNIISN

SEQ ID NO: 319409 - protein, 28 aa, Mycobacterium
LVFFAGDHPWRWFLIGFMVIFHLNIISN

SEQ ID NO: 319410 - protein, 17 aa, Mycobacterium
LVFFWDALLAWSIVVIA

SEQ ID NO: 319411 - protein, 19 aa, Mycobacterium
LVFGGLWLAIGYLVAALVC

SEQ ID NO: 319412 - protein, 17 aa, Mycobacterium
LVFGISFEFPLLIIMLN

SEQ ID NO: 319413 - protein, 22 aa, Mycobacterium
LVFGVGFMWLGMVVGLMVRTVE

SEQ ID NO: 319414 - protein, 20 aa, Mycobacterium
LVFHGGAPPLQFWQALDTAL

SEQ ID NO: 319415 - protein, 17 aa, Mycobacterium
LVFRAETILILPVAIAM

SEQ ID NO: 319416 - protein, 23 aa, Mycobacterium
LVFSVLAAYAFARLEFPGRDVLF

SEQ ID NO: 319417 - protein, 24 aa, Mycobacterium
LVFTGGGVYAEFLIDGLSVNMRSL

SEQ ID NO: 319418 - protein, 18 aa, Mycobacterium
LVFYAGRYALLAAGAAFA

SEQ ID NO: 319419 - protein, 24 aa, Mycobacterium
LVGAAGWTGIEMGRRFVEAGLNRT

SEQ ID NO: 319420 - protein, 26 aa, Mycobacterium
LVGACTRLPYSLATTIFGGRNWAIIS

SEQ ID NO: 319421 - protein, 19 aa, Mycobacterium
LVGAIAWAIIAFFRGETVN

SEQ ID NO: 319422 - protein, 22 aa, Mycobacterium
LVGALGWKSIFFVNVPIGVVGL

SEQ ID NO: 319423 - protein, 17 aa, Mycobacterium
LVGASLVRAWCGSAPDL

SEQ ID NO: 319424 - protein, 29 aa, Mycobacterium
LVGATIVFLACRWVQAQGGAPLWVGYLGA

SEQ ID NO: 319425 - protein, 19 aa, Mycobacterium
LVGATRWYTQLPFLLEAVI

SEQ ID NO: 319426 - protein, 19 aa, Mycobacterium
LVGAVPWLALAFAESLFCG

SEQ ID NO: 319427 - protein, 18 aa, Mycobacterium
LVGAVPWLALSLLCALWV

SEQ ID NO: 319428 - protein, 18 aa, Mycobacterium
LVGAVPWLALSVVEALFC

SEQ ID NO: 319429 - protein, 26 aa, Mycobacterium
LVGAWFRSGYSLLFLAVPLAGFVIVA

SEQ ID NO: 319430 - protein, 25 aa, Mycobacterium
LVGCARAGQSLVIFPEGRLARAPGL

SEQ ID NO: 319431 - protein, 27 aa, Mycobacterium
LVGCPGSVCKGKVKQAYGFAYQQALDA

SEQ ID NO: 319432 - protein, 17 aa, Mycobacterium
LVGCVIEPWALHRPFIP

SEQ ID NO: 319433 - protein, 23 aa, Mycobacterium
LVGDCALYWIGRGLGQTHLGRYH

SEQ ID NO: 319434 - protein, 21 aa, Mycobacterium
LVGDHGWWTVYAPAGEENRRD

SEQ ID NO: 319435 - protein, 23 aa, Mycobacterium
LVGDPRAAVLVPLVQTATTLPVM

SEQ ID NO: 319436 - protein, 17 aa, Mycobacterium
LVGFGWALLFNGFFGPR

SEQ ID NO: 319437 - protein, 31 aa, Mycobacterium
LVGFQMLMLFGFAGAALWKVGTGAAPGHLSF

SEQ ID NO: 319438 - protein, 18 aa, Mycobacterium
LVGFRQSLAIAWLTLIVA

SEQ ID NO: 319439 - protein, 18 aa, Mycobacterium
LVGGALIEYVDWRAVFWI

SEQ ID NO: 319440 - protein, 21 aa, Mycobacterium
LVGGAVLGSFALRTESTLIDP

SEQ ID NO: 319441 - protein, 24 aa, Mycobacterium
LVGGAWRTALGFTIANALLLRTRI

SEQ ID NO: 319442 - protein, 32 aa, Mycobacterium
LVGGCARIPYTLGIAAFGGRNWTTFSAFVLVI

SEQ ID NO: 319443 - protein, 25 aa, Mycobacterium
LVGGCVRIPYTLGIAKFGGRNWTTF

SEQ ID NO: 319444 - protein, 26 aa, Mycobacterium
LVGGGLALVVMTAWLTPKVGPTIVGA

SEQ ID NO: 319445 - protein, 24 aa, Mycobacterium
LVGGGLLASFSLRSESALTDPGLD

SEQ ID NO: 319446 - protein, 21 aa, Mycobacterium
LVGGLGWQWIFFVNVPVGIVG

SEQ ID NO: 319447 - protein, 18 aa, Mycobacterium
LVGGPWDWQRWAPASPWA

SEQ ID NO: 319448 - protein, 18 aa, Mycobacterium
LVGGRLYHLATDWRTYWG

SEQ ID NO: 319449 - protein, 17 aa, Mycobacterium
LVGGRWAQDLSVSAPHS

SEQ ID NO: 319450 - protein, 24 aa, Mycobacterium
LVGGVLGSISWRGPFFGVSALMAL

SEQ ID NO: 319451 - protein, 24 aa, Mycobacterium
LVGGVLGSVSWRGPFFGVSVLMVV

SEQ ID NO: 319452 - protein, 17 aa, Mycobacterium
LVGGWFDAVVMRLVDGF

SEQ ID NO: 319453 - protein, 27 aa, Mycobacterium
LVGHRNRIAAAYSWGLAFLGRTRGQMA

SEQ ID NO: 319454 - protein, 28 aa, Mycobacterium
LVGHRNRVAAAFSWGLAFLGRTRGQMAI

SEQ ID NO: 319455 - protein, 20 aa, Mycobacterium
LVGIFIARHVLRRVWGSEAR

SEQ ID NO: 319456 - protein, 18 aa, Mycobacterium
LVGIGLALFALRAVVLPW

SEQ ID NO: 319457 - protein, 24 aa, Mycobacterium
LVGKRLPSVVTIPGGVALVAVGLW

SEQ ID NO: 319458 - protein, 25 aa, Mycobacterium
LVGLAFALGMLLTFTLMVGPVKEQL

SEQ ID NO: 319459 - protein, 18 aa, Mycobacterium
LVGLPLAAPLAVLSAAAL

SEQ ID NO: 319460 - protein, 23 aa, Mycobacterium
LVGLSAFMWWRAQQQKVDHKNVN

SEQ ID NO: 319461 - protein, 18 aa, Mycobacterium
LVGLSLLGDLSWWVTAVI

SEQ ID NO: 319462 - protein, 25 aa, Mycobacterium
LVGNANWWPSRRFATRRPARPPQPT

SEQ ID NO: 319463 - protein, 23 aa, Mycobacterium
LVGRNRPALPFALVDADGYSFPS

SEQ ID NO: 319464 - protein, 24 aa, Mycobacterium
LVGRPRPPLPFALIDADGYSFPSG

SEQ ID NO: 319465 - protein, 17 aa, Mycobacterium
LVGRTGRYKVFPVTGTA

SEQ ID NO: 319466 - protein, 20 aa, Mycobacterium
LVGSCVAAFVLLKINPLALF

SEQ ID NO: 319467 - protein, 22 aa, Mycobacterium
LVGSLLIMWAAYRGLAAHWQTI

SEQ ID NO: 319468 - protein, 25 aa, Mycobacterium
LVGSYAQDCVTRWLTATASHQQVLH

SEQ ID NO: 319469 - protein, 17 aa, Mycobacterium
LVGTFAFGLNGALTAVR

SEQ ID NO: 319470 - protein, 17 aa, Mycobacterium
LVGTNFFGINTIPIALN

SEQ ID NO: 319471 - protein, 27 aa, Mycobacterium
LVGTPAMWWLAVPVLLYAAWRMFVRRD

SEQ ID NO: 319472 - protein, 19 aa, Mycobacterium
LVGVLGFSAVVIFLRDHRM

SEQ ID NO: 319473 - protein, 17 aa, Mycobacterium
LVGVLLLSPGLATFLFG

SEQ ID NO: 319474 - protein, 20 aa, Mycobacterium
LVGVPRGRIGIGLKLTGNRT

SEQ ID NO: 319475 - protein, 20 aa, Mycobacterium
LVGVPRGRIGIGLKLTNGRT

SEQ ID NO: 319476 - protein, 25 aa, Mycobacterium
LVGVPRGRVGIGLKLTGGRTAQAWA

SEQ ID NO: 319477 - protein, 19 aa, Mycobacterium
LVGVSALAWLLVDDSSPAR

SEQ ID NO: 319478 - protein, 20 aa, Mycobacterium
LVGVVAFALVVVFLKDHRML

SEQ ID NO: 319479 - protein, 22 aa, Mycobacterium
LVGVVLLLFAGFVVDEPFTDTV

SEQ ID NO: 319480 - protein, 23 aa, Mycobacterium
LVHFFDIQWPWSTAIYTLIVVAW

SEQ ID NO: 319481 - protein, 19 aa, Mycobacterium
LVHHCHREQWPVAGPVLGR

SEQ ID NO: 319482 - protein, 20 aa, Mycobacterium
LVHLACIWMVAIGVNASAFF

SEQ ID NO: 319483 - protein, 17 aa, Mycobacterium
LVHLLGRIPLPGSAPRA

SEQ ID NO: 319484 - protein, 17 aa, Mycobacterium
LVHRGREGYQRGQDAYD

SEQ ID NO: 319485 - protein, 19 aa, Mycobacterium
LVHRRRSLSRADLTRHTGL

SEQ ID NO: 319486 - protein, 17 aa, Mycobacterium
LVHRSVDALEWLALIAM

SEQ ID NO: 319487 - protein, 24 aa, Mycobacterium
LVHWPESWPLVSLSPTVEPFVVFG

SEQ ID NO: 319488 - protein, 18 aa, Mycobacterium
LVHYGPRAPQLWLPPLEE

SEQ ID NO: 319489 - protein, 19 aa, Mycobacterium
LVIACPCALGLATPTALLV

SEQ ID NO: 319490 - protein, 17 aa, Mycobacterium
LVIAGLVGAELYVRHVA

SEQ ID NO: 319491 - protein, 21 aa, Mycobacterium
LVIATLFLLRSMNRQLRKVPE

SEQ ID NO: 319492 - protein, 17 aa, Mycobacterium
LVIAVPVVMYLRDVAPM

SEQ ID NO: 319493 - protein, 17 aa, Mycobacterium
LVICLGALLYSFLSPAG

SEQ ID NO: 319494 - protein, 17 aa, Mycobacterium
LVICLGSLLWSFISPSG

SEQ ID NO: 319495 - protein, 18 aa, Mycobacterium
LVIFVLVYLQFRGDFTPK

SEQ ID NO: 319496 - protein, 18 aa, Mycobacterium
LVIGCILLAGMVGMCSLQ

SEQ ID NO: 319497 - protein, 35 aa, Mycobacterium
LVIGCVVLAGLLGMCSFQLDSRRGPIPSYDAAAAL

SEQ ID NO: 319498 - protein, 17 aa, Mycobacterium
LVIGFALALALHQQRWA

SEQ ID NO: 319499 - protein, 20 aa, Mycobacterium
LVIGVIGGVIGRKTAEVVEA

SEQ ID NO: 319500 - protein, 19 aa, Mycobacterium
LVILGLWLLAGRDIIALMP

SEQ ID NO: 319501 - protein, 25 aa, Mycobacterium
LVILLRAIVAPLYLIGSVLVSFLSA

SEQ ID NO: 319502 - protein, 18 aa, Mycobacterium
LVILPALFSALLTVAGGA

SEQ ID NO: 319503 - protein, 23 aa, Mycobacterium
LVIPCLLLSWAVSHPGIPFVLLT

SEQ ID NO: 319504 - protein, 25 aa, Mycobacterium
LVIPTEYRTVVAFVALIIVLLVRPS

SEQ ID NO: 319505 - protein, 19 aa, Mycobacterium
LVIRKVRGGILIGLVCGTV

SEQ ID NO: 319506 - protein, 28 aa, Mycobacterium
LVISLCIALGVWVTRIFGDVGPLDKINI

SEQ ID NO: 319507 - protein, 24 aa, Mycobacterium
LVITPLRLLFLIVLVGTTVEALTE

SEQ ID NO: 319508 - protein, 17 aa, Mycobacterium
LVIVLAMIALAGAAFAH

SEQ ID NO: 319509 - protein, 17 aa, Mycobacterium
LVIVMMALLVQWARSDD

SEQ ID NO: 319510 - protein, 17 aa, Mycobacterium
LVIVVGLRNVYLWVTYF

SEQ ID NO: 319511 - protein, 19 aa, Mycobacterium
LVIVVGLRNVYLWVVYFLG

SEQ ID NO: 319512 - protein, 24 aa, Mycobacterium
LVIVVMLVYFGLRRSTLLDVADEH

SEQ ID NO: 319513 - protein, 23 aa, Mycobacterium
LVKAGLIGTVLMILVVAVGLQPE

SEQ ID NO: 319514 - protein, 26 aa, Mycobacterium
LVKDGRLSQDRATLWSAVAIAALSPA

SEQ ID NO: 319515 - protein, 17 aa, Mycobacterium
LVKGAAMFDDLGAQIAA

SEQ ID NO: 319516 - protein, 26 aa, Mycobacterium
LVKKRAMAALSRLHGLHVADFLFVPP

SEQ ID NO: 319517 - protein, 23 aa, Mycobacterium
LVKMAWKRALDPVSLLVVPIFGV

SEQ ID NO: 319518 - protein, 17 aa, Mycobacterium
LVKRFAKGLVVRANQVG

SEQ ID NO: 319519 - protein, 18 aa, Mycobacterium
LVKVAPWAFAESMAGCYP

SEQ ID NO: 319520 - protein, 17 aa, Mycobacterium
LVLACLLLPAGAVGDRY

SEQ ID NO: 319521 - protein, 30 aa, Mycobacterium
LVLACVVLAGVLGMCSFAPTGPGAGPVPDY

SEQ ID NO: 319522 - protein, 17 aa, Mycobacterium
LVLAFVALIAFVMLLVS

SEQ ID NO: 319523 - protein, 19 aa, Mycobacterium
LVLALAGSLARQGATPESA

SEQ ID NO: 319524 - protein, 19 aa, Mycobacterium
LVLALTWMQFRGQFEDKVQ

SEQ ID NO: 319525 - protein, 17 aa, Mycobacterium
LVLAMPVALGIAIFLTQ

SEQ ID NO: 319526 - protein, 17 aa, Mycobacterium
LVLARWGSRHRPEPVTS

SEQ ID NO: 319527 - protein, 17 aa, Mycobacterium
LVLASVVGRYARTTAAL

SEQ ID NO: 319528 - protein, 18 aa, Mycobacterium
LVLAVWRAPTQAHWPPVV

SEQ ID NO: 319529 - protein, 20 aa, Mycobacterium
LVLCVVALFAVNVVLTTIGV

SEQ ID NO: 319530 - protein, 18 aa, Mycobacterium
LVLDSPLPLAIGAEAAAE

SEQ ID NO: 319531 - protein, 17 aa, Mycobacterium
LVLELLATLGVALIAVG

SEQ ID NO: 319532 - protein, 17 aa, Mycobacterium
LVLELLATLGVAVIAVS

SEQ ID NO: 319533 - protein, 21 aa, Mycobacterium
LVLEPVAWLLGQTMSILSPLE

SEQ ID NO: 319534 - protein, 28 aa, Mycobacterium
LVLEPVRLVLRRWVKRGGAQEAAPESTA

SEQ ID NO: 319535 - protein, 26 aa, Mycobacterium
LVLFCVIEARVADPMLDIRLFKNRAF

SEQ ID NO: 319536 - protein, 22 aa, Mycobacterium
LVLFPQYFLKSFGYAGVAVVAF

SEQ ID NO: 319537 - protein, 17 aa, Mycobacterium
LVLGHGLHFAMAVAMAT

SEQ ID NO: 319538 - protein, 17 aa, Mycobacterium
LVLGLFWLGWIIVFTST

SEQ ID NO: 319539 - protein, 25 aa, Mycobacterium
LVLGVVLMMLWRVAAPPFFQGQTLP

SEQ ID NO: 319540 - protein, 24 aa, Mycobacterium
LVLIALPVLALWVAIPMALGRTTF

SEQ ID NO: 319541 - protein, 25 aa, Mycobacterium
LVLIVAFFAVWWVYDTYRPEPAPKP

SEQ ID NO: 319542 - protein, 21 aa, Mycobacterium
LVLIWRLVRRESVQPAVSGFI

SEQ ID NO: 319543 - protein, 25 aa, Mycobacterium
LVLLGCLLATLGLWRWSEGTVSVTT

SEQ ID NO: 319544 - protein, 23 aa, Mycobacterium
LVLLGIGIGWGMYGSSPTPFHVA

SEQ ID NO: 319545 - protein, 25 aa, Mycobacterium
LVLLGVGLLWFGWFGFNAGSALAAN

SEQ ID NO: 319546 - protein, 26 aa, Mycobacterium
LVLLIAEGVAVNFWLFRRDAVTVGTD

SEQ ID NO: 319547 - protein, 18 aa, Mycobacterium
LVLLPEYAVLVLLVGALR

SEQ ID NO: 319548 - protein, 26 aa, Mycobacterium
LVLLVWAALLGLWSRLVSPRSMAEQD

SEQ ID NO: 319549 - protein, 21 aa, Mycobacterium
LVLMSCPAFGLALTLVLRTIG

SEQ ID NO: 319550 - protein, 27 aa, Mycobacterium
LVLNAAWSWLFFRFHKLGASAAGAAVL

SEQ ID NO: 319551 - protein, 18 aa, Mycobacterium
LVLQRAGGVLTIIMGLVF

SEQ ID NO: 319552 - protein, 18 aa, Mycobacterium
LVLRRFLRNRAAVASLAV

SEQ ID NO: 319553 - protein, 26 aa, Mycobacterium
LVLRVAVGLTLCWDGLNVVFASEQFK

SEQ ID NO: 319554 - protein, 17 aa, Mycobacterium
LVLSAFAFQAVGALIGT

SEQ ID NO: 319555 - protein, 25 aa, Mycobacterium
LVLTETWFAIGVMLIPLLLSALVLE

SEQ ID NO: 319556 - protein, 25 aa, Mycobacterium
LVLVARFALAGAILATWALIARALW

SEQ ID NO: 319557 - protein, 26 aa, Mycobacterium
LVLVDFKGGATFLGLEAVHHVSAVIT

SEQ ID NO: 319558 - protein, 19 aa, Mycobacterium
LVLVELWPAASRPYIGGSQ

SEQ ID NO: 319559 - protein, 19 aa, Mycobacterium
LVLVLCLAILLPLGMFLDG

SEQ ID NO: 319560 - protein, 18 aa, Mycobacterium
LVLVPIFLLALFAKDGHE

SEQ ID NO: 319561 - protein, 19 aa, Mycobacterium
LVLVPIFLYALFYDGGHQT

SEQ ID NO: 319562 - protein, 25 aa, Mycobacterium
LVLVPRFGWQAAFIVAIIPAVVLFL

SEQ ID NO: 319563 - protein, 18 aa, Mycobacterium
LVLVTALVGVVVNVTATW

SEQ ID NO: 319564 - protein, 28 aa, Mycobacterium
LVLVYRSIACVVLILLTVAFEFTVSNGI

SEQ ID NO: 319565 - protein, 17 aa, Mycobacterium
LVLWAAIGVVFATFAGR

SEQ ID NO: 319566 - protein, 18 aa, Mycobacterium
LVLWASIGLVFSVLVGRG

SEQ ID NO: 319567 - protein, 18 aa, Mycobacterium
LVLYALPMLAGLSMTHAF

SEQ ID NO: 319568 - protein, 18 aa, Mycobacterium
LVMAFCFTTLSTYMRFKD

SEQ ID NO: 319569 - protein, 18 aa, Mycobacterium
LVMEAIAIPLSFLVLVWV

SEQ ID NO: 319570 - protein, 23 aa, Mycobacterium
LVMEEVLAIKPDICFLWDEAWYA

SEQ ID NO: 319571 - protein, 32 aa, Mycobacterium
LVMIGFILGWPWWWISACSVLVLLVLEGVAVN

SEQ ID NO: 319572 - protein, 17 aa, Mycobacterium
LVMILIALIVYGIIELI

SEQ ID NO: 319573 - protein, 17 aa, Mycobacterium
LVMILVAIVIWAATHDD

SEQ ID NO: 319574 - protein, 25 aa, Mycobacterium
LVMISGGIAAWLYVKTYRPDQQVDP

SEQ ID NO: 319575 - protein, 22 aa, Mycobacterium
LVMLCAHALFKAALFMVVGIID

SEQ ID NO: 319576 - protein, 19 aa, Mycobacterium
LVMLLGPAFLDRPAFTGDP

SEQ ID NO: 319577 - protein, 19 aa, Mycobacterium
LVMLLRAIIAPLYLIGSVL

SEQ ID NO: 319578 - protein, 27 aa, Mycobacterium
LVMPLARILGPWFWWPQKLPTPKRATF

SEQ ID NO: 319579 - protein, 32 aa, Mycobacterium
LVMPLARLLGPWFWWPQKLPRRQPVQLRGTPG

SEQ ID NO: 319580 - protein, 17 aa, Mycobacterium
LVMPLRIDAAIDPIEPN

SEQ ID NO: 319581 - protein, 18 aa, Mycobacterium
LVMTWGPSLCRVERNNSG

SEQ ID NO: 319582 - protein, 20 aa, Mycobacterium
LVMYWPLGVVVLVSIVPITL

SEQ ID NO: 319583 - protein, 24 aa, Mycobacterium
LVNDEARRLLGLPPGPVRLDDLPG

SEQ ID NO: 319584 - protein, 26 aa, Mycobacterium
LVNGLRLGLANAWLFLVAAELIASSK

SEQ ID NO: 319585 - protein, 20 aa, Mycobacterium
LVNLNFWGALEAVIMLVLTE

SEQ ID NO: 319586 - protein, 25 aa, Mycobacterium
LVNWVMKRPLAFAIPIAVGMILLVI

SEQ ID NO: 319587 - protein, 31 aa, Mycobacterium
LVPAFMHVMGSWNWWAPKPLVWLHERFGISE

SEQ ID NO: 319588 - protein, 23 aa, Mycobacterium
LVPAFVAWWMRRTLPEAQEWQNT

SEQ ID NO: 319589 - protein, 24 aa, Mycobacterium
LVPAIRWPMWLRTLLATVALAAIL

SEQ ID NO: 319590 - protein, 17 aa, Mycobacterium
LVPALMAMFAQWNWWLP

SEQ ID NO: 319591 - protein, 23 aa, Mycobacterium
LVPCVLIGSLARVYAIVWGLSFF

SEQ ID NO: 319592 - protein, 23 aa, Mycobacterium
LVPDARAALVSMRDRIPHHGVVV

SEQ ID NO: 319593 - protein, 18 aa, Mycobacterium
LVPDAVAAMAAANSELGI

SEQ ID NO: 319594 - protein, 19 aa, Mycobacterium
LVPEAGWQGAASRAYIAQA

SEQ ID NO: 319595 - protein, 18 aa, Mycobacterium
LVPEEGWQGIAAQAYAAQ

SEQ ID NO: 319596 - protein, 23 aa, Mycobacterium
LVPELPIALNLRGFAAVTIDGSP

SEQ ID NO: 319597 - protein, 22 aa, Mycobacterium
LVPFGSLIWVLARWPGNSPGVR

SEQ ID NO: 319598 - protein, 17 aa, Mycobacterium
LVPGDRFWWALNRVAGF

SEQ ID NO: 319599 - protein, 26 aa, Mycobacterium
LVPGGGWRGAAAQAYAANNLAQSQRA

SEQ ID NO: 319600 - protein, 18 aa, Mycobacterium
LVPHWFKPSQVPLLTQLT

SEQ ID NO: 319601 - protein, 18 aa, Mycobacterium
LVPLALFFCHGGWPTTIA

SEQ ID NO: 319602 - protein, 23 aa, Mycobacterium
LVPLEDLCVYPWSPFSLVNGSVS

SEQ ID NO: 319603 - protein, 17 aa, Mycobacterium
LVPLKIFSDRNFSLSSI

SEQ ID NO: 319604 - protein, 20 aa, Mycobacterium
LVPLTCSLATTLVLFEGGRD

SEQ ID NO: 319605 - protein, 18 aa, Mycobacterium
LVPLVPAALIALVLIVIQ

SEQ ID NO: 319606 - protein, 26 aa, Mycobacterium
LVPLWAAMLMWLTLWVLYLSIVNVGQ

SEQ ID NO: 319607 - protein, 21 aa, Mycobacterium
LVPNGTFFFVLAIFLVVLAVI

SEQ ID NO: 319608 - protein, 23 aa, Mycobacterium
LVPNGTFFFVLAIFLVVLGVIGT

SEQ ID NO: 319609 - protein, 24 aa, Mycobacterium
LVPPKEFWAEFDIPREVKKELFFR

SEQ ID NO: 319610 - protein, 23 aa, Mycobacterium
LVPPPRRATAYGVYAAVLGTATA

SEQ ID NO: 319611 - protein, 18 aa, Mycobacterium
LVPQAGWYAGSLVCAAFL

SEQ ID NO: 319612 - protein, 18 aa, Mycobacterium
LVPSAHRLMRSKFGRTVH

SEQ ID NO: 319613 - protein, 21 aa, Mycobacterium
LVPSARFPGWGFVLTALAAPI

SEQ ID NO: 319614 - protein, 30 aa, Mycobacterium
LVPTVRFRPFIRLTVEWVEVLAFIVLLPAA

SEQ ID NO: 319615 - protein, 25 aa, Mycobacterium
LVPYRRRGRVLGWVFGGAAGGMAFG

SEQ ID NO: 319616 - protein, 21 aa, Mycobacterium
LVQAAAMAVIILRYPVDIAQA

SEQ ID NO: 319617 - protein, 19 aa, Mycobacterium
LVQEAWKQIDVELQRRHDL

SEQ ID NO: 319618 - protein, 27 aa, Mycobacterium
LVQGFAVGGEWGGAVLMAVEHAPPKRR

SEQ ID NO: 319619 - protein, 23 aa, Mycobacterium
LVQHPRLARHDALKVLSADLTAD

SEQ ID NO: 319620 - protein, 18 aa, Mycobacterium
LVQIIRWLRPGAVIAIAK

SEQ ID NO: 319621 - protein, 21 aa, Mycobacterium
LVQMMWAMRATGMWTDVRGTN

SEQ ID NO: 319622 - protein, 24 aa, Mycobacterium
LVQPCPRADLAAGQVRVAVGAAGV

SEQ ID NO: 319623 - protein, 28 aa, Mycobacterium
LVRAAGWRLNRLVPHGAVDRLDERLRER

SEQ ID NO: 319624 - protein, 21 aa, Mycobacterium
LVRAGALAANGLRRGDRIVMV

SEQ ID NO: 319625 - protein, 21 aa, Mycobacterium
LVRAGDRWLGAIGLMDLPRPE

SEQ ID NO: 319626 - protein, 17 aa, Mycobacterium
LVRAGQSFVIFPEGRLA

SEQ ID NO: 319627 - protein, 25 aa, Mycobacterium
LVRAKFPQLSAYQVINRLTRTARAP

SEQ ID NO: 319628 - protein, 20 aa, Mycobacterium
LVRARNAYKNAFAQIDVQMR

SEQ ID NO: 319629 - protein, 19 aa, Mycobacterium
LVRAVLCQLATWHSPRDVK

SEQ ID NO: 319630 - protein, 19 aa, Mycobacterium
LVRAWCGSAPDLRRRTDLA

SEQ ID NO: 319631 - protein, 17 aa, Mycobacterium
LVREISGRVSLCVAWSA

SEQ ID NO: 319632 - protein, 26 aa, Mycobacterium
LVRGNLRILLPLAIVGALLLVAGGAI

SEQ ID NO: 319633 - protein, 25 aa, Mycobacterium
LVRGTLRILLPIATLGALLLVAGGA

SEQ ID NO: 319634 - protein, 20 aa, Mycobacterium
LVRGTLRILLPVATVSAMLL

SEQ ID NO: 319635 - protein, 21 aa, Mycobacterium
LVRHPIMLGFIVAFWATPTMT

SEQ ID NO: 319636 - protein, 22 aa, Mycobacterium
LVRHPLMLGFVIVFWAVPTMTA

SEQ ID NO: 319637 - protein, 23 aa, Mycobacterium
LVRHVEKWARVRGDKLAYRFLDF

SEQ ID NO: 319638 - protein, 18 aa, Mycobacterium
LVRIRDAAEAVGFYRGER

SEQ ID NO: 319639 - protein, 18 aa, Mycobacterium
LVRLRDAAEAIGFYRGER

SEQ ID NO: 319640 - protein, 18 aa, Mycobacterium
LVRLRDAAEAVAFYRGEI

SEQ ID NO: 319641 - protein, 17 aa, Mycobacterium
LVRLRDAAEAVGFYRGE

SEQ ID NO: 319642 - protein, 18 aa, Mycobacterium
LVRLRDAAEAVGFYRGER

SEQ ID NO: 319643 - protein, 33 aa, Mycobacterium
LVRLYRRGKVPIIRLGHLLVFFVRALAAVPLAL

SEQ ID NO: 319644 - protein, 37 aa, Mycobacterium
LVRMLLVPAFMHLLGRWNWWAPPPLARLHARIGVSET

SEQ ID NO: 319645 - protein, 17 aa, Mycobacterium
LVRPELALIGGLALVMM

SEQ ID NO: 319646 - protein, 17 aa, Mycobacterium
LVRPELALMGGLALIMM

SEQ ID NO: 319647 - protein, 18 aa, Mycobacterium
LVRPETRARQGITSHRTL

SEQ ID NO: 319648 - protein, 17 aa, Mycobacterium
LVRPIRRLEAGTEKIRS

SEQ ID NO: 319649 - protein, 18 aa, Mycobacterium
LVRPIRRLEAGTERISAG

SEQ ID NO: 319650 - protein, 23 aa, Mycobacterium
LVRPTDRIEAFAVVLTVVVMLVT

SEQ ID NO: 319651 - protein, 20 aa, Mycobacterium
LVRQRWRGQRAVDTFLILPL

SEQ ID NO: 319652 - protein, 25 aa, Mycobacterium
LVRRLLPALILVLAACAVLTVLVQP

SEQ ID NO: 319653 - protein, 18 aa, Mycobacterium
LVRSGMVTPGGWHLWCAA

SEQ ID NO: 319654 - protein, 23 aa, Mycobacterium
LVRSRFPQLSAREVMDRIKNTAH

SEQ ID NO: 319655 - protein, 20 aa, Mycobacterium
LVRYLAREYLLIVSTSSSES

SEQ ID NO: 319656 - protein, 18 aa, Mycobacterium
LVSAMLVWWHFVGANTAD

SEQ ID NO: 319657 - protein, 19 aa, Mycobacterium
LVSANVWWVLAAVVAAMAS

SEQ ID NO: 319658 - protein, 25 aa, Mycobacterium
LVSARSAGLVGVFISVYTVTAAGFA

SEQ ID NO: 319659 - protein, 17 aa, Mycobacterium
LVSCKRDVGAAVLAAYV

SEQ ID NO: 319660 - protein, 24 aa, Mycobacterium
LVSGAWNDFVSWLRDAFVSDVRLP

SEQ ID NO: 319661 - protein, 23 aa, Mycobacterium
LVSGLGWEWIFFVNIPIGLAGLV

SEQ ID NO: 319662 - protein, 18 aa, Mycobacterium
LVSGRLGDRYGPKNVYMV

SEQ ID NO: 319663 - protein, 23 aa, Mycobacterium
LVSGSLWGAFAVLAKEVVARVAD

SEQ ID NO: 319664 - protein, 24 aa, Mycobacterium
LVSIPLGVAIGWYRPVADFLNPIL

SEQ ID NO: 319665 - protein, 25 aa, Mycobacterium
LVSITRLVAWGALAVYLLWRSGFRP

SEQ ID NO: 319666 - protein, 20 aa, Mycobacterium
LVSLRDFLLLFFFLDLGARL

SEQ ID NO: 319667 - protein, 25 aa, Mycobacterium
LVSLVSWGLVWRALHPGVPADDELD

SEQ ID NO: 319668 - protein, 24 aa, Mycobacterium
LVSLWTVRVLAHWQQGRVAQHGAS

SEQ ID NO: 319669 - protein, 23 aa, Mycobacterium
LVSNWLAVLPLQYGGSDGAAGEL

SEQ ID NO: 319670 - protein, 25 aa, Mycobacterium
LVSPARWYWAVIAAFVIFAGTNSWG

SEQ ID NO: 319671 - protein, 26 aa, Mycobacterium
LVSPLHWYWAVIAAFVVFAGTNSWGE

SEQ ID NO: 319672 - protein, 21 aa, Mycobacterium
LVSRIPVSVILIGLGSILVLG

SEQ ID NO: 319673 - protein, 25 aa, Mycobacterium
LVSTIGWIAVPAFLWVAFALLVTDD

SEQ ID NO: 319674 - protein, 24 aa, Mycobacterium
LVSTRMLARRSMLFTNLATIFVGM

SEQ ID NO: 319675 - protein, 20 aa, Mycobacterium
LVSTVGWGWTLLALAGAFLL

SEQ ID NO: 319676 - protein, 23 aa, Mycobacterium
LVSWASSLLSQWGSKLQSFFGGI

SEQ ID NO: 319677 - protein, 21 aa, Mycobacterium
LVTAAGIVWYIAGSVLVVIVV

SEQ ID NO: 319678 - protein, 18 aa, Mycobacterium
LVTAAPWLGITIGLTLAI

SEQ ID NO: 319679 - protein, 17 aa, Mycobacterium
LVTAASLVVHWATMQDL

SEQ ID NO: 319680 - protein, 18 aa, Mycobacterium
LVTAGSLVVHWATMQELY

SEQ ID NO: 319681 - protein, 24 aa, Mycobacterium
LVTAICLQLAIPAQFNLTPRWPLP

SEQ ID NO: 319682 - protein, 34 aa, Mycobacterium
LVTALCLFTALFIMLRRKRIPGVARGPAWRLMGV

SEQ ID NO: 319683 - protein, 22 aa, Mycobacterium
LVTDVFPAFALATGEGEGDVLD

SEQ ID NO: 319684 - protein, 18 aa, Mycobacterium
LVTFAMKGNVLLGSETSA

SEQ ID NO: 319685 - protein, 23 aa, Mycobacterium
LVTGLAGWLFGWLAERSGSLAAP

SEQ ID NO: 319686 - protein, 23 aa, Mycobacterium
LVTGLAGWVFGWLAERSGSLAAP

SEQ ID NO: 319687 - protein, 18 aa, Mycobacterium
LVTGPGFYDVALRDFGLL

SEQ ID NO: 319688 - protein, 18 aa, Mycobacterium
LVTGRLSSLVARARAAVT

SEQ ID NO: 319689 - protein, 20 aa, Mycobacterium
LVTLGIQHVIAFYAGAVLVP

SEQ ID NO: 319690 - protein, 18 aa, Mycobacterium
LVTLPTLALFVAIQMVTG

SEQ ID NO: 319691 - protein, 33 aa, Mycobacterium
LVTLRFIQGFAVGGEWGGAVLLVAEHSPNASRG

SEQ ID NO: 319692 - protein, 20 aa, Mycobacterium
LVTLRGLLLLAFPKAFVSVA

SEQ ID NO: 319693 - protein, 23 aa, Mycobacterium
LVTPRPVWTFGPFDVSGHHIPFQ

SEQ ID NO: 319694 - protein, 22 aa, Mycobacterium
LVTQRFMLRWRAWLTDQLTGDW

SEQ ID NO: 319695 - protein, 22 aa, Mycobacterium
LVTQRLSERLRAPVVTTPQALL

SEQ ID NO: 319696 - protein, 22 aa, Mycobacterium
LVTRRWEEIGGQAYGVGALVHG

SEQ ID NO: 319697 - protein, 17 aa, Mycobacterium
LVTSILVLIAFPLLTAA

SEQ ID NO: 319698 - protein, 18 aa, Mycobacterium
LVTVLWVLYGYSMAFGND

SEQ ID NO: 319699 - protein, 27 aa, Mycobacterium
LVTVPIWVVFLAWASFFFVGGGPAGWV

SEQ ID NO: 319700 - protein, 22 aa, Mycobacterium
LVTYAAAIVLDFLMEGLFMLPA

SEQ ID NO: 319701 - protein, 18 aa, Mycobacterium
LVVAALFALIIAMPLGIW

SEQ ID NO: 319702 - protein, 18 aa, Mycobacterium
LVVAALFGLIIAMPLGIW

SEQ ID NO: 319703 - protein, 20 aa, Mycobacterium
LVVAGATAFVLAKPKGSTEP

SEQ ID NO: 319704 - protein, 18 aa, Mycobacterium
LVVAGLWLQHCCKSPPDP

SEQ ID NO: 319705 - protein, 25 aa, Mycobacterium
LVVAGYWRRGALVIGIGVGVAAALR

SEQ ID NO: 319706 - protein, 18 aa, Mycobacterium
LVVAHGVIDTVAFVGYAL

SEQ ID NO: 319707 - protein, 27 aa, Mycobacterium
LVVAMLLYIVCWWRHLRPETAAPPAEP

SEQ ID NO: 319708 - protein, 31 aa, Mycobacterium
LVVARCEYHPTPGCPQTRITGVPGPGPETRT

SEQ ID NO: 319709 - protein, 20 aa, Mycobacterium
LVVATLFLVRSMNRQLKKVP

SEQ ID NO: 319710 - protein, 35 aa, Mycobacterium
LVVATSVVWWGWRERRDLFSGFGWLAVVLLAVAGA

SEQ ID NO: 319711 - protein, 24 aa, Mycobacterium
LVVAVGCGFAFAPLGPVAGPWSAL

SEQ ID NO: 319712 - protein, 18 aa, Mycobacterium
LVVAVLVVRFTRWGSQFW

SEQ ID NO: 319713 - protein, 28 aa, Mycobacterium
LVVAVSIGLWWYFDRRTSDNQAEAAATC

SEQ ID NO: 319714 - protein, 23 aa, Mycobacterium
LVVDRLSALMLVVSSIVLLAVVF

SEQ ID NO: 319715 - protein, 23 aa, Mycobacterium
LVVDRLSALMLVVSSIVLLAVVV

SEQ ID NO: 319716 - protein, 19 aa, Mycobacterium
LVVFSSIAGHRVRRANYVY

SEQ ID NO: 319717 - protein, 20 aa, Mycobacterium
LVVGCVVAYGLGDMSFAKVD

SEQ ID NO: 319718 - protein, 21 aa, Mycobacterium
LVVGFCWALFFNGFLGAKLGV

SEQ ID NO: 319719 - protein, 19 aa, Mycobacterium
LVVGGRFGLFDPRRVITTH

SEQ ID NO: 319720 - protein, 17 aa, Mycobacterium
LVVGLVLVAGFIAIAVL

SEQ ID NO: 319721 - protein, 18 aa, Mycobacterium
LVVGMGMTLVVAALAARR

SEQ ID NO: 319722 - protein, 19 aa, Mycobacterium
LVVLGRVATPWARATKTAG

SEQ ID NO: 319723 - protein, 29 aa, Mycobacterium
LVVLLARLVARTRLRLPAQRIRAANFAAL

SEQ ID NO: 319724 - protein, 17 aa, Mycobacterium
LVVLLVIIVGAFFIKTA

SEQ ID NO: 319725 - protein, 18 aa, Mycobacterium
LVVLSGYMWWRAQQEKVD

SEQ ID NO: 319726 - protein, 17 aa, Mycobacterium
LVVLVICGLMFRDPPKN

SEQ ID NO: 319727 - protein, 17 aa, Mycobacterium
LVVLWLFVLVPMLISKR

SEQ ID NO: 319728 - protein, 17 aa, Mycobacterium
LVVMDWLELSWRWLFGL

SEQ ID NO: 319729 - protein, 20 aa, Mycobacterium
LVVMILFGACVVFELEGPAG

SEQ ID NO: 319730 - protein, 30 aa, Mycobacterium
LVVMNWLGLSWRWLFGLSIIPALISLIIRY

SEQ ID NO: 319731 - protein, 23 aa, Mycobacterium
LVVPCLLLSWAVSHPGIPFVLLI

SEQ ID NO: 319732 - protein, 18 aa, Mycobacterium
LVVPGALLALGLASLGLN

SEQ ID NO: 319733 - protein, 17 aa, Mycobacterium
LVVPRFAAAVMIGVALT

SEQ ID NO: 319734 - protein, 20 aa, Mycobacterium
LVVRFTRWGSQFWRITGEYY

SEQ ID NO: 319735 - protein, 20 aa, Mycobacterium
LVVRKVRGGLLIGIVAMTVV

SEQ ID NO: 319736 - protein, 17 aa, Mycobacterium
LVVRPDLPETLLPQNYK

SEQ ID NO: 319737 - protein, 20 aa, Mycobacterium
LVVRSGVVYGARLEVVNSGL

SEQ ID NO: 319738 - protein, 22 aa, Mycobacterium
LVVSDRGYTIFLAILPFLIGAL

SEQ ID NO: 319739 - protein, 23 aa, Mycobacterium
LVVSDRGYTIFLAVLPFLIGALS

SEQ ID NO: 319740 - protein, 21 aa, Mycobacterium
LVVSDRGYTVFLALLPFLIGV

SEQ ID NO: 319741 - protein, 21 aa, Mycobacterium
LVVSILLLWFATLVQTYVGLT

SEQ ID NO: 319742 - protein, 26 aa, Mycobacterium
LVVSLLVRRRRVWARLTPENDAPGTV

SEQ ID NO: 319743 - protein, 20 aa, Mycobacterium
LVVSLLVRRRRVWVRLTPDA

SEQ ID NO: 319744 - protein, 26 aa, Mycobacterium
LVVSMLLYIMCWWRHLRPEVPAPADP

SEQ ID NO: 319745 - protein, 18 aa, Mycobacterium
LVVTLGTWVWLGVEEDQY

SEQ ID NO: 319746 - protein, 20 aa, Mycobacterium
LVVVCSVGLCDPHAPRRWLP

SEQ ID NO: 319747 - protein, 23 aa, Mycobacterium
LVVVFLVTWPLVYLASKSPTMAK

SEQ ID NO: 319748 - protein, 17 aa, Mycobacterium
LVVVIGFVAFHLVQTVR

SEQ ID NO: 319749 - protein, 17 aa, Mycobacterium
LVVVLCCAAATCAVAGL

SEQ ID NO: 319750 - protein, 27 aa, Mycobacterium
LVVVLGLAGLVAFLGYRVHQSQQTEQQ

SEQ ID NO: 319751 - protein, 18 aa, Mycobacterium
LVVVTSDAAEWDWVKWLP

SEQ ID NO: 319752 - protein, 17 aa, Mycobacterium
LVVVVAVGLRWLPASGA

SEQ ID NO: 319753 - protein, 18 aa, Mycobacterium
LVVVVFPLLVFVLTRLNR

SEQ ID NO: 319754 - protein, 24 aa, Mycobacterium
LVWAGSILTLVSWRQGRLAPTWSF

SEQ ID NO: 319755 - protein, 24 aa, Mycobacterium
LVWGPRVARKLSWRVLPLATWATA

SEQ ID NO: 319756 - protein, 19 aa, Mycobacterium
LVWLLWVVIERGWYAVVQP

SEQ ID NO: 319757 - protein, 22 aa, Mycobacterium
LVWPLLRGAWRGWAVAAGALVI

SEQ ID NO: 319758 - protein, 23 aa, Mycobacterium
LVWQYLLGLQLHWTVLSTSVIVL

SEQ ID NO: 319759 - protein, 20 aa, Mycobacterium
LVWTGVLCALALMISARVVS

SEQ ID NO: 319760 - protein, 25 aa, Mycobacterium
LVYLLPLILWLWRGETTHDRHAAAR

SEQ ID NO: 319761 - protein, 18 aa, Mycobacterium
LVYTELWVGFTAVTALLI

SEQ ID NO: 319762 - protein, 18 aa, Mycobacterium
LWAARLLLFRVEFGAGLI

SEQ ID NO: 319763 - protein, 26 aa, Mycobacterium
LWAASRLPWVGIRSFDGLGPPRQVIL

SEQ ID NO: 319764 - protein, 26 aa, Mycobacterium
LWAASRLPWVVIRSFDGLGPPKEVTL

SEQ ID NO: 319765 - protein, 17 aa, Mycobacterium
LWAAYGVALVLSIALDV

SEQ ID NO: 319766 - protein, 19 aa, Mycobacterium
LWAGYACSTLIIFPLVIYG

SEQ ID NO: 319767 - protein, 27 aa, Mycobacterium
LWAILGWRPVLVVPLTFTLFTPLAVPG

SEQ ID NO: 319768 - protein, 29 aa, Mycobacterium
LWAIMVSLAELWRSAGVLPDAVIGHSQGE

SEQ ID NO: 319769 - protein, 26 aa, Mycobacterium
LWANSPWSSWYYRLGAITVGPEQLHL

SEQ ID NO: 319770 - protein, 17 aa, Mycobacterium
LWASGRFARRADKVADE

SEQ ID NO: 319771 - protein, 19 aa, Mycobacterium
LWASLRHGMPLGVAYGIWA

SEQ ID NO: 319772 - protein, 20 aa, Mycobacterium
LWASYLVKAYAWRMLLSPEG

SEQ ID NO: 319773 - protein, 17 aa, Mycobacterium
LWAYLGWLRYKVKDPEV

SEQ ID NO: 319774 - protein, 20 aa, Mycobacterium
LWAYWCGPCADELPAMAELQ

SEQ ID NO: 319775 - protein, 19 aa, Mycobacterium
LWCRASRVAGGLRADGLKP

SEQ ID NO: 319776 - protein, 19 aa, Mycobacterium
LWDSGARRLAAWTGSATAA

SEQ ID NO: 319777 - protein, 26 aa, Mycobacterium
LWEQRTEWPLAMVAIAFLAMYSIEVL

SEQ ID NO: 319778 - protein, 17 aa, Mycobacterium
LWFAAAWSATEWGKASI

SEQ ID NO: 319779 - protein, 25 aa, Mycobacterium
LWGALERRWGQWVALVVSTAVFALA

SEQ ID NO: 319780 - protein, 20 aa, Mycobacterium
LWGAMLMWLTLWVLYLSIVN

SEQ ID NO: 319781 - protein, 18 aa, Mycobacterium
LWGAMTFGPFIAHYVAPV

SEQ ID NO: 319782 - protein, 26 aa, Mycobacterium
LWGASRFNWVEVRSFDGLGQPKTTAL

SEQ ID NO: 319783 - protein, 19 aa, Mycobacterium
LWGDARIGNVLYTDFRPAG

SEQ ID NO: 319784 - protein, 25 aa, Mycobacterium
LWGNAWKYLRRSGFFITGSILLTIL

SEQ ID NO: 319785 - protein, 18 aa, Mycobacterium
LWGTIGIGFLALETGLFY

SEQ ID NO: 319786 - protein, 24 aa, Mycobacterium
LWHDGTNFWTGWILQLAAIFFAAA

SEQ ID NO: 319787 - protein, 21 aa, Mycobacterium
LWHPHIVGVLDRGEFNGRLWI

SEQ ID NO: 319788 - protein, 25 aa, Mycobacterium
LWIAAVYHYPWPVGMWGEALAMAVP

SEQ ID NO: 319789 - protein, 22 aa, Mycobacterium
LWIASFFLFPGFNPPMSPAMPA

SEQ ID NO: 319790 - protein, 17 aa, Mycobacterium
LWIGLVVLWLFVLVPML

SEQ ID NO: 319791 - protein, 17 aa, Mycobacterium
LWIGVAVVAVLFGWGAW

SEQ ID NO: 319792 - protein, 26 aa, Mycobacterium
LWIPRLCPLGELLAPLTFVTFAYMSV

SEQ ID NO: 319793 - protein, 19 aa, Mycobacterium
LWISLVVLWLFVLVPMLIS

SEQ ID NO: 319794 - protein, 18 aa, Mycobacterium
LWISLVVLWLFVLVPMLV

SEQ ID NO: 319795 - protein, 25 aa, Mycobacterium
LWITACDHVAFGVWTLWPVLVLFMP

SEQ ID NO: 319796 - protein, 18 aa, Mycobacterium
LWKGRRMGPLVAEEMPVV

SEQ ID NO: 319797 - protein, 17 aa, Mycobacterium
LWLAGWGAARLVATALP

SEQ ID NO: 319798 - protein, 22 aa, Mycobacterium
LWLAPIGAFGWIASIIGATGWG

SEQ ID NO: 319799 - protein, 21 aa, Mycobacterium
LWLETPARLGITIPTVAVPIV

SEQ ID NO: 319800 - protein, 18 aa, Mycobacterium
LWLFAFVLAELLGYSAFA

SEQ ID NO: 319801 - protein, 17 aa, Mycobacterium
LWLPGLMSILALAELQW

SEQ ID NO: 319802 - protein, 18 aa, Mycobacterium
LWLQCAIAGTPRRPDEHA

SEQ ID NO: 319803 - protein, 20 aa, Mycobacterium
LWLVVLLAALWKGRRLGPLV

SEQ ID NO: 319804 - protein, 23 aa, Mycobacterium
LWMLFEGALGWRSVAIGVTAAVA

SEQ ID NO: 319805 - protein, 31 aa, Mycobacterium; identical to SEQ ID NO: 13943

SEQ ID NO: 319806 - protein, 19 aa, Mycobacterium
LWNRMIRFEYALIVSTATA

SEQ ID NO: 319807 - protein, 18 aa, Mycobacterium
LWPLADRPRLAAGAPGGT

SEQ ID NO: 319808 - protein, 38 aa, Mycobacterium
LWPSGAELLIRFTGPEVWWLLTVARWAARMPAATVPVP

SEQ ID NO: 319809 - protein, 18 aa, Mycobacterium
LWQARRLGPLVAESLPVV

SEQ ID NO: 319810 - protein, 24 aa, Mycobacterium
LWQFLCDRRSAIGKVPDERWEQFD

SEQ ID NO: 319811 - protein, 24 aa, Mycobacterium
LWQHLLRIELHWLVLAMSVIVLLA

SEQ ID NO: 319812 - protein, 22 aa, Mycobacterium
LWQRLHEAVLWDAIGITMCRAL

SEQ ID NO: 319813 - protein, 19 aa, Mycobacterium
LWQVRELQFAALAAVLLTA

SEQ ID NO: 319814 - protein, 19 aa, Mycobacterium
LWQVRELQFAVLAAVLLSV

SEQ ID NO: 319815 - protein, 27 aa, Mycobacterium
LWQVSEIRAAALAGVLLLAGLIVGWAG

SEQ ID NO: 319816 - protein, 19 aa, Mycobacterium
LWQYILGIELHWMTMAFSV

SEQ ID NO: 319817 - protein, 22 aa, Mycobacterium
LWQYILGIHLHWMVLAMSVIIL

SEQ ID NO: 319818 - protein, 23 aa, Mycobacterium
LWRGHAAAARGLRPRPRTGHYLR

SEQ ID NO: 319819 - protein, 22 aa, Mycobacterium
LWRGHAAAARGLRSRPSTGHYL

SEQ ID NO: 319820 - protein, 19 aa, Mycobacterium
LWRHALRNALPPIVNIIGL

SEQ ID NO: 319821 - protein, 22 aa, Mycobacterium
LWRLAIYVVVSVLGMFTLVALF

SEQ ID NO: 319822 - protein, 24 aa, Mycobacterium
LWRPIRSYFYWERHCSDIPICWSL

SEQ ID NO: 319823 - protein, 17 aa, Mycobacterium
LWRRGRQTVARIGSALF

SEQ ID NO: 319824 - protein, 20 aa, Mycobacterium
LWSAEPGPLVGQSLTPPGWT

SEQ ID NO: 319825 - protein, 18 aa, Mycobacterium
LWSAIGLVPQRGYLFSGT

SEQ ID NO: 319826 - protein, 17 aa, Mycobacterium
LWSAMFIGIAVLFGIAV

SEQ ID NO: 319827 - protein, 26 aa, Mycobacterium
LWSFKIALAACGAALAVAAGYLVDVA

SEQ ID NO: 319828 - protein, 24 aa, Mycobacterium
LWSLFWEVMCYLVVAIIGVAGLAN

SEQ ID NO: 319829 - protein, 24 aa, Mycobacterium
LWSLIWEVMCYLIVAVIGVVGLAN

SEQ ID NO: 319830 - protein, 24 aa, Mycobacterium
LWSLVWEVICYLAVAGVGLAGLAH

SEQ ID NO: 319831 - protein, 24 aa, Mycobacterium
LWSQACASLAGGILVSGGDPIAQV

SEQ ID NO: 319832 - protein, 19 aa, Mycobacterium
LWSTRRGETEYGLKAVPLG

SEQ ID NO: 319833 - protein, 21 aa, Mycobacterium
LWSTRRGETEYGLKAVPLGGF

SEQ ID NO: 319834 - protein, 17 aa, Mycobacterium
LWSTTVFSVKDGKVLHD

SEQ ID NO: 319835 - protein, 18 aa, Mycobacterium
LWSVALIIGLLALFGGMM

SEQ ID NO: 319836 - protein, 17 aa, Mycobacterium
LWTDPAILGQTLRAIPI

SEQ ID NO: 319837 - protein, 20 aa, Mycobacterium
LWTIALTFEAGYYLVTVVVP

SEQ ID NO: 319838 - protein, 24 aa, Mycobacterium
LWTLGWELLCYLAVVVLGVTGLLG

SEQ ID NO: 319839 - protein, 19 aa, Mycobacterium
LWTLLRIPTLIACGDHDLM

SEQ ID NO: 319840 - protein, 22 aa, Mycobacterium
LWTLVFEFLCYIAIAVAGVAGL

SEQ ID NO: 319841 - protein, 20 aa, Mycobacterium
LWTSALWAVALLVAGTGIGM

SEQ ID NO: 319842 - protein, 20 aa, Mycobacterium
LWTSLWWIAQGWVYAAIATM

SEQ ID NO: 319843 - protein, 20 aa, Mycobacterium
LWTTPLWLVLMVVPFVYLVV

SEQ ID NO: 319844 - protein, 23 aa, Mycobacterium
LWTVGLCLYGLLVGSVVHGIGDE

SEQ ID NO: 319845 - protein, 21 aa, Mycobacterium
LWTVGLCLYGVLMGSVVHGIG

SEQ ID NO: 319846 - protein, 19 aa, Mycobacterium
LWVAWVRRDLLGGYRYPMW

SEQ ID NO: 319847 - protein, 18 aa, Mycobacterium
LWVCLLITAFVIAPVSVW

SEQ ID NO: 319848 - protein, 19 aa, Mycobacterium
LWVCVGLVGFYIALRTPVA

SEQ ID NO: 319849 - protein, 17 aa, Mycobacterium
LWVGFTVISAVLILGLA

SEQ ID NO: 319850 - protein, 26 aa, Mycobacterium
LWVILGWRPVLLVPLTFALFTPLAVP

SEQ ID NO: 319851 - protein, 19 aa, Mycobacterium
LWVSLVFGVLATRYRDISP

SEQ ID NO: 319852 - protein, 26 aa, Mycobacterium
LWVSRADAAVLEWVTQYWNQFLLWAQ

SEQ ID NO: 319853 - protein, 24 aa, Mycobacterium
LWVSRADTAVVDWVVSYWHQFTAW

SEQ ID NO: 319854 - protein, 19 aa, Mycobacterium
LWVVTVVPLLLATLAIAVW

SEQ ID NO: 319855 - protein, 17 aa, Mycobacterium
LWWALALGADFGGNLTA

SEQ ID NO: 319856 - protein, 22 aa, Mycobacterium
LWWALLLVVGFWGVLRVSEALG

SEQ ID NO: 319857 - protein, 24 aa, Mycobacterium
LWWISESGVRFGVPRQEDTMNALG

SEQ ID NO: 319858 - protein, 21 aa, Mycobacterium
LWWNKPWPLRLGAIARLPLQI

SEQ ID NO: 319859 - protein, 21 aa, Mycobacterium
LWWRHLISFLIAPVTMTLVIP

SEQ ID NO: 319860 - protein, 23 aa, Mycobacterium
LWWRHLMSVLLFPATMTLVVPAL

SEQ ID NO: 319861 - protein, 18 aa, Mycobacterium
LWWSLAWTAGMIAYAGDV

SEQ ID NO: 319862 - protein, 24 aa, Mycobacterium
LWWVSDQGIRYGIELDDSALKPLH

SEQ ID NO: 319863 - protein, 23 aa, Mycobacterium
LWYAGLPLKVFLSSVVAAVLAAA

SEQ ID NO: 319864 - protein, 18 aa, Mycobacterium
LYAACLAIGYLSTQLVVG

SEQ ID NO: 319865 - protein, 18 aa, Mycobacterium
LYAACLAIGYLSTQVVVG

SEQ ID NO: 319866 - protein, 18 aa, Mycobacterium
LYAACLAIGYLTTQVVVG

SEQ ID NO: 319867 - protein, 21 aa, Mycobacterium
LYAFLCATALMVVRSEERHAR

SEQ ID NO: 319868 - protein, 26 aa, Mycobacterium
LYAKERRFAVAFVMVGAILFVAGAIL

SEQ ID NO: 319869 - protein, 18 aa, Mycobacterium
LYAKVGFVLQETQLVHGS

SEQ ID NO: 319870 - protein, 20 aa, Mycobacterium
LYALLINRWPLPETGEPSGL

SEQ ID NO: 319871 - protein, 22 aa, Mycobacterium
LYALLVNRWPLPEAGADSGFAP

SEQ ID NO: 319872 - protein, 20 aa, Mycobacterium
LYALLVNRWPLPESGEPSGL

SEQ ID NO: 319873 - protein, 18 aa, Mycobacterium
LYALVLIPFGVYLASYTP

SEQ ID NO: 319874 - protein, 18 aa, Mycobacterium
LYAQVGFVLQETQLVHGT

SEQ ID NO: 319875 - protein, 27 aa, Mycobacterium
LYAVCASVLHWLRLFILQSPRPMPRAR

SEQ ID NO: 319876 - protein, 18 aa, Mycobacterium
LYAVMAMWTGFAAVALSR

SEQ ID NO: 319877 - protein, 25 aa, Mycobacterium
LYAVMAQPLGAGWVPAVLLHHWLQL

SEQ ID NO: 319878 - protein, 20 aa, Mycobacterium
LYAVMARPLGARWVPAVLLD

SEQ ID NO: 319879 - protein, 19 aa, Mycobacterium
LYAVPAMLGASITALLIHV

SEQ ID NO: 319880 - protein, 26 aa, Mycobacterium
LYDATDSLLRFAVRSDATLTGLFGLV

SEQ ID NO: 319881 - protein, 24 aa, Mycobacterium
LYDHPRLGSLAGFLDELGPPPQVD

SEQ ID NO: 319882 - protein, 24 aa, Mycobacterium
LYDHPRLGSLAGYLDELDPPAAVE

SEQ ID NO: 319883 - protein, 18 aa, Mycobacterium
LYDPAGRYGSWNLPALAC

SEQ ID NO: 319884 - protein, 27 aa, Mycobacterium
LYDSTDSLLRFAMRADATLTGLLGLAV

SEQ ID NO: 319885 - protein, 18 aa, Mycobacterium
LYEGHILAAILMGFWIGA

SEQ ID NO: 319886 - protein, 40 aa, Mycobacterium
LYEPRGDRAVRRWRRIATHVVRWPGPVLAGSLAVLALAIL

SEQ ID NO: 319887 - protein, 25 aa, Mycobacterium
LYESNVVAVLGMPVGKITKITPQSG

SEQ ID NO: 319888 - protein, 22 aa, Mycobacterium
LYFCVGMAVLLVGFYAVDVLTP

SEQ ID NO: 319889 - protein, 25 aa, Mycobacterium
LYFDGRLDAGLGRSLTLTVIGLVIG

SEQ ID NO: 319890 - protein, 33 aa, Mycobacterium
LYFNALVAIAITGVWLWLDYDALLLVVATQILQ

SEQ ID NO: 319891 - protein, 27 aa, Mycobacterium
LYFWLPCLACLLALAELHLRTARLTVA

SEQ ID NO: 319892 - protein, 29 aa, Mycobacterium
LYGAGAYIWWGLCPGFFLLLLPAGPLEVV

SEQ ID NO: 319893 - protein, 23 aa, Mycobacterium
LYGARISLAIGVPATTIAMVVGV

SEQ ID NO: 319894 - protein, 27 aa, Mycobacterium
LYGDFFSFYMCDLLLKLNGKGGQPIYV

SEQ ID NO: 319895 - protein, 21 aa, Mycobacterium
LYGGALAWLAPPVLRRMTGQG

SEQ ID NO: 319896 - protein, 29 aa, Mycobacterium
LYGIFIVWLFHDWRDVFWINVPLTAIAML

SEQ ID NO: 319897 - protein, 29 aa, Mycobacterium
LYGIFIVWLFHDWRDVFWINVPLTAIAMV

SEQ ID NO: 319898 - protein, 29 aa, Mycobacterium
LYGIFIVYLFHDWRYVFWINVPLTLIAMA

SEQ ID NO: 319899 - protein, 17 aa, Mycobacterium
LYGIWSVQAFFVDGTYV

SEQ ID NO: 319900 - protein, 19 aa, Mycobacterium
LYGLHALLRLHFLQEEENY

SEQ ID NO: 319901 - protein, 30 aa, Mycobacterium
LYGLIDIRFIPKYLFSVSFCGILVATGSYL

SEQ ID NO: 319902 - protein, 20 aa, Mycobacterium
LYGLVGILGVHIWVTNKVDF

SEQ ID NO: 319903 - protein, 17 aa, Mycobacterium
LYGNTRSPLDFTTDPGA

SEQ ID NO: 319904 - protein, 20 aa, Mycobacterium
LYGNYAWWFRLSGLGVLALL

SEQ ID NO: 319905 - protein, 19 aa, Mycobacterium
LYGPGGVPLWPGVPPAPTE

SEQ ID NO: 319906 - protein, 23 aa, Mycobacterium
LYGRETTVPWGLEIFYRRDPSGF

SEQ ID NO: 319907 - protein, 22 aa, Mycobacterium
LYGRETTVPWGLEIYERRNSAG

SEQ ID NO: 319908 - protein, 25 aa, Mycobacterium
LYGVGMAVGMWAFFAALGAGPISVV

SEQ ID NO: 319909 - protein, 17 aa, Mycobacterium
LYHCVERLIVARRISTV

SEQ ID NO: 319910 - protein, 17 aa, Mycobacterium
LYHDMGLMVGLFIPVYC

SEQ ID NO: 319911 - protein, 18 aa, Mycobacterium
LYIACLAVTYLTCQVVAN

SEQ ID NO: 319912 - protein, 25 aa, Mycobacterium
LYIARTRWGTPLWLVLIGGGALLLV

SEQ ID NO: 319913 - protein, 21 aa, Mycobacterium
LYIFWELTTVLSFLLVGHYAE

SEQ ID NO: 319914 - protein, 19 aa, Mycobacterium
LYILLGWVAAWFIGPIMDG

SEQ ID NO: 319915 - protein, 21 aa, Mycobacterium
LYIRLRLGDTPQFAELAKADK

SEQ ID NO: 319916 - protein, 20 aa, Mycobacterium
LYISPWLFLLGVSMAALTAY

SEQ ID NO: 319917 - protein, 18 aa, Mycobacterium
LYIVGVFVSFTFSQIGMV

SEQ ID NO: 319918 - protein, 25 aa, Mycobacterium
LYIVGYCLLAIAIGAVLSFGADLLG

SEQ ID NO: 319919 - protein, 26 aa, Mycobacterium
LYKSAPRGSLIWLVLAIGVAMLGQRL

SEQ ID NO: 319920 - protein, 24 aa, Mycobacterium
LYLAVTALIAWRAVDERLDRDGFE

SEQ ID NO: 319921 - protein, 17 aa, Mycobacterium
LYLFAALLVCAAGYAEG

SEQ ID NO: 319922 - protein, 24 aa, Mycobacterium
LYLGALLRLPRWLIDLSPVSRTTV

SEQ ID NO: 319923 - protein, 26 aa, Mycobacterium
LYLIDAIACVAPIWATVRLHTMPPTG

SEQ ID NO: 319924 - protein, 19 aa, Mycobacterium
LYLIVGGIIYAVLWLYGLV

SEQ ID NO: 319925 - protein, 20 aa, Mycobacterium
LYLMLGYVAIWFADALLHGA

SEQ ID NO: 319926 - protein, 24 aa, Mycobacterium
LYLNYVWHYSLLKAGFAIAPAALI

SEQ ID NO: 319927 - protein, 23 aa, Mycobacterium
LYLPELGGAVVMAFVFGHVISRR

SEQ ID NO: 319928 - protein, 17 aa, Mycobacterium
LYLRVPALNALFPDYRG

SEQ ID NO: 319929 - protein, 24 aa, Mycobacterium
LYLWHWPLLIFWLAYSGHAQANLA

SEQ ID NO: 319930 - protein, 24 aa, Mycobacterium
LYLWHWPLLIFWLAYSGHTQANLA

SEQ ID NO: 319931 - protein, 25 aa, Mycobacterium
LYLWHWPLLIFWLSFTGHRHAGFVE

SEQ ID NO: 319932 - protein, 23 aa, Mycobacterium
LYLWHWPLLIFWLSYSGHTAANF

SEQ ID NO: 319933 - protein, 24 aa, Mycobacterium
LYLWHWPLLIFWLSYTGHKHATFL

SEQ ID NO: 319934 - protein, 24 aa, Mycobacterium
LYLWHWPLLIFWLSYTGHRHANFI

SEQ ID NO: 319935 - protein, 24 aa, Mycobacterium
LYLWHWPLLIFWLSYTGHRQANFL

SEQ ID NO: 319936 - protein, 22 aa, Mycobacterium
LYLWHWPLLIFYLAYTGGTRVN

SEQ ID NO: 319937 - protein, 22 aa, Mycobacterium
LYLWHWPVLIFWLVHTGAPRVG

SEQ ID NO: 319938 - protein, 18 aa, Mycobacterium
LYNGWRPALYAAVKALAL

SEQ ID NO: 319939 - protein, 23 aa, Mycobacterium
LYNQRGIGLWVVYVKDFGGLTPA

SEQ ID NO: 319940 - protein, 26 aa, Mycobacterium
LYNTPTAQCLVAWEAQRIRDARGGRP

SEQ ID NO: 319941 - protein, 35 aa, Mycobacterium
LYPDEVKYIPANVHARIRATTFFSAKYVDLVYPSR

SEQ ID NO: 319942 - protein, 20 aa, Mycobacterium
LYPHCAPKIGVLGENPSLDQ

SEQ ID NO: 319943 - protein, 21 aa, Mycobacterium
LYPHCAPKIGVLGRNPDVTES

SEQ ID NO: 319944 - protein, 18 aa, Mycobacterium
LYPHWRRVVEANAAHLRR

SEQ ID NO: 319945 - protein, 17 aa, Mycobacterium
LYPLLPIYLTTVLGAPP

SEQ ID NO: 319946 - protein, 22 aa, Mycobacterium
LYPRVELRPDALYVDDGDILTS

SEQ ID NO: 319947 - protein, 24 aa, Mycobacterium
LYQKERRFAIAFVVPAVVLFGAGA

SEQ ID NO: 319948 - protein, 24 aa, Mycobacterium
LYQKERRFAVAFVIPAALLFVAGA

SEQ ID NO: 319949 - protein, 24 aa, Mycobacterium
LYQKERRFAVGFVVPAAVLFVAGA

SEQ ID NO: 319950 - protein, 23 aa, Mycobacterium
LYQRELIALFPPMITTMKSMRAM

SEQ ID NO: 319951 - protein, 17 aa, Mycobacterium
LYQREPLLILAYAVLLI

SEQ ID NO: 319952 - protein, 18 aa, Mycobacterium
LYQRMIINTLPFFFRGSV

SEQ ID NO: 319953 - protein, 24 aa, Mycobacterium
LYRIGALCPYCMVVWSVTIPLLVV

SEQ ID NO: 319954 - protein, 27 aa, Mycobacterium
LYRIGSLCPYCMVVWIITATLLVVVGS

SEQ ID NO: 319955 - protein, 27 aa, Mycobacterium
LYRILTCWLPVFVGWPIMRWLTRKEMV

SEQ ID NO: 319956 - protein, 20 aa, Mycobacterium
LYRIRVGRRIGSAALVADGL

SEQ ID NO: 319957 - protein, 23 aa, Mycobacterium
LYRLGELVPALALVIAANVSLVV

SEQ ID NO: 319958 - protein, 26 aa, Mycobacterium
LYRPVATLWLFAIGWAAARATRDRER

SEQ ID NO: 319959 - protein, 23 aa, Mycobacterium
LYRQQRLWGATPLVASWQLVMSG

SEQ ID NO: 319960 - protein, 21 aa, Mycobacterium
LYSELAASWLWVVASGGLYLW

SEQ ID NO: 319961 - protein, 19 aa, Mycobacterium
LYSFWGVVVTYMYFILPLY

SEQ ID NO: 319962 - protein, 17 aa, Mycobacterium
LYSGIVLAGIGMGMVVG

SEQ ID NO: 319963 - protein, 24 aa, Mycobacterium
LYSIGALCPYCMVVWAATITLLVV

SEQ ID NO: 319964 - protein, 17 aa, Mycobacterium
LYTLLAVAAARWPDRTA

SEQ ID NO: 319965 - protein, 24 aa, Mycobacterium
LYVACLAVSYLSCQVMVGIMSGGS

SEQ ID NO: 319966 - protein, 20 aa, Mycobacterium
LYVAVCLLAALLALPEAARH

SEQ ID NO: 319967 - protein, 36 aa, Mycobacterium
LYVFPLGVVVGGPFLPLAIILYWFANNIWTFGQQHY

SEQ ID NO: 319968 - protein, 36 aa, Mycobacterium
LYVFPLGVVVGGPFLPLAIIMYWLANNIWTFGQQHY

SEQ ID NO: 319969 - protein, 24 aa, Mycobacterium
LYVFWEITTVLSFLLVGHYAERAT

SEQ ID NO: 319970 - protein, 19 aa, Mycobacterium
LYVGSRTGTGFGRDLRSAV

SEQ ID NO: 319971 - protein, 23 aa, Mycobacterium
LYVHLEMTLPIYIWALLISLALN

SEQ ID NO: 319972 - protein, 26 aa, Mycobacterium
LYVILGWRPVLLVPLTFALFTPLALP

SEQ ID NO: 319973 - protein, 24 aa, Mycobacterium
LYVILGWRRVLLIPLTFALFTPLG

SEQ ID NO: 319974 - protein, 24 aa, Mycobacterium
LYVIRDWLPFALVLVAYDLSRGAA

SEQ ID NO: 319975 - protein, 19 aa, Mycobacterium
LYVLPWICAPLAIAVLWRW

SEQ ID NO: 319976 - protein, 17 aa, Mycobacterium
LYVMSWVDRRRGHHLRG

SEQ ID NO: 319977 - protein, 17 aa, Mycobacterium
LYVPPLLVGAHPLVVVA

SEQ ID NO: 319978 - protein, 20 aa, Mycobacterium
LYVTALLFILAWATSGLNGW

SEQ ID NO: 319979 - protein, 20 aa, Mycobacterium
LYVTALLFILAWSTSGINGW

SEQ ID NO: 319980 - protein, 29 aa, Mycobacterium
LYVTQRFLIRWRVWLTDRLTADWLGGRAY

SEQ ID NO: 319981 - protein, 22 aa, Mycobacterium
LYVTRGAGFWGPPVRIGAPPDI

SEQ ID NO: 319982 - protein, 19 aa, Mycobacterium
LYVVFRWFFAKDLRVQPNP

SEQ ID NO: 319983 - protein, 20 aa, Mycobacterium
LYYGLPMWLIMTLRVTIIVL

SEQ ID NO: 319984 - protein, 20 aa, Mycobacterium
MAAAICLFGIALNAVNPGEA

SEQ ID NO: 319985 - protein, 20 aa, Mycobacterium
MAAAMAWGLLVAHRRPPPPP

SEQ ID NO: 319986 - protein, 19 aa, Mycobacterium
MAACSGAQCPDLGPNGLVY

SEQ ID NO: 319987 - protein, 19 aa, Mycobacterium
MAAGGLVIVIGVVSGLLGA

SEQ ID NO: 319988 - protein, 23 aa, Mycobacterium
MAAGGWTAIPMWVLGILTFLVPA

SEQ ID NO: 319989 - protein, 22 aa, Mycobacterium
MAAGLLLGRWIPGLNTALEKVQ

SEQ ID NO: 319990 - protein, 22 aa, Mycobacterium
MAAGLLLGRWIPGLNTALESIQ

SEQ ID NO: 319991 - protein, 22 aa, Mycobacterium
MAAGLLLGRWIPGLNTALESVQ

SEQ ID NO: 319992 - protein, 19 aa, Mycobacterium
MAAHRRWGLMVPAVLAVAL

SEQ ID NO: 319993 - protein, 20 aa, Mycobacterium
MAAIRKPWQMYPVGLLFGLG

SEQ ID NO: 319994 - protein, 21 aa, Mycobacterium
MAAKVDWPNFWSLITSTSSRT

SEQ ID NO: 319995 - protein, 18 aa, Mycobacterium
MAAMLAVMGLCFAAAVEA

SEQ ID NO: 319996 - protein, 19 aa, Mycobacterium
MAAMRKRPWLLGFLGLAVG

SEQ ID NO: 319997 - protein, 20 aa, Mycobacterium
MAAPCSLVRIVPATLGPDTL

SEQ ID NO: 319998 - protein, 24 aa, Mycobacterium
MAAPLFVLAFAWGKLGLSQRRWIR

SEQ ID NO: 319999 - protein, 17 aa, Mycobacterium
MAAPVWIAKTGPFAWNG

SEQ ID NO: 320000 - protein, 19 aa, Mycobacterium
MAAVMLRAGIPEARAALDV

SEQ ID NO: 320001 - protein, 18 aa, Mycobacterium
MAAVQLARHWGVEIFVTA

SEQ ID NO: 320002 - protein, 25 aa, Mycobacterium
MADAGWRLPAFAAFMVTATETLAGI

SEQ ID NO: 320003 - protein, 25 aa, Mycobacterium
MADFARLYPFQVFMDLYGLPLADRD

SEQ ID NO: 320004 - protein, 25 aa, Mycobacterium
MADFARLYPYQVFMDLYGLPLEDRD

SEQ ID NO: 320005 - protein, 24 aa, Mycobacterium
MADLDRGAAELVLSQAEAVKKVRD

SEQ ID NO: 320006 - protein, 17 aa, Mycobacterium
MADLDRLAAELVSAQAD

SEQ ID NO: 320007 - protein, 18 aa, Mycobacterium
MADLDRLAAELVSAQAEH

SEQ ID NO: 320008 - protein, 20 aa, Mycobacterium
MADVLSFRLKQRPVRMAAAT

SEQ ID NO: 320009 - protein, 17 aa, Mycobacterium
MAEAGLRNTFWALVLPF

SEQ ID NO: 320010 - protein, 18 aa, Mycobacterium
MAESLLVSALVTLTGAVV

SEQ ID NO: 320011 - protein, 23 aa, Mycobacterium
MAETRPVQKFAVTLLLSSFVALV

SEQ ID NO: 320012 - protein, 20 aa, Mycobacterium
MAETYIPFFGQRLGHLSPVA

SEQ ID NO: 320013 - protein, 18 aa, Mycobacterium
MAEVYLALHPRLPRRDVI

SEQ ID NO: 320014 - protein, 17 aa, Mycobacterium
MAFALTIHGDGPRFFTK

SEQ ID NO: 320015 - protein, 18 aa, Mycobacterium
MAFAMIARLRDPRVEAPS

SEQ ID NO: 320016 - protein, 27 aa, Mycobacterium
MAFQACFISAAAVAARFGAAALAAHQV

SEQ ID NO: 320017 - protein, 27 aa, Mycobacterium
MAFQACFISAGAVAARFGAASVAAHQV

SEQ ID NO: 320018 - protein, 25 aa, Mycobacterium
MAGALTGAVLARWQVALLAVVIVTA

SEQ ID NO: 320019 - protein, 27 aa, Mycobacterium
MAGAYAGGVLGRFIPGTALLIAFAVVM

SEQ ID NO: 320020 - protein, 19 aa, Mycobacterium
MAGFLPWFADIDRQMYFFY

SEQ ID NO: 320021 - protein, 23 aa, Mycobacterium
MAGGNLFAAMSLWVLAMCVYVVM

SEQ ID NO: 320022 - protein, 21 aa, Mycobacterium
MAGGWRRWTATLTVLSAVAVL

SEQ ID NO: 320023 - protein, 24 aa, Mycobacterium
MAGPTLTSFAWRGHVAGARDKGAD

SEQ ID NO: 320024 - protein, 21 aa, Mycobacterium
MAGPVAPRPGGTGWSERSGHH

SEQ ID NO: 320025 - protein, 25 aa, Mycobacterium
MAGRGGSFVFRHRAGNVVILVLMLV

SEQ ID NO: 320026 - protein, 21 aa, Mycobacterium
MAGTVVEWYEFFLYATAATLV

SEQ ID NO: 320027 - protein, 22 aa, Mycobacterium
MAGTVVEWYEFFLYATAATLVF

SEQ ID NO: 320028 - protein, 21 aa, Mycobacterium
MAGTVVEWYEFFLYGTAATLV

SEQ ID NO: 320029 - protein, 17 aa, Mycobacterium
MAGVALFVIVMAVVAGA

SEQ ID NO: 320030 - protein, 24 aa, Mycobacterium
MAHAFSIQLICRALGMLASVVSVA

SEQ ID NO: 320031 - protein, 19 aa, Mycobacterium
MAHGDVRPAFAIASVVGIP

SEQ ID NO: 320032 - protein, 27 aa, Mycobacterium
MAHHRCTAREWMWAVLLAGAVAVIVLA

SEQ ID NO: 320033 - protein, 24 aa, Mycobacterium
MAHPGKRAPTVELCNDPNGYQPLA

SEQ ID NO: 320034 - protein, 26 aa, Mycobacterium
MAIALICAAAVFSAITLRDLRIPAIG

SEQ ID NO: 320035 - protein, 18 aa, Mycobacterium
MAIGLAVGVIGGRALLVF

SEQ ID NO: 320036 - protein, 17 aa, Mycobacterium
MAILLSFMSAQLVTTIF

SEQ ID NO: 320037 - protein, 20 aa, Mycobacterium
MAIMGTFFFLNPVLVFFQGV

SEQ ID NO: 320038 - protein, 19 aa, Mycobacterium
MAINILIAFVAFSLAASCI

SEQ ID NO: 320039 - protein, 18 aa, Mycobacterium
MAIRREAEQFVGIELSAT

SEQ ID NO: 320040 - protein, 26 aa, Mycobacterium
MAIVGWASGLGFGWVYTLGTANVVRS

SEQ ID NO: 320041 - protein, 23 aa, Mycobacterium
MALAVAIPAVWTQWNVIGEDGYA

SEQ ID NO: 320042 - protein, 17 aa, Mycobacterium
MALAYRYGGTIKALLLT

SEQ ID NO: 320043 - protein, 17 aa, Mycobacterium
MALAYRYGGTIKALLVC

SEQ ID NO: 320044 - protein, 30 aa, Mycobacterium
MALCIPGALFMLSCFFVFGSLYHLHGATPS

SEQ ID NO: 320045 - protein, 18 aa, Mycobacterium
MALGRTTFLPPLGTWFAA

SEQ ID NO: 320046 - protein, 17 aa, Mycobacterium
MALKARIFRRSNRKPAA

SEQ ID NO: 320047 - protein, 17 aa, Mycobacterium
MALLLLACVPLNWIITM

SEQ ID NO: 320048 - protein, 35 aa, Mycobacterium
MALLVIGFVLGWPWWWISACSVLVLLIAEGVAVNF

SEQ ID NO: 320049 - protein, 19 aa, Mycobacterium
MALMVRAGLGLDPWDVFHQ

SEQ ID NO: 320050 - protein, 22 aa, Mycobacterium
MALPCAISVLVIVAAALTLAPA

SEQ ID NO: 320051 - protein, 27 aa, Mycobacterium
MALRQEAALTWLLLVSVPVMAVANYWV

SEQ ID NO: 320052 - protein, 29 aa, Mycobacterium
MALSGALAFWVCGLLLCLFVGPSQSSARA

SEQ ID NO: 320053 - protein, 28 aa, Mycobacterium
MALTLWLHVVDLRFSADVRRRLLDKLSR

SEQ ID NO: 320054 - protein, 17 aa, Mycobacterium
MALVPVFLVFLFTDGGH

SEQ ID NO: 320055 - protein, 18 aa, Mycobacterium
MALWSMLPWYALLVPCVL

SEQ ID NO: 320056 - protein, 17 aa, Mycobacterium
MALYLWHMVPVVIVAVV

SEQ ID NO: 320057 - protein, 31 aa, Mycobacterium
MAMFSQWNWWLPRWLARMLPSVDFDRPLPEV

SEQ ID NO: 320058 - protein, 32 aa, Mycobacterium
MAMTPLGWRWAGIVWAYALFWFLIEDRVKLGA

SEQ ID NO: 320059 - protein, 19 aa, Mycobacterium
MAMVLLRERISGLAAVGLI

SEQ ID NO: 320060 - protein, 45 aa, Mycobacterium
MAMVPRLQFTNWQWLSLTLAAPVVVWGAWPFHRAGWANLRHGTAT

SEQ ID NO: 320061 - protein, 25 aa, Mycobacterium
MANDIYKWGEFGMLPSLNARRHPDR

SEQ ID NO: 320062 - protein, 18 aa, Mycobacterium
MANMRLHAGVEVTPANAR

SEQ ID NO: 320063 - protein, 24 aa, Mycobacterium
MAPAALPWYYSWPLAIAAPLLQSR

SEQ ID NO: 320064 - protein, 19 aa, Mycobacterium
MAPAAPPWPGPQPAEPAAP

SEQ ID NO: 320065 - protein, 17 aa, Mycobacterium
MAPAISPKKSWEGLAGS

SEQ ID NO: 320066 - protein, 18 aa, Mycobacterium
MAPFHHHFELVGWAETTV

SEQ ID NO: 320067 - protein, 27 aa, Mycobacterium
MAPLIFGCVLMWILAWLTATPVRVVRA

SEQ ID NO: 320068 - protein, 17 aa, Mycobacterium
MAPTLLVAIPFTVLVSF

SEQ ID NO: 320069 - protein, 25 aa, Mycobacterium
MAPVEVPPDAGFAIARGAAQSAEGF

SEQ ID NO: 320070 - protein, 22 aa, Mycobacterium
MARAELEGALLALRTLARGRWR

SEQ ID NO: 320071 - protein, 20 aa, Mycobacterium
MARCPACREAVADLSGVPAL

SEQ ID NO: 320072 - protein, 23 aa, Mycobacterium
MARFPVAVAAAVALYLASAAQLP

SEQ ID NO: 320073 - protein, 20 aa, Mycobacterium
MARPAFKRWWARFVPPSIER

SEQ ID NO: 320074 - protein, 20 aa, Mycobacterium
MARPGFKRWWTRFVPKTVER

SEQ ID NO: 320075 - protein, 18 aa, Mycobacterium
MARRWYRRLLRSTVQDPE

SEQ ID NO: 320076 - protein, 19 aa, Mycobacterium
MASLPQHRPAALPVPPAPA

SEQ ID NO: 320077 - protein, 22 aa, Mycobacterium
MASNYNVHWLFWLVPLMPLFFF

SEQ ID NO: 320078 - protein, 44 aa, Mycobacterium
MASTMFFGAYPWAGWLAFAATVPVQFVAGWPFLKAAAQQARAGT

SEQ ID NO: 320079 - protein, 43 aa, Mycobacterium
MASTMFFGAYPWAGWLAFAATVPVQFVAGWPFLKEAVQRAREL

SEQ ID NO: 320080 - protein, 26 aa, Mycobacterium
MATAILFPMYFLKSFAYAGVATVAFA

SEQ ID NO: 320081 - protein, 18 aa, Mycobacterium
MATALKWLGIPEFSLLDW

SEQ ID NO: 320082 - protein, 24 aa, Mycobacterium
MATDRGRGWATLRDAGPVVIGDGF

SEQ ID NO: 320083 - protein, 19 aa, Mycobacterium
MATGSFRRWERAMFVFIAI

SEQ ID NO: 320084 - protein, 18 aa, Mycobacterium
MATGYTWVLTLVATGVVI

SEQ ID NO: 320085 - protein, 21 aa, Mycobacterium
MATLIFGFILMWIMSWLTATP

SEQ ID NO: 320086 - protein, 17 aa, Mycobacterium
MATPFTFRHPRTVQRVG

SEQ ID NO: 320087 - protein, 25 aa, Mycobacterium
MATRPRLRRVTTFWFITHTLAAAAI

SEQ ID NO: 320088 - protein, 31 aa, Mycobacterium; identical to SEQ ID NO: 100933

SEQ ID NO: 320089 - protein, 31 aa, Mycobacterium
MAVAAPNCGVSWNLLAGIGRIESGHAGGGAV

SEQ ID NO: 320090 - protein, 26 aa, Mycobacterium
MAVAFAVPVTVGFGFSRSLQPIRDLA

SEQ ID NO: 320091 - protein, 20 aa, Mycobacterium
MAVAVYAVVSRALYDDLDNQ

SEQ ID NO: 320092 - protein, 24 aa, Mycobacterium
MAVEKAAHPWAFLMRSLVGGVMVA

SEQ ID NO: 320093 - protein, 21 aa, Mycobacterium
MAVFVPQYFRVVRNATVGVKQ

SEQ ID NO: 320094 - protein, 18 aa, Mycobacterium
MAVGFVLGARHGYDRIAN

SEQ ID NO: 320095 - protein, 21 aa, Mycobacterium
MAVGLLAAYLAALGISTALWQ

SEQ ID NO: 320096 - protein, 17 aa, Mycobacterium
MAVLLSELERTGAFDRE

SEQ ID NO: 320097 - protein, 24 aa, Mycobacterium
MAVLTAFLFFIFGQYRTGATTGYS

SEQ ID NO: 320098 - protein, 25 aa, Mycobacterium
MAVMALFPMYFLKSSAYTIVVTAII

SEQ ID NO: 320099 - protein, 18 aa, Mycobacterium
MAVMVVVCLVLYFQFRNR

SEQ ID NO: 320100 - protein, 17 aa, Mycobacterium
MAVPGVRAVQSASRPDG

SEQ ID NO: 320101 - protein, 19 aa, Mycobacterium
MAVPLCVLSAALALNLWVG

SEQ ID NO: 320102 - protein, 24 aa, Mycobacterium
MAVQCKRLAKAVGVAAVQQVVSGS

SEQ ID NO: 320103 - protein, 25 aa, Mycobacterium
MAVVGWASGLGFGWIYTLGTANVVR

SEQ ID NO: 320104 - protein, 25 aa, Mycobacterium
MAVVGWASGLGFGWMFTLGTANVVR

SEQ ID NO: 320105 - protein, 37 aa, Mycobacterium
MAWYLSEAVGIAFLVPLMLRWDHYLRRGHSRREVLWF

SEQ ID NO: 320106 - protein, 20 aa, Mycobacterium
MCAAVASAGFGTWSLAHNRN

SEQ ID NO: 320107 - protein, 20 aa, Mycobacterium
MCAAVASAGFGTWSLARTQN

SEQ ID NO: 320108 - protein, 23 aa, Mycobacterium
MCAGAYGPYVAWLVQASSDSAAV

SEQ ID NO: 320109 - protein, 26 aa, Mycobacterium
MCALWPAARQRLVWMTLALAVITLIV

SEQ ID NO: 320110 - protein, 17 aa, Mycobacterium
MCGGALLGAAMSRVTVA

SEQ ID NO: 320111 - protein, 19 aa, Mycobacterium
MCGLLAGAFVLRRPQYRPL

SEQ ID NO: 320112 - protein, 25 aa, Mycobacterium
MCGPRPYLRGLRRSVLPTQLVSEIG

SEQ ID NO: 320113 - protein, 19 aa, Mycobacterium
MCGVLGAVLLVYGAWQLWR

SEQ ID NO: 320114 - protein, 17 aa, Mycobacterium
MCHTHGWRIAVVGCGER

SEQ ID NO: 320115 - protein, 33 aa, Mycobacterium
MCLATAGLLAWFWPRLGKLTLPVTFYIVVLTAM

SEQ ID NO: 320116 - protein, 22 aa, Mycobacterium
MCLIGAAVAALLWKFAGNDKAR

SEQ ID NO: 320117 - protein, 20 aa, Mycobacterium
MCLVSIALLVWFWPHLGPDK

SEQ ID NO: 320118 - protein, 20 aa, Mycobacterium
MCSAGGWIHGQRQSLLQNAT

SEQ ID NO: 320119 - protein, 20 aa, Mycobacterium
MCVAACLLLEYGVATAAVAV

SEQ ID NO: 320120 - protein, 35 aa, Mycobacterium
MCVLTGKALARPFQWREFILQGWFLLGVSFLPTVM

SEQ ID NO: 320121 - protein, 20 aa, Mycobacterium
MCVTAMATVRLRSRDRVLVA

SEQ ID NO: 320122 - protein, 22 aa, Mycobacterium
MCYVLCAVINRRARRHDKTDDS

SEQ ID NO: 320123 - protein, 18 aa, Mycobacterium
MDAFDYFIVVLVYADIAK

SEQ ID NO: 320124 - protein, 18 aa, Mycobacterium
MDALRGMRASDETLFVVL

SEQ ID NO: 320125 - protein, 17 aa, Mycobacterium
MDDVRALFDAIINDDPL

SEQ ID NO: 320126 - protein, 19 aa, Mycobacterium
MDFSRFDGLAGNRFIERAV

SEQ ID NO: 320127 - protein, 17 aa, Mycobacterium
MDFVEGVVPPDVMPYTF

SEQ ID NO: 320128 - protein, 17 aa, Mycobacterium
MDGGFRTLLERAPQTLH

SEQ ID NO: 320129 - protein, 21 aa, Mycobacterium
MDHDHPFYKWIALSNTTLGTL

SEQ ID NO: 320130 - protein, 25 aa, Mycobacterium
MDIRSVSWLPLYHDMGLIMILFPPL

SEQ ID NO: 320131 - protein, 19 aa, Mycobacterium
MDITLRFDALAAIMSVLVL

SEQ ID NO: 320132 - protein, 19 aa, Mycobacterium
MDIVEFVLFHLLPLLPESV

SEQ ID NO: 320133 - protein, 25 aa, Mycobacterium
MDLKAFWYHFAIMFEALFILTTLDA

SEQ ID NO: 320134 - protein, 25 aa, Mycobacterium
MDLPRPRDLAPLLAAWIASIGVMIF

SEQ ID NO: 320135 - protein, 20 aa, Mycobacterium
MDLRTLLRCRASDRVSISLP

SEQ ID NO: 320136 - protein, 18 aa, Mycobacterium
MDPLNLIGYFGTWALVGI

SEQ ID NO: 320137 - protein, 25 aa, Mycobacterium
MDPQQRLLLEVSWEALERTGIDPTT

SEQ ID NO: 320138 - protein, 20 aa, Mycobacterium
MDQVRRWPFLFAALGILVAA

SEQ ID NO: 320139 - protein, 27 aa, Mycobacterium
MDRIAAYERYWLYPGAENLAVFRAHLE

SEQ ID NO: 320140 - protein, 25 aa, Mycobacterium
MDRIAAYERYWLYPGAKNLATFRAH

SEQ ID NO: 320141 - protein, 17 aa, Mycobacterium
MDRRLLLIIASVGLAVS

SEQ ID NO: 320142 - protein, 21 aa, Mycobacterium
MDRYYCCESSRRQCIATQLVR

SEQ ID NO: 320143 - protein, 21 aa, Mycobacterium
MDRYYCCQSPRRQWIATQLVR

SEQ ID NO: 320144 - protein, 18 aa, Mycobacterium
MDSNYRWFHPAPSTLAAA

SEQ ID NO: 320145 - protein, 18 aa, Mycobacterium
MDSNYRWFHPAPTTLAAA

SEQ ID NO: 320146 - protein, 24 aa, Mycobacterium
MDSVKRVGGTMVIQQAEQVDVTAL

SEQ ID NO: 320147 - protein, 17 aa, Mycobacterium
MDTGNMRVNLALTPTYT

SEQ ID NO: 320148 - protein, 23 aa, Mycobacterium
MDVIAVTAIYEWVPAPVGLALAG

SEQ ID NO: 320149 - protein, 17 aa, Mycobacterium
MDVNFSLAERWTKSGEP

SEQ ID NO: 320150 - protein, 26 aa, Mycobacterium
MEAIKTGILPLMWFVLLCTAGINIFG

SEQ ID NO: 320151 - protein, 26 aa, Mycobacterium
MEAIKTGMLPLMWLSLGISAGVSLFG

SEQ ID NO: 320152 - protein, 25 aa, Mycobacterium
MEAVVALAFFIPLLIGTGGNTGTQI

SEQ ID NO: 320153 - protein, 21 aa, Mycobacterium
MEEVLAIKPDICFLWDEAWYA

SEQ ID NO: 320154 - protein, 25 aa, Mycobacterium
MEFNVKLPWRKEVKLNTEQVTNAVV

SEQ ID NO: 320155 - protein, 17 aa, Mycobacterium
MEGLAIPLSFLVLVWVF

SEQ ID NO: 320156 - protein, 19 aa, Mycobacterium
MEIGVPIFFVLSGFLLFLP

SEQ ID NO: 320157 - protein, 20 aa, Mycobacterium
MEITGTVSLAEQFPGSVPPE

SEQ ID NO: 320158 - protein, 18 aa, Mycobacterium
MEKRLPSFAAELVAFSGA

SEQ ID NO: 320159 - protein, 25 aa, Mycobacterium
MELDSAMGLHGWQWMFLIEGLVTML

SEQ ID NO: 320160 - protein, 17 aa, Mycobacterium
MELIAIPLSFVVLVWAF

SEQ ID NO: 320161 - protein, 20 aa, Mycobacterium
MELIEGGTLRELLSERGPMP

SEQ ID NO: 320162 - protein, 18 aa, Mycobacterium
MELISVAVIILMLLAIYR

SEQ ID NO: 320163 - protein, 19 aa, Mycobacterium
MELSVRLFGFSPWSMLVPQ

SEQ ID NO: 320164 - protein, 24 aa, Mycobacterium
MEMIRRYEAFAGPVILVTMIALAV

SEQ ID NO: 320165 - protein, 17 aa, Mycobacterium
MEPRMAAKVLAGIDQHY

SEQ ID NO: 320166 - protein, 27 aa, Mycobacterium
MEPVDALVCALRLAGLRGSVGGGDPGW

SEQ ID NO: 320167 - protein, 24 aa, Mycobacterium
MEQRGACTVSGLLAGTDVSVPAPS

SEQ ID NO: 320168 - protein, 30 aa, Mycobacterium
MERGEPWPPPLKEPAFKEAIARATRAAEAA

SEQ ID NO: 320169 - protein, 27 aa, Mycobacterium
MERMRTWRNSVLIAMIVAFFAMAVVLA

SEQ ID NO: 320170 - protein, 23 aa, Mycobacterium
MESEFPSELSVLFKNLENKGNPW

SEQ ID NO: 320171 - protein, 24 aa, Mycobacterium
MESEFPSELSVLFKNLETKGNPWG

SEQ ID NO: 320172 - protein, 23 aa, Mycobacterium
MESRLARLMWRLCKINGEPSRYR

SEQ ID NO: 320173 - protein, 17 aa, Mycobacterium
MESRPDAVFVVGSGIDI

SEQ ID NO: 320174 - protein, 20 aa, Mycobacterium
MEVGMILTVFTMRIAAGIGF

SEQ ID NO: 320175 - protein, 23 aa, Mycobacterium
MEVMGVSVIRRLVVPRFAAAIMV

SEQ ID NO: 320176 - protein, 23 aa, Mycobacterium
MEVMGVSVIRRLVVPRLAAAVMI

SEQ ID NO: 320177 - protein, 23 aa, Mycobacterium
MEVMGVSVIRRLVVPRVAAAVLV

SEQ ID NO: 320178 - protein, 25 aa, Mycobacterium
MEVTGAVNLAEKFPGPLPAEDDQDE

SEQ ID NO: 320179 - protein, 17 aa, Mycobacterium
MEYVDGITLRDIVKDDG

SEQ ID NO: 320180 - protein, 20 aa, Mycobacterium
MFAAFPGWYATVFSTLYLPL

SEQ ID NO: 320181 - protein, 25 aa, Mycobacterium
MFAAGRGGLLLGLLIPHGLLELTAV

SEQ ID NO: 320182 - protein, 19 aa, Mycobacterium
MFADVGFALVMFVAGTHVP

SEQ ID NO: 320183 - protein, 19 aa, Mycobacterium
MFAPEQHRATLICFGATLA

SEQ ID NO: 320184 - protein, 20 aa, Mycobacterium
MFDRIKVPTLIIRGGENDMD

SEQ ID NO: 320185 - protein, 19 aa, Mycobacterium
MFFARRAVAAMTRRRVRME

SEQ ID NO: 320186 - protein, 18 aa, Mycobacterium
MFFLGVGGAAEWSGLADR

SEQ ID NO: 320187 - protein, 20 aa, Mycobacterium
MFGADVWWLAALGAPLLTGV

SEQ ID NO: 320188 - protein, 21 aa, Mycobacterium
MFGAICAVIATLLMGVSVGFA

SEQ ID NO: 320189 - protein, 18 aa, Mycobacterium
MFGDAAGLSRAVLNLLDN

SEQ ID NO: 320190 - protein, 17 aa, Mycobacterium
MFIEFSRQRALSADGRC

SEQ ID NO: 320191 - protein, 20 aa, Mycobacterium
MFIYASAATLVFDKVFFSAA

SEQ ID NO: 320192 - protein, 25 aa, Mycobacterium
MFKLPFPWREFLLQTWFVARVSIIP

SEQ ID NO: 320193 - protein, 19 aa, Mycobacterium
MFLFLAALFVAVAWAWREG

SEQ ID NO: 320194 - protein, 22 aa, Mycobacterium
MFLLTLFLDFVFNDREIKWLKW

SEQ ID NO: 320195 - protein, 27 aa, Mycobacterium
MFMEELFWGCAGIGLAVVMPALALSAI

SEQ ID NO: 320196 - protein, 18 aa, Mycobacterium
MFRVAAFIVVGLVLLGMG

SEQ ID NO: 320197 - protein, 20 aa, Mycobacterium
MFSDIVHRAFPWREFIHQGA

SEQ ID NO: 320198 - protein, 26 aa, Mycobacterium
MFVAGLRQGWAFAWRSLMAGELVVLI

SEQ ID NO: 320199 - protein, 18 aa, Mycobacterium
MFVFVGWVILTAVLWITR

SEQ ID NO: 320200 - protein, 25 aa, Mycobacterium
MFVMFGVPQLQLWISPAMLALMAVM

SEQ ID NO: 320201 - protein, 28 aa, Mycobacterium
MFVVSLLCAFGFDWAPLLWLPACAVFFP

SEQ ID NO: 320202 - protein, 18 aa, Mycobacterium
MFWSVAPLVLACVVLAGV

SEQ ID NO: 320203 - protein, 27 aa, Mycobacterium
MFYGFAASVLPVWLLLAPRDYLSTFMK

SEQ ID NO: 320204 - protein, 17 aa, Mycobacterium
MGADIAWLLPAALVCLV

SEQ ID NO: 320205 - protein, 20 aa, Mycobacterium
MGAGDLYILRRHILPNIAGP

SEQ ID NO: 320206 - protein, 33 aa, Mycobacterium
MGALGVAGIVEWPILLAVGGSALLLRRMSQRPE

SEQ ID NO: 320207 - protein, 21 aa, Mycobacterium
MGALQAVFWWFSPWAAREYAA

SEQ ID NO: 320208 - protein, 19 aa, Mycobacterium
MGAMLGGIIIGDLLSGGMR

SEQ ID NO: 320209 - protein, 25 aa, Mycobacterium
MGAVGWASGLGFGWIYTLGTANVVR

SEQ ID NO: 320210 - protein, 19 aa, Mycobacterium
MGAVSVVLAPLVLLVVGVR

SEQ ID NO: 320211 - protein, 25 aa, Mycobacterium
MGCGAVTVLAVWRIRETQGVDLAGI

SEQ ID NO: 320212 - protein, 17 aa, Mycobacterium
MGEVYLAQHPRLPRQDA

SEQ ID NO: 320213 - protein, 18 aa, Mycobacterium
MGEVYLARHPRLPRQDAL

SEQ ID NO: 320214 - protein, 22 aa, Mycobacterium
MGFPLSIGMVVVVAAALTLGPA

SEQ ID NO: 320215 - protein, 18 aa, Mycobacterium
MGFVLWRYQLRQGSANSV

SEQ ID NO: 320216 - protein, 18 aa, Mycobacterium
MGGACGTCRAKLIEGNVE

SEQ ID NO: 320217 - protein, 26 aa, Mycobacterium
MGGAGFMVLFAFPFFWLAGANSGWTL

SEQ ID NO: 320218 - protein, 17 aa, Mycobacterium
MGGALGIAVAGSILAGR

SEQ ID NO: 320219 - protein, 17 aa, Mycobacterium
MGGLLLAAPASSDVSPG

SEQ ID NO: 320220 - protein, 29 aa, Mycobacterium
MGGPPARRISTNGPRHWIEVRGLGCKHSA

SEQ ID NO: 320221 - protein, 18 aa, Mycobacterium
MGGTCAVDLAVMHPDMFS

SEQ ID NO: 320222 - protein, 18 aa, Mycobacterium
MGGTCAVDLTVMHPDLFS

SEQ ID NO: 320223 - protein, 19 aa, Mycobacterium
MGGTCAVDLTVMHPDLFST

SEQ ID NO: 320224 - protein, 19 aa, Mycobacterium
MGGTCAVTLAAKHPELFSA

SEQ ID NO: 320225 - protein, 23 aa, Mycobacterium
MGGWASIHIFGFPALDNTTPLFA

SEQ ID NO: 320226 - protein, 25 aa, Mycobacterium
MGHFGRRSISLGWLLLVLPACTLSY

SEQ ID NO: 320227 - protein, 24 aa, Mycobacterium
MGHPGKRAPTVEICNSDKPYMPLA

SEQ ID NO: 320228 - protein, 24 aa, Mycobacterium
MGHRQRFWLSGMALLATLLVACAY

SEQ ID NO: 320229 - protein, 31 aa, Mycobacterium
MGHVRPLYQPGLRFLIPLADKMIRVDQRLVT

SEQ ID NO: 320230 - protein, 17 aa, Mycobacterium
MGHVYLAAHPRLPREDA

SEQ ID NO: 320231 - protein, 32 aa, Mycobacterium
MGIAACLIMGWGHRLLRGLALVAVSAMVAVGV

SEQ ID NO: 320232 - protein, 27 aa, Mycobacterium
MGIAAFVLALAYRSYRLTTIEEVSNDP

SEQ ID NO: 320233 - protein, 20 aa, Mycobacterium
MGIAVCGAAYSLSAAAHGPA

SEQ ID NO: 320234 - protein, 23 aa, Mycobacterium
MGIPCAAGMLVAVVAALTMGPAV

SEQ ID NO: 320235 - protein, 21 aa, Mycobacterium
MGIPVVGTWMHWALFGGDFPG

SEQ ID NO: 320236 - protein, 23 aa, Mycobacterium
MGITRVSLNFVMFRSVYADGSRI

SEQ ID NO: 320237 - protein, 28 aa, Mycobacterium
MGIVVGRWLDRYGPRWIMTIGSVLGVVA

SEQ ID NO: 320238 - protein, 34 aa, Mycobacterium
MGLACGIPAWFVSGVVWGAWIGKRVHVEVPEEFV

SEQ ID NO: 320239 - protein, 20 aa, Mycobacterium
MGLATLRVFPFFIVATLVTL

SEQ ID NO: 320240 - protein, 25 aa, Mycobacterium
MGLDSLLQWMFYVGLLITAADVLIA

SEQ ID NO: 320241 - protein, 20 aa, Mycobacterium
MGLFVFCAFVTPGSDPFSML

SEQ ID NO: 320242 - protein, 20 aa, Mycobacterium
MGLHPLMFFLPIWEGADSWP

SEQ ID NO: 320243 - protein, 17 aa, Mycobacterium
MGLLCHRIAAVYSAIAT

SEQ ID NO: 320244 - protein, 19 aa, Mycobacterium
MGLLPDIATGFGITEPTAG

SEQ ID NO: 320245 - protein, 24 aa, Mycobacterium
MGLLSRLWVVPVHRASGLIARILA

SEQ ID NO: 320246 - protein, 19 aa, Mycobacterium
MGLSMLVPILLVLGAPVSL

SEQ ID NO: 320247 - protein, 17 aa, Mycobacterium
MGLVLGIAIPILGGFAG

SEQ ID NO: 320248 - protein, 19 aa, Mycobacterium
MGMAVGLVVLFAFRNVSTG

SEQ ID NO: 320249 - protein, 21 aa, Mycobacterium
MGMPCAVGMLAAVLIALTLVP

SEQ ID NO: 320250 - protein, 32 aa, Mycobacterium
MGMTEPRVLLRVELPNAMPLLLGGLRSATLQV

SEQ ID NO: 320251 - protein, 22 aa, Mycobacterium
MGMTESRILLRVETPNALPLIL

SEQ ID NO: 320252 - protein, 33 aa, Mycobacterium
MGMTESRILLRVEVPNALPLILGGLRTSTLQIV

SEQ ID NO: 320253 - protein, 22 aa, Mycobacterium
MGPACAIAMLVTVAAALTLGPA

SEQ ID NO: 320254 - protein, 17 aa, Mycobacterium
MGPAVAISMLFTIAAAL

SEQ ID NO: 320255 - protein, 21 aa, Mycobacterium
MGPGGYRFMDYLKLGLPVTIV

SEQ ID NO: 320256 - protein, 19 aa, Mycobacterium
MGPGHMRPGGGMFGPGGAP

SEQ ID NO: 320257 - protein, 23 aa, Mycobacterium
MGPGSWGPGGMMGPGSWGPGMMG

SEQ ID NO: 320258 - protein, 19 aa, Mycobacterium
MGPKMLAMAVISPIMVATI

SEQ ID NO: 320259 - protein, 22 aa, Mycobacterium
MGPNARQVLVAGPFGGEGTTTT

SEQ ID NO: 320260 - protein, 17 aa, Mycobacterium
MGPWPVYVLTASALVLV

SEQ ID NO: 320261 - protein, 21 aa, Mycobacterium
MGRAGVTVVHRGATAPHREQY

SEQ ID NO: 320262 - protein, 23 aa, Mycobacterium
MGRDGLLPARFAAVHPRFQTPVS

SEQ ID NO: 320263 - protein, 23 aa, Mycobacterium
MGRDGLLPARFAAVNPRTQTPVS

SEQ ID NO: 320264 - protein, 17 aa, Mycobacterium
MGRDGLLPARFAKVNPR

SEQ ID NO: 320265 - protein, 21 aa, Mycobacterium
MGRDGLLPPVFAKVRPPNMTP

SEQ ID NO: 320266 - protein, 21 aa, Mycobacterium
MGRITGWPLPALLIPPMALSR

SEQ ID NO: 320267 - protein, 23 aa, Mycobacterium
MGSPGGMRAKITFLQQGTDTLAD

SEQ ID NO: 320268 - protein, 23 aa, Mycobacterium
MGSSRRFTLRMVLAEAAGIGVVG

SEQ ID NO: 320269 - protein, 25 aa, Mycobacterium
MGSVVVSAWGYGAAFIIAGSVGVAC

SEQ ID NO: 320270 - protein, 24 aa, Mycobacterium
MGTASWPDIFARVSADPQAAHQSF

SEQ ID NO: 320271 - protein, 21 aa, Mycobacterium
MGTSNWAHIFIKVGADPDEAK

SEQ ID NO: 320272 - protein, 23 aa, Mycobacterium
MGVAETFLLFALADNTFQLNHDL

SEQ ID NO: 320273 - protein, 23 aa, Mycobacterium
MGVAETFLLLALAKQVFGLDQDL

SEQ ID NO: 320274 - protein, 25 aa, Mycobacterium
MGVDPVRRLAAPRVLAATVVAVSLV

SEQ ID NO: 320275 - protein, 24 aa, Mycobacterium
MGVLCYRHRIRVALAACVAAGLIS

SEQ ID NO: 320276 - protein, 19 aa, Mycobacterium
MGVNLARITDVYDWSAPMV

SEQ ID NO: 320277 - protein, 20 aa, Mycobacterium
MGVPGLRVGPVAPVRPWRAP

SEQ ID NO: 320278 - protein, 20 aa, Mycobacterium
MGVSVVRRLVVPRFAAAIVI

SEQ ID NO: 320279 - protein, 20 aa, Mycobacterium
MGVVTVLWVLYGYSMAFGDD

SEQ ID NO: 320280 - protein, 20 aa, Mycobacterium
MGVYLRYLRPGKVSEVTVIG

SEQ ID NO: 320281 - protein, 17 aa, Mycobacterium
MGYEALLGRRAFPQDNP

SEQ ID NO: 320282 - protein, 22 aa, Mycobacterium
MGYLAISLWAVRDVAVRAADLA

SEQ ID NO: 320283 - protein, 22 aa, Mycobacterium
MGYLPCSIWIVIGAVFAGAVQD

SEQ ID NO: 320284 - protein, 24 aa, Mycobacterium
MHEVPVLWRFHRVHHSVREMDWLA

SEQ ID NO: 320285 - protein, 24 aa, Mycobacterium
MHFLPRWLPNPLRRSGEEAKAELF

SEQ ID NO: 320286 - protein, 22 aa, Mycobacterium
MHHGELPVPGWVISAITVAVVL

SEQ ID NO: 320287 - protein, 23 aa, Mycobacterium
MHIALKVPRMITGLRSLSMREVL

SEQ ID NO: 320288 - protein, 18 aa, Mycobacterium
MHIFTAPINVIFKRLPDG

SEQ ID NO: 320289 - protein, 18 aa, Mycobacterium
MHIGPARFRRAVAPILSL

SEQ ID NO: 320290 - protein, 18 aa, Mycobacterium
MHMAGELPPIVTQFADGL

SEQ ID NO: 320291 - protein, 26 aa, Mycobacterium
MHQVFLGARSLLYFKGHADTGISQAL

SEQ ID NO: 320292 - protein, 24 aa, Mycobacterium
MHRCTRLYRPVFYYLGFWAVALLI

SEQ ID NO: 320293 - protein, 23 aa, Mycobacterium
MHRGVAYFPNLVVPIVVGGVGIG

SEQ ID NO: 320294 - protein, 23 aa, Mycobacterium
MHRGVPYFPNLVLPIIVGGIGIG

SEQ ID NO: 320295 - protein, 17 aa, Mycobacterium
MHRLLFRRHRLVVLVSA

SEQ ID NO: 320296 - protein, 20 aa, Mycobacterium
MHTANPWLYEGHVLGAIFLG

SEQ ID NO: 320297 - protein, 18 aa, Mycobacterium
MHVTVVVVDLNLFKQIND

SEQ ID NO: 320298 - protein, 26 aa, Mycobacterium
MHWAAFRALLVLTVIVGLGYPLLVWL

SEQ ID NO: 320299 - protein, 19 aa, Mycobacterium
MHYQSWRLSYRGIVATELL

SEQ ID NO: 320300 - protein, 25 aa, Mycobacterium
MIAAGRGDVFFGLILPHGLLELTAV

SEQ ID NO: 320301 - protein, 22 aa, Mycobacterium
MIAIAAWSGWLLEINHRKPQLL

SEQ ID NO: 320302 - protein, 18 aa, Mycobacterium
MIANPFRAGEKIGKLFAT

SEQ ID NO: 320303 - protein, 18 aa, Mycobacterium
MIANPFRAGERIGSLFST

SEQ ID NO: 320304 - protein, 20 aa, Mycobacterium
MIASTLWWTLLMRPETQMWQ

SEQ ID NO: 320305 - protein, 18 aa, Mycobacterium
MICAVLVPQMVAYKAGQP

SEQ ID NO: 320306 - protein, 24 aa, Mycobacterium
MICHLAVFHPPDLVQIRVLTDNPE

SEQ ID NO: 320307 - protein, 27 aa, Mycobacterium
MIFAVCIAAILLARVFVRPIRRLEAGA

SEQ ID NO: 320308 - protein, 22 aa, Mycobacterium
MIFNVIWTYALVRGAAAVVGNL

SEQ ID NO: 320309 - protein, 22 aa, Mycobacterium
MIFNVIWTYVLVRGSAVNNETL

SEQ ID NO: 320310 - protein, 22 aa, Mycobacterium
MIFNVIWTYVLVRGSAVNNGTL

SEQ ID NO: 320311 - protein, 27 aa, Mycobacterium
MIFSTSRLKPWDARHIRRGALAAVIAV

SEQ ID NO: 320312 - protein, 19 aa, Mycobacterium
MIGDRLVDRFGETAVVRAG

SEQ ID NO: 320313 - protein, 18 aa, Mycobacterium
MIGGEFDLSAGVAVTTSS

SEQ ID NO: 320314 - protein, 20 aa, Mycobacterium
MIGKCLRPLPNKWKGLTDPE

SEQ ID NO: 320315 - protein, 19 aa, Mycobacterium
MIIGMPFILVGEVAAFAGS

SEQ ID NO: 320316 - protein, 17 aa, Mycobacterium
MIIGVGVYLSAQDKDAP

SEQ ID NO: 320317 - protein, 17 aa, Mycobacterium
MIIGVGVYLSAQDKDTP

SEQ ID NO: 320318 - protein, 18 aa, Mycobacterium
MIILLVFWHTFLMVYLYE

SEQ ID NO: 320319 - protein, 18 aa, Mycobacterium
MILFIYRSIVTMLISMVI

SEQ ID NO: 320320 - protein, 17 aa, Mycobacterium
MILFNWFCVGLIPVLIL

SEQ ID NO: 320321 - protein, 18 aa, Mycobacterium
MILIFAIMVLITRSVVAA

SEQ ID NO: 320322 - protein, 22 aa, Mycobacterium
MILSCTIVGPLVLAFFAQFAIA

SEQ ID NO: 320323 - protein, 19 aa, Mycobacterium
MILSVDWFGLIVLAAWGTL

SEQ ID NO: 320324 - protein, 24 aa, Mycobacterium
MILTPRFIALTGHARDLEIATQTL

SEQ ID NO: 320325 - protein, 18 aa, Mycobacterium
MILVPAFMHVLGHWNWWA

SEQ ID NO: 320326 - protein, 23 aa, Mycobacterium
MINRPRPGLQLLAFLTGGFAMGT

SEQ ID NO: 320327 - protein, 21 aa, Mycobacterium
MIPGWDTPQGKALGDAVAAFI

SEQ ID NO: 320328 - protein, 43 aa, Mycobacterium
MIPVLQFTYWQWASLVLAAPVIVWAAWPFHRAAWANLRHATAT

SEQ ID NO: 320329 - protein, 23 aa, Mycobacterium
MIQAGFIIGCGLLLDTFVVRTLT

SEQ ID NO: 320330 - protein, 19 aa, Mycobacterium
MIQDITRPLGIPIQHSSIP

SEQ ID NO: 320331 - protein, 20 aa, Mycobacterium
MIQDITRPLGIPIQHSSIPF

SEQ ID NO: 320332 - protein, 24 aa, Mycobacterium
MIRADVPGGTWARGLRARERLERY

SEQ ID NO: 320333 - protein, 19 aa, Mycobacterium
MIRQHRFTISAARDQLEAG

SEQ ID NO: 320334 - protein, 20 aa, Mycobacterium
MISAGAFALAQLALRGRLPR

SEQ ID NO: 320335 - protein, 20 aa, Mycobacterium
MISAMAQLYVHGHELDIRTL

SEQ ID NO: 320336 - protein, 18 aa, Mycobacterium
MISPLSWTPIALAVFGIG

SEQ ID NO: 320337 - protein, 23 aa, Mycobacterium
MIVLTVFLFFIFGQYRTGSTNGY

SEQ ID NO: 320338 - protein, 17 aa, Mycobacterium
MIVPGLFGSAFGTYLMR

SEQ ID NO: 320339 - protein, 35 aa, Mycobacterium
MIWVRLRAPWAKGLVEFLCLLPLTIPALVIVVGLR

SEQ ID NO: 320340 - protein, 34 aa, Mycobacterium
MIWVRLRARWARRIVEFLCLLPLTIPALVIVVGL

SEQ ID NO: 320341 - protein, 18 aa, Mycobacterium
MKAAIMVALLFRTLDAWR

SEQ ID NO: 320342 - protein, 17 aa, Mycobacterium
MKAMMLLGHNFREFDSN

SEQ ID NO: 320343 - protein, 19 aa, Mycobacterium
MKAMMRLGHNFHEFDSNST

SEQ ID NO: 320344 - protein, 22 aa, Mycobacterium
MKAMMRLGHNFREFDSNSTVMI

SEQ ID NO: 320345 - protein, 17 aa, Mycobacterium
MKARAIAGWMAIGCIGA

SEQ ID NO: 320346 - protein, 17 aa, Mycobacterium
MKAVGIWAGVAGSGGVL

SEQ ID NO: 320347 - protein, 21 aa, Mycobacterium
MKFGAWMLFAGLWAVLVYFPV

SEQ ID NO: 320348 - protein, 21 aa, Mycobacterium
MKITPGPLWATWSAATALTLF

SEQ ID NO: 320349 - protein, 17 aa, Mycobacterium
MKITYGWSLMLVVVFCV

SEQ ID NO: 320350 - protein, 24 aa, Mycobacterium
MKLTISTYWLLVFGQLAKAVTAAV

SEQ ID NO: 320351 - protein, 20 aa, Mycobacterium
MKQNLWWGAGYNLVSVPLAA

SEQ ID NO: 320352 - protein, 22 aa, Mycobacterium
MKRFWIPLLLVVVVAVGAYAIV

SEQ ID NO: 320353 - protein, 23 aa, Mycobacterium
MKYALKGTRLQGSVIEIAGPAAL

SEQ ID NO: 320354 - protein, 21 aa, Mycobacterium
MKYQPEWVPRYACYEDARLVP

SEQ ID NO: 320355 - protein, 27 aa, Mycobacterium
MLAAEAWTGRLTWRRHEPGLGSRPVPD

SEQ ID NO: 320356 - protein, 26 aa, Mycobacterium
MLAAFSAQIATLVPFLFGLVTATVIA

SEQ ID NO: 320357 - protein, 17 aa, Mycobacterium
MLAAMAWVCADAILLLR

SEQ ID NO: 320358 - protein, 18 aa, Mycobacterium
MLACFGYGTASVLQGYGA

SEQ ID NO: 320359 - protein, 23 aa, Mycobacterium
MLAFGCLQAGIAVMAAPALNRAL

SEQ ID NO: 320360 - protein, 33 aa, Mycobacterium
MLAGLPLIPFTPRWLVRRAEGIAMSSGQLPVGC

SEQ ID NO: 320361 - protein, 20 aa, Mycobacterium
MLAGRLVVDVQWYSGHQTLP

SEQ ID NO: 320362 - protein, 19 aa, Mycobacterium
MLAGVAGFAGRRSIQHSVR

SEQ ID NO: 320363 - protein, 25 aa, Mycobacterium
MLALGWRPGAPFPHGSALLAASGAA

SEQ ID NO: 320364 - protein, 30 aa, Mycobacterium
MLALRRDRFRICMWVGWLTLLMTYTPLAFE

SEQ ID NO: 320365 - protein, 17 aa, Mycobacterium
MLAPAILDRPAYAGSAA

SEQ ID NO: 320366 - protein, 17 aa, Mycobacterium
MLAQMMWTMRATGSLRD

SEQ ID NO: 320367 - protein, 20 aa, Mycobacterium
MLDIRLFKNRAFGLGNLANL

SEQ ID NO: 320368 - protein, 24 aa, Mycobacterium
MLDLSRIDAGLALERDDVDVAAVL

SEQ ID NO: 320369 - protein, 21 aa, Mycobacterium
MLDLSSRFDRIVVDGPPVLAT

SEQ ID NO: 320370 - protein, 19 aa, Mycobacterium
MLDRLCGLQTLQLTTNDDS

SEQ ID NO: 320371 - protein, 25 aa, Mycobacterium
MLENSGLRAGWRKVSGISSGRSGAQ

SEQ ID NO: 320372 - protein, 30 aa, Mycobacterium
MLESFLFYSGFYLPMYWSSRGKLTNTADII

SEQ ID NO: 320373 - protein, 17 aa, Mycobacterium
MLFAQATYYGEFKDTGG

SEQ ID NO: 320374 - protein, 18 aa, Mycobacterium
MLFFVYRSVVTMFLVLLT

SEQ ID NO: 320375 - protein, 18 aa, Mycobacterium
MLFIAYRSVSTVLLVLVM

SEQ ID NO: 320376 - protein, 19 aa, Mycobacterium
MLGEIGGFAVVFVGFIVGQ

SEQ ID NO: 320377 - protein, 36 aa, Mycobacterium
MLGGGKGRPSWRVLLIGLGVIVAWLLVATLLARLVV

SEQ ID NO: 320378 - protein, 18 aa, Mycobacterium
MLGGLLLIVTLIVYQFRA

SEQ ID NO: 320379 - protein, 19 aa, Mycobacterium
MLGPKMARHLGVVRRALSR

SEQ ID NO: 320380 - protein, 17 aa, Mycobacterium
MLGQIRVIFAMCRDGLL

SEQ ID NO: 320381 - protein, 17 aa, Mycobacterium
MLGRPPLKSATREEQLR

SEQ ID NO: 320382 - protein, 19 aa, Mycobacterium
MLHYANRGWFFPLAIRQVP

SEQ ID NO: 320383 - protein, 21 aa, Mycobacterium
MLIAAGGWRRRALIFVAGGLL

SEQ ID NO: 320384 - protein, 25 aa, Mycobacterium
MLIGGIVFACCAIVGNLTSASVSDR

SEQ ID NO: 320385 - protein, 23 aa, Mycobacterium
MLIGIAALGAWGFYRFNQHLATL

SEQ ID NO: 320386 - protein, 18 aa, Mycobacterium
MLIPLVPAAVIALALIVA

SEQ ID NO: 320387 - protein, 45 aa, Mycobacterium
MLIYLDRRFTIGHGRLFGLYVALYCVGRFGVELMRDDTATHIAGI

SEQ ID NO: 320388 - protein, 17 aa, Mycobacterium
MLLADFGADVVTVERPG

SEQ ID NO: 320389 - protein, 24 aa, Mycobacterium
MLLAGLPALLVWFIRRYVPEPPEI

SEQ ID NO: 320390 - protein, 22 aa, Mycobacterium
MLLANLFAGLVIYVGKAQFSEH

SEQ ID NO: 320391 - protein, 23 aa, Mycobacterium
MLLATFLLGWGIVAPMAGSHLIR

SEQ ID NO: 320392 - protein, 19 aa, Mycobacterium
MLLDGRYLVQAKIASGGTS

SEQ ID NO: 320393 - protein, 19 aa, Mycobacterium
MLLFFYRSIFTVLMVLLMV

SEQ ID NO: 320394 - protein, 20 aa, Mycobacterium
MLLFVYRSVMTVILLLIMVG

SEQ ID NO: 320395 - protein, 23 aa, Mycobacterium
MLLGARLLVGLTIGVTVVVVPVY

SEQ ID NO: 320396 - protein, 17 aa, Mycobacterium
MLLGGRLGDTIGRKRTF

SEQ ID NO: 320397 - protein, 27 aa, Mycobacterium
MLLGYAVPDFPGARWIAPLLGTVMYVV

SEQ ID NO: 320398 - protein, 20 aa, Mycobacterium
MLLIAYRSFTRAIIPLVGVL

SEQ ID NO: 320399 - protein, 20 aa, Mycobacterium
MLLIVFRSVATMVLILFMVF

SEQ ID NO: 320400 - protein, 24 aa, Mycobacterium
MLLKSTGRLNDFVRVVADLNNVGD

SEQ ID NO: 320401 - protein, 18 aa, Mycobacterium
MLLKVGARMSYLMGLTVF

SEQ ID NO: 320402 - protein, 26 aa, Mycobacterium
MLLLVYRSAACLLVPLPAVLIEMLVA

SEQ ID NO: 320403 - protein, 18 aa, Mycobacterium
MLLLVYRSPLTVVLLLLT

SEQ ID NO: 320404 - protein, 20 aa, Mycobacterium
MLLLVYRSVITMVIVVAMVM

SEQ ID NO: 320405 - protein, 18 aa, Mycobacterium
MLLMVYRSIITVILSLVM

SEQ ID NO: 320406 - protein, 19 aa, Mycobacterium
MLLMVYRSVITVILLLIMV

SEQ ID NO: 320407 - protein, 29 aa, Mycobacterium
MLLNRRKFLPPFITWYAAMLFAVVPLRNI

SEQ ID NO: 320408 - protein, 18 aa, Mycobacterium
MLLPACVALCGVAAGLFM

SEQ ID NO: 320409 - protein, 32 aa, Mycobacterium
MLLPEEQFLSWGWRIPFILGAVLMLVGLWLRR

SEQ ID NO: 320410 - protein, 34 aa, Mycobacterium
MLLVGLRFLQGFAVGGEWGGAVLLVAEHSPDSQR

SEQ ID NO: 320411 - protein, 22 aa, Mycobacterium
MLLVGVMLRYTKFLVRQDPSLP

SEQ ID NO: 320412 - protein, 24 aa, Mycobacterium
MLLVLRFLQGGACSAFIVVAIAIA

SEQ ID NO: 320413 - protein, 32 aa, Mycobacterium
MLLVQAGYMLIGWQAGLAFTRASLRSVGRLLP

SEQ ID NO: 320414 - protein, 18 aa, Mycobacterium
MLMFVYRSIGTVLLTMVI

SEQ ID NO: 320415 - protein, 44 aa, Mycobacterium
MLMHLMRLAGSLGFLPIGGWALRAIVAALLEWQRKSELSGDRAG

SEQ ID NO: 320416 - protein, 24 aa, Mycobacterium
MLMPFAGISFLWFIGVVRDGFGRY

SEQ ID NO: 320417 - protein, 18 aa, Mycobacterium
MLMSCALLGDRYGRRRGF

SEQ ID NO: 320418 - protein, 18 aa, Mycobacterium
MLMTAPLFVSWWIAGARY

SEQ ID NO: 320419 - protein, 24 aa, Mycobacterium
MLNFPYSRYDTMTLAAFDLVTAAL

SEQ ID NO: 320420 - protein, 18 aa, Mycobacterium
MLNHCYFGYFASGGAVGV

SEQ ID NO: 320421 - protein, 24 aa, Mycobacterium
MLNRPKPLLQLLAFVAGGFAMGLT

SEQ ID NO: 320422 - protein, 23 aa, Mycobacterium
MLPAAAKSAGWSLDKMNSMYEAT

SEQ ID NO: 320423 - protein, 22 aa, Mycobacterium
MLPATLSLAAKRGLGLPGSDRV

SEQ ID NO: 320424 - protein, 18 aa, Mycobacterium
MLPEGFGSTAIRAPIIEE

SEQ ID NO: 320425 - protein, 25 aa, Mycobacterium
MLPESPRWLEIRGRHAEARVVVESI

SEQ ID NO: 320426 - protein, 18 aa, Mycobacterium
MLPFVWNVFKSWRYGEPV

SEQ ID NO: 320427 - protein, 20 aa, Mycobacterium
MLPGLAVFRAVFYFAADSHF

SEQ ID NO: 320428 - protein, 18 aa, Mycobacterium
MLPHAVGVLTELGLGERL

SEQ ID NO: 320429 - protein, 33 aa, Mycobacterium
MLPSESFDSWGWRLPFLAAFPLLGVALWIRLTM

SEQ ID NO: 320430 - protein, 20 aa, Mycobacterium
MLPVPRYVAGRSFWRTPSLF

SEQ ID NO: 320431 - protein, 19 aa, Mycobacterium
MLPVTYRVIAYIKKNEPTY

SEQ ID NO: 320432 - protein, 18 aa, Mycobacterium
MLQKTATVPGGWFTATVL

SEQ ID NO: 320433 - protein, 23 aa, Mycobacterium
MLQTEFNVLLPWSKQVELPEPAK

SEQ ID NO: 320434 - protein, 28 aa, Mycobacterium
MLRATVEMFRFVPVVVTFTLGIAVLFAI

SEQ ID NO: 320435 - protein, 19 aa, Mycobacterium
MLRCLGVRISVSGGPIRDI

SEQ ID NO: 320436 - protein, 17 aa, Mycobacterium
MLRDMFSDVRMLCYDTG

SEQ ID NO: 320437 - protein, 17 aa, Mycobacterium
MLRLKVALAAGVVLACP

SEQ ID NO: 320438 - protein, 17 aa, Mycobacterium
MLRLKVGLTAGVVLACP

SEQ ID NO: 320439 - protein, 19 aa, Mycobacterium
MLRLLRRDPPAAARWRRFF

SEQ ID NO: 320440 - protein, 20 aa, Mycobacterium
MLRQLRRARHHDGGISSFQA

SEQ ID NO: 320441 - protein, 20 aa, Mycobacterium
MLRYCVQLFPDASRYFTPVI

SEQ ID NO: 320442 - protein, 23 aa, Mycobacterium
MLSDEFRVLIAARRLRPPQVREG

SEQ ID NO: 320443 - protein, 26 aa, Mycobacterium
MLSFGGLMLLGGRLGDTFGRKRVFIG

SEQ ID NO: 320444 - protein, 20 aa, Mycobacterium
MLSIVAVYLVRWLSMRMDMF

SEQ ID NO: 320445 - protein, 18 aa, Mycobacterium
MLTARPVLAMGLSAAIGL

SEQ ID NO: 320446 - protein, 36 aa, Mycobacterium
MLTSFAGLGMFNPLSLGAGFVLGRKAYKEDMENRML

SEQ ID NO: 320447 - protein, 19 aa, Mycobacterium
MLVAGVAWNATWIGSLPVL

SEQ ID NO: 320448 - protein, 17 aa, Mycobacterium
MLVALVFSEVVAQFPVA

SEQ ID NO: 320449 - protein, 26 aa, Mycobacterium
MLVGLAVGCVNGFLVSRINVPPFIAT

SEQ ID NO: 320450 - protein, 23 aa, Mycobacterium
MLVIDRVAKYVVHMRGIERVQTI

SEQ ID NO: 320451 - protein, 19 aa, Mycobacterium
MLVLVIAGLVILGPERLPG

SEQ ID NO: 320452 - protein, 24 aa, Mycobacterium
MLVPLPLFFCHGGWPVTVAAVVMV

SEQ ID NO: 320453 - protein, 25 aa, Mycobacterium
MLVPLPLFFCHSGWPITVAAIVMVC

SEQ ID NO: 320454 - protein, 24 aa, Mycobacterium
MLVSGVAFKATWIGGSVPILSIFG

SEQ ID NO: 320455 - protein, 19 aa, Mycobacterium
MLVTMRFDRPVRWTPARYA

SEQ ID NO: 320456 - protein, 24 aa, Mycobacterium
MLVVVFCVLYFRYLDAKQDGRLDQ

SEQ ID NO: 320457 - protein, 25 aa, Mycobacterium
MLVVWEIFSDLTFVIPSPVQTFGVL

SEQ ID NO: 320458 - protein, 24 aa, Mycobacterium
MLYPEMVTKLVVWNIVGGIYGTFV

SEQ ID NO: 320459 - protein, 24 aa, Mycobacterium
MLYPEMVTKLVVWNIVGGVYGTFV

SEQ ID NO: 320460 - protein, 17 aa, Mycobacterium
MMAACVVGAIALISVPE

SEQ ID NO: 320461 - protein, 23 aa, Mycobacterium
MMAGCVLTGLSVWVLAHRNSVRS

SEQ ID NO: 320462 - protein, 25 aa, Mycobacterium
MMAGLLVSLLVRRRRVWVRITPATD

SEQ ID NO: 320463 - protein, 18 aa, Mycobacterium
MMDNCPNTRLVIGGYSLG

SEQ ID NO: 320464 - protein, 25 aa, Mycobacterium
MMESEFPGELGVLFKNLETKGNPWG

SEQ ID NO: 320465 - protein, 24 aa, Mycobacterium
MMESEFPSELSVLFKNLENKGNPW

SEQ ID NO: 320466 - protein, 20 aa, Mycobacterium
MMFNEPRVSDDPIVLSAKAD

SEQ ID NO: 320467 - protein, 21 aa, Mycobacterium
MMGLHPLMFFLPIWHDANSWA

SEQ ID NO: 320468 - protein, 20 aa, Mycobacterium
MMGLPRLYRIPVHTIHKFGH

SEQ ID NO: 320469 - protein, 20 aa, Mycobacterium
MMGVPTFRFKLWAFVIGASI

SEQ ID NO: 320470 - protein, 18 aa, Mycobacterium
MMGVTGVVIMIMLAIVYR

SEQ ID NO: 320471 - protein, 18 aa, Mycobacterium
MMGVTGVVIMIMLFIVYR

SEQ ID NO: 320472 - protein, 23 aa, Mycobacterium
MMLLDRIAKGVFHLPGIARVQGI

SEQ ID NO: 320473 - protein, 19 aa, Mycobacterium
MMLLNVLKPTGAVGESSII

SEQ ID NO: 320474 - protein, 23 aa, Mycobacterium
MMLSLVWPIASLGFLLSMTQESF

SEQ ID NO: 320475 - protein, 24 aa, Mycobacterium
MMLSLVWPIASLGFLLSMTQESFT

SEQ ID NO: 320476 - protein, 17 aa, Mycobacterium
MMLTMLAVMVPRASACA

SEQ ID NO: 320477 - protein, 19 aa, Mycobacterium
MMNIRLFRSTAFGMGNLAG

SEQ ID NO: 320478 - protein, 33 aa, Mycobacterium
MMPAIAALLGRWFWWPRRVPTHAASPPAVTASP

SEQ ID NO: 320479 - protein, 23 aa, Mycobacterium
MMPLATDGPRGWADDDAPDPPAP

SEQ ID NO: 320480 - protein, 19 aa, Mycobacterium
MMQLPRLYRVPVHTVHKFG

SEQ ID NO: 320481 - protein, 22 aa, Mycobacterium
MMRPLRLLRLLVLVGALQKAVG

SEQ ID NO: 320482 - protein, 21 aa, Mycobacterium
MMRPLRLLRLVVLVGALQKAV

SEQ ID NO: 320483 - protein, 21 aa, Mycobacterium
MMRSRVINTIGFIMTGTVLLV

SEQ ID NO: 320484 - protein, 26 aa, Mycobacterium
MMRTSARTTMLWGLGLLTLASCMFAT

SEQ ID NO: 320485 - protein, 20 aa, Mycobacterium
MMSGGLFLLLVGRKLVWGVA

SEQ ID NO: 320486 - protein, 24 aa, Mycobacterium
MMSPEGLEGTALVVAGEACPTEVV

SEQ ID NO: 320487 - protein, 30 aa, Mycobacterium
MMTGHFYTPWSWLPRIVMQFTAGALACAAV

SEQ ID NO: 320488 - protein, 19 aa, Mycobacterium
MMVACVIGAISLVRMPETA

SEQ ID NO: 320489 - protein, 37 aa, Mycobacterium
MMVRRWRWIGTATVRWPGPILAAACAVGLVGLLALPG

SEQ ID NO: 320490 - protein, 22 aa, Mycobacterium
MMVSLAQLWRSVGVVPDAVIGH

SEQ ID NO: 320491 - protein, 26 aa, Mycobacterium
MMWQHLIGLPLHWLILPLSFIILVAV

SEQ ID NO: 320492 - protein, 28 aa, Mycobacterium
MMWTDGLIRLWPAWEFYPFGHTIPQGVW

SEQ ID NO: 320493 - protein, 25 aa, Mycobacterium
MMYPELAVLAAFVWASVPLLQREPK

SEQ ID NO: 320494 - protein, 17 aa, Mycobacterium
MNALLLPIVLGLLLVLE

SEQ ID NO: 320495 - protein, 23 aa, Mycobacterium
MNANEKWEAVGMGRSTETYLAGS

SEQ ID NO: 320496 - protein, 23 aa, Mycobacterium
MNDARFKDLASMFVSPDGHAVRY

SEQ ID NO: 320497 - protein, 23 aa, Mycobacterium
MNFEVGFHPSPLALAFTLGALAI

SEQ ID NO: 320498 - protein, 22 aa, Mycobacterium
MNIAQWYAFEFFFTTSHYAMAY

SEQ ID NO: 320499 - protein, 25 aa, Mycobacterium
MNLAGARPRLIWYAPHLVEGATSSP

SEQ ID NO: 320500 - protein, 26 aa, Mycobacterium
MNLAGARPRLIWYAPHRVEGESPPPG

SEQ ID NO: 320501 - protein, 25 aa, Mycobacterium
MNLAGDRPRLVWYAPHHVEGETSTK

SEQ ID NO: 320502 - protein, 25 aa, Mycobacterium
MNLAGDRPRLVWYAPHRVEGQTSEP

SEQ ID NO: 320503 - protein, 25 aa, Mycobacterium
MNLAGRSAHLVWYVPERPKVGASAK

SEQ ID NO: 320504 - protein, 25 aa, Mycobacterium
MNLLSLCVAFGALVWIFQDGHLGGL

SEQ ID NO: 320505 - protein, 21 aa, Mycobacterium
MNLPIAVWMMRSFFLEVPGEL

SEQ ID NO: 320506 - protein, 18 aa, Mycobacterium
MNLPRPRDLAPLLAAWAI

SEQ ID NO: 320507 - protein, 24 aa, Mycobacterium
MNLTNLKGLLGRLVEMLASLPSLI

SEQ ID NO: 320508 - protein, 17 aa, Mycobacterium
MNLYTLLAVAAARWPDR

SEQ ID NO: 320509 - protein, 23 aa, Mycobacterium
MNNRCPLTSYVLVGFSQGAVIAG

SEQ ID NO: 320510 - protein, 25 aa, Mycobacterium
MNPIARMVWRICKINGKPSRYRCEP

SEQ ID NO: 320511 - protein, 19 aa, Mycobacterium
MNTANPWLYEGHVLGAIFL

SEQ ID NO: 320512 - protein, 24 aa, Mycobacterium
MNTKCPLTSYVLMGFSQGAVIMGD

SEQ ID NO: 320513 - protein, 21 aa, Mycobacterium
MNVLAALAFWATVYLPAADFY

SEQ ID NO: 320514 - protein, 20 aa, Mycobacterium
MNVMVGFPLGGLLSIAIATC

SEQ ID NO: 320515 - protein, 19 aa, Mycobacterium
MPADVLQWSAGKALITTGT

SEQ ID NO: 320516 - protein, 21 aa, Mycobacterium
MPAIAWFPFAIIFFGLHTSAI

SEQ ID NO: 320517 - protein, 18 aa, Mycobacterium
MPAIEWYHVRQLRRVVDA

SEQ ID NO: 320518 - protein, 18 aa, Mycobacterium
MPAIFIAGFIPMFLTAYA

SEQ ID NO: 320519 - protein, 17 aa, Mycobacterium
MPAIFVFGFIPMFLTAF

SEQ ID NO: 320520 - protein, 17 aa, Mycobacterium
MPAPMRPLLAARPDAYR

SEQ ID NO: 320521 - protein, 18 aa, Mycobacterium
MPARGRLITMLLIGVVLL

SEQ ID NO: 320522 - protein, 17 aa, Mycobacterium
MPARTASAVTFLYALGY

SEQ ID NO: 320523 - protein, 19 aa, Mycobacterium
MPASLSARFDRACAQSQLP

SEQ ID NO: 320524 - protein, 21 aa, Mycobacterium
MPATVFVAFQLMFAIITVALI

SEQ ID NO: 320525 - protein, 31 aa, Mycobacterium
MPAVATLLGRWFWWPRPLAWQTRKPQMVSQR

SEQ ID NO: 320526 - protein, 21 aa, Mycobacterium
MPAVVARFGRYATANGALAFA

SEQ ID NO: 320527 - protein, 20 aa, Mycobacterium
MPAWRARPVLLVAPVVLVAL

SEQ ID NO: 320528 - protein, 18 aa, Mycobacterium
MPAYVVTVLLVFGIYELR

SEQ ID NO: 320529 - protein, 24 aa, Mycobacterium
MPDLARKASTPWVLAAVVAALSVA

SEQ ID NO: 320530 - protein, 24 aa, Mycobacterium
MPDRVKCLHVVIAHSLAKGPGVNP

SEQ ID NO: 320531 - protein, 24 aa, Mycobacterium
MPEVNRPDVPIVLRIYDRTLGDAV

SEQ ID NO: 320532 - protein, 19 aa, Mycobacterium
MPEVSWLWPSGLDVSSIAA

SEQ ID NO: 320533 - protein, 17 aa, Mycobacterium
MPEVVAPLISRGLAELA

SEQ ID NO: 320534 - protein, 25 aa, Mycobacterium
MPFYRTVISVATWLVGGAIFVAVTW

SEQ ID NO: 320535 - protein, 20 aa, Mycobacterium
MPGDGLSDCDAHGMIVASLI

SEQ ID NO: 320536 - protein, 17 aa, Mycobacterium
MPGETRVAATPQTVGQL

SEQ ID NO: 320537 - protein, 17 aa, Mycobacterium
MPHWLEWVSDAMPASYA

SEQ ID NO: 320538 - protein, 21 aa, Mycobacterium
MPIERARALLDVLAWPEDSVA

SEQ ID NO: 320539 - protein, 17 aa, Mycobacterium
MPISRLLVVLGNAVTPG

SEQ ID NO: 320540 - protein, 17 aa, Mycobacterium
MPIVEAFRRHWRQIVLV

SEQ ID NO: 320541 - protein, 25 aa, Mycobacterium
MPLFPELRSISLLQVLTGIASSVFA

SEQ ID NO: 320542 - protein, 19 aa, Mycobacterium
MPLGIWVFGPLRRRATAAL

SEQ ID NO: 320543 - protein, 23 aa, Mycobacterium
MPLGRWIGFALIWTALAVMTIGT

SEQ ID NO: 320544 - protein, 19 aa, Mycobacterium
MPLHVFIGVILMMAPRTLT

SEQ ID NO: 320545 - protein, 17 aa, Mycobacterium
MPLHVFIGVVLMMAPRP

SEQ ID NO: 320546 - protein, 23 aa, Mycobacterium
MPLLGRASDRFGRKLMLQVSLAG

SEQ ID NO: 320547 - protein, 24 aa, Mycobacterium
MPLLGRASDRFGRKLMLQVSLLGF

SEQ ID NO: 320548 - protein, 23 aa, Mycobacterium
MPLLGRASDRFGRKMLIQVGLAG

SEQ ID NO: 320549 - protein, 23 aa, Mycobacterium
MPLLGRASDRFGRKMLIQVSLAG

SEQ ID NO: 320550 - protein, 17 aa, Mycobacterium
MPLLLAGALALSAFLGW

SEQ ID NO: 320551 - protein, 27 aa, Mycobacterium
MPLLYGAMYLWAFWNPFAEVNKVPVAL

SEQ ID NO: 320552 - protein, 25 aa, Mycobacterium
MPLLYGAMYLWAFWNPFNEVDKVPV

SEQ ID NO: 320553 - protein, 28 aa, Mycobacterium
MPLPTSIPLTALWLAQSWHRRILDEELD

SEQ ID NO: 320554 - protein, 25 aa, Mycobacterium
MPLQRLGFWGDHRIRSYLERHSTDQ

SEQ ID NO: 320555 - protein, 18 aa, Mycobacterium
MPLSRLLVVLGNALTPGR

SEQ ID NO: 320556 - protein, 19 aa, Mycobacterium
MPMFPGLYSISVLQALTGI

SEQ ID NO: 320557 - protein, 29 aa, Mycobacterium
MPPALRRTWVGALVRWLARPAGLSAAAVA

SEQ ID NO: 320558 - protein, 20 aa, Mycobacterium
MPPFYPAGWFWIGGRLAALT

SEQ ID NO: 320559 - protein, 23 aa, Mycobacterium
MPPGLRQLAKWTGLVFGIATLAV

SEQ ID NO: 320560 - protein, 22 aa, Mycobacterium
MPPMRWFGFALIWVALAVFTVD

SEQ ID NO: 320561 - protein, 17 aa, Mycobacterium
MPQGWSFAQAAAVPVVF

SEQ ID NO: 320562 - protein, 26 aa, Mycobacterium
MPQLPCILPAPFCPPSTSPPTPTPEQ

SEQ ID NO: 320563 - protein, 19 aa, Mycobacterium
MPRLLRWLQPVIPLAAGPT

SEQ ID NO: 320564 - protein, 19 aa, Mycobacterium
MPRMLKWLSPLVPLVAGPL

SEQ ID NO: 320565 - protein, 18 aa, Mycobacterium
MPRRIPLFPTAERPAIES

SEQ ID NO: 320566 - protein, 20 aa, Mycobacterium
MPRVAAIPFSSERQYMATLH

SEQ ID NO: 320567 - protein, 19 aa, Mycobacterium
MPSAIAIMIVILLIGIAID

SEQ ID NO: 320568 - protein, 28 aa, Mycobacterium
MPSIATLLGRWFWWPLVVRSRPLRPRPQ

SEQ ID NO: 320569 - protein, 26 aa, Mycobacterium
MPSVAALLGRWFWWPQQVRTRPASQL

SEQ ID NO: 320570 - protein, 19 aa, Mycobacterium
MPTSMPMRMVVPHMLLVSY

SEQ ID NO: 320571 - protein, 17 aa, Mycobacterium
MPTYLSKDWGRDWGSLR

SEQ ID NO: 320572 - protein, 17 aa, Mycobacterium
MPVDVAPPFVVADIGAN

SEQ ID NO: 320573 - protein, 18 aa, Mycobacterium
MPVGPRLSRTAELDKISS

SEQ ID NO: 320574 - protein, 28 aa, Mycobacterium
MPVLLFCIAFGLSMDYEVFLLSRIREYW

SEQ ID NO: 320575 - protein, 30 aa, Mycobacterium
MPVLLFCIAFGLSMDYEVFLLSRIREYWLA

SEQ ID NO: 320576 - protein, 44 aa, Mycobacterium
MPVLLFCIAFGLSMDYEVFLLSRIREYWLASGAARPARPTPKQA

SEQ ID NO: 320577 - protein, 28 aa, Mycobacterium
MPVLLFCIAFGLSMDYEVFLVSRIREFR

SEQ ID NO: 320578 - protein, 19 aa, Mycobacterium
MPVPEVLDIVKAVAAALDY

SEQ ID NO: 320579 - protein, 21 aa, Mycobacterium
MPVPSRRAAIAGRGVLTALPV

SEQ ID NO: 320580 - protein, 17 aa, Mycobacterium
MPWTQWLTWIFQAVPVF

SEQ ID NO: 320581 - protein, 24 aa, Mycobacterium
MPYLLERIDYSFGRHKYWCNINAD

SEQ ID NO: 320582 - protein, 18 aa, Mycobacterium
MQAIHRIGAVFKESDSDS

SEQ ID NO: 320583 - protein, 17 aa, Mycobacterium
MQCEAWDPTTGKYGPLY

SEQ ID NO: 320584 - protein, 19 aa, Mycobacterium
MQDLMKYSPLRTGIAAIPF

SEQ ID NO: 320585 - protein, 17 aa, Mycobacterium
MQDPAVAIDIYKGDTGL

SEQ ID NO: 320586 - protein, 25 aa, Mycobacterium
MQFGEGWWTSVWFLAFWITGTSMLM

SEQ ID NO: 320587 - protein, 24 aa, Mycobacterium
MQFICSSIQAGSRLGYQESAELCA

SEQ ID NO: 320588 - protein, 24 aa, Mycobacterium
MQFLCSAIQAGSRLGYQESAELCA

SEQ ID NO: 320589 - protein, 24 aa, Mycobacterium
MQFVCSSIQAGSRLGYQESAELCA

SEQ ID NO: 320590 - protein, 17 aa, Mycobacterium
MQGDGPYILAGWSLGGV

SEQ ID NO: 320591 - protein, 24 aa, Mycobacterium
MQIGGGLTLDWGALLIIAVVTFLL

SEQ ID NO: 320592 - protein, 30 aa, Mycobacterium
MQKALPWVMGGCMLGMIAILIFGGLRNFSP

SEQ ID NO: 320593 - protein, 32 aa, Mycobacterium
MQKALPWVMGGCMLGMIAIMVFTGVRQLSPYM

SEQ ID NO: 320594 - protein, 23 aa, Mycobacterium
MQKRVLAGGGIGQFIEFYDFTLY

SEQ ID NO: 320595 - protein, 25 aa, Mycobacterium
MQLALTELWRAYGVHPDAVIGHSMG

SEQ ID NO: 320596 - protein, 29 aa, Mycobacterium
MQLSLPSWVRARGLSVYQLIFMGGQAVGS

SEQ ID NO: 320597 - protein, 23 aa, Mycobacterium
MQLVGAICYWLASARYRRDIIEE

SEQ ID NO: 320598 - protein, 34 aa, Mycobacterium
MQQPRWVTRLGLAVGVALTFTFLWFVFVGVGDSD

SEQ ID NO: 320599 - protein, 21 aa, Mycobacterium
MQQWRRLPLVPATIVGWGGLA

SEQ ID NO: 320600 - protein, 17 aa, Mycobacterium
MQRRTWRNPSPELLVEW

SEQ ID NO: 320601 - protein, 23 aa, Mycobacterium
MQTGWGKLVLIAAGLGVAAVGAY

SEQ ID NO: 320602 - protein, 20 aa, Mycobacterium
MQWRKRRLFIAVLSTGLIFG

SEQ ID NO: 320603 - protein, 22 aa, Mycobacterium
MQWRKRRLVIAIISTGIIFGMT

SEQ ID NO: 320604 - protein, 17 aa, Mycobacterium
MQYYIAFRIYKSAEALF

SEQ ID NO: 320605 - protein, 17 aa, Mycobacterium
MRAARPFIALYDRSAKA

SEQ ID NO: 320606 - protein, 19 aa, Mycobacterium
MRCGLDRPADFVVGAPIQI

SEQ ID NO: 320607 - protein, 22 aa, Mycobacterium
MRDGKTRMIVYMTGIDAGLNES

SEQ ID NO: 320608 - protein, 21 aa, Mycobacterium
MRDGSKWDLMIAGIAAASLIF

SEQ ID NO: 320609 - protein, 17 aa, Mycobacterium
MRDWATSVGPWFPLAFL

SEQ ID NO: 320610 - protein, 23 aa, Mycobacterium
MRENLRLRSFRNIVVSTTILLSL

SEQ ID NO: 320611 - protein, 23 aa, Mycobacterium
MRFKDLELRYARLARAIALDSAQ

SEQ ID NO: 320612 - protein, 23 aa, Mycobacterium
MRFKDLELRYARLARAIALEGAQ

SEQ ID NO: 320613 - protein, 22 aa, Mycobacterium
MRFKDLELRYARLARALALEGA

SEQ ID NO: 320614 - protein, 23 aa, Mycobacterium
MRFKDLELRYARLARAVALEGAQ

SEQ ID NO: 320615 - protein, 19 aa, Mycobacterium
MRGDACWRNLTCLYYHHET

SEQ ID NO: 320616 - protein, 20 aa, Mycobacterium
MRGDPCWRDLTCLYYHHETQ

SEQ ID NO: 320617 - protein, 21 aa, Mycobacterium
MRGDRCWRDLTCLYYHHETQP

SEQ ID NO: 320618 - protein, 21 aa, Mycobacterium
MRGGKWWTKPFVRAAYGNAVI

SEQ ID NO: 320619 - protein, 21 aa, Mycobacterium
MRGGKWWTKPFVRSAYGNAVI

SEQ ID NO: 320620 - protein, 26 aa, Mycobacterium
MRGMPARGRLVAVLLIGLVLLTAGYT

SEQ ID NO: 320621 - protein, 20 aa, Mycobacterium
MRGSYGGMVMVGMLSSVAGL

SEQ ID NO: 320622 - protein, 17 aa, Mycobacterium
MRGVISLLLGLAIGIVG

SEQ ID NO: 320623 - protein, 26 aa, Mycobacterium
MRHLPAVLMILSLVSFTIAMAGPTHD

SEQ ID NO: 320624 - protein, 18 aa, Mycobacterium
MRHPRAGSGVAERDGLIV

SEQ ID NO: 320625 - protein, 19 aa, Mycobacterium
MRHRARPGEDDMFTAPGAV

SEQ ID NO: 320626 - protein, 20 aa, Mycobacterium
MRHSMALAHRVIQQLPAQRA

SEQ ID NO: 320627 - protein, 26 aa, Mycobacterium
MRILAICGGVLIGTVIVGWVISLIVV

SEQ ID NO: 320628 - protein, 18 aa, Mycobacterium
MRITLERVDDGFKAAKVG

SEQ ID NO: 320629 - protein, 17 aa, Mycobacterium
MRKAKELVIATKMSGEW

SEQ ID NO: 320630 - protein, 18 aa, Mycobacterium
MRKIHTFSVPPNMVAPLL

SEQ ID NO: 320631 - protein, 33 aa, Mycobacterium
MRKISAWVGIAAFPTMLAGIYGMNFEHMPELAE

SEQ ID NO: 320632 - protein, 19 aa, Mycobacterium
MRKMHAVAVPPSWAAPLLA

SEQ ID NO: 320633 - protein, 17 aa, Mycobacterium
MRKVIWPNRKQMLTYTS

SEQ ID NO: 320634 - protein, 20 aa, Mycobacterium
MRKWFRRASPFIGVLGGWAH

SEQ ID NO: 320635 - protein, 18 aa, Mycobacterium
MRLADWWPEPDEFDPARF

SEQ ID NO: 320636 - protein, 18 aa, Mycobacterium
MRLNREYRAEAAILEMFR

SEQ ID NO: 320637 - protein, 19 aa, Mycobacterium
MRLNREYRSEAAILEMFRT

SEQ ID NO: 320638 - protein, 30 aa, Mycobacterium
MRLPDLIAGIVCWLLLSREVLPRLGPAVAA

SEQ ID NO: 320639 - protein, 18 aa, Mycobacterium
MRLPDLICSVICWLLLSR

SEQ ID NO: 320640 - protein, 20 aa, Mycobacterium
MRLVAEFTPVHFFAQPVVTL

SEQ ID NO: 320641 - protein, 20 aa, Mycobacterium
MRMILEVPALQAYSMLMYTG

SEQ ID NO: 320642 - protein, 20 aa, Mycobacterium
MRMTDLFVAVSLNYPFSRYD

SEQ ID NO: 320643 - protein, 24 aa, Mycobacterium
MRNSPEPILLMLAAVKCGAISGML

SEQ ID NO: 320644 - protein, 26 aa, Mycobacterium
MRPFVDLRWWPFLLLLGTTLALMLTA

SEQ ID NO: 320645 - protein, 37 aa, Mycobacterium
MRPLRNYFYWEPHCFDIPACWAFRSLFDMLDSVDKLA

SEQ ID NO: 320646 - protein, 36 aa, Mycobacterium
MRPLRNYFYWEPHCFDIPVCQSFRSLFDMLDSIDKL

SEQ ID NO: 320647 - protein, 19 aa, Mycobacterium
MRPQGRFDAVATGFGPGLQ

SEQ ID NO: 320648 - protein, 23 aa, Mycobacterium
MRQEGRPASAYTLRRLVSHFWRL

SEQ ID NO: 320649 - protein, 21 aa, Mycobacterium
MRQGAFCPKVGTLPGTDYRVQ

SEQ ID NO: 320650 - protein, 25 aa, Mycobacterium
MRRDDRLLAVLPFFHIYGMTVLLNA

SEQ ID NO: 320651 - protein, 18 aa, Mycobacterium
MRRFSWSGPAPVLDPLPR

SEQ ID NO: 320652 - protein, 23 aa, Mycobacterium
MRRIEAACKVWSAGVSASPLGRD

SEQ ID NO: 320653 - protein, 18 aa, Mycobacterium
MRRLARWADLPDDSRPLL

SEQ ID NO: 320654 - protein, 18 aa, Mycobacterium
MRRMSVSPAFGYSYLVIY

SEQ ID NO: 320655 - protein, 30 aa, Mycobacterium
MRRPSLHKYLGLVGPVGFSTVLSGGTSLSE

SEQ ID NO: 320656 - protein, 19 aa, Mycobacterium
MRRQLKWLSPLIPLVASPL

SEQ ID NO: 320657 - protein, 20 aa, Mycobacterium
MRSQDFWRSAARLVKRLAPQ

SEQ ID NO: 320658 - protein, 18 aa, Mycobacterium
MRSWKGKALKEFRTALRI

SEQ ID NO: 320659 - protein, 22 aa, Mycobacterium
MRSWPVDRPFALLPAARALMLD

SEQ ID NO: 320660 - protein, 29 aa, Mycobacterium
MRTAFLRYWKEIIRLVAQMSLGTGALAVI

SEQ ID NO: 320661 - protein, 29 aa, Mycobacterium
MRTSTLVLIIAFFLVWWTYDTYRPAPAPK

SEQ ID NO: 320662 - protein, 26 aa, Mycobacterium
MRTYGRLLHDARFVILVLVAALGMSG

SEQ ID NO: 320663 - protein, 28 aa, Mycobacterium
MRVARRVRRLPGVLSIVVLLFVACAPVA

SEQ ID NO: 320664 - protein, 19 aa, Mycobacterium
MRVGLRKSGGAWTIEALEP

SEQ ID NO: 320665 - protein, 20 aa, Mycobacterium
MRVGLVFLAGWIITLKEDIL

SEQ ID NO: 320666 - protein, 20 aa, Mycobacterium
MRVLSLRTIVVVAALSVITL

SEQ ID NO: 320667 - protein, 31 aa, Mycobacterium
MRYDQFMRLGWKLLIPVSLAWIAIVATTRAM

SEQ ID NO: 320668 - protein, 18 aa, Mycobacterium
MSAARGLVAFLGNAGVIG

SEQ ID NO: 320669 - protein, 17 aa, Mycobacterium
MSAELHSTVLTFENLKE

SEQ ID NO: 320670 - protein, 21 aa, Mycobacterium
MSAGFLTVFGVFGLLISPLIA

SEQ ID NO: 320671 - protein, 17 aa, Mycobacterium
MSALSRIAVYESGFETD

SEQ ID NO: 320672 - protein, 19 aa, Mycobacterium
MSARAWRVLYRSTDAAGSP

SEQ ID NO: 320673 - protein, 26 aa, Mycobacterium
MSARKVLEPRGWRIWRVWPDTTTLLV

SEQ ID NO: 320674 - protein, 17 aa, Mycobacterium
MSARPGTLTAVIGPSGA

SEQ ID NO: 320675 - protein, 17 aa, Mycobacterium
MSESLLLAATPALAGAV

SEQ ID NO: 320676 - protein, 27 aa, Mycobacterium
MSFQRWDVFRPPKFVGLQNFRELFTSD

SEQ ID NO: 320677 - protein, 31 aa, Mycobacterium
MSFVLARRVGRIAARTGPRMFLIAGPALSGL

SEQ ID NO: 320678 - protein, 26 aa, Mycobacterium
MSFVLQEFVHFVLPKLMKGYGGSNAQ

SEQ ID NO: 320679 - protein, 24 aa, Mycobacterium
MSGIPILLCAGGYVVFFHGPRLHL

SEQ ID NO: 320680 - protein, 20 aa, Mycobacterium
MSGLFAYIAGASFVLQGRFG

SEQ ID NO: 320681 - protein, 25 aa, Mycobacterium
MSGLNSRLLKSWVRKYTVRRGALLF

SEQ ID NO: 320682 - protein, 17 aa, Mycobacterium
MSGYRSIVVFGIANLVG

SEQ ID NO: 320683 - protein, 17 aa, Mycobacterium
MSICTGLGLLVIAEGIE

SEQ ID NO: 320684 - protein, 18 aa, Mycobacterium
MSISYSRVRRDGGEHRLP

SEQ ID NO: 320685 - protein, 23 aa, Mycobacterium
MSLFVSWLLFTWMIARLPRETVT

SEQ ID NO: 320686 - protein, 20 aa, Mycobacterium
MSLGAAFGFSTLIWQHLGDF

SEQ ID NO: 320687 - protein, 35 aa, Mycobacterium
MSLGHWEFYMALAYFKLAIIAAGIDFRRRMSELAD

SEQ ID NO: 320688 - protein, 35 aa, Mycobacterium
MSLGHWEFYMALGYFKLAIIAAGIDFRRRMSELAD

SEQ ID NO: 320689 - protein, 23 aa, Mycobacterium
MSLHEPYLMGCLNARNELSQISY

SEQ ID NO: 320690 - protein, 22 aa, Mycobacterium
MSLMAMPFADWGNRTLPGRGDG

SEQ ID NO: 320691 - protein, 24 aa, Mycobacterium
MSLNTSYYRLMLKLKGGPEAVADA

SEQ ID NO: 320692 - protein, 25 aa, Mycobacterium
MSLNTSYYRLMLKLKGGPQAVADAA

SEQ ID NO: 320693 - protein, 19 aa, Mycobacterium
MSLPNLRYVTQAGGRLDPD

SEQ ID NO: 320694 - protein, 21 aa, Mycobacterium
MSLPPAHSLSEFHLTDSSAAS

SEQ ID NO: 320695 - protein, 23 aa, Mycobacterium
MSLSGFEHAWFFLFLLVVAGLAA

SEQ ID NO: 320696 - protein, 24 aa, Mycobacterium
MSLSGFEHSWFFLFLLVVFGLAAL

SEQ ID NO: 320697 - protein, 28 aa, Mycobacterium
MSLSQAWLAGVGVDWSAVFAGSGGRQVG

SEQ ID NO: 320698 - protein, 24 aa, Mycobacterium
MSPYEILTVASLVQRESKPQDFSK

SEQ ID NO: 320699 - protein, 19 aa, Mycobacterium
MSQNLTPALGVFALNSDKF

SEQ ID NO: 320700 - protein, 22 aa, Mycobacterium
MSRAAGLPIGLGAAVLVPPMAL

SEQ ID NO: 320701 - protein, 18 aa, Mycobacterium
MSRAFPFSAGGGILVGAL

SEQ ID NO: 320702 - protein, 24 aa, Mycobacterium
MSRCPKAVVVAALVAALAGPVAYS

SEQ ID NO: 320703 - protein, 23 aa, Mycobacterium
MSREHVHLPALLIGLGTFGVGTA

SEQ ID NO: 320704 - protein, 26 aa, Mycobacterium
MSRFPTAGHLVSWAKLCPRTIQSGPV

SEQ ID NO: 320705 - protein, 24 aa, Mycobacterium
MSRGELDRTLVLWMLPLLIAPPMY

SEQ ID NO: 320706 - protein, 37 aa, Mycobacterium
MSRRFAVLVLLLCLFGMLVTLLRRGRIPGVASGPAWR

SEQ ID NO: 320707 - protein, 19 aa, Mycobacterium
MSRRRAIVCRLPAVEALGS

SEQ ID NO: 320708 - protein, 22 aa, Mycobacterium
MSSALPAAGGGYTFARRALGPW

SEQ ID NO: 320709 - protein, 25 aa, Mycobacterium
MSSVGRGGLQFMLIIWLQGIWLPLH

SEQ ID NO: 320710 - protein, 20 aa, Mycobacterium
MSSVVFLLGIAFVYAATGTL

SEQ ID NO: 320711 - protein, 27 aa, Mycobacterium
MSTSLPVDASWRFRYRRSRSVANSFAM

SEQ ID NO: 320712 - protein, 30 aa, Mycobacterium
MSTSVYDMGLFYRYAWHNPVFADIVATRAT

SEQ ID NO: 320713 - protein, 24 aa, Mycobacterium
MSVDWFGVIVLAAWGTLGALSALR

SEQ ID NO: 320714 - protein, 24 aa, Mycobacterium
MSVLCAALALNLWVGYFPWVQTAW

SEQ ID NO: 320715 - protein, 20 aa, Mycobacterium
MSVLRAEWWDAVQAAGGTRW

SEQ ID NO: 320716 - protein, 17 aa, Mycobacterium
MSVLRLISFATDVSTYA

SEQ ID NO: 320717 - protein, 17 aa, Mycobacterium
MSVLRLITFGADVSIFA

SEQ ID NO: 320718 - protein, 20 aa, Mycobacterium
MSVMTGKALFTRPFQWKEFV

SEQ ID NO: 320719 - protein, 19 aa, Mycobacterium
MSVPLFAERVAPTTWHPVH

SEQ ID NO: 320720 - protein, 18 aa, Mycobacterium
MSVSPAFGYSYLVIYSLS

SEQ ID NO: 320721 - protein, 20 aa, Mycobacterium
MTAACERPMIFPLSNPTSRM

SEQ ID NO: 320722 - protein, 26 aa, Mycobacterium
MTAAPLFHNIASWLMRRENVPLSPDP

SEQ ID NO: 320723 - protein, 21 aa, Mycobacterium
MTADFASLIGVMADNVDNFDR

SEQ ID NO: 320724 - protein, 22 aa, Mycobacterium
MTAGAALVMWMGELVTERGIGN

SEQ ID NO: 320725 - protein, 29 aa, Mycobacterium
MTAIVGAFALRRVWWLYKLIMSGQPASDR

SEQ ID NO: 320726 - protein, 25 aa, Mycobacterium
MTALGIASAVPWWAGLFTSATMAAI

SEQ ID NO: 320727 - protein, 19 aa, Mycobacterium
MTALMWFVFGLTAVLALGS

SEQ ID NO: 320728 - protein, 24 aa, Mycobacterium
MTAPKFWWLMTVFAALIALGAYLG

SEQ ID NO: 320729 - protein, 18 aa, Mycobacterium
MTAVFCIQLGTAVATMSP

SEQ ID NO: 320730 - protein, 18 aa, Mycobacterium
MTEAIPIPATALLPLVVF

SEQ ID NO: 320731 - protein, 24 aa, Mycobacterium
MTEQRFKEVFGRVVQNVPWVLERV

SEQ ID NO: 320732 - protein, 17 aa, Mycobacterium
MTFSVLAAYAFARLEFP

SEQ ID NO: 320733 - protein, 17 aa, Mycobacterium
MTFSVLGGYAFARLEFP

SEQ ID NO: 320734 - protein, 26 aa, Mycobacterium
MTGCVSIGGGCLWQPQPLVGLMSCSA

SEQ ID NO: 320735 - protein, 17 aa, Mycobacterium
MTGFPGFTKAGDRRRSA

SEQ ID NO: 320736 - protein, 22 aa, Mycobacterium
MTGGAALVMWMGELITERGIGN

SEQ ID NO: 320737 - protein, 24 aa, Mycobacterium
MTGRAVSFVGPWLFATFALLFHAT

SEQ ID NO: 320738 - protein, 19 aa, Mycobacterium
MTGRWPWRQPTVSPETTAA

SEQ ID NO: 320739 - protein, 24 aa, Mycobacterium
MTGSWRLLGVLALADPARNDSAAT

SEQ ID NO: 320740 - protein, 22 aa, Mycobacterium
MTHDELRFVVGHELGHALSGHA

SEQ ID NO: 320741 - protein, 21 aa, Mycobacterium
MTIDALVWVPRMYYLYGNASR

SEQ ID NO: 320742 - protein, 23 aa, Mycobacterium
MTITVVMLISWLVARRREAYSQR

SEQ ID NO: 320743 - protein, 24 aa, Mycobacterium
MTLFSFLFAALWLSALAIFQTRST

SEQ ID NO: 320744 - protein, 29 aa, Mycobacterium
MTLLPAILVLAGPRGWVKPRRELTAQFWR

SEQ ID NO: 320745 - protein, 25 aa, Mycobacterium
MTLPRPRDLAPLLAAWVASVGVMVF

SEQ ID NO: 320746 - protein, 19 aa, Mycobacterium
MTLSLVWPVTAMGFLLSMT

SEQ ID NO: 320747 - protein, 25 aa, Mycobacterium
MTLTSCWRLFVPGGFLDASHGRQWK

SEQ ID NO: 320748 - protein, 26 aa, Mycobacterium
MTLYLWHMPLLLGMHLVFDYAGFDRY

SEQ ID NO: 320749 - protein, 17 aa, Mycobacterium
MTNGFASTVARLANHPS

SEQ ID NO: 320750 - protein, 36 aa, Mycobacterium
MTNPAGALATWWPFLFGVAYQVFFNLVGWPTWGMIF

SEQ ID NO: 320751 - protein, 24 aa, Mycobacterium
MTNPMLRRFHELQANTLMLSGSPQ

SEQ ID NO: 320752 - protein, 27 aa, Mycobacterium
MTPAIAALLGRWFWWPLQVSPRPVGAV

SEQ ID NO: 320753 - protein, 29 aa, Mycobacterium
MTPAIAALLGRWFWWPLRVRSRPDRRAIQ

SEQ ID NO: 320754 - protein, 33 aa, Mycobacterium
MTPAIAALLGRWFWWPQRIRRRPAITSQAPAER

SEQ ID NO: 320755 - protein, 26 aa, Mycobacterium
MTPAIAALLGRWFWWPQTPPRKRLAL

SEQ ID NO: 320756 - protein, 17 aa, Mycobacterium
MTPHWSGPAQVVDRIDG

SEQ ID NO: 320757 - protein, 17 aa, Mycobacterium
MTPLARFGFPVRQVAIA

SEQ ID NO: 320758 - protein, 20 aa, Mycobacterium
MTPLGWGWATVVWAYALFWF

SEQ ID NO: 320759 - protein, 17 aa, Mycobacterium
MTPLRAVHIISEVAKAL

SEQ ID NO: 320760 - protein, 22 aa, Mycobacterium
MTPLRVMFVIALVFLALGWSTK

SEQ ID NO: 320761 - protein, 18 aa, Mycobacterium
MTPLRVMLIIALVFLALG

SEQ ID NO: 320762 - protein, 33 aa, Mycobacterium
MTPSIAAALGRWFWWPINVFEIVRRGRETQAPE

SEQ ID NO: 320763 - protein, 29 aa, Mycobacterium
MTPSIAAALGRWFWWPLNTFEITRHGRGG

SEQ ID NO: 320764 - protein, 29 aa, Mycobacterium
MTPSIAAALGRWFWWPLNTFEITRRGRQA

SEQ ID NO: 320765 - protein, 30 aa, Mycobacterium
MTPSIAALLGRWFWWPIRVRPRPASEMLRP

SEQ ID NO: 320766 - protein, 28 aa, Mycobacterium
MTPSIAALLGRWFWWPLNIRSRPPRLTR

SEQ ID NO: 320767 - protein, 29 aa, Mycobacterium
MTPSIAALLGRWFWWPLQVRSRPTGTTTG

SEQ ID NO: 320768 - protein, 29 aa, Mycobacterium
MTPSIAALLGRWFWWPLQVRTRPTRPTAV

SEQ ID NO: 320769 - protein, 26 aa, Mycobacterium
MTPSIAALLGRWFWWPMKVRSRPARI

SEQ ID NO: 320770 - protein, 27 aa, Mycobacterium
MTPSIAALLGRWFWWPMRVRTRPARTP

SEQ ID NO: 320771 - protein, 27 aa, Mycobacterium
MTPSIAALLGRWFWWPMVVRPRPASAL

SEQ ID NO: 320772 - protein, 35 aa, Mycobacterium
MTPSIAALLGRWFWWPQIVRPRPASQMLRSEGPRP

SEQ ID NO: 320773 - protein, 29 aa, Mycobacterium
MTPSIAALLGRWFWWPQKIRTRPVPVPWG

SEQ ID NO: 320774 - protein, 27 aa, Mycobacterium
MTPSIAALLGRWFWWPQKVRPRPASAL

SEQ ID NO: 320775 - protein, 35 aa, Mycobacterium
MTPSIAALLGRWFWWPQRVRPRPASQMLRPSGPRS

SEQ ID NO: 320776 - protein, 30 aa, Mycobacterium
MTPSIAALLGRWFWWPQRVRPRPASRMLRA

SEQ ID NO: 320777 - protein, 34 aa, Mycobacterium
MTPSIAALLGRWFWWPQRVRPRPASRMLRPYGPR

SEQ ID NO: 320778 - protein, 39 aa, Mycobacterium
MTPSIAALLGRWFWWPQRVRPRPPSALLTPVGASAPSAW

SEQ ID NO: 320779 - protein, 29 aa, Mycobacterium
MTPSIAALLGRWFWWPQRVRQRPASAMLR

SEQ ID NO: 320780 - protein, 35 aa, Mycobacterium
MTPSIAALLGRWFWWPQRVRTRPASYMLRPFGPRR

SEQ ID NO: 320781 - protein, 31 aa, Mycobacterium
MTPSIAALLGRWFWWPQVVRARPARGVVARA

SEQ ID NO: 320782 - protein, 27 aa, Mycobacterium
MTPSIAALMGRWFWWPQQVRTRPASQL

SEQ ID NO: 320783 - protein, 36 aa, Mycobacterium
MTPSIASLLGRWFWWPMVVRPRPRPQPWPQPLHAGA

SEQ ID NO: 320784 - protein, 27 aa, Mycobacterium
MTPSIAVLLGRWFWWPHHVRPRPIPQR

SEQ ID NO: 320785 - protein, 42 aa, Mycobacterium
MTPSLATLLGRWFWWPQHVRPRPASTMLRPYGPRPAVRELIL

SEQ ID NO: 320786 - protein, 40 aa, Mycobacterium
MTPTIAALLGRWFWWPLLVRPRPASLLLRSVGTRPSVRTL

SEQ ID NO: 320787 - protein, 22 aa, Mycobacterium
MTRSIDGVRNWLIDGPLHLSKE

SEQ ID NO: 320788 - protein, 18 aa, Mycobacterium
MTRYYAAQRTFWVDPVSG

SEQ ID NO: 320789 - protein, 19 aa, Mycobacterium
MTRYYAAQRTFWVDPVTGT

SEQ ID NO: 320790 - protein, 26 aa, Mycobacterium
MTSLAVWVLCLGWQPLPGHIWSAGGI

SEQ ID NO: 320791 - protein, 20 aa, Mycobacterium
MTSVFAGFIFNPEPMIAQVG

SEQ ID NO: 320792 - protein, 32 aa, Mycobacterium
MTSWGWRIPFVLGGPLGVAAMFMRSRLDESPD

SEQ ID NO: 320793 - protein, 24 aa, Mycobacterium
MTTARRLGVTFGVAAALLLLIALS

SEQ ID NO: 320794 - protein, 18 aa, Mycobacterium
MTVDAAFMSRCAGGDTAT

SEQ ID NO: 320795 - protein, 21 aa, Mycobacterium
MTVGLGLAVARSIVAFLGERD

SEQ ID NO: 320796 - protein, 25 aa, Mycobacterium
MTVLAVFPMYFLKSSAYTVVATAVI

SEQ ID NO: 320797 - protein, 23 aa, Mycobacterium
MTVLTVFLFFIFGQYRTGSTNGY

SEQ ID NO: 320798 - protein, 35 aa, Mycobacterium
MTVMGRWFWWPKRVRVRPASLMLRSVGPRPLVRAL

SEQ ID NO: 320799 - protein, 28 aa, Mycobacterium
MTYVLFAQVFWLFWAALLSAPLWLPLLI

SEQ ID NO: 320800 - protein, 21 aa, Mycobacterium
MVAAGVWPITAIGVAAITGVY

SEQ ID NO: 320801 - protein, 25 aa, Mycobacterium
MVACVVGLCALPFLIETAGASIAGT

SEQ ID NO: 320802 - protein, 26 aa, Mycobacterium
MVAGALRRWLLDRGELPKQSLVAACP

SEQ ID NO: 320803 - protein, 22 aa, Mycobacterium
MVAGATHLLGWVLLAATVIPLA

SEQ ID NO: 320804 - protein, 17 aa, Mycobacterium
MVAGFALLARLGTASTY

SEQ ID NO: 320805 - protein, 22 aa, Mycobacterium
MVAGLLLGRLVPGLGGAVSAVQ

SEQ ID NO: 320806 - protein, 18 aa, Mycobacterium
MVAIPWYFLRELRAELGS

SEQ ID NO: 320807 - protein, 25 aa, Mycobacterium
MVAMKRIGKVFHEFNTDSSVMIVLE

SEQ ID NO: 320808 - protein, 26 aa, Mycobacterium
MVAMVLFPMYFLKSFAYAGIAVVALA

SEQ ID NO: 320809 - protein, 26 aa, Mycobacterium
MVAMVLFPMYFLKSFAYAGIAVVSFA

SEQ ID NO: 320810 - protein, 17 aa, Mycobacterium
MVAPRAGLVMDPGSKVT

SEQ ID NO: 320811 - protein, 17 aa, Mycobacterium
MVARFAVMFAAGALIHQ

SEQ ID NO: 320812 - protein, 19 aa, Mycobacterium
MVATLRFGFAHQKLANLIA

SEQ ID NO: 320813 - protein, 18 aa, Mycobacterium
MVAVAGLCALCLYCESLG

SEQ ID NO: 320814 - protein, 17 aa, Mycobacterium
MVAVLTLVFAFRSSAAL

SEQ ID NO: 320815 - protein, 23 aa, Mycobacterium
MVDALGGVEVCSKSALHDYELGT

SEQ ID NO: 320816 - protein, 18 aa, Mycobacterium
MVDALGGVEVCSSTPLHD

SEQ ID NO: 320817 - protein, 17 aa, Mycobacterium
MVDALGGVEVCSTTPLE

SEQ ID NO: 320818 - protein, 17 aa, Mycobacterium
MVDALGGVEVCTPTPIE

SEQ ID NO: 320819 - protein, 18 aa, Mycobacterium
MVDLFRWHGAEEVEHRSV

SEQ ID NO: 320820 - protein, 24 aa, Mycobacterium
MVDRDPLPHWGRDRVTLLGDAAHP

SEQ ID NO: 320821 - protein, 18 aa, Mycobacterium
MVETFGWTTIVDVLIIAY

SEQ ID NO: 320822 - protein, 39 aa, Mycobacterium
MVFGAAPWAGWLAFAATVPVQFVAGWPILKAAAQQARAL

SEQ ID NO: 320823 - protein, 20 aa, Mycobacterium
MVFGELVPKYLAVARPLRTA

SEQ ID NO: 320824 - protein, 26 aa, Mycobacterium
MVFVICVAALLVAQIFVRPIRRLQAG

SEQ ID NO: 320825 - protein, 18 aa, Mycobacterium
MVFVPLLFLLAVALVASI

SEQ ID NO: 320826 - protein, 22 aa, Mycobacterium
MVGALADWFAVTALFKHPLGLP

SEQ ID NO: 320827 - protein, 26 aa, Mycobacterium
MVGALADWFAVTALFRHPLGLKIPHT

SEQ ID NO: 320828 - protein, 28 aa, Mycobacterium
MVGLFPGTPRWVWAVVFVAVNTVINLLG

SEQ ID NO: 320829 - protein, 18 aa, Mycobacterium
MVGLLGQDWRYLGYARRA

SEQ ID NO: 320830 - protein, 19 aa, Mycobacterium
MVGPVWRRDAVIDFNGAVI

SEQ ID NO: 320831 - protein, 26 aa, Mycobacterium
MVHLARIFFTGAFRRPREANWVIGSL

SEQ ID NO: 320832 - protein, 27 aa, Mycobacterium
MVHMARIFFTGAFRRPREANWVIGALL

SEQ ID NO: 320833 - protein, 21 aa, Mycobacterium
MVIAAGFAGMFVGANILSVAA

SEQ ID NO: 320834 - protein, 17 aa, Mycobacterium
MVICTATAFIVLLSGPE

SEQ ID NO: 320835 - protein, 26 aa, Mycobacterium
MVIGGAALALLGMRRYVFARPPLLGP

SEQ ID NO: 320836 - protein, 26 aa, Mycobacterium
MVIGGAALALLGVRRYVFARPPLLGP

SEQ ID NO: 320837 - protein, 31 aa, Mycobacterium
MVIGGAALALLGVRRYVFKRPPLLSPSGQLV

SEQ ID NO: 320838 - protein, 19 aa, Mycobacterium
MVILPPFVYFISYRWSIGL

SEQ ID NO: 320839 - protein, 26 aa, Mycobacterium
MVITSVLCATGFRQAALMWLPAVAVF

SEQ ID NO: 320840 - protein, 22 aa, Mycobacterium
MVKDLRGQRVFERVITGLLMVI

SEQ ID NO: 320841 - protein, 17 aa, Mycobacterium
MVLASIFVTLPFVVREV

SEQ ID NO: 320842 - protein, 17 aa, Mycobacterium
MVLLPAIRRQQIPLRPL

SEQ ID NO: 320843 - protein, 17 aa, Mycobacterium
MVLLSAAVMLFSLAAAT

SEQ ID NO: 320844 - protein, 17 aa, Mycobacterium
MVLMSLVALDILLFYVF

SEQ ID NO: 320845 - protein, 21 aa, Mycobacterium
MVLNLVAGWAGMWDLGVAGLV

SEQ ID NO: 320846 - protein, 30 aa, Mycobacterium
MVLSGPVAFWACGLALCLFIGPTQSSARTL

SEQ ID NO: 320847 - protein, 19 aa, Mycobacterium
MVLVAVAVGAGWLYSLGVT

SEQ ID NO: 320848 - protein, 18 aa, Mycobacterium
MVLVCTLLYRNFRKNGWL

SEQ ID NO: 320849 - protein, 20 aa, Mycobacterium
MVLVPAFMHVMGRWNWWAPK

SEQ ID NO: 320850 - protein, 23 aa, Mycobacterium
MVMPAGGAEPGWEVIDAGDWSVG

SEQ ID NO: 320851 - protein, 19 aa, Mycobacterium
MVNMGGFLASLIVMQAMGV

SEQ ID NO: 320852 - protein, 18 aa, Mycobacterium
MVPDDGFNLLGMSFDNTG

SEQ ID NO: 320853 - protein, 19 aa, Mycobacterium
MVPEGLVLLTSVAFAVGVV

SEQ ID NO: 320854 - protein, 18 aa, Mycobacterium
MVPPPAILANRLQLAELM

SEQ ID NO: 320855 - protein, 28 aa, Mycobacterium
MVPSIAALLGRWFWWPINVRTRPARARP

SEQ ID NO: 320856 - protein, 18 aa, Mycobacterium
MVPTRGSSSYSYSYSYYG

SEQ ID NO: 320857 - protein, 26 aa, Mycobacterium
MVRIFSLPIIVFWVLVAVGLGILTPS

SEQ ID NO: 320858 - protein, 18 aa, Mycobacterium
MVRPIRRLEAGTEKISGG

SEQ ID NO: 320859 - protein, 22 aa, Mycobacterium
MVRPLPRLPRSLPLADALSRMR

SEQ ID NO: 320860 - protein, 43 aa, Mycobacterium
MVRRRKELWLRVANLFAFIAALAGFCLWFGISATMVGLPFAAF

SEQ ID NO: 320861 - protein, 24 aa, Mycobacterium
MVSARPHSHFTYFLPDGNEYQISL

SEQ ID NO: 320862 - protein, 26 aa, Mycobacterium
MVSLACGLERARQLVASWSDRLSIAA

SEQ ID NO: 320863 - protein, 22 aa, Mycobacterium
MVSLAELWRSVGVVPDAVIGHS

SEQ ID NO: 320864 - protein, 24 aa, Mycobacterium
MVSLARTLISYGIEPDAVIGHSQG

SEQ ID NO: 320865 - protein, 17 aa, Mycobacterium
MVSLVYGLSRLAHGPGA

SEQ ID NO: 320866 - protein, 25 aa, Mycobacterium
MVTAPLLYRRFKGWPAQRNQVDAEG

SEQ ID NO: 320867 - protein, 23 aa, Mycobacterium
MVTGLLAINVCRLGEGVNADPGK

SEQ ID NO: 320868 - protein, 25 aa, Mycobacterium
MVTMVGWWALSRVLGRLLGVPDVHK

SEQ ID NO: 320869 - protein, 20 aa, Mycobacterium
MVTVTALRRFLRAHSAITEA

SEQ ID NO: 320870 - protein, 17 aa, Mycobacterium
MVVAAAILAAFFVVELT

SEQ ID NO: 320871 - protein, 18 aa, Mycobacterium
MVVAAIWPGAAGGLAGVL

SEQ ID NO: 320872 - protein, 23 aa, Mycobacterium
MVVGNRHFLAFAAAMTGRYVLSS

SEQ ID NO: 320873 - protein, 20 aa, Mycobacterium
MVVHVIRGDGLAGLSEARMA

SEQ ID NO: 320874 - protein, 20 aa, Mycobacterium
MVVHVIRGDGLAGLSEARMS

SEQ ID NO: 320875 - protein, 28 aa, Mycobacterium
MVVSFSFGEWQQAIAIAIVLLINTAIGY

SEQ ID NO: 320876 - protein, 19 aa, Mycobacterium
MVVSGGWYLVLVELWPAAS

SEQ ID NO: 320877 - protein, 19 aa, Mycobacterium
MVVVLMSFAVYAVISAALY

SEQ ID NO: 320878 - protein, 21 aa, Mycobacterium
MVVVVRFLEPFTVLADLAGAV

SEQ ID NO: 320879 - protein, 17 aa, Mycobacterium
MVVYFRSGVATGRGPAV

SEQ ID NO: 320880 - protein, 19 aa, Mycobacterium
MVWLGEISYEIFLLHVVVM

SEQ ID NO: 320881 - protein, 25 aa, Mycobacterium
MVWLLSDLIGWRGILLLTGASGLLL

SEQ ID NO: 320882 - protein, 27 aa, Mycobacterium
MVYTETKLNSAFSFGGPKCLVKVIQKL

SEQ ID NO: 320883 - protein, 18 aa, Mycobacterium
MVYVRRPVTAPGRSGARA

SEQ ID NO: 320884 - protein, 19 aa, Mycobacterium
MWAALEVAQAAGFVRQHAA

SEQ ID NO: 320885 - protein, 18 aa, Mycobacterium
MWEALRVAAADDFVGAHG

SEQ ID NO: 320886 - protein, 19 aa, Mycobacterium
MWEALRVAAADDFVREHAD

SEQ ID NO: 320887 - protein, 17 aa, Mycobacterium
MWEALRVACADDFVAGH

SEQ ID NO: 320888 - protein, 19 aa, Mycobacterium
MWFLCKAHQVCPVGAVVAT

SEQ ID NO: 320889 - protein, 25 aa, Mycobacterium
MWGGWGWSGWILMSAVMVLFSAALI

SEQ ID NO: 320890 - protein, 19 aa, Mycobacterium
MWGGWILMGAVMVMLSAVL

SEQ ID NO: 320891 - protein, 18 aa, Mycobacterium
MWHRFDVVDRARAQFTVP

SEQ ID NO: 320892 - protein, 24 aa, Mycobacterium
MWIGYRSGWPWLVSFDDAGLDPAF

SEQ ID NO: 320893 - protein, 26 aa, Mycobacterium
MWLGRLRFGGLYALSALGGSVLVYLI

SEQ ID NO: 320894 - protein, 24 aa, Mycobacterium
MWLYGLFNVAAWLFVYFRMPDLTG

SEQ ID NO: 320895 - protein, 19 aa, Mycobacterium
MWRLWRLTRRLIQQRRKNP

SEQ ID NO: 320896 - protein, 24 aa, Mycobacterium
MWSLVWELLCYLFVAAIGLAGLGN

SEQ ID NO: 320897 - protein, 22 aa, Mycobacterium
MWTWNEFLLPLVMVVSDNKRTA

SEQ ID NO: 320898 - protein, 21 aa, Mycobacterium
MWVGYRQRWAWLYRVDWSLLD

SEQ ID NO: 320899 - protein, 18 aa, Mycobacterium
MWVQAATVMSVYEAGSTA

SEQ ID NO: 320900 - protein, 18 aa, Mycobacterium
MWVQAATVMSVYQAGSTA

SEQ ID NO: 320901 - protein, 18 aa, Mycobacterium
MWWEERIDSPGFVRNKVS

SEQ ID NO: 320902 - protein, 22 aa, Mycobacterium
MYATPDFWNLDGLSATGWTLNW

SEQ ID NO: 320903 - protein, 19 aa, Mycobacterium
MYFLIGGFGGGAGRSRAAV

SEQ ID NO: 320904 - protein, 18 aa, Mycobacterium
MYGDAAGLSRAVLNLLDN

SEQ ID NO: 320905 - protein, 45 aa, Mycobacterium
MYKQDVWKRVAVLFAGPAMNFVICLVLIYGIALVWGLPNLHPPTR

SEQ ID NO: 320906 - protein, 17 aa, Mycobacterium
MYLMLGWGLFQIYVLGT

SEQ ID NO: 320907 - protein, 27 aa, Mycobacterium
MYLTQRFMMRWRVWLTRRFIDDWLSDL

SEQ ID NO: 320908 - protein, 23 aa, Mycobacterium
MYMVACFIFFFIGGLMALLMRAE

SEQ ID NO: 320909 - protein, 22 aa, Mycobacterium
MYMVACFVFFFIGGLMALLLRL

SEQ ID NO: 320910 - protein, 23 aa, Mycobacterium
MYMVACYIFFFIGGLMALLIRGE

SEQ ID NO: 320911 - protein, 18 aa, Mycobacterium
MYNYCRDDHPGVLVRGAK

SEQ ID NO: 320912 - protein, 25 aa, Mycobacterium
MYPENLPRVNAHGGPGGAPGCWQQI

SEQ ID NO: 320913 - protein, 17 aa, Mycobacterium
MYSEMFAITAVVCVIAA

SEQ ID NO: 320914 - protein, 17 aa, Mycobacterium
MYSESSMQLRQLLIDNK

SEQ ID NO: 320915 - protein, 27 aa, Mycobacterium
MYTRADCPRYGELKGPSCFTAPELVVR

SEQ ID NO: 320916 - protein, 18 aa, Mycobacterium
NAAATAWKTLKRLVLEGV

SEQ ID NO: 320917 - protein, 20 aa, Mycobacterium
NAAFRYALVRLRDAAEAIGF

SEQ ID NO: 320918 - protein, 20 aa, Mycobacterium
NAAFRYALVRLRDAAEAVAF

SEQ ID NO: 320919 - protein, 20 aa, Mycobacterium
NAAFRYALVRLRDAAESVAL

SEQ ID NO: 320920 - protein, 18 aa, Mycobacterium
NAAFRYALVRMRDAAEAV

SEQ ID NO: 320921 - protein, 19 aa, Mycobacterium
NAAHELRTPLTAMRADLDT

SEQ ID NO: 320922 - protein, 20 aa, Mycobacterium
NAAHELRTPLTAMRADLDTL

SEQ ID NO: 320923 - protein, 29 aa, Mycobacterium
NAALFTSLCSVCIALIYLAYLMVTTPLLL

SEQ ID NO: 320924 - protein, 26 aa, Mycobacterium
NAALGVAFPLCFWVMGVYATLRDLSL

SEQ ID NO: 320925 - protein, 17 aa, Mycobacterium
NAAPFQLAHGWADILGT

SEQ ID NO: 320926 - protein, 26 aa, Mycobacterium
NAARLSVPLLVRRGIDYGIPSIMHGG

SEQ ID NO: 320927 - protein, 25 aa, Mycobacterium
NAARRPEANVSLIWFTVWSSVVHAA

SEQ ID NO: 320928 - protein, 18 aa, Mycobacterium
NACEVMADFARLYPYQVF

SEQ ID NO: 320929 - protein, 23 aa, Mycobacterium
NADALRKAFGWFVLAMSSVILAQ

SEQ ID NO: 320930 - protein, 24 aa, Mycobacterium
NADLRMVLKSAAKLKHLAPDAICV

SEQ ID NO: 320931 - protein, 21 aa, Mycobacterium
NAFALLGLRALFFLVKGLLDR

SEQ ID NO: 320932 - protein, 20 aa, Mycobacterium
NAFGLTWRLDRAALLLWTVG

SEQ ID NO: 320933 - protein, 17 aa, Mycobacterium
NAGCSRTTTGLVVPTGY

SEQ ID NO: 320934 - protein, 26 aa, Mycobacterium
NAGDGVFGLSGWRFMTLMTGVPAIIL

SEQ ID NO: 320935 - protein, 20 aa, Mycobacterium
NAGLSWLLMVSMPALGLANW

SEQ ID NO: 320936 - protein, 24 aa, Mycobacterium
NAGRAPLPVAGWAVRSDPDGTSLE

SEQ ID NO: 320937 - protein, 18 aa, Mycobacterium
NAHPRSGPADILAKLRKR

SEQ ID NO: 320938 - protein, 18 aa, Mycobacterium
NAIALALLAALTFAAFGV

SEQ ID NO: 320939 - protein, 17 aa, Mycobacterium
NAIPEAPALVIPAIAGA

SEQ ID NO: 320940 - protein, 18 aa, Mycobacterium
NAIQPAWDGIKNAISAAW

SEQ ID NO: 320941 - protein, 23 aa, Mycobacterium
NAISAFAAWGAFLFMMSLYLQGE

SEQ ID NO: 320942 - protein, 36 aa, Mycobacterium
NAISAMLIYRLISWLLISAIGWVVFFFVFRTENVAV

SEQ ID NO: 320943 - protein, 25 aa, Mycobacterium
NAKAARLSGLPVQRITTAAYVICSG

SEQ ID NO: 320944 - protein, 23 aa, Mycobacterium
NAKSATYRALAWSQDADTGNEPV

SEQ ID NO: 320945 - protein, 18 aa, Mycobacterium
NALADAREGAVSSAQTER

SEQ ID NO: 320946 - protein, 32 aa, Mycobacterium
NALAGLNLPAWGSLRLALPMGGNGDASFLAGE

SEQ ID NO: 320947 - protein, 17 aa, Mycobacterium
NALFDAFGPKGTDGKPS

SEQ ID NO: 320948 - protein, 18 aa, Mycobacterium
NALFPTYRGSVIDAVANT

SEQ ID NO: 320949 - protein, 23 aa, Mycobacterium
NALGPICAIILITGAGGMFGGVL

SEQ ID NO: 320950 - protein, 18 aa, Mycobacterium
NALLTPLVTLGFDEIGQV

SEQ ID NO: 320951 - protein, 27 aa, Mycobacterium
NALNAWRLALAVSVIFWHSWPLTGRTI

SEQ ID NO: 320952 - protein, 17 aa, Mycobacterium
NALNAWRLILATSVILW

SEQ ID NO: 320953 - protein, 22 aa, Mycobacterium
NALPARGPWQLPPIPAAGEPNT

SEQ ID NO: 320954 - protein, 19 aa, Mycobacterium
NALPGVFYVLLWVGVVAAS

SEQ ID NO: 320955 - protein, 18 aa, Mycobacterium
NALPHFLGSSGVRLLLVT

SEQ ID NO: 320956 - protein, 20 aa, Mycobacterium
NALPNAPPFGAWIDVRVVVW

SEQ ID NO: 320957 - protein, 23 aa, Mycobacterium
NALRYAPDCVVRVNAGRVGDRVL

SEQ ID NO: 320958 - protein, 17 aa, Mycobacterium
NALRYAPNCVVRVNAGR

SEQ ID NO: 320959 - protein, 27 aa, Mycobacterium
NAMFFPEPRCRVVTGVGAFDPGLRRKA

SEQ ID NO: 320960 - protein, 19 aa, Mycobacterium
NAMSSARLAARYPESGGTY

SEQ ID NO: 320961 - protein, 25 aa, Mycobacterium
NANLQRPLLGWALFAVLIGWSAACA

SEQ ID NO: 320962 - protein, 29 aa, Mycobacterium
NANPGLDRRGVAVLLDFGGSGTSITAVDA

SEQ ID NO: 320963 - protein, 24 aa, Mycobacterium
NAPEEPELALARGAALASATAPAL

SEQ ID NO: 320964 - protein, 21 aa, Mycobacterium
NAPLHYERFGPPPVIDGVPFE

SEQ ID NO: 320965 - protein, 25 aa, Mycobacterium
NAPTTRLGSMFGYGVGYAVASLSCT

SEQ ID NO: 320966 - protein, 19 aa, Mycobacterium
NAPVLLCRLTDAWVALVGA

SEQ ID NO: 320967 - protein, 24 aa, Mycobacterium
NAQARLAALSIQIGTVAATGPGVT

SEQ ID NO: 320968 - protein, 23 aa, Mycobacterium
NAQGASEVYGWIEPVARVLVGNP

SEQ ID NO: 320969 - protein, 21 aa, Mycobacterium
NARELREARDLFAGVLQAASE

SEQ ID NO: 320970 - protein, 24 aa, Mycobacterium
NARGEVVSLGFLISLWAGSSAISS

SEQ ID NO: 320971 - protein, 17 aa, Mycobacterium
NARGGGRRDRWIRRAHQ

SEQ ID NO: 320972 - protein, 19 aa, Mycobacterium
NARHAARIIGASSRCHREV

SEQ ID NO: 320973 - protein, 22 aa, Mycobacterium
NARMWRPLIVFLLAVAVVVAVW

SEQ ID NO: 320974 - protein, 19 aa, Mycobacterium
NASALGLDGFIWRQQSYGY

SEQ ID NO: 320975 - protein, 21 aa, Mycobacterium
NASALPFRYTVNGYRGCSHAC

SEQ ID NO: 320976 - protein, 23 aa, Mycobacterium
NASEIPAIISLIFSSAFGLDSAF

SEQ ID NO: 320977 - protein, 22 aa, Mycobacterium
NASGLRSGQFVRASGVEVGKVK

SEQ ID NO: 320978 - protein, 19 aa, Mycobacterium
NASLPVVTVVGLEFGSLLG

SEQ ID NO: 320979 - protein, 20 aa, Mycobacterium
NASPAAGILLSFATFGVGFI

SEQ ID NO: 320980 - protein, 25 aa, Mycobacterium
NATGRWELSFGFLLVPLIALLAGGY

SEQ ID NO: 320981 - protein, 20 aa, Mycobacterium
NATRQFLVDAAHELRTPIAG

SEQ ID NO: 320982 - protein, 20 aa, Mycobacterium
NAVAELRATTVFGNKYVSFT

SEQ ID NO: 320983 - protein, 23 aa, Mycobacterium
NAVARAGGLLAVAVLPGVAGISG

SEQ ID NO: 320984 - protein, 20 aa, Mycobacterium
NAVFRYALVRLRDAGEAVGF

SEQ ID NO: 320985 - protein, 19 aa, Mycobacterium
NAVIAFAVIGFASLAAAIA

SEQ ID NO: 320986 - protein, 19 aa, Mycobacterium
NAVIAFAVIGLASLATAIA

SEQ ID NO: 320987 - protein, 19 aa, Mycobacterium
NAVLPAKLILLAIAVICAV

SEQ ID NO: 320988 - protein, 24 aa, Mycobacterium
NAVLPEQISFLAITTIVGGTVGGY

SEQ ID NO: 320989 - protein, 24 aa, Mycobacterium
NAVLWRIHMVSALMVMPQSMTVTF

SEQ ID NO: 320990 - protein, 17 aa, Mycobacterium
NAVNLKGSGQCYFLQGS

SEQ ID NO: 320991 - protein, 23 aa, Mycobacterium
NAWQMSLHLAVTVAYFAVGLTIL

SEQ ID NO: 320992 - protein, 24 aa, Mycobacterium
NAWRLALAGEVIFWHTFPIRGHLP

SEQ ID NO: 320993 - protein, 17 aa, Mycobacterium
NAYKNAFAQIDVQMRRR

SEQ ID NO: 320994 - protein, 19 aa, Mycobacterium
NAYLWLFAVLLIWLGVRAA

SEQ ID NO: 320995 - protein, 25 aa, Mycobacterium
NCGVAESCWFRWLASGPLDVRRRQV

SEQ ID NO: 320996 - protein, 23 aa, Mycobacterium
NCPFCGGLRMTHDLLHGHLAAAV

SEQ ID NO: 320997 - protein, 21 aa, Mycobacterium
NCPGCGTLRMIYSLLHGDVLA

SEQ ID NO: 320998 - protein, 20 aa, Mycobacterium
NCPLPRPAIGPGTYSLVVQL

SEQ ID NO: 320999 - protein, 21 aa, Mycobacterium
NCRLRVLVLGYSGLLAGIAGF

SEQ ID NO: 321000 - protein, 24 aa, Mycobacterium
NDAEKLLKAIMLQAQVTSKGEIIA

SEQ ID NO: 321001 - protein, 18 aa, Mycobacterium
NDAGFWLVKEYFGMSVGQ

SEQ ID NO: 321002 - protein, 24 aa, Mycobacterium
NDAKARLSALSIMVGTVGATGPGV

SEQ ID NO: 321003 - protein, 28 aa, Mycobacterium
NDFEQLIATPLDRFVGFVEEILQRNGFR

SEQ ID NO: 321004 - protein, 21 aa, Mycobacterium
NDFTGLWHLVGKVGGAPGGAA

SEQ ID NO: 321005 - protein, 23 aa, Mycobacterium
NDFVLGLVFLFAAFWIGLFIWYV

SEQ ID NO: 321006 - protein, 23 aa, Mycobacterium
NDGKEVPANLVGRDPKTDLAVIK

SEQ ID NO: 321007 - protein, 22 aa, Mycobacterium
NDGLALPFVMIFLATAQGAGSE

SEQ ID NO: 321008 - protein, 18 aa, Mycobacterium
NDIFRLSLAGIFLVVVVT

SEQ ID NO: 321009 - protein, 18 aa, Mycobacterium
NDINGWRDWVLGAMVLIV

SEQ ID NO: 321010 - protein, 17 aa, Mycobacterium
NDIRANLRVTLAGDGEV

SEQ ID NO: 321011 - protein, 17 aa, Mycobacterium
NDKLAFTIEARALTFQP

SEQ ID NO: 321012 - protein, 21 aa, Mycobacterium
NDLLHGLLMYSGNDAAHALAM

SEQ ID NO: 321013 - protein, 18 aa, Mycobacterium
NDLNFVWITDFQPYQPQL

SEQ ID NO: 321014 - protein, 17 aa, Mycobacterium
NDLPAPHWTLWRIFAYG

SEQ ID NO: 321015 - protein, 26 aa, Mycobacterium
NDLRLYLDGGLQFSTRDEYRYTESLV

SEQ ID NO: 321016 - protein, 26 aa, Mycobacterium
NDMRLYLDGGLQFSTRDEYRYTESLV

SEQ ID NO: 321017 - protein, 17 aa, Mycobacterium
NDNWRWLLATSAILGVI

SEQ ID NO: 321018 - protein, 18 aa, Mycobacterium
NDPRWILPETDPLGRHPW

SEQ ID NO: 321019 - protein, 18 aa, Mycobacterium
NDQFKAGAYIAAGLVLFI

SEQ ID NO: 321020 - protein, 21 aa, Mycobacterium
NDRFGWPLVAGYLFDPQILEG

SEQ ID NO: 321021 - protein, 22 aa, Mycobacterium
NDSGFWLVNRFFNMDVKTTLKT

SEQ ID NO: 321022 - protein, 25 aa, Mycobacterium
NDSGFWLVSRFFGMDVKTTLKTWTL

SEQ ID NO: 321023 - protein, 18 aa, Mycobacterium
NDSMELIELVTFGVIMVM

SEQ ID NO: 321024 - protein, 19 aa, Mycobacterium
NDVDFVWITDFQQYQPQLD

SEQ ID NO: 321025 - protein, 19 aa, Mycobacterium
NDVGWSFAEVILVAVVVMT

SEQ ID NO: 321026 - protein, 19 aa, Mycobacterium
NDVLNAWAMSVLLWGVLIA

SEQ ID NO: 321027 - protein, 21 aa, Mycobacterium
NDVLNAWAMSVVLWGILIAVF

SEQ ID NO: 321028 - protein, 20 aa, Mycobacterium
NDVLNAWAMSVVLWGVLIAV

SEQ ID NO: 321029 - protein, 17 aa, Mycobacterium
NDYAKIGVLLGEAHAAA

SEQ ID NO: 321030 - protein, 21 aa, Mycobacterium
NDYQIDWERSALVSGMMPATF

SEQ ID NO: 321031 - protein, 31 aa, Mycobacterium
NDYRPNMFVTYWSFRAMIGFLAIPLLFAVAA

SEQ ID NO: 321032 - protein, 21 aa, Mycobacterium
NEALAVPIWWAYAAAEILITA

SEQ ID NO: 321033 - protein, 17 aa, Mycobacterium
NEARWVRGAVPFEGDIG

SEQ ID NO: 321034 - protein, 17 aa, Mycobacterium
NEDCSFADLGIDSLALA

SEQ ID NO: 321035 - protein, 22 aa, Mycobacterium
NEDRIVSWVGWLRAPDAAAETV

SEQ ID NO: 321036 - protein, 23 aa, Mycobacterium
NEGAQIWAGVGLVLGPLLIAFSF

SEQ ID NO: 321037 - protein, 19 aa, Mycobacterium
NEHLPLLQPLRGIVPDSVL

SEQ ID NO: 321038 - protein, 22 aa, Mycobacterium
NEIDRLTGLLNREAFEIQAATM

SEQ ID NO: 321039 - protein, 21 aa, Mycobacterium
NEILETVALLLHIGVMLAFLI

SEQ ID NO: 321040 - protein, 21 aa, Mycobacterium
NEIPVLVLPAGKRIEFELNSA

SEQ ID NO: 321041 - protein, 18 aa, Mycobacterium
NELKRFGDRVIIRTDDQS

SEQ ID NO: 321042 - protein, 21 aa, Mycobacterium
NELPDCIVVSVSHRPALERLH

SEQ ID NO: 321043 - protein, 33 aa, Mycobacterium
NELPRGEIGRIFVGNFFPFEGYTGGGGKQIIDG

SEQ ID NO: 321044 - protein, 26 aa, Mycobacterium
NELQAFDVFSSFWFTAVYVLLFVSLV

SEQ ID NO: 321045 - protein, 20 aa, Mycobacterium
NELSTVFLILGISAPVSGII

SEQ ID NO: 321046 - protein, 25 aa, Mycobacterium
NENYIWKARTLGVGYLDLTGCMALG

SEQ ID NO: 321047 - protein, 20 aa, Mycobacterium
NEPGQILVLLNVGAVFMGTA

SEQ ID NO: 321048 - protein, 25 aa, Mycobacterium
NEPICPPCGAFIRSYASDIDAAVAN

SEQ ID NO: 321049 - protein, 23 aa, Mycobacterium
NEPLPKFADAWFRRYNQGDDVCH

SEQ ID NO: 321050 - protein, 25 aa, Mycobacterium
NEPLQKRFSAMTVIGPDDKTDQWQA

SEQ ID NO: 321051 - protein, 19 aa, Mycobacterium
NEPVLRRSVLTVYGHAAPQ

SEQ ID NO: 321052 - protein, 24 aa, Mycobacterium
NEQIMPLLVVSLMGQMVLSGGMVP

SEQ ID NO: 321053 - protein, 22 aa, Mycobacterium
NEQIMPLLVVSLMLQLVLAGGV

SEQ ID NO: 321054 - protein, 22 aa, Mycobacterium
NEQIMPLLVVSLMLQLVLCGGM

SEQ ID NO: 321055 - protein, 23 aa, Mycobacterium
NERAEPGFVRRVLSSALPSGLIV

SEQ ID NO: 321056 - protein, 22 aa, Mycobacterium
NERAKTGFVRRVMTAALPSGLV

SEQ ID NO: 321057 - protein, 23 aa, Mycobacterium
NERAYPGFVRRVLSSALPSGLIV

SEQ ID NO: 321058 - protein, 23 aa, Mycobacterium
NERAYPGFVRRVLTSALPSGLVV

SEQ ID NO: 321059 - protein, 22 aa, Mycobacterium
NERELRAVLGHELSHVYNRDIL

SEQ ID NO: 321060 - protein, 23 aa, Mycobacterium
NERLNAMFRYALVRLRDTSESVA

SEQ ID NO: 321061 - protein, 17 aa, Mycobacterium
NERLVGLVLGFGAGALI

SEQ ID NO: 321062 - protein, 23 aa, Mycobacterium
NERYWRCADFAQALSQVASPQGA

SEQ ID NO: 321063 - protein, 17 aa, Mycobacterium
NESPCTVNSFASLAQQG

SEQ ID NO: 321064 - protein, 24 aa, Mycobacterium
NESPCTVNSFASLIGQKYFDNTKC

SEQ ID NO: 321065 - protein, 24 aa, Mycobacterium
NESPCTVNSFASLVGQKYFDNTKC

SEQ ID NO: 321066 - protein, 27 aa, Mycobacterium
NETGYRLRVKMAFAEGQYRISKLDQVT

SEQ ID NO: 321067 - protein, 25 aa, Mycobacterium
NETGYRLRVKMAMAEGQYKISKLDQ

SEQ ID NO: 321068 - protein, 22 aa, Mycobacterium
NETRGEWYLRQLLGSANIEGGR

SEQ ID NO: 321069 - protein, 25 aa, Mycobacterium
NEVLAMGLDAWRWMFLAMAVPAVLY

SEQ ID NO: 321070 - protein, 28 aa, Mycobacterium
NFADPPPGWRLLNLDAVRPFATGAGITV

SEQ ID NO: 321071 - protein, 27 aa, Mycobacterium
NFAPNIGWRLAFGVGAIFGIFVLLVRR

SEQ ID NO: 321072 - protein, 22 aa, Mycobacterium
NFASILPLRCRLGDNPTFAELV

SEQ ID NO: 321073 - protein, 17 aa, Mycobacterium
NFAWLNWVTILLACSAI

SEQ ID NO: 321074 - protein, 31 aa, Mycobacterium
NFGVPWSNSFPEWKFGFTTMLLGLSVLALLA

SEQ ID NO: 321075 - protein, 31 aa, Mycobacterium
NFGVPWSNSFPRLRWSLTTALLELSVIVLVV

SEQ ID NO: 321076 - protein, 28 aa, Mycobacterium
NFHFMPELDAWWGYPAVIGTMAIICLIL

SEQ ID NO: 321077 - protein, 26 aa, Mycobacterium
NFHFMPELNWTWGYPGVMAAMTLTCL

SEQ ID NO: 321078 - protein, 21 aa, Mycobacterium
NFHNLYWPAEYLIDANGQVRH

SEQ ID NO: 321079 - protein, 19 aa, Mycobacterium
NFLGLPLNFLFFAVLAVCT

SEQ ID NO: 321080 - protein, 18 aa, Mycobacterium
NFLGLYLGWEGVGLASYL

SEQ ID NO: 321081 - protein, 19 aa, Mycobacterium
NFLILLIPFSLPRTFGRMV

SEQ ID NO: 321082 - protein, 17 aa, Mycobacterium
NFPDTSFAWAFVLALLA

SEQ ID NO: 321083 - protein, 23 aa, Mycobacterium
NFPPPGMPPMPPWPPPPPPPPPP

SEQ ID NO: 321084 - protein, 28 aa, Mycobacterium
NFRAPGVILRQVLTWVLSTGVPLLAIIL

SEQ ID NO: 321085 - protein, 28 aa, Mycobacterium
NFRAPGVILRQVLTWVLSTGVPVLAIVL

SEQ ID NO: 321086 - protein, 21 aa, Mycobacterium
NFRDVVAALGMYPGEAPPLGA

SEQ ID NO: 321087 - protein, 17 aa, Mycobacterium
NFRNVGVDLCWDEPDLR

SEQ ID NO: 321088 - protein, 18 aa, Mycobacterium
NFSPYMLMMPMMVVMGAV

SEQ ID NO: 321089 - protein, 24 aa, Mycobacterium
NFTRSAGLQRLRLLEGSYGVVVNV

SEQ ID NO: 321090 - protein, 30 aa, Mycobacterium
NFVMGCLLFGMAFVCLVGLLQSVASVDLRF

SEQ ID NO: 321091 - protein, 17 aa, Mycobacterium
NFVVRVVRRGHRQQVWL

SEQ ID NO: 321092 - protein, 18 aa, Mycobacterium
NFVWPWVGGAFTLLTGLV

SEQ ID NO: 321093 - protein, 17 aa, Mycobacterium
NFWAVAAALSLGVAAAV

SEQ ID NO: 321094 - protein, 23 aa, Mycobacterium
NGAFFSQFMGWIMRPLGHTANEW

SEQ ID NO: 321095 - protein, 18 aa, Mycobacterium
NGAFLVAVCLANIVGAPV

SEQ ID NO: 321096 - protein, 23 aa, Mycobacterium
NGAKIWIQFHGFSIQPAEFSKIL

SEQ ID NO: 321097 - protein, 18 aa, Mycobacterium
NGALTERIIEFARTQQAL

SEQ ID NO: 321098 - protein, 20 aa, Mycobacterium
NGAVRARFLTDRLIFDSQYT

SEQ ID NO: 321099 - protein, 37 aa, Mycobacterium
NGCVLLAEMLFLRWLLDGRIGRQWWAGVAIGLTLTLK

SEQ ID NO: 321100 - protein, 18 aa, Mycobacterium
NGDKLAFTIEARALTFQP

SEQ ID NO: 321101 - protein, 22 aa, Mycobacterium
NGEASWRPAVDANRIALIGVIT

SEQ ID NO: 321102 - protein, 25 aa, Mycobacterium
NGEYMGADGKLYRQANLVGNAKSWQ

SEQ ID NO: 321103 - protein, 26 aa, Mycobacterium
NGFFREIVTRSGFDDALLLDTRGNVV

SEQ ID NO: 321104 - protein, 19 aa, Mycobacterium
NGFGTPLVMHVMYGVKIAL

SEQ ID NO: 321105 - protein, 30 aa, Mycobacterium
NGFSELAVGFPVLFLTAAAIAEYVVVTRVV

SEQ ID NO: 321106 - protein, 27 aa, Mycobacterium
NGFVAAFVCGIAFNYFRRSEQFHTELE

SEQ ID NO: 321107 - protein, 21 aa, Mycobacterium
NGGIVASMGWICRVISPMIDS

SEQ ID NO: 321108 - protein, 26 aa, Mycobacterium
NGGKLPPTVCRQNPDLPRDQPQLSAM

SEQ ID NO: 321109 - protein, 28 aa, Mycobacterium
NGGPILWQHLFWFFGHPEVYIVALPFFG

SEQ ID NO: 321110 - protein, 28 aa, Mycobacterium
NGGTMLWEHLFWFFGHPEVYIIALPFFG

SEQ ID NO: 321111 - protein, 17 aa, Mycobacterium
NGIGVGFISWVVLALAR

SEQ ID NO: 321112 - protein, 24 aa, Mycobacterium
NGIGVGFVAWVVLRSAAGKFREIS

SEQ ID NO: 321113 - protein, 23 aa, Mycobacterium
NGIPRMKVPVWSLLIIGVAALAV

SEQ ID NO: 321114 - protein, 17 aa, Mycobacterium
NGIRLGDKVRIVDENFT

SEQ ID NO: 321115 - protein, 24 aa, Mycobacterium
NGKKAVLFTSDWTPRYHGETIYLA

SEQ ID NO: 321116 - protein, 24 aa, Mycobacterium
NGKKAVLWTSGWTPRYAGETIFLA

SEQ ID NO: 321117 - protein, 27 aa, Mycobacterium
NGKPWLVFGPYAGWSPKFLKHGHFTDL

SEQ ID NO: 321118 - protein, 20 aa, Mycobacterium
NGLAGLNLPGWGSLRLALPM

SEQ ID NO: 321119 - protein, 30 aa, Mycobacterium
NGLAVMVMVPFALRLRRQMPAGYTIVEFIR

SEQ ID NO: 321120 - protein, 22 aa, Mycobacterium
NGLFGLLVAWVLVRDNFPGKRI

SEQ ID NO: 321121 - protein, 21 aa, Mycobacterium
NGLFGRLAFLFVGPVVAFPAF

SEQ ID NO: 321122 - protein, 22 aa, Mycobacterium
NGLGGYFFRYLFSNPIPYARAG

SEQ ID NO: 321123 - protein, 23 aa, Mycobacterium
NGLKTVLLLGGMSAMIVFIGSLF

SEQ ID NO: 321124 - protein, 17 aa, Mycobacterium
NGLLDVGGASLIANMTA

SEQ ID NO: 321125 - protein, 18 aa, Mycobacterium
NGLLLAMVDTVTMNRETA

SEQ ID NO: 321126 - protein, 24 aa, Mycobacterium
NGMFLVLVGLLWPHLNLPHAWQVV

SEQ ID NO: 321127 - protein, 20 aa, Mycobacterium
NGMSLLIFAGIAARIPAEGK

SEQ ID NO: 321128 - protein, 20 aa, Mycobacterium
NGMSLLIFAGIAARIPAEGQ

SEQ ID NO: 321129 - protein, 25 aa, Mycobacterium
NGNAWPVGRLMAWLTGCVVLVFTSS

SEQ ID NO: 321130 - protein, 31 aa, Mycobacterium
NGPEVLNLLLIDFKGGATFLDLAQAPHVAAV

SEQ ID NO: 321131 - protein, 18 aa, Mycobacterium
NGPRMPMVPGSWDSPQEG

SEQ ID NO: 321132 - protein, 17 aa, Mycobacterium
NGPSLSAYQDWSDEINR

SEQ ID NO: 321133 - protein, 17 aa, Mycobacterium
NGQPNFVHINLKPQYAK

SEQ ID NO: 321134 - protein, 29 aa, Mycobacterium
NGSDVFGRGGPYLARGAADLVIPSQLLDE

SEQ ID NO: 321135 - protein, 18 aa, Mycobacterium
NGSEVFERGGPYLTRGAA

SEQ ID NO: 321136 - protein, 23 aa, Mycobacterium
NGSGPRFTAPMSKNGVPYGGILL

SEQ ID NO: 321137 - protein, 31 aa, Mycobacterium
NGSHRRLLLRITRWDVVLAMAVAGTVNAAML

SEQ ID NO: 321138 - protein, 22 aa, Mycobacterium
NGSRARLPFDLKPETTPVMGSY

SEQ ID NO: 321139 - protein, 20 aa, Mycobacterium
NGSWGKVIDMLAIFATLFGS

SEQ ID NO: 321140 - protein, 23 aa, Mycobacterium
NGTLRTAGQWVVFIAQTVWLLPT

SEQ ID NO: 321141 - protein, 20 aa, Mycobacterium
NGVAAFLNWVHLPGVGDALK

SEQ ID NO: 321142 - protein, 18 aa, Mycobacterium
NGVGFLAGALVGYLLLRR

SEQ ID NO: 321143 - protein, 17 aa, Mycobacterium
NGVPIGRLASIDVVEVD

SEQ ID NO: 321144 - protein, 29 aa, Mycobacterium
NGVTSVSIPSWWQPYVLSVGAVDSTGQPS

SEQ ID NO: 321145 - protein, 17 aa, Mycobacterium
NGVVLKFAMHSMNSTFA

SEQ ID NO: 321146 - protein, 18 aa, Mycobacterium
NGVVLKFAMRTMNDTFAS

SEQ ID NO: 321147 - protein, 22 aa, Mycobacterium
NGWHAVAGLALFAPGLVCATRK

SEQ ID NO: 321148 - protein, 21 aa, Mycobacterium
NGWHAVAGLALFAPGLVFAMR

SEQ ID NO: 321149 - protein, 17 aa, Mycobacterium
NGYDFGYFSLVVPKGSP

SEQ ID NO: 321150 - protein, 22 aa, Mycobacterium
NGYLLRFGADADRAGLRADITS

SEQ ID NO: 321151 - protein, 23 aa, Mycobacterium
NHDGGQRWRQWWASHPGLGLTLL

SEQ ID NO: 321152 - protein, 21 aa, Mycobacterium
NHFGILIGFAIMFVIAGMTTM

SEQ ID NO: 321153 - protein, 38 aa, Mycobacterium
NHRGIPVFIALGVLSMLLAGGFAWLFAGRAVRPLHQLT

SEQ ID NO: 321154 - protein, 17 aa, Mycobacterium
NHRWFLVSLYGAARVGA

SEQ ID NO: 321155 - protein, 27 aa, Mycobacterium
NHVFGSRLRRGWQFIGLIIVGAAFAYA

SEQ ID NO: 321156 - protein, 24 aa, Mycobacterium
NIAEHRCTIAFIAPPVAVALAKHP

SEQ ID NO: 321157 - protein, 18 aa, Mycobacterium
NIDWAYAGGPAWTWTAAK

SEQ ID NO: 321158 - protein, 20 aa, Mycobacterium
NIEAPGVYPALVNVNGTPDY

SEQ ID NO: 321159 - protein, 22 aa, Mycobacterium
NIEPALRFYVVFFLALLFVTWH

SEQ ID NO: 321160 - protein, 17 aa, Mycobacterium
NIERRIGLFDTWPGLIL

SEQ ID NO: 321161 - protein, 26 aa, Mycobacterium
NIFGLSFPRAMFWTVLIYVLVATIIS

SEQ ID NO: 321162 - protein, 17 aa, Mycobacterium
NIGDWLGYFLLLASFMV

SEQ ID NO: 321163 - protein, 19 aa, Mycobacterium
NIGEGLVILAAIAFGTALP

SEQ ID NO: 321164 - protein, 19 aa, Mycobacterium
NIGQGWWGLGFKFIGENIP

SEQ ID NO: 321165 - protein, 23 aa, Mycobacterium
NIIVRFNLLFIFIALFAVASVTA

SEQ ID NO: 321166 - protein, 22 aa, Mycobacterium
NIKAVRTVRFWAAPLVITLALM

SEQ ID NO: 321167 - protein, 19 aa, Mycobacterium
NILDSRGGMVFTLVCVAAL

SEQ ID NO: 321168 - protein, 18 aa, Mycobacterium
NILPGSPPAGAWIDQAIV

SEQ ID NO: 321169 - protein, 19 aa, Mycobacterium
NINPILSCGSVMMTPQASL

SEQ ID NO: 321170 - protein, 25 aa, Mycobacterium
NIPANRKRVAVVSFPRDLAIQPTLC

SEQ ID NO: 321171 - protein, 28 aa, Mycobacterium
NIPANRKRVVAVSFPRDLAITPIQCEAW

SEQ ID NO: 321172 - protein, 20 aa, Mycobacterium
NIPAWLLLVALVILVAGGAV

SEQ ID NO: 321173 - protein, 35 aa, Mycobacterium
NIPGLGELWGRSVFHCPFCHGWEVRDAPLAVIARG

SEQ ID NO: 321174 - protein, 28 aa, Mycobacterium
NIPVLLFCIAFGLAMDYEVFLVSRIHEY

SEQ ID NO: 321175 - protein, 26 aa, Mycobacterium
NIPVLLFCIAFGLATDYEVFLVSRIH

SEQ ID NO: 321176 - protein, 40 aa, Mycobacterium
NIPVLMFCIAFGLSMDYEVFLLARIREYWLQSPRARADND

SEQ ID NO: 321177 - protein, 40 aa, Mycobacterium
NIPVLMFCIAFGLSMDYEVFLLSRIREFWLGSPQQSADND

SEQ ID NO: 321178 - protein, 21 aa, Mycobacterium
NIPYPGFGHVSGFIVSTSVIV

SEQ ID NO: 321179 - protein, 17 aa, Mycobacterium
NIRLPKLTRATVVIGSL

SEQ ID NO: 321180 - protein, 20 aa, Mycobacterium
NIRVAMLLAAAWLAVLASPL

SEQ ID NO: 321181 - protein, 25 aa, Mycobacterium
NISADRPRRIWGIYAGVIGVPLSAV

SEQ ID NO: 321182 - protein, 22 aa, Mycobacterium
NISAKAGLWGLLALLVGLVSWL

SEQ ID NO: 321183 - protein, 18 aa, Mycobacterium
NIVAAVLCHRLVELLGVA

SEQ ID NO: 321184 - protein, 19 aa, Mycobacterium
NIVAAVLCHRLVELVGVAL

SEQ ID NO: 321185 - protein, 22 aa, Mycobacterium
NIVAAVLCHRLVVLIGVAMIVW

SEQ ID NO: 321186 - protein, 21 aa, Mycobacterium
NIVAAVLFHRLVVLIGVALIV

SEQ ID NO: 321187 - protein, 23 aa, Mycobacterium
NIVEVLETLMGFGPPAEGDELLV

SEQ ID NO: 321188 - protein, 25 aa, Mycobacterium
NIVHSARVPARWAARKDGPPILLLD

SEQ ID NO: 321189 - protein, 25 aa, Mycobacterium
NKALWALGVFLVLAGIYIAVRYERY

SEQ ID NO: 321190 - protein, 17 aa, Mycobacterium
NKAVARRNMAWSIATDH

SEQ ID NO: 321191 - protein, 17 aa, Mycobacterium
NKHFPFVISTMLANNPF

SEQ ID NO: 321192 - protein, 25 aa, Mycobacterium
NKHWQRLKGVAVVSVPGQEPVTVDH

SEQ ID NO: 321193 - protein, 23 aa, Mycobacterium
NKIGPWAPWLGVLVYAIGVLLFL

SEQ ID NO: 321194 - protein, 25 aa, Mycobacterium
NKLQAFDVFSSFWFTAIYVLLFVSL

SEQ ID NO: 321195 - protein, 22 aa, Mycobacterium
NKPSMPYRLRVIVHEDDQGRMT

SEQ ID NO: 321196 - protein, 22 aa, Mycobacterium
NKPSMPYRLRVIVHEDDTGRMT

SEQ ID NO: 321197 - protein, 21 aa, Mycobacterium
NKTREAWGQGVANVVTGFFGG

SEQ ID NO: 321198 - protein, 20 aa, Mycobacterium
NKTWLGFIAIAVIGALVGGM

SEQ ID NO: 321199 - protein, 29 aa, Mycobacterium
NLAAGWWSFLSILLMNWIAIFGNMGQINQ

SEQ ID NO: 321200 - protein, 25 aa, Mycobacterium
NLAAVKDMFAWIGPVLAALQGNPVC

SEQ ID NO: 321201 - protein, 24 aa, Mycobacterium
NLADRIGRRRVMLLSVSLMAVTTL

SEQ ID NO: 321202 - protein, 25 aa, Mycobacterium
NLAKAGGNVNLWTGIALTVVAAACV

SEQ ID NO: 321203 - protein, 19 aa, Mycobacterium
NLALAMPLTLIGALGGLGL

SEQ ID NO: 321204 - protein, 23 aa, Mycobacterium
NLAMGVVFGYVWHRTGRLWPLVV

SEQ ID NO: 321205 - protein, 26 aa, Mycobacterium
NLDASLRWVDVVGMSMLAGIGFTVSL

SEQ ID NO: 321206 - protein, 25 aa, Mycobacterium
NLDFFCAVIIAGLLAGLAGLSTTVV

SEQ ID NO: 321207 - protein, 23 aa, Mycobacterium
NLERSRVGRAWIAIREDEDAAEV

SEQ ID NO: 321208 - protein, 21 aa, Mycobacterium
NLERSRVGRAWIAVREDEDAA

SEQ ID NO: 321209 - protein, 23 aa, Mycobacterium
NLERSRVGRSWVAIREDEDAAEM

SEQ ID NO: 321210 - protein, 24 aa, Mycobacterium
NLFDRICRVGRSLRVHLLLATQSL

SEQ ID NO: 321211 - protein, 27 aa, Mycobacterium
NLFGVELWERFSFYGMLTILGYYLYYT

SEQ ID NO: 321212 - protein, 25 aa, Mycobacterium
NLFPRKVSFLPGMRYYAGNWDTTLW

SEQ ID NO: 321213 - protein, 18 aa, Mycobacterium
NLFTLLAIIPFVGELLVL

SEQ ID NO: 321214 - protein, 18 aa, Mycobacterium
NLFVFLMIMASFRVPRED

SEQ ID NO: 321215 - protein, 27 aa, Mycobacterium
NLGDRWGRRRLMLWGATLFAAASVLAA

SEQ ID NO: 321216 - protein, 19 aa, Mycobacterium
NLGGWAIPVATDIAFALAV

SEQ ID NO: 321217 - protein, 19 aa, Mycobacterium
NLGHGGIDFGVAFYGAPAV

SEQ ID NO: 321218 - protein, 21 aa, Mycobacterium
NLGNMHAMLTFTPSSTYTRAD

SEQ ID NO: 321219 - protein, 18 aa, Mycobacterium
NLGPEVLVANGITLIDSI

SEQ ID NO: 321220 - protein, 20 aa, Mycobacterium
NLGPEVLVGNGIVLIDEAGP

SEQ ID NO: 321221 - protein, 27 aa, Mycobacterium
NLGQTARLYIRPVIHAMAAQPPTEDGQ

SEQ ID NO: 321222 - protein, 26 aa, Mycobacterium
NLGQTARLYIRPVLNSMPAQAVQPKP

SEQ ID NO: 321223 - protein, 27 aa, Mycobacterium
NLHDELFDACGWRRLIFATPEELEATL

SEQ ID NO: 321224 - protein, 24 aa, Mycobacterium
NLHELTRGLNLSAFVLFSSMAGII

SEQ ID NO: 321225 - protein, 35 aa, Mycobacterium
NLHKLEPLLRLPLALGLIYLLGRIPLPGSVARPVW

SEQ ID NO: 321226 - protein, 18 aa, Mycobacterium
NLIAALVLEATFTAIFVP

SEQ ID NO: 321227 - protein, 24 aa, Mycobacterium
NLIACSLVPLFAVTAVQISRIGTS

SEQ ID NO: 321228 - protein, 29 aa, Mycobacterium
NLIATVVRFVLLRGWVFHPARTRRPSQAP

SEQ ID NO: 321229 - protein, 25 aa, Mycobacterium
NLISPLWFAIRAYRQMKTQDGTGCI

SEQ ID NO: 321230 - protein, 24 aa, Mycobacterium
NLKEYWASRALRIFPGLWICLMVI

SEQ ID NO: 321231 - protein, 27 aa, Mycobacterium
NLKWSKARGGVEFGAGHYPVMVVLHTA

SEQ ID NO: 321232 - protein, 28 aa, Mycobacterium
NLLATVVRFVLLRGWVFHPRRTTTGGTT

SEQ ID NO: 321233 - protein, 20 aa, Mycobacterium
NLLLVFGVSFEFPLLIVMLN

SEQ ID NO: 321234 - protein, 25 aa, Mycobacterium
NLLQMAFRFWAFRRWVFPDEFARNP

SEQ ID NO: 321235 - protein, 26 aa, Mycobacterium
NLLQMAFRFWAFRRWVFPDEFARNPD

SEQ ID NO: 321236 - protein, 26 aa, Mycobacterium
NLLQMAFRFWAFRRWVFPDEFARNPE

SEQ ID NO: 321237 - protein, 26 aa, Mycobacterium
NLLQMAFRFWAFRRWVFPDQFARTPD

SEQ ID NO: 321238 - protein, 30 aa, Mycobacterium
NLLRKVPPRKLGYRLAWLYNVLFIVAVYGV

SEQ ID NO: 321239 - protein, 25 aa, Mycobacterium
NLLRTPELYGWVLAALGGMIFQQSA

SEQ ID NO: 321240 - protein, 25 aa, Mycobacterium
NLLTICLLGKWAFAALKDYHRQFAQ

SEQ ID NO: 321241 - protein, 18 aa, Mycobacterium
NLMQGVLIGLVLAIALTA

SEQ ID NO: 321242 - protein, 22 aa, Mycobacterium
NLNRYGLAAARGLDDIGQMAWF

SEQ ID NO: 321243 - protein, 29 aa, Mycobacterium
NLPADFLTRGGFNFAGWLATVSLGALWQI

SEQ ID NO: 321244 - protein, 22 aa, Mycobacterium
NLPAVLMLLPLVAAAGPGAVLA

SEQ ID NO: 321245 - protein, 21 aa, Mycobacterium
NLPDQRRFVLVSTTHSVSSQR

SEQ ID NO: 321246 - protein, 28 aa, Mycobacterium
NLPLLFVGVGLLWFGWFGFNAGSALAAN

SEQ ID NO: 321247 - protein, 22 aa, Mycobacterium
NLPPLCTTGFLPAQQHRVPEVD

SEQ ID NO: 321248 - protein, 21 aa, Mycobacterium
NLPRTNARGGPGGRPGCWQTI

SEQ ID NO: 321249 - protein, 20 aa, Mycobacterium
NLPRVNARGGPGGKPGCWQP

SEQ ID NO: 321250 - protein, 35 aa, Mycobacterium
NLPRVNARGGPGGRPGCWQTITRDLWPAPYLVMDV

SEQ ID NO: 321251 - protein, 32 aa, Mycobacterium
NLPTIIYSLYWKRFNTRGALWSMYGGLISTIV

SEQ ID NO: 321252 - protein, 32 aa, Mycobacterium
NLPTIVYSLYWKRFNTRGALWSMYGGLISTIV

SEQ ID NO: 321253 - protein, 28 aa, Mycobacterium
NLPVLLFCIAFGLSMDYEVFLVSRIREF

SEQ ID NO: 321254 - protein, 19 aa, Mycobacterium
NLQELRENWSLSGRALGMG

SEQ ID NO: 321255 - protein, 23 aa, Mycobacterium
NLRENLRPPFGVVPFAGVLDTSA

SEQ ID NO: 321256 - protein, 18 aa, Mycobacterium
NLRGKWRVSPGVAATGHF

SEQ ID NO: 321257 - protein, 26 aa, Mycobacterium
NLRLPRMTRATVIVGTLIVVLALVAA

SEQ ID NO: 321258 - protein, 29 aa, Mycobacterium
NLRMTCGPLRWLIATPQFHHWHHARQPQA

SEQ ID NO: 321259 - protein, 29 aa, Mycobacterium
NLRTPGVILRLMLAWVLSTAVPLLAIVLA

SEQ ID NO: 321260 - protein, 26 aa, Mycobacterium
NLSSWLAYAAIAVWCVTAIVGAVTAR

SEQ ID NO: 321261 - protein, 25 aa, Mycobacterium
NLTPRAVIAFVVIGLFVVCFLAAGV

SEQ ID NO: 321262 - protein, 24 aa, Mycobacterium
NLTPRWPLPVLESALLLVLVILNP

SEQ ID NO: 321263 - protein, 18 aa, Mycobacterium
NLTRTRVILFATTGLLSA

SEQ ID NO: 321264 - protein, 24 aa, Mycobacterium
NLTSHGGFMPLGFGAITVGIVTVI

SEQ ID NO: 321265 - protein, 17 aa, Mycobacterium
NLTVYGFSKVTQVQVDS

SEQ ID NO: 321266 - protein, 28 aa, Mycobacterium
NLVAARVGRPPVTRRAILTLVAGQAPQV

SEQ ID NO: 321267 - protein, 29 aa, Mycobacterium
NLVLNGAWSWLFFRFHKLGASALGAAVLA

SEQ ID NO: 321268 - protein, 24 aa, Mycobacterium
NLVTWWTGDALLVFNTGKLTQRYT

SEQ ID NO: 321269 - protein, 23 aa, Mycobacterium
NLWRLVLAVEVIFWHSFPVTGHR

SEQ ID NO: 321270 - protein, 21 aa, Mycobacterium
NLYPRMVSFLPGMRYYAGNWD

SEQ ID NO: 321271 - protein, 23 aa, Mycobacterium
NLYSCSLAALSIGVRMTRWKVTL

SEQ ID NO: 321272 - protein, 20 aa, Mycobacterium
NMAGAPWLVYYARALGADIG

SEQ ID NO: 321273 - protein, 20 aa, Mycobacterium
NMAGAPWLVYYARALGNRVG

SEQ ID NO: 321274 - protein, 21 aa, Mycobacterium
NMEWIPVVTFLQVSADMAVAV

SEQ ID NO: 321275 - protein, 25 aa, Mycobacterium
NMFPEKISFLPAMRYYAGNWATSVW

SEQ ID NO: 321276 - protein, 25 aa, Mycobacterium
NMFPKKISFLPAMRYYAGNWASSVW

SEQ ID NO: 321277 - protein, 26 aa, Mycobacterium
NMGYLKARVADMYTMIDELQHMIDIA

SEQ ID NO: 321278 - protein, 22 aa, Mycobacterium
NMKGPGLSRGLIIGAVVLVLVV

SEQ ID NO: 321279 - protein, 25 aa, Mycobacterium
NMLNPGLVVLGGFLRVFPAFAAAVL

SEQ ID NO: 321280 - protein, 24 aa, Mycobacterium
NMQFMKARMDDMLIQVKAMDVSIA

SEQ ID NO: 321281 - protein, 24 aa, Mycobacterium
NMQFMKARMDDMLIQVQAMNVTID

SEQ ID NO: 321282 - protein, 19 aa, Mycobacterium
NMRINLSFTPTYSYTRADC

SEQ ID NO: 321283 - protein, 21 aa, Mycobacterium
NMTGNVIFLGFWFVPHSGVDL

SEQ ID NO: 321284 - protein, 24 aa, Mycobacterium
NMTTGEFRKSIVVQRNTADEKSPV

SEQ ID NO: 321285 - protein, 25 aa, Mycobacterium
NNARDFLRIDVIIFGLVVYALLGIV

SEQ ID NO: 321286 - protein, 30 aa, Mycobacterium
NNARDRWSTWWSSHVGLGLSLLAGAAALVL

SEQ ID NO: 321287 - protein, 26 aa, Mycobacterium
NNERAHPGFVRRVMTAALPSGVVVGI

SEQ ID NO: 321288 - protein, 26 aa, Mycobacterium
NNGLRPEPIIALGILLTWCSVERGVA

SEQ ID NO: 321289 - protein, 27 aa, Mycobacterium
NNGLRPEPIIALGILLTWCSVERGVAT

SEQ ID NO: 321290 - protein, 19 aa, Mycobacterium
NNIAGRIAVTIGPETIDHW

SEQ ID NO: 321291 - protein, 22 aa, Mycobacterium
NNLGPKMLLIFALAAVGAVIAQ

SEQ ID NO: 321292 - protein, 21 aa, Mycobacterium
NNLPAVLVLLPLVAGSGPAAV

SEQ ID NO: 321293 - protein, 31 aa, Mycobacterium
NNNVTLCKFGFVSGETCGKVIGHDNLTVEAE

SEQ ID NO: 321294 - protein, 24 aa, Mycobacterium
NNPEVKKGATFTCDVSIDGTKRQV

SEQ ID NO: 321295 - protein, 29 aa, Mycobacterium
NNPNGGILARFPGLYIQSVGLTFNGATPV

SEQ ID NO: 321296 - protein, 17 aa, Mycobacterium
NNPVLRPRFIKRKFFEH

SEQ ID NO: 321297 - protein, 26 aa, Mycobacterium
NNTESRWKLGLYAAGRASQMRRMRAP

SEQ ID NO: 321298 - protein, 18 aa, Mycobacterium
NNVVAWLRFNRMPSPDSV

SEQ ID NO: 321299 - protein, 19 aa, Mycobacterium
NPAAALGEFDFRKAELSRV

SEQ ID NO: 321300 - protein, 37 aa, Mycobacterium
NPADRYARCIDFAHSFARAARCGRHPKSSASTMPAPL

SEQ ID NO: 321301 - protein, 22 aa, Mycobacterium
NPAGSFALRVWVNNAWVAAQCI

SEQ ID NO: 321302 - protein, 19 aa, Mycobacterium
NPAHRVIEAAATFPSAEKA

SEQ ID NO: 321303 - protein, 22 aa, Mycobacterium
NPAHYFILFGLFLLFIAGTLAM

SEQ ID NO: 321304 - protein, 17 aa, Mycobacterium
NPALPIPTKRSGYVDVH

SEQ ID NO: 321305 - protein, 23 aa, Mycobacterium
NPAPRLPAVLMIGSALNTPADWI

SEQ ID NO: 321306 - protein, 31 aa, Mycobacterium
NPASIYPPCPFRWLTGWNCPFCGGLRMTYDV

SEQ ID NO: 321307 - protein, 23 aa, Mycobacterium
NPASPRPLLGFAPGTQGLARSAA

SEQ ID NO: 321308 - protein, 21 aa, Mycobacterium
NPCTVGFLPSSQWRAPEDETT

SEQ ID NO: 321309 - protein, 23 aa, Mycobacterium
NPDAPMVFGMVLAAYFTTRAIDS

SEQ ID NO: 321310 - protein, 26 aa, Mycobacterium
NPDDRFERCRGFAAAVADRLGDVAEA

SEQ ID NO: 321311 - protein, 18 aa, Mycobacterium
NPDTGKYGPIYDEKKGTW

SEQ ID NO: 321312 - protein, 17 aa, Mycobacterium
NPDTGKYGPLYDAKTKT

SEQ ID NO: 321313 - protein, 21 aa, Mycobacterium
NPFLRREFTECDKWRDLVVAR

SEQ ID NO: 321314 - protein, 20 aa, Mycobacterium
NPFVFCLTVAAATLPLAAAS

SEQ ID NO: 321315 - protein, 21 aa, Mycobacterium
NPGEILAWCSSAGFDRDNCAA

SEQ ID NO: 321316 - protein, 22 aa, Mycobacterium
NPGGWPFPPVPFVNGLASFFGQ

SEQ ID NO: 321317 - protein, 29 aa, Mycobacterium
NPGMLAGGLALLLMVVWVGIALAVSASLG

SEQ ID NO: 321318 - protein, 40 aa, Mycobacterium
NPGVPVPIPVIVPFPGWQPGYPRPPYNPPYTPPSTTTITP

SEQ ID NO: 321319 - protein, 34 aa, Mycobacterium
NPIAAGLCLLVFAGFMLYFAVYSRHRLVANSPDE

SEQ ID NO: 321320 - protein, 17 aa, Mycobacterium
NPIETPDLLSLLLEASY

SEQ ID NO: 321321 - protein, 17 aa, Mycobacterium
NPILGCLPMLAQIPVFI

SEQ ID NO: 321322 - protein, 22 aa, Mycobacterium
NPISFWEFTRKGALVTAVSIAL

SEQ ID NO: 321323 - protein, 19 aa, Mycobacterium
NPKAVVTFYEDFLCPACGN

SEQ ID NO: 321324 - protein, 22 aa, Mycobacterium
NPKEKARAIGIWTAVASVGTAT

SEQ ID NO: 321325 - protein, 28 aa, Mycobacterium
NPKGNRFGWLDADGNVWVPTGKGGLAHG

SEQ ID NO: 321326 - protein, 27 aa, Mycobacterium
NPKHVVLEVFGRPGATATINYLDVNAQ

SEQ ID NO: 321327 - protein, 26 aa, Mycobacterium
NPKRIRGRHWALTAAAIVAIAIVALA

SEQ ID NO: 321328 - protein, 26 aa, Mycobacterium
NPLFIPRFLFTVSICGVLVATGAYLL

SEQ ID NO: 321329 - protein, 22 aa, Mycobacterium
NPLFRPRALAWLMPSIQENAAA

SEQ ID NO: 321330 - protein, 18 aa, Mycobacterium
NPLLPLAEYLPHSKDIGL

SEQ ID NO: 321331 - protein, 17 aa, Mycobacterium
NPLPCAGAVSGPFGGPG

SEQ ID NO: 321332 - protein, 22 aa, Mycobacterium
NPLRIAAAMGVVMLGAAFFACL

SEQ ID NO: 321333 - protein, 19 aa, Mycobacterium
NPLVQLWVFLQQVVAELRK

SEQ ID NO: 321334 - protein, 27 aa, Mycobacterium
NPMFLFFPAMMAVSLIGTLAYGSRGAG

SEQ ID NO: 321335 - protein, 23 aa, Mycobacterium
NPMLLRVGARTSYLVGLAVFGAA

SEQ ID NO: 321336 - protein, 19 aa, Mycobacterium
NPPLPAWLTPSPRVPGTGD

SEQ ID NO: 321337 - protein, 20 aa, Mycobacterium
NPPLPWWQPNPSPRVPGSAD

SEQ ID NO: 321338 - protein, 25 aa, Mycobacterium
NPQAYTPWFDRVIAFVIDQLPIAVV

SEQ ID NO: 321339 - protein, 18 aa, Mycobacterium
NPQFPPSWGYPAQPGGQP

SEQ ID NO: 321340 - protein, 23 aa, Mycobacterium
NPREIKLAASYFLVTPLIVLTGT

SEQ ID NO: 321341 - protein, 21 aa, Mycobacterium
NPRRTVPVATFIVVIGVGLFY

SEQ ID NO: 321342 - protein, 17 aa, Mycobacterium
NPRRVHWIAQTRVGTPG

SEQ ID NO: 321343 - protein, 20 aa, Mycobacterium
NPRVACLVGGLGTVAAALAH

SEQ ID NO: 321344 - protein, 24 aa, Mycobacterium
NPRYVWAWRLLRLDFTGVALGALF

SEQ ID NO: 321345 - protein, 23 aa, Mycobacterium
NPSDVLAGWALGYAYFIVCLLAL

SEQ ID NO: 321346 - protein, 17 aa, Mycobacterium
NPSQFKTTVVFNDGKEV

SEQ ID NO: 321347 - protein, 18 aa, Mycobacterium
NPSTCWWWERTAGENRSR

SEQ ID NO: 321348 - protein, 29 aa, Mycobacterium
NPTAWTNWVEIFLLLVISFSLPRTFGRMV

SEQ ID NO: 321349 - protein, 28 aa, Mycobacterium
NPTAWTNWVEIFLLLVISSALPRTFGRL

SEQ ID NO: 321350 - protein, 22 aa, Mycobacterium
NPVQALITWGPFLLAVVYQAVS

SEQ ID NO: 321351 - protein, 22 aa, Mycobacterium
NPVQFICGGSFDTPAGTSGPDY

SEQ ID NO: 321352 - protein, 25 aa, Mycobacterium
NPVVKKGDTFTCEVSIDGTKRQVTV

SEQ ID NO: 321353 - protein, 25 aa, Mycobacterium
NPVVPWTAAAMFLAFWLPFNNGLRP

SEQ ID NO: 321354 - protein, 23 aa, Mycobacterium
NPWHHAHALPVWWTTEHADSIGI

SEQ ID NO: 321355 - protein, 21 aa, Mycobacterium
NPWKWNIIGLLAIAVGASILL

SEQ ID NO: 321356 - protein, 19 aa, Mycobacterium
NPWKWNVIGLLAIAILISI

SEQ ID NO: 321357 - protein, 19 aa, Mycobacterium
NPYRGSRVLWLIHGVSVLL

SEQ ID NO: 321358 - protein, 27 aa, Mycobacterium
NPYSGLMGCTLFAVIGGFLAYFHSVGQ

SEQ ID NO: 321359 - protein, 19 aa, Mycobacterium
NQALGWLVGLALSGALSYS

SEQ ID NO: 321360 - protein, 23 aa, Mycobacterium
NQFVMPDLSGMFWTDAEPRLRAL

SEQ ID NO: 321361 - protein, 25 aa, Mycobacterium
NQFVMPDLVGQFWSDAYPRLTALGW

SEQ ID NO: 321362 - protein, 17 aa, Mycobacterium
NQGIALVLGVLFIAILV

SEQ ID NO: 321363 - protein, 24 aa, Mycobacterium
NQGPGEFWFGVLFYGAPVVPVVVI

SEQ ID NO: 321364 - protein, 17 aa, Mycobacterium
NQISAYKGQIIYDTPET

SEQ ID NO: 321365 - protein, 25 aa, Mycobacterium
NQKIEKVVLVSAFLAAAALAQAVGN

SEQ ID NO: 321366 - protein, 26 aa, Mycobacterium
NQKRWSSDLSMTWNLLCRSITHGIVP

SEQ ID NO: 321367 - protein, 22 aa, Mycobacterium
NQLDGFLAWVLVFILLLVVADL

SEQ ID NO: 321368 - protein, 26 aa, Mycobacterium
NQLFFPEPRCRVVTAVGPYDPGERSR

SEQ ID NO: 321369 - protein, 24 aa, Mycobacterium
NQLLWRRDELGLGVGDAVLQTTEP

SEQ ID NO: 321370 - protein, 17 aa, Mycobacterium
NQLRTDIANARRVLSGA

SEQ ID NO: 321371 - protein, 26 aa, Mycobacterium
NQLYTERHVRLWVVYVDDFSGQSATN

SEQ ID NO: 321372 - protein, 23 aa, Mycobacterium
NQNRIRWGNLLTLPVADGGLLYV

SEQ ID NO: 321373 - protein, 23 aa, Mycobacterium
NQNRIRWGNLLTLPVAQGGLLYV

SEQ ID NO: 321374 - protein, 23 aa, Mycobacterium
NQNRIRWGNLLTLPVGQGGLLYV

SEQ ID NO: 321375 - protein, 25 aa, Mycobacterium
NQPPPCMTGFLPASEWRSPADTSQA

SEQ ID NO: 321376 - protein, 18 aa, Mycobacterium
NQRAAALAPRGVDVEIAW

SEQ ID NO: 321377 - protein, 30 aa, Mycobacterium
NQRPVLGCAFATVAVALAWLSFEMVPDTSI

SEQ ID NO: 321378 - protein, 20 aa, Mycobacterium
NQRSGGAFRQLWRKIRFRSD

SEQ ID NO: 321379 - protein, 29 aa, Mycobacterium
NQSAFRLKTRLLFMPGVMVTSVPWQLTSS

SEQ ID NO: 321380 - protein, 29 aa, Mycobacterium
NQSALRLKGRLLFMPGVMVTSVPWQLSSS

SEQ ID NO: 321381 - protein, 29 aa, Mycobacterium
NQSALRLKGRLLFMPGVMVTSVPWQLTSS

SEQ ID NO: 321382 - protein, 19 aa, Mycobacterium
NQTALEPLPPIAGPSSTIA

SEQ ID NO: 321383 - protein, 17 aa, Mycobacterium
NQTLRLVGLDSITRVWL

SEQ ID NO: 321384 - protein, 17 aa, Mycobacterium
NQVNSVLVVAGRSHTDQ

SEQ ID NO: 321385 - protein, 31 aa, Mycobacterium
NRALAGIGLKAFWYHFAIMFEALFILTTVDA

SEQ ID NO: 321386 - protein, 21 aa, Mycobacterium
NRALRAMLGYSRRAMSELTFQ

SEQ ID NO: 321387 - protein, 23 aa, Mycobacterium
NRARLQRILVLGMVMTLGTVTVL

SEQ ID NO: 321388 - protein, 20 aa, Mycobacterium
NRARWSAAVVDRVNELDADV

SEQ ID NO: 321389 - protein, 19 aa, Mycobacterium
NRATARFYITYSLAHIVGA

SEQ ID NO: 321390 - protein, 25 aa, Mycobacterium
NRAVDAGVVAGNFFEHQPFLNDAIA

SEQ ID NO: 321391 - protein, 18 aa, Mycobacterium
NRDAWMVGYTPSLSTAVW

SEQ ID NO: 321392 - protein, 34 aa, Mycobacterium
NREARPRIASFIRRFSVLIILAWIVVAALATFAI

SEQ ID NO: 321393 - protein, 20 aa, Mycobacterium
NRELWIGAVIASLVVGVIVY

SEQ ID NO: 321394 - protein, 20 aa, Mycobacterium
NRELWVGAVIASLVVGVIVW

SEQ ID NO: 321395 - protein, 28 aa, Mycobacterium
NRFGRAGLRLGPAVGHLEVHHGRRAEGH

SEQ ID NO: 321396 - protein, 25 aa, Mycobacterium
NRFVFANADAFSWRETFESLVPVDG

SEQ ID NO: 321397 - protein, 23 aa, Mycobacterium
NRGAQRWDLERQVRLVAGSIVLS

SEQ ID NO: 321398 - protein, 17 aa, Mycobacterium
NRGPWQLPQIPAAGAPN

SEQ ID NO: 321399 - protein, 18 aa, Mycobacterium
NRGRRAALEDALRQAIRD

SEQ ID NO: 321400 - protein, 19 aa, Mycobacterium
NRGVFLGGVAVTFAVVVAL

SEQ ID NO: 321401 - protein, 25 aa, Mycobacterium
NRGYVYRTPLLATRKGDVPAAVVLA

SEQ ID NO: 321402 - protein, 24 aa, Mycobacterium
NRHAAPHWDWLKWLPHSQHPSAFD

SEQ ID NO: 321403 - protein, 18 aa, Mycobacterium
NRHFPFVISTMLANNPFI

SEQ ID NO: 321404 - protein, 19 aa, Mycobacterium
NRIFGWRAGCVAIAVMIAV

SEQ ID NO: 321405 - protein, 21 aa, Mycobacterium
NRIGLALAVTLEFLGPLTVAI

SEQ ID NO: 321406 - protein, 24 aa, Mycobacterium
NRIGLRIITFGSIVSVAFALLANL

SEQ ID NO: 321407 - protein, 23 aa, Mycobacterium
NRIQFASGPGFIDPRCTLAVVDG

SEQ ID NO: 321408 - protein, 17 aa, Mycobacterium
NRITWPGSIYLGVIAIL

SEQ ID NO: 321409 - protein, 20 aa, Mycobacterium
NRIYKPYPYILAIVDELADL

SEQ ID NO: 321410 - protein, 22 aa, Mycobacterium
NRKWIENWILWIVTDTFSVGVY

SEQ ID NO: 321411 - protein, 23 aa, Mycobacterium
NRLKVKSVHPMAGLTPGQVLDAA

SEQ ID NO: 321412 - protein, 25 aa, Mycobacterium
NRLKVKTVRPAPGFTPGQVLDAALS

SEQ ID NO: 321413 - protein, 21 aa, Mycobacterium
NRLLLPPILGWSLGRALCGIT

SEQ ID NO: 321414 - protein, 17 aa, Mycobacterium
NRLRSYFGVHDDRPLTS

SEQ ID NO: 321415 - protein, 21 aa, Mycobacterium
NRLTQSAAWVGIVAGVVFIVA

SEQ ID NO: 321416 - protein, 22 aa, Mycobacterium
NRLVLPAVKGWTLGRALFGIAV

SEQ ID NO: 321417 - protein, 19 aa, Mycobacterium
NRNLGWLFLFKKGNVSLAG

SEQ ID NO: 321418 - protein, 18 aa, Mycobacterium
NRPESWPSAADFVDADIR

SEQ ID NO: 321419 - protein, 20 aa, Mycobacterium
NRPHLGLAAATFVALGGTSL

SEQ ID NO: 321420 - protein, 28 aa, Mycobacterium
NRPIAALAVICLGVFVISVDATIVNVAL

SEQ ID NO: 321421 - protein, 33 aa, Mycobacterium
NRPTPDRVRELVVAWGKLYPQFGAVGALSLVQC

SEQ ID NO: 321422 - protein, 19 aa, Mycobacterium
NRPVGREVILECLRLATQA

SEQ ID NO: 321423 - protein, 21 aa, Mycobacterium
NRQATEFLVAPGIPHETLAAA

SEQ ID NO: 321424 - protein, 20 aa, Mycobacterium
NRRCTPRDALYPLVDFLTRS

SEQ ID NO: 321425 - protein, 17 aa, Mycobacterium
NRRKARRPRRRHRRRPP

SEQ ID NO: 321426 - protein, 22 aa, Mycobacterium
NRRNPWPIIAAVAAVLVVIVGG

SEQ ID NO: 321427 - protein, 19 aa, Mycobacterium
NRRPAMVVGAVIGGLLLLG

SEQ ID NO: 321428 - protein, 20 aa, Mycobacterium
NRRRTWLVLRMDPQRNVAAV

SEQ ID NO: 321429 - protein, 26 aa, Mycobacterium
NRRTLRNVYIPWTFTMTPISNSDVGS

SEQ ID NO: 321430 - protein, 24 aa, Mycobacterium
NRSRRGRALFVFTVGMVLIVAASA

SEQ ID NO: 321431 - protein, 18 aa, Mycobacterium
NRSWRDYALFVALVGPNL

SEQ ID NO: 321432 - protein, 18 aa, Mycobacterium
NRTDRFIEALSLEQPVYS

SEQ ID NO: 321433 - protein, 25 aa, Mycobacterium
NRTFAEWLENLWILNVGVFAAGLSY

SEQ ID NO: 321434 - protein, 20 aa, Mycobacterium
NRTGLFEALFLLGVLVGTIQ

SEQ ID NO: 321435 - protein, 19 aa, Mycobacterium
NRTVLRRAFGLLGPLEAVL

SEQ ID NO: 321436 - protein, 23 aa, Mycobacterium
NRVAAMLGGWLAVLAGAWFVVGG

SEQ ID NO: 321437 - protein, 24 aa, Mycobacterium
NRVGDMGLALAMMLMFSTFGSVGF

SEQ ID NO: 321438 - protein, 26 aa, Mycobacterium
NRVRVRLKPMYARSIPATVTARVVPS

SEQ ID NO: 321439 - protein, 17 aa, Mycobacterium
NRVSTYLGDISFALYLV

SEQ ID NO: 321440 - protein, 26 aa, Mycobacterium
NRWAQRPRVWWAVAIGNSGAMTLYLW

SEQ ID NO: 321441 - protein, 19 aa, Mycobacterium
NRYRFVLTNHHIVLDGWSM

SEQ ID NO: 321442 - protein, 22 aa, Mycobacterium
NSAEKWKGCAGKTVTVTNKSKT

SEQ ID NO: 321443 - protein, 17 aa, Mycobacterium
NSAGWVFTEMGRQPWVV

SEQ ID NO: 321444 - protein, 17 aa, Mycobacterium
NSAHPFENPTPWTNWLE

SEQ ID NO: 321445 - protein, 23 aa, Mycobacterium
NSASLPWIRTWIAAYAVLMLAGA

SEQ ID NO: 321446 - protein, 23 aa, Mycobacterium
NSASRLAIITVIGLIIAYVFRPA

SEQ ID NO: 321447 - protein, 25 aa, Mycobacterium
NSDAFARLGRFSRTLVLAVAIMIFA

SEQ ID NO: 321448 - protein, 18 aa, Mycobacterium
NSDLNWSILATRDNSDAF

SEQ ID NO: 321449 - protein, 26 aa, Mycobacterium
NSDNKRWQRLKGVAVVSAPGGQEPVT

SEQ ID NO: 321450 - protein, 24 aa, Mycobacterium
NSGAWLVLFMIFNVIWTYVLVRGS

SEQ ID NO: 321451 - protein, 32 aa, Mycobacterium
NSGSMTIYLWHWVVTFLLSYGVYLTFRIGLLS

SEQ ID NO: 321452 - protein, 24 aa, Mycobacterium
NSGTCYRPPAAVHRRWRDEFGLAL

SEQ ID NO: 321453 - protein, 19 aa, Mycobacterium
NSHLLRGAALILTEDSVLD

SEQ ID NO: 321454 - protein, 20 aa, Mycobacterium
NSIAWAWGMGVTFGIFAAGR

SEQ ID NO: 321455 - protein, 20 aa, Mycobacterium
NSIEIPWFRLPAAGEIAPGS

SEQ ID NO: 321456 - protein, 28 aa, Mycobacterium
NSKPKKRRLRWLIAAVLVVLIALAGLAI

SEQ ID NO: 321457 - protein, 17 aa, Mycobacterium
NSLARAMSWAERPVHPV

SEQ ID NO: 321458 - protein, 18 aa, Mycobacterium
NSLDAVWKQLMPNRYTRP

SEQ ID NO: 321459 - protein, 20 aa, Mycobacterium
NSLDGVWAQLMPDYTRPRVE

SEQ ID NO: 321460 - protein, 19 aa, Mycobacterium
NSLFGFSWADHVVALIIAG

SEQ ID NO: 321461 - protein, 19 aa, Mycobacterium
NSLGGWVAFELERRGRARS

SEQ ID NO: 321462 - protein, 23 aa, Mycobacterium
NSLLRYGYFPLLGIALVALVTLL

SEQ ID NO: 321463 - protein, 28 aa, Mycobacterium
NSLPLLAALAWVCGDAILLIRTGNQRYA

SEQ ID NO: 321464 - protein, 24 aa, Mycobacterium
NSLQRLKVPLGNRMDNNELFFVDI

SEQ ID NO: 321465 - protein, 17 aa, Mycobacterium
NSLRLRRFDRLPTAPKE

SEQ ID NO: 321466 - protein, 17 aa, Mycobacterium
NSLYRAGLAIGLSLLPV

SEQ ID NO: 321467 - protein, 27 aa, Mycobacterium
NSMFIPRFLFALSFCGLGVTTASYMFT

SEQ ID NO: 321468 - protein, 25 aa, Mycobacterium
NSMQVCKKSDCPFSTSASENLQIPQ

SEQ ID NO: 321469 - protein, 23 aa, Mycobacterium
NSPGDWRTVGLLVGLFVAVIVLV

SEQ ID NO: 321470 - protein, 26 aa, Mycobacterium
NSPVWFSLFCTVFFGLGWLVTLRNGD

SEQ ID NO: 321471 - protein, 22 aa, Mycobacterium
NSRDPIERWAHNLNTLDAQAAE

SEQ ID NO: 321472 - protein, 26 aa, Mycobacterium
NSRIPGDSLVAWWVRLIVPALAVVLV

SEQ ID NO: 321473 - protein, 21 aa, Mycobacterium
NSSKITTEWFPREERGQAAGI

SEQ ID NO: 321474 - protein, 27 aa, Mycobacterium
NSSPPPPRWVWLPLIAVGAVGMVLMAI

SEQ ID NO: 321475 - protein, 17 aa, Mycobacterium
NSTDEWLIDVAPMLSDP

SEQ ID NO: 321476 - protein, 23 aa, Mycobacterium
NSTDRPLLPRAFPSASASALLLN

SEQ ID NO: 321477 - protein, 19 aa, Mycobacterium
NSVDAVWKQLMRGYTRPHV

SEQ ID NO: 321478 - protein, 19 aa, Mycobacterium
NSVGFIAPVGLVFLVALRR

SEQ ID NO: 321479 - protein, 37 aa, Mycobacterium
NSVLAFTVIKWLGVVYLAYLAWRQWRSVAVDLHSQVD

SEQ ID NO: 321480 - protein, 19 aa, Mycobacterium
NSVLPAPMVAMVFDTVFQP

SEQ ID NO: 321481 - protein, 30 aa, Mycobacterium
NTAIFPADIGWRIAFGIGAVFGLVVLVVRR

SEQ ID NO: 321482 - protein, 29 aa, Mycobacterium
NTANFPPDIGWRLAFGIGAILGIFVLLVR

SEQ ID NO: 321483 - protein, 18 aa, Mycobacterium
NTANPWLYEGHILAAILM

SEQ ID NO: 321484 - protein, 17 aa, Mycobacterium
NTAWYRLTKFFGKLFLI

SEQ ID NO: 321485 - protein, 19 aa, Mycobacterium
NTCAMGMALAKLPYNRGTA

SEQ ID NO: 321486 - protein, 27 aa, Mycobacterium
NTELFKRMTMILTWIWVAAFAGMTLSS

SEQ ID NO: 321487 - protein, 24 aa, Mycobacterium
NTELLPVFFLLPVSVAFQERPAIT

SEQ ID NO: 321488 - protein, 24 aa, Mycobacterium
NTESNFPALVTFLSNAIADQQAST

SEQ ID NO: 321489 - protein, 20 aa, Mycobacterium
NTFGLAWRLDRGALLLWTIG

SEQ ID NO: 321490 - protein, 20 aa, Mycobacterium
NTGDGALRGWAIPTATDIAF

SEQ ID NO: 321491 - protein, 18 aa, Mycobacterium
NTGGDIFERGGPYLVRGA

SEQ ID NO: 321492 - protein, 24 aa, Mycobacterium
NTGGPFFIEFRTYRFRAHSMFDPE

SEQ ID NO: 321493 - protein, 27 aa, Mycobacterium
NTGPEFGKAAPFGLLITVVLLVGTFAL

SEQ ID NO: 321494 - protein, 26 aa, Mycobacterium
NTGSPDWPGKWAIVYVDTTGQHPDAV

SEQ ID NO: 321495 - protein, 18 aa, Mycobacterium
NTIEELYPITGVKSLPFQ

SEQ ID NO: 321496 - protein, 38 aa, Mycobacterium
NTIRGLKVLMWAALVSVLAVALGLLLYFTPIMSARNVE

SEQ ID NO: 321497 - protein, 20 aa, Mycobacterium
NTIYSPLFRKFVEWIEYLCL

SEQ ID NO: 321498 - protein, 21 aa, Mycobacterium
NTIYSPLFRKFVEWIEYLCLM

SEQ ID NO: 321499 - protein, 20 aa, Mycobacterium
NTIYSPLFRKFVEWTEYLCL

SEQ ID NO: 321500 - protein, 17 aa, Mycobacterium
NTLKVGPSLSKGATTGT

SEQ ID NO: 321501 - protein, 25 aa, Mycobacterium
NTLRRPHPLVAWLSRMPTTRGFQML

SEQ ID NO: 321502 - protein, 18 aa, Mycobacterium
NTLSQRFSGGVISWDTSA

SEQ ID NO: 321503 - protein, 27 aa, Mycobacterium
NTMFIPRFLFAVSFCGLLVATGSYLLT

SEQ ID NO: 321504 - protein, 26 aa, Mycobacterium
NTMFIPRFLFAVTFCGVLVATGSYLL

SEQ ID NO: 321505 - protein, 17 aa, Mycobacterium
NTPADWLGPGGAFTAID

SEQ ID NO: 321506 - protein, 19 aa, Mycobacterium
NTRGVLRAATVLVVVLVGA

SEQ ID NO: 321507 - protein, 31 aa, Mycobacterium
NTRGWRRVGTAVVRWPVPILAGAIAVALVGL

SEQ ID NO: 321508 - protein, 23 aa, Mycobacterium
NTRNVFGPPAWAPVVNNVVAIAT

SEQ ID NO: 321509 - protein, 22 aa, Mycobacterium
NTRPDPDAPRRGGSGVSAQDLL

SEQ ID NO: 321510 - protein, 23 aa, Mycobacterium
NTRPEIVCAIYLVAISGAAVGAA

SEQ ID NO: 321511 - protein, 21 aa, Mycobacterium
NTRRIMLADFGIARWDNDISG

SEQ ID NO: 321512 - protein, 24 aa, Mycobacterium
NTRSFTGAGVWLGIASFAAAGVVA

SEQ ID NO: 321513 - protein, 25 aa, Mycobacterium
NTRSFTGAVVWLGIASFAAAGVVGL

SEQ ID NO: 321514 - protein, 21 aa, Mycobacterium
NTSSVALIWFGGLRIDQGQMQ

SEQ ID NO: 321515 - protein, 17 aa, Mycobacterium
NTTAYNRWWEARTLWGS

SEQ ID NO: 321516 - protein, 22 aa, Mycobacterium
NTTKRLPAYWQQDLPPSDDPHS

SEQ ID NO: 321517 - protein, 18 aa, Mycobacterium
NTVAILWWLLAAHATHFA

SEQ ID NO: 321518 - protein, 17 aa, Mycobacterium
NTVLRWMQNALSFIGFV

SEQ ID NO: 321519 - protein, 18 aa, Mycobacterium
NTVLRWVQNALSFIGFVP

SEQ ID NO: 321520 - protein, 18 aa, Mycobacterium
NTWITGRLELPVDVTTVV

SEQ ID NO: 321521 - protein, 24 aa, Mycobacterium
NVAAKLFAARGYHGTRMDDVAEAV

SEQ ID NO: 321522 - protein, 17 aa, Mycobacterium
NVAEIAPALAILGRPFK

SEQ ID NO: 321523 - protein, 19 aa, Mycobacterium
NVAGIPWWGAILSAVVASL

SEQ ID NO: 321524 - protein, 20 aa, Mycobacterium
NVDAVFRRGGGRRGAERCAV

SEQ ID NO: 321525 - protein, 23 aa, Mycobacterium
NVDFFCAVIIVGLLAGVAGLATT

SEQ ID NO: 321526 - protein, 24 aa, Mycobacterium
NVDLVLRGGALVRLQEAATRAGGL

SEQ ID NO: 321527 - protein, 24 aa, Mycobacterium
NVEKRPRLTVFDDFGGRIPSDKPP

SEQ ID NO: 321528 - protein, 19 aa, Mycobacterium
NVFGFRVPSGLSMAPWDLH

SEQ ID NO: 321529 - protein, 18 aa, Mycobacterium
NVFTRINAILGVLLLIVL

SEQ ID NO: 321530 - protein, 22 aa, Mycobacterium
NVGCIQARLGYFNEEQNLLTRW

SEQ ID NO: 321531 - protein, 17 aa, Mycobacterium
NVGHCGDFYTVGPGNQL

SEQ ID NO: 321532 - protein, 24 aa, Mycobacterium
NVGMAVSLYLGFRSGTKVFHDTVP

SEQ ID NO: 321533 - protein, 17 aa, Mycobacterium
NVGQVWYGFGWESLLLE

SEQ ID NO: 321534 - protein, 26 aa, Mycobacterium
NVGVFAAGLSYFWLSGFALNISSTVM

SEQ ID NO: 321535 - protein, 22 aa, Mycobacterium
NVGVLRWSWRVMNYRFPMNSTD

SEQ ID NO: 321536 - protein, 29 aa, Mycobacterium
NVHKLEPLIRLPLILGLAHALSRIPLPAS

SEQ ID NO: 321537 - protein, 19 aa, Mycobacterium
NVHSSRPLLALSLLECNFG

SEQ ID NO: 321538 - protein, 25 aa, Mycobacterium
NVHVAFSIWYLWSVMVLFMPQSVYG

SEQ ID NO: 321539 - protein, 18 aa, Mycobacterium
NVIARYQFALARKGLLPK

SEQ ID NO: 321540 - protein, 17 aa, Mycobacterium
NVIPAITKYMSALDVAL

SEQ ID NO: 321541 - protein, 23 aa, Mycobacterium
NVIRVRIGIHMGRSVRRGDDLFG

SEQ ID NO: 321542 - protein, 17 aa, Mycobacterium
NVISGLVGRSGLVYDMW

SEQ ID NO: 321543 - protein, 19 aa, Mycobacterium
NVKDVKCNDGTDPTVKKGA

SEQ ID NO: 321544 - protein, 19 aa, Mycobacterium
NVKGDSVVIIAVDTKPVTI

SEQ ID NO: 321545 - protein, 24 aa, Mycobacterium
NVLAAKADSAWYLHQLTANTELAA

SEQ ID NO: 321546 - protein, 22 aa, Mycobacterium
NVLAQLGLRIFILVLVLPGVGM

SEQ ID NO: 321547 - protein, 18 aa, Mycobacterium
NVLLGWPLWVSVIAAAAI

SEQ ID NO: 321548 - protein, 20 aa, Mycobacterium
NVLLIRLGVTGAFLAIMIID

SEQ ID NO: 321549 - protein, 17 aa, Mycobacterium
NVLRLSVGAIDYLLIAI

SEQ ID NO: 321550 - protein, 25 aa, Mycobacterium
NVLWPRTGDPWVDWAPFIVTAALFV

SEQ ID NO: 321551 - protein, 21 aa, Mycobacterium
NVMALYLWHMIPVVVVAIVAY

SEQ ID NO: 321552 - protein, 20 aa, Mycobacterium
NVMALYLWHMVPVVIVAVVA

SEQ ID NO: 321553 - protein, 24 aa, Mycobacterium
NVPFEIAVAVSLLIALAVFAVGRA

SEQ ID NO: 321554 - protein, 22 aa, Mycobacterium
NVPYPGFGHLAGFIASTSLIFV

SEQ ID NO: 321555 - protein, 17 aa, Mycobacterium
NVQQCIKEASGGAAGQI

SEQ ID NO: 321556 - protein, 28 aa, Mycobacterium
NVRRWRRIGTATVRWPGAVFAASSAIAL

SEQ ID NO: 321557 - protein, 25 aa, Mycobacterium
NVRSRAAEILRHWNTRRRNAAWERL

SEQ ID NO: 321558 - protein, 26 aa, Mycobacterium
NVSARPHSQFSYFLPDGHEYQITLVV

SEQ ID NO: 321559 - protein, 17 aa, Mycobacterium
NVSKWAFLLTFAGVGLN

SEQ ID NO: 321560 - protein, 25 aa, Mycobacterium
NVSPHPALYWPARAWILVVRAVPEL

SEQ ID NO: 321561 - protein, 23 aa, Mycobacterium
NVSVIGRVVAWLRKRAGARGRAL

SEQ ID NO: 321562 - protein, 18 aa, Mycobacterium
NVSVPWGIAVDNSGTVYV

SEQ ID NO: 321563 - protein, 19 aa, Mycobacterium
NVTNLKGLLGRLIEMLTTL

SEQ ID NO: 321564 - protein, 22 aa, Mycobacterium
NVVDAAPFLLMFTVGEVGAMAS

SEQ ID NO: 321565 - protein, 24 aa, Mycobacterium
NVVMKRPIAFAAPILIGMILLILP

SEQ ID NO: 321566 - protein, 22 aa, Mycobacterium
NVWAHAIIFCGHFPDQTYTFTP

SEQ ID NO: 321567 - protein, 33 aa, Mycobacterium
NVWDSLAGLANRYAIVVIGLWVVAAGLGTLLVP

SEQ ID NO: 321568 - protein, 24 aa, Mycobacterium
NVYLGLKVGLTFATAIPAAVISMA

SEQ ID NO: 321569 - protein, 24 aa, Mycobacterium
NVYLGLKVGLTFATSIPAAVISMG

SEQ ID NO: 321570 - protein, 23 aa, Mycobacterium
NVYQRLRHAFVLEERGLIDVKGK

SEQ ID NO: 321571 - protein, 18 aa, Mycobacterium
NVYWITFAGLATVDNPRY

SEQ ID NO: 321572 - protein, 27 aa, Mycobacterium
NWAGFSVGWLYWYFWVIVVGFEAIAGA

SEQ ID NO: 321573 - protein, 20 aa, Mycobacterium
NWATLIALGIGDIVAIDFMA

SEQ ID NO: 321574 - protein, 20 aa, Mycobacterium
NWFGVCLIPILILLVLQIRR

SEQ ID NO: 321575 - protein, 17 aa, Mycobacterium
NWGVAGWSMGGTCAVDL

SEQ ID NO: 321576 - protein, 23 aa, Mycobacterium
NWILRRLGIEPAEELRSARTGQE

SEQ ID NO: 321577 - protein, 23 aa, Mycobacterium
NWIVRRLGIEPAEELRSARSPQE

SEQ ID NO: 321578 - protein, 24 aa, Mycobacterium
NWIVRRLGVEPAEELRSARSPQEL

SEQ ID NO: 321579 - protein, 18 aa, Mycobacterium
NWLRAGVLGANDGIVSTA

SEQ ID NO: 321580 - protein, 19 aa, Mycobacterium
NWPEIALGLAGLVCSIAAL

SEQ ID NO: 321581 - protein, 20 aa, Mycobacterium
NWPHTRKLLAEHLVDVPDEE

SEQ ID NO: 321582 - protein, 19 aa, Mycobacterium
NWPQPLQRWWLYRRVADVA

SEQ ID NO: 321583 - protein, 35 aa, Mycobacterium
NWQWLALTLASPVVVWGALPFHRAAWANARHRAAT

SEQ ID NO: 321584 - protein, 20 aa, Mycobacterium
NWTAALWAVALLVAGIGIGM

SEQ ID NO: 321585 - protein, 21 aa, Mycobacterium
NWYIVHSMLPIFRRMQRLIDG

SEQ ID NO: 321586 - protein, 18 aa, Mycobacterium
NWYLIGFAAVALFVLIRD

SEQ ID NO: 321587 - protein, 23 aa, Mycobacterium
NYAELRHRIGFVPQDDILHTPLT

SEQ ID NO: 321588 - protein, 30 aa, Mycobacterium
NYAEVFTLMPFWRMFFNTVLYAGCVTAGQI

SEQ ID NO: 321589 - protein, 18 aa, Mycobacterium
NYAGLIFWDTELWMYPNL

SEQ ID NO: 321590 - protein, 21 aa, Mycobacterium
NYAMGAFFVIYGLVVFSLGAM

SEQ ID NO: 321591 - protein, 24 aa, Mycobacterium
NYECVNCLTYALARQLFVTLDEPL

SEQ ID NO: 321592 - protein, 17 aa, Mycobacterium
NYFPFGVNFFSTAEVLP

SEQ ID NO: 321593 - protein, 26 aa, Mycobacterium
NYGAARAGARIILLNSEFSGPQIKEV

SEQ ID NO: 321594 - protein, 25 aa, Mycobacterium
NYGGDAWVIRDGRRSRIDAANRSVL

SEQ ID NO: 321595 - protein, 21 aa, Mycobacterium
NYGGDAWVIREGRRSRIDATN

SEQ ID NO: 321596 - protein, 17 aa, Mycobacterium
NYGLRASALPARVNGPG

SEQ ID NO: 321597 - protein, 25 aa, Mycobacterium
NYGVWWYWLGLCLIAAVLVLMGNLE

SEQ ID NO: 321598 - protein, 38 aa, Mycobacterium
NYLDRMGPGWSTRATLHFLWLRLSRVWPVYLVTLHLAA

SEQ ID NO: 321599 - protein, 38 aa, Mycobacterium
NYLDRMGRSWSTRATLHFLWLRLARVWPVYLVTLHLAA

SEQ ID NO: 321600 - protein, 17 aa, Mycobacterium
NYLVWAILATILCCLPF

SEQ ID NO: 321601 - protein, 19 aa, Mycobacterium
NYNDRIYLPAGIPANQGYA

SEQ ID NO: 321602 - protein, 25 aa, Mycobacterium
NYQMPGGVMMCWAVLAFFAFVIWTL

SEQ ID NO: 321603 - protein, 22 aa, Mycobacterium
NYRFAREGVDYFHISKNTISPF

SEQ ID NO: 321604 - protein, 17 aa, Mycobacterium
NYTEAWATAPFGHFFLN

SEQ ID NO: 321605 - protein, 27 aa, Mycobacterium
NYYVAEFNGTVSIMRGIQGSFLGMSLH

SEQ ID NO: 321606 - protein, 20 aa, Mycobacterium
PAAAMAIGRSVCPMAVQPDG

SEQ ID NO: 321607 - protein, 20 aa, Mycobacterium
PAAAVGLLFMVRSRGLGWSE

SEQ ID NO: 321608 - protein, 23 aa, Mycobacterium
PAAAVLIGKLSWWPTKPPAPEPA

SEQ ID NO: 321609 - protein, 24 aa, Mycobacterium
PAAAWLNRTLGWFFLFASGDGPVD

SEQ ID NO: 321610 - protein, 19 aa, Mycobacterium
PAADRLLVHAGRRIAACVR

SEQ ID NO: 321611 - protein, 18 aa, Mycobacterium
PAAEPAPNPTPARQVPAT

SEQ ID NO: 321612 - protein, 28 aa, Mycobacterium
PAAGASRVEIYWLPAGIAAILVLAELYL

SEQ ID NO: 321613 - protein, 31 aa, Mycobacterium
PAAGGLFAQWGLWRWAFGMLAVITAGIAAMV

SEQ ID NO: 321614 - protein, 27 aa, Mycobacterium
PAAGIGAAMACIWGPLATTATRNLPPS

SEQ ID NO: 321615 - protein, 20 aa, Mycobacterium
PAAGMLTGFLARRYGENARF

SEQ ID NO: 321616 - protein, 18 aa, Mycobacterium
PAAHGPHRSFIPRMIRLF

SEQ ID NO: 321617 - protein, 18 aa, Mycobacterium
PAAICATVGAANLLQGTV

SEQ ID NO: 321618 - protein, 19 aa, Mycobacterium
PAAIESFIAASRFSKELLV

SEQ ID NO: 321619 - protein, 26 aa, Mycobacterium
PAAKNIPLLIAMGVVFFVVYYLMFRF

SEQ ID NO: 321620 - protein, 18 aa, Mycobacterium
PAAKRINLGTLLREPLVG

SEQ ID NO: 321621 - protein, 24 aa, Mycobacterium
PAALIRTATSLAIICERDSGGYYY

SEQ ID NO: 321622 - protein, 25 aa, Mycobacterium
PAALIRTSLSLAIICDRGDGDYYYR

SEQ ID NO: 321623 - protein, 20 aa, Mycobacterium
PAALRIAAVVLMCLVSIALL

SEQ ID NO: 321624 - protein, 27 aa, Mycobacterium
PAALVARVRPPLAWAVPAVLAVRVEPR

SEQ ID NO: 321625 - protein, 22 aa, Mycobacterium
PAALWVWVGLTAVAAAMLVVGW

SEQ ID NO: 321626 - protein, 18 aa, Mycobacterium
PAAMCFAAVALAVGLAAA

SEQ ID NO: 321627 - protein, 18 aa, Mycobacterium
PAAMPVHRGATSAWAVCD

SEQ ID NO: 321628 - protein, 26 aa, Mycobacterium
PAAPPRPVPVPVLAPPVFVPPPRVPV

SEQ ID NO: 321629 - protein, 25 aa, Mycobacterium
PAAPPVAGGALAWSQDDDGVQDPLP

SEQ ID NO: 321630 - protein, 23 aa, Mycobacterium
PAARLSARLDLSSGLSVLLLGTV

SEQ ID NO: 321631 - protein, 17 aa, Mycobacterium
PAARPPVTSRWRWVPAF

SEQ ID NO: 321632 - protein, 21 aa, Mycobacterium
PAARQAWQWFVTEVPQRSLHN

SEQ ID NO: 321633 - protein, 18 aa, Mycobacterium
PAARRVERTWPFGFATGL

SEQ ID NO: 321634 - protein, 23 aa, Mycobacterium
PAARSANPFIFVYNYIKQVVAEM

SEQ ID NO: 321635 - protein, 23 aa, Mycobacterium
PAARVNCLALGPTITENFQSFVL

SEQ ID NO: 321636 - protein, 17 aa, Mycobacterium
PAASFPLAHRFDDRADR

SEQ ID NO: 321637 - protein, 25 aa, Mycobacterium
PAASLSRLAGLWGAAGGFSQLTTVA

SEQ ID NO: 321638 - protein, 17 aa, Mycobacterium
PAATKVGPPRFGAGAKK

SEQ ID NO: 321639 - protein, 32 aa, Mycobacterium
PAATPPPPLFRVAGHRGLRGWQGGHRSADGRR

SEQ ID NO: 321640 - protein, 24 aa, Mycobacterium
PAAVSWAGYLGWFPTLQHTWASWV

SEQ ID NO: 321641 - protein, 28 aa, Mycobacterium
PAAVTIVLAIGVARMAKRRAVVRRLPAV

SEQ ID NO: 321642 - protein, 17 aa, Mycobacterium
PACGAGRSRSLCAAVTL

SEQ ID NO: 321643 - protein, 23 aa, Mycobacterium
PACGCYYSDVYWITFAGMAPADD

SEQ ID NO: 321644 - protein, 19 aa, Mycobacterium
PACQWAVAAQPGMTIPVVA

SEQ ID NO: 321645 - protein, 27 aa, Mycobacterium
PACSVGFLPPSSWRSPADLTDVDTPDG

SEQ ID NO: 321646 - protein, 23 aa, Mycobacterium
PADAMPVRVGVAVVGAIIVFMLI

SEQ ID NO: 321647 - protein, 23 aa, Mycobacterium
PADDPRYVIGIMMDAPQRAADGS

SEQ ID NO: 321648 - protein, 18 aa, Mycobacterium
PADGLRLGDLRVEPLSVD

SEQ ID NO: 321649 - protein, 21 aa, Mycobacterium
PADLFGWFTLAWVFVLGVVSC

SEQ ID NO: 321650 - protein, 23 aa, Mycobacterium
PADLRPGPDQLSFVLLGDPNNPN

SEQ ID NO: 321651 - protein, 23 aa, Mycobacterium
PADLSGGLGDIFTAPARSAAPAR

SEQ ID NO: 321652 - protein, 18 aa, Mycobacterium
PADLSLYDYDGYDDSLDE

SEQ ID NO: 321653 - protein, 25 aa, Mycobacterium
PADPLPRLVAYAGVGVLAAVVIAAA

SEQ ID NO: 321654 - protein, 17 aa, Mycobacterium
PADRPRPARPTGAGGTL

SEQ ID NO: 321655 - protein, 22 aa, Mycobacterium
PADSAAMCFGVSGVAMVFGALA

SEQ ID NO: 321656 - protein, 27 aa, Mycobacterium
PADVGWLRLPGFDWPAHPSWLYRLTQG

SEQ ID NO: 321657 - protein, 20 aa, Mycobacterium
PADWDWIKWLPHNQHPLRLD

SEQ ID NO: 321658 - protein, 24 aa, Mycobacterium
PAEEAIQFLAEVAVARRGEVVAQV

SEQ ID NO: 321659 - protein, 20 aa, Mycobacterium
PAEHPLTAVIHAAGVLDDAV

SEQ ID NO: 321660 - protein, 21 aa, Mycobacterium
PAEIPYLAPNQEWRIVWDSAL

SEQ ID NO: 321661 - protein, 19 aa, Mycobacterium
PAELARWTFHGHTHYLVID

SEQ ID NO: 321662 - protein, 21 aa, Mycobacterium
PAELDRYAADLSRVPDVLGVS

SEQ ID NO: 321663 - protein, 19 aa, Mycobacterium
PAELGWLKDEIAAVVTGLS

SEQ ID NO: 321664 - protein, 24 aa, Mycobacterium
PAELPLREILPAVQRLVIPATSNG

SEQ ID NO: 321665 - protein, 25 aa, Mycobacterium
PAEPHPPEHEWAAAVDEHGGAHRRS

SEQ ID NO: 321666 - protein, 19 aa, Mycobacterium
PAERDLVFERFYRATPARG

SEQ ID NO: 321667 - protein, 22 aa, Mycobacterium
PAEVRDVYFEAVGVILTLIMLG

SEQ ID NO: 321668 - protein, 25 aa, Mycobacterium
PAFAVVAEFSWFIGAGLGAIVYLVV

SEQ ID NO: 321669 - protein, 20 aa, Mycobacterium
PAFFNLVALYGPRKVRIVDG

SEQ ID NO: 321670 - protein, 18 aa, Mycobacterium
PAFKGRVSLLSDTQDGLG

SEQ ID NO: 321671 - protein, 31 aa, Mycobacterium
PAFMRFVRRFAVPILTTWLFMTVAVNVLVPP

SEQ ID NO: 321672 - protein, 17 aa, Mycobacterium
PAFNADRASTLGILTGM

SEQ ID NO: 321673 - protein, 17 aa, Mycobacterium
PAGAEAVDIGGLYERLA

SEQ ID NO: 321674 - protein, 22 aa, Mycobacterium
PAGAEPFVPWFAQSVGNATQVI

SEQ ID NO: 321675 - protein, 18 aa, Mycobacterium
PAGALALGQSVCPMLVEP

SEQ ID NO: 321676 - protein, 23 aa, Mycobacterium
PAGDLRRLLTFCVVWMVIPTALV

SEQ ID NO: 321677 - protein, 26 aa, Mycobacterium
PAGDRRAMMLAHWAWLSMLLAGGAGM

SEQ ID NO: 321678 - protein, 18 aa, Mycobacterium
PAGDVGWGTRIRQILLTG

SEQ ID NO: 321679 - protein, 18 aa, Mycobacterium
PAGEQYINFEGVSDQGPF

SEQ ID NO: 321680 - protein, 17 aa, Mycobacterium
PAGFPMGPPGGFHHGPG

SEQ ID NO: 321681 - protein, 18 aa, Mycobacterium
PAGIAFALAVCVLAVICL

SEQ ID NO: 321682 - protein, 20 aa, Mycobacterium
PAGLLPLVLVTSGVIFAYAA

SEQ ID NO: 321683 - protein, 20 aa, Mycobacterium
PAGLPRWRTLLGNQAVGATL

SEQ ID NO: 321684 - protein, 18 aa, Mycobacterium
PAGLRLAVDNAIANAVKH

SEQ ID NO: 321685 - protein, 23 aa, Mycobacterium
PAGLSPEELHSWVSRGVTAQRHY

SEQ ID NO: 321686 - protein, 18 aa, Mycobacterium
PAGMSAAELARWTYQGHT

SEQ ID NO: 321687 - protein, 17 aa, Mycobacterium
PAGPRQVTYSVTGTKAP

SEQ ID NO: 321688 - protein, 17 aa, Mycobacterium
PAGQPWYTSLWHTIADQ

SEQ ID NO: 321689 - protein, 26 aa, Mycobacterium
PAGRKRLGQRPGLLIGALVSILLLIA

SEQ ID NO: 321690 - protein, 19 aa, Mycobacterium
PAGRLALWTLFWLGWAIAL

SEQ ID NO: 321691 - protein, 22 aa, Mycobacterium
PAGRLRKGAVLERIGTDIDELA

SEQ ID NO: 321692 - protein, 19 aa, Mycobacterium
PAGRPPRTAPIPAAQLRPH

SEQ ID NO: 321693 - protein, 20 aa, Mycobacterium
PAGTFDYWQAWVFIAVFLAG

SEQ ID NO: 321694 - protein, 20 aa, Mycobacterium
PAGTFHYWQAWVFLAIFVVC

SEQ ID NO: 321695 - protein, 24 aa, Mycobacterium
PAGTLHYWQAWVFIAVFTVATIVP

SEQ ID NO: 321696 - protein, 24 aa, Mycobacterium
PAGTLRYWQAWVFIAVFMAATIVP

SEQ ID NO: 321697 - protein, 28 aa, Mycobacterium
PAGTRMATLLAHLAWLATLIVGGAGALI

SEQ ID NO: 321698 - protein, 20 aa, Mycobacterium
PAGVFLGVLAVRRGEAGRGW

SEQ ID NO: 321699 - protein, 18 aa, Mycobacterium
PAGVHFRPFLAALGASLA

SEQ ID NO: 321700 - protein, 18 aa, Mycobacterium
PAGVHFRPFLSALGASVC

SEQ ID NO: 321701 - protein, 25 aa, Mycobacterium
PAGWSFSGPLLWLKSAIVDRDRQYA

SEQ ID NO: 321702 - protein, 25 aa, Mycobacterium
PAHGFPARLWRTLERHPPPGVRRLA

SEQ ID NO: 321703 - protein, 20 aa, Mycobacterium
PAHLEYHAAEFGLSGFIAVS

SEQ ID NO: 321704 - protein, 24 aa, Mycobacterium
PAHLRSGWYRLPARDKAGPLLVVS

SEQ ID NO: 321705 - protein, 21 aa, Mycobacterium
PAHRAAIEFNPPLPTGYQELA

SEQ ID NO: 321706 - protein, 20 aa, Mycobacterium
PAHWRPDQVEALRAALDAEL

SEQ ID NO: 321707 - protein, 23 aa, Mycobacterium
PAIAALVGKANWWPSQVNARQTS

SEQ ID NO: 321708 - protein, 32 aa, Mycobacterium
PAIARILGPWFWWPRVVRWRPAHASGAVLTSA

SEQ ID NO: 321709 - protein, 18 aa, Mycobacterium
PAIARWVQRPRVWWWTAI

SEQ ID NO: 321710 - protein, 25 aa, Mycobacterium
PAIEHDPIRALGPWPGAEPQPVPTT

SEQ ID NO: 321711 - protein, 25 aa, Mycobacterium
PAIGRLADRYGRARVIPLGLALTAA

SEQ ID NO: 321712 - protein, 35 aa, Mycobacterium
PAIPRMPSWWPLDMTWGGLPLFVPVGYISYFVLPA

SEQ ID NO: 321713 - protein, 18 aa, Mycobacterium
PAIQRYFHGSSISSLSWV

SEQ ID NO: 321714 - protein, 21 aa, Mycobacterium
PAISPKKSWEGFAGSLFFGIT

SEQ ID NO: 321715 - protein, 18 aa, Mycobacterium
PAITLYDAALCAVFGALV

SEQ ID NO: 321716 - protein, 23 aa, Mycobacterium
PAKFEVIAKFILGIPLLVLAWMF

SEQ ID NO: 321717 - protein, 20 aa, Mycobacterium
PAKHHILRGLGIPEDHIASS

SEQ ID NO: 321718 - protein, 19 aa, Mycobacterium
PAKIRTRFMPAIDLDHDPD

SEQ ID NO: 321719 - protein, 30 aa, Mycobacterium
PAKMTRPSRPWWRRKAVVITAAALLTVAVT

SEQ ID NO: 321720 - protein, 19 aa, Mycobacterium
PAKPIAVNIIDFGADPDRS

SEQ ID NO: 321721 - protein, 19 aa, Mycobacterium
PAKPIAVNVIDFGADPDRS

SEQ ID NO: 321722 - protein, 20 aa, Mycobacterium
PALAAIMYALPVGRPVTGLP

SEQ ID NO: 321723 - protein, 17 aa, Mycobacterium
PALAAPMIACLVAGCGT

SEQ ID NO: 321724 - protein, 19 aa, Mycobacterium
PALALAGILAFEFNMGVTR

SEQ ID NO: 321725 - protein, 17 aa, Mycobacterium
PALAPVVAVGAALAALG

SEQ ID NO: 321726 - protein, 18 aa, Mycobacterium
PALASFVAEDRFLPRQLT

SEQ ID NO: 321727 - protein, 28 aa, Mycobacterium
PALAVFGRKLFWPFIPAVGDQPLTDSGV

SEQ ID NO: 321728 - protein, 17 aa, Mycobacterium
PALDAHDPYGAGVSAAR

SEQ ID NO: 321729 - protein, 17 aa, Mycobacterium
PALDELIGFFVNTLVLR

SEQ ID NO: 321730 - protein, 20 aa, Mycobacterium
PALDMLLAIIRRTRKGLSPF

SEQ ID NO: 321731 - protein, 26 aa, Mycobacterium
PALEPVWRLTRGRGQVVAVIDTGVAR

SEQ ID NO: 321732 - protein, 22 aa, Mycobacterium
PALFPTNVRYGALAISYNISIS

SEQ ID NO: 321733 - protein, 19 aa, Mycobacterium
PALGMGRLIGIIAVGMVVN

SEQ ID NO: 321734 - protein, 32 aa, Mycobacterium
PALGVSLFLVLGCASGLCLREGLIDLEAAAPK

SEQ ID NO: 321735 - protein, 19 aa, Mycobacterium
PALILGCGIAIFTQLSGIE

SEQ ID NO: 321736 - protein, 23 aa, Mycobacterium
PALIPFVIVQAVFGFSLLEAVNY

SEQ ID NO: 321737 - protein, 18 aa, Mycobacterium
PALIRLFTKQGLGHEIRE

SEQ ID NO: 321738 - protein, 23 aa, Mycobacterium
PALLALFGCGSFVGVHATGRLAD

SEQ ID NO: 321739 - protein, 19 aa, Mycobacterium
PALLGFAGGRVAKFIEPPL

SEQ ID NO: 321740 - protein, 20 aa, Mycobacterium
PALLHLGSLFGLFDPKRRVK

SEQ ID NO: 321741 - protein, 24 aa, Mycobacterium
PALLITIFIYWGFDTAVACNEETD

SEQ ID NO: 321742 - protein, 21 aa, Mycobacterium
PALLLAYLVSAKWPWKTTLLH

SEQ ID NO: 321743 - protein, 18 aa, Mycobacterium
PALLMRRPKVVLVDDLAH

SEQ ID NO: 321744 - protein, 24 aa, Mycobacterium
PALLPRLFERFARADNSRLNGTGT

SEQ ID NO: 321745 - protein, 23 aa, Mycobacterium
PALLPVRSHRVWLALNAAGALLL

SEQ ID NO: 321746 - protein, 20 aa, Mycobacterium
PALLQFIYVRAFASVVDASF

SEQ ID NO: 321747 - protein, 24 aa, Mycobacterium
PALNRWFFELVYWFFDFSGVSSYL

SEQ ID NO: 321748 - protein, 17 aa, Mycobacterium
PALQSVRAMLDRIRSVL

SEQ ID NO: 321749 - protein, 19 aa, Mycobacterium
PALRTPVVYPRGTVATANA

SEQ ID NO: 321750 - protein, 18 aa, Mycobacterium
PALSGLGMILIRLKDDGF

SEQ ID NO: 321751 - protein, 17 aa, Mycobacterium
PALSQRVHWLSKRLSIQ

SEQ ID NO: 321752 - protein, 18 aa, Mycobacterium
PALTRLRTGYGIAAVSVT

SEQ ID NO: 321753 - protein, 18 aa, Mycobacterium
PALVALLLGKTAQADERG

SEQ ID NO: 321754 - protein, 19 aa, Mycobacterium
PALWAAGLVLLGAWMPFNN

SEQ ID NO: 321755 - protein, 24 aa, Mycobacterium
PAMAAMLGQANWWPSKIGASSTRR

SEQ ID NO: 321756 - protein, 17 aa, Mycobacterium
PAMASNYNVHWLFWLVP

SEQ ID NO: 321757 - protein, 18 aa, Mycobacterium
PAMDQLRAALSRLTGLSG

SEQ ID NO: 321758 - protein, 17 aa, Mycobacterium
PAMLQRAIPDYTTAMQH

SEQ ID NO: 321759 - protein, 17 aa, Mycobacterium
PAMPVRVSFLLSGVVLN

SEQ ID NO: 321760 - protein, 18 aa, Mycobacterium
PANSDFYAAARIGIGDQP

SEQ ID NO: 321761 - protein, 19 aa, Mycobacterium
PANVEARITATTAFGAKYV

SEQ ID NO: 321762 - protein, 20 aa, Mycobacterium
PAPAALWLWIMLTGTAAAVL

SEQ ID NO: 321763 - protein, 17 aa, Mycobacterium
PAPAPAWLARLPRPTLA

SEQ ID NO: 321764 - protein, 36 aa, Mycobacterium
PAPAPRKRRLAGKAWAIVALVAAVLFVGSAGFAGAM

SEQ ID NO: 321765 - protein, 18 aa, Mycobacterium
PAPAQFAAPVQRQAPQPQ

SEQ ID NO: 321766 - protein, 20 aa, Mycobacterium
PAPARGWAQDLWRRKINLKP

SEQ ID NO: 321767 - protein, 18 aa, Mycobacterium
PAPARPVAPPSDDTDTDT

SEQ ID NO: 321768 - protein, 17 aa, Mycobacterium
PAPDAFSGIAPEVELIS

SEQ ID NO: 321769 - protein, 22 aa, Mycobacterium
PAPDGLRLSATIDTRFSTTPTT

SEQ ID NO: 321770 - protein, 24 aa, Mycobacterium
PAPDRRPSPRTAVTRLAAATAAGL

SEQ ID NO: 321771 - protein, 18 aa, Mycobacterium
PAPEKKKRRFLRDPLSIL

SEQ ID NO: 321772 - protein, 38 aa, Mycobacterium
PAPEQGRQSPNLKIAVGAVAAILALLLLRRRRRREDSV

SEQ ID NO: 321773 - protein, 18 aa, Mycobacterium
PAPFLLKPGVGEAGSASA

SEQ ID NO: 321774 - protein, 36 aa, Mycobacterium
PAPGRPPLARFLYRFSIPILVLWLGAAGLLNLAVPQ

SEQ ID NO: 321775 - protein, 17 aa, Mycobacterium
PAPGYSREEVLRCAVHA

SEQ ID NO: 321776 - protein, 18 aa, Mycobacterium
PAPHRRNLVLAGATSGVL

SEQ ID NO: 321777 - protein, 21 aa, Mycobacterium
PAPILCATIAIAIVGLATLPG

SEQ ID NO: 321778 - protein, 25 aa, Mycobacterium
PAPKKVRTGPNWGDLLLRVAAGLVL

SEQ ID NO: 321779 - protein, 22 aa, Mycobacterium
PAPKLACLFAVGAFASLGLPGF

SEQ ID NO: 321780 - protein, 27 aa, Mycobacterium
PAPLMAMVFDMVYQPGKLPDSFADYLR

SEQ ID NO: 321781 - protein, 18 aa, Mycobacterium
PAPLRIIVAFGVVVAALA

SEQ ID NO: 321782 - protein, 19 aa, Mycobacterium
PAPNFALEYCLRTDKLPTD

SEQ ID NO: 321783 - protein, 18 aa, Mycobacterium
PAPPGYRVPSYNPTQTDS

SEQ ID NO: 321784 - protein, 26 aa, Mycobacterium
PAPPLWPHSWPFIAQVLAAILVADLG

SEQ ID NO: 321785 - protein, 20 aa, Mycobacterium
PAPPPFQFGDETGYARPDLR

SEQ ID NO: 321786 - protein, 18 aa, Mycobacterium
PAPSGVMHDLRLVAATVI

SEQ ID NO: 321787 - protein, 18 aa, Mycobacterium
PAPTELRRGVAIVNSPLV

SEQ ID NO: 321788 - protein, 40 aa, Mycobacterium
PAPTRAVAGIGVGAAGLWSVLRGHAATWWAQLTGTDMTGT

SEQ ID NO: 321789 - protein, 18 aa, Mycobacterium
PAPWYRTGPAIVGTIAAI

SEQ ID NO: 321790 - protein, 17 aa, Mycobacterium
PAPYGPLFLWIGRGISA

SEQ ID NO: 321791 - protein, 21 aa, Mycobacterium
PAQGAPPWRPESGPFPSAAQP

SEQ ID NO: 321792 - protein, 18 aa, Mycobacterium
PAQIHWYRRHRAMLGVIH

SEQ ID NO: 321793 - protein, 20 aa, Mycobacterium
PAQLWAFWLAPLVGAAIAGV

SEQ ID NO: 321794 - protein, 27 aa, Mycobacterium
PAQPKRRLRLLLTVAAVVLFLDVVTKV

SEQ ID NO: 321795 - protein, 20 aa, Mycobacterium
PAQPWPGQQPEPGRDQPAGG

SEQ ID NO: 321796 - protein, 24 aa, Mycobacterium
PAQRWKAIRGEAGWLTTYAYPPEA

SEQ ID NO: 321797 - protein, 18 aa, Mycobacterium
PARDLAVDFYRVSGVVLI

SEQ ID NO: 321798 - protein, 20 aa, Mycobacterium
PARDRSALTLAVVTSPLDPR

SEQ ID NO: 321799 - protein, 17 aa, Mycobacterium
PARGRLVTMLLVGVVLL

SEQ ID NO: 321800 - protein, 24 aa, Mycobacterium
PARLDDSRFLLPVLGVPPAEGSDG

SEQ ID NO: 321801 - protein, 25 aa, Mycobacterium
PARLDLLTQRYIELTTRIAPTEQRL

SEQ ID NO: 321802 - protein, 28 aa, Mycobacterium
PARLISSLSGFLFALSVSRVILGVVLAP

SEQ ID NO: 321803 - protein, 21 aa, Mycobacterium
PARLPPGRGFLLTRAGDEELV

SEQ ID NO: 321804 - protein, 18 aa, Mycobacterium
PARLVVPGLYGYVSATKW

SEQ ID NO: 321805 - protein, 17 aa, Mycobacterium
PARPVARGVVYGFIGTV

SEQ ID NO: 321806 - protein, 19 aa, Mycobacterium
PARPWYRRGGVVFYAALFL

SEQ ID NO: 321807 - protein, 23 aa, Mycobacterium
PARRITVRVIYALGALFAAVLIV

SEQ ID NO: 321808 - protein, 17 aa, Mycobacterium
PARRLEPDPAVFADEET

SEQ ID NO: 321809 - protein, 24 aa, Mycobacterium
PARRPRPEIGTVRRTGLSGLARGG

SEQ ID NO: 321810 - protein, 22 aa, Mycobacterium
PARSGPKGALVYKLVTTTDHKT

SEQ ID NO: 321811 - protein, 20 aa, Mycobacterium
PARTVVRWIRISVLILTGLV

SEQ ID NO: 321812 - protein, 24 aa, Mycobacterium
PARVREIIELNGPDIYRTTTVTRE

SEQ ID NO: 321813 - protein, 23 aa, Mycobacterium
PARVRELAILRVAHRRACAYEWT

SEQ ID NO: 321814 - protein, 25 aa, Mycobacterium
PARVREVIELNGPDIYRSTTVTREV

SEQ ID NO: 321815 - protein, 20 aa, Mycobacterium
PARYLALFLVLLIGAFLLVF

SEQ ID NO: 321816 - protein, 24 aa, Mycobacterium
PASDINFVLALALFVFICYHAAGI

SEQ ID NO: 321817 - protein, 24 aa, Mycobacterium
PASDINFVLALALFVFVCYHAAGI

SEQ ID NO: 321818 - protein, 23 aa, Mycobacterium
PASGGRYHGIWSMTLAIASVVAP

SEQ ID NO: 321819 - protein, 17 aa, Mycobacterium
PASGLAVGFVHNRLLTP

SEQ ID NO: 321820 - protein, 18 aa, Mycobacterium
PASGRTAVLGAMAVDRPT

SEQ ID NO: 321821 - protein, 19 aa, Mycobacterium
PASGVAFSLVHNRLLTPFV

SEQ ID NO: 321822 - protein, 18 aa, Mycobacterium
PASGWYAQGTTVFFVLAG

SEQ ID NO: 321823 - protein, 17 aa, Mycobacterium
PASLAVAVLALWASARA

SEQ ID NO: 321824 - protein, 20 aa, Mycobacterium
PASLVPLLISQVGGLAAGLV

SEQ ID NO: 321825 - protein, 26 aa, Mycobacterium
PASMGRTFVWAGLWFYPIPIVLGLLG

SEQ ID NO: 321826 - protein, 18 aa, Mycobacterium
PASMLRRAVLALCSVLAQ

SEQ ID NO: 321827 - protein, 25 aa, Mycobacterium
PASPPRIVSPVPRKPVRQPPPVLAP

SEQ ID NO: 321828 - protein, 20 aa, Mycobacterium
PASPVWLPALLTVGLILTVN

SEQ ID NO: 321829 - protein, 19 aa, Mycobacterium
PASRMLRAYGPRRLVRALL

SEQ ID NO: 321830 - protein, 17 aa, Mycobacterium
PASSWLVCDTVSTSSSL

SEQ ID NO: 321831 - protein, 19 aa, Mycobacterium
PASVIKVLVAMEAINNLNL

SEQ ID NO: 321832 - protein, 18 aa, Mycobacterium
PASVTGLFAEKVSRTPEA

SEQ ID NO: 321833 - protein, 19 aa, Mycobacterium
PASWFKERRVVVWAETTRA

SEQ ID NO: 321834 - protein, 26 aa, Mycobacterium
PATAWALEGFGPWSATGIRGAVAAAL

SEQ ID NO: 321835 - protein, 27 aa, Mycobacterium
PATGARLRWVPLRGPSATPAQGLEHAD

SEQ ID NO: 321836 - protein, 24 aa, Mycobacterium
PATLDRFCKRFAPYNFREDMMQPS

SEQ ID NO: 321837 - protein, 25 aa, Mycobacterium
PATLLFFRYYWLRSEPLPSQRPTTT

SEQ ID NO: 321838 - protein, 24 aa, Mycobacterium
PATLLLLRYRWLRAEPLPTPRPVN

SEQ ID NO: 321839 - protein, 24 aa, Mycobacterium
PATLRRIARWGGGWVSAAGLGGLQ

SEQ ID NO: 321840 - protein, 25 aa, Mycobacterium
PATPAPFDGPGMRMMNGLHVHVSAA

SEQ ID NO: 321841 - protein, 24 aa, Mycobacterium
PATRAEFLAAWRLMHDSGMFLGPL

SEQ ID NO: 321842 - protein, 23 aa, Mycobacterium
PATRLPDLAFEWTTHIQDGLTLL

SEQ ID NO: 321843 - protein, 22 aa, Mycobacterium
PATSRPKQQWGHTLAQQAATVS

SEQ ID NO: 321844 - protein, 19 aa, Mycobacterium
PATSWMLYSGIGITIGIVV

SEQ ID NO: 321845 - protein, 17 aa, Mycobacterium
PATTAVGPFYCPVDQTA

SEQ ID NO: 321846 - protein, 17 aa, Mycobacterium
PATVPWAELNEFYREST

SEQ ID NO: 321847 - protein, 17 aa, Mycobacterium
PATYLAFGPPALVISLL

SEQ ID NO: 321848 - protein, 17 aa, Mycobacterium
PAVAAPVIACLVASCGT

SEQ ID NO: 321849 - protein, 20 aa, Mycobacterium
PAVAISMLFTIAAALTLAPA

SEQ ID NO: 321850 - protein, 26 aa, Mycobacterium
PAVATLLGRWFWWPLNVRTRPLPPPR

SEQ ID NO: 321851 - protein, 20 aa, Mycobacterium
PAVDMPTNIVGAAGTIGAMT

SEQ ID NO: 321852 - protein, 19 aa, Mycobacterium
PAVEVVELLNRFFAVIVDE

SEQ ID NO: 321853 - protein, 21 aa, Mycobacterium
PAVGIPLLLILGCASGLCLRE

SEQ ID NO: 321854 - protein, 17 aa, Mycobacterium
PAVKDCAVFGIPDGTNG

SEQ ID NO: 321855 - protein, 19 aa, Mycobacterium
PAVKFLGLALFTLVGAVVV

SEQ ID NO: 321856 - protein, 24 aa, Mycobacterium
PAVLALTLLFGWAIAAVSFGLVES

SEQ ID NO: 321857 - protein, 25 aa, Mycobacterium
PAVLIPALLAILLVIATLVALREFQ

SEQ ID NO: 321858 - protein, 18 aa, Mycobacterium
PAVLSVLVLEDFAMAAYL

SEQ ID NO: 321859 - protein, 18 aa, Mycobacterium
PAVLSVLVLEDFAMAGYL

SEQ ID NO: 321860 - protein, 25 aa, Mycobacterium
PAVLTTIFIYWGWDTAVACNEESDD

SEQ ID NO: 321861 - protein, 18 aa, Mycobacterium
PAVLVVRCTLAVSAVALA

SEQ ID NO: 321862 - protein, 18 aa, Mycobacterium
PAVLVVRCTVVVTAFALA

SEQ ID NO: 321863 - protein, 18 aa, Mycobacterium
PAVLVVRCTVVVTVFALA

SEQ ID NO: 321864 - protein, 25 aa, Mycobacterium
PAVMLGAGLLWFGWFGFNAGSALAA

SEQ ID NO: 321865 - protein, 23 aa, Mycobacterium
PAVPPRTAGAVTYPDQRNSSPGR

SEQ ID NO: 321866 - protein, 21 aa, Mycobacterium
PAVPVPWSVLALFAGGPTLSR

SEQ ID NO: 321867 - protein, 17 aa, Mycobacterium
PAVRPSALISLAVGIVF

SEQ ID NO: 321868 - protein, 33 aa, Mycobacterium
PAVRTGPVWVLRRCVADFSEAPFFGSEWASLGL

SEQ ID NO: 321869 - protein, 23 aa, Mycobacterium
PAVSGDGGVPVWSWYLVAATALA

SEQ ID NO: 321870 - protein, 29 aa, Mycobacterium
PAVSKSYFPGIVEAFGWGLGTLAASDAAS

SEQ ID NO: 321871 - protein, 20 aa, Mycobacterium
PAVTCLALAAAIVLQYRHRG

SEQ ID NO: 321872 - protein, 30 aa, Mycobacterium
PAVTFGTGFAPFFLPLALFIGALIIWMLLK

SEQ ID NO: 321873 - protein, 24 aa, Mycobacterium
PAVTGAALGRWVAARFNWRRPQTL

SEQ ID NO: 321874 - protein, 36 aa, Mycobacterium
PAVTLAMAVFRDFPWRKVLPFSVAQLLGAFAAALIV

SEQ ID NO: 321875 - protein, 18 aa, Mycobacterium
PAVTLGFWVVKILATTLG

SEQ ID NO: 321876 - protein, 24 aa, Mycobacterium
PAVVLAQAIGRLGNYFNQELYGRE

SEQ ID NO: 321877 - protein, 18 aa, Mycobacterium
PAVVSWADFCAGGDGGAA

SEQ ID NO: 321878 - protein, 24 aa, Mycobacterium
PAVWRFDQYYWFTAILTARGFQTA

SEQ ID NO: 321879 - protein, 17 aa, Mycobacterium
PAWLGFLGAVLITTGGL

SEQ ID NO: 321880 - protein, 18 aa, Mycobacterium
PAWLRPRKPAPHIARAHS

SEQ ID NO: 321881 - protein, 22 aa, Mycobacterium
PAWNGIKEVIGLAWEVASDLFA

SEQ ID NO: 321882 - protein, 29 aa, Mycobacterium
PAWRKLGTAIAKWPAAMIAVAALVIPLCI

SEQ ID NO: 321883 - protein, 18 aa, Mycobacterium
PAWRTRAAAVATVANIGG

SEQ ID NO: 321884 - protein, 18 aa, Mycobacterium
PAWVDFWIGVSFVLGPIP

SEQ ID NO: 321885 - protein, 23 aa, Mycobacterium
PAYGETWIMVGVTMTLVVLAGIP

SEQ ID NO: 321886 - protein, 19 aa, Mycobacterium
PAYLWSWPLVFVGQMAVAL

SEQ ID NO: 321887 - protein, 19 aa, Mycobacterium
PAYMCTLLGVSAYDGVILG

SEQ ID NO: 321888 - protein, 24 aa, Mycobacterium
PAYSHNFYLWWLAKAGAVGMAAFV

SEQ ID NO: 321889 - protein, 19 aa, Mycobacterium
PAYTLPWRVHRFAPGELDD

SEQ ID NO: 321890 - protein, 19 aa, Mycobacterium
PAYWILVAIAYIWYHIRDQ

SEQ ID NO: 321891 - protein, 26 aa, Mycobacterium
PCDGVADAPPGWLPAWLRPRKPAPHI

SEQ ID NO: 321892 - protein, 19 aa, Mycobacterium
PCGDPAWVDRAIRLGLWAG

SEQ ID NO: 321893 - protein, 18 aa, Mycobacterium
PCIMLFLHTRYWWAGIAI

SEQ ID NO: 321894 - protein, 19 aa, Mycobacterium
PCLPDHRLTALASGLDVMA

SEQ ID NO: 321895 - protein, 20 aa, Mycobacterium
PCNVGFIPPPLIRSPADEGL

SEQ ID NO: 321896 - protein, 20 aa, Mycobacterium
PCNVGFLPPPLIRSPADETL

SEQ ID NO: 321897 - protein, 25 aa, Mycobacterium
PCSHPHCCSVGYLLRDDRGQWRSLV

SEQ ID NO: 321898 - protein, 20 aa, Mycobacterium
PDAAAALFAARANPGIPARG

SEQ ID NO: 321899 - protein, 24 aa, Mycobacterium
PDAACGLRVGVAYSTIQETEEIPA

SEQ ID NO: 321900 - protein, 24 aa, Mycobacterium
PDAARAAGLATLTRDGFSDGPSVP

SEQ ID NO: 321901 - protein, 29 aa, Mycobacterium
PDAEHARHLLIRLAVAAVLFVPLADLSVM

SEQ ID NO: 321902 - protein, 31 aa, Mycobacterium
PDAISAMLIYRAVSWVFISAIGWVIFFFLFR

SEQ ID NO: 321903 - protein, 19 aa, Mycobacterium
PDALAALLGCITFMTIGAY

SEQ ID NO: 321904 - protein, 21 aa, Mycobacterium
PDALDVDVRWSRDLGSDLLRV

SEQ ID NO: 321905 - protein, 19 aa, Mycobacterium
PDALHQFGYGRSRYFYSFV

SEQ ID NO: 321906 - protein, 17 aa, Mycobacterium
PDAPLTLVEYGDFECPF

SEQ ID NO: 321907 - protein, 20 aa, Mycobacterium
PDAPPPVFPEVTITPPAPTD

SEQ ID NO: 321908 - protein, 23 aa, Mycobacterium
PDAPSGVVTFLFTDVEGSTRRWE

SEQ ID NO: 321909 - protein, 33 aa, Mycobacterium
PDAPTARLMMAWTVLDNKIWIMGGVREGVGLTT

SEQ ID NO: 321910 - protein, 20 aa, Mycobacterium
PDARFAVITFTSRPTVTWPL

SEQ ID NO: 321911 - protein, 21 aa, Mycobacterium
PDARGRVRIGTILVQPDPDAE

SEQ ID NO: 321912 - protein, 21 aa, Mycobacterium
PDARIVPGLVVYRYDAPLCFA

SEQ ID NO: 321913 - protein, 23 aa, Mycobacterium
PDARPRLILGATLIALSVLGLRH

SEQ ID NO: 321914 - protein, 23 aa, Mycobacterium
PDASRITPPMLVAGFAHSVPVTI

SEQ ID NO: 321915 - protein, 18 aa, Mycobacterium
PDATRGWFRAPLHDGLYV

SEQ ID NO: 321916 - protein, 19 aa, Mycobacterium
PDAVGGGFVADGKRLYEEP

SEQ ID NO: 321917 - protein, 18 aa, Mycobacterium
PDAYRKLIDLTLWQRATD

SEQ ID NO: 321918 - protein, 18 aa, Mycobacterium
PDAYRKLVDLTLWQRATD

SEQ ID NO: 321919 - protein, 20 aa, Mycobacterium
PDCGASFTWSTKAFGPYVGW

SEQ ID NO: 321920 - protein, 18 aa, Mycobacterium
PDDLLSIIGTHRQWARQA

SEQ ID NO: 321921 - protein, 25 aa, Mycobacterium
PDDLRFAVAGIARFSETLNQRDAQL

SEQ ID NO: 321922 - protein, 24 aa, Mycobacterium
PDDLRPSALAGFIAHFSTAVEGLV

SEQ ID NO: 321923 - protein, 22 aa, Mycobacterium
PDDRFATCTDFANALEHPQNHA

SEQ ID NO: 321924 - protein, 22 aa, Mycobacterium
PDDRLTAVLPPVRDGDIAPPID

SEQ ID NO: 321925 - protein, 33 aa, Mycobacterium
PDDSRPLLERFLARRLLIKDLRDGEVIVEVALE

SEQ ID NO: 321926 - protein, 24 aa, Mycobacterium
PDDVFWSFLEAIIITAVVMITHCF

SEQ ID NO: 321927 - protein, 24 aa, Mycobacterium
PDDVFWSFLEAIIITAVVMVSHCY

SEQ ID NO: 321928 - protein, 25 aa, Mycobacterium
PDDVFWSFLEAILITAVVMITHCFY

SEQ ID NO: 321929 - protein, 24 aa, Mycobacterium
PDEFVRRLPFMGAKRDFSEPVALN

SEQ ID NO: 321930 - protein, 25 aa, Mycobacterium
PDEKRLFSRMAEVFAGFSEYTDAQV

SEQ ID NO: 321931 - protein, 23 aa, Mycobacterium
PDELYAKVGFVFQDVQLVAGTVR

SEQ ID NO: 321932 - protein, 19 aa, Mycobacterium
PDEMIYCIWALTMIIPAVF

SEQ ID NO: 321933 - protein, 25 aa, Mycobacterium
PDEPTLCWMWERRAGDQSPKTTVLS

SEQ ID NO: 321934 - protein, 24 aa, Mycobacterium
PDERRCAAMAIELITRPSLLVVDE

SEQ ID NO: 321935 - protein, 18 aa, Mycobacterium
PDEVYPLAVGELSVGIGV

SEQ ID NO: 321936 - protein, 21 aa, Mycobacterium
PDFAELFVAIGRLGRSLHVHL

SEQ ID NO: 321937 - protein, 19 aa, Mycobacterium
PDFEFPLAVRGLFARLPVA

SEQ ID NO: 321938 - protein, 23 aa, Mycobacterium
PDFGKASPVGLLIVVLLLISTLF

SEQ ID NO: 321939 - protein, 19 aa, Mycobacterium
PDFLVLRAGRHHVPLATAL

SEQ ID NO: 321940 - protein, 17 aa, Mycobacterium
PDFRISLVSPVTVREGC

SEQ ID NO: 321941 - protein, 17 aa, Mycobacterium
PDFWVTVAGITFADPAG

SEQ ID NO: 321942 - protein, 17 aa, Mycobacterium
PDGAAWFRTGDLGMYLG

SEQ ID NO: 321943 - protein, 27 aa, Mycobacterium
PDGAVGRALCLAIDPDLLVTVNAMTAG

SEQ ID NO: 321944 - protein, 27 aa, Mycobacterium
PDGAVGRALCLAVDPDLLVTVNAMTAG

SEQ ID NO: 321945 - protein, 18 aa, Mycobacterium
PDGFRATTLTLSYNTITL

SEQ ID NO: 321946 - protein, 21 aa, Mycobacterium
PDGGAAFVRRLVTLATTLLVV

SEQ ID NO: 321947 - protein, 21 aa, Mycobacterium
PDGGAAFVRRLVTLTTTLLIV

SEQ ID NO: 321948 - protein, 20 aa, Mycobacterium
PDGHGARYLVQSALNPFTTA

SEQ ID NO: 321949 - protein, 24 aa, Mycobacterium
PDGKTARMLVVFDVEPDSYRALNT

SEQ ID NO: 321950 - protein, 21 aa, Mycobacterium
PDGLQPISPVLAAILRNTNSY

SEQ ID NO: 321951 - protein, 19 aa, Mycobacterium
PDGPAVVLVHGFPDSHVLW

SEQ ID NO: 321952 - protein, 18 aa, Mycobacterium
PDGPGHRGVESFQLPEEI

SEQ ID NO: 321953 - protein, 27 aa, Mycobacterium
PDGPRISFEVGHHRGIIGLLPQTGFPP

SEQ ID NO: 321954 - protein, 17 aa, Mycobacterium
PDGPWAYLNERAEQVRL

SEQ ID NO: 321955 - protein, 20 aa, Mycobacterium
PDGRAARRTALAVIALLSLF

SEQ ID NO: 321956 - protein, 21 aa, Mycobacterium
PDGRAARRTALAVIALLSLFY

SEQ ID NO: 321957 - protein, 22 aa, Mycobacterium
PDGRFSWPAAGVFVTGVVLVAA

SEQ ID NO: 321958 - protein, 17 aa, Mycobacterium
PDGRPGRGITRDRRHML

SEQ ID NO: 321959 - protein, 22 aa, Mycobacterium
PDGRRIPGWTKDRLVHVIQQSI

SEQ ID NO: 321960 - protein, 18 aa, Mycobacterium
PDGRVVILFSDIEESTAL

SEQ ID NO: 321961 - protein, 24 aa, Mycobacterium
PDGSHGMYSWLHFSLATAVALIAW

SEQ ID NO: 321962 - protein, 24 aa, Mycobacterium
PDGSHGMYSWLHFWIATSCALAAW

SEQ ID NO: 321963 - protein, 18 aa, Mycobacterium
PDGSHGMYSWLHVSLATT

SEQ ID NO: 321964 - protein, 20 aa, Mycobacterium
PDGSIDWLGAVGLAGGLSAV

SEQ ID NO: 321965 - protein, 17 aa, Mycobacterium
PDGTGIGLSSYFYTLML

SEQ ID NO: 321966 - protein, 19 aa, Mycobacterium
PDGTYPCSIRVESLSAGYS

SEQ ID NO: 321967 - protein, 19 aa, Mycobacterium
PDGWATLFLPQLPYLPLGN

SEQ ID NO: 321968 - protein, 18 aa, Mycobacterium
PDGYDPALLIAEVQNAGY

SEQ ID NO: 321969 - protein, 18 aa, Mycobacterium
PDGYLERQVRRWGSQWDL

SEQ ID NO: 321970 - protein, 24 aa, Mycobacterium
PDGYLQRQVRRWGSQWDLVRLPDD

SEQ ID NO: 321971 - protein, 18 aa, Mycobacterium
PDGYYLRIGRIATVGATV

SEQ ID NO: 321972 - protein, 17 aa, Mycobacterium
PDHLAALELRRYPAADL

SEQ ID NO: 321973 - protein, 18 aa, Mycobacterium
PDHLEALATLALDMSEAV

SEQ ID NO: 321974 - protein, 25 aa, Mycobacterium
PDHRGRVRINTVLVCPTEPVEPELH

SEQ ID NO: 321975 - protein, 25 aa, Mycobacterium
PDHRPPRAPVWVAMYGVTSLLLAAL

SEQ ID NO: 321976 - protein, 17 aa, Mycobacterium
PDHYDWFSDYLGARGLK

SEQ ID NO: 321977 - protein, 20 aa, Mycobacterium
PDIARKGFSSVLWVGPPNAS

SEQ ID NO: 321978 - protein, 17 aa, Mycobacterium
PDICFLWDEAWYAFATA

SEQ ID NO: 321979 - protein, 17 aa, Mycobacterium
PDILDDLSRSMVVAVDN

SEQ ID NO: 321980 - protein, 22 aa, Mycobacterium
PDIPGVPWWGAILIAVAGTLFG

SEQ ID NO: 321981 - protein, 24 aa, Mycobacterium
PDIPGVPWYAALLFAVTATAIGYG

SEQ ID NO: 321982 - protein, 22 aa, Mycobacterium
PDIPQALWLIGCLVVLVCSLAM

SEQ ID NO: 321983 - protein, 24 aa, Mycobacterium
PDITVRWMYWWGLFITAADILIAL

SEQ ID NO: 321984 - protein, 20 aa, Mycobacterium
PDKARAALAQGTFPAMAIVL

SEQ ID NO: 321985 - protein, 18 aa, Mycobacterium
PDKARAALTQGAFPLLAV

SEQ ID NO: 321986 - protein, 17 aa, Mycobacterium
PDKAVLVGIDLDQTFGD

SEQ ID NO: 321987 - protein, 26 aa, Mycobacterium
PDKFPADTTVVSWLPLFHDMGLILGI

SEQ ID NO: 321988 - protein, 32 aa, Mycobacterium
PDKKVAAIGFCMGGGLVWRLLAAGTPELAAAF

SEQ ID NO: 321989 - protein, 20 aa, Mycobacterium
PDKPAWWVRHYTFFGTATGL

SEQ ID NO: 321990 - protein, 17 aa, Mycobacterium
PDLARQVAKIAAPSVSS

SEQ ID NO: 321991 - protein, 20 aa, Mycobacterium
PDLIARMLAELSRLLCAETL

SEQ ID NO: 321992 - protein, 21 aa, Mycobacterium
PDLICSVICWLLLSREVLPRL

SEQ ID NO: 321993 - protein, 20 aa, Mycobacterium
PDLLFAVLFVRALGIGVLPG

SEQ ID NO: 321994 - protein, 17 aa, Mycobacterium
PDLLKWSMVVFTVVEGV

SEQ ID NO: 321995 - protein, 17 aa, Mycobacterium
PDLLSLLLEASYDDGSQ

SEQ ID NO: 321996 - protein, 20 aa, Mycobacterium
PDLQAAWRVLHALPAAAAAT

SEQ ID NO: 321997 - protein, 23 aa, Mycobacterium
PDLQGADQLLVRWQQANDRINSY

SEQ ID NO: 321998 - protein, 20 aa, Mycobacterium
PDLRTAVVSIDPRTGAVKAY

SEQ ID NO: 321999 - protein, 19 aa, Mycobacterium
PDLSGPVPRPPRRSDAAQG

SEQ ID NO: 322000 - protein, 27 aa, Mycobacterium
PDLTMFPRADWLRALRRAFQVTPHSEL

SEQ ID NO: 322001 - protein, 17 aa, Mycobacterium
PDLVASVGSLARVTGRL

SEQ ID NO: 322002 - protein, 23 aa, Mycobacterium
PDMFVNGCVLSWDDVVQPECASG

SEQ ID NO: 322003 - protein, 20 aa, Mycobacterium
PDMRAAVVSIDPRTGGIKAY

SEQ ID NO: 322004 - protein, 19 aa, Mycobacterium
PDMRSAVVSIDPKTGGIKA

SEQ ID NO: 322005 - protein, 24 aa, Mycobacterium
PDNTARLLGGAALVVAALGIALAL

SEQ ID NO: 322006 - protein, 26 aa, Mycobacterium
PDNTEGGWKLGFYASSRASQLRRMRA

SEQ ID NO: 322007 - protein, 27 aa, Mycobacterium
PDNTESRWKLGLYAAGRASQMRRLRAP

SEQ ID NO: 322008 - protein, 26 aa, Mycobacterium
PDNTESRWKLGLYAASRASQMRRLRT

SEQ ID NO: 322009 - protein, 31 aa, Mycobacterium
PDPALGWGVLDPLAALTWNVADPVPTRPVNE

SEQ ID NO: 322010 - protein, 21 aa, Mycobacterium
PDPAVITLIIRKGRTFVPQPH

SEQ ID NO: 322011 - protein, 25 aa, Mycobacterium
PDPDRRADLAMTWLLAGLAAGILSG

SEQ ID NO: 322012 - protein, 27 aa, Mycobacterium
PDPDRRADLAMTWLVAGLVAGILSGAV

SEQ ID NO: 322013 - protein, 24 aa, Mycobacterium
PDPDRREDLAMTWLLAGLAAGVLS

SEQ ID NO: 322014 - protein, 33 aa, Mycobacterium
PDPEPARTIAWSRVLVFAVIPAVALLLAAGSAF

SEQ ID NO: 322015 - protein, 17 aa, Mycobacterium
PDPEPDWEPSGDGGSAE

SEQ ID NO: 322016 - protein, 30 aa, Mycobacterium
PDPGRWPWPTFAVNIVGAFLLGYFTTRLLE

SEQ ID NO: 322017 - protein, 21 aa, Mycobacterium
PDPHSFAVLFAPPRLAAQLTG

SEQ ID NO: 322018 - protein, 18 aa, Mycobacterium
PDPILPMPTKRSGYIDTD

SEQ ID NO: 322019 - protein, 17 aa, Mycobacterium
PDPLGWVGNQVRFRHRT

SEQ ID NO: 322020 - protein, 26 aa, Mycobacterium
PDPLRSRLRSLLLLLVLGSAALAATV

SEQ ID NO: 322021 - protein, 22 aa, Mycobacterium
PDPNLRPQIVGVFTDLTGPAPD

SEQ ID NO: 322022 - protein, 22 aa, Mycobacterium
PDPNLRPQIVGVFTDLTGPAPP

SEQ ID NO: 322023 - protein, 19 aa, Mycobacterium
PDPNLRPQIVGVFTQLSGP

SEQ ID NO: 322024 - protein, 20 aa, Mycobacterium
PDPRIDRSRIKMTMEKVDGR

SEQ ID NO: 322025 - protein, 24 aa, Mycobacterium
PDPRIDRSRIKMTMEYVDGRWRAA

SEQ ID NO: 322026 - protein, 17 aa, Mycobacterium
PDPRPSAVHTMLFAQFW

SEQ ID NO: 322027 - protein, 25 aa, Mycobacterium
PDPRRRSTMIGAWGVVGGIGIASAP

SEQ ID NO: 322028 - protein, 25 aa, Mycobacterium
PDPSDDRRVLAYTYRGGWGDPTSSA

SEQ ID NO: 322029 - protein, 25 aa, Mycobacterium
PDPVFPRWVGHYSLATAAAMIPAAG

SEQ ID NO: 322030 - protein, 18 aa, Mycobacterium
PDQLARRLVHLVVPAQVA

SEQ ID NO: 322031 - protein, 29 aa, Mycobacterium
PDQPNPWYKQPAVLIALAGAGVAVVAVIA

SEQ ID NO: 322032 - protein, 19 aa, Mycobacterium
PDRAFSAAIAVLVIACPCA

SEQ ID NO: 322033 - protein, 19 aa, Mycobacterium
PDRCIAGACIAQLAPDLSR

SEQ ID NO: 322034 - protein, 24 aa, Mycobacterium
PDRDRLIFSYHFLLLDGWSREQLL

SEQ ID NO: 322035 - protein, 18 aa, Mycobacterium
PDRFLLLVVEGTDEDPVA

SEQ ID NO: 322036 - protein, 17 aa, Mycobacterium
PDRHIWLALNLAVLIAV

SEQ ID NO: 322037 - protein, 25 aa, Mycobacterium
PDRLEALCRGGLTPIGLLGLADTPR

SEQ ID NO: 322038 - protein, 19 aa, Mycobacterium
PDRLRPALVAELADAETRV

SEQ ID NO: 322039 - protein, 26 aa, Mycobacterium
PDRLSGLSWRDWLLAVVVIAVIRPAA

SEQ ID NO: 322040 - protein, 18 aa, Mycobacterium
PDRMVPPAEEIVRKTTFV

SEQ ID NO: 322041 - protein, 30 aa, Mycobacterium
PDRPAVWKPPRGRVASWFAEPDKKRNRILL

SEQ ID NO: 322042 - protein, 31 aa, Mycobacterium
PDRPPYLGWEPFQPVDAGVFFGRDAEVARAM

SEQ ID NO: 322043 - protein, 19 aa, Mycobacterium
PDRPRGHRAGSPSRSQRSA

SEQ ID NO: 322044 - protein, 18 aa, Mycobacterium
PDRPVVVSVVGLVHSPGL

SEQ ID NO: 322045 - protein, 18 aa, Mycobacterium
PDRPVVVSVVGLVHTPGL

SEQ ID NO: 322046 - protein, 25 aa, Mycobacterium
PDRPWAWTAGRGWLQVLPGLVAVLG

SEQ ID NO: 322047 - protein, 20 aa, Mycobacterium
PDRRAEVSSTYFVVAYVAIS

SEQ ID NO: 322048 - protein, 23 aa, Mycobacterium
PDRRRDLAMTWLLAGLVAGVLSG

SEQ ID NO: 322049 - protein, 19 aa, Mycobacterium
PDRRRFFGTAAVFALGSAG

SEQ ID NO: 322050 - protein, 17 aa, Mycobacterium
PDRWDVIGALACLVGVA

SEQ ID NO: 322051 - protein, 25 aa, Mycobacterium
PDRYPLKGIFHAAGVLDDAVLASLT

SEQ ID NO: 322052 - protein, 19 aa, Mycobacterium
PDSPPKWLPDRLRPTASRV

SEQ ID NO: 322053 - protein, 19 aa, Mycobacterium
PDSTIPIELPFTGLADPHG

SEQ ID NO: 322054 - protein, 30 aa, Mycobacterium
PDSWGIALLYLCCSGSFLGFAFAFGEVLGH

SEQ ID NO: 322055 - protein, 17 aa, Mycobacterium
PDSWPSQADFVAGDIRD

SEQ ID NO: 322056 - protein, 19 aa, Mycobacterium
PDTALARGAALASANTPLF

SEQ ID NO: 322057 - protein, 21 aa, Mycobacterium
PDTALWPWLAACIAAVAPLSL

SEQ ID NO: 322058 - protein, 20 aa, Mycobacterium
PDTHRDSWRRRTRPQHAGTD

SEQ ID NO: 322059 - protein, 17 aa, Mycobacterium
PDTRLRKDLTWLDLVVF

SEQ ID NO: 322060 - protein, 25 aa, Mycobacterium
PDTRPRLILGSSLIALSFLGLRHLW

SEQ ID NO: 322061 - protein, 24 aa, Mycobacterium
PDTRPRLILGSSLIASSFLGLRHL

SEQ ID NO: 322062 - protein, 19 aa, Mycobacterium
PDTSFAWAFVLALLAAALA

SEQ ID NO: 322063 - protein, 19 aa, Mycobacterium
PDTSFAWSFVLALLAAALA

SEQ ID NO: 322064 - protein, 19 aa, Mycobacterium
PDTSFAWSFVLALLAAALT

SEQ ID NO: 322065 - protein, 19 aa, Mycobacterium
PDTSLSRWLPADEPSGPSA

SEQ ID NO: 322066 - protein, 20 aa, Mycobacterium
PDVALLWALIQIYRQSQVFG

SEQ ID NO: 322067 - protein, 20 aa, Mycobacterium
PDVEAITLSPAWNLAATSRM

SEQ ID NO: 322068 - protein, 18 aa, Mycobacterium
PDVLRPDINVAYTDTDGT

SEQ ID NO: 322069 - protein, 20 aa, Mycobacterium
PDVLRPDLTVAYTDTDGHGQ

SEQ ID NO: 322070 - protein, 20 aa, Mycobacterium
PDVPPGVIVDALVAGTHQGI

SEQ ID NO: 322071 - protein, 20 aa, Mycobacterium
PDVPSKQYGGSWYRSPFLVT

SEQ ID NO: 322072 - protein, 17 aa, Mycobacterium
PDVQLIAVPGTWESSPQ

SEQ ID NO: 322073 - protein, 20 aa, Mycobacterium
PDVREYFVARALRILPGYYI

SEQ ID NO: 322074 - protein, 26 aa, Mycobacterium
PDVTAWRWMYGVGVLPAVAVIVGRFF

SEQ ID NO: 322075 - protein, 25 aa, Mycobacterium
PDVWWSARADYTLTRVRIVPGAAPT

SEQ ID NO: 322076 - protein, 18 aa, Mycobacterium
PDVYLPIWQAFAESGVKV

SEQ ID NO: 322077 - protein, 18 aa, Mycobacterium
PDWARPAVGGVVLGLLLL

SEQ ID NO: 322078 - protein, 17 aa, Mycobacterium
PDWLRPVGSRRASAPVP

SEQ ID NO: 322079 - protein, 24 aa, Mycobacterium
PDWVITRPRLTGICGSDSKQILMD

SEQ ID NO: 322080 - protein, 23 aa, Mycobacterium
PDWVRSRIGVVPRHDAVPDCLTV

SEQ ID NO: 322081 - protein, 20 aa, Mycobacterium
PDYDARMFPSPANMQQLPLV

SEQ ID NO: 322082 - protein, 21 aa, Mycobacterium
PDYRFTFANERTFLAWQRTAL

SEQ ID NO: 322083 - protein, 26 aa, Mycobacterium
PDYRVLGALPLAYAVVVSGVLIKNKR

SEQ ID NO: 322084 - protein, 19 aa, Mycobacterium
PDYYRLRFGRSVEIGASIL

SEQ ID NO: 322085 - protein, 22 aa, Mycobacterium
PEAAGTLCASWAGGRAGVALLA

SEQ ID NO: 322086 - protein, 26 aa, Mycobacterium
PEAEPWAEYDEMPMDPLSEFVPEQAE

SEQ ID NO: 322087 - protein, 23 aa, Mycobacterium
PEAGDFTALPGRGVRARVAGHVV

SEQ ID NO: 322088 - protein, 20 aa, Mycobacterium
PEAIALIVVIVRYLEPFTTI

SEQ ID NO: 322089 - protein, 17 aa, Mycobacterium
PEAKWVVFYSLGPGADG

SEQ ID NO: 322090 - protein, 17 aa, Mycobacterium
PEALETVWINKDKAFSS

SEQ ID NO: 322091 - protein, 26 aa, Mycobacterium
PEALLVPGMSSGVVPLRLTTSPYTSV

SEQ ID NO: 322092 - protein, 35 aa, Mycobacterium
PEALPAAACALALVALAYWLSRFGYLAVGVPLGAA

SEQ ID NO: 322093 - protein, 25 aa, Mycobacterium
PEALRFGGVWWAFVFPLGMYSAATE

SEQ ID NO: 322094 - protein, 20 aa, Mycobacterium
PEALRPLAQEPRVQRPDPQP

SEQ ID NO: 322095 - protein, 17 aa, Mycobacterium
PEAPEVITALRAGGYQV

SEQ ID NO: 322096 - protein, 25 aa, Mycobacterium
PEAQWRSVTATGHYLSDVQVLARLR

SEQ ID NO: 322097 - protein, 17 aa, Mycobacterium
PEATGAWLIRDQEEDDT

SEQ ID NO: 322098 - protein, 19 aa, Mycobacterium
PECPTKALAGINCPGCGTL

SEQ ID NO: 322099 - protein, 20 aa, Mycobacterium
PEDINLCIAYDPAAHDVSEL

SEQ ID NO: 322100 - protein, 17 aa, Mycobacterium
PEDLFKVQRTLLARYHV

SEQ ID NO: 322101 - protein, 21 aa, Mycobacterium
PEDLHALLIREHVTVITQTPS

SEQ ID NO: 322102 - protein, 25 aa, Mycobacterium
PEDMRARETVGWMRAELPKVQQLGT

SEQ ID NO: 322103 - protein, 24 aa, Mycobacterium
PEDMRARETVGWMRAQLPKVPDRG

SEQ ID NO: 322104 - protein, 22 aa, Mycobacterium
PEDPKWSWLKWLPHTQHQTDTD

SEQ ID NO: 322105 - protein, 21 aa, Mycobacterium
PEDRWAITVAACIFALTVPAG

SEQ ID NO: 322106 - protein, 18 aa, Mycobacterium
PEDVAAWDVGNSAIARRN

SEQ ID NO: 322107 - protein, 18 aa, Mycobacterium
PEDVAAWEAGNKYVARRN

SEQ ID NO: 322108 - protein, 18 aa, Mycobacterium
PEDVQAWEGTGGKAPGKE

SEQ ID NO: 322109 - protein, 18 aa, Mycobacterium
PEEDLVRWDGRIDDPAGG

SEQ ID NO: 322110 - protein, 36 aa, Mycobacterium
PEERAAALIRPAVMYIVIGAYGWVRLPTGQRLSHYG

SEQ ID NO: 322111 - protein, 23 aa, Mycobacterium
PEERRLVFERFYRSDAARAMPGS

SEQ ID NO: 322112 - protein, 20 aa, Mycobacterium
PEERVDEFLAWQKDIVAAES

SEQ ID NO: 322113 - protein, 18 aa, Mycobacterium
PEEYCERGTPSSGGTFIY

SEQ ID NO: 322114 - protein, 25 aa, Mycobacterium
PEFGVKISPFPAAVIAFSLNVGGYA

SEQ ID NO: 322115 - protein, 19 aa, Mycobacterium
PEFMRRRFGPGAHLVNAIS

SEQ ID NO: 322116 - protein, 18 aa, Mycobacterium
PEFRRRFHRETAVAANLY

SEQ ID NO: 322117 - protein, 19 aa, Mycobacterium
PEFVPWLRWVIAASAVLAA

SEQ ID NO: 322118 - protein, 22 aa, Mycobacterium
PEFVQPYLPIAVVAALDAVFGG

SEQ ID NO: 322119 - protein, 19 aa, Mycobacterium
PEGAVGEIWLHGPNVGAGY

SEQ ID NO: 322120 - protein, 17 aa, Mycobacterium
PEGDPDLRGQTPREPRR

SEQ ID NO: 322121 - protein, 19 aa, Mycobacterium
PEGERALVFDRFARGSTAS

SEQ ID NO: 322122 - protein, 28 aa, Mycobacterium
PEGLPAIMSVVLALGMRRMAGQNAVVKE

SEQ ID NO: 322123 - protein, 17 aa, Mycobacterium
PEGLPLVATLAQLSAAR

SEQ ID NO: 322124 - protein, 19 aa, Mycobacterium
PEGLRRLDTVDALLIDPRV

SEQ ID NO: 322125 - protein, 21 aa, Mycobacterium
PEGPEAPAAPGKTPAPGLPPL

SEQ ID NO: 322126 - protein, 17 aa, Mycobacterium
PEGPEIYLVVDDYDLVA

SEQ ID NO: 322127 - protein, 26 aa, Mycobacterium
PEGPKSPRWLWIAAGAAVLLVVALVI

SEQ ID NO: 322128 - protein, 26 aa, Mycobacterium
PEGPKTPRWLWIAAGAAVVLVIGLVI

SEQ ID NO: 322129 - protein, 44 aa, Mycobacterium
PEGPWLRTGDLGFLCDGELFIVGRMKDLLIVYGRNHYPEDIEST

SEQ ID NO: 322130 - protein, 19 aa, Mycobacterium
PEGPWLRTGDLGVVSEGEL

SEQ ID NO: 322131 - protein, 44 aa, Mycobacterium
PEGPWLRTGDSGFYFDGELFIIGRIKDLLIVYGRNHSPDDIEAT

SEQ ID NO: 322132 - protein, 25 aa, Mycobacterium
PEGQIAVGSLITWVLIERAITSRRL

SEQ ID NO: 322133 - protein, 20 aa, Mycobacterium
PEGQILSFHIAIPICTMAVF

SEQ ID NO: 322134 - protein, 32 aa, Mycobacterium
PEGRPGCWQPITRDLWPFPYLVMDTGASIAPY

SEQ ID NO: 322135 - protein, 21 aa, Mycobacterium
PEGRSIVVYAKQHFGLRARTP

SEQ ID NO: 322136 - protein, 18 aa, Mycobacterium
PEGRSIVVYAKQQYGLRA

SEQ ID NO: 322137 - protein, 18 aa, Mycobacterium
PEGRSKMWADKVPRFPSM

SEQ ID NO: 322138 - protein, 26 aa, Mycobacterium
PEGSAAWWLARLEWVAILSVVTAAEI

SEQ ID NO: 322139 - protein, 29 aa, Mycobacterium
PEGWGYRPAAVGLFAFVWMELASPNSASL

SEQ ID NO: 322140 - protein, 20 aa, Mycobacterium
PEHLREAIFSRGVTSKPDVP

SEQ ID NO: 322141 - protein, 19 aa, Mycobacterium
PEIDARLAARGAPDQPLER

SEQ ID NO: 322142 - protein, 20 aa, Mycobacterium
PEIPLGSWLADLPDERLIQL

SEQ ID NO: 322143 - protein, 23 aa, Mycobacterium
PEKFAEMLEMFGLGQRTGVGLPG

SEQ ID NO: 322144 - protein, 25 aa, Mycobacterium
PEKLGKAAEQWGQLVGIVLPMLSGN

SEQ ID NO: 322145 - protein, 23 aa, Mycobacterium
PEKLSLLLACVAEIMAIVLSVYV

SEQ ID NO: 322146 - protein, 26 aa, Mycobacterium
PEKSWRKRLPTIFIDVARIALICVGL

SEQ ID NO: 322147 - protein, 22 aa, Mycobacterium
PEKTFPEWLRPYVRNQPISQFA

SEQ ID NO: 322148 - protein, 20 aa, Mycobacterium
PELFGPLGAGIGGQVLAGSV

SEQ ID NO: 322149 - protein, 21 aa, Mycobacterium
PELGTTIGLLPAWKVVLILLL

SEQ ID NO: 322150 - protein, 17 aa, Mycobacterium
PELGVLYPSELATGMRI

SEQ ID NO: 322151 - protein, 18 aa, Mycobacterium
PELGVLYPSELSPGMRIY

SEQ ID NO: 322152 - protein, 21 aa, Mycobacterium
PELLQGWPLDARTDIYSLGCT

SEQ ID NO: 322153 - protein, 30 aa, Mycobacterium
PELLSGHRVCDWTGCGLGGVLAGLGDGSPD

SEQ ID NO: 322154 - protein, 22 aa, Mycobacterium
PELLVRMVTRAMSAPAAPHPRR

SEQ ID NO: 322155 - protein, 21 aa, Mycobacterium
PELLVRMVTRAMSAPSAQQPQ

SEQ ID NO: 322156 - protein, 24 aa, Mycobacterium
PELMTLEKIAAWAITEPDSGSDAF

SEQ ID NO: 322157 - protein, 26 aa, Mycobacterium
PELNTMIGVLPRWQPVAILSVLAVLG

SEQ ID NO: 322158 - protein, 32 aa, Mycobacterium; identical to SEQ ID NO: 14056

SEQ ID NO: 322159 - protein, 32 aa, Mycobacterium
PELPRVIPPSFLRRAMPYVLVILIVGMVVALF

SEQ ID NO: 322160 - protein, 21 aa, Mycobacterium
PELQPFVQRVMRIHVTEEARH

SEQ ID NO: 322161 - protein, 23 aa, Mycobacterium
PELRQRAAGFIGFTIGGPLSDGL

SEQ ID NO: 322162 - protein, 20 aa, Mycobacterium
PELRVAGLLPGVIAESQRRH

SEQ ID NO: 322163 - protein, 18 aa, Mycobacterium
PELVESMGSIAKVVRQLS

SEQ ID NO: 322164 - protein, 21 aa, Mycobacterium
PELVGTMGWLAGLWRDVLGTT

SEQ ID NO: 322165 - protein, 19 aa, Mycobacterium
PELYACILVALGGVAWSQS

SEQ ID NO: 322166 - protein, 17 aa, Mycobacterium
PELYRITYDGSIADEPH

SEQ ID NO: 322167 - protein, 18 aa, Mycobacterium
PEMIRLMMRGEKSPSGVS

SEQ ID NO: 322168 - protein, 18 aa, Mycobacterium
PEMREWLRNWVGRAVGKS

SEQ ID NO: 322169 - protein, 17 aa, Mycobacterium
PEMYAMNTALAFGSDAA

SEQ ID NO: 322170 - protein, 31 aa, Mycobacterium
PENAASPWRAIGKRILIAVGTLFAAVLVVYA

SEQ ID NO: 322171 - protein, 25 aa, Mycobacterium
PENPLPRRLAFLGAGVCLIAVVVVA

SEQ ID NO: 322172 - protein, 18 aa, Mycobacterium
PENQVVAVPAHWHPAAFD

SEQ ID NO: 322173 - protein, 18 aa, Mycobacterium
PENVRPVLPVVKAAAAVG

SEQ ID NO: 322174 - protein, 24 aa, Mycobacterium
PEPAREVATVLGLDEVYAQQTPAD

SEQ ID NO: 322175 - protein, 30 aa, Mycobacterium
PEPDAAAAQPWYRRRGAVVGAGAAAVVAVI

SEQ ID NO: 322176 - protein, 20 aa, Mycobacterium
PEPDADWIIDGHKMWIGNGG

SEQ ID NO: 322177 - protein, 25 aa, Mycobacterium
PEPFLNWPYWWAGVFELVLGSLLTV

SEQ ID NO: 322178 - protein, 27 aa, Mycobacterium
PEPFMYTYCRDVHPGVLVRGAKNAPRP

SEQ ID NO: 322179 - protein, 20 aa, Mycobacterium
PEPKRPGWRHEHSYFPRPGP

SEQ ID NO: 322180 - protein, 25 aa, Mycobacterium
PEPLERRRAWLHKLTPGKVVVAVVG

SEQ ID NO: 322181 - protein, 25 aa, Mycobacterium
PEPLKYRRGFVTGHQVTGWRFVMRR

SEQ ID NO: 322182 - protein, 21 aa, Mycobacterium
PEPLLAAAVLLRPRLPRVLAA

SEQ ID NO: 322183 - protein, 24 aa, Mycobacterium
PEPNINVRLAIEWLDKYSDGLSLT

SEQ ID NO: 322184 - protein, 33 aa, Mycobacterium
PEPPRRSNTFWLWVVGIGALVVIIALIITLVLL

SEQ ID NO: 322185 - protein, 29 aa, Mycobacterium
PEPPVIPWYRLPAVIIVSTVVAVLLVGTA

SEQ ID NO: 322186 - protein, 23 aa, Mycobacterium
PEPSESFDVIGMLLLSPGLATFL

SEQ ID NO: 322187 - protein, 25 aa, Mycobacterium
PEPTEGGLVRTARWAGSTVSIPADI

SEQ ID NO: 322188 - protein, 23 aa, Mycobacterium
PEPTELNLALAVPVTLVLIASSF

SEQ ID NO: 322189 - protein, 35 aa, Mycobacterium
PEPTPWYRRPAMLIAWLISVVILIGLIVFGIIELI

SEQ ID NO: 322190 - protein, 18 aa, Mycobacterium
PEPTRQPIAQSFWYRTAK

SEQ ID NO: 322191 - protein, 17 aa, Mycobacterium
PEPVPVPVEQRFWYRCA

SEQ ID NO: 322192 - protein, 22 aa, Mycobacterium
PEQAPQFWRMRLTVEENAGQAK

SEQ ID NO: 322193 - protein, 23 aa, Mycobacterium
PEQLRLGPYAVMHAIAHEVVSHY

SEQ ID NO: 322194 - protein, 19 aa, Mycobacterium
PEQPPTLFLNPLPGSQYDA

SEQ ID NO: 322195 - protein, 20 aa, Mycobacterium
PEQRKSSLPGENVVQEPIRR

SEQ ID NO: 322196 - protein, 24 aa, Mycobacterium
PEQRPRAWRMRITVQQVGDEAKVA

SEQ ID NO: 322197 - protein, 18 aa, Mycobacterium
PEQWRMSGVRKYTTRALC

SEQ ID NO: 322198 - protein, 20 aa, Mycobacterium
PERALCAPAAALLLYLQPLT

SEQ ID NO: 322199 - protein, 19 aa, Mycobacterium
PERFRQALFRALAAVVEIW

SEQ ID NO: 322200 - protein, 20 aa, Mycobacterium
PERFRQALFRALASLVEIWM

SEQ ID NO: 322201 - protein, 23 aa, Mycobacterium
PERLPGAIRWTAGALRQAREYLS

SEQ ID NO: 322202 - protein, 23 aa, Mycobacterium
PERNRAVAFAIVLLVALAASTSL

SEQ ID NO: 322203 - protein, 24 aa, Mycobacterium
PERPPRPIWLPVLGDPTPVDELVA

SEQ ID NO: 322204 - protein, 17 aa, Mycobacterium
PERRGTAMGVWGAVAGI

SEQ ID NO: 322205 - protein, 21 aa, Mycobacterium
PERRHQVVIIGSGFGGLNAAK

SEQ ID NO: 322206 - protein, 19 aa, Mycobacterium
PERRRPALAVLTGCVVVVT

SEQ ID NO: 322207 - protein, 17 aa, Mycobacterium
PESEFAMRLYAVSLDQL

SEQ ID NO: 322208 - protein, 20 aa, Mycobacterium
PESGPSRREWVLERRWEIVR

SEQ ID NO: 322209 - protein, 25 aa, Mycobacterium
PESIRIGVMSLIWLGTLPFMTLAVL

SEQ ID NO: 322210 - protein, 21 aa, Mycobacterium
PESLNSLTAPMLETFAVTLER

SEQ ID NO: 322211 - protein, 18 aa, Mycobacterium
PESLPDNALLVLDTDDEW

SEQ ID NO: 322212 - protein, 19 aa, Mycobacterium
PESLSELVRLRVDGLAEDV

SEQ ID NO: 322213 - protein, 25 aa, Mycobacterium
PESLYPALLGFILLSAVAATLLVAM

SEQ ID NO: 322214 - protein, 22 aa, Mycobacterium
PESPIRIAARIDVFGALLLGGG

SEQ ID NO: 322215 - protein, 20 aa, Mycobacterium
PESPRFLLRRRRFEDARKAV

SEQ ID NO: 322216 - protein, 28 aa, Mycobacterium
PESWQGTYRIAFWVGVGLAALVALLSLI

SEQ ID NO: 322217 - protein, 28 aa, Mycobacterium
PESWQGTYRVAFWVGVGLAVLVALLSLV

SEQ ID NO: 322218 - protein, 25 aa, Mycobacterium
PESYSLPLRRLLGFLAAGLDASLIP

SEQ ID NO: 322219 - protein, 18 aa, Mycobacterium
PETAHTYTRCAGRIATLA

SEQ ID NO: 322220 - protein, 19 aa, Mycobacterium
PETALARGAALASAHAPLF

SEQ ID NO: 322221 - protein, 26 aa, Mycobacterium
PETDKPVWITMLWPLADRPRLAPGVP

SEQ ID NO: 322222 - protein, 19 aa, Mycobacterium
PETFNVIFVDMKFESAAQD

SEQ ID NO: 322223 - protein, 19 aa, Mycobacterium
PETLLRPPVPQAPAQLPRP

SEQ ID NO: 322224 - protein, 17 aa, Mycobacterium
PETMPGVAPADRPPSGG

SEQ ID NO: 322225 - protein, 19 aa, Mycobacterium
PETPIWRLVLPFFATGVGM

SEQ ID NO: 322226 - protein, 23 aa, Mycobacterium
PETRVPAPSAWWVLIAGVIGLVA

SEQ ID NO: 322227 - protein, 20 aa, Mycobacterium
PETWWSRALPVGFSAASLLL

SEQ ID NO: 322228 - protein, 17 aa, Mycobacterium
PETYVFVWLGFYGGIMG

SEQ ID NO: 322229 - protein, 21 aa, Mycobacterium
PEVGKSVGVLGTMFVNLIKMM

SEQ ID NO: 322230 - protein, 18 aa, Mycobacterium
PEVGLRYTLFAFFVVVLA

SEQ ID NO: 322231 - protein, 17 aa, Mycobacterium
PEVGLVLMDIMMPVMDG

SEQ ID NO: 322232 - protein, 26 aa, Mycobacterium
PEVHKAAPLWTVYAFNGFIVVVVGAL

SEQ ID NO: 322233 - protein, 27 aa, Mycobacterium
PEVIPLSFAQNRLWFVDQLQGPSPVYN

SEQ ID NO: 322234 - protein, 29 aa, Mycobacterium
PEVLNLLLIDFKGGATFLDLEKAPHVAAV

SEQ ID NO: 322235 - protein, 19 aa, Mycobacterium
PEVPKRQWGLPLAATAAAV

SEQ ID NO: 322236 - protein, 21 aa, Mycobacterium
PEVPRATPVPVVTRVLPVVLV

SEQ ID NO: 322237 - protein, 22 aa, Mycobacterium
PEVPRLCKVHLLVGDDTLIDYV

SEQ ID NO: 322238 - protein, 24 aa, Mycobacterium
PEVRRLIRRLFPALVVVLTACAGL

SEQ ID NO: 322239 - protein, 17 aa, Mycobacterium
PEVSAKLIAALRAERPR

SEQ ID NO: 322240 - protein, 23 aa, Mycobacterium
PEVVEPYLPIAVVAALDAVFGGL

SEQ ID NO: 322241 - protein, 23 aa, Mycobacterium
PEVVVLAAFAWSAPLLMHDDLKR

SEQ ID NO: 322242 - protein, 18 aa, Mycobacterium
PEWSGGSECLSLVSDAAG

SEQ ID NO: 322243 - protein, 24 aa, Mycobacterium
PEWTGSKWSVPIGMYEKDLSTVML

SEQ ID NO: 322244 - protein, 19 aa, Mycobacterium
PEYLVFGAISIATLGWLWG

SEQ ID NO: 322245 - protein, 20 aa, Mycobacterium
PEYRSVPDLSAAARDGKPNV

SEQ ID NO: 322246 - protein, 25 aa, Mycobacterium
PFAALGVGMAMLWSPLAATASRNLP

SEQ ID NO: 322247 - protein, 24 aa, Mycobacterium
PFAAMGAGMAFVWSPLAATATRNL

SEQ ID NO: 322248 - protein, 22 aa, Mycobacterium
PFACKRPIIDQGYYETFNRDNV

SEQ ID NO: 322249 - protein, 17 aa, Mycobacterium
PFADFLDRLAFSRSPQL

SEQ ID NO: 322250 - protein, 19 aa, Mycobacterium
PFAELGLNSLMAMAIRREA

SEQ ID NO: 322251 - protein, 32 aa, Mycobacterium
PFAGALMDRWDRRLVIVGANIGRLILIAGIGT

SEQ ID NO: 322252 - protein, 31 aa, Mycobacterium
PFAGALMDRWDRRLVIVGANVGRLILIAAIG

SEQ ID NO: 322253 - protein, 30 aa, Mycobacterium
PFAGALMDRWDRRLVLVGANAGRLILIAAI

SEQ ID NO: 322254 - protein, 30 aa, Mycobacterium
PFAGALMDRWDRRLVLVGASIGRLAFIAGI

SEQ ID NO: 322255 - protein, 20 aa, Mycobacterium
PFAPAPVVSLGFAVVAVGIA

SEQ ID NO: 322256 - protein, 17 aa, Mycobacterium
PFAQTAFTSALPWMAGR

SEQ ID NO: 322257 - protein, 20 aa, Mycobacterium
PFAVAAGVAAVWAQKYQDYT

SEQ ID NO: 322258 - protein, 26 aa, Mycobacterium
PFDNGLRPEPIIALGSLVTYVLIERS

SEQ ID NO: 322259 - protein, 26 aa, Mycobacterium
PFDNGLRPEPIIAVGSLITYVLIERS

SEQ ID NO: 322260 - protein, 26 aa, Mycobacterium
PFEAADVRQVWSAHMFAAPPRPSIMR

SEQ ID NO: 322261 - protein, 23 aa, Mycobacterium
PFEAAGIEFVVWRAEAPRDATLR

SEQ ID NO: 322262 - protein, 17 aa, Mycobacterium
PFEGARIYLGGSAATYN

SEQ ID NO: 322263 - protein, 18 aa, Mycobacterium
PFEMIKFRTMVDGADGML

SEQ ID NO: 322264 - protein, 19 aa, Mycobacterium
PFEPYPACRTWADEALQRI

SEQ ID NO: 322265 - protein, 18 aa, Mycobacterium
PFFARAVRVLALPIVAFW

SEQ ID NO: 322266 - protein, 19 aa, Mycobacterium
PFFGIRWGYPDDRVLPASS

SEQ ID NO: 322267 - protein, 19 aa, Mycobacterium
PFFLMDFVEGVVPPDVMPY

SEQ ID NO: 322268 - protein, 25 aa, Mycobacterium
PFFLRRFGIKTVMLMSMVAWTLRFG

SEQ ID NO: 322269 - protein, 19 aa, Mycobacterium
PFFRSRPSALLAVTSLTVV

SEQ ID NO: 322270 - protein, 18 aa, Mycobacterium
PFFWLLSTGEGWAVLVAM

SEQ ID NO: 322271 - protein, 23 aa, Mycobacterium
PFGEYLPWRGFFKHLSSYADRAG

SEQ ID NO: 322272 - protein, 25 aa, Mycobacterium
PFGFASLRIASYALWPFGRTIVDKP

SEQ ID NO: 322273 - protein, 24 aa, Mycobacterium
PFGLENWTLLALEILVITGAVLAL

SEQ ID NO: 322274 - protein, 17 aa, Mycobacterium
PFGPVVSVFGHRTPLQL

SEQ ID NO: 322275 - protein, 18 aa, Mycobacterium
PFGPVVSVFGHRTPLQLT

SEQ ID NO: 322276 - protein, 18 aa, Mycobacterium
PFHQAAWVNLKHGTATMD

SEQ ID NO: 322277 - protein, 19 aa, Mycobacterium
PFHVSRIALEGSLLDALQL

SEQ ID NO: 322278 - protein, 17 aa, Mycobacterium
PFIAWPPALPVAMWLLA

SEQ ID NO: 322279 - protein, 17 aa, Mycobacterium
PFIAWPPALPVAMWVLA

SEQ ID NO: 322280 - protein, 20 aa, Mycobacterium
PFIGRWDALGFLQDFFATAV

SEQ ID NO: 322281 - protein, 19 aa, Mycobacterium
PFIIISVLFYFTVVVQEEM

SEQ ID NO: 322282 - protein, 24 aa, Mycobacterium
PFIQQESWHAWAHQVVLDHLAEQG

SEQ ID NO: 322283 - protein, 23 aa, Mycobacterium
PFISPSRKIAMRLLYATGALFAA

SEQ ID NO: 322284 - protein, 21 aa, Mycobacterium
PFLDLRFFRSIPFTTATINAI

SEQ ID NO: 322285 - protein, 21 aa, Mycobacterium
PFLGVRWGFPDERVLPRSASA

SEQ ID NO: 322286 - protein, 28 aa, Mycobacterium
PFLLGFRLTCYYYRKAYYRSVWQSPTGC

SEQ ID NO: 322287 - protein, 21 aa, Mycobacterium
PFLLIMGGFMYFASRRQKRAM

SEQ ID NO: 322288 - protein, 30 aa, Mycobacterium; identical to SEQ ID NO: 17025

SEQ ID NO: 322289 - protein, 24 aa, Mycobacterium
PFLRASLAGPRRWGPWLRKRIASA

SEQ ID NO: 322290 - protein, 19 aa, Mycobacterium
PFLVMELIEGGTLRELLRE

SEQ ID NO: 322291 - protein, 27 aa, Mycobacterium
PFLVPRGARLDPALMLLAVFSGIAAFG

SEQ ID NO: 322292 - protein, 20 aa, Mycobacterium
PFLYTYCRDDDPAVLIRGAR

SEQ ID NO: 322293 - protein, 26 aa, Mycobacterium
PFLYYKGGAIPAMYLWALAGIMLITL

SEQ ID NO: 322294 - protein, 32 aa, Mycobacterium
PFMFGSPYAIFLLREHFRIIPNDLINAAFLDG

SEQ ID NO: 322295 - protein, 18 aa, Mycobacterium
PFMGWLYNFLPVYTFSAL

SEQ ID NO: 322296 - protein, 19 aa, Mycobacterium
PFMRPSFDISKVLPESAQS

SEQ ID NO: 322297 - protein, 20 aa, Mycobacterium
PFNALMLDLDWRIRTGRPLV

SEQ ID NO: 322298 - protein, 23 aa, Mycobacterium
PFNVRRIPPPVVEPGPDRGPITI

SEQ ID NO: 322299 - protein, 28 aa, Mycobacterium
PFPLVVACLVCFLIGFAGLLWLPMHGTA

SEQ ID NO: 322300 - protein, 20 aa, Mycobacterium
PFPRVGVCVDRNGVARYDEL

SEQ ID NO: 322301 - protein, 18 aa, Mycobacterium
PFQYWSWANLASVVCAIG

SEQ ID NO: 322302 - protein, 19 aa, Mycobacterium
PFRAGERIGSLFSTHPPIE

SEQ ID NO: 322303 - protein, 19 aa, Mycobacterium
PFRALRHRGLFGVGVTALL

SEQ ID NO: 322304 - protein, 25 aa, Mycobacterium
PFRTVFRHRAYKAALFSNFATGWAS

SEQ ID NO: 322305 - protein, 25 aa, Mycobacterium
PFRVPWREQVFLSWAGLRGAVPIVL

SEQ ID NO: 322306 - protein, 17 aa, Mycobacterium
PFSNLTAPWGITVDSAG

SEQ ID NO: 322307 - protein, 18 aa, Mycobacterium
PFSPGWLLTAIVWATTAT

SEQ ID NO: 322308 - protein, 18 aa, Mycobacterium
PFSWVWPALSLVVLQLLV

SEQ ID NO: 322309 - protein, 17 aa, Mycobacterium
PFTDQIAAFKLIMLALW

SEQ ID NO: 322310 - protein, 27 aa, Mycobacterium
PFVAPADLGANCQYPAAGEASKPVEPP

SEQ ID NO: 322311 - protein, 24 aa, Mycobacterium
PFVELRFFRSIPFASATAIAVCAF

SEQ ID NO: 322312 - protein, 19 aa, Mycobacterium
PFVGIWLIDLVVRFIPGIG

SEQ ID NO: 322313 - protein, 21 aa, Mycobacterium
PFVILIGLIVSRQWKLLGAYA

SEQ ID NO: 322314 - protein, 26 aa, Mycobacterium
PFVMLGAALLWFGWFGFNVGSEGAAD

SEQ ID NO: 322315 - protein, 25 aa, Mycobacterium
PFVMLGAGLLWFGWYGFNAGSATSA

SEQ ID NO: 322316 - protein, 30 aa, Mycobacterium
PFVPRTIRRFAVLVLLLWLAYTAIVNLAVP

SEQ ID NO: 322317 - protein, 20 aa, Mycobacterium
PFVSAALFAWAGESWPLSVY

SEQ ID NO: 322318 - protein, 18 aa, Mycobacterium
PFVVFGYVMFYFGPYFPA

SEQ ID NO: 322319 - protein, 23 aa, Mycobacterium
PFWPRLLVACVVGFLPIYLANIA

SEQ ID NO: 322320 - protein, 18 aa, Mycobacterium
PFYPPGWFWIGGRAAALS

SEQ ID NO: 322321 - protein, 18 aa, Mycobacterium
PFYPPGWFWIGGRAAALT

SEQ ID NO: 322322 - protein, 19 aa, Mycobacterium
PFYPPGWFWIGGRAAALTG

SEQ ID NO: 322323 - protein, 18 aa, Mycobacterium
PFYRCYETADGKYMAVGA

SEQ ID NO: 322324 - protein, 27 aa, Mycobacterium
PGAALATWLPFLLVLASMTYVLFAQVF

SEQ ID NO: 322325 - protein, 18 aa, Mycobacterium
PGAARLATVVAERPRYIN

SEQ ID NO: 322326 - protein, 17 aa, Mycobacterium
PGAESMVGLLINTVPVR

SEQ ID NO: 322327 - protein, 19 aa, Mycobacterium
PGAIYASGLFESWIVIGLV

SEQ ID NO: 322328 - protein, 22 aa, Mycobacterium
PGALPALPALFIIVDEFTELLS

SEQ ID NO: 322329 - protein, 20 aa, Mycobacterium
PGALWWSLALGTDFGGNLTA

SEQ ID NO: 322330 - protein, 31 aa, Mycobacterium
PGAMPNFLVGLRLGLSSAWLSLIFAEMINTT

SEQ ID NO: 322331 - protein, 22 aa, Mycobacterium
PGANPRPAAPLISADTKAAISV

SEQ ID NO: 322332 - protein, 18 aa, Mycobacterium
PGANQWMMTAEVGVTNFV

SEQ ID NO: 322333 - protein, 17 aa, Mycobacterium
PGAPAAMPVHRGATSAW

SEQ ID NO: 322334 - protein, 18 aa, Mycobacterium
PGAPEFHLATGTGAGLPD

SEQ ID NO: 322335 - protein, 18 aa, Mycobacterium
PGAPEFHLATRAGAGFPD

SEQ ID NO: 322336 - protein, 24 aa, Mycobacterium
PGAPESRIPVLIALVTAICLQLAI

SEQ ID NO: 322337 - protein, 18 aa, Mycobacterium
PGAPIWQLVLPFAALGVG

SEQ ID NO: 322338 - protein, 22 aa, Mycobacterium
PGAPLAERACMLYAGTTMVAGT

SEQ ID NO: 322339 - protein, 22 aa, Mycobacterium
PGAPLAERTCMLYAGTTVIAGT

SEQ ID NO: 322340 - protein, 21 aa, Mycobacterium
PGARIVGWGWLALTIVGVPWL

SEQ ID NO: 322341 - protein, 20 aa, Mycobacterium
PGARMYRTGDLVRWGDDGQL

SEQ ID NO: 322342 - protein, 22 aa, Mycobacterium
PGASEAEMWEALRVAAADDFVR

SEQ ID NO: 322343 - protein, 17 aa, Mycobacterium
PGASLWALNKTIFPTHS

SEQ ID NO: 322344 - protein, 17 aa, Mycobacterium
PGASWYWLLAGPIAAVS

SEQ ID NO: 322345 - protein, 27 aa, Mycobacterium
PGAVSGPLWRLCGSTAIGLLLLILTPT

SEQ ID NO: 322346 - protein, 17 aa, Mycobacterium
PGAVVLKAGDARAARGT

SEQ ID NO: 322347 - protein, 24 aa, Mycobacterium
PGCDLREARQAGAIQTYLGPEYTF

SEQ ID NO: 322348 - protein, 19 aa, Mycobacterium
PGCECGSVPVARRLFGDGA

SEQ ID NO: 322349 - protein, 18 aa, Mycobacterium
PGCTVGFLPPSQWRSPAD

SEQ ID NO: 322350 - protein, 17 aa, Mycobacterium
PGCWQPITHDLWPAPFL

SEQ ID NO: 322351 - protein, 22 aa, Mycobacterium
PGDAGGRWLLRHVTLSLEPGET

SEQ ID NO: 322352 - protein, 19 aa, Mycobacterium
PGDGLWMIVLSCIVYGMAF

SEQ ID NO: 322353 - protein, 27 aa, Mycobacterium
PGDGSCFRLTLPLVRGHKVTTSPLPMK

SEQ ID NO: 322354 - protein, 30 aa, Mycobacterium
PGDGTAGPWPRWWCAAAALGVALVAALPWL

SEQ ID NO: 322355 - protein, 25 aa, Mycobacterium
PGDGWRRARVAGLGLGVAVAAACPW

SEQ ID NO: 322356 - protein, 18 aa, Mycobacterium
PGDPAVLVANTFGAGDFV

SEQ ID NO: 322357 - protein, 17 aa, Mycobacterium
PGDPAVTVANTFSTEDF

SEQ ID NO: 322358 - protein, 24 aa, Mycobacterium
PGDPEVWHLLNWHALEELEHKSVA

SEQ ID NO: 322359 - protein, 17 aa, Mycobacterium
PGDRVALQMTAHLATPP

SEQ ID NO: 322360 - protein, 19 aa, Mycobacterium
PGDVGWLKLPTFDWPTDPS

SEQ ID NO: 322361 - protein, 18 aa, Mycobacterium
PGDVGWLKLPTFDWPTNP

SEQ ID NO: 322362 - protein, 26 aa, Mycobacterium
PGDVIVFKGPPSWNVGYKSIRSSNTA

SEQ ID NO: 322363 - protein, 19 aa, Mycobacterium
PGDVIVFRGPPSWNVGYKS

SEQ ID NO: 322364 - protein, 32 aa, Mycobacterium
PGDYRPNLFVTYWSFRAMIGFLAVPGLFALAA

SEQ ID NO: 322365 - protein, 32 aa, Mycobacterium
PGDYRPNLFVTYWSFRAMIGLLLVPVAFALVT

SEQ ID NO: 322366 - protein, 19 aa, Mycobacterium
PGEASLLVASYPEVPKRQW

SEQ ID NO: 322367 - protein, 18 aa, Mycobacterium
PGEDDMFTAPGAVGHDPQ

SEQ ID NO: 322368 - protein, 25 aa, Mycobacterium
PGEFARRLPLMAAHRDFSTPTALNW

SEQ ID NO: 322369 - protein, 23 aa, Mycobacterium
PGEGCCFRVTLPRISDVHAQHAV

SEQ ID NO: 322370 - protein, 21 aa, Mycobacterium
PGEGCCFRVTLPRVSEAAVEL

SEQ ID NO: 322371 - protein, 30 aa, Mycobacterium
PGEKAWVMVCVLIAFPMRIAAAIGLLQMRR

SEQ ID NO: 322372 - protein, 33 aa, Mycobacterium
PGEKSMVFGMILTVFAMRCAAAIGFLQMKRWGH

SEQ ID NO: 322373 - protein, 18 aa, Mycobacterium
PGELAIERGEPWPKPVPE

SEQ ID NO: 322374 - protein, 18 aa, Mycobacterium
PGELLAVAVRPGCSQTDP

SEQ ID NO: 322375 - protein, 20 aa, Mycobacterium
PGELRITLMRADVLAEPIAL

SEQ ID NO: 322376 - protein, 19 aa, Mycobacterium
PGELRITLMRADVLAEPIV

SEQ ID NO: 322377 - protein, 23 aa, Mycobacterium
PGELRSYPIAAFMWSSAIVGAPL

SEQ ID NO: 322378 - protein, 31 aa, Mycobacterium
PGEPRRALLRITRWDVGIAMLVAGAVNLSML

SEQ ID NO: 322379 - protein, 20 aa, Mycobacterium
PGEQQPGGYRDGRDGRDSDD

SEQ ID NO: 322380 - protein, 19 aa, Mycobacterium
PGESTFYWLTLTLAAVWAL

SEQ ID NO: 322381 - protein, 18 aa, Mycobacterium
PGEVPERVPVTFVNHLSG

SEQ ID NO: 322382 - protein, 23 aa, Mycobacterium
PGFARSELHFSRAAILAAGALGA

SEQ ID NO: 322383 - protein, 21 aa, Mycobacterium
PGFIACLMVAVAVSLFTARED

SEQ ID NO: 322384 - protein, 18 aa, Mycobacterium
PGFSCEWLQPPASTSDER

SEQ ID NO: 322385 - protein, 21 aa, Mycobacterium
PGFVPDPDYTWVPRTKVETPR

SEQ ID NO: 322386 - protein, 22 aa, Mycobacterium
PGFVPDPNYTWVPRTNVETRAP

SEQ ID NO: 322387 - protein, 30 aa, Mycobacterium
PGGAALGYFWGWRAALWAVVLVSVPALAAI

SEQ ID NO: 322388 - protein, 21 aa, Mycobacterium
PGGAPGCWQSITHDFWPAPEL

SEQ ID NO: 322389 - protein, 18 aa, Mycobacterium
PGGAPGYVFFVSGTTAAH

SEQ ID NO: 322390 - protein, 17 aa, Mycobacterium
PGGFGFGLGNLILLGNV

SEQ ID NO: 322391 - protein, 25 aa, Mycobacterium
PGGGPVKPKAGAVLDLNTATVQDLD

SEQ ID NO: 322392 - protein, 28 aa, Mycobacterium
PGGKPGCWKTITRDLWPAPYLVTDSGSS

SEQ ID NO: 322393 - protein, 23 aa, Mycobacterium
PGGMPLDEVVPIITAVASALDYS

SEQ ID NO: 322394 - protein, 42 aa, Mycobacterium
PGGPRGARAARPWPDWIQQINWKWVRRSVGLAAAVMILLPIV

SEQ ID NO: 322395 - protein, 26 aa, Mycobacterium
PGGRGGYQWISDTGVRYGIDTEAEGD

SEQ ID NO: 322396 - protein, 17 aa, Mycobacterium
PGGSDPASWLGRAAAAA

SEQ ID NO: 322397 - protein, 20 aa, Mycobacterium
PGGTVARVAAGFFAVAVTGV

SEQ ID NO: 322398 - protein, 18 aa, Mycobacterium
PGGVEKLADEQGWTEADQ

SEQ ID NO: 322399 - protein, 18 aa, Mycobacterium
PGGYDPRPFDPFDEGASC

SEQ ID NO: 322400 - protein, 28 aa, Mycobacterium
PGHSDLGWLWWFGAGWVAVAVVGAGVIV

SEQ ID NO: 322401 - protein, 24 aa, Mycobacterium
PGHWDRLAVCWQLAQTHGLAIAAL

SEQ ID NO: 322402 - protein, 18 aa, Mycobacterium
PGIFPGEQQPGGYRDGRD

SEQ ID NO: 322403 - protein, 17 aa, Mycobacterium
PGIGIALMLGLGALMFV

SEQ ID NO: 322404 - protein, 21 aa, Mycobacterium
PGIIDDLWPPKLPDLPIPGLP

SEQ ID NO: 322405 - protein, 19 aa, Mycobacterium
PGILDRIRDRLSRVGDPVV

SEQ ID NO: 322406 - protein, 17 aa, Mycobacterium
PGIPGYLDEQWVAEAVA

SEQ ID NO: 322407 - protein, 32 aa, Mycobacterium
PGKEQDVIVVWGFPFGKAKPGDEVTIRISDFA

SEQ ID NO: 322408 - protein, 24 aa, Mycobacterium
PGKLDWAGTLTFGIGLTVLLTGIT

SEQ ID NO: 322409 - protein, 22 aa, Mycobacterium
PGKRAPTVKLCESDEQYVPLND

SEQ ID NO: 322410 - protein, 17 aa, Mycobacterium
PGKRVLIGATLLVTMFP

SEQ ID NO: 322411 - protein, 20 aa, Mycobacterium
PGKYTHAAAVDKVRELQSAG

SEQ ID NO: 322412 - protein, 20 aa, Mycobacterium
PGLALPFLLVGGFGGLIMVA

SEQ ID NO: 322413 - protein, 17 aa, Mycobacterium
PGLALSGFVERVADNEP

SEQ ID NO: 322414 - protein, 28 aa, Mycobacterium
PGLALSLAVAAGFLKWQGGSARTAQLAA

SEQ ID NO: 322415 - protein, 18 aa, Mycobacterium
PGLARRIISLALPALGVL

SEQ ID NO: 322416 - protein, 25 aa, Mycobacterium
PGLAWLPLFVVFGVLTGLLGAAYNV

SEQ ID NO: 322417 - protein, 18 aa, Mycobacterium
PGLDAIGIPANFAGGLSL

SEQ ID NO: 322418 - protein, 18 aa, Mycobacterium
PGLDELAGTELLLDALAG

SEQ ID NO: 322419 - protein, 21 aa, Mycobacterium
PGLDLPRIAGIGALSGMGFTI

SEQ ID NO: 322420 - protein, 19 aa, Mycobacterium
PGLFGLSAVVVRRLPGWPI

SEQ ID NO: 322421 - protein, 24 aa, Mycobacterium
PGLGLAAVRRGRIHRVGVQQDAAA

SEQ ID NO: 322422 - protein, 19 aa, Mycobacterium
PGLGRLVFNSVAARDYPVI

SEQ ID NO: 322423 - protein, 19 aa, Mycobacterium
PGLISGAVLAFARSLGEFG

SEQ ID NO: 322424 - protein, 18 aa, Mycobacterium
PGLLPRLLPVAISVVSIG

SEQ ID NO: 322425 - protein, 31 aa, Mycobacterium
PGLLSRFLIALEVLWWAPGAFLEAIVTGQYL

SEQ ID NO: 322426 - protein, 17 aa, Mycobacterium
PGLLTTRYCKIPMEAQN

SEQ ID NO: 322427 - protein, 18 aa, Mycobacterium
PGLMGRFGDVLGLPFAFE

SEQ ID NO: 322428 - protein, 30 aa, Mycobacterium
PGLMSILALAELQWRSGRLALTFVLGHIGA

SEQ ID NO: 322429 - protein, 19 aa, Mycobacterium
PGLNDAIALLLVIAVGTAV

SEQ ID NO: 322430 - protein, 20 aa, Mycobacterium
PGLPDFTWPPKIDIPDWNLP

SEQ ID NO: 322431 - protein, 26 aa, Mycobacterium
PGLPEFEWPSIPGLPDFGLPNLPGLP

SEQ ID NO: 322432 - protein, 23 aa, Mycobacterium
PGLPIETILPFISMFAVSNTALI

SEQ ID NO: 322433 - protein, 19 aa, Mycobacterium
PGLPLWPYLACAALTGCGG

SEQ ID NO: 322434 - protein, 22 aa, Mycobacterium
PGLPLWPYLVCAAFTGLGGGNY

SEQ ID NO: 322435 - protein, 20 aa, Mycobacterium
PGLPLWPYLVCAALAGFGGG

SEQ ID NO: 322436 - protein, 20 aa, Mycobacterium
PGLPLWPYLVCAALSGLGGG

SEQ ID NO: 322437 - protein, 20 aa, Mycobacterium
PGLPLWPYLVCAALTGLGGG

SEQ ID NO: 322438 - protein, 25 aa, Mycobacterium
PGLPLWPYLVCAALTGLGGGNFSAS

SEQ ID NO: 322439 - protein, 24 aa, Mycobacterium
PGLPLWPYLVCAALTGLGGGNYAA

SEQ ID NO: 322440 - protein, 24 aa, Mycobacterium
PGLPLWPYLVCAALTGLGGGNYSA

SEQ ID NO: 322441 - protein, 20 aa, Mycobacterium
PGLPLWPYLVCAALTGMGGA

SEQ ID NO: 322442 - protein, 25 aa, Mycobacterium
PGLPLWPYLVCAVLTGLGGGNFSAS

SEQ ID NO: 322443 - protein, 25 aa, Mycobacterium
PGLPLWPYVVCAALTGLGGGNYAAS

SEQ ID NO: 322444 - protein, 20 aa, Mycobacterium
PGLPNIPGLPDFKWPPVPGI

SEQ ID NO: 322445 - protein, 20 aa, Mycobacterium
PGLPNIPGLPDFTWPPKIDI

SEQ ID NO: 322446 - protein, 25 aa, Mycobacterium
PGLPNRFMLVGPYSWTGTSFHYILE

SEQ ID NO: 322447 - protein, 25 aa, Mycobacterium
PGLQEKLAFVWELPDNALATGDVVT

SEQ ID NO: 322448 - protein, 21 aa, Mycobacterium
PGLRRKAPIYVLEDAPWSAFR

SEQ ID NO: 322449 - protein, 24 aa, Mycobacterium
PGLRYRSGGPFADAVAAVRAGRRP

SEQ ID NO: 322450 - protein, 17 aa, Mycobacterium
PGLTATRFVANPFDGAG

SEQ ID NO: 322451 - protein, 27 aa, Mycobacterium
PGLVGGPWRWDRWVPSSPWAEPSSFVI

SEQ ID NO: 322452 - protein, 26 aa, Mycobacterium
PGLYKKERRFAVAFVIPAAVLFVAGA

SEQ ID NO: 322453 - protein, 19 aa, Mycobacterium
PGMAERFAQMRAMGIRTVM

SEQ ID NO: 322454 - protein, 18 aa, Mycobacterium
PGMGRELLAASPVFAEHM

SEQ ID NO: 322455 - protein, 17 aa, Mycobacterium
PGMPLPRLLEVNAEAVT

SEQ ID NO: 322456 - protein, 24 aa, Mycobacterium
PGMPRRLRWVSPFIPLVAGPLPVA

SEQ ID NO: 322457 - protein, 19 aa, Mycobacterium
PGMRHPFELTITPGDGASN

SEQ ID NO: 322458 - protein, 25 aa, Mycobacterium
PGPAAWPDLLCDKLVANMSHKQWHD

SEQ ID NO: 322459 - protein, 31 aa, Mycobacterium
PGPFRRRLLRVTRWDVGLAMVLAGGVNAAML

SEQ ID NO: 322460 - protein, 18 aa, Mycobacterium
PGPGGSVLPAGRLVPYDL

SEQ ID NO: 322461 - protein, 18 aa, Mycobacterium
PGPIPYPGAPPYGAQQYA

SEQ ID NO: 322462 - protein, 19 aa, Mycobacterium
PGPKIGAFFDLDGTLVAGF

SEQ ID NO: 322463 - protein, 19 aa, Mycobacterium
PGPLARAGLATAVLAESAA

SEQ ID NO: 322464 - protein, 19 aa, Mycobacterium
PGPLSWFFHHLPKPLHRVE

SEQ ID NO: 322465 - protein, 17 aa, Mycobacterium
PGPLVAEELPVVVRASE

SEQ ID NO: 322466 - protein, 17 aa, Mycobacterium
PGPLVAVDALKADLGVT

SEQ ID NO: 322467 - protein, 24 aa, Mycobacterium
PGPPAPWPGYAEDFPAPPRQHVPV

SEQ ID NO: 322468 - protein, 19 aa, Mycobacterium
PGPQLPGPFITPGGTGGSG

SEQ ID NO: 322469 - protein, 18 aa, Mycobacterium
PGPREWLLAALHSKISQF

SEQ ID NO: 322470 - protein, 17 aa, Mycobacterium
PGPRVPRMPGIVDTLMR

SEQ ID NO: 322471 - protein, 24 aa, Mycobacterium
PGPSFRYLQQVYNLYIRPFYPGSP

SEQ ID NO: 322472 - protein, 25 aa, Mycobacterium
PGPVAERLLGWTIALAVCVPAALFL

SEQ ID NO: 322473 - protein, 19 aa, Mycobacterium
PGPVYPGALPPPVQYPKRR

SEQ ID NO: 322474 - protein, 25 aa, Mycobacterium
PGPWRILVTVPLRYLRPSHHPSTEA

SEQ ID NO: 322475 - protein, 25 aa, Mycobacterium
PGQEWRMVWDSALDRAEIGSGIESR

SEQ ID NO: 322476 - protein, 19 aa, Mycobacterium
PGQFSQPFIDAAFSDLGLD

SEQ ID NO: 322477 - protein, 27 aa, Mycobacterium
PGQGACFRLTLPLVRGHKVTTSPLPMK

SEQ ID NO: 322478 - protein, 27 aa, Mycobacterium
PGQGSCFRLTLPLVRGHKVTTSPLPMK

SEQ ID NO: 322479 - protein, 18 aa, Mycobacterium
PGQILVLLNVGAVFMGTA

SEQ ID NO: 322480 - protein, 24 aa, Mycobacterium
PGRACACGAAIAPGGARATMNHEV

SEQ ID NO: 322481 - protein, 24 aa, Mycobacterium
PGRAVAVGCAILIAGMLILTAALL

SEQ ID NO: 322482 - protein, 18 aa, Mycobacterium
PGRDLSIHAGDWTAMIGT

SEQ ID NO: 322483 - protein, 19 aa, Mycobacterium
PGRGWQIFSGIISTLAGIV

SEQ ID NO: 322484 - protein, 26 aa, Mycobacterium
PGRLLSLQIASLMFLFVITSLLSVLG

SEQ ID NO: 322485 - protein, 21 aa, Mycobacterium
PGRLPGFGLVAAPLRAALAGT

SEQ ID NO: 322486 - protein, 20 aa, Mycobacterium
PGRRPFILAYNRIRRPLMRF

SEQ ID NO: 322487 - protein, 31 aa, Mycobacterium
PGRRVHVMGHDWGSVGIWEYLTRPGAGDRVA

SEQ ID NO: 322488 - protein, 27 aa, Mycobacterium
PGRSVEIGPYLPFANVFRFLDVQWLFP

SEQ ID NO: 322489 - protein, 20 aa, Mycobacterium
PGRSVLRALVLLPLVLPPVV

SEQ ID NO: 322490 - protein, 23 aa, Mycobacterium
PGRVRELLELASRLHGSLLDRHR

SEQ ID NO: 322491 - protein, 22 aa, Mycobacterium
PGSALRPGDRVVVEAGQVIPGD

SEQ ID NO: 322492 - protein, 26 aa, Mycobacterium
PGSAVQAPWPLLRTFASGPALSREAA

SEQ ID NO: 322493 - protein, 22 aa, Mycobacterium
PGSAVWGLLPVIARDQLGLGSA

SEQ ID NO: 322494 - protein, 27 aa, Mycobacterium
PGSDLRELPAALQLMNMPEAWKESTGV

SEQ ID NO: 322495 - protein, 18 aa, Mycobacterium
PGSFSGRAGPHRHRAEAE

SEQ ID NO: 322496 - protein, 23 aa, Mycobacterium
PGSGEGLAKCFAYVKKPKGEPAV

SEQ ID NO: 322497 - protein, 25 aa, Mycobacterium
PGSGRWGEQLFKGLATAAGATIVSA

SEQ ID NO: 322498 - protein, 19 aa, Mycobacterium
PGSMATIAVVVSVLIAVSV

SEQ ID NO: 322499 - protein, 19 aa, Mycobacterium
PGSNRRVLGVWVVFVLAAA

SEQ ID NO: 322500 - protein, 20 aa, Mycobacterium
PGSPCSYTPAADGLPRPDNP

SEQ ID NO: 322501 - protein, 20 aa, Mycobacterium
PGSPCSYTPPADGIPSPGNP

SEQ ID NO: 322502 - protein, 20 aa, Mycobacterium
PGSPCSYTPPGNGLPSPGNP

SEQ ID NO: 322503 - protein, 19 aa, Mycobacterium
PGSTRWQGNPIRPWQTRRK

SEQ ID NO: 322504 - protein, 19 aa, Mycobacterium
PGSVLEYAGWAVAMHLWFL

SEQ ID NO: 322505 - protein, 18 aa, Mycobacterium
PGSVPVERTFWYRTAKLA

SEQ ID NO: 322506 - protein, 36 aa, Mycobacterium
PGTDFRLPPKYMEMLNLTEAWQFGRGEGVKVAVIDT

SEQ ID NO: 322507 - protein, 25 aa, Mycobacterium
PGTDPRPGDAIPEFSVTTTDGAVID

SEQ ID NO: 322508 - protein, 17 aa, Mycobacterium
PGTDYDWDSKDRNTTPG

SEQ ID NO: 322509 - protein, 39 aa, Mycobacterium
PGTGFFRTVYVLPWICAPLAIAVLWRWILAPTDGALSTV

SEQ ID NO: 322510 - protein, 21 aa, Mycobacterium
PGTGGASLWWMIGLLAAAGVL

SEQ ID NO: 322511 - protein, 21 aa, Mycobacterium
PGTGGASLWWMIGLLVAAGVL

SEQ ID NO: 322512 - protein, 24 aa, Mycobacterium
PGTGQAAANIWLDRLRTLARRTCV

SEQ ID NO: 322513 - protein, 18 aa, Mycobacterium
PGTLAFTGLQAMLDPPRA

SEQ ID NO: 322514 - protein, 27 aa, Mycobacterium
PGTLDPEWRLPYAVNRVSGFATVPTEV

SEQ ID NO: 322515 - protein, 22 aa, Mycobacterium
PGTVAFSFAGAFGLSVLVWQHL

SEQ ID NO: 322516 - protein, 20 aa, Mycobacterium
PGTVLVTGMFGWLLGRLRER

SEQ ID NO: 322517 - protein, 17 aa, Mycobacterium
PGVELAIARDGRGRAVA

SEQ ID NO: 322518 - protein, 28 aa, Mycobacterium
PGVERRPSRLGRGWLVGISAVLLLAAGG

SEQ ID NO: 322519 - protein, 17 aa, Mycobacterium
PGVFPLPLTIAGHIERW

SEQ ID NO: 322520 - protein, 36 aa, Mycobacterium
PGVKRPFIPRMVRAFAIPIIFFWGLLAVTTNTFMPQ

SEQ ID NO: 322521 - protein, 17 aa, Mycobacterium
PGVLISTLLGLALLVAG

SEQ ID NO: 322522 - protein, 24 aa, Mycobacterium
PGVMAGPGIPVWLRAPRAIPGALV

SEQ ID NO: 322523 - protein, 24 aa, Mycobacterium
PGVPARGVIAVCDFGGSGTSITLA

SEQ ID NO: 322524 - protein, 22 aa, Mycobacterium
PGVPGRSSVSVNIGMAASLWFG

SEQ ID NO: 322525 - protein, 18 aa, Mycobacterium
PGVTLWAGQTMQIPLYGP

SEQ ID NO: 322526 - protein, 21 aa, Mycobacterium
PGVTPFVRVRIDQVTPDVVTT

SEQ ID NO: 322527 - protein, 18 aa, Mycobacterium
PGVVTTWMKLAVRDRIVD

SEQ ID NO: 322528 - protein, 35 aa, Mycobacterium
PGWGAAALIGFRFGTCYFGAFGLVVAVGLIPVVLK

SEQ ID NO: 322529 - protein, 23 aa, Mycobacterium
PGWSDGLVARGWPKVLADGLAVA

SEQ ID NO: 322530 - protein, 25 aa, Mycobacterium
PGWVSAVNWFWLLAFAIAAIIWAVM

SEQ ID NO: 322531 - protein, 19 aa, Mycobacterium
PGYACACGAAIAPGDAQAT

SEQ ID NO: 322532 - protein, 25 aa, Mycobacterium
PGYLDEILIRVGPEPSRSQQQAALA

SEQ ID NO: 322533 - protein, 19 aa, Mycobacterium
PGYLWPGLALLAATASCSD

SEQ ID NO: 322534 - protein, 26 aa, Mycobacterium
PHACKLWPLVFARLAATVVIFVMAAA

SEQ ID NO: 322535 - protein, 28 aa, Mycobacterium
PHAGAWQPGPPLPIRLHHATAATYRGEV

SEQ ID NO: 322536 - protein, 18 aa, Mycobacterium
PHAGTAIHAAWCSVMDLA

SEQ ID NO: 322537 - protein, 20 aa, Mycobacterium
PHAPPAPVIIKSRTGEASNI

SEQ ID NO: 322538 - protein, 18 aa, Mycobacterium
PHAQPPGAHWPGPQQQPA

SEQ ID NO: 322539 - protein, 24 aa, Mycobacterium
PHEAVEILAALSFAAVLMGTALTV

SEQ ID NO: 322540 - protein, 19 aa, Mycobacterium
PHEGIEILAALNVAAVIIG

SEQ ID NO: 322541 - protein, 22 aa, Mycobacterium
PHELPTEAFAAHKPAAPQMIPP

SEQ ID NO: 322542 - protein, 20 aa, Mycobacterium
PHERRLVFERFYRSTTARAM

SEQ ID NO: 322543 - protein, 22 aa, Mycobacterium
PHGAAGPTWHADVLLPDLAAAW

SEQ ID NO: 322544 - protein, 18 aa, Mycobacterium
PHGIEVFVGGTPALEQDS

SEQ ID NO: 322545 - protein, 23 aa, Mycobacterium
PHGPEPKGNVTPMRMSRRRRNQR

SEQ ID NO: 322546 - protein, 27 aa, Mycobacterium
PHGYLGVWSALPFAIWFFLAVEGVPLA

SEQ ID NO: 322547 - protein, 18 aa, Mycobacterium
PHIIVRFMAMRSAADAKA

SEQ ID NO: 322548 - protein, 24 aa, Mycobacterium
PHIPDATVVFARLPGSPMFSLPPV

SEQ ID NO: 322549 - protein, 25 aa, Mycobacterium
PHIPFADLRMKVVDTLTEWPETGHP

SEQ ID NO: 322550 - protein, 18 aa, Mycobacterium
PHKAEVYAVLPLSGSSLP

SEQ ID NO: 322551 - protein, 26 aa, Mycobacterium
PHKLSLPLSFWLYSGFTAITMIGFAT

SEQ ID NO: 322552 - protein, 25 aa, Mycobacterium
PHLDAGPFLSYGIQWITFGILAPIG

SEQ ID NO: 322553 - protein, 25 aa, Mycobacterium
PHLDSGPFLSYGIQWIAFGILAPIG

SEQ ID NO: 322554 - protein, 25 aa, Mycobacterium
PHLFDRDGVDFATGPAPLALPYLDA

SEQ ID NO: 322555 - protein, 20 aa, Mycobacterium
PHLFDRDGVDFATGPPPPAL

SEQ ID NO: 322556 - protein, 17 aa, Mycobacterium
PHLGLIPLFILWFGIGE

SEQ ID NO: 322557 - protein, 17 aa, Mycobacterium
PHLGLIPLFIVWFGIGE

SEQ ID NO: 322558 - protein, 18 aa, Mycobacterium
PHLNLPHAWQVVTVVLLV

SEQ ID NO: 322559 - protein, 25 aa, Mycobacterium
PHLPGWRLALVIAFIPMADGIGNGA

SEQ ID NO: 322560 - protein, 24 aa, Mycobacterium
PHLPIPRLTGMPTLPDALPTMLST

SEQ ID NO: 322561 - protein, 17 aa, Mycobacterium
PHLVAGILLVVYTATGR

SEQ ID NO: 322562 - protein, 20 aa, Mycobacterium
PHMPPALTSYIFGGGADAAR

SEQ ID NO: 322563 - protein, 17 aa, Mycobacterium
PHMSWLDVFAIGSVLPG

SEQ ID NO: 322564 - protein, 19 aa, Mycobacterium
PHMVLAYGAARADLDDASD

SEQ ID NO: 322565 - protein, 18 aa, Mycobacterium
PHPDLPIPTKHSGYINVD

SEQ ID NO: 322566 - protein, 27 aa, Mycobacterium
PHPIPALAVICLSVFVISVDATIVNVA

SEQ ID NO: 322567 - protein, 20 aa, Mycobacterium
PHPPSWIGIVHGWIYFVYLI

SEQ ID NO: 322568 - protein, 19 aa, Mycobacterium
PHPVLPATPWHHTRHWVAH

SEQ ID NO: 322569 - protein, 25 aa, Mycobacterium
PHPYPRWLSTAGWAGFALGIAMLLG

SEQ ID NO: 322570 - protein, 20 aa, Mycobacterium
PHRGLLIAAHLVWLAALAGG

SEQ ID NO: 322571 - protein, 20 aa, Mycobacterium
PHRLRIYTWTGLFTFAMFLA

SEQ ID NO: 322572 - protein, 17 aa, Mycobacterium
PHRLRVTGSALLFVAGF

SEQ ID NO: 322573 - protein, 18 aa, Mycobacterium
PHRRRSRPGLRRDRPRRR

SEQ ID NO: 322574 - protein, 18 aa, Mycobacterium
PHRRRVALGVLTSVTVVL

SEQ ID NO: 322575 - protein, 24 aa, Mycobacterium
PHRVGFREATAWSVFYIAVAIGFG

SEQ ID NO: 322576 - protein, 31 aa, Mycobacterium
PHSKKFTWHWWWLAAAIPVLLLVVFLVVMAV

SEQ ID NO: 322577 - protein, 26 aa, Mycobacterium
PHSLAARLRNPWMLLGAAALVALIVF

SEQ ID NO: 322578 - protein, 18 aa, Mycobacterium
PHSSEIRNADVLRMVIGG

SEQ ID NO: 322579 - protein, 22 aa, Mycobacterium
PHTFELLDRIGFDDMSLPHLRY

SEQ ID NO: 322580 - protein, 22 aa, Mycobacterium
PHTFELLDRIGFEAMSLPNLRY

SEQ ID NO: 322581 - protein, 25 aa, Mycobacterium
PHTPLRLTLWMSVVPPIPLFALSAF

SEQ ID NO: 322582 - protein, 21 aa, Mycobacterium
PHTPPSLVLRLPEPRNVAGIR

SEQ ID NO: 322583 - protein, 37 aa, Mycobacterium
PHVLRDLREGFAFVLKTPWLLWTVLFASMFVLVVLGP

SEQ ID NO: 322584 - protein, 17 aa, Mycobacterium
PHYGELKGPSCFTAPLI

SEQ ID NO: 322585 - protein, 26 aa, Mycobacterium
PIAFAIRDIVPWWIVITLLARDLILT

SEQ ID NO: 322586 - protein, 19 aa, Mycobacterium
PIAGAQFFYYNAVAHLSVG

SEQ ID NO: 322587 - protein, 19 aa, Mycobacterium
PIAGMPVLQVWNADNVIVF

SEQ ID NO: 322588 - protein, 19 aa, Mycobacterium
PIAGMPVLTVWNADNVIVF

SEQ ID NO: 322589 - protein, 19 aa, Mycobacterium
PIAKLVWRVLHIDGRAARY

SEQ ID NO: 322590 - protein, 24 aa, Mycobacterium
PIALSPWPPRAFGMLLLALAVAVA

SEQ ID NO: 322591 - protein, 37 aa, Mycobacterium
PIALVLDILTAFPILVQILAWLIALSIALAVLLSPLI

SEQ ID NO: 322592 - protein, 18 aa, Mycobacterium
PIAPLWALVQANRFLRAT

SEQ ID NO: 322593 - protein, 18 aa, Mycobacterium
PIAPRLSIYGSLMAIVLF

SEQ ID NO: 322594 - protein, 17 aa, Mycobacterium
PIAQSFWYRTAKFVMRH

SEQ ID NO: 322595 - protein, 18 aa, Mycobacterium
PIATGVVVLGAIPYGIAS

SEQ ID NO: 322596 - protein, 20 aa, Mycobacterium
PIAVPCPQFADYHRPTGTGL

SEQ ID NO: 322597 - protein, 17 aa, Mycobacterium
PIAYLFRPYIVYRSRDV

SEQ ID NO: 322598 - protein, 22 aa, Mycobacterium
PIDLLWSFLQAILMAITILLIH

SEQ ID NO: 322599 - protein, 24 aa, Mycobacterium
PIDLLWSFLQAVLMAIAILLVHTY

SEQ ID NO: 322600 - protein, 22 aa, Mycobacterium
PIDLLWSFLQAVLMALTILLIH

SEQ ID NO: 322601 - protein, 20 aa, Mycobacterium
PIDLLWSFLQAVLMALTVLL

SEQ ID NO: 322602 - protein, 22 aa, Mycobacterium
PIDPALPGARVEFMVSDAGPMA

SEQ ID NO: 322603 - protein, 20 aa, Mycobacterium
PIFFVLSGFLLFRPWVHSAV

SEQ ID NO: 322604 - protein, 24 aa, Mycobacterium
PIFLLGFGVLAARGFLYTLSGNPY

SEQ ID NO: 322605 - protein, 18 aa, Mycobacterium
PIFWLLDTTNFLAILAAM

SEQ ID NO: 322606 - protein, 18 aa, Mycobacterium
PIGAALFGHYGDRFSRKG

SEQ ID NO: 322607 - protein, 18 aa, Mycobacterium
PIGAARLSAFSVLLEMLG

SEQ ID NO: 322608 - protein, 24 aa, Mycobacterium
PIGFLIAGVIGFFGGFAYGAVSDA

SEQ ID NO: 322609 - protein, 17 aa, Mycobacterium
PIGQGLSMTLLQMAAMY

SEQ ID NO: 322610 - protein, 21 aa, Mycobacterium
PIGRDIWRAAARNGLLLIAVW

SEQ ID NO: 322611 - protein, 20 aa, Mycobacterium
PIGRNPWRGPPVPYDTPMTN

SEQ ID NO: 322612 - protein, 18 aa, Mycobacterium
PIGTQIIAVFVFIMAMLA

SEQ ID NO: 322613 - protein, 18 aa, Mycobacterium
PIGVLTYVILKRVDDLAY

SEQ ID NO: 322614 - protein, 24 aa, Mycobacterium
PIGVYADTGETVWLDLREGAQGGM

SEQ ID NO: 322615 - protein, 24 aa, Mycobacterium
PIIGHLSWRGAFFTCAVVGGVLTV

SEQ ID NO: 322616 - protein, 21 aa, Mycobacterium
PIIGRWDALGFLQDFFATAVF

SEQ ID NO: 322617 - protein, 18 aa, Mycobacterium
PIINPFLRREFTECDKWR

SEQ ID NO: 322618 - protein, 25 aa, Mycobacterium
PIKFTRAAALWSSLITGFLVLIVLL

SEQ ID NO: 322619 - protein, 19 aa, Mycobacterium
PIKMFPDWAQPLIRLQPIS

SEQ ID NO: 322620 - protein, 17 aa, Mycobacterium
PIKRARTTFTFLAVATL

SEQ ID NO: 322621 - protein, 20 aa, Mycobacterium
PIKTSWGGPIYGSGLPSDIW

SEQ ID NO: 322622 - protein, 22 aa, Mycobacterium
PILAALQSWASHAFTRAIFDDT

SEQ ID NO: 322623 - protein, 19 aa, Mycobacterium
PILAFLVVLVLLAGLGWLT

SEQ ID NO: 322624 - protein, 35 aa, Mycobacterium
PILFVAMPWLYLRVRFFRRKWTAITLASTAAGEQL

SEQ ID NO: 322625 - protein, 23 aa, Mycobacterium
PILGAPINWFPLYLGPALAVELI

SEQ ID NO: 322626 - protein, 19 aa, Mycobacterium
PILGGWLIDAFGWQWIFLI

SEQ ID NO: 322627 - protein, 19 aa, Mycobacterium
PILGGWLIDSFGWQWIFLI

SEQ ID NO: 322628 - protein, 19 aa, Mycobacterium
PILGGWLIGAFSWPWIFLV

SEQ ID NO: 322629 - protein, 30 aa, Mycobacterium
PILGGWLISSFGWHWIFLVNLPIGLAAFAL

SEQ ID NO: 322630 - protein, 19 aa, Mycobacterium
PILGWMNITLGWRTSLLIL

SEQ ID NO: 322631 - protein, 37 aa, Mycobacterium
PILPIRLFAAPVFSVCCVLAFVVGFAMLGALIFVPTF

SEQ ID NO: 322632 - protein, 18 aa, Mycobacterium
PILRILMRRRQTVGLWPL

SEQ ID NO: 322633 - protein, 18 aa, Mycobacterium
PIMFHPLNTITAYKGQII

SEQ ID NO: 322634 - protein, 18 aa, Mycobacterium
PIMFHPLNTITAYKGQVI

SEQ ID NO: 322635 - protein, 19 aa, Mycobacterium
PINAPIVIAGPAGFGPAAV

SEQ ID NO: 322636 - protein, 19 aa, Mycobacterium
PINLLSYFGTWALIGLLVV

SEQ ID NO: 322637 - protein, 18 aa, Mycobacterium
PINLRSGIITVTQDERQI

SEQ ID NO: 322638 - protein, 17 aa, Mycobacterium
PINWFPLYLGAAVVVEL

SEQ ID NO: 322639 - protein, 30 aa, Mycobacterium
PIPEGKNEFGWIWRHCRHVLFDDWFDVEDH

SEQ ID NO: 322640 - protein, 20 aa, Mycobacterium
PIPGFPNLPGLPSIPNLFPG

SEQ ID NO: 322641 - protein, 18 aa, Mycobacterium
PIPHLAKLGMVFASLPLH

SEQ ID NO: 322642 - protein, 18 aa, Mycobacterium
PIPHLGKIGMVFASLPLH

SEQ ID NO: 322643 - protein, 22 aa, Mycobacterium
PIPLAAGFMALVFIASMTAGIV

SEQ ID NO: 322644 - protein, 26 aa, Mycobacterium
PIPPPEPPWWLEILAWLQKFATLLEE

SEQ ID NO: 322645 - protein, 21 aa, Mycobacterium
PIPWLIEPRWAMASLCLVSVW

SEQ ID NO: 322646 - protein, 33 aa, Mycobacterium
PIRNYFYWEKHCFDIPMCWALRSVFDALDGISL

SEQ ID NO: 322647 - protein, 18 aa, Mycobacterium
PIRRLRADAPPFFVLHGC

SEQ ID NO: 322648 - protein, 18 aa, Mycobacterium
PIRRLRADAPPFFVLHGH

SEQ ID NO: 322649 - protein, 19 aa, Mycobacterium
PIRRRPPAIRARIAKGPEV

SEQ ID NO: 322650 - protein, 33 aa, Mycobacterium
PIRSYFYWEKHCFDIPVCWSLRSVFDTLDGVDL

SEQ ID NO: 322651 - protein, 34 aa, Mycobacterium
PIRSYFYWEKHCYDIPACWALRSVFNALDGIDQV

SEQ ID NO: 322652 - protein, 19 aa, Mycobacterium
PIRVRLHINAPPGMTVTDM

SEQ ID NO: 322653 - protein, 30 aa, Mycobacterium
PIRVRPRPASEMLRPFGPRSLVRSLLLGEP

SEQ ID NO: 322654 - protein, 28 aa, Mycobacterium
PISGGWLLEHFWWGSIFMVNIPIAVITI

SEQ ID NO: 322655 - protein, 28 aa, Mycobacterium
PISGGWLLEHFWWGSVFMVNIPIAALAI

SEQ ID NO: 322656 - protein, 20 aa, Mycobacterium
PISHLLGGGGFALHLDSRQV

SEQ ID NO: 322657 - protein, 25 aa, Mycobacterium
PISNLLLTLLFEWGVAIHDMDIEAI

SEQ ID NO: 322658 - protein, 18 aa, Mycobacterium
PISVAELLAKNGTIGAPP

SEQ ID NO: 322659 - protein, 26 aa, Mycobacterium
PITALGVAIPFVWAPLAAIGSRDLPA

SEQ ID NO: 322660 - protein, 20 aa, Mycobacterium
PITEYGEFVALSRDGKRIAA

SEQ ID NO: 322661 - protein, 19 aa, Mycobacterium
PITFCFFVFAFMGTVVLDP

SEQ ID NO: 322662 - protein, 27 aa, Mycobacterium
PITLAGLLPAFALVLALKHEVWTRLIA

SEQ ID NO: 322663 - protein, 23 aa, Mycobacterium
PITRREWTWALLLAVALAVLIAI

SEQ ID NO: 322664 - protein, 18 aa, Mycobacterium
PITVLAMDAVPRISRAQS

SEQ ID NO: 322665 - protein, 17 aa, Mycobacterium
PIVGYAYSWATGGDMSW

SEQ ID NO: 322666 - protein, 26 aa, Mycobacterium
PIVIALSVATLGSWIVVGGSIGAAFT

SEQ ID NO: 322667 - protein, 26 aa, Mycobacterium
PIYGSGLPSDIWKATMDGALEGTDVE

SEQ ID NO: 322668 - protein, 24 aa, Mycobacterium
PIYMRLEMTAPIYIWALLMALALN

SEQ ID NO: 322669 - protein, 21 aa, Mycobacterium
PIYYPRYLIFTAPAMAIVLAV

SEQ ID NO: 322670 - protein, 21 aa, Mycobacterium
PIYYPRYLIFTAPAMAVVLAV

SEQ ID NO: 322671 - protein, 22 aa, Mycobacterium
PKAPQLWLPPLDEPIALADVLA

SEQ ID NO: 322672 - protein, 32 aa, Mycobacterium
PKASVMTHYRWLRALAGFGGLGMRLNSNDTLY

SEQ ID NO: 322673 - protein, 17 aa, Mycobacterium
PKAVVSFYEDFLCPACG

SEQ ID NO: 322674 - protein, 17 aa, Mycobacterium
PKAVVSMYEDFLCPHCG

SEQ ID NO: 322675 - protein, 22 aa, Mycobacterium
PKAVWLQRFPGIGIVGDLEQGR

SEQ ID NO: 322676 - protein, 36 aa, Mycobacterium
PKCLVKEIQKLSGLSINRFIAIDFSGFAKMVDALGG

SEQ ID NO: 322677 - protein, 36 aa, Mycobacterium
PKCLVKEIQKLSGLSINRFIAVDFSGFAKMVDALGG

SEQ ID NO: 322678 - protein, 26 aa, Mycobacterium
PKDAKAIIMSPNLVAARFIQLTPAYT

SEQ ID NO: 322679 - protein, 20 aa, Mycobacterium
PKDQPSRNPIAFVINYLKEV

SEQ ID NO: 322680 - protein, 19 aa, Mycobacterium
PKDRYALVTVNSQMYLLYD

SEQ ID NO: 322681 - protein, 21 aa, Mycobacterium
PKEFRCVSVDLIARQPVVHRR

SEQ ID NO: 322682 - protein, 22 aa, Mycobacterium
PKEPEFRRGMLYDVNPVGFVSM

SEQ ID NO: 322683 - protein, 33 aa, Mycobacterium
PKEPKFERRPLGVSWLIGVVVIPLLLAALGYGA

SEQ ID NO: 322684 - protein, 20 aa, Mycobacterium
PKFFFVPTLDEFRAVFSQGV

SEQ ID NO: 322685 - protein, 20 aa, Mycobacterium
PKFRWISVGAAIAIVTWVCA

SEQ ID NO: 322686 - protein, 21 aa, Mycobacterium
PKGAGSPSVIPLGRTTTPYTL

SEQ ID NO: 322687 - protein, 20 aa, Mycobacterium
PKGLVFFLAVLPQFVVPTAP

SEQ ID NO: 322688 - protein, 18 aa, Mycobacterium
PKGPFGDIIESFADGFAG

SEQ ID NO: 322689 - protein, 23 aa, Mycobacterium
PKGPWLRTGDLGVMFDDELYIIG

SEQ ID NO: 322690 - protein, 21 aa, Mycobacterium
PKGQYCGLCGVHLEKEPGDGP

SEQ ID NO: 322691 - protein, 19 aa, Mycobacterium
PKGRAVLRNVIGGGLALAI

SEQ ID NO: 322692 - protein, 19 aa, Mycobacterium
PKGRAVLRNVIGGGLALSI

SEQ ID NO: 322693 - protein, 17 aa, Mycobacterium
PKIGIKLVILVALGAVL

SEQ ID NO: 322694 - protein, 20 aa, Mycobacterium
PKILVAVLMAFFPIVISGLA

SEQ ID NO: 322695 - protein, 18 aa, Mycobacterium
PKKSRKSPGIWWAVTSVV

SEQ ID NO: 322696 - protein, 20 aa, Mycobacterium
PKKYEGFFGQVQRGWDGLVA

SEQ ID NO: 322697 - protein, 19 aa, Mycobacterium
PKLGQPVQWTPCRSSNPAV

SEQ ID NO: 322698 - protein, 34 aa, Mycobacterium
PKLKAAAKLPVTWEMSFLYAVVFGGFVAFSNYLP

SEQ ID NO: 322699 - protein, 18 aa, Mycobacterium
PKLKAFMADLCWIENIGA

SEQ ID NO: 322700 - protein, 18 aa, Mycobacterium
PKLPNGYANTTIDGVQYR

SEQ ID NO: 322701 - protein, 19 aa, Mycobacterium
PKLRAVLRNAIGGSLALAV

SEQ ID NO: 322702 - protein, 25 aa, Mycobacterium
PKLRIGRDRWFNLLWLIPIGFALLI

SEQ ID NO: 322703 - protein, 20 aa, Mycobacterium
PKLRYRVMVEGIAIIAGIEH

SEQ ID NO: 322704 - protein, 24 aa, Mycobacterium
PKLSPAEANGWCDANRLGVDDCFA

SEQ ID NO: 322705 - protein, 20 aa, Mycobacterium
PKLTERMAVRLASMDLRPHA

SEQ ID NO: 322706 - protein, 26 aa, Mycobacterium
PKLTRRSRILILIALGVIAVLLAGPR

SEQ ID NO: 322707 - protein, 25 aa, Mycobacterium
PKLTRRSRVLILIALGVIALLLAGP

SEQ ID NO: 322708 - protein, 17 aa, Mycobacterium
PKLTTALIHAYPADHPN

SEQ ID NO: 322709 - protein, 26 aa, Mycobacterium
PKLTYTGSILGTWGYMAPERFTDGTN

SEQ ID NO: 322710 - protein, 24 aa, Mycobacterium
PKMLWRSLPDALRKLNPRTLWRNP

SEQ ID NO: 322711 - protein, 19 aa, Mycobacterium
PKMTWLDALYFSTETIATV

SEQ ID NO: 322712 - protein, 18 aa, Mycobacterium
PKPAPADVISALEGQTWS

SEQ ID NO: 322713 - protein, 21 aa, Mycobacterium
PKPAPPRPGGGPVKPKAGAVL

SEQ ID NO: 322714 - protein, 20 aa, Mycobacterium
PKPDLLRRLLHDFRGPLIVS

SEQ ID NO: 322715 - protein, 20 aa, Mycobacterium
PKPEEIGGYAGVPQAPPPPP

SEQ ID NO: 322716 - protein, 41 aa, Mycobacterium
PKPGQRPLEQFFWYRSSKIVLRYRIPIGLAAVALLLLLGAP

SEQ ID NO: 322717 - protein, 19 aa, Mycobacterium
PKPLAALFLFLQTVSLGLF

SEQ ID NO: 322718 - protein, 20 aa, Mycobacterium
PKPPPVRRPVKLTLLTSGTT

SEQ ID NO: 322719 - protein, 27 aa, Mycobacterium
PKPPVPRLPPRLPIHKAALLGLSCLGD

SEQ ID NO: 322720 - protein, 20 aa, Mycobacterium
PKPSLSTAFSDWLNEQLYRL

SEQ ID NO: 322721 - protein, 29 aa, Mycobacterium
PKQAPKPQWPGSGPGGWDPGPGRGSDNGP

SEQ ID NO: 322722 - protein, 24 aa, Mycobacterium
PKQFRCVSVDLIARRAVVHRRGPL

SEQ ID NO: 322723 - protein, 21 aa, Mycobacterium
PKQFRCVSVDLLARQSVVHRS

SEQ ID NO: 322724 - protein, 19 aa, Mycobacterium
PKRAVKRRIYWTGTVAGVV

SEQ ID NO: 322725 - protein, 23 aa, Mycobacterium
PKRGVPSHGLLKCSSSQLSADTD

SEQ ID NO: 322726 - protein, 19 aa, Mycobacterium
PKRIWEVFRDEQITTTLAV

SEQ ID NO: 322727 - protein, 26 aa, Mycobacterium
PKRLPCWEWSLPLAALNLLFIAFVGV

SEQ ID NO: 322728 - protein, 25 aa, Mycobacterium
PKRNPWPIVAGVAALVFVLIVGGIG

SEQ ID NO: 322729 - protein, 33 aa, Mycobacterium
PKRPLLPRLIHRFSVLILLVWLGLTAIVNLAVP

SEQ ID NO: 322730 - protein, 26 aa, Mycobacterium
PKRPLVLRLGRWDVPMMSGLTGLIFR

SEQ ID NO: 322731 - protein, 28 aa, Mycobacterium
PKRPSTWRHVPAILLVASLVLFTIAMAG

SEQ ID NO: 322732 - protein, 18 aa, Mycobacterium
PKRPVNVRRWRRIGTATV

SEQ ID NO: 322733 - protein, 19 aa, Mycobacterium
PKRRDWIAFAVVLAVCGVA

SEQ ID NO: 322734 - protein, 19 aa, Mycobacterium
PKRRGDWLIAGAGAFVAHA

SEQ ID NO: 322735 - protein, 18 aa, Mycobacterium
PKRSPCTNATLSLGSSPK

SEQ ID NO: 322736 - protein, 17 aa, Mycobacterium
PKRTSLEVSCLIKGSEL

SEQ ID NO: 322737 - protein, 28 aa, Mycobacterium
PKSDLSWRDCTSRVFGDAGVPAIPGVTL

SEQ ID NO: 322738 - protein, 25 aa, Mycobacterium
PKSGFNVGEAISWAWNKFTKNVAAL

SEQ ID NO: 322739 - protein, 30 aa, Mycobacterium
PKSPDAASGPSWWAAGGIAVVAAALGAAAA

SEQ ID NO: 322740 - protein, 19 aa, Mycobacterium
PKTAALIAGVLGVLLVAAI

SEQ ID NO: 322741 - protein, 17 aa, Mycobacterium
PKTAPWEVVRLLVDGPV

SEQ ID NO: 322742 - protein, 26 aa, Mycobacterium
PKTARRLLLQYAFDLALAYFIAVVDA

SEQ ID NO: 322743 - protein, 23 aa, Mycobacterium
PKTPEFRRGMLYAINPVGFGSML

SEQ ID NO: 322744 - protein, 19 aa, Mycobacterium
PKTPEFRRGMLYAVNPVGF

SEQ ID NO: 322745 - protein, 18 aa, Mycobacterium
PKTPPRTAAPVFAVRIIL

SEQ ID NO: 322746 - protein, 21 aa, Mycobacterium
PKTRIGARLARIVQSPLAIAT

SEQ ID NO: 322747 - protein, 29 aa, Mycobacterium
PKTYFTARCLRIFPGLWVCLLITAFVIAP

SEQ ID NO: 322748 - protein, 21 aa, Mycobacterium
PKVALRTGRIIGVEALLRWPH

SEQ ID NO: 322749 - protein, 19 aa, Mycobacterium
PKVGPWALYGLLFTIVILF

SEQ ID NO: 322750 - protein, 18 aa, Mycobacterium
PKVGYWTQHFQYRNARDA

SEQ ID NO: 322751 - protein, 37 aa, Mycobacterium
PKVLRWSRNRMAFLAALMFILALCFATTNGWWYVSSY

SEQ ID NO: 322752 - protein, 23 aa, Mycobacterium
PKVVAAWRPWLGVLGGVLILLIG

SEQ ID NO: 322753 - protein, 18 aa, Mycobacterium
PKVVLGLYEDFLCPACGN

SEQ ID NO: 322754 - protein, 21 aa, Mycobacterium
PKWLPDRLRPTASRVRAERAS

SEQ ID NO: 322755 - protein, 17 aa, Mycobacterium
PKWRALADFGIAAGSWL

SEQ ID NO: 322756 - protein, 20 aa, Mycobacterium
PKYPGLKALHDMIFELLDDA

SEQ ID NO: 322757 - protein, 19 aa, Mycobacterium
PLAAIVFCPFAWLQMPAAS

SEQ ID NO: 322758 - protein, 19 aa, Mycobacterium
PLAAIVFCPFAWMHMPAAS

SEQ ID NO: 322759 - protein, 17 aa, Mycobacterium
PLAATGLLHHDGSAPDI

SEQ ID NO: 322760 - protein, 19 aa, Mycobacterium
PLAEMGLNSVMAMSIRREV

SEQ ID NO: 322761 - protein, 17 aa, Mycobacterium
PLAGYVLVLYALREVKE

SEQ ID NO: 322762 - protein, 19 aa, Mycobacterium
PLAHMVWGGGLLSDNERGF

SEQ ID NO: 322763 - protein, 19 aa, Mycobacterium
PLAHMVWGGGLLSGAEDGI

SEQ ID NO: 322764 - protein, 20 aa, Mycobacterium
PLALDSYWGLLFVIPGTIVL

SEQ ID NO: 322765 - protein, 21 aa, Mycobacterium
PLALGLKAAWQAWRGNGDDDG

SEQ ID NO: 322766 - protein, 19 aa, Mycobacterium
PLALGSYWGLLGVIPGTLV

SEQ ID NO: 322767 - protein, 18 aa, Mycobacterium
PLALIGFVLLLTSIELQV

SEQ ID NO: 322768 - protein, 19 aa, Mycobacterium
PLALPLASLVFLGAFVPLV

SEQ ID NO: 322769 - protein, 19 aa, Mycobacterium
PLALRFDSVNLIGLAVIAR

SEQ ID NO: 322770 - protein, 17 aa, Mycobacterium
PLALSRLGVPGTVISML

SEQ ID NO: 322771 - protein, 19 aa, Mycobacterium
PLANIGIFSLFVVVTMIVV

SEQ ID NO: 322772 - protein, 19 aa, Mycobacterium
PLAPHGLPGHLVGFVEALR

SEQ ID NO: 322773 - protein, 24 aa, Mycobacterium
PLAPPRAVAIITQIASALDAAHAA

SEQ ID NO: 322774 - protein, 23 aa, Mycobacterium
PLAQDGWGLATWVVIAFVVMCFL

SEQ ID NO: 322775 - protein, 24 aa, Mycobacterium
PLAQPRIYFGPVIASAADDYAIVG

SEQ ID NO: 322776 - protein, 28 aa, Mycobacterium
PLARKGYSTVLVFWFGWPASEVPGVYFS

SEQ ID NO: 322777 - protein, 25 aa, Mycobacterium
PLARKGYSTVLVFWFGWPTSEVPGI

SEQ ID NO: 322778 - protein, 37 aa, Mycobacterium
PLARRGASLIWRFGVPLVCALAGFLLAATHTVSGGSE

SEQ ID NO: 322779 - protein, 18 aa, Mycobacterium
PLASDWPLVVADASQPAT

SEQ ID NO: 322780 - protein, 25 aa, Mycobacterium
PLATGCLRVRASITISPDDLVSGEI

SEQ ID NO: 322781 - protein, 25 aa, Mycobacterium
PLATGCLRVRASITISPEDLVSGEI

SEQ ID NO: 322782 - protein, 17 aa, Mycobacterium
PLAVFAMHSLKSYYFNA

SEQ ID NO: 322783 - protein, 17 aa, Mycobacterium
PLAVGVALADAMLKRNR

SEQ ID NO: 322784 - protein, 23 aa, Mycobacterium
PLAVVWPSGWAWHSGPPHESNYF

SEQ ID NO: 322785 - protein, 18 aa, Mycobacterium
PLAWWLCGTATAVTVLYL

SEQ ID NO: 322786 - protein, 24 aa, Mycobacterium
PLCIYGGGCYTFFVEVFTTATRFT

SEQ ID NO: 322787 - protein, 24 aa, Mycobacterium
PLDALAAACRRIAEGNFGERIVPH

SEQ ID NO: 322788 - protein, 26 aa, Mycobacterium
PLDAWQRLFLGITFLFLVSSAFTLAK

SEQ ID NO: 322789 - protein, 21 aa, Mycobacterium
PLDGGRLVRAYLWRRHGDIVR

SEQ ID NO: 322790 - protein, 25 aa, Mycobacterium
PLDKERRKQAAVAFDRDNSGIAEAF

SEQ ID NO: 322791 - protein, 19 aa, Mycobacterium
PLDLEVRAVVALLCGPLLG

SEQ ID NO: 322792 - protein, 19 aa, Mycobacterium
PLDNSWRMPPLTLLEPVTW

SEQ ID NO: 322793 - protein, 17 aa, Mycobacterium
PLDPPPPAPDAFSGIAP

SEQ ID NO: 322794 - protein, 19 aa, Mycobacterium
PLDPVGWAQALGAAAAATA

SEQ ID NO: 322795 - protein, 24 aa, Mycobacterium
PLDQPRIYFGPVISNTPADYAIVG

SEQ ID NO: 322796 - protein, 24 aa, Mycobacterium
PLDQPRIYYGPVISNTPADYAIVG

SEQ ID NO: 322797 - protein, 18 aa, Mycobacterium
PLDSCGWTVPNSESKIVD

SEQ ID NO: 322798 - protein, 26 aa, Mycobacterium
PLEASPRFVAWLAEFEPVRQAFLGCR

SEQ ID NO: 322799 - protein, 21 aa, Mycobacterium
PLEATPPFFQWLAEFEPMHQV

SEQ ID NO: 322800 - protein, 36 aa, Mycobacterium
PLEAVPPFFRWLAKFEPMHQVFLGVRSLLYLNGQPE

SEQ ID NO: 322801 - protein, 19 aa, Mycobacterium
PLEEQFWYRSTRYVLRHSL

SEQ ID NO: 322802 - protein, 21 aa, Mycobacterium
PLEPITLGALVSRQATSTPHA

SEQ ID NO: 322803 - protein, 19 aa, Mycobacterium
PLFAFNVGVLRWSWRLMNY

SEQ ID NO: 322804 - protein, 27 aa, Mycobacterium
PLFARANRVAHGWLFGEPRSGGTGDHW

SEQ ID NO: 322805 - protein, 32 aa, Mycobacterium
PLFATFILGMFWRRMTSTAGWTGLVAGTLSAV

SEQ ID NO: 322806 - protein, 20 aa, Mycobacterium
PLFDRLGRRFPKHFGPGHVA

SEQ ID NO: 322807 - protein, 19 aa, Mycobacterium
PLFEDPAGWLRHIILPALT

SEQ ID NO: 322808 - protein, 19 aa, Mycobacterium
PLFFEVGVVLLIPIVLLVA

SEQ ID NO: 322809 - protein, 17 aa, Mycobacterium
PLFGGLIAVAGYPVAFA

SEQ ID NO: 322810 - protein, 18 aa, Mycobacterium
PLFHVAALAPLVGCVYRG

SEQ ID NO: 322811 - protein, 30 aa, Mycobacterium
PLFPTANSIFARWFPPRERGKATSLMNSGA

SEQ ID NO: 322812 - protein, 19 aa, Mycobacterium
PLFREHLHLAGVPTDSPEE

SEQ ID NO: 322813 - protein, 19 aa, Mycobacterium
PLFWLIDTRNAWAITAAVA

SEQ ID NO: 322814 - protein, 23 aa, Mycobacterium
PLFYAEGTTMLFGDAKKSVSEVT

SEQ ID NO: 322815 - protein, 19 aa, Mycobacterium
PLFYGEGTTMLFGDAKKSV

SEQ ID NO: 322816 - protein, 25 aa, Mycobacterium
PLGAGMAIRARWPDAATRIAPPIQR

SEQ ID NO: 322817 - protein, 20 aa, Mycobacterium
PLGAHGFALLGLILPIATLV

SEQ ID NO: 322818 - protein, 19 aa, Mycobacterium
PLGALLWGHFGDRLSRKQV

SEQ ID NO: 322819 - protein, 18 aa, Mycobacterium
PLGALVFGQLGDRIGRKK

SEQ ID NO: 322820 - protein, 27 aa, Mycobacterium
PLGDRFGRRYVIVWAIGSFAATTLLTA

SEQ ID NO: 322821 - protein, 17 aa, Mycobacterium
PLGEALRNAVLPEQISF

SEQ ID NO: 322822 - protein, 18 aa, Mycobacterium
PLGFGMSLVRQLAHFVDA

SEQ ID NO: 322823 - protein, 25 aa, Mycobacterium
PLGFWLYAACAYRRDRAQARIEEMS

SEQ ID NO: 322824 - protein, 18 aa, Mycobacterium
PLGGIVFGHFGDRVGRRR

SEQ ID NO: 322825 - protein, 18 aa, Mycobacterium
PLGGMVWGPLGDRLGRKS

SEQ ID NO: 322826 - protein, 17 aa, Mycobacterium
PLGGTRLLLNLAGDGRG

SEQ ID NO: 322827 - protein, 18 aa, Mycobacterium
PLGIWVFAPLRRRATAAL

SEQ ID NO: 322828 - protein, 24 aa, Mycobacterium
PLGKMLLFGLCLVIPTVAIAVAIM

SEQ ID NO: 322829 - protein, 17 aa, Mycobacterium
PLGNLGRLLTDFMTNPA

SEQ ID NO: 322830 - protein, 20 aa, Mycobacterium
PLGNLKLGGFSEKYLPPTNS

SEQ ID NO: 322831 - protein, 17 aa, Mycobacterium
PLGPFGWAQGLGAAAAA

SEQ ID NO: 322832 - protein, 18 aa, Mycobacterium
PLGPMLLAADARRAGLPV

SEQ ID NO: 322833 - protein, 17 aa, Mycobacterium
PLGPVWVALLIVGAASA

SEQ ID NO: 322834 - protein, 26 aa, Mycobacterium
PLGRARLRLAGAAGLFVAGFTAVFLM

SEQ ID NO: 322835 - protein, 27 aa, Mycobacterium
PLGRMGIAVLCARILLRKVTPGSYPRG

SEQ ID NO: 322836 - protein, 20 aa, Mycobacterium
PLGRNPWRGPPVPYDTPVTD

SEQ ID NO: 322837 - protein, 25 aa, Mycobacterium
PLGTAVAVWSMSSWIVTGELFPMLS

SEQ ID NO: 322838 - protein, 20 aa, Mycobacterium
PLGVLLVAGIFRLTASVWRL

SEQ ID NO: 322839 - protein, 32 aa, Mycobacterium; identical to SEQ ID NO: 14092

SEQ ID NO: 322840 - protein, 25 aa, Mycobacterium
PLGYAPGTCRAFLPAKDSLARVTCD

SEQ ID NO: 322841 - protein, 18 aa, Mycobacterium
PLGYVDWIKAAAVGAPVF

SEQ ID NO: 322842 - protein, 17 aa, Mycobacterium
PLHLAHPATPMTPALAW

SEQ ID NO: 322843 - protein, 18 aa, Mycobacterium
PLHLLTLIAGFALLAYVV

SEQ ID NO: 322844 - protein, 27 aa, Mycobacterium
PLHRVSRALRPDWSRTPAARRVLAGLL

SEQ ID NO: 322845 - protein, 20 aa, Mycobacterium
PLIDLRLLKNRVVTQANLTL

SEQ ID NO: 322846 - protein, 24 aa, Mycobacterium
PLIDLRLLTNRAFTLTNVAMFFYI

SEQ ID NO: 322847 - protein, 20 aa, Mycobacterium
PLIGLWAMVATLRFGFAHQK

SEQ ID NO: 322848 - protein, 25 aa, Mycobacterium
PLIGNRLSERLQVPVFTTAQPIFSA

SEQ ID NO: 322849 - protein, 18 aa, Mycobacterium
PLIGQGLETLLGGTGIPT

SEQ ID NO: 322850 - protein, 24 aa, Mycobacterium
PLIGRWDALGFLQDFFAVAVLLGI

SEQ ID NO: 322851 - protein, 17 aa, Mycobacterium
PLIIGIADFTWSAGSLT

SEQ ID NO: 322852 - protein, 21 aa, Mycobacterium
PLILVMGAFLFFANRRQRKAL

SEQ ID NO: 322853 - protein, 18 aa, Mycobacterium
PLIPLAVSAFLTSRKKAA

SEQ ID NO: 322854 - protein, 20 aa, Mycobacterium
PLIPVFMVLIGLATRDRSAA

SEQ ID NO: 322855 - protein, 23 aa, Mycobacterium
PLIPYLLGFESLWGGLACGGVGL

SEQ ID NO: 322856 - protein, 24 aa, Mycobacterium
PLITSRLSERLQVPIVTTAQPRLN

SEQ ID NO: 322857 - protein, 20 aa, Mycobacterium
PLIVPELFGDMGRQSLNLAS

SEQ ID NO: 322858 - protein, 23 aa, Mycobacterium
PLIVVKLWSVWPKLFERPVIGGF

SEQ ID NO: 322859 - protein, 17 aa, Mycobacterium
PLIWLSLVFGWGLAGIW

SEQ ID NO: 322860 - protein, 17 aa, Mycobacterium
PLIWVLGSVIAKGFKAV

SEQ ID NO: 322861 - protein, 29 aa, Mycobacterium
PLKEPAWRRFRVSQVLIGLSAVVAMTAIG

SEQ ID NO: 322862 - protein, 17 aa, Mycobacterium
PLKVFGIPVDERAATLA

SEQ ID NO: 322863 - protein, 18 aa, Mycobacterium
PLLAGPFAPWVFAGNLTA

SEQ ID NO: 322864 - protein, 30 aa, Mycobacterium
PLLAKLTRWTIDAHMGLLFGVVNQIILAVS

SEQ ID NO: 322865 - protein, 24 aa, Mycobacterium
PLLALPFRPLLAFLTTGFLAPVFR

SEQ ID NO: 322866 - protein, 30 aa, Mycobacterium
PLLARMIRRLALPIIVVWIAVIAALNIFVP

SEQ ID NO: 322867 - protein, 21 aa, Mycobacterium
PLLCIFIIFVGIFAGYLVNVG

SEQ ID NO: 322868 - protein, 17 aa, Mycobacterium
PLLDTVRTWSSWKSILL

SEQ ID NO: 322869 - protein, 19 aa, Mycobacterium
PLLEPLRGIVPAPLLDLVE

SEQ ID NO: 322870 - protein, 35 aa, Mycobacterium
PLLFLVVLWCGRFPRHWRCWPRHWSRAPRPRSSNE

SEQ ID NO: 322871 - protein, 19 aa, Mycobacterium
PLLFPAMLLALTLLLASTI

SEQ ID NO: 322872 - protein, 18 aa, Mycobacterium
PLLFPFQPIHVTIAAWFT

SEQ ID NO: 322873 - protein, 26 aa, Mycobacterium
PLLGLIADRWRLLWMAPAGLAAAGIG

SEQ ID NO: 322874 - protein, 21 aa, Mycobacterium
PLLGRLCDRWSSKRVLIVGGV

SEQ ID NO: 322875 - protein, 19 aa, Mycobacterium
PLLPRLVERDAIVGEAADR

SEQ ID NO: 322876 - protein, 18 aa, Mycobacterium
PLLPRPLAWPSSRAQWQR

SEQ ID NO: 322877 - protein, 23 aa, Mycobacterium
PLLRICEEAELPLSMHFGSGGMP

SEQ ID NO: 322878 - protein, 17 aa, Mycobacterium
PLLRVTRLVGIAIIAVS

SEQ ID NO: 322879 - protein, 20 aa, Mycobacterium
PLLRYLRERAPAAASSSQTA

SEQ ID NO: 322880 - protein, 25 aa, Mycobacterium
PLLSGCLRVRASLTISPDDLVSGEI

SEQ ID NO: 322881 - protein, 17 aa, Mycobacterium
PLLSWVGRTVFGVDATL

SEQ ID NO: 322882 - protein, 25 aa, Mycobacterium
PLLTHPVLLCGGALLATVCLVVLML

SEQ ID NO: 322883 - protein, 23 aa, Mycobacterium
PLLVAWAASVGIMIFEKDLGTSL

SEQ ID NO: 322884 - protein, 19 aa, Mycobacterium
PLLVAYPLIMAFTLVYTAE

SEQ ID NO: 322885 - protein, 18 aa, Mycobacterium
PLLVGARAIGRVVTARRA

SEQ ID NO: 322886 - protein, 19 aa, Mycobacterium
PLLVLFAVLLLRRRGARAV

SEQ ID NO: 322887 - protein, 21 aa, Mycobacterium
PLMERLRQMMHASDNVMAESI

SEQ ID NO: 322888 - protein, 20 aa, Mycobacterium
PLMLACFAFGTKRFFRGETL

SEQ ID NO: 322889 - protein, 18 aa, Mycobacterium
PLMRLREECRAAKERLSS

SEQ ID NO: 322890 - protein, 19 aa, Mycobacterium
PLMVVMIALVVQWSRSDER

SEQ ID NO: 322891 - protein, 30 aa, Mycobacterium
PLNMWAGANTGWWPLLWFTAKVWGFLFIYF

SEQ ID NO: 322892 - protein, 31 aa, Mycobacterium
PLNMWAGANTGWWPVLWFTAKMWTFLFIYFW

SEQ ID NO: 322893 - protein, 20 aa, Mycobacterium
PLNTLRRWQRMVPAIEALLT

SEQ ID NO: 322894 - protein, 28 aa, Mycobacterium
PLPAVAIRTVWVVLRFDPGANVDAVFRR

SEQ ID NO: 322895 - protein, 17 aa, Mycobacterium
PLPGRPRAAPGPYRLPP

SEQ ID NO: 322896 - protein, 18 aa, Mycobacterium
PLPLEYQGAALPKRMNKL

SEQ ID NO: 322897 - protein, 18 aa, Mycobacterium
PLPMALRNDLPVPIRVRL

SEQ ID NO: 322898 - protein, 21 aa, Mycobacterium
PLPQIFGPGGGGGFPGGDDDR

SEQ ID NO: 322899 - protein, 27 aa, Mycobacterium
PLPSEIYWRRRALAIGVVVVVVAIVAA

SEQ ID NO: 322900 - protein, 21 aa, Mycobacterium
PLPSGTYCKIPMDTPANGVRG

SEQ ID NO: 322901 - protein, 19 aa, Mycobacterium
PLPSHRLILGAMLATTVFV

SEQ ID NO: 322902 - protein, 28 aa, Mycobacterium
PLPTEIYWRRRGLALGIAVVVIGIAVAA

SEQ ID NO: 322903 - protein, 17 aa, Mycobacterium
PLPVLGFGFSALAISMT

SEQ ID NO: 322904 - protein, 21 aa, Mycobacterium
PLPYIVMEYVDGVTLRDIVHT

SEQ ID NO: 322905 - protein, 19 aa, Mycobacterium
PLQFYSRSVGLGIVIAVLI

SEQ ID NO: 322906 - protein, 19 aa, Mycobacterium
PLQLRVAKNLGLHGFGLYR

SEQ ID NO: 322907 - protein, 24 aa, Mycobacterium
PLQQVRAWITWALIAVNVLVYTAT

SEQ ID NO: 322908 - protein, 23 aa, Mycobacterium
PLQRWWLYRRVADVAALEHFTAV

SEQ ID NO: 322909 - protein, 27 aa, Mycobacterium
PLQVSPRPVGAVRGWRGPRLVRSVLQR

SEQ ID NO: 322910 - protein, 18 aa, Mycobacterium
PLQWAYHLILPWITLAVL

SEQ ID NO: 322911 - protein, 21 aa, Mycobacterium
PLRARLRRPTIVLGSIVALLG

SEQ ID NO: 322912 - protein, 18 aa, Mycobacterium
PLRFLARATNLWNSELPF

SEQ ID NO: 322913 - protein, 18 aa, Mycobacterium
PLRFLARATSLWNSELPF

SEQ ID NO: 322914 - protein, 25 aa, Mycobacterium
PLRLSPRHWWVWVACLIATDFCYYW

SEQ ID NO: 322915 - protein, 18 aa, Mycobacterium
PLRNVHKLGPVIRLPLVL

SEQ ID NO: 322916 - protein, 35 aa, Mycobacterium
PLRNYLYWEKHCFDIPMCWSMRSLFDALDGIDKLT

SEQ ID NO: 322917 - protein, 33 aa, Mycobacterium
PLRNYLYWEPHCYDIPMCHSMRSIFDALDGMDT

SEQ ID NO: 322918 - protein, 23 aa, Mycobacterium
PLRQLRWALSEVQRGNYNAHVPI

SEQ ID NO: 322919 - protein, 19 aa, Mycobacterium
PLRRAERLNVVFVLAASQL

SEQ ID NO: 322920 - protein, 31 aa, Mycobacterium
PLRRFKDASWRVGAWICSAIVVAGWGSILLM

SEQ ID NO: 322921 - protein, 25 aa, Mycobacterium
PLRRHFAWLKDWYEFAVTDIGRSPL

SEQ ID NO: 322922 - protein, 20 aa, Mycobacterium
PLRRTVLTALGWMIFAIILA

SEQ ID NO: 322923 - protein, 19 aa, Mycobacterium
PLRSFKFKTAVLVGVALLI

SEQ ID NO: 322924 - protein, 23 aa, Mycobacterium
PLRSNWGVAGWSMGGTCAVDLTV

SEQ ID NO: 322925 - protein, 26 aa, Mycobacterium
PLRSPDFRRLWLAGIPTVIGANLTIF

SEQ ID NO: 322926 - protein, 21 aa, Mycobacterium
PLRSYFYWERHCYDIPICWSL

SEQ ID NO: 322927 - protein, 20 aa, Mycobacterium
PLRTGIFGIALVACLVLVSF

SEQ ID NO: 322928 - protein, 18 aa, Mycobacterium
PLRVGLVAAALVLVACGL

SEQ ID NO: 322929 - protein, 20 aa, Mycobacterium
PLSFLDCLYYATVSLSTTGY

SEQ ID NO: 322930 - protein, 20 aa, Mycobacterium
PLSGRSTSAGVQWFAGVVLL

SEQ ID NO: 322931 - protein, 19 aa, Mycobacterium
PLSLAVLVWVFGGLLVAAL

SEQ ID NO: 322932 - protein, 23 aa, Mycobacterium
PLSLPRPLANGWRPTDGPGPAFL

SEQ ID NO: 322933 - protein, 19 aa, Mycobacterium
PLSLPRPPTLANYLGLADA

SEQ ID NO: 322934 - protein, 17 aa, Mycobacterium
PLSPRLFVSNMLHSYEF

SEQ ID NO: 322935 - protein, 20 aa, Mycobacterium
PLSRCGVVWIITQADPSQPA

SEQ ID NO: 322936 - protein, 18 aa, Mycobacterium
PLSRRLAQCRSAKEQLSA

SEQ ID NO: 322937 - protein, 18 aa, Mycobacterium
PLSWATGFTPGYGIVATV

SEQ ID NO: 322938 - protein, 24 aa, Mycobacterium
PLTAALSELWGWRQAVVAVAIAAA

SEQ ID NO: 322939 - protein, 24 aa, Mycobacterium
PLTAMGAAMAFIWSPLAATATRNL

SEQ ID NO: 322940 - protein, 18 aa, Mycobacterium
PLTDPGVAIAILVVAAVL

SEQ ID NO: 322941 - protein, 23 aa, Mycobacterium
PLTDRTRKFWAWTISGYALTVVT

SEQ ID NO: 322942 - protein, 17 aa, Mycobacterium
PLTENFDVFGYHVTGST

SEQ ID NO: 322943 - protein, 17 aa, Mycobacterium
PLTESSVRSGLAPAERD

SEQ ID NO: 322944 - protein, 22 aa, Mycobacterium
PLTFFLLEWGRSLLVDQPDARV

SEQ ID NO: 322945 - protein, 25 aa, Mycobacterium
PLTGAEVIDNFLSVTVRTYLVPLDG

SEQ ID NO: 322946 - protein, 20 aa, Mycobacterium
PLTIIWPSGWSWGHGSSHYL

SEQ ID NO: 322947 - protein, 23 aa, Mycobacterium
PLTPPRAVAIISQVASALDAAHA

SEQ ID NO: 322948 - protein, 24 aa, Mycobacterium
PLTPPRAVAVITQIASALDAAHAA

SEQ ID NO: 322949 - protein, 18 aa, Mycobacterium
PLTRMLKVELPLALPVLI

SEQ ID NO: 322950 - protein, 18 aa, Mycobacterium
PLTRMLKVELPLSIPVLV

SEQ ID NO: 322951 - protein, 18 aa, Mycobacterium
PLTSTRFVACPFGDPGTR

SEQ ID NO: 322952 - protein, 35 aa, Mycobacterium
PLTVPKPAPPRDMVPVWVAAGGLFVALLIGGGVFG

SEQ ID NO: 322953 - protein, 18 aa, Mycobacterium
PLTYTWLLVLAITTIIQN

SEQ ID NO: 322954 - protein, 25 aa, Mycobacterium
PLVAEIGVACAVAIAVDATIVRLIL

SEQ ID NO: 322955 - protein, 25 aa, Mycobacterium
PLVAEIGVACAVAIAVDATIVRLIM

SEQ ID NO: 322956 - protein, 25 aa, Mycobacterium
PLVAEIGVACAVAIAVDATVVRLVL

SEQ ID NO: 322957 - protein, 25 aa, Mycobacterium
PLVAEIGVACAVAIAVDATVVRLVM

SEQ ID NO: 322958 - protein, 17 aa, Mycobacterium
PLVATLRAISCVLFPVG

SEQ ID NO: 322959 - protein, 19 aa, Mycobacterium
PLVAVSIMVAIEFSNLSAL

SEQ ID NO: 322960 - protein, 18 aa, Mycobacterium
PLVDRVRRTKGRMRLLYQ

SEQ ID NO: 322961 - protein, 18 aa, Mycobacterium
PLVFAIPIVLGMILLVIP

SEQ ID NO: 322962 - protein, 25 aa, Mycobacterium
PLVGKMMRFFPPVVIGTTILLIGIQ

SEQ ID NO: 322963 - protein, 18 aa, Mycobacterium
PLVGYVWSWASGRGRGWR

SEQ ID NO: 322964 - protein, 34 aa, Mycobacterium
PLVLACIVLAGLVGMCSFAPGSHRGAVPTYDAPA

SEQ ID NO: 322965 - protein, 20 aa, Mycobacterium
PLVLAFVALIAFVMLLISIH

SEQ ID NO: 322966 - protein, 20 aa, Mycobacterium
PLVLGFVALIAFVMLLVSVH

SEQ ID NO: 322967 - protein, 17 aa, Mycobacterium
PLVPAVMVAAAIIAVAG

SEQ ID NO: 322968 - protein, 18 aa, Mycobacterium
PLVPPALLRPGSQVNAYV

SEQ ID NO: 322969 - protein, 25 aa, Mycobacterium
PLVREEVAACWRTDVPKFTARGDSD

SEQ ID NO: 322970 - protein, 28 aa, Mycobacterium
PLVRLADRYAAYFLPLALAMAGIAWLAS

SEQ ID NO: 322971 - protein, 24 aa, Mycobacterium
PLVTTRLSERLQVPVFTTPQPSSS

SEQ ID NO: 322972 - protein, 20 aa, Mycobacterium
PLVWLLWVVIERGWYAIIRV

SEQ ID NO: 322973 - protein, 26 aa, Mycobacterium
PLWFVVAAFCAYSFISGGPSILVWIY

SEQ ID NO: 322974 - protein, 18 aa, Mycobacterium
PLWIPWQSITALRAERGI

SEQ ID NO: 322975 - protein, 17 aa, Mycobacterium
PLWRKVMDHRVLDHYDG

SEQ ID NO: 322976 - protein, 22 aa, Mycobacterium
PLYALSVLAAFFAARFTTVYIN

SEQ ID NO: 322977 - protein, 22 aa, Mycobacterium
PLYCIAVVCAFQAARFGTTGVY

SEQ ID NO: 322978 - protein, 24 aa, Mycobacterium
PLYCVALLMSFFSVRVITTAFYGQ

SEQ ID NO: 322979 - protein, 23 aa, Mycobacterium
PLYCVGVLASFWAARFGTTVIYG

SEQ ID NO: 322980 - protein, 23 aa, Mycobacterium
PLYCVGVLASFWAARFGTTVLYS

SEQ ID NO: 322981 - protein, 21 aa, Mycobacterium
PLYEAATAWTALSAEHASVAE

SEQ ID NO: 322982 - protein, 27 aa, Mycobacterium
PLYFWLPCLACLLALAELHLHTGRLTL

SEQ ID NO: 322983 - protein, 17 aa, Mycobacterium
PLYKRGGFVSAYQYLGT

SEQ ID NO: 322984 - protein, 26 aa, Mycobacterium
PLYKTPRVFIAAAWVAIVAGVVFIVS

SEQ ID NO: 322985 - protein, 20 aa, Mycobacterium
PLYLACLAISYVSCQVMVGI

SEQ ID NO: 322986 - protein, 26 aa, Mycobacterium
PLYLLCLVISYITCRLLVGISSGGSI

SEQ ID NO: 322987 - protein, 25 aa, Mycobacterium
PLYNLLLMLLFEWGVAVHDTDIEGL

SEQ ID NO: 322988 - protein, 17 aa, Mycobacterium
PLYSIAVILSFLASKLT

SEQ ID NO: 322989 - protein, 17 aa, Mycobacterium
PLYSIAVILSFLASQFT

SEQ ID NO: 322990 - protein, 17 aa, Mycobacterium
PLYSIAVILSFVASQFI

SEQ ID NO: 322991 - protein, 30 aa, Mycobacterium
PLYSLSVLAAFFAARFTTVFINGQSAGLYD

SEQ ID NO: 322992 - protein, 31 aa, Mycobacterium
PLYSLSVLAAFFAARFTTVFINGQSKGLYDH

SEQ ID NO: 322993 - protein, 21 aa, Mycobacterium
PLYVMCLAVSYLTTQTVVFLI

SEQ ID NO: 322994 - protein, 20 aa, Mycobacterium
PLYVVCLAVSYLTTQAVVMV

SEQ ID NO: 322995 - protein, 29 aa, Mycobacterium
PMALGRKKFLPPFVSWFAAMLFAVVPLRN

SEQ ID NO: 322996 - protein, 19 aa, Mycobacterium
PMALVLARSRARLMRLMRP

SEQ ID NO: 322997 - protein, 17 aa, Mycobacterium
PMDAARGAVAGVLALFG

SEQ ID NO: 322998 - protein, 17 aa, Mycobacterium
PMFVAPLAVPAFINSYA

SEQ ID NO: 322999 - protein, 25 aa, Mycobacterium
PMGSSLYWLRFGTIRLPPWPERVPW

SEQ ID NO: 323000 - protein, 21 aa, Mycobacterium
PMGVPLEWNVFMIFGVLALFV

SEQ ID NO: 323001 - protein, 21 aa, Mycobacterium
PMGVPLEWNVFMIFGVLSLFV

SEQ ID NO: 323002 - protein, 21 aa, Mycobacterium
PMGVPLEWNVFMIFGVLWLFV

SEQ ID NO: 323003 - protein, 20 aa, Mycobacterium
PMHQVFLGARSLLYFGGRGD

SEQ ID NO: 323004 - protein, 17 aa, Mycobacterium
PMHVGALQLFQPPEHAD

SEQ ID NO: 323005 - protein, 32 aa, Mycobacterium
PMIKPAILVALLFRTLDAFRIFDNIYILTGGS

SEQ ID NO: 323006 - protein, 17 aa, Mycobacterium
PMINRAGKVLGVVFGAA

SEQ ID NO: 323007 - protein, 22 aa, Mycobacterium
PMLAVCGRRLFWPFIPHADDAE

SEQ ID NO: 323008 - protein, 25 aa, Mycobacterium
PMLLAARFLLGLAVGVSIVVVPVYV

SEQ ID NO: 323009 - protein, 28 aa, Mycobacterium
PMLLRVGARSSYLFGLAVFGIASMVCAA

SEQ ID NO: 323010 - protein, 25 aa, Mycobacterium
PMLLRVGARTSYLMGLTVFGVASLL

SEQ ID NO: 323011 - protein, 17 aa, Mycobacterium
PMLRGRRAPEATTAHGL

SEQ ID NO: 323012 - protein, 23 aa, Mycobacterium
PMLSEEFRLLAAARRLQPPAPEK

SEQ ID NO: 323013 - protein, 25 aa, Mycobacterium
PMLSLRLVTSPGFAGVWVAAAAASG

SEQ ID NO: 323014 - protein, 19 aa, Mycobacterium
PMLSMRRISAFVLGQGLIT

SEQ ID NO: 323015 - protein, 17 aa, Mycobacterium
PMMLAPWVLLPVILALQ

SEQ ID NO: 323016 - protein, 17 aa, Mycobacterium
PMMLAPWVLLPVILALR

SEQ ID NO: 323017 - protein, 17 aa, Mycobacterium
PMMPALLVKSVLKERPA

SEQ ID NO: 323018 - protein, 19 aa, Mycobacterium
PMMRARTAIVGGLVLLGPT

SEQ ID NO: 323019 - protein, 17 aa, Mycobacterium
PMMSGLTGLIFRALLAL

SEQ ID NO: 323020 - protein, 17 aa, Mycobacterium
PMMSIGGIHIWLGGALN

SEQ ID NO: 323021 - protein, 25 aa, Mycobacterium
PMPHALRVIAEWNPLSSLALALRKL

SEQ ID NO: 323022 - protein, 18 aa, Mycobacterium
PMPHWLRVIAEWNPVSSL

SEQ ID NO: 323023 - protein, 22 aa, Mycobacterium
PMPPAAVVLGHLALPRIRRTGE

SEQ ID NO: 323024 - protein, 23 aa, Mycobacterium
PMPSLRAVISIGDRLDPSVAQRF

SEQ ID NO: 323025 - protein, 18 aa, Mycobacterium
PMQLKLAITAGIGLFILF

SEQ ID NO: 323026 - protein, 18 aa, Mycobacterium
PMRREFSMWSAAMLGFVF

SEQ ID NO: 323027 - protein, 22 aa, Mycobacterium
PMSQMSIAGPWVSIAAPGTDVV

SEQ ID NO: 323028 - protein, 18 aa, Mycobacterium
PMSTGRRLAVAFAAAAVL

SEQ ID NO: 323029 - protein, 18 aa, Mycobacterium
PMSTGRRLGVAFAAAAVL

SEQ ID NO: 323030 - protein, 23 aa, Mycobacterium
PMTKSSAVALTFLYALGYPIGAL

SEQ ID NO: 323031 - protein, 21 aa, Mycobacterium
PMVPEGLVLLTSVAFAVGVVR

SEQ ID NO: 323032 - protein, 26 aa, Mycobacterium
PMVVRPRPASALLRPTGPRPAVRALL

SEQ ID NO: 323033 - protein, 19 aa, Mycobacterium
PMWLIMTLRVTIIVLGAIS

SEQ ID NO: 323034 - protein, 18 aa, Mycobacterium
PMYIPKIFFAVGFSGAVV

SEQ ID NO: 323035 - protein, 22 aa, Mycobacterium
PNAEGGLQINIYASRGNYESGY

SEQ ID NO: 323036 - protein, 20 aa, Mycobacterium
PNAGRLSSMPGVRDVSQPPL

SEQ ID NO: 323037 - protein, 19 aa, Mycobacterium
PNAIWKSFDLFVGAIQAFI

SEQ ID NO: 323038 - protein, 24 aa, Mycobacterium
PNAIWKSFDLFVGAIQAFIFALLT

SEQ ID NO: 323039 - protein, 19 aa, Mycobacterium
PNAIWKSFDLFVGLIQAFI

SEQ ID NO: 323040 - protein, 18 aa, Mycobacterium
PNARFALWVNSDAAEQVG

SEQ ID NO: 323041 - protein, 21 aa, Mycobacterium
PNDVPTMLAPVAVPYPSGPAA

SEQ ID NO: 323042 - protein, 24 aa, Mycobacterium
PNEFRPERFLGVRPQTYAWVPFGG

SEQ ID NO: 323043 - protein, 17 aa, Mycobacterium
PNEPGQILVLLNVGAVF

SEQ ID NO: 323044 - protein, 21 aa, Mycobacterium
PNGDLGRATGRVEFQHVSFGY

SEQ ID NO: 323045 - protein, 24 aa, Mycobacterium
PNGPLPYIVMEYVDGVTLRDIVHT

SEQ ID NO: 323046 - protein, 19 aa, Mycobacterium
PNGTFFAVLIIFLIVLGVI

SEQ ID NO: 323047 - protein, 19 aa, Mycobacterium
PNGVEWARTALALMRIGAV

SEQ ID NO: 323048 - protein, 20 aa, Mycobacterium
PNHFNIFGPYGYNGSSYFTL

SEQ ID NO: 323049 - protein, 20 aa, Mycobacterium
PNIFAPLGILVAHIYSTMTH

SEQ ID NO: 323050 - protein, 18 aa, Mycobacterium
PNKGARTLLEFSGGPGQP

SEQ ID NO: 323051 - protein, 24 aa, Mycobacterium
PNKWVPWRQGLFIKRKAEISEEYA

SEQ ID NO: 323052 - protein, 20 aa, Mycobacterium
PNLAARFVEQFGEPVQVLTA

SEQ ID NO: 323053 - protein, 19 aa, Mycobacterium
PNLAFLPFGAGPHRCFGAA

SEQ ID NO: 323054 - protein, 21 aa, Mycobacterium
PNLFATIGIIVAHSYAYLTNS

SEQ ID NO: 323055 - protein, 21 aa, Mycobacterium
PNLFATLGIVVAHSYAYLTNS

SEQ ID NO: 323056 - protein, 19 aa, Mycobacterium
PNLFWCVGYTNASWTLRAD

SEQ ID NO: 323057 - protein, 22 aa, Mycobacterium
PNLRARPGARANLFGMTESFGP

SEQ ID NO: 323058 - protein, 18 aa, Mycobacterium
PNLTSVEASDFWEVLTRG

SEQ ID NO: 323059 - protein, 20 aa, Mycobacterium
PNLYRPAGGLSNDVVRQTAG

SEQ ID NO: 323060 - protein, 20 aa, Mycobacterium
PNMIAALVLEATFTAIFVPV

SEQ ID NO: 323061 - protein, 17 aa, Mycobacterium
PNMPVDVAPPFVVADIG

SEQ ID NO: 323062 - protein, 32 aa, Mycobacterium
PNNPNGGLLARFPGLFVQPMGLTFSGATPSNL

SEQ ID NO: 323063 - protein, 27 aa, Mycobacterium
PNNTEGRWKLGLYAAGRASQMRRMRAP

SEQ ID NO: 323064 - protein, 18 aa, Mycobacterium
PNPFALFLVSMLGPIAAT

SEQ ID NO: 323065 - protein, 26 aa, Mycobacterium
PNPIRSRLRSLLLLLVLGSAAIAATV

SEQ ID NO: 323066 - protein, 21 aa, Mycobacterium
PNPPLPPWQPYPMPRVPGTSD

SEQ ID NO: 323067 - protein, 18 aa, Mycobacterium
PNQLSLNMSDAWRHSDGR

SEQ ID NO: 323068 - protein, 25 aa, Mycobacterium
PNRFLAYGWRIGFLLSLLLVVIGIV

SEQ ID NO: 323069 - protein, 19 aa, Mycobacterium
PNRHRGFVVSFLVWSVVVG

SEQ ID NO: 323070 - protein, 47 aa, Mycobacterium
PNRLPAPRRMPAWRRLLAEMVHFFALLFWVAGGLAFIAGMPQLGVAV

SEQ ID NO: 323071 - protein, 28 aa, Mycobacterium
PNRLPRKRLRVAGMTFGAVAVAVVASAT

SEQ ID NO: 323072 - protein, 17 aa, Mycobacterium
PNRPSRWLDASLMRAAV

SEQ ID NO: 323073 - protein, 24 aa, Mycobacterium
PNSDLRWAILATRDDWDAYERLSS

SEQ ID NO: 323074 - protein, 21 aa, Mycobacterium
PNSPGAGSLFWVSDTGVRYGI

SEQ ID NO: 323075 - protein, 28 aa, Mycobacterium
PNSVLRNWPAWLAIYGFMTMDRWLLGHW

SEQ ID NO: 323076 - protein, 23 aa, Mycobacterium
PNSVYRSGLAFGLTLLPALALLA

SEQ ID NO: 323077 - protein, 18 aa, Mycobacterium
PNSYLRQMIYPFTGRGGC

SEQ ID NO: 323078 - protein, 18 aa, Mycobacterium
PNTEAVVVQVRWPGAAAQ

SEQ ID NO: 323079 - protein, 24 aa, Mycobacterium
PNTRSFTAAGIWLAIASFAAAGVV

SEQ ID NO: 323080 - protein, 27 aa, Mycobacterium
PNTRSFTAAGIWLGIGSLLAAGVVALL

SEQ ID NO: 323081 - protein, 23 aa, Mycobacterium
PNVNIRLAIEWLDTYSDGMPLSV

SEQ ID NO: 323082 - protein, 23 aa, Mycobacterium
PNVNIRMAMDWLDTYADDMSLSI

SEQ ID NO: 323083 - protein, 17 aa, Mycobacterium
PNVRELIEITLVKNPGM

SEQ ID NO: 323084 - protein, 22 aa, Mycobacterium
PNWKQSMTVLLMLYPTIMCISY

SEQ ID NO: 323085 - protein, 26 aa, Mycobacterium
PNYFGDACVWWGLWLITITGWVPLLT

SEQ ID NO: 323086 - protein, 26 aa, Mycobacterium
PNYFGDACVWWGLWLVTITGWVPLIT

SEQ ID NO: 323087 - protein, 23 aa, Mycobacterium
PNYPEYEAAVAIRRAAINAERDE

SEQ ID NO: 323088 - protein, 24 aa, Mycobacterium
PPAAPLSPWWSWRRRPTVADNFMG

SEQ ID NO: 323089 - protein, 24 aa, Mycobacterium
PPAAWRIPVTVVAVLVALVITGAV

SEQ ID NO: 323090 - protein, 27 aa, Mycobacterium
PPACTVGFLPPSAWRSPADTTTIDTPD

SEQ ID NO: 323091 - protein, 40 aa, Mycobacterium
PPADGAPRWTGRVEFAHVSFAYRPGVPVIDDLSLVAEPGS

SEQ ID NO: 323092 - protein, 17 aa, Mycobacterium
PPADPLPAVAMPAPPLA

SEQ ID NO: 323093 - protein, 19 aa, Mycobacterium
PPAELPVAAAKNFYVSPFN

SEQ ID NO: 323094 - protein, 21 aa, Mycobacterium
PPAELRQALLAAAEPAQSRRQ

SEQ ID NO: 323095 - protein, 25 aa, Mycobacterium
PPAEYWMAAPWQWRVDGRDHSGVRI

SEQ ID NO: 323096 - protein, 19 aa, Mycobacterium
PPAGAWIDQAIVIWVLIAL

SEQ ID NO: 323097 - protein, 30 aa, Mycobacterium
PPAGIPVDPVPDWPAPVAPPLTPNLLDLGG

SEQ ID NO: 323098 - protein, 25 aa, Mycobacterium
PPAGKRPGRRPVVVVAAVVATALLI

SEQ ID NO: 323099 - protein, 25 aa, Mycobacterium
PPAGLSPQELRGWDFRSSANGSGSH

SEQ ID NO: 323100 - protein, 20 aa, Mycobacterium
PPAHQVWLPPLREAPPLGAL

SEQ ID NO: 323101 - protein, 18 aa, Mycobacterium
PPAKLLVLGLFWLGWIIV

SEQ ID NO: 323102 - protein, 29 aa, Mycobacterium
PPALAAAVPAYWGGHSIAALRAAIDKVPA

SEQ ID NO: 323103 - protein, 25 aa, Mycobacterium
PPALPRAPSWWPLNMTWGGLPSSVP

SEQ ID NO: 323104 - protein, 18 aa, Mycobacterium
PPALPTVMMIGGQFNTPA

SEQ ID NO: 323105 - protein, 18 aa, Mycobacterium
PPAPLPVPAKPIGGEMLG

SEQ ID NO: 323106 - protein, 25 aa, Mycobacterium
PPAPPARPGMPAWGPVPGSPPPGFT

SEQ ID NO: 323107 - protein, 23 aa, Mycobacterium
PPAPPVLAPLAPVVPPTPPVVTV

SEQ ID NO: 323108 - protein, 23 aa, Mycobacterium
PPARARTAAFFDLDKTIIAKSST

SEQ ID NO: 323109 - protein, 22 aa, Mycobacterium
PPARSGPQVLPRTPDGASTLGA

SEQ ID NO: 323110 - protein, 18 aa, Mycobacterium
PPASIWVLAPAVAFVAIL

SEQ ID NO: 323111 - protein, 25 aa, Mycobacterium
PPATRRFTPGSVLTVLGVGIFAVVF

SEQ ID NO: 323112 - protein, 17 aa, Mycobacterium
PPAVRTDPVVLSAQTEL

SEQ ID NO: 323113 - protein, 21 aa, Mycobacterium
PPCLTGFLPAAQWRSPADTSL

SEQ ID NO: 323114 - protein, 19 aa, Mycobacterium
PPCPFKMLTGWDCPGCGGL

SEQ ID NO: 323115 - protein, 21 aa, Mycobacterium
PPDARGRVAGLFTTSFMVGAV

SEQ ID NO: 323116 - protein, 23 aa, Mycobacterium
PPDARPPLVARIAVPDAARAEFT

SEQ ID NO: 323117 - protein, 18 aa, Mycobacterium
PPDGRAGVTVITLGNHRG

SEQ ID NO: 323118 - protein, 18 aa, Mycobacterium
PPDGRAGVTVLTLGNHRG

SEQ ID NO: 323119 - protein, 23 aa, Mycobacterium
PPDHRARDIAIGFVGAVAAGVLV

SEQ ID NO: 323120 - protein, 18 aa, Mycobacterium
PPDKRPQVSGVFTDLRVA

SEQ ID NO: 323121 - protein, 37 aa, Mycobacterium
PPDPRPRRVALIGIAVCAAFLAAALAMLAPVRRLRQS

SEQ ID NO: 323122 - protein, 36 aa, Mycobacterium
PPDQPPAPEPVPWYRKPAALVGLGALGALIVALVIY

SEQ ID NO: 323123 - protein, 19 aa, Mycobacterium
PPDRVCALLERVANALPQR

SEQ ID NO: 323124 - protein, 26 aa, Mycobacterium
PPDTTRPVGLTMFWPLADRPRLAAGA

SEQ ID NO: 323125 - protein, 26 aa, Mycobacterium
PPEIPRPVPSPIIAKIMPLVMVVAMV

SEQ ID NO: 323126 - protein, 24 aa, Mycobacterium
PPEKDMSSPGWLTELDTMGRQLHA

SEQ ID NO: 323127 - protein, 20 aa, Mycobacterium
PPELAARVFATGTRVARKLL

SEQ ID NO: 323128 - protein, 25 aa, Mycobacterium
PPELPRMPSWWPMNMTWGGGLPSAV

SEQ ID NO: 323129 - protein, 33 aa, Mycobacterium
PPELPRVIPPSMLRRAMPVLIVILIVGMIIALV

SEQ ID NO: 323130 - protein, 26 aa, Mycobacterium
PPEQARRLTVRTEQKIGAVIASADID

SEQ ID NO: 323131 - protein, 24 aa, Mycobacterium
PPEQRARPGARATLFGMTEAFGPY

SEQ ID NO: 323132 - protein, 26 aa, Mycobacterium
PPESPRRKWWIAAIVAAFALALLLLA

SEQ ID NO: 323133 - protein, 18 aa, Mycobacterium
PPEVPSWRRKLRPYILSV

SEQ ID NO: 323134 - protein, 19 aa, Mycobacterium
PPFAWREYLNQTWFVARVS

SEQ ID NO: 323135 - protein, 17 aa, Mycobacterium
PPFGSWVDITVVIWVLV

SEQ ID NO: 323136 - protein, 18 aa, Mycobacterium
PPFGTWYAAMLFAVVPLR

SEQ ID NO: 323137 - protein, 18 aa, Mycobacterium
PPFLRAVAGLGHALGLPI

SEQ ID NO: 323138 - protein, 20 aa, Mycobacterium
PPFRSPESMATVLYASSTIG

SEQ ID NO: 323139 - protein, 24 aa, Mycobacterium
PPFYPAGWFWLGGRIAAATGTPAW

SEQ ID NO: 323140 - protein, 26 aa, Mycobacterium
PPFYPAGWFWLGGRLAALTGTPAWEM

SEQ ID NO: 323141 - protein, 20 aa, Mycobacterium
PPFYPPGWFWIGGRAAALTG

SEQ ID NO: 323142 - protein, 19 aa, Mycobacterium
PPGARWRVAGSAALFVAGF

SEQ ID NO: 323143 - protein, 21 aa, Mycobacterium
PPGAVPVFLSLTGRLPAPERH

SEQ ID NO: 323144 - protein, 31 aa, Mycobacterium
PPGCTVGFLPPSEWRSPADLTIADTPDGLYC

SEQ ID NO: 323145 - protein, 17 aa, Mycobacterium
PPGGTVTITARLRDSQA

SEQ ID NO: 323146 - protein, 18 aa, Mycobacterium
PPGHPLPVLPLAFDPPQH

SEQ ID NO: 323147 - protein, 39 aa, Mycobacterium
PPGLEMVAAFFACARIGVIAVPVSPPLPMAFEAGLAKLS

SEQ ID NO: 323148 - protein, 22 aa, Mycobacterium
PPGLRQLAKWTGLIASVVTLAV

SEQ ID NO: 323149 - protein, 22 aa, Mycobacterium
PPGPREWLTWLLHSRVTAFFSH

SEQ ID NO: 323150 - protein, 26 aa, Mycobacterium
PPGSKSRKGRAFAIVAALLAIAAIAV

SEQ ID NO: 323151 - protein, 24 aa, Mycobacterium
PPGSLLRQVVRFGAIGVVSTLAYL

SEQ ID NO: 323152 - protein, 25 aa, Mycobacterium
PPGSWTRFGPWLREPVGPIHWAGTE

SEQ ID NO: 323153 - protein, 18 aa, Mycobacterium
PPGTQAWVTGPGATIADE

SEQ ID NO: 323154 - protein, 19 aa, Mycobacterium
PPGVEHPAPVYGSPYYAPP

SEQ ID NO: 323155 - protein, 18 aa, Mycobacterium
PPGWSLTATASFKSATKW

SEQ ID NO: 323156 - protein, 23 aa, Mycobacterium
PPHPRFALLTVVSSFVLAELSDK

SEQ ID NO: 323157 - protein, 20 aa, Mycobacterium
PPHSRLGNRLRRITGNRRVG

SEQ ID NO: 323158 - protein, 22 aa, Mycobacterium
PPICTVGFMPPNTWRSPDDLSD

SEQ ID NO: 323159 - protein, 27 aa, Mycobacterium
PPIIYYITYRWCIGLQRGDRAVLQHGI

SEQ ID NO: 323160 - protein, 19 aa, Mycobacterium
PPILAFAGPWIFLRIRFFR

SEQ ID NO: 323161 - protein, 32 aa, Mycobacterium
PPILALMMPWLFLRVRFFRRKWTAVTLSSTWA

SEQ ID NO: 323162 - protein, 18 aa, Mycobacterium
PPIQIPLLPDNVSRQAFP

SEQ ID NO: 323163 - protein, 19 aa, Mycobacterium
PPISAPRIRGLGGAAPGLA

SEQ ID NO: 323164 - protein, 25 aa, Mycobacterium
PPKGPGSKAPWLIIAGVAVLGVLAL

SEQ ID NO: 323165 - protein, 19 aa, Mycobacterium
PPKLPTVMMIGGEFNTPAD

SEQ ID NO: 323166 - protein, 24 aa, Mycobacterium
PPKNPDRWNILLAPLPGPTPPQYP

SEQ ID NO: 323167 - protein, 21 aa, Mycobacterium
PPKNWWPPHVDPLGAASDPRI

SEQ ID NO: 323168 - protein, 37 aa, Mycobacterium
PPKRPPAWSLGNWPVGWKVVAIAVVPLLLAMVLGGLR

SEQ ID NO: 323169 - protein, 20 aa, Mycobacterium
PPKSAPGWYPDPAGVGHGLQ

SEQ ID NO: 323170 - protein, 24 aa, Mycobacterium
PPKWASWVRLVFGVALLALAAFHW

SEQ ID NO: 323171 - protein, 29 aa, Mycobacterium
PPKYRGRLVLCFQIAIGVGIVIATIVGAS

SEQ ID NO: 323172 - protein, 17 aa, Mycobacterium
PPLAALIEPDLRVLVNL

SEQ ID NO: 323173 - protein, 30 aa, Mycobacterium
PPLATLLIGEWGWRGALFGLGGLWGGLVLI

SEQ ID NO: 323174 - protein, 17 aa, Mycobacterium
PPLEEAIPLQGLLERSG

SEQ ID NO: 323175 - protein, 23 aa, Mycobacterium
PPLFQEHLHRAGVPMNSPEEMHA

SEQ ID NO: 323176 - protein, 21 aa, Mycobacterium
PPLFREHLNRAGLPHSSNEQF

SEQ ID NO: 323177 - protein, 18 aa, Mycobacterium
PPLFWLLFGIMIVTSVGW

SEQ ID NO: 323178 - protein, 26 aa, Mycobacterium
PPLGRAALWRAARSGLEGDLVDLIHP

SEQ ID NO: 323179 - protein, 21 aa, Mycobacterium
PPLHDQWRPVLWTISILTMAV

SEQ ID NO: 323180 - protein, 20 aa, Mycobacterium
PPLHDQWRPVLWTISILTMV

SEQ ID NO: 323181 - protein, 21 aa, Mycobacterium
PPLKFAQLVGLVFAVCGVAGF

SEQ ID NO: 323182 - protein, 21 aa, Mycobacterium
PPLKFAQLVGLVFAVIGAVGF

SEQ ID NO: 323183 - protein, 23 aa, Mycobacterium
PPLLACIAYALAIDYEIFVLSRI

SEQ ID NO: 323184 - protein, 25 aa, Mycobacterium
PPLLARLRPGLPAPQVPAAVTPSRP

SEQ ID NO: 323185 - protein, 23 aa, Mycobacterium
PPLLRRVWEAIIGEFTPPSTPRP

SEQ ID NO: 323186 - protein, 19 aa, Mycobacterium
PPLLSRLHQRIGISETPAP

SEQ ID NO: 323187 - protein, 18 aa, Mycobacterium
PPLLTLRSTVVFSAAAMA

SEQ ID NO: 323188 - protein, 32 aa, Mycobacterium
PPLLVLWLVRWLLFRVEFGAGMIKMRGDRCWR

SEQ ID NO: 323189 - protein, 25 aa, Mycobacterium
PPLPDLPAAPLLPEIWSNAPPIPGW

SEQ ID NO: 323190 - protein, 22 aa, Mycobacterium
PPLPPVIEAFPGYHEVQQPPKS

SEQ ID NO: 323191 - protein, 17 aa, Mycobacterium
PPLPPWQPNPSPRVPGT

SEQ ID NO: 323192 - protein, 17 aa, Mycobacterium
PPLPRATTATVLPASGI

SEQ ID NO: 323193 - protein, 25 aa, Mycobacterium
PPLQRFTGSIPRHGRVVPIEGGHWV

SEQ ID NO: 323194 - protein, 19 aa, Mycobacterium
PPLREIYRQGFAVAQDQPW

SEQ ID NO: 323195 - protein, 17 aa, Mycobacterium
PPLRERILLRLSSIELN

SEQ ID NO: 323196 - protein, 20 aa, Mycobacterium
PPLRLKLMRAAVETCRLLPM

SEQ ID NO: 323197 - protein, 21 aa, Mycobacterium
PPLRRRLTPNVPRLGIEALEG

SEQ ID NO: 323198 - protein, 17 aa, Mycobacterium
PPLSGTVDQMERLAPLL

SEQ ID NO: 323199 - protein, 18 aa, Mycobacterium
PPLTGLNPFVGRHDAGLR

SEQ ID NO: 323200 - protein, 25 aa, Mycobacterium
PPLTIPWSVLSLFAAGPTLSRADAL

SEQ ID NO: 323201 - protein, 18 aa, Mycobacterium
PPLTTSIPIVNPATAASP

SEQ ID NO: 323202 - protein, 17 aa, Mycobacterium
PPLWPLIITAYWAVALS

SEQ ID NO: 323203 - protein, 17 aa, Mycobacterium
PPMPLAVPAKPVGGDAL

SEQ ID NO: 323204 - protein, 17 aa, Mycobacterium
PPMPTLFVVADEFTLML

SEQ ID NO: 323205 - protein, 17 aa, Mycobacterium
PPMTTWYAAMLFAVVPL

SEQ ID NO: 323206 - protein, 18 aa, Mycobacterium
PPNEVAVFTGRGAPKVVR

SEQ ID NO: 323207 - protein, 22 aa, Mycobacterium
PPNRKRVGVALGSVCLTGGLAL

SEQ ID NO: 323208 - protein, 20 aa, Mycobacterium
PPNVRELIEITLVKNPGLRY

SEQ ID NO: 323209 - protein, 17 aa, Mycobacterium
PPPAARPTLPLVAPAPA

SEQ ID NO: 323210 - protein, 24 aa, Mycobacterium
PPPAMPPALAWWASSLQLSGLGPE

SEQ ID NO: 323211 - protein, 18 aa, Mycobacterium
PPPARPVPFEVMSVVTGD

SEQ ID NO: 323212 - protein, 24 aa, Mycobacterium
PPPASPRPARRLMVGHAPLVVTAV

SEQ ID NO: 323213 - protein, 24 aa, Mycobacterium
PPPCLTGFIPAEQWRSFADTSLQP

SEQ ID NO: 323214 - protein, 17 aa, Mycobacterium
PPPDAFSGIAPDVELIA

SEQ ID NO: 323215 - protein, 17 aa, Mycobacterium
PPPDGMRVYITGPAALT

SEQ ID NO: 323216 - protein, 25 aa, Mycobacterium
PPPDHRARNIAIGFLGVVAAGVLVF

SEQ ID NO: 323217 - protein, 18 aa, Mycobacterium
PPPDWPLTAVDRVHEQLS

SEQ ID NO: 323218 - protein, 17 aa, Mycobacterium
PPPFTSWQPPGVPPVPP

SEQ ID NO: 323219 - protein, 24 aa, Mycobacterium
PPPGHGVPPGYGRPPGYGTPPAFG

SEQ ID NO: 323220 - protein, 20 aa, Mycobacterium
PPPGSMKPLIHVLGQAEGNV

SEQ ID NO: 323221 - protein, 17 aa, Mycobacterium
PPPGYPGGSPWGAAQPN

SEQ ID NO: 323222 - protein, 24 aa, Mycobacterium
PPPKPPWWNIIWQLLETLAHVLTQ

SEQ ID NO: 323223 - protein, 26 aa, Mycobacterium
PPPLARIARWTALYGTYGNWLFTALG

SEQ ID NO: 323224 - protein, 27 aa, Mycobacterium
PPPMPVPPAGHAFRGGPPPGAPGPGQL

SEQ ID NO: 323225 - protein, 25 aa, Mycobacterium
PPPNFPPQPPHGFEQPQGFDPFDQE

SEQ ID NO: 323226 - protein, 26 aa, Mycobacterium
PPPPDHRARNIAIGFVGAVAAGVLVA

SEQ ID NO: 323227 - protein, 19 aa, Mycobacterium
PPPPFTSWMPPDYPPQAPQ

SEQ ID NO: 323228 - protein, 19 aa, Mycobacterium
PPPPFTSWMPPDYPPQPPL

SEQ ID NO: 323229 - protein, 17 aa, Mycobacterium
PPPPGRPSAQVWLVDPR

SEQ ID NO: 323230 - protein, 17 aa, Mycobacterium
PPPPPAWTYGGPVTGPP

SEQ ID NO: 323231 - protein, 17 aa, Mycobacterium
PPPPPGWGPPPVPPGRP

SEQ ID NO: 323232 - protein, 23 aa, Mycobacterium
PPPPPPGPPRHGGGGPTGGDGPS

SEQ ID NO: 323233 - protein, 18 aa, Mycobacterium
PPPPPRPVATATTTVAPP

SEQ ID NO: 323234 - protein, 25 aa, Mycobacterium
PPPPPWTYGGPFPGPPPQRPSGNRM

SEQ ID NO: 323235 - protein, 19 aa, Mycobacterium
PPPPRGFLPLFPPGMGPPG

SEQ ID NO: 323236 - protein, 24 aa, Mycobacterium
PPPPRPEVVLRFTGTQWVAIDLSH

SEQ ID NO: 323237 - protein, 30 aa, Mycobacterium
PPPPSPSGNRVWWILGTVIVIGVIALAGGI

SEQ ID NO: 323238 - protein, 29 aa, Mycobacterium
PPPRGPKPPPRWLWIVAGAAVLLVVALVV

SEQ ID NO: 323239 - protein, 21 aa, Mycobacterium
PPPRPRSRRRPIIAATVLVLV

SEQ ID NO: 323240 - protein, 17 aa, Mycobacterium
PPPRPSVLRPGRVPPAL

SEQ ID NO: 323241 - protein, 26 aa, Mycobacterium
PPPRPVAQSFWYRTAKLVTRHAIPVG

SEQ ID NO: 323242 - protein, 19 aa, Mycobacterium
PPPRRFASGIMGRTMVVWF

SEQ ID NO: 323243 - protein, 22 aa, Mycobacterium
PPPRRGTFSPGQKALMWAAAVL

SEQ ID NO: 323244 - protein, 27 aa, Mycobacterium
PPPRRPAHRKLVGWLSAAAGLVLAAAL

SEQ ID NO: 323245 - protein, 23 aa, Mycobacterium
PPPRRRAHRRLVAVVSIAVTLVA

SEQ ID NO: 323246 - protein, 29 aa, Mycobacterium
PPPRRRARGRLVAWISLAAAVVVIAALGW

SEQ ID NO: 323247 - protein, 22 aa, Mycobacterium
PPPSLRRYTAHRVRRIMPAYVV

SEQ ID NO: 323248 - protein, 26 aa, Mycobacterium
PPPSLSRYAWHRVRRIMPAYVVTVLF

SEQ ID NO: 323249 - protein, 26 aa, Mycobacterium
PPPSLSRYAWHRVRRIMPAYVVVVLI

SEQ ID NO: 323250 - protein, 23 aa, Mycobacterium
PPPSPGTVYQMWLLGANGPTSAG

SEQ ID NO: 323251 - protein, 20 aa, Mycobacterium
PPPSPGTVYQMWLVDAKGPT

SEQ ID NO: 323252 - protein, 23 aa, Mycobacterium
PPPSPPWWSIMWQLLQTLADIVS

SEQ ID NO: 323253 - protein, 22 aa, Mycobacterium
PPPVAYPRRWGYWPAAAGLYLF

SEQ ID NO: 323254 - protein, 29 aa, Mycobacterium
PPQAAPRPSAWPLVALAITAIVGVVLGTT

SEQ ID NO: 323255 - protein, 19 aa, Mycobacterium
PPQGVWHLGPLPIRAYALF

SEQ ID NO: 323256 - protein, 17 aa, Mycobacterium
PPQLSYPPQQQFQQAYA

SEQ ID NO: 323257 - protein, 23 aa, Mycobacterium
PPQLVPLLEFTTTYLSGVLVGLA

SEQ ID NO: 323258 - protein, 18 aa, Mycobacterium
PPQNLQFMLADLKGGSGV

SEQ ID NO: 323259 - protein, 17 aa, Mycobacterium
PPQSFAIPGCYNLSVPP

SEQ ID NO: 323260 - protein, 18 aa, Mycobacterium
PPRGWPVGSYPTYAEAQR

SEQ ID NO: 323261 - protein, 21 aa, Mycobacterium
PPRREAICQAGLQIFADMVLA

SEQ ID NO: 323262 - protein, 20 aa, Mycobacterium
PPRRHPWEIGLLVVVILFTV

SEQ ID NO: 323263 - protein, 19 aa, Mycobacterium
PPRRLASGIMGRTMMVWLL

SEQ ID NO: 323264 - protein, 29 aa, Mycobacterium
PPRRQPHRALVVWISFAAALVAVGALAGC

SEQ ID NO: 323265 - protein, 25 aa, Mycobacterium
PPRRRVWWPPVGVRIALALLTIGVA

SEQ ID NO: 323266 - protein, 17 aa, Mycobacterium
PPRRVWRVLPLGRMGTW

SEQ ID NO: 323267 - protein, 24 aa, Mycobacterium
PPRTADMKALFAAIINDDPLPLEN

SEQ ID NO: 323268 - protein, 24 aa, Mycobacterium
PPRTADMKALFSAIIDDEPLPLEN

SEQ ID NO: 323269 - protein, 23 aa, Mycobacterium
PPRTRLGARLAPIVQAPLAIATW

SEQ ID NO: 323270 - protein, 23 aa, Mycobacterium
PPRVRELAILRVAHRRECAYEWS

SEQ ID NO: 323271 - protein, 23 aa, Mycobacterium
PPSDFKTSVAVWLGLYPTVVLLT

SEQ ID NO: 323272 - protein, 17 aa, Mycobacterium
PPSGRHAAIEFDEPIPS

SEQ ID NO: 323273 - protein, 24 aa, Mycobacterium
PPSHAQVFILSWAGMRGVVSLAAA

SEQ ID NO: 323274 - protein, 31 aa, Mycobacterium
PPSRKAPLAWAMGAAIPWSMLVFGQLVWLLF

SEQ ID NO: 323275 - protein, 25 aa, Mycobacterium
PPSRPGEKNMPFWGTSFSAAYVSGV

SEQ ID NO: 323276 - protein, 26 aa, Mycobacterium
PPSVGRYAWHRVRRIMPAYAVTVIAA

SEQ ID NO: 323277 - protein, 25 aa, Mycobacterium
PPSVSRYAWHRVRRIMPAYVITVLF

SEQ ID NO: 323278 - protein, 17 aa, Mycobacterium
PPTHLWQARLVRDAKPY

SEQ ID NO: 323279 - protein, 18 aa, Mycobacterium
PPTLRWVAGSDHRGPANA

SEQ ID NO: 323280 - protein, 20 aa, Mycobacterium
PPTNWWWAAIVSVALLTWVL

SEQ ID NO: 323281 - protein, 33 aa, Mycobacterium
PPTPEWGLLVAEGRSYLATAWWLTSLPGAVILV

SEQ ID NO: 323282 - protein, 18 aa, Mycobacterium
PPTRARMYLMAVAAVLAF

SEQ ID NO: 323283 - protein, 17 aa, Mycobacterium
PPVGLIGVFGEATQGRG

SEQ ID NO: 323284 - protein, 19 aa, Mycobacterium
PPVKAALAAATARAPHDPT

SEQ ID NO: 323285 - protein, 19 aa, Mycobacterium
PPVKGLGIAAGARRPGAKK

SEQ ID NO: 323286 - protein, 24 aa, Mycobacterium
PPVLIPWSVLSLFAPGPTLSRADA

SEQ ID NO: 323287 - protein, 26 aa, Mycobacterium
PPVNRRCVLTLYPHCAPKIGVPEENP

SEQ ID NO: 323288 - protein, 17 aa, Mycobacterium
PPVPLHLALLAVVLPLV

SEQ ID NO: 323289 - protein, 17 aa, Mycobacterium
PPVRRLPASFGVDQVRQ

SEQ ID NO: 323290 - protein, 17 aa, Mycobacterium
PPVVEPGPDRGPITIVA

SEQ ID NO: 323291 - protein, 20 aa, Mycobacterium
PPWMVFFAFSVSLIYQFWVH

SEQ ID NO: 323292 - protein, 19 aa, Mycobacterium
PPWVALPIGLFISSIICAL

SEQ ID NO: 323293 - protein, 17 aa, Mycobacterium
PPYGRPPLAPPPAPGPA

SEQ ID NO: 323294 - protein, 24 aa, Mycobacterium
PPYLRLPALTRREAIIAAATVLVL

SEQ ID NO: 323295 - protein, 22 aa, Mycobacterium
PPYPLNVIPWLFILTVAAALAW

SEQ ID NO: 323296 - protein, 18 aa, Mycobacterium
PPYRDYRPGDHDAHDAYD

SEQ ID NO: 323297 - protein, 21 aa, Mycobacterium
PPYRFPSPRNLLIAMWASAKL

SEQ ID NO: 323298 - protein, 23 aa, Mycobacterium
PQAFLIRPSRWLWAIHANRATMS

SEQ ID NO: 323299 - protein, 31 aa, Mycobacterium
PQAPATARRSWGWVIAVVLVIAALVAIAILG

SEQ ID NO: 323300 - protein, 18 aa, Mycobacterium
PQAPFGRDPISGVPLSDK

SEQ ID NO: 323301 - protein, 18 aa, Mycobacterium
PQARGRAVLRVEIGAPSP

SEQ ID NO: 323302 - protein, 20 aa, Mycobacterium
PQARWIRPAYWAMLVGTAVL

SEQ ID NO: 323303 - protein, 23 aa, Mycobacterium
PQAYKFLGGNGYSLNSHTTPLSA

SEQ ID NO: 323304 - protein, 24 aa, Mycobacterium
PQDAIRWAALVVLTLIGLGLIFPP

SEQ ID NO: 323305 - protein, 23 aa, Mycobacterium
PQDAIRWAALVVLVLIGAGLIFP

SEQ ID NO: 323306 - protein, 18 aa, Mycobacterium
PQDGRKRLIINWLAAILV

SEQ ID NO: 323307 - protein, 26 aa, Mycobacterium
PQDPKSPRWLWIVAGVAVVMVIGLVI

SEQ ID NO: 323308 - protein, 27 aa, Mycobacterium
PQDSWRKRLPTIFLDVARFALIGIGLA

SEQ ID NO: 323309 - protein, 22 aa, Mycobacterium
PQEFARRLPFMAAKRDFSEPTA

SEQ ID NO: 323310 - protein, 23 aa, Mycobacterium
PQERRLVFERFYRSASARAMPGS

SEQ ID NO: 323311 - protein, 21 aa, Mycobacterium
PQERRLVFERFYRSTTARAMP

SEQ ID NO: 323312 - protein, 21 aa, Mycobacterium
PQFGKDLGFYAFELPFYRLLL

SEQ ID NO: 323313 - protein, 18 aa, Mycobacterium
PQGAVGEIWVQGRNVGLG

SEQ ID NO: 323314 - protein, 31 aa, Mycobacterium
PQGPLPAQIYWRRRALAIGIAVVVVGVVAAI

SEQ ID NO: 323315 - protein, 26 aa, Mycobacterium
PQGPRLTFAVGPRLGYSDRPGRARQS

SEQ ID NO: 323316 - protein, 25 aa, Mycobacterium
PQGRPSAFTMAGPWVGIAAPGEDIT

SEQ ID NO: 323317 - protein, 23 aa, Mycobacterium
PQHLRLGPYAVMHAIADYVVDHY

SEQ ID NO: 323318 - protein, 19 aa, Mycobacterium
PQIVRSRPASQLLRPFGPR

SEQ ID NO: 323319 - protein, 17 aa, Mycobacterium
PQLAYSMADDAEPFAGG

SEQ ID NO: 323320 - protein, 26 aa, Mycobacterium
PQLAYSMADEGGVYPGEMDEYDPEFD

SEQ ID NO: 323321 - protein, 22 aa, Mycobacterium
PQLDAATAWLVSPVLQGGRTEG

SEQ ID NO: 323322 - protein, 22 aa, Mycobacterium
PQLFARRIGRNESFNHAGNATA

SEQ ID NO: 323323 - protein, 25 aa, Mycobacterium
PQLLDFYNAFFPRLEEAIDYCDKFP

SEQ ID NO: 323324 - protein, 31 aa, Mycobacterium
PQLLLCGIIVPRAALPEWLQWVSNALPASYA

SEQ ID NO: 323325 - protein, 23 aa, Mycobacterium
PQLPCLLPPPFCPSSTTPATPPP

SEQ ID NO: 323326 - protein, 19 aa, Mycobacterium
PQLRVAIEGVARFSQTLDE

SEQ ID NO: 323327 - protein, 21 aa, Mycobacterium
PQLRVGSCYQTAVVMGSTVFV

SEQ ID NO: 323328 - protein, 18 aa, Mycobacterium
PQLSDFGIAHIEGGYETA

SEQ ID NO: 323329 - protein, 24 aa, Mycobacterium
PQLSHGDWRLHIHGMVDREITYSF

SEQ ID NO: 323330 - protein, 26 aa, Mycobacterium
PQLSHGDWRLRIHGMVNREATYSLAD

SEQ ID NO: 323331 - protein, 26 aa, Mycobacterium
PQLSRGDWRLRIHGMVDREISYTFDD

SEQ ID NO: 323332 - protein, 26 aa, Mycobacterium
PQLSRGDWRLRIHGMVDREITLSFDD

SEQ ID NO: 323333 - protein, 27 aa, Mycobacterium
PQLSRSEWRLRIHGMVDREVTFTYEDL

SEQ ID NO: 323334 - protein, 22 aa, Mycobacterium
PQLSSKRPGVFDNGAVWDNAMT

SEQ ID NO: 323335 - protein, 18 aa, Mycobacterium
PQLTDFGIAHIEGGFETA

SEQ ID NO: 323336 - protein, 18 aa, Mycobacterium
PQLWQLTRGAGQRVAVID

SEQ ID NO: 323337 - protein, 23 aa, Mycobacterium
PQLYGVGYPVMYAAFAHHYAIWF

SEQ ID NO: 323338 - protein, 17 aa, Mycobacterium
PQMREPVLFAIPFFLLL

SEQ ID NO: 323339 - protein, 17 aa, Mycobacterium
PQMSAWVRYHSDSRLPK

SEQ ID NO: 323340 - protein, 21 aa, Mycobacterium
PQMVTRFAVMFAAGALIYQYQ

SEQ ID NO: 323341 - protein, 19 aa, Mycobacterium
PQNMMTPMMLFIKSPRDLR

SEQ ID NO: 323342 - protein, 19 aa, Mycobacterium
PQPLSFWGVPVQPEGGADA

SEQ ID NO: 323343 - protein, 20 aa, Mycobacterium
PQPMPTWLWVLLAGGAALLG

SEQ ID NO: 323344 - protein, 18 aa, Mycobacterium
PQPPGGSAYQGYPPPGPV

SEQ ID NO: 323345 - protein, 19 aa, Mycobacterium
PQPRLSRDAFLPFQSGRPF

SEQ ID NO: 323346 - protein, 22 aa, Mycobacterium
PQPRSDLGVAIADRRLVAAGGQ

SEQ ID NO: 323347 - protein, 24 aa, Mycobacterium
PQPTELYWVLTMLATALLLVEIYL

SEQ ID NO: 323348 - protein, 19 aa, Mycobacterium
PQPTPWTGATGWGTGYPGT

SEQ ID NO: 323349 - protein, 31 aa, Mycobacterium
PQPVSADMIDWFWRHNAWRGVFNNPLPRRAT

SEQ ID NO: 323350 - protein, 24 aa, Mycobacterium
PQPYWRVTALLVVFSVVNFPDALL

SEQ ID NO: 323351 - protein, 24 aa, Mycobacterium
PQQALNVPLPWSIVLSSTKPGIPA

SEQ ID NO: 323352 - protein, 17 aa, Mycobacterium
PQQALNVPLPWSKVLSS

SEQ ID NO: 323353 - protein, 23 aa, Mycobacterium
PQRFRDEMGFAWDPSRERMFRWL

SEQ ID NO: 323354 - protein, 17 aa, Mycobacterium
PQRGFEILSDRAQSGSV

SEQ ID NO: 323355 - protein, 17 aa, Mycobacterium
PQRGMTIAVMLLGVGGI

SEQ ID NO: 323356 - protein, 24 aa, Mycobacterium
PQRGPRLVLQVGVPPGAAVPGTRV

SEQ ID NO: 323357 - protein, 36 aa, Mycobacterium
PQRRRKRKSNGWKIFRNVMIALVLLAIVIPLATFAL

SEQ ID NO: 323358 - protein, 18 aa, Mycobacterium
PQRRWQRLLVAPLAVATW

SEQ ID NO: 323359 - protein, 24 aa, Mycobacterium
PQRSARLLSSWYRLPPKDATKPLL

SEQ ID NO: 323360 - protein, 30 aa, Mycobacterium
PQRTMGAAWARFVVRFRKPLLVGGSAALIV

SEQ ID NO: 323361 - protein, 19 aa, Mycobacterium
PQRVRPRPASRMLRAYGPR

SEQ ID NO: 323362 - protein, 26 aa, Mycobacterium
PQRVRPRPASTMLRPYGPRPAVRQLL

SEQ ID NO: 323363 - protein, 26 aa, Mycobacterium
PQRVRQRPASAMLRSVGPRPLVRSLL

SEQ ID NO: 323364 - protein, 17 aa, Mycobacterium
PQRVRQRPLPAPWPQPV

SEQ ID NO: 323365 - protein, 20 aa, Mycobacterium
PQRVRTRPASQLLRPYGPRP

SEQ ID NO: 323366 - protein, 18 aa, Mycobacterium
PQRVRTRPVPAPWPRSGG

SEQ ID NO: 323367 - protein, 17 aa, Mycobacterium
PQRVSGVTLPWTLAVTT

SEQ ID NO: 323368 - protein, 22 aa, Mycobacterium
PQTCLKVAAGETARLPVTLRTD

SEQ ID NO: 323369 - protein, 19 aa, Mycobacterium
PQTGGVGWAGRLPKPGFSN

SEQ ID NO: 323370 - protein, 24 aa, Mycobacterium
PQTLFFPFVMLLAATSLFRGNDNK

SEQ ID NO: 323371 - protein, 27 aa, Mycobacterium
PQVGRLSDRFGRRPVYIVGAILAATWG

SEQ ID NO: 323372 - protein, 30 aa, Mycobacterium
PQVLRWSRNRMAVVATVLFVLALSWASAAG

SEQ ID NO: 323373 - protein, 19 aa, Mycobacterium
PQWFLLPWLLLVGVRLGLG

SEQ ID NO: 323374 - protein, 27 aa, Mycobacterium
PQWRSRVKAKRLGRGYEYLDLGPDADD

SEQ ID NO: 323375 - protein, 17 aa, Mycobacterium
PQYGELKGPSCFTAPLV

SEQ ID NO: 323376 - protein, 24 aa, Mycobacterium
PQYHASSALLAWLTAAAVAIAMLT

SEQ ID NO: 323377 - protein, 19 aa, Mycobacterium
PQYKHAIVMGVNKDRVPGG

SEQ ID NO: 323378 - protein, 19 aa, Mycobacterium
PQYKHSVVMGVNKNKVPGG

SEQ ID NO: 323379 - protein, 17 aa, Mycobacterium
PQYQFVESVSWIPAFGM

SEQ ID NO: 323380 - protein, 17 aa, Mycobacterium
PQYRMLAALDDSVGTQR

SEQ ID NO: 323381 - protein, 26 aa, Mycobacterium
PRAAEALGRVEVVCFDKTGTLSENRL

SEQ ID NO: 323382 - protein, 23 aa, Mycobacterium
PRAAFDQRWLDWSVWIGVAALAV

SEQ ID NO: 323383 - protein, 18 aa, Mycobacterium
PRAAKLKAAELVVTDEGV

SEQ ID NO: 323384 - protein, 17 aa, Mycobacterium
PRAALALAVGAAVTTLA

SEQ ID NO: 323385 - protein, 19 aa, Mycobacterium
PRAAQKFIITGSFLSLFAT

SEQ ID NO: 323386 - protein, 17 aa, Mycobacterium
PRAASIVAQVARALDAA

SEQ ID NO: 323387 - protein, 24 aa, Mycobacterium
PRADARIGLRGAVVLYVVMAGVIW

SEQ ID NO: 323388 - protein, 20 aa, Mycobacterium
PRADGGFTLFYLGINLGAFI

SEQ ID NO: 323389 - protein, 20 aa, Mycobacterium
PRADPWKSFGAVMAATLLLE

SEQ ID NO: 323390 - protein, 19 aa, Mycobacterium
PRAEPRAAQKFIITGSFLS

SEQ ID NO: 323391 - protein, 21 aa, Mycobacterium
PRAFGKVILPLAMPGVLAGSM

SEQ ID NO: 323392 - protein, 19 aa, Mycobacterium
PRAFRVPGYPVTPVLSVIA

SEQ ID NO: 323393 - protein, 20 aa, Mycobacterium
PRAGSGVAERDGLIVGFAAA

SEQ ID NO: 323394 - protein, 18 aa, Mycobacterium
PRAGTWFLSSAVLADHVE

SEQ ID NO: 323395 - protein, 17 aa, Mycobacterium
PRALFPWPYNGIPGGSR

SEQ ID NO: 323396 - protein, 20 aa, Mycobacterium
PRALMPAWLQWLSNAMPASY

SEQ ID NO: 323397 - protein, 19 aa, Mycobacterium
PRALMPHWLEWVSDAMPAS

SEQ ID NO: 323398 - protein, 40 aa, Mycobacterium
PRAPDYFRRAELCRERLGPVLRRLTVNYPPIMFHPLNTIT

SEQ ID NO: 323399 - protein, 21 aa, Mycobacterium
PRAPQLWLPPLDEPIPITALL

SEQ ID NO: 323400 - protein, 20 aa, Mycobacterium
PRAPQLWLPPLDEPIPLTAV

SEQ ID NO: 323401 - protein, 20 aa, Mycobacterium
PRAPQLWLPPLDTAIPLASV

SEQ ID NO: 323402 - protein, 20 aa, Mycobacterium
PRARNPWAIVSGVAVAILVM

SEQ ID NO: 323403 - protein, 22 aa, Mycobacterium
PRARPDHAFALADFALDMANVA

SEQ ID NO: 323404 - protein, 17 aa, Mycobacterium
PRATFGLPLLSDGIDIV

SEQ ID NO: 323405 - protein, 19 aa, Mycobacterium
PRATLAWTMTIAAGVLVGM

SEQ ID NO: 323406 - protein, 17 aa, Mycobacterium
PRATLGLTAIVVVAIQI

SEQ ID NO: 323407 - protein, 19 aa, Mycobacterium
PRDAAARLSVRNATHAGLK

SEQ ID NO: 323408 - protein, 18 aa, Mycobacterium
PRDAFGPDGPRGVPSGAP

SEQ ID NO: 323409 - protein, 18 aa, Mycobacterium
PRDRVLRRDIQWQERESW

SEQ ID NO: 323410 - protein, 17 aa, Mycobacterium
PRDVPVRTAIGSMAIAL

SEQ ID NO: 323411 - protein, 20 aa, Mycobacterium
PRDYWLLGIAAAVVIVLFGW

SEQ ID NO: 323412 - protein, 20 aa, Mycobacterium
PREANAIKNLLGMVANTTAG

SEQ ID NO: 323413 - protein, 17 aa, Mycobacterium
PREDALKVLPISVSADD

SEQ ID NO: 323414 - protein, 18 aa, Mycobacterium
PREFLKRDLGGFASGTAW

SEQ ID NO: 323415 - protein, 26 aa, Mycobacterium
PREIVLRAWTLVWLMLVWTMLWGNFS

SEQ ID NO: 323416 - protein, 32 aa, Mycobacterium
PRELAASPDLDWRSVWDRGWSAAAQAQDKPVE

SEQ ID NO: 323417 - protein, 20 aa, Mycobacterium
PREQLVASGRLDWMKDHSDA

SEQ ID NO: 323418 - protein, 18 aa, Mycobacterium
PRFARRRAGAQVSLVPLA

SEQ ID NO: 323419 - protein, 23 aa, Mycobacterium
PRFFPIVIGVALLVMAVILAIAI

SEQ ID NO: 323420 - protein, 21 aa, Mycobacterium
PRFFSRRIGRNESFNHAGNAS

SEQ ID NO: 323421 - protein, 23 aa, Mycobacterium
PRFGVLEPAQFLPLVREHGLMDA

SEQ ID NO: 323422 - protein, 20 aa, Mycobacterium
PRFILWVLACFAVLALTVWA

SEQ ID NO: 323423 - protein, 18 aa, Mycobacterium
PRFMRAVRTFAVPIIVAW

SEQ ID NO: 323424 - protein, 31 aa, Mycobacterium
PRFMRFVRTFAWPIIIGWLLLTVALNVLVPP

SEQ ID NO: 323425 - protein, 17 aa, Mycobacterium
PRFPEIKSDLAMSNAGY

SEQ ID NO: 323426 - protein, 18 aa, Mycobacterium
PRFPRGWLTEPNLAVVAV

SEQ ID NO: 323427 - protein, 24 aa, Mycobacterium
PRGALPSPRRWIWIVLAVGGITAA

SEQ ID NO: 323428 - protein, 27 aa, Mycobacterium
PRGDLMVEAPLWFHIHVLLGLTLFCLW

SEQ ID NO: 323429 - protein, 20 aa, Mycobacterium
PRGDNHFRRPTAVSRGTGDE

SEQ ID NO: 323430 - protein, 17 aa, Mycobacterium
PRGELMALAPLYYQLHV

SEQ ID NO: 323431 - protein, 26 aa, Mycobacterium
PRGGFVTGWMYWYFFVVVVAVETVAG

SEQ ID NO: 323432 - protein, 29 aa, Mycobacterium
PRGGKPPLRQRNWGWVLAIVVIVLAVAAI

SEQ ID NO: 323433 - protein, 20 aa, Mycobacterium
PRGLITVRLTPDFDIAQLTR

SEQ ID NO: 323434 - protein, 24 aa, Mycobacterium
PRGMPLELAAPIITAVGSALDYAH

SEQ ID NO: 323435 - protein, 21 aa, Mycobacterium
PRGPIARIHIESGVKIPVGTP

SEQ ID NO: 323436 - protein, 26 aa, Mycobacterium
PRGPLPRPAPPLPLAAPSPVRGAPPE

SEQ ID NO: 323437 - protein, 17 aa, Mycobacterium
PRGPMGHWLQHAHESLA

SEQ ID NO: 323438 - protein, 25 aa, Mycobacterium
PRGRDVPLRIGMAMGPVVAGVVGAK

SEQ ID NO: 323439 - protein, 22 aa, Mycobacterium
PRGRVRIGTVLVSPVEPPNDDD

SEQ ID NO: 323440 - protein, 20 aa, Mycobacterium
PRGTDVTLHLNADYIDHAVS

SEQ ID NO: 323441 - protein, 18 aa, Mycobacterium
PRGVLPGPLARAGLATAV

SEQ ID NO: 323442 - protein, 18 aa, Mycobacterium
PRGWPIGSYPTYAEAQRA

SEQ ID NO: 323443 - protein, 29 aa, Mycobacterium
PRGYDVLPSMEWIPFVTFLQVSADMAVAV

SEQ ID NO: 323444 - protein, 25 aa, Mycobacterium
PRHARRWRRIGAIIGGCAAVVAVAI

SEQ ID NO: 323445 - protein, 19 aa, Mycobacterium
PRHLAGMLFITVRGFARQL

SEQ ID NO: 323446 - protein, 19 aa, Mycobacterium
PRHLRYRAQAGLSLAALLA

SEQ ID NO: 323447 - protein, 27 aa, Mycobacterium
PRHRARLDTWRYGWVLNIGAAIAGAVG

SEQ ID NO: 323448 - protein, 20 aa, Mycobacterium
PRHWRTRLILAVLGIVSTLI

SEQ ID NO: 323449 - protein, 27 aa, Mycobacterium
PRHWVGRAMGIGWAFIGIIFVAFYTAN

SEQ ID NO: 323450 - protein, 20 aa, Mycobacterium
PRIAAVVVVALLLALTIALL

SEQ ID NO: 323451 - protein, 18 aa, Mycobacterium
PRIARLIRTLSIPIILFW

SEQ ID NO: 323452 - protein, 25 aa, Mycobacterium
PRIATTAGMLAEWLAGDGADVPLDQ

SEQ ID NO: 323453 - protein, 19 aa, Mycobacterium
PRIGELVAALTERLTDTDM

SEQ ID NO: 323454 - protein, 28 aa, Mycobacterium
PRIIRTFAVPIILVWIALIAVLNTVVPQ

SEQ ID NO: 323455 - protein, 18 aa, Mycobacterium
PRILFAAGAVVVLALGSA

SEQ ID NO: 323456 - protein, 18 aa, Mycobacterium
PRILLSDFGIAGRAPEQA

SEQ ID NO: 323457 - protein, 19 aa, Mycobacterium
PRIMLSPPSIAPITSTTTT

SEQ ID NO: 323458 - protein, 18 aa, Mycobacterium
PRIWRMRITLERVDDGFK

SEQ ID NO: 323459 - protein, 27 aa, Mycobacterium
PRKHQDFAWAWVCRLLVTMSVLLVTVY

SEQ ID NO: 323460 - protein, 22 aa, Mycobacterium
PRKISFLPGMRYYAGNWDTTLW

SEQ ID NO: 323461 - protein, 19 aa, Mycobacterium
PRKLTEIIDGGTFLLNTLD

SEQ ID NO: 323462 - protein, 21 aa, Mycobacterium
PRKSAEIGLQRQLRRITRRAL

SEQ ID NO: 323463 - protein, 19 aa, Mycobacterium
PRKSREIGLQRQLSRITRR

SEQ ID NO: 323464 - protein, 22 aa, Mycobacterium
PRKVSFLPGMRYYAGNWDTTLW

SEQ ID NO: 323465 - protein, 22 aa, Mycobacterium
PRKVSFLPGMRYYAGNWDTTVW

SEQ ID NO: 323466 - protein, 19 aa, Mycobacterium
PRLAPGVPGGTIPVRLVDD

SEQ ID NO: 323467 - protein, 21 aa, Mycobacterium
PRLAPRPVDRPPVDPASQRAF

SEQ ID NO: 323468 - protein, 20 aa, Mycobacterium
PRLARNLSITTCDSALGVRT

SEQ ID NO: 323469 - protein, 21 aa, Mycobacterium
PRLDALDVRRLLRRVFRRPEP

SEQ ID NO: 323470 - protein, 22 aa, Mycobacterium
PRLDIPGLILSAAGITTLVYTV

SEQ ID NO: 323471 - protein, 17 aa, Mycobacterium
PRLFRPATVKPDRVADV

SEQ ID NO: 323472 - protein, 33 aa, Mycobacterium
PRLGGKLRTSRQFNWGWILAIVVIVLALAAIAI

SEQ ID NO: 323473 - protein, 21 aa, Mycobacterium
PRLGVCGGVSWQGHLCGALAG

SEQ ID NO: 323474 - protein, 24 aa, Mycobacterium
PRLGVRWWRFLAGILLGLACGTKW

SEQ ID NO: 323475 - protein, 19 aa, Mycobacterium
PRLIHGVLVASALVVGMCW

SEQ ID NO: 323476 - protein, 20 aa, Mycobacterium
PRLIIVSVLAMIAVTGHFVS

SEQ ID NO: 323477 - protein, 23 aa, Mycobacterium
PRLKEVLDDLMLLAREPKRLALI

SEQ ID NO: 323478 - protein, 19 aa, Mycobacterium
PRLLRPDWVITRPRLTGIC

SEQ ID NO: 323479 - protein, 23 aa, Mycobacterium
PRLLVTCGIVLLAVFTAFIAHSP

SEQ ID NO: 323480 - protein, 25 aa, Mycobacterium
PRLMPKRGRIAILLFGLSQFVIAGL

SEQ ID NO: 323481 - protein, 23 aa, Mycobacterium
PRLPARWRVALQAVLGGLLVLVT

SEQ ID NO: 323482 - protein, 17 aa, Mycobacterium
PRLPAVMMIGGQFNTPA

SEQ ID NO: 323483 - protein, 21 aa, Mycobacterium
PRLPDGFAVQVDRRVRVLGDG

SEQ ID NO: 323484 - protein, 17 aa, Mycobacterium
PRLPEQVRVRMAKLKAL

SEQ ID NO: 323485 - protein, 22 aa, Mycobacterium
PRLPERCRPVVRALVGTALLGL

SEQ ID NO: 323486 - protein, 18 aa, Mycobacterium
PRLPHLVSGGDYVMGPFG

SEQ ID NO: 323487 - protein, 20 aa, Mycobacterium
PRLPIQPIDYEQWMVHWLTA

SEQ ID NO: 323488 - protein, 22 aa, Mycobacterium
PRLPRQDALKVLRPEVSADTEY

SEQ ID NO: 323489 - protein, 32 aa, Mycobacterium
PRLRADMVAALLLGIGVLRVLLHKEPIATASD

SEQ ID NO: 323490 - protein, 24 aa, Mycobacterium
PRLRDRWRTLAWALAALVAIVITG

SEQ ID NO: 323491 - protein, 24 aa, Mycobacterium
PRLREYFVARVLRIFPGLWVCLAV

SEQ ID NO: 323492 - protein, 17 aa, Mycobacterium
PRLRGWIHVYSAVIAVI

SEQ ID NO: 323493 - protein, 20 aa, Mycobacterium
PRLSIYGSLMAIVLFVFTVS

SEQ ID NO: 323494 - protein, 19 aa, Mycobacterium
PRLSNIAVISAADIVDRIL

SEQ ID NO: 323495 - protein, 27 aa, Mycobacterium
PRLSPGGRTTFRFLLVAAAAVILTAAL

SEQ ID NO: 323496 - protein, 17 aa, Mycobacterium
PRLVMEEVLAIKPDICF

SEQ ID NO: 323497 - protein, 18 aa, Mycobacterium
PRLVSLYGTAMWDEMTRE

SEQ ID NO: 323498 - protein, 18 aa, Mycobacterium
PRLWPAHPRWSNYTEVFS

SEQ ID NO: 323499 - protein, 23 aa, Mycobacterium
PRLWPHSWPFVAQVLTAILVADF

SEQ ID NO: 323500 - protein, 22 aa, Mycobacterium
PRMLHFPRSWPYMNISPNLEPA

SEQ ID NO: 323501 - protein, 20 aa, Mycobacterium
PRMPELRADIARLAALGETY

SEQ ID NO: 323502 - protein, 19 aa, Mycobacterium
PRMPRKSALIGVIGGAAYA

SEQ ID NO: 323503 - protein, 21 aa, Mycobacterium
PRNAFPLAMTQPGPRKLHFVA

SEQ ID NO: 323504 - protein, 18 aa, Mycobacterium
PRNAKFGVHLNALPEACA

SEQ ID NO: 323505 - protein, 25 aa, Mycobacterium
PRNVDIPGLGWYRVVSHPGDGDESL

SEQ ID NO: 323506 - protein, 21 aa, Mycobacterium
PRPARPELVVLCDVSGSVAGF

SEQ ID NO: 323507 - protein, 17 aa, Mycobacterium
PRPASLRALPGSDITID

SEQ ID NO: 323508 - protein, 22 aa, Mycobacterium
PRPASQMLRPSGPRSLVRALLL

SEQ ID NO: 323509 - protein, 21 aa, Mycobacterium
PRPEAAAAIAEARRAGVRVVM

SEQ ID NO: 323510 - protein, 24 aa, Mycobacterium
PRPEELPRVWALINATSADPLAPF

SEQ ID NO: 323511 - protein, 18 aa, Mycobacterium
PRPEWLWIALSLLVLAAG

SEQ ID NO: 323512 - protein, 22 aa, Mycobacterium
PRPGAPSGFDTACMVLLGLFPL

SEQ ID NO: 323513 - protein, 31 aa, Mycobacterium
PRPGVLTRVLQKAWIPLLLVVVLALSALVVS

SEQ ID NO: 323514 - protein, 21 aa, Mycobacterium
PRPLGGYLMVLAIYGVVVALT

SEQ ID NO: 323515 - protein, 19 aa, Mycobacterium
PRPLGRLIADSGLRAGAKA

SEQ ID NO: 323516 - protein, 29 aa, Mycobacterium
PRPLLQLFVFLCGAFAMGLSLGLTLLFVL

SEQ ID NO: 323517 - protein, 19 aa, Mycobacterium
PRPLRSGQVLEAEHVTVEI

SEQ ID NO: 323518 - protein, 17 aa, Mycobacterium
PRPLVPDRVLADLDDDI

SEQ ID NO: 323519 - protein, 26 aa, Mycobacterium
PRPMPKRGRIAMLFLALSQFIIAGVV

SEQ ID NO: 323520 - protein, 21 aa, Mycobacterium
PRPMVNLLAFWFGGMATGIGV

SEQ ID NO: 323521 - protein, 20 aa, Mycobacterium
PRPPARATLIAGRSSGFLVS

SEQ ID NO: 323522 - protein, 18 aa, Mycobacterium
PRPPVAQGGPLGASPPAV

SEQ ID NO: 323523 - protein, 19 aa, Mycobacterium
PRPQNWGVVGWSMGGTCAV

SEQ ID NO: 323524 - protein, 24 aa, Mycobacterium
PRPQPRNGDAFGILLAATVPMMLI

SEQ ID NO: 323525 - protein, 18 aa, Mycobacterium
PRPQPWPQPLHAGAAEAV

SEQ ID NO: 323526 - protein, 21 aa, Mycobacterium
PRPQVHLAIGVGARGMTTIAT

SEQ ID NO: 323527 - protein, 22 aa, Mycobacterium
PRPRDLAPLLAAWAISVGVMVF

SEQ ID NO: 323528 - protein, 22 aa, Mycobacterium
PRPRDLAPLLVAWAASVGIMIF

SEQ ID NO: 323529 - protein, 24 aa, Mycobacterium
PRPRDLGPLLAIWGISVGVMVFEK

SEQ ID NO: 323530 - protein, 29 aa, Mycobacterium
PRPRRNVWLIVAAVAVVFVLLGSGLGIWL

SEQ ID NO: 323531 - protein, 23 aa, Mycobacterium
PRPRRRVRRIALAVTGIVAVVGI

SEQ ID NO: 323532 - protein, 19 aa, Mycobacterium
PRPSAPVPILVGGASDAAL

SEQ ID NO: 323533 - protein, 17 aa, Mycobacterium
PRPSAVHTMLFAQFWLE

SEQ ID NO: 323534 - protein, 24 aa, Mycobacterium
PRPSDVDPRLAAFDEVIAKGMAKK

SEQ ID NO: 323535 - protein, 19 aa, Mycobacterium
PRPSTAVTDDQWLQTYYLL

SEQ ID NO: 323536 - protein, 20 aa, Mycobacterium
PRPTGLAFLGGWLLGLAAVT

SEQ ID NO: 323537 - protein, 19 aa, Mycobacterium
PRPVAPGLFNAIPQAPPLA

SEQ ID NO: 323538 - protein, 25 aa, Mycobacterium
PRPVFKRWVAHFNVLVAAMLIPAAF

SEQ ID NO: 323539 - protein, 20 aa, Mycobacterium
PRPVGGPGYRDVTVVIPCRD

SEQ ID NO: 323540 - protein, 22 aa, Mycobacterium
PRQGDVYAIGAGFGQDFTGGKM

SEQ ID NO: 323541 - protein, 17 aa, Mycobacterium
PRQSWQPPGQGDHSSDP

SEQ ID NO: 323542 - protein, 28 aa, Mycobacterium
PRQWAPYHLRLDWLMWFAAISPGYAQPW

SEQ ID NO: 323543 - protein, 17 aa, Mycobacterium
PRQWVKNILVFAAPLAA

SEQ ID NO: 323544 - protein, 19 aa, Mycobacterium
PRRCDRSSVLAAIGDAAHV

SEQ ID NO: 323545 - protein, 21 aa, Mycobacterium
PRRGWLEALLGHFSDPAVALV

SEQ ID NO: 323546 - protein, 19 aa, Mycobacterium
PRRKRKLGNFAISGISTVL

SEQ ID NO: 323547 - protein, 19 aa, Mycobacterium
PRRLAAGAVVRSRNVTTEV

SEQ ID NO: 323548 - protein, 17 aa, Mycobacterium
PRRLAKQLFGFTEGFFS

SEQ ID NO: 323549 - protein, 19 aa, Mycobacterium
PRRLLGWSTISQVGFLLVP

SEQ ID NO: 323550 - protein, 30 aa, Mycobacterium
PRRLLSMQRISAFVLPRGLITVRLTPDFDI

SEQ ID NO: 323551 - protein, 25 aa, Mycobacterium
PRRLRTEVLAGLVVALALIPEAISF

SEQ ID NO: 323552 - protein, 19 aa, Mycobacterium
PRRLVPFVVALSAYAFAGI

SEQ ID NO: 323553 - protein, 17 aa, Mycobacterium
PRRPRIPLHAKPVAQLA

SEQ ID NO: 323554 - protein, 19 aa, Mycobacterium
PRRRVRPLLLAGVAVAVLA

SEQ ID NO: 323555 - protein, 25 aa, Mycobacterium
PRRSEPRGKFHLCNYVTAVTDGANV

SEQ ID NO: 323556 - protein, 17 aa, Mycobacterium
PRRSRRRRAAEPDPEPE

SEQ ID NO: 323557 - protein, 19 aa, Mycobacterium
PRRSYPEGWGYRPAAVGLF

SEQ ID NO: 323558 - protein, 19 aa, Mycobacterium
PRRTFAPVLGRLLHDRTAD

SEQ ID NO: 323559 - protein, 19 aa, Mycobacterium
PRRVWATVMTVLIAVVTTV

SEQ ID NO: 323560 - protein, 19 aa, Mycobacterium
PRRVWATVMTVLIGVLTTV

SEQ ID NO: 323561 - protein, 28 aa, Mycobacterium
PRRWGPWLRKRIASARRWLSTSVLAASV

SEQ ID NO: 323562 - protein, 19 aa, Mycobacterium
PRRWLPLVLAGLVAVAVLL

SEQ ID NO: 323563 - protein, 19 aa, Mycobacterium
PRRYADYLPTDGFTTLNIV

SEQ ID NO: 323564 - protein, 25 aa, Mycobacterium
PRRYLTTMMLMWGLGSIPLVIVGYT

SEQ ID NO: 323565 - protein, 24 aa, Mycobacterium
PRRYSEVPMMILGVVLVGIAAAVF

SEQ ID NO: 323566 - protein, 19 aa, Mycobacterium
PRSAALIAALDKQYSSGGG

SEQ ID NO: 323567 - protein, 20 aa, Mycobacterium
PRSAASLRLGCLVPVANLLW

SEQ ID NO: 323568 - protein, 19 aa, Mycobacterium
PRSAVGLAVVATLFFALGN

SEQ ID NO: 323569 - protein, 21 aa, Mycobacterium
PRSDLGVAIVDGRLVAAGGAS

SEQ ID NO: 323570 - protein, 23 aa, Mycobacterium
PRSDVYSAGILMYELLTGSTPFT

SEQ ID NO: 323571 - protein, 17 aa, Mycobacterium
PRSDVYSAGILTYELLT

SEQ ID NO: 323572 - protein, 18 aa, Mycobacterium
PRSDVYSAGILTYELLTG

SEQ ID NO: 323573 - protein, 22 aa, Mycobacterium
PRSELAVCLALVLLMLPVIVRA

SEQ ID NO: 323574 - protein, 21 aa, Mycobacterium
PRSLWVWIAISGATVVVLVAG

SEQ ID NO: 323575 - protein, 19 aa, Mycobacterium
PRSPRALWAGCVVPLANLL

SEQ ID NO: 323576 - protein, 20 aa, Mycobacterium
PRSPVGTLFIQPRVDTRGQQ

SEQ ID NO: 323577 - protein, 19 aa, Mycobacterium
PRSRAHYIYVGFEVVKVVA

SEQ ID NO: 323578 - protein, 21 aa, Mycobacterium
PRSRRRMIIAAVLVVLVVVAG

SEQ ID NO: 323579 - protein, 25 aa, Mycobacterium
PRSSSGNRAFWIIAAVFVVGILGAV

SEQ ID NO: 323580 - protein, 24 aa, Mycobacterium
PRTADAVPPWYADVLLPDLGAAWR

SEQ ID NO: 323581 - protein, 20 aa, Mycobacterium
PRTASVVVWYSPERCDTAAI

SEQ ID NO: 323582 - protein, 19 aa, Mycobacterium
PRTDDMRALFDAIINDDPL

SEQ ID NO: 323583 - protein, 25 aa, Mycobacterium
PRTDLKLHWSWHGVGLGLLFGFGGL

SEQ ID NO: 323584 - protein, 24 aa, Mycobacterium
PRTDPLPRQPLRPIDDSNGGSVGR

SEQ ID NO: 323585 - protein, 26 aa, Mycobacterium
PRTDRIRAALIIWGGWLVVTAVVFSY

SEQ ID NO: 323586 - protein, 20 aa, Mycobacterium
PRTFKTRLLTLLVIVGPGII

SEQ ID NO: 323587 - protein, 17 aa, Mycobacterium
PRTGGIKAYYGGSDANG

SEQ ID NO: 323588 - protein, 19 aa, Mycobacterium
PRTGRYVGADGRLYRQSDL

SEQ ID NO: 323589 - protein, 21 aa, Mycobacterium
PRTGSVVVWYSPRRCNRSAVL

SEQ ID NO: 323590 - protein, 25 aa, Mycobacterium
PRTHPLRIAALLGVAAAVVIAGSAP

SEQ ID NO: 323591 - protein, 18 aa, Mycobacterium
PRTLPNAVAPVIAGTGAA

SEQ ID NO: 323592 - protein, 17 aa, Mycobacterium
PRTLPNAVAPVVAGTGA

SEQ ID NO: 323593 - protein, 22 aa, Mycobacterium
PRTMSPLVSALWIIGQSVIAVV

SEQ ID NO: 323594 - protein, 20 aa, Mycobacterium
PRTPICSPGIDALGSAEHPE

SEQ ID NO: 323595 - protein, 27 aa, Mycobacterium
PRTPKNSRRWWAWMLLAGPGWVIFGAA

SEQ ID NO: 323596 - protein, 28 aa, Mycobacterium
PRTQLAALVMWTAWLLSGAIVFGYMRGM

SEQ ID NO: 323597 - protein, 19 aa, Mycobacterium
PRTSQKFIITASFLGLFAT

SEQ ID NO: 323598 - protein, 25 aa, Mycobacterium
PRTTLRGGLGYGLLFGLAFFIPLLP

SEQ ID NO: 323599 - protein, 22 aa, Mycobacterium
PRTVIDLAMVRPLPRLPRSLPL

SEQ ID NO: 323600 - protein, 27 aa, Mycobacterium
PRTWQLMRQALRIIMEIAPPGIDVDAA

SEQ ID NO: 323601 - protein, 17 aa, Mycobacterium
PRVAALMRARNYGVRVV

SEQ ID NO: 323602 - protein, 21 aa, Mycobacterium
PRVAALPLWTWLLTVAVLSLG

SEQ ID NO: 323603 - protein, 20 aa, Mycobacterium
PRVAQQKVLLFGVAFALIAR

SEQ ID NO: 323604 - protein, 24 aa, Mycobacterium
PRVEVVIDDAMRWLRAPHPDVVPA

SEQ ID NO: 323605 - protein, 19 aa, Mycobacterium
PRVHRWARGVDLIRFAPSA

SEQ ID NO: 323606 - protein, 36 aa, Mycobacterium
PRVKRPFIPRMVRAFAIPIIFFWGLLAVATNTFMPQ

SEQ ID NO: 323607 - protein, 28 aa, Mycobacterium
PRVLAVSSLPYWLGDSLRAASAGLLALL

SEQ ID NO: 323608 - protein, 21 aa, Mycobacterium
PRVLCTDTLRVSRIRGADDSE

SEQ ID NO: 323609 - protein, 20 aa, Mycobacterium
PRVLCTEKLRVARITGAEQD

SEQ ID NO: 323610 - protein, 19 aa, Mycobacterium
PRVPAEPGGDFVDAAGDGM

SEQ ID NO: 323611 - protein, 19 aa, Mycobacterium
PRVPAEPGGDFVDAAGNGM

SEQ ID NO: 323612 - protein, 21 aa, Mycobacterium
PRVPRMPGIVDTLMRTMTIGS

SEQ ID NO: 323613 - protein, 26 aa, Mycobacterium
PRVPSIFRPPWEPQRPPQQNPWNPPW

SEQ ID NO: 323614 - protein, 26 aa, Mycobacterium
PRVPVMRPRAPAPAFRGPFGGGHGPF

SEQ ID NO: 323615 - protein, 19 aa, Mycobacterium
PRVQVVIGDAMKWLRGTDS

SEQ ID NO: 323616 - protein, 18 aa, Mycobacterium
PRVTCANGELTIRPDRRL

SEQ ID NO: 323617 - protein, 17 aa, Mycobacterium
PRVTIGLDQTRFARSVH

SEQ ID NO: 323618 - protein, 21 aa, Mycobacterium
PRVVGDPTLLTMLWQNLIGNA

SEQ ID NO: 323619 - protein, 31 aa, Mycobacterium
PRVVPPSLLRRALPYLIVILIVGMIVALVAT

SEQ ID NO: 323620 - protein, 32 aa, Mycobacterium
PRVVPPSLLRRVLPFLIVILIVGMIVALFATG

SEQ ID NO: 323621 - protein, 18 aa, Mycobacterium
PRVVSALMRSVWLAVLTV

SEQ ID NO: 323622 - protein, 19 aa, Mycobacterium
PRWPELNGATGHTFGTGMR

SEQ ID NO: 323623 - protein, 20 aa, Mycobacterium
PRWPFLLRLWGRHPLVRPTD

SEQ ID NO: 323624 - protein, 19 aa, Mycobacterium
PRWPTFGITVLPRLTEGIG

SEQ ID NO: 323625 - protein, 26 aa, Mycobacterium
PRWTARLGAISVDWWATAVAGAIVAL

SEQ ID NO: 323626 - protein, 30 aa, Mycobacterium
PRYAEFPFRFDGEWLWTWQFEDLGPALIED

SEQ ID NO: 323627 - protein, 18 aa, Mycobacterium
PRYAESMYYVDPQGVRYG

SEQ ID NO: 323628 - protein, 26 aa, Mycobacterium
PRYDPWDQRLCLILSGDFYDAIARGR

SEQ ID NO: 323629 - protein, 19 aa, Mycobacterium
PRYGESMYYIDPEGVRYGV

SEQ ID NO: 323630 - protein, 32 aa, Mycobacterium
PRYIEYRGGSFPELDVPAVLARKPQVVLVDEL

SEQ ID NO: 323631 - protein, 28 aa, Mycobacterium
PRYRAELSRRAWLPLVVASATWVVAEVV

SEQ ID NO: 323632 - protein, 33 aa, Mycobacterium
PRYSGHAVAGVSGFGFGGANAHLVVREVLPTDL

SEQ ID NO: 323633 - protein, 19 aa, Mycobacterium
PRYVIGIEMNAPKRGSDGS

SEQ ID NO: 323634 - protein, 17 aa, Mycobacterium
PRYVIGLMMDNPERNAD

SEQ ID NO: 323635 - protein, 28 aa, Mycobacterium
PSALISLAVGIVFTWLFMYGMVPMMQGP

SEQ ID NO: 323636 - protein, 27 aa, Mycobacterium
PSALPRRVLEDLPRRIRAGDAYQTGFI

SEQ ID NO: 323637 - protein, 24 aa, Mycobacterium
PSANLGANCQYPASPDKAAKPAKP

SEQ ID NO: 323638 - protein, 17 aa, Mycobacterium
PSANYLAALAITVFVPF

SEQ ID NO: 323639 - protein, 18 aa, Mycobacterium
PSAPRPGTLLGDLTSVAT

SEQ ID NO: 323640 - protein, 26 aa, Mycobacterium
PSAPVAPRITTEFVEVGGMTLPPGTS

SEQ ID NO: 323641 - protein, 25 aa, Mycobacterium
PSAQCCIAAYVPYLSWLMQASADSA

SEQ ID NO: 323642 - protein, 21 aa, Mycobacterium
PSARFARGAAFAVLGTAFTLR

SEQ ID NO: 323643 - protein, 19 aa, Mycobacterium
PSARWRVAGSAALFVAGFT

SEQ ID NO: 323644 - protein, 18 aa, Mycobacterium
PSASRRAAPSTSPAPPRG

SEQ ID NO: 323645 - protein, 17 aa, Mycobacterium
PSAVPKMLAAQFGLELK

SEQ ID NO: 323646 - protein, 26 aa, Mycobacterium
PSAYRGRLVLCFQIAIGVGILAANLI

SEQ ID NO: 323647 - protein, 20 aa, Mycobacterium
PSCFTAPELVVRPDLPETLL

SEQ ID NO: 323648 - protein, 21 aa, Mycobacterium
PSCKGTWRPRAERRNKGRAVR

SEQ ID NO: 323649 - protein, 21 aa, Mycobacterium
PSCQKVLEGSGFVIAPDRVMT

SEQ ID NO: 323650 - protein, 20 aa, Mycobacterium
PSCQKVLEGSGFVVAPSRVM

SEQ ID NO: 323651 - protein, 22 aa, Mycobacterium
PSDLGLPEPFPVGSVVVSYDED

SEQ ID NO: 323652 - protein, 21 aa, Mycobacterium
PSDLLWSFLQAIVMAIAVMLV

SEQ ID NO: 323653 - protein, 24 aa, Mycobacterium
PSDPEALAAVPLDALDDLSRKIVV

SEQ ID NO: 323654 - protein, 22 aa, Mycobacterium
PSDQGAGPWGFVSTASKGIVAQ

SEQ ID NO: 323655 - protein, 21 aa, Mycobacterium
PSDRQLIGIGLVVVLLAAVLT

SEQ ID NO: 323656 - protein, 17 aa, Mycobacterium
PSDRQLLVCGVAVLAIV

SEQ ID NO: 323657 - protein, 30 aa, Mycobacterium
PSEGFWSFGDWTSAGPWMLGFLLGAFTIVG

SEQ ID NO: 323658 - protein, 19 aa, Mycobacterium
PSELGAQPGLWIPGSSVSA

SEQ ID NO: 323659 - protein, 25 aa, Mycobacterium
PSEPLRPAPVVLPFTGLDGPTPVAV

SEQ ID NO: 323660 - protein, 24 aa, Mycobacterium
PSERDGLRFNDDWDNLGQRLTASG

SEQ ID NO: 323661 - protein, 24 aa, Mycobacterium
PSERFDFIGMLLLLPGIAMLLLGV

SEQ ID NO: 323662 - protein, 18 aa, Mycobacterium
PSFAPAFESRDRKASFSY

SEQ ID NO: 323663 - protein, 17 aa, Mycobacterium
PSGFGFGLGNVILVTNV

SEQ ID NO: 323664 - protein, 26 aa, Mycobacterium
PSGFILRRHILPNIAGPLIVQLSLSL

SEQ ID NO: 323665 - protein, 20 aa, Mycobacterium
PSGGGSPVFSGHGTQASAAT

SEQ ID NO: 323666 - protein, 17 aa, Mycobacterium
PSGIGFLEFHQIDRARE

SEQ ID NO: 323667 - protein, 20 aa, Mycobacterium
PSGIPFPGSWNGSLWTLGWE

SEQ ID NO: 323668 - protein, 29 aa, Mycobacterium
PSGLGRAAARPGPSVAFAQYDPHTGSYVA

SEQ ID NO: 323669 - protein, 18 aa, Mycobacterium
PSGLSMLGAESGGLRVPV

SEQ ID NO: 323670 - protein, 20 aa, Mycobacterium
PSGMGRWTPDTGETIADRLG

SEQ ID NO: 323671 - protein, 21 aa, Mycobacterium
PSGMVPVFFVLWALSNFAGPL

SEQ ID NO: 323672 - protein, 18 aa, Mycobacterium
PSGPMPWAPPPWTSPARR

SEQ ID NO: 323673 - protein, 17 aa, Mycobacterium
PSGQPLRPGAEVKADDV

SEQ ID NO: 323674 - protein, 23 aa, Mycobacterium
PSGQQPSAFLWPRSLQARATRRA

SEQ ID NO: 323675 - protein, 24 aa, Mycobacterium
PSGSGLPALLAIAAIAAVLANVVN

SEQ ID NO: 323676 - protein, 23 aa, Mycobacterium
PSGSGLPALLGIAAVAAALANMV

SEQ ID NO: 323677 - protein, 17 aa, Mycobacterium
PSGTLAGLAGRVARLNQ

SEQ ID NO: 323678 - protein, 18 aa, Mycobacterium
PSGYLERQVRRWGSQWDL

SEQ ID NO: 323679 - protein, 24 aa, Mycobacterium
PSIAALMGKWFWWPQRVRQRPLPA

SEQ ID NO: 323680 - protein, 27 aa, Mycobacterium
PSIAAVLGRWFWWPLQVRSRPGHVAPL

SEQ ID NO: 323681 - protein, 17 aa, Mycobacterium
PSIAFNYLGRVSGLTGA

SEQ ID NO: 323682 - protein, 22 aa, Mycobacterium
PSIHNSQPWQWRVGERSVHLYA

SEQ ID NO: 323683 - protein, 31 aa, Mycobacterium
PSILARSIYKFAVPIALFWLAVCAIIAAFVP

SEQ ID NO: 323684 - protein, 25 aa, Mycobacterium
PSIRLRGEYFLITTLAFAEVIHQLT

SEQ ID NO: 323685 - protein, 25 aa, Mycobacterium
PSKPWYMWFCPGANHAPHHSPAEYA

SEQ ID NO: 323686 - protein, 19 aa, Mycobacterium
PSLAESFAGADPEADAERR

SEQ ID NO: 323687 - protein, 18 aa, Mycobacterium
PSLFSRELFQEVFLNPGL

SEQ ID NO: 323688 - protein, 28 aa, Mycobacterium
PSLGGLVADHWGWRWIFVPLVPVALAGF

SEQ ID NO: 323689 - protein, 23 aa, Mycobacterium
PSLIGCVRVRASITVSPDDRVSG

SEQ ID NO: 323690 - protein, 35 aa, Mycobacterium
PSLKYLSYRLFLKRAGSHWLVTRMTTITSLDLTPH

SEQ ID NO: 323691 - protein, 20 aa, Mycobacterium
PSLLLAVVVLYVFSPSAANI

SEQ ID NO: 323692 - protein, 19 aa, Mycobacterium
PSLLPRGPLFQALVSGGSG

SEQ ID NO: 323693 - protein, 23 aa, Mycobacterium
PSLLPRGPLFQGLVSGISGAIGY

SEQ ID NO: 323694 - protein, 19 aa, Mycobacterium
PSLLPRGPLFQGLVSGLSG

SEQ ID NO: 323695 - protein, 17 aa, Mycobacterium
PSLLSAVRWRRRRTRVV

SEQ ID NO: 323696 - protein, 23 aa, Mycobacterium
PSLLVVGCGLIIVALLVTVRAAQ

SEQ ID NO: 323697 - protein, 17 aa, Mycobacterium
PSLNWWWGAVVAAALLA

SEQ ID NO: 323698 - protein, 17 aa, Mycobacterium
PSLPHTIWVTFLLMALS

SEQ ID NO: 323699 - protein, 18 aa, Mycobacterium
PSLPRRDALKILDGPLAR

SEQ ID NO: 323700 - protein, 19 aa, Mycobacterium
PSLQGWRPVTVAGLVVGLF

SEQ ID NO: 323701 - protein, 27 aa, Mycobacterium
PSLRRWTFWQLEVMASRGFLRVAVVHL

SEQ ID NO: 323702 - protein, 25 aa, Mycobacterium
PSLSLRWRVMLLAMSMVAMVVVLMA

SEQ ID NO: 323703 - protein, 23 aa, Mycobacterium
PSLSRADALLARDSLTPTDRQAV

SEQ ID NO: 323704 - protein, 28 aa, Mycobacterium
PSLVRRVKEAFPRATVLNGYGMTESASL

SEQ ID NO: 323705 - protein, 19 aa, Mycobacterium
PSLWGWRNTLVLRWFVLGA

SEQ ID NO: 323706 - protein, 17 aa, Mycobacterium
PSLYALVLIPFGVYLAS

SEQ ID NO: 323707 - protein, 34 aa, Mycobacterium
PSMNRGWCMIRTRWGRRAARILPLLGLAGLAAAT

SEQ ID NO: 323708 - protein, 17 aa, Mycobacterium
PSMPYRLRVIVHEDETG

SEQ ID NO: 323709 - protein, 25 aa, Mycobacterium
PSNFFAWALSVMFLVFSLRALLYKP

SEQ ID NO: 323710 - protein, 21 aa, Mycobacterium
PSNFFAWALSVMFLVFTLRAL

SEQ ID NO: 323711 - protein, 23 aa, Mycobacterium
PSPARSSALLGLLAGTRGLGSGR

SEQ ID NO: 323712 - protein, 21 aa, Mycobacterium
PSPAVRPTIHMPLDHDPYQAP

SEQ ID NO: 323713 - protein, 18 aa, Mycobacterium
PSPGGTPLVSYGIPEQQT

SEQ ID NO: 323714 - protein, 17 aa, Mycobacterium
PSPIFLGLVALTAVGGA

SEQ ID NO: 323715 - protein, 23 aa, Mycobacterium
PSPQPPNVTTWWAIQSSCIPTGC

SEQ ID NO: 323716 - protein, 23 aa, Mycobacterium
PSPRPAPGPSHGDQWDDWLQRHL

SEQ ID NO: 323717 - protein, 17 aa, Mycobacterium
PSPRPLRSGQVLEAEHV

SEQ ID NO: 323718 - protein, 21 aa, Mycobacterium
PSPRSVLSRVLAPSDSPVTSS

SEQ ID NO: 323719 - protein, 23 aa, Mycobacterium
PSPTCIIVGLPAGLRLAVDNAIA

SEQ ID NO: 323720 - protein, 25 aa, Mycobacterium
PSPVPRALTPWPYNSIPMCPGCTLG

SEQ ID NO: 323721 - protein, 23 aa, Mycobacterium
PSPWRPVAADGQWLPPGAPGSHW

SEQ ID NO: 323722 - protein, 25 aa, Mycobacterium
PSQAELRYAQALQRPILPVQVGPVD

SEQ ID NO: 323723 - protein, 30 aa, Mycobacterium
PSQTLRLKVELPFIGLYVHTGGVAVDTAGN

SEQ ID NO: 323724 - protein, 30 aa, Mycobacterium
PSRANGPYPRWVCVWDHSRMTQNPETSAGS

SEQ ID NO: 323725 - protein, 26 aa, Mycobacterium
PSRGCGRVLALRPMRAIGRLSYSWYL

SEQ ID NO: 323726 - protein, 23 aa, Mycobacterium
PSRGLRVTWIAAFGSLVLGFPLY

SEQ ID NO: 323727 - protein, 25 aa, Mycobacterium
PSRHMPAMTSVPVAPANPGSGSANQ

SEQ ID NO: 323728 - protein, 17 aa, Mycobacterium
PSRKAPPAFAARMVLGA

SEQ ID NO: 323729 - protein, 18 aa, Mycobacterium
PSRLAEVMAHAAGTTVEI

SEQ ID NO: 323730 - protein, 23 aa, Mycobacterium
PSRSGSLTSVWLLLGLLAISAVL

SEQ ID NO: 323731 - protein, 25 aa, Mycobacterium
PSRSRDARFGRWWHGGQPVRAAGVD

SEQ ID NO: 323732 - protein, 21 aa, Mycobacterium
PSRSRSLLDRVLRWLQEHDRY

SEQ ID NO: 323733 - protein, 18 aa, Mycobacterium
PSSAEWDPVVGHGVVDAL

SEQ ID NO: 323734 - protein, 23 aa, Mycobacterium
PSSLRPVDAIPLLPNGKRDNNAL

SEQ ID NO: 323735 - protein, 18 aa, Mycobacterium
PSSPELLGKVIGTNPPAN

SEQ ID NO: 323736 - protein, 21 aa, Mycobacterium
PSSPRRWQVLRPHRRQDPLRA

SEQ ID NO: 323737 - protein, 25 aa, Mycobacterium
PSSPSRPQPAPGYRLPEKSEPDSDE

SEQ ID NO: 323738 - protein, 19 aa, Mycobacterium
PSSVGYRASDRHFPEARMG

SEQ ID NO: 323739 - protein, 18 aa, Mycobacterium
PSSVRYSGVSVVWQFGAM

SEQ ID NO: 323740 - protein, 18 aa, Mycobacterium
PSTCWWWERTRGENRARI

SEQ ID NO: 323741 - protein, 17 aa, Mycobacterium
PSTLAMRHIGKVFNEFD

SEQ ID NO: 323742 - protein, 18 aa, Mycobacterium
PSTLFGMTEVLGVGSPDA

SEQ ID NO: 323743 - protein, 40 aa, Mycobacterium
PSTRHLGRWLGPLAILLALWAIRALTHWLQARLGQRGASA

SEQ ID NO: 323744 - protein, 17 aa, Mycobacterium
PSTRHWLGTNALGQDLL

SEQ ID NO: 323745 - protein, 18 aa, Mycobacterium
PSTRSFNGAAIFVSIAAL

SEQ ID NO: 323746 - protein, 18 aa, Mycobacterium
PSTVQALRDALRTHVGFV

SEQ ID NO: 323747 - protein, 40 aa, Mycobacterium
PSVAALLGRWFWWPLRVRPRPASYMLRPFGPRRLVRSLLL

SEQ ID NO: 323748 - protein, 28 aa, Mycobacterium
PSVAALMGRWFWWPQRVRTRPASQLLRP

SEQ ID NO: 323749 - protein, 21 aa, Mycobacterium
PSVAFPMVWTTLYGDIAASSA

SEQ ID NO: 323750 - protein, 17 aa, Mycobacterium
PSVAFRPLRLLVVCVAL

SEQ ID NO: 323751 - protein, 23 aa, Mycobacterium
PSVAFRPVRLFAISIAITAVAVL

SEQ ID NO: 323752 - protein, 18 aa, Mycobacterium
PSVAFRPVRLFVVSIAVT

SEQ ID NO: 323753 - protein, 18 aa, Mycobacterium
PSVAFRPVRLLVISLGLT

SEQ ID NO: 323754 - protein, 39 aa, Mycobacterium
PSVATLLGRWFWWPLRVRPRPASQMLRPYGPRTAVRQLL

SEQ ID NO: 323755 - protein, 19 aa, Mycobacterium
PSVFSPGPLKWIYLTMGVL

SEQ ID NO: 323756 - protein, 26 aa, Mycobacterium
PSVFTEAPWWITFVVVPSYIVVALAL

SEQ ID NO: 323757 - protein, 18 aa, Mycobacterium
PSVIAIGAVVGFVVGAWS

SEQ ID NO: 323758 - protein, 18 aa, Mycobacterium
PSVLSVLVLEDFAMAAYL

SEQ ID NO: 323759 - protein, 18 aa, Mycobacterium
PSVMGRATTSWVLGSGVP

SEQ ID NO: 323760 - protein, 22 aa, Mycobacterium
PSVPDARLEFVLADAEPAVAVT

SEQ ID NO: 323761 - protein, 21 aa, Mycobacterium
PSVVLRRRIVVGVVLVIGAVV

SEQ ID NO: 323762 - protein, 34 aa, Mycobacterium
PSVVRRLLGELTHFFALLLWAAAVLAFFAKLPQL

SEQ ID NO: 323763 - protein, 28 aa, Mycobacterium
PSVVRSHLRWTSPILRHAVRLSAATALA

SEQ ID NO: 323764 - protein, 18 aa, Mycobacterium
PSYGLAEATVYVASRESD

SEQ ID NO: 323765 - protein, 17 aa, Mycobacterium
PSYGMAEATLFVSTIGP

SEQ ID NO: 323766 - protein, 17 aa, Mycobacterium
PTAAVDMGEGFGMPSTE

SEQ ID NO: 323767 - protein, 19 aa, Mycobacterium
PTAAWRVIEVVPGGKCRQT

SEQ ID NO: 323768 - protein, 25 aa, Mycobacterium
PTAEQVGAVALCFQAARLQLLRGHA

SEQ ID NO: 323769 - protein, 19 aa, Mycobacterium
PTAGHVISAYALGVVVGAP

SEQ ID NO: 323770 - protein, 18 aa, Mycobacterium
PTAGMPLLHVEKPQYEGT

SEQ ID NO: 323771 - protein, 24 aa, Mycobacterium
PTAHLPFRSGRSFSASVTGTELTV

SEQ ID NO: 323772 - protein, 24 aa, Mycobacterium
PTAKEARRSVVWAIALIGAFYLFT

SEQ ID NO: 323773 - protein, 25 aa, Mycobacterium
PTAKEARRSVVWAIALIGAFYLFTL

SEQ ID NO: 323774 - protein, 18 aa, Mycobacterium
PTALAATVMICFHFGILS

SEQ ID NO: 323775 - protein, 20 aa, Mycobacterium
PTALLFAGLIVPRVFDIREA

SEQ ID NO: 323776 - protein, 19 aa, Mycobacterium
PTAMIPISIVWFGIGENSK

SEQ ID NO: 323777 - protein, 24 aa, Mycobacterium
PTAMWICVLNPLVLIHLMGGVHNE

SEQ ID NO: 323778 - protein, 20 aa, Mycobacterium
PTARACLRIGLTPDAVTILG

SEQ ID NO: 323779 - protein, 24 aa, Mycobacterium
PTARAREALMPGVRVMAANTFDTD

SEQ ID NO: 323780 - protein, 23 aa, Mycobacterium
PTARARRALTPKLRITAAEQFAS

SEQ ID NO: 323781 - protein, 38 aa, Mycobacterium
PTARWSAPLQLMFSFLALPLIRLTNGTANWILRRLGIE

SEQ ID NO: 323782 - protein, 24 aa, Mycobacterium
PTAVGCVRIRASITVSPDDRVSGQ

SEQ ID NO: 323783 - protein, 17 aa, Mycobacterium
PTAVRMVLVEGENGDGA

SEQ ID NO: 323784 - protein, 19 aa, Mycobacterium
PTDAAAVFSVLRVLPLPRR

SEQ ID NO: 323785 - protein, 22 aa, Mycobacterium
PTDLTRPSWLFVLRKTAREFTH

SEQ ID NO: 323786 - protein, 17 aa, Mycobacterium
PTDMMLLDRIAKGVFHL

SEQ ID NO: 323787 - protein, 20 aa, Mycobacterium
PTEAAPTAWVNPPATEPANL

SEQ ID NO: 323788 - protein, 23 aa, Mycobacterium
PTEAQWGALAIRVDQAKSVATEI

SEQ ID NO: 323789 - protein, 17 aa, Mycobacterium
PTEIGGYAGVPAPPPPP

SEQ ID NO: 323790 - protein, 18 aa, Mycobacterium
PTEIGGYAGVPAPPPPPP

SEQ ID NO: 323791 - protein, 18 aa, Mycobacterium
PTELDWVGQLTFVPGIAV

SEQ ID NO: 323792 - protein, 33 aa, Mycobacterium
PTELEGSASLPSRRIWALVALFVVVGVTVGAMA

SEQ ID NO: 323793 - protein, 18 aa, Mycobacterium
PTELKAAAIGAAVGALLW

SEQ ID NO: 323794 - protein, 25 aa, Mycobacterium
PTELVDRWAPGRVMINAYGPTEATI

SEQ ID NO: 323795 - protein, 23 aa, Mycobacterium
PTEQKELCRFPGIDPKRDLNKVP

SEQ ID NO: 323796 - protein, 24 aa, Mycobacterium
PTESYTPWITRVLAFLIDNAPVVV

SEQ ID NO: 323797 - protein, 19 aa, Mycobacterium
PTFGDWGFALARRGGTAPI

SEQ ID NO: 323798 - protein, 24 aa, Mycobacterium
PTFLRNIKPILGLGVGLVVVTAFT

SEQ ID NO: 323799 - protein, 22 aa, Mycobacterium
PTFLYELIWNVLVFAILIYADR

SEQ ID NO: 323800 - protein, 25 aa, Mycobacterium
PTFLYELLWNLLIFAVLIYADRRFT

SEQ ID NO: 323801 - protein, 18 aa, Mycobacterium
PTGALFRTEFSTVVVQQD

SEQ ID NO: 323802 - protein, 22 aa, Mycobacterium
PTGIKFFNWVGTMWKGQLTFET

SEQ ID NO: 323803 - protein, 18 aa, Mycobacterium
PTGIKFVNWIGTMWKGQL

SEQ ID NO: 323804 - protein, 18 aa, Mycobacterium
PTGLRLVIDNAVANAVKH

SEQ ID NO: 323805 - protein, 18 aa, Mycobacterium
PTGLTQWSVVLGADPASD

SEQ ID NO: 323806 - protein, 24 aa, Mycobacterium
PTGWPHTAFLFSLYAFLCATALVV

SEQ ID NO: 323807 - protein, 26 aa, Mycobacterium
PTHRHHLPQLPPVITIPQVPTVITVP

SEQ ID NO: 323808 - protein, 21 aa, Mycobacterium
PTHVRASGIGVPYSFTVAVFG

SEQ ID NO: 323809 - protein, 24 aa, Mycobacterium
PTIALASIWLKGPLVLGLGAIQLV

SEQ ID NO: 323810 - protein, 24 aa, Mycobacterium
PTIALTSIWLKGPLVLGLGPIQLV

SEQ ID NO: 323811 - protein, 19 aa, Mycobacterium
PTIEIAPGITIPVGPPTTV

SEQ ID NO: 323812 - protein, 26 aa, Mycobacterium
PTIPWYQEFLRYYFLTVEDSVDGSLT

SEQ ID NO: 323813 - protein, 18 aa, Mycobacterium
PTKIGALVDSISGGERDP

SEQ ID NO: 323814 - protein, 30 aa, Mycobacterium
PTKVPGRAGLLCVLSILLTYLLVAVAVMMF

SEQ ID NO: 323815 - protein, 19 aa, Mycobacterium
PTKVPGRAGLLCVTTILLT

SEQ ID NO: 323816 - protein, 17 aa, Mycobacterium
PTKVRMVLVEGECADGA

SEQ ID NO: 323817 - protein, 22 aa, Mycobacterium
PTLDWGREFVHSGQWIAVTFAA

SEQ ID NO: 323818 - protein, 24 aa, Mycobacterium
PTLEIAPGITIPWGPPTTVPVGPP

SEQ ID NO: 323819 - protein, 19 aa, Mycobacterium
PTLGLRLSPMIAAAAMALS

SEQ ID NO: 323820 - protein, 22 aa, Mycobacterium
PTLHGCSGCVGDRIMVDKVTYR

SEQ ID NO: 323821 - protein, 17 aa, Mycobacterium
PTLLKLAAMVGAVISTI

SEQ ID NO: 323822 - protein, 21 aa, Mycobacterium
PTLLKLLAMIVGVAMTVIALG

SEQ ID NO: 323823 - protein, 19 aa, Mycobacterium
PTLLRTVLRVAVIVCVAAA

SEQ ID NO: 323824 - protein, 19 aa, Mycobacterium
PTLLTMVWQNLIGNAVKFR

SEQ ID NO: 323825 - protein, 27 aa, Mycobacterium
PTLLVAIPFTVLVSFTLNILLRELGAA

SEQ ID NO: 323826 - protein, 19 aa, Mycobacterium
PTLLVGLAIMGLGMGCTMM

SEQ ID NO: 323827 - protein, 19 aa, Mycobacterium
PTLRDGAVLDVDRTQVPIE

SEQ ID NO: 323828 - protein, 20 aa, Mycobacterium
PTLREAALWSAIYIGVAILF

SEQ ID NO: 323829 - protein, 19 aa, Mycobacterium
PTLRISLIAFGRLVISAGL

SEQ ID NO: 323830 - protein, 17 aa, Mycobacterium
PTLTAAQRSSRRSDALE

SEQ ID NO: 323831 - protein, 21 aa, Mycobacterium
PTLWGWRRKPVLRWFVLGAGI

SEQ ID NO: 323832 - protein, 24 aa, Mycobacterium
PTLWSWRDRPVLRWFVLGIAIGVA

SEQ ID NO: 323833 - protein, 24 aa, Mycobacterium
PTMAELALNHTMHGVLVATNFFGI

SEQ ID NO: 323834 - protein, 18 aa, Mycobacterium
PTMLRTRMADGVERAARR

SEQ ID NO: 323835 - protein, 21 aa, Mycobacterium
PTMRWAYWIGLFVTYADVMIA

SEQ ID NO: 323836 - protein, 23 aa, Mycobacterium
PTNWARLTLPYVGFMGSTALLTF

SEQ ID NO: 323837 - protein, 18 aa, Mycobacterium
PTPAPWSILTLLPAGPEL

SEQ ID NO: 323838 - protein, 18 aa, Mycobacterium
PTPAVPLVGAVLIPVAIR

SEQ ID NO: 323839 - protein, 18 aa, Mycobacterium
PTPGFRFVDHTVIGCSLV

SEQ ID NO: 323840 - protein, 24 aa, Mycobacterium
PTPGKLDWAGTVTVALGLTVLLTG

SEQ ID NO: 323841 - protein, 24 aa, Mycobacterium
PTPHTSWRAWAQRLADTAAAGGFD

SEQ ID NO: 323842 - protein, 19 aa, Mycobacterium
PTPKRLAAGAVISVDNVGT

SEQ ID NO: 323843 - protein, 17 aa, Mycobacterium
PTPKVVGKFRDGDVRAA

SEQ ID NO: 323844 - protein, 25 aa, Mycobacterium
PTPPKYCLSEFDLAEDTGPTPPQLP

SEQ ID NO: 323845 - protein, 19 aa, Mycobacterium
PTPPQGFSSSGFTPPSSQP

SEQ ID NO: 323846 - protein, 26 aa, Mycobacterium
PTPPQRSGWDIALSIALLVLTVVVGV

SEQ ID NO: 323847 - protein, 30 aa, Mycobacterium
PTPRLMTAWTVLGDKIWIMGGLRDGVALQT

SEQ ID NO: 323848 - protein, 28 aa, Mycobacterium
PTPVALELARFAALSAIFTGLGGVVVGI

SEQ ID NO: 323849 - protein, 18 aa, Mycobacterium
PTPWTAAGAVCFAVSDAM

SEQ ID NO: 323850 - protein, 20 aa, Mycobacterium
PTPWTALGAVCFAVSDAMIG

SEQ ID NO: 323851 - protein, 18 aa, Mycobacterium
PTQRPELPADPATPTAES

SEQ ID NO: 323852 - protein, 34 aa, Mycobacterium
PTRGSARGGIYMKNLLRRQCDAVSRRFAAFLRSR

SEQ ID NO: 323853 - protein, 18 aa, Mycobacterium
PTRGSTWAVGRPPRRGAI

SEQ ID NO: 323854 - protein, 25 aa, Mycobacterium
PTRLRTEVLAGLVVALALIPEAISF

SEQ ID NO: 323855 - protein, 28 aa, Mycobacterium
PTRPRWPRRRMFFVVTLAVLFVLSGMAV

SEQ ID NO: 323856 - protein, 17 aa, Mycobacterium
PTSEHPHRVLVLANQTV

SEQ ID NO: 323857 - protein, 26 aa, Mycobacterium
PTSHRRPLKVGGIMRTYGRLLHDARF

SEQ ID NO: 323858 - protein, 23 aa, Mycobacterium
PTSTDFPPDWGYSLTGRLQRAAA

SEQ ID NO: 323859 - protein, 26 aa, Mycobacterium
PTSTIIPVAKWLGAPLARGGSTTTRA

SEQ ID NO: 323860 - protein, 26 aa, Mycobacterium
PTSTIYRYPIPAIPSPPPIPPIPAIP

SEQ ID NO: 323861 - protein, 23 aa, Mycobacterium
PTSVKAWLGLGVLLLLVLFSVRL

SEQ ID NO: 323862 - protein, 19 aa, Mycobacterium
PTSYKWAYTVLAIAFVLEG

SEQ ID NO: 323863 - protein, 24 aa, Mycobacterium
PTSYVRRTWLVLRMNPQRNVAAVA

SEQ ID NO: 323864 - protein, 20 aa, Mycobacterium
PTSYWGLKGLIGVNAVAADP

SEQ ID NO: 323865 - protein, 18 aa, Mycobacterium
PTTARLVLVEGAGADGRI

SEQ ID NO: 323866 - protein, 18 aa, Mycobacterium
PTTIGALMSAIGIAGMDR

SEQ ID NO: 323867 - protein, 20 aa, Mycobacterium
PTTRGFQMLLAMWVAVVVLA

SEQ ID NO: 323868 - protein, 25 aa, Mycobacterium
PTTVAHFLPPVLRKLTIYLPQSPST

SEQ ID NO: 323869 - protein, 17 aa, Mycobacterium
PTVAWTTDADLLISEVQ

SEQ ID NO: 323870 - protein, 27 aa, Mycobacterium
PTVGRLSDRFGRRPVYFLGAVLAMVWG

SEQ ID NO: 323871 - protein, 20 aa, Mycobacterium
PTVILVRWLLTAGARWDAQQ

SEQ ID NO: 323872 - protein, 18 aa, Mycobacterium
PTVIPRIIAGLITVGFVA

SEQ ID NO: 323873 - protein, 17 aa, Mycobacterium
PTVKKGATFDCDVSIDG

SEQ ID NO: 323874 - protein, 17 aa, Mycobacterium
PTVKKGATFECTVSIDG

SEQ ID NO: 323875 - protein, 24 aa, Mycobacterium
PTVKKGDTFTCEVSIDGTKRQVTV

SEQ ID NO: 323876 - protein, 24 aa, Mycobacterium
PTVQREVCAALTLDSRPGRNQPPG

SEQ ID NO: 323877 - protein, 31 aa, Mycobacterium
PTVSACRLKLSKAIAGLAHRGVLVVALVAAV

SEQ ID NO: 323878 - protein, 22 aa, Mycobacterium
PTWPQCFPGSFTPVPHAEVAGI

SEQ ID NO: 323879 - protein, 22 aa, Mycobacterium
PTWPQCFPGSFTPVPHAEVAVV

SEQ ID NO: 323880 - protein, 23 aa, Mycobacterium
PTWPQCFPGSFVPVAHAEVPRIH

SEQ ID NO: 323881 - protein, 21 aa, Mycobacterium
PTYGFVRRRYWLKELGVDQTK

SEQ ID NO: 323882 - protein, 19 aa, Mycobacterium
PVAAACIIGALTLFSGPTG

SEQ ID NO: 323883 - protein, 25 aa, Mycobacterium
PVAAGLCLAVFAAFMAYFALYSRHR

SEQ ID NO: 323884 - protein, 19 aa, Mycobacterium
PVAATPRGSWRAQAAGRLL

SEQ ID NO: 323885 - protein, 21 aa, Mycobacterium
PVADVPSALTFGFSNTLGSVA

SEQ ID NO: 323886 - protein, 17 aa, Mycobacterium
PVAFLAVVAVDLFIDGL

SEQ ID NO: 323887 - protein, 22 aa, Mycobacterium
PVAFVRRPYRWIKELGADDRPM

SEQ ID NO: 323888 - protein, 20 aa, Mycobacterium
PVAGWVLFGALLAWSLACAV

SEQ ID NO: 323889 - protein, 18 aa, Mycobacterium
PVAHWVFAFDGAAAEKGG

SEQ ID NO: 323890 - protein, 17 aa, Mycobacterium
PVAHWVFAFDKFASAHG

SEQ ID NO: 323891 - protein, 20 aa, Mycobacterium
PVAKLVWKICKIDGPPSRYR

SEQ ID NO: 323892 - protein, 23 aa, Mycobacterium
PVALILWRTFRPGFDQFFDWVST

SEQ ID NO: 323893 - protein, 25 aa, Mycobacterium
PVALSRLRVPAMIVSVLTLMIRYID

SEQ ID NO: 323894 - protein, 30 aa, Mycobacterium
PVAPGVRARLLLMWLACTALPGSAIAVLLI

SEQ ID NO: 323895 - protein, 26 aa, Mycobacterium
PVAQSRWRHLPIAASLLSLALLTIAL

SEQ ID NO: 323896 - protein, 19 aa, Mycobacterium
PVASLIQTYTWRKLSGGQV

SEQ ID NO: 323897 - protein, 20 aa, Mycobacterium
PVASVALRRFVRTHSLVPEL

SEQ ID NO: 323898 - protein, 26 aa, Mycobacterium
PVAVSIPQAALWLSLTTLFGLLAYYF

SEQ ID NO: 323899 - protein, 18 aa, Mycobacterium
PVAVVIAMRARRRTLVAP

SEQ ID NO: 323900 - protein, 23 aa, Mycobacterium
PVDEWAVALALALRAFPLLIEEF

SEQ ID NO: 323901 - protein, 23 aa, Mycobacterium
PVDEWAVTIALALRAFPMLIDEF

SEQ ID NO: 323902 - protein, 24 aa, Mycobacterium
PVDFGFEYDQQYGFNQPFFDYRNS

SEQ ID NO: 323903 - protein, 21 aa, Mycobacterium
PVDLLWSFLQAILMAIAILLV

SEQ ID NO: 323904 - protein, 18 aa, Mycobacterium
PVDYELEAAVAAERTPTG

SEQ ID NO: 323905 - protein, 34 aa, Mycobacterium
PVEFAGFFAWLCWLVLHLVYLVGFKTKIVTLLSW

SEQ ID NO: 323906 - protein, 25 aa, Mycobacterium
PVEFVEIPWDAIFAGLDAERFDVVA

SEQ ID NO: 323907 - protein, 24 aa, Mycobacterium
PVEIPKDYIALFAIAPLVLIVPAL

SEQ ID NO: 323908 - protein, 20 aa, Mycobacterium
PVERPAHRWVVVSDGPPPSA

SEQ ID NO: 323909 - protein, 20 aa, Mycobacterium
PVFAVKSGAFFAMTVAILGL

SEQ ID NO: 323910 - protein, 23 aa, Mycobacterium
PVFDRTALKHFVAIALPIVATII

SEQ ID NO: 323911 - protein, 23 aa, Mycobacterium
PVFEHLDYAMAMRTYGWPRDLPR

SEQ ID NO: 323912 - protein, 24 aa, Mycobacterium
PVFGFGVIFGAIWAEQAWGRYWGW

SEQ ID NO: 323913 - protein, 18 aa, Mycobacterium
PVFGPILWFAIGKSDPSD

SEQ ID NO: 323914 - protein, 18 aa, Mycobacterium
PVFIEAYDQFGWQVKCGS

SEQ ID NO: 323915 - protein, 30 aa, Mycobacterium
PVGAALVIAGLAWYFFAPRRAHAASLSEGV

SEQ ID NO: 323916 - protein, 24 aa, Mycobacterium
PVGARLRVEVPLRRPAATSGPATV

SEQ ID NO: 323917 - protein, 28 aa, Mycobacterium
PVGARRTLPVSIPRTAVVAALVLAVCAV

SEQ ID NO: 323918 - protein, 28 aa, Mycobacterium
PVGAVAGMFGEFFYKDPRRIAAATTLLL

SEQ ID NO: 323919 - protein, 18 aa, Mycobacterium
PVGAWAPISEDFVRALRS

SEQ ID NO: 323920 - protein, 24 aa, Mycobacterium
PVGCGGARPSVRRSAAASGGGAHE

SEQ ID NO: 323921 - protein, 21 aa, Mycobacterium
PVGDPRAWPQAVDAWLRLCQT

SEQ ID NO: 323922 - protein, 18 aa, Mycobacterium
PVGFTLDRFGSHGVVLLF

SEQ ID NO: 323923 - protein, 17 aa, Mycobacterium
PVGGRIFALLAVAALLM

SEQ ID NO: 323924 - protein, 34 aa, Mycobacterium
PVGHLELFLKLLRDGRWWLGSGVAAMGFACQAAA

SEQ ID NO: 323925 - protein, 17 aa, Mycobacterium
PVGLRRQLRTLAGFGSM

SEQ ID NO: 323926 - protein, 21 aa, Mycobacterium
PVGNAERGSARWGFGAVLEGF

SEQ ID NO: 323927 - protein, 24 aa, Mycobacterium
PVGNPLRGIFVVNRVAGRWPFALR

SEQ ID NO: 323928 - protein, 22 aa, Mycobacterium
PVGRMGIAVLFARMLLSGLQPG

SEQ ID NO: 323929 - protein, 19 aa, Mycobacterium
PVGSLWYTVLCFVIAGLCL

SEQ ID NO: 323930 - protein, 22 aa, Mycobacterium
PVGTIVRIIIDFSTNPAAAIVT

SEQ ID NO: 323931 - protein, 22 aa, Mycobacterium
PVGWAHRLARRRVLMALLALTA

SEQ ID NO: 323932 - protein, 20 aa, Mycobacterium
PVGWYYDLLALWSHVSTASV

SEQ ID NO: 323933 - protein, 27 aa, Mycobacterium
PVHVLAHDWGSVGVWHYLKRPGAGDRV

SEQ ID NO: 323934 - protein, 27 aa, Mycobacterium
PVHVLGHDWGSVAIWEYLTRSGAADRV

SEQ ID NO: 323935 - protein, 17 aa, Mycobacterium
PVIALVVAVGYGLATDY

SEQ ID NO: 323936 - protein, 21 aa, Mycobacterium
PVIAVCITGDFLLIAAGIGGL

SEQ ID NO: 323937 - protein, 19 aa, Mycobacterium
PVICRTAFGVLGANIPAII

SEQ ID NO: 323938 - protein, 21 aa, Mycobacterium
PVIDAFGYRSVFVVAALLATA

SEQ ID NO: 323939 - protein, 17 aa, Mycobacterium
PVIDELVLHTPLVLAEH

SEQ ID NO: 323940 - protein, 17 aa, Mycobacterium
PVIEEVRHLLADRPRAI

SEQ ID NO: 323941 - protein, 20 aa, Mycobacterium
PVIGAFPFNGHFTVVLLLTL

SEQ ID NO: 323942 - protein, 19 aa, Mycobacterium
PVIGFPPYIQQILPPSPGP

SEQ ID NO: 323943 - protein, 21 aa, Mycobacterium
PVIHGEPWWAWTVVAVLVVCL

SEQ ID NO: 323944 - protein, 23 aa, Mycobacterium
PVKADTKSGLYWTPDSADYHEAP

SEQ ID NO: 323945 - protein, 25 aa, Mycobacterium
PVKAEVFRPLSFRRRITNGAATIFF

SEQ ID NO: 323946 - protein, 24 aa, Mycobacterium
PVKPRRRILRRLLITSLGLATVLA

SEQ ID NO: 323947 - protein, 22 aa, Mycobacterium
PVKWWDILRKPSYLAIVAGAAS

SEQ ID NO: 323948 - protein, 18 aa, Mycobacterium
PVLALAAKRGIGEPKADR

SEQ ID NO: 323949 - protein, 19 aa, Mycobacterium
PVLALAAKRGIGEPKADRT

SEQ ID NO: 323950 - protein, 17 aa, Mycobacterium
PVLAMGLSAAIGLVSVW

SEQ ID NO: 323951 - protein, 18 aa, Mycobacterium
PVLAQFACLAATLSYGIG

SEQ ID NO: 323952 - protein, 17 aa, Mycobacterium
PVLAVVCVALFGLVVSP

SEQ ID NO: 323953 - protein, 19 aa, Mycobacterium
PVLEEAFSRPVGGADSLQR

SEQ ID NO: 323954 - protein, 26 aa, Mycobacterium
PVLERHAAEMIAGFAGRGECDAMAEF

SEQ ID NO: 323955 - protein, 22 aa, Mycobacterium
PVLERHAAEMIGALAAQGKCEV

SEQ ID NO: 323956 - protein, 19 aa, Mycobacterium
PVLEVATSLVVSVPEEPDM

SEQ ID NO: 323957 - protein, 17 aa, Mycobacterium
PVLGGPCGDVGKLAYDP

SEQ ID NO: 323958 - protein, 24 aa, Mycobacterium
PVLGSLWAPVGLRFHAVHHFFPQL

SEQ ID NO: 323959 - protein, 18 aa, Mycobacterium
PVLIRLFTRQGFGHEIRE

SEQ ID NO: 323960 - protein, 21 aa, Mycobacterium
PVLIVGIGWLVSRMSDGRKRA

SEQ ID NO: 323961 - protein, 18 aa, Mycobacterium
PVLKPGVVPLRPLTLSDI

SEQ ID NO: 323962 - protein, 23 aa, Mycobacterium
PVLLDWTVGLVFPCQHPMLHQYG

SEQ ID NO: 323963 - protein, 29 aa, Mycobacterium
PVLMFCVAFGLSMDYEVFLLSRIREYWLE

SEQ ID NO: 323964 - protein, 26 aa, Mycobacterium
PVLPIASICACVWLMVNLTALTWVRF

SEQ ID NO: 323965 - protein, 30 aa, Mycobacterium
PVLPIASLCACLWLMLNLTALTWIRFGVWL

SEQ ID NO: 323966 - protein, 18 aa, Mycobacterium
PVLQEAFSRPVGSPESLQ

SEQ ID NO: 323967 - protein, 21 aa, Mycobacterium
PVLRAVAWSAQAIRCAHNGSV

SEQ ID NO: 323968 - protein, 17 aa, Mycobacterium
PVLRRLGVLLVLLCAQA

SEQ ID NO: 323969 - protein, 27 aa, Mycobacterium
PVLSIIACLFVLYGLPAVTWLWFSVWV

SEQ ID NO: 323970 - protein, 25 aa, Mycobacterium
PVLYGALFFPVWPLGVLVPVGVAVV

SEQ ID NO: 323971 - protein, 18 aa, Mycobacterium
PVMLGWGIWESVAIGAAS

SEQ ID NO: 323972 - protein, 24 aa, Mycobacterium
PVMMSIVAIAIRYNPAFDKADEFH

SEQ ID NO: 323973 - protein, 19 aa, Mycobacterium
PVNLRSGLITVTQNDREIA

SEQ ID NO: 323974 - protein, 19 aa, Mycobacterium
PVNTWRAAALRNRMVAGSL

SEQ ID NO: 323975 - protein, 23 aa, Mycobacterium
PVNVRASSLGFCYNIGALGGAVA

SEQ ID NO: 323976 - protein, 28 aa, Mycobacterium
PVPDSLIHLCLFIGALTFMYISARAVGD

SEQ ID NO: 323977 - protein, 26 aa, Mycobacterium
PVPDSLIHMCLFLGALTFMYISARAV

SEQ ID NO: 323978 - protein, 25 aa, Mycobacterium
PVPFPGFKNGVGLMLQLPQPTVVGS

SEQ ID NO: 323979 - protein, 18 aa, Mycobacterium
PVPGWPYLQVFATGFLMF

SEQ ID NO: 323980 - protein, 21 aa, Mycobacterium
PVPKLIVIAGFIVAAVCLALA

SEQ ID NO: 323981 - protein, 19 aa, Mycobacterium
PVPMSGYFLYRAATVVVIT

SEQ ID NO: 323982 - protein, 20 aa, Mycobacterium
PVPPRQGWLVPLAATVAAVL

SEQ ID NO: 323983 - protein, 17 aa, Mycobacterium
PVPTRTVTETSTPAQTT

SEQ ID NO: 323984 - protein, 20 aa, Mycobacterium
PVPVSHAMAVTWQGNPVVLG

SEQ ID NO: 323985 - protein, 20 aa, Mycobacterium
PVQAHRLFRMSGRDPHEQHR

SEQ ID NO: 323986 - protein, 24 aa, Mycobacterium
PVQAWLRMRRWVKQRVEERLADSR

SEQ ID NO: 323987 - protein, 21 aa, Mycobacterium
PVQLGKDWIWLHAARIAAAVL

SEQ ID NO: 323988 - protein, 19 aa, Mycobacterium
PVQVPSRWQHDVDMRGKRV

SEQ ID NO: 323989 - protein, 17 aa, Mycobacterium
PVQVWAVAGGLLLALQI

SEQ ID NO: 323990 - protein, 17 aa, Mycobacterium
PVRARPAVVTAGMVVAA

SEQ ID NO: 323991 - protein, 17 aa, Mycobacterium
PVRCTGDPVALSRMVRN

SEQ ID NO: 323992 - protein, 22 aa, Mycobacterium
PVRDGKFEFVVRSVEPGLSEVG

SEQ ID NO: 323993 - protein, 18 aa, Mycobacterium
PVRGRLADVAALACVAVV

SEQ ID NO: 323994 - protein, 19 aa, Mycobacterium
PVRLPVKAPPGARTENLAP

SEQ ID NO: 323995 - protein, 17 aa, Mycobacterium
PVRRRISVNDVRGHSNW

SEQ ID NO: 323996 - protein, 28 aa, Mycobacterium
PVRSGGSTARINGRYGPLAPGPQNSIYS

SEQ ID NO: 323997 - protein, 17 aa, Mycobacterium
PVRVWPGVVTTVLDGLV

SEQ ID NO: 323998 - protein, 23 aa, Mycobacterium
PVRYRVHLFLLVIVERAGNVDMS

SEQ ID NO: 323999 - protein, 18 aa, Mycobacterium
PVSAWRAQDATAMRGLAA

SEQ ID NO: 324000 - protein, 23 aa, Mycobacterium
PVSFGTFFRARGFGLYVGAALLV

SEQ ID NO: 324001 - protein, 24 aa, Mycobacterium
PVSFVRRPYRWIKELGASDVPTFA

SEQ ID NO: 324002 - protein, 21 aa, Mycobacterium
PVSGAALWGWGLAWMAVVVWF

SEQ ID NO: 324003 - protein, 18 aa, Mycobacterium
PVSGLRLGFDELAAQPDS

SEQ ID NO: 324004 - protein, 17 aa, Mycobacterium
PVSGSWKTLLRVQDGTT

SEQ ID NO: 324005 - protein, 24 aa, Mycobacterium
PVSIRAEPAVAWVDANLGDPKRAA

SEQ ID NO: 324006 - protein, 22 aa, Mycobacterium
PVSLSGRGVRWSDVVAGNEALG

SEQ ID NO: 324007 - protein, 24 aa, Mycobacterium
PVSLVTFSVVVSWWAAALGGTSTA

SEQ ID NO: 324008 - protein, 30 aa, Mycobacterium
PVSPASMRKFFKAFEPYGLRETAVKPSYGL

SEQ ID NO: 324009 - protein, 18 aa, Mycobacterium
PVSRYHWVPAAAGWTVGV

SEQ ID NO: 324010 - protein, 24 aa, Mycobacterium
PVSVMLKSTVPVLANPQRPGPFGL

SEQ ID NO: 324011 - protein, 20 aa, Mycobacterium
PVSWFGRPGSMATIAIVVGV

SEQ ID NO: 324012 - protein, 20 aa, Mycobacterium
PVSWSHHWVWGLPTVVVLAV

SEQ ID NO: 324013 - protein, 20 aa, Mycobacterium
PVSWSHHWVWMLPAVLVTGV

SEQ ID NO: 324014 - protein, 26 aa, Mycobacterium
PVSWSHHWVWMLPVLVVTAVLAYRRR

SEQ ID NO: 324015 - protein, 18 aa, Mycobacterium
PVSYAIAAMRGYAMGGPV

SEQ ID NO: 324016 - protein, 18 aa, Mycobacterium
PVSYPGLPPAPGGYRNRR

SEQ ID NO: 324017 - protein, 22 aa, Mycobacterium
PVTAEAIVSWRNANGQFASVDQ

SEQ ID NO: 324018 - protein, 24 aa, Mycobacterium
PVTDRFGRRRVLLAGVAVMAVLTF

SEQ ID NO: 324019 - protein, 22 aa, Mycobacterium
PVTEVRRLLPRPADEHRAEAAS

SEQ ID NO: 324020 - protein, 25 aa, Mycobacterium
PVTGAPAWETFALFTARNGASALVG

SEQ ID NO: 324021 - protein, 18 aa, Mycobacterium
PVTLNLDGLGRYRVVAAP

SEQ ID NO: 324022 - protein, 19 aa, Mycobacterium
PVTLNLDGLGRYRVVAAPS

SEQ ID NO: 324023 - protein, 18 aa, Mycobacterium
PVTLWRGRLSVAIDALES

SEQ ID NO: 324024 - protein, 18 aa, Mycobacterium
PVTLWRGRLSVAIDALET

SEQ ID NO: 324025 - protein, 18 aa, Mycobacterium
PVTMWRGRLSVAVDALQT

SEQ ID NO: 324026 - protein, 28 aa, Mycobacterium
PVTPAEAFAAWEYASRFDVAHVVMAPTL

SEQ ID NO: 324027 - protein, 27 aa, Mycobacterium
PVTRVAAALCFLILMLAMFPANIYAAR

SEQ ID NO: 324028 - protein, 26 aa, Mycobacterium
PVTVAHFLPPVLRRLSIFVPPSPSVA

SEQ ID NO: 324029 - protein, 19 aa, Mycobacterium
PVTVRLGGHYRLTGPDDQV

SEQ ID NO: 324030 - protein, 19 aa, Mycobacterium
PVTVWRGRLAIALDALETD

SEQ ID NO: 324031 - protein, 24 aa, Mycobacterium
PVVAALRTEAWRGTAAECCVAAYV

SEQ ID NO: 324032 - protein, 20 aa, Mycobacterium
PVVGGLLYGPLISRFAREAR

SEQ ID NO: 324033 - protein, 19 aa, Mycobacterium
PVVIASFFIQRRLVQGISG

SEQ ID NO: 324034 - protein, 25 aa, Mycobacterium
PVVIATAVATFAVWFVAGPAPTVTQ

SEQ ID NO: 324035 - protein, 24 aa, Mycobacterium
PVVLAGPVGWAVLWLVTVVPVVLV

SEQ ID NO: 324036 - protein, 21 aa, Mycobacterium
PVVLGLAVATLGFWIGSGYPV

SEQ ID NO: 324037 - protein, 18 aa, Mycobacterium
PVVMYLRDVAPMDVVTWV

SEQ ID NO: 324038 - protein, 20 aa, Mycobacterium
PVVRAKLWLQCAIAGTPRLP

SEQ ID NO: 324039 - protein, 20 aa, Mycobacterium
PVVRAKLWLQCAIAGTPRRP

SEQ ID NO: 324040 - protein, 27 aa, Mycobacterium
PVVTQRLSEEFRMPVTTVVQSQVIAAT

SEQ ID NO: 324041 - protein, 20 aa, Mycobacterium
PVWQSLRHADTWILALLYIG

SEQ ID NO: 324042 - protein, 20 aa, Mycobacterium
PVWQSLRHSDTWVMSLLYIG

SEQ ID NO: 324043 - protein, 20 aa, Mycobacterium
PVWTLMALMGFVIPNAPALA

SEQ ID NO: 324044 - protein, 25 aa, Mycobacterium
PVYQFPGYLGFHIVERWQFHYSQVV

SEQ ID NO: 324045 - protein, 26 aa, Mycobacterium
PVYRAVINFKFGWDIYNEHFDHVDPH

SEQ ID NO: 324046 - protein, 24 aa, Mycobacterium
PVYRAVVNFRRGWDIYNEHFDYVD

SEQ ID NO: 324047 - protein, 36 aa, Mycobacterium
PVYVVMAMTFGWVWLIKRVLAGLRWENDNQPLTAKD

SEQ ID NO: 324048 - protein, 24 aa, Mycobacterium
PWALFMVTVTYVWKNLGYTCVIYL

SEQ ID NO: 324049 - protein, 17 aa, Mycobacterium
PWALVPVGATVLVIAAG

SEQ ID NO: 324050 - protein, 18 aa, Mycobacterium
PWAPFTIDFNLANIGGPS

SEQ ID NO: 324051 - protein, 18 aa, Mycobacterium
PWAPYSGYLTLAFLAGVL

SEQ ID NO: 324052 - protein, 20 aa, Mycobacterium
PWARRRGHDQVRSPPPARPV

SEQ ID NO: 324053 - protein, 22 aa, Mycobacterium
PWDTPRPAPGMVSTDGKSAIIV

SEQ ID NO: 324054 - protein, 17 aa, Mycobacterium
PWFPSVTNRGVFETREG

SEQ ID NO: 324055 - protein, 19 aa, Mycobacterium
PWGAFDMSLGKAMYAGFTL

SEQ ID NO: 324056 - protein, 30 aa, Mycobacterium
PWGPRLGVRWWRFGAGILLGLACGTKWSGL

SEQ ID NO: 324057 - protein, 20 aa, Mycobacterium
PWGWIAHRLLSAPVTAARMA

SEQ ID NO: 324058 - protein, 19 aa, Mycobacterium
PWHDQVFLSLAGLRGAVPI

SEQ ID NO: 324059 - protein, 23 aa, Mycobacterium
PWHSTRDYWVLGIAAAVVLALFG

SEQ ID NO: 324060 - protein, 27 aa, Mycobacterium
PWICAPLAIAVMWRWILAPTDGAISTL

SEQ ID NO: 324061 - protein, 19 aa, Mycobacterium
PWLAACIAAVAPLSLLATV

SEQ ID NO: 324062 - protein, 26 aa, Mycobacterium
PWLALSLLCALWVALFGLLAVAVRNL

SEQ ID NO: 324063 - protein, 21 aa, Mycobacterium
PWLFFVASFFTSFAFPLACYF

SEQ ID NO: 324064 - protein, 19 aa, Mycobacterium
PWLGTLRRDLLPTGYALAL

SEQ ID NO: 324065 - protein, 20 aa, Mycobacterium
PWLLPLRWSLVEYYYLKYYI

SEQ ID NO: 324066 - protein, 19 aa, Mycobacterium
PWLNLPAVLLIIMCAILLI

SEQ ID NO: 324067 - protein, 17 aa, Mycobacterium
PWLPLVFLLVHIVVTVP

SEQ ID NO: 324068 - protein, 26 aa, Mycobacterium
PWLTFLRTLPPLAYFFLLVIWLGIDE

SEQ ID NO: 324069 - protein, 19 aa, Mycobacterium
PWLVYWVLVGNVPFHTAVL

SEQ ID NO: 324070 - protein, 18 aa, Mycobacterium
PWNALWAMMFGFFMILVD

SEQ ID NO: 324071 - protein, 27 aa, Mycobacterium
PWPDQRPPRRGQWVAVYGLTSLLLAGL

SEQ ID NO: 324072 - protein, 21 aa, Mycobacterium
PWPSLREAVAFVAFADIGIAV

SEQ ID NO: 324073 - protein, 18 aa, Mycobacterium
PWQLLWQLLQYLWNAYTG

SEQ ID NO: 324074 - protein, 19 aa, Mycobacterium
PWQLRLRRPTIAMGSVVVL

SEQ ID NO: 324075 - protein, 19 aa, Mycobacterium
PWQMYPVGLLFGLGFDTVT

SEQ ID NO: 324076 - protein, 22 aa, Mycobacterium
PWQTTFDRWLLGVAVAVVVILF

SEQ ID NO: 324077 - protein, 27 aa, Mycobacterium
PWQVYWRILLPHARPAVMVLAVLTWVN

SEQ ID NO: 324078 - protein, 19 aa, Mycobacterium
PWQWQRWAPASPWATPPVT

SEQ ID NO: 324079 - protein, 18 aa, Mycobacterium
PWRPRRFLRSLAQALRLS

SEQ ID NO: 324080 - protein, 18 aa, Mycobacterium
PWRSFGAVMALTLFLEAI

SEQ ID NO: 324081 - protein, 18 aa, Mycobacterium
PWRVHRFAPGELDDMKAR

SEQ ID NO: 324082 - protein, 19 aa, Mycobacterium
PWSTLKVSALLSVALFFIW

SEQ ID NO: 324083 - protein, 18 aa, Mycobacterium
PWTALTLLVVGVYGLCLK

SEQ ID NO: 324084 - protein, 24 aa, Mycobacterium
PWTSSFVGVGPWLALAGMESVFPA

SEQ ID NO: 324085 - protein, 19 aa, Mycobacterium
PWVASRIGLSRAISVALLA

SEQ ID NO: 324086 - protein, 18 aa, Mycobacterium
PWVDAAFKKRGIDPEDFW

SEQ ID NO: 324087 - protein, 18 aa, Mycobacterium
PWWAWTVVAVLVVCLMIS

SEQ ID NO: 324088 - protein, 17 aa, Mycobacterium
PWWLAPLISGVLFAGSV

SEQ ID NO: 324089 - protein, 20 aa, Mycobacterium
PWYLRATPLAAVALGLAVVL

SEQ ID NO: 324090 - protein, 20 aa, Mycobacterium
PWYPKASVLGGVISSLFFLT

SEQ ID NO: 324091 - protein, 26 aa, Mycobacterium
PYAAMFTDVYGLRIGDDVRMAGVRVG

SEQ ID NO: 324092 - protein, 19 aa, Mycobacterium
PYAGDRWWVLLLHLATAAA

SEQ ID NO: 324093 - protein, 19 aa, Mycobacterium
PYAGDRWWVLLLHLVTASA

SEQ ID NO: 324094 - protein, 18 aa, Mycobacterium
PYAGERWWVLLLPLATTA

SEQ ID NO: 324095 - protein, 26 aa, Mycobacterium
PYAIFLLREHFRIIPNDMINAARLDG

SEQ ID NO: 324096 - protein, 18 aa, Mycobacterium
PYALSMACAVWLTVLFVA

SEQ ID NO: 324097 - protein, 19 aa, Mycobacterium
PYAMAANWFGGRNWTMISA

SEQ ID NO: 324098 - protein, 17 aa, Mycobacterium
PYASFLYNTEGLPYFSI

SEQ ID NO: 324099 - protein, 19 aa, Mycobacterium
PYASISIAHGIRRFEFMIH

SEQ ID NO: 324100 - protein, 17 aa, Mycobacterium
PYCGSPYSFLPQLSPGD

SEQ ID NO: 324101 - protein, 18 aa, Mycobacterium
PYCSLPASARANLSVDGA

SEQ ID NO: 324102 - protein, 18 aa, Mycobacterium
PYDEGRVVEQEAAANIRQ

SEQ ID NO: 324103 - protein, 19 aa, Mycobacterium
PYERAFRDATAMSIGFAVA

SEQ ID NO: 324104 - protein, 18 aa, Mycobacterium
PYETTYLTEIGWNVGSVA

SEQ ID NO: 324105 - protein, 19 aa, Mycobacterium
PYEVELCVAEVAHYGESKA

SEQ ID NO: 324106 - protein, 26 aa, Mycobacterium
PYFHTMGVPCAIGMLAAVAVAVTLVP

SEQ ID NO: 324107 - protein, 28 aa, Mycobacterium
PYFKTTGIPLSIGMAIVVAMALTLGPAL

SEQ ID NO: 324108 - protein, 27 aa, Mycobacterium
PYFKVMLANLAPYWILQPFVDAAFKKR

SEQ ID NO: 324109 - protein, 28 aa, Mycobacterium
PYFNTLGPPCAIGMLVAVFAALTLGPAV

SEQ ID NO: 324110 - protein, 27 aa, Mycobacterium
PYFQPLGIPCAIGITVAVLVALTLAPA

SEQ ID NO: 324111 - protein, 27 aa, Mycobacterium
PYFQTLGVPCAVGMLVAVAVALTLGPA

SEQ ID NO: 324112 - protein, 29 aa, Mycobacterium
PYFRTLGIPCAVGMLLAVVVALTLGPAVL

SEQ ID NO: 324113 - protein, 19 aa, Mycobacterium
PYFTGYLPTLFLAAILTPA

SEQ ID NO: 324114 - protein, 21 aa, Mycobacterium
PYGGICLTAAIGLIGVLLNGV

SEQ ID NO: 324115 - protein, 19 aa, Mycobacterium
PYGICLVEDITSRKRAEAE

SEQ ID NO: 324116 - protein, 23 aa, Mycobacterium
PYGPRPLVRALLLPRDGKSANPS

SEQ ID NO: 324117 - protein, 23 aa, Mycobacterium
PYGPRPLVRALLLPRNGDSADGP

SEQ ID NO: 324118 - protein, 18 aa, Mycobacterium
PYGRIFAAVVAPRLDPVQ

SEQ ID NO: 324119 - protein, 22 aa, Mycobacterium
PYHLRLDWLMWFAAISPGYALP

SEQ ID NO: 324120 - protein, 23 aa, Mycobacterium
PYHLRLDWLMWFAAISPTYAHPW

SEQ ID NO: 324121 - protein, 18 aa, Mycobacterium
PYIKGTIEQARQLATRVD

SEQ ID NO: 324122 - protein, 21 aa, Mycobacterium
PYILAGWSLGGVLAYACAIGL

SEQ ID NO: 324123 - protein, 29 aa, Mycobacterium
PYILVGWSLGGALAYACAIGLKREGADVR

SEQ ID NO: 324124 - protein, 18 aa, Mycobacterium
PYIVMPYYAADSLAVRLR

SEQ ID NO: 324125 - protein, 22 aa, Mycobacterium
PYKTAGVVFLVLALVIFVLVYL

SEQ ID NO: 324126 - protein, 22 aa, Mycobacterium
PYLLITRQWRAVAAAAVTAIGT

SEQ ID NO: 324127 - protein, 18 aa, Mycobacterium
PYLVCAVYLVLLAIAGLG

SEQ ID NO: 324128 - protein, 24 aa, Mycobacterium
PYMLMMPMMVVMGAVGMMASGGSG

SEQ ID NO: 324129 - protein, 19 aa, Mycobacterium
PYMSGLVGLAYNRAATGRD

SEQ ID NO: 324130 - protein, 20 aa, Mycobacterium
PYPAPARRRTWIVLRADPDK

SEQ ID NO: 324131 - protein, 28 aa, Mycobacterium
PYPVVCDVTARLGLLGMRNDVLVPCYGM

SEQ ID NO: 324132 - protein, 21 aa, Mycobacterium
PYQRRGHALGWLFGAMAGGMA

SEQ ID NO: 324133 - protein, 23 aa, Mycobacterium
PYQYPRHLPIIGAKGGPGGKPGC

SEQ ID NO: 324134 - protein, 19 aa, Mycobacterium
PYRAQWDAGAVVLELYEHL

SEQ ID NO: 324135 - protein, 19 aa, Mycobacterium
PYRGSSVLWRIHAVSVLLV

SEQ ID NO: 324136 - protein, 22 aa, Mycobacterium
PYTCAAVAMYLWSRHADATGEQ

SEQ ID NO: 324137 - protein, 21 aa, Mycobacterium
PYTFELLDRIGFTSMDLPHLR

SEQ ID NO: 324138 - protein, 18 aa, Mycobacterium
PYTLKIMTWAALVFAPLV

SEQ ID NO: 324139 - protein, 17 aa, Mycobacterium
PYTLPSLDLLVAGDPPK

SEQ ID NO: 324140 - protein, 23 aa, Mycobacterium
PYTLRIMTWASLALLPLVLGYQA

SEQ ID NO: 324141 - protein, 25 aa, Mycobacterium
PYVFAAAALMLWPRHATRSGDIGWH

SEQ ID NO: 324142 - protein, 24 aa, Mycobacterium
PYVGWMCGWGMVIATIIVLSNLAA

SEQ ID NO: 324143 - protein, 24 aa, Mycobacterium
PYVGWMCGWGMVIATVIVLSNLAA

SEQ ID NO: 324144 - protein, 23 aa, Mycobacterium
PYVLEFYRRVRAAADKITSDVEM

SEQ ID NO: 324145 - protein, 17 aa, Mycobacterium
PYVLPPLDLLVAGEPPK

SEQ ID NO: 324146 - protein, 20 aa, Mycobacterium
PYVMGGAMLGMIVIMVAGGT

SEQ ID NO: 324147 - protein, 24 aa, Mycobacterium
PYVRDGWAFVAIRLTSTAPIVGGL

SEQ ID NO: 324148 - protein, 19 aa, Mycobacterium
PYVVCAVYLVLLAVAAVGA

SEQ ID NO: 324149 - protein, 19 aa, Mycobacterium
PYWVCAIYLVLLTIGGIGA

SEQ ID NO: 324150 - protein, 17 aa, Mycobacterium
PYYARMHTWIKRAVLVC

SEQ ID NO: 324151 - protein, 25 aa, Mycobacterium
PYYPEYSRPGGYYGPAADPSAPFGR

SEQ ID NO: 324152 - protein, 20 aa, Mycobacterium
PYYSMPIIGWWLRPKASARQ

SEQ ID NO: 324153 - protein, 17 aa, Mycobacterium
QAAAFLLTMRNDASSSN

SEQ ID NO: 324154 - protein, 17 aa, Mycobacterium
QAAAILRALQRVRRDLA

SEQ ID NO: 324155 - protein, 17 aa, Mycobacterium
QAAALREALANQKIEKV

SEQ ID NO: 324156 - protein, 23 aa, Mycobacterium
QAAASRPGLLAVVSGDTLSGAGM

SEQ ID NO: 324157 - protein, 25 aa, Mycobacterium
QAADAWLGLCQTYGWAPGVMGASTQ

SEQ ID NO: 324158 - protein, 22 aa, Mycobacterium
QAAEVPRELGVPVAPVVPAVRV

SEQ ID NO: 324159 - protein, 18 aa, Mycobacterium
QAAFTMMVLISFNLIAPT

SEQ ID NO: 324160 - protein, 25 aa, Mycobacterium
QAAFWCALSLPPLLLGMLGSLAYIA

SEQ ID NO: 324161 - protein, 28 aa, Mycobacterium
QAAGEAPTRVMLVGQRLDLDSVAAELRS

SEQ ID NO: 324162 - protein, 25 aa, Mycobacterium
QAAHWEPWIWAMIVAGIGFMTVFVF

SEQ ID NO: 324163 - protein, 20 aa, Mycobacterium
QAALPRRGGSPSRPLAPTPA

SEQ ID NO: 324164 - protein, 24 aa, Mycobacterium
QAALRRVATLVARGSPPEEVYPAA

SEQ ID NO: 324165 - protein, 25 aa, Mycobacterium
QAANVLGSWSDFWEEFVYNFFDIFT

SEQ ID NO: 324166 - protein, 18 aa, Mycobacterium
QAAPFLPLYEGVRVECAK

SEQ ID NO: 324167 - protein, 18 aa, Mycobacterium
QAAPSAMVHHWLYSVFLT

SEQ ID NO: 324168 - protein, 18 aa, Mycobacterium
QAAVFWNGMEAIRKFIDF

SEQ ID NO: 324169 - protein, 17 aa, Mycobacterium
QAAVRWAARDAELRNVP

SEQ ID NO: 324170 - protein, 20 aa, Mycobacterium
QACILPIYLITGGHDVEITG

SEQ ID NO: 324171 - protein, 22 aa, Mycobacterium
QADHPLLLAVPAFAPAIVVAGV

SEQ ID NO: 324172 - protein, 18 aa, Mycobacterium
QADHYDWFADYLSARGLV

SEQ ID NO: 324173 - protein, 26 aa, Mycobacterium
QAEAHAWRPLFWIIAAIALAALVMAL

SEQ ID NO: 324174 - protein, 25 aa, Mycobacterium
QAEILWDVIPFDWANDSNTAATRLL

SEQ ID NO: 324175 - protein, 25 aa, Mycobacterium
QAEKWNFPIVLVILLAVFGSLAAAA

SEQ ID NO: 324176 - protein, 24 aa, Mycobacterium
QAEPSRARFIAVMALYGLTYAVQV

SEQ ID NO: 324177 - protein, 22 aa, Mycobacterium
QAESLRGLAILLLVALVTTGVI

SEQ ID NO: 324178 - protein, 31 aa, Mycobacterium
QAFKAAECRAAARAWARYEPELARHADESEV

SEQ ID NO: 324179 - protein, 20 aa, Mycobacterium
QAFLAYIMMGWLPQVFIDNG

SEQ ID NO: 324180 - protein, 20 aa, Mycobacterium
QAFLGCRSLLYSDGAGGAEL

SEQ ID NO: 324181 - protein, 22 aa, Mycobacterium
QAFLMRPSRWLWAIHDNRASMS

SEQ ID NO: 324182 - protein, 19 aa, Mycobacterium
QAFSEPRVVSALMRSVWLA

SEQ ID NO: 324183 - protein, 25 aa, Mycobacterium
QAGERRMLCGLQLPGPNNQQTAFKG

SEQ ID NO: 324184 - protein, 17 aa, Mycobacterium
QAGEVIIAVSNAQAAAA

SEQ ID NO: 324185 - protein, 26 aa, Mycobacterium
QAGFDLASSVLRRLPGGPALASLAGS

SEQ ID NO: 324186 - protein, 19 aa, Mycobacterium
QAGFTRLILLTGDRAEPTR

SEQ ID NO: 324187 - protein, 20 aa, Mycobacterium
QAGGVWAFIGVLIVAFFLAS

SEQ ID NO: 324188 - protein, 24 aa, Mycobacterium
QAGLAERRRLHAAFGTYVDPALAA

SEQ ID NO: 324189 - protein, 17 aa, Mycobacterium
QAGLLRLLVEVRERERL

SEQ ID NO: 324190 - protein, 20 aa, Mycobacterium
QAGMFGRAFAIRFAPATFAV

SEQ ID NO: 324191 - protein, 19 aa, Mycobacterium
QAGPLMEILQILKANNVPL

SEQ ID NO: 324192 - protein, 24 aa, Mycobacterium
QAGRASASLGTWAVVAVVLGPVLI

SEQ ID NO: 324193 - protein, 21 aa, Mycobacterium
QAGSTLLKFFGGLRNVSDGKP

SEQ ID NO: 324194 - protein, 25 aa, Mycobacterium
QAGTQDWKAWLFGSLDAGNAITVDK

SEQ ID NO: 324195 - protein, 25 aa, Mycobacterium
QAGTRGASFVFRHRAGNAAIGVLIV

SEQ ID NO: 324196 - protein, 26 aa, Mycobacterium
QAIAAWLQLCQAYGWAPGVMGASLAG

SEQ ID NO: 324197 - protein, 20 aa, Mycobacterium
QAIAGARARGDNTFAELLSG

SEQ ID NO: 324198 - protein, 23 aa, Mycobacterium
QAIGLNSCVLWVGMGIGSLVFQA

SEQ ID NO: 324199 - protein, 26 aa, Mycobacterium
QAIILYCVVRFALGMHAAHPVAMLGF

SEQ ID NO: 324200 - protein, 24 aa, Mycobacterium
QAISGTWLGHPVHPPLTDVVIGSF

SEQ ID NO: 324201 - protein, 29 aa, Mycobacterium
QAISPWAACKIFFSFLWAALRNAPSVWLG

SEQ ID NO: 324202 - protein, 26 aa, Mycobacterium
QAITSRLPLVLGIIAGITFVLLFLLT

SEQ ID NO: 324203 - protein, 25 aa, Mycobacterium
QAKPEERAAALIRPSIMYLAGEGYG

SEQ ID NO: 324204 - protein, 24 aa, Mycobacterium
QALGFPAGIGIAFVALVSYVALEA

SEQ ID NO: 324205 - protein, 17 aa, Mycobacterium
QALKIFMIGSIIAEVIG

SEQ ID NO: 324206 - protein, 21 aa, Mycobacterium
QALNVPLPWSKVLSSTKPGIP

SEQ ID NO: 324207 - protein, 17 aa, Mycobacterium
QALQAGLSVRPMIVTLI

SEQ ID NO: 324208 - protein, 23 aa, Mycobacterium
QALRLCAEPHPPTGHEVVPAGAP

SEQ ID NO: 324209 - protein, 17 aa, Mycobacterium
QALRLSYMALFSVPVLA

SEQ ID NO: 324210 - protein, 19 aa, Mycobacterium
QALVDCGVYVDGRRMPGKY

SEQ ID NO: 324211 - protein, 19 aa, Mycobacterium
QALVPIHLAFAFRGMNTHG

SEQ ID NO: 324212 - protein, 33 aa, Mycobacterium
QAMLNLPAAWQFSRGEGQLVAILDTGVQPGPRL

SEQ ID NO: 324213 - protein, 25 aa, Mycobacterium
QAMTFRYFYNGAYQQLYLPRGARMV

SEQ ID NO: 324214 - protein, 18 aa, Mycobacterium
QANSGHRGGIPNGRSDPA

SEQ ID NO: 324215 - protein, 20 aa, Mycobacterium
QAPAMYRIVRELATAAHQPM

SEQ ID NO: 324216 - protein, 28 aa, Mycobacterium
QAPAPVPIPVPLPPVIVVPPLTPPWTPP

SEQ ID NO: 324217 - protein, 22 aa, Mycobacterium
QAPELDAAISRQERELAGARHR

SEQ ID NO: 324218 - protein, 29 aa, Mycobacterium
QAPHVCKLWPLVFARVAASLVIFAMAATS

SEQ ID NO: 324219 - protein, 17 aa, Mycobacterium
QAPKMTVIAGRRLPLPP

SEQ ID NO: 324220 - protein, 24 aa, Mycobacterium
QAPMMYRIVRELATAAHQPMPRLY

SEQ ID NO: 324221 - protein, 22 aa, Mycobacterium
QAPMTMYLHLPFVSIPIPINPP

SEQ ID NO: 324222 - protein, 31 aa, Mycobacterium
QAPSHWDVAFIRRFMLIFGPISSLFDFLTFG

SEQ ID NO: 324223 - protein, 23 aa, Mycobacterium
QAPTLPGFPAIRLQPCKPPTEPP

SEQ ID NO: 324224 - protein, 31 aa, Mycobacterium
QAPVAILSIVGFLFVLGGLFGNPFAAAVGEV

SEQ ID NO: 324225 - protein, 20 aa, Mycobacterium
QAPVMYRIVRELATAAHQPM

SEQ ID NO: 324226 - protein, 18 aa, Mycobacterium
QAQGRTAVVVGWDGTARG

SEQ ID NO: 324227 - protein, 17 aa, Mycobacterium
QAQILHWRGDTASGGAI

SEQ ID NO: 324228 - protein, 24 aa, Mycobacterium
QAQPRSTLQLVLDNLWPLAKAALT

SEQ ID NO: 324229 - protein, 23 aa, Mycobacterium
QAQTVFNAFAWLIGEIITVATVG

SEQ ID NO: 324230 - protein, 23 aa, Mycobacterium
QARAVFRGPLLKGLMADLRIYMK

SEQ ID NO: 324231 - protein, 31 aa, Mycobacterium
QARIDSLHWRVFWICSGVILTTMLVGWVIGL

SEQ ID NO: 324232 - protein, 17 aa, Mycobacterium
QARLRILRCPTRQRRDC

SEQ ID NO: 324233 - protein, 23 aa, Mycobacterium
QARMLARMRWALPGVEGAAPAVA

SEQ ID NO: 324234 - protein, 21 aa, Mycobacterium
QARMMPEIVMIESNHDMRNPA

SEQ ID NO: 324235 - protein, 25 aa, Mycobacterium
QARVDGFTRWQAFRMVVLPQVYPGI

SEQ ID NO: 324236 - protein, 25 aa, Mycobacterium
QASGHPRWMRWLRSHYRRWGLIAVG

SEQ ID NO: 324237 - protein, 23 aa, Mycobacterium
QASKLLQCIVAGPGYANAQPTLG

SEQ ID NO: 324238 - protein, 19 aa, Mycobacterium
QASPAAGILLSFATFGVGF

SEQ ID NO: 324239 - protein, 19 aa, Mycobacterium
QASSILLTLALTVSIVNAM

SEQ ID NO: 324240 - protein, 17 aa, Mycobacterium
QASVKWQPITNARIARD

SEQ ID NO: 324241 - protein, 31 aa, Mycobacterium
QATATEWLNRLRALAHRTCVAPLPYAQTDLD

SEQ ID NO: 324242 - protein, 24 aa, Mycobacterium
QATDLRSPLLWALVVAALAVVIAG

SEQ ID NO: 324243 - protein, 23 aa, Mycobacterium
QATFARRRRNLLIGAGAGLAVIV

SEQ ID NO: 324244 - protein, 21 aa, Mycobacterium
QATFLPWVWYAARREELHLDE

SEQ ID NO: 324245 - protein, 21 aa, Mycobacterium
QATGALGLFGKVGVVLVAVGI

SEQ ID NO: 324246 - protein, 25 aa, Mycobacterium
QATILYCVVRFALGVHAVHPVAMLG

SEQ ID NO: 324247 - protein, 18 aa, Mycobacterium
QATRCDKEDILAGNDDPN

SEQ ID NO: 324248 - protein, 20 aa, Mycobacterium
QAVGFWKIGVRLPLLQGVTF

SEQ ID NO: 324249 - protein, 27 aa, Mycobacterium
QAVGLPCRGDAAADVFAFLLRGIGFDA

SEQ ID NO: 324250 - protein, 17 aa, Mycobacterium
QAVGVPVDLPALEKMPE

SEQ ID NO: 324251 - protein, 25 aa, Mycobacterium
QAVILYCVVRFALGMHAVHPAAMLG

SEQ ID NO: 324252 - protein, 26 aa, Mycobacterium
QAVIRADVPGGVWSRGLRARRRLERY

SEQ ID NO: 324253 - protein, 33 aa, Mycobacterium
QAVLNLPAAWQFSRGEGQLVAILDTGVQPGPRL

SEQ ID NO: 324254 - protein, 18 aa, Mycobacterium
QAVLPVAAVFLLWDEIAV

SEQ ID NO: 324255 - protein, 24 aa, Mycobacterium
QAYAESLGQVFLWAATVAAVAFVL

SEQ ID NO: 324256 - protein, 23 aa, Mycobacterium
QAYCAPLPCFTFLELLGAPLEDI

SEQ ID NO: 324257 - protein, 17 aa, Mycobacterium
QCAPFHPPSRLSLADAL

SEQ ID NO: 324258 - protein, 24 aa, Mycobacterium
QCDQGLRLLGLVALQDPPRDEVSE

SEQ ID NO: 324259 - protein, 17 aa, Mycobacterium
QCESAVSSRRMWAIPLV

SEQ ID NO: 324260 - protein, 24 aa, Mycobacterium
QCGLALALDRGRLSALRGVLTPAA

SEQ ID NO: 324261 - protein, 24 aa, Mycobacterium
QCGYRTPVTFLLRLLVPTAASVAV

SEQ ID NO: 324262 - protein, 21 aa, Mycobacterium
QCNNALMARRAWAIPAAALGG

SEQ ID NO: 324263 - protein, 23 aa, Mycobacterium
QDAGLSWLLLVAVPVLALANYWI

SEQ ID NO: 324264 - protein, 24 aa, Mycobacterium
QDAGLSWLLLVSVPVLGLANYWII

SEQ ID NO: 324265 - protein, 22 aa, Mycobacterium
QDALGAMLWRSLWGEAAPRTQI

SEQ ID NO: 324266 - protein, 18 aa, Mycobacterium
QDASRVFERFYRTDSSRA

SEQ ID NO: 324267 - protein, 20 aa, Mycobacterium
QDAVCAQRSWQHAVHSDPRG

SEQ ID NO: 324268 - protein, 19 aa, Mycobacterium
QDEEVWLFCVQRYESTGEP

SEQ ID NO: 324269 - protein, 18 aa, Mycobacterium
QDELLLGMVCSQSATVLG

SEQ ID NO: 324270 - protein, 25 aa, Mycobacterium
QDGKGIAIAGIILGAVIPVLWILVL

SEQ ID NO: 324271 - protein, 22 aa, Mycobacterium
QDGRGGLYWFSHGFNVRAVVPF

SEQ ID NO: 324272 - protein, 27 aa, Mycobacterium
QDGSIDRPECWGSIAAGSPDAYTPGSF

SEQ ID NO: 324273 - protein, 23 aa, Mycobacterium
QDHRGRLRVPLGTSAAGAVLELD

SEQ ID NO: 324274 - protein, 17 aa, Mycobacterium
QDHRVRLAGEQAQQAAI

SEQ ID NO: 324275 - protein, 21 aa, Mycobacterium
QDIIGFKLHWMVLAMSIILML

SEQ ID NO: 324276 - protein, 23 aa, Mycobacterium
QDKATDWTARFNASPLRAALTPH

SEQ ID NO: 324277 - protein, 17 aa, Mycobacterium
QDKAVWKALQLVLESFA

SEQ ID NO: 324278 - protein, 19 aa, Mycobacterium
QDLSFPFALAVIGLALNEA

SEQ ID NO: 324279 - protein, 18 aa, Mycobacterium
QDNRVGLLVIPEGRQLDD

SEQ ID NO: 324280 - protein, 17 aa, Mycobacterium
QDPGVSRAEGWRRRGPL

SEQ ID NO: 324281 - protein, 23 aa, Mycobacterium
QDPIKLIALLVCLIPTTIGALMS

SEQ ID NO: 324282 - protein, 25 aa, Mycobacterium
QDPLWDYKVSSWLIAAGACVVQAAV

SEQ ID NO: 324283 - protein, 23 aa, Mycobacterium
QDPRNWRLSVTVKQDGDQIKLAK

SEQ ID NO: 324284 - protein, 31 aa, Mycobacterium
QDRFWQHAPKTWLLDMAMLAALSLLYGGFVR

SEQ ID NO: 324285 - protein, 19 aa, Mycobacterium
QDRTVLVIAHRLHTITRAH

SEQ ID NO: 324286 - protein, 33 aa, Mycobacterium
QDRYAEAAPLPWYKRAAVVFSLAAAGLAILVAV

SEQ ID NO: 324287 - protein, 28 aa, Mycobacterium
QDSPIGVRGARNFPCMGQPGKRAPTVEI

SEQ ID NO: 324288 - protein, 28 aa, Mycobacterium
QDSPIGVRGTRNFPCMEQPGKRAPTVEI

SEQ ID NO: 324289 - protein, 19 aa, Mycobacterium
QDSPVLCWSWQREPGDQAP

SEQ ID NO: 324290 - protein, 17 aa, Mycobacterium
QDWRMVVGNRHFLAFAA

SEQ ID NO: 324291 - protein, 25 aa, Mycobacterium
QEAALKYFLLGAFSSAFFIYGAAML

SEQ ID NO: 324292 - protein, 25 aa, Mycobacterium
QEAALKYFLLGAFSSAFFLYGVALL

SEQ ID NO: 324293 - protein, 24 aa, Mycobacterium
QEAALTWLLLVSVPILALANYWIM

SEQ ID NO: 324294 - protein, 22 aa, Mycobacterium
QEAALTWLLLVSVPIMAVANYW

SEQ ID NO: 324295 - protein, 22 aa, Mycobacterium
QEAALTWLLLVSVPVLAVANYW

SEQ ID NO: 324296 - protein, 27 aa, Mycobacterium
QEAGEIPTRMSFIVSGRVGVSVAGDGD

SEQ ID NO: 324297 - protein, 35 aa, Mycobacterium
QEAGRPARWSWLWPREHHLVSWLAAVVVPSLICAL

SEQ ID NO: 324298 - protein, 17 aa, Mycobacterium
QEFSGAWSEFSKSTYGI

SEQ ID NO: 324299 - protein, 26 aa, Mycobacterium
QEGDRGVSWLPFFHDMGLITVLLASV

SEQ ID NO: 324300 - protein, 20 aa, Mycobacterium
QEGKHDWPFAAQAFATALPW

SEQ ID NO: 324301 - protein, 23 aa, Mycobacterium
QEGPGAAVIRTWAFQHRLRINLD

SEQ ID NO: 324302 - protein, 22 aa, Mycobacterium
QEGRGANVFFMLGGQRLDLSSL

SEQ ID NO: 324303 - protein, 25 aa, Mycobacterium
QEGSNRIPVFVFHPAGGSTVVYEPL

SEQ ID NO: 324304 - protein, 17 aa, Mycobacterium
QEIGREWRRDRNFVYYL

SEQ ID NO: 324305 - protein, 17 aa, Mycobacterium
QEIPAGINTGIIRSMGG

SEQ ID NO: 324306 - protein, 25 aa, Mycobacterium
QEIPRVYWKLARSVRAGRWQTLTHI

SEQ ID NO: 324307 - protein, 25 aa, Mycobacterium
QEIRAKRTLDALAIVGQAKPLVRRQ

SEQ ID NO: 324308 - protein, 27 aa, Mycobacterium
QEIRTANYFFCWAAIYQLGIAWHDGLL

SEQ ID NO: 324309 - protein, 25 aa, Mycobacterium
QEKKRIPLVEAFRTGRRGIFVTFAA

SEQ ID NO: 324310 - protein, 20 aa, Mycobacterium
QELGDFGILVHSGWTPSRAL

SEQ ID NO: 324311 - protein, 24 aa, Mycobacterium
QELIPYIVQFPRFFNGEVTLGGLT

SEQ ID NO: 324312 - protein, 21 aa, Mycobacterium
QELIPYIVQFSRFYNGEITLG

SEQ ID NO: 324313 - protein, 17 aa, Mycobacterium
QELLSRINAELSVYTGL

SEQ ID NO: 324314 - protein, 23 aa, Mycobacterium
QELRHWAVVLVLTAVGWVFAAFA

SEQ ID NO: 324315 - protein, 24 aa, Mycobacterium
QELRHWLVVIALTIVGWVLAAFAM

SEQ ID NO: 324316 - protein, 21 aa, Mycobacterium
QELRIGVGINTGVIIAGTIGG

SEQ ID NO: 324317 - protein, 20 aa, Mycobacterium
QEMTVRLGIVTGKGHGALIR

SEQ ID NO: 324318 - protein, 21 aa, Mycobacterium
QEMVLRLGAVVRVGHARLIFE

SEQ ID NO: 324319 - protein, 19 aa, Mycobacterium
QEPFTVIGVAFALSLLLGV

SEQ ID NO: 324320 - protein, 25 aa, Mycobacterium
QEPHAWRMRLSVRKIDGVVKVSDVE

SEQ ID NO: 324321 - protein, 22 aa, Mycobacterium
QEPRAWRMRVTVQKVGNDAKVA

SEQ ID NO: 324322 - protein, 21 aa, Mycobacterium
QEPRIWRLRVTVTEEDGQYKM

SEQ ID NO: 324323 - protein, 26 aa, Mycobacterium
QEPRTWRLSVSLVREDGQIKMSKVEF

SEQ ID NO: 324324 - protein, 20 aa, Mycobacterium
QERRLVFERFYRSTSARAMP

SEQ ID NO: 324325 - protein, 18 aa, Mycobacterium
QERYMSAGDLAIAAHDAL

SEQ ID NO: 324326 - protein, 24 aa, Mycobacterium
QESALKYFLLGAFSSAFFLFGSAF

SEQ ID NO: 324327 - protein, 24 aa, Mycobacterium
QESRTRFELGQTWQVLTATARNRV

SEQ ID NO: 324328 - protein, 22 aa, Mycobacterium
QETGYRLRVRMTPTEGQYKISK

SEQ ID NO: 324329 - protein, 20 aa, Mycobacterium
QEVLAIKPDICFLWDEAWYA

SEQ ID NO: 324330 - protein, 22 aa, Mycobacterium
QEVLNHSALVRFGADEIIQEAG

SEQ ID NO: 324331 - protein, 20 aa, Mycobacterium
QEVPNTFLLVLAALALLILT

SEQ ID NO: 324332 - protein, 27 aa, Mycobacterium
QEVPTLCWSWQRVAGDQAPKMTVIAGR

SEQ ID NO: 324333 - protein, 18 aa, Mycobacterium
QEYYGFLGTEGVDRLTRQ

SEQ ID NO: 324334 - protein, 19 aa, Mycobacterium
QFALFRISVKLPDTDTVSL

SEQ ID NO: 324335 - protein, 20 aa, Mycobacterium
QFDALHFAKPIFGPAARALA

SEQ ID NO: 324336 - protein, 21 aa, Mycobacterium
QFDALHFAKPIFGPAARALAQ

SEQ ID NO: 324337 - protein, 20 aa, Mycobacterium
QFELACGYTPEIDWPSATLG

SEQ ID NO: 324338 - protein, 24 aa, Mycobacterium
QFFGCTPLGPVAWSGVLGSTAGAT

SEQ ID NO: 324339 - protein, 18 aa, Mycobacterium
QFFLAQVHQRFRIQLPAG

SEQ ID NO: 324340 - protein, 18 aa, Mycobacterium
QFGDGWWSSVWAICGWMV

SEQ ID NO: 324341 - protein, 24 aa, Mycobacterium
QFGQRLAAFVVPRPNRDLDEHAIR

SEQ ID NO: 324342 - protein, 26 aa, Mycobacterium
QFGYGRSRYFYSFVVALLVFVLGAVA

SEQ ID NO: 324343 - protein, 41 aa, Mycobacterium
QFHQFGAFYKRSWRINDWMWGRLDGAGWLVHVLLNPRRVHW

SEQ ID NO: 324344 - protein, 17 aa, Mycobacterium
QFICGGVFETGTKTEYL

SEQ ID NO: 324345 - protein, 23 aa, Mycobacterium
QFICSSIQAASRLGYQESAELCA

SEQ ID NO: 324346 - protein, 21 aa, Mycobacterium
QFIDYCVDLLLGTAAAYAPHR

SEQ ID NO: 324347 - protein, 30 aa, Mycobacterium
QFLARRTAIALTRWRVRMEVEPGRRQNLAV

SEQ ID NO: 324348 - protein, 31 aa, Mycobacterium
QFLARRTAMALTRWRVRMEVEPGRRQTLAVV

SEQ ID NO: 324349 - protein, 18 aa, Mycobacterium
QFLLFCFDSPTADLDTVR

SEQ ID NO: 324350 - protein, 32 aa, Mycobacterium
QFLRQQLRWKKSWLREAPRAMCAVRRKNPVMV

SEQ ID NO: 324351 - protein, 22 aa, Mycobacterium
QFLVALCFAELAARYPISGAIY

SEQ ID NO: 324352 - protein, 19 aa, Mycobacterium
QFMKDRAADMLSMSKDLDA

SEQ ID NO: 324353 - protein, 18 aa, Mycobacterium
QFMLRTAPFSHDSWLGNW

SEQ ID NO: 324354 - protein, 19 aa, Mycobacterium
QFPPMIAMLENSRSMILTM

SEQ ID NO: 324355 - protein, 33 aa, Mycobacterium
QFPVAGGVYPWARRLWGRKWAWMTGWVYMFCLL

SEQ ID NO: 324356 - protein, 33 aa, Mycobacterium
QFPVAGGVYPWARRLWGRKWAWMTGWVYMFTLL

SEQ ID NO: 324357 - protein, 29 aa, Mycobacterium
QFPVAGGVYPWARRLWGRKYAWMTGWVYL

SEQ ID NO: 324358 - protein, 25 aa, Mycobacterium
QFPWLKARFRSIADPWNQVGVQTKF

SEQ ID NO: 324359 - protein, 40 aa, Mycobacterium
QFRPLRNYFYWEPHCADIPMCWAMRSLFDMTDQVDSMTDA

SEQ ID NO: 324360 - protein, 37 aa, Mycobacterium
QFRPVRNYFYWEPHCYNIPLCWSFRSLFDSMDGISTM

SEQ ID NO: 324361 - protein, 24 aa, Mycobacterium
QFSGSRWFLFPALAAISDDVLTRP

SEQ ID NO: 324362 - protein, 21 aa, Mycobacterium
QFSSSGLTEWIGTQAESLRGL

SEQ ID NO: 324363 - protein, 20 aa, Mycobacterium
QFTAWDVFLGYELPQPPDVG

SEQ ID NO: 324364 - protein, 22 aa, Mycobacterium
QFVCSSIQAGSRLGYQESAELC

SEQ ID NO: 324365 - protein, 20 aa, Mycobacterium
QFWDRFPKFVLGFIAASIIG

SEQ ID NO: 324366 - protein, 19 aa, Mycobacterium
QFYCLDFGGGVLATIRDLP

SEQ ID NO: 324367 - protein, 19 aa, Mycobacterium
QGADLCALLLEIYAVMGAG

SEQ ID NO: 324368 - protein, 19 aa, Mycobacterium
QGALLIGVFFWFSVVGGIT

SEQ ID NO: 324369 - protein, 25 aa, Mycobacterium
QGAPAEIWEVFTLQPGPGGAFTGEF

SEQ ID NO: 324370 - protein, 20 aa, Mycobacterium
QGAPQWLGGSTWLVVGMASV

SEQ ID NO: 324371 - protein, 20 aa, Mycobacterium
QGAVINWATLIALGIGDIVA

SEQ ID NO: 324372 - protein, 19 aa, Mycobacterium
QGAVIRIPAVASRSGDLPP

SEQ ID NO: 324373 - protein, 19 aa, Mycobacterium
QGDERRFTAPSSFDGSTQK

SEQ ID NO: 324374 - protein, 24 aa, Mycobacterium
QGDEVVAMLSLVPWGSNGVSLDVM

SEQ ID NO: 324375 - protein, 18 aa, Mycobacterium
QGDRAIACVATFDTQRTA

SEQ ID NO: 324376 - protein, 21 aa, Mycobacterium
QGDWAAAIRHRLRAVARQLEE

SEQ ID NO: 324377 - protein, 26 aa, Mycobacterium
QGEVGRIFVGNAFPFEGYTGGGHKQI

SEQ ID NO: 324378 - protein, 26 aa, Mycobacterium
QGEVGRIFVGNAFPFEGYTGGGKKQI

SEQ ID NO: 324379 - protein, 18 aa, Mycobacterium
QGEVHLVLLAAYVFLSIS

SEQ ID NO: 324380 - protein, 20 aa, Mycobacterium
QGEVRSMLLWHALEESEHRT

SEQ ID NO: 324381 - protein, 20 aa, Mycobacterium
QGFAVGGEWGGATLMAVEHA

SEQ ID NO: 324382 - protein, 23 aa, Mycobacterium
QGGARMGFGFGKSRAKLLNKDMP

SEQ ID NO: 324383 - protein, 23 aa, Mycobacterium
QGGARMGFGFGKSRAKMLNKDMP

SEQ ID NO: 324384 - protein, 24 aa, Mycobacterium
QGGDNRSALVLSLASWAVVIVLFW

SEQ ID NO: 324385 - protein, 21 aa, Mycobacterium
QGGEPRLNLPDAITGNPGDPR

SEQ ID NO: 324386 - protein, 22 aa, Mycobacterium
QGGEVPPELKATVEAISAGGGT

SEQ ID NO: 324387 - protein, 26 aa, Mycobacterium
QGGFRDGGAMPGTWRNVKIGDLSRFD

SEQ ID NO: 324388 - protein, 25 aa, Mycobacterium
QGGLSTVWLLSGFFFLIPVIVARKK

SEQ ID NO: 324389 - protein, 25 aa, Mycobacterium
QGGLSTVWLLSGFFFLIPVVVARKK

SEQ ID NO: 324390 - protein, 17 aa, Mycobacterium
QGGRYAAKIIKREVSGT

SEQ ID NO: 324391 - protein, 25 aa, Mycobacterium
QGHAAGWMPWIWVMIVAGVGFLAVF

SEQ ID NO: 324392 - protein, 19 aa, Mycobacterium
QGHEGFVWVGLREPSQAQM

SEQ ID NO: 324393 - protein, 18 aa, Mycobacterium
QGIRSEHVLPVIAVCITG

SEQ ID NO: 324394 - protein, 27 aa, Mycobacterium
QGLASLAILAYWVWNYGYRQGTTGSSI

SEQ ID NO: 324395 - protein, 17 aa, Mycobacterium
QGLFPARQHLLTYGKAA

SEQ ID NO: 324396 - protein, 25 aa, Mycobacterium
QGLLRRSVPLLARRLITLLPALVIL

SEQ ID NO: 324397 - protein, 18 aa, Mycobacterium
QGLREQRGWLWAGAGVIA

SEQ ID NO: 324398 - protein, 17 aa, Mycobacterium
QGLRVLAVAQRPWEHGT

SEQ ID NO: 324399 - protein, 17 aa, Mycobacterium
QGLSRAVGARGQMTLQE

SEQ ID NO: 324400 - protein, 23 aa, Mycobacterium
QGLVCSLISIPIGVMVAVYLVEY

SEQ ID NO: 324401 - protein, 20 aa, Mycobacterium
QGLVPLRLVLVGTAVGYGLS

SEQ ID NO: 324402 - protein, 35 aa, Mycobacterium
QGMPEAKAFFWLNIRRFCLLAGINIAVVVTDFYLL

SEQ ID NO: 324403 - protein, 17 aa, Mycobacterium
QGMTPVFVASRAGLPGV

SEQ ID NO: 324404 - protein, 21 aa, Mycobacterium
QGNGSWIACRFVVNNHDGHGD

SEQ ID NO: 324405 - protein, 20 aa, Mycobacterium
QGNPNRCQAIAWFSDGKLDF

SEQ ID NO: 324406 - protein, 25 aa, Mycobacterium
QGNSVRGARNYPCPDVPGKRAASPK

SEQ ID NO: 324407 - protein, 31 aa, Mycobacterium
QGPGPRGRNPWPIVAAVAIVLVLIVGGIGVW

SEQ ID NO: 324408 - protein, 26 aa, Mycobacterium
QGPGRSRAAVKFLLYNLFGGLIMLAA

SEQ ID NO: 324409 - protein, 22 aa, Mycobacterium
QGPPGLRRAVGRVVRLGPAEDQ

SEQ ID NO: 324410 - protein, 17 aa, Mycobacterium
QGQDLIGEFVAHSAAFH

SEQ ID NO: 324411 - protein, 17 aa, Mycobacterium
QGQELVGEFVARSAAFH

SEQ ID NO: 324412 - protein, 18 aa, Mycobacterium
QGQLWSFRIATIVCDLAM

SEQ ID NO: 324413 - protein, 20 aa, Mycobacterium
QGQNLIGEFVVRRGTFHAMM

SEQ ID NO: 324414 - protein, 26 aa, Mycobacterium
QGQVGRIFVGNAFPFEGYTGGGHKQI

SEQ ID NO: 324415 - protein, 29 aa, Mycobacterium
QGQWEACTALSLSPYRTWRAVVLPQVVRR

SEQ ID NO: 324416 - protein, 25 aa, Mycobacterium
QGREFLEQSWFVARVSLAPTLLVAI

SEQ ID NO: 324417 - protein, 27 aa, Mycobacterium
QGRLARYEIPTRITIVDAIPRTPSGKA

SEQ ID NO: 324418 - protein, 33 aa, Mycobacterium
QGSPIWAAIFVWELARPPIWMLVVFLVTAVGAH

SEQ ID NO: 324419 - protein, 34 aa, Mycobacterium
QGSPIWAAIFVWELARPPLWLFALFLLTATAAHA

SEQ ID NO: 324420 - protein, 36 aa, Mycobacterium
QGSPIWAAIFVWELARPPVWLFFLFLVTATGAHALK

SEQ ID NO: 324421 - protein, 22 aa, Mycobacterium
QGSTVQCTWVYDRGVNIDELRS

SEQ ID NO: 324422 - protein, 24 aa, Mycobacterium
QGTFPRLKSALIVEGTGAVVGGAS

SEQ ID NO: 324423 - protein, 17 aa, Mycobacterium
QGVAGAISVYIAGIHNG

SEQ ID NO: 324424 - protein, 26 aa, Mycobacterium
QGVAGPWRWNAKFLTEAVPEFYADAG

SEQ ID NO: 324425 - protein, 22 aa, Mycobacterium
QGVLWTFALVWLITDRGWSAAS

SEQ ID NO: 324426 - protein, 17 aa, Mycobacterium
QGVNLALATWVSAINFW

SEQ ID NO: 324427 - protein, 18 aa, Mycobacterium
QGWLDYMERIGWDALHNR

SEQ ID NO: 324428 - protein, 19 aa, Mycobacterium
QHAEGAYDFVALGSGSVIG

SEQ ID NO: 324429 - protein, 25 aa, Mycobacterium
QHAPAAWLLDMGMLAVLSVGYGALV

SEQ ID NO: 324430 - protein, 23 aa, Mycobacterium
QHGRRVALALSFGLRTALALVLI

SEQ ID NO: 324431 - protein, 18 aa, Mycobacterium
QHHLLEWLPIKTRNDPLF

SEQ ID NO: 324432 - protein, 21 aa, Mycobacterium
QHILGLDLNWIAPVFGVIILL

SEQ ID NO: 324433 - protein, 17 aa, Mycobacterium
QHILHRIAPVAAGALAL

SEQ ID NO: 324434 - protein, 18 aa, Mycobacterium
QHISPFVASLLRSANSFG

SEQ ID NO: 324435 - protein, 24 aa, Mycobacterium
QHPEPEWLFTLVGGPRMWERRQAD

SEQ ID NO: 324436 - protein, 25 aa, Mycobacterium
QHPKMPLVPLIDGWESVAEMEAALG

SEQ ID NO: 324437 - protein, 27 aa, Mycobacterium
QHPRLPRLDALKILSLDATDDDEFRAR

SEQ ID NO: 324438 - protein, 17 aa, Mycobacterium
QHPRLPRRDALKVLPAE

SEQ ID NO: 324439 - protein, 21 aa, Mycobacterium
QHRATLICFGATLAAVVSTLL

SEQ ID NO: 324440 - protein, 18 aa, Mycobacterium
QHRRWAAAVTLSLVLAWF

SEQ ID NO: 324441 - protein, 25 aa, Mycobacterium
QHRRWRDVRPALRLRCASKPRRADH

SEQ ID NO: 324442 - protein, 27 aa, Mycobacterium
QHSVMARPWFKSRWTRLVPATVERSTY

SEQ ID NO: 324443 - protein, 25 aa, Mycobacterium
QHTAWGVGVALAFVTLPFVVRAVQP

SEQ ID NO: 324444 - protein, 17 aa, Mycobacterium
QHTGALLVGRLVVGVGV

SEQ ID NO: 324445 - protein, 24 aa, Mycobacterium
QHTSQFIWWLGVLYILYTFLPLLV

SEQ ID NO: 324446 - protein, 17 aa, Mycobacterium
QHVLRAVSDVVIEVEAC

SEQ ID NO: 324447 - protein, 22 aa, Mycobacterium
QHYGVPAGDLWNPDVLVSHFGS

SEQ ID NO: 324448 - protein, 24 aa, Mycobacterium
QIAAFKLIMLALWWGAATSKLNHH

SEQ ID NO: 324449 - protein, 25 aa, Mycobacterium
QIAAYKLIMLLLWWGAATSKLNHHF

SEQ ID NO: 324450 - protein, 17 aa, Mycobacterium
QIADLVPGGGWRGAAAQ

SEQ ID NO: 324451 - protein, 17 aa, Mycobacterium
QIAGLGPEAGWQGSAAR

SEQ ID NO: 324452 - protein, 18 aa, Mycobacterium
QIAKSVLIFLGIPLLAGY

SEQ ID NO: 324453 - protein, 34 aa, Mycobacterium
QIASALCRHYWPLALFAAALSRRSRQVLVVAAIV

SEQ ID NO: 324454 - protein, 18 aa, Mycobacterium
QIATLIPGGSWRGSAAQA

SEQ ID NO: 324455 - protein, 17 aa, Mycobacterium
QIAWFVPAHWGFAATAS

SEQ ID NO: 324456 - protein, 20 aa, Mycobacterium
QICSMVLKIVQPVDSLIAGT

SEQ ID NO: 324457 - protein, 26 aa, Mycobacterium
QIELPPGYLPLRIPIEVNFTQRVAVD

SEQ ID NO: 324458 - protein, 25 aa, Mycobacterium
QIEMLGHEAFVWVGLREPDQAEMQE

SEQ ID NO: 324459 - protein, 24 aa, Mycobacterium
QIGGMTCASCAARIERKLNKLDGV

SEQ ID NO: 324460 - protein, 20 aa, Mycobacterium
QIGTRVELRLGDPADSEVDR

SEQ ID NO: 324461 - protein, 17 aa, Mycobacterium
QIHHWAALMFAAAIMVH

SEQ ID NO: 324462 - protein, 22 aa, Mycobacterium
QIIARTDARWVYGDVKETVRRL

SEQ ID NO: 324463 - protein, 17 aa, Mycobacterium
QILPKVMTTFGLTAAYV

SEQ ID NO: 324464 - protein, 17 aa, Mycobacterium
QIMESRGGVIFAAVCAA

SEQ ID NO: 324465 - protein, 17 aa, Mycobacterium
QIMPLLVVSIMSQLVFS

SEQ ID NO: 324466 - protein, 18 aa, Mycobacterium
QIMPLLVVSIMSQLVFSS

SEQ ID NO: 324467 - protein, 18 aa, Mycobacterium
QIPAAPRPTAPQVVISVV

SEQ ID NO: 324468 - protein, 22 aa, Mycobacterium
QIPDAAVIFAQLPGLPEFSLPT

SEQ ID NO: 324469 - protein, 23 aa, Mycobacterium
QIPEINTYLSLVVIIGILTIVTV

SEQ ID NO: 324470 - protein, 17 aa, Mycobacterium
QIPFWTFLRNSVIITSV

SEQ ID NO: 324471 - protein, 19 aa, Mycobacterium
QIPGGWLVDRVRPRVLYPV

SEQ ID NO: 324472 - protein, 18 aa, Mycobacterium
QIPLKERREHLLVEHHLS

SEQ ID NO: 324473 - protein, 25 aa, Mycobacterium
QIRDLTAFFAWTAWAAAAERPGHKY

SEQ ID NO: 324474 - protein, 25 aa, Mycobacterium
QIRELTGFFAWTAWAAAAERPGHRY

SEQ ID NO: 324475 - protein, 23 aa, Mycobacterium
QISETLFILAIPFFLRRFGIKTV

SEQ ID NO: 324476 - protein, 18 aa, Mycobacterium
QISQPWVDAAFKKRGIDP

SEQ ID NO: 324477 - protein, 20 aa, Mycobacterium
QITHDFWPAPELVMDTANSI

SEQ ID NO: 324478 - protein, 18 aa, Mycobacterium
QIVFWIAFDGFFFGLTYG

SEQ ID NO: 324479 - protein, 18 aa, Mycobacterium
QKAIKLLDDYTMSLGESV

SEQ ID NO: 324480 - protein, 22 aa, Mycobacterium
QKAKLADPVFIAAQARERLGFV

SEQ ID NO: 324481 - protein, 26 aa, Mycobacterium
QKALMWAAAVLGIFAIIIAALILLQA

SEQ ID NO: 324482 - protein, 19 aa, Mycobacterium
QKFGSTMGYELDIHSDMAY

SEQ ID NO: 324483 - protein, 24 aa, Mycobacterium
QKGSRFGIIGALFLLPLVTAPVLV

SEQ ID NO: 324484 - protein, 22 aa, Mycobacterium
QKLDLAESLLLTAYQPLTAAAA

SEQ ID NO: 324485 - protein, 23 aa, Mycobacterium
QKLFGWWGGSGVTAFKNSLSDVG

SEQ ID NO: 324486 - protein, 23 aa, Mycobacterium
QKLFGWWGGSGVTGFKNSLSDVG

SEQ ID NO: 324487 - protein, 24 aa, Mycobacterium
QKLFGWWGGSGVTGFRNSLSDVGY

SEQ ID NO: 324488 - protein, 19 aa, Mycobacterium
QKLGGGVAWAAGEVPLVIV

SEQ ID NO: 324489 - protein, 17 aa, Mycobacterium
QKLMTFVGMVILAGAVL

SEQ ID NO: 324490 - protein, 20 aa, Mycobacterium
QKLVRYFGIHGGASTAIYTV

SEQ ID NO: 324491 - protein, 24 aa, Mycobacterium
QKQRWARDLTRSMLLAPMFITPIA

SEQ ID NO: 324492 - protein, 22 aa, Mycobacterium
QKRALAILTMVALLFGAYFLRD

SEQ ID NO: 324493 - protein, 20 aa, Mycobacterium
QKRLEKMGVEIQLNAMVTDV

SEQ ID NO: 324494 - protein, 29 aa, Mycobacterium
QKTWKRVAVLFAGPAMNFIIGLVLIYGIA

SEQ ID NO: 324495 - protein, 18 aa, Mycobacterium
QKVLEGTGFVVAPNRVMS

SEQ ID NO: 324496 - protein, 20 aa, Mycobacterium
QLAASFLDWDLYKQAIPDLF

SEQ ID NO: 324497 - protein, 20 aa, Mycobacterium
QLADRKGIWQALLGSDAIYF

SEQ ID NO: 324498 - protein, 23 aa, Mycobacterium
QLAEIWTRLIGMIGSGPAPGGPT

SEQ ID NO: 324499 - protein, 20 aa, Mycobacterium
QLAELLSGWRQCGGSTVTLT

SEQ ID NO: 324500 - protein, 23 aa, Mycobacterium
QLAETVFHGFPFGLFFIALVTAL

SEQ ID NO: 324501 - protein, 20 aa, Mycobacterium
QLAFAKLRAIEHNRYVVVAA

SEQ ID NO: 324502 - protein, 19 aa, Mycobacterium
QLAGEGWLGPASTAMAAAV

SEQ ID NO: 324503 - protein, 24 aa, Mycobacterium
QLAGGPAWLYWTLYLACYAAGGWE

SEQ ID NO: 324504 - protein, 25 aa, Mycobacterium
QLAGMDLPTVWALTRGAGQTVAVID

SEQ ID NO: 324505 - protein, 19 aa, Mycobacterium
QLALMCVTAMATVRLRSRD

SEQ ID NO: 324506 - protein, 23 aa, Mycobacterium
QLDRVRMLLLTNCTFDGVVYNPL

SEQ ID NO: 324507 - protein, 21 aa, Mycobacterium
QLDSLVCALTLAAVAAAVTEG

SEQ ID NO: 324508 - protein, 24 aa, Mycobacterium
QLDSYRLALLVPLALGVIGVAVAL

SEQ ID NO: 324509 - protein, 18 aa, Mycobacterium
QLDVPALWSPRSRDEELR

SEQ ID NO: 324510 - protein, 23 aa, Mycobacterium
QLEASCYNPAFGGQPRVFINEAR

SEQ ID NO: 324511 - protein, 28 aa, Mycobacterium
QLERRAARARKQRILTIAGSVVAVLVIG

SEQ ID NO: 324512 - protein, 29 aa, Mycobacterium
QLEVGLEYEAWFLAAAVRRGWVVAVTDYP

SEQ ID NO: 324513 - protein, 25 aa, Mycobacterium
QLFAGIRPSFPVLAASLANLGRVGV

SEQ ID NO: 324514 - protein, 20 aa, Mycobacterium
QLFGHIPYRIDIDVYQMGAR

SEQ ID NO: 324515 - protein, 19 aa, Mycobacterium
QLFPGPWALVPVGATVLVI

SEQ ID NO: 324516 - protein, 38 aa, Mycobacterium
QLFPRLSYTLDGWVAGWRRIGAQARFYARTLGAIRDAL

SEQ ID NO: 324517 - protein, 24 aa, Mycobacterium
QLFQELFDYLWGFRTFDTSKGPGF

SEQ ID NO: 324518 - protein, 24 aa, Mycobacterium
QLFRELVLYLPWVAQGELWRTVTT

SEQ ID NO: 324519 - protein, 18 aa, Mycobacterium
QLFRFGRLLDSQSQLSRL

SEQ ID NO: 324520 - protein, 17 aa, Mycobacterium
QLFRFGRVLDAEPRLSA

SEQ ID NO: 324521 - protein, 27 aa, Mycobacterium
QLGEDYLRLAALGSYGAFFNIYFCTVT

SEQ ID NO: 324522 - protein, 27 aa, Mycobacterium
QLGIAWRGGLLAGRRPVLLAAGSVVAL

SEQ ID NO: 324523 - protein, 28 aa, Mycobacterium
QLGIAWRGGLLTGRRPWLLAGASAAGLA

SEQ ID NO: 324524 - protein, 23 aa, Mycobacterium
QLGITICSILLGRVGEPAVAHLL

SEQ ID NO: 324525 - protein, 28 aa, Mycobacterium
QLGLALRLAAVVVCLIGAIPLLNAVFPD

SEQ ID NO: 324526 - protein, 21 aa, Mycobacterium
QLGPVPLKLRESPGLMILGRQ

SEQ ID NO: 324527 - protein, 23 aa, Mycobacterium
QLGRLRSPLGLDLNARTPEETAI

SEQ ID NO: 324528 - protein, 21 aa, Mycobacterium
QLGTRIELRLGDPADSEVDRR

SEQ ID NO: 324529 - protein, 21 aa, Mycobacterium
QLGTRIELRLGDPAESEMDRR

SEQ ID NO: 324530 - protein, 18 aa, Mycobacterium
QLHALIGMVLFTLLPFTR

SEQ ID NO: 324531 - protein, 24 aa, Mycobacterium
QLHLRVLLICGGFVVGTFLVGSWM

SEQ ID NO: 324532 - protein, 26 aa, Mycobacterium
QLHPADRLHWSGVRMWRGASDVGPFL

SEQ ID NO: 324533 - protein, 19 aa, Mycobacterium
QLHPVYNLTSARLVLGNPA

SEQ ID NO: 324534 - protein, 17 aa, Mycobacterium
QLIAFARAFLADPAVLI

SEQ ID NO: 324535 - protein, 27 aa, Mycobacterium
QLIEVIGEGAMGKVYRARDTKMRREVA

SEQ ID NO: 324536 - protein, 17 aa, Mycobacterium
QLIMFGTLTVLSLLVLG

SEQ ID NO: 324537 - protein, 24 aa, Mycobacterium
QLISLLNDMAWFFFIAPVGTIVVA

SEQ ID NO: 324538 - protein, 17 aa, Mycobacterium
QLITGVWTWQIISLNAL

SEQ ID NO: 324539 - protein, 32 aa, Mycobacterium
QLITLVGLLMLLKAVAYWFDRYELLSHTRGGK

SEQ ID NO: 324540 - protein, 26 aa, Mycobacterium
QLIVLLCGGLVGPIFLVVYFVMGLDS

SEQ ID NO: 324541 - protein, 18 aa, Mycobacterium
QLIVLRLVIGAAIGADYP

SEQ ID NO: 324542 - protein, 21 aa, Mycobacterium
QLKHANWSWALLGLAVSALTY

SEQ ID NO: 324543 - protein, 24 aa, Mycobacterium
QLKRERDAVELDLRANVGAMSATL

SEQ ID NO: 324544 - protein, 28 aa, Mycobacterium
QLLADEGHHLVATRLCWSDQDRAEDLRR

SEQ ID NO: 324545 - protein, 18 aa, Mycobacterium
QLLEIFPPSIAIAEEARD

SEQ ID NO: 324546 - protein, 18 aa, Mycobacterium
QLLEVGRAYGRRGAALVT

SEQ ID NO: 324547 - protein, 19 aa, Mycobacterium
QLLGCTPLGPFGWAQGLGA

SEQ ID NO: 324548 - protein, 25 aa, Mycobacterium
QLLGPGPKWWGVTLLVIGAFSAMYG

SEQ ID NO: 324549 - protein, 26 aa, Mycobacterium
QLLGPGPRWWGLALMVAGGVSALYGV

SEQ ID NO: 324550 - protein, 19 aa, Mycobacterium
QLLKWLSAVVIVAATAVAL

SEQ ID NO: 324551 - protein, 19 aa, Mycobacterium
QLLLCVFLTCIASVLIEGR

SEQ ID NO: 324552 - protein, 23 aa, Mycobacterium
QLLPRSGQGPSLKDGDVIPSSRT

SEQ ID NO: 324553 - protein, 19 aa, Mycobacterium
QLLRRLDLRPQTSARNMLN

SEQ ID NO: 324554 - protein, 25 aa, Mycobacterium
QLLVEALETMAGLATSQRLADVVIA

SEQ ID NO: 324555 - protein, 24 aa, Mycobacterium
QLLVLLCGGLVGPIFLIVYFALGV

SEQ ID NO: 324556 - protein, 24 aa, Mycobacterium
QLLVLLCGGLVGPIFLIVYFTLGL

SEQ ID NO: 324557 - protein, 23 aa, Mycobacterium
QLMTIPGIRMVQSASRPAGSVPD

SEQ ID NO: 324558 - protein, 17 aa, Mycobacterium
QLNGILLSADAVNVTMG

SEQ ID NO: 324559 - protein, 24 aa, Mycobacterium
QLNNWPAVFPLGMYSAASFAVAGE

SEQ ID NO: 324560 - protein, 23 aa, Mycobacterium
QLNRMVDELDRIVATEPGPTTVS

SEQ ID NO: 324561 - protein, 25 aa, Mycobacterium
QLPACPPSLAAQVQFSDPWRDPNAR

SEQ ID NO: 324562 - protein, 18 aa, Mycobacterium
QLPATGGLYQFSNVTYRG

SEQ ID NO: 324563 - protein, 22 aa, Mycobacterium
QLPDIGAILAQMGTNLVAGLRS

SEQ ID NO: 324564 - protein, 17 aa, Mycobacterium
QLPGGNTFSGWGTAEHI

SEQ ID NO: 324565 - protein, 22 aa, Mycobacterium
QLPLPRTRPFPAVALPDTGPGD

SEQ ID NO: 324566 - protein, 18 aa, Mycobacterium
QLPMRPTVLEARDDIPAT

SEQ ID NO: 324567 - protein, 34 aa, Mycobacterium
QLPRVIPPSLLRRAMPYLMGILIVGMIVAMVATG

SEQ ID NO: 324568 - protein, 31 aa, Mycobacterium
QLPVLLFCIAFGLSMDYEVFLISRIREYWLA

SEQ ID NO: 324569 - protein, 21 aa, Mycobacterium
QLQLLGGGAWQLGPVEKEPAQ

SEQ ID NO: 324570 - protein, 24 aa, Mycobacterium
QLQRITWIVTWYLLGYIAAMPLLG

SEQ ID NO: 324571 - protein, 25 aa, Mycobacterium
QLRDSFFDWDMYRQAIPALFHTGLP

SEQ ID NO: 324572 - protein, 25 aa, Mycobacterium
QLRDSFFDWEMYRQAIPALFSTGLP

SEQ ID NO: 324573 - protein, 20 aa, Mycobacterium
QLRITDWFASRWRPGRSLVV

SEQ ID NO: 324574 - protein, 29 aa, Mycobacterium
QLRITRWFAAHWRVSRSLVVGAAILAIAF

SEQ ID NO: 324575 - protein, 21 aa, Mycobacterium
QLRITRWFSARWRPGRSVYIG

SEQ ID NO: 324576 - protein, 22 aa, Mycobacterium
QLRPRFGAGCTRGTLGADYLPT

SEQ ID NO: 324577 - protein, 19 aa, Mycobacterium
QLRRMKAVATGFLIGATVL

SEQ ID NO: 324578 - protein, 17 aa, Mycobacterium
QLRVFYAREEPWTPIVL

SEQ ID NO: 324579 - protein, 18 aa, Mycobacterium
QLRWWEWTLDNPLNKPFF

SEQ ID NO: 324580 - protein, 22 aa, Mycobacterium
QLSFARTGRWNKLFADGADIQR

SEQ ID NO: 324581 - protein, 25 aa, Mycobacterium
QLSGESQWSLSLGVGQMLVAVLAGA

SEQ ID NO: 324582 - protein, 18 aa, Mycobacterium
QLSMCFALLITGVGSLIH

SEQ ID NO: 324583 - protein, 19 aa, Mycobacterium
QLSTIARRQIRLVISDRGY

SEQ ID NO: 324584 - protein, 18 aa, Mycobacterium
QLSVCFALLITGVGSLIH

SEQ ID NO: 324585 - protein, 19 aa, Mycobacterium
QLSVCFVLLISGVGSLIHI

SEQ ID NO: 324586 - protein, 23 aa, Mycobacterium
QLTFSVLAGYAFARLDFPGRDAL

SEQ ID NO: 324587 - protein, 18 aa, Mycobacterium
QLTGLRVVRAFAREPFER

SEQ ID NO: 324588 - protein, 24 aa, Mycobacterium
QLTPEGFRFPALVGTHHGRWDDVV

SEQ ID NO: 324589 - protein, 17 aa, Mycobacterium
QLTRIAFQISIGLSHGS

SEQ ID NO: 324590 - protein, 17 aa, Mycobacterium
QLVAFARAFLADPAVLI

SEQ ID NO: 324591 - protein, 17 aa, Mycobacterium
QLVGLVFAVCGVAGFAL

SEQ ID NO: 324592 - protein, 18 aa, Mycobacterium
QLVGLVFAVIGAVGFAMA

SEQ ID NO: 324593 - protein, 20 aa, Mycobacterium
QLVLCGGMVPVTDRIGLDQM

SEQ ID NO: 324594 - protein, 18 aa, Mycobacterium
QLVMFAVLTAITAVALGW

SEQ ID NO: 324595 - protein, 25 aa, Mycobacterium
QLVVLLCGGLVGPIFLIVYFTLGLG

SEQ ID NO: 324596 - protein, 18 aa, Mycobacterium
QLVVRSGVVHGARLRFID

SEQ ID NO: 324597 - protein, 26 aa, Mycobacterium
QLVYLSGWKPSFVLPGPGTVAANLWQ

SEQ ID NO: 324598 - protein, 37 aa, Mycobacterium
QLVYRFTATRAGVWLYHCATMPMSVHIANGMFGAVVI

SEQ ID NO: 324599 - protein, 31 aa, Mycobacterium
QLWPAFWTTLRLTFFSAVGALVWGTLLAEFR

SEQ ID NO: 324600 - protein, 17 aa, Mycobacterium
QLWSRAGGFHRLLSTDS

SEQ ID NO: 324601 - protein, 18 aa, Mycobacterium
QLYETSCITCHGANLQGV

SEQ ID NO: 324602 - protein, 27 aa, Mycobacterium
QMAVALCFMELAAKYPVAGSVYNWSKK

SEQ ID NO: 324603 - protein, 17 aa, Mycobacterium
QMAVLAVLVAWNLTLIL

SEQ ID NO: 324604 - protein, 23 aa, Mycobacterium
QMAVSAWCFTVAVFIGMIATARV

SEQ ID NO: 324605 - protein, 17 aa, Mycobacterium
QMGPRMVYTETKLNSSF

SEQ ID NO: 324606 - protein, 17 aa, Mycobacterium
QMIRALPHLGLIPLFIV

SEQ ID NO: 324607 - protein, 18 aa, Mycobacterium
QMKSYRIAGEQAAKAERE

SEQ ID NO: 324608 - protein, 18 aa, Mycobacterium
QMLMGIAAIVAFALGPGL

SEQ ID NO: 324609 - protein, 20 aa, Mycobacterium
QMLPAWIVGGTGSWRLALGV

SEQ ID NO: 324610 - protein, 23 aa, Mycobacterium
QMLRPQLEASRDWQTVEELARRA

SEQ ID NO: 324611 - protein, 23 aa, Mycobacterium
QMLRTIPFIAMVPLFVVWFGIGE

SEQ ID NO: 324612 - protein, 27 aa, Mycobacterium
QMLSDPRFKPYLKMMFSEDGTTTRMIV

SEQ ID NO: 324613 - protein, 23 aa, Mycobacterium
QMQVGSLIAFLAYFMQILMAVLM

SEQ ID NO: 324614 - protein, 24 aa, Mycobacterium
QMQVGSLIAFLSYFLLILMSVLIL

SEQ ID NO: 324615 - protein, 27 aa, Mycobacterium
QMRDWAESVGPWFPLAFLAAHVVATVV

SEQ ID NO: 324616 - protein, 24 aa, Mycobacterium
QMRLRAGSPILFYPAGALGMTVLA

SEQ ID NO: 324617 - protein, 20 aa, Mycobacterium
QMRVDARLPLPALPPARSGA

SEQ ID NO: 324618 - protein, 24 aa, Mycobacterium
QMSPFWRQMFLTIGVLVAVFGMRL

SEQ ID NO: 324619 - protein, 18 aa, Mycobacterium
QMTLQEILVTRGAEAPEA

SEQ ID NO: 324620 - protein, 19 aa, Mycobacterium
QMVARFAVMFAAGALLNQY

SEQ ID NO: 324621 - protein, 23 aa, Mycobacterium
QMVVRLAIVVTVFALLAALTGKL

SEQ ID NO: 324622 - protein, 23 aa, Mycobacterium
QMVYARLAMRYLQARAEEDALSA

SEQ ID NO: 324623 - protein, 25 aa, Mycobacterium
QNAESCKAILAAGGFTNTVVVEVDN

SEQ ID NO: 324624 - protein, 19 aa, Mycobacterium
QNCLRHVHIGFERTLHQDV

SEQ ID NO: 324625 - protein, 24 aa, Mycobacterium
QNDFGVTVIFGFPGIVLASIFVTL

SEQ ID NO: 324626 - protein, 25 aa, Mycobacterium
QNDVTRWPELRAVLTDAFGRHDRDH

SEQ ID NO: 324627 - protein, 26 aa, Mycobacterium
QNGLRSASFVFRHRTGNAVIFLLLVV

SEQ ID NO: 324628 - protein, 23 aa, Mycobacterium
QNPLFKSAMPYFFSGDGKVTRMV

SEQ ID NO: 324629 - protein, 24 aa, Mycobacterium
QNQKAAEAWIDYVYDRANYAKLVA

SEQ ID NO: 324630 - protein, 24 aa, Mycobacterium
QNSLLPRWLPDASDDRGWVAKVRA

SEQ ID NO: 324631 - protein, 20 aa, Mycobacterium
QNSLLPRWLPDGSPDRGWAA

SEQ ID NO: 324632 - protein, 25 aa, Mycobacterium
QNSYCTEVGVLPGTDFKLQPKYMEM

SEQ ID NO: 324633 - protein, 46 aa, Mycobacterium
QNSYCTEVGVLPGTDFRLQPKYMDMLNLQEAWQFGRGAGIKVAVID

SEQ ID NO: 324634 - protein, 17 aa, Mycobacterium
QNWDLFRAPTFVGLQNF

SEQ ID NO: 324635 - protein, 17 aa, Mycobacterium
QPAAQWRTLPDAPTARL

SEQ ID NO: 324636 - protein, 23 aa, Mycobacterium
QPAGPRGPAAWLQSDRNGAPPIG

SEQ ID NO: 324637 - protein, 17 aa, Mycobacterium
QPAHEWGPAIPPGPVYG

SEQ ID NO: 324638 - protein, 28 aa, Mycobacterium
QPAKKKRKWPAIVGGVIALMIVGSIFND

SEQ ID NO: 324639 - protein, 17 aa, Mycobacterium
QPALAWSEADDQSRAMP

SEQ ID NO: 324640 - protein, 17 aa, Mycobacterium
QPALWLLIFGQTFSRLH

SEQ ID NO: 324641 - protein, 20 aa, Mycobacterium
QPAMYRIVRELATVARQPMP

SEQ ID NO: 324642 - protein, 24 aa, Mycobacterium
QPAPEGASAWSFGPGREPVIMRCG

SEQ ID NO: 324643 - protein, 20 aa, Mycobacterium
QPAPWPYFSPPDHVVPPYGR

SEQ ID NO: 324644 - protein, 34 aa, Mycobacterium
QPARRRRRLSGRFRRPKWSTLAASLAVLVIIAAL

SEQ ID NO: 324645 - protein, 23 aa, Mycobacterium
QPASFQQWSWYRWTKSVMRHAVP

SEQ ID NO: 324646 - protein, 26 aa, Mycobacterium
QPATLRRFAKRFAAFNLDPRVLRPSY

SEQ ID NO: 324647 - protein, 23 aa, Mycobacterium
QPDLRISGPLSIPSFPTSEANVP

SEQ ID NO: 324648 - protein, 18 aa, Mycobacterium
QPDRSLRGLWTNTVLTDE

SEQ ID NO: 324649 - protein, 31 aa, Mycobacterium
QPDRTRFRPFLPRLKQLIVEVVAHTRMNKFR

SEQ ID NO: 324650 - protein, 20 aa, Mycobacterium
QPEGLTFGLLRYLNPGANLA

SEQ ID NO: 324651 - protein, 24 aa, Mycobacterium
QPELRRVMGPGLLLLFVVGDILGT

SEQ ID NO: 324652 - protein, 24 aa, Mycobacterium
QPEPENYLVWAILVTVLCCLPFGI

SEQ ID NO: 324653 - protein, 26 aa, Mycobacterium
QPERKPFPLLASIVTSIFVIGVAALA

SEQ ID NO: 324654 - protein, 21 aa, Mycobacterium
QPFEYKGRPGIRLHLNDEDNA

SEQ ID NO: 324655 - protein, 19 aa, Mycobacterium
QPFLAAGVLLVFYTATARY

SEQ ID NO: 324656 - protein, 21 aa, Mycobacterium
QPFLGRWLLLTAVMFALSAAT

SEQ ID NO: 324657 - protein, 25 aa, Mycobacterium
QPFWTPLRVVFVIALGFLILGWTSK

SEQ ID NO: 324658 - protein, 24 aa, Mycobacterium
QPGKKRPVGLIAGVGGGIALLLVV

SEQ ID NO: 324659 - protein, 20 aa, Mycobacterium
QPGKLPASLADYLRGLIQER

SEQ ID NO: 324660 - protein, 20 aa, Mycobacterium
QPGKMPASLADYLRGLIQER

SEQ ID NO: 324661 - protein, 21 aa, Mycobacterium
QPGMSPVRWTGKLVAAPLSAL

SEQ ID NO: 324662 - protein, 19 aa, Mycobacterium
QPIEDGRNILPPNKFPMIP

SEQ ID NO: 324663 - protein, 19 aa, Mycobacterium
QPIGFGMSVVRQIAHFLDA

SEQ ID NO: 324664 - protein, 17 aa, Mycobacterium
QPIPRFLAGQSFWRTPS

SEQ ID NO: 324665 - protein, 22 aa, Mycobacterium
QPIPRPSRHRPDIPTAFDEVIA

SEQ ID NO: 324666 - protein, 17 aa, Mycobacterium
QPLAGIPQPHGRRVSTR

SEQ ID NO: 324667 - protein, 17 aa, Mycobacterium
QPLIPPFLPRMIHRLAL

SEQ ID NO: 324668 - protein, 18 aa, Mycobacterium
QPLLAGLLTLAGATAPAQ

SEQ ID NO: 324669 - protein, 17 aa, Mycobacterium
QPLLAGLLTLSGATTPA

SEQ ID NO: 324670 - protein, 22 aa, Mycobacterium
QPLTFLDCLYFSAVSLSTTGYG

SEQ ID NO: 324671 - protein, 23 aa, Mycobacterium
QPMPGPLSWFFHRMPRPLHRIEV

SEQ ID NO: 324672 - protein, 17 aa, Mycobacterium
QPMRQGAFCPKVGTLPG

SEQ ID NO: 324673 - protein, 28 aa, Mycobacterium
QPNGPRGRGAAVWVLGGLAVLVVIVLTV

SEQ ID NO: 324674 - protein, 19 aa, Mycobacterium
QPPDPVLEEAFSRPPGGVD

SEQ ID NO: 324675 - protein, 28 aa, Mycobacterium
QPPEGSAAWWLVRLEWITILSVVTAGEM

SEQ ID NO: 324676 - protein, 23 aa, Mycobacterium
QPPGPREWLTWLLHSRVTAFLSH

SEQ ID NO: 324677 - protein, 17 aa, Mycobacterium
QPPHGIEVFVGGTPALE

SEQ ID NO: 324678 - protein, 18 aa, Mycobacterium
QPPLPVPLHHAAAATYRN

SEQ ID NO: 324679 - protein, 24 aa, Mycobacterium
QPPPAAFPIAWNLLYADIASTSAH

SEQ ID NO: 324680 - protein, 23 aa, Mycobacterium
QPPPDLWSAVTFITLALFLGIGT

SEQ ID NO: 324681 - protein, 21 aa, Mycobacterium
QPPRPPTMVVHNGRVNNYPPA

SEQ ID NO: 324682 - protein, 17 aa, Mycobacterium
QPQLARGAVILFSTNLV

SEQ ID NO: 324683 - protein, 17 aa, Mycobacterium
QPQPGWPAAQPGYAPEP

SEQ ID NO: 324684 - protein, 20 aa, Mycobacterium
QPRLAMAISTVISLLSVWAG

SEQ ID NO: 324685 - protein, 19 aa, Mycobacterium
QPRRPRSAVGLAVVATLFF

SEQ ID NO: 324686 - protein, 24 aa, Mycobacterium
QPRVRPKPPIPYPGDAHAHPDTRG

SEQ ID NO: 324687 - protein, 17 aa, Mycobacterium
QPSGFSVQGPWVGAAAP

SEQ ID NO: 324688 - protein, 28 aa, Mycobacterium
QPSRGMERAPGRFALLQALSAGAIGAGT

SEQ ID NO: 324689 - protein, 22 aa, Mycobacterium
QPSSFTMAGPWVGIAAPGENIV

SEQ ID NO: 324690 - protein, 24 aa, Mycobacterium
QPTALRPGIPKAFDAVIARGMAKK

SEQ ID NO: 324691 - protein, 21 aa, Mycobacterium
QPTDVSLRWGDVENELGKHRN

SEQ ID NO: 324692 - protein, 23 aa, Mycobacterium
QPTFLYELIWNLLVFAALIYLDR

SEQ ID NO: 324693 - protein, 27 aa, Mycobacterium
QPTIWEIGRPWYLAWAGLVYIVATLAT

SEQ ID NO: 324694 - protein, 25 aa, Mycobacterium
QPTQYGGFGARGYPPAGRPPPNQPY

SEQ ID NO: 324695 - protein, 22 aa, Mycobacterium
QPVAPRPSAWVLVPVWMDPLDR

SEQ ID NO: 324696 - protein, 17 aa, Mycobacterium
QPVAVDFEHHAHLLILG

SEQ ID NO: 324697 - protein, 27 aa, Mycobacterium
QPVENGRLVWIFACICGAVFALASAHS

SEQ ID NO: 324698 - protein, 31 aa, Mycobacterium
QPVIKRRGKYWWIRWAILIVLAIVLAVEIGF

SEQ ID NO: 324699 - protein, 19 aa, Mycobacterium
QPVLMDWAVGLAFPCQQPM

SEQ ID NO: 324700 - protein, 22 aa, Mycobacterium
QPVSRPSHRWVVVGAPQDGEVD

SEQ ID NO: 324701 - protein, 21 aa, Mycobacterium
QPVTPRPAAAPARLPQTTADG

SEQ ID NO: 324702 - protein, 22 aa, Mycobacterium
QPWFFWPTRPVWLYRLTQGLHV

SEQ ID NO: 324703 - protein, 18 aa, Mycobacterium
QPWRDLRKQLRKQQVTPD

SEQ ID NO: 324704 - protein, 19 aa, Mycobacterium
QPYFLGNPLYAFLLMVLFQ

SEQ ID NO: 324705 - protein, 21 aa, Mycobacterium
QQADSHLLPFIAHDRAGFGGA

SEQ ID NO: 324706 - protein, 24 aa, Mycobacterium
QQAGSFPFVCSMNMISGTLVVTPN

SEQ ID NO: 324707 - protein, 18 aa, Mycobacterium
QQALECNDPPPASDPAAP

SEQ ID NO: 324708 - protein, 23 aa, Mycobacterium
QQCVDRLRPGPVMVDDKKIAWPA

SEQ ID NO: 324709 - protein, 17 aa, Mycobacterium
QQDWAVRTYCLRTGDRC

SEQ ID NO: 324710 - protein, 18 aa, Mycobacterium
QQFDFSQPILDAGMQIIV

SEQ ID NO: 324711 - protein, 19 aa, Mycobacterium
QQFPGPWALVPVGATVLII

SEQ ID NO: 324712 - protein, 22 aa, Mycobacterium
QQFPRAANLVYYLGAGAPGSQA

SEQ ID NO: 324713 - protein, 17 aa, Mycobacterium
QQFSRVRVFAFIDTTDE

SEQ ID NO: 324714 - protein, 19 aa, Mycobacterium
QQGEQGWQQPAYGQGQQYP

SEQ ID NO: 324715 - protein, 19 aa, Mycobacterium
QQHGIDWRAVYAGRSRDYM

SEQ ID NO: 324716 - protein, 20 aa, Mycobacterium
QQHVRLWVVYVKDFEGTDPT

SEQ ID NO: 324717 - protein, 19 aa, Mycobacterium
QQLDGRSALGYVRSRATPR

SEQ ID NO: 324718 - protein, 18 aa, Mycobacterium
QQLFLSSLLRSMISHNTF

SEQ ID NO: 324719 - protein, 19 aa, Mycobacterium
QQLIRQLRSGLGAESVEKA

SEQ ID NO: 324720 - protein, 19 aa, Mycobacterium
QQLIRQLRTGLGAEAVNKA

SEQ ID NO: 324721 - protein, 17 aa, Mycobacterium
QQLLSFFALLLLTAAGM

SEQ ID NO: 324722 - protein, 17 aa, Mycobacterium
QQLRLTLKKGNNDTDNS

SEQ ID NO: 324723 - protein, 24 aa, Mycobacterium
QQLRSVLRYDVPASIVVFLIALPL

SEQ ID NO: 324724 - protein, 19 aa, Mycobacterium
QQLTLPFRAPKTMFNVRIG

SEQ ID NO: 324725 - protein, 25 aa, Mycobacterium
QQPAKKRPVGLIAGVGGAIALLLIA

SEQ ID NO: 324726 - protein, 24 aa, Mycobacterium
QQPEVANPALWILAGAVAGLIAIA

SEQ ID NO: 324727 - protein, 18 aa, Mycobacterium
QQPNPCVYTPGGPPPAVY

SEQ ID NO: 324728 - protein, 24 aa, Mycobacterium
QQRGLDLPLVWQLSRGAGQTVAVI

SEQ ID NO: 324729 - protein, 20 aa, Mycobacterium
QQRLIRLAMDLGRARQHTQP

SEQ ID NO: 324730 - protein, 17 aa, Mycobacterium
QQRSRWTSRQLAPAAML

SEQ ID NO: 324731 - protein, 17 aa, Mycobacterium
QQSRLFLQAGRQGALNL

SEQ ID NO: 324732 - protein, 24 aa, Mycobacterium
QQVPDCHGLSFGDAVKKLQAAGFK

SEQ ID NO: 324733 - protein, 18 aa, Mycobacterium
QQVQQLIEQGDWQQAQAK

SEQ ID NO: 324734 - protein, 19 aa, Mycobacterium
QQVRTRPASQLLRPYGPRS

SEQ ID NO: 324735 - protein, 20 aa, Mycobacterium
QRAAAQWSHPEPAALAAVPG

SEQ ID NO: 324736 - protein, 23 aa, Mycobacterium
QRADGTLEFLGRMDRQLKLRGVR

SEQ ID NO: 324737 - protein, 25 aa, Mycobacterium
QRADRFDALIGRRGLWAVVGQRFVP

SEQ ID NO: 324738 - protein, 22 aa, Mycobacterium
QRAEAVVSRLVFARMTPEHKIE

SEQ ID NO: 324739 - protein, 26 aa, Mycobacterium
QRAELIANTVAREFVAYTAAIETATG

SEQ ID NO: 324740 - protein, 19 aa, Mycobacterium
QRAFGRPSGVSGSFLGAEK

SEQ ID NO: 324741 - protein, 19 aa, Mycobacterium
QRAFGRPSGVSGSFQGADK

SEQ ID NO: 324742 - protein, 26 aa, Mycobacterium
QRAKALAQEVARVFVEAGLGAVAMPE

SEQ ID NO: 324743 - protein, 23 aa, Mycobacterium
QRAKGPLVFDLGICLVLITLPTL

SEQ ID NO: 324744 - protein, 17 aa, Mycobacterium
QRAVDTFLILPLTAPEV

SEQ ID NO: 324745 - protein, 22 aa, Mycobacterium
QRAWLSGLALVLTLVVGLAYLA

SEQ ID NO: 324746 - protein, 27 aa, Mycobacterium
QRDDYQWRIDFLRTRGLLPVLRYIIAG

SEQ ID NO: 324747 - protein, 27 aa, Mycobacterium
QRDGLTLGQALIFWASGRDQLLPRDLV

SEQ ID NO: 324748 - protein, 19 aa, Mycobacterium
QRDPRWWGPDADKYEPIRF

SEQ ID NO: 324749 - protein, 29 aa, Mycobacterium
QREGPIAWPEAMRIGVKLCGALETAHLTG

SEQ ID NO: 324750 - protein, 26 aa, Mycobacterium
QREIAMRMVAVFAHRLYGAITTAHFM

SEQ ID NO: 324751 - protein, 35 aa, Mycobacterium
QRERKGRFWISLHAASTRRALLLTALGGLLIAGLI

SEQ ID NO: 324752 - protein, 23 aa, Mycobacterium
QREVLPLAVPVILASALFGGGLL

SEQ ID NO: 324753 - protein, 20 aa, Mycobacterium
QRFGWDVTIVRVLAVASILL

SEQ ID NO: 324754 - protein, 21 aa, Mycobacterium
QRFLTRRMEHALVRADARMLD

SEQ ID NO: 324755 - protein, 25 aa, Mycobacterium
QRFMLSLYVPLVMRILCSAILVPPR

SEQ ID NO: 324756 - protein, 23 aa, Mycobacterium
QRFQELSARAAAIQDLMVVMLAA

SEQ ID NO: 324757 - protein, 25 aa, Mycobacterium
QRFRREAHAAARLSNPHLIPIHTYG

SEQ ID NO: 324758 - protein, 24 aa, Mycobacterium
QRFRREAHVAARLTSPHLIPIHTY

SEQ ID NO: 324759 - protein, 21 aa, Mycobacterium
QRFRVRAADGTYHWVEGHGKP

SEQ ID NO: 324760 - protein, 20 aa, Mycobacterium
QRFSAVSSRFQVPLFSTIAA

SEQ ID NO: 324761 - protein, 21 aa, Mycobacterium
QRFVTVWAGFRGAVSLAAAVA

SEQ ID NO: 324762 - protein, 25 aa, Mycobacterium
QRFWRITIPMLRPTTFFVLVTGIVS

SEQ ID NO: 324763 - protein, 18 aa, Mycobacterium
QRFWRITLPMLRPTTFFV

SEQ ID NO: 324764 - protein, 17 aa, Mycobacterium
QRFWSTYLLVAGLVLIV

SEQ ID NO: 324765 - protein, 23 aa, Mycobacterium
QRGAACTLLALFVVQFPIATTHG

SEQ ID NO: 324766 - protein, 25 aa, Mycobacterium
QRGDPAVIVAHAFSNEGFVAYAVAK

SEQ ID NO: 324767 - protein, 27 aa, Mycobacterium
QRGEALADDVARSFADAGLDSVLSPEL

SEQ ID NO: 324768 - protein, 18 aa, Mycobacterium
QRGLDIPAASGFTSEPAL

SEQ ID NO: 324769 - protein, 19 aa, Mycobacterium
QRGLFAWMELSTVLRAVAI

SEQ ID NO: 324770 - protein, 18 aa, Mycobacterium
QRGQIMVCSYVLRTAGQY

SEQ ID NO: 324771 - protein, 22 aa, Mycobacterium
QRGQSVPFTLSYPLRAGDRPSL

SEQ ID NO: 324772 - protein, 22 aa, Mycobacterium
QRIDAAEAMAFVRQRRDENDGS

SEQ ID NO: 324773 - protein, 18 aa, Mycobacterium
QRIGPVWLTAVGYAVACQ

SEQ ID NO: 324774 - protein, 19 aa, Mycobacterium
QRIHWAWVVAAVSFVAILG

SEQ ID NO: 324775 - protein, 17 aa, Mycobacterium
QRISPILFLAFAVGDFI

SEQ ID NO: 324776 - protein, 19 aa, Mycobacterium
QRISSVPLFTTVTSVQQAI

SEQ ID NO: 324777 - protein, 17 aa, Mycobacterium
QRLAALAAQQGRELDVS

SEQ ID NO: 324778 - protein, 17 aa, Mycobacterium
QRLAIARAVIRKPVIYL

SEQ ID NO: 324779 - protein, 18 aa, Mycobacterium
QRLDVVFVLGPRTRDLAV

SEQ ID NO: 324780 - protein, 21 aa, Mycobacterium
QRLFSAEGFTSVAHVFVMEWM

SEQ ID NO: 324781 - protein, 23 aa, Mycobacterium
QRLGDWVPVTAFVVLIGAAVLRW

SEQ ID NO: 324782 - protein, 23 aa, Mycobacterium
QRLGERRIYIGGMVIVAVSTGAC

SEQ ID NO: 324783 - protein, 21 aa, Mycobacterium
QRLGERRVYTSGLIIVAVSTG

SEQ ID NO: 324784 - protein, 20 aa, Mycobacterium
QRLHGREVYAGTGVGLALVK

SEQ ID NO: 324785 - protein, 25 aa, Mycobacterium
QRLHGRLGPIGVVFMVVAAAAPLTV

SEQ ID NO: 324786 - protein, 27 aa, Mycobacterium
QRLHYGIGRPGRWLVYAGCIGAVEIAV

SEQ ID NO: 324787 - protein, 20 aa, Mycobacterium
QRLKAGQVLMSRNVTSEANT

SEQ ID NO: 324788 - protein, 22 aa, Mycobacterium
QRLKHVTMIPHRGGRICVRALR

SEQ ID NO: 324789 - protein, 24 aa, Mycobacterium
QRLKSWRRGLIFAMFVFAAVFTPG

SEQ ID NO: 324790 - protein, 19 aa, Mycobacterium
QRLLAGWATVLLLIALIAG

SEQ ID NO: 324791 - protein, 25 aa, Mycobacterium
QRLLPYRWIAVGVLVILAIVFTMVY

SEQ ID NO: 324792 - protein, 18 aa, Mycobacterium
QRLLRRFNSGIAVTLTVL

SEQ ID NO: 324793 - protein, 17 aa, Mycobacterium
QRLLSRRRFANALNGIA

SEQ ID NO: 324794 - protein, 22 aa, Mycobacterium
QRLMLEVSWEALEHAGIDPMSL

SEQ ID NO: 324795 - protein, 23 aa, Mycobacterium
QRLPAATPFRNFVSWLAARDTAA

SEQ ID NO: 324796 - protein, 43 aa, Mycobacterium
QRLPEIYRKLARVGSYGAWFPYYICGISFRASDLEGRTVVFPW

SEQ ID NO: 324797 - protein, 19 aa, Mycobacterium
QRLPTVLVLIALVTFALLF

SEQ ID NO: 324798 - protein, 27 aa, Mycobacterium
QRLPVASSYRRFVTWLIERDVDGARRA

SEQ ID NO: 324799 - protein, 22 aa, Mycobacterium
QRLSEERQMWVALANIGLSVLA

SEQ ID NO: 324800 - protein, 38 aa, Mycobacterium
QRLSEVIPRADLDFGDRLFCAAVPQLRHVAFAHDAVRA

SEQ ID NO: 324801 - protein, 27 aa, Mycobacterium
QRLSRRGALVRTPRAVEALGRVQTVCF

SEQ ID NO: 324802 - protein, 22 aa, Mycobacterium
QRLTAHGALVRAPRTIEALGRV

SEQ ID NO: 324803 - protein, 27 aa, Mycobacterium
QRLTAMVAALPRWCDIIPGAPEVALPQ

SEQ ID NO: 324804 - protein, 19 aa, Mycobacterium
QRLVLEITETVPIVDLVEG

SEQ ID NO: 324805 - protein, 26 aa, Mycobacterium
QRLVVPRFLALVLIAPILCTIVIASG

SEQ ID NO: 324806 - protein, 19 aa, Mycobacterium
QRLYSVGWLTRPWEDLLAE

SEQ ID NO: 324807 - protein, 19 aa, Mycobacterium
QRMILRARYPNIFRSAPAR

SEQ ID NO: 324808 - protein, 19 aa, Mycobacterium
QRMKARAIADWMAIGMVGA

SEQ ID NO: 324809 - protein, 29 aa, Mycobacterium
QRNAFLAPWRLALVPVVSWTIGSALFAVL

SEQ ID NO: 324810 - protein, 18 aa, Mycobacterium
QRNPGASGISEMPGVFAE

SEQ ID NO: 324811 - protein, 24 aa, Mycobacterium
QRNQIPQGRLAAIATVGGGASIPL

SEQ ID NO: 324812 - protein, 21 aa, Mycobacterium
QRPDAPWGKPRVVYLQHASDP

SEQ ID NO: 324813 - protein, 21 aa, Mycobacterium
QRPDEPWGRPRVVYLQHASDP

SEQ ID NO: 324814 - protein, 24 aa, Mycobacterium
QRPDWSPTTSRSWAKKVLAATPGD

SEQ ID NO: 324815 - protein, 20 aa, Mycobacterium
QRPFVGHVIRIFSLPIVLLW

SEQ ID NO: 324816 - protein, 37 aa, Mycobacterium
QRPHPYPRWLATVCWAGFSLGIAMMLGANWRTCAIAA

SEQ ID NO: 324817 - protein, 18 aa, Mycobacterium
QRPNVFSVDGPVTSGPVW

SEQ ID NO: 324818 - protein, 24 aa, Mycobacterium
QRPPRRLRLLLSVAAIVLALDIVT

SEQ ID NO: 324819 - protein, 26 aa, Mycobacterium
QRPSRFRHIPAMLLALSLVLFTVAMA

SEQ ID NO: 324820 - protein, 20 aa, Mycobacterium
QRQALRAGLSVRPMIVTLIG

SEQ ID NO: 324821 - protein, 26 aa, Mycobacterium
QRQKFFWNLLVDYWFRMEIDGWENIP

SEQ ID NO: 324822 - protein, 17 aa, Mycobacterium
QRQQHAWGEAMDAAARP

SEQ ID NO: 324823 - protein, 22 aa, Mycobacterium
QRQRLCIARALVAAPALLIIDD

SEQ ID NO: 324824 - protein, 17 aa, Mycobacterium
QRQRLGLARVLGSPAAV

SEQ ID NO: 324825 - protein, 19 aa, Mycobacterium
QRRGQSWGLPTTMLVVSLM

SEQ ID NO: 324826 - protein, 23 aa, Mycobacterium
QRRGRGVAWVLYQWRWSITALWF

SEQ ID NO: 324827 - protein, 19 aa, Mycobacterium
QRRKQAWLRELSNWEPDLV

SEQ ID NO: 324828 - protein, 22 aa, Mycobacterium
QRRLTPPTTRKGTITIEPPPQL

SEQ ID NO: 324829 - protein, 18 aa, Mycobacterium
QRRMEVLALPLVAVVLFL

SEQ ID NO: 324830 - protein, 22 aa, Mycobacterium
QRRMEVLALPLVAVVLFLVFGG

SEQ ID NO: 324831 - protein, 18 aa, Mycobacterium
QRRMEVLAVPLVAVVLFL

SEQ ID NO: 324832 - protein, 27 aa, Mycobacterium
QRRNPVLVFLGYFWAPIPWMIEAALVL

SEQ ID NO: 324833 - protein, 37 aa, Mycobacterium
QRRPARHRPAAWSLSNWPVGWKVVAIAVVPLLLATVF

SEQ ID NO: 324834 - protein, 26 aa, Mycobacterium
QRRRREWWLLVPLAVATWALVHASGV

SEQ ID NO: 324835 - protein, 17 aa, Mycobacterium
QRRSKAAGFVIAVIYKY

SEQ ID NO: 324836 - protein, 20 aa, Mycobacterium
QRRSQLWQAFQIQRKEDKRL

SEQ ID NO: 324837 - protein, 18 aa, Mycobacterium
QRRVCAAPTVFPNANFAD

SEQ ID NO: 324838 - protein, 22 aa, Mycobacterium
QRRVPTEMLGRVSSLDFFVSLA

SEQ ID NO: 324839 - protein, 26 aa, Mycobacterium
QRRWIRGRELRIGRFRTHSTNLVSGG

SEQ ID NO: 324840 - protein, 30 aa, Mycobacterium
QRSDQRLGFTARRAAVLAAVVCVLTLTIAG

SEQ ID NO: 324841 - protein, 19 aa, Mycobacterium
QRSGFAVSLSLVLLMIPVI

SEQ ID NO: 324842 - protein, 22 aa, Mycobacterium
QRSGGWENGEWTGSHRAVTPGP

SEQ ID NO: 324843 - protein, 29 aa, Mycobacterium
QRSGYPAELAKLWPVIVDLTIVLATVAVI

SEQ ID NO: 324844 - protein, 23 aa, Mycobacterium
QRSKGALIFDVGICLVLIALPVL

SEQ ID NO: 324845 - protein, 18 aa, Mycobacterium
QRSLIMRALTGAPVEPTL

SEQ ID NO: 324846 - protein, 19 aa, Mycobacterium
QRSLLTVSLVFFWDALAAW

SEQ ID NO: 324847 - protein, 19 aa, Mycobacterium
QRSRWAALVTLSLVLVWFV

SEQ ID NO: 324848 - protein, 27 aa, Mycobacterium
QRSTSVARWLIAVAVLAVLTVVVTVAI

SEQ ID NO: 324849 - protein, 18 aa, Mycobacterium
QRTEPSFDVTALLNGYEP

SEQ ID NO: 324850 - protein, 24 aa, Mycobacterium
QRTKVWLPECLQMAQQKTGALFGV

SEQ ID NO: 324851 - protein, 20 aa, Mycobacterium
QRTRAWEAVRAALDNGELSP

SEQ ID NO: 324852 - protein, 27 aa, Mycobacterium
QRTWPNHVFDFLAPRFAALEFSGFFGS

SEQ ID NO: 324853 - protein, 17 aa, Mycobacterium
QRVELKAILEYEAAHPS

SEQ ID NO: 324854 - protein, 17 aa, Mycobacterium
QRVELKAILEYEAAHPT

SEQ ID NO: 324855 - protein, 17 aa, Mycobacterium
QRVFYRLIHVLDPLIAL

SEQ ID NO: 324856 - protein, 18 aa, Mycobacterium
QRVSELDGALAQTQAAVD

SEQ ID NO: 324857 - protein, 17 aa, Mycobacterium
QRVTRRLDLGFAESDAL

SEQ ID NO: 324858 - protein, 19 aa, Mycobacterium
QRVTVALTIINPLTYEDGE

SEQ ID NO: 324859 - protein, 21 aa, Mycobacterium
QRWAPASPWATPPVTVMVLGW

SEQ ID NO: 324860 - protein, 25 aa, Mycobacterium
QRWASPFWQTWDLLMLWLAQLHGGN

SEQ ID NO: 324861 - protein, 19 aa, Mycobacterium
QRWAYPLLLVLSGVALGVS

SEQ ID NO: 324862 - protein, 29 aa, Mycobacterium
QRWRAIGTAVVRWPAPILVASLAVALVGL

SEQ ID NO: 324863 - protein, 30 aa, Mycobacterium
QRWVLGVSIAAVIVLLAWWKGMFLTTRIGR

SEQ ID NO: 324864 - protein, 26 aa, Mycobacterium
QRYFDGTNWTTEWAFSTDPPKERTSG

SEQ ID NO: 324865 - protein, 17 aa, Mycobacterium
QRYPTARDLAAAARQVL

SEQ ID NO: 324866 - protein, 18 aa, Mycobacterium
QRYREWLAVFYFIPLLLS

SEQ ID NO: 324867 - protein, 21 aa, Mycobacterium
QSADSVQAWAAHLATITSELR

SEQ ID NO: 324868 - protein, 17 aa, Mycobacterium
QSAGLFRYIAKRLLLAI

SEQ ID NO: 324869 - protein, 25 aa, Mycobacterium
QSAIPRQALVPGFWGNVVHDLSHAY

SEQ ID NO: 324870 - protein, 26 aa, Mycobacterium
QSAKFRALFGRRRTRRRAPVPAVETA

SEQ ID NO: 324871 - protein, 24 aa, Mycobacterium
QSALRLKGRLLFEPNVMVTSVPWQ

SEQ ID NO: 324872 - protein, 28 aa, Mycobacterium
QSALRLKGRLLFMPGVMVTSVPWQLTSS

SEQ ID NO: 324873 - protein, 28 aa, Mycobacterium
QSALRLKGRLLFMPNVMVTSVPWQLTSS

SEQ ID NO: 324874 - protein, 27 aa, Mycobacterium
QSALRLKGRLLFVPNVMVTSVPWQLDS

SEQ ID NO: 324875 - protein, 18 aa, Mycobacterium
QSARGVVAFLGYHELIGL

SEQ ID NO: 324876 - protein, 19 aa, Mycobacterium
QSAVRRLAYVGAVAVAAAV

SEQ ID NO: 324877 - protein, 24 aa, Mycobacterium
QSAVSRRGMWAIPLAVIGAVGIAG

SEQ ID NO: 324878 - protein, 21 aa, Mycobacterium
QSDALAAAWRAGRISITAISP

SEQ ID NO: 324879 - protein, 28 aa, Mycobacterium
QSDTVPGRYLPPVPHEPDPVALPVTVLT

SEQ ID NO: 324880 - protein, 19 aa, Mycobacterium
QSDVGFAMWQYYLATGDRQ

SEQ ID NO: 324881 - protein, 20 aa, Mycobacterium
QSERPRLVVLSMSRRYQPDF

SEQ ID NO: 324882 - protein, 18 aa, Mycobacterium
QSGRLWKLTSAMTTDDRT

SEQ ID NO: 324883 - protein, 18 aa, Mycobacterium
QSHPRLARNLSITTCDSA

SEQ ID NO: 324884 - protein, 25 aa, Mycobacterium
QSHRPELLDGVGIIVGIDRFMSEAR

SEQ ID NO: 324885 - protein, 22 aa, Mycobacterium
QSILGIPLNWVVLAMSVIILLA

SEQ ID NO: 324886 - protein, 31 aa, Mycobacterium
QSKFWTRWTGWVMRRPWLSAMAAAAVLLTFA

SEQ ID NO: 324887 - protein, 18 aa, Mycobacterium
QSLAIAWLTLIVAEQINA

SEQ ID NO: 324888 - protein, 19 aa, Mycobacterium
QSLKLQWGVTRPDGGIQPL

SEQ ID NO: 324889 - protein, 19 aa, Mycobacterium
QSLKLQWGVTRPDGTTQPL

SEQ ID NO: 324890 - protein, 26 aa, Mycobacterium
QSLLLPALCLLIAEAFHLEPHLAVGL

SEQ ID NO: 324891 - protein, 19 aa, Mycobacterium
QSLLPASRAHWFGTDLQGH

SEQ ID NO: 324892 - protein, 22 aa, Mycobacterium
QSLNMSKDWARAVVDIPVPTTV

SEQ ID NO: 324893 - protein, 20 aa, Mycobacterium
QSMLLPAFIALFGIVAALFL

SEQ ID NO: 324894 - protein, 20 aa, Mycobacterium
QSMLLPAFVALLGVVAALFM

SEQ ID NO: 324895 - protein, 17 aa, Mycobacterium
QSMTVTFMLVWLTGNHG

SEQ ID NO: 324896 - protein, 19 aa, Mycobacterium
QSPAWPALYPHARQVELPT

SEQ ID NO: 324897 - protein, 25 aa, Mycobacterium
QSPKLLRRLTDAWVILIGISLFGSY

SEQ ID NO: 324898 - protein, 23 aa, Mycobacterium
QSPVFRALWIAQFVSNLGTWMQT

SEQ ID NO: 324899 - protein, 31 aa, Mycobacterium
QSRGWRRVGTIVVRWPKPVLVASSAAVLVGA

SEQ ID NO: 324900 - protein, 25 aa, Mycobacterium
QSRRQPRWRTAVFASAAAIAVGLGA

SEQ ID NO: 324901 - protein, 20 aa, Mycobacterium
QSRWMFSALMGLSVVVVLLL

SEQ ID NO: 324902 - protein, 24 aa, Mycobacterium
QSSCIPTGCLAAAAMLDGYGHGQA

SEQ ID NO: 324903 - protein, 19 aa, Mycobacterium
QSSNLLLRALRIEPVHDVE

SEQ ID NO: 324904 - protein, 17 aa, Mycobacterium
QSSRPLIGKGWIQGVAL

SEQ ID NO: 324905 - protein, 24 aa, Mycobacterium
QSTALADVSIRWQLKQPAAPELFQ

SEQ ID NO: 324906 - protein, 25 aa, Mycobacterium
QSTALADVSIRWQLKQSAAPELFQQ

SEQ ID NO: 324907 - protein, 17 aa, Mycobacterium
QSTLRVFLARALNGGLR

SEQ ID NO: 324908 - protein, 17 aa, Mycobacterium
QSTPAFWIGILFILLFA

SEQ ID NO: 324909 - protein, 22 aa, Mycobacterium
QSTPVDRVWRALRILNDQQIAH

SEQ ID NO: 324910 - protein, 24 aa, Mycobacterium
QSTWYRRLRKPGFQPPPKAFPIAW

SEQ ID NO: 324911 - protein, 25 aa, Mycobacterium
QSVGFWKIGVRLPLLQGVAFAGVSP

SEQ ID NO: 324912 - protein, 25 aa, Mycobacterium
QSVSRWRFVLVTAGMWIAAAAAGAG

SEQ ID NO: 324913 - protein, 18 aa, Mycobacterium
QSWSAWFYGALDAHDFIT

SEQ ID NO: 324914 - protein, 20 aa, Mycobacterium
QSYPNVRLLWSGDWSTFSGP

SEQ ID NO: 324915 - protein, 21 aa, Mycobacterium
QTAHVPYLSWLHETSAVSAGV

SEQ ID NO: 324916 - protein, 32 aa, Mycobacterium
QTAKTRGWPGLRAAWVRPALILGCGIAIFTQL

SEQ ID NO: 324917 - protein, 25 aa, Mycobacterium
QTALELLRSAFIPWLVTINPEDHHP

SEQ ID NO: 324918 - protein, 24 aa, Mycobacterium
QTAPEPYPGPGFGLIIAWLTAIVL

SEQ ID NO: 324919 - protein, 27 aa, Mycobacterium
QTARMDLTFSLGERWTMAGEPAGIAGA

SEQ ID NO: 324920 - protein, 17 aa, Mycobacterium
QTAVPAWHEAHPYLPFV

SEQ ID NO: 324921 - protein, 23 aa, Mycobacterium
QTGGRMGFGFGKSRAKQLSKDMP

SEQ ID NO: 324922 - protein, 23 aa, Mycobacterium
QTGLRADCATGIYGYSEGGNSAG

SEQ ID NO: 324923 - protein, 23 aa, Mycobacterium
QTGRPCPPAIFDQSGKVINAAEA

SEQ ID NO: 324924 - protein, 24 aa, Mycobacterium
QTHGLRPDELRVMYDHHDAILHSV

SEQ ID NO: 324925 - protein, 24 aa, Mycobacterium
QTHSSDAIAGWASHLAAVTTELQT

SEQ ID NO: 324926 - protein, 19 aa, Mycobacterium
QTIGAGILWILGDVLGLPF

SEQ ID NO: 324927 - protein, 24 aa, Mycobacterium
QTIQWRPEEQITFLSSGVVRIDPP

SEQ ID NO: 324928 - protein, 17 aa, Mycobacterium
QTITVAVSPAWYDDYVL

SEQ ID NO: 324929 - protein, 23 aa, Mycobacterium
QTKRMGTGLDEASDFLLQMKHDA

SEQ ID NO: 324930 - protein, 21 aa, Mycobacterium
QTLFFPFVLLLAATALFRGND

SEQ ID NO: 324931 - protein, 21 aa, Mycobacterium
QTLFFPFVLLLAATALYRGGG

SEQ ID NO: 324932 - protein, 28 aa, Mycobacterium
QTLGRVELRLVWPAILSAMRLSTQMSMG

SEQ ID NO: 324933 - protein, 18 aa, Mycobacterium
QTLKRYRRQTGILLVDMT

SEQ ID NO: 324934 - protein, 19 aa, Mycobacterium
QTLMPRVQVGIAEHSLIDT

SEQ ID NO: 324935 - protein, 17 aa, Mycobacterium
QTLPIWIFSNLFRPNQA

SEQ ID NO: 324936 - protein, 26 aa, Mycobacterium
QTLQWRPDDQFTFLSSGAMRFDPPAG

SEQ ID NO: 324937 - protein, 25 aa, Mycobacterium
QTLRYFPDLVFVLALLAAVAFCAPN

SEQ ID NO: 324938 - protein, 25 aa, Mycobacterium
QTMGVPCAVGMLVAVFAALTLGPAV

SEQ ID NO: 324939 - protein, 19 aa, Mycobacterium
QTPILAVFVPLALVAIVDG

SEQ ID NO: 324940 - protein, 20 aa, Mycobacterium
QTPPAPVWWPGQPAPQPQIQ

SEQ ID NO: 324941 - protein, 23 aa, Mycobacterium
QTQRILTRWSRDFVTLIEALVFP

SEQ ID NO: 324942 - protein, 32 aa, Mycobacterium
QTRGWRRIGTAVVRWPAPILAVTIGIALVGLL

SEQ ID NO: 324943 - protein, 22 aa, Mycobacterium
QTVCGLSPIRSALVTAPTAIAS

SEQ ID NO: 324944 - protein, 18 aa, Mycobacterium
QTVKLGRGSGRAIAIAVT

SEQ ID NO: 324945 - protein, 23 aa, Mycobacterium
QTVPVLPAYIPVDVDMTMIKAQV

SEQ ID NO: 324946 - protein, 24 aa, Mycobacterium
QTVTVTFMLVWLIRNLHWSVTAAG

SEQ ID NO: 324947 - protein, 18 aa, Mycobacterium
QTWAGFAVAAVLLFGVAP

SEQ ID NO: 324948 - protein, 38 aa, Mycobacterium
QTWFIARVSLLPTLLVAIPFTVLVAFTLNILLREIGAA

SEQ ID NO: 324949 - protein, 26 aa, Mycobacterium
QTWIGRFVSTYGWRAYALPLLVVLTA

SEQ ID NO: 324950 - protein, 17 aa, Mycobacterium
QTYPGLPARGIVALCDF

SEQ ID NO: 324951 - protein, 17 aa, Mycobacterium
QTYRILAARMREDTRDV

SEQ ID NO: 324952 - protein, 24 aa, Mycobacterium
QTYVPLNDGFNWKGDPNATYSGQD

SEQ ID NO: 324953 - protein, 35 aa, Mycobacterium
QVAETFAIDGLESIKMPRLRASEMGADLSDLKSLS

SEQ ID NO: 324954 - protein, 17 aa, Mycobacterium
QVAPLLWAAVAGVPGVL

SEQ ID NO: 324955 - protein, 24 aa, Mycobacterium
QVCAAAVGRRCRVTALAATPAAAD

SEQ ID NO: 324956 - protein, 28 aa, Mycobacterium
QVDGAGAWRRLTKVILPIIKPAVVVALL

SEQ ID NO: 324957 - protein, 28 aa, Mycobacterium
QVDGAGPWRRLTGVILPIIKPAVVVALL

SEQ ID NO: 324958 - protein, 26 aa, Mycobacterium
QVDLREGAVVRALRLEDVTPVPVSPT

SEQ ID NO: 324959 - protein, 18 aa, Mycobacterium
QVDQPTDVSLRWGDVENE

SEQ ID NO: 324960 - protein, 23 aa, Mycobacterium
QVELATAEWVVWFNTERPHEYLD

SEQ ID NO: 324961 - protein, 27 aa, Mycobacterium
QVFPEHKYHIVRLLQARGHIVGMTGDG

SEQ ID NO: 324962 - protein, 19 aa, Mycobacterium
QVGAVALSFQAARLQLMRS

SEQ ID NO: 324963 - protein, 17 aa, Mycobacterium
QVGLTYITGTVVKAGQR

SEQ ID NO: 324964 - protein, 19 aa, Mycobacterium
QVHQRFRIQLPAGWAPEHD

SEQ ID NO: 324965 - protein, 19 aa, Mycobacterium
QVIKLCADVGMQTDVDDAL

SEQ ID NO: 324966 - protein, 17 aa, Mycobacterium
QVILFAHNIVIYAVIAM

SEQ ID NO: 324967 - protein, 28 aa, Mycobacterium
QVIVGGVDSRLWIAIVVLTGLLAVSLAG

SEQ ID NO: 324968 - protein, 24 aa, Mycobacterium
QVKSRDNIERWARNLNRLAAQSAQ

SEQ ID NO: 324969 - protein, 20 aa, Mycobacterium
QVLCSVGAVYFGSRTGMGFG

SEQ ID NO: 324970 - protein, 19 aa, Mycobacterium
QVLGFGLVWIGRYLILDRW

SEQ ID NO: 324971 - protein, 23 aa, Mycobacterium
QVLGLRVGDDIVWGLPPDRDIDI

SEQ ID NO: 324972 - protein, 34 aa, Mycobacterium
QVLGRLNWWAPEPLARVHARFGLSERAGHQPGAE

SEQ ID NO: 324973 - protein, 18 aa, Mycobacterium
QVLLPHARPAVMVLAVLT

SEQ ID NO: 324974 - protein, 24 aa, Mycobacterium
QVLWTVIGLFAFYVALRTPVAVMR

SEQ ID NO: 324975 - protein, 19 aa, Mycobacterium
QVMDLRPEIAIALVTLAIS

SEQ ID NO: 324976 - protein, 26 aa, Mycobacterium
QVNQFRPGLLRAFRTADFAGIMPRAV

SEQ ID NO: 324977 - protein, 18 aa, Mycobacterium
QVPPTRWSWYDDGSPEGA

SEQ ID NO: 324978 - protein, 23 aa, Mycobacterium
QVQRGWDGLVAVVSGAVLLFGFL

SEQ ID NO: 324979 - protein, 25 aa, Mycobacterium
QVRGVRGALVIGVLLLAIVGGATGW

SEQ ID NO: 324980 - protein, 17 aa, Mycobacterium
QVRIILCDKEFVDQVAE

SEQ ID NO: 324981 - protein, 30 aa, Mycobacterium
QVRISRFQTLLLKWAMMVLLGLLTSAVYVW

SEQ ID NO: 324982 - protein, 26 aa, Mycobacterium
QVRISRFRTLLLKWGLMTVLALLTSA

SEQ ID NO: 324983 - protein, 26 aa, Mycobacterium
QVRLVVSDRAYFVFLAVLPFVMGALS

SEQ ID NO: 324984 - protein, 26 aa, Mycobacterium
QVRQDCLRRGIVFAMARVKQDLREAL

SEQ ID NO: 324985 - protein, 19 aa, Mycobacterium
QVRVLPPFLSRKHLPSRLA

SEQ ID NO: 324986 - protein, 17 aa, Mycobacterium
QVSFWKLSIVQVANTFA

SEQ ID NO: 324987 - protein, 23 aa, Mycobacterium
QVSPVQYPRGWAAVAAAINARPA

SEQ ID NO: 324988 - protein, 23 aa, Mycobacterium
QVTDLRLSLSVNVSGLELVEKGY

SEQ ID NO: 324989 - protein, 24 aa, Mycobacterium
QVTGWRFVMRRIASGIALHDTRML

SEQ ID NO: 324990 - protein, 18 aa, Mycobacterium
QVTKELLELFNIDEQTLN

SEQ ID NO: 324991 - protein, 18 aa, Mycobacterium
QVTKELMELFNIDERTLN

SEQ ID NO: 324992 - protein, 21 aa, Mycobacterium
QVVAVPAHWHPAAFDAVRAAM

SEQ ID NO: 324993 - protein, 26 aa, Mycobacterium
QVVLIFRLGGAWPPQRGFEILSDRAQ

SEQ ID NO: 324994 - protein, 19 aa, Mycobacterium
QVVLNLWAYWCGPCADELP

SEQ ID NO: 324995 - protein, 18 aa, Mycobacterium
QVVLPFNGLNFRFSPGGV

SEQ ID NO: 324996 - protein, 26 aa, Mycobacterium
QVVPSWIAMFVYRIDINLRMSVVLGF

SEQ ID NO: 324997 - protein, 19 aa, Mycobacterium
QVVVWTFTLVWLVTDRGWS

SEQ ID NO: 324998 - protein, 23 aa, Mycobacterium
QVVVWTFTLVWMISEHGWSPESA

SEQ ID NO: 324999 - protein, 19 aa, Mycobacterium
QVWYGFGWESLLLETGFLM

SEQ ID NO: 325000 - protein, 23 aa, Mycobacterium
QVYVVMGAAWVWYRGLQGEPVPV

SEQ ID NO: 325001 - protein, 20 aa, Mycobacterium
QWALPSVVLSLAWMGWLCVM

SEQ ID NO: 325002 - protein, 17 aa, Mycobacterium
QWFARRPVVNAGGRRVI

SEQ ID NO: 325003 - protein, 18 aa, Mycobacterium
QWHYRAWGLEAWEMNLEM

SEQ ID NO: 325004 - protein, 21 aa, Mycobacterium
QWIDIPEVLQPGSYKPPPDIA

SEQ ID NO: 325005 - protein, 20 aa, Mycobacterium
QWKLNPGVVSSFTATARYTD

SEQ ID NO: 325006 - protein, 23 aa, Mycobacterium
QWLPPGAPGSHWVAEEAAGAETQ

SEQ ID NO: 325007 - protein, 20 aa, Mycobacterium
QWMTVLAMGLGFAITGADPA

SEQ ID NO: 325008 - protein, 23 aa, Mycobacterium
QWPGDLGERPALWIPASSVSEAR

SEQ ID NO: 325009 - protein, 20 aa, Mycobacterium
QWPGEWWNSVTAEWVVIIWM

SEQ ID NO: 325010 - protein, 20 aa, Mycobacterium
QWPILVVGLIFIAAFALVVA

SEQ ID NO: 325011 - protein, 24 aa, Mycobacterium
QWPMFAWFCIYAYRKFVRYEEVPP

SEQ ID NO: 325012 - protein, 25 aa, Mycobacterium
QWRDDLRWPPASALVSPDEAVEALI

SEQ ID NO: 325013 - protein, 24 aa, Mycobacterium
QWRGLVICICLEMTIALTSYTLSG

SEQ ID NO: 325014 - protein, 26 aa, Mycobacterium
QWRVLISRLFLRTSIGELFTTAGAPV

SEQ ID NO: 325015 - protein, 26 aa, Mycobacterium
QWSRLWRSDVRVVGRPQLQDALRSTN

SEQ ID NO: 325016 - protein, 22 aa, Mycobacterium
QWSSEAVDRVWLRGTVALVGTI

SEQ ID NO: 325017 - protein, 26 aa, Mycobacterium
QWVGDLPWFIPMAFISLPFLLAFRLT

SEQ ID NO: 325018 - protein, 17 aa, Mycobacterium
QWWTEPVPTGWLRGFLH

SEQ ID NO: 325019 - protein, 21 aa, Mycobacterium
QWWTWACALVLTDLAYYGRHR

SEQ ID NO: 325020 - protein, 25 aa, Mycobacterium
QYAPRRLAGPLAYMVDLLAAVPSIV

SEQ ID NO: 325021 - protein, 25 aa, Mycobacterium
QYAPRRVAGPLAYLVDLLAAVPSIV

SEQ ID NO: 325022 - protein, 17 aa, Mycobacterium
QYFEPLPAPALITRNEY

SEQ ID NO: 325023 - protein, 24 aa, Mycobacterium
QYFVFPLVFGWLGCKLLYEDWRRL

SEQ ID NO: 325024 - protein, 23 aa, Mycobacterium
QYGDENFLIVGMDSRAGANSEIG

SEQ ID NO: 325025 - protein, 23 aa, Mycobacterium
QYISLVLACWLWSGGAHIPMSDV

SEQ ID NO: 325026 - protein, 19 aa, Mycobacterium
QYPPARVVLWGLFGLGWVV

SEQ ID NO: 325027 - protein, 24 aa, Mycobacterium
QYQQPGFPGGGFGDPSQFGQQPGQ

SEQ ID NO: 325028 - protein, 25 aa, Mycobacterium
QYQVPRPWAGVLRRDMIPTAYALVL

SEQ ID NO: 325029 - protein, 17 aa, Mycobacterium
QYRAEGALLAWLTVAAV

SEQ ID NO: 325030 - protein, 19 aa, Mycobacterium
QYRGVGYRAFDLMEAGPDL

SEQ ID NO: 325031 - protein, 20 aa, Mycobacterium
QYRHARALAKVGLREPALAD

SEQ ID NO: 325032 - protein, 20 aa, Mycobacterium
QYRIMPNFKQIVVSSNQWQA

SEQ ID NO: 325033 - protein, 26 aa, Mycobacterium
QYRVTVELPEAGGLYPRSNVTYRGVE

SEQ ID NO: 325034 - protein, 19 aa, Mycobacterium
QYTAGPYVPADVALYDYDN

SEQ ID NO: 325035 - protein, 25 aa, Mycobacterium
QYTKEICNLMGLRQLGCSTGTIQDF

SEQ ID NO: 325036 - protein, 25 aa, Mycobacterium
QYVARFGLGYTVTRGHHLEVAGYRD

SEQ ID NO: 325037 - protein, 18 aa, Mycobacterium
QYWLGIVLLVVFAIQLRL

SEQ ID NO: 325038 - protein, 17 aa, Mycobacterium
RAAAAAIERERLSRQVH

SEQ ID NO: 325039 - protein, 19 aa, Mycobacterium
RAAAARWVVPLTLLLTLAA

SEQ ID NO: 325040 - protein, 17 aa, Mycobacterium
RAAADAIRLSRRTLNTI

SEQ ID NO: 325041 - protein, 27 aa, Mycobacterium
RAAADTLRRAWVRCEADGKSAALDDLP

SEQ ID NO: 325042 - protein, 20 aa, Mycobacterium
RAAAMWASLATGFLILIVLL

SEQ ID NO: 325043 - protein, 17 aa, Mycobacterium
RAAAPRVVVLSRLVPHK

SEQ ID NO: 325044 - protein, 18 aa, Mycobacterium
RAAARLASELGISDVRAE

SEQ ID NO: 325045 - protein, 20 aa, Mycobacterium
RAAAVGLGLALLIMPLIGLW

SEQ ID NO: 325046 - protein, 20 aa, Mycobacterium
RAAAVGLGLAVLIMPLIGLW

SEQ ID NO: 325047 - protein, 19 aa, Mycobacterium
RAAAVTAVMTAVILVGQLT

SEQ ID NO: 325048 - protein, 22 aa, Mycobacterium
RAADAIMAFLALVIVTSVSMVF

SEQ ID NO: 325049 - protein, 23 aa, Mycobacterium
RAADAPPGWLPGWLRPVHSRRVT

SEQ ID NO: 325050 - protein, 21 aa, Mycobacterium
RAADVLRAWNTRRRNAAWERL

SEQ ID NO: 325051 - protein, 18 aa, Mycobacterium
RAADVVVLIDGYRQPAGP

SEQ ID NO: 325052 - protein, 19 aa, Mycobacterium
RAAEFRDSHTFLKSTQVIQ

SEQ ID NO: 325053 - protein, 17 aa, Mycobacterium
RAAETVWGPRLGVRWWR

SEQ ID NO: 325054 - protein, 19 aa, Mycobacterium
RAAGFAYPFMAFHVAGRGF

SEQ ID NO: 325055 - protein, 19 aa, Mycobacterium
RAAGFAYPFMAFHVAGRGH

SEQ ID NO: 325056 - protein, 18 aa, Mycobacterium
RAAGGPLGPLGAVEGEVY

SEQ ID NO: 325057 - protein, 19 aa, Mycobacterium
RAAGLLALVFMWTLHRPGR

SEQ ID NO: 325058 - protein, 19 aa, Mycobacterium
RAAGLTVFFVCAMYTHVLA

SEQ ID NO: 325059 - protein, 25 aa, Mycobacterium
RAAHRRKMLLSGIALAAVLLIAIGY

SEQ ID NO: 325060 - protein, 17 aa, Mycobacterium
RAAHVVMLGVGLGNDDS

SEQ ID NO: 325061 - protein, 26 aa, Mycobacterium
RAAICMAVPVLVGWSAGNTSAGLIAT

SEQ ID NO: 325062 - protein, 20 aa, Mycobacterium
RAAIPAGLLAGILYGGMAVA

SEQ ID NO: 325063 - protein, 17 aa, Mycobacterium
RAAIRTDTILGRKNIEI

SEQ ID NO: 325064 - protein, 20 aa, Mycobacterium
RAALEGYWRDQLCGAPPEID

SEQ ID NO: 325065 - protein, 26 aa, Mycobacterium
RAALPRGRQWLRLGVVAAGVVAGFPL

SEQ ID NO: 325066 - protein, 18 aa, Mycobacterium
RAALRLTPLCVFTTAISL

SEQ ID NO: 325067 - protein, 19 aa, Mycobacterium
RAALVTALMTAVILLGQMT

SEQ ID NO: 325068 - protein, 18 aa, Mycobacterium
RAAMGVGAAVIFPTTLGL

SEQ ID NO: 325069 - protein, 24 aa, Mycobacterium
RAAMHRIGPILGWTLVATTVGLIL

SEQ ID NO: 325070 - protein, 18 aa, Mycobacterium
RAAMLFKGTHVVGGNGEG

SEQ ID NO: 325071 - protein, 23 aa, Mycobacterium
RAAPERRRAVLVASVAVAAVASL

SEQ ID NO: 325072 - protein, 24 aa, Mycobacterium
RAAQLKREALALAEDEEYDEYEDD

SEQ ID NO: 325073 - protein, 19 aa, Mycobacterium
RAARGGVLIKDRLALEGMR

SEQ ID NO: 325074 - protein, 22 aa, Mycobacterium
RAARGGVLIKDRLALEGMRTVD

SEQ ID NO: 325075 - protein, 23 aa, Mycobacterium
RAARGGVLIKDRLALEGMRTVDA

SEQ ID NO: 325076 - protein, 22 aa, Mycobacterium
RAARGGVLVKDRLALEQMRTVD

SEQ ID NO: 325077 - protein, 19 aa, Mycobacterium
RAARIADLRVRAVDVAGHL

SEQ ID NO: 325078 - protein, 17 aa, Mycobacterium
RAARKGRLWRRVGTAVV

SEQ ID NO: 325079 - protein, 17 aa, Mycobacterium
RAARPGVLISTLLGLAL

SEQ ID NO: 325080 - protein, 20 aa, Mycobacterium
RAARQGRLQISLNLAYGSAM

SEQ ID NO: 325081 - protein, 22 aa, Mycobacterium
RAARQGRLQISLNLAYGSAMAS

SEQ ID NO: 325082 - protein, 21 aa, Mycobacterium
RAARYQRARVVGVENVADREL

SEQ ID NO: 325083 - protein, 21 aa, Mycobacterium
RAATATVWRAGLRLWVPTLAV

SEQ ID NO: 325084 - protein, 18 aa, Mycobacterium
RAATIAFVIGWGLDAIDH

SEQ ID NO: 325085 - protein, 24 aa, Mycobacterium
RAATPRECRDPKPYVPAGTNPWYG

SEQ ID NO: 325086 - protein, 30 aa, Mycobacterium
RAAVGGTRWWSPRTWPLRARLVGTQVALLA

SEQ ID NO: 325087 - protein, 23 aa, Mycobacterium
RAAVPLREVFRPPVLKSTVLGML

SEQ ID NO: 325088 - protein, 18 aa, Mycobacterium
RAAVRPHRARFYATIAAL

SEQ ID NO: 325089 - protein, 18 aa, Mycobacterium
RAAWQRLDVVFVLGPRTR

SEQ ID NO: 325090 - protein, 17 aa, Mycobacterium
RAAYLGFYRRRNRAYAH

SEQ ID NO: 325091 - protein, 17 aa, Mycobacterium
RACGSCRHPAGKRHDPH

SEQ ID NO: 325092 - protein, 21 aa, Mycobacterium
RADAPCLRHVVFEIPAAGDPE

SEQ ID NO: 325093 - protein, 20 aa, Mycobacterium
RADAPPFFVLHGHDDSLIPV

SEQ ID NO: 325094 - protein, 22 aa, Mycobacterium
RADARAGLAPVFSLTRYGHERL

SEQ ID NO: 325095 - protein, 21 aa, Mycobacterium
RADATLCALLIDVDRFKSVND

SEQ ID NO: 325096 - protein, 21 aa, Mycobacterium
RADAWGRKPIFLVAFAVLTAR

SEQ ID NO: 325097 - protein, 24 aa, Mycobacterium
RADCPRYGDVKGPSCFTAPEQVVR

SEQ ID NO: 325098 - protein, 21 aa, Mycobacterium
RADELGVPPGFEAFIANVTPD

SEQ ID NO: 325099 - protein, 20 aa, Mycobacterium
RADETLALIRRGDENVRKQS

SEQ ID NO: 325100 - protein, 20 aa, Mycobacterium
RADETLSLIRRGDEEIRKQS

SEQ ID NO: 325101 - protein, 20 aa, Mycobacterium
RADETLSLIRRGDEEKRKQS

SEQ ID NO: 325102 - protein, 17 aa, Mycobacterium
RADGIVVDPMLPPQLAD

SEQ ID NO: 325103 - protein, 25 aa, Mycobacterium
RADHFRSGLLFALASAFAFGCSGPF

SEQ ID NO: 325104 - protein, 17 aa, Mycobacterium
RADHPLIDLRLFRNPVL

SEQ ID NO: 325105 - protein, 20 aa, Mycobacterium
RADLMKKLRADTEHVEPGMD

SEQ ID NO: 325106 - protein, 20 aa, Mycobacterium
RADMRITHPLISRAHLLLRF

SEQ ID NO: 325107 - protein, 25 aa, Mycobacterium
RADPGRAGAIGLAIVAALAVMVTVF

SEQ ID NO: 325108 - protein, 25 aa, Mycobacterium
RADPSRVRRSGGTGLGLAISVEDAR

SEQ ID NO: 325109 - protein, 27 aa, Mycobacterium
RADQLLVDRPLRVVVAGQLKQGKSQLV

SEQ ID NO: 325110 - protein, 20 aa, Mycobacterium
RADTVLGAFVVVIGAAALVM

SEQ ID NO: 325111 - protein, 19 aa, Mycobacterium
RADVIPAITKYMSALDVAL

SEQ ID NO: 325112 - protein, 21 aa, Mycobacterium
RADVRYRTVLTLVVAAFALTT

SEQ ID NO: 325113 - protein, 17 aa, Mycobacterium
RAEALLAASQGRVAGRL

SEQ ID NO: 325114 - protein, 22 aa, Mycobacterium
RAEDLRRALDDSGVLDVAVLSE

SEQ ID NO: 325115 - protein, 24 aa, Mycobacterium
RAEETELYPALAVPLRSGEATATM

SEQ ID NO: 325116 - protein, 20 aa, Mycobacterium
RAEGGPDHRGRVRINTVLVC

SEQ ID NO: 325117 - protein, 23 aa, Mycobacterium
RAEGKERLESFYLTYHSVSHVIL

SEQ ID NO: 325118 - protein, 18 aa, Mycobacterium
RAEGQRQAAILAAEAAAE

SEQ ID NO: 325119 - protein, 21 aa, Mycobacterium
RAEGVWRWVEAVLQQLCQGKF

SEQ ID NO: 325120 - protein, 30 aa, Mycobacterium
RAELGASYSNATWRLWSLPWQAKSPGTHTI

SEQ ID NO: 325121 - protein, 17 aa, Mycobacterium
RAEPRTSQKFIITASFL

SEQ ID NO: 325122 - protein, 18 aa, Mycobacterium
RAEQAVRCGLDIQRALSR

SEQ ID NO: 325123 - protein, 20 aa, Mycobacterium
RAEQVFPRTVPPDQARAANQ

SEQ ID NO: 325124 - protein, 24 aa, Mycobacterium
RAERAVGALARMAATSATVIRDGA

SEQ ID NO: 325125 - protein, 23 aa, Mycobacterium
RAERLVALWFALGGVFGLALLGV

SEQ ID NO: 325126 - protein, 21 aa, Mycobacterium
RAERTVAYWFLLAGFSGLALL

SEQ ID NO: 325127 - protein, 19 aa, Mycobacterium
RAESTYLLSAHGLLLAPFA

SEQ ID NO: 325128 - protein, 28 aa, Mycobacterium
RAEVAAIPLVCVVLFFVFGGVIAAALPG

SEQ ID NO: 325129 - protein, 18 aa, Mycobacterium
RAEVLRRQKRGLLPGQSG

SEQ ID NO: 325130 - protein, 18 aa, Mycobacterium
RAEVPGFENARLGTLASW

SEQ ID NO: 325131 - protein, 20 aa, Mycobacterium
RAEVSPRATRPIPVTAGPAR

SEQ ID NO: 325132 - protein, 17 aa, Mycobacterium
RAFFVPIIGCLAQVALA

SEQ ID NO: 325133 - protein, 22 aa, Mycobacterium
RAFGETEFWFAMIKIVAILALI

SEQ ID NO: 325134 - protein, 20 aa, Mycobacterium
RAFPGLAVPWLVAGLAVGLA

SEQ ID NO: 325135 - protein, 25 aa, Mycobacterium
RAFPWREFIHQGAFMAGSAVVPTLL

SEQ ID NO: 325136 - protein, 19 aa, Mycobacterium
RAFQGLRAMWQRGDELFAE

SEQ ID NO: 325137 - protein, 18 aa, Mycobacterium
RAFSDGRLVLLFASSLAT

SEQ ID NO: 325138 - protein, 24 aa, Mycobacterium
RAFSRDRMAVVSLVVLVIVTLAAV

SEQ ID NO: 325139 - protein, 19 aa, Mycobacterium
RAFTAHGLDSIFATFNQVL

SEQ ID NO: 325140 - protein, 19 aa, Mycobacterium
RAGAIALAVVAALAVLVTA

SEQ ID NO: 325141 - protein, 18 aa, Mycobacterium
RAGALFKRLNPRMRRSRV

SEQ ID NO: 325142 - protein, 23 aa, Mycobacterium
RAGALLLHPAVTIPLFLFSYYGL

SEQ ID NO: 325143 - protein, 20 aa, Mycobacterium
RAGALWSSLIAGFLILILLL

SEQ ID NO: 325144 - protein, 21 aa, Mycobacterium
RAGCGVAGFVLANQYWLAASI

SEQ ID NO: 325145 - protein, 17 aa, Mycobacterium
RAGCVAIAVMIAVIGVV

SEQ ID NO: 325146 - protein, 21 aa, Mycobacterium
RAGDLPLLLGALFANGLARFV

SEQ ID NO: 325147 - protein, 17 aa, Mycobacterium
RAGEARASGKVKRFNMF

SEQ ID NO: 325148 - protein, 21 aa, Mycobacterium
RAGEATSLILLTATAMGLATC

SEQ ID NO: 325149 - protein, 19 aa, Mycobacterium
RAGGEAMIYVQINGQSEKD

SEQ ID NO: 325150 - protein, 18 aa, Mycobacterium
RAGGFHRLLSTDSAETRF

SEQ ID NO: 325151 - protein, 17 aa, Mycobacterium
RAGGPALALRFLALTAG

SEQ ID NO: 325152 - protein, 18 aa, Mycobacterium
RAGGPIIAFLRMISPLSW

SEQ ID NO: 325153 - protein, 17 aa, Mycobacterium
RAGGRAHRGADEPATDA

SEQ ID NO: 325154 - protein, 21 aa, Mycobacterium
RAGGRYSVYVWALVAMALARF

SEQ ID NO: 325155 - protein, 25 aa, Mycobacterium
RAGHVSLLQVTWIYDRAVDLDGLRR

SEQ ID NO: 325156 - protein, 17 aa, Mycobacterium
RAGILIRSAEALETAHK

SEQ ID NO: 325157 - protein, 17 aa, Mycobacterium
RAGILIRSAEALETAHR

SEQ ID NO: 325158 - protein, 17 aa, Mycobacterium
RAGISYVLVSMVSSMIF

SEQ ID NO: 325159 - protein, 18 aa, Mycobacterium
RAGLFTLRGYLVVAVVLV

SEQ ID NO: 325160 - protein, 22 aa, Mycobacterium
RAGLGGICLVLAVGLVGMLVVR

SEQ ID NO: 325161 - protein, 21 aa, Mycobacterium
RAGLIAAVGFELFKQVGSIYL

SEQ ID NO: 325162 - protein, 19 aa, Mycobacterium
RAGLLVWGGWLAVTGVVFS

SEQ ID NO: 325163 - protein, 19 aa, Mycobacterium
RAGMASGIMSAQRAIGSTI

SEQ ID NO: 325164 - protein, 20 aa, Mycobacterium
RAGNKLAFTIEARALTFQPK

SEQ ID NO: 325165 - protein, 21 aa, Mycobacterium
RAGNQVPVWSLLVLTAAASLV

SEQ ID NO: 325166 - protein, 20 aa, Mycobacterium
RAGQSFVIFPEGRLARAPGL

SEQ ID NO: 325167 - protein, 23 aa, Mycobacterium
RAGRGGLVLLGLVLLSVVVNVRL

SEQ ID NO: 325168 - protein, 23 aa, Mycobacterium
RAGRLAPPMRWHSGRRVHLDLDP

SEQ ID NO: 325169 - protein, 19 aa, Mycobacterium
RAGRVCAMVGDGANDAAAI

SEQ ID NO: 325170 - protein, 19 aa, Mycobacterium
RAGSAGLWHRPAGPGTAKA

SEQ ID NO: 325171 - protein, 23 aa, Mycobacterium
RAGSSWYIGLGFFFAPALIVVSP

SEQ ID NO: 325172 - protein, 21 aa, Mycobacterium
RAGSVVLGWLVALVMAAIAHP

SEQ ID NO: 325173 - protein, 21 aa, Mycobacterium
RAGSWFGPYRLVRLLRQGGMG

SEQ ID NO: 325174 - protein, 23 aa, Mycobacterium
RAGTQIGVPYSWGGGSLTGPSRG

SEQ ID NO: 325175 - protein, 27 aa, Mycobacterium
RAGTYPFRMFGIRTVLIGLDLLLLRGA

SEQ ID NO: 325176 - protein, 26 aa, Mycobacterium
RAGVGFIPFVIAMGIGLGVSSQLVSR

SEQ ID NO: 325177 - protein, 23 aa, Mycobacterium
RAGVRVCGRGGLVTGTGTVDAAE

SEQ ID NO: 325178 - protein, 17 aa, Mycobacterium
RAGVTVITLGNHRGSAY

SEQ ID NO: 325179 - protein, 27 aa, Mycobacterium
RAGWRPFALGVLCWAVPAAVAGSVVVA

SEQ ID NO: 325180 - protein, 18 aa, Mycobacterium
RAGWSLDRVNSIYEAILN

SEQ ID NO: 325181 - protein, 19 aa, Mycobacterium
RAGYGMPGDHGSVFEDLTA

SEQ ID NO: 325182 - protein, 23 aa, Mycobacterium
RAHRHRTRWLLLVISGIVTGTTA

SEQ ID NO: 325183 - protein, 23 aa, Mycobacterium
RAHTREIADWVAAHHAGVRIGST

SEQ ID NO: 325184 - protein, 21 aa, Mycobacterium
RAIALSIVFAEIAAIGGIMLS

SEQ ID NO: 325185 - protein, 25 aa, Mycobacterium
RAIAMVARLLKIIPIERASLRRLPA

SEQ ID NO: 325186 - protein, 18 aa, Mycobacterium
RAIAPWYLLTALANCSWL

SEQ ID NO: 325187 - protein, 17 aa, Mycobacterium
RAIARTVRRRRATDGLL

SEQ ID NO: 325188 - protein, 17 aa, Mycobacterium
RAIDAFVTRVVDTYGRL

SEQ ID NO: 325189 - protein, 25 aa, Mycobacterium
RAIDRLGPELSVREIAEEAGTAKPK

SEQ ID NO: 325190 - protein, 17 aa, Mycobacterium
RAIEIIADACQALNFSH

SEQ ID NO: 325191 - protein, 20 aa, Mycobacterium
RAIHGPVFYAVVTGWLHGAR

SEQ ID NO: 325192 - protein, 18 aa, Mycobacterium
RAIIAPLYLIGSVLVSFF

SEQ ID NO: 325193 - protein, 19 aa, Mycobacterium
RAILYKPFVRQIRTTRQMQ

SEQ ID NO: 325194 - protein, 19 aa, Mycobacterium
RAIQIAGGIAMIVLAVALV

SEQ ID NO: 325195 - protein, 18 aa, Mycobacterium
RAISCVLFPVGLIWVAID

SEQ ID NO: 325196 - protein, 20 aa, Mycobacterium
RAITGLARFGAHAVGQVGAV

SEQ ID NO: 325197 - protein, 18 aa, Mycobacterium
RAITPPKGLEIFVGGTPA

SEQ ID NO: 325198 - protein, 20 aa, Mycobacterium
RAIVAPLYLVGSVVLSYFAA

SEQ ID NO: 325199 - protein, 29 aa, Mycobacterium
RAKKKGVLGRFWLVLTIAAVVALSGFVVY

SEQ ID NO: 325200 - protein, 30 aa, Mycobacterium
RAKKRRSRRRPMLLAGRSLAAMFAVLALVL

SEQ ID NO: 325201 - protein, 23 aa, Mycobacterium
RAKTFFLLVGMSALIVFVGSLFG

SEQ ID NO: 325202 - protein, 21 aa, Mycobacterium
RAKTFLLLAVFSGLIVAVGAM

SEQ ID NO: 325203 - protein, 18 aa, Mycobacterium
RALALVRKTLKDKPVPLA

SEQ ID NO: 325204 - protein, 22 aa, Mycobacterium
RALAPSYLDVCANADRGAGALA

SEQ ID NO: 325205 - protein, 17 aa, Mycobacterium
RALAVSPLPNWLGDSLR

SEQ ID NO: 325206 - protein, 17 aa, Mycobacterium
RALEAGIVLQAYLPDAL

SEQ ID NO: 325207 - protein, 21 aa, Mycobacterium
RALESPWLPAVLAGAGVATVL

SEQ ID NO: 325208 - protein, 20 aa, Mycobacterium
RALEYLKITYGWSLLLIVTF

SEQ ID NO: 325209 - protein, 24 aa, Mycobacterium
RALEYLKITYGWSLLLIVTFTVLY

SEQ ID NO: 325210 - protein, 20 aa, Mycobacterium
RALEYLKITYGWSLLLIVVF

SEQ ID NO: 325211 - protein, 23 aa, Mycobacterium
RALFLPAHDPFAAAVVAEAHRTG

SEQ ID NO: 325212 - protein, 27 aa, Mycobacterium
RALFNRLRPTLPIVLANLVSVGEVAVA

SEQ ID NO: 325213 - protein, 17 aa, Mycobacterium
RALFYARGLKHATVQVE

SEQ ID NO: 325214 - protein, 19 aa, Mycobacterium
RALGASIGRGVWCETYWLP

SEQ ID NO: 325215 - protein, 21 aa, Mycobacterium
RALGHRIGDGWLVARAGSLQR

SEQ ID NO: 325216 - protein, 19 aa, Mycobacterium
RALGRHCVTVIAFAVSIPM

SEQ ID NO: 325217 - protein, 17 aa, Mycobacterium
RALGVLIALSLVASGAM

SEQ ID NO: 325218 - protein, 17 aa, Mycobacterium
RALGWRLNRLVRHRSID

SEQ ID NO: 325219 - protein, 18 aa, Mycobacterium
RALILSRVRLFLIGVPIL

SEQ ID NO: 325220 - protein, 17 aa, Mycobacterium
RALLAPLYLLGTVVLNY

SEQ ID NO: 325221 - protein, 23 aa, Mycobacterium
RALLDRTTRWGSFLPDIDAFDAE

SEQ ID NO: 325222 - protein, 22 aa, Mycobacterium
RALLRRRQLWIGAAVVVVATAP

SEQ ID NO: 325223 - protein, 17 aa, Mycobacterium
RALLTALARLAGTHRSG

SEQ ID NO: 325224 - protein, 22 aa, Mycobacterium
RALNRFTDMPGRDSGMLADLGE

SEQ ID NO: 325225 - protein, 17 aa, Mycobacterium
RALPFAISLSRRSSRVI

SEQ ID NO: 325226 - protein, 25 aa, Mycobacterium
RALPFAVSLSRRCSRVIKQNLWASL

SEQ ID NO: 325227 - protein, 18 aa, Mycobacterium
RALPGDWGPLGALGGTDP

SEQ ID NO: 325228 - protein, 19 aa, Mycobacterium
RALPPGWKPGSKAAPEPQL

SEQ ID NO: 325229 - protein, 19 aa, Mycobacterium
RALPPGWKPGSKTAPTPVL

SEQ ID NO: 325230 - protein, 22 aa, Mycobacterium
RALPQAWTLRADEVVQNVTVYP

SEQ ID NO: 325231 - protein, 20 aa, Mycobacterium
RALRAQWPILLVGLIFAVAF

SEQ ID NO: 325232 - protein, 26 aa, Mycobacterium
RALRRGRSAGLWTWLTDAAVIGGLLL

SEQ ID NO: 325233 - protein, 25 aa, Mycobacterium
RALRWPRVPITLLAGVVAVDYQPRL

SEQ ID NO: 325234 - protein, 23 aa, Mycobacterium
RALSWAMPLAPWVYASATLGFVT

SEQ ID NO: 325235 - protein, 26 aa, Mycobacterium
RALTDPRYTAVLGHLISENGRAAYLL

SEQ ID NO: 325236 - protein, 19 aa, Mycobacterium
RALTGLAVVGLLGAGAVAF

SEQ ID NO: 325237 - protein, 19 aa, Mycobacterium
RALTGVGFAFLLGLSLAII

SEQ ID NO: 325238 - protein, 19 aa, Mycobacterium
RALTKPRFRGWIHVYSAGT

SEQ ID NO: 325239 - protein, 17 aa, Mycobacterium
RALTRYGPISVRALFLV

SEQ ID NO: 325240 - protein, 20 aa, Mycobacterium
RALVGFPVKLGRLLRASRDG

SEQ ID NO: 325241 - protein, 26 aa, Mycobacterium
RALVLYCFTLPFAMVETFGWTTIVDV

SEQ ID NO: 325242 - protein, 18 aa, Mycobacterium
RALVPGMLGSMVGDATTN

SEQ ID NO: 325243 - protein, 29 aa, Mycobacterium
RAMAKKPAERFAHCRDFTEQLAPGCAPTL

SEQ ID NO: 325244 - protein, 24 aa, Mycobacterium
RAMARAVVHAVNLGAQVINISMVS

SEQ ID NO: 325245 - protein, 34 aa, Mycobacterium
RAMDLLGQGALWLWNNAISPAWEGIKTAISAAWR

SEQ ID NO: 325246 - protein, 28 aa, Mycobacterium
RAMGPMQFLPGTWARYASDGKGDGVADP

SEQ ID NO: 325247 - protein, 28 aa, Mycobacterium
RAMGVLIIMVMVCWLLLAVLRGRLHPIG

SEQ ID NO: 325248 - protein, 24 aa, Mycobacterium
RAMRRTVLPQAMRVIIPPTGNEVI

SEQ ID NO: 325249 - protein, 24 aa, Mycobacterium
RAMTIAASMLFVFFQRVAWYLTST

SEQ ID NO: 325250 - protein, 26 aa, Mycobacterium
RAMYRPATILGCWVALIATVGLFFSG

SEQ ID NO: 325251 - protein, 23 aa, Mycobacterium
RANARLAAALIRVSLDDDVRRQV

SEQ ID NO: 325252 - protein, 17 aa, Mycobacterium
RANELRALLAERIANLK

SEQ ID NO: 325253 - protein, 18 aa, Mycobacterium
RANIAIVGVGTRFPGDMN

SEQ ID NO: 325254 - protein, 24 aa, Mycobacterium
RANIGVVPTEDWLSAYAQNPSHIA

SEQ ID NO: 325255 - protein, 25 aa, Mycobacterium
RANLTPTRIVRIITDVAAALDYAHS

SEQ ID NO: 325256 - protein, 27 aa, Mycobacterium
RANPGIPARGIVAVCDFGGSGTSMTLV

SEQ ID NO: 325257 - protein, 17 aa, Mycobacterium
RANWGVAGWSMGGTCAV

SEQ ID NO: 325258 - protein, 19 aa, Mycobacterium
RAPAGVKITHRSACTNVVQ

SEQ ID NO: 325259 - protein, 27 aa, Mycobacterium
RAPAYRFPSYLGFHIVERWQFHYSQVV

SEQ ID NO: 325260 - protein, 34 aa, Mycobacterium
RAPDRKLAAVGFCMGGGLVWRLLAAGTPQLAAAV

SEQ ID NO: 325261 - protein, 22 aa, Mycobacterium
RAPEDLRTSANIGLLEKAAQQI

SEQ ID NO: 325262 - protein, 27 aa, Mycobacterium
RAPLGLSPPRLWAGLRLGSAAGAAAAT

SEQ ID NO: 325263 - protein, 31 aa, Mycobacterium
RAPLRATSSLSLRWRVMLLAMSMVAMVVVLM

SEQ ID NO: 325264 - protein, 20 aa, Mycobacterium
RAPLSTWAVVAAVMIPALVV

SEQ ID NO: 325265 - protein, 18 aa, Mycobacterium
RAPLWDWAVVAIVIVPVV

SEQ ID NO: 325266 - protein, 20 aa, Mycobacterium
RAPQAQGREVLRVEVKVASP

SEQ ID NO: 325267 - protein, 22 aa, Mycobacterium
RAPQLWLPPLEEAIPLQGLLER

SEQ ID NO: 325268 - protein, 21 aa, Mycobacterium
RAPRWLQMLCGTWVVVVFGML

SEQ ID NO: 325269 - protein, 26 aa, Mycobacterium
RAPSLSGRLRNPWILLAAAALAVLLV

SEQ ID NO: 325270 - protein, 25 aa, Mycobacterium
RAPSRARLAPVVLMCVGAISLLVWF

SEQ ID NO: 325271 - protein, 19 aa, Mycobacterium
RAPTVEICQSDRPFEPLAM

SEQ ID NO: 325272 - protein, 19 aa, Mycobacterium
RAPVLTSWRSVVSNKAFLL

SEQ ID NO: 325273 - protein, 18 aa, Mycobacterium
RAPWVPVLPIASICACVW

SEQ ID NO: 325274 - protein, 17 aa, Mycobacterium
RAQAELMHAKHDSAPAP

SEQ ID NO: 325275 - protein, 26 aa, Mycobacterium
RAQAGGLPPLFAGVVRRPRRRQIEDT

SEQ ID NO: 325276 - protein, 20 aa, Mycobacterium
RAQAGWPAARAFDLTVLGSG

SEQ ID NO: 325277 - protein, 19 aa, Mycobacterium
RAQALPPGRALLVDTDDAV

SEQ ID NO: 325278 - protein, 17 aa, Mycobacterium
RAQFSIDADGEMKAVET

SEQ ID NO: 325279 - protein, 19 aa, Mycobacterium
RAQHVAAIITNLAEEANLV

SEQ ID NO: 325280 - protein, 24 aa, Mycobacterium
RAQIPMYLGYAFRAMNTHGRALFT

SEQ ID NO: 325281 - protein, 18 aa, Mycobacterium
RAQMRRWRDGEASASPLY

SEQ ID NO: 325282 - protein, 24 aa, Mycobacterium
RAQQLKLLRAAFIPWLATINPDND

SEQ ID NO: 325283 - protein, 23 aa, Mycobacterium
RAQRLCRPVFWYLAAWTGALVVV

SEQ ID NO: 325284 - protein, 26 aa, Mycobacterium
RAQRMARARLGVENAYDREYDVVPSR

SEQ ID NO: 325285 - protein, 21 aa, Mycobacterium
RAQRMARSRLGVENTSDRDYD

SEQ ID NO: 325286 - protein, 20 aa, Mycobacterium
RAQTGFVRRVMLSAIPSGLT

SEQ ID NO: 325287 - protein, 21 aa, Mycobacterium
RAQYLPTLLVGLAIMGMGTGC

SEQ ID NO: 325288 - protein, 23 aa, Mycobacterium
RARAECRRLRALFDQASTFDHPL

SEQ ID NO: 325289 - protein, 19 aa, Mycobacterium
RARAIQLRRRAEVAEGPDE

SEQ ID NO: 325290 - protein, 19 aa, Mycobacterium
RARALKMPFYRTLISVTNW

SEQ ID NO: 325291 - protein, 23 aa, Mycobacterium
RARDISIAVFTFFTRLVGRVNRA

SEQ ID NO: 325292 - protein, 19 aa, Mycobacterium
RARHFWMLRAASCRSGEVH

SEQ ID NO: 325293 - protein, 19 aa, Mycobacterium
RARIKVTTILGSRYLALEP

SEQ ID NO: 325294 - protein, 23 aa, Mycobacterium
RARLDGAAIAWVCVDGDPQGAVL

SEQ ID NO: 325295 - protein, 24 aa, Mycobacterium
RARLDSAAIAWVCVDGELAGAVLL

SEQ ID NO: 325296 - protein, 27 aa, Mycobacterium
RARLLRAVGPEARRVLVTAPFGGEGTT

SEQ ID NO: 325297 - protein, 18 aa, Mycobacterium
RARRPALIALVIIAASGC

SEQ ID NO: 325298 - protein, 17 aa, Mycobacterium
RARRRERREPPPADEPM

SEQ ID NO: 325299 - protein, 25 aa, Mycobacterium
RARRYRPGPPPGWEGAWREPPTPGV

SEQ ID NO: 325300 - protein, 22 aa, Mycobacterium
RARSRLQSSAFWDIATFLLNGS

SEQ ID NO: 325301 - protein, 19 aa, Mycobacterium
RARTKVMIAHRLSAIRNAD

SEQ ID NO: 325302 - protein, 19 aa, Mycobacterium
RARTVQKLLLAGADPAALA

SEQ ID NO: 325303 - protein, 20 aa, Mycobacterium
RARVAVGVAQVLLVGSAAAL

SEQ ID NO: 325304 - protein, 17 aa, Mycobacterium
RARVEWLVPMIGVDLDL

SEQ ID NO: 325305 - protein, 18 aa, Mycobacterium
RARVIPLGLALTAACAAV

SEQ ID NO: 325306 - protein, 30 aa, Mycobacterium
RARVWDSAVCKAWLLAVPFLVSTALLVIFA

SEQ ID NO: 325307 - protein, 18 aa, Mycobacterium
RARYPNIFRSAPARLSYQ

SEQ ID NO: 325308 - protein, 18 aa, Mycobacterium
RASAIMHGVWILLFTIPF

SEQ ID NO: 325309 - protein, 19 aa, Mycobacterium
RASARLVGPLASYLVVNVS

SEQ ID NO: 325310 - protein, 20 aa, Mycobacterium
RASDGWAFACTAIVVAAVVI

SEQ ID NO: 325311 - protein, 20 aa, Mycobacterium
RASGMALPFADDSMDICLSS

SEQ ID NO: 325312 - protein, 24 aa, Mycobacterium
RASGRDGFWLSMLVFSVLAVVNVV

SEQ ID NO: 325313 - protein, 23 aa, Mycobacterium
RASLEGLFKMIGHIPHLEAVGVN

SEQ ID NO: 325314 - protein, 19 aa, Mycobacterium
RASLREMLIPLVPAAVIAL

SEQ ID NO: 325315 - protein, 21 aa, Mycobacterium
RASLREMLIPLVPAAVIALAL

SEQ ID NO: 325316 - protein, 20 aa, Mycobacterium
RASLREMLIPLVPAAVVALA

SEQ ID NO: 325317 - protein, 24 aa, Mycobacterium
RASLVAIVCVVLFASLALYGVDPN

SEQ ID NO: 325318 - protein, 23 aa, Mycobacterium
RASMQIRRIDPWSTLKVSALLSV

SEQ ID NO: 325319 - protein, 46 aa, Mycobacterium
RASMQIRRIDPWSTLKVSLLLSVALFFVWMISVAFLYLVLGGMGVW

SEQ ID NO: 325320 - protein, 20 aa, Mycobacterium
RASPEHKLRLVRALQAGGEV

SEQ ID NO: 325321 - protein, 18 aa, Mycobacterium
RASTIMHGFWILLFAVPF

SEQ ID NO: 325322 - protein, 19 aa, Mycobacterium
RASTVLHGFWVMLFALPFA

SEQ ID NO: 325323 - protein, 17 aa, Mycobacterium
RASVTLGGFGLVCLIAL

SEQ ID NO: 325324 - protein, 20 aa, Mycobacterium
RATAEAFAAQGNWAAAIRHR

SEQ ID NO: 325325 - protein, 17 aa, Mycobacterium
RATASAMFLFFNAVFGS

SEQ ID NO: 325326 - protein, 18 aa, Mycobacterium
RATDALRTRLLVSAVLTV

SEQ ID NO: 325327 - protein, 21 aa, Mycobacterium
RATGRVEFQHVSFGYRPGVPV

SEQ ID NO: 325328 - protein, 19 aa, Mycobacterium
RATISRPAAEPAPNPTPAR

SEQ ID NO: 325329 - protein, 19 aa, Mycobacterium
RATISRPAATPAPNPTPAR

SEQ ID NO: 325330 - protein, 36 aa, Mycobacterium
RATLPRLRYDQFMALGWKLLIPVSLLWIMIAAVIRA

SEQ ID NO: 325331 - protein, 37 aa, Mycobacterium
RATLPRLRYDQFMALGWKLLIPVSLVWVLIAAVIRTL

SEQ ID NO: 325332 - protein, 25 aa, Mycobacterium
RATLPRLRYDQFMRLGWEVLIPVAL

SEQ ID NO: 325333 - protein, 18 aa, Mycobacterium
RATLPRMRYDQFMRLGWK

SEQ ID NO: 325334 - protein, 18 aa, Mycobacterium
RATPSFLTVLGVLLLPFV

SEQ ID NO: 325335 - protein, 21 aa, Mycobacterium
RATPTLFGFHAAGIVLHGLLG

SEQ ID NO: 325336 - protein, 21 aa, Mycobacterium
RATQFPGREGAGYPIENDNKL

SEQ ID NO: 325337 - protein, 30 aa, Mycobacterium
RATRLAKLFALASTLLVVWGSTSITLASPA

SEQ ID NO: 325338 - protein, 29 aa, Mycobacterium
RATSGRRMWAWRNGPLLERSMSNLDAAEA

SEQ ID NO: 325339 - protein, 25 aa, Mycobacterium
RATSPYSSWLVVRWVVASALGGPLL

SEQ ID NO: 325340 - protein, 20 aa, Mycobacterium
RATTIFGAKFVDLVFPDDPS

SEQ ID NO: 325341 - protein, 17 aa, Mycobacterium
RATVFVVTLGFLVQITG

SEQ ID NO: 325342 - protein, 20 aa, Mycobacterium
RATVIIGSLVLVLGLVAAFV

SEQ ID NO: 325343 - protein, 20 aa, Mycobacterium
RATVPTRHALIFGLVLTVTS

SEQ ID NO: 325344 - protein, 18 aa, Mycobacterium
RATWWSVVNILVIVYALI

SEQ ID NO: 325345 - protein, 19 aa, Mycobacterium
RATYAAVLIIGGFYALTCW

SEQ ID NO: 325346 - protein, 18 aa, Mycobacterium
RAVAIEWRGKIDDTKWRG

SEQ ID NO: 325347 - protein, 18 aa, Mycobacterium
RAVAIEWRGKVDDTKWRA

SEQ ID NO: 325348 - protein, 25 aa, Mycobacterium
RAVARIGILAIRWRLPSGVELDTGF

SEQ ID NO: 325349 - protein, 20 aa, Mycobacterium
RAVATAGGYRLSGRKEVINN

SEQ ID NO: 325350 - protein, 20 aa, Mycobacterium
RAVATARCAAYGAVIAALTL

SEQ ID NO: 325351 - protein, 17 aa, Mycobacterium
RAVAVNLLLPFMHRHHV

SEQ ID NO: 325352 - protein, 17 aa, Mycobacterium
RAVEHRALMAIAIGEAG

SEQ ID NO: 325353 - protein, 25 aa, Mycobacterium
RAVEVSEYILLIFVVPWAIWLLNLL

SEQ ID NO: 325354 - protein, 25 aa, Mycobacterium
RAVGILCRNGHVFIEAMFATTLVGA

SEQ ID NO: 325355 - protein, 18 aa, Mycobacterium
RAVHSALLLRAWSDDIVV

SEQ ID NO: 325356 - protein, 19 aa, Mycobacterium
RAVIKVTTILGSRYLSLEP

SEQ ID NO: 325357 - protein, 21 aa, Mycobacterium
RAVINRLWLRATVGIAGAIGL

SEQ ID NO: 325358 - protein, 19 aa, Mycobacterium
RAVIRYDDLIGGRYLALEE

SEQ ID NO: 325359 - protein, 19 aa, Mycobacterium
RAVLELAYFSGLGVLIVFL

SEQ ID NO: 325360 - protein, 17 aa, Mycobacterium
RAVLRARGDVPGWDEDR

SEQ ID NO: 325361 - protein, 25 aa, Mycobacterium
RAVNSCIRCGLHAACGSPTRSEVCA

SEQ ID NO: 325362 - protein, 20 aa, Mycobacterium
RAVPELILAVVFVAALGLGP

SEQ ID NO: 325363 - protein, 23 aa, Mycobacterium
RAVPQPPSIRECIPGPAPGPIPY

SEQ ID NO: 325364 - protein, 26 aa, Mycobacterium
RAVPQPPSVRPCLPGPAIGPNPGGPP

SEQ ID NO: 325365 - protein, 19 aa, Mycobacterium
RAVPWRPKLLPVEDRRSIM

SEQ ID NO: 325366 - protein, 17 aa, Mycobacterium
RAVRLLMGLLLSAFTTI

SEQ ID NO: 325367 - protein, 17 aa, Mycobacterium
RAVSKWLSLLFLATFTV

SEQ ID NO: 325368 - protein, 26 aa, Mycobacterium
RAVTFIPWPVIEGFTLGIAAIIFLQQ

SEQ ID NO: 325369 - protein, 20 aa, Mycobacterium
RAVVAPLYLIGTVIVSYMSA

SEQ ID NO: 325370 - protein, 21 aa, Mycobacterium
RAVVAPLYLVASVVISYLSAV

SEQ ID NO: 325371 - protein, 19 aa, Mycobacterium
RAVVVGGLVLTLPLATVVL

SEQ ID NO: 325372 - protein, 17 aa, Mycobacterium
RAVVYSVTGTKQLLDIV

SEQ ID NO: 325373 - protein, 29 aa, Mycobacterium
RAYAESLNQVFLCAAFVALAGFILALFLR

SEQ ID NO: 325374 - protein, 24 aa, Mycobacterium
RAYALCIIAGIVAALIIGDRRWEQ

SEQ ID NO: 325375 - protein, 19 aa, Mycobacterium
RAYALPILMVLTAVVVYQT

SEQ ID NO: 325376 - protein, 18 aa, Mycobacterium
RAYDCAIATKFAAGDAPD

SEQ ID NO: 325377 - protein, 18 aa, Mycobacterium
RAYYRGRFIDAFGGEPVD

SEQ ID NO: 325378 - protein, 20 aa, Mycobacterium
RCADLRVLALPIVDNETRLV

SEQ ID NO: 325379 - protein, 25 aa, Mycobacterium
RCATTVMRRALPLGTVVVVLLLVLG

SEQ ID NO: 325380 - protein, 20 aa, Mycobacterium
RCAYAGLVLLGLALTGVTVI

SEQ ID NO: 325381 - protein, 26 aa, Mycobacterium
RCDGAGVAEVVWRAAFVTVCGLPTDT

SEQ ID NO: 325382 - protein, 19 aa, Mycobacterium
RCEADGKSAALDDLPAAAR

SEQ ID NO: 325383 - protein, 25 aa, Mycobacterium
RCEKALAEYVSWSLLDVVRAVPGAP

SEQ ID NO: 325384 - protein, 24 aa, Mycobacterium
RCGGTLKALLLSGGAMSALALAVM

SEQ ID NO: 325385 - protein, 18 aa, Mycobacterium
RCGLPINILAVGYGAFMI

SEQ ID NO: 325386 - protein, 24 aa, Mycobacterium
RCGRRDGRLWIEVRGLDGTGGAAR

SEQ ID NO: 325387 - protein, 19 aa, Mycobacterium
RCHSCGAVNIAGTWHESAY

SEQ ID NO: 325388 - protein, 26 aa, Mycobacterium
RCIPSVPRWVWLLVVAGSLFTIVNGG

SEQ ID NO: 325389 - protein, 17 aa, Mycobacterium
RCKPGLVRLRPAPSLGL

SEQ ID NO: 325390 - protein, 19 aa, Mycobacterium
RCLAHGVGGHAYRTSFAYI

SEQ ID NO: 325391 - protein, 18 aa, Mycobacterium
RCRPAVIVPETLPLPNVV

SEQ ID NO: 325392 - protein, 18 aa, Mycobacterium
RCSVFAGGFDLAAADVVA

SEQ ID NO: 325393 - protein, 18 aa, Mycobacterium
RCSVLHLWADAGGAHADF

SEQ ID NO: 325394 - protein, 22 aa, Mycobacterium
RCTERRWARPASHTGLAVAMIV

SEQ ID NO: 325395 - protein, 22 aa, Mycobacterium
RCTRLYRPVFYYLAFWTATLVV

SEQ ID NO: 325396 - protein, 23 aa, Mycobacterium
RCWRIARVFGRNPLLRRADRIEA

SEQ ID NO: 325397 - protein, 21 aa, Mycobacterium
RCWRLARLVGRNPLLRRTDRL

SEQ ID NO: 325398 - protein, 17 aa, Mycobacterium
RDADYRLGWFVIVGTIP

SEQ ID NO: 325399 - protein, 21 aa, Mycobacterium
RDAEELHRAFQLATLSGPPPS

SEQ ID NO: 325400 - protein, 18 aa, Mycobacterium
RDAIPARWPLVAVSTVIV

SEQ ID NO: 325401 - protein, 19 aa, Mycobacterium
RDALKAVVGPALRLNDADQ

SEQ ID NO: 325402 - protein, 20 aa, Mycobacterium
RDALRTHVGFVRSGMAPRLV

SEQ ID NO: 325403 - protein, 28 aa, Mycobacterium
RDAPALVAYCHRHRIDVINVTPTYAHHL

SEQ ID NO: 325404 - protein, 17 aa, Mycobacterium
RDAPLAVIARGERAVHS

SEQ ID NO: 325405 - protein, 20 aa, Mycobacterium
RDAPRSASVLAVRDSSLLRV

SEQ ID NO: 325406 - protein, 24 aa, Mycobacterium
RDAQLPDRLLGALEKRGLTADMLT

SEQ ID NO: 325407 - protein, 18 aa, Mycobacterium
RDARGCGQVTMIDGQTGR

SEQ ID NO: 325408 - protein, 25 aa, Mycobacterium
RDCKGPKETLARCAGNAVDNGGRGS

SEQ ID NO: 325409 - protein, 21 aa, Mycobacterium
RDCSPAELFWIWCGANIAPIN

SEQ ID NO: 325410 - protein, 24 aa, Mycobacterium
RDDAYRFAVWLSLPVTALVAGFGL

SEQ ID NO: 325411 - protein, 20 aa, Mycobacterium
RDDDGVFYFVGRAGSMIKTA

SEQ ID NO: 325412 - protein, 24 aa, Mycobacterium
RDDELRVPIGITASGEPLMFDLKD

SEQ ID NO: 325413 - protein, 18 aa, Mycobacterium
RDDFDYRALIPGFITSAS

SEQ ID NO: 325414 - protein, 22 aa, Mycobacterium
RDDMRTKLSVARTNGVTQTSTI

SEQ ID NO: 325415 - protein, 22 aa, Mycobacterium
RDDPSRPAVCIVRARSRDGDET

SEQ ID NO: 325416 - protein, 17 aa, Mycobacterium
RDEELRVPIGVTSTGEP

SEQ ID NO: 325417 - protein, 24 aa, Mycobacterium
RDEGTALMSWCIVAAQVVMVPVAY

SEQ ID NO: 325418 - protein, 37 aa, Mycobacterium
RDERDRLALWSRVLPITFTAVGLIALVGGGLLASFSL

SEQ ID NO: 325419 - protein, 25 aa, Mycobacterium
RDESRCVLESPGIYTPEGTALIELV

SEQ ID NO: 325420 - protein, 21 aa, Mycobacterium
RDEVEARLALGQPSRQAAAPY

SEQ ID NO: 325421 - protein, 17 aa, Mycobacterium
RDFCLRVADRIVLVTGD

SEQ ID NO: 325422 - protein, 26 aa, Mycobacterium
RDFDIEKLWTVIGLVPQRGYLFSGTI

SEQ ID NO: 325423 - protein, 24 aa, Mycobacterium
RDFKASAIRLLRRLTPQRGMTIAV

SEQ ID NO: 325424 - protein, 17 aa, Mycobacterium
RDGENPFALLLVSLLGP

SEQ ID NO: 325425 - protein, 25 aa, Mycobacterium
RDGLGLKFVQYLAFAGVLIGASVYQ

SEQ ID NO: 325426 - protein, 23 aa, Mycobacterium
RDGLLPARFAKVNPRTMTPVNNT

SEQ ID NO: 325427 - protein, 19 aa, Mycobacterium
RDGLWWLVIRDDGRGGATI

SEQ ID NO: 325428 - protein, 23 aa, Mycobacterium
RDGNRFELGLTFHHALLDGWSVA

SEQ ID NO: 325429 - protein, 19 aa, Mycobacterium
RDGRELGTVLVVRDRTDVE

SEQ ID NO: 325430 - protein, 17 aa, Mycobacterium
RDGRIGVGAGRLHPLAV

SEQ ID NO: 325431 - protein, 20 aa, Mycobacterium
RDGRPRARRKSMWSGVRSLP

SEQ ID NO: 325432 - protein, 22 aa, Mycobacterium
RDGYPTIPVFAFGWPTSELSPL

SEQ ID NO: 325433 - protein, 23 aa, Mycobacterium
RDHLARVLPGYMVPTRYGIVDTL

SEQ ID NO: 325434 - protein, 17 aa, Mycobacterium
RDHTVDGVVLFPGAGFV

SEQ ID NO: 325435 - protein, 19 aa, Mycobacterium
RDHYPAMVCMHALLLVSCV

SEQ ID NO: 325436 - protein, 19 aa, Mycobacterium
RDIAGFSLPILVRALGILA

SEQ ID NO: 325437 - protein, 17 aa, Mycobacterium
RDIKAIALAAVGCAAAF

SEQ ID NO: 325438 - protein, 18 aa, Mycobacterium
RDIKWLKWIEAPFARVGR

SEQ ID NO: 325439 - protein, 17 aa, Mycobacterium
RDILSYYGIEDAANIDF

SEQ ID NO: 325440 - protein, 24 aa, Mycobacterium
RDITELPGVFAQWLSTVLPGGVTP

SEQ ID NO: 325441 - protein, 17 aa, Mycobacterium
RDITKLLGYNVAARTGT

SEQ ID NO: 325442 - protein, 19 aa, Mycobacterium
RDIVLGVVRDGRLLRIGAP

SEQ ID NO: 325443 - protein, 18 aa, Mycobacterium
RDIWIAGILGVVIVALAT

SEQ ID NO: 325444 - protein, 22 aa, Mycobacterium
RDKGRPVVRVTVGVSPHTPTTE

SEQ ID NO: 325445 - protein, 33 aa, Mycobacterium
RDKIPRLIRTFAVPIILGWIAIIAVLNVSVPQL

SEQ ID NO: 325446 - protein, 19 aa, Mycobacterium
RDLAARWDRLHRLRVALLL

SEQ ID NO: 325447 - protein, 23 aa, Mycobacterium
RDLAELLDLAPLLADNAYNMIDR

SEQ ID NO: 325448 - protein, 19 aa, Mycobacterium
RDLAIQPTLCEVWNEDTKS

SEQ ID NO: 325449 - protein, 24 aa, Mycobacterium
RDLAITPMKCEPWDPETGTYGPIW

SEQ ID NO: 325450 - protein, 17 aa, Mycobacterium
RDLGFKIIFGLPGIVLA

SEQ ID NO: 325451 - protein, 17 aa, Mycobacterium
RDLGGFASGTAWLVPML

SEQ ID NO: 325452 - protein, 26 aa, Mycobacterium
RDLLAIIRLLAWQGAALAAIPVLRGV

SEQ ID NO: 325453 - protein, 27 aa, Mycobacterium
RDLLANRWFLRLSVITGPLAVLAVESG

SEQ ID NO: 325454 - protein, 27 aa, Mycobacterium
RDLLGGYRYPMWLKIVGLAVWLLTLYL

SEQ ID NO: 325455 - protein, 20 aa, Mycobacterium
RDLLWLQVAIGIAVLTVLGV

SEQ ID NO: 325456 - protein, 24 aa, Mycobacterium
RDLMGVPRLSFWAHPQTAVMSIIV

SEQ ID NO: 325457 - protein, 20 aa, Mycobacterium
RDLPKAVLFSIAFIALVVGY

SEQ ID NO: 325458 - protein, 17 aa, Mycobacterium
RDLPLIADAAAQVPVSV

SEQ ID NO: 325459 - protein, 17 aa, Mycobacterium
RDLRARLLRSYQSQQDG

SEQ ID NO: 325460 - protein, 27 aa, Mycobacterium
RDLRFVACGRPLPGHEIRILDAAGNEL

SEQ ID NO: 325461 - protein, 21 aa, Mycobacterium
RDLRHPVVVAILFVVIAGIVL

SEQ ID NO: 325462 - protein, 22 aa, Mycobacterium
RDLRIPAIGLALLLLSSVIVGA

SEQ ID NO: 325463 - protein, 25 aa, Mycobacterium
RDLRLLLERAPRFARRRTGSDVSQI

SEQ ID NO: 325464 - protein, 29 aa, Mycobacterium
RDLTSRLWRRSGVHIVRRPIAHLTASLVV

SEQ ID NO: 325465 - protein, 22 aa, Mycobacterium
RDLTVSFSWSMFNWIADVACLA

SEQ ID NO: 325466 - protein, 17 aa, Mycobacterium
RDLTYRQVLPGALAAAV

SEQ ID NO: 325467 - protein, 17 aa, Mycobacterium
RDLVAMGLRNWGLLIGA

SEQ ID NO: 325468 - protein, 18 aa, Mycobacterium
RDLVKVAFAPAVVALVII

SEQ ID NO: 325469 - protein, 17 aa, Mycobacterium
RDMGVGELLGMVQAGLS

SEQ ID NO: 325470 - protein, 17 aa, Mycobacterium
RDMIPTAYALVLMPCAV

SEQ ID NO: 325471 - protein, 17 aa, Mycobacterium
RDMPTSMPMRMVVPHML

SEQ ID NO: 325472 - protein, 24 aa, Mycobacterium
RDMRNRFLVALALSIPIMLWSPMG

SEQ ID NO: 325473 - protein, 20 aa, Mycobacterium
RDNGVRRIVMLTGDHPDIAK

SEQ ID NO: 325474 - protein, 18 aa, Mycobacterium
RDPAGFVDVHSLDGVSTG

SEQ ID NO: 325475 - protein, 17 aa, Mycobacterium
RDPALDELIGFFVNTLV

SEQ ID NO: 325476 - protein, 19 aa, Mycobacterium
RDPALDELIGFFVNTLVLR

SEQ ID NO: 325477 - protein, 18 aa, Mycobacterium
RDPERFVDLLARERVTVL

SEQ ID NO: 325478 - protein, 25 aa, Mycobacterium
RDPKPRRFDVLIAAVAVALGIPLIT

SEQ ID NO: 325479 - protein, 18 aa, Mycobacterium
RDPLAHRSLIWFTVVSSV

SEQ ID NO: 325480 - protein, 23 aa, Mycobacterium
RDPLRTGIFGVVLVVCVVLIAFG

SEQ ID NO: 325481 - protein, 22 aa, Mycobacterium
RDPLTGLCHRRALFRQLNALLL

SEQ ID NO: 325482 - protein, 26 aa, Mycobacterium
RDPPAAARWRRFFGFAVAVPAIAAIH

SEQ ID NO: 325483 - protein, 17 aa, Mycobacterium
RDPRAAIIACYAAMEQG

SEQ ID NO: 325484 - protein, 17 aa, Mycobacterium
RDPRLLVTCGIVLLAVF

SEQ ID NO: 325485 - protein, 17 aa, Mycobacterium
RDPSFYLRFRREAQNAA

SEQ ID NO: 325486 - protein, 18 aa, Mycobacterium
RDPSGFVDVHSLDGVSTG

SEQ ID NO: 325487 - protein, 19 aa, Mycobacterium
RDQRSVLVVAHRLSTVTNA

SEQ ID NO: 325488 - protein, 18 aa, Mycobacterium
RDRAAVVSSEAGTWLLWD

SEQ ID NO: 325489 - protein, 21 aa, Mycobacterium
RDRAGPAWLTTRLRRLLDGRS

SEQ ID NO: 325490 - protein, 25 aa, Mycobacterium
RDRDPLRTGIFGVVLVVCVVLIAFG

SEQ ID NO: 325491 - protein, 20 aa, Mycobacterium
RDRHSGSWFAVSMVPFTIAI

SEQ ID NO: 325492 - protein, 17 aa, Mycobacterium
RDRIPAAVLALVGVMSV

SEQ ID NO: 325493 - protein, 22 aa, Mycobacterium
RDRIPARWSLVAVSVVIVLFSG

SEQ ID NO: 325494 - protein, 18 aa, Mycobacterium
RDRLMLSCELFDGQAVPQ

SEQ ID NO: 325495 - protein, 27 aa, Mycobacterium
RDRLPLVCCLLAFILTFFVTRTVVRYI

SEQ ID NO: 325496 - protein, 27 aa, Mycobacterium
RDRMLFTYHFLLFDGWSRELVLRDLFA

SEQ ID NO: 325497 - protein, 24 aa, Mycobacterium
RDRNRLVTFAAIFLAGGLMFSLTV

SEQ ID NO: 325498 - protein, 24 aa, Mycobacterium
RDRNRLVTFTAIFLAGGLMFSLTV

SEQ ID NO: 325499 - protein, 26 aa, Mycobacterium
RDRSWWSGPEVFVFVDDYAMVNSAAP

SEQ ID NO: 325500 - protein, 19 aa, Mycobacterium
RDRTGHIVAVFKAPDGKTV

SEQ ID NO: 325501 - protein, 28 aa, Mycobacterium
RDRTTPSVGRWVAVVAVLAVLTIAVTIA

SEQ ID NO: 325502 - protein, 17 aa, Mycobacterium
RDSAGLAVLPIRLVVGW

SEQ ID NO: 325503 - protein, 19 aa, Mycobacterium
RDSAVLRVLFQWRWSIATL

SEQ ID NO: 325504 - protein, 22 aa, Mycobacterium
RDSELTVAFILGVLLIGTPGWQ

SEQ ID NO: 325505 - protein, 23 aa, Mycobacterium
RDSFFDWDMYRQAIPTLFKTGLP

SEQ ID NO: 325506 - protein, 28 aa, Mycobacterium
RDSGAWRRIAESVARRPALVAVVAIAVL

SEQ ID NO: 325507 - protein, 17 aa, Mycobacterium
RDSGCDIGQGFYFGKPV

SEQ ID NO: 325508 - protein, 24 aa, Mycobacterium
RDSVPFIVACLVVFMLFNAGGLQL

SEQ ID NO: 325509 - protein, 31 aa, Mycobacterium
RDTDLCGVSWVYRYAVAVYRDDRGCGQVSTI

SEQ ID NO: 325510 - protein, 31 aa, Mycobacterium
RDTDLCGVTWVYRYAVAVYRDDRGCGQVSTI

SEQ ID NO: 325511 - protein, 19 aa, Mycobacterium
RDTELRNLLANARKATAVL

SEQ ID NO: 325512 - protein, 31 aa, Mycobacterium
RDTPPMRWFQRPVLWFFAAAVFSAAVFTALF

SEQ ID NO: 325513 - protein, 17 aa, Mycobacterium
RDTVPALGKAAVVTTSA

SEQ ID NO: 325514 - protein, 17 aa, Mycobacterium
RDVAGWFAISSEGPPAP

SEQ ID NO: 325515 - protein, 22 aa, Mycobacterium
RDVEEPYLLAAHGTTYREYGAR

SEQ ID NO: 325516 - protein, 17 aa, Mycobacterium
RDVFRRRTIAALAASAD

SEQ ID NO: 325517 - protein, 17 aa, Mycobacterium
RDVGFVFLVMAIGMTTG

SEQ ID NO: 325518 - protein, 17 aa, Mycobacterium
RDVLEAQAAPALAEAAR

SEQ ID NO: 325519 - protein, 22 aa, Mycobacterium
RDVQAGLFWPVLAVVMFAALGL

SEQ ID NO: 325520 - protein, 25 aa, Mycobacterium
RDWATSVGPWFPLAFLGAHILVTVF

SEQ ID NO: 325521 - protein, 20 aa, Mycobacterium
RDWGVPTWAAALFAAIATGV

SEQ ID NO: 325522 - protein, 17 aa, Mycobacterium
RDWLGGPPLNISEAQLN

SEQ ID NO: 325523 - protein, 17 aa, Mycobacterium
RDYFVLIVVAAVGAYLF

SEQ ID NO: 325524 - protein, 19 aa, Mycobacterium
RDYLILIVVAGVAAYLFSP

SEQ ID NO: 325525 - protein, 19 aa, Mycobacterium
RDYLMPLAVFIAGGAAIGA

SEQ ID NO: 325526 - protein, 18 aa, Mycobacterium
RDYPDLRVEVAQREADEA

SEQ ID NO: 325527 - protein, 26 aa, Mycobacterium
REAALQIGHFFGHKFKPWGAIKAGKA

SEQ ID NO: 325528 - protein, 28 aa, Mycobacterium
REAALRLGGRQSLILVGAWAASGAVLML

SEQ ID NO: 325529 - protein, 27 aa, Mycobacterium
REAAWLSWPGFVWLALVFYLVLTLLVL

SEQ ID NO: 325530 - protein, 20 aa, Mycobacterium
REAEEALAHTALWQQVLGDG

SEQ ID NO: 325531 - protein, 17 aa, Mycobacterium
REAELLALFAGGVLVNS

SEQ ID NO: 325532 - protein, 17 aa, Mycobacterium
REAELLALFAGSVLRGA

SEQ ID NO: 325533 - protein, 21 aa, Mycobacterium
REAHAGDRYLLCSDGLSDPVS

SEQ ID NO: 325534 - protein, 31 aa, Mycobacterium
REAKRKPRNGIRVRIGIHMGRSVRRGDDLFG

SEQ ID NO: 325535 - protein, 20 aa, Mycobacterium
REALERGWPVMSFSRPVSLR

SEQ ID NO: 325536 - protein, 22 aa, Mycobacterium
REALHWRSGDTVTLRGRTEPTE

SEQ ID NO: 325537 - protein, 17 aa, Mycobacterium
REALLHSIREGVIAVNG

SEQ ID NO: 325538 - protein, 18 aa, Mycobacterium
REALLPGVEVSGASGFDS

SEQ ID NO: 325539 - protein, 19 aa, Mycobacterium
REALRGHPDLAPGAVQPAL

SEQ ID NO: 325540 - protein, 19 aa, Mycobacterium
REARLRAGDTVYLVGPYRE

SEQ ID NO: 325541 - protein, 21 aa, Mycobacterium
REARLSWILAALAGLVGAAAF

SEQ ID NO: 325542 - protein, 21 aa, Mycobacterium
REASEFIPVHGISAEELADAA

SEQ ID NO: 325543 - protein, 21 aa, Mycobacterium
REATDLAALVRAAATQVLPDA

SEQ ID NO: 325544 - protein, 19 aa, Mycobacterium
REAVAPGFDLSRCKTGADA

SEQ ID NO: 325545 - protein, 19 aa, Mycobacterium
REAVERGWPVLSFSRPVSL

SEQ ID NO: 325546 - protein, 17 aa, Mycobacterium
REAYRLYRGPIFRGLIP

SEQ ID NO: 325547 - protein, 19 aa, Mycobacterium
REDFAYLVDFGIASATTDE

SEQ ID NO: 325548 - protein, 21 aa, Mycobacterium
REDLAMWWLLGGIFAGVVSGL

SEQ ID NO: 325549 - protein, 18 aa, Mycobacterium
REDLPPRVVIDCQLGTGD

SEQ ID NO: 325550 - protein, 23 aa, Mycobacterium
REEAAKSGVEWVPAKSFVIDRLP

SEQ ID NO: 325551 - protein, 24 aa, Mycobacterium
REEREIESWLGALRGPAPAKNVPQ

SEQ ID NO: 325552 - protein, 24 aa, Mycobacterium
REERPGAVRLLRLMVDRPRYINLI

SEQ ID NO: 325553 - protein, 20 aa, Mycobacterium
REEVLRCAVHAAPVTNGGTQ

SEQ ID NO: 325554 - protein, 23 aa, Mycobacterium
REEVPELDAGIGVAAGQVVAGNV

SEQ ID NO: 325555 - protein, 24 aa, Mycobacterium
REFEDAGVCAIHIEDNLGGKHSAE

SEQ ID NO: 325556 - protein, 33 aa, Mycobacterium
REFEYPEQGGLPWYKRTALVLTVAGAGVAVLVA

SEQ ID NO: 325557 - protein, 17 aa, Mycobacterium
REFGIMSSIGLADEVLY

SEQ ID NO: 325558 - protein, 21 aa, Mycobacterium
REFGNIVFHFSLLGLLVAVAV

SEQ ID NO: 325559 - protein, 20 aa, Mycobacterium
REFLEQSWFIARVAIAPTLL

SEQ ID NO: 325560 - protein, 32 aa, Mycobacterium
REFLGEWAVLIFRWLLLTGTFACAMAFHNCAS

SEQ ID NO: 325561 - protein, 20 aa, Mycobacterium
REFRVDEVLLVWDRGIRGSE

SEQ ID NO: 325562 - protein, 17 aa, Mycobacterium
REGHHRPPVPAWTLALV

SEQ ID NO: 325563 - protein, 19 aa, Mycobacterium
REGPIPWPEALEIGVKLCG

SEQ ID NO: 325564 - protein, 21 aa, Mycobacterium
REGPVPWPEALHIGVKLCGAL

SEQ ID NO: 325565 - protein, 27 aa, Mycobacterium
REGSQFGPYRLRRIVGRGAMGDVYEAE

SEQ ID NO: 325566 - protein, 18 aa, Mycobacterium
REGSQFGQYRLRRLVGRG

SEQ ID NO: 325567 - protein, 20 aa, Mycobacterium
REGVGRMPIGMLIPTAALIV

SEQ ID NO: 325568 - protein, 20 aa, Mycobacterium
REHADFLAVTMIDLDKFKVL

SEQ ID NO: 325569 - protein, 35 aa, Mycobacterium
REHISLRPLWGIDQRLKRFGAMAAAMVLYVLISQL

SEQ ID NO: 325570 - protein, 18 aa, Mycobacterium
REHLDVVELFGSRSGDTV

SEQ ID NO: 325571 - protein, 21 aa, Mycobacterium
REIAQYDLPASLVVFLVALPL

SEQ ID NO: 325572 - protein, 19 aa, Mycobacterium
REIARGSTLISVTQQVGGS

SEQ ID NO: 325573 - protein, 24 aa, Mycobacterium
REIATRTVAVFAHRLYGAITSAHY

SEQ ID NO: 325574 - protein, 17 aa, Mycobacterium
REICERYGIPYNSGPLP

SEQ ID NO: 325575 - protein, 19 aa, Mycobacterium
REIDEARDRLALTVDSLAE

SEQ ID NO: 325576 - protein, 20 aa, Mycobacterium
REIDGLLPTLIRGQGTEFDS

SEQ ID NO: 325577 - protein, 21 aa, Mycobacterium
REIDHRVRLLFGLLAALQLML

SEQ ID NO: 325578 - protein, 21 aa, Mycobacterium
REIDYRFTLANERTFLSWIRT

SEQ ID NO: 325579 - protein, 21 aa, Mycobacterium
REIGAQLGIGIGKPAVIGSEI

SEQ ID NO: 325580 - protein, 17 aa, Mycobacterium
REIGLQRQLSRITRRAL

SEQ ID NO: 325581 - protein, 23 aa, Mycobacterium
REILPNIAPTVIIYWAVQLPTNI

SEQ ID NO: 325582 - protein, 18 aa, Mycobacterium
REIRVVAGIVTILLAVAL

SEQ ID NO: 325583 - protein, 22 aa, Mycobacterium
REISGRVSLCVAWSAAVVAFHN

SEQ ID NO: 325584 - protein, 23 aa, Mycobacterium
REITRPVLDYVKRAREESPRTVV

SEQ ID NO: 325585 - protein, 20 aa, Mycobacterium
REITRPVLDYVKRITKESPR

SEQ ID NO: 325586 - protein, 21 aa, Mycobacterium
REITRPVLDYVKRVSKESPRT

SEQ ID NO: 325587 - protein, 21 aa, Mycobacterium
REITRPVLDYVKRVTKDSPRT

SEQ ID NO: 325588 - protein, 24 aa, Mycobacterium
REITRPVLEYVKRAREESPRTVVT

SEQ ID NO: 325589 - protein, 28 aa, Mycobacterium
REIVVPRPRVFRLRADLPVPQALHALAA

SEQ ID NO: 325590 - protein, 26 aa, Mycobacterium
REKPPRLYQAAAWVVIVAGVIFIAWS

SEQ ID NO: 325591 - protein, 21 aa, Mycobacterium
RELAAELGLNPWAVEDAVAAA

SEQ ID NO: 325592 - protein, 21 aa, Mycobacterium
RELAPRAQIIAAVRETDNEHL

SEQ ID NO: 325593 - protein, 21 aa, Mycobacterium
RELDAALLAAVGFGNTGADVF

SEQ ID NO: 325594 - protein, 24 aa, Mycobacterium
RELDDAANWLALRLSRAGVVPGGC

SEQ ID NO: 325595 - protein, 19 aa, Mycobacterium
RELFQEVFLNPGLALLLGG

SEQ ID NO: 325596 - protein, 17 aa, Mycobacterium
RELFWPFGVYALIILAV

SEQ ID NO: 325597 - protein, 24 aa, Mycobacterium
RELGVMPLFPALLMVWGTARTTAL

SEQ ID NO: 325598 - protein, 17 aa, Mycobacterium
RELLNAVVPQVVPSWIA

SEQ ID NO: 325599 - protein, 21 aa, Mycobacterium
RELLRLPRIERIVQVELDPAV

SEQ ID NO: 325600 - protein, 18 aa, Mycobacterium
RELLRVVLEAVGDRARVI

SEQ ID NO: 325601 - protein, 29 aa, Mycobacterium
RELLSGISFSARPGVFTAIAGPSPARSSA

SEQ ID NO: 325602 - protein, 21 aa, Mycobacterium
RELMGRAGSVADLLAAESSLT

SEQ ID NO: 325603 - protein, 20 aa, Mycobacterium
RELMNQLKLLNAKVESRNPN

SEQ ID NO: 325604 - protein, 21 aa, Mycobacterium
RELPDCIIVSVSHRPALERLH

SEQ ID NO: 325605 - protein, 19 aa, Mycobacterium
RELPDCIVVSASHRSTVEP

SEQ ID NO: 325606 - protein, 17 aa, Mycobacterium
RELPLALSRLGVPGTVI

SEQ ID NO: 325607 - protein, 17 aa, Mycobacterium
RELPSYWTPFASPAVTL

SEQ ID NO: 325608 - protein, 20 aa, Mycobacterium
RELRVGDRMLVKPGERIATD

SEQ ID NO: 325609 - protein, 33 aa, Mycobacterium
RELSGQWSRLKWQIPAVLLGALIGSFLLLHLPE

SEQ ID NO: 325610 - protein, 17 aa, Mycobacterium
RELVLRDLFALYDSDAQ

SEQ ID NO: 325611 - protein, 19 aa, Mycobacterium
RELWIGAVIASLVVGVIVW

SEQ ID NO: 325612 - protein, 19 aa, Mycobacterium
RELWIGSVIAAFVVGGIVY

SEQ ID NO: 325613 - protein, 20 aa, Mycobacterium
RELWLAWGTLVVFYNIFFVV

SEQ ID NO: 325614 - protein, 21 aa, Mycobacterium
RELWLAWWTLVVFYNIFFPMF

SEQ ID NO: 325615 - protein, 21 aa, Mycobacterium
RELWLAWWTLVVFYNLFVLVF

SEQ ID NO: 325616 - protein, 20 aa, Mycobacterium
REMLVPLVPAAVIALALIVL

SEQ ID NO: 325617 - protein, 22 aa, Mycobacterium
REMQRLRLTAPMVLVLTGMAIS

SEQ ID NO: 325618 - protein, 23 aa, Mycobacterium
RENDIWLLGAIGPRMVYSTNLDA

SEQ ID NO: 325619 - protein, 22 aa, Mycobacterium
RENGSAWILRVAGLHTLTVGCS

SEQ ID NO: 325620 - protein, 18 aa, Mycobacterium
RENLKTVVDEAAVAVGGL

SEQ ID NO: 325621 - protein, 17 aa, Mycobacterium
RENVVALTVLWLLNIGE

SEQ ID NO: 325622 - protein, 30 aa, Mycobacterium
RENVVALTVLWLLNIGEYLQDLTLRRTRRA

SEQ ID NO: 325623 - protein, 19 aa, Mycobacterium
REPDLPRGFKVPGYPVTPI

SEQ ID NO: 325624 - protein, 19 aa, Mycobacterium
REPDLPRSFKVPGYPVTPV

SEQ ID NO: 325625 - protein, 31 aa, Mycobacterium
REPERLWEVSELRFAAVAGVVLLAGYVVGWT

SEQ ID NO: 325626 - protein, 20 aa, Mycobacterium
REPERLWQIKELQFAAISGV

SEQ ID NO: 325627 - protein, 20 aa, Mycobacterium
REPGSWAAPVSEARPDAEPE

SEQ ID NO: 325628 - protein, 24 aa, Mycobacterium
REPGWRYRLAINLSAGILSTVVVG

SEQ ID NO: 325629 - protein, 30 aa, Mycobacterium
REPQRLWHVRKLRRATLSGALLGASVIVAW

SEQ ID NO: 325630 - protein, 26 aa, Mycobacterium
REPQSWPAAETMAGPVAPRPGGTGWS

SEQ ID NO: 325631 - protein, 20 aa, Mycobacterium
REPRPGGAPTEIIPIVDDAS

SEQ ID NO: 325632 - protein, 34 aa, Mycobacterium
REPRSVARWIRRLAVPIILGWLLLAVALNALVPQ

SEQ ID NO: 325633 - protein, 21 aa, Mycobacterium
REPWFRRYATTYLLFAPISLG

SEQ ID NO: 325634 - protein, 25 aa, Mycobacterium
REQPRLSRRWILIAVAALVLVAGVI

SEQ ID NO: 325635 - protein, 19 aa, Mycobacterium
REQPWTPILIIVVITGVKI

SEQ ID NO: 325636 - protein, 21 aa, Mycobacterium
REQPWTPIVIILVITAVKILG

SEQ ID NO: 325637 - protein, 21 aa, Mycobacterium
REQPWTPIVIILVITAVKIVG

SEQ ID NO: 325638 - protein, 17 aa, Mycobacterium
REQRYHWIAGTFEPIPF

SEQ ID NO: 325639 - protein, 20 aa, Mycobacterium
RERAALVILGLVSGVFFVTC

SEQ ID NO: 325640 - protein, 25 aa, Mycobacterium
RERDRLRDLFGRHVGEEVARRAVDL

SEQ ID NO: 325641 - protein, 30 aa, Mycobacterium
RERELPPAVAFWLMLGIPLGTVWSEEAAFR

SEQ ID NO: 325642 - protein, 27 aa, Mycobacterium
RERGGSLGRWLIAVAVLAVLTVLVTIG

SEQ ID NO: 325643 - protein, 21 aa, Mycobacterium
RERIFERLVRLDAGRGRDHGG

SEQ ID NO: 325644 - protein, 20 aa, Mycobacterium
RERIGYTGAYPVIAHTPMLD

SEQ ID NO: 325645 - protein, 26 aa, Mycobacterium
RERKRMSWQRWALLFVGIAQVAVGIV

SEQ ID NO: 325646 - protein, 27 aa, Mycobacterium
RERLGEFWGYLAGWSFAVGKTASCAAM

SEQ ID NO: 325647 - protein, 21 aa, Mycobacterium
RERMVAIKLLRPEMAADHSFQ

SEQ ID NO: 325648 - protein, 24 aa, Mycobacterium
RERNRVATFAAIFLAGGVLFTLTV

SEQ ID NO: 325649 - protein, 28 aa, Mycobacterium
RERRKWWRRVWLAFPLGLVAMASTMFFG

SEQ ID NO: 325650 - protein, 19 aa, Mycobacterium
RERRTRQIVQMAGRGGSFV

SEQ ID NO: 325651 - protein, 21 aa, Mycobacterium
RERRVASWLAAVIVPSLICAI

SEQ ID NO: 325652 - protein, 26 aa, Mycobacterium
RERRVTSWLAALIVPSIICAITVTAL

SEQ ID NO: 325653 - protein, 25 aa, Mycobacterium
RERRWAGRCLAAAAAAFAVLVLAEY

SEQ ID NO: 325654 - protein, 17 aa, Mycobacterium
RERVLGLMRAILCELVF

SEQ ID NO: 325655 - protein, 19 aa, Mycobacterium
RERVVALKLMSPTLSSDPV

SEQ ID NO: 325656 - protein, 23 aa, Mycobacterium
RESDIWLLGAIGPRMVYSTNLDA

SEQ ID NO: 325657 - protein, 19 aa, Mycobacterium
RESGTLIWLILLLAAFSWM

SEQ ID NO: 325658 - protein, 25 aa, Mycobacterium
RESKRLRGSDNWWRFIRNSRIPEPP

SEQ ID NO: 325659 - protein, 17 aa, Mycobacterium
RESLRAIGRILPLALLL

SEQ ID NO: 325660 - protein, 33 aa, Mycobacterium
RESYDWLARELPNLRAAFRWTADRNDMDTCAPI

SEQ ID NO: 325661 - protein, 17 aa, Mycobacterium
RETHAWVAYGLLACIVA

SEQ ID NO: 325662 - protein, 29 aa, Mycobacterium
RETNSWRWPAFAWCYMFVLAWTMAFVARS

SEQ ID NO: 325663 - protein, 27 aa, Mycobacterium
RETNSWRWPAVAFSYMFGLAWVAAFAA

SEQ ID NO: 325664 - protein, 17 aa, Mycobacterium
RETSPCSAYLPEVIDTV

SEQ ID NO: 325665 - protein, 20 aa, Mycobacterium
RETTLPWGLEIFYRRDPSGY

SEQ ID NO: 325666 - protein, 24 aa, Mycobacterium
REVARASRLLGIAVLVIAVVVIAT

SEQ ID NO: 325667 - protein, 25 aa, Mycobacterium
REVIPRLGTAVKHSRAAAWTAAGLF

SEQ ID NO: 325668 - protein, 20 aa, Mycobacterium
REVLEKVALPHLADRLDEEQ

SEQ ID NO: 325669 - protein, 20 aa, Mycobacterium
REVLPRDVIEREPEPAPEAQ

SEQ ID NO: 325670 - protein, 19 aa, Mycobacterium
REVLPRDVVEKEAREPEPE

SEQ ID NO: 325671 - protein, 19 aa, Mycobacterium
REVLPRDVVEREPEPAPQA

SEQ ID NO: 325672 - protein, 25 aa, Mycobacterium
REVLPRLGPAVAGSRAAMWAAGLVL

SEQ ID NO: 325673 - protein, 20 aa, Mycobacterium
REVLPRLGPAVTSSKAANWA

SEQ ID NO: 325674 - protein, 35 aa, Mycobacterium
REVLRVEVKVASPILKSGLCLVDTPGVGGFGQPHL

SEQ ID NO: 325675 - protein, 20 aa, Mycobacterium
REVMVPRTEMVWIEADKTAG

SEQ ID NO: 325676 - protein, 19 aa, Mycobacterium
REVMVPRTEMVWIESDKTA

SEQ ID NO: 325677 - protein, 23 aa, Mycobacterium
REVPDVSGLSYADAVRRLTDAGF

SEQ ID NO: 325678 - protein, 23 aa, Mycobacterium
REVREISALVIVQFVETMTGIKA

SEQ ID NO: 325679 - protein, 21 aa, Mycobacterium
REVTRPVLDYVKRVSKESPRT

SEQ ID NO: 325680 - protein, 18 aa, Mycobacterium
REVVELRRAVSPLVTDLE

SEQ ID NO: 325681 - protein, 28 aa, Mycobacterium
REWYESRFLPRVGPWALYGLLFTIVVLF

SEQ ID NO: 325682 - protein, 25 aa, Mycobacterium
REYISRGVGGHGWFQGSVSNPRDPG

SEQ ID NO: 325683 - protein, 17 aa, Mycobacterium
REYPAALRRLATLLRAT

SEQ ID NO: 325684 - protein, 26 aa, Mycobacterium
REYPSTLKISIVERVPVVVKDYPDGP

SEQ ID NO: 325685 - protein, 17 aa, Mycobacterium
REYWLASGAARPATPNP

SEQ ID NO: 325686 - protein, 17 aa, Mycobacterium
REYWLASGAARPATPSP

SEQ ID NO: 325687 - protein, 19 aa, Mycobacterium
RFAALEFSGFFGSTYCPGV

SEQ ID NO: 325688 - protein, 21 aa, Mycobacterium
RFADRRGRRAALTFSVSLMAL

SEQ ID NO: 325689 - protein, 19 aa, Mycobacterium
RFAENIMYYLVVTFSIVYL

SEQ ID NO: 325690 - protein, 19 aa, Mycobacterium
RFAESFWMFLPRSMFGSLK

SEQ ID NO: 325691 - protein, 24 aa, Mycobacterium
RFALKRGALMFGKLLPAGIGAVIG

SEQ ID NO: 325692 - protein, 21 aa, Mycobacterium
RFAQPDALLRFGIGLDGVATG

SEQ ID NO: 325693 - protein, 20 aa, Mycobacterium
RFARDLRTGLLRKLSRLPLG

SEQ ID NO: 325694 - protein, 19 aa, Mycobacterium
RFARFPAGRGLLLTDTDTP

SEQ ID NO: 325695 - protein, 18 aa, Mycobacterium
RFARRPLIASGYGMAALG

SEQ ID NO: 325696 - protein, 21 aa, Mycobacterium
RFASLPGLVALTGRWDLAPGT

SEQ ID NO: 325697 - protein, 22 aa, Mycobacterium
RFATRFGAVVVDGFGSTEGGVA

SEQ ID NO: 325698 - protein, 21 aa, Mycobacterium
RFAVHVIEFLLLLSSLGGLAV

SEQ ID NO: 325699 - protein, 20 aa, Mycobacterium
RFDAEAAIAQASRYAADTFT

SEQ ID NO: 325700 - protein, 26 aa, Mycobacterium
RFDEADLRCAIGLFAEDAHIFATTIR

SEQ ID NO: 325701 - protein, 27 aa, Mycobacterium
RFDETWPLLTGFVWLGGLLIVASVVLT

SEQ ID NO: 325702 - protein, 20 aa, Mycobacterium
RFDKADAYWTIRGWSARGPI

SEQ ID NO: 325703 - protein, 20 aa, Mycobacterium
RFDPATLWRGQARRDRLRVP

SEQ ID NO: 325704 - protein, 38 aa, Mycobacterium
RFDPQSGKWTKLVGMPTPRGSYGATFIDGRIVVVGGEE

SEQ ID NO: 325705 - protein, 25 aa, Mycobacterium
RFDRAKAYWTRHGWAAQAPIKTESR

SEQ ID NO: 325706 - protein, 24 aa, Mycobacterium
RFDRAKAYWTRQGWAARAPIKTES

SEQ ID NO: 325707 - protein, 18 aa, Mycobacterium
RFDVAHVVMAPTLDADED

SEQ ID NO: 325708 - protein, 23 aa, Mycobacterium
RFELPMMAVAALLFWGLAADGNL

SEQ ID NO: 325709 - protein, 29 aa, Mycobacterium
RFEPQQIVRWCLSLALIPAVVLLVLAGFG

SEQ ID NO: 325710 - protein, 24 aa, Mycobacterium
RFEQGIPAAIAWVFMPALFGVTLS

SEQ ID NO: 325711 - protein, 35 aa, Mycobacterium
RFESPRPGDVIVFKGPPNWNLGYKSIRSNNTVLRW

SEQ ID NO: 325712 - protein, 18 aa, Mycobacterium
RFFGEALYHRSRTAAARC

SEQ ID NO: 325713 - protein, 22 aa, Mycobacterium
RFGAFGGWACVRSCWAVMLAMA

SEQ ID NO: 325714 - protein, 17 aa, Mycobacterium
RFGFLITALCLFTAVFI

SEQ ID NO: 325715 - protein, 18 aa, Mycobacterium
RFGGLPVITPALVRSVHA

SEQ ID NO: 325716 - protein, 21 aa, Mycobacterium
RFGIWEFGGYGAAAAIGILAF

SEQ ID NO: 325717 - protein, 17 aa, Mycobacterium
RFGPLTPPRAVAIISQV

SEQ ID NO: 325718 - protein, 18 aa, Mycobacterium
RFGRKRLLMTGLVIFGLV

SEQ ID NO: 325719 - protein, 22 aa, Mycobacterium
RFGRRKIIIGSLVFFGVMCTAT

SEQ ID NO: 325720 - protein, 18 aa, Mycobacterium
RFGSGKRYHAMFSTASDL

SEQ ID NO: 325721 - protein, 20 aa, Mycobacterium
RFGTKRLWMGSILAFTLGSL

SEQ ID NO: 325722 - protein, 20 aa, Mycobacterium
RFGTKRMFMGSILVFTLSSL

SEQ ID NO: 325723 - protein, 18 aa, Mycobacterium
RFGTMAAAMVLYVLISQL

SEQ ID NO: 325724 - protein, 19 aa, Mycobacterium
RFGVDSALDDAVRGLRARL

SEQ ID NO: 325725 - protein, 18 aa, Mycobacterium
RFGWSQAPTWLVIVGEVL

SEQ ID NO: 325726 - protein, 20 aa, Mycobacterium
RFGYKPMIVAGCLVRTGGFV

SEQ ID NO: 325727 - protein, 18 aa, Mycobacterium
RFHAHWVNQAAVTFASGD

SEQ ID NO: 325728 - protein, 20 aa, Mycobacterium
RFHQGWPAAILFLLIPSVVV

SEQ ID NO: 325729 - protein, 26 aa, Mycobacterium
RFHREADAAAALWHPHIVAVHDRGET

SEQ ID NO: 325730 - protein, 18 aa, Mycobacterium
RFIEALSLEQPVYSTDPE

SEQ ID NO: 325731 - protein, 22 aa, Mycobacterium
RFIGTRWVPPVLAVVVLVVGSL

SEQ ID NO: 325732 - protein, 17 aa, Mycobacterium
RFIIGTVLTTPVLYAVM

SEQ ID NO: 325733 - protein, 33 aa, Mycobacterium
RFIREADMAATLWHPHIVGVHDRGEFEGRLWIS

SEQ ID NO: 325734 - protein, 26 aa, Mycobacterium
RFIREADVAAALWHPNIVRVHDRGEH

SEQ ID NO: 325735 - protein, 27 aa, Mycobacterium
RFLDFDSGEFLKVMLRWLNAFVSKPGQ

SEQ ID NO: 325736 - protein, 24 aa, Mycobacterium
RFLGPAEAVLLCLTSAALATLGIW

SEQ ID NO: 325737 - protein, 22 aa, Mycobacterium
RFLPSRWWSMTPLDGLVSAMLV

SEQ ID NO: 325738 - protein, 19 aa, Mycobacterium
RFLQGAALAAVFLTVTLAR

SEQ ID NO: 325739 - protein, 26 aa, Mycobacterium
RFLRESRAAAILQEPHVIPIHDWGEI

SEQ ID NO: 325740 - protein, 21 aa, Mycobacterium
RFLVLGLEFQLAADVLRTAIS

SEQ ID NO: 325741 - protein, 18 aa, Mycobacterium
RFMLLRVAGAIDQARRER

SEQ ID NO: 325742 - protein, 19 aa, Mycobacterium
RFMLSDGLGNLGGPFTKLR

SEQ ID NO: 325743 - protein, 20 aa, Mycobacterium
RFMPDPQPMRTPGAQPLDRP

SEQ ID NO: 325744 - protein, 29 aa, Mycobacterium
RFNREADAAASLWHPHIVAVHDRGETDGQ

SEQ ID NO: 325745 - protein, 25 aa, Mycobacterium
RFNREADIAAGLWHPHIVGLHDRGE

SEQ ID NO: 325746 - protein, 26 aa, Mycobacterium
RFNREADVAAALWHPHIVEIHDRGEH

SEQ ID NO: 325747 - protein, 18 aa, Mycobacterium
RFPLMISTALGVLIIGVV

SEQ ID NO: 325748 - protein, 21 aa, Mycobacterium
RFPSEWTYAQGLLFIVVVGFF

SEQ ID NO: 325749 - protein, 38 aa, Mycobacterium
RFPTLLMGLACWWVISREVIPRLGAAAKHSRAAAWTAA

SEQ ID NO: 325750 - protein, 20 aa, Mycobacterium
RFQFQEFVRQGAFMAGTAVL

SEQ ID NO: 325751 - protein, 23 aa, Mycobacterium
RFQKCLFDLSFAFAVLLITSPLL

SEQ ID NO: 325752 - protein, 26 aa, Mycobacterium
RFQLGITGMSCFACARKVQSTLNKVP

SEQ ID NO: 325753 - protein, 17 aa, Mycobacterium
RFQSWLPALKEMVPSLG

SEQ ID NO: 325754 - protein, 19 aa, Mycobacterium
RFQWAEFVRQGAFMAATAV

SEQ ID NO: 325755 - protein, 21 aa, Mycobacterium
RFQWQEFIRQGAFMASTAVVP

SEQ ID NO: 325756 - protein, 19 aa, Mycobacterium
RFRALRLGLMIGGSIALIP

SEQ ID NO: 325757 - protein, 21 aa, Mycobacterium
RFRKGLMGVIVVALIIGVGST

SEQ ID NO: 325758 - protein, 20 aa, Mycobacterium
RFRPSRRSPASASRRYPRFP

SEQ ID NO: 325759 - protein, 18 aa, Mycobacterium
RFRRGCAAVPARRAGTAA

SEQ ID NO: 325760 - protein, 17 aa, Mycobacterium
RFRSSRVGVTLTVALAV

SEQ ID NO: 325761 - protein, 17 aa, Mycobacterium
RFRVRRTTKLLAVLGAA

SEQ ID NO: 325762 - protein, 26 aa, Mycobacterium
RFSARARWAVALVCAMLVAVAATCSA

SEQ ID NO: 325763 - protein, 28 aa, Mycobacterium
RFSDDPLRIGVASIWLSVIVLLPLAAIV

SEQ ID NO: 325764 - protein, 19 aa, Mycobacterium
RFSEGIARFLGTGRYLAIQ

SEQ ID NO: 325765 - protein, 18 aa, Mycobacterium
RFSKELLVHSSTDDASPR

SEQ ID NO: 325766 - protein, 17 aa, Mycobacterium
RFSSCGEFADQLSRHLD

SEQ ID NO: 325767 - protein, 17 aa, Mycobacterium
RFTDRFAKFNLDPAAVR

SEQ ID NO: 325768 - protein, 27 aa, Mycobacterium
RFTELVTLPAGWAWLENGWVMTIVAAL

SEQ ID NO: 325769 - protein, 26 aa, Mycobacterium
RFTGKAVWWAASRQLLFGAAAVAATY

SEQ ID NO: 325770 - protein, 28 aa, Mycobacterium
RFTGPEMWWVLRVAHWAAGVPMATVPVP

SEQ ID NO: 325771 - protein, 19 aa, Mycobacterium
RFTGRRLGIYTAVITISVV

SEQ ID NO: 325772 - protein, 24 aa, Mycobacterium
RFTGWEWVLTALALPVVTWAAWPF

SEQ ID NO: 325773 - protein, 19 aa, Mycobacterium
RFTPVVWGVLIGFVALYLL

SEQ ID NO: 325774 - protein, 23 aa, Mycobacterium
RFTTWGRQFWRVTGGYFVGRESI

SEQ ID NO: 325775 - protein, 21 aa, Mycobacterium
RFVACPFGEPGARMYRTGDLV

SEQ ID NO: 325776 - protein, 18 aa, Mycobacterium
RFVACPFGEPGGRMYRTG

SEQ ID NO: 325777 - protein, 19 aa, Mycobacterium
RFVDLLARERVTVLNQTPS

SEQ ID NO: 325778 - protein, 26 aa, Mycobacterium
RFVEARAAAGVGRRPKAVVVEAEPVV

SEQ ID NO: 325779 - protein, 25 aa, Mycobacterium
RFVFPMTAVFLVWYTTYVLLGAFAT

SEQ ID NO: 325780 - protein, 30 aa, Mycobacterium
RFVGALAVFCAACWLIALLAHNYRHEDWQA

SEQ ID NO: 325781 - protein, 33 aa, Mycobacterium
RFVSACRRRYGDVFTLRIASMGTWVYLADPADI

SEQ ID NO: 325782 - protein, 19 aa, Mycobacterium
RFVTTFGVISMLADIVYEG

SEQ ID NO: 325783 - protein, 17 aa, Mycobacterium
RFWLIPLGLVWLAFLPN

SEQ ID NO: 325784 - protein, 19 aa, Mycobacterium
RGAALASAHAPLFASSTAA

SEQ ID NO: 325785 - protein, 25 aa, Mycobacterium
RGAAPETFVALALPRSIDMVVALFA

SEQ ID NO: 325786 - protein, 30 aa, Mycobacterium
RGAAVLAARIMWRLAARPSTHARRVQQLLG

SEQ ID NO: 325787 - protein, 18 aa, Mycobacterium
RGACEVMADFARLYPYQV

SEQ ID NO: 325788 - protein, 18 aa, Mycobacterium
RGAFLGGVAQTLLLVAEF

SEQ ID NO: 325789 - protein, 18 aa, Mycobacterium
RGAISRILGHDVGFGPPL

SEQ ID NO: 325790 - protein, 17 aa, Mycobacterium
RGALAAVIAVAFLATGL

SEQ ID NO: 325791 - protein, 25 aa, Mycobacterium
RGALLSAFIMWTKVIYRRLARRVAR

SEQ ID NO: 325792 - protein, 27 aa, Mycobacterium
RGALPSIPRWLWILLALGFGTAALAGG

SEQ ID NO: 325793 - protein, 18 aa, Mycobacterium
RGALPTLIRAGAAALGSA

SEQ ID NO: 325794 - protein, 25 aa, Mycobacterium
RGAMPRIALVIVIFMPLLYGAMYLW

SEQ ID NO: 325795 - protein, 24 aa, Mycobacterium
RGANAKAAFVWNKFPKFVLGFLAV

SEQ ID NO: 325796 - protein, 23 aa, Mycobacterium
RGANRPAAWDMRSVLTIATALGI

SEQ ID NO: 325797 - protein, 31 aa, Mycobacterium
RGAPKVVRGGARFRMPGIERVDIMSLEPFNV

SEQ ID NO: 325798 - protein, 24 aa, Mycobacterium
RGAPRGSAVALVLLGGIAVVGGIL

SEQ ID NO: 325799 - protein, 17 aa, Mycobacterium
RGAQMGVLIKGPEVLES

SEQ ID NO: 325800 - protein, 23 aa, Mycobacterium
RGASAFLPYGYLGIWAAVPFAIW

SEQ ID NO: 325801 - protein, 26 aa, Mycobacterium
RGAVPSMPRWLFVVLAFGGLTAALAG

SEQ ID NO: 325802 - protein, 18 aa, Mycobacterium
RGAVRLRELVLAQPQVAI

SEQ ID NO: 325803 - protein, 17 aa, Mycobacterium
RGAVSLAAALAVPMTTH

SEQ ID NO: 325804 - protein, 17 aa, Mycobacterium
RGAVSLAAALAVPMTTR

SEQ ID NO: 325805 - protein, 17 aa, Mycobacterium
RGAVSLAAALAVPTTTL

SEQ ID NO: 325806 - protein, 21 aa, Mycobacterium
RGCAYEWTHHVSLARQAGISD

SEQ ID NO: 325807 - protein, 42 aa, Mycobacterium
RGCQPRLAVPGVLARLVLLWFLCSAIPIGVIAAFVVLRSYGW

SEQ ID NO: 325808 - protein, 24 aa, Mycobacterium
RGDARFRLATLALTFAAVVVIGLL

SEQ ID NO: 325809 - protein, 18 aa, Mycobacterium
RGDFTPKVKLTMFSERAG

SEQ ID NO: 325810 - protein, 21 aa, Mycobacterium
RGDGPGFGFGPTIGASTGATA

SEQ ID NO: 325811 - protein, 19 aa, Mycobacterium
RGDHPLLVCDGDRIGYAEA

SEQ ID NO: 325812 - protein, 23 aa, Mycobacterium
RGDLCGLIGIAIAWVVVGQVWFG

SEQ ID NO: 325813 - protein, 19 aa, Mycobacterium
RGDLGYSLTDGRTVTELLG

SEQ ID NO: 325814 - protein, 17 aa, Mycobacterium
RGDLMVQAPLYFHIHVM

SEQ ID NO: 325815 - protein, 17 aa, Mycobacterium
RGDMEMVLLVSSDDGVR

SEQ ID NO: 325816 - protein, 19 aa, Mycobacterium
RGDPCWRDLTCLYYHHETQ

SEQ ID NO: 325817 - protein, 19 aa, Mycobacterium
RGDPCWRNLTCLYYHHETQ

SEQ ID NO: 325818 - protein, 22 aa, Mycobacterium
RGDPGMWSWLLHRISGATIFFF

SEQ ID NO: 325819 - protein, 19 aa, Mycobacterium
RGDPLWRILVAKNLAMAAM

SEQ ID NO: 325820 - protein, 19 aa, Mycobacterium
RGDPRVRALLSLMAVTGPY

SEQ ID NO: 325821 - protein, 21 aa, Mycobacterium
RGDVFGLRRWYVITFLMGLFF

SEQ ID NO: 325822 - protein, 21 aa, Mycobacterium
RGEAIAGLVMSAGWVAVLFAL

SEQ ID NO: 325823 - protein, 21 aa, Mycobacterium
RGEAPPAVFDAERLDSDRADK

SEQ ID NO: 325824 - protein, 24 aa, Mycobacterium
RGEDAGRIWISMDYVEGADAAHLL

SEQ ID NO: 325825 - protein, 22 aa, Mycobacterium
RGEFEGRLWISMDHVEGTDAAR

SEQ ID NO: 325826 - protein, 19 aa, Mycobacterium
RGEFLRLLSNITWGNGSIV

SEQ ID NO: 325827 - protein, 23 aa, Mycobacterium
RGEFNGRLWISMEYVDGTDAGRL

SEQ ID NO: 325828 - protein, 22 aa, Mycobacterium
RGEFQDRLWISMEYVDGTDVAR

SEQ ID NO: 325829 - protein, 18 aa, Mycobacterium
RGEFSLIIIGLVGVSIPT

SEQ ID NO: 325830 - protein, 22 aa, Mycobacterium
RGEHDGQLWIAMDYVDGTDAAR

SEQ ID NO: 325831 - protein, 18 aa, Mycobacterium
RGEHPLLVCDGDRISYRD

SEQ ID NO: 325832 - protein, 24 aa, Mycobacterium
RGEKPRRNSLRTLIPVSVRTPDAM

SEQ ID NO: 325833 - protein, 26 aa, Mycobacterium
RGEPLPWQDLRAAFTERGWLDLTHTR

SEQ ID NO: 325834 - protein, 19 aa, Mycobacterium
RGESIPAFANALVSLGAAG

SEQ ID NO: 325835 - protein, 24 aa, Mycobacterium
RGETGYDLRLRAGIDTGTVSSGLV

SEQ ID NO: 325836 - protein, 17 aa, Mycobacterium
RGEVELPLRVRESDANP

SEQ ID NO: 325837 - protein, 17 aa, Mycobacterium
RGEVVSIGFVISLWAGS

SEQ ID NO: 325838 - protein, 17 aa, Mycobacterium
RGFAAELGLDMAAFDAA

SEQ ID NO: 325839 - protein, 18 aa, Mycobacterium
RGFAAELGLDMAAFDAAY

SEQ ID NO: 325840 - protein, 17 aa, Mycobacterium
RGFALDLADGGHEHART

SEQ ID NO: 325841 - protein, 20 aa, Mycobacterium
RGFGAYPTRTWARPSTFGVP

SEQ ID NO: 325842 - protein, 19 aa, Mycobacterium
RGFRTASLAPRERRVTSWL

SEQ ID NO: 325843 - protein, 21 aa, Mycobacterium
RGGAGIKVRLVKGANLPMEHV

SEQ ID NO: 325844 - protein, 18 aa, Mycobacterium
RGGAPNTPGHEWAAPSGE

SEQ ID NO: 325845 - protein, 18 aa, Mycobacterium
RGGARVYWVLLWVSFALA

SEQ ID NO: 325846 - protein, 17 aa, Mycobacterium
RGGDLLLLIGALLANGL

SEQ ID NO: 325847 - protein, 25 aa, Mycobacterium
RGGELPEPLLRSAMVTLAGTEPATV

SEQ ID NO: 325848 - protein, 18 aa, Mycobacterium
RGGFGGWSPTSFGGSPGS

SEQ ID NO: 325849 - protein, 17 aa, Mycobacterium
RGGFGGWSPTSFGGSSG

SEQ ID NO: 325850 - protein, 18 aa, Mycobacterium
RGGFGGWSPTSFGGSSGG

SEQ ID NO: 325851 - protein, 20 aa, Mycobacterium
RGGFGHGFGGFGGGHGFGGG

SEQ ID NO: 325852 - protein, 18 aa, Mycobacterium
RGGGFGFGGPHRGERDDD

SEQ ID NO: 325853 - protein, 18 aa, Mycobacterium
RGGGRAVAVVAGIAVTVT

SEQ ID NO: 325854 - protein, 17 aa, Mycobacterium
RGGGYGGSDVDELDRYG

SEQ ID NO: 325855 - protein, 36 aa, Mycobacterium
RGGPGGRPGCWQTITRELWPAPFLVMDTGASMAPYN

SEQ ID NO: 325856 - protein, 17 aa, Mycobacterium
RGGRLLPWVLITGVVSW

SEQ ID NO: 325857 - protein, 33 aa, Mycobacterium
RGGRYWFDHGWNWRGLTAWLISAALSICFVNLP

SEQ ID NO: 325858 - protein, 18 aa, Mycobacterium
RGGTAFFLDKCFGTAIGG

SEQ ID NO: 325859 - protein, 18 aa, Mycobacterium
RGGVTFAAVCVAALLIVV

SEQ ID NO: 325860 - protein, 19 aa, Mycobacterium
RGGWSEMLRPPYSRATAFV

SEQ ID NO: 325861 - protein, 26 aa, Mycobacterium
RGHDRAFSWLPMYHDMGFIQVLGGLL

SEQ ID NO: 325862 - protein, 24 aa, Mycobacterium
RGHLDTALVVARCEYHPTPGCPQT

SEQ ID NO: 325863 - protein, 25 aa, Mycobacterium
RGHLPLLCCLVAFILTFFVTRTFVR

SEQ ID NO: 325864 - protein, 19 aa, Mycobacterium
RGHLWPINRSAADPVATTT

SEQ ID NO: 325865 - protein, 17 aa, Mycobacterium
RGHRLVFSNGIITLTAL

SEQ ID NO: 325866 - protein, 17 aa, Mycobacterium
RGHRRSRKALAAAGALV

SEQ ID NO: 325867 - protein, 24 aa, Mycobacterium
RGHTEILWTAAFVVALLQYLRPIA

SEQ ID NO: 325868 - protein, 18 aa, Mycobacterium
RGHTRTVQSLAFSPDGHT

SEQ ID NO: 325869 - protein, 33 aa, Mycobacterium
RGIDPEEFWRNAGLPAFRFPDPNGERHENGAPP

SEQ ID NO: 325870 - protein, 32 aa, Mycobacterium
RGIEPPCPACAGGDYSLCWSFADGDIKPGIHT

SEQ ID NO: 325871 - protein, 18 aa, Mycobacterium
RGIGNGMSLLIFVGIAAR

SEQ ID NO: 325872 - protein, 24 aa, Mycobacterium
RGIIGRLAIFGAVVIGYLLALVLG

SEQ ID NO: 325873 - protein, 31 aa, Mycobacterium
RGIKVPRPTATRFRLLWLRQLSDAVRTFRND

SEQ ID NO: 325874 - protein, 25 aa, Mycobacterium
RGIKVPRPTSTRFRLLRLRQISDAA

SEQ ID NO: 325875 - protein, 17 aa, Mycobacterium
RGILLGGVITLVFTAAN

SEQ ID NO: 325876 - protein, 37 aa, Mycobacterium
RGINPEEFWRNAGLPAFRFPDPNGVGFENGAPPPAPT

SEQ ID NO: 325877 - protein, 21 aa, Mycobacterium
RGIPYFPNLVLPITIGGIGIG

SEQ ID NO: 325878 - protein, 20 aa, Mycobacterium
RGIPYPGSWNSSLWTLAFEL

SEQ ID NO: 325879 - protein, 25 aa, Mycobacterium
RGIQWLSNINMVLAFVLALFIFLVG

SEQ ID NO: 325880 - protein, 17 aa, Mycobacterium
RGIRVGRIQSLRPTPTG

SEQ ID NO: 325881 - protein, 19 aa, Mycobacterium
RGIVPAPLLDLVEPDLRVI

SEQ ID NO: 325882 - protein, 23 aa, Mycobacterium
RGIYLRRVVFVGVFFTAHVIPLF

SEQ ID NO: 325883 - protein, 21 aa, Mycobacterium
RGKGAWENGALWVALVLGIGY

SEQ ID NO: 325884 - protein, 17 aa, Mycobacterium
RGKHCHPDSVAPRTARK

SEQ ID NO: 325885 - protein, 36 aa, Mycobacterium
RGKHPRGGLSGMLRGGRSRLGFGTLAVLLCLLLGIA

SEQ ID NO: 325886 - protein, 25 aa, Mycobacterium
RGKHRNRLWISMDFVDGTDASRLLH

SEQ ID NO: 325887 - protein, 20 aa, Mycobacterium
RGKRSAAIDLRAPRGAEVIA

SEQ ID NO: 325888 - protein, 17 aa, Mycobacterium
RGKVVLVDFWAYSCINC

SEQ ID NO: 325889 - protein, 19 aa, Mycobacterium
RGLAYASFDSGFVIADRLG

SEQ ID NO: 325890 - protein, 21 aa, Mycobacterium
RGLDLRLDRPVALKIMDSRYA

SEQ ID NO: 325891 - protein, 30 aa, Mycobacterium
RGLDMRPNPGIGFPGYVDYLPATRGTPQPP

SEQ ID NO: 325892 - protein, 19 aa, Mycobacterium
RGLEAHLSYRVCLKTLSPS

SEQ ID NO: 325893 - protein, 17 aa, Mycobacterium
RGLEAKGGARGVADAVN

SEQ ID NO: 325894 - protein, 17 aa, Mycobacterium
RGLERLVTFLALGVAAI

SEQ ID NO: 325895 - protein, 22 aa, Mycobacterium
RGLESHLSYRICLKTFSAAESR

SEQ ID NO: 325896 - protein, 24 aa, Mycobacterium
RGLESHLSYRLCLKTFSANESRAA

SEQ ID NO: 325897 - protein, 21 aa, Mycobacterium
RGLESRWASLSGDVVATGSAA

SEQ ID NO: 325898 - protein, 20 aa, Mycobacterium
RGLETHLSYRVCLKTFSAGE

SEQ ID NO: 325899 - protein, 19 aa, Mycobacterium
RGLGARWVAMNDLAWNTAG

SEQ ID NO: 325900 - protein, 19 aa, Mycobacterium
RGLGATIGRGVWCETYWLP

SEQ ID NO: 325901 - protein, 23 aa, Mycobacterium
RGLGGFTQVASWWSEPIVFEKVV

SEQ ID NO: 325902 - protein, 24 aa, Mycobacterium
RGLGRYVVIAALGGLRCRASRIVL

SEQ ID NO: 325903 - protein, 28 aa, Mycobacterium
RGLGRYVVISALGGLRCRASRIVLHPGF

SEQ ID NO: 325904 - protein, 19 aa, Mycobacterium
RGLGTRWVAMNDITLASAG

SEQ ID NO: 325905 - protein, 19 aa, Mycobacterium
RGLITVRLTPDFDMAQVTR

SEQ ID NO: 325906 - protein, 26 aa, Mycobacterium
RGLKALSRAVGFTWRRSLQVRVVVSN

SEQ ID NO: 325907 - protein, 20 aa, Mycobacterium
RGLKRPWLFFVASFFTSFAF

SEQ ID NO: 325908 - protein, 24 aa, Mycobacterium
RGLLGRLAIFVAVAAGYLLAVFLG

SEQ ID NO: 325909 - protein, 19 aa, Mycobacterium
RGLLLPEEFLPAAERAGLM

SEQ ID NO: 325910 - protein, 20 aa, Mycobacterium
RGLLPVLRYIIAGIGGSLGV

SEQ ID NO: 325911 - protein, 24 aa, Mycobacterium
RGLLRLLADLRRHRGLTVVVISHD

SEQ ID NO: 325912 - protein, 17 aa, Mycobacterium
RGLLRVLAVTGFLHVVA

SEQ ID NO: 325913 - protein, 19 aa, Mycobacterium
RGLMAFGALILIGAGVAPP

SEQ ID NO: 325914 - protein, 19 aa, Mycobacterium
RGLNEVAFPHFLESEQHPE

SEQ ID NO: 325915 - protein, 17 aa, Mycobacterium
RGLNLALATWVSAINFW

SEQ ID NO: 325916 - protein, 19 aa, Mycobacterium
RGLPGLSVAWGLWEQPSTM

SEQ ID NO: 325917 - protein, 25 aa, Mycobacterium
RGLPRGAAVSLVLLGGFSILGGILT

SEQ ID NO: 325918 - protein, 24 aa, Mycobacterium
RGLRPTWRSYRMVATVSLTWTVFT

SEQ ID NO: 325919 - protein, 26 aa, Mycobacterium
RGLRRPWLYFVSSLFTSFAFALAFYF

SEQ ID NO: 325920 - protein, 26 aa, Mycobacterium
RGLRSRAGGVVFAMLLVLTFSTAFNM

SEQ ID NO: 325921 - protein, 23 aa, Mycobacterium
RGLRYTTAIALVAVLVGGVYVLS

SEQ ID NO: 325922 - protein, 20 aa, Mycobacterium
RGMADGCWIAGTVLAVVPAS

SEQ ID NO: 325923 - protein, 17 aa, Mycobacterium
RGMEVIDLLAAAITVTL

SEQ ID NO: 325924 - protein, 19 aa, Mycobacterium
RGMTPRAALTKHLLDGDDS

SEQ ID NO: 325925 - protein, 20 aa, Mycobacterium
RGMTPRAALTKHLLDGDDSF

SEQ ID NO: 325926 - protein, 26 aa, Mycobacterium
RGNGRFLRWANVIFLSGLAIPLQAVV

SEQ ID NO: 325927 - protein, 26 aa, Mycobacterium
RGNVFTRINAILGVLFVIVLSTGSLI

SEQ ID NO: 325928 - protein, 19 aa, Mycobacterium
RGPALAVAVAVQWIANFVV

SEQ ID NO: 325929 - protein, 22 aa, Mycobacterium
RGPAWRVLGVVFGTIFFLMFAP

SEQ ID NO: 325930 - protein, 19 aa, Mycobacterium
RGPAYAVLGAALWIALYLA

SEQ ID NO: 325931 - protein, 22 aa, Mycobacterium
RGPEHPLWLGSIKSNIGHTQAA

SEQ ID NO: 325932 - protein, 17 aa, Mycobacterium
RGPEISLMLGYGTGTKL

SEQ ID NO: 325933 - protein, 17 aa, Mycobacterium
RGPILALAGRFVPMSIT

SEQ ID NO: 325934 - protein, 18 aa, Mycobacterium
RGPIPSYDAAAALRADAA

SEQ ID NO: 325935 - protein, 17 aa, Mycobacterium
RGPKMAIGGGVGGLLIA

SEQ ID NO: 325936 - protein, 20 aa, Mycobacterium
RGPMPPHAVAAVFNPLLGGL

SEQ ID NO: 325937 - protein, 24 aa, Mycobacterium
RGPMPPHAVAAVLRPVLGGLAAAH

SEQ ID NO: 325938 - protein, 24 aa, Mycobacterium
RGPMPPHAVAAVLRPVLGGLATAH

SEQ ID NO: 325939 - protein, 24 aa, Mycobacterium
RGPMPPHAVVAVLRPVLGGLAAAH

SEQ ID NO: 325940 - protein, 24 aa, Mycobacterium
RGPMPPYAVAAVLRPVLGGLAAAH

SEQ ID NO: 325941 - protein, 19 aa, Mycobacterium
RGPMPRWAEWASTAVDGLV

SEQ ID NO: 325942 - protein, 17 aa, Mycobacterium
RGPRKVVLIGLTLIAAG

SEQ ID NO: 325943 - protein, 19 aa, Mycobacterium
RGPVRFGGVAWAQHRGIRA

SEQ ID NO: 325944 - protein, 18 aa, Mycobacterium
RGPYLVGYVRDQLQTPLE

SEQ ID NO: 325945 - protein, 19 aa, Mycobacterium
RGPYRWLHHPNYVAVVAEG

SEQ ID NO: 325946 - protein, 20 aa, Mycobacterium
RGQIGEWIITRGLRIVMVLI

SEQ ID NO: 325947 - protein, 17 aa, Mycobacterium
RGQRTLLTRAIPFAVLG

SEQ ID NO: 325948 - protein, 22 aa, Mycobacterium
RGQYLPFTLGYQGVPAIFVSGT

SEQ ID NO: 325949 - protein, 35 aa, Mycobacterium
RGQYRRASLLLSDARRAGRLVADMLDLSRIDAGLP

SEQ ID NO: 325950 - protein, 21 aa, Mycobacterium
RGRAAGLLCRPRDIFVEQTVA

SEQ ID NO: 325951 - protein, 21 aa, Mycobacterium
RGRALGMVAFMAYFFSLYLRA

SEQ ID NO: 325952 - protein, 20 aa, Mycobacterium
RGRDRPKPLAALFLFLQTVS

SEQ ID NO: 325953 - protein, 19 aa, Mycobacterium
RGRGDERWCEIPVGAKPTG

SEQ ID NO: 325954 - protein, 19 aa, Mycobacterium
RGRIGIGLKLTNGRTAQAW

SEQ ID NO: 325955 - protein, 21 aa, Mycobacterium
RGRIMALWLVGFLGSRPFAAA

SEQ ID NO: 325956 - protein, 25 aa, Mycobacterium
RGRLPLLCCLVAFILTFFVTRTFAR

SEQ ID NO: 325957 - protein, 25 aa, Mycobacterium
RGRLPLLCCLVAFILTFFVTRTFVR

SEQ ID NO: 325958 - protein, 20 aa, Mycobacterium
RGRLVCPWHGSWFAAESGEV

SEQ ID NO: 325959 - protein, 20 aa, Mycobacterium
RGRLVCPWHGSWFAIESGDV

SEQ ID NO: 325960 - protein, 20 aa, Mycobacterium
RGRLVTMLLVGVVLLAVGYS

SEQ ID NO: 325961 - protein, 33 aa, Mycobacterium
RGRLWRRVGTAVVRWPAPILAVSAAIVLVGMVA

SEQ ID NO: 325962 - protein, 33 aa, Mycobacterium
RGRLWRRVGTAVVRWPAPILAVSAAVVLVGMIA

SEQ ID NO: 325963 - protein, 21 aa, Mycobacterium
RGRPIGRYLAWTFFASLGLTE

SEQ ID NO: 325964 - protein, 19 aa, Mycobacterium
RGRRAWMTPTVAILAAVSF

SEQ ID NO: 325965 - protein, 21 aa, Mycobacterium
RGRRPAAPRRARGVQEPRVPR

SEQ ID NO: 325966 - protein, 18 aa, Mycobacterium
RGRVPGAVSGPLWRLCGS

SEQ ID NO: 325967 - protein, 26 aa, Mycobacterium
RGRVPGLASGPAWRLIGTTAVGLLLL

SEQ ID NO: 325968 - protein, 19 aa, Mycobacterium
RGRWPRLIGIANDNVMALY

SEQ ID NO: 325969 - protein, 30 aa, Mycobacterium
RGSAGTSLRFGVAVVWLSVIVLLPLAAIAW

SEQ ID NO: 325970 - protein, 19 aa, Mycobacterium
RGSDGVVIPGSYRNRHDAV

SEQ ID NO: 325971 - protein, 22 aa, Mycobacterium
RGSGGFAGMLFGSVSAAVVLLS

SEQ ID NO: 325972 - protein, 17 aa, Mycobacterium
RGSGYGLGLSTRTQVTG

SEQ ID NO: 325973 - protein, 23 aa, Mycobacterium
RGSNRPAAWDMRGVLTIATTLGV

SEQ ID NO: 325974 - protein, 18 aa, Mycobacterium
RGSQTAWYQSLRKPSFQP

SEQ ID NO: 325975 - protein, 25 aa, Mycobacterium
RGSQTLRPGAVLPLGQSTTPYQLYD

SEQ ID NO: 325976 - protein, 18 aa, Mycobacterium
RGSRELAVAAQWRTEGAI

SEQ ID NO: 325977 - protein, 24 aa, Mycobacterium
RGSSSPNRTYGWHRAEVFTAVANA

SEQ ID NO: 325978 - protein, 18 aa, Mycobacterium
RGSVAFLGYHEVFGLTTF

SEQ ID NO: 325979 - protein, 23 aa, Mycobacterium
RGSWARARLKSGAELRLPAVSFS

SEQ ID NO: 325980 - protein, 23 aa, Mycobacterium
RGSYGGVLIFGMLTSFAGLGMFN

SEQ ID NO: 325981 - protein, 24 aa, Mycobacterium
RGSYGGVLMFGMLTSFAGLGMFNP

SEQ ID NO: 325982 - protein, 39 aa, Mycobacterium
RGTGLFRTVFVLPWICAPLAIAVLWRWILAPTDGAVSTV

SEQ ID NO: 325983 - protein, 22 aa, Mycobacterium
RGTIRSGLFRAFDSVVGVSLML

SEQ ID NO: 325984 - protein, 17 aa, Mycobacterium
RGTLDYFASQHVAIKVI

SEQ ID NO: 325985 - protein, 20 aa, Mycobacterium
RGTPGFPADGVVALCDFGAG

SEQ ID NO: 325986 - protein, 17 aa, Mycobacterium
RGTPTVFVCALVAGALF

SEQ ID NO: 325987 - protein, 19 aa, Mycobacterium
RGTQAAFGWSLFDGGSTVA

SEQ ID NO: 325988 - protein, 19 aa, Mycobacterium
RGTQNFGLLILRVGLGAVL

SEQ ID NO: 325989 - protein, 19 aa, Mycobacterium
RGTVTFLVLLVLIRAVGQR

SEQ ID NO: 325990 - protein, 17 aa, Mycobacterium
RGTWDRLEELLKRRQRL

SEQ ID NO: 325991 - protein, 19 aa, Mycobacterium
RGTWWGWHGAGWFLLTLMV

SEQ ID NO: 325992 - protein, 18 aa, Mycobacterium
RGVAIKVLPPELAAEPGR

SEQ ID NO: 325993 - protein, 20 aa, Mycobacterium
RGVASSRPALWCNSDADNDR

SEQ ID NO: 325994 - protein, 17 aa, Mycobacterium
RGVAVSFWLTAPYIAAE

SEQ ID NO: 325995 - protein, 20 aa, Mycobacterium
RGVAVSFWLVAPLVAAESIR

SEQ ID NO: 325996 - protein, 19 aa, Mycobacterium
RGVFGGDLFSSALINSIGI

SEQ ID NO: 325997 - protein, 21 aa, Mycobacterium
RGVFRGEFFSSALINSIGVGL

SEQ ID NO: 325998 - protein, 19 aa, Mycobacterium
RGVGFLRQFWGKLRLRDDE

SEQ ID NO: 325999 - protein, 21 aa, Mycobacterium
RGVGVCGGKVRGRVRIVRPET

SEQ ID NO: 326000 - protein, 17 aa, Mycobacterium
RGVGWKTLRDAGPVVFM

SEQ ID NO: 326001 - protein, 21 aa, Mycobacterium
RGVGWKTLRDAGPVVFMNGHY

SEQ ID NO: 326002 - protein, 19 aa, Mycobacterium
RGVHLAAIAVVFSIVALAA

SEQ ID NO: 326003 - protein, 18 aa, Mycobacterium
RGVPVRALGIVFAALVGL

SEQ ID NO: 326004 - protein, 19 aa, Mycobacterium
RGVQKWWVLVPLSVATWVL

SEQ ID NO: 326005 - protein, 22 aa, Mycobacterium
RGVRDGVEFEMLLGMADAQAEA

SEQ ID NO: 326006 - protein, 19 aa, Mycobacterium
RGVRWWRRSLTVLAIPLCV

SEQ ID NO: 326007 - protein, 19 aa, Mycobacterium
RGVSHVILGSGLTIAGACL

SEQ ID NO: 326008 - protein, 18 aa, Mycobacterium
RGVSVGVIVALVAVIVVV

SEQ ID NO: 326009 - protein, 21 aa, Mycobacterium
RGVVRTAVLIPYGIVTVVASY

SEQ ID NO: 326010 - protein, 17 aa, Mycobacterium
RGWLEALLGHFCDPTVA

SEQ ID NO: 326011 - protein, 19 aa, Mycobacterium
RGWMLRLLAILVAAASAGM

SEQ ID NO: 326012 - protein, 30 aa, Mycobacterium
RGWSAMPLALRLLLPIAFVLISAGIGVAFW

SEQ ID NO: 326013 - protein, 29 aa, Mycobacterium
RGWYENRFLPRIGPWALYGLLFTIVILFA

SEQ ID NO: 326014 - protein, 28 aa, Mycobacterium
RGYDVLPQTRWIPLVTFLQVSADMAVAV

SEQ ID NO: 326015 - protein, 21 aa, Mycobacterium
RGYEYGRAFQGLRAMWQRGDE

SEQ ID NO: 326016 - protein, 26 aa, Mycobacterium
RGYFTGRDSVVVWLWLAGILLLVIAS

SEQ ID NO: 326017 - protein, 21 aa, Mycobacterium
RGYGYGPAFQGLRAVWRRGRD

SEQ ID NO: 326018 - protein, 19 aa, Mycobacterium
RGYLRRSVAFTGFNVAVSQ

SEQ ID NO: 326019 - protein, 19 aa, Mycobacterium
RGYTYGLLWLAGVVVLLGA

SEQ ID NO: 326020 - protein, 21 aa, Mycobacterium
RHAAIEFDEPIPSATALHLPL

SEQ ID NO: 326021 - protein, 17 aa, Mycobacterium
RHADGWAVAILMLSGFT

SEQ ID NO: 326022 - protein, 18 aa, Mycobacterium
RHAMLRLRVENWMLQVPE

SEQ ID NO: 326023 - protein, 17 aa, Mycobacterium
RHDLVLEMFTAVHAAFP

SEQ ID NO: 326024 - protein, 23 aa, Mycobacterium
RHEACEKPGGLAPVMMQQTFSTS

SEQ ID NO: 326025 - protein, 22 aa, Mycobacterium
RHFGDELLWHIANRLVHSVRRD

SEQ ID NO: 326026 - protein, 21 aa, Mycobacterium
RHFPQARLKPEVLMIESDHDM

SEQ ID NO: 326027 - protein, 22 aa, Mycobacterium
RHFSRSRLEPELLMIETDHDLR

SEQ ID NO: 326028 - protein, 26 aa, Mycobacterium
RHFVSRAVGLVPWRSWRREQNGEAGA

SEQ ID NO: 326029 - protein, 29 aa, Mycobacterium
RHGRPFRRRNYIPGIVLFVALAVVTLMVW

SEQ ID NO: 326030 - protein, 17 aa, Mycobacterium
RHHARTVVLYGIVPIAG

SEQ ID NO: 326031 - protein, 21 aa, Mycobacterium
RHHEVDRWKATVLTTTVVLFV

SEQ ID NO: 326032 - protein, 23 aa, Mycobacterium
RHHGRGVLLSGLMDLAGTVPAAA

SEQ ID NO: 326033 - protein, 21 aa, Mycobacterium
RHHGVDRWKATVLTTTVVLFI

SEQ ID NO: 326034 - protein, 19 aa, Mycobacterium
RHHHHGMFKPGGSGGPGGP

SEQ ID NO: 326035 - protein, 19 aa, Mycobacterium
RHHIYRGAIGLALLAALIA

SEQ ID NO: 326036 - protein, 19 aa, Mycobacterium
RHHIYRNAIALALLAALTF

SEQ ID NO: 326037 - protein, 17 aa, Mycobacterium
RHIAYRVLAQRDWGHDW

SEQ ID NO: 326038 - protein, 25 aa, Mycobacterium
RHIGVRTVADFGWYTTVGRSGLVSI

SEQ ID NO: 326039 - protein, 27 aa, Mycobacterium
RHIVRCLRRARALGANWVEVKKEANDR

SEQ ID NO: 326040 - protein, 20 aa, Mycobacterium
RHKFVWNLLVDYWFRMEIDG

SEQ ID NO: 326041 - protein, 25 aa, Mycobacterium
RHLFGRGSVFEWLGYAMLYLSFVLG

SEQ ID NO: 326042 - protein, 19 aa, Mycobacterium
RHLGIPFGFGVIFAISGMI

SEQ ID NO: 326043 - protein, 22 aa, Mycobacterium
RHLPHALAHARRSRQIMVQNVG

SEQ ID NO: 326044 - protein, 17 aa, Mycobacterium
RHLPHPLAHVHPGHGTP

SEQ ID NO: 326045 - protein, 19 aa, Mycobacterium
RHLPLPPSVVSAGISQIRG

SEQ ID NO: 326046 - protein, 19 aa, Mycobacterium
RHLRIPLREVMWGSDAALL

SEQ ID NO: 326047 - protein, 23 aa, Mycobacterium
RHLRRLRSGLTLADAQGAVTDSV

SEQ ID NO: 326048 - protein, 29 aa, Mycobacterium
RHMGLFVVGRLAARHGIRVGLRGPSTGEA

SEQ ID NO: 326049 - protein, 30 aa, Mycobacterium
RHMGLFVVGRLAARHGIRVGLRGPSTGEAG

SEQ ID NO: 326050 - protein, 26 aa, Mycobacterium
RHMLLYAAAMGVAWLLDVPALIRKRF

SEQ ID NO: 326051 - protein, 25 aa, Mycobacterium
RHNINRCALVLIGLLQLGVAGMQVA

SEQ ID NO: 326052 - protein, 23 aa, Mycobacterium
RHPDSIGAFFAYGGKDGQGVNLG

SEQ ID NO: 326053 - protein, 23 aa, Mycobacterium
RHPGVGGVGWGCCPYPPGPSPYP

SEQ ID NO: 326054 - protein, 25 aa, Mycobacterium
RHPNYFGEFGFWFALALFGVSASPS

SEQ ID NO: 326055 - protein, 38 aa, Mycobacterium
RHPRRHAGSIYKMPGGVSMCWAVLAFFAFVIWTLTTKT

SEQ ID NO: 326056 - protein, 18 aa, Mycobacterium
RHPVPWPTAIHKVVTAAL

SEQ ID NO: 326057 - protein, 24 aa, Mycobacterium
RHPVTRAEWVWAVLLTAALVVVIA

SEQ ID NO: 326058 - protein, 23 aa, Mycobacterium
RHQRKMLWIIAGIFIVLFTAGLG

SEQ ID NO: 326059 - protein, 26 aa, Mycobacterium
RHQVSGWRFVMRRIASGIALHDTRML

SEQ ID NO: 326060 - protein, 25 aa, Mycobacterium
RHQVSGWRFVMRRIASGVALHDTRM

SEQ ID NO: 326061 - protein, 18 aa, Mycobacterium
RHRIVRAPAYVFVEFFRG

SEQ ID NO: 326062 - protein, 18 aa, Mycobacterium
RHRKARRLPAPPSPSWWL

SEQ ID NO: 326063 - protein, 22 aa, Mycobacterium
RHRMLPRLGLNYAAPPPAVIQA

SEQ ID NO: 326064 - protein, 17 aa, Mycobacterium
RHRMRVLLAATVAGGLV

SEQ ID NO: 326065 - protein, 18 aa, Mycobacterium
RHRNDIRVATAMAAAVAV

SEQ ID NO: 326066 - protein, 19 aa, Mycobacterium
RHRVLAWTAALTMAGVVLL

SEQ ID NO: 326067 - protein, 26 aa, Mycobacterium
RHRYIGVAVSREFSAIIAGGIAPFVG

SEQ ID NO: 326068 - protein, 27 aa, Mycobacterium
RHSLHWKIGEAPVFYGGYAVLLAVSAA

SEQ ID NO: 326069 - protein, 26 aa, Mycobacterium
RHSLHWKVSEAPLFYGGYAVLLAVSA

SEQ ID NO: 326070 - protein, 41 aa, Mycobacterium
RHSRAYLFGGRMRVSTVGLVLVFFALYWVNQNYQPEPPAPA

SEQ ID NO: 326071 - protein, 24 aa, Mycobacterium
RHSSWWPYAALFAVAAAALLWLGR

SEQ ID NO: 326072 - protein, 20 aa, Mycobacterium
RHSVPVWGLFGALLLSVITS

SEQ ID NO: 326073 - protein, 31 aa, Mycobacterium
RHTARMWRVWLFTVIGCNPVLFTLAAGMLGG

SEQ ID NO: 326074 - protein, 17 aa, Mycobacterium
RHTVDWMRTHLPGAADG

SEQ ID NO: 326075 - protein, 20 aa, Mycobacterium
RHVANGKVAAAVACEVKDKA

SEQ ID NO: 326076 - protein, 19 aa, Mycobacterium
RHVELPATLCIPLLLAAFW

SEQ ID NO: 326077 - protein, 18 aa, Mycobacterium
RHVPRWIPRVTPWEPSPA

SEQ ID NO: 326078 - protein, 20 aa, Mycobacterium
RHWHFFSVIGWILVGLSYYI

SEQ ID NO: 326079 - protein, 19 aa, Mycobacterium
RHWHFFSVIGWILVGLTYY

SEQ ID NO: 326080 - protein, 24 aa, Mycobacterium
RHWPRSHAQWASWAPLGNLLAGTL

SEQ ID NO: 326081 - protein, 18 aa, Mycobacterium
RHWVVVLVLTVVGWGFAA

SEQ ID NO: 326082 - protein, 21 aa, Mycobacterium
RHYLYRHLWLFGDKYDSVMID

SEQ ID NO: 326083 - protein, 26 aa, Mycobacterium
RHYRLEVNHPLRLGGDRVYLQGHGYA

SEQ ID NO: 326084 - protein, 32 aa, Mycobacterium
RHYSAEFLQAASLRAGNPIVVAGIPVGNVTSM

SEQ ID NO: 326085 - protein, 17 aa, Mycobacterium
RIAALIAGAGFGILVIA

SEQ ID NO: 326086 - protein, 20 aa, Mycobacterium
RIAAQLAVLAAAAFTYVTAE

SEQ ID NO: 326087 - protein, 21 aa, Mycobacterium
RIAAWAAFDWGSAAFNTVIVM

SEQ ID NO: 326088 - protein, 20 aa, Mycobacterium
RIADGCWIAGTVVAVLPALV

SEQ ID NO: 326089 - protein, 17 aa, Mycobacterium
RIADPVLAMLLRVAQPA

SEQ ID NO: 326090 - protein, 21 aa, Mycobacterium
RIAEPKWGPPVGRVLSTVLKE

SEQ ID NO: 326091 - protein, 23 aa, Mycobacterium
RIAEPQWGPPIGRVLASLLAEGR

SEQ ID NO: 326092 - protein, 22 aa, Mycobacterium
RIAEPQWGPPIGRVLNSLLDEG

SEQ ID NO: 326093 - protein, 31 aa, Mycobacterium
RIAETRWGTRLGVRWWRFGAGVLLGLACATK

SEQ ID NO: 326094 - protein, 34 aa, Mycobacterium
RIAFSALCCLVCLGCGFTAQMLAPRLDRAGTARL

SEQ ID NO: 326095 - protein, 24 aa, Mycobacterium
RIAGEFRASGLAHLTAVSGANVTI

SEQ ID NO: 326096 - protein, 18 aa, Mycobacterium
RIAGFAVKVHWSVLVILW

SEQ ID NO: 326097 - protein, 24 aa, Mycobacterium
RIAGFPVNVHWSVLVILWLFTWSL

SEQ ID NO: 326098 - protein, 19 aa, Mycobacterium
RIAGFSVKVHWSVLVILWL

SEQ ID NO: 326099 - protein, 30 aa, Mycobacterium
RIAGGVIAGAWGWRAVFAIAAAITAALALV

SEQ ID NO: 326100 - protein, 19 aa, Mycobacterium
RIAGIGALSGMGFTISLLV

SEQ ID NO: 326101 - protein, 23 aa, Mycobacterium
RIAKIPLDIDATLIRQGTGSALD

SEQ ID NO: 326102 - protein, 26 aa, Mycobacterium
RIALGFGLGCAIGIERQWRAKNAGLR

SEQ ID NO: 326103 - protein, 24 aa, Mycobacterium
RIALGSLRNKLVFILPGAMLLSQF

SEQ ID NO: 326104 - protein, 19 aa, Mycobacterium
RIALPAAGLYPLATFGLGM

SEQ ID NO: 326105 - protein, 19 aa, Mycobacterium
RIALPLLVYFAIMWGGGYL

SEQ ID NO: 326106 - protein, 23 aa, Mycobacterium
RIALPRLRAAAGRADGVVDRLGS

SEQ ID NO: 326107 - protein, 21 aa, Mycobacterium
RIALRGRRDPVPVAGQRSRTS

SEQ ID NO: 326108 - protein, 25 aa, Mycobacterium
RIAQLSWPIAIAVGPPLTYGVIALA

SEQ ID NO: 326109 - protein, 18 aa, Mycobacterium
RIARALRSRGHVVAMTGD

SEQ ID NO: 326110 - protein, 17 aa, Mycobacterium
RIARAVRSRGHVVAMTG

SEQ ID NO: 326111 - protein, 17 aa, Mycobacterium
RIARFGLSGVLVGSCVA

SEQ ID NO: 326112 - protein, 18 aa, Mycobacterium
RIARLAGLAGALGLLAVT

SEQ ID NO: 326113 - protein, 26 aa, Mycobacterium
RIASHMPLLLGLAFALLVARERVGSH

SEQ ID NO: 326114 - protein, 18 aa, Mycobacterium
RIASRVGTGVGFATDQVF

SEQ ID NO: 326115 - protein, 27 aa, Mycobacterium
RICDRPARRPVRRVLLFVVPSSGPPPN

SEQ ID NO: 326116 - protein, 22 aa, Mycobacterium
RIDCACKVWAAGVQASPLGKMI

SEQ ID NO: 326117 - protein, 22 aa, Mycobacterium
RIDCACKVWAAGVQASPLGKMV

SEQ ID NO: 326118 - protein, 19 aa, Mycobacterium
RIDHWLNVLFLTLVIRSGI

SEQ ID NO: 326119 - protein, 19 aa, Mycobacterium
RIDLEGSPLDALQLPDVPH

SEQ ID NO: 326120 - protein, 20 aa, Mycobacterium
RIDLEGSPLDALRLPDLPHG

SEQ ID NO: 326121 - protein, 19 aa, Mycobacterium
RIDRVPRFELARCGLPMPK

SEQ ID NO: 326122 - protein, 19 aa, Mycobacterium
RIDVFGALLLGGGIGATLA

SEQ ID NO: 326123 - protein, 18 aa, Mycobacterium
RIDWDRSSLVSGLMPATF

SEQ ID NO: 326124 - protein, 20 aa, Mycobacterium
RIECACKVWAAGVQASELGK

SEQ ID NO: 326125 - protein, 22 aa, Mycobacterium
RIECACKVWAAGVQASSLGAML

SEQ ID NO: 326126 - protein, 21 aa, Mycobacterium
RIEFADVEFRYAGASAAVLDG

SEQ ID NO: 326127 - protein, 25 aa, Mycobacterium
RIEGPPGLRRAVGRVVRLEPTKNAQ

SEQ ID NO: 326128 - protein, 17 aa, Mycobacterium
RIEKRLPSFAAELVAFS

SEQ ID NO: 326129 - protein, 23 aa, Mycobacterium
RIEVFTAIIPSVAWLMVLLELTN

SEQ ID NO: 326130 - protein, 24 aa, Mycobacterium
RIFDPKVFVVSFVFNVLVAALIVY

SEQ ID NO: 326131 - protein, 25 aa, Mycobacterium
RIFEAMGMSGYFAKLGLPALVQVAA

SEQ ID NO: 326132 - protein, 23 aa, Mycobacterium
RIFPGLWVCLAIIAFVIAPTSVL

SEQ ID NO: 326133 - protein, 17 aa, Mycobacterium
RIFPGLWVCLAVVAFVI

SEQ ID NO: 326134 - protein, 23 aa, Mycobacterium
RIFSRSSWPEWQRVSELLRTETV

SEQ ID NO: 326135 - protein, 24 aa, Mycobacterium
RIGARTVLIAGLAVFAVASLSFAV

SEQ ID NO: 326136 - protein, 21 aa, Mycobacterium
RIGAVVVPFSTFVTARELREQ

SEQ ID NO: 326137 - protein, 22 aa, Mycobacterium
RIGAYERYWLYPGAQNLANFRA

SEQ ID NO: 326138 - protein, 26 aa, Mycobacterium
RIGGAGRGFCSGAGISEEDHANPGAA

SEQ ID NO: 326139 - protein, 23 aa, Mycobacterium
RIGGMTCASCANRIERKLNKLDG

SEQ ID NO: 326140 - protein, 25 aa, Mycobacterium
RIGLFDTWPGLILPYITFALPLAIY

SEQ ID NO: 326141 - protein, 18 aa, Mycobacterium
RIGLTVLAWWFDWLPHHG

SEQ ID NO: 326142 - protein, 19 aa, Mycobacterium
RIGLTVLAWWFDWLPHHGL

SEQ ID NO: 326143 - protein, 18 aa, Mycobacterium
RIGPKRTLLLGLVIIIAG

SEQ ID NO: 326144 - protein, 19 aa, Mycobacterium
RIGRQCLTAGLGFGGGCLP

SEQ ID NO: 326145 - protein, 17 aa, Mycobacterium
RIGSLIAGGGWWGLLEV

SEQ ID NO: 326146 - protein, 24 aa, Mycobacterium
RIGSRIGKSYSMFALCDEAYALIT

SEQ ID NO: 326147 - protein, 19 aa, Mycobacterium
RIGVDVIAVLSLIGTLLVG

SEQ ID NO: 326148 - protein, 24 aa, Mycobacterium
RIGVKPIMWTGCALLIVGSIPAFL

SEQ ID NO: 326149 - protein, 23 aa, Mycobacterium
RIGVKPIMWTGCGLLIVASIPAF

SEQ ID NO: 326150 - protein, 18 aa, Mycobacterium
RIHMTNMVAGWDVEQVKS

SEQ ID NO: 326151 - protein, 19 aa, Mycobacterium
RIHPLRAAALVGVAAAVVI

SEQ ID NO: 326152 - protein, 19 aa, Mycobacterium
RIIAAVAFALSPRVLTTLG

SEQ ID NO: 326153 - protein, 18 aa, Mycobacterium
RIIATGNSVDAVWTQILG

SEQ ID NO: 326154 - protein, 18 aa, Mycobacterium
RIIGAALLVFLAAAVFGI

SEQ ID NO: 326155 - protein, 17 aa, Mycobacterium
RIIGITLISFVAIMFTP

SEQ ID NO: 326156 - protein, 26 aa, Mycobacterium
RIIRVLAVPIVLGWVLLTVLTNVAVP

SEQ ID NO: 326157 - protein, 27 aa, Mycobacterium
RIISHLPVLLGLIFALLVLRDYRAGRT

SEQ ID NO: 326158 - protein, 32 aa, Mycobacterium
RIKDEIREGRSFRSAVPRGWARARKTILSGNA

SEQ ID NO: 326159 - protein, 36 aa, Mycobacterium; identical to SEQ ID NO: 160134

SEQ ID NO: 326160 - protein, 35 aa, Mycobacterium
RIKDEIREGRSFRSAVPRGWVRARKTIVSGNAVTF

SEQ ID NO: 326161 - protein, 20 aa, Mycobacterium
RIKLLTLRSPLWAAAAAAVL

SEQ ID NO: 326162 - protein, 23 aa, Mycobacterium
RIKPAWWTWILIAALGVFFFTTG

SEQ ID NO: 326163 - protein, 17 aa, Mycobacterium
RILCSAAALDRAHEAEC

SEQ ID NO: 326164 - protein, 18 aa, Mycobacterium
RILDWSARTLSGPRGDGL

SEQ ID NO: 326165 - protein, 17 aa, Mycobacterium
RILEAILPYYGPYRNDV

SEQ ID NO: 326166 - protein, 21 aa, Mycobacterium
RILEHLQYTVIAVFFSALIAV

SEQ ID NO: 326167 - protein, 17 aa, Mycobacterium
RILGHATDLLFNGVIGR

SEQ ID NO: 326168 - protein, 23 aa, Mycobacterium
RILGHATDLLFNGVIGRQLPAGI

SEQ ID NO: 326169 - protein, 18 aa, Mycobacterium
RILGHATDLLFNGVIGRR

SEQ ID NO: 326170 - protein, 17 aa, Mycobacterium
RILKGDLSLMLFPLLST

SEQ ID NO: 326171 - protein, 18 aa, Mycobacterium
RILPGFYVCMIVTAFVFA

SEQ ID NO: 326172 - protein, 23 aa, Mycobacterium
RILPITFTALGLVALVGGAVLGT

SEQ ID NO: 326173 - protein, 27 aa, Mycobacterium
RILRDLVRLLARFLIRRLRLSQEVSLL

SEQ ID NO: 326174 - protein, 25 aa, Mycobacterium
RILRRYSIDELPQFINVLKGDMSVV

SEQ ID NO: 326175 - protein, 22 aa, Mycobacterium
RILWYLLIAHAVHFLAVPTVGR

SEQ ID NO: 326176 - protein, 22 aa, Mycobacterium
RILYQWRWSLVVFWFVALVLAI

SEQ ID NO: 326177 - protein, 17 aa, Mycobacterium
RIMLQNIGLSLAIITIL

SEQ ID NO: 326178 - protein, 20 aa, Mycobacterium
RIMPAYVITVLFAYVLYHFR

SEQ ID NO: 326179 - protein, 24 aa, Mycobacterium
RIMRENGWEGARYGSKHKTTVADS

SEQ ID NO: 326180 - protein, 27 aa, Mycobacterium
RINASWPQVMPWTALWLGALSTAILVQ

SEQ ID NO: 326181 - protein, 27 aa, Mycobacterium
RINGFARWVVRTPWPVFSLSMLQADII

SEQ ID NO: 326182 - protein, 19 aa, Mycobacterium
RINGWTAVCAGLLTVYLAT

SEQ ID NO: 326183 - protein, 17 aa, Mycobacterium
RINRVPLYELVRCGLEV

SEQ ID NO: 326184 - protein, 24 aa, Mycobacterium
RINSFTSTFVFIGAVVYIMAAPRG

SEQ ID NO: 326185 - protein, 18 aa, Mycobacterium
RINSGRLLIFSAYVTHRI

SEQ ID NO: 326186 - protein, 21 aa, Mycobacterium
RINVTWFSWLSAVGEIGTGLI

SEQ ID NO: 326187 - protein, 24 aa, Mycobacterium
RIPDQRWYGRFGILTIPTPFLANS

SEQ ID NO: 326188 - protein, 23 aa, Mycobacterium
RIPFEVLEPTFARLAAGGYARSD

SEQ ID NO: 326189 - protein, 24 aa, Mycobacterium
RIPHHGVVVVCDFGGTGTSITLAD

SEQ ID NO: 326190 - protein, 28 aa, Mycobacterium
RIPLPGSAPKPVWLGAFAHPERDKRVAA

SEQ ID NO: 326191 - protein, 30 aa, Mycobacterium
RIPLPGSVARPVWRDAFAHPENDRRVAVGI

SEQ ID NO: 326192 - protein, 25 aa, Mycobacterium
RIPLSVGDVARRVFLGKPLITEDIA

SEQ ID NO: 326193 - protein, 22 aa, Mycobacterium
RIPPKYVVLGSFAGTAAAAFVA

SEQ ID NO: 326194 - protein, 29 aa, Mycobacterium
RIPTWQPWLRWVLLIGGLVVAIALTLGVL

SEQ ID NO: 326195 - protein, 24 aa, Mycobacterium
RIPVDEWAVVLALALRAFPMLIDE

SEQ ID NO: 326196 - protein, 29 aa, Mycobacterium
RIPVEVVDGIVLRDGRPFEMADTDLVTPV

SEQ ID NO: 326197 - protein, 18 aa, Mycobacterium
RIQEARAALLRVDPAADV

SEQ ID NO: 326198 - protein, 20 aa, Mycobacterium
RIQLLIGFMCVALIVYFVML

SEQ ID NO: 326199 - protein, 20 aa, Mycobacterium
RIQLLIGFMCVALVVYFVLL

SEQ ID NO: 326200 - protein, 23 aa, Mycobacterium
RIQPSGSRIGLERTEPALNLDLL

SEQ ID NO: 326201 - protein, 17 aa, Mycobacterium
RIRDARGGRPPALRLHD

SEQ ID NO: 326202 - protein, 23 aa, Mycobacterium
RIRELERPLAESAWASEQGSSAS

SEQ ID NO: 326203 - protein, 31 aa, Mycobacterium
RIRFWRRIGTAVVRWPAPILLASLAAALVGL

SEQ ID NO: 326204 - protein, 17 aa, Mycobacterium
RIRHLRTTITWIAVPSV

SEQ ID NO: 326205 - protein, 19 aa, Mycobacterium
RIRISVLLRGWNKMPAMAA

SEQ ID NO: 326206 - protein, 17 aa, Mycobacterium
RIRLGKPGWVAAGEFAA

SEQ ID NO: 326207 - protein, 34 aa, Mycobacterium
RIRSWRKIGTTIVRWPGPVLAAAMAIAIIGLAAL

SEQ ID NO: 326208 - protein, 23 aa, Mycobacterium
RIRTAIGPSQAWYTDNLRYYYMF

SEQ ID NO: 326209 - protein, 23 aa, Mycobacterium
RIRTAIGPSQAWYTENLRYYYLI

SEQ ID NO: 326210 - protein, 20 aa, Mycobacterium
RIRTAIGPSQEWWTENLRYY

SEQ ID NO: 326211 - protein, 18 aa, Mycobacterium
RIRTRVVADVAVPVSDIR

SEQ ID NO: 326212 - protein, 25 aa, Mycobacterium
RIRVRANWFRFDAVRAVAIEDSVAT

SEQ ID NO: 326213 - protein, 26 aa, Mycobacterium
RIRVSRLQALLVEWTLLSLLALPTSA

SEQ ID NO: 326214 - protein, 19 aa, Mycobacterium
RISAVFVPVVFAIAGLAGA

SEQ ID NO: 326215 - protein, 28 aa, Mycobacterium
RISDGAVFCGLLWWAAFGLQSAELVVAT

SEQ ID NO: 326216 - protein, 19 aa, Mycobacterium
RISGFSWPESVAVGAGLNT

SEQ ID NO: 326217 - protein, 30 aa, Mycobacterium
RISLTAFWIRRARRLLPALVLMVLTVTAAR

SEQ ID NO: 326218 - protein, 17 aa, Mycobacterium
RITDIFFGLPLLLAAIV

SEQ ID NO: 326219 - protein, 18 aa, Mycobacterium
RITDPQIRVVIAGQLKQG

SEQ ID NO: 326220 - protein, 20 aa, Mycobacterium
RITFEVGHHQGVIGLLPPPE

SEQ ID NO: 326221 - protein, 21 aa, Mycobacterium
RITGFIKLLLITAALGAASAS

SEQ ID NO: 326222 - protein, 25 aa, Mycobacterium
RITGFIRIVLLAAILGAALSSAFSV

SEQ ID NO: 326223 - protein, 19 aa, Mycobacterium
RITWIVTMYLLGYIAAMPL

SEQ ID NO: 326224 - protein, 19 aa, Mycobacterium
RIVALKVLPPHLAQDASFQ

SEQ ID NO: 326225 - protein, 29 aa, Mycobacterium
RIVDTSLRFGVLCRFTAYVAGELRDGRVV

SEQ ID NO: 326226 - protein, 20 aa, Mycobacterium
RIVGLLGVAYVDTWSSAAAV

SEQ ID NO: 326227 - protein, 19 aa, Mycobacterium
RIVLPQAMRVIVPPTGNEV

SEQ ID NO: 326228 - protein, 18 aa, Mycobacterium
RIVMGRGAAIIGALLAIV

SEQ ID NO: 326229 - protein, 20 aa, Mycobacterium
RIVPEPGIRPGSGARVLTVS

SEQ ID NO: 326230 - protein, 18 aa, Mycobacterium
RIWAELSEVFGQRKLLKW

SEQ ID NO: 326231 - protein, 22 aa, Mycobacterium
RIWDGGLGIWGAVALGGVGAWI

SEQ ID NO: 326232 - protein, 20 aa, Mycobacterium
RIYGALCANVRAVGRDPKPR

SEQ ID NO: 326233 - protein, 23 aa, Mycobacterium
RKAEAGFDRPIWAQYWEYLTGLL

SEQ ID NO: 326234 - protein, 21 aa, Mycobacterium
RKAESKARRAQMWQAFQIQRK

SEQ ID NO: 326235 - protein, 23 aa, Mycobacterium
RKAHWLDVARELATDGLRVLGLA

SEQ ID NO: 326236 - protein, 19 aa, Mycobacterium
RKALLLPAGALVYIAVPPA

SEQ ID NO: 326237 - protein, 20 aa, Mycobacterium
RKALRSNNVNFVWITDFQQY

SEQ ID NO: 326238 - protein, 21 aa, Mycobacterium
RKALVGYRIFAWATGLWLIAL

SEQ ID NO: 326239 - protein, 17 aa, Mycobacterium
RKEGWGLAVVEAAQHGV

SEQ ID NO: 326240 - protein, 25 aa, Mycobacterium
RKEIIRLIAEISMGAGTLAMIGGTV

SEQ ID NO: 326241 - protein, 30 aa, Mycobacterium
RKELAEEWGRQWWGVAICVVTEVLLSGVQI

SEQ ID NO: 326242 - protein, 18 aa, Mycobacterium
RKELVRLIAEISMGAGTL

SEQ ID NO: 326243 - protein, 18 aa, Mycobacterium
RKEMIAYTTTVLFFLIFM

SEQ ID NO: 326244 - protein, 22 aa, Mycobacterium
RKESGEWKVCMSDSPTLSNFPG

SEQ ID NO: 326245 - protein, 21 aa, Mycobacterium
RKETIRLIAEMSMGTGALVMI

SEQ ID NO: 326246 - protein, 24 aa, Mycobacterium
RKETIRLVAEMTLGAGALVMIGGT

SEQ ID NO: 326247 - protein, 25 aa, Mycobacterium
RKETIRLVAEMTLGAGALVMIGGTV

SEQ ID NO: 326248 - protein, 21 aa, Mycobacterium
RKETIRLVAEMTMGAGALVMI

SEQ ID NO: 326249 - protein, 21 aa, Mycobacterium
RKETLRLIAQIGMGTGAMAVI

SEQ ID NO: 326250 - protein, 21 aa, Mycobacterium
RKETLRLVAQIGMGTGAMAVI

SEQ ID NO: 326251 - protein, 17 aa, Mycobacterium
RKEVKKAGGALRQPLGR

SEQ ID NO: 326252 - protein, 20 aa, Mycobacterium
RKEYLRYLAGLRGRVTSSAT

SEQ ID NO: 326253 - protein, 20 aa, Mycobacterium
RKEYLRYLAGLRGRVTTSAT

SEQ ID NO: 326254 - protein, 20 aa, Mycobacterium
RKEYLRYLAGLRTRVTSSAA

SEQ ID NO: 326255 - protein, 20 aa, Mycobacterium
RKEYLRYLAGLRTRVTSSAS

SEQ ID NO: 326256 - protein, 26 aa, Mycobacterium
RKFDVLSGFLMFNFGLSLIIALVTSD

SEQ ID NO: 326257 - protein, 19 aa, Mycobacterium
RKFFDEVWIHEHDIGNMRI

SEQ ID NO: 326258 - protein, 26 aa, Mycobacterium
RKFRRRVSAGLLLLIALVVAGGLAST

SEQ ID NO: 326259 - protein, 19 aa, Mycobacterium
RKGAASSVAEWVRGNGGDV

SEQ ID NO: 326260 - protein, 19 aa, Mycobacterium
RKGAASSVAEWVRGQGGNV

SEQ ID NO: 326261 - protein, 17 aa, Mycobacterium
RKGASDAVFTWVASLSG

SEQ ID NO: 326262 - protein, 17 aa, Mycobacterium
RKGDFARRTFGLRRDLV

SEQ ID NO: 326263 - protein, 19 aa, Mycobacterium
RKGIARGKSVVALAFAGGV

SEQ ID NO: 326264 - protein, 26 aa, Mycobacterium
RKGKAFLVALGLRFGQAGNSGLVQTF

SEQ ID NO: 326265 - protein, 17 aa, Mycobacterium
RKGLKPRQVQMIGIGGA

SEQ ID NO: 326266 - protein, 19 aa, Mycobacterium
RKGTLLMLAVVFVIGSLWC

SEQ ID NO: 326267 - protein, 27 aa, Mycobacterium
RKIHAFAVPIVLGWLAICVALTVFVPS

SEQ ID NO: 326268 - protein, 18 aa, Mycobacterium
RKIKIGMWRQANVAKVGL

SEQ ID NO: 326269 - protein, 17 aa, Mycobacterium
RKIVLKSAIPGIVTGLL

SEQ ID NO: 326270 - protein, 29 aa, Mycobacterium
RKKAICTVLFPLTMRWLAGEIMTPPRSFA

SEQ ID NO: 326271 - protein, 17 aa, Mycobacterium
RKKRIAQLEAFAASQGW

SEQ ID NO: 326272 - protein, 24 aa, Mycobacterium
RKKRPDLERGFRAPWVPVLPIASL

SEQ ID NO: 326273 - protein, 19 aa, Mycobacterium
RKLGGAYSVDYHPVSYPGA

SEQ ID NO: 326274 - protein, 23 aa, Mycobacterium
RKLLAGSLVLNWVLGPALMFTLA

SEQ ID NO: 326275 - protein, 24 aa, Mycobacterium
RKLLASSLILNWALGPALMFTLAW

SEQ ID NO: 326276 - protein, 19 aa, Mycobacterium
RKLLASSLVLNWLIGPAVM

SEQ ID NO: 326277 - protein, 20 aa, Mycobacterium
RKLLEANGILALADVMAANE

SEQ ID NO: 326278 - protein, 23 aa, Mycobacterium
RKLLGRMQMRFGPNRVGPAGLLQ

SEQ ID NO: 326279 - protein, 20 aa, Mycobacterium
RKLLIGIAVFGAIAALAVLF

SEQ ID NO: 326280 - protein, 19 aa, Mycobacterium
RKLLISSLLLNWVAGPALM

SEQ ID NO: 326281 - protein, 19 aa, Mycobacterium
RKLLISSLVLNWVLGPALM

SEQ ID NO: 326282 - protein, 19 aa, Mycobacterium
RKLLLASLVLNWVLGPALM

SEQ ID NO: 326283 - protein, 24 aa, Mycobacterium
RKLLLGSLVLNWVLGPALMFALAW

SEQ ID NO: 326284 - protein, 33 aa, Mycobacterium
RKLPILRLSERLMIWTIFEFLALALVDAKPVAR

SEQ ID NO: 326285 - protein, 21 aa, Mycobacterium
RKLQNPGWRPGVWACSLAMVA

SEQ ID NO: 326286 - protein, 26 aa, Mycobacterium
RKLQSPSWRPGAWLATILVVAGWGGT

SEQ ID NO: 326287 - protein, 37 aa, Mycobacterium
RKLTRLGSYGAWFPYYLCGLALRVSDLQYRTVEVGIT

SEQ ID NO: 326288 - protein, 22 aa, Mycobacterium
RKLYEAQRGLAHQVHHDALTGL

SEQ ID NO: 326289 - protein, 28 aa, Mycobacterium
RKMGKNLYLRNAVFAEWIEKVDALIQDE

SEQ ID NO: 326290 - protein, 19 aa, Mycobacterium
RKMHAAAVPPSWAAPLLAL

SEQ ID NO: 326291 - protein, 23 aa, Mycobacterium
RKMKQNLWWAAGYNLISVPLAAG

SEQ ID NO: 326292 - protein, 25 aa, Mycobacterium
RKMTGRWIVIAGCVTNLLSTIVAAG

SEQ ID NO: 326293 - protein, 19 aa, Mycobacterium
RKPERLSRFGGSNFFAAYT

SEQ ID NO: 326294 - protein, 17 aa, Mycobacterium
RKPFLLVGSALTSVFVI

SEQ ID NO: 326295 - protein, 20 aa, Mycobacterium
RKPRIARTMRVLALPIIVVW

SEQ ID NO: 326296 - protein, 17 aa, Mycobacterium
RKPVLLTCLGIVVATSV

SEQ ID NO: 326297 - protein, 28 aa, Mycobacterium
RKQILRLDSSCLVARVLTRSALGTLAGF

SEQ ID NO: 326298 - protein, 24 aa, Mycobacterium
RKQSHFRSGRWLLLVDAVLLIALG

SEQ ID NO: 326299 - protein, 20 aa, Mycobacterium
RKQWIIVGAIALVALVAFIV

SEQ ID NO: 326300 - protein, 19 aa, Mycobacterium
RKRGRVLRSVLALTAVVAV

SEQ ID NO: 326301 - protein, 27 aa, Mycobacterium
RKRHTELRVRIGIHMGRSVRRGDDLFG

SEQ ID NO: 326302 - protein, 22 aa, Mycobacterium
RKRLEPRPVSRPPVDPSAQRAF

SEQ ID NO: 326303 - protein, 22 aa, Mycobacterium
RKRLIINWLAAILVPPATALFI

SEQ ID NO: 326304 - protein, 22 aa, Mycobacterium
RKRLPAPVARKGTITIEPPPEL

SEQ ID NO: 326305 - protein, 20 aa, Mycobacterium
RKRLPKLTKRQRFWISLYLP

SEQ ID NO: 326306 - protein, 33 aa, Mycobacterium
RKRLRAKRWSIRWALACVAGLLVTTVLATTGAP

SEQ ID NO: 326307 - protein, 18 aa, Mycobacterium
RKRMFIYGVGLFTIASVL

SEQ ID NO: 326308 - protein, 17 aa, Mycobacterium
RKRRRAMAFYKGCVRRQ

SEQ ID NO: 326309 - protein, 28 aa, Mycobacterium
RKRRSRRDPLSIFLILIIVFSLVLAGVI

SEQ ID NO: 326310 - protein, 18 aa, Mycobacterium
RKRRWMRRAGLISAGANA

SEQ ID NO: 326311 - protein, 22 aa, Mycobacterium
RKRSFEATGVMSMEVFRRRKAG

SEQ ID NO: 326312 - protein, 21 aa, Mycobacterium
RKRVFQAAIVFFVVGSALCGL

SEQ ID NO: 326313 - protein, 21 aa, Mycobacterium
RKRVFQAAVVFFVAGSVLCGL

SEQ ID NO: 326314 - protein, 20 aa, Mycobacterium
RKRVFQVAALLFVAGSVSCG

SEQ ID NO: 326315 - protein, 18 aa, Mycobacterium
RKRVGSVGGELREDIAEL

SEQ ID NO: 326316 - protein, 26 aa, Mycobacterium
RKRYARVAVVAAVYLGAFGLAGGLGW

SEQ ID NO: 326317 - protein, 19 aa, Mycobacterium
RKSALIGVIGGAAYAAIGI

SEQ ID NO: 326318 - protein, 20 aa, Mycobacterium
RKSGGDRRKLIIAAAAIGAV

SEQ ID NO: 326319 - protein, 21 aa, Mycobacterium
RKSLWALIPRPLRRLMGPALI

SEQ ID NO: 326320 - protein, 19 aa, Mycobacterium
RKTDITTFFIGSGLAAVAG

SEQ ID NO: 326321 - protein, 24 aa, Mycobacterium
RKTDSRLAARLAALASLGASLIHF

SEQ ID NO: 326322 - protein, 19 aa, Mycobacterium
RKTLWHNLGVLSGAVVAFC

SEQ ID NO: 326323 - protein, 19 aa, Mycobacterium
RKTSVPAMVSMIALAVLLG

SEQ ID NO: 326324 - protein, 19 aa, Mycobacterium
RKVAMLVVVVICIFYLVPQ

SEQ ID NO: 326325 - protein, 19 aa, Mycobacterium
RKVAMLVVVVICVFYLAPQ

SEQ ID NO: 326326 - protein, 36 aa, Mycobacterium; identical to SEQ ID NO: 17410

SEQ ID NO: 326327 - protein, 17 aa, Mycobacterium
RKVDLTVVHTWQPPNVF

SEQ ID NO: 326328 - protein, 21 aa, Mycobacterium
RKVDQIWLFAVEGVEVVGASV

SEQ ID NO: 326329 - protein, 18 aa, Mycobacterium
RKVIWPNRKQMVSYTSVV

SEQ ID NO: 326330 - protein, 24 aa, Mycobacterium
RKVLPRRASHLAIRMYNALLEAVL

SEQ ID NO: 326331 - protein, 23 aa, Mycobacterium
RKVPSAFGSWFSFNEVDGANTPN

SEQ ID NO: 326332 - protein, 21 aa, Mycobacterium
RKVSFLPGMRYYAGNWDTTLW

SEQ ID NO: 326333 - protein, 18 aa, Mycobacterium
RKWTAVTLSSTWAGEQLL

SEQ ID NO: 326334 - protein, 26 aa, Mycobacterium
RKYAFRKRMLVAMAVVLVGSAIAAFE

SEQ ID NO: 326335 - protein, 24 aa, Mycobacterium
RKYFTYRDILGIAYAQAKFQLTGK

SEQ ID NO: 326336 - protein, 20 aa, Mycobacterium
RKYGRCITRVLVVGSPTAVR

SEQ ID NO: 326337 - protein, 24 aa, Mycobacterium
RKYRWLVFTGWLLALVPAVYLALT

SEQ ID NO: 326338 - protein, 19 aa, Mycobacterium
RLAAPRAVLGAALASLTIG

SEQ ID NO: 326339 - protein, 24 aa, Mycobacterium
RLAATAVLISPAWKRDEVDHALAL

SEQ ID NO: 326340 - protein, 26 aa, Mycobacterium
RLAATSVCLIGGWGLGSVLLGTLPLF

SEQ ID NO: 326341 - protein, 19 aa, Mycobacterium
RLAAVPVVESLPVSYYPPT

SEQ ID NO: 326342 - protein, 21 aa, Mycobacterium
RLAAVVLCVLAIPLTASIGIS

SEQ ID NO: 326343 - protein, 17 aa, Mycobacterium
RLADEFDLRDQPDATFV

SEQ ID NO: 326344 - protein, 24 aa, Mycobacterium
RLADLFLPHGIWLLGYQIYLWDMR

SEQ ID NO: 326345 - protein, 25 aa, Mycobacterium
RLADRAAGWLFWFALGTAAITAAAW

SEQ ID NO: 326346 - protein, 25 aa, Mycobacterium
RLADRAAGWLFWFALGTAAITAVAW

SEQ ID NO: 326347 - protein, 25 aa, Mycobacterium
RLADRAAGWLFWFALVTALVTAAAW

SEQ ID NO: 326348 - protein, 25 aa, Mycobacterium
RLADVPRLSGWLAVRGDGQVWLERG

SEQ ID NO: 326349 - protein, 18 aa, Mycobacterium
RLADVVIAVPSYWTVEAT

SEQ ID NO: 326350 - protein, 22 aa, Mycobacterium
RLAECSRYYVQVFEQWKNIGVL

SEQ ID NO: 326351 - protein, 17 aa, Mycobacterium
RLAEHRPSLGLLFPASA

SEQ ID NO: 326352 - protein, 21 aa, Mycobacterium
RLAENGFAYLFPVFAVGFAVN

SEQ ID NO: 326353 - protein, 22 aa, Mycobacterium
RLAESTAGPGARVVPLHLADSA

SEQ ID NO: 326354 - protein, 28 aa, Mycobacterium
RLAFGYPSRHWWLVWMFAGVFAASLAAL

SEQ ID NO: 326355 - protein, 18 aa, Mycobacterium
RLAFYPLALVPFGSLIWV

SEQ ID NO: 326356 - protein, 21 aa, Mycobacterium
RLAGLFATPMTWRILDGVIAV

SEQ ID NO: 326357 - protein, 18 aa, Mycobacterium
RLAGPEGVNGEFDTPIDP

SEQ ID NO: 326358 - protein, 18 aa, Mycobacterium
RLAGPQGVNGEFDTPIDP

SEQ ID NO: 326359 - protein, 22 aa, Mycobacterium
RLAGRGAPAHRVWLPPLTSAPR

SEQ ID NO: 326360 - protein, 17 aa, Mycobacterium
RLAGWAQAFDELGGLPR

SEQ ID NO: 326361 - protein, 23 aa, Mycobacterium
RLAKARPKLLIADGELNTHVMRR

SEQ ID NO: 326362 - protein, 19 aa, Mycobacterium
RLAKGRIGVGTLMTIAAVG

SEQ ID NO: 326363 - protein, 19 aa, Mycobacterium
RLALIPVFIYALLVVHAHG

SEQ ID NO: 326364 - protein, 18 aa, Mycobacterium
RLALQWNVLNLVRVALTA

SEQ ID NO: 326365 - protein, 19 aa, Mycobacterium
RLAMGAALLAVFLFGCFVF

SEQ ID NO: 326366 - protein, 29 aa, Mycobacterium
RLANLGYRAGWRFFVMYGATEATARMAYL

SEQ ID NO: 326367 - protein, 20 aa, Mycobacterium
RLAPEPELAELANLPAPRRA

SEQ ID NO: 326368 - protein, 18 aa, Mycobacterium
RLAPGVPGGTIPVRLIDD

SEQ ID NO: 326369 - protein, 19 aa, Mycobacterium
RLAPIPGVETLALDVTDDT

SEQ ID NO: 326370 - protein, 26 aa, Mycobacterium
RLAPSLPAPQRERLVLGMLTHAIAVA

SEQ ID NO: 326371 - protein, 20 aa, Mycobacterium
RLAPVPVMNWMGTAYVNVVR

SEQ ID NO: 326372 - protein, 19 aa, Mycobacterium
RLAQLAFLVVAAFLLTNKV

SEQ ID NO: 326373 - protein, 22 aa, Mycobacterium
RLARPVAIKLLYPALAADADLR

SEQ ID NO: 326374 - protein, 18 aa, Mycobacterium
RLARRAVTAREWVWAVVL

SEQ ID NO: 326375 - protein, 18 aa, Mycobacterium
RLARRCGADLRYAANSDL

SEQ ID NO: 326376 - protein, 17 aa, Mycobacterium
RLARVPWGLLALPTAGP

SEQ ID NO: 326377 - protein, 17 aa, Mycobacterium
RLARWLPNRSVAAVAVA

SEQ ID NO: 326378 - protein, 24 aa, Mycobacterium
RLASGMPREAAIPFSSERQYMATL

SEQ ID NO: 326379 - protein, 29 aa, Mycobacterium
RLATLVRLELPLAWPVIMTGIRVSAQMLM

SEQ ID NO: 326380 - protein, 23 aa, Mycobacterium
RLATPRSVLIAAIVSLMIGAAAG

SEQ ID NO: 326381 - protein, 24 aa, Mycobacterium
RLATRAPELLPLLPDGYVAELQSC

SEQ ID NO: 326382 - protein, 18 aa, Mycobacterium
RLAVALLCTAALAAAVAT

SEQ ID NO: 326383 - protein, 19 aa, Mycobacterium
RLAVDGVLLAVFLFGCFVF

SEQ ID NO: 326384 - protein, 20 aa, Mycobacterium
RLAVIRRGVIPASWGGKLKT

SEQ ID NO: 326385 - protein, 34 aa, Mycobacterium
RLAVTLELPASGGLYRFSNVTYRGVQVGKVTEVN

SEQ ID NO: 326386 - protein, 26 aa, Mycobacterium
RLAWCPSDFRGAVVVSVPLGSSTTVY

SEQ ID NO: 326387 - protein, 36 aa, Mycobacterium
RLAWIGGRASGLVAGWNRVGIQVAFYARTIAEMRTA

SEQ ID NO: 326388 - protein, 27 aa, Mycobacterium
RLAWSLTVLVAVAWIARGIFLGRPVTA

SEQ ID NO: 326389 - protein, 18 aa, Mycobacterium
RLAYVGAVAVAAAVALTV

SEQ ID NO: 326390 - protein, 19 aa, Mycobacterium
RLDAAGFGFAAVAGASWAG

SEQ ID NO: 326391 - protein, 22 aa, Mycobacterium
RLDALWRSAVVVLQSILAVAFG

SEQ ID NO: 326392 - protein, 17 aa, Mycobacterium
RLDDIAYGLGLWSGVVR

SEQ ID NO: 326393 - protein, 20 aa, Mycobacterium
RLDDRFRLLTGSRRGLERHQ

SEQ ID NO: 326394 - protein, 20 aa, Mycobacterium
RLDFCGIAFGALFFCLSLTP

SEQ ID NO: 326395 - protein, 19 aa, Mycobacterium
RLDGAMFFGAAERISNAIV

SEQ ID NO: 326396 - protein, 17 aa, Mycobacterium
RLDGLAHPRSNVHFTPT

SEQ ID NO: 326397 - protein, 21 aa, Mycobacterium
RLDIMHSRLWGRAEAIRTTLR

SEQ ID NO: 326398 - protein, 19 aa, Mycobacterium
RLDLPVMAVAAVLFWVLCI

SEQ ID NO: 326399 - protein, 19 aa, Mycobacterium
RLDPLPSVGRIIGLEEVPD

SEQ ID NO: 326400 - protein, 18 aa, Mycobacterium
RLDQPGMSPVRWTGKLVA

SEQ ID NO: 326401 - protein, 25 aa, Mycobacterium
RLDQSGLVISDFVDRVGDQIGIVAA

SEQ ID NO: 326402 - protein, 34 aa, Mycobacterium
RLDRLPWGRFHWRVVIGLGGVWILDGLEVTMVGN

SEQ ID NO: 326403 - protein, 34 aa, Mycobacterium
RLDRLPWGRFHWRVVIGLGGVWVLDGLEVTMVGN

SEQ ID NO: 326404 - protein, 31 aa, Mycobacterium
RLDRLPWSRFHWRVVLGLGGVWILDGLEVTM

SEQ ID NO: 326405 - protein, 33 aa, Mycobacterium
RLDRLPWSRFHWRVVVGLGGVWILDGLEVTMVG

SEQ ID NO: 326406 - protein, 34 aa, Mycobacterium
RLDRLPWSRFHWRVVVGLGGVWVLDGLEVTMVGN

SEQ ID NO: 326407 - protein, 26 aa, Mycobacterium
RLDRRLDEAAGFAIPFLPRGLDEIPR

SEQ ID NO: 326408 - protein, 26 aa, Mycobacterium
RLDRRLDEAAGFAIPFLPRGLDQIPR

SEQ ID NO: 326409 - protein, 21 aa, Mycobacterium
RLDRSVAVKLLYPSQSSDDSV

SEQ ID NO: 326410 - protein, 22 aa, Mycobacterium
RLDVPCLLALTMTDELIARGGG

SEQ ID NO: 326411 - protein, 24 aa, Mycobacterium
RLEFPGRDALFWVYIATLMVPATV

SEQ ID NO: 326412 - protein, 24 aa, Mycobacterium
RLEFPGRDGLFWVYIATLMVPATV

SEQ ID NO: 326413 - protein, 20 aa, Mycobacterium
RLEIGVPIFFVLSGFLLFLP

SEQ ID NO: 326414 - protein, 18 aa, Mycobacterium
RLELTLVVGEWLKRIPDF

SEQ ID NO: 326415 - protein, 17 aa, Mycobacterium
RLELWPLVREEVAACWR

SEQ ID NO: 326416 - protein, 23 aa, Mycobacterium
RLELWRSDMVRMLSYGALDARIK

SEQ ID NO: 326417 - protein, 29 aa, Mycobacterium
RLEPVDALVCARLLAAYGAGDGTDRSTVG

SEQ ID NO: 326418 - protein, 19 aa, Mycobacterium
RLETSCYNPSFGADRQARV

SEQ ID NO: 326419 - protein, 22 aa, Mycobacterium
RLFALYVAAYCVGRFGVELLRD

SEQ ID NO: 326420 - protein, 23 aa, Mycobacterium
RLFANPRFSGVVGANLFSVLGLS

SEQ ID NO: 326421 - protein, 25 aa, Mycobacterium
RLFGELEFWAALVKVLALVVFLVVG

SEQ ID NO: 326422 - protein, 25 aa, Mycobacterium
RLFGKSAYHALTFGWLMSGLGRAVT

SEQ ID NO: 326423 - protein, 25 aa, Mycobacterium
RLFGLSLRDGRWWLGGAAAVLNYSL

SEQ ID NO: 326424 - protein, 24 aa, Mycobacterium
RLFNIPRGALYIVDSTLYVNASGS

SEQ ID NO: 326425 - protein, 27 aa, Mycobacterium
RLFPPSWKPGPDWEPLGMLVAGAVLIV

SEQ ID NO: 326426 - protein, 19 aa, Mycobacterium
RLFVRSRLIDAAREQADRG

SEQ ID NO: 326427 - protein, 19 aa, Mycobacterium
RLGAELAVAALVPIAGALA

SEQ ID NO: 326428 - protein, 17 aa, Mycobacterium
RLGAIARLPLQIPMITT

SEQ ID NO: 326429 - protein, 23 aa, Mycobacterium
RLGATPLPVWGIIAGKSLAVVTV

SEQ ID NO: 326430 - protein, 26 aa, Mycobacterium
RLGDILTAAGYNWAIADWRANRDPNK

SEQ ID NO: 326431 - protein, 24 aa, Mycobacterium
RLGDSRADLFGTIRNLQILVDALS

SEQ ID NO: 326432 - protein, 26 aa, Mycobacterium
RLGECGALVRVPRAAEALGRVEVVCF

SEQ ID NO: 326433 - protein, 19 aa, Mycobacterium
RLGERPDLMGDLDAIEDAA

SEQ ID NO: 326434 - protein, 22 aa, Mycobacterium
RLGESLYAFQFRSILGSLRSAW

SEQ ID NO: 326435 - protein, 27 aa, Mycobacterium
RLGFDPTFPFDVYWILPPTNYSAMHSI

SEQ ID NO: 326436 - protein, 19 aa, Mycobacterium
RLGGGTATVMFSRDRNAGV

SEQ ID NO: 326437 - protein, 24 aa, Mycobacterium
RLGGSRRAIFVGAIRVGRDHIAST

SEQ ID NO: 326438 - protein, 23 aa, Mycobacterium
RLGGTWRDVRLGLVFGLGGLVVS

SEQ ID NO: 326439 - protein, 23 aa, Mycobacterium
RLGIARIWLYLVISIGVAISVGL

SEQ ID NO: 326440 - protein, 20 aa, Mycobacterium
RLGKFHFWLTFIGFHSTFLV

SEQ ID NO: 326441 - protein, 24 aa, Mycobacterium
RLGKLHFWLTFIGFHLTFLVQHWL

SEQ ID NO: 326442 - protein, 23 aa, Mycobacterium
RLGKLHFWLTLIGFHTTFLVHHW

SEQ ID NO: 326443 - protein, 19 aa, Mycobacterium
RLGLDAPKGIGYVNFVVWL

SEQ ID NO: 326444 - protein, 25 aa, Mycobacterium
RLGPGRLYIGLLVLRGLGYCCYAGV

SEQ ID NO: 326445 - protein, 30 aa, Mycobacterium
RLGPRLLALSRLPAWIPDALRGAAAGVIAL

SEQ ID NO: 326446 - protein, 18 aa, Mycobacterium
RLGRKSVMAITIVLMALS

SEQ ID NO: 326447 - protein, 17 aa, Mycobacterium
RLGRRKLLIFGLMLAAV

SEQ ID NO: 326448 - protein, 17 aa, Mycobacterium
RLGRVGTDLALSASTAV

SEQ ID NO: 326449 - protein, 21 aa, Mycobacterium
RLGSTARRAAILAAVVCALTL

SEQ ID NO: 326450 - protein, 19 aa, Mycobacterium
RLGTRFGPYELHSVIGVGG

SEQ ID NO: 326451 - protein, 23 aa, Mycobacterium
RLGTRFGPYELRSLIGAGGLGEV

SEQ ID NO: 326452 - protein, 24 aa, Mycobacterium
RLGWIELGPSYGWLSSTPALVVLA

SEQ ID NO: 326453 - protein, 26 aa, Mycobacterium
RLGYGRTGYIWSMFAAFGLFTVGAVV

SEQ ID NO: 326454 - protein, 25 aa, Mycobacterium
RLGYWPAAAGLFAFVWLELASADPG

SEQ ID NO: 326455 - protein, 17 aa, Mycobacterium
RLHDLGKVIDLYRSTHW

SEQ ID NO: 326456 - protein, 18 aa, Mycobacterium
RLHGLHVADFLFVPPQAL

SEQ ID NO: 326457 - protein, 19 aa, Mycobacterium
RLHGREVYAGTGVGLALVK

SEQ ID NO: 326458 - protein, 20 aa, Mycobacterium
RLIAAFERWTVPPTVAVLVA

SEQ ID NO: 326459 - protein, 20 aa, Mycobacterium
RLIATGGMGQVWEAVDSRLG

SEQ ID NO: 326460 - protein, 19 aa, Mycobacterium
RLIATGGMGQVWEGVDSRL

SEQ ID NO: 326461 - protein, 19 aa, Mycobacterium
RLIEACGAVVIMIGAVVAI

SEQ ID NO: 326462 - protein, 19 aa, Mycobacterium
RLIELALRGGGPDNVTVVV

SEQ ID NO: 326463 - protein, 19 aa, Mycobacterium
RLIGYVVGDALDIGALRST

SEQ ID NO: 326464 - protein, 27 aa, Mycobacterium
RLIHPVAIEHLGWVAAAGLIGFIGNEV

SEQ ID NO: 326465 - protein, 20 aa, Mycobacterium
RLIIGLLMTAIVLVFAAKRV

SEQ ID NO: 326466 - protein, 26 aa, Mycobacterium
RLILADRLYSAFLVILPFVLAGLTLL

SEQ ID NO: 326467 - protein, 19 aa, Mycobacterium
RLILIAAIGTILAVRAGDL

SEQ ID NO: 326468 - protein, 31 aa, Mycobacterium
RLIRAFSVPIVLFWLAVCVVVSVFVPSLEEV

SEQ ID NO: 326469 - protein, 23 aa, Mycobacterium
RLIRWKDAIIALGLLASLDDADL

SEQ ID NO: 326470 - protein, 19 aa, Mycobacterium
RLISSLCGFLLTLTVSRVI

SEQ ID NO: 326471 - protein, 21 aa, Mycobacterium
RLITLCPALVILAVGFDPTRA

SEQ ID NO: 326472 - protein, 18 aa, Mycobacterium
RLKELGCMGLMMSASPDE

SEQ ID NO: 326473 - protein, 23 aa, Mycobacterium
RLKFSAWLVFAGLWATLVYFPIA

SEQ ID NO: 326474 - protein, 22 aa, Mycobacterium
RLKPGESVRVAGIRVGTVDSVS

SEQ ID NO: 326475 - protein, 24 aa, Mycobacterium
RLKTFLLLVGMSAMIVFFGALFGR

SEQ ID NO: 326476 - protein, 23 aa, Mycobacterium
RLKTFLLLVGMSGLIVFVGSLFG

SEQ ID NO: 326477 - protein, 23 aa, Mycobacterium
RLKTFLLLVVMSAMIVFVGRLFG

SEQ ID NO: 326478 - protein, 33 aa, Mycobacterium
RLKVIDTVTDWPRYGGYAVAGVSSFGFGGANAH

SEQ ID NO: 326479 - protein, 25 aa, Mycobacterium
RLLAACRRAKEQLSTAAVSTVAGAS

SEQ ID NO: 326480 - protein, 18 aa, Mycobacterium
RLLAHPRGNAGRRYIRAA

SEQ ID NO: 326481 - protein, 24 aa, Mycobacterium
RLLAIIANALRWLVWAKTKDGHRN

SEQ ID NO: 326482 - protein, 25 aa, Mycobacterium
RLLAPLRFALILSGVLQVVATLVQL

SEQ ID NO: 326483 - protein, 20 aa, Mycobacterium
RLLAPLRPALILSGVLQAVI

SEQ ID NO: 326484 - protein, 25 aa, Mycobacterium
RLLAPLRWALILSGLLQAVITLVQL

SEQ ID NO: 326485 - protein, 24 aa, Mycobacterium
RLLDKLSRVPLGWFTQRGSGSVKK

SEQ ID NO: 326486 - protein, 17 aa, Mycobacterium
RLLEAMRKFKLIWDPEW

SEQ ID NO: 326487 - protein, 20 aa, Mycobacterium
RLLEDLRRNNGMTVVVISHD

SEQ ID NO: 326488 - protein, 24 aa, Mycobacterium
RLLEKGSSVSGGWFTITVLVILLV

SEQ ID NO: 326489 - protein, 17 aa, Mycobacterium
RLLFLAWLPLSGFLLYA

SEQ ID NO: 326490 - protein, 20 aa, Mycobacterium
RLLFSVGVDGFFAVSGFLVA

SEQ ID NO: 326491 - protein, 25 aa, Mycobacterium
RLLGKPAYHALTFGWLMSGLARGVT

SEQ ID NO: 326492 - protein, 27 aa, Mycobacterium
RLLGNQRWRWGALMLVVSIVLQAAALD

SEQ ID NO: 326493 - protein, 20 aa, Mycobacterium
RLLGPMERLLILSLGVGGQF

SEQ ID NO: 326494 - protein, 18 aa, Mycobacterium
RLLGRGGMGEVYEAEHTV

SEQ ID NO: 326495 - protein, 18 aa, Mycobacterium
RLLGRGGMGEVYEAENTV

SEQ ID NO: 326496 - protein, 18 aa, Mycobacterium
RLLGSAWAGLTTQRDVLV

SEQ ID NO: 326497 - protein, 28 aa, Mycobacterium
RLLGSAYGWFAGWAYMWTLLVTLTAVSY

SEQ ID NO: 326498 - protein, 25 aa, Mycobacterium
RLLGWSFGGSMALLIAQELSRRGRE

SEQ ID NO: 326499 - protein, 21 aa, Mycobacterium
RLLLELATLVGAEFINVFELI

SEQ ID NO: 326500 - protein, 24 aa, Mycobacterium
RLLLFRVEFGAGLIKMRGDPCWRD

SEQ ID NO: 326501 - protein, 20 aa, Mycobacterium
RLLLPGMVLGAVSFAYVVRL

SEQ ID NO: 326502 - protein, 20 aa, Mycobacterium
RLLLSLMPEPVVQRYREGEE

SEQ ID NO: 326503 - protein, 19 aa, Mycobacterium
RLLMIVGVVLAQFATANQL

SEQ ID NO: 326504 - protein, 17 aa, Mycobacterium
RLLPAVAAVAGMGVLAV

SEQ ID NO: 326505 - protein, 21 aa, Mycobacterium
RLLPGLAMSARAWRVLYRSTD

SEQ ID NO: 326506 - protein, 18 aa, Mycobacterium
RLLPTALALIVFIGVATA

SEQ ID NO: 326507 - protein, 25 aa, Mycobacterium
RLLQKAASLPGGWLTATVLVILLGV

SEQ ID NO: 326508 - protein, 18 aa, Mycobacterium
RLLRIGRSRFQARNLVAV

SEQ ID NO: 326509 - protein, 28 aa, Mycobacterium
RLLRLKVFPLAISLPWGIAPAALPQLPL

SEQ ID NO: 326510 - protein, 17 aa, Mycobacterium
RLLRTAFGPVITGLQTM

SEQ ID NO: 326511 - protein, 26 aa, Mycobacterium
RLLRTPRPYLYAGILFFATLGALAVN

SEQ ID NO: 326512 - protein, 25 aa, Mycobacterium
RLLRVTRWDVGLAMIVAGGVNAAML

SEQ ID NO: 326513 - protein, 32 aa, Mycobacterium
RLLRWLKDDPRGWSRLRGNAVVSIEGAQPQLA

SEQ ID NO: 326514 - protein, 17 aa, Mycobacterium
RLLSEYGDRAGLFDTSA

SEQ ID NO: 326515 - protein, 18 aa, Mycobacterium
RLLSRMWILPIHRASAVT

SEQ ID NO: 326516 - protein, 20 aa, Mycobacterium
RLLSVWPLVGLGAISYGVYL

SEQ ID NO: 326517 - protein, 17 aa, Mycobacterium
RLLSYEMTLAEWLGTAV

SEQ ID NO: 326518 - protein, 31 aa, Mycobacterium
RLLVPAVLIELAFSLIVMWVPPVARLLGQWN

SEQ ID NO: 326519 - protein, 19 aa, Mycobacterium
RLLVRPGITGLWQVSGRSD

SEQ ID NO: 326520 - protein, 18 aa, Mycobacterium
RLLVSAVLTVPVIAMAMV

SEQ ID NO: 326521 - protein, 20 aa, Mycobacterium
RLLYLASMGCWLIAQLFRVT

SEQ ID NO: 326522 - protein, 21 aa, Mycobacterium
RLMFDPVFGALFWGKIFSVVA

SEQ ID NO: 326523 - protein, 17 aa, Mycobacterium
RLMGVIFATIFFLMFTP

SEQ ID NO: 326524 - protein, 17 aa, Mycobacterium
RLMGVIFATMFFLMFTP

SEQ ID NO: 326525 - protein, 22 aa, Mycobacterium
RLMIKAVSTLGAIGLAAALVAV

SEQ ID NO: 326526 - protein, 21 aa, Mycobacterium
RLMPKRGRIAMLLFALSQFVI

SEQ ID NO: 326527 - protein, 18 aa, Mycobacterium
RLMWTVPVYAFFAAGLGV

SEQ ID NO: 326528 - protein, 17 aa, Mycobacterium
RLNAAAVSADWDDEATL

SEQ ID NO: 326529 - protein, 24 aa, Mycobacterium
RLNCASCHNFTGRGGALSSGKFAP

SEQ ID NO: 326530 - protein, 20 aa, Mycobacterium
RLNDPWYQQLWYYVVRGPEI

SEQ ID NO: 326531 - protein, 19 aa, Mycobacterium
RLNIAAADLGRLHLAASIR

SEQ ID NO: 326532 - protein, 19 aa, Mycobacterium
RLNLRVFFTRTAIVLIVIA

SEQ ID NO: 326533 - protein, 25 aa, Mycobacterium
RLNSLFRLDHLAARMRRNGANLLVL

SEQ ID NO: 326534 - protein, 19 aa, Mycobacterium
RLPAGTPMYGLERVEGTIQ

SEQ ID NO: 326535 - protein, 20 aa, Mycobacterium
RLPAMVRMVPGPLVAIAGAT

SEQ ID NO: 326536 - protein, 20 aa, Mycobacterium
RLPAQCATIGQVLQDNGYST

SEQ ID NO: 326537 - protein, 28 aa, Mycobacterium
RLPDDEIMAWGWRVPFLASSALLLVGLY

SEQ ID NO: 326538 - protein, 29 aa, Mycobacterium
RLPDDQFLAWGWRIPFLVSAILIVIGLVV

SEQ ID NO: 326539 - protein, 20 aa, Mycobacterium
RLPDGTPFPTLYYLTHPALT

SEQ ID NO: 326540 - protein, 23 aa, Mycobacterium
RLPDLKLFVCGGASVSPSLIRRA

SEQ ID NO: 326541 - protein, 19 aa, Mycobacterium
RLPGALTVRGGRPATPAPF

SEQ ID NO: 326542 - protein, 17 aa, Mycobacterium
RLPGVAMVQSITRPMGR

SEQ ID NO: 326543 - protein, 18 aa, Mycobacterium
RLPIAPWEQAAHLLDYGF

SEQ ID NO: 326544 - protein, 17 aa, Mycobacterium
RLPLIVRIDDPWLAEAW

SEQ ID NO: 326545 - protein, 17 aa, Mycobacterium
RLPLIVRIDDPWLAESW

SEQ ID NO: 326546 - protein, 19 aa, Mycobacterium
RLPLPEPYVPPRIDAARDR

SEQ ID NO: 326547 - protein, 19 aa, Mycobacterium
RLPLPEPYVPPRLDLVRER

SEQ ID NO: 326548 - protein, 19 aa, Mycobacterium
RLPLPRSAQGPVVYVQDVA

SEQ ID NO: 326549 - protein, 17 aa, Mycobacterium
RLPLSYVDAHRHGELLS

SEQ ID NO: 326550 - protein, 24 aa, Mycobacterium
RLPLVCCLVAFILTFFITRTIVRY

SEQ ID NO: 326551 - protein, 21 aa, Mycobacterium
RLPNLRPGGDYVTDGDGLSDC

SEQ ID NO: 326552 - protein, 18 aa, Mycobacterium
RLPPWPRIPLTKGSARTA

SEQ ID NO: 326553 - protein, 22 aa, Mycobacterium
RLPREVWVLVVANVVVALGYGV

SEQ ID NO: 326554 - protein, 18 aa, Mycobacterium
RLPRPLQRLLSRRRFANA

SEQ ID NO: 326555 - protein, 21 aa, Mycobacterium
RLPRQDALKVLRPEVSADHEY

SEQ ID NO: 326556 - protein, 20 aa, Mycobacterium
RLPRRDALKVLPAELTADPQ

SEQ ID NO: 326557 - protein, 17 aa, Mycobacterium
RLPRRWRAQDLFTVTVG

SEQ ID NO: 326558 - protein, 24 aa, Mycobacterium
RLPSGTPEYGSWILGRVTESQSRR

SEQ ID NO: 326559 - protein, 30 aa, Mycobacterium
RLPTLAMALTCWWLISREVIPRLGHAVKHS

SEQ ID NO: 326560 - protein, 30 aa, Mycobacterium
RLPTLAMALTCWWVISREVIPRLGHAVKTN

SEQ ID NO: 326561 - protein, 24 aa, Mycobacterium
RLPTLAMGLLCWAVISREVIPRLG

SEQ ID NO: 326562 - protein, 20 aa, Mycobacterium
RLPVEGRLHVVSMIRLAFTV

SEQ ID NO: 326563 - protein, 24 aa, Mycobacterium
RLPVLDRLLPVWIGAAMAAGLLLG

SEQ ID NO: 326564 - protein, 26 aa, Mycobacterium
RLPYPGRIGLLFAVMPFHAFFGIALM

SEQ ID NO: 326565 - protein, 17 aa, Mycobacterium
RLQRRLGAEPDVDPDGA

SEQ ID NO: 326566 - protein, 18 aa, Mycobacterium
RLRAEAAVAELFAEQDQY

SEQ ID NO: 326567 - protein, 27 aa, Mycobacterium
RLRAESRLNRLLALQIPPARKVVTGQD

SEQ ID NO: 326568 - protein, 27 aa, Mycobacterium
RLRAESRLNRLLALQVPPARKVVAGPD

SEQ ID NO: 326569 - protein, 21 aa, Mycobacterium
RLRATEYVWLALPRRPSVLAG

SEQ ID NO: 326570 - protein, 19 aa, Mycobacterium
RLRATVYGLVVLTLATAIA

SEQ ID NO: 326571 - protein, 19 aa, Mycobacterium
RLRAYLAARALRILPGFYV

SEQ ID NO: 326572 - protein, 25 aa, Mycobacterium
RLRCHSLGGPPVVQWGSRDIERKVQ

SEQ ID NO: 326573 - protein, 26 aa, Mycobacterium
RLRCKRHLRLGISIFPMRSAKVIAKA

SEQ ID NO: 326574 - protein, 21 aa, Mycobacterium
RLRDSERWYGYNLYGPTEYTI

SEQ ID NO: 326575 - protein, 19 aa, Mycobacterium
RLRERGWLAILSLRLIPAV

SEQ ID NO: 326576 - protein, 21 aa, Mycobacterium
RLRFIPWVRRIVDPPVRVLIR

SEQ ID NO: 326577 - protein, 21 aa, Mycobacterium
RLRGDYLAIVTLGFGEIIRLM

SEQ ID NO: 326578 - protein, 26 aa, Mycobacterium
RLRGQGPPAHRVWLPPLGPAPQLHTL

SEQ ID NO: 326579 - protein, 19 aa, Mycobacterium
RLRITRLTRVLAVTGAVAC

SEQ ID NO: 326580 - protein, 24 aa, Mycobacterium
RLRLFGIGIPAAIGLLAGIVAQSY

SEQ ID NO: 326581 - protein, 17 aa, Mycobacterium
RLRPIISAVLSIRDTWL

SEQ ID NO: 326582 - protein, 18 aa, Mycobacterium
RLRQLPAGVIGEIYVTGG

SEQ ID NO: 326583 - protein, 18 aa, Mycobacterium
RLRQVLLQVGTGVERPSA

SEQ ID NO: 326584 - protein, 20 aa, Mycobacterium
RLRRALGVAGLVAFGLAYID

SEQ ID NO: 326585 - protein, 25 aa, Mycobacterium
RLRRPAQLGGLVFVSAFTVVTLGMP

SEQ ID NO: 326586 - protein, 21 aa, Mycobacterium
RLRRPELPTSVRSAMDTVRGH

SEQ ID NO: 326587 - protein, 17 aa, Mycobacterium
RLRRPTIVLGSTVALLG

SEQ ID NO: 326588 - protein, 25 aa, Mycobacterium
RLRRRGDAWPTGRVVAWLLGCLVLL

SEQ ID NO: 326589 - protein, 18 aa, Mycobacterium
RLRRRLGSDPDTAEDDAP

SEQ ID NO: 326590 - protein, 21 aa, Mycobacterium
RLRRRQMSVGEFIGMVQAGLN

SEQ ID NO: 326591 - protein, 19 aa, Mycobacterium
RLRRRQRFMLSLYVPLVMR

SEQ ID NO: 326592 - protein, 17 aa, Mycobacterium
RLRRRVTDLGWFRALAC

SEQ ID NO: 326593 - protein, 22 aa, Mycobacterium
RLRSEIRAGTPIVGMEPSCLAV

SEQ ID NO: 326594 - protein, 20 aa, Mycobacterium
RLRSMYGYGVAYAVASLSCT

SEQ ID NO: 326595 - protein, 21 aa, Mycobacterium
RLRTDLSYGLYIYAFPTQVML

SEQ ID NO: 326596 - protein, 21 aa, Mycobacterium
RLRTDLSYGMYIYAYPTQQLL

SEQ ID NO: 326597 - protein, 20 aa, Mycobacterium
RLRTDLSYGVYIYAFPIQQL

SEQ ID NO: 326598 - protein, 18 aa, Mycobacterium
RLRWDPYPFILLNLAFST

SEQ ID NO: 326599 - protein, 18 aa, Mycobacterium
RLSDALVRISSQFGVSIP

SEQ ID NO: 326600 - protein, 17 aa, Mycobacterium
RLSDRIATHLALAQSAG

SEQ ID NO: 326601 - protein, 30 aa, Mycobacterium
RLSDRLGRRVPFLVGGVGMAVWAFAVYPLM

SEQ ID NO: 326602 - protein, 30 aa, Mycobacterium
RLSEATDALARRIALVLGYRTTAVCVIEPE

SEQ ID NO: 326603 - protein, 30 aa, Mycobacterium
RLSEVDLRPHVWITRVPFVVFVIGALGVGL

SEQ ID NO: 326604 - protein, 21 aa, Mycobacterium
RLSGRRKGILLALLIAPFWIS

SEQ ID NO: 326605 - protein, 20 aa, Mycobacterium
RLSIDELPQFINVLRGEMSV

SEQ ID NO: 326606 - protein, 20 aa, Mycobacterium
RLSIFSVVLLIFTVMIFVVF

SEQ ID NO: 326607 - protein, 19 aa, Mycobacterium
RLSPMIAAAAMALSSLSVV

SEQ ID NO: 326608 - protein, 19 aa, Mycobacterium
RLSPMIAAGAMALSSLSVV

SEQ ID NO: 326609 - protein, 28 aa, Mycobacterium
RLSPNPVFRSVAWVYLWIFRGTPVYVQL

SEQ ID NO: 326610 - protein, 19 aa, Mycobacterium
RLSPQVARYTRILIAGMAM

SEQ ID NO: 326611 - protein, 19 aa, Mycobacterium
RLSQPARQRWFAMIASSDD

SEQ ID NO: 326612 - protein, 23 aa, Mycobacterium
RLSRLSTWGPWVSVGAAALCGVC

SEQ ID NO: 326613 - protein, 24 aa, Mycobacterium
RLSRPHAPWARWRYSARPDKMRRA

SEQ ID NO: 326614 - protein, 18 aa, Mycobacterium
RLSSDHPLVLPILGAIAA

SEQ ID NO: 326615 - protein, 21 aa, Mycobacterium
RLSSGGIEWGVAIPFTAGGIV

SEQ ID NO: 326616 - protein, 28 aa, Mycobacterium
RLSSRPARGSYTFGLKRAEILSAQANGV

SEQ ID NO: 326617 - protein, 21 aa, Mycobacterium
RLSVLSLPTTIIFDADGRPRY

SEQ ID NO: 326618 - protein, 29 aa, Mycobacterium
RLSYSWYLWHWPVLLLAAPLLGRPLGPID

SEQ ID NO: 326619 - protein, 18 aa, Mycobacterium
RLTADWLGGRAYYRGRFL

SEQ ID NO: 326620 - protein, 20 aa, Mycobacterium
RLTARGALVRAPRTIEALGR

SEQ ID NO: 326621 - protein, 19 aa, Mycobacterium
RLTDRARRASGYLSVLLIA

SEQ ID NO: 326622 - protein, 19 aa, Mycobacterium
RLTEAFNMMLRALAESRER

SEQ ID NO: 326623 - protein, 19 aa, Mycobacterium
RLTGEPALGPVLLTQDAAR

SEQ ID NO: 326624 - protein, 25 aa, Mycobacterium
RLTGFARIVLLAAILGAALSSAFTV

SEQ ID NO: 326625 - protein, 25 aa, Mycobacterium
RLTGFARIVLLAAILGAALSSSFSV

SEQ ID NO: 326626 - protein, 17 aa, Mycobacterium
RLTGHPLRRPRGTEWLW

SEQ ID NO: 326627 - protein, 24 aa, Mycobacterium
RLTHALDLLNFLLADVRDGLGPYL

SEQ ID NO: 326628 - protein, 19 aa, Mycobacterium
RLTPLCVFTTAISLLALLV

SEQ ID NO: 326629 - protein, 20 aa, Mycobacterium
RLTPPGTFRAIPRYWQEAAD

SEQ ID NO: 326630 - protein, 33 aa, Mycobacterium
RLTRELRRPVDVAGRLGDHTSFYGRALAGTPHA

SEQ ID NO: 326631 - protein, 19 aa, Mycobacterium
RLTRLICAVVGGLLLCASF

SEQ ID NO: 326632 - protein, 23 aa, Mycobacterium
RLTRPVRITAWLVAGLSALGLLN

SEQ ID NO: 326633 - protein, 18 aa, Mycobacterium
RLTWHGAVGVWIVVGLLA

SEQ ID NO: 326634 - protein, 17 aa, Mycobacterium
RLVAELSLQPGIFAVHW

SEQ ID NO: 326635 - protein, 17 aa, Mycobacterium
RLVAGWFPAHQRGLAMG

SEQ ID NO: 326636 - protein, 17 aa, Mycobacterium
RLVAVLMVLQLISTLAS

SEQ ID NO: 326637 - protein, 18 aa, Mycobacterium
RLVCIEDLGDIDILITDK

SEQ ID NO: 326638 - protein, 20 aa, Mycobacterium
RLVDGLSPWLLVGVAAALVA

SEQ ID NO: 326639 - protein, 18 aa, Mycobacterium
RLVDLFPEPSLRTQRVIA

SEQ ID NO: 326640 - protein, 28 aa, Mycobacterium
RLVDLLPLPSLRVQRLIAFLVILTQGGI

SEQ ID NO: 326641 - protein, 28 aa, Mycobacterium
RLVDVVGCSLRLPGIYPPQVYQGRLHVD

SEQ ID NO: 326642 - protein, 17 aa, Mycobacterium
RLVEAYAVIALALFVNW

SEQ ID NO: 326643 - protein, 17 aa, Mycobacterium
RLVEILIGGGLAVMAHV

SEQ ID NO: 326644 - protein, 18 aa, Mycobacterium
RLVFGHLDLTTALTVLIL

SEQ ID NO: 326645 - protein, 25 aa, Mycobacterium
RLVHAFSAPVAYLFRPYVVYRSRGV

SEQ ID NO: 326646 - protein, 23 aa, Mycobacterium
RLVKRAHSTLSFQLSGAQLGITI

SEQ ID NO: 326647 - protein, 27 aa, Mycobacterium
RLVMRAGEPRLSAWVRYHSDERLPKEL

SEQ ID NO: 326648 - protein, 17 aa, Mycobacterium
RLVNILVITPLRLLFLI

SEQ ID NO: 326649 - protein, 20 aa, Mycobacterium
RLVPAVGLVGCLVLAFTLPL

SEQ ID NO: 326650 - protein, 18 aa, Mycobacterium
RLVQGLAVGGEWGGATTM

SEQ ID NO: 326651 - protein, 25 aa, Mycobacterium
RLVRARGTLAFDVGICLVLITLPTM

SEQ ID NO: 326652 - protein, 26 aa, Mycobacterium
RLVRDAKPYPGFHRIQGVEVVPMSVL

SEQ ID NO: 326653 - protein, 17 aa, Mycobacterium
RLVRRLLDVAGTTYAAE

SEQ ID NO: 326654 - protein, 19 aa, Mycobacterium
RLVRSELPQTIVVSVSHRS

SEQ ID NO: 326655 - protein, 17 aa, Mycobacterium
RLVSPWWALGLGMILGG

SEQ ID NO: 326656 - protein, 24 aa, Mycobacterium
RLVTLCPAVAILAIGFDPTRTLVL

SEQ ID NO: 326657 - protein, 25 aa, Mycobacterium
RLVTLCPAVAILALGLDPTRTLVLS

SEQ ID NO: 326658 - protein, 23 aa, Mycobacterium
RLVTPRLAAILFVSPLLCIFIIF

SEQ ID NO: 326659 - protein, 17 aa, Mycobacterium
RLVVLSMSRRYQPDFSF

SEQ ID NO: 326660 - protein, 18 aa, Mycobacterium
RLVVPRFAAAIMIAVALT

SEQ ID NO: 326661 - protein, 23 aa, Mycobacterium
RLVVPRFAAAIMIGIALTGVVCF

SEQ ID NO: 326662 - protein, 18 aa, Mycobacterium
RLVVPRFAAAIMIGVALT

SEQ ID NO: 326663 - protein, 19 aa, Mycobacterium
RLVVPRFAAAIMIGVALTG

SEQ ID NO: 326664 - protein, 19 aa, Mycobacterium
RLVVPRFAAAIMVGVALTG

SEQ ID NO: 326665 - protein, 24 aa, Mycobacterium
RLVVPRFAAAIVIGIALTGVVCFV

SEQ ID NO: 326666 - protein, 18 aa, Mycobacterium
RLVVPRVAAAVLVGVGLT

SEQ ID NO: 326667 - protein, 17 aa, Mycobacterium
RLVVPRVLASTFVALLL

SEQ ID NO: 326668 - protein, 18 aa, Mycobacterium
RLVVPRVVASTMVAVLLN

SEQ ID NO: 326669 - protein, 25 aa, Mycobacterium
RLWHTRPDLRQALAQLPACPPSLAA

SEQ ID NO: 326670 - protein, 21 aa, Mycobacterium
RLWVPWWWWPPALALAGILAF

SEQ ID NO: 326671 - protein, 25 aa, Mycobacterium
RLYADPWCAWALLAATVAIPTGLAV

SEQ ID NO: 326672 - protein, 20 aa, Mycobacterium
RLYALHILLIPGIILALIGA

SEQ ID NO: 326673 - protein, 20 aa, Mycobacterium
RLYALHILLIPGIILALIGV

SEQ ID NO: 326674 - protein, 20 aa, Mycobacterium
RLYALHILLLPGIILALIGL

SEQ ID NO: 326675 - protein, 38 aa, Mycobacterium
RLYDDRRIKLWVVFVEDFSGQNYIGWAQNTMRLSDFGD

SEQ ID NO: 326676 - protein, 20 aa, Mycobacterium
RLYDIPSRFVKTIGPDPVHI

SEQ ID NO: 326677 - protein, 20 aa, Mycobacterium
RLYGRRGARNRAMRAVTATK

SEQ ID NO: 326678 - protein, 17 aa, Mycobacterium
RLYLRRDRLSLPLWVFL

SEQ ID NO: 326679 - protein, 30 aa, Mycobacterium
RLYRHIATSVVRWPKPVFVASAVVVLVGAV

SEQ ID NO: 326680 - protein, 20 aa, Mycobacterium
RLYSVGWLSRPWEQMLDSMG

SEQ ID NO: 326681 - protein, 26 aa, Mycobacterium
RMAHAFSIQLICRALGMLASVVSVAM

SEQ ID NO: 326682 - protein, 26 aa, Mycobacterium
RMAKRSGHEHFWRSGFQGLRGAVAVA

SEQ ID NO: 326683 - protein, 19 aa, Mycobacterium
RMAPFHHHFELVGWAETQV

SEQ ID NO: 326684 - protein, 18 aa, Mycobacterium
RMAVTVAVAAALFVGCAA

SEQ ID NO: 326685 - protein, 30 aa, Mycobacterium
RMDDETFLSWGWRIPFLLSAIVIVVGLYIR

SEQ ID NO: 326686 - protein, 20 aa, Mycobacterium
RMELSLVISEWLRRIPQFEL

SEQ ID NO: 326687 - protein, 20 aa, Mycobacterium
RMFGGGLTLAVLVDATLVRM

SEQ ID NO: 326688 - protein, 25 aa, Mycobacterium
RMGARIPGLVQFLLTMGWVGVNTWV

SEQ ID NO: 326689 - protein, 26 aa, Mycobacterium
RMGEALRRWAALLVMTIFVVIMPLTV

SEQ ID NO: 326690 - protein, 31 aa, Mycobacterium
RMGHARPLYGPGLRFLIPFVDKMIRVDQRLV

SEQ ID NO: 326691 - protein, 28 aa, Mycobacterium
RMGMTPSRMLMPLAFAAKVGPLLILVGS

SEQ ID NO: 326692 - protein, 18 aa, Mycobacterium
RMGTSAFFSSDWAWLSCL

SEQ ID NO: 326693 - protein, 18 aa, Mycobacterium
RMGVSRSILGRVADLGGA

SEQ ID NO: 326694 - protein, 19 aa, Mycobacterium
RMHVRLCIIVGSLELVQAA

SEQ ID NO: 326695 - protein, 27 aa, Mycobacterium
RMIHAFAVPIILAWVAVCVALSVFIPS

SEQ ID NO: 326696 - protein, 26 aa, Mycobacterium
RMIHRLAVPIVLLWIGLVVVLSIFVP

SEQ ID NO: 326697 - protein, 17 aa, Mycobacterium
RMISRACATRARAAGVI

SEQ ID NO: 326698 - protein, 20 aa, Mycobacterium
RMKDLSCIGLQMSGNKDEGV

SEQ ID NO: 326699 - protein, 21 aa, Mycobacterium
RMKFTDTWDGLRLWVHENGQR

SEQ ID NO: 326700 - protein, 19 aa, Mycobacterium
RMLASGLVALLLNSLVVII

SEQ ID NO: 326701 - protein, 20 aa, Mycobacterium
RMLEHGHWVLAVAYTVVSIV

SEQ ID NO: 326702 - protein, 18 aa, Mycobacterium
RMLELCGSEMGADGAPQP

SEQ ID NO: 326703 - protein, 25 aa, Mycobacterium
RMLKVELPLALPVLIASLRVVAVTN

SEQ ID NO: 326704 - protein, 24 aa, Mycobacterium
RMLKVELPLSIPVLVAGLRVVVVT

SEQ ID NO: 326705 - protein, 19 aa, Mycobacterium
RMLLSPEGPLSWATGFTPG

SEQ ID NO: 326706 - protein, 17 aa, Mycobacterium
RMLPSALLAPLAATLAT

SEQ ID NO: 326707 - protein, 27 aa, Mycobacterium
RMNGWPEAIFRFGLYAFLCATALMVVR

SEQ ID NO: 326708 - protein, 21 aa, Mycobacterium
RMPAARALLWVLFWLGWAIAL

SEQ ID NO: 326709 - protein, 23 aa, Mycobacterium
RMPENRLRVLVACGAAGGISATF

SEQ ID NO: 326710 - protein, 22 aa, Mycobacterium
RMPETLSAYLFGGGADAAREVL

SEQ ID NO: 326711 - protein, 19 aa, Mycobacterium
RMPGKYAYTDAVREVRERE

SEQ ID NO: 326712 - protein, 21 aa, Mycobacterium
RMPLAPYSGYLTLAFLAGVLI

SEQ ID NO: 326713 - protein, 19 aa, Mycobacterium
RMPLWPLPPLLAVVGVVVT

SEQ ID NO: 326714 - protein, 25 aa, Mycobacterium
RMPPLTLLEPVTWSPGTRLGMIALR

SEQ ID NO: 326715 - protein, 21 aa, Mycobacterium
RMPPRRHLLTLIPMGLAGIVG

SEQ ID NO: 326716 - protein, 23 aa, Mycobacterium
RMQAEFPSMIAVATSMRGTLLTL

SEQ ID NO: 326717 - protein, 18 aa, Mycobacterium
RMRAEAFDLVLQTGAAGG

SEQ ID NO: 326718 - protein, 17 aa, Mycobacterium
RMRAVLVAIDNTPDGAL

SEQ ID NO: 326719 - protein, 18 aa, Mycobacterium
RMRIEQWDRTTLLEQERV

SEQ ID NO: 326720 - protein, 18 aa, Mycobacterium
RMRIRRYLQLLLIGLSGN

SEQ ID NO: 326721 - protein, 17 aa, Mycobacterium
RMRYSGVSLGYQVTSIV

SEQ ID NO: 326722 - protein, 18 aa, Mycobacterium
RMSIALAGLSPRLPPAPD

SEQ ID NO: 326723 - protein, 27 aa, Mycobacterium
RMSLWYPDRAWWVLGIYTVAAAVALIV

SEQ ID NO: 326724 - protein, 18 aa, Mycobacterium
RMSPGFAEAAPWRPVVLV

SEQ ID NO: 326725 - protein, 21 aa, Mycobacterium
RMSRERLWQTIGFLSLVALLF

SEQ ID NO: 326726 - protein, 18 aa, Mycobacterium
RMSRHFADRTRPWITTVL

SEQ ID NO: 326727 - protein, 21 aa, Mycobacterium
RMSVSPALRYALMAGATTGTI

SEQ ID NO: 326728 - protein, 18 aa, Mycobacterium
RMSYPIFALYNIVGAVVW

SEQ ID NO: 326729 - protein, 23 aa, Mycobacterium
RMTAVKYPSGWNAVAAHINADPH

SEQ ID NO: 326730 - protein, 23 aa, Mycobacterium
RMTELVEDLLLLARLDSGRPLAQ

SEQ ID NO: 326731 - protein, 23 aa, Mycobacterium
RMTFAFYGPFAFVIGGTQHVIAN

SEQ ID NO: 326732 - protein, 18 aa, Mycobacterium
RMTPAVAILAAVAFVSFL

SEQ ID NO: 326733 - protein, 21 aa, Mycobacterium
RMTRWKVTLLAGAVASVVLAV

SEQ ID NO: 326734 - protein, 18 aa, Mycobacterium
RMTVFPYGRSGMIAASML

SEQ ID NO: 326735 - protein, 19 aa, Mycobacterium
RMTYGWKRAEILSAQANGL

SEQ ID NO: 326736 - protein, 26 aa, Mycobacterium
RMVAGLDIFALLAIPFFILGGEIMAA

SEQ ID NO: 326737 - protein, 34 aa, Mycobacterium
RMVLVPAFIHLLGRWTWWAPRPLVSLRERSAIGE

SEQ ID NO: 326738 - protein, 24 aa, Mycobacterium
RMYLLGLAGAIVFGLLAAASPNAV

SEQ ID NO: 326739 - protein, 19 aa, Mycobacterium
RMYSLHILLLPGIILALIG

SEQ ID NO: 326740 - protein, 24 aa, Mycobacterium
RNADYRLGWYVIIGTIPICILGLF

SEQ ID NO: 326741 - protein, 23 aa, Mycobacterium
RNADYRLGWYVIIGTIPICVMGL

SEQ ID NO: 326742 - protein, 25 aa, Mycobacterium
RNALRDRGGRSRMLATTVGSAAAVT

SEQ ID NO: 326743 - protein, 25 aa, Mycobacterium
RNAPGCAGCCQCAIGCPRNAKFGVH

SEQ ID NO: 326744 - protein, 20 aa, Mycobacterium
RNAQRLRRGPAAGHNSDPHW

SEQ ID NO: 326745 - protein, 19 aa, Mycobacterium
RNARIIRRFFYLVLLMTAF

SEQ ID NO: 326746 - protein, 24 aa, Mycobacterium
RNARSRAWVKVGYVVFVLAGIYAV

SEQ ID NO: 326747 - protein, 25 aa, Mycobacterium
RNARSRAWVKVGYVVFVLAGIYAVL

SEQ ID NO: 326748 - protein, 19 aa, Mycobacterium
RNAVRELSQAAGRLGDSRT

SEQ ID NO: 326749 - protein, 19 aa, Mycobacterium
RNAYWPAEYLIDASGTVRH

SEQ ID NO: 326750 - protein, 22 aa, Mycobacterium
RNCLDIGVWRDAGWQVHALGRT

SEQ ID NO: 326751 - protein, 27 aa, Mycobacterium
RNDEAGIPMALRWGYYAREELVDAPFG

SEQ ID NO: 326752 - protein, 20 aa, Mycobacterium
RNDLPVPIRVRLDIDAPPGM

SEQ ID NO: 326753 - protein, 21 aa, Mycobacterium
RNDLPVPIRVRLHINAPPGMT

SEQ ID NO: 326754 - protein, 23 aa, Mycobacterium
RNEHPRLIVVSMLRHDGGSGFPP

SEQ ID NO: 326755 - protein, 20 aa, Mycobacterium
RNFGKMAFRPHNIPWVMLGA

SEQ ID NO: 326756 - protein, 17 aa, Mycobacterium
RNFGMVFLAALLVGILT

SEQ ID NO: 326757 - protein, 22 aa, Mycobacterium
RNFGNAVLLLAIWIGIGFIFRG

SEQ ID NO: 326758 - protein, 17 aa, Mycobacterium
RNFMPGWLALALAVILV

SEQ ID NO: 326759 - protein, 27 aa, Mycobacterium
RNGELPAALGKPVWDRPIGGLLATTAG

SEQ ID NO: 326760 - protein, 28 aa, Mycobacterium
RNGELPPGLAKPVWDRPIGGCSPRRPGL

SEQ ID NO: 326761 - protein, 18 aa, Mycobacterium
RNGLGLTFALAIALFLMF

SEQ ID NO: 326762 - protein, 19 aa, Mycobacterium
RNGQSWLPAPAIITLAVAT

SEQ ID NO: 326763 - protein, 23 aa, Mycobacterium
RNGRGGITMTGRLLTQVAGQPAI

SEQ ID NO: 326764 - protein, 19 aa, Mycobacterium
RNGVDHGKYYFMVELPPDF

SEQ ID NO: 326765 - protein, 18 aa, Mycobacterium
RNGYVAGIMSRLPDAQVL

SEQ ID NO: 326766 - protein, 21 aa, Mycobacterium
RNIFGPPAWAPVVNNVVAIAT

SEQ ID NO: 326767 - protein, 17 aa, Mycobacterium
RNIGVPLAFHLGYHSVP

SEQ ID NO: 326768 - protein, 17 aa, Mycobacterium
RNIGVVLERVFRGVTVV

SEQ ID NO: 326769 - protein, 20 aa, Mycobacterium
RNILGYKLIHWNDVVAVSFP

SEQ ID NO: 326770 - protein, 26 aa, Mycobacterium
RNIRMPEIFAALSIGAVVVGLGMAWG

SEQ ID NO: 326771 - protein, 32 aa, Mycobacterium
RNKILIILPVALLLSQFVPWLLTPILMLGATY

SEQ ID NO: 326772 - protein, 22 aa, Mycobacterium
RNLASLLQLVAWGALAIYLLWR

SEQ ID NO: 326773 - protein, 17 aa, Mycobacterium
RNLHDRLLAAASRAEAL

SEQ ID NO: 326774 - protein, 17 aa, Mycobacterium
RNLIIFVVSIVILVTVL

SEQ ID NO: 326775 - protein, 17 aa, Mycobacterium
RNLPVVSVLVVLGIISV

SEQ ID NO: 326776 - protein, 18 aa, Mycobacterium
RNLRWIVPTAVVIVVLAV

SEQ ID NO: 326777 - protein, 17 aa, Mycobacterium
RNLTLYRSVIGLCEALR

SEQ ID NO: 326778 - protein, 20 aa, Mycobacterium
RNLTWLVLNAHIAFSVWYLW

SEQ ID NO: 326779 - protein, 17 aa, Mycobacterium
RNLVLACAVGIGPFALT

SEQ ID NO: 326780 - protein, 25 aa, Mycobacterium
RNLVPLKIAIGLLCLSIVVLGTLIQ

SEQ ID NO: 326781 - protein, 25 aa, Mycobacterium
RNLVVPRLLAAMVIGVALCGVVCFV

SEQ ID NO: 326782 - protein, 22 aa, Mycobacterium
RNLWTFSIIFCGHFPSGTQTFS

SEQ ID NO: 326783 - protein, 18 aa, Mycobacterium
RNMAIGFIAGLLLAIAVA

SEQ ID NO: 326784 - protein, 19 aa, Mycobacterium
RNMEIEPRGSDPLQANGVL

SEQ ID NO: 326785 - protein, 20 aa, Mycobacterium
RNPEVWSWIVWLPHNLHDEL

SEQ ID NO: 326786 - protein, 17 aa, Mycobacterium
RNPFALENWTLPVLELT

SEQ ID NO: 326787 - protein, 20 aa, Mycobacterium
RNPGSPVMLMFLCTTLIVWQ

SEQ ID NO: 326788 - protein, 18 aa, Mycobacterium
RNPIAFVINYLKEVLGEL

SEQ ID NO: 326789 - protein, 17 aa, Mycobacterium
RNPKRWQDIDEILDAGI

SEQ ID NO: 326790 - protein, 17 aa, Mycobacterium
RNPKRWQDVEELLNAGI

SEQ ID NO: 326791 - protein, 17 aa, Mycobacterium
RNPLAWTVTLFFGCQAF

SEQ ID NO: 326792 - protein, 41 aa, Mycobacterium
RNPNRKTGLRWRRVGALVARWPAPMLVASALVLAICALPVS

SEQ ID NO: 326793 - protein, 17 aa, Mycobacterium
RNPRLIIVSVLAMIAVT

SEQ ID NO: 326794 - protein, 32 aa, Mycobacterium
RNPSWRVGAWICSVIVVAAWGSILLMGVTDPL

SEQ ID NO: 326795 - protein, 35 aa, Mycobacterium
RNPVLEFLGYFWAPIPWMIEVALALSVAARHWTDA

SEQ ID NO: 326796 - protein, 29 aa, Mycobacterium
RNQPAALPRWRVAHSDTRCAEQPACRDAG

SEQ ID NO: 326797 - protein, 22 aa, Mycobacterium
RNQPPGAFDLSEVWRLTRGAGQ

SEQ ID NO: 326798 - protein, 17 aa, Mycobacterium
RNRADSIVAGIVSCVVE

SEQ ID NO: 326799 - protein, 22 aa, Mycobacterium
RNRAGGSPLVLTRRRQPSPTAV

SEQ ID NO: 326800 - protein, 19 aa, Mycobacterium
RNREAIALKLSSQGQAILA

SEQ ID NO: 326801 - protein, 22 aa, Mycobacterium
RNRIFERLVRLDAARTRDHGGA

SEQ ID NO: 326802 - protein, 24 aa, Mycobacterium
RNRNPCLVCSGALGYGKSYAAKRI

SEQ ID NO: 326803 - protein, 24 aa, Mycobacterium
RNRPDRRLFLGALAFVAGFSVLVR

SEQ ID NO: 326804 - protein, 18 aa, Mycobacterium
RNRRLHRYTDAPVAQSRW

SEQ ID NO: 326805 - protein, 18 aa, Mycobacterium
RNRRPRRLLIGTLLALAL

SEQ ID NO: 326806 - protein, 19 aa, Mycobacterium
RNRSWWAGPDIYLVVDDYD

SEQ ID NO: 326807 - protein, 22 aa, Mycobacterium
RNRVATFAAIFMAGGVLFTLTI

SEQ ID NO: 326808 - protein, 22 aa, Mycobacterium
RNRVATFAAVFLAGGVMFTLTV

SEQ ID NO: 326809 - protein, 21 aa, Mycobacterium
RNRVGLMGITVLVLVVAVGQS

SEQ ID NO: 326810 - protein, 26 aa, Mycobacterium
RNTFFAPFRLTRVLLILWAAGTALLT

SEQ ID NO: 326811 - protein, 18 aa, Mycobacterium
RNTFPGIILPLAGVAFGT

SEQ ID NO: 326812 - protein, 19 aa, Mycobacterium
RNTFWALVIPFMFGSPYAI

SEQ ID NO: 326813 - protein, 24 aa, Mycobacterium
RNTPTEFWLVMTLHHRPDGNLAGE

SEQ ID NO: 326814 - protein, 18 aa, Mycobacterium
RNTWRALTSMGTALVLLF

SEQ ID NO: 326815 - protein, 17 aa, Mycobacterium
RNTWRMPPLTLLEPVVW

SEQ ID NO: 326816 - protein, 24 aa, Mycobacterium
RNVDRPSPHIDWSAGTVRLLTEAV

SEQ ID NO: 326817 - protein, 18 aa, Mycobacterium
RNVGMVFLAVLLVEVLTS

SEQ ID NO: 326818 - protein, 25 aa, Mycobacterium
RNVGNMRMNLSFTPSYTYTRADCPQ

SEQ ID NO: 326819 - protein, 19 aa, Mycobacterium
RNVLPARWSLVAVSVVVVL

SEQ ID NO: 326820 - protein, 21 aa, Mycobacterium
RNVPKAMLFSVAFIAIVIAYA

SEQ ID NO: 326821 - protein, 23 aa, Mycobacterium
RNVWAHAIIFCGHFPDQTWTFTE

SEQ ID NO: 326822 - protein, 17 aa, Mycobacterium
RNVYGGIAFGPEGPALL

SEQ ID NO: 326823 - protein, 18 aa, Mycobacterium
RNWLRARTAAATGSADSE

SEQ ID NO: 326824 - protein, 17 aa, Mycobacterium
RNWRLKVTVKNDGGQYK

SEQ ID NO: 326825 - protein, 17 aa, Mycobacterium
RNWTTFSAFVLVIPTAG

SEQ ID NO: 326826 - protein, 24 aa, Mycobacterium
RNYFTYRDVIGFIYAQAKFQILGK

SEQ ID NO: 326827 - protein, 24 aa, Mycobacterium
RNYFTYRDVIGFIYAQAKFQVLGK

SEQ ID NO: 326828 - protein, 20 aa, Mycobacterium
RNYGGILIIWDRLFGTFQEE

SEQ ID NO: 326829 - protein, 27 aa, Mycobacterium
RNYLYWEKHCYDIPVCQALRSVFDTLD

SEQ ID NO: 326830 - protein, 18 aa, Mycobacterium
RNYLYWEQHCYNIPVCWA

SEQ ID NO: 326831 - protein, 27 aa, Mycobacterium
RNYRPNLFVTYWSFRAMIGLAAGSALL

SEQ ID NO: 326832 - protein, 18 aa, Mycobacterium
RPAAELTPEEKLADRYGK

SEQ ID NO: 326833 - protein, 25 aa, Mycobacterium
RPAAKRPRKGLIAATVGALVLVAAG

SEQ ID NO: 326834 - protein, 17 aa, Mycobacterium
RPAALLVVIALVAIAVL

SEQ ID NO: 326835 - protein, 18 aa, Mycobacterium
RPAAPGETGMIFVRGGLE

SEQ ID NO: 326836 - protein, 17 aa, Mycobacterium
RPADFVVGSPIQVVDRV

SEQ ID NO: 326837 - protein, 19 aa, Mycobacterium
RPADLLVLLDSLRQREASL

SEQ ID NO: 326838 - protein, 19 aa, Mycobacterium
RPADPVLEEAFHRPEGSSD

SEQ ID NO: 326839 - protein, 28 aa, Mycobacterium
RPAKAAKRPAAKRAPAKRPAGSSAPPKS

SEQ ID NO: 326840 - protein, 18 aa, Mycobacterium
RPAKGVVVPVDIDGASQF

SEQ ID NO: 326841 - protein, 18 aa, Mycobacterium
RPAKLDQWIAFWSVPVFF

SEQ ID NO: 326842 - protein, 21 aa, Mycobacterium
RPALDGAVGAAMFAAYGRSAD

SEQ ID NO: 326843 - protein, 19 aa, Mycobacterium
RPALIVLDMVRRYGADFGF

SEQ ID NO: 326844 - protein, 24 aa, Mycobacterium
RPALPDWRDFDVFTRQVSVPPTTP

SEQ ID NO: 326845 - protein, 22 aa, Mycobacterium
RPAPELHPDLALLLSTSGSTGS

SEQ ID NO: 326846 - protein, 20 aa, Mycobacterium
RPAPETIPALNARFPGQSAP

SEQ ID NO: 326847 - protein, 19 aa, Mycobacterium
RPAPKASRHASIIILTSGT

SEQ ID NO: 326848 - protein, 19 aa, Mycobacterium
RPAPLLRVRNKFFAHADQL

SEQ ID NO: 326849 - protein, 20 aa, Mycobacterium
RPAPLNRLGRWWPAALVAPI

SEQ ID NO: 326850 - protein, 20 aa, Mycobacterium
RPAPSPGASLPRPAPPASTP

SEQ ID NO: 326851 - protein, 19 aa, Mycobacterium
RPAPTDGFVGVAPDARLLS

SEQ ID NO: 326852 - protein, 20 aa, Mycobacterium
RPAPTDGFVGVAPDVRLLSL

SEQ ID NO: 326853 - protein, 22 aa, Mycobacterium
RPARPVRPGGRLVFAQLRNKVG

SEQ ID NO: 326854 - protein, 22 aa, Mycobacterium
RPASARFGFLLAIPAVLASGLF

SEQ ID NO: 326855 - protein, 18 aa, Mycobacterium
RPASGPSHLDVTVVVPVR

SEQ ID NO: 326856 - protein, 18 aa, Mycobacterium
RPASGPSYRDVTVVIPVR

SEQ ID NO: 326857 - protein, 24 aa, Mycobacterium
RPASRMLRPYGPRRLVRKLLLREA

SEQ ID NO: 326858 - protein, 18 aa, Mycobacterium
RPASVILVAGLISGQRAT

SEQ ID NO: 326859 - protein, 24 aa, Mycobacterium
RPATVIRHYLGYGVAVATMGALLG

SEQ ID NO: 326860 - protein, 21 aa, Mycobacterium
RPAVIAVGAPVMILAGIATYF

SEQ ID NO: 326861 - protein, 26 aa, Mycobacterium
RPAVIAVGVPVMILAGIATYFNSRAS

SEQ ID NO: 326862 - protein, 19 aa, Mycobacterium
RPAVLVVRCTLAVSAVALA

SEQ ID NO: 326863 - protein, 21 aa, Mycobacterium
RPAYWLSMLIVLGFQIPVDGW

SEQ ID NO: 326864 - protein, 21 aa, Mycobacterium
RPAYWLSMVIVLGFQIPVDGW

SEQ ID NO: 326865 - protein, 21 aa, Mycobacterium
RPAYWLSMVIVLGFQVPVDGW

SEQ ID NO: 326866 - protein, 20 aa, Mycobacterium
RPDALEDLGLHSALNALCSD

SEQ ID NO: 326867 - protein, 24 aa, Mycobacterium
RPDDPVLCWEWERSAGDQAPNTTV

SEQ ID NO: 326868 - protein, 22 aa, Mycobacterium
RPDEELRAWPSPNTEPDGEIGE

SEQ ID NO: 326869 - protein, 24 aa, Mycobacterium
RPDGLRGSFVAERVRPRKYREQAE

SEQ ID NO: 326870 - protein, 18 aa, Mycobacterium
RPDHSMPEDAEWRRVTAT

SEQ ID NO: 326871 - protein, 18 aa, Mycobacterium
RPDIPVLHDISLQLTPGT

SEQ ID NO: 326872 - protein, 21 aa, Mycobacterium
RPDLGRLASGLAQLQGGADTA

SEQ ID NO: 326873 - protein, 21 aa, Mycobacterium
RPDLLDGVGLIVGIDRFMSEA

SEQ ID NO: 326874 - protein, 19 aa, Mycobacterium
RPDPWEHLGPPNWPGNPYP

SEQ ID NO: 326875 - protein, 27 aa, Mycobacterium
RPDQPRGWRFWHRPRRQLQTQVVLDWE

SEQ ID NO: 326876 - protein, 25 aa, Mycobacterium
RPDRDRYPAVMWILLAGNLLVRSAG

SEQ ID NO: 326877 - protein, 24 aa, Mycobacterium
RPDRFPVAWLLARPDRKSLLRLAA

SEQ ID NO: 326878 - protein, 17 aa, Mycobacterium
RPDRRAVQAALERVAHR

SEQ ID NO: 326879 - protein, 23 aa, Mycobacterium
RPDRTRWLYFAVIGAVILGVIAG

SEQ ID NO: 326880 - protein, 20 aa, Mycobacterium
RPDTAWPVYVDPPLHLTGAG

SEQ ID NO: 326881 - protein, 22 aa, Mycobacterium
RPDVASLLALLVSKGVAKFKAP

SEQ ID NO: 326882 - protein, 19 aa, Mycobacterium
RPDVFTIRVGNIVPGQRVT

SEQ ID NO: 326883 - protein, 19 aa, Mycobacterium
RPEAPEVIGGLRAHGYQVA

SEQ ID NO: 326884 - protein, 18 aa, Mycobacterium
RPEGRPMERASIANILAG

SEQ ID NO: 326885 - protein, 25 aa, Mycobacterium
RPELARLDPVFARAMAKKPAERFAH

SEQ ID NO: 326886 - protein, 25 aa, Mycobacterium
RPELGLRPRLALGIHQPATDARRPR

SEQ ID NO: 326887 - protein, 19 aa, Mycobacterium
RPELGVLYPSHLATGMRIY

SEQ ID NO: 326888 - protein, 33 aa, Mycobacterium
RPELSDAALVSRSWAMAFATLISRLTGFARVVL

SEQ ID NO: 326889 - protein, 24 aa, Mycobacterium
RPELSDAALVSRSWAMAFATLVSR

SEQ ID NO: 326890 - protein, 31 aa, Mycobacterium
RPESTQSRFWTRWVGWVMHRPWITALSASVV

SEQ ID NO: 326891 - protein, 24 aa, Mycobacterium
RPEVAAAVRECHRAGIRVKMITGD

SEQ ID NO: 326892 - protein, 19 aa, Mycobacterium
RPFHLAWCAQPPRRASMFA

SEQ ID NO: 326893 - protein, 19 aa, Mycobacterium
RPFHMGAFVVAARTGAPVT

SEQ ID NO: 326894 - protein, 31 aa, Mycobacterium
RPFIARTIQKFSLPVILLWIALTVGANLLAP

SEQ ID NO: 326895 - protein, 17 aa, Mycobacterium
RPFLVPRSAHLHPALML

SEQ ID NO: 326896 - protein, 17 aa, Mycobacterium
RPFQFGEFLDQTWMIAR

SEQ ID NO: 326897 - protein, 19 aa, Mycobacterium
RPGALAFEEKARWIPGVNS

SEQ ID NO: 326898 - protein, 31 aa, Mycobacterium
RPGCAPAPDSVRCAASMALAPEEPVNFSRTL

SEQ ID NO: 326899 - protein, 26 aa, Mycobacterium
RPGCWQPITHDLWPAPYLVLDTGASI

SEQ ID NO: 326900 - protein, 19 aa, Mycobacterium
RPGDVMPSSYLGIWKEFSK

SEQ ID NO: 326901 - protein, 17 aa, Mycobacterium
RPGETGWVLLIAAAVTV

SEQ ID NO: 326902 - protein, 19 aa, Mycobacterium
RPGFPDFGAPGLAIPEVAG

SEQ ID NO: 326903 - protein, 17 aa, Mycobacterium
RPGFPPLRLDQSLDEAG

SEQ ID NO: 326904 - protein, 22 aa, Mycobacterium
RPGGHREPAYLAAMIAEQCVTA

SEQ ID NO: 326905 - protein, 18 aa, Mycobacterium
RPGLVLGLLVIAILVAWR

SEQ ID NO: 326906 - protein, 18 aa, Mycobacterium
RPGMLLFGLLPLALLAVY

SEQ ID NO: 326907 - protein, 20 aa, Mycobacterium
RPGNAVIEWLRMPGDIILIV

SEQ ID NO: 326908 - protein, 19 aa, Mycobacterium
RPGPDVPVLNHLRVPALGA

SEQ ID NO: 326909 - protein, 17 aa, Mycobacterium
RPGPGPRFLDAPGQPAG

SEQ ID NO: 326910 - protein, 18 aa, Mycobacterium
RPGPGPRFLDAPGQPAGM

SEQ ID NO: 326911 - protein, 19 aa, Mycobacterium
RPGPIVKPVSATVFSPDGA

SEQ ID NO: 326912 - protein, 18 aa, Mycobacterium
RPGQKPWWVRHYTFTGTT

SEQ ID NO: 326913 - protein, 19 aa, Mycobacterium
RPGQPLDIYQEFRCAVRRS

SEQ ID NO: 326914 - protein, 17 aa, Mycobacterium
RPGRSSLEEPIAVIGMG

SEQ ID NO: 326915 - protein, 17 aa, Mycobacterium
RPGSGTVQCNGQQPNPC

SEQ ID NO: 326916 - protein, 18 aa, Mycobacterium
RPGSPAWNHAYVIAALRA

SEQ ID NO: 326917 - protein, 19 aa, Mycobacterium
RPGTEPGRIVVRVPEDVTT

SEQ ID NO: 326918 - protein, 18 aa, Mycobacterium
RPGVLDWALAFVAVLVCL

SEQ ID NO: 326919 - protein, 19 aa, Mycobacterium
RPGWGVKAAIAAVLVVLGI

SEQ ID NO: 326920 - protein, 21 aa, Mycobacterium
RPGWIALALVVVAFAYLCFTV

SEQ ID NO: 326921 - protein, 20 aa, Mycobacterium
RPGWIALGLVVVAFTYLCFT

SEQ ID NO: 326922 - protein, 22 aa, Mycobacterium
RPHAPWARWRYATQPDKMRRAL

SEQ ID NO: 326923 - protein, 21 aa, Mycobacterium
RPHAPWARWRYTTQPDKMRRA

SEQ ID NO: 326924 - protein, 19 aa, Mycobacterium
RPHLRGIRRSPLPAELVTE

SEQ ID NO: 326925 - protein, 25 aa, Mycobacterium
RPHPYPRWVATAGWAGFALGIAILL

SEQ ID NO: 326926 - protein, 20 aa, Mycobacterium
RPIALPRPGTSFRQWAELLS

SEQ ID NO: 326927 - protein, 25 aa, Mycobacterium
RPIASLAAACRRITQGNFDEVISAP

SEQ ID NO: 326928 - protein, 18 aa, Mycobacterium
RPIIDAAVGPGFLRSGLL

SEQ ID NO: 326929 - protein, 17 aa, Mycobacterium
RPIIVLDGFSWAWNTFT

SEQ ID NO: 326930 - protein, 37 aa, Mycobacterium
RPIKNYYYWEPHCADIPICWMGRSMFESMDSIDGMTA

SEQ ID NO: 326931 - protein, 18 aa, Mycobacterium
RPILPVGAVLRRIGSVAE

SEQ ID NO: 326932 - protein, 24 aa, Mycobacterium
RPILRRLAVLLALVFAQALVGIVQ

SEQ ID NO: 326933 - protein, 22 aa, Mycobacterium
RPIPIRYANWVSHAVRGDFGVT

SEQ ID NO: 326934 - protein, 34 aa, Mycobacterium
RPIRNYFHWEPHCFDIPVCWALRSVSDSVDGIDA

SEQ ID NO: 326935 - protein, 21 aa, Mycobacterium
RPIRNYFYWEKHCADIPICWA

SEQ ID NO: 326936 - protein, 27 aa, Mycobacterium
RPIRNYLHWERHCFDIPICASLRSLFD

SEQ ID NO: 326937 - protein, 36 aa, Mycobacterium
RPIRSYFYWDKHCYDIPVCWSIRSIFDMIDNVDQMS

SEQ ID NO: 326938 - protein, 34 aa, Mycobacterium
RPIRSYFYWEQHCYDIPACWAARSAFDAIDGIDR

SEQ ID NO: 326939 - protein, 19 aa, Mycobacterium
RPKLGDWVTLAITVAVSAA

SEQ ID NO: 326940 - protein, 21 aa, Mycobacterium
RPKMSARALAQVIERSSRIQG

SEQ ID NO: 326941 - protein, 19 aa, Mycobacterium
RPKPSPWPKPIQREPADAV

SEQ ID NO: 326942 - protein, 18 aa, Mycobacterium
RPKRLNVLGCASVAVALQ

SEQ ID NO: 326943 - protein, 25 aa, Mycobacterium
RPKRLTGRRLAAVGAAITALLFVGS

SEQ ID NO: 326944 - protein, 22 aa, Mycobacterium
RPKRNPVPSLLRTLLSDHLDAG

SEQ ID NO: 326945 - protein, 22 aa, Mycobacterium
RPLAALAAACRRITEGSFDERI

SEQ ID NO: 326946 - protein, 22 aa, Mycobacterium
RPLAALAASCRRITEGNFTERI

SEQ ID NO: 326947 - protein, 17 aa, Mycobacterium
RPLAERARSFVRGDSLG

SEQ ID NO: 326948 - protein, 17 aa, Mycobacterium
RPLELDGLWGIVFSPLL

SEQ ID NO: 326949 - protein, 18 aa, Mycobacterium
RPLESYNKTWLGFIAVAV

SEQ ID NO: 326950 - protein, 18 aa, Mycobacterium
RPLFPAESGAALKHLLVV

SEQ ID NO: 326951 - protein, 18 aa, Mycobacterium
RPLGDKFNDVMGRANDRA

SEQ ID NO: 326952 - protein, 21 aa, Mycobacterium
RPLGWSVPGMAFIVLVAVGAD

SEQ ID NO: 326953 - protein, 23 aa, Mycobacterium
RPLLGAVLTRLAGRGAPAHRVWL

SEQ ID NO: 326954 - protein, 19 aa, Mycobacterium
RPLLVPAFMQLMGRLNWWA

SEQ ID NO: 326955 - protein, 19 aa, Mycobacterium
RPLMLPAPLLAAIGSLILA

SEQ ID NO: 326956 - protein, 18 aa, Mycobacterium
RPLPAPWPQPVQRDPEDA

SEQ ID NO: 326957 - protein, 17 aa, Mycobacterium
RPLPDLTAPLLAMALCS

SEQ ID NO: 326958 - protein, 17 aa, Mycobacterium
RPLPIFVPLVWVGTAPT

SEQ ID NO: 326959 - protein, 24 aa, Mycobacterium
RPLQIAVSLMWPVGVAALVYAVRV

SEQ ID NO: 326960 - protein, 32 aa, Mycobacterium
RPLRGYLYWEQHCFNIPVCWAARSVFEAIDGV

SEQ ID NO: 326961 - protein, 22 aa, Mycobacterium
RPLRSYFYWERHCYDIPICFSL

SEQ ID NO: 326962 - protein, 17 aa, Mycobacterium
RPLRTPDRFARPGPSRR

SEQ ID NO: 326963 - protein, 21 aa, Mycobacterium
RPLSAGFAVPVFAFFAAGVTV

SEQ ID NO: 326964 - protein, 25 aa, Mycobacterium
RPLSGKLAALWRGTLVVLQSILAVV

SEQ ID NO: 326965 - protein, 17 aa, Mycobacterium
RPLTPFAALAKLIVASL

SEQ ID NO: 326966 - protein, 17 aa, Mycobacterium
RPLVEIGQMVWFALSAI

SEQ ID NO: 326967 - protein, 28 aa, Mycobacterium
RPLVGRPRTWPAIALSAIAALLAVGAMV

SEQ ID NO: 326968 - protein, 18 aa, Mycobacterium
RPLVPGIMIAGAATAAVG

SEQ ID NO: 326969 - protein, 26 aa, Mycobacterium
RPLYARLLYGLSIPIVILWVLLACGL

SEQ ID NO: 326970 - protein, 19 aa, Mycobacterium
RPMLDKLNGVLTIVDNRKD

SEQ ID NO: 326971 - protein, 21 aa, Mycobacterium
RPMPLPPGRAVLVTRAGDERL

SEQ ID NO: 326972 - protein, 17 aa, Mycobacterium
RPMPVTRKARRQRRGME

SEQ ID NO: 326973 - protein, 32 aa, Mycobacterium
RPMRNYLYWEPHCYDIPVCQSLRSVFDTLDGI

SEQ ID NO: 326974 - protein, 18 aa, Mycobacterium
RPNHPAWSANLLAHPECT

SEQ ID NO: 326975 - protein, 17 aa, Mycobacterium
RPNRLTQSAAWVGIVAG

SEQ ID NO: 326976 - protein, 21 aa, Mycobacterium
RPNVVHINLKPALAHTVPRSV

SEQ ID NO: 326977 - protein, 20 aa, Mycobacterium
RPNWTLLRKTVRDLRRRPAQ

SEQ ID NO: 326978 - protein, 26 aa, Mycobacterium
RPNWVGALISCVWLAIIMVPIYWIVI

SEQ ID NO: 326979 - protein, 19 aa, Mycobacterium
RPPAAAIGYALTGIFGSVL

SEQ ID NO: 326980 - protein, 20 aa, Mycobacterium
RPPERANRARLAKGPEVTDR

SEQ ID NO: 326981 - protein, 23 aa, Mycobacterium
RPPETHVGVLFCDVDHFKAINDR

SEQ ID NO: 326982 - protein, 24 aa, Mycobacterium
RPPGGWDPYLGFGVVDALAAVSDD

SEQ ID NO: 326983 - protein, 26 aa, Mycobacterium
RPPKPRIAAVVAMCLATAGLLAWFWP

SEQ ID NO: 326984 - protein, 20 aa, Mycobacterium
RPPLLAGLIRRLSVPIILGW

SEQ ID NO: 326985 - protein, 18 aa, Mycobacterium
RPPLLGPSGRMVATGVTI

SEQ ID NO: 326986 - protein, 26 aa, Mycobacterium
RPPNTPSRIALRWARIAVLIVTGLVT

SEQ ID NO: 326987 - protein, 22 aa, Mycobacterium
RPPPRRGVPRGPLPRPAPPLPL

SEQ ID NO: 326988 - protein, 17 aa, Mycobacterium
RPPRPNAAPSIGRAAPA

SEQ ID NO: 326989 - protein, 17 aa, Mycobacterium
RPPRPNQAPTLGRAAPA

SEQ ID NO: 326990 - protein, 22 aa, Mycobacterium
RPPRPVRSWVLIPALAGAGLVM

SEQ ID NO: 326991 - protein, 17 aa, Mycobacterium
RPPSNFYVRGFDEDGRT

SEQ ID NO: 326992 - protein, 20 aa, Mycobacterium
RPPSPIACRLIDALEFSASA

SEQ ID NO: 326993 - protein, 17 aa, Mycobacterium
RPPVLRSTILGLLSRWG

SEQ ID NO: 326994 - protein, 30 aa, Mycobacterium
RPPVNVLATLSLVFAFVFAPVGAILGHAGL

SEQ ID NO: 326995 - protein, 18 aa, Mycobacterium
RPQGRLRPGQPARRPGRR

SEQ ID NO: 326996 - protein, 19 aa, Mycobacterium
RPQLFEAFGDTLYMVSITL

SEQ ID NO: 326997 - protein, 20 aa, Mycobacterium
RPQPEPHVAQPPVPGHEQQF

SEQ ID NO: 326998 - protein, 23 aa, Mycobacterium
RPQRLFYLLIHLLDPFISLESLY

SEQ ID NO: 326999 - protein, 21 aa, Mycobacterium
RPQWLALIVVVLAFAYLCFTV

SEQ ID NO: 327000 - protein, 19 aa, Mycobacterium
RPREANWVIGALLFILAMF

SEQ ID NO: 327001 - protein, 19 aa, Mycobacterium
RPREANWVIGALLLILAMF

SEQ ID NO: 327002 - protein, 20 aa, Mycobacterium
RPRFIKRKFFEHFPDDLRPG

SEQ ID NO: 327003 - protein, 31 aa, Mycobacterium
RPRFMRMVRAFAIPIILIWLLLTIAVNVFVP

SEQ ID NO: 327004 - protein, 18 aa, Mycobacterium
RPRFSLMNVLGQHRLLFL

SEQ ID NO: 327005 - protein, 17 aa, Mycobacterium
RPRIRVGSKSQLRESNS

SEQ ID NO: 327006 - protein, 22 aa, Mycobacterium
RPRIVDLGFWCFMAGAVIMIVG

SEQ ID NO: 327007 - protein, 20 aa, Mycobacterium
RPRLAVPRVPGGEVNVQPPP

SEQ ID NO: 327008 - protein, 26 aa, Mycobacterium
RPRLRPLASYNKTWLGFVGLSLAVVL

SEQ ID NO: 327009 - protein, 18 aa, Mycobacterium
RPRPDHVQALADFALDMV

SEQ ID NO: 327010 - protein, 21 aa, Mycobacterium
RPRPPTALVYASWTSFPSGHA

SEQ ID NO: 327011 - protein, 22 aa, Mycobacterium
RPRPSGLAFLGGWLLSLAALTA

SEQ ID NO: 327012 - protein, 22 aa, Mycobacterium
RPRPSSLAFLGGWLLSLAALTA

SEQ ID NO: 327013 - protein, 23 aa, Mycobacterium
RPRPTGLAFLGGWLVGMAALTAL

SEQ ID NO: 327014 - protein, 21 aa, Mycobacterium
RPRPTGLAFLGGWVLGLIAVT

SEQ ID NO: 327015 - protein, 18 aa, Mycobacterium
RPRPVRFIFGLDYITFLH

SEQ ID NO: 327016 - protein, 18 aa, Mycobacterium
RPRQWIKNLLVLAAPLAA

SEQ ID NO: 327017 - protein, 24 aa, Mycobacterium
RPRRPRLAGWGAPAAAFVVSVLLG

SEQ ID NO: 327018 - protein, 21 aa, Mycobacterium
RPRTLLRSWMLIPALAAAGLL

SEQ ID NO: 327019 - protein, 24 aa, Mycobacterium
RPRWLCAATGLGFAVVGALPWLTA

SEQ ID NO: 327020 - protein, 17 aa, Mycobacterium
RPRWLMFAPTFVQLGIL

SEQ ID NO: 327021 - protein, 18 aa, Mycobacterium
RPRYINLVVLLRIVCEIT

SEQ ID NO: 327022 - protein, 18 aa, Mycobacterium
RPRYPAVEIYRVIHRVGE

SEQ ID NO: 327023 - protein, 25 aa, Mycobacterium
RPSAARPGIPAAFDQVIARGMAKDP

SEQ ID NO: 327024 - protein, 25 aa, Mycobacterium
RPSAARPGIPAGFDNVIARGMAKDP

SEQ ID NO: 327025 - protein, 18 aa, Mycobacterium
RPSFKAWWTRIVPSPIER

SEQ ID NO: 327026 - protein, 19 aa, Mycobacterium
RPSPLPGQLLTEIGPSGVL

SEQ ID NO: 327027 - protein, 20 aa, Mycobacterium
RPSPTDGFVGMAPDVRLLSL

SEQ ID NO: 327028 - protein, 25 aa, Mycobacterium
RPSQLRPGIPAAFDAVIARGMAKRP

SEQ ID NO: 327029 - protein, 29 aa, Mycobacterium
RPSQLRPGIPATFDAVIARGMAKRPEDRF

SEQ ID NO: 327030 - protein, 17 aa, Mycobacterium
RPSSGSPGWGFKIASAV

SEQ ID NO: 327031 - protein, 19 aa, Mycobacterium
RPSSIYALHELRNHGIRVA

SEQ ID NO: 327032 - protein, 24 aa, Mycobacterium
RPSTRVAFRFCVVYFGLFCVLLTQ

SEQ ID NO: 327033 - protein, 17 aa, Mycobacterium
RPSVGAPPWNADLMLDD

SEQ ID NO: 327034 - protein, 19 aa, Mycobacterium
RPSVGRWALQPLTCAFAVA

SEQ ID NO: 327035 - protein, 20 aa, Mycobacterium
RPSYGMAEATVYVATRAPGE

SEQ ID NO: 327036 - protein, 19 aa, Mycobacterium
RPTGITARITPDMIGTGAK

SEQ ID NO: 327037 - protein, 18 aa, Mycobacterium
RPTKGVVVPVDIDSSASH

SEQ ID NO: 327038 - protein, 17 aa, Mycobacterium
RPTLPVLLANLTSLGQV

SEQ ID NO: 327039 - protein, 18 aa, Mycobacterium
RPTLRYWVALILVALAAV

SEQ ID NO: 327040 - protein, 25 aa, Mycobacterium
RPTPLLRARGKFFAHADQLSIHRAY

SEQ ID NO: 327041 - protein, 19 aa, Mycobacterium
RPTSLSFLAGWVLGLAALT

SEQ ID NO: 327042 - protein, 26 aa, Mycobacterium
RPTVNVKIAATWPIDGGNLAQAVRTA

SEQ ID NO: 327043 - protein, 19 aa, Mycobacterium
RPTVTWPLSADTWSLRPVV

SEQ ID NO: 327044 - protein, 22 aa, Mycobacterium
RPTWRSYRFAVVVTATWTAVTM

SEQ ID NO: 327045 - protein, 20 aa, Mycobacterium
RPVAGFPLLHVEKPQYSGAQ

SEQ ID NO: 327046 - protein, 18 aa, Mycobacterium
RPVALTIIDGAAFTADQV

SEQ ID NO: 327047 - protein, 24 aa, Mycobacterium
RPVAPEAYALYGISRVLPPALRST

SEQ ID NO: 327048 - protein, 24 aa, Mycobacterium
RPVAPEAYALYGISRVLPQALRST

SEQ ID NO: 327049 - protein, 23 aa, Mycobacterium
RPVDEERKPFLLVGSALTSLFVV

SEQ ID NO: 327050 - protein, 17 aa, Mycobacterium
RPVHPVTLWRGRLSVAI

SEQ ID NO: 327051 - protein, 17 aa, Mycobacterium
RPVHPVTVWRGRLAIAL

SEQ ID NO: 327052 - protein, 17 aa, Mycobacterium
RPVHPVTVWRGRLSIAL

SEQ ID NO: 327053 - protein, 18 aa, Mycobacterium
RPVIDYWGIVLIGLGASA

SEQ ID NO: 327054 - protein, 19 aa, Mycobacterium
RPVISMLRAIGGRRASIVG

SEQ ID NO: 327055 - protein, 18 aa, Mycobacterium
RPVLERRDSAVLRVLFQW

SEQ ID NO: 327056 - protein, 17 aa, Mycobacterium
RPVLKPPVWEWKIAAYL

SEQ ID NO: 327057 - protein, 24 aa, Mycobacterium
RPVLWGVAIATMLIGSIGAVTQTD

SEQ ID NO: 327058 - protein, 19 aa, Mycobacterium
RPVNAPVMSGFEGAVRTAV

SEQ ID NO: 327059 - protein, 19 aa, Mycobacterium
RPVPFEVMSVVTGDAVVLD

SEQ ID NO: 327060 - protein, 17 aa, Mycobacterium
RPVPSPWPKPSAAKAIE

SEQ ID NO: 327061 - protein, 24 aa, Mycobacterium
RPVRWLRLGGTAPMPTYFEIIDRP

SEQ ID NO: 327062 - protein, 20 aa, Mycobacterium
RPVSVAELLARNGAAEGKIS

SEQ ID NO: 327063 - protein, 18 aa, Mycobacterium
RPVVGFIVIATLFFALGN

SEQ ID NO: 327064 - protein, 19 aa, Mycobacterium
RPVVVAAQLNTAVMTANAE

SEQ ID NO: 327065 - protein, 17 aa, Mycobacterium
RPVVYAFGLVFFAVGYL

SEQ ID NO: 327066 - protein, 17 aa, Mycobacterium
RPWAGAAVRDLGPALYA

SEQ ID NO: 327067 - protein, 17 aa, Mycobacterium
RPWNIKPGDVMPSTYLG

SEQ ID NO: 327068 - protein, 20 aa, Mycobacterium
RPWYLAWAGLVYVVATLATL

SEQ ID NO: 327069 - protein, 25 aa, Mycobacterium
RPYAMYKQKVWKRVAVLFAGPAMNF

SEQ ID NO: 327070 - protein, 19 aa, Mycobacterium
RPYFTGYLPAVVLAGILTP

SEQ ID NO: 327071 - protein, 19 aa, Mycobacterium
RPYGPRPAVRQLLLWEDDD

SEQ ID NO: 327072 - protein, 19 aa, Mycobacterium
RPYGPRTAVRQLLLWEDDD

SEQ ID NO: 327073 - protein, 19 aa, Mycobacterium
RPYGYDETARWVPRLWRRD

SEQ ID NO: 327074 - protein, 31 aa, Mycobacterium
RPYQWWRVLLVACSMLAYVLIFSIPLAQELF

SEQ ID NO: 327075 - protein, 19 aa, Mycobacterium
RQAETPLLLAVDGTLVGLI

SEQ ID NO: 327076 - protein, 21 aa, Mycobacterium
RQAETPLLLAVDGTLVGLISL

SEQ ID NO: 327077 - protein, 19 aa, Mycobacterium
RQAETPLLLAVDGTLVGLV

SEQ ID NO: 327078 - protein, 20 aa, Mycobacterium
RQAHTVAAFLLVAAIAAHVC

SEQ ID NO: 327079 - protein, 17 aa, Mycobacterium
RQAIPALFHTGLPNTLI

SEQ ID NO: 327080 - protein, 29 aa, Mycobacterium
RQALRPGSMSLRLAARVAVAVAISGAIAV

SEQ ID NO: 327081 - protein, 19 aa, Mycobacterium
RQALTEMWWEERIDSPGFV

SEQ ID NO: 327082 - protein, 25 aa, Mycobacterium
RQAPVLLCRLTDAWVILIAVSLLSC

SEQ ID NO: 327083 - protein, 17 aa, Mycobacterium
RQARARLGVENTHDRDY

SEQ ID NO: 327084 - protein, 27 aa, Mycobacterium
RQARDLLRVAFGPSIVALVIIAAIVLL

SEQ ID NO: 327085 - protein, 17 aa, Mycobacterium
RQARHVVTANLIIAGTF

SEQ ID NO: 327086 - protein, 22 aa, Mycobacterium
RQDALGALLWRSLYPDAAPRTQ

SEQ ID NO: 327087 - protein, 25 aa, Mycobacterium
RQDALVGLVCLQAAAVLGRPSPEDI

SEQ ID NO: 327088 - protein, 23 aa, Mycobacterium
RQDPLRARWVLWVGGGALVGAVV

SEQ ID NO: 327089 - protein, 25 aa, Mycobacterium
RQDPRKFRLIVTITRDGDQLKMSKV

SEQ ID NO: 327090 - protein, 27 aa, Mycobacterium
RQDRLGPRLVLRVGLVVLLAVQIALAV

SEQ ID NO: 327091 - protein, 22 aa, Mycobacterium
RQDTIRWVALAALVAIGLGLIF

SEQ ID NO: 327092 - protein, 18 aa, Mycobacterium
RQEFPWPVLEEAAQQGFY

SEQ ID NO: 327093 - protein, 20 aa, Mycobacterium
RQEFPWPVLEEAAQRGFYSP

SEQ ID NO: 327094 - protein, 24 aa, Mycobacterium
RQEFPWPVLEEAARRGFYSPLFYR

SEQ ID NO: 327095 - protein, 20 aa, Mycobacterium
RQEFPWPVLEEAATRGFYSP

SEQ ID NO: 327096 - protein, 17 aa, Mycobacterium
RQELLRAAGNFANVTEY

SEQ ID NO: 327097 - protein, 20 aa, Mycobacterium
RQELYADPIIAYRHTSYQEI

SEQ ID NO: 327098 - protein, 26 aa, Mycobacterium
RQENPWWPDRDRPRYTPPAQTQQPPI

SEQ ID NO: 327099 - protein, 24 aa, Mycobacterium
RQETWLMIVLGVGFGLGVALTLSR

SEQ ID NO: 327100 - protein, 30 aa, Mycobacterium
RQEWLDRPSYRFEHLLSFAFNGLGSARNTV

SEQ ID NO: 327101 - protein, 17 aa, Mycobacterium
RQFHIALVGALMVAALA

SEQ ID NO: 327102 - protein, 18 aa, Mycobacterium
RQFHIALVGAVMVAALAL

SEQ ID NO: 327103 - protein, 23 aa, Mycobacterium
RQFSEPDPPPLYYIPPSSSSATV

SEQ ID NO: 327104 - protein, 32 aa, Mycobacterium
RQFTAEFLQAAALRPGNIVTVAGVQVGSVTGV

SEQ ID NO: 327105 - protein, 23 aa, Mycobacterium
RQGASWLGALMVAAMIALVLLVQ

SEQ ID NO: 327106 - protein, 19 aa, Mycobacterium
RQGLYPGIGAPSWTADYGN

SEQ ID NO: 327107 - protein, 19 aa, Mycobacterium
RQGRAYWIHLLMASQQIET

SEQ ID NO: 327108 - protein, 18 aa, Mycobacterium
RQHGSLMRLFAMQVPGQL

SEQ ID NO: 327109 - protein, 17 aa, Mycobacterium
RQHHFTDLLPLTPLQQG

SEQ ID NO: 327110 - protein, 35 aa, Mycobacterium
RQHISLRPLWGIDDRLKRFGAMAAAMVLYVLISQL

SEQ ID NO: 327111 - protein, 21 aa, Mycobacterium
RQHKRLVLSPTGMRRIDANTV

SEQ ID NO: 327112 - protein, 17 aa, Mycobacterium
RQIDAWVAPAGEAASTI

SEQ ID NO: 327113 - protein, 19 aa, Mycobacterium
RQIHHWAALMFAASIVVHL

SEQ ID NO: 327114 - protein, 18 aa, Mycobacterium
RQILLGRLMCIAGSGSTA

SEQ ID NO: 327115 - protein, 18 aa, Mycobacterium
RQIRLGVAPSIVVMLFGV

SEQ ID NO: 327116 - protein, 19 aa, Mycobacterium
RQIRLIVSDRGYFVFLALL

SEQ ID NO: 327117 - protein, 27 aa, Mycobacterium
RQIRLVISDRGYTVFLALLPFLIGTLT

SEQ ID NO: 327118 - protein, 28 aa, Mycobacterium
RQIRLVVADRAYFVFLALLPFILGSLSL

SEQ ID NO: 327119 - protein, 17 aa, Mycobacterium
RQIRVFVEEIVRLEPSA

SEQ ID NO: 327120 - protein, 23 aa, Mycobacterium
RQIYRPREDLVRWNGRVDDPAGG

SEQ ID NO: 327121 - protein, 20 aa, Mycobacterium
RQLAGMSYVWWALAVIVVAG

SEQ ID NO: 327122 - protein, 25 aa, Mycobacterium
RQLDEYIKFLVTWQRPLVGKKTMMD

SEQ ID NO: 327123 - protein, 27 aa, Mycobacterium
RQLFDRLRPTLPIMLANLVSIGQVAVT

SEQ ID NO: 327124 - protein, 25 aa, Mycobacterium
RQLFDRLSPTLPIVLANLVSVGQVG

SEQ ID NO: 327125 - protein, 17 aa, Mycobacterium
RQLFGHKGLRALMTAAT

SEQ ID NO: 327126 - protein, 20 aa, Mycobacterium
RQLGADTAQLQWIVDAYTLV

SEQ ID NO: 327127 - protein, 29 aa, Mycobacterium
RQLGLPGIRHSIGLARWWHLGVDVLWLLN

SEQ ID NO: 327128 - protein, 23 aa, Mycobacterium
RQLGYRSRPLWRSFTRVGTVTAE

SEQ ID NO: 327129 - protein, 20 aa, Mycobacterium
RQLILGGIDGRLWQAVITLL

SEQ ID NO: 327130 - protein, 17 aa, Mycobacterium
RQLIPCNSALTGLAVLD

SEQ ID NO: 327131 - protein, 26 aa, Mycobacterium
RQLLARGGIALVVVLLVTSWLLAKSM

SEQ ID NO: 327132 - protein, 23 aa, Mycobacterium
RQLLVRGGAALALVAVLTAGLLI

SEQ ID NO: 327133 - protein, 20 aa, Mycobacterium
RQLMIGAGLVTLVVAALLLV

SEQ ID NO: 327134 - protein, 17 aa, Mycobacterium
RQLRNAVLILLAGTAVV

SEQ ID NO: 327135 - protein, 17 aa, Mycobacterium
RQLRPGDTIPLSRTSPA

SEQ ID NO: 327136 - protein, 18 aa, Mycobacterium
RQLRSGVLNAERALTLSS

SEQ ID NO: 327137 - protein, 17 aa, Mycobacterium
RQLRTWVLVPALGGAGL

SEQ ID NO: 327138 - protein, 18 aa, Mycobacterium
RQLRWALSEVQRGNYNAH

SEQ ID NO: 327139 - protein, 17 aa, Mycobacterium
RQLSRRAPLIGVIPTGY

SEQ ID NO: 327140 - protein, 25 aa, Mycobacterium
RQLSSLDLLNGIGRDRWSERSSRVE

SEQ ID NO: 327141 - protein, 19 aa, Mycobacterium
RQLVASWSDRLSIAAVNGV

SEQ ID NO: 327142 - protein, 19 aa, Mycobacterium
RQLYFLLGDMLKRLVYLSQ

SEQ ID NO: 327143 - protein, 17 aa, Mycobacterium
RQLYFWVLVAIAAGIVV

SEQ ID NO: 327144 - protein, 18 aa, Mycobacterium
RQMIYPFTGRGGCASEAT

SEQ ID NO: 327145 - protein, 24 aa, Mycobacterium
RQMPEFKRPKLVVFGESLGSFGGE

SEQ ID NO: 327146 - protein, 28 aa, Mycobacterium
RQMRLIISDRGYFIFLAILPFIMGSLSM

SEQ ID NO: 327147 - protein, 28 aa, Mycobacterium
RQMRLIVSDRGYFVFLALLPFIMGSLSM

SEQ ID NO: 327148 - protein, 18 aa, Mycobacterium
RQNGWWPGVKEPLLRWLA

SEQ ID NO: 327149 - protein, 19 aa, Mycobacterium
RQPGKRLPRITLRVNSDDS

SEQ ID NO: 327150 - protein, 18 aa, Mycobacterium
RQQFVRFLAIFAAVSASF

SEQ ID NO: 327151 - protein, 22 aa, Mycobacterium
RQQVWLSVAGLVLILVVATAYL

SEQ ID NO: 327152 - protein, 18 aa, Mycobacterium
RQRCITSWAGFRGAVSLA

SEQ ID NO: 327153 - protein, 19 aa, Mycobacterium
RQREARALLGSLLRPYRWA

SEQ ID NO: 327154 - protein, 17 aa, Mycobacterium
RQREFWRTALAGAPDEL

SEQ ID NO: 327155 - protein, 21 aa, Mycobacterium
RQRFYALGLYVVMLIGAIVTA

SEQ ID NO: 327156 - protein, 21 aa, Mycobacterium
RQRFYALGLYVVMLVGAIAAA

SEQ ID NO: 327157 - protein, 31 aa, Mycobacterium
RQRGWLAILSLRLIPAVPFSAINYAAGASTV

SEQ ID NO: 327158 - protein, 21 aa, Mycobacterium
RQRHAASWAAALMVPSLICAF

SEQ ID NO: 327159 - protein, 19 aa, Mycobacterium
RQRIEPAVSQREWTRAALA

SEQ ID NO: 327160 - protein, 21 aa, Mycobacterium
RQRKPWRGVLLTLAAVTVIAS

SEQ ID NO: 327161 - protein, 17 aa, Mycobacterium
RQRMPAVRVLDGAEAGT

SEQ ID NO: 327162 - protein, 18 aa, Mycobacterium
RQRRGYRPPWAFAAATVM

SEQ ID NO: 327163 - protein, 27 aa, Mycobacterium
RQRRRAILPACCALGGLVVPVVIFLSF

SEQ ID NO: 327164 - protein, 17 aa, Mycobacterium
RQRTAMVAAERLEHMLA

SEQ ID NO: 327165 - protein, 17 aa, Mycobacterium
RQRTAMVAAERVEQMLA

SEQ ID NO: 327166 - protein, 24 aa, Mycobacterium
RQRVDLRPMWGIDERLKRFGTMAA

SEQ ID NO: 327167 - protein, 23 aa, Mycobacterium
RQSALGALLWRGLSPELTPRTQI

SEQ ID NO: 327168 - protein, 19 aa, Mycobacterium
RQSLAIAWLTLIVAEQINA

SEQ ID NO: 327169 - protein, 19 aa, Mycobacterium
RQSLALSWLTLIVAEQINA

SEQ ID NO: 327170 - protein, 17 aa, Mycobacterium
RQSLQLGGGEWGSLFTE

SEQ ID NO: 327171 - protein, 28 aa, Mycobacterium
RQSPTFIADSGFRLAVLGLTVYTASFVC

SEQ ID NO: 327172 - protein, 24 aa, Mycobacterium
RQTIDCVFVMLVLMLVQVTARPWT

SEQ ID NO: 327173 - protein, 23 aa, Mycobacterium
RQTRAAVVTLTLLILLCGTTALV

SEQ ID NO: 327174 - protein, 17 aa, Mycobacterium
RQTRIEAKVRRRRMQRQ

SEQ ID NO: 327175 - protein, 19 aa, Mycobacterium
RQVATYTLLGVVALGVAVV

SEQ ID NO: 327176 - protein, 22 aa, Mycobacterium
RQVCAHCGAMIEAEAAFCQVCG

SEQ ID NO: 327177 - protein, 18 aa, Mycobacterium
RQVHHWAALMFAAAIMVH

SEQ ID NO: 327178 - protein, 19 aa, Mycobacterium
RQVLHDRGSLLALAVPATL

SEQ ID NO: 327179 - protein, 28 aa, Mycobacterium
RQVRLIFSDRGYFVFLAVLPFIMGSLSM

SEQ ID NO: 327180 - protein, 29 aa, Mycobacterium
RQVRLIVADRAYFIFLALLPFVMGALALT

SEQ ID NO: 327181 - protein, 28 aa, Mycobacterium
RQVRLVIADRAYFAFLAILPFILGALSL

SEQ ID NO: 327182 - protein, 33 aa, Mycobacterium
RQVRLVVADRAYFTFLAALPFVLGALSLTVPGD

SEQ ID NO: 327183 - protein, 29 aa, Mycobacterium
RQVRLVVADRAYFVFLALLPFVMGALSLT

SEQ ID NO: 327184 - protein, 17 aa, Mycobacterium
RQWAPYHLRLDWLMWFA

SEQ ID NO: 327185 - protein, 26 aa, Mycobacterium
RQWYESRFLPKIGPWALYGLLFTIVI

SEQ ID NO: 327186 - protein, 17 aa, Mycobacterium
RQYLRRSILPLLLVASL

SEQ ID NO: 327187 - protein, 27 aa, Mycobacterium
RQYRVPRPWLGMLRRDLIPTGYALALI

SEQ ID NO: 327188 - protein, 20 aa, Mycobacterium
RRAAILAAVVCALTLTVAGP

SEQ ID NO: 327189 - protein, 19 aa, Mycobacterium
RRAAILAAVVCVLTLTIAG

SEQ ID NO: 327190 - protein, 20 aa, Mycobacterium
RRAALAASFGLRTLLAVIMI

SEQ ID NO: 327191 - protein, 18 aa, Mycobacterium
RRAALTFSVSLMALCSLV

SEQ ID NO: 327192 - protein, 26 aa, Mycobacterium
RRAARRITMFFKHAALVFAYTTYISI

SEQ ID NO: 327193 - protein, 20 aa, Mycobacterium
RRAATVIAHAAWLALLVAGG

SEQ ID NO: 327194 - protein, 20 aa, Mycobacterium
RRADGLYEIIGRRSRFLKLF

SEQ ID NO: 327195 - protein, 22 aa, Mycobacterium
RRADIADLTRRVVIGAVLTAPV

SEQ ID NO: 327196 - protein, 29 aa, Mycobacterium
RRAGISVDRIRVTAFIACSSLAALSGIIA

SEQ ID NO: 327197 - protein, 19 aa, Mycobacterium
RRAGLAMLPYAVWCAFATV

SEQ ID NO: 327198 - protein, 19 aa, Mycobacterium
RRAGLAMLPYAVWTAFATA

SEQ ID NO: 327199 - protein, 20 aa, Mycobacterium
RRAGLFTLRGYLVVAVAFVI

SEQ ID NO: 327200 - protein, 20 aa, Mycobacterium
RRAGPGGGREPSYRRRSPVE

SEQ ID NO: 327201 - protein, 25 aa, Mycobacterium
RRAGRRFYWATAIIGIACFAVGTGQ

SEQ ID NO: 327202 - protein, 20 aa, Mycobacterium
RRAGRRFYWATAVIGTVCFA

SEQ ID NO: 327203 - protein, 25 aa, Mycobacterium
RRAGTQIGVPYSWGGGSLTGPTRGV

SEQ ID NO: 327204 - protein, 19 aa, Mycobacterium
RRAGVKVAMVTGDHPATAT

SEQ ID NO: 327205 - protein, 22 aa, Mycobacterium
RRAGVMQRILDWSARTLSGPRG

SEQ ID NO: 327206 - protein, 19 aa, Mycobacterium
RRAGWLIAFTGLVIGFSVW

SEQ ID NO: 327207 - protein, 18 aa, Mycobacterium
RRAILRGNALGIPFNETA

SEQ ID NO: 327208 - protein, 19 aa, Mycobacterium
RRAIYRAVWRNHRYHHFKN

SEQ ID NO: 327209 - protein, 23 aa, Mycobacterium
RRALAVSSLPFWVGDALRAASAG

SEQ ID NO: 327210 - protein, 18 aa, Mycobacterium
RRALLSAVSHDLRTPLAA

SEQ ID NO: 327211 - protein, 20 aa, Mycobacterium
RRALYRFVGLVLPLVALLTT

SEQ ID NO: 327212 - protein, 30 aa, Mycobacterium
RRANKKGLLARFWLVLTIAAVVALSGFVVY

SEQ ID NO: 327213 - protein, 18 aa, Mycobacterium
RRANQFDAVVSFVVTVVV

SEQ ID NO: 327214 - protein, 18 aa, Mycobacterium
RRAPEVPRLALLAVAAFS

SEQ ID NO: 327215 - protein, 22 aa, Mycobacterium
RRAPEVPRLAPLAIAAFAAAAA

SEQ ID NO: 327216 - protein, 21 aa, Mycobacterium
RRAPEVPRLGPLAIAAFAAAA

SEQ ID NO: 327217 - protein, 19 aa, Mycobacterium
RRAPFPLIDLQLFTEPVYR

SEQ ID NO: 327218 - protein, 17 aa, Mycobacterium
RRAPLIGVIPTGYGAYQ

SEQ ID NO: 327219 - protein, 20 aa, Mycobacterium
RRAPQASGRQVLRVEVTAPS

SEQ ID NO: 327220 - protein, 19 aa, Mycobacterium
RRAQAWAKKHEELRAALAT

SEQ ID NO: 327221 - protein, 20 aa, Mycobacterium
RRAQRLCRPVFWYLAVWAAV

SEQ ID NO: 327222 - protein, 19 aa, Mycobacterium
RRARFARIAAQHGSYVIED

SEQ ID NO: 327223 - protein, 18 aa, Mycobacterium
RRARGLRISPRIVFVPVI

SEQ ID NO: 327224 - protein, 21 aa, Mycobacterium
RRARHISPLPGRGLTRDGHEL

SEQ ID NO: 327225 - protein, 25 aa, Mycobacterium
RRARHRPWRDYALFVVLVGPNVGLL

SEQ ID NO: 327226 - protein, 28 aa, Mycobacterium
RRARSLNPWPALWAMLVGYFMIVLDSTV

SEQ ID NO: 327227 - protein, 21 aa, Mycobacterium
RRARVDGRAALALLGASAAIT

SEQ ID NO: 327228 - protein, 17 aa, Mycobacterium
RRASAWGRRSNQPLVLA

SEQ ID NO: 327229 - protein, 19 aa, Mycobacterium
RRASAYGVFAAGLGAASAA

SEQ ID NO: 327230 - protein, 20 aa, Mycobacterium
RRASDGFAFLSTLVVVAAVV

SEQ ID NO: 327231 - protein, 18 aa, Mycobacterium
RRASTVGLVALVAAQLGQ

SEQ ID NO: 327232 - protein, 18 aa, Mycobacterium
RRASTVGLVALVSAQLGQ

SEQ ID NO: 327233 - protein, 24 aa, Mycobacterium
RRATARWTWPALGLAIVIVTYLAG

SEQ ID NO: 327234 - protein, 25 aa, Mycobacterium
RRATEVLRRLYARVGDRLVLISVGG

SEQ ID NO: 327235 - protein, 19 aa, Mycobacterium
RRATMLAHALLSRLPRNSV

SEQ ID NO: 327236 - protein, 18 aa, Mycobacterium
RRAVEHRALMAIAIGDLG

SEQ ID NO: 327237 - protein, 18 aa, Mycobacterium
RRAVEHRALMAIAIGQAD

SEQ ID NO: 327238 - protein, 23 aa, Mycobacterium
RRAVEHRALMALAVGNLGMANTQ

SEQ ID NO: 327239 - protein, 25 aa, Mycobacterium
RRAVEIADVVLLCFDTQSQQASEFA

SEQ ID NO: 327240 - protein, 20 aa, Mycobacterium
RRAVLKSTYAQFLFSMSGAD

SEQ ID NO: 327241 - protein, 26 aa, Mycobacterium
RRAVRTRGGADFGLFESGELTAAEHR

SEQ ID NO: 327242 - protein, 17 aa, Mycobacterium
RRAVVAAMLAFWIVIVA

SEQ ID NO: 327243 - protein, 20 aa, Mycobacterium
RRAVVSLVERFGDIAKDLDN

SEQ ID NO: 327244 - protein, 17 aa, Mycobacterium
RRDAKRRARGHVATQPQ

SEQ ID NO: 327245 - protein, 21 aa, Mycobacterium
RRDDLAMSWLLAGLFAGVVSG

SEQ ID NO: 327246 - protein, 21 aa, Mycobacterium
RRDEAWLLRGSQLAAAENLAA

SEQ ID NO: 327247 - protein, 18 aa, Mycobacterium
RRDIFLGAMRVGRDHIAS

SEQ ID NO: 327248 - protein, 18 aa, Mycobacterium
RRDKRKGGVLDFGTTIVG

SEQ ID NO: 327249 - protein, 23 aa, Mycobacterium
RRDLGAAFGWSLFNWVADVACLL

SEQ ID NO: 327250 - protein, 25 aa, Mycobacterium
RRDLKHAKSRLRAIDRMSGTEFEEF

SEQ ID NO: 327251 - protein, 24 aa, Mycobacterium
RRDRAGELLLWLVRPDFAAYLHVG

SEQ ID NO: 327252 - protein, 23 aa, Mycobacterium
RRDRRLSGMLLAFAGATVLGFSG

SEQ ID NO: 327253 - protein, 24 aa, Mycobacterium
RRDTRRLWLGYGVALALSIVLDAY

SEQ ID NO: 327254 - protein, 31 aa, Mycobacterium
RREEAPRGKYWWLRWVILGIVAIVLAVEIAL

SEQ ID NO: 327255 - protein, 17 aa, Mycobacterium
RREEGFRWGQIATASLV

SEQ ID NO: 327256 - protein, 21 aa, Mycobacterium
RREFAIPAGLGIPIGATASFL

SEQ ID NO: 327257 - protein, 21 aa, Mycobacterium
RREHIGEALRRLPPYATALGE

SEQ ID NO: 327258 - protein, 19 aa, Mycobacterium
RREIGAWIERRARVPVDPE

SEQ ID NO: 327259 - protein, 19 aa, Mycobacterium
RREIIRLVAEISMGAGTLA

SEQ ID NO: 327260 - protein, 23 aa, Mycobacterium
RRELGGLACLVQLLLAALIGAAL

SEQ ID NO: 327261 - protein, 29 aa, Mycobacterium
RREQRNWLRRLWLAMPLALLASVSTMVFG

SEQ ID NO: 327262 - protein, 36 aa, Mycobacterium
RRERISLRPLWGIDARLKKFGMMALAMVLYVLVSQV

SEQ ID NO: 327263 - protein, 24 aa, Mycobacterium
RRERISLRPLWGIDDRLKKFGAMA

SEQ ID NO: 327264 - protein, 25 aa, Mycobacterium
RRESLRLVAEIGMGTGAMAVIGGTV

SEQ ID NO: 327265 - protein, 21 aa, Mycobacterium
RRETPPCSAFLPEVIDRVMLD

SEQ ID NO: 327266 - protein, 21 aa, Mycobacterium
RRETWLIMRLPIIDNAQALRW

SEQ ID NO: 327267 - protein, 20 aa, Mycobacterium
RRETWLIMRLSIIDNTQALR

SEQ ID NO: 327268 - protein, 25 aa, Mycobacterium
RREVIRLIAEISMGAGTLAMIGGTL

SEQ ID NO: 327269 - protein, 18 aa, Mycobacterium
RRFGGITGDVLGAAVELT

SEQ ID NO: 327270 - protein, 17 aa, Mycobacterium
RRFKRPPWVALPIGLFI

SEQ ID NO: 327271 - protein, 18 aa, Mycobacterium
RRFLKAVLPVAAVFLIWD

SEQ ID NO: 327272 - protein, 17 aa, Mycobacterium
RRFMSFGLIFLMLNVLQ

SEQ ID NO: 327273 - protein, 19 aa, Mycobacterium
RRFPTAVAVVAGLAGLVVG

SEQ ID NO: 327274 - protein, 22 aa, Mycobacterium
RRFRLTPRRLFGALSSGVLGVL

SEQ ID NO: 327275 - protein, 23 aa, Mycobacterium
RRFRWAVFAVWLLLLLPSVYLAM

SEQ ID NO: 327276 - protein, 24 aa, Mycobacterium
RRFRWLVFTGWMLALVPAIYLALT

SEQ ID NO: 327277 - protein, 17 aa, Mycobacterium
RRFTFGIAGTGNVARHH

SEQ ID NO: 327278 - protein, 19 aa, Mycobacterium
RRFTRSAGRMRVRHLRNHV

SEQ ID NO: 327279 - protein, 22 aa, Mycobacterium
RRFVARGGERGVIYDIALWMVP

SEQ ID NO: 327280 - protein, 25 aa, Mycobacterium
RRFVGSRLKAVFVGVFVVLAAASFW

SEQ ID NO: 327281 - protein, 30 aa, Mycobacterium
RRFVLPNRLWWPLSPRLRKALKTVTVAVSV

SEQ ID NO: 327282 - protein, 24 aa, Mycobacterium
RRFYASAPNRLWVADFTYVATWMG

SEQ ID NO: 327283 - protein, 18 aa, Mycobacterium
RRFYQKKGFQRDGRSVLL

SEQ ID NO: 327284 - protein, 20 aa, Mycobacterium
RRGALMFGKVLPVGIGVVVG

SEQ ID NO: 327285 - protein, 19 aa, Mycobacterium
RRGAPAIGVGNVIGSVVFS

SEQ ID NO: 327286 - protein, 25 aa, Mycobacterium
RRGAPRGGAVALVLLTGFALFGGLL

SEQ ID NO: 327287 - protein, 19 aa, Mycobacterium
RRGFVTRHQVSGWRFVMRR

SEQ ID NO: 327288 - protein, 23 aa, Mycobacterium
RRGGILRILRYVAIAIWAAVIVY

SEQ ID NO: 327289 - protein, 21 aa, Mycobacterium
RRGGRRPGWVLLTTLLVLAIG

SEQ ID NO: 327290 - protein, 19 aa, Mycobacterium
RRGGSPGWYKGASLATDAL

SEQ ID NO: 327291 - protein, 17 aa, Mycobacterium
RRGGSPSRPLAPTPAGR

SEQ ID NO: 327292 - protein, 24 aa, Mycobacterium
RRGHGHRPMLLAARSVAALLAVLA

SEQ ID NO: 327293 - protein, 31 aa, Mycobacterium
RRGHGMPLLTVIGVICSAIIAALAVGALTLL

SEQ ID NO: 327294 - protein, 25 aa, Mycobacterium
RRGITIPGAEDFRALPGRGVRASVG

SEQ ID NO: 327295 - protein, 19 aa, Mycobacterium
RRGKILAGLIAAAAPGAAL

SEQ ID NO: 327296 - protein, 18 aa, Mycobacterium
RRGLLIGGAVAAVVVIAA

SEQ ID NO: 327297 - protein, 26 aa, Mycobacterium
RRGLPRGGAVALVLLGGFAILGGILA

SEQ ID NO: 327298 - protein, 35 aa, Mycobacterium
RRGLRHPWLYFVSSLFTSFAFAFAFYFATMERQRR

SEQ ID NO: 327299 - protein, 18 aa, Mycobacterium
RRGLWAVVGQRFVPGISD

SEQ ID NO: 327300 - protein, 20 aa, Mycobacterium
RRGMAGAWAPTGFAIATLLS

SEQ ID NO: 327301 - protein, 21 aa, Mycobacterium
RRGPGKSVLLGIVLIAVGLAM

SEQ ID NO: 327302 - protein, 19 aa, Mycobacterium
RRGPGRWGSTSLRVGVSVV

SEQ ID NO: 327303 - protein, 21 aa, Mycobacterium
RRGQESFNFGELFAYTKVCSH

SEQ ID NO: 327304 - protein, 17 aa, Mycobacterium
RRGQIIFERVITGLLLV

SEQ ID NO: 327305 - protein, 20 aa, Mycobacterium
RRGQKVPVGPVVFGGVAWAQ

SEQ ID NO: 327306 - protein, 33 aa, Mycobacterium
RRGRIPGVASGPAWRLIGTTAFGLLLLTFTPTK

SEQ ID NO: 327307 - protein, 25 aa, Mycobacterium
RRGSSSPDRTYGWHRAEVFTAVANA

SEQ ID NO: 327308 - protein, 17 aa, Mycobacterium
RRGTAMGVWGAVAGIAT

SEQ ID NO: 327309 - protein, 21 aa, Mycobacterium
RRGTQHLGLLILRVGLGFVLA

SEQ ID NO: 327310 - protein, 20 aa, Mycobacterium
RRGTQHLGLLVLRVGLGAVL

SEQ ID NO: 327311 - protein, 28 aa, Mycobacterium
RRGVLPGLASGPVWRLIGSTAIGLLLLT

SEQ ID NO: 327312 - protein, 24 aa, Mycobacterium
RRGVPLRVSLVVGTLVLVALGLVA

SEQ ID NO: 327313 - protein, 20 aa, Mycobacterium
RRGWLEALLGHFCDPTVGLV

SEQ ID NO: 327314 - protein, 22 aa, Mycobacterium
RRGWPREAMRPHNLPAVMLGAG

SEQ ID NO: 327315 - protein, 29 aa, Mycobacterium
RRGYDVLPETRWIPVVTFLQVSADMAVAV

SEQ ID NO: 327316 - protein, 29 aa, Mycobacterium
RRGYDVLPQTRWIPVVTFLQVSADMAVAV

SEQ ID NO: 327317 - protein, 17 aa, Mycobacterium
RRHAAGISSRYGYRRHQ

SEQ ID NO: 327318 - protein, 18 aa, Mycobacterium
RRHAKVVVLYGIIPVAGA

SEQ ID NO: 327319 - protein, 24 aa, Mycobacterium
RRHCGYRTPVMFLLWVLIPTAASV

SEQ ID NO: 327320 - protein, 23 aa, Mycobacterium
RRHETWLMMLLGAGFGLGVALTL

SEQ ID NO: 327321 - protein, 22 aa, Mycobacterium
RRHGVPRQLGLVAALPLSLVAV

SEQ ID NO: 327322 - protein, 18 aa, Mycobacterium
RRHMIRWALPPILILAPL

SEQ ID NO: 327323 - protein, 18 aa, Mycobacterium
RRHMIRWGIPPLFVLAPF

SEQ ID NO: 327324 - protein, 23 aa, Mycobacterium
RRHPGDASFYWLTLALAGVWVAG

SEQ ID NO: 327325 - protein, 24 aa, Mycobacterium
RRHPGEASFYWLTLALAAVWTAGA

SEQ ID NO: 327326 - protein, 24 aa, Mycobacterium
RRHPNRKAMIVGRAAAAMIAALTL

SEQ ID NO: 327327 - protein, 18 aa, Mycobacterium
RRHRELRAALTPLVQERV

SEQ ID NO: 327328 - protein, 18 aa, Mycobacterium
RRHRHLRAALTPLVQERV

SEQ ID NO: 327329 - protein, 18 aa, Mycobacterium
RRHRVVIIGSGFGGLNAA

SEQ ID NO: 327330 - protein, 18 aa, Mycobacterium
RRHVDSYRGLAYVRPWLA

SEQ ID NO: 327331 - protein, 27 aa, Mycobacterium
RRHVRWRHRICLAAAIIAMLATPALIQ

SEQ ID NO: 327332 - protein, 17 aa, Mycobacterium
RRHVVVVGEEPRAADDV

SEQ ID NO: 327333 - protein, 22 aa, Mycobacterium
RRIADIMLLSGLAPLTVSAAAA

SEQ ID NO: 327334 - protein, 17 aa, Mycobacterium
RRIATDFDRSQRAASAA

SEQ ID NO: 327335 - protein, 17 aa, Mycobacterium
RRIATDFDRTQKAASAA

SEQ ID NO: 327336 - protein, 19 aa, Mycobacterium
RRIAVIAGITLVVLIAVAA

SEQ ID NO: 327337 - protein, 18 aa, Mycobacterium
RRIEAFAMFNVFYQSGIL

SEQ ID NO: 327338 - protein, 23 aa, Mycobacterium
RRIESACKVWSAGVQASGLGRDL

SEQ ID NO: 327339 - protein, 24 aa, Mycobacterium
RRIESACKVWSAGVQASRLGRDLA

SEQ ID NO: 327340 - protein, 23 aa, Mycobacterium
RRIESACKVWSAGVSASPLGKDL

SEQ ID NO: 327341 - protein, 22 aa, Mycobacterium
RRIESACKVWSAGVSASPLGRD

SEQ ID NO: 327342 - protein, 17 aa, Mycobacterium
RRILLRTVLFIAPGSAL

SEQ ID NO: 327343 - protein, 17 aa, Mycobacterium
RRILLRTVLFIAPGSAV

SEQ ID NO: 327344 - protein, 25 aa, Mycobacterium
RRILPPRWWSIGALDGLVTAVLVWW

SEQ ID NO: 327345 - protein, 24 aa, Mycobacterium
RRILPQRWWSIGGLDALVIAVLVW

SEQ ID NO: 327346 - protein, 19 aa, Mycobacterium
RRILVVAALVMIAAGIFGI

SEQ ID NO: 327347 - protein, 18 aa, Mycobacterium
RRIMPAYWILVAIAYIWY

SEQ ID NO: 327348 - protein, 21 aa, Mycobacterium
RRIPRGRLILVGIVSALAVGG

SEQ ID NO: 327349 - protein, 19 aa, Mycobacterium
RRIPVAVGLLLAGPLMHFV

SEQ ID NO: 327350 - protein, 25 aa, Mycobacterium
RRIQRSPLPFGRHRWVVDARAPDIA

SEQ ID NO: 327351 - protein, 24 aa, Mycobacterium
RRITLPMLRPTFFFVLVTGVVSAV

SEQ ID NO: 327352 - protein, 31 aa, Mycobacterium
RRITRFSDTFFREVWDPELATAKGRVNLSFT

SEQ ID NO: 327353 - protein, 19 aa, Mycobacterium
RRIVGITIISFIAMMFTPT

SEQ ID NO: 327354 - protein, 20 aa, Mycobacterium
RRIVGWRAARSMTTDLVLDA

SEQ ID NO: 327355 - protein, 21 aa, Mycobacterium
RRIVLPQAMRVIIPPTGNDFI

SEQ ID NO: 327356 - protein, 21 aa, Mycobacterium
RRKAMSWHAVIGVWVLAVLLA

SEQ ID NO: 327357 - protein, 33 aa, Mycobacterium
RRKFDPWGVVAWIVGLGFFFPVFWMVLTAFKQE

SEQ ID NO: 327358 - protein, 23 aa, Mycobacterium
RRKKRSQPWILLAATMAMAVLIV

SEQ ID NO: 327359 - protein, 18 aa, Mycobacterium
RRKPDLRGATLLAGALGL

SEQ ID NO: 327360 - protein, 25 aa, Mycobacterium
RRKPLESYNRLWLGVVAVAVVSVLI

SEQ ID NO: 327361 - protein, 21 aa, Mycobacterium
RRKQGRSKRPWVIAGAVTVVV

SEQ ID NO: 327362 - protein, 24 aa, Mycobacterium
RRKRPDLERGFRAPWVPWLPIASL

SEQ ID NO: 327363 - protein, 23 aa, Mycobacterium
RRKVDLVAVHAWKAPGVLDPIVS

SEQ ID NO: 327364 - protein, 20 aa, Mycobacterium
RRLAGVGGGRCVLVDNEDRL

SEQ ID NO: 327365 - protein, 21 aa, Mycobacterium
RRLAQLGGLVLVSAFTVVTLG

SEQ ID NO: 327366 - protein, 19 aa, Mycobacterium
RRLARALSLALLIVVAVGA

SEQ ID NO: 327367 - protein, 30 aa, Mycobacterium
RRLARIVRRFAIPIILFWVAITALLNLAVP

SEQ ID NO: 327368 - protein, 17 aa, Mycobacterium
RRLARYRAEAASARRSD

SEQ ID NO: 327369 - protein, 17 aa, Mycobacterium
RRLDAVWSNMATFEKEI

SEQ ID NO: 327370 - protein, 22 aa, Mycobacterium
RRLEAFALFNVFYQAGILAGPL

SEQ ID NO: 327371 - protein, 25 aa, Mycobacterium
RRLETRMMALFGIFFGLGAALTVSR

SEQ ID NO: 327372 - protein, 20 aa, Mycobacterium
RRLGLSDSYGIQKRFTEVLT

SEQ ID NO: 327373 - protein, 18 aa, Mycobacterium
RRLGLYLTLPSYVVMLLV

SEQ ID NO: 327374 - protein, 19 aa, Mycobacterium
RRLGPLVAEELPVVVRASE

SEQ ID NO: 327375 - protein, 18 aa, Mycobacterium
RRLGRLLAVGAIPMLTAP

SEQ ID NO: 327376 - protein, 21 aa, Mycobacterium
RRLGTHLRTLFLGLLTALTVA

SEQ ID NO: 327377 - protein, 19 aa, Mycobacterium
RRLHVLLADAMRAADAGTA

SEQ ID NO: 327378 - protein, 32 aa, Mycobacterium
RRLIGELTHFFALLLWAAAVLAFFADLPELSI

SEQ ID NO: 327379 - protein, 18 aa, Mycobacterium
RRLIMLGLLGFGVVTGVT

SEQ ID NO: 327380 - protein, 20 aa, Mycobacterium
RRLISVRKLAGLALWLITAV

SEQ ID NO: 327381 - protein, 21 aa, Mycobacterium
RRLITVCPALVILAVGFDPTR

SEQ ID NO: 327382 - protein, 30 aa, Mycobacterium
RRLKIAHTVSFSFDMSWEELLWLIEGHEVH

SEQ ID NO: 327383 - protein, 25 aa, Mycobacterium
RRLLGTAYGWFAGWVYMWTLVIAMA

SEQ ID NO: 327384 - protein, 20 aa, Mycobacterium
RRLLGTHLRTMFVVLLSALT

SEQ ID NO: 327385 - protein, 20 aa, Mycobacterium
RRLLHDFRGPLIVSLLLVAL

SEQ ID NO: 327386 - protein, 17 aa, Mycobacterium
RRLLIARALISAFPVVL

SEQ ID NO: 327387 - protein, 17 aa, Mycobacterium
RRLLLGMLAELAAGAGV

SEQ ID NO: 327388 - protein, 18 aa, Mycobacterium
RRLLLIIASVGLAVSSVL

SEQ ID NO: 327389 - protein, 17 aa, Mycobacterium
RRLLPALVVVLAVSAVL

SEQ ID NO: 327390 - protein, 17 aa, Mycobacterium
RRLLPDPARARVRVYAT

SEQ ID NO: 327391 - protein, 22 aa, Mycobacterium
RRLLRMRSFITIGVFAAAAVVA

SEQ ID NO: 327392 - protein, 20 aa, Mycobacterium
RRLNELGIRVALDDFGTGFN

SEQ ID NO: 327393 - protein, 27 aa, Mycobacterium
RRLNHLCDRLWLIAAIEHYTAVMGDFA

SEQ ID NO: 327394 - protein, 18 aa, Mycobacterium
RRLPAPPSPSWWLPLVRG

SEQ ID NO: 327395 - protein, 21 aa, Mycobacterium
RRLPLASLFFADPNLRVPLAV

SEQ ID NO: 327396 - protein, 17 aa, Mycobacterium
RRLPRPGGPDAPTEQIR

SEQ ID NO: 327397 - protein, 27 aa, Mycobacterium
RRLPYPGRIGLLFAVMPFHAFFGIALM

SEQ ID NO: 327398 - protein, 18 aa, Mycobacterium
RRLQELRQSAPVVVTKTR

SEQ ID NO: 327399 - protein, 21 aa, Mycobacterium
RRLREAGFDRLVMLTGDRPEP

SEQ ID NO: 327400 - protein, 19 aa, Mycobacterium
RRLRGGTLREPLLVRVFGG

SEQ ID NO: 327401 - protein, 17 aa, Mycobacterium
RRLRPDALEDLGLHSAL

SEQ ID NO: 327402 - protein, 17 aa, Mycobacterium
RRLRRIAVIAGITLVVL

SEQ ID NO: 327403 - protein, 23 aa, Mycobacterium
RRLRSLFPANWRTFTLVDAAVIF

SEQ ID NO: 327404 - protein, 17 aa, Mycobacterium
RRLSPGALRAVIVAVGL

SEQ ID NO: 327405 - protein, 19 aa, Mycobacterium
RRLSRRFARVGVEIPSGRL

SEQ ID NO: 327406 - protein, 27 aa, Mycobacterium
RRLSRRYWAVVSFLVLFSIANFPDALL

SEQ ID NO: 327407 - protein, 17 aa, Mycobacterium
RRLSRWDSNPGYIRSTS

SEQ ID NO: 327408 - protein, 18 aa, Mycobacterium
RRLSVGIRFVVPVLLLVA

SEQ ID NO: 327409 - protein, 25 aa, Mycobacterium
RRLTRPVRFAAWAVAGVSALGLLNF

SEQ ID NO: 327410 - protein, 20 aa, Mycobacterium
RRLTSVSGLLGVAWGLAPVL

SEQ ID NO: 327411 - protein, 18 aa, Mycobacterium
RRLVAVLMVLQLISTLAS

SEQ ID NO: 327412 - protein, 17 aa, Mycobacterium
RRLVVGILLAVALVAAL

SEQ ID NO: 327413 - protein, 20 aa, Mycobacterium
RRLVVPRLAAAVMIGVALTG

SEQ ID NO: 327414 - protein, 24 aa, Mycobacterium
RRLWPRSAPMLAAYATLQACILPI

SEQ ID NO: 327415 - protein, 19 aa, Mycobacterium
RRMAGPVAILAVWTIGSTS

SEQ ID NO: 327416 - protein, 18 aa, Mycobacterium
RRMLRLIRRYGPIMTMPI

SEQ ID NO: 327417 - protein, 17 aa, Mycobacterium
RRMMIAYAVLLVIGSAV

SEQ ID NO: 327418 - protein, 20 aa, Mycobacterium
RRNAAALSHHGVRLDYDPEQ

SEQ ID NO: 327419 - protein, 21 aa, Mycobacterium
RRNAAIWVRDRSRWLRGRRHT

SEQ ID NO: 327420 - protein, 24 aa, Mycobacterium
RRNAELLLLCFAAAITVAALLIVE

SEQ ID NO: 327421 - protein, 17 aa, Mycobacterium
RRNLIFVAIVLGMLLAA

SEQ ID NO: 327422 - protein, 21 aa, Mycobacterium
RRNLRTVISLSVILVLLTAAS

SEQ ID NO: 327423 - protein, 18 aa, Mycobacterium
RRNLRTVISLSVVLVLLT

SEQ ID NO: 327424 - protein, 19 aa, Mycobacterium
RRNLVVFGLLGFGLVGGVV

SEQ ID NO: 327425 - protein, 30 aa, Mycobacterium
RRPAAAVSRTAGFAFRHRTGNIIIFLTLAI

SEQ ID NO: 327426 - protein, 22 aa, Mycobacterium
RRPAKDVPLRKLDFPITSNGKD

SEQ ID NO: 327427 - protein, 18 aa, Mycobacterium
RRPALVLIDEMAHTNVPG

SEQ ID NO: 327428 - protein, 19 aa, Mycobacterium
RRPAPSPIRPGCHASAHRP

SEQ ID NO: 327429 - protein, 22 aa, Mycobacterium
RRPAYWVSMLIVLGFQIPVDGW

SEQ ID NO: 327430 - protein, 21 aa, Mycobacterium
RRPDGGAARAIAPWYLLTALA

SEQ ID NO: 327431 - protein, 20 aa, Mycobacterium
RRPEFATPRLALTLRAASFT

SEQ ID NO: 327432 - protein, 32 aa, Mycobacterium
RRPESTQSRFWARWVGWVMRRPWITALSASLV

SEQ ID NO: 327433 - protein, 32 aa, Mycobacterium
RRPESTQSRFWNRWIGWVMRRPWMSALAASLV

SEQ ID NO: 327434 - protein, 26 aa, Mycobacterium
RRPFPQRLGPRWTLLYKLVTTTDHKL

SEQ ID NO: 327435 - protein, 17 aa, Mycobacterium
RRPGAEGPFAPAAPATP

SEQ ID NO: 327436 - protein, 17 aa, Mycobacterium
RRPGGVIRTSWARHRYA

SEQ ID NO: 327437 - protein, 20 aa, Mycobacterium
RRPILLSGIAIMIVADVALM

SEQ ID NO: 327438 - protein, 32 aa, Mycobacterium
RRPKEPIISASLWRMMAGYGVAIAVSTLLALV

SEQ ID NO: 327439 - protein, 27 aa, Mycobacterium
RRPKGAVIFCVAGLTVAFVVLTGLAFG

SEQ ID NO: 327440 - protein, 17 aa, Mycobacterium
RRPLIASGYGMAALGKL

SEQ ID NO: 327441 - protein, 18 aa, Mycobacterium
RRPLPPLPAMGKLLAAAL

SEQ ID NO: 327442 - protein, 19 aa, Mycobacterium
RRPLVQLLVFLGGGFAMGV

SEQ ID NO: 327443 - protein, 18 aa, Mycobacterium
RRPNAVVLASAMYAALAI

SEQ ID NO: 327444 - protein, 24 aa, Mycobacterium
RRPPRRLRLLLSVAAIVLALDIVT

SEQ ID NO: 327445 - protein, 26 aa, Mycobacterium
RRPPRTRGRAGLWTWITDTGVIGGLL

SEQ ID NO: 327446 - protein, 17 aa, Mycobacterium
RRPPTRSQITFGVLGVA

SEQ ID NO: 327447 - protein, 20 aa, Mycobacterium
RRPPWPDLTSPGWSPAENPQ

SEQ ID NO: 327448 - protein, 18 aa, Mycobacterium
RRPRLWPELVRHRGQALR

SEQ ID NO: 327449 - protein, 17 aa, Mycobacterium
RRPSTDFVQQVLRAVAP

SEQ ID NO: 327450 - protein, 18 aa, Mycobacterium
RRPTIVRALLTLTRPRDD

SEQ ID NO: 327451 - protein, 20 aa, Mycobacterium
RRPVISLLRAIGGRRVTIVG

SEQ ID NO: 327452 - protein, 19 aa, Mycobacterium
RRPVVGYIWGWVNTHDRRW

SEQ ID NO: 327453 - protein, 23 aa, Mycobacterium
RRPWPMVGAVLLFVIAAVPNYLF

SEQ ID NO: 327454 - protein, 23 aa, Mycobacterium
RRQAETPLLLAVDGKLVGLISLR

SEQ ID NO: 327455 - protein, 17 aa, Mycobacterium
RRQAVITLAPWLLTAAI

SEQ ID NO: 327456 - protein, 38 aa, Mycobacterium
RRQFQLRPAESGPRRQRRLSPVGGPGNRHRRRRRKWRK

SEQ ID NO: 327457 - protein, 30 aa, Mycobacterium
RRQFRLVVADRAYFVFLALLPFIMGSLSLT

SEQ ID NO: 327458 - protein, 33 aa, Mycobacterium
RRQIRLVISDRGYFAFLMLLPFIMGILSLSVPG

SEQ ID NO: 327459 - protein, 18 aa, Mycobacterium
RRQMITYTSVVLVFLAFM

SEQ ID NO: 327460 - protein, 19 aa, Mycobacterium
RRQPFAFAAAFLAAGLALR

SEQ ID NO: 327461 - protein, 27 aa, Mycobacterium
RRQPNRALVAWISFAAALLAIGALAGC

SEQ ID NO: 327462 - protein, 24 aa, Mycobacterium
RRQQIPLRPLWGLDDRLKQFGGMA

SEQ ID NO: 327463 - protein, 21 aa, Mycobacterium
RRQRCCCADSARICRKQSDRR

SEQ ID NO: 327464 - protein, 17 aa, Mycobacterium
RRQRGGAGIKVRLVKGA

SEQ ID NO: 327465 - protein, 36 aa, Mycobacterium
RRQRIDLRPLWGIDARLKRFGTMAAAMVLYVLISQL

SEQ ID NO: 327466 - protein, 19 aa, Mycobacterium
RRQRYGWLALVTALLGWAA

SEQ ID NO: 327467 - protein, 17 aa, Mycobacterium
RRQSYGYGGSFTSGTPM

SEQ ID NO: 327468 - protein, 19 aa, Mycobacterium
RRQVDIEGFQLVRQTYDMA

SEQ ID NO: 327469 - protein, 18 aa, Mycobacterium
RRQVFVGAMRVGRDHIAS

SEQ ID NO: 327470 - protein, 18 aa, Mycobacterium
RRRAAALAAARRVDPTDV

SEQ ID NO: 327471 - protein, 17 aa, Mycobacterium
RRRADALAAARRVDPTD

SEQ ID NO: 327472 - protein, 21 aa, Mycobacterium
RRRADVDARATLAMAAGAALF

SEQ ID NO: 327473 - protein, 22 aa, Mycobacterium
RRRAIWQWLLVLLATVATAGAT

SEQ ID NO: 327474 - protein, 25 aa, Mycobacterium
RRRAKLEKIGRGFEYADLEPDTDHD

SEQ ID NO: 327475 - protein, 29 aa, Mycobacterium
RRRALVPYEFPWTVPVVMYGSTLLIVGCA

SEQ ID NO: 327476 - protein, 25 aa, Mycobacterium
RRRAMAFYKGCVRRQIAVNGGGTHL

SEQ ID NO: 327477 - protein, 17 aa, Mycobacterium
RRRARHFWMLRAASCRS

SEQ ID NO: 327478 - protein, 27 aa, Mycobacterium
RRRCGYRTPVPFVLRLLIPTGASVVVT

SEQ ID NO: 327479 - protein, 20 aa, Mycobacterium
RRRDCIAAAGIVGWTVRQTL

SEQ ID NO: 327480 - protein, 22 aa, Mycobacterium
RRRDCLHTDGIIGWTVRQTLLQ

SEQ ID NO: 327481 - protein, 24 aa, Mycobacterium
RRRDRVFSWLPFYHDMGFIQVLAA

SEQ ID NO: 327482 - protein, 17 aa, Mycobacterium
RRRFFGYLNLFLAAMLL

SEQ ID NO: 327483 - protein, 17 aa, Mycobacterium
RRRGHLWPINRSAADPV

SEQ ID NO: 327484 - protein, 17 aa, Mycobacterium
RRRGLFGSFLEFGTLAG

SEQ ID NO: 327485 - protein, 20 aa, Mycobacterium
RRRGSHLARQISLLRNYLLP

SEQ ID NO: 327486 - protein, 22 aa, Mycobacterium
RRRGWPTTLFRPHNLPFVMLGA

SEQ ID NO: 327487 - protein, 25 aa, Mycobacterium
RRRIAHDFTLIPAFIEEILRVDGPV

SEQ ID NO: 327488 - protein, 19 aa, Mycobacterium
RRRILMIVGSAVAAVAVIA

SEQ ID NO: 327489 - protein, 21 aa, Mycobacterium
RRRIRIQLILTTFVVIANLLG

SEQ ID NO: 327490 - protein, 18 aa, Mycobacterium
RRRIYGAGLFVLGLAMLV

SEQ ID NO: 327491 - protein, 22 aa, Mycobacterium
RRRKVIGMSLGLGLGAFGLSTL

SEQ ID NO: 327492 - protein, 21 aa, Mycobacterium
RRRLAPPNTRKGTITIEAPPE

SEQ ID NO: 327493 - protein, 21 aa, Mycobacterium
RRRLAPPVTRKGTIAIEAPPE

SEQ ID NO: 327494 - protein, 21 aa, Mycobacterium
RRRLAPPVTRKGTINIEAPPE

SEQ ID NO: 327495 - protein, 22 aa, Mycobacterium
RRRLDEYVEFLVSWQRPLAGKK

SEQ ID NO: 327496 - protein, 24 aa, Mycobacterium
RRRLESYHKAWLGTVAVVVVAVLV

SEQ ID NO: 327497 - protein, 18 aa, Mycobacterium
RRRLHPLLLLCISAISFS

SEQ ID NO: 327498 - protein, 18 aa, Mycobacterium
RRRLHPLLLLCISAMSFS

SEQ ID NO: 327499 - protein, 19 aa, Mycobacterium
RRRLIPTLMLLSAAALTWC

SEQ ID NO: 327500 - protein, 21 aa, Mycobacterium
RRRLPGQLPAAIACLTVAAVH

SEQ ID NO: 327501 - protein, 27 aa, Mycobacterium
RRRLQGAALFCIGLAMLVIGVAVPATQ

SEQ ID NO: 327502 - protein, 27 aa, Mycobacterium
RRRLRRRLSGGLLLLIALTIAGGLAAV

SEQ ID NO: 327503 - protein, 22 aa, Mycobacterium
RRRLTPPTTRKGTITIEAPPQL

SEQ ID NO: 327504 - protein, 18 aa, Mycobacterium
RRRLVAFVSHDLRTPLAG

SEQ ID NO: 327505 - protein, 20 aa, Mycobacterium
RRRMRWLRSHYRRWGLIAVG

SEQ ID NO: 327506 - protein, 19 aa, Mycobacterium
RRRNWLISGVIFAATAAVA

SEQ ID NO: 327507 - protein, 19 aa, Mycobacterium
RRRPERFVLAVLGIALAIA

SEQ ID NO: 327508 - protein, 19 aa, Mycobacterium
RRRPERFVLSVLGIALAIA

SEQ ID NO: 327509 - protein, 21 aa, Mycobacterium
RRRPEVLVYAWLMPASTVVQA

SEQ ID NO: 327510 - protein, 23 aa, Mycobacterium
RRRQGIVCAAALSGIAGLDLYTA

SEQ ID NO: 327511 - protein, 33 aa, Mycobacterium
RRRQIRLLARREVRLLLAHRSYFAFLAILPFVL

SEQ ID NO: 327512 - protein, 26 aa, Mycobacterium
RRRRALRWALIFSAGCVFWAAVTAVL

SEQ ID NO: 327513 - protein, 27 aa, Mycobacterium
RRRRALRWGLIFAVGCVFWAAVTMLLA

SEQ ID NO: 327514 - protein, 22 aa, Mycobacterium
RRRREILVYAWLMPVSTVVQAV

SEQ ID NO: 327515 - protein, 24 aa, Mycobacterium
RRRRELKTPWWETAQPAGQPEQAA

SEQ ID NO: 327516 - protein, 22 aa, Mycobacterium
RRRREVLFYAWLMPASTVAQAI

SEQ ID NO: 327517 - protein, 22 aa, Mycobacterium
RRRRLRRRATAALLLLSGLVMA

SEQ ID NO: 327518 - protein, 17 aa, Mycobacterium
RRRRPGSPSSERGHKKV

SEQ ID NO: 327519 - protein, 50 aa, Mycobacterium
RRRRPHPKSSWAAVLAWVVLPSLALLLAITAGVLRWQYDTMRYAQIAGVQ

SEQ ID NO: 327520 - protein, 18 aa, Mycobacterium
RRRRPPIGVAPLAVRTVM

SEQ ID NO: 327521 - protein, 27 aa, Mycobacterium
RRRRRALRWALIFSAGCVFWAAVTAVL

SEQ ID NO: 327522 - protein, 20 aa, Mycobacterium
RRRRRLRRFTESSVPQSPIR

SEQ ID NO: 327523 - protein, 26 aa, Mycobacterium
RRRRRVLGGFVFGLLVVFVVVVVVFG

SEQ ID NO: 327524 - protein, 26 aa, Mycobacterium
RRRRSWRWVVVILLVLAVIAGVDAYL

SEQ ID NO: 327525 - protein, 17 aa, Mycobacterium
RRRRVIVAITLVVGAAV

SEQ ID NO: 327526 - protein, 19 aa, Mycobacterium
RRRRWPQALLAAGAITFVA

SEQ ID NO: 327527 - protein, 25 aa, Mycobacterium
RRRSELLPVGITWTSLIAVDVSLVL

SEQ ID NO: 327528 - protein, 20 aa, Mycobacterium
RRRSGFHLLLLGALAAIVCA

SEQ ID NO: 327529 - protein, 19 aa, Mycobacterium
RRRSHVGIRLLLAAMMGLT

SEQ ID NO: 327530 - protein, 18 aa, Mycobacterium
RRRSMLSLADRVAVLDSG

SEQ ID NO: 327531 - protein, 21 aa, Mycobacterium
RRRSWARSHGFDYERESTEIL

SEQ ID NO: 327532 - protein, 18 aa, Mycobacterium
RRRTHVAVGDGILVPHAS

SEQ ID NO: 327533 - protein, 26 aa, Mycobacterium
RRRTQHNVYIPWSMTVTPISQSDVGS

SEQ ID NO: 327534 - protein, 22 aa, Mycobacterium
RRRTRKKVLMGSAVVAGIAAVV

SEQ ID NO: 327535 - protein, 18 aa, Mycobacterium
RRRTWLILRMNPQRNVAA

SEQ ID NO: 327536 - protein, 18 aa, Mycobacterium
RRRVPDVRGAAMLATALG

SEQ ID NO: 327537 - protein, 25 aa, Mycobacterium
RRRVPEGLWHPGLVAALVGGGLALV

SEQ ID NO: 327538 - protein, 19 aa, Mycobacterium
RRRVPGISYATTFRADPYP

SEQ ID NO: 327539 - protein, 23 aa, Mycobacterium
RRRVRIQIILTFFILFTNIMGIA

SEQ ID NO: 327540 - protein, 17 aa, Mycobacterium
RRRVWARLSPGAAAGTV

SEQ ID NO: 327541 - protein, 17 aa, Mycobacterium
RRRWLTWWRYTRTWESV

SEQ ID NO: 327542 - protein, 18 aa, Mycobacterium
RRRWRLLYLASMGCWLIA

SEQ ID NO: 327543 - protein, 17 aa, Mycobacterium
RRSAPLVRGLKALSRAV

SEQ ID NO: 327544 - protein, 18 aa, Mycobacterium
RRSARVVQLVHIREQLVL

SEQ ID NO: 327545 - protein, 20 aa, Mycobacterium
RRSDLDAALLASVGLANNGS

SEQ ID NO: 327546 - protein, 19 aa, Mycobacterium
RRSGFGLGLALGVLYVPCA

SEQ ID NO: 327547 - protein, 22 aa, Mycobacterium
RRSGLRPPALWSGMRTGSVAAA

SEQ ID NO: 327548 - protein, 23 aa, Mycobacterium
RRSILWRTKVRLQFTGWLQYLIT

SEQ ID NO: 327549 - protein, 18 aa, Mycobacterium
RRSIPIGGVVVVLLVLLG

SEQ ID NO: 327550 - protein, 18 aa, Mycobacterium
RRSLPLAYLISIGVVIVL

SEQ ID NO: 327551 - protein, 23 aa, Mycobacterium
RRSPDRYAFWVGMVLFLGVCTVQ

SEQ ID NO: 327552 - protein, 19 aa, Mycobacterium
RRSQLWQAFQIQRKEDKRL

SEQ ID NO: 327553 - protein, 31 aa, Mycobacterium
RRSRGGGTLLNWRSPIAWLSRYRPGTHLANW

SEQ ID NO: 327554 - protein, 17 aa, Mycobacterium
RRSRLARFFDEGITATV

SEQ ID NO: 327555 - protein, 19 aa, Mycobacterium
RRSRTPALDAGRALATALR

SEQ ID NO: 327556 - protein, 30 aa, Mycobacterium
RRSRVDLRHPAVVRALRLDGVVPQPVSMEL

SEQ ID NO: 327557 - protein, 21 aa, Mycobacterium
RRSSVPVVLDIDVGHRLPESV

SEQ ID NO: 327558 - protein, 17 aa, Mycobacterium
RRSVPHLQRMLGHLETS

SEQ ID NO: 327559 - protein, 20 aa, Mycobacterium
RRTADLGARGIRINCTGPAV

SEQ ID NO: 327560 - protein, 18 aa, Mycobacterium
RRTAFFVPLLGCVAQVAL

SEQ ID NO: 327561 - protein, 17 aa, Mycobacterium
RRTAIWAVIDTVVVVYA

SEQ ID NO: 327562 - protein, 19 aa, Mycobacterium
RRTALIIALALTVEVLFLG

SEQ ID NO: 327563 - protein, 18 aa, Mycobacterium
RRTECALLGEAIYPTGPQ

SEQ ID NO: 327564 - protein, 23 aa, Mycobacterium
RRTELTVRGWQALVLTVMGVMVL

SEQ ID NO: 327565 - protein, 23 aa, Mycobacterium
RRTELVYAPVFWVFLPLAVIGFL

SEQ ID NO: 327566 - protein, 19 aa, Mycobacterium
RRTEVLVYAWLMPASTVVQ

SEQ ID NO: 327567 - protein, 23 aa, Mycobacterium
RRTFGGLVQDVHWVVDRAYRQRP

SEQ ID NO: 327568 - protein, 23 aa, Mycobacterium
RRTGKFASFAVAFAFVSIATGIF

SEQ ID NO: 327569 - protein, 23 aa, Mycobacterium
RRTGRLWPLIIAHGVINTVAYVG

SEQ ID NO: 327570 - protein, 17 aa, Mycobacterium
RRTGWRPLFAEYCVMAR

SEQ ID NO: 327571 - protein, 24 aa, Mycobacterium
RRTLPELWNLLGHIDAVHGLYYLL

SEQ ID NO: 327572 - protein, 25 aa, Mycobacterium
RRTLVFPAGMYWRTTEMFSGAPQMV

SEQ ID NO: 327573 - protein, 36 aa, Mycobacterium
RRTLWIAGALAIVIAVVAGAFGWTYLRDRSHRLTIT

SEQ ID NO: 327574 - protein, 18 aa, Mycobacterium
RRTLWPKVAGARVLHELF

SEQ ID NO: 327575 - protein, 18 aa, Mycobacterium
RRTMAWAIIDVLVVVYAL

SEQ ID NO: 327576 - protein, 25 aa, Mycobacterium
RRTQHNVYIPWSMTVTPISQSDVGS

SEQ ID NO: 327577 - protein, 24 aa, Mycobacterium
RRTRLVLAGAFALLLLAAAASAQW

SEQ ID NO: 327578 - protein, 18 aa, Mycobacterium
RRTRRPAAAVSRTAGFAF

SEQ ID NO: 327579 - protein, 20 aa, Mycobacterium
RRTRSIECVYRLSQTIDPTM

SEQ ID NO: 327580 - protein, 17 aa, Mycobacterium
RRTRWARLFEEGIGQAI

SEQ ID NO: 327581 - protein, 21 aa, Mycobacterium
RRTVDFAFEMQRIVDRFRGET

SEQ ID NO: 327582 - protein, 18 aa, Mycobacterium
RRTVIALRWAIEEREPTP

SEQ ID NO: 327583 - protein, 18 aa, Mycobacterium
RRTVIALRWAIEERPPTH

SEQ ID NO: 327584 - protein, 17 aa, Mycobacterium
RRTVLALRWAIEERAPT

SEQ ID NO: 327585 - protein, 17 aa, Mycobacterium
RRTVLALRWAIEERQPT

SEQ ID NO: 327586 - protein, 22 aa, Mycobacterium
RRTVLKSSYAQFLFLMSGADHD

SEQ ID NO: 327587 - protein, 25 aa, Mycobacterium
RRTVSRADWMWALLLTGALTVFVLL

SEQ ID NO: 327588 - protein, 17 aa, Mycobacterium
RRTVSWLVIVGTGIPFL

SEQ ID NO: 327589 - protein, 22 aa, Mycobacterium
RRVALAASFALRTVLIVVLIAN

SEQ ID NO: 327590 - protein, 20 aa, Mycobacterium
RRVALAASFVLRTVLAVVLI

SEQ ID NO: 327591 - protein, 26 aa, Mycobacterium
RRVAMELRISLAIVFGLAALAVETHV

SEQ ID NO: 327592 - protein, 25 aa, Mycobacterium
RRVAPCLPGATLLDVDGDEFTGAVK

SEQ ID NO: 327593 - protein, 19 aa, Mycobacterium
RRVEAFAMFNLFYQAGILL

SEQ ID NO: 327594 - protein, 21 aa, Mycobacterium
RRVEAFAVFNVFYQAGILFGP

SEQ ID NO: 327595 - protein, 22 aa, Mycobacterium
RRVEAFAVFNVFYQAGILFGPI

SEQ ID NO: 327596 - protein, 17 aa, Mycobacterium
RRVHPLLLLCISAMSFS

SEQ ID NO: 327597 - protein, 23 aa, Mycobacterium
RRVKGRVGFVVAERPGVGPGLPA

SEQ ID NO: 327598 - protein, 23 aa, Mycobacterium
RRVLQSAGVRRARHLRDHIIVVG

SEQ ID NO: 327599 - protein, 18 aa, Mycobacterium
RRVLTPKLRVGAAETLAI

SEQ ID NO: 327600 - protein, 24 aa, Mycobacterium
RRVPDLRGAMLLGVALGLMTLGLV

SEQ ID NO: 327601 - protein, 25 aa, Mycobacterium
RRVPDLRGASLLAIALGLLTLGLIK

SEQ ID NO: 327602 - protein, 19 aa, Mycobacterium
RRVPMLLPLGHRPRRDPAQ

SEQ ID NO: 327603 - protein, 21 aa, Mycobacterium
RRVPMVEIYDGQSLNIGNPDG

SEQ ID NO: 327604 - protein, 25 aa, Mycobacterium
RRVPRGAAVSLVLLGGFAILGGILA

SEQ ID NO: 327605 - protein, 23 aa, Mycobacterium
RRVPVWRWFVLGAGVGVAGSWIA

SEQ ID NO: 327606 - protein, 17 aa, Mycobacterium
RRVQVWFTLLIGIVGFG

SEQ ID NO: 327607 - protein, 27 aa, Mycobacterium
RRVRFEWSSAFVQFGGTVLFNLSTGAA

SEQ ID NO: 327608 - protein, 17 aa, Mycobacterium
RRVRRWFRIALACLLLI

SEQ ID NO: 327609 - protein, 17 aa, Mycobacterium
RRVSLRPILALREAADL

SEQ ID NO: 327610 - protein, 21 aa, Mycobacterium
RRVTDLGWFRALACFKSAATW

SEQ ID NO: 327611 - protein, 21 aa, Mycobacterium
RRVTLPMLMPAIFASTVLVFA

SEQ ID NO: 327612 - protein, 18 aa, Mycobacterium
RRVVMLLMLVGNVGFVAA

SEQ ID NO: 327613 - protein, 17 aa, Mycobacterium
RRVYPRALFGALITAGV

SEQ ID NO: 327614 - protein, 17 aa, Mycobacterium
RRWALAWIALAGSTVAS

SEQ ID NO: 327615 - protein, 18 aa, Mycobacterium
RRWGLAVPAVLAVCLVLV

SEQ ID NO: 327616 - protein, 18 aa, Mycobacterium
RRWIKQLATESAYGRVFA

SEQ ID NO: 327617 - protein, 24 aa, Mycobacterium
RRWREVRRAVLAFDLATLVWVAVF

SEQ ID NO: 327618 - protein, 22 aa, Mycobacterium
RRWSDALALWSRFTRLREPQLC

SEQ ID NO: 327619 - protein, 24 aa, Mycobacterium
RRWSPDGRPIVGFVGRLAPEKHAE

SEQ ID NO: 327620 - protein, 18 aa, Mycobacterium
RRWVVRAVLLGVALLAGV

SEQ ID NO: 327621 - protein, 17 aa, Mycobacterium
RRWYTVTQAIGFLSIAL

SEQ ID NO: 327622 - protein, 19 aa, Mycobacterium
RRWYVITFLMGLFFILGQA

SEQ ID NO: 327623 - protein, 19 aa, Mycobacterium
RRWYVITFLMGLFFVCGQG

SEQ ID NO: 327624 - protein, 18 aa, Mycobacterium
RRYADYLATDGFQPLNIV

SEQ ID NO: 327625 - protein, 18 aa, Mycobacterium
RRYADYLPSDGFTDLNIV

SEQ ID NO: 327626 - protein, 18 aa, Mycobacterium
RRYADYLPSDGFTTLNVI

SEQ ID NO: 327627 - protein, 18 aa, Mycobacterium
RRYADYLPTDGFQGLNIV

SEQ ID NO: 327628 - protein, 24 aa, Mycobacterium
RRYADYLPTDGFQTLNLVSTIGAF

SEQ ID NO: 327629 - protein, 19 aa, Mycobacterium
RRYADYLPTDGFQTLNVIS

SEQ ID NO: 327630 - protein, 18 aa, Mycobacterium
RRYADYLPTDGFTALNIV

SEQ ID NO: 327631 - protein, 20 aa, Mycobacterium
RRYADYLPTDGFTFLNSFST

SEQ ID NO: 327632 - protein, 18 aa, Mycobacterium
RRYADYLPTDGFTTLNGI

SEQ ID NO: 327633 - protein, 20 aa, Mycobacterium
RRYDEVMAWFARQHIAVKAL

SEQ ID NO: 327634 - protein, 20 aa, Mycobacterium
RRYTAEFLQAASLQPDNVVS

SEQ ID NO: 327635 - protein, 17 aa, Mycobacterium
RSAARSLMLGGIATAVA

SEQ ID NO: 327636 - protein, 23 aa, Mycobacterium
RSADGWRGVSIGVIVALVAVVVV

SEQ ID NO: 327637 - protein, 19 aa, Mycobacterium
RSADPFLRMITATAGLWMI

SEQ ID NO: 327638 - protein, 19 aa, Mycobacterium
RSAEAVARFLSWVYATNPP

SEQ ID NO: 327639 - protein, 17 aa, Mycobacterium
RSAEFSWQESVDGMRSV

SEQ ID NO: 327640 - protein, 26 aa, Mycobacterium
RSAELARGLIALGIGKAAHVGLLYPN

SEQ ID NO: 327641 - protein, 18 aa, Mycobacterium
RSAELARGLIAVGAGKGT

SEQ ID NO: 327642 - protein, 17 aa, Mycobacterium
RSAEVPDALYLQYTSGS

SEQ ID NO: 327643 - protein, 17 aa, Mycobacterium
RSAEVVVYGLAFFFGAF

SEQ ID NO: 327644 - protein, 18 aa, Mycobacterium
RSAEVVVYGLAFFFGAFF

SEQ ID NO: 327645 - protein, 17 aa, Mycobacterium
RSAFYAGYDESDREYVQ

SEQ ID NO: 327646 - protein, 20 aa, Mycobacterium
RSAGFAYPFLAYHVAGRGHQ

SEQ ID NO: 327647 - protein, 24 aa, Mycobacterium
RSAGLPCAIGILATMVAALTLTPA

SEQ ID NO: 327648 - protein, 23 aa, Mycobacterium
RSAGLPCAIGILTGMVASLTLLP

SEQ ID NO: 327649 - protein, 19 aa, Mycobacterium
RSAGSALRALLSLGAKDVA

SEQ ID NO: 327650 - protein, 17 aa, Mycobacterium
RSAGVPFGPHAGGPEEI

SEQ ID NO: 327651 - protein, 20 aa, Mycobacterium
RSAMRAWVAQAVTWHDPTVL

SEQ ID NO: 327652 - protein, 20 aa, Mycobacterium
RSAPALAAYAAFHCWTFPLF

SEQ ID NO: 327653 - protein, 26 aa, Mycobacterium
RSAPFRRSRLALAMTALGLYAVTLNV

SEQ ID NO: 327654 - protein, 20 aa, Mycobacterium
RSAPLWVTHLAWLVTLGLAL

SEQ ID NO: 327655 - protein, 17 aa, Mycobacterium
RSAPPARRTFSSGQRAL

SEQ ID NO: 327656 - protein, 19 aa, Mycobacterium
RSAPVLAAYATLHCWTLPI

SEQ ID NO: 327657 - protein, 17 aa, Mycobacterium
RSARERRTRQAVEVASR

SEQ ID NO: 327658 - protein, 20 aa, Mycobacterium
RSARHRPWMPAAGNHENELG

SEQ ID NO: 327659 - protein, 20 aa, Mycobacterium
RSARLMWRICKIDGEPSRYR

SEQ ID NO: 327660 - protein, 27 aa, Mycobacterium
RSARNRMAFLAGVLFILAMCFASTNGW

SEQ ID NO: 327661 - protein, 17 aa, Mycobacterium
RSARPEVEFVLNDCGAR

SEQ ID NO: 327662 - protein, 24 aa, Mycobacterium
RSARSRAWVKVGYVLFVLAGIYAV

SEQ ID NO: 327663 - protein, 24 aa, Mycobacterium
RSARSRAWVKVGYVLFVLGGVYAV

SEQ ID NO: 327664 - protein, 18 aa, Mycobacterium
RSARVRALLDVRRRLVQE

SEQ ID NO: 327665 - protein, 18 aa, Mycobacterium
RSASLGIVVAVLILAGAV

SEQ ID NO: 327666 - protein, 18 aa, Mycobacterium
RSASRIAERFAEGHLSER

SEQ ID NO: 327667 - protein, 22 aa, Mycobacterium
RSASRIAERFAEGHLSERMPVR

SEQ ID NO: 327668 - protein, 17 aa, Mycobacterium
RSATAGKIGSRRFPIDV

SEQ ID NO: 327669 - protein, 25 aa, Mycobacterium
RSATRLRDRLGYVFGPPGWQPRVAA

SEQ ID NO: 327670 - protein, 33 aa, Mycobacterium
RSATWSAPVVIQFCLLLLLAAMWLLGKWAFPTE

SEQ ID NO: 327671 - protein, 17 aa, Mycobacterium
RSAVDAIRLSRRTLSTI

SEQ ID NO: 327672 - protein, 20 aa, Mycobacterium
RSAVFPRWLAVATPWTAIPL

SEQ ID NO: 327673 - protein, 25 aa, Mycobacterium
RSDAHLPFRSGRSFSASVSDTELSI

SEQ ID NO: 327674 - protein, 19 aa, Mycobacterium
RSDLGAAITDGRLVAAGGM

SEQ ID NO: 327675 - protein, 21 aa, Mycobacterium
RSDPRAPAYIYFTSGSTGRPK

SEQ ID NO: 327676 - protein, 20 aa, Mycobacterium
RSEALLANMLPVSVADRLKE

SEQ ID NO: 327677 - protein, 18 aa, Mycobacterium
RSELARKGIARGKSVVAL

SEQ ID NO: 327678 - protein, 18 aa, Mycobacterium
RSELLRVIAQMGFGAGTL

SEQ ID NO: 327679 - protein, 23 aa, Mycobacterium
RSFAEGAGWLAQIGVFVILGLLV

SEQ ID NO: 327680 - protein, 23 aa, Mycobacterium
RSFAEGLGWLAQIGLFVLLGLLV

SEQ ID NO: 327681 - protein, 19 aa, Mycobacterium
RSFALYWHAVCGIPLMVPQ

SEQ ID NO: 327682 - protein, 28 aa, Mycobacterium
RSFKLIRNGFWRVLGIRTLTFLVASIVA

SEQ ID NO: 327683 - protein, 19 aa, Mycobacterium
RSFKVPGYPVTPVLSIIAC

SEQ ID NO: 327684 - protein, 19 aa, Mycobacterium
RSFLTALFRNVAALDSGAR

SEQ ID NO: 327685 - protein, 25 aa, Mycobacterium
RSFMPDLPLPYAFPASPDSGESDVA

SEQ ID NO: 327686 - protein, 17 aa, Mycobacterium
RSFNGAAIFVSIAALLV

SEQ ID NO: 327687 - protein, 21 aa, Mycobacterium
RSFPPLTVWTGLSLLGVAIAE

SEQ ID NO: 327688 - protein, 26 aa, Mycobacterium
RSFVDLRWWPLALLIGLTLALVTLAA

SEQ ID NO: 327689 - protein, 27 aa, Mycobacterium
RSFVLVRNGFWRVLGIRVLTLLVTSVV

SEQ ID NO: 327690 - protein, 25 aa, Mycobacterium
RSGARWISWPSYAVVEFIRSTPIPI

SEQ ID NO: 327691 - protein, 17 aa, Mycobacterium
RSGEAGHGLGLAIVNSI

SEQ ID NO: 327692 - protein, 23 aa, Mycobacterium
RSGGAARAMFDPVLSRLKELGCM

SEQ ID NO: 327693 - protein, 17 aa, Mycobacterium
RSGGALRQLWGKLKLRD

SEQ ID NO: 327694 - protein, 17 aa, Mycobacterium
RSGGALRQLWWKLRLRG

SEQ ID NO: 327695 - protein, 19 aa, Mycobacterium
RSGIAGRAGVALAVGVVVG

SEQ ID NO: 327696 - protein, 20 aa, Mycobacterium
RSGLLPDLIPIGLLAGLSAV

SEQ ID NO: 327697 - protein, 20 aa, Mycobacterium
RSGPAAGHRSDPNWTPPEES

SEQ ID NO: 327698 - protein, 18 aa, Mycobacterium
RSGQIVLVPGEIPKVTDK

SEQ ID NO: 327699 - protein, 18 aa, Mycobacterium
RSGVDHGNYYFMLELPPD

SEQ ID NO: 327700 - protein, 19 aa, Mycobacterium
RSGVGGVIRKAKELVISTK

SEQ ID NO: 327701 - protein, 17 aa, Mycobacterium
RSGWKLVGVGIDPGSTV

SEQ ID NO: 327702 - protein, 26 aa, Mycobacterium
RSIAKRSRKLFVAQWTNTGRLNAHIE

SEQ ID NO: 327703 - protein, 22 aa, Mycobacterium
RSIDLSRTVGWFTTKYPVSLDL

SEQ ID NO: 327704 - protein, 34 aa, Mycobacterium
RSILPIIIACAICITIIMSLTYRSLFTASMPLLV

SEQ ID NO: 327705 - protein, 19 aa, Mycobacterium
RSIPISAPWAANRAADLDG

SEQ ID NO: 327706 - protein, 20 aa, Mycobacterium
RSKAAGFVIAVIYKYLDDQG

SEQ ID NO: 327707 - protein, 23 aa, Mycobacterium
RSKDFWLPAMFALTVLYFTVVGF

SEQ ID NO: 327708 - protein, 19 aa, Mycobacterium
RSKGAYGRDAINFRGFGNG

SEQ ID NO: 327709 - protein, 19 aa, Mycobacterium
RSKLTPDYDFGCKRPTFSN

SEQ ID NO: 327710 - protein, 20 aa, Mycobacterium
RSKMTGDFLTYYGKFTSDVV

SEQ ID NO: 327711 - protein, 20 aa, Mycobacterium
RSKPVWYTVSGVLLLLTVGG

SEQ ID NO: 327712 - protein, 19 aa, Mycobacterium
RSLAAMFAVLALVLTGGAW

SEQ ID NO: 327713 - protein, 19 aa, Mycobacterium
RSLAAQFLVFQLFVVAVVL

SEQ ID NO: 327714 - protein, 22 aa, Mycobacterium
RSLAELWPFASGTLSRPDGAND

SEQ ID NO: 327715 - protein, 20 aa, Mycobacterium
RSLAELWPFTSGTLTRPCGP

SEQ ID NO: 327716 - protein, 23 aa, Mycobacterium
RSLAELWPYASGTLCRPEGDNAT

SEQ ID NO: 327717 - protein, 24 aa, Mycobacterium
RSLAELWPYASGTLRRPDGDNETM

SEQ ID NO: 327718 - protein, 19 aa, Mycobacterium
RSLAGQAIALQVIVVAVVV

SEQ ID NO: 327719 - protein, 17 aa, Mycobacterium
RSLARAVVHAANLGAGV

SEQ ID NO: 327720 - protein, 18 aa, Mycobacterium
RSLARAVVHAANLGAGVI

SEQ ID NO: 327721 - protein, 17 aa, Mycobacterium
RSLDRGFVWVGLHEPDE

SEQ ID NO: 327722 - protein, 17 aa, Mycobacterium
RSLGWLRRVHTGSINDY

SEQ ID NO: 327723 - protein, 19 aa, Mycobacterium
RSLIGYVLLLLVVVSVLAL

SEQ ID NO: 327724 - protein, 29 aa, Mycobacterium
RSLIVRRWRLIGKCLRPLPNKWKGLTDPE

SEQ ID NO: 327725 - protein, 17 aa, Mycobacterium
RSLLARRISVEAMIEFG

SEQ ID NO: 327726 - protein, 17 aa, Mycobacterium
RSLLIFVVVVVILVTVL

SEQ ID NO: 327727 - protein, 24 aa, Mycobacterium
RSLLVERWRLIGKCLRPLPDKWKG

SEQ ID NO: 327728 - protein, 21 aa, Mycobacterium
RSLPEGMTYGLLRYLNSDVDL

SEQ ID NO: 327729 - protein, 26 aa, Mycobacterium
RSLQARATRRALLLTALGGLLIAGLV

SEQ ID NO: 327730 - protein, 20 aa, Mycobacterium
RSLRARMAIVVDTAADTVRA

SEQ ID NO: 327731 - protein, 18 aa, Mycobacterium
RSLSTVSLVFCWIAVTAW

SEQ ID NO: 327732 - protein, 18 aa, Mycobacterium
RSLVRPAVLIPALLAILL

SEQ ID NO: 327733 - protein, 25 aa, Mycobacterium
RSLVRSGMDLGPWLVSRDVTVVSTV

SEQ ID NO: 327734 - protein, 25 aa, Mycobacterium
RSLVRSGMDLGPWLVTRDVTVVSTV

SEQ ID NO: 327735 - protein, 19 aa, Mycobacterium
RSMAGWKMTAARRAASRIV

SEQ ID NO: 327736 - protein, 18 aa, Mycobacterium
RSMALVLLVTFVVIIVLL

SEQ ID NO: 327737 - protein, 26 aa, Mycobacterium
RSNFDPARPIAVNVIDFGDDSDRETW

SEQ ID NO: 327738 - protein, 20 aa, Mycobacterium
RSNGKVFALWGATAVLLSVA

SEQ ID NO: 327739 - protein, 22 aa, Mycobacterium
RSNHAPLPWWILAALVVVVVAL

SEQ ID NO: 327740 - protein, 22 aa, Mycobacterium
RSNNRWPSWCSRSVICLPRDGC

SEQ ID NO: 327741 - protein, 19 aa, Mycobacterium
RSNPVLRQQIQAVVRRAAQ

SEQ ID NO: 327742 - protein, 18 aa, Mycobacterium
RSPADAMVPDIRFDQTSQ

SEQ ID NO: 327743 - protein, 27 aa, Mycobacterium
RSPAEPAHPRWWFVSTTPGRILTIGIV

SEQ ID NO: 327744 - protein, 19 aa, Mycobacterium
RSPEYLWPARSRQDILPDP

SEQ ID NO: 327745 - protein, 21 aa, Mycobacterium
RSPFRAVANGVRRGWSGMPVA

SEQ ID NO: 327746 - protein, 18 aa, Mycobacterium
RSPFWPLAIGIIGVVVLV

SEQ ID NO: 327747 - protein, 23 aa, Mycobacterium
RSPGARAALIGAVALLAAAIGYV

SEQ ID NO: 327748 - protein, 24 aa, Mycobacterium
RSPISARHKIVFAVVAVIGAAAWA

SEQ ID NO: 327749 - protein, 20 aa, Mycobacterium
RSPITIALPLLVAGAGLGVG

SEQ ID NO: 327750 - protein, 27 aa, Mycobacterium
RSPKRLEAVGATGGWMIVGLGAGVAVS

SEQ ID NO: 327751 - protein, 19 aa, Mycobacterium
RSPLAWTVTVFFGSQAFLA

SEQ ID NO: 327752 - protein, 22 aa, Mycobacterium
RSPLELWICALAPVVNLFMAPV

SEQ ID NO: 327753 - protein, 21 aa, Mycobacterium
RSPRFRAAMYVAVSNYFCVGG

SEQ ID NO: 327754 - protein, 24 aa, Mycobacterium
RSPRLAALPLWTWLLTVAVISMGG

SEQ ID NO: 327755 - protein, 25 aa, Mycobacterium
RSPSRPWWRRKAVAISAAALLVVAA

SEQ ID NO: 327756 - protein, 17 aa, Mycobacterium
RSPTALADLELMVSRVS

SEQ ID NO: 327757 - protein, 28 aa, Mycobacterium
RSPTTPAHPRWWFLWTTPGRILTIGLVL

SEQ ID NO: 327758 - protein, 17 aa, Mycobacterium
RSPWASAIGNTLTSVGL

SEQ ID NO: 327759 - protein, 28 aa, Mycobacterium
RSPWLRTGDLGFEWDGGFYIVGRSKDLI

SEQ ID NO: 327760 - protein, 23 aa, Mycobacterium
RSQAVLYSSMLVQAYQAANVHVQ

SEQ ID NO: 327761 - protein, 25 aa, Mycobacterium
RSQDARLGLDVVVFGGEALEPARLS

SEQ ID NO: 327762 - protein, 21 aa, Mycobacterium
RSQLTPSRILAGISTTVAVVA

SEQ ID NO: 327763 - protein, 20 aa, Mycobacterium
RSQMAAGWLRHLAGDRIEVR

SEQ ID NO: 327764 - protein, 17 aa, Mycobacterium
RSQRIWLSAAVLVHVAI

SEQ ID NO: 327765 - protein, 20 aa, Mycobacterium
RSQSGYAMRVGLRKSGGAWT

SEQ ID NO: 327766 - protein, 37 aa, Mycobacterium
RSQSQAALGRHARYVGRVGALAVALGIGLALGSAAVA

SEQ ID NO: 327767 - protein, 18 aa, Mycobacterium
RSRAHYVYVGFEVVKVVA

SEQ ID NO: 327768 - protein, 28 aa, Mycobacterium
RSRAIGSVRGLVGWLERLLAASGRVPDA

SEQ ID NO: 327769 - protein, 19 aa, Mycobacterium
RSRGVWILLALALLYVAFF

SEQ ID NO: 327770 - protein, 18 aa, Mycobacterium
RSRKGGSTGLGLAIVSAV

SEQ ID NO: 327771 - protein, 17 aa, Mycobacterium
RSRPFISLIIAFALASC

SEQ ID NO: 327772 - protein, 19 aa, Mycobacterium
RSRPRLAFMPFGSGRHHCL

SEQ ID NO: 327773 - protein, 27 aa, Mycobacterium
RSRPVVEFAETLFMFALSITGLTIAIV

SEQ ID NO: 327774 - protein, 18 aa, Mycobacterium
RSRRVVLVSHCLLNENTR

SEQ ID NO: 327775 - protein, 17 aa, Mycobacterium
RSRSLCAAVTLGVALTA

SEQ ID NO: 327776 - protein, 25 aa, Mycobacterium
RSRTLRNAILLAMAVTFGLTIVLLA

SEQ ID NO: 327777 - protein, 26 aa, Mycobacterium
RSRTQRNVYIPWSLTVTPISQSEVGS

SEQ ID NO: 327778 - protein, 23 aa, Mycobacterium
RSRTRWEGFSFRWYWGDPVKSVW

SEQ ID NO: 327779 - protein, 38 aa, Mycobacterium
RSRWLRPVLICVLVAVLAIGAYLVWPSRTGQKVTAYFT

SEQ ID NO: 327780 - protein, 30 aa, Mycobacterium
RSSAMPSRHTWTKGMLPGLMSVPLTIAGQI

SEQ ID NO: 327781 - protein, 22 aa, Mycobacterium
RSSASLHAWAGVAMVLGPLLTG

SEQ ID NO: 327782 - protein, 18 aa, Mycobacterium
RSSCTPTGCLAAATMLDD

SEQ ID NO: 327783 - protein, 27 aa, Mycobacterium
RSSHPLMSPKLFADRNFGVANAVTLLI

SEQ ID NO: 327784 - protein, 19 aa, Mycobacterium
RSSLVSGLMPATFTIAEDN

SEQ ID NO: 327785 - protein, 17 aa, Mycobacterium
RSSPESVDRMLIGLCAV

SEQ ID NO: 327786 - protein, 26 aa, Mycobacterium
RSSSGNRLFWILAAVFVVVILGVVGG

SEQ ID NO: 327787 - protein, 24 aa, Mycobacterium
RSSSRWPGALGWGTNRLLVPAVLI

SEQ ID NO: 327788 - protein, 24 aa, Mycobacterium
RSSSRWPGSLGWFTNRLLVPAVLI

SEQ ID NO: 327789 - protein, 25 aa, Mycobacterium
RSSVAVPMFHGFGLGMLMLTFALGG

SEQ ID NO: 327790 - protein, 17 aa, Mycobacterium
RSSWWSRLHSTLTPPEW

SEQ ID NO: 327791 - protein, 19 aa, Mycobacterium
RSTKFPAMIIGERDIGSDS

SEQ ID NO: 327792 - protein, 18 aa, Mycobacterium
RSTMALSIIVANVVAWTV

SEQ ID NO: 327793 - protein, 26 aa, Mycobacterium
RSTMATLRISFLSALVLELLATLGVA

SEQ ID NO: 327794 - protein, 18 aa, Mycobacterium
RSTPDALRKFNPRTLWRN

SEQ ID NO: 327795 - protein, 18 aa, Mycobacterium
RSTPVIRRAVLTLYPHCA

SEQ ID NO: 327796 - protein, 19 aa, Mycobacterium
RSTWDVPTLALLGVGNGAQ

SEQ ID NO: 327797 - protein, 23 aa, Mycobacterium
RSVARRHPWLLAFVGLALGYAEA

SEQ ID NO: 327798 - protein, 26 aa, Mycobacterium
RSVDALEWLALIAMAPLACWICGLYG

SEQ ID NO: 327799 - protein, 26 aa, Mycobacterium
RSVDNWVRRLLALPAFPDGSADRLMQ

SEQ ID NO: 327800 - protein, 26 aa, Mycobacterium
RSVDNWVRRMLALPVFPARSSDHRMQ

SEQ ID NO: 327801 - protein, 21 aa, Mycobacterium
RSVDVAFWFWVVSAAALFLNG

SEQ ID NO: 327802 - protein, 22 aa, Mycobacterium
RSVFWASSLGMYVPTVWLAAVG

SEQ ID NO: 327803 - protein, 24 aa, Mycobacterium
RSVGIICRNHRGFAESMLAGAQLG

SEQ ID NO: 327804 - protein, 20 aa, Mycobacterium
RSVGLGIVIAVLILLGAGLL

SEQ ID NO: 327805 - protein, 18 aa, Mycobacterium
RSVGPLGLAGRQGSHRVP

SEQ ID NO: 327806 - protein, 24 aa, Mycobacterium
RSVGPRPLVRALLHQPRHATAPDP

SEQ ID NO: 327807 - protein, 25 aa, Mycobacterium
RSVGPRPLVRALLYHPQRGVPSDAQ

SEQ ID NO: 327808 - protein, 19 aa, Mycobacterium
RSVIELASTFGIATVAEGV

SEQ ID NO: 327809 - protein, 20 aa, Mycobacterium
RSVLEKPPGFPLQYAPPPGL

SEQ ID NO: 327810 - protein, 20 aa, Mycobacterium
RSVLEPWLTFLRTLPPLAYF

SEQ ID NO: 327811 - protein, 22 aa, Mycobacterium
RSVLPVAAAFLVWDELAVAARV

SEQ ID NO: 327812 - protein, 18 aa, Mycobacterium
RSVLRAEVAEIRRSDPDL

SEQ ID NO: 327813 - protein, 27 aa, Mycobacterium
RSVMATLRVAFLSAMVLEMIATLSVAL

SEQ ID NO: 327814 - protein, 23 aa, Mycobacterium
RSVNPRVSRWVQWLGNAALGVAF

SEQ ID NO: 327815 - protein, 18 aa, Mycobacterium
RSVPEFMRRRFGPGAHLV

SEQ ID NO: 327816 - protein, 18 aa, Mycobacterium
RSVPFAAVVLLAAMQGVP

SEQ ID NO: 327817 - protein, 21 aa, Mycobacterium
RSVPSHGFSYGALRYLRDGTS

SEQ ID NO: 327818 - protein, 23 aa, Mycobacterium
RSVRSLPDFWRLLQVRIASQFGD

SEQ ID NO: 327819 - protein, 20 aa, Mycobacterium
RSVSTVMIMLAMVFIELAAA

SEQ ID NO: 327820 - protein, 17 aa, Mycobacterium
RSVWRKHRDVLRGGRIE

SEQ ID NO: 327821 - protein, 17 aa, Mycobacterium
RSWMLIPALAAAGLLTG

SEQ ID NO: 327822 - protein, 17 aa, Mycobacterium
RSWWTWVLLAGPGWVVF

SEQ ID NO: 327823 - protein, 22 aa, Mycobacterium
RSYDGPVLWSTVLLLIVFAQIF

SEQ ID NO: 327824 - protein, 19 aa, Mycobacterium
RSYFNGGICGDGTDVPCPD

SEQ ID NO: 327825 - protein, 20 aa, Mycobacterium
RSYLLIVCAGSFYQFASYGS

SEQ ID NO: 327826 - protein, 20 aa, Mycobacterium
RSYVPPDINSLLAATNRGLT

SEQ ID NO: 327827 - protein, 18 aa, Mycobacterium
RTAAFFDLDKTIIAKSST

SEQ ID NO: 327828 - protein, 20 aa, Mycobacterium
RTADGLPLGEPVRLSVHSNA

SEQ ID NO: 327829 - protein, 23 aa, Mycobacterium
RTADLRRKILFTIGIVVLYRVGA

SEQ ID NO: 327830 - protein, 21 aa, Mycobacterium
RTADLRRKILFTLGLVILYRV

SEQ ID NO: 327831 - protein, 20 aa, Mycobacterium
RTAEFHFVNGQWQRTPVTSQ

SEQ ID NO: 327832 - protein, 20 aa, Mycobacterium
RTAFTLAAGLLFGPALGIAI

SEQ ID NO: 327833 - protein, 20 aa, Mycobacterium
RTAFTLAAGLLFGPALGVPI

SEQ ID NO: 327834 - protein, 19 aa, Mycobacterium
RTAFTLAAGLLFGPLTGVA

SEQ ID NO: 327835 - protein, 19 aa, Mycobacterium
RTAFTLAAGLLFGTQLGVL

SEQ ID NO: 327836 - protein, 18 aa, Mycobacterium
RTANWTWALLGLAVSALT

SEQ ID NO: 327837 - protein, 19 aa, Mycobacterium
RTAPPVFAVRIILGAFAGA

SEQ ID NO: 327838 - protein, 21 aa, Mycobacterium
RTAQAWARKHHQLRAALTNLV

SEQ ID NO: 327839 - protein, 17 aa, Mycobacterium
RTARLVAIIAGLLGTLM

SEQ ID NO: 327840 - protein, 23 aa, Mycobacterium
RTASALWRPLALVVVLLAAWWAV

SEQ ID NO: 327841 - protein, 23 aa, Mycobacterium
RTASMRWYPIITFWQVAADMTNA

SEQ ID NO: 327842 - protein, 25 aa, Mycobacterium
RTATLQRLLPRLGIGSSADPQAVAI

SEQ ID NO: 327843 - protein, 25 aa, Mycobacterium
RTATLQRLLPRLGISPGTDPPAVVL

SEQ ID NO: 327844 - protein, 18 aa, Mycobacterium
RTAVFPMIKQEGGRCAEP

SEQ ID NO: 327845 - protein, 18 aa, Mycobacterium
RTAYLVMELIHGEPLNSV

SEQ ID NO: 327846 - protein, 18 aa, Mycobacterium
RTCRAGGPALALRFLALT

SEQ ID NO: 327847 - protein, 20 aa, Mycobacterium
RTCWPYCLAAVTIPWGVLLI

SEQ ID NO: 327848 - protein, 23 aa, Mycobacterium
RTDDLRPIPVFGSDELARLTEAF

SEQ ID NO: 327849 - protein, 26 aa, Mycobacterium
RTDELFLAMPRIGPWSDATTLSDLEY

SEQ ID NO: 327850 - protein, 22 aa, Mycobacterium
RTDGVVLHWVTDYWNHFCLMVQ

SEQ ID NO: 327851 - protein, 17 aa, Mycobacterium
RTDHPLIDLRLFRNPVV

SEQ ID NO: 327852 - protein, 20 aa, Mycobacterium
RTDLSMLLGLIFLLWAGPGR

SEQ ID NO: 327853 - protein, 18 aa, Mycobacterium
RTDLSYGVYIYAFPAQQL

SEQ ID NO: 327854 - protein, 17 aa, Mycobacterium
RTDLSYGVYIYAFPTQQ

SEQ ID NO: 327855 - protein, 19 aa, Mycobacterium
RTDLSYGVYIYAWPIQQLL

SEQ ID NO: 327856 - protein, 25 aa, Mycobacterium
RTDQRAAAITKRWAQWNPGLELIVL

SEQ ID NO: 327857 - protein, 24 aa, Mycobacterium
RTEFLRLLSNIAWGNGSIVVGGGT

SEQ ID NO: 327858 - protein, 18 aa, Mycobacterium
RTEIGVKVFGPVHGGVFV

SEQ ID NO: 327859 - protein, 31 aa, Mycobacterium
RTEIRRWARWESVSFWLLLLGGICVFAAPVL

SEQ ID NO: 327860 - protein, 20 aa, Mycobacterium
RTELIITLVGLFIASYHTTM

SEQ ID NO: 327861 - protein, 21 aa, Mycobacterium
RTELLIAQAMCELRRDRTSFI

SEQ ID NO: 327862 - protein, 26 aa, Mycobacterium
RTELQADCYAGIWAHYAATVNQKDGT

SEQ ID NO: 327863 - protein, 26 aa, Mycobacterium
RTELQADCYAGIWAHYASTVKQESTG

SEQ ID NO: 327864 - protein, 21 aa, Mycobacterium
RTELRDWLARKAFYGGSAAPL

SEQ ID NO: 327865 - protein, 17 aa, Mycobacterium
RTELVFAGLAGSLLLTG

SEQ ID NO: 327866 - protein, 22 aa, Mycobacterium
RTFADLLLRTEVRYRDPEQRPA

SEQ ID NO: 327867 - protein, 19 aa, Mycobacterium
RTFADMLLRTEVRTAEPVE

SEQ ID NO: 327868 - protein, 20 aa, Mycobacterium
RTFCAGWLAVYVIEFPLEIF

SEQ ID NO: 327869 - protein, 20 aa, Mycobacterium
RTFDFCFALAALILVSPLLI

SEQ ID NO: 327870 - protein, 17 aa, Mycobacterium
RTFGRPAGVEGSFLGAG

SEQ ID NO: 327871 - protein, 21 aa, Mycobacterium
RTFGSLCRPYAPGQILRSSWP

SEQ ID NO: 327872 - protein, 20 aa, Mycobacterium
RTFLEYGIASMEVFRRRRFG

SEQ ID NO: 327873 - protein, 24 aa, Mycobacterium
RTFLNSIDLLWSFVTVIAAAIAVM

SEQ ID NO: 327874 - protein, 23 aa, Mycobacterium
RTFQLRKDLVALRRVVLPMREVV

SEQ ID NO: 327875 - protein, 19 aa, Mycobacterium
RTGAELFEALTPVLTEREL

SEQ ID NO: 327876 - protein, 20 aa, Mycobacterium
RTGAFVGHCAEFCGTYHSMM

SEQ ID NO: 327877 - protein, 20 aa, Mycobacterium
RTGASGWQLFALRCAATIAV

SEQ ID NO: 327878 - protein, 23 aa, Mycobacterium
RTGERGWLAAVCGLVVGYLLSVV

SEQ ID NO: 327879 - protein, 19 aa, Mycobacterium
RTGGFSIPVVPLLIGGQAM

SEQ ID NO: 327880 - protein, 18 aa, Mycobacterium
RTGKLGVRDVLFGGQVSY

SEQ ID NO: 327881 - protein, 17 aa, Mycobacterium
RTGLALLDCSAAVVLTT

SEQ ID NO: 327882 - protein, 20 aa, Mycobacterium
RTGLFRRPAYWLSMVIVLGF

SEQ ID NO: 327883 - protein, 20 aa, Mycobacterium
RTGLPVFPASLLLGLLAVGF

SEQ ID NO: 327884 - protein, 33 aa, Mycobacterium
RTGLSAMLRGSRSRMLFGALAILLCLVLGVAIV

SEQ ID NO: 327885 - protein, 20 aa, Mycobacterium
RTGLTGWSLVALRFGVTIAL

SEQ ID NO: 327886 - protein, 19 aa, Mycobacterium
RTGPAAGHRSDPDFRREDI

SEQ ID NO: 327887 - protein, 21 aa, Mycobacterium
RTGPAAGHRSDPHWKPEDDWG

SEQ ID NO: 327888 - protein, 21 aa, Mycobacterium
RTGRLWPLIIAHGVINTVAYV

SEQ ID NO: 327889 - protein, 24 aa, Mycobacterium
RTGRLWPLIIAHTLIDAVAFVGYA

SEQ ID NO: 327890 - protein, 22 aa, Mycobacterium
RTGRLWPLVVAHGVIDTVAFVG

SEQ ID NO: 327891 - protein, 21 aa, Mycobacterium
RTGRPLPCWVTAIVDAPAARG

SEQ ID NO: 327892 - protein, 25 aa, Mycobacterium
RTGRRLGALIVDWLIAYGLAALLMT

SEQ ID NO: 327893 - protein, 20 aa, Mycobacterium
RTHSFWLPLTTAVIVRPEYA

SEQ ID NO: 327894 - protein, 23 aa, Mycobacterium
RTILHRRITRFGALPLVLPLLAA

SEQ ID NO: 327895 - protein, 17 aa, Mycobacterium
RTIPSELPYGADVVVGV

SEQ ID NO: 327896 - protein, 18 aa, Mycobacterium
RTITMPSARISSTEAAGS

SEQ ID NO: 327897 - protein, 20 aa, Mycobacterium
RTIVKFTPQQVGSFPFVCSM

SEQ ID NO: 327898 - protein, 33 aa, Mycobacterium
RTLACLAGGISVLIAWWMWEKRATRPLVSTRML

SEQ ID NO: 327899 - protein, 19 aa, Mycobacterium
RTLARLTLPTADQAPIVIP

SEQ ID NO: 327900 - protein, 25 aa, Mycobacterium
RTLATIKTNLVWAFGYNLAAIPLAA

SEQ ID NO: 327901 - protein, 17 aa, Mycobacterium
RTLDLPPLIGVTMYGAF

SEQ ID NO: 327902 - protein, 27 aa, Mycobacterium
RTLGLRPAPEFEQWLHAIGMVDDDGRL

SEQ ID NO: 327903 - protein, 19 aa, Mycobacterium
RTLITVPLFHVTGCNSQLL

SEQ ID NO: 327904 - protein, 17 aa, Mycobacterium
RTLLEFSGGPGQPNLVA

SEQ ID NO: 327905 - protein, 23 aa, Mycobacterium
RTLLERGPGAFNEASRLLDQIKP

SEQ ID NO: 327906 - protein, 18 aa, Mycobacterium
RTLLLGIVLWTSVVSLVT

SEQ ID NO: 327907 - protein, 24 aa, Mycobacterium
RTLLLKWMLVAVVSLFSSAVYLWV

SEQ ID NO: 327908 - protein, 19 aa, Mycobacterium
RTLLPAGLAAGFAEVVLIG

SEQ ID NO: 327909 - protein, 27 aa, Mycobacterium
RTLNTIKTNLFWAFGYNVAALPLAAFG

SEQ ID NO: 327910 - protein, 33 aa, Mycobacterium
RTLPPGGAPRSWLIQEFACFAYLVGVAVLFGLG

SEQ ID NO: 327911 - protein, 19 aa, Mycobacterium
RTLPPGWKPGSKAAPAPTL

SEQ ID NO: 327912 - protein, 19 aa, Mycobacterium
RTLPPGWKPGSKAVAAPTL

SEQ ID NO: 327913 - protein, 19 aa, Mycobacterium
RTLPPGWKPGSLAAPPPVL

SEQ ID NO: 327914 - protein, 19 aa, Mycobacterium
RTLPPGWKPGSRAVAAPTL

SEQ ID NO: 327915 - protein, 33 aa, Mycobacterium
RTLPTESYTPWLTRLAAFIIDILPYAVVHGIGT

SEQ ID NO: 327916 - protein, 24 aa, Mycobacterium
RTLRTDLWWWAPLVTNIGFLAFIV

SEQ ID NO: 327917 - protein, 24 aa, Mycobacterium
RTLRTIYQNLGWAFGYNTAAIPLA

SEQ ID NO: 327918 - protein, 19 aa, Mycobacterium
RTLSPFAVQRWLNPVNAAA

SEQ ID NO: 327919 - protein, 25 aa, Mycobacterium
RTLSTIKTNLFWAFVYNVAAIPVAA

SEQ ID NO: 327920 - protein, 27 aa, Mycobacterium
RTLTIIKANLFWAFGYNIAAIPLAALG

SEQ ID NO: 327921 - protein, 24 aa, Mycobacterium
RTLTVVRLLAPVLLPLLYKAAIAV

SEQ ID NO: 327922 - protein, 30 aa, Mycobacterium
RTLVIPALFALIGDRIWWPTAPQHAKAVAG

SEQ ID NO: 327923 - protein, 29 aa, Mycobacterium
RTLVIPALFALIGDRIWWPTSPANAEPVE

SEQ ID NO: 327924 - protein, 33 aa, Mycobacterium
RTLVIPALFTLIGDRIWWPTFPNIARYQPDPAY

SEQ ID NO: 327925 - protein, 17 aa, Mycobacterium
RTLWFGISGAFMVVAIL

SEQ ID NO: 327926 - protein, 26 aa, Mycobacterium
RTLYRGDPGMWSWVLHRISGATIFFF

SEQ ID NO: 327927 - protein, 18 aa, Mycobacterium
RTMCREIVRTTTPQQAQL

SEQ ID NO: 327928 - protein, 26 aa, Mycobacterium
RTMFRPAAILGCWVVLLAAVGLFFTG

SEQ ID NO: 327929 - protein, 18 aa, Mycobacterium
RTNLEVLHTLDLPPEQRK

SEQ ID NO: 327930 - protein, 32 aa, Mycobacterium
RTPAPVLRPPRTWSLRTRLILTQLLLLAVVCA

SEQ ID NO: 327931 - protein, 19 aa, Mycobacterium
RTPDAPWFDNWIVALSAAV

SEQ ID NO: 327932 - protein, 17 aa, Mycobacterium
RTPDRLRALLIDERIGV

SEQ ID NO: 327933 - protein, 29 aa, Mycobacterium
RTPEWQPWLRWVVLVGSIAVAVVFSAGAH

SEQ ID NO: 327934 - protein, 24 aa, Mycobacterium
RTPISKLFILASRFVRRETSPCSA

SEQ ID NO: 327935 - protein, 23 aa, Mycobacterium
RTPPAGKRFPLLDSNNVARELRL

SEQ ID NO: 327936 - protein, 26 aa, Mycobacterium
RTPPLPVVWWTIVASLAMAYVIDPAW

SEQ ID NO: 327937 - protein, 18 aa, Mycobacterium
RTPSRPASVTGLFAEKVS

SEQ ID NO: 327938 - protein, 25 aa, Mycobacterium
RTPTWEGVTFWVLGAIAVLGALGVI

SEQ ID NO: 327939 - protein, 18 aa, Mycobacterium
RTQFEFFGVAISNITLVI

SEQ ID NO: 327940 - protein, 28 aa, Mycobacterium
RTQHSADWRKPGVVQRVVDWSTRVRSGS

SEQ ID NO: 327941 - protein, 17 aa, Mycobacterium
RTQLTMISARSGLSLDS

SEQ ID NO: 327942 - protein, 20 aa, Mycobacterium
RTQLWTSLLSWGVILLLFAI

SEQ ID NO: 327943 - protein, 36 aa, Mycobacterium
RTQRIRGWRKIGALVVRWPGPILVVTIGIALVGLLT

SEQ ID NO: 327944 - protein, 23 aa, Mycobacterium
RTQSRAVLMGVVLLVTAVAGCFV

SEQ ID NO: 327945 - protein, 23 aa, Mycobacterium
RTQSRAVLTGALILVTGLVGCFI

SEQ ID NO: 327946 - protein, 24 aa, Mycobacterium
RTQSRSVLMGVLIFITGLVGCFVF

SEQ ID NO: 327947 - protein, 23 aa, Mycobacterium
RTQSRSVLVGALILVTGLIGCFL

SEQ ID NO: 327948 - protein, 18 aa, Mycobacterium
RTRAFGVATITPLIFAGA

SEQ ID NO: 327949 - protein, 21 aa, Mycobacterium
RTREKHLWARLVGSTFVGQLG

SEQ ID NO: 327950 - protein, 19 aa, Mycobacterium
RTRERLILAAILLTITVVY

SEQ ID NO: 327951 - protein, 43 aa, Mycobacterium
RTRGWRRIGTAIVRWPGPILTVACAVALIGLLALPGYQTSYDV

SEQ ID NO: 327952 - protein, 23 aa, Mycobacterium
RTRISTFLAGLFLLGLVVGLGDV

SEQ ID NO: 327953 - protein, 19 aa, Mycobacterium
RTRLEQLAVLAAEAHRPAA

SEQ ID NO: 327954 - protein, 19 aa, Mycobacterium
RTRLEQLAVLAAEAKRPAA

SEQ ID NO: 327955 - protein, 18 aa, Mycobacterium
RTRLEQLAVLAAETKRPV

SEQ ID NO: 327956 - protein, 20 aa, Mycobacterium
RTRLMPTWLVVLTYVVSLTV

SEQ ID NO: 327957 - protein, 18 aa, Mycobacterium
RTRMSAILHGVWILLFAS

SEQ ID NO: 327958 - protein, 18 aa, Mycobacterium
RTRPLAVEPGVAPWRQLL

SEQ ID NO: 327959 - protein, 29 aa, Mycobacterium
RTRQPRSRFRFGIQSKILITMLLSSILGV

SEQ ID NO: 327960 - protein, 24 aa, Mycobacterium
RTRRGLRALLSLAPEEATVLRDGT

SEQ ID NO: 327961 - protein, 18 aa, Mycobacterium
RTRRGLRALLSLVPDEAT

SEQ ID NO: 327962 - protein, 19 aa, Mycobacterium
RTRRGRALFLFTVGISLLV

SEQ ID NO: 327963 - protein, 19 aa, Mycobacterium
RTRRGRALFVFTIGIVLIV

SEQ ID NO: 327964 - protein, 20 aa, Mycobacterium
RTRRLTILVGNVVVGALGVV

SEQ ID NO: 327965 - protein, 17 aa, Mycobacterium
RTRRPEFGTPKLALNLR

SEQ ID NO: 327966 - protein, 25 aa, Mycobacterium
RTRSRRRAEIEAAKGIDPSDAEALA

SEQ ID NO: 327967 - protein, 21 aa, Mycobacterium
RTRTAGAWIAGHGCTRLLQGL

SEQ ID NO: 327968 - protein, 31 aa, Mycobacterium
RTRVQRIYCRMVLRCFGIRITVTGSPIRNLS

SEQ ID NO: 327969 - protein, 19 aa, Mycobacterium
RTRVWAMKALALLVTRVGG

SEQ ID NO: 327970 - protein, 23 aa, Mycobacterium
RTSARATILLGLGLLAGATGVFA

SEQ ID NO: 327971 - protein, 18 aa, Mycobacterium
RTSAYYSFEQSLLATICQ

SEQ ID NO: 327972 - protein, 19 aa, Mycobacterium
RTSFWCMNIGLAWMVFVTL

SEQ ID NO: 327973 - protein, 18 aa, Mycobacterium
RTSHIGSTLGLVVTLLDR

SEQ ID NO: 327974 - protein, 18 aa, Mycobacterium
RTSIPFLLSLQSAGQVQA

SEQ ID NO: 327975 - protein, 17 aa, Mycobacterium
RTSTLVLIVAFFAVWWV

SEQ ID NO: 327976 - protein, 18 aa, Mycobacterium
RTTLAWTRTSFAFLANGA

SEQ ID NO: 327977 - protein, 23 aa, Mycobacterium
RTTPEAFAATLGRGLAERHSVLP

SEQ ID NO: 327978 - protein, 19 aa, Mycobacterium
RTTTSFALLTGQIVGVGYT

SEQ ID NO: 327979 - protein, 24 aa, Mycobacterium
RTVAFALEMQRIIERFNHQSGHQL

SEQ ID NO: 327980 - protein, 20 aa, Mycobacterium
RTVDLRRKILFTLGIVILYR

SEQ ID NO: 327981 - protein, 17 aa, Mycobacterium
RTVDSFIGVGVQLVVVL

SEQ ID NO: 327982 - protein, 25 aa, Mycobacterium
RTVEYCMVDLFTGRFQWAEFVRQGA

SEQ ID NO: 327983 - protein, 32 aa, Mycobacterium
RTVGWAHWLVMVGFLGGFPLYFESYGQTFNPE

SEQ ID NO: 327984 - protein, 19 aa, Mycobacterium
RTVLARFAIASAVAVGAVL

SEQ ID NO: 327985 - protein, 19 aa, Mycobacterium
RTVLARRVVAGVLVVLAAV

SEQ ID NO: 327986 - protein, 22 aa, Mycobacterium
RTVLIGLDLLLLRGADLRRAER

SEQ ID NO: 327987 - protein, 20 aa, Mycobacterium
RTVLSSALLFLVAGALLGPG

SEQ ID NO: 327988 - protein, 17 aa, Mycobacterium
RTVMAGRVAAALVAVLA

SEQ ID NO: 327989 - protein, 19 aa, Mycobacterium
RTVMFSAVILVASSVPLLL

SEQ ID NO: 327990 - protein, 25 aa, Mycobacterium
RTVMQLCALLPFALPFVVLAYGIKR

SEQ ID NO: 327991 - protein, 24 aa, Mycobacterium
RTVRARAFGWLWQALAATLVAAVF

SEQ ID NO: 327992 - protein, 26 aa, Mycobacterium
RTVREAFGCAMSRGLAARHDALVLRP

SEQ ID NO: 327993 - protein, 25 aa, Mycobacterium
RTVSDAWYLNWGFFVAMGAILALGA

SEQ ID NO: 327994 - protein, 20 aa, Mycobacterium
RTVTATAWRVLIAGSVVGFL

SEQ ID NO: 327995 - protein, 45 aa, Mycobacterium
RTVTVPAIAVLVGRANWWRPSGWESAIRWPLRRRRRPAKRKPLLP

SEQ ID NO: 327996 - protein, 19 aa, Mycobacterium
RTVVLARLRLFGIGIPAAI

SEQ ID NO: 327997 - protein, 19 aa, Mycobacterium
RTVVPGALQKGWLPAVTVI

SEQ ID NO: 327998 - protein, 21 aa, Mycobacterium
RTVVSMVWWAAGAVLPLAAIV

SEQ ID NO: 327999 - protein, 18 aa, Mycobacterium
RTVVYSVTGSKQLLDLVN

SEQ ID NO: 328000 - protein, 22 aa, Mycobacterium
RTWSRIVLPQSIAMIIPVLGNY

SEQ ID NO: 328001 - protein, 19 aa, Mycobacterium
RTYLSNDVLNAWAMSVVLW

SEQ ID NO: 328002 - protein, 24 aa, Mycobacterium
RVAAAVCLFVLMLAMFPANVYAAR

SEQ ID NO: 328003 - protein, 17 aa, Mycobacterium
RVAAAWLARPVCIVTVV

SEQ ID NO: 328004 - protein, 21 aa, Mycobacterium
RVAAMLGGWLAVLAGAWFVVG

SEQ ID NO: 328005 - protein, 17 aa, Mycobacterium
RVADAFAEPFIVDGHQI

SEQ ID NO: 328006 - protein, 18 aa, Mycobacterium
RVAETPAFEQVQRENDRA

SEQ ID NO: 328007 - protein, 19 aa, Mycobacterium
RVAFFIATASLGFVFLAGW

SEQ ID NO: 328008 - protein, 38 aa, Mycobacterium
RVAFMFTALCLFASLFIMLRRKRVPGVARGPAWRLMGV

SEQ ID NO: 328009 - protein, 28 aa, Mycobacterium
RVAGLSRWWRVALLAAISTFLAAESLSR

SEQ ID NO: 328010 - protein, 36 aa, Mycobacterium
RVAIVVLMLLPLVYGALYLWAFWDPFGHTNKMPVAL

SEQ ID NO: 328011 - protein, 19 aa, Mycobacterium
RVAKGIVHMRGIERVQTIT

SEQ ID NO: 328012 - protein, 19 aa, Mycobacterium
RVALAASFALRTALALVLI

SEQ ID NO: 328013 - protein, 18 aa, Mycobacterium
RVALAGSFILRTALALLL

SEQ ID NO: 328014 - protein, 33 aa, Mycobacterium
RVALVVCTLAMLVLVGCLIYLLATTARNTRDLH

SEQ ID NO: 328015 - protein, 17 aa, Mycobacterium
RVANLFLTKTVYSALLA

SEQ ID NO: 328016 - protein, 20 aa, Mycobacterium
RVAPEHKIRLVKALQSRGHV

SEQ ID NO: 328017 - protein, 25 aa, Mycobacterium
RVAPENAFGAIFLMGVLVVSAGWSM

SEQ ID NO: 328018 - protein, 18 aa, Mycobacterium
RVAPPILTLWLVRWLLFR

SEQ ID NO: 328019 - protein, 19 aa, Mycobacterium
RVAPTWLRQVPTRLSGLLD

SEQ ID NO: 328020 - protein, 24 aa, Mycobacterium
RVAQEAPVVWAARVLAVGMRLFPV

SEQ ID NO: 328021 - protein, 18 aa, Mycobacterium
RVAQLIFLVVAAFLLTNK

SEQ ID NO: 328022 - protein, 19 aa, Mycobacterium
RVAQQKVLLFGIAFALVAR

SEQ ID NO: 328023 - protein, 17 aa, Mycobacterium
RVARFMLSDGLSNLGGP

SEQ ID NO: 328024 - protein, 32 aa, Mycobacterium
RVARRRIRRCLTRWRPILLGLLVIATTGFAAG

SEQ ID NO: 328025 - protein, 26 aa, Mycobacterium
RVATTWFPERERASVIGFYTSGQFIG

SEQ ID NO: 328026 - protein, 18 aa, Mycobacterium
RVAVSGLRVSVVMVATPV

SEQ ID NO: 328027 - protein, 27 aa, Mycobacterium
RVCDSCPRADTIVLIAALFRALVEREI

SEQ ID NO: 328028 - protein, 17 aa, Mycobacterium
RVDAAGGTFVFLDTPAG

SEQ ID NO: 328029 - protein, 19 aa, Mycobacterium
RVDATGCVYIVDRLKELIK

SEQ ID NO: 328030 - protein, 17 aa, Mycobacterium
RVDFDVDRSLELFDETT

SEQ ID NO: 328031 - protein, 30 aa, Mycobacterium
RVDLKGFWIRRARRLLPALLVMTLAVVAAR

SEQ ID NO: 328032 - protein, 23 aa, Mycobacterium
RVDLRPMLTHTFGLERWREAFLA

SEQ ID NO: 328033 - protein, 18 aa, Mycobacterium
RVDMVCFDKTGTLSENRL

SEQ ID NO: 328034 - protein, 25 aa, Mycobacterium
RVDNVQLPWAFKIVSTLPSLSGNIV

SEQ ID NO: 328035 - protein, 18 aa, Mycobacterium
RVDPLAAHNGVWTHYSGW

SEQ ID NO: 328036 - protein, 25 aa, Mycobacterium
RVDRFPLAWLLARPDRSSLVRLLAI

SEQ ID NO: 328037 - protein, 18 aa, Mycobacterium
RVDRVVADLIRFTYPQPD

SEQ ID NO: 328038 - protein, 19 aa, Mycobacterium
RVDTGLVFTPGWPMAVGIV

SEQ ID NO: 328039 - protein, 24 aa, Mycobacterium
RVEINARPGIVLVVPADTPHNLAV

SEQ ID NO: 328040 - protein, 17 aa, Mycobacterium
RVELKALQIGQGITAVM

SEQ ID NO: 328041 - protein, 26 aa, Mycobacterium
RVELLKLAVVLALWAAVAGAFVSVLY

SEQ ID NO: 328042 - protein, 19 aa, Mycobacterium
RVERTWPFGFATGLVAVGL

SEQ ID NO: 328043 - protein, 17 aa, Mycobacterium
RVEVAGVGVVLYRNEGR

SEQ ID NO: 328044 - protein, 25 aa, Mycobacterium
RVEVGLPAWIFVPATLGALFVVIPL

SEQ ID NO: 328045 - protein, 20 aa, Mycobacterium
RVFFTRTAIVLIVIAAGILA

SEQ ID NO: 328046 - protein, 25 aa, Mycobacterium
RVFHNIAFPGFYLLLSAASTVYMAQ

SEQ ID NO: 328047 - protein, 17 aa, Mycobacterium
RVFLALAAIFGLLAGPQ

SEQ ID NO: 328048 - protein, 19 aa, Mycobacterium
RVFPLQARTLVPIAGMMIG

SEQ ID NO: 328049 - protein, 17 aa, Mycobacterium
RVFSGLFAAAAVVLSLV

SEQ ID NO: 328050 - protein, 17 aa, Mycobacterium
RVFSGLFATAAVVLALV

SEQ ID NO: 328051 - protein, 17 aa, Mycobacterium
RVGDVFFGLPLLLAAIV

SEQ ID NO: 328052 - protein, 25 aa, Mycobacterium
RVGGRRWLDRPAYLVMSRIDAAGRA

SEQ ID NO: 328053 - protein, 25 aa, Mycobacterium
RVGHRLRPVVIAVIAAVVILIAAAV

SEQ ID NO: 328054 - protein, 20 aa, Mycobacterium
RVGKVFNEFDTDSAVMIVLE

SEQ ID NO: 328055 - protein, 18 aa, Mycobacterium
RVGLFSTVTMAITIAFTG

SEQ ID NO: 328056 - protein, 29 aa, Mycobacterium
RVGLKGFWIRRARRLLPALVVMVLAVVAV

SEQ ID NO: 328057 - protein, 18 aa, Mycobacterium
RVGLLMPNGVEWARTALA

SEQ ID NO: 328058 - protein, 18 aa, Mycobacterium
RVGPGASVTGWLAAVALP

SEQ ID NO: 328059 - protein, 27 aa, Mycobacterium
RVGPRRWIARIALTWGALSALMMFVQG

SEQ ID NO: 328060 - protein, 17 aa, Mycobacterium
RVGQPKTRCQAIEVAIG

SEQ ID NO: 328061 - protein, 22 aa, Mycobacterium
RVGRKPMWWFSVVGLFVAGVPM

SEQ ID NO: 328062 - protein, 24 aa, Mycobacterium
RVGRRPILLCGTAMMIGADVVLMA

SEQ ID NO: 328063 - protein, 18 aa, Mycobacterium
RVGRRPILLSGIAIMIVA

SEQ ID NO: 328064 - protein, 22 aa, Mycobacterium
RVGRRPILLSGIAMMVAADVAL

SEQ ID NO: 328065 - protein, 24 aa, Mycobacterium
RVGSGPLLRRVFVIASLITAVLSL

SEQ ID NO: 328066 - protein, 21 aa, Mycobacterium
RVGSGTLLRRVFAIASGITAV

SEQ ID NO: 328067 - protein, 26 aa, Mycobacterium
RVGSRFGPYHLVRLIGRGGMGEVYEA

SEQ ID NO: 328068 - protein, 19 aa, Mycobacterium
RVGTEAAEFLGRELSLAVV

SEQ ID NO: 328069 - protein, 19 aa, Mycobacterium
RVGTQFGPYRLRRLLGRGG

SEQ ID NO: 328070 - protein, 25 aa, Mycobacterium
RVGTRFGPYYLKRQLGTGGMGEVYE

SEQ ID NO: 328071 - protein, 19 aa, Mycobacterium
RVGVASVIAEGFLVLPFTR

SEQ ID NO: 328072 - protein, 18 aa, Mycobacterium
RVGVKVGPVGLTLAGTAT

SEQ ID NO: 328073 - protein, 19 aa, Mycobacterium
RVGVPAAARPPFWRGAPGL

SEQ ID NO: 328074 - protein, 18 aa, Mycobacterium
RVHAASLAGRFLVFQLLV

SEQ ID NO: 328075 - protein, 25 aa, Mycobacterium
RVHPGPQPPPTRMGPYLAPDPAPPR

SEQ ID NO: 328076 - protein, 18 aa, Mycobacterium
RVHVVIDDAMSWLRGPGR

SEQ ID NO: 328077 - protein, 29 aa, Mycobacterium
RVIAAFRPGWFGYSLLTPIGWAGVVGVAF

SEQ ID NO: 328078 - protein, 23 aa, Mycobacterium
RVIAGFMLATAFLSMWVSNTATA

SEQ ID NO: 328079 - protein, 21 aa, Mycobacterium
RVIAKFERWTVPPTVAVLVAM

SEQ ID NO: 328080 - protein, 26 aa, Mycobacterium
RVIDSCDPTRHWAEIGVDVENAVATA

SEQ ID NO: 328081 - protein, 18 aa, Mycobacterium
RVIHCRTQYLGPEELLVA

SEQ ID NO: 328082 - protein, 31 aa, Mycobacterium
RVIIGVGALIWAGSLLWYLTCVGTTPNFLGE

SEQ ID NO: 328083 - protein, 22 aa, Mycobacterium
RVIKQNLWASLGIVAVLIPATI

SEQ ID NO: 328084 - protein, 22 aa, Mycobacterium
RVIKQNLWASLGIVAVLIPATV

SEQ ID NO: 328085 - protein, 23 aa, Mycobacterium
RVIKQNLWASLGIVAVLIPATVF

SEQ ID NO: 328086 - protein, 20 aa, Mycobacterium
RVILPALLPALLSGAGLAFS

SEQ ID NO: 328087 - protein, 30 aa, Mycobacterium
RVIRLRLAPWDVICTVALLVALVVLATATA

SEQ ID NO: 328088 - protein, 25 aa, Mycobacterium
RVITRRLAIALVVLFGAAVIVYLDR

SEQ ID NO: 328089 - protein, 18 aa, Mycobacterium
RVKPLGLAIVNFALAFSA

SEQ ID NO: 328090 - protein, 25 aa, Mycobacterium
RVKPPRLYTAAAWVVIVAGIVFILS

SEQ ID NO: 328091 - protein, 24 aa, Mycobacterium
RVLAEFPPMIAIMKTMHGSLLTMH

SEQ ID NO: 328092 - protein, 19 aa, Mycobacterium
RVLAIPIVLFWVGVAVLLS

SEQ ID NO: 328093 - protein, 18 aa, Mycobacterium
RVLAMSGAAAAGWFLVEG

SEQ ID NO: 328094 - protein, 20 aa, Mycobacterium
RVLAPLGGAALLIGVAGSVA

SEQ ID NO: 328095 - protein, 23 aa, Mycobacterium
RVLAPRVGLGFQVLEQHRQFRRE

SEQ ID NO: 328096 - protein, 24 aa, Mycobacterium
RVLARYGYTFGIVGCVLLAIPALL

SEQ ID NO: 328097 - protein, 22 aa, Mycobacterium
RVLCAITHGLLWSVIAPIATRL

SEQ ID NO: 328098 - protein, 17 aa, Mycobacterium
RVLDAFHAPILVDGVPI

SEQ ID NO: 328099 - protein, 29 aa, Mycobacterium
RVLDHPLRWLSLRSIVILSQLGVTILVLT

SEQ ID NO: 328100 - protein, 17 aa, Mycobacterium
RVLFTVLTAIPFVLTLV

SEQ ID NO: 328101 - protein, 20 aa, Mycobacterium
RVLGPMERLLILSLGLGGQV

SEQ ID NO: 328102 - protein, 18 aa, Mycobacterium
RVLGRKVSIGGLIELAVW

SEQ ID NO: 328103 - protein, 19 aa, Mycobacterium
RVLIAFALVAVLLLLLGPR

SEQ ID NO: 328104 - protein, 18 aa, Mycobacterium
RVLIPAILMVILLVLYAL

SEQ ID NO: 328105 - protein, 19 aa, Mycobacterium
RVLLGSGLAIFITNVIVFG

SEQ ID NO: 328106 - protein, 22 aa, Mycobacterium
RVLLGSLMRPHTSTLLLLLLLA

SEQ ID NO: 328107 - protein, 30 aa, Mycobacterium
RVLLICGFAIGAAAVFAWLLAAFAVRPFKQ

SEQ ID NO: 328108 - protein, 20 aa, Mycobacterium
RVLLIPAILAVILVVLYALL

SEQ ID NO: 328109 - protein, 27 aa, Mycobacterium
RVLLTPVFCMLLPISVVPLAAPDSAAF

SEQ ID NO: 328110 - protein, 17 aa, Mycobacterium
RVLPALVNQFIALLKAS

SEQ ID NO: 328111 - protein, 19 aa, Mycobacterium
RVLPVVLVVAMVGMMVVYF

SEQ ID NO: 328112 - protein, 25 aa, Mycobacterium
RVLQGFALGGEWGGAVLLAVEHSPD

SEQ ID NO: 328113 - protein, 19 aa, Mycobacterium
RVLQGSVLVFLLGSMLCGA

SEQ ID NO: 328114 - protein, 22 aa, Mycobacterium
RVLQIRALVLGGAMDWLQDNEA

SEQ ID NO: 328115 - protein, 20 aa, Mycobacterium
RVLRDGGIMLLARVAGLLLA

SEQ ID NO: 328116 - protein, 24 aa, Mycobacterium
RVLTAMACILGFLLAGVAYLAHVT

SEQ ID NO: 328117 - protein, 25 aa, Mycobacterium
RVLTCWLPVFLGWPIMRWLTKNEMI

SEQ ID NO: 328118 - protein, 33 aa, Mycobacterium
RVLTIGGGILLFWAMLYGWAFMHRGVAYFPNLV

SEQ ID NO: 328119 - protein, 24 aa, Mycobacterium
RVLTTMACILGFLLAGVAYLAYAT

SEQ ID NO: 328120 - protein, 26 aa, Mycobacterium
RVLVAPPFFHGFGLAALLGPLALGGT

SEQ ID NO: 328121 - protein, 19 aa, Mycobacterium
RVLYPVCLALWSLATLFMG

SEQ ID NO: 328122 - protein, 18 aa, Mycobacterium
RVMAALVGADFDPVTLSE

SEQ ID NO: 328123 - protein, 18 aa, Mycobacterium
RVMGPGLLLLFVVGDILG

SEQ ID NO: 328124 - protein, 18 aa, Mycobacterium
RVMLLTFFGKRRWHRDVH

SEQ ID NO: 328125 - protein, 17 aa, Mycobacterium
RVMVEGIAIIAGIEHLT

SEQ ID NO: 328126 - protein, 18 aa, Mycobacterium
RVNDAVLMAIRIAEELHD

SEQ ID NO: 328127 - protein, 27 aa, Mycobacterium
RVNFVLRYFPLPGHFNAERAARAVEAA

SEQ ID NO: 328128 - protein, 17 aa, Mycobacterium
RVNGEIVLLLFLPAILY

SEQ ID NO: 328129 - protein, 17 aa, Mycobacterium
RVNSRLTTFGLLGGTMI

SEQ ID NO: 328130 - protein, 17 aa, Mycobacterium
RVNSRLTTFGLLGGTVA

SEQ ID NO: 328131 - protein, 18 aa, Mycobacterium
RVNVSFTPSYTYTRADCP

SEQ ID NO: 328132 - protein, 23 aa, Mycobacterium
RVPACRDARRRVLYIGENAVISA

SEQ ID NO: 328133 - protein, 20 aa, Mycobacterium
RVPAEIACRLLHAPMSDAHS

SEQ ID NO: 328134 - protein, 20 aa, Mycobacterium
RVPALKALFPDYRGSALEAF

SEQ ID NO: 328135 - protein, 17 aa, Mycobacterium
RVPALNALFPNYRGSVF

SEQ ID NO: 328136 - protein, 19 aa, Mycobacterium
RVPEAPGLQGLPGIQAAPG

SEQ ID NO: 328137 - protein, 17 aa, Mycobacterium
RVPERDPRTEVGRLSSA

SEQ ID NO: 328138 - protein, 17 aa, Mycobacterium
RVPGVARGPAWRVLGVV

SEQ ID NO: 328139 - protein, 29 aa, Mycobacterium
RVPHLPRRKRFWLSLYVPVIMRVACSAIV

SEQ ID NO: 328140 - protein, 18 aa, Mycobacterium
RVPIAIRIVADRETREAT

SEQ ID NO: 328141 - protein, 20 aa, Mycobacterium
RVPLDGVPLVMGRESGALYV

SEQ ID NO: 328142 - protein, 31 aa, Mycobacterium
RVPLRATSSLSLRWRVMLLAMSMVAMVVVLM

SEQ ID NO: 328143 - protein, 17 aa, Mycobacterium
RVPRSFDDVIARGMAKH

SEQ ID NO: 328144 - protein, 17 aa, Mycobacterium
RVPWTAGTKRKPVDVAL

SEQ ID NO: 328145 - protein, 22 aa, Mycobacterium
RVQDPTLCWSWQRSAGDQAPTT

SEQ ID NO: 328146 - protein, 22 aa, Mycobacterium
RVQRVRRLGARVVLVDLNAPST

SEQ ID NO: 328147 - protein, 25 aa, Mycobacterium
RVQRYRGKPVLTWWQGRKQSGHGLG

SEQ ID NO: 328148 - protein, 21 aa, Mycobacterium
RVRAKLLARYGAVQGARQGDA

SEQ ID NO: 328149 - protein, 19 aa, Mycobacterium
RVREAYVLQYAEIFTITAV

SEQ ID NO: 328150 - protein, 22 aa, Mycobacterium
RVRGGLMGIILLVVVIGVGQSF

SEQ ID NO: 328151 - protein, 24 aa, Mycobacterium
RVRGKGAGFAASFAKVAAVMTAFL

SEQ ID NO: 328152 - protein, 18 aa, Mycobacterium
RVRHPDVVCIERLEHFIR

SEQ ID NO: 328153 - protein, 19 aa, Mycobacterium
RVRIAFDLVTLMMAAVSAT

SEQ ID NO: 328154 - protein, 20 aa, Mycobacterium
RVRIGLMGIVVTVLVIGVGQ

SEQ ID NO: 328155 - protein, 30 aa, Mycobacterium
RVRKYLTLMAFRIPALILAAVAYGAWHNGL

SEQ ID NO: 328156 - protein, 31 aa, Mycobacterium
RVRKYLTLMAFRIPALILAAVAYNIWENGLI

SEQ ID NO: 328157 - protein, 30 aa, Mycobacterium
RVRKYLTLMSFRVPALILAAVAYGIWENGL

SEQ ID NO: 328158 - protein, 18 aa, Mycobacterium
RVRLIERLVSGKVADATL

SEQ ID NO: 328159 - protein, 19 aa, Mycobacterium
RVRMPMIDGPGVDAGQPRA

SEQ ID NO: 328160 - protein, 17 aa, Mycobacterium
RVRPDARGTLDYFASQH

SEQ ID NO: 328161 - protein, 17 aa, Mycobacterium
RVRRVGLVHAELNSVAL

SEQ ID NO: 328162 - protein, 17 aa, Mycobacterium
RVRTDPQAAAILRALQR

SEQ ID NO: 328163 - protein, 17 aa, Mycobacterium
RVRVMGVAAVLFAVSSV

SEQ ID NO: 328164 - protein, 26 aa, Mycobacterium
RVSAWLRLPLIGLIVLLGSDPNIQMW

SEQ ID NO: 328165 - protein, 17 aa, Mycobacterium
RVSDDPIVLSAKADLAK

SEQ ID NO: 328166 - protein, 28 aa, Mycobacterium
RVSGELPRTATFKVIKRQLSAEALETAD

SEQ ID NO: 328167 - protein, 19 aa, Mycobacterium
RVSGFAVGKVERIRLDGRK

SEQ ID NO: 328168 - protein, 21 aa, Mycobacterium
RVSGVTLPWTLAVTTTLPSVS

SEQ ID NO: 328169 - protein, 18 aa, Mycobacterium
RVSHQWWAGIAIGFTLVL

SEQ ID NO: 328170 - protein, 18 aa, Mycobacterium
RVSIPALAILAAVALLIG

SEQ ID NO: 328171 - protein, 19 aa, Mycobacterium
RVSNLFLTKTVYSVLLAIL

SEQ ID NO: 328172 - protein, 19 aa, Mycobacterium
RVSNLFLTKTVYSVLLAVL

SEQ ID NO: 328173 - protein, 19 aa, Mycobacterium
RVSPLRLGEDFANLSRAFN

SEQ ID NO: 328174 - protein, 18 aa, Mycobacterium
RVSRSFAPRLDIEAVGRF

SEQ ID NO: 328175 - protein, 25 aa, Mycobacterium
RVSSLDFFVSLAFMPLSFAIVGPLS

SEQ ID NO: 328176 - protein, 23 aa, Mycobacterium
RVTAAIYRCCVGLTVALICGYAI

SEQ ID NO: 328177 - protein, 21 aa, Mycobacterium
RVTAMPVRLVDGGAGGLRIIG

SEQ ID NO: 328178 - protein, 24 aa, Mycobacterium
RVTGWSMLEVSRFGASSLLTRTTT

SEQ ID NO: 328179 - protein, 26 aa, Mycobacterium
RVTLELFTAAGLLRLSVDATWTAIAA

SEQ ID NO: 328180 - protein, 23 aa, Mycobacterium
RVTLPMCRPTIVAAVLLTCLPML

SEQ ID NO: 328181 - protein, 23 aa, Mycobacterium
RVTLWCGVISLLLSAISIVIIYS

SEQ ID NO: 328182 - protein, 20 aa, Mycobacterium
RVTRVPVWSLLLIGAAALAV

SEQ ID NO: 328183 - protein, 18 aa, Mycobacterium
RVTVWAVAIGATFVIGFS

SEQ ID NO: 328184 - protein, 19 aa, Mycobacterium
RVVALGGIAVRPPAEPPSP

SEQ ID NO: 328185 - protein, 20 aa, Mycobacterium
RVVALTAWAFAVWILLTWTP

SEQ ID NO: 328186 - protein, 19 aa, Mycobacterium
RVVATGNSLDGVWAQLMPD

SEQ ID NO: 328187 - protein, 18 aa, Mycobacterium
RVVATGNSVDGVWQQLLQ

SEQ ID NO: 328188 - protein, 20 aa, Mycobacterium
RVVDCPDRRISRAAQLLVAK

SEQ ID NO: 328189 - protein, 18 aa, Mycobacterium
RVVEAPRVPDHAVTPVPV

SEQ ID NO: 328190 - protein, 19 aa, Mycobacterium
RVVESIKVLNIRYILTSSP

SEQ ID NO: 328191 - protein, 17 aa, Mycobacterium
RVVFLARDGHLAFTGSP

SEQ ID NO: 328192 - protein, 23 aa, Mycobacterium
RVVFPDLHLSAALPAHQRTIVKF

SEQ ID NO: 328193 - protein, 24 aa, Mycobacterium
RVVFPDLHLSAALPAHQRTTVRFT

SEQ ID NO: 328194 - protein, 24 aa, Mycobacterium
RVVGACAYLVPILGCAALLIDGSS

SEQ ID NO: 328195 - protein, 26 aa, Mycobacterium
RVVGRGRPADRPALLGAVKTNVGHLE

SEQ ID NO: 328196 - protein, 20 aa, Mycobacterium
RVVKRQGQESFNFGELFAYT

SEQ ID NO: 328197 - protein, 26 aa, Mycobacterium
RVVLASFWPALLVVVCQVFVMYVVVH

SEQ ID NO: 328198 - protein, 24 aa, Mycobacterium
RVVLASYWPGLLIAVCQVVVMYVV

SEQ ID NO: 328199 - protein, 17 aa, Mycobacterium
RVVPLHLADSALIDLIR

SEQ ID NO: 328200 - protein, 20 aa, Mycobacterium
RVVPLPRRLSGLLEAESGFN

SEQ ID NO: 328201 - protein, 17 aa, Mycobacterium
RVVPRAMWQAVLASGVL

SEQ ID NO: 328202 - protein, 28 aa, Mycobacterium
RVVRACAREGFERGRFGQVSASYSRTAL

SEQ ID NO: 328203 - protein, 20 aa, Mycobacterium
RVVSELDFEVVFQAIHDVAS

SEQ ID NO: 328204 - protein, 26 aa, Mycobacterium
RVVSRLRAAGYTLRPRDMFAHRTVEA

SEQ ID NO: 328205 - protein, 19 aa, Mycobacterium
RVVTANLFIAGTFISVLVL

SEQ ID NO: 328206 - protein, 18 aa, Mycobacterium
RVVTYLKMGCPLTTEMVP

SEQ ID NO: 328207 - protein, 22 aa, Mycobacterium
RVVVGRGRLMARLPAGGAMVAV

SEQ ID NO: 328208 - protein, 19 aa, Mycobacterium
RVVVLPRLLARAVGAEPRS

SEQ ID NO: 328209 - protein, 26 aa, Mycobacterium
RVWQTRIAPVLACLGLVGALLLVLTN

SEQ ID NO: 328210 - protein, 21 aa, Mycobacterium
RVYTGPMLYLFVATLALTIPL

SEQ ID NO: 328211 - protein, 21 aa, Mycobacterium
RWAGLGKRYPLVGIVFSLFLL

SEQ ID NO: 328212 - protein, 20 aa, Mycobacterium
RWAQRPRVWWLAVIGNSGAM

SEQ ID NO: 328213 - protein, 19 aa, Mycobacterium
RWAVLSFLAYQHMSFVVQT

SEQ ID NO: 328214 - protein, 20 aa, Mycobacterium
RWDAGHLVLELYERLVEKHT

SEQ ID NO: 328215 - protein, 28 aa, Mycobacterium
RWEWSPLYFKEISWVGSNAFGVEEVDGV

SEQ ID NO: 328216 - protein, 20 aa, Mycobacterium
RWFFWAAFAVATLLIAGVVS

SEQ ID NO: 328217 - protein, 19 aa, Mycobacterium
RWFGFGGGLLLAAVVYLVL

SEQ ID NO: 328218 - protein, 26 aa, Mycobacterium
RWFPRSLRGQLLLGVLAVVTVVLVAV

SEQ ID NO: 328219 - protein, 21 aa, Mycobacterium
RWFRIALACLLLIAVAGVAVG

SEQ ID NO: 328220 - protein, 18 aa, Mycobacterium
RWFSELTGLPVAVEYGIG

SEQ ID NO: 328221 - protein, 26 aa, Mycobacterium
RWFVVFTIGNGVLWLHDSVLIVLLPI

SEQ ID NO: 328222 - protein, 17 aa, Mycobacterium
RWGHQWMVITCWMGVVI

SEQ ID NO: 328223 - protein, 17 aa, Mycobacterium
RWGHQWMVVTCWMGVVI

SEQ ID NO: 328224 - protein, 19 aa, Mycobacterium
RWGLVALTVPAGVFLGVLA

SEQ ID NO: 328225 - protein, 19 aa, Mycobacterium
RWGSQWALVRLPDDRRDAD

SEQ ID NO: 328226 - protein, 19 aa, Mycobacterium
RWGYWPAAAGLYLFVWLEL

SEQ ID NO: 328227 - protein, 18 aa, Mycobacterium
RWHEHAAVLEEPVRRIPG

SEQ ID NO: 328228 - protein, 19 aa, Mycobacterium
RWHRSDGEIPWAYRQSCGE

SEQ ID NO: 328229 - protein, 18 aa, Mycobacterium
RWIAITAGVLALVLLVWW

SEQ ID NO: 328230 - protein, 29 aa, Mycobacterium
RWIDVPDRLLQRWTGLTVTLDISGNVGRC

SEQ ID NO: 328231 - protein, 19 aa, Mycobacterium
RWIPELKTYGLAGVAQSAL

SEQ ID NO: 328232 - protein, 18 aa, Mycobacterium
RWIPQNWRTFTLLDGVVI

SEQ ID NO: 328233 - protein, 19 aa, Mycobacterium
RWITGEGFTDSGLRLDLRT

SEQ ID NO: 328234 - protein, 19 aa, Mycobacterium
RWLASRWGAQRSLFVGAVV

SEQ ID NO: 328235 - protein, 19 aa, Mycobacterium
RWLATVIKMDGRRIDQLRL

SEQ ID NO: 328236 - protein, 19 aa, Mycobacterium
RWLAVATPWTAIPLASAQF

SEQ ID NO: 328237 - protein, 20 aa, Mycobacterium
RWLDRSPWRTLAIACCTALF

SEQ ID NO: 328238 - protein, 17 aa, Mycobacterium
RWLGDTMGELRAYLEQW

SEQ ID NO: 328239 - protein, 26 aa, Mycobacterium
RWLGRGRLAAVGGLEPFAFTVIDVIV

SEQ ID NO: 328240 - protein, 18 aa, Mycobacterium
RWLLDGKVGHQWWAGLVI

SEQ ID NO: 328241 - protein, 18 aa, Mycobacterium
RWLLGALAVIVAFMIGEV

SEQ ID NO: 328242 - protein, 18 aa, Mycobacterium
RWLLLTLVAIWGLRLSWH

SEQ ID NO: 328243 - protein, 26 aa, Mycobacterium
RWLRRPVVQAKLWLQDAIAGMPKFPD

SEQ ID NO: 328244 - protein, 29 aa, Mycobacterium
RWLRRPVVQAKLWLQDAITGMPRFPDDAA

SEQ ID NO: 328245 - protein, 17 aa, Mycobacterium
RWLTFGVGAGYDVTAFV

SEQ ID NO: 328246 - protein, 18 aa, Mycobacterium
RWLWLVKWCVLAVPHYPI

SEQ ID NO: 328247 - protein, 20 aa, Mycobacterium
RWMQNALSFIGFVPPDENDL

SEQ ID NO: 328248 - protein, 26 aa, Mycobacterium
RWNLHRRIALLTVRAMGTSATRVIAG

SEQ ID NO: 328249 - protein, 20 aa, Mycobacterium
RWNLPIILIVLLAVFGSLAA

SEQ ID NO: 328250 - protein, 22 aa, Mycobacterium
RWNWVLDGMVTIGALSAQDRAG

SEQ ID NO: 328251 - protein, 24 aa, Mycobacterium
RWPLEGSIYQWSRRLLGTTYGWFA

SEQ ID NO: 328252 - protein, 17 aa, Mycobacterium
RWREAFLAIADQGASGA

SEQ ID NO: 328253 - protein, 18 aa, Mycobacterium
RWRGAVVGMLLCVAGAAI

SEQ ID NO: 328254 - protein, 18 aa, Mycobacterium
RWRGRIFAAIAVLLALVA

SEQ ID NO: 328255 - protein, 18 aa, Mycobacterium
RWRGWLDHSLVIALIATI

SEQ ID NO: 328256 - protein, 20 aa, Mycobacterium
RWRRECLIAVIELKPRPFTP

SEQ ID NO: 328257 - protein, 17 aa, Mycobacterium
RWRRFDLTDTVIMSALV

SEQ ID NO: 328258 - protein, 21 aa, Mycobacterium
RWRVWLTDRLTGDWLDDRAYY

SEQ ID NO: 328259 - protein, 21 aa, Mycobacterium
RWRYGHLGWAPAIYCGGLAAL

SEQ ID NO: 328260 - protein, 27 aa, Mycobacterium
RWSNYTEVFALLPFGRMFFNTVLYAGC

SEQ ID NO: 328261 - protein, 19 aa, Mycobacterium
RWSSWLRVVLGAGLIAFGV

SEQ ID NO: 328262 - protein, 24 aa, Mycobacterium
RWTARRWTHLMPRAVPLTYAQIAA

SEQ ID NO: 328263 - protein, 24 aa, Mycobacterium
RWTATVFGLLGFVLSVSIPLLPVK

SEQ ID NO: 328264 - protein, 17 aa, Mycobacterium
RWTLWRTITVLVVSVGW

SEQ ID NO: 328265 - protein, 19 aa, Mycobacterium
RWTRAVDHLLHLSMSAAMI

SEQ ID NO: 328266 - protein, 31 aa, Mycobacterium
RWTRVARGWPGWGLALWLICPIWLAHSMPTW

SEQ ID NO: 328267 - protein, 25 aa, Mycobacterium
RWTVIAICATVFFVVVYLLSAWTTT

SEQ ID NO: 328268 - protein, 21 aa, Mycobacterium
RWVFLKRVFFGLACLGLTGFV

SEQ ID NO: 328269 - protein, 19 aa, Mycobacterium
RWVLVPAPSGTTVRWTVAF

SEQ ID NO: 328270 - protein, 19 aa, Mycobacterium
RWVRAEVLSSGDLVISGST

SEQ ID NO: 328271 - protein, 20 aa, Mycobacterium
RWVSESGWGETLFSLDKTTI

SEQ ID NO: 328272 - protein, 20 aa, Mycobacterium
RWVSSVLVEFFRAVPVLIMM

SEQ ID NO: 328273 - protein, 19 aa, Mycobacterium
RWWTWTLLAGPGWVVFGAL

SEQ ID NO: 328274 - protein, 17 aa, Mycobacterium
RWWWKTVPWETGFATLD

SEQ ID NO: 328275 - protein, 18 aa, Mycobacterium
RWYGYNLYGPTEYTINTL

SEQ ID NO: 328276 - protein, 18 aa, Mycobacterium
RWYVITFLMGLFFVCGQG

SEQ ID NO: 328277 - protein, 18 aa, Mycobacterium
RWYVVTLLMGLIFVLGQG

SEQ ID NO: 328278 - protein, 19 aa, Mycobacterium
RYADRLEILHVMSNEPLHT

SEQ ID NO: 328279 - protein, 20 aa, Mycobacterium
RYADRLEVLHVLSSEPLHTP

SEQ ID NO: 328280 - protein, 19 aa, Mycobacterium
RYAHWARHNINRCALVLIG

SEQ ID NO: 328281 - protein, 27 aa, Mycobacterium
RYAIACLLLLGWVRLTGHPLRRPRGTE

SEQ ID NO: 328282 - protein, 32 aa, Mycobacterium
RYAIPAAKWPEKWARLSFWCMNIGLAWMVFAT

SEQ ID NO: 328283 - protein, 20 aa, Mycobacterium
RYARSRVRRIMPAYVVTVLL

SEQ ID NO: 328284 - protein, 20 aa, Mycobacterium
RYATCGDLSAAAYAALATPD

SEQ ID NO: 328285 - protein, 19 aa, Mycobacterium
RYATCGDLSAAAYSALATP

SEQ ID NO: 328286 - protein, 25 aa, Mycobacterium
RYCENWRGGYDINRRRDHDLRVLEV

SEQ ID NO: 328287 - protein, 18 aa, Mycobacterium
RYDFDLVPYYPLVLTGFL

SEQ ID NO: 328288 - protein, 20 aa, Mycobacterium
RYDLVIAVIATVCLIFAIML

SEQ ID NO: 328289 - protein, 24 aa, Mycobacterium
RYDPEDLWTVMGLVPQRGYLFSGT

SEQ ID NO: 328290 - protein, 19 aa, Mycobacterium
RYDPPYKTACAGMVILVVT

SEQ ID NO: 328291 - protein, 20 aa, Mycobacterium
RYEGVAVQCAVFGENYSLGQ

SEQ ID NO: 328292 - protein, 18 aa, Mycobacterium
RYELRGLLGRGGMAEVRD

SEQ ID NO: 328293 - protein, 21 aa, Mycobacterium
RYEVIDVPAGQAWAIAAAGTP

SEQ ID NO: 328294 - protein, 17 aa, Mycobacterium
RYFEKRSKRQAGAALRA

SEQ ID NO: 328295 - protein, 25 aa, Mycobacterium
RYFQIRRGHMMLTFVLATMLLVGVM

SEQ ID NO: 328296 - protein, 25 aa, Mycobacterium
RYFTDTFARLGLRRDTLVPCYGMAE

SEQ ID NO: 328297 - protein, 28 aa, Mycobacterium
RYFYVKWWKLALMLLGVWAAAAVVGLGL

SEQ ID NO: 328298 - protein, 20 aa, Mycobacterium
RYGACLVPAPRSLVRSGMDL

SEQ ID NO: 328299 - protein, 27 aa, Mycobacterium
RYGARRWLARIAVSWGIVVVATGFAPN

SEQ ID NO: 328300 - protein, 18 aa, Mycobacterium
RYGAVPWVGVAAAPQLGP

SEQ ID NO: 328301 - protein, 17 aa, Mycobacterium
RYGEPVTVDDPWGYGNS

SEQ ID NO: 328302 - protein, 17 aa, Mycobacterium
RYGESMYYIDPEGVRYG

SEQ ID NO: 328303 - protein, 18 aa, Mycobacterium
RYGFRLFSAFMFQQLTLS

SEQ ID NO: 328304 - protein, 24 aa, Mycobacterium
RYGGDAWVIREGRRSRIDATDRSV

SEQ ID NO: 328305 - protein, 25 aa, Mycobacterium
RYGGLRAALPVTFVTFGLAYLAIIG

SEQ ID NO: 328306 - protein, 25 aa, Mycobacterium
RYGGLRAALPVTFVTFGLGYLAIIG

SEQ ID NO: 328307 - protein, 24 aa, Mycobacterium
RYGGLRAVMPITFVTFGLGYLAII

SEQ ID NO: 328308 - protein, 24 aa, Mycobacterium
RYGGLRTALPITFVTFGLGYLAII

SEQ ID NO: 328309 - protein, 18 aa, Mycobacterium
RYGGVPWVGAAALPDVGD

SEQ ID NO: 328310 - protein, 23 aa, Mycobacterium
RYGKEILRLIAQMSLGTGALAVI

SEQ ID NO: 328311 - protein, 18 aa, Mycobacterium
RYGLLSFATAREFGGAGG

SEQ ID NO: 328312 - protein, 20 aa, Mycobacterium
RYGPISVRALFLVFGIGLVA

SEQ ID NO: 328313 - protein, 29 aa, Mycobacterium
RYGRSRLSRIPRRWVIVALGVLVVAAGLA

SEQ ID NO: 328314 - protein, 24 aa, Mycobacterium
RYGVREPLVLTALLQLLSAVAQNC

SEQ ID NO: 328315 - protein, 20 aa, Mycobacterium
RYHWVPAAAGWTVGVIATLS

SEQ ID NO: 328316 - protein, 19 aa, Mycobacterium
RYIEIAHRLFPRAMLHFED

SEQ ID NO: 328317 - protein, 23 aa, Mycobacterium
RYIPGEPLADIAVGDGYADDTDA

SEQ ID NO: 328318 - protein, 25 aa, Mycobacterium
RYKAETLRLIATMSLGIGALAIIGG

SEQ ID NO: 328319 - protein, 19 aa, Mycobacterium
RYKDDYKAAGVPMLPAVAT

SEQ ID NO: 328320 - protein, 20 aa, Mycobacterium
RYKEDYEAAGVPMLPVVATE

SEQ ID NO: 328321 - protein, 19 aa, Mycobacterium
RYLFAFGRDGLLWHRLGEA

SEQ ID NO: 328322 - protein, 18 aa, Mycobacterium
RYLISLPLFHVAALAPLV

SEQ ID NO: 328323 - protein, 19 aa, Mycobacterium
RYLLLQTVVVFVWIALNLF

SEQ ID NO: 328324 - protein, 20 aa, Mycobacterium
RYLLSSNMGEIFTVFFGVVL

SEQ ID NO: 328325 - protein, 20 aa, Mycobacterium
RYLNCYGIRVDAIRITGRTT

SEQ ID NO: 328326 - protein, 18 aa, Mycobacterium
RYLPDLVVVAALLAAVGL

SEQ ID NO: 328327 - protein, 21 aa, Mycobacterium
RYLTEAVKPAGRRRRWQPTRD

SEQ ID NO: 328328 - protein, 21 aa, Mycobacterium
RYMSLAALAALVFDLLVTAGV

SEQ ID NO: 328329 - protein, 20 aa, Mycobacterium
RYMVTCIVTPPSPYRLEIKP

SEQ ID NO: 328330 - protein, 25 aa, Mycobacterium
RYPLKAELPASGGLYPTANVTYRGI

SEQ ID NO: 328331 - protein, 27 aa, Mycobacterium
RYPNMLRFAGVWWAFVFPLGMYSAASF

SEQ ID NO: 328332 - protein, 17 aa, Mycobacterium
RYPRFPGSRPGDLEPGS

SEQ ID NO: 328333 - protein, 20 aa, Mycobacterium
RYPTCADFAAALAGRPATGP

SEQ ID NO: 328334 - protein, 19 aa, Mycobacterium
RYQEVIAMHECRSAKQLAE

SEQ ID NO: 328335 - protein, 20 aa, Mycobacterium
RYQFALARKGLLPKPLATVH

SEQ ID NO: 328336 - protein, 19 aa, Mycobacterium
RYQRLMLAVVGVAWLLILV

SEQ ID NO: 328337 - protein, 20 aa, Mycobacterium
RYQRLMLGVVGIVWLLILVP

SEQ ID NO: 328338 - protein, 29 aa, Mycobacterium
RYRAVVLARLRLVGIGVPAAIGLLAGIVA

SEQ ID NO: 328339 - protein, 18 aa, Mycobacterium
RYRGHSWAELGLGRDHWR

SEQ ID NO: 328340 - protein, 17 aa, Mycobacterium
RYRHRSLRIGRSPGSDI

SEQ ID NO: 328341 - protein, 17 aa, Mycobacterium
RYRIRVLLAAAVAGGVI

SEQ ID NO: 328342 - protein, 18 aa, Mycobacterium
RYRLLVFHGGAPPLQFWQ

SEQ ID NO: 328343 - protein, 24 aa, Mycobacterium
RYRLLVFHGGAPPLQFWQALDTAL

SEQ ID NO: 328344 - protein, 19 aa, Mycobacterium
RYRLPRAALALAVGAAVTT

SEQ ID NO: 328345 - protein, 18 aa, Mycobacterium
RYRRLPNWLTLPAAVVII

SEQ ID NO: 328346 - protein, 18 aa, Mycobacterium
RYRSWLPTLEEMVPSLGV

SEQ ID NO: 328347 - protein, 29 aa, Mycobacterium
RYRTRLLPWVLIDTAVTWGFGIIDENLLY

SEQ ID NO: 328348 - protein, 29 aa, Mycobacterium
RYRTTVMARLRLFGIGVPVFIGLLAGIVA

SEQ ID NO: 328349 - protein, 21 aa, Mycobacterium
RYRVMVEKLALIAGIEHFTAV

SEQ ID NO: 328350 - protein, 17 aa, Mycobacterium
RYRYDKFGWTTRSSQLY

SEQ ID NO: 328351 - protein, 21 aa, Mycobacterium
RYSASLRRSAGRSLALGGGAT

SEQ ID NO: 328352 - protein, 21 aa, Mycobacterium
RYSDREWILEIARQYRELSTG

SEQ ID NO: 328353 - protein, 18 aa, Mycobacterium
RYSFPVFVFTVILITLVL

SEQ ID NO: 328354 - protein, 17 aa, Mycobacterium
RYSPPHTQVRVSAVPTD

SEQ ID NO: 328355 - protein, 20 aa, Mycobacterium
RYSVPLSAAIAGRYAVSAEF

SEQ ID NO: 328356 - protein, 25 aa, Mycobacterium
RYTFTGTAVGLVFLFLSLTPSLLPR

SEQ ID NO: 328357 - protein, 19 aa, Mycobacterium
RYVAPAIVITVCLRQFFAA

SEQ ID NO: 328358 - protein, 18 aa, Mycobacterium
RYVIGVMLDAPHRAADGS

SEQ ID NO: 328359 - protein, 19 aa, Mycobacterium
RYVLIPVIIGLVLITAFVF

SEQ ID NO: 328360 - protein, 27 aa, Mycobacterium
RYVVAVGRRGELSYSFDELRAGGVSLV

SEQ ID NO: 328361 - protein, 18 aa, Mycobacterium
RYVVPPVRRLMAARQATV

SEQ ID NO: 328362 - protein, 18 aa, Mycobacterium
RYWQEAADWLSAHNTGTP

SEQ ID NO: 328363 - protein, 18 aa, Mycobacterium
RYWSEPEPRWPRSEPIAR

SEQ ID NO: 328364 - protein, 21 aa, Mycobacterium
RYYCCQPPRRQWIATQLVRRL

SEQ ID NO: 328365 - protein, 20 aa, Mycobacterium
RYYNSLYFPYVVGVRAYAQN

SEQ ID NO: 328366 - protein, 30 aa, Mycobacterium
SAAALWAASRLPWVVIRSFDGLGPPREVTL

SEQ ID NO: 328367 - protein, 20 aa, Mycobacterium
SAAAPLLCPALIELIALTNL

SEQ ID NO: 328368 - protein, 17 aa, Mycobacterium
SAAARRRALPWDLAKLE

SEQ ID NO: 328369 - protein, 22 aa, Mycobacterium
SAACKAWLLGQPFLAAGVLLVF

SEQ ID NO: 328370 - protein, 23 aa, Mycobacterium
SAADLWWLVFLGAGPSAIAFTTW

SEQ ID NO: 328371 - protein, 26 aa, Mycobacterium
SAADYPEPFLYAGYCRDDDPAVLVRG

SEQ ID NO: 328372 - protein, 19 aa, Mycobacterium
SAAELARWTYQGHTHYLII

SEQ ID NO: 328373 - protein, 17 aa, Mycobacterium
SAAFAVSVSLRLHQEEL

SEQ ID NO: 328374 - protein, 18 aa, Mycobacterium
SAAGRCVSGPPQFAGGGD

SEQ ID NO: 328375 - protein, 23 aa, Mycobacterium
SAAGRMRTAWAIMAAALGSWAVA

SEQ ID NO: 328376 - protein, 20 aa, Mycobacterium
SAAGVLIWPALGVLLPVARV

SEQ ID NO: 328377 - protein, 19 aa, Mycobacterium
SAAHELRTPLTAMRADLDT

SEQ ID NO: 328378 - protein, 24 aa, Mycobacterium
SAAHRPCRRAARLTGSMAAGVVTG

SEQ ID NO: 328379 - protein, 23 aa, Mycobacterium
SAAKRSAFLHWSRGPEGGQSRFW

SEQ ID NO: 328380 - protein, 24 aa, Mycobacterium
SAALTLAYVLRFFGPAASRRASVR

SEQ ID NO: 328381 - protein, 22 aa, Mycobacterium
SAAMRWYPIVTFWQVAADLANA

SEQ ID NO: 328382 - protein, 24 aa, Mycobacterium
SAAPGRPKLADWVTLAITAAAGAA

SEQ ID NO: 328383 - protein, 22 aa, Mycobacterium
SAARLLFSFAPFEYVLKNIAVM

SEQ ID NO: 328384 - protein, 17 aa, Mycobacterium
SAARLVKRLAPQRRLSL

SEQ ID NO: 328385 - protein, 32 aa, Mycobacterium
SAARRTPIIGAFPKMFIPFIVVIPGMICAVLV

SEQ ID NO: 328386 - protein, 19 aa, Mycobacterium
SAARVRRGLVPVGDAARQV

SEQ ID NO: 328387 - protein, 19 aa, Mycobacterium
SAASAVWTVCAAMLVPLTI

SEQ ID NO: 328388 - protein, 18 aa, Mycobacterium
SAASGLWPVAAGRVSAVL

SEQ ID NO: 328389 - protein, 19 aa, Mycobacterium
SAATGRLWGLTAALATDER

SEQ ID NO: 328390 - protein, 18 aa, Mycobacterium
SAATLVFDKVFFSAAGDL

SEQ ID NO: 328391 - protein, 17 aa, Mycobacterium
SAATRRGSQQAGEQAGQ

SEQ ID NO: 328392 - protein, 46 aa, Mycobacterium
SAATVAFAFLAMVFAKLSVFAALGPACAIAVFVGFAATVTLFPPVL

SEQ ID NO: 328393 - protein, 27 aa, Mycobacterium
SAATVLFALTGRRLWHRFRGQPDRADL

SEQ ID NO: 328394 - protein, 24 aa, Mycobacterium
SADALPIRVGVAVIGTIIVFSLIM

SEQ ID NO: 328395 - protein, 17 aa, Mycobacterium
SADAMAVLAEMAAAIDT

SEQ ID NO: 328396 - protein, 20 aa, Mycobacterium
SADAPPFFVLHGRNDSLVPV

SEQ ID NO: 328397 - protein, 23 aa, Mycobacterium
SADELYERVGLVLQETQLVHGTV

SEQ ID NO: 328398 - protein, 23 aa, Mycobacterium
SADGRRGVSVGVIVALVAVVVVV

SEQ ID NO: 328399 - protein, 24 aa, Mycobacterium
SADLRMVLKSAAKLKHLAPDAICV

SEQ ID NO: 328400 - protein, 22 aa, Mycobacterium
SADPCGDRCGGGGNGQGSYGPD

SEQ ID NO: 328401 - protein, 27 aa, Mycobacterium
SADPVFLDWLVGLAFPCQRPFGHQNGV

SEQ ID NO: 328402 - protein, 20 aa, Mycobacterium
SADRAHWGVAGWSMGGTCAV

SEQ ID NO: 328403 - protein, 20 aa, Mycobacterium
SADRSHWGVAGWSMGGTCAV

SEQ ID NO: 328404 - protein, 19 aa, Mycobacterium
SADRVRAGISYVMVSMMSS

SEQ ID NO: 328405 - protein, 19 aa, Mycobacterium
SADSDRRWLLGALAVIVAF

SEQ ID NO: 328406 - protein, 22 aa, Mycobacterium
SADSRAHCPMMCTGDPTAGTVP

SEQ ID NO: 328407 - protein, 24 aa, Mycobacterium
SADSRANPFLFVYNYLKQVVAEMR

SEQ ID NO: 328408 - protein, 20 aa, Mycobacterium
SAEAVARFLSWVYATRPPQR

SEQ ID NO: 328409 - protein, 26 aa, Mycobacterium
SAEGAIDRPECWGSVAPGTPDAYTGD

SEQ ID NO: 328410 - protein, 24 aa, Mycobacterium
SAELCAQYLAPILDSIKFNYFPFG

SEQ ID NO: 328411 - protein, 24 aa, Mycobacterium
SAELCAQYLAPIMDAIKFNYLPFG

SEQ ID NO: 328412 - protein, 17 aa, Mycobacterium
SAELMVVHVIRGDGLAG

SEQ ID NO: 328413 - protein, 25 aa, Mycobacterium
SAEPPLRLPTYLTDRAGALDAAGES

SEQ ID NO: 328414 - protein, 36 aa, Mycobacterium
SAEQLRIAHTVSFSFDMSWEELFWLVEGHQVHVCDE

SEQ ID NO: 328415 - protein, 20 aa, Mycobacterium
SAEVTQHWVAPRPSANRPVP

SEQ ID NO: 328416 - protein, 18 aa, Mycobacterium
SAFAGISVNTEWYNTALG

SEQ ID NO: 328417 - protein, 18 aa, Mycobacterium
SAFAGLAVNTVWYNTALG

SEQ ID NO: 328418 - protein, 32 aa, Mycobacterium
SAFATEVWQLVALRFLLGVAIGADYPIASSLL

SEQ ID NO: 328419 - protein, 20 aa, Mycobacterium
SAFCQVCGTATAALASHPAL

SEQ ID NO: 328420 - protein, 19 aa, Mycobacterium
SAFGLRIALVPLFIAEVFH

SEQ ID NO: 328421 - protein, 18 aa, Mycobacterium
SAFGLRVALVPLFITDVM

SEQ ID NO: 328422 - protein, 17 aa, Mycobacterium
SAFGVTWNNQVFNQGAP

SEQ ID NO: 328423 - protein, 19 aa, Mycobacterium
SAFHMPIGWLIAALAGAGC

SEQ ID NO: 328424 - protein, 17 aa, Mycobacterium
SAFLPHGYLGVWSALPF

SEQ ID NO: 328425 - protein, 23 aa, Mycobacterium
SAFREILSGLSFFRNAYDDFAGY

SEQ ID NO: 328426 - protein, 17 aa, Mycobacterium
SAFRVVTGFLFFLHGTS

SEQ ID NO: 328427 - protein, 28 aa, Mycobacterium
SAFYGLDLAKLLPFNLARTWHVQLSLFW

SEQ ID NO: 328428 - protein, 18 aa, Mycobacterium
SAGALGFVENDLGFKIIF

SEQ ID NO: 328429 - protein, 18 aa, Mycobacterium
SAGARPTIHMPLDHDPYQ

SEQ ID NO: 328430 - protein, 19 aa, Mycobacterium
SAGGLDIGPLISYETTFSD

SEQ ID NO: 328431 - protein, 17 aa, Mycobacterium
SAGHPVRTILGGWAAIS

SEQ ID NO: 328432 - protein, 30 aa, Mycobacterium
SAGIVIAVLICLGAVLLAYFKPLGKRGDDT

SEQ ID NO: 328433 - protein, 26 aa, Mycobacterium
SAGKLSFPASVAAGWAPFSDDQSPNL

SEQ ID NO: 328434 - protein, 20 aa, Mycobacterium
SAGLIALVFVGGRPTRKDLP

SEQ ID NO: 328435 - protein, 19 aa, Mycobacterium
SAGLLALLGLSGFVTAGSL

SEQ ID NO: 328436 - protein, 24 aa, Mycobacterium
SAGPRPILAYAVGLVMLAAAATHA

SEQ ID NO: 328437 - protein, 17 aa, Mycobacterium
SAGPRPLMSFLLQKQER

SEQ ID NO: 328438 - protein, 22 aa, Mycobacterium
SAGPTGKPWPLARATMVEPPRV

SEQ ID NO: 328439 - protein, 19 aa, Mycobacterium
SAGRRWQHRYSQHLRVSDS

SEQ ID NO: 328440 - protein, 22 aa, Mycobacterium
SAGRYMPFATVVIGVVLVALSI

SEQ ID NO: 328441 - protein, 23 aa, Mycobacterium
SAGTFPLAIGVLQVLALDIGTDV

SEQ ID NO: 328442 - protein, 25 aa, Mycobacterium
SAGVQHLRAAIRVVDPKLVVAQPRV

SEQ ID NO: 328443 - protein, 18 aa, Mycobacterium
SAHARAGARYLVTDTGVR

SEQ ID NO: 328444 - protein, 21 aa, Mycobacterium
SAHGLYPLLIMTLLPVLAGVD

SEQ ID NO: 328445 - protein, 23 aa, Mycobacterium
SAHGMWWPFVLIGVAYNLLIAWA

SEQ ID NO: 328446 - protein, 23 aa, Mycobacterium
SAHIRTGTLLGERMLAVESAGSG

SEQ ID NO: 328447 - protein, 24 aa, Mycobacterium
SAHRGEQVLAAALDAMARLVDGGS

SEQ ID NO: 328448 - protein, 20 aa, Mycobacterium
SAHRLLRPKFGRTIHAELTP

SEQ ID NO: 328449 - protein, 18 aa, Mycobacterium
SAHRLMRSKFGRTVHAEL

SEQ ID NO: 328450 - protein, 19 aa, Mycobacterium
SAHVPVFFIVWALSNFVGP

SEQ ID NO: 328451 - protein, 20 aa, Mycobacterium
SAIAYAVCYLLLERSKFGFK

SEQ ID NO: 328452 - protein, 18 aa, Mycobacterium
SAICAVIVTALDPYLGTS

SEQ ID NO: 328453 - protein, 25 aa, Mycobacterium
SAICLEFLDYFLIGFIVTFVSTSWQ

SEQ ID NO: 328454 - protein, 27 aa, Mycobacterium
SAIFLRDLRIPAIGVVLLLLSSLVVGA

SEQ ID NO: 328455 - protein, 19 aa, Mycobacterium
SAIFVPIVIALSVATLGSW

SEQ ID NO: 328456 - protein, 20 aa, Mycobacterium
SAIGALMLIPGVPGRSSASV

SEQ ID NO: 328457 - protein, 32 aa, Mycobacterium
SAIICIIGYRLIHFLNRIGTWVLGIAIVGGFI

SEQ ID NO: 328458 - protein, 24 aa, Mycobacterium
SAILLLLFWQWRTMPAVIWDVQYP

SEQ ID NO: 328459 - protein, 20 aa, Mycobacterium
SAILRKPVLTLYRQRPPEIG

SEQ ID NO: 328460 - protein, 21 aa, Mycobacterium
SAIPGMMLMCIVLTAGAMRPN

SEQ ID NO: 328461 - protein, 24 aa, Mycobacterium
SAIPRQTLSAGFWDSLLHDLSRAY

SEQ ID NO: 328462 - protein, 17 aa, Mycobacterium
SAIPVLSLIVVAIWLLG

SEQ ID NO: 328463 - protein, 17 aa, Mycobacterium
SAIRLALIPVFVYVMLI

SEQ ID NO: 328464 - protein, 24 aa, Mycobacterium
SAIRNSWTLLPIVPFVGGLLGVIA

SEQ ID NO: 328465 - protein, 24 aa, Mycobacterium
SAIYMLWLYQRVMTGPLAKGNERI

SEQ ID NO: 328466 - protein, 24 aa, Mycobacterium
SAIYMLWLYQRVMTGPVAAGNEKI

SEQ ID NO: 328467 - protein, 25 aa, Mycobacterium
SAIYMLWLYQRVMTGPVAKGNERIG

SEQ ID NO: 328468 - protein, 23 aa, Mycobacterium
SAKKFTMWSAIAGIIVFVIYGIL

SEQ ID NO: 328469 - protein, 17 aa, Mycobacterium
SAKKWAIISAIGGVVVA

SEQ ID NO: 328470 - protein, 19 aa, Mycobacterium
SAKPASWDMRSVLTIATAL

SEQ ID NO: 328471 - protein, 29 aa, Mycobacterium
SAKRARGSPLRVMILLALVTAIASALLDN

SEQ ID NO: 328472 - protein, 19 aa, Mycobacterium
SAKVLPSVVQLQIQSGRQQ

SEQ ID NO: 328473 - protein, 18 aa, Mycobacterium
SALADARAGAVTSAQTER

SEQ ID NO: 328474 - protein, 26 aa, Mycobacterium
SALAGVAVGGVWAWIAPPIHAVVALT

SEQ ID NO: 328475 - protein, 19 aa, Mycobacterium
SALAGVLMVTSFRMISATT

SEQ ID NO: 328476 - protein, 17 aa, Mycobacterium
SALAIALMGAVNAVATL

SEQ ID NO: 328477 - protein, 20 aa, Mycobacterium
SALAKMPVVNRIDLSAYPDE

SEQ ID NO: 328478 - protein, 18 aa, Mycobacterium
SALAPRRLAALVALAAAC

SEQ ID NO: 328479 - protein, 17 aa, Mycobacterium
SALAVVVVLAFARDRLA

SEQ ID NO: 328480 - protein, 23 aa, Mycobacterium
SALCFVCAGVLLYVDIGRRRSRG

SEQ ID NO: 328481 - protein, 21 aa, Mycobacterium
SALCFVGAAVLLYVDIDRRRG

SEQ ID NO: 328482 - protein, 21 aa, Mycobacterium
SALCFVGAAVLLYVDLDRRRG

SEQ ID NO: 328483 - protein, 20 aa, Mycobacterium
SALCFVGAVVLLYVDIDRRR

SEQ ID NO: 328484 - protein, 21 aa, Mycobacterium
SALCFVSAVVLLYVDIDRRRG

SEQ ID NO: 328485 - protein, 17 aa, Mycobacterium
SALCGAVGDVLQQRATH

SEQ ID NO: 328486 - protein, 22 aa, Mycobacterium
SALCGLSQSMAMLVGARALQGI

SEQ ID NO: 328487 - protein, 21 aa, Mycobacterium
SALCGYAVLYLAARDLEPAGF

SEQ ID NO: 328488 - protein, 23 aa, Mycobacterium
SALCSTTAALVCIAAELSGQWYH

SEQ ID NO: 328489 - protein, 28 aa, Mycobacterium
SALDHRFGWSSVPVWLSLLGDLLVATGL

SEQ ID NO: 328490 - protein, 20 aa, Mycobacterium
SALDLDLLLGGLKPVIQGLN

SEQ ID NO: 328491 - protein, 20 aa, Mycobacterium
SALEAGRWQALMLPVTTLVI

SEQ ID NO: 328492 - protein, 20 aa, Mycobacterium
SALERARSAGLVTVHGDATK

SEQ ID NO: 328493 - protein, 19 aa, Mycobacterium
SALFDWPIWADGLVFLVVS

SEQ ID NO: 328494 - protein, 23 aa, Mycobacterium
SALGALLFPSRRREWVVAGAGTF

SEQ ID NO: 328495 - protein, 17 aa, Mycobacterium
SALGLAGLSAWLITRAW

SEQ ID NO: 328496 - protein, 17 aa, Mycobacterium
SALGMLAVWSRQTAGDN

SEQ ID NO: 328497 - protein, 18 aa, Mycobacterium
SALGVRTRQSWRQRRAGV

SEQ ID NO: 328498 - protein, 21 aa, Mycobacterium
SALIAVPVGLVIGHTGRGTLF

SEQ ID NO: 328499 - protein, 21 aa, Mycobacterium
SALITYYGFVSLFPLLLLLTT

SEQ ID NO: 328500 - protein, 25 aa, Mycobacterium
SALKAFWYHFAIMFEALFILTTVDA

SEQ ID NO: 328501 - protein, 20 aa, Mycobacterium
SALKGDWVIVLAVAVGTLLL

SEQ ID NO: 328502 - protein, 25 aa, Mycobacterium
SALLHRTPIRFIRAFSGAARVSGPL

SEQ ID NO: 328503 - protein, 25 aa, Mycobacterium
SALLLLRLGEPFAISAMASTTAIVL

SEQ ID NO: 328504 - protein, 30 aa, Mycobacterium
SALLPGPAWVRRLWLAMIIVAPASIWLEPL

SEQ ID NO: 328505 - protein, 35 aa, Mycobacterium
SALLRRAESPAVWLNPWRWYSVPRAAAAALTVDQG

SEQ ID NO: 328506 - protein, 17 aa, Mycobacterium
SALMFGALLTIAATSAA

SEQ ID NO: 328507 - protein, 18 aa, Mycobacterium
SALMGIVVGRWLDRYGPR

SEQ ID NO: 328508 - protein, 17 aa, Mycobacterium
SALMYPEPKRPGWRHEH

SEQ ID NO: 328509 - protein, 24 aa, Mycobacterium
SALPERLVPLANIWEEILGTPVTN

SEQ ID NO: 328510 - protein, 20 aa, Mycobacterium
SALPSHWERLAVYWQLASDH

SEQ ID NO: 328511 - protein, 19 aa, Mycobacterium
SALPTHWERLAGYWQLASD

SEQ ID NO: 328512 - protein, 29 aa, Mycobacterium
SALRAGVGFIPFVIAMGIGLGISSQLVSR

SEQ ID NO: 328513 - protein, 29 aa, Mycobacterium
SALRAGVGFIPFVIAMGIGLGVSSQLVSR

SEQ ID NO: 328514 - protein, 29 aa, Mycobacterium
SALRAGVGFIPFVIGMGIGLGAASQLVRS

SEQ ID NO: 328515 - protein, 17 aa, Mycobacterium
SALRGARILGWGWLALT

SEQ ID NO: 328516 - protein, 20 aa, Mycobacterium
SALRWAVATIFGLSIAGDLY

SEQ ID NO: 328517 - protein, 26 aa, Mycobacterium
SALRWLPDSLTAGGTRGWLESVRTDP

SEQ ID NO: 328518 - protein, 19 aa, Mycobacterium
SALSLRPTVAIALVTLAIS

SEQ ID NO: 328519 - protein, 21 aa, Mycobacterium
SALTAIRCDPDSKAYYQRKRD

SEQ ID NO: 328520 - protein, 17 aa, Mycobacterium
SALVFVGFRASRKVPTE

SEQ ID NO: 328521 - protein, 30 aa, Mycobacterium
SALVLRDLRIPAIGVALLLLSSLVVGAGWP

SEQ ID NO: 328522 - protein, 17 aa, Mycobacterium
SALVVSRLHKLFGSEDL

SEQ ID NO: 328523 - protein, 25 aa, Mycobacterium
SALWAFSLAMIDGWQRGFAGRLTAR

SEQ ID NO: 328524 - protein, 18 aa, Mycobacterium
SAMLLFKGFKHMHLGLTT

SEQ ID NO: 328525 - protein, 51 aa, Mycobacterium
SAMPSHANKFGWHSWWWLAAIPVLVLLVVVAWALFGWRRRRSGADGAAGYA

SEQ ID NO: 328526 - protein, 19 aa, Mycobacterium
SAMVLEMIATLSVALIAVS

SEQ ID NO: 328527 - protein, 18 aa, Mycobacterium
SANIPRKLGGAYSVDYHP

SEQ ID NO: 328528 - protein, 20 aa, Mycobacterium
SANQHLLPFIAHDRAGFGGA

SEQ ID NO: 328529 - protein, 18 aa, Mycobacterium
SANYRDVQAFSMNDILTM

SEQ ID NO: 328530 - protein, 18 aa, Mycobacterium
SAPGAAIIQFFGGIHEIY

SEQ ID NO: 328531 - protein, 20 aa, Mycobacterium
SAPGAQWRRVTATGHYLPDA

SEQ ID NO: 328532 - protein, 25 aa, Mycobacterium
SAPKCPLPRPAIGPGTYNLVVQLGN

SEQ ID NO: 328533 - protein, 19 aa, Mycobacterium
SAPLAYTAIAVWCVTAIIG

SEQ ID NO: 328534 - protein, 22 aa, Mycobacterium
SAPLFHNIAAWLMQRENVPLSA

SEQ ID NO: 328535 - protein, 27 aa, Mycobacterium
SAPRGRRLRFRPGRAAGGVVLLVVSIL

SEQ ID NO: 328536 - protein, 20 aa, Mycobacterium
SAPVAPRITTDFVNVGGMTL

SEQ ID NO: 328537 - protein, 19 aa, Mycobacterium
SAPVAPRITTRVVEVGGMT

SEQ ID NO: 328538 - protein, 25 aa, Mycobacterium
SAPVPTPWAGVPGWGVGHTGTTGAP

SEQ ID NO: 328539 - protein, 21 aa, Mycobacterium
SAPVSGRWRALLLAAVAACAA

SEQ ID NO: 328540 - protein, 23 aa, Mycobacterium
SAQARLAALSILVGAVGATGPGV

SEQ ID NO: 328541 - protein, 31 aa, Mycobacterium
SAQFAFLGWHWSLPLGVAILFAAVAGGLLTV

SEQ ID NO: 328542 - protein, 19 aa, Mycobacterium
SAQIAALGPDDGWQGLAAQ

SEQ ID NO: 328543 - protein, 33 aa, Mycobacterium
SAQLAALGPDGGWRGNAAQAYGARNLAQSQHTI

SEQ ID NO: 328544 - protein, 39 aa, Mycobacterium
SAQTGAPGGLWARRKWEIVRIASPLALLALWQLGSAVGV

SEQ ID NO: 328545 - protein, 18 aa, Mycobacterium
SAQTYNLLAGWWSLLSLL

SEQ ID NO: 328546 - protein, 22 aa, Mycobacterium
SARAALAIVRRWLAKADSHDIA

SEQ ID NO: 328547 - protein, 23 aa, Mycobacterium
SARAMPGSGLGLAIVKQVVLNHG

SEQ ID NO: 328548 - protein, 23 aa, Mycobacterium
SARDPRWLLWLVALMTAALIPFS

SEQ ID NO: 328549 - protein, 19 aa, Mycobacterium
SARISLLVTDESGMSTVEY

SEQ ID NO: 328550 - protein, 17 aa, Mycobacterium
SARKGRIQISLNLAYGS

SEQ ID NO: 328551 - protein, 24 aa, Mycobacterium
SARLGFEVSKARLLYNPVVMPRAA

SEQ ID NO: 328552 - protein, 26 aa, Mycobacterium
SARLKLGRPALLVVRCASAVTVVALA

SEQ ID NO: 328553 - protein, 21 aa, Mycobacterium
SARLKLGRPAVLVVRCTLAVS

SEQ ID NO: 328554 - protein, 23 aa, Mycobacterium
SARNLFFRGVFPLLGGLSMLAAF

SEQ ID NO: 328555 - protein, 22 aa, Mycobacterium
SARNRMAFLSLVLFVLAFCFAS

SEQ ID NO: 328556 - protein, 27 aa, Mycobacterium
SARPASGRMTYGWRRVEILSAQANGVT

SEQ ID NO: 328557 - protein, 23 aa, Mycobacterium
SARPHIAAALVLMAVSGLLAFNW

SEQ ID NO: 328558 - protein, 20 aa, Mycobacterium
SARRLRRWQAVRSRELPSNP

SEQ ID NO: 328559 - protein, 30 aa, Mycobacterium
SARRWRRIGTAIVRWPAPILVASLAVALIG

SEQ ID NO: 328560 - protein, 23 aa, Mycobacterium
SARSLGLSPVRLFQKVVLPAAVP

SEQ ID NO: 328561 - protein, 23 aa, Mycobacterium
SARTESMPGWTARLDRDAASGAV

SEQ ID NO: 328562 - protein, 17 aa, Mycobacterium
SARTWLLSIARRVVADH

SEQ ID NO: 328563 - protein, 18 aa, Mycobacterium
SARTWLLSIARRVVADHI

SEQ ID NO: 328564 - protein, 24 aa, Mycobacterium
SASARMSWRAVIAVVALLVGAFVA

SEQ ID NO: 328565 - protein, 32 aa, Mycobacterium
SASCAPGASHLGVWFGHFPWWIPLGSLVLPFL

SEQ ID NO: 328566 - protein, 19 aa, Mycobacterium
SASDLSYRFVLPTTTKPLG

SEQ ID NO: 328567 - protein, 19 aa, Mycobacterium
SASDSARDVVVWESGSADG

SEQ ID NO: 328568 - protein, 18 aa, Mycobacterium
SASGLGFAIPVNEMKFVA

SEQ ID NO: 328569 - protein, 18 aa, Mycobacterium
SASGLGFAIPVNEMKVVA

SEQ ID NO: 328570 - protein, 19 aa, Mycobacterium
SASGLGFAIPVNEVKEVVE

SEQ ID NO: 328571 - protein, 18 aa, Mycobacterium
SASGLGFAIPVNEVKQVV

SEQ ID NO: 328572 - protein, 19 aa, Mycobacterium
SASLDEWGPEEWGVVGDKP

SEQ ID NO: 328573 - protein, 22 aa, Mycobacterium
SASPSRTYGWHRAEVFTAVANA

SEQ ID NO: 328574 - protein, 17 aa, Mycobacterium
SASRIAERFAEGHLTER

SEQ ID NO: 328575 - protein, 17 aa, Mycobacterium
SASRLAIITVLGLIVAY

SEQ ID NO: 328576 - protein, 17 aa, Mycobacterium
SASRVIWSFARDEVLPA

SEQ ID NO: 328577 - protein, 21 aa, Mycobacterium
SASTWSLCDTVAYAGTANPVT

SEQ ID NO: 328578 - protein, 20 aa, Mycobacterium
SASVLPSLKRYVLEMRFKPM

SEQ ID NO: 328579 - protein, 26 aa, Mycobacterium
SATDWPRYGGYALAGVSSFGFGGANA

SEQ ID NO: 328580 - protein, 18 aa, Mycobacterium
SATFLYRQQRLWGATPLV

SEQ ID NO: 328581 - protein, 17 aa, Mycobacterium
SATGIPAFWAWSHLNGP

SEQ ID NO: 328582 - protein, 18 aa, Mycobacterium
SATKEFEQALAFGEAPTE

SEQ ID NO: 328583 - protein, 17 aa, Mycobacterium
SATLALRVAARGRTSFY

SEQ ID NO: 328584 - protein, 25 aa, Mycobacterium
SATLCALLRLLEPNWSMTLVERLDG

SEQ ID NO: 328585 - protein, 26 aa, Mycobacterium
SATLLALPMRGFMFLTRPMLRALNRA

SEQ ID NO: 328586 - protein, 20 aa, Mycobacterium
SATMPPLWVIVSCALAMAGG

SEQ ID NO: 328587 - protein, 17 aa, Mycobacterium
SATNFAVTAAWAAGAVA

SEQ ID NO: 328588 - protein, 25 aa, Mycobacterium
SATNVLRARRAVQMVGGVALGIVVG

SEQ ID NO: 328589 - protein, 25 aa, Mycobacterium
SATRLRDRLGYAFGPPGWQPSTTAT

SEQ ID NO: 328590 - protein, 25 aa, Mycobacterium
SATRLRDRLGYVFGPPGWKPQTPAN

SEQ ID NO: 328591 - protein, 26 aa, Mycobacterium
SATRLYLPMPFFWVGGFGGGILSALL

SEQ ID NO: 328592 - protein, 26 aa, Mycobacterium
SATRSFAEGVGWLAQIGLFVLLGLLV

SEQ ID NO: 328593 - protein, 24 aa, Mycobacterium
SATTFPWVFLFPAGVLVLILVCAN

SEQ ID NO: 328594 - protein, 18 aa, Mycobacterium
SATVCAALAEPGPGSPAR

SEQ ID NO: 328595 - protein, 20 aa, Mycobacterium
SAVAAALAVIVILAGLSGSL

SEQ ID NO: 328596 - protein, 17 aa, Mycobacterium
SAVFVPVVFAIAIVAGG

SEQ ID NO: 328597 - protein, 24 aa, Mycobacterium
SAVGIALWLPWLIAAGVTFVLASV

SEQ ID NO: 328598 - protein, 19 aa, Mycobacterium
SAVGLYPGDDVRILGVKAG

SEQ ID NO: 328599 - protein, 19 aa, Mycobacterium
SAVGRFLAEVARYIARAVA

SEQ ID NO: 328600 - protein, 17 aa, Mycobacterium
SAVHFGRGLAARHYFTY

SEQ ID NO: 328601 - protein, 32 aa, Mycobacterium
SAVIGLGMAVLWLSGWPTRRQSIFYIMTGCVS

SEQ ID NO: 328602 - protein, 19 aa, Mycobacterium
SAVLALWAVRALGWKLSAL

SEQ ID NO: 328603 - protein, 18 aa, Mycobacterium
SAVLGRRVEWLSNPDLAL

SEQ ID NO: 328604 - protein, 26 aa, Mycobacterium
SAVLLCGLPILLVVALAVKLSSKGPV

SEQ ID NO: 328605 - protein, 26 aa, Mycobacterium
SAVLRLPLIGLIAVLVWIWEVNHWLP

SEQ ID NO: 328606 - protein, 20 aa, Mycobacterium
SAVLRLPLIGLIFVLVMVWE

SEQ ID NO: 328607 - protein, 25 aa, Mycobacterium
SAVNGLRALPTLGVLLLGVLLFGLG

SEQ ID NO: 328608 - protein, 20 aa, Mycobacterium
SAVQCYYGFCADGGPEGVGI

SEQ ID NO: 328609 - protein, 22 aa, Mycobacterium
SAVRAAAEWAPATLLIVATLTI

SEQ ID NO: 328610 - protein, 22 aa, Mycobacterium
SAVRAAAEWAPATLLLVATLTI

SEQ ID NO: 328611 - protein, 23 aa, Mycobacterium
SAVRGARNYPCQEFPGKRAPTIQ

SEQ ID NO: 328612 - protein, 20 aa, Mycobacterium
SAVRRMPIVEAFRRHWRQIV

SEQ ID NO: 328613 - protein, 24 aa, Mycobacterium
SAVSSRAGVEIAIDDNGRGVPEDE

SEQ ID NO: 328614 - protein, 19 aa, Mycobacterium
SAVSSRDGVEIAIDDDGVG

SEQ ID NO: 328615 - protein, 18 aa, Mycobacterium
SAVSSREGVEIAIDDNGV

SEQ ID NO: 328616 - protein, 17 aa, Mycobacterium
SAVSWPPDTAFMATPFV

SEQ ID NO: 328617 - protein, 27 aa, Mycobacterium
SAVTGTIQWPALVMFLIIFFWTPPHTW

SEQ ID NO: 328618 - protein, 18 aa, Mycobacterium
SAVTMLLPLLSIGTSLVI

SEQ ID NO: 328619 - protein, 17 aa, Mycobacterium
SAVVVLQSILAVAFGGG

SEQ ID NO: 328620 - protein, 23 aa, Mycobacterium
SAVYILWTYQRMMTGPVRDGIGD

SEQ ID NO: 328621 - protein, 24 aa, Mycobacterium
SAVYMLWLYQRVMTGPVATGNEKI

SEQ ID NO: 328622 - protein, 23 aa, Mycobacterium
SAWLRIFAVGLMFAGVTTTALLV

SEQ ID NO: 328623 - protein, 17 aa, Mycobacterium
SAWREFLAAEPVRVSAV

SEQ ID NO: 328624 - protein, 21 aa, Mycobacterium
SAWSAANARFNDFFRGIVTRF

SEQ ID NO: 328625 - protein, 21 aa, Mycobacterium
SAWYLCLGVAVAGAIILVGQR

SEQ ID NO: 328626 - protein, 26 aa, Mycobacterium
SAYDIGLFYRYAWQNPTFADIVATRT

SEQ ID NO: 328627 - protein, 26 aa, Mycobacterium
SAYDIGLFYRYAWQNPTFANIVATRT

SEQ ID NO: 328628 - protein, 27 aa, Mycobacterium
SAYDIGLFYRYAWRNPTFADIVATRSY

SEQ ID NO: 328629 - protein, 26 aa, Mycobacterium
SAYLLAKVCVYTVFAIVQSAIVTIIA

SEQ ID NO: 328630 - protein, 25 aa, Mycobacterium
SAYLLAKVCVYTVFAVIQSAIVTVI

SEQ ID NO: 328631 - protein, 20 aa, Mycobacterium
SAYLLAKVVVFTAFAIVQAA

SEQ ID NO: 328632 - protein, 19 aa, Mycobacterium
SAYLPEVIDTVLADLSSRF

SEQ ID NO: 328633 - protein, 19 aa, Mycobacterium
SAYPGMLPPPVPYPKRRRW

SEQ ID NO: 328634 - protein, 19 aa, Mycobacterium
SAYTMTPWIGLAVAAVMLI

SEQ ID NO: 328635 - protein, 20 aa, Mycobacterium
SAYVPEIASFIAAQAAFTMM

SEQ ID NO: 328636 - protein, 20 aa, Mycobacterium
SAYWRLKFDFYDRYGTRFTP

SEQ ID NO: 328637 - protein, 17 aa, Mycobacterium
SCAEGRATGSYFRMILP

SEQ ID NO: 328638 - protein, 35 aa, Mycobacterium
SCEPGASHLGVWFGHFPWWIPLGMLVLPFLLGFRL

SEQ ID NO: 328639 - protein, 23 aa, Mycobacterium
SCFAVNAIMCYVLCAVINRRARR

SEQ ID NO: 328640 - protein, 20 aa, Mycobacterium
SCGTCSVAEALKRSLNTSFY

SEQ ID NO: 328641 - protein, 19 aa, Mycobacterium
SCLLFPAYFQQVLGKTPLQ

SEQ ID NO: 328642 - protein, 19 aa, Mycobacterium
SCLLFPAYFQQVLGKTPMQ

SEQ ID NO: 328643 - protein, 21 aa, Mycobacterium
SCLRCGGRVQATLWSGARRFE

SEQ ID NO: 328644 - protein, 24 aa, Mycobacterium
SCQAPKAFVVLFVIPGTKEASQCK

SEQ ID NO: 328645 - protein, 19 aa, Mycobacterium
SCQKVLEGSGFVVAPERVM

SEQ ID NO: 328646 - protein, 20 aa, Mycobacterium
SCSMRLPVMYPPMAHAGSLH

SEQ ID NO: 328647 - protein, 26 aa, Mycobacterium
SCVAFGCITGALLLLRARTSDGAKML

SEQ ID NO: 328648 - protein, 23 aa, Mycobacterium
SDAAEWDWVKWLPHAGDPKLIDG

SEQ ID NO: 328649 - protein, 28 aa, Mycobacterium
SDAAFLSWGWRVAFWLSAVVVLIGYYIR

SEQ ID NO: 328650 - protein, 18 aa, Mycobacterium
SDAARLAGIAAKDGAAGY

SEQ ID NO: 328651 - protein, 31 aa, Mycobacterium
SDADFPRQFGYNMPLELVLTVTPFLIISVLF

SEQ ID NO: 328652 - protein, 20 aa, Mycobacterium
SDAEAFPVLTCMEQTGQTRR

SEQ ID NO: 328653 - protein, 21 aa, Mycobacterium
SDAIAAFLWMANWRFVAQKTD

SEQ ID NO: 328654 - protein, 17 aa, Mycobacterium
SDALGRRPVALAGAAAT

SEQ ID NO: 328655 - protein, 25 aa, Mycobacterium
SDALRAAGIPVLRRLMTRDVTTEGQ

SEQ ID NO: 328656 - protein, 18 aa, Mycobacterium
SDAMGFTGTVTRHDVTAA

SEQ ID NO: 328657 - protein, 19 aa, Mycobacterium
SDAPLWITFAVMPAYVVIA

SEQ ID NO: 328658 - protein, 21 aa, Mycobacterium
SDAPRKWWQPRNISAGGGLHI

SEQ ID NO: 328659 - protein, 24 aa, Mycobacterium
SDAPSLIAMRRIGKDFQQFDSDNT

SEQ ID NO: 328660 - protein, 27 aa, Mycobacterium
SDARATFLRWIWYAARREKLHLDGADD

SEQ ID NO: 328661 - protein, 18 aa, Mycobacterium
SDARSFVHTIDWQPRVDV

SEQ ID NO: 328662 - protein, 24 aa, Mycobacterium
SDASGRMRLRITGFHVDAVRAVAI

SEQ ID NO: 328663 - protein, 18 aa, Mycobacterium
SDDGLRWRTVVSIPVPPS

SEQ ID NO: 328664 - protein, 21 aa, Mycobacterium
SDEDGRLAVSLGIGAGIGAIF

SEQ ID NO: 328665 - protein, 19 aa, Mycobacterium
SDEDGRTAVALGIGAGIGA

SEQ ID NO: 328666 - protein, 24 aa, Mycobacterium
SDEGGFKLGWYAASRASQLRKMRA

SEQ ID NO: 328667 - protein, 23 aa, Mycobacterium
SDELVHSLWWLAQAWTIAALCTL

SEQ ID NO: 328668 - protein, 34 aa, Mycobacterium
SDERDRIALWTRILPITFTALGLVSLVGGAVLGS

SEQ ID NO: 328669 - protein, 20 aa, Mycobacterium
SDERMNWSIFGWTAPSNWIG

SEQ ID NO: 328670 - protein, 19 aa, Mycobacterium
SDERMNWSVFGWTAPSNWI

SEQ ID NO: 328671 - protein, 20 aa, Mycobacterium
SDEYWFSWKYFHPDTRVIDV

SEQ ID NO: 328672 - protein, 20 aa, Mycobacterium
SDFARLGLAAGLVVALVWLS

SEQ ID NO: 328673 - protein, 17 aa, Mycobacterium
SDFRLSLLGKFLCFAIV

SEQ ID NO: 328674 - protein, 23 aa, Mycobacterium
SDFRLSLLGKFLCFAIVAVGIGL

SEQ ID NO: 328675 - protein, 18 aa, Mycobacterium
SDGARYDLMIAVVSALTL

SEQ ID NO: 328676 - protein, 25 aa, Mycobacterium
SDGAVFCGLLWWIAFGLHDKLLAAA

SEQ ID NO: 328677 - protein, 23 aa, Mycobacterium
SDGAVFCGLLWWITFGMHDALLA

SEQ ID NO: 328678 - protein, 21 aa, Mycobacterium
SDGEIPWAYRQSCGEPVDVPS

SEQ ID NO: 328679 - protein, 20 aa, Mycobacterium
SDGHGLLAYFTEAIRQRRQN

SEQ ID NO: 328680 - protein, 18 aa, Mycobacterium
SDGKFAYVQVNLMGLQGH

SEQ ID NO: 328681 - protein, 21 aa, Mycobacterium
SDGLQPISPVLAAILRNTDSH

SEQ ID NO: 328682 - protein, 19 aa, Mycobacterium
SDGLTAWIAAPLLFIGFMF

SEQ ID NO: 328683 - protein, 19 aa, Mycobacterium
SDGLTAWIAAPLLFIGVLF

SEQ ID NO: 328684 - protein, 21 aa, Mycobacterium
SDGLYRFVRHPMYVGNVIMMV

SEQ ID NO: 328685 - protein, 25 aa, Mycobacterium
SDGSRYDMMIAILSALCLVLVIMLV

SEQ ID NO: 328686 - protein, 19 aa, Mycobacterium
SDIAQLLRMLRMRHDVTYR

SEQ ID NO: 328687 - protein, 24 aa, Mycobacterium
SDIDTPDGLYCKLPQDSPIAVRGA

SEQ ID NO: 328688 - protein, 18 aa, Mycobacterium
SDIPLHWIPGHPVASTMV

SEQ ID NO: 328689 - protein, 26 aa, Mycobacterium
SDIYSLGCALFRLLTSHTPYEDNSLS

SEQ ID NO: 328690 - protein, 30 aa, Mycobacterium
SDKFFEEVWDPASTVAHGRVNVSFTPSYTY

SEQ ID NO: 328691 - protein, 24 aa, Mycobacterium
SDLEHAQQLLTRWRQADDRINAYI

SEQ ID NO: 328692 - protein, 24 aa, Mycobacterium
SDLELPPTWMLFFFAPTLVGLCAM

SEQ ID NO: 328693 - protein, 17 aa, Mycobacterium
SDLGVGVADAGLRSVSA

SEQ ID NO: 328694 - protein, 19 aa, Mycobacterium
SDLIPMLPAAFVLAVVTAG

SEQ ID NO: 328695 - protein, 20 aa, Mycobacterium
SDLLWSFLQAIVMSIAVMLV

SEQ ID NO: 328696 - protein, 19 aa, Mycobacterium
SDLNWKSVWDNGWSAAEAA

SEQ ID NO: 328697 - protein, 25 aa, Mycobacterium
SDLRLPAVGWALFAVLIGWSAACAF

SEQ ID NO: 328698 - protein, 24 aa, Mycobacterium
SDLRRDRTSFIIAHRLSTIRTADR

SEQ ID NO: 328699 - protein, 25 aa, Mycobacterium
SDLRSGQKVRIAGVPVGRVKNVSLN

SEQ ID NO: 328700 - protein, 17 aa, Mycobacterium
SDLRVVGQIGTTIMIGL

SEQ ID NO: 328701 - protein, 22 aa, Mycobacterium
SDLVVRSAIRFDVTISAEQATN

SEQ ID NO: 328702 - protein, 17 aa, Mycobacterium
SDLYLFFTWLPSGQDSN

SEQ ID NO: 328703 - protein, 17 aa, Mycobacterium
SDMPRVVKRQGQESFNF

SEQ ID NO: 328704 - protein, 17 aa, Mycobacterium
SDMQFAIATTLGVGLAA

SEQ ID NO: 328705 - protein, 17 aa, Mycobacterium
SDMSMALVGVGLLSVGL

SEQ ID NO: 328706 - protein, 23 aa, Mycobacterium
SDNEILGLCFMFVLAGLDTVTSA

SEQ ID NO: 328707 - protein, 20 aa, Mycobacterium
SDNPYWLVSVQMLDGVGAGV

SEQ ID NO: 328708 - protein, 17 aa, Mycobacterium
SDPETYGRLTVLTVPGQ

SEQ ID NO: 328709 - protein, 19 aa, Mycobacterium
SDPIAWWTPDLLFKKPDWL

SEQ ID NO: 328710 - protein, 17 aa, Mycobacterium
SDPKVVLGLYEDFLCPA

SEQ ID NO: 328711 - protein, 24 aa, Mycobacterium
SDPNAKWGFWVGLFITYADVMIAL

SEQ ID NO: 328712 - protein, 22 aa, Mycobacterium
SDPQFGIDLGFYAFDLPFYRLV

SEQ ID NO: 328713 - protein, 22 aa, Mycobacterium
SDPRALAVLNLLVALGLLTMAP

SEQ ID NO: 328714 - protein, 22 aa, Mycobacterium
SDPRRLSAIVCLLLAPAAGIGL

SEQ ID NO: 328715 - protein, 22 aa, Mycobacterium
SDPRSPARETLWWVSDAGVRYG

SEQ ID NO: 328716 - protein, 17 aa, Mycobacterium
SDPSFAPAFESRDRKAS

SEQ ID NO: 328717 - protein, 27 aa, Mycobacterium
SDPVPFPGFKNGVGLILQLPQPTVIGS

SEQ ID NO: 328718 - protein, 18 aa, Mycobacterium
SDRAVVSRSWGMAVATLV

SEQ ID NO: 328719 - protein, 17 aa, Mycobacterium
SDREWILAIAQQYREIE

SEQ ID NO: 328720 - protein, 22 aa, Mycobacterium
SDRFGRRPIYFVGTVTAATWGF

SEQ ID NO: 328721 - protein, 18 aa, Mycobacterium
SDRFKPLPAPVWVSVTAV

SEQ ID NO: 328722 - protein, 17 aa, Mycobacterium
SDRHFPPARMEPEVLMI

SEQ ID NO: 328723 - protein, 21 aa, Mycobacterium
SDRHKVVIIGSGFGGLTAAKA

SEQ ID NO: 328724 - protein, 23 aa, Mycobacterium
SDRHKVVIIGSGFGGLTAAKTLK

SEQ ID NO: 328725 - protein, 34 aa, Mycobacterium
SDRIGRRRIMLFGWAGCLAWSFVVIPLIDTGKPA

SEQ ID NO: 328726 - protein, 26 aa, Mycobacterium
SDRLARLAGFSIRHKVLIIGVWVVTA

SEQ ID NO: 328727 - protein, 28 aa, Mycobacterium
SDRLYWKAVVYLRIVIRWISDEHPGETY

SEQ ID NO: 328728 - protein, 23 aa, Mycobacterium
SDRPRYPVLVFASGLNGFRQSNM

SEQ ID NO: 328729 - protein, 25 aa, Mycobacterium
SDRQLLLCGLVMAVVAALVGTALVI

SEQ ID NO: 328730 - protein, 22 aa, Mycobacterium
SDRVGRRVLLIIGLTAAGVATA

SEQ ID NO: 328731 - protein, 26 aa, Mycobacterium
SDRYGRRAVMLPAPFISMLGSLVLAL

SEQ ID NO: 328732 - protein, 25 aa, Mycobacterium
SDSLGRRKPLFAGIVLHMVASLLCM

SEQ ID NO: 328733 - protein, 17 aa, Mycobacterium
SDSLRRSAARSLMLGGI

SEQ ID NO: 328734 - protein, 21 aa, Mycobacterium
SDSLRSWLRFLVLASAAPLAG

SEQ ID NO: 328735 - protein, 17 aa, Mycobacterium
SDSPAGFDVPALTLPPS

SEQ ID NO: 328736 - protein, 28 aa, Mycobacterium
SDSTDALLRFVMRADATLTGLMGLALAA

SEQ ID NO: 328737 - protein, 24 aa, Mycobacterium
SDSTDSLLRFALRADATVCAGVGL

SEQ ID NO: 328738 - protein, 27 aa, Mycobacterium
SDSVMEIVGWRALWGLGNALFIATALA

SEQ ID NO: 328739 - protein, 18 aa, Mycobacterium
SDTPLVFSDGNWILDLEH

SEQ ID NO: 328740 - protein, 19 aa, Mycobacterium
SDTRGWLFFIVKVTAFSVG

SEQ ID NO: 328741 - protein, 17 aa, Mycobacterium
SDTVPLYGAELLNQGKF

SEQ ID NO: 328742 - protein, 17 aa, Mycobacterium
SDTVPLYGAELLNQGRF

SEQ ID NO: 328743 - protein, 17 aa, Mycobacterium
SDTVPLYGAELLSQGKF

SEQ ID NO: 328744 - protein, 17 aa, Mycobacterium
SDTVPLYGAELLSQGRF

SEQ ID NO: 328745 - protein, 17 aa, Mycobacterium
SDVHSVGGYVFAGSLFA

SEQ ID NO: 328746 - protein, 19 aa, Mycobacterium
SDVIAGWALGYVYFLFWLW

SEQ ID NO: 328747 - protein, 26 aa, Mycobacterium
SDVIGYRLRPIRTIALAAAVTMAALA

SEQ ID NO: 328748 - protein, 20 aa, Mycobacterium
SDVLAGWALGYAYFLVCLRL

SEQ ID NO: 328749 - protein, 19 aa, Mycobacterium
SDVLAGWSLGYLYFLVCLW

SEQ ID NO: 328750 - protein, 18 aa, Mycobacterium
SDVLSGWMLGLAWAGTVV

SEQ ID NO: 328751 - protein, 18 aa, Mycobacterium
SDVPPRYVDFYYFSFNLG

SEQ ID NO: 328752 - protein, 20 aa, Mycobacterium
SDVRAVWPVLVGVGLLAGAV

SEQ ID NO: 328753 - protein, 25 aa, Mycobacterium
SDVRIPLNRAVVMLVIDVSESMAAT

SEQ ID NO: 328754 - protein, 25 aa, Mycobacterium
SDVRIPLNRAVVMLVIDVSESMASN

SEQ ID NO: 328755 - protein, 19 aa, Mycobacterium
SDVRLTRTELDEVLRAPLA

SEQ ID NO: 328756 - protein, 18 aa, Mycobacterium
SDVVAGWSLGYLYFLLCF

SEQ ID NO: 328757 - protein, 30 aa, Mycobacterium
SDVVPRKGWLEALLGHFCDPAVALVAPRIV

SEQ ID NO: 328758 - protein, 17 aa, Mycobacterium
SDWVPRTLPPGWKPGSK

SEQ ID NO: 328759 - protein, 24 aa, Mycobacterium
SDYLAEPDTLVWADLCNPDHDTLG

SEQ ID NO: 328760 - protein, 22 aa, Mycobacterium
SDYRCPFCAKFSRDTEPQLIER

SEQ ID NO: 328761 - protein, 20 aa, Mycobacterium
SDYVERWLANQQKLFPNGET

SEQ ID NO: 328762 - protein, 26 aa, Mycobacterium
SEAEAGLRSSSFVFRHRTGNLAILAV

SEQ ID NO: 328763 - protein, 19 aa, Mycobacterium
SEAELALAVEEFGTESTAP

SEQ ID NO: 328764 - protein, 24 aa, Mycobacterium
SEAFTRLWPSVIFLISAPVSLVGL

SEQ ID NO: 328765 - protein, 23 aa, Mycobacterium
SEALAVPIWWVYATSLLLITAGL

SEQ ID NO: 328766 - protein, 18 aa, Mycobacterium
SEALCWDVGEIVELRGRT

SEQ ID NO: 328767 - protein, 18 aa, Mycobacterium
SEALDITGALLLSPGVAI

SEQ ID NO: 328768 - protein, 20 aa, Mycobacterium
SEAPEFIIATIFATRGKGTA

SEQ ID NO: 328769 - protein, 20 aa, Mycobacterium
SEAQLLEWIHRAADAAEPVI

SEQ ID NO: 328770 - protein, 19 aa, Mycobacterium
SEARLITAMIVREDSQTLY

SEQ ID NO: 328771 - protein, 17 aa, Mycobacterium
SEARMNPELLMLEADHD

SEQ ID NO: 328772 - protein, 21 aa, Mycobacterium
SEARSTWYTVDRPVYVALTLP

SEQ ID NO: 328773 - protein, 20 aa, Mycobacterium
SEASFAITVQRDFFHPPDQV

SEQ ID NO: 328774 - protein, 27 aa, Mycobacterium
SEATLGFCVGCYMHKLIWGCEDCEVPY

SEQ ID NO: 328775 - protein, 24 aa, Mycobacterium
SEAVLPRLVAKMKHLGVEPATVGV

SEQ ID NO: 328776 - protein, 24 aa, Mycobacterium
SEDAPRPAPPDVIHAIETQHWTDE

SEQ ID NO: 328777 - protein, 19 aa, Mycobacterium
SEDASCGTCSVAEALKRSL

SEQ ID NO: 328778 - protein, 24 aa, Mycobacterium
SEDERARWSLGETVTLRGHERPTR

SEQ ID NO: 328779 - protein, 24 aa, Mycobacterium
SEDGRVGLGTVQWTAPIGEVSDGA

SEQ ID NO: 328780 - protein, 19 aa, Mycobacterium
SEDIASIAVFIPVALLANI

SEQ ID NO: 328781 - protein, 24 aa, Mycobacterium
SEDPNWVSVLGWQGGLPNDRGMFL

SEQ ID NO: 328782 - protein, 17 aa, Mycobacterium
SEEAGGLYGDVLAEGDI

SEQ ID NO: 328783 - protein, 21 aa, Mycobacterium
SEFDKTGFVEVVLAKEGSGAA

SEQ ID NO: 328784 - protein, 18 aa, Mycobacterium
SEFGLRPNPSVFRVLNTM

SEQ ID NO: 328785 - protein, 30 aa, Mycobacterium
SEFHGRFAPSVFVRVRLSWWIGTLAPAIGI

SEQ ID NO: 328786 - protein, 25 aa, Mycobacterium
SEGAAFGFFPILWIVINAIWVYQMT

SEQ ID NO: 328787 - protein, 19 aa, Mycobacterium
SEGADWDLLIAGISSLCLI

SEQ ID NO: 328788 - protein, 23 aa, Mycobacterium
SEGAKWDLLIAGIASLCLIFVIM

SEQ ID NO: 328789 - protein, 23 aa, Mycobacterium
SEGAKWDLLIAGVASLCLIFIVM

SEQ ID NO: 328790 - protein, 24 aa, Mycobacterium
SEGDSRLVFLAAFAGFAVGLIPIS

SEQ ID NO: 328791 - protein, 23 aa, Mycobacterium
SEGGRRGVSIGVIVALVAVVVVV

SEQ ID NO: 328792 - protein, 17 aa, Mycobacterium
SEGILYFAIEERDASQR

SEQ ID NO: 328793 - protein, 25 aa, Mycobacterium
SEGKLVAPVKYPSLYAGDEDGKVTT

SEQ ID NO: 328794 - protein, 19 aa, Mycobacterium
SEGLLYFAIQMRDASERLV

SEQ ID NO: 328795 - protein, 20 aa, Mycobacterium
SEGMVAWIVGMVAIIAAALW

SEQ ID NO: 328796 - protein, 17 aa, Mycobacterium
SEGNLIDALEHVARLAL

SEQ ID NO: 328797 - protein, 24 aa, Mycobacterium
SEGPRPVVRSLLLHRELEDDMPTA

SEQ ID NO: 328798 - protein, 24 aa, Mycobacterium
SEHPLAGAIVRYAAAHGIASASLT

SEQ ID NO: 328799 - protein, 19 aa, Mycobacterium
SEHPLARAIVRAAQKRRIT

SEQ ID NO: 328800 - protein, 20 aa, Mycobacterium
SEHPRLVVLGMLRHGGTGAP

SEQ ID NO: 328801 - protein, 24 aa, Mycobacterium
SEHRAVRWICSALVEFFRAIPVLI

SEQ ID NO: 328802 - protein, 17 aa, Mycobacterium
SEHSRAVVVTTPQPALD

SEQ ID NO: 328803 - protein, 25 aa, Mycobacterium
SEIISGLCLLAVVLLVGVAGMHVDV

SEQ ID NO: 328804 - protein, 23 aa, Mycobacterium
SEIKPESAVVLLFINQTTTSQEI

SEQ ID NO: 328805 - protein, 27 aa, Mycobacterium
SEIKRFGRSRLTRVAIVVLMLLPLVYG

SEQ ID NO: 328806 - protein, 49 aa, Mycobacterium
SEIKRFGRSRMTRAAIVVLMLLPLVYGALYLWAYWDPFGHVNKMPVALV

SEQ ID NO: 328807 - protein, 17 aa, Mycobacterium
SEIPVLVLPAGKRIEFQ

SEQ ID NO: 328808 - protein, 22 aa, Mycobacterium
SEIPVLVLPAGKRIEFVLNSAD

SEQ ID NO: 328809 - protein, 20 aa, Mycobacterium
SEIRNADVLRMVIGGAALAL

SEQ ID NO: 328810 - protein, 19 aa, Mycobacterium
SEKEIIAGFPAGLFVILVG

SEQ ID NO: 328811 - protein, 21 aa, Mycobacterium
SELAKARRGPLVGIPGAPASI

SEQ ID NO: 328812 - protein, 17 aa, Mycobacterium
SELGGQPGLWIPGSSVS

SEQ ID NO: 328813 - protein, 18 aa, Mycobacterium
SELGSYDALLAVATVARS

SEQ ID NO: 328814 - protein, 20 aa, Mycobacterium
SELHPDSAVVLVFVNQSTQS

SEQ ID NO: 328815 - protein, 21 aa, Mycobacterium
SELHPGSAEVLLFVDQSTSSK

SEQ ID NO: 328816 - protein, 19 aa, Mycobacterium
SELHRACGADIARGSLRLW

SEQ ID NO: 328817 - protein, 24 aa, Mycobacterium
SELIPAIVVGAVLLLLGRPLSVLI

SEQ ID NO: 328818 - protein, 22 aa, Mycobacterium
SELKTANWSWALVGLLVSALTY

SEQ ID NO: 328819 - protein, 22 aa, Mycobacterium
SELPAGIVTAFLGAPVLIWLIR

SEQ ID NO: 328820 - protein, 20 aa, Mycobacterium
SELPDLGAPPVEPAGADERR

SEQ ID NO: 328821 - protein, 21 aa, Mycobacterium
SELPLREILPAVQRIVQPARE

SEQ ID NO: 328822 - protein, 23 aa, Mycobacterium
SELQKALGQRSAVLFGLAYMTPI

SEQ ID NO: 328823 - protein, 23 aa, Mycobacterium
SELQTRGGVLLEFQTEDRSGQIV

SEQ ID NO: 328824 - protein, 22 aa, Mycobacterium
SELRPPVRSGFGSRVELRLAAV

SEQ ID NO: 328825 - protein, 23 aa, Mycobacterium
SELRPPVRSGFGSRVELRLAAVE

SEQ ID NO: 328826 - protein, 21 aa, Mycobacterium
SELSDHTWATLGERLNDQQRM

SEQ ID NO: 328827 - protein, 33 aa, Mycobacterium
SELVEGPPPRWPWVVGVTAIIAAIALVASVALL

SEQ ID NO: 328828 - protein, 25 aa, Mycobacterium
SEMLPEMVRRPYLRATVFVVVLGFL

SEQ ID NO: 328829 - protein, 25 aa, Mycobacterium
SENRLKVKVVRPMTGFTPAQVLDAA

SEQ ID NO: 328830 - protein, 25 aa, Mycobacterium
SEPEPRWPRSEPIARRKSGPERSEY

SEQ ID NO: 328831 - protein, 26 aa, Mycobacterium
SEPFARITSVLTWIWIAAFAGMTVSS

SEQ ID NO: 328832 - protein, 27 aa, Mycobacterium
SEPVLQPWLGMLGHLVVAGPIPRMASA

SEQ ID NO: 328833 - protein, 26 aa, Mycobacterium
SEPVLTRSGAEWMPNFIDLLQRKLTR

SEQ ID NO: 328834 - protein, 19 aa, Mycobacterium
SEQFWRIPGGMAGVWTTVV

SEQ ID NO: 328835 - protein, 23 aa, Mycobacterium
SEQIMPLLVVSLMLQLVLAGGLV

SEQ ID NO: 328836 - protein, 19 aa, Mycobacterium
SERDPRTIGLVGIAITVVI

SEQ ID NO: 328837 - protein, 32 aa, Mycobacterium
SERLRCPIIAAPHPQLAVAFGAAFMAGQPDET

SEQ ID NO: 328838 - protein, 19 aa, Mycobacterium
SERRLMVATVLPLLPFGIP

SEQ ID NO: 328839 - protein, 25 aa, Mycobacterium
SERVLRPVAIQALRRGVPENVTAPG

SEQ ID NO: 328840 - protein, 20 aa, Mycobacterium
SERWTHPPILWAATDEDVGG

SEQ ID NO: 328841 - protein, 22 aa, Mycobacterium
SERYPRRLLRPIPSWFKELTHE

SEQ ID NO: 328842 - protein, 25 aa, Mycobacterium
SESALPRLIAKMAHLGVDKSTVGIV

SEQ ID NO: 328843 - protein, 24 aa, Mycobacterium
SESERARWSLGESVTLRGLDEPTR

SEQ ID NO: 328844 - protein, 25 aa, Mycobacterium
SESYRGAFRPYLEWLEEAGQECQQQ

SEQ ID NO: 328845 - protein, 22 aa, Mycobacterium
SETFDVIGMLLLSPGLPVLLYG

SEQ ID NO: 328846 - protein, 22 aa, Mycobacterium
SETLDIIGMLLLSPGLATFLYG

SEQ ID NO: 328847 - protein, 17 aa, Mycobacterium
SEVARGWIVAAIGALVV

SEQ ID NO: 328848 - protein, 18 aa, Mycobacterium
SEVFYKFPKLKVALSEGG

SEQ ID NO: 328849 - protein, 17 aa, Mycobacterium
SEVHLARDVRLHRDVAV

SEQ ID NO: 328850 - protein, 17 aa, Mycobacterium
SEVLQRWISESIHDGPL

SEQ ID NO: 328851 - protein, 26 aa, Mycobacterium
SEVNVAALVDAWLEAPAPILQQIIAN

SEQ ID NO: 328852 - protein, 20 aa, Mycobacterium
SEVPRIVWEGLLSLLMPVII

SEQ ID NO: 328853 - protein, 22 aa, Mycobacterium
SEVQYPLLTKMRSASRRAVVSL

SEQ ID NO: 328854 - protein, 23 aa, Mycobacterium
SEVRCAAMYYAVMTQLGFAAILL

SEQ ID NO: 328855 - protein, 23 aa, Mycobacterium
SEVRGFAGFPIGGRFLRADKPAL

SEQ ID NO: 328856 - protein, 28 aa, Mycobacterium
SEVWTHYSGWWVFDMTMLMLFGVAAAGF

SEQ ID NO: 328857 - protein, 33 aa, Mycobacterium
SEWFDELLYRLTAGAAKIPGGWFTVAVLVVLLA

SEQ ID NO: 328858 - protein, 28 aa, Mycobacterium
SEYFIGPKSIRVWLMLGVLLLSVVLAVR

SEQ ID NO: 328859 - protein, 27 aa, Mycobacterium
SEYLRALRVAILPAPPPPGPAFRTQQE

SEQ ID NO: 328860 - protein, 23 aa, Mycobacterium
SEYTRLGLCTVPVALVAAVIGLW

SEQ ID NO: 328861 - protein, 19 aa, Mycobacterium
SFAAIALEIEKWWRTGSPA

SEQ ID NO: 328862 - protein, 29 aa, Mycobacterium
SFAALAAMGVCFVVLIKWLVARRAAAFAY

SEQ ID NO: 328863 - protein, 28 aa, Mycobacterium
SFAPQMTWPEAMGLVIVDGLIIVALGIS

SEQ ID NO: 328864 - protein, 22 aa, Mycobacterium
SFDGFEYLFWVGCAGAYDDKAK

SEQ ID NO: 328865 - protein, 24 aa, Mycobacterium
SFDGWPTFIAFAAGLATYVAVALA

SEQ ID NO: 328866 - protein, 23 aa, Mycobacterium
SFDGYEYLFWVGCAGAYDDKAKK

SEQ ID NO: 328867 - protein, 18 aa, Mycobacterium
SFEAKKDIIAYVRTVAEE

SEQ ID NO: 328868 - protein, 17 aa, Mycobacterium
SFELSKANFGTVFITAV

SEQ ID NO: 328869 - protein, 17 aa, Mycobacterium
SFFAYSFDRTGLLLRST

SEQ ID NO: 328870 - protein, 19 aa, Mycobacterium
SFGDMRSAFYAGYDESDRE

SEQ ID NO: 328871 - protein, 21 aa, Mycobacterium
SFGEFEYWFSSIKVIAVVVFL

SEQ ID NO: 328872 - protein, 27 aa, Mycobacterium
SFGGFDLLALSPVFGFAQFALLIAGLT

SEQ ID NO: 328873 - protein, 22 aa, Mycobacterium
SFGGLLTFLGFLGIVLIAVGFT

SEQ ID NO: 328874 - protein, 30 aa, Mycobacterium
SFGGPAFFWTWPIVFLGQYMVALNFAELAA

SEQ ID NO: 328875 - protein, 24 aa, Mycobacterium
SFGLSVLVWQHFVGIELHWMVLPM

SEQ ID NO: 328876 - protein, 19 aa, Mycobacterium
SFGPMPLVLQYLGDHIDKL

SEQ ID NO: 328877 - protein, 20 aa, Mycobacterium
SFGWPSRMLMINQFGINLGF

SEQ ID NO: 328878 - protein, 24 aa, Mycobacterium
SFHATRWEMMLAVILPAIRTHVQT

SEQ ID NO: 328879 - protein, 17 aa, Mycobacterium
SFIPGFEAPELDSHILL

SEQ ID NO: 328880 - protein, 23 aa, Mycobacterium
SFISSRLGTTVIYGQGSGVYDHY

SEQ ID NO: 328881 - protein, 17 aa, Mycobacterium
SFLEFGTLAGFSFGALL

SEQ ID NO: 328882 - protein, 19 aa, Mycobacterium
SFLEYGIASMEMFRRRKFG

SEQ ID NO: 328883 - protein, 19 aa, Mycobacterium
SFLGIGMGFLISRKSWSIL

SEQ ID NO: 328884 - protein, 25 aa, Mycobacterium
SFLMQLCVQGAWGVIPAHLTEMSPD

SEQ ID NO: 328885 - protein, 25 aa, Mycobacterium
SFLMQVCVQGAWGVIPAHLTEMSPD

SEQ ID NO: 328886 - protein, 18 aa, Mycobacterium
SFLYEIGFQLAAFAVLLW

SEQ ID NO: 328887 - protein, 25 aa, Mycobacterium
SFLYMCASGSFIGFAFVFGQVLQFN

SEQ ID NO: 328888 - protein, 29 aa, Mycobacterium
SFMALCIPGALFMLGCFYVFGSLYHLHGA

SEQ ID NO: 328889 - protein, 22 aa, Mycobacterium
SFMNFAYGWAFSNPVRKIYYNI

SEQ ID NO: 328890 - protein, 23 aa, Mycobacterium
SFMNFAYGWAFSNPVRKIYYNIT

SEQ ID NO: 328891 - protein, 23 aa, Mycobacterium
SFMPPEAPSAVAAARAAQLFNQT

SEQ ID NO: 328892 - protein, 21 aa, Mycobacterium
SFPPIRVWGTVGFIAALHTVS

SEQ ID NO: 328893 - protein, 28 aa, Mycobacterium
SFPTFLRHIRPILGLGVGLVVVSAFAVA

SEQ ID NO: 328894 - protein, 21 aa, Mycobacterium
SFQRWDLFTPPKFVGLGNFRD

SEQ ID NO: 328895 - protein, 24 aa, Mycobacterium
SFQRWDVFTPPKFVGLKNFGELFT

SEQ ID NO: 328896 - protein, 19 aa, Mycobacterium
SFRAARAGDGVKLMNYMAL

SEQ ID NO: 328897 - protein, 29 aa, Mycobacterium
SFREIRWNLRVIIMFSVGLVIATAVAVSW

SEQ ID NO: 328898 - protein, 25 aa, Mycobacterium
SFRRRLDEYVGFLVAWQRPLAGKKT

SEQ ID NO: 328899 - protein, 20 aa, Mycobacterium
SFSALPYVEFHVSAIPNLMS

SEQ ID NO: 328900 - protein, 23 aa, Mycobacterium
SFSLRSRPKLAITDDGLVVRGWA

SEQ ID NO: 328901 - protein, 17 aa, Mycobacterium
SFSQRWASGGSVATYSE

SEQ ID NO: 328902 - protein, 34 aa, Mycobacterium
SFTFMTPAAFVRRPGRWIRELARKPGETGGTFSA

SEQ ID NO: 328903 - protein, 33 aa, Mycobacterium
SFTGAGSFFPLLMVGGLVAMLFGGRGGSQEMSR

SEQ ID NO: 328904 - protein, 35 aa, Mycobacterium
SFTLAVPRWPLLARLRGRHALVRAVDRVEAAVLVL

SEQ ID NO: 328905 - protein, 21 aa, Mycobacterium
SFTTMLPIVWAVKTAAHDGLS

SEQ ID NO: 328906 - protein, 23 aa, Mycobacterium
SFTTRPGSLIAVVGPSRARNSSL

SEQ ID NO: 328907 - protein, 28 aa, Mycobacterium
SFTVPSDSSWWWVCVAILALVTLLMSVN

SEQ ID NO: 328908 - protein, 17 aa, Mycobacterium
SFVAMFVVNAAPSVVLR

SEQ ID NO: 328909 - protein, 38 aa, Mycobacterium
SFVAPRLPTAWRVGLQAGLGCLLVWLTRAPVGLRPPRL

SEQ ID NO: 328910 - protein, 30 aa, Mycobacterium
SFVDRALGWALRLFAAVAVYNAVSMIASAM

SEQ ID NO: 328911 - protein, 33 aa, Mycobacterium
SFVEFSAYMAIPWLAAVAVEFALLSWLFSAELR

SEQ ID NO: 328912 - protein, 20 aa, Mycobacterium
SFVFRHRAGNAVIFALMMVA

SEQ ID NO: 328913 - protein, 28 aa, Mycobacterium
SFVGIVLVLMWWRRPPVRSDYPPERALA

SEQ ID NO: 328914 - protein, 18 aa, Mycobacterium
SFVQRLFSAEGFTSVAHV

SEQ ID NO: 328915 - protein, 19 aa, Mycobacterium
SFVRLLLVPVFLYLLLVAH

SEQ ID NO: 328916 - protein, 18 aa, Mycobacterium
SFVTARTALLDGILTFFV

SEQ ID NO: 328917 - protein, 20 aa, Mycobacterium
SFWQRLRVIVIPGATPQVLV

SEQ ID NO: 328918 - protein, 30 aa, Mycobacterium
SFWYVPKLGLRLVLLVGMLVMSVGFLCMRG

SEQ ID NO: 328919 - protein, 26 aa, Mycobacterium
SFWYVPKLGLRLVLSVGTLLMAVGFA

SEQ ID NO: 328920 - protein, 25 aa, Mycobacterium
SFYCAIARIPLGIAVTIEVLGPLIL

SEQ ID NO: 328921 - protein, 20 aa, Mycobacterium
SFYFVGWFLYNAMPSGFIEF

SEQ ID NO: 328922 - protein, 26 aa, Mycobacterium
SFYIATVACCSVLLLTGIAVVELAVT

SEQ ID NO: 328923 - protein, 20 aa, Mycobacterium
SFYIPPEVFDNADFKRGLKM

SEQ ID NO: 328924 - protein, 29 aa, Mycobacterium
SFYLPPEVFKNPDFIRGLKMFVSPDGKAV

SEQ ID NO: 328925 - protein, 20 aa, Mycobacterium
SFYLPPEVFNNAKFKRVMKM

SEQ ID NO: 328926 - protein, 22 aa, Mycobacterium
SGAAGLNAWLPLLAVGAADRLG

SEQ ID NO: 328927 - protein, 23 aa, Mycobacterium
SGAANFLIVWLIPVALGVGYARR

SEQ ID NO: 328928 - protein, 19 aa, Mycobacterium
SGAAVPRRIARFADRFAEL

SEQ ID NO: 328929 - protein, 19 aa, Mycobacterium
SGAAVRVLFQWRWSIATLW

SEQ ID NO: 328930 - protein, 21 aa, Mycobacterium
SGADTDYWLALDGARQTLADH

SEQ ID NO: 328931 - protein, 23 aa, Mycobacterium
SGAEAEPVWTTRLTGPTGATQIA

SEQ ID NO: 328932 - protein, 18 aa, Mycobacterium
SGAEAISVDGARIGPNVT

SEQ ID NO: 328933 - protein, 25 aa, Mycobacterium
SGAELRAQVLLGLRERELCPAAIDF

SEQ ID NO: 328934 - protein, 17 aa, Mycobacterium
SGAFGLSVLIWQHLIGL

SEQ ID NO: 328935 - protein, 20 aa, Mycobacterium
SGAFLYQWRDVIPARWSLVA

SEQ ID NO: 328936 - protein, 23 aa, Mycobacterium
SGAGEALRTMFIITGVALVGLVI

SEQ ID NO: 328937 - protein, 30 aa, Mycobacterium
SGAGKSCFLRAGIVPRLQRQASKYLVLDIV

SEQ ID NO: 328938 - protein, 17 aa, Mycobacterium
SGAICWAGGTTALVYYA

SEQ ID NO: 328939 - protein, 22 aa, Mycobacterium
SGAKYRIARLVAVVTGLLGTLL

SEQ ID NO: 328940 - protein, 30 aa, Mycobacterium
SGALFVRVGDRLYPALNLASARLITGRPDN

SEQ ID NO: 328941 - protein, 20 aa, Mycobacterium
SGALSWFSPLGWSLLVRPYA

SEQ ID NO: 328942 - protein, 18 aa, Mycobacterium
SGALYVRVGDTWHPVLNL

SEQ ID NO: 328943 - protein, 18 aa, Mycobacterium
SGALYVRVGEKLYPALNL

SEQ ID NO: 328944 - protein, 24 aa, Mycobacterium
SGAMTLVCTVLFAALLPKSQFFVP

SEQ ID NO: 328945 - protein, 26 aa, Mycobacterium
SGAMVFAILVLLGRYISYTLDLAGIA

SEQ ID NO: 328946 - protein, 20 aa, Mycobacterium
SGAPFPDRNLIIFVVSIVIL

SEQ ID NO: 328947 - protein, 17 aa, Mycobacterium
SGAQVEALFLPAHDPLA

SEQ ID NO: 328948 - protein, 19 aa, Mycobacterium
SGAQWGYRMVLPQLILMPI

SEQ ID NO: 328949 - protein, 19 aa, Mycobacterium
SGAQWGYRMVLPQLILMPV

SEQ ID NO: 328950 - protein, 17 aa, Mycobacterium
SGASRLQTRAVWRLVNF

SEQ ID NO: 328951 - protein, 26 aa, Mycobacterium
SGATAFWVCGLLLCLFIGPSQSSARA

SEQ ID NO: 328952 - protein, 34 aa, Mycobacterium
SGAYTVPDFAEFRLGSVWLRKVAMLVVVVICVFY

SEQ ID NO: 328953 - protein, 23 aa, Mycobacterium
SGCSWSEALALGWPEGITPEAHV

SEQ ID NO: 328954 - protein, 24 aa, Mycobacterium
SGCSWSEALGLGWPEGVTPEAHAN

SEQ ID NO: 328955 - protein, 23 aa, Mycobacterium
SGCSWSEVLGLGWPNGITPEAHA

SEQ ID NO: 328956 - protein, 21 aa, Mycobacterium
SGDAISRWAHNLNVLATQTAE

SEQ ID NO: 328957 - protein, 19 aa, Mycobacterium
SGDGLTPEGRVGRAVVAQN

SEQ ID NO: 328958 - protein, 23 aa, Mycobacterium
SGDIRIAFRDGRGGADIQPGQLL

SEQ ID NO: 328959 - protein, 26 aa, Mycobacterium
SGDLPRWLPRSLRRQLLLGVLAVVSV

SEQ ID NO: 328960 - protein, 25 aa, Mycobacterium
SGDPSGWPRLDWAMDAALLLVALAS

SEQ ID NO: 328961 - protein, 27 aa, Mycobacterium
SGDQARLRLAIRSGEMHFIPSNATVRI

SEQ ID NO: 328962 - protein, 24 aa, Mycobacterium
SGDRKLEAFAMFNIFYQAGILLGP

SEQ ID NO: 328963 - protein, 22 aa, Mycobacterium
SGEDLPAWPFAVGVVAAVGAAA

SEQ ID NO: 328964 - protein, 19 aa, Mycobacterium
SGEGGYYLPQRAWNDPRFQ

SEQ ID NO: 328965 - protein, 18 aa, Mycobacterium
SGEGRLTRALTWPSQAPV

SEQ ID NO: 328966 - protein, 20 aa, Mycobacterium
SGELCIRGPYLMQGYYGRSR

SEQ ID NO: 328967 - protein, 22 aa, Mycobacterium
SGEPRDCRLLGVDDMRPSERAQ

SEQ ID NO: 328968 - protein, 27 aa, Mycobacterium
SGETRLYLPMPFFWVGGFGSGILSVLL

SEQ ID NO: 328969 - protein, 18 aa, Mycobacterium
SGEVQLLLDNAALTEGET

SEQ ID NO: 328970 - protein, 17 aa, Mycobacterium
SGEYPPVRGVIHAAGVL

SEQ ID NO: 328971 - protein, 21 aa, Mycobacterium
SGFAHSWFFLFIFVIAGLIAV

SEQ ID NO: 328972 - protein, 18 aa, Mycobacterium
SGFANLEAIIGIAALAQN

SEQ ID NO: 328973 - protein, 23 aa, Mycobacterium
SGFGTAVGMAFLFRGLSRGAMSV

SEQ ID NO: 328974 - protein, 19 aa, Mycobacterium
SGFLITAAWVRRPNLKEYW

SEQ ID NO: 328975 - protein, 25 aa, Mycobacterium
SGFRIPWRDQVFLSWAGLRGAVPIV

SEQ ID NO: 328976 - protein, 17 aa, Mycobacterium
SGFSRFPVVHGDLDETV

SEQ ID NO: 328977 - protein, 17 aa, Mycobacterium
SGFTAAAPLVFALVSMQ

SEQ ID NO: 328978 - protein, 21 aa, Mycobacterium
SGFVVFVVWLAVSRYGNIPLG

SEQ ID NO: 328979 - protein, 31 aa, Mycobacterium
SGGAARAMFEPLLAGLRDFGCMALMMSGRPE

SEQ ID NO: 328980 - protein, 26 aa, Mycobacterium
SGGDLLWLWCYHLGWVVIALAIVAIW

SEQ ID NO: 328981 - protein, 19 aa, Mycobacterium
SGGFAAMLFGSVSAAVVLL

SEQ ID NO: 328982 - protein, 17 aa, Mycobacterium
SGGGCIYPSPPSPSAPP

SEQ ID NO: 328983 - protein, 23 aa, Mycobacterium
SGGGGAPWLWVGVAVAVVVAVAA

SEQ ID NO: 328984 - protein, 23 aa, Mycobacterium
SGGGGHEGHGGHSGGGNTTVTET

SEQ ID NO: 328985 - protein, 23 aa, Mycobacterium
SGGGRRGPGRGMAIGGGLGGLLI

SEQ ID NO: 328986 - protein, 19 aa, Mycobacterium
SGGLFPLALGVLQIIALDI

SEQ ID NO: 328987 - protein, 19 aa, Mycobacterium
SGGMPGIVPYLISPSGQQV

SEQ ID NO: 328988 - protein, 29 aa, Mycobacterium
SGGPLRYAGWSSCFRREAGSYGKDTRGII

SEQ ID NO: 328989 - protein, 31 aa, Mycobacterium; identical to SEQ ID NO: 12269

SEQ ID NO: 328990 - protein, 31 aa, Mycobacterium
SGGQRKRASVALELLTGPSLLILDEPTTGLD

SEQ ID NO: 328991 - protein, 17 aa, Mycobacterium
SGGRMGFGFGKSKAKML

SEQ ID NO: 328992 - protein, 26 aa, Mycobacterium
SGGVPIGGWISRTVFAAKFAERNFLF

SEQ ID NO: 328993 - protein, 22 aa, Mycobacterium
SGGVPIGNWLTRSVFAAKYAER

SEQ ID NO: 328994 - protein, 26 aa, Mycobacterium
SGGWYFWPVWPILGAGIGVLVHALPI

SEQ ID NO: 328995 - protein, 19 aa, Mycobacterium
SGHALGIMVCVLALLTVFT

SEQ ID NO: 328996 - protein, 23 aa, Mycobacterium
SGHARAILIYGLLLTAATAGAAA

SEQ ID NO: 328997 - protein, 24 aa, Mycobacterium
SGHERGRRAAAFASGGVLVVGAVA

SEQ ID NO: 328998 - protein, 22 aa, Mycobacterium
SGHPLLPLSLFTARNFAAVNLV

SEQ ID NO: 328999 - protein, 22 aa, Mycobacterium
SGHRRRMRGNADAIPVAELTGE

SEQ ID NO: 329000 - protein, 20 aa, Mycobacterium
SGHVPLFFIVWALSNFVGPL

SEQ ID NO: 329001 - protein, 26 aa, Mycobacterium
SGIAAVGCLIAFLWVERTAENPVVPF

SEQ ID NO: 329002 - protein, 31 aa, Mycobacterium
SGIAEGLRFVWNLRVLRTLGLIDLTVTALYL

SEQ ID NO: 329003 - protein, 36 aa, Mycobacterium
SGIALSATCYFFAELMLRPAATIALGGGQPTRRLAP

SEQ ID NO: 329004 - protein, 19 aa, Mycobacterium
SGIAVRMSLWYPDRAWWVL

SEQ ID NO: 329005 - protein, 18 aa, Mycobacterium
SGIDIPLARINSVEFRHG

SEQ ID NO: 329006 - protein, 19 aa, Mycobacterium
SGIESRFTGTVSYYDRPDQ

SEQ ID NO: 329007 - protein, 26 aa, Mycobacterium
SGIFPRWFPSSLRRQLLLGVLAVVSV

SEQ ID NO: 329008 - protein, 18 aa, Mycobacterium
SGIFRSDFGAITGPDTAP

SEQ ID NO: 329009 - protein, 19 aa, Mycobacterium
SGIGAAFGRILSAVGPALV

SEQ ID NO: 329010 - protein, 17 aa, Mycobacterium
SGIGFLINNARDFLRID

SEQ ID NO: 329011 - protein, 30 aa, Mycobacterium
SGILLSFWDWKSIFWALGAAGALVFVLTCT

SEQ ID NO: 329012 - protein, 24 aa, Mycobacterium
SGIPMKKMHAVAVPPNLAAVLLAV

SEQ ID NO: 329013 - protein, 26 aa, Mycobacterium
SGIREVRGFAGFPIGGRFLRTDNAAL

SEQ ID NO: 329014 - protein, 17 aa, Mycobacterium
SGIRLISPQTLFFPFVL

SEQ ID NO: 329015 - protein, 23 aa, Mycobacterium
SGKACGHAAVIVDAAVKAAADEV

SEQ ID NO: 329016 - protein, 18 aa, Mycobacterium
SGKAPVLFQIPGGAWTTG

SEQ ID NO: 329017 - protein, 21 aa, Mycobacterium
SGKDRVVLRLDLYPDEVKYIP

SEQ ID NO: 329018 - protein, 29 aa, Mycobacterium
SGKETLAPRSWRIVMTLQRDGGQLKVAKV

SEQ ID NO: 329019 - protein, 23 aa, Mycobacterium
SGKFGAGLTKWSVVIDAPPSSER

SEQ ID NO: 329020 - protein, 17 aa, Mycobacterium
SGKGHFDQDKWELFHVD

SEQ ID NO: 329021 - protein, 21 aa, Mycobacterium
SGKIRRAACVERYRRQQFTRL

SEQ ID NO: 329022 - protein, 21 aa, Mycobacterium
SGKIRRAACVERYRSDGFNRL

SEQ ID NO: 329023 - protein, 20 aa, Mycobacterium
SGKIVPAVLALLVVASLALL

SEQ ID NO: 329024 - protein, 18 aa, Mycobacterium
SGKLARRACQTEYLAGMY

SEQ ID NO: 329025 - protein, 22 aa, Mycobacterium
SGKSRSLLRNPLAWTVTLFFGC

SEQ ID NO: 329026 - protein, 20 aa, Mycobacterium
SGKSTFAWIAAGLTKPTTGQ

SEQ ID NO: 329027 - protein, 26 aa, Mycobacterium
SGKSTLALLAMRCYDVTAGAVRVGGH

SEQ ID NO: 329028 - protein, 18 aa, Mycobacterium
SGKVKRFNMFDTWVQAAP

SEQ ID NO: 329029 - protein, 21 aa, Mycobacterium
SGKVRRAQCVELYRQDEFTRL

SEQ ID NO: 329030 - protein, 21 aa, Mycobacterium
SGKVRRASSVQLYLDDKFSRL

SEQ ID NO: 329031 - protein, 37 aa, Mycobacterium
SGLAAAVFLVGWRGARWWRRGVAVLSIPLCVLCAGMA

SEQ ID NO: 329032 - protein, 25 aa, Mycobacterium
SGLAARLSPALSVVAAVTCAAMGLA

SEQ ID NO: 329033 - protein, 27 aa, Mycobacterium
SGLAFSAFDLMAWRITAGVAIGIASVI

SEQ ID NO: 329034 - protein, 19 aa, Mycobacterium
SGLAGRRIWDAALVAASPL

SEQ ID NO: 329035 - protein, 19 aa, Mycobacterium
SGLAKRHQSALVHITHYDN

SEQ ID NO: 329036 - protein, 39 aa, Mycobacterium
SGLARGGRSRLAFGLLAALLCLLLGIAIVTQVRQNESGD

SEQ ID NO: 329037 - protein, 24 aa, Mycobacterium
SGLATAVACPWPYPEAKVYDPQGY

SEQ ID NO: 329038 - protein, 20 aa, Mycobacterium
SGLCAAAYLVCRHAAGAAAP

SEQ ID NO: 329039 - protein, 19 aa, Mycobacterium
SGLCAAAYLVCRHAVGPSA

SEQ ID NO: 329040 - protein, 25 aa, Mycobacterium
SGLDRYVVADSWIKPIGGYQSALIK

SEQ ID NO: 329041 - protein, 28 aa, Mycobacterium
SGLEPGRLRPLATWGPWVSVGTTVLAGV

SEQ ID NO: 329042 - protein, 18 aa, Mycobacterium
SGLFAYISGASFVLQGQY

SEQ ID NO: 329043 - protein, 19 aa, Mycobacterium
SGLFLRLDLSAGIATALSA

SEQ ID NO: 329044 - protein, 17 aa, Mycobacterium
SGLGTVLLQAVSNQDIS

SEQ ID NO: 329045 - protein, 18 aa, Mycobacterium
SGLHFWLTGSLRGMLAPL

SEQ ID NO: 329046 - protein, 29 aa, Mycobacterium
SGLKARLSFLLVMLFVKPLLILFPIFDAG

SEQ ID NO: 329047 - protein, 21 aa, Mycobacterium
SGLLCSLCEPMLDLLGHLHWA

SEQ ID NO: 329048 - protein, 23 aa, Mycobacterium
SGLLLEHYSWRSTFIGTAAMAAV

SEQ ID NO: 329049 - protein, 20 aa, Mycobacterium
SGLLLFRPWVRAVATGAQAP

SEQ ID NO: 329050 - protein, 19 aa, Mycobacterium
SGLLSSMPSFGMVTTLIAW

SEQ ID NO: 329051 - protein, 19 aa, Mycobacterium
SGLMAAYVMVGFGSAGELA

SEQ ID NO: 329052 - protein, 17 aa, Mycobacterium
SGLMEFGPVLLVALGAV

SEQ ID NO: 329053 - protein, 18 aa, Mycobacterium
SGLMRKAKELVIATKMSG

SEQ ID NO: 329054 - protein, 32 aa, Mycobacterium
SGLMRKSKELVIATKMSGEWSKDDVLQAYLNI

SEQ ID NO: 329055 - protein, 59 aa, Mycobacterium
SGLMVPRRKELWLRAANAVAFILMVCAFFRWGFPATMWAVPFAVFFLLSAGSWRDGVGT

SEQ ID NO: 329056 - protein, 25 aa, Mycobacterium
SGLNINRFLGVDFAGFSKMVDALGG

SEQ ID NO: 329057 - protein, 21 aa, Mycobacterium
SGLPARLWRSPLRGPWLTAVF

SEQ ID NO: 329058 - protein, 25 aa, Mycobacterium
SGLPLGAGFVSEWLLVQSLIHARPE

SEQ ID NO: 329059 - protein, 26 aa, Mycobacterium
SGLPLGAGFVSEWLLVQSLIHARPEH

SEQ ID NO: 329060 - protein, 25 aa, Mycobacterium
SGLPLGAGFVSEWLLVQSLIHTARE

SEQ ID NO: 329061 - protein, 22 aa, Mycobacterium
SGLPQRHRTALVHITHFDNEAA

SEQ ID NO: 329062 - protein, 23 aa, Mycobacterium
SGLQPGPLGLRFLARLIDGLLVV

SEQ ID NO: 329063 - protein, 22 aa, Mycobacterium
SGLRILPMVIGMLITSIGSGSM

SEQ ID NO: 329064 - protein, 17 aa, Mycobacterium
SGLSRRKLFGAAGVTAA

SEQ ID NO: 329065 - protein, 20 aa, Mycobacterium
SGLTALTWPTMANFAVDSSM

SEQ ID NO: 329066 - protein, 20 aa, Mycobacterium
SGLTALTWPTVANFAVDAAM

SEQ ID NO: 329067 - protein, 21 aa, Mycobacterium
SGLTALTWPVMANFAVDSAMA

SEQ ID NO: 329068 - protein, 20 aa, Mycobacterium
SGLTALTWPVVANFAVDASM

SEQ ID NO: 329069 - protein, 20 aa, Mycobacterium
SGLTGTRFVACPFGEPGARM

SEQ ID NO: 329070 - protein, 33 aa, Mycobacterium
SGLVGRSGLVYDMWGGAVSLAYQMHSGAPQAGI

SEQ ID NO: 329071 - protein, 18 aa, Mycobacterium
SGLVLDRGAKVTYNGVEI

SEQ ID NO: 329072 - protein, 23 aa, Mycobacterium
SGLVLGCSIVFGVEQPRIHYTLV

SEQ ID NO: 329073 - protein, 20 aa, Mycobacterium
SGLYIPILLASAFGLGMAGQ

SEQ ID NO: 329074 - protein, 17 aa, Mycobacterium
SGLYLPLLLILVSMIVR

SEQ ID NO: 329075 - protein, 17 aa, Mycobacterium
SGLYPIATFGIGLVAFA

SEQ ID NO: 329076 - protein, 17 aa, Mycobacterium
SGLYPIATFGLGLVAFA

SEQ ID NO: 329077 - protein, 17 aa, Mycobacterium
SGLYPLATFALGMVAFA

SEQ ID NO: 329078 - protein, 19 aa, Mycobacterium
SGMAPRLVPDAVAAMAAAN

SEQ ID NO: 329079 - protein, 25 aa, Mycobacterium
SGMLREVGVLLLIALVLYCITQNFI

SEQ ID NO: 329080 - protein, 25 aa, Mycobacterium
SGNPFRVHGLLGLLGITRPTEVTIA

SEQ ID NO: 329081 - protein, 18 aa, Mycobacterium
SGNPYWLVGVQLLDGVGA

SEQ ID NO: 329082 - protein, 25 aa, Mycobacterium
SGNQFRLGLLFAVGSALAFGSSGPF

SEQ ID NO: 329083 - protein, 23 aa, Mycobacterium
SGNQVAATRLCLPDPAEADTLRM

SEQ ID NO: 329084 - protein, 24 aa, Mycobacterium
SGNRAIAMLGGWLSALAGAWFVVG

SEQ ID NO: 329085 - protein, 23 aa, Mycobacterium
SGNRVVLGVGVGWNLNDVRNHGA

SEQ ID NO: 329086 - protein, 21 aa, Mycobacterium
SGPASFPGVFIASAVIVALGL

SEQ ID NO: 329087 - protein, 22 aa, Mycobacterium
SGPFFKAYIPNLIPGQFSQPFI

SEQ ID NO: 329088 - protein, 33 aa, Mycobacterium
SGPGRQFRINWKWVRRGSAIAVAVMVLLPLITF

SEQ ID NO: 329089 - protein, 23 aa, Mycobacterium
SGPHMAVLVGIDLNPTIVDRLFM

SEQ ID NO: 329090 - protein, 25 aa, Mycobacterium
SGPIGFVGLILPHAVRLLVGSDHRR

SEQ ID NO: 329091 - protein, 27 aa, Mycobacterium
SGPKHARPGGIAKWIRVLAVPIILVWV

SEQ ID NO: 329092 - protein, 26 aa, Mycobacterium
SGPLADRTRRFWAWTVAGYALTLITV

SEQ ID NO: 329093 - protein, 20 aa, Mycobacterium
SGPLKFVLFNGAIAQLKLDV

SEQ ID NO: 329094 - protein, 22 aa, Mycobacterium
SGPLPYIVMEYVNGVTLRDIVH

SEQ ID NO: 329095 - protein, 19 aa, Mycobacterium
SGPLTGRFLPPVGGFLYWL

SEQ ID NO: 329096 - protein, 17 aa, Mycobacterium
SGPLTGRFMPPIGGILY

SEQ ID NO: 329097 - protein, 17 aa, Mycobacterium
SGPLTGRFMPPVGGFLY

SEQ ID NO: 329098 - protein, 25 aa, Mycobacterium
SGPPLPPVIEAFPGYHDVPKASTPA

SEQ ID NO: 329099 - protein, 24 aa, Mycobacterium
SGPPRGVPVLALRDVGHEYGSGTP

SEQ ID NO: 329100 - protein, 35 aa, Mycobacterium
SGPPRSLREQINWTWVRRGSLIAAVVLIVLPLLTF

SEQ ID NO: 329101 - protein, 23 aa, Mycobacterium
SGPRRRGAVIIPAYNEAAVIERT

SEQ ID NO: 329102 - protein, 26 aa, Mycobacterium
SGPTLRRPAVYRGWYALPERIAATLT

SEQ ID NO: 329103 - protein, 40 aa, Mycobacterium
SGPVRASMQIRRVDPWTVLKVSLVLSVVLFFVWMIAVAFL

SEQ ID NO: 329104 - protein, 30 aa, Mycobacterium
SGPWLPARWRHWWWALLLAFVPIHLVISAI

SEQ ID NO: 329105 - protein, 27 aa, Mycobacterium
SGPWLPARWRHWWWGLLLAFVPIHLVI

SEQ ID NO: 329106 - protein, 30 aa, Mycobacterium
SGPWLPARWRHWWWTLLWAFVPIHLVISAV

SEQ ID NO: 329107 - protein, 30 aa, Mycobacterium; identical to SEQ ID NO: 17670

SEQ ID NO: 329108 - protein, 30 aa, Mycobacterium
SGPWLPARWRRWWWALLLAFVPIHLVVSAV

SEQ ID NO: 329109 - protein, 26 aa, Mycobacterium
SGPWLPQRLRRWWWGLLLAFVPIHLV

SEQ ID NO: 329110 - protein, 33 aa, Mycobacterium
SGPYFKIVLSNLLPYWILQPFVDAAFKKRGIDP

SEQ ID NO: 329111 - protein, 17 aa, Mycobacterium
SGPYLPADLRLYDYDAF

SEQ ID NO: 329112 - protein, 20 aa, Mycobacterium
SGQIAALVPEEGWQGIAAQA

SEQ ID NO: 329113 - protein, 23 aa, Mycobacterium
SGQNPRVFHVLGVVMAAILLLML

SEQ ID NO: 329114 - protein, 21 aa, Mycobacterium
SGQWSWLKWLPHVDIPGQADG

SEQ ID NO: 329115 - protein, 23 aa, Mycobacterium
SGRAAAVGLGLAVLVMPVIGLWA

SEQ ID NO: 329116 - protein, 25 aa, Mycobacterium
SGRGWSDRALLLAGVAVLAILGLVT

SEQ ID NO: 329117 - protein, 26 aa, Mycobacterium
SGRKLVIACGLLLLIWVTRVPVPVGL

SEQ ID NO: 329118 - protein, 24 aa, Mycobacterium
SGRMLFGAELWEWVNPNNVTRTGD

SEQ ID NO: 329119 - protein, 24 aa, Mycobacterium
SGRMVGRFGARPSLLAAGTLFLTA

SEQ ID NO: 329120 - protein, 27 aa, Mycobacterium
SGRPAALKQRNWGWVLAIVVIVLALAA

SEQ ID NO: 329121 - protein, 38 aa, Mycobacterium
SGRRAGIAAGVFALIAFGLCWLALPLAFRSSNFRSTYM

SEQ ID NO: 329122 - protein, 21 aa, Mycobacterium
SGRREFLAFLQKFVVKKPVTR

SEQ ID NO: 329123 - protein, 24 aa, Mycobacterium
SGRRVSRMEGGLMVAAYLGYLAFV

SEQ ID NO: 329124 - protein, 26 aa, Mycobacterium
SGRYYFSITLPEDFSEAIASPSGDSP

SEQ ID NO: 329125 - protein, 24 aa, Mycobacterium
SGSALSWFSPIAWAQQMRSFVDLR

SEQ ID NO: 329126 - protein, 23 aa, Mycobacterium
SGSESWKAWFFGSFDPQNYVTVD

SEQ ID NO: 329127 - protein, 23 aa, Mycobacterium
SGSFLPRRRQWWTRGVAAAALCG

SEQ ID NO: 329128 - protein, 18 aa, Mycobacterium
SGSFPMAFAVLAAACAVM

SEQ ID NO: 329129 - protein, 17 aa, Mycobacterium
SGSFRRWERAMFVFIAI

SEQ ID NO: 329130 - protein, 18 aa, Mycobacterium
SGSGLGLALVAQQAELHG

SEQ ID NO: 329131 - protein, 27 aa, Mycobacterium
SGSGVAFLAFILWESRAKTRLIKPEGV

SEQ ID NO: 329132 - protein, 29 aa, Mycobacterium
SGSHSDLDWLWWFGAGWVAVAIVGAGVIL

SEQ ID NO: 329133 - protein, 23 aa, Mycobacterium
SGSRNVWLWVNWGLALATVPAAA

SEQ ID NO: 329134 - protein, 19 aa, Mycobacterium
SGSSCDRPGTSVFAMTTSN

SEQ ID NO: 329135 - protein, 27 aa, Mycobacterium
SGSSFNCARPGPLQWAFNVPGDVVPTA

SEQ ID NO: 329136 - protein, 24 aa, Mycobacterium
SGTDTFLRPSVPKVQAPVPRQQPK

SEQ ID NO: 329137 - protein, 22 aa, Mycobacterium
SGTETPAFWAFLVCYLCAAALT

SEQ ID NO: 329138 - protein, 18 aa, Mycobacterium
SGTHWRPQPEPHVAQPPV

SEQ ID NO: 329139 - protein, 17 aa, Mycobacterium
SGTLIGFAGAFGALGGV

SEQ ID NO: 329140 - protein, 27 aa, Mycobacterium
SGTLLFKLTPWIVVGVFAFGAAMALYF

SEQ ID NO: 329141 - protein, 25 aa, Mycobacterium
SGTLLFKLTPWIVVSVFVLGAALAT

SEQ ID NO: 329142 - protein, 19 aa, Mycobacterium
SGTLNIWGVSFPRAMFWTV

SEQ ID NO: 329143 - protein, 35 aa, Mycobacterium
SGTLPLVYLVYRSGWRWSDPEDRPGVLDWALAFVA

SEQ ID NO: 329144 - protein, 20 aa, Mycobacterium
SGTLSWLSPLGWSLLVKPYA

SEQ ID NO: 329145 - protein, 20 aa, Mycobacterium
SGTPGRPAVLGAVVLDAPAV

SEQ ID NO: 329146 - protein, 27 aa, Mycobacterium
SGTQVRFGPVVARPRPSAPVPILVGGA

SEQ ID NO: 329147 - protein, 27 aa, Mycobacterium
SGTSVMAVGGWRGDPVPTLPEFIDDVH

SEQ ID NO: 329148 - protein, 19 aa, Mycobacterium
SGTVGLLFAIILLDASLIG

SEQ ID NO: 329149 - protein, 20 aa, Mycobacterium
SGVANFLIVWLIPVVIGVGY

SEQ ID NO: 329150 - protein, 20 aa, Mycobacterium
SGVATGRGPAVMFFPAMMAM

SEQ ID NO: 329151 - protein, 24 aa, Mycobacterium
SGVDRSTVVLGMWQHLLHRYSGQE

SEQ ID NO: 329152 - protein, 24 aa, Mycobacterium
SGVFRAVVMAGLLMLASSSSIAVL

SEQ ID NO: 329153 - protein, 19 aa, Mycobacterium
SGVFVPVVLGLAVATLGFW

SEQ ID NO: 329154 - protein, 21 aa, Mycobacterium
SGVFWWSGPFLMFVVIPLADY

SEQ ID NO: 329155 - protein, 20 aa, Mycobacterium
SGVITRLAPFSWVWPALSLV

SEQ ID NO: 329156 - protein, 19 aa, Mycobacterium
SGVLNAERALTLSSAGALI

SEQ ID NO: 329157 - protein, 31 aa, Mycobacterium
SGVLQRPSFRMPWSPYSGWITLAFLASVLIL

SEQ ID NO: 329158 - protein, 18 aa, Mycobacterium
SGVQEPRSALSDGALVAL

SEQ ID NO: 329159 - protein, 21 aa, Mycobacterium
SGVVSRLNPALAVVAAVVCVA

SEQ ID NO: 329160 - protein, 26 aa, Mycobacterium
SGVWHRIAAAVARRPARVAIVSIGGL

SEQ ID NO: 329161 - protein, 27 aa, Mycobacterium
SGWIADRFGIRPVFLTAIAVFTIASIG

SEQ ID NO: 329162 - protein, 22 aa, Mycobacterium
SGWLPRVRRQGLAVVVAIVVWG

SEQ ID NO: 329163 - protein, 18 aa, Mycobacterium
SGYDFRPQIVGVFTDLSG

SEQ ID NO: 329164 - protein, 18 aa, Mycobacterium
SGYDFRPQIVGVFTDLTG

SEQ ID NO: 329165 - protein, 24 aa, Mycobacterium
SGYDLRLRRLPNWLTVPGAVLILV

SEQ ID NO: 329166 - protein, 19 aa, Mycobacterium
SGYFLYRAATVVVITTVYV

SEQ ID NO: 329167 - protein, 19 aa, Mycobacterium
SGYMWWRAQQEKVDSSNVN

SEQ ID NO: 329168 - protein, 19 aa, Mycobacterium
SHAALRCVGVGKCRVPEAQ

SEQ ID NO: 329169 - protein, 26 aa, Mycobacterium
SHAGGVAARWAHWVALPLGTVTPTRL

SEQ ID NO: 329170 - protein, 24 aa, Mycobacterium
SHAILDYLGTLAFAMSAALVAVEK

SEQ ID NO: 329171 - protein, 20 aa, Mycobacterium
SHARRARRIMLQNVGLSLAL

SEQ ID NO: 329172 - protein, 23 aa, Mycobacterium
SHARSSWLPMFILLIVLSSVAAA

SEQ ID NO: 329173 - protein, 22 aa, Mycobacterium
SHELRTPLAAIRGYTELAQRKQ

SEQ ID NO: 329174 - protein, 22 aa, Mycobacterium
SHELRTPLAAIRGYTELAQRKR

SEQ ID NO: 329175 - protein, 22 aa, Mycobacterium
SHELRTPLAAIRGYTELTQRMG

SEQ ID NO: 329176 - protein, 17 aa, Mycobacterium
SHELRTPLTAMRTNLEV

SEQ ID NO: 329177 - protein, 23 aa, Mycobacterium
SHELRTPLTTVRMAADLIYDNRE

SEQ ID NO: 329178 - protein, 19 aa, Mycobacterium
SHFPTWLNLLGIFVPSIGA

SEQ ID NO: 329179 - protein, 28 aa, Mycobacterium
SHGKKFTWHWWWLVAVVPVVLLIVMFVL

SEQ ID NO: 329180 - protein, 23 aa, Mycobacterium
SHHPWSALLVLFGIGVAGSAVGP

SEQ ID NO: 329181 - protein, 27 aa, Mycobacterium
SHINAPRAKLFAALFLILGLVVVGEVA

SEQ ID NO: 329182 - protein, 23 aa, Mycobacterium
SHLADHGWICVSIDYRVSPRNTW

SEQ ID NO: 329183 - protein, 27 aa, Mycobacterium
SHLDSELAWRLPFLLSSVLIVAGMIIR

SEQ ID NO: 329184 - protein, 18 aa, Mycobacterium
SHLFWAREEFQAQVPRWV

SEQ ID NO: 329185 - protein, 17 aa, Mycobacterium
SHLGYSRNFIWFVGALC

SEQ ID NO: 329186 - protein, 23 aa, Mycobacterium
SHLQRGYCRLMLRSLGVRMSVAG

SEQ ID NO: 329187 - protein, 21 aa, Mycobacterium
SHLRTAGAWVGGHIGTRLLQG

SEQ ID NO: 329188 - protein, 22 aa, Mycobacterium
SHLTVGGFRDWLLESASRDDGA

SEQ ID NO: 329189 - protein, 26 aa, Mycobacterium
SHPGRYAGGHWAWFRAARATHSGAAK

SEQ ID NO: 329190 - protein, 25 aa, Mycobacterium
SHPIIAKALSRWGHIVLPVALITIG

SEQ ID NO: 329191 - protein, 25 aa, Mycobacterium
SHPRPGDLPRVWALIQATRDDPLAP

SEQ ID NO: 329192 - protein, 20 aa, Mycobacterium
SHRALLLLNLHKLREINQSV

SEQ ID NO: 329193 - protein, 23 aa, Mycobacterium
SHRARGSFPYGTLVVNISGAALL

SEQ ID NO: 329194 - protein, 20 aa, Mycobacterium
SHRDGLRSAPAIAPAPERKR

SEQ ID NO: 329195 - protein, 23 aa, Mycobacterium
SHRKAVLIIYLWVAIIAFGAAST

SEQ ID NO: 329196 - protein, 25 aa, Mycobacterium
SHRMLLAVAVVIAFIAAVTGIVVAA

SEQ ID NO: 329197 - protein, 23 aa, Mycobacterium
SHRRAVLLIYLWVGIIAFGAAST

SEQ ID NO: 329198 - protein, 25 aa, Mycobacterium
SHRRVTRWEWIWAVLLAGAVAVIVT

SEQ ID NO: 329199 - protein, 18 aa, Mycobacterium
SHRRVVLLIYLWVGIVAF

SEQ ID NO: 329200 - protein, 19 aa, Mycobacterium
SHRRVVLLIYLWVGIVAFG

SEQ ID NO: 329201 - protein, 23 aa, Mycobacterium
SHRRVVLLIYLWVGIVAFGAAST

SEQ ID NO: 329202 - protein, 24 aa, Mycobacterium
SHRRVVLLIYLWVGIVAFGAASTI

SEQ ID NO: 329203 - protein, 23 aa, Mycobacterium
SHRRVVLLIYLWVGIVAIGAAST

SEQ ID NO: 329204 - protein, 26 aa, Mycobacterium
SHRWVLLKGRLVAGIASAFVMAITGI

SEQ ID NO: 329205 - protein, 20 aa, Mycobacterium
SHSNPAVVISHHLNSPPPKL

SEQ ID NO: 329206 - protein, 24 aa, Mycobacterium
SHTARPGLRMVVGAVVLVIAAALT

SEQ ID NO: 329207 - protein, 24 aa, Mycobacterium
SHTPRLAIRALRIGASVAAPRTMK

SEQ ID NO: 329208 - protein, 28 aa, Mycobacterium
SHVDEWRATFAVNVFGAVALTLALLPAL

SEQ ID NO: 329209 - protein, 20 aa, Mycobacterium
SHWALRRWGSHRLIPVMVAG

SEQ ID NO: 329210 - protein, 18 aa, Mycobacterium
SHYGSLMVTDAIIRVAVS

SEQ ID NO: 329211 - protein, 32 aa, Mycobacterium
SHYPLTWVASPGRRLWMKLEYRPDVVERDRAQ

SEQ ID NO: 329212 - protein, 32 aa, Mycobacterium
SIAALLGKWFWWPQMVRRRPKPSPWPKPIQRE

SEQ ID NO: 329213 - protein, 24 aa, Mycobacterium
SIAALLGRWFWWPLRVRTHGTAGV

SEQ ID NO: 329214 - protein, 18 aa, Mycobacterium
SIAALRAAIDKVPALAPG

SEQ ID NO: 329215 - protein, 22 aa, Mycobacterium
SIADFLKPGPRHVLVAEDDANQ

SEQ ID NO: 329216 - protein, 23 aa, Mycobacterium
SIAFAVGVIRLGRRQCLVNELPA

SEQ ID NO: 329217 - protein, 23 aa, Mycobacterium
SIAGLYAAWGIVIKGTLGVAASL

SEQ ID NO: 329218 - protein, 18 aa, Mycobacterium
SIAHGIRRFEFMIHADES

SEQ ID NO: 329219 - protein, 24 aa, Mycobacterium
SIAIKGFVFGIDFEGGTKVWFPKG

SEQ ID NO: 329220 - protein, 25 aa, Mycobacterium
SIALRRKFSASGFLDDVREYGATYA

SEQ ID NO: 329221 - protein, 22 aa, Mycobacterium
SIANDIAKYFAIIPALFVGLFP

SEQ ID NO: 329222 - protein, 29 aa, Mycobacterium
SIANDIAKYFAIIPAMFVALFPGLDTINV

SEQ ID NO: 329223 - protein, 18 aa, Mycobacterium
SIAPTILLSIPFNALSVF

SEQ ID NO: 329224 - protein, 30 aa, Mycobacterium
SIASALCFLPGLILGIFAQFTIPFAIDRSE

SEQ ID NO: 329225 - protein, 18 aa, Mycobacterium
SIAVVCWLVAAALLVGLA

SEQ ID NO: 329226 - protein, 17 aa, Mycobacterium
SIAYTAIVWWRIRLRRR

SEQ ID NO: 329227 - protein, 29 aa, Mycobacterium
SICDMAVPRFCRLVFVIGLLLSVTMATTV

SEQ ID NO: 329228 - protein, 19 aa, Mycobacterium
SIDAIRYALAFFLLQAVFV

SEQ ID NO: 329229 - protein, 23 aa, Mycobacterium
SIDARPGTLTAVIGPSGAGKSTF

SEQ ID NO: 329230 - protein, 26 aa, Mycobacterium
SIDRMGRRPILMIGIGIMIVADALLV

SEQ ID NO: 329231 - protein, 18 aa, Mycobacterium
SIEAGVPAELGWLKDEIA

SEQ ID NO: 329232 - protein, 18 aa, Mycobacterium
SIELSRTAVPVEWDEVKE

SEQ ID NO: 329233 - protein, 23 aa, Mycobacterium
SIEPALRFYIAFFLALLGVTWYC

SEQ ID NO: 329234 - protein, 17 aa, Mycobacterium
SIEPVWIIVLSPVFAWL

SEQ ID NO: 329235 - protein, 20 aa, Mycobacterium
SIESIRRWLIDGPAHLRREQ

SEQ ID NO: 329236 - protein, 20 aa, Mycobacterium
SIGAIWWARETFRDEITELD

SEQ ID NO: 329237 - protein, 26 aa, Mycobacterium
SIGLADEVLYFFLVESAIVFVAAYVL

SEQ ID NO: 329238 - protein, 17 aa, Mycobacterium
SIGPLGLAGRQRSQVVP

SEQ ID NO: 329239 - protein, 22 aa, Mycobacterium
SIGPWLLRTVFDPAYQAGGPLL

SEQ ID NO: 329240 - protein, 20 aa, Mycobacterium
SIGTLPTHRPQFVGLVAGVT

SEQ ID NO: 329241 - protein, 25 aa, Mycobacterium
SIHRAYRYARAMARWSPTSRSEIAD

SEQ ID NO: 329242 - protein, 17 aa, Mycobacterium
SILANFLSIIGLIGFIF

SEQ ID NO: 329243 - protein, 25 aa, Mycobacterium
SILGDLPWWVTVVILVREVAVTVLR

SEQ ID NO: 329244 - protein, 18 aa, Mycobacterium
SILGPRNAFPLAMTQPGP

SEQ ID NO: 329245 - protein, 18 aa, Mycobacterium
SILIPLKATLGFLLSIGA

SEQ ID NO: 329246 - protein, 19 aa, Mycobacterium
SILIRGLMNYTFWMPNGSP

SEQ ID NO: 329247 - protein, 18 aa, Mycobacterium
SILPVGISGLVLAAAVAA

SEQ ID NO: 329248 - protein, 18 aa, Mycobacterium
SILRDWRALGRHCVTVIA

SEQ ID NO: 329249 - protein, 17 aa, Mycobacterium
SILRVGVAVIMFSAMPS

SEQ ID NO: 329250 - protein, 20 aa, Mycobacterium
SILVGWRYAAGTALLALVAA

SEQ ID NO: 329251 - protein, 18 aa, Mycobacterium
SINAKPGYVTSYYFSPED

SEQ ID NO: 329252 - protein, 20 aa, Mycobacterium
SINILVALRVKVASDQTENE

SEQ ID NO: 329253 - protein, 19 aa, Mycobacterium
SINPVLSCGSVMITPQASL

SEQ ID NO: 329254 - protein, 19 aa, Mycobacterium
SIPAARELFILDPTNMTTT

SEQ ID NO: 329255 - protein, 19 aa, Mycobacterium
SIPARMPVETFKFAPDAAG

SEQ ID NO: 329256 - protein, 32 aa, Mycobacterium
SIPDATKAAARWIRPLMPPFVARVIDNTTQPL

SEQ ID NO: 329257 - protein, 31 aa, Mycobacterium
SIPDATKAAARWIRPLVPPFVARVIDNTTQP

SEQ ID NO: 329258 - protein, 27 aa, Mycobacterium
SIPGIAHFFTMWGFFILLTVYIEAYGF

SEQ ID NO: 329259 - protein, 27 aa, Mycobacterium
SIPLITARLSQRFGVPVRSAAQPASLA

SEQ ID NO: 329260 - protein, 18 aa, Mycobacterium
SIPLLINAFGERWEFAAE

SEQ ID NO: 329261 - protein, 17 aa, Mycobacterium
SIPLPWMAVLIANDRPP

SEQ ID NO: 329262 - protein, 21 aa, Mycobacterium
SIPLVGLFVRILRVRPAILAP

SEQ ID NO: 329263 - protein, 20 aa, Mycobacterium
SIRDTWLLALLYLGTFGSFI

SEQ ID NO: 329264 - protein, 18 aa, Mycobacterium
SIRLDWGALLIVSIVSLL

SEQ ID NO: 329265 - protein, 18 aa, Mycobacterium
SIRRGRLHPLLLVSISAI

SEQ ID NO: 329266 - protein, 21 aa, Mycobacterium
SISILFLFFFQLVQGRLPLHL

SEQ ID NO: 329267 - protein, 28 aa, Mycobacterium
SISLPGSRTEFYWVFTGIAMVLMFYELF

SEQ ID NO: 329268 - protein, 23 aa, Mycobacterium
SISTNWPSPTFLYRLRARRPKRR

SEQ ID NO: 329269 - protein, 17 aa, Mycobacterium
SISVDWQVTGLFVAAAM

SEQ ID NO: 329270 - protein, 19 aa, Mycobacterium
SISVRRRGRSLGQMARDEL

SEQ ID NO: 329271 - protein, 18 aa, Mycobacterium
SITDRFDGLLARNYGMAT

SEQ ID NO: 329272 - protein, 20 aa, Mycobacterium
SITHDFWPAPELVMDTGNSL

SEQ ID NO: 329273 - protein, 20 aa, Mycobacterium
SITLDGQWVLVTFTVADGIR

SEQ ID NO: 329274 - protein, 18 aa, Mycobacterium
SITPRTLKVLPRSETLIM

SEQ ID NO: 329275 - protein, 30 aa, Mycobacterium
SITTHFLGFHWSLPVGVGYLLAAVAGATTT

SEQ ID NO: 329276 - protein, 19 aa, Mycobacterium
SIVAALFIYALWVATLGFQ

SEQ ID NO: 329277 - protein, 18 aa, Mycobacterium
SIVAALFIYALWVATLGL

SEQ ID NO: 329278 - protein, 18 aa, Mycobacterium
SIVAALFVFSLWIATLGF

SEQ ID NO: 329279 - protein, 19 aa, Mycobacterium
SIVAISVLRLEGAGRPDRA

SEQ ID NO: 329280 - protein, 23 aa, Mycobacterium
SIVCGAVLLLGRLIGLRTSVVLA

SEQ ID NO: 329281 - protein, 21 aa, Mycobacterium
SIVGRRGLARVLAGAMLAGAV

SEQ ID NO: 329282 - protein, 19 aa, Mycobacterium
SIVGVAVMIFSYMQVPTLL

SEQ ID NO: 329283 - protein, 19 aa, Mycobacterium
SIVMPWPTVEVAVAVVAVT

SEQ ID NO: 329284 - protein, 19 aa, Mycobacterium
SIVTLALVVGVWFVVLGIF

SEQ ID NO: 329285 - protein, 22 aa, Mycobacterium
SIYAFECPLLLGTTAVLMDRWD

SEQ ID NO: 329286 - protein, 18 aa, Mycobacterium
SIYALFWGTAGVPGMTHP

SEQ ID NO: 329287 - protein, 26 aa, Mycobacterium
SIYLTNTWLPYLFKVAGFATGSISIL

SEQ ID NO: 329288 - protein, 22 aa, Mycobacterium
SKAEWFFGAVVFVAVAVTMWQT

SEQ ID NO: 329289 - protein, 25 aa, Mycobacterium
SKAPLDRISITWTDGSGRTRVNPNV

SEQ ID NO: 329290 - protein, 18 aa, Mycobacterium
SKASVVLDISPVSARLAV

SEQ ID NO: 329291 - protein, 23 aa, Mycobacterium
SKDAFPASFIVKLKDPEKHADFD

SEQ ID NO: 329292 - protein, 22 aa, Mycobacterium
SKDMPVVIGVTLFVAAVYVLAN

SEQ ID NO: 329293 - protein, 17 aa, Mycobacterium
SKEGPRKLTEIIDGGTF

SEQ ID NO: 329294 - protein, 19 aa, Mycobacterium
SKEHALHYYSRDALKPEVP

SEQ ID NO: 329295 - protein, 21 aa, Mycobacterium
SKFTASAAMWGLQGGDPAEQV

SEQ ID NO: 329296 - protein, 20 aa, Mycobacterium
SKGLKWLSNINMALAALLAL

SEQ ID NO: 329297 - protein, 22 aa, Mycobacterium
SKHAVEMIVPALVFGLVYAILQ

SEQ ID NO: 329298 - protein, 20 aa, Mycobacterium
SKHPERFGKGAVEGVAAPET

SEQ ID NO: 329299 - protein, 26 aa, Mycobacterium
SKIATGCPFCRVMLTDGVTARDDSAA

SEQ ID NO: 329300 - protein, 29 aa, Mycobacterium
SKILECSTGEFRVQAGLFSSIVAEAYQAA

SEQ ID NO: 329301 - protein, 17 aa, Mycobacterium
SKILLLIFFSAVLTAKR

SEQ ID NO: 329302 - protein, 19 aa, Mycobacterium
SKKDCKQNPIFDPLQPDDP

SEQ ID NO: 329303 - protein, 22 aa, Mycobacterium
SKKDCKQNPVFDPLQPSDPRDW

SEQ ID NO: 329304 - protein, 17 aa, Mycobacterium
SKLKAAGFSKFKQANSP

SEQ ID NO: 329305 - protein, 20 aa, Mycobacterium
SKLMQCVASGPGYSQSQPTL

SEQ ID NO: 329306 - protein, 19 aa, Mycobacterium
SKLSSLLFRKPATDRSASR

SEQ ID NO: 329307 - protein, 21 aa, Mycobacterium
SKLWLSRWERGPLEMLWQASY

SEQ ID NO: 329308 - protein, 20 aa, Mycobacterium
SKNALPPCPPPAPKTPPPPA

SEQ ID NO: 329309 - protein, 26 aa, Mycobacterium
SKPAARAASPFVFVYNYLKQVVAEMR

SEQ ID NO: 329310 - protein, 19 aa, Mycobacterium
SKPAFEVLAPFVVDGGPTV

SEQ ID NO: 329311 - protein, 18 aa, Mycobacterium
SKPAQWRAIRRAIDAHDE

SEQ ID NO: 329312 - protein, 21 aa, Mycobacterium
SKPFFAQGLLNRRAVLKSSYA

SEQ ID NO: 329313 - protein, 21 aa, Mycobacterium
SKPFFAQGLMNRRAVLKSSYA

SEQ ID NO: 329314 - protein, 19 aa, Mycobacterium
SKPGVRIVLADGEIQSDAA

SEQ ID NO: 329315 - protein, 26 aa, Mycobacterium
SKQGIVYRPSFRMWGAPYTGYLTLVF

SEQ ID NO: 329316 - protein, 17 aa, Mycobacterium
SKQRGLFAWMELSTVLR

SEQ ID NO: 329317 - protein, 21 aa, Mycobacterium
SKRCRRVVVVAAVLDGVFDWV

SEQ ID NO: 329318 - protein, 18 aa, Mycobacterium
SKSQGLSVADLVLVPPHS

SEQ ID NO: 329319 - protein, 21 aa, Mycobacterium
SKSRVALYLLITIAPFAVIAP

SEQ ID NO: 329320 - protein, 17 aa, Mycobacterium
SKSVIVLKRSMSSGYAG

SEQ ID NO: 329321 - protein, 24 aa, Mycobacterium
SKTYRWTFAQVVGSPPRITMLETQ

SEQ ID NO: 329322 - protein, 18 aa, Mycobacterium
SKVALYLLITIAPFAVIA

SEQ ID NO: 329323 - protein, 18 aa, Mycobacterium
SKVALYLLITIAPFAVVA

SEQ ID NO: 329324 - protein, 17 aa, Mycobacterium
SKVPVFVFHPAGGSTVV

SEQ ID NO: 329325 - protein, 17 aa, Mycobacterium
SKWAFLLTFAGVGLNTN

SEQ ID NO: 329326 - protein, 25 aa, Mycobacterium
SLAAIPALMFPPLMEAAAGKNNSAA

SEQ ID NO: 329327 - protein, 36 aa, Mycobacterium
SLAAIPGIMWQRWLFAWPAMLAALIVAIGQPAMLPQ

SEQ ID NO: 329328 - protein, 29 aa, Mycobacterium
SLAALPLLSSMVVLFAFSGNTAMVVVGAL

SEQ ID NO: 329329 - protein, 28 aa, Mycobacterium
SLAANIVGGIDWDGHGLLGLEEAMDSVL

SEQ ID NO: 329330 - protein, 28 aa, Mycobacterium
SLAANIVGGIDWDGHGLLGLEESLDSVL

SEQ ID NO: 329331 - protein, 21 aa, Mycobacterium
SLAAPRRIIATAILVMAGAAI

SEQ ID NO: 329332 - protein, 21 aa, Mycobacterium
SLAARPGMLTAVIGPSGAGKS

SEQ ID NO: 329333 - protein, 19 aa, Mycobacterium
SLADGLARFTAELRQADPG

SEQ ID NO: 329334 - protein, 19 aa, Mycobacterium
SLAELMGGPDIEPVQSTLQ

SEQ ID NO: 329335 - protein, 17 aa, Mycobacterium
SLAFAMQAGCRFTAQLG

SEQ ID NO: 329336 - protein, 18 aa, Mycobacterium
SLAFAMQAGCRFTAQLGS

SEQ ID NO: 329337 - protein, 18 aa, Mycobacterium
SLAFAMQGGCRFTAQLGS

SEQ ID NO: 329338 - protein, 24 aa, Mycobacterium
SLAFAMQGGCRFTAQLGSMRIAEE

SEQ ID NO: 329339 - protein, 27 aa, Mycobacterium
SLAFIAIWATLGFKWFEELGGREYIAC

SEQ ID NO: 329340 - protein, 28 aa, Mycobacterium
SLAFQACFISAAAVAARFGAAALAAHQV

SEQ ID NO: 329341 - protein, 18 aa, Mycobacterium
SLAGLRGAVPIVLATFPV

SEQ ID NO: 329342 - protein, 18 aa, Mycobacterium
SLAKMPVVNRLDLSAYPD

SEQ ID NO: 329343 - protein, 19 aa, Mycobacterium
SLALAEIGEDVLLVEGDTR

SEQ ID NO: 329344 - protein, 19 aa, Mycobacterium
SLALAELGEDVLLVEGDTR

SEQ ID NO: 329345 - protein, 25 aa, Mycobacterium
SLAPGLRLGWLVLPASLLDAVVEAK

SEQ ID NO: 329346 - protein, 18 aa, Mycobacterium
SLAPIIAVWLLKTFDSSV

SEQ ID NO: 329347 - protein, 29 aa, Mycobacterium
SLARERGWEIRDFRTARKAARIGVPSALA

SEQ ID NO: 329348 - protein, 23 aa, Mycobacterium
SLARQGISYLVLRNDLDPESSRS

SEQ ID NO: 329349 - protein, 25 aa, Mycobacterium
SLASLRLWRHLGRLCLMSPDPSTNL

SEQ ID NO: 329350 - protein, 26 aa, Mycobacterium
SLASRGIDGVEFFSALHAGGALAKAA

SEQ ID NO: 329351 - protein, 19 aa, Mycobacterium
SLAVAVVVCTAALGVAIYK

SEQ ID NO: 329352 - protein, 20 aa, Mycobacterium
SLAVGPVWRVISPMRTVYLL

SEQ ID NO: 329353 - protein, 21 aa, Mycobacterium
SLAVLRWSWTPLLFAGSVLTL

SEQ ID NO: 329354 - protein, 17 aa, Mycobacterium
SLCALGRANGIDCAVVP

SEQ ID NO: 329355 - protein, 17 aa, Mycobacterium
SLDAMKVFEYVFATTRG

SEQ ID NO: 329356 - protein, 20 aa, Mycobacterium
SLDATISWTSDGIKESVQNA

SEQ ID NO: 329357 - protein, 24 aa, Mycobacterium
SLDDTWWRLPVLVLSAFANGWAEE

SEQ ID NO: 329358 - protein, 19 aa, Mycobacterium
SLDEARSGVDHGNYYFMLE

SEQ ID NO: 329359 - protein, 24 aa, Mycobacterium
SLDELRPAFDEVRPLKSGTDKSID

SEQ ID NO: 329360 - protein, 25 aa, Mycobacterium
SLDGKSAFVLLRLAGDIGQTQANKS

SEQ ID NO: 329361 - protein, 17 aa, Mycobacterium
SLDRLDALMPKLLSTLP

SEQ ID NO: 329362 - protein, 17 aa, Mycobacterium
SLDRVDVVQPMLFAVMV

SEQ ID NO: 329363 - protein, 28 aa, Mycobacterium
SLEDIIRFQAEFLWRDYFQPGITVDGEE

SEQ ID NO: 329364 - protein, 26 aa, Mycobacterium
SLEEPIAVIGMGCRFPGGITSPDALW

SEQ ID NO: 329365 - protein, 18 aa, Mycobacterium
SLEGWDISVERVGDASQT

SEQ ID NO: 329366 - protein, 17 aa, Mycobacterium
SLEQAWHGLRQWRLHAL

SEQ ID NO: 329367 - protein, 24 aa, Mycobacterium
SLERHGRDGWPDDVDLSRTVGWFT

SEQ ID NO: 329368 - protein, 23 aa, Mycobacterium
SLESRLAALGSRAAAMPKGPLPG

SEQ ID NO: 329369 - protein, 22 aa, Mycobacterium
SLESRLAALGSRAGAGALPKGP

SEQ ID NO: 329370 - protein, 18 aa, Mycobacterium
SLFAAIIGSVSFWGSLVA

SEQ ID NO: 329371 - protein, 19 aa, Mycobacterium
SLFARGHRGLGEWRGGHRS

SEQ ID NO: 329372 - protein, 19 aa, Mycobacterium
SLFATMVVSAFDHRFGWSP

SEQ ID NO: 329373 - protein, 17 aa, Mycobacterium
SLFSVALMAAMTLGAGT

SEQ ID NO: 329374 - protein, 18 aa, Mycobacterium
SLFTAALRLVMGPFAHSL

SEQ ID NO: 329375 - protein, 29 aa, Mycobacterium
SLFTASGYVLWWAVLFPAISVPIIASLVL

SEQ ID NO: 329376 - protein, 20 aa, Mycobacterium
SLFTSFAFALAFYFATIERQ

SEQ ID NO: 329377 - protein, 20 aa, Mycobacterium
SLFYYLRWIIPSFQRPAEGM

SEQ ID NO: 329378 - protein, 18 aa, Mycobacterium
SLGAAAFVEVGPSGGLTA

SEQ ID NO: 329379 - protein, 25 aa, Mycobacterium
SLGAAAGWRTPFAVLAALAMCTLVL

SEQ ID NO: 329380 - protein, 19 aa, Mycobacterium
SLGAAFGFSTLIWQHLGNF

SEQ ID NO: 329381 - protein, 29 aa, Mycobacterium
SLGAAVLLHGSWHWVFAALVVVAAALLVM

SEQ ID NO: 329382 - protein, 29 aa, Mycobacterium
SLGAAVLLKASWHWVFVALVILAGLLLVM

SEQ ID NO: 329383 - protein, 24 aa, Mycobacterium
SLGAGRLIFRATIQRLRDDEISGR

SEQ ID NO: 329384 - protein, 20 aa, Mycobacterium
SLGALTLVIGFIFDAILEVS

SEQ ID NO: 329385 - protein, 28 aa, Mycobacterium
SLGDHFGRRKVFVLGVVWFALASIACGL

SEQ ID NO: 329386 - protein, 23 aa, Mycobacterium
SLGDLDWPAGHFPVSVLHNRQLV

SEQ ID NO: 329387 - protein, 26 aa, Mycobacterium
SLGDRLGRRRLLLIGGAGFAVVSALA

SEQ ID NO: 329388 - protein, 19 aa, Mycobacterium
SLGDWLRGPYCALPDSARA

SEQ ID NO: 329389 - protein, 21 aa, Mycobacterium
SLGFLTVFGVFGLLISPVIAS

SEQ ID NO: 329390 - protein, 19 aa, Mycobacterium
SLGFWRGMLAIALGNAVLT

SEQ ID NO: 329391 - protein, 18 aa, Mycobacterium
SLGGLGWATKHIPIGTAY

SEQ ID NO: 329392 - protein, 35 aa, Mycobacterium
SLGGVLAYACAIGLKRLGKDVAFVGLIDAVRAGEE

SEQ ID NO: 329393 - protein, 28 aa, Mycobacterium
SLGGVLAYACAIGLKRLGKDVRFVGLID

SEQ ID NO: 329394 - protein, 26 aa, Mycobacterium
SLGIWRVGVRLPMVIGASYTGIAPML

SEQ ID NO: 329395 - protein, 17 aa, Mycobacterium
SLGKMALGLRVVSEDGS

SEQ ID NO: 329396 - protein, 27 aa, Mycobacterium
SLGLFGIRNGWWVYLTIYALFIGIHLS

SEQ ID NO: 329397 - protein, 18 aa, Mycobacterium
SLGLFGITAGWWIYLAAF

SEQ ID NO: 329398 - protein, 19 aa, Mycobacterium
SLGRALCGITVVRRDSHDG

SEQ ID NO: 329399 - protein, 19 aa, Mycobacterium
SLGRAMGVNLARITDVYDW

SEQ ID NO: 329400 - protein, 24 aa, Mycobacterium
SLGRLWPFASGTLVYPAGENDTMF

SEQ ID NO: 329401 - protein, 24 aa, Mycobacterium
SLGSARLMFRATLQRLRDDEISGR

SEQ ID NO: 329402 - protein, 22 aa, Mycobacterium
SLGSEGGVFAWVPMICGGLAGV

SEQ ID NO: 329403 - protein, 19 aa, Mycobacterium
SLGVEVWFLAALAAPLMTA

SEQ ID NO: 329404 - protein, 20 aa, Mycobacterium
SLGWQTWLILCAVVVVLWAA

SEQ ID NO: 329405 - protein, 19 aa, Mycobacterium
SLGYFAAVVGVVFAAGLVM

SEQ ID NO: 329406 - protein, 19 aa, Mycobacterium
SLHGPWVGLAAPGADIVGL

SEQ ID NO: 329407 - protein, 25 aa, Mycobacterium
SLHWKPTEAPVFYLGYAMLLVVAAA

SEQ ID NO: 329408 - protein, 20 aa, Mycobacterium
SLIAGVLWGAGWVAVLAVLT

SEQ ID NO: 329409 - protein, 24 aa, Mycobacterium
SLIALSFLGLRHLWAGSPESPELR

SEQ ID NO: 329410 - protein, 19 aa, Mycobacterium
SLICAITVAVLDRYLDTSG

SEQ ID NO: 329411 - protein, 26 aa, Mycobacterium
SLIDVLHWPGYLLVVAGVIGGVGSLA

SEQ ID NO: 329412 - protein, 27 aa, Mycobacterium
SLIDVMKYRDSWIIAFLYIGTFGSFIG

SEQ ID NO: 329413 - protein, 24 aa, Mycobacterium
SLIDVMSWPGYLFMLVGVIAVFRC

SEQ ID NO: 329414 - protein, 24 aa, Mycobacterium
SLIGAAVPVRWLALGMMALITALS

SEQ ID NO: 329415 - protein, 19 aa, Mycobacterium
SLIGGFAWHAWHRADHPLI

SEQ ID NO: 329416 - protein, 18 aa, Mycobacterium
SLILALLAFRHFGQGYAI

SEQ ID NO: 329417 - protein, 19 aa, Mycobacterium
SLIRERFGRGWAWLSAFTL

SEQ ID NO: 329418 - protein, 26 aa, Mycobacterium
SLIRNWPAWLGIYGFMTLDDWLIYKY

SEQ ID NO: 329419 - protein, 26 aa, Mycobacterium
SLIRNWPAWLGIYGFMTLDRWLLFNW

SEQ ID NO: 329420 - protein, 17 aa, Mycobacterium
SLIRRAADYFDRAVVTR

SEQ ID NO: 329421 - protein, 22 aa, Mycobacterium
SLIWEVLCYLAVAGIGLAGLAN

SEQ ID NO: 329422 - protein, 18 aa, Mycobacterium
SLIWNCVFIGAGYGLGAN

SEQ ID NO: 329423 - protein, 27 aa, Mycobacterium
SLKHLRTRLRDEFGFPKAELHPQAYWT

SEQ ID NO: 329424 - protein, 24 aa, Mycobacterium
SLLALGWRPAAPFPTGNELAAASG

SEQ ID NO: 329425 - protein, 19 aa, Mycobacterium
SLLAPLFMVAVVTLSFAAA

SEQ ID NO: 329426 - protein, 34 aa, Mycobacterium
SLLASMSPLIRWIIKVPREFINSYLFNFPDTSFA

SEQ ID NO: 329427 - protein, 19 aa, Mycobacterium
SLLCGMAGSMAMLVGARAI

SEQ ID NO: 329428 - protein, 20 aa, Mycobacterium
SLLCGPVWRVLSPVRAAYRL

SEQ ID NO: 329429 - protein, 19 aa, Mycobacterium
SLLDSATFAGNWPGLNVVD

SEQ ID NO: 329430 - protein, 28 aa, Mycobacterium
SLLDTARIAFGWIRRPAAPGRLVVIADH

SEQ ID NO: 329431 - protein, 26 aa, Mycobacterium
SLLGALCLLGTLWLVIRARSSTRAGA

SEQ ID NO: 329432 - protein, 18 aa, Mycobacterium
SLLGDLLVATGLGIAMLV

SEQ ID NO: 329433 - protein, 22 aa, Mycobacterium
SLLGDLSWWVTAVILVREIGIT

SEQ ID NO: 329434 - protein, 27 aa, Mycobacterium
SLLGVFAFVCVLAFVMLLATLRSPVLA

SEQ ID NO: 329435 - protein, 17 aa, Mycobacterium
SLLHGWFPLSVQGLTLF

SEQ ID NO: 329436 - protein, 21 aa, Mycobacterium
SLLKHRWTIPTAFVLTLTATA

SEQ ID NO: 329437 - protein, 19 aa, Mycobacterium
SLLLGCAFGTVPVLAVHFS

SEQ ID NO: 329438 - protein, 25 aa, Mycobacterium
SLLLKAVAWALLYIVHRRNRTSRRF

SEQ ID NO: 329439 - protein, 17 aa, Mycobacterium
SLLLKLDIARGYLAVAL

SEQ ID NO: 329440 - protein, 19 aa, Mycobacterium
SLLPALLSGAGLAFSRAIG

SEQ ID NO: 329441 - protein, 20 aa, Mycobacterium
SLLPHLWKATLVSGVLAVVL

SEQ ID NO: 329442 - protein, 17 aa, Mycobacterium
SLLPPSRAHWFGTDLQG

SEQ ID NO: 329443 - protein, 22 aa, Mycobacterium
SLLPRGALFQGLVSGISGAIGY

SEQ ID NO: 329444 - protein, 19 aa, Mycobacterium
SLLRGRTGEVLAHAGANPC

SEQ ID NO: 329445 - protein, 22 aa, Mycobacterium
SLLRIGVVALMIAAMLTDTRRS

SEQ ID NO: 329446 - protein, 20 aa, Mycobacterium
SLLRKQRIGPVWLTAVGYAV

SEQ ID NO: 329447 - protein, 22 aa, Mycobacterium
SLLRLPRLPDLVAVPPTLADHL

SEQ ID NO: 329448 - protein, 22 aa, Mycobacterium
SLLRLPRLPDLVAVPPTLIDHL

SEQ ID NO: 329449 - protein, 24 aa, Mycobacterium
SLLRQWGDLSGWLADEVEDLKAAD

SEQ ID NO: 329450 - protein, 17 aa, Mycobacterium
SLLRSMISHNTFFSLSK

SEQ ID NO: 329451 - protein, 28 aa, Mycobacterium
SLLTAIIMGAAWARFGNPAWITHRLARP

SEQ ID NO: 329452 - protein, 24 aa, Mycobacterium
SLLVGRLGDRFGVKNLYLMGLAVF

SEQ ID NO: 329453 - protein, 19 aa, Mycobacterium
SLLVTLAIAIAVDYAIFLI

SEQ ID NO: 329454 - protein, 18 aa, Mycobacterium
SLLWGIALDGFRPDRWDV

SEQ ID NO: 329455 - protein, 21 aa, Mycobacterium
SLMALCSLVIAIVPSREVIGA

SEQ ID NO: 329456 - protein, 24 aa, Mycobacterium
SLMALGWRVGDPFPTGAHLAAASG

SEQ ID NO: 329457 - protein, 18 aa, Mycobacterium
SLMLQLVLCGGMVPVTDR

SEQ ID NO: 329458 - protein, 17 aa, Mycobacterium
SLMPAFIAAWRSYRNRR

SEQ ID NO: 329459 - protein, 18 aa, Mycobacterium
SLMPFARMFFNTVLYAGC

SEQ ID NO: 329460 - protein, 20 aa, Mycobacterium
SLMSIPLWIIVVLPIAKIIA

SEQ ID NO: 329461 - protein, 19 aa, Mycobacterium
SLMTVRGAVAFLGFHDIIG

SEQ ID NO: 329462 - protein, 31 aa, Mycobacterium
SLMVFPALLVYSVWRMLNWLNISAKAGLWGL

SEQ ID NO: 329463 - protein, 18 aa, Mycobacterium
SLNAGYDAVIWVTSAYLL

SEQ ID NO: 329464 - protein, 22 aa, Mycobacterium
SLNEAKQGLEFVSDSDERTSLQ

SEQ ID NO: 329465 - protein, 23 aa, Mycobacterium
SLNTSYYRLMLKLENGPADVAEA

SEQ ID NO: 329466 - protein, 24 aa, Mycobacterium
SLNTSYYRLMLKLKGGPQAVADAA

SEQ ID NO: 329467 - protein, 24 aa, Mycobacterium
SLNTSYYRLMLKLKNGPQDVADAA

SEQ ID NO: 329468 - protein, 18 aa, Mycobacterium
SLPALRHDLAVLPEVANA

SEQ ID NO: 329469 - protein, 25 aa, Mycobacterium
SLPDAKSALASWLPPGPAPVADYPT

SEQ ID NO: 329470 - protein, 25 aa, Mycobacterium
SLPDAKSALASWLPPGPVPVADYPT

SEQ ID NO: 329471 - protein, 32 aa, Mycobacterium
SLPDATKAAARWIRPLVPPFVGRVIGTTTAPL

SEQ ID NO: 329472 - protein, 23 aa, Mycobacterium
SLPDVRWSTLPIWNSELVTAPLL

SEQ ID NO: 329473 - protein, 32 aa, Mycobacterium
SLPEATRAAARWIRPLVPPFVARVIDTTTQPL

SEQ ID NO: 329474 - protein, 19 aa, Mycobacterium
SLPEGLTYGLLRYLNPEVD

SEQ ID NO: 329475 - protein, 23 aa, Mycobacterium
SLPKRVHERFDLVGFDPRGVASS

SEQ ID NO: 329476 - protein, 21 aa, Mycobacterium
SLPLMVLVGWLVSRSRNGRTR

SEQ ID NO: 329477 - protein, 20 aa, Mycobacterium
SLPMRRMVGFLATGLDASLI

SEQ ID NO: 329478 - protein, 25 aa, Mycobacterium
SLPPEARRPAGLKAFAGSAASVLTN

SEQ ID NO: 329479 - protein, 18 aa, Mycobacterium
SLPQLLKLWGGTMFANLV

SEQ ID NO: 329480 - protein, 19 aa, Mycobacterium
SLPRTFGRMVGSKKQGYAI

SEQ ID NO: 329481 - protein, 19 aa, Mycobacterium
SLPRTFGRMVGSPKQGIAI

SEQ ID NO: 329482 - protein, 19 aa, Mycobacterium
SLPRWYWAGLAVATLLGTV

SEQ ID NO: 329483 - protein, 24 aa, Mycobacterium
SLPTRPDAVFLVGSGIDLPLIKPT

SEQ ID NO: 329484 - protein, 25 aa, Mycobacterium
SLPVPLPTHRLILGAVLAMAVFLIA

SEQ ID NO: 329485 - protein, 18 aa, Mycobacterium
SLQACNWYLGALGAILDI

SEQ ID NO: 329486 - protein, 25 aa, Mycobacterium
SLQQIGPTFRYREFSGDEIDQLILS

SEQ ID NO: 329487 - protein, 17 aa, Mycobacterium
SLQRILLGFGLAAVVGI

SEQ ID NO: 329488 - protein, 19 aa, Mycobacterium
SLRAESMLIDPGLDGAGDR

SEQ ID NO: 329489 - protein, 20 aa, Mycobacterium
SLRGEAVGVYVGFSNNDYQF

SEQ ID NO: 329490 - protein, 17 aa, Mycobacterium
SLRGKVVLVDFWAYSCI

SEQ ID NO: 329491 - protein, 29 aa, Mycobacterium
SLRGQRLRPAASYRSFVTWLSERDQVAAQ

SEQ ID NO: 329492 - protein, 20 aa, Mycobacterium
SLRIPARVLTAAQIRSADEA

SEQ ID NO: 329493 - protein, 18 aa, Mycobacterium
SLRIRPVVFEAGRVLTEP

SEQ ID NO: 329494 - protein, 20 aa, Mycobacterium
SLRLRLLVGQIVVLAIVCVG

SEQ ID NO: 329495 - protein, 20 aa, Mycobacterium
SLRLTVAVRANAQWAVEREL

SEQ ID NO: 329496 - protein, 26 aa, Mycobacterium
SLRPDRNLFVPLAFHLGYHSLPIGNV

SEQ ID NO: 329497 - protein, 20 aa, Mycobacterium
SLRQRVAFTSAIAGAIVVLI

SEQ ID NO: 329498 - protein, 26 aa, Mycobacterium
SLRRAGVVLACAFAVFTASVLQDPMI

SEQ ID NO: 329499 - protein, 20 aa, Mycobacterium
SLRRDWPALMGIDDPDALDV

SEQ ID NO: 329500 - protein, 22 aa, Mycobacterium
SLRRGWTMAAICFVAVALGAVW

SEQ ID NO: 329501 - protein, 26 aa, Mycobacterium
SLRSHIGMVLQDTWLFDGTISENIAY

SEQ ID NO: 329502 - protein, 26 aa, Mycobacterium
SLRSRIGMVLQDTWLFDGTIAQNIAY

SEQ ID NO: 329503 - protein, 22 aa, Mycobacterium
SLRTRVAFATAIGAAIVVVIVG

SEQ ID NO: 329504 - protein, 21 aa, Mycobacterium
SLSAFLSYFAQILMAVLMATM

SEQ ID NO: 329505 - protein, 17 aa, Mycobacterium
SLSAGWQLTFGPYVADY

SEQ ID NO: 329506 - protein, 17 aa, Mycobacterium
SLSAPRRVIAVVVLVMI

SEQ ID NO: 329507 - protein, 26 aa, Mycobacterium
SLSDRFGRRGWLNSGLALFAVTSAVA

SEQ ID NO: 329508 - protein, 26 aa, Mycobacterium
SLSDRYGRRGWLIAGLALFAMTSGVA

SEQ ID NO: 329509 - protein, 28 aa, Mycobacterium
SLSDRYGRRGWLSAGLILFALTSALAAQ

SEQ ID NO: 329510 - protein, 28 aa, Mycobacterium
SLSFAVADETAWLWAARLGQGIGAAAFS

SEQ ID NO: 329511 - protein, 21 aa, Mycobacterium
SLSPRMSIILAGLTPGEASPA

SEQ ID NO: 329512 - protein, 32 aa, Mycobacterium
SLSQCHMLWYLALCAQAGIVVTAYRDRPAGTM

SEQ ID NO: 329513 - protein, 25 aa, Mycobacterium
SLSQRFSRRYTIIFCALLGLPIVPL

SEQ ID NO: 329514 - protein, 24 aa, Mycobacterium
SLTAALWVLALWVVFQAGAAAPTA

SEQ ID NO: 329515 - protein, 22 aa, Mycobacterium
SLTADGGLDWHVTDLAEARSGV

SEQ ID NO: 329516 - protein, 19 aa, Mycobacterium
SLTAGFGLAAPFLIYGAAL

SEQ ID NO: 329517 - protein, 20 aa, Mycobacterium
SLTAQFGAAVAFTVLMYAVV

SEQ ID NO: 329518 - protein, 20 aa, Mycobacterium
SLTARPGTLTAIIGGSGAGK

SEQ ID NO: 329519 - protein, 23 aa, Mycobacterium
SLTARPGTLTALIGGSGAGKTTL

SEQ ID NO: 329520 - protein, 17 aa, Mycobacterium
SLTAVELRNRIKAATGM

SEQ ID NO: 329521 - protein, 17 aa, Mycobacterium
SLTAVFGALVWVFQDGH

SEQ ID NO: 329522 - protein, 25 aa, Mycobacterium
SLTLLPALIALAGRYGLAQPRNPNR

SEQ ID NO: 329523 - protein, 24 aa, Mycobacterium
SLTLLPALIGLAGRRGLAQPRPLR

SEQ ID NO: 329524 - protein, 19 aa, Mycobacterium
SLTNPRLIGYIIAAAPLVM

SEQ ID NO: 329525 - protein, 20 aa, Mycobacterium
SLTQRSRFLIAVSAVLVLLL

SEQ ID NO: 329526 - protein, 33 aa, Mycobacterium
SLTRRIAVFILLLCLFGTLAVLLRRGVLPGLAS

SEQ ID NO: 329527 - protein, 29 aa, Mycobacterium
SLTVPARGVWWWVSICVMGLAVLAMLVNR

SEQ ID NO: 329528 - protein, 18 aa, Mycobacterium
SLTVPGHTGFGYADPTSD

SEQ ID NO: 329529 - protein, 21 aa, Mycobacterium
SLTYLDVCDQVLLLAPGGKTA

SEQ ID NO: 329530 - protein, 23 aa, Mycobacterium
SLTYLSYCDQVLLLAPGGKTAYC

SEQ ID NO: 329531 - protein, 24 aa, Mycobacterium
SLVAGRLGDRFGVKNLYLAGLAVF

SEQ ID NO: 329532 - protein, 17 aa, Mycobacterium
SLVALHLAVQSLRSREC

SEQ ID NO: 329533 - protein, 27 aa, Mycobacterium
SLVCSLAGMLCCLPGLAGLVLGILGMR

SEQ ID NO: 329534 - protein, 20 aa, Mycobacterium
SLVFEVMCYIAVAGLGLLGL

SEQ ID NO: 329535 - protein, 22 aa, Mycobacterium
SLVGLPASFALVVPVAHVIGNT

SEQ ID NO: 329536 - protein, 30 aa, Mycobacterium
SLVGVLVLLKAVAYWLDRYELLSHTRGGKP

SEQ ID NO: 329537 - protein, 20 aa, Mycobacterium
SLVIKRRRVWARLSPGAAAG

SEQ ID NO: 329538 - protein, 19 aa, Mycobacterium
SLVIMPALSWAQRRTGREL

SEQ ID NO: 329539 - protein, 26 aa, Mycobacterium
SLVKLFDWLPMFVLIAGIFGWVTDAL

SEQ ID NO: 329540 - protein, 19 aa, Mycobacterium
SLVKRVCPSASWPRIDVAK

SEQ ID NO: 329541 - protein, 18 aa, Mycobacterium
SLVLNWLIGPAVMFALAW

SEQ ID NO: 329542 - protein, 20 aa, Mycobacterium
SLVLVLGLVAAFVGLKLYQK

SEQ ID NO: 329543 - protein, 22 aa, Mycobacterium
SLVPCLAVTLFWGLRSERSRRH

SEQ ID NO: 329544 - protein, 22 aa, Mycobacterium
SLVQLVSLWGLQQISWFVPAQW

SEQ ID NO: 329545 - protein, 17 aa, Mycobacterium
SLVRSWTLIPGLAAAGL

SEQ ID NO: 329546 - protein, 17 aa, Mycobacterium
SLVRVLAPVFGRDMGLG

SEQ ID NO: 329547 - protein, 18 aa, Mycobacterium
SLVSTVAYLRSWRNNPAS

SEQ ID NO: 329548 - protein, 24 aa, Mycobacterium
SLVSWCGLPIPVLSGVLAPVALRD

SEQ ID NO: 329549 - protein, 19 aa, Mycobacterium
SLVTAWLTPFGPVALGLKV

SEQ ID NO: 329550 - protein, 17 aa, Mycobacterium
SLVVHWATMQDLYGITE

SEQ ID NO: 329551 - protein, 31 aa, Mycobacterium
SLVVMNWLGLSWRWLFALSIVPALVSLIIRY

SEQ ID NO: 329552 - protein, 27 aa, Mycobacterium
SLVVWRLRSPATFRRYVATPARRARWL

SEQ ID NO: 329553 - protein, 19 aa, Mycobacterium
SLWIPILIIGCVYVPYMAR

SEQ ID NO: 329554 - protein, 26 aa, Mycobacterium
SLWVFARFGLALSMIVYGMAKAIPTQ

SEQ ID NO: 329555 - protein, 19 aa, Mycobacterium
SLWVTRTIARRSQRLFVAQ

SEQ ID NO: 329556 - protein, 28 aa, Mycobacterium
SLYRIGALCPYCMLVWVVTITLLVVAAS

SEQ ID NO: 329557 - protein, 25 aa, Mycobacterium
SLYRIGALCPYCMVVWAVTIPLAVV

SEQ ID NO: 329558 - protein, 25 aa, Mycobacterium
SLYRIGALCPYCMVVWAVTIPLLVV

SEQ ID NO: 329559 - protein, 25 aa, Mycobacterium
SLYRIGALCPYCMVVWAVTMSLLVV

SEQ ID NO: 329560 - protein, 22 aa, Mycobacterium
SMAALPPFFGFIAKEADFETVL

SEQ ID NO: 329561 - protein, 25 aa, Mycobacterium
SMAGCYPARELFGALYSAYAEQFSA

SEQ ID NO: 329562 - protein, 31 aa, Mycobacterium
SMAGLKLPSWGSLRLALPVGGNGDATFLAGE

SEQ ID NO: 329563 - protein, 22 aa, Mycobacterium
SMARRASARAARWRTGQFTYHP

SEQ ID NO: 329564 - protein, 21 aa, Mycobacterium
SMARRASARAARWRTGQFTYR

SEQ ID NO: 329565 - protein, 21 aa, Mycobacterium
SMATLVFGFVLMWILAWLTAT

SEQ ID NO: 329566 - protein, 28 aa, Mycobacterium
SMAVMVLFPMHFLKSFAYAGVATVAFAA

SEQ ID NO: 329567 - protein, 25 aa, Mycobacterium
SMDANAALRWSLIAGASCNDAALTH

SEQ ID NO: 329568 - protein, 20 aa, Mycobacterium
SMDANYRWFHPAPTTLAAAV

SEQ ID NO: 329569 - protein, 20 aa, Mycobacterium
SMDANYRWFHPAPTTLSAAV

SEQ ID NO: 329570 - protein, 24 aa, Mycobacterium
SMEEPVTCWQWVKAAGEQQSRTVL

SEQ ID NO: 329571 - protein, 17 aa, Mycobacterium
SMFKMMGVTGVVIMIML

SEQ ID NO: 329572 - protein, 19 aa, Mycobacterium
SMFPFVWNVFKSWRYGEVV

SEQ ID NO: 329573 - protein, 27 aa, Mycobacterium
SMFPFVWNVFKSWRYGEVVTVDDPWGY

SEQ ID NO: 329574 - protein, 22 aa, Mycobacterium
SMGALCAMLTLFVAASHNPWTA

SEQ ID NO: 329575 - protein, 19 aa, Mycobacterium
SMIGLLALPGYRTNYNDRD

SEQ ID NO: 329576 - protein, 22 aa, Mycobacterium
SMKAMMRLGSNFHEFNSNSTVM

SEQ ID NO: 329577 - protein, 28 aa, Mycobacterium
SMKEMGKAFGRPGIDNAVIIVMHGDKGF

SEQ ID NO: 329578 - protein, 27 aa, Mycobacterium
SMLKHKRIAAIIGVMVLVVASSVVAVL

SEQ ID NO: 329579 - protein, 18 aa, Mycobacterium
SMLLPAFIALTGIGAALF

SEQ ID NO: 329580 - protein, 19 aa, Mycobacterium
SMLLPAFIAVFGIIAALFL

SEQ ID NO: 329581 - protein, 24 aa, Mycobacterium
SMLNDLPWWVTVLILSRELGVTML

SEQ ID NO: 329582 - protein, 25 aa, Mycobacterium
SMLPDYRTVAALPLAYAIIVSGALL

SEQ ID NO: 329583 - protein, 20 aa, Mycobacterium
SMLPGPRPPAPIEPTEQKEL

SEQ ID NO: 329584 - protein, 25 aa, Mycobacterium
SMLQRKLRVGFAKAGRLMDLMETRN

SEQ ID NO: 329585 - protein, 20 aa, Mycobacterium
SMLRTSRVVFTLAADKNAGI

SEQ ID NO: 329586 - protein, 26 aa, Mycobacterium
SMLSWLPQFHDMGLIGMLLWPLFYGG

SEQ ID NO: 329587 - protein, 21 aa, Mycobacterium
SMLTLVAVLAMMLSISPLLAV

SEQ ID NO: 329588 - protein, 21 aa, Mycobacterium
SMLVLAIPVNYIWDFAVEGTA

SEQ ID NO: 329589 - protein, 17 aa, Mycobacterium
SMMALVILDVCWVPLLA

SEQ ID NO: 329590 - protein, 17 aa, Mycobacterium
SMMLFPFLMTVVLKNSL

SEQ ID NO: 329591 - protein, 17 aa, Mycobacterium
SMMLFPFLMTVVLPNSV

SEQ ID NO: 329592 - protein, 26 aa, Mycobacterium
SMNFSARLLPEFAGAVAKTGLTIGLA

SEQ ID NO: 329593 - protein, 29 aa, Mycobacterium
SMNHIIIPLPWLLQAPRLFAGQIQLGAVT

SEQ ID NO: 329594 - protein, 17 aa, Mycobacterium
SMPRAFVYTALGASIGD

SEQ ID NO: 329595 - protein, 19 aa, Mycobacterium
SMQAVIIFIILAASIGLGF

SEQ ID NO: 329596 - protein, 29 aa, Mycobacterium
SMQLSLPGWVRARGLSVYQLVFMGGQALG

SEQ ID NO: 329597 - protein, 18 aa, Mycobacterium
SMRIFKSEIREMQSENKP

SEQ ID NO: 329598 - protein, 18 aa, Mycobacterium
SMRIPRWVEVTAGEVPAT

SEQ ID NO: 329599 - protein, 24 aa, Mycobacterium
SMRKPHRYVGFRQRCVTSWAGFRG

SEQ ID NO: 329600 - protein, 19 aa, Mycobacterium
SMRLTFGVLQSYLSPANLE

SEQ ID NO: 329601 - protein, 21 aa, Mycobacterium
SMRPDCLRRLDEVDAVVIDPR

SEQ ID NO: 329602 - protein, 18 aa, Mycobacterium
SMRRFAWAPGAPVLDPLP

SEQ ID NO: 329603 - protein, 22 aa, Mycobacterium
SMRRMSVSPAFGYSYLIIYSLS

SEQ ID NO: 329604 - protein, 19 aa, Mycobacterium
SMSAAMIAMAWRIGPASHG

SEQ ID NO: 329605 - protein, 20 aa, Mycobacterium
SMSAHFTFGLALLTGLYVAA

SEQ ID NO: 329606 - protein, 18 aa, Mycobacterium
SMSAHVTFGLALLTGLYV

SEQ ID NO: 329607 - protein, 19 aa, Mycobacterium
SMSVLRLVTFTTDVSIFAL

SEQ ID NO: 329608 - protein, 17 aa, Mycobacterium
SMTLAWPGGLLDADDVS

SEQ ID NO: 329609 - protein, 20 aa, Mycobacterium
SMVAWTLRFGLFAYGDPGDG

SEQ ID NO: 329610 - protein, 28 aa, Mycobacterium
SMVFFWGWGELTALMIFGSIRNTNWATT

SEQ ID NO: 329611 - protein, 24 aa, Mycobacterium
SNALNAWRLALAGEVIFWHTYPVR

SEQ ID NO: 329612 - protein, 24 aa, Mycobacterium
SNARGEVVSLGFIISLWAGSSAIS

SEQ ID NO: 329613 - protein, 20 aa, Mycobacterium
SNAVTYHWGSPNVANAGTAN

SEQ ID NO: 329614 - protein, 20 aa, Mycobacterium
SNFFAWALSVMFLVFSLRAL

SEQ ID NO: 329615 - protein, 24 aa, Mycobacterium
SNFGEIEFWFALIKLAAIGCLIVV

SEQ ID NO: 329616 - protein, 25 aa, Mycobacterium
SNFGVPWSNAFPAWHYAFATALLGL

SEQ ID NO: 329617 - protein, 25 aa, Mycobacterium
SNFGVPWSNSFPAWHYAFATALLGL

SEQ ID NO: 329618 - protein, 31 aa, Mycobacterium
SNFGVPWSNSFPEFKFGFTTMLLGLSVLALL

SEQ ID NO: 329619 - protein, 19 aa, Mycobacterium
SNFSAGWAIFGIRGALLPL

SEQ ID NO: 329620 - protein, 18 aa, Mycobacterium
SNFWGRHLVMGLPMAAAL

SEQ ID NO: 329621 - protein, 23 aa, Mycobacterium
SNGFPTPYYLAAMAAVLTSGAAV

SEQ ID NO: 329622 - protein, 24 aa, Mycobacterium
SNGLNRFRTFFGFTLNDPANRRML

SEQ ID NO: 329623 - protein, 29 aa, Mycobacterium
SNIKTPAWLRGLMPVVIIPLIASLAVGLI

SEQ ID NO: 329624 - protein, 20 aa, Mycobacterium
SNILPITFAALGVVALVGGG

SEQ ID NO: 329625 - protein, 19 aa, Mycobacterium
SNINMVLAISLAFFVFVVG

SEQ ID NO: 329626 - protein, 19 aa, Mycobacterium
SNISPHFPYAAQIWQGMWQ

SEQ ID NO: 329627 - protein, 18 aa, Mycobacterium
SNLLFLWERHRVGELLDA

SEQ ID NO: 329628 - protein, 21 aa, Mycobacterium
SNLPGAPLIPATIDFSDHPHA

SEQ ID NO: 329629 - protein, 24 aa, Mycobacterium
SNMHRPRFAHLVRIFAVPIILGWV

SEQ ID NO: 329630 - protein, 24 aa, Mycobacterium
SNMPYRVGLIGGLALLPLLALLAL

SEQ ID NO: 329631 - protein, 18 aa, Mycobacterium
SNPGFSFSGFARAIKNNL

SEQ ID NO: 329632 - protein, 19 aa, Mycobacterium
SNPGFSFSGFARAVKNNLF

SEQ ID NO: 329633 - protein, 25 aa, Mycobacterium
SNQLRPVYNLTSARLVLGNASNPVA

SEQ ID NO: 329634 - protein, 18 aa, Mycobacterium
SNRLAHKLIEYGAGPGER

SEQ ID NO: 329635 - protein, 17 aa, Mycobacterium
SNRRVVGVWVVFVLALA

SEQ ID NO: 329636 - protein, 26 aa, Mycobacterium
SNRTLKPLPVRAFDVRCAQQAYRYVS

SEQ ID NO: 329637 - protein, 29 aa, Mycobacterium
SNSMGWNFSAAKNVFAWIGPVLAALQGNP

SEQ ID NO: 329638 - protein, 17 aa, Mycobacterium
SNSTLPVAVRWVATTIM

SEQ ID NO: 329639 - protein, 20 aa, Mycobacterium
SNTALRWVQNALSFIGFVPP

SEQ ID NO: 329640 - protein, 17 aa, Mycobacterium
SNTALWLIPVVVVVVLA

SEQ ID NO: 329641 - protein, 26 aa, Mycobacterium
SNVFGLAWRLDRGAVLVWTVGLVLYG

SEQ ID NO: 329642 - protein, 18 aa, Mycobacterium
SNVHFTPTYSSWRNQVER

SEQ ID NO: 329643 - protein, 17 aa, Mycobacterium
SNVLHSFQFTKYRIDRV

SEQ ID NO: 329644 - protein, 24 aa, Mycobacterium
SNVLRAQRAIQMMIGVTLGIGLGS

SEQ ID NO: 329645 - protein, 24 aa, Mycobacterium
SNVLRAQRAVQMMVGVTLGIGLGS

SEQ ID NO: 329646 - protein, 17 aa, Mycobacterium
SNVPLPWTLSVTTTLPS

SEQ ID NO: 329647 - protein, 17 aa, Mycobacterium
SNVPRWIPRVSAWDPPA

SEQ ID NO: 329648 - protein, 17 aa, Mycobacterium
SNWIGSIEPVWIIVLSP

SEQ ID NO: 329649 - protein, 17 aa, Mycobacterium
SNWLSVLPLQYTDASGH

SEQ ID NO: 329650 - protein, 17 aa, Mycobacterium
SNWLSVLPLQYTDKSGH

SEQ ID NO: 329651 - protein, 25 aa, Mycobacterium
SNYFCVGGAIFLLASVFFQARQHLS

SEQ ID NO: 329652 - protein, 26 aa, Mycobacterium
SNYGEVFALMPFWRMLFNTVLYAGCV

SEQ ID NO: 329653 - protein, 19 aa, Mycobacterium
SPADARGRVAGLFSSGFMI

SEQ ID NO: 329654 - protein, 26 aa, Mycobacterium
SPAEPAHPRWWFISTTPGRILTIGIV

SEQ ID NO: 329655 - protein, 26 aa, Mycobacterium
SPAEPAHPRWWFVSTTPGRILTIGIV

SEQ ID NO: 329656 - protein, 20 aa, Mycobacterium
SPAERWHLLARTWLDLPGRP

SEQ ID NO: 329657 - protein, 25 aa, Mycobacterium
SPAIEARFPWYVQMWGGRQWARSLH

SEQ ID NO: 329658 - protein, 24 aa, Mycobacterium
SPAKFEVIAKFILGIPLLVLAWLF

SEQ ID NO: 329659 - protein, 19 aa, Mycobacterium
SPALSQRVHWLSKRLSIQH

SEQ ID NO: 329660 - protein, 18 aa, Mycobacterium
SPARLRAAPATEFTVIDA

SEQ ID NO: 329661 - protein, 30 aa, Mycobacterium
SPARVREIIELKGPDIYRSITVTREVYTVR

SEQ ID NO: 329662 - protein, 24 aa, Mycobacterium
SPASSPTPPARRVGDVPDPAAAVN

SEQ ID NO: 329663 - protein, 19 aa, Mycobacterium
SPATSSWLVCDTVAGPSTM

SEQ ID NO: 329664 - protein, 19 aa, Mycobacterium
SPAVMPWAQLDEFYRGSNR

SEQ ID NO: 329665 - protein, 18 aa, Mycobacterium
SPAVPLTAAVVFTCIVIT

SEQ ID NO: 329666 - protein, 18 aa, Mycobacterium
SPAWNHAYVIAALRAGLI

SEQ ID NO: 329667 - protein, 22 aa, Mycobacterium
SPCILPVLPVILLSGAGGTRAD

SEQ ID NO: 329668 - protein, 22 aa, Mycobacterium
SPCILPVLPVLLLSGAGGSRGI

SEQ ID NO: 329669 - protein, 18 aa, Mycobacterium
SPCVIPLVPGYLSYLAAV

SEQ ID NO: 329670 - protein, 23 aa, Mycobacterium
SPDGKHLYARIAASQTSNRLDVI

SEQ ID NO: 329671 - protein, 23 aa, Mycobacterium
SPDGRSGVAMVWLVGEVGSDKAR

SEQ ID NO: 329672 - protein, 20 aa, Mycobacterium
SPDPANWAVVGWSMGGTCAV

SEQ ID NO: 329673 - protein, 18 aa, Mycobacterium
SPDPRYAESMYYVDPQGV

SEQ ID NO: 329674 - protein, 23 aa, Mycobacterium
SPDRRIMLADFGIAGWVGEASGL

SEQ ID NO: 329675 - protein, 19 aa, Mycobacterium
SPEETWRALLEGRDAITDL

SEQ ID NO: 329676 - protein, 23 aa, Mycobacterium
SPEFNRTALERFLAVAIPLFALP

SEQ ID NO: 329677 - protein, 19 aa, Mycobacterium
SPELHPWLRDHTVDGVVLF

SEQ ID NO: 329678 - protein, 33 aa, Mycobacterium
SPELLTSLLAKVSWRRRRTRIVTWVASAAAAVV

SEQ ID NO: 329679 - protein, 25 aa, Mycobacterium
SPELWPKLKSFMADLVWIENIGARG

SEQ ID NO: 329680 - protein, 20 aa, Mycobacterium
SPELYCLFHHGANVLPKVTD

SEQ ID NO: 329681 - protein, 21 aa, Mycobacterium
SPEPRYGENLYYIDPQGVRYG

SEQ ID NO: 329682 - protein, 21 aa, Mycobacterium
SPEPSNWGIVGWSMGGTCAVD

SEQ ID NO: 329683 - protein, 24 aa, Mycobacterium
SPEQKARLISALRRTGRSVGFLGD

SEQ ID NO: 329684 - protein, 22 aa, Mycobacterium
SPERFRQALFRALAGVIEIWML

SEQ ID NO: 329685 - protein, 25 aa, Mycobacterium
SPERFRQALFRGISGFIEIWMLTGG

SEQ ID NO: 329686 - protein, 24 aa, Mycobacterium
SPERTKRSALREFALLAVIAVALY

SEQ ID NO: 329687 - protein, 23 aa, Mycobacterium
SPETRRALAPARQWGFFILLILL

SEQ ID NO: 329688 - protein, 19 aa, Mycobacterium
SPEVLNIVFTDFKLRSAAG

SEQ ID NO: 329689 - protein, 17 aa, Mycobacterium
SPFAGIAPWALLSILSG

SEQ ID NO: 329690 - protein, 18 aa, Mycobacterium
SPFDARLLQILKDNDAKA

SEQ ID NO: 329691 - protein, 24 aa, Mycobacterium
SPFGWYYDLLALWAHVSTASVWMR

SEQ ID NO: 329692 - protein, 25 aa, Mycobacterium
SPFGWYYDLLTIWAHVSTASVWMRL

SEQ ID NO: 329693 - protein, 25 aa, Mycobacterium
SPFKMPGGVVMCWVVLAFFVFLVWA

SEQ ID NO: 329694 - protein, 24 aa, Mycobacterium
SPFSWSHHWVWFVPLVVHLGYRGY

SEQ ID NO: 329695 - protein, 24 aa, Mycobacterium
SPFSWTHHWVWVVPLMVWFVHRAL

SEQ ID NO: 329696 - protein, 18 aa, Mycobacterium
SPFYPVLQQHLGYSAATS

SEQ ID NO: 329697 - protein, 31 aa, Mycobacterium
SPGAPVHVLAHDWGSVGVWHYLKRPGAGDRV

SEQ ID NO: 329698 - protein, 19 aa, Mycobacterium
SPGASSWLVCDTVANSTGA

SEQ ID NO: 329699 - protein, 25 aa, Mycobacterium
SPGDALYGLRGMIFGEQATRDVQVE

SEQ ID NO: 329700 - protein, 23 aa, Mycobacterium
SPGEWPWAYAMLLGIHVVLLFVA

SEQ ID NO: 329701 - protein, 25 aa, Mycobacterium
SPGLPGSGVVVLVDLGGSGSSVTLA

SEQ ID NO: 329702 - protein, 18 aa, Mycobacterium
SPGLREFLRLVFSGTMVT

SEQ ID NO: 329703 - protein, 26 aa, Mycobacterium
SPGMRRLKLLEISYGVGVSVNVGDGL

SEQ ID NO: 329704 - protein, 25 aa, Mycobacterium
SPGPGGAWQFRWPTLTLDNTNRIYQ

SEQ ID NO: 329705 - protein, 19 aa, Mycobacterium
SPGQPVHVLGHDWGSVAIW

SEQ ID NO: 329706 - protein, 19 aa, Mycobacterium
SPGRPVHVLAHDWGSVGVW

SEQ ID NO: 329707 - protein, 17 aa, Mycobacterium
SPHDLRNPQALADLEQM

SEQ ID NO: 329708 - protein, 20 aa, Mycobacterium
SPHDLRSPKALADMEQMAQR

SEQ ID NO: 329709 - protein, 23 aa, Mycobacterium
SPHSYRGAPLPELAPILEAGATA

SEQ ID NO: 329710 - protein, 20 aa, Mycobacterium
SPIAGMPVLQVWNADNVIVF

SEQ ID NO: 329711 - protein, 26 aa, Mycobacterium
SPIAVRGARNYPCIEHPGKRAPTVEI

SEQ ID NO: 329712 - protein, 26 aa, Mycobacterium
SPIAVRGARNYPCMGHPGKRAPTVEI

SEQ ID NO: 329713 - protein, 25 aa, Mycobacterium
SPIGVRGARNYPCMGQPGKRAPTVE

SEQ ID NO: 329714 - protein, 28 aa, Mycobacterium
SPIRRMIKVELPLSIPVLVAGLRVVVVT

SEQ ID NO: 329715 - protein, 23 aa, Mycobacterium
SPITFRHKIVFGVIAAVGAVAWA

SEQ ID NO: 329716 - protein, 19 aa, Mycobacterium
SPITLKHKVFLAVVAVIGA

SEQ ID NO: 329717 - protein, 20 aa, Mycobacterium
SPITVKHKIIFSIVAVLGAV

SEQ ID NO: 329718 - protein, 24 aa, Mycobacterium
SPKAPRWAWVALVVVGIVGQILMI

SEQ ID NO: 329719 - protein, 21 aa, Mycobacterium
SPKIRTGYNVPISHVPGPRAA

SEQ ID NO: 329720 - protein, 17 aa, Mycobacterium
SPKKAASALAWLVEEME

SEQ ID NO: 329721 - protein, 17 aa, Mycobacterium
SPKKSWEGLAGSLVLGI

SEQ ID NO: 329722 - protein, 24 aa, Mycobacterium
SPKTPEFRRGMLYAINPVGFGSLL

SEQ ID NO: 329723 - protein, 19 aa, Mycobacterium
SPLAHVGFFVLDRSLRPVP

SEQ ID NO: 329724 - protein, 19 aa, Mycobacterium
SPLAVGTWIVVVWSIFSLT

SEQ ID NO: 329725 - protein, 17 aa, Mycobacterium
SPLAYAAIAVWCVTAIV

SEQ ID NO: 329726 - protein, 17 aa, Mycobacterium
SPLAYAAIAVWCVTAVV

SEQ ID NO: 329727 - protein, 18 aa, Mycobacterium
SPLECVYYAVGIASIALG

SEQ ID NO: 329728 - protein, 24 aa, Mycobacterium
SPLNVRGARNIPCETVPGKRAPTV

SEQ ID NO: 329729 - protein, 29 aa, Mycobacterium
SPLPEEPPVPFGYLMRLGDTLAEKELSPQ

SEQ ID NO: 329730 - protein, 29 aa, Mycobacterium
SPLPGPCCDEPAWECPPSVSGQDRDRSVG

SEQ ID NO: 329731 - protein, 24 aa, Mycobacterium
SPLPVPWSVLSQFAAGPALSRGDA

SEQ ID NO: 329732 - protein, 29 aa, Mycobacterium
SPLRKHSIPFWRKWTQQVMRRPWLSALGA

SEQ ID NO: 329733 - protein, 27 aa, Mycobacterium
SPLSGRLVGRFGARPSLMIAGALIVAA

SEQ ID NO: 329734 - protein, 25 aa, Mycobacterium
SPLTAALSLMWGWRLAAVCVTVAAA

SEQ ID NO: 329735 - protein, 26 aa, Mycobacterium
SPLTAALSLMWGWRLAVVCVTVAAAL

SEQ ID NO: 329736 - protein, 25 aa, Mycobacterium
SPLTAVMSLMWGWRLAAVCVTVAAA

SEQ ID NO: 329737 - protein, 21 aa, Mycobacterium
SPLYRRLGKRFGSGIAATLTL

SEQ ID NO: 329738 - protein, 19 aa, Mycobacterium
SPMFMLFPIMMMVSMVSMV

SEQ ID NO: 329739 - protein, 27 aa, Mycobacterium
SPMNVRGARNYPCLEHPGKRAPTVELC

SEQ ID NO: 329740 - protein, 24 aa, Mycobacterium
SPMSFLRRPARWMQLLASHPKCFS

SEQ ID NO: 329741 - protein, 21 aa, Mycobacterium
SPPKKRRRRPLLIAAVAVTVL

SEQ ID NO: 329742 - protein, 26 aa, Mycobacterium
SPPPPRWVWPPLIAVGGVGIVLMAIW

SEQ ID NO: 329743 - protein, 23 aa, Mycobacterium
SPPPRPSAVNARVPRSFDDVIAR

SEQ ID NO: 329744 - protein, 39 aa, Mycobacterium
SPPQGVWYLGPFPLRAYALCIIVGIVAALVIGDRRWVAR

SEQ ID NO: 329745 - protein, 21 aa, Mycobacterium
SPPQRRGFFASFVQLGSPVAY

SEQ ID NO: 329746 - protein, 19 aa, Mycobacterium
SPPRIPAPVPPTGGSPTPT

SEQ ID NO: 329747 - protein, 17 aa, Mycobacterium
SPPSHLWQARLAPDAMP

SEQ ID NO: 329748 - protein, 18 aa, Mycobacterium
SPQLVAAPFDPAVGAALA

SEQ ID NO: 329749 - protein, 24 aa, Mycobacterium
SPQPPDVNTWWAIRSSCTPTGCLA

SEQ ID NO: 329750 - protein, 21 aa, Mycobacterium
SPQRISWRAGGMIAAVGSVLI

SEQ ID NO: 329751 - protein, 28 aa, Mycobacterium
SPRDPIPRWLRYVLMADRAGSAWYVGTG

SEQ ID NO: 329752 - protein, 25 aa, Mycobacterium
SPREAGWHRAWLGGLLVGGFAAVVA

SEQ ID NO: 329753 - protein, 25 aa, Mycobacterium
SPREVLPLLVPVVLVSALFNGSLVQ

SEQ ID NO: 329754 - protein, 21 aa, Mycobacterium
SPRKWRKLAITGGAIVVVAIL

SEQ ID NO: 329755 - protein, 20 aa, Mycobacterium
SPRPEGWVITAGRSGWRSST

SEQ ID NO: 329756 - protein, 17 aa, Mycobacterium
SPRRPGTVVVDRHSDTE

SEQ ID NO: 329757 - protein, 20 aa, Mycobacterium
SPRRRRDWLVAGAGAFAAHA

SEQ ID NO: 329758 - protein, 28 aa, Mycobacterium
SPRRRTRLRLPFSPWHLVLIPVTFLLIL

SEQ ID NO: 329759 - protein, 22 aa, Mycobacterium
SPRSLYRGRARSKGAYGRDAIN

SEQ ID NO: 329760 - protein, 24 aa, Mycobacterium
SPRSRSGIEYIYLLKREVVEMRRA

SEQ ID NO: 329761 - protein, 18 aa, Mycobacterium
SPRSVAMVLLATGVSVAV

SEQ ID NO: 329762 - protein, 20 aa, Mycobacterium
SPSRPLPKRNLVMGLAAGLL

SEQ ID NO: 329763 - protein, 22 aa, Mycobacterium
SPSRPLRSGMIIAPTQARSDGE

SEQ ID NO: 329764 - protein, 17 aa, Mycobacterium
SPSTRWESWDMSTSLPV

SEQ ID NO: 329765 - protein, 29 aa, Mycobacterium
SPSVLRWSRNRMAFLAAVLFMLALCWATT

SEQ ID NO: 329766 - protein, 18 aa, Mycobacterium
SPSVRAGFVAAFSVPGEG

SEQ ID NO: 329767 - protein, 23 aa, Mycobacterium
SPSWTPKFVDHFVGDRIYRELVD

SEQ ID NO: 329768 - protein, 21 aa, Mycobacterium
SPTALRRLRRPTIVLGSTVAL

SEQ ID NO: 329769 - protein, 17 aa, Mycobacterium
SPTAPYPTIPGLPWVPA

SEQ ID NO: 329770 - protein, 21 aa, Mycobacterium
SPTCIIVGLPAGLRLAVDNAI

SEQ ID NO: 329771 - protein, 21 aa, Mycobacterium
SPTMLFFPFVLLLAATALYRG

SEQ ID NO: 329772 - protein, 23 aa, Mycobacterium
SPTPRPATVLTIAPSGTRLPEAH

SEQ ID NO: 329773 - protein, 30 aa, Mycobacterium
SPTRKRLLRRPGWASVGVALVLVIAVLGTA

SEQ ID NO: 329774 - protein, 24 aa, Mycobacterium
SPTSAFRRLRLEMLAAERETFIAE

SEQ ID NO: 329775 - protein, 23 aa, Mycobacterium
SPTSRIIAAAAFALSPRVLTTLG

SEQ ID NO: 329776 - protein, 39 aa, Mycobacterium
SPTVLRWSRNRMAFLAALLFTLALCWATTNGWWYVSSYG

SEQ ID NO: 329777 - protein, 27 aa, Mycobacterium
SPVAVRGARNYPCMAHPGKRAPTVELC

SEQ ID NO: 329778 - protein, 27 aa, Mycobacterium
SPVAWWRDPWRPPRILVGVTVIYLVWS

SEQ ID NO: 329779 - protein, 21 aa, Mycobacterium
SPVHYPHGWTAVAAAINARPA

SEQ ID NO: 329780 - protein, 25 aa, Mycobacterium
SPWDLGRPAPIGSVLSVHDVQQSGD

SEQ ID NO: 329781 - protein, 17 aa, Mycobacterium
SPWEIRVLCLLPIANIV

SEQ ID NO: 329782 - protein, 29 aa, Mycobacterium
SPWLLPLRWPMVEYFYLKYYLPRARSRPV

SEQ ID NO: 329783 - protein, 17 aa, Mycobacterium
SPWPGLTAALWVVIALA

SEQ ID NO: 329784 - protein, 33 aa, Mycobacterium
SPWQIYWRILLPHARPAVMVLAVLTWVNVWNDF

SEQ ID NO: 329785 - protein, 28 aa, Mycobacterium
SPWQIYWRILLPHARPAVMVLGVLTWVN

SEQ ID NO: 329786 - protein, 24 aa, Mycobacterium
SPYDIGPTPSWRNLRYPRSQIPTD

SEQ ID NO: 329787 - protein, 18 aa, Mycobacterium
SQAANTWADYTAAHIGTQ

SEQ ID NO: 329788 - protein, 17 aa, Mycobacterium
SQAGCRMTAEIGSMRIA

SEQ ID NO: 329789 - protein, 19 aa, Mycobacterium
SQAIWFKLLLVAVVVGVAV

SEQ ID NO: 329790 - protein, 24 aa, Mycobacterium
SQALRFTYMLLFSIPVLAPLFLRL

SEQ ID NO: 329791 - protein, 24 aa, Mycobacterium
SQAPLPSGMYCKIPKDYQGNSVRG

SEQ ID NO: 329792 - protein, 18 aa, Mycobacterium
SQARFIGYGGMLTESFVA

SEQ ID NO: 329793 - protein, 23 aa, Mycobacterium
SQAVLYSSMLVQAYQAANVHVQL

SEQ ID NO: 329794 - protein, 23 aa, Mycobacterium
SQDWSWQTQLNWIATALGRADAA

SEQ ID NO: 329795 - protein, 19 aa, Mycobacterium
SQELFLKFHSVLYDPSKQP

SEQ ID NO: 329796 - protein, 23 aa, Mycobacterium
SQFDALEFAKPIFGPAARALAQL

SEQ ID NO: 329797 - protein, 25 aa, Mycobacterium
SQFDRLRLRLSRSVTVVVGGDDDAS

SEQ ID NO: 329798 - protein, 19 aa, Mycobacterium
SQFVPWLLTPILMLGATYL

SEQ ID NO: 329799 - protein, 19 aa, Mycobacterium
SQGHTPVWVAWDGAVRGVI

SEQ ID NO: 329800 - protein, 25 aa, Mycobacterium
SQGLGDEVRRVWGLTAALTVDARTG

SEQ ID NO: 329801 - protein, 26 aa, Mycobacterium
SQHRGELALAEALDAMAREVGGGAPV

SEQ ID NO: 329802 - protein, 19 aa, Mycobacterium
SQISTSLDFFLSGRRMPAW

SEQ ID NO: 329803 - protein, 17 aa, Mycobacterium
SQLAVSLALVLLMLPVI

SEQ ID NO: 329804 - protein, 18 aa, Mycobacterium
SQLRPGRVPAALDEVIAK

SEQ ID NO: 329805 - protein, 17 aa, Mycobacterium
SQLRSDMQFAIATTLGV

SEQ ID NO: 329806 - protein, 17 aa, Mycobacterium
SQLSWPVAVAVGPALTY

SEQ ID NO: 329807 - protein, 18 aa, Mycobacterium
SQLVLSLLSWAVVIALFA

SEQ ID NO: 329808 - protein, 17 aa, Mycobacterium
SQLWFDALTGICAHVRA

SEQ ID NO: 329809 - protein, 23 aa, Mycobacterium
SQMFKAVSWLPGDGRERLLTVPG

SEQ ID NO: 329810 - protein, 19 aa, Mycobacterium
SQMMYARPVVDWVERQAQE

SEQ ID NO: 329811 - protein, 25 aa, Mycobacterium
SQMVYARLAMRYVQAHAEQGALAAA

SEQ ID NO: 329812 - protein, 21 aa, Mycobacterium
SQPEPRWPKSPSQPKKAPGPE

SEQ ID NO: 329813 - protein, 17 aa, Mycobacterium
SQPLWLAGMWVAAAMAV

SEQ ID NO: 329814 - protein, 18 aa, Mycobacterium
SQPSMIGQLAQWLLSLVG

SEQ ID NO: 329815 - protein, 23 aa, Mycobacterium
SQPSTQAPVHWKPITNARVARDA

SEQ ID NO: 329816 - protein, 21 aa, Mycobacterium
SQPTTWWPPRWHPQNYRTATE

SEQ ID NO: 329817 - protein, 25 aa, Mycobacterium
SQQLVIAVPAHWGPTTLRALRNALR

SEQ ID NO: 329818 - protein, 18 aa, Mycobacterium
SQRHWAYALTYYWGLVLS

SEQ ID NO: 329819 - protein, 24 aa, Mycobacterium
SQRPRLLPVRGWSSCDLQSQARLR

SEQ ID NO: 329820 - protein, 24 aa, Mycobacterium
SQRQWAFELTYYWGLTLSAQALIS

SEQ ID NO: 329821 - protein, 22 aa, Mycobacterium
SQRRGVPSLLWVSLVVVGLVCA

SEQ ID NO: 329822 - protein, 22 aa, Mycobacterium
SQRRPDIPKAFDAVIARGMAKR

SEQ ID NO: 329823 - protein, 26 aa, Mycobacterium
SQRTHWYGRSSVLISVTGAAAVALVI

SEQ ID NO: 329824 - protein, 19 aa, Mycobacterium
SQRVFRQGFVVGMTNPKTA

SEQ ID NO: 329825 - protein, 23 aa, Mycobacterium
SQRVYKPYPYVVAIVDELADLMM

SEQ ID NO: 329826 - protein, 26 aa, Mycobacterium
SQSALNLPAAWQFSRGDGQLVAVLDT

SEQ ID NO: 329827 - protein, 23 aa, Mycobacterium
SQSRLLGECRRAKEQLSTATTAA

SEQ ID NO: 329828 - protein, 20 aa, Mycobacterium
SQTDFPSEGLVRFEGDSYSE

SEQ ID NO: 329829 - protein, 29 aa, Mycobacterium
SQTEFNVSLPWTKAVILNPGIQNPSVVAT

SEQ ID NO: 329830 - protein, 17 aa, Mycobacterium
SQTVRWDDIDGLRFHRG

SEQ ID NO: 329831 - protein, 18 aa, Mycobacterium
SQVAPVAPVPTRTVTETS

SEQ ID NO: 329832 - protein, 17 aa, Mycobacterium
SQVKLPSLLALGFVTMA

SEQ ID NO: 329833 - protein, 26 aa, Mycobacterium
SQVKSSDAIERWARNLNRLGAQSAQE

SEQ ID NO: 329834 - protein, 18 aa, Mycobacterium
SQWAEHRLLPDPKRARVR

SEQ ID NO: 329835 - protein, 19 aa, Mycobacterium
SRAAIGVPDAYHLPNTPGS

SEQ ID NO: 329836 - protein, 29 aa, Mycobacterium
SRAAKIVRRLAVPIVLFWVAIAAVTNATV

SEQ ID NO: 329837 - protein, 17 aa, Mycobacterium
SRAALALSLKTAAASTA

SEQ ID NO: 329838 - protein, 17 aa, Mycobacterium
SRAALLLSLKTSAAATA

SEQ ID NO: 329839 - protein, 18 aa, Mycobacterium
SRAARLIGALALLCAACW

SEQ ID NO: 329840 - protein, 23 aa, Mycobacterium
SRAARLIGALALVSATCWLGEIV

SEQ ID NO: 329841 - protein, 18 aa, Mycobacterium
SRAARYLRRTRSQGLAVP

SEQ ID NO: 329842 - protein, 24 aa, Mycobacterium
SRADLKETWLRISPSEDPATPDAV

SEQ ID NO: 329843 - protein, 17 aa, Mycobacterium
SRAEKMASIAVDKSLAK

SEQ ID NO: 329844 - protein, 20 aa, Mycobacterium
SRAGAWLADQFTAFNQRVLH

SEQ ID NO: 329845 - protein, 20 aa, Mycobacterium
SRAGGRITTTRLVLAGVAVA

SEQ ID NO: 329846 - protein, 21 aa, Mycobacterium
SRAHLLLRFDHGRWMAIDNGS

SEQ ID NO: 329847 - protein, 25 aa, Mycobacterium
SRALKACGWAFLIWGLYAYLWAFVL

SEQ ID NO: 329848 - protein, 23 aa, Mycobacterium
SRALLCDFRRSAVEDHWALFTHT

SEQ ID NO: 329849 - protein, 18 aa, Mycobacterium
SRALPVFLVPMLLVLLLI

SEQ ID NO: 329850 - protein, 17 aa, Mycobacterium
SRARLAAGAVLHSKNVS

SEQ ID NO: 329851 - protein, 20 aa, Mycobacterium
SRARLPYGLNPATTPVLGSW

SEQ ID NO: 329852 - protein, 21 aa, Mycobacterium
SRAVAIAWRRSLQLRVVALTL

SEQ ID NO: 329853 - protein, 22 aa, Mycobacterium
SRAVAVAWRRSLQLRVVALTLG

SEQ ID NO: 329854 - protein, 18 aa, Mycobacterium
SRAWELLAGVLAAAYVTR

SEQ ID NO: 329855 - protein, 23 aa, Mycobacterium
SRAWMVWLPWISMMAISSSEYAF

SEQ ID NO: 329856 - protein, 21 aa, Mycobacterium
SRDLLAIVARVTWGCEPDDVS

SEQ ID NO: 329857 - protein, 22 aa, Mycobacterium
SRDPAQLWVLIFALTMMAGLVV

SEQ ID NO: 329858 - protein, 31 aa, Mycobacterium
SRDTWLAWVPRLAWIGVTVWLLIAVAVLLLR

SEQ ID NO: 329859 - protein, 18 aa, Mycobacterium
SREAELLALFAGSVLRGA

SEQ ID NO: 329860 - protein, 23 aa, Mycobacterium
SREFGGAWGWLAAVLSVGLCAIG

SEQ ID NO: 329861 - protein, 24 aa, Mycobacterium
SREGLRLADEQLWPVAPLDTQSGV

SEQ ID NO: 329862 - protein, 18 aa, Mycobacterium
SRELQRFTGGWGAVVGLG

SEQ ID NO: 329863 - protein, 29 aa, Mycobacterium
SRESLRASIGMVLQDTWLFAGTIYDNIAY

SEQ ID NO: 329864 - protein, 19 aa, Mycobacterium
SRETVRVMNSLAWGRGSIV

SEQ ID NO: 329865 - protein, 26 aa, Mycobacterium
SREVLPRLGPAVARSKPAAWAAGFVL

SEQ ID NO: 329866 - protein, 20 aa, Mycobacterium
SRFAELDVEAVLRRQPQVVL

SEQ ID NO: 329867 - protein, 19 aa, Mycobacterium
SRFGLFEPKRRMMVRRWRW

SEQ ID NO: 329868 - protein, 18 aa, Mycobacterium
SRFPALVRDFAAMCRSHG

SEQ ID NO: 329869 - protein, 18 aa, Mycobacterium
SRFRMFKRDPAAAPKTRS

SEQ ID NO: 329870 - protein, 29 aa, Mycobacterium
SRFTDLVALPAGWAWLENGWVMAIVAVLL

SEQ ID NO: 329871 - protein, 17 aa, Mycobacterium
SRGAVGLIGLATAAWAG

SEQ ID NO: 329872 - protein, 18 aa, Mycobacterium
SRGDLDRTLLLWMLPLLI

SEQ ID NO: 329873 - protein, 18 aa, Mycobacterium
SRGDLDRTLLLWTLPLLI

SEQ ID NO: 329874 - protein, 19 aa, Mycobacterium
SRGDLDRTLLLWVLPLLIA

SEQ ID NO: 329875 - protein, 23 aa, Mycobacterium
SRGELLCGVKAPAIVLLSFIPMY

SEQ ID NO: 329876 - protein, 19 aa, Mycobacterium
SRGGAVFAAVCVATLIIIV

SEQ ID NO: 329877 - protein, 19 aa, Mycobacterium
SRGGMVFTLVCVAALIIVV

SEQ ID NO: 329878 - protein, 24 aa, Mycobacterium
SRGHPRKLLLRVFVIGATTTAVLS

SEQ ID NO: 329879 - protein, 22 aa, Mycobacterium
SRGKWDTLRAMGFDDDHIGDSR

SEQ ID NO: 329880 - protein, 23 aa, Mycobacterium
SRGKWDTLRAMGFDDDHIGDSRT

SEQ ID NO: 329881 - protein, 19 aa, Mycobacterium
SRGKWDTLRAMGFDDDQIA

SEQ ID NO: 329882 - protein, 23 aa, Mycobacterium
SRGKWDTLRAMGFDDEHIGDSRS

SEQ ID NO: 329883 - protein, 23 aa, Mycobacterium
SRGMLLPEEFLPAAERAGLMRRV

SEQ ID NO: 329884 - protein, 26 aa, Mycobacterium
SRGPFWSRPAPARILLLAVIGTQVIA

SEQ ID NO: 329885 - protein, 20 aa, Mycobacterium
SRGPVPRWADWASSAVDVLV

SEQ ID NO: 329886 - protein, 19 aa, Mycobacterium
SRGQLDRTLLLWLLPLLVA

SEQ ID NO: 329887 - protein, 27 aa, Mycobacterium
SRGRHLVRLALFAGFLLGMFYLVAVAR

SEQ ID NO: 329888 - protein, 19 aa, Mycobacterium
SRGRNAISIYGDDTALRDG

SEQ ID NO: 329889 - protein, 21 aa, Mycobacterium
SRGTAGLSFGLAKSATSAAGR

SEQ ID NO: 329890 - protein, 19 aa, Mycobacterium
SRHHIWRITLRALSKSWDD

SEQ ID NO: 329891 - protein, 18 aa, Mycobacterium
SRHPRLVGQLGAAAAGAG

SEQ ID NO: 329892 - protein, 30 aa, Mycobacterium
SRHWLIEVPIRIVVYIAVALVIRYLVHRMI

SEQ ID NO: 329893 - protein, 19 aa, Mycobacterium
SRIAAVHLFLWGLGTLLFT

SEQ ID NO: 329894 - protein, 19 aa, Mycobacterium
SRIAERFAEGHLSERMPVR

SEQ ID NO: 329895 - protein, 20 aa, Mycobacterium
SRIALHRLIELAGRDVNPPT

SEQ ID NO: 329896 - protein, 19 aa, Mycobacterium
SRIDTVLVVATSVTETAGS

SEQ ID NO: 329897 - protein, 31 aa, Mycobacterium
SRIGAGPVLRLWRSVLMFASRFWQFEQLYRS

SEQ ID NO: 329898 - protein, 24 aa, Mycobacterium
SRIPEDRTAPALDLDVLLGGLRPV

SEQ ID NO: 329899 - protein, 17 aa, Mycobacterium
SRITLPGSIYLGVIAVL

SEQ ID NO: 329900 - protein, 20 aa, Mycobacterium
SRKAPTLALIVPGVVGFALS

SEQ ID NO: 329901 - protein, 19 aa, Mycobacterium
SRKEGWGLAVVEAAQHRVP

SEQ ID NO: 329902 - protein, 19 aa, Mycobacterium
SRKEGWGLAVVEAAQHSVP

SEQ ID NO: 329903 - protein, 19 aa, Mycobacterium
SRKPPVLFVHGAWHGAWCW

SEQ ID NO: 329904 - protein, 19 aa, Mycobacterium
SRKRPWGAEHIARVGRFGV

SEQ ID NO: 329905 - protein, 26 aa, Mycobacterium
SRKRWARLRTLMVISGPGLIVMVGDN

SEQ ID NO: 329906 - protein, 17 aa, Mycobacterium
SRKSPGIWWAVTSVVAI

SEQ ID NO: 329907 - protein, 17 aa, Mycobacterium
SRLAIITVLGLIVAYIF

SEQ ID NO: 329908 - protein, 22 aa, Mycobacterium
SRLESDLIRRTFAEMLTIVRSR

SEQ ID NO: 329909 - protein, 17 aa, Mycobacterium
SRLIGSLILAIPVVVIS

SEQ ID NO: 329910 - protein, 25 aa, Mycobacterium
SRLIKRSGPAAGHRSDPDWQPPEDS

SEQ ID NO: 329911 - protein, 22 aa, Mycobacterium
SRLIRLFFQPVLIAWALWATGI

SEQ ID NO: 329912 - protein, 22 aa, Mycobacterium
SRLKPGETVRVAGIRVGTVNSV

SEQ ID NO: 329913 - protein, 20 aa, Mycobacterium
SRLLAPILAPVIYRAAIAVR

SEQ ID NO: 329914 - protein, 22 aa, Mycobacterium
SRLLGHVPYRIDIDVYRMGGRA

SEQ ID NO: 329915 - protein, 19 aa, Mycobacterium
SRLNCVGQIRFGESGYANA

SEQ ID NO: 329916 - protein, 22 aa, Mycobacterium
SRLNSRLLKSWVKRYTLRRGAL

SEQ ID NO: 329917 - protein, 17 aa, Mycobacterium
SRLPFTAGVVLAISAVL

SEQ ID NO: 329918 - protein, 27 aa, Mycobacterium
SRLQTRAVWRLANFLLEGLVFLLIGQQ

SEQ ID NO: 329919 - protein, 27 aa, Mycobacterium
SRLQTRAVWRLVNFLLEGLVFLLIGHQ

SEQ ID NO: 329920 - protein, 17 aa, Mycobacterium
SRLRPIRIIAAAAAASM

SEQ ID NO: 329921 - protein, 17 aa, Mycobacterium
SRLSRRSPIPGALSFIA

SEQ ID NO: 329922 - protein, 17 aa, Mycobacterium
SRLSTRAQFALQARPLR

SEQ ID NO: 329923 - protein, 17 aa, Mycobacterium
SRLTVFGLLGGTMAGGA

SEQ ID NO: 329924 - protein, 17 aa, Mycobacterium
SRLVLEITETVPIVDLA

SEQ ID NO: 329925 - protein, 19 aa, Mycobacterium
SRMEAMPADVLQWSAGKAL

SEQ ID NO: 329926 - protein, 20 aa, Mycobacterium
SRMIPRMVVAAAILAAFFVV

SEQ ID NO: 329927 - protein, 20 aa, Mycobacterium
SRMLGAGGMGEVYLAKHPRL

SEQ ID NO: 329928 - protein, 20 aa, Mycobacterium
SRMMPEIVMIEADHDMRNSA

SEQ ID NO: 329929 - protein, 21 aa, Mycobacterium
SRMVIAAGILTIFFVVELTTA

SEQ ID NO: 329930 - protein, 33 aa, Mycobacterium
SRNALGHWAGFSVGWLYWYFWVIVVGFEAIAGA

SEQ ID NO: 329931 - protein, 26 aa, Mycobacterium
SRNLYRYGVGGLIAPFIGIKVIDLVV

SEQ ID NO: 329932 - protein, 17 aa, Mycobacterium
SRNPLVQLWVFLQQVVA

SEQ ID NO: 329933 - protein, 17 aa, Mycobacterium
SRNVLRFSESVAMDERF

SEQ ID NO: 329934 - protein, 17 aa, Mycobacterium
SRPAFVVDDGGYVSARW

SEQ ID NO: 329935 - protein, 18 aa, Mycobacterium
SRPALWCNSDADNDRLRA

SEQ ID NO: 329936 - protein, 22 aa, Mycobacterium
SRPASQLLRPFGPRAAVRSLLL

SEQ ID NO: 329937 - protein, 21 aa, Mycobacterium
SRPDAVFVVGSGIDIPLIKPA

SEQ ID NO: 329938 - protein, 17 aa, Mycobacterium
SRPDYPGDLAVDYPERL

SEQ ID NO: 329939 - protein, 21 aa, Mycobacterium
SRPELIDGIGCRVLSWVNSVR

SEQ ID NO: 329940 - protein, 23 aa, Mycobacterium
SRPEMLDGIGVRVLRWVNDLRGK

SEQ ID NO: 329941 - protein, 18 aa, Mycobacterium
SRPFCTPGGVGAVLSVIG

SEQ ID NO: 329942 - protein, 22 aa, Mycobacterium
SRPHAPWARWRYTAKPDKMRRA

SEQ ID NO: 329943 - protein, 17 aa, Mycobacterium
SRPKWPEIKGVRDFAGV

SEQ ID NO: 329944 - protein, 20 aa, Mycobacterium
SRPLGAAVFGYFGDRLGRKK

SEQ ID NO: 329945 - protein, 21 aa, Mycobacterium
SRPLIGKGWIQGVALVMIFGF

SEQ ID NO: 329946 - protein, 17 aa, Mycobacterium
SRPLWLICTALGVVIVA

SEQ ID NO: 329947 - protein, 19 aa, Mycobacterium
SRPMPLRNMAMGLTAGVLL

SEQ ID NO: 329948 - protein, 17 aa, Mycobacterium
SRPPKRAVVVAAAATEP

SEQ ID NO: 329949 - protein, 23 aa, Mycobacterium
SRPQRLFYLLIHLLDPLISLESL

SEQ ID NO: 329950 - protein, 21 aa, Mycobacterium
SRPRPLGQLIAFWLGGITTCV

SEQ ID NO: 329951 - protein, 31 aa, Mycobacterium
SRPRPRHRLADWWSIAGLFGVVAVVYGGGAE

SEQ ID NO: 329952 - protein, 29 aa, Mycobacterium
SRPWPDLGRPRRAGVSSFGISGTNAHVIL

SEQ ID NO: 329953 - protein, 20 aa, Mycobacterium
SRQDVIKMLADWTEMAERMT

SEQ ID NO: 329954 - protein, 18 aa, Mycobacterium
SRQGRPALVGALGAVLLT

SEQ ID NO: 329955 - protein, 23 aa, Mycobacterium
SRQLRPGDTIPLAQTSPALDLDA

SEQ ID NO: 329956 - protein, 34 aa, Mycobacterium
SRRAEAAQSRFWTRWTGAVMRRPWASAIAAAILL

SEQ ID NO: 329957 - protein, 17 aa, Mycobacterium
SRRAGSTGLGLAIAAAV

SEQ ID NO: 329958 - protein, 17 aa, Mycobacterium
SRRDLGVAFSWSLFNWI

SEQ ID NO: 329959 - protein, 18 aa, Mycobacterium
SRRDLGVAFSWSLFNWIA

SEQ ID NO: 329960 - protein, 42 aa, Mycobacterium
SRRGPLRAAMQIRRIDPWATLKVSLVLSVVFFFVWMIAVAML

SEQ ID NO: 329961 - protein, 21 aa, Mycobacterium
SRRIVGITIISFVAMMFTPTK

SEQ ID NO: 329962 - protein, 22 aa, Mycobacterium
SRRLLDMGCALIAGAGVVVLTQ

SEQ ID NO: 329963 - protein, 24 aa, Mycobacterium
SRRLPRPAVGISIVVATVLAIGGA

SEQ ID NO: 329964 - protein, 27 aa, Mycobacterium
SRRMGGEVIGWFGGWFMILAQIVTASA

SEQ ID NO: 329965 - protein, 19 aa, Mycobacterium
SRRMWSIPLAVVGLIAIGG

SEQ ID NO: 329966 - protein, 22 aa, Mycobacterium
SRRPELVSSVGKMTEVVRNLSR

SEQ ID NO: 329967 - protein, 24 aa, Mycobacterium
SRRPGESTFHWLTLGLAVIWAVGA

SEQ ID NO: 329968 - protein, 18 aa, Mycobacterium
SRRPPLLRYLRERAPAAA

SEQ ID NO: 329969 - protein, 19 aa, Mycobacterium
SRRREWVVAGAGTFVAHAA

SEQ ID NO: 329970 - protein, 20 aa, Mycobacterium
SRRRGTWVIAELVVVVALML

SEQ ID NO: 329971 - protein, 27 aa, Mycobacterium
SRRRLHRRLSGGLLLLIALTVAGGLAA

SEQ ID NO: 329972 - protein, 27 aa, Mycobacterium
SRRRLRRRLSGGLLLLIALTIAGGVAA

SEQ ID NO: 329973 - protein, 24 aa, Mycobacterium
SRRSRSADGDSEWTGSHRAVESRR

SEQ ID NO: 329974 - protein, 18 aa, Mycobacterium
SRRSRSLVDQQLSLIDEL

SEQ ID NO: 329975 - protein, 19 aa, Mycobacterium
SRRTSLWRQTSMLIRRQVR

SEQ ID NO: 329976 - protein, 19 aa, Mycobacterium
SRRVEAVAPWLTVDSGTYP

SEQ ID NO: 329977 - protein, 25 aa, Mycobacterium
SRRWQRLRTLMVISGPGLIVMVGDN

SEQ ID NO: 329978 - protein, 24 aa, Mycobacterium
SRSDPNIDWVVVCMHQTAISTADK

SEQ ID NO: 329979 - protein, 23 aa, Mycobacterium
SRSEMRRALAMAPRKSREIGLQR

SEQ ID NO: 329980 - protein, 20 aa, Mycobacterium
SRSEVRRALAMAPRKSAEIG

SEQ ID NO: 329981 - protein, 18 aa, Mycobacterium
SRSGHPLARAITDAAGPD

SEQ ID NO: 329982 - protein, 20 aa, Mycobacterium
SRSGNTLTLIGDFPNEDAKA

SEQ ID NO: 329983 - protein, 25 aa, Mycobacterium
SRSKLDALRARFCMVMDELRGTTSE

SEQ ID NO: 329984 - protein, 19 aa, Mycobacterium
SRSKTAWILGTACLGMAKI

SEQ ID NO: 329985 - protein, 20 aa, Mycobacterium
SRSLFDWPVRSPVVVEFGSW

SEQ ID NO: 329986 - protein, 24 aa, Mycobacterium
SRSLPQIWAAFLLFSIGFYVMAGA

SEQ ID NO: 329987 - protein, 22 aa, Mycobacterium
SRSNWLPTFILLIVLSVVAAAY

SEQ ID NO: 329988 - protein, 29 aa, Mycobacterium
SRSPTAPSHPRWWFLWTTPGRILSIGMVL

SEQ ID NO: 329989 - protein, 25 aa, Mycobacterium
SRSRHKLRLRVGVNTGKVISGLVGR

SEQ ID NO: 329990 - protein, 19 aa, Mycobacterium
SRSRKGGSTGLGLAIVAAV

SEQ ID NO: 329991 - protein, 19 aa, Mycobacterium
SRSRKGGSTGLGLAIVSAV

SEQ ID NO: 329992 - protein, 23 aa, Mycobacterium
SRSRKGGSTGLGLAIVSAVVRAH

SEQ ID NO: 329993 - protein, 21 aa, Mycobacterium
SRSRPRVVSPAGWSVPVEPSD

SEQ ID NO: 329994 - protein, 30 aa, Mycobacterium
SRSRRFGFLRLGRRSAPAAVTPVAETSVAE

SEQ ID NO: 329995 - protein, 27 aa, Mycobacterium
SRSSGQVVFQRGFQLPPLPPGTETVIV

SEQ ID NO: 329996 - protein, 19 aa, Mycobacterium
SRTALLDAVEQERRRIESD

SEQ ID NO: 329997 - protein, 22 aa, Mycobacterium
SRTAPHRWLKTSGMVRDTATDS

SEQ ID NO: 329998 - protein, 17 aa, Mycobacterium
SRTDIFVPAIMALAVIS

SEQ ID NO: 329999 - protein, 20 aa, Mycobacterium
SRTGTGFGRDLRSAVFEHVV

SEQ ID NO: 330000 - protein, 24 aa, Mycobacterium
SRTKSICPWKGLAHYYTVSVNGDV

SEQ ID NO: 330001 - protein, 20 aa, Mycobacterium
SRTLAERVLGVSLSEPANAG

SEQ ID NO: 330002 - protein, 24 aa, Mycobacterium
SRTLPELWRLLGHIDAVHGAYYLV

SEQ ID NO: 330003 - protein, 24 aa, Mycobacterium
SRTLPELWRLLGHIDAVHGLYYLL

SEQ ID NO: 330004 - protein, 23 aa, Mycobacterium
SRTMLALCGLAIGLRLKVSAPKP

SEQ ID NO: 330005 - protein, 19 aa, Mycobacterium
SRTPLLLIMFAALMAGAGN

SEQ ID NO: 330006 - protein, 23 aa, Mycobacterium
SRTPRPVPVPPRTSAPTSPTTPG

SEQ ID NO: 330007 - protein, 20 aa, Mycobacterium
SRTRGVPVIDVPVQLIVNTK

SEQ ID NO: 330008 - protein, 19 aa, Mycobacterium
SRTTTGLVVPTGYSFNLDG

SEQ ID NO: 330009 - protein, 18 aa, Mycobacterium
SRTVGWFTSIYPVRIDPG

SEQ ID NO: 330010 - protein, 18 aa, Mycobacterium
SRTVLTFRPGLPLDAEQQ

SEQ ID NO: 330011 - protein, 21 aa, Mycobacterium
SRVALFWVAFILTRPLGATVG

SEQ ID NO: 330012 - protein, 28 aa, Mycobacterium
SRVELLRLAVILALWAAVVAAFVSVIYR

SEQ ID NO: 330013 - protein, 19 aa, Mycobacterium
SRVGPRVLAVSSLPYWLGD

SEQ ID NO: 330014 - protein, 19 aa, Mycobacterium
SRVLAAIGRQEWLDRPSYR

SEQ ID NO: 330015 - protein, 18 aa, Mycobacterium
SRVLAHFSTAIEMLVPLV

SEQ ID NO: 330016 - protein, 18 aa, Mycobacterium
SRVLTRLLSFALTALTLV

SEQ ID NO: 330017 - protein, 27 aa, Mycobacterium
SRVPAARLTRWFVWLLVAVACYTAAQS

SEQ ID NO: 330018 - protein, 17 aa, Mycobacterium
SRVRMVFYDQRGHGQSG

SEQ ID NO: 330019 - protein, 39 aa, Mycobacterium
SRVRPSSDLWRMMPYLLPYRGRWIVMIVVALASLAATIS

SEQ ID NO: 330020 - protein, 28 aa, Mycobacterium
SRVVFVPEIPRLPSGKVLRRVLKERHGC

SEQ ID NO: 330021 - protein, 27 aa, Mycobacterium
SRVWAAFLWCLPVSPVLFSLTLLGVTY

SEQ ID NO: 330022 - protein, 18 aa, Mycobacterium
SRVYSILLLIVLGSFLVG

SEQ ID NO: 330023 - protein, 24 aa, Mycobacterium
SRWGSRAVFFGRFIALLRILAGPL

SEQ ID NO: 330024 - protein, 18 aa, Mycobacterium
SRWQGAPAEAGRPAVPES

SEQ ID NO: 330025 - protein, 19 aa, Mycobacterium
SRWRPARPVARGVVYGFIG

SEQ ID NO: 330026 - protein, 21 aa, Mycobacterium
SRYAHCPLRRITGIGAARGAH

SEQ ID NO: 330027 - protein, 23 aa, Mycobacterium
SRYGYVCGLTGLILLAIPAVLPR

SEQ ID NO: 330028 - protein, 20 aa, Mycobacterium
SRYHECLRRGVDSDQAVARA

SEQ ID NO: 330029 - protein, 17 aa, Mycobacterium
SRYPSGMPHPDVVEIIS

SEQ ID NO: 330030 - protein, 22 aa, Mycobacterium
SRYQWTAGYPGGRGDYIDGEVI

SEQ ID NO: 330031 - protein, 23 aa, Mycobacterium
SRYRGRLLGALFVVWAGGAAAAA

SEQ ID NO: 330032 - protein, 18 aa, Mycobacterium
SRYWSHYVISFIVVGAIV

SEQ ID NO: 330033 - protein, 26 aa, Mycobacterium
SSAAASFRVPVKWETNRGVRTAETSV

SEQ ID NO: 330034 - protein, 19 aa, Mycobacterium
SSAAEAFVLFAIATILVTR

SEQ ID NO: 330035 - protein, 17 aa, Mycobacterium
SSAAFPLIPDLGSAFTD

SEQ ID NO: 330036 - protein, 19 aa, Mycobacterium
SSAALLRTGKQLFDTSCVS

SEQ ID NO: 330037 - protein, 22 aa, Mycobacterium
SSAEGFSGVAPEATVISIRQSS

SEQ ID NO: 330038 - protein, 17 aa, Mycobacterium
SSAHWFKTFLAPLTGGI

SEQ ID NO: 330039 - protein, 32 aa, Mycobacterium
SSALNLALTISRLTLRHAFQALRESENVSSAA

SEQ ID NO: 330040 - protein, 22 aa, Mycobacterium
SSALPAYLVLGLIVGVLMLATN

SEQ ID NO: 330041 - protein, 17 aa, Mycobacterium
SSARAGVVAKWLVGQPV

SEQ ID NO: 330042 - protein, 17 aa, Mycobacterium
SSARPVLFGFMMISNLA

SEQ ID NO: 330043 - protein, 25 aa, Mycobacterium
SSARRLTKFGALVRVPRSVEALGRI

SEQ ID NO: 330044 - protein, 22 aa, Mycobacterium
SSASCALLMLLTARRRGKALAS

SEQ ID NO: 330045 - protein, 19 aa, Mycobacterium
SSASFWTFGAIAMVTLLAK

SEQ ID NO: 330046 - protein, 26 aa, Mycobacterium
SSASIPWKPVLGALAFGAVLVGAFML

SEQ ID NO: 330047 - protein, 19 aa, Mycobacterium
SSATEWWLGPDADSPRRMP

SEQ ID NO: 330048 - protein, 27 aa, Mycobacterium
SSAVGFGCVVMAWLAPGTVFLFLLNSS

SEQ ID NO: 330049 - protein, 19 aa, Mycobacterium
SSCGAMKALLSESTDTPTT

SEQ ID NO: 330050 - protein, 26 aa, Mycobacterium
SSCTVGFLPPSAWRSPADESDMDTPD

SEQ ID NO: 330051 - protein, 25 aa, Mycobacterium
SSDVIGCALVLLGLIVTVQAAQLSA

SEQ ID NO: 330052 - protein, 24 aa, Mycobacterium
SSEIPFKARLFRVAADDHVLVAVV

SEQ ID NO: 330053 - protein, 23 aa, Mycobacterium
SSELRLPPFRVPAPRDSKQHVAE

SEQ ID NO: 330054 - protein, 19 aa, Mycobacterium
SSFLLDWPIWADGIVFLIV

SEQ ID NO: 330055 - protein, 20 aa, Mycobacterium
SSFLVRFNYDDLKALPSDVT

SEQ ID NO: 330056 - protein, 26 aa, Mycobacterium
SSFRRRLDEYIGFLVAWQKPFTGKKS

SEQ ID NO: 330057 - protein, 24 aa, Mycobacterium
SSGARLQAILTEFNAMVTASPNDP

SEQ ID NO: 330058 - protein, 17 aa, Mycobacterium
SSGEAWAAVTLGIALLV

SEQ ID NO: 330059 - protein, 25 aa, Mycobacterium
SSGERRVAVIFALAALSWITLPLIW

SEQ ID NO: 330060 - protein, 17 aa, Mycobacterium
SSGFGFLLLAHTSWTSV

SEQ ID NO: 330061 - protein, 17 aa, Mycobacterium
SSGHYGWHHGYGGGRGG

SEQ ID NO: 330062 - protein, 17 aa, Mycobacterium
SSGLLPPIDQWSGSSFS

SEQ ID NO: 330063 - protein, 29 aa, Mycobacterium
SSGPFFKAYVVNLFPGQFVQPFIDAAFSD

SEQ ID NO: 330064 - protein, 24 aa, Mycobacterium
SSGQPAGAVGFELDVIAAVVVGGT

SEQ ID NO: 330065 - protein, 24 aa, Mycobacterium
SSGQPRSAALLAALDKQYSSGGGA

SEQ ID NO: 330066 - protein, 23 aa, Mycobacterium
SSGSPGWGFKIASAVVLVLLGIG

SEQ ID NO: 330067 - protein, 19 aa, Mycobacterium
SSHELRTPLTAMRTNLEVL

SEQ ID NO: 330068 - protein, 19 aa, Mycobacterium
SSHFGQWVGDLPWFIPMAF

SEQ ID NO: 330069 - protein, 31 aa, Mycobacterium
SSHKEVLLHLAAEGWTRWSATVCAALAEPGP

SEQ ID NO: 330070 - protein, 22 aa, Mycobacterium
SSHKEVLLRLSTEGMAALAESV

SEQ ID NO: 330071 - protein, 24 aa, Mycobacterium
SSHPRPGALPRVWALINATSEDPL

SEQ ID NO: 330072 - protein, 17 aa, Mycobacterium
SSHVFGFPALDNSTPLF

SEQ ID NO: 330073 - protein, 26 aa, Mycobacterium
SSIAGALCRPAAAAVPMGLVLVGVGH

SEQ ID NO: 330074 - protein, 25 aa, Mycobacterium
SSIAMKRMGAVFGEYDSDSAAMIVL

SEQ ID NO: 330075 - protein, 19 aa, Mycobacterium
SSIGRTAIDQVLNAVSTRI

SEQ ID NO: 330076 - protein, 17 aa, Mycobacterium
SSILCFKTQASESPAPV

SEQ ID NO: 330077 - protein, 24 aa, Mycobacterium
SSINPPYMTFRWSSQGPGGQVGSS

SEQ ID NO: 330078 - protein, 22 aa, Mycobacterium
SSISILFLFVFQLVQGKLPLHL

SEQ ID NO: 330079 - protein, 17 aa, Mycobacterium
SSITVSVLVSWLLFTWI

SEQ ID NO: 330080 - protein, 18 aa, Mycobacterium
SSKAELVLHAILGETPDL

SEQ ID NO: 330081 - protein, 18 aa, Mycobacterium
SSKGFEWDTACPADQWRH

SEQ ID NO: 330082 - protein, 23 aa, Mycobacterium
SSLAACIRPFLTTLGGITFNAEA

SEQ ID NO: 330083 - protein, 25 aa, Mycobacterium
SSLARLRPLDPLALGPVDAPVVLII

SEQ ID NO: 330084 - protein, 18 aa, Mycobacterium
SSLKIVFVSGSALGADLA

SEQ ID NO: 330085 - protein, 17 aa, Mycobacterium
SSLLKKFSASRHVPPYA

SEQ ID NO: 330086 - protein, 20 aa, Mycobacterium
SSLLLNWVAGPALMFALAWL

SEQ ID NO: 330087 - protein, 19 aa, Mycobacterium
SSLLRTSRVVFTLMADKNP

SEQ ID NO: 330088 - protein, 21 aa, Mycobacterium
SSLPAVVRWARVPGDVAHADE

SEQ ID NO: 330089 - protein, 24 aa, Mycobacterium
SSLRAGLLAAVGFEIFKQLASIYL

SEQ ID NO: 330090 - protein, 17 aa, Mycobacterium
SSLRGGPVGVYVGVSNN

SEQ ID NO: 330091 - protein, 22 aa, Mycobacterium
SSLRVRASMGLVRSGGAGGLQT

SEQ ID NO: 330092 - protein, 19 aa, Mycobacterium
SSLVEMLRGTDSWTPFVAP

SEQ ID NO: 330093 - protein, 19 aa, Mycobacterium
SSLVEVLRGTDSWTPFVAP

SEQ ID NO: 330094 - protein, 33 aa, Mycobacterium
SSLVNFGALFGFCLLHASVIWFYLVRNKSTNYL

SEQ ID NO: 330095 - protein, 18 aa, Mycobacterium
SSLVRLLAILAGFPLVVA

SEQ ID NO: 330096 - protein, 17 aa, Mycobacterium
SSLWTSALWAVALLVAG

SEQ ID NO: 330097 - protein, 21 aa, Mycobacterium
SSLYSTWTFLRVWRDSPVPAY

SEQ ID NO: 330098 - protein, 23 aa, Mycobacterium
SSMELRSGAALPVADGVSTVALV

SEQ ID NO: 330099 - protein, 25 aa, Mycobacterium
SSMIFEFGPPPPPGMGMPPPPGVGM

SEQ ID NO: 330100 - protein, 20 aa, Mycobacterium
SSMRFVEALTFLVITIMLVL

SEQ ID NO: 330101 - protein, 17 aa, Mycobacterium
SSMRLVVVPQGVRRVLP

SEQ ID NO: 330102 - protein, 20 aa, Mycobacterium
SSMVLVCLFLYLSFRNRNWL

SEQ ID NO: 330103 - protein, 17 aa, Mycobacterium
SSPEMAGKVIGTNPPAN

SEQ ID NO: 330104 - protein, 24 aa, Mycobacterium
SSPHVYRPGVPMPATEHGAVAPAS

SEQ ID NO: 330105 - protein, 20 aa, Mycobacterium
SSPIPAPWAVLAILADGPGL

SEQ ID NO: 330106 - protein, 22 aa, Mycobacterium
SSPKMTFPPIHSLSEFDLTEAT

SEQ ID NO: 330107 - protein, 25 aa, Mycobacterium
SSPRARLRILPGDRVHAASLAGRFL

SEQ ID NO: 330108 - protein, 26 aa, Mycobacterium
SSPTCSLGPPGSRTRCTAAQVDHTGV

SEQ ID NO: 330109 - protein, 32 aa, Mycobacterium
SSPVALRCVEVLEWLAWSALVPLACWISELYS

SEQ ID NO: 330110 - protein, 34 aa, Mycobacterium
SSQFSVRLLRTFLRDMPNQMVLAIFACTFAYSTG

SEQ ID NO: 330111 - protein, 30 aa, Mycobacterium
SSQFSVRLLRTFLRDVPNQVVLAVFACTFA

SEQ ID NO: 330112 - protein, 25 aa, Mycobacterium
SSQLRPVYNLTSARLILGEGKTPVA

SEQ ID NO: 330113 - protein, 24 aa, Mycobacterium
SSQPRAVGQLVAFWLGGIFTSVAL

SEQ ID NO: 330114 - protein, 18 aa, Mycobacterium
SSQVRAGYIAAFSVPSEH

SEQ ID NO: 330115 - protein, 24 aa, Mycobacterium
SSRAVYGEGEWRTATDSTFYPLPR

SEQ ID NO: 330116 - protein, 25 aa, Mycobacterium
SSRFGETFWGFWPRSVWGALRSSWN

SEQ ID NO: 330117 - protein, 19 aa, Mycobacterium
SSRFPEMQDPAVAIDIYKG

SEQ ID NO: 330118 - protein, 19 aa, Mycobacterium
SSRGPVFLILFATLMACAG

SEQ ID NO: 330119 - protein, 22 aa, Mycobacterium
SSRGYAAAIGRTGGDDATPVLM

SEQ ID NO: 330120 - protein, 21 aa, Mycobacterium
SSRRAMVVLAFTIVGFTIAGV

SEQ ID NO: 330121 - protein, 18 aa, Mycobacterium
SSRRCWLTLVVTDDGRGF

SEQ ID NO: 330122 - protein, 23 aa, Mycobacterium
SSRYKSEFLANMSHELRTPLNSI

SEQ ID NO: 330123 - protein, 20 aa, Mycobacterium
SSSCGQWLYATEKFTNDTAA

SEQ ID NO: 330124 - protein, 33 aa, Mycobacterium
SSSEIAIAVPAYWKPGTVQALRNALRTHVGFVR

SEQ ID NO: 330125 - protein, 25 aa, Mycobacterium
SSSFPEMRKPAVAINIYRGDTGLDS

SEQ ID NO: 330126 - protein, 18 aa, Mycobacterium
SSSLLYLIGITELTFEVK

SEQ ID NO: 330127 - protein, 19 aa, Mycobacterium
SSSLVAIHLACQGLRTQDC

SEQ ID NO: 330128 - protein, 20 aa, Mycobacterium
SSSLVAIHLACQSLRSGDSD

SEQ ID NO: 330129 - protein, 21 aa, Mycobacterium
SSSPEQLWVATAVAVFVLIPA

SEQ ID NO: 330130 - protein, 19 aa, Mycobacterium
SSSPTWRGFADRLTRDVGV

SEQ ID NO: 330131 - protein, 17 aa, Mycobacterium
SSSRPGIVGTVRTDRDI

SEQ ID NO: 330132 - protein, 26 aa, Mycobacterium
SSSVVEWKLRPGVVSTMNAQARYTDP

SEQ ID NO: 330133 - protein, 21 aa, Mycobacterium
SSTDGKAWYLPVGLQGELATP

SEQ ID NO: 330134 - protein, 23 aa, Mycobacterium
SSTGRDWWWAAALGVLGTGLLGG

SEQ ID NO: 330135 - protein, 19 aa, Mycobacterium
SSTLTSVGWIGYIIIGGIA

SEQ ID NO: 330136 - protein, 33 aa, Mycobacterium
SSTPAKHHIRWARAIVYALLPGLALSLAVAAGF

SEQ ID NO: 330137 - protein, 20 aa, Mycobacterium
SSTPVSLAFEQASFGYAAEH

SEQ ID NO: 330138 - protein, 18 aa, Mycobacterium
SSTRGWAPVIGPFFHRGI

SEQ ID NO: 330139 - protein, 20 aa, Mycobacterium
SSTRPSTGWEDAPPLSAYAD

SEQ ID NO: 330140 - protein, 19 aa, Mycobacterium
SSTRTGSPLLSYGVPQSPT

SEQ ID NO: 330141 - protein, 30 aa, Mycobacterium
SSVALRLPFDPRLRRMAVVAADQILVKGAP

SEQ ID NO: 330142 - protein, 23 aa, Mycobacterium
SSVFFVGAFIWKHHYHCHHHHGM

SEQ ID NO: 330143 - protein, 25 aa, Mycobacterium
SSVGGRRAWAIPLAVLGVIAIGATL

SEQ ID NO: 330144 - protein, 18 aa, Mycobacterium
SSVGLAFPPLGRGPLIDR

SEQ ID NO: 330145 - protein, 25 aa, Mycobacterium
SSVKDHLKHLVAVPIHAPDDAELAL

SEQ ID NO: 330146 - protein, 23 aa, Mycobacterium
SSVKEHLQHLVSMPVNAPEEPEL

SEQ ID NO: 330147 - protein, 19 aa, Mycobacterium
SSVPTYLRNDWYRDWGSIE

SEQ ID NO: 330148 - protein, 19 aa, Mycobacterium
SSVVALIWFGVSRNRKRRN

SEQ ID NO: 330149 - protein, 29 aa, Mycobacterium
SSWFHAAGPVGAWIDTLVRTFIGAGVLAL

SEQ ID NO: 330150 - protein, 20 aa, Mycobacterium
SSWLMDWPLWADGVVFLVVS

SEQ ID NO: 330151 - protein, 22 aa, Mycobacterium
SSWLVCDEITKAFGAAAPEPVT

SEQ ID NO: 330152 - protein, 21 aa, Mycobacterium
SSWRNQVERWFALLTDKKLRR

SEQ ID NO: 330153 - protein, 21 aa, Mycobacterium
SSYLESIGFTYNTHYKRSPGG

SEQ ID NO: 330154 - protein, 24 aa, Mycobacterium
SSYPRLIRVAMLYNDRVGYGPTVS

SEQ ID NO: 330155 - protein, 24 aa, Mycobacterium
SSYPRLIRVAMMYNDKIGYGPTVR

SEQ ID NO: 330156 - protein, 25 aa, Mycobacterium
SSYPRLIRVAMMYNDKVGYGPTVRD

SEQ ID NO: 330157 - protein, 24 aa, Mycobacterium
SSYPRLIRVGMYYNGKVGYATTVR

SEQ ID NO: 330158 - protein, 18 aa, Mycobacterium
STAALVRRSLQFGTLSAE

SEQ ID NO: 330159 - protein, 20 aa, Mycobacterium
STAERHAFGIFGAVIGAAST

SEQ ID NO: 330160 - protein, 20 aa, Mycobacterium
STAFPGWWQTLVYSTGALVS

SEQ ID NO: 330161 - protein, 24 aa, Mycobacterium
STAHIRTGSLLGQRVLALESTGSG

SEQ ID NO: 330162 - protein, 20 aa, Mycobacterium
STAKESFVSFGLVSLSLAIL

SEQ ID NO: 330163 - protein, 18 aa, Mycobacterium
STALCAGAVFAILPRVTW

SEQ ID NO: 330164 - protein, 22 aa, Mycobacterium
STALGMSWGRAMRRTVLPQAMR

SEQ ID NO: 330165 - protein, 23 aa, Mycobacterium
STALRAGNWQALMLPVTTLTINV

SEQ ID NO: 330166 - protein, 25 aa, Mycobacterium
STAQAKAWVKLGFVVFVVAGIYAIL

SEQ ID NO: 330167 - protein, 18 aa, Mycobacterium
STAVLLVWLVLGVVSVRL

SEQ ID NO: 330168 - protein, 19 aa, Mycobacterium
STAVRWRCVSVLGKRWNPR

SEQ ID NO: 330169 - protein, 18 aa, Mycobacterium
STAWLLALGLAMIVAAVW

SEQ ID NO: 330170 - protein, 18 aa, Mycobacterium
STDAAAVFSVLRVVPLPR

SEQ ID NO: 330171 - protein, 28 aa, Mycobacterium
STDDASPRLAWRVVVHVPDTGEMAPSGM

SEQ ID NO: 330172 - protein, 19 aa, Mycobacterium
STDLPRWVYLPAAVGTAFV

SEQ ID NO: 330173 - protein, 18 aa, Mycobacterium
STDLPVPLSFALIGAAWA

SEQ ID NO: 330174 - protein, 23 aa, Mycobacterium
STDQRFLLGANMAIRNSAWRAVR

SEQ ID NO: 330175 - protein, 17 aa, Mycobacterium
STEEHRQRIALATRAQT

SEQ ID NO: 330176 - protein, 24 aa, Mycobacterium
STELSLGVFGAWMGSVAASGLVTW

SEQ ID NO: 330177 - protein, 19 aa, Mycobacterium
STFCVGVFAALRNLREVVL

SEQ ID NO: 330178 - protein, 20 aa, Mycobacterium
STFLEYGIASMEVFRRRKFG

SEQ ID NO: 330179 - protein, 18 aa, Mycobacterium
STGEGWAVLVAMILIVTV

SEQ ID NO: 330180 - protein, 24 aa, Mycobacterium
STGHELRLRVGISTGNVISGLVGR

SEQ ID NO: 330181 - protein, 17 aa, Mycobacterium
STGRPSPPVGLGSGGLG

SEQ ID NO: 330182 - protein, 24 aa, Mycobacterium
STGSLAVAVGMTWATASDLELPPT

SEQ ID NO: 330183 - protein, 22 aa, Mycobacterium
STGVLDRYVNVIADLHNVGDGL

SEQ ID NO: 330184 - protein, 24 aa, Mycobacterium
STHGRLILCGVYGVLAIAGLIVNR

SEQ ID NO: 330185 - protein, 18 aa, Mycobacterium
STHTPIRWVSSVLVEFFR

SEQ ID NO: 330186 - protein, 23 aa, Mycobacterium
STIATYLRGDWHRDWGSVEQYYR

SEQ ID NO: 330187 - protein, 17 aa, Mycobacterium
STIGIWAPILLVLARIF

SEQ ID NO: 330188 - protein, 24 aa, Mycobacterium
STIKRRKMIGLSLGIGFGAFGLGT

SEQ ID NO: 330189 - protein, 30 aa, Mycobacterium
STILLRFAYLRPPGMTWLDALYFSTETIAT

SEQ ID NO: 330190 - protein, 17 aa, Mycobacterium
STINWLAAITFAAAAVF

SEQ ID NO: 330191 - protein, 17 aa, Mycobacterium
STIWLTAWLFSASPAGT

SEQ ID NO: 330192 - protein, 24 aa, Mycobacterium
STKFVMRRWLPIGLAVLALLVLLG

SEQ ID NO: 330193 - protein, 20 aa, Mycobacterium
STKMSSEWSKDQVLQSYLNI

SEQ ID NO: 330194 - protein, 26 aa, Mycobacterium
STKVFALRGGNWVELAGLSHARAAPA

SEQ ID NO: 330195 - protein, 17 aa, Mycobacterium
STLAALLARFHDVDAGA

SEQ ID NO: 330196 - protein, 17 aa, Mycobacterium
STLAALLARFHDVDQGS

SEQ ID NO: 330197 - protein, 17 aa, Mycobacterium
STLAALLARFHDVEQGS

SEQ ID NO: 330198 - protein, 19 aa, Mycobacterium
STLAALLARFHDVERGAIR

SEQ ID NO: 330199 - protein, 18 aa, Mycobacterium
STLASYVIGIGGNNDGAS

SEQ ID NO: 330200 - protein, 29 aa, Mycobacterium
STLERWAVHIPFRVYLGWVSVATIANATI

SEQ ID NO: 330201 - protein, 19 aa, Mycobacterium
STLMIFPLVMYGMKVLSQL

SEQ ID NO: 330202 - protein, 17 aa, Mycobacterium
STLMVIGSLTFFDLIFV

SEQ ID NO: 330203 - protein, 17 aa, Mycobacterium
STLPALLAIAAVAAVLA

SEQ ID NO: 330204 - protein, 19 aa, Mycobacterium
STLPAVVRWAKMPEDATHA

SEQ ID NO: 330205 - protein, 18 aa, Mycobacterium
STLPPLPTPRHAEAVAAV

SEQ ID NO: 330206 - protein, 20 aa, Mycobacterium
STLPVAVRWVATTIMMAMMV

SEQ ID NO: 330207 - protein, 25 aa, Mycobacterium
STLVLRRKFKPPLVLEDIEKYKVTA

SEQ ID NO: 330208 - protein, 25 aa, Mycobacterium
STLVLRRKFKPPLVLQDIEKHKVTA

SEQ ID NO: 330209 - protein, 25 aa, Mycobacterium
STLVLRRKFKPPLVLQDIEKYKVTA

SEQ ID NO: 330210 - protein, 21 aa, Mycobacterium
STLVLRRKFKPQLVLEDIEKH

SEQ ID NO: 330211 - protein, 24 aa, Mycobacterium
STLVNLLMRFYEVDSGRILIDGVD

SEQ ID NO: 330212 - protein, 23 aa, Mycobacterium
STLWQLAFPMARPALVTVAVYNG

SEQ ID NO: 330213 - protein, 32 aa, Mycobacterium
STMGASRFKTFLKIRFPASLPQLMSGLKVAAT

SEQ ID NO: 330214 - protein, 21 aa, Mycobacterium
STPALRLSVYLTDDSNVLTPA

SEQ ID NO: 330215 - protein, 20 aa, Mycobacterium
STPLGWRTLEQLLFLAAAAT

SEQ ID NO: 330216 - protein, 23 aa, Mycobacterium
STPSRLIGAAAFALSPRVLTTLG

SEQ ID NO: 330217 - protein, 20 aa, Mycobacterium
STQLRGGQQVLLPPAGTSFQ

SEQ ID NO: 330218 - protein, 30 aa, Mycobacterium
STQRFTDRFQRIFVPVVLVGVVLLLFAGFV

SEQ ID NO: 330219 - protein, 18 aa, Mycobacterium
STRFPGWGYLLTALAAPI

SEQ ID NO: 330220 - protein, 24 aa, Mycobacterium
STRFVACPFGDPGTRMYRTGDLVC

SEQ ID NO: 330221 - protein, 24 aa, Mycobacterium
STRLAALPLWTWLLAVAMISMGGP

SEQ ID NO: 330222 - protein, 31 aa, Mycobacterium
STRRRVYQRAGSRKPNLLDRIKSLGPAKQRA

SEQ ID NO: 330223 - protein, 21 aa, Mycobacterium
STRVPFPVILIVLSTMIAGVL

SEQ ID NO: 330224 - protein, 29 aa, Mycobacterium
STSIRSGLAVPRPLPAVIADASSHTEATE

SEQ ID NO: 330225 - protein, 22 aa, Mycobacterium
STSLRLPWLVPGSFLKSVVSIP

SEQ ID NO: 330226 - protein, 24 aa, Mycobacterium
STSPRPQLHLAIGIGVRALTMAAT

SEQ ID NO: 330227 - protein, 19 aa, Mycobacterium
STSRLGVMVAVTAAAVGVI

SEQ ID NO: 330228 - protein, 22 aa, Mycobacterium
STSRSALGYGGKLGVRDVLFGG

SEQ ID NO: 330229 - protein, 20 aa, Mycobacterium
STTAWLFDMAMLAALSVVYS

SEQ ID NO: 330230 - protein, 25 aa, Mycobacterium
STTFARLSMRAQFALEARPLRMAFL

SEQ ID NO: 330231 - protein, 18 aa, Mycobacterium
STTFVMRRSIPIGGVVVV

SEQ ID NO: 330232 - protein, 21 aa, Mycobacterium
STTGYAKVRAHWGVNDAAPEY

SEQ ID NO: 330233 - protein, 18 aa, Mycobacterium
STTLWRIVIPQASRVAVP

SEQ ID NO: 330234 - protein, 21 aa, Mycobacterium
STTRWWLSGLLVGLAAGIKLT

SEQ ID NO: 330235 - protein, 26 aa, Mycobacterium
STTTRAGDLVTWWTGDSVMVFDAAGL

SEQ ID NO: 330236 - protein, 20 aa, Mycobacterium
STTTRSTRPPRTRESDENDD

SEQ ID NO: 330237 - protein, 17 aa, Mycobacterium
STVFKLLVPLALLFLLG

SEQ ID NO: 330238 - protein, 33 aa, Mycobacterium
STVLAVAAPSWFAWLAVIWLWLTVLFANLAEAV

SEQ ID NO: 330239 - protein, 21 aa, Mycobacterium
STVLCLARAPSPLTLVAIHEY

SEQ ID NO: 330240 - protein, 17 aa, Mycobacterium
STVPFGFLGLAAVVAAS

SEQ ID NO: 330241 - protein, 23 aa, Mycobacterium
STVPPRLGEPVSRTEMTDVAPAK

SEQ ID NO: 330242 - protein, 23 aa, Mycobacterium
STVRGARNYPCQEFPGKRAPTIQ

SEQ ID NO: 330243 - protein, 24 aa, Mycobacterium
STVRGARNYPCQEFPGKRAPTIQL

SEQ ID NO: 330244 - protein, 17 aa, Mycobacterium
STVRRLANTVAQPAQMV

SEQ ID NO: 330245 - protein, 31 aa, Mycobacterium
STVTYRDAVPFPKFIEGMGLLLHLAQPTALS

SEQ ID NO: 330246 - protein, 27 aa, Mycobacterium
STVVSWKLKPGVVSTMTAQARYTDPNT

SEQ ID NO: 330247 - protein, 18 aa, Mycobacterium
STVWCLVLLSLALTAATF

SEQ ID NO: 330248 - protein, 21 aa, Mycobacterium
STWRAVLGSTLFQHALVTTVY

SEQ ID NO: 330249 - protein, 21 aa, Mycobacterium
STYFDFAWPLFIMSIGVGLST

SEQ ID NO: 330250 - protein, 20 aa, Mycobacterium
STYGHLRWLTTGTHDDETIR

SEQ ID NO: 330251 - protein, 19 aa, Mycobacterium
STYLRGDWYRDWGSVEQYF

SEQ ID NO: 330252 - protein, 19 aa, Mycobacterium
STYLRGDWYRDWGTVEQYY

SEQ ID NO: 330253 - protein, 17 aa, Mycobacterium
STYRAGLIGGLALLPLL

SEQ ID NO: 330254 - protein, 20 aa, Mycobacterium
STYVLLRLAGDIGQMQANES

SEQ ID NO: 330255 - protein, 18 aa, Mycobacterium
SVAALVFGKLFFPDMAPA

SEQ ID NO: 330256 - protein, 23 aa, Mycobacterium
SVAAVVFGFFLWSGHRDDTAERR

SEQ ID NO: 330257 - protein, 25 aa, Mycobacterium
SVADFWRFWVVHLWVEDFLELFTTV

SEQ ID NO: 330258 - protein, 21 aa, Mycobacterium
SVADPEFWELFARHRGTSFAG

SEQ ID NO: 330259 - protein, 27 aa, Mycobacterium
SVAGIAAIALIIWLITVIARQFSEPDP

SEQ ID NO: 330260 - protein, 18 aa, Mycobacterium
SVAIEFALGLALALVMHR

SEQ ID NO: 330261 - protein, 24 aa, Mycobacterium
SVAIRRPLVGYAWSWATGRGDGWR

SEQ ID NO: 330262 - protein, 39 aa, Mycobacterium
SVAKILGRWFWWPQRVRPRPASTMLRPYGPRPAVRQLLL

SEQ ID NO: 330263 - protein, 23 aa, Mycobacterium
SVALMAFAIIARLRDPRAVAPSA

SEQ ID NO: 330264 - protein, 17 aa, Mycobacterium
SVALTWFGGLRIDAGQM

SEQ ID NO: 330265 - protein, 17 aa, Mycobacterium
SVAPMFIEWYKRRRAAK

SEQ ID NO: 330266 - protein, 17 aa, Mycobacterium
SVAQFFAYAGKDGRATA

SEQ ID NO: 330267 - protein, 30 aa, Mycobacterium
SVARERGWEIRDFRTARKAARIGVPSALAL

SEQ ID NO: 330268 - protein, 29 aa, Mycobacterium
SVAWNVVSSIPWLGSPFKTGQQVTEVVLG

SEQ ID NO: 330269 - protein, 21 aa, Mycobacterium
SVAYLDVCDQLLLVAPGGKTA

SEQ ID NO: 330270 - protein, 25 aa, Mycobacterium
SVAYVLYCDVAILIGICVVTTTGVA

SEQ ID NO: 330271 - protein, 19 aa, Mycobacterium
SVCALMWGSHESRARAASR

SEQ ID NO: 330272 - protein, 25 aa, Mycobacterium
SVCSHCLYNGAVGWSQLVGSRMRIL

SEQ ID NO: 330273 - protein, 25 aa, Mycobacterium
SVCTHCLYNGAVGWSQLTGHTMRLL

SEQ ID NO: 330274 - protein, 25 aa, Mycobacterium
SVDASWWKFNRMRMRDSKLGLLPLY

SEQ ID NO: 330275 - protein, 17 aa, Mycobacterium
SVDAVWHQLMPGYTRPH

SEQ ID NO: 330276 - protein, 17 aa, Mycobacterium
SVDAVWTQILGPKYPRP

SEQ ID NO: 330277 - protein, 18 aa, Mycobacterium
SVDELPQFVNVLKRDMSV

SEQ ID NO: 330278 - protein, 19 aa, Mycobacterium
SVDFAMEMRHIIERFNSST

SEQ ID NO: 330279 - protein, 25 aa, Mycobacterium
SVDGKASFVLLRLAGNIGQLEANES

SEQ ID NO: 330280 - protein, 22 aa, Mycobacterium
SVDNWARRVWALPVFPDGSADS

SEQ ID NO: 330281 - protein, 24 aa, Mycobacterium
SVDWFAIAVLAVWGALAGYGALRW

SEQ ID NO: 330282 - protein, 24 aa, Mycobacterium
SVDWFGIAVLAVWGGVSAVCALRL

SEQ ID NO: 330283 - protein, 17 aa, Mycobacterium
SVEGPRLTVAVGPERLT

SEQ ID NO: 330284 - protein, 20 aa, Mycobacterium
SVELHFERFAAAPVVDGHPF

SEQ ID NO: 330285 - protein, 26 aa, Mycobacterium
SVERMIYRLIGVDARSEQTWGAYARS

SEQ ID NO: 330286 - protein, 18 aa, Mycobacterium
SVEVAAYYVVAEALTNAA

SEQ ID NO: 330287 - protein, 19 aa, Mycobacterium
SVEVSFYLALPVLALLARR

SEQ ID NO: 330288 - protein, 18 aa, Mycobacterium
SVEVTFYLALPVLALLAR

SEQ ID NO: 330289 - protein, 22 aa, Mycobacterium
SVEWDTLLFFVGLFIMVGALVK

SEQ ID NO: 330290 - protein, 24 aa, Mycobacterium
SVFAGIGMFGPWGIIIGPVLMILI

SEQ ID NO: 330291 - protein, 19 aa, Mycobacterium
SVFDDAPWWITFAASPAYI

SEQ ID NO: 330292 - protein, 19 aa, Mycobacterium
SVFGAGITVGEAWKRLRPR

SEQ ID NO: 330293 - protein, 25 aa, Mycobacterium
SVFGRGDIALGWAFLGAAIGSVIRP

SEQ ID NO: 330294 - protein, 17 aa, Mycobacterium
SVFSGIAMFGPWGIVIG

SEQ ID NO: 330295 - protein, 22 aa, Mycobacterium
SVFSVDGRRLFNIPRGALYIVD

SEQ ID NO: 330296 - protein, 24 aa, Mycobacterium
SVFSVDNKRIWANLDCAPSQESSI

SEQ ID NO: 330297 - protein, 22 aa, Mycobacterium
SVGAFAIGFAWLGIGTSYLAVL

SEQ ID NO: 330298 - protein, 17 aa, Mycobacterium
SVGAPPWNADLMLDDLA

SEQ ID NO: 330299 - protein, 18 aa, Mycobacterium
SVGFTIILVMGMMAVTHR

SEQ ID NO: 330300 - protein, 18 aa, Mycobacterium
SVGFTVFYYSWVVAAPAY

SEQ ID NO: 330301 - protein, 21 aa, Mycobacterium
SVGGGWWKTLFAAVLPQSMPA

SEQ ID NO: 330302 - protein, 17 aa, Mycobacterium
SVGLAFPPLGRGPLIDR

SEQ ID NO: 330303 - protein, 26 aa, Mycobacterium
SVGLCAVGVVIGRFQRWNSWDLIHRP

SEQ ID NO: 330304 - protein, 27 aa, Mycobacterium
SVGLDPSWQAGLALARIDHIAWGRELV

SEQ ID NO: 330305 - protein, 25 aa, Mycobacterium
SVGLFDTWPGLIIPYITFALPLAIY

SEQ ID NO: 330306 - protein, 17 aa, Mycobacterium
SVGLLWIGYLHRQRRIT

SEQ ID NO: 330307 - protein, 19 aa, Mycobacterium
SVGMGRFALQKAADYVKTR

SEQ ID NO: 330308 - protein, 20 aa, Mycobacterium
SVGNYRAAIQVALGKGEDDA

SEQ ID NO: 330309 - protein, 27 aa, Mycobacterium
SVGQLLSNCGWKIAMKTASAQDSQAVI

SEQ ID NO: 330310 - protein, 19 aa, Mycobacterium
SVGRIGVKALIYFEAITTF

SEQ ID NO: 330311 - protein, 19 aa, Mycobacterium
SVGRIGVKALIYFEAVTTF

SEQ ID NO: 330312 - protein, 21 aa, Mycobacterium
SVGTAVGWRGAFAVLAVLAAV

SEQ ID NO: 330313 - protein, 21 aa, Mycobacterium
SVGVACAFLTLLLKQPKLPKS

SEQ ID NO: 330314 - protein, 21 aa, Mycobacterium
SVGVAPAWVALCGAAVLAARS

SEQ ID NO: 330315 - protein, 25 aa, Mycobacterium
SVHPRRLTPWVAILFTTLIAFGLIF

SEQ ID NO: 330316 - protein, 21 aa, Mycobacterium
SVHVYRLVWRQMILFAHNIVI

SEQ ID NO: 330317 - protein, 22 aa, Mycobacterium
SVHVYRLVWRQMILFAHNIVIY

SEQ ID NO: 330318 - protein, 25 aa, Mycobacterium
SVHVYRLVWRQMLLFAHNIIIFVII

SEQ ID NO: 330319 - protein, 17 aa, Mycobacterium
SVIAPRIVERVGTTAVV

SEQ ID NO: 330320 - protein, 19 aa, Mycobacterium
SVIIRRPIVGYAYSWATGG

SEQ ID NO: 330321 - protein, 18 aa, Mycobacterium
SVILRILIFYVGAVLLLV

SEQ ID NO: 330322 - protein, 20 aa, Mycobacterium
SVIMLTFFGVFPILRNVVVG

SEQ ID NO: 330323 - protein, 21 aa, Mycobacterium
SVIMLVFFGFLPILRNVLVGL

SEQ ID NO: 330324 - protein, 17 aa, Mycobacterium
SVIPAFMAFAVIPLGPE

SEQ ID NO: 330325 - protein, 17 aa, Mycobacterium
SVIPAFTAFAFVPFGPE

SEQ ID NO: 330326 - protein, 26 aa, Mycobacterium
SVIRNWPAWLAIYGFMTLDRWLLFNW

SEQ ID NO: 330327 - protein, 26 aa, Mycobacterium
SVIRNWPAWLGIYGFMTLDRWLLFNW

SEQ ID NO: 330328 - protein, 23 aa, Mycobacterium
SVISFGALVAFSAVNLSVIKHYF

SEQ ID NO: 330329 - protein, 25 aa, Mycobacterium
SVISWVSVVIIGIWVMLQIADVLQF

SEQ ID NO: 330330 - protein, 25 aa, Mycobacterium
SVITLVVLLGTWVWVGVTNDQYSQL

SEQ ID NO: 330331 - protein, 23 aa, Mycobacterium
SVITQAWGWQWLFWLSAAGLAVN

SEQ ID NO: 330332 - protein, 21 aa, Mycobacterium
SVITRPRWVALEKSISEIVGV

SEQ ID NO: 330333 - protein, 19 aa, Mycobacterium
SVIVGLWGAMTFGPFIAHY

SEQ ID NO: 330334 - protein, 24 aa, Mycobacterium
SVKAALRGEAAWAAALLGLSNGFP

SEQ ID NO: 330335 - protein, 22 aa, Mycobacterium
SVKYAAPLLLEYAMEHLAVVLG

SEQ ID NO: 330336 - protein, 24 aa, Mycobacterium
SVLAALCYSIFLFLLRRGGPDRPL

SEQ ID NO: 330337 - protein, 18 aa, Mycobacterium
SVLALMHFYVWKRTVKDT

SEQ ID NO: 330338 - protein, 25 aa, Mycobacterium
SVLARTSRWPWLVLGAIAVAAVGIP

SEQ ID NO: 330339 - protein, 19 aa, Mycobacterium
SVLASRFLLQRSKQLRVAR

SEQ ID NO: 330340 - protein, 22 aa, Mycobacterium
SVLCGLAQSMAMLVGARALQGV

SEQ ID NO: 330341 - protein, 19 aa, Mycobacterium
SVLCPRLGVPSVVGVTGGM

SEQ ID NO: 330342 - protein, 20 aa, Mycobacterium
SVLDHRFGWSAVPVVVCVVG

SEQ ID NO: 330343 - protein, 18 aa, Mycobacterium
SVLEDNYRALKIIETSFQ

SEQ ID NO: 330344 - protein, 21 aa, Mycobacterium
SVLFGRGEVLPPLPQGTTATV

SEQ ID NO: 330345 - protein, 20 aa, Mycobacterium
SVLGEGFRSFLRPGFTPESI

SEQ ID NO: 330346 - protein, 32 aa, Mycobacterium
SVLILMEFLELLPRASVCAGRLGEVLSTAPAI

SEQ ID NO: 330347 - protein, 17 aa, Mycobacterium
SVLILWTPVMVFGFVLM

SEQ ID NO: 330348 - protein, 23 aa, Mycobacterium
SVLIRGLMGYAFWVPNGSPEYRY

SEQ ID NO: 330349 - protein, 19 aa, Mycobacterium
SVLLEFAIQIARLHDRRKA

SEQ ID NO: 330350 - protein, 25 aa, Mycobacterium
SVLLGECGMALAFDRDKLPDLHGVL

SEQ ID NO: 330351 - protein, 18 aa, Mycobacterium
SVLLPAFIALFGIIAALF

SEQ ID NO: 330352 - protein, 27 aa, Mycobacterium
SVLLWQHIVGIPLHWMVLPMSVIVLLA

SEQ ID NO: 330353 - protein, 17 aa, Mycobacterium
SVLNVRGAHNMPCETRP

SEQ ID NO: 330354 - protein, 19 aa, Mycobacterium
SVLPFVWNVFKSWRYGEPV

SEQ ID NO: 330355 - protein, 27 aa, Mycobacterium
SVLPIIALMVIAVWLLGVGTLMDLALV

SEQ ID NO: 330356 - protein, 17 aa, Mycobacterium
SVLPLPGRESAPRSMWR

SEQ ID NO: 330357 - protein, 17 aa, Mycobacterium
SVLPRAVVVGGLVLTLP

SEQ ID NO: 330358 - protein, 21 aa, Mycobacterium
SVLRLIATVAGWLVVSSFQVA

SEQ ID NO: 330359 - protein, 24 aa, Mycobacterium
SVLRLVPHWFAPRQIPVVTQLTGI

SEQ ID NO: 330360 - protein, 17 aa, Mycobacterium
SVLRQAAPTADQINDVF

SEQ ID NO: 330361 - protein, 24 aa, Mycobacterium
SVLRTEVLAGLVVALALIPEAIAF

SEQ ID NO: 330362 - protein, 22 aa, Mycobacterium
SVLVAWLMFTWMIARLPRQPGR

SEQ ID NO: 330363 - protein, 28 aa, Mycobacterium
SVLVWEYLFGIKLYWVVLALAVILLLAV

SEQ ID NO: 330364 - protein, 17 aa, Mycobacterium
SVLYAARRLRPGDVDAR

SEQ ID NO: 330365 - protein, 21 aa, Mycobacterium
SVLYCSLLLVIGGVTAAVVVS

SEQ ID NO: 330366 - protein, 17 aa, Mycobacterium
SVLYWLRPGTIRLPPWP

SEQ ID NO: 330367 - protein, 17 aa, Mycobacterium
SVMAVLALISWSTTMSM

SEQ ID NO: 330368 - protein, 22 aa, Mycobacterium
SVNALAALVSWTSNRLRGLQTG

SEQ ID NO: 330369 - protein, 18 aa, Mycobacterium
SVNLDWGALLIVAGVATL

SEQ ID NO: 330370 - protein, 20 aa, Mycobacterium
SVNLSKDWARAVVDIPVSTN

SEQ ID NO: 330371 - protein, 24 aa, Mycobacterium
SVNNEFFYWMSIALMMLIHAGFLA

SEQ ID NO: 330372 - protein, 19 aa, Mycobacterium
SVNTEWYNTALGLAMVFGR

SEQ ID NO: 330373 - protein, 17 aa, Mycobacterium
SVNWLWFLVFTIAAIVW

SEQ ID NO: 330374 - protein, 20 aa, Mycobacterium
SVPAALLRREMRFRALSLQW

SEQ ID NO: 330375 - protein, 19 aa, Mycobacterium
SVPAPPGIKAHVAGNTVLN

SEQ ID NO: 330376 - protein, 19 aa, Mycobacterium
SVPAPPGVKAYVTGPAALS

SEQ ID NO: 330377 - protein, 19 aa, Mycobacterium
SVPDVPRPGFPDFGAPDLP

SEQ ID NO: 330378 - protein, 24 aa, Mycobacterium
SVPEAVAMIVVVARYLEPFTSLSE

SEQ ID NO: 330379 - protein, 23 aa, Mycobacterium
SVPEEPDMALARGAALASANAPL

SEQ ID NO: 330380 - protein, 18 aa, Mycobacterium
SVPHHWWTPWIVLPLGGV

SEQ ID NO: 330381 - protein, 21 aa, Mycobacterium
SVPIILGWLGIAVLISVAVPS

SEQ ID NO: 330382 - protein, 21 aa, Mycobacterium
SVPIVVGWVALVVILALAAPQ

SEQ ID NO: 330383 - protein, 24 aa, Mycobacterium
SVPLTDLRSRLGLLEQDAPVLHGT

SEQ ID NO: 330384 - protein, 27 aa, Mycobacterium
SVPSAALWAALSTRWSNPALLTAALVV

SEQ ID NO: 330385 - protein, 24 aa, Mycobacterium
SVPWLRSVLEPWLTFLRALPPLAY

SEQ ID NO: 330386 - protein, 24 aa, Mycobacterium
SVQEVLRFGWPEGITPEAHDYMAP

SEQ ID NO: 330387 - protein, 18 aa, Mycobacterium
SVQGQFYLAFLFLVAACA

SEQ ID NO: 330388 - protein, 18 aa, Mycobacterium
SVQLGGSYLKDGKRRAIT

SEQ ID NO: 330389 - protein, 24 aa, Mycobacterium
SVQNAIPILGEFVTNSVVTHPADG

SEQ ID NO: 330390 - protein, 21 aa, Mycobacterium
SVQRIIFASGLTVAGATACMT

SEQ ID NO: 330391 - protein, 25 aa, Mycobacterium
SVQVRRGEVIAGRRGFALDLADGGH

SEQ ID NO: 330392 - protein, 23 aa, Mycobacterium
SVRAVNLPAFFASFMFLFVATGI

SEQ ID NO: 330393 - protein, 26 aa, Mycobacterium
SVRGAEALVRWQHPRFGVLEPAQFLP

SEQ ID NO: 330394 - protein, 20 aa, Mycobacterium
SVRPSPLFLALVGLTAVGGA

SEQ ID NO: 330395 - protein, 26 aa, Mycobacterium
SVRRLPPPRIEPGPDHRPITMVAVSV

SEQ ID NO: 330396 - protein, 21 aa, Mycobacterium
SVRRVPWRLILDGVIVATSLF

SEQ ID NO: 330397 - protein, 18 aa, Mycobacterium
SVRVHLRGSYSPTPTTMS

SEQ ID NO: 330398 - protein, 19 aa, Mycobacterium
SVRVIARGGRLMAYYVPAG

SEQ ID NO: 330399 - protein, 20 aa, Mycobacterium
SVRVPTLWIVLGPLGQSITA

SEQ ID NO: 330400 - protein, 23 aa, Mycobacterium
SVSADSARVLVAVSVKTSNIAAP

SEQ ID NO: 330401 - protein, 19 aa, Mycobacterium
SVSDLPRPGFPDFGAPGLA

SEQ ID NO: 330402 - protein, 24 aa, Mycobacterium
SVSDRIGRRPVFLTMALFTILYAF

SEQ ID NO: 330403 - protein, 19 aa, Mycobacterium
SVSDVRIGPNVTMRQAGGA

SEQ ID NO: 330404 - protein, 23 aa, Mycobacterium
SVSEAGRLLRRWRRDPIVAVQAL

SEQ ID NO: 330405 - protein, 24 aa, Mycobacterium
SVSEAYPSVWGLLSGAGESLLVYL

SEQ ID NO: 330406 - protein, 19 aa, Mycobacterium
SVSGLDYAPLLAQGAELTP

SEQ ID NO: 330407 - protein, 25 aa, Mycobacterium
SVSKTASMPPLWVIVSCALAMATGT

SEQ ID NO: 330408 - protein, 23 aa, Mycobacterium
SVSLAGRFAGFRGLDLINLAITT

SEQ ID NO: 330409 - protein, 25 aa, Mycobacterium
SVSLAGRFAGFRGLDLINLAVTTNA

SEQ ID NO: 330410 - protein, 18 aa, Mycobacterium
SVSLEFVLGLALALVMHR

SEQ ID NO: 330411 - protein, 18 aa, Mycobacterium
SVSLPMLVAMRVAQGVGG

SEQ ID NO: 330412 - protein, 31 aa, Mycobacterium
SVSLVRKGFWRLLGILVLTGFIVGFVSMIIG

SEQ ID NO: 330413 - protein, 24 aa, Mycobacterium
SVSREVFRQTPLIQIEAAQALGAT

SEQ ID NO: 330414 - protein, 22 aa, Mycobacterium
SVSRTRWLSSHLVMALAGSAVA

SEQ ID NO: 330415 - protein, 23 aa, Mycobacterium
SVSSFGEFEFWFAGIKVATIVIF

SEQ ID NO: 330416 - protein, 22 aa, Mycobacterium
SVSYLDVCDQILLVAPGGKTAF

SEQ ID NO: 330417 - protein, 23 aa, Mycobacterium
SVSYLDVCDQILLVAPGGKTAFC

SEQ ID NO: 330418 - protein, 23 aa, Mycobacterium
SVTAGLLLVCFLVGVVVASVCRR

SEQ ID NO: 330419 - protein, 17 aa, Mycobacterium
SVTAGVLIVCFVSGVVI

SEQ ID NO: 330420 - protein, 18 aa, Mycobacterium
SVTAIALEIEKWWRTGGK

SEQ ID NO: 330421 - protein, 18 aa, Mycobacterium
SVTAPWRAAARRVAGERA

SEQ ID NO: 330422 - protein, 23 aa, Mycobacterium
SVTGLYAAWGIVVKGTLGVAASL

SEQ ID NO: 330423 - protein, 18 aa, Mycobacterium
SVTLEFVLGLALALVMHR

SEQ ID NO: 330424 - protein, 17 aa, Mycobacterium
SVTLLLGGCRFAKEHLS

SEQ ID NO: 330425 - protein, 23 aa, Mycobacterium
SVTSFGEFEFWFAGIKVATIAVF

SEQ ID NO: 330426 - protein, 20 aa, Mycobacterium
SVTTFPWVFLFPAGVLVLIA

SEQ ID NO: 330427 - protein, 18 aa, Mycobacterium
SVTVEFVLGLTLALVMHR

SEQ ID NO: 330428 - protein, 17 aa, Mycobacterium
SVVAGPVASWLINAGDG

SEQ ID NO: 330429 - protein, 19 aa, Mycobacterium
SVVATSFYGRLNCSIVNAA

SEQ ID NO: 330430 - protein, 18 aa, Mycobacterium
SVVCAMALAHLSLGTVLL

SEQ ID NO: 330431 - protein, 18 aa, Mycobacterium
SVVCATWAPTAGGHGSRT

SEQ ID NO: 330432 - protein, 24 aa, Mycobacterium
SVVELLGGPALPWWLFAAAAFALT

SEQ ID NO: 330433 - protein, 20 aa, Mycobacterium
SVVELWRRRSHVGIRLLLAA

SEQ ID NO: 330434 - protein, 17 aa, Mycobacterium
SVVFPFHVSRIALEGSL

SEQ ID NO: 330435 - protein, 27 aa, Mycobacterium
SVVIPWYRLPGVIIVATVVAVLLVGAA

SEQ ID NO: 330436 - protein, 18 aa, Mycobacterium
SVVLGWWLAVVIYLLPRR

SEQ ID NO: 330437 - protein, 42 aa, Mycobacterium
SVVLSLAWMGWLCVMFLRRGHEIPRRYLALVVLASLIAGKAA

SEQ ID NO: 330438 - protein, 21 aa, Mycobacterium
SVVQCYYGFCAEGGPEGVGVA

SEQ ID NO: 330439 - protein, 17 aa, Mycobacterium
SVVRAIAVGLVLVAAML

SEQ ID NO: 330440 - protein, 23 aa, Mycobacterium
SVVRDLPPEGGLVFGTAPAEGRD

SEQ ID NO: 330441 - protein, 17 aa, Mycobacterium
SVVRGTVTFLVLLVLIR

SEQ ID NO: 330442 - protein, 18 aa, Mycobacterium
SVVTLAFGLALAVHHFVE

SEQ ID NO: 330443 - protein, 18 aa, Mycobacterium
SVVTLCLELFGFSDHTPL

SEQ ID NO: 330444 - protein, 19 aa, Mycobacterium
SVVTLCLELFGFSDHTPLA

SEQ ID NO: 330445 - protein, 25 aa, Mycobacterium
SVVTRIEGLLTWLGGGHWGELGERH

SEQ ID NO: 330446 - protein, 18 aa, Mycobacterium
SVVVGILFIGRRLVSTWW

SEQ ID NO: 330447 - protein, 27 aa, Mycobacterium
SVVVVVAAVILWRFVGDTLSDRSDIAA

SEQ ID NO: 330448 - protein, 20 aa, Mycobacterium
SVVYDMWGAAVSTAYQMHSG

SEQ ID NO: 330449 - protein, 19 aa, Mycobacterium
SVWAWQWQQHRGPGMVVAL

SEQ ID NO: 330450 - protein, 20 aa, Mycobacterium
SVWCGLSGSAAMLIAARVAQ

SEQ ID NO: 330451 - protein, 19 aa, Mycobacterium
SVWEVFWPLSVGATLVVAR

SEQ ID NO: 330452 - protein, 19 aa, Mycobacterium
SVWFWIPLAILVIGISSIP

SEQ ID NO: 330453 - protein, 18 aa, Mycobacterium
SVWRAIGGWDEFNVTEDA

SEQ ID NO: 330454 - protein, 27 aa, Mycobacterium
SVWTMALRFGGFAVVVGLVAWLLNRRN

SEQ ID NO: 330455 - protein, 20 aa, Mycobacterium
SVWYLLWLVAAAALGYVVWR

SEQ ID NO: 330456 - protein, 19 aa, Mycobacterium
SWAGLRGAVPIVLATFPIV

SEQ ID NO: 330457 - protein, 23 aa, Mycobacterium
SWAGLRGAVPIVLATFPIVEGVA

SEQ ID NO: 330458 - protein, 19 aa, Mycobacterium
SWAKAAMPRGIELQTSDSD

SEQ ID NO: 330459 - protein, 20 aa, Mycobacterium
SWAMPARWGYAAASSTVDLR

SEQ ID NO: 330460 - protein, 21 aa, Mycobacterium
SWATAIRYQALFTEAGGLTVG

SEQ ID NO: 330461 - protein, 19 aa, Mycobacterium
SWATIVICQIQLYRWSQRG

SEQ ID NO: 330462 - protein, 23 aa, Mycobacterium
SWATIVICQLRLYQWSRHGILKR

SEQ ID NO: 330463 - protein, 22 aa, Mycobacterium
SWATPARWGFAASASTADLTKL

SEQ ID NO: 330464 - protein, 21 aa, Mycobacterium
SWATPARWGFAASASTVDLIK

SEQ ID NO: 330465 - protein, 20 aa, Mycobacterium
SWDPSSWARWLANAVTTGMT

SEQ ID NO: 330466 - protein, 20 aa, Mycobacterium
SWFDAARPVGAWIDTTVRVL

SEQ ID NO: 330467 - protein, 23 aa, Mycobacterium
SWFDAARPVGAWVDAVLRTFIGS

SEQ ID NO: 330468 - protein, 25 aa, Mycobacterium
SWFDAARPVGAWVDTLLRTFIGAGV

SEQ ID NO: 330469 - protein, 20 aa, Mycobacterium
SWFDAARPVGEWIDTALRTL

SEQ ID NO: 330470 - protein, 18 aa, Mycobacterium
SWFHAAKPVGGWIDNAFR

SEQ ID NO: 330471 - protein, 21 aa, Mycobacterium
SWFVARVSIVPTLMLTIPYTV

SEQ ID NO: 330472 - protein, 19 aa, Mycobacterium
SWFVTRWVVASALGGPILF

SEQ ID NO: 330473 - protein, 20 aa, Mycobacterium
SWGGLRRGEIEVADTVKPSS

SEQ ID NO: 330474 - protein, 18 aa, Mycobacterium
SWGMAVATLVSRLTGFAR

SEQ ID NO: 330475 - protein, 21 aa, Mycobacterium
SWGTRVIAFVALIFGTLNVIG

SEQ ID NO: 330476 - protein, 22 aa, Mycobacterium
SWHPRATPTVVVPAGHPKLSPQ

SEQ ID NO: 330477 - protein, 22 aa, Mycobacterium
SWIDQAVTLWVLIALIVAMSLF

SEQ ID NO: 330478 - protein, 18 aa, Mycobacterium
SWIFYATLLVIFWGVWGA

SEQ ID NO: 330479 - protein, 18 aa, Mycobacterium
SWILKRIGRRSELLRDIA

SEQ ID NO: 330480 - protein, 21 aa, Mycobacterium
SWIMWAWYKLFAAMLGPSNFF

SEQ ID NO: 330481 - protein, 37 aa, Mycobacterium
SWIMWVWYKLFALIFGPSNFFAWALSVMFLVFTLRAL

SEQ ID NO: 330482 - protein, 22 aa, Mycobacterium
SWIMWVWYKLFALVLGPSNFFA

SEQ ID NO: 330483 - protein, 23 aa, Mycobacterium
SWIMWVWYKLFASMLGPSNFFAW

SEQ ID NO: 330484 - protein, 21 aa, Mycobacterium
SWKPWLRGTAYGFPFGALPAG

SEQ ID NO: 330485 - protein, 25 aa, Mycobacterium
SWLDRFPIGSTWQVYAFRDTALADT

SEQ ID NO: 330486 - protein, 35 aa, Mycobacterium
SWLGNWTIFYWGWWISWAPFVGMFIARISRGRTIR

SEQ ID NO: 330487 - protein, 26 aa, Mycobacterium
SWLGRLRFGALYAMSGLGGSVLVYLV

SEQ ID NO: 330488 - protein, 21 aa, Mycobacterium
SWLLQRLGRRSTLLHHAAELT

SEQ ID NO: 330489 - protein, 23 aa, Mycobacterium
SWLRFAESVSFVLGPGALAVLGI

SEQ ID NO: 330490 - protein, 17 aa, Mycobacterium
SWLRFGHGLVVSSILLW

SEQ ID NO: 330491 - protein, 19 aa, Mycobacterium
SWLTFPIGTLKTAGAIGLA

SEQ ID NO: 330492 - protein, 19 aa, Mycobacterium
SWPAYVGIRPLEFSLGQYN

SEQ ID NO: 330493 - protein, 20 aa, Mycobacterium
SWPGAYPVRAGLLFVDGVVN

SEQ ID NO: 330494 - protein, 20 aa, Mycobacterium
SWPPDTAFMATPFVLAVMFA

SEQ ID NO: 330495 - protein, 26 aa, Mycobacterium
SWPSELGDRPALWIPSSSIGSARLEA

SEQ ID NO: 330496 - protein, 20 aa, Mycobacterium
SWPTTLHMTLVVIALIITIH

SEQ ID NO: 330497 - protein, 26 aa, Mycobacterium
SWQGENRIAWWVGVGIAVLVTLLSVV

SEQ ID NO: 330498 - protein, 26 aa, Mycobacterium
SWQGEYRVAWWVGVGLAVVLTLLSIV

SEQ ID NO: 330499 - protein, 22 aa, Mycobacterium
SWQMIVYVCIFRAIKNQPDDEL

SEQ ID NO: 330500 - protein, 25 aa, Mycobacterium
SWRILSEDLSRAWNDLAAGRDVAAD

SEQ ID NO: 330501 - protein, 23 aa, Mycobacterium
SWRLIGKCLRPLPNKWKGLTDPE

SEQ ID NO: 330502 - protein, 18 aa, Mycobacterium
SWSLGWWAGAIEFLTGVA

SEQ ID NO: 330503 - protein, 19 aa, Mycobacterium
SWSTLRRSVTLTAIGAVVI

SEQ ID NO: 330504 - protein, 20 aa, Mycobacterium
SWTHHWVWLVPLMIWLLSGP

SEQ ID NO: 330505 - protein, 21 aa, Mycobacterium
SWTHHWVWLVPLMIWVLQGPV

SEQ ID NO: 330506 - protein, 24 aa, Mycobacterium
SWTVLALAALVVWLLAARSIHGAR

SEQ ID NO: 330507 - protein, 23 aa, Mycobacterium
SWVAINICGFFKANRGQYDPKAL

SEQ ID NO: 330508 - protein, 18 aa, Mycobacterium
SWVNLTAAMMLVFFFVAA

SEQ ID NO: 330509 - protein, 23 aa, Mycobacterium
SWVSLGVCWLIWVLNAYDREIIL

SEQ ID NO: 330510 - protein, 22 aa, Mycobacterium
SWVWCGALFNVLAVVVFLGVIT

SEQ ID NO: 330511 - protein, 19 aa, Mycobacterium
SWWAYPLILASCTFDAILP

SEQ ID NO: 330512 - protein, 25 aa, Mycobacterium
SWYLWHWPALLLAPALIGADLGLAG

SEQ ID NO: 330513 - protein, 24 aa, Mycobacterium
SWYLWHWPVLLLATPLLGRPMGPL

SEQ ID NO: 330514 - protein, 28 aa, Mycobacterium
SYAFDFSVWEIWAALLGGARVVVVPESI

SEQ ID NO: 330515 - protein, 22 aa, Mycobacterium
SYAFYDFERGWALVGLAIAFAV

SEQ ID NO: 330516 - protein, 21 aa, Mycobacterium
SYAFYDFERGWSLVALAVAFA

SEQ ID NO: 330517 - protein, 21 aa, Mycobacterium
SYATLCAWLAARDARGRARKS

SEQ ID NO: 330518 - protein, 24 aa, Mycobacterium
SYAVYRRSRLMPVIAGLAMGVVLA

SEQ ID NO: 330519 - protein, 19 aa, Mycobacterium
SYCYGLSVVHSHLLVGAAL

SEQ ID NO: 330520 - protein, 18 aa, Mycobacterium
SYECLIVAAAQFALGIVV

SEQ ID NO: 330521 - protein, 21 aa, Mycobacterium
SYESTPLWAGIFLLPMTLGFL

SEQ ID NO: 330522 - protein, 17 aa, Mycobacterium
SYFPRPGPGPRFLDAPG

SEQ ID NO: 330523 - protein, 26 aa, Mycobacterium
SYFVAFEVSQGWTLGKKLLGMRVHGP

SEQ ID NO: 330524 - protein, 24 aa, Mycobacterium
SYGGDAWVIREGRRSRIDATNRSV

SEQ ID NO: 330525 - protein, 19 aa, Mycobacterium
SYGGDYGADYGAYPPPDQP

SEQ ID NO: 330526 - protein, 25 aa, Mycobacterium
SYGGPELPWWLWAIVTLGLVAYLGY

SEQ ID NO: 330527 - protein, 23 aa, Mycobacterium
SYGLGAILGFIGVKLILHALHEN

SEQ ID NO: 330528 - protein, 19 aa, Mycobacterium
SYGLMTWLIVWRAAEDRRD

SEQ ID NO: 330529 - protein, 18 aa, Mycobacterium
SYGSWRAALPHFLGSSGV

SEQ ID NO: 330530 - protein, 18 aa, Mycobacterium
SYGWAFVVGGAMPLIAAV

SEQ ID NO: 330531 - protein, 25 aa, Mycobacterium
SYITHLTWELGWLILHKPIAGARSS

SEQ ID NO: 330532 - protein, 18 aa, Mycobacterium
SYKARFGNVSGLEAGNFV

SEQ ID NO: 330533 - protein, 22 aa, Mycobacterium
SYKVPRRFAVIHSDELPVKSSG

SEQ ID NO: 330534 - protein, 17 aa, Mycobacterium
SYLDRYGIRADKIRITS

SEQ ID NO: 330535 - protein, 24 aa, Mycobacterium
SYLLAEFALRPVAAQALEAGPPPR

SEQ ID NO: 330536 - protein, 25 aa, Mycobacterium
SYLLTEFALRPVAAQALEAGPPPRR

SEQ ID NO: 330537 - protein, 23 aa, Mycobacterium
SYLMISRMLPLFHRLQSLIDNIN

SEQ ID NO: 330538 - protein, 18 aa, Mycobacterium
SYLVPPPAGIPVDPVPDW

SEQ ID NO: 330539 - protein, 17 aa, Mycobacterium
SYMALFSVPVLAPLVLR

SEQ ID NO: 330540 - protein, 28 aa, Mycobacterium
SYMFTEFALRPVAAMALAAGPPLLRWAP

SEQ ID NO: 330541 - protein, 27 aa, Mycobacterium
SYMSALGIGVVFFQFILGKEIVWTVPG

SEQ ID NO: 330542 - protein, 24 aa, Mycobacterium
SYNPWDQRLCLIPDADLYTAIADG

SEQ ID NO: 330543 - protein, 26 aa, Mycobacterium
SYPGFPADVLYEFRLLALATQLVLWA

SEQ ID NO: 330544 - protein, 22 aa, Mycobacterium
SYPPGFAPYPFPPAPRPPVSGV

SEQ ID NO: 330545 - protein, 30 aa, Mycobacterium
SYPQHWGYWPAAFGLFAFVWLELASPDPGS

SEQ ID NO: 330546 - protein, 19 aa, Mycobacterium
SYQGCVWRCGEPQDDFEFD

SEQ ID NO: 330547 - protein, 23 aa, Mycobacterium
SYQKCGDPAWIDRAMNLGTWGGA

SEQ ID NO: 330548 - protein, 17 aa, Mycobacterium
SYRVCLKTLSAIESRTA

SEQ ID NO: 330549 - protein, 25 aa, Mycobacterium
SYSEEGPCWSMRLNMIEPLKEPAWR

SEQ ID NO: 330550 - protein, 26 aa, Mycobacterium
SYSEERLRPPPGYKDTTVPGIFSRDT

SEQ ID NO: 330551 - protein, 23 aa, Mycobacterium
SYSLPVRRLVGFAAAGLDASLIP

SEQ ID NO: 330552 - protein, 22 aa, Mycobacterium
SYTSSYLRFVWTLSATAMVVCY

SEQ ID NO: 330553 - protein, 19 aa, Mycobacterium
SYTSVVLVFLVFMVTLIGV

SEQ ID NO: 330554 - protein, 22 aa, Mycobacterium
SYTWPQMLSRFFVVFLAGALFY

SEQ ID NO: 330555 - protein, 18 aa, Mycobacterium
SYVAAHLPYLAWLNQASA

SEQ ID NO: 330556 - protein, 20 aa, Mycobacterium
SYWTVEATRALAQTVTASDL

SEQ ID NO: 330557 - protein, 19 aa, Mycobacterium
SYYPRPGPGPRFLDAPGQP

SEQ ID NO: 330558 - protein, 17 aa, Mycobacterium
TAAAAVWLLLPRQLPLE

SEQ ID NO: 330559 - protein, 22 aa, Mycobacterium
TAAAFFCLGIWALSPIYPDEIA

SEQ ID NO: 330560 - protein, 20 aa, Mycobacterium
TAAALAWTWYLLSRNPDARA

SEQ ID NO: 330561 - protein, 18 aa, Mycobacterium
TAAALVFNRLFFTDLDPA

SEQ ID NO: 330562 - protein, 19 aa, Mycobacterium
TAAALVFPKLFFPNASPAA

SEQ ID NO: 330563 - protein, 17 aa, Mycobacterium
TAAALVFPSVFYPGLGP

SEQ ID NO: 330564 - protein, 24 aa, Mycobacterium
TAAAPWYLSLAMLAGLVIVGAVGG

SEQ ID NO: 330565 - protein, 21 aa, Mycobacterium
TAAAWWLCSAATVVTMLYLAY

SEQ ID NO: 330566 - protein, 20 aa, Mycobacterium
TAADDAMDWTRTGPAERVDI

SEQ ID NO: 330567 - protein, 17 aa, Mycobacterium
TAADVLIALAITGFGAR

SEQ ID NO: 330568 - protein, 23 aa, Mycobacterium
TAAEIALLWWARRIFAAPLPLLG

SEQ ID NO: 330569 - protein, 24 aa, Mycobacterium
TAAESGAQWGYRMVLPQLILMPIL

SEQ ID NO: 330570 - protein, 17 aa, Mycobacterium
TAAEVILGILLLIGWKP

SEQ ID NO: 330571 - protein, 18 aa, Mycobacterium
TAAFALAAVLARPVGGML

SEQ ID NO: 330572 - protein, 25 aa, Mycobacterium
TAAFRRILPFVGRIAGVIVLITGLY

SEQ ID NO: 330573 - protein, 23 aa, Mycobacterium
TAAFRRVLPYVGRIVGVIVLLTG

SEQ ID NO: 330574 - protein, 32 aa, Mycobacterium
TAAGIGWPVGRPCASCCLMVATGSAALWWHAA

SEQ ID NO: 330575 - protein, 32 aa, Mycobacterium
TAAGLLCLVSLPWVVRGCALLDAGLARTLLCG

SEQ ID NO: 330576 - protein, 18 aa, Mycobacterium
TAAGLVFGVAFFPNLSPL

SEQ ID NO: 330577 - protein, 18 aa, Mycobacterium
TAAGVWLAAGAELLWELP

SEQ ID NO: 330578 - protein, 20 aa, Mycobacterium
TAAILFRFTERRTLAEFAPF

SEQ ID NO: 330579 - protein, 18 aa, Mycobacterium
TAAIRLTFAMARDNALPF

SEQ ID NO: 330580 - protein, 28 aa, Mycobacterium
TAAISRRWRPAWIGWWVALGLAAAVAGG

SEQ ID NO: 330581 - protein, 19 aa, Mycobacterium
TAAKAAWREVLDGFETPTL

SEQ ID NO: 330582 - protein, 30 aa, Mycobacterium
TAALAGIFVCLFCAFYFMTVTYSLMTFWIT

SEQ ID NO: 330583 - protein, 19 aa, Mycobacterium
TAALAGWVVVARRRDTHAA

SEQ ID NO: 330584 - protein, 23 aa, Mycobacterium
TAALDMGEGFGMPSDDSSERMME

SEQ ID NO: 330585 - protein, 20 aa, Mycobacterium
TAALGCSLLVLYLLTMATGQ

SEQ ID NO: 330586 - protein, 30 aa, Mycobacterium
TAALLFIGCFTMWWQEFYADWGAYLYYNPD

SEQ ID NO: 330587 - protein, 24 aa, Mycobacterium
TAALLPVFFLLPISVAFQDRPALT

SEQ ID NO: 330588 - protein, 23 aa, Mycobacterium
TAALLPVFFLLPISVAFQDRPLL

SEQ ID NO: 330589 - protein, 26 aa, Mycobacterium
TAALRRRLIICVALSVPVIAMAMAPP

SEQ ID NO: 330590 - protein, 17 aa, Mycobacterium
TAALYVRVGDNLHPVLN

SEQ ID NO: 330591 - protein, 17 aa, Mycobacterium
TAALYVRVGDQLHPVLN

SEQ ID NO: 330592 - protein, 17 aa, Mycobacterium
TAALYVRVGEDLHPVLN

SEQ ID NO: 330593 - protein, 19 aa, Mycobacterium
TAAPVFAVRIILGGFAGAV

SEQ ID NO: 330594 - protein, 23 aa, Mycobacterium
TAARARTAAFFDLDKTIIAKSST

SEQ ID NO: 330595 - protein, 17 aa, Mycobacterium
TAARIGVIFVVAVIFGV

SEQ ID NO: 330596 - protein, 26 aa, Mycobacterium
TAARLCKRLLASRGLMAAVVVLAIAG

SEQ ID NO: 330597 - protein, 28 aa, Mycobacterium
TAARLGLSAPRTAPWQVVSLLVDGPVLS

SEQ ID NO: 330598 - protein, 23 aa, Mycobacterium
TAARLKLGHPAQMVVRLAIVVTV

SEQ ID NO: 330599 - protein, 18 aa, Mycobacterium
TAARVAGVMWKRFTETGA

SEQ ID NO: 330600 - protein, 28 aa, Mycobacterium
TAARWAELRPALKDQLGTRIELRLGDPA

SEQ ID NO: 330601 - protein, 18 aa, Mycobacterium
TAASGIWTVCAVLMVPLT

SEQ ID NO: 330602 - protein, 18 aa, Mycobacterium
TAASLVFNQAFFPDQSTF

SEQ ID NO: 330603 - protein, 18 aa, Mycobacterium
TAATAALWASMRERTPAA

SEQ ID NO: 330604 - protein, 21 aa, Mycobacterium
TAATAPARWEFAGAERTGDVA

SEQ ID NO: 330605 - protein, 25 aa, Mycobacterium
TACAPGASHFGHWVGELPWFIPMAF

SEQ ID NO: 330606 - protein, 19 aa, Mycobacterium
TACAPGSSHFGQWVGDLPW

SEQ ID NO: 330607 - protein, 44 aa, Mycobacterium
TACLCAAVWLLCHRPNRVWWRFVAWWLPCVALAVTWWVIALLHL

SEQ ID NO: 330608 - protein, 19 aa, Mycobacterium
TADELYAQVGFVLQETQLV

SEQ ID NO: 330609 - protein, 23 aa, Mycobacterium
TADELYRQVGFVLQDTQLVGGTV

SEQ ID NO: 330610 - protein, 19 aa, Mycobacterium
TADGLGCYGPPQRALAVMR

SEQ ID NO: 330611 - protein, 23 aa, Mycobacterium
TADIYPRYTCDYGTPRRPSSSAD

SEQ ID NO: 330612 - protein, 27 aa, Mycobacterium
TADTRLYLPMPFFWVGGFGAGIVTALV

SEQ ID NO: 330613 - protein, 25 aa, Mycobacterium
TAEAARMLMLPDVLNSVVKATEAAA

SEQ ID NO: 330614 - protein, 17 aa, Mycobacterium
TAEAVVLSADFINEALS

SEQ ID NO: 330615 - protein, 26 aa, Mycobacterium
TAEDRLFCNSPFFWIGGFAFGLLATL

SEQ ID NO: 330616 - protein, 20 aa, Mycobacterium
TAEIVAAILIAARPFSARAT

SEQ ID NO: 330617 - protein, 24 aa, Mycobacterium
TAELYPRYTCDYGTPSYLPSAADY

SEQ ID NO: 330618 - protein, 24 aa, Mycobacterium
TAERLRLLIQPVLVLVVAGAVIFW

SEQ ID NO: 330619 - protein, 22 aa, Mycobacterium
TAERRRTVAFTNGYDFGYYSLV

SEQ ID NO: 330620 - protein, 31 aa, Mycobacterium
TAEVRPASWGARAGALALDILPALGVIATCV

SEQ ID NO: 330621 - protein, 25 aa, Mycobacterium
TAEWWPKERRGFALGAHHTGYPVGS

SEQ ID NO: 330622 - protein, 27 aa, Mycobacterium
TAFACVWYFRRTLFSSARNLFFRGVFP

SEQ ID NO: 330623 - protein, 17 aa, Mycobacterium
TAFGFSLDDIVLVPTAE

SEQ ID NO: 330624 - protein, 25 aa, Mycobacterium
TAFIPRFLFAVGFPGIVVATACYMI

SEQ ID NO: 330625 - protein, 23 aa, Mycobacterium
TAFLLYLRMFFEPMQEISQFFNT

SEQ ID NO: 330626 - protein, 23 aa, Mycobacterium
TAFQWNWKFGYQKIAFADGSFDY

SEQ ID NO: 330627 - protein, 23 aa, Mycobacterium
TAFQWNWKFGYQKVAFKDGSLNY

SEQ ID NO: 330628 - protein, 24 aa, Mycobacterium
TAFQWNWKFGYQKVDFHDHTLTYD

SEQ ID NO: 330629 - protein, 23 aa, Mycobacterium
TAFQWNWKFGYQKVEFADGTMSY

SEQ ID NO: 330630 - protein, 25 aa, Mycobacterium
TAFSGIRPSFPILAANLANFGRIGV

SEQ ID NO: 330631 - protein, 20 aa, Mycobacterium
TAFSLLGLRQLYFLIDNLLD

SEQ ID NO: 330632 - protein, 18 aa, Mycobacterium
TAFTAIGTGAMWLWNNAI

SEQ ID NO: 330633 - protein, 18 aa, Mycobacterium
TAFTLAAGLLFGPLLGVA

SEQ ID NO: 330634 - protein, 20 aa, Mycobacterium
TAFTSALPWMAGRIGTPTVP

SEQ ID NO: 330635 - protein, 36 aa, Mycobacterium
TAFVPNFLVMEIFQPFFDYFFGFRAYGAPGQPPDTA

SEQ ID NO: 330636 - protein, 27 aa, Mycobacterium
TAGAPEAVDFSRWWAGTHQHVTDLQKS

SEQ ID NO: 330637 - protein, 24 aa, Mycobacterium
TAGAWLFDMGMLAALSIGYAGLVR

SEQ ID NO: 330638 - protein, 28 aa, Mycobacterium
TAGEMLLLWWQRRFFAVPLPTFGLPLGD

SEQ ID NO: 330639 - protein, 17 aa, Mycobacterium
TAGGFYLAFLFPLIGFL

SEQ ID NO: 330640 - protein, 19 aa, Mycobacterium
TAGGFYLAFLFPLVGFLVV

SEQ ID NO: 330641 - protein, 24 aa, Mycobacterium
TAGGLLGWCWRRSSPPSPAGSNFQ

SEQ ID NO: 330642 - protein, 26 aa, Mycobacterium
TAGHARAPWEAWTLVLAVLGPAVAVC

SEQ ID NO: 330643 - protein, 21 aa, Mycobacterium
TAGLRAAHRGQTGVLSATDYL

SEQ ID NO: 330644 - protein, 17 aa, Mycobacterium
TAGPGARIVPLHLADSA

SEQ ID NO: 330645 - protein, 25 aa, Mycobacterium
TAGRAATFLAPWLFSVFIDVFDSYR

SEQ ID NO: 330646 - protein, 18 aa, Mycobacterium
TAGVAAACATVLQQAAGE

SEQ ID NO: 330647 - protein, 20 aa, Mycobacterium
TAGWHWKAALNGFGATLSAI

SEQ ID NO: 330648 - protein, 24 aa, Mycobacterium
TAGYWLCCLLLTMTLGLLFSAFHM

SEQ ID NO: 330649 - protein, 25 aa, Mycobacterium
TAHAAGRTWVLWVLLGTGQLLSHLL

SEQ ID NO: 330650 - protein, 24 aa, Mycobacterium
TAHIRTGSLLGERVLTLEPAGSGT

SEQ ID NO: 330651 - protein, 23 aa, Mycobacterium
TAHIRTGSLLGQRVLTLESAGSG

SEQ ID NO: 330652 - protein, 23 aa, Mycobacterium
TAHIRTGTLLGQRVLTVQSEGDG

SEQ ID NO: 330653 - protein, 20 aa, Mycobacterium
TAHRRVWRDREPALASPGRP

SEQ ID NO: 330654 - protein, 25 aa, Mycobacterium
TAHVAFSIWYLWSVMVLFMPVSTYG

SEQ ID NO: 330655 - protein, 23 aa, Mycobacterium
TAHYRREIIRLIAEISMGAGTLA

SEQ ID NO: 330656 - protein, 37 aa, Mycobacterium
TAIAGFVFTWLRRRSGSLLAPIALHWSLNGMGVLAAV

SEQ ID NO: 330657 - protein, 17 aa, Mycobacterium
TAIAIKRAEVRRAAEIM

SEQ ID NO: 330658 - protein, 24 aa, Mycobacterium
TAIAVCAFAAWGAFLFMMSIYLQG

SEQ ID NO: 330659 - protein, 26 aa, Mycobacterium
TAIAVWCVTAIIGAFAAHRGYRSWRG

SEQ ID NO: 330660 - protein, 23 aa, Mycobacterium
TAIEMLVPLALFFSHGGWPTALA

SEQ ID NO: 330661 - protein, 18 aa, Mycobacterium
TAIGGGVLRDVIIGQHPP

SEQ ID NO: 330662 - protein, 22 aa, Mycobacterium
TAIGIGWGITWLGYAADYSRFV

SEQ ID NO: 330663 - protein, 26 aa, Mycobacterium
TAIKNVIGAVWGWLSTTVFPALKTAF

SEQ ID NO: 330664 - protein, 18 aa, Mycobacterium
TAILCLLGSSILTVAGTW

SEQ ID NO: 330665 - protein, 17 aa, Mycobacterium
TAILIPYGIVTVVASYS

SEQ ID NO: 330666 - protein, 17 aa, Mycobacterium
TAIPAYWHQAADWLSEH

SEQ ID NO: 330667 - protein, 24 aa, Mycobacterium
TAIPVAIALLLSWRFGPRALGPDD

SEQ ID NO: 330668 - protein, 17 aa, Mycobacterium
TAIPVSIALLLSLRFGS

SEQ ID NO: 330669 - protein, 24 aa, Mycobacterium
TAIRGLRGPQVFEIVRDGKPQSLM

SEQ ID NO: 330670 - protein, 19 aa, Mycobacterium
TAISAALGYAGWRSPPATP

SEQ ID NO: 330671 - protein, 25 aa, Mycobacterium
TAIVCTFAALPLGVLAARYRDRVTR

SEQ ID NO: 330672 - protein, 23 aa, Mycobacterium
TAIVLLLAIGWRSRRRLPAAVIF

SEQ ID NO: 330673 - protein, 21 aa, Mycobacterium
TAIVLSYHWARVVATRSALQL

SEQ ID NO: 330674 - protein, 26 aa, Mycobacterium
TAIVVLCCWAALGTVMVVIAALRQAR

SEQ ID NO: 330675 - protein, 20 aa, Mycobacterium
TAIWWFLIRPWVRERRITLD

SEQ ID NO: 330676 - protein, 22 aa, Mycobacterium
TAKACLRLGLTPDVVTILGTVV

SEQ ID NO: 330677 - protein, 24 aa, Mycobacterium
TAKFGLGESAGWAACAGFVAAVVA

SEQ ID NO: 330678 - protein, 24 aa, Mycobacterium
TAKRLCPQRDVLLISVGDGPAPAP

SEQ ID NO: 330679 - protein, 23 aa, Mycobacterium
TAKRSRWALLLDWREPEAPAYPM

SEQ ID NO: 330680 - protein, 27 aa, Mycobacterium
TAKVWLFLFFFMWLRATLPRMRYDQFM

SEQ ID NO: 330681 - protein, 26 aa, Mycobacterium
TAKVWTFMFLYFWLRATLPRLRYDQF

SEQ ID NO: 330682 - protein, 17 aa, Mycobacterium
TALAALVVMCLVMIGFQ

SEQ ID NO: 330683 - protein, 17 aa, Mycobacterium
TALALVLIMNYDGATGS

SEQ ID NO: 330684 - protein, 19 aa, Mycobacterium
TALCGAGLTLTGFLGLSDT

SEQ ID NO: 330685 - protein, 21 aa, Mycobacterium
TALCGGPFFLWLLRRDARRAD

SEQ ID NO: 330686 - protein, 22 aa, Mycobacterium
TALCGYAVIYLAARDLAPSGFS

SEQ ID NO: 330687 - protein, 22 aa, Mycobacterium
TALCGYAVLYLAARDLEPAGFS

SEQ ID NO: 330688 - protein, 22 aa, Mycobacterium
TALCGYGVIYLAARDLAPSGFS

SEQ ID NO: 330689 - protein, 26 aa, Mycobacterium
TALFNIIWRIFEAIISIVIAAFALSL

SEQ ID NO: 330690 - protein, 18 aa, Mycobacterium
TALFQFAFDVQTFELPQG

SEQ ID NO: 330691 - protein, 17 aa, Mycobacterium
TALFSARDPLGVRADDL

SEQ ID NO: 330692 - protein, 18 aa, Mycobacterium
TALGFPRGDRVTATAELA

SEQ ID NO: 330693 - protein, 34 aa, Mycobacterium
TALGGGIKLAMWGARPVIAALFDRAKERLAEPVL

SEQ ID NO: 330694 - protein, 24 aa, Mycobacterium
TALGIPVIPVIAHRGGGIDTLRAQ

SEQ ID NO: 330695 - protein, 22 aa, Mycobacterium
TALGLCAGTALLSVLIGSAGSR

SEQ ID NO: 330696 - protein, 29 aa, Mycobacterium
TALGRWLSGRFGWRRPPTLLVVGLVVGFC

SEQ ID NO: 330697 - protein, 34 aa, Mycobacterium
TALICVYAFAALWALALAFRRSRPMVSLDRFANI

SEQ ID NO: 330698 - protein, 18 aa, Mycobacterium
TALIVVVAAHLRRRRRLG

SEQ ID NO: 330699 - protein, 20 aa, Mycobacterium
TALLALFGYLKVRRIRGPQK

SEQ ID NO: 330700 - protein, 23 aa, Mycobacterium
TALLCSPMPIAAFLVTPIVGKIV

SEQ ID NO: 330701 - protein, 18 aa, Mycobacterium
TALLDGILTFFVVAAFGA

SEQ ID NO: 330702 - protein, 20 aa, Mycobacterium
TALLDVYQALFVVAAFGALI

SEQ ID NO: 330703 - protein, 17 aa, Mycobacterium
TALLGLLTYLASFGPKL

SEQ ID NO: 330704 - protein, 25 aa, Mycobacterium
TALLILFAFPMFWLVNTGSTVLIVL

SEQ ID NO: 330705 - protein, 25 aa, Mycobacterium
TALLRLCMLPGLALLIWAAPRLARH

SEQ ID NO: 330706 - protein, 24 aa, Mycobacterium
TALNEGRGDFFAVVKSLALFVNAL

SEQ ID NO: 330707 - protein, 25 aa, Mycobacterium
TALNEGRGDFFAVVKSLALFVNALH

SEQ ID NO: 330708 - protein, 19 aa, Mycobacterium
TALPLLFFALAGRETAGRV

SEQ ID NO: 330709 - protein, 17 aa, Mycobacterium
TALPVWGIIAGKALAVV

SEQ ID NO: 330710 - protein, 23 aa, Mycobacterium
TALRELALLWLADQVDAALAKYR

SEQ ID NO: 330711 - protein, 23 aa, Mycobacterium
TALRELALLWLADQVDAALEKYR

SEQ ID NO: 330712 - protein, 23 aa, Mycobacterium
TALRELALLWLADQVDTALAKYR

SEQ ID NO: 330713 - protein, 18 aa, Mycobacterium
TALRLSRKTLGTIKANLF

SEQ ID NO: 330714 - protein, 23 aa, Mycobacterium
TALRTAYSAVMARNPVLRSAFWA

SEQ ID NO: 330715 - protein, 18 aa, Mycobacterium
TALRYGFEQTWPASGTSW

SEQ ID NO: 330716 - protein, 21 aa, Mycobacterium
TALTWVRFAVWLVVGTAIYVG

SEQ ID NO: 330717 - protein, 18 aa, Mycobacterium
TALWLLVALAVYDAIATI

SEQ ID NO: 330718 - protein, 23 aa, Mycobacterium
TAMAAAVAPYVVWMRATAAQAEQ

SEQ ID NO: 330719 - protein, 18 aa, Mycobacterium
TAMARNPVFLAFPLMMLV

SEQ ID NO: 330720 - protein, 18 aa, Mycobacterium
TAMARWAGLGKRYPLVGI

SEQ ID NO: 330721 - protein, 28 aa, Mycobacterium
TAMDGLRLPNWGTLKLALPKLDNGDTAY

SEQ ID NO: 330722 - protein, 19 aa, Mycobacterium
TAMGALVAWALVAPLVLDR

SEQ ID NO: 330723 - protein, 19 aa, Mycobacterium
TAMLGSWMAVAAGAWFVVG

SEQ ID NO: 330724 - protein, 17 aa, Mycobacterium
TAMSIGFAVAVSALAAL

SEQ ID NO: 330725 - protein, 18 aa, Mycobacterium
TAMVVCYGLWAFSRDRAN

SEQ ID NO: 330726 - protein, 23 aa, Mycobacterium
TANEWIETIALLAHIAIMLVFLL

SEQ ID NO: 330727 - protein, 22 aa, Mycobacterium
TANRVSMLLAMQGQRGTNAEDM

SEQ ID NO: 330728 - protein, 25 aa, Mycobacterium
TANSVGLDIYWRNARTHTTHDPLPY

SEQ ID NO: 330729 - protein, 19 aa, Mycobacterium
TAPAVGFLGAYRRLWQEIG

SEQ ID NO: 330730 - protein, 21 aa, Mycobacterium
TAPDWRAALRVAVPAVIAVLA

SEQ ID NO: 330731 - protein, 17 aa, Mycobacterium
TAPELGQMVRFRHNTGD

SEQ ID NO: 330732 - protein, 21 aa, Mycobacterium
TAPGELRITLMRGDVLADPIA

SEQ ID NO: 330733 - protein, 21 aa, Mycobacterium
TAPGELRITLMRGDVLADPIV

SEQ ID NO: 330734 - protein, 22 aa, Mycobacterium
TAPGLVLRGFVERVGDRAPLVA

SEQ ID NO: 330735 - protein, 20 aa, Mycobacterium
TAPIGFGAWLRIFGIAVVAS

SEQ ID NO: 330736 - protein, 18 aa, Mycobacterium
TAPLRTWAIVAAVLAPLL

SEQ ID NO: 330737 - protein, 30 aa, Mycobacterium
TAPLWASHVFTEFRWLSVALLAGGLAGFCM

SEQ ID NO: 330738 - protein, 29 aa, Mycobacterium
TAPLWRAAQLFRLLSCGYALGFHIAINAN

SEQ ID NO: 330739 - protein, 24 aa, Mycobacterium
TAPNSSWFVTRWVVASALGGPLLI

SEQ ID NO: 330740 - protein, 21 aa, Mycobacterium
TAPPYPPSILLTGVIVNKLGR

SEQ ID NO: 330741 - protein, 17 aa, Mycobacterium
TAPRAGLVMERDAKVKY

SEQ ID NO: 330742 - protein, 34 aa, Mycobacterium
TAPRGPSRVGRGWLAAIAVLLALCAGAIGAGGYL

SEQ ID NO: 330743 - protein, 17 aa, Mycobacterium
TAPRWLRHATDAWIAVL

SEQ ID NO: 330744 - protein, 18 aa, Mycobacterium
TAPSTVKMTTEWLHVPLL

SEQ ID NO: 330745 - protein, 31 aa, Mycobacterium
TAPTDFRFLGWHWTLPLGVAILLAAVVGGLI

SEQ ID NO: 330746 - protein, 24 aa, Mycobacterium
TAPVPAAPGAPGFVPNPNPGVPVP

SEQ ID NO: 330747 - protein, 19 aa, Mycobacterium
TAPVPAVIGYFVAGLLFVV

SEQ ID NO: 330748 - protein, 28 aa, Mycobacterium
TAQNLLRAGEKFTWLGRGMEVAKAGVDL

SEQ ID NO: 330749 - protein, 25 aa, Mycobacterium
TAQPRAFLPVFLLAYFASAVALLAA

SEQ ID NO: 330750 - protein, 19 aa, Mycobacterium
TAQRPAVFIFNHRNQVDPV

SEQ ID NO: 330751 - protein, 29 aa, Mycobacterium
TAQSLAFAVFWMRNQFRGFPGEIIEAARL

SEQ ID NO: 330752 - protein, 23 aa, Mycobacterium
TARAKGLGAHGVYFNHALSAALN

SEQ ID NO: 330753 - protein, 23 aa, Mycobacterium
TARAMPGSGLGLAIVKQVVLKHG

SEQ ID NO: 330754 - protein, 22 aa, Mycobacterium
TAREWMWAILLAGAVAVIVTAG

SEQ ID NO: 330755 - protein, 19 aa, Mycobacterium
TARICAIVYLGPVGLLPTF

SEQ ID NO: 330756 - protein, 18 aa, Mycobacterium
TARLGRASSIGALSVPQS

SEQ ID NO: 330757 - protein, 18 aa, Mycobacterium
TARLYIRPVVHAIPAGEG

SEQ ID NO: 330758 - protein, 21 aa, Mycobacterium
TARPHTAPGWITVDDFVQRYV

SEQ ID NO: 330759 - protein, 25 aa, Mycobacterium
TARSRLDPAAGVMLSALWVTSTSQL

SEQ ID NO: 330760 - protein, 19 aa, Mycobacterium
TARSWPVLNADASSPSTLN

SEQ ID NO: 330761 - protein, 20 aa, Mycobacterium
TARTRGPIRIARPAVPAEIR

SEQ ID NO: 330762 - protein, 19 aa, Mycobacterium
TARVPRRVLLLGLMAVFTL

SEQ ID NO: 330763 - protein, 20 aa, Mycobacterium
TARVPTLWIVLGPLGQSITA

SEQ ID NO: 330764 - protein, 22 aa, Mycobacterium
TARVRRALAAAHCASTILQAGQ

SEQ ID NO: 330765 - protein, 23 aa, Mycobacterium
TASALEFLGPLGVAVARGRGRGR

SEQ ID NO: 330766 - protein, 23 aa, Mycobacterium
TASARGAGHLGLAGTSPKTTATA

SEQ ID NO: 330767 - protein, 24 aa, Mycobacterium
TASARQAPWVLIRTFAPGPALSRA

SEQ ID NO: 330768 - protein, 19 aa, Mycobacterium
TASAWRWTAALAALVMLAS

SEQ ID NO: 330769 - protein, 29 aa, Mycobacterium
TASIPARWRPAWIGWWLGIAVAATVDADF

SEQ ID NO: 330770 - protein, 18 aa, Mycobacterium
TASLLSMFGYGLTYAVAS

SEQ ID NO: 330771 - protein, 18 aa, Mycobacterium
TASLPYFVVLAVLAGGSL

SEQ ID NO: 330772 - protein, 24 aa, Mycobacterium
TASLRQRLLISLVLTVPVILMAMV

SEQ ID NO: 330773 - protein, 25 aa, Mycobacterium
TASMYRCCIALAVSVGCGYVIGFRF

SEQ ID NO: 330774 - protein, 22 aa, Mycobacterium
TASPRRPGVVVVDRHSDTDVLE

SEQ ID NO: 330775 - protein, 24 aa, Mycobacterium
TASTAAPLLVVWVIAAALHVAVGS

SEQ ID NO: 330776 - protein, 18 aa, Mycobacterium
TASWWRTLLAPIIGGAGM

SEQ ID NO: 330777 - protein, 28 aa, Mycobacterium
TATAFLLGDLALWAAVGVITAQRGNVSL

SEQ ID NO: 330778 - protein, 18 aa, Mycobacterium
TATALLVVFFRHNLSMNG

SEQ ID NO: 330779 - protein, 25 aa, Mycobacterium
TATALVWFPLWFVILGIGWALVRRR

SEQ ID NO: 330780 - protein, 35 aa, Mycobacterium
TATAPFKSATKWSGISFRDHGNWVIGAPDVLLDSA

SEQ ID NO: 330781 - protein, 25 aa, Mycobacterium
TATAPFKSATKWSGVSFGDHGNWVI

SEQ ID NO: 330782 - protein, 25 aa, Mycobacterium
TATARIGFDLGFAVLDHSQHDVADR

SEQ ID NO: 330783 - protein, 26 aa, Mycobacterium
TATAVFGIFAHRWLARRTRRRINPGL

SEQ ID NO: 330784 - protein, 19 aa, Mycobacterium
TATEQIPFWTFLRNSVVIT

SEQ ID NO: 330785 - protein, 21 aa, Mycobacterium
TATGYLGAWIFYSKRDDTVGL

SEQ ID NO: 330786 - protein, 18 aa, Mycobacterium
TATLGDKCVIARLGGDEF

SEQ ID NO: 330787 - protein, 28 aa, Mycobacterium
TATLGLRFYLRWITSTGYTYGALSTPIA

SEQ ID NO: 330788 - protein, 24 aa, Mycobacterium
TATLRPGLVVLVAFDPADRQELSL

SEQ ID NO: 330789 - protein, 20 aa, Mycobacterium
TATLSLRWLSTVVYLCGLAT

SEQ ID NO: 330790 - protein, 28 aa, Mycobacterium
TATNLFSVSSFGEFEYWFAGVKVAAILA

SEQ ID NO: 330791 - protein, 27 aa, Mycobacterium
TATNRLRLGLNIPYLLLLLAFVVYDIF

SEQ ID NO: 330792 - protein, 19 aa, Mycobacterium
TATRMAVPAGSDVIRQGDR

SEQ ID NO: 330793 - protein, 18 aa, Mycobacterium
TATRSVRAAHRVAHIDIR

SEQ ID NO: 330794 - protein, 21 aa, Mycobacterium
TATVISLVFPFDLTRITLTGS

SEQ ID NO: 330795 - protein, 18 aa, Mycobacterium
TATVLLVVFLYDNFGLKW

SEQ ID NO: 330796 - protein, 23 aa, Mycobacterium
TATVVGWLWPLWDSRRRTFADMV

SEQ ID NO: 330797 - protein, 18 aa, Mycobacterium
TATYLSIYIGLAIAFGVW

SEQ ID NO: 330798 - protein, 19 aa, Mycobacterium
TAVAGCFVFSLIRPNGTVG

SEQ ID NO: 330799 - protein, 18 aa, Mycobacterium
TAVALGIGAGIGAIFAAP

SEQ ID NO: 330800 - protein, 23 aa, Mycobacterium
TAVALLFAMRALRLVWQAWARHP

SEQ ID NO: 330801 - protein, 17 aa, Mycobacterium
TAVAMRAWWQTGRSVFW

SEQ ID NO: 330802 - protein, 18 aa, Mycobacterium
TAVAVSWTARAFGMESHA

SEQ ID NO: 330803 - protein, 18 aa, Mycobacterium
TAVAVSWTARALGMESHA

SEQ ID NO: 330804 - protein, 21 aa, Mycobacterium
TAVAYLTVWVFYSRRDDEVGL

SEQ ID NO: 330805 - protein, 23 aa, Mycobacterium
TAVEGLVPFALFFSHGGWVTTVA

SEQ ID NO: 330806 - protein, 19 aa, Mycobacterium
TAVEWYDFYLYAAMASIVF

SEQ ID NO: 330807 - protein, 23 aa, Mycobacterium
TAVGVWGLHVLTRGDGVAGAAGW

SEQ ID NO: 330808 - protein, 17 aa, Mycobacterium
TAVIIVGLFAVQRHGTE

SEQ ID NO: 330809 - protein, 17 aa, Mycobacterium
TAVLAFGILGDQARAET

SEQ ID NO: 330810 - protein, 18 aa, Mycobacterium
TAVLFAFHVVTGRPLGLF

SEQ ID NO: 330811 - protein, 17 aa, Mycobacterium
TAVLLAGILNLVGAFLS

SEQ ID NO: 330812 - protein, 24 aa, Mycobacterium
TAVLSRSRVVGVSFAVGVVVLLGL

SEQ ID NO: 330813 - protein, 26 aa, Mycobacterium
TAVLTAWVVGYALRPLRRLAATAAEV

SEQ ID NO: 330814 - protein, 26 aa, Mycobacterium
TAVLYRPGSAVFWVFVIALAAGAFAL

SEQ ID NO: 330815 - protein, 19 aa, Mycobacterium
TAVMCCAIVIAAAALCGVI

SEQ ID NO: 330816 - protein, 17 aa, Mycobacterium
TAVPAVLMAVPFGAMIA

SEQ ID NO: 330817 - protein, 23 aa, Mycobacterium
TAVPFSALYLFKFDFNPISLGSA

SEQ ID NO: 330818 - protein, 17 aa, Mycobacterium
TAVPWARQRTAMVSAEY

SEQ ID NO: 330819 - protein, 19 aa, Mycobacterium
TAVRRTVMTAGRTVAFSAV

SEQ ID NO: 330820 - protein, 24 aa, Mycobacterium
TAVVIGWCLPLFGLSLAAFLVIDA

SEQ ID NO: 330821 - protein, 18 aa, Mycobacterium
TAVVSLIVLFAFVEVGQF

SEQ ID NO: 330822 - protein, 18 aa, Mycobacterium
TAVVVCYGLWAFERDHHS

SEQ ID NO: 330823 - protein, 23 aa, Mycobacterium
TAVYVCGPTAMLESVRTARDQHA

SEQ ID NO: 330824 - protein, 20 aa, Mycobacterium
TAWAFAVWILLTWTPTVENL

SEQ ID NO: 330825 - protein, 25 aa, Mycobacterium
TAWGSCGKPFPGMEVRIVDPESGMP

SEQ ID NO: 330826 - protein, 18 aa, Mycobacterium
TAWGVHFATAVVMAVTAV

SEQ ID NO: 330827 - protein, 17 aa, Mycobacterium
TAWMPFDNGLRPEPIIA

SEQ ID NO: 330828 - protein, 21 aa, Mycobacterium
TAYCAGPLGFMLAGPIADKFG

SEQ ID NO: 330829 - protein, 21 aa, Mycobacterium
TAYGADGAERWHYNRTGPGGV

SEQ ID NO: 330830 - protein, 26 aa, Mycobacterium
TAYLLAKICVYTVFAVVQSAIVTIIV

SEQ ID NO: 330831 - protein, 26 aa, Mycobacterium
TAYLLAKVCVYSVFAVVQSAIVTVIT

SEQ ID NO: 330832 - protein, 17 aa, Mycobacterium
TAYSEMYSEMFAITAVV

SEQ ID NO: 330833 - protein, 19 aa, Mycobacterium
TCAAMGLAVTVLVVHIRSL

SEQ ID NO: 330834 - protein, 20 aa, Mycobacterium
TCAAVLAWIAVEKVKTGHVT

SEQ ID NO: 330835 - protein, 25 aa, Mycobacterium
TCALAALCYAEFASTLPVAGSAYTF

SEQ ID NO: 330836 - protein, 18 aa, Mycobacterium
TCAVVLFLLFWSLLPLLL

SEQ ID NO: 330837 - protein, 18 aa, Mycobacterium
TCEITATVLLVVFLYDNF

SEQ ID NO: 330838 - protein, 21 aa, Mycobacterium
TCGLGALVWGVIDAVLILTDK

SEQ ID NO: 330839 - protein, 18 aa, Mycobacterium
TCMKELPVTLLLHPTGTD

SEQ ID NO: 330840 - protein, 31 aa, Mycobacterium
TCPDGKVCNGGRSGLIGVGGAGFNGGTGGST

SEQ ID NO: 330841 - protein, 31 aa, Mycobacterium
TCTAPWMVVMMIGWFTRRGWYDSDALQVFNR

SEQ ID NO: 330842 - protein, 19 aa, Mycobacterium
TCVVAIPVGIALTRGSMRR

SEQ ID NO: 330843 - protein, 40 aa, Mycobacterium
TCWAVTAGGIWWPIGRALAWCCVVLIGASAALAWRARDRP

SEQ ID NO: 330844 - protein, 44 aa, Mycobacterium
TDAATRVWRSRVGRLRTSTVVLIVAFFALWWLQQTYQPEPARTE

SEQ ID NO: 330845 - protein, 26 aa, Mycobacterium
TDADPAGWPRLDWSMDAALLLAALAS

SEQ ID NO: 330846 - protein, 19 aa, Mycobacterium
TDAEPMLYQAGWQGGGLST

SEQ ID NO: 330847 - protein, 26 aa, Mycobacterium
TDAEPRLRALGWTGILDKGADVDAGG

SEQ ID NO: 330848 - protein, 23 aa, Mycobacterium
TDAEPRLRALGWTGSLDKGPDVD

SEQ ID NO: 330849 - protein, 26 aa, Mycobacterium
TDAEPRLRALGWTGVLDKGGDVQNSG

SEQ ID NO: 330850 - protein, 18 aa, Mycobacterium
TDAGARFGVEDTKEAREA

SEQ ID NO: 330851 - protein, 23 aa, Mycobacterium
TDAIPVELGREFVPVRSAPSDTA

SEQ ID NO: 330852 - protein, 19 aa, Mycobacterium
TDAPFDWYLGVLSKLASVS

SEQ ID NO: 330853 - protein, 27 aa, Mycobacterium
TDATYFWPVWPILGAGIGVLSHALGVR

SEQ ID NO: 330854 - protein, 26 aa, Mycobacterium
TDAVPFPAFKNGVGLMLQLPKPTVVG

SEQ ID NO: 330855 - protein, 21 aa, Mycobacterium
TDCDGRGTLVAGIVAGQPGND

SEQ ID NO: 330856 - protein, 24 aa, Mycobacterium
TDDGPQLQANWTWASSALDRDQVS

SEQ ID NO: 330857 - protein, 25 aa, Mycobacterium
TDDLDFLRLAVLDALLVLQADTAPV

SEQ ID NO: 330858 - protein, 22 aa, Mycobacterium
TDDLRPIPVFGSDELARLTESF

SEQ ID NO: 330859 - protein, 39 aa, Mycobacterium
TDDLRRPVLGWVLFAGLIVWSAACATVYLTGSRRRGTWV

SEQ ID NO: 330860 - protein, 20 aa, Mycobacterium
TDEGPSWLLWSVILLTSGLV

SEQ ID NO: 330861 - protein, 18 aa, Mycobacterium
TDEVFRVATLRTLGVALT

SEQ ID NO: 330862 - protein, 17 aa, Mycobacterium
TDFPRQFGYNMPLELVL

SEQ ID NO: 330863 - protein, 19 aa, Mycobacterium
TDGADGWTVHRRRLTTRHE

SEQ ID NO: 330864 - protein, 24 aa, Mycobacterium
TDGDARPGVEIKLGPDGEIFSRGP

SEQ ID NO: 330865 - protein, 21 aa, Mycobacterium
TDGGERFPVRDLLLFCTLVVV

SEQ ID NO: 330866 - protein, 24 aa, Mycobacterium
TDGLLRIIPAWEIYPFGHTIPQAV

SEQ ID NO: 330867 - protein, 22 aa, Mycobacterium
TDGPIAPRRAIEIIADACQALN

SEQ ID NO: 330868 - protein, 17 aa, Mycobacterium
TDGQGSIDRWIDVPDRL

SEQ ID NO: 330869 - protein, 24 aa, Mycobacterium
TDGRARAFGWLWQALAATLVAAVF

SEQ ID NO: 330870 - protein, 26 aa, Mycobacterium
TDGRRSRMLLFGGMAAMVVGFVIGAV

SEQ ID NO: 330871 - protein, 22 aa, Mycobacterium
TDGRVAQVIWSDVPVQLTVVDT

SEQ ID NO: 330872 - protein, 18 aa, Mycobacterium
TDHFRHFAPFGVAGIGAA

SEQ ID NO: 330873 - protein, 18 aa, Mycobacterium
TDHPLIDLRLLKNRVVTQ

SEQ ID NO: 330874 - protein, 25 aa, Mycobacterium
TDHVRIPSLFVVELFPPSVKENLDR

SEQ ID NO: 330875 - protein, 20 aa, Mycobacterium
TDIDGSDRFAQNRKITRVRW

SEQ ID NO: 330876 - protein, 20 aa, Mycobacterium
TDIFFGLPLLLAAIVLMQVM

SEQ ID NO: 330877 - protein, 26 aa, Mycobacterium
TDIGSAPMLEFWGLTSSQQLTVPVLH

SEQ ID NO: 330878 - protein, 18 aa, Mycobacterium
TDITGAWLGVMNRGDVDR

SEQ ID NO: 330879 - protein, 17 aa, Mycobacterium
TDITTFFIGSGLAAVAG

SEQ ID NO: 330880 - protein, 25 aa, Mycobacterium
TDKELRAVVLPTVLIIQIDGVTGQL

SEQ ID NO: 330881 - protein, 17 aa, Mycobacterium
TDLAALVRAAAAQVLSD

SEQ ID NO: 330882 - protein, 24 aa, Mycobacterium
TDLAAPLPRPAVIVAGDYSAGKSS

SEQ ID NO: 330883 - protein, 24 aa, Mycobacterium
TDLAVKVRWPWPRTIGTLLAGTIP

SEQ ID NO: 330884 - protein, 22 aa, Mycobacterium
TDLFCTPDRCPTIIGNTLVFRD

SEQ ID NO: 330885 - protein, 27 aa, Mycobacterium
TDLGEIELPPGYLPIRVPIEVNFTQRV

SEQ ID NO: 330886 - protein, 36 aa, Mycobacterium
TDLGLILGRSRLHGIKKWKAAILATTLLLFLGGGVA

SEQ ID NO: 330887 - protein, 18 aa, Mycobacterium
TDLITGWWATDPLFCVAM

SEQ ID NO: 330888 - protein, 18 aa, Mycobacterium
TDLLDGWVAYYAEHPRER

SEQ ID NO: 330889 - protein, 19 aa, Mycobacterium
TDLLDRLGTHLTRHTGPGV

SEQ ID NO: 330890 - protein, 24 aa, Mycobacterium
TDLLLRASVMPTYLSNDWGQDWGS

SEQ ID NO: 330891 - protein, 24 aa, Mycobacterium
TDLLLRASVMSTYLSQDWGQDWGS

SEQ ID NO: 330892 - protein, 17 aa, Mycobacterium
TDLPIPFTYALVGAAWT

SEQ ID NO: 330893 - protein, 23 aa, Mycobacterium
TDLRRAPQAGGREVLRVEIGAPS

SEQ ID NO: 330894 - protein, 29 aa, Mycobacterium
TDLSRRFWRRSGVNIVRRPKAHLLASALV

SEQ ID NO: 330895 - protein, 19 aa, Mycobacterium
TDLTPVVGVFADNAQHFVP

SEQ ID NO: 330896 - protein, 22 aa, Mycobacterium
TDMFPALAVAVTPQYREPEEAE

SEQ ID NO: 330897 - protein, 22 aa, Mycobacterium
TDMFPALAVAVTSQYAAPDEAE

SEQ ID NO: 330898 - protein, 17 aa, Mycobacterium
TDMFRWHGAEEVEHRSV

SEQ ID NO: 330899 - protein, 26 aa, Mycobacterium
TDMNAKCPLTSYVLMGFSQGAVIAGD

SEQ ID NO: 330900 - protein, 17 aa, Mycobacterium
TDNALTILMMMVTAVAV

SEQ ID NO: 330901 - protein, 19 aa, Mycobacterium
TDPEGRSFVGLGNYLVILT

SEQ ID NO: 330902 - protein, 23 aa, Mycobacterium
TDPEVRAMLNWHAIEEMEHKSVA

SEQ ID NO: 330903 - protein, 21 aa, Mycobacterium
TDPFSLILFRGLDTVIGVAAG

SEQ ID NO: 330904 - protein, 22 aa, Mycobacterium
TDPKRAALLAGAMADSFATLVP

SEQ ID NO: 330905 - protein, 21 aa, Mycobacterium
TDPKRAALLAGGMADSFATLV

SEQ ID NO: 330906 - protein, 24 aa, Mycobacterium
TDPKRAEVLGVIHLKDVVKQGMKQ

SEQ ID NO: 330907 - protein, 17 aa, Mycobacterium
TDPPRPEAAAAIAEARR

SEQ ID NO: 330908 - protein, 21 aa, Mycobacterium
TDPRAAVVVRAIIELTHGLGM

SEQ ID NO: 330909 - protein, 22 aa, Mycobacterium
TDPRALAGVPLQALDDLSRELV

SEQ ID NO: 330910 - protein, 20 aa, Mycobacterium
TDPRFLRFAQTTGVDHRSLA

SEQ ID NO: 330911 - protein, 26 aa, Mycobacterium
TDPVALRLLWTVPLLSFFAAGAGIGI

SEQ ID NO: 330912 - protein, 26 aa, Mycobacterium
TDPVLLDWLVGLAFPCQRPFDHRNGV

SEQ ID NO: 330913 - protein, 25 aa, Mycobacterium
TDPVPRAKAIGLWTAMVGVGVAVGP

SEQ ID NO: 330914 - protein, 17 aa, Mycobacterium
TDRASAIVLADHEYFDN

SEQ ID NO: 330915 - protein, 20 aa, Mycobacterium
TDRGVLHPPLQVLAAIEAAA

SEQ ID NO: 330916 - protein, 19 aa, Mycobacterium
TDRHIELTPVYRGGPTLKN

SEQ ID NO: 330917 - protein, 25 aa, Mycobacterium
TDRILAGACAVAWLAALGAGVAALV

SEQ ID NO: 330918 - protein, 20 aa, Mycobacterium
TDRPRYARRSPVETTHVQLP

SEQ ID NO: 330919 - protein, 18 aa, Mycobacterium
TDRRSRVGVLAISVLAAM

SEQ ID NO: 330920 - protein, 17 aa, Mycobacterium
TDRYWWSALAVTLGITV

SEQ ID NO: 330921 - protein, 17 aa, Mycobacterium
TDSKFTASAAMWGLQGG

SEQ ID NO: 330922 - protein, 22 aa, Mycobacterium
TDSRLAARLAALASLGASVIHF

SEQ ID NO: 330923 - protein, 30 aa, Mycobacterium
TDSRLRRGAHWRAIVVVGLLVSSAALVTVL

SEQ ID NO: 330924 - protein, 20 aa, Mycobacterium
TDSVTGWPGLYVTYQGRGGK

SEQ ID NO: 330925 - protein, 20 aa, Mycobacterium
TDTLAFWAFLAFYLSAAVVT

SEQ ID NO: 330926 - protein, 18 aa, Mycobacterium
TDTLGWHSPYGVVHHLEE

SEQ ID NO: 330927 - protein, 24 aa, Mycobacterium
TDTPKPQWRLAVRAFSRDRMAVVS

SEQ ID NO: 330928 - protein, 21 aa, Mycobacterium
TDTRPSLYTDLIIPSAAMATV

SEQ ID NO: 330929 - protein, 20 aa, Mycobacterium
TDTTVRWLAVFALALGGFGI

SEQ ID NO: 330930 - protein, 24 aa, Mycobacterium
TDVDTPDGLYCKLPQDSPIGVRGT

SEQ ID NO: 330931 - protein, 23 aa, Mycobacterium
TDVKPELPAGFDEVIARGLAKDP

SEQ ID NO: 330932 - protein, 17 aa, Mycobacterium
TDVPIAIALHGAGVVTI

SEQ ID NO: 330933 - protein, 27 aa, Mycobacterium
TDVQPMFRKHPAFFSAVTNLAWTFDKN

SEQ ID NO: 330934 - protein, 25 aa, Mycobacterium
TDVRARPAGLTVFGGSEFSAGTRVP

SEQ ID NO: 330935 - protein, 20 aa, Mycobacterium
TDVRLLGPRLARSAAGPDAR

SEQ ID NO: 330936 - protein, 19 aa, Mycobacterium
TDVSLRWGDAESELGKHRG

SEQ ID NO: 330937 - protein, 18 aa, Mycobacterium
TDVSLRWSNAEDDLGKHH

SEQ ID NO: 330938 - protein, 17 aa, Mycobacterium
TDVTLVIGANDVTNPAA

SEQ ID NO: 330939 - protein, 25 aa, Mycobacterium
TDVYDWSAPMVRALNVSPECNLDPA

SEQ ID NO: 330940 - protein, 19 aa, Mycobacterium
TDWAPGLVALAVLWSVRVV

SEQ ID NO: 330941 - protein, 18 aa, Mycobacterium
TDYSIFFIGRYQEGRRAG

SEQ ID NO: 330942 - protein, 17 aa, Mycobacterium
TEAFNLMLRALAESRER

SEQ ID NO: 330943 - protein, 22 aa, Mycobacterium
TEAIPTYLRDDWYRDWGSIERY

SEQ ID NO: 330944 - protein, 20 aa, Mycobacterium
TEALIQRAMCDLRRDRTSFI

SEQ ID NO: 330945 - protein, 19 aa, Mycobacterium
TEALLSCWSQPPHQPLPES

SEQ ID NO: 330946 - protein, 24 aa, Mycobacterium
TEAMACARRLAPYRVLTGSGDEVQ

SEQ ID NO: 330947 - protein, 26 aa, Mycobacterium
TEAPQTVRWTLRLDVTDVDGELKVSR

SEQ ID NO: 330948 - protein, 22 aa, Mycobacterium
TEARAAAALNHPHVVAVHDTGV

SEQ ID NO: 330949 - protein, 21 aa, Mycobacterium
TEARRARPRVFSLEDDGLRSL

SEQ ID NO: 330950 - protein, 18 aa, Mycobacterium
TEARRRTVAFTNGYDFGY

SEQ ID NO: 330951 - protein, 25 aa, Mycobacterium
TEARVLAAIARRAADGATVIVVGHR

SEQ ID NO: 330952 - protein, 34 aa, Mycobacterium
TEATMLRLRNWLRTHRRQILSIAFAAAGVALLAS

SEQ ID NO: 330953 - protein, 26 aa, Mycobacterium
TEATTARPELRFSHGPYADEDDYDDY

SEQ ID NO: 330954 - protein, 27 aa, Mycobacterium
TEAVPEFYADAGWTWMAVAGVALTAAA

SEQ ID NO: 330955 - protein, 17 aa, Mycobacterium
TECKRDILAQTGRISMA

SEQ ID NO: 330956 - protein, 24 aa, Mycobacterium
TEDGRTAILVGVVWFIIVVLGYFV

SEQ ID NO: 330957 - protein, 28 aa, Mycobacterium
TEFFNMVFSSWWLRRHCGYRTPVMFLLW

SEQ ID NO: 330958 - protein, 20 aa, Mycobacterium
TEFFSRAPSGLAIGGAAAGV

SEQ ID NO: 330959 - protein, 20 aa, Mycobacterium
TEFFSRLPSALAVGAAAAGV

SEQ ID NO: 330960 - protein, 17 aa, Mycobacterium
TEFGIGVSAGRAIAGHI

SEQ ID NO: 330961 - protein, 17 aa, Mycobacterium
TEFKANPMWPWLYGAIL

SEQ ID NO: 330962 - protein, 17 aa, Mycobacterium
TEFPRQFGYNLPLELVL

SEQ ID NO: 330963 - protein, 23 aa, Mycobacterium
TEFRFAEVALRFIRRRYDEVMAW

SEQ ID NO: 330964 - protein, 20 aa, Mycobacterium
TEFWSRVPSSLAIGAAAGGV

SEQ ID NO: 330965 - protein, 20 aa, Mycobacterium
TEFWSRVPSSLAIGGAAAGV

SEQ ID NO: 330966 - protein, 28 aa, Mycobacterium
TEGFSRLWPTVVCLIGYAISFALLAVSI

SEQ ID NO: 330967 - protein, 23 aa, Mycobacterium
TEGGIGPSSRICTFSAADKPVIF

SEQ ID NO: 330968 - protein, 22 aa, Mycobacterium
TEGPMPPKRAIEVIADACQALN

SEQ ID NO: 330969 - protein, 17 aa, Mycobacterium
TEGYLAVGMINDAIEDG

SEQ ID NO: 330970 - protein, 21 aa, Mycobacterium
TEIEQLLGLLLSQGRAVGISV

SEQ ID NO: 330971 - protein, 30 aa, Mycobacterium
TEIFPLTLFAIAGMMLFPACNDLLTMFVAL

SEQ ID NO: 330972 - protein, 21 aa, Mycobacterium
TEIKNAAALGYVREFMTMYTT

SEQ ID NO: 330973 - protein, 21 aa, Mycobacterium
TEILAVPALAIFTLMMAFYTP

SEQ ID NO: 330974 - protein, 19 aa, Mycobacterium
TEISTALLIPKFTVIEDGA

SEQ ID NO: 330975 - protein, 17 aa, Mycobacterium
TEISTALVIPKFTVIED

SEQ ID NO: 330976 - protein, 23 aa, Mycobacterium
TELARPIPAIAIVPVAILLFPSD

SEQ ID NO: 330977 - protein, 21 aa, Mycobacterium
TELCAALSQRLRAVAPGRVNA

SEQ ID NO: 330978 - protein, 19 aa, Mycobacterium
TELDEVLRAPLADFVAVLQ

SEQ ID NO: 330979 - protein, 19 aa, Mycobacterium
TELFLPRNYAVAVTFVTPI

SEQ ID NO: 330980 - protein, 17 aa, Mycobacterium
TELGLDRALPIQFFDYL

SEQ ID NO: 330981 - protein, 18 aa, Mycobacterium
TELIGLVVHGAFILLLLL

SEQ ID NO: 330982 - protein, 24 aa, Mycobacterium
TELLDRLGAHLTRHIGPGVEYADI

SEQ ID NO: 330983 - protein, 18 aa, Mycobacterium
TELLDRLNTVTGLALPPT

SEQ ID NO: 330984 - protein, 18 aa, Mycobacterium
TELLGSTVAGSWQGPSAM

SEQ ID NO: 330985 - protein, 20 aa, Mycobacterium
TELLIAHAMAELRRDRTSFI

SEQ ID NO: 330986 - protein, 34 aa, Mycobacterium
TELLIARATAELRRDRTSFIIAHRLSTIRDADQI

SEQ ID NO: 330987 - protein, 25 aa, Mycobacterium
TELLLRPSSVPTYLKDDWYRDWGSL

SEQ ID NO: 330988 - protein, 20 aa, Mycobacterium
TELLPGWTSAVDRDTAKGTV

SEQ ID NO: 330989 - protein, 23 aa, Mycobacterium
TELNASLGDRAWVKNLERHNTLI

SEQ ID NO: 330990 - protein, 19 aa, Mycobacterium
TELNRAGATVVKLPSEDLT

SEQ ID NO: 330991 - protein, 26 aa, Mycobacterium
TELPARRWDLPVLRWVDGTRPGRRLV

SEQ ID NO: 330992 - protein, 17 aa, Mycobacterium
TELPTIMMIGGEFNTPS

SEQ ID NO: 330993 - protein, 26 aa, Mycobacterium
TELQADCYAGVWAHYAAITKQEGTDV

SEQ ID NO: 330994 - protein, 25 aa, Mycobacterium
TELQADCYAGVWAHYASITRQESTG

SEQ ID NO: 330995 - protein, 25 aa, Mycobacterium
TELQADCYAGVWAHYASTVRQESTG

SEQ ID NO: 330996 - protein, 25 aa, Mycobacterium
TELQADCYAGVWAKHASTTVQEGTG

SEQ ID NO: 330997 - protein, 25 aa, Mycobacterium
TELQADCYAGVWAYYASTVKQQSTG

SEQ ID NO: 330998 - protein, 20 aa, Mycobacterium
TELRDWLARKAFYGGSAAPL

SEQ ID NO: 330999 - protein, 21 aa, Mycobacterium
TELRKWFARKSFYGGSAAPLT

SEQ ID NO: 331000 - protein, 17 aa, Mycobacterium
TELRSRLLIAVLAVLAT

SEQ ID NO: 331001 - protein, 17 aa, Mycobacterium
TELRTRLLISLAAILLT

SEQ ID NO: 331002 - protein, 26 aa, Mycobacterium
TELTPPRLARYVKLEVTGPAQQHVGL

SEQ ID NO: 331003 - protein, 25 aa, Mycobacterium
TELTSAQWLFAIAVGSSVLVVDEIG

SEQ ID NO: 331004 - protein, 20 aa, Mycobacterium
TELVAAVWVLAVVARPYQWW

SEQ ID NO: 331005 - protein, 25 aa, Mycobacterium
TELWRSLVWIGWVWPLTAAIFVTIA

SEQ ID NO: 331006 - protein, 20 aa, Mycobacterium
TELYWVFTGLAAVLALGEIS

SEQ ID NO: 331007 - protein, 23 aa, Mycobacterium
TENRLRVVCALPSSATPEQPYPD

SEQ ID NO: 331008 - protein, 23 aa, Mycobacterium
TEPALNLDLLLGGLKPVIQGLNP

SEQ ID NO: 331009 - protein, 24 aa, Mycobacterium
TEPVAVVGIGCRFPGGADGPEGLW

SEQ ID NO: 331010 - protein, 21 aa, Mycobacterium
TEPVLRILFYYFLLSTVMSLP

SEQ ID NO: 331011 - protein, 19 aa, Mycobacterium
TEPVRRRWLTWWRYTRTWE

SEQ ID NO: 331012 - protein, 19 aa, Mycobacterium
TERALQIVLGLQRMSVAPL

SEQ ID NO: 331013 - protein, 30 aa, Mycobacterium
TEREISVAGVPWPAYKLIALAVGAVVLLVV

SEQ ID NO: 331014 - protein, 21 aa, Mycobacterium
TERGFSMALGRLGDSTDGDCL

SEQ ID NO: 331015 - protein, 21 aa, Mycobacterium
TERGIGNGMSLLIFAGIAARI

SEQ ID NO: 331016 - protein, 21 aa, Mycobacterium
TERGIGNGMSLLIFVGIAARI

SEQ ID NO: 331017 - protein, 19 aa, Mycobacterium
TERGLILTDFVDRVGDPVG

SEQ ID NO: 331018 - protein, 27 aa, Mycobacterium
TERHCYDIPVCWAVRSAFDATDGVDEL

SEQ ID NO: 331019 - protein, 21 aa, Mycobacterium
TERLVAYWLMLGGLSGLALLL

SEQ ID NO: 331020 - protein, 23 aa, Mycobacterium
TERSRLAKRLLIGFLSAGALILV

SEQ ID NO: 331021 - protein, 23 aa, Mycobacterium
TESERGFSMALGRLGDPADTDCL

SEQ ID NO: 331022 - protein, 27 aa, Mycobacterium
TESIPTYLSGDWYRDWGSLERYLRVVP

SEQ ID NO: 331023 - protein, 22 aa, Mycobacterium
TESKMNMPWLFFFSGLAIPAFY

SEQ ID NO: 331024 - protein, 19 aa, Mycobacterium
TESMPGWTATLDRDAASGG

SEQ ID NO: 331025 - protein, 25 aa, Mycobacterium
TESPAEWARHLLLPWTTLVLVEVGL

SEQ ID NO: 331026 - protein, 19 aa, Mycobacterium
TETAFEWNGLGSQLAHYLS

SEQ ID NO: 331027 - protein, 22 aa, Mycobacterium
TETIITFFVVYSFGMLIGQDIW

SEQ ID NO: 331028 - protein, 18 aa, Mycobacterium
TETPAFWIFFACYIGAAI

SEQ ID NO: 331029 - protein, 19 aa, Mycobacterium
TETPALWIFLGCYIGFAVL

SEQ ID NO: 331030 - protein, 25 aa, Mycobacterium
TETTMWLCASAPLAPGLGAPPIGSP

SEQ ID NO: 331031 - protein, 20 aa, Mycobacterium
TEVAGLRLLPSRSALPAHPT

SEQ ID NO: 331032 - protein, 24 aa, Mycobacterium
TEVFPLTMFAIGGMLLFPAADDLL

SEQ ID NO: 331033 - protein, 23 aa, Mycobacterium
TEVFSGLRWVALVALAAAVAGLI

SEQ ID NO: 331034 - protein, 22 aa, Mycobacterium
TEVGRTCVFLASGAADYINGTT

SEQ ID NO: 331035 - protein, 18 aa, Mycobacterium
TEVPECRAGIGVAAGQVV

SEQ ID NO: 331036 - protein, 22 aa, Mycobacterium
TEVVDRWAVDRVMINAYGPTES

SEQ ID NO: 331037 - protein, 25 aa, Mycobacterium
TEVVLILILGALSWNNLRENLRPPF

SEQ ID NO: 331038 - protein, 21 aa, Mycobacterium
TEVVVGLGIIMTIFRTRRSAS

SEQ ID NO: 331039 - protein, 17 aa, Mycobacterium
TEWARFTRKVMPRDRIY

SEQ ID NO: 331040 - protein, 23 aa, Mycobacterium
TEWTEPAVSAAMFDLGFTLVDHG

SEQ ID NO: 331041 - protein, 20 aa, Mycobacterium
TEYFLVGSFTSWLLALGGIG

SEQ ID NO: 331042 - protein, 26 aa, Mycobacterium
TEYGRYELDPALFLRYPGVTDVTRGP

SEQ ID NO: 331043 - protein, 21 aa, Mycobacterium
TEYQGRWIASMSGEDFKSLAA

SEQ ID NO: 331044 - protein, 17 aa, Mycobacterium
TFAAFTALCVFLPGIIG

SEQ ID NO: 331045 - protein, 19 aa, Mycobacterium
TFAAYCYSLLVTVASTALP

SEQ ID NO: 331046 - protein, 23 aa, Mycobacterium
TFADPAGPLAWCRSQGFDRDHCA

SEQ ID NO: 331047 - protein, 23 aa, Mycobacterium
TFADWLENLWILNVIVFVAGLTY

SEQ ID NO: 331048 - protein, 23 aa, Mycobacterium
TFAFTEARIRRAALGLVAAARIQ

SEQ ID NO: 331049 - protein, 21 aa, Mycobacterium
TFAGLCAGVASVILTAKLSSG

SEQ ID NO: 331050 - protein, 20 aa, Mycobacterium
TFALIAIGLIGTWLNIGLCL

SEQ ID NO: 331051 - protein, 23 aa, Mycobacterium
TFALPQWRDAFLAIANQGESGAV

SEQ ID NO: 331052 - protein, 25 aa, Mycobacterium
TFALSEAFLARWIVAVSNFGIFLVA

SEQ ID NO: 331053 - protein, 19 aa, Mycobacterium
TFALSEPVMARWIQPLSNA

SEQ ID NO: 331054 - protein, 23 aa, Mycobacterium
TFASLELFATIGPALAIAIGVAF

SEQ ID NO: 331055 - protein, 25 aa, Mycobacterium
TFCLSFTRLPYFQTLGVPLAIGMVI

SEQ ID NO: 331056 - protein, 29 aa, Mycobacterium
TFDGIRPSFPMLAANLANFGRIGVIYNKS

SEQ ID NO: 331057 - protein, 24 aa, Mycobacterium
TFDLVGALLWLVGVSALAWLLVDD

SEQ ID NO: 331058 - protein, 24 aa, Mycobacterium
TFDMRRLRGGTLREPLLVRLFGGA

SEQ ID NO: 331059 - protein, 18 aa, Mycobacterium
TFDVRLARQAYRFVSQAR

SEQ ID NO: 331060 - protein, 24 aa, Mycobacterium
TFFFQLRTANWWFALLGLAVSALT

SEQ ID NO: 331061 - protein, 23 aa, Mycobacterium
TFFGTATGLVFIWLSLTPSLLPR

SEQ ID NO: 331062 - protein, 19 aa, Mycobacterium
TFFGTRRWEGSGAHPHEAP

SEQ ID NO: 331063 - protein, 21 aa, Mycobacterium
TFGEFLAWVIGWNLVLELAIG

SEQ ID NO: 331064 - protein, 21 aa, Mycobacterium
TFGEFLAWVIGWNLVLELAVG

SEQ ID NO: 331065 - protein, 20 aa, Mycobacterium
TFGFGVIFGAIWAEETWGRF

SEQ ID NO: 331066 - protein, 18 aa, Mycobacterium
TFGSWIGFSFAFGQVLQI

SEQ ID NO: 331067 - protein, 18 aa, Mycobacterium
TFGTAVFVAAEFSLTALD

SEQ ID NO: 331068 - protein, 20 aa, Mycobacterium
TFHEPFVVFGYLAALTSLEL

SEQ ID NO: 331069 - protein, 28 aa, Mycobacterium
TFHRHRWSRRRIMLVAVLAAVLVVAALF

SEQ ID NO: 331070 - protein, 24 aa, Mycobacterium
TFIGLWIFGWSRLPKLIHLACIWI

SEQ ID NO: 331071 - protein, 25 aa, Mycobacterium
TFIKHPIQWIRAMSKYRATVGVAPN

SEQ ID NO: 331072 - protein, 20 aa, Mycobacterium
TFIRHERRAPFPLIDLQLFT

SEQ ID NO: 331073 - protein, 17 aa, Mycobacterium
TFIRQRPLRQAVRQRER

SEQ ID NO: 331074 - protein, 27 aa, Mycobacterium
TFITRPLGSWFFGRFADRNGRRAALTL

SEQ ID NO: 331075 - protein, 21 aa, Mycobacterium
TFKDFRDGSTYDLFIAGVGAL

SEQ ID NO: 331076 - protein, 21 aa, Mycobacterium
TFKDFRDGSTYDLLIAGVGAL

SEQ ID NO: 331077 - protein, 25 aa, Mycobacterium
TFLAAWRVAVVDLILWGSGAVLLTT

SEQ ID NO: 331078 - protein, 20 aa, Mycobacterium
TFLAGHTWAQWHSYAFDASV

SEQ ID NO: 331079 - protein, 25 aa, Mycobacterium
TFLAPWRIARFDLILWGVGAVVLTT

SEQ ID NO: 331080 - protein, 17 aa, Mycobacterium
TFLASLVAVSLCFGLFN

SEQ ID NO: 331081 - protein, 23 aa, Mycobacterium
TFLGLWIFGWTRLPKLVHLACIW

SEQ ID NO: 331082 - protein, 26 aa, Mycobacterium
TFLILMRQGYRWTRTILTSGGLVSVI

SEQ ID NO: 331083 - protein, 20 aa, Mycobacterium
TFLPACLGILGRHVDALGVR

SEQ ID NO: 331084 - protein, 21 aa, Mycobacterium
TFLTVEAWAFLQLGSRQQSGD

SEQ ID NO: 331085 - protein, 20 aa, Mycobacterium
TFLTVEAWAFLQLGSRQQSH

SEQ ID NO: 331086 - protein, 21 aa, Mycobacterium
TFLVGSWMWSIMIKPFRLLAQ

SEQ ID NO: 331087 - protein, 30 aa, Mycobacterium
TFLVRTVIIPALFTLIGPKIWWPALRQETR

SEQ ID NO: 331088 - protein, 18 aa, Mycobacterium
TFMKVALMLWQIGSPVLF

SEQ ID NO: 331089 - protein, 18 aa, Mycobacterium
TFMRIGIGVAVEVAFLAY

SEQ ID NO: 331090 - protein, 18 aa, Mycobacterium
TFMVLRLVFVGWRAFSGR

SEQ ID NO: 331091 - protein, 18 aa, Mycobacterium
TFMVLRLVFVGWRALSGR

SEQ ID NO: 331092 - protein, 25 aa, Mycobacterium
TFPAMFPTQVRFAGFAIAYNVSTSI

SEQ ID NO: 331093 - protein, 24 aa, Mycobacterium
TFPAMFPTQVRYAGFAIAYNVSTS

SEQ ID NO: 331094 - protein, 19 aa, Mycobacterium
TFPAQWRTSAGRAWSFGVY

SEQ ID NO: 331095 - protein, 21 aa, Mycobacterium
TFPGNIYAGMFGFTAAALLEI

SEQ ID NO: 331096 - protein, 24 aa, Mycobacterium
TFPPERRGTALSVWGATAGIATLV

SEQ ID NO: 331097 - protein, 18 aa, Mycobacterium
TFPTIAIGGARPGADRLL

SEQ ID NO: 331098 - protein, 18 aa, Mycobacterium
TFPWVRRSSAGGPVQVDT

SEQ ID NO: 331099 - protein, 18 aa, Mycobacterium
TFQAAPSGARFAAVMALY

SEQ ID NO: 331100 - protein, 18 aa, Mycobacterium
TFRHGFRSPNLFMGAAGV

SEQ ID NO: 331101 - protein, 36 aa, Mycobacterium
TFRPVRSYFYWERHCYDIPVCFGLRSLFDTLDGFDQ

SEQ ID NO: 331102 - protein, 24 aa, Mycobacterium
TFRPVRTYFYWEKHCYDIPVCIGL

SEQ ID NO: 331103 - protein, 17 aa, Mycobacterium
TFRWSFTSLNGRPPNIS

SEQ ID NO: 331104 - protein, 28 aa, Mycobacterium
TFSIPPRWRTSWGWGWITIGLVAIVCNQ

SEQ ID NO: 331105 - protein, 20 aa, Mycobacterium
TFTGIRLAVGMAYSAVVAAE

SEQ ID NO: 331106 - protein, 19 aa, Mycobacterium
TFTGIRLAVGMAYSSVVAA

SEQ ID NO: 331107 - protein, 21 aa, Mycobacterium
TFTLGIAVLFAIQAAAVHVGW

SEQ ID NO: 331108 - protein, 18 aa, Mycobacterium
TFTSRPTVTWPLSADTWS

SEQ ID NO: 331109 - protein, 24 aa, Mycobacterium
TFTTFGWFRFYLAAVPLVVIVAMV

SEQ ID NO: 331110 - protein, 28 aa, Mycobacterium
TFVAACLRIPYSLGIATFGGRNWTVFSI

SEQ ID NO: 331111 - protein, 26 aa, Mycobacterium
TFVAMVHPPFAWREYIAQAWFVARVS

SEQ ID NO: 331112 - protein, 32 aa, Mycobacterium
TFVAMVKPPFAWREFISQSWFVARVSIVPTLM

SEQ ID NO: 331113 - protein, 30 aa, Mycobacterium
TFVLLNTMFGWWVLSRVIRRLSVIPDVHQL

SEQ ID NO: 331114 - protein, 18 aa, Mycobacterium
TFVLTAVVTVCFDLIEAV

SEQ ID NO: 331115 - protein, 24 aa, Mycobacterium
TFVPDLPLAYSFPAVPAAESPPPA

SEQ ID NO: 331116 - protein, 32 aa, Mycobacterium
TFVSMFRPPFAWREYLLQCWFVARVSTLPGVL

SEQ ID NO: 331117 - protein, 25 aa, Mycobacterium
TFVVPPVMRVLRERDAMVAKTAADN

SEQ ID NO: 331118 - protein, 29 aa, Mycobacterium
TFWRVTLPSIRWGLTYGVVLTVARTLGEF

SEQ ID NO: 331119 - protein, 25 aa, Mycobacterium
TFYFRACGIAGLIILACMALARILA

SEQ ID NO: 331120 - protein, 18 aa, Mycobacterium
TFYRGDPGMWSWLLHRIS

SEQ ID NO: 331121 - protein, 31 aa, Mycobacterium
TGAAAWLGSAVWWKALLALAVALALTVGVNY

SEQ ID NO: 331122 - protein, 31 aa, Mycobacterium
TGAAAWLGSAVWWKALLALAVAVALTVGVNY

SEQ ID NO: 331123 - protein, 31 aa, Mycobacterium
TGAAAWLHAAVWWKALLALVVAIALTVGVNY

SEQ ID NO: 331124 - protein, 30 aa, Mycobacterium
TGAAAWLHAAVWWKALLALVVAVALTVGVN

SEQ ID NO: 331125 - protein, 26 aa, Mycobacterium
TGAAFVEWGWRIPFLASAVLVAVGLY

SEQ ID NO: 331126 - protein, 23 aa, Mycobacterium
TGAAGWFLDWLMHRTKSLAAPLL

SEQ ID NO: 331127 - protein, 24 aa, Mycobacterium
TGADANKSLDCRIIATGNSVDAVW

SEQ ID NO: 331128 - protein, 25 aa, Mycobacterium
TGADVLKAHPIVAVDRRGTGMSGAI

SEQ ID NO: 331129 - protein, 26 aa, Mycobacterium
TGAETLRLAGYLIMCRNTTKDFEDFA

SEQ ID NO: 331130 - protein, 19 aa, Mycobacterium
TGAGGPWSLAQGRNVARSG

SEQ ID NO: 331131 - protein, 18 aa, Mycobacterium
TGAGRLGFAGVHTATTAV

SEQ ID NO: 331132 - protein, 25 aa, Mycobacterium
TGAHAGTVWTHFIFGSALAGLGLGA

SEQ ID NO: 331133 - protein, 23 aa, Mycobacterium
TGAINWRLGGKRSTFALGDGVEF

SEQ ID NO: 331134 - protein, 21 aa, Mycobacterium
TGAIRPELRPVDLRDAVEHVL

SEQ ID NO: 331135 - protein, 23 aa, Mycobacterium
TGAIRVTPRFTRMIVAAMFGALA

SEQ ID NO: 331136 - protein, 24 aa, Mycobacterium
TGALELLGAAGLLYPPTRVAAAVC

SEQ ID NO: 331137 - protein, 17 aa, Mycobacterium
TGALFRTEFGTVVVQQD

SEQ ID NO: 331138 - protein, 25 aa, Mycobacterium
TGARRGRSRLLFGALAILLCLVLGV

SEQ ID NO: 331139 - protein, 21 aa, Mycobacterium
TGARYLATFAHDVDAYESTAV

SEQ ID NO: 331140 - protein, 18 aa, Mycobacterium
TGAWIDVAVILWVLLALS

SEQ ID NO: 331141 - protein, 25 aa, Mycobacterium
TGAYCVYQEGLGPTGLLLSARVALV

SEQ ID NO: 331142 - protein, 19 aa, Mycobacterium
TGAYLAWYWLPAATGHTAS

SEQ ID NO: 331143 - protein, 23 aa, Mycobacterium
TGDKRAAPKLGIDLQGGTRVTLT

SEQ ID NO: 331144 - protein, 19 aa, Mycobacterium
TGDLRAAYRDDLKRMLGVA

SEQ ID NO: 331145 - protein, 18 aa, Mycobacterium
TGDLVRWRADGQLDYLGR

SEQ ID NO: 331146 - protein, 25 aa, Mycobacterium
TGDLVRWRADGQLEYLGRADEQVKI

SEQ ID NO: 331147 - protein, 17 aa, Mycobacterium
TGDLVSWGTDGQLRYLG

SEQ ID NO: 331148 - protein, 20 aa, Mycobacterium
TGDLWRTYVLPGIEGTLTAA

SEQ ID NO: 331149 - protein, 20 aa, Mycobacterium
TGDNEFAILLGEGADLIAAR

SEQ ID NO: 331150 - protein, 17 aa, Mycobacterium
TGDRCMSFFHAPSGAVE

SEQ ID NO: 331151 - protein, 23 aa, Mycobacterium
TGDRFGRRRTFHLGLTVFAVASL

SEQ ID NO: 331152 - protein, 30 aa, Mycobacterium
TGDVHWTQQINWLWVRRAAYLSAAVLVLLP

SEQ ID NO: 331153 - protein, 19 aa, Mycobacterium
TGEAELRGGDYFGAVLNRA

SEQ ID NO: 331154 - protein, 23 aa, Mycobacterium
TGEIYPRYTCDYGTPRRPPSSAD

SEQ ID NO: 331155 - protein, 17 aa, Mycobacterium
TGELPLMVVMIALVVQW

SEQ ID NO: 331156 - protein, 18 aa, Mycobacterium
TGEPGCATNTYLDRSVLP

SEQ ID NO: 331157 - protein, 17 aa, Mycobacterium
TGEPLWSLYDGEIPHPS

SEQ ID NO: 331158 - protein, 17 aa, Mycobacterium
TGERCMSFFHAPPDGSK

SEQ ID NO: 331159 - protein, 24 aa, Mycobacterium
TGERGRLAAILGLVTGYLMCAVLL

SEQ ID NO: 331160 - protein, 19 aa, Mycobacterium
TGFAARYLPIAGHPTLILA

SEQ ID NO: 331161 - protein, 19 aa, Mycobacterium
TGFDPGPLVLAFVLGSLVE

SEQ ID NO: 331162 - protein, 19 aa, Mycobacterium
TGFICHVGWEVTADIAHRL

SEQ ID NO: 331163 - protein, 17 aa, Mycobacterium
TGFRAALLLATLCGAAF

SEQ ID NO: 331164 - protein, 18 aa, Mycobacterium
TGFTRADAIAALVVAALM

SEQ ID NO: 331165 - protein, 28 aa, Mycobacterium
TGFVALSAVGGWLYWKGVELDGEQQARA

SEQ ID NO: 331166 - protein, 25 aa, Mycobacterium
TGFVGRWLPDRAILWQMVLLDPLLS

SEQ ID NO: 331167 - protein, 35 aa, Mycobacterium
TGGAFPRLARLVVRRPLIVIGFWVALAAALSMALP

SEQ ID NO: 331168 - protein, 26 aa, Mycobacterium
TGGLFAQFGLWRWAFGAMAVLTTLMA

SEQ ID NO: 331169 - protein, 29 aa, Mycobacterium
TGGLFAQFGLWRWAFGVMATMAGLMTLLV

SEQ ID NO: 331170 - protein, 23 aa, Mycobacterium
TGGLLGGYGILRFDNGVPSVDTL

SEQ ID NO: 331171 - protein, 24 aa, Mycobacterium
TGGLRRILPYVGRIAGALLLLTGL

SEQ ID NO: 331172 - protein, 18 aa, Mycobacterium
TGGRAGMVAIQLKDGKEF

SEQ ID NO: 331173 - protein, 22 aa, Mycobacterium
TGGRGPLWLVLLPAAALIPVAI

SEQ ID NO: 331174 - protein, 24 aa, Mycobacterium
TGGTRWVVLVGVVLGVAFLTKMLQ

SEQ ID NO: 331175 - protein, 20 aa, Mycobacterium
TGGVVLLVLLAAAALLVARQ

SEQ ID NO: 331176 - protein, 20 aa, Mycobacterium
TGHHGTVWSIAFGPDGHTLT

SEQ ID NO: 331177 - protein, 25 aa, Mycobacterium
TGHIAFSIWYLWSVMVLFMPESVYG

SEQ ID NO: 331178 - protein, 25 aa, Mycobacterium
TGHLRRWHGVVLLVGYVAYWIVSFS

SEQ ID NO: 331179 - protein, 31 aa, Mycobacterium
TGHPLRRPRGTEWLWLLGVTVSGLVLFNVAL

SEQ ID NO: 331180 - protein, 26 aa, Mycobacterium
TGHPRRAGVSSFGFGGTNAHVVIEQG

SEQ ID NO: 331181 - protein, 37 aa, Mycobacterium
TGIAGFVFSWLRRRSGSLLAPIALHWSLNGMGALAAA

SEQ ID NO: 331182 - protein, 20 aa, Mycobacterium
TGIAIVGGVLAWIASSVSEP

SEQ ID NO: 331183 - protein, 17 aa, Mycobacterium
TGIARVLFGRFDDDVLD

SEQ ID NO: 331184 - protein, 25 aa, Mycobacterium
TGIDEPRLGLILEVVAAAGLIAGGM

SEQ ID NO: 331185 - protein, 25 aa, Mycobacterium
TGIGIWCVLDPPSFARAVGFGEHQH

SEQ ID NO: 331186 - protein, 26 aa, Mycobacterium
TGIGMAWPHLSVRAMASVDDPAEGGA

SEQ ID NO: 331187 - protein, 22 aa, Mycobacterium
TGIRLALGVAWIVLVPAEMLGV

SEQ ID NO: 331188 - protein, 23 aa, Mycobacterium
TGISPELDAVVLKALAKNPDNRY

SEQ ID NO: 331189 - protein, 28 aa, Mycobacterium
TGKEICNLMGLRQLGCSTGTLQDYGPDF

SEQ ID NO: 331190 - protein, 21 aa, Mycobacterium
TGKLRIEWRDLPIFGTQSVQA

SEQ ID NO: 331191 - protein, 18 aa, Mycobacterium
TGKRARRGVAESTDEPET

SEQ ID NO: 331192 - protein, 17 aa, Mycobacterium
TGKRLPRRWRAQDLFTV

SEQ ID NO: 331193 - protein, 26 aa, Mycobacterium
TGLACGRALRATWLMAARGTGGAARS

SEQ ID NO: 331194 - protein, 18 aa, Mycobacterium
TGLAMILAAFGIVYQAGA

SEQ ID NO: 331195 - protein, 28 aa, Mycobacterium
TGLAVRLSLWYPHYAWLMLTIYLATAVV

SEQ ID NO: 331196 - protein, 22 aa, Mycobacterium
TGLCGYAVIYLAARNLAPSGFS

SEQ ID NO: 331197 - protein, 25 aa, Mycobacterium
TGLDIRPNPGIAFPGYADYLPVTRG

SEQ ID NO: 331198 - protein, 32 aa, Mycobacterium
TGLDIRPNPGIGFPGWANYFPVTRGIPQPPII

SEQ ID NO: 331199 - protein, 31 aa, Mycobacterium
TGLDIRPNPGIGHPCWADYLPVTRAVPQPPS

SEQ ID NO: 331200 - protein, 26 aa, Mycobacterium
TGLDIRPNPGIGHPCYADYLPVTRAV

SEQ ID NO: 331201 - protein, 21 aa, Mycobacterium
TGLFALNFFALISVYLVFFDG

SEQ ID NO: 331202 - protein, 21 aa, Mycobacterium
TGLFDFLAIWAAKRSRGKPFR

SEQ ID NO: 331203 - protein, 23 aa, Mycobacterium
TGLGRNWANLGFLGTSAVVVGSV

SEQ ID NO: 331204 - protein, 18 aa, Mycobacterium
TGLHRPGGVAVDAAGNVY

SEQ ID NO: 331205 - protein, 25 aa, Mycobacterium
TGLLAYRFRLRVLIAATVAAGVIAF

SEQ ID NO: 331206 - protein, 24 aa, Mycobacterium
TGLLCGLGSIVAIVLGAIALDQIK

SEQ ID NO: 331207 - protein, 20 aa, Mycobacterium
TGLLDLLNRLGITPLPNTAG

SEQ ID NO: 331208 - protein, 27 aa, Mycobacterium
TGLLTKMSRLPLGWFTARGSGSIKQLV

SEQ ID NO: 331209 - protein, 19 aa, Mycobacterium
TGLMCIRLPSLRELDHAPT

SEQ ID NO: 331210 - protein, 19 aa, Mycobacterium
TGLPWYAILVLPILFSAGM

SEQ ID NO: 331211 - protein, 23 aa, Mycobacterium
TGLQALCAVGALYVGSRTGTGFG

SEQ ID NO: 331212 - protein, 19 aa, Mycobacterium
TGLQIDWALAAAVTGAAVA

SEQ ID NO: 331213 - protein, 22 aa, Mycobacterium
TGLRAPWRPRTFLRALSQALRF

SEQ ID NO: 331214 - protein, 21 aa, Mycobacterium
TGLRFPFDIPIEDFLFGFAMV

SEQ ID NO: 331215 - protein, 22 aa, Mycobacterium
TGLSLRLHPGAAMIITGKSGTG

SEQ ID NO: 331216 - protein, 19 aa, Mycobacterium
TGLTASRFVACPFADAQLP

SEQ ID NO: 331217 - protein, 20 aa, Mycobacterium
TGLTPISFAVGSTGLLYAVG

SEQ ID NO: 331218 - protein, 27 aa, Mycobacterium
TGLTWIRFSVWMAIGVVLYFVYGRRHS

SEQ ID NO: 331219 - protein, 25 aa, Mycobacterium
TGLVGCFIFSLFRPGGVPGNNAILA

SEQ ID NO: 331220 - protein, 17 aa, Mycobacterium
TGLYAFGAMIFLAVGSL

SEQ ID NO: 331221 - protein, 18 aa, Mycobacterium
TGMAEAMASFSPTAPTDA

SEQ ID NO: 331222 - protein, 17 aa, Mycobacterium
TGMGFGRDMRSALFHHI

SEQ ID NO: 331223 - protein, 19 aa, Mycobacterium
TGMKVRRYFVGFGPTLWST

SEQ ID NO: 331224 - protein, 24 aa, Mycobacterium
TGMLWPEVQGWLGDHVVGGVTLFP

SEQ ID NO: 331225 - protein, 25 aa, Mycobacterium
TGMRTPWLVPGWLFISAVVYVPLAL

SEQ ID NO: 331226 - protein, 20 aa, Mycobacterium
TGNLPVQWDKVPAAVPNGGK

SEQ ID NO: 331227 - protein, 20 aa, Mycobacterium
TGNVIFLGFWLAPRTSIDLT

SEQ ID NO: 331228 - protein, 20 aa, Mycobacterium
TGNVIFLGFWLAPRTSVDLT

SEQ ID NO: 331229 - protein, 23 aa, Mycobacterium
TGPELPAGPARLAGTAGAETAPI

SEQ ID NO: 331230 - protein, 22 aa, Mycobacterium
TGPGKEPLWLGSIKSNMGHTSA

SEQ ID NO: 331231 - protein, 33 aa, Mycobacterium
TGPGRYGFDAGRGWARRPFVGSFVALLIGIGAG

SEQ ID NO: 331232 - protein, 19 aa, Mycobacterium
TGPLLKKRIQGHWPPPDLK

SEQ ID NO: 331233 - protein, 23 aa, Mycobacterium
TGPLPYIVMEYVDGITLRDIVKD

SEQ ID NO: 331234 - protein, 22 aa, Mycobacterium
TGPLPYIVMEYVDGVTLRDIVH

SEQ ID NO: 331235 - protein, 20 aa, Mycobacterium
TGPPLPMPLHHAAAAAYRGE

SEQ ID NO: 331236 - protein, 23 aa, Mycobacterium
TGPRVDRLFVCGSSQLTTALCAD

SEQ ID NO: 331237 - protein, 20 aa, Mycobacterium
TGPSPETRRALTLYGVQLVL

SEQ ID NO: 331238 - protein, 20 aa, Mycobacterium
TGQAGPLFEIMKVLKANGIG

SEQ ID NO: 331239 - protein, 39 aa, Mycobacterium
TGQLAVVVHPTFLYELLWNVLVFAMLIYLDRRFTIGHGR

SEQ ID NO: 331240 - protein, 18 aa, Mycobacterium
TGQPDAYEAYEHEQDRDV

SEQ ID NO: 331241 - protein, 20 aa, Mycobacterium
TGRGDGWRSVPRAVLAFDIA

SEQ ID NO: 331242 - protein, 20 aa, Mycobacterium
TGRGLDVWSALPVLGAIPLI

SEQ ID NO: 331243 - protein, 26 aa, Mycobacterium
TGRIFAYFRYRLRSAFLLDTSRFAVH

SEQ ID NO: 331244 - protein, 33 aa, Mycobacterium
TGRIIGVEALLRWPHPRLGLLYPGAFMSLVRQH

SEQ ID NO: 331245 - protein, 21 aa, Mycobacterium
TGRIKDLVIIDGRNHYPQDIE

SEQ ID NO: 331246 - protein, 21 aa, Mycobacterium
TGRLNDYIRVVAELTNVGDGL

SEQ ID NO: 331247 - protein, 26 aa, Mycobacterium
TGRLPLPRADRVPVVFIDDVATATQS

SEQ ID NO: 331248 - protein, 20 aa, Mycobacterium
TGRLWPLIVAHTLIDVVAFV

SEQ ID NO: 331249 - protein, 25 aa, Mycobacterium
TGRPALCRVSRVGALASLLASMYFL

SEQ ID NO: 331250 - protein, 21 aa, Mycobacterium
TGRPGWDGGVGTITPAAAAAI

SEQ ID NO: 331251 - protein, 25 aa, Mycobacterium
TGRRSLRVWLVLGAMLLSVIIGVRL

SEQ ID NO: 331252 - protein, 19 aa, Mycobacterium
TGRYKVFPVTGTALMALAF

SEQ ID NO: 331253 - protein, 27 aa, Mycobacterium
TGSAYNYPLVFRVRGALDVDALRDALT

SEQ ID NO: 331254 - protein, 26 aa, Mycobacterium
TGSDGHSAMAMVWLVGQAGSTQARES

SEQ ID NO: 331255 - protein, 19 aa, Mycobacterium
TGSFLDNWLPLAPQQTIRA

SEQ ID NO: 331256 - protein, 29 aa, Mycobacterium
TGSLLVKHRISAFVLPHGLITVRLPGLDG

SEQ ID NO: 331257 - protein, 25 aa, Mycobacterium
TGSNRLLMGLGWPVVVLLALAVARK

SEQ ID NO: 331258 - protein, 25 aa, Mycobacterium
TGSNRLLMGLGWPVVVLVSIVVARR

SEQ ID NO: 331259 - protein, 26 aa, Mycobacterium
TGSNRLLMGLGWPVVVLVSIVVARRA

SEQ ID NO: 331260 - protein, 19 aa, Mycobacterium
TGSPTRWDATPESPAELST

SEQ ID NO: 331261 - protein, 25 aa, Mycobacterium
TGSVEEFRSGLLIVVALAAVLVIAP

SEQ ID NO: 331262 - protein, 26 aa, Mycobacterium
TGSVGIAIWLLCFHKVNSVSSLGSAV

SEQ ID NO: 331263 - protein, 25 aa, Mycobacterium
TGTALRQGRFWLLSIAFVGQAGSVS

SEQ ID NO: 331264 - protein, 20 aa, Mycobacterium
TGTALTIYIALAIAFGVWTW

SEQ ID NO: 331265 - protein, 18 aa, Mycobacterium
TGTAVSIAALVPIAGALA

SEQ ID NO: 331266 - protein, 21 aa, Mycobacterium
TGTLIFGFILMWIMSWLTATP

SEQ ID NO: 331267 - protein, 19 aa, Mycobacterium
TGTMGNWILLWSVLAFACF

SEQ ID NO: 331268 - protein, 26 aa, Mycobacterium
TGTPLEPYPSWAWTDERIAGYFAGQQ

SEQ ID NO: 331269 - protein, 19 aa, Mycobacterium
TGTRVARKLLIVDLPRPPV

SEQ ID NO: 331270 - protein, 25 aa, Mycobacterium
TGTSGWEMYKPWAITSLAIAVCAAF

SEQ ID NO: 331271 - protein, 23 aa, Mycobacterium
TGTTCFVGFLASYLFNVYFQHGA

SEQ ID NO: 331272 - protein, 21 aa, Mycobacterium
TGTTVGLVFIWLSLTPSLLPR

SEQ ID NO: 331273 - protein, 21 aa, Mycobacterium
TGTTVGLVFVWFSMTPSLLPR

SEQ ID NO: 331274 - protein, 22 aa, Mycobacterium
TGVAGWLFGWLADRSGSLAAPM

SEQ ID NO: 331275 - protein, 20 aa, Mycobacterium
TGVAVAIPFGMVGLVHPRSG

SEQ ID NO: 331276 - protein, 23 aa, Mycobacterium
TGVAYPLVIWLAAQVPGLRDKAD

SEQ ID NO: 331277 - protein, 25 aa, Mycobacterium
TGVGLGMSVARGFVEAMGGTIAAGD

SEQ ID NO: 331278 - protein, 25 aa, Mycobacterium
TGVGLGMSVARGFVEAMGGTITATD

SEQ ID NO: 331279 - protein, 25 aa, Mycobacterium
TGVGLGMSVARGFVEAMGGTVAAGD

SEQ ID NO: 331280 - protein, 24 aa, Mycobacterium
TGVGLPSLLLFLGVGVLVGEGGLG

SEQ ID NO: 331281 - protein, 18 aa, Mycobacterium
TGVGWAAYILFSLAALAF

SEQ ID NO: 331282 - protein, 24 aa, Mycobacterium
TGVPWYTSDGVRFVWDATGSLIYF

SEQ ID NO: 331283 - protein, 21 aa, Mycobacterium
TGVTILNNWIRQGVVERGLVV

SEQ ID NO: 331284 - protein, 21 aa, Mycobacterium
TGVVIGIIWMGRRLVSPWWAL

SEQ ID NO: 331285 - protein, 25 aa, Mycobacterium
TGVVIGIVWMGRRLVSPWWALGLGM

SEQ ID NO: 331286 - protein, 18 aa, Mycobacterium
TGVWPLTGGIALIVAVAA

SEQ ID NO: 331287 - protein, 19 aa, Mycobacterium
TGWALPIVCAAFLVYGYYG

SEQ ID NO: 331288 - protein, 25 aa, Mycobacterium
TGWLCPGCGGLRMTHDLLHGDIAAA

SEQ ID NO: 331289 - protein, 26 aa, Mycobacterium
TGWMADRFGVRRVFISAIAVFTLASV

SEQ ID NO: 331290 - protein, 25 aa, Mycobacterium
TGWNCPACGGLRMTHDLLHGDVAAA

SEQ ID NO: 331291 - protein, 22 aa, Mycobacterium
TGWRATIAVAMSNYIEAGSIIA

SEQ ID NO: 331292 - protein, 27 aa, Mycobacterium
TGWSGLPLFAARCAATVVLAAASYWVL

SEQ ID NO: 331293 - protein, 21 aa, Mycobacterium
TGYGCGAIFAFHGAPDLALTQ

SEQ ID NO: 331294 - protein, 26 aa, Mycobacterium
TGYLLAGTHSWRWMLGLATVPAMLLL

SEQ ID NO: 331295 - protein, 20 aa, Mycobacterium
TGYRVKDLLAEAGVRSGADM

SEQ ID NO: 331296 - protein, 24 aa, Mycobacterium
TGYSKFWWPDVPTWAPALVTIAVM

SEQ ID NO: 331297 - protein, 28 aa, Mycobacterium
TGYSRFPVIGPRGDYLGYLHIKDVLTMG

SEQ ID NO: 331298 - protein, 18 aa, Mycobacterium
TGYSRFPVLGLDQHFIGY

SEQ ID NO: 331299 - protein, 17 aa, Mycobacterium
TGYSRFPVTDASGTFIG

SEQ ID NO: 331300 - protein, 30 aa, Mycobacterium
TGYWLAGGVSILWLGVAGWSLWAANSPGMG

SEQ ID NO: 331301 - protein, 17 aa, Mycobacterium
THALRYALAVSAAGGAG

SEQ ID NO: 331302 - protein, 25 aa, Mycobacterium
THDVRHGIFWAGFVLYFTTYHTWLG

SEQ ID NO: 331303 - protein, 23 aa, Mycobacterium
THEAAKRGFRWSSTSPRQRHAAS

SEQ ID NO: 331304 - protein, 21 aa, Mycobacterium
THGAHVCSLCLSTDKLADHVP

SEQ ID NO: 331305 - protein, 25 aa, Mycobacterium
THGPTLRESALWSAMFIGIAVLFGI

SEQ ID NO: 331306 - protein, 19 aa, Mycobacterium
THIYFALTLAVEGMVLISL

SEQ ID NO: 331307 - protein, 17 aa, Mycobacterium
THLIPGATIAGGRYRLL

SEQ ID NO: 331308 - protein, 23 aa, Mycobacterium
THLLELPGALFVVVAITIAGAVL

SEQ ID NO: 331309 - protein, 26 aa, Mycobacterium
THPADRLIVIYADFKGEAGADIFRHF

SEQ ID NO: 331310 - protein, 27 aa, Mycobacterium
THPLISRAHLLLRFDQGRWLAIDNNSL

SEQ ID NO: 331311 - protein, 19 aa, Mycobacterium
THPSLPTTRIFGARRFRVA

SEQ ID NO: 331312 - protein, 23 aa, Mycobacterium
THQICAHCGAAIGAGAAFCQVCG

SEQ ID NO: 331313 - protein, 23 aa, Mycobacterium
THQQCAKAECPFNTAQSENLPIP

SEQ ID NO: 331314 - protein, 30 aa, Mycobacterium
THRDRIADVFLRLAAVFFYAAPVFFVAILL

SEQ ID NO: 331315 - protein, 26 aa, Mycobacterium
THRGGGCGRDGCRHAVSGPVKQLRAR

SEQ ID NO: 331316 - protein, 31 aa, Mycobacterium
THRLRIAIVLMPFAGIAFLWFLGVVRDGLGT

SEQ ID NO: 331317 - protein, 18 aa, Mycobacterium
THRRKVRFDWSRTPLHWV

SEQ ID NO: 331318 - protein, 25 aa, Mycobacterium
THRWIKDLPDEPVWINGDHARLHQL

SEQ ID NO: 331319 - protein, 17 aa, Mycobacterium
THRYEVEVTWTGNTGSG

SEQ ID NO: 331320 - protein, 23 aa, Mycobacterium
THSPEAFNVIFVDMKFESAAQDI

SEQ ID NO: 331321 - protein, 18 aa, Mycobacterium
THTKRTVVSMVWWAAGAV

SEQ ID NO: 331322 - protein, 23 aa, Mycobacterium
THVARLAVFVVFLLVLFYLVAVA

SEQ ID NO: 331323 - protein, 19 aa, Mycobacterium
THWSFMLGEIALYSFIVLL

SEQ ID NO: 331324 - protein, 25 aa, Mycobacterium
TIAALGIMICWYYGITAFACIWYFR

SEQ ID NO: 331325 - protein, 22 aa, Mycobacterium
TIAARTGWYLAMVAASVALAVA

SEQ ID NO: 331326 - protein, 21 aa, Mycobacterium
TIAAWPRAPLPGRPRAAPGPY

SEQ ID NO: 331327 - protein, 27 aa, Mycobacterium
TIADGRYRLLVFHGGPPHLQFWQALDT

SEQ ID NO: 331328 - protein, 28 aa, Mycobacterium
TIAGACLCLGFARLGYFNTMGPACAIAM

SEQ ID NO: 331329 - protein, 26 aa, Mycobacterium
TIAGACYCLTFARLNYFHTMGPAVAI

SEQ ID NO: 331330 - protein, 41 aa, Mycobacterium
TIAGAILCLHFTRLPYFQTMGIPCAIGMLAAVAVAVTLVPA

SEQ ID NO: 331331 - protein, 27 aa, Mycobacterium
TIAGAVLCLHFTRLPVYQTLGVATAVG

SEQ ID NO: 331332 - protein, 24 aa, Mycobacterium
TIAGGRYRLLVSHGGPEHLQFWQA

SEQ ID NO: 331333 - protein, 17 aa, Mycobacterium
TIAGIVIVIYSFVPMLW

SEQ ID NO: 331334 - protein, 19 aa, Mycobacterium
TIANLPVAVGWTIALVVVL

SEQ ID NO: 331335 - protein, 20 aa, Mycobacterium
TIARRSQRLFVAQWANTGKL

SEQ ID NO: 331336 - protein, 27 aa, Mycobacterium
TIARVLVEWRFDLIFGTAAVVMAGVYL

SEQ ID NO: 331337 - protein, 25 aa, Mycobacterium
TIATGCPFCRVMITDGVDDVAASRN

SEQ ID NO: 331338 - protein, 25 aa, Mycobacterium
TIATGCPFCRVMVTDGVNDRQEEAG

SEQ ID NO: 331339 - protein, 18 aa, Mycobacterium
TIATRFGVFDPKRKVKTR

SEQ ID NO: 331340 - protein, 26 aa, Mycobacterium
TIAWYQEFLRYYFLTVESNVDGSLTR

SEQ ID NO: 331341 - protein, 20 aa, Mycobacterium
TICIRLIEWVMGIDVGELLA

SEQ ID NO: 331342 - protein, 17 aa, Mycobacterium
TICPPKLTDMIEQERKA

SEQ ID NO: 331343 - protein, 18 aa, Mycobacterium
TIDRHWLLVQGLRSPSLL

SEQ ID NO: 331344 - protein, 27 aa, Mycobacterium
TIEAAQLSALWARFPLPVIPAPGDPTP

SEQ ID NO: 331345 - protein, 28 aa, Mycobacterium
TIEAAQMSALWARFPLPVIPAPGDPTPS

SEQ ID NO: 331346 - protein, 21 aa, Mycobacterium
TIEALTFAVIITMLLLVYRSI

SEQ ID NO: 331347 - protein, 23 aa, Mycobacterium
TIELHASLAIGDRVHTTSGLQGT

SEQ ID NO: 331348 - protein, 23 aa, Mycobacterium
TIFAGRLSERFGPGRMTVAGAVT

SEQ ID NO: 331349 - protein, 17 aa, Mycobacterium
TIFLIGHPMNWWTPTTD

SEQ ID NO: 331350 - protein, 21 aa, Mycobacterium
TIGFARLKPAVDFGAPDGPAD

SEQ ID NO: 331351 - protein, 27 aa, Mycobacterium
TIGGGYLLVCAMIYGWAFMQRGVPYFP

SEQ ID NO: 331352 - protein, 21 aa, Mycobacterium
TIGIALGVARPVISLLGEHGV

SEQ ID NO: 331353 - protein, 17 aa, Mycobacterium
TIGLFGFSEHGWDPAPY

SEQ ID NO: 331354 - protein, 21 aa, Mycobacterium
TIGLLRPGHSPPWAADVIAND

SEQ ID NO: 331355 - protein, 25 aa, Mycobacterium
TIGVLRARHPPPWGADVLVSDLTGA

SEQ ID NO: 331356 - protein, 19 aa, Mycobacterium
TIIFNGWNWSATQTIIPLP

SEQ ID NO: 331357 - protein, 17 aa, Mycobacterium
TILAIGDNTWFSWLVVF

SEQ ID NO: 331358 - protein, 23 aa, Mycobacterium
TILDSRGGAIFAAVCVAALVIIV

SEQ ID NO: 331359 - protein, 17 aa, Mycobacterium
TILDSRGGMIFTAVLIA

SEQ ID NO: 331360 - protein, 18 aa, Mycobacterium
TILDSRGGVTFAAVCVAA

SEQ ID NO: 331361 - protein, 18 aa, Mycobacterium
TILESRGGVVFTAVVIAA

SEQ ID NO: 331362 - protein, 25 aa, Mycobacterium
TILGFYANCGMAWVVAVASDIVVNK

SEQ ID NO: 331363 - protein, 24 aa, Mycobacterium
TILGFYANCGMAWVVTVASDIAIN

SEQ ID NO: 331364 - protein, 25 aa, Mycobacterium
TILGFYANCGMAWVVTVASDIVFNK

SEQ ID NO: 331365 - protein, 25 aa, Mycobacterium
TILGFYANCGMAWVVTVASDIVVNK

SEQ ID NO: 331366 - protein, 23 aa, Mycobacterium
TILGRVAIRLGMPAIAGELCAGV

SEQ ID NO: 331367 - protein, 21 aa, Mycobacterium
TILIIRGLRTAIAIRDSFGKL

SEQ ID NO: 331368 - protein, 33 aa, Mycobacterium
TILILVLVYLQFRGDFLPRTQLTMISARSGLSL

SEQ ID NO: 331369 - protein, 25 aa, Mycobacterium
TILNRRSKLFGALPLVAPLFAAITV

SEQ ID NO: 331370 - protein, 22 aa, Mycobacterium
TILPAHLLWLIERRHADPAVSK

SEQ ID NO: 331371 - protein, 17 aa, Mycobacterium
TILPKWLGYYTVWQYVT

SEQ ID NO: 331372 - protein, 27 aa, Mycobacterium
TILRPEHHFPRRGAIDITVGRPIAPAG

SEQ ID NO: 331373 - protein, 18 aa, Mycobacterium
TILVPFLIGQSVILALAI

SEQ ID NO: 331374 - protein, 37 aa, Mycobacterium
TILYWRVARVRPRFAFDGPVCRELVRFGVPVTAVTLL

SEQ ID NO: 331375 - protein, 25 aa, Mycobacterium
TINNEFYYWVSIALMFLIHAGFLAY

SEQ ID NO: 331376 - protein, 29 aa, Mycobacterium
TIPHRLLEVYLGFFAGFLMYLASADILPR

SEQ ID NO: 331377 - protein, 25 aa, Mycobacterium
TIPQCVARFTIMFAAGAVLYQFRDA

SEQ ID NO: 331378 - protein, 23 aa, Mycobacterium
TIPQMIARFAVMFAAGALIYQYQ

SEQ ID NO: 331379 - protein, 28 aa, Mycobacterium
TIQAAQLSALWARFPLPVIPAPGDPTPS

SEQ ID NO: 331380 - protein, 27 aa, Mycobacterium
TIQAAQLSAVWARFPLPVIPAPGDPTP

SEQ ID NO: 331381 - protein, 20 aa, Mycobacterium
TIRCSVGVAVAFADEPEVTP

SEQ ID NO: 331382 - protein, 31 aa, Mycobacterium
TIRGDASVGWLRLGALLVLAAAFVGLVINRR

SEQ ID NO: 331383 - protein, 20 aa, Mycobacterium
TIRLGRPGWLDAGALADAVV

SEQ ID NO: 331384 - protein, 25 aa, Mycobacterium
TIRRLALPILLFWVGLAALTNIAVP

SEQ ID NO: 331385 - protein, 21 aa, Mycobacterium
TISFLPIIALAIIFGLSSDYQ

SEQ ID NO: 331386 - protein, 24 aa, Mycobacterium
TISGNRLGLAMAFLVSIAAAFVVS

SEQ ID NO: 331387 - protein, 17 aa, Mycobacterium
TISMGGFPTALRDTRDY

SEQ ID NO: 331388 - protein, 17 aa, Mycobacterium
TITDLGLILGRSRIHGI

SEQ ID NO: 331389 - protein, 24 aa, Mycobacterium
TITLAIGVARMAKRRAVIRRLPAV

SEQ ID NO: 331390 - protein, 18 aa, Mycobacterium
TITLAIGVARMARRRAVV

SEQ ID NO: 331391 - protein, 18 aa, Mycobacterium
TITLPSWTAGSRQVSCNI

SEQ ID NO: 331392 - protein, 17 aa, Mycobacterium
TITRSLIGISIDRVTPA

SEQ ID NO: 331393 - protein, 20 aa, Mycobacterium
TIVCAAVLFSARLLGPRTAV

SEQ ID NO: 331394 - protein, 24 aa, Mycobacterium
TIVCAAVLFSARLVGLRAAVGLTV

SEQ ID NO: 331395 - protein, 26 aa, Mycobacterium
TIVCGAVLFSARWVGPRAAVALAGIA

SEQ ID NO: 331396 - protein, 17 aa, Mycobacterium
TIVGLGFDSRLAGGTGE

SEQ ID NO: 331397 - protein, 20 aa, Mycobacterium
TIVPLPWVIQAPRLFAGQID

SEQ ID NO: 331398 - protein, 18 aa, Mycobacterium
TIVWAQKIIIPLAVVVLA

SEQ ID NO: 331399 - protein, 24 aa, Mycobacterium
TIYHFTRRLMVGIANDLERAAVYF

SEQ ID NO: 331400 - protein, 23 aa, Mycobacterium
TKAFGPWIGWIGGWGLAVSAIIV

SEQ ID NO: 331401 - protein, 23 aa, Mycobacterium
TKALRVGYVAAFSVPANQLPQKV

SEQ ID NO: 331402 - protein, 18 aa, Mycobacterium
TKAQAIAGARARGDNTFA

SEQ ID NO: 331403 - protein, 23 aa, Mycobacterium
TKETLKNAWGRNVVGIVGLNFFT

SEQ ID NO: 331404 - protein, 23 aa, Mycobacterium
TKFTLVMALPWLGAVATLYVVFR

SEQ ID NO: 331405 - protein, 25 aa, Mycobacterium
TKGACPMLDLPIKVFGQRPYTECEQ

SEQ ID NO: 331406 - protein, 17 aa, Mycobacterium
TKGMLPGVFPVPLTIAG

SEQ ID NO: 331407 - protein, 18 aa, Mycobacterium
TKGQLRLLHSDDFREGTK

SEQ ID NO: 331408 - protein, 21 aa, Mycobacterium
TKHYPGRIVFLAVNLAIALIL

SEQ ID NO: 331409 - protein, 22 aa, Mycobacterium
TKHYPGRVVFLAVNLVIALVMM

SEQ ID NO: 331410 - protein, 18 aa, Mycobacterium
TKIARAMVTEFGMSSKLG

SEQ ID NO: 331411 - protein, 26 aa, Mycobacterium
TKIPELRPGGFLGVQGFWGMAHDART

SEQ ID NO: 331412 - protein, 19 aa, Mycobacterium
TKIRTAIGPSQEWWTENLR

SEQ ID NO: 331413 - protein, 19 aa, Mycobacterium
TKKARAMVTEFGMSAKLGA

SEQ ID NO: 331414 - protein, 24 aa, Mycobacterium
TKKSEWLAGVAIGLTLVIKPLLAP

SEQ ID NO: 331415 - protein, 24 aa, Mycobacterium
TKKVRMTLFYGAAMAFGLSEVVVS

SEQ ID NO: 331416 - protein, 20 aa, Mycobacterium
TKLDLAINPLRFAARALNLW

SEQ ID NO: 331417 - protein, 17 aa, Mycobacterium
TKLFVTLFLILALVVVG

SEQ ID NO: 331418 - protein, 17 aa, Mycobacterium
TKLVDMPTPRGSYGAAF

SEQ ID NO: 331419 - protein, 21 aa, Mycobacterium
TKLVMRRWAPIGLTVVALLLL

SEQ ID NO: 331420 - protein, 25 aa, Mycobacterium
TKLYNQRGVRLWVVYVKDFGGLKPA

SEQ ID NO: 331421 - protein, 18 aa, Mycobacterium
TKMLQAFLVVPGLALAFL

SEQ ID NO: 331422 - protein, 21 aa, Mycobacterium
TKNFPVRQLVTDTGWGTGLDI

SEQ ID NO: 331423 - protein, 24 aa, Mycobacterium
TKPSLAPWVALRLLPQGPTLSRAD

SEQ ID NO: 331424 - protein, 19 aa, Mycobacterium
TKQLRMFGRHHLPTPDEAR

SEQ ID NO: 331425 - protein, 29 aa, Mycobacterium
TKSTPRYNKKIAVGFAVITVAATVLVSAG

SEQ ID NO: 331426 - protein, 34 aa, Mycobacterium
TKTEYLKRAEICRERMGPVLRRATFNYAPILLHP

SEQ ID NO: 331427 - protein, 21 aa, Mycobacterium
TKTPLSFIGYWVVPFSLLGLA

SEQ ID NO: 331428 - protein, 23 aa, Mycobacterium
TKTPVEFDRVLAMIDRLSKAMKG

SEQ ID NO: 331429 - protein, 21 aa, Mycobacterium
TKTRVRDVLRNAAIIRRFVYL

SEQ ID NO: 331430 - protein, 23 aa, Mycobacterium
TKTTFGLLRAEYFVGMTVSGALL

SEQ ID NO: 331431 - protein, 20 aa, Mycobacterium
TKVCSHLGCPSSLYEQQSYR

SEQ ID NO: 331432 - protein, 32 aa, Mycobacterium
TKVGPPRFGAGAKKLRSGKFSDSLAGHSAAAG

SEQ ID NO: 331433 - protein, 19 aa, Mycobacterium
TKVIYRRLARRVARDVADY

SEQ ID NO: 331434 - protein, 26 aa, Mycobacterium
TKVPRTRFGTWLGRPMTSFHLIIAVT

SEQ ID NO: 331435 - protein, 24 aa, Mycobacterium
TKWGRSRPGLRLLALAAGLLGVAF

SEQ ID NO: 331436 - protein, 25 aa, Mycobacterium
TKWLQQYTQNFAWPVSKDLNPGGWP

SEQ ID NO: 331437 - protein, 19 aa, Mycobacterium
TKWRGWADFGIAAGSWLPA

SEQ ID NO: 331438 - protein, 22 aa, Mycobacterium
TKWRGWADFGIAAGSWLPAVLW

SEQ ID NO: 331439 - protein, 21 aa, Mycobacterium
TKYLRPGFHPDDIDTNALLEH

SEQ ID NO: 331440 - protein, 21 aa, Mycobacterium
TKYPSGYAVDLFNALNAKNAK

SEQ ID NO: 331441 - protein, 21 aa, Mycobacterium
TKYPSGYAVDLFNALTAKNAK

SEQ ID NO: 331442 - protein, 20 aa, Mycobacterium
TKYPTGYGVTLFNALQDKGA

SEQ ID NO: 331443 - protein, 26 aa, Mycobacterium
TKYPVSLAVGGLRWTQVVAGDAALGA

SEQ ID NO: 331444 - protein, 21 aa, Mycobacterium
TLAAFGWSLYALFWGTAGVPG

SEQ ID NO: 331445 - protein, 22 aa, Mycobacterium
TLAAFLWSLYALFLGTAGEPGM

SEQ ID NO: 331446 - protein, 24 aa, Mycobacterium
TLAAPCAIGMLVAVFAALTLGPAV

SEQ ID NO: 331447 - protein, 18 aa, Mycobacterium
TLAASLAVLVIIAALAGS

SEQ ID NO: 331448 - protein, 18 aa, Mycobacterium
TLAAVWSHPARETWAALE

SEQ ID NO: 331449 - protein, 25 aa, Mycobacterium
TLADRYGRRRWYLMGIALFTLGSIA

SEQ ID NO: 331450 - protein, 17 aa, Mycobacterium
TLAEFAPFDWIAAVAAG

SEQ ID NO: 331451 - protein, 27 aa, Mycobacterium
TLAEIWSHPALETWMAIEIAARGRSGA

SEQ ID NO: 331452 - protein, 25 aa, Mycobacterium
TLAGFAILCSVVIAPSWADPAQDAM

SEQ ID NO: 331453 - protein, 25 aa, Mycobacterium
TLAGIACWLLISRFVLRRLGPGKNG

SEQ ID NO: 331454 - protein, 25 aa, Mycobacterium
TLAGLPAVLSISVLVLRYGLDKLCG

SEQ ID NO: 331455 - protein, 24 aa, Mycobacterium
TLAHLRSAVPLVALLGCGGALGAG

SEQ ID NO: 331456 - protein, 29 aa, Mycobacterium
TLAICVVSMLLAKLLVRPIRRLEAGTERI

SEQ ID NO: 331457 - protein, 22 aa, Mycobacterium
TLAKRWKLVVGALLACLAGATA

SEQ ID NO: 331458 - protein, 18 aa, Mycobacterium
TLALFVAIQMITRRRKFQ

SEQ ID NO: 331459 - protein, 19 aa, Mycobacterium
TLALIVFGLLWPVIFAGGG

SEQ ID NO: 331460 - protein, 17 aa, Mycobacterium
TLALLFVAVALRFVTTT

SEQ ID NO: 331461 - protein, 24 aa, Mycobacterium
TLALPCSIGLFVVVLASLTFAPAV

SEQ ID NO: 331462 - protein, 18 aa, Mycobacterium
TLAMGWSALVGFSRIYLG

SEQ ID NO: 331463 - protein, 17 aa, Mycobacterium
TLAPAILALGSRFGLFE

SEQ ID NO: 331464 - protein, 24 aa, Mycobacterium
TLAPEVDRAVALSGADLVEITDPT

SEQ ID NO: 331465 - protein, 20 aa, Mycobacterium
TLAPEVDRAVALSGASLAEI

SEQ ID NO: 331466 - protein, 24 aa, Mycobacterium
TLAPRAFYDYVPWVDRIPPYSEHL

SEQ ID NO: 331467 - protein, 17 aa, Mycobacterium
TLARIGVLGGMSGGLLG

SEQ ID NO: 331468 - protein, 20 aa, Mycobacterium
TLARNGIRATDLVAIASVGG

SEQ ID NO: 331469 - protein, 23 aa, Mycobacterium
TLARQGISYLVLRNDLDPETSRS

SEQ ID NO: 331470 - protein, 23 aa, Mycobacterium
TLASICALTIISWVVFGGAATFG

SEQ ID NO: 331471 - protein, 26 aa, Mycobacterium
TLATIKGNLFWAFAYNVAALPLAAAG

SEQ ID NO: 331472 - protein, 26 aa, Mycobacterium
TLATIKGNLFWAFAYNVAALPLAVAG

SEQ ID NO: 331473 - protein, 23 aa, Mycobacterium
TLATLSIVFAFFFAPAGVVLGHV

SEQ ID NO: 331474 - protein, 25 aa, Mycobacterium
TLAVLLCLLLGIAIVTQVRQTESGD

SEQ ID NO: 331475 - protein, 21 aa, Mycobacterium
TLAVLMLLPLSAFEATNALPA

SEQ ID NO: 331476 - protein, 18 aa, Mycobacterium
TLAWCLGMVLVFGAITLR

SEQ ID NO: 331477 - protein, 18 aa, Mycobacterium
TLAWPHVRKAGLGAGDEP

SEQ ID NO: 331478 - protein, 18 aa, Mycobacterium
TLCLIFVVMLAITRSVVA

SEQ ID NO: 331479 - protein, 18 aa, Mycobacterium
TLDDGLPALLDWIAKSDV

SEQ ID NO: 331480 - protein, 17 aa, Mycobacterium
TLDHLWLPDTPEVGSTV

SEQ ID NO: 331481 - protein, 25 aa, Mycobacterium
TLDIGLPDMAGWVVLDVLKHDLATR

SEQ ID NO: 331482 - protein, 19 aa, Mycobacterium
TLDLALAQLRSWRDQGMNL

SEQ ID NO: 331483 - protein, 18 aa, Mycobacterium
TLDRIAYRTTIFAFPVFG

SEQ ID NO: 331484 - protein, 18 aa, Mycobacterium
TLELRVCDSCPRADTIVL

SEQ ID NO: 331485 - protein, 24 aa, Mycobacterium
TLESRLAALGTRAGAAVLPKGPLP

SEQ ID NO: 331486 - protein, 19 aa, Mycobacterium
TLFCCLPLGIVSIVYSSKV

SEQ ID NO: 331487 - protein, 17 aa, Mycobacterium
TLFFVLLCDVMVSVLGV

SEQ ID NO: 331488 - protein, 26 aa, Mycobacterium
TLFHLSLRHTLWWLGSLAALGSFGLQ

SEQ ID NO: 331489 - protein, 25 aa, Mycobacterium
TLFIPRFLIAVGICGILVATGSYLL

SEQ ID NO: 331490 - protein, 26 aa, Mycobacterium
TLFLRLCLGGQMLFYGFAKLIPTQMP

SEQ ID NO: 331491 - protein, 32 aa, Mycobacterium
TLFVVHELRVARPMLDPRLFADGGFSSGTAAL

SEQ ID NO: 331492 - protein, 20 aa, Mycobacterium
TLGGSLWWLGAVNVLCALVF

SEQ ID NO: 331493 - protein, 21 aa, Mycobacterium
TLGICAIFLLRARSFVDRNQS

SEQ ID NO: 331494 - protein, 18 aa, Mycobacterium
TLGIPMAVGMTIAVVAAL

SEQ ID NO: 331495 - protein, 22 aa, Mycobacterium
TLGKRWGRGLAVITELLLLPVA

SEQ ID NO: 331496 - protein, 23 aa, Mycobacterium
TLGLRPAEMAELVRTQAAVLHGI

SEQ ID NO: 331497 - protein, 26 aa, Mycobacterium
TLGMPRSEFAVSLALVLLMLPVIVRA

SEQ ID NO: 331498 - protein, 18 aa, Mycobacterium
TLGQARNALRDRGGRSRM

SEQ ID NO: 331499 - protein, 22 aa, Mycobacterium
TLGRALCGIAVVRHNGAAGDAV

SEQ ID NO: 331500 - protein, 25 aa, Mycobacterium
TLGSLRGAVAFNNVHFGYVPGRPVL

SEQ ID NO: 331501 - protein, 18 aa, Mycobacterium
TLGSTWWQTFWRITLPSI

SEQ ID NO: 331502 - protein, 26 aa, Mycobacterium
TLGTIKANLFWAFAYNTAAIPLAALG

SEQ ID NO: 331503 - protein, 34 aa, Mycobacterium
TLGTVGAWIGCRRRGIPLPAFLDAVAPGVVMGQA

SEQ ID NO: 331504 - protein, 19 aa, Mycobacterium
TLGWISFVVLWVVRVIIVS

SEQ ID NO: 331505 - protein, 32 aa, Mycobacterium
TLHAQRYRLCMIVGVQPLRAAPIFDDADAGTP

SEQ ID NO: 331506 - protein, 24 aa, Mycobacterium
TLHDMKFARFVRSGPIGVVHTGSP

SEQ ID NO: 331507 - protein, 25 aa, Mycobacterium
TLHGCRGCTGDRIMVDKVVFRFSEP

SEQ ID NO: 331508 - protein, 27 aa, Mycobacterium
TLHLYLPKVGLRFAVTGGLLLLAGGLF

SEQ ID NO: 331509 - protein, 18 aa, Mycobacterium
TLIAAPFALLAVAYIGDL

SEQ ID NO: 331510 - protein, 29 aa, Mycobacterium
TLIAFRIGRPLIRRFFLNERLNAMFRYAL

SEQ ID NO: 331511 - protein, 18 aa, Mycobacterium
TLIARGRPDELLQVAWTD

SEQ ID NO: 331512 - protein, 27 aa, Mycobacterium
TLIAWTRSGHGWWWAVALGVLGLGLLG

SEQ ID NO: 331513 - protein, 24 aa, Mycobacterium
TLICIAWSLWIRRVTWTCRWEVAA

SEQ ID NO: 331514 - protein, 18 aa, Mycobacterium
TLIDGRVVVWGTDDRTQE

SEQ ID NO: 331515 - protein, 18 aa, Mycobacterium
TLIDILYDTARRFPDAPA

SEQ ID NO: 331516 - protein, 17 aa, Mycobacterium
TLIEMVVGFVLALLIVY

SEQ ID NO: 331517 - protein, 25 aa, Mycobacterium
TLIGCAVALLAYRATQRMRAPTALS

SEQ ID NO: 331518 - protein, 25 aa, Mycobacterium
TLIKADFWRVFGIWLLAAIVAQFIA

SEQ ID NO: 331519 - protein, 17 aa, Mycobacterium
TLIKIRHTESWVLIIAG

SEQ ID NO: 331520 - protein, 23 aa, Mycobacterium
TLIQAGAALTVLLFDSGILTPPP

SEQ ID NO: 331521 - protein, 25 aa, Mycobacterium
TLIRVELPLALRVIVAGVRTALVLI

SEQ ID NO: 331522 - protein, 19 aa, Mycobacterium
TLITFPTLIAFGYPPVVAT

SEQ ID NO: 331523 - protein, 21 aa, Mycobacterium
TLITFPTLVALGFPPVTATMS

SEQ ID NO: 331524 - protein, 23 aa, Mycobacterium
TLITFPTLVALGFPPVTATMSNA

SEQ ID NO: 331525 - protein, 24 aa, Mycobacterium
TLIYEVMCYLAVLAIGVAGLAQNR

SEQ ID NO: 331526 - protein, 24 aa, Mycobacterium
TLKVLPRSETLIMLITVACTVATG

SEQ ID NO: 331527 - protein, 20 aa, Mycobacterium
TLLAALPLAGMRVGFNEPAA

SEQ ID NO: 331528 - protein, 23 aa, Mycobacterium
TLLAPWVRFGQRASKPIVRLGHM

SEQ ID NO: 331529 - protein, 24 aa, Mycobacterium
TLLCIAWSLWIRRVTWSCRWEVAA

SEQ ID NO: 331530 - protein, 27 aa, Mycobacterium
TLLDACWPASSLLIAMASWSPSSPTAP

SEQ ID NO: 331531 - protein, 26 aa, Mycobacterium
TLLDPGGWPRLDWSMDAALLLAALAA

SEQ ID NO: 331532 - protein, 18 aa, Mycobacterium
TLLELAPPVAVVLRDGEP

SEQ ID NO: 331533 - protein, 24 aa, Mycobacterium
TLLGAPVWIGPLLVGAIVITNVVA

SEQ ID NO: 331534 - protein, 19 aa, Mycobacterium
TLLGLCWILGTIAALYAVV

SEQ ID NO: 331535 - protein, 21 aa, Mycobacterium
TLLGVFSRLYVPQLLITGTAD

SEQ ID NO: 331536 - protein, 19 aa, Mycobacterium
TLLGVPMAVVLARARFPGR

SEQ ID NO: 331537 - protein, 24 aa, Mycobacterium
TLLHTAWGLALGRLTGRDDVVFGT

SEQ ID NO: 331538 - protein, 19 aa, Mycobacterium
TLLIGRGILYGQQRVNGVK

SEQ ID NO: 331539 - protein, 28 aa, Mycobacterium
TLLIRHCVRRFGGITGDVLGCAIELATT

SEQ ID NO: 331540 - protein, 20 aa, Mycobacterium
TLLLAARARRRFSRATVGGV

SEQ ID NO: 331541 - protein, 17 aa, Mycobacterium
TLLLAVRAKRYFAKTTV

SEQ ID NO: 331542 - protein, 23 aa, Mycobacterium
TLLLFPVVQPWYVLWAIIPLAAW

SEQ ID NO: 331543 - protein, 19 aa, Mycobacterium
TLLLIPVFFSGRRVHRAEG

SEQ ID NO: 331544 - protein, 26 aa, Mycobacterium
TLLMALACWWVISREVIPRLGTAVKH

SEQ ID NO: 331545 - protein, 18 aa, Mycobacterium
TLLMLWVGHAHRTHRITW

SEQ ID NO: 331546 - protein, 32 aa, Mycobacterium
TLLPDDAFHTWGWRVPFLLGAVLLVVGYFIRR

SEQ ID NO: 331547 - protein, 32 aa, Mycobacterium
TLLPDEAFVSWGWRVPFLLSVVLLAIGVYVRV

SEQ ID NO: 331548 - protein, 29 aa, Mycobacterium
TLLRRPIAVWWIVWVLSAIVATWSIVSTV

SEQ ID NO: 331549 - protein, 17 aa, Mycobacterium
TLLRWPNLAVGLSQVAL

SEQ ID NO: 331550 - protein, 17 aa, Mycobacterium
TLLSFDLLDEDEHDQIE

SEQ ID NO: 331551 - protein, 21 aa, Mycobacterium
TLLTAHRSRWLASIGSGVEIF

SEQ ID NO: 331552 - protein, 24 aa, Mycobacterium
TLLTAQIVWWWRHGHKPGVPAPAV

SEQ ID NO: 331553 - protein, 24 aa, Mycobacterium
TLLTHWKLALGALLACTIGAAAVT

SEQ ID NO: 331554 - protein, 18 aa, Mycobacterium
TLLTRWKLVAAALLACLA

SEQ ID NO: 331555 - protein, 26 aa, Mycobacterium
TLLVAIPFTVLVAFTLNILLREIGAA

SEQ ID NO: 331556 - protein, 32 aa, Mycobacterium
TLLVASAWWLFEWEISRGASLPEARATSLNLF

SEQ ID NO: 331557 - protein, 27 aa, Mycobacterium
TLLVASAWWLFEWEVGKGASVEAARTA

SEQ ID NO: 331558 - protein, 20 aa, Mycobacterium
TLLVCDRLAIDASPFLIAEV

SEQ ID NO: 331559 - protein, 20 aa, Mycobacterium
TLLVCDRLAINANPFLMAEA

SEQ ID NO: 331560 - protein, 20 aa, Mycobacterium
TLLVCDRLVINPAPYLMAEA

SEQ ID NO: 331561 - protein, 20 aa, Mycobacterium
TLLVRFNYDDLKALPEDVDS

SEQ ID NO: 331562 - protein, 17 aa, Mycobacterium
TLLYLVFHWSWLALTGV

SEQ ID NO: 331563 - protein, 19 aa, Mycobacterium
TLMFQEMVNRLGVDVPGMP

SEQ ID NO: 331564 - protein, 20 aa, Mycobacterium
TLMGGFGVFAITTPAADAKP

SEQ ID NO: 331565 - protein, 20 aa, Mycobacterium
TLMLLSAAALTWCAVAPTLS

SEQ ID NO: 331566 - protein, 19 aa, Mycobacterium
TLMNIPLWIVLVLPVAKIV

SEQ ID NO: 331567 - protein, 29 aa, Mycobacterium
TLMSYPGLLLYEMSVAFSPDGKRIASTVW

SEQ ID NO: 331568 - protein, 17 aa, Mycobacterium
TLMWADLNAMAATQRAV

SEQ ID NO: 331569 - protein, 28 aa, Mycobacterium
TLNAICDSIAFGAAGARAPLVPGSAPPR

SEQ ID NO: 331570 - protein, 26 aa, Mycobacterium
TLPASTAVAYPAHWTTSAVDALGAAL

SEQ ID NO: 331571 - protein, 21 aa, Mycobacterium
TLPATVFVAFQLMFAIITVAL

SEQ ID NO: 331572 - protein, 35 aa, Mycobacterium
TLPFLLLFRLTCYYYRGAYYRTVWQSPSACAVAEP

SEQ ID NO: 331573 - protein, 20 aa, Mycobacterium
TLPGCRRLRLPSTPVTTELN

SEQ ID NO: 331574 - protein, 21 aa, Mycobacterium
TLPPGSQVRLCMAAVNRDGSD

SEQ ID NO: 331575 - protein, 20 aa, Mycobacterium
TLPPTLIFDHRAPSALAQHL

SEQ ID NO: 331576 - protein, 19 aa, Mycobacterium
TLPVGLFFGWLGKRLAVAR

SEQ ID NO: 331577 - protein, 24 aa, Mycobacterium
TLQIGLGIGRLVFRALNTVEVCFA

SEQ ID NO: 331578 - protein, 24 aa, Mycobacterium
TLQIGLGIGRLVFRALNTVEVGFA

SEQ ID NO: 331579 - protein, 28 aa, Mycobacterium
TLQRPHFRMPLSPYSGWLTLVFLAAVLI

SEQ ID NO: 331580 - protein, 18 aa, Mycobacterium
TLRDEMVKRMAIMANPGI

SEQ ID NO: 331581 - protein, 20 aa, Mycobacterium
TLREWFARKAFYGKSAAPLS

SEQ ID NO: 331582 - protein, 25 aa, Mycobacterium
TLRMLIPVMRWQRRDMLLGDRDPSD

SEQ ID NO: 331583 - protein, 25 aa, Mycobacterium
TLRPLRRLGAIAANVAAMPLADDDH

SEQ ID NO: 331584 - protein, 19 aa, Mycobacterium
TLRPLRRVAATAATVAAMP

SEQ ID NO: 331585 - protein, 27 aa, Mycobacterium
TLRRRRFRWCVAAAYLSGVSTVAGVGA

SEQ ID NO: 331586 - protein, 19 aa, Mycobacterium
TLRSMFRSVVQRDPMGVQQ

SEQ ID NO: 331587 - protein, 21 aa, Mycobacterium
TLRTDTWWWAPLVTNIGFLAF

SEQ ID NO: 331588 - protein, 22 aa, Mycobacterium
TLRTGIFGIVLVTAVVLVSFGY

SEQ ID NO: 331589 - protein, 26 aa, Mycobacterium
TLRTIKGNLFWAFAYNVAALPLAALG

SEQ ID NO: 331590 - protein, 17 aa, Mycobacterium
TLRWMGRHQPSPPAASR

SEQ ID NO: 331591 - protein, 25 aa, Mycobacterium
TLSALLLAAGLSWAAIQLAHLTGLS

SEQ ID NO: 331592 - protein, 34 aa, Mycobacterium
TLSDDAMHTWGWRIPFLVALPMGLIGWYLRSRLD

SEQ ID NO: 331593 - protein, 28 aa, Mycobacterium
TLSGGALWRFAALMFLSSMVASIGLLQN

SEQ ID NO: 331594 - protein, 18 aa, Mycobacterium
TLSLGWPAPVALVTVLAV

SEQ ID NO: 331595 - protein, 23 aa, Mycobacterium
TLSLPECQGALYTSQDPVYSGTG

SEQ ID NO: 331596 - protein, 25 aa, Mycobacterium
TLSMALKQVRCWREQGITLTVAVNL

SEQ ID NO: 331597 - protein, 24 aa, Mycobacterium
TLSMRRISAFVLPQGLITVRLTPD

SEQ ID NO: 331598 - protein, 25 aa, Mycobacterium
TLSNPDCQGALYAMQGPAYAGSGQT

SEQ ID NO: 331599 - protein, 24 aa, Mycobacterium
TLSQRFGRRYTIAFCAVLALPIVP

SEQ ID NO: 331600 - protein, 17 aa, Mycobacterium
TLSRLIAGYATPTAGVV

SEQ ID NO: 331601 - protein, 26 aa, Mycobacterium
TLSTIKSNLFWAFAYNVAALPLAAAG

SEQ ID NO: 331602 - protein, 25 aa, Mycobacterium
TLSTIKTNLFWAFAYNVAAIPVAAL

SEQ ID NO: 331603 - protein, 17 aa, Mycobacterium
TLSVAVPAVLLSAVIGS

SEQ ID NO: 331604 - protein, 18 aa, Mycobacterium
TLSVDWFGLLVLAAWGAV

SEQ ID NO: 331605 - protein, 26 aa, Mycobacterium
TLTAIAVVVLLGWSFFYFSDDTRGYK

SEQ ID NO: 331606 - protein, 26 aa, Mycobacterium
TLTALLLAAGFSWAAIQLAHLTGLSD

SEQ ID NO: 331607 - protein, 18 aa, Mycobacterium
TLTDLFRWHGAEEVEHRS

SEQ ID NO: 331608 - protein, 26 aa, Mycobacterium
TLTDLGLLLARSYHHGVDRWRAAILT

SEQ ID NO: 331609 - protein, 24 aa, Mycobacterium
TLTEFPDQLSLLARRPDLIPSAIE

SEQ ID NO: 331610 - protein, 17 aa, Mycobacterium
TLTFDWNFGNYLHAFSA

SEQ ID NO: 331611 - protein, 19 aa, Mycobacterium
TLTGLALCAALMAVGTIGF

SEQ ID NO: 331612 - protein, 24 aa, Mycobacterium
TLTKFQGEFLWREYRKPGTEDLDD

SEQ ID NO: 331613 - protein, 17 aa, Mycobacterium
TLTKSLRNFVMRGVVPL

SEQ ID NO: 331614 - protein, 23 aa, Mycobacterium
TLTLGDGRVVIWGTTDRTDEKAE

SEQ ID NO: 331615 - protein, 26 aa, Mycobacterium
TLTLLRLVLVPVFLLALFAGDGQEPG

SEQ ID NO: 331616 - protein, 18 aa, Mycobacterium
TLTLRPGTVTALVGPSGS

SEQ ID NO: 331617 - protein, 30 aa, Mycobacterium
TLTPFPWNQLHQFLELFMKAWTQIGQLLVN

SEQ ID NO: 331618 - protein, 18 aa, Mycobacterium
TLTPLPIKTFDVRLARQA

SEQ ID NO: 331619 - protein, 26 aa, Mycobacterium
TLTPVLVRWFGLWRVIAAGMAFAALS

SEQ ID NO: 331620 - protein, 24 aa, Mycobacterium
TLTRHCWRGAGRAWIEVRGLNDTP

SEQ ID NO: 331621 - protein, 24 aa, Mycobacterium
TLTRRALGEAFGWSLFNWIADVAC

SEQ ID NO: 331622 - protein, 22 aa, Mycobacterium
TLTVCLTVAAIVLWASLVSSVL

SEQ ID NO: 331623 - protein, 19 aa, Mycobacterium
TLTVSRLLAPILAPVIYRA

SEQ ID NO: 331624 - protein, 28 aa, Mycobacterium
TLVAACLRIPYSLGIATFGGRNWTVFSV

SEQ ID NO: 331625 - protein, 17 aa, Mycobacterium
TLVALGFPPVTATMSNA

SEQ ID NO: 331626 - protein, 19 aa, Mycobacterium
TLVDCAVYADGHRLPGKIG

SEQ ID NO: 331627 - protein, 29 aa, Mycobacterium
TLVFAPRGWVAICAFAMVVATHEVVRRLR

SEQ ID NO: 331628 - protein, 18 aa, Mycobacterium
TLVGAEFINVFELIVGIV

SEQ ID NO: 331629 - protein, 27 aa, Mycobacterium
TLVGAVLRLPYTFATAWFGGRNWTVFS

SEQ ID NO: 331630 - protein, 17 aa, Mycobacterium
TLVGLLALPGYRTTYDG

SEQ ID NO: 331631 - protein, 25 aa, Mycobacterium
TLVGSCLRIPYTLATATFGGRNWTV

SEQ ID NO: 331632 - protein, 28 aa, Mycobacterium
TLVIPALFTLIGDRIWWPSDPKTTAHQP

SEQ ID NO: 331633 - protein, 22 aa, Mycobacterium
TLVLCVIALFAVNVVLTTIGVR

SEQ ID NO: 331634 - protein, 21 aa, Mycobacterium
TLVNLLMRFYDVDSGRITIDG

SEQ ID NO: 331635 - protein, 24 aa, Mycobacterium
TLVNLLMRFYEVDSGQILLDGVDI

SEQ ID NO: 331636 - protein, 23 aa, Mycobacterium
TLVNLLMRFYEVDSGRILIDGVD

SEQ ID NO: 331637 - protein, 24 aa, Mycobacterium
TLVNLLMRFYEVDSGRILLDGIDV

SEQ ID NO: 331638 - protein, 24 aa, Mycobacterium
TLVPLLRRPAVIVGKSTVPVGTAA

SEQ ID NO: 331639 - protein, 24 aa, Mycobacterium
TLVRGRVWAFPWIMFVLAAGLAGV

SEQ ID NO: 331640 - protein, 17 aa, Mycobacterium
TLVRMFLVPAFIHLLGP

SEQ ID NO: 331641 - protein, 35 aa, Mycobacterium
TLVRMLLVPAFMRVMGRWNWWAPAPLARLHERIGF

SEQ ID NO: 331642 - protein, 36 aa, Mycobacterium
TLVRMVLVPAFIHWLGRWTWWAPKPLERLRNRSVTG

SEQ ID NO: 331643 - protein, 23 aa, Mycobacterium
TLVSLRLWRHLGRLYLMSPDPAT

SEQ ID NO: 331644 - protein, 17 aa, Mycobacterium
TLVSRLTGFARIVLLAA

SEQ ID NO: 331645 - protein, 21 aa, Mycobacterium
TLVSRPACDLAGMLTIAQQAR

SEQ ID NO: 331646 - protein, 25 aa, Mycobacterium
TLVVDRLSALMLVVSAIVLLAVVLY

SEQ ID NO: 331647 - protein, 19 aa, Mycobacterium
TLWAPRFVAPLGLLRGSVA

SEQ ID NO: 331648 - protein, 22 aa, Mycobacterium
TLWGAVAGYLRARFDVPSFITT

SEQ ID NO: 331649 - protein, 22 aa, Mycobacterium
TLYVIGCLIGVLAVQQSALFTA

SEQ ID NO: 331650 - protein, 32 aa, Mycobacterium
TLYVLPWVCAPLAIAVMWRWILAPTDGAVSAV

SEQ ID NO: 331651 - protein, 18 aa, Mycobacterium
TMAAGIASMGVWPLAIGQ

SEQ ID NO: 331652 - protein, 18 aa, Mycobacterium
TMAPAISPKKSWEGLAGS

SEQ ID NO: 331653 - protein, 17 aa, Mycobacterium
TMASIRCGKSIRFRSRD

SEQ ID NO: 331654 - protein, 26 aa, Mycobacterium
TMDTSRLHDEWGFRPAWTAEEAVQDF

SEQ ID NO: 331655 - protein, 20 aa, Mycobacterium
TMGTTNWAKIFGMVGADPDE

SEQ ID NO: 331656 - protein, 20 aa, Mycobacterium
TMIAGIYGMNFHFMPELDAW

SEQ ID NO: 331657 - protein, 20 aa, Mycobacterium
TMIAGIYGMNFHFMPELDSR

SEQ ID NO: 331658 - protein, 28 aa, Mycobacterium
TMIAGVLGHRWLSKRTRRMINPGMLAGG

SEQ ID NO: 331659 - protein, 20 aa, Mycobacterium
TMITLIPIVALMTVGGPAIG

SEQ ID NO: 331660 - protein, 17 aa, Mycobacterium
TMLAFAVLWGVSAGIGA

SEQ ID NO: 331661 - protein, 25 aa, Mycobacterium
TMLGGLCLIGTVWLVARARSSVRAG

SEQ ID NO: 331662 - protein, 28 aa, Mycobacterium
TMLSFRFAPELMVIVPLFVIYNQIGLFD

SEQ ID NO: 331663 - protein, 25 aa, Mycobacterium
TMLSSRLGRRFSRPQIVRIAEVSGG

SEQ ID NO: 331664 - protein, 27 aa, Mycobacterium
TMLVATAWWLFEWEIGKGASVEVARTA

SEQ ID NO: 331665 - protein, 20 aa, Mycobacterium
TMLYGCYAMFGLSFVASLNI

SEQ ID NO: 331666 - protein, 17 aa, Mycobacterium
TMLYGCYAMFGLSLVAS

SEQ ID NO: 331667 - protein, 24 aa, Mycobacterium
TMMGGLLVSLIVRRRRVWVRLTPG

SEQ ID NO: 331668 - protein, 18 aa, Mycobacterium
TMNYPPLLFHPINSITAY

SEQ ID NO: 331669 - protein, 25 aa, Mycobacterium
TMPGLCFAAAGLAAPWLARKLGLGW

SEQ ID NO: 331670 - protein, 19 aa, Mycobacterium
TMPTPPGWADAGTRTPAWA

SEQ ID NO: 331671 - protein, 28 aa, Mycobacterium
TMPVLLFCIAFGLSMDYEVFLVSRIREY

SEQ ID NO: 331672 - protein, 17 aa, Mycobacterium
TMRPALDKLNGVLTILD

SEQ ID NO: 331673 - protein, 17 aa, Mycobacterium
TMRPLRYVVVGFGLSAV

SEQ ID NO: 331674 - protein, 25 aa, Mycobacterium
TMRTVKLNLAWAFGYNIAAIPIAAA

SEQ ID NO: 331675 - protein, 26 aa, Mycobacterium
TMRVLALPIIVVWLLIAIGVNVFVPQ

SEQ ID NO: 331676 - protein, 18 aa, Mycobacterium
TMSPGRRAGLFTLRGYLV

SEQ ID NO: 331677 - protein, 25 aa, Mycobacterium
TMSVWKFFALLGYAAIYAYLAPWQL

SEQ ID NO: 331678 - protein, 25 aa, Mycobacterium
TMTASWQLVLLWGVLVGIGTGSISM

SEQ ID NO: 331679 - protein, 25 aa, Mycobacterium
TMTGARPGGFGDLNGRTNEICAPGD

SEQ ID NO: 331680 - protein, 18 aa, Mycobacterium
TMTGIKAVQAYRREPRNQ

SEQ ID NO: 331681 - protein, 26 aa, Mycobacterium
TMTGRAVAFLAPWLFSVFVDVFGAVR

SEQ ID NO: 331682 - protein, 26 aa, Mycobacterium
TMTGRAVAFLGPWLFSIFVDIFSAVR

SEQ ID NO: 331683 - protein, 26 aa, Mycobacterium
TMTGRAVAFLGPWSFSVFVDAFSAVR

SEQ ID NO: 331684 - protein, 25 aa, Mycobacterium
TMTGRAVAFVAPWLFSVFVDIFGAV

SEQ ID NO: 331685 - protein, 19 aa, Mycobacterium
TMTLNWGYAAGVALFGVAL

SEQ ID NO: 331686 - protein, 21 aa, Mycobacterium
TMTRYYAAQREFWVDPVSGII

SEQ ID NO: 331687 - protein, 20 aa, Mycobacterium
TMTRYYAAQRTFWVDPVSGT

SEQ ID NO: 331688 - protein, 17 aa, Mycobacterium
TMTTLPYFQSMALPCAI

SEQ ID NO: 331689 - protein, 17 aa, Mycobacterium
TMTTLPYFQTMGLPCAI

SEQ ID NO: 331690 - protein, 25 aa, Mycobacterium
TMTYALRYRWWVVLTGVAIASVTVH

SEQ ID NO: 331691 - protein, 20 aa, Mycobacterium
TMVACIGGVFRECRPQNVIA

SEQ ID NO: 331692 - protein, 20 aa, Mycobacterium
TMVGLPFAAFFAFSVGCWPA

SEQ ID NO: 331693 - protein, 18 aa, Mycobacterium
TMVLLQLRVFYAREEPWT

SEQ ID NO: 331694 - protein, 18 aa, Mycobacterium
TMVRTSLWIGVAVVAVLF

SEQ ID NO: 331695 - protein, 23 aa, Mycobacterium
TMVSVAIAVLWLAALAINHSRST

SEQ ID NO: 331696 - protein, 25 aa, Mycobacterium
TMVTVLYWRADGVILSLVNTHSEVG

SEQ ID NO: 331697 - protein, 20 aa, Mycobacterium
TMYPEMVVLAALAWASVPLL

SEQ ID NO: 331698 - protein, 18 aa, Mycobacterium
TNAGVAWAIYPISLAVTI

SEQ ID NO: 331699 - protein, 18 aa, Mycobacterium
TNALAIASLIASFTGLLC

SEQ ID NO: 331700 - protein, 17 aa, Mycobacterium
TNASGLRHPGVGGVGWG

SEQ ID NO: 331701 - protein, 25 aa, Mycobacterium
TNDSYRWPIYFEYLFNERVLTVGVL

SEQ ID NO: 331702 - protein, 18 aa, Mycobacterium
TNFKRALIEVSYFSGLGV

SEQ ID NO: 331703 - protein, 23 aa, Mycobacterium
TNHRLTTWIGWGVAVLISVLNVA

SEQ ID NO: 331704 - protein, 27 aa, Mycobacterium
TNIGPDFGKAGPFGLTVVVLLMVGTFF

SEQ ID NO: 331705 - protein, 22 aa, Mycobacterium
TNKRKAPTLALVIPGIIGFLLS

SEQ ID NO: 331706 - protein, 28 aa, Mycobacterium
TNLFGVELWERFSFYGMLTILGYYLYYS

SEQ ID NO: 331707 - protein, 17 aa, Mycobacterium
TNLFSVTSFGEFEFWFA

SEQ ID NO: 331708 - protein, 19 aa, Mycobacterium
TNLMWLDLIGRRLAEIGDK

SEQ ID NO: 331709 - protein, 17 aa, Mycobacterium
TNLRRLQDGIGQLASGA

SEQ ID NO: 331710 - protein, 19 aa, Mycobacterium
TNLVAGLRSPFAEDPSTLE

SEQ ID NO: 331711 - protein, 20 aa, Mycobacterium
TNLVGIVVMAAVVFLLSGLV

SEQ ID NO: 331712 - protein, 17 aa, Mycobacterium
TNMAGELLIPVEGGIDV

SEQ ID NO: 331713 - protein, 27 aa, Mycobacterium
TNPGLPIRGVVAVCDFGAGGTSITLAD

SEQ ID NO: 331714 - protein, 25 aa, Mycobacterium
TNPRLPDAPFPPADPRSEFDAAEHS

SEQ ID NO: 331715 - protein, 25 aa, Mycobacterium
TNPSEFKMSVVFNDGKEVPANLVGR

SEQ ID NO: 331716 - protein, 17 aa, Mycobacterium
TNQAQVLDVRWAIGGLG

SEQ ID NO: 331717 - protein, 18 aa, Mycobacterium
TNQLDWSVSVVVMLVASV

SEQ ID NO: 331718 - protein, 22 aa, Mycobacterium
TNRASAVFGGWLAGLAGAWFVV

SEQ ID NO: 331719 - protein, 24 aa, Mycobacterium
TNSSSWWAFRSFCSSTGCVASGTV

SEQ ID NO: 331720 - protein, 20 aa, Mycobacterium
TNVALAFPFLVTALSVVTLN

SEQ ID NO: 331721 - protein, 40 aa, Mycobacterium
TNVLQMIISVGLDWNIRSVSWLPLFHDMGLLMIMFPALCG

SEQ ID NO: 331722 - protein, 17 aa, Mycobacterium
TNVLSELPEGSDITLNL

SEQ ID NO: 331723 - protein, 19 aa, Mycobacterium
TNWLPMFVIMIVVSVVAGI

SEQ ID NO: 331724 - protein, 24 aa, Mycobacterium
TNWQWLSLTLAAPVVVWGALPFHR

SEQ ID NO: 331725 - protein, 25 aa, Mycobacterium
TNYERQGLSWALYAVMAMWTGFAAV

SEQ ID NO: 331726 - protein, 23 aa, Mycobacterium
TPAEPPLAAGFNALPQALMPYTK

SEQ ID NO: 331727 - protein, 23 aa, Mycobacterium
TPAGRPVAMSGLAQVNRDSVDAI

SEQ ID NO: 331728 - protein, 18 aa, Mycobacterium
TPAHLWVLGGFLVGAIVV

SEQ ID NO: 331729 - protein, 19 aa, Mycobacterium
TPAHRVWLSPLPRAIPLSD

SEQ ID NO: 331730 - protein, 27 aa, Mycobacterium
TPAIATILGRWFWWPLNVRTRPLPPPR

SEQ ID NO: 331731 - protein, 20 aa, Mycobacterium
TPALIRLFTKQGFGHHTRDD

SEQ ID NO: 331732 - protein, 20 aa, Mycobacterium
TPALIRLFTKQGFGHQIRED

SEQ ID NO: 331733 - protein, 20 aa, Mycobacterium
TPALIRLFTRQGFGHHTRDD

SEQ ID NO: 331734 - protein, 20 aa, Mycobacterium
TPALIRLFTRQGFGHHTRED

SEQ ID NO: 331735 - protein, 17 aa, Mycobacterium
TPALPIPYPRTGQGGDP

SEQ ID NO: 331736 - protein, 22 aa, Mycobacterium
TPALRPLVDLLAIAGGSGTMSN

SEQ ID NO: 331737 - protein, 17 aa, Mycobacterium
TPALWIFLGCYVALAAL

SEQ ID NO: 331738 - protein, 18 aa, Mycobacterium
TPAPYGPLFLWIGKGISW

SEQ ID NO: 331739 - protein, 18 aa, Mycobacterium
TPAPYGPLFLWIGRGISA

SEQ ID NO: 331740 - protein, 18 aa, Mycobacterium
TPAPYGPLFLWIGRGISD

SEQ ID NO: 331741 - protein, 19 aa, Mycobacterium
TPAQAVWQLAKAVRAELSD

SEQ ID NO: 331742 - protein, 25 aa, Mycobacterium
TPARGMPGSGLGLAIVKQVVLKHGG

SEQ ID NO: 331743 - protein, 25 aa, Mycobacterium
TPARIRELIKLSGPDIYRDPAPVTR

SEQ ID NO: 331744 - protein, 25 aa, Mycobacterium
TPARIREVIKLSGPDIYRDPAPVTR

SEQ ID NO: 331745 - protein, 33 aa, Mycobacterium
TPAVAALLGRWFWWPQKFRSAASERRLARIGVQ

SEQ ID NO: 331746 - protein, 29 aa, Mycobacterium
TPAVAALLGRWFWWPQRVRQRPARAFHAS

SEQ ID NO: 331747 - protein, 19 aa, Mycobacterium
TPAVLSILVLEDFAMAAYL

SEQ ID NO: 331748 - protein, 28 aa, Mycobacterium
TPDEARSGDRWLWWNLGDVVRRASNVTV

SEQ ID NO: 331749 - protein, 23 aa, Mycobacterium
TPDEMYKYLVAVSRQPDHAKIRA

SEQ ID NO: 331750 - protein, 25 aa, Mycobacterium
TPDRNWAWSTARGWLEVAPGAATAL

SEQ ID NO: 331751 - protein, 25 aa, Mycobacterium
TPDRVDAVLRAKVDGAWNLHQLTRD

SEQ ID NO: 331752 - protein, 25 aa, Mycobacterium
TPDVKEPLSRVALGARVGIAVVVVL

SEQ ID NO: 331753 - protein, 17 aa, Mycobacterium
TPEAGFAIAEREVERSE

SEQ ID NO: 331754 - protein, 18 aa, Mycobacterium
TPEFDRRALYRFVGLVLP

SEQ ID NO: 331755 - protein, 22 aa, Mycobacterium
TPEGRSIVVFAKREFGLRARTP

SEQ ID NO: 331756 - protein, 23 aa, Mycobacterium
TPEGRSVVVFAKEHFGLRARTPG

SEQ ID NO: 331757 - protein, 19 aa, Mycobacterium
TPEMAAAVSKIMRNQDLIA

SEQ ID NO: 331758 - protein, 19 aa, Mycobacterium
TPEWRRRLDDLSYTPVLAP

SEQ ID NO: 331759 - protein, 27 aa, Mycobacterium
TPFPHRWAVMFLVAVGFWNFLGAGIFG

SEQ ID NO: 331760 - protein, 20 aa, Mycobacterium
TPFWRANGFSGQALSDTGPV

SEQ ID NO: 331761 - protein, 18 aa, Mycobacterium
TPFWRINGFTGQSLSDIG

SEQ ID NO: 331762 - protein, 19 aa, Mycobacterium
TPFYPNWFYFLVEVIGAAA

SEQ ID NO: 331763 - protein, 18 aa, Mycobacterium
TPGAAPWERLFAPPPEDS

SEQ ID NO: 331764 - protein, 24 aa, Mycobacterium
TPGPESRSQWFLRQLKALGAAEFP

SEQ ID NO: 331765 - protein, 21 aa, Mycobacterium
TPGRAAVISTFLLLATYALVS

SEQ ID NO: 331766 - protein, 21 aa, Mycobacterium
TPGRMAVLVLGTFAVGVYGGY

SEQ ID NO: 331767 - protein, 23 aa, Mycobacterium
TPGSFWLSFGSFAKMVDVWFAMG

SEQ ID NO: 331768 - protein, 26 aa, Mycobacterium
TPGVMGFGVYLVWPAFYTDVTDSYRL

SEQ ID NO: 331769 - protein, 21 aa, Mycobacterium
TPGWPAPAWSGYTAPAAPRPR

SEQ ID NO: 331770 - protein, 25 aa, Mycobacterium
TPHGPRSVTVLALVPFFSTVIGTVG

SEQ ID NO: 331771 - protein, 31 aa, Mycobacterium
TPHRPRWSRRRMVVVAALAVLLVVAGLTVGW

SEQ ID NO: 331772 - protein, 24 aa, Mycobacterium
TPILDQLRRAYGPEFLDDIFKPLG

SEQ ID NO: 331773 - protein, 18 aa, Mycobacterium
TPIQRLLLELATLVGAEF

SEQ ID NO: 331774 - protein, 19 aa, Mycobacterium
TPIRRGRASFALAGVNDVA

SEQ ID NO: 331775 - protein, 25 aa, Mycobacterium
TPKEPKLSLDRVVEGPYVLPPLDLL

SEQ ID NO: 331776 - protein, 24 aa, Mycobacterium
TPKNIPWPGVWNGSLWTLAFETGC

SEQ ID NO: 331777 - protein, 29 aa, Mycobacterium
TPKPPKTGRRNWGWVIAIILVIAALAAAA

SEQ ID NO: 331778 - protein, 19 aa, Mycobacterium
TPLDQAVEFVRTAMSIYPN

SEQ ID NO: 331779 - protein, 23 aa, Mycobacterium
TPLFPRHGITGLVRLDGATFTYP

SEQ ID NO: 331780 - protein, 23 aa, Mycobacterium
TPLGQGRRAWDWVSGRDKDSSTS

SEQ ID NO: 331781 - protein, 24 aa, Mycobacterium
TPLKAACLRHCYWPLSVSPPCGKY

SEQ ID NO: 331782 - protein, 17 aa, Mycobacterium
TPLKMAAMILGLVLTAA

SEQ ID NO: 331783 - protein, 19 aa, Mycobacterium
TPLLVQAFFIYFGIPATMG

SEQ ID NO: 331784 - protein, 33 aa, Mycobacterium
TPLLVQAFFIYFGIPSALGFQMSALTAGIITLS

SEQ ID NO: 331785 - protein, 20 aa, Mycobacterium
TPLLWPAIALVALLILNAFL

SEQ ID NO: 331786 - protein, 24 aa, Mycobacterium
TPLMRRFGIKRVLLVNGVVSVAWF

SEQ ID NO: 331787 - protein, 24 aa, Mycobacterium
TPLMRRFGIRTVLLVNGAASVACF

SEQ ID NO: 331788 - protein, 17 aa, Mycobacterium
TPLNSILILAGLLTESD

SEQ ID NO: 331789 - protein, 18 aa, Mycobacterium
TPLRGVGVFASYAAGFTL

SEQ ID NO: 331790 - protein, 32 aa, Mycobacterium
TPLSASQWLVCFAVASTVLWVSEIRKLVLRRW

SEQ ID NO: 331791 - protein, 25 aa, Mycobacterium
TPLSFYGIVRMWLRSLLCITPSMLI

SEQ ID NO: 331792 - protein, 29 aa, Mycobacterium
TPLWRAAQGFRLLSCLYALGFHIAITDDL

SEQ ID NO: 331793 - protein, 23 aa, Mycobacterium
TPLYAIAVILSFLASQFTTVVLL

SEQ ID NO: 331794 - protein, 20 aa, Mycobacterium
TPLYAVAVILSFAASNLTTV

SEQ ID NO: 331795 - protein, 25 aa, Mycobacterium
TPMGRTRLMLGFALLPTTLAGSAVV

SEQ ID NO: 331796 - protein, 24 aa, Mycobacterium
TPMLFSVGFLLTFLLGGLTGVMLA

SEQ ID NO: 331797 - protein, 19 aa, Mycobacterium
TPMPFAYAVHLRRALVLYC

SEQ ID NO: 331798 - protein, 22 aa, Mycobacterium
TPMQRRDLLTRVIVAAAKADQE

SEQ ID NO: 331799 - protein, 17 aa, Mycobacterium
TPNAHWHVIGAGLAIVG

SEQ ID NO: 331800 - protein, 25 aa, Mycobacterium
TPPDLKAAVQGVARFSQTLDERDGQ

SEQ ID NO: 331801 - protein, 19 aa, Mycobacterium
TPPEHWDSPLFKKINTVIT

SEQ ID NO: 331802 - protein, 22 aa, Mycobacterium
TPPGRMSIAVFGARTLVGSLQP

SEQ ID NO: 331803 - protein, 18 aa, Mycobacterium
TPPLPLPFPRTGQGGEPH

SEQ ID NO: 331804 - protein, 18 aa, Mycobacterium
TPPLPMPFPRTGQGGEPR

SEQ ID NO: 331805 - protein, 18 aa, Mycobacterium
TPPPLQFPGNGVQVGHRL

SEQ ID NO: 331806 - protein, 24 aa, Mycobacterium
TPPQPGTVYQMWLIDTEGPHSAGT

SEQ ID NO: 331807 - protein, 24 aa, Mycobacterium
TPPSARLGIVAAVVLLVAESMLTI

SEQ ID NO: 331808 - protein, 19 aa, Mycobacterium
TPPSGRRAPSLSGRLRNPW

SEQ ID NO: 331809 - protein, 22 aa, Mycobacterium
TPPVPLPAPRYVDIAREVAATL

SEQ ID NO: 331810 - protein, 18 aa, Mycobacterium
TPPVPRPKYDQHQQQYGQ

SEQ ID NO: 331811 - protein, 24 aa, Mycobacterium
TPPWNFPVAIPAGSTLAALAAGSA

SEQ ID NO: 331812 - protein, 18 aa, Mycobacterium
TPQHRWTLVWSAMARLPY

SEQ ID NO: 331813 - protein, 18 aa, Mycobacterium
TPQLALSIRTWSIVAHVL

SEQ ID NO: 331814 - protein, 25 aa, Mycobacterium
TPQPPRRAAVHGGWEQLLRRLATNV

SEQ ID NO: 331815 - protein, 22 aa, Mycobacterium
TPQRRARSWTKVAAALAAAAVL

SEQ ID NO: 331816 - protein, 21 aa, Mycobacterium
TPQRRGRWRIFAAASTVLALT

SEQ ID NO: 331817 - protein, 17 aa, Mycobacterium
TPQSGYVDVEFTVDKDV

SEQ ID NO: 331818 - protein, 23 aa, Mycobacterium
TPREIKLAATYLLISPLIALTGS

SEQ ID NO: 331819 - protein, 21 aa, Mycobacterium
TPRGFHGVAVFDLTSPAPVPA

SEQ ID NO: 331820 - protein, 18 aa, Mycobacterium
TPRGRFTIPTPYGGPVLP

SEQ ID NO: 331821 - protein, 23 aa, Mycobacterium
TPRGRRGGAVVLYGAVWLAVWTV

SEQ ID NO: 331822 - protein, 19 aa, Mycobacterium
TPRGRYTIPTPYGGPTLPI

SEQ ID NO: 331823 - protein, 20 aa, Mycobacterium
TPRGRYTIPTPYGGPTLPIE

SEQ ID NO: 331824 - protein, 20 aa, Mycobacterium
TPRIGWPNATTYLGPHQGVG

SEQ ID NO: 331825 - protein, 24 aa, Mycobacterium
TPRNVPFPGVWDGVLWTLVFEFLC

SEQ ID NO: 331826 - protein, 21 aa, Mycobacterium
TPRPTATRSRRSWVRRASDAA

SEQ ID NO: 331827 - protein, 28 aa, Mycobacterium
TPRYRRWLHIVGPRHWQWCLIAVGMFQI

SEQ ID NO: 331828 - protein, 19 aa, Mycobacterium
TPSAFPISAKIVPGGVAVD

SEQ ID NO: 331829 - protein, 19 aa, Mycobacterium
TPSAHWPEPALIFEPEPLD

SEQ ID NO: 331830 - protein, 18 aa, Mycobacterium
TPSECRVILLDAAPAVLP

SEQ ID NO: 331831 - protein, 21 aa, Mycobacterium
TPSESVFFWNVIAPAWNNRIE

SEQ ID NO: 331832 - protein, 17 aa, Mycobacterium
TPSHLRTAGAWVGGHIG

SEQ ID NO: 331833 - protein, 28 aa, Mycobacterium
TPSIAAALGRWFWWPLDVYQIVDRTAGR

SEQ ID NO: 331834 - protein, 37 aa, Mycobacterium
TPSIATLLGRWFWWPQRVRERPVPSKWPTPIQRTPEE

SEQ ID NO: 331835 - protein, 26 aa, Mycobacterium
TPSLAALFGKWFWWPMHVRQRPRARP

SEQ ID NO: 331836 - protein, 41 aa, Mycobacterium
TPSLATLLGRWFWWPQHVRPRPASTMLRPYGPRPAVRELLL

SEQ ID NO: 331837 - protein, 17 aa, Mycobacterium
TPSPRPAPSPGASLPRP

SEQ ID NO: 331838 - protein, 29 aa, Mycobacterium
TPSVAALLGRWFWWPQRVRQRPASSMLRP

SEQ ID NO: 331839 - protein, 27 aa, Mycobacterium
TPSVARLLGRWFWWPQRVRPRPASTML

SEQ ID NO: 331840 - protein, 17 aa, Mycobacterium
TPSYAPHWSALRLSLLA

SEQ ID NO: 331841 - protein, 27 aa, Mycobacterium
TPTAPPPRRRWPALAATAVVAAAIGAG

SEQ ID NO: 331842 - protein, 23 aa, Mycobacterium
TPTKWTHHFGVFAGLAGCLGALA

SEQ ID NO: 331843 - protein, 24 aa, Mycobacterium
TPTKWTHHFGVFAGLAGSLGALAA

SEQ ID NO: 331844 - protein, 20 aa, Mycobacterium
TPTKWVHHFGLFAAVGAAMA

SEQ ID NO: 331845 - protein, 19 aa, Mycobacterium
TPTLYRPAGGLSNAAVRQT

SEQ ID NO: 331846 - protein, 19 aa, Mycobacterium
TPTLYRPAGGLSNDAVRRT

SEQ ID NO: 331847 - protein, 17 aa, Mycobacterium
TPTPLVRLAVLRVRTLR

SEQ ID NO: 331848 - protein, 25 aa, Mycobacterium
TPTPQARLGLIGAITAAGLNCHVMV

SEQ ID NO: 331849 - protein, 23 aa, Mycobacterium
TPTPRPAPAYEWHAMSAEQVREV

SEQ ID NO: 331850 - protein, 23 aa, Mycobacterium
TPTRIRLTYWWPGQPDQMIVDGD

SEQ ID NO: 331851 - protein, 20 aa, Mycobacterium
TPTTPIWRLLLPLTAMGAAM

SEQ ID NO: 331852 - protein, 19 aa, Mycobacterium
TPTWRRLLDDLSYEPLVSP

SEQ ID NO: 331853 - protein, 17 aa, Mycobacterium
TPVAWGVLIGFIALYLI

SEQ ID NO: 331854 - protein, 17 aa, Mycobacterium
TPVGIGLGLLAAASAVE

SEQ ID NO: 331855 - protein, 20 aa, Mycobacterium
TPVLGRLGDMYGPKRILIVC

SEQ ID NO: 331856 - protein, 19 aa, Mycobacterium
TPVLGSWRPGIQVPAHLRS

SEQ ID NO: 331857 - protein, 19 aa, Mycobacterium
TPVLGSWRSGIQIPAHLRS

SEQ ID NO: 331858 - protein, 18 aa, Mycobacterium
TPVLGSWRSGIQVPAMLR

SEQ ID NO: 331859 - protein, 24 aa, Mycobacterium
TPVPELRTGGLGVREIKRLAKATG

SEQ ID NO: 331860 - protein, 21 aa, Mycobacterium
TPVPRWLRFVLASDRAGSAWY

SEQ ID NO: 331861 - protein, 18 aa, Mycobacterium
TPVPTYLQNDWFRDWGAL

SEQ ID NO: 331862 - protein, 18 aa, Mycobacterium
TPVRIVATGFGFVVIILL

SEQ ID NO: 331863 - protein, 17 aa, Mycobacterium
TPVVYPRGTVATANAGP

SEQ ID NO: 331864 - protein, 17 aa, Mycobacterium
TPWCAVGLLATPLALRA

SEQ ID NO: 331865 - protein, 24 aa, Mycobacterium
TPWLVRNGEPFFPRDCLADGGDAT

SEQ ID NO: 331866 - protein, 19 aa, Mycobacterium
TPWSEVHTLLLPAYGETWI

SEQ ID NO: 331867 - protein, 25 aa, Mycobacterium
TPYDVGPTPSWRNLRYPRSEIPDDA

SEQ ID NO: 331868 - protein, 17 aa, Mycobacterium
TPYELAETIARRLGLTG

SEQ ID NO: 331869 - protein, 18 aa, Mycobacterium
TQALAHARRARTIMLQNV

SEQ ID NO: 331870 - protein, 17 aa, Mycobacterium
TQAPLGWLYVLCGALVF

SEQ ID NO: 331871 - protein, 19 aa, Mycobacterium
TQASIEWTQHIYIRTPQDA

SEQ ID NO: 331872 - protein, 19 aa, Mycobacterium
TQATLAWQIGYMGTQIDKT

SEQ ID NO: 331873 - protein, 19 aa, Mycobacterium
TQEEFNKAAALFVSPDGRS

SEQ ID NO: 331874 - protein, 19 aa, Mycobacterium
TQGNAWINAVVAIGGVLGA

SEQ ID NO: 331875 - protein, 24 aa, Mycobacterium
TQGSYPLLVVFGLFLGIAGTVFAV

SEQ ID NO: 331876 - protein, 25 aa, Mycobacterium
TQIAALGPDGGWQGSAARAYGARNL

SEQ ID NO: 331877 - protein, 21 aa, Mycobacterium
TQIIAVIAFVFGMFTVAELTL

SEQ ID NO: 331878 - protein, 23 aa, Mycobacterium
TQIITRLVIFFVVAILVGAVVFA

SEQ ID NO: 331879 - protein, 17 aa, Mycobacterium
TQIPAPVILVVATTVAF

SEQ ID NO: 331880 - protein, 19 aa, Mycobacterium
TQIRFPMVAVLGYGGVGDR

SEQ ID NO: 331881 - protein, 24 aa, Mycobacterium
TQKFFKDLRVRGGTVITAVGVTGY

SEQ ID NO: 331882 - protein, 19 aa, Mycobacterium
TQLGIAPPTMRGYVSGAQQ

SEQ ID NO: 331883 - protein, 18 aa, Mycobacterium
TQLGNKWFEEPWKPEVDT

SEQ ID NO: 331884 - protein, 19 aa, Mycobacterium
TQLLRRLDIKIIRISQFRR

SEQ ID NO: 331885 - protein, 33 aa, Mycobacterium
TQLPRLEIGPFPPAEFPGGIRIPSTTLYITTTL

SEQ ID NO: 331886 - protein, 24 aa, Mycobacterium
TQLRQPGSWWLLAGAVFAILAAII

SEQ ID NO: 331887 - protein, 33 aa, Mycobacterium
TQLVRPPFAWREFIHQAWFVARVSIAPTILLSI

SEQ ID NO: 331888 - protein, 18 aa, Mycobacterium
TQNGLPFLARLVYGRRVV

SEQ ID NO: 331889 - protein, 18 aa, Mycobacterium
TQPMPGPLSWFFHHLPKP

SEQ ID NO: 331890 - protein, 22 aa, Mycobacterium
TQQDVWRFVAYLSDAGNADDLA

SEQ ID NO: 331891 - protein, 22 aa, Mycobacterium
TQQYLIDWERSALVNGLLPAQF

SEQ ID NO: 331892 - protein, 24 aa, Mycobacterium
TQRFLRDHPEVWAGGHGQRRAVAG

SEQ ID NO: 331893 - protein, 34 aa, Mycobacterium
TQRIRGWRKVGALVVRWPGPILVLTIGVALVGLL

SEQ ID NO: 331894 - protein, 27 aa, Mycobacterium
TQRLGKPYMWWAAALVPLYWMLQSIAA

SEQ ID NO: 331895 - protein, 40 aa, Mycobacterium
TQRLSWRLLTLGSWATSCAWAFSLAMIDGWQQGFAGRLTT

SEQ ID NO: 331896 - protein, 26 aa, Mycobacterium
TQSLRLWERHGLLAPSRTEGGTRRYS

SEQ ID NO: 331897 - protein, 18 aa, Mycobacterium
TQSRAVAMGAVLLVTGLA

SEQ ID NO: 331898 - protein, 24 aa, Mycobacterium
TQSRQALKIQRWRSKVRNHTVVIG

SEQ ID NO: 331899 - protein, 24 aa, Mycobacterium
TQSRQVYQIQRWRSRLRNHIIIVG

SEQ ID NO: 331900 - protein, 23 aa, Mycobacterium
TQTARMDLSFSLAEHRTRDGEPA

SEQ ID NO: 331901 - protein, 26 aa, Mycobacterium
TQTPLSFIFYWVVPFALLGVAALLTR

SEQ ID NO: 331902 - protein, 23 aa, Mycobacterium
TQTRSGRTLDIFGQACVNVLQLN

SEQ ID NO: 331903 - protein, 24 aa, Mycobacterium
TQTSVAAGLAWYLTHDVLHHRQPF

SEQ ID NO: 331904 - protein, 17 aa, Mycobacterium
TQVGFKMTKWINQIEFV

SEQ ID NO: 331905 - protein, 25 aa, Mycobacterium
TQVIIRFWLLTAIACGLGVALFYGE

SEQ ID NO: 331906 - protein, 23 aa, Mycobacterium
TQVRRASLIASRTGADLKVVHVV

SEQ ID NO: 331907 - protein, 18 aa, Mycobacterium
TQVRYAGFAISYNLSTAA

SEQ ID NO: 331908 - protein, 18 aa, Mycobacterium
TQVSGLWAQGRYAEAQAA

SEQ ID NO: 331909 - protein, 19 aa, Mycobacterium
TQVVIAWFGYRLIAAFERW

SEQ ID NO: 331910 - protein, 25 aa, Mycobacterium
TQYAPRRFAMPLAHLVDLLAAVPSI

SEQ ID NO: 331911 - protein, 26 aa, Mycobacterium
TRAAEPILPMRLFRSPVFTVCCVLSF

SEQ ID NO: 331912 - protein, 20 aa, Mycobacterium
TRAALTASRARIVTAADQAR

SEQ ID NO: 331913 - protein, 21 aa, Mycobacterium
TRADPFLARTLAPEVDRAVAL

SEQ ID NO: 331914 - protein, 18 aa, Mycobacterium
TRAGEVVGSMAYLSPERL

SEQ ID NO: 331915 - protein, 23 aa, Mycobacterium
TRAGFLMLLWLFIWSVLRILRTD

SEQ ID NO: 331916 - protein, 22 aa, Mycobacterium
TRAGFLMLLWLFIWSVLRVLRT

SEQ ID NO: 331917 - protein, 23 aa, Mycobacterium
TRAGFLMLLWVFIWSVLRILRTD

SEQ ID NO: 331918 - protein, 27 aa, Mycobacterium
TRAMYRPATILGCWVVLVATVGLFFTG

SEQ ID NO: 331919 - protein, 20 aa, Mycobacterium
TRAQRLCRPVFWYLACWVTA

SEQ ID NO: 331920 - protein, 20 aa, Mycobacterium
TRARAVICVGDDDATNLEIA

SEQ ID NO: 331921 - protein, 22 aa, Mycobacterium
TRARVPRRVAVIAGATVLVAAL

SEQ ID NO: 331922 - protein, 17 aa, Mycobacterium
TRAVFGLTAEEAEATRM

SEQ ID NO: 331923 - protein, 17 aa, Mycobacterium
TRAVLRPLLAFVAARQL

SEQ ID NO: 331924 - protein, 20 aa, Mycobacterium
TRAYLGAKITVFCMFAITQA

SEQ ID NO: 331925 - protein, 18 aa, Mycobacterium
TRCEVRDGVFQVRRKGTD

SEQ ID NO: 331926 - protein, 19 aa, Mycobacterium
TRDAVAYGVSTSARTITSA

SEQ ID NO: 331927 - protein, 19 aa, Mycobacterium
TRDEYRYTESLVYPALGAG

SEQ ID NO: 331928 - protein, 19 aa, Mycobacterium
TRDEYRYTESLVYPALGDG

SEQ ID NO: 331929 - protein, 19 aa, Mycobacterium
TRDEYRYTESLVYPAVGKG

SEQ ID NO: 331930 - protein, 33 aa, Mycobacterium
TRDFKGSAIRLARRLLPQRALTLAVILLGVGGI

SEQ ID NO: 331931 - protein, 17 aa, Mycobacterium
TRDGFPQVYSISTAQVS

SEQ ID NO: 331932 - protein, 20 aa, Mycobacterium
TRDLPAMWRYAGMAASALVA

SEQ ID NO: 331933 - protein, 24 aa, Mycobacterium
TRDTWKIAPPFAAMIAISRLFGFL

SEQ ID NO: 331934 - protein, 17 aa, Mycobacterium
TREAGGIVSAATYRLKR

SEQ ID NO: 331935 - protein, 17 aa, Mycobacterium
TREALAFDPPREPAIET

SEQ ID NO: 331936 - protein, 19 aa, Mycobacterium
TRFADIRKLLAPAGVLATL

SEQ ID NO: 331937 - protein, 26 aa, Mycobacterium
TRFKRKEHWLDVHFAHGSSSVLMPGN

SEQ ID NO: 331938 - protein, 24 aa, Mycobacterium
TRFKRKEHWLDVHFSGDGSVIMPG

SEQ ID NO: 331939 - protein, 24 aa, Mycobacterium
TRFKRKPHWLDVNFTGDSSSVMPG

SEQ ID NO: 331940 - protein, 17 aa, Mycobacterium
TRFLIWNLFLAWLPVFA

SEQ ID NO: 331941 - protein, 26 aa, Mycobacterium
TRGAGWRRDAGWARRLAWISLAALLV

SEQ ID NO: 331942 - protein, 30 aa, Mycobacterium
TRGAVGLGVESARSSASWAGDRYRRSKVAR

SEQ ID NO: 331943 - protein, 23 aa, Mycobacterium
TRGGFLLLLWVFIWSVLRILRTD

SEQ ID NO: 331944 - protein, 22 aa, Mycobacterium
TRGGGWAAIVGVGIFLGVAALF

SEQ ID NO: 331945 - protein, 18 aa, Mycobacterium
TRGGWYVRQLLGAANIEG

SEQ ID NO: 331946 - protein, 18 aa, Mycobacterium
TRGGWYVRQLVGAANIEG

SEQ ID NO: 331947 - protein, 24 aa, Mycobacterium
TRGSSDYRRLLAALFCAGVATFAQ

SEQ ID NO: 331948 - protein, 21 aa, Mycobacterium
TRGTVHLVIGCGGRSLTSNQL

SEQ ID NO: 331949 - protein, 20 aa, Mycobacterium
TRGVAFAVLGTVFALRAVGD

SEQ ID NO: 331950 - protein, 20 aa, Mycobacterium
TRGVNRWELIACAVSGHATY

SEQ ID NO: 331951 - protein, 29 aa, Mycobacterium
TRGWRRMGTAVVRWPAPVLAVTIAVALVG

SEQ ID NO: 331952 - protein, 32 aa, Mycobacterium
TRGWRRVGTAIVRWPGPILAVSIAIALIGLLA

SEQ ID NO: 331953 - protein, 33 aa, Mycobacterium
TRGWRRVGTAIVRWPGPILAVSIAIALIGLLAL

SEQ ID NO: 331954 - protein, 33 aa, Mycobacterium
TRGWRRVGTAIVRWPGPILAVSVAIALIGLLAL

SEQ ID NO: 331955 - protein, 17 aa, Mycobacterium
TRHGFRVVTYLKMGCPL

SEQ ID NO: 331956 - protein, 25 aa, Mycobacterium
TRHIIRLALFAAFLLGLFYLVAVAR

SEQ ID NO: 331957 - protein, 22 aa, Mycobacterium
TRHPSFARRDLSSMRRGNLYSI

SEQ ID NO: 331958 - protein, 17 aa, Mycobacterium
TRHRWMRVVSVTLAALG

SEQ ID NO: 331959 - protein, 17 aa, Mycobacterium
TRIAFQISIGLSHGSSI

SEQ ID NO: 331960 - protein, 27 aa, Mycobacterium
TRIDRLRAALPYDLPASLVVFLVALPL

SEQ ID NO: 331961 - protein, 22 aa, Mycobacterium
TRIECPEGTVGEIWAHGDNVST

SEQ ID NO: 331962 - protein, 18 aa, Mycobacterium
TRIELAIVVLLFVILLVI

SEQ ID NO: 331963 - protein, 21 aa, Mycobacterium
TRKPVHWQLVLAFAIPALVGA

SEQ ID NO: 331964 - protein, 23 aa, Mycobacterium
TRKRVRKPAWPDIPITNDDYESL

SEQ ID NO: 331965 - protein, 17 aa, Mycobacterium
TRLALFLIVGTLVAAVV

SEQ ID NO: 331966 - protein, 17 aa, Mycobacterium
TRLAPRVLILCGGVVVF

SEQ ID NO: 331967 - protein, 17 aa, Mycobacterium
TRLATRVGFPSMLLFLL

SEQ ID NO: 331968 - protein, 20 aa, Mycobacterium
TRLDVIGVLTLGMMTALGGG

SEQ ID NO: 331969 - protein, 22 aa, Mycobacterium
TRLFELPGALFVVVAVTVAGAL

SEQ ID NO: 331970 - protein, 19 aa, Mycobacterium
TRLLAGVIVVVPLYCVALL

SEQ ID NO: 331971 - protein, 20 aa, Mycobacterium
TRLLGVGLWAQIAGVAGAVV

SEQ ID NO: 331972 - protein, 21 aa, Mycobacterium
TRLLLMTQIKPGSVVLFHDTY

SEQ ID NO: 331973 - protein, 18 aa, Mycobacterium
TRLPAGVMVSHRNLHVNF

SEQ ID NO: 331974 - protein, 24 aa, Mycobacterium
TRLPDLKVFICGGASVSPSLIRRA

SEQ ID NO: 331975 - protein, 17 aa, Mycobacterium
TRLPELIAGAAIVETVF

SEQ ID NO: 331976 - protein, 17 aa, Mycobacterium
TRLPGKYTHAAAVDKVR

SEQ ID NO: 331977 - protein, 17 aa, Mycobacterium
TRLPLIMQNIHRYFFYA

SEQ ID NO: 331978 - protein, 28 aa, Mycobacterium
TRLPRLPVTIAAGITFFDYQPWLRRRLE

SEQ ID NO: 331979 - protein, 19 aa, Mycobacterium
TRLPWRPPPVQARETDPRP

SEQ ID NO: 331980 - protein, 19 aa, Mycobacterium
TRLPWRRLPAEGAEMPAGP

SEQ ID NO: 331981 - protein, 29 aa, Mycobacterium
TRLQDGIVWELRLPRVLLAAACGSGLALC

SEQ ID NO: 331982 - protein, 17 aa, Mycobacterium
TRLQFWLADIRPQVSCS

SEQ ID NO: 331983 - protein, 21 aa, Mycobacterium
TRLRKDLTWLDLVVFGVAVVI

SEQ ID NO: 331984 - protein, 19 aa, Mycobacterium
TRLRQPLIVAFIVVGIAVG

SEQ ID NO: 331985 - protein, 17 aa, Mycobacterium
TRLRRALQIQHRVVADV

SEQ ID NO: 331986 - protein, 27 aa, Mycobacterium
TRLSRLWFEALAGICAHVRGGGGGLTP

SEQ ID NO: 331987 - protein, 20 aa, Mycobacterium
TRLSSWRLLALNPVTLISAL

SEQ ID NO: 331988 - protein, 23 aa, Mycobacterium
TRLTLITLIPIVAFMTVGGPAMG

SEQ ID NO: 331989 - protein, 22 aa, Mycobacterium
TRLTLVTLIPIVAFMTVGGPAI

SEQ ID NO: 331990 - protein, 27 aa, Mycobacterium
TRLTMLTLIPIVALMTVGGPAIGSALF

SEQ ID NO: 331991 - protein, 20 aa, Mycobacterium
TRLVEDLLLLARLDSGRPLE

SEQ ID NO: 331992 - protein, 23 aa, Mycobacterium
TRLVLRLPGPQPYEGTKMEYGFK

SEQ ID NO: 331993 - protein, 21 aa, Mycobacterium
TRLVWPVVVLILITGLAALGS

SEQ ID NO: 331994 - protein, 27 aa, Mycobacterium
TRLWAWFLTFLRLCVAGQMLFYGIAKL

SEQ ID NO: 331995 - protein, 24 aa, Mycobacterium
TRLYLDGGLQFSTRDEYRYTESLV

SEQ ID NO: 331996 - protein, 25 aa, Mycobacterium
TRMRGRSRLLLGMVRVNRPWRLLPS

SEQ ID NO: 331997 - protein, 18 aa, Mycobacterium
TRNASGLGGRDVLLAVAT

SEQ ID NO: 331998 - protein, 17 aa, Mycobacterium
TRNAWQIVVGILVLLVY

SEQ ID NO: 331999 - protein, 18 aa, Mycobacterium
TRNAWWVRHYTFTGSAVG

SEQ ID NO: 332000 - protein, 21 aa, Mycobacterium
TRPAAKFPGGMQAWGMQTDST

SEQ ID NO: 332001 - protein, 21 aa, Mycobacterium
TRPASQLLRPYGPRSAVRAYL

SEQ ID NO: 332002 - protein, 22 aa, Mycobacterium
TRPASYMLRPFGPRRLVRSLLL

SEQ ID NO: 332003 - protein, 45 aa, Mycobacterium
TRPDALPAPRRLISSFGHWIRRCLSRWRSIVLMLLLISTIGSAAG

SEQ ID NO: 332004 - protein, 18 aa, Mycobacterium
TRPGTARPVVTTKLPPFA

SEQ ID NO: 332005 - protein, 21 aa, Mycobacterium
TRPIDEISLGAAINYAVNVKN

SEQ ID NO: 332006 - protein, 21 aa, Mycobacterium
TRPITVLAMDAVPRISRAQSL

SEQ ID NO: 332007 - protein, 19 aa, Mycobacterium
TRPLAGLATIAFVGLIVAI

SEQ ID NO: 332008 - protein, 21 aa, Mycobacterium
TRPNAQWSVQRRLRREILRAY

SEQ ID NO: 332009 - protein, 20 aa, Mycobacterium
TRPSTFLWLIATTGTLLVVG

SEQ ID NO: 332010 - protein, 20 aa, Mycobacterium
TRPSTFLWLIVLAGTLLTVT

SEQ ID NO: 332011 - protein, 17 aa, Mycobacterium
TRPTTRLSTQRAGRPKA

SEQ ID NO: 332012 - protein, 20 aa, Mycobacterium
TRPYRVIAGLVLSFCLVTLT

SEQ ID NO: 332013 - protein, 18 aa, Mycobacterium
TRRAELDSIFALLSNNTA

SEQ ID NO: 332014 - protein, 27 aa, Mycobacterium
TRRAKVFRRIRIGIIVLACLVTLQSVL

SEQ ID NO: 332015 - protein, 22 aa, Mycobacterium
TRRALAGLQAWLARPDTSGTAL

SEQ ID NO: 332016 - protein, 20 aa, Mycobacterium
TRRALPFSVAGGALVGLLSV

SEQ ID NO: 332017 - protein, 18 aa, Mycobacterium
TRRELPGLLAHSLIPIVL

SEQ ID NO: 332018 - protein, 31 aa, Mycobacterium
TRRFAVLVLLLCLFGSLVVLLRRGWVGGLAR

SEQ ID NO: 332019 - protein, 24 aa, Mycobacterium
TRRIRLRLIISCALVLIPWTVFLG

SEQ ID NO: 332020 - protein, 23 aa, Mycobacterium
TRRLRRVALVAGIALVVLVVLVV

SEQ ID NO: 332021 - protein, 21 aa, Mycobacterium
TRRLSDLGMFVFRSYGSTEHP

SEQ ID NO: 332022 - protein, 17 aa, Mycobacterium
TRRPTRLGNGWVATICA

SEQ ID NO: 332023 - protein, 19 aa, Mycobacterium
TRRRLFGDLAHEIRTPVAV

SEQ ID NO: 332024 - protein, 24 aa, Mycobacterium
TRRRRPRFRVSIQSKLMVLLLLSS

SEQ ID NO: 332025 - protein, 26 aa, Mycobacterium
TRRRVTRWEWMWAALLAGAVAVIVTV

SEQ ID NO: 332026 - protein, 27 aa, Mycobacterium
TRRRVTRWEWTWAVLLAVSLAVVVIVG

SEQ ID NO: 332027 - protein, 20 aa, Mycobacterium
TRRWLMLAIGLLTTLCANVF

SEQ ID NO: 332028 - protein, 28 aa, Mycobacterium
TRRWRRIGTAVVRWPGAVLAAALAVSLV

SEQ ID NO: 332029 - protein, 28 aa, Mycobacterium
TRRWRRVGTAIVRWPGPILAATVAVALI

SEQ ID NO: 332030 - protein, 28 aa, Mycobacterium
TRRWRRVGTAIVRWPGPVLAATCLVASI

SEQ ID NO: 332031 - protein, 27 aa, Mycobacterium
TRRWRRVGTAIVRWPGPVLAATCVIAF

SEQ ID NO: 332032 - protein, 25 aa, Mycobacterium
TRSDRILPGLLWRRDTIGAAVAASQ

SEQ ID NO: 332033 - protein, 24 aa, Mycobacterium
TRSGLLRFAMRLDAMLVGITGIPF

SEQ ID NO: 332034 - protein, 26 aa, Mycobacterium
TRSGSWSVLVTRWRLIGKCLRPLPDK

SEQ ID NO: 332035 - protein, 19 aa, Mycobacterium
TRSLLAPDCRSAQQKLTGM

SEQ ID NO: 332036 - protein, 20 aa, Mycobacterium
TRSNWLVMFLVMLALTLIAG

SEQ ID NO: 332037 - protein, 20 aa, Mycobacterium
TRSQITFGVLGVALCALLGL

SEQ ID NO: 332038 - protein, 23 aa, Mycobacterium
TRSRTWRSWWSRWSRCSPSESRP

SEQ ID NO: 332039 - protein, 20 aa, Mycobacterium
TRSRVRYGVLGRDGAQLALS

SEQ ID NO: 332040 - protein, 20 aa, Mycobacterium
TRSSNWRRAVLLAAAVGVMF

SEQ ID NO: 332041 - protein, 18 aa, Mycobacterium
TRSTCISLSPARRNIIFM

SEQ ID NO: 332042 - protein, 26 aa, Mycobacterium
TRSTLRFLWLRLARVWPVYLVTMHLA

SEQ ID NO: 332043 - protein, 30 aa, Mycobacterium
TRSVMRPGHHFPRRGAIDVVIGMPIRPAGR

SEQ ID NO: 332044 - protein, 21 aa, Mycobacterium
TRTAGWAVFFALIALLVVAGF

SEQ ID NO: 332045 - protein, 19 aa, Mycobacterium
TRTAIFAVLLVAFGIKAAV

SEQ ID NO: 332046 - protein, 31 aa, Mycobacterium
TRTALEATWKYVVICSVGIAVAFLGTVLLYF

SEQ ID NO: 332047 - protein, 20 aa, Mycobacterium
TRTAQKFIIMGAFVAVFAIM

SEQ ID NO: 332048 - protein, 27 aa, Mycobacterium
TRTGGQVVFQRGFQLPALPPGTATVEV

SEQ ID NO: 332049 - protein, 21 aa, Mycobacterium
TRTGISLAIVSLVGVVSYFLV

SEQ ID NO: 332050 - protein, 20 aa, Mycobacterium
TRTPAPVLQVWNDRLAGRDQ

SEQ ID NO: 332051 - protein, 21 aa, Mycobacterium
TRTPIVAAFRRHWRQILLVAG

SEQ ID NO: 332052 - protein, 21 aa, Mycobacterium
TRTRAAATWTGVILGLLILIL

SEQ ID NO: 332053 - protein, 20 aa, Mycobacterium
TRTVWEIVVGVVVFFIYGGI

SEQ ID NO: 332054 - protein, 18 aa, Mycobacterium
TRVALIVGAAWLLVLVGA

SEQ ID NO: 332055 - protein, 19 aa, Mycobacterium
TRVAPLTARERPARVPLSF

SEQ ID NO: 332056 - protein, 18 aa, Mycobacterium
TRVARFMLSDGLGNLGGP

SEQ ID NO: 332057 - protein, 19 aa, Mycobacterium
TRVFHWLTAILVFAALFIG

SEQ ID NO: 332058 - protein, 20 aa, Mycobacterium
TRVGEIAARFGGDEFLVVAF

SEQ ID NO: 332059 - protein, 25 aa, Mycobacterium
TRVNPNVYIPWSITVTPISNSEIGS

SEQ ID NO: 332060 - protein, 34 aa, Mycobacterium
TRVRAARCFGASEGVIFFRIVLPSAVPYIAAGVR

SEQ ID NO: 332061 - protein, 17 aa, Mycobacterium
TRVRHWFASPRTWRLLD

SEQ ID NO: 332062 - protein, 19 aa, Mycobacterium
TRWEVVRTTVLPFGLSGYI

SEQ ID NO: 332063 - protein, 24 aa, Mycobacterium
TRWFSMEYDQWFGMTLPAVEAAGC

SEQ ID NO: 332064 - protein, 22 aa, Mycobacterium
TRWLRVGADGPAWAADFDALVD

SEQ ID NO: 332065 - protein, 20 aa, Mycobacterium
TRWRTVTAVDGVVVGGMAIW

SEQ ID NO: 332066 - protein, 24 aa, Mycobacterium
TRYGPMSVRLLFLVFGVGLIADAL

SEQ ID NO: 332067 - protein, 24 aa, Mycobacterium
TRYYPTWLPSRRFIAAVIAIGGMQ

SEQ ID NO: 332068 - protein, 18 aa, Mycobacterium
TSAGVQWFAGVVLLIVGP

SEQ ID NO: 332069 - protein, 24 aa, Mycobacterium
TSAHKWSLFLPLISGRVGNVKGSA

SEQ ID NO: 332070 - protein, 17 aa, Mycobacterium
TSAHSLGSYGFAVGMLA

SEQ ID NO: 332071 - protein, 17 aa, Mycobacterium
TSALRHRTFLAALMSNF

SEQ ID NO: 332072 - protein, 17 aa, Mycobacterium
TSALYVRVGEQLHPVLN

SEQ ID NO: 332073 - protein, 23 aa, Mycobacterium
TSCLSLARLPYFRTLGIPCAVGM

SEQ ID NO: 332074 - protein, 20 aa, Mycobacterium
TSDGRFGWQGIVPSRAEKMA

SEQ ID NO: 332075 - protein, 17 aa, Mycobacterium
TSDGVLAEVRWQDGSAV

SEQ ID NO: 332076 - protein, 22 aa, Mycobacterium
TSDMGWPTRVWVSNLNGLGGLF

SEQ ID NO: 332077 - protein, 25 aa, Mycobacterium
TSDQPRPLVPAMFSGVLSRLRRTHT

SEQ ID NO: 332078 - protein, 29 aa, Mycobacterium
TSDSVMGIVGWRALWGLGNALFIATALAT

SEQ ID NO: 332079 - protein, 22 aa, Mycobacterium
TSEQRKATTILREGEDAVQRAE

SEQ ID NO: 332080 - protein, 24 aa, Mycobacterium
TSFPARIGMMTGIYTAALQGGGAL

SEQ ID NO: 332081 - protein, 21 aa, Mycobacterium
TSFPLQVPWLPLVAPVAVVAI

SEQ ID NO: 332082 - protein, 18 aa, Mycobacterium
TSFQRWSDRLAEHARHPD

SEQ ID NO: 332083 - protein, 30 aa, Mycobacterium
TSFRELRWNLRIVIMFSIGLVIATAVAVSW

SEQ ID NO: 332084 - protein, 24 aa, Mycobacterium
TSFRIGSFSTTYGVVAMLLVYAVV

SEQ ID NO: 332085 - protein, 21 aa, Mycobacterium
TSGAALVMWMGELVTERGIGN

SEQ ID NO: 332086 - protein, 20 aa, Mycobacterium
TSGACLIDGEPIREHVGAVA

SEQ ID NO: 332087 - protein, 17 aa, Mycobacterium
TSGFISKFAVFRAAAQG

SEQ ID NO: 332088 - protein, 17 aa, Mycobacterium
TSGGLPMLRMMGGSPDA

SEQ ID NO: 332089 - protein, 18 aa, Mycobacterium
TSGGMPMLRMMGGSPDGG

SEQ ID NO: 332090 - protein, 18 aa, Mycobacterium
TSGGMPMLRMMGGSPEAE

SEQ ID NO: 332091 - protein, 17 aa, Mycobacterium
TSGGRLLQAASFGLSHI

SEQ ID NO: 332092 - protein, 23 aa, Mycobacterium
TSGLPAFWHVAAWWNQPIVYQKV

SEQ ID NO: 332093 - protein, 27 aa, Mycobacterium
TSGLSIRGIGSWIVATVVVWVATAVAT

SEQ ID NO: 332094 - protein, 20 aa, Mycobacterium
TSGPMVLFSAVFAFAIRALN

SEQ ID NO: 332095 - protein, 19 aa, Mycobacterium
TSGSIDWFGAVGLAVGLSA

SEQ ID NO: 332096 - protein, 27 aa, Mycobacterium
TSGTALVVLTCRAVAISPYDRAPDLAQ

SEQ ID NO: 332097 - protein, 19 aa, Mycobacterium
TSGTWLFDMAMLGVLSVFY

SEQ ID NO: 332098 - protein, 19 aa, Mycobacterium
TSHGYPFALAVTIVPVLTM

SEQ ID NO: 332099 - protein, 17 aa, Mycobacterium
TSHLFGWPLASYLQPVG

SEQ ID NO: 332100 - protein, 17 aa, Mycobacterium
TSHPSYALLLLLTAPIP

SEQ ID NO: 332101 - protein, 23 aa, Mycobacterium
TSHVLPGVLTPVGQDQNILLMGL

SEQ ID NO: 332102 - protein, 19 aa, Mycobacterium
TSIAEWKGVHLGRLVELVR

SEQ ID NO: 332103 - protein, 24 aa, Mycobacterium
TSIAFAVGVIRLGRRQCLVQELPA

SEQ ID NO: 332104 - protein, 23 aa, Mycobacterium
TSIAFAVGVVRLGRRQCLVNELP

SEQ ID NO: 332105 - protein, 17 aa, Mycobacterium
TSIPFIISMQGVSNTEN

SEQ ID NO: 332106 - protein, 21 aa, Mycobacterium
TSIPVPFALVLTSLLGASLLA

SEQ ID NO: 332107 - protein, 20 aa, Mycobacterium
TSKRRALVRLALVVAVLAVL

SEQ ID NO: 332108 - protein, 20 aa, Mycobacterium
TSLALNWLVGPAVMFALAWL

SEQ ID NO: 332109 - protein, 23 aa, Mycobacterium
TSLAVDMGEGFGMPNSVSPDKLL

SEQ ID NO: 332110 - protein, 23 aa, Mycobacterium
TSLGLRTAVEFATRTAPGRAGLL

SEQ ID NO: 332111 - protein, 23 aa, Mycobacterium
TSLLTALVYVHFHMETHGALMPI

SEQ ID NO: 332112 - protein, 26 aa, Mycobacterium
TSLPAFRYAAAIAYIGLLCTWLLVAV

SEQ ID NO: 332113 - protein, 18 aa, Mycobacterium
TSLVPLLLSQIGGLAAGV

SEQ ID NO: 332114 - protein, 30 aa, Mycobacterium
TSLWGNCTIKVMVGFLFLYPAFVAKAHDAD

SEQ ID NO: 332115 - protein, 30 aa, Mycobacterium
TSLWGNCTIKVMVGFLFLYPAFVAKAHDAN

SEQ ID NO: 332116 - protein, 30 aa, Mycobacterium
TSLWGNCTIKVMVGFLFLYPAFVAKAHDAS

SEQ ID NO: 332117 - protein, 30 aa, Mycobacterium
TSLWGNCTIKVMVGFLFLYPAFVAKAHQAS

SEQ ID NO: 332118 - protein, 30 aa, Mycobacterium
TSLWGNCTVKVMVGFLFLYPAFVAKAHDAS

SEQ ID NO: 332119 - protein, 18 aa, Mycobacterium
TSMLCRMAIRLLDAGNVQ

SEQ ID NO: 332120 - protein, 18 aa, Mycobacterium
TSMTMVWLAVLLYVKIDE

SEQ ID NO: 332121 - protein, 28 aa, Mycobacterium
TSNEMIAWVCIAASLVGVILLIVDAIRD

SEQ ID NO: 332122 - protein, 24 aa, Mycobacterium
TSNEVLAFVCIAAAAVGVVLMIID

SEQ ID NO: 332123 - protein, 23 aa, Mycobacterium
TSNVLVAWVCIGASVLGVILLIV

SEQ ID NO: 332124 - protein, 27 aa, Mycobacterium
TSPAPRPAPKLKPVRVARRRPHRRLVA

SEQ ID NO: 332125 - protein, 24 aa, Mycobacterium
TSPDPECRAAIELYGPHQRSGGAL

SEQ ID NO: 332126 - protein, 18 aa, Mycobacterium
TSPDYNRDRLFVIENGKR

SEQ ID NO: 332127 - protein, 19 aa, Mycobacterium
TSPEIAASCALRTTDRPPA

SEQ ID NO: 332128 - protein, 24 aa, Mycobacterium
TSPELKTALGQQNWQKLPELQSSP

SEQ ID NO: 332129 - protein, 24 aa, Mycobacterium
TSPHSSWLVVRWVVASALGGPLLM

SEQ ID NO: 332130 - protein, 20 aa, Mycobacterium
TSPHWVWIAGFAATLVSGCL

SEQ ID NO: 332131 - protein, 23 aa, Mycobacterium
TSPNQRRGVVLGVAAGILVAALL

SEQ ID NO: 332132 - protein, 28 aa, Mycobacterium
TSPPAPRWAWPTLVTVGLIGLIVMVFRF

SEQ ID NO: 332133 - protein, 25 aa, Mycobacterium
TSPYSSWLVVRWVIASALGGPLLIA

SEQ ID NO: 332134 - protein, 24 aa, Mycobacterium
TSPYSSWLVVRWVVASALGGPLLI

SEQ ID NO: 332135 - protein, 23 aa, Mycobacterium
TSRFGIRRPYLVGGTLVGALGLT

SEQ ID NO: 332136 - protein, 22 aa, Mycobacterium
TSRGRGAVVGALLCVAGVAILA

SEQ ID NO: 332137 - protein, 23 aa, Mycobacterium
TSRGTGFWGPPFRVFAPSEITLL

SEQ ID NO: 332138 - protein, 22 aa, Mycobacterium
TSRLRAASRQSLAALVEKFDSV

SEQ ID NO: 332139 - protein, 22 aa, Mycobacterium
TSRPRAVLRAGAATAGMSLGFL

SEQ ID NO: 332140 - protein, 17 aa, Mycobacterium
TSRRSRWARVLDEGIGA

SEQ ID NO: 332141 - protein, 17 aa, Mycobacterium
TSRRTRWARLFEEGIGQ

SEQ ID NO: 332142 - protein, 23 aa, Mycobacterium
TSSGVLLLWSWLAMSLAQGYYSM

SEQ ID NO: 332143 - protein, 23 aa, Mycobacterium
TSSGVLLLWSWLVMSLAQGYYSM

SEQ ID NO: 332144 - protein, 19 aa, Mycobacterium
TSSSVRWVVVDGAAGEESR

SEQ ID NO: 332145 - protein, 24 aa, Mycobacterium
TSTAWWVCGGFGVLSVLYLGYLRR

SEQ ID NO: 332146 - protein, 25 aa, Mycobacterium
TSTPPPAGPLFPSEPTTTVIDPDGP

SEQ ID NO: 332147 - protein, 19 aa, Mycobacterium
TSTPPRWSPTAPYPTIPGL

SEQ ID NO: 332148 - protein, 25 aa, Mycobacterium
TSTPRLGALPLWTWLATLLVLMTIT

SEQ ID NO: 332149 - protein, 20 aa, Mycobacterium
TSTYKAEFSNVTGLEQNDFV

SEQ ID NO: 332150 - protein, 20 aa, Mycobacterium
TSVACPWPYPEAKVYDPQGF

SEQ ID NO: 332151 - protein, 17 aa, Mycobacterium
TSVAGLGMFNLISLGAG

SEQ ID NO: 332152 - protein, 20 aa, Mycobacterium
TSVAVLVFFARHADLASGRV

SEQ ID NO: 332153 - protein, 25 aa, Mycobacterium
TSVEASDFWEVLTRGQVTRTAAIVY

SEQ ID NO: 332154 - protein, 24 aa, Mycobacterium
TSVPMLFAKPSYYGQFTDSGGINT

SEQ ID NO: 332155 - protein, 18 aa, Mycobacterium
TSVVIGLMLQNSVGQIVS

SEQ ID NO: 332156 - protein, 17 aa, Mycobacterium
TSWAGFRGAVSLAAALA

SEQ ID NO: 332157 - protein, 23 aa, Mycobacterium
TSWRAVQALPQFRRLLELRAVSQ

SEQ ID NO: 332158 - protein, 17 aa, Mycobacterium
TTAALYCVAYGVAGALI

SEQ ID NO: 332159 - protein, 23 aa, Mycobacterium
TTAASAFARYVHKPEQLAKLAKA

SEQ ID NO: 332160 - protein, 17 aa, Mycobacterium
TTAAWKTLALFGYAALF

SEQ ID NO: 332161 - protein, 17 aa, Mycobacterium
TTAERIVICSGFTQGLR

SEQ ID NO: 332162 - protein, 17 aa, Mycobacterium
TTAGWKTLALLGYAAIY

SEQ ID NO: 332163 - protein, 26 aa, Mycobacterium
TTAHIRTGTLLGERVLALDSEGSGTL

SEQ ID NO: 332164 - protein, 28 aa, Mycobacterium
TTAILTFFFCWNDFLFAISLTSTDSART

SEQ ID NO: 332165 - protein, 24 aa, Mycobacterium
TTAITVLTCWIVFGTALVAAAAVR

SEQ ID NO: 332166 - protein, 17 aa, Mycobacterium
TTAKWLALFSFWLVCLY

SEQ ID NO: 332167 - protein, 22 aa, Mycobacterium
TTALRLVRRCVAGNPRLSAAVT

SEQ ID NO: 332168 - protein, 18 aa, Mycobacterium
TTALTLLFFEVFPHFPVG

SEQ ID NO: 332169 - protein, 22 aa, Mycobacterium
TTAMRWYPIVTFWQVAADMTNA

SEQ ID NO: 332170 - protein, 20 aa, Mycobacterium
TTAPGCGCRFTVRLPRVTDE

SEQ ID NO: 332171 - protein, 18 aa, Mycobacterium
TTAVLVDRSLRFGSRTAE

SEQ ID NO: 332172 - protein, 18 aa, Mycobacterium
TTDAFWLFMVFYAGAAAL

SEQ ID NO: 332173 - protein, 22 aa, Mycobacterium
TTDAPFDWYLGLLSRLASVSTA

SEQ ID NO: 332174 - protein, 38 aa, Mycobacterium
TTDLLPAFAYFAVWYLLCGCAFLLLGFETRGKNLETLD

SEQ ID NO: 332175 - protein, 25 aa, Mycobacterium
TTDPGWKWLWWQYALADTRYVSGNP

SEQ ID NO: 332176 - protein, 25 aa, Mycobacterium
TTDPGWKWLWWQYGLADTRYTSGNA

SEQ ID NO: 332177 - protein, 24 aa, Mycobacterium
TTDPGWRWLWWQYGLADTRYRSDD

SEQ ID NO: 332178 - protein, 22 aa, Mycobacterium
TTEAPFDWYLGVLARLASVSTA

SEQ ID NO: 332179 - protein, 24 aa, Mycobacterium
TTEGQRPAWLNVIRADPGRVGVLA

SEQ ID NO: 332180 - protein, 20 aa, Mycobacterium
TTEHWRYYNSVYFPYVVGVR

SEQ ID NO: 332181 - protein, 18 aa, Mycobacterium
TTEIRRLARRCGADLRYA

SEQ ID NO: 332182 - protein, 18 aa, Mycobacterium
TTFAAFTALCVFLPGIIG

SEQ ID NO: 332183 - protein, 20 aa, Mycobacterium
TTFFPRLSTAAIEIGLVAGA

SEQ ID NO: 332184 - protein, 26 aa, Mycobacterium
TTGAEGRLDWQISRRAPADSLLAPYE

SEQ ID NO: 332185 - protein, 24 aa, Mycobacterium
TTGAFKGGMLIAADDLVQSVEQSR

SEQ ID NO: 332186 - protein, 22 aa, Mycobacterium
TTGARYLATFAHNVDAYASTAV

SEQ ID NO: 332187 - protein, 17 aa, Mycobacterium
TTGILDLLSERELRAVL

SEQ ID NO: 332188 - protein, 29 aa, Mycobacterium
TTGKKPPASSLISLAPKERNVAVEAPAVS

SEQ ID NO: 332189 - protein, 18 aa, Mycobacterium
TTGLRLSQIALFVLLTTF

SEQ ID NO: 332190 - protein, 17 aa, Mycobacterium
TTGMTWSNVVAGALLTF

SEQ ID NO: 332191 - protein, 26 aa, Mycobacterium
TTGPLLEMLDRVGAVGLNPDDVAVAA

SEQ ID NO: 332192 - protein, 17 aa, Mycobacterium
TTGSTGFRGFHGRPGSR

SEQ ID NO: 332193 - protein, 20 aa, Mycobacterium
TTGVIWRIILFYVGSIFLVV

SEQ ID NO: 332194 - protein, 18 aa, Mycobacterium
TTHARTAAFFDLDKTIIA

SEQ ID NO: 332195 - protein, 17 aa, Mycobacterium
TTHCLRTGDRCMSFFHA

SEQ ID NO: 332196 - protein, 23 aa, Mycobacterium
TTHGRLLLCGVYTAVAAVALIRQ

SEQ ID NO: 332197 - protein, 19 aa, Mycobacterium
TTHHGWRWASLIVAAAALA

SEQ ID NO: 332198 - protein, 18 aa, Mycobacterium
TTHWGLQIDHFWWSAIWA

SEQ ID NO: 332199 - protein, 24 aa, Mycobacterium
TTIDTPDGLYCKLPQDSPMNVRGA

SEQ ID NO: 332200 - protein, 17 aa, Mycobacterium
TTIEPSPGFPVQYAPPD

SEQ ID NO: 332201 - protein, 20 aa, Mycobacterium
TTIFCCLPFGIVSIVKAAQV

SEQ ID NO: 332202 - protein, 23 aa, Mycobacterium
TTIGALLSAIGIARMDRLVQRNV

SEQ ID NO: 332203 - protein, 23 aa, Mycobacterium
TTIGCGIARGGPYEYVGQELQQK

SEQ ID NO: 332204 - protein, 24 aa, Mycobacterium
TTIGCGIARGGPYRSAGETLNQKP

SEQ ID NO: 332205 - protein, 19 aa, Mycobacterium
TTILFPAAVAALVYALIAV

SEQ ID NO: 332206 - protein, 19 aa, Mycobacterium
TTILSGRMSRHFADRTRPW

SEQ ID NO: 332207 - protein, 18 aa, Mycobacterium
TTKLLAFNQGFYNLFLAI

SEQ ID NO: 332208 - protein, 23 aa, Mycobacterium
TTKLPLYLNIAVVVLGLAVYLLN

SEQ ID NO: 332209 - protein, 22 aa, Mycobacterium
TTKPRARRKASRAAGPAKSEST

SEQ ID NO: 332210 - protein, 18 aa, Mycobacterium
TTLAALPWVTWLAVGNNI

SEQ ID NO: 332211 - protein, 26 aa, Mycobacterium
TTLARLIAGYTRPSAGSITFEGHDIH

SEQ ID NO: 332212 - protein, 18 aa, Mycobacterium
TTLARRPVWWAGTIAAVA

SEQ ID NO: 332213 - protein, 23 aa, Mycobacterium
TTLEAIGGLFAMSSDAVRFAFRR

SEQ ID NO: 332214 - protein, 19 aa, Mycobacterium
TTLIAWGYVVDRFGERLVL

SEQ ID NO: 332215 - protein, 24 aa, Mycobacterium
TTLLEMVAGFILALLIVKGNYVKG

SEQ ID NO: 332216 - protein, 27 aa, Mycobacterium
TTLLKIPFLANWQFSRRIIDWFAEKTQ

SEQ ID NO: 332217 - protein, 20 aa, Mycobacterium
TTLLRFAYRHPPGMTWLDAL

SEQ ID NO: 332218 - protein, 17 aa, Mycobacterium
TTLLRHIIRTVREHSTP

SEQ ID NO: 332219 - protein, 17 aa, Mycobacterium
TTLLRHIIRTVRENSTP

SEQ ID NO: 332220 - protein, 24 aa, Mycobacterium
TTLMNLLMRFYEVDSGRILIDGVD

SEQ ID NO: 332221 - protein, 20 aa, Mycobacterium
TTLPAVVRWAKMPEDLAHAE

SEQ ID NO: 332222 - protein, 26 aa, Mycobacterium
TTLPRALRLARDFGAVVFGKYGQYLV

SEQ ID NO: 332223 - protein, 22 aa, Mycobacterium
TTLQMPLAMWPKSCAEFDEYWA

SEQ ID NO: 332224 - protein, 17 aa, Mycobacterium
TTLRELCRVVADAEKRY

SEQ ID NO: 332225 - protein, 20 aa, Mycobacterium
TTLRMPLQLMNFGTTVDNIG

SEQ ID NO: 332226 - protein, 23 aa, Mycobacterium
TTLVNLLMRFYDVDSGRILLDGT

SEQ ID NO: 332227 - protein, 23 aa, Mycobacterium
TTLVNLLMRFYDVDSGRILVDGV

SEQ ID NO: 332228 - protein, 25 aa, Mycobacterium
TTLVNLLMRFYEVDSGRILVDGIDI

SEQ ID NO: 332229 - protein, 23 aa, Mycobacterium
TTLVRCFDELLVLAQQHPQVRKW

SEQ ID NO: 332230 - protein, 18 aa, Mycobacterium
TTMQLLFSGGRRQLNIGV

SEQ ID NO: 332231 - protein, 23 aa, Mycobacterium
TTNMSHKQWDEWVSPDIDYVQAC

SEQ ID NO: 332232 - protein, 25 aa, Mycobacterium
TTPEGVTIVTTRPGVVNTPVITAPT

SEQ ID NO: 332233 - protein, 17 aa, Mycobacterium
TTPGPLRQMVRAGLPNA

SEQ ID NO: 332234 - protein, 18 aa, Mycobacterium
TTPGRPSVGRWALQPLTC

SEQ ID NO: 332235 - protein, 25 aa, Mycobacterium
TTPILLWGGYPFHRAALVNARHGAS

SEQ ID NO: 332236 - protein, 17 aa, Mycobacterium
TTPIWRLVLPFFAMGVG

SEQ ID NO: 332237 - protein, 23 aa, Mycobacterium
TTPLKFRLAYIADLEATFTPFFK

SEQ ID NO: 332238 - protein, 23 aa, Mycobacterium
TTPLRRLDLLIAYGTAFSTAAAA

SEQ ID NO: 332239 - protein, 24 aa, Mycobacterium
TTPLRRLDMLAGYGTAFSLAAAAQ

SEQ ID NO: 332240 - protein, 26 aa, Mycobacterium
TTPLWRAAQVFRLLSCVYAAGFQIAI

SEQ ID NO: 332241 - protein, 25 aa, Mycobacterium
TTPQWYALTWDWRTDSGYQQVTVVV

SEQ ID NO: 332242 - protein, 17 aa, Mycobacterium
TTPRPGRETEFLAAEKA

SEQ ID NO: 332243 - protein, 18 aa, Mycobacterium
TTPWLALAISFAAVILAS

SEQ ID NO: 332244 - protein, 20 aa, Mycobacterium
TTPWQHHRHWITTKRSGHVA

SEQ ID NO: 332245 - protein, 20 aa, Mycobacterium
TTPYYARMHKWIKRAVLVCL

SEQ ID NO: 332246 - protein, 23 aa, Mycobacterium
TTQLTMLAPRAGLVMDPGSKVTY

SEQ ID NO: 332247 - protein, 32 aa, Mycobacterium
TTQRDWLRRINWKWVRRSAYLAAAVVILLPIV

SEQ ID NO: 332248 - protein, 22 aa, Mycobacterium
TTRHELHPDLALLLSTSGSTGS

SEQ ID NO: 332249 - protein, 21 aa, Mycobacterium
TTRHKIIFGIIALVGAIAWAI

SEQ ID NO: 332250 - protein, 30 aa, Mycobacterium
TTRRWRRIGTAVVRWPAPILIATIAVAVIG

SEQ ID NO: 332251 - protein, 34 aa, Mycobacterium
TTRRWRRIGTIVVRWPGPVLVAAALISLIGLLAL

SEQ ID NO: 332252 - protein, 29 aa, Mycobacterium
TTRRWRRIGTIVVRWPGPVLVATLLISLI

SEQ ID NO: 332253 - protein, 25 aa, Mycobacterium
TTSHFPWTPFTIVLVIAVILAVAGT

SEQ ID NO: 332254 - protein, 22 aa, Mycobacterium
TTSHPRKPRPAFQDASCPDVQL

SEQ ID NO: 332255 - protein, 24 aa, Mycobacterium
TTSIRSGLAVSRPLPAVIADAAAR

SEQ ID NO: 332256 - protein, 18 aa, Mycobacterium
TTSIVFHVLAGVLIVGTA

SEQ ID NO: 332257 - protein, 24 aa, Mycobacterium
TTSRIEGLLTWLGGGHWRELGERH

SEQ ID NO: 332258 - protein, 17 aa, Mycobacterium
TTSRMAFALTIHGDGPR

SEQ ID NO: 332259 - protein, 17 aa, Mycobacterium
TTSVLPGTDPGAVSPNQ

SEQ ID NO: 332260 - protein, 25 aa, Mycobacterium
TTTARRDGTDWILKGQKVYISGIDQ

SEQ ID NO: 332261 - protein, 22 aa, Mycobacterium
TTTFLLPLFFVYSGLNTEIGLV

SEQ ID NO: 332262 - protein, 23 aa, Mycobacterium
TTTLSGRFGVPVITAPRPQLTAA

SEQ ID NO: 332263 - protein, 26 aa, Mycobacterium
TTTRPMMLCALGFTAAAMLVGFWQLT

SEQ ID NO: 332264 - protein, 25 aa, Mycobacterium
TTTSRLGFDLGFAVLDHTQHDVADR

SEQ ID NO: 332265 - protein, 23 aa, Mycobacterium
TTTWWQRLPVFAAAMIGWGGLVL

SEQ ID NO: 332266 - protein, 25 aa, Mycobacterium
TTVAFGAFAHRWLARRTRRRINPGL

SEQ ID NO: 332267 - protein, 26 aa, Mycobacterium
TTVAHFLPPVLRKLSIFLPQSPSPNE

SEQ ID NO: 332268 - protein, 22 aa, Mycobacterium
TTVASYLKDDWFRDWGSLQRLT

SEQ ID NO: 332269 - protein, 27 aa, Mycobacterium
TTVESIPWRGVCRLYDTPGINGWGGRK

SEQ ID NO: 332270 - protein, 18 aa, Mycobacterium
TTVFAWCAAGIVSFHVLE

SEQ ID NO: 332271 - protein, 17 aa, Mycobacterium
TTVGLRVYLTWITSTGY

SEQ ID NO: 332272 - protein, 27 aa, Mycobacterium
TTVGRAVSFLAPWLFFMFIDIFGTDRA

SEQ ID NO: 332273 - protein, 31 aa, Mycobacterium
TTVIIRFWLLTAIACGLGLALFYGEWLATIG

SEQ ID NO: 332274 - protein, 26 aa, Mycobacterium
TTVIIRFWLLTAIACGLGVALFYGEW

SEQ ID NO: 332275 - protein, 25 aa, Mycobacterium
TTVIIRFWLLTAIACGLGVALFYSE

SEQ ID NO: 332276 - protein, 25 aa, Mycobacterium
TTVIIRFWLLTAISCGLGVALFYGE

SEQ ID NO: 332277 - protein, 25 aa, Mycobacterium
TTVKPGHATLRMSLTITTAAATDRS

SEQ ID NO: 332278 - protein, 17 aa, Mycobacterium
TTVLPVIDPRASELPDL

SEQ ID NO: 332279 - protein, 20 aa, Mycobacterium
TTVLSGRLSRHFGERTRAWI

SEQ ID NO: 332280 - protein, 25 aa, Mycobacterium
TTVLWRIHFASALLMVPQTVVLTFM

SEQ ID NO: 332281 - protein, 24 aa, Mycobacterium
TTVPRRLRHPSPRREPTAGRPAEQ

SEQ ID NO: 332282 - protein, 20 aa, Mycobacterium
TTVRDIVVVLGFAITSLGLA

SEQ ID NO: 332283 - protein, 20 aa, Mycobacterium
TTVVCLRAPGMTMFRMPIFT

SEQ ID NO: 332284 - protein, 25 aa, Mycobacterium
TTVVFGAFSHRWLARRTRRRINPGL

SEQ ID NO: 332285 - protein, 25 aa, Mycobacterium
TTVVLRFVEHLTYHYAFGSLLEGIT

SEQ ID NO: 332286 - protein, 21 aa, Mycobacterium
TTVVLRFVEHLTYHYTFGSLL

SEQ ID NO: 332287 - protein, 19 aa, Mycobacterium
TTVVSWLPFFHDMGLVLGI

SEQ ID NO: 332288 - protein, 26 aa, Mycobacterium
TTVVSWRVAYQWLRQRSRSLLHASTA

SEQ ID NO: 332289 - protein, 18 aa, Mycobacterium
TTVWCLVLLSLALTVTTF

SEQ ID NO: 332290 - protein, 19 aa, Mycobacterium
TTWRNGCDLQMATQRLTDM

SEQ ID NO: 332291 - protein, 17 aa, Mycobacterium
TTWRRRAVHLLAGAAAV

SEQ ID NO: 332292 - protein, 20 aa, Mycobacterium
TTYGEWLPVRAWFDELHRNL

SEQ ID NO: 332293 - protein, 23 aa, Mycobacterium
TTYGQWMPIRAWFDDLHRNLHLG

SEQ ID NO: 332294 - protein, 26 aa, Mycobacterium
TVAAFAATVPVCWLLMGQPLGNLPTW

SEQ ID NO: 332295 - protein, 38 aa, Mycobacterium
TVAAFGPDVPFTFTFPKPGRYLAWIQAQRDYRVLTIPV

SEQ ID NO: 332296 - protein, 17 aa, Mycobacterium
TVACLPVAAGLDDRTLG

SEQ ID NO: 332297 - protein, 26 aa, Mycobacterium
TVADFWRFWVVHLWVEDFLELFTTVM

SEQ ID NO: 332298 - protein, 19 aa, Mycobacterium
TVADGFRIFALAAVGGVFV

SEQ ID NO: 332299 - protein, 19 aa, Mycobacterium
TVADGIRLGDRTEASIKTT

SEQ ID NO: 332300 - protein, 24 aa, Mycobacterium
TVAEIPRDWALLGVFLGAVVAVAT

SEQ ID NO: 332301 - protein, 23 aa, Mycobacterium
TVAFPMYFLKSFAYAGVATVAFV

SEQ ID NO: 332302 - protein, 17 aa, Mycobacterium
TVAFWLLGFHTEGSPLL

SEQ ID NO: 332303 - protein, 26 aa, Mycobacterium
TVAGLLQLLGIFGFLGIGRMYIGQVG

SEQ ID NO: 332304 - protein, 22 aa, Mycobacterium
TVAGLLQLLGLFGIAGIGRIYM

SEQ ID NO: 332305 - protein, 18 aa, Mycobacterium
TVAGRLGVDRVFAQVRPQ

SEQ ID NO: 332306 - protein, 18 aa, Mycobacterium
TVAGRPGHLVGIDETIGL

SEQ ID NO: 332307 - protein, 18 aa, Mycobacterium
TVAGSWQGPSAMQYAASH

SEQ ID NO: 332308 - protein, 24 aa, Mycobacterium
TVAHFLPPVLRKLTIFVPESPSAA

SEQ ID NO: 332309 - protein, 26 aa, Mycobacterium
TVAIHLLVSMGMVWLATLLYVKVGEP

SEQ ID NO: 332310 - protein, 19 aa, Mycobacterium
TVAIMLPTCRAYFTTFAGV

SEQ ID NO: 332311 - protein, 26 aa, Mycobacterium
TVAIMVVSLIGWWALSRLLERMRGIP

SEQ ID NO: 332312 - protein, 18 aa, Mycobacterium
TVAIPAIVAFLAEYPAVA

SEQ ID NO: 332313 - protein, 18 aa, Mycobacterium
TVALMWVYVPRFLPGPSE

SEQ ID NO: 332314 - protein, 31 aa, Mycobacterium
TVALSLVAMVAFPMYFLKSFAYAGIAVVVFS

SEQ ID NO: 332315 - protein, 30 aa, Mycobacterium
TVALVRLTARWPRRRALLVTMVCLTVSQVI

SEQ ID NO: 332316 - protein, 18 aa, Mycobacterium
TVAPFLAVISTTFKQGSV

SEQ ID NO: 332317 - protein, 20 aa, Mycobacterium
TVAPSFPLSKQDLWEVVAAA

SEQ ID NO: 332318 - protein, 17 aa, Mycobacterium
TVAPVFALAAAVVSVSM

SEQ ID NO: 332319 - protein, 17 aa, Mycobacterium
TVAPVFVVAAAVIATSL

SEQ ID NO: 332320 - protein, 19 aa, Mycobacterium
TVASPAWYDDYVLTVGSVG

SEQ ID NO: 332321 - protein, 17 aa, Mycobacterium
TVASRFGLLEPKRAIRI

SEQ ID NO: 332322 - protein, 18 aa, Mycobacterium
TVAVCAVGGILGVMYSIP

SEQ ID NO: 332323 - protein, 30 aa, Mycobacterium
TVAVTFIVMVFCKLPVFSTVGPAISVSIVV

SEQ ID NO: 332324 - protein, 24 aa, Mycobacterium
TVAWYPLNMIRRPISVAAMLAAAA

SEQ ID NO: 332325 - protein, 20 aa, Mycobacterium
TVCTRDRAGALAGLQALAAG

SEQ ID NO: 332326 - protein, 25 aa, Mycobacterium
TVCVPELLLPLMLLNFTPMFGHIAH

SEQ ID NO: 332327 - protein, 21 aa, Mycobacterium
TVCWIGMAAALFGYALHHAGR

SEQ ID NO: 332328 - protein, 29 aa, Mycobacterium
TVDANAALRWSLLAGAVCNDAALTHDGRR

SEQ ID NO: 332329 - protein, 18 aa, Mycobacterium
TVDARTGLTGVQYTDPLR

SEQ ID NO: 332330 - protein, 18 aa, Mycobacterium
TVDGLGCYGPPERALAVM

SEQ ID NO: 332331 - protein, 19 aa, Mycobacterium
TVDGLRPQFPGGLDATVLL

SEQ ID NO: 332332 - protein, 37 aa, Mycobacterium
TVDGLVLTIGFLLPWIPVLGVLVLAVVWVLRRKIFSR

SEQ ID NO: 332333 - protein, 24 aa, Mycobacterium
TVDGPRLRATLTYADGELDEPSVA

SEQ ID NO: 332334 - protein, 18 aa, Mycobacterium
TVDLRRKILFTLGIVVLY

SEQ ID NO: 332335 - protein, 17 aa, Mycobacterium
TVDLVYQFIPVLRANGY

SEQ ID NO: 332336 - protein, 23 aa, Mycobacterium
TVELPINLRSGLLTVTQGERTLA

SEQ ID NO: 332337 - protein, 19 aa, Mycobacterium
TVFAAVAGFVMVPGGPSVS

SEQ ID NO: 332338 - protein, 28 aa, Mycobacterium
TVFADFPGLEVCVYAAPSQTVIGGPPEQ

SEQ ID NO: 332339 - protein, 18 aa, Mycobacterium
TVFFLKAALIIPLGLAIF

SEQ ID NO: 332340 - protein, 24 aa, Mycobacterium
TVFFPHLSPTVAMIGSMGTFAAAF

SEQ ID NO: 332341 - protein, 18 aa, Mycobacterium
TVFGWPGMAAVLVDSAAA

SEQ ID NO: 332342 - protein, 23 aa, Mycobacterium
TVFPMRIAAAIAFLQMKRWGHQW

SEQ ID NO: 332343 - protein, 19 aa, Mycobacterium
TVFSRSGLGTVLLQAVSNQ

SEQ ID NO: 332344 - protein, 17 aa, Mycobacterium
TVFTYRLHQEVVFPAVD

SEQ ID NO: 332345 - protein, 18 aa, Mycobacterium
TVFVCALVAGALFGIVIV

SEQ ID NO: 332346 - protein, 19 aa, Mycobacterium
TVGAALVFAGIGSMAAAAV

SEQ ID NO: 332347 - protein, 18 aa, Mycobacterium
TVGEIWAHGEHVAMGYWQ

SEQ ID NO: 332348 - protein, 24 aa, Mycobacterium
TVGGPGAVFWMWVVAAVGMATAVI

SEQ ID NO: 332349 - protein, 17 aa, Mycobacterium
TVGLLGFSERGWDPAPY

SEQ ID NO: 332350 - protein, 18 aa, Mycobacterium
TVGLWPLLAPMLAAGTVI

SEQ ID NO: 332351 - protein, 18 aa, Mycobacterium
TVGPFLAVISTTFKQGSI

SEQ ID NO: 332352 - protein, 28 aa, Mycobacterium
TVGRGCYALEMWGGPVGQEVSLAVALVV

SEQ ID NO: 332353 - protein, 24 aa, Mycobacterium
TVGRISAVVACRRGVPGAAASGFG

SEQ ID NO: 332354 - protein, 22 aa, Mycobacterium
TVGRNVGEWALHFLQGAVGGLA

SEQ ID NO: 332355 - protein, 25 aa, Mycobacterium
TVGRPVAGCPIRIFDRNGRPVGPRV

SEQ ID NO: 332356 - protein, 24 aa, Mycobacterium
TVGRSNLEAAFVFKTGHTCGLAQD

SEQ ID NO: 332357 - protein, 23 aa, Mycobacterium
TVGRYALAGAMIFAGFSHLFWAR

SEQ ID NO: 332358 - protein, 22 aa, Mycobacterium
TVGYIDGWVPFWVTIPVNAAVT

SEQ ID NO: 332359 - protein, 25 aa, Mycobacterium
TVGYINGWLPFWVTIPINASVTFVM

SEQ ID NO: 332360 - protein, 19 aa, Mycobacterium
TVHAAGCAFAQGHLFGKPV

SEQ ID NO: 332361 - protein, 18 aa, Mycobacterium
TVHLGYSVWTLWPVLVLF

SEQ ID NO: 332362 - protein, 17 aa, Mycobacterium
TVHYARLYYSDEPGGIN

SEQ ID NO: 332363 - protein, 24 aa, Mycobacterium
TVIACWRMGRQLRRQRSASRLHAA

SEQ ID NO: 332364 - protein, 25 aa, Mycobacterium
TVIALGIGSLAVWKVHEMSAPGPVP

SEQ ID NO: 332365 - protein, 31 aa, Mycobacterium
TVIAPPPPRMLLVGSALTFVAVSFATLAVTV

SEQ ID NO: 332366 - protein, 17 aa, Mycobacterium
TVIARIVGLLGVAYVDT

SEQ ID NO: 332367 - protein, 19 aa, Mycobacterium
TVIASLWFTIFGDAALLRQ

SEQ ID NO: 332368 - protein, 17 aa, Mycobacterium
TVIAYGLIPIAGAQFFY

SEQ ID NO: 332369 - protein, 18 aa, Mycobacterium
TVIFVFNRFHAFRRGRSG

SEQ ID NO: 332370 - protein, 18 aa, Mycobacterium
TVIGAKALVAGGWVAVVT

SEQ ID NO: 332371 - protein, 25 aa, Mycobacterium
TVILAELRLHFPALRDGVSARQAVA

SEQ ID NO: 332372 - protein, 18 aa, Mycobacterium
TVILRFSYQPRPKMTWLD

SEQ ID NO: 332373 - protein, 23 aa, Mycobacterium
TVIMSALVLWYVIGAGSSDDGYQ

SEQ ID NO: 332374 - protein, 20 aa, Mycobacterium
TVIVSSLIAGLAFGAAMVAM

SEQ ID NO: 332375 - protein, 24 aa, Mycobacterium
TVKEWPCAVKLMTAEFSKDPVFRE

SEQ ID NO: 332376 - protein, 25 aa, Mycobacterium
TVKLPHIDVRWGFRERVTAIAVLVL

SEQ ID NO: 332377 - protein, 17 aa, Mycobacterium
TVKTGLTPISFAVGSTG

SEQ ID NO: 332378 - protein, 19 aa, Mycobacterium
TVLAFWFFAAGWAAAKATQ

SEQ ID NO: 332379 - protein, 23 aa, Mycobacterium
TVLCGLLAALTRKVLDHQRAHAW

SEQ ID NO: 332380 - protein, 19 aa, Mycobacterium
TVLFGWGAWQRRWIADDGL

SEQ ID NO: 332381 - protein, 18 aa, Mycobacterium
TVLFLPQVIATVVIATIW

SEQ ID NO: 332382 - protein, 17 aa, Mycobacterium
TVLFQTALTKLRDILAA

SEQ ID NO: 332383 - protein, 17 aa, Mycobacterium
TVLFRTIYVIPWICAPL

SEQ ID NO: 332384 - protein, 17 aa, Mycobacterium
TVLFSALTVALALVALI

SEQ ID NO: 332385 - protein, 18 aa, Mycobacterium
TVLGVPVASWLGQSLGWR

SEQ ID NO: 332386 - protein, 22 aa, Mycobacterium
TVLGWVLAAFAVRPLKRLAEQT

SEQ ID NO: 332387 - protein, 25 aa, Mycobacterium
TVLHGAWGLMLGRLLGRNRVVFGST

SEQ ID NO: 332388 - protein, 25 aa, Mycobacterium
TVLIGWASGLGFGWIYTLGTANAVR

SEQ ID NO: 332389 - protein, 26 aa, Mycobacterium
TVLIGWSAACAVAYLRGFGRRPSWVL

SEQ ID NO: 332390 - protein, 18 aa, Mycobacterium
TVLLEFAIQIARLNDRRK

SEQ ID NO: 332391 - protein, 19 aa, Mycobacterium
TVLLFPVVQPWYLLWAIIP

SEQ ID NO: 332392 - protein, 18 aa, Mycobacterium
TVLLPPWLAAAATWGGVA

SEQ ID NO: 332393 - protein, 37 aa, Mycobacterium
TVLPAALAILGPRVDALGVRWLLKFVNNEVSSDPSNT

SEQ ID NO: 332394 - protein, 17 aa, Mycobacterium
TVLPFGAPYTRFNGRLG

SEQ ID NO: 332395 - protein, 20 aa, Mycobacterium
TVLRDAYRKALRSNNVNFVW

SEQ ID NO: 332396 - protein, 24 aa, Mycobacterium
TVLRRVSLPLVMPALASGTVLAFA

SEQ ID NO: 332397 - protein, 24 aa, Mycobacterium
TVLRSELYAIPALIAAGIAAAGYS

SEQ ID NO: 332398 - protein, 19 aa, Mycobacterium
TVLSDRYWWSALVVTLVIT

SEQ ID NO: 332399 - protein, 25 aa, Mycobacterium
TVLSFEMGLLWPGLMGRFGDVLGLP

SEQ ID NO: 332400 - protein, 25 aa, Mycobacterium
TVLSPRAGLVMDVDAKVKYRGIQVG

SEQ ID NO: 332401 - protein, 18 aa, Mycobacterium
TVLTCVLAIPLGIALTRG

SEQ ID NO: 332402 - protein, 19 aa, Mycobacterium
TVLVLVVAVGQSFTSIPMM

SEQ ID NO: 332403 - protein, 24 aa, Mycobacterium
TVLVPVVAAVLFLASAVFAVTQFA

SEQ ID NO: 332404 - protein, 28 aa, Mycobacterium
TVLVVALWRFRWIRLAMISALLATLGSG

SEQ ID NO: 332405 - protein, 23 aa, Mycobacterium
TVLYFCLAQLILAIFAHSETALF

SEQ ID NO: 332406 - protein, 19 aa, Mycobacterium
TVMCRRRFDAQQAMTDIRR

SEQ ID NO: 332407 - protein, 17 aa, Mycobacterium
TVMFCPGGPTGTLDVTL

SEQ ID NO: 332408 - protein, 22 aa, Mycobacterium
TVMGGLVAYFFGFIVLEAVLSR

SEQ ID NO: 332409 - protein, 30 aa, Mycobacterium
TVMLRTLLRRKLWWAGTISAVMGYGFQALA

SEQ ID NO: 332410 - protein, 18 aa, Mycobacterium
TVMRNRLAAVLLVGITGY

SEQ ID NO: 332411 - protein, 24 aa, Mycobacterium
TVNALCGIGIFAVVVFTTGLPLAY

SEQ ID NO: 332412 - protein, 19 aa, Mycobacterium
TVNRGCVVQTHLFHDRIMR

SEQ ID NO: 332413 - protein, 38 aa, Mycobacterium
TVNRPIHRRWRRIGTMVARWPGPVLVAAALVLLICTLP

SEQ ID NO: 332414 - protein, 18 aa, Mycobacterium
TVNSFASLAQQGYFANTP

SEQ ID NO: 332415 - protein, 20 aa, Mycobacterium
TVPAAALVMVFAIGAAMSMA

SEQ ID NO: 332416 - protein, 24 aa, Mycobacterium
TVPADVRAAGRLVIGVNVPYAPME

SEQ ID NO: 332417 - protein, 18 aa, Mycobacterium
TVPAMLLLPLLIRAPDTA

SEQ ID NO: 332418 - protein, 22 aa, Mycobacterium
TVPAMLLLPLLIRMPDTPRWYV

SEQ ID NO: 332419 - protein, 28 aa, Mycobacterium
TVPASLWVTRWITRRSQPLFVAQWRNTG

SEQ ID NO: 332420 - protein, 23 aa, Mycobacterium
TVPEAIALIVVIARYLEPFTAVS

SEQ ID NO: 332421 - protein, 21 aa, Mycobacterium
TVPEMRQWLRNWVGKAVGKSP

SEQ ID NO: 332422 - protein, 31 aa, Mycobacterium
TVPGPGSAGWLRLGVLTALIATALALVINRR

SEQ ID NO: 332423 - protein, 18 aa, Mycobacterium
TVPGRYFYVKWWKLALML

SEQ ID NO: 332424 - protein, 18 aa, Mycobacterium
TVPLASWTAGSREVACSI

SEQ ID NO: 332425 - protein, 21 aa, Mycobacterium
TVPLPRRLSSRLFGRNPLIRA

SEQ ID NO: 332426 - protein, 24 aa, Mycobacterium
TVPLSLLVTRVITRRSQGLFVAHW

SEQ ID NO: 332427 - protein, 26 aa, Mycobacterium
TVPLVRWTAHWPRRHALMVSLVCLTI

SEQ ID NO: 332428 - protein, 31 aa, Mycobacterium
TVPLVRWTAHWPRRRTLVVALVCLTVSQLIS

SEQ ID NO: 332429 - protein, 17 aa, Mycobacterium
TVPRWLRIAGGVGAVAV

SEQ ID NO: 332430 - protein, 32 aa, Mycobacterium
TVPSRYVYLKWWKFVLVVLGVWFGAAQVGLSL

SEQ ID NO: 332431 - protein, 28 aa, Mycobacterium
TVPVGLALWLSMRFPPRLLGPDDSKRAV

SEQ ID NO: 332432 - protein, 23 aa, Mycobacterium
TVPVLLAAALLVWAVFDAVPPWA

SEQ ID NO: 332433 - protein, 23 aa, Mycobacterium
TVPWRPGPIRALLATRPAAFRSL

SEQ ID NO: 332434 - protein, 17 aa, Mycobacterium
TVPWSDIEGLRFERGRW

SEQ ID NO: 332435 - protein, 27 aa, Mycobacterium
TVQAAQLSAMWARFPLPVIPAPGDPTP

SEQ ID NO: 332436 - protein, 27 aa, Mycobacterium
TVQDPELRKALMPSYGILARRTILSSD

SEQ ID NO: 332437 - protein, 18 aa, Mycobacterium
TVQIYGLDCGADLKLAAL

SEQ ID NO: 332438 - protein, 18 aa, Mycobacterium
TVQQDLRSLSGFSDAYSA

SEQ ID NO: 332439 - protein, 20 aa, Mycobacterium
TVRAGFIGVVLIVLVIAVGL

SEQ ID NO: 332440 - protein, 18 aa, Mycobacterium
TVRENLELLGPVPGLDEV

SEQ ID NO: 332441 - protein, 30 aa, Mycobacterium
TVRFTPQQAGSFGFFCSMNMINGTLVVTPD

SEQ ID NO: 332442 - protein, 18 aa, Mycobacterium
TVRGGRPATPAPFDGPGM

SEQ ID NO: 332443 - protein, 18 aa, Mycobacterium
TVRLWDPDTHQLLGRPLD

SEQ ID NO: 332444 - protein, 33 aa, Mycobacterium
TVRPSLRGLRRDQWPPIVGLVLVFSVMNLSLYT

SEQ ID NO: 332445 - protein, 37 aa, Mycobacterium
TVRSTRLWRRVGIRVARWPKPIFVTTFAALIVLMMVI

SEQ ID NO: 332446 - protein, 26 aa, Mycobacterium
TVRTLRRGMPFALTWWSLTFPVGTFV

SEQ ID NO: 332447 - protein, 25 aa, Mycobacterium
TVSADWGHAVVLVFVDQTTVIGDDP

SEQ ID NO: 332448 - protein, 24 aa, Mycobacterium
TVSAKSLRAGDVIDLAAPEVVPAD

SEQ ID NO: 332449 - protein, 31 aa, Mycobacterium
TVSFPVVAYRAWRWWLATAVAFFAVAALVGF

SEQ ID NO: 332450 - protein, 27 aa, Mycobacterium
TVSFPVVAYRSWRWWLGATLGSMAVAV

SEQ ID NO: 332451 - protein, 31 aa, Mycobacterium
TVSFPVVAYRSWRWWLGTAAGFFAVVLLMAF

SEQ ID NO: 332452 - protein, 29 aa, Mycobacterium
TVSFPVVAYRTWRWWLATAAAFFAVVVVI

SEQ ID NO: 332453 - protein, 25 aa, Mycobacterium
TVSFPVVVYRSWRWSVASGAAFYLV

SEQ ID NO: 332454 - protein, 28 aa, Mycobacterium
TVSHFQRAVLRIGNYLIVLAAALVALTV

SEQ ID NO: 332455 - protein, 17 aa, Mycobacterium
TVSIMRGVQGSFLGISL

SEQ ID NO: 332456 - protein, 25 aa, Mycobacterium
TVSLLKRLGITVAMLTGDNTRTANA

SEQ ID NO: 332457 - protein, 25 aa, Mycobacterium
TVSPVEFWQYPTINALARFLTGGEV

SEQ ID NO: 332458 - protein, 31 aa, Mycobacterium
TVSRPSLRSRIGMVLQDTWLFEGTIADNIGY

SEQ ID NO: 332459 - protein, 26 aa, Mycobacterium
TVSVLVSWLLFTWIIARLPRERVGFR

SEQ ID NO: 332460 - protein, 18 aa, Mycobacterium
TVSWLPLYHDMGLMVGLF

SEQ ID NO: 332461 - protein, 27 aa, Mycobacterium
TVSYLLAALIERLMGFRVSREEEVSGV

SEQ ID NO: 332462 - protein, 25 aa, Mycobacterium
TVTAAREFLPYQALTGLRSDAIAAF

SEQ ID NO: 332463 - protein, 23 aa, Mycobacterium
TVTARPWLTAALVALFAVAAAPN

SEQ ID NO: 332464 - protein, 25 aa, Mycobacterium
TVTASMSCILAWLGQHPHERRRLVE

SEQ ID NO: 332465 - protein, 20 aa, Mycobacterium
TVTCFAFFFIGGLMALLMRT

SEQ ID NO: 332466 - protein, 17 aa, Mycobacterium
TVTDLGLILGRSRLHGI

SEQ ID NO: 332467 - protein, 19 aa, Mycobacterium
TVTDRHVWIPAALGLALIV

SEQ ID NO: 332468 - protein, 25 aa, Mycobacterium
TVTFGCLLMWILAWLTATPVRVVRA

SEQ ID NO: 332469 - protein, 20 aa, Mycobacterium
TVTGGAWQWSNVKNNRLNHV

SEQ ID NO: 332470 - protein, 22 aa, Mycobacterium
TVTICGEFALLVQVSLRAAATG

SEQ ID NO: 332471 - protein, 28 aa, Mycobacterium
TVTLDLPAGGGLYRFSNVTYRGVQVGKV

SEQ ID NO: 332472 - protein, 27 aa, Mycobacterium
TVTLELPATGGLYRFSNVTYRGVQIGK

SEQ ID NO: 332473 - protein, 29 aa, Mycobacterium
TVTLELPATGGLYRFSNVTYRGVQLGKVT

SEQ ID NO: 332474 - protein, 29 aa, Mycobacterium
TVTLEVPAAGGLYRFSNVTYRGVQVGKVT

SEQ ID NO: 332475 - protein, 21 aa, Mycobacterium
TVTLGLFAIVFGFSRAEVRGW

SEQ ID NO: 332476 - protein, 32 aa, Mycobacterium
TVTLLRPSGVLRRLGLVAALPLSLVAIAAAAI

SEQ ID NO: 332477 - protein, 18 aa, Mycobacterium
TVTLVWLYIEILRLLSYF

SEQ ID NO: 332478 - protein, 19 aa, Mycobacterium
TVTLVWLYIEILRLLSYLQ

SEQ ID NO: 332479 - protein, 19 aa, Mycobacterium
TVTMTASWQKIFSGDPKVG

SEQ ID NO: 332480 - protein, 23 aa, Mycobacterium
TVTSGIATWVWDWSADPGTALGA

SEQ ID NO: 332481 - protein, 25 aa, Mycobacterium
TVTSWPTAAGFPFYTAIKKLLLDQA

SEQ ID NO: 332482 - protein, 31 aa, Mycobacterium
TVVAFWIGHPLIRFSFRNELFNAAFRYALVR

SEQ ID NO: 332483 - protein, 17 aa, Mycobacterium
TVVAVIIEAVWHLGSAV

SEQ ID NO: 332484 - protein, 24 aa, Mycobacterium
TVVCGAVLLSIHLPLGLMVLIGVP

SEQ ID NO: 332485 - protein, 19 aa, Mycobacterium
TVVCLRAPGMTMFRMPIFT

SEQ ID NO: 332486 - protein, 18 aa, Mycobacterium
TVVCMRAPGMIMFRMPIF

SEQ ID NO: 332487 - protein, 18 aa, Mycobacterium
TVVCVFEPEGALALTVDR

SEQ ID NO: 332488 - protein, 22 aa, Mycobacterium
TVVFSFMSLFFIDVVVTAVGVK

SEQ ID NO: 332489 - protein, 19 aa, Mycobacterium
TVVGLEFGSLLGGAILTEQ

SEQ ID NO: 332490 - protein, 20 aa, Mycobacterium
TVVICIVGALLGLLIGGRKE

SEQ ID NO: 332491 - protein, 34 aa, Mycobacterium
TVVIIKRGLLKWAWIPGVPLLWDLIVTMTASWQK

SEQ ID NO: 332492 - protein, 17 aa, Mycobacterium
TVVKARWGESATGAATI

SEQ ID NO: 332493 - protein, 21 aa, Mycobacterium
TVVLCVVALFAVNVVLTTVGV

SEQ ID NO: 332494 - protein, 21 aa, Mycobacterium
TVVLCVVALYAVNVILTTIGV

SEQ ID NO: 332495 - protein, 20 aa, Mycobacterium
TVVLGWRLVGFLWATVAGAV

SEQ ID NO: 332496 - protein, 23 aa, Mycobacterium
TVVLTFMLVWLIHSHGWSIAAAG

SEQ ID NO: 332497 - protein, 23 aa, Mycobacterium
TVVLTFMLVWLMKNQHWSIATAG

SEQ ID NO: 332498 - protein, 22 aa, Mycobacterium
TVVSVLWLWWTTNLLSGLLALA

SEQ ID NO: 332499 - protein, 19 aa, Mycobacterium
TVVTARFPRKPLLLTTLLG

SEQ ID NO: 332500 - protein, 34 aa, Mycobacterium
TVVVIKRGLIKWAWIPALPLMWDLTVTMTASWQK

SEQ ID NO: 332501 - protein, 18 aa, Mycobacterium
TVVVLAVLAWRRRNVALA

SEQ ID NO: 332502 - protein, 19 aa, Mycobacterium
TVWFWIPLAIMIIGVSSIP

SEQ ID NO: 332503 - protein, 18 aa, Mycobacterium
TVWGLRLSWHMYRKTAGK

SEQ ID NO: 332504 - protein, 32 aa, Mycobacterium
TVWGPRLGVRWWRFGAGVLLGLAFATKWSGLY

SEQ ID NO: 332505 - protein, 17 aa, Mycobacterium
TVWSYRSLKELGVRTPG

SEQ ID NO: 332506 - protein, 25 aa, Mycobacterium
TVWTVIAILALFGWPQVARIARGAV

SEQ ID NO: 332507 - protein, 24 aa, Mycobacterium
TVWVRPRQGPKLADLIAEPDTTRA

SEQ ID NO: 332508 - protein, 23 aa, Mycobacterium
TVWVRPRQGPKLADLIAQPDTTR

SEQ ID NO: 332509 - protein, 23 aa, Mycobacterium
TVYPEILFWGFPIATGVVVLGAI

SEQ ID NO: 332510 - protein, 19 aa, Mycobacterium
TVYSPLFRKFVEWIEYLCL

SEQ ID NO: 332511 - protein, 21 aa, Mycobacterium
TWAAAMLVWRFGRIEEKWTAA

SEQ ID NO: 332512 - protein, 18 aa, Mycobacterium
TWAKLYSDWVPRTLPPGW

SEQ ID NO: 332513 - protein, 24 aa, Mycobacterium
TWAQLRTRLDAVGARLQQVTRPGD

SEQ ID NO: 332514 - protein, 21 aa, Mycobacterium
TWAVALLVWRLGRIEEKWTTA

SEQ ID NO: 332515 - protein, 30 aa, Mycobacterium
TWDFKPAPVPWYRTRGAAVALTAAGIAAAA

SEQ ID NO: 332516 - protein, 19 aa, Mycobacterium
TWDIFCLWMTSAHSLGSYG

SEQ ID NO: 332517 - protein, 21 aa, Mycobacterium
TWFFPAWYAVFGVIICILARV

SEQ ID NO: 332518 - protein, 24 aa, Mycobacterium
TWFFPAWYAVFGVIICLMARVTPP

SEQ ID NO: 332519 - protein, 18 aa, Mycobacterium
TWFLAHGMTSPLRDMTAA

SEQ ID NO: 332520 - protein, 21 aa, Mycobacterium
TWFLQTSMCMFFKARSDVARM

SEQ ID NO: 332521 - protein, 21 aa, Mycobacterium
TWFRHEPRLGSYATPDATAAT

SEQ ID NO: 332522 - protein, 24 aa, Mycobacterium
TWFVARVSLVPALMLTVPYTVLLV

SEQ ID NO: 332523 - protein, 19 aa, Mycobacterium
TWGPSLCRVERNNSGCRSG

SEQ ID NO: 332524 - protein, 20 aa, Mycobacterium
TWGSALWQRVLAAVIAAVIF

SEQ ID NO: 332525 - protein, 22 aa, Mycobacterium
TWIAWPSPRKAVTLYCGTEHYT

SEQ ID NO: 332526 - protein, 25 aa, Mycobacterium
TWIGQCKHWVPTIAQANKWITKGYR

SEQ ID NO: 332527 - protein, 23 aa, Mycobacterium
TWLASHHLEWIFALYSVVLAAIG

SEQ ID NO: 332528 - protein, 20 aa, Mycobacterium
TWLGCLPVSTWLDGLHRHLN

SEQ ID NO: 332529 - protein, 17 aa, Mycobacterium
TWLVYRITATVSEKDTE

SEQ ID NO: 332530 - protein, 26 aa, Mycobacterium
TWMIARVSLVPTLLVAIPFTVLVAFT

SEQ ID NO: 332531 - protein, 17 aa, Mycobacterium
TWMQFRGQFEDKVQLTV

SEQ ID NO: 332532 - protein, 19 aa, Mycobacterium
TWNGHVFLVVDGWATLRQD

SEQ ID NO: 332533 - protein, 39 aa, Mycobacterium
TWNYLDRMGHSWSTRATLHFLWLRLARVWPVYLVTMHLA

SEQ ID NO: 332534 - protein, 39 aa, Mycobacterium
TWNYLDRMGRSWSTRATVHFLWLRLARVWPVYLVTLHLA

SEQ ID NO: 332535 - protein, 22 aa, Mycobacterium
TWPQCFPGSFVPVAHAEVPRIH

SEQ ID NO: 332536 - protein, 18 aa, Mycobacterium
TWPTLPRATRLQIVTRHW

SEQ ID NO: 332537 - protein, 24 aa, Mycobacterium
TWPYWYAGVIELVLGLLIMVGLFT

SEQ ID NO: 332538 - protein, 21 aa, Mycobacterium
TWQIISLNALAAMIFAAVPWL

SEQ ID NO: 332539 - protein, 20 aa, Mycobacterium
TWSPPGMSPFTWDLPDPTPL

SEQ ID NO: 332540 - protein, 24 aa, Mycobacterium
TWSQVVPMTVCLAVVTVALLAMGP

SEQ ID NO: 332541 - protein, 24 aa, Mycobacterium
TWTPRIAAQLAILAAAAFTYVTAE

SEQ ID NO: 332542 - protein, 23 aa, Mycobacterium
TWVALRYSTPVSTLFVIAAANWI

SEQ ID NO: 332543 - protein, 17 aa, Mycobacterium
TWVARRLLGMAAGGPGL

SEQ ID NO: 332544 - protein, 24 aa, Mycobacterium
TWVLLAGPGWVVFGAIKQIIGLFL

SEQ ID NO: 332545 - protein, 19 aa, Mycobacterium
TWWQSCPQGSISAFFYTRT

SEQ ID NO: 332546 - protein, 23 aa, Mycobacterium
TWWRIPVLLGSAFANGWAEEIIV

SEQ ID NO: 332547 - protein, 27 aa, Mycobacterium
TWYETRFLPRIGPWALYGLLFTIVVLF

SEQ ID NO: 332548 - protein, 27 aa, Mycobacterium
TWYLAGYRLSLIIAKRYPNMPVPNLLG

SEQ ID NO: 332549 - protein, 18 aa, Mycobacterium
TYAQRLAIAEAFDTVEIY

SEQ ID NO: 332550 - protein, 17 aa, Mycobacterium
TYARAMGPMQFLPGTWA

SEQ ID NO: 332551 - protein, 26 aa, Mycobacterium
TYDDRASALAGLWLIIELNLAVPLAI

SEQ ID NO: 332552 - protein, 18 aa, Mycobacterium
TYDMALVFRHRVRRDRLI

SEQ ID NO: 332553 - protein, 26 aa, Mycobacterium
TYDRNSGAFILEWTSQIVGGPFNDFT

SEQ ID NO: 332554 - protein, 24 aa, Mycobacterium
TYEPDMCGAIPKILNHSGDSLAAY

SEQ ID NO: 332555 - protein, 21 aa, Mycobacterium
TYFALPFVRARQDLRKFVWLA

SEQ ID NO: 332556 - protein, 25 aa, Mycobacterium
TYFRAWGALCILLAAGIAFLAGRTR

SEQ ID NO: 332557 - protein, 18 aa, Mycobacterium
TYFSEGLLYFAIQMRDAS

SEQ ID NO: 332558 - protein, 18 aa, Mycobacterium
TYFWPIWPILGAGIGLAS

SEQ ID NO: 332559 - protein, 21 aa, Mycobacterium
TYGFQHRRFWLGQLDAGRTDV

SEQ ID NO: 332560 - protein, 24 aa, Mycobacterium
TYGLKLPLLALLDFLTGHFSVALS

SEQ ID NO: 332561 - protein, 27 aa, Mycobacterium
TYHIAKPWRWGYLGVLFVIFGFPLITM

SEQ ID NO: 332562 - protein, 20 aa, Mycobacterium
TYHRIGLDALWVGLVLLVVS

SEQ ID NO: 332563 - protein, 18 aa, Mycobacterium
TYIDGVRWRVRTVEIPAP

SEQ ID NO: 332564 - protein, 25 aa, Mycobacterium
TYIFIPFQYASFFLGAYYFTATDLS

SEQ ID NO: 332565 - protein, 18 aa, Mycobacterium
TYIFIPFQYLSVVFGAYL

SEQ ID NO: 332566 - protein, 21 aa, Mycobacterium
TYIIAFRFYARLVEMKIVRPR

SEQ ID NO: 332567 - protein, 24 aa, Mycobacterium
TYIPPELCQSVGVAMEPGKPTPDA

SEQ ID NO: 332568 - protein, 19 aa, Mycobacterium
TYLAGATALLGLLTYLASF

SEQ ID NO: 332569 - protein, 19 aa, Mycobacterium
TYLAIGYQHNWLHILGSAF

SEQ ID NO: 332570 - protein, 23 aa, Mycobacterium
TYLCFEGAEKVWGMIRGHKSHGT

SEQ ID NO: 332571 - protein, 18 aa, Mycobacterium
TYLDVCDQVLLLAPGGKT

SEQ ID NO: 332572 - protein, 18 aa, Mycobacterium
TYLDVCDQVLLMAPGGKT

SEQ ID NO: 332573 - protein, 20 aa, Mycobacterium
TYLFMAGMFIMLGWGLFQIY

SEQ ID NO: 332574 - protein, 24 aa, Mycobacterium
TYLGFGSIALWAFRFAWVQVGALG

SEQ ID NO: 332575 - protein, 18 aa, Mycobacterium
TYLMFSWMQVFTASGFAF

SEQ ID NO: 332576 - protein, 18 aa, Mycobacterium
TYLRGDWYRDWGSVEQYF

SEQ ID NO: 332577 - protein, 20 aa, Mycobacterium
TYLSHDWGRDWGSLRKFDTI

SEQ ID NO: 332578 - protein, 20 aa, Mycobacterium
TYNKTWLGFIAIAVIASLIG

SEQ ID NO: 332579 - protein, 27 aa, Mycobacterium
TYPGFPADVLYEFRLASLGTQVVLWAT

SEQ ID NO: 332580 - protein, 19 aa, Mycobacterium
TYPGLKVTLMPSPTVLMLG

SEQ ID NO: 332581 - protein, 18 aa, Mycobacterium
TYPRLIRVAMMYNDQIGY

SEQ ID NO: 332582 - protein, 25 aa, Mycobacterium
TYQPELRESLALRWIMSGASPVPPS

SEQ ID NO: 332583 - protein, 29 aa, Mycobacterium
TYQRLKKPILVWWIAWVVSTATSLFAIAT

SEQ ID NO: 332584 - protein, 23 aa, Mycobacterium
TYRAEVLRQIAAIGLGAGSLAVV

SEQ ID NO: 332585 - protein, 24 aa, Mycobacterium
TYREWKAGSGWTAWQGAGWFLLLL

SEQ ID NO: 332586 - protein, 20 aa, Mycobacterium
TYRVWKARGTWWGWQGAGWF

SEQ ID NO: 332587 - protein, 25 aa, Mycobacterium
TYRVWRRRGRWWVWQGAGWFLLLLM

SEQ ID NO: 332588 - protein, 20 aa, Mycobacterium
TYRYRLRVLVAATFAAGTLA

SEQ ID NO: 332589 - protein, 19 aa, Mycobacterium
TYSGFTIVKTFGHREAAAG

SEQ ID NO: 332590 - protein, 23 aa, Mycobacterium
TYSHLFYQWWLAKAGAVGMAAFA

SEQ ID NO: 332591 - protein, 19 aa, Mycobacterium
TYSQRAVSMLREYADEDRT

SEQ ID NO: 332592 - protein, 25 aa, Mycobacterium
TYSYWFEPNPAWSRLFAPGAEVKQY

SEQ ID NO: 332593 - protein, 30 aa, Mycobacterium
TYTRADCPRYGDLKGPSCFTAPELVVRPDL

SEQ ID NO: 332594 - protein, 27 aa, Mycobacterium
TYVLLRFSLRTPLTFGARGASHSTKFL

SEQ ID NO: 332595 - protein, 29 aa, Mycobacterium
TYVRCTRCNRFICPECMRDAAVGHQCIDC

SEQ ID NO: 332596 - protein, 36 aa, Mycobacterium
TYWQWASLTLAAPVIVWAAWPFHRAAWANLRHGTAT

SEQ ID NO: 332597 - protein, 17 aa, Mycobacterium
TYYGEFKDTGGLNKGDK

SEQ ID NO: 332598 - protein, 18 aa, Mycobacterium
TYYLLRAAVAGVWVAAAF

SEQ ID NO: 332599 - protein, 17 aa, Mycobacterium
VAAAALGYVVWRLFGHI

SEQ ID NO: 332600 - protein, 25 aa, Mycobacterium
VAAADLRPGDVIVVRPGERISADGT

SEQ ID NO: 332601 - protein, 19 aa, Mycobacterium
VAAARWPDRTAIIDDDGAL

SEQ ID NO: 332602 - protein, 17 aa, Mycobacterium
VAAASVDEVLRWLDSSA

SEQ ID NO: 332603 - protein, 17 aa, Mycobacterium
VAAAVACEVKDKATASF

SEQ ID NO: 332604 - protein, 25 aa, Mycobacterium
VAAAVARAVVPLAVVVGATVVGVTA

SEQ ID NO: 332605 - protein, 23 aa, Mycobacterium
VAACAACGIIYELALLTLSASLD

SEQ ID NO: 332606 - protein, 23 aa, Mycobacterium
VAACAACGIIYELALLTLSTSLD

SEQ ID NO: 332607 - protein, 23 aa, Mycobacterium
VAACAACGIVYELALLTLSASLD

SEQ ID NO: 332608 - protein, 17 aa, Mycobacterium
VAACLLLEYGVATAAVA

SEQ ID NO: 332609 - protein, 17 aa, Mycobacterium
VAACLLLEYGVSMSATS

SEQ ID NO: 332610 - protein, 23 aa, Mycobacterium
VAADLKRLLGFSTIENMGLVTLA

SEQ ID NO: 332611 - protein, 22 aa, Mycobacterium
VAADRFGRRRVFILNMVLYAVF

SEQ ID NO: 332612 - protein, 27 aa, Mycobacterium
VAADRLPKLWVMRCSLAVQTALMLTTA

SEQ ID NO: 332613 - protein, 19 aa, Mycobacterium
VAAFAFVFCVILILLRSLV

SEQ ID NO: 332614 - protein, 19 aa, Mycobacterium
VAAFAFVFCVVLLLLRSFV

SEQ ID NO: 332615 - protein, 27 aa, Mycobacterium
VAAFARFLRRSVELMYFVAVPIAVVGV

SEQ ID NO: 332616 - protein, 18 aa, Mycobacterium
VAAFRALIIALILAAGLA

SEQ ID NO: 332617 - protein, 17 aa, Mycobacterium
VAAFRRSRSAAGRTAVA

SEQ ID NO: 332618 - protein, 20 aa, Mycobacterium
VAAFVLALTYRSYRINTIEE

SEQ ID NO: 332619 - protein, 18 aa, Mycobacterium
VAAGACSVLHVWADAGAS

SEQ ID NO: 332620 - protein, 25 aa, Mycobacterium
VAAGAFAGATVWPYLSDRALVDTKV

SEQ ID NO: 332621 - protein, 26 aa, Mycobacterium
VAAGATFWLVRRSLRSVDAIRARVAE

SEQ ID NO: 332622 - protein, 17 aa, Mycobacterium
VAAGCWQSAKAVAVSQA

SEQ ID NO: 332623 - protein, 18 aa, Mycobacterium
VAAGGLLGALLIGGGVFG

SEQ ID NO: 332624 - protein, 25 aa, Mycobacterium
VAAGHPGPGWGLIVAWITVLLLIYH

SEQ ID NO: 332625 - protein, 21 aa, Mycobacterium
VAAGIAFRPAATIAVLLSVSV

SEQ ID NO: 332626 - protein, 17 aa, Mycobacterium
VAAGLFLAGVLQRDGAT

SEQ ID NO: 332627 - protein, 22 aa, Mycobacterium
VAAGLGIVVAKPWRSSAPRPGP

SEQ ID NO: 332628 - protein, 17 aa, Mycobacterium
VAAGLWAVAERIYDAPL

SEQ ID NO: 332629 - protein, 19 aa, Mycobacterium
VAAGMPRVAAIPFSSERQY

SEQ ID NO: 332630 - protein, 23 aa, Mycobacterium
VAAGRRKALAFIEGRSVAELVNL

SEQ ID NO: 332631 - protein, 23 aa, Mycobacterium
VAAGRRKALAFIEGRSVEQLVAL

SEQ ID NO: 332632 - protein, 20 aa, Mycobacterium
VAAGSWLPAVLWGVAFAILV

SEQ ID NO: 332633 - protein, 22 aa, Mycobacterium
VAAGSWPKIRIQAVQHAAEVTG

SEQ ID NO: 332634 - protein, 21 aa, Mycobacterium
VAAGTVFRPAATIAVVLSVAT

SEQ ID NO: 332635 - protein, 17 aa, Mycobacterium
VAAGVWPASASGVAAIT

SEQ ID NO: 332636 - protein, 17 aa, Mycobacterium
VAAGWGWADGVAGIVVT

SEQ ID NO: 332637 - protein, 17 aa, Mycobacterium
VAAGYNVAFAFLGALAG

SEQ ID NO: 332638 - protein, 17 aa, Mycobacterium
VAAHAPYLAWLLESSAK

SEQ ID NO: 332639 - protein, 18 aa, Mycobacterium
VAAHIGELELLYPQPVES

SEQ ID NO: 332640 - protein, 22 aa, Mycobacterium
VAAHVSRFGYWALLAPIAAAGT

SEQ ID NO: 332641 - protein, 22 aa, Mycobacterium
VAAIAILGTVLFTRGKHSKVSQ

SEQ ID NO: 332642 - protein, 27 aa, Mycobacterium
VAAIAVVAVAGWWFLRSDEDTITVTAQ

SEQ ID NO: 332643 - protein, 18 aa, Mycobacterium
VAAICFGAYLLITGVAQV

SEQ ID NO: 332644 - protein, 22 aa, Mycobacterium
VAAICHGVLLAARSIDPATGRS

SEQ ID NO: 332645 - protein, 18 aa, Mycobacterium
VAAICLFAALLWSGSLHA

SEQ ID NO: 332646 - protein, 20 aa, Mycobacterium
VAAIGDWAAGYVRRHPLAAL

SEQ ID NO: 332647 - protein, 18 aa, Mycobacterium
VAAIPAWVAVDRGNSTGF

SEQ ID NO: 332648 - protein, 17 aa, Mycobacterium
VAAIPRPVLGAAAVVMF

SEQ ID NO: 332649 - protein, 24 aa, Mycobacterium
VAAITNLFLPPGMVVNPLNTIEEL

SEQ ID NO: 332650 - protein, 17 aa, Mycobacterium
VAAIYGMNFRFMPELTW

SEQ ID NO: 332651 - protein, 24 aa, Mycobacterium
VAAKLKACPDARVTVNGYSDNGGG

SEQ ID NO: 332652 - protein, 17 aa, Mycobacterium
VAAKLYPLLLLIPLVLL

SEQ ID NO: 332653 - protein, 21 aa, Mycobacterium
VAAKLYPLLLLIPLVLLAVRT

SEQ ID NO: 332654 - protein, 23 aa, Mycobacterium
VAAKRLRPGDIIEIHADEVVPAD

SEQ ID NO: 332655 - protein, 17 aa, Mycobacterium
VAAKTWPWIAAAVAVVV

SEQ ID NO: 332656 - protein, 25 aa, Mycobacterium
VAALAICYRPLLFATVDPEVAAARG

SEQ ID NO: 332657 - protein, 19 aa, Mycobacterium
VAALAPWLLQKLRRADGTT

SEQ ID NO: 332658 - protein, 24 aa, Mycobacterium
VAALAVGAVVCWVTTRVVASVVTL

SEQ ID NO: 332659 - protein, 24 aa, Mycobacterium
VAALCALALAFSPARRLLEAEESS

SEQ ID NO: 332660 - protein, 29 aa, Mycobacterium
VAALCCLGVFCAFILYFALYSRHQLVANS

SEQ ID NO: 332661 - protein, 24 aa, Mycobacterium
VAALCIATSRLLLDVIKTVARLLI

SEQ ID NO: 332662 - protein, 17 aa, Mycobacterium
VAALCLIFGIMLIMTRS

SEQ ID NO: 332663 - protein, 25 aa, Mycobacterium
VAALEAAALIALWRLLARARQENDE

SEQ ID NO: 332664 - protein, 17 aa, Mycobacterium
VAALGLLAYLASFGPMF

SEQ ID NO: 332665 - protein, 19 aa, Mycobacterium
VAALIGLLALPGYYTTYDD

SEQ ID NO: 332666 - protein, 26 aa, Mycobacterium
VAALIRRLGLRSGVGAPIVVEGRLWG

SEQ ID NO: 332667 - protein, 22 aa, Mycobacterium
VAALLPWIGVVIARRGHDVEDH

SEQ ID NO: 332668 - protein, 24 aa, Mycobacterium
VAALQRLGIRISLDDYGTGWSSLA

SEQ ID NO: 332669 - protein, 23 aa, Mycobacterium
VAALRLVPIYVVAAALAASIAVT

SEQ ID NO: 332670 - protein, 20 aa, Mycobacterium
VAALRTELGLDRALPIQFFD

SEQ ID NO: 332671 - protein, 19 aa, Mycobacterium
VAALSEWLGFSSEVGAFLA

SEQ ID NO: 332672 - protein, 19 aa, Mycobacterium
VAALSTWLTAPRDGGRLDP

SEQ ID NO: 332673 - protein, 19 aa, Mycobacterium
VAALTFKGSLGVASIVVFI

SEQ ID NO: 332674 - protein, 30 aa, Mycobacterium
VAALTRPPAVREFFRQAGAIARVSVLPMCM

SEQ ID NO: 332675 - protein, 19 aa, Mycobacterium
VAALTWDVPPGETFAPGVQ

SEQ ID NO: 332676 - protein, 18 aa, Mycobacterium
VAALVCFLLIVTIPFGFA

SEQ ID NO: 332677 - protein, 29 aa, Mycobacterium
VAALVPGGGWRGCAAQAYAAQSLAQSARA

SEQ ID NO: 332678 - protein, 17 aa, Mycobacterium
VAAPFLYQDEMGFSPSA

SEQ ID NO: 332679 - protein, 23 aa, Mycobacterium
VAAPGLAQHGPWIAILTAALTAL

SEQ ID NO: 332680 - protein, 19 aa, Mycobacterium
VAAPIGFVMPMSAGAVLMS

SEQ ID NO: 332681 - protein, 17 aa, Mycobacterium
VAAPVIACLVASCGTWL

SEQ ID NO: 332682 - protein, 19 aa, Mycobacterium
VAAQLGRWFWWPMRTGAIR

SEQ ID NO: 332683 - protein, 22 aa, Mycobacterium
VAAQSWSLDRIKAVKNAANVTV

SEQ ID NO: 332684 - protein, 36 aa, Mycobacterium
VAARADGTPMRRASVLRLFEHRAAEVGLPEENPGVT

SEQ ID NO: 332685 - protein, 25 aa, Mycobacterium
VAARDLRPGSALTYNDIRLETRSAA

SEQ ID NO: 332686 - protein, 17 aa, Mycobacterium
VAARIAAELGIAEVIAE

SEQ ID NO: 332687 - protein, 26 aa, Mycobacterium
VAARVGEPFGSLVLAAAVTVIEVALI

SEQ ID NO: 332688 - protein, 18 aa, Mycobacterium
VAASAFFLLRAVGTSDTI

SEQ ID NO: 332689 - protein, 33 aa, Mycobacterium
VAASESHSDWGWLWWFGGAWAVLAVAGAAVIVL

SEQ ID NO: 332690 - protein, 22 aa, Mycobacterium
VAASFGAPRVWTALSDTRILPA

SEQ ID NO: 332691 - protein, 19 aa, Mycobacterium
VAASGAAVWALPERLRPAV

SEQ ID NO: 332692 - protein, 23 aa, Mycobacterium
VAASLRWRAVLLAAVAACAACGI

SEQ ID NO: 332693 - protein, 21 aa, Mycobacterium
VAASYSWYYAWTPGTGYLANL

SEQ ID NO: 332694 - protein, 19 aa, Mycobacterium
VAATAWRLFDNGQLATHIG

SEQ ID NO: 332695 - protein, 23 aa, Mycobacterium
VAATCTVLAPLAMESRTIASTLA

SEQ ID NO: 332696 - protein, 18 aa, Mycobacterium
VAATEVVVGLGIIMTIFR

SEQ ID NO: 332697 - protein, 18 aa, Mycobacterium
VAATLVFVGGVVALALAL

SEQ ID NO: 332698 - protein, 21 aa, Mycobacterium
VAATLVWLMGIGRDIDAFHGI

SEQ ID NO: 332699 - protein, 19 aa, Mycobacterium
VAAVFGFKLLSPGGFIPLL

SEQ ID NO: 332700 - protein, 17 aa, Mycobacterium
VAAVIAFVGSNAGAKPA

SEQ ID NO: 332701 - protein, 21 aa, Mycobacterium
VAAVIVWKFVGDALSDRSDAA

SEQ ID NO: 332702 - protein, 17 aa, Mycobacterium
VAAVLAFTVAALALALD

SEQ ID NO: 332703 - protein, 22 aa, Mycobacterium
VAAVQRRVRRAALVVLLTDLNA

SEQ ID NO: 332704 - protein, 21 aa, Mycobacterium
VAAVQRRWRLAVATVATPFLA

SEQ ID NO: 332705 - protein, 19 aa, Mycobacterium
VAAVSRWSNLGAHASPSLH

SEQ ID NO: 332706 - protein, 26 aa, Mycobacterium
VAAVTMGALTSWLGFQTHQAHQASEQ

SEQ ID NO: 332707 - protein, 27 aa, Mycobacterium
VAAVTRPAGTFAWIWPSVIAAVAGALV

SEQ ID NO: 332708 - protein, 17 aa, Mycobacterium
VAAVTVIVAAGALWAVR

SEQ ID NO: 332709 - protein, 17 aa, Mycobacterium
VAAWIAVAVIANLAVVL

SEQ ID NO: 332710 - protein, 19 aa, Mycobacterium
VACAIVFGSILGFVAGLIF

SEQ ID NO: 332711 - protein, 17 aa, Mycobacterium
VACGIALGAVVAAIARR

SEQ ID NO: 332712 - protein, 26 aa, Mycobacterium
VACGLAALCYAEFASTVPVAGSAYTF

SEQ ID NO: 332713 - protein, 25 aa, Mycobacterium
VACLALLAWFWPRLVEQGMAVPVTA

SEQ ID NO: 332714 - protein, 18 aa, Mycobacterium
VACLIAGGAMVFAAKPLV

SEQ ID NO: 332715 - protein, 23 aa, Mycobacterium
VACLSFTRLPYFHSLGIPAALGI

SEQ ID NO: 332716 - protein, 18 aa, Mycobacterium
VACPFGETGERMYRTGDL

SEQ ID NO: 332717 - protein, 18 aa, Mycobacterium
VACPFGGRGTRMYRTGDL

SEQ ID NO: 332718 - protein, 19 aa, Mycobacterium
VACQVPIYLMRASKQTALE

SEQ ID NO: 332719 - protein, 19 aa, Mycobacterium
VACQVPIYLMRSSKQTALE

SEQ ID NO: 332720 - protein, 21 aa, Mycobacterium
VADDEAMRWMGRQARARVPVA

SEQ ID NO: 332721 - protein, 17 aa, Mycobacterium
VADDLVWGLPPGTAVDV

SEQ ID NO: 332722 - protein, 18 aa, Mycobacterium
VADFAAMCHTHGWRIAVV

SEQ ID NO: 332723 - protein, 17 aa, Mycobacterium
VADFPVPGWPYLQVFAT

SEQ ID NO: 332724 - protein, 25 aa, Mycobacterium
VADGHPWRWFLIGFMVIFHLNILSN

SEQ ID NO: 332725 - protein, 20 aa, Mycobacterium
VADGLKVIATRSKLMSRLSG

SEQ ID NO: 332726 - protein, 17 aa, Mycobacterium
VADGRRVVLGAADTFRA

SEQ ID NO: 332727 - protein, 20 aa, Mycobacterium
VADIMLMSGLAPLAVAAAAA

SEQ ID NO: 332728 - protein, 20 aa, Mycobacterium
VADKLGLRVDFVGTEFSGLL

SEQ ID NO: 332729 - protein, 32 aa, Mycobacterium
VADPPARGLHAWWGPLSLLLALWVIRAIAHWF

SEQ ID NO: 332730 - protein, 18 aa, Mycobacterium
VADPSTRHLGRWLGPLAI

SEQ ID NO: 332731 - protein, 23 aa, Mycobacterium
VADRAVVVATRLDANALKSNSAA

SEQ ID NO: 332732 - protein, 24 aa, Mycobacterium
VADRLPAVRLDWFTAERTATARQA

SEQ ID NO: 332733 - protein, 24 aa, Mycobacterium
VADRLPGVRLDWFTADNTATARQA

SEQ ID NO: 332734 - protein, 24 aa, Mycobacterium
VADRLPGVRLDWFTAEHTATARQA

SEQ ID NO: 332735 - protein, 25 aa, Mycobacterium
VADRMRFLPWIAFTALWATLVYFPV

SEQ ID NO: 332736 - protein, 24 aa, Mycobacterium
VADTAAGWLFWFALAAAIITAVTW

SEQ ID NO: 332737 - protein, 19 aa, Mycobacterium
VADTMLLSSLAPVSVAAAA

SEQ ID NO: 332738 - protein, 21 aa, Mycobacterium
VADTRSAVYLPGTRNELVVFD

SEQ ID NO: 332739 - protein, 20 aa, Mycobacterium
VADYPAVLLNGSWLSQEQTT

SEQ ID NO: 332740 - protein, 24 aa, Mycobacterium
VADYPTVLLAGSWLEQEQVTAASE

SEQ ID NO: 332741 - protein, 23 aa, Mycobacterium
VAEAAVSLVTRWLSSTIGEGLIL

SEQ ID NO: 332742 - protein, 19 aa, Mycobacterium
VAEALGIGSPASRVVGAAA

SEQ ID NO: 332743 - protein, 18 aa, Mycobacterium
VAEALGIGSPTSRIIAAA

SEQ ID NO: 332744 - protein, 18 aa, Mycobacterium
VAEALGIGSTPSRLIGAA

SEQ ID NO: 332745 - protein, 24 aa, Mycobacterium
VAEELFFRGALYSALGKFYPVVVS

SEQ ID NO: 332746 - protein, 25 aa, Mycobacterium
VAEELFFRGALYTALGRYHPVLIST

SEQ ID NO: 332747 - protein, 19 aa, Mycobacterium
VAEGALLLFLFSVGHALEG

SEQ ID NO: 332748 - protein, 20 aa, Mycobacterium
VAELCGQWTQMWAYGTAFLL

SEQ ID NO: 332749 - protein, 18 aa, Mycobacterium
VAELLAIAGVKYLVLGTG

SEQ ID NO: 332750 - protein, 19 aa, Mycobacterium
VAELPKFRVMPEHKQVATS

SEQ ID NO: 332751 - protein, 32 aa, Mycobacterium
VAELPQKVLAPWHLRLGAFAVDVLSGAAVVAT

SEQ ID NO: 332752 - protein, 21 aa, Mycobacterium
VAEMPRFNRWFMANINGLGGY

SEQ ID NO: 332753 - protein, 18 aa, Mycobacterium
VAEMTMGAGALVMIGGTV

SEQ ID NO: 332754 - protein, 18 aa, Mycobacterium
VAENILYYMVVTFSITYL

SEQ ID NO: 332755 - protein, 25 aa, Mycobacterium
VAEPTSWLRFWFPDPAGSKTEFQRA

SEQ ID NO: 332756 - protein, 18 aa, Mycobacterium
VAERARFVLSVVGVAVAV

SEQ ID NO: 332757 - protein, 17 aa, Mycobacterium
VAERARLVFSVLGVGIA

SEQ ID NO: 332758 - protein, 17 aa, Mycobacterium
VAERVARRPALVAAATI

SEQ ID NO: 332759 - protein, 26 aa, Mycobacterium
VAERWASPFWQIWDMALLWLAMIHGA

SEQ ID NO: 332760 - protein, 22 aa, Mycobacterium
VAESLHALSHAYARYRNGEHTS

SEQ ID NO: 332761 - protein, 25 aa, Mycobacterium
VAESSRPRALITVLAVAAVIALVAA

SEQ ID NO: 332762 - protein, 22 aa, Mycobacterium
VAESWKDLGTNTVKGLPDAVGG

SEQ ID NO: 332763 - protein, 26 aa, Mycobacterium
VAETAWPFLVGTLVGWVVSRGWQRPT

SEQ ID NO: 332764 - protein, 17 aa, Mycobacterium
VAEVDVRTLAGMWTDLL

SEQ ID NO: 332765 - protein, 23 aa, Mycobacterium
VAFAAGWAFNRLMAAARPPRPVR

SEQ ID NO: 332766 - protein, 18 aa, Mycobacterium
VAFAPAVVALVIIAAVTL

SEQ ID NO: 332767 - protein, 31 aa, Mycobacterium
VAFATVIAFWLGRPLIRLSFNNEKFNAAFRY

SEQ ID NO: 332768 - protein, 20 aa, Mycobacterium
VAFAVAALWCHVGGDPRSLR

SEQ ID NO: 332769 - protein, 33 aa, Mycobacterium
VAFDQLWKWNTIVALVLGVLVILGLAGGVRVVR

SEQ ID NO: 332770 - protein, 18 aa, Mycobacterium
VAFEQRYLDWSVWIGVVV

SEQ ID NO: 332771 - protein, 21 aa, Mycobacterium
VAFFAWERFARTRLIDPNGVH

SEQ ID NO: 332772 - protein, 17 aa, Mycobacterium
VAFGPSVVALVIIAAVV

SEQ ID NO: 332773 - protein, 22 aa, Mycobacterium
VAFGVLVVFLLPALRDGASAVP

SEQ ID NO: 332774 - protein, 20 aa, Mycobacterium
VAFGVSWGPVTWVMLGEIFP

SEQ ID NO: 332775 - protein, 18 aa, Mycobacterium
VAFILTFFVTRTFVRLIR

SEQ ID NO: 332776 - protein, 18 aa, Mycobacterium
VAFILTFFVTRTFVRVIR

SEQ ID NO: 332777 - protein, 17 aa, Mycobacterium
VAFLTKMLQAFLVVPGL

SEQ ID NO: 332778 - protein, 19 aa, Mycobacterium
VAFPEHPQMVAARCAASLL

SEQ ID NO: 332779 - protein, 23 aa, Mycobacterium
VAFPRPGLGLTFLTLLTALGLGY

SEQ ID NO: 332780 - protein, 17 aa, Mycobacterium
VAFSFAGAFGLSVLIWQ

SEQ ID NO: 332781 - protein, 21 aa, Mycobacterium
VAFSIWSLWSVMVLFMPASVY

SEQ ID NO: 332782 - protein, 21 aa, Mycobacterium
VAFSVGMLYAGILQLPTWMVK

SEQ ID NO: 332783 - protein, 19 aa, Mycobacterium
VAFTAGFPALSPVMGLTHG

SEQ ID NO: 332784 - protein, 27 aa, Mycobacterium
VAFTLYPRRAVLGLALFIGQAFLYNGV

SEQ ID NO: 332785 - protein, 19 aa, Mycobacterium
VAFVLIGLWTMRKKGPHPA

SEQ ID NO: 332786 - protein, 17 aa, Mycobacterium
VAFVPLDPSWPAHRRRQ

SEQ ID NO: 332787 - protein, 25 aa, Mycobacterium
VAFWIGRPIITLAFRNEKFNAAFRY

SEQ ID NO: 332788 - protein, 18 aa, Mycobacterium
VAGAAILAAVKWGLKDDG

SEQ ID NO: 332789 - protein, 22 aa, Mycobacterium
VAGAEPGVDCPYRETTPPAVDA

SEQ ID NO: 332790 - protein, 17 aa, Mycobacterium
VAGAFVFSDLVMMKYLA

SEQ ID NO: 332791 - protein, 19 aa, Mycobacterium
VAGALAWSYGEPVALLTTV

SEQ ID NO: 332792 - protein, 27 aa, Mycobacterium
VAGALFCLSFTRLPYFQTLGVPAALGV

SEQ ID NO: 332793 - protein, 18 aa, Mycobacterium
VAGAVVWLTGFTRADAIA

SEQ ID NO: 332794 - protein, 24 aa, Mycobacterium
VAGCLGMLGWLAVEQFRDGKPTTF

SEQ ID NO: 332795 - protein, 24 aa, Mycobacterium
VAGCLGMLGWLAVEQIRDGRPTTF

SEQ ID NO: 332796 - protein, 23 aa, Mycobacterium
VAGCLGMLGWLSVEQIRDGKPTT

SEQ ID NO: 332797 - protein, 23 aa, Mycobacterium
VAGCLGMLGWLSVEQIRDGRPTT

SEQ ID NO: 332798 - protein, 20 aa, Mycobacterium
VAGCLLRTGGFALLVVAQSL

SEQ ID NO: 332799 - protein, 19 aa, Mycobacterium
VAGCVAAVLAVRQSGLFTA

SEQ ID NO: 332800 - protein, 23 aa, Mycobacterium
VAGDPAEFWGLKGLIGGNAVKAD

SEQ ID NO: 332801 - protein, 23 aa, Mycobacterium
VAGETGWHPLVVVSQVFFGIAFA

SEQ ID NO: 332802 - protein, 25 aa, Mycobacterium
VAGFSVYRLRGFFGYTDKGPITSGI

SEQ ID NO: 332803 - protein, 19 aa, Mycobacterium
VAGGSFRRWERFLFALIAI

SEQ ID NO: 332804 - protein, 27 aa, Mycobacterium
VAGGSFRRWERLMFLLIAVNVLIIPMV

SEQ ID NO: 332805 - protein, 17 aa, Mycobacterium
VAGGVRAAFGFSLDDVV

SEQ ID NO: 332806 - protein, 17 aa, Mycobacterium
VAGHVISAYALGVVVGA

SEQ ID NO: 332807 - protein, 30 aa, Mycobacterium
VAGIGGVFSRRWAKLWLPITAGVYTANGLM

SEQ ID NO: 332808 - protein, 17 aa, Mycobacterium
VAGIPGPLVAIVVVTAI

SEQ ID NO: 332809 - protein, 28 aa, Mycobacterium
VAGISHKRWLRWPARVYTDIFRGLPEVV

SEQ ID NO: 332810 - protein, 25 aa, Mycobacterium
VAGKESFPASFIVKLNNPEQHADFD

SEQ ID NO: 332811 - protein, 19 aa, Mycobacterium
VAGKTVAYAAVFTDVYGLR

SEQ ID NO: 332812 - protein, 19 aa, Mycobacterium
VAGLARLGLGISDQTVVFM

SEQ ID NO: 332813 - protein, 18 aa, Mycobacterium
VAGLAVSESVSWPGWAVV

SEQ ID NO: 332814 - protein, 27 aa, Mycobacterium
VAGLCALCLYCESLGPLGHEVSLAIAL

SEQ ID NO: 332815 - protein, 23 aa, Mycobacterium
VAGLCIPIFLSGRRVSRMEGGLM

SEQ ID NO: 332816 - protein, 18 aa, Mycobacterium
VAGLGVGTLIGWGLLELF

SEQ ID NO: 332817 - protein, 22 aa, Mycobacterium
VAGLGWLIGVWQPLLLWTPLGI

SEQ ID NO: 332818 - protein, 26 aa, Mycobacterium
VAGLLKRRWPAPVVFALFLVGAALVS

SEQ ID NO: 332819 - protein, 27 aa, Mycobacterium
VAGLLKRRWVVPAAFVFFLAATAYLSY

SEQ ID NO: 332820 - protein, 21 aa, Mycobacterium
VAGLLQLIGLVGFVGFGRIYL

SEQ ID NO: 332821 - protein, 18 aa, Mycobacterium
VAGLLVGELVWWERAGLL

SEQ ID NO: 332822 - protein, 21 aa, Mycobacterium
VAGLPVCWLGYALMSGPIWQY

SEQ ID NO: 332823 - protein, 29 aa, Mycobacterium
VAGLRATMLAHWVWLCLLLAGAAGMAGCW

SEQ ID NO: 332824 - protein, 18 aa, Mycobacterium
VAGLRLAVVYALIGTIAM

SEQ ID NO: 332825 - protein, 24 aa, Mycobacterium
VAGLSRGLVPLALMVFGFGMVIGN

SEQ ID NO: 332826 - protein, 20 aa, Mycobacterium
VAGLVALYIVVQRARQQRIL

SEQ ID NO: 332827 - protein, 17 aa, Mycobacterium
VAGLVLLYLFLPIFVIV

SEQ ID NO: 332828 - protein, 24 aa, Mycobacterium
VAGLVVCAYLRLPAALIAVAALGL

SEQ ID NO: 332829 - protein, 18 aa, Mycobacterium
VAGLWGVLRIYQYERFFD

SEQ ID NO: 332830 - protein, 26 aa, Mycobacterium
VAGMPRALVPVALMVFGLGMFFGNLV

SEQ ID NO: 332831 - protein, 26 aa, Mycobacterium
VAGPLRPGHWLMFAVISAATLGAMVA

SEQ ID NO: 332832 - protein, 22 aa, Mycobacterium
VAGPVARPAKPRLLQDGRDMFW

SEQ ID NO: 332833 - protein, 20 aa, Mycobacterium
VAGQVLRPKLYRVLSHTTLT

SEQ ID NO: 332834 - protein, 24 aa, Mycobacterium
VAGRDGRAPWDLDAVIEPGAVTVL

SEQ ID NO: 332835 - protein, 24 aa, Mycobacterium
VAGRLRVAAFQTLLLSLLPRVLDA

SEQ ID NO: 332836 - protein, 22 aa, Mycobacterium
VAGRMPGHMNVLLAEADVAYDA

SEQ ID NO: 332837 - protein, 21 aa, Mycobacterium
VAGRMPGHMNVLLAEADVEYD

SEQ ID NO: 332838 - protein, 21 aa, Mycobacterium
VAGRMPGHMNVLLAEAEVDYD

SEQ ID NO: 332839 - protein, 22 aa, Mycobacterium
VAGRPALAAVDLFIVVQANLAM

SEQ ID NO: 332840 - protein, 28 aa, Mycobacterium
VAGRTVPYTAVFTDVFGLREGDDVRMAG

SEQ ID NO: 332841 - protein, 17 aa, Mycobacterium
VAGRWLFGIYGAAAAIA

SEQ ID NO: 332842 - protein, 21 aa, Mycobacterium
VAGSVLEYAGWAVAMHLWFLA

SEQ ID NO: 332843 - protein, 19 aa, Mycobacterium
VAGSYRKTRLVPFGEYVPL

SEQ ID NO: 332844 - protein, 28 aa, Mycobacterium
VAGTMLLRLCMLPGLALLIWAAPRLAQH

SEQ ID NO: 332845 - protein, 28 aa, Mycobacterium
VAGTMLLRLCMLPGLALLIWAAPRVARH

SEQ ID NO: 332846 - protein, 28 aa, Mycobacterium
VAGTMLLRLCMLPGLALLIWATPRVARH

SEQ ID NO: 332847 - protein, 28 aa, Mycobacterium
VAGTMLLRLCMLPGLALLVWATPRVAQF

SEQ ID NO: 332848 - protein, 29 aa, Mycobacterium
VAGTMLLRLCMLPGLLLLIWAAPRVARHV

SEQ ID NO: 332849 - protein, 25 aa, Mycobacterium
VAGVAALVRSRFPALTGPQVRERLT

SEQ ID NO: 332850 - protein, 18 aa, Mycobacterium
VAGVAALVRSRYPELTAP

SEQ ID NO: 332851 - protein, 18 aa, Mycobacterium
VAGVAILAAIRWGLKDDG

SEQ ID NO: 332852 - protein, 21 aa, Mycobacterium
VAGVIPWWVVGLLLGRDAVLA

SEQ ID NO: 332853 - protein, 32 aa, Mycobacterium
VAGVLCALAVGLKFRLGFDDSLDVVGVHLVGG

SEQ ID NO: 332854 - protein, 27 aa, Mycobacterium
VAGVLVAFLAWWFPRQAGGGANNASGA

SEQ ID NO: 332855 - protein, 22 aa, Mycobacterium
VAGVMWKRFTETGAIKAKSVII

SEQ ID NO: 332856 - protein, 25 aa, Mycobacterium
VAGVSSFGFGGANAHVVVREVLPRD

SEQ ID NO: 332857 - protein, 18 aa, Mycobacterium
VAGWAGHLMVGVFFGVGL

SEQ ID NO: 332858 - protein, 25 aa, Mycobacterium
VAGWNRLGSQTAFYVKALSLVWDAV

SEQ ID NO: 332859 - protein, 25 aa, Mycobacterium
VAGYRVGAWLPTRVALLVVPLLAAG

SEQ ID NO: 332860 - protein, 18 aa, Mycobacterium
VAGYVSLFLLAAMVGVLY

SEQ ID NO: 332861 - protein, 18 aa, Mycobacterium
VAHCAWARSPGPDSRIGQ

SEQ ID NO: 332862 - protein, 19 aa, Mycobacterium
VAHIPRLTPARALTPPPTP

SEQ ID NO: 332863 - protein, 30 aa, Mycobacterium
VAHLLDTLSLFVGWLWPLWDSRRRTFADMV

SEQ ID NO: 332864 - protein, 18 aa, Mycobacterium
VAHLMKVLATTAIEAVDA

SEQ ID NO: 332865 - protein, 19 aa, Mycobacterium
VAHRIVWSTVFLMLVLAFA

SEQ ID NO: 332866 - protein, 23 aa, Mycobacterium
VAHWVWSPSGWLAKMGVLDYAGG

SEQ ID NO: 332867 - protein, 19 aa, Mycobacterium
VAIACILGALTLFSGPTGI

SEQ ID NO: 332868 - protein, 21 aa, Mycobacterium
VAIALRIGRGTLRKMRQNLGW

SEQ ID NO: 332869 - protein, 19 aa, Mycobacterium
VAIALSLLAMLLIRQLRRR

SEQ ID NO: 332870 - protein, 20 aa, Mycobacterium
VAIAPRRWGLRDTLEAADHQ

SEQ ID NO: 332871 - protein, 17 aa, Mycobacterium
VAIAVIGLMLVRALFLD

SEQ ID NO: 332872 - protein, 17 aa, Mycobacterium
VAIAVIMLRAGRPARHH

SEQ ID NO: 332873 - protein, 24 aa, Mycobacterium
VAIFLCGVCSIPGRHTITDPYVLG

SEQ ID NO: 332874 - protein, 17 aa, Mycobacterium
VAIGALFAVVFAVAYGR

SEQ ID NO: 332875 - protein, 18 aa, Mycobacterium
VAIGALFAVVFAVAYGRV

SEQ ID NO: 332876 - protein, 33 aa, Mycobacterium
VAIGCSLALVAHCVRRFGGITGDVLGAAVEVTT

SEQ ID NO: 332877 - protein, 17 aa, Mycobacterium
VAIGFPIAGRRDPALDE

SEQ ID NO: 332878 - protein, 18 aa, Mycobacterium
VAIGTVLLWRHRSERIGT

SEQ ID NO: 332879 - protein, 25 aa, Mycobacterium
VAIHLLVSMAMVWLAVLLFVKIGEP

SEQ ID NO: 332880 - protein, 36 aa, Mycobacterium
VAIILGICVASMLIAQAMVRPVRRLEAGTQKISAGD

SEQ ID NO: 332881 - protein, 22 aa, Mycobacterium
VAIKSRRMWSGLRSMPLREVLR

SEQ ID NO: 332882 - protein, 24 aa, Mycobacterium
VAILAVTGYLIFKPSGQAPVKRVD

SEQ ID NO: 332883 - protein, 23 aa, Mycobacterium
VAIMLPTCREYFVTFAGVALAGA

SEQ ID NO: 332884 - protein, 17 aa, Mycobacterium
VAINVRPAADVRAQPVT

SEQ ID NO: 332885 - protein, 17 aa, Mycobacterium
VAIPAAWTQLHVVDADG

SEQ ID NO: 332886 - protein, 17 aa, Mycobacterium
VAIPSLIGFLILIASTR

SEQ ID NO: 332887 - protein, 19 aa, Mycobacterium
VAIPVCLSPGAGAIQSMSS

SEQ ID NO: 332888 - protein, 19 aa, Mycobacterium
VAITFVWLGMVLAISFLEA

SEQ ID NO: 332889 - protein, 18 aa, Mycobacterium
VAITGYSKFWWPDIPAWL

SEQ ID NO: 332890 - protein, 18 aa, Mycobacterium
VAITGYSKFWWPDVPTWA

SEQ ID NO: 332891 - protein, 25 aa, Mycobacterium
VAITSRVVLRWSWTPLLVLGSVATL

SEQ ID NO: 332892 - protein, 17 aa, Mycobacterium
VAIVGAGVILWRVRRES

SEQ ID NO: 332893 - protein, 17 aa, Mycobacterium
VAIVGGFAIAAVTGHVL

SEQ ID NO: 332894 - protein, 27 aa, Mycobacterium
VAIVIAAPCYPMFGAWSDRVGRSRVML

SEQ ID NO: 332895 - protein, 24 aa, Mycobacterium
VAIVLVCANHVGLTYLFGGAHVLL

SEQ ID NO: 332896 - protein, 27 aa, Mycobacterium
VAIWHYQPRAMDWPAPISAPGPGANVK

SEQ ID NO: 332897 - protein, 23 aa, Mycobacterium
VAIWLGHPLIWLSFNNEKLNAAF

SEQ ID NO: 332898 - protein, 24 aa, Mycobacterium
VAKFKAPEQVVIWDALPKNDAGKV

SEQ ID NO: 332899 - protein, 20 aa, Mycobacterium
VAKIPPAWVLPRMLIEAPFL

SEQ ID NO: 332900 - protein, 18 aa, Mycobacterium
VAKLWPGGVEKLADEQGW

SEQ ID NO: 332901 - protein, 23 aa, Mycobacterium
VAKRSHFPRVRFFEDDIEDDFDD

SEQ ID NO: 332902 - protein, 19 aa, Mycobacterium
VAKSGAAFLPLDPEYPRER

SEQ ID NO: 332903 - protein, 18 aa, Mycobacterium
VALAAFRFLLPGDDHDDH

SEQ ID NO: 332904 - protein, 19 aa, Mycobacterium
VALAAWAALAARVPTEVAP

SEQ ID NO: 332905 - protein, 18 aa, Mycobacterium
VALACARGVVAVLAYNNA

SEQ ID NO: 332906 - protein, 18 aa, Mycobacterium
VALACLLLPAGAIGDRYG

SEQ ID NO: 332907 - protein, 17 aa, Mycobacterium
VALAEKLFSRWGVRAVF

SEQ ID NO: 332908 - protein, 34 aa, Mycobacterium
VALAFGCAIVRWSIWPSKRQSVVLILALNLAIAL

SEQ ID NO: 332909 - protein, 17 aa, Mycobacterium
VALALAALVIFPMYFLR

SEQ ID NO: 332910 - protein, 19 aa, Mycobacterium
VALAPRYAAPAPDAIYGNN

SEQ ID NO: 332911 - protein, 25 aa, Mycobacterium
VALARLRLQVFVNLPSLPALLTGLG

SEQ ID NO: 332912 - protein, 24 aa, Mycobacterium
VALARRWVATLGAFNGRLAAAGAY

SEQ ID NO: 332913 - protein, 17 aa, Mycobacterium
VALAVAVHVARRTMRTN

SEQ ID NO: 332914 - protein, 17 aa, Mycobacterium
VALAVAVPAAWAQTHII

SEQ ID NO: 332915 - protein, 25 aa, Mycobacterium
VALCGVVCFVGFLASYLFNVYVQGG

SEQ ID NO: 332916 - protein, 21 aa, Mycobacterium
VALCVLGVIGWRQRRSSVARL

SEQ ID NO: 332917 - protein, 17 aa, Mycobacterium
VALDILLFYVFFEAMLI

SEQ ID NO: 332918 - protein, 21 aa, Mycobacterium
VALDKWLRRRTASVVHVPTPP

SEQ ID NO: 332919 - protein, 19 aa, Mycobacterium
VALEVALAINIRPTVALLP

SEQ ID NO: 332920 - protein, 25 aa, Mycobacterium
VALFFIWMIAVAFLYLVLGGMGVWA

SEQ ID NO: 332921 - protein, 36 aa, Mycobacterium
VALFILSAAMTGCFVSICGAVGFVGLVIPHAARLLV

SEQ ID NO: 332922 - protein, 18 aa, Mycobacterium
VALFLIERNMDFLTGEAV

SEQ ID NO: 332923 - protein, 19 aa, Mycobacterium
VALFMGVCTVVFIGLGCVG

SEQ ID NO: 332924 - protein, 26 aa, Mycobacterium
VALFVGEVLRYLGFTLKNYRKEVLRL

SEQ ID NO: 332925 - protein, 17 aa, Mycobacterium
VALFVVDVALVATGAAV

SEQ ID NO: 332926 - protein, 18 aa, Mycobacterium
VALFWPAGTFDYWQAWVF

SEQ ID NO: 332927 - protein, 17 aa, Mycobacterium
VALGALLWRSLNPDTTP

SEQ ID NO: 332928 - protein, 29 aa, Mycobacterium
VALGICVLLFPVVQPWYLLWAIIPLACWA

SEQ ID NO: 332929 - protein, 22 aa, Mycobacterium
VALGQQCARRPLPLLPAMAKVL

SEQ ID NO: 332930 - protein, 25 aa, Mycobacterium
VALGQQCARRPLPLVTALAKVVVAA

SEQ ID NO: 332931 - protein, 29 aa, Mycobacterium
VALGVGNTVGWRFALAGWIVTAGVYVVWT

SEQ ID NO: 332932 - protein, 19 aa, Mycobacterium
VALGVPGWNVRAYVLDDYL

SEQ ID NO: 332933 - protein, 27 aa, Mycobacterium
VALGVVALVWFCFHCARVPNPFVNVRL

SEQ ID NO: 332934 - protein, 17 aa, Mycobacterium
VALGVVFPLYLNTFSAI

SEQ ID NO: 332935 - protein, 23 aa, Mycobacterium
VALHECGHMWAARATGMKVRRYF

SEQ ID NO: 332936 - protein, 24 aa, Mycobacterium
VALIAVGIGLRLVFGEMTLATGLT

SEQ ID NO: 332937 - protein, 24 aa, Mycobacterium
VALIAVGIGLRLVFGEMTLTTGLT

SEQ ID NO: 332938 - protein, 17 aa, Mycobacterium
VALIDAKSGRQTTYREM

SEQ ID NO: 332939 - protein, 26 aa, Mycobacterium
VALIGWASGLGFGWLFTLGTANVVRS

SEQ ID NO: 332940 - protein, 26 aa, Mycobacterium
VALIIAIGVFLAWRAIPALARNKENF

SEQ ID NO: 332941 - protein, 24 aa, Mycobacterium
VALIKAVIFGAIVAVVSCQKGLST

SEQ ID NO: 332942 - protein, 17 aa, Mycobacterium
VALIPMAALVAVMIMVS

SEQ ID NO: 332943 - protein, 17 aa, Mycobacterium
VALIVYFVMLGRAAFVF

SEQ ID NO: 332944 - protein, 31 aa, Mycobacterium
VALKMLWPSSPRWLGVPLYILLGWVAVWFIG

SEQ ID NO: 332945 - protein, 18 aa, Mycobacterium
VALLAAALSRHFRRVVLV

SEQ ID NO: 332946 - protein, 25 aa, Mycobacterium
VALLAFGAGLAWLAMDRRRIRDAER

SEQ ID NO: 332947 - protein, 23 aa, Mycobacterium
VALLDVHFAYVPGRPVLPGLDLV

SEQ ID NO: 332948 - protein, 25 aa, Mycobacterium
VALLGFPVWMIFVLNTAGLLFQIPC

SEQ ID NO: 332949 - protein, 18 aa, Mycobacterium
VALLGYVIVDAFDGQVTA

SEQ ID NO: 332950 - protein, 18 aa, Mycobacterium
VALLLCYLGGIVSAFASS

SEQ ID NO: 332951 - protein, 17 aa, Mycobacterium
VALLLERTHLIPIAVLA

SEQ ID NO: 332952 - protein, 25 aa, Mycobacterium
VALLPISWPLGIAALGGVPLLLGAL

SEQ ID NO: 332953 - protein, 19 aa, Mycobacterium
VALLPRLFGSVTVEPERVS

SEQ ID NO: 332954 - protein, 19 aa, Mycobacterium
VALLPRLFRPATVKPDRVA

SEQ ID NO: 332955 - protein, 17 aa, Mycobacterium
VALLSMFTIGLPRAAAS

SEQ ID NO: 332956 - protein, 18 aa, Mycobacterium
VALLTIPITIRFVPETFR

SEQ ID NO: 332957 - protein, 25 aa, Mycobacterium
VALLTTVIFAIRWRRDEELESVKRE

SEQ ID NO: 332958 - protein, 25 aa, Mycobacterium
VALLTWQVLRLRTGPAPMLSPVVGL

SEQ ID NO: 332959 - protein, 25 aa, Mycobacterium
VALLVGFGVMIGRLLEITGGAQVLA

SEQ ID NO: 332960 - protein, 24 aa, Mycobacterium
VALLVGFGVMIGRLLETTGGAQVL

SEQ ID NO: 332961 - protein, 26 aa, Mycobacterium
VALLVLRGAVLPALLAHALGAEDAPR

SEQ ID NO: 332962 - protein, 17 aa, Mycobacterium
VALLVTLAIILAALAVL

SEQ ID NO: 332963 - protein, 19 aa, Mycobacterium
VALLVWVFPVGNLTALTTR

SEQ ID NO: 332964 - protein, 28 aa, Mycobacterium
VALMRRSRLPAVRWVAGVYIWVIRGTPL

SEQ ID NO: 332965 - protein, 17 aa, Mycobacterium
VALMRWTPIDLLPKHHE

SEQ ID NO: 332966 - protein, 17 aa, Mycobacterium
VALNFLLCIGYLLFSLT

SEQ ID NO: 332967 - protein, 19 aa, Mycobacterium
VALPAARLGAGATVGPGSL

SEQ ID NO: 332968 - protein, 23 aa, Mycobacterium
VALPDGRHVWEFAPREATDLAAL

SEQ ID NO: 332969 - protein, 23 aa, Mycobacterium
VALPDGRHVWEYNPRGLTDLPAL

SEQ ID NO: 332970 - protein, 25 aa, Mycobacterium
VALPKAGTSFARWAALLEEHAYDRD

SEQ ID NO: 332971 - protein, 20 aa, Mycobacterium
VALPLALAFGISSGVGAAAG

SEQ ID NO: 332972 - protein, 20 aa, Mycobacterium
VALPLSFLVLVWVFGGVFAA

SEQ ID NO: 332973 - protein, 22 aa, Mycobacterium
VALPLSFPSLGQMAAKNPLQIL

SEQ ID NO: 332974 - protein, 20 aa, Mycobacterium
VALPQMRFNIDIKADSAVEP

SEQ ID NO: 332975 - protein, 22 aa, Mycobacterium
VALPTFVCTTVLSGRLSRHFGE

SEQ ID NO: 332976 - protein, 19 aa, Mycobacterium
VALPVPLPTHRLVIGAVLA

SEQ ID NO: 332977 - protein, 17 aa, Mycobacterium
VALRERTDLVASHTKKV

SEQ ID NO: 332978 - protein, 17 aa, Mycobacterium
VALRPGGPAGEYTVNYR

SEQ ID NO: 332979 - protein, 19 aa, Mycobacterium
VALRQSWIGWVVVAFSVGM

SEQ ID NO: 332980 - protein, 18 aa, Mycobacterium
VALRVRLQKALPPLWADE

SEQ ID NO: 332981 - protein, 33 aa, Mycobacterium
VALSAAALLVWRLRWASAGGWLAPTIFGVTALV

SEQ ID NO: 332982 - protein, 26 aa, Mycobacterium
VALSKVIAKAIGWDGEGNPLAPPLTP

SEQ ID NO: 332983 - protein, 25 aa, Mycobacterium
VALSRRPTFSAGRVRRVDVADLVVG

SEQ ID NO: 332984 - protein, 19 aa, Mycobacterium
VALTFVWLGMVLAISFLEA

SEQ ID NO: 332985 - protein, 26 aa, Mycobacterium
VALTGVVCFAGFFASYMFNVYFQNGA

SEQ ID NO: 332986 - protein, 26 aa, Mycobacterium
VALTGVVCFVGFFASYMFNVYFQNGA

SEQ ID NO: 332987 - protein, 29 aa, Mycobacterium
VALTGVVCFVGFIASFLFNVYFQDGAPGS

SEQ ID NO: 332988 - protein, 26 aa, Mycobacterium
VALTGVVCFVGFLASYLFNVYFQNGA

SEQ ID NO: 332989 - protein, 22 aa, Mycobacterium
VALTVLWLLNIGEYLQDLTLRR

SEQ ID NO: 332990 - protein, 24 aa, Mycobacterium
VALVCAAALLALRRAGLLDPGRAS

SEQ ID NO: 332991 - protein, 19 aa, Mycobacterium
VALVGFLFVGRLIGDRLVD

SEQ ID NO: 332992 - protein, 38 aa, Mycobacterium
VALVGGLLYWVWPSRGTYKIVGHFASAVGLYPGDDVRI

SEQ ID NO: 332993 - protein, 18 aa, Mycobacterium
VALVGLLTLPGYRTNYND

SEQ ID NO: 332994 - protein, 24 aa, Mycobacterium
VALVIATAVAVSWTARALGMDSHT

SEQ ID NO: 332995 - protein, 24 aa, Mycobacterium
VALVIATAVAVSWTARALGMNPHA

SEQ ID NO: 332996 - protein, 20 aa, Mycobacterium
VALVIRYLVHRMIDRATTGR

SEQ ID NO: 332997 - protein, 20 aa, Mycobacterium
VALVIWGSAVVAGFESVTKL

SEQ ID NO: 332998 - protein, 30 aa, Mycobacterium
VALVLMAWGAFRLWRWRRRRAKSTHPSPPQ

SEQ ID NO: 332999 - protein, 17 aa, Mycobacterium
VALVVMCVAAATLTVLA

SEQ ID NO: 333000 - protein, 18 aa, Mycobacterium
VALWVLPRAIALARAALR

SEQ ID NO: 333001 - protein, 18 aa, Mycobacterium
VALWVLPRAIALARDALR

SEQ ID NO: 333002 - protein, 26 aa, Mycobacterium
VALYLGALLRLPRWLLDLSPVGRTTA

SEQ ID NO: 333003 - protein, 25 aa, Mycobacterium
VAMAGGFLTVFGVFGLVVSPVVASA

SEQ ID NO: 333004 - protein, 19 aa, Mycobacterium
VAMGLSFATVFLYAGTMST

SEQ ID NO: 333005 - protein, 25 aa, Mycobacterium
VAMLAFGAGLAWLAMDRRRIRQAQR

SEQ ID NO: 333006 - protein, 19 aa, Mycobacterium
VAMLPTLLVAIPFTVLVSF

SEQ ID NO: 333007 - protein, 20 aa, Mycobacterium
VAMLSVGLLFKVGAVPFHFW

SEQ ID NO: 333008 - protein, 31 aa, Mycobacterium
VAMRAWWQTGRSVFWPLAIGLIGLAALAGSF

SEQ ID NO: 333009 - protein, 19 aa, Mycobacterium
VAMSGVFYAPAFAALTRYF

SEQ ID NO: 333010 - protein, 23 aa, Mycobacterium
VANARKALAQAFNVRQILDDDVP

SEQ ID NO: 333011 - protein, 24 aa, Mycobacterium
VANGIWWTGVFPGIAIVLVVLGMT

SEQ ID NO: 333012 - protein, 21 aa, Mycobacterium
VANKRWARWQYLAATVIGGAS

SEQ ID NO: 333013 - protein, 28 aa, Mycobacterium
VANLCGELACGILAIRLSARRLAMGALT

SEQ ID NO: 333014 - protein, 18 aa, Mycobacterium
VANLCLAVSIYLDARPEP

SEQ ID NO: 333015 - protein, 23 aa, Mycobacterium
VANLELYLIFPLANEQATITLVR

SEQ ID NO: 333016 - protein, 23 aa, Mycobacterium
VANLELYLIFPLKNEQATIQLVR

SEQ ID NO: 333017 - protein, 23 aa, Mycobacterium
VANLELYLIFPLKNEQATITLVR

SEQ ID NO: 333018 - protein, 17 aa, Mycobacterium
VANLHWQGRTFDIAIGP

SEQ ID NO: 333019 - protein, 29 aa, Mycobacterium
VANYWVMSHMLPLFRRMQGLIDGINRVMR

SEQ ID NO: 333020 - protein, 23 aa, Mycobacterium
VAPARARPVWVVPEARAVTAATR

SEQ ID NO: 333021 - protein, 25 aa, Mycobacterium
VAPDSPHDWIECGEWIRELRPHIDL

SEQ ID NO: 333022 - protein, 27 aa, Mycobacterium
VAPEAFPEVFPEFSAPQGRTGRHAAAE

SEQ ID NO: 333023 - protein, 27 aa, Mycobacterium
VAPGVVMGQAIGRLGNYFNQELYGRET

SEQ ID NO: 333024 - protein, 29 aa, Mycobacterium
VAPKRPSRWRHVPAILLALSLVLLTTAMA

SEQ ID NO: 333025 - protein, 25 aa, Mycobacterium
VAPLKFAQLVGFVFAALSTLGFAGG

SEQ ID NO: 333026 - protein, 27 aa, Mycobacterium
VAPLKFAQLVGLIFALAGVAAFAAGAF

SEQ ID NO: 333027 - protein, 31 aa, Mycobacterium
VAPLVRKTAAWSWRLLVILAALVALLLVIKK

SEQ ID NO: 333028 - protein, 25 aa, Mycobacterium
VAPMVISRWTLLVWILAAVGSGMGY

SEQ ID NO: 333029 - protein, 25 aa, Mycobacterium
VAPNYACFVAAWILAGVAMSGVFYA

SEQ ID NO: 333030 - protein, 25 aa, Mycobacterium
VAPQRLGQMLAELMTLFAAGKLHRL

SEQ ID NO: 333031 - protein, 24 aa, Mycobacterium
VAPRLLVELVAGFLGGLVGFVVLG

SEQ ID NO: 333032 - protein, 17 aa, Mycobacterium
VAPYWYPYWQQWAPVAP

SEQ ID NO: 333033 - protein, 17 aa, Mycobacterium
VAQAAGFVRQHAAGLQM

SEQ ID NO: 333034 - protein, 22 aa, Mycobacterium
VAQAEAALRCPATQAVLNSVRA

SEQ ID NO: 333035 - protein, 28 aa, Mycobacterium
VAQCVKAEMLAASSWRVAVNAGSESSAR

SEQ ID NO: 333036 - protein, 24 aa, Mycobacterium
VAQFGWRATCLITVAAGVLQLILG

SEQ ID NO: 333037 - protein, 18 aa, Mycobacterium
VAQFGWRETCFITVVAGV

SEQ ID NO: 333038 - protein, 17 aa, Mycobacterium
VAQIAEWQERIAENPGN

SEQ ID NO: 333039 - protein, 18 aa, Mycobacterium
VAQIAFLVVAAFLLTNKV

SEQ ID NO: 333040 - protein, 17 aa, Mycobacterium
VAQIVLLDNRFATLPYV

SEQ ID NO: 333041 - protein, 17 aa, Mycobacterium
VAQLAFLVVAVFLLTNK

SEQ ID NO: 333042 - protein, 18 aa, Mycobacterium
VAQLPVRVVSAFIDIFVQ

SEQ ID NO: 333043 - protein, 21 aa, Mycobacterium
VAQLRRDGYHIAMLTGDNHTT

SEQ ID NO: 333044 - protein, 21 aa, Mycobacterium
VAQRQWRWPLGEIDKPFEMRR

SEQ ID NO: 333045 - protein, 24 aa, Mycobacterium
VAQWRLQVSVAGWRHRDPGGILSD

SEQ ID NO: 333046 - protein, 17 aa, Mycobacterium
VARAARAGILMKGGAAL

SEQ ID NO: 333047 - protein, 19 aa, Mycobacterium
VARARVVEAPRVPDHAVTP

SEQ ID NO: 333048 - protein, 31 aa, Mycobacterium
VARCEYHPTPGCPQTRITGVPGQGPETRTAN

SEQ ID NO: 333049 - protein, 29 aa, Mycobacterium
VARERGWEIRDFRTARKAARIGVPSALAL

SEQ ID NO: 333050 - protein, 24 aa, Mycobacterium
VARGLRILPAFYICLIITAVVIAP

SEQ ID NO: 333051 - protein, 21 aa, Mycobacterium
VARGPVVWVRVWPAVTAGPGV

SEQ ID NO: 333052 - protein, 18 aa, Mycobacterium
VARGWIVAAIGALVVAVT

SEQ ID NO: 333053 - protein, 26 aa, Mycobacterium
VARPYEWWRVALVSISALAYVVIFSI

SEQ ID NO: 333054 - protein, 26 aa, Mycobacterium
VARPYQWWRVALVALSGLGYVAIFAI

SEQ ID NO: 333055 - protein, 26 aa, Mycobacterium
VARPYQWWRVALVIVSGLAYVVIFSL

SEQ ID NO: 333056 - protein, 22 aa, Mycobacterium
VARRRLTAAQARSVRKDPDRIT

SEQ ID NO: 333057 - protein, 25 aa, Mycobacterium
VARVLFDWRFDLLFGTAAIVGALVY

SEQ ID NO: 333058 - protein, 28 aa, Mycobacterium
VARVSIFKLARYLAREYLLIVATSSSES

SEQ ID NO: 333059 - protein, 22 aa, Mycobacterium
VARVWTKAFWRPRSDAPEGDLA

SEQ ID NO: 333060 - protein, 21 aa, Mycobacterium
VASAWLRPAGTVAVVLVVGAI

SEQ ID NO: 333061 - protein, 17 aa, Mycobacterium
VASCLLLEYGVATAAVA

SEQ ID NO: 333062 - protein, 43 aa, Mycobacterium
VASDPSARCLRCWLGSLLILSALWALRAVTHWLQARLGQRGAS

SEQ ID NO: 333063 - protein, 21 aa, Mycobacterium
VASGVPLPLLLFGVALTGLVA

SEQ ID NO: 333064 - protein, 17 aa, Mycobacterium
VASHALSALNFMLPAGE

SEQ ID NO: 333065 - protein, 20 aa, Mycobacterium
VASHELRTPLTAMRTNLEVL

SEQ ID NO: 333066 - protein, 17 aa, Mycobacterium
VASLALSEATSWPTWAV

SEQ ID NO: 333067 - protein, 23 aa, Mycobacterium
VASLSWTLALLLGHPEHLRRLYA

SEQ ID NO: 333068 - protein, 28 aa, Mycobacterium
VASPGRPWPRVVGALALAVLGACGVMLL

SEQ ID NO: 333069 - protein, 20 aa, Mycobacterium
VASPLTAVVLNFSEEINPAF

SEQ ID NO: 333070 - protein, 25 aa, Mycobacterium
VASQRFLPRLVILVVVALIITAVVY

SEQ ID NO: 333071 - protein, 20 aa, Mycobacterium
VASRLLPDRMLAGIDDVARE

SEQ ID NO: 333072 - protein, 25 aa, Mycobacterium
VASRPELLEGIGRRVLAWVNSIRGR

SEQ ID NO: 333073 - protein, 18 aa, Mycobacterium
VASSRWWISGTLIGLAGG

SEQ ID NO: 333074 - protein, 19 aa, Mycobacterium
VASVALVFVAILVPVLVLV

SEQ ID NO: 333075 - protein, 21 aa, Mycobacterium
VASVLPVWLLLAPRDYLSTFM

SEQ ID NO: 333076 - protein, 23 aa, Mycobacterium
VASYGEFEFWFAGIKVAAIIAFI

SEQ ID NO: 333077 - protein, 19 aa, Mycobacterium
VATALKSHRLITLTGPGGV

SEQ ID NO: 333078 - protein, 20 aa, Mycobacterium
VATDSVRLLAPIPGKSAVGI

SEQ ID NO: 333079 - protein, 22 aa, Mycobacterium
VATGICVAVLLNILFHARRPLE

SEQ ID NO: 333080 - protein, 31 aa, Mycobacterium
VATGLRLISPTTLFFPFVLLLAATALYRGTD

SEQ ID NO: 333081 - protein, 17 aa, Mycobacterium
VATIAGLIGFVLSVATP

SEQ ID NO: 333082 - protein, 18 aa, Mycobacterium
VATIAGLVGFVLSIATPL

SEQ ID NO: 333083 - protein, 17 aa, Mycobacterium
VATIAGLVGFVLSVATP

SEQ ID NO: 333084 - protein, 24 aa, Mycobacterium
VATIKRFTERFAPFNLSPAAVRPS

SEQ ID NO: 333085 - protein, 20 aa, Mycobacterium
VATIQEWSAGYVVRHPLASL

SEQ ID NO: 333086 - protein, 18 aa, Mycobacterium
VATKRMGAVFNEYKSNSS

SEQ ID NO: 333087 - protein, 17 aa, Mycobacterium
VATLARYLTNRVAPQQD

SEQ ID NO: 333088 - protein, 18 aa, Mycobacterium
VATLAVWLLTGHSATVAF

SEQ ID NO: 333089 - protein, 23 aa, Mycobacterium
VATLCAAGAFAALTVAQLNALPQ

SEQ ID NO: 333090 - protein, 18 aa, Mycobacterium
VATLGFWIGSGYPVAAAF

SEQ ID NO: 333091 - protein, 29 aa, Mycobacterium
VATLLCLLLAFPLAYVIAFKAGRFKNLIL

SEQ ID NO: 333092 - protein, 25 aa, Mycobacterium
VATLRVCLIASVFAHCVERTEDQLK

SEQ ID NO: 333093 - protein, 28 aa, Mycobacterium
VATLSLRASDGFRRRAWIVPVVIGYAAS

SEQ ID NO: 333094 - protein, 17 aa, Mycobacterium
VATNDRFGWPLVAGYLF

SEQ ID NO: 333095 - protein, 21 aa, Mycobacterium
VATPCPLLLAAPVAIVSGLSR

SEQ ID NO: 333096 - protein, 18 aa, Mycobacterium
VATPIWLYRIKALTPARL

SEQ ID NO: 333097 - protein, 17 aa, Mycobacterium
VATPLAYAVDLLAAVPS

SEQ ID NO: 333098 - protein, 30 aa, Mycobacterium
VATRAGGAPLRRASVLHLFQHQAAEVGLPE

SEQ ID NO: 333099 - protein, 24 aa, Mycobacterium
VATRLIFPLIMVLSAYFFFAGHNT

SEQ ID NO: 333100 - protein, 28 aa, Mycobacterium
VATRLIFPLVMVLSFYFFFAGHNVPGGG

SEQ ID NO: 333101 - protein, 20 aa, Mycobacterium
VATTPIEWMALRAIAGAVSA

SEQ ID NO: 333102 - protein, 30 aa, Mycobacterium
VATTSAWRLLARFGYHLASLVLIVVLLAMD

SEQ ID NO: 333103 - protein, 29 aa, Mycobacterium
VATVLCVILAFPLAYVIAFKAGRFKNLIL

SEQ ID NO: 333104 - protein, 25 aa, Mycobacterium
VATWLNRSLGWCFLFANGNASVAGG

SEQ ID NO: 333105 - protein, 22 aa, Mycobacterium
VATWMLLRLRLDHLRSQNWDRE

SEQ ID NO: 333106 - protein, 22 aa, Mycobacterium
VAVAAACPWLVAAFVSGAVSSS

SEQ ID NO: 333107 - protein, 19 aa, Mycobacterium
VAVAGIWNQTFVPYPSAVW

SEQ ID NO: 333108 - protein, 19 aa, Mycobacterium
VAVAGSWRSGGARFNPATA

SEQ ID NO: 333109 - protein, 26 aa, Mycobacterium
VAVALVLWWRLIRFEYALLVTIATAA

SEQ ID NO: 333110 - protein, 18 aa, Mycobacterium
VAVCANNIGVIWIAIEAT

SEQ ID NO: 333111 - protein, 19 aa, Mycobacterium
VAVCGVLLYLSDRDGTLVL

SEQ ID NO: 333112 - protein, 20 aa, Mycobacterium
VAVDAWRGEVTAARIASHVP

SEQ ID NO: 333113 - protein, 17 aa, Mycobacterium
VAVELSLRRAGVVLACA

SEQ ID NO: 333114 - protein, 19 aa, Mycobacterium
VAVFLPWNLYFGVGIPGSR

SEQ ID NO: 333115 - protein, 20 aa, Mycobacterium
VAVGAGWLYSLGVTLTGGGE

SEQ ID NO: 333116 - protein, 21 aa, Mycobacterium
VAVGAILLWPSRQRVDIPMPL

SEQ ID NO: 333117 - protein, 19 aa, Mycobacterium
VAVGFWNFLGAGIFGFLIN

SEQ ID NO: 333118 - protein, 17 aa, Mycobacterium
VAVGFWNFVGAGIFGFL

SEQ ID NO: 333119 - protein, 21 aa, Mycobacterium
VAVGIGLAWGRGGMLVLGQGV

SEQ ID NO: 333120 - protein, 19 aa, Mycobacterium
VAVGLGLAVGRSIVSLLGQ

SEQ ID NO: 333121 - protein, 26 aa, Mycobacterium
VAVGPAWRPASTVAVWAAAAALALSE

SEQ ID NO: 333122 - protein, 19 aa, Mycobacterium
VAVGQSFTSIPMMFASPSY

SEQ ID NO: 333123 - protein, 23 aa, Mycobacterium
VAVGRKLGLPKRVMTILTGESLI

SEQ ID NO: 333124 - protein, 24 aa, Mycobacterium
VAVGVGWHTLVRWRAPNRNAIVTD

SEQ ID NO: 333125 - protein, 17 aa, Mycobacterium
VAVGVLFGVVAVLTKLV

SEQ ID NO: 333126 - protein, 23 aa, Mycobacterium
VAVGVTAAVGWWAARRTAAEAPR

SEQ ID NO: 333127 - protein, 18 aa, Mycobacterium
VAVIAAWQGVRAWRGHDC

SEQ ID NO: 333128 - protein, 23 aa, Mycobacterium
VAVIFCWIGMVLAISFLEAPLKF

SEQ ID NO: 333129 - protein, 18 aa, Mycobacterium
VAVIFGFVLWHVIGANSS

SEQ ID NO: 333130 - protein, 18 aa, Mycobacterium
VAVIILMLLAIYRSIVTM

SEQ ID NO: 333131 - protein, 32 aa, Mycobacterium
VAVILAVVLVTGFWKPGFFVTTKLDVDAAQTG

SEQ ID NO: 333132 - protein, 17 aa, Mycobacterium
VAVILSFAASNLTTVVM

SEQ ID NO: 333133 - protein, 18 aa, Mycobacterium
VAVILWTAIWVLVGMAVH

SEQ ID NO: 333134 - protein, 25 aa, Mycobacterium
VAVIVAIRIARRAMRSSRGGDPALF

SEQ ID NO: 333135 - protein, 19 aa, Mycobacterium
VAVIVALWVSRADTAVVDW

SEQ ID NO: 333136 - protein, 17 aa, Mycobacterium
VAVKNGTEGAEFAESIK

SEQ ID NO: 333137 - protein, 23 aa, Mycobacterium
VAVLAALLAGLSLVPKAKSYAGI

SEQ ID NO: 333138 - protein, 18 aa, Mycobacterium
VAVLACVIVAARFVGWVR

SEQ ID NO: 333139 - protein, 17 aa, Mycobacterium
VAVLAFVARRVKGRVGF

SEQ ID NO: 333140 - protein, 33 aa, Mycobacterium
VAVLAPPCIMMFLHMRYWWVGIALVALGVIVAT

SEQ ID NO: 333141 - protein, 24 aa, Mycobacterium
VAVLAVAVAAVWHRVVSGRRETIM

SEQ ID NO: 333142 - protein, 18 aa, Mycobacterium
VAVLAVRYASIFTAVVQP

SEQ ID NO: 333143 - protein, 24 aa, Mycobacterium
VAVLFTVCVYYEMQGPAGQLWSFK

SEQ ID NO: 333144 - protein, 20 aa, Mycobacterium
VAVLMFRFNNPDALLVFLMI

SEQ ID NO: 333145 - protein, 20 aa, Mycobacterium
VAVLMGRRFWWPTQVAADAS

SEQ ID NO: 333146 - protein, 25 aa, Mycobacterium
VAVLTGRILRRWSRDPATLVQSMVM

SEQ ID NO: 333147 - protein, 19 aa, Mycobacterium
VAVLVALTLAPAVLSVASR

SEQ ID NO: 333148 - protein, 23 aa, Mycobacterium
VAVLVGLAFKWSVVTWGLALLAS

SEQ ID NO: 333149 - protein, 18 aa, Mycobacterium
VAVLVYLFVIEWRMALIL

SEQ ID NO: 333150 - protein, 18 aa, Mycobacterium
VAVLVYLFVVDWRVALVL

SEQ ID NO: 333151 - protein, 17 aa, Mycobacterium
VAVNFWLLRRDSVSLGT

SEQ ID NO: 333152 - protein, 20 aa, Mycobacterium
VAVNLLLPFMHRHHVAACVD

SEQ ID NO: 333153 - protein, 19 aa, Mycobacterium
VAVPAAKTWEVLTDVRRVA

SEQ ID NO: 333154 - protein, 17 aa, Mycobacterium
VAVPAAWAQTTIIDEDG

SEQ ID NO: 333155 - protein, 18 aa, Mycobacterium
VAVPALWLVAGRQSRNAE

SEQ ID NO: 333156 - protein, 19 aa, Mycobacterium
VAVPGGAYLALPVVAILIG

SEQ ID NO: 333157 - protein, 22 aa, Mycobacterium
VAVPGYRPAYNDRWYLPDDAPV

SEQ ID NO: 333158 - protein, 24 aa, Mycobacterium
VAVPMAKRFAPVLVAATVAGAVGF

SEQ ID NO: 333159 - protein, 21 aa, Mycobacterium
VAVPSAKVWEMFTDGERVAPC

SEQ ID NO: 333160 - protein, 19 aa, Mycobacterium
VAVRAIGALLILKKPPENH

SEQ ID NO: 333161 - protein, 23 aa, Mycobacterium
VAVRAWWATGRSPFWPLAIGIIG

SEQ ID NO: 333162 - protein, 25 aa, Mycobacterium
VAVRLRGRPGGRIGAIALAATGIAT

SEQ ID NO: 333163 - protein, 19 aa, Mycobacterium
VAVSAMVAVGVGWITATLL

SEQ ID NO: 333164 - protein, 17 aa, Mycobacterium
VAVSFWLTAPYIAAESI

SEQ ID NO: 333165 - protein, 18 aa, Mycobacterium
VAVSPAWYDDYVLTVGSV

SEQ ID NO: 333166 - protein, 20 aa, Mycobacterium
VAVSPDGRWIASGGDGVALW

SEQ ID NO: 333167 - protein, 21 aa, Mycobacterium
VAVSRRLRDLVAMGLRNWGLL

SEQ ID NO: 333168 - protein, 17 aa, Mycobacterium
VAVSTTAAAALVALAIP

SEQ ID NO: 333169 - protein, 20 aa, Mycobacterium
VAVTFVWLGMVLAISFLEAP

SEQ ID NO: 333170 - protein, 27 aa, Mycobacterium
VAVTLRLITRWVGHFVLLIPTVIAVVA

SEQ ID NO: 333171 - protein, 20 aa, Mycobacterium
VAVVAALIWWTSDARATISR

SEQ ID NO: 333172 - protein, 17 aa, Mycobacterium
VAVVALRGHVPGGSRAQ

SEQ ID NO: 333173 - protein, 18 aa, Mycobacterium
VAVVCLLFDSGIITPPVP

SEQ ID NO: 333174 - protein, 19 aa, Mycobacterium
VAVVFFSGFFIGRATDGFG

SEQ ID NO: 333175 - protein, 25 aa, Mycobacterium
VAVVICILAGFVPLSYLADVVSIGT

SEQ ID NO: 333176 - protein, 23 aa, Mycobacterium
VAVVIFLGAWVWVGITNNQYSQL

SEQ ID NO: 333177 - protein, 18 aa, Mycobacterium
VAVVRRPVPLLIVSLVIL

SEQ ID NO: 333178 - protein, 28 aa, Mycobacterium
VAVVVVVAGVIVWRFFGEALYHRSRTAA

SEQ ID NO: 333179 - protein, 28 aa, Mycobacterium
VAVYRLSRRGAPWSTRRTVSWLIGCLAL

SEQ ID NO: 333180 - protein, 20 aa, Mycobacterium
VAWAAAPALLGWIDLHGTWA

SEQ ID NO: 333181 - protein, 25 aa, Mycobacterium
VAWAACPAALGWIDLHGTWAAWMGN

SEQ ID NO: 333182 - protein, 21 aa, Mycobacterium
VAWGVLIGFIALYLIGSLARF

SEQ ID NO: 333183 - protein, 19 aa, Mycobacterium
VAWIVHLLPLLPIASVVLA

SEQ ID NO: 333184 - protein, 20 aa, Mycobacterium
VAWLLRFISNHSMYWFVGYR

SEQ ID NO: 333185 - protein, 24 aa, Mycobacterium
VAWRLFGHIPYRIDIDIYQMGGQA

SEQ ID NO: 333186 - protein, 19 aa, Mycobacterium
VAWWGMWRLTRGPSVESAS

SEQ ID NO: 333187 - protein, 18 aa, Mycobacterium
VAYAAVFTDVYGLREGDD

SEQ ID NO: 333188 - protein, 17 aa, Mycobacterium
VAYALGLQGPAITVDTA

SEQ ID NO: 333189 - protein, 17 aa, Mycobacterium
VAYLIYLAVRQWRTAAI

SEQ ID NO: 333190 - protein, 23 aa, Mycobacterium
VAYLLNFGPTFTISADLGPGIGG

SEQ ID NO: 333191 - protein, 24 aa, Mycobacterium
VAYRPLRRRGARPLTFLITAIGMS

SEQ ID NO: 333192 - protein, 18 aa, Mycobacterium
VAYSRLIFVSGLERHLPR

SEQ ID NO: 333193 - protein, 20 aa, Mycobacterium
VAYSRLIFVSGLERHLPRIF

SEQ ID NO: 333194 - protein, 20 aa, Mycobacterium
VAYWCIGGVVFIVASWSVAK

SEQ ID NO: 333195 - protein, 21 aa, Mycobacterium
VCAAVASAVFGVWSLFHTRTA

SEQ ID NO: 333196 - protein, 20 aa, Mycobacterium
VCAFAAFTAALMVRMLVRRR

SEQ ID NO: 333197 - protein, 20 aa, Mycobacterium
VCAGVPIVALVGDGPDSGAD

SEQ ID NO: 333198 - protein, 20 aa, Mycobacterium
VCALISIPIGLLLAIYLAEY

SEQ ID NO: 333199 - protein, 18 aa, Mycobacterium
VCALPVAGLRLGFDELAA

SEQ ID NO: 333200 - protein, 17 aa, Mycobacterium
VCATMRYEDFSGNQIDQ

SEQ ID NO: 333201 - protein, 23 aa, Mycobacterium
VCATRKSWAVLYLLIAAAAGALP

SEQ ID NO: 333202 - protein, 33 aa, Mycobacterium
VCAVLGGLLLRWRSNHLWAAFVFGLPILPVVLT

SEQ ID NO: 333203 - protein, 25 aa, Mycobacterium
VCCVLAFVVGFAMLGAMTFLPTYMQ

SEQ ID NO: 333204 - protein, 24 aa, Mycobacterium
VCCVLSFIVGFAMLGALTFLPTFM

SEQ ID NO: 333205 - protein, 25 aa, Mycobacterium
VCCVLSFVVGFAMLGALTFLPTYMQ

SEQ ID NO: 333206 - protein, 22 aa, Mycobacterium
VCEITATAFLVVFFRHNLNLNG

SEQ ID NO: 333207 - protein, 29 aa, Mycobacterium
VCFVPVLLYRIWRLWRYPSLLPGKAVTGF

SEQ ID NO: 333208 - protein, 17 aa, Mycobacterium
VCGIAAVVSAVFVLDPP

SEQ ID NO: 333209 - protein, 17 aa, Mycobacterium
VCGLALATVGGFLIDLA

SEQ ID NO: 333210 - protein, 19 aa, Mycobacterium
VCGLLILSGLLLFWVGLSY

SEQ ID NO: 333211 - protein, 20 aa, Mycobacterium
VCGVAGTLTIAWYILAAPGE

SEQ ID NO: 333212 - protein, 18 aa, Mycobacterium
VCIGLELHGPEGQILSFH

SEQ ID NO: 333213 - protein, 25 aa, Mycobacterium
VCISEDCPPVPFAVNYYIYPVMWGG

SEQ ID NO: 333214 - protein, 21 aa, Mycobacterium
VCITVTVLLAGFITAGWRVYM

SEQ ID NO: 333215 - protein, 19 aa, Mycobacterium
VCLAVPLLVPVTDFHTFNT

SEQ ID NO: 333216 - protein, 22 aa, Mycobacterium
VCMGWCAVNTWIVLDLVMALLG

SEQ ID NO: 333217 - protein, 22 aa, Mycobacterium
VCQEARHDFVLDRSIKSVKILG

SEQ ID NO: 333218 - protein, 19 aa, Mycobacterium
VCQVFVMYVVVHFGVGLQA

SEQ ID NO: 333219 - protein, 25 aa, Mycobacterium
VCSWWQSAGAPGWVGYVRAAAEAGM

SEQ ID NO: 333220 - protein, 18 aa, Mycobacterium
VCTGATAVPGRDGAAAQL

SEQ ID NO: 333221 - protein, 24 aa, Mycobacterium
VCVDGELAGAVLLRDPLRRQAPRT

SEQ ID NO: 333222 - protein, 20 aa, Mycobacterium
VCVECPPGYHCGHNPERCIP

SEQ ID NO: 333223 - protein, 22 aa, Mycobacterium
VCVFHARTLDAFAFGHDAAATL

SEQ ID NO: 333224 - protein, 19 aa, Mycobacterium
VCVGVVYQGVIGRKALRGR

SEQ ID NO: 333225 - protein, 17 aa, Mycobacterium
VCVILAYFFEHTVFLFL

SEQ ID NO: 333226 - protein, 20 aa, Mycobacterium
VCVPAALFLFPPRHHDELRR

SEQ ID NO: 333227 - protein, 17 aa, Mycobacterium
VCVPALLALVWPLLRGA

SEQ ID NO: 333228 - protein, 17 aa, Mycobacterium
VCVPLALVCYFIASTPI

SEQ ID NO: 333229 - protein, 17 aa, Mycobacterium
VCVVFLNLLEGVGIGLL

SEQ ID NO: 333230 - protein, 24 aa, Mycobacterium
VCYLLLERSKFGFKVKAVRDNEIA

SEQ ID NO: 333231 - protein, 18 aa, Mycobacterium
VDAAHELRTPIAGMQVAA

SEQ ID NO: 333232 - protein, 25 aa, Mycobacterium
VDAFATLMRWDGRQQDRWSSGQLIV

SEQ ID NO: 333233 - protein, 23 aa, Mycobacterium
VDAFRALQNWVPLVAAAGSMIIS

SEQ ID NO: 333234 - protein, 19 aa, Mycobacterium
VDAGARWAALSGAERAAVL

SEQ ID NO: 333235 - protein, 18 aa, Mycobacterium
VDAIDRIGLTPGVSQVAV

SEQ ID NO: 333236 - protein, 23 aa, Mycobacterium
VDAIICYIGFLFPLWDAKRQTLA

SEQ ID NO: 333237 - protein, 27 aa, Mycobacterium
VDAIRARIPWVLGFIAAVTFTLLFLLT

SEQ ID NO: 333238 - protein, 26 aa, Mycobacterium
VDAITQRLPIVFALIALITFALLFLL

SEQ ID NO: 333239 - protein, 18 aa, Mycobacterium
VDALRAWVDADLTRATTL

SEQ ID NO: 333240 - protein, 21 aa, Mycobacterium
VDALRHGWVLAAVCFAAVAVL

SEQ ID NO: 333241 - protein, 25 aa, Mycobacterium
VDALRLGPPGALFFVLVCGGALGAT

SEQ ID NO: 333242 - protein, 22 aa, Mycobacterium
VDAMPVRIGVGVIGAVIVLTLI

SEQ ID NO: 333243 - protein, 23 aa, Mycobacterium
VDASLRLLVRGGRFLEMGKTDIR

SEQ ID NO: 333244 - protein, 32 aa, Mycobacterium
VDAVLLLRAVRQWRYLVGIGLDVVGFLLQVAA

SEQ ID NO: 333245 - protein, 17 aa, Mycobacterium
VDDALAWSQDADSDEPV

SEQ ID NO: 333246 - protein, 27 aa, Mycobacterium
VDDALELRARILGAFEAAEVATDPAER

SEQ ID NO: 333247 - protein, 23 aa, Mycobacterium
VDDEMFDRITVPTLIIRGGENDM

SEQ ID NO: 333248 - protein, 18 aa, Mycobacterium
VDDFSGQSPTGWAQGTVR

SEQ ID NO: 333249 - protein, 17 aa, Mycobacterium
VDDPPACTVGFLPPSAW

SEQ ID NO: 333250 - protein, 18 aa, Mycobacterium
VDDPRDWAGVRTIVSPAW

SEQ ID NO: 333251 - protein, 24 aa, Mycobacterium
VDDVLRLLIRAILRADSGVVNLAA

SEQ ID NO: 333252 - protein, 23 aa, Mycobacterium
VDDWAVTISLAFRMFPMLSEEFR

SEQ ID NO: 333253 - protein, 17 aa, Mycobacterium
VDEALSIITAVASALDY

SEQ ID NO: 333254 - protein, 17 aa, Mycobacterium
VDELSRLAPLVDNDLDR

SEQ ID NO: 333255 - protein, 17 aa, Mycobacterium
VDEVCAIVEAVAGALDY

SEQ ID NO: 333256 - protein, 23 aa, Mycobacterium
VDFDIGRLGGFFIALTGAVAVVA

SEQ ID NO: 333257 - protein, 23 aa, Mycobacterium
VDFFCAVVIVGLLAGVAGLSTTV

SEQ ID NO: 333258 - protein, 24 aa, Mycobacterium
VDFFSVGWWPVFNVADPSVVGGAI

SEQ ID NO: 333259 - protein, 21 aa, Mycobacterium
VDFGIGVSAGRVFAGNIGAEN

SEQ ID NO: 333260 - protein, 19 aa, Mycobacterium
VDFLWGRLPLYIIAIYPMM

SEQ ID NO: 333261 - protein, 19 aa, Mycobacterium
VDFLWGRLPLYIVAVYPTM

SEQ ID NO: 333262 - protein, 17 aa, Mycobacterium
VDFYRASGVVLIVLGHW

SEQ ID NO: 333263 - protein, 21 aa, Mycobacterium
VDGAGAWRRLTKIILPLIKPA

SEQ ID NO: 333264 - protein, 18 aa, Mycobacterium
VDGAGPWRRLVRVTLPII

SEQ ID NO: 333265 - protein, 40 aa, Mycobacterium
VDGASWFYMFRKLMLPMLWPYILVAVIFRFMDNLKVFDHI

SEQ ID NO: 333266 - protein, 18 aa, Mycobacterium
VDGDLVYLGMVGITDPPR

SEQ ID NO: 333267 - protein, 18 aa, Mycobacterium
VDGGTWAAFGDRLKHLVL

SEQ ID NO: 333268 - protein, 17 aa, Mycobacterium
VDGHVPGPFAGLDLRQA

SEQ ID NO: 333269 - protein, 23 aa, Mycobacterium
VDGKAAFVMLRLAGNTGKLEANE

SEQ ID NO: 333270 - protein, 18 aa, Mycobacterium
VDGLAGLYADLQELSRGI

SEQ ID NO: 333271 - protein, 19 aa, Mycobacterium
VDGLGWQWIFFVNVPVGVI

SEQ ID NO: 333272 - protein, 18 aa, Mycobacterium
VDGMHWGTFINLRCVCLA

SEQ ID NO: 333273 - protein, 25 aa, Mycobacterium
VDGPLRLGHWLLFAVISVSSLGAMI

SEQ ID NO: 333274 - protein, 24 aa, Mycobacterium
VDGPPRILIIAAVVLAVATVGVIL

SEQ ID NO: 333275 - protein, 19 aa, Mycobacterium
VDGQKRLKNARVLVIGAGG

SEQ ID NO: 333276 - protein, 19 aa, Mycobacterium
VDGRELWNTYGPTEATVVA

SEQ ID NO: 333277 - protein, 22 aa, Mycobacterium
VDGRLPVGVGRLVARGLLIALV

SEQ ID NO: 333278 - protein, 27 aa, Mycobacterium
VDGRRGMRAVWPAAVVCGVVFAVAQYA

SEQ ID NO: 333279 - protein, 18 aa, Mycobacterium
VDGSKWDLLIAGVAAICL

SEQ ID NO: 333280 - protein, 19 aa, Mycobacterium
VDGTIWIFGGVRADGTVTG

SEQ ID NO: 333281 - protein, 17 aa, Mycobacterium
VDGVGMIVGIDRFMSEA

SEQ ID NO: 333282 - protein, 19 aa, Mycobacterium
VDGVRWVVYQGGERDGKPN

SEQ ID NO: 333283 - protein, 20 aa, Mycobacterium
VDHLLHLSMSAAMIAMAWRI

SEQ ID NO: 333284 - protein, 19 aa, Mycobacterium
VDHRRPLKVRGIAATYLEL

SEQ ID NO: 333285 - protein, 20 aa, Mycobacterium
VDHWLPGLYAVILGLYAAAA

SEQ ID NO: 333286 - protein, 18 aa, Mycobacterium
VDIAHRAALLYAFATLLV

SEQ ID NO: 333287 - protein, 19 aa, Mycobacterium
VDIGMGIGLVIGALACWLN

SEQ ID NO: 333288 - protein, 18 aa, Mycobacterium
VDIIVHFRGGGVAWISPS

SEQ ID NO: 333289 - protein, 18 aa, Mycobacterium
VDIPVVFYQLSFARTGRW

SEQ ID NO: 333290 - protein, 19 aa, Mycobacterium
VDISGRWAVKTVHGAVSEA

SEQ ID NO: 333291 - protein, 20 aa, Mycobacterium
VDISHGGGVYGVRTADNEAV

SEQ ID NO: 333292 - protein, 25 aa, Mycobacterium
VDKCGSALMTRRLWTMPVVAVGALA

SEQ ID NO: 333293 - protein, 23 aa, Mycobacterium
VDKPAGGLWLMGLSARLFGFSSA

SEQ ID NO: 333294 - protein, 17 aa, Mycobacterium
VDKSRMKITMEKIDGRW

SEQ ID NO: 333295 - protein, 25 aa, Mycobacterium
VDLAAPWFIGAAMGLQVLGTFSVGQ

SEQ ID NO: 333296 - protein, 20 aa, Mycobacterium
VDLACTIALEAAREAVAEEA

SEQ ID NO: 333297 - protein, 18 aa, Mycobacterium
VDLARGYLAIALPVGTMG

SEQ ID NO: 333298 - protein, 18 aa, Mycobacterium
VDLARGYLAIALPVGTVG

SEQ ID NO: 333299 - protein, 26 aa, Mycobacterium
VDLAYPRTRIEYMLRHARPTAVIADG

SEQ ID NO: 333300 - protein, 17 aa, Mycobacterium
VDLCWRLIEAGARLRYE

SEQ ID NO: 333301 - protein, 17 aa, Mycobacterium
VDLCWRLIESGVRLRYE

SEQ ID NO: 333302 - protein, 18 aa, Mycobacterium
VDLCWRLVESGARLRYEP

SEQ ID NO: 333303 - protein, 19 aa, Mycobacterium
VDLGDGFGMPSTETPEKLL

SEQ ID NO: 333304 - protein, 25 aa, Mycobacterium
VDLLGERRFELALAHSPIGMAVVGL

SEQ ID NO: 333305 - protein, 17 aa, Mycobacterium
VDLLPFLLLGTTFGVRL

SEQ ID NO: 333306 - protein, 21 aa, Mycobacterium
VDLRGALFDSPRFDVRSVGPF

SEQ ID NO: 333307 - protein, 20 aa, Mycobacterium
VDLSRTVGWFTTKYPVALTV

SEQ ID NO: 333308 - protein, 18 aa, Mycobacterium
VDLSTLYLIDAIACVAPI

SEQ ID NO: 333309 - protein, 24 aa, Mycobacterium
VDLTLRLTALADDRYCLDDDHPVV

SEQ ID NO: 333310 - protein, 21 aa, Mycobacterium
VDLTVCVAVGYTAFLLCPARQ

SEQ ID NO: 333311 - protein, 20 aa, Mycobacterium
VDMGEGFGMPSTEPAEKVLE

SEQ ID NO: 333312 - protein, 25 aa, Mycobacterium
VDMGWDVVSIRGWAELLGFARRFAR

SEQ ID NO: 333313 - protein, 18 aa, Mycobacterium
VDMLVWVPRMLYLFGEQR

SEQ ID NO: 333314 - protein, 19 aa, Mycobacterium
VDMRRRHVVVVGEEPRAAD

SEQ ID NO: 333315 - protein, 17 aa, Mycobacterium
VDMTHRAALLYSFATLL

SEQ ID NO: 333316 - protein, 20 aa, Mycobacterium
VDNAPLPWAHELVTNDPTLF

SEQ ID NO: 333317 - protein, 18 aa, Mycobacterium
VDNLPAPVAREVEPRAEG

SEQ ID NO: 333318 - protein, 22 aa, Mycobacterium
VDNPRYVIGIMMDNPDRNADGT

SEQ ID NO: 333319 - protein, 22 aa, Mycobacterium
VDNPRYVIGIMMDNPERNADGT

SEQ ID NO: 333320 - protein, 18 aa, Mycobacterium
VDNPRYVIGLMMDNPERN

SEQ ID NO: 333321 - protein, 24 aa, Mycobacterium
VDNRVGYGLVDPVAALTFNIPAGE

SEQ ID NO: 333322 - protein, 26 aa, Mycobacterium
VDNYHPRPVLGFGFSVLAIALTWLTF

SEQ ID NO: 333323 - protein, 24 aa, Mycobacterium
VDPALPLARIEFMVADTAPILAVT

SEQ ID NO: 333324 - protein, 26 aa, Mycobacterium
VDPDGALARWNWVLDGMVDTKALSAK

SEQ ID NO: 333325 - protein, 23 aa, Mycobacterium
VDPDVLGGLLITVGDEVIDGSIS

SEQ ID NO: 333326 - protein, 22 aa, Mycobacterium
VDPELLGGLVVNIGDEEIDGSL

SEQ ID NO: 333327 - protein, 29 aa, Mycobacterium
VDPIAEGWFFDRPDLIGADGVHPNDAGHA

SEQ ID NO: 333328 - protein, 23 aa, Mycobacterium
VDPRALRPWQVVWHCALYGMLHA

SEQ ID NO: 333329 - protein, 20 aa, Mycobacterium
VDPVAALTWDVADVPLDGPA

SEQ ID NO: 333330 - protein, 18 aa, Mycobacterium
VDPVAALTWDVPEGPVKP

SEQ ID NO: 333331 - protein, 19 aa, Mycobacterium
VDPVAALTWDVPEGPVQPP

SEQ ID NO: 333332 - protein, 17 aa, Mycobacterium
VDPVAALTWDVPPGETF

SEQ ID NO: 333333 - protein, 20 aa, Mycobacterium
VDPVAALTWNVPAAGVDASV

SEQ ID NO: 333334 - protein, 22 aa, Mycobacterium
VDPVAALTWQLPAGDQPSGAAA

SEQ ID NO: 333335 - protein, 21 aa, Mycobacterium
VDPVAALTWQLPAGNQPPAAA

SEQ ID NO: 333336 - protein, 23 aa, Mycobacterium
VDQEFGVAAVLVGVVGDSAHGVG

SEQ ID NO: 333337 - protein, 22 aa, Mycobacterium
VDQGALLLGVFFWFTVIGGITV

SEQ ID NO: 333338 - protein, 23 aa, Mycobacterium
VDQKRWSFDLAMTGDLLSRSITH

SEQ ID NO: 333339 - protein, 26 aa, Mycobacterium
VDQKRWSTDLSMTWSLLQRSFTHGVL

SEQ ID NO: 333340 - protein, 27 aa, Mycobacterium
VDQQRWSFDLSMTWDLLRRSFTHGIVP

SEQ ID NO: 333341 - protein, 23 aa, Mycobacterium
VDQRLLVPIPAGWSFAEAASAPI

SEQ ID NO: 333342 - protein, 25 aa, Mycobacterium
VDRAHPRPVIGFGFSLVSAALTWLA

SEQ ID NO: 333343 - protein, 25 aa, Mycobacterium
VDRAHPRSVVGFGFSLMAIGVTWLS

SEQ ID NO: 333344 - protein, 26 aa, Mycobacterium
VDRAIRLGLWAGIAIFVADLVVTVSR

SEQ ID NO: 333345 - protein, 17 aa, Mycobacterium
VDREYPLTVSRPGWAMW

SEQ ID NO: 333346 - protein, 21 aa, Mycobacterium
VDRFFAPRVAALVLVVSAAGY

SEQ ID NO: 333347 - protein, 18 aa, Mycobacterium
VDRILIGACAAVWLVLLG

SEQ ID NO: 333348 - protein, 28 aa, Mycobacterium
VDRMLIGLCAVIWLAFVGMLVGAIVVIA

SEQ ID NO: 333349 - protein, 17 aa, Mycobacterium
VDRVLIGACAAVWLALV

SEQ ID NO: 333350 - protein, 17 aa, Mycobacterium
VDRVRPRVLYPVCLALW

SEQ ID NO: 333351 - protein, 26 aa, Mycobacterium
VDRYHPRPVLGFGFSVLAIALTWLTF

SEQ ID NO: 333352 - protein, 18 aa, Mycobacterium
VDSDELWDIRNRGVIPPG

SEQ ID NO: 333353 - protein, 18 aa, Mycobacterium
VDSLGWQWIFIVNVPVGI

SEQ ID NO: 333354 - protein, 27 aa, Mycobacterium
VDSPSDKGITTWLLWDGKRSQIDLADH

SEQ ID NO: 333355 - protein, 23 aa, Mycobacterium
VDSWMCAISGRAKQFGMIPYFKD

SEQ ID NO: 333356 - protein, 22 aa, Mycobacterium
VDSWMCAISGRAKQFGMIQYFQ

SEQ ID NO: 333357 - protein, 26 aa, Mycobacterium
VDSYRGLAYVRPWLAGALVVALLGLV

SEQ ID NO: 333358 - protein, 23 aa, Mycobacterium
VDTGKAFALALVMVNADTVDADV

SEQ ID NO: 333359 - protein, 18 aa, Mycobacterium
VDTLGWQWIFFVNIPVGI

SEQ ID NO: 333360 - protein, 17 aa, Mycobacterium
VDTPRLLPRSLKPGPDW

SEQ ID NO: 333361 - protein, 23 aa, Mycobacterium
VDTRVQAAVPFYGIYDFTRFDKS

SEQ ID NO: 333362 - protein, 24 aa, Mycobacterium
VDTVGGLMAFELGRVPLPGAEVTW

SEQ ID NO: 333363 - protein, 24 aa, Mycobacterium
VDTVLRAKIDGAWNLHELTRGLNL

SEQ ID NO: 333364 - protein, 18 aa, Mycobacterium
VDTWGWRSIFYVNVPMGV

SEQ ID NO: 333365 - protein, 17 aa, Mycobacterium
VDVAPPFVVADIGANPW

SEQ ID NO: 333366 - protein, 22 aa, Mycobacterium
VDVARLAALVAVMFGHCALLLA

SEQ ID NO: 333367 - protein, 18 aa, Mycobacterium
VDVASALALAVAIQLLLQ

SEQ ID NO: 333368 - protein, 17 aa, Mycobacterium
VDVGFALSVCATAAIVV

SEQ ID NO: 333369 - protein, 19 aa, Mycobacterium
VDVIGSWIIGNLFGVGSLL

SEQ ID NO: 333370 - protein, 19 aa, Mycobacterium
VDVIRPGWVARHHWSDADL

SEQ ID NO: 333371 - protein, 18 aa, Mycobacterium
VDVMPAWLRALSKVNPLS

SEQ ID NO: 333372 - protein, 24 aa, Mycobacterium
VDVSPLGLPMRWNGLGIYIGEHGE

SEQ ID NO: 333373 - protein, 18 aa, Mycobacterium
VDVTRGAVGLGVESARSS

SEQ ID NO: 333374 - protein, 19 aa, Mycobacterium
VDVWSGWSDRGGHRPWSAD

SEQ ID NO: 333375 - protein, 19 aa, Mycobacterium
VDWVIAGRVVQGFATGIAT

SEQ ID NO: 333376 - protein, 17 aa, Mycobacterium
VDYAKTRTLWGKNIGQF

SEQ ID NO: 333377 - protein, 19 aa, Mycobacterium
VDYARMWIQAATTMSAYQA

SEQ ID NO: 333378 - protein, 23 aa, Mycobacterium
VDYFGRRVMSIFSDVLSLVSVSA

SEQ ID NO: 333379 - protein, 17 aa, Mycobacterium
VDYMFSFDADWSKDWQW

SEQ ID NO: 333380 - protein, 21 aa, Mycobacterium
VDYSLFILMRFREELRSGRDP

SEQ ID NO: 333381 - protein, 21 aa, Mycobacterium
VDYSLFILMRFREELRTGRRP

SEQ ID NO: 333382 - protein, 22 aa, Mycobacterium
VDYYPTKRLNFIDTAADPTTCV

SEQ ID NO: 333383 - protein, 18 aa, Mycobacterium
VEAALALGATRWEVVRTI

SEQ ID NO: 333384 - protein, 17 aa, Mycobacterium
VEAASLLNKLEELLDSR

SEQ ID NO: 333385 - protein, 24 aa, Mycobacterium
VEAFLPRRMRYGAQVTLTVGGLIA

SEQ ID NO: 333386 - protein, 22 aa, Mycobacterium
VEAFNAAFAPYGLKQTVIKPSY

SEQ ID NO: 333387 - protein, 24 aa, Mycobacterium
VEAGDEFWLLLSGRELPARDRRVL

SEQ ID NO: 333388 - protein, 24 aa, Mycobacterium
VEAGGKLALAFAVIGIVAATFGAA

SEQ ID NO: 333389 - protein, 19 aa, Mycobacterium
VEAGRRVVLITGDHPVTAR

SEQ ID NO: 333390 - protein, 23 aa, Mycobacterium
VEAILRWIAVLAALFVVLTVVYR

SEQ ID NO: 333391 - protein, 22 aa, Mycobacterium
VEALARLDVVCFDKTGTLSENR

SEQ ID NO: 333392 - protein, 17 aa, Mycobacterium
VEALFCALFGMLAVVVR

SEQ ID NO: 333393 - protein, 22 aa, Mycobacterium
VEALKGTPLRNAKIYMTGTAAS

SEQ ID NO: 333394 - protein, 26 aa, Mycobacterium
VEALLRWPHPELGLLYPGTFMPLVRE

SEQ ID NO: 333395 - protein, 19 aa, Mycobacterium
VEALLRWSPEFGSDLQANE

SEQ ID NO: 333396 - protein, 24 aa, Mycobacterium
VEALNWRWVFLVNLPLGIVAVLAA

SEQ ID NO: 333397 - protein, 20 aa, Mycobacterium
VEALVGLGFAVKQAEEATDK

SEQ ID NO: 333398 - protein, 20 aa, Mycobacterium
VEALWWIRARMLGVQPRLWR

SEQ ID NO: 333399 - protein, 22 aa, Mycobacterium
VEAMGGPPARRCSTNGRRRWIE

SEQ ID NO: 333400 - protein, 24 aa, Mycobacterium
VEAMRFKHSWVMSFLYIGTFGSFI

SEQ ID NO: 333401 - protein, 18 aa, Mycobacterium
VEAPEFHAALLAELALIG

SEQ ID NO: 333402 - protein, 17 aa, Mycobacterium
VEAPGFDLSQCRTGADA

SEQ ID NO: 333403 - protein, 21 aa, Mycobacterium
VEARRPAEFVPTMIVNDRATI

SEQ ID NO: 333404 - protein, 23 aa, Mycobacterium
VEASSLFLVSRLNCSITASDGTV

SEQ ID NO: 333405 - protein, 24 aa, Mycobacterium
VEASSLFRVSRLNCSITTSDGTVL

SEQ ID NO: 333406 - protein, 24 aa, Mycobacterium
VEASSWRLVFLVNIPLGIVAVLVA

SEQ ID NO: 333407 - protein, 18 aa, Mycobacterium
VEAWHLVAVVALDALLLA

SEQ ID NO: 333408 - protein, 21 aa, Mycobacterium
VEAYAVIALALFVNWLRVLVA

SEQ ID NO: 333409 - protein, 21 aa, Mycobacterium
VEAYPPTLLITAQDEFLEPDA

SEQ ID NO: 333410 - protein, 17 aa, Mycobacterium
VECVRAGARTIRQPRTR

SEQ ID NO: 333411 - protein, 27 aa, Mycobacterium
VEDGRTRWMLLVGVFVGFGFLTKQLQV

SEQ ID NO: 333412 - protein, 17 aa, Mycobacterium
VEDVASVALVFVAILVP

SEQ ID NO: 333413 - protein, 19 aa, Mycobacterium
VEELFWYRSTKFVMRHALP

SEQ ID NO: 333414 - protein, 17 aa, Mycobacterium
VEELPKEFRCVSVDLLA

SEQ ID NO: 333415 - protein, 24 aa, Mycobacterium
VEELRRNQIEPALRSGDWGGAAVA

SEQ ID NO: 333416 - protein, 19 aa, Mycobacterium
VEENFRLLDRAAREKIAAW

SEQ ID NO: 333417 - protein, 31 aa, Mycobacterium
VEEPAGGWKRLPLTVFGIAVAAVLVAVGGVT

SEQ ID NO: 333418 - protein, 27 aa, Mycobacterium
VEEVLPLLPLQEGMYFHSMFGDPATDT

SEQ ID NO: 333419 - protein, 17 aa, Mycobacterium
VEEVRRRGITIPGAEDF

SEQ ID NO: 333420 - protein, 20 aa, Mycobacterium
VEFGRYRLFEKLGQGNMGAV

SEQ ID NO: 333421 - protein, 24 aa, Mycobacterium
VEGACTFLSLPRLTGVLASIPERT

SEQ ID NO: 333422 - protein, 24 aa, Mycobacterium
VEGACTFLSLPRLTRVLASVPDSA

SEQ ID NO: 333423 - protein, 23 aa, Mycobacterium
VEGLAALIFSRYVWAFELTSALL

SEQ ID NO: 333424 - protein, 22 aa, Mycobacterium
VEGLAALIFTRYLWAFELTSAL

SEQ ID NO: 333425 - protein, 17 aa, Mycobacterium
VEGLGDRVGDIWVSIIV

SEQ ID NO: 333426 - protein, 18 aa, Mycobacterium
VEGMLARIGTEQQRTKAA

SEQ ID NO: 333427 - protein, 25 aa, Mycobacterium
VEGQRPSLLAWLGIVVAVPALWLVA

SEQ ID NO: 333428 - protein, 23 aa, Mycobacterium
VEGRAVVVGRPRLFGDPEKSLPR

SEQ ID NO: 333429 - protein, 24 aa, Mycobacterium
VEGTCTFLALPRLTQVLAAIPERT

SEQ ID NO: 333430 - protein, 20 aa, Mycobacterium
VEGTVRFDGREPVAVDPENG

SEQ ID NO: 333431 - protein, 18 aa, Mycobacterium
VEGYNFLNLLGLGPATGI

SEQ ID NO: 333432 - protein, 20 aa, Mycobacterium
VEHFNWLEDLGFQFERSYFP

SEQ ID NO: 333433 - protein, 17 aa, Mycobacterium
VEHKPRLARTIRVLALP

SEQ ID NO: 333434 - protein, 18 aa, Mycobacterium
VEHLKWYDYPLAAAVSLI

SEQ ID NO: 333435 - protein, 20 aa, Mycobacterium
VEIADRLVAVVGEHRTAVPR

SEQ ID NO: 333436 - protein, 23 aa, Mycobacterium
VEIAEAMRGMLQRIWDEQIRTKE

SEQ ID NO: 333437 - protein, 22 aa, Mycobacterium
VEIAMLVAFLYLPPLARLLGQT

SEQ ID NO: 333438 - protein, 17 aa, Mycobacterium
VEIGKQLLITRGALTTF

SEQ ID NO: 333439 - protein, 17 aa, Mycobacterium
VEIPILHLSRWIPELKT

SEQ ID NO: 333440 - protein, 20 aa, Mycobacterium
VEITALRLLAPYLGLTLETS

SEQ ID NO: 333441 - protein, 27 aa, Mycobacterium
VEIWRSVRGLPDFWRLLQVRMASQFGD

SEQ ID NO: 333442 - protein, 17 aa, Mycobacterium
VEKGFWGKLVNVVMKRP

SEQ ID NO: 333443 - protein, 24 aa, Mycobacterium
VEKLGRALILHGLWPQPPTEQFCD

SEQ ID NO: 333444 - protein, 20 aa, Mycobacterium
VEKLRSALCAVDGVTDVHDL

SEQ ID NO: 333445 - protein, 21 aa, Mycobacterium
VEKRLSVPVPERGRGALGARR

SEQ ID NO: 333446 - protein, 24 aa, Mycobacterium
VEKRNPLLGLRFRYAVTDPARTRR

SEQ ID NO: 333447 - protein, 24 aa, Mycobacterium
VEKRPRLTMFDDFGGRIPSDKPPI

SEQ ID NO: 333448 - protein, 23 aa, Mycobacterium
VELAAGLLLLWNRTWVLGALGSV

SEQ ID NO: 333449 - protein, 24 aa, Mycobacterium
VELAAPWFIGAAMGLQVLGTFSVG

SEQ ID NO: 333450 - protein, 17 aa, Mycobacterium
VELARRLAPGATVVLAA

SEQ ID NO: 333451 - protein, 22 aa, Mycobacterium
VELGIILALLMGWQFTAAEFVG

SEQ ID NO: 333452 - protein, 25 aa, Mycobacterium
VELLSTPELYAWAVVGILGTSTQQA

SEQ ID NO: 333453 - protein, 19 aa, Mycobacterium
VELNGRFAGVITNYRGYLR

SEQ ID NO: 333454 - protein, 23 aa, Mycobacterium
VELPINLRSGLITVTQGDRTIAR

SEQ ID NO: 333455 - protein, 20 aa, Mycobacterium
VELPLALRVIVAGVRTALVL

SEQ ID NO: 333456 - protein, 23 aa, Mycobacterium
VELPLMEVRALLDLGDVAKATRK

SEQ ID NO: 333457 - protein, 20 aa, Mycobacterium
VELPLSIPVLVSGLRVVVVT

SEQ ID NO: 333458 - protein, 20 aa, Mycobacterium
VELPQAGGLYPGGNVTYRGV

SEQ ID NO: 333459 - protein, 17 aa, Mycobacterium
VELPRLPLGTRNVTVGD

SEQ ID NO: 333460 - protein, 19 aa, Mycobacterium
VELQIAWPGDERVDRALAG

SEQ ID NO: 333461 - protein, 38 aa, Mycobacterium
VELRLPRELPVLAPGQEWRLVWDSALDRAEIGSGIESR

SEQ ID NO: 333462 - protein, 23 aa, Mycobacterium
VELRLPRELPVLAPGQEWRMVWD

SEQ ID NO: 333463 - protein, 20 aa, Mycobacterium
VELRNRLKSATGLTLPPTVI

SEQ ID NO: 333464 - protein, 20 aa, Mycobacterium
VELRNRLKTATGLTLSPTLI

SEQ ID NO: 333465 - protein, 17 aa, Mycobacterium
VELTQAIAIFFSTGLIP

SEQ ID NO: 333466 - protein, 19 aa, Mycobacterium
VEMRLIDGVSLRAMLTQFG

SEQ ID NO: 333467 - protein, 18 aa, Mycobacterium
VEMRLIDGVSLRTLLTQY

SEQ ID NO: 333468 - protein, 17 aa, Mycobacterium
VEMSFYLALPLLALLAR

SEQ ID NO: 333469 - protein, 23 aa, Mycobacterium
VEMTLLWWLRRFFAAPLPTIRIP

SEQ ID NO: 333470 - protein, 25 aa, Mycobacterium
VENDWKFKIIFGLPGIVLASIFVTL

SEQ ID NO: 333471 - protein, 24 aa, Mycobacterium
VENFRPGTMARFGLDEPVVRAVNP

SEQ ID NO: 333472 - protein, 24 aa, Mycobacterium
VENPAGKIGEVWLHGEHVAAGYWH

SEQ ID NO: 333473 - protein, 25 aa, Mycobacterium
VEPDLRVIIELGYDRTGYADVPTPA

SEQ ID NO: 333474 - protein, 23 aa, Mycobacterium
VEPERPIRTAAFFDLDKTVIAKS

SEQ ID NO: 333475 - protein, 17 aa, Mycobacterium
VEPGELVAIAGGSGAGK

SEQ ID NO: 333476 - protein, 26 aa, Mycobacterium
VEPILTRSGAEWMPNFIALLQRKLSR

SEQ ID NO: 333477 - protein, 18 aa, Mycobacterium
VEPTRLGLTVLMLNRPRP

SEQ ID NO: 333478 - protein, 24 aa, Mycobacterium
VEPVHPRWWFISTTPGRILSIGIV

SEQ ID NO: 333479 - protein, 26 aa, Mycobacterium
VEPVLTRSGADWMPNFIDLLQRKLSQ

SEQ ID NO: 333480 - protein, 39 aa, Mycobacterium
VEPVVRKTAAWAWRLLVILAAAVALLWVVKKLEVIVVPV

SEQ ID NO: 333481 - protein, 23 aa, Mycobacterium
VEQKLRPLGLLTRADGSQPEVEK

SEQ ID NO: 333482 - protein, 19 aa, Mycobacterium
VEQLLGLLLSQGRAVGISV

SEQ ID NO: 333483 - protein, 18 aa, Mycobacterium
VEQLTWRDGLVVGVAQTL

SEQ ID NO: 333484 - protein, 19 aa, Mycobacterium
VERAGAVGLGRMGGTAVVM

SEQ ID NO: 333485 - protein, 17 aa, Mycobacterium
VERARSEAVFALNISIP

SEQ ID NO: 333486 - protein, 22 aa, Mycobacterium
VERDSPTWSPRFVDHLVGDRIH

SEQ ID NO: 333487 - protein, 23 aa, Mycobacterium
VERDSPTWSPRFVDHLVGDRIHR

SEQ ID NO: 333488 - protein, 24 aa, Mycobacterium
VERELRRRILIAFDENGIRPLYLD

SEQ ID NO: 333489 - protein, 20 aa, Mycobacterium
VERFWMSLSQAWLAGVGVDW

SEQ ID NO: 333490 - protein, 22 aa, Mycobacterium
VERKRFSAAVAEVSEAALAAGR

SEQ ID NO: 333491 - protein, 26 aa, Mycobacterium
VERLPKRLASAIGMVLELLAGIPSVI

SEQ ID NO: 333492 - protein, 26 aa, Mycobacterium
VERRARAPIMARFHGMWSLGALLGAL

SEQ ID NO: 333493 - protein, 17 aa, Mycobacterium
VERRHAGGFLGFALGGP

SEQ ID NO: 333494 - protein, 24 aa, Mycobacterium
VERSIDSSRRWLIEGPAHLRREQI

SEQ ID NO: 333495 - protein, 22 aa, Mycobacterium
VESAAWPAGVPWTDASLTAAAG

SEQ ID NO: 333496 - protein, 22 aa, Mycobacterium
VESDTAAVIAFVFAGVITCAMG

SEQ ID NO: 333497 - protein, 24 aa, Mycobacterium
VESEFPGELGVLFKNLETKGNPWG

SEQ ID NO: 333498 - protein, 19 aa, Mycobacterium
VESHLRRELASELQAQSSD

SEQ ID NO: 333499 - protein, 17 aa, Mycobacterium
VESHSWIPAFGATYSLG

SEQ ID NO: 333500 - protein, 24 aa, Mycobacterium
VESLGWRWALVVAPAAALITIPIT

SEQ ID NO: 333501 - protein, 23 aa, Mycobacterium
VESMHAFSHAYARYRNGEHTSIH

SEQ ID NO: 333502 - protein, 21 aa, Mycobacterium
VESMISTLAQLYVHGHDLDMR

SEQ ID NO: 333503 - protein, 24 aa, Mycobacterium
VESMPSRPDGVYVVGTGVDIALIK

SEQ ID NO: 333504 - protein, 17 aa, Mycobacterium
VESRIKSLWLAFTGCAM

SEQ ID NO: 333505 - protein, 17 aa, Mycobacterium
VESRRRGVSVGVIVALV

SEQ ID NO: 333506 - protein, 21 aa, Mycobacterium
VESRVPEPILPPRLFRDPVFT

SEQ ID NO: 333507 - protein, 17 aa, Mycobacterium
VETGEIMIFVGGDFVVT

SEQ ID NO: 333508 - protein, 20 aa, Mycobacterium
VETLGWRSVFAVNVPLGAIV

SEQ ID NO: 333509 - protein, 30 aa, Mycobacterium
VETVHRPRWSWRRMALVATLVVLLVVAGLF

SEQ ID NO: 333510 - protein, 20 aa, Mycobacterium
VEVAADPAFAVARGAAIAAA

SEQ ID NO: 333511 - protein, 20 aa, Mycobacterium
VEVAFLAYVVHFGRKAVRAG

SEQ ID NO: 333512 - protein, 20 aa, Mycobacterium
VEVALRVSLAAAFLSAVADR

SEQ ID NO: 333513 - protein, 26 aa, Mycobacterium
VEVASRGASFVFRHRAGNAVILVLML

SEQ ID NO: 333514 - protein, 25 aa, Mycobacterium
VEVGQFIRRLFSFLVRQLDRIAPFR

SEQ ID NO: 333515 - protein, 31 aa, Mycobacterium
VEVPEDPTFALARGAAMAAAGAGSTMAQQVL

SEQ ID NO: 333516 - protein, 17 aa, Mycobacterium
VEVPKWRILPDRFGAEA

SEQ ID NO: 333517 - protein, 23 aa, Mycobacterium
VEVPSGPVAVEFDDVRFSYPAAD

SEQ ID NO: 333518 - protein, 23 aa, Mycobacterium
VEVRLPGDILRRLDDFAMESGVD

SEQ ID NO: 333519 - protein, 17 aa, Mycobacterium
VEVSFYLALPLLALLAR

SEQ ID NO: 333520 - protein, 23 aa, Mycobacterium
VEVVGRALPVFKWSVLTENTRGN

SEQ ID NO: 333521 - protein, 18 aa, Mycobacterium
VEWDELRNSITNIIDKLG

SEQ ID NO: 333522 - protein, 20 aa, Mycobacterium
VEWDTLLFFAGLFIMVGALV

SEQ ID NO: 333523 - protein, 22 aa, Mycobacterium
VEYRRGFVTRHQVTGWRFVMRR

SEQ ID NO: 333524 - protein, 24 aa, Mycobacterium
VEYVCLTGIFPLAFWLMGVLAAIR

SEQ ID NO: 333525 - protein, 27 aa, Mycobacterium
VFAALLAVSGVLGWMTWKQHQLTQAGE

SEQ ID NO: 333526 - protein, 23 aa, Mycobacterium
VFAESWYPALTLLAAAVIAARAY

SEQ ID NO: 333527 - protein, 18 aa, Mycobacterium
VFAGCVHDYLVLWISTRR

SEQ ID NO: 333528 - protein, 36 aa, Mycobacterium
VFAIGIALWLLRFAMSSSWLLALVQIGRPVFATVNM

SEQ ID NO: 333529 - protein, 20 aa, Mycobacterium
VFAPAGWRTYVSGLLIPVQA

SEQ ID NO: 333530 - protein, 19 aa, Mycobacterium
VFAPLRRRATAALATAGAR

SEQ ID NO: 333531 - protein, 20 aa, Mycobacterium
VFAPRFWVPIVAMAILVATH

SEQ ID NO: 333532 - protein, 30 aa, Mycobacterium
VFARTVHKLAVPVVFAWVGLVVVLSVLVPS

SEQ ID NO: 333533 - protein, 18 aa, Mycobacterium
VFATLGIFVACSYASLTH

SEQ ID NO: 333534 - protein, 18 aa, Mycobacterium
VFAVKSGAFFAMITGVLG

SEQ ID NO: 333535 - protein, 18 aa, Mycobacterium
VFAVKSGAFFAVTVGILG

SEQ ID NO: 333536 - protein, 19 aa, Mycobacterium
VFCGVFVQALPFLALGVVI

SEQ ID NO: 333537 - protein, 18 aa, Mycobacterium
VFCTVLGPYSFRAVFAVF

SEQ ID NO: 333538 - protein, 23 aa, Mycobacterium
VFDFSDPYFESGVQMAVLASDDD

SEQ ID NO: 333539 - protein, 24 aa, Mycobacterium
VFDFSEPYFESGIQMAVLEDNEDI

SEQ ID NO: 333540 - protein, 18 aa, Mycobacterium
VFDGWFPVHVPLRWRPEL

SEQ ID NO: 333541 - protein, 24 aa, Mycobacterium
VFDIEIVFLYPWAVAFDSLGMFAL

SEQ ID NO: 333542 - protein, 24 aa, Mycobacterium
VFDIEIVFLYPWAVSFDALGTFAL

SEQ ID NO: 333543 - protein, 19 aa, Mycobacterium
VFDKLPFVIVVLISVTTIL

SEQ ID NO: 333544 - protein, 19 aa, Mycobacterium
VFDNADFKRGLKMFLSPDG

SEQ ID NO: 333545 - protein, 25 aa, Mycobacterium
VFDNPDFKRGLEMFVSPDGKAVRMI

SEQ ID NO: 333546 - protein, 20 aa, Mycobacterium
VFDNPDFKRGLKMFLSPDGH

SEQ ID NO: 333547 - protein, 19 aa, Mycobacterium
VFDNPDFKRGMKMFMSPDG

SEQ ID NO: 333548 - protein, 23 aa, Mycobacterium
VFDPPKLPALFVGAAIIGPTVVA

SEQ ID NO: 333549 - protein, 24 aa, Mycobacterium
VFDRGDIALGWAFLGAGIGSVIRP

SEQ ID NO: 333550 - protein, 24 aa, Mycobacterium
VFDRSPGLHRLRLLEVSYGVGVSV

SEQ ID NO: 333551 - protein, 20 aa, Mycobacterium
VFDSVSWRGPTGIACVPAAI

SEQ ID NO: 333552 - protein, 26 aa, Mycobacterium
VFEILPRAAKFVVVAVVVIFVAGVVA

SEQ ID NO: 333553 - protein, 17 aa, Mycobacterium
VFERFSRGSTASHSGSG

SEQ ID NO: 333554 - protein, 19 aa, Mycobacterium
VFERGGPYLTRGAADLVPT

SEQ ID NO: 333555 - protein, 31 aa, Mycobacterium
VFFEVWLARIPFFWFDWDSGKVPKAWYPKPY

SEQ ID NO: 333556 - protein, 18 aa, Mycobacterium
VFFGLACLGLTGFVITVV

SEQ ID NO: 333557 - protein, 17 aa, Mycobacterium
VFFGLPLLLAAIVLMQV

SEQ ID NO: 333558 - protein, 18 aa, Mycobacterium
VFFGRLADRIGRRPVFLT

SEQ ID NO: 333559 - protein, 23 aa, Mycobacterium
VFFPNLSHSLALFASIATFSTAF

SEQ ID NO: 333560 - protein, 18 aa, Mycobacterium
VFFSGRRVHRAEGGAMVV

SEQ ID NO: 333561 - protein, 20 aa, Mycobacterium
VFFTGAFRRPREANWVIGSV

SEQ ID NO: 333562 - protein, 17 aa, Mycobacterium
VFGCAALLAAAIPMGRS

SEQ ID NO: 333563 - protein, 17 aa, Mycobacterium
VFGESLGSFGGEAPFLS

SEQ ID NO: 333564 - protein, 17 aa, Mycobacterium
VFGESLGSFGGEAPFMN

SEQ ID NO: 333565 - protein, 17 aa, Mycobacterium
VFGFCLLEAVNYLEHYG

SEQ ID NO: 333566 - protein, 24 aa, Mycobacterium
VFGGLSVGIGVAWICVVSAEMISG

SEQ ID NO: 333567 - protein, 25 aa, Mycobacterium
VFGGLSVGMGVAWICVISAEMISGR

SEQ ID NO: 333568 - protein, 24 aa, Mycobacterium
VFGGRFTAPLGFLLSGCGAASFLL

SEQ ID NO: 333569 - protein, 23 aa, Mycobacterium
VFGHNWMDGWRGLLISVVLGLAG

SEQ ID NO: 333570 - protein, 18 aa, Mycobacterium
VFGLLVAWVLTRDEFPGK

SEQ ID NO: 333571 - protein, 27 aa, Mycobacterium
VFGMPKFDFVACLTMIIVLMITSVEST

SEQ ID NO: 333572 - protein, 23 aa, Mycobacterium
VFGMWYWEFDRGGPFARRTPDRP

SEQ ID NO: 333573 - protein, 25 aa, Mycobacterium
VFGPLRRRATAALAIAGERRRRERE

SEQ ID NO: 333574 - protein, 18 aa, Mycobacterium
VFGPPGTVANINYLDIEA

SEQ ID NO: 333575 - protein, 21 aa, Mycobacterium
VFGQMRFDRTNGYSAEFSNIS

SEQ ID NO: 333576 - protein, 21 aa, Mycobacterium
VFGRLNWWAPAPLARLRRRTD

SEQ ID NO: 333577 - protein, 18 aa, Mycobacterium
VFGVILLAGLAWYWYLKR

SEQ ID NO: 333578 - protein, 21 aa, Mycobacterium
VFHASVGLAHRLPGGPVIKPA

SEQ ID NO: 333579 - protein, 18 aa, Mycobacterium
VFHGFPLGLYLIATVTAL

SEQ ID NO: 333580 - protein, 18 aa, Mycobacterium
VFHRGRTVLARFAIASAV

SEQ ID NO: 333581 - protein, 29 aa, Mycobacterium
VFIAAGFGWKSYRQWRTTGSTGFRGFHGR

SEQ ID NO: 333582 - protein, 18 aa, Mycobacterium
VFIGFAFVGMPLVAQLGV

SEQ ID NO: 333583 - protein, 18 aa, Mycobacterium
VFIICWITGSSVMAAGGW

SEQ ID NO: 333584 - protein, 18 aa, Mycobacterium
VFIICWITGSSVMAGGGW

SEQ ID NO: 333585 - protein, 20 aa, Mycobacterium
VFLAALLLGPGIPLALLYAG

SEQ ID NO: 333586 - protein, 24 aa, Mycobacterium
VFLAARYWLWIAVATGVVVALVLL

SEQ ID NO: 333587 - protein, 22 aa, Mycobacterium
VFLACTMISLAVLYIAQDAPFL

SEQ ID NO: 333588 - protein, 19 aa, Mycobacterium
VFLFPAGVLVLIAFCANLV

SEQ ID NO: 333589 - protein, 18 aa, Mycobacterium
VFLFWPWEYQPFGSEGEF

SEQ ID NO: 333590 - protein, 18 aa, Mycobacterium
VFLGEISYEIFLIHLVTM

SEQ ID NO: 333591 - protein, 24 aa, Mycobacterium
VFLHGAGLRTGMIRTFGGTGGVVT

SEQ ID NO: 333592 - protein, 17 aa, Mycobacterium
VFLLNFVSFIAVGIALW

SEQ ID NO: 333593 - protein, 29 aa, Mycobacterium
VFLTGFDWTRWLTIVAFDVAIVFLLFAAR

SEQ ID NO: 333594 - protein, 17 aa, Mycobacterium
VFLTGIIAAVAGLKVLP

SEQ ID NO: 333595 - protein, 29 aa, Mycobacterium
VFLVALCRQRWGLVTGMVILAALLKPQLV

SEQ ID NO: 333596 - protein, 24 aa, Mycobacterium
VFLVIATALTWLVYVTLRRDVKGA

SEQ ID NO: 333597 - protein, 22 aa, Mycobacterium
VFMRPGQRLTRGMVLVDDRAVD

SEQ ID NO: 333598 - protein, 21 aa, Mycobacterium
VFNNPDFKRGLKLFLSPDGKA

SEQ ID NO: 333599 - protein, 23 aa, Mycobacterium
VFPEHKYRIVRLLQAGGHIVGMT

SEQ ID NO: 333600 - protein, 26 aa, Mycobacterium
VFPLAEWVIHVAILHWRPRRLGPVVV

SEQ ID NO: 333601 - protein, 17 aa, Mycobacterium
VFPLQARTLVPVAGMMI

SEQ ID NO: 333602 - protein, 24 aa, Mycobacterium
VFPPERRGAAAGVWAAVAGFGSLV

SEQ ID NO: 333603 - protein, 18 aa, Mycobacterium
VFQGRDLLGEFVSRKASF

SEQ ID NO: 333604 - protein, 20 aa, Mycobacterium
VFQNPDFQLGLSLMMSPDGK

SEQ ID NO: 333605 - protein, 17 aa, Mycobacterium
VFQWGWLEQLGFPRISS

SEQ ID NO: 333606 - protein, 20 aa, Mycobacterium
VFRGPPSWNVGYKSIRSSNT

SEQ ID NO: 333607 - protein, 17 aa, Mycobacterium
VFRHWVAHFNLVVAAAL

SEQ ID NO: 333608 - protein, 25 aa, Mycobacterium
VFRYYSSKNAIVWGDFDSHLGVMRA

SEQ ID NO: 333609 - protein, 25 aa, Mycobacterium
VFSLLTAIIARWVHRQISKGVVSTV

SEQ ID NO: 333610 - protein, 18 aa, Mycobacterium
VFSSFWFTAIYVLLFVSL

SEQ ID NO: 333611 - protein, 21 aa, Mycobacterium
VFSSYRLDHQFELMRQIGELT

SEQ ID NO: 333612 - protein, 18 aa, Mycobacterium
VFSVVMIFACLFFAVYFM

SEQ ID NO: 333613 - protein, 24 aa, Mycobacterium
VFTDAPWWVTFVVAPAYIVVALVL

SEQ ID NO: 333614 - protein, 26 aa, Mycobacterium
VFTDFKLRSAAGMIGRFPHVVAAVSN

SEQ ID NO: 333615 - protein, 20 aa, Mycobacterium
VFTGYPFLRGALRSLRSGKA

SEQ ID NO: 333616 - protein, 17 aa, Mycobacterium
VFTMRIAAAIGFLQMKR

SEQ ID NO: 333617 - protein, 21 aa, Mycobacterium
VFTNPDFKRGLKMFVSPDGKA

SEQ ID NO: 333618 - protein, 24 aa, Mycobacterium
VFTSGVMLIRWLIARRAAVFAHHG

SEQ ID NO: 333619 - protein, 19 aa, Mycobacterium
VFVAISCRTVIRLLKPDAH

SEQ ID NO: 333620 - protein, 18 aa, Mycobacterium
VFVAVLIGLIVYGITELL

SEQ ID NO: 333621 - protein, 21 aa, Mycobacterium
VFVGAFTVMRVRTFFGSGDDP

SEQ ID NO: 333622 - protein, 24 aa, Mycobacterium
VFVGAVLFTVIWWNIEHTRSNWLV

SEQ ID NO: 333623 - protein, 18 aa, Mycobacterium
VFVGRLFGTTAMWLAVLF

SEQ ID NO: 333624 - protein, 18 aa, Mycobacterium
VFVTAPWQLIVLRLVIGA

SEQ ID NO: 333625 - protein, 18 aa, Mycobacterium
VFVTLPFVVREVEPVLHE

SEQ ID NO: 333626 - protein, 17 aa, Mycobacterium
VFVWVEGRAPAGILPPR

SEQ ID NO: 333627 - protein, 18 aa, Mycobacterium
VFWINVPLTAIAMLMIQF

SEQ ID NO: 333628 - protein, 19 aa, Mycobacterium
VFYIFGAFLVYTAVNLVRD

SEQ ID NO: 333629 - protein, 29 aa, Mycobacterium
VGAALVGLLMRWRNRYGWSAFVFGLPVLP

SEQ ID NO: 333630 - protein, 25 aa, Mycobacterium
VGAALWRLGDALALPGIPDSPAIFV

SEQ ID NO: 333631 - protein, 20 aa, Mycobacterium
VGAASIWLSVIVLLPLAAIL

SEQ ID NO: 333632 - protein, 19 aa, Mycobacterium
VGAATVWLSVIVLLPLAAI

SEQ ID NO: 333633 - protein, 18 aa, Mycobacterium
VGAAVIFPTTLGLITNIF

SEQ ID NO: 333634 - protein, 20 aa, Mycobacterium
VGAAVWRLGELSGIPGVPDA

SEQ ID NO: 333635 - protein, 17 aa, Mycobacterium
VGADGRLYRQSDLVKPS

SEQ ID NO: 333636 - protein, 21 aa, Mycobacterium
VGADYSMLFAARIREESHDGM

SEQ ID NO: 333637 - protein, 25 aa, Mycobacterium
VGAESRVAIALPRSADLIVAVLAVI

SEQ ID NO: 333638 - protein, 19 aa, Mycobacterium
VGAFAPMWPVPAGAVRTLV

SEQ ID NO: 333639 - protein, 26 aa, Mycobacterium
VGAFLRLPYTFAVPIFGGRNWTTISA

SEQ ID NO: 333640 - protein, 26 aa, Mycobacterium
VGAFLRLPYTFAVPLFGGRNWTTISA

SEQ ID NO: 333641 - protein, 23 aa, Mycobacterium
VGAGELLRRNLLIYGLGGVIVPF

SEQ ID NO: 333642 - protein, 18 aa, Mycobacterium
VGAGLVMGRMAFKEDKEN

SEQ ID NO: 333643 - protein, 19 aa, Mycobacterium
VGAIFKLVVPMLVVGALIL

SEQ ID NO: 333644 - protein, 23 aa, Mycobacterium
VGAITYWLVHMIGGYPGAIIGFA

SEQ ID NO: 333645 - protein, 20 aa, Mycobacterium
VGAKLRFNYDDSLDVVGVHF

SEQ ID NO: 333646 - protein, 24 aa, Mycobacterium
VGALAILVMVVWVGTALTISTTAS

SEQ ID NO: 333647 - protein, 19 aa, Mycobacterium
VGALASLLASMYFLVADLG

SEQ ID NO: 333648 - protein, 19 aa, Mycobacterium
VGALCGVASMAFMAVSATL

SEQ ID NO: 333649 - protein, 18 aa, Mycobacterium
VGALFVLGFLRFGLPPSD

SEQ ID NO: 333650 - protein, 23 aa, Mycobacterium
VGALGILVMVVWVGTALTLSTAA

SEQ ID NO: 333651 - protein, 21 aa, Mycobacterium
VGALGVALALMGRAQHRDDLR

SEQ ID NO: 333652 - protein, 17 aa, Mycobacterium
VGALIFGLWADRVGRRL

SEQ ID NO: 333653 - protein, 17 aa, Mycobacterium
VGALIFGLWADRVGRRV

SEQ ID NO: 333654 - protein, 17 aa, Mycobacterium
VGALLGLLIGGRKEHAE

SEQ ID NO: 333655 - protein, 27 aa, Mycobacterium
VGALLRLPYTFAIPVFGGRNWTTISAS

SEQ ID NO: 333656 - protein, 26 aa, Mycobacterium
VGALLRLPYTFAVPIFGGRNWTIISA

SEQ ID NO: 333657 - protein, 26 aa, Mycobacterium
VGALLWSYNGGRTFQELGLASSDNLY

SEQ ID NO: 333658 - protein, 26 aa, Mycobacterium
VGALPFCVHRVWAGPVPVRLGSLVGA

SEQ ID NO: 333659 - protein, 20 aa, Mycobacterium
VGALPGFLLVGVCFLTATFR

SEQ ID NO: 333660 - protein, 19 aa, Mycobacterium
VGALRLTPFASSYRVTVSL

SEQ ID NO: 333661 - protein, 18 aa, Mycobacterium
VGALTYWLSSGVTSATGS

SEQ ID NO: 333662 - protein, 21 aa, Mycobacterium
VGALVSLLASMYFLVGDLGRP

SEQ ID NO: 333663 - protein, 18 aa, Mycobacterium
VGALWGYVFVTCLGAIAP

SEQ ID NO: 333664 - protein, 20 aa, Mycobacterium
VGAPLPLLLWLAGPGDSLVS

SEQ ID NO: 333665 - protein, 21 aa, Mycobacterium
VGAQIAALVPDGGWQGLAAQA

SEQ ID NO: 333666 - protein, 17 aa, Mycobacterium
VGARIIMLNTEFSGPQI

SEQ ID NO: 333667 - protein, 25 aa, Mycobacterium
VGARIWPGPAAAVLLALASSAVLAV

SEQ ID NO: 333668 - protein, 24 aa, Mycobacterium
VGASARGAGRLGFAGTAPAAAGTT

SEQ ID NO: 333669 - protein, 17 aa, Mycobacterium
VGASGFAAAMAQPYLSE

SEQ ID NO: 333670 - protein, 25 aa, Mycobacterium
VGASGRGAGQLGFAGTLPRTTSTTS

SEQ ID NO: 333671 - protein, 18 aa, Mycobacterium
VGASKGYFLLGIWMSLFW

SEQ ID NO: 333672 - protein, 18 aa, Mycobacterium
VGASRWYTQLPFLMEAML

SEQ ID NO: 333673 - protein, 30 aa, Mycobacterium
VGATVAFFANFGWRALRRSAMVAAVSAGVA

SEQ ID NO: 333674 - protein, 19 aa, Mycobacterium
VGAVAAFVMAITGFGWAGY

SEQ ID NO: 333675 - protein, 18 aa, Mycobacterium
VGAVALSFQAARLQLMRS

SEQ ID NO: 333676 - protein, 20 aa, Mycobacterium
VGAVCALAGTLLPIRTARGH

SEQ ID NO: 333677 - protein, 23 aa, Mycobacterium
VGAVGMVLMAIWFHVWQDDVRDL

SEQ ID NO: 333678 - protein, 28 aa, Mycobacterium
VGAVHFWPADRGEAFIFAVCVVLFLTTL

SEQ ID NO: 333679 - protein, 20 aa, Mycobacterium
VGAVLLFYLLWGRRHSALND

SEQ ID NO: 333680 - protein, 21 aa, Mycobacterium
VGCALDYEYIAMLFVEADSAT

SEQ ID NO: 333681 - protein, 25 aa, Mycobacterium
VGCGSLGASGYLVWHHRTVAHQQQR

SEQ ID NO: 333682 - protein, 17 aa, Mycobacterium
VGCHGGYLSVSGQANTV

SEQ ID NO: 333683 - protein, 33 aa, Mycobacterium
VGCLAGLLAVGWVWRSARFRRLAQLGGLVLVSA

SEQ ID NO: 333684 - protein, 28 aa, Mycobacterium
VGCLAGLVATGWVWRRGHRLIAQLGGLV

SEQ ID NO: 333685 - protein, 29 aa, Mycobacterium
VGCLTPRLFEHFRSLRATPVPAPRNLSRL

SEQ ID NO: 333686 - protein, 17 aa, Mycobacterium
VGCVFWAAVTMLLAAWG

SEQ ID NO: 333687 - protein, 21 aa, Mycobacterium
VGCVYRGATIVMLRQFDPKRI

SEQ ID NO: 333688 - protein, 23 aa, Mycobacterium
VGDAGLALGMFVMFATFGTLSYA

SEQ ID NO: 333689 - protein, 23 aa, Mycobacterium
VGDAGLALGMFVMFSTFGTLSYA

SEQ ID NO: 333690 - protein, 17 aa, Mycobacterium
VGDARSGVGGVIRKAKE

SEQ ID NO: 333691 - protein, 22 aa, Mycobacterium
VGDDPKTEFIQPLATQARPKAA

SEQ ID NO: 333692 - protein, 22 aa, Mycobacterium
VGDGPWLDFCVRVADRVVLVAR

SEQ ID NO: 333693 - protein, 19 aa, Mycobacterium
VGDLFLLNFLTIVTEFIGI

SEQ ID NO: 333694 - protein, 20 aa, Mycobacterium
VGDLFLLNFLTIVTEFIGIT

SEQ ID NO: 333695 - protein, 19 aa, Mycobacterium
VGDPPVWYVAAVVAFTAMV

SEQ ID NO: 333696 - protein, 18 aa, Mycobacterium
VGDRIAALHAPDGGWQGS

SEQ ID NO: 333697 - protein, 25 aa, Mycobacterium
VGDRLRKDFAHDLAMAVPVVVPDAR

SEQ ID NO: 333698 - protein, 27 aa, Mycobacterium
VGDVFRRSWKWLSVVGLVAILVICVGY

SEQ ID NO: 333699 - protein, 24 aa, Mycobacterium
VGDVLLIRPGERVGGDGVVIDGAS

SEQ ID NO: 333700 - protein, 23 aa, Mycobacterium
VGDVRKYLRPGFHPDDINTDELL

SEQ ID NO: 333701 - protein, 22 aa, Mycobacterium
VGEALKVMFIITGVALVGLVVF

SEQ ID NO: 333702 - protein, 18 aa, Mycobacterium
VGEEVIAAGAPLGLRSTV

SEQ ID NO: 333703 - protein, 19 aa, Mycobacterium
VGEEVIAAGAPLGLRSTVT

SEQ ID NO: 333704 - protein, 23 aa, Mycobacterium
VGELCIRGPFVMQGYYKRSREEC

SEQ ID NO: 333705 - protein, 18 aa, Mycobacterium
VGELCIRGPYVMQGYYKR

SEQ ID NO: 333706 - protein, 20 aa, Mycobacterium
VGELIVQAWTLLKVTAVPAV

SEQ ID NO: 333707 - protein, 18 aa, Mycobacterium
VGEPKRFRKAKAAKNGRP

SEQ ID NO: 333708 - protein, 20 aa, Mycobacterium
VGESKGYFLLGIWSSLIYAV

SEQ ID NO: 333709 - protein, 18 aa, Mycobacterium
VGEVLAIISATAAALDYA

SEQ ID NO: 333710 - protein, 18 aa, Mycobacterium
VGEVLEIVAPVADALDYA

SEQ ID NO: 333711 - protein, 17 aa, Mycobacterium
VGEVPIYDIIVGNGDGE

SEQ ID NO: 333712 - protein, 19 aa, Mycobacterium
VGFAAIVFLVVRYVVPPVR

SEQ ID NO: 333713 - protein, 24 aa, Mycobacterium
VGFALAFLVARSFSSGCAALTGVE

SEQ ID NO: 333714 - protein, 18 aa, Mycobacterium
VGFALVMFVAGTHVPVRD

SEQ ID NO: 333715 - protein, 19 aa, Mycobacterium
VGFAQLLGYLFVKMRQPKV

SEQ ID NO: 333716 - protein, 19 aa, Mycobacterium
VGFDAVIARGMAKEPDDRY

SEQ ID NO: 333717 - protein, 18 aa, Mycobacterium
VGFDCSGLTRFAFAGVGV

SEQ ID NO: 333718 - protein, 19 aa, Mycobacterium
VGFEVFKQAGSLYLRAVLR

SEQ ID NO: 333719 - protein, 17 aa, Mycobacterium
VGFFNGFLVMRTKIPSF

SEQ ID NO: 333720 - protein, 17 aa, Mycobacterium
VGFGGMFAFYTYISTTL

SEQ ID NO: 333721 - protein, 32 aa, Mycobacterium
VGFGNTGADVFGRGGPYLARGAADLVPSAQLL

SEQ ID NO: 333722 - protein, 19 aa, Mycobacterium
VGFISWVVLALARGRFRSV

SEQ ID NO: 333723 - protein, 24 aa, Mycobacterium
VGFKTKISTLLSWTVTFLSTRRGQ

SEQ ID NO: 333724 - protein, 25 aa, Mycobacterium
VGFKTKIVTLLSWGVTFLSTKRGQL

SEQ ID NO: 333725 - protein, 24 aa, Mycobacterium
VGFKTKIVTLLSWTVTFLSTKRGQ

SEQ ID NO: 333726 - protein, 25 aa, Mycobacterium
VGFKTKVSTLLSWTVTFLSTRRGQL

SEQ ID NO: 333727 - protein, 19 aa, Mycobacterium
VGFLCAFAPNFTVLVILRL

SEQ ID NO: 333728 - protein, 19 aa, Mycobacterium
VGFLLLLWLFIWSVLRILR

SEQ ID NO: 333729 - protein, 35 aa, Mycobacterium
VGFLMRPVGGFLFGWLADRRGRRFSMTTSMLLMAA

SEQ ID NO: 333730 - protein, 25 aa, Mycobacterium
VGFMPVLLYRIWRVARFPASVPALA

SEQ ID NO: 333731 - protein, 17 aa, Mycobacterium
VGFMWTEAVAYTAISAA

SEQ ID NO: 333732 - protein, 18 aa, Mycobacterium
VGFNIVFSDARIDDVQIG

SEQ ID NO: 333733 - protein, 18 aa, Mycobacterium
VGFQSTAVLLVWLVLGVV

SEQ ID NO: 333734 - protein, 18 aa, Mycobacterium
VGFSMLALMTRRWTLAWV

SEQ ID NO: 333735 - protein, 25 aa, Mycobacterium
VGFSMLALVTRRWALAWVALAGSAI

SEQ ID NO: 333736 - protein, 19 aa, Mycobacterium
VGFTLAIGILIDAFLVRMT

SEQ ID NO: 333737 - protein, 19 aa, Mycobacterium
VGFTVRIGLFVLTPTMFGV

SEQ ID NO: 333738 - protein, 27 aa, Mycobacterium
VGFVEEILQRNGFRVTLAAVATTGGGA

SEQ ID NO: 333739 - protein, 23 aa, Mycobacterium
VGFVGVLFTGVWVLIAYFRAEVR

SEQ ID NO: 333740 - protein, 19 aa, Mycobacterium
VGFVMGRSRFMAAYFSLPL

SEQ ID NO: 333741 - protein, 17 aa, Mycobacterium
VGFWNFVGAGIFGFLIN

SEQ ID NO: 333742 - protein, 28 aa, Mycobacterium
VGGALAEVSWRLAFLINVPAGALMIYLA

SEQ ID NO: 333743 - protein, 18 aa, Mycobacterium
VGGALAWQAGSTVRPLAY

SEQ ID NO: 333744 - protein, 26 aa, Mycobacterium
VGGALLEHFHWGAVFLVAVPILLPLL

SEQ ID NO: 333745 - protein, 28 aa, Mycobacterium
VGGALTEVSWRWAFLVNVPIGLVMVYLA

SEQ ID NO: 333746 - protein, 23 aa, Mycobacterium
VGGEGSFWRRLFSGRALTSVSHV

SEQ ID NO: 333747 - protein, 24 aa, Mycobacterium
VGGEPRAKILLEVNPKYLKLIPRN

SEQ ID NO: 333748 - protein, 23 aa, Mycobacterium
VGGFAGPFVTGWLRDLFGNDQGA

SEQ ID NO: 333749 - protein, 34 aa, Mycobacterium
VGGFFRMCVLTGKALFRRPFQWRELILQCWFVMR

SEQ ID NO: 333750 - protein, 20 aa, Mycobacterium
VGGGAVWLIAWRVVQGVGGA

SEQ ID NO: 333751 - protein, 30 aa, Mycobacterium
VGGGIALLLVVVVLVLGFWQPGFFVTTKLD

SEQ ID NO: 333752 - protein, 17 aa, Mycobacterium
VGGGLLASFSLRTESAL

SEQ ID NO: 333753 - protein, 17 aa, Mycobacterium
VGGILFGHFGDRLGRKR

SEQ ID NO: 333754 - protein, 18 aa, Mycobacterium
VGGLAPTVWGWRNRPVWR

SEQ ID NO: 333755 - protein, 18 aa, Mycobacterium
VGGLVIAAGFGYTAPAAA

SEQ ID NO: 333756 - protein, 30 aa, Mycobacterium
VGGLVIGLAFAWGRRLLRRLPHDVMTANAI

SEQ ID NO: 333757 - protein, 18 aa, Mycobacterium
VGGMAIWYVIGANSSDDG

SEQ ID NO: 333758 - protein, 30 aa, Mycobacterium
VGGMICVVPGFLLELMVAFFTSDLVIRVSY

SEQ ID NO: 333759 - protein, 23 aa, Mycobacterium
VGGPRRKGRIISEHEKKITAYHE

SEQ ID NO: 333760 - protein, 19 aa, Mycobacterium
VGGRGPALNVTYFDASGSL

SEQ ID NO: 333761 - protein, 21 aa, Mycobacterium
VGGRMLPFWLVGGALMGAAVD

SEQ ID NO: 333762 - protein, 19 aa, Mycobacterium
VGGSCWIPRVFDHAPVPPQ

SEQ ID NO: 333763 - protein, 19 aa, Mycobacterium
VGGSGDWGPSLGPTVGGRS

SEQ ID NO: 333764 - protein, 21 aa, Mycobacterium
VGGTGSWRLALGVLAVLLLVV

SEQ ID NO: 333765 - protein, 35 aa, Mycobacterium
VGGTPRGVGWLPLRMAAPFVRPVAAWQLGKLRPII

SEQ ID NO: 333766 - protein, 19 aa, Mycobacterium
VGGTWHWNTYPGIAVDIPS

SEQ ID NO: 333767 - protein, 33 aa, Mycobacterium
VGGVFRVLLCIAEARPFVLLPKFELQRWAAAVR

SEQ ID NO: 333768 - protein, 18 aa, Mycobacterium
VGGVLAWIASSVSEPPAR

SEQ ID NO: 333769 - protein, 25 aa, Mycobacterium
VGGVLPFVWIAWIALRNFRSGSTVE

SEQ ID NO: 333770 - protein, 18 aa, Mycobacterium
VGGVRAVRAYPRTASVVI

SEQ ID NO: 333771 - protein, 18 aa, Mycobacterium
VGGVSARLLSLYIAGGML

SEQ ID NO: 333772 - protein, 19 aa, Mycobacterium
VGGVTRLIPLTGLTTPWMS

SEQ ID NO: 333773 - protein, 17 aa, Mycobacterium
VGGVVFGALGDRIGRKR

SEQ ID NO: 333774 - protein, 17 aa, Mycobacterium
VGHAEAGLHQWLNVTLL

SEQ ID NO: 333775 - protein, 17 aa, Mycobacterium
VGHAEASMHQWLDVTLL

SEQ ID NO: 333776 - protein, 18 aa, Mycobacterium
VGHAIGYQRHEACPGNGD

SEQ ID NO: 333777 - protein, 17 aa, Mycobacterium
VGHAIGYQRHEQCTENG

SEQ ID NO: 333778 - protein, 18 aa, Mycobacterium
VGHCGDFYTAGPGNQLLT

SEQ ID NO: 333779 - protein, 20 aa, Mycobacterium
VGHNMRMRKVLVGLTATAIV

SEQ ID NO: 333780 - protein, 46 aa, Mycobacterium
VGIALVFVRWWGLPAWSWAVLWRRGRRPIDWSAPITVANNRSGGGV

SEQ ID NO: 333781 - protein, 18 aa, Mycobacterium
VGIAVMFLLPKVTTAVPA

SEQ ID NO: 333782 - protein, 21 aa, Mycobacterium
VGIFALCLPVFIDAYDQYGWQ

SEQ ID NO: 333783 - protein, 19 aa, Mycobacterium
VGIFSFFANDLFQTFFQVD

SEQ ID NO: 333784 - protein, 17 aa, Mycobacterium
VGIGATLTVVWAIVTKK

SEQ ID NO: 333785 - protein, 19 aa, Mycobacterium
VGIGLAWGRGGMLVLGQGV

SEQ ID NO: 333786 - protein, 17 aa, Mycobacterium
VGIGLLVAIGILVGRVM

SEQ ID NO: 333787 - protein, 26 aa, Mycobacterium
VGIGVALAGWAYWYIQSEGWADRGNP

SEQ ID NO: 333788 - protein, 26 aa, Mycobacterium
VGIGVRPRGPLVFRVAERMSLISDAL

SEQ ID NO: 333789 - protein, 27 aa, Mycobacterium
VGIGVRPRGPLVFRVAERMSLISDALY

SEQ ID NO: 333790 - protein, 24 aa, Mycobacterium
VGIKRYEVSSAQSPRSKPTSPRTI

SEQ ID NO: 333791 - protein, 17 aa, Mycobacterium
VGIMRLVGATRWYTQLP

SEQ ID NO: 333792 - protein, 24 aa, Mycobacterium
VGINALICLVAFRVTTARDLTYRQ

SEQ ID NO: 333793 - protein, 24 aa, Mycobacterium
VGIPGSRPALFTVLIAVTALSLLA

SEQ ID NO: 333794 - protein, 19 aa, Mycobacterium
VGITTCWEVIFDRAARESV

SEQ ID NO: 333795 - protein, 20 aa, Mycobacterium
VGIVSGALFVRRQNRSATPM

SEQ ID NO: 333796 - protein, 37 aa, Mycobacterium
VGKATFRTPFQWREFILQSWFLLRVAFLPTVAVSIPL

SEQ ID NO: 333797 - protein, 24 aa, Mycobacterium
VGKGRPADRPALLGAVKTNIGHLE

SEQ ID NO: 333798 - protein, 24 aa, Mycobacterium
VGKGRPADRPALLGAVKTNVGHLE

SEQ ID NO: 333799 - protein, 36 aa, Mycobacterium
VGKLEFGGFIAWLAWLLLHLYYLIGHRNRIAAMFAW

SEQ ID NO: 333800 - protein, 36 aa, Mycobacterium
VGKVEFAGFFAWLAWLVLHLYYLIGHRNRLAAMFAW

SEQ ID NO: 333801 - protein, 25 aa, Mycobacterium
VGLAAGVFFVWWELRTDHPALDLRI

SEQ ID NO: 333802 - protein, 33 aa, Mycobacterium
VGLAALAFKVWTRWPLRAVTAAGVYLAGGSLLL

SEQ ID NO: 333803 - protein, 17 aa, Mycobacterium
VGLALGVARSIVSLLGE

SEQ ID NO: 333804 - protein, 19 aa, Mycobacterium
VGLALSVLLGLWLLPGLPW

SEQ ID NO: 333805 - protein, 22 aa, Mycobacterium
VGLAPERITGWATAIRYQAVFA

SEQ ID NO: 333806 - protein, 25 aa, Mycobacterium
VGLAPRWLPYLAVVEGAGVVGLVIG

SEQ ID NO: 333807 - protein, 19 aa, Mycobacterium
VGLASYLLIGFWYQKPSAA

SEQ ID NO: 333808 - protein, 28 aa, Mycobacterium
VGLAVTGQFPWSRVPAYIAAQVLGAIIG

SEQ ID NO: 333809 - protein, 23 aa, Mycobacterium
VGLCVGVSIVLPAAVWGVLTPGR

SEQ ID NO: 333810 - protein, 21 aa, Mycobacterium
VGLFFAFWSWVGFESSAMYGE

SEQ ID NO: 333811 - protein, 25 aa, Mycobacterium
VGLFSGVLGAFAMRRAALPASGLYP

SEQ ID NO: 333812 - protein, 18 aa, Mycobacterium
VGLGHHYVIGSGNHLLNE

SEQ ID NO: 333813 - protein, 21 aa, Mycobacterium
VGLGLAGGVPQVFTVAGNIDE

SEQ ID NO: 333814 - protein, 21 aa, Mycobacterium
VGLGLSVVKGFVEAMEGTVNA

SEQ ID NO: 333815 - protein, 26 aa, Mycobacterium
VGLGRWRWRADGLGALGLAALIGLPG

SEQ ID NO: 333816 - protein, 24 aa, Mycobacterium
VGLGSFGIRVVRDLIAAGYDVAVI

SEQ ID NO: 333817 - protein, 19 aa, Mycobacterium
VGLGSGFLITLAYMVFEAS

SEQ ID NO: 333818 - protein, 21 aa, Mycobacterium
VGLGVFCVGGALVIGALGKRA

SEQ ID NO: 333819 - protein, 21 aa, Mycobacterium
VGLGVYGAWCLLRHAEFREYR

SEQ ID NO: 333820 - protein, 22 aa, Mycobacterium
VGLHRIFRPGVQTYEFWLKIGI

SEQ ID NO: 333821 - protein, 17 aa, Mycobacterium
VGLHSRRNLALYVTALL

SEQ ID NO: 333822 - protein, 40 aa, Mycobacterium
VGLIAQYLSFAWAFGISGGMLLLAALCWTFAPETRPRPSA

SEQ ID NO: 333823 - protein, 25 aa, Mycobacterium
VGLIAQYTSYGWAFLVSGIILAVAA

SEQ ID NO: 333824 - protein, 17 aa, Mycobacterium
VGLIGCVVLAFTLPPVS

SEQ ID NO: 333825 - protein, 19 aa, Mycobacterium
VGLIPFVIIQAVFGFSLLE

SEQ ID NO: 333826 - protein, 35 aa, Mycobacterium
VGLIVSWIAVILLTFHWARVVWQRTIVQLAAEEQR

SEQ ID NO: 333827 - protein, 19 aa, Mycobacterium
VGLKMPAIFIAGFIPMFLT

SEQ ID NO: 333828 - protein, 18 aa, Mycobacterium
VGLLDFGGSASYATLVET

SEQ ID NO: 333829 - protein, 26 aa, Mycobacterium
VGLLFKVGAVPFHFWVPDVYQGAPTP

SEQ ID NO: 333830 - protein, 17 aa, Mycobacterium
VGLLGLFLTYAGWAPAN

SEQ ID NO: 333831 - protein, 21 aa, Mycobacterium
VGLLILSLVYLQFRGDFDRKV

SEQ ID NO: 333832 - protein, 26 aa, Mycobacterium
VGLLLNALFGWSWADPIVALVIAGVA

SEQ ID NO: 333833 - protein, 26 aa, Mycobacterium
VGLLPAWKIVLILLLLAVLGLRDKVI

SEQ ID NO: 333834 - protein, 25 aa, Mycobacterium
VGLLRFYGARARRLLPASATVGVVT

SEQ ID NO: 333835 - protein, 21 aa, Mycobacterium
VGLLRYRRRRISLAARPEVES

SEQ ID NO: 333836 - protein, 24 aa, Mycobacterium
VGLLVIGGLAWLFGARVVADGCWI

SEQ ID NO: 333837 - protein, 28 aa, Mycobacterium
VGLMPLRLFPRWIHPFVRNQPISQFVEA

SEQ ID NO: 333838 - protein, 17 aa, Mycobacterium
VGLPEWIYLPAAVGALF

SEQ ID NO: 333839 - protein, 24 aa, Mycobacterium
VGLPQDIWWLLPVVKTASAAGLIG

SEQ ID NO: 333840 - protein, 19 aa, Mycobacterium
VGLPRQLGLPGIRHSIGLA

SEQ ID NO: 333841 - protein, 19 aa, Mycobacterium
VGLQAKYPLATVGFLILVA

SEQ ID NO: 333842 - protein, 21 aa, Mycobacterium
VGLRNVYLWVVYFLGESALTL

SEQ ID NO: 333843 - protein, 23 aa, Mycobacterium
VGLRPGEEKLVFSRFWRADPSRV

SEQ ID NO: 333844 - protein, 23 aa, Mycobacterium
VGLRPGEEKLVFSRFWRSDPSRV

SEQ ID NO: 333845 - protein, 25 aa, Mycobacterium
VGLRPPRLWAGLRLGAAAAAVTTTA

SEQ ID NO: 333846 - protein, 20 aa, Mycobacterium
VGLRVYLTWITSTGYTYGAL

SEQ ID NO: 333847 - protein, 19 aa, Mycobacterium
VGLSLFYWWYHTLDKTAAV

SEQ ID NO: 333848 - protein, 18 aa, Mycobacterium
VGLTFRFLLNDQLGAIPA

SEQ ID NO: 333849 - protein, 29 aa, Mycobacterium
VGLVCLGAGMLRLGYLANMLSKPVLVGYM

SEQ ID NO: 333850 - protein, 18 aa, Mycobacterium
VGLVGMWLTGSFLDNWLP

SEQ ID NO: 333851 - protein, 19 aa, Mycobacterium
VGLVHAELNSVALLLYTAS

SEQ ID NO: 333852 - protein, 19 aa, Mycobacterium
VGLVIATAVAVSWTARAFG

SEQ ID NO: 333853 - protein, 20 aa, Mycobacterium
VGLVLGMLVHYVRTRLDDPL

SEQ ID NO: 333854 - protein, 18 aa, Mycobacterium
VGLVLRWISRTAGPGPLA

SEQ ID NO: 333855 - protein, 17 aa, Mycobacterium
VGLVRYRRRKIKLSAPE

SEQ ID NO: 333856 - protein, 19 aa, Mycobacterium
VGLVRYRRRQIKLSAPDTA

SEQ ID NO: 333857 - protein, 18 aa, Mycobacterium
VGLVTCRVLQGGAAAATW

SEQ ID NO: 333858 - protein, 18 aa, Mycobacterium
VGLVWWLLGAGWAMALLV

SEQ ID NO: 333859 - protein, 18 aa, Mycobacterium
VGLYPGDEVRILGVPVGT

SEQ ID NO: 333860 - protein, 17 aa, Mycobacterium
VGMAAYFFGSIVVDLGM

SEQ ID NO: 333861 - protein, 23 aa, Mycobacterium
VGMAMWLPWLIVAGVCFILTTVS

SEQ ID NO: 333862 - protein, 17 aa, Mycobacterium
VGMPLVAQLGVACAVAI

SEQ ID NO: 333863 - protein, 18 aa, Mycobacterium
VGMSGWQRGKKYAVRCVS

SEQ ID NO: 333864 - protein, 24 aa, Mycobacterium
VGMVASLWFGYRAALKTLRDPLPE

SEQ ID NO: 333865 - protein, 17 aa, Mycobacterium
VGMVFAYFRRLLRRWRH

SEQ ID NO: 333866 - protein, 25 aa, Mycobacterium
VGMVGVAVMAVWYIQAPTLLGIGKM

SEQ ID NO: 333867 - protein, 17 aa, Mycobacterium
VGMVLFWGLIIVGIVAL

SEQ ID NO: 333868 - protein, 24 aa, Mycobacterium
VGNLVIQWISQWIMGLNLGMLPTL

SEQ ID NO: 333869 - protein, 18 aa, Mycobacterium
VGNNFVWAHQRAMHLAAQ

SEQ ID NO: 333870 - protein, 17 aa, Mycobacterium
VGNSLRLRGFTSTSSAP

SEQ ID NO: 333871 - protein, 18 aa, Mycobacterium
VGNSLRLRSFTSVITDAP

SEQ ID NO: 333872 - protein, 17 aa, Mycobacterium
VGNYRAATQVALGESED

SEQ ID NO: 333873 - protein, 17 aa, Mycobacterium
VGNYRAATQVALGSSEE

SEQ ID NO: 333874 - protein, 24 aa, Mycobacterium
VGPALSVTIGFGFVASVTLLPAMV

SEQ ID NO: 333875 - protein, 20 aa, Mycobacterium
VGPALWLGHRQWRKYEERQG

SEQ ID NO: 333876 - protein, 18 aa, Mycobacterium
VGPAMWLYGLFNVAAWLF

SEQ ID NO: 333877 - protein, 21 aa, Mycobacterium
VGPAPPWGDWVVIGVGAALVA

SEQ ID NO: 333878 - protein, 22 aa, Mycobacterium
VGPAWRLVLRGGPNEVVLDRAA

SEQ ID NO: 333879 - protein, 17 aa, Mycobacterium
VGPDVAVVARTVAQVLP

SEQ ID NO: 333880 - protein, 24 aa, Mycobacterium
VGPERFYDMVGKFGLGQRTGVGLP

SEQ ID NO: 333881 - protein, 25 aa, Mycobacterium
VGPFKKGAFRIAMAAGIPVVPIVIR

SEQ ID NO: 333882 - protein, 28 aa, Mycobacterium
VGPFKKGPFRLAMAAGIPIVPIVIRNAE

SEQ ID NO: 333883 - protein, 29 aa, Mycobacterium
VGPGRYGFDAGRGWARRPFIGSFAAVVLG

SEQ ID NO: 333884 - protein, 31 aa, Mycobacterium
VGPGRYGLDAGRGWARRPFVGSIAALILGAG

SEQ ID NO: 333885 - protein, 18 aa, Mycobacterium
VGPIADRLLGWVIALVVC

SEQ ID NO: 333886 - protein, 18 aa, Mycobacterium
VGPIDGWYAYALDVRSRA

SEQ ID NO: 333887 - protein, 35 aa, Mycobacterium
VGPLEFSGFIAWLMWLVLHLVYLVGFKTKVSTLLS

SEQ ID NO: 333888 - protein, 23 aa, Mycobacterium
VGPRSIWVWLMLGVLLLSVVLAV

SEQ ID NO: 333889 - protein, 17 aa, Mycobacterium
VGPSRRGPLRAAMQIRR

SEQ ID NO: 333890 - protein, 21 aa, Mycobacterium
VGPSRRKLLTTGLASAAVGAG

SEQ ID NO: 333891 - protein, 17 aa, Mycobacterium
VGPTIAWYQEFLRYYFL

SEQ ID NO: 333892 - protein, 17 aa, Mycobacterium
VGPTIPWYQEFLRYYFL

SEQ ID NO: 333893 - protein, 22 aa, Mycobacterium
VGPTLRIGHIHFPLIMAVYDSF

SEQ ID NO: 333894 - protein, 25 aa, Mycobacterium
VGPVAATPIMRWLRDVEGTGAPTDQ

SEQ ID NO: 333895 - protein, 25 aa, Mycobacterium
VGPVLGISVAVVFFAAITLLPALLV

SEQ ID NO: 333896 - protein, 27 aa, Mycobacterium
VGPVMAASIVRWRSEHGKFTSIDQLAE

SEQ ID NO: 333897 - protein, 20 aa, Mycobacterium
VGPVTSEFAGKVHFVEQDRE

SEQ ID NO: 333898 - protein, 20 aa, Mycobacterium
VGPVTSEFSGKVHFVERDRD

SEQ ID NO: 333899 - protein, 27 aa, Mycobacterium
VGPVVATPIMRWLREVDGPTGQFNQTV

SEQ ID NO: 333900 - protein, 20 aa, Mycobacterium
VGPWLLRVAFGPQYQASGAL

SEQ ID NO: 333901 - protein, 31 aa, Mycobacterium
VGQEVPGASQWMMQAEVAITNFVSSMDVSKQ

SEQ ID NO: 333902 - protein, 17 aa, Mycobacterium
VGQGAMWLWNNAIQPAW

SEQ ID NO: 333903 - protein, 19 aa, Mycobacterium
VGQQCARHPVPWPTAIHKV

SEQ ID NO: 333904 - protein, 20 aa, Mycobacterium
VGQQCARRPLPPLPAMGKLL

SEQ ID NO: 333905 - protein, 17 aa, Mycobacterium
VGQRVDILLVFGLGAFL

SEQ ID NO: 333906 - protein, 27 aa, Mycobacterium
VGQSRGWRAAAPLGRDDAWIIFTSGST

SEQ ID NO: 333907 - protein, 21 aa, Mycobacterium
VGQWLAAILFLRALHAEHAPL

SEQ ID NO: 333908 - protein, 19 aa, Mycobacterium
VGQYPWLLVDEVTIADAAG

SEQ ID NO: 333909 - protein, 22 aa, Mycobacterium
VGRDMTPVWVAAAGVGGLALVC

SEQ ID NO: 333910 - protein, 24 aa, Mycobacterium
VGRDRLRVPIGIAVDGTPMELDIK

SEQ ID NO: 333911 - protein, 19 aa, Mycobacterium
VGRDRWFNLLWLIPIGFGL

SEQ ID NO: 333912 - protein, 24 aa, Mycobacterium
VGRDRWLNLMWLIPIGFALLVLAV

SEQ ID NO: 333913 - protein, 23 aa, Mycobacterium
VGRICAGAISLGVLKRCAQLMYR

SEQ ID NO: 333914 - protein, 18 aa, Mycobacterium
VGRKAVLVGALLLMGVAT

SEQ ID NO: 333915 - protein, 20 aa, Mycobacterium
VGRKPLWWFSLIGLFVAGIP

SEQ ID NO: 333916 - protein, 18 aa, Mycobacterium
VGRNPWRGPPVPYDTPVT

SEQ ID NO: 333917 - protein, 23 aa, Mycobacterium
VGRRGTQHLGLLVLRVGLGVVLG

SEQ ID NO: 333918 - protein, 24 aa, Mycobacterium
VGRSSRFVKLFGLRIDLQRLESGL

SEQ ID NO: 333919 - protein, 22 aa, Mycobacterium
VGRTALAAAVTWLAVNLPIMVL

SEQ ID NO: 333920 - protein, 52 aa, Mycobacterium
VGSAAAVTLLFGGFGAAVYQSHPGDALYGLRTSLFGAPPAVRTDPVVLSAQT

SEQ ID NO: 333921 - protein, 17 aa, Mycobacterium
VGSAIEFYDFLIYGTAA

SEQ ID NO: 333922 - protein, 28 aa, Mycobacterium
VGSMLLGVVVMLIWWAISPGFFRGRTLR

SEQ ID NO: 333923 - protein, 28 aa, Mycobacterium
VGSPLTAAMSLMWGWRLAVVCVTVAAAV

SEQ ID NO: 333924 - protein, 19 aa, Mycobacterium
VGSPTALPMALSGTLLIVI

SEQ ID NO: 333925 - protein, 20 aa, Mycobacterium
VGSRVGRRALAVSSLPFWVG

SEQ ID NO: 333926 - protein, 29 aa, Mycobacterium
VGSSDPVMLDWLVGLAFPCQRPFDHRYGV

SEQ ID NO: 333927 - protein, 23 aa, Mycobacterium
VGSSTWIAWAAWAAIALAVVTLV

SEQ ID NO: 333928 - protein, 20 aa, Mycobacterium
VGSVLRFVIDRAVARRVSRP

SEQ ID NO: 333929 - protein, 20 aa, Mycobacterium
VGSWISRTVFAAKFAERNFL

SEQ ID NO: 333930 - protein, 23 aa, Mycobacterium
VGSYPRMRDIFAERFAGRTRDEW

SEQ ID NO: 333931 - protein, 33 aa, Mycobacterium
VGTACGFLNGVLITFCRVPAFIATLATLTALRG

SEQ ID NO: 333932 - protein, 25 aa, Mycobacterium
VGTAGAALFLWAFAFGPPPPPGPGG

SEQ ID NO: 333933 - protein, 25 aa, Mycobacterium
VGTALEWYDYFLFGTAAALVFNRLF

SEQ ID NO: 333934 - protein, 18 aa, Mycobacterium
VGTARRWAMLAIALGSTA

SEQ ID NO: 333935 - protein, 35 aa, Mycobacterium
VGTDSRAAIKITTLFGSRYVDLRPAGAGTPAGRRI

SEQ ID NO: 333936 - protein, 19 aa, Mycobacterium
VGTEGVYAPFSFHDPATGQ

SEQ ID NO: 333937 - protein, 17 aa, Mycobacterium
VGTEILAVPALAIFTLM

SEQ ID NO: 333938 - protein, 18 aa, Mycobacterium
VGTEPNFLREWLPGQLLQ

SEQ ID NO: 333939 - protein, 24 aa, Mycobacterium
VGTFGMLRYCLQLFPDASTYFRPV

SEQ ID NO: 333940 - protein, 25 aa, Mycobacterium
VGTIGFCRSALVRRWPAPRQRSEQS

SEQ ID NO: 333941 - protein, 20 aa, Mycobacterium
VGTLCTFVMSTYVLPDRPES

SEQ ID NO: 333942 - protein, 19 aa, Mycobacterium
VGTLIGWGLLELFPGTLAR

SEQ ID NO: 333943 - protein, 28 aa, Mycobacterium
VGTLYTDRHIRLWVVYVDDFSGQGAVNW

SEQ ID NO: 333944 - protein, 18 aa, Mycobacterium
VGTMIANYRVEAVVSSGG

SEQ ID NO: 333945 - protein, 25 aa, Mycobacterium
VGTPAMWWLAVPVLLYAAWRMFVRR

SEQ ID NO: 333946 - protein, 34 aa, Mycobacterium
VGTPAMWWLAVPVLLYACWRAFVRRDWRYAVVLT

SEQ ID NO: 333947 - protein, 31 aa, Mycobacterium
VGTSIRAGLAIPRPLPVLIAEAGTTARESGP

SEQ ID NO: 333948 - protein, 20 aa, Mycobacterium
VGTTIEWYDFFLYATAASLV

SEQ ID NO: 333949 - protein, 21 aa, Mycobacterium
VGTTIEWYDFFLYATAASLVF

SEQ ID NO: 333950 - protein, 19 aa, Mycobacterium
VGTTIEWYDFYLYATAAAL

SEQ ID NO: 333951 - protein, 21 aa, Mycobacterium
VGTWLLMRYILPWLLPQIARS

SEQ ID NO: 333952 - protein, 18 aa, Mycobacterium
VGTWWRYRYDKFGWTSRS

SEQ ID NO: 333953 - protein, 18 aa, Mycobacterium
VGTWWRYRYDKFGWTTRS

SEQ ID NO: 333954 - protein, 17 aa, Mycobacterium
VGVAAATFVGWSLIAAD

SEQ ID NO: 333955 - protein, 23 aa, Mycobacterium
VGVAALGAVGWTFAIVTGGVLLA

SEQ ID NO: 333956 - protein, 18 aa, Mycobacterium
VGVACRRLNGDADTRELL

SEQ ID NO: 333957 - protein, 18 aa, Mycobacterium
VGVALVLAGVGSMLAAAL

SEQ ID NO: 333958 - protein, 19 aa, Mycobacterium
VGVALWLVGLVFEALGDRQ

SEQ ID NO: 333959 - protein, 17 aa, Mycobacterium
VGVAPSFADQVKDPAYS

SEQ ID NO: 333960 - protein, 18 aa, Mycobacterium
VGVASWLAGINLLLGLFN

SEQ ID NO: 333961 - protein, 19 aa, Mycobacterium
VGVATCWEVIFDRVPRHAV

SEQ ID NO: 333962 - protein, 19 aa, Mycobacterium
VGVATCWEVIFDRVPRKAV

SEQ ID NO: 333963 - protein, 18 aa, Mycobacterium
VGVAVAWLTLLAMTGLGR

SEQ ID NO: 333964 - protein, 17 aa, Mycobacterium
VGVAVLFLLRPVLDSAQ

SEQ ID NO: 333965 - protein, 21 aa, Mycobacterium
VGVAVLVAWIPLRNRPGIGTV

SEQ ID NO: 333966 - protein, 23 aa, Mycobacterium
VGVCVGVSIVLPAAVWGVLTPGR

SEQ ID NO: 333967 - protein, 19 aa, Mycobacterium
VGVDGFFAVSGFLVAASWL

SEQ ID NO: 333968 - protein, 17 aa, Mycobacterium
VGVDIIAVLSLVGTLLV

SEQ ID NO: 333969 - protein, 19 aa, Mycobacterium
VGVDLCWDEPDLRVRARRI

SEQ ID NO: 333970 - protein, 20 aa, Mycobacterium
VGVDPVVMWILMPLAVFGSA

SEQ ID NO: 333971 - protein, 30 aa, Mycobacterium
VGVEALARFPCEPFRPDAFFAEAAQLGIGI

SEQ ID NO: 333972 - protein, 19 aa, Mycobacterium
VGVFCCIGSVVAIVVGTIA

SEQ ID NO: 333973 - protein, 21 aa, Mycobacterium
VGVGRPRMMAYFIGSCATIPV

SEQ ID NO: 333974 - protein, 18 aa, Mycobacterium
VGVGWNLNDVRNHGADPR

SEQ ID NO: 333975 - protein, 19 aa, Mycobacterium
VGVIFLMLLLLYRSIITVI

SEQ ID NO: 333976 - protein, 17 aa, Mycobacterium
VGVLAVVVGVVLWRRRH

SEQ ID NO: 333977 - protein, 20 aa, Mycobacterium
VGVLILRLVLGVTLAAHGYN

SEQ ID NO: 333978 - protein, 20 aa, Mycobacterium
VGVLIYRSPWASAIGNTLTS

SEQ ID NO: 333979 - protein, 18 aa, Mycobacterium
VGVLLFVGSAAFAGATLQ

SEQ ID NO: 333980 - protein, 17 aa, Mycobacterium
VGVLLPRWSGDQYDAGR

SEQ ID NO: 333981 - protein, 21 aa, Mycobacterium
VGVLRWSWRLMNYRFPMNSTD

SEQ ID NO: 333982 - protein, 21 aa, Mycobacterium
VGVMRWRWRVAFYALTVLGTD

SEQ ID NO: 333983 - protein, 18 aa, Mycobacterium
VGVNLGAGWGEPVGVSNT

SEQ ID NO: 333984 - protein, 23 aa, Mycobacterium
VGVPLGAALMFFLGVGGAAEWSG

SEQ ID NO: 333985 - protein, 18 aa, Mycobacterium
VGVPRGRVGIGIKLTGGR

SEQ ID NO: 333986 - protein, 18 aa, Mycobacterium
VGVPVDLPALEKMPEVDV

SEQ ID NO: 333987 - protein, 19 aa, Mycobacterium
VGVSAKFWTLLEVIPNLTL

SEQ ID NO: 333988 - protein, 18 aa, Mycobacterium
VGVSGIWDGSTLFADAVV

SEQ ID NO: 333989 - protein, 23 aa, Mycobacterium
VGVSLALACDVVLASEKSFFMLA

SEQ ID NO: 333990 - protein, 25 aa, Mycobacterium
VGVTGSVFAFWGWDTCLTLGEESKD

SEQ ID NO: 333991 - protein, 17 aa, Mycobacterium
VGVTLRLLVIGSLAGTA

SEQ ID NO: 333992 - protein, 18 aa, Mycobacterium
VGVTLRLLVIGSLVGTVA

SEQ ID NO: 333993 - protein, 17 aa, Mycobacterium
VGVTRARAVICVGDDDA

SEQ ID NO: 333994 - protein, 20 aa, Mycobacterium
VGVVFACYGLAYFVLTPVAG

SEQ ID NO: 333995 - protein, 17 aa, Mycobacterium
VGVVLLLFAGFVVDEPF

SEQ ID NO: 333996 - protein, 17 aa, Mycobacterium
VGVVRLGQRRCLVQELP

SEQ ID NO: 333997 - protein, 23 aa, Mycobacterium
VGVVSVWLGLLLSWHAATAGGAS

SEQ ID NO: 333998 - protein, 24 aa, Mycobacterium
VGVVVLVVLRWLARKVVVTVRRKY

SEQ ID NO: 333999 - protein, 25 aa, Mycobacterium
VGWADPASGVAFALVHNRLLTPLVM

SEQ ID NO: 334000 - protein, 26 aa, Mycobacterium
VGWAMSAAFQAPVCAAAMAVVGGALA

SEQ ID NO: 334001 - protein, 26 aa, Mycobacterium
VGWFTTKYPVALAVSGKPGRSAGRLR

SEQ ID NO: 334002 - protein, 19 aa, Mycobacterium
VGWFTTKYPVALTVENLPW

SEQ ID NO: 334003 - protein, 19 aa, Mycobacterium
VGWKTLRDAGPVVFMNGAY

SEQ ID NO: 334004 - protein, 32 aa, Mycobacterium
VGYFGHMWELYALWTWLAIFLMAGNRRDATVA

SEQ ID NO: 334005 - protein, 18 aa, Mycobacterium
VGYLDLTGCMALGITGPV

SEQ ID NO: 334006 - protein, 18 aa, Mycobacterium
VGYLFYWAIIGIDPGPRR

SEQ ID NO: 334007 - protein, 25 aa, Mycobacterium
VGYLLAGSHSWRWILGLAAVPATLL

SEQ ID NO: 334008 - protein, 30 aa, Mycobacterium
VGYPLVIALFRWFPQITVWTGLSLLGVAIA

SEQ ID NO: 334009 - protein, 31 aa, Mycobacterium
VGYRSPRYLRFGWAAARLDDLANYFGARVTA

SEQ ID NO: 334010 - protein, 30 aa, Mycobacterium
VGYRSPRYLRFGWAAARLDDVANYAGARAT

SEQ ID NO: 334011 - protein, 20 aa, Mycobacterium
VGYTAAVIWSARRESRAIAA

SEQ ID NO: 334012 - protein, 25 aa, Mycobacterium
VHAARRGLSFTLTWWSFTFPVGTCV

SEQ ID NO: 334013 - protein, 25 aa, Mycobacterium
VHAGLCLPALWAIRHRTIETRSGTP

SEQ ID NO: 334014 - protein, 17 aa, Mycobacterium
VHAQAYWSAGRAMGTRR

SEQ ID NO: 334015 - protein, 25 aa, Mycobacterium
VHAYAGSLAQVFLCAAAVAAIGFVL

SEQ ID NO: 334016 - protein, 25 aa, Mycobacterium
VHAYPRTGSVVVWYSPRRCDRSAVL

SEQ ID NO: 334017 - protein, 25 aa, Mycobacterium
VHAYPRTGSVVVWYSPRRCDRSSVL

SEQ ID NO: 334018 - protein, 21 aa, Mycobacterium
VHDAMREIWTFTPAGAISVRG

SEQ ID NO: 334019 - protein, 19 aa, Mycobacterium
VHDLHIWTITSGMEAATVH

SEQ ID NO: 334020 - protein, 19 aa, Mycobacterium
VHDLHVWTLAPGKDMATAH

SEQ ID NO: 334021 - protein, 19 aa, Mycobacterium
VHDLHVWTLSPGKDMCTAH

SEQ ID NO: 334022 - protein, 19 aa, Mycobacterium
VHDLHVWTLVPGKDMVTAH

SEQ ID NO: 334023 - protein, 17 aa, Mycobacterium
VHDYLVLWISTRRRGRS

SEQ ID NO: 334024 - protein, 18 aa, Mycobacterium
VHEAVVCNPPPQATGAAS

SEQ ID NO: 334025 - protein, 27 aa, Mycobacterium
VHFDLDPLLPFPRWHEHAAVVEEPVRR

SEQ ID NO: 334026 - protein, 24 aa, Mycobacterium
VHFLIVGYLFYWAIIGIDPGPRRL

SEQ ID NO: 334027 - protein, 17 aa, Mycobacterium
VHGDFRLGNLLASGARI

SEQ ID NO: 334028 - protein, 25 aa, Mycobacterium
VHGRAIVAAPSFRAARAGDGVKLMN

SEQ ID NO: 334029 - protein, 24 aa, Mycobacterium
VHHSIKRFYGFNGLMKHPVHGGLE

SEQ ID NO: 334030 - protein, 23 aa, Mycobacterium
VHHSVTRFYGLNGQMKHPLHQTV

SEQ ID NO: 334031 - protein, 25 aa, Mycobacterium
VHLARIFFTGAFRRPREANWIIGSL

SEQ ID NO: 334032 - protein, 17 aa, Mycobacterium
VHLARVFFTGAFRRPRE

SEQ ID NO: 334033 - protein, 17 aa, Mycobacterium
VHLIEVPYVLPFLAEGK

SEQ ID NO: 334034 - protein, 23 aa, Mycobacterium
VHLVVGAAGFWFARTYAAARAYL

SEQ ID NO: 334035 - protein, 23 aa, Mycobacterium
VHPEIPKAFDAVIARGMAKKPAD

SEQ ID NO: 334036 - protein, 18 aa, Mycobacterium
VHPGRTEATMLWLRNWLR

SEQ ID NO: 334037 - protein, 25 aa, Mycobacterium
VHPTRGCGHLLAWSPIGAIGRISYS

SEQ ID NO: 334038 - protein, 41 aa, Mycobacterium
VHPYVRKGAAWAWRLLVLLAFGLTVLWLFWHLKTITIPLLL

SEQ ID NO: 334039 - protein, 26 aa, Mycobacterium
VHQNPDRWAWLWSLLVFLAVASSVVA

SEQ ID NO: 334040 - protein, 17 aa, Mycobacterium
VHRAEGGAMVVAYLAYL

SEQ ID NO: 334041 - protein, 24 aa, Mycobacterium
VHRAYRYARAMARWSPTSRSEIAD

SEQ ID NO: 334042 - protein, 24 aa, Mycobacterium
VHRGRLQLMLLDAVRKRIGPQAVR

SEQ ID NO: 334043 - protein, 25 aa, Mycobacterium
VHRSEALVADALRALAYTATGGHTL

SEQ ID NO: 334044 - protein, 19 aa, Mycobacterium
VHSIPGPQAHFGFLSEGGG

SEQ ID NO: 334045 - protein, 25 aa, Mycobacterium
VHSLAERGLRVLAVAKRPWEHDTAD

SEQ ID NO: 334046 - protein, 17 aa, Mycobacterium
VHSNAYGKVLFAITLSA

SEQ ID NO: 334047 - protein, 17 aa, Mycobacterium
VHSNAYGKVLFFITLSA

SEQ ID NO: 334048 - protein, 17 aa, Mycobacterium
VHSNAYGKVLFVITLTG

SEQ ID NO: 334049 - protein, 26 aa, Mycobacterium
VHSPVGLPHRWARRRVVMAAVAALAY

SEQ ID NO: 334050 - protein, 26 aa, Mycobacterium
VHTDGPLPPRRAIEIIADACQALNFS

SEQ ID NO: 334051 - protein, 27 aa, Mycobacterium
VHTDGPLPPRRAIEIIADACQALNFSH

SEQ ID NO: 334052 - protein, 20 aa, Mycobacterium
VHVGWPWAALAAGPVLLAAG

SEQ ID NO: 334053 - protein, 17 aa, Mycobacterium
VHVKSFFNSIGAKLQSA

SEQ ID NO: 334054 - protein, 24 aa, Mycobacterium
VHVYRLVWRQIILFAHNIIIFVII

SEQ ID NO: 334055 - protein, 27 aa, Mycobacterium
VHVYRLVWRQLLLFAHNIIIFLIVVAV

SEQ ID NO: 334056 - protein, 20 aa, Mycobacterium
VHVYRLVWRQVIFFAHNIVI

SEQ ID NO: 334057 - protein, 24 aa, Mycobacterium
VHVYRLVWRQVILFAHNIVIYAVI

SEQ ID NO: 334058 - protein, 20 aa, Mycobacterium
VHWIVDYWNRFSLWVQHLVT

SEQ ID NO: 334059 - protein, 24 aa, Mycobacterium
VHYLDWLNYLLGWGALYQLGIAWR

SEQ ID NO: 334060 - protein, 26 aa, Mycobacterium
VHYLLDVLRRVAIDFDRSDDAASVAD

SEQ ID NO: 334061 - protein, 26 aa, Mycobacterium
VHYLLDVLRRVAIDFDRTEKAASVAD

SEQ ID NO: 334062 - protein, 31 aa, Mycobacterium
VHYSRRMPRRFHLRSVLLAAVTAVAGFALSS

SEQ ID NO: 334063 - protein, 24 aa, Mycobacterium
VIAAPRLVLGMALLIAIAAALFGV

SEQ ID NO: 334064 - protein, 18 aa, Mycobacterium
VIACPCALGLATPTALLV

SEQ ID NO: 334065 - protein, 17 aa, Mycobacterium
VIACPCALGLATPTAMM

SEQ ID NO: 334066 - protein, 29 aa, Mycobacterium
VIADGTWAKLYCQWVPRTLPPGWKPGSKA

SEQ ID NO: 334067 - protein, 20 aa, Mycobacterium
VIADGTWAKLYSDWVPRTLP

SEQ ID NO: 334068 - protein, 19 aa, Mycobacterium
VIADGTWSQLYSKWVPRTL

SEQ ID NO: 334069 - protein, 24 aa, Mycobacterium
VIADRRIGFGFGVGSVIAVWTWSM

SEQ ID NO: 334070 - protein, 37 aa, Mycobacterium
VIAEAISCVLVWQAARWRPTLQFSKSEFFDMAKFGNK

SEQ ID NO: 334071 - protein, 24 aa, Mycobacterium
VIAEVWKTTPFMSLLLLAGLALVP

SEQ ID NO: 334072 - protein, 23 aa, Mycobacterium
VIAFSTMFAMLLGYEVPDVPGGR

SEQ ID NO: 334073 - protein, 24 aa, Mycobacterium
VIAGRPAPTDAFIGVAPDARILSL

SEQ ID NO: 334074 - protein, 17 aa, Mycobacterium
VIAHRGGGIDTLRAQLA

SEQ ID NO: 334075 - protein, 26 aa, Mycobacterium
VIAHWVWAPSGWLLKMGVLDYAGGLV

SEQ ID NO: 334076 - protein, 17 aa, Mycobacterium
VIAIPAYSLQLLSELPD

SEQ ID NO: 334077 - protein, 27 aa, Mycobacterium
VIAKYRAGGSLTRFGMLAAQVVPPAVM

SEQ ID NO: 334078 - protein, 22 aa, Mycobacterium
VIAMWMPIMLFFYMGFEHSIVN

SEQ ID NO: 334079 - protein, 26 aa, Mycobacterium
VIAPAKLFSVPGLTGLLAQMRAKFGD

SEQ ID NO: 334080 - protein, 26 aa, Mycobacterium
VIARLFAGVNLWRFVVYIKDELFLAL

SEQ ID NO: 334081 - protein, 23 aa, Mycobacterium
VIATCYRPLLFATVDPDVAAARG

SEQ ID NO: 334082 - protein, 28 aa, Mycobacterium
VIAVFGMRLVFPLTIVWVTAGLDPVRAM

SEQ ID NO: 334083 - protein, 24 aa, Mycobacterium
VIAVLLCSLGFVMANRHHATGQRT

SEQ ID NO: 334084 - protein, 24 aa, Mycobacterium
VIAVTRYRIELVRQIAQMGLGAGA

SEQ ID NO: 334085 - protein, 18 aa, Mycobacterium
VIAVWTWSMAVMMSSAQA

SEQ ID NO: 334086 - protein, 18 aa, Mycobacterium
VIAYCLGLGMPFLLLAFG

SEQ ID NO: 334087 - protein, 18 aa, Mycobacterium
VICAETEVLLGVVLALLG

SEQ ID NO: 334088 - protein, 24 aa, Mycobacterium
VIDGEIKQRYELFTSVGARDANDY

SEQ ID NO: 334089 - protein, 25 aa, Mycobacterium
VIDLLLKRAASLGVQIRYETGATEL

SEQ ID NO: 334090 - protein, 24 aa, Mycobacterium
VIDPFRLAIRVELAGVDAATGTYS

SEQ ID NO: 334091 - protein, 19 aa, Mycobacterium
VIDRLKDIINRGGENVSSV

SEQ ID NO: 334092 - protein, 18 aa, Mycobacterium
VIDRVAKGIVHMRGIERV

SEQ ID NO: 334093 - protein, 20 aa, Mycobacterium
VIDVVRHWNSPAVVLAACAA

SEQ ID NO: 334094 - protein, 21 aa, Mycobacterium
VIEAAHKFGRFFTGQVTAAGK

SEQ ID NO: 334095 - protein, 26 aa, Mycobacterium
VIEGACTFLALPRLTGVLATIPERTA

SEQ ID NO: 334096 - protein, 24 aa, Mycobacterium
VIETGDPTLHWAEIGAELEDAVAT

SEQ ID NO: 334097 - protein, 17 aa, Mycobacterium
VIFATALAFVLSFADRR

SEQ ID NO: 334098 - protein, 25 aa, Mycobacterium
VIFDAPRWLSFGLVPAYNVLAVVLG

SEQ ID NO: 334099 - protein, 20 aa, Mycobacterium
VIFFTGFRLGMQSGHGGYGH

SEQ ID NO: 334100 - protein, 23 aa, Mycobacterium
VIFPRAAVCADRIGEVLSTQTAI

SEQ ID NO: 334101 - protein, 23 aa, Mycobacterium
VIGAIGGALGWRPHPVGLLVGAV

SEQ ID NO: 334102 - protein, 19 aa, Mycobacterium
VIGALPLAYAVIVAGALLR

SEQ ID NO: 334103 - protein, 19 aa, Mycobacterium
VIGAVAWAILALVRGETVN

SEQ ID NO: 334104 - protein, 19 aa, Mycobacterium
VIGFASLAAAIAIAVRPTA

SEQ ID NO: 334105 - protein, 24 aa, Mycobacterium
VIGGAALALLGVRRYVFARPPLLG

SEQ ID NO: 334106 - protein, 25 aa, Mycobacterium
VIGGAALALLGVRRYVFKRPPLLGP

SEQ ID NO: 334107 - protein, 18 aa, Mycobacterium
VIGIAWLAAHRAVTEKIE

SEQ ID NO: 334108 - protein, 26 aa, Mycobacterium
VIGILLSWGLVELWPGTLARQDRLPY

SEQ ID NO: 334109 - protein, 18 aa, Mycobacterium
VIGIWLINVFSGEELTDA

SEQ ID NO: 334110 - protein, 18 aa, Mycobacterium
VIGLAISGVAVWQGVRSW

SEQ ID NO: 334111 - protein, 30 aa, Mycobacterium
VIGLAWEVASDLFANWKRAMDLLGQGALWL

SEQ ID NO: 334112 - protein, 17 aa, Mycobacterium
VIGLFVVCFLAAGVYLV

SEQ ID NO: 334113 - protein, 24 aa, Mycobacterium
VIGLGCGFGPLNNRFFPPMGSVLY

SEQ ID NO: 334114 - protein, 41 aa, Mycobacterium
VIGLILLLVFRSWFTAMLPLLVMGVSLLIARGVIAGLAERG

SEQ ID NO: 334115 - protein, 19 aa, Mycobacterium
VIGPCGWAFLIWGLGMYLW

SEQ ID NO: 334116 - protein, 22 aa, Mycobacterium
VIGSISFWGSIIAFGKLQEIIS

SEQ ID NO: 334117 - protein, 25 aa, Mycobacterium
VIGSIWSWIVGMLVWVWQGILEVAY

SEQ ID NO: 334118 - protein, 19 aa, Mycobacterium
VIGTAFLVFVGVGAVPATI

SEQ ID NO: 334119 - protein, 21 aa, Mycobacterium
VIGTALEWYDFILYGTASALV

SEQ ID NO: 334120 - protein, 21 aa, Mycobacterium
VIGTLRRWSMLVIALTSTMCA

SEQ ID NO: 334121 - protein, 25 aa, Mycobacterium
VIGVRVMPVFAFKSGAFFAAIVGVL

SEQ ID NO: 334122 - protein, 17 aa, Mycobacterium
VIGWLWPGLGADLRPLA

SEQ ID NO: 334123 - protein, 18 aa, Mycobacterium
VIHHLVIDGVSWRILSED

SEQ ID NO: 334124 - protein, 29 aa, Mycobacterium
VIHLSMIFFWGWGRLTALMIFGSVRNIYW

SEQ ID NO: 334125 - protein, 25 aa, Mycobacterium
VIHSFRVVPFLFTRDVMPEPKANNS

SEQ ID NO: 334126 - protein, 18 aa, Mycobacterium
VIIGLVLITAFVFHAWYR

SEQ ID NO: 334127 - protein, 21 aa, Mycobacterium
VIIGVRLSVLFSYQSNDLYSA

SEQ ID NO: 334128 - protein, 21 aa, Mycobacterium
VIIGVSAYWLGTRRRRTGDGP

SEQ ID NO: 334129 - protein, 17 aa, Mycobacterium
VIIQAVFGFCLLEAVNY

SEQ ID NO: 334130 - protein, 23 aa, Mycobacterium
VIISCIKAALFGLIAGLVACYRG

SEQ ID NO: 334131 - protein, 20 aa, Mycobacterium
VILAGFLIAIAFRVAQGSAT

SEQ ID NO: 334132 - protein, 28 aa, Mycobacterium
VILAGSDSGWAFITILVLTLIQAGAALT

SEQ ID NO: 334133 - protein, 30 aa, Mycobacterium
VILCAAVRPRLRGVSGRAWLSALALATTLV

SEQ ID NO: 334134 - protein, 32 aa, Mycobacterium; identical to SEQ ID NO: 14695

SEQ ID NO: 334135 - protein, 26 aa, Mycobacterium
VILGLMMCFDLGGPVNKAAYAFATAG

SEQ ID NO: 334136 - protein, 26 aa, Mycobacterium
VILGLMMCFDLGGPVNKAAYAFATAS

SEQ ID NO: 334137 - protein, 17 aa, Mycobacterium
VILGSGLTIVGACLCLT

SEQ ID NO: 334138 - protein, 18 aa, Mycobacterium
VILILCRLVQGFATGGEY

SEQ ID NO: 334139 - protein, 26 aa, Mycobacterium
VILLVKRIWWPLALWLLLIVVNVDAG

SEQ ID NO: 334140 - protein, 18 aa, Mycobacterium
VILLVVLFFAFSRMQSGG

SEQ ID NO: 334141 - protein, 18 aa, Mycobacterium
VILLWIGWMHRTRKITWL

SEQ ID NO: 334142 - protein, 26 aa, Mycobacterium
VILLYAVCVVLRLARFNALQDDGSQP

SEQ ID NO: 334143 - protein, 20 aa, Mycobacterium
VILNGFFLGVVTLVGMTTLD

SEQ ID NO: 334144 - protein, 28 aa, Mycobacterium
VILPPLLALCGRRLFWPFIPRPEDADGV

SEQ ID NO: 334145 - protein, 19 aa, Mycobacterium
VILSTRLIPAVPFSVLNYA

SEQ ID NO: 334146 - protein, 17 aa, Mycobacterium
VILTGAFDTAALFRSFR

SEQ ID NO: 334147 - protein, 18 aa, Mycobacterium
VILVDLWIFTPFVAILVL

SEQ ID NO: 334148 - protein, 19 aa, Mycobacterium
VILVLGFWVPGFFVTTKLD

SEQ ID NO: 334149 - protein, 18 aa, Mycobacterium
VIMLVFFGSLPILRNVLV

SEQ ID NO: 334150 - protein, 23 aa, Mycobacterium
VIMNMCVFGAVALGPFVGGTQAE

SEQ ID NO: 334151 - protein, 26 aa, Mycobacterium
VIMVAWRWVPAKARRVPGPLVAIVAV

SEQ ID NO: 334152 - protein, 18 aa, Mycobacterium
VIMVMLLLVYRSVITMVI

SEQ ID NO: 334153 - protein, 25 aa, Mycobacterium
VINSALPRWLWTRGSALVSAMWGVA

SEQ ID NO: 334154 - protein, 23 aa, Mycobacterium
VINVAWSLVVLWPMDPDQTRTRA

SEQ ID NO: 334155 - protein, 19 aa, Mycobacterium
VIPASSVLRSHAISLNDKE

SEQ ID NO: 334156 - protein, 23 aa, Mycobacterium
VIPEERTQVPVEWDQLRNSITNI

SEQ ID NO: 334157 - protein, 17 aa, Mycobacterium
VIPELEAEFGWSRTALS

SEQ ID NO: 334158 - protein, 17 aa, Mycobacterium
VIPLAGWVADRFGTKRP

SEQ ID NO: 334159 - protein, 26 aa, Mycobacterium
VIPLVAILVRVEWSQFISLITSESSR

SEQ ID NO: 334160 - protein, 22 aa, Mycobacterium
VIPLYCVAVIMSFISSRLGTTV

SEQ ID NO: 334161 - protein, 23 aa, Mycobacterium
VIPNRSLELFLSMAATTVTAAMV

SEQ ID NO: 334162 - protein, 17 aa, Mycobacterium
VIPRLGHAVKHSRAAAW

SEQ ID NO: 334163 - protein, 19 aa, Mycobacterium
VIPSRWRAAWVGWWVAAGI

SEQ ID NO: 334164 - protein, 19 aa, Mycobacterium
VIPVFARKPIFGYTTLVYA

SEQ ID NO: 334165 - protein, 23 aa, Mycobacterium
VIQHRLGVRPGKPGRREVTAADG

SEQ ID NO: 334166 - protein, 21 aa, Mycobacterium
VIQKLSGLHVNRFMAVDFVGF

SEQ ID NO: 334167 - protein, 18 aa, Mycobacterium
VIQKLSGLSINRFIAIDF

SEQ ID NO: 334168 - protein, 21 aa, Mycobacterium
VIQMIARVLAMIAIVIPVAGV

SEQ ID NO: 334169 - protein, 27 aa, Mycobacterium
VIQTEFNVALPWSKEVSLSRSANHPAS

SEQ ID NO: 334170 - protein, 18 aa, Mycobacterium
VIRDDGRGGATIQPGRGL

SEQ ID NO: 334171 - protein, 17 aa, Mycobacterium
VIREIFWELPVYDPHHL

SEQ ID NO: 334172 - protein, 19 aa, Mycobacterium
VIRLPGGRDRMLFTYHFLL

SEQ ID NO: 334173 - protein, 35 aa, Mycobacterium
VIRRDWRNILRIIALRLAESGGFYVIVTYMLSYLT

SEQ ID NO: 334174 - protein, 27 aa, Mycobacterium
VIRRPAVGVLWSWAAGRDRGWRDVPRA

SEQ ID NO: 334175 - protein, 20 aa, Mycobacterium
VIRRRDVVLVTGPWLAGVSS

SEQ ID NO: 334176 - protein, 19 aa, Mycobacterium
VISGFPVDRGWDVEGVFDP

SEQ ID NO: 334177 - protein, 19 aa, Mycobacterium
VISILCFSIGSFLCGLSWG

SEQ ID NO: 334178 - protein, 23 aa, Mycobacterium
VISMAIYISCWWRHLKPASDKPA

SEQ ID NO: 334179 - protein, 29 aa, Mycobacterium
VISSGTRPLRFVSMMGILFALLGFGVAIY

SEQ ID NO: 334180 - protein, 23 aa, Mycobacterium
VISSLEIQQLLSLGPNKPDPSQL

SEQ ID NO: 334181 - protein, 24 aa, Mycobacterium
VISYEIAMALSFVAVFIYAGTMST

SEQ ID NO: 334182 - protein, 18 aa, Mycobacterium
VITALGLVILLLFKDFHA

SEQ ID NO: 334183 - protein, 17 aa, Mycobacterium
VITAVPFLLPLQFQLQF

SEQ ID NO: 334184 - protein, 17 aa, Mycobacterium
VIVAARFVGWVRAVLLA

SEQ ID NO: 334185 - protein, 17 aa, Mycobacterium
VIVAHTALVLAFAFSSV

SEQ ID NO: 334186 - protein, 17 aa, Mycobacterium
VIVALWVSRSDGVVLHW

SEQ ID NO: 334187 - protein, 19 aa, Mycobacterium
VIVAPKGREAPESLRGNQD

SEQ ID NO: 334188 - protein, 25 aa, Mycobacterium
VIVAVARWRGLLALVGILVAFVVLV

SEQ ID NO: 334189 - protein, 26 aa, Mycobacterium
VIVAVARWRGLLALVGIVVAFAVLVV

SEQ ID NO: 334190 - protein, 40 aa, Mycobacterium
VIVAVARWRGLRALVGIVIAFGVLVVFLLPALRDGAPAVP

SEQ ID NO: 334191 - protein, 26 aa, Mycobacterium
VIVFKGPPPWNLGYKSIRSNNTVLRW

SEQ ID NO: 334192 - protein, 18 aa, Mycobacterium
VIVFLILVMLLRAIIAPL

SEQ ID NO: 334193 - protein, 17 aa, Mycobacterium
VIVFPAFALFNTGSIAA

SEQ ID NO: 334194 - protein, 25 aa, Mycobacterium
VIVFQWGWLEFLGFHKANIDSSIPP

SEQ ID NO: 334195 - protein, 19 aa, Mycobacterium
VIVFTVVMLLVAAGLIITF

SEQ ID NO: 334196 - protein, 19 aa, Mycobacterium
VIVGAAWPMIVEQISVKPN

SEQ ID NO: 334197 - protein, 24 aa, Mycobacterium
VIVGLGYPLLVWLVAQLPGLRDKA

SEQ ID NO: 334198 - protein, 24 aa, Mycobacterium
VIVGRVRPAFFFALGLPALIIVLL

SEQ ID NO: 334199 - protein, 25 aa, Mycobacterium
VIVGWLTLWPFGSWLTTHFVVTNRR

SEQ ID NO: 334200 - protein, 25 aa, Mycobacterium
VIVGWLTLWPFLTWLTTHFVITDRR

SEQ ID NO: 334201 - protein, 18 aa, Mycobacterium
VIVIELVGLLAAAIASAA

SEQ ID NO: 334202 - protein, 18 aa, Mycobacterium
VIVLFAWWRGLYLTTILH

SEQ ID NO: 334203 - protein, 31 aa, Mycobacterium
VIVLFGWWGGLYFTTLVRRRLAIIGRANAFT

SEQ ID NO: 334204 - protein, 26 aa, Mycobacterium
VIVLYEIVDILPFPVGSLVGPAAVLG

SEQ ID NO: 334205 - protein, 19 aa, Mycobacterium
VIVRPEYASVFVRTVNRIF

SEQ ID NO: 334206 - protein, 17 aa, Mycobacterium
VIVRRQLAPLARVSEAA

SEQ ID NO: 334207 - protein, 18 aa, Mycobacterium
VIVSSLIAGLAFGSAMVG

SEQ ID NO: 334208 - protein, 19 aa, Mycobacterium
VIVTLCYWSSGLDPYVGQY

SEQ ID NO: 334209 - protein, 24 aa, Mycobacterium
VIVVVGTVILWSFFGDALSNRSHR

SEQ ID NO: 334210 - protein, 19 aa, Mycobacterium
VIWDVRMPAARALLWVLFW

SEQ ID NO: 334211 - protein, 32 aa, Mycobacterium
VIWQHVLGIQLHWSVPVAVFAILISVGADYNL

SEQ ID NO: 334212 - protein, 17 aa, Mycobacterium
VIWRGETLTEMFMMTVA

SEQ ID NO: 334213 - protein, 17 aa, Mycobacterium
VIWRVKFSVMENATGIL

SEQ ID NO: 334214 - protein, 18 aa, Mycobacterium
VKAAEAARLQERAAQHQS

SEQ ID NO: 334215 - protein, 19 aa, Mycobacterium
VKAEMLVGTPAMWWLAVPV

SEQ ID NO: 334216 - protein, 17 aa, Mycobacterium
VKAGPSSVWFVAFFLTL

SEQ ID NO: 334217 - protein, 21 aa, Mycobacterium
VKAKVIEFVTKPAVTVTLVGV

SEQ ID NO: 334218 - protein, 20 aa, Mycobacterium
VKALHKLGVRVVMITGDAQA

SEQ ID NO: 334219 - protein, 26 aa, Mycobacterium
VKALIYFEAITTFALLFGLVVGNVVK

SEQ ID NO: 334220 - protein, 26 aa, Mycobacterium
VKALIYFEAVTTFALLFGLLVGNLAK

SEQ ID NO: 334221 - protein, 24 aa, Mycobacterium
VKAPLWPFHRWLPDAAVEATPASA

SEQ ID NO: 334222 - protein, 23 aa, Mycobacterium
VKAPLWPLHTWLPDAAVHATPSS

SEQ ID NO: 334223 - protein, 19 aa, Mycobacterium
VKAQPGALLALAAKADVLL

SEQ ID NO: 334224 - protein, 21 aa, Mycobacterium
VKARALPALGRRRRVTDNMAA

SEQ ID NO: 334225 - protein, 31 aa, Mycobacterium
VKARLYRRIGASVVRWPKPILVASAAAVLVG

SEQ ID NO: 334226 - protein, 19 aa, Mycobacterium
VKARTFSGLARRRRLVNSL

SEQ ID NO: 334227 - protein, 20 aa, Mycobacterium
VKAVIFGAIVAIVSCQKGLS

SEQ ID NO: 334228 - protein, 18 aa, Mycobacterium
VKAVMLVGTPTMWFLAVP

SEQ ID NO: 334229 - protein, 19 aa, Mycobacterium
VKAYAWRMLLSPEGPLSWA

SEQ ID NO: 334230 - protein, 19 aa, Mycobacterium
VKCEAWNPDTGKYGPIYDE

SEQ ID NO: 334231 - protein, 21 aa, Mycobacterium
VKDAPLPWSFTITTTEPAVIG

SEQ ID NO: 334232 - protein, 24 aa, Mycobacterium
VKDGDCLNWPGRNPDAARIVDCGE

SEQ ID NO: 334233 - protein, 19 aa, Mycobacterium
VKDRQRFAGKPVIASGVKR

SEQ ID NO: 334234 - protein, 37 aa, Mycobacterium
VKEPEKRPGPARLLRVLAIPVVIFWVAAAAALNIFVP

SEQ ID NO: 334235 - protein, 21 aa, Mycobacterium
VKEYFGMSVGQTLKSWSVMET

SEQ ID NO: 334236 - protein, 17 aa, Mycobacterium
VKGLGIAAGAKRPGAKK

SEQ ID NO: 334237 - protein, 18 aa, Mycobacterium
VKGLGIAGGAKRPGAKKA

SEQ ID NO: 334238 - protein, 19 aa, Mycobacterium
VKGLGLAAGAKRPGAKKTA

SEQ ID NO: 334239 - protein, 25 aa, Mycobacterium
VKIALYILGGWLFAWSTRGIGGFTQ

SEQ ID NO: 334240 - protein, 21 aa, Mycobacterium
VKILLYVLVAWLIVLSTSGID

SEQ ID NO: 334241 - protein, 27 aa, Mycobacterium
VKIPGGALCGKLAVPVDYAHPDGDIAA

SEQ ID NO: 334242 - protein, 26 aa, Mycobacterium
VKISRFQTLLLKWAIMVLLGLFTSGA

SEQ ID NO: 334243 - protein, 18 aa, Mycobacterium
VKITSELTPVVGNLADTS

SEQ ID NO: 334244 - protein, 21 aa, Mycobacterium
VKKGATFDCDVSIDGAPKHVT

SEQ ID NO: 334245 - protein, 18 aa, Mycobacterium
VKKLEVIVVPVLVALLLS

SEQ ID NO: 334246 - protein, 19 aa, Mycobacterium
VKLDMVIAKGMAKNPRDRY

SEQ ID NO: 334247 - protein, 19 aa, Mycobacterium
VKLFGEMEFWAALIKVVAI

SEQ ID NO: 334248 - protein, 19 aa, Mycobacterium
VKLFGEMEFWAALIKVVAL

SEQ ID NO: 334249 - protein, 17 aa, Mycobacterium
VKLIGWLRPGAVIAIKG

SEQ ID NO: 334250 - protein, 23 aa, Mycobacterium
VKLPEALSVVAMLQRRLGGRLGA

SEQ ID NO: 334251 - protein, 21 aa, Mycobacterium
VKLRWDPYPFILLNLAFSTQA

SEQ ID NO: 334252 - protein, 23 aa, Mycobacterium
VKLSLWYPHYAWLLLTIYLAAAL

SEQ ID NO: 334253 - protein, 17 aa, Mycobacterium
VKLSRPVAKAALRAGLT

SEQ ID NO: 334254 - protein, 26 aa, Mycobacterium
VKMTTEWLHVPLLPIPIPIRVPASQA

SEQ ID NO: 334255 - protein, 27 aa, Mycobacterium
VKMTTEWLHVPLLPVPIPIQLPANQAP

SEQ ID NO: 334256 - protein, 19 aa, Mycobacterium
VKPHLTPIFAWGAAVIIVV

SEQ ID NO: 334257 - protein, 24 aa, Mycobacterium
VKPSYGMAEAVVYVAISEVGTPPV

SEQ ID NO: 334258 - protein, 29 aa, Mycobacterium
VKQGLYKWAWIPALPLGWDLIVTMTASWQ

SEQ ID NO: 334259 - protein, 19 aa, Mycobacterium
VKQLREIPVPKGVTMYVGG

SEQ ID NO: 334260 - protein, 22 aa, Mycobacterium
VKQPFLDRYEGVAVQCAVFGEN

SEQ ID NO: 334261 - protein, 25 aa, Mycobacterium
VKQRSRAAVKFLMYNLFGGLVMLAA

SEQ ID NO: 334262 - protein, 22 aa, Mycobacterium
VKRLAPQRRLSLAVITLGITGT

SEQ ID NO: 334263 - protein, 23 aa, Mycobacterium
VKRLAPQRRRSLAVIALGIVGTA

SEQ ID NO: 334264 - protein, 17 aa, Mycobacterium
VKRLVRRLLPALILVLA

SEQ ID NO: 334265 - protein, 33 aa, Mycobacterium
VKRPLIPRMVRVLAVPIVVFWAIVAVTTNTFVP

SEQ ID NO: 334266 - protein, 17 aa, Mycobacterium
VKRRGQESFNFGELFAY

SEQ ID NO: 334267 - protein, 19 aa, Mycobacterium
VKRRIYWTGTVAGVVLLFC

SEQ ID NO: 334268 - protein, 27 aa, Mycobacterium
VKSERRDALKWVWIGVGAAVVMTVTVF

SEQ ID NO: 334269 - protein, 27 aa, Mycobacterium
VKSERRDALRWVWLGVSCAIAVTVTVF

SEQ ID NO: 334270 - protein, 17 aa, Mycobacterium
VKTARGVLIAELSLVAV

SEQ ID NO: 334271 - protein, 20 aa, Mycobacterium
VKTGFWRVLGIWLLASLVAS

SEQ ID NO: 334272 - protein, 34 aa, Mycobacterium
VKTRGWRRVGVAVVRWPGPILVGAVLVTVIGLVA

SEQ ID NO: 334273 - protein, 26 aa, Mycobacterium
VKTVWLRPGTRLGFFTHMGTQFSITV

SEQ ID NO: 334274 - protein, 17 aa, Mycobacterium
VKVAVSPDGRWIASGGD

SEQ ID NO: 334275 - protein, 22 aa, Mycobacterium
VKVDLPLAVPVLIAGLRVVVVT

SEQ ID NO: 334276 - protein, 17 aa, Mycobacterium
VKVPANVIAAAFTSSVL

SEQ ID NO: 334277 - protein, 20 aa, Mycobacterium
VKYQPEWVPRFACYEDARLI

SEQ ID NO: 334278 - protein, 17 aa, Mycobacterium
VLAAAMFYFGMAKVIPT

SEQ ID NO: 334279 - protein, 22 aa, Mycobacterium
VLAAAVGTRFMQLRARRSATSG

SEQ ID NO: 334280 - protein, 18 aa, Mycobacterium
VLAAAVWNGAFGGIPSIY

SEQ ID NO: 334281 - protein, 25 aa, Mycobacterium
VLAAGLIFLWALVLGIWKYRQMATS

SEQ ID NO: 334282 - protein, 25 aa, Mycobacterium
VLAALWLTLRLTFYGTVLGFLLGVA

SEQ ID NO: 334283 - protein, 19 aa, Mycobacterium
VLAAPLLVRLMLGRAPQVN

SEQ ID NO: 334284 - protein, 19 aa, Mycobacterium
VLAAPLLVRLMLGRDPQVN

SEQ ID NO: 334285 - protein, 24 aa, Mycobacterium
VLAAVFGPWLLREAFGAQYRAEGA

SEQ ID NO: 334286 - protein, 18 aa, Mycobacterium
VLAAYAFARLEFPGRDGL

SEQ ID NO: 334287 - protein, 22 aa, Mycobacterium
VLACAALLVWFWPRLLEQGMAV

SEQ ID NO: 334288 - protein, 23 aa, Mycobacterium
VLADRTALVIAHRLSTVQIADRV

SEQ ID NO: 334289 - protein, 31 aa, Mycobacterium
VLAEAFLPRRARYGAQVTLALAGLIAAFLAT

SEQ ID NO: 334290 - protein, 23 aa, Mycobacterium
VLAEIAIAVLLMWSNTVVATPHW

SEQ ID NO: 334291 - protein, 19 aa, Mycobacterium
VLAEIKALLFGVVAGLVGC

SEQ ID NO: 334292 - protein, 19 aa, Mycobacterium
VLAEVRWQDGSAVALLDAA

SEQ ID NO: 334293 - protein, 24 aa, Mycobacterium
VLAEVWKTTPFMALLLLAGLALVP

SEQ ID NO: 334294 - protein, 24 aa, Mycobacterium
VLAEVWKTTPFMSLLLLAGLALVP

SEQ ID NO: 334295 - protein, 21 aa, Mycobacterium
VLAFACFWVQTTVWTSAVASR

SEQ ID NO: 334296 - protein, 20 aa, Mycobacterium
VLAFAMPRWSVLSGVAVLGV

SEQ ID NO: 334297 - protein, 24 aa, Mycobacterium
VLAFGARDRPEFALWDSPPQVIVG

SEQ ID NO: 334298 - protein, 21 aa, Mycobacterium
VLAFVFARLFAAPQTARAIEY

SEQ ID NO: 334299 - protein, 17 aa, Mycobacterium
VLAGLAFGERPGTLAGV

SEQ ID NO: 334300 - protein, 17 aa, Mycobacterium
VLAGLRCGERVLVHTAT

SEQ ID NO: 334301 - protein, 17 aa, Mycobacterium
VLAGLTLGPAVVFVGSR

SEQ ID NO: 334302 - protein, 27 aa, Mycobacterium
VLAGPVSRWRWLLGATVAAVLGSAVVL

SEQ ID NO: 334303 - protein, 17 aa, Mycobacterium
VLAGWLLGMAWAGAVMV

SEQ ID NO: 334304 - protein, 26 aa, Mycobacterium
VLAIACGLLAGWLHFRMDYAGHTQVA

SEQ ID NO: 334305 - protein, 19 aa, Mycobacterium
VLAIAFLAVPGFQPSYNER

SEQ ID NO: 334306 - protein, 25 aa, Mycobacterium
VLAIAGTGIGVWRLSSSHGENLPQI

SEQ ID NO: 334307 - protein, 24 aa, Mycobacterium
VLAIPFALAFTRPVPTPPRRDDDE

SEQ ID NO: 334308 - protein, 19 aa, Mycobacterium
VLAIRFGAVAYPRERDVHV

SEQ ID NO: 334309 - protein, 18 aa, Mycobacterium
VLAISALTFVAWAALGNS

SEQ ID NO: 334310 - protein, 17 aa, Mycobacterium
VLALAAKRGIGEPKADR

SEQ ID NO: 334311 - protein, 17 aa, Mycobacterium
VLALALFVFVCYHVAGI

SEQ ID NO: 334312 - protein, 18 aa, Mycobacterium
VLALARWGSRHRPDSVRS

SEQ ID NO: 334313 - protein, 19 aa, Mycobacterium
VLALAWAAVRLLRRRRAAA

SEQ ID NO: 334314 - protein, 34 aa, Mycobacterium
VLALFGCWRGMYFTTLLRRRLAIMGHRESAAAES

SEQ ID NO: 334315 - protein, 18 aa, Mycobacterium
VLALGGGIHSVFQSLIGE

SEQ ID NO: 334316 - protein, 18 aa, Mycobacterium
VLALGYRRSHAIRDSPAV

SEQ ID NO: 334317 - protein, 17 aa, Mycobacterium
VLALLGFLKVRRIRGPR

SEQ ID NO: 334318 - protein, 25 aa, Mycobacterium
VLALVAAFVGWRLYQKLTNNTVVAY

SEQ ID NO: 334319 - protein, 19 aa, Mycobacterium
VLALVLFLGHLVRQIRIET

SEQ ID NO: 334320 - protein, 25 aa, Mycobacterium
VLALVLTGGAWEWSSSKNNRLNTVS

SEQ ID NO: 334321 - protein, 31 aa, Mycobacterium
VLAMAGISNRRWLRWPARVYTDIFRGLPEVV

SEQ ID NO: 334322 - protein, 19 aa, Mycobacterium
VLAMWSLAVLREYERGVVF

SEQ ID NO: 334323 - protein, 17 aa, Mycobacterium
VLAPRITADTGWSAPAV

SEQ ID NO: 334324 - protein, 19 aa, Mycobacterium
VLAPRWSMRLTARGWPKPL

SEQ ID NO: 334325 - protein, 17 aa, Mycobacterium
VLAPVAVIPLVLPDGTR

SEQ ID NO: 334326 - protein, 25 aa, Mycobacterium
VLARRPLIGVVWAWMTGRDDTWRRT

SEQ ID NO: 334327 - protein, 20 aa, Mycobacterium
VLASMHFYVWTRLAKNTTTP

SEQ ID NO: 334328 - protein, 23 aa, Mycobacterium
VLATCYRPLLFATVDPDVAAARG

SEQ ID NO: 334329 - protein, 22 aa, Mycobacterium
VLATLWIPPLIYFGLHRVEQRP

SEQ ID NO: 334330 - protein, 24 aa, Mycobacterium
VLATWSLVVLREYERGVVFRMGHV

SEQ ID NO: 334331 - protein, 23 aa, Mycobacterium
VLAVAVVGYARWTLPDREGNADR

SEQ ID NO: 334332 - protein, 18 aa, Mycobacterium
VLAVLAWRALDASDQLGK

SEQ ID NO: 334333 - protein, 19 aa, Mycobacterium
VLAVLAWRALEPADHLGKL

SEQ ID NO: 334334 - protein, 17 aa, Mycobacterium
VLAVPRNRIRSVSTDAR

SEQ ID NO: 334335 - protein, 29 aa, Mycobacterium
VLAVRPELQPALAGQNWAALPGLQTNPNG

SEQ ID NO: 334336 - protein, 18 aa, Mycobacterium
VLAVSALTMLAAFGTPPA

SEQ ID NO: 334337 - protein, 26 aa, Mycobacterium
VLAVSRWRRGGLRAAVDPLRRLAVIA

SEQ ID NO: 334338 - protein, 17 aa, Mycobacterium
VLAVVAAVRMFRPASAQ

SEQ ID NO: 334339 - protein, 23 aa, Mycobacterium
VLAWATSGINGWFYNANYGVPWF

SEQ ID NO: 334340 - protein, 18 aa, Mycobacterium
VLAWLAALGCYDIHQRRL

SEQ ID NO: 334341 - protein, 27 aa, Mycobacterium
VLAYLFFPLYRRLRTRMGTGGAAATTL

SEQ ID NO: 334342 - protein, 28 aa, Mycobacterium
VLCALAVGLKFKFGFDDSLDVVGVHLVG

SEQ ID NO: 334343 - protein, 20 aa, Mycobacterium
VLCAVAVAIGGLHLVQPTPS

SEQ ID NO: 334344 - protein, 19 aa, Mycobacterium
VLCGAGIAYRIYRADVPET

SEQ ID NO: 334345 - protein, 22 aa, Mycobacterium
VLCQYTLIFLVVIQWHHGELVL

SEQ ID NO: 334346 - protein, 26 aa, Mycobacterium
VLDAEPRLSALLSDYTTPAEGRVALL

SEQ ID NO: 334347 - protein, 27 aa, Mycobacterium
VLDEWLRPVPPGVVGELYLAGRGVGVG

SEQ ID NO: 334348 - protein, 22 aa, Mycobacterium
VLDEWLRPVPVGVVGELYVAGE

SEQ ID NO: 334349 - protein, 18 aa, Mycobacterium
VLDGPGIPEVLGDEPRIR

SEQ ID NO: 334350 - protein, 17 aa, Mycobacterium
VLDICANVTMLLALHTW

SEQ ID NO: 334351 - protein, 21 aa, Mycobacterium
VLDIVKAVAAALDYAHGRGLL

SEQ ID NO: 334352 - protein, 36 aa, Mycobacterium
VLDLEPRGPLPTEIYWRRRGLALGIAVVVIGVAVAA

SEQ ID NO: 334353 - protein, 33 aa, Mycobacterium
VLDLEPRGPLPTEIYWRRRGLAVGVAVVVVGIV

SEQ ID NO: 334354 - protein, 25 aa, Mycobacterium
VLDLGCGRGAVLLAAAKRLPRGRAI

SEQ ID NO: 334355 - protein, 18 aa, Mycobacterium
VLDLTIRLAEVMLSSGSG

SEQ ID NO: 334356 - protein, 18 aa, Mycobacterium
VLDRIAYRTTIFAFPTFG

SEQ ID NO: 334357 - protein, 17 aa, Mycobacterium
VLDRLAKGIFRVPGISR

SEQ ID NO: 334358 - protein, 26 aa, Mycobacterium
VLDTLAVFVGWLWPLWDARNRTFADL

SEQ ID NO: 334359 - protein, 34 aa, Mycobacterium
VLDVKLGLMCLVAFPVLVLLVWWFQRESSKTYRE

SEQ ID NO: 334360 - protein, 25 aa, Mycobacterium
VLDVPQPLAYCLPGVRSRVVVSEGA

SEQ ID NO: 334361 - protein, 25 aa, Mycobacterium
VLDVPQPLAYCLPGVRSRVVVSEGT

SEQ ID NO: 334362 - protein, 19 aa, Mycobacterium
VLEAGRWQALMLPVTTLVI

SEQ ID NO: 334363 - protein, 18 aa, Mycobacterium
VLEALRYGKGLRADELIA

SEQ ID NO: 334364 - protein, 18 aa, Mycobacterium
VLEGFDFGVGMLMEPLAR

SEQ ID NO: 334365 - protein, 17 aa, Mycobacterium
VLEGFDFGVGMLMHPLG

SEQ ID NO: 334366 - protein, 24 aa, Mycobacterium
VLEGTYRVDIDWAKQTENGAPASS

SEQ ID NO: 334367 - protein, 23 aa, Mycobacterium
VLEIGCWALGFVVTGAGIGMAWP

SEQ ID NO: 334368 - protein, 28 aa, Mycobacterium
VLELIRQPRFWRLAIAFLTLALAVGGML

SEQ ID NO: 334369 - protein, 39 aa, Mycobacterium
VLEPKGAGKARGWRRVGAATVRWPGAILVAAVTMALVGL

SEQ ID NO: 334370 - protein, 18 aa, Mycobacterium
VLERIRTSGFLILTVLVG

SEQ ID NO: 334371 - protein, 19 aa, Mycobacterium
VLERVAPPHPSRWRHVPTI

SEQ ID NO: 334372 - protein, 23 aa, Mycobacterium
VLERWEHVLFPIVLIALGIFILV

SEQ ID NO: 334373 - protein, 19 aa, Mycobacterium
VLETLEFALVVTIASVPVA

SEQ ID NO: 334374 - protein, 19 aa, Mycobacterium
VLEVIDRGPGMTKTDAERV

SEQ ID NO: 334375 - protein, 24 aa, Mycobacterium
VLFAGGGPQGWSWGSLNPLNGFHD

SEQ ID NO: 334376 - protein, 17 aa, Mycobacterium
VLFALASGRAMRALGWL

SEQ ID NO: 334377 - protein, 18 aa, Mycobacterium
VLFATAWAATAEENLEAA

SEQ ID NO: 334378 - protein, 20 aa, Mycobacterium
VLFCTLVLIAVLSWGAGRIN

SEQ ID NO: 334379 - protein, 19 aa, Mycobacterium
VLFFLMGCFTIVGTRQIAI

SEQ ID NO: 334380 - protein, 19 aa, Mycobacterium
VLFFVCAIYTHLLARDYSP

SEQ ID NO: 334381 - protein, 24 aa, Mycobacterium
VLFGALTAVFGWQVLPFLIIQGLF

SEQ ID NO: 334382 - protein, 24 aa, Mycobacterium
VLFGGLTAVFGWQVLPFLIIQAFY

SEQ ID NO: 334383 - protein, 23 aa, Mycobacterium
VLFGLACAAIVYIALTAPRRPRL

SEQ ID NO: 334384 - protein, 18 aa, Mycobacterium
VLFICAAAGLAIGSSGLD

SEQ ID NO: 334385 - protein, 32 aa, Mycobacterium
VLFIGRFLDLMWRAVSFQVLPTIVLRNVGTVE

SEQ ID NO: 334386 - protein, 30 aa, Mycobacterium
VLFIKDGRLHYVYNFLGIKPEQEFISAPLT

SEQ ID NO: 334387 - protein, 19 aa, Mycobacterium
VLFLLRRVLLRSTYFTLPR

SEQ ID NO: 334388 - protein, 22 aa, Mycobacterium
VLFPLPPSWGWFWFSLTVLGAL

SEQ ID NO: 334389 - protein, 26 aa, Mycobacterium
VLFPVGFCLLYLLGFDLLTGVFTLVP

SEQ ID NO: 334390 - protein, 17 aa, Mycobacterium
VLFPVGLIWVAIDRQRR

SEQ ID NO: 334391 - protein, 17 aa, Mycobacterium
VLFPVWVLIVSVMMLAR

SEQ ID NO: 334392 - protein, 21 aa, Mycobacterium
VLFSVRLNVLFSYQSNDMYTA

SEQ ID NO: 334393 - protein, 19 aa, Mycobacterium
VLFTGLWALIAYFRAEVRR

SEQ ID NO: 334394 - protein, 18 aa, Mycobacterium
VLFTGLWGLIAYFRAEVR

SEQ ID NO: 334395 - protein, 24 aa, Mycobacterium
VLFVCAIMFTLVWWHVDHSRSNWL

SEQ ID NO: 334396 - protein, 20 aa, Mycobacterium
VLGAAGGWLGYRYLSDHPTA

SEQ ID NO: 334397 - protein, 17 aa, Mycobacterium
VLGAGGMGRVYLARHPR

SEQ ID NO: 334398 - protein, 17 aa, Mycobacterium
VLGAGVGVTGAWVALLA

SEQ ID NO: 334399 - protein, 19 aa, Mycobacterium
VLGALTASIPARWRPAWIG

SEQ ID NO: 334400 - protein, 18 aa, Mycobacterium
VLGAMIFAAVPWLQRFGE

SEQ ID NO: 334401 - protein, 20 aa, Mycobacterium
VLGAPHSWWALYLGPALVVE

SEQ ID NO: 334402 - protein, 18 aa, Mycobacterium
VLGCRLRGRAGRHRFEHR

SEQ ID NO: 334403 - protein, 30 aa, Mycobacterium
VLGDEDMQAWGWRLPFLVAAPLGLIGVYLR

SEQ ID NO: 334404 - protein, 20 aa, Mycobacterium
VLGDGPAAVCGAVIAVVGPA

SEQ ID NO: 334405 - protein, 18 aa, Mycobacterium
VLGELRKVIWPNRKEMIA

SEQ ID NO: 334406 - protein, 27 aa, Mycobacterium
VLGFLAYLASFGPMFTISSELGGGSSE

SEQ ID NO: 334407 - protein, 21 aa, Mycobacterium
VLGFLRYGLPPGDRIQLQDLP

SEQ ID NO: 334408 - protein, 21 aa, Mycobacterium
VLGFWFAFVMLRIVRGRGPLR

SEQ ID NO: 334409 - protein, 30 aa, Mycobacterium
VLGGAIATLGDWRWIFAVNVPIGLIGILFA

SEQ ID NO: 334410 - protein, 26 aa, Mycobacterium
VLGGQVVAGFGWRAVFLALAGLNLVM

SEQ ID NO: 334411 - protein, 21 aa, Mycobacterium
VLGIPGLPFVALIILIVGGIL

SEQ ID NO: 334412 - protein, 18 aa, Mycobacterium
VLGLAIILFSGRRWVTTL

SEQ ID NO: 334413 - protein, 22 aa, Mycobacterium
VLGLCGGVSWQAHLCGAVAGVV

SEQ ID NO: 334414 - protein, 26 aa, Mycobacterium
VLGLIGVALGWGWADAVAGIVVTGFI

SEQ ID NO: 334415 - protein, 19 aa, Mycobacterium
VLGLLLMRGQFIPGLNALD

SEQ ID NO: 334416 - protein, 30 aa, Mycobacterium
VLGPLYGVLCVWLFGSWTAIFWVNVPLAII

SEQ ID NO: 334417 - protein, 33 aa, Mycobacterium
VLGPMYGIALVWLFNHWQAVFWVNVPLAVIAMV

SEQ ID NO: 334418 - protein, 17 aa, Mycobacterium
VLGRIYDSWAQRSGDED

SEQ ID NO: 334419 - protein, 20 aa, Mycobacterium
VLGRSWSVICDELLDHYAEV

SEQ ID NO: 334420 - protein, 21 aa, Mycobacterium
VLGSLCAALWISDSLDGYGPV

SEQ ID NO: 334421 - protein, 19 aa, Mycobacterium
VLGSQAWLAAHRVGDVVVL

SEQ ID NO: 334422 - protein, 25 aa, Mycobacterium
VLGTFPIIFGLSFRDALLATLAGLV

SEQ ID NO: 334423 - protein, 26 aa, Mycobacterium
VLGTMLGWRATFWAIALLCLPAVVGI

SEQ ID NO: 334424 - protein, 21 aa, Mycobacterium
VLGTWQFSSRSLFALLSVTLA

SEQ ID NO: 334425 - protein, 23 aa, Mycobacterium
VLGVALCALLGLAITTQVRQTES

SEQ ID NO: 334426 - protein, 17 aa, Mycobacterium
VLGVCFFLASSGASAAY

SEQ ID NO: 334427 - protein, 25 aa, Mycobacterium
VLGVLALVVVLVFTLGGNKSNNAGP

SEQ ID NO: 334428 - protein, 21 aa, Mycobacterium
VLGVWKYRQIMAADDHRAHPY

SEQ ID NO: 334429 - protein, 18 aa, Mycobacterium
VLGWGWLALILVGVPWLL

SEQ ID NO: 334430 - protein, 24 aa, Mycobacterium
VLGWPLWTAYVVVFLLTLVIGARL

SEQ ID NO: 334431 - protein, 19 aa, Mycobacterium
VLHDCWSLRDPMKLPTTPA

SEQ ID NO: 334432 - protein, 24 aa, Mycobacterium
VLHFSASWCGPCAGVRRVVDRVCE

SEQ ID NO: 334433 - protein, 27 aa, Mycobacterium
VLHHELEFWWELALLIVIMLLGHWFEM

SEQ ID NO: 334434 - protein, 18 aa, Mycobacterium
VLHLTRFGKTVYAVGGNR

SEQ ID NO: 334435 - protein, 18 aa, Mycobacterium
VLHPSNDVVNAWLMSVVL

SEQ ID NO: 334436 - protein, 17 aa, Mycobacterium
VLHRAWVAPMILIVLDD

SEQ ID NO: 334437 - protein, 22 aa, Mycobacterium
VLHRHPHWKRLIGPALVLILST

SEQ ID NO: 334438 - protein, 18 aa, Mycobacterium
VLHTLDLPPEQRKEITED

SEQ ID NO: 334439 - protein, 25 aa, Mycobacterium
VLHVAQPLAYCLPGVRSRVVVSEGA

SEQ ID NO: 334440 - protein, 20 aa, Mycobacterium
VLHYCPKPVVVVPHPMLSAE

SEQ ID NO: 334441 - protein, 18 aa, Mycobacterium
VLIALALTNWGVKTAAKT

SEQ ID NO: 334442 - protein, 19 aa, Mycobacterium
VLIARPGFVIGRMTEGMTP

SEQ ID NO: 334443 - protein, 17 aa, Mycobacterium
VLIARRFHNDAVRDTLA

SEQ ID NO: 334444 - protein, 18 aa, Mycobacterium
VLIFGIAMGALFAVLFCV

SEQ ID NO: 334445 - protein, 18 aa, Mycobacterium
VLIFGVAMGALFGVLFCV

SEQ ID NO: 334446 - protein, 26 aa, Mycobacterium
VLIGAGLAVILSFVWGVRIGGLFTAL

SEQ ID NO: 334447 - protein, 17 aa, Mycobacterium
VLIGATLLVTMFPAISL

SEQ ID NO: 334448 - protein, 22 aa, Mycobacterium
VLIGELACLVGMVVGVPVAALV

SEQ ID NO: 334449 - protein, 17 aa, Mycobacterium
VLIGLSAVVAMTAIGGV

SEQ ID NO: 334450 - protein, 28 aa, Mycobacterium
VLILAVSDWKAAWWAAAGVAAVLCVIAW

SEQ ID NO: 334451 - protein, 18 aa, Mycobacterium
VLILLAVSGRYLYTYAAP

SEQ ID NO: 334452 - protein, 17 aa, Mycobacterium
VLILPLMIAPVIAGVIW

SEQ ID NO: 334453 - protein, 19 aa, Mycobacterium
VLIMLMWVGTALIISTADS

SEQ ID NO: 334454 - protein, 17 aa, Mycobacterium
VLIPLALLGILGLAAVV

SEQ ID NO: 334455 - protein, 23 aa, Mycobacterium
VLIRRPVVGYIWGWVHTDDAGWR

SEQ ID NO: 334456 - protein, 25 aa, Mycobacterium
VLISLLFGWPWWAALLIAIVSLALV

SEQ ID NO: 334457 - protein, 27 aa, Mycobacterium
VLISLPTLGLWVSIPMALGRKKFLPPF

SEQ ID NO: 334458 - protein, 17 aa, Mycobacterium
VLISWRRTRRPEFATPR

SEQ ID NO: 334459 - protein, 18 aa, Mycobacterium
VLIVGGVLSGVWATFFLA

SEQ ID NO: 334460 - protein, 17 aa, Mycobacterium
VLIVWRRDLLAIIRLLA

SEQ ID NO: 334461 - protein, 26 aa, Mycobacterium
VLIWQHLLHMPLNWIVVPMAVIVMLA

SEQ ID NO: 334462 - protein, 19 aa, Mycobacterium
VLIWQHLVGLELHWMVLAM

SEQ ID NO: 334463 - protein, 27 aa, Mycobacterium
VLIWQHLVGLPLHWLILPLTFIILVAV

SEQ ID NO: 334464 - protein, 19 aa, Mycobacterium
VLIYTELYAGFTAITAILI

SEQ ID NO: 334465 - protein, 24 aa, Mycobacterium
VLIYTRGIVTFDLPGAAVIATIQI

SEQ ID NO: 334466 - protein, 24 aa, Mycobacterium
VLKIALYILGGWLFAMVTTEGIDR

SEQ ID NO: 334467 - protein, 24 aa, Mycobacterium
VLKRTGRLSLRHALDMLEQTGRAL

SEQ ID NO: 334468 - protein, 25 aa, Mycobacterium
VLKRTGRLSLRHALDMLEQTGRALQ

SEQ ID NO: 334469 - protein, 26 aa, Mycobacterium
VLKRTGRLSLRHSLDMLEQTGRALQV

SEQ ID NO: 334470 - protein, 25 aa, Mycobacterium
VLLAACAVNYAMLLAAFIITGIAVG

SEQ ID NO: 334471 - protein, 24 aa, Mycobacterium
VLLAEALGALLAALTRGRPAGPVV

SEQ ID NO: 334472 - protein, 18 aa, Mycobacterium
VLLAITYYQVRVMDRGQR

SEQ ID NO: 334473 - protein, 19 aa, Mycobacterium
VLLAIVVGAVHFWPADRGE

SEQ ID NO: 334474 - protein, 31 aa, Mycobacterium
VLLALLANLFFPWGIAGDRPSLVGVGIGVAA

SEQ ID NO: 334475 - protein, 24 aa, Mycobacterium
VLLALPGFLVSVWIVTAYGAGPLS

SEQ ID NO: 334476 - protein, 19 aa, Mycobacterium
VLLALRVAVRLGLALLLAP

SEQ ID NO: 334477 - protein, 21 aa, Mycobacterium
VLLAPVFCLLAPVAVVPVAIP

SEQ ID NO: 334478 - protein, 21 aa, Mycobacterium
VLLATRFVAAFVYAGFWAVGA

SEQ ID NO: 334479 - protein, 39 aa, Mycobacterium
VLLAVFLWLERRTWHPILDLSIFANRRFSGGTAAVTTAY

SEQ ID NO: 334480 - protein, 17 aa, Mycobacterium
VLLDYLFLPLVIWLIGG

SEQ ID NO: 334481 - protein, 21 aa, Mycobacterium
VLLEDAYRVPAWWDPAKAERG

SEQ ID NO: 334482 - protein, 17 aa, Mycobacterium
VLLEFAIQIARLHDKRK

SEQ ID NO: 334483 - protein, 27 aa, Mycobacterium
VLLELRRRVFRHFGRLDIAFHDRYTSG

SEQ ID NO: 334484 - protein, 26 aa, Mycobacterium
VLLEVWPVILVGALAWLGAAMAAFLV

SEQ ID NO: 334485 - protein, 18 aa, Mycobacterium
VLLGELRDAMLLMPISDP

SEQ ID NO: 334486 - protein, 17 aa, Mycobacterium
VLLGLAAIVAVAALSTW

SEQ ID NO: 334487 - protein, 18 aa, Mycobacterium
VLLGLFLATAVLLIMKMS

SEQ ID NO: 334488 - protein, 19 aa, Mycobacterium
VLLGLPLALAMLALLVYLY

SEQ ID NO: 334489 - protein, 20 aa, Mycobacterium
VLLGLWLLPGLPWAVLLAVA

SEQ ID NO: 334490 - protein, 17 aa, Mycobacterium
VLLGMGIGWGLYGNTRS

SEQ ID NO: 334491 - protein, 21 aa, Mycobacterium
VLLGTVLAIMVWRSRGAPRPA

SEQ ID NO: 334492 - protein, 23 aa, Mycobacterium
VLLGVGLLWFGWFGFNAGSALAA

SEQ ID NO: 334493 - protein, 24 aa, Mycobacterium
VLLGVGLLWFGWFGFNAGSALAAN

SEQ ID NO: 334494 - protein, 18 aa, Mycobacterium
VLLGVGWVLFVWSVLGQL

SEQ ID NO: 334495 - protein, 24 aa, Mycobacterium
VLLGVGYPLLIWLVAGLPGLHDKA

SEQ ID NO: 334496 - protein, 19 aa, Mycobacterium
VLLGVPMALVLARSRARLM

SEQ ID NO: 334497 - protein, 18 aa, Mycobacterium
VLLHAGAQDADWRDFCLR

SEQ ID NO: 334498 - protein, 22 aa, Mycobacterium
VLLIAGGLAWLARTHRKVQLQQ

SEQ ID NO: 334499 - protein, 36 aa, Mycobacterium
VLLICAFAIGAAAVFAWLLAVFAVRPFKQLAEQTRS

SEQ ID NO: 334500 - protein, 22 aa, Mycobacterium
VLLIGLIRWYIGMAQRTSALAT

SEQ ID NO: 334501 - protein, 24 aa, Mycobacterium
VLLILEVFWWPRRQAQLLTNADRA

SEQ ID NO: 334502 - protein, 24 aa, Mycobacterium
VLLILGIYVVLQFARRRRVLRFAN

SEQ ID NO: 334503 - protein, 18 aa, Mycobacterium
VLLIYLWVGIVAFGAAST

SEQ ID NO: 334504 - protein, 24 aa, Mycobacterium
VLLKETLHRASMPGAPSPAPNRAR

SEQ ID NO: 334505 - protein, 32 aa, Mycobacterium
VLLKMCWPTAPRWVGVPLYLLLGWVAVWYTAT

SEQ ID NO: 334506 - protein, 19 aa, Mycobacterium
VLLKMFWPSAPRWLGVPLY

SEQ ID NO: 334507 - protein, 17 aa, Mycobacterium
VLLLAGFGWMISSRMVR

SEQ ID NO: 334508 - protein, 19 aa, Mycobacterium
VLLLAGFGWMISSRMVRGM

SEQ ID NO: 334509 - protein, 19 aa, Mycobacterium
VLLLAGLIVGWAGGPGPVT

SEQ ID NO: 334510 - protein, 31 aa, Mycobacterium
VLLLAGLVVGAALWHRRRNRDDGFDHEPFDD

SEQ ID NO: 334511 - protein, 18 aa, Mycobacterium
VLLLALAVEHQWPGPCRL

SEQ ID NO: 334512 - protein, 21 aa, Mycobacterium
VLLLAPTLRWFVPGDEPTPQQ

SEQ ID NO: 334513 - protein, 25 aa, Mycobacterium
VLLLASRSRTAWVLGTACLSMAKIL

SEQ ID NO: 334514 - protein, 20 aa, Mycobacterium
VLLLCYLGFISGDGPTRGLF

SEQ ID NO: 334515 - protein, 18 aa, Mycobacterium
VLLLGATMLLMFLAFGSV

SEQ ID NO: 334516 - protein, 22 aa, Mycobacterium
VLLLLYWQWRTMPAVIWDVRQP

SEQ ID NO: 334517 - protein, 20 aa, Mycobacterium
VLLLPLILFWKGRGEQRSRL

SEQ ID NO: 334518 - protein, 21 aa, Mycobacterium
VLLLVAWQVAAAWELVSPSVL

SEQ ID NO: 334519 - protein, 20 aa, Mycobacterium
VLLMLAVLWAALTARWWLSG

SEQ ID NO: 334520 - protein, 25 aa, Mycobacterium
VLLMVGTFFLIRSMNSHLRKLPETF

SEQ ID NO: 334521 - protein, 23 aa, Mycobacterium
VLLPLLRPGYLLLRDAVSTPRSY

SEQ ID NO: 334522 - protein, 25 aa, Mycobacterium
VLLRELRVGLSLGLLLGGLAFAVTS

SEQ ID NO: 334523 - protein, 24 aa, Mycobacterium
VLLRRGWVGGLARGPAWRLIGTTA

SEQ ID NO: 334524 - protein, 17 aa, Mycobacterium
VLLRSLLAPLFMVAVVT

SEQ ID NO: 334525 - protein, 22 aa, Mycobacterium
VLLRVADCGLGMTDSDRRIANM

SEQ ID NO: 334526 - protein, 27 aa, Mycobacterium
VLLRVPLPREIKVWGHIAVVSLTLCVM

SEQ ID NO: 334527 - protein, 30 aa, Mycobacterium
VLLSDEAFTSWGWRVPFLVSAPIVLVATLI

SEQ ID NO: 334528 - protein, 24 aa, Mycobacterium
VLLTAATIGFGWSVPDVADEGRLP

SEQ ID NO: 334529 - protein, 62 aa, Mycobacterium
VLLTAGITPRLYVWITGPDVLPAVAAIVAVLVWGVGANLGWWKGLAGLWQWATDASHKAAAT

SEQ ID NO: 334530 - protein, 29 aa, Mycobacterium
VLLTIAWVVVICAMFVRGGPVIPRNYVLL

SEQ ID NO: 334531 - protein, 23 aa, Mycobacterium
VLLVGTFALVWSMNRHLRNLPES

SEQ ID NO: 334532 - protein, 18 aa, Mycobacterium
VLLVPTMIWVRLRAPWAK

SEQ ID NO: 334533 - protein, 26 aa, Mycobacterium
VLLVWRRVSDGWAFLCIAVVVAAVVL

SEQ ID NO: 334534 - protein, 25 aa, Mycobacterium
VLLWCSGSIWPAVMVHIAYNSAGIV

SEQ ID NO: 334535 - protein, 26 aa, Mycobacterium
VLLWEHILGLQLHWFVLPFTVIILLA

SEQ ID NO: 334536 - protein, 25 aa, Mycobacterium
VLLWQHIIGLALHWMVLPMAVILLL

SEQ ID NO: 334537 - protein, 26 aa, Mycobacterium
VLLWQHIIGMPLHWLVIAMSVIVLLA

SEQ ID NO: 334538 - protein, 25 aa, Mycobacterium
VLLWQHLFWFFGHPEVYIIALPFFG

SEQ ID NO: 334539 - protein, 26 aa, Mycobacterium
VLLWQHLIGIPLHWMVLPMAVIVLLA

SEQ ID NO: 334540 - protein, 26 aa, Mycobacterium
VLLWQYILGLKLHWMVLAMAVILLLA

SEQ ID NO: 334541 - protein, 26 aa, Mycobacterium
VLLWQYIVGLPLQWMVMSMAVIILLA

SEQ ID NO: 334542 - protein, 22 aa, Mycobacterium
VLLWRLIRRDSPQPAFSGFFGV

SEQ ID NO: 334543 - protein, 22 aa, Mycobacterium
VLLWRLIRRDSPQPALSGFFGV

SEQ ID NO: 334544 - protein, 26 aa, Mycobacterium
VLLYAVCIVLRLARFNALLDVDQPAY

SEQ ID NO: 334545 - protein, 30 aa, Mycobacterium
VLLYAVCIVLRLARFNAMLAVDQPAYEKKY

SEQ ID NO: 334546 - protein, 25 aa, Mycobacterium
VLLYAVCVVLRLARFNALLDDGTQP

SEQ ID NO: 334547 - protein, 24 aa, Mycobacterium
VLLYAVCVVLRLARYNAQLDDGTL

SEQ ID NO: 334548 - protein, 29 aa, Mycobacterium
VLLYRMLTCWLPVFVGWPVMRWLTTNEMI

SEQ ID NO: 334549 - protein, 30 aa, Mycobacterium
VLMAELRPELPRSIRALPHADKPSVLLVVG

SEQ ID NO: 334550 - protein, 23 aa, Mycobacterium
VLMAICLGGLVGALGYATVSNYV

SEQ ID NO: 334551 - protein, 17 aa, Mycobacterium
VLMAMVLLRERISGLAA

SEQ ID NO: 334552 - protein, 19 aa, Mycobacterium
VLMAWGWPVAAVEPVVWAV

SEQ ID NO: 334553 - protein, 22 aa, Mycobacterium
VLMDLSARFSRMVIDGPPVLAT

SEQ ID NO: 334554 - protein, 18 aa, Mycobacterium
VLMGGVWTALYLSGPAGE

SEQ ID NO: 334555 - protein, 17 aa, Mycobacterium
VLMGKPLVREYAAAELP

SEQ ID NO: 334556 - protein, 21 aa, Mycobacterium
VLMGVAAWLVWRTRPPVPASA

SEQ ID NO: 334557 - protein, 22 aa, Mycobacterium
VLMLGQCRVLFAMARDGLLPRQ

SEQ ID NO: 334558 - protein, 23 aa, Mycobacterium
VLMLGQCRVLFAMARDGLLPRSL

SEQ ID NO: 334559 - protein, 27 aa, Mycobacterium
VLMLRDVWHAETWRGRIGYLLRPPGWQ

SEQ ID NO: 334560 - protein, 19 aa, Mycobacterium
VLMPLSLFGTLGLAAVVFV

SEQ ID NO: 334561 - protein, 26 aa, Mycobacterium
VLMRAVAGVSIFKLVRYLAREYLLIV

SEQ ID NO: 334562 - protein, 19 aa, Mycobacterium
VLMTIPWAVISGFLFNVLL

SEQ ID NO: 334563 - protein, 18 aa, Mycobacterium
VLMTIVAVAIRCAAAFDR

SEQ ID NO: 334564 - protein, 18 aa, Mycobacterium
VLMVEMKSLLIGEGATAI

SEQ ID NO: 334565 - protein, 27 aa, Mycobacterium
VLNAHIAFSVWYLWSVMVLFMPQSIYG

SEQ ID NO: 334566 - protein, 24 aa, Mycobacterium
VLNAWLMSVVLWGALIAVFGPALI

SEQ ID NO: 334567 - protein, 18 aa, Mycobacterium
VLNLIFGLVIAWVLVRDD

SEQ ID NO: 334568 - protein, 21 aa, Mycobacterium
VLNRKVRGIGIFRTIVFLPLA

SEQ ID NO: 334569 - protein, 23 aa, Mycobacterium
VLPACTLSYFGQGALVLRDQTAV

SEQ ID NO: 334570 - protein, 23 aa, Mycobacterium
VLPAFCAAALLAGDRPLRARIAD

SEQ ID NO: 334571 - protein, 24 aa, Mycobacterium
VLPALAFRPLRLAALCGVLGALAL

SEQ ID NO: 334572 - protein, 22 aa, Mycobacterium
VLPALWRYAPLTPIRGPPRSPV

SEQ ID NO: 334573 - protein, 29 aa, Mycobacterium
VLPEAAFMSWGWRIAFWLSAVVVLIGYYI

SEQ ID NO: 334574 - protein, 18 aa, Mycobacterium
VLPFEGLSYPTGVTADNS

SEQ ID NO: 334575 - protein, 26 aa, Mycobacterium
VLPFFAMGVGMAFVWSPLTATATRNL

SEQ ID NO: 334576 - protein, 26 aa, Mycobacterium
VLPFFATGVGMAFVWSPLTATATRNL

SEQ ID NO: 334577 - protein, 19 aa, Mycobacterium
VLPFTGLTAPWGITVDGAG

SEQ ID NO: 334578 - protein, 18 aa, Mycobacterium
VLPGALAAAVIWQILQWG

SEQ ID NO: 334579 - protein, 23 aa, Mycobacterium
VLPGETAWPFLVALIAVATMTLG

SEQ ID NO: 334580 - protein, 17 aa, Mycobacterium
VLPIHRASTVVGWVFAE

SEQ ID NO: 334581 - protein, 25 aa, Mycobacterium
VLPNDPRWWFGLPAVIALICNGLAA

SEQ ID NO: 334582 - protein, 24 aa, Mycobacterium
VLPSIPGWLWFLLLLGAVTATFAG

SEQ ID NO: 334583 - protein, 29 aa, Mycobacterium
VLPVAAILACVWLMLNLTGLTWIRFLIWM

SEQ ID NO: 334584 - protein, 24 aa, Mycobacterium
VLQAISWTYVWIFRSIPLIVQLLF

SEQ ID NO: 334585 - protein, 24 aa, Mycobacterium
VLQLCLVVLLVAVWRGRRPGPLVA

SEQ ID NO: 334586 - protein, 25 aa, Mycobacterium
VLQLCVVVALFALWQARRLGPLVAE

SEQ ID NO: 334587 - protein, 25 aa, Mycobacterium
VLQLFGVVCPIELLHTQLIQASGIF

SEQ ID NO: 334588 - protein, 19 aa, Mycobacterium
VLQPYLLRHHELIKFAIVG

SEQ ID NO: 334589 - protein, 18 aa, Mycobacterium
VLRDARALFYARGLKHAT

SEQ ID NO: 334590 - protein, 18 aa, Mycobacterium
VLRDRAWVTVALRELVPG

SEQ ID NO: 334591 - protein, 25 aa, Mycobacterium
VLREEAARFGVEWLAPKSFVADRLP

SEQ ID NO: 334592 - protein, 21 aa, Mycobacterium
VLRERLTRWQGFGMVMAMGSV

SEQ ID NO: 334593 - protein, 22 aa, Mycobacterium
VLRGGCALAAVGMLTVIAAPVL

SEQ ID NO: 334594 - protein, 17 aa, Mycobacterium
VLRIGVLVFVIAAMIVG

SEQ ID NO: 334595 - protein, 25 aa, Mycobacterium
VLRIRRVEGGWGMLSMTQLMAATVF

SEQ ID NO: 334596 - protein, 22 aa, Mycobacterium
VLRLADPLGRGWLADVDVSYAL

SEQ ID NO: 334597 - protein, 24 aa, Mycobacterium
VLRLPEPRNVAGIRLTPSSSALPA

SEQ ID NO: 334598 - protein, 19 aa, Mycobacterium
VLRLPHRYASLLLGGTGLI

SEQ ID NO: 334599 - protein, 27 aa, Mycobacterium
VLRLPRTRVGAWLGRPMTSFHLIVAVT

SEQ ID NO: 334600 - protein, 33 aa, Mycobacterium
VLRLRRMGRSWPWWSTVCFLSGCAILGAVMGLS

SEQ ID NO: 334601 - protein, 26 aa, Mycobacterium
VLRLVPRRLLAVSGWGPVLSTQRNAE

SEQ ID NO: 334602 - protein, 22 aa, Mycobacterium
VLRNLFNLLGLSSFFQMLVTGL

SEQ ID NO: 334603 - protein, 34 aa, Mycobacterium
VLRNSLRTGLGLALAVAVTHVFPVEHGFWVVLGA

SEQ ID NO: 334604 - protein, 17 aa, Mycobacterium
VLRPEIAALSMSGSSFI

SEQ ID NO: 334605 - protein, 17 aa, Mycobacterium
VLRPGRVPPALDEVIAK

SEQ ID NO: 334606 - protein, 24 aa, Mycobacterium
VLRRPQFRALWVFVLIPVLILLAV

SEQ ID NO: 334607 - protein, 19 aa, Mycobacterium
VLRRTRPDLPRGFRTPLVP

SEQ ID NO: 334608 - protein, 24 aa, Mycobacterium
VLRSELYAIPAMVAAALTVAALGL

SEQ ID NO: 334609 - protein, 20 aa, Mycobacterium
VLRSTILGLLSRWGEGAAFN

SEQ ID NO: 334610 - protein, 26 aa, Mycobacterium
VLRTNTALMPARWSVAGVEHTGAVDV

SEQ ID NO: 334611 - protein, 17 aa, Mycobacterium
VLRTVLHGLDLEEATLN

SEQ ID NO: 334612 - protein, 25 aa, Mycobacterium
VLRVLPLPRRLAGLLEAESGFNDAP

SEQ ID NO: 334613 - protein, 30 aa, Mycobacterium
VLRVPVRLSRLAPAFDGFRIAVVSDIHLGP

SEQ ID NO: 334614 - protein, 21 aa, Mycobacterium
VLRVQLVMGRDLLLRSLAFQA

SEQ ID NO: 334615 - protein, 24 aa, Mycobacterium
VLSAFKVPTVWLLLADDANIPRGP

SEQ ID NO: 334616 - protein, 20 aa, Mycobacterium
VLSAIRLALIPVFVYVMLIA

SEQ ID NO: 334617 - protein, 24 aa, Mycobacterium
VLSAPRLSARIGVGRHIAIALALF

SEQ ID NO: 334618 - protein, 20 aa, Mycobacterium
VLSCASCREWLGRARGLDRQ

SEQ ID NO: 334619 - protein, 33 aa, Mycobacterium
VLSCGALIDGVREFPGPWALVPVGAAMLLILVG

SEQ ID NO: 334620 - protein, 33 aa, Mycobacterium
VLSEEQLLSWGWRIPFLLSFVLMLFAIWLRLNL

SEQ ID NO: 334621 - protein, 25 aa, Mycobacterium
VLSFAIAALQGWSAYGYTPLPPGKA

SEQ ID NO: 334622 - protein, 24 aa, Mycobacterium
VLSGAERRSLLAATPGHPAGPRTD

SEQ ID NO: 334623 - protein, 22 aa, Mycobacterium
VLSGNFSWLNWLTILLACSAVD

SEQ ID NO: 334624 - protein, 29 aa, Mycobacterium
VLSGPMAFWACGLLLCLFIGPTLSSARTL

SEQ ID NO: 334625 - protein, 24 aa, Mycobacterium
VLSIAAALALRFTGRRLAIYTAIV

SEQ ID NO: 334626 - protein, 19 aa, Mycobacterium
VLSIAYTAIVWWKIRLKRR

SEQ ID NO: 334627 - protein, 20 aa, Mycobacterium
VLSIPGLLLALVFIAMFGPG

SEQ ID NO: 334628 - protein, 20 aa, Mycobacterium
VLSLAAGVGLGWLTALAGSV

SEQ ID NO: 334629 - protein, 25 aa, Mycobacterium
VLSLAFGWRAMFLIIGLAGLVLALA

SEQ ID NO: 334630 - protein, 19 aa, Mycobacterium
VLSLFRIVFGLLFTIHGTA

SEQ ID NO: 334631 - protein, 24 aa, Mycobacterium
VLSLMVVAVWLLGVGTLKDLALVQ

SEQ ID NO: 334632 - protein, 26 aa, Mycobacterium
VLSLPLYLLCGLARRRRLLSQEAALK

SEQ ID NO: 334633 - protein, 27 aa, Mycobacterium
VLSLPLYLMCGLARHRRLLSQEAALKY

SEQ ID NO: 334634 - protein, 28 aa, Mycobacterium
VLSLPLYLMCGLARHRRLLSQEAAMKYF

SEQ ID NO: 334635 - protein, 27 aa, Mycobacterium
VLSLPLYLMCGLARHRRLLSQESALKY

SEQ ID NO: 334636 - protein, 26 aa, Mycobacterium
VLSLPVMAVVLFFVFGGVIAAGLPLM

SEQ ID NO: 334637 - protein, 18 aa, Mycobacterium
VLSLRPQPVGDLVGEMVV

SEQ ID NO: 334638 - protein, 24 aa, Mycobacterium
VLSLSFSSVNGWWYVSNFGVPWSN

SEQ ID NO: 334639 - protein, 17 aa, Mycobacterium
VLSRITLPGSIYLGVIA

SEQ ID NO: 334640 - protein, 18 aa, Mycobacterium
VLSSALAGPRTRIGPLRK

SEQ ID NO: 334641 - protein, 20 aa, Mycobacterium
VLSVDWFGVVVLAVWGTLAA

SEQ ID NO: 334642 - protein, 26 aa, Mycobacterium
VLSVLACGYILFSLPWYTWLAFSIWV

SEQ ID NO: 334643 - protein, 36 aa, Mycobacterium
VLSVLACGYLLYSLHWYTWIAFTAWVAAALLFYLFW

SEQ ID NO: 334644 - protein, 25 aa, Mycobacterium
VLSWLQATMSWHWVFIVTGAIGIGW

SEQ ID NO: 334645 - protein, 17 aa, Mycobacterium
VLSWNVVVPVLAVVVLA

SEQ ID NO: 334646 - protein, 23 aa, Mycobacterium
VLSWRATEVLLHLAPADYRDPQI

SEQ ID NO: 334647 - protein, 25 aa, Mycobacterium
VLTAEAGAFIGIIALSLWVMKLTIS

SEQ ID NO: 334648 - protein, 32 aa, Mycobacterium
VLTAFLFMTFSEYRGGSYAGYSAVFDDASRLE

SEQ ID NO: 334649 - protein, 25 aa, Mycobacterium
VLTAGWYLCRGRVLQLARERIGYTG

SEQ ID NO: 334650 - protein, 17 aa, Mycobacterium
VLTAVILPAIRGHIQTG

SEQ ID NO: 334651 - protein, 24 aa, Mycobacterium
VLTCWLPVFLGWPIMRWLTKSEMI

SEQ ID NO: 334652 - protein, 24 aa, Mycobacterium
VLTCWLPVFVGWPVMRWLTKNDMI

SEQ ID NO: 334653 - protein, 17 aa, Mycobacterium
VLTDADFGSSLVVTAIF

SEQ ID NO: 334654 - protein, 22 aa, Mycobacterium
VLTDGYWWTAFAVTLGITVVSV

SEQ ID NO: 334655 - protein, 19 aa, Mycobacterium
VLTEHLVELMPVVYTPTVG

SEQ ID NO: 334656 - protein, 27 aa, Mycobacterium
VLTELPDRFPLKGVFHAAGVLDDAVIA

SEQ ID NO: 334657 - protein, 22 aa, Mycobacterium
VLTGGAWQWQSAKNNLLNRVSA

SEQ ID NO: 334658 - protein, 21 aa, Mycobacterium
VLTGGAWQWQSSKNDSLNKVA

SEQ ID NO: 334659 - protein, 22 aa, Mycobacterium
VLTGGAWQWSASKNERLNTVSA

SEQ ID NO: 334660 - protein, 20 aa, Mycobacterium
VLTGLRFVLVPIFLYLLFYD

SEQ ID NO: 334661 - protein, 23 aa, Mycobacterium
VLTICWAALLLHESLTWTTACGG

SEQ ID NO: 334662 - protein, 32 aa, Mycobacterium
VLTIGGGILLFWAMLYGWGFMHRGVPYFPNLV

SEQ ID NO: 334663 - protein, 26 aa, Mycobacterium
VLTLAVGWRSRRWRAVRMPVAALSGG

SEQ ID NO: 334664 - protein, 19 aa, Mycobacterium
VLTLAVGWRSRRWRTVWLP

SEQ ID NO: 334665 - protein, 19 aa, Mycobacterium
VLTLFPHRGPEVGGPPDGS

SEQ ID NO: 334666 - protein, 18 aa, Mycobacterium
VLTLGVWVWVGVTNDQYD

SEQ ID NO: 334667 - protein, 25 aa, Mycobacterium
VLTLRWPGGWWLDPAIGLCIVAVAL

SEQ ID NO: 334668 - protein, 31 aa, Mycobacterium
VLTLTVMGIFYLRLPATFGIGTYEVSADFVA

SEQ ID NO: 334669 - protein, 29 aa, Mycobacterium
VLTMFCFVGFPILVGVVVWTFVDAIMMFT

SEQ ID NO: 334670 - protein, 25 aa, Mycobacterium
VLTSPEFIPWLLVALTGMVFQQSAF

SEQ ID NO: 334671 - protein, 17 aa, Mycobacterium
VLTTLCLGIAAALDIVV

SEQ ID NO: 334672 - protein, 18 aa, Mycobacterium
VLTVCFVLSAVSGVARGI

SEQ ID NO: 334673 - protein, 29 aa, Mycobacterium
VLTYHIVKPWRWGYLAVLLVIFGFPLLTM

SEQ ID NO: 334674 - protein, 26 aa, Mycobacterium
VLVAAGLGWLLAGPAIRPLRKLTEHT

SEQ ID NO: 334675 - protein, 25 aa, Mycobacterium
VLVAIPMLAAWLVVRRARGASPLSR

SEQ ID NO: 334676 - protein, 23 aa, Mycobacterium
VLVAKARVPALIVTLGTLSVALG

SEQ ID NO: 334677 - protein, 18 aa, Mycobacterium
VLVANTFGAGDFVAYVVA

SEQ ID NO: 334678 - protein, 19 aa, Mycobacterium
VLVASRWLLKGTREYQLPT

SEQ ID NO: 334679 - protein, 18 aa, Mycobacterium
VLVAVRMARRAMRTNRDA

SEQ ID NO: 334680 - protein, 24 aa, Mycobacterium
VLVDFKGGATFLGLASAPHISALI

SEQ ID NO: 334681 - protein, 24 aa, Mycobacterium
VLVDFKGGATFLGLDRAQHVAAII

SEQ ID NO: 334682 - protein, 25 aa, Mycobacterium
VLVESWRIIGKCLHPLPDKRKGLTD

SEQ ID NO: 334683 - protein, 40 aa, Mycobacterium
VLVFFGAMLYWQFRGTFIPKTRLTMIAPRAGLVTDPGAKV

SEQ ID NO: 334684 - protein, 24 aa, Mycobacterium
VLVFLLSPAISWRAPVAAAAIAMA

SEQ ID NO: 334685 - protein, 18 aa, Mycobacterium
VLVFPGIGLGVVVAGARL

SEQ ID NO: 334686 - protein, 18 aa, Mycobacterium
VLVFSYRQVIAVHPEGGG

SEQ ID NO: 334687 - protein, 21 aa, Mycobacterium
VLVGAFTVMRVRTFFGSGDDP

SEQ ID NO: 334688 - protein, 22 aa, Mycobacterium
VLVGATLVGFGFVIGGPAMQSV

SEQ ID NO: 334689 - protein, 19 aa, Mycobacterium
VLVGGWALTGEDFVALIHS

SEQ ID NO: 334690 - protein, 23 aa, Mycobacterium
VLVGIPLLLLVGLLLAYLYTMLV

SEQ ID NO: 334691 - protein, 19 aa, Mycobacterium
VLVGLFVFVDWRMHAAVLP

SEQ ID NO: 334692 - protein, 17 aa, Mycobacterium
VLVGLTLIAAGLGIFAF

SEQ ID NO: 334693 - protein, 23 aa, Mycobacterium
VLVGVVLLLFAGFVVDEPFTDTV

SEQ ID NO: 334694 - protein, 19 aa, Mycobacterium
VLVGYMLGVALAMVAGQLG

SEQ ID NO: 334695 - protein, 24 aa, Mycobacterium
VLVIAVSLPVVWWRHRHNERDAMF

SEQ ID NO: 334696 - protein, 17 aa, Mycobacterium
VLVIIAALAGSGYMINE

SEQ ID NO: 334697 - protein, 18 aa, Mycobacterium
VLVIRFFTSGGMPMLRMM

SEQ ID NO: 334698 - protein, 23 aa, Mycobacterium
VLVIRPLSVFAMFGRRKLANQVE

SEQ ID NO: 334699 - protein, 17 aa, Mycobacterium
VLVLAGRFVLSAHVTTA

SEQ ID NO: 334700 - protein, 18 aa, Mycobacterium
VLVLCYALVPVLWVLSLS

SEQ ID NO: 334701 - protein, 26 aa, Mycobacterium
VLVLDWRSARWWGRGASLMAVPLCVL

SEQ ID NO: 334702 - protein, 18 aa, Mycobacterium
VLVLEFRNANGLTPASAD

SEQ ID NO: 334703 - protein, 18 aa, Mycobacterium
VLVLLLLLGPRFIDTYVD

SEQ ID NO: 334704 - protein, 19 aa, Mycobacterium
VLVLLPIVTFAMAYFIVDI

SEQ ID NO: 334705 - protein, 21 aa, Mycobacterium
VLVLTLGTWVWIGVTNDQYAQ

SEQ ID NO: 334706 - protein, 19 aa, Mycobacterium
VLVLTWMQFRGDFEDKAEI

SEQ ID NO: 334707 - protein, 19 aa, Mycobacterium
VLVMIGWGLFRIFVLGDPL

SEQ ID NO: 334708 - protein, 31 aa, Mycobacterium
VLVMLLCLFGMLFVLLRRGRVPGLASGPAWR

SEQ ID NO: 334709 - protein, 17 aa, Mycobacterium
VLVMVWEVDHWLPGLYA

SEQ ID NO: 334710 - protein, 18 aa, Mycobacterium
VLVNLGFNLFIFIINSFT

SEQ ID NO: 334711 - protein, 30 aa, Mycobacterium
VLVPLILAATFGGLRIYASVTEAADLRLAA

SEQ ID NO: 334712 - protein, 17 aa, Mycobacterium
VLVPLLPVRQSTVDINW

SEQ ID NO: 334713 - protein, 17 aa, Mycobacterium
VLVPVFLYLLLVADLTG

SEQ ID NO: 334714 - protein, 20 aa, Mycobacterium
VLVRARLATIGRQYEEAAMD

SEQ ID NO: 334715 - protein, 19 aa, Mycobacterium
VLVRGLAITFGFMFVVSLL

SEQ ID NO: 334716 - protein, 24 aa, Mycobacterium
VLVRPEIMRGTGFLGAHADEIYHL

SEQ ID NO: 334717 - protein, 24 aa, Mycobacterium
VLVVAGLFGWGAWQRRWIADDGLI

SEQ ID NO: 334718 - protein, 17 aa, Mycobacterium
VLVVCVVLIAFGYAALP

SEQ ID NO: 334719 - protein, 25 aa, Mycobacterium
VLVVGWRTARWWRRAVALTAVPLTI

SEQ ID NO: 334720 - protein, 25 aa, Mycobacterium
VLVVIVGGLGIWLVVRPKPAPPPDP

SEQ ID NO: 334721 - protein, 23 aa, Mycobacterium
VLVVLLKTWAWRRTTIQVGGDAV

SEQ ID NO: 334722 - protein, 19 aa, Mycobacterium
VLVVTNFFGINAIPIALNE

SEQ ID NO: 334723 - protein, 23 aa, Mycobacterium
VLVWLRRRVSVFRPEKFMELGWV

SEQ ID NO: 334724 - protein, 26 aa, Mycobacterium
VLVWQHICGIQINWVVLAMSVIVLLA

SEQ ID NO: 334725 - protein, 26 aa, Mycobacterium
VLVWQHIFGIQLYWIVLALAVIVLLG

SEQ ID NO: 334726 - protein, 27 aa, Mycobacterium
VLVWQHLIGLPLHWLVLPLAFIILVAV

SEQ ID NO: 334727 - protein, 20 aa, Mycobacterium
VLVWQHLLGIQINWVVLAMS

SEQ ID NO: 334728 - protein, 26 aa, Mycobacterium
VLVWQHLLGLDLNWIAPVFGLIILLA

SEQ ID NO: 334729 - protein, 25 aa, Mycobacterium
VLVWQYLLGMQLHWTVLSTSVIVLL

SEQ ID NO: 334730 - protein, 22 aa, Mycobacterium
VLVWVFDCWQLFVRPPRSTRGA

SEQ ID NO: 334731 - protein, 26 aa, Mycobacterium
VLVYGFICGTALLVVIFRLRNIDELA

SEQ ID NO: 334732 - protein, 19 aa, Mycobacterium
VLVYLQFRGDFTPKVKLTM

SEQ ID NO: 334733 - protein, 22 aa, Mycobacterium
VLVYRFGGTRVLDGLDLYSIGR

SEQ ID NO: 334734 - protein, 19 aa, Mycobacterium
VLVYTELWVGFTAVTALLI

SEQ ID NO: 334735 - protein, 24 aa, Mycobacterium
VLVYTELWVGFTVVSALLILGLAQ

SEQ ID NO: 334736 - protein, 26 aa, Mycobacterium
VLWAALTARWWLSGLLVGAAAGIKLT

SEQ ID NO: 334737 - protein, 18 aa, Mycobacterium
VLWAPMGGWQLGRHLMQW

SEQ ID NO: 334738 - protein, 19 aa, Mycobacterium
VLWGAGWVAVLAVLTRLRQ

SEQ ID NO: 334739 - protein, 17 aa, Mycobacterium
VLWIAAVAALAWTAMIA

SEQ ID NO: 334740 - protein, 27 aa, Mycobacterium
VLWIASRLGWVVIRSFDGLGPPKEVTL

SEQ ID NO: 334741 - protein, 18 aa, Mycobacterium
VLWMLPLLIAPPMYSKDV

SEQ ID NO: 334742 - protein, 37 aa, Mycobacterium
VLWQLSGPLLLWGFEIPRAMVFIAFVFSITVTVLAFW

SEQ ID NO: 334743 - protein, 26 aa, Mycobacterium
VLWVGWRLLGRVPYRIDIDVYRMGGR

SEQ ID NO: 334744 - protein, 17 aa, Mycobacterium
VLYECLTGQLPFSGETL

SEQ ID NO: 334745 - protein, 17 aa, Mycobacterium
VLYECLTGTPPYRADSA

SEQ ID NO: 334746 - protein, 19 aa, Mycobacterium
VLYLAYLRRQTRIEEQLRR

SEQ ID NO: 334747 - protein, 25 aa, Mycobacterium
VLYLLTAYPLRWPPQVNALRYEVIV

SEQ ID NO: 334748 - protein, 22 aa, Mycobacterium
VLYLVGAIGWNVGDLAAGGDTV

SEQ ID NO: 334749 - protein, 17 aa, Mycobacterium
VLYLWGLGSKGWANSYY

SEQ ID NO: 334750 - protein, 19 aa, Mycobacterium
VLYNIAFPGAYLCMSAASL

SEQ ID NO: 334751 - protein, 18 aa, Mycobacterium
VLYPCALAMMVLSKSFSV

SEQ ID NO: 334752 - protein, 19 aa, Mycobacterium
VLYPCALGMMVLSKSFSVL

SEQ ID NO: 334753 - protein, 25 aa, Mycobacterium
VLYTDFRPAGVLDWEMTALGPRELD

SEQ ID NO: 334754 - protein, 17 aa, Mycobacterium
VLYYVMLTFIARPYLIP

SEQ ID NO: 334755 - protein, 24 aa, Mycobacterium
VMAALCAATAIIAVVVPFAAGLSV

SEQ ID NO: 334756 - protein, 23 aa, Mycobacterium
VMAATAWFLTDWMIARRAETYRD

SEQ ID NO: 334757 - protein, 35 aa, Mycobacterium
VMAAVCLYCAYELWRFDSIRSWLLVAVMNIAMIAV

SEQ ID NO: 334758 - protein, 24 aa, Mycobacterium
VMAGGGWTAIPMWVLGILTFLVPA

SEQ ID NO: 334759 - protein, 25 aa, Mycobacterium
VMAGMLPTVLAWVFAPRYAAGAAVL

SEQ ID NO: 334760 - protein, 24 aa, Mycobacterium
VMALYLWHMMPVIVVTVIAYPAGL

SEQ ID NO: 334761 - protein, 24 aa, Mycobacterium
VMAQRPAVCRALIGELGRAARMPA

SEQ ID NO: 334762 - protein, 17 aa, Mycobacterium
VMARDILSYYGIEDAAN

SEQ ID NO: 334763 - protein, 17 aa, Mycobacterium
VMARRRWRAAPPARVAA

SEQ ID NO: 334764 - protein, 26 aa, Mycobacterium
VMAVFYLRLPATFGLGTYGVSADFVA

SEQ ID NO: 334765 - protein, 20 aa, Mycobacterium
VMAVLTAFLFLVFSDTRTGA

SEQ ID NO: 334766 - protein, 27 aa, Mycobacterium
VMCLLLRAVVAPLYLLGTVLLTYIASL

SEQ ID NO: 334767 - protein, 25 aa, Mycobacterium
VMDTARLHDEWKFQPAFTAEESVED

SEQ ID NO: 334768 - protein, 24 aa, Mycobacterium
VMEMIALPLSFLILIWVFGGLLAA

SEQ ID NO: 334769 - protein, 17 aa, Mycobacterium
VMFAFPVLLLALAIVAI

SEQ ID NO: 334770 - protein, 17 aa, Mycobacterium
VMFAFPVLLLALAVVAI

SEQ ID NO: 334771 - protein, 26 aa, Mycobacterium
VMFAQWRRLRSPSRPPLGPGGVILGY

SEQ ID NO: 334772 - protein, 22 aa, Mycobacterium
VMFLLCGYLIFQAGWGAIDLSL

SEQ ID NO: 334773 - protein, 18 aa, Mycobacterium
VMFPEIKTIGGYRQDPLK

SEQ ID NO: 334774 - protein, 19 aa, Mycobacterium
VMFPFEMRAVVVLSGERLV

SEQ ID NO: 334775 - protein, 18 aa, Mycobacterium
VMFVLFWASAFVLLISPL

SEQ ID NO: 334776 - protein, 23 aa, Mycobacterium
VMGVGETFLLFAFADTALGLDHN

SEQ ID NO: 334777 - protein, 27 aa, Mycobacterium
VMGVSVIKRLVVPRFAAAIMIGVALTG

SEQ ID NO: 334778 - protein, 20 aa, Mycobacterium
VMHDLRLVAATVIALVAGVL

SEQ ID NO: 334779 - protein, 24 aa, Mycobacterium
VMIFACLFFAVYFMQVTYSLMTFW

SEQ ID NO: 334780 - protein, 28 aa, Mycobacterium
VMIIIVFGQIRFDRTYAYSAEFSNASGL

SEQ ID NO: 334781 - protein, 17 aa, Mycobacterium
VMIKLGVLVVFAIVAFT

SEQ ID NO: 334782 - protein, 24 aa, Mycobacterium
VMILLTVFLFFIFGQYRTGSTNGY

SEQ ID NO: 334783 - protein, 18 aa, Mycobacterium
VMIMLAMVFIELAAARGV

SEQ ID NO: 334784 - protein, 19 aa, Mycobacterium
VMIVAASFAIARIVEQNLV

SEQ ID NO: 334785 - protein, 18 aa, Mycobacterium
VMIVCGFVLGAAGQVVKL

SEQ ID NO: 334786 - protein, 19 aa, Mycobacterium
VMKRINKARWNAFAQQSPT

SEQ ID NO: 334787 - protein, 22 aa, Mycobacterium
VMLALGGALAFVVIYVTMTVNM

SEQ ID NO: 334788 - protein, 20 aa, Mycobacterium
VMLGTPASGFGRVVSAETRT

SEQ ID NO: 334789 - protein, 25 aa, Mycobacterium
VMLPAHAAAVWLGALLIAGGARLCS

SEQ ID NO: 334790 - protein, 17 aa, Mycobacterium
VMLSGLWVAATGQLVLI

SEQ ID NO: 334791 - protein, 18 aa, Mycobacterium
VMLSMALANAAAMDDAMA

SEQ ID NO: 334792 - protein, 17 aa, Mycobacterium
VMMAGRLLVPVTGAIGV

SEQ ID NO: 334793 - protein, 19 aa, Mycobacterium
VMMSLRLERALGRLPADWQ

SEQ ID NO: 334794 - protein, 19 aa, Mycobacterium
VMNALLLPIVLGLLLALEA

SEQ ID NO: 334795 - protein, 19 aa, Mycobacterium
VMNALLLPIVLGLLLVLEA

SEQ ID NO: 334796 - protein, 18 aa, Mycobacterium
VMPFHAFFGIALMTMNSA

SEQ ID NO: 334797 - protein, 19 aa, Mycobacterium
VMPFHAFFGIALMTTSSAI

SEQ ID NO: 334798 - protein, 17 aa, Mycobacterium
VMPFTSSILANFLSIIG

SEQ ID NO: 334799 - protein, 25 aa, Mycobacterium
VMPYRFRGVAMFFALTWAVGIGAYT

SEQ ID NO: 334800 - protein, 17 aa, Mycobacterium
VMRGHASGWWAQITGGD

SEQ ID NO: 334801 - protein, 22 aa, Mycobacterium
VMRMIGQWRGTVIIDGPASDDA

SEQ ID NO: 334802 - protein, 19 aa, Mycobacterium
VMRQLRAALVLVLACAPCN

SEQ ID NO: 334803 - protein, 26 aa, Mycobacterium
VMSHLLRWGMSMIVVAPVLSWAVFVL

SEQ ID NO: 334804 - protein, 23 aa, Mycobacterium
VMTAGAALVMWMGELVTERGVGN

SEQ ID NO: 334805 - protein, 24 aa, Mycobacterium
VMTLMTGVLFVIFGEYRSGSANTY

SEQ ID NO: 334806 - protein, 24 aa, Mycobacterium
VMTLVVLLGTWVWVGVTNDQYSQL

SEQ ID NO: 334807 - protein, 23 aa, Mycobacterium
VMVAAPWLVRPGEPINVGLWLID

SEQ ID NO: 334808 - protein, 17 aa, Mycobacterium
VMVAVLAVGSVAALGLG

SEQ ID NO: 334809 - protein, 17 aa, Mycobacterium
VMVCFHLGILTAIPMGV

SEQ ID NO: 334810 - protein, 19 aa, Mycobacterium
VMVDLRLKVMQEPRESDIW

SEQ ID NO: 334811 - protein, 28 aa, Mycobacterium
VMVELSCGRGVVAFLAYHKLIGISVFAS

SEQ ID NO: 334812 - protein, 21 aa, Mycobacterium
VMVLDGWRTVIGFASGPEDRW

SEQ ID NO: 334813 - protein, 19 aa, Mycobacterium
VMVLLKLAVLSVFAIIAFT

SEQ ID NO: 334814 - protein, 36 aa, Mycobacterium; identical to SEQ ID NO: 12646

SEQ ID NO: 334815 - protein, 23 aa, Mycobacterium
VMVPHRPAGRGVLIATAVASVVF

SEQ ID NO: 334816 - protein, 18 aa, Mycobacterium
VMVVAMVGMIAFFVTSGS

SEQ ID NO: 334817 - protein, 18 aa, Mycobacterium
VMVVCIAGAFGTLATGSW

SEQ ID NO: 334818 - protein, 19 aa, Mycobacterium
VMWQRRRAGVVGAERRIEE

SEQ ID NO: 334819 - protein, 29 aa, Mycobacterium
VNAFLRKLPRARRPRVIAIDAVPDAVGAT

SEQ ID NO: 334820 - protein, 20 aa, Mycobacterium
VNAGFLRRLAGVGGGRCVLV

SEQ ID NO: 334821 - protein, 24 aa, Mycobacterium
VNAKSLRPGDIIDLAAPEVVPADA

SEQ ID NO: 334822 - protein, 18 aa, Mycobacterium
VNALPGREGPVPIAGTSF

SEQ ID NO: 334823 - protein, 24 aa, Mycobacterium
VNALVPFYAIGVFTGFSMAGYGMT

SEQ ID NO: 334824 - protein, 18 aa, Mycobacterium
VNAPSAWSAPPAAATPSA

SEQ ID NO: 334825 - protein, 25 aa, Mycobacterium
VNDLRNWFLIFAFVAIGLEFSARGL

SEQ ID NO: 334826 - protein, 18 aa, Mycobacterium
VNDPRLSNIAVISAADIV

SEQ ID NO: 334827 - protein, 25 aa, Mycobacterium
VNDWPRIGDLIPVLYPPKNPDRWNI

SEQ ID NO: 334828 - protein, 37 aa, Mycobacterium
VNEWLQSWTIFYWAWWVSWTPFVGMFIARISRGRTIR

SEQ ID NO: 334829 - protein, 24 aa, Mycobacterium
VNFALHSTFRWLLSAAAALWIVAT

SEQ ID NO: 334830 - protein, 19 aa, Mycobacterium
VNFLRARMGPAMASSGLSA

SEQ ID NO: 334831 - protein, 24 aa, Mycobacterium
VNFRDVLVALGMYPGGGALGAEGA

SEQ ID NO: 334832 - protein, 23 aa, Mycobacterium
VNFRDVLVALGMYPGGGELGAEG

SEQ ID NO: 334833 - protein, 24 aa, Mycobacterium
VNFRDVLVALGMYPGGGELGVEGA

SEQ ID NO: 334834 - protein, 23 aa, Mycobacterium
VNFRDVLVALGMYPGGGQLGAEG

SEQ ID NO: 334835 - protein, 23 aa, Mycobacterium
VNFRDVLVVLGLYPGNKPTLGGE

SEQ ID NO: 334836 - protein, 18 aa, Mycobacterium
VNFSQRFGLTLVGIGVAL

SEQ ID NO: 334837 - protein, 23 aa, Mycobacterium
VNGIRVGSAILREGDVVTIGNVD

SEQ ID NO: 334838 - protein, 27 aa, Mycobacterium
VNGITSRLPMVFGFIAIVTLVLLFLLT

SEQ ID NO: 334839 - protein, 27 aa, Mycobacterium
VNGITSRLPVVFGFIAAVTVVLLFLMT

SEQ ID NO: 334840 - protein, 18 aa, Mycobacterium
VNGKSWLVFGPYAGWSPK

SEQ ID NO: 334841 - protein, 23 aa, Mycobacterium
VNGLASFFGQLGFSPALSSALGW

SEQ ID NO: 334842 - protein, 24 aa, Mycobacterium
VNGLFGRLAWLFVGPVVAFPSFGY

SEQ ID NO: 334843 - protein, 26 aa, Mycobacterium
VNGSLRLHPMLDKLLFESQFTKEICN

SEQ ID NO: 334844 - protein, 27 aa, Mycobacterium
VNGYRGCSHACRYCFARPTHEYLELDC

SEQ ID NO: 334845 - protein, 18 aa, Mycobacterium
VNHPLRVGGDRVYLQGHG

SEQ ID NO: 334846 - protein, 18 aa, Mycobacterium
VNHPLRVGGDRVYLQGRG

SEQ ID NO: 334847 - protein, 23 aa, Mycobacterium
VNHPSWIDPLALAAVMPRSFHFV

SEQ ID NO: 334848 - protein, 19 aa, Mycobacterium
VNIGLAYGIHVVVTTPSWL

SEQ ID NO: 334849 - protein, 26 aa, Mycobacterium
VNIGRSLPFLILMAAIIPVTRFLVGT

SEQ ID NO: 334850 - protein, 19 aa, Mycobacterium
VNIGTLFAFVLVSAGVLVL

SEQ ID NO: 334851 - protein, 29 aa, Mycobacterium
VNIPANRKRVVAVSFPRDLAITPIQCEAW

SEQ ID NO: 334852 - protein, 29 aa, Mycobacterium
VNIPANRKRVVAVSFPRDLAITPMQCEAW

SEQ ID NO: 334853 - protein, 18 aa, Mycobacterium
VNIRGILSFTPSTMYTRA

SEQ ID NO: 334854 - protein, 26 aa, Mycobacterium
VNISRFRTLLLKWGLMTVLALLTSAV

SEQ ID NO: 334855 - protein, 35 aa, Mycobacterium
VNKLGLSMGINFRAVRDMFAWIGPVLTALQGNRVC

SEQ ID NO: 334856 - protein, 28 aa, Mycobacterium
VNKLYTDRHIRLWVVYVDDFSGQSPTGW

SEQ ID NO: 334857 - protein, 21 aa, Mycobacterium
VNLAGALAFWRLNKRRSPMRY

SEQ ID NO: 334858 - protein, 25 aa, Mycobacterium
VNLALNAGWSWVFFNRRQLGPAAAL

SEQ ID NO: 334859 - protein, 24 aa, Mycobacterium
VNLIKMMIGPVIFCTIVLGIGSVR

SEQ ID NO: 334860 - protein, 17 aa, Mycobacterium
VNLKGSGQCYFLQGSPA

SEQ ID NO: 334861 - protein, 22 aa, Mycobacterium
VNLLLSPAVFRGFDQVGALSPT

SEQ ID NO: 334862 - protein, 20 aa, Mycobacterium
VNLMIYWRLWAKYKASTELS

SEQ ID NO: 334863 - protein, 24 aa, Mycobacterium
VNLNPKLGWWLMEIPATVVFAIFY

SEQ ID NO: 334864 - protein, 24 aa, Mycobacterium
VNLRLMPFIFLLYLVNYVDRTALG

SEQ ID NO: 334865 - protein, 19 aa, Mycobacterium
VNMGLRITLGLTELMVVGT

SEQ ID NO: 334866 - protein, 25 aa, Mycobacterium
VNPDSLRKAFGWFVLAMSSVILAQE

SEQ ID NO: 334867 - protein, 24 aa, Mycobacterium
VNPEAAGVLRVWGAALTLILIIAA

SEQ ID NO: 334868 - protein, 19 aa, Mycobacterium
VNPKLVYCSVTGYGQTGTL

SEQ ID NO: 334869 - protein, 25 aa, Mycobacterium
VNPLNWPPAFFSWFAAGMLLAEWVH

SEQ ID NO: 334870 - protein, 26 aa, Mycobacterium
VNPYTARHMGLFVVGRLADQHGLVVR

SEQ ID NO: 334871 - protein, 24 aa, Mycobacterium
VNPYTARHMGLFVVSRLAAQHGLV

SEQ ID NO: 334872 - protein, 18 aa, Mycobacterium
VNQRRWSSDLAMTADLLA

SEQ ID NO: 334873 - protein, 17 aa, Mycobacterium
VNQRRWSSDLSMTRRLL

SEQ ID NO: 334874 - protein, 23 aa, Mycobacterium
VNRASGRVGTWFSTTTWGSALWQ

SEQ ID NO: 334875 - protein, 25 aa, Mycobacterium
VNRIACLQHAYPLGTDDRMLVKTPI

SEQ ID NO: 334876 - protein, 18 aa, Mycobacterium
VNRLERRPTLPISEEIGS

SEQ ID NO: 334877 - protein, 22 aa, Mycobacterium
VNRWLAPALTGWTLGRALCGIA

SEQ ID NO: 334878 - protein, 23 aa, Mycobacterium
VNSADNWLHFALAVLMIGLGVAL

SEQ ID NO: 334879 - protein, 17 aa, Mycobacterium
VNSFASLAQQGFFKDTK

SEQ ID NO: 334880 - protein, 24 aa, Mycobacterium
VNSLFAWSWADPIAALAIAVIAVR

SEQ ID NO: 334881 - protein, 17 aa, Mycobacterium
VNTEFRSTALAAALNSH

SEQ ID NO: 334882 - protein, 19 aa, Mycobacterium
VNVEAVGLVRIGSADEAVQ

SEQ ID NO: 334883 - protein, 19 aa, Mycobacterium
VNVEAVGLVRIGSNDEAVQ

SEQ ID NO: 334884 - protein, 18 aa, Mycobacterium
VNVGTLFAFVLVSAGVIV

SEQ ID NO: 334885 - protein, 25 aa, Mycobacterium
VNVVMKRPIAFAAPILVVMVLLIIP

SEQ ID NO: 334886 - protein, 17 aa, Mycobacterium
VNWAVSARRGRLHVTQR

SEQ ID NO: 334887 - protein, 19 aa, Mycobacterium
VNWMLALLMLMILVGAIAG

SEQ ID NO: 334888 - protein, 18 aa, Mycobacterium
VNYLLQWLAGGPNEPLWL

SEQ ID NO: 334889 - protein, 18 aa, Mycobacterium
VNYVKWFMGQFTSVDPYH

SEQ ID NO: 334890 - protein, 18 aa, Mycobacterium
VPAAIMLWLLLRLPESPR

SEQ ID NO: 334891 - protein, 17 aa, Mycobacterium
VPACILIFAQLNLLWLG

SEQ ID NO: 334892 - protein, 17 aa, Mycobacterium
VPADLTPDLALAYGAVF

SEQ ID NO: 334893 - protein, 20 aa, Mycobacterium
VPAETAGAVSARAFAGGVLP

SEQ ID NO: 334894 - protein, 19 aa, Mycobacterium
VPAGRGHRAAMLWTAIAIW

SEQ ID NO: 334895 - protein, 18 aa, Mycobacterium
VPAGRLWVMGDNRTHSAD

SEQ ID NO: 334896 - protein, 25 aa, Mycobacterium
VPAHLRSGWYRLPARDKAGPLLVVS

SEQ ID NO: 334897 - protein, 24 aa, Mycobacterium
VPAIALIGMCALLLIRGASESAKV

SEQ ID NO: 334898 - protein, 24 aa, Mycobacterium
VPALIRKRFDTVPGTRKDPRIRDD

SEQ ID NO: 334899 - protein, 20 aa, Mycobacterium
VPALQSWRPVTLAGLGVGAL

SEQ ID NO: 334900 - protein, 19 aa, Mycobacterium
VPALSAWWVLIAGAFGLLA

SEQ ID NO: 334901 - protein, 24 aa, Mycobacterium
VPALYRVAAWVVIVAGITFIASTL

SEQ ID NO: 334902 - protein, 17 aa, Mycobacterium
VPAMGLLTHVGRKSGKR

SEQ ID NO: 334903 - protein, 29 aa, Mycobacterium
VPAPPPPRDARPGWVAMAITGLAVVSVLG

SEQ ID NO: 334904 - protein, 19 aa, Mycobacterium
VPAPQLRQGDIVVVEAGQT

SEQ ID NO: 334905 - protein, 22 aa, Mycobacterium
VPARTVPAGAIFTVIPGPAGPF

SEQ ID NO: 334906 - protein, 21 aa, Mycobacterium
VPARVNAVVMFQVMEPLKAIL

SEQ ID NO: 334907 - protein, 18 aa, Mycobacterium
VPARVNAVVMFQVTDPLK

SEQ ID NO: 334908 - protein, 20 aa, Mycobacterium
VPARVNAVVMFQVTDPMKAI

SEQ ID NO: 334909 - protein, 17 aa, Mycobacterium
VPASTTGWRSRPDVSDQ

SEQ ID NO: 334910 - protein, 27 aa, Mycobacterium
VPASVWVMAALRRGRIGVDVIAVLSLI

SEQ ID NO: 334911 - protein, 19 aa, Mycobacterium
VPATLFFLGCFYVFGSLEQ

SEQ ID NO: 334912 - protein, 24 aa, Mycobacterium
VPATLRVALRIVWALLLMPGLPLL

SEQ ID NO: 334913 - protein, 26 aa, Mycobacterium
VPAVLLHHWLQLALITPVMFYVGWPI

SEQ ID NO: 334914 - protein, 20 aa, Mycobacterium
VPAYRVLKRHAAMVVNPSHP

SEQ ID NO: 334915 - protein, 19 aa, Mycobacterium
VPCAVGTFVAVIAALTLGP

SEQ ID NO: 334916 - protein, 17 aa, Mycobacterium
VPCEVRDGVFRVDKIAT

SEQ ID NO: 334917 - protein, 17 aa, Mycobacterium
VPCGVLVATVVAGDKVF

SEQ ID NO: 334918 - protein, 20 aa, Mycobacterium
VPDASQWMMQAEVAVTNFVA

SEQ ID NO: 334919 - protein, 17 aa, Mycobacterium
VPDCLTVERALGYAAQL

SEQ ID NO: 334920 - protein, 30 aa, Mycobacterium
VPDDALLGWVWRIPFLASIFLIGVAVLIRL

SEQ ID NO: 334921 - protein, 17 aa, Mycobacterium
VPDELREASFALGVPKW

SEQ ID NO: 334922 - protein, 26 aa, Mycobacterium
VPDIQRMAGLMPQMVVLMPPMIASMK

SEQ ID NO: 334923 - protein, 22 aa, Mycobacterium
VPDPRIDRSRIKMTMEKVDGQW

SEQ ID NO: 334924 - protein, 23 aa, Mycobacterium
VPDSYRLLNIVFMLVVVFTLVQG

SEQ ID NO: 334925 - protein, 24 aa, Mycobacterium
VPDSYRLLNIVFMLVVVFTLVQGP

SEQ ID NO: 334926 - protein, 22 aa, Mycobacterium
VPDSYRLLNIVFVLVVVFTLVQ

SEQ ID NO: 334927 - protein, 23 aa, Mycobacterium
VPDVLRGLFGTRLLQREYYDDEF

SEQ ID NO: 334928 - protein, 17 aa, Mycobacterium
VPDVSSLSYSDAVSKLK

SEQ ID NO: 334929 - protein, 17 aa, Mycobacterium
VPEDRWQGLAAQAYTSQ

SEQ ID NO: 334930 - protein, 23 aa, Mycobacterium
VPEKSVLCSSWKPGQEKTQEHAS

SEQ ID NO: 334931 - protein, 20 aa, Mycobacterium
VPEMRQWLRNWVGKAVGRSP

SEQ ID NO: 334932 - protein, 26 aa, Mycobacterium
VPEMRRMADLMPRMVAVMPAQIQSMK

SEQ ID NO: 334933 - protein, 18 aa, Mycobacterium
VPERGRGALGARRRDPDR

SEQ ID NO: 334934 - protein, 18 aa, Mycobacterium
VPERPSPTTAPARAAPST

SEQ ID NO: 334935 - protein, 21 aa, Mycobacterium
VPESPRWLFIHGRDEEAERVV

SEQ ID NO: 334936 - protein, 21 aa, Mycobacterium
VPESPRWLFIHGREEEAEHIV

SEQ ID NO: 334937 - protein, 21 aa, Mycobacterium
VPESPRWLFIHGREHEAERIV

SEQ ID NO: 334938 - protein, 21 aa, Mycobacterium
VPESPRWLFIHGREQEAEQIV

SEQ ID NO: 334939 - protein, 17 aa, Mycobacterium
VPESRSQARLVLDGLSV

SEQ ID NO: 334940 - protein, 18 aa, Mycobacterium
VPETLTWAQLHRRMLNVG

SEQ ID NO: 334941 - protein, 20 aa, Mycobacterium
VPFAIWLFLAIEGVPLAAEE

SEQ ID NO: 334942 - protein, 17 aa, Mycobacterium
VPFGLIGGRLYHLSTDW

SEQ ID NO: 334943 - protein, 20 aa, Mycobacterium
VPFLIIAVLFYFTVVVQNKV

SEQ ID NO: 334944 - protein, 17 aa, Mycobacterium
VPFPLGGSIVVVNHPDY

SEQ ID NO: 334945 - protein, 22 aa, Mycobacterium
VPFPNFKQGEGLMLQLPSPTVV

SEQ ID NO: 334946 - protein, 19 aa, Mycobacterium
VPFTPSWAAFVSHSVSEAG

SEQ ID NO: 334947 - protein, 20 aa, Mycobacterium
VPGAGARLVTTMTRHPGGAS

SEQ ID NO: 334948 - protein, 23 aa, Mycobacterium
VPGARPPLPPAPPGARTVPLAPQ

SEQ ID NO: 334949 - protein, 17 aa, Mycobacterium
VPGARRLLGGGLALLAI

SEQ ID NO: 334950 - protein, 18 aa, Mycobacterium
VPGAYWLFHGSKIGKFKD

SEQ ID NO: 334951 - protein, 19 aa, Mycobacterium
VPGCGHAFVVDTGVEAGIR

SEQ ID NO: 334952 - protein, 18 aa, Mycobacterium
VPGDVGFGVPKTALEGGE

SEQ ID NO: 334953 - protein, 19 aa, Mycobacterium
VPGFAWWAAALNSLPMLAA

SEQ ID NO: 334954 - protein, 20 aa, Mycobacterium
VPGFAWWAAALNSLPMLAAL

SEQ ID NO: 334955 - protein, 17 aa, Mycobacterium
VPGGNGFQLPGATAGTP

SEQ ID NO: 334956 - protein, 28 aa, Mycobacterium
VPGIELMDWLLAAGMQWNVGEWLGALGS

SEQ ID NO: 334957 - protein, 21 aa, Mycobacterium
VPGKENFGWIATALLGIIGGY

SEQ ID NO: 334958 - protein, 21 aa, Mycobacterium
VPGLPPPPLIFAEREAPTGTN

SEQ ID NO: 334959 - protein, 18 aa, Mycobacterium
VPGMLLGTYFLVSALIGK

SEQ ID NO: 334960 - protein, 18 aa, Mycobacterium
VPGSAGFGYADPAGESAG

SEQ ID NO: 334961 - protein, 18 aa, Mycobacterium
VPGVPGFGQVIAPQVIAP

SEQ ID NO: 334962 - protein, 26 aa, Mycobacterium
VPGWDFGSEFARIGLLAGLVLVLVWV

SEQ ID NO: 334963 - protein, 17 aa, Mycobacterium
VPHALSLLDSKETEGFL

SEQ ID NO: 334964 - protein, 20 aa, Mycobacterium
VPHKFLLRPAQGCIGMAVAV

SEQ ID NO: 334965 - protein, 20 aa, Mycobacterium
VPIAAGFMALVFIASMVAGI

SEQ ID NO: 334966 - protein, 23 aa, Mycobacterium
VPICAFALRATRTIANIPADQPR

SEQ ID NO: 334967 - protein, 17 aa, Mycobacterium
VPIEEVLFFLVIPTCAL

SEQ ID NO: 334968 - protein, 20 aa, Mycobacterium
VPIGRVERLDITPSGVNAIV

SEQ ID NO: 334969 - protein, 19 aa, Mycobacterium
VPILLPLLVLGPRLVPESR

SEQ ID NO: 334970 - protein, 19 aa, Mycobacterium
VPILVVAVVWLAFELALFR

SEQ ID NO: 334971 - protein, 27 aa, Mycobacterium
VPIMKPAILVALLFRTLDAFRIFDNIY

SEQ ID NO: 334972 - protein, 25 aa, Mycobacterium
VPIMLEVLERCFAHRYQSWLPTLKE

SEQ ID NO: 334973 - protein, 19 aa, Mycobacterium
VPIQIPLPQIFGPGGGGGF

SEQ ID NO: 334974 - protein, 21 aa, Mycobacterium
VPKLRRWLASAVRPKLEEVWE

SEQ ID NO: 334975 - protein, 17 aa, Mycobacterium
VPLAGWAADRFGTKRMF

SEQ ID NO: 334976 - protein, 17 aa, Mycobacterium
VPLAHVSDSEFLIADVF

SEQ ID NO: 334977 - protein, 17 aa, Mycobacterium
VPLAYAWSKAQFGSIEP

SEQ ID NO: 334978 - protein, 17 aa, Mycobacterium
VPLAYAWSKSEFGSIEP

SEQ ID NO: 334979 - protein, 26 aa, Mycobacterium
VPLCALCAALVLNLWVGYFPTVQEAW

SEQ ID NO: 334980 - protein, 23 aa, Mycobacterium
VPLEATPSFFRWLAEFEPMHQVF

SEQ ID NO: 334981 - protein, 21 aa, Mycobacterium
VPLGGFCDIAGMTSVEELTPE

SEQ ID NO: 334982 - protein, 18 aa, Mycobacterium
VPLGRLADRLGPGRLYIG

SEQ ID NO: 334983 - protein, 17 aa, Mycobacterium
VPLHLADSALIDLIRVG

SEQ ID NO: 334984 - protein, 23 aa, Mycobacterium
VPLIGLVAHRSRRLLAVATEAAQ

SEQ ID NO: 334985 - protein, 18 aa, Mycobacterium
VPLLIVWALIRRRQSRRV

SEQ ID NO: 334986 - protein, 20 aa, Mycobacterium
VPLLLAMVLGGLRIHGGMAN

SEQ ID NO: 334987 - protein, 17 aa, Mycobacterium
VPLPTALQMRDWARDLG

SEQ ID NO: 334988 - protein, 17 aa, Mycobacterium
VPLRPLVGWVTRHSKAA

SEQ ID NO: 334989 - protein, 20 aa, Mycobacterium
VPLRVGLVAATLALVLCGLL

SEQ ID NO: 334990 - protein, 28 aa, Mycobacterium
VPLSLLATRAIARRSQRLFLAQWASIGR

SEQ ID NO: 334991 - protein, 23 aa, Mycobacterium
VPLSLLVTRAITRRSQRLFVAHW

SEQ ID NO: 334992 - protein, 21 aa, Mycobacterium
VPLTLIAMVMIQFSLPSHERT

SEQ ID NO: 334993 - protein, 17 aa, Mycobacterium
VPLVMVLVIAIASFAVV

SEQ ID NO: 334994 - protein, 22 aa, Mycobacterium
VPLWCLSSLAGYLATRTLVVVA

SEQ ID NO: 334995 - protein, 20 aa, Mycobacterium
VPLWLTALILLIAMTATNLF

SEQ ID NO: 334996 - protein, 20 aa, Mycobacterium
VPLYFAFGVVAALLGELTVA

SEQ ID NO: 334997 - protein, 17 aa, Mycobacterium
VPMALVLARGDIPGQKV

SEQ ID NO: 334998 - protein, 18 aa, Mycobacterium
VPMCWSLRSIFDALDGVD

SEQ ID NO: 334999 - protein, 23 aa, Mycobacterium
VPMELKLGITAGIGLFILFIGLV

SEQ ID NO: 335000 - protein, 21 aa, Mycobacterium
VPMLHRFGELVAPLTFIGAAY

SEQ ID NO: 335001 - protein, 22 aa, Mycobacterium
VPMLHRFGELVAPLTFVGAAYV

SEQ ID NO: 335002 - protein, 23 aa, Mycobacterium
VPNIPGAPWWGAVLIAVSTTALG

SEQ ID NO: 335003 - protein, 24 aa, Mycobacterium
VPNIPGVPWWAAVLIAVTATAVGY

SEQ ID NO: 335004 - protein, 23 aa, Mycobacterium
VPNLELYLIFPLNNEESTIALVR

SEQ ID NO: 335005 - protein, 20 aa, Mycobacterium
VPNQVVLAVFACTFAYSTGG

SEQ ID NO: 335006 - protein, 21 aa, Mycobacterium
VPPADGLAALLLGPTAAAGAG

SEQ ID NO: 335007 - protein, 28 aa, Mycobacterium
VPPAHRASIEFAPPLPAEYHQLAEHWPQ

SEQ ID NO: 335008 - protein, 19 aa, Mycobacterium
VPPAPAVAAWLVRRVPVVP

SEQ ID NO: 335009 - protein, 24 aa, Mycobacterium
VPPARYTKMTAMPQLVAFFNGVGG

SEQ ID NO: 335010 - protein, 23 aa, Mycobacterium
VPPATALFIHFFDTAFGVGSKSA

SEQ ID NO: 335011 - protein, 17 aa, Mycobacterium
VPPDHVIDTDPNANTSV

SEQ ID NO: 335012 - protein, 27 aa, Mycobacterium
VPPDSVWWWVCVSLLALVVLVMAANRL

SEQ ID NO: 335013 - protein, 20 aa, Mycobacterium
VPPEVPVRVLPGPGDQAPPA

SEQ ID NO: 335014 - protein, 17 aa, Mycobacterium
VPPEVRTVFVIAAIAAF

SEQ ID NO: 335015 - protein, 17 aa, Mycobacterium
VPPFGNLWIQILKSSSL

SEQ ID NO: 335016 - protein, 20 aa, Mycobacterium
VPPGETFAPGVQRAQLKVPA

SEQ ID NO: 335017 - protein, 18 aa, Mycobacterium
VPPHSVWAFDEAVDHIEQ

SEQ ID NO: 335018 - protein, 18 aa, Mycobacterium
VPPIEQWSGSTFSNLPIG

SEQ ID NO: 335019 - protein, 19 aa, Mycobacterium
VPPIPGFLVIGGFVCAAVL

SEQ ID NO: 335020 - protein, 20 aa, Mycobacterium
VPPLDQWSGSTFANLPIGQG

SEQ ID NO: 335021 - protein, 26 aa, Mycobacterium
VPPLKFAQLVGFVFAAVGAVGFAFGI

SEQ ID NO: 335022 - protein, 19 aa, Mycobacterium
VPPLMWNLTAPDAQAVLTA

SEQ ID NO: 335023 - protein, 19 aa, Mycobacterium
VPPLPAFKPSANLGANCQY

SEQ ID NO: 335024 - protein, 23 aa, Mycobacterium
VPPLQFAQLLGFTFAAVGTVGFA

SEQ ID NO: 335025 - protein, 24 aa, Mycobacterium
VPPLRFAQLVGLVFAAAGVVGFAL

SEQ ID NO: 335026 - protein, 25 aa, Mycobacterium
VPPPKPGTVYQMWLLGDQGATSAGT

SEQ ID NO: 335027 - protein, 23 aa, Mycobacterium
VPPRRLSHYTGFQRWAHQLWLDI

SEQ ID NO: 335028 - protein, 21 aa, Mycobacterium
VPPRTSMRHQFFTVARRQVRL

SEQ ID NO: 335029 - protein, 17 aa, Mycobacterium
VPPSYGYQPAFPGATPR

SEQ ID NO: 335030 - protein, 22 aa, Mycobacterium
VPQDCWLDWDMNVGRHCFSDYA

SEQ ID NO: 335031 - protein, 24 aa, Mycobacterium
VPQIRRLDVTLARLGPALDGLRVA

SEQ ID NO: 335032 - protein, 18 aa, Mycobacterium
VPQLAALSRDAAGVDISL

SEQ ID NO: 335033 - protein, 26 aa, Mycobacterium
VPQLDAGPFLSYGIQWIAFGILAPIG

SEQ ID NO: 335034 - protein, 20 aa, Mycobacterium
VPQLSVTVAYLLAMVSVLAL

SEQ ID NO: 335035 - protein, 19 aa, Mycobacterium
VPQVPQWPGAGSGSGSGSG

SEQ ID NO: 335036 - protein, 21 aa, Mycobacterium
VPQYPRLGFRELVRIHDQRIA

SEQ ID NO: 335037 - protein, 22 aa, Mycobacterium
VPRARYAFDIATVGWTLVFAAR

SEQ ID NO: 335038 - protein, 18 aa, Mycobacterium
VPRGLRLIATLPVPVAVA

SEQ ID NO: 335039 - protein, 26 aa, Mycobacterium
VPRIGRDFTAVPLLWLLAIDITLILL

SEQ ID NO: 335040 - protein, 20 aa, Mycobacterium
VPRLKGARKLWLLLAAPSGM

SEQ ID NO: 335041 - protein, 24 aa, Mycobacterium
VPRPPRIAKPGPRIAGPESATSLM

SEQ ID NO: 335042 - protein, 19 aa, Mycobacterium
VPRPWQLGAEMLRVTRPGG

SEQ ID NO: 335043 - protein, 19 aa, Mycobacterium
VPRRIARFADRFAELAPQA

SEQ ID NO: 335044 - protein, 18 aa, Mycobacterium
VPSAAYLHDMMRAPGYAQ

SEQ ID NO: 335045 - protein, 17 aa, Mycobacterium
VPSAERERIVAFFTAVA

SEQ ID NO: 335046 - protein, 26 aa, Mycobacterium
VPSAEVGANCQYRPSGKASKTIEKQI

SEQ ID NO: 335047 - protein, 24 aa, Mycobacterium
VPSARTSFIGAYRKLWSEVRSEWE

SEQ ID NO: 335048 - protein, 17 aa, Mycobacterium
VPSCSINPVLSCGSVMV

SEQ ID NO: 335049 - protein, 18 aa, Mycobacterium
VPSGLSMAPWDLHSGEPH

SEQ ID NO: 335050 - protein, 17 aa, Mycobacterium
VPSKQYGGSWYRTPFLV

SEQ ID NO: 335051 - protein, 20 aa, Mycobacterium
VPSLQTWRPVTVAGLAVGLL

SEQ ID NO: 335052 - protein, 18 aa, Mycobacterium
VPSNVFAVSALQLVDHGP

SEQ ID NO: 335053 - protein, 18 aa, Mycobacterium
VPSNVFAVSSIQLVEHGP

SEQ ID NO: 335054 - protein, 17 aa, Mycobacterium
VPSNVFAVSSVQLVGSP

SEQ ID NO: 335055 - protein, 33 aa, Mycobacterium
VPSQPGLTLTGFVGRVGDPVGIVAADGSVHRAE

SEQ ID NO: 335056 - protein, 17 aa, Mycobacterium
VPSRAVVMVAAEGEDAN

SEQ ID NO: 335057 - protein, 17 aa, Mycobacterium
VPSRRLLPALAVVAVAG

SEQ ID NO: 335058 - protein, 26 aa, Mycobacterium
VPTAAACLLLAFAMVYAGFETNFANF

SEQ ID NO: 335059 - protein, 17 aa, Mycobacterium
VPTACWLLIGMLLLGNH

SEQ ID NO: 335060 - protein, 18 aa, Mycobacterium
VPTALNMIGRAIGSYGDF

SEQ ID NO: 335061 - protein, 28 aa, Mycobacterium
VPTARAAAPFQLLFSLIFTPVIRLTNGT

SEQ ID NO: 335062 - protein, 20 aa, Mycobacterium
VPTARLITRGPVRPRMAYPA

SEQ ID NO: 335063 - protein, 23 aa, Mycobacterium
VPTASSARPDLIFAEPPEAAPEP

SEQ ID NO: 335064 - protein, 23 aa, Mycobacterium
VPTAVCLIGDLLIATGLGIAMLV

SEQ ID NO: 335065 - protein, 20 aa, Mycobacterium
VPTFGDWGFALARRGGGAPT

SEQ ID NO: 335066 - protein, 19 aa, Mycobacterium
VPTFGDWGFVLARRGSSAP

SEQ ID NO: 335067 - protein, 27 aa, Mycobacterium
VPTGIKFFNWIGTMWKGQITFETPMLF

SEQ ID NO: 335068 - protein, 24 aa, Mycobacterium
VPTGLKFFNWIGTMWRGQLTFESP

SEQ ID NO: 335069 - protein, 24 aa, Mycobacterium
VPTGLKFFNWIGTMWRGQLTFETP

SEQ ID NO: 335070 - protein, 31 aa, Mycobacterium
VPTGLMIKLSMWWPDSAWIVMGIYTMLALIA

SEQ ID NO: 335071 - protein, 22 aa, Mycobacterium
VPTKRLRLGDIIEVHADEVVPA

SEQ ID NO: 335072 - protein, 29 aa, Mycobacterium
VPTPPRATLPWPYTWDRVLGQSVSGAVGV

SEQ ID NO: 335073 - protein, 20 aa, Mycobacterium
VPTPRRRSIVAVVWSGFPSG

SEQ ID NO: 335074 - protein, 19 aa, Mycobacterium
VPVAALVQVYTYRKLTGGQ

SEQ ID NO: 335075 - protein, 33 aa, Mycobacterium
VPVAGEIHFGLGLALLAWFGFYLYKLSHGEVEE

SEQ ID NO: 335076 - protein, 26 aa, Mycobacterium
VPVALRLFVFAAVVMLLGIVGAIASN

SEQ ID NO: 335077 - protein, 28 aa, Mycobacterium
VPVARFGQLAVWIFFGLTLVLAGLTQLA

SEQ ID NO: 335078 - protein, 19 aa, Mycobacterium
VPVASWLGQSLGWRAAFGL

SEQ ID NO: 335079 - protein, 19 aa, Mycobacterium
VPVATWLGNTVGWRSAFAV

SEQ ID NO: 335080 - protein, 20 aa, Mycobacterium
VPVAVWLLDGFVRRIPIEID

SEQ ID NO: 335081 - protein, 24 aa, Mycobacterium
VPVDCAAPHAMEVTGAVNLAEKFP

SEQ ID NO: 335082 - protein, 23 aa, Mycobacterium
VPVDCTAPHAMEVTGTVNLAERF

SEQ ID NO: 335083 - protein, 23 aa, Mycobacterium
VPVEGRVALLRKVLDSASTKVHP

SEQ ID NO: 335084 - protein, 19 aa, Mycobacterium
VPVEQVRVGDLVRVRPGEK

SEQ ID NO: 335085 - protein, 25 aa, Mycobacterium
VPVGELRVDFGLQLDQLSMCFALLI

SEQ ID NO: 335086 - protein, 18 aa, Mycobacterium
VPVLHGLTPTALNATVEL

SEQ ID NO: 335087 - protein, 20 aa, Mycobacterium
VPVLLALLFSPVSWPERLLL

SEQ ID NO: 335088 - protein, 24 aa, Mycobacterium
VPVLPREGAVALGMTDWECARRVT

SEQ ID NO: 335089 - protein, 19 aa, Mycobacterium
VPVLSALPGQFLLKDLVLL

SEQ ID NO: 335090 - protein, 17 aa, Mycobacterium
VPVMRFGLVVFGAGSVL

SEQ ID NO: 335091 - protein, 24 aa, Mycobacterium
VPVPEIPTLLSLGVIIVTLLITTV

SEQ ID NO: 335092 - protein, 17 aa, Mycobacterium
VPVRRQATPRGRGPAPS

SEQ ID NO: 335093 - protein, 25 aa, Mycobacterium
VPVSWLRFPIGTLKTLGTVGLIVGL

SEQ ID NO: 335094 - protein, 18 aa, Mycobacterium
VPVTASFVIAWVIIGPAL

SEQ ID NO: 335095 - protein, 17 aa, Mycobacterium
VPVTKHLAAGGQQDPNS

SEQ ID NO: 335096 - protein, 19 aa, Mycobacterium
VPVVIASFFIQRKLVQGIS

SEQ ID NO: 335097 - protein, 20 aa, Mycobacterium
VPWAASIGGGLAFTTYCYIR

SEQ ID NO: 335098 - protein, 19 aa, Mycobacterium
VPWINGVLMVAVLTLVFAF

SEQ ID NO: 335099 - protein, 19 aa, Mycobacterium
VPWPGVWNGSLWTLTFEMG

SEQ ID NO: 335100 - protein, 18 aa, Mycobacterium
VPWWFLVAQLPFAGIVFA

SEQ ID NO: 335101 - protein, 19 aa, Mycobacterium
VPWWFLVAQLPFAGMVFAL

SEQ ID NO: 335102 - protein, 19 aa, Mycobacterium
VPWWWWPLGFAAAALIAFE

SEQ ID NO: 335103 - protein, 19 aa, Mycobacterium
VPYAYAMVGAAWALTFTFA

SEQ ID NO: 335104 - protein, 21 aa, Mycobacterium
VPYLLGYESLWAGLACGGVGL

SEQ ID NO: 335105 - protein, 19 aa, Mycobacterium
VPYPGFGTLAGFLASTSVI

SEQ ID NO: 335106 - protein, 24 aa, Mycobacterium
VPYRAEILVGLVVSVLAATADLRG

SEQ ID NO: 335107 - protein, 24 aa, Mycobacterium
VPYSAMFTDVFGLREGDDVRMAGV

SEQ ID NO: 335108 - protein, 19 aa, Mycobacterium
VPYVGPWRLSGTRFAPTAT

SEQ ID NO: 335109 - protein, 17 aa, Mycobacterium
VPYVLPFLAEGKFSGVH

SEQ ID NO: 335110 - protein, 18 aa, Mycobacterium
VPYVLPFLAESKFSGVTL

SEQ ID NO: 335111 - protein, 30 aa, Mycobacterium
VQAAALRDALAWHKVENVMLVSGFLAAAAL

SEQ ID NO: 335112 - protein, 26 aa, Mycobacterium
VQAASLRPGQPITVAGIPVGNVTSMK

SEQ ID NO: 335113 - protein, 18 aa, Mycobacterium
VQAAWVWWGVCAPEHVRF

SEQ ID NO: 335114 - protein, 17 aa, Mycobacterium
VQAEVFGASAFPQMMLR

SEQ ID NO: 335115 - protein, 19 aa, Mycobacterium
VQAGCRFTTQIGAMRVAEE

SEQ ID NO: 335116 - protein, 18 aa, Mycobacterium
VQAGCRFTTQLGSMRIAE

SEQ ID NO: 335117 - protein, 21 aa, Mycobacterium
VQALDRTAGWYADAETGNAAL

SEQ ID NO: 335118 - protein, 18 aa, Mycobacterium
VQALGWQWIFFINVPIGL

SEQ ID NO: 335119 - protein, 17 aa, Mycobacterium
VQANFRAGQANSILVIT

SEQ ID NO: 335120 - protein, 24 aa, Mycobacterium
VQASSWRWVFLVNLPLGIIAVVVA

SEQ ID NO: 335121 - protein, 23 aa, Mycobacterium
VQASWPWAVAVFALVVFVGPLGE

SEQ ID NO: 335122 - protein, 24 aa, Mycobacterium
VQAYPRSASVVIWYAPEDCDTAAV

SEQ ID NO: 335123 - protein, 24 aa, Mycobacterium
VQAYPRSGSVVIWYLPDDCDTAAA

SEQ ID NO: 335124 - protein, 24 aa, Mycobacterium
VQAYPRTASVVIWYGAEGCDTAAV

SEQ ID NO: 335125 - protein, 24 aa, Mycobacterium
VQAYPRTASVVIWYSHQDCETADV

SEQ ID NO: 335126 - protein, 24 aa, Mycobacterium
VQAYPRTASVVIWYSPQHCDTAEV

SEQ ID NO: 335127 - protein, 24 aa, Mycobacterium
VQAYPRTASVVIWYSPQQCDTAAV

SEQ ID NO: 335128 - protein, 26 aa, Mycobacterium
VQCLEALRCAARCVSMCGMREHGAEP

SEQ ID NO: 335129 - protein, 22 aa, Mycobacterium
VQDALFWMSFVCAIAVAALVIA

SEQ ID NO: 335130 - protein, 17 aa, Mycobacterium
VQEKLGLGETELPDERK

SEQ ID NO: 335131 - protein, 20 aa, Mycobacterium
VQFICGGSFETAAGPRAPDY

SEQ ID NO: 335132 - protein, 19 aa, Mycobacterium
VQFICGGTFDAAATPDNYK

SEQ ID NO: 335133 - protein, 23 aa, Mycobacterium
VQFLDWRLVFASIAGLAALAALV

SEQ ID NO: 335134 - protein, 18 aa, Mycobacterium
VQGAAHFLFVPQLLLFML

SEQ ID NO: 335135 - protein, 19 aa, Mycobacterium
VQGAIRWWQPLTWLLYPAV

SEQ ID NO: 335136 - protein, 18 aa, Mycobacterium
VQGARIVEVVAGGAAEKA

SEQ ID NO: 335137 - protein, 17 aa, Mycobacterium
VQGASHFLFVPQLLLFM

SEQ ID NO: 335138 - protein, 17 aa, Mycobacterium
VQGFAGAAGIVIARAII

SEQ ID NO: 335139 - protein, 23 aa, Mycobacterium
VQGLKMLLGTVVLVVVGVGLALI

SEQ ID NO: 335140 - protein, 17 aa, Mycobacterium
VQHAGVVPKGMAFIIAG

SEQ ID NO: 335141 - protein, 25 aa, Mycobacterium
VQHKRRWILGIGMVGSAPREGAATA

SEQ ID NO: 335142 - protein, 18 aa, Mycobacterium
VQIIKAVLLIAGAGFMTV

SEQ ID NO: 335143 - protein, 18 aa, Mycobacterium
VQIIKAVLLIAGAGLMTV

SEQ ID NO: 335144 - protein, 30 aa, Mycobacterium
VQIIPARLVLDFAPELGLLATMTTVVAAAL

SEQ ID NO: 335145 - protein, 25 aa, Mycobacterium
VQKMPIAFFTRTRTGALVSRLGNDV

SEQ ID NO: 335146 - protein, 17 aa, Mycobacterium
VQLARHWGVEIFVTASR

SEQ ID NO: 335147 - protein, 18 aa, Mycobacterium
VQLDGAWLSEEQHTAASQ

SEQ ID NO: 335148 - protein, 19 aa, Mycobacterium
VQLGNAVPMPAFKAPANLG

SEQ ID NO: 335149 - protein, 25 aa, Mycobacterium
VQLIRAKPAWPFAVGTLALCVLSLA

SEQ ID NO: 335150 - protein, 21 aa, Mycobacterium
VQLLLESFAFLLIGLQLPKVV

SEQ ID NO: 335151 - protein, 20 aa, Mycobacterium
VQLTVLWPLADRPRLAAGAP

SEQ ID NO: 335152 - protein, 24 aa, Mycobacterium
VQNPEPRATTLVLQITVKKDGDAW

SEQ ID NO: 335153 - protein, 31 aa, Mycobacterium
VQPFGEYLPMPWLFKHLSGYAGRAGSMVPRA

SEQ ID NO: 335154 - protein, 26 aa, Mycobacterium
VQPFGEYLPMPWLFRHLSGYASRAGS

SEQ ID NO: 335155 - protein, 25 aa, Mycobacterium
VQPFGEYLPMPWLFSHLSAYADRAG

SEQ ID NO: 335156 - protein, 22 aa, Mycobacterium
VQPGTKFGLGWQLGDAGNKATF

SEQ ID NO: 335157 - protein, 24 aa, Mycobacterium
VQPKGVELPSWVTGNDDFYRIDTA

SEQ ID NO: 335158 - protein, 24 aa, Mycobacterium
VQPRAGEFPAHIGTGPASEFYRFS

SEQ ID NO: 335159 - protein, 18 aa, Mycobacterium
VQPTLPILLANLVSVGQV

SEQ ID NO: 335160 - protein, 19 aa, Mycobacterium
VQPVVLWILLPIVAFGSAY

SEQ ID NO: 335161 - protein, 25 aa, Mycobacterium
VQQKLPRLIPGFFRSPRWVPVLGWL

SEQ ID NO: 335162 - protein, 17 aa, Mycobacterium
VQREVCTGATAVPGRDG

SEQ ID NO: 335163 - protein, 19 aa, Mycobacterium
VQRRLRREILRAYDEHEIY

SEQ ID NO: 335164 - protein, 21 aa, Mycobacterium
VQRRPRLTMFDDFGGRIPSDK

SEQ ID NO: 335165 - protein, 18 aa, Mycobacterium
VQSITRPLGIPIQHSSIP

SEQ ID NO: 335166 - protein, 29 aa, Mycobacterium
VQSRFPRAWKLGAGWVGAPGRALDASGDV

SEQ ID NO: 335167 - protein, 19 aa, Mycobacterium
VQSSLSFFRAVYDAFAGYR

SEQ ID NO: 335168 - protein, 25 aa, Mycobacterium
VQSSRWGRYPVRAGVRVCGRGGLVT

SEQ ID NO: 335169 - protein, 23 aa, Mycobacterium
VQSWRLLGYRVDRALVGVSVLMA

SEQ ID NO: 335170 - protein, 22 aa, Mycobacterium
VQTEGFSGPALIVGSPTTSSVP

SEQ ID NO: 335171 - protein, 24 aa, Mycobacterium
VQTIRACHAYRAPVLCRGGGTSLS

SEQ ID NO: 335172 - protein, 18 aa, Mycobacterium
VQTLPPLVAQIMQNAGRP

SEQ ID NO: 335173 - protein, 29 aa, Mycobacterium
VQVAILAWIWRLGGPRGAFLGGVAQTLLL

SEQ ID NO: 335174 - protein, 23 aa, Mycobacterium
VQVEGRIAIALCPDHCDHPQELL

SEQ ID NO: 335175 - protein, 24 aa, Mycobacterium
VQVLRRLGTVLLIVGGIGVAVAAI

SEQ ID NO: 335176 - protein, 18 aa, Mycobacterium
VQVMPLFFLAGGAAGVHS

SEQ ID NO: 335177 - protein, 18 aa, Mycobacterium
VQVPGRYQYLKWWKLLLV

SEQ ID NO: 335178 - protein, 19 aa, Mycobacterium
VQVPIPFRTVFRHRAYKAA

SEQ ID NO: 335179 - protein, 26 aa, Mycobacterium
VQVRWTVAVTPKWVGWLPLRWTAFAV

SEQ ID NO: 335180 - protein, 20 aa, Mycobacterium
VQWPNPWPATFGHHEFFHAF

SEQ ID NO: 335181 - protein, 17 aa, Mycobacterium
VQWRAMTVRGLRGELTT

SEQ ID NO: 335182 - protein, 18 aa, Mycobacterium
VQYALGLVIILAVLVVPV

SEQ ID NO: 335183 - protein, 28 aa, Mycobacterium
VQYLRKRYEALVGNPLFGTMEFIDDAGE

SEQ ID NO: 335184 - protein, 19 aa, Mycobacterium
VQYLRYLGGLLHGDLGRAY

SEQ ID NO: 335185 - protein, 24 aa, Mycobacterium
VQYPKRRRSPWIIVAVALAAVVAV

SEQ ID NO: 335186 - protein, 20 aa, Mycobacterium
VRAAFGFSLDDVVVVPARAI

SEQ ID NO: 335187 - protein, 17 aa, Mycobacterium
VRAAHRVAHIDIRAIDG

SEQ ID NO: 335188 - protein, 21 aa, Mycobacterium
VRAALAVGCAPRLRFANPPAV

SEQ ID NO: 335189 - protein, 19 aa, Mycobacterium
VRAALCLAVDPDLLVTVNA

SEQ ID NO: 335190 - protein, 17 aa, Mycobacterium
VRAAMLLAAAWLALLAL

SEQ ID NO: 335191 - protein, 18 aa, Mycobacterium
VRAARISYRRAFSDGRLV

SEQ ID NO: 335192 - protein, 35 aa, Mycobacterium
VRAARWARRLAWASLLWMCAEGALGLWQGLAAGSI

SEQ ID NO: 335193 - protein, 17 aa, Mycobacterium
VRAGFVAAFSVPGEGRE

SEQ ID NO: 335194 - protein, 22 aa, Mycobacterium
VRAGHSAMAWQVAGWTLFTLAV

SEQ ID NO: 335195 - protein, 19 aa, Mycobacterium
VRAGISYVMVSMMSSVVFL

SEQ ID NO: 335196 - protein, 23 aa, Mycobacterium
VRAGLIAAIGFELFKQVASIYLS

SEQ ID NO: 335197 - protein, 28 aa, Mycobacterium
VRAGLIAALAFEVFKLVASIYLRSVLTG

SEQ ID NO: 335198 - protein, 26 aa, Mycobacterium
VRAHFGDDLLYVWRHFPLERAHPRAF

SEQ ID NO: 335199 - protein, 18 aa, Mycobacterium
VRAKAMTVPGFIDPDNDP

SEQ ID NO: 335200 - protein, 17 aa, Mycobacterium
VRAKFPNLTAHQVIHRL

SEQ ID NO: 335201 - protein, 24 aa, Mycobacterium
VRAKFPQLSAYQVINRLTRTARAP

SEQ ID NO: 335202 - protein, 17 aa, Mycobacterium
VRANAQWAVERELRRRI

SEQ ID NO: 335203 - protein, 17 aa, Mycobacterium
VRANPRATLGLTAIVVV

SEQ ID NO: 335204 - protein, 20 aa, Mycobacterium
VRASGFRFDAGRAVAIEETV

SEQ ID NO: 335205 - protein, 38 aa, Mycobacterium
VRASMQIRRVDPWSTLKVSLLLSVVLFFVWMIAVAFLY

SEQ ID NO: 335206 - protein, 22 aa, Mycobacterium
VRATLWVLFGLFFLFPLYAMAD

SEQ ID NO: 335207 - protein, 25 aa, Mycobacterium
VRAVEPRLPAILLGLGAEPDDRERR

SEQ ID NO: 335208 - protein, 25 aa, Mycobacterium
VRAVPDWLPYAVLLPVAAVVLIGLG

SEQ ID NO: 335209 - protein, 24 aa, Mycobacterium
VRAYPRTASVVIWYAPERCDTAAV

SEQ ID NO: 335210 - protein, 22 aa, Mycobacterium
VRCGLLRTSLTWTTPDGRATDL

SEQ ID NO: 335211 - protein, 19 aa, Mycobacterium
VRDAGALIDLLSGYQRAED

SEQ ID NO: 335212 - protein, 21 aa, Mycobacterium
VRDDCPRYGELAGPSCTTAPE

SEQ ID NO: 335213 - protein, 17 aa, Mycobacterium
VRDDIRLGKDTKASIRV

SEQ ID NO: 335214 - protein, 21 aa, Mycobacterium
VRDDPRIAPLRAPDLSGLPPA

SEQ ID NO: 335215 - protein, 21 aa, Mycobacterium
VRDGLYRWVRHPNYAAVAAEV

SEQ ID NO: 335216 - protein, 26 aa, Mycobacterium
VRDLMGVPHLEWYDYPLSGVLSLVVL

SEQ ID NO: 335217 - protein, 24 aa, Mycobacterium
VRDRRPGAVMDHGLWSWSRHPNYF

SEQ ID NO: 335218 - protein, 27 aa, Mycobacterium
VRDVLFGGRVSYLALLVLALIALVIGL

SEQ ID NO: 335219 - protein, 18 aa, Mycobacterium
VREICERYGVPYNTGPLP

SEQ ID NO: 335220 - protein, 24 aa, Mycobacterium
VREIKRLAKATGIDEPRLGLILEV

SEQ ID NO: 335221 - protein, 17 aa, Mycobacterium
VRELQFAAVAGVFLLAG

SEQ ID NO: 335222 - protein, 18 aa, Mycobacterium
VREPDLPRGFKVPLYPVT

SEQ ID NO: 335223 - protein, 21 aa, Mycobacterium
VREPELPRAFRVPGYPVTPVL

SEQ ID NO: 335224 - protein, 25 aa, Mycobacterium
VREPGEFLVELLVVLVVGEVRGLDT

SEQ ID NO: 335225 - protein, 25 aa, Mycobacterium
VRERLPACAVVSVGHRSTIDRHHQS

SEQ ID NO: 335226 - protein, 21 aa, Mycobacterium
VRETWRVIGDYVITGDDVRVG

SEQ ID NO: 335227 - protein, 18 aa, Mycobacterium
VREVALLRVVHRSKCGYL

SEQ ID NO: 335228 - protein, 17 aa, Mycobacterium
VRFAHGQVWQVGWISGL

SEQ ID NO: 335229 - protein, 19 aa, Mycobacterium
VRFALRLSLAAAFLSAVAD

SEQ ID NO: 335230 - protein, 17 aa, Mycobacterium
VRFGIPGSALFAVSTTG

SEQ ID NO: 335231 - protein, 27 aa, Mycobacterium
VRFPRTSALVIRYGDVPSRPLVEIGQM

SEQ ID NO: 335232 - protein, 17 aa, Mycobacterium
VRFTARISGPARHDLTV

SEQ ID NO: 335233 - protein, 17 aa, Mycobacterium
VRFTTWGRQFWRVTRGY

SEQ ID NO: 335234 - protein, 20 aa, Mycobacterium
VRGAMNAAWDKLGSSGGVLG

SEQ ID NO: 335235 - protein, 22 aa, Mycobacterium
VRGAMNAAWEKLGGATGTLGAP

SEQ ID NO: 335236 - protein, 22 aa, Mycobacterium
VRGARNYPCVDVPGKRAATPRE

SEQ ID NO: 335237 - protein, 19 aa, Mycobacterium
VRGGYVWAALYVIAVIGPA

SEQ ID NO: 335238 - protein, 19 aa, Mycobacterium
VRGHLPRTQLAALVMWTAW

SEQ ID NO: 335239 - protein, 33 aa, Mycobacterium
VRGLRTRLLRAIGPEARRVLVAAPFGGEGTTTT

SEQ ID NO: 335240 - protein, 18 aa, Mycobacterium
VRGLRTRLLRAMGPQARR

SEQ ID NO: 335241 - protein, 19 aa, Mycobacterium
VRGMDWLRRHTRMIQVIGG

SEQ ID NO: 335242 - protein, 24 aa, Mycobacterium
VRGMRLSGVTSMFVVLGPSGTGKS

SEQ ID NO: 335243 - protein, 26 aa, Mycobacterium
VRGPEWLRIGVMGVLYVLAIPVITIG

SEQ ID NO: 335244 - protein, 31 aa, Mycobacterium
VRGSHELFARPDVRAAVPGLLLALGENDDLR

SEQ ID NO: 335245 - protein, 21 aa, Mycobacterium
VRGSRNIPCTDIPGKRAATPR

SEQ ID NO: 335246 - protein, 21 aa, Mycobacterium
VRGSRNIPCVDVPGKRAATPR

SEQ ID NO: 335247 - protein, 23 aa, Mycobacterium
VRGTIRILLPVSVVAAIVLVAGG

SEQ ID NO: 335248 - protein, 18 aa, Mycobacterium
VRGWPLRALAGLLALASL

SEQ ID NO: 335249 - protein, 18 aa, Mycobacterium
VRGWPLRGLAALLAMVSL

SEQ ID NO: 335250 - protein, 18 aa, Mycobacterium
VRGWPLRILAVLVAAASA

SEQ ID NO: 335251 - protein, 17 aa, Mycobacterium
VRHAWQLACELRGVDPP

SEQ ID NO: 335252 - protein, 20 aa, Mycobacterium
VRHCVRRFGGITGDVLGAAV

SEQ ID NO: 335253 - protein, 24 aa, Mycobacterium
VRHCVRRFGGITGDVLGASIEITT

SEQ ID NO: 335254 - protein, 38 aa, Mycobacterium
VRHMSVGVAMLLEFLSPILVIAWTWMITRHRPHTRVLA

SEQ ID NO: 335255 - protein, 21 aa, Mycobacterium
VRHPLMLGFIIAFWAAPTMTA

SEQ ID NO: 335256 - protein, 20 aa, Mycobacterium
VRHPLMLGFIIAFWATPTMT

SEQ ID NO: 335257 - protein, 21 aa, Mycobacterium
VRHPLMLGMVIAFWAAPVMTA

SEQ ID NO: 335258 - protein, 25 aa, Mycobacterium
VRHPLMTGLLICFWSASTFTAGHLL

SEQ ID NO: 335259 - protein, 19 aa, Mycobacterium
VRIAPGMPPRSTVLLTTVG

SEQ ID NO: 335260 - protein, 20 aa, Mycobacterium
VRIAPHFVRVRMTSPTLFED

SEQ ID NO: 335261 - protein, 19 aa, Mycobacterium
VRIASAFAIASAVLIVGTA

SEQ ID NO: 335262 - protein, 19 aa, Mycobacterium
VRIDDPWLAEAWRAQQFGG

SEQ ID NO: 335263 - protein, 19 aa, Mycobacterium
VRIDDPWLAESWRAKQFGG

SEQ ID NO: 335264 - protein, 17 aa, Mycobacterium
VRIGLRLTEATQTTMVL

SEQ ID NO: 335265 - protein, 25 aa, Mycobacterium
VRILPVFALKGGSFFAFTTAILALM

SEQ ID NO: 335266 - protein, 23 aa, Mycobacterium
VRILRVRPAILAPITALITLLGV

SEQ ID NO: 335267 - protein, 17 aa, Mycobacterium
VRILVCASLGAGAAVLV

SEQ ID NO: 335268 - protein, 21 aa, Mycobacterium
VRIPLGLPGHRGLVWLTLLVA

SEQ ID NO: 335269 - protein, 18 aa, Mycobacterium
VRIPPRIVKATIAPDGTR

SEQ ID NO: 335270 - protein, 23 aa, Mycobacterium
VRIPRCVALGYGRPQNRTFREDD

SEQ ID NO: 335271 - protein, 23 aa, Mycobacterium
VRIPRNRAVVMLVIDVSQSMRAT

SEQ ID NO: 335272 - protein, 24 aa, Mycobacterium
VRIPRNRAVVMLVIDVSQSMRATD

SEQ ID NO: 335273 - protein, 26 aa, Mycobacterium
VRIPRSVEALGRVDMVCFDKTGTLSE

SEQ ID NO: 335274 - protein, 29 aa, Mycobacterium
VRIPRSVEALGRVDMVCFDKTGTLSENRL

SEQ ID NO: 335275 - protein, 17 aa, Mycobacterium
VRIPYAMAANWFGGSTW

SEQ ID NO: 335276 - protein, 19 aa, Mycobacterium
VRITDDWYAPVGGIVMAGC

SEQ ID NO: 335277 - protein, 18 aa, Mycobacterium
VRITRTWYAPVGGLLMAM

SEQ ID NO: 335278 - protein, 19 aa, Mycobacterium
VRIVFVFAFAYLRPPGQRP

SEQ ID NO: 335279 - protein, 18 aa, Mycobacterium
VRIVPVLLALLFSPVSWP

SEQ ID NO: 335280 - protein, 18 aa, Mycobacterium
VRIWLARVLADPHMKSQA

SEQ ID NO: 335281 - protein, 20 aa, Mycobacterium
VRKAIGGLRRLLGARPDSDA

SEQ ID NO: 335282 - protein, 17 aa, Mycobacterium
VRKIVKLALPGRAPRQA

SEQ ID NO: 335283 - protein, 20 aa, Mycobacterium
VRKKLRYAAVALVFLPIGQG

SEQ ID NO: 335284 - protein, 21 aa, Mycobacterium
VRKLAGLALWLITAVVLIVVW

SEQ ID NO: 335285 - protein, 19 aa, Mycobacterium
VRKSIAWWVLLIDLLGRSA

SEQ ID NO: 335286 - protein, 31 aa, Mycobacterium
VRLADRYAAWFLPLTLLVAGAAWLASGSPVR

SEQ ID NO: 335287 - protein, 30 aa, Mycobacterium
VRLADRYAAWFLPMALVLAAASWLASGSAV

SEQ ID NO: 335288 - protein, 27 aa, Mycobacterium
VRLAEPRWMPLWAFVIAMVLLRSSLVG

SEQ ID NO: 335289 - protein, 17 aa, Mycobacterium
VRLAEVMLSAGSGSADV

SEQ ID NO: 335290 - protein, 26 aa, Mycobacterium
VRLALRRDRVRLAVWIAVLTSTMVYA

SEQ ID NO: 335291 - protein, 19 aa, Mycobacterium
VRLAVLRVRTLRITVVGGS

SEQ ID NO: 335292 - protein, 17 aa, Mycobacterium
VRLDDLPGFLRSHDPGA

SEQ ID NO: 335293 - protein, 21 aa, Mycobacterium
VRLFLIVSVALFFLGAFVGIM

SEQ ID NO: 335294 - protein, 19 aa, Mycobacterium
VRLGLVFGLGGLVVSVPAS

SEQ ID NO: 335295 - protein, 19 aa, Mycobacterium
VRLKMLRATVEMFRFVPVV

SEQ ID NO: 335296 - protein, 20 aa, Mycobacterium
VRLLAILAGFPLVVAVVRPI

SEQ ID NO: 335297 - protein, 24 aa, Mycobacterium
VRLLELRPQIAIALVTLSLSPLPP

SEQ ID NO: 335298 - protein, 17 aa, Mycobacterium
VRLLERLLSDKVSATTL

SEQ ID NO: 335299 - protein, 18 aa, Mycobacterium
VRLLMGLLLSAFTTIGIA

SEQ ID NO: 335300 - protein, 23 aa, Mycobacterium
VRLLRIASPLFHYGILVVIVGHV

SEQ ID NO: 335301 - protein, 17 aa, Mycobacterium
VRLLRPLILLPLVLPPV

SEQ ID NO: 335302 - protein, 34 aa, Mycobacterium
VRLPEAGFRFLLYAFLCCAAFLVVRIEERHTRSV

SEQ ID NO: 335303 - protein, 24 aa, Mycobacterium
VRLRRRGDAWPPGRTVAWLLGCLT

SEQ ID NO: 335304 - protein, 17 aa, Mycobacterium
VRLRSFDGLGEPRTLLV

SEQ ID NO: 335305 - protein, 25 aa, Mycobacterium
VRLSRPHAPWARWRYTSRPRKMHRA

SEQ ID NO: 335306 - protein, 21 aa, Mycobacterium
VRLTFPDSWRPKAGADAPAAR

SEQ ID NO: 335307 - protein, 17 aa, Mycobacterium
VRLVTWFFPAWYAVFGV

SEQ ID NO: 335308 - protein, 21 aa, Mycobacterium
VRLWWDKPWAMRIVALARLPL

SEQ ID NO: 335309 - protein, 32 aa, Mycobacterium
VRLYRRGKVPIIRLGHLLVFFVRAAVAVPLAV

SEQ ID NO: 335310 - protein, 18 aa, Mycobacterium
VRMLGVFRRYGALVGAVC

SEQ ID NO: 335311 - protein, 20 aa, Mycobacterium
VRMLLVPAFMHVFGRLNWWA

SEQ ID NO: 335312 - protein, 21 aa, Mycobacterium
VRMVLVPAFMHLMGGVNWWAP

SEQ ID NO: 335313 - protein, 27 aa, Mycobacterium
VRNDMPWPVAVVVCVLAGAVIGAWQGF

SEQ ID NO: 335314 - protein, 36 aa, Mycobacterium
VRNFRFPFSAVVGAWGRDSPWPVVRNPLIASTLAGL

SEQ ID NO: 335315 - protein, 24 aa, Mycobacterium
VRNGMPVWLVVLWALALLVTGAGI

SEQ ID NO: 335316 - protein, 18 aa, Mycobacterium
VRNLLNWHAVEELEHKSV

SEQ ID NO: 335317 - protein, 24 aa, Mycobacterium
VRNPMISGVLCILLGEAAVAASGW

SEQ ID NO: 335318 - protein, 24 aa, Mycobacterium
VRNPMITGVLCILLGEAAIIASGP

SEQ ID NO: 335319 - protein, 26 aa, Mycobacterium
VRNRIGTRLGKPGPRSVAVPDASSGD

SEQ ID NO: 335320 - protein, 18 aa, Mycobacterium
VRPAADVRAQPVTPTQSD

SEQ ID NO: 335321 - protein, 20 aa, Mycobacterium
VRPAGLMMLGGSEFEGGLRE

SEQ ID NO: 335322 - protein, 26 aa, Mycobacterium
VRPARIGILAIRWRLPSGVEIDTGFR

SEQ ID NO: 335323 - protein, 17 aa, Mycobacterium
VRPATYLAFGPPALVIS

SEQ ID NO: 335324 - protein, 27 aa, Mycobacterium
VRPDALPRIKGDPMLLTMLWQNLIGNA

SEQ ID NO: 335325 - protein, 17 aa, Mycobacterium
VRPLRVLRDGALKVAHT

SEQ ID NO: 335326 - protein, 30 aa, Mycobacterium
VRPLTWRAALWSVMSVRWAGIALALFLTGL

SEQ ID NO: 335327 - protein, 25 aa, Mycobacterium
VRPLVLEFGQGQWKSRSEAVQFACI

SEQ ID NO: 335328 - protein, 17 aa, Mycobacterium
VRPLWLLLTQSLPGSLH

SEQ ID NO: 335329 - protein, 27 aa, Mycobacterium
VRPLYAPGLRLLIPLLDKMIRVDQRLV

SEQ ID NO: 335330 - protein, 29 aa, Mycobacterium
VRPRDRHQWLRWYPLAMLFAGTVLITMSS

SEQ ID NO: 335331 - protein, 18 aa, Mycobacterium
VRPRVRRAGVLGFGSLIG

SEQ ID NO: 335332 - protein, 19 aa, Mycobacterium
VRPSDPMVILFTSGSSGPP

SEQ ID NO: 335333 - protein, 24 aa, Mycobacterium
VRPYGYDETARWVPRLWRRDIKAG

SEQ ID NO: 335334 - protein, 18 aa, Mycobacterium
VRQARWFIVGGLVAAVMG

SEQ ID NO: 335335 - protein, 22 aa, Mycobacterium
VRQGNDLVGEFVLRRASFQAMM

SEQ ID NO: 335336 - protein, 17 aa, Mycobacterium
VRQGWRRLDSASVDSVD

SEQ ID NO: 335337 - protein, 20 aa, Mycobacterium
VRQIHHWAALMFAASIMVHM

SEQ ID NO: 335338 - protein, 18 aa, Mycobacterium
VRQILTWALSTGVPILAI

SEQ ID NO: 335339 - protein, 18 aa, Mycobacterium
VRQIRIEMMLGHVSAEAT

SEQ ID NO: 335340 - protein, 23 aa, Mycobacterium
VRQLFTVRIGLRLTEATQTTMVL

SEQ ID NO: 335341 - protein, 23 aa, Mycobacterium
VRQLFTVRIGLRMTEATQTAMVL

SEQ ID NO: 335342 - protein, 19 aa, Mycobacterium
VRQRFFALFLYVVGLLFIV

SEQ ID NO: 335343 - protein, 22 aa, Mycobacterium
VRQRFFALFLYVVMLVFVVATA

SEQ ID NO: 335344 - protein, 19 aa, Mycobacterium
VRQRFFALFLYVVMLVVVV

SEQ ID NO: 335345 - protein, 22 aa, Mycobacterium
VRQRLFALFLYVVMLVFVVCAA

SEQ ID NO: 335346 - protein, 19 aa, Mycobacterium
VRQRWRGQRAVDTFLVLPL

SEQ ID NO: 335347 - protein, 19 aa, Mycobacterium
VRQVHHWAALLFAASIMVH

SEQ ID NO: 335348 - protein, 17 aa, Mycobacterium
VRRCASMATELVSRPSL

SEQ ID NO: 335349 - protein, 19 aa, Mycobacterium
VRRDVRMIHDPMRSQSSSL

SEQ ID NO: 335350 - protein, 23 aa, Mycobacterium
VRRGGRRWWLGYGAALVGAVTVN

SEQ ID NO: 335351 - protein, 18 aa, Mycobacterium
VRRGYWATGLMDRVGTRL

SEQ ID NO: 335352 - protein, 18 aa, Mycobacterium
VRRHPLAALTTVGEQFVL

SEQ ID NO: 335353 - protein, 27 aa, Mycobacterium
VRRNRPRWWICYALALALSILLNVNLV

SEQ ID NO: 335354 - protein, 23 aa, Mycobacterium
VRRNRPWLWLLYALVLMVSILIN

SEQ ID NO: 335355 - protein, 24 aa, Mycobacterium
VRRPLRLRAGRTYDRLSASTGAAT

SEQ ID NO: 335356 - protein, 19 aa, Mycobacterium
VRRQLCIRLERYQHRLDLL

SEQ ID NO: 335357 - protein, 21 aa, Mycobacterium
VRRQLRTVRNIGVFGVNLVGL

SEQ ID NO: 335358 - protein, 21 aa, Mycobacterium
VRRRDCLHLYLRDEFTRLDGQ

SEQ ID NO: 335359 - protein, 17 aa, Mycobacterium
VRRRLVVGWLVYTANAV

SEQ ID NO: 335360 - protein, 20 aa, Mycobacterium
VRRRSGFHLVLLAVLAAIAC

SEQ ID NO: 335361 - protein, 21 aa, Mycobacterium
VRRTRYAWLVTGFDSAFTLAL

SEQ ID NO: 335362 - protein, 29 aa, Mycobacterium
VRRWRGIGTAIVRWPAPILVASLAVALVG

SEQ ID NO: 335363 - protein, 22 aa, Mycobacterium
VRRYAWHRVRRIMPAYVVTVLI

SEQ ID NO: 335364 - protein, 17 aa, Mycobacterium
VRRYSRETVRVMNSLAW

SEQ ID NO: 335365 - protein, 23 aa, Mycobacterium
VRSASRIAERFAEGHLSERMPVR

SEQ ID NO: 335366 - protein, 17 aa, Mycobacterium
VRSDLLPELTLRAQSTR

SEQ ID NO: 335367 - protein, 18 aa, Mycobacterium
VRSDLSWQALDAALARRA

SEQ ID NO: 335368 - protein, 26 aa, Mycobacterium
VRSFWQFGPTPAMLLAASAIRFPDRA

SEQ ID NO: 335369 - protein, 17 aa, Mycobacterium
VRSGTLIGFAGAFGALG

SEQ ID NO: 335370 - protein, 17 aa, Mycobacterium
VRSHRRTVMAGRVAAAL

SEQ ID NO: 335371 - protein, 18 aa, Mycobacterium
VRSLVWLQIGIGAAVLVV

SEQ ID NO: 335372 - protein, 18 aa, Mycobacterium
VRSPEEFHALLVDEQVSV

SEQ ID NO: 335373 - protein, 24 aa, Mycobacterium
VRSRAELLPTLALLLDEPDSPVDV

SEQ ID NO: 335374 - protein, 19 aa, Mycobacterium
VRSSLRAMFARTVKLVGWF

SEQ ID NO: 335375 - protein, 24 aa, Mycobacterium
VRSTWQLIGDNLWPLAKAAVTMTI

SEQ ID NO: 335376 - protein, 27 aa, Mycobacterium
VRSWRRVGTVVVRWPVPVLTATLAIAL

SEQ ID NO: 335377 - protein, 25 aa, Mycobacterium
VRTFAVPIIVAWLLLTIAVNVLVPW

SEQ ID NO: 335378 - protein, 17 aa, Mycobacterium
VRTIQWFFVDLFTGNFQ

SEQ ID NO: 335379 - protein, 18 aa, Mycobacterium
VRTLLGGRAVRWDEIDGL

SEQ ID NO: 335380 - protein, 19 aa, Mycobacterium
VRTLPGPGFPDFGAPDLPV

SEQ ID NO: 335381 - protein, 24 aa, Mycobacterium
VRTLPSPRPRRWSRAAVSAAAAVF

SEQ ID NO: 335382 - protein, 19 aa, Mycobacterium
VRTPIIWGPGKARAVQEFA

SEQ ID NO: 335383 - protein, 25 aa, Mycobacterium
VRTSEALLRLAMRTDAVLVGISGIA

SEQ ID NO: 335384 - protein, 19 aa, Mycobacterium
VRTSLIFSAFVLVMISLAV

SEQ ID NO: 335385 - protein, 19 aa, Mycobacterium
VRTWSSWKSILLGTFGAQG

SEQ ID NO: 335386 - protein, 18 aa, Mycobacterium
VRVAGRLTAALGESGTIA

SEQ ID NO: 335387 - protein, 19 aa, Mycobacterium
VRVAPRVAVSGLRVSVVMV

SEQ ID NO: 335388 - protein, 18 aa, Mycobacterium
VRVARLNAYFGPLLQSLP

SEQ ID NO: 335389 - protein, 17 aa, Mycobacterium
VRVDWASIIGAGRRVAL

SEQ ID NO: 335390 - protein, 17 aa, Mycobacterium
VRVELPLSIPVLVAGLR

SEQ ID NO: 335391 - protein, 22 aa, Mycobacterium
VRVESRAAPLLPDGALTDVDEV

SEQ ID NO: 335392 - protein, 18 aa, Mycobacterium
VRVFGGAAASSFRRRLDE

SEQ ID NO: 335393 - protein, 19 aa, Mycobacterium
VRVGDEVLASGAPLGLRST

SEQ ID NO: 335394 - protein, 18 aa, Mycobacterium
VRVGEHIAITGANGSGKT

SEQ ID NO: 335395 - protein, 24 aa, Mycobacterium
VRVGEKLYPALNLSSARLIAGEAA

SEQ ID NO: 335396 - protein, 19 aa, Mycobacterium
VRVGRHIYKQVPQRKGPAI

SEQ ID NO: 335397 - protein, 24 aa, Mycobacterium
VRVLAVPIIVFWGLLAVTTNTFIP

SEQ ID NO: 335398 - protein, 21 aa, Mycobacterium
VRVLFQWRWSIATLWLTAVFL

SEQ ID NO: 335399 - protein, 18 aa, Mycobacterium
VRVMPVFAVKSGAFFAAI

SEQ ID NO: 335400 - protein, 17 aa, Mycobacterium
VRVMPVFAVKSGAFFAM

SEQ ID NO: 335401 - protein, 18 aa, Mycobacterium
VRVPPRIIKETVAPDGTR

SEQ ID NO: 335402 - protein, 19 aa, Mycobacterium
VRVPPRIIKSTIAPDGTVT

SEQ ID NO: 335403 - protein, 30 aa, Mycobacterium
VRVPRSVEALGRIEVVCFDKTGTLSENRLR

SEQ ID NO: 335404 - protein, 25 aa, Mycobacterium
VRVPSRIFVWLAMIFGVGFSMLALL

SEQ ID NO: 335405 - protein, 21 aa, Mycobacterium
VRVRLALLLGYLVLPFDLIPD

SEQ ID NO: 335406 - protein, 18 aa, Mycobacterium
VRVTRWVATIAGLIGFVL

SEQ ID NO: 335407 - protein, 18 aa, Mycobacterium
VRVVSAFIDIFVQMIVLY

SEQ ID NO: 335408 - protein, 18 aa, Mycobacterium
VRVWDADTGAFLWNVMYG

SEQ ID NO: 335409 - protein, 25 aa, Mycobacterium
VRWAVAGRMAVAWLITLPAAGLVGA

SEQ ID NO: 335410 - protein, 25 aa, Mycobacterium
VRWAVAGRMAVAWLVTLPAAGIVGA

SEQ ID NO: 335411 - protein, 25 aa, Mycobacterium
VRWAVAGRMVLAWLVTLPAAGIVGA

SEQ ID NO: 335412 - protein, 25 aa, Mycobacterium
VRWGVAGRMAVAWLVTLPLAGVVGA

SEQ ID NO: 335413 - protein, 26 aa, Mycobacterium
VRWGVAGRMGVAWLVTLPLAGLVGAF

SEQ ID NO: 335414 - protein, 26 aa, Mycobacterium
VRWGVAGRMVAAWLITLPLAGLVGAI

SEQ ID NO: 335415 - protein, 27 aa, Mycobacterium
VRWGVATRMVAAWVITLPLAGLVGAIT

SEQ ID NO: 335416 - protein, 17 aa, Mycobacterium
VRWIELGLGLVLVLILV

SEQ ID NO: 335417 - protein, 22 aa, Mycobacterium
VRWPWAVIGVWIALAVALPLSF

SEQ ID NO: 335418 - protein, 23 aa, Mycobacterium
VRWPWVVIGAWVALAIALPLTFP

SEQ ID NO: 335419 - protein, 20 aa, Mycobacterium
VRWRADGQLDYLGRADEQVK

SEQ ID NO: 335420 - protein, 17 aa, Mycobacterium
VRWRAVLLAAVAACAAS

SEQ ID NO: 335421 - protein, 21 aa, Mycobacterium
VRWRRRRTRVVTWVASAAAAA

SEQ ID NO: 335422 - protein, 21 aa, Mycobacterium
VRWYPATLVFLAFDVEMLFMY

SEQ ID NO: 335423 - protein, 18 aa, Mycobacterium
VRYAGVVFPVIGWWLYDI

SEQ ID NO: 335424 - protein, 21 aa, Mycobacterium
VRYPAGINWVLAFWGVLMAGG

SEQ ID NO: 335425 - protein, 17 aa, Mycobacterium
VRYRPVGAGELLRRNLL

SEQ ID NO: 335426 - protein, 17 aa, Mycobacterium
VRYRRRRISFTAKPEPG

SEQ ID NO: 335427 - protein, 20 aa, Mycobacterium
VSAAGLRAGRPTTLSATIGS

SEQ ID NO: 335428 - protein, 18 aa, Mycobacterium
VSAAINFVLIAAVVYFLI

SEQ ID NO: 335429 - protein, 20 aa, Mycobacterium
VSAAVTWTLRALPFAVLAPL

SEQ ID NO: 335430 - protein, 21 aa, Mycobacterium
VSACLGALFVPGPLLAGTSGF

SEQ ID NO: 335431 - protein, 22 aa, Mycobacterium
VSACVMVFVAVWFALRDTQRAE

SEQ ID NO: 335432 - protein, 17 aa, Mycobacterium
VSADAWLVADLDSGAVI

SEQ ID NO: 335433 - protein, 18 aa, Mycobacterium
VSADFAVSIPQAGLTVSV

SEQ ID NO: 335434 - protein, 17 aa, Mycobacterium
VSADFVAGGGLYKNANV

SEQ ID NO: 335435 - protein, 22 aa, Mycobacterium
VSAEAPPFFVLHGRNDSLVPVE

SEQ ID NO: 335436 - protein, 17 aa, Mycobacterium
VSAEYGLYVGIGSAVCA

SEQ ID NO: 335437 - protein, 26 aa, Mycobacterium
VSAFDPESWGSWIVKATQTAIAHTTA

SEQ ID NO: 335438 - protein, 23 aa, Mycobacterium
VSAFLWSLYALFFGTAGTPGMKH

SEQ ID NO: 335439 - protein, 25 aa, Mycobacterium
VSAGERPLGEIISAGKLSFPISAAP

SEQ ID NO: 335440 - protein, 17 aa, Mycobacterium
VSAGRVFAGNIGAENRH

SEQ ID NO: 335441 - protein, 27 aa, Mycobacterium
VSAHIAALGPDGGWQGSAAQAYLAQIL

SEQ ID NO: 335442 - protein, 17 aa, Mycobacterium
VSAHPWSRNAARILGAS

SEQ ID NO: 335443 - protein, 23 aa, Mycobacterium
VSAICGYAVLYLAARELGPALFS

SEQ ID NO: 335444 - protein, 17 aa, Mycobacterium
VSAIVGAFAAHRGYRRW

SEQ ID NO: 335445 - protein, 20 aa, Mycobacterium
VSAKSLRVGDVIDLAAPEVV

SEQ ID NO: 335446 - protein, 26 aa, Mycobacterium
VSALFFPWNLYFGFRIPGSSRILFGV

SEQ ID NO: 335447 - protein, 24 aa, Mycobacterium
VSALPFFWLIESRSLPQIWAAFLL

SEQ ID NO: 335448 - protein, 18 aa, Mycobacterium
VSALRRFLEAHARVTDVP

SEQ ID NO: 335449 - protein, 25 aa, Mycobacterium
VSALVCARLLAPHRCGDRAGGHPGD

SEQ ID NO: 335450 - protein, 19 aa, Mycobacterium
VSALVWLQIGIGVAVLVVV

SEQ ID NO: 335451 - protein, 23 aa, Mycobacterium
VSANSRAAERFRQATSLRLTSDS

SEQ ID NO: 335452 - protein, 17 aa, Mycobacterium
VSAPASWAEPTEPGTTT

SEQ ID NO: 335453 - protein, 27 aa, Mycobacterium
VSAQIEALVPGGGWQGSAAQAYVAHNL

SEQ ID NO: 335454 - protein, 32 aa, Mycobacterium
VSAQLRFPFDPRLRRMAVVLAEEVVVKGAPDT

SEQ ID NO: 335455 - protein, 17 aa, Mycobacterium
VSAQPGRHDWPFAAQAF

SEQ ID NO: 335456 - protein, 18 aa, Mycobacterium
VSAQPLWLVFAGVGVLIF

SEQ ID NO: 335457 - protein, 24 aa, Mycobacterium
VSAQWCLGDSTLLRGLGQPTRLAT

SEQ ID NO: 335458 - protein, 20 aa, Mycobacterium
VSATMRFAAAIAVYAALTAV

SEQ ID NO: 335459 - protein, 31 aa, Mycobacterium
VSAVFVPIVIALAVATLGFWLGTGGSVAAAF

SEQ ID NO: 335460 - protein, 27 aa, Mycobacterium
VSAVFVPIVLALSVATLAVWLLTGHSA

SEQ ID NO: 335461 - protein, 18 aa, Mycobacterium
VSAWLVVVPLTFATALVL

SEQ ID NO: 335462 - protein, 21 aa, Mycobacterium
VSCNIGSTLGNGAWSTLVNSA

SEQ ID NO: 335463 - protein, 22 aa, Mycobacterium
VSCSIGATLGNGGWSTLVNTAK

SEQ ID NO: 335464 - protein, 35 aa, Mycobacterium
VSDATAALAALRGRPGFPTTGVVALCDFGASGTTV

SEQ ID NO: 335465 - protein, 33 aa, Mycobacterium
VSDELWRRIGVSLRLVLIGSVIGTVLGVVAGAW

SEQ ID NO: 335466 - protein, 17 aa, Mycobacterium
VSDHGPFVLAIRKPGGK

SEQ ID NO: 335467 - protein, 19 aa, Mycobacterium
VSDIFNNWVRVGQLVGQGA

SEQ ID NO: 335468 - protein, 18 aa, Mycobacterium
VSDIHLGPMLGRSHTERI

SEQ ID NO: 335469 - protein, 18 aa, Mycobacterium
VSDLRVVGQLGMTIGIGL

SEQ ID NO: 335470 - protein, 19 aa, Mycobacterium
VSDRIGRRPPYLFGAIAGV

SEQ ID NO: 335471 - protein, 29 aa, Mycobacterium
VSDRIGRSRVYLCGAFGLAVFAFPFWMLV

SEQ ID NO: 335472 - protein, 26 aa, Mycobacterium
VSDRNRPGWEWLKWLPHNQHPSHHDE

SEQ ID NO: 335473 - protein, 23 aa, Mycobacterium
VSEAALAAGRWQALMLPATSLVI

SEQ ID NO: 335474 - protein, 31 aa, Mycobacterium
VSEELWRRIGVSLRLLLLGSILGTVIGVVVG

SEQ ID NO: 335475 - protein, 24 aa, Mycobacterium
VSEIRKLVLRRWAADRRGRRSRPQ

SEQ ID NO: 335476 - protein, 25 aa, Mycobacterium
VSELHPGSAVVLVFVDQSTTTKDNP

SEQ ID NO: 335477 - protein, 18 aa, Mycobacterium
VSEREGAKLIIYDDEYAK

SEQ ID NO: 335478 - protein, 18 aa, Mycobacterium
VSEREGAKLIIYDDEYTG

SEQ ID NO: 335479 - protein, 23 aa, Mycobacterium
VSERGYPGSIWIAGTATNHQGML

SEQ ID NO: 335480 - protein, 17 aa, Mycobacterium
VSFAALRQLAFGGVAIA

SEQ ID NO: 335481 - protein, 17 aa, Mycobacterium
VSFASPRTGAGTASLTD

SEQ ID NO: 335482 - protein, 21 aa, Mycobacterium
VSFEFPLLIVMLNFVGILSYD

SEQ ID NO: 335483 - protein, 22 aa, Mycobacterium
VSFEPFRLGMTVLMLNRPRPML

SEQ ID NO: 335484 - protein, 26 aa, Mycobacterium
VSFGAFLGDWARYIPRDTPSWKPMLA

SEQ ID NO: 335485 - protein, 17 aa, Mycobacterium
VSFGLTFVGLILAEMFS

SEQ ID NO: 335486 - protein, 23 aa, Mycobacterium
VSFPELRNFLGAAYGFYALCAVL

SEQ ID NO: 335487 - protein, 31 aa, Mycobacterium
VSFPVVAYRAGRWWLATAVAFFAVVVLIAFW

SEQ ID NO: 335488 - protein, 25 aa, Mycobacterium
VSFQRARDALRLAGITASDRVLTDF

SEQ ID NO: 335489 - protein, 21 aa, Mycobacterium
VSFTTLRLVYNEAKANFVEGR

SEQ ID NO: 335490 - protein, 18 aa, Mycobacterium
VSGAICWAGGTTALVYFA

SEQ ID NO: 335491 - protein, 18 aa, Mycobacterium
VSGAICWAGGTTALVYYA

SEQ ID NO: 335492 - protein, 19 aa, Mycobacterium
VSGALCWAGGTTALVYFAG

SEQ ID NO: 335493 - protein, 21 aa, Mycobacterium
VSGAVAWFIGLFYKNLYVEGL

SEQ ID NO: 335494 - protein, 33 aa, Mycobacterium
VSGAVLLFGFLLPWLGVLAVVGVVIYGLIRWSR

SEQ ID NO: 335495 - protein, 21 aa, Mycobacterium
VSGAYAALARRGYEYGRAFQG

SEQ ID NO: 335496 - protein, 27 aa, Mycobacterium
VSGCLLRIAWDKHRVALFAGAPTAVGT

SEQ ID NO: 335497 - protein, 22 aa, Mycobacterium
VSGDTGLAVGLALLAALLAGVS

SEQ ID NO: 335498 - protein, 17 aa, Mycobacterium
VSGGWYAPFGLLLVAIT

SEQ ID NO: 335499 - protein, 25 aa, Mycobacterium
VSGLPRALVPLALSLYGIGMVTGNV

SEQ ID NO: 335500 - protein, 18 aa, Mycobacterium
VSGLSWQWIFLINVPIGI

SEQ ID NO: 335501 - protein, 26 aa, Mycobacterium
VSGPLHLGGICWRGRNQRPVITGTTV

SEQ ID NO: 335502 - protein, 17 aa, Mycobacterium
VSGPLLLQYPLYGGIIG

SEQ ID NO: 335503 - protein, 29 aa, Mycobacterium
VSGPPGYSAIWLWLGIALLGAVILWYTAV

SEQ ID NO: 335504 - protein, 27 aa, Mycobacterium
VSGRFIDRFGARKVLMVGAFVGIAGFL

SEQ ID NO: 335505 - protein, 26 aa, Mycobacterium
VSGRGLDIWSALPILGSVSLIGRMLR

SEQ ID NO: 335506 - protein, 19 aa, Mycobacterium
VSGRQAGLVDAVRAAESAL

SEQ ID NO: 335507 - protein, 21 aa, Mycobacterium
VSGSMSWLLLTLVSKPTRDAL

SEQ ID NO: 335508 - protein, 33 aa, Mycobacterium
VSGVAEGLRFVWSLRVLRALALIDLSVTALYLP

SEQ ID NO: 335509 - protein, 31 aa, Mycobacterium
VSGVFVPIVIAIAVTTLGVWLGAGYPVSAAL

SEQ ID NO: 335510 - protein, 28 aa, Mycobacterium
VSGWRFLLRRLEHAIVRRDTRMFDDPLQ

SEQ ID NO: 335511 - protein, 28 aa, Mycobacterium
VSHFQRAVLRIGNYLILIAVALVTLAVV

SEQ ID NO: 335512 - protein, 29 aa, Mycobacterium
VSHFQRAVLRIGNYLIVIAVALVALTVAV

SEQ ID NO: 335513 - protein, 20 aa, Mycobacterium
VSHPGIPFAVLVAVAATAGF

SEQ ID NO: 335514 - protein, 25 aa, Mycobacterium
VSHSRANWLPTFIALIVLSCVAAVY

SEQ ID NO: 335515 - protein, 18 aa, Mycobacterium
VSIAIAFLAAVTLLPAVM

SEQ ID NO: 335516 - protein, 17 aa, Mycobacterium
VSIEGDVALAFPATLPD

SEQ ID NO: 335517 - protein, 17 aa, Mycobacterium
VSIPALFAQQVSRVPGA

SEQ ID NO: 335518 - protein, 21 aa, Mycobacterium
VSIPFTLGGQIAFSASATTAS

SEQ ID NO: 335519 - protein, 18 aa, Mycobacterium
VSIPLPWMAVLIANDRPP

SEQ ID NO: 335520 - protein, 25 aa, Mycobacterium
VSIPVLRWSWTPVLLASSLITLLPI

SEQ ID NO: 335521 - protein, 22 aa, Mycobacterium
VSKGLFYGGGWAQLERQAIGAF

SEQ ID NO: 335522 - protein, 24 aa, Mycobacterium
VSLAGMALVWARRWPGRVQSQVFS

SEQ ID NO: 335523 - protein, 32 aa, Mycobacterium
VSLAPTLLVAIPFTVLVSFTLNILLRELGAAD

SEQ ID NO: 335524 - protein, 18 aa, Mycobacterium
VSLASLFVAFLMSYFYPI

SEQ ID NO: 335525 - protein, 17 aa, Mycobacterium
VSLAVSFPGDIESTNGE

SEQ ID NO: 335526 - protein, 18 aa, Mycobacterium
VSLCTMAATVGGAMPLIA

SEQ ID NO: 335527 - protein, 21 aa, Mycobacterium
VSLFRWLDPASVAWLRICGAA

SEQ ID NO: 335528 - protein, 18 aa, Mycobacterium
VSLGITWWQSCPQGSISA

SEQ ID NO: 335529 - protein, 18 aa, Mycobacterium
VSLGRRVVSLPWRLANIQ

SEQ ID NO: 335530 - protein, 24 aa, Mycobacterium
VSLIKMMISPVIFCTIVLGIGSVR

SEQ ID NO: 335531 - protein, 27 aa, Mycobacterium
VSLILWRTFRPGFGQFYAWVSTPAAIS

SEQ ID NO: 335532 - protein, 29 aa, Mycobacterium
VSLLALLRWRGAALLTLAWRSVSKRHVAD

SEQ ID NO: 335533 - protein, 19 aa, Mycobacterium
VSLLPRRNPGSSGIADVPG

SEQ ID NO: 335534 - protein, 18 aa, Mycobacterium
VSLLPTLMLTIPYTVLLT

SEQ ID NO: 335535 - protein, 24 aa, Mycobacterium
VSLPCGRGPVIGVAGEFVQTSVTT

SEQ ID NO: 335536 - protein, 24 aa, Mycobacterium
VSLPSRVFTWLALVFSVGFSVLAL

SEQ ID NO: 335537 - protein, 18 aa, Mycobacterium
VSLQQVFLLLLIPITIGA

SEQ ID NO: 335538 - protein, 25 aa, Mycobacterium
VSLRPDKKVVVKFDADRNVVLTEGS

SEQ ID NO: 335539 - protein, 17 aa, Mycobacterium
VSLRPILALREAADLLR

SEQ ID NO: 335540 - protein, 17 aa, Mycobacterium
VSLTIGLIAMVGVLIIG

SEQ ID NO: 335541 - protein, 19 aa, Mycobacterium
VSLTLTWLVYVSLRRDVAG

SEQ ID NO: 335542 - protein, 25 aa, Mycobacterium
VSLTPRLWVRARPGPQLRDLIQQPG

SEQ ID NO: 335543 - protein, 18 aa, Mycobacterium
VSLVFCWIAVTAWVIVAV

SEQ ID NO: 335544 - protein, 25 aa, Mycobacterium
VSLVIGAGMAVVFGVPVIVAPSFSP

SEQ ID NO: 335545 - protein, 17 aa, Mycobacterium
VSLVRSRVVWLLVLAIG

SEQ ID NO: 335546 - protein, 31 aa, Mycobacterium
VSMAPTLLVAIPFTVLVSFTLNILLRELGAA

SEQ ID NO: 335547 - protein, 32 aa, Mycobacterium
VSMAPTLLVAIPFTVLVSFTLNILLRELGAAD

SEQ ID NO: 335548 - protein, 25 aa, Mycobacterium
VSMEFKPTGAKVWADYTSAHWQQGT

SEQ ID NO: 335549 - protein, 17 aa, Mycobacterium
VSMVKGWYMSFWPIIAI

SEQ ID NO: 335550 - protein, 23 aa, Mycobacterium
VSMVLAKLLVRPIRRLEAGTEKI

SEQ ID NO: 335551 - protein, 22 aa, Mycobacterium
VSMVSSLVFLFGIALVYATTGT

SEQ ID NO: 335552 - protein, 25 aa, Mycobacterium
VSMWVTLMFPAWVLLVSGLILARSQ

SEQ ID NO: 335553 - protein, 24 aa, Mycobacterium
VSNPDCQGAFHVGQGAVYTGSGQT

SEQ ID NO: 335554 - protein, 18 aa, Mycobacterium
VSPAIGLIAAMATYGVGY

SEQ ID NO: 335555 - protein, 29 aa, Mycobacterium
VSPAVLRWSRNRMAFLAAVLFLMALCFAT

SEQ ID NO: 335556 - protein, 23 aa, Mycobacterium
VSPEVIDRILLGACAAIYLVLLG

SEQ ID NO: 335557 - protein, 18 aa, Mycobacterium
VSPHPVLAPALADILAGT

SEQ ID NO: 335558 - protein, 23 aa, Mycobacterium
VSPKELLPMLPVAVVLAAVTAAT

SEQ ID NO: 335559 - protein, 29 aa, Mycobacterium
VSPLIRYLIKVPREFINDYLFNFPDTSIA

SEQ ID NO: 335560 - protein, 30 aa, Mycobacterium
VSPLVRKAAAWSWRLLIIGGAIVALLWLIK

SEQ ID NO: 335561 - protein, 27 aa, Mycobacterium
VSPNPRGRGGLRLPGLGRIPNPGRGPA

SEQ ID NO: 335562 - protein, 24 aa, Mycobacterium
VSPPATRLGRAWLITVLGAMVALG

SEQ ID NO: 335563 - protein, 25 aa, Mycobacterium
VSPPRVDEKWLPAATSPAPPRPTVQ

SEQ ID NO: 335564 - protein, 18 aa, Mycobacterium
VSPRRGRGPVRASMQIRR

SEQ ID NO: 335565 - protein, 17 aa, Mycobacterium
VSPSIEVLIMLRFVQGF

SEQ ID NO: 335566 - protein, 25 aa, Mycobacterium
VSPTRRLRVGACVVIGLAGLLGAVL

SEQ ID NO: 335567 - protein, 21 aa, Mycobacterium
VSPWWALGLGMILGGALGNLV

SEQ ID NO: 335568 - protein, 28 aa, Mycobacterium
VSQCVKAEMLAASSWRVAVNAGSESSDR

SEQ ID NO: 335569 - protein, 21 aa, Mycobacterium
VSQGIAALFGAFARDYQAVSA

SEQ ID NO: 335570 - protein, 18 aa, Mycobacterium
VSQISWSTVLLIGGVLTF

SEQ ID NO: 335571 - protein, 21 aa, Mycobacterium
VSQLPGIAMVRGITRPKGEPL

SEQ ID NO: 335572 - protein, 21 aa, Mycobacterium
VSQPDCQGALYTTQSTVYAGT

SEQ ID NO: 335573 - protein, 22 aa, Mycobacterium
VSQRYPSVWELLSGSGERLLIY

SEQ ID NO: 335574 - protein, 17 aa, Mycobacterium
VSQVPPTRWSWYDDGSP

SEQ ID NO: 335575 - protein, 23 aa, Mycobacterium
VSRAEGWRRRGPLLPALIFMIVV

SEQ ID NO: 335576 - protein, 23 aa, Mycobacterium
VSRFVSLPGLVAVTGRWDLAPGT

SEQ ID NO: 335577 - protein, 24 aa, Mycobacterium
VSRLLAGAAPRLAVTGLAVGALVG

SEQ ID NO: 335578 - protein, 22 aa, Mycobacterium
VSRLSSAYGQLMAWNRVLGEVL

SEQ ID NO: 335579 - protein, 22 aa, Mycobacterium
VSRNPWAALALVFAVGVSGTSL

SEQ ID NO: 335580 - protein, 22 aa, Mycobacterium
VSRPLGGAVFGHFGDRVSRKTM

SEQ ID NO: 335581 - protein, 20 aa, Mycobacterium
VSRRSWWQERLMLWATIGLA

SEQ ID NO: 335582 - protein, 24 aa, Mycobacterium
VSRSWGMAFATLISRLTGFARIVL

SEQ ID NO: 335583 - protein, 17 aa, Mycobacterium
VSSAWTMPPDRPQAASQ

SEQ ID NO: 335584 - protein, 26 aa, Mycobacterium
VSSDLAEWEWVKWLPHFGDSRRYDAA

SEQ ID NO: 335585 - protein, 22 aa, Mycobacterium
VSSFAGVFCCIGSIVSVVLGTI

SEQ ID NO: 335586 - protein, 22 aa, Mycobacterium
VSSFGEFEFWFAGIKVAVIVVF

SEQ ID NO: 335587 - protein, 30 aa, Mycobacterium
VSSGFLPEWGTNALYHWPTVILGAVIMVAA

SEQ ID NO: 335588 - protein, 17 aa, Mycobacterium
VSSHAAAFIALRVGVNL

SEQ ID NO: 335589 - protein, 21 aa, Mycobacterium
VSSIPAWVPYAVLLPVAAAVL

SEQ ID NO: 335590 - protein, 18 aa, Mycobacterium
VSSLNRPVFTAGQAGNQD

SEQ ID NO: 335591 - protein, 38 aa, Mycobacterium
VSSPGWRKVGTSVVRWPIPIVLVTCVIAVVGFVALMTY

SEQ ID NO: 335592 - protein, 22 aa, Mycobacterium
VSSRRAAVVLIFSMAGFAIAVL

SEQ ID NO: 335593 - protein, 22 aa, Mycobacterium
VSSRRAAVVLIFSMLGFAIAVL

SEQ ID NO: 335594 - protein, 23 aa, Mycobacterium
VSSSPLAWLWQILFGTSTFPTSI

SEQ ID NO: 335595 - protein, 23 aa, Mycobacterium
VSSTARPALQLQNFGMVVDDVGT

SEQ ID NO: 335596 - protein, 20 aa, Mycobacterium
VSSVALIWFGGLRIDAGQMQ

SEQ ID NO: 335597 - protein, 19 aa, Mycobacterium
VSSVALIWFGGLRIDRGQM

SEQ ID NO: 335598 - protein, 20 aa, Mycobacterium
VSSVALIWFGGMRIDAGEMQ

SEQ ID NO: 335599 - protein, 20 aa, Mycobacterium
VSSVALIWFGGQRIDRGQMQ

SEQ ID NO: 335600 - protein, 18 aa, Mycobacterium
VSSVIGVVPFDFVTFLLA

SEQ ID NO: 335601 - protein, 17 aa, Mycobacterium
VSSWAWAWIPVHTDSGL

SEQ ID NO: 335602 - protein, 17 aa, Mycobacterium
VSSWRLIGKCLRPLPNK

SEQ ID NO: 335603 - protein, 20 aa, Mycobacterium
VSSYARPLAGLATVLVIALI

SEQ ID NO: 335604 - protein, 25 aa, Mycobacterium
VSSYRRPLLGTGFCGGLTTFSTMQV

SEQ ID NO: 335605 - protein, 18 aa, Mycobacterium
VSTDEMWDIRNRGVIPPG

SEQ ID NO: 335606 - protein, 19 aa, Mycobacterium
VSTLPGVLMTIPWAVISGF

SEQ ID NO: 335607 - protein, 18 aa, Mycobacterium
VSTLVSWVLAGQRPGNLP

SEQ ID NO: 335608 - protein, 18 aa, Mycobacterium
VSTMLLVLVMVGFEMGTA

SEQ ID NO: 335609 - protein, 43 aa, Mycobacterium
VSTMVFGAYPWAGWLAFAATVPVQFVAGWPFLRGAVQQARAGS

SEQ ID NO: 335610 - protein, 20 aa, Mycobacterium
VSTPRLTATLTLENLLATAA

SEQ ID NO: 335611 - protein, 20 aa, Mycobacterium
VSTREFVPEITILQRERNLD

SEQ ID NO: 335612 - protein, 21 aa, Mycobacterium
VSTRWSDIVGIGDPGLLNPEV

SEQ ID NO: 335613 - protein, 19 aa, Mycobacterium
VSTSLVVFVGFRSSRKSAS

SEQ ID NO: 335614 - protein, 20 aa, Mycobacterium
VSTSLVVFVGFRSSRKSASQ

SEQ ID NO: 335615 - protein, 19 aa, Mycobacterium
VSVAARYELAFELLAIASI

SEQ ID NO: 335616 - protein, 25 aa, Mycobacterium
VSVAIELLTGPSLVLFEDATGKPDR

SEQ ID NO: 335617 - protein, 29 aa, Mycobacterium
VSVALLLAGLRRYRGRSWVTRTGFVLAAM

SEQ ID NO: 335618 - protein, 17 aa, Mycobacterium
VSVCAAVLVIAGLLLRG

SEQ ID NO: 335619 - protein, 29 aa, Mycobacterium
VSVDAHAALRWSLIAGARCNDAALSHDDG

SEQ ID NO: 335620 - protein, 20 aa, Mycobacterium
VSVDGVRIGPNVTIRQAGGA

SEQ ID NO: 335621 - protein, 17 aa, Mycobacterium
VSVGAAWQSRTGNKVDL

SEQ ID NO: 335622 - protein, 31 aa, Mycobacterium
VSVGAILAMMVWLMSYNRLWERPRDLDQRRN

SEQ ID NO: 335623 - protein, 17 aa, Mycobacterium
VSVGFLISLWAGSSAIS

SEQ ID NO: 335624 - protein, 18 aa, Mycobacterium
VSVGRVVTLAFLMLQLVS

SEQ ID NO: 335625 - protein, 21 aa, Mycobacterium
VSVHLLASMTMVWLSVLLYVK

SEQ ID NO: 335626 - protein, 18 aa, Mycobacterium
VSVHQSWAITSYLLGGTI

SEQ ID NO: 335627 - protein, 19 aa, Mycobacterium
VSVLRARLVLMVVTALMTA

SEQ ID NO: 335628 - protein, 17 aa, Mycobacterium
VSVPIEDAWDLLTDLDQ

SEQ ID NO: 335629 - protein, 19 aa, Mycobacterium
VSVPPRMVVLLLALVTVAA

SEQ ID NO: 335630 - protein, 20 aa, Mycobacterium
VSVPVLIGIIVDRAVATGSV

SEQ ID NO: 335631 - protein, 17 aa, Mycobacterium
VSVVRNLVVPRLLAAMV

SEQ ID NO: 335632 - protein, 21 aa, Mycobacterium
VSVVVLVAAVIVWKFVGDALS

SEQ ID NO: 335633 - protein, 23 aa, Mycobacterium
VSVWFIAGSALRPGQVTVGTALA

SEQ ID NO: 335634 - protein, 17 aa, Mycobacterium
VSVYVISGFCASLAGIL

SEQ ID NO: 335635 - protein, 17 aa, Mycobacterium
VSWLIALVYTGLYTGGL

SEQ ID NO: 335636 - protein, 30 aa, Mycobacterium
VSWLLLAVFRGRLHPIGGLGVALGLTVLLF

SEQ ID NO: 335637 - protein, 22 aa, Mycobacterium
VSWPERLLLGWLGPRGTTSIVF

SEQ ID NO: 335638 - protein, 26 aa, Mycobacterium
VSWRQGRLAPTWSFHFGLLLLGWGVF

SEQ ID NO: 335639 - protein, 23 aa, Mycobacterium
VSWRRVSGRWSKSGDPGRCTREA

SEQ ID NO: 335640 - protein, 20 aa, Mycobacterium
VSWSHHWVWMLPAVVVTGVL

SEQ ID NO: 335641 - protein, 20 aa, Mycobacterium
VSWSHHWVWMLPTVVVTAVL

SEQ ID NO: 335642 - protein, 17 aa, Mycobacterium
VSWSHHWVWVLPAVLVT

SEQ ID NO: 335643 - protein, 27 aa, Mycobacterium
VSWVPELWMDFTLRFDALAAIMSVLVL

SEQ ID NO: 335644 - protein, 22 aa, Mycobacterium
VSYLDLCDQLLLLAPGGKTAYF

SEQ ID NO: 335645 - protein, 21 aa, Mycobacterium
VSYLDVCDQLLLVAPGGKTAF

SEQ ID NO: 335646 - protein, 31 aa, Mycobacterium
VSYMRYPVFLAFDIVGGIAWGAGATLAGYFL

SEQ ID NO: 335647 - protein, 32 aa, Mycobacterium
VSYMRYPVFLAFDIVGGISWGAGVTLAGYFLG

SEQ ID NO: 335648 - protein, 26 aa, Mycobacterium
VSYMRYPVFLGFDIVGGILWGGGVTL

SEQ ID NO: 335649 - protein, 20 aa, Mycobacterium
VSYTPAWEAMMRVTGIVSAM

SEQ ID NO: 335650 - protein, 17 aa, Mycobacterium
VSYYPPTRLHLVDTSIN

SEQ ID NO: 335651 - protein, 50 aa, Mycobacterium
VTAAAPTRRVEWSRVVAFLVLPALALVLAAGAGYLKWLDDSYRDGSMSVD

SEQ ID NO: 335652 - protein, 26 aa, Mycobacterium
VTAAGATAAWAIGRWTPGTERRTATM

SEQ ID NO: 335653 - protein, 25 aa, Mycobacterium
VTAAGATAAWAIGRWTPGTERRTST

SEQ ID NO: 335654 - protein, 26 aa, Mycobacterium
VTAAGATAAWAIGRWTPGTERRTSTM

SEQ ID NO: 335655 - protein, 25 aa, Mycobacterium
VTAAIAGQVGRLWGLTSALSTDERT

SEQ ID NO: 335656 - protein, 18 aa, Mycobacterium
VTAARWLFALFTVLAALG

SEQ ID NO: 335657 - protein, 24 aa, Mycobacterium
VTAARWPNRVAVIDDDGTFSYRDL

SEQ ID NO: 335658 - protein, 29 aa, Mycobacterium
VTACALVLSLIGVWAIRRRLLRQTHGLRP

SEQ ID NO: 335659 - protein, 19 aa, Mycobacterium
VTADIAHRLLDGVDPDIIT

SEQ ID NO: 335660 - protein, 28 aa, Mycobacterium
VTAEAIVTDVLTWIGLRPSVDDSPAPQT

SEQ ID NO: 335661 - protein, 17 aa, Mycobacterium
VTAFGVYMGFWFPGVPR

SEQ ID NO: 335662 - protein, 23 aa, Mycobacterium
VTAFSVGLATMFALIQQPVRRSF

SEQ ID NO: 335663 - protein, 22 aa, Mycobacterium
VTAGEVPTTFGYHGDDGEHPTI

SEQ ID NO: 335664 - protein, 23 aa, Mycobacterium
VTAGFLTLFGFIFVITQYFQFVK

SEQ ID NO: 335665 - protein, 19 aa, Mycobacterium
VTAGVYALVGFEVTPATVI

SEQ ID NO: 335666 - protein, 22 aa, Mycobacterium
VTAILAFLAWRAVNDRLGQICV

SEQ ID NO: 335667 - protein, 23 aa, Mycobacterium
VTALCGYTVIYLAARDLAPSGFS

SEQ ID NO: 335668 - protein, 18 aa, Mycobacterium
VTALGIEMYRWWRSPSVG

SEQ ID NO: 335669 - protein, 17 aa, Mycobacterium
VTALGVYAMAARRDRPI

SEQ ID NO: 335670 - protein, 24 aa, Mycobacterium
VTAMKMLIGPIVFLTIVGGIAGVA

SEQ ID NO: 335671 - protein, 24 aa, Mycobacterium
VTAPPNLRELVAHLMKVLATTAIE

SEQ ID NO: 335672 - protein, 21 aa, Mycobacterium
VTAPSGRRTWSMPKSPISREQ

SEQ ID NO: 335673 - protein, 17 aa, Mycobacterium
VTARPKRAVYYLITMAL

SEQ ID NO: 335674 - protein, 22 aa, Mycobacterium
VTASGRWRALLLAAVAACAACG

SEQ ID NO: 335675 - protein, 27 aa, Mycobacterium
VTASTRGAGPMGFAGTVSRGDEQAGGL

SEQ ID NO: 335676 - protein, 32 aa, Mycobacterium
VTATLLFGVFANRWLAKRTRRRVNIGFVAGGL

SEQ ID NO: 335677 - protein, 22 aa, Mycobacterium
VTATLWIPPLIYFALHRIRRYP

SEQ ID NO: 335678 - protein, 23 aa, Mycobacterium
VTAVALLFGWGAWQRRWIADDGL

SEQ ID NO: 335679 - protein, 17 aa, Mycobacterium
VTAVAVGAIVGRTATAS

SEQ ID NO: 335680 - protein, 30 aa, Mycobacterium
VTAVLAVLAWRALDSWDRLGRLLVVELFGL

SEQ ID NO: 335681 - protein, 19 aa, Mycobacterium
VTAVLGCRRSVPAAAGSSL

SEQ ID NO: 335682 - protein, 23 aa, Mycobacterium
VTAYPICYAIWLSVQKYSFASPQ

SEQ ID NO: 335683 - protein, 22 aa, Mycobacterium
VTCGIGAFIWGIVDAILILTDK

SEQ ID NO: 335684 - protein, 31 aa, Mycobacterium
VTCLRPKPARRPVFVDGRLRKQILRLDSSCL

SEQ ID NO: 335685 - protein, 20 aa, Mycobacterium
VTDAEMWEALRVAAADDFVG

SEQ ID NO: 335686 - protein, 29 aa, Mycobacterium
VTDAGVGRPWASWMMPKMISPIRTAINTP

SEQ ID NO: 335687 - protein, 26 aa, Mycobacterium
VTDMGEIVLPPGFLPLKVPIEVHFTQ

SEQ ID NO: 335688 - protein, 19 aa, Mycobacterium
VTDVLPLTPVQQGLLFHST

SEQ ID NO: 335689 - protein, 18 aa, Mycobacterium
VTDYSGSGVKDFVFEVHR

SEQ ID NO: 335690 - protein, 18 aa, Mycobacterium
VTDYSRPSAMLVAEQPEL

SEQ ID NO: 335691 - protein, 24 aa, Mycobacterium
VTECRVCKVDVPKGQYCGLCGVHL

SEQ ID NO: 335692 - protein, 28 aa, Mycobacterium
VTESAGLGRLWVSVVLLLFGFGSFIGVT

SEQ ID NO: 335693 - protein, 26 aa, Mycobacterium
VTEVACAAALVAEGRYDIRVSPPRLG

SEQ ID NO: 335694 - protein, 21 aa, Mycobacterium
VTFFFLKDGPGFIPWLRRTVG

SEQ ID NO: 335695 - protein, 29 aa, Mycobacterium
VTFFGRRVTGWVATMFVWLRRRRKPPDVP

SEQ ID NO: 335696 - protein, 17 aa, Mycobacterium
VTFGYRPDIPVLHDISL

SEQ ID NO: 335697 - protein, 24 aa, Mycobacterium
VTFIAWSGVLGFLLGSITVTVLAA

SEQ ID NO: 335698 - protein, 25 aa, Mycobacterium
VTFLPAVLVLVGRRGWITPRKAYAN

SEQ ID NO: 335699 - protein, 18 aa, Mycobacterium
VTFLPILAVTFGIGALNT

SEQ ID NO: 335700 - protein, 29 aa, Mycobacterium
VTFLTRPIGSWFFGRFADRRGRRAALTFS

SEQ ID NO: 335701 - protein, 18 aa, Mycobacterium
VTFMLVWLTGNHGWSVRA

SEQ ID NO: 335702 - protein, 27 aa, Mycobacterium
VTFSGRRVTGWVATVFAWLRRRRRPPD

SEQ ID NO: 335703 - protein, 21 aa, Mycobacterium
VTGALRAWVAQAMTWHDPSVL

SEQ ID NO: 335704 - protein, 19 aa, Mycobacterium
VTGCTAVLLSPMSFLRRPA

SEQ ID NO: 335705 - protein, 24 aa, Mycobacterium
VTGEYRSGLIATTFTAIPRRTLVV

SEQ ID NO: 335706 - protein, 19 aa, Mycobacterium
VTGFGVLLWLWLLAFTDSV

SEQ ID NO: 335707 - protein, 19 aa, Mycobacterium
VTGGFWRVLGIRLLTAIVV

SEQ ID NO: 335708 - protein, 24 aa, Mycobacterium
VTGGLLHFWTWQSIFVTFTIASVG

SEQ ID NO: 335709 - protein, 22 aa, Mycobacterium
VTGGLVAFIFLLARTAMSKFTP

SEQ ID NO: 335710 - protein, 19 aa, Mycobacterium
VTGGRAMMRADLVGLGDPV

SEQ ID NO: 335711 - protein, 21 aa, Mycobacterium
VTGLAGCFVFSLIRPNGTAGT

SEQ ID NO: 335712 - protein, 17 aa, Mycobacterium
VTGLAREALTESGLLIE

SEQ ID NO: 335713 - protein, 23 aa, Mycobacterium
VTGLCLMAGILTRAMSVSVFLLA

SEQ ID NO: 335714 - protein, 19 aa, Mycobacterium
VTGLLHCSDEIAGVSGAAR

SEQ ID NO: 335715 - protein, 24 aa, Mycobacterium
VTGLLIGALWAWIAPPIRAVVALT

SEQ ID NO: 335716 - protein, 24 aa, Mycobacterium
VTGLVARLRGKWVPGPWNLGKFST

SEQ ID NO: 335717 - protein, 25 aa, Mycobacterium
VTGLYRWFPPITVWTGLSLLAVAVA

SEQ ID NO: 335718 - protein, 27 aa, Mycobacterium
VTGPVARLALVGPGARGADVIDQSVVD

SEQ ID NO: 335719 - protein, 22 aa, Mycobacterium
VTGRAGLDQMSWATPARWGFAA

SEQ ID NO: 335720 - protein, 32 aa, Mycobacterium
VTGRAGLEQLSFLFPSRWGFAATAATCDLRKL

SEQ ID NO: 335721 - protein, 27 aa, Mycobacterium
VTGRLFGRFDLAVAVFFALSGFLLWRG

SEQ ID NO: 335722 - protein, 18 aa, Mycobacterium
VTGRRSWLITLGVVLFGV

SEQ ID NO: 335723 - protein, 21 aa, Mycobacterium
VTGRVARLAMIGAPANGGQLL

SEQ ID NO: 335724 - protein, 23 aa, Mycobacterium
VTGRWRRLKTLAVITGPGLIVMV

SEQ ID NO: 335725 - protein, 25 aa, Mycobacterium
VTGRYPHRRSWIVLGIIASNALMWT

SEQ ID NO: 335726 - protein, 17 aa, Mycobacterium
VTGSIFFLVSGVLAMVS

SEQ ID NO: 335727 - protein, 21 aa, Mycobacterium
VTGTIAWPALVMFAIIFFWTP

SEQ ID NO: 335728 - protein, 18 aa, Mycobacterium
VTGTLAWPALAMFAIIFF

SEQ ID NO: 335729 - protein, 19 aa, Mycobacterium
VTGTLAWPALAMFAIVFFW

SEQ ID NO: 335730 - protein, 18 aa, Mycobacterium
VTGTTIWWTSDARATVSR

SEQ ID NO: 335731 - protein, 17 aa, Mycobacterium
VTGVWAFVLLDRTPEWQ

SEQ ID NO: 335732 - protein, 22 aa, Mycobacterium
VTGYGCGAIFAFHGAPDLALTQ

SEQ ID NO: 335733 - protein, 21 aa, Mycobacterium
VTHAFPAWVSTALALGVVAIG

SEQ ID NO: 335734 - protein, 18 aa, Mycobacterium
VTHVYPQLVDVIRERNLR

SEQ ID NO: 335735 - protein, 18 aa, Mycobacterium
VTIAAAWAQSRLVDENGY

SEQ ID NO: 335736 - protein, 17 aa, Mycobacterium
VTIPAAVMLARYQARRM

SEQ ID NO: 335737 - protein, 17 aa, Mycobacterium
VTIPALFAEQVVRAPDA

SEQ ID NO: 335738 - protein, 21 aa, Mycobacterium
VTIPFGIGMAFYGNIGGGAFV

SEQ ID NO: 335739 - protein, 29 aa, Mycobacterium
VTIQLGLAIGRLVFRALNAVECVLAAVLV

SEQ ID NO: 335740 - protein, 26 aa, Mycobacterium
VTIVCAAVLFSARWIGPRAAAALAGL

SEQ ID NO: 335741 - protein, 19 aa, Mycobacterium
VTKLKAAGFTKFKQANSPS

SEQ ID NO: 335742 - protein, 18 aa, Mycobacterium
VTLCIAFGVYTAVMADIQ

SEQ ID NO: 335743 - protein, 18 aa, Mycobacterium
VTLELAYFGGLGALIILL

SEQ ID NO: 335744 - protein, 23 aa, Mycobacterium
VTLEVPAGGWGEVSFVDADGNRV

SEQ ID NO: 335745 - protein, 24 aa, Mycobacterium
VTLGGFGLVCLIALITDGANGSRA

SEQ ID NO: 335746 - protein, 24 aa, Mycobacterium
VTLHEVPVLSGLGLTMTGARPGGF

SEQ ID NO: 335747 - protein, 18 aa, Mycobacterium
VTLIAWGYVADRIGERTV

SEQ ID NO: 335748 - protein, 19 aa, Mycobacterium
VTLIAWGYVVDRIGERAVL

SEQ ID NO: 335749 - protein, 21 aa, Mycobacterium
VTLLGALGWAFGNIASRKAME

SEQ ID NO: 335750 - protein, 26 aa, Mycobacterium
VTLLPAIIVLAGRRGWVSPRREITAR

SEQ ID NO: 335751 - protein, 33 aa, Mycobacterium
VTLLPAILVLAGPRGWIKPRRELTAQFWRRSGI

SEQ ID NO: 335752 - protein, 29 aa, Mycobacterium
VTLLPAILVLAGPRGWVKPRRELTTRFWR

SEQ ID NO: 335753 - protein, 26 aa, Mycobacterium
VTLLPAMVVLAGRRGWVKPRKDLTGR

SEQ ID NO: 335754 - protein, 29 aa, Mycobacterium
VTLLPAVMVLAGRRGWIAPRRDLTSRLWR

SEQ ID NO: 335755 - protein, 18 aa, Mycobacterium
VTLLPFLVLGTTFGARLL

SEQ ID NO: 335756 - protein, 21 aa, Mycobacterium
VTLLVCERLAINAAPFLMAEV

SEQ ID NO: 335757 - protein, 19 aa, Mycobacterium
VTLMPSPTVLMLGMPAGLR

SEQ ID NO: 335758 - protein, 25 aa, Mycobacterium
VTLPIGLGIGRLVFRALNTCEVVLG

SEQ ID NO: 335759 - protein, 25 aa, Mycobacterium
VTLPIGLGIGRLVFRALNTVEVVFA

SEQ ID NO: 335760 - protein, 26 aa, Mycobacterium
VTLQIGLGIGRLVFRALNIVEVVFAL

SEQ ID NO: 335761 - protein, 26 aa, Mycobacterium
VTLQIGLGIGRLVFRALNTVEVAFAL

SEQ ID NO: 335762 - protein, 24 aa, Mycobacterium
VTLRAPHGGIFVFFAIGNLLWFVI

SEQ ID NO: 335763 - protein, 23 aa, Mycobacterium
VTLRGVLLLAFPKAFVSAANSMI

SEQ ID NO: 335764 - protein, 20 aa, Mycobacterium
VTLSLRSVRTLAICGEPAAA

SEQ ID NO: 335765 - protein, 20 aa, Mycobacterium
VTLSPGWDAAGWLMLTAING

SEQ ID NO: 335766 - protein, 18 aa, Mycobacterium
VTLTWLWVAAFAGMTLSS

SEQ ID NO: 335767 - protein, 23 aa, Mycobacterium
VTLYAVFRWFFAKDLRVQPRPDE

SEQ ID NO: 335768 - protein, 20 aa, Mycobacterium
VTMGVAWSVLYIPLGGVGTI

SEQ ID NO: 335769 - protein, 19 aa, Mycobacterium
VTMGVAWSVLYIPMGGVGT

SEQ ID NO: 335770 - protein, 19 aa, Mycobacterium
VTMGVAWSVLYIPVGGVGT

SEQ ID NO: 335771 - protein, 22 aa, Mycobacterium
VTMLRRRIDAPLEEGALSMMTP

SEQ ID NO: 335772 - protein, 18 aa, Mycobacterium
VTMLSKWPVGWMVVLLYA

SEQ ID NO: 335773 - protein, 18 aa, Mycobacterium
VTMLSKWQVGWVVVLLYA

SEQ ID NO: 335774 - protein, 18 aa, Mycobacterium
VTMMLPLIVVGVSLGIAQ

SEQ ID NO: 335775 - protein, 26 aa, Mycobacterium
VTMTYALRFRWWVVIAGVAIASFTVH

SEQ ID NO: 335776 - protein, 23 aa, Mycobacterium
VTNAVVIAADFSHDVSCTLLVNG

SEQ ID NO: 335777 - protein, 20 aa, Mycobacterium
VTNGRKAPVLALIVPGIVGF

SEQ ID NO: 335778 - protein, 24 aa, Mycobacterium
VTNKIVRLWAGWVPAMGLLTHVGR

SEQ ID NO: 335779 - protein, 23 aa, Mycobacterium
VTNLELYLIFPLANEQATIALVR

SEQ ID NO: 335780 - protein, 23 aa, Mycobacterium
VTNLELYLIFPLNSEDSTIALVR

SEQ ID NO: 335781 - protein, 24 aa, Mycobacterium
VTNQGRIGLMLANNESPCTVNSFA

SEQ ID NO: 335782 - protein, 18 aa, Mycobacterium
VTNSRKAPTLALIVPGVV

SEQ ID NO: 335783 - protein, 18 aa, Mycobacterium
VTNTGFGTGMDWRPNPGI

SEQ ID NO: 335784 - protein, 19 aa, Mycobacterium
VTPALWLLACAVIIVSYAR

SEQ ID NO: 335785 - protein, 19 aa, Mycobacterium
VTPGGWHLWCAAALSGIAG

SEQ ID NO: 335786 - protein, 22 aa, Mycobacterium
VTPGRCAAIAVPGRGAGAEKLV

SEQ ID NO: 335787 - protein, 24 aa, Mycobacterium
VTPHPRFPHLIPGGDYVMGGDGLQ

SEQ ID NO: 335788 - protein, 35 aa, Mycobacterium
VTPLVRKTAAWSWRLLVIFAAALAVIWVISKLEII

SEQ ID NO: 335789 - protein, 33 aa, Mycobacterium
VTPLVRMAAAWSWRLLVIFAAIVTLLWLVLRLE

SEQ ID NO: 335790 - protein, 24 aa, Mycobacterium
VTPQARTALWASLVGTTIEWYDFF

SEQ ID NO: 335791 - protein, 21 aa, Mycobacterium
VTPRLCARAANPFPIVAASAL

SEQ ID NO: 335792 - protein, 19 aa, Mycobacterium
VTPRPISMNVLNAIPEVPA

SEQ ID NO: 335793 - protein, 25 aa, Mycobacterium
VTPSALRQSFLWGLAGVIAAEHPEL

SEQ ID NO: 335794 - protein, 18 aa, Mycobacterium
VTPVGAFIRKYSLDELPQ

SEQ ID NO: 335795 - protein, 18 aa, Mycobacterium
VTPYRFTPKVAWLTLLAG

SEQ ID NO: 335796 - protein, 29 aa, Mycobacterium
VTQGLRFVWNLRVLRALALIDLTVTALYL

SEQ ID NO: 335797 - protein, 17 aa, Mycobacterium
VTQRLSFHTRLPVLTVS

SEQ ID NO: 335798 - protein, 17 aa, Mycobacterium
VTQRVIDKLGLPMTAKQ

SEQ ID NO: 335799 - protein, 35 aa, Mycobacterium
VTRAVCGPEAFLAYGWRIPFLLSAVLVVIGLVIRL

SEQ ID NO: 335800 - protein, 22 aa, Mycobacterium
VTRHLWIPLVLVIVLAVSGLVV

SEQ ID NO: 335801 - protein, 31 aa, Mycobacterium
VTRIGRILRRFSIDEIPQFINVVKRDMSVVG

SEQ ID NO: 335802 - protein, 21 aa, Mycobacterium
VTRLGNLSARKVVVLVNPTTN

SEQ ID NO: 335803 - protein, 18 aa, Mycobacterium
VTRPAGAVPEQFRATYQA

SEQ ID NO: 335804 - protein, 25 aa, Mycobacterium
VTRPELEQLISAPLDGFLNAVEDTL

SEQ ID NO: 335805 - protein, 22 aa, Mycobacterium
VTRPLAALARACRRVTEGNFGE

SEQ ID NO: 335806 - protein, 17 aa, Mycobacterium
VTRSRGPFWSRPAPARI

SEQ ID NO: 335807 - protein, 18 aa, Mycobacterium
VTRWGRYAAPNGALALAA

SEQ ID NO: 335808 - protein, 18 aa, Mycobacterium
VTRWLATHRDLWLTTVLR

SEQ ID NO: 335809 - protein, 34 aa, Mycobacterium
VTSEFDLASGLAEVWRRGLRLWVACLALTAAWIG

SEQ ID NO: 335810 - protein, 28 aa, Mycobacterium
VTSEPAWMRRAWLAAAMVAPAVIYLEPI

SEQ ID NO: 335811 - protein, 26 aa, Mycobacterium
VTSISIPSWWQPYVLSVASLTPDGQP

SEQ ID NO: 335812 - protein, 23 aa, Mycobacterium
VTSLAAPFFVKVLWPPENSAWKK

SEQ ID NO: 335813 - protein, 22 aa, Mycobacterium
VTSLRAAAHRGLPADLDAHVTG

SEQ ID NO: 335814 - protein, 24 aa, Mycobacterium
VTSNELVAWVCIGASVLGVVLLIV

SEQ ID NO: 335815 - protein, 25 aa, Mycobacterium
VTSQYPRKRCLGADGKIGPGTETQI

SEQ ID NO: 335816 - protein, 28 aa, Mycobacterium
VTSSIVEWKLRPGVVSTMNAQARYTDPS

SEQ ID NO: 335817 - protein, 25 aa, Mycobacterium
VTTAETLGGLGLLFGVLTPLAACAV

SEQ ID NO: 335818 - protein, 25 aa, Mycobacterium
VTTAYLVMCGFIFVATQYLQFVAAY

SEQ ID NO: 335819 - protein, 18 aa, Mycobacterium
VTTIYDWVPAPAGLVLAA

SEQ ID NO: 335820 - protein, 18 aa, Mycobacterium
VTTPEQFQPFTGIPSLTF

SEQ ID NO: 335821 - protein, 17 aa, Mycobacterium
VTTQWSSLVEVLRGTDS

SEQ ID NO: 335822 - protein, 23 aa, Mycobacterium
VTTRWPYADVVVAVLVALWVAPR

SEQ ID NO: 335823 - protein, 18 aa, Mycobacterium
VTVALAFVTLPFVVRAVQ

SEQ ID NO: 335824 - protein, 20 aa, Mycobacterium
VTVALCLGGGVFGLSLGKHV

SEQ ID NO: 335825 - protein, 18 aa, Mycobacterium
VTVANTFSPGNFVAYAVA

SEQ ID NO: 335826 - protein, 17 aa, Mycobacterium
VTVANTFSTEDFVAYAV

SEQ ID NO: 335827 - protein, 24 aa, Mycobacterium
VTVAVVSLGLWVIFLPSVVRRRLP

SEQ ID NO: 335828 - protein, 17 aa, Mycobacterium
VTVAYLLAMVSVLALVL

SEQ ID NO: 335829 - protein, 17 aa, Mycobacterium
VTVCIAISLVVYLFYLK

SEQ ID NO: 335830 - protein, 28 aa, Mycobacterium
VTVCLLVMYWPLGLVVLGSIVPIVATVL

SEQ ID NO: 335831 - protein, 23 aa, Mycobacterium
VTVCVLPALQFGFWLLQDSSMQS

SEQ ID NO: 335832 - protein, 17 aa, Mycobacterium
VTVELPQAGGLYPGGNV

SEQ ID NO: 335833 - protein, 18 aa, Mycobacterium
VTVFVSAFALILAMPVAL

SEQ ID NO: 335834 - protein, 17 aa, Mycobacterium
VTVGDAWEHGVMPYTTT

SEQ ID NO: 335835 - protein, 17 aa, Mycobacterium
VTVGLIGLIVMVFRFHS

SEQ ID NO: 335836 - protein, 27 aa, Mycobacterium
VTVIAFAVSIPMWWLLAGQQLGNLPVW

SEQ ID NO: 335837 - protein, 24 aa, Mycobacterium
VTVITVLYWRVDGVILSLLNTHSE

SEQ ID NO: 335838 - protein, 33 aa, Mycobacterium
VTVLAVALWRFRWFRLATSWALVAALGCLLAWS

SEQ ID NO: 335839 - protein, 27 aa, Mycobacterium
VTVLLWFPTTVAKLAMFVRATEPVPFA

SEQ ID NO: 335840 - protein, 25 aa, Mycobacterium
VTVNMGGRTIIIWKKKPSTSTHTPG

SEQ ID NO: 335841 - protein, 27 aa, Mycobacterium
VTVPICIVLGIGAAWLVERSDIPGRAI

SEQ ID NO: 335842 - protein, 22 aa, Mycobacterium
VTVPKALFWIALLWVAVTTVIA

SEQ ID NO: 335843 - protein, 25 aa, Mycobacterium
VTVPLSLWVTRSIAKRSRKLFVAQW

SEQ ID NO: 335844 - protein, 24 aa, Mycobacterium
VTVPLVLACVFGGLRISASTVEAR

SEQ ID NO: 335845 - protein, 23 aa, Mycobacterium
VTVRAGGMAIIYEELNRQTENDL

SEQ ID NO: 335846 - protein, 25 aa, Mycobacterium
VTVRSSDGGTEWRAVSRHDALGGYT

SEQ ID NO: 335847 - protein, 19 aa, Mycobacterium
VTVRWDPYPFILLNLAFST

SEQ ID NO: 335848 - protein, 22 aa, Mycobacterium
VTVTFMLVWLIDRRGWSVAGAG

SEQ ID NO: 335849 - protein, 28 aa, Mycobacterium
VTVVAIWLGRPLIWLSFNNEKLNAAFRY

SEQ ID NO: 335850 - protein, 23 aa, Mycobacterium
VTVVASYSWYYAWTPGTGYLANL

SEQ ID NO: 335851 - protein, 25 aa, Mycobacterium
VTVVAVVVVLGWSFFYFSDDTRGYK

SEQ ID NO: 335852 - protein, 24 aa, Mycobacterium
VTVVICVFGALLGLLVSGRKEHAE

SEQ ID NO: 335853 - protein, 22 aa, Mycobacterium
VTVVSAFIWRYAFAIDSGFVNQ

SEQ ID NO: 335854 - protein, 17 aa, Mycobacterium
VTVWRGRLSIALDALET

SEQ ID NO: 335855 - protein, 27 aa, Mycobacterium
VTWAVALLVWRYGRIEEKWGPTDLGAE

SEQ ID NO: 335856 - protein, 17 aa, Mycobacterium
VTYAAGLHRQAAEGLGR

SEQ ID NO: 335857 - protein, 18 aa, Mycobacterium
VTYLQAGTQWARRPGTAL

SEQ ID NO: 335858 - protein, 26 aa, Mycobacterium
VTYSYVMVCCAAFVNALMSIVAAAPA

SEQ ID NO: 335859 - protein, 24 aa, Mycobacterium
VVAACLAGAIAGFARLRPGVLHAR

SEQ ID NO: 335860 - protein, 18 aa, Mycobacterium
VVAAEAAESDGLADSAFT

SEQ ID NO: 335861 - protein, 17 aa, Mycobacterium
VVAAELFNGIPGVGGLV

SEQ ID NO: 335862 - protein, 18 aa, Mycobacterium
VVAAGWENVHFGLASGPP

SEQ ID NO: 335863 - protein, 18 aa, Mycobacterium
VVAALAWTLALLPQNPQA

SEQ ID NO: 335864 - protein, 23 aa, Mycobacterium
VVAALCLIFIIMLGITRSPVASA

SEQ ID NO: 335865 - protein, 23 aa, Mycobacterium
VVAALMLKAGWGLVRESGRIFLE

SEQ ID NO: 335866 - protein, 18 aa, Mycobacterium
VVAARFCARVAPHDLGPD

SEQ ID NO: 335867 - protein, 33 aa, Mycobacterium
VVAAVARWWVPEPRWAGGWLGLERAAHILVVRP

SEQ ID NO: 335868 - protein, 22 aa, Mycobacterium
VVACALSVFVTAPWQLIVLRLV

SEQ ID NO: 335869 - protein, 19 aa, Mycobacterium
VVACFIFFFIGGLMALLLR

SEQ ID NO: 335870 - protein, 27 aa, Mycobacterium
VVACYAMLKAFRFDLLTTPRLLHVTVP

SEQ ID NO: 335871 - protein, 41 aa, Mycobacterium
VVADARPGDLLYGLHAMLFNEPRVSEDQIMLSAKADLAKAE

SEQ ID NO: 335872 - protein, 19 aa, Mycobacterium
VVADGCWIAATVVAVVPAL

SEQ ID NO: 335873 - protein, 25 aa, Mycobacterium
VVAEAEAAAALARSAGADAALLVAD

SEQ ID NO: 335874 - protein, 26 aa, Mycobacterium
VVAEAWRSIKPSVFIPASLVIVTMIV

SEQ ID NO: 335875 - protein, 19 aa, Mycobacterium
VVAEMRKVIWPNRKQMLTY

SEQ ID NO: 335876 - protein, 21 aa, Mycobacterium
VVAEMRKVIWPNRKQMLTYTS

SEQ ID NO: 335877 - protein, 25 aa, Mycobacterium
VVAEMRKVIWPNRRQMITYTSVVLV

SEQ ID NO: 335878 - protein, 24 aa, Mycobacterium
VVAEVWKTTPFMSLLLLAGLALVP

SEQ ID NO: 335879 - protein, 18 aa, Mycobacterium
VVAFCAVSLTVGYLAPRV

SEQ ID NO: 335880 - protein, 18 aa, Mycobacterium
VVAFGWQIATMAALYGAI

SEQ ID NO: 335881 - protein, 20 aa, Mycobacterium
VVAFKAEVTALIQLYIVGVF

SEQ ID NO: 335882 - protein, 18 aa, Mycobacterium
VVAGAFVFSDLVMMKYLA

SEQ ID NO: 335883 - protein, 22 aa, Mycobacterium
VVAGAVIFWAFNRQLTATQLEN

SEQ ID NO: 335884 - protein, 23 aa, Mycobacterium
VVAGCAILAFFRPNMPLGDQPIV

SEQ ID NO: 335885 - protein, 27 aa, Mycobacterium
VVAGGSFRRWEAMMFLLIAVNVVIIPM

SEQ ID NO: 335886 - protein, 25 aa, Mycobacterium
VVAGLTVGWWVIQRNYYVAEYNGRV

SEQ ID NO: 335887 - protein, 19 aa, Mycobacterium
VVAHPLRRRVVMLLMLVGN

SEQ ID NO: 335888 - protein, 25 aa, Mycobacterium
VVAHWVWGPGGWLAKLGVLDYAGGL

SEQ ID NO: 335889 - protein, 18 aa, Mycobacterium
VVAIELRPLGVIQAPVRA

SEQ ID NO: 335890 - protein, 21 aa, Mycobacterium
VVAIFRIVFGFLFAVHGASKL

SEQ ID NO: 335891 - protein, 19 aa, Mycobacterium
VVAIIFPKPWSWADLSVVP

SEQ ID NO: 335892 - protein, 18 aa, Mycobacterium
VVAIQLVALLSMFTIGLP

SEQ ID NO: 335893 - protein, 20 aa, Mycobacterium
VVAIVVGLVRYRRRKIKLSA

SEQ ID NO: 335894 - protein, 28 aa, Mycobacterium
VVALALLFGVGDAWRISLDRPTPPAPGE

SEQ ID NO: 335895 - protein, 25 aa, Mycobacterium
VVALATSVLLGWKAVGRHCATVAAF

SEQ ID NO: 335896 - protein, 17 aa, Mycobacterium
VVALCDFGAGGTSVTLA

SEQ ID NO: 335897 - protein, 24 aa, Mycobacterium
VVALGGLFLWIGYRRRTGRLRRIA

SEQ ID NO: 335898 - protein, 26 aa, Mycobacterium
VVALMLRAGVVLVRAATLVFLEAAPA

SEQ ID NO: 335899 - protein, 22 aa, Mycobacterium
VVALPLALAFGISSGVGAAAGL

SEQ ID NO: 335900 - protein, 27 aa, Mycobacterium
VVALTVLWLLNIGEYLQDLTLRRTRRA

SEQ ID NO: 335901 - protein, 20 aa, Mycobacterium
VVALVVGLVRYRRRQIKLSA

SEQ ID NO: 335902 - protein, 18 aa, Mycobacterium
VVALVYIIGVILWAMTLS

SEQ ID NO: 335903 - protein, 25 aa, Mycobacterium
VVALWAYFIGWEWALLVIPLHLCGD

SEQ ID NO: 335904 - protein, 21 aa, Mycobacterium
VVAMIPLVWLLYTVVAKGISA

SEQ ID NO: 335905 - protein, 20 aa, Mycobacterium
VVAMLLVYAVVWYALSQTAW

SEQ ID NO: 335906 - protein, 24 aa, Mycobacterium
VVANRVSYFYDFRGPSMAIDTACS

SEQ ID NO: 335907 - protein, 23 aa, Mycobacterium
VVAQPRVAVAVPHARVLVYDELQ

SEQ ID NO: 335908 - protein, 35 aa, Mycobacterium
VVAQRFWELPPRFWLYCGFTAITMSGFATFGLLSF

SEQ ID NO: 335909 - protein, 17 aa, Mycobacterium
VVAREALQLSVFQRSPA

SEQ ID NO: 335910 - protein, 25 aa, Mycobacterium
VVARGYRRAYRWVEGALGIVFTAAG

SEQ ID NO: 335911 - protein, 28 aa, Mycobacterium
VVARLRLVPALCRLIDPPLIVLIREGEV

SEQ ID NO: 335912 - protein, 28 aa, Mycobacterium
VVARPYQWWRLGLVMASGAAYLAIFSLP

SEQ ID NO: 335913 - protein, 26 aa, Mycobacterium
VVASALPILWLVTRHPAVMVGVALVL

SEQ ID NO: 335914 - protein, 18 aa, Mycobacterium
VVASGWGPTAAWYQNVVH

SEQ ID NO: 335915 - protein, 20 aa, Mycobacterium
VVASVLYFLVAFAILIVGFV

SEQ ID NO: 335916 - protein, 18 aa, Mycobacterium
VVATAYLFFGALQVNPLD

SEQ ID NO: 335917 - protein, 19 aa, Mycobacterium
VVAVAARPAPGLTALTRAD

SEQ ID NO: 335918 - protein, 24 aa, Mycobacterium
VVAVALRLNTRWVAHVVLLIPTVI

SEQ ID NO: 335919 - protein, 28 aa, Mycobacterium
VVAVAPRLGAWVVAAWLAGIIIDLVTGP

SEQ ID NO: 335920 - protein, 20 aa, Mycobacterium
VVAVGLRWLPASGAAAPGAD

SEQ ID NO: 335921 - protein, 23 aa, Mycobacterium
VVAVLAGFSWSTLRRSVTLTAIG

SEQ ID NO: 335922 - protein, 19 aa, Mycobacterium
VVAVLAWQWRAHRGPGMVV

SEQ ID NO: 335923 - protein, 26 aa, Mycobacterium
VVAVLPALVWVLAALRRGRFGVDLIA

SEQ ID NO: 335924 - protein, 20 aa, Mycobacterium
VVAVLSMMVWISPLLALITL

SEQ ID NO: 335925 - protein, 25 aa, Mycobacterium
VVAVRRIGFSMARTSSRMIWTSRAW

SEQ ID NO: 335926 - protein, 28 aa, Mycobacterium
VVAVTVGAIFLHEPVGWSLLGGAALVLL

SEQ ID NO: 335927 - protein, 18 aa, Mycobacterium
VVAVVAAVLVWQWREHRG

SEQ ID NO: 335928 - protein, 23 aa, Mycobacterium
VVAVYRIRIGRRIGSAALVADGL

SEQ ID NO: 335929 - protein, 26 aa, Mycobacterium
VVAWVSLVVYAWRVSRAPRFAPEGAD

SEQ ID NO: 335930 - protein, 19 aa, Mycobacterium
VVAYCVVFLLLVGVLVVIA

SEQ ID NO: 335931 - protein, 17 aa, Mycobacterium
VVCAIGLGGVAGLGRVF

SEQ ID NO: 335932 - protein, 17 aa, Mycobacterium
VVCAIGLGSVAGISRVV

SEQ ID NO: 335933 - protein, 19 aa, Mycobacterium
VVCAVCVPAALMVMNPIHV

SEQ ID NO: 335934 - protein, 27 aa, Mycobacterium
VVCDRTRGAAFLAMFFASAGLFGVVLS

SEQ ID NO: 335935 - protein, 19 aa, Mycobacterium
VVCNVWRLFMQDNSKRPEP

SEQ ID NO: 335936 - protein, 20 aa, Mycobacterium
VVCTQAVMVLGRLNAADIDP

SEQ ID NO: 335937 - protein, 24 aa, Mycobacterium
VVCVAISVALTFLVINIRALLHDR

SEQ ID NO: 335938 - protein, 18 aa, Mycobacterium
VVCVLPINLGMFTAARVI

SEQ ID NO: 335939 - protein, 23 aa, Mycobacterium
VVCVLTLTIAGPVRTYFAQRTEM

SEQ ID NO: 335940 - protein, 20 aa, Mycobacterium
VVDFLDRRGAPRGGAVALVL

SEQ ID NO: 335941 - protein, 25 aa, Mycobacterium
VVDFLSIGWWPVFNVADPAVVGGAI

SEQ ID NO: 335942 - protein, 21 aa, Mycobacterium
VVDHRVRYALAAMLALFGAEI

SEQ ID NO: 335943 - protein, 23 aa, Mycobacterium
VVDLFLRRVFAIRWRVWLNTRLV

SEQ ID NO: 335944 - protein, 23 aa, Mycobacterium
VVDLLPMPSLRAQRLIAAAVILT

SEQ ID NO: 335945 - protein, 25 aa, Mycobacterium
VVDRRFKIGHGRLFAMYVAAYCVGR

SEQ ID NO: 335946 - protein, 24 aa, Mycobacterium
VVDRWSVLWFLAYQHISLVGQTLI

SEQ ID NO: 335947 - protein, 25 aa, Mycobacterium
VVDVSFPVGHRWARIDLPDDEYIPV

SEQ ID NO: 335948 - protein, 23 aa, Mycobacterium
VVEAAHAFSRFFTGQVTAAGKVP

SEQ ID NO: 335949 - protein, 19 aa, Mycobacterium
VVEAIKALNIRYIYTSTPT

SEQ ID NO: 335950 - protein, 18 aa, Mycobacterium
VVEKRAAVDEVLLVLDAT

SEQ ID NO: 335951 - protein, 19 aa, Mycobacterium
VVEMPRLNRWFMANINGLG

SEQ ID NO: 335952 - protein, 19 aa, Mycobacterium
VVETFGWRVAILGCGAAAA

SEQ ID NO: 335953 - protein, 19 aa, Mycobacterium
VVEVLALLELGERRADDRR

SEQ ID NO: 335954 - protein, 19 aa, Mycobacterium
VVFAWPGLGRLVFNAVAAR

SEQ ID NO: 335955 - protein, 19 aa, Mycobacterium
VVFFFVWMIAVAMLYLVLG

SEQ ID NO: 335956 - protein, 19 aa, Mycobacterium
VVFFVVYYLMFRFAITKWN

SEQ ID NO: 335957 - protein, 25 aa, Mycobacterium
VVFGDFRFGPTNVYHATFTNASRLK

SEQ ID NO: 335958 - protein, 18 aa, Mycobacterium
VVFGESLGSFGGEAPFLA

SEQ ID NO: 335959 - protein, 20 aa, Mycobacterium
VVFGESLGSFGGEAPFLALN

SEQ ID NO: 335960 - protein, 18 aa, Mycobacterium
VVFGGYFIIFMIYRSMNP

SEQ ID NO: 335961 - protein, 25 aa, Mycobacterium
VVFPLPVDIITPFLRHPEVLQGVVD

SEQ ID NO: 335962 - protein, 25 aa, Mycobacterium
VVFPLPVDIITPFLRNPEMLRGVVD

SEQ ID NO: 335963 - protein, 25 aa, Mycobacterium
VVFPLPVDIITPFLRQPELLQSVVD

SEQ ID NO: 335964 - protein, 17 aa, Mycobacterium
VVFSAVIIVASSVPLLL

SEQ ID NO: 335965 - protein, 17 aa, Mycobacterium
VVFTFIPTYFIKTLEFS

SEQ ID NO: 335966 - protein, 17 aa, Mycobacterium
VVFTFLPTYFIKTLGFT

SEQ ID NO: 335967 - protein, 17 aa, Mycobacterium
VVFTFMALFAINVIATA

SEQ ID NO: 335968 - protein, 26 aa, Mycobacterium
VVFYSAWIFFDGAWRALRARTLDMMV

SEQ ID NO: 335969 - protein, 19 aa, Mycobacterium
VVGACGWAFLIWGLYGYLW

SEQ ID NO: 335970 - protein, 20 aa, Mycobacterium
VVGACGWAFLIWGMYAYLWA

SEQ ID NO: 335971 - protein, 17 aa, Mycobacterium
VVGADWLVEGAVGIARE

SEQ ID NO: 335972 - protein, 25 aa, Mycobacterium
VVGALIWAGSLVWYIERVGNKPDFL

SEQ ID NO: 335973 - protein, 18 aa, Mycobacterium
VVGALPWLTASALGSLTS

SEQ ID NO: 335974 - protein, 23 aa, Mycobacterium
VVGARPPRPAAFHEWHAMSVEQV

SEQ ID NO: 335975 - protein, 21 aa, Mycobacterium
VVGAVLCLVARWRGWQLTEGP

SEQ ID NO: 335976 - protein, 22 aa, Mycobacterium
VVGCAVGGLILSMVQGRPMIAA

SEQ ID NO: 335977 - protein, 23 aa, Mycobacterium
VVGDFPIVVALLFSFVIALPLGI

SEQ ID NO: 335978 - protein, 17 aa, Mycobacterium
VVGDLMSVPGVPGMAQG

SEQ ID NO: 335979 - protein, 22 aa, Mycobacterium
VVGEILAGIVLGPALLGRLHFV

SEQ ID NO: 335980 - protein, 17 aa, Mycobacterium
VVGEIVAAIPRPVLGAA

SEQ ID NO: 335981 - protein, 17 aa, Mycobacterium
VVGELAALVAFSGAINQ

SEQ ID NO: 335982 - protein, 28 aa, Mycobacterium
VVGFLVCFAATIPLAGWFGDRFGRRRVY

SEQ ID NO: 335983 - protein, 18 aa, Mycobacterium
VVGFPLRPLHPARARAYD

SEQ ID NO: 335984 - protein, 18 aa, Mycobacterium
VVGGALAYLVVKTLINSM

SEQ ID NO: 335985 - protein, 24 aa, Mycobacterium
VVGGGLYWLAQVSWPAPRVVSSGS

SEQ ID NO: 335986 - protein, 25 aa, Mycobacterium
VVGGLAILVMVVWVGTALAISTAAS

SEQ ID NO: 335987 - protein, 22 aa, Mycobacterium
VVGGLLSILAVGLVTAMIFWMS

SEQ ID NO: 335988 - protein, 22 aa, Mycobacterium
VVGIGALAWIFWPDAEGGQDTS

SEQ ID NO: 335989 - protein, 21 aa, Mycobacterium
VVGILVSWGLVELFPGTLARP

SEQ ID NO: 335990 - protein, 17 aa, Mycobacterium
VVGLAVALWVVRTRALL

SEQ ID NO: 335991 - protein, 25 aa, Mycobacterium
VVGLGCGFGPLNNRFFPPLGSILYW

SEQ ID NO: 335992 - protein, 23 aa, Mycobacterium
VVGLGCGFGPLNNRFFPPMGSSL

SEQ ID NO: 335993 - protein, 24 aa, Mycobacterium
VVGLGCGFGPLNNRFFPPMGSVLY

SEQ ID NO: 335994 - protein, 18 aa, Mycobacterium
VVGLGFGIWFGFKALHGL

SEQ ID NO: 335995 - protein, 18 aa, Mycobacterium
VVGLGFGLLAVRATRPVL

SEQ ID NO: 335996 - protein, 19 aa, Mycobacterium
VVGLLDFGASASYVTLMEA

SEQ ID NO: 335997 - protein, 21 aa, Mycobacterium
VVGLLLKARSTGVVFQTADQV

SEQ ID NO: 335998 - protein, 25 aa, Mycobacterium
VVGLVCAAALFALRRAGLLDRGREV

SEQ ID NO: 335999 - protein, 17 aa, Mycobacterium
VVGPAVMFTLAWSLLGD

SEQ ID NO: 336000 - protein, 18 aa, Mycobacterium
VVGPEAINHIPLRMQVWQ

SEQ ID NO: 336001 - protein, 24 aa, Mycobacterium
VVGPIEILLPFVIRDHGGDPGAHA

SEQ ID NO: 336002 - protein, 30 aa, Mycobacterium
VVGPTIPWYQEFLRYYWLTVEESVDGSLAR

SEQ ID NO: 336003 - protein, 19 aa, Mycobacterium
VVGQLGMTIGIGLIVDTLI

SEQ ID NO: 336004 - protein, 19 aa, Mycobacterium
VVGQLGMTIGIGLVVDTLI

SEQ ID NO: 336005 - protein, 25 aa, Mycobacterium
VVGRRSRFVKIYGLRIDLQRLETSL

SEQ ID NO: 336006 - protein, 26 aa, Mycobacterium
VVGSAFWRKIYRRFGVRGMLLGSALC

SEQ ID NO: 336007 - protein, 24 aa, Mycobacterium
VVGSRFGLALVWVVVVGVVGICLF

SEQ ID NO: 336008 - protein, 24 aa, Mycobacterium
VVGVLHCIRESLVATVLALLFIPL

SEQ ID NO: 336009 - protein, 29 aa, Mycobacterium
VVGVVIYGLIRWSRARTAPPPPAPDLTPP

SEQ ID NO: 336010 - protein, 19 aa, Mycobacterium
VVGVWVVFVLALASWLLAG

SEQ ID NO: 336011 - protein, 18 aa, Mycobacterium
VVGWRGARWRRRTASLVA

SEQ ID NO: 336012 - protein, 19 aa, Mycobacterium
VVGYLRWTAPDDEFNRDRE

SEQ ID NO: 336013 - protein, 18 aa, Mycobacterium
VVGYRVIHVVGRIATVLG

SEQ ID NO: 336014 - protein, 17 aa, Mycobacterium
VVHAANLGAQVINISEA

SEQ ID NO: 336015 - protein, 18 aa, Mycobacterium
VVHFGVGLQAKYPLATVG

SEQ ID NO: 336016 - protein, 20 aa, Mycobacterium
VVHGDFRLGNLLADGPAINA

SEQ ID NO: 336017 - protein, 26 aa, Mycobacterium
VVHIAIKIPTMWSGLRSISPRDVLRT

SEQ ID NO: 336018 - protein, 17 aa, Mycobacterium
VVHLKWYDYPLTAVVSL

SEQ ID NO: 336019 - protein, 18 aa, Mycobacterium
VVHPSWWSAARVAVVTRA

SEQ ID NO: 336020 - protein, 24 aa, Mycobacterium
VVHPTFLYELLWNVLVFVLLIVVD

SEQ ID NO: 336021 - protein, 17 aa, Mycobacterium
VVHRAWVGPMVLVVLDD

SEQ ID NO: 336022 - protein, 17 aa, Mycobacterium
VVHVRWLAASDERTGSF

SEQ ID NO: 336023 - protein, 24 aa, Mycobacterium
VVIAIAIATFAVWFVAGPTPELTQ

SEQ ID NO: 336024 - protein, 23 aa, Mycobacterium
VVICDRLRIPPQPYLIAEVLASN

SEQ ID NO: 336025 - protein, 24 aa, Mycobacterium
VVIERGWYAIIRVDWWTHSLRGVL

SEQ ID NO: 336026 - protein, 17 aa, Mycobacterium
VVIGLLSARGSVAFLGY

SEQ ID NO: 336027 - protein, 24 aa, Mycobacterium
VVIGTAFTALVTRFTDSIITPLIN

SEQ ID NO: 336028 - protein, 33 aa, Mycobacterium
VVIGVAYARRLIRPRIALAVAVCTLAGQIMLAL

SEQ ID NO: 336029 - protein, 27 aa, Mycobacterium
VVIGWRSRRWRLLWVPVSVAFGALGAL

SEQ ID NO: 336030 - protein, 19 aa, Mycobacterium
VVIIFAMLLMVYRSVITVI

SEQ ID NO: 336031 - protein, 36 aa, Mycobacterium
VVIKKGHLKWAWIPGVPLLWDLAVTLTASWQKVFSA

SEQ ID NO: 336032 - protein, 18 aa, Mycobacterium
VVILEILVVMILFGACVV

SEQ ID NO: 336033 - protein, 17 aa, Mycobacterium
VVIMIMLAIVYRSVSTV

SEQ ID NO: 336034 - protein, 19 aa, Mycobacterium
VVIMIMLFIAYRSVSTVLL

SEQ ID NO: 336035 - protein, 19 aa, Mycobacterium
VVIMIMLFIVYRSVSTVLL

SEQ ID NO: 336036 - protein, 19 aa, Mycobacterium
VVIPAFMRAMFTVGLSDAE

SEQ ID NO: 336037 - protein, 22 aa, Mycobacterium
VVIPGIASVASWLQGAALTAMF

SEQ ID NO: 336038 - protein, 19 aa, Mycobacterium
VVISGHCANLAVSGVQNDI

SEQ ID NO: 336039 - protein, 22 aa, Mycobacterium
VVISGWALLTWILMAFGTCLSR

SEQ ID NO: 336040 - protein, 19 aa, Mycobacterium
VVITAEVFVACLGVCCLAL

SEQ ID NO: 336041 - protein, 24 aa, Mycobacterium
VVIVPLWRYRVHRWDISVDTATPA

SEQ ID NO: 336042 - protein, 21 aa, Mycobacterium
VVIYFLYGRRRSVLATRDTTP

SEQ ID NO: 336043 - protein, 18 aa, Mycobacterium
VVKACFYAVIATLAVAPL

SEQ ID NO: 336044 - protein, 25 aa, Mycobacterium
VVKFALGVFSAFGLVFVQFPGKTPV

SEQ ID NO: 336045 - protein, 18 aa, Mycobacterium
VVKLRRAALSGALLTGSV

SEQ ID NO: 336046 - protein, 18 aa, Mycobacterium
VVKPLGVFVVRNGEASWR

SEQ ID NO: 336047 - protein, 18 aa, Mycobacterium
VVLACAGLLWSDRITAEV

SEQ ID NO: 336048 - protein, 22 aa, Mycobacterium
VVLACGWAFLIWGLLLYLWSAV

SEQ ID NO: 336049 - protein, 26 aa, Mycobacterium
VVLAGELLCFVGMLVGVPVASLIQTY

SEQ ID NO: 336050 - protein, 19 aa, Mycobacterium
VVLAGILRVFARLRRGDYD

SEQ ID NO: 336051 - protein, 23 aa, Mycobacterium
VVLAGPVGWAVLWLVTVVPVVLV

SEQ ID NO: 336052 - protein, 19 aa, Mycobacterium
VVLAIGWGFLVWGMAMYVW

SEQ ID NO: 336053 - protein, 18 aa, Mycobacterium
VVLALVGGYFGLRKAGVV

SEQ ID NO: 336054 - protein, 19 aa, Mycobacterium
VVLARRWVAKLGAFNGALA

SEQ ID NO: 336055 - protein, 28 aa, Mycobacterium
VVLARRWVTRLGAFNGVLAAAGAYAAAM

SEQ ID NO: 336056 - protein, 26 aa, Mycobacterium
VVLAVRPELAPALAKQNWAALPGLQT

SEQ ID NO: 336057 - protein, 35 aa, Mycobacterium
VVLDWRLGLMCLAAFPILVALVWWFRNESARTYRK

SEQ ID NO: 336058 - protein, 18 aa, Mycobacterium
VVLERVFRGVTVVAGVLA

SEQ ID NO: 336059 - protein, 19 aa, Mycobacterium
VVLFFTFACALGVLRAVTG

SEQ ID NO: 336060 - protein, 18 aa, Mycobacterium
VVLFFVWMIAVAFLYLVL

SEQ ID NO: 336061 - protein, 19 aa, Mycobacterium
VVLFFVWMIAVAFLYLVLG

SEQ ID NO: 336062 - protein, 27 aa, Mycobacterium
VVLFGRLGDMYGRVRIYNIGFVVFTVA

SEQ ID NO: 336063 - protein, 30 aa, Mycobacterium
VVLFGRLGDMYGRVRIYNMGFVVFTVSAVV

SEQ ID NO: 336064 - protein, 18 aa, Mycobacterium
VVLFTCFAFLMAMPESAV

SEQ ID NO: 336065 - protein, 18 aa, Mycobacterium
VVLFTFVWWGVSHSRANW

SEQ ID NO: 336066 - protein, 27 aa, Mycobacterium
VVLGAGLIAFGVYRWLRRNDQSESPAW

SEQ ID NO: 336067 - protein, 20 aa, Mycobacterium
VVLGFRFRQGMIASLMWVSV

SEQ ID NO: 336068 - protein, 25 aa, Mycobacterium
VVLGLGYPVFIWLVAQLPGLQDKAD

SEQ ID NO: 336069 - protein, 19 aa, Mycobacterium
VVLGTLIWSAHRDEVAERV

SEQ ID NO: 336070 - protein, 17 aa, Mycobacterium
VVLGVIIWSGHRDQVAE

SEQ ID NO: 336071 - protein, 17 aa, Mycobacterium
VVLGWPDGLRLAVDNLV

SEQ ID NO: 336072 - protein, 17 aa, Mycobacterium
VVLIAAAVIVYVDRNGY

SEQ ID NO: 336073 - protein, 24 aa, Mycobacterium
VVLKESRDRLRLVQRQLRDHFREI

SEQ ID NO: 336074 - protein, 18 aa, Mycobacterium
VVLKGAGVDGPWSVIREI

SEQ ID NO: 336075 - protein, 18 aa, Mycobacterium
VVLLELVIGYKVFDLIVV

SEQ ID NO: 336076 - protein, 19 aa, Mycobacterium
VVLLIYLWVGIVAFGAAST

SEQ ID NO: 336077 - protein, 18 aa, Mycobacterium
VVLLKRFEPQQIVRWCLS

SEQ ID NO: 336078 - protein, 24 aa, Mycobacterium
VVLLLEVLFFRWLLHGTKKSEWLA

SEQ ID NO: 336079 - protein, 19 aa, Mycobacterium
VVLLLFAGFVVDEPFTDTV

SEQ ID NO: 336080 - protein, 19 aa, Mycobacterium
VVLLRGREAPPSAVPPGVL

SEQ ID NO: 336081 - protein, 17 aa, Mycobacterium
VVLLRRFTPQAITVAAL

SEQ ID NO: 336082 - protein, 19 aa, Mycobacterium
VVLLTFPPVFALSIVAGRA

SEQ ID NO: 336083 - protein, 24 aa, Mycobacterium
VVLLVSAWWLFDALWHPVRGRLAD

SEQ ID NO: 336084 - protein, 26 aa, Mycobacterium
VVLLVTSWLLAKSMGYLDRGVQVVAD

SEQ ID NO: 336085 - protein, 23 aa, Mycobacterium
VVLMCYENAWNLIAIAVLVPVLT

SEQ ID NO: 336086 - protein, 23 aa, Mycobacterium
VVLMGVAGYAVVSRALYDDIDDQ

SEQ ID NO: 336087 - protein, 18 aa, Mycobacterium
VVLPELPAGYADTYIDGV

SEQ ID NO: 336088 - protein, 17 aa, Mycobacterium
VVLPLVWALNALGWHAA

SEQ ID NO: 336089 - protein, 23 aa, Mycobacterium
VVLPPELARRVSVTTRQETGVLF

SEQ ID NO: 336090 - protein, 28 aa, Mycobacterium
VVLPPLLALCGRRLFWPFIPRAEDTTAL

SEQ ID NO: 336091 - protein, 28 aa, Mycobacterium
VVLPPLLALSGRRLFWPFIPEPDAGATL

SEQ ID NO: 336092 - protein, 20 aa, Mycobacterium
VVLREILHRVDLFATTARGE

SEQ ID NO: 336093 - protein, 24 aa, Mycobacterium
VVLSARLIFALPFSVLNYAAGASS

SEQ ID NO: 336094 - protein, 33 aa, Mycobacterium
VVLVAGWPRSRWWRRGASALAIPMSVLCAALAL

SEQ ID NO: 336095 - protein, 25 aa, Mycobacterium
VVLVGYCAGWLPWFADIDRQMYFFY

SEQ ID NO: 336096 - protein, 21 aa, Mycobacterium
VVLVICYLNLRGLKEAGMPFA

SEQ ID NO: 336097 - protein, 21 aa, Mycobacterium
VVLVVAAIGVWLATRPDSTPK

SEQ ID NO: 336098 - protein, 24 aa, Mycobacterium
VVLVVAGFLWLRGSGEKKLTVAAT

SEQ ID NO: 336099 - protein, 27 aa, Mycobacterium
VVLVVLAWRNRRIWVPAARTHRSSAVL

SEQ ID NO: 336100 - protein, 18 aa, Mycobacterium
VVLWASCLVISVRSGSAT

SEQ ID NO: 336101 - protein, 28 aa, Mycobacterium
VVLYLTLRFSTVLIRVLRDGGIMLLARV

SEQ ID NO: 336102 - protein, 27 aa, Mycobacterium
VVMAFSGIVPWWFVAILLARDGLLAAT

SEQ ID NO: 336103 - protein, 18 aa, Mycobacterium
VVMALGFVLTSQVTNRVL

SEQ ID NO: 336104 - protein, 17 aa, Mycobacterium
VVMFWRRSTLAGALLLP

SEQ ID NO: 336105 - protein, 23 aa, Mycobacterium
VVMIRGALLITRLTMTRLLVIDP

SEQ ID NO: 336106 - protein, 21 aa, Mycobacterium
VVMIVRFKFNPVVSLVVGSAY

SEQ ID NO: 336107 - protein, 18 aa, Mycobacterium
VVMRNRLAAVLMVGVTGY

SEQ ID NO: 336108 - protein, 18 aa, Mycobacterium
VVMSCFFGTLMVITQFFQ

SEQ ID NO: 336109 - protein, 18 aa, Mycobacterium
VVMSCYFGTLMVITQHFQ

SEQ ID NO: 336110 - protein, 24 aa, Mycobacterium
VVMSGGIVRRVRVAPAAPPPAPEP

SEQ ID NO: 336111 - protein, 24 aa, Mycobacterium
VVNGLRALPTLGVLLLGVLVFGLG

SEQ ID NO: 336112 - protein, 24 aa, Mycobacterium
VVNLLFGLLIAWVLVRDDFVGKRL

SEQ ID NO: 336113 - protein, 17 aa, Mycobacterium
VVNRRTGRKRTFNAKFV

SEQ ID NO: 336114 - protein, 17 aa, Mycobacterium
VVPAGGFDAVIVDLPDP

SEQ ID NO: 336115 - protein, 41 aa, Mycobacterium
VVPAIAGALGKWFWWSPVPLLRGLLFRWSKARSPRTAGVLS

SEQ ID NO: 336116 - protein, 30 aa, Mycobacterium
VVPAIATLLGRWFWWPAVVHDRAASRDTVA

SEQ ID NO: 336117 - protein, 23 aa, Mycobacterium
VVPARSLVGLAVGWVVGALVVLV

SEQ ID NO: 336118 - protein, 25 aa, Mycobacterium
VVPEAKRFCWNCGRPVGRSDSETKG

SEQ ID NO: 336119 - protein, 22 aa, Mycobacterium
VVPEAPPPVYVEPLAPAPYVPP

SEQ ID NO: 336120 - protein, 17 aa, Mycobacterium
VVPFLKFPANPPAASAE

SEQ ID NO: 336121 - protein, 18 aa, Mycobacterium
VVPLGVVVMFARRRPAFL

SEQ ID NO: 336122 - protein, 24 aa, Mycobacterium
VVPPVMKVLRERDAMVAKTAADTK

SEQ ID NO: 336123 - protein, 28 aa, Mycobacterium
VVPSLICALTVAWLDRFLAVGGESALFV

SEQ ID NO: 336124 - protein, 22 aa, Mycobacterium
VVPVDGRIAGAVAVLDESVLTG

SEQ ID NO: 336125 - protein, 26 aa, Mycobacterium
VVPVLPRLAKPAGLEFLGVGVVFACY

SEQ ID NO: 336126 - protein, 24 aa, Mycobacterium
VVQEMTVRLGIVTGRGHGALIRER

SEQ ID NO: 336127 - protein, 23 aa, Mycobacterium
VVQEMTVRLGIVTGRGHGSLIRE

SEQ ID NO: 336128 - protein, 17 aa, Mycobacterium
VVQGHFFVHSMIVASLV

SEQ ID NO: 336129 - protein, 18 aa, Mycobacterium
VVQLLSILCFGRLSDRLG

SEQ ID NO: 336130 - protein, 17 aa, Mycobacterium
VVQTHLFHDRIMRMDTV

SEQ ID NO: 336131 - protein, 18 aa, Mycobacterium
VVQYLRVALVTATIPLVV

SEQ ID NO: 336132 - protein, 20 aa, Mycobacterium
VVQYLRYLGGVLHGDLGRSY

SEQ ID NO: 336133 - protein, 17 aa, Mycobacterium
VVRAGVAYQARLKPAES

SEQ ID NO: 336134 - protein, 17 aa, Mycobacterium
VVRAKLYLQCAIAGTPR

SEQ ID NO: 336135 - protein, 18 aa, Mycobacterium
VVRAKLYLQCAIAGTPRL

SEQ ID NO: 336136 - protein, 23 aa, Mycobacterium
VVRAPRWPVWVVLGVLAVPAVIA

SEQ ID NO: 336137 - protein, 19 aa, Mycobacterium
VVRDIAAWVLRRKFSAAID

SEQ ID NO: 336138 - protein, 18 aa, Mycobacterium
VVRDMPAKGGVVLGTAPK

SEQ ID NO: 336139 - protein, 25 aa, Mycobacterium
VVRGARNYPCQEFPGKRAPTIQLCR

SEQ ID NO: 336140 - protein, 24 aa, Mycobacterium
VVRGLKMLLATVVVVVVGVGLGLV

SEQ ID NO: 336141 - protein, 27 aa, Mycobacterium
VVRGLPGWPIWFAVLWAAQEWLKSLMP

SEQ ID NO: 336142 - protein, 17 aa, Mycobacterium
VVRGRLVVRASAVGNQT

SEQ ID NO: 336143 - protein, 24 aa, Mycobacterium
VVRLPIGLLDRGRSGDLLARGTSD

SEQ ID NO: 336144 - protein, 18 aa, Mycobacterium
VVRLVRRLLPALVVVLAA

SEQ ID NO: 336145 - protein, 18 aa, Mycobacterium
VVRLVWVAVSAVIGYAAT

SEQ ID NO: 336146 - protein, 18 aa, Mycobacterium
VVRPLWLLLTQSLPRPLR

SEQ ID NO: 336147 - protein, 23 aa, Mycobacterium
VVRPRPAPAGARTGRRDDPVPPA

SEQ ID NO: 336148 - protein, 19 aa, Mycobacterium
VVRQIPVLIGSLVVGSATG

SEQ ID NO: 336149 - protein, 34 aa, Mycobacterium
VVRRDWRYAAALVGYCAGWLPWFANIDRQMYFFY

SEQ ID NO: 336150 - protein, 19 aa, Mycobacterium
VVRRDWRYGAVLVGYMAGF

SEQ ID NO: 336151 - protein, 19 aa, Mycobacterium
VVRRICWELPIYDPAQLPG

SEQ ID NO: 336152 - protein, 22 aa, Mycobacterium
VVRRPVVGFLWSWTSGRDQGWR

SEQ ID NO: 336153 - protein, 25 aa, Mycobacterium
VVRTPELYAWLVVALAGFAWEQAAF

SEQ ID NO: 336154 - protein, 19 aa, Mycobacterium
VVRYARHRVYVFVSSVDLS

SEQ ID NO: 336155 - protein, 27 aa, Mycobacterium
VVSAFAVAAVSSWLVIVPLTFGTALVL

SEQ ID NO: 336156 - protein, 22 aa, Mycobacterium
VVSAGWDMRLSVATSLLTALVY

SEQ ID NO: 336157 - protein, 26 aa, Mycobacterium
VVSALAFDYFRSWPDTAMGWPEPQDW

SEQ ID NO: 336158 - protein, 23 aa, Mycobacterium
VVSALGVLLMISATFNKPSAYST

SEQ ID NO: 336159 - protein, 30 aa, Mycobacterium
VVSAVAALVRARFPEMTARQVMQRIEDTAR

SEQ ID NO: 336160 - protein, 17 aa, Mycobacterium
VVSCGKPVAGNVVRIVD

SEQ ID NO: 336161 - protein, 19 aa, Mycobacterium
VVSCGKPVDGLRLRVVDSD

SEQ ID NO: 336162 - protein, 19 aa, Mycobacterium
VVSDIEWIRAPARGIGAWM

SEQ ID NO: 336163 - protein, 23 aa, Mycobacterium
VVSDIHLGPLLGRAHTERIVRMI

SEQ ID NO: 336164 - protein, 24 aa, Mycobacterium
VVSDRWYTVFLAALPFMLGLLTLT

SEQ ID NO: 336165 - protein, 17 aa, Mycobacterium
VVSFAAILWRLSGTLTV

SEQ ID NO: 336166 - protein, 20 aa, Mycobacterium
VVSFTAWLNAVAARARQAAR

SEQ ID NO: 336167 - protein, 24 aa, Mycobacterium
VVSIAAPALVGWAITHYGIQTPYL

SEQ ID NO: 336168 - protein, 22 aa, Mycobacterium
VVSKIDVHRGWREVVDANREAL

SEQ ID NO: 336169 - protein, 18 aa, Mycobacterium
VVSPAGWSVPVEPSDEGV

SEQ ID NO: 336170 - protein, 21 aa, Mycobacterium
VVSPCPRTELTAGQVRVAVAA

SEQ ID NO: 336171 - protein, 19 aa, Mycobacterium
VVSPFRLLAQQARLINAQS

SEQ ID NO: 336172 - protein, 19 aa, Mycobacterium
VVSSPSWFADYVLSVGAVD

SEQ ID NO: 336173 - protein, 24 aa, Mycobacterium
VVSTMCAGAFLGATMSRFVVAPVF

SEQ ID NO: 336174 - protein, 20 aa, Mycobacterium
VVSVLLGVGIGWGLYGNTRS

SEQ ID NO: 336175 - protein, 21 aa, Mycobacterium
VVSVVWWLAAVNLMLGLFNLL

SEQ ID NO: 336176 - protein, 25 aa, Mycobacterium
VVSYEIAMGLSFVAVFLYAGTMSTS

SEQ ID NO: 336177 - protein, 20 aa, Mycobacterium
VVTCFGFFFVGGLMALLMRA

SEQ ID NO: 336178 - protein, 30 aa, Mycobacterium
VVTDAGVGRPCASWMMPYTISAMRAAISTP

SEQ ID NO: 336179 - protein, 24 aa, Mycobacterium
VVTDCARNRVVALRGRSTQQKELP

SEQ ID NO: 336180 - protein, 24 aa, Mycobacterium
VVTESLLGGALAWLGNGFPDRGDG

SEQ ID NO: 336181 - protein, 19 aa, Mycobacterium
VVTGASIGNAVEWFDFAIY

SEQ ID NO: 336182 - protein, 23 aa, Mycobacterium
VVTGFICHVGWEVTSDIGNRLLD

SEQ ID NO: 336183 - protein, 18 aa, Mycobacterium
VVTIAGLVFAFTMGSMLT

SEQ ID NO: 336184 - protein, 23 aa, Mycobacterium
VVTIHLFGRPLGRLIDHDNTVEE

SEQ ID NO: 336185 - protein, 19 aa, Mycobacterium
VVTIPAAIMLARYQARRTV

SEQ ID NO: 336186 - protein, 30 aa, Mycobacterium
VVTLCGAVLIHGLCRWFFLNRAGAVRLTVL

SEQ ID NO: 336187 - protein, 22 aa, Mycobacterium
VVTLRRWLWPAVTAPVCCLALI

SEQ ID NO: 336188 - protein, 19 aa, Mycobacterium
VVTPAWYAPLVLTVGGIGE

SEQ ID NO: 336189 - protein, 19 aa, Mycobacterium
VVTPAWYAPLVLTVGGIGQ

SEQ ID NO: 336190 - protein, 17 aa, Mycobacterium
VVTRTGISLAIVSLVGV

SEQ ID NO: 336191 - protein, 26 aa, Mycobacterium
VVTSNQLVAWVCIGASALGVVLLIVD

SEQ ID NO: 336192 - protein, 24 aa, Mycobacterium
VVTSVCIAPGWVGADASGADQWHQ

SEQ ID NO: 336193 - protein, 20 aa, Mycobacterium
VVTVLHFATVFGLAALGRLL

SEQ ID NO: 336194 - protein, 17 aa, Mycobacterium
VVTVLLAGVLGWLLAGP

SEQ ID NO: 336195 - protein, 18 aa, Mycobacterium
VVVADLIAEFGWGITCFI

SEQ ID NO: 336196 - protein, 25 aa, Mycobacterium
VVVAEIINKFGWQMACLITIGAGLL

SEQ ID NO: 336197 - protein, 18 aa, Mycobacterium
VVVAGLIDEVGWPMLCVM

SEQ ID NO: 336198 - protein, 17 aa, Mycobacterium
VVVAGLIEQVGWQMLCL

SEQ ID NO: 336199 - protein, 20 aa, Mycobacterium
VVVAGLWCGINNTLITETVM

SEQ ID NO: 336200 - protein, 18 aa, Mycobacterium
VVVAICFVLTWSEATLGF

SEQ ID NO: 336201 - protein, 27 aa, Mycobacterium
VVVALAAPLGWFGFRVHLAGQAQARQG

SEQ ID NO: 336202 - protein, 20 aa, Mycobacterium
VVVALEIALAINIRPTVALR

SEQ ID NO: 336203 - protein, 20 aa, Mycobacterium
VVVALVLLWKSMGWLDRILT

SEQ ID NO: 336204 - protein, 22 aa, Mycobacterium
VVVAPCWIFRRGILAWNGQIAW

SEQ ID NO: 336205 - protein, 22 aa, Mycobacterium
VVVAPCWIFRRGVLAWNGQIAW

SEQ ID NO: 336206 - protein, 20 aa, Mycobacterium
VVVAPLWRYRVHRWEVDPTA

SEQ ID NO: 336207 - protein, 22 aa, Mycobacterium
VVVAPRLQHRFGTLPTLLVNLA

SEQ ID NO: 336208 - protein, 31 aa, Mycobacterium
VVVATVIAFWIGRPIIWLAFDNEKFNAAFRY

SEQ ID NO: 336209 - protein, 22 aa, Mycobacterium
VVVAVAAGLIWWTSDARATLSR

SEQ ID NO: 336210 - protein, 22 aa, Mycobacterium
VVVAVAITAWFAISKGDKTDTA

SEQ ID NO: 336211 - protein, 33 aa, Mycobacterium
VVVAVARWRGLRALIGIVVAFGVLVVFLLPALR

SEQ ID NO: 336212 - protein, 17 aa, Mycobacterium
VVVAVGFFVSTRIKGDS

SEQ ID NO: 336213 - protein, 22 aa, Mycobacterium
VVVAVTAALIWWTSDARATSSR

SEQ ID NO: 336214 - protein, 17 aa, Mycobacterium
VVVAVTGTTIWWTSDAR

SEQ ID NO: 336215 - protein, 22 aa, Mycobacterium
VVVEAFYLFSCRSLTHSAFRIG

SEQ ID NO: 336216 - protein, 41 aa, Mycobacterium
VVVEAFYLFSCRSLTRSAWRIGFWSNRWIIFGVAAQAIAQL

SEQ ID NO: 336217 - protein, 21 aa, Mycobacterium
VVVFQWGWLSSLGFDQLSSLD

SEQ ID NO: 336218 - protein, 18 aa, Mycobacterium
VVVGAFLGMKLYKQMTTK

SEQ ID NO: 336219 - protein, 19 aa, Mycobacterium
VVVGAGWVYNLGAKATTAS

SEQ ID NO: 336220 - protein, 23 aa, Mycobacterium
VVVGALLALLGFLKVRRIRGPRE

SEQ ID NO: 336221 - protein, 28 aa, Mycobacterium
VVVGGWPVWVALAVLVEWVLSAVPEVAR

SEQ ID NO: 336222 - protein, 18 aa, Mycobacterium
VVVGQHLNMPPPRISKRH

SEQ ID NO: 336223 - protein, 26 aa, Mycobacterium
VVVGSVILWSFFGDVLSKRSHKAAGR

SEQ ID NO: 336224 - protein, 18 aa, Mycobacterium
VVVGTLWLFGALAFVGRW

SEQ ID NO: 336225 - protein, 18 aa, Mycobacterium
VVVHGHFFIHSMIVAGLI

SEQ ID NO: 336226 - protein, 19 aa, Mycobacterium
VVVICVFYLAPQYQGAGLA

SEQ ID NO: 336227 - protein, 24 aa, Mycobacterium
VVVISMAMPLHFSGWEILVAALTT

SEQ ID NO: 336228 - protein, 23 aa, Mycobacterium
VVVIVGAALLWPSRQKVDIPLPY

SEQ ID NO: 336229 - protein, 25 aa, Mycobacterium
VVVLACIFILPGRRWVRPAEQWAAG

SEQ ID NO: 336230 - protein, 22 aa, Mycobacterium
VVVLLLGWSFFYFSDDTRGYKP

SEQ ID NO: 336231 - protein, 18 aa, Mycobacterium
VVVLMSFAVYAVISAALY

SEQ ID NO: 336232 - protein, 19 aa, Mycobacterium
VVVMIAALVLARWLANPAA

SEQ ID NO: 336233 - protein, 27 aa, Mycobacterium
VVVPHLGWRWMFFIGLVPAFVAWWMRR

SEQ ID NO: 336234 - protein, 18 aa, Mycobacterium
VVVPLIYVKNYIKVPPNE

SEQ ID NO: 336235 - protein, 18 aa, Mycobacterium
VVVPLTFATALVLGAIVA

SEQ ID NO: 336236 - protein, 25 aa, Mycobacterium
VVVPTWWPGQRVDVIVAAATCLPPG

SEQ ID NO: 336237 - protein, 18 aa, Mycobacterium
VVVQVRWPGAAAQHSGSL

SEQ ID NO: 336238 - protein, 22 aa, Mycobacterium
VVVRAGGGAMIYAQVNDQTVRD

SEQ ID NO: 336239 - protein, 27 aa, Mycobacterium
VVVRLPGWPLWFATLWVAAEWAKSTFP

SEQ ID NO: 336240 - protein, 28 aa, Mycobacterium
VVVRRLPAWPIWFALLWAAQEWLKSVFP

SEQ ID NO: 336241 - protein, 27 aa, Mycobacterium
VVVRRLPGWPLWFAGLWSAQEWLKSTV

SEQ ID NO: 336242 - protein, 19 aa, Mycobacterium
VVVSLPPPGPYFVDASGTE

SEQ ID NO: 336243 - protein, 17 aa, Mycobacterium
VVVSNHLNTPPPRISER

SEQ ID NO: 336244 - protein, 29 aa, Mycobacterium
VVVSVLICLGAALMAYFKPLGKQGSDQLL

SEQ ID NO: 336245 - protein, 21 aa, Mycobacterium
VVVTCPHCFNTLGKEYRQLGS

SEQ ID NO: 336246 - protein, 21 aa, Mycobacterium
VVVTCPHCFNTLGREYPQVGG

SEQ ID NO: 336247 - protein, 22 aa, Mycobacterium
VVVVELVGGLAVELQPASNTAA

SEQ ID NO: 336248 - protein, 21 aa, Mycobacterium
VVVVFLVTWPLVYLASKSPLW

SEQ ID NO: 336249 - protein, 17 aa, Mycobacterium
VVVVFPLLVFMLMRLNR

SEQ ID NO: 336250 - protein, 17 aa, Mycobacterium
VVVVGHRAPVLAIGDRV

SEQ ID NO: 336251 - protein, 20 aa, Mycobacterium
VVVVICIFYLVPQYQGAGLA

SEQ ID NO: 336252 - protein, 18 aa, Mycobacterium
VVVVLAFARDRLAGPAAH

SEQ ID NO: 336253 - protein, 26 aa, Mycobacterium
VVVVLALRRVWWLYKLIMSGQPASGR

SEQ ID NO: 336254 - protein, 26 aa, Mycobacterium
VVWQYIFGIPLYWVIFPLAVIILLAV

SEQ ID NO: 336255 - protein, 24 aa, Mycobacterium
VVWTPELYALLLVALGGFVGGQLA

SEQ ID NO: 336256 - protein, 27 aa, Mycobacterium
VVYALLPVLWIFSLSLKPTSTVKDGKL

SEQ ID NO: 336257 - protein, 23 aa, Mycobacterium
VVYEMIKKGWAAWTLIVFALVFG

SEQ ID NO: 336258 - protein, 18 aa, Mycobacterium
VVYHVMRMIGQWRGTVII

SEQ ID NO: 336259 - protein, 19 aa, Mycobacterium
VVYIKDELFLALGTASTEV

SEQ ID NO: 336260 - protein, 24 aa, Mycobacterium
VVYRNPRTMLLPLIAIGASMVIAQ

SEQ ID NO: 336261 - protein, 17 aa, Mycobacterium
VWAAMFIFDPVGKYLMP

SEQ ID NO: 336262 - protein, 23 aa, Mycobacterium
VWAFELTSALLITAAIGAMVLAH

SEQ ID NO: 336263 - protein, 18 aa, Mycobacterium
VWAGRPFHQAAWVNLKHG

SEQ ID NO: 336264 - protein, 18 aa, Mycobacterium
VWAILAAMGLVIPNAPAV

SEQ ID NO: 336265 - protein, 20 aa, Mycobacterium
VWAIVSLWILPGVHLTAGTM

SEQ ID NO: 336266 - protein, 19 aa, Mycobacterium
VWALMTWPWVRIRQNADAK

SEQ ID NO: 336267 - protein, 18 aa, Mycobacterium
VWALNALGWHAAAQVPLW

SEQ ID NO: 336268 - protein, 18 aa, Mycobacterium
VWAVCAALLVPLTISDVS

SEQ ID NO: 336269 - protein, 26 aa, Mycobacterium
VWAVPRYVRRDPIKSRVYSILLLIVL

SEQ ID NO: 336270 - protein, 24 aa, Mycobacterium
VWEAVDSRLGRRVAVKVLKQEFSS

SEQ ID NO: 336271 - protein, 21 aa, Mycobacterium
VWEFLTHPFEFLKDLLNKLVS

SEQ ID NO: 336272 - protein, 26 aa, Mycobacterium
VWEGVDSRLGRRVAIKVLKAEYSTDS

SEQ ID NO: 336273 - protein, 19 aa, Mycobacterium
VWFFLLKRYTVEGPLEHDA

SEQ ID NO: 336274 - protein, 17 aa, Mycobacterium
VWHNGWVSLAILAASIP

SEQ ID NO: 336275 - protein, 27 aa, Mycobacterium
VWILLNLGAFAWQWDPYPFILLNLAFS

SEQ ID NO: 336276 - protein, 19 aa, Mycobacterium
VWIRGRQGPNLADLVAQPD

SEQ ID NO: 336277 - protein, 18 aa, Mycobacterium
VWLGEISYEIFLIHLITM

SEQ ID NO: 336278 - protein, 18 aa, Mycobacterium
VWLGEISYELFLIHMILM

SEQ ID NO: 336279 - protein, 20 aa, Mycobacterium
VWLIVGGAAMFAAFPGWYAT

SEQ ID NO: 336280 - protein, 18 aa, Mycobacterium
VWLLSAVTVCVFGVAPRF

SEQ ID NO: 336281 - protein, 19 aa, Mycobacterium
VWLSDCWGLFVRPAGSGGA

SEQ ID NO: 336282 - protein, 20 aa, Mycobacterium
VWMIAVAFLYLVLGGMGVWS

SEQ ID NO: 336283 - protein, 25 aa, Mycobacterium
VWMSRPRRWSVLLASLLLGVAAVSR

SEQ ID NO: 336284 - protein, 23 aa, Mycobacterium
VWMVPLTVAVTWERFTQSPRRTA

SEQ ID NO: 336285 - protein, 19 aa, Mycobacterium
VWNDFLWPLLMIQRNSLAT

SEQ ID NO: 336286 - protein, 19 aa, Mycobacterium
VWNDFLWPLLMVQRDSIAT

SEQ ID NO: 336287 - protein, 19 aa, Mycobacterium
VWNNKVLRTLAFVDLAATG

SEQ ID NO: 336288 - protein, 22 aa, Mycobacterium
VWNVFKSWRFGEPVLVDDPWGH

SEQ ID NO: 336289 - protein, 21 aa, Mycobacterium
VWNVFKSWRYGEPVLVDDPWG

SEQ ID NO: 336290 - protein, 26 aa, Mycobacterium
VWNVFKSWRYGEPVSVDDPWGYGNSL

SEQ ID NO: 336291 - protein, 22 aa, Mycobacterium
VWNVFKSWRYGEPVTVDDPWGY

SEQ ID NO: 336292 - protein, 21 aa, Mycobacterium
VWNVFKSYRYGEVVTVDDPWG

SEQ ID NO: 336293 - protein, 22 aa, Mycobacterium
VWNWMIAAYLFSGGLSAGSALL

SEQ ID NO: 336294 - protein, 19 aa, Mycobacterium
VWPAGTCLGIDPATNQPTD

SEQ ID NO: 336295 - protein, 18 aa, Mycobacterium
VWPAGTCLGIDSTTNLPT

SEQ ID NO: 336296 - protein, 24 aa, Mycobacterium
VWPSRLRATGMGFAYGAGGLGKVV

SEQ ID NO: 336297 - protein, 22 aa, Mycobacterium
VWQHIFGIKLHWLVLPMSVIVL

SEQ ID NO: 336298 - protein, 17 aa, Mycobacterium
VWQSLRHPDTWVMSLLY

SEQ ID NO: 336299 - protein, 19 aa, Mycobacterium
VWQVIRMGLGPAQVAVVGT

SEQ ID NO: 336300 - protein, 21 aa, Mycobacterium
VWRKHICHKRVQGECQTRVLA

SEQ ID NO: 336301 - protein, 19 aa, Mycobacterium
VWRNLRFPTKTAPPGANVV

SEQ ID NO: 336302 - protein, 19 aa, Mycobacterium
VWSFARPGAPPIKLTDSLD

SEQ ID NO: 336303 - protein, 27 aa, Mycobacterium
VWSTESRWRPVAAILGVVVALGAVATA

SEQ ID NO: 336304 - protein, 21 aa, Mycobacterium
VWTLPAARLRRIPVIRGVHSY

SEQ ID NO: 336305 - protein, 24 aa, Mycobacterium
VWTVIAILALFGWPQIARIARSSV

SEQ ID NO: 336306 - protein, 24 aa, Mycobacterium
VWTVIAILALFGWPQIARVARGSV

SEQ ID NO: 336307 - protein, 19 aa, Mycobacterium
VWTVPGMAFLVLVAVGADY

SEQ ID NO: 336308 - protein, 21 aa, Mycobacterium
VWVNNSWVAAKCIAMSVVLGL

SEQ ID NO: 336309 - protein, 23 aa, Mycobacterium
VWVPRMLYLFGEQRMGLPEQAFT

SEQ ID NO: 336310 - protein, 23 aa, Mycobacterium
VWVRARQGPQLADLVAQPGTTRA

SEQ ID NO: 336311 - protein, 20 aa, Mycobacterium
VWVSLCIVFALLGLYLTYVG

SEQ ID NO: 336312 - protein, 18 aa, Mycobacterium
VWYGFGWESLLLETGFLM

SEQ ID NO: 336313 - protein, 27 aa, Mycobacterium
VWYLIVGAFVLRFLLKVKPIKERLPAW

SEQ ID NO: 336314 - protein, 19 aa, Mycobacterium
VWYLQRVGTEPNFLREWLP

SEQ ID NO: 336315 - protein, 17 aa, Mycobacterium
VWYPSTRPLNFVPASGL

SEQ ID NO: 336316 - protein, 21 aa, Mycobacterium
VYAGLLTPWWLRLLGATVGKG

SEQ ID NO: 336317 - protein, 26 aa, Mycobacterium
VYALLPVLWIFSLSLKPTSTVKDGKL

SEQ ID NO: 336318 - protein, 19 aa, Mycobacterium
VYASLLTPWWLRLLGAKVG

SEQ ID NO: 336319 - protein, 23 aa, Mycobacterium
VYASLRLADWWPDPDRFDPGRFL

SEQ ID NO: 336320 - protein, 17 aa, Mycobacterium
VYASMRLADWWPEPDEF

SEQ ID NO: 336321 - protein, 18 aa, Mycobacterium
VYATMAVTFLFAAPDMIV

SEQ ID NO: 336322 - protein, 18 aa, Mycobacterium
VYATMAVTFLFGGVDMIV

SEQ ID NO: 336323 - protein, 21 aa, Mycobacterium
VYAVCGFFVFLILRALGELVL

SEQ ID NO: 336324 - protein, 17 aa, Mycobacterium
VYAVLPLSGSSLPSQSV

SEQ ID NO: 336325 - protein, 34 aa, Mycobacterium
VYCACPSYFMSPAAFVRKPIRWMRMLAERDQPFT

SEQ ID NO: 336326 - protein, 24 aa, Mycobacterium
VYDAPRPVLGAAIAELVPDPARRA

SEQ ID NO: 336327 - protein, 22 aa, Mycobacterium
VYDGDRLWIRFIPDTEKRSQVI

SEQ ID NO: 336328 - protein, 26 aa, Mycobacterium
VYEGFPADLLYEFRLYALGTQIVVYA

SEQ ID NO: 336329 - protein, 17 aa, Mycobacterium
VYFAAYRWCIALQRSDR

SEQ ID NO: 336330 - protein, 19 aa, Mycobacterium
VYFAYSRKHSVLGLRVDVE

SEQ ID NO: 336331 - protein, 26 aa, Mycobacterium
VYFGARTGTGFGRDLRAAMFEHVITF

SEQ ID NO: 336332 - protein, 21 aa, Mycobacterium
VYFGPDYANFVAVTGNNPAAQ

SEQ ID NO: 336333 - protein, 18 aa, Mycobacterium
VYFSHALNKVWRRHMLAV

SEQ ID NO: 336334 - protein, 18 aa, Mycobacterium
VYFVGRLSAMVKTAGANV

SEQ ID NO: 336335 - protein, 18 aa, Mycobacterium
VYFVTYRWCIGLQRSDRA

SEQ ID NO: 336336 - protein, 20 aa, Mycobacterium
VYGARVSLTIGLIAMVGVLI

SEQ ID NO: 336337 - protein, 17 aa, Mycobacterium
VYGLLFAAYGSRSLFDF

SEQ ID NO: 336338 - protein, 25 aa, Mycobacterium
VYGSGLPSDIWKSTMDGALKGTSKE

SEQ ID NO: 336339 - protein, 20 aa, Mycobacterium
VYIALAVLIGAVWGTRRIFK

SEQ ID NO: 336340 - protein, 22 aa, Mycobacterium
VYIEAYGFLFVENFSIPVIGHW

SEQ ID NO: 336341 - protein, 17 aa, Mycobacterium
VYIFSLVGYHWLASTPG

SEQ ID NO: 336342 - protein, 18 aa, Mycobacterium
VYITAAFAAMFLFFKVLE

SEQ ID NO: 336343 - protein, 18 aa, Mycobacterium
VYLCLAAGVYFSARSRFV

SEQ ID NO: 336344 - protein, 28 aa, Mycobacterium
VYLGAFGLAGGLGWKLWDEHTVTQAGQA

SEQ ID NO: 336345 - protein, 25 aa, Mycobacterium
VYLLLERNLTRMLLGLLLIGNAVNL

SEQ ID NO: 336346 - protein, 25 aa, Mycobacterium
VYLLLERNLTRMLLGLLLISNAINL

SEQ ID NO: 336347 - protein, 24 aa, Mycobacterium
VYLLPLILWLWRGETTHDRHAAAR

SEQ ID NO: 336348 - protein, 22 aa, Mycobacterium
VYLLVRGRRAFFVPIIGCLAQV

SEQ ID NO: 336349 - protein, 19 aa, Mycobacterium
VYLPRTVLVDGQRPGPAAG

SEQ ID NO: 336350 - protein, 23 aa, Mycobacterium
VYLSMPFVAAFVGWSTKIVALEM

SEQ ID NO: 336351 - protein, 18 aa, Mycobacterium
VYLTFRIGLLSQHDAWYW

SEQ ID NO: 336352 - protein, 20 aa, Mycobacterium
VYLVAIAWFGLRASGRQKTS

SEQ ID NO: 336353 - protein, 18 aa, Mycobacterium
VYLVIAFTLLQAAVAVVC

SEQ ID NO: 336354 - protein, 26 aa, Mycobacterium
VYLVSRWVSLPGLVAVTARWDFAPGT

SEQ ID NO: 336355 - protein, 27 aa, Mycobacterium
VYLWLPGLVCLLALGELIWRGRGLLIT

SEQ ID NO: 336356 - protein, 19 aa, Mycobacterium
VYMGFWFPGVPRWVWVFSI

SEQ ID NO: 336357 - protein, 19 aa, Mycobacterium
VYMQVGFLLWLAVATTALS

SEQ ID NO: 336358 - protein, 23 aa, Mycobacterium
VYNMPVGLRLYGRLDAAALGAAL

SEQ ID NO: 336359 - protein, 18 aa, Mycobacterium
VYNPRLVMEEVLAIKPDI

SEQ ID NO: 336360 - protein, 18 aa, Mycobacterium
VYNRLAKHQKLEFDSTVN

SEQ ID NO: 336361 - protein, 24 aa, Mycobacterium
VYPDRLDAGLLRIAGVCVLASLMS

SEQ ID NO: 336362 - protein, 31 aa, Mycobacterium
VYQFRYIVIGVMVALCLGGGVYGISLGNHVT

SEQ ID NO: 336363 - protein, 19 aa, Mycobacterium
VYRFPRLARVTTLMLTVYF

SEQ ID NO: 336364 - protein, 26 aa, Mycobacterium
VYRLSRRGAPWSTRRTVSWLIGCLAL

SEQ ID NO: 336365 - protein, 20 aa, Mycobacterium
VYRPYPYVVAIVDELADLMM

SEQ ID NO: 336366 - protein, 22 aa, Mycobacterium
VYRYRFIVIGVTVALCLGGGVF

SEQ ID NO: 336367 - protein, 24 aa, Mycobacterium
VYRYRFIVVAAFVTVCLGSGLFGI

SEQ ID NO: 336368 - protein, 17 aa, Mycobacterium
VYRYRYIVIGVTVALCL

SEQ ID NO: 336369 - protein, 27 aa, Mycobacterium
VYSGRGWQWPGMGRQLLADEPAFAEAI

SEQ ID NO: 336370 - protein, 23 aa, Mycobacterium
VYSLDNKRLWSNLDCAPSNETLV

SEQ ID NO: 336371 - protein, 22 aa, Mycobacterium
VYSRLASRTRPLAVEPGVAPWR

SEQ ID NO: 336372 - protein, 26 aa, Mycobacterium
VYTETKLNSAFAFGGPKCLVKVIQKI

SEQ ID NO: 336373 - protein, 25 aa, Mycobacterium
VYTETKLNSSFSFGGPKCLVKVIQK

SEQ ID NO: 336374 - protein, 24 aa, Mycobacterium
VYVAGFRQGFFFFAILLTALSIIP

SEQ ID NO: 336375 - protein, 21 aa, Mycobacterium
VYVCGPTALLESVRIARDEHA

SEQ ID NO: 336376 - protein, 18 aa, Mycobacterium
VYVVWTRLILGGMDADQT

SEQ ID NO: 336377 - protein, 27 aa, Mycobacterium
VYWAKPEAMVWVALFWAFAALPADLHV

SEQ ID NO: 336378 - protein, 25 aa, Mycobacterium
VYWTILCAILIYLLAYGARAILILR

SEQ ID NO: 336379 - protein, 19 aa, Mycobacterium
VYYIAYRWAIGLQRSDRAV

SEQ ID NO: 336380 - protein, 19 aa, Mycobacterium
VYYPVSWIMWAWYKLFAAM

SEQ ID NO: 336381 - protein, 17 aa, Mycobacterium
WAAALLMGTITAVGGGT

SEQ ID NO: 336382 - protein, 17 aa, Mycobacterium
WAAALQWINLDNTWVEW

SEQ ID NO: 336383 - protein, 17 aa, Mycobacterium
WAAFALALFLAGLGAQL

SEQ ID NO: 336384 - protein, 19 aa, Mycobacterium
WAAFGYLAAVSMFLGFFAW

SEQ ID NO: 336385 - protein, 17 aa, Mycobacterium
WAAFLSWINLHGTWASW

SEQ ID NO: 336386 - protein, 20 aa, Mycobacterium
WAAFRLEVIGAALASAVLAV

SEQ ID NO: 336387 - protein, 24 aa, Mycobacterium
WAAGQLLCGWLVDRYGARSTLVST

SEQ ID NO: 336388 - protein, 25 aa, Mycobacterium
WAAGVLGALAIIIAVLIVINSRADS

SEQ ID NO: 336389 - protein, 25 aa, Mycobacterium
WAAGVLGALAIVIAILIVLNAQDRK

SEQ ID NO: 336390 - protein, 26 aa, Mycobacterium
WAAGVLGALAIVIAILIVLNHQDQQN

SEQ ID NO: 336391 - protein, 18 aa, Mycobacterium
WAAIEFTHITGLSEDQNN

SEQ ID NO: 336392 - protein, 18 aa, Mycobacterium
WAAIELAHLTGLAEDQNN

SEQ ID NO: 336393 - protein, 20 aa, Mycobacterium
WAAIVAVALLTWVLMHRATT

SEQ ID NO: 336394 - protein, 17 aa, Mycobacterium
WAALHVVGCRELRPQGR

SEQ ID NO: 336395 - protein, 18 aa, Mycobacterium
WAALPPLLVYAILGSSRQ

SEQ ID NO: 336396 - protein, 17 aa, Mycobacterium
WAALRNAPSVWLGGMLS

SEQ ID NO: 336397 - protein, 17 aa, Mycobacterium
WAANWLITVSFPELRNH

SEQ ID NO: 336398 - protein, 27 aa, Mycobacterium
WAAQEWLKSLVPFGGFPWGSVAFGQAQ

SEQ ID NO: 336399 - protein, 17 aa, Mycobacterium
WAARGGQRGVIYDIALW

SEQ ID NO: 336400 - protein, 18 aa, Mycobacterium
WAATAKWEGNQWKISNLL

SEQ ID NO: 336401 - protein, 26 aa, Mycobacterium
WAATRWELASVFPWFAGIVSAACLGA

SEQ ID NO: 336402 - protein, 23 aa, Mycobacterium
WAAVGVGVGALWIGVTDGDGVAI

SEQ ID NO: 336403 - protein, 19 aa, Mycobacterium
WAAVLVPACILIFAQLNLL

SEQ ID NO: 336404 - protein, 20 aa, Mycobacterium
WAAVMLVHYFFIARRQVDAE

SEQ ID NO: 336405 - protein, 32 aa, Mycobacterium
WAAVRPRLPRLLVCVGAGLLLYASFPPVNWWW

SEQ ID NO: 336406 - protein, 17 aa, Mycobacterium
WADAGTRTPAWAYSAIV

SEQ ID NO: 336407 - protein, 19 aa, Mycobacterium
WADAMDRRLLLIIASVGLA

SEQ ID NO: 336408 - protein, 19 aa, Mycobacterium
WADGWWFDPAIGLAVAVIA

SEQ ID NO: 336409 - protein, 25 aa, Mycobacterium
WAEAEIPGAGPIMLVAAHTRPPEKD

SEQ ID NO: 336410 - protein, 20 aa, Mycobacterium
WAEEAWGRYWGWDPKETVSF

SEQ ID NO: 336411 - protein, 21 aa, Mycobacterium
WAEEAWGRYWGWDPKETVSFI

SEQ ID NO: 336412 - protein, 21 aa, Mycobacterium
WAEEAWGRYWGWDPKETVSFV

SEQ ID NO: 336413 - protein, 21 aa, Mycobacterium
WAEETWGRFWGWDPKETVSFI

SEQ ID NO: 336414 - protein, 22 aa, Mycobacterium
WAEETWGRFWGWDPKETVSFIA

SEQ ID NO: 336415 - protein, 18 aa, Mycobacterium
WAELLGFARRFARQAYPA

SEQ ID NO: 336416 - protein, 23 aa, Mycobacterium
WAERRGRGDERWCEVPVGAKPNG

SEQ ID NO: 336417 - protein, 22 aa, Mycobacterium
WAFELTGALLITATIGAMVLAH

SEQ ID NO: 336418 - protein, 19 aa, Mycobacterium
WAFGPGLWNAWQQPTAEAI

SEQ ID NO: 336419 - protein, 17 aa, Mycobacterium
WAFLIWGLYGYLWAFVQ

SEQ ID NO: 336420 - protein, 29 aa, Mycobacterium
WAFLVCYLCAAALTWARYVRPRSPVASAP

SEQ ID NO: 336421 - protein, 17 aa, Mycobacterium
WAFVFPLGMYSAASFAM

SEQ ID NO: 336422 - protein, 18 aa, Mycobacterium
WAFVFPLGMYSAATEATA

SEQ ID NO: 336423 - protein, 17 aa, Mycobacterium
WAFVVGGAMPLIAAVAW

SEQ ID NO: 336424 - protein, 21 aa, Mycobacterium
WAGAFTFTAAVGFVGDYVFHD

SEQ ID NO: 336425 - protein, 17 aa, Mycobacterium
WAGAVLLAVEHSPRNRR

SEQ ID NO: 336426 - protein, 19 aa, Mycobacterium
WAGELTRFGVAVVGDVPVG

SEQ ID NO: 336427 - protein, 27 aa, Mycobacterium
WAGFALGIAMLLGGSWLTCLVAALTSA

SEQ ID NO: 336428 - protein, 24 aa, Mycobacterium
WAGFEFVNIVWPRTVSDAWYLNWG

SEQ ID NO: 336429 - protein, 21 aa, Mycobacterium
WAGGLLALLGHALRGGSHTDI

SEQ ID NO: 336430 - protein, 25 aa, Mycobacterium
WAGLGRRYPIVGVVFSLFLLAFAGI

SEQ ID NO: 336431 - protein, 17 aa, Mycobacterium
WAGLRGAVPVVLATFPI

SEQ ID NO: 336432 - protein, 17 aa, Mycobacterium
WAGLSTFMVLRLVFVGW

SEQ ID NO: 336433 - protein, 19 aa, Mycobacterium
WAGPVPVRLGSLVGADSTL

SEQ ID NO: 336434 - protein, 35 aa, Mycobacterium
WAGTIALLMSWRRGRLAPNWSFHFGLLLAGWGIFN

SEQ ID NO: 336435 - protein, 17 aa, Mycobacterium
WAGTKLIAVFLISVLLT

SEQ ID NO: 336436 - protein, 18 aa, Mycobacterium
WAGTKLLVVFGISVLLTF

SEQ ID NO: 336437 - protein, 25 aa, Mycobacterium
WAGVRTIVSPAWFSDYVLAVAAVTP

SEQ ID NO: 336438 - protein, 17 aa, Mycobacterium
WAGVSAFDADLMPPTVA

SEQ ID NO: 336439 - protein, 27 aa, Mycobacterium
WAGVSTLAIPAWWEQYVLSVGSVGPQG

SEQ ID NO: 336440 - protein, 18 aa, Mycobacterium
WAGVTSISIPSWWQPYVL

SEQ ID NO: 336441 - protein, 27 aa, Mycobacterium
WAGVTSVSIPSLWQPYVLSVASLTPEG

SEQ ID NO: 336442 - protein, 19 aa, Mycobacterium
WAGVVGVAFLANRIGDRFV

SEQ ID NO: 336443 - protein, 33 aa, Mycobacterium
WAGWLAFAATVPVQFVAGWPFLKGAVQQARAGS

SEQ ID NO: 336444 - protein, 26 aa, Mycobacterium
WAHSIGRIMLLAAVVGVVSVWLGLLL

SEQ ID NO: 336445 - protein, 17 aa, Mycobacterium
WAIADWRANRDPNKGTG

SEQ ID NO: 336446 - protein, 20 aa, Mycobacterium
WAIDVMTAWLDDRDDDLLHA

SEQ ID NO: 336447 - protein, 17 aa, Mycobacterium
WAIFGIRGALLPLLVVE

SEQ ID NO: 336448 - protein, 26 aa, Mycobacterium
WAIFHTLMIFWPFIQLAIQMAVVLAP

SEQ ID NO: 336449 - protein, 20 aa, Mycobacterium
WAILAVVVILLFGAKKLPDA

SEQ ID NO: 336450 - protein, 20 aa, Mycobacterium
WAILAVVVIVLFGAKKLPDA

SEQ ID NO: 336451 - protein, 21 aa, Mycobacterium
WAILAVVVIVLFGAKKLPDAA

SEQ ID NO: 336452 - protein, 17 aa, Mycobacterium
WAISPGFFRGRTLRRHS

SEQ ID NO: 336453 - protein, 17 aa, Mycobacterium
WAIYVVVGLGMAYMTYR

SEQ ID NO: 336454 - protein, 17 aa, Mycobacterium
WAKIFGMVGADPDEANR

SEQ ID NO: 336455 - protein, 25 aa, Mycobacterium
WAKIRGRLVPLLGLAVLEGAVLAVF

SEQ ID NO: 336456 - protein, 26 aa, Mycobacterium
WALACSVPVVLAGAVIIHLARSWSLA

SEQ ID NO: 336457 - protein, 28 aa, Mycobacterium
WALALGCSVLPLAAGQIWLAVRGRRGDL

SEQ ID NO: 336458 - protein, 17 aa, Mycobacterium
WALAWIALVGSALASAT

SEQ ID NO: 336459 - protein, 30 aa, Mycobacterium
WALFKNPWIMPAFGFAVGFISDYIALNMLF

SEQ ID NO: 336460 - protein, 17 aa, Mycobacterium
WALFTWMIARLPRERLP

SEQ ID NO: 336461 - protein, 25 aa, Mycobacterium
WALLTTMWFGFGWLTPVVTVFLSGL

SEQ ID NO: 336462 - protein, 24 aa, Mycobacterium
WALPERLRPAVLRPAPAAEQDGTA

SEQ ID NO: 336463 - protein, 19 aa, Mycobacterium
WALSVMFLVFSLRALLYKP

SEQ ID NO: 336464 - protein, 17 aa, Mycobacterium
WALTLPAALFVVGALTA

SEQ ID NO: 336465 - protein, 18 aa, Mycobacterium
WAMGVSRAQAVAFTDGAG

SEQ ID NO: 336466 - protein, 17 aa, Mycobacterium
WAMMVSLAQLWRSVGVV

SEQ ID NO: 336467 - protein, 23 aa, Mycobacterium
WAMPELVARVALAGLAVRAVRLM

SEQ ID NO: 336468 - protein, 18 aa, Mycobacterium
WAMVSLCLVSVWRSVPFA

SEQ ID NO: 336469 - protein, 19 aa, Mycobacterium
WANLLGIGEVDAFDPAARW

SEQ ID NO: 336470 - protein, 19 aa, Mycobacterium
WANNLYGNYAWWFRLSGLG

SEQ ID NO: 336471 - protein, 17 aa, Mycobacterium
WAPASPWATPPPSVMAL

SEQ ID NO: 336472 - protein, 17 aa, Mycobacterium
WAPILLVVLRFVQGFAV

SEQ ID NO: 336473 - protein, 19 aa, Mycobacterium
WAPSFAFLNIDTWQLVINT

SEQ ID NO: 336474 - protein, 24 aa, Mycobacterium
WAPTARLGSMYGYGVSYAVASLSC

SEQ ID NO: 336475 - protein, 25 aa, Mycobacterium
WAPTPRWVGASLWAFVATAMVLLFG

SEQ ID NO: 336476 - protein, 21 aa, Mycobacterium
WAQLMPDYTRPRVEIFTNGVQ

SEQ ID NO: 336477 - protein, 20 aa, Mycobacterium
WAQVMIGLWVALGGVYDGWT

SEQ ID NO: 336478 - protein, 18 aa, Mycobacterium
WARFSGPAVQLFADDVQA

SEQ ID NO: 336479 - protein, 21 aa, Mycobacterium
WARGCTSVGATLVFTGAGSMV

SEQ ID NO: 336480 - protein, 19 aa, Mycobacterium
WARIDPEMYPELVSALSED

SEQ ID NO: 336481 - protein, 24 aa, Mycobacterium
WARQHARRMVLIWVAVVLAITGLV

SEQ ID NO: 336482 - protein, 24 aa, Mycobacterium
WARQHARRTVLIWVAVVLAITGMV

SEQ ID NO: 336483 - protein, 26 aa, Mycobacterium
WARTRLPEYMVPKAFVALDQVPLTAN

SEQ ID NO: 336484 - protein, 20 aa, Mycobacterium
WASFGLRIALVPLFVVEVLG

SEQ ID NO: 336485 - protein, 21 aa, Mycobacterium
WASIIPAGWSFLLALRSRGLG

SEQ ID NO: 336486 - protein, 19 aa, Mycobacterium
WASLLRRRRKYAWSGFGFA

SEQ ID NO: 336487 - protein, 31 aa, Mycobacterium
WASRAFGPVTGWLGGWGIIAADVIVMANLAQ

SEQ ID NO: 336488 - protein, 18 aa, Mycobacterium
WATDASHKAAATSGVVAL

SEQ ID NO: 336489 - protein, 17 aa, Mycobacterium
WATIVACQLRFHRLTIS

SEQ ID NO: 336490 - protein, 18 aa, Mycobacterium
WATIVACQLRFHRLTTAG

SEQ ID NO: 336491 - protein, 25 aa, Mycobacterium
WATKHIPIGTAYAVWTGLGAALTVG

SEQ ID NO: 336492 - protein, 20 aa, Mycobacterium
WATPARWGFAASASTADLTK

SEQ ID NO: 336493 - protein, 20 aa, Mycobacterium
WATPARWGFATSASTVDLIK

SEQ ID NO: 336494 - protein, 20 aa, Mycobacterium
WATPARWGYAASASTIDTHR

SEQ ID NO: 336495 - protein, 18 aa, Mycobacterium
WATRAMVGEELWIAERPA

SEQ ID NO: 336496 - protein, 17 aa, Mycobacterium
WAVGLLMGVRTLSNQGM

SEQ ID NO: 336497 - protein, 17 aa, Mycobacterium
WAVIELTHLTGLSDEQN

SEQ ID NO: 336498 - protein, 18 aa, Mycobacterium
WAVLAFFAFVIWTLTTNT

SEQ ID NO: 336499 - protein, 18 aa, Mycobacterium
WAVLRLVLAAAMFYFGMA

SEQ ID NO: 336500 - protein, 20 aa, Mycobacterium
WAVLRTAAGKGREISPLLWV

SEQ ID NO: 336501 - protein, 20 aa, Mycobacterium
WAVPARWGYAASAATVNLRE

SEQ ID NO: 336502 - protein, 20 aa, Mycobacterium
WAVTGFKYLTGRTYRSSGSI

SEQ ID NO: 336503 - protein, 18 aa, Mycobacterium
WAVTLALALRAFPMLIDE

SEQ ID NO: 336504 - protein, 24 aa, Mycobacterium
WAWLACVPLAMAITAIAGLILGTP

SEQ ID NO: 336505 - protein, 21 aa, Mycobacterium
WAWLACVPLAMAVTALSGLIL

SEQ ID NO: 336506 - protein, 17 aa, Mycobacterium
WAYALTYYWGLVLSSQA

SEQ ID NO: 336507 - protein, 17 aa, Mycobacterium
WCAAGLVATPLALRAIA

SEQ ID NO: 336508 - protein, 17 aa, Mycobacterium
WCAFATVLATHVWRLNR

SEQ ID NO: 336509 - protein, 19 aa, Mycobacterium
WCALFPILWALSGSLKKSG

SEQ ID NO: 336510 - protein, 17 aa, Mycobacterium
WCALFPIMWALSGSLKR

SEQ ID NO: 336511 - protein, 19 aa, Mycobacterium
WCAPMIIALSSRLFAEGTV

SEQ ID NO: 336512 - protein, 17 aa, Mycobacterium
WCAVGLLATPLALRAAA

SEQ ID NO: 336513 - protein, 18 aa, Mycobacterium
WCDANRLGVDDCFAKFVS

SEQ ID NO: 336514 - protein, 17 aa, Mycobacterium
WCIAGIIVAAVTLVRSG

SEQ ID NO: 336515 - protein, 19 aa, Mycobacterium
WCLGMVLVFGAITLRMQRR

SEQ ID NO: 336516 - protein, 19 aa, Mycobacterium
WCLGMVLVFGTITLRMQRR

SEQ ID NO: 336517 - protein, 20 aa, Mycobacterium
WCLLTMLASVDMRFRDRYLI

SEQ ID NO: 336518 - protein, 26 aa, Mycobacterium
WCRYYRRNGWKYGTPRDDSRRIHDKL

SEQ ID NO: 336519 - protein, 17 aa, Mycobacterium
WCTASVVGIAIWLAVSD

SEQ ID NO: 336520 - protein, 18 aa, Mycobacterium
WCTVALMNLAMVALHTPM

SEQ ID NO: 336521 - protein, 18 aa, Mycobacterium
WCTVARNRAFWCFAAAMT

SEQ ID NO: 336522 - protein, 17 aa, Mycobacterium
WCVSAIVGAFAAHRGYR

SEQ ID NO: 336523 - protein, 17 aa, Mycobacterium
WDAAGWLMLTAINGQVL

SEQ ID NO: 336524 - protein, 17 aa, Mycobacterium
WDAEAGTAIGPRIETGG

SEQ ID NO: 336525 - protein, 31 aa, Mycobacterium
WDAIARFSSRYAVLIIGLWVLLAGAGNLLVP

SEQ ID NO: 336526 - protein, 19 aa, Mycobacterium
WDALWSRALKACGWAFLIW

SEQ ID NO: 336527 - protein, 17 aa, Mycobacterium
WDAPRVGAALVVALVSH

SEQ ID NO: 336528 - protein, 25 aa, Mycobacterium
WDDALRFAYFPVLFVALAVAVNVLY

SEQ ID NO: 336529 - protein, 21 aa, Mycobacterium
WDEIGQIAISWVLSPLLGGLV

SEQ ID NO: 336530 - protein, 24 aa, Mycobacterium
WDEKPWRVPVAFVIAQGTATVINF

SEQ ID NO: 336531 - protein, 20 aa, Mycobacterium
WDEVKEALTQLSVTLSPAAG

SEQ ID NO: 336532 - protein, 21 aa, Mycobacterium
WDEVKESLTQLAVQLGPTTGS

SEQ ID NO: 336533 - protein, 19 aa, Mycobacterium
WDGGLGIWGAVALGCVGAW

SEQ ID NO: 336534 - protein, 17 aa, Mycobacterium
WDGHGLLGLEDSLDAVL

SEQ ID NO: 336535 - protein, 17 aa, Mycobacterium
WDGHGLLGLEDSMDAVL

SEQ ID NO: 336536 - protein, 18 aa, Mycobacterium
WDGIKNAISAAWDFVSPI

SEQ ID NO: 336537 - protein, 23 aa, Mycobacterium
WDGKIRPGFEMLVDNFSAGILGM

SEQ ID NO: 336538 - protein, 17 aa, Mycobacterium
WDGLRLWVRENGKRLIT

SEQ ID NO: 336539 - protein, 17 aa, Mycobacterium
WDGPAWSISAEWLAYVL

SEQ ID NO: 336540 - protein, 26 aa, Mycobacterium
WDGPSAEFCVAAYAPYLAWLAATSAA

SEQ ID NO: 336541 - protein, 23 aa, Mycobacterium
WDGREKFPGLAWLRQPARYSDRE

SEQ ID NO: 336542 - protein, 21 aa, Mycobacterium
WDGRPRGVLVVGDTAKPTSAE

SEQ ID NO: 336543 - protein, 17 aa, Mycobacterium
WDKFPKFVLGFLAVSTI

SEQ ID NO: 336544 - protein, 17 aa, Mycobacterium
WDLLIAGISSLCLIFII

SEQ ID NO: 336545 - protein, 19 aa, Mycobacterium
WDLLIAGVAAICLIFIIML

SEQ ID NO: 336546 - protein, 17 aa, Mycobacterium
WDLLMLWLAQLHGGNGM

SEQ ID NO: 336547 - protein, 17 aa, Mycobacterium
WDLPDPTPLPAPPAKPK

SEQ ID NO: 336548 - protein, 18 aa, Mycobacterium
WDPDRRTFADMLLRTEVR

SEQ ID NO: 336549 - protein, 18 aa, Mycobacterium
WDPETGTYGPIWDEASGT

SEQ ID NO: 336550 - protein, 19 aa, Mycobacterium
WDPEWKMNPGKVIDPYRFD

SEQ ID NO: 336551 - protein, 18 aa, Mycobacterium
WDPGRQVIGLNLILSFSP

SEQ ID NO: 336552 - protein, 21 aa, Mycobacterium
WDPKETVSFIAWVAYAAYLHA

SEQ ID NO: 336553 - protein, 23 aa, Mycobacterium
WDPKETVSFIAWVVYAAYLHARS

SEQ ID NO: 336554 - protein, 18 aa, Mycobacterium
WDPVVGHGVVDALAAVSG

SEQ ID NO: 336555 - protein, 19 aa, Mycobacterium
WDPVWNYWFIEVLFLALVF

SEQ ID NO: 336556 - protein, 30 aa, Mycobacterium
WDRFGPRYLLACWVLAFVISLPIYSVLISL

SEQ ID NO: 336557 - protein, 24 aa, Mycobacterium
WDRHLRPRLAREFAAASGQRLVGD

SEQ ID NO: 336558 - protein, 20 aa, Mycobacterium
WDRRAVLICANLIRVLLVAL

SEQ ID NO: 336559 - protein, 22 aa, Mycobacterium
WDRVEARGEAAARAVLPGLAAK

SEQ ID NO: 336560 - protein, 25 aa, Mycobacterium
WDSAACKAWLLAQPFLAAGVLLVIY

SEQ ID NO: 336561 - protein, 25 aa, Mycobacterium
WDSAACKAWLLGHSYLLAVALLVAF

SEQ ID NO: 336562 - protein, 28 aa, Mycobacterium
WDSATCKAWLLAQPHLVAGILLVVYTAT

SEQ ID NO: 336563 - protein, 19 aa, Mycobacterium
WDSPLFLRINYVISGVWAA

SEQ ID NO: 336564 - protein, 25 aa, Mycobacterium
WDSSACKAWLLGHGYLVTTVLLVLS

SEQ ID NO: 336565 - protein, 23 aa, Mycobacterium
WDTIGRPIARRNLVFSIFAEHIG

SEQ ID NO: 336566 - protein, 17 aa, Mycobacterium
WDTLRAMGFDDDQIADS

SEQ ID NO: 336567 - protein, 17 aa, Mycobacterium
WDVGEVVELRGRRAPTQ

SEQ ID NO: 336568 - protein, 22 aa, Mycobacterium
WDVRCAPAAFRFMSQARHIGKV

SEQ ID NO: 336569 - protein, 22 aa, Mycobacterium
WDYPNVPLLCSLAVAGLLFISL

SEQ ID NO: 336570 - protein, 20 aa, Mycobacterium
WEALEHARIPASSLRGEAVG

SEQ ID NO: 336571 - protein, 20 aa, Mycobacterium
WEALEHARIPASSLRGESVG

SEQ ID NO: 336572 - protein, 20 aa, Mycobacterium
WEALEHARIPASSLRGGAVG

SEQ ID NO: 336573 - protein, 21 aa, Mycobacterium
WEALEHARIPASSLRGGSVGV

SEQ ID NO: 336574 - protein, 25 aa, Mycobacterium
WEALEHARIPPSSLRGGPVGVYVGV

SEQ ID NO: 336575 - protein, 17 aa, Mycobacterium
WEALRVADADGFVRAHD

SEQ ID NO: 336576 - protein, 18 aa, Mycobacterium
WEALRVADADGFVRAHPD

SEQ ID NO: 336577 - protein, 20 aa, Mycobacterium
WEAPSLCARWSVKDVVAHVI

SEQ ID NO: 336578 - protein, 22 aa, Mycobacterium
WEAVDSRLGRRVAVKVLKAEFS

SEQ ID NO: 336579 - protein, 17 aa, Mycobacterium
WEAVRAALDGGGLAPGW

SEQ ID NO: 336580 - protein, 22 aa, Mycobacterium
WEFLDLPRLWQILLTVGLFLWI

SEQ ID NO: 336581 - protein, 22 aa, Mycobacterium
WEFLVLLLIGGSLALLIMQMRR

SEQ ID NO: 336582 - protein, 17 aa, Mycobacterium
WEGFAGSLFFGITAAIL

SEQ ID NO: 336583 - protein, 17 aa, Mycobacterium
WEGLLSLLMPVIILGGI

SEQ ID NO: 336584 - protein, 23 aa, Mycobacterium
WEGTDSRLGRKVAVKVLKAEFSS

SEQ ID NO: 336585 - protein, 20 aa, Mycobacterium
WEIAQSVLIFLGIPLLAGYL

SEQ ID NO: 336586 - protein, 20 aa, Mycobacterium
WEIFGALLSGGRVVIASEGA

SEQ ID NO: 336587 - protein, 27 aa, Mycobacterium
WEKHCADIPICWSLRSIFDALDGVDQV

SEQ ID NO: 336588 - protein, 27 aa, Mycobacterium
WEKHCFDVPICWSFRSLFDSLDGIDKL

SEQ ID NO: 336589 - protein, 28 aa, Mycobacterium
WEKHCFDVPLCWSIRQIFDMFDSVDQLS

SEQ ID NO: 336590 - protein, 26 aa, Mycobacterium
WEKHCYDIPICFSLRSIFDTLDGVDL

SEQ ID NO: 336591 - protein, 26 aa, Mycobacterium
WEKHCYDIPICFSLRSVFDTLDGIDA

SEQ ID NO: 336592 - protein, 25 aa, Mycobacterium
WEKHCYDIPICLSLRSIFDALDGVD

SEQ ID NO: 336593 - protein, 27 aa, Mycobacterium
WEKHCYDIPICWSFRSIFDALDGLDQV

SEQ ID NO: 336594 - protein, 27 aa, Mycobacterium
WEKHCYDIPICWSFRSVFDALDGVDEI

SEQ ID NO: 336595 - protein, 27 aa, Mycobacterium
WEKHCYDIPICWSIRSLFDSLDGFDQL

SEQ ID NO: 336596 - protein, 26 aa, Mycobacterium
WEKHCYDIPICWSLRSIFDTLDGIDT

SEQ ID NO: 336597 - protein, 27 aa, Mycobacterium
WEKHCYDIPICWSLRSLFDALDGFDLL

SEQ ID NO: 336598 - protein, 22 aa, Mycobacterium
WEKLPPIRMVHRGTAASLRLVR

SEQ ID NO: 336599 - protein, 18 aa, Mycobacterium
WEKNLPYLLVIDEAAQFK

SEQ ID NO: 336600 - protein, 19 aa, Mycobacterium
WEKNPSPTFRSGEFNPAVP

SEQ ID NO: 336601 - protein, 17 aa, Mycobacterium
WELIACAVSGHATYAPD

SEQ ID NO: 336602 - protein, 35 aa, Mycobacterium
WELVSEVARFGVQMLFDLLQLVVAYVVLLAGYVLQ

SEQ ID NO: 336603 - protein, 24 aa, Mycobacterium
WEPLQRMAFRFNECSTQAVAAFAE

SEQ ID NO: 336604 - protein, 22 aa, Mycobacterium
WERAWLTWFWMGMALGYCVLAL

SEQ ID NO: 336605 - protein, 22 aa, Mycobacterium
WERERLPLETPVVLDWDSLPPV

SEQ ID NO: 336606 - protein, 24 aa, Mycobacterium
WERERRFDLAAAPLTRYTLVRRRD

SEQ ID NO: 336607 - protein, 19 aa, Mycobacterium
WERFRRAGTVIAEQRATAW

SEQ ID NO: 336608 - protein, 27 aa, Mycobacterium
WERHCSDIPICWSLRSLFDAIDGVDKL

SEQ ID NO: 336609 - protein, 26 aa, Mycobacterium
WERHCYDIPICFSLRSIFDALDGVDE

SEQ ID NO: 336610 - protein, 26 aa, Mycobacterium
WERHCYDIPICWSLRNIFETLDGVDT

SEQ ID NO: 336611 - protein, 27 aa, Mycobacterium
WERHCYDIPICWSLRSIFDALDGLDQI

SEQ ID NO: 336612 - protein, 27 aa, Mycobacterium
WERHCYDVPVCWALRSLFDALDGIDAV

SEQ ID NO: 336613 - protein, 25 aa, Mycobacterium
WERLRGRLLALIGLTLLEAVVLLAV

SEQ ID NO: 336614 - protein, 20 aa, Mycobacterium
WERSALVSGMMPATFTISED

SEQ ID NO: 336615 - protein, 18 aa, Mycobacterium
WERSGWRVFRLGARAPVG

SEQ ID NO: 336616 - protein, 23 aa, Mycobacterium
WERTGRPIARRNLVFSIFAEHIG

SEQ ID NO: 336617 - protein, 26 aa, Mycobacterium
WESAYKAAGLIGMFFIGVMIGAIASR

SEQ ID NO: 336618 - protein, 18 aa, Mycobacterium
WETLLFFAGLFIMVGALV

SEQ ID NO: 336619 - protein, 17 aa, Mycobacterium
WEVGLILTVFTMRIAAA

SEQ ID NO: 336620 - protein, 17 aa, Mycobacterium
WEVPILVVAVVWLAFEL

SEQ ID NO: 336621 - protein, 18 aa, Mycobacterium
WEVSCLRSERTGRHQRPA

SEQ ID NO: 336622 - protein, 18 aa, Mycobacterium
WEWLCARSEHSGSRQGAA

SEQ ID NO: 336623 - protein, 19 aa, Mycobacterium
WFAAMLFAVVPLRNILPGN

SEQ ID NO: 336624 - protein, 26 aa, Mycobacterium
WFAAVGRGVRRWALILIPLGAASFVL

SEQ ID NO: 336625 - protein, 24 aa, Mycobacterium
WFASRWRPGRSLVVGAMVMTASLF

SEQ ID NO: 336626 - protein, 19 aa, Mycobacterium
WFCYVRRPAAMPVTGTERH

SEQ ID NO: 336627 - protein, 26 aa, Mycobacterium
WFDALAGICAHVRRGGGGLTPSDILP

SEQ ID NO: 336628 - protein, 23 aa, Mycobacterium
WFDIPGGMKHRLLTAAGIGSVSD

SEQ ID NO: 336629 - protein, 25 aa, Mycobacterium
WFDLAARPDLDPALVSRTITRWDGD

SEQ ID NO: 336630 - protein, 26 aa, Mycobacterium
WFEIVPVTEFWARVPSALMVGVAAAG

SEQ ID NO: 336631 - protein, 24 aa, Mycobacterium
WFGDRWSAIFVICLSEIWKTTPFI

SEQ ID NO: 336632 - protein, 24 aa, Mycobacterium
WFGELGYRSVFTTQIITRLVIFFV

SEQ ID NO: 336633 - protein, 23 aa, Mycobacterium
WFGELGYRSVFTTVLATRLIVFV

SEQ ID NO: 336634 - protein, 23 aa, Mycobacterium
WFGELGYRSVFTTVLVTRFLVFL

SEQ ID NO: 336635 - protein, 23 aa, Mycobacterium
WFGELGYRSVFTTVLVTRIVVFL

SEQ ID NO: 336636 - protein, 19 aa, Mycobacterium
WFGGLLLGAIGDRFGRQPA

SEQ ID NO: 336637 - protein, 17 aa, Mycobacterium
WFGGSTWTTISSLVLLI

SEQ ID NO: 336638 - protein, 18 aa, Mycobacterium
WFGSVRYVFAPGRDVLAG

SEQ ID NO: 336639 - protein, 19 aa, Mycobacterium
WFGTMLFAIVPLRNILPGA

SEQ ID NO: 336640 - protein, 18 aa, Mycobacterium
WFGYRLIAAFERWTVPPT

SEQ ID NO: 336641 - protein, 17 aa, Mycobacterium
WFIDQLHGPSPVYNLAV

SEQ ID NO: 336642 - protein, 17 aa, Mycobacterium
WFIHSNWNFVFAVLPPY

SEQ ID NO: 336643 - protein, 17 aa, Mycobacterium
WFIHSNWNVAFGVLPPY

SEQ ID NO: 336644 - protein, 20 aa, Mycobacterium
WFIMCGTTAYLLVYSVLALV

SEQ ID NO: 336645 - protein, 17 aa, Mycobacterium
WFIPVSIAGELGSPQST

SEQ ID NO: 336646 - protein, 25 aa, Mycobacterium
WFLHFLLRHNMYWFVGYRIVVGVGV

SEQ ID NO: 336647 - protein, 22 aa, Mycobacterium
WFLHTTAGWLLATIVLVTRPTY

SEQ ID NO: 336648 - protein, 25 aa, Mycobacterium
WFLQRGLPLVLPRRVRARKLVQRSA

SEQ ID NO: 336649 - protein, 17 aa, Mycobacterium
WFLVATIPLAVMNLPVL

SEQ ID NO: 336650 - protein, 18 aa, Mycobacterium
WFLVATIPLAVMNLPVLY

SEQ ID NO: 336651 - protein, 26 aa, Mycobacterium
WFPGVPRWVWVFSIIFFIGAINLLSV

SEQ ID NO: 336652 - protein, 26 aa, Mycobacterium
WFRALACFKSAATWSLIVKHNRRRRA

SEQ ID NO: 336653 - protein, 23 aa, Mycobacterium
WFSARWRPGRSVYIGVALMAASF

SEQ ID NO: 336654 - protein, 23 aa, Mycobacterium
WFSDRCGCWTSLSVGLAILAVSY

SEQ ID NO: 336655 - protein, 17 aa, Mycobacterium
WFSPLAWAQQMRPFVDL

SEQ ID NO: 336656 - protein, 24 aa, Mycobacterium
WFTAKMWTFLFIYFWLRASLPRLR

SEQ ID NO: 336657 - protein, 18 aa, Mycobacterium
WFVARVSIIPTLLLAIPF

SEQ ID NO: 336658 - protein, 24 aa, Mycobacterium
WFVARVSIIPTLLLTIPFTVLVVF

SEQ ID NO: 336659 - protein, 18 aa, Mycobacterium
WFVARVSLAPTLLVAIPF

SEQ ID NO: 336660 - protein, 25 aa, Mycobacterium
WFVFSLFPIFWMLMLALKNAEEQTT

SEQ ID NO: 336661 - protein, 17 aa, Mycobacterium
WFVLPFTVIILLAVGSD

SEQ ID NO: 336662 - protein, 17 aa, Mycobacterium
WFVPLVVHLGYRGYVLG

SEQ ID NO: 336663 - protein, 25 aa, Mycobacterium
WFVWRPEERSQILLIAGGSGIVPLM

SEQ ID NO: 336664 - protein, 18 aa, Mycobacterium
WFWLLIYSDWVWPSLPPV

SEQ ID NO: 336665 - protein, 24 aa, Mycobacterium
WFYWALSVAVGLPIGLVLLTELHN

SEQ ID NO: 336666 - protein, 20 aa, Mycobacterium
WGAARLDSPTLRRWLRSYRT

SEQ ID NO: 336667 - protein, 18 aa, Mycobacterium
WGAEHIARVGRFGVLGLI

SEQ ID NO: 336668 - protein, 24 aa, Mycobacterium
WGAESYATILGRFHRPVAIAMALG

SEQ ID NO: 336669 - protein, 18 aa, Mycobacterium
WGARLRAFVVKKPDAEVD

SEQ ID NO: 336670 - protein, 18 aa, Mycobacterium
WGARLRAFVVKKPDTDLD

SEQ ID NO: 336671 - protein, 26 aa, Mycobacterium
WGAWQRRRGKLGWAAFAFGLPVLPVV

SEQ ID NO: 336672 - protein, 18 aa, Mycobacterium
WGDAPLWFVVAAFCAYSF

SEQ ID NO: 336673 - protein, 22 aa, Mycobacterium
WGETLTKGWQRLLGTLLGVPAG

SEQ ID NO: 336674 - protein, 22 aa, Mycobacterium
WGETLTKGWQRLLGTLLGVPCG

SEQ ID NO: 336675 - protein, 22 aa, Mycobacterium
WGETLTKGWQRLLGTVLGVPCG

SEQ ID NO: 336676 - protein, 17 aa, Mycobacterium
WGGAGYIRHTVKTASAT

SEQ ID NO: 336677 - protein, 20 aa, Mycobacterium
WGGMAVWLFAMFDMLDGAMA

SEQ ID NO: 336678 - protein, 25 aa, Mycobacterium
WGGVLKHWIGLLAMIFVVGAAQAYN

SEQ ID NO: 336679 - protein, 17 aa, Mycobacterium
WGHQWTIVTCWFGVIVW

SEQ ID NO: 336680 - protein, 20 aa, Mycobacterium
WGIVLKLGVPGAIGAFAGAT

SEQ ID NO: 336681 - protein, 24 aa, Mycobacterium
WGLAAAVCAACYFLMSDKAGAMSD

SEQ ID NO: 336682 - protein, 27 aa, Mycobacterium
WGLAGIWCGLTLFLVLRLVLVGWRALS

SEQ ID NO: 336683 - protein, 17 aa, Mycobacterium
WGLFGIWSGLSTFMVLR

SEQ ID NO: 336684 - protein, 17 aa, Mycobacterium
WGLGAALAMEKVPVERR

SEQ ID NO: 336685 - protein, 17 aa, Mycobacterium
WGLGAALAMEKVPVQRR

SEQ ID NO: 336686 - protein, 24 aa, Mycobacterium
WGLITALFIEQGWLQGIFAGLKDP

SEQ ID NO: 336687 - protein, 17 aa, Mycobacterium
WGLLELFPGTLARPDRF

SEQ ID NO: 336688 - protein, 21 aa, Mycobacterium
WGLQIDHFWWSAIWAAILLSI

SEQ ID NO: 336689 - protein, 18 aa, Mycobacterium
WGLVVPLALAAAVVAVDA

SEQ ID NO: 336690 - protein, 26 aa, Mycobacterium
WGMMLGFFSSIWIWNIFITFLPLFLQ

SEQ ID NO: 336691 - protein, 22 aa, Mycobacterium
WGNEILASLIWVAKGWAISAAV

SEQ ID NO: 336692 - protein, 23 aa, Mycobacterium
WGNGKPGLADRIFRWLAQGAGVL

SEQ ID NO: 336693 - protein, 20 aa, Mycobacterium
WGPGKARAVQEFAAANGVDL

SEQ ID NO: 336694 - protein, 18 aa, Mycobacterium
WGPRLLWRLFQLLTLAAL

SEQ ID NO: 336695 - protein, 22 aa, Mycobacterium
WGPTTLRALRNALRTNPSLSHG

SEQ ID NO: 336696 - protein, 18 aa, Mycobacterium
WGPVVWVLLGEMFPNRFR

SEQ ID NO: 336697 - protein, 18 aa, Mycobacterium
WGPVVWVLLGEMFPNRIR

SEQ ID NO: 336698 - protein, 24 aa, Mycobacterium
WGQLVGRYGLVVVLVWIGVGKYVK

SEQ ID NO: 336699 - protein, 20 aa, Mycobacterium
WGQPPPRPRRNVWLIVAAVA

SEQ ID NO: 336700 - protein, 39 aa, Mycobacterium
WGQQFWRVNAPFFWGRGTWRTWALLAFVMWHTVYMARVA

SEQ ID NO: 336701 - protein, 19 aa, Mycobacterium
WGQSTFRSSELGSYDALLA

SEQ ID NO: 336702 - protein, 25 aa, Mycobacterium
WGRLARIGWRLAVADRPDLVASTAT

SEQ ID NO: 336703 - protein, 17 aa, Mycobacterium
WGRRPLAVVPLGLMVLP

SEQ ID NO: 336704 - protein, 20 aa, Mycobacterium
WGRSGPMTRGLSALSRAVGV

SEQ ID NO: 336705 - protein, 17 aa, Mycobacterium
WGSIAGYAINPARDFGP

SEQ ID NO: 336706 - protein, 18 aa, Mycobacterium
WGSQWDLVRLPDDRRDGD

SEQ ID NO: 336707 - protein, 18 aa, Mycobacterium
WGSQWDLVRLPDDRRDND

SEQ ID NO: 336708 - protein, 18 aa, Mycobacterium
WGSQWDLVRLPEDRRDSD

SEQ ID NO: 336709 - protein, 25 aa, Mycobacterium
WGTFINLRCVCLAPPDAHHDTLAMV

SEQ ID NO: 336710 - protein, 24 aa, Mycobacterium
WGTSLPAAFSGWLLAGPVAIGVLA

SEQ ID NO: 336711 - protein, 40 aa, Mycobacterium
WGTTWGRAAALLLLGIGIAVLIVVGGWALTTEKSPRQGAQ

SEQ ID NO: 336712 - protein, 20 aa, Mycobacterium
WGVAPVRILVCASLGAGAAV

SEQ ID NO: 336713 - protein, 26 aa, Mycobacterium
WGVCAPEHVRFGLFIAIALADMSVPL

SEQ ID NO: 336714 - protein, 25 aa, Mycobacterium
WGVDGRLPLLISGGAGAVFALALLA

SEQ ID NO: 336715 - protein, 19 aa, Mycobacterium
WGVLVGFVALYLIGSLAGF

SEQ ID NO: 336716 - protein, 18 aa, Mycobacterium
WGVLVGFVALYLLGSLSG

SEQ ID NO: 336717 - protein, 17 aa, Mycobacterium
WGVNAVRVVTDHQALPA

SEQ ID NO: 336718 - protein, 18 aa, Mycobacterium
WGVPVNIAALVYGITAMV

SEQ ID NO: 336719 - protein, 20 aa, Mycobacterium
WGVRVGGLFTALGVTSVVIG

SEQ ID NO: 336720 - protein, 19 aa, Mycobacterium
WGWSSLPAIGSLVAAALAM

SEQ ID NO: 336721 - protein, 17 aa, Mycobacterium
WGYAFGVLPPFWAAKAF

SEQ ID NO: 336722 - protein, 18 aa, Mycobacterium
WHALDPEIVYARLAGGAR

SEQ ID NO: 336723 - protein, 18 aa, Mycobacterium
WHAPFPFNLIDGANSGWW

SEQ ID NO: 336724 - protein, 19 aa, Mycobacterium
WHAPGWPPPPSSPSRPQPA

SEQ ID NO: 336725 - protein, 19 aa, Mycobacterium
WHAPWPLNMWAGANTGWWP

SEQ ID NO: 336726 - protein, 25 aa, Mycobacterium
WHDDSRPGSEWARFTVKEMPVNKLY

SEQ ID NO: 336727 - protein, 18 aa, Mycobacterium
WHDGFRQWGVWLFGIWIP

SEQ ID NO: 336728 - protein, 23 aa, Mycobacterium
WHFMEVRHAPQWLKVTANGWLIA

SEQ ID NO: 336729 - protein, 23 aa, Mycobacterium
WHGVGLPLLLSIVVLATGFTVFL

SEQ ID NO: 336730 - protein, 19 aa, Mycobacterium
WHHTIPAPVWVALIMGLIF

SEQ ID NO: 336731 - protein, 22 aa, Mycobacterium
WHIWYWPTLCALVLVRTLFLLH

SEQ ID NO: 336732 - protein, 18 aa, Mycobacterium
WHLLFSFAAGALYFFFVL

SEQ ID NO: 336733 - protein, 17 aa, Mycobacterium
WHMPALLGVHLLFDGLG

SEQ ID NO: 336734 - protein, 18 aa, Mycobacterium
WHPVPNLASARLIAGTAA

SEQ ID NO: 336735 - protein, 18 aa, Mycobacterium
WHQVKVVSAPSWFSDYVL

SEQ ID NO: 336736 - protein, 18 aa, Mycobacterium
WHQVKVVSSPSWFSDYVL

SEQ ID NO: 336737 - protein, 19 aa, Mycobacterium
WHRVGDWVNRRPALVAVVA

SEQ ID NO: 336738 - protein, 24 aa, Mycobacterium
WHSHGGGWGHHGGWHRSWDDGGWD

SEQ ID NO: 336739 - protein, 17 aa, Mycobacterium
WHWPLLVYWLVYTGEAR

SEQ ID NO: 336740 - protein, 24 aa, Mycobacterium
WHYFPRHRFLFGDKYDSVMIDQRD

SEQ ID NO: 336741 - protein, 17 aa, Mycobacterium
WHYNELWLGGAAGPGEK

SEQ ID NO: 336742 - protein, 26 aa, Mycobacterium
WIAAAALFAMGLWRLVETALGRSCDR

SEQ ID NO: 336743 - protein, 22 aa, Mycobacterium
WIACRRRGIPLPAFADAIAPGI

SEQ ID NO: 336744 - protein, 23 aa, Mycobacterium
WIAFAGTAAHDWLFVTLVFALGA

SEQ ID NO: 336745 - protein, 17 aa, Mycobacterium
WIAGLNLNLVGFLVVGM

SEQ ID NO: 336746 - protein, 18 aa, Mycobacterium
WIAICVALSVFIPSLEEV

SEQ ID NO: 336747 - protein, 17 aa, Mycobacterium
WIAILAMVALFVLMKLI

SEQ ID NO: 336748 - protein, 17 aa, Mycobacterium
WIALALVVIAFTYLCFT

SEQ ID NO: 336749 - protein, 18 aa, Mycobacterium
WIALFAMSLLFGMMKMIH

SEQ ID NO: 336750 - protein, 18 aa, Mycobacterium
WIALNLFAVRLRWDPYPF

SEQ ID NO: 336751 - protein, 19 aa, Mycobacterium
WIAPRTDLSRRFWRRSGVN

SEQ ID NO: 336752 - protein, 25 aa, Mycobacterium
WIAVILLTFHWARVVWSRTAVQLAA

SEQ ID NO: 336753 - protein, 26 aa, Mycobacterium
WICAPLAIAVLWRWILAPTDGAVSTL

SEQ ID NO: 336754 - protein, 23 aa, Mycobacterium
WICAPLAIGVLWHWMLAPTDGAV

SEQ ID NO: 336755 - protein, 20 aa, Mycobacterium
WIDGCRELIQNAAMAANGSH

SEQ ID NO: 336756 - protein, 18 aa, Mycobacterium
WIDGCRELIQNAAQAANG

SEQ ID NO: 336757 - protein, 17 aa, Mycobacterium
WIDQAVVIWVLIALATA

SEQ ID NO: 336758 - protein, 19 aa, Mycobacterium
WIFYLFGAFLVYTAINLAR

SEQ ID NO: 336759 - protein, 18 aa, Mycobacterium
WIGPRAAAALAGLTLGAF

SEQ ID NO: 336760 - protein, 17 aa, Mycobacterium
WIGTMWKGQLTFETPMI

SEQ ID NO: 336761 - protein, 19 aa, Mycobacterium
WIITRGLRVVMLLIAAVLA

SEQ ID NO: 336762 - protein, 25 aa, Mycobacterium
WILGRGVPIALLLIGGLLAARFINW

SEQ ID NO: 336763 - protein, 18 aa, Mycobacterium
WILGRSGYEGVAHAVELA

SEQ ID NO: 336764 - protein, 17 aa, Mycobacterium
WILLTWTPTVENLLVGL

SEQ ID NO: 336765 - protein, 19 aa, Mycobacterium
WILLWSVLAFACFWVQTTV

SEQ ID NO: 336766 - protein, 20 aa, Mycobacterium
WILREFIETLKIGWAGLALV

SEQ ID NO: 336767 - protein, 25 aa, Mycobacterium
WILVALAAVCWLPAADRLERRQPFA

SEQ ID NO: 336768 - protein, 18 aa, Mycobacterium
WIMGGLRDGVALQTVESY

SEQ ID NO: 336769 - protein, 25 aa, Mycobacterium
WIMVMWKPDGAHGMYSWAHVLLTTA

SEQ ID NO: 336770 - protein, 27 aa, Mycobacterium
WINNSWVAAQCIIFAILLGLPIPYVLF

SEQ ID NO: 336771 - protein, 17 aa, Mycobacterium
WIPVAIGVAIALVVSLT

SEQ ID NO: 336772 - protein, 25 aa, Mycobacterium
WIPYARADLVLGIVVVIVGATALMA

SEQ ID NO: 336773 - protein, 19 aa, Mycobacterium
WIPYATTPVRLLWQLVSDI

SEQ ID NO: 336774 - protein, 25 aa, Mycobacterium
WIPYGRADLVIGIVVVMVGATALMA

SEQ ID NO: 336775 - protein, 17 aa, Mycobacterium
WIQAAAVMGGYQDVSAT

SEQ ID NO: 336776 - protein, 26 aa, Mycobacterium
WIQRRAVPLDSVYNWSPLAGLATQLT

SEQ ID NO: 336777 - protein, 30 aa, Mycobacterium
WIRAPARGIGAWMPCPLRVYGNAERDDAVA

SEQ ID NO: 336778 - protein, 19 aa, Mycobacterium
WIRDKELRARFTPDYDCGC

SEQ ID NO: 336779 - protein, 23 aa, Mycobacterium
WIRELRPHIDLYLLTDESIAAGA

SEQ ID NO: 336780 - protein, 24 aa, Mycobacterium
WIRQRSRWYKGYLQTMLVHLRHPA

SEQ ID NO: 336781 - protein, 19 aa, Mycobacterium
WIRRAHQRLSFQLSGAQLG

SEQ ID NO: 336782 - protein, 17 aa, Mycobacterium
WIRSELKNFGVTRFGDL

SEQ ID NO: 336783 - protein, 18 aa, Mycobacterium
WISPRKHQDFAWAWVCRL

SEQ ID NO: 336784 - protein, 25 aa, Mycobacterium
WISYARADLVLGIVVVMVGATALMA

SEQ ID NO: 336785 - protein, 20 aa, Mycobacterium
WITPARWGFAASASTVDLIR

SEQ ID NO: 336786 - protein, 24 aa, Mycobacterium
WITPVGPVALGFKVVALAVGASTF

SEQ ID NO: 336787 - protein, 18 aa, Mycobacterium
WITRRTVLALRWAIEERQ

SEQ ID NO: 336788 - protein, 18 aa, Mycobacterium
WIVCWLVLVWVLLWGNIS

SEQ ID NO: 336789 - protein, 17 aa, Mycobacterium
WIVGRFGGYEGVVEAVE

SEQ ID NO: 336790 - protein, 32 aa, Mycobacterium
WIVIGLVVGAWLNWKFVAPRLRAYTEIANNSI

SEQ ID NO: 336791 - protein, 18 aa, Mycobacterium
WIVLAAAVAQGFADAVDK

SEQ ID NO: 336792 - protein, 23 aa, Mycobacterium
WIWCGANIAPINWVLGALGITLG

SEQ ID NO: 336793 - protein, 17 aa, Mycobacterium
WKEQRDTEIAGRQALSA

SEQ ID NO: 336794 - protein, 18 aa, Mycobacterium
WKGDLTAGLQDAAEHLPP

SEQ ID NO: 336795 - protein, 21 aa, Mycobacterium
WKKFVRLFVGLSFAALAIYAL

SEQ ID NO: 336796 - protein, 23 aa, Mycobacterium
WKKGLRHSVYFTHGIRNAVDNGH

SEQ ID NO: 336797 - protein, 22 aa, Mycobacterium
WKKGLRHSVYFTHGVRNAVDSG

SEQ ID NO: 336798 - protein, 17 aa, Mycobacterium
WKLPPDFGQRSNSGLYH

SEQ ID NO: 336799 - protein, 19 aa, Mycobacterium
WKLVGVGIDPGSTVTALAN

SEQ ID NO: 336800 - protein, 20 aa, Mycobacterium
WKMNPGKVIDPYRFDENLKL

SEQ ID NO: 336801 - protein, 24 aa, Mycobacterium
WKPTRPKRFAWLLGAALAATCLAM

SEQ ID NO: 336802 - protein, 25 aa, Mycobacterium
WKPVGRPRVAGVSSFGFGGTNAHVV

SEQ ID NO: 336803 - protein, 25 aa, Mycobacterium
WKPWLRGTAFGFPFGALPAGGAELP

SEQ ID NO: 336804 - protein, 19 aa, Mycobacterium
WKQIDVELQRRHDLIPNLI

SEQ ID NO: 336805 - protein, 27 aa, Mycobacterium
WKQSGERRMLCGLQLLGPGDTQLEFTG

SEQ ID NO: 336806 - protein, 19 aa, Mycobacterium
WKRDEVDHALALTGPAHAV

SEQ ID NO: 336807 - protein, 20 aa, Mycobacterium
WKRLIWPVLVLIVVTGLAAF

SEQ ID NO: 336808 - protein, 37 aa, Mycobacterium
WKRVAVLFAGPGMNFVICLVLIYGIAVVWGLPNLHPP

SEQ ID NO: 336809 - protein, 20 aa, Mycobacterium
WKSFDLFVGAIQAFIFALLT

SEQ ID NO: 336810 - protein, 19 aa, Mycobacterium
WKSFRGVMAACLILEAIVV

SEQ ID NO: 336811 - protein, 18 aa, Mycobacterium
WKSFRGVMAGTLILEAIV

SEQ ID NO: 336812 - protein, 18 aa, Mycobacterium
WKTIKRLVLEGVDDPSSV

SEQ ID NO: 336813 - protein, 21 aa, Mycobacterium
WKTIMRIVFPIAMPGIVSGVL

SEQ ID NO: 336814 - protein, 18 aa, Mycobacterium
WKTYFGPTGKGFGAALQI

SEQ ID NO: 336815 - protein, 19 aa, Mycobacterium
WKVLIPVSLLWIMVVAITR

SEQ ID NO: 336816 - protein, 17 aa, Mycobacterium
WLAAILVPPATALFIHF

SEQ ID NO: 336817 - protein, 17 aa, Mycobacterium
WLAAIVSVLGTWISAAA

SEQ ID NO: 336818 - protein, 19 aa, Mycobacterium
WLAALGVGFLGMLVARRRS

SEQ ID NO: 336819 - protein, 22 aa, Mycobacterium
WLADHVIGGVVLFPGAGFVELA

SEQ ID NO: 336820 - protein, 24 aa, Mycobacterium
WLADWRFLAICGVLALIATLALLP

SEQ ID NO: 336821 - protein, 21 aa, Mycobacterium
WLAEFEPMHQVFLGARSLLYF

SEQ ID NO: 336822 - protein, 18 aa, Mycobacterium
WLAIAAWAALAVVAVALI

SEQ ID NO: 336823 - protein, 17 aa, Mycobacterium
WLAIIMVPIYWIVITSL

SEQ ID NO: 336824 - protein, 27 aa, Mycobacterium
WLAILSLRLIPAVPFAALNYGAGASAV

SEQ ID NO: 336825 - protein, 28 aa, Mycobacterium
WLALPRRPSVLAGKWVFYGLLGAVLSLV

SEQ ID NO: 336826 - protein, 18 aa, Mycobacterium
WLALVFGSYLVFIAVREI

SEQ ID NO: 336827 - protein, 17 aa, Mycobacterium
WLALVWVIVETVNVLWP

SEQ ID NO: 336828 - protein, 18 aa, Mycobacterium
WLANLPFFQTMFAGIDPY

SEQ ID NO: 336829 - protein, 18 aa, Mycobacterium
WLANWRFVAQKTDYFTQG

SEQ ID NO: 336830 - protein, 25 aa, Mycobacterium
WLAPWAAVMLVHWFGVARRQVDPAT

SEQ ID NO: 336831 - protein, 17 aa, Mycobacterium
WLARKVVVTVRRKYGRC

SEQ ID NO: 336832 - protein, 20 aa, Mycobacterium
WLARLGDWSGRRFKRPPWVA

SEQ ID NO: 336833 - protein, 19 aa, Mycobacterium
WLARLRRPTLVLGSAVVLL

SEQ ID NO: 336834 - protein, 25 aa, Mycobacterium
WLATFEPMHQVFLGVRSLLYLDGHA

SEQ ID NO: 336835 - protein, 17 aa, Mycobacterium
WLAYAVAAVLGVASLAI

SEQ ID NO: 336836 - protein, 18 aa, Mycobacterium
WLDDSYRDGSMSVDGNGR

SEQ ID NO: 336837 - protein, 29 aa, Mycobacterium
WLDGDSARWPGIKGVALVAMPGQDPVVVE

SEQ ID NO: 336838 - protein, 18 aa, Mycobacterium
WLDGRAYYRSRFIDDSID

SEQ ID NO: 336839 - protein, 28 aa, Mycobacterium
WLDRVQAFDVFSSFWFTSIYVLLFVSLV

SEQ ID NO: 336840 - protein, 27 aa, Mycobacterium
WLDRWEPEPPRLLIFAFIWGTSVAVVV

SEQ ID NO: 336841 - protein, 25 aa, Mycobacterium
WLDYELDVAKLLDFPVMTDMRDPIT

SEQ ID NO: 336842 - protein, 24 aa, Mycobacterium
WLEHSRELAEWLLEREKSVASSAE

SEQ ID NO: 336843 - protein, 17 aa, Mycobacterium
WLENGWVMAIVAVLLVV

SEQ ID NO: 336844 - protein, 34 aa, Mycobacterium
WLESLWIGAVYRYPWPVSMWPEALAMAVPAAIAM

SEQ ID NO: 336845 - protein, 19 aa, Mycobacterium
WLFALSWMVIGVIVYFAYS

SEQ ID NO: 336846 - protein, 18 aa, Mycobacterium
WLFAMFDMLDGAMARARG

SEQ ID NO: 336847 - protein, 19 aa, Mycobacterium
WLFGAGALTASVTWFVGLG

SEQ ID NO: 336848 - protein, 27 aa, Mycobacterium
WLFGEPRSGGTGDHWVVDLAPMLNDSS

SEQ ID NO: 336849 - protein, 17 aa, Mycobacterium
WLFMLVLGVCFFLASSG

SEQ ID NO: 336850 - protein, 17 aa, Mycobacterium
WLFMRFSGVVLVFLALG

SEQ ID NO: 336851 - protein, 20 aa, Mycobacterium
WLFRHLSGYASRAGSFVPGT

SEQ ID NO: 336852 - protein, 17 aa, Mycobacterium
WLFSALFTPAIRLTNGA

SEQ ID NO: 336853 - protein, 18 aa, Mycobacterium
WLFVSILGPIGFAGIALV

SEQ ID NO: 336854 - protein, 18 aa, Mycobacterium
WLGAALIGTAVAAFVFGV

SEQ ID NO: 336855 - protein, 20 aa, Mycobacterium
WLGAGFPVAAAFTAAVAVLV

SEQ ID NO: 336856 - protein, 17 aa, Mycobacterium
WLGALLIAGGARLCSVV

SEQ ID NO: 336857 - protein, 17 aa, Mycobacterium
WLGAVGLAGGLSAVLLA

SEQ ID NO: 336858 - protein, 18 aa, Mycobacterium
WLGAVPMGVLCYRHRIRV

SEQ ID NO: 336859 - protein, 18 aa, Mycobacterium
WLGDHVVGGVTLFPGAGF

SEQ ID NO: 336860 - protein, 20 aa, Mycobacterium
WLGDRYGRRLIYIVLTTLTA

SEQ ID NO: 336861 - protein, 24 aa, Mycobacterium
WLGFATAYPMVWWLLAKEATKAES

SEQ ID NO: 336862 - protein, 17 aa, Mycobacterium
WLGFIAIAVIASLIGAM

SEQ ID NO: 336863 - protein, 18 aa, Mycobacterium
WLGGLAFDAAGWSAVAGT

SEQ ID NO: 336864 - protein, 19 aa, Mycobacterium
WLGGLVITAGYGYRAPSLV

SEQ ID NO: 336865 - protein, 20 aa, Mycobacterium
WLGGRLAPRLGAWNAGLAAV

SEQ ID NO: 336866 - protein, 17 aa, Mycobacterium
WLGHASPDPGDRLVASG

SEQ ID NO: 336867 - protein, 18 aa, Mycobacterium
WLGPIIVAVALMYGLGLF

SEQ ID NO: 336868 - protein, 17 aa, Mycobacterium
WLGRAAAIAGLTVAILA

SEQ ID NO: 336869 - protein, 17 aa, Mycobacterium
WLGRAAAIAGLTVALLA

SEQ ID NO: 336870 - protein, 24 aa, Mycobacterium
WLGRLRFGALYALSGLGGSVLVYL

SEQ ID NO: 336871 - protein, 17 aa, Mycobacterium
WLGSPPMRLRRKPAEAD

SEQ ID NO: 336872 - protein, 19 aa, Mycobacterium
WLGSPPVRLRRKATAADVL

SEQ ID NO: 336873 - protein, 18 aa, Mycobacterium
WLGSPPVRLRRRPTAADA

SEQ ID NO: 336874 - protein, 17 aa, Mycobacterium
WLHAIGMVDDDGRLTPF

SEQ ID NO: 336875 - protein, 18 aa, Mycobacterium
WLHFGLGTVMVLLAVTLA

SEQ ID NO: 336876 - protein, 21 aa, Mycobacterium
WLHLVDARFARDLRTGLLTKM

SEQ ID NO: 336877 - protein, 18 aa, Mycobacterium
WLIAGGLALLFVKGNLLS

SEQ ID NO: 336878 - protein, 20 aa, Mycobacterium
WLIDDYGWQWIFWINVPIGL

SEQ ID NO: 336879 - protein, 26 aa, Mycobacterium
WLIDTSSWRWIFLINVPIGLLTIVLA

SEQ ID NO: 336880 - protein, 19 aa, Mycobacterium
WLIGPAVMFALAWLLLPDL

SEQ ID NO: 336881 - protein, 19 aa, Mycobacterium
WLIIELNLAVPLAIQTVVR

SEQ ID NO: 336882 - protein, 23 aa, Mycobacterium
WLILLLAAFSWMISARIVRGLTM

SEQ ID NO: 336883 - protein, 17 aa, Mycobacterium
WLIPAMFGVAYRRRLLD

SEQ ID NO: 336884 - protein, 17 aa, Mycobacterium
WLIPIVVIIPVFYAFVR

SEQ ID NO: 336885 - protein, 17 aa, Mycobacterium
WLITRAWQMPPVLHLTV

SEQ ID NO: 336886 - protein, 18 aa, Mycobacterium
WLIVGGAAMFAAFPGWYA

SEQ ID NO: 336887 - protein, 25 aa, Mycobacterium
WLIVIGYWFGWKFLRTYRNYLLGLE

SEQ ID NO: 336888 - protein, 24 aa, Mycobacterium
WLKTVPKRLSALLNTSGLPQVLEP

SEQ ID NO: 336889 - protein, 17 aa, Mycobacterium
WLLDGRVSHQWWAGIAI

SEQ ID NO: 336890 - protein, 27 aa, Mycobacterium
WLLEPVLGRRRVEGVLGHAVDVVAIVG

SEQ ID NO: 336891 - protein, 25 aa, Mycobacterium
WLLFAVLRGRLHPVGGLGVALGATL

SEQ ID NO: 336892 - protein, 19 aa, Mycobacterium
WLLGMAWAGAVMVVGTWWD

SEQ ID NO: 336893 - protein, 19 aa, Mycobacterium
WLLHSRVTAFFSHPIIAFI

SEQ ID NO: 336894 - protein, 19 aa, Mycobacterium
WLLHSRVTAFLSHPITAFI

SEQ ID NO: 336895 - protein, 17 aa, Mycobacterium
WLLIALPAAGATILLLA

SEQ ID NO: 336896 - protein, 28 aa, Mycobacterium
WLLLAVFRGRLHPIGGLGVALGICVLLF

SEQ ID NO: 336897 - protein, 18 aa, Mycobacterium
WLLLGRSPEFQPWLRWAI

SEQ ID NO: 336898 - protein, 17 aa, Mycobacterium
WLLLTAVMFALSAATYA

SEQ ID NO: 336899 - protein, 19 aa, Mycobacterium
WLLLTKMIFKPEVDELAGG

SEQ ID NO: 336900 - protein, 18 aa, Mycobacterium
WLLMGVLAVRLFGFTPGQ

SEQ ID NO: 336901 - protein, 24 aa, Mycobacterium
WLLPDVLEGPDWVRRKETGAQQGL

SEQ ID NO: 336902 - protein, 19 aa, Mycobacterium
WLLSIARRVVADHIRHVQS

SEQ ID NO: 336903 - protein, 19 aa, Mycobacterium
WLLSIARRVVADHIRQLQS

SEQ ID NO: 336904 - protein, 19 aa, Mycobacterium
WLLSIARRVVADHIRYLRS

SEQ ID NO: 336905 - protein, 22 aa, Mycobacterium
WLLWDGKRSALNLGDVAVTSAL

SEQ ID NO: 336906 - protein, 22 aa, Mycobacterium
WLLWDGKRSPIDLADRAVTDAL

SEQ ID NO: 336907 - protein, 18 aa, Mycobacterium
WLLWSKRLFGLNGGGKAY

SEQ ID NO: 336908 - protein, 22 aa, Mycobacterium
WLMEIPATVVFAIFYLTGPQRF

SEQ ID NO: 336909 - protein, 21 aa, Mycobacterium
WLMILLAHFRFRAQQHHGEAS

SEQ ID NO: 336910 - protein, 17 aa, Mycobacterium
WLMSSDVCKHCTHAGCL

SEQ ID NO: 336911 - protein, 18 aa, Mycobacterium
WLMSSDVCKHCTHAGCLD

SEQ ID NO: 336912 - protein, 24 aa, Mycobacterium
WLMSSDVCKHCTHAGCLDVCPTGA

SEQ ID NO: 336913 - protein, 20 aa, Mycobacterium
WLMTAGSLWGPAALIGVAMA

SEQ ID NO: 336914 - protein, 19 aa, Mycobacterium
WLMVNLTALTWVRFAVWLV

SEQ ID NO: 336915 - protein, 17 aa, Mycobacterium
WLNGWPGLVASLGLGLA

SEQ ID NO: 336916 - protein, 25 aa, Mycobacterium
WLNRLKTLARRLCVAPTTYAQADLD

SEQ ID NO: 336917 - protein, 21 aa, Mycobacterium
WLPDISRMGFSSVLWVGPPNA

SEQ ID NO: 336918 - protein, 32 aa, Mycobacterium
WLPEDAMLTYGWRIPLLLGLPFGLVALFLRLR

SEQ ID NO: 336919 - protein, 22 aa, Mycobacterium
WLPFFHDMGLVLGIAIPILGGF

SEQ ID NO: 336920 - protein, 27 aa, Mycobacterium
WLPFYHDMGFILGIVFPVLAGVPAVLT

SEQ ID NO: 336921 - protein, 20 aa, Mycobacterium
WLPHAPLWLIALLLMLAMTA

SEQ ID NO: 336922 - protein, 17 aa, Mycobacterium
WLPHSQHPSAFDGVGTS

SEQ ID NO: 336923 - protein, 25 aa, Mycobacterium
WLPIASLCACLWLMVNLTALTWIRF

SEQ ID NO: 336924 - protein, 18 aa, Mycobacterium
WLPLFAVAWLVVGVAQAG

SEQ ID NO: 336925 - protein, 26 aa, Mycobacterium
WLPLFHDMGLILGICAPLVTGCTAVL

SEQ ID NO: 336926 - protein, 18 aa, Mycobacterium
WLPLSGFLLYAGKLSRRD

SEQ ID NO: 336927 - protein, 18 aa, Mycobacterium
WLPPGPVPVADYPTVLLS

SEQ ID NO: 336928 - protein, 20 aa, Mycobacterium
WLPPLREAPPLGALLADDAR

SEQ ID NO: 336929 - protein, 17 aa, Mycobacterium
WLPQRPVLVPGTVDDNL

SEQ ID NO: 336930 - protein, 25 aa, Mycobacterium
WLPTWREGHWYTRLIGIDHVLTRGA

SEQ ID NO: 336931 - protein, 21 aa, Mycobacterium
WLPVLIVVAVAAGALIVMNVR

SEQ ID NO: 336932 - protein, 17 aa, Mycobacterium
WLPVRAWFDELHRNLHL

SEQ ID NO: 336933 - protein, 20 aa, Mycobacterium
WLPWLRTAVNGGGWANAIGG

SEQ ID NO: 336934 - protein, 21 aa, Mycobacterium
WLQEHDRYLVIVVGLIFGVWF

SEQ ID NO: 336935 - protein, 17 aa, Mycobacterium
WLQHCCKSPPDPPATPA

SEQ ID NO: 336936 - protein, 18 aa, Mycobacterium
WLQHCCKSPYDPTERGEG

SEQ ID NO: 336937 - protein, 17 aa, Mycobacterium
WLQQYTKNFAWPVSKDL

SEQ ID NO: 336938 - protein, 18 aa, Mycobacterium
WLQRFSWVGLVIAVVGGL

SEQ ID NO: 336939 - protein, 17 aa, Mycobacterium
WLRFGIFYYSEAVGPTL

SEQ ID NO: 336940 - protein, 19 aa, Mycobacterium
WLRHATDAWIAVLFGAVFV

SEQ ID NO: 336941 - protein, 19 aa, Mycobacterium
WLRICGAALVFLAIARPGR

SEQ ID NO: 336942 - protein, 21 aa, Mycobacterium
WLRIEHWLNVLFLTLVIRSGI

SEQ ID NO: 336943 - protein, 17 aa, Mycobacterium
WLRIFGIAVVASGVVAL

SEQ ID NO: 336944 - protein, 25 aa, Mycobacterium
WLRRWPTRRQSLMMGMVGGSMIAVG

SEQ ID NO: 336945 - protein, 24 aa, Mycobacterium
WLRSHYRRWGLIAVGLFQVAIAAA

SEQ ID NO: 336946 - protein, 25 aa, Mycobacterium
WLRSHYRRWGLIAVGVFQVAIAAAQ

SEQ ID NO: 336947 - protein, 22 aa, Mycobacterium
WLRVEHWLNLLFVTLIIRSGIE

SEQ ID NO: 336948 - protein, 25 aa, Mycobacterium
WLRVFELAAGLILLVFLSRSPRVNR

SEQ ID NO: 336949 - protein, 19 aa, Mycobacterium
WLRVFSISLMFAGVTLTAI

SEQ ID NO: 336950 - protein, 26 aa, Mycobacterium
WLSATRWLGCLLACALAGAVLVMPLT

SEQ ID NO: 336951 - protein, 17 aa, Mycobacterium
WLSAVVIVAATAVALVV

SEQ ID NO: 336952 - protein, 20 aa, Mycobacterium
WLSDRFGRRGTLLMLAVLFI

SEQ ID NO: 336953 - protein, 19 aa, Mycobacterium
WLSGFALNISSTVMLFTVT

SEQ ID NO: 336954 - protein, 22 aa, Mycobacterium
WLSLAFGWGLFGIWSGLSTFMV

SEQ ID NO: 336955 - protein, 17 aa, Mycobacterium
WLSMAASVLVLVVSTAL

SEQ ID NO: 336956 - protein, 18 aa, Mycobacterium
WLSPEPRDAFGPDGPRGV

SEQ ID NO: 336957 - protein, 25 aa, Mycobacterium
WLSPLECVYYTAGIASIVLGWYFNI

SEQ ID NO: 336958 - protein, 18 aa, Mycobacterium
WLSPLGWSLLVKPYAGDR

SEQ ID NO: 336959 - protein, 26 aa, Mycobacterium
WLSSELMFFAGLFAFYFTARAQSGGN

SEQ ID NO: 336960 - protein, 25 aa, Mycobacterium
WLSSELMFFAGLFAMYFTARAQAEE

SEQ ID NO: 336961 - protein, 25 aa, Mycobacterium
WLSSELMFFAGLFAMYFTARSQAGG

SEQ ID NO: 336962 - protein, 18 aa, Mycobacterium
WLSTVAIIALLATVAATL

SEQ ID NO: 336963 - protein, 18 aa, Mycobacterium
WLSVALLCAGLAGFCVHT

SEQ ID NO: 336964 - protein, 17 aa, Mycobacterium
WLSVIVLLPLAAIVWQS

SEQ ID NO: 336965 - protein, 19 aa, Mycobacterium
WLSVLPLQYTDASGHTTEL

SEQ ID NO: 336966 - protein, 18 aa, Mycobacterium
WLTATPIRVVRAALNRVE

SEQ ID NO: 336967 - protein, 17 aa, Mycobacterium
WLTAWHKALSSPLLTLN

SEQ ID NO: 336968 - protein, 17 aa, Mycobacterium
WLTDAGARFGVEDTKEA

SEQ ID NO: 336969 - protein, 24 aa, Mycobacterium
WLTDPRFLLGTLVYLAGFVLLVWS

SEQ ID NO: 336970 - protein, 17 aa, Mycobacterium
WLTKASADYAVMAAEHE

SEQ ID NO: 336971 - protein, 19 aa, Mycobacterium
WLTLFPALTIIAVVLATNN

SEQ ID NO: 336972 - protein, 20 aa, Mycobacterium
WLTPARWGFAASASTIDLNT

SEQ ID NO: 336973 - protein, 20 aa, Mycobacterium
WLTPARWGFAASASTIDTHR

SEQ ID NO: 336974 - protein, 20 aa, Mycobacterium
WLTPARWGYAAGASSIDFPS

SEQ ID NO: 336975 - protein, 21 aa, Mycobacterium
WLTPARWGYAAGASSIDFPSL

SEQ ID NO: 336976 - protein, 20 aa, Mycobacterium
WLTPARWGYAASAATVNLRE

SEQ ID NO: 336977 - protein, 19 aa, Mycobacterium
WLTTGWINMIFMWLIPAAL

SEQ ID NO: 336978 - protein, 17 aa, Mycobacterium
WLTWGFQVVPVFFAVAG

SEQ ID NO: 336979 - protein, 20 aa, Mycobacterium
WLVADLDSGAVIAAKDPHGR

SEQ ID NO: 336980 - protein, 17 aa, Mycobacterium
WLVALFAAVMGASAWMP

SEQ ID NO: 336981 - protein, 19 aa, Mycobacterium
WLVEGDPLALAWALDPSDT

SEQ ID NO: 336982 - protein, 25 aa, Mycobacterium
WLVEHPRLRRVIGAMTGVYVLCLWA

SEQ ID NO: 336983 - protein, 20 aa, Mycobacterium
WLVFGGLWLALGYLLAALIC

SEQ ID NO: 336984 - protein, 20 aa, Mycobacterium
WLVFGGLWLALGYLVAALIC

SEQ ID NO: 336985 - protein, 19 aa, Mycobacterium
WLVGISAVLLLAAGGIGAG

SEQ ID NO: 336986 - protein, 17 aa, Mycobacterium
WLVGLAALVVLTIIVTF

SEQ ID NO: 336987 - protein, 19 aa, Mycobacterium
WLVGPAVMFALAWLLLPDL

SEQ ID NO: 336988 - protein, 27 aa, Mycobacterium
WLVIVGWGTLWPFLSWLTTHFVVTNRR

SEQ ID NO: 336989 - protein, 20 aa, Mycobacterium
WLVIVPLTFGTALVLGAIVA

SEQ ID NO: 336990 - protein, 17 aa, Mycobacterium
WLVLLVAHSGYLRHPDF

SEQ ID NO: 336991 - protein, 33 aa, Mycobacterium
WLVLVGWLAVWPFLNWWTTHFVITDRRVMYRHG

SEQ ID NO: 336992 - protein, 17 aa, Mycobacterium
WLVLVWVLLWGNISAAN

SEQ ID NO: 336993 - protein, 20 aa, Mycobacterium
WLVPAGLLALLALPPALALE

SEQ ID NO: 336994 - protein, 19 aa, Mycobacterium
WLVPSRWGFAASASTMDLA

SEQ ID NO: 336995 - protein, 20 aa, Mycobacterium
WLVRNGEPFFPSDCLADGGD

SEQ ID NO: 336996 - protein, 25 aa, Mycobacterium
WLVTAAGILWLWAGALAVLAVAVGV

SEQ ID NO: 336997 - protein, 25 aa, Mycobacterium
WLVVLILAMLAHWLRNPTVARGHVR

SEQ ID NO: 336998 - protein, 21 aa, Mycobacterium
WLWWRRAHGTGRPGWDGGVGT

SEQ ID NO: 336999 - protein, 23 aa, Mycobacterium
WLYEGHVLGAIFLGFLIGATTAG

SEQ ID NO: 337000 - protein, 19 aa, Mycobacterium
WLYEGHVLGAIFLGFLMGA

SEQ ID NO: 337001 - protein, 21 aa, Mycobacterium
WLYNFLPVYTFSALLGVFEVT

SEQ ID NO: 337002 - protein, 20 aa, Mycobacterium
WLYTVFTVLAAVGFIASYQA

SEQ ID NO: 337003 - protein, 26 aa, Mycobacterium
WLYVLCGALVFAALAWVTPRVQGEKP

SEQ ID NO: 337004 - protein, 24 aa, Mycobacterium
WMAPICIIAVLLAGLVAYPRHTAS

SEQ ID NO: 337005 - protein, 18 aa, Mycobacterium
WMCFVNWASTSIVDVTAV

SEQ ID NO: 337006 - protein, 17 aa, Mycobacterium
WMDRGRLVCPWHGSWFA

SEQ ID NO: 337007 - protein, 18 aa, Mycobacterium
WMGDPAISSKGFEWDTAC

SEQ ID NO: 337008 - protein, 18 aa, Mycobacterium
WMGILIWCLYVFNMTMYA

SEQ ID NO: 337009 - protein, 20 aa, Mycobacterium
WMGVLIWCLYVFNMTMYADV

SEQ ID NO: 337010 - protein, 17 aa, Mycobacterium
WMGVVIWIGYVFNMTMF

SEQ ID NO: 337011 - protein, 17 aa, Mycobacterium
WMGVVIWITYVFNMTMF

SEQ ID NO: 337012 - protein, 17 aa, Mycobacterium
WMGVVIWSAYVFNMTMF

SEQ ID NO: 337013 - protein, 17 aa, Mycobacterium
WMHPHRMGGPGGPGGQA

SEQ ID NO: 337014 - protein, 25 aa, Mycobacterium
WMIARVSLVPTLLVAIPFTVLVAFT

SEQ ID NO: 337015 - protein, 20 aa, Mycobacterium
WMIRDGRFFAPVDCLSDGGD

SEQ ID NO: 337016 - protein, 25 aa, Mycobacterium
WMLAIGSLFPVKWMAQGFRSVLLPP

SEQ ID NO: 337017 - protein, 21 aa, Mycobacterium
WMLLAGPGWVIFGAAKQIIGL

SEQ ID NO: 337018 - protein, 17 aa, Mycobacterium
WMLMAGKKLSARDRRVL

SEQ ID NO: 337019 - protein, 17 aa, Mycobacterium
WMLMLLLIAFGTMELAW

SEQ ID NO: 337020 - protein, 19 aa, Mycobacterium
WMMQAEVAVTNFVASMDVS

SEQ ID NO: 337021 - protein, 19 aa, Mycobacterium
WMMTAEVGVTNFVASMDVT

SEQ ID NO: 337022 - protein, 22 aa, Mycobacterium
WMNITLGWRTSLLILAAAFALT

SEQ ID NO: 337023 - protein, 31 aa, Mycobacterium
WMRLPDLFAGLVCWLLLSREVLPRLGPAVAA

SEQ ID NO: 337024 - protein, 31 aa, Mycobacterium
WMRLPDLFAGLVCWLLLSREVLPRLGPAVTS

SEQ ID NO: 337025 - protein, 17 aa, Mycobacterium
WMSCAFVAAAAVIRRWA

SEQ ID NO: 337026 - protein, 17 aa, Mycobacterium
WMSCAFVAAAGAIRRWA

SEQ ID NO: 337027 - protein, 17 aa, Mycobacterium
WMSHLRVALSEMWAHPV

SEQ ID NO: 337028 - protein, 19 aa, Mycobacterium
WMSHLRVALSEMWAHPVQR

SEQ ID NO: 337029 - protein, 21 aa, Mycobacterium
WMTGGSYLVARRIRMRIEQWD

SEQ ID NO: 337030 - protein, 30 aa, Mycobacterium
WMTVDALVWVPRMYYLLGIENKGLPEQWFT

SEQ ID NO: 337031 - protein, 22 aa, Mycobacterium
WMTWVGCISLGMFGLGLTVYVF

SEQ ID NO: 337032 - protein, 17 aa, Mycobacterium
WMVFAAFWAVLVYFPVA

SEQ ID NO: 337033 - protein, 18 aa, Mycobacterium
WMVIGVIVYFAYSRKHSV

SEQ ID NO: 337034 - protein, 19 aa, Mycobacterium
WMVIVAVLVVVLAGFAIYR

SEQ ID NO: 337035 - protein, 18 aa, Mycobacterium
WMVLPLTFILLVAVGSDY

SEQ ID NO: 337036 - protein, 17 aa, Mycobacterium
WMVLPMAVIILLAVGAD

SEQ ID NO: 337037 - protein, 18 aa, Mycobacterium
WMVRLLLFRVEFGAGLIK

SEQ ID NO: 337038 - protein, 18 aa, Mycobacterium
WMYFFNWAATAIVDVTAI

SEQ ID NO: 337039 - protein, 18 aa, Mycobacterium
WNALAKHEHWTVPDIEYV

SEQ ID NO: 337040 - protein, 18 aa, Mycobacterium
WNDFLWPLLMIQRNSLAT

SEQ ID NO: 337041 - protein, 18 aa, Mycobacterium
WNDPRFQRAANLYFSPDG

SEQ ID NO: 337042 - protein, 20 aa, Mycobacterium
WNGQIAWWLDMVVFGIYTGV

SEQ ID NO: 337043 - protein, 19 aa, Mycobacterium
WNGRSTWFRHEPRLGSYAT

SEQ ID NO: 337044 - protein, 17 aa, Mycobacterium
WNKFPKFVLGFLAVSAI

SEQ ID NO: 337045 - protein, 17 aa, Mycobacterium
WNLAFGVLPPYWAAKAF

SEQ ID NO: 337046 - protein, 22 aa, Mycobacterium
WNLLDDACCHLAEVDLAGMDIT

SEQ ID NO: 337047 - protein, 22 aa, Mycobacterium
WNLLVDYWFRMEIDGWDNIPEP

SEQ ID NO: 337048 - protein, 18 aa, Mycobacterium
WNNFMWPLVITSGGNWRV

SEQ ID NO: 337049 - protein, 20 aa, Mycobacterium
WNPEDVVAWEAGNKRIARRN

SEQ ID NO: 337050 - protein, 17 aa, Mycobacterium
WNPEFLREGYAVQDTLR

SEQ ID NO: 337051 - protein, 28 aa, Mycobacterium
WNSPFWQTWDLLLLWLAQLHGGNGLRVI

SEQ ID NO: 337052 - protein, 19 aa, Mycobacterium
WNTHIINGWGATAASSVTY

SEQ ID NO: 337053 - protein, 18 aa, Mycobacterium
WNVACERTEVTGTRQGIP

SEQ ID NO: 337054 - protein, 17 aa, Mycobacterium
WNVFMIFGVLALFVGHA

SEQ ID NO: 337055 - protein, 17 aa, Mycobacterium
WNVFMIFGVLSLFVAHT

SEQ ID NO: 337056 - protein, 19 aa, Mycobacterium
WNVFTSYRYGEVVTVDDPW

SEQ ID NO: 337057 - protein, 18 aa, Mycobacterium
WNVLFAYATIFLFLGFPA

SEQ ID NO: 337058 - protein, 21 aa, Mycobacterium
WNYLDRMGHRWSTRETLHFLW

SEQ ID NO: 337059 - protein, 38 aa, Mycobacterium
WNYLDRMGRSWSTRATLHFLWLRLARVWPVYLVTLHLA

SEQ ID NO: 337060 - protein, 17 aa, Mycobacterium
WPAAGLIAAGSLVGGLA

SEQ ID NO: 337061 - protein, 18 aa, Mycobacterium
WPAAGLIAAGSLVGGLLG

SEQ ID NO: 337062 - protein, 18 aa, Mycobacterium
WPAAILFLLIPSVVVTGF

SEQ ID NO: 337063 - protein, 17 aa, Mycobacterium
WPAARAFDLTVLGSGVV

SEQ ID NO: 337064 - protein, 19 aa, Mycobacterium
WPAAVAVGLAAMFTLTGIA

SEQ ID NO: 337065 - protein, 19 aa, Mycobacterium
WPAEDAAFITGLRDHLARV

SEQ ID NO: 337066 - protein, 25 aa, Mycobacterium
WPAKLVLLASFAMFFVVAVWKELLT

SEQ ID NO: 337067 - protein, 17 aa, Mycobacterium
WPALMGIDDPDALDVDV

SEQ ID NO: 337068 - protein, 32 aa, Mycobacterium
WPAMNRGWCLLRTRWGRRMARVLPVIGVAGLA

SEQ ID NO: 337069 - protein, 31 aa, Mycobacterium
WPDTAMGWPEPQDWTALAVFVVVGLVANSLA

SEQ ID NO: 337070 - protein, 27 aa, Mycobacterium
WPEALEIGVKLCGALETAHRAGTLHRD

SEQ ID NO: 337071 - protein, 20 aa, Mycobacterium
WPEALHIGVKLCGALETAHR

SEQ ID NO: 337072 - protein, 19 aa, Mycobacterium
WPEIKGVRDFAGVTLHTAR

SEQ ID NO: 337073 - protein, 20 aa, Mycobacterium
WPEKLARTSFWCMNIGLAWM

SEQ ID NO: 337074 - protein, 19 aa, Mycobacterium
WPFASGWDSGMRDVTASFA

SEQ ID NO: 337075 - protein, 17 aa, Mycobacterium
WPFLAGTVVGWLAARAW

SEQ ID NO: 337076 - protein, 25 aa, Mycobacterium
WPFLSGGAIGWVLSRGWSRPTSITP

SEQ ID NO: 337077 - protein, 29 aa, Mycobacterium
WPGAVLASACALALIGLLALPGYKTSYDT

SEQ ID NO: 337078 - protein, 24 aa, Mycobacterium
WPGFGRSVGVLGEIFVSLIKMMIS

SEQ ID NO: 337079 - protein, 19 aa, Mycobacterium
WPGGWWLDPAVGLVIAGLA

SEQ ID NO: 337080 - protein, 24 aa, Mycobacterium
WPGISAEQLAPWLFDAELSVEWVA

SEQ ID NO: 337081 - protein, 21 aa, Mycobacterium
WPGLVGLRDVHRFDPATLWRG

SEQ ID NO: 337082 - protein, 22 aa, Mycobacterium
WPGNPYPPAAMVPFLIFGLLGK

SEQ ID NO: 337083 - protein, 24 aa, Mycobacterium
WPGPCRLLCAFGVGMCQPNVAAAS

SEQ ID NO: 337084 - protein, 28 aa, Mycobacterium
WPGPVLAATCVIAFIGLLALPSYKTTYD

SEQ ID NO: 337085 - protein, 19 aa, Mycobacterium
WPGQLMFAPAVALLAYAII

SEQ ID NO: 337086 - protein, 17 aa, Mycobacterium
WPGVKIVNNIEVKGPAP

SEQ ID NO: 337087 - protein, 17 aa, Mycobacterium
WPHLSAWAMDSVDDPAE

SEQ ID NO: 337088 - protein, 17 aa, Mycobacterium
WPHLTVRAMDCVDDPAE

SEQ ID NO: 337089 - protein, 28 aa, Mycobacterium
WPIGRTISWLFGCGFLLIATSSGVGRYM

SEQ ID NO: 337090 - protein, 25 aa, Mycobacterium
WPLADRPRLAPGVPGGTIPVRLVDD

SEQ ID NO: 337091 - protein, 23 aa, Mycobacterium
WPLEGSIYQWSRRLLGTAYGWFA

SEQ ID NO: 337092 - protein, 17 aa, Mycobacterium
WPLGEIDKPFEMRRDPL

SEQ ID NO: 337093 - protein, 18 aa, Mycobacterium
WPLHTAMWVLAVASLVTV

SEQ ID NO: 337094 - protein, 26 aa, Mycobacterium
WPLNVTWGGLPLFVPVGYISYFVLPA

SEQ ID NO: 337095 - protein, 24 aa, Mycobacterium
WPLRESGVRSGLAPAERDSSGNPV

SEQ ID NO: 337096 - protein, 17 aa, Mycobacterium
WPLSVYMFIGTVVSIGA

SEQ ID NO: 337097 - protein, 17 aa, Mycobacterium
WPLWAAYIGVFALTVLV

SEQ ID NO: 337098 - protein, 19 aa, Mycobacterium
WPMAVGIVGAVLVTAVAAF

SEQ ID NO: 337099 - protein, 18 aa, Mycobacterium
WPMEIVALGSAFALVVVG

SEQ ID NO: 337100 - protein, 18 aa, Mycobacterium
WPNFWSLITSTSSRTALV

SEQ ID NO: 337101 - protein, 17 aa, Mycobacterium
WPNGVVVAAIFSAIVAF

SEQ ID NO: 337102 - protein, 18 aa, Mycobacterium
WPNVHIISSDPFESIATI

SEQ ID NO: 337103 - protein, 18 aa, Mycobacterium
WPPALPVAMWLLAAASLV

SEQ ID NO: 337104 - protein, 18 aa, Mycobacterium
WPPALPVAMWLLAAASVV

SEQ ID NO: 337105 - protein, 19 aa, Mycobacterium
WPPALPVAMWLLAVTSVIT

SEQ ID NO: 337106 - protein, 19 aa, Mycobacterium
WPPALPVAMWVLAVASVIT

SEQ ID NO: 337107 - protein, 17 aa, Mycobacterium
WPPASALVTPEEAVNAL

SEQ ID NO: 337108 - protein, 42 aa, Mycobacterium
WPPGRPTTWLQVSAYRFLVRRLECALLRGGLDPADGRPRASA

SEQ ID NO: 337109 - protein, 19 aa, Mycobacterium
WPPPDLKEGGYFTMGKWGM

SEQ ID NO: 337110 - protein, 17 aa, Mycobacterium
WPPQRGFEILSDRAQSG

SEQ ID NO: 337111 - protein, 21 aa, Mycobacterium
WPQALLAAGAITFVASASAAV

SEQ ID NO: 337112 - protein, 27 aa, Mycobacterium
WPQKVRPRPASALLEPYGPRPLVRALL

SEQ ID NO: 337113 - protein, 18 aa, Mycobacterium
WPQQSVLIVAYAMVAMCA

SEQ ID NO: 337114 - protein, 21 aa, Mycobacterium
WPRGGFVGIDIFFVIAGFFVT

SEQ ID NO: 337115 - protein, 19 aa, Mycobacterium
WPRPLSPDFVAFRRVQEER

SEQ ID NO: 337116 - protein, 18 aa, Mycobacterium
WPSGLDFGTQMAPALLIT

SEQ ID NO: 337117 - protein, 29 aa, Mycobacterium
WPSLNRGWCLIRTRWARRVARILPPAGLA

SEQ ID NO: 337118 - protein, 19 aa, Mycobacterium
WPTAIAAFVMVVFHLNILL

SEQ ID NO: 337119 - protein, 25 aa, Mycobacterium
WPTDGHGAIDRWIDVPDRLLQRWTG

SEQ ID NO: 337120 - protein, 18 aa, Mycobacterium
WPTDGHGTVDRWVDVPDR

SEQ ID NO: 337121 - protein, 17 aa, Mycobacterium
WPTDPSWLYRLTQGLHV

SEQ ID NO: 337122 - protein, 17 aa, Mycobacterium
WPTNPSWLYRLTQGLHV

SEQ ID NO: 337123 - protein, 18 aa, Mycobacterium
WPTVEVAVAVVAVTVVSM

SEQ ID NO: 337124 - protein, 20 aa, Mycobacterium
WPVDAVVIAVILVLNALLGY

SEQ ID NO: 337125 - protein, 34 aa, Mycobacterium
WPVGRACASGCLLLALGAGVLWWITDRRPRSRRW

SEQ ID NO: 337126 - protein, 25 aa, Mycobacterium
WPVLTGRWLFYGALGAAAAAVALLT

SEQ ID NO: 337127 - protein, 28 aa, Mycobacterium
WPVVARLIAAVVMPFGILLAGLLTPLAG

SEQ ID NO: 337128 - protein, 19 aa, Mycobacterium
WPVVVLLALAVARKTSGHP

SEQ ID NO: 337129 - protein, 20 aa, Mycobacterium
WPVVVLVSIVVARRAGSQRV

SEQ ID NO: 337130 - protein, 19 aa, Mycobacterium
WPVVVLVSIVVARRSGSGK

SEQ ID NO: 337131 - protein, 17 aa, Mycobacterium
WPYLVCAALSGLGGGNF

SEQ ID NO: 337132 - protein, 18 aa, Mycobacterium
WQAFGPAVGFAFFPPAGV

SEQ ID NO: 337133 - protein, 17 aa, Mycobacterium
WQAGLLLAGQRFNRDAA

SEQ ID NO: 337134 - protein, 25 aa, Mycobacterium
WQAITHDLWPAPSLVVDTGASLAPY

SEQ ID NO: 337135 - protein, 18 aa, Mycobacterium
WQALDGALARRAVVARAV

SEQ ID NO: 337136 - protein, 17 aa, Mycobacterium
WQAVFTFTTDRPGSHEV

SEQ ID NO: 337137 - protein, 18 aa, Mycobacterium
WQDRIAVGDLGYRAAATL

SEQ ID NO: 337138 - protein, 19 aa, Mycobacterium
WQDVIKGVLIVAAVAVDVW

SEQ ID NO: 337139 - protein, 17 aa, Mycobacterium
WQDVLGLGVQWIVIPLS

SEQ ID NO: 337140 - protein, 22 aa, Mycobacterium
WQERESWRTPALETLERPAWSP

SEQ ID NO: 337141 - protein, 17 aa, Mycobacterium
WQFGITTVYHFILVPLT

SEQ ID NO: 337142 - protein, 18 aa, Mycobacterium
WQGLNVWAAQAMVDLGFT

SEQ ID NO: 337143 - protein, 18 aa, Mycobacterium
WQGRAFWWASSFGVITAL

SEQ ID NO: 337144 - protein, 23 aa, Mycobacterium
WQHIIGLNLHWMVLPLTFILLVA

SEQ ID NO: 337145 - protein, 22 aa, Mycobacterium
WQHILGIELHWLVLAMAVIILL

SEQ ID NO: 337146 - protein, 23 aa, Mycobacterium
WQHLIGLHLHWLVLPLTFIILVA

SEQ ID NO: 337147 - protein, 27 aa, Mycobacterium
WQHTPARWWFDVGMLALISAVYLGFVR

SEQ ID NO: 337148 - protein, 19 aa, Mycobacterium
WQIAKSVLIFLGIPLLAGF

SEQ ID NO: 337149 - protein, 19 aa, Mycobacterium
WQIAKSVLIFLGIPLLAGY

SEQ ID NO: 337150 - protein, 20 aa, Mycobacterium
WQIAKSVLIFLGIPLLAGYL

SEQ ID NO: 337151 - protein, 19 aa, Mycobacterium
WQIAKSVLIFLGLPLLAGY

SEQ ID NO: 337152 - protein, 23 aa, Mycobacterium
WQIGRPWYLAWAGLIYTAAAVAT

SEQ ID NO: 337153 - protein, 24 aa, Mycobacterium
WQISRPWYLAWAGLVYIVAAVATL

SEQ ID NO: 337154 - protein, 26 aa, Mycobacterium
WQKITRELWPAPFLVMDTGASMAPYN

SEQ ID NO: 337155 - protein, 17 aa, Mycobacterium
WQLLLFRSLGGIGSTMF

SEQ ID NO: 337156 - protein, 17 aa, Mycobacterium
WQLPASLAGAALGAFLL

SEQ ID NO: 337157 - protein, 18 aa, Mycobacterium
WQLRFPVRAATVGTAAAA

SEQ ID NO: 337158 - protein, 22 aa, Mycobacterium
WQMGLHLLITVAYFALGLTVVP

SEQ ID NO: 337159 - protein, 17 aa, Mycobacterium
WQPEAPDGEALILRCGL

SEQ ID NO: 337160 - protein, 17 aa, Mycobacterium
WQPEQVLAYAASSEIHS

SEQ ID NO: 337161 - protein, 17 aa, Mycobacterium
WQPEQVLAYAASSELHS

SEQ ID NO: 337162 - protein, 24 aa, Mycobacterium
WQQRTEWPLAVVAVAFLAIYSVEV

SEQ ID NO: 337163 - protein, 23 aa, Mycobacterium
WQRGELLEVLNLYTDVMSNTLAN

SEQ ID NO: 337164 - protein, 19 aa, Mycobacterium
WQRHCRRKYPEPGISTPSV

SEQ ID NO: 337165 - protein, 23 aa, Mycobacterium
WQRLGLERQVLWAATRALVQLLL

SEQ ID NO: 337166 - protein, 23 aa, Mycobacterium
WQRLGLERQVVWAAARALVQLLL

SEQ ID NO: 337167 - protein, 22 aa, Mycobacterium
WQRLGLQGQLVWAAARALVQLL

SEQ ID NO: 337168 - protein, 17 aa, Mycobacterium
WQRRHHATGGKVRIDGA

SEQ ID NO: 337169 - protein, 17 aa, Mycobacterium
WQSARFALQQEAAAPAC

SEQ ID NO: 337170 - protein, 18 aa, Mycobacterium
WQSVKVTAIFAVLATVIE

SEQ ID NO: 337171 - protein, 31 aa, Mycobacterium
WQTFWRITLPSIRWGLTYGIVLTVARTLGEY

SEQ ID NO: 337172 - protein, 17 aa, Mycobacterium
WQTIGFLSLVALLFMVA

SEQ ID NO: 337173 - protein, 20 aa, Mycobacterium
WQTVVGVTFQLFTIVLLTYL

SEQ ID NO: 337174 - protein, 20 aa, Mycobacterium
WQVAAAWELVSPSVLPGPLT

SEQ ID NO: 337175 - protein, 17 aa, Mycobacterium
WQVGWVVVLLYAVCVVL

SEQ ID NO: 337176 - protein, 20 aa, Mycobacterium
WQVKCGSGFATDLTQASSAD

SEQ ID NO: 337177 - protein, 17 aa, Mycobacterium
WQVLPFLIIQGLFGASL

SEQ ID NO: 337178 - protein, 21 aa, Mycobacterium
WQVRILPPFLSRKHLPSRLAR

SEQ ID NO: 337179 - protein, 33 aa, Mycobacterium
WQVVMPMGHICCGRPLYDYGFLDIAERYLQRVI

SEQ ID NO: 337180 - protein, 25 aa, Mycobacterium
WQVVWHCALYGMLHAWIAFLANGFC

SEQ ID NO: 337181 - protein, 18 aa, Mycobacterium
WQVWTFLVVFALSTWIPT

SEQ ID NO: 337182 - protein, 18 aa, Mycobacterium
WQYDTMRYAQIAGVQALQ

SEQ ID NO: 337183 - protein, 19 aa, Mycobacterium
WRAAASMGAPTAGIRSGSG

SEQ ID NO: 337184 - protein, 17 aa, Mycobacterium
WRAAWVGWWVAAGIASA

SEQ ID NO: 337185 - protein, 22 aa, Mycobacterium
WRAEVMPEDKLEVVRDLQDEGY

SEQ ID NO: 337186 - protein, 22 aa, Mycobacterium
WRAEVMPEDKLEVVRELQDDGY

SEQ ID NO: 337187 - protein, 17 aa, Mycobacterium
WRAIPALARNKENFLTY

SEQ ID NO: 337188 - protein, 17 aa, Mycobacterium
WRALTGFVGANLLLDAA

SEQ ID NO: 337189 - protein, 24 aa, Mycobacterium
WRAPSAKNRQPWDFVIVTERSALQ

SEQ ID NO: 337190 - protein, 21 aa, Mycobacterium
WRARCDLGIAIGSWIPALLWG

SEQ ID NO: 337191 - protein, 17 aa, Mycobacterium
WRAVLLAAVAACAASGI

SEQ ID NO: 337192 - protein, 26 aa, Mycobacterium
WRAVREYDLKLILAFGTVSQLGLITV

SEQ ID NO: 337193 - protein, 21 aa, Mycobacterium
WRAVSVRGPHGLTTVAIDLSD

SEQ ID NO: 337194 - protein, 25 aa, Mycobacterium
WRAYAIPLLVALTVFVGYQTVTQRE

SEQ ID NO: 337195 - protein, 25 aa, Mycobacterium
WRAYALPVLIVLTVVVVYQTVTGTA

SEQ ID NO: 337196 - protein, 25 aa, Mycobacterium
WRAYALPVLMVLTVVVGYQTVTGTT

SEQ ID NO: 337197 - protein, 17 aa, Mycobacterium
WRCSEALRRTWRRGWPT

SEQ ID NO: 337198 - protein, 25 aa, Mycobacterium
WRDADRALRCGLMDWGCVGQMNLGM

SEQ ID NO: 337199 - protein, 20 aa, Mycobacterium
WRDEGAIILHVIRDGAVVGG

SEQ ID NO: 337200 - protein, 20 aa, Mycobacterium
WRDFCLRAADRIVLVSEGPA

SEQ ID NO: 337201 - protein, 18 aa, Mycobacterium
WRDLPIFGTQSVQAAKAG

SEQ ID NO: 337202 - protein, 24 aa, Mycobacterium
WRDNLRWPPASALVSAEEAVAALR

SEQ ID NO: 337203 - protein, 21 aa, Mycobacterium
WRDNLRWPPASALVTPEEAVN

SEQ ID NO: 337204 - protein, 18 aa, Mycobacterium
WRDQLCGAPPEIDLPRDF

SEQ ID NO: 337205 - protein, 23 aa, Mycobacterium
WRDRKRYMWLYGMIPPTAIFIAT

SEQ ID NO: 337206 - protein, 19 aa, Mycobacterium
WREALGSWTVLALAALVVW

SEQ ID NO: 337207 - protein, 26 aa, Mycobacterium
WRELILQCWFVMRVALLPTIMVSIPL

SEQ ID NO: 337208 - protein, 19 aa, Mycobacterium
WREVLDGFETPTLVAPPGV

SEQ ID NO: 337209 - protein, 18 aa, Mycobacterium
WREVPFALLPTVFSVHQF

SEQ ID NO: 337210 - protein, 23 aa, Mycobacterium
WREVPRAVYAFDIASLCWALVFA

SEQ ID NO: 337211 - protein, 22 aa, Mycobacterium
WREVPRAVYAFDVATLGWTLVF

SEQ ID NO: 337212 - protein, 19 aa, Mycobacterium
WRGAPAIIVSAVGWMTTLK

SEQ ID NO: 337213 - protein, 18 aa, Mycobacterium
WRGARWRRRTASLVAVPF

SEQ ID NO: 337214 - protein, 27 aa, Mycobacterium
WRGEIGEWIITRGLRIAMVLIAAVLAA

SEQ ID NO: 337215 - protein, 17 aa, Mycobacterium
WRGLTLGLRPAEMAELV

SEQ ID NO: 337216 - protein, 19 aa, Mycobacterium
WRGTAAIIVSLLGWLVTLR

SEQ ID NO: 337217 - protein, 23 aa, Mycobacterium
WRGVLQAAGLLFFAFAGYARIAT

SEQ ID NO: 337218 - protein, 20 aa, Mycobacterium
WRHGACLVPAPRSLVRSGMD

SEQ ID NO: 337219 - protein, 18 aa, Mycobacterium
WRHLLSVLLAPAMMTVFI

SEQ ID NO: 337220 - protein, 19 aa, Mycobacterium
WRHVDVFQFFYLVLPLFCG

SEQ ID NO: 337221 - protein, 26 aa, Mycobacterium
WRHVGLPVLCPFLLAGWVLTFAWSLG

SEQ ID NO: 337222 - protein, 20 aa, Mycobacterium
WRHVLQYGVAAWTGIILGIV

SEQ ID NO: 337223 - protein, 21 aa, Mycobacterium
WRHYNSLYFPYVVGVRAYAQN

SEQ ID NO: 337224 - protein, 21 aa, Mycobacterium
WRIALVDLVLWGVGTILLTTL

SEQ ID NO: 337225 - protein, 17 aa, Mycobacterium
WRIDRPWPLAWAGLVDI

SEQ ID NO: 337226 - protein, 19 aa, Mycobacterium
WRIILFYVGSIFLVVCILP

SEQ ID NO: 337227 - protein, 22 aa, Mycobacterium
WRILLEDINLGWAQHRDGQSVV

SEQ ID NO: 337228 - protein, 21 aa, Mycobacterium
WRILLEDLNIAWAQHCTGQSI

SEQ ID NO: 337229 - protein, 24 aa, Mycobacterium
WRILLEDLNIAWGQHRHGQPVALP

SEQ ID NO: 337230 - protein, 19 aa, Mycobacterium
WRILLEDLNIAWTQQQDGR

SEQ ID NO: 337231 - protein, 33 aa, Mycobacterium
WRILRAWFDGLFVKAHRSFDYWMGWYVIVGTMP

SEQ ID NO: 337232 - protein, 17 aa, Mycobacterium
WRINGFTGQSLSDIGPV

SEQ ID NO: 337233 - protein, 19 aa, Mycobacterium
WRIPADGMSAVSVAAAIPM

SEQ ID NO: 337234 - protein, 20 aa, Mycobacterium
WRIPVTMVAVLMALVVTGAV

SEQ ID NO: 337235 - protein, 22 aa, Mycobacterium
WRITLPMLRPTTFFVLVTGIVS

SEQ ID NO: 337236 - protein, 21 aa, Mycobacterium
WRKTRRQTLKDYVAFPLLAGP

SEQ ID NO: 337237 - protein, 25 aa, Mycobacterium
WRKVGAATVRWPGAILVASVAVSLI

SEQ ID NO: 337238 - protein, 18 aa, Mycobacterium
WRLALGVLAVLLLVVVMI

SEQ ID NO: 337239 - protein, 17 aa, Mycobacterium
WRLAVFDVAAPLVAAMA

SEQ ID NO: 337240 - protein, 25 aa, Mycobacterium
WRLFLRQRSFWALAVGFFGTLWTIQ

SEQ ID NO: 337241 - protein, 17 aa, Mycobacterium
WRLHALVLITTFLIFPI

SEQ ID NO: 337242 - protein, 20 aa, Mycobacterium
WRLILDGVIVATSLFVATWV

SEQ ID NO: 337243 - protein, 17 aa, Mycobacterium
WRLLGGLAVLGAVSPLW

SEQ ID NO: 337244 - protein, 17 aa, Mycobacterium
WRLLRAGNATLILSFLG

SEQ ID NO: 337245 - protein, 17 aa, Mycobacterium
WRLLSGPESNTMTPRTT

SEQ ID NO: 337246 - protein, 20 aa, Mycobacterium
WRLPDATALLVGFVVTASLV

SEQ ID NO: 337247 - protein, 17 aa, Mycobacterium
WRLTVPQKRLSRFTKTG

SEQ ID NO: 337248 - protein, 20 aa, Mycobacterium
WRLVETALGRSCDRDSTGSS

SEQ ID NO: 337249 - protein, 17 aa, Mycobacterium
WRLWAKYKASTELSGGA

SEQ ID NO: 337250 - protein, 17 aa, Mycobacterium
WRMAGIFSAAGIPATLA

SEQ ID NO: 337251 - protein, 20 aa, Mycobacterium
WRMHAAVLPPSVFGGGPLKS

SEQ ID NO: 337252 - protein, 35 aa, Mycobacterium
WRMPPLALLEPVRWSPGTKLGMLALRGYLVVGAIL

SEQ ID NO: 337253 - protein, 22 aa, Mycobacterium
WRMPPLTLLEPVVWSPGTRLGM

SEQ ID NO: 337254 - protein, 20 aa, Mycobacterium
WRMWYGGPWFSTRLVTATKP

SEQ ID NO: 337255 - protein, 17 aa, Mycobacterium
WRNLRFARSDMPADAVA

SEQ ID NO: 337256 - protein, 19 aa, Mycobacterium
WRNLRFPRSQIPADAVAVR

SEQ ID NO: 337257 - protein, 27 aa, Mycobacterium
WRNPYMPSPYLWRGAPDWPDTPRPPWP

SEQ ID NO: 337258 - protein, 18 aa, Mycobacterium
WRPALLALALGAGVIALG

SEQ ID NO: 337259 - protein, 20 aa, Mycobacterium
WRPDGQLQYRGRADDQVKIR

SEQ ID NO: 337260 - protein, 19 aa, Mycobacterium
WRPGVWACSLAMVAAWGSI

SEQ ID NO: 337261 - protein, 18 aa, Mycobacterium
WRPILQIIGLVVIHNVGF

SEQ ID NO: 337262 - protein, 23 aa, Mycobacterium
WRPIRNYFYWDKHCFDIPICWSI

SEQ ID NO: 337263 - protein, 23 aa, Mycobacterium
WRPIRSYFYWEKHCADIPICWSL

SEQ ID NO: 337264 - protein, 23 aa, Mycobacterium
WRPIRSYFYWEKHCYDIPICLSL

SEQ ID NO: 337265 - protein, 22 aa, Mycobacterium
WRPIRSYFYWEKHCYDIPICWS

SEQ ID NO: 337266 - protein, 23 aa, Mycobacterium
WRPIRSYFYWEKHCYDIPICWSF

SEQ ID NO: 337267 - protein, 23 aa, Mycobacterium
WRPIRSYFYWEKHCYDIPICWSI

SEQ ID NO: 337268 - protein, 23 aa, Mycobacterium
WRPIRSYFYWEKHCYDIPICWSL

SEQ ID NO: 337269 - protein, 22 aa, Mycobacterium
WRPIRSYFYWEKHCYDVPICWS

SEQ ID NO: 337270 - protein, 23 aa, Mycobacterium
WRPIRSYFYWERHCYDIPICWSL

SEQ ID NO: 337271 - protein, 36 aa, Mycobacterium
WRPIRSYFYWERHCYDIPICWSLRSLFDALDGFDQL

SEQ ID NO: 337272 - protein, 17 aa, Mycobacterium
WRPLAQVPLRQRQSVNA

SEQ ID NO: 337273 - protein, 20 aa, Mycobacterium
WRPLLEPALTILTVGALGAG

SEQ ID NO: 337274 - protein, 22 aa, Mycobacterium
WRPMRSYFYWEKHCFDVPICWS

SEQ ID NO: 337275 - protein, 18 aa, Mycobacterium
WRPPDWPPPGYPYDPNRP

SEQ ID NO: 337276 - protein, 21 aa, Mycobacterium
WRPTLLLTRSFIADYVRNPVN

SEQ ID NO: 337277 - protein, 20 aa, Mycobacterium
WRQILQVVGLFIVFNIGYYV

SEQ ID NO: 337278 - protein, 25 aa, Mycobacterium
WRQLAGGSYVWWAFAVIVVIGLVSS

SEQ ID NO: 337279 - protein, 22 aa, Mycobacterium
WRQLAGMSYVWWALAVIVVAGL

SEQ ID NO: 337280 - protein, 25 aa, Mycobacterium
WRQLVGGSYLWWALAVIVAIGTVTL

SEQ ID NO: 337281 - protein, 23 aa, Mycobacterium
WRQRFVTAWAGFRGAVSLAAALA

SEQ ID NO: 337282 - protein, 27 aa, Mycobacterium
WRQTSMLIRRQVRLIAADRGYLVVMAV

SEQ ID NO: 337283 - protein, 20 aa, Mycobacterium
WRQVIFFAHNIVIYFVVAII

SEQ ID NO: 337284 - protein, 27 aa, Mycobacterium
WRRAVLLAAAVGVMFGVVAVLTKIVMH

SEQ ID NO: 337285 - protein, 18 aa, Mycobacterium
WRRDRNLVYFLFASALFR

SEQ ID NO: 337286 - protein, 20 aa, Mycobacterium
WRRDRNLVYFLIASAIFRDG

SEQ ID NO: 337287 - protein, 19 aa, Mycobacterium
WRRGLIFAMFVFAAVFTPG

SEQ ID NO: 337288 - protein, 18 aa, Mycobacterium
WRRGRRIAPELSGLWTAG

SEQ ID NO: 337289 - protein, 19 aa, Mycobacterium
WRRLAALPAAIAGWAGLAL

SEQ ID NO: 337290 - protein, 21 aa, Mycobacterium
WRRLTKIILPLIKPAVLVALL

SEQ ID NO: 337291 - protein, 24 aa, Mycobacterium
WRRQLSWLPQRPVLVPGTVRDNLV

SEQ ID NO: 337292 - protein, 27 aa, Mycobacterium
WRRRAWAGRLFVAPNLAAVAVFMLFPL

SEQ ID NO: 337293 - protein, 18 aa, Mycobacterium
WRRRRARLTTWVASAAAA

SEQ ID NO: 337294 - protein, 19 aa, Mycobacterium
WRRTRRPEFATPRLALTLR

SEQ ID NO: 337295 - protein, 17 aa, Mycobacterium
WRRVLRSHHVEAGVGEY

SEQ ID NO: 337296 - protein, 22 aa, Mycobacterium
WRRVRAWGPWLLGLSVAVRLAW

SEQ ID NO: 337297 - protein, 18 aa, Mycobacterium
WRRVVEANAAHLRRAGIT

SEQ ID NO: 337298 - protein, 19 aa, Mycobacterium
WRSDMVRMVAYGETDARVK

SEQ ID NO: 337299 - protein, 29 aa, Mycobacterium
WRSGDGPARIGLARIRWRQDILGGVGLAM

SEQ ID NO: 337300 - protein, 18 aa, Mycobacterium
WRSGMGYALAAVAVVLSV

SEQ ID NO: 337301 - protein, 23 aa, Mycobacterium
WRSLKTANPWWVLAAALAAMASM

SEQ ID NO: 337302 - protein, 19 aa, Mycobacterium
WRSMREVILPLVSPGIAAT

SEQ ID NO: 337303 - protein, 17 aa, Mycobacterium
WRSVFAVNVPLGAIVLV

SEQ ID NO: 337304 - protein, 24 aa, Mycobacterium
WRSVPRAVLAFDIASLGWVLVFTS

SEQ ID NO: 337305 - protein, 18 aa, Mycobacterium
WRTAFVIMGAVSVVLAPL

SEQ ID NO: 337306 - protein, 26 aa, Mycobacterium
WRTDQLFCVAVGFLTAVSAAATIGGL

SEQ ID NO: 337307 - protein, 20 aa, Mycobacterium
WRTITVLVVSVGWVAATVGR

SEQ ID NO: 337308 - protein, 17 aa, Mycobacterium
WRTLAIACCTALFVMSS

SEQ ID NO: 337309 - protein, 20 aa, Mycobacterium
WRTMPAVIWAVSWPPAKLLV

SEQ ID NO: 337310 - protein, 19 aa, Mycobacterium
WRTMPAVIWDVQYPPARVV

SEQ ID NO: 337311 - protein, 19 aa, Mycobacterium
WRTSLLILAAAFALTSVPA

SEQ ID NO: 337312 - protein, 18 aa, Mycobacterium
WRTTEMFSGAPQMVVHPG

SEQ ID NO: 337313 - protein, 17 aa, Mycobacterium
WRTVGLLVGLFVLLIVL

SEQ ID NO: 337314 - protein, 18 aa, Mycobacterium
WRVARFPASVPALAATAF

SEQ ID NO: 337315 - protein, 19 aa, Mycobacterium
WRVFLHPSVAPMIVLVTAL

SEQ ID NO: 337316 - protein, 20 aa, Mycobacterium
WRVIGVAGIRAHELGNKVLP

SEQ ID NO: 337317 - protein, 17 aa, Mycobacterium
WRVLGIRLLTAIVVGLV

SEQ ID NO: 337318 - protein, 19 aa, Mycobacterium
WRVLGIWLLASLVASVIAS

SEQ ID NO: 337319 - protein, 20 aa, Mycobacterium
WRVLPAHLAVVFLVADLVLV

SEQ ID NO: 337320 - protein, 21 aa, Mycobacterium
WRVSPGVAATGHFDAVHRVLG

SEQ ID NO: 337321 - protein, 17 aa, Mycobacterium
WRVTLPLLAPGVASGAV

SEQ ID NO: 337322 - protein, 20 aa, Mycobacterium
WRVTPGVATTGHFDAVHRVI

SEQ ID NO: 337323 - protein, 19 aa, Mycobacterium
WRWFLIGFMVIFHLNILSN

SEQ ID NO: 337324 - protein, 28 aa, Mycobacterium
WRWMLGLACVPALLLAPLVIRMPDTARW

SEQ ID NO: 337325 - protein, 23 aa, Mycobacterium
WRYPDKRPHFLVWVVAPILGALA

SEQ ID NO: 337326 - protein, 20 aa, Mycobacterium
WRYPLLRERAGRWEFAVDLV

SEQ ID NO: 337327 - protein, 19 aa, Mycobacterium
WRYRVHRWEVDPTAVYTRS

SEQ ID NO: 337328 - protein, 17 aa, Mycobacterium
WSAAGVGVLYVFAAYTQ

SEQ ID NO: 337329 - protein, 18 aa, Mycobacterium
WSAANARYNDFFRGIVTR

SEQ ID NO: 337330 - protein, 24 aa, Mycobacterium
WSAGEFPLVIVMLALLVQWARSDR

SEQ ID NO: 337331 - protein, 17 aa, Mycobacterium
WSAIGNMAANGYGEHSP

SEQ ID NO: 337332 - protein, 20 aa, Mycobacterium
WSASGFVGAFGRAMNRIYEV

SEQ ID NO: 337333 - protein, 17 aa, Mycobacterium
WSAVFAGSGGRQVGLPT

SEQ ID NO: 337334 - protein, 18 aa, Mycobacterium
WSAWTRWASTPLILVPPW

SEQ ID NO: 337335 - protein, 19 aa, Mycobacterium
WSCRWEVAATLNIALQGAA

SEQ ID NO: 337336 - protein, 17 aa, Mycobacterium
WSCWGQIAALAGHIEKI

SEQ ID NO: 337337 - protein, 22 aa, Mycobacterium
WSDAIGRRPMLLAGVAAALISA

SEQ ID NO: 337338 - protein, 20 aa, Mycobacterium
WSDAQFTALREEFFAQPDLA

SEQ ID NO: 337339 - protein, 17 aa, Mycobacterium
WSDFAVIEIDPSLTDSA

SEQ ID NO: 337340 - protein, 18 aa, Mycobacterium
WSDHYVRRSGDLLASRLR

SEQ ID NO: 337341 - protein, 25 aa, Mycobacterium
WSDIEGLRFERGRWAVAQRTTGEDL

SEQ ID NO: 337342 - protein, 23 aa, Mycobacterium
WSDRWGSRMRPIRAIAAAASATM

SEQ ID NO: 337343 - protein, 19 aa, Mycobacterium
WSDVLGRRPLLLTGAGFAI

SEQ ID NO: 337344 - protein, 25 aa, Mycobacterium
WSEGPRYQRLMFWVVGVVFLLLMVP

SEQ ID NO: 337345 - protein, 17 aa, Mycobacterium
WSEGPRYQRLMLAVVGV

SEQ ID NO: 337346 - protein, 18 aa, Mycobacterium
WSELARPVQWVYGVVGFA

SEQ ID NO: 337347 - protein, 18 aa, Mycobacterium
WSEWMAHPITATVLTIFL

SEQ ID NO: 337348 - protein, 24 aa, Mycobacterium
WSFAQAAAVPVVFLTALFGLQDLA

SEQ ID NO: 337349 - protein, 24 aa, Mycobacterium
WSFSTILLALSWLNPEYVRKNLWW

SEQ ID NO: 337350 - protein, 24 aa, Mycobacterium
WSGARRFETTAGFITDTERVLRIV

SEQ ID NO: 337351 - protein, 17 aa, Mycobacterium
WSGASYAEHGNWVIGAP

SEQ ID NO: 337352 - protein, 18 aa, Mycobacterium
WSGGWWVDPVIGLAISGV

SEQ ID NO: 337353 - protein, 30 aa, Mycobacterium
WSGLRDAWVRPALVLGCGIAVFTQLSGIEM

SEQ ID NO: 337354 - protein, 17 aa, Mycobacterium
WSGLYFIAFFGAMSLAF

SEQ ID NO: 337355 - protein, 29 aa, Mycobacterium
WSGVESVSVPSWWQPYVLSVGSVGIDGSP

SEQ ID NO: 337356 - protein, 21 aa, Mycobacterium
WSIEPGDTFLVPSPVAHIGGS

SEQ ID NO: 337357 - protein, 20 aa, Mycobacterium
WSISAEWLAYVLFALLVLVL

SEQ ID NO: 337358 - protein, 18 aa, Mycobacterium
WSITALWFTAVFLMIMAR

SEQ ID NO: 337359 - protein, 24 aa, Mycobacterium
WSKGMLPGVFPVPLAITGNVADWP

SEQ ID NO: 337360 - protein, 25 aa, Mycobacterium
WSKGPRYQRLMLWIIGAVWFVVMVP

SEQ ID NO: 337361 - protein, 25 aa, Mycobacterium
WSLAQAAGVPVVFLTAFYGLSVLAG

SEQ ID NO: 337362 - protein, 21 aa, Mycobacterium
WSLAVLREYERGVVFRMGHAR

SEQ ID NO: 337363 - protein, 37 aa, Mycobacterium
WSLGGVLAYACAIGLKRLGKDVQWVGLIDAVRAGEEV

SEQ ID NO: 337364 - protein, 20 aa, Mycobacterium
WSLICLMVPSAERERIVAFF

SEQ ID NO: 337365 - protein, 18 aa, Mycobacterium
WSLIPLVIGCVVLAGLLG

SEQ ID NO: 337366 - protein, 17 aa, Mycobacterium
WSLIPLVLACIVLAGLV

SEQ ID NO: 337367 - protein, 19 aa, Mycobacterium
WSLLLGYGCLPWVATAMLG

SEQ ID NO: 337368 - protein, 19 aa, Mycobacterium
WSLLRRPSTDFVQQVLRAV

SEQ ID NO: 337369 - protein, 20 aa, Mycobacterium
WSLNAGEVIQRVVERDSPTW

SEQ ID NO: 337370 - protein, 17 aa, Mycobacterium
WSLPILLQEIFAGYFGH

SEQ ID NO: 337371 - protein, 38 aa, Mycobacterium
WSLVALRFGVTIALAWVSWRFVEQPVRRWRPQHVPMLP

SEQ ID NO: 337372 - protein, 17 aa, Mycobacterium
WSLVPLVIGCILLAGMV

SEQ ID NO: 337373 - protein, 20 aa, Mycobacterium
WSLYALFWGTAGVPGMTHPF

SEQ ID NO: 337374 - protein, 22 aa, Mycobacterium
WSMGGTCALDLTVMHPETFSAF

SEQ ID NO: 337375 - protein, 20 aa, Mycobacterium
WSMRLTARGWPKPLADALCV

SEQ ID NO: 337376 - protein, 27 aa, Mycobacterium
WSMVPPPALSPIDWTKIPPPQLPPIDW

SEQ ID NO: 337377 - protein, 18 aa, Mycobacterium
WSNLDCAPSNETLVKTFN

SEQ ID NO: 337378 - protein, 19 aa, Mycobacterium
WSNYTEVFSLMPFARMFFN

SEQ ID NO: 337379 - protein, 24 aa, Mycobacterium
WSPFLRLNTWTTYILPGLLGTVTA

SEQ ID NO: 337380 - protein, 17 aa, Mycobacterium
WSPGMPTPSTVTVTPTT

SEQ ID NO: 337381 - protein, 34 aa, Mycobacterium
WSPGTNWGDWLMKRCTRLFRPVFYYLAFWAVALT

SEQ ID NO: 337382 - protein, 24 aa, Mycobacterium
WSPGTRLGMIALRAYLVVGALLLV

SEQ ID NO: 337383 - protein, 24 aa, Mycobacterium
WSPGTRLGMIALRGYLVVGAVLLI

SEQ ID NO: 337384 - protein, 20 aa, Mycobacterium
WSPPGGRVGIRLRQLDPSHA

SEQ ID NO: 337385 - protein, 18 aa, Mycobacterium
WSPPGGRVGVRLHQVDHM

SEQ ID NO: 337386 - protein, 17 aa, Mycobacterium
WSQAPTWLVIVGEVLTI

SEQ ID NO: 337387 - protein, 18 aa, Mycobacterium
WSQIVAICGLLLGAGIAN

SEQ ID NO: 337388 - protein, 19 aa, Mycobacterium
WSQRHWAFVLTYYWGLVLS

SEQ ID NO: 337389 - protein, 22 aa, Mycobacterium
WSQSHSLAFDFSVWEIFGALLH

SEQ ID NO: 337390 - protein, 26 aa, Mycobacterium
WSQTDFPGDVPVRFEGDSYNEDGPCW

SEQ ID NO: 337391 - protein, 20 aa, Mycobacterium
WSQVYARACVVADELTMYGV

SEQ ID NO: 337392 - protein, 17 aa, Mycobacterium
WSRAGGFHRLLSTDSAE

SEQ ID NO: 337393 - protein, 17 aa, Mycobacterium
WSRVGGFHRLLSTDSAE

SEQ ID NO: 337394 - protein, 20 aa, Mycobacterium
WSSDLSMTRRLLARSITHGI

SEQ ID NO: 337395 - protein, 19 aa, Mycobacterium
WSSIKGRSTFTAAYTAPGG

SEQ ID NO: 337396 - protein, 18 aa, Mycobacterium
WSSVKTIATPAWFSDYAL

SEQ ID NO: 337397 - protein, 25 aa, Mycobacterium
WSTLPPERRPRLILYGESLGSMAGQ

SEQ ID NO: 337398 - protein, 19 aa, Mycobacterium
WSTVLLIGGVLTFVGVLQE

SEQ ID NO: 337399 - protein, 19 aa, Mycobacterium
WSVDAEWTGAVLADLLATV

SEQ ID NO: 337400 - protein, 17 aa, Mycobacterium
WSVLALFAGGPTLSRAD

SEQ ID NO: 337401 - protein, 21 aa, Mycobacterium
WSVWVVELLAGMTALGGGIKL

SEQ ID NO: 337402 - protein, 17 aa, Mycobacterium
WSWADLSVVPALGLIVL

SEQ ID NO: 337403 - protein, 24 aa, Mycobacterium
WSWSDVWLPAILLAVAGLGWWWSV

SEQ ID NO: 337404 - protein, 19 aa, Mycobacterium
WSWVLDGMVEIGALSEQDR

SEQ ID NO: 337405 - protein, 19 aa, Mycobacterium
WSYAMAWPAIAPQLVALLT

SEQ ID NO: 337406 - protein, 30 aa, Mycobacterium
WSYERDSALCGVSWVYHYAVAVYRDDRGCG

SEQ ID NO: 337407 - protein, 17 aa, Mycobacterium
WSYGEPVALLTTVIFAI

SEQ ID NO: 337408 - protein, 18 aa, Mycobacterium
WTAALAALVMLASLAVLR

SEQ ID NO: 337409 - protein, 19 aa, Mycobacterium
WTAAVGFAAVAIYWAYRWT

SEQ ID NO: 337410 - protein, 17 aa, Mycobacterium
WTAFAIRPFMSILLKRA

SEQ ID NO: 337411 - protein, 19 aa, Mycobacterium
WTAGLRRIPSWSKTLRVSS

SEQ ID NO: 337412 - protein, 25 aa, Mycobacterium
WTAHLPRRQVLVLSLTCLTLSQVIS

SEQ ID NO: 337413 - protein, 24 aa, Mycobacterium
WTAHLPRRRVLVASLTCLTASQLI

SEQ ID NO: 337414 - protein, 18 aa, Mycobacterium
WTALAAWVALAVTVIALV

SEQ ID NO: 337415 - protein, 18 aa, Mycobacterium
WTASIAILSFITGLTLIG

SEQ ID NO: 337416 - protein, 22 aa, Mycobacterium
WTDGLLRLVPNWELYVFGHTVP

SEQ ID NO: 337417 - protein, 17 aa, Mycobacterium
WTEPVPTGWLRGFLHAR

SEQ ID NO: 337418 - protein, 17 aa, Mycobacterium
WTFASLIVVALGALMFI

SEQ ID NO: 337419 - protein, 17 aa, Mycobacterium
WTFHGHTHYLVIDDVDQ

SEQ ID NO: 337420 - protein, 19 aa, Mycobacterium
WTFQAAPSTARFVAVMILY

SEQ ID NO: 337421 - protein, 17 aa, Mycobacterium
WTFSIMLGTAIVGAITF

SEQ ID NO: 337422 - protein, 17 aa, Mycobacterium
WTGACLVFAISFNKVLQ

SEQ ID NO: 337423 - protein, 18 aa, Mycobacterium
WTGATGWGTGYPGTAGAP

SEQ ID NO: 337424 - protein, 20 aa, Mycobacterium
WTHHWVWMVPFMVWLLHGPW

SEQ ID NO: 337425 - protein, 17 aa, Mycobacterium
WTHPRLLGVSISDHCLH

SEQ ID NO: 337426 - protein, 18 aa, Mycobacterium
WTITAGKELSRWIGDARV

SEQ ID NO: 337427 - protein, 31 aa, Mycobacterium
WTKIPPPQLPPIDWTKIPPPQIPQFQDPFAQ

SEQ ID NO: 337428 - protein, 21 aa, Mycobacterium
WTLASLKDMPAAITLNATQEG

SEQ ID NO: 337429 - protein, 22 aa, Mycobacterium
WTLLAGPGWVVFGALKQIIGLF

SEQ ID NO: 337430 - protein, 24 aa, Mycobacterium
WTLLEVIPNLTLIVVLGFGAYAAG

SEQ ID NO: 337431 - protein, 17 aa, Mycobacterium
WTLLKVTAVPAVLMAVP

SEQ ID NO: 337432 - protein, 17 aa, Mycobacterium
WTLPLLIRRLKVSAEAD

SEQ ID NO: 337433 - protein, 17 aa, Mycobacterium
WTLRALPFAVLAPLRHS

SEQ ID NO: 337434 - protein, 31 aa, Mycobacterium
WTLSDSAFMAWGWRVGFWLSVIIVAIGYYIR

SEQ ID NO: 337435 - protein, 33 aa, Mycobacterium
WTMFHSAAFDFSVWELWGPLLHGGRLVVVEHDV

SEQ ID NO: 337436 - protein, 20 aa, Mycobacterium
WTNWLENFLILLIPFSLPRT

SEQ ID NO: 337437 - protein, 18 aa, Mycobacterium
WTPVLAVASLDGQPRRVE

SEQ ID NO: 337438 - protein, 17 aa, Mycobacterium
WTPYSLQACNWYLGALG

SEQ ID NO: 337439 - protein, 23 aa, Mycobacterium
WTQQLPFGIAITGLLAVAASYAA

SEQ ID NO: 337440 - protein, 18 aa, Mycobacterium
WTQVHWPAHAALIHHGYD

SEQ ID NO: 337441 - protein, 26 aa, Mycobacterium
WTRIRGRLPALLGLALVEAVVVAALA

SEQ ID NO: 337442 - protein, 17 aa, Mycobacterium
WTRLRRPTLALGTSIVL

SEQ ID NO: 337443 - protein, 27 aa, Mycobacterium
WTSPARRTRTPWLLAVAVLVVVIVVVG

SEQ ID NO: 337444 - protein, 18 aa, Mycobacterium
WTTLGGFIRTQALVSFVD

SEQ ID NO: 337445 - protein, 21 aa, Mycobacterium
WTTPLWLVMMVIPFVYLLVRH

SEQ ID NO: 337446 - protein, 17 aa, Mycobacterium
WTVCAAMLVPLTISDVS

SEQ ID NO: 337447 - protein, 23 aa, Mycobacterium
WTVIAVLALFGWPQVARIARGSV

SEQ ID NO: 337448 - protein, 18 aa, Mycobacterium
WTYDTYRPAPAPKPPAQQ

SEQ ID NO: 337449 - protein, 19 aa, Mycobacterium
WTYFARLVRNSVIELKARP

SEQ ID NO: 337450 - protein, 18 aa, Mycobacterium
WVAAGSFYGGGSVPPDGS

SEQ ID NO: 337451 - protein, 17 aa, Mycobacterium
WVAAKCIAMSVVLGLPI

SEQ ID NO: 337452 - protein, 24 aa, Mycobacterium
WVAATLWIPPLVYFGLRRFGREPE

SEQ ID NO: 337453 - protein, 29 aa, Mycobacterium
WVAATVGRLHPVWVALPVVVLALLAFSTV

SEQ ID NO: 337454 - protein, 19 aa, Mycobacterium
WVAGPALMFALAWLLLPDL

SEQ ID NO: 337455 - protein, 17 aa, Mycobacterium
WVAIRSALILGRSVDNW

SEQ ID NO: 337456 - protein, 20 aa, Mycobacterium
WVAIVLVFYLVWGRHHSALN

SEQ ID NO: 337457 - protein, 18 aa, Mycobacterium
WVARARIALSGLAVSGSA

SEQ ID NO: 337458 - protein, 18 aa, Mycobacterium
WVATAVAVFVLIPAGILG

SEQ ID NO: 337459 - protein, 18 aa, Mycobacterium
WVATIAGLIGFVLSVATP

SEQ ID NO: 337460 - protein, 19 aa, Mycobacterium
WVATIAGLLGFVLSVSIPL

SEQ ID NO: 337461 - protein, 20 aa, Mycobacterium
WVATIAGLLGFVMAVAVPLL

SEQ ID NO: 337462 - protein, 17 aa, Mycobacterium
WVAVLALGAGCLVGSRI

SEQ ID NO: 337463 - protein, 17 aa, Mycobacterium
WVDAAFKKRGIDPEQFW

SEQ ID NO: 337464 - protein, 23 aa, Mycobacterium
WVDVPDRLLQRWTGVDLTLDVSG

SEQ ID NO: 337465 - protein, 19 aa, Mycobacterium
WVDVVLRILIGSAVVLLPI

SEQ ID NO: 337466 - protein, 18 aa, Mycobacterium
WVEGHGKPYVDADGNTDG

SEQ ID NO: 337467 - protein, 18 aa, Mycobacterium
WVFAPRYAAGAAVLAALA

SEQ ID NO: 337468 - protein, 18 aa, Mycobacterium
WVFLFPAGVLVLIILCSN

SEQ ID NO: 337469 - protein, 20 aa, Mycobacterium
WVFTAIPWVVAAAGIGGIAL

SEQ ID NO: 337470 - protein, 17 aa, Mycobacterium
WVGGVPIRVFGGRFTAP

SEQ ID NO: 337471 - protein, 17 aa, Mycobacterium
WVGMPPSPVTLGHARGP

SEQ ID NO: 337472 - protein, 18 aa, Mycobacterium
WVGPRAAVALAGIALVAF

SEQ ID NO: 337473 - protein, 19 aa, Mycobacterium
WVGQLTFVPGIAVLAYTII

SEQ ID NO: 337474 - protein, 21 aa, Mycobacterium
WVGWLPLRWTAFAVRPFQRAL

SEQ ID NO: 337475 - protein, 24 aa, Mycobacterium
WVIFLPSVVRRRLPEKWAADHDVD

SEQ ID NO: 337476 - protein, 17 aa, Mycobacterium
WVIGALLLILAMFEGYF

SEQ ID NO: 337477 - protein, 18 aa, Mycobacterium
WVIGSLLLILAMFEGFFG

SEQ ID NO: 337478 - protein, 24 aa, Mycobacterium
WVIGSLLLILAMFEGFFGYSLPDD

SEQ ID NO: 337479 - protein, 18 aa, Mycobacterium
WVIGSLLLILAMFEGYFG

SEQ ID NO: 337480 - protein, 18 aa, Mycobacterium
WVILALRSGRLGVDLIAV

SEQ ID NO: 337481 - protein, 18 aa, Mycobacterium
WVIREGRRSRIDATNRSV

SEQ ID NO: 337482 - protein, 18 aa, Mycobacterium
WVIVLAVAVGTLLLSVLA

SEQ ID NO: 337483 - protein, 18 aa, Mycobacterium
WVLAAALAGLRSRAGALL

SEQ ID NO: 337484 - protein, 22 aa, Mycobacterium
WVLCFLVLVWVLLWGDLSPANI

SEQ ID NO: 337485 - protein, 18 aa, Mycobacterium
WVLCSVLVNGLRTVLSST

SEQ ID NO: 337486 - protein, 17 aa, Mycobacterium
WVLDGMVDIGALSQADR

SEQ ID NO: 337487 - protein, 18 aa, Mycobacterium
WVLDPELDTLGATEWYRN

SEQ ID NO: 337488 - protein, 20 aa, Mycobacterium
WVLGVGWAVAAAACFTAGVA

SEQ ID NO: 337489 - protein, 17 aa, Mycobacterium
WVLHRISGATIFFFLFV

SEQ ID NO: 337490 - protein, 18 aa, Mycobacterium
WVLLPLILTFQGRMSPRR

SEQ ID NO: 337491 - protein, 17 aa, Mycobacterium
WVLPVHRMSGLMARILA

SEQ ID NO: 337492 - protein, 20 aa, Mycobacterium
WVLRGDIYRALNWMAPAEAD

SEQ ID NO: 337493 - protein, 17 aa, Mycobacterium
WVLSLVGLLLIGYLAAV

SEQ ID NO: 337494 - protein, 20 aa, Mycobacterium
WVLYPCALGMMVLSKSFSVL

SEQ ID NO: 337495 - protein, 23 aa, Mycobacterium
WVLYPCALSMLVLSKSFGVLRGA

SEQ ID NO: 337496 - protein, 21 aa, Mycobacterium
WVLYQWRWSITALWFTAVFLM

SEQ ID NO: 337497 - protein, 20 aa, Mycobacterium
WVMVAVALPLTFPPLTEMAQ

SEQ ID NO: 337498 - protein, 26 aa, Mycobacterium
WVNNAWVAAQCIGFAILLGLPIPYIL

SEQ ID NO: 337499 - protein, 19 aa, Mycobacterium
WVNNSWVAAKCIAMSVVLG

SEQ ID NO: 337500 - protein, 17 aa, Mycobacterium
WVNRRPALVAVVAVAGL

SEQ ID NO: 337501 - protein, 17 aa, Mycobacterium
WVPEFLFKRDVMPNPAA

SEQ ID NO: 337502 - protein, 25 aa, Mycobacterium
WVPELAMDIALRFDALAAIMSVLVL

SEQ ID NO: 337503 - protein, 19 aa, Mycobacterium
WVPGLSMDITLRFDALAAI

SEQ ID NO: 337504 - protein, 17 aa, Mycobacterium
WVPLVVVVALVIGGVAV

SEQ ID NO: 337505 - protein, 19 aa, Mycobacterium
WVQNALSFIGFVPPDENDL

SEQ ID NO: 337506 - protein, 23 aa, Mycobacterium
WVQRPRVWWWTAIGNSGAMTLYL

SEQ ID NO: 337507 - protein, 23 aa, Mycobacterium
WVRASAWLSQLYPLWRDITKSVD

SEQ ID NO: 337508 - protein, 18 aa, Mycobacterium
WVRIAIAAVAAHRRGRAV

SEQ ID NO: 337509 - protein, 19 aa, Mycobacterium
WVRRIVDPPVRVLIRDGQL

SEQ ID NO: 337510 - protein, 25 aa, Mycobacterium
WVSARFGWSMLKSMLVLAIPVNYIW

SEQ ID NO: 337511 - protein, 17 aa, Mycobacterium
WVSCLFVACARAVGRWA

SEQ ID NO: 337512 - protein, 23 aa, Mycobacterium
WVSDAGVRYGLMSSREGTSTEKA

SEQ ID NO: 337513 - protein, 17 aa, Mycobacterium
WVSDNGVRFGIAANDDT

SEQ ID NO: 337514 - protein, 17 aa, Mycobacterium
WVSVPTLAVFAASAITL

SEQ ID NO: 337515 - protein, 24 aa, Mycobacterium
WVSVVLVFYFVWGRHHSALNDGGD

SEQ ID NO: 337516 - protein, 24 aa, Mycobacterium
WVTAQCIAMSILLGIPIPYILFQN

SEQ ID NO: 337517 - protein, 22 aa, Mycobacterium
WVTFMVRKSRRQRRTEAEAEAI

SEQ ID NO: 337518 - protein, 19 aa, Mycobacterium
WVTPEAGSLKHLRTRLRDE

SEQ ID NO: 337519 - protein, 17 aa, Mycobacterium
WVTPLGPVVLGMKALAL

SEQ ID NO: 337520 - protein, 18 aa, Mycobacterium
WVVAQCVIAVAFGAGLFV

SEQ ID NO: 337521 - protein, 20 aa, Mycobacterium
WVVASALGGPILFTAICLAV

SEQ ID NO: 337522 - protein, 18 aa, Mycobacterium
WVVASALGGPLLIAALLL

SEQ ID NO: 337523 - protein, 18 aa, Mycobacterium
WVVIIVLGVTNWVSYARV

SEQ ID NO: 337524 - protein, 26 aa, Mycobacterium
WVVLALARGRFRSVHPLLYVVAMLFV

SEQ ID NO: 337525 - protein, 17 aa, Mycobacterium
WVVLVATVGLFFTGDHQ

SEQ ID NO: 337526 - protein, 25 aa, Mycobacterium
WVVSGLKLNIGFALVGAIVGEYISS

SEQ ID NO: 337527 - protein, 23 aa, Mycobacterium
WVVTLCVPGVRFVGGDTTLQRVL

SEQ ID NO: 337528 - protein, 24 aa, Mycobacterium
WVVYQWRWSIAALWFTAVFLLCMA

SEQ ID NO: 337529 - protein, 18 aa, Mycobacterium
WVYLPAAAGTVFVVLPLI

SEQ ID NO: 337530 - protein, 19 aa, Mycobacterium
WVYVPRFLPGPSEQTDAVD

SEQ ID NO: 337531 - protein, 21 aa, Mycobacterium
WWAAIVSVALLTWVLMHPTTT

SEQ ID NO: 337532 - protein, 17 aa, Mycobacterium
WWAALLIAIVSLALVLG

SEQ ID NO: 337533 - protein, 18 aa, Mycobacterium
WWADAARSPGMWHALANS

SEQ ID NO: 337534 - protein, 18 aa, Mycobacterium
WWAIGLGMILGGALGNLV

SEQ ID NO: 337535 - protein, 20 aa, Mycobacterium
WWASHPGLGLTLLAGGGALV

SEQ ID NO: 337536 - protein, 25 aa, Mycobacterium
WWDRRKGRHGRGIVLTALGYGITVA

SEQ ID NO: 337537 - protein, 18 aa, Mycobacterium
WWDRRRGRHGRGIALTAL

SEQ ID NO: 337538 - protein, 17 aa, Mycobacterium
WWEFPRDIEARLSEVAR

SEQ ID NO: 337539 - protein, 20 aa, Mycobacterium
WWGSEQLGLLVFVPLIALAP

SEQ ID NO: 337540 - protein, 17 aa, Mycobacterium
WWIPLSVLLEFLIGWMW

SEQ ID NO: 337541 - protein, 17 aa, Mycobacterium
WWITFAASPAYIALALA

SEQ ID NO: 337542 - protein, 25 aa, Mycobacterium
WWKMHRLRMRDSKLGLLPKFSTLFG

SEQ ID NO: 337543 - protein, 17 aa, Mycobacterium
WWLGGRLGLEDKLRALL

SEQ ID NO: 337544 - protein, 17 aa, Mycobacterium
WWLGLYLLARNPRKPVL

SEQ ID NO: 337545 - protein, 17 aa, Mycobacterium
WWLGLYLVARDPRKPVL

SEQ ID NO: 337546 - protein, 24 aa, Mycobacterium
WWLHRQVPRGYGWVRRTVQSPPAV

SEQ ID NO: 337547 - protein, 17 aa, Mycobacterium
WWLLAAHATHFAVIPLA

SEQ ID NO: 337548 - protein, 20 aa, Mycobacterium
WWLLTRRNVDVLSRNRLTLA

SEQ ID NO: 337549 - protein, 17 aa, Mycobacterium
WWLMLAKAVAIFVFLLL

SEQ ID NO: 337550 - protein, 22 aa, Mycobacterium
WWLTEAGARFGVEDTKEAREAL

SEQ ID NO: 337551 - protein, 17 aa, Mycobacterium
WWMMVAWSQARRETTRT

SEQ ID NO: 337552 - protein, 30 aa, Mycobacterium
WWPGVKEPLLRWLAIAAISIVIALVFWGPY

SEQ ID NO: 337553 - protein, 18 aa, Mycobacterium
WWPSKIGASSTRRRVYQR

SEQ ID NO: 337554 - protein, 18 aa, Mycobacterium
WWPVVLAGGVLVAAVAAV

SEQ ID NO: 337555 - protein, 20 aa, Mycobacterium
WWQERLMLWATIGLAVVSPM

SEQ ID NO: 337556 - protein, 20 aa, Mycobacterium
WWQRRPTRGSTWAVGRPPRR

SEQ ID NO: 337557 - protein, 32 aa, Mycobacterium
WWQTFWRITLPSIRWGLTYGIVLTIARTLGEF

SEQ ID NO: 337558 - protein, 32 aa, Mycobacterium; identical to SEQ ID NO: 18391

SEQ ID NO: 337559 - protein, 17 aa, Mycobacterium
WWRETRFQAYQGVSMPY

SEQ ID NO: 337560 - protein, 22 aa, Mycobacterium
WWRIPVLILVSFANAWAEEIIV

SEQ ID NO: 337561 - protein, 22 aa, Mycobacterium
WWRQLAGMSYVWWALAVIVAAG

SEQ ID NO: 337562 - protein, 23 aa, Mycobacterium
WWRQLAGMSYVWWALAVLLAAGL

SEQ ID NO: 337563 - protein, 27 aa, Mycobacterium
WWRQLSWLPQRSVLIPGTVRDNLVLLG

SEQ ID NO: 337564 - protein, 18 aa, Mycobacterium
WWRQRLVDHVRRLGIPDA

SEQ ID NO: 337565 - protein, 27 aa, Mycobacterium
WWRSDRLFCIAVAFLALVFAATTISGV

SEQ ID NO: 337566 - protein, 18 aa, Mycobacterium
WWRTSELLAMFGGHLNLG

SEQ ID NO: 337567 - protein, 17 aa, Mycobacterium
WWRYRYDKFGWTTRSSQ

SEQ ID NO: 337568 - protein, 24 aa, Mycobacterium
WWSVSSLLVCNWIALFENHRARVT

SEQ ID NO: 337569 - protein, 17 aa, Mycobacterium
WWTAMLLAGPGWVLFGA

SEQ ID NO: 337570 - protein, 22 aa, Mycobacterium
WWTENLRYYYLILPTTDGAISR

SEQ ID NO: 337571 - protein, 22 aa, Mycobacterium
WWTENLRYYYLILPTVDGAIAR

SEQ ID NO: 337572 - protein, 17 aa, Mycobacterium
WWTVYAPAGEENRRDLA

SEQ ID NO: 337573 - protein, 21 aa, Mycobacterium
WWVALAELWPASSRPWIGGSP

SEQ ID NO: 337574 - protein, 19 aa, Mycobacterium
WWVGLLVYFLPRRSWLRAA

SEQ ID NO: 337575 - protein, 19 aa, Mycobacterium
WWWGLLLAFVPIHLVVSAV

SEQ ID NO: 337576 - protein, 19 aa, Mycobacterium
WYAAMLFAVVPLRNALPNA

SEQ ID NO: 337577 - protein, 18 aa, Mycobacterium
WYAAMLFAVVPLRNILPG

SEQ ID NO: 337578 - protein, 19 aa, Mycobacterium
WYAAMLFAVVPLRNILPGA

SEQ ID NO: 337579 - protein, 19 aa, Mycobacterium
WYAAMLFAVVPLRNILPGS

SEQ ID NO: 337580 - protein, 18 aa, Mycobacterium
WYAVFGVIICILARVTPP

SEQ ID NO: 337581 - protein, 21 aa, Mycobacterium
WYDYPVAAGLSLVVLFTLVEI

SEQ ID NO: 337582 - protein, 22 aa, Mycobacterium
WYFVPVCLIALIGGMSTGTTAL

SEQ ID NO: 337583 - protein, 23 aa, Mycobacterium
WYLACWVTALLAVRVTLGAESAV

SEQ ID NO: 337584 - protein, 17 aa, Mycobacterium
WYLAVPLIITLGLLNFS

SEQ ID NO: 337585 - protein, 17 aa, Mycobacterium
WYLLKGRADDARRALLR

SEQ ID NO: 337586 - protein, 17 aa, Mycobacterium
WYLPVGLQGELATPESG

SEQ ID NO: 337587 - protein, 17 aa, Mycobacterium
WYMSFWPIIAIAVITVT

SEQ ID NO: 337588 - protein, 34 aa, Mycobacterium
WYNTALGLAMLFGRFLPMILVLALAGSLARQGAT

SEQ ID NO: 337589 - protein, 30 aa, Mycobacterium
WYNTALGLAMVFGRFLPIVLVLALAGSLVR

SEQ ID NO: 337590 - protein, 25 aa, Mycobacterium
WYTAIVAFALLAWVLTHKSTTQIGG

SEQ ID NO: 337591 - protein, 19 aa, Mycobacterium
WYTQLPFLLEAVIAALAGV

SEQ ID NO: 337592 - protein, 19 aa, Mycobacterium
WYTQLPFLMEAMLAATLGV

SEQ ID NO: 337593 - protein, 18 aa, Mycobacterium
WYTWLAFSIWVSVVLVFY

SEQ ID NO: 337594 - protein, 19 aa, Mycobacterium
WYWLLAGPFSALSLILIEK

SEQ ID NO: 337595 - protein, 20 aa, Mycobacterium
WYWNRYPGARVDIPSVDYMF

SEQ ID NO: 337596 - protein, 17 aa, Mycobacterium
WYWRLLATRPMVWLGEI

SEQ ID NO: 337597 - protein, 19 aa, Mycobacterium
YAAAGYVIYGASWRDTDDY

SEQ ID NO: 337598 - protein, 17 aa, Mycobacterium
YAAAHLPYVAWLTKASS

SEQ ID NO: 337599 - protein, 24 aa, Mycobacterium
YAADGNWAAAIRHRLRAVARELEE

SEQ ID NO: 337600 - protein, 19 aa, Mycobacterium
YAAEIIRAAILSIPKGQWE

SEQ ID NO: 337601 - protein, 32 aa, Mycobacterium
YAAESGVGVVLSFVAGLVVVFAVGAVAPDDRV

SEQ ID NO: 337602 - protein, 21 aa, Mycobacterium
YAAGCVVAVLAVRYASIFTAV

SEQ ID NO: 337603 - protein, 27 aa, Mycobacterium
YAAIAVWCVTAIVGALAARRGYRHWRA

SEQ ID NO: 337604 - protein, 18 aa, Mycobacterium
YAAIAVWCVTAVVGVFAA

SEQ ID NO: 337605 - protein, 23 aa, Mycobacterium
YAALCIGAILTVWAMLHTIYAAR

SEQ ID NO: 337606 - protein, 30 aa, Mycobacterium
YAAMAADIYKWGEFGMLPALNARRHPDRAA

SEQ ID NO: 337607 - protein, 32 aa, Mycobacterium
YAAMATEIAKWGEFGMLPSFNARRHPHRAACI

SEQ ID NO: 337608 - protein, 25 aa, Mycobacterium
YAATGRGTGPLGFAGTAPAAASTHV

SEQ ID NO: 337609 - protein, 25 aa, Mycobacterium
YAAWRMFVRRDWRYAVVLVGYCAGW

SEQ ID NO: 337610 - protein, 17 aa, Mycobacterium
YACAIGLKREGADVRFV

SEQ ID NO: 337611 - protein, 21 aa, Mycobacterium
YADDGTPLWPGLPPAPPPSDQ

SEQ ID NO: 337612 - protein, 28 aa, Mycobacterium
YADEVVVDWPHRYLRAEAAGGRVDARTV

SEQ ID NO: 337613 - protein, 25 aa, Mycobacterium
YADLDRLEWAKACFDEGQRLQGLLL

SEQ ID NO: 337614 - protein, 23 aa, Mycobacterium
YADLGFEVHQVYGLTESCGPGCV

SEQ ID NO: 337615 - protein, 26 aa, Mycobacterium
YADSLTEVFLWAAPVAVVGFVLALFL

SEQ ID NO: 337616 - protein, 18 aa, Mycobacterium
YADYLKATCRAIVTPEQN

SEQ ID NO: 337617 - protein, 24 aa, Mycobacterium
YAELPRSGGLYPTGNVTYRGTQIG

SEQ ID NO: 337618 - protein, 26 aa, Mycobacterium
YAEYHLRGAMYGHLGQGCIHSRVKFD

SEQ ID NO: 337619 - protein, 19 aa, Mycobacterium
YAFECPLLLGTTAVLMDRW

SEQ ID NO: 337620 - protein, 23 aa, Mycobacterium
YAFLCATALIVVRIEERHARSIA

SEQ ID NO: 337621 - protein, 23 aa, Mycobacterium
YAFLCATALVVVRIEERHIRSVA

SEQ ID NO: 337622 - protein, 19 aa, Mycobacterium
YAFLCATALVVVRTEERRV

SEQ ID NO: 337623 - protein, 17 aa, Mycobacterium
YAFMRRRFWLQDLGVDQ

SEQ ID NO: 337624 - protein, 21 aa, Mycobacterium
YAFPVQQLLAILGFANSQPFL

SEQ ID NO: 337625 - protein, 21 aa, Mycobacterium
YAFQRRRFWEVPGADGPADAT

SEQ ID NO: 337626 - protein, 17 aa, Mycobacterium
YAFWSQRQWAFELTYYW

SEQ ID NO: 337627 - protein, 27 aa, Mycobacterium
YAFYDFERTWPLTAFALVFAIVIVAVA

SEQ ID NO: 337628 - protein, 22 aa, Mycobacterium
YAGAAALTWKVYVRRPVGYLPA

SEQ ID NO: 337629 - protein, 22 aa, Mycobacterium
YAGAAALTWKVYVRRPVVGIQA

SEQ ID NO: 337630 - protein, 19 aa, Mycobacterium
YAGAFGLSILFWQHLVGLH

SEQ ID NO: 337631 - protein, 17 aa, Mycobacterium
YAGAVVVGAIGIAIVAT

SEQ ID NO: 337632 - protein, 17 aa, Mycobacterium
YAGDHWPVLALHLATTV

SEQ ID NO: 337633 - protein, 20 aa, Mycobacterium
YAGFFGTAVLFAFHVVTGRP

SEQ ID NO: 337634 - protein, 26 aa, Mycobacterium
YAGGPAWTWTAAKAWLEVLPGAVTVA

SEQ ID NO: 337635 - protein, 28 aa, Mycobacterium
YAGLLLLMRARFKRLPIPIQLDSLVCAL

SEQ ID NO: 337636 - protein, 17 aa, Mycobacterium
YAGLRRRGAEGSRTDDN

SEQ ID NO: 337637 - protein, 17 aa, Mycobacterium
YAGMAGLQHQLETTKEL

SEQ ID NO: 337638 - protein, 23 aa, Mycobacterium
YAGNWATSVWCFRAGAEEKIDAD

SEQ ID NO: 337639 - protein, 23 aa, Mycobacterium
YAGNWATSVWCFRAGAEEKIEAS

SEQ ID NO: 337640 - protein, 24 aa, Mycobacterium
YAGNWATSVWCFRPGAEEKLEANV

SEQ ID NO: 337641 - protein, 23 aa, Mycobacterium
YAGPLAWWAYHRWGRPATPRWQH

SEQ ID NO: 337642 - protein, 18 aa, Mycobacterium
YAGVPWWGAVLAAVTATA

SEQ ID NO: 337643 - protein, 23 aa, Mycobacterium
YAGVSGFKGFLVLTMVLTAADRA

SEQ ID NO: 337644 - protein, 26 aa, Mycobacterium
YAGWDPDWFKFFLGAMLLFAVIANNA

SEQ ID NO: 337645 - protein, 27 aa, Mycobacterium
YAGWNPDWFKFFLGAMLLFAVVANNVV

SEQ ID NO: 337646 - protein, 22 aa, Mycobacterium
YAHAHLGYSRGFIWSVGAVVGL

SEQ ID NO: 337647 - protein, 19 aa, Mycobacterium
YAHGRGLLHRDVKPANILI

SEQ ID NO: 337648 - protein, 17 aa, Mycobacterium
YAHWASHAVRGDFGKTV

SEQ ID NO: 337649 - protein, 27 aa, Mycobacterium
YAIARYRAGGTLTRFGMLAAQVLPPAV

SEQ ID NO: 337650 - protein, 22 aa, Mycobacterium
YAKNRARLGVSPGVRVGLVDAI

SEQ ID NO: 337651 - protein, 25 aa, Mycobacterium
YALAAAVCWACYILLTQRVGDEVAG

SEQ ID NO: 337652 - protein, 21 aa, Mycobacterium
YALACSAFHLLTGTQPYDYPS

SEQ ID NO: 337653 - protein, 24 aa, Mycobacterium
YALACVLGECLTGAPPYRADSVER

SEQ ID NO: 337654 - protein, 24 aa, Mycobacterium
YALACVLGECLTGAPPYRTDSVER

SEQ ID NO: 337655 - protein, 27 aa, Mycobacterium
YALCAVLSGLFVWKWVRETKGVSLEDM

SEQ ID NO: 337656 - protein, 23 aa, Mycobacterium
YALKWPNPWPATFGHHEFFHACT

SEQ ID NO: 337657 - protein, 20 aa, Mycobacterium
YALLMVSSGFGFLLLAHTRW

SEQ ID NO: 337658 - protein, 20 aa, Mycobacterium
YALLMVSSGFGFLLLAHTSW

SEQ ID NO: 337659 - protein, 25 aa, Mycobacterium
YALLPVLWILSLSLKPTSTVKDGKL

SEQ ID NO: 337660 - protein, 25 aa, Mycobacterium
YALLPVLWILSLSLKPTSTVKDGRL

SEQ ID NO: 337661 - protein, 17 aa, Mycobacterium
YALPERIAATLTDMANG

SEQ ID NO: 337662 - protein, 23 aa, Mycobacterium
YALRWPDPWPSTFGYHEIFHAFT

SEQ ID NO: 337663 - protein, 19 aa, Mycobacterium
YALVLLGLRVFYAREQPWT

SEQ ID NO: 337664 - protein, 20 aa, Mycobacterium
YALVPVLWVLSLSLKPTSSV

SEQ ID NO: 337665 - protein, 20 aa, Mycobacterium
YALVRLRDAAEAVGFYRGER

SEQ ID NO: 337666 - protein, 20 aa, Mycobacterium
YAMAANWFGGSTWTTISSLV

SEQ ID NO: 337667 - protein, 28 aa, Mycobacterium
YAMVAMCALALAFSRTRRWLGRGRLAAV

SEQ ID NO: 337668 - protein, 20 aa, Mycobacterium
YANEQFWRIPGGMVGVWITV

SEQ ID NO: 337669 - protein, 24 aa, Mycobacterium
YAPEEIFLVLSVAGLASYSMAPWI

SEQ ID NO: 337670 - protein, 23 aa, Mycobacterium
YAPEEIFLVLSVAGLSAYTMTPW

SEQ ID NO: 337671 - protein, 23 aa, Mycobacterium
YAPEEIFLVLSVAGMSAYAMTPW

SEQ ID NO: 337672 - protein, 23 aa, Mycobacterium
YAPEEVFLMLSVAGVSAYALTPW

SEQ ID NO: 337673 - protein, 20 aa, Mycobacterium
YAPLFPIRFLPGVDAPSGPI

SEQ ID NO: 337674 - protein, 18 aa, Mycobacterium
YAPNCVVRVNAGRVGDRV

SEQ ID NO: 337675 - protein, 20 aa, Mycobacterium
YAQADLRSAELARGLIALGI

SEQ ID NO: 337676 - protein, 17 aa, Mycobacterium
YAQGLLFIVVVGFFPAG

SEQ ID NO: 337677 - protein, 20 aa, Mycobacterium
YARHEAWTPTLMIIVITAVK

SEQ ID NO: 337678 - protein, 21 aa, Mycobacterium
YARHRADAVLVGIAECVVEDG

SEQ ID NO: 337679 - protein, 19 aa, Mycobacterium
YARLERAGAVALTTLPVFV

SEQ ID NO: 337680 - protein, 25 aa, Mycobacterium
YARQHGRRMVLIWVAAVLALTGLVA

SEQ ID NO: 337681 - protein, 20 aa, Mycobacterium
YARREHLGAVALTMLPVFVT

SEQ ID NO: 337682 - protein, 18 aa, Mycobacterium
YASALAWVMFAVLLVLTV

SEQ ID NO: 337683 - protein, 19 aa, Mycobacterium
YASDSGFLARFRLEARAVA

SEQ ID NO: 337684 - protein, 19 aa, Mycobacterium
YASIGIWAPITLVVLRMIQ

SEQ ID NO: 337685 - protein, 19 aa, Mycobacterium
YASLFPARIRYTGLSTVYQ

SEQ ID NO: 337686 - protein, 18 aa, Mycobacterium
YASPELLQGWPLDARTDI

SEQ ID NO: 337687 - protein, 17 aa, Mycobacterium
YATAASLVFNQAFFPDQ

SEQ ID NO: 337688 - protein, 17 aa, Mycobacterium
YATDISQMYEAMHHGDL

SEQ ID NO: 337689 - protein, 18 aa, Mycobacterium
YATGAFLIGYGVVVFGLA

SEQ ID NO: 337690 - protein, 22 aa, Mycobacterium
YATIFLFLGFPAWQGYGVTSMS

SEQ ID NO: 337691 - protein, 26 aa, Mycobacterium
YATLFAVAAGALWWLGRVEIRVTADP

SEQ ID NO: 337692 - protein, 17 aa, Mycobacterium
YATLGYLNTVVWLIPGM

SEQ ID NO: 337693 - protein, 19 aa, Mycobacterium
YAVACLGPLLFGVLHDVSG

SEQ ID NO: 337694 - protein, 18 aa, Mycobacterium
YAVFLISRYHDYVRKGQD

SEQ ID NO: 337695 - protein, 18 aa, Mycobacterium
YAVFRFFVEFFRANETVW

SEQ ID NO: 337696 - protein, 18 aa, Mycobacterium
YAVGLKDTFGYDDSLDVV

SEQ ID NO: 337697 - protein, 22 aa, Mycobacterium
YAVGLKSKFGYDDSLDVVGVHL

SEQ ID NO: 337698 - protein, 19 aa, Mycobacterium
YAVGTPWSQPVLRDVSFRV

SEQ ID NO: 337699 - protein, 26 aa, Mycobacterium
YAVLAVIWFWLLKRYIVEGPLEHDAE

SEQ ID NO: 337700 - protein, 26 aa, Mycobacterium
YAVLAVIWFWLLKRYVVEGPQEHDAE

SEQ ID NO: 337701 - protein, 18 aa, Mycobacterium
YAVMAARAAAPILQALAG

SEQ ID NO: 337702 - protein, 25 aa, Mycobacterium
YAVPELPLAGAMVLGAIVAPPDAVS

SEQ ID NO: 337703 - protein, 23 aa, Mycobacterium
YAVTSWALISGWGDDAAVARATD

SEQ ID NO: 337704 - protein, 24 aa, Mycobacterium
YAVVELMALIGLTAAIGFPWAVLV

SEQ ID NO: 337705 - protein, 17 aa, Mycobacterium
YAVVSLILFVNWIRVLV

SEQ ID NO: 337706 - protein, 23 aa, Mycobacterium
YAWPYRWLIAVVAGLQLISTLTS

SEQ ID NO: 337707 - protein, 27 aa, Mycobacterium
YAYGPGFQGLVGVWRRDSELFAEVVAP

SEQ ID NO: 337708 - protein, 17 aa, Mycobacterium
YAYIPFQYASVIVGAYL

SEQ ID NO: 337709 - protein, 18 aa, Mycobacterium
YCGSPAWNHSYTIAALRA

SEQ ID NO: 337710 - protein, 20 aa, Mycobacterium
YCLGLGIPFVLLAFGSARAV

SEQ ID NO: 337711 - protein, 20 aa, Mycobacterium
YCLGLGMPFLLLAFGSARAV

SEQ ID NO: 337712 - protein, 27 aa, Mycobacterium
YCLPKPDFPIPTWGGRLLHFLPGAQLA

SEQ ID NO: 337713 - protein, 17 aa, Mycobacterium
YCRLVLRCFGVRITVSG

SEQ ID NO: 337714 - protein, 17 aa, Mycobacterium
YCVAGRPSAIVLTTGAL

SEQ ID NO: 337715 - protein, 23 aa, Mycobacterium
YDAFQRPGLLILVFVVTILSAGF

SEQ ID NO: 337716 - protein, 23 aa, Mycobacterium
YDALPRRVVHALDLVNFSLADVR

SEQ ID NO: 337717 - protein, 34 aa, Mycobacterium
YDALRPANVIGTWELLRLALTTHRKSFHLVSSTF

SEQ ID NO: 337718 - protein, 26 aa, Mycobacterium
YDATDSLLRFAMRADATLTGLCGLLI

SEQ ID NO: 337719 - protein, 25 aa, Mycobacterium
YDDAYRRPALFNPLNQAMTFRYFYN

SEQ ID NO: 337720 - protein, 25 aa, Mycobacterium
YDDFQRRSKPFIQVVQHFQSKSVGT

SEQ ID NO: 337721 - protein, 21 aa, Mycobacterium
YDDGFKRKKIVDVLRESLHNV

SEQ ID NO: 337722 - protein, 18 aa, Mycobacterium
YDEMAINILIAFVAFSLA

SEQ ID NO: 337723 - protein, 18 aa, Mycobacterium
YDETARWVPRLWRRDIKA

SEQ ID NO: 337724 - protein, 25 aa, Mycobacterium
YDFGCKRPTFSNSYYRTFTKPHVHL

SEQ ID NO: 337725 - protein, 25 aa, Mycobacterium
YDGDLRFIITVTLIVVFLILAALLR

SEQ ID NO: 337726 - protein, 21 aa, Mycobacterium
YDHVRGSAKPASWDMRSVLTI

SEQ ID NO: 337727 - protein, 17 aa, Mycobacterium
YDIPGRSAVPIESETIR

SEQ ID NO: 337728 - protein, 20 aa, Mycobacterium
YDITFYPRWLLPAASGHELH

SEQ ID NO: 337729 - protein, 19 aa, Mycobacterium
YDLDGLRGIAIFLVAVFHV

SEQ ID NO: 337730 - protein, 22 aa, Mycobacterium
YDLGLFYKYAFADPTFADLVSA

SEQ ID NO: 337731 - protein, 17 aa, Mycobacterium
YDLLALWSHVSTASVWM

SEQ ID NO: 337732 - protein, 18 aa, Mycobacterium
YDLMIAGISALCLIFLIM

SEQ ID NO: 337733 - protein, 17 aa, Mycobacterium
YDLQAALADSTRTFEQV

SEQ ID NO: 337734 - protein, 28 aa, Mycobacterium
YDNRRELSEGFDLLPLMADNVYNIIDPV

SEQ ID NO: 337735 - protein, 21 aa, Mycobacterium
YDPAHEFAYFGILGLVAIVVG

SEQ ID NO: 337736 - protein, 29 aa, Mycobacterium
YDPNSRFTMGMLWPGEKGWTEAGERRVLC

SEQ ID NO: 337737 - protein, 21 aa, Mycobacterium
YDPRIGRQFLNAGLGFGGGCL

SEQ ID NO: 337738 - protein, 19 aa, Mycobacterium
YDPSLRSTRSLDLQYRDDH

SEQ ID NO: 337739 - protein, 25 aa, Mycobacterium
YDQFGWQVKCGSGFTTDLTQASNAE

SEQ ID NO: 337740 - protein, 22 aa, Mycobacterium
YDQPRLGSLATYLDELAPPIEV

SEQ ID NO: 337741 - protein, 20 aa, Mycobacterium
YDQYGWQVKCGSGFATDLTQ

SEQ ID NO: 337742 - protein, 25 aa, Mycobacterium
YDRNEIFPKWFAYVSIWQIITEVIA

SEQ ID NO: 337743 - protein, 24 aa, Mycobacterium
YDRPEQRPGWRFWRRGRRPLETKV

SEQ ID NO: 337744 - protein, 17 aa, Mycobacterium
YDRVGGRASTIDVDGFR

SEQ ID NO: 337745 - protein, 22 aa, Mycobacterium
YDRWGYDRWGYNWDGYNWSGYN

SEQ ID NO: 337746 - protein, 18 aa, Mycobacterium
YDTPPGWETTAIAPFSSA

SEQ ID NO: 337747 - protein, 26 aa, Mycobacterium
YDVTPSRLRRPGAAVLEIDDEDPEFE

SEQ ID NO: 337748 - protein, 26 aa, Mycobacterium
YDVVPSRLRRPGAVVLEIDDEDPVFE

SEQ ID NO: 337749 - protein, 20 aa, Mycobacterium
YDYGPEFGDDAEAGEDAPTK

SEQ ID NO: 337750 - protein, 20 aa, Mycobacterium
YDYPLAAAVSLIALFTLVEI

SEQ ID NO: 337751 - protein, 18 aa, Mycobacterium
YDYRLLLGHRPGGLPWPD

SEQ ID NO: 337752 - protein, 19 aa, Mycobacterium
YDYYYRPGMDLRPIPEGKN

SEQ ID NO: 337753 - protein, 17 aa, Mycobacterium
YEAKGLTAATARTVAEE

SEQ ID NO: 337754 - protein, 43 aa, Mycobacterium
YEAKRAAKGRFWRRVGTAVVRWPAPILVASAFIVLIGVVAVPG

SEQ ID NO: 337755 - protein, 20 aa, Mycobacterium
YEALLGRRAFPQDNPAALAR

SEQ ID NO: 337756 - protein, 24 aa, Mycobacterium
YEAVERRLPEVLSQLRHRAAEALL

SEQ ID NO: 337757 - protein, 19 aa, Mycobacterium
YEDPDGFFKAVKENAAEPL

SEQ ID NO: 337758 - protein, 27 aa, Mycobacterium
YEEPLDRRWIWVAGVAGAILLVAVICT

SEQ ID NO: 337759 - protein, 26 aa, Mycobacterium
YEEPRRNPLSRWLVGLAALVVLTIIV

SEQ ID NO: 337760 - protein, 24 aa, Mycobacterium
YEGNVVAVLGMPVGKVTKINAKGG

SEQ ID NO: 337761 - protein, 24 aa, Mycobacterium
YEGRFDRRSLLALWGLEIVTSCVF

SEQ ID NO: 337762 - protein, 20 aa, Mycobacterium
YEGYLAWAVGAAIVAPTTLY

SEQ ID NO: 337763 - protein, 20 aa, Mycobacterium
YEGYLVWAAGAAIFAPMALV

SEQ ID NO: 337764 - protein, 19 aa, Mycobacterium
YEIASAAGFSARDTDRVVR

SEQ ID NO: 337765 - protein, 26 aa, Mycobacterium
YELAETIARRLGLTGALGTVAESIDG

SEQ ID NO: 337766 - protein, 20 aa, Mycobacterium
YELGEILGYGGMSEVHLARD

SEQ ID NO: 337767 - protein, 17 aa, Mycobacterium
YELSVESHLRRELASEL

SEQ ID NO: 337768 - protein, 17 aa, Mycobacterium
YEMRPSWSRTYAHGNEL

SEQ ID NO: 337769 - protein, 20 aa, Mycobacterium
YEQGASWAWLLSGPIAGVGM

SEQ ID NO: 337770 - protein, 26 aa, Mycobacterium
YEQLRAVGPFDVLPFLLAVPGLILIA

SEQ ID NO: 337771 - protein, 22 aa, Mycobacterium
YERDIRFIIVVTLVIVMLVLML

SEQ ID NO: 337772 - protein, 24 aa, Mycobacterium
YERFDVGLDLAKRGYAPYLLISQS

SEQ ID NO: 337773 - protein, 26 aa, Mycobacterium
YERQQSRRAIFIWLVIVLILTSSVAA

SEQ ID NO: 337774 - protein, 23 aa, Mycobacterium
YERYMTLAAIAAMFFDLAVTAGV

SEQ ID NO: 337775 - protein, 26 aa, Mycobacterium
YESQFLPRIGPWALYGLLFTIVILFA

SEQ ID NO: 337776 - protein, 19 aa, Mycobacterium
YESRFLPKVGPWALYGLLF

SEQ ID NO: 337777 - protein, 20 aa, Mycobacterium
YETIGAWAPILLVAMRLLGG

SEQ ID NO: 337778 - protein, 18 aa, Mycobacterium
YETSRISSDFTFADAPND

SEQ ID NO: 337779 - protein, 18 aa, Mycobacterium
YEVFLIARIREYWSQLMR

SEQ ID NO: 337780 - protein, 26 aa, Mycobacterium
YEVFLLSRIREYWLASGAARPAKPSP

SEQ ID NO: 337781 - protein, 19 aa, Mycobacterium
YEVFLLSRIREYWLESPRT

SEQ ID NO: 337782 - protein, 19 aa, Mycobacterium
YEVFLVSRIREFRLQGHGG

SEQ ID NO: 337783 - protein, 27 aa, Mycobacterium
YEVKGCIAHGGMGWIYLALDRNVNDRP

SEQ ID NO: 337784 - protein, 18 aa, Mycobacterium
YEVLELELAYKPQTLLAY

SEQ ID NO: 337785 - protein, 17 aa, Mycobacterium
YEWSHHVSMAKDEGITD

SEQ ID NO: 337786 - protein, 22 aa, Mycobacterium
YFAGAVDCRAAAALLAGALPLV

SEQ ID NO: 337787 - protein, 17 aa, Mycobacterium
YFDIRYRRLPNWLTLPA

SEQ ID NO: 337788 - protein, 18 aa, Mycobacterium
YFDLAWPALILSAGIGLC

SEQ ID NO: 337789 - protein, 19 aa, Mycobacterium
YFERCPPFAVLSALVIAAA

SEQ ID NO: 337790 - protein, 27 aa, Mycobacterium
YFETLGIPCAVGMLVAVFAALTLGPAV

SEQ ID NO: 337791 - protein, 26 aa, Mycobacterium
YFETLGIPCAVGMLVAVMVALTLGPA

SEQ ID NO: 337792 - protein, 19 aa, Mycobacterium
YFFIARFFTGSGIGGEYAA

SEQ ID NO: 337793 - protein, 19 aa, Mycobacterium
YFGAWRSSALMWLVDLLLV

SEQ ID NO: 337794 - protein, 17 aa, Mycobacterium
YFGDGAVAEGAFHESLN

SEQ ID NO: 337795 - protein, 24 aa, Mycobacterium
YFGLPRWISVPLSAVLLFAVVAGG

SEQ ID NO: 337796 - protein, 20 aa, Mycobacterium
YFGPRLKNPLNYVLNPSHRV

SEQ ID NO: 337797 - protein, 29 aa, Mycobacterium
YFGSGGSPLIKWMFWTGLLITALDVLIAL

SEQ ID NO: 337798 - protein, 18 aa, Mycobacterium
YFIIRWRVWLTDRLTGDW

SEQ ID NO: 337799 - protein, 19 aa, Mycobacterium
YFISYRWSIGLQRSDRAVL

SEQ ID NO: 337800 - protein, 18 aa, Mycobacterium
YFLDRLEQAVARQSCDIA

SEQ ID NO: 337801 - protein, 32 aa, Mycobacterium
YFLGGDEMAAWGWRVPMLFGAAMGFFVLYLRR

SEQ ID NO: 337802 - protein, 22 aa, Mycobacterium
YFLIEPRNSFAVAGADSALTTG

SEQ ID NO: 337803 - protein, 23 aa, Mycobacterium
YFLIEPRYTFTIADPDNAVTTLV

SEQ ID NO: 337804 - protein, 17 aa, Mycobacterium
YFLIGGFGGGSGRSRAA

SEQ ID NO: 337805 - protein, 17 aa, Mycobacterium
YFLIGGFGQGPGRSRAA

SEQ ID NO: 337806 - protein, 17 aa, Mycobacterium
YFLPLDAWQRLFLGITF

SEQ ID NO: 337807 - protein, 19 aa, Mycobacterium
YFLSYRWSIGLQRSDRSVL

SEQ ID NO: 337808 - protein, 22 aa, Mycobacterium
YFLVCLRLVPPATLTRRDETPA

SEQ ID NO: 337809 - protein, 22 aa, Mycobacterium
YFLVCLWVFRPLPITGAEPARL

SEQ ID NO: 337810 - protein, 21 aa, Mycobacterium
YFMLELPPDFSEAIASPLTGE

SEQ ID NO: 337811 - protein, 19 aa, Mycobacterium
YFPEVLALYPGDKVLIMGV

SEQ ID NO: 337812 - protein, 27 aa, Mycobacterium
YFQTLGAPCAIGMLVAVLAALTLGPAV

SEQ ID NO: 337813 - protein, 26 aa, Mycobacterium
YFQTLGAPCAVGMLVAVLAALTLGPA

SEQ ID NO: 337814 - protein, 26 aa, Mycobacterium
YFQTLGVPCAVGMLVAVLAALTLGPA

SEQ ID NO: 337815 - protein, 26 aa, Mycobacterium
YFQTLGVPCSVGLLVGVLVSLTLGPA

SEQ ID NO: 337816 - protein, 17 aa, Mycobacterium
YFRKSLEDIIRFQAEFL

SEQ ID NO: 337817 - protein, 24 aa, Mycobacterium
YFRRLLRRWRHDVLTANAISLATP

SEQ ID NO: 337818 - protein, 30 aa, Mycobacterium
YFRRSLEDITRFQAEFLWRDYYAPGGTIDG

SEQ ID NO: 337819 - protein, 21 aa, Mycobacterium
YFTGEGWLAVSAGLLIVAFVA

SEQ ID NO: 337820 - protein, 18 aa, Mycobacterium
YFTGYLPALLLAAILTPA

SEQ ID NO: 337821 - protein, 18 aa, Mycobacterium
YFTGYLPALLLAVILTPA

SEQ ID NO: 337822 - protein, 21 aa, Mycobacterium
YFVAFEVSQGWTPGKKILGLS

SEQ ID NO: 337823 - protein, 23 aa, Mycobacterium
YFVAKGMWRKAITLTLFNVALGV

SEQ ID NO: 337824 - protein, 18 aa, Mycobacterium
YFVGRAGSMIKTAGANVA

SEQ ID NO: 337825 - protein, 18 aa, Mycobacterium
YFVMLGRAAFVFITSGEA

SEQ ID NO: 337826 - protein, 24 aa, Mycobacterium
YFVTYRWAVALQRSDRAVLEHGVE

SEQ ID NO: 337827 - protein, 17 aa, Mycobacterium
YFWQHWGIIGGEPKSFW

SEQ ID NO: 337828 - protein, 24 aa, Mycobacterium
YFYFLGRAGAMIKTAGANVTPDEV

SEQ ID NO: 337829 - protein, 18 aa, Mycobacterium
YGAALGLGTLVFQYGLGK

SEQ ID NO: 337830 - protein, 17 aa, Mycobacterium
YGAARVGARIIMLNTEF

SEQ ID NO: 337831 - protein, 26 aa, Mycobacterium
YGAFPKRFSHVHPRFLVPSFSTLIAG

SEQ ID NO: 337832 - protein, 23 aa, Mycobacterium
YGAHPLHLLTMLSGFALLGYLLA

SEQ ID NO: 337833 - protein, 22 aa, Mycobacterium
YGAICYLIFVAAFLYAIGFVGN

SEQ ID NO: 337834 - protein, 23 aa, Mycobacterium
YGAKNVKDVKCNDGNNPEVKKGA

SEQ ID NO: 337835 - protein, 18 aa, Mycobacterium
YGAKNVNDVTCNGGVSPT

SEQ ID NO: 337836 - protein, 18 aa, Mycobacterium
YGALPIVANTVIGLDGVD

SEQ ID NO: 337837 - protein, 23 aa, Mycobacterium
YGALRAARRLGVPTVAVYQTDVP

SEQ ID NO: 337838 - protein, 22 aa, Mycobacterium
YGAMFTDVFGLREGDDVRIAGV

SEQ ID NO: 337839 - protein, 19 aa, Mycobacterium
YGAPADWHAPGWPPPPSSP

SEQ ID NO: 337840 - protein, 19 aa, Mycobacterium
YGAPAGWHAPGWPPHDQQP

SEQ ID NO: 337841 - protein, 18 aa, Mycobacterium
YGAPAGWHAPGWPPPPGG

SEQ ID NO: 337842 - protein, 19 aa, Mycobacterium
YGAPAGWHAPGWPPPQQSQ

SEQ ID NO: 337843 - protein, 25 aa, Mycobacterium
YGAPVAIAVPAHWGERQVGALREAL

SEQ ID NO: 337844 - protein, 18 aa, Mycobacterium
YGAVKVYRWSMLAFLAAS

SEQ ID NO: 337845 - protein, 31 aa, Mycobacterium
YGAVPRRFAEISPRFLVPRFSTIVSSAVTAV

SEQ ID NO: 337846 - protein, 17 aa, Mycobacterium
YGCLPWVATAMLTLRAG

SEQ ID NO: 337847 - protein, 17 aa, Mycobacterium
YGDAAGLGRAVLNLLDN

SEQ ID NO: 337848 - protein, 17 aa, Mycobacterium
YGDAAGLSRAVLNLLDN

SEQ ID NO: 337849 - protein, 22 aa, Mycobacterium
YGDENFLIVGMDTRAGANSNVG

SEQ ID NO: 337850 - protein, 25 aa, Mycobacterium
YGDFFSFYLCDIVLKLNGKGGQPVY

SEQ ID NO: 337851 - protein, 26 aa, Mycobacterium
YGDFFSFYLCEMLFKLNGKGGQPVYV

SEQ ID NO: 337852 - protein, 23 aa, Mycobacterium
YGDFPAYFNPLALANSIAAIQYA

SEQ ID NO: 337853 - protein, 30 aa, Mycobacterium
YGDFSFSHQHPWLRVFSITLMFAGVTTTAI

SEQ ID NO: 337854 - protein, 17 aa, Mycobacterium
YGDIPMMGPHIGNVPLL

SEQ ID NO: 337855 - protein, 17 aa, Mycobacterium
YGDKLDERGVEYIGFAV

SEQ ID NO: 337856 - protein, 17 aa, Mycobacterium
YGDRVNFVLRYFPLPGH

SEQ ID NO: 337857 - protein, 18 aa, Mycobacterium
YGDVPSRPLVEIGQMVWF

SEQ ID NO: 337858 - protein, 18 aa, Mycobacterium
YGEFTFAQQSAWLRIFAV

SEQ ID NO: 337859 - protein, 18 aa, Mycobacterium
YGFMVRRPVHESAAAISE

SEQ ID NO: 337860 - protein, 25 aa, Mycobacterium
YGGKGGVPIGNWLNRSVFAAKFAER

SEQ ID NO: 337861 - protein, 23 aa, Mycobacterium
YGGLRKVLPVTFATFGLGYLAII

SEQ ID NO: 337862 - protein, 19 aa, Mycobacterium
YGGTSRFLSPVTFIKHPIQ

SEQ ID NO: 337863 - protein, 29 aa, Mycobacterium
YGGYLKFCMRVMVVTLWFSAGMAIFSSLH

SEQ ID NO: 337864 - protein, 28 aa, Mycobacterium
YGIFIVFLFHDWRYVFWINVPLTLIAMV

SEQ ID NO: 337865 - protein, 23 aa, Mycobacterium
YGIGMAFGMWAFFAALGSGPISV

SEQ ID NO: 337866 - protein, 18 aa, Mycobacterium
YGIPGLVLGPAIGRLADR

SEQ ID NO: 337867 - protein, 20 aa, Mycobacterium
YGISLVWLFHHWQSVFWVNV

SEQ ID NO: 337868 - protein, 17 aa, Mycobacterium
YGITAFACIWYFRRELF

SEQ ID NO: 337869 - protein, 23 aa, Mycobacterium
YGKSAYHALTYGWLMSGLVRAVT

SEQ ID NO: 337870 - protein, 21 aa, Mycobacterium
YGLATILGFIGIKLMLEALHH

SEQ ID NO: 337871 - protein, 20 aa, Mycobacterium
YGLCLKVVFDAAVSEHASHM

SEQ ID NO: 337872 - protein, 20 aa, Mycobacterium
YGLEFYAGWLTEYSLSVDNL

SEQ ID NO: 337873 - protein, 31 aa, Mycobacterium
YGLTGFACAWFYRKRLTTSFRDLMMRGVMPL

SEQ ID NO: 337874 - protein, 18 aa, Mycobacterium
YGLVFGMLLAVPFGLLAA

SEQ ID NO: 337875 - protein, 26 aa, Mycobacterium
YGLVGIIGIRIWLTNHVDFSKPVNQM

SEQ ID NO: 337876 - protein, 26 aa, Mycobacterium
YGLVGILGVRIWLTNHVDFSKPVNQM

SEQ ID NO: 337877 - protein, 17 aa, Mycobacterium
YGLVPMCAVVGAVFGTL

SEQ ID NO: 337878 - protein, 19 aa, Mycobacterium
YGMAEATVYIATREPGEPP

SEQ ID NO: 337879 - protein, 30 aa, Mycobacterium
YGMNFRFMPELTWTWGYPGVMAVMVVVCLV

SEQ ID NO: 337880 - protein, 29 aa, Mycobacterium
YGMVNTLFIPRFLLVVSFGGVVVATASYL

SEQ ID NO: 337881 - protein, 30 aa, Mycobacterium
YGMYRGAIKINLGKFFKYTGAFLVIVAAGI

SEQ ID NO: 337882 - protein, 18 aa, Mycobacterium
YGNAYACDLNATGFFPGL

SEQ ID NO: 337883 - protein, 18 aa, Mycobacterium
YGPLGGLDPVGFVPDGVR

SEQ ID NO: 337884 - protein, 18 aa, Mycobacterium
YGPPPGWQPPGYGAPGYP

SEQ ID NO: 337885 - protein, 23 aa, Mycobacterium
YGPPQPGPGPGWPQGPVNTPPAD

SEQ ID NO: 337886 - protein, 22 aa, Mycobacterium
YGPQAPRLWLPPLDEPIPLSTL

SEQ ID NO: 337887 - protein, 21 aa, Mycobacterium
YGQAVGRFLPVLGRFPRSVGG

SEQ ID NO: 337888 - protein, 20 aa, Mycobacterium
YGQSLKLQWGHRDFDRPDGT

SEQ ID NO: 337889 - protein, 19 aa, Mycobacterium
YGQSLKLQWGVHNPDGSYQ

SEQ ID NO: 337890 - protein, 22 aa, Mycobacterium
YGRETTVPWGLEIFYRRDPAGF

SEQ ID NO: 337891 - protein, 17 aa, Mycobacterium
YGRKHLLQIAIVLVGVA

SEQ ID NO: 337892 - protein, 19 aa, Mycobacterium
YGRKRMFIVEMVIFTIFLA

SEQ ID NO: 337893 - protein, 22 aa, Mycobacterium
YGRLNCSIVNAAGQLVAAQANN

SEQ ID NO: 337894 - protein, 19 aa, Mycobacterium
YGRQILKTPVWNWMIAAYL

SEQ ID NO: 337895 - protein, 17 aa, Mycobacterium
YGRRPVMALGVASSALG

SEQ ID NO: 337896 - protein, 24 aa, Mycobacterium
YGSGLPSDIWKATMDGALKGTEVE

SEQ ID NO: 337897 - protein, 21 aa, Mycobacterium
YGSGRLARLTTFMVDVLAGVP

SEQ ID NO: 337898 - protein, 24 aa, Mycobacterium
YGSHPLHLLTMIAGFAVLGYVVAT

SEQ ID NO: 337899 - protein, 17 aa, Mycobacterium
YGSLAGWFDIPGGMKHR

SEQ ID NO: 337900 - protein, 18 aa, Mycobacterium
YGSLVIVFQWGWLEFLGF

SEQ ID NO: 337901 - protein, 18 aa, Mycobacterium
YGSLVVVFQWGWLEQLGF

SEQ ID NO: 337902 - protein, 18 aa, Mycobacterium
YGSLVVVFQWGWLSSLGF

SEQ ID NO: 337903 - protein, 17 aa, Mycobacterium
YGSVLIPPSFSSKLRDL

SEQ ID NO: 337904 - protein, 23 aa, Mycobacterium
YGTGPGWPTGPYSPGPPPKGPGS

SEQ ID NO: 337905 - protein, 26 aa, Mycobacterium
YGTYFKGHLYIAGRIKDLVIIDGRNH

SEQ ID NO: 337906 - protein, 23 aa, Mycobacterium
YGTYRLEVLAAIINGLLLFGVAF

SEQ ID NO: 337907 - protein, 18 aa, Mycobacterium
YGTYRLEVLAAVINGLLL

SEQ ID NO: 337908 - protein, 21 aa, Mycobacterium
YGVAWFGAYSIVISWAEQHID

SEQ ID NO: 337909 - protein, 23 aa, Mycobacterium
YGVLPAPLVATVFDFFYQPGKLP

SEQ ID NO: 337910 - protein, 26 aa, Mycobacterium
YGVMVSSLIGWWALSRLLDRMGNVPD

SEQ ID NO: 337911 - protein, 21 aa, Mycobacterium
YGVNPPFLWQHITGRYTNISV

SEQ ID NO: 337912 - protein, 19 aa, Mycobacterium
YGVPLTVYLLGGWLGSRFP

SEQ ID NO: 337913 - protein, 24 aa, Mycobacterium
YGVPSGTVPLFFILWALSNFVGPL

SEQ ID NO: 337914 - protein, 26 aa, Mycobacterium
YGVYLWHWPIFLALNGERTGWSGLPL

SEQ ID NO: 337915 - protein, 20 aa, Mycobacterium
YGVYRKGRLQLISSAFEPLL

SEQ ID NO: 337916 - protein, 21 aa, Mycobacterium
YGVYRKGRLQLVSAAFEPLLG

SEQ ID NO: 337917 - protein, 17 aa, Mycobacterium
YGWHAGAPWGTWLFTRA

SEQ ID NO: 337918 - protein, 21 aa, Mycobacterium
YGWLAARRRVREMVLPAITTA

SEQ ID NO: 337919 - protein, 23 aa, Mycobacterium
YGYDLWIPLIFLVLVSGFIAIQI

SEQ ID NO: 337920 - protein, 19 aa, Mycobacterium
YGYLGIWAAVPFAIWLFLA

SEQ ID NO: 337921 - protein, 24 aa, Mycobacterium
YGYQHWVPAGAIAFGLFIVTNAAK

SEQ ID NO: 337922 - protein, 22 aa, Mycobacterium
YGYRLFSAFMFQHLTLSILVPP

SEQ ID NO: 337923 - protein, 18 aa, Mycobacterium
YGYSGLGEVAVFVFFGLV

SEQ ID NO: 337924 - protein, 23 aa, Mycobacterium
YGYTCGFAGLVMLAIPALLPARL

SEQ ID NO: 337925 - protein, 20 aa, Mycobacterium
YHAPHPDDLLSIIGTHRQWA

SEQ ID NO: 337926 - protein, 18 aa, Mycobacterium
YHAPHPDDLLSIVGTQRQ

SEQ ID NO: 337927 - protein, 22 aa, Mycobacterium
YHDDGFKRKKIVDVLRESLHQV

SEQ ID NO: 337928 - protein, 19 aa, Mycobacterium
YHHGVDRWRAAILTATVSA

SEQ ID NO: 337929 - protein, 17 aa, Mycobacterium
YHIARPWRWGYLGVLFV

SEQ ID NO: 337930 - protein, 26 aa, Mycobacterium
YHIARPWRWGYLGVLFVIFGFPLITM

SEQ ID NO: 337931 - protein, 21 aa, Mycobacterium
YHLATDWRTYWGPGGAGLGAA

SEQ ID NO: 337932 - protein, 17 aa, Mycobacterium
YHLVNSYGAFGVVGRTR

SEQ ID NO: 337933 - protein, 20 aa, Mycobacterium
YHPRSLRRECMRVLGRSRCY

SEQ ID NO: 337934 - protein, 17 aa, Mycobacterium
YHPVEAVVVSRATEVVL

SEQ ID NO: 337935 - protein, 22 aa, Mycobacterium
YHPVRSRPGWQLWATERLMDSA

SEQ ID NO: 337936 - protein, 17 aa, Mycobacterium
YHRFIFWAYARNGDTDP

SEQ ID NO: 337937 - protein, 18 aa, Mycobacterium
YHSLERLGATAMFSDGRA

SEQ ID NO: 337938 - protein, 18 aa, Mycobacterium
YHSLPIGGVMPGFGHVGM

SEQ ID NO: 337939 - protein, 25 aa, Mycobacterium
YHTGTPWGAWLFRRAQRLCRPVFWY

SEQ ID NO: 337940 - protein, 25 aa, Mycobacterium
YHVGRRKVSVAAKFWTLLEVIPNVA

SEQ ID NO: 337941 - protein, 19 aa, Mycobacterium
YHVITDWKTYFGPTGKGFG

SEQ ID NO: 337942 - protein, 19 aa, Mycobacterium
YHVITDWPTYFGDGGAGPA

SEQ ID NO: 337943 - protein, 18 aa, Mycobacterium
YHYYAREALKPEMTYVDY

SEQ ID NO: 337944 - protein, 17 aa, Mycobacterium
YIACLTISYLSCQLMVT

SEQ ID NO: 337945 - protein, 19 aa, Mycobacterium
YIATRGWLTLFPALTIIAV

SEQ ID NO: 337946 - protein, 20 aa, Mycobacterium
YIGATTLTWWRYVRPHGGSG

SEQ ID NO: 337947 - protein, 17 aa, Mycobacterium
YIGLAGLIASFFSIIYA

SEQ ID NO: 337948 - protein, 23 aa, Mycobacterium
YIGLLCTWLLVAVRTLRVGIGRG

SEQ ID NO: 337949 - protein, 23 aa, Mycobacterium
YIGRPDLTASRFVACPFGETGER

SEQ ID NO: 337950 - protein, 32 aa, Mycobacterium
YIGVALSWPLWWVAVCSVLCLLIVEGVVVNLV

SEQ ID NO: 337951 - protein, 19 aa, Mycobacterium
YIIAVVVWGLIDGNADAKA

SEQ ID NO: 337952 - protein, 17 aa, Mycobacterium
YILLGWVAVWFIGPIMH

SEQ ID NO: 337953 - protein, 20 aa, Mycobacterium
YILLRSAFAPLLLVGVTVLS

SEQ ID NO: 337954 - protein, 25 aa, Mycobacterium
YILWPALIIGTAWLIRRARRRAGTT

SEQ ID NO: 337955 - protein, 24 aa, Mycobacterium
YIPAEAPSNIGYRASDRHFPPARM

SEQ ID NO: 337956 - protein, 18 aa, Mycobacterium
YIPASLPSIQGFQASDRH

SEQ ID NO: 337957 - protein, 18 aa, Mycobacterium
YIPPEVFDNPDFKRGLKM

SEQ ID NO: 337958 - protein, 18 aa, Mycobacterium
YIPSCSINPVLSCGSVMI

SEQ ID NO: 337959 - protein, 18 aa, Mycobacterium
YIQSEGWADRGNPAPLML

SEQ ID NO: 337960 - protein, 26 aa, Mycobacterium
YIRLARPLIAFYNWCANTALRLVKVP

SEQ ID NO: 337961 - protein, 18 aa, Mycobacterium
YIRPVVWGGIGAAVAAAV

SEQ ID NO: 337962 - protein, 20 aa, Mycobacterium
YIRTNPKATLGLTAIVVVIM

SEQ ID NO: 337963 - protein, 17 aa, Mycobacterium
YISEGILYFAIEERDAS

SEQ ID NO: 337964 - protein, 20 aa, Mycobacterium
YISPWLFLLGVSMAGLTAYA

SEQ ID NO: 337965 - protein, 17 aa, Mycobacterium
YISYGWRIDTEQWALTN

SEQ ID NO: 337966 - protein, 19 aa, Mycobacterium
YITARLVLFATAWAATAEE

SEQ ID NO: 337967 - protein, 24 aa, Mycobacterium
YITEALKRLPAYATTLGEVVGSGP

SEQ ID NO: 337968 - protein, 23 aa, Mycobacterium
YITGRIKDLIIVDGRNHYPQDIE

SEQ ID NO: 337969 - protein, 20 aa, Mycobacterium
YITRTLCLFVIAFGLYMVPQ

SEQ ID NO: 337970 - protein, 24 aa, Mycobacterium
YIVDRLKELIKYKGYQVPPAELEA

SEQ ID NO: 337971 - protein, 20 aa, Mycobacterium
YIVGCIAAVLAVRQSGVFTA

SEQ ID NO: 337972 - protein, 19 aa, Mycobacterium
YIVGKCFDGELTMVASPAP

SEQ ID NO: 337973 - protein, 30 aa, Mycobacterium
YIVMSYCAAGSLGLRVQREGPIAWPEAMRI

SEQ ID NO: 337974 - protein, 23 aa, Mycobacterium
YKAFEMWLIVGVIYFIVIMALTK

SEQ ID NO: 337975 - protein, 18 aa, Mycobacterium
YKAPVWGYSAGSLGTPPQ

SEQ ID NO: 337976 - protein, 18 aa, Mycobacterium
YKAVEVGSTIQGVVDVPQ

SEQ ID NO: 337977 - protein, 18 aa, Mycobacterium
YKDDYKAAGVPMLPAIAT

SEQ ID NO: 337978 - protein, 18 aa, Mycobacterium
YKDDYKAAGVPMLPAVAT

SEQ ID NO: 337979 - protein, 33 aa, Mycobacterium
YKFAAPRLRSYGGFAYRARWLIVAVVAAANTAT

SEQ ID NO: 337980 - protein, 24 aa, Mycobacterium
YKFLNFPYWWGFINGASFVTVGAI

SEQ ID NO: 337981 - protein, 17 aa, Mycobacterium
YKGGPVLADNAVIPEER

SEQ ID NO: 337982 - protein, 22 aa, Mycobacterium
YKGPRNRIKYALYGVCLAPVLF

SEQ ID NO: 337983 - protein, 23 aa, Mycobacterium
YKGSELMPAAVQIIAKGEDGFNL

SEQ ID NO: 337984 - protein, 18 aa, Mycobacterium
YKIFPVLGTAVMTVGFVL

SEQ ID NO: 337985 - protein, 19 aa, Mycobacterium
YKIIGLLGLMVLALVGTGL

SEQ ID NO: 337986 - protein, 20 aa, Mycobacterium
YKLGEKWTHPPILWAAIGEE

SEQ ID NO: 337987 - protein, 20 aa, Mycobacterium
YKLIPWKDVVGVSFPGGSRW

SEQ ID NO: 337988 - protein, 20 aa, Mycobacterium
YKLPDKWTHPPILWAATDED

SEQ ID NO: 337989 - protein, 20 aa, Mycobacterium
YKNLEVCVYAAPNQTVIGGP

SEQ ID NO: 337990 - protein, 20 aa, Mycobacterium
YKPFVRQIRTTRQMQELQPQ

SEQ ID NO: 337991 - protein, 20 aa, Mycobacterium
YKPGDTIAVDYRRKNAPMGT

SEQ ID NO: 337992 - protein, 23 aa, Mycobacterium
YKPKSSVYRSVWRNHRRHHFKNE

SEQ ID NO: 337993 - protein, 28 aa, Mycobacterium
YKPLARKGFLSIWSWMFGLVVTEFPLQT

SEQ ID NO: 337994 - protein, 25 aa, Mycobacterium
YKPLIVAGCLLRIGAFGLLAIAQSL

SEQ ID NO: 337995 - protein, 19 aa, Mycobacterium
YKQKVWKRVAVLFAGPAMN

SEQ ID NO: 337996 - protein, 21 aa, Mycobacterium
YKRFVNRTIVFTGWNLSMNHI

SEQ ID NO: 337997 - protein, 26 aa, Mycobacterium
YKRYINRMAKFYGWNLSVSQAQELIP

SEQ ID NO: 337998 - protein, 26 aa, Mycobacterium
YKSIRSSNTLVRWVQNALSFIGFVPP

SEQ ID NO: 337999 - protein, 21 aa, Mycobacterium
YKTHTFFTVYAIDILTSGGGT

SEQ ID NO: 338000 - protein, 19 aa, Mycobacterium
YKVPREVIFIDELPRNPTG

SEQ ID NO: 338001 - protein, 18 aa, Mycobacterium
YKVPREVIFLDELPRNPT

SEQ ID NO: 338002 - protein, 20 aa, Mycobacterium
YKWWPSKGALALDGYFAKVE

SEQ ID NO: 338003 - protein, 17 aa, Mycobacterium
YKYPQNLPIVAAKGGPG

SEQ ID NO: 338004 - protein, 31 aa, Mycobacterium
YLAARALRILPGFYVCLLVTAFIFAPLSVAI

SEQ ID NO: 338005 - protein, 19 aa, Mycobacterium
YLAFGLMAALLLDATVVRM

SEQ ID NO: 338006 - protein, 18 aa, Mycobacterium
YLAGALIAVMLAGGRALD

SEQ ID NO: 338007 - protein, 18 aa, Mycobacterium
YLAGALIAVMLAGGRALE

SEQ ID NO: 338008 - protein, 18 aa, Mycobacterium
YLAGEGYGLVRLPTGEIL

SEQ ID NO: 338009 - protein, 17 aa, Mycobacterium
YLAGHKIVLMSFVVDLV

SEQ ID NO: 338010 - protein, 25 aa, Mycobacterium
YLAGREIPAAVPLVSFAILAACGLP

SEQ ID NO: 338011 - protein, 17 aa, Mycobacterium
YLAIDRLPLGTAVAIEF

SEQ ID NO: 338012 - protein, 17 aa, Mycobacterium
YLAIRLFTQYDVSSVIG

SEQ ID NO: 338013 - protein, 20 aa, Mycobacterium
YLALFGMLLRDTRWWLGGLG

SEQ ID NO: 338014 - protein, 23 aa, Mycobacterium
YLALRRWLHTRGVGADTLLVEME

SEQ ID NO: 338015 - protein, 22 aa, Mycobacterium
YLALVVKFHWGFSLAAGVLTLS

SEQ ID NO: 338016 - protein, 20 aa, Mycobacterium
YLAPRVMRLAPRQAVAVSLE

SEQ ID NO: 338017 - protein, 24 aa, Mycobacterium
YLASAAQLPAAWAHVHASADNAVR

SEQ ID NO: 338018 - protein, 20 aa, Mycobacterium
YLASLGIGVVVFQWGLGHEI

SEQ ID NO: 338019 - protein, 17 aa, Mycobacterium
YLASLPADLRPGPDQLS

SEQ ID NO: 338020 - protein, 19 aa, Mycobacterium
YLATDGFQPLNIVSTIGAL

SEQ ID NO: 338021 - protein, 18 aa, Mycobacterium
YLAYLRRQTRIEAKVRRR

SEQ ID NO: 338022 - protein, 18 aa, Mycobacterium
YLAYLRRQTRIEEQVRRR

SEQ ID NO: 338023 - protein, 24 aa, Mycobacterium
YLCLALVVGCAVLVVFLRSITGSV

SEQ ID NO: 338024 - protein, 30 aa, Mycobacterium
YLDARPEPVFARWVAHFNVATAVLLVPSAF

SEQ ID NO: 338025 - protein, 30 aa, Mycobacterium
YLDEARIDRRWMWIAGVAGAILFVAVITVS

SEQ ID NO: 338026 - protein, 19 aa, Mycobacterium
YLDLPLPIVGQRMVAGLDI

SEQ ID NO: 338027 - protein, 17 aa, Mycobacterium
YLDRFPLMKPLDMSDAV

SEQ ID NO: 338028 - protein, 17 aa, Mycobacterium
YLELMIRQHRFTISVAR

SEQ ID NO: 338029 - protein, 42 aa, Mycobacterium
YLEPRPSRTARRWRRVGTAVARWPGPILVAALGLTLLAALPL

SEQ ID NO: 338030 - protein, 26 aa, Mycobacterium
YLERIFDPKVFVISFVFNVFVAALIV

SEQ ID NO: 338031 - protein, 17 aa, Mycobacterium
YLERIFDPKVFVVSFVF

SEQ ID NO: 338032 - protein, 21 aa, Mycobacterium
YLERLWVPWWWALPGFGAATL

SEQ ID NO: 338033 - protein, 31 aa, Mycobacterium
YLFGFKLGWFPIAGIRDGWYSFLLPGLVLAS

SEQ ID NO: 338034 - protein, 18 aa, Mycobacterium
YLFTPLFNWFNKRLNAGL

SEQ ID NO: 338035 - protein, 26 aa, Mycobacterium
YLFVIEWRMALILLIPILVYLLTMMA

SEQ ID NO: 338036 - protein, 27 aa, Mycobacterium
YLFVVDWRLALVMFVPVLIYLVLMTVM

SEQ ID NO: 338037 - protein, 22 aa, Mycobacterium
YLGALLGGLSWPFVLLPHLGMI

SEQ ID NO: 338038 - protein, 20 aa, Mycobacterium
YLGFYRRRNRAYAHLEPIRP

SEQ ID NO: 338039 - protein, 17 aa, Mycobacterium
YLGGAGVGIGYWRRSGL

SEQ ID NO: 338040 - protein, 19 aa, Mycobacterium
YLGGRRLAANVLKVVTLLS

SEQ ID NO: 338041 - protein, 25 aa, Mycobacterium
YLGGWRIIQTMGHKLVRIEAPQGFS

SEQ ID NO: 338042 - protein, 21 aa, Mycobacterium
YLGGWRVIRTLGKGLVEIQSP

SEQ ID NO: 338043 - protein, 26 aa, Mycobacterium
YLGLLWWMMVCWAQPLRVRPHGRVFI

SEQ ID NO: 338044 - protein, 25 aa, Mycobacterium
YLGLLWWMMVCWAQPVRNRPDRRLF

SEQ ID NO: 338045 - protein, 25 aa, Mycobacterium
YLGLLWWMMVCWSQALRAYPADGGA

SEQ ID NO: 338046 - protein, 17 aa, Mycobacterium
YLGMLGVPYRFDDAWRH

SEQ ID NO: 338047 - protein, 19 aa, Mycobacterium
YLGPWAVTVFEWLVVGGSF

SEQ ID NO: 338048 - protein, 17 aa, Mycobacterium
YLGRPGQTATRFVAAPG

SEQ ID NO: 338049 - protein, 18 aa, Mycobacterium
YLGRRGRSTSRCSRCSPL

SEQ ID NO: 338050 - protein, 24 aa, Mycobacterium
YLGRSGLTSARFVACPFGVPGARM

SEQ ID NO: 338051 - protein, 26 aa, Mycobacterium
YLGWPLISAGAFALVQLAARGRLDQP

SEQ ID NO: 338052 - protein, 18 aa, Mycobacterium
YLHDMMRAPGYAQGLNPG

SEQ ID NO: 338053 - protein, 17 aa, Mycobacterium
YLHTEWVGADRIYVVAA

SEQ ID NO: 338054 - protein, 24 aa, Mycobacterium
YLIAKICVYTVFAVVQSAIVTIIV

SEQ ID NO: 338055 - protein, 19 aa, Mycobacterium
YLIAWALSSTGSWRLMLGL

SEQ ID NO: 338056 - protein, 17 aa, Mycobacterium
YLICAALTGLGGANYSA

SEQ ID NO: 338057 - protein, 26 aa, Mycobacterium
YLIDAITCLAPIWATFRLTPMPVGNA

SEQ ID NO: 338058 - protein, 20 aa, Mycobacterium
YLITMALHWTIGGGSYAWTI

SEQ ID NO: 338059 - protein, 21 aa, Mycobacterium
YLKRLLGTGGMGEVYEAVDTV

SEQ ID NO: 338060 - protein, 22 aa, Mycobacterium
YLLAEFALRPAAAQALEAGPPP

SEQ ID NO: 338061 - protein, 22 aa, Mycobacterium
YLLAGTHSWRWMLGLACVPALL

SEQ ID NO: 338062 - protein, 18 aa, Mycobacterium
YLLAKRFGGQGVQDTGDA

SEQ ID NO: 338063 - protein, 17 aa, Mycobacterium
YLLFAALGFGWRSWSQH

SEQ ID NO: 338064 - protein, 26 aa, Mycobacterium
YLLGFGSLVAGLACGGAGLLVAGGLT

SEQ ID NO: 338065 - protein, 17 aa, Mycobacterium
YLLGGWLGSRFPLLRDT

SEQ ID NO: 338066 - protein, 26 aa, Mycobacterium
YLLGQLRLSAPDRIRALREFAPSAAA

SEQ ID NO: 338067 - protein, 21 aa, Mycobacterium
YLLGVLLSWILKRIGRRSELL

SEQ ID NO: 338068 - protein, 20 aa, Mycobacterium
YLLLAAPAFLPAVIVVAVIL

SEQ ID NO: 338069 - protein, 26 aa, Mycobacterium
YLLLRARLDPPGGHLVSRDVVRTILV

SEQ ID NO: 338070 - protein, 18 aa, Mycobacterium
YLLLRGWFEIVPVTEFWA

SEQ ID NO: 338071 - protein, 18 aa, Mycobacterium
YLLLTLLLSRLFTPDEVA

SEQ ID NO: 338072 - protein, 26 aa, Mycobacterium
YLLLVVLCRRRWRPALLMAGLTALAA

SEQ ID NO: 338073 - protein, 24 aa, Mycobacterium
YLLSEFALRPVAARALEVGPTSRS

SEQ ID NO: 338074 - protein, 17 aa, Mycobacterium
YLLTEFALRPVAAQALA

SEQ ID NO: 338075 - protein, 27 aa, Mycobacterium
YLLVWLQRIGQLWVFPAYTATLAAISV

SEQ ID NO: 338076 - protein, 17 aa, Mycobacterium
YLLWAIIPLAAWATRPA

SEQ ID NO: 338077 - protein, 17 aa, Mycobacterium
YLLWAIIPLAAWATRSG

SEQ ID NO: 338078 - protein, 20 aa, Mycobacterium
YLLWPGARRLPGSARFSSAL

SEQ ID NO: 338079 - protein, 27 aa, Mycobacterium
YLLYIRAARPFIAFYNWCANATLRAFG

SEQ ID NO: 338080 - protein, 25 aa, Mycobacterium
YLLYIRIARPFIAFYNWCANSTLRA

SEQ ID NO: 338081 - protein, 18 aa, Mycobacterium
YLNELRNAGLRYALVRVR

SEQ ID NO: 338082 - protein, 23 aa, Mycobacterium
YLNGYRMPVIDVHDGQSIHVGNP

SEQ ID NO: 338083 - protein, 17 aa, Mycobacterium
YLNQTWFVARVSLVPAL

SEQ ID NO: 338084 - protein, 19 aa, Mycobacterium
YLPAAAIALFQAVILYCVV

SEQ ID NO: 338085 - protein, 27 aa, Mycobacterium
YLPLLGLRLTAFLGLLVTAVGLWCMCT

SEQ ID NO: 338086 - protein, 18 aa, Mycobacterium
YLPPDVFDNPDFKRGLEM

SEQ ID NO: 338087 - protein, 18 aa, Mycobacterium
YLPPDVFNNPDFKRGLKL

SEQ ID NO: 338088 - protein, 19 aa, Mycobacterium
YLPPDVFTNPDFKRGLKMF

SEQ ID NO: 338089 - protein, 18 aa, Mycobacterium
YLPPEAFDNADFQRGLNL

SEQ ID NO: 338090 - protein, 18 aa, Mycobacterium
YLPPEAFDNPDFQRGLTL

SEQ ID NO: 338091 - protein, 18 aa, Mycobacterium
YLPPEAFETADFQRGIKL

SEQ ID NO: 338092 - protein, 20 aa, Mycobacterium
YLPPEAFQNPDFERGLKMFL

SEQ ID NO: 338093 - protein, 19 aa, Mycobacterium
YLPPEAFQNPDFQRGLKLF

SEQ ID NO: 338094 - protein, 20 aa, Mycobacterium
YLPPEAFQNPDFQRGLKLFL

SEQ ID NO: 338095 - protein, 20 aa, Mycobacterium
YLPPEAFQNPDFQRGLKLMV

SEQ ID NO: 338096 - protein, 19 aa, Mycobacterium
YLPPEAFQNPDFQRGLTLF

SEQ ID NO: 338097 - protein, 18 aa, Mycobacterium
YLPPEVFQNPDFQLGLSL

SEQ ID NO: 338098 - protein, 18 aa, Mycobacterium
YLPSDGFTDLNIVSTVGA

SEQ ID NO: 338099 - protein, 18 aa, Mycobacterium
YLPSDGFTTLNVISTIGA

SEQ ID NO: 338100 - protein, 18 aa, Mycobacterium
YLPTDGFQGLNIVSTIGA

SEQ ID NO: 338101 - protein, 19 aa, Mycobacterium
YLPTDGFTALNIVSTVGAF

SEQ ID NO: 338102 - protein, 19 aa, Mycobacterium
YLPTDGFTTLNIVSTIGSF

SEQ ID NO: 338103 - protein, 20 aa, Mycobacterium
YLPTGRWPAEYGIDDDQPDG

SEQ ID NO: 338104 - protein, 22 aa, Mycobacterium
YLPVVIALLLIRPHAPVITGNV

SEQ ID NO: 338105 - protein, 25 aa, Mycobacterium
YLQDRFPTVPFWTWIVGFAALTTVL

SEQ ID NO: 338106 - protein, 36 aa, Mycobacterium
YLQIPSLMGIGRYTLKAELPASGGLYPTANVTYRGI

SEQ ID NO: 338107 - protein, 21 aa, Mycobacterium
YLRARALRILPGFYTCLVVTA

SEQ ID NO: 338108 - protein, 22 aa, Mycobacterium
YLREFGNLVFHFSLLGLLVAVA

SEQ ID NO: 338109 - protein, 20 aa, Mycobacterium
YLREFGNLVFHLSLVGLLVA

SEQ ID NO: 338110 - protein, 25 aa, Mycobacterium
YLRGFGRRPAWVIAEIAVVVLLMLS

SEQ ID NO: 338111 - protein, 21 aa, Mycobacterium
YLRLKLGMVRAAVPATDAELT

SEQ ID NO: 338112 - protein, 17 aa, Mycobacterium
YLRNDWYRDWGSIEKYE

SEQ ID NO: 338113 - protein, 24 aa, Mycobacterium
YLRRWTSFESIPQWVLALLALIVV

SEQ ID NO: 338114 - protein, 17 aa, Mycobacterium
YLRTWKRNEEAYLERNA

SEQ ID NO: 338115 - protein, 17 aa, Mycobacterium
YLSAASFLGVAGLIAKY

SEQ ID NO: 338116 - protein, 25 aa, Mycobacterium
YLSAAVVTWARYVRRPTSTAASVSD

SEQ ID NO: 338117 - protein, 18 aa, Mycobacterium
YLSALAMLASRHPLPTLW

SEQ ID NO: 338118 - protein, 18 aa, Mycobacterium
YLSQGIFAYICVAYLVSY

SEQ ID NO: 338119 - protein, 18 aa, Mycobacterium
YLSQGVFAYICVAYLVSY

SEQ ID NO: 338120 - protein, 21 aa, Mycobacterium
YLSSVQIDWSLALAVTAAAVV

SEQ ID NO: 338121 - protein, 19 aa, Mycobacterium
YLTDPRHTFTIAEPSAAVT

SEQ ID NO: 338122 - protein, 17 aa, Mycobacterium
YLTQRFIIAWRMWLTGH

SEQ ID NO: 338123 - protein, 18 aa, Mycobacterium
YLTRVMQAAAEWTDVLIN

SEQ ID NO: 338124 - protein, 24 aa, Mycobacterium
YLTSRGEPFWTISGGLAGVIAVAA

SEQ ID NO: 338125 - protein, 17 aa, Mycobacterium
YLVCAAFTGLGGGNYSG

SEQ ID NO: 338126 - protein, 17 aa, Mycobacterium
YLVCAALAGFGGGNFAS

SEQ ID NO: 338127 - protein, 17 aa, Mycobacterium
YLVCAALSGLGGGNFAA

SEQ ID NO: 338128 - protein, 17 aa, Mycobacterium
YLVCAALSGLGGGNYSA

SEQ ID NO: 338129 - protein, 17 aa, Mycobacterium
YLVCAALTGLGGGNFAA

SEQ ID NO: 338130 - protein, 17 aa, Mycobacterium
YLVCAALTGLGGGNYAA

SEQ ID NO: 338131 - protein, 21 aa, Mycobacterium
YLVFHWSWLALTGVALAAATA

SEQ ID NO: 338132 - protein, 24 aa, Mycobacterium
YLVLCAVASLLLSMVQGRPLITAL

SEQ ID NO: 338133 - protein, 24 aa, Mycobacterium
YLVPEPLRPAAVDRTVFALFLGTA

SEQ ID NO: 338134 - protein, 22 aa, Mycobacterium
YLVSAKWPWKTTLLHILGAGVA

SEQ ID NO: 338135 - protein, 19 aa, Mycobacterium
YLVVIAFIVGVGFFAPGRF

SEQ ID NO: 338136 - protein, 17 aa, Mycobacterium
YLVWDYGYRQGTTGSSI

SEQ ID NO: 338137 - protein, 24 aa, Mycobacterium
YLVWPAVIIGTAWATRRRRRRAAG

SEQ ID NO: 338138 - protein, 24 aa, Mycobacterium
YLWAFELTGALLITAALGAMVLAH

SEQ ID NO: 338139 - protein, 24 aa, Mycobacterium
YLWAFELTSALLITAAIGAMVLAH

SEQ ID NO: 338140 - protein, 24 aa, Mycobacterium
YLWAFELTSALLITAALGAMVLAH

SEQ ID NO: 338141 - protein, 24 aa, Mycobacterium
YLWAFELTSALLITAAVGAMVLAH

SEQ ID NO: 338142 - protein, 25 aa, Mycobacterium
YLWATVAGAFSWLLMLLVSPATRAA

SEQ ID NO: 338143 - protein, 24 aa, Mycobacterium
YLWHMPALLGMHLAFDFLGFDRYD

SEQ ID NO: 338144 - protein, 23 aa, Mycobacterium
YLWHMPVLLGVHLLFDYLGSPRF

SEQ ID NO: 338145 - protein, 17 aa, Mycobacterium
YLYARGMLARRGRGHPS

SEQ ID NO: 338146 - protein, 17 aa, Mycobacterium
YLYIPFQYASVIFGAYL

SEQ ID NO: 338147 - protein, 19 aa, Mycobacterium
YLYITLRGAIAMVTLVADF

SEQ ID NO: 338148 - protein, 17 aa, Mycobacterium
YLYKGLNLTAGFYAFLS

SEQ ID NO: 338149 - protein, 19 aa, Mycobacterium
YLYPGRTTTSFALLTGQIV

SEQ ID NO: 338150 - protein, 18 aa, Mycobacterium
YLYPTKRSWAQGDRAIAC

SEQ ID NO: 338151 - protein, 21 aa, Mycobacterium
YMERPHVPHALSLLDSKETEG

SEQ ID NO: 338152 - protein, 21 aa, Mycobacterium
YMFAAGALLMFIATCTIGSSR

SEQ ID NO: 338153 - protein, 23 aa, Mycobacterium
YMFDRLDVFDVMIFEECAELLAF

SEQ ID NO: 338154 - protein, 19 aa, Mycobacterium
YMFVLAWTMAFVARSIAVG

SEQ ID NO: 338155 - protein, 17 aa, Mycobacterium
YMLVALFFGTAWITSRT

SEQ ID NO: 338156 - protein, 25 aa, Mycobacterium
YMMFFVLCGWMMGHILQLQQRLILQ

SEQ ID NO: 338157 - protein, 19 aa, Mycobacterium
YMMGACVIGALALIRIPET

SEQ ID NO: 338158 - protein, 29 aa, Mycobacterium
YMMWTDGLIRLWPAWEFYPFGHTIPQGVW

SEQ ID NO: 338159 - protein, 31 aa, Mycobacterium
YMMWTEGLARIWPPWEFYFWHHTIPAAVWVA

SEQ ID NO: 338160 - protein, 31 aa, Mycobacterium; identical to SEQ ID NO: 159821

SEQ ID NO: 338161 - protein, 30 aa, Mycobacterium; identical to SEQ ID NO: 12822

SEQ ID NO: 338162 - protein, 32 aa, Mycobacterium
YMMWTEGLARIWPPWEFYFWHHTVPAPVWVAL

SEQ ID NO: 338163 - protein, 25 aa, Mycobacterium
YMNMVSIMAICFEKMIVSTVREAMP

SEQ ID NO: 338164 - protein, 18 aa, Mycobacterium
YMRLEHRDAENLRQQNAE

SEQ ID NO: 338165 - protein, 25 aa, Mycobacterium
YMTPSDWRAYLAILLAFLARGALTK

SEQ ID NO: 338166 - protein, 24 aa, Mycobacterium
YMYFTGRLSSLIKTAGANVSPAEV

SEQ ID NO: 338167 - protein, 23 aa, Mycobacterium
YNADGKLVAPVAYPSLLAGNEDA

SEQ ID NO: 338168 - protein, 17 aa, Mycobacterium
YNADGKLVAPVAYPSLY

SEQ ID NO: 338169 - protein, 19 aa, Mycobacterium
YNAMISRLRADSEHVRLVQ

SEQ ID NO: 338170 - protein, 18 aa, Mycobacterium
YNCGSAWSAAVQAGDIDT

SEQ ID NO: 338171 - protein, 24 aa, Mycobacterium
YNEDGPCWSMRLNVIDPPKEPPWR

SEQ ID NO: 338172 - protein, 17 aa, Mycobacterium
YNFLDLLGLGPATGIIS

SEQ ID NO: 338173 - protein, 32 aa, Mycobacterium
YNGMFFYPGYYPYAFWGPGWGWALTDVLLMDA

SEQ ID NO: 338174 - protein, 23 aa, Mycobacterium
YNHDIRFIIVVTIVVVLFILIML

SEQ ID NO: 338175 - protein, 21 aa, Mycobacterium
YNIGTPWAKTALRDLNFVVEQ

SEQ ID NO: 338176 - protein, 24 aa, Mycobacterium
YNKLIKPFVDWLANIPFLQALFSG

SEQ ID NO: 338177 - protein, 19 aa, Mycobacterium
YNLALAWALFRRFHAKHVA

SEQ ID NO: 338178 - protein, 17 aa, Mycobacterium
YNLASARLLLGSPEVPR

SEQ ID NO: 338179 - protein, 30 aa, Mycobacterium
YNLLAGWWSLLSLLLFNWIALISNANAMRQ

SEQ ID NO: 338180 - protein, 19 aa, Mycobacterium
YNLMRTMCVGVVTAVGNLV

SEQ ID NO: 338181 - protein, 20 aa, Mycobacterium
YNLYIRPFYPGSPVLGVTTP

SEQ ID NO: 338182 - protein, 24 aa, Mycobacterium
YNNPEPMMLLLMVASVWAVLEAVR

SEQ ID NO: 338183 - protein, 17 aa, Mycobacterium
YNPARLGAVAGASLTES

SEQ ID NO: 338184 - protein, 25 aa, Mycobacterium
YNPELTCTLVGSKYDAEFFGDVSGG

SEQ ID NO: 338185 - protein, 19 aa, Mycobacterium
YNPRITYRSAVRLFGSPFF

SEQ ID NO: 338186 - protein, 20 aa, Mycobacterium
YNSIPMCPGCTLGGRVGGSQ

SEQ ID NO: 338187 - protein, 20 aa, Mycobacterium
YNSLDMSESLLLAATPALAG

SEQ ID NO: 338188 - protein, 29 aa, Mycobacterium
YNTALGLAMVFGRFLPIVLVLALAGSLAR

SEQ ID NO: 338189 - protein, 17 aa, Mycobacterium
YNTEGLPYFSIGMANNF

SEQ ID NO: 338190 - protein, 18 aa, Mycobacterium
YNVLAVVLGALWLTRQTT

SEQ ID NO: 338191 - protein, 19 aa, Mycobacterium
YNVVWKLPPDFGQRSNSGL

SEQ ID NO: 338192 - protein, 17 aa, Mycobacterium
YNYNVPMGPPIAAPGLM

SEQ ID NO: 338193 - protein, 22 aa, Mycobacterium
YPAAVSVPLAFLTMIVVSLATR

SEQ ID NO: 338194 - protein, 34 aa, Mycobacterium
YPACPFKWLTGWDCPACGGLRMVHDLLHGDLVAS

SEQ ID NO: 338195 - protein, 18 aa, Mycobacterium
YPAGMPVAEVVAVVTAVA

SEQ ID NO: 338196 - protein, 18 aa, Mycobacterium
YPALLRKIVVPQLVPTVL

SEQ ID NO: 338197 - protein, 17 aa, Mycobacterium
YPAPANRRTWIVLRADP

SEQ ID NO: 338198 - protein, 17 aa, Mycobacterium
YPARLVVPGLYGYVSAT

SEQ ID NO: 338199 - protein, 21 aa, Mycobacterium
YPARLVVPGLYGYVSATKWVT

SEQ ID NO: 338200 - protein, 18 aa, Mycobacterium
YPEDLFKVQRALLAKYHV

SEQ ID NO: 338201 - protein, 20 aa, Mycobacterium
YPEDLFKVQRMLLAKYHVND

SEQ ID NO: 338202 - protein, 23 aa, Mycobacterium
YPENLPRVNAHGGPGGAPGCWQS

SEQ ID NO: 338203 - protein, 17 aa, Mycobacterium
YPEPFLYTYCRDDDPAV

SEQ ID NO: 338204 - protein, 19 aa, Mycobacterium
YPEPFLYTYCRDDDPQVLI

SEQ ID NO: 338205 - protein, 21 aa, Mycobacterium
YPFDPATKWMATVHRDHDEYF

SEQ ID NO: 338206 - protein, 21 aa, Mycobacterium
YPGAENLAVFRAHLESLSTVR

SEQ ID NO: 338207 - protein, 18 aa, Mycobacterium
YPGAPGYPGQGGDEGSKR

SEQ ID NO: 338208 - protein, 20 aa, Mycobacterium
YPGAPRWELVDGVRVNRAGG

SEQ ID NO: 338209 - protein, 20 aa, Mycobacterium
YPGDEVRILGVPVGTVDTIE

SEQ ID NO: 338210 - protein, 19 aa, Mycobacterium
YPGGSPWGAAQPNGPRGRG

SEQ ID NO: 338211 - protein, 17 aa, Mycobacterium
YPGLAVDIPVVFYQLSF

SEQ ID NO: 338212 - protein, 26 aa, Mycobacterium
YPGLPARGIVALCDFGATGTSLTLAD

SEQ ID NO: 338213 - protein, 19 aa, Mycobacterium
YPHGGGRVGHRLHSAVIIA

SEQ ID NO: 338214 - protein, 25 aa, Mycobacterium
YPHQGVDTGGIWVWRDADTVDIGQH

SEQ ID NO: 338215 - protein, 17 aa, Mycobacterium
YPHWREIVNANIGHLQR

SEQ ID NO: 338216 - protein, 18 aa, Mycobacterium
YPICVAIGATALTFVFLL

SEQ ID NO: 338217 - protein, 21 aa, Mycobacterium
YPIDVTERWDIEGLAVTGFDF

SEQ ID NO: 338218 - protein, 22 aa, Mycobacterium
YPIMRKLFSQFGLDVLAAESVK

SEQ ID NO: 338219 - protein, 19 aa, Mycobacterium
YPKIGIKLVILVVLGGVLG

SEQ ID NO: 338220 - protein, 23 aa, Mycobacterium
YPKTRRISFRFGESESEDRYFAN

SEQ ID NO: 338221 - protein, 19 aa, Mycobacterium
YPLAAAISVVTLFLFVEIG

SEQ ID NO: 338222 - protein, 20 aa, Mycobacterium
YPLADPIVGLVITLAILAVL

SEQ ID NO: 338223 - protein, 26 aa, Mycobacterium
YPLAWALCGLFPLAAVPLVPTRLLPP

SEQ ID NO: 338224 - protein, 26 aa, Mycobacterium
YPLAWGLCGLFPLAAIPLVPTRLRPP

SEQ ID NO: 338225 - protein, 19 aa, Mycobacterium
YPLIMAFTLVYTAEHYVVD

SEQ ID NO: 338226 - protein, 18 aa, Mycobacterium
YPLQVTLALGGLIATVVA

SEQ ID NO: 338227 - protein, 18 aa, Mycobacterium
YPLTPVHQDDQGFAMRQI

SEQ ID NO: 338228 - protein, 23 aa, Mycobacterium
YPLTVSRPGWAMWLAESRERIAG

SEQ ID NO: 338229 - protein, 18 aa, Mycobacterium
YPLVGIVFSLFLLAFAGI

SEQ ID NO: 338230 - protein, 26 aa, Mycobacterium
YPLYLWHWPLLIFWFAYSNDDTAGLT

SEQ ID NO: 338231 - protein, 23 aa, Mycobacterium
YPPKPPVGAALWKLMERARQIGL

SEQ ID NO: 338232 - protein, 19 aa, Mycobacterium
YPPVEPRPAAPAKAPEAPV

SEQ ID NO: 338233 - protein, 18 aa, Mycobacterium
YPPYRPGRANYMLLAAAV

SEQ ID NO: 338234 - protein, 20 aa, Mycobacterium
YPQCPFKLLTGWNCPACGGL

SEQ ID NO: 338235 - protein, 27 aa, Mycobacterium
YPQCPFKWLTGWNCPFCGGLRMTHDLL

SEQ ID NO: 338236 - protein, 17 aa, Mycobacterium
YPQLISLLISVAETIGD

SEQ ID NO: 338237 - protein, 18 aa, Mycobacterium
YPQNLPIVAAKGGPGGKP

SEQ ID NO: 338238 - protein, 18 aa, Mycobacterium
YPQNLPIVGAKGGPGGKP

SEQ ID NO: 338239 - protein, 25 aa, Mycobacterium
YPQPNSRSRWRAMCEDLVDAVLALP

SEQ ID NO: 338240 - protein, 20 aa, Mycobacterium
YPQRRSKRRLVVGILLAVAL

SEQ ID NO: 338241 - protein, 18 aa, Mycobacterium
YPRAVFTAMGMRFGENAM

SEQ ID NO: 338242 - protein, 19 aa, Mycobacterium
YPRGVFTAMGLRFAENIMY

SEQ ID NO: 338243 - protein, 17 aa, Mycobacterium
YPRGVFTAMGLRVAENI

SEQ ID NO: 338244 - protein, 20 aa, Mycobacterium
YPRMREIFTKRFASRTRDEW

SEQ ID NO: 338245 - protein, 17 aa, Mycobacterium
YPSDVLAGWSLGYLYFL

SEQ ID NO: 338246 - protein, 17 aa, Mycobacterium
YPSDVVAGWSLGYLYFL

SEQ ID NO: 338247 - protein, 19 aa, Mycobacterium
YPSMFGFGAVAAVGCLAVA

SEQ ID NO: 338248 - protein, 17 aa, Mycobacterium
YPSSLKATTVFFSPGNE

SEQ ID NO: 338249 - protein, 24 aa, Mycobacterium
YPSSWRTLPVTIFGLSDRGQVFSA

SEQ ID NO: 338250 - protein, 17 aa, Mycobacterium
YPSTRPLNFVPASGLQS

SEQ ID NO: 338251 - protein, 25 aa, Mycobacterium
YPTFSHNFYLWWLAKAGAVGMALFA

SEQ ID NO: 338252 - protein, 17 aa, Mycobacterium
YPTGYAVDLFNALTAKN

SEQ ID NO: 338253 - protein, 19 aa, Mycobacterium
YPTSYLRQMIYPFTHASGC

SEQ ID NO: 338254 - protein, 24 aa, Mycobacterium
YPTYSHLFYLWWLAKAGVVGMAAF

SEQ ID NO: 338255 - protein, 20 aa, Mycobacterium
YPVICRTVFGVLGANIPAII

SEQ ID NO: 338256 - protein, 18 aa, Mycobacterium
YPVTTIFLVLAIACGLLA

SEQ ID NO: 338257 - protein, 18 aa, Mycobacterium
YPVYDWPQSPPAPPTPPP

SEQ ID NO: 338258 - protein, 17 aa, Mycobacterium
YPYREPLPAPPPGGPPP

SEQ ID NO: 338259 - protein, 23 aa, Mycobacterium
YPYYASYLLPFLIPALSGLSGLA

SEQ ID NO: 338260 - protein, 22 aa, Mycobacterium
YQAGGPLLGWLTAGAVMIALLT

SEQ ID NO: 338261 - protein, 17 aa, Mycobacterium
YQALGAKIPRGVLLYGP

SEQ ID NO: 338262 - protein, 18 aa, Mycobacterium
YQANWWWLVAAMGAAAAS

SEQ ID NO: 338263 - protein, 25 aa, Mycobacterium
YQARKRLAAAAGRDLPIALLEDAVA

SEQ ID NO: 338264 - protein, 20 aa, Mycobacterium
YQARKRLAAATGKDLAVALL

SEQ ID NO: 338265 - protein, 18 aa, Mycobacterium
YQARRMVWEAEIRDSEAA

SEQ ID NO: 338266 - protein, 22 aa, Mycobacterium
YQASGALLAWLTAAAVAIAMLT

SEQ ID NO: 338267 - protein, 21 aa, Mycobacterium
YQAVSWVGASILYPSLFLLPL

SEQ ID NO: 338268 - protein, 20 aa, Mycobacterium
YQFHQRWGTGHGRAGRSVPN

SEQ ID NO: 338269 - protein, 19 aa, Mycobacterium
YQFRAPRPLLTIRTMLTSS

SEQ ID NO: 338270 - protein, 27 aa, Mycobacterium
YQFVESVSWIPAFGMKYAVGLDGIGLA

SEQ ID NO: 338271 - protein, 17 aa, Mycobacterium
YQGAALPKKMNKLGSAG

SEQ ID NO: 338272 - protein, 17 aa, Mycobacterium
YQGFFGEIERGWDGLVA

SEQ ID NO: 338273 - protein, 26 aa, Mycobacterium
YQGVIGRKALRGRTIIDASANGSIAV

SEQ ID NO: 338274 - protein, 25 aa, Mycobacterium
YQGVRLRDGASLTLDDVTPIPAGFE

SEQ ID NO: 338275 - protein, 18 aa, Mycobacterium
YQGYPGYQPPPGSVPPSY

SEQ ID NO: 338276 - protein, 21 aa, Mycobacterium
YQHDIRFIIAVTLIVVLLTLI

SEQ ID NO: 338277 - protein, 26 aa, Mycobacterium
YQHNWLHILGSAFMRNALIGGTLVAL

SEQ ID NO: 338278 - protein, 19 aa, Mycobacterium
YQLHAFPGVHIEPYAAFSE

SEQ ID NO: 338279 - protein, 25 aa, Mycobacterium
YQLNLPRLWSGFQIIGDGSGTYDYA

SEQ ID NO: 338280 - protein, 17 aa, Mycobacterium
YQLPGDWKANIAAQPLV

SEQ ID NO: 338281 - protein, 20 aa, Mycobacterium
YQNLYWPAEYLIDADGTVRH

SEQ ID NO: 338282 - protein, 20 aa, Mycobacterium
YQNMMPHWLAITLAVILVVI

SEQ ID NO: 338283 - protein, 19 aa, Mycobacterium
YQPGLTCMLVGAKTALDTG

SEQ ID NO: 338284 - protein, 24 aa, Mycobacterium
YQPPSIAFPMVWTTLYGDIATSSA

SEQ ID NO: 338285 - protein, 22 aa, Mycobacterium
YQPRLRGLLEDRIGAAATDTVM

SEQ ID NO: 338286 - protein, 21 aa, Mycobacterium
YQQDIRFIIIATLIVVLLTLT

SEQ ID NO: 338287 - protein, 26 aa, Mycobacterium
YQRAEALAADVARTFTEAGLDAVRIP

SEQ ID NO: 338288 - protein, 25 aa, Mycobacterium
YQRAEALAAEVARTFTEAGLDAVQM

SEQ ID NO: 338289 - protein, 26 aa, Mycobacterium
YQRAEGRYALMPGIIGALAESGTPLS

SEQ ID NO: 338290 - protein, 26 aa, Mycobacterium
YQRLKSWRRGLIFAMFVFAAVFTPGS

SEQ ID NO: 338291 - protein, 27 aa, Mycobacterium
YQRLRRPIVVWWITWAVSNAVSLFAIA

SEQ ID NO: 338292 - protein, 17 aa, Mycobacterium
YQRQMLAVIAGLFLVIF

SEQ ID NO: 338293 - protein, 24 aa, Mycobacterium
YQTERLWAAIGLVPQRGYLFSGTV

SEQ ID NO: 338294 - protein, 17 aa, Mycobacterium
YQTGLRGSFDMGTAAAQ

SEQ ID NO: 338295 - protein, 23 aa, Mycobacterium
YQTRLQERYVWNSVDVLLEAFVF

SEQ ID NO: 338296 - protein, 19 aa, Mycobacterium
YQVPERIAVTLAELRSAYA

SEQ ID NO: 338297 - protein, 18 aa, Mycobacterium
YQVWRAEGTWPIWHGAGW

SEQ ID NO: 338298 - protein, 18 aa, Mycobacterium
YQVWRARGTWWGWHGAGW

SEQ ID NO: 338299 - protein, 22 aa, Mycobacterium
YRAALKDVYITAAFAAMFLFFK

SEQ ID NO: 338300 - protein, 21 aa, Mycobacterium
YRAGLIGGLALLPLLLVLAFV

SEQ ID NO: 338301 - protein, 17 aa, Mycobacterium
YRALKGLITDPVGTIVR

SEQ ID NO: 338302 - protein, 23 aa, Mycobacterium
YRANMPGPFLFPGEDLPQTTVPV

SEQ ID NO: 338303 - protein, 20 aa, Mycobacterium
YRATNRVILLGFAMEALACL

SEQ ID NO: 338304 - protein, 18 aa, Mycobacterium
YRAVCLCPGCGDNSAHLI

SEQ ID NO: 338305 - protein, 21 aa, Mycobacterium
YRAVEHLARVEARGDTEMLAP

SEQ ID NO: 338306 - protein, 19 aa, Mycobacterium
YRAVINFKLGLDIYNEQFD

SEQ ID NO: 338307 - protein, 21 aa, Mycobacterium
YRAVLNFRRGWDIYNEHFDYV

SEQ ID NO: 338308 - protein, 17 aa, Mycobacterium
YRDELGMATDRLKGWAQ

SEQ ID NO: 338309 - protein, 18 aa, Mycobacterium
YRDVAGWFAISSDGPPTA

SEQ ID NO: 338310 - protein, 19 aa, Mycobacterium
YRDVDAFERRRAIWQWLLV

SEQ ID NO: 338311 - protein, 17 aa, Mycobacterium
YRDVQAFSMNDILTMML

SEQ ID NO: 338312 - protein, 21 aa, Mycobacterium
YREHFGFPLVVCARETERYER

SEQ ID NO: 338313 - protein, 17 aa, Mycobacterium
YREQIFRSFGYALVATL

SEQ ID NO: 338314 - protein, 25 aa, Mycobacterium
YRERLWVPLWWWLPGLGLAALIALE

SEQ ID NO: 338315 - protein, 23 aa, Mycobacterium
YREVRTGHDVRWTVVLDTAVRIS

SEQ ID NO: 338316 - protein, 35 aa, Mycobacterium
YRFTEPRPGDVVVFKGPPSWNIGYKSIRSDNPVIR

SEQ ID NO: 338317 - protein, 17 aa, Mycobacterium
YRFTLANERTFLAWQRT

SEQ ID NO: 338318 - protein, 18 aa, Mycobacterium
YRFTPKVAWLTLLAGSAM

SEQ ID NO: 338319 - protein, 17 aa, Mycobacterium
YRFTQNVGYGSDGKLVA

SEQ ID NO: 338320 - protein, 21 aa, Mycobacterium
YRGGPTLKNGDIIGLDRTKTP

SEQ ID NO: 338321 - protein, 28 aa, Mycobacterium
YRGGWADRVLMRLADVQLAFPAILLALA

SEQ ID NO: 338322 - protein, 17 aa, Mycobacterium
YRGGWLDTIVMRVVDVM

SEQ ID NO: 338323 - protein, 26 aa, Mycobacterium
YRGWLNRMMLYFGWNVSVSQTINPLP

SEQ ID NO: 338324 - protein, 18 aa, Mycobacterium
YRIARFVAAVAGLLGTIL

SEQ ID NO: 338325 - protein, 18 aa, Mycobacterium
YRIGLKVASPSASRQIIG

SEQ ID NO: 338326 - protein, 21 aa, Mycobacterium
YRKELLRMVAQMGMGTGAMAV

SEQ ID NO: 338327 - protein, 25 aa, Mycobacterium
YRKEMLRLIAEIGMGTGAMAVVGGT

SEQ ID NO: 338328 - protein, 26 aa, Mycobacterium
YRKETIRLIAEMTMGAGALVMIGGTV

SEQ ID NO: 338329 - protein, 22 aa, Mycobacterium
YRKETLRLIAQIGMGTGAMAVV

SEQ ID NO: 338330 - protein, 20 aa, Mycobacterium
YRKETVRLIAEMTMGAGALV

SEQ ID NO: 338331 - protein, 25 aa, Mycobacterium
YRKEVLRLIAEIGMGTGAMAAVGGT

SEQ ID NO: 338332 - protein, 35 aa, Mycobacterium
YRKLARLGSYGSWIMYYVCGISIRVTDLQGRTAVF

SEQ ID NO: 338333 - protein, 39 aa, Mycobacterium
YRKLVRLGSYGAWIPYYLCELSLRVSDLQYRTVVSPIYR

SEQ ID NO: 338334 - protein, 37 aa, Mycobacterium
YRKLVRLGSYGSWLNLYICGVSIRVSDLQGRTAHFPW

SEQ ID NO: 338335 - protein, 33 aa, Mycobacterium
YRKLVRLGSYGSWLNLYICGVSVRVTDLQGRTA

SEQ ID NO: 338336 - protein, 18 aa, Mycobacterium
YRLFSAFMFQHLTLSILV

SEQ ID NO: 338337 - protein, 24 aa, Mycobacterium
YRLGRWGVPVNIGALIYGVAAIVN

SEQ ID NO: 338338 - protein, 19 aa, Mycobacterium
YRLLTSAFLHFGLTHLAFN

SEQ ID NO: 338339 - protein, 26 aa, Mycobacterium
YRLPPPRPLHRAGRRPPISMIPSFPG

SEQ ID NO: 338340 - protein, 18 aa, Mycobacterium
YRLQRLIATGGMGQVWEG

SEQ ID NO: 338341 - protein, 19 aa, Mycobacterium
YRLVELLGRGGMGEVWRAY

SEQ ID NO: 338342 - protein, 26 aa, Mycobacterium
YRLVSVLRLGVLVFLIGAMLIGTPQH

SEQ ID NO: 338343 - protein, 20 aa, Mycobacterium
YRLWDHIRFNTTITEACFDE

SEQ ID NO: 338344 - protein, 24 aa, Mycobacterium
YRNACATAPGLGCYNVRDPLDLAL

SEQ ID NO: 338345 - protein, 17 aa, Mycobacterium
YRNSLARAMSWAERPVH

SEQ ID NO: 338346 - protein, 21 aa, Mycobacterium
YRPDEDLVRWGARVDDPSGGP

SEQ ID NO: 338347 - protein, 21 aa, Mycobacterium
YRPDEDLVRWGGRVDDPAGGP

SEQ ID NO: 338348 - protein, 20 aa, Mycobacterium
YRPELGVLYPSELATGMRIY

SEQ ID NO: 338349 - protein, 20 aa, Mycobacterium
YRPELGVLYPSELDTGMRIY

SEQ ID NO: 338350 - protein, 19 aa, Mycobacterium
YRPELGVLYPSELENGMRI

SEQ ID NO: 338351 - protein, 21 aa, Mycobacterium
YRPELGVLYPSHLATGMRIYV

SEQ ID NO: 338352 - protein, 18 aa, Mycobacterium
YRPGEALLALYRRRGAFI

SEQ ID NO: 338353 - protein, 26 aa, Mycobacterium
YRPGPPSYPSRPSWPSPPPDRPPDPV

SEQ ID NO: 338354 - protein, 20 aa, Mycobacterium
YRPLEFKGIGPVGWQGIVPR

SEQ ID NO: 338355 - protein, 19 aa, Mycobacterium
YRPPWAFAAATVMTLLTFA

SEQ ID NO: 338356 - protein, 22 aa, Mycobacterium
YRPRLPRLSRWRVGFATWLTDA

SEQ ID NO: 338357 - protein, 18 aa, Mycobacterium
YRQAIPALFSTGLPNTLI

SEQ ID NO: 338358 - protein, 19 aa, Mycobacterium
YRQAIPTLFKTGLPNTLIL

SEQ ID NO: 338359 - protein, 23 aa, Mycobacterium
YRQAQLLLRRWTALGANVREHPI

SEQ ID NO: 338360 - protein, 17 aa, Mycobacterium
YRQFVVFDAIGAVVWAT

SEQ ID NO: 338361 - protein, 19 aa, Mycobacterium
YRQGFAVAQDQPWFRQYAM

SEQ ID NO: 338362 - protein, 17 aa, Mycobacterium
YRQIMAADDHRAHPYVD

SEQ ID NO: 338363 - protein, 17 aa, Mycobacterium
YRQQRIWGASPLVASWQ

SEQ ID NO: 338364 - protein, 17 aa, Mycobacterium
YRQRLFRDRGIASVSQL

SEQ ID NO: 338365 - protein, 24 aa, Mycobacterium
YRQYRNIMWWTVLWAATWLLALVT

SEQ ID NO: 338366 - protein, 20 aa, Mycobacterium
YRREIIRLVAEISMGAGTLA

SEQ ID NO: 338367 - protein, 20 aa, Mycobacterium
YRREVIRLIAEISMGAGTLA

SEQ ID NO: 338368 - protein, 20 aa, Mycobacterium
YRRGFVTRHQVSGWRFVMRR

SEQ ID NO: 338369 - protein, 24 aa, Mycobacterium
YRRGGAVHLRVWFAERLAEASGAE

SEQ ID NO: 338370 - protein, 39 aa, Mycobacterium
YRRGLRHPWLYFVSSLFTSFAFAFAFYFATMERQRRHAQ

SEQ ID NO: 338371 - protein, 24 aa, Mycobacterium
YRRLLRASVNWGCVLTTTELAPCS

SEQ ID NO: 338372 - protein, 19 aa, Mycobacterium
YRRSLRLAAAVLAARSPAR

SEQ ID NO: 338373 - protein, 34 aa, Mycobacterium
YRRYTAEFLQAAALRAGNPIAIAGIPVGTVTSMK

SEQ ID NO: 338374 - protein, 17 aa, Mycobacterium
YRSAFGAQFFSGLVSPA

SEQ ID NO: 338375 - protein, 20 aa, Mycobacterium
YRSDDPWIFGLEFGAVLVGI

SEQ ID NO: 338376 - protein, 18 aa, Mycobacterium
YRSEAAILEMFRTDRPEV

SEQ ID NO: 338377 - protein, 26 aa, Mycobacterium
YRSFWAMCAGWLGFNGVFYGLLTWGP

SEQ ID NO: 338378 - protein, 19 aa, Mycobacterium
YRSGMPLEDVIEIVTAVAE

SEQ ID NO: 338379 - protein, 18 aa, Mycobacterium
YRSITRAIIPLFGVLITL

SEQ ID NO: 338380 - protein, 19 aa, Mycobacterium
YRSIVVFGIANLVGLSVVA

SEQ ID NO: 338381 - protein, 19 aa, Mycobacterium
YRSLKELGVRTPGKLDWAG

SEQ ID NO: 338382 - protein, 18 aa, Mycobacterium
YRSLWVFLLLPVLILLTV

SEQ ID NO: 338383 - protein, 25 aa, Mycobacterium
YRSPDASTAWAVVWVVAAAAIGQVV

SEQ ID NO: 338384 - protein, 17 aa, Mycobacterium
YRSPVLWLVPLLVVGFA

SEQ ID NO: 338385 - protein, 24 aa, Mycobacterium
YRSSKFVMRRWAPVGLAVVGLLLL

SEQ ID NO: 338386 - protein, 17 aa, Mycobacterium
YRSSMRLVVVPQGVRRV

SEQ ID NO: 338387 - protein, 23 aa, Mycobacterium
YRSTRPLPVWGTWKTLLRVQDGY

SEQ ID NO: 338388 - protein, 20 aa, Mycobacterium
YRSVIGLCEALRLKVIAEGI

SEQ ID NO: 338389 - protein, 20 aa, Mycobacterium
YRSVITMVIVVAMVMLELAS

SEQ ID NO: 338390 - protein, 24 aa, Mycobacterium
YRTELIRLIATMGLGAGALAVVGG

SEQ ID NO: 338391 - protein, 36 aa, Mycobacterium
YRTMMMHLMRLARSFGVVPVGGWALRAIIAALLEWQ

SEQ ID NO: 338392 - protein, 19 aa, Mycobacterium
YRTRLGFAVVAGDPIGEES

SEQ ID NO: 338393 - protein, 33 aa, Mycobacterium
YRTVPGPGSSGWLRLGVLAALIATALALLINRR

SEQ ID NO: 338394 - protein, 17 aa, Mycobacterium
YRVEPDAAFGGWLMPVV

SEQ ID NO: 338395 - protein, 29 aa, Mycobacterium
YRVLAIAAWLAVLVCVDFVALQLITGVWT

SEQ ID NO: 338396 - protein, 18 aa, Mycobacterium
YRVLGLLTALSLVASGAM

SEQ ID NO: 338397 - protein, 20 aa, Mycobacterium
YRVNRKWRPLLVAYPLIMAF

SEQ ID NO: 338398 - protein, 18 aa, Mycobacterium
YRVRRIEKLLSTSLADPE

SEQ ID NO: 338399 - protein, 17 aa, Mycobacterium
YRYPQNLPIVGAKGGPG

SEQ ID NO: 338400 - protein, 18 aa, Mycobacterium
YRYRLRVLVAATVAAGVI

SEQ ID NO: 338401 - protein, 17 aa, Mycobacterium
YSAHFGRADILLIAHSA

SEQ ID NO: 338402 - protein, 27 aa, Mycobacterium
YSALRAGVGFIPFVIALGIGLGVSSAL

SEQ ID NO: 338403 - protein, 19 aa, Mycobacterium
YSALRAGVGFIPFVIAMGI

SEQ ID NO: 338404 - protein, 17 aa, Mycobacterium
YSAPWMLFLGLAMSGIT

SEQ ID NO: 338405 - protein, 19 aa, Mycobacterium
YSAVGLLRSFAWVDAPSGT

SEQ ID NO: 338406 - protein, 20 aa, Mycobacterium
YSDDTWRLWSVDWTAADPGE

SEQ ID NO: 338407 - protein, 28 aa, Mycobacterium
YSDRLARLAGFSIRHKVLIIGMWVVTAA

SEQ ID NO: 338408 - protein, 19 aa, Mycobacterium
YSDRLFAAVAWFGAALSAA

SEQ ID NO: 338409 - protein, 20 aa, Mycobacterium
YSDRLFAGGCWFGAAVSVAV

SEQ ID NO: 338410 - protein, 22 aa, Mycobacterium
YSDVNAMLVIPGRSIYTANQQG

SEQ ID NO: 338411 - protein, 22 aa, Mycobacterium
YSFESTPLWAGIYMLPMTIGFL

SEQ ID NO: 338412 - protein, 23 aa, Mycobacterium
YSFLSFYPYYGFQGLTSHYANPL

SEQ ID NO: 338413 - protein, 19 aa, Mycobacterium
YSGDRRLSLGTERTDADIH

SEQ ID NO: 338414 - protein, 22 aa, Mycobacterium
YSGEFLRLLSNITWGNGSIVVG

SEQ ID NO: 338415 - protein, 25 aa, Mycobacterium
YSGGMPPHQVCEIVTAMAGALDYAH

SEQ ID NO: 338416 - protein, 26 aa, Mycobacterium
YSGHVRWSIRVMIVILWFSAAMAIIS

SEQ ID NO: 338417 - protein, 18 aa, Mycobacterium
YSGLPFWPQGKIYDAYFS

SEQ ID NO: 338418 - protein, 20 aa, Mycobacterium
YSGLVIAIGPLVAWAVLVLP

SEQ ID NO: 338419 - protein, 23 aa, Mycobacterium
YSGNPWNALSAMMIGFFMIMLDS

SEQ ID NO: 338420 - protein, 18 aa, Mycobacterium
YSGSPAWNHSYSVAALRA

SEQ ID NO: 338421 - protein, 18 aa, Mycobacterium
YSHGAFIFLGPGFTPGSP

SEQ ID NO: 338422 - protein, 20 aa, Mycobacterium
YSHLEFRTTMLYRLVRHPIM

SEQ ID NO: 338423 - protein, 17 aa, Mycobacterium
YSIARVITGSSFETLPV

SEQ ID NO: 338424 - protein, 17 aa, Mycobacterium
YSIAVILSFLASKLTTV

SEQ ID NO: 338425 - protein, 20 aa, Mycobacterium
YSKRTILLWTALGGMLPALV

SEQ ID NO: 338426 - protein, 28 aa, Mycobacterium
YSLAVLAAFFAARFTTVFINGQSAGLYD

SEQ ID NO: 338427 - protein, 20 aa, Mycobacterium
YSLDELPQFFNVLFGDMSVV

SEQ ID NO: 338428 - protein, 22 aa, Mycobacterium
YSLDNKRLWSNLDCAPSNETLV

SEQ ID NO: 338429 - protein, 17 aa, Mycobacterium
YSLDYLVFGKNWMDGWH

SEQ ID NO: 338430 - protein, 19 aa, Mycobacterium
YSLFILMRFREELRAGRDQ

SEQ ID NO: 338431 - protein, 19 aa, Mycobacterium
YSLFILMRFREELRAGREP

SEQ ID NO: 338432 - protein, 17 aa, Mycobacterium
YSLIKAVIFVWIASTIQ

SEQ ID NO: 338433 - protein, 18 aa, Mycobacterium
YSLIKAVIFVWIASTIQC

SEQ ID NO: 338434 - protein, 22 aa, Mycobacterium
YSLPMRRVVGFVATALDASVIP

SEQ ID NO: 338435 - protein, 17 aa, Mycobacterium
YSLRFVALGYIFVLLVV

SEQ ID NO: 338436 - protein, 26 aa, Mycobacterium
YSLTIIPLFIVMGIFAVRAGLAQAGF

SEQ ID NO: 338437 - protein, 22 aa, Mycobacterium
YSNGWANIRAFAGGCGLADDVL

SEQ ID NO: 338438 - protein, 31 aa, Mycobacterium
YSNHDLRFIIAMTICVVLLILIALLRAVVAP

SEQ ID NO: 338439 - protein, 18 aa, Mycobacterium
YSNNVFLKFEDREITYGE

SEQ ID NO: 338440 - protein, 19 aa, Mycobacterium
YSPEFFCTIRNYYDEEPAA

SEQ ID NO: 338441 - protein, 25 aa, Mycobacterium
YSPEFGCLFKGIGRGIKEFAPLIGV

SEQ ID NO: 338442 - protein, 19 aa, Mycobacterium
YSPEYTCLLEGAKYLLDHG

SEQ ID NO: 338443 - protein, 18 aa, Mycobacterium
YSPLRTGIAAIPFVVGMG

SEQ ID NO: 338444 - protein, 18 aa, Mycobacterium
YSPPTSQVRVSAVFAGNG

SEQ ID NO: 338445 - protein, 24 aa, Mycobacterium
YSPRRCNRSAVLQAISDAQHVAAE

SEQ ID NO: 338446 - protein, 26 aa, Mycobacterium
YSPSYTCLLLGAKHLLDEGGYEAPGG

SEQ ID NO: 338447 - protein, 18 aa, Mycobacterium
YSPTVSVAPFDPAVGAAL

SEQ ID NO: 338448 - protein, 20 aa, Mycobacterium
YSRGAAMLCLGSFLMQLFVQ

SEQ ID NO: 338449 - protein, 20 aa, Mycobacterium
YSSEFDRVTLEAGEDVAKTG

SEQ ID NO: 338450 - protein, 19 aa, Mycobacterium
YSSPRYCIAMTAALEHYTA

SEQ ID NO: 338451 - protein, 21 aa, Mycobacterium
YSSRASAAAYCVADQSQELFL

SEQ ID NO: 338452 - protein, 21 aa, Mycobacterium
YSSSVAYLLGRLVSLTVLTTA

SEQ ID NO: 338453 - protein, 20 aa, Mycobacterium
YSTRSGVLWRLITFTYQANL

SEQ ID NO: 338454 - protein, 23 aa, Mycobacterium
YSTYELFAGGALFFETAALIIAF

SEQ ID NO: 338455 - protein, 24 aa, Mycobacterium
YSTYELFAGGPLFFDTSALIIAFV

SEQ ID NO: 338456 - protein, 22 aa, Mycobacterium
YSVALFGYVAVDAFAGDVTATR

SEQ ID NO: 338457 - protein, 17 aa, Mycobacterium
YSVIKAVVFVWIASTIQ

SEQ ID NO: 338458 - protein, 18 aa, Mycobacterium
YSVWTLWPVLVLFMPENV

SEQ ID NO: 338459 - protein, 24 aa, Mycobacterium
YSWYLWHWPVLLLAPPLLGHPLGL

SEQ ID NO: 338460 - protein, 25 aa, Mycobacterium
YSWYLWHWPVLLLLPPLLGDPAGLP

SEQ ID NO: 338461 - protein, 18 aa, Mycobacterium
YSYLPSWISFLGDREISM

SEQ ID NO: 338462 - protein, 25 aa, Mycobacterium
YTAAEYSWFIGCGVALVVYYLLATR

SEQ ID NO: 338463 - protein, 18 aa, Mycobacterium
YTDACPIATIALEVASTD

SEQ ID NO: 338464 - protein, 27 aa, Mycobacterium
YTDAVPFPSFKQGEGLILQLPNPTVVG

SEQ ID NO: 338465 - protein, 30 aa, Mycobacterium
YTDILFKKPLRLWVAVSLYGGTALTVALTI

SEQ ID NO: 338466 - protein, 17 aa, Mycobacterium
YTDRLAWSLTVLVAVAW

SEQ ID NO: 338467 - protein, 17 aa, Mycobacterium
YTFGGNWFADAPADRRR

SEQ ID NO: 338468 - protein, 17 aa, Mycobacterium
YTFGGNWLYDASAESQR

SEQ ID NO: 338469 - protein, 24 aa, Mycobacterium
YTFTGSAVGLIFLWFSMTPSLLPR

SEQ ID NO: 338470 - protein, 24 aa, Mycobacterium
YTFTGTAVGLVFLWLSMTPSLLPR

SEQ ID NO: 338471 - protein, 17 aa, Mycobacterium
YTGEFLLGYLADYHIPT

SEQ ID NO: 338472 - protein, 22 aa, Mycobacterium
YTGETRFPLILQNIHRYFFYAA

SEQ ID NO: 338473 - protein, 20 aa, Mycobacterium
YTGGTRFCFTLPVMPTNKPG

SEQ ID NO: 338474 - protein, 24 aa, Mycobacterium
YTGLNTPLFLKGLARMFGEGAYMN

SEQ ID NO: 338475 - protein, 17 aa, Mycobacterium
YTGVSGWFDVPGSPEPR

SEQ ID NO: 338476 - protein, 19 aa, Mycobacterium
YTGYLTLVFLFAVLVLMGF

SEQ ID NO: 338477 - protein, 22 aa, Mycobacterium
YTILIIRGLRTAIAVRDSFGKL

SEQ ID NO: 338478 - protein, 25 aa, Mycobacterium
YTKPRLSWLDAMYFTAETITTVGYG

SEQ ID NO: 338479 - protein, 17 aa, Mycobacterium
YTLAFAIASYWLTIRRA

SEQ ID NO: 338480 - protein, 27 aa, Mycobacterium
YTLAQFLGWPWGKFRRPAQAARFHVVM

SEQ ID NO: 338481 - protein, 21 aa, Mycobacterium
YTLDNQRLWSNLDCAPSNETL

SEQ ID NO: 338482 - protein, 30 aa, Mycobacterium
YTLEPAQWLLLIWLLVRWIRTRDDRLLVAA

SEQ ID NO: 338483 - protein, 24 aa, Mycobacterium
YTLKAELPASGGLYKTSNVTYRGE

SEQ ID NO: 338484 - protein, 18 aa, Mycobacterium
YTLKVMTWVTAFMAPLTV

SEQ ID NO: 338485 - protein, 17 aa, Mycobacterium
YTLKVMTWVTVIMAPLT

SEQ ID NO: 338486 - protein, 17 aa, Mycobacterium
YTLPILMSVALMLVAAA

SEQ ID NO: 338487 - protein, 20 aa, Mycobacterium
YTLRFAPRGYRRWSPAVVGI

SEQ ID NO: 338488 - protein, 19 aa, Mycobacterium
YTPEAARLLTLPDILNSVV

SEQ ID NO: 338489 - protein, 19 aa, Mycobacterium
YTPRTSRAFAPRLDPEAVG

SEQ ID NO: 338490 - protein, 22 aa, Mycobacterium
YTPWSWLPRIIMQFTAGALACA

SEQ ID NO: 338491 - protein, 23 aa, Mycobacterium
YTQARSGSFGWAGALAGAMLIGT

SEQ ID NO: 338492 - protein, 17 aa, Mycobacterium
YTQLPFLVEAMLAAFIG

SEQ ID NO: 338493 - protein, 25 aa, Mycobacterium
YTQRRHAWISWMRRYGTRTPGFLRE

SEQ ID NO: 338494 - protein, 25 aa, Mycobacterium
YTRADCPRYGELKGPSCFTAPLVPV

SEQ ID NO: 338495 - protein, 25 aa, Mycobacterium
YTRADCPRYGELKGPSCFTAPQIAV

SEQ ID NO: 338496 - protein, 30 aa, Mycobacterium
YTRADCPRYGELRAPSCFTAPLVQARPDLP

SEQ ID NO: 338497 - protein, 25 aa, Mycobacterium
YTRADCPRYGQLLGPSCYTAPTIAV

SEQ ID NO: 338498 - protein, 34 aa, Mycobacterium
YTREGRTLYEFVRFYWLHPELRVELADDRAVERF

SEQ ID NO: 338499 - protein, 23 aa, Mycobacterium
YTRSEGAGMLVLKRVDDARRDGD

SEQ ID NO: 338500 - protein, 23 aa, Mycobacterium
YTRSEGGGMFVLKRVDDARRDGD

SEQ ID NO: 338501 - protein, 26 aa, Mycobacterium
YTSNRLAKIPLDWDATLVSEGKGRAL

SEQ ID NO: 338502 - protein, 19 aa, Mycobacterium
YTSVVLVFLAFMVALVGGA

SEQ ID NO: 338503 - protein, 18 aa, Mycobacterium
YTTGPAHRTRKWAEYLTV

SEQ ID NO: 338504 - protein, 27 aa, Mycobacterium
YTVAEFWRFWVVHLWVEDFLELFTTVM

SEQ ID NO: 338505 - protein, 22 aa, Mycobacterium
YTVGHWRAWLFIGLGAAVAATS

SEQ ID NO: 338506 - protein, 18 aa, Mycobacterium
YTVRRGALLFGKLLPVGI

SEQ ID NO: 338507 - protein, 22 aa, Mycobacterium
YTVTCFVFFFIGGLMALLMRTE

SEQ ID NO: 338508 - protein, 21 aa, Mycobacterium
YTWLLVPAVIWLLSGQVISGR

SEQ ID NO: 338509 - protein, 22 aa, Mycobacterium
YVAAHVPYLMWLIQASANSAAM

SEQ ID NO: 338510 - protein, 23 aa, Mycobacterium
YVAAHVPYVAWLMQTSADSAATA

SEQ ID NO: 338511 - protein, 18 aa, Mycobacterium
YVAEPLIGQGLETLLGGT

SEQ ID NO: 338512 - protein, 24 aa, Mycobacterium
YVAEYHGTVSIMRGIQGSLLGMPL

SEQ ID NO: 338513 - protein, 21 aa, Mycobacterium
YVAEYYRYFGATASPFDWYAT

SEQ ID NO: 338514 - protein, 18 aa, Mycobacterium
YVAGRGVGLGYWRRTGLT

SEQ ID NO: 338515 - protein, 20 aa, Mycobacterium
YVAIAIWAAVIVYRTVTDGF

SEQ ID NO: 338516 - protein, 18 aa, Mycobacterium
YVAKRLWDSGARRLAAWT

SEQ ID NO: 338517 - protein, 21 aa, Mycobacterium
YVALEVLKLAGLFTGGILLLA

SEQ ID NO: 338518 - protein, 20 aa, Mycobacterium
YVARLRRAHPAAGPAEIVAK

SEQ ID NO: 338519 - protein, 17 aa, Mycobacterium
YVARPVGGILFGHFGDR

SEQ ID NO: 338520 - protein, 30 aa, Mycobacterium
YVATPARRARWLLWALISWPRVAKACGLST

SEQ ID NO: 338521 - protein, 22 aa, Mycobacterium
YVDAHAPYLAWLTTTSADYAAT

SEQ ID NO: 338522 - protein, 25 aa, Mycobacterium
YVDNFSGQSAMNWGQSTFRSSELGS

SEQ ID NO: 338523 - protein, 19 aa, Mycobacterium
YVEQVPHPPSWIGIVHGWI

SEQ ID NO: 338524 - protein, 17 aa, Mycobacterium
YVFARPPLLGPSGQLVA

SEQ ID NO: 338525 - protein, 22 aa, Mycobacterium
YVFARPPLLGPSGRLFATGVTV

SEQ ID NO: 338526 - protein, 19 aa, Mycobacterium
YVFARPPLLGPSGRMVATG

SEQ ID NO: 338527 - protein, 17 aa, Mycobacterium
YVFPLGVVVGGPFLPLA

SEQ ID NO: 338528 - protein, 31 aa, Mycobacterium
YVFPLGVVVGGPFLPLAIILYWFSNNIWTFA

SEQ ID NO: 338529 - protein, 31 aa, Mycobacterium
YVFPLGVVVGGPFLPLAIILYWFSNNIWTFG

SEQ ID NO: 338530 - protein, 35 aa, Mycobacterium
YVFPLGVVVGGPFLPLAVIMYWLANNIWTYGQQHY

SEQ ID NO: 338531 - protein, 20 aa, Mycobacterium
YVFSTFVMRGLNGIDSREAI

SEQ ID NO: 338532 - protein, 23 aa, Mycobacterium
YVFTRWFPTHFVTLWMVDTPSHH

SEQ ID NO: 338533 - protein, 18 aa, Mycobacterium
YVGAVFRDIMQILLVTSL

SEQ ID NO: 338534 - protein, 19 aa, Mycobacterium
YVGFEVLLAASFVLLTIGA

SEQ ID NO: 338535 - protein, 17 aa, Mycobacterium
YVGNVILMLGIPLALGS

SEQ ID NO: 338536 - protein, 24 aa, Mycobacterium
YVGRAGLTAARFVACPFRVGASGQ

SEQ ID NO: 338537 - protein, 28 aa, Mycobacterium
YVGSLNYLLCWGLLYQLGIAWRGGLLAG

SEQ ID NO: 338538 - protein, 26 aa, Mycobacterium
YVIARSYLRLRVHRWEFNEVALYVQT

SEQ ID NO: 338539 - protein, 21 aa, Mycobacterium
YVICSGLAALTGVLLTARLTI

SEQ ID NO: 338540 - protein, 22 aa, Mycobacterium
YVIEAPPVFFARHASLVAATLL

SEQ ID NO: 338541 - protein, 17 aa, Mycobacterium
YVIFPALTGPLFPITFL

SEQ ID NO: 338542 - protein, 17 aa, Mycobacterium
YVIGLMMDNPERNADGS

SEQ ID NO: 338543 - protein, 17 aa, Mycobacterium
YVISALLAIIAIGFLAS

SEQ ID NO: 338544 - protein, 18 aa, Mycobacterium
YVLALALFVFVCYHIAGF

SEQ ID NO: 338545 - protein, 19 aa, Mycobacterium
YVLALLIERSMGFRLSRED

SEQ ID NO: 338546 - protein, 17 aa, Mycobacterium
YVLDRVGERLVMTVGSA

SEQ ID NO: 338547 - protein, 23 aa, Mycobacterium
YVLFKTRIGNWIFAVGGNQDSAR

SEQ ID NO: 338548 - protein, 19 aa, Mycobacterium
YVLHRAWVGPMVLLVLDDP

SEQ ID NO: 338549 - protein, 18 aa, Mycobacterium
YVLLPGRPLPPATYSATE

SEQ ID NO: 338550 - protein, 22 aa, Mycobacterium
YVLRLPDLLTRSLLSVLLVAPV

SEQ ID NO: 338551 - protein, 17 aa, Mycobacterium
YVLSRITLPGSIYLGVI

SEQ ID NO: 338552 - protein, 19 aa, Mycobacterium
YVLSSQFYLALPIQATVLA

SEQ ID NO: 338553 - protein, 20 aa, Mycobacterium
YVMSCAAIVTAVLQHWVDAA

SEQ ID NO: 338554 - protein, 26 aa, Mycobacterium
YVMVDHRLHPALNLVSARLIAGEDAN

SEQ ID NO: 338555 - protein, 23 aa, Mycobacterium
YVNELQALLVDWGFTPMTVGPRP

SEQ ID NO: 338556 - protein, 18 aa, Mycobacterium
YVNGRRVSSVDLQDGQVL

SEQ ID NO: 338557 - protein, 18 aa, Mycobacterium
YVPAETLLAATHYVQAQN

SEQ ID NO: 338558 - protein, 17 aa, Mycobacterium
YVPELPTDLDSWSVIAD

SEQ ID NO: 338559 - protein, 24 aa, Mycobacterium
YVPLARGPIVWWVEWLAEKTQKTK

SEQ ID NO: 338560 - protein, 18 aa, Mycobacterium
YVQPGLHAPMGAYPAEPV

SEQ ID NO: 338561 - protein, 18 aa, Mycobacterium
YVREAMLVAAAWLAIFAL

SEQ ID NO: 338562 - protein, 18 aa, Mycobacterium
YVREAMLVAAAWLAVFAL

SEQ ID NO: 338563 - protein, 40 aa, Mycobacterium
YVRGGYDGLTSWLTGMFDRSAWRPAAVVVVGSDLDISDFS

SEQ ID NO: 338564 - protein, 21 aa, Mycobacterium
YVRKNLWWLLASSMTACAILI

SEQ ID NO: 338565 - protein, 19 aa, Mycobacterium
YVRRTIIFNGWNWSATQTI

SEQ ID NO: 338566 - protein, 17 aa, Mycobacterium
YVSARWPGDTHTFAQVL

SEQ ID NO: 338567 - protein, 19 aa, Mycobacterium
YVSGNPWIFALEVVGVLTG

SEQ ID NO: 338568 - protein, 18 aa, Mycobacterium
YVSLDVMRGIAILGTLGT

SEQ ID NO: 338569 - protein, 23 aa, Mycobacterium
YVSLFLRRRFHAGSDNRPREDAT

SEQ ID NO: 338570 - protein, 26 aa, Mycobacterium
YVTQAPPVFFGWRPSLVAATLLSPAA

SEQ ID NO: 338571 - protein, 22 aa, Mycobacterium
YVTQRLSERLRAPVVTSPQPQL

SEQ ID NO: 338572 - protein, 17 aa, Mycobacterium
YVTRALCFVTIGFGLYM

SEQ ID NO: 338573 - protein, 17 aa, Mycobacterium
YVTRFPLLKPLDMSDAV

SEQ ID NO: 338574 - protein, 21 aa, Mycobacterium
YVTRGAGFWGPPLRIGAPPDI

SEQ ID NO: 338575 - protein, 24 aa, Mycobacterium
YVTRLERRSVFPGGLSFVTGLFVA

SEQ ID NO: 338576 - protein, 18 aa, Mycobacterium
YVTVCIAISLVVYLFFLK

SEQ ID NO: 338577 - protein, 23 aa, Mycobacterium
YVVACAVGGVLLAMAEGRPVVSA

SEQ ID NO: 338578 - protein, 24 aa, Mycobacterium
YVVGGRPFLSGALDEIRSRKPAMM

SEQ ID NO: 338579 - protein, 26 aa, Mycobacterium
YVVIASVGLWWFIRRQISRQRRGIEP

SEQ ID NO: 338580 - protein, 20 aa, Mycobacterium
YVVSVAVMFLLLPTISETPG

SEQ ID NO: 338581 - protein, 18 aa, Mycobacterium
YVVSYVFIAIVWVNHHHL

SEQ ID NO: 338582 - protein, 20 aa, Mycobacterium
YVVTCFIFFLIGGLLALLMR

SEQ ID NO: 338583 - protein, 20 aa, Mycobacterium
YVVTCFVFFLIGGIMALFIR

SEQ ID NO: 338584 - protein, 24 aa, Mycobacterium
YVWSWASGRGRGWREVPRAVYAFD

SEQ ID NO: 338585 - protein, 30 aa, Mycobacterium
YVYARRATVRAVWGAAVWAATLAVVVGAMV

SEQ ID NO: 338586 - protein, 31 aa, Mycobacterium
YVYGRERLGPFWGHTAGWSFIVGKTASCAAM

SEQ ID NO: 338587 - protein, 24 aa, Mycobacterium
YVYSLDNKRLWSNLDCAPSNETLI

SEQ ID NO: 338588 - protein, 17 aa, Mycobacterium
YVYTLDNQRLWSNLDCA

SEQ ID NO: 338589 - protein, 27 aa, Mycobacterium
YWARQRARRALLFWVIAVITLAGLAAA

SEQ ID NO: 338590 - protein, 28 aa, Mycobacterium
YWDKHCFDIPICWSIRSIFDALDGVDQV

SEQ ID NO: 338591 - protein, 18 aa, Mycobacterium
YWDSPLFMRINAVITAVW

SEQ ID NO: 338592 - protein, 28 aa, Mycobacterium
YWEKHCFDIPICWSIRSIFDALDGADAL

SEQ ID NO: 338593 - protein, 27 aa, Mycobacterium
YWEKHCYDIPVCFALRSIYDALDGIDQ

SEQ ID NO: 338594 - protein, 27 aa, Mycobacterium
YWEKHCYDIPVCIGLRSLFDTFDGFDQ

SEQ ID NO: 338595 - protein, 21 aa, Mycobacterium
YWFRGHFWLATIVVLSVQYLG

SEQ ID NO: 338596 - protein, 24 aa, Mycobacterium
YWGAFKAVPQWVIALIALIIVLTM

SEQ ID NO: 338597 - protein, 24 aa, Mycobacterium
YWHRSIRQTVQFERAIRTAFNSGC

SEQ ID NO: 338598 - protein, 20 aa, Mycobacterium
YWIIRHLMPVFTRMQSLIDG

SEQ ID NO: 338599 - protein, 22 aa, Mycobacterium
YWIMTHMLPLFRSMQALIDGIN

SEQ ID NO: 338600 - protein, 19 aa, Mycobacterium
YWITRRTVIALRWAIEERP

SEQ ID NO: 338601 - protein, 21 aa, Mycobacterium
YWLFLCGGLITLAGFIAPGGA

SEQ ID NO: 338602 - protein, 17 aa, Mycobacterium
YWLGRLVLERGVAAVYL

SEQ ID NO: 338603 - protein, 24 aa, Mycobacterium
YWLMLCGMLIYLLGYGSRALLILR

SEQ ID NO: 338604 - protein, 24 aa, Mycobacterium
YWMDVPLWLSALIFMVLMTATNLF

SEQ ID NO: 338605 - protein, 17 aa, Mycobacterium
YWMGWYVIVGTMPIGIL

SEQ ID NO: 338606 - protein, 34 aa, Mycobacterium
YWQWLSLTLAAPVVVWGAWPFHRATWANLRHGTA

SEQ ID NO: 338607 - protein, 18 aa, Mycobacterium
YWRTVIGVLAAVAVLVIG

SEQ ID NO: 338608 - protein, 19 aa, Mycobacterium
YWSAFKAIPQWSIALIALV

SEQ ID NO: 338609 - protein, 17 aa, Mycobacterium
YWTIRGWSARGPIKTGC

SEQ ID NO: 338610 - protein, 18 aa, Mycobacterium
YWTQHFQYLAARNAGKTS

SEQ ID NO: 338611 - protein, 17 aa, Mycobacterium
YWVAGAVSVLWLGVAGW

SEQ ID NO: 338612 - protein, 18 aa, Mycobacterium
YWYPGPPQQQGWQGNAPT

SEQ ID NO: 338613 - protein, 18 aa, Mycobacterium
YWYRKGYNPAAVIATAVS

SEQ ID NO: 338614 - protein, 25 aa, Mycobacterium
YWYRNIRQTVRFDRAVRYCHEQGCR

SEQ ID NO: 338615 - protein, 24 aa, Mycobacterium
YYAGNWASSVWCFRAGAEEKVDAE

SEQ ID NO: 338616 - protein, 18 aa, Mycobacterium
YYAGVYVWTLPAARLRRI

SEQ ID NO: 338617 - protein, 18 aa, Mycobacterium
YYAIESYGRVFGIFYATF

SEQ ID NO: 338618 - protein, 18 aa, Mycobacterium
YYASKSLILYDIYKSAAD

SEQ ID NO: 338619 - protein, 26 aa, Mycobacterium
YYFVRRGRYAIGEIFVPRGGVYGTWG

SEQ ID NO: 338620 - protein, 32 aa, Mycobacterium
YYGITAFACMWYFRKELFTSLRNVVFKFLCPL

SEQ ID NO: 338621 - protein, 23 aa, Mycobacterium
YYGLSVPEFPNFLMMYGPNTNVG

SEQ ID NO: 338622 - protein, 27 aa, Mycobacterium
YYGLYLPSMIWREITGFCTGAICLVFA

SEQ ID NO: 338623 - protein, 19 aa, Mycobacterium
YYHYRVRKPAVWTLFAVGV

SEQ ID NO: 338624 - protein, 28 aa, Mycobacterium
YYLAAFVVGSAVAWGIVTVSIKPVATTA

SEQ ID NO: 338625 - protein, 17 aa, Mycobacterium
YYLIGALVTALVPILVT

SEQ ID NO: 338626 - protein, 17 aa, Mycobacterium
YYLMFRFAITKWNMRTP

SEQ ID NO: 338627 - protein, 20 aa, Mycobacterium
YYLPQRAWNDPRFQRAAELY

SEQ ID NO: 338628 - protein, 30 aa, Mycobacterium
YYLPQRAWQDPRFQRAAGLYFGPDGHSTRM

SEQ ID NO: 338629 - protein, 19 aa, Mycobacterium
YYLVWPLLVLFAVLLLRRR

SEQ ID NO: 338630 - protein, 23 aa, Mycobacterium
YYNALYFPYVMGVRAYAQGATAA

SEQ ID NO: 338631 - protein, 17 aa, Mycobacterium
YYNEYRPDRETDPAAAQ

SEQ ID NO: 338632 - protein, 26 aa, Mycobacterium
YYNHDLRFIIVLTVIVVLLILVALLR

SEQ ID NO: 338633 - protein, 17 aa, Mycobacterium
YYPVSWIMWVWYKLFAL

SEQ ID NO: 338634 - protein, 18 aa, Mycobacterium
YYPVSWIMWVWYKLFALV

SEQ ID NO: 338635 - protein, 17 aa, Mycobacterium
YYPVSWIMWVWYKLFAS

SEQ ID NO: 338636 - protein, 24 aa, Mycobacterium
YYQLHVMIALALFAIWPFTRLVHA

SEQ ID NO: 338637 - protein, 18 aa, Mycobacterium
YYQWPVYEGLMWGGVQAA

SEQ ID NO: 338638 - protein, 17 aa, Mycobacterium
YYRTVWQSPTACAVAEP

SEQ ID NO: 338639 - protein, 23 aa, Mycobacterium
YYRYCTYAFIPFQMVSLVLACYL

SEQ ID NO: 338640 - protein, 18 aa, Mycobacterium
YYRYCTYAFLPFQYLSVV

SEQ ID NO: 338641 - protein, 22 aa, Mycobacterium
YYSKEFFRLLADVTWGNGSLVT

SEQ ID NO: 338642 - protein, 17 aa, Mycobacterium
YYTAYRGIAHVILGSGL

SEQ ID NO: 338643 - protein, 26 aa, Mycobacterium
YYVAEYNGRVSIVRGIQGTLLGVPLQ

SEQ ID NO: 338644 - protein, 17 aa, Mycobacterium
YYWGAAVAVGAAVCILM

SEQ ID NO: 338645 - protein, 20 aa, Mycobacterium
YYWIVCMAMSAVQDRLEQRL

SEQ ID NO: 338646 - protein, 34 aa, Mycobacterium
YYYMAETNLRFMLGRFATIDVRFLPGSVGTTMTM

SEQ ID NO: 338647 - protein, 19 aa, Mycobacterium
ASVALELLTGPSLLILDEP

SEQ ID NO: 338648 - protein, 17 aa, Mycobacterium
IKFFNWIGTMWKGQLTF

SEQ ID NO: 338649 - protein, 17 aa, Mycobacterium
FSWLRRRSGSLIAPIAL

SEQ ID NO: 338650 - protein, 18 aa, Mycobacterium
GIKFFNWIGTMWKGQLTF

SEQ ID NO: 338651 - protein, 17 aa, Mycobacterium
GVIPVIFASSLIYIPHL

SEQ ID NO: 338652 - protein, 17 aa, Mycobacterium
LFWFFGHPEVYIIALPF

SEQ ID NO: 338653 - protein, 18 aa, Mycobacterium
LVAIPFTVLVSFTLNILL

SEQ ID NO: 338654 - protein, 18 aa, Mycobacterium
FASVNGWWYVSNFGVPWS

SEQ ID NO: 338655 - protein, 19 aa, Mycobacterium
RKLRVGFAKAGRLMDLMET

SEQ ID NO: 338656 - protein, 18 aa, Mycobacterium
VLVILRLLYGIGMGGEWG

SEQ ID NO: 338657 - protein, 19 aa, Mycobacterium
AGATAAWAIGRWTPGTERR

SEQ ID NO: 338658 - protein, 21 aa, Mycobacterium
ALTEVSWRLAFLVNVPIGLVM

SEQ ID NO: 338659 - protein, 17 aa, Mycobacterium
AVFCVLGVLPLIVLTQL

SEQ ID NO: 338660 - protein, 18 aa, Mycobacterium
AVGGEWGGAVLLVAEHSP

SEQ ID NO: 338661 - protein, 18 aa, Mycobacterium
AVVAREFGFPCVVDVQGA

SEQ ID NO: 338662 - protein, 18 aa, Mycobacterium
EAWYAFATAVPWARQRTA

SEQ ID NO: 338663 - protein, 17 aa, Mycobacterium
FTVLVSFTLNILLRELG

SEQ ID NO: 338664 - protein, 19 aa, Mycobacterium
FWIRRARRLLPALVLMVLT

SEQ ID NO: 338665 - protein, 19 aa, Mycobacterium
GGPLPRGRGLLMAEDTGVF

SEQ ID NO: 338666 - protein, 17 aa, Mycobacterium
GLGCGFGPLNNRFFPPM

SEQ ID NO: 338667 - protein, 20 aa, Mycobacterium
GLRTRSEMIAQLVFAMGGRA

SEQ ID NO: 338668 - protein, 18 aa, Mycobacterium
GSSFKVFALVAALEQGIG

SEQ ID NO: 338669 - protein, 18 aa, Mycobacterium
GVPLEWNVFFIFSLFYLF

SEQ ID NO: 338670 - protein, 18 aa, Mycobacterium
GVSVIRRLVVPRFAAAIM

SEQ ID NO: 338671 - protein, 20 aa, Mycobacterium
HALEGYAMGRARRAIEALAE

SEQ ID NO: 338672 - protein, 19 aa, Mycobacterium
HLFWFFGHPEVYIIALPFF

SEQ ID NO: 338673 - protein, 21 aa, Mycobacterium
IAVVVLLGWSFFYFSDDTRGY

SEQ ID NO: 338674 - protein, 17 aa, Mycobacterium
ISLNFAMFRSAFEQGAQ

SEQ ID NO: 338675 - protein, 18 aa, Mycobacterium
ISLNFAMFRSAFEQGAQL

SEQ ID NO: 338676 - protein, 24 aa, Mycobacterium
NGLRPEPIIALGILLTWCSVERAV

SEQ ID NO: 338677 - protein, 18 aa, Mycobacterium
NVFKSWRYGEVVTVDDPW

SEQ ID NO: 338678 - protein, 17 aa, Mycobacterium
QCFPGSFTPVAVAEVPR

SEQ ID NO: 338679 - protein, 17 aa, Mycobacterium
RGGLFVRQIHHWAALMF

SEQ ID NO: 338680 - protein, 24 aa, Mycobacterium
RLLRLPRGWPWSDLIETGWTALQT

SEQ ID NO: 338681 - protein, 20 aa, Mycobacterium
RLLYGIGMGGEWGLGAALAM

SEQ ID NO: 338682 - protein, 18 aa, Mycobacterium
RYGGYALAGVSSFGFGGA

SEQ ID NO: 338683 - protein, 24 aa, Mycobacterium
SIATLLGRWFWWPQVVHPRGDNAR

SEQ ID NO: 338684 - protein, 19 aa, Mycobacterium
VVVALLFRTLDAFRIFDNI

SEQ ID NO: 338685 - protein, 18 aa, Mycobacterium
VYVLPLLLLVGLFVMFSR

SEQ ID NO: 338686 - protein, 17 aa, Mycobacterium
WEIRDFRTARKAARIGV

SEQ ID NO: 338687 - protein, 17 aa, Mycobacterium
YNMPLELVLTVTPFLII

SEQ ID NO: 338688 - protein, 18 aa, Mycobacterium
AAGVFKVYGLLFAAVTVL

SEQ ID NO: 338689 - protein, 19 aa, Mycobacterium
AARLLTWRASWMAANNVPF

SEQ ID NO: 338690 - protein, 20 aa, Mycobacterium
AASVLPVWLLLAPRDYLSTF

SEQ ID NO: 338691 - protein, 18 aa, Mycobacterium
AATIARRLGLTGALGTVA

SEQ ID NO: 338692 - protein, 24 aa, Mycobacterium
ACGLAALCYAEFASTVPVAGSAYT

SEQ ID NO: 338693 - protein, 20 aa, Mycobacterium
ADFWRFWVVHLWVEDFLELF

SEQ ID NO: 338694 - protein, 17 aa, Mycobacterium
ADRLIVIYADFKGEAGA

SEQ ID NO: 338695 - protein, 24 aa, Mycobacterium
AFGGPGAMFWMWAVAFLGASTSFV

SEQ ID NO: 338696 - protein, 24 aa, Mycobacterium
AGIFVCLFCAFYFMTVTYSLMTFW

SEQ ID NO: 338697 - protein, 24 aa, Mycobacterium
AGPRLIDAYVDWLWFGELGYRSVF

SEQ ID NO: 338698 - protein, 17 aa, Mycobacterium
ALADWFAVTALFRHPLG

SEQ ID NO: 338699 - protein, 17 aa, Mycobacterium
ALELTWEALEHARIPAS

SEQ ID NO: 338700 - protein, 23 aa, Mycobacterium
ALTGVVCFAGFFASYMFNVYFQN

SEQ ID NO: 338701 - protein, 19 aa, Mycobacterium
AMATLRIAFLSALVLELLA

SEQ ID NO: 338702 - protein, 18 aa, Mycobacterium
AMVFAKLSVFAALGPACA

SEQ ID NO: 338703 - protein, 21 aa, Mycobacterium
ARRFSGLALWCFAAMAVSGIV

SEQ ID NO: 338704 - protein, 19 aa, Mycobacterium
ARSLLGLAVGWFVGALVVL

SEQ ID NO: 338705 - protein, 23 aa, Mycobacterium
ARVFVEWRFDLIFGTAAFVIAGI

SEQ ID NO: 338706 - protein, 24 aa, Mycobacterium
AVPEVLRLIFASAFGLDSAFGAII

SEQ ID NO: 338707 - protein, 19 aa, Mycobacterium
CAPLAIAVLWRWILAPTDG

SEQ ID NO: 338708 - protein, 19 aa, Mycobacterium
CFISAAAVAARFGAAALAA

SEQ ID NO: 338709 - protein, 17 aa, Mycobacterium
CGTCSRAGVTASPSRST

SEQ ID NO: 338710 - protein, 17 aa, Mycobacterium
CIEATVLAVGWLMGGTV

SEQ ID NO: 338711 - protein, 21 aa, Mycobacterium
CLSFTRLPWFNTMGAPVAIGM

SEQ ID NO: 338712 - protein, 17 aa, Mycobacterium
CLVKEIQKLSGLSINRF

SEQ ID NO: 338713 - protein, 21 aa, Mycobacterium
CVKAEMLAASSWRVAVNAGSE

SEQ ID NO: 338714 - protein, 21 aa, Mycobacterium
DAEPAAWLRFWFPDPDGSKTE

SEQ ID NO: 338715 - protein, 23 aa, Mycobacterium
DALELRGRILGAFEQAERSSDPV

SEQ ID NO: 338716 - protein, 20 aa, Mycobacterium
DARLRFVLCDAGPVVVVTTA

SEQ ID NO: 338717 - protein, 17 aa, Mycobacterium
EAMLFGEYIRLMALVEY

SEQ ID NO: 338718 - protein, 25 aa, Mycobacterium
EATWKYVVICSVGIAVAFLGTVLLY

SEQ ID NO: 338719 - protein, 19 aa, Mycobacterium
EKRPRLTMFDDFGGRIPSD

SEQ ID NO: 338720 - protein, 19 aa, Mycobacterium
ELAARFGFLLAIPAVFASG

SEQ ID NO: 338721 - protein, 18 aa, Mycobacterium
EPVRRRWLTWSRYTRTWE

SEQ ID NO: 338722 - protein, 18 aa, Mycobacterium
EPVRRRWLTWSRYTRTWQ

SEQ ID NO: 338723 - protein, 19 aa, Mycobacterium
EQIMPLFVVTVMAQLVLCG

SEQ ID NO: 338724 - protein, 17 aa, Mycobacterium
ERFGRGWGWFSVGDLFL

SEQ ID NO: 338725 - protein, 23 aa, Mycobacterium
ERSRQGWKIQRWRSRVRNHTIVI

SEQ ID NO: 338726 - protein, 18 aa, Mycobacterium
FASLRIASYALWPFGRTI

SEQ ID NO: 338727 - protein, 19 aa, Mycobacterium
FDQLWRWNSIVALVLSVLV

SEQ ID NO: 338728 - protein, 17 aa, Mycobacterium
FFTMWGFFILLTVYIEA

SEQ ID NO: 338729 - protein, 20 aa, Mycobacterium
FGNDHFAEWAPGMKSIDDAL

SEQ ID NO: 338730 - protein, 21 aa, Mycobacterium
FGTGMAPFFLTLALFFGALVL

SEQ ID NO: 338731 - protein, 19 aa, Mycobacterium
FKGGSTFLGMEKLPHTAAV

SEQ ID NO: 338732 - protein, 20 aa, Mycobacterium
FKLAIIAAGIDFRRRMSELA

SEQ ID NO: 338733 - protein, 19 aa, Mycobacterium
FLLIMGGFMYFASRRQKRA

SEQ ID NO: 338734 - protein, 17 aa, Mycobacterium
FMVELPPDFSAAIASPV

SEQ ID NO: 338735 - protein, 18 aa, Mycobacterium
FPGELGVLFKNLETKGNP

SEQ ID NO: 338736 - protein, 18 aa, Mycobacterium
FRVPELLAGSFLLALLAV

SEQ ID NO: 338737 - protein, 18 aa, Mycobacterium
FTALRIAFLAVLVGTTLE

SEQ ID NO: 338738 - protein, 18 aa, Mycobacterium
FTVLVSFTLNILLRELGA

SEQ ID NO: 338739 - protein, 23 aa, Mycobacterium
FVVGRLAARHGIRVGLRGPSTGE

SEQ ID NO: 338740 - protein, 17 aa, Mycobacterium
GALYLWAFWDPFGHTNK

SEQ ID NO: 338741 - protein, 18 aa, Mycobacterium
GANFTAAMAFEIGSTNLV

SEQ ID NO: 338742 - protein, 19 aa, Mycobacterium
GANTGWWPVLWFTAKMWTF

SEQ ID NO: 338743 - protein, 17 aa, Mycobacterium
GGWRVIRTLGKGLVEIE

SEQ ID NO: 338744 - protein, 21 aa, Mycobacterium
GLFDTWPGLILPYITFALPLA

SEQ ID NO: 338745 - protein, 18 aa, Mycobacterium
GPGQRVALLLSRSVEAVV

SEQ ID NO: 338746 - protein, 17 aa, Mycobacterium
GPLPPRRAIEIIADACQ

SEQ ID NO: 338747 - protein, 24 aa, Mycobacterium
GQGAWLKRIIPVAALGGVAGAALL

SEQ ID NO: 338748 - protein, 17 aa, Mycobacterium
GQGWAQCHSLAFDFSVW

SEQ ID NO: 338749 - protein, 24 aa, Mycobacterium
GRFGEKRAPLALGVAALLFGFPIF

SEQ ID NO: 338750 - protein, 19 aa, Mycobacterium
GRWALCLVDGSPLRATQSL

SEQ ID NO: 338751 - protein, 18 aa, Mycobacterium
GTFNRYWLAAAFGVTALV

SEQ ID NO: 338752 - protein, 19 aa, Mycobacterium
GWEIRDFRTARKAARIGVP

SEQ ID NO: 338753 - protein, 21 aa, Mycobacterium
HEGGHTLAAWAMPDIDPVYKV

SEQ ID NO: 338754 - protein, 19 aa, Mycobacterium
HFGNAVLLLAIWIGIGFIF

SEQ ID NO: 338755 - protein, 18 aa, Mycobacterium
HLFWFFGHPEVYIVALPF

SEQ ID NO: 338756 - protein, 23 aa, Mycobacterium
IAAPRAKLFAALFLILALVVIGE

SEQ ID NO: 338757 - protein, 19 aa, Mycobacterium
IAERLRPGGVIQREIAMRT

SEQ ID NO: 338758 - protein, 17 aa, Mycobacterium
IAFGLSMDYEVFLISRI

SEQ ID NO: 338759 - protein, 17 aa, Mycobacterium
IAFGLSMDYEVFLLSRI

SEQ ID NO: 338760 - protein, 22 aa, Mycobacterium
IATACPFCRVMVTDGVNDRQEE

SEQ ID NO: 338761 - protein, 20 aa, Mycobacterium
IAVFCGFAFAGMPLVAEIGV

SEQ ID NO: 338762 - protein, 17 aa, Mycobacterium
IFLMLSVAGLAAYSMAP

SEQ ID NO: 338763 - protein, 21 aa, Mycobacterium
IGRIKDLLIVYGRNHSPDDIE

SEQ ID NO: 338764 - protein, 18 aa, Mycobacterium
IKASARFGLYYTPSSALY

SEQ ID NO: 338765 - protein, 22 aa, Mycobacterium
IKTPQFWLLWIVLCFNVTAGIG

SEQ ID NO: 338766 - protein, 17 aa, Mycobacterium
IMIAVFCGFAFAGMPLV

SEQ ID NO: 338767 - protein, 18 aa, Mycobacterium
IPEARRVLSMLLGQKNLE

SEQ ID NO: 338768 - protein, 19 aa, Mycobacterium
IPGLAHFFTMWGFFILLTV

SEQ ID NO: 338769 - protein, 19 aa, Mycobacterium
KDSFPASFIVKLENPEQHK

SEQ ID NO: 338770 - protein, 18 aa, Mycobacterium
KGDTFTCEVSIDGTKRQV

SEQ ID NO: 338771 - protein, 18 aa, Mycobacterium
KGGSTFLGMEKLPHTAAV

SEQ ID NO: 338772 - protein, 23 aa, Mycobacterium
KGLMTRSEMIARLVFAMGGRAAE

SEQ ID NO: 338773 - protein, 18 aa, Mycobacterium
KMNMPWLFFFSGLAIPAF

SEQ ID NO: 338774 - protein, 19 aa, Mycobacterium
KVGPTIAWYQDFLRYYFLT

SEQ ID NO: 338775 - protein, 20 aa, Mycobacterium
KVSLLLSVALFFVWMIAVAF

SEQ ID NO: 338776 - protein, 20 aa, Mycobacterium
LAARGWVCVSIGYRVSPRHT

SEQ ID NO: 338777 - protein, 19 aa, Mycobacterium
LAATIARRLGLTGALGTVA

SEQ ID NO: 338778 - protein, 17 aa, Mycobacterium
LAICVLAGYLARIPDCK

SEQ ID NO: 338779 - protein, 19 aa, Mycobacterium
LASGRAMRALGWLRRNTRR

SEQ ID NO: 338780 - protein, 25 aa, Mycobacterium
LEDIVRFQAEFLWRDYFPRGLTDDG

SEQ ID NO: 338781 - protein, 23 aa, Mycobacterium
LFGVELWERFSFYGMLTILGYYL

SEQ ID NO: 338782 - protein, 23 aa, Mycobacterium
LFKAAGYLLWWAVLFPAISIPII

SEQ ID NO: 338783 - protein, 18 aa, Mycobacterium
LGDILGFGGMSEVHLARD

SEQ ID NO: 338784 - protein, 17 aa, Mycobacterium
LGEILGFGGMSEVHLAR

SEQ ID NO: 338785 - protein, 18 aa, Mycobacterium
LGGWRIIRTLGKGLVEIQ

SEQ ID NO: 338786 - protein, 20 aa, Mycobacterium
LGKEIAWPVPLLAFIILVAV

SEQ ID NO: 338787 - protein, 22 aa, Mycobacterium
LGLMMCFDLGGPVNKAAYAFAT

SEQ ID NO: 338788 - protein, 25 aa, Mycobacterium
LGVVVGGPFLPLAIILYWFSNNIWT

SEQ ID NO: 338789 - protein, 17 aa, Mycobacterium
LKFFNWIGTMWRGQLTF

SEQ ID NO: 338790 - protein, 17 aa, Mycobacterium
LKIPFGHELKTGNVMYL

SEQ ID NO: 338791 - protein, 17 aa, Mycobacterium
LLAFRLTCYYYRKAYYR

SEQ ID NO: 338792 - protein, 20 aa, Mycobacterium
LLLFRLTCYYYRGAYYRTVW

SEQ ID NO: 338793 - protein, 17 aa, Mycobacterium
LLQGFAVGGEWAGSALL

SEQ ID NO: 338794 - protein, 17 aa, Mycobacterium
LLTTVIFAIRWRRDEES

SEQ ID NO: 338795 - protein, 19 aa, Mycobacterium
LLVAIPFTVLVSFTLNILL

SEQ ID NO: 338796 - protein, 18 aa, Mycobacterium
LMFFAGLFAMYFTARAQA

SEQ ID NO: 338797 - protein, 18 aa, Mycobacterium
LMGLGWPVVVLVSIVVAR

SEQ ID NO: 338798 - protein, 17 aa, Mycobacterium
LPFLWNIFKSWRYGEVV

SEQ ID NO: 338799 - protein, 18 aa, Mycobacterium
LPIVLVWLGIVFVTNTVA

SEQ ID NO: 338800 - protein, 23 aa, Mycobacterium
LPLAHWEFYMALAYFKLAIIAAG

SEQ ID NO: 338801 - protein, 21 aa, Mycobacterium
LPLLLLVGLFVMFSRMQGGAR

SEQ ID NO: 338802 - protein, 17 aa, Mycobacterium
LPPLAYFFLLVIWLGID

SEQ ID NO: 338803 - protein, 21 aa, Mycobacterium
LPVTWEMSFLYAVVFGGFVAF

SEQ ID NO: 338804 - protein, 20 aa, Mycobacterium
LQHGFKLVKWIKGIEFVADY

SEQ ID NO: 338805 - protein, 20 aa, Mycobacterium
LQMAFRFWAFRRFVFPDEFA

SEQ ID NO: 338806 - protein, 21 aa, Mycobacterium
LQMAFRFWAFRRWVFPDEFAR

SEQ ID NO: 338807 - protein, 17 aa, Mycobacterium
LRLCQTYGWSPGVMGAS

SEQ ID NO: 338808 - protein, 17 aa, Mycobacterium
LRPGGVIQREIAMRTVA

SEQ ID NO: 338809 - protein, 18 aa, Mycobacterium
LRRDRTSFIIAHRLSTIR

SEQ ID NO: 338810 - protein, 18 aa, Mycobacterium
LRSGWYRLPARDKAGPLL

SEQ ID NO: 338811 - protein, 19 aa, Mycobacterium
LRWALIFSAGCVFWAAVTA

SEQ ID NO: 338812 - protein, 18 aa, Mycobacterium
LRWRVMLLAMSMVAMVVV

SEQ ID NO: 338813 - protein, 17 aa, Mycobacterium
LRYDQFMGLGWKLLIPA

SEQ ID NO: 338814 - protein, 17 aa, Mycobacterium
LSRGDWRLRIHGMVDRE

SEQ ID NO: 338815 - protein, 21 aa, Mycobacterium
LSVGAAYSWSVFKKPLEGALG

SEQ ID NO: 338816 - protein, 17 aa, Mycobacterium
LSYFKALGIPSALGLLV

SEQ ID NO: 338817 - protein, 17 aa, Mycobacterium
LTIAVAFIGMWASLVDL

SEQ ID NO: 338818 - protein, 18 aa, Mycobacterium
LTKMTAMPQLVAFFNGVG

SEQ ID NO: 338819 - protein, 19 aa, Mycobacterium
LVAEIGVACAVAIAVDATI

SEQ ID NO: 338820 - protein, 19 aa, Mycobacterium
LVAEIGVACAVAIAVDATV

SEQ ID NO: 338821 - protein, 18 aa, Mycobacterium
LVAIPFTVLVAFTLNILL

SEQ ID NO: 338822 - protein, 18 aa, Mycobacterium
MALELTWEALEHARIPAS

SEQ ID NO: 338823 - protein, 17 aa, Mycobacterium
MALSFASVNGWWYVSNF

SEQ ID NO: 338824 - protein, 24 aa, Mycobacterium
MFAAMCCFCGGWLVGAAGLALGQY

SEQ ID NO: 338825 - protein, 18 aa, Mycobacterium
MQGGCRFTAQLGSMRIAE

SEQ ID NO: 338826 - protein, 20 aa, Mycobacterium
MVLFPMYFLKSFAYAGIAVV

SEQ ID NO: 338827 - protein, 21 aa, Mycobacterium
NAGPPRLWVWIALTVLACGVL

SEQ ID NO: 338828 - protein, 20 aa, Mycobacterium
PADRLIVIYADFKGEAGADI

SEQ ID NO: 338829 - protein, 23 aa, Mycobacterium
PAEPAHPRWWFVSTTPGRILTIG

SEQ ID NO: 338830 - protein, 21 aa, Mycobacterium
PDPNLRPAIVGVFTDLTGPAP

SEQ ID NO: 338831 - protein, 20 aa, Mycobacterium
PEGMAAWIIGMVAAIGLALW

SEQ ID NO: 338832 - protein, 22 aa, Mycobacterium
PEVVQWKLKPGVVSTMNAQARY

SEQ ID NO: 338833 - protein, 19 aa, Mycobacterium
PGEKNMPFWGTSFSAAYVS

SEQ ID NO: 338834 - protein, 23 aa, Mycobacterium
PGVILRLMLAWVLSTAVPLLAIV

SEQ ID NO: 338835 - protein, 22 aa, Mycobacterium
PHLDAGPFLSYGIQWIAFGIIA

SEQ ID NO: 338836 - protein, 20 aa, Mycobacterium
PLLLLVGLFVMFSRMQGGAR

SEQ ID NO: 338837 - protein, 17 aa, Mycobacterium
PNFGTGMAPFFLTLALF

SEQ ID NO: 338838 - protein, 17 aa, Mycobacterium
PNLRRWLSTEVRPKLKE

SEQ ID NO: 338839 - protein, 19 aa, Mycobacterium
PQHVRPRPASTMLRPYGPR

SEQ ID NO: 338840 - protein, 18 aa, Mycobacterium
PRDLAPLLAAWVISVGVM

SEQ ID NO: 338841 - protein, 24 aa, Mycobacterium
PRVIPPSFLRRAMPYVLVILIVGM

SEQ ID NO: 338842 - protein, 19 aa, Mycobacterium
PTAPRWVGVPLYLLLGWVA

SEQ ID NO: 338843 - protein, 23 aa, Mycobacterium
PVFLDWLVGLAFPCQRPFGHQNG

SEQ ID NO: 338844 - protein, 21 aa, Mycobacterium
PVLLFCIAFGLSMDYEVFLVS

SEQ ID NO: 338845 - protein, 23 aa, Mycobacterium
PWLPARWRRWWWALLLAFVPIHL

SEQ ID NO: 338846 - protein, 22 aa, Mycobacterium
QDRLPIEIAIAVLVLGVLLLVY

SEQ ID NO: 338847 - protein, 21 aa, Mycobacterium
QHTKWGVGIALLFVTLPFVVR

SEQ ID NO: 338848 - protein, 17 aa, Mycobacterium
QLIAFGILTVISLLVLG

SEQ ID NO: 338849 - protein, 19 aa, Mycobacterium
QPVLLDWAVGLAFPCQQPM

SEQ ID NO: 338850 - protein, 17 aa, Mycobacterium
QRVALLLSRSVEAVVAI

SEQ ID NO: 338851 - protein, 17 aa, Mycobacterium
RAAVKFLLYNLFGGLIM

SEQ ID NO: 338852 - protein, 17 aa, Mycobacterium
RGGLFVRQVHHWAALIF

SEQ ID NO: 338853 - protein, 17 aa, Mycobacterium
RKRVVAVSFPRDLAITP

SEQ ID NO: 338854 - protein, 17 aa, Mycobacterium
RLDNARFLLPVVGVPPD

SEQ ID NO: 338855 - protein, 22 aa, Mycobacterium
RLIFERFGKFWGAFSVGDLLIL

SEQ ID NO: 338856 - protein, 18 aa, Mycobacterium
RLRYDQFMALGWKLLIPV

SEQ ID NO: 338857 - protein, 19 aa, Mycobacterium
RLYLDGGLQFSTRDEYRYT

SEQ ID NO: 338858 - protein, 19 aa, Mycobacterium
RPASTMLRPYGPRPAVREL

SEQ ID NO: 338859 - protein, 20 aa, Mycobacterium
RRFGGSLLLYAFPAAGAFAA

SEQ ID NO: 338860 - protein, 21 aa, Mycobacterium
RRLDEAAGFAIPFVPRGLDEI

SEQ ID NO: 338861 - protein, 17 aa, Mycobacterium
RRLRLLLSVAAIVLALD

SEQ ID NO: 338862 - protein, 17 aa, Mycobacterium
RRWRLRILPALVAAAAV

SEQ ID NO: 338863 - protein, 31 aa, Mycobacterium
RSYFYWEPHCFDIPVCWSLRSIFDAIDGVDL

SEQ ID NO: 338864 - protein, 22 aa, Mycobacterium
RVGTAIVRWPGPILAVSIAIAL

SEQ ID NO: 338865 - protein, 19 aa, Mycobacterium
RVSYFYDFRGPSVAVDTAC

SEQ ID NO: 338866 - protein, 19 aa, Mycobacterium
RWRHVPTILLATSLVLLTT

SEQ ID NO: 338867 - protein, 25 aa, Mycobacterium
SALRLKGRLLFMPGVMVTSVPWQLT

SEQ ID NO: 338868 - protein, 19 aa, Mycobacterium
SAVSSRAGVEIAIDDNGSG

SEQ ID NO: 338869 - protein, 24 aa, Mycobacterium
SFVIGRPLIWLSFRNEKLNAAFRY

SEQ ID NO: 338870 - protein, 18 aa, Mycobacterium
SGFSRFPIVDGDLDETVG

SEQ ID NO: 338871 - protein, 19 aa, Mycobacterium
SGMDLGPWLVSRDITVVST

SEQ ID NO: 338872 - protein, 24 aa, Mycobacterium
SLATLLGRWFWWPQHVRPRPASTM

SEQ ID NO: 338873 - protein, 18 aa, Mycobacterium
SPYSSWLVVRWVVASALG

SEQ ID NO: 338874 - protein, 18 aa, Mycobacterium
SRLRRPGAVVLEIDDEDP

SEQ ID NO: 338875 - protein, 20 aa, Mycobacterium
SVGWLYWYFWVIVVGFEAIA

SEQ ID NO: 338876 - protein, 19 aa, Mycobacterium
TAFRVPFLRNWKVSRAYLN

SEQ ID NO: 338877 - protein, 20 aa, Mycobacterium
TATRRFLVDAAHELRTPIAG

SEQ ID NO: 338878 - protein, 24 aa, Mycobacterium
TCALAALCYAEFASTLPVAGSAYT

SEQ ID NO: 338879 - protein, 23 aa, Mycobacterium
TDGLIRLWPAWEFYPFGHTIPQG

SEQ ID NO: 338880 - protein, 17 aa, Mycobacterium
TDWPRYGGYALAGVSSF

SEQ ID NO: 338881 - protein, 21 aa, Mycobacterium
TKLNSAFAFGGPKCLVKVIQK

SEQ ID NO: 338882 - protein, 17 aa, Mycobacterium
TLTKGWQRLLGTLLGVP

SEQ ID NO: 338883 - protein, 19 aa, Mycobacterium
TRATLHFLWLRLARVWPVY

SEQ ID NO: 338884 - protein, 19 aa, Mycobacterium
TVVRMFLVPSVMKLLGDDC

SEQ ID NO: 338885 - protein, 17 aa, Mycobacterium
VACAVAIAVDATVVRLV

SEQ ID NO: 338886 - protein, 17 aa, Mycobacterium
VALLLSRSVEAVVAIMG

SEQ ID NO: 338887 - protein, 17 aa, Mycobacterium
VALSFASVNGWWYVSNF

SEQ ID NO: 338888 - protein, 18 aa, Mycobacterium
VANALRLLGMPMQSVTPA

SEQ ID NO: 338889 - protein, 18 aa, Mycobacterium
VIFAIRWRRDEESESKKR

SEQ ID NO: 338890 - protein, 18 aa, Mycobacterium
VKRALAWVKAHIAEYGGD

SEQ ID NO: 338891 - protein, 17 aa, Mycobacterium
VLGVLPLIVLTQLGIIV

SEQ ID NO: 338892 - protein, 19 aa, Mycobacterium
VLLFCIAFGLSMDYEVFLL

SEQ ID NO: 338893 - protein, 20 aa, Mycobacterium
VLLFCIAFGLSMDYEVFLLS

SEQ ID NO: 338894 - protein, 20 aa, Mycobacterium
VLLFCIAFGLSMDYEVFLVA

SEQ ID NO: 338895 - protein, 17 aa, Mycobacterium
VLRRKFKPPLVLQDIEK

SEQ ID NO: 338896 - protein, 20 aa, Mycobacterium
VMALTCWWVISREVMPRLGH

SEQ ID NO: 338897 - protein, 19 aa, Mycobacterium
VSIPSLWQPYVLSVASLTP

SEQ ID NO: 338898 - protein, 17 aa, Mycobacterium
VYTTRWWLSGLLVGVAA

SEQ ID NO: 338899 - protein, 18 aa, Mycobacterium
WAVMFLVAVGFWNFLGAG

SEQ ID NO: 338900 - protein, 25 aa, Mycobacterium
WGNCTIKVMVGFLFLYPAFVAKAHD

SEQ ID NO: 338901 - protein, 17 aa, Mycobacterium
WHWDRWAPASPWATPPP

SEQ ID NO: 338902 - protein, 17 aa, Mycobacterium
WKCTLCYDRLHDGLEPA

SEQ ID NO: 338903 - protein, 19 aa, Mycobacterium
WNIFKSWRYGEVVTVDDPW

SEQ ID NO: 338904 - protein, 24 aa, Mycobacterium
WRITLPSIRWGLTYGIVLTVARTL

SEQ ID NO: 338905 - protein, 17 aa, Mycobacterium
WRPVLLVPLTFALFTPL

SEQ ID NO: 338906 - protein, 20 aa, Mycobacterium
WRSGALGSLLSFVGVLLGAI

SEQ ID NO: 338907 - protein, 18 aa, Mycobacterium
WSTLKVSLLLSVALFFVW

SEQ ID NO: 338908 - protein, 18 aa, Mycobacterium
WVLITWLLVRWARTRDDR

SEQ ID NO: 338909 - protein, 22 aa, Mycobacterium
YCLSFARLPWFNTMGAPVAIGM

SEQ ID NO: 338910 - protein, 23 aa, Mycobacterium
YGGLRAALPITFATFGLGYLAII

SEQ ID NO: 338911 - protein, 24 aa, Mycobacterium
YHEGGHTLAAWAMPDIEPIYKVTI

SEQ ID NO: 338912 - protein, 27 aa, Mycobacterium
YKVGPTIAWYQDWLRYYFLTVESNPDG

SEQ ID NO: 338913 - protein, 21 aa, Mycobacterium
YMAETNLRFLLGKSATIPVPI

SEQ ID NO: 338914 - protein, 19 aa, Mycobacterium
YTLKAELPASGGLYPTANV

SEQ ID NO: 338915 - protein, 27 aa, Mycobacterium
YTRWRRLATAIVRWPAPILATSVILAI

SEQ ID NO: 338916 - protein, 17 aa, Mycobacterium
AAAALFAMGLWRLVETA

SEQ ID NO: 338917 - protein, 24 aa, Mycobacterium
AAAFIWQMLQWFGAGYVAHTVKRA

SEQ ID NO: 338918 - protein, 17 aa, Mycobacterium
AAAFPFYGPTPEAPDFA

SEQ ID NO: 338919 - protein, 19 aa, Mycobacterium
AAAGWRILARRSVSGSSST

SEQ ID NO: 338920 - protein, 26 aa, Mycobacterium
AAAILIRWKLSIAFLPNVGIAAAAAI

SEQ ID NO: 338921 - protein, 17 aa, Mycobacterium
AAAKLRVTWEMSFLYAI

SEQ ID NO: 338922 - protein, 18 aa, Mycobacterium
AAALCFLILMLAMFPANI

SEQ ID NO: 338923 - protein, 28 aa, Mycobacterium
AAALLVWRLRWASAGGWLAPTIFGVTAL

SEQ ID NO: 338924 - protein, 18 aa, Mycobacterium
AAAPRPPLGPVWVALLII

SEQ ID NO: 338925 - protein, 17 aa, Mycobacterium
AAARFRPRLDILAAAGV

SEQ ID NO: 338926 - protein, 17 aa, Mycobacterium
AAARFTRRPRIRSAVRQ

SEQ ID NO: 338927 - protein, 24 aa, Mycobacterium
AAAVGEVGIGWGLITLAVVSGLQA

SEQ ID NO: 338928 - protein, 18 aa, Mycobacterium
AAAVNNFILLFIGNGTAT

SEQ ID NO: 338929 - protein, 17 aa, Mycobacterium
AAAVSRTAGFAFRHRTG

SEQ ID NO: 338930 - protein, 17 aa, Mycobacterium
AACATVYLTGSRRRGTW

SEQ ID NO: 338931 - protein, 17 aa, Mycobacterium
AADGSVHRAEWALTEAM

SEQ ID NO: 338932 - protein, 18 aa, Mycobacterium
AADYRSAQVIKLVSNHAP

SEQ ID NO: 338933 - protein, 22 aa, Mycobacterium
AAELPIIIVILIQIILVLLEIL

SEQ ID NO: 338934 - protein, 17 aa, Mycobacterium
AAETMAGPVAPRPGGTG

SEQ ID NO: 338935 - protein, 18 aa, Mycobacterium
AAEYSWFIGCGVALVVYY

SEQ ID NO: 338936 - protein, 18 aa, Mycobacterium
AAFEAAWGAARLDSPTLR

SEQ ID NO: 338937 - protein, 18 aa, Mycobacterium
AAFELAAFAAFGSAASAT

SEQ ID NO: 338938 - protein, 17 aa, Mycobacterium
AAFLWGLSISPVLLSLI

SEQ ID NO: 338939 - protein, 25 aa, Mycobacterium
AAFLYRRWNLPVAVLAGAAAGVALA

SEQ ID NO: 338940 - protein, 20 aa, Mycobacterium
AAFMSWGWRIAFWLSAVVVL

SEQ ID NO: 338941 - protein, 17 aa, Mycobacterium
AAFMVVCTLGLAAMLAI

SEQ ID NO: 338942 - protein, 24 aa, Mycobacterium
AAFPRYHPRWAWWLTTVPLLREFL

SEQ ID NO: 338943 - protein, 20 aa, Mycobacterium
AAGFFMLWYYGFLWYHFVVM

SEQ ID NO: 338944 - protein, 19 aa, Mycobacterium
AAGGIAWLLGERGMADGCW

SEQ ID NO: 338945 - protein, 25 aa, Mycobacterium
AAGIGAAMACIWGPLATTATRNLPP

SEQ ID NO: 338946 - protein, 17 aa, Mycobacterium
AAGLAWYLTHDVLHHRQ

SEQ ID NO: 338947 - protein, 17 aa, Mycobacterium
AAGVLYPLLGLRLSPMI

SEQ ID NO: 338948 - protein, 20 aa, Mycobacterium
AAGWMPWIWVMIVAGVGFLA

SEQ ID NO: 338949 - protein, 22 aa, Mycobacterium
AAGWWSFLSILLMNWIAIFGNM

SEQ ID NO: 338950 - protein, 22 aa, Mycobacterium
AAIAGQVGRLWGLTSALSTDER

SEQ ID NO: 338951 - protein, 17 aa, Mycobacterium
AAIAIVLASVATLAVVI

SEQ ID NO: 338952 - protein, 23 aa, Mycobacterium
AAICMAVPVLVGWSAGNTSAGLI

SEQ ID NO: 338953 - protein, 24 aa, Mycobacterium
AAIPGIMWQRWLFAWPAMLAALIV

SEQ ID NO: 338954 - protein, 17 aa, Mycobacterium
AAKDIPLVFGYDYQTVE

SEQ ID NO: 338955 - protein, 23 aa, Mycobacterium
AAKELFNIFLIIAIVTAMLGALR

SEQ ID NO: 338956 - protein, 18 aa, Mycobacterium
AAKRSSYLHWGRGVEATQ

SEQ ID NO: 338957 - protein, 25 aa, Mycobacterium
AAKWPEKWARLSFWCMNIGLAWMVF

SEQ ID NO: 338958 - protein, 24 aa, Mycobacterium
AALAFKVWTRWPLRAVTAAGVYLA

SEQ ID NO: 338959 - protein, 18 aa, Mycobacterium
AALIALWRLLARARQEND

SEQ ID NO: 338960 - protein, 23 aa, Mycobacterium
AALIRRLGLRSGVGAPIVVEGRL

SEQ ID NO: 338961 - protein, 17 aa, Mycobacterium
AALKDVYITAAFAAMFL

SEQ ID NO: 338962 - protein, 17 aa, Mycobacterium
AALLGGPDKLVWTRVAG

SEQ ID NO: 338963 - protein, 18 aa, Mycobacterium
AALLIKWTYGPASDAQTP

SEQ ID NO: 338964 - protein, 24 aa, Mycobacterium
AALLRPGRGPSVWYQPDRTSAQPV

SEQ ID NO: 338965 - protein, 18 aa, Mycobacterium
AALMGRWFWWPQRVRTRP

SEQ ID NO: 338966 - protein, 17 aa, Mycobacterium
AALPPFFGFVAKEADLE

SEQ ID NO: 338967 - protein, 22 aa, Mycobacterium
AALPWLRIAIFGAPAILVSLAG

SEQ ID NO: 338968 - protein, 19 aa, Mycobacterium
AALPWLRIAILGTPAILIS

SEQ ID NO: 338969 - protein, 19 aa, Mycobacterium
AALPWLRIAILGVPAILVS

SEQ ID NO: 338970 - protein, 20 aa, Mycobacterium
AALQRLGIRISLDDYGTGWS

SEQ ID NO: 338971 - protein, 21 aa, Mycobacterium
AALRAAVKIHRRVAERFGQEL

SEQ ID NO: 338972 - protein, 19 aa, Mycobacterium
AALRRGRLMVLAAILLFAL

SEQ ID NO: 338973 - protein, 17 aa, Mycobacterium
AALRWSLIAGARCNDAA

SEQ ID NO: 338974 - protein, 17 aa, Mycobacterium
AALSVREVPSWLRRVID

SEQ ID NO: 338975 - protein, 18 aa, Mycobacterium
AALTFALIWCARHLLQWV

SEQ ID NO: 338976 - protein, 21 aa, Mycobacterium
AALVARVRPPLAWAVPAVLAV

SEQ ID NO: 338977 - protein, 17 aa, Mycobacterium
AALVEEVFFVPALSEAS

SEQ ID NO: 338978 - protein, 24 aa, Mycobacterium
AALVRARFPEMTARQVMQRIEDTA

SEQ ID NO: 338979 - protein, 18 aa, Mycobacterium
AALWRLGDALALPGIPDS

SEQ ID NO: 338980 - protein, 18 aa, Mycobacterium
AAMGVAWLLDVPALIRKR

SEQ ID NO: 338981 - protein, 18 aa, Mycobacterium
AAMTGCFVSICGAVGFVG

SEQ ID NO: 338982 - protein, 24 aa, Mycobacterium
AAPARPGYRTALGARLGVPVEAIS

SEQ ID NO: 338983 - protein, 19 aa, Mycobacterium
AAPETFVALALPRSIDMVV

SEQ ID NO: 338984 - protein, 17 aa, Mycobacterium
AAPFVRPVAAWQLGKLR

SEQ ID NO: 338985 - protein, 24 aa, Mycobacterium
AAPLAGALCSIGWQRRLPTVTVTG

SEQ ID NO: 338986 - protein, 25 aa, Mycobacterium
AAPLLGVLCSISWQRRVPEIRVHGE

SEQ ID NO: 338987 - protein, 25 aa, Mycobacterium
AAPLLGVLCSIYWQRPVPAVQVHGE

SEQ ID NO: 338988 - protein, 21 aa, Mycobacterium
AAPPRPGFRAALSARLGVAAE

SEQ ID NO: 338989 - protein, 24 aa, Mycobacterium
AAPPRPVPVPVLAPPVFVPPPRVP

SEQ ID NO: 338990 - protein, 23 aa, Mycobacterium
AAPPVAGGALAWSQDDDGVQDPL

SEQ ID NO: 338991 - protein, 17 aa, Mycobacterium
AAPRLRSYGGFAYRARW

SEQ ID NO: 338992 - protein, 24 aa, Mycobacterium
AAPRMSIALARLSPRFATTDFADP

SEQ ID NO: 338993 - protein, 19 aa, Mycobacterium
AAPTFEFFALYGTAAVYYW

SEQ ID NO: 338994 - protein, 20 aa, Mycobacterium
AAQMSALWARFPLPVIPAPG

SEQ ID NO: 338995 - protein, 17 aa, Mycobacterium
AAQRPGPRIAFRPDIEG

SEQ ID NO: 338996 - protein, 23 aa, Mycobacterium
AAQTEIFPLLTLSVGGMMVFPAA

SEQ ID NO: 338997 - protein, 23 aa, Mycobacterium
AAQTEIFPLLTLSVGGMMVFSAS

SEQ ID NO: 338998 - protein, 20 aa, Mycobacterium
AARKRIAWWVLVLYLVGAIG

SEQ ID NO: 338999 - protein, 18 aa, Mycobacterium
AARLEFMLGDAKPVAAVT

SEQ ID NO: 339000 - protein, 19 aa, Mycobacterium
AARLLTWRASWMAATGVPF

SEQ ID NO: 339001 - protein, 17 aa, Mycobacterium
AARPGNWSLFDGGYTFA

SEQ ID NO: 339002 - protein, 21 aa, Mycobacterium
AARRGLSFTLTWWSFTFPVGT

SEQ ID NO: 339003 - protein, 21 aa, Mycobacterium
AARYLTPWGRQFWRITRGYFV

SEQ ID NO: 339004 - protein, 22 aa, Mycobacterium
AASFRRRWLVLGTWLAVLLGVG

SEQ ID NO: 339005 - protein, 18 aa, Mycobacterium
AASIPIILIWVAIAAFLN

SEQ ID NO: 339006 - protein, 21 aa, Mycobacterium
AASRLPWVGIRSFDGLGPPRQ

SEQ ID NO: 339007 - protein, 21 aa, Mycobacterium
AASRLPWVVIRSFDGLGPPKE

SEQ ID NO: 339008 - protein, 21 aa, Mycobacterium
AASRLPWVVIRSFDGLGPPRE

SEQ ID NO: 339009 - protein, 19 aa, Mycobacterium
AASRRASVRLGIIDDHVVI

SEQ ID NO: 339010 - protein, 20 aa, Mycobacterium
AASVLPVWFLLAPRDYLSTF

SEQ ID NO: 339011 - protein, 23 aa, Mycobacterium
AASYRWGHHFGRLVEHPDSEQLL

SEQ ID NO: 339012 - protein, 19 aa, Mycobacterium
AATDLKRLLPYLIPYRTRW

SEQ ID NO: 339013 - protein, 19 aa, Mycobacterium
AATFLAPWLFSVFIDVFDS

SEQ ID NO: 339014 - protein, 20 aa, Mycobacterium
AATGACWCLGLAAWAVAAVS

SEQ ID NO: 339015 - protein, 19 aa, Mycobacterium
AATGARPPVAFAPGDDGYS

SEQ ID NO: 339016 - protein, 19 aa, Mycobacterium
AATGWVVLCGCALGFAFLT

SEQ ID NO: 339017 - protein, 18 aa, Mycobacterium
AATRAMLAAEAWNGRSTW

SEQ ID NO: 339018 - protein, 18 aa, Mycobacterium
AATRVWRSRVGRLRTSTV

SEQ ID NO: 339019 - protein, 19 aa, Mycobacterium
AATRWELASVFPWFAGIVS

SEQ ID NO: 339020 - protein, 19 aa, Mycobacterium
AATSVCLIGGWGLGSVLLG

SEQ ID NO: 339021 - protein, 20 aa, Mycobacterium
AATTGCRWLAVTALSVVMVV

SEQ ID NO: 339022 - protein, 23 aa, Mycobacterium
AAVAVFQLCWARLVLVRTTNPVL

SEQ ID NO: 339023 - protein, 20 aa, Mycobacterium
AAVGCLIAFLWVERTAENPV

SEQ ID NO: 339024 - protein, 26 aa, Mycobacterium
AAVGFCMGGGLVWRLLAAGTPQLAAA

SEQ ID NO: 339025 - protein, 19 aa, Mycobacterium
AAVGLTWWWWGYRRRGISY

SEQ ID NO: 339026 - protein, 17 aa, Mycobacterium
AAVGVMFGVVAVLTKIV

SEQ ID NO: 339027 - protein, 17 aa, Mycobacterium
AAVIVIGGWALSTESSP

SEQ ID NO: 339028 - protein, 19 aa, Mycobacterium
AAVLGRWFWWPLQVRSRPG

SEQ ID NO: 339029 - protein, 24 aa, Mycobacterium
AAVLLKASWHWVFVALVILAGLLL

SEQ ID NO: 339030 - protein, 18 aa, Mycobacterium
AAVPAYWGGHSIAALRAA

SEQ ID NO: 339031 - protein, 22 aa, Mycobacterium
AAVPPRHWRWPLGEIDKPFEMR

SEQ ID NO: 339032 - protein, 23 aa, Mycobacterium
AAVPRPPLGPVWVALLIIGASSG

SEQ ID NO: 339033 - protein, 19 aa, Mycobacterium
AAVPWLHRFGDLIAPLTFI

SEQ ID NO: 339034 - protein, 21 aa, Mycobacterium
AAVQAPWPLLRTFAAGPALSR

SEQ ID NO: 339035 - protein, 17 aa, Mycobacterium
AAVRSRGAVPLALTILA

SEQ ID NO: 339036 - protein, 17 aa, Mycobacterium
AAVSLVLLGGFAILGGI

SEQ ID NO: 339037 - protein, 17 aa, Mycobacterium
AAVSLVLLGGFSILGGI

SEQ ID NO: 339038 - protein, 25 aa, Mycobacterium
AAVTRPAGTFAWIWPSVIAAVAGAL

SEQ ID NO: 339039 - protein, 25 aa, Mycobacterium
AAVVAMAALASWFGFHAYQSHQADQ

SEQ ID NO: 339040 - protein, 19 aa, Mycobacterium
AAVVTWARYVRRPTSTAAS

SEQ ID NO: 339041 - protein, 18 aa, Mycobacterium
AAVVVCLIGAIPLLNAVF

SEQ ID NO: 339042 - protein, 18 aa, Mycobacterium
AAVWWKALLALVVAVALT

SEQ ID NO: 339043 - protein, 21 aa, Mycobacterium
AAVYVIFRWFFARDLVAEPNR

SEQ ID NO: 339044 - protein, 17 aa, Mycobacterium
AAWFLPMALVLAAASWL

SEQ ID NO: 339045 - protein, 18 aa, Mycobacterium
ACAAALVAEGRYDIRVSP

SEQ ID NO: 339046 - protein, 17 aa, Mycobacterium
ACAIAMLVTVAAALTLG

SEQ ID NO: 339047 - protein, 19 aa, Mycobacterium
ACAIAVLFGFLATVTLLPP

SEQ ID NO: 339048 - protein, 20 aa, Mycobacterium
ACASGCLLLALGAGVLWWIT

SEQ ID NO: 339049 - protein, 17 aa, Mycobacterium
ACAVFFPLWLVLQIVSG

SEQ ID NO: 339050 - protein, 20 aa, Mycobacterium
ACFISAGAVAARFGAASVAA

SEQ ID NO: 339051 - protein, 18 aa, Mycobacterium
ACGGLRMTHDLLHGDVAA

SEQ ID NO: 339052 - protein, 18 aa, Mycobacterium
ACKLWPLVFARLAATVVI

SEQ ID NO: 339053 - protein, 17 aa, Mycobacterium
ACLFWRLFMQDNRTPPE

SEQ ID NO: 339054 - protein, 21 aa, Mycobacterium
ACLIVPFILGLVWRRGTTTAA

SEQ ID NO: 339055 - protein, 19 aa, Mycobacterium
ACLLLAFAMVYAGFETNFA

SEQ ID NO: 339056 - protein, 17 aa, Mycobacterium
ACPFKWLTGWDCPACGG

SEQ ID NO: 339057 - protein, 18 aa, Mycobacterium
ACPPSLAAQVQFSDPWRD

SEQ ID NO: 339058 - protein, 22 aa, Mycobacterium
ACQSGDYSLCWSFTDGGIQPGI

SEQ ID NO: 339059 - protein, 23 aa, Mycobacterium
ACSSSLVAIHWAMASLRSGECDM

SEQ ID NO: 339060 - protein, 19 aa, Mycobacterium
ACTRLPYSLATTIFGGRNW

SEQ ID NO: 339061 - protein, 20 aa, Mycobacterium
ACVWYFRRTLFSSARNLFFR

SEQ ID NO: 339062 - protein, 23 aa, Mycobacterium
ADAGWRLPAFAAFMVTATETLAG

SEQ ID NO: 339063 - protein, 19 aa, Mycobacterium
ADAPPGWLPGWLRPVHSRR

SEQ ID NO: 339064 - protein, 18 aa, Mycobacterium
ADARRPTSASSRKKAPEP

SEQ ID NO: 339065 - protein, 18 aa, Mycobacterium
ADDVARSFADAGLDSVLS

SEQ ID NO: 339066 - protein, 18 aa, Mycobacterium
ADEFGWRGPFWKWIAGLD

SEQ ID NO: 339067 - protein, 22 aa, Mycobacterium
ADEGHHLVATRLCWSDQDRAED

SEQ ID NO: 339068 - protein, 24 aa, Mycobacterium
ADFLTRGGFNFAGWLATVSLGALW

SEQ ID NO: 339069 - protein, 26 aa, Mycobacterium
ADFPTLSVLCGVVWLAGSLGYLSVGL

SEQ ID NO: 339070 - protein, 19 aa, Mycobacterium
ADFWRFWVVHLWVEDFLEL

SEQ ID NO: 339071 - protein, 17 aa, Mycobacterium
ADHGWICVSIDYRVSPR

SEQ ID NO: 339072 - protein, 21 aa, Mycobacterium
ADIYPRYTCDYGYPRTAVSAA

SEQ ID NO: 339073 - protein, 20 aa, Mycobacterium
ADLGANCQYPASPEPAAKPV

SEQ ID NO: 339074 - protein, 17 aa, Mycobacterium
ADLKETWLRISPSEDPA

SEQ ID NO: 339075 - protein, 17 aa, Mycobacterium
ADLRGAIGFSSFAVLLY

SEQ ID NO: 339076 - protein, 22 aa, Mycobacterium
ADPAGWPRLDWSMDAALLLAAL

SEQ ID NO: 339077 - protein, 23 aa, Mycobacterium
ADPEVRLLFSLGLRILERRRHTG

SEQ ID NO: 339078 - protein, 17 aa, Mycobacterium
ADPLLAWMFWTGLLITA

SEQ ID NO: 339079 - protein, 25 aa, Mycobacterium
ADPVFLDWLVGLAFPCQRPFGHQNG

SEQ ID NO: 339080 - protein, 22 aa, Mycobacterium
ADRLPAVRLDWFTAERTATARQ

SEQ ID NO: 339081 - protein, 22 aa, Mycobacterium
ADRLPGVRLDWFTADNTATARQ

SEQ ID NO: 339082 - protein, 22 aa, Mycobacterium
ADRLPGVRLDWFTAEHTATARQ

SEQ ID NO: 339083 - protein, 18 aa, Mycobacterium
ADRLRCWLITIVIWVWAV

SEQ ID NO: 339084 - protein, 24 aa, Mycobacterium
ADRRFTLGHGRLFALYVAGYCVGR

SEQ ID NO: 339085 - protein, 17 aa, Mycobacterium
ADSAWLLGVGRVFSGLA

SEQ ID NO: 339086 - protein, 19 aa, Mycobacterium
ADTRAWLIHEMIIVAAVGI

SEQ ID NO: 339087 - protein, 18 aa, Mycobacterium
ADVLKAHPIVAVDRRGTG

SEQ ID NO: 339088 - protein, 18 aa, Mycobacterium
ADVLYEFRLVSLGTQLVL

SEQ ID NO: 339089 - protein, 18 aa, Mycobacterium
ADVRAAGRLVIGVNVPYA

SEQ ID NO: 339090 - protein, 17 aa, Mycobacterium
ADWMWALLLTGALTVFV

SEQ ID NO: 339091 - protein, 18 aa, Mycobacterium
ADYPEPFLYAGYCRDDDP

SEQ ID NO: 339092 - protein, 23 aa, Mycobacterium
AEAFLPRRARYGAQVTLALAGLI

SEQ ID NO: 339093 - protein, 23 aa, Mycobacterium
AEAHAWRPLFWIIAAIALAALVM

SEQ ID NO: 339094 - protein, 18 aa, Mycobacterium
AEALGRVEVVCFDKTGTL

SEQ ID NO: 339095 - protein, 17 aa, Mycobacterium
AEARRRRALIVGLSAGA

SEQ ID NO: 339096 - protein, 18 aa, Mycobacterium
AEAVVSRLVFARMTPEHK

SEQ ID NO: 339097 - protein, 19 aa, Mycobacterium
AEEAWGRFWAWDPKETVSF

SEQ ID NO: 339098 - protein, 21 aa, Mycobacterium
AEEWGRQWWGVAICVVTEVLL

SEQ ID NO: 339099 - protein, 18 aa, Mycobacterium
AEFFRLVWQFGDGSGQPI

SEQ ID NO: 339100 - protein, 17 aa, Mycobacterium
AEFPGGIRIPSTTLYIT

SEQ ID NO: 339101 - protein, 18 aa, Mycobacterium
AEGLGWLAQIGLFVLLGL

SEQ ID NO: 339102 - protein, 19 aa, Mycobacterium
AEHPELWGGLVDLPAGADL

SEQ ID NO: 339103 - protein, 20 aa, Mycobacterium
AEHRCTIAFIAPPVAVALAK

SEQ ID NO: 339104 - protein, 19 aa, Mycobacterium
AEIALGFALTAPIVHATAA

SEQ ID NO: 339105 - protein, 19 aa, Mycobacterium
AEILVGLVVSVLAATADLR

SEQ ID NO: 339106 - protein, 17 aa, Mycobacterium
AEIRWAFTPPRTWLMGV

SEQ ID NO: 339107 - protein, 20 aa, Mycobacterium
AELAFLVAMVMARPDPRALV

SEQ ID NO: 339108 - protein, 20 aa, Mycobacterium
AELAFLVAMVMARPQFDALL

SEQ ID NO: 339109 - protein, 18 aa, Mycobacterium
AELARGLIALGIGKAAHV

SEQ ID NO: 339110 - protein, 17 aa, Mycobacterium
AELCAQYLAPILDSIKF

SEQ ID NO: 339111 - protein, 17 aa, Mycobacterium
AELCAQYLAPVLDAIKF

SEQ ID NO: 339112 - protein, 20 aa, Mycobacterium
AELIAWSGLLLLALTALGGG

SEQ ID NO: 339113 - protein, 19 aa, Mycobacterium
AELMLRPAATIALGGGQPT

SEQ ID NO: 339114 - protein, 17 aa, Mycobacterium
AELRAQVLLGLRERELC

SEQ ID NO: 339115 - protein, 21 aa, Mycobacterium
AELVFAVFLYRVWNLPVAILS

SEQ ID NO: 339116 - protein, 19 aa, Mycobacterium
AEMWPGIATPTLWARTAGI

SEQ ID NO: 339117 - protein, 23 aa, Mycobacterium
AENYLRLNALGAYGSFFNIFYCS

SEQ ID NO: 339118 - protein, 19 aa, Mycobacterium
AEPFAAWIIGAACAYATHH

SEQ ID NO: 339119 - protein, 17 aa, Mycobacterium
AEPHRALVWLGWLTTAT

SEQ ID NO: 339120 - protein, 24 aa, Mycobacterium
AEPRLAVPSVYARLVLLWFLCSAF

SEQ ID NO: 339121 - protein, 17 aa, Mycobacterium
AEQALRCAIDIQDALHR

SEQ ID NO: 339122 - protein, 24 aa, Mycobacterium
AEQLRIAHTVSFSFDMSWEELFWL

SEQ ID NO: 339123 - protein, 23 aa, Mycobacterium
AERDGRRLIAVLLKGTRVPIAPW

SEQ ID NO: 339124 - protein, 17 aa, Mycobacterium
AERFRILRYDNRGVGLS

SEQ ID NO: 339125 - protein, 18 aa, Mycobacterium
AERGLRVLAVAKRPWEHD

SEQ ID NO: 339126 - protein, 21 aa, Mycobacterium
AESCKAILAAGGFTNTVVVEV

SEQ ID NO: 339127 - protein, 21 aa, Mycobacterium
AESPWKLLGRFGYHFSSLIAI

SEQ ID NO: 339128 - protein, 21 aa, Mycobacterium
AESRLNRLLALQVPPARKVVA

SEQ ID NO: 339129 - protein, 18 aa, Mycobacterium
AEVAWYRRPLVMILGAAA

SEQ ID NO: 339130 - protein, 20 aa, Mycobacterium
AEVFGGLLLLLPRTTAAGAL

SEQ ID NO: 339131 - protein, 21 aa, Mycobacterium
AEWLIHVGILHWRPRSLGPVT

SEQ ID NO: 339132 - protein, 19 aa, Mycobacterium
AEWSWLKWLPHVDISGEVD

SEQ ID NO: 339133 - protein, 17 aa, Mycobacterium
AEYVSWSLLDVVRAVPG

SEQ ID NO: 339134 - protein, 17 aa, Mycobacterium
AEYWPEFAANGKAKLTV

SEQ ID NO: 339135 - protein, 18 aa, Mycobacterium
AFAAWEYASRFDVAHVVM

SEQ ID NO: 339136 - protein, 19 aa, Mycobacterium
AFAGATVWPYLSDRALVDT

SEQ ID NO: 339137 - protein, 26 aa, Mycobacterium
AFATEVWQLVALRFLLGVAIGADYPI

SEQ ID NO: 339138 - protein, 22 aa, Mycobacterium
AFAVEMALMFAVPAGPAMARSF

SEQ ID NO: 339139 - protein, 22 aa, Mycobacterium
AFAVFWMRNQFRGFPGEIIEAA

SEQ ID NO: 339140 - protein, 18 aa, Mycobacterium
AFCHSARLLVFILATALG

SEQ ID NO: 339141 - protein, 20 aa, Mycobacterium
AFDPESWGSWIVKATQTAIA

SEQ ID NO: 339142 - protein, 20 aa, Mycobacterium
AFDQLWRWNSIVALVLSVLV

SEQ ID NO: 339143 - protein, 20 aa, Mycobacterium
AFELIDWPVAVVIAAGHFLA

SEQ ID NO: 339144 - protein, 19 aa, Mycobacterium
AFGAGLAWLAMDRRRIRQA

SEQ ID NO: 339145 - protein, 21 aa, Mycobacterium
AFGCAIVRWSIWPSKRQSVVL

SEQ ID NO: 339146 - protein, 17 aa, Mycobacterium
AFGCLQAGIAVMAAPAL

SEQ ID NO: 339147 - protein, 26 aa, Mycobacterium
AFGMPVPHPWALWLFGVFIMLTVGVA

SEQ ID NO: 339148 - protein, 19 aa, Mycobacterium
AFIAIWATLGFKWFEELGG

SEQ ID NO: 339149 - protein, 23 aa, Mycobacterium
AFIHLLGPWSWWAPKPLAWLHDR

SEQ ID NO: 339150 - protein, 22 aa, Mycobacterium
AFIPRFLFAVGFPGIVVATACY

SEQ ID NO: 339151 - protein, 24 aa, Mycobacterium
AFKQGVGLILRLAKPTALSEVTID

SEQ ID NO: 339152 - protein, 19 aa, Mycobacterium
AFLCVTAFVAVRVEERHAR

SEQ ID NO: 339153 - protein, 20 aa, Mycobacterium
AFLGDWARYIPRDTPSWKPM

SEQ ID NO: 339154 - protein, 20 aa, Mycobacterium
AFLLWGWRVPFILSVVMLGV

SEQ ID NO: 339155 - protein, 18 aa, Mycobacterium
AFLQWGWRVPFLLSAVLV

SEQ ID NO: 339156 - protein, 18 aa, Mycobacterium
AFLQWGWRVPFLVSAALI

SEQ ID NO: 339157 - protein, 17 aa, Mycobacterium
AFLRLPYTFAVPIFGGR

SEQ ID NO: 339158 - protein, 19 aa, Mycobacterium
AFLSWGWRVAFWLSAVVVL

SEQ ID NO: 339159 - protein, 20 aa, Mycobacterium
AFMMMPFVLGYDIANAVIYW

SEQ ID NO: 339160 - protein, 19 aa, Mycobacterium
AFPWREFIHQGAFMAGSAV

SEQ ID NO: 339161 - protein, 17 aa, Mycobacterium
AFQACFISAAAVAARFG

SEQ ID NO: 339162 - protein, 21 aa, Mycobacterium
AFRGLRAAWRRGREIYAEVAA

SEQ ID NO: 339163 - protein, 21 aa, Mycobacterium
AFRIGRPLIRRFFLNERLNAM

SEQ ID NO: 339164 - protein, 19 aa, Mycobacterium
AFRLTCYYYRKAYYRSVWQ

SEQ ID NO: 339165 - protein, 20 aa, Mycobacterium
AFRLTCYYYRKAYYRSVWQS

SEQ ID NO: 339166 - protein, 18 aa, Mycobacterium
AFSWLPMYHDMGFIQVLG

SEQ ID NO: 339167 - protein, 17 aa, Mycobacterium
AFTRLWPSVIFLISAPV

SEQ ID NO: 339168 - protein, 18 aa, Mycobacterium
AFVEWGWRIPFLASAVLV

SEQ ID NO: 339169 - protein, 18 aa, Mycobacterium
AFVLALAYRSYRLTTIEE

SEQ ID NO: 339170 - protein, 19 aa, Mycobacterium
AFVRKPIRWMRMLAERDQP

SEQ ID NO: 339171 - protein, 18 aa, Mycobacterium
AFVRRSGIYFGFAIGLVQ

SEQ ID NO: 339172 - protein, 25 aa, Mycobacterium
AFWIGHPLIRFSFRNELFNAAFRYA

SEQ ID NO: 339173 - protein, 24 aa, Mycobacterium
AFWIGRPLIRLSFRNEKLNAVFRY

SEQ ID NO: 339174 - protein, 21 aa, Mycobacterium
AFWLGRPLIRLSFNNEKFNAA

SEQ ID NO: 339175 - protein, 21 aa, Mycobacterium
AFYITCVIFIFGVLGALLWAV

SEQ ID NO: 339176 - protein, 17 aa, Mycobacterium
AGAAIGWGLLNRNRRRG

SEQ ID NO: 339177 - protein, 20 aa, Mycobacterium
AGAALFLWAFAFGPPPPPGP

SEQ ID NO: 339178 - protein, 19 aa, Mycobacterium
AGACALALFAIFWWALPLT

SEQ ID NO: 339179 - protein, 21 aa, Mycobacterium
AGACALALFAVFWVLVPLLLR

SEQ ID NO: 339180 - protein, 19 aa, Mycobacterium
AGACLPLGLALCLLITGIF

SEQ ID NO: 339181 - protein, 18 aa, Mycobacterium
AGAGFPDFGAPQLPITEL

SEQ ID NO: 339182 - protein, 18 aa, Mycobacterium
AGAIGLAIVAALAVLVTV

SEQ ID NO: 339183 - protein, 21 aa, Mycobacterium
AGALCGYLLLRRSLGRAAGPL

SEQ ID NO: 339184 - protein, 17 aa, Mycobacterium
AGALCRPAAAAVPMGLV

SEQ ID NO: 339185 - protein, 19 aa, Mycobacterium
AGALWSSLFAGFVILILLL

SEQ ID NO: 339186 - protein, 17 aa, Mycobacterium
AGAMLCLHFTRLNYFSS

SEQ ID NO: 339187 - protein, 17 aa, Mycobacterium
AGARIILLNSEFSGPQI

SEQ ID NO: 339188 - protein, 20 aa, Mycobacterium
AGARPRLIWYAPHLVEGATS

SEQ ID NO: 339189 - protein, 21 aa, Mycobacterium
AGARPRLIWYAPHRVEGESPP

SEQ ID NO: 339190 - protein, 21 aa, Mycobacterium
AGAVLFLLAGRRLWHRFRGQP

SEQ ID NO: 339191 - protein, 18 aa, Mycobacterium
AGAVVWFGITSAWKERLD

SEQ ID NO: 339192 - protein, 18 aa, Mycobacterium
AGAWGLAEVFGWKHTLNE

SEQ ID NO: 339193 - protein, 18 aa, Mycobacterium
AGAWGLSEVFGWQHTLNQ

SEQ ID NO: 339194 - protein, 18 aa, Mycobacterium
AGAWGLSEVFGWRHTLNQ

SEQ ID NO: 339195 - protein, 23 aa, Mycobacterium
AGAWLPHYLVWFIGGMMLAVLAT

SEQ ID NO: 339196 - protein, 24 aa, Mycobacterium
AGAYIWWGLCPGFFLLLLPAGPLE

SEQ ID NO: 339197 - protein, 18 aa, Mycobacterium
AGELLLWLVRPDFAAYLH

SEQ ID NO: 339198 - protein, 17 aa, Mycobacterium
AGEVLMRILDVLFAFPL

SEQ ID NO: 339199 - protein, 17 aa, Mycobacterium
AGFGRAIAVTALMTAVI

SEQ ID NO: 339200 - protein, 18 aa, Mycobacterium
AGFVSEWLLVQSLIHTAR

SEQ ID NO: 339201 - protein, 20 aa, Mycobacterium
AGFWKSILIFGLLVAADITR

SEQ ID NO: 339202 - protein, 17 aa, Mycobacterium
AGGFFDKLSRFVIQKPF

SEQ ID NO: 339203 - protein, 20 aa, Mycobacterium
AGGFLTVFGVFGLVVSPVVA

SEQ ID NO: 339204 - protein, 21 aa, Mycobacterium
AGGLPPLFAGVVRRPRRRQIE

SEQ ID NO: 339205 - protein, 18 aa, Mycobacterium
AGGPAWLYWTLYLACYAA

SEQ ID NO: 339206 - protein, 19 aa, Mycobacterium
AGGSPVRIMILLVVVTAIA

SEQ ID NO: 339207 - protein, 22 aa, Mycobacterium
AGGVAARWAHWVALPLGTVTPT

SEQ ID NO: 339208 - protein, 20 aa, Mycobacterium
AGGVLGRFIPGTALLIAFAV

SEQ ID NO: 339209 - protein, 18 aa, Mycobacterium
AGHLVSWAKLCPRTIQSG

SEQ ID NO: 339210 - protein, 19 aa, Mycobacterium
AGHPISFWQFTRYGIVVTF

SEQ ID NO: 339211 - protein, 18 aa, Mycobacterium
AGHWLMFAVISLSTFSAM

SEQ ID NO: 339212 - protein, 19 aa, Mycobacterium
AGIGCFIAFIGFVDAGFVR

SEQ ID NO: 339213 - protein, 19 aa, Mycobacterium
AGIHGWRWMLGLATVPAML

SEQ ID NO: 339214 - protein, 17 aa, Mycobacterium
AGILGLAPADSWPAAVA

SEQ ID NO: 339215 - protein, 20 aa, Mycobacterium
AGILRPEFRVSAGGALAAAL

SEQ ID NO: 339216 - protein, 25 aa, Mycobacterium
AGISNRRWLRWPARVYTDIFRGLPE

SEQ ID NO: 339217 - protein, 19 aa, Mycobacterium
AGITVWLGLVAQFGGVLGS

SEQ ID NO: 339218 - protein, 24 aa, Mycobacterium
AGKSCFLRAGIVPRLQRQASKYLV

SEQ ID NO: 339219 - protein, 17 aa, Mycobacterium
AGLALGMFVMFATFGTL

SEQ ID NO: 339220 - protein, 25 aa, Mycobacterium
AGLDPRLLHTLSFVVALAIVVTLHV

SEQ ID NO: 339221 - protein, 19 aa, Mycobacterium
AGLFGWGAWQRRWIADDGL

SEQ ID NO: 339222 - protein, 24 aa, Mycobacterium
AGLIAALAFEVFKLVASIYLRSVL

SEQ ID NO: 339223 - protein, 17 aa, Mycobacterium
AGLKLPSWGSLRLALPV

SEQ ID NO: 339224 - protein, 18 aa, Mycobacterium
AGLLAAVGFEIFKQLASI

SEQ ID NO: 339225 - protein, 20 aa, Mycobacterium
AGLLKRHWVIPILLISALFC

SEQ ID NO: 339226 - protein, 18 aa, Mycobacterium
AGLLLNWVDLSTLYLIDA

SEQ ID NO: 339227 - protein, 21 aa, Mycobacterium
AGLLPAFALVLALKHEVWTRL

SEQ ID NO: 339228 - protein, 20 aa, Mycobacterium
AGLLRIAAVLGIVAGLAVLA

SEQ ID NO: 339229 - protein, 20 aa, Mycobacterium
AGLLRYWYLRILRPEVAARI

SEQ ID NO: 339230 - protein, 17 aa, Mycobacterium
AGLLSWLLLGQRVDIGM

SEQ ID NO: 339231 - protein, 17 aa, Mycobacterium
AGLLYFYFVLPRWFELM

SEQ ID NO: 339232 - protein, 18 aa, Mycobacterium
AGLNWPTAFLVGAILSPT

SEQ ID NO: 339233 - protein, 22 aa, Mycobacterium
AGLRLGPAVGHLEVHHGRRAEG

SEQ ID NO: 339234 - protein, 17 aa, Mycobacterium
AGLRLLAGLIWLYNVVW

SEQ ID NO: 339235 - protein, 19 aa, Mycobacterium
AGLRLSRTVALGVCGLALA

SEQ ID NO: 339236 - protein, 19 aa, Mycobacterium
AGLTPCWGEHLLVLRSLNP

SEQ ID NO: 339237 - protein, 17 aa, Mycobacterium
AGMAVVFGVPVIVAPSF

SEQ ID NO: 339238 - protein, 21 aa, Mycobacterium
AGMDLPTVWALTRGAGQTVAV

SEQ ID NO: 339239 - protein, 17 aa, Mycobacterium
AGMLRLGYLANMLSKPV

SEQ ID NO: 339240 - protein, 22 aa, Mycobacterium
AGMPGMRMAFSLLPDAGSETEH

SEQ ID NO: 339241 - protein, 17 aa, Mycobacterium
AGNEFLFQQLAMQNIEL

SEQ ID NO: 339242 - protein, 18 aa, Mycobacterium
AGNPIAIAGIPVGTVTSM

SEQ ID NO: 339243 - protein, 18 aa, Mycobacterium
AGPLLAGVLLKWVDLSTL

SEQ ID NO: 339244 - protein, 23 aa, Mycobacterium
AGPLRPGHWLMFAVISAATLGAM

SEQ ID NO: 339245 - protein, 25 aa, Mycobacterium
AGPWIFLRIRFFRRKLIAVQLAATP

SEQ ID NO: 339246 - protein, 18 aa, Mycobacterium
AGPWKRLTKVILPMIKPA

SEQ ID NO: 339247 - protein, 19 aa, Mycobacterium
AGPWRRLTGVILPIIKPAV

SEQ ID NO: 339248 - protein, 18 aa, Mycobacterium
AGRCLAAAAAAFAVLVLA

SEQ ID NO: 339249 - protein, 22 aa, Mycobacterium
AGRSRGGAVAAVFFALVSGSLW

SEQ ID NO: 339250 - protein, 17 aa, Mycobacterium
AGRVQWRTGLIFGAAGM

SEQ ID NO: 339251 - protein, 20 aa, Mycobacterium
AGSCALVLFALFWVLVPLLL

SEQ ID NO: 339252 - protein, 19 aa, Mycobacterium
AGSHWLVTRMTTITSLDLT

SEQ ID NO: 339253 - protein, 21 aa, Mycobacterium
AGSIGRLSVPPSWAQALPDVE

SEQ ID NO: 339254 - protein, 20 aa, Mycobacterium
AGSLITWWTGDSVLVFETGN

SEQ ID NO: 339255 - protein, 24 aa, Mycobacterium
AGSMFGPYHLKRLLGRGGMGEVYE

SEQ ID NO: 339256 - protein, 19 aa, Mycobacterium
AGSMFGPYRLIRPLGRGGM

SEQ ID NO: 339257 - protein, 17 aa, Mycobacterium
AGSPILFYPAGALAVTV

SEQ ID NO: 339258 - protein, 18 aa, Mycobacterium
AGSWFGPYRLVRLLRQGG

SEQ ID NO: 339259 - protein, 17 aa, Mycobacterium
AGSWPKIRIQAVQHAAE

SEQ ID NO: 339260 - protein, 21 aa, Mycobacterium
AGTQDWKAWLFGSLDAGNAIT

SEQ ID NO: 339261 - protein, 19 aa, Mycobacterium
AGTVWTHFIFGSALAGLGL

SEQ ID NO: 339262 - protein, 22 aa, Mycobacterium
AGVGRPCASWMMPYTISAMRAA

SEQ ID NO: 339263 - protein, 19 aa, Mycobacterium
AGVGVDWSAVFAGSGGRQV

SEQ ID NO: 339264 - protein, 18 aa, Mycobacterium
AGVISRHAAAIIGLLMLV

SEQ ID NO: 339265 - protein, 19 aa, Mycobacterium
AGVIVWRFFGEALYHRSRT

SEQ ID NO: 339266 - protein, 20 aa, Mycobacterium
AGVIYCCYETALGRSVAVKV

SEQ ID NO: 339267 - protein, 19 aa, Mycobacterium
AGVLVAWLGGMLLSGMLTV

SEQ ID NO: 339268 - protein, 17 aa, Mycobacterium
AGVPVVFLTAFYGLSVL

SEQ ID NO: 339269 - protein, 17 aa, Mycobacterium
AGVVLVRAATLVFLEAA

SEQ ID NO: 339270 - protein, 24 aa, Mycobacterium
AGWNPDWFKFFLGAMLLFAVVANN

SEQ ID NO: 339271 - protein, 17 aa, Mycobacterium
AGWRLNRLVPHGAVDRL

SEQ ID NO: 339272 - protein, 17 aa, Mycobacterium
AGWRRDAGWARRLAWIS

SEQ ID NO: 339273 - protein, 19 aa, Mycobacterium
AGYCAGRFWIELMRSDTAT

SEQ ID NO: 339274 - protein, 19 aa, Mycobacterium
AGYVLWWAVLFPAISVPII

SEQ ID NO: 339275 - protein, 17 aa, Mycobacterium
AGYWRRGALVIGIGVGV

SEQ ID NO: 339276 - protein, 23 aa, Mycobacterium
AHAAGRTWVLWVLLGTGQLLSHL

SEQ ID NO: 339277 - protein, 19 aa, Mycobacterium
AHCVRRFGGITGDVLGAAV

SEQ ID NO: 339278 - protein, 24 aa, Mycobacterium
AHGLGMPVSLGWQLWLYGVFAIIA

SEQ ID NO: 339279 - protein, 17 aa, Mycobacterium
AHIAALGPDGGWQGSAA

SEQ ID NO: 339280 - protein, 20 aa, Mycobacterium
AHIRTGSLLGQRVLALESTG

SEQ ID NO: 339281 - protein, 22 aa, Mycobacterium
AHIRTGTLLGERVLALDSEGSG

SEQ ID NO: 339282 - protein, 17 aa, Mycobacterium
AHLGYSRGFIWSVGAVV

SEQ ID NO: 339283 - protein, 22 aa, Mycobacterium
AHPDARIGFMMSDAKPVAALTT

SEQ ID NO: 339284 - protein, 22 aa, Mycobacterium
AHRKLCDTYKLAARAVQIQTNG

SEQ ID NO: 339285 - protein, 17 aa, Mycobacterium
AHRWMLRVRWLIEPTLV

SEQ ID NO: 339286 - protein, 20 aa, Mycobacterium
AHSRLRVHWVRRRDETSLAE

SEQ ID NO: 339287 - protein, 23 aa, Mycobacterium
AHVLLRMDWQLALLLGAIVSSTD

SEQ ID NO: 339288 - protein, 22 aa, Mycobacterium
AIAALLGRWFWWPLQVSPRPVG

SEQ ID NO: 339289 - protein, 21 aa, Mycobacterium
AIAALLGRWFWWPRRVPTHAA

SEQ ID NO: 339290 - protein, 20 aa, Mycobacterium
AIAALMGRWFWWPMKVSKYA

SEQ ID NO: 339291 - protein, 23 aa, Mycobacterium
AIAALVGRANWWPSQGGVPSPKP

SEQ ID NO: 339292 - protein, 21 aa, Mycobacterium
AIAAWLAVLVCVDFVALQLIT

SEQ ID NO: 339293 - protein, 19 aa, Mycobacterium
AIALPRWGTTEVVSEVVYG

SEQ ID NO: 339294 - protein, 18 aa, Mycobacterium
AIALRILFDLPLLLGGII

SEQ ID NO: 339295 - protein, 24 aa, Mycobacterium
AIARFSSRYAVLIIGLWVLLAGAG

SEQ ID NO: 339296 - protein, 25 aa, Mycobacterium
AIARLLGPLFWWPRLIRSRPAPAQY

SEQ ID NO: 339297 - protein, 18 aa, Mycobacterium
AIASRFDGAITYYDEPPE

SEQ ID NO: 339298 - protein, 24 aa, Mycobacterium
AIATMLGRWFWWPINIRTRPAPKP

SEQ ID NO: 339299 - protein, 23 aa, Mycobacterium
AIATRLPMVLTFIVLITVVLVFL

SEQ ID NO: 339300 - protein, 21 aa, Mycobacterium
AIAVPSHWGPGTVGALRGALR

SEQ ID NO: 339301 - protein, 22 aa, Mycobacterium
AIAVVAVAGWWFLRSDEDTITV

SEQ ID NO: 339302 - protein, 18 aa, Mycobacterium
AICYAELASAVPVSGSSY

SEQ ID NO: 339303 - protein, 19 aa, Mycobacterium
AIEAPAWWRGTFIVMALAG

SEQ ID NO: 339304 - protein, 18 aa, Mycobacterium
AIEHLGWVAAAGLIGFIG

SEQ ID NO: 339305 - protein, 18 aa, Mycobacterium
AIFLCGVCSIPGRHTITD

SEQ ID NO: 339306 - protein, 23 aa, Mycobacterium
AIFPADIGWRIAFGIGAVFGLVV

SEQ ID NO: 339307 - protein, 18 aa, Mycobacterium
AIFYLRVPTALGIGKHDV

SEQ ID NO: 339308 - protein, 23 aa, Mycobacterium
AIGARVGFELGFAVLDHSQHGVA

SEQ ID NO: 339309 - protein, 26 aa, Mycobacterium
AIGLIEWPVLLAVGGGALVLQRIARQ

SEQ ID NO: 339310 - protein, 21 aa, Mycobacterium
AIGLKRLGKDVAFVGLIDAVR

SEQ ID NO: 339311 - protein, 24 aa, Mycobacterium
AIGYALGVFGVWLVRFMRSKDTSP

SEQ ID NO: 339312 - protein, 18 aa, Mycobacterium
AIGYALGVLVVWLVRYMR

SEQ ID NO: 339313 - protein, 24 aa, Mycobacterium
AIGYGLGVFGVWLVRYMCSADSSP

SEQ ID NO: 339314 - protein, 17 aa, Mycobacterium
AILDYLGTLAFAMSAAL

SEQ ID NO: 339315 - protein, 21 aa, Mycobacterium
AILFPMYFLKSFAYAGVATVA

SEQ ID NO: 339316 - protein, 23 aa, Mycobacterium
AILGWRPVLVVPLTFTLFTPLAV

SEQ ID NO: 339317 - protein, 17 aa, Mycobacterium
AILRWIAVLAALFVVLT

SEQ ID NO: 339318 - protein, 18 aa, Mycobacterium
AINCGYPLIERFPLMLFT

SEQ ID NO: 339319 - protein, 24 aa, Mycobacterium
AIQWRARSWLKRVLPVALIAAVAV

SEQ ID NO: 339320 - protein, 19 aa, Mycobacterium
AIRALRESHDWSLADLAAA

SEQ ID NO: 339321 - protein, 26 aa, Mycobacterium
AIRIFAIPIILGWLVITVLVNVLVPS

SEQ ID NO: 339322 - protein, 28 aa, Mycobacterium
AIRLGTFLLVCFLGVIGLFAVFGQLRFG

SEQ ID NO: 339323 - protein, 19 aa, Mycobacterium
AISAAWRFVSPILDKFSEG

SEQ ID NO: 339324 - protein, 21 aa, Mycobacterium
AISAVWNWLSTTVFPGLKLAF

SEQ ID NO: 339325 - protein, 20 aa, Mycobacterium
AISPRITIALARLSPSRPAV

SEQ ID NO: 339326 - protein, 24 aa, Mycobacterium
AITSRLPLVLGIIAGITFVLLFLL

SEQ ID NO: 339327 - protein, 23 aa, Mycobacterium
AITSRLPLVLGLIAIIMFALLFL

SEQ ID NO: 339328 - protein, 25 aa, Mycobacterium
AITSRLPWLFGFVACVTLVLLFALT

SEQ ID NO: 339329 - protein, 23 aa, Mycobacterium
AIVGWASGLGFGWVYTLGTANVV

SEQ ID NO: 339330 - protein, 19 aa, Mycobacterium
AIYILKLIFGYALGGVIVA

SEQ ID NO: 339331 - protein, 23 aa, Mycobacterium
AIYNEVLQFFVILAFLVPLTIFG

SEQ ID NO: 339332 - protein, 19 aa, Mycobacterium
AKADSAWYLHQLTANTELA

SEQ ID NO: 339333 - protein, 22 aa, Mycobacterium
AKERRFAVAFVMVGAILFVAGA

SEQ ID NO: 339334 - protein, 20 aa, Mycobacterium
AKFPGLTAHQVINRIVQSAH

SEQ ID NO: 339335 - protein, 19 aa, Mycobacterium
AKGASWVRYAALGAVAAIM

SEQ ID NO: 339336 - protein, 19 aa, Mycobacterium
AKHHIRWARAIVYALLPGL

SEQ ID NO: 339337 - protein, 23 aa, Mycobacterium
AKKKRKWPAIVGGVIALMIVGSI

SEQ ID NO: 339338 - protein, 18 aa, Mycobacterium
AKKRPVGLIAGVGGAIAL

SEQ ID NO: 339339 - protein, 26 aa, Mycobacterium
AKLRVTWEMSFLYAIVFGGFVAFANY

SEQ ID NO: 339340 - protein, 18 aa, Mycobacterium
AKPAWPFAVGTLALCVLS

SEQ ID NO: 339341 - protein, 19 aa, Mycobacterium
AKQAQAWPKCNGATLHVSE

SEQ ID NO: 339342 - protein, 17 aa, Mycobacterium
AKRELWAHLGWQDIKQR

SEQ ID NO: 339343 - protein, 21 aa, Mycobacterium
AKRRGWPILRFNSRGPVGLRR

SEQ ID NO: 339344 - protein, 18 aa, Mycobacterium
AKSGVEWVPAKSFVIDRL

SEQ ID NO: 339345 - protein, 18 aa, Mycobacterium
AKSLRPGDIIDLAAPEVV

SEQ ID NO: 339346 - protein, 18 aa, Mycobacterium
AKTVPIMLGIALVASAAL

SEQ ID NO: 339347 - protein, 25 aa, Mycobacterium
AKYPPAWLLCALFPLAAVPLVPTRL

SEQ ID NO: 339348 - protein, 17 aa, Mycobacterium
ALAALAIRCTVPVELNV

SEQ ID NO: 339349 - protein, 19 aa, Mycobacterium
ALAALRPTPGFPASGVVAL

SEQ ID NO: 339350 - protein, 23 aa, Mycobacterium
ALAAPLGWFGFRVHLAGQAQARQ

SEQ ID NO: 339351 - protein, 17 aa, Mycobacterium
ALADWFAVTALFKHPLG

SEQ ID NO: 339352 - protein, 17 aa, Mycobacterium
ALAEALDAMAREVGGGA

SEQ ID NO: 339353 - protein, 17 aa, Mycobacterium
ALAGGWRRATAVLTVLS

SEQ ID NO: 339354 - protein, 17 aa, Mycobacterium
ALAILTMVALLFGAYFL

SEQ ID NO: 339355 - protein, 20 aa, Mycobacterium
ALAKAFLRFNVHLLTSSTLP

SEQ ID NO: 339356 - protein, 21 aa, Mycobacterium
ALAKAFLRFNVHLLTSSTLPP

SEQ ID NO: 339357 - protein, 20 aa, Mycobacterium
ALALLFGVGDAWRISLDRPT

SEQ ID NO: 339358 - protein, 17 aa, Mycobacterium
ALALLGMRRYVFARPPL

SEQ ID NO: 339359 - protein, 20 aa, Mycobacterium
ALAPNILALIAFRVIQGIGG

SEQ ID NO: 339360 - protein, 18 aa, Mycobacterium
ALAQRTCVVPLPYAQADL

SEQ ID NO: 339361 - protein, 20 aa, Mycobacterium
ALAQWAWRLPFLLGGLLGVV

SEQ ID NO: 339362 - protein, 18 aa, Mycobacterium
ALARFALSLSDSVGHLTD

SEQ ID NO: 339363 - protein, 18 aa, Mycobacterium
ALARLGYSIGFALLNDSQ

SEQ ID NO: 339364 - protein, 17 aa, Mycobacterium
ALASIWLKGPLVLGLGA

SEQ ID NO: 339365 - protein, 19 aa, Mycobacterium
ALATLVGRASWWPSRPGTQ

SEQ ID NO: 339366 - protein, 17 aa, Mycobacterium
ALATWLPFLLVLASMTY

SEQ ID NO: 339367 - protein, 18 aa, Mycobacterium
ALAVAVLWWLSVQRDRRQ

SEQ ID NO: 339368 - protein, 23 aa, Mycobacterium
ALAVGLKFKFGFDDSLDVVGVHL

SEQ ID NO: 339369 - protein, 22 aa, Mycobacterium
ALAVGLKFKLGFDDSLDVVGVH

SEQ ID NO: 339370 - protein, 17 aa, Mycobacterium
ALAWRWGGTVKAFVISC

SEQ ID NO: 339371 - protein, 17 aa, Mycobacterium
ALAYRWGGNVGAFLLAS

SEQ ID NO: 339372 - protein, 19 aa, Mycobacterium
ALCAGQWALWWANGFSWIW

SEQ ID NO: 339373 - protein, 18 aa, Mycobacterium
ALCAVGFSALPRLFTDDR

SEQ ID NO: 339374 - protein, 25 aa, Mycobacterium
ALCCLGVFCAFILYFALYSRHQLVA

SEQ ID NO: 339375 - protein, 26 aa, Mycobacterium
ALCCLVCLGCGFTAQMLAPRLDRAGT

SEQ ID NO: 339376 - protein, 23 aa, Mycobacterium
ALCGLCAVAYLVSRHAAGAPAGV

SEQ ID NO: 339377 - protein, 19 aa, Mycobacterium
ALCGVVCFVGFLASYLFNV

SEQ ID NO: 339378 - protein, 18 aa, Mycobacterium
ALCLLIAEAFHLEPHLAV

SEQ ID NO: 339379 - protein, 18 aa, Mycobacterium
ALCLPLARALRRSASVPA

SEQ ID NO: 339380 - protein, 18 aa, Mycobacterium
ALCPYCMVVWAATITLLV

SEQ ID NO: 339381 - protein, 18 aa, Mycobacterium
ALCRGGLTPIGLLGLADT

SEQ ID NO: 339382 - protein, 18 aa, Mycobacterium
ALCYAELASAVPVSGSSF

SEQ ID NO: 339383 - protein, 20 aa, Mycobacterium
ALDARVGFMVGWAVLLDYLF

SEQ ID NO: 339384 - protein, 18 aa, Mycobacterium
ALDDGWAAVRWVAEHAEE

SEQ ID NO: 339385 - protein, 18 aa, Mycobacterium
ALDLRIFRAGPFNAAVIA

SEQ ID NO: 339386 - protein, 30 aa, Mycobacterium
ALDQDFLFSWGWRIPFFFSLVLVAVALVIR

SEQ ID NO: 339387 - protein, 17 aa, Mycobacterium
ALDRPGTLYSYVYADQT

SEQ ID NO: 339388 - protein, 22 aa, Mycobacterium
ALELRGRILGAFEAAEVATDHA

SEQ ID NO: 339389 - protein, 17 aa, Mycobacterium
ALELTWEALEHARIPPS

SEQ ID NO: 339390 - protein, 20 aa, Mycobacterium
ALFFPWNLYFGFRIPGSSRI

SEQ ID NO: 339391 - protein, 17 aa, Mycobacterium
ALFGGMMWISFASGARS

SEQ ID NO: 339392 - protein, 18 aa, Mycobacterium
ALFGWSWADPIVALVIAG

SEQ ID NO: 339393 - protein, 19 aa, Mycobacterium
ALFYRYAWQNPVFADIVHT

SEQ ID NO: 339394 - protein, 21 aa, Mycobacterium
ALGAVGAWIACRRRGIPLPAF

SEQ ID NO: 339395 - protein, 21 aa, Mycobacterium
ALGIGSLAVWKVHEMSAPGPV

SEQ ID NO: 339396 - protein, 25 aa, Mycobacterium
ALGLAIAVVLCWLLYRRAVRLNLRV

SEQ ID NO: 339397 - protein, 21 aa, Mycobacterium
ALGNRFLPIFVRQGTSYLLLA

SEQ ID NO: 339398 - protein, 20 aa, Mycobacterium
ALGPAGWRLSQNIAGVVCIG

SEQ ID NO: 339399 - protein, 18 aa, Mycobacterium
ALGPRGNETFNHVKDGDC

SEQ ID NO: 339400 - protein, 19 aa, Mycobacterium
ALGRRVIARFGWRRPQTLL

SEQ ID NO: 339401 - protein, 22 aa, Mycobacterium
ALGVAFPLCFWVMGVYATLRDL

SEQ ID NO: 339402 - protein, 20 aa, Mycobacterium
ALGWALRLFAAVAVYNAVSM

SEQ ID NO: 339403 - protein, 20 aa, Mycobacterium
ALGWRPGAPFPHGSALLAAS

SEQ ID NO: 339404 - protein, 23 aa, Mycobacterium
ALIGWASGLGFGWLFTLGTANVV

SEQ ID NO: 339405 - protein, 18 aa, Mycobacterium
ALIIATAWLLRRIGKNNR

SEQ ID NO: 339406 - protein, 18 aa, Mycobacterium
ALIIATAWLVRRARRRPS

SEQ ID NO: 339407 - protein, 17 aa, Mycobacterium
ALILVAAWRMHARQAET

SEQ ID NO: 339408 - protein, 24 aa, Mycobacterium
ALIRARFPALTARQVMQRIESTAH

SEQ ID NO: 339409 - protein, 25 aa, Mycobacterium
ALIRARFPALTARQVMQRITSTAHH

SEQ ID NO: 339410 - protein, 19 aa, Mycobacterium
ALIRKRFDTVPGTRKDPRI

SEQ ID NO: 339411 - protein, 17 aa, Mycobacterium
ALISLAVGIVFTWLFMY

SEQ ID NO: 339412 - protein, 18 aa, Mycobacterium
ALITVLRARAFRDRRHAI

SEQ ID NO: 339413 - protein, 18 aa, Mycobacterium
ALIVINGFAAYALFTGHL

SEQ ID NO: 339414 - protein, 22 aa, Mycobacterium
ALKRVWIPLVIVAVVAVAGFSV

SEQ ID NO: 339415 - protein, 19 aa, Mycobacterium
ALKVDWPNFWSMIASASSK

SEQ ID NO: 339416 - protein, 17 aa, Mycobacterium
ALLAALCAVGFSALPRL

SEQ ID NO: 339417 - protein, 18 aa, Mycobacterium
ALLADALRALGYAATGGR

SEQ ID NO: 339418 - protein, 18 aa, Mycobacterium
ALLAWFGFYLYKVSHGDV

SEQ ID NO: 339419 - protein, 25 aa, Mycobacterium
ALLAWSLACAVAYLQGFGRRLSWVL

SEQ ID NO: 339420 - protein, 19 aa, Mycobacterium
ALLCPLLVYGWLGLPRMEL

SEQ ID NO: 339421 - protein, 19 aa, Mycobacterium
ALLCPLLVYGWLGMPRLGL

SEQ ID NO: 339422 - protein, 17 aa, Mycobacterium
ALLDRWDRRAVLICANL

SEQ ID NO: 339423 - protein, 19 aa, Mycobacterium
ALLDRWDRRLVLIGANTGR

SEQ ID NO: 339424 - protein, 18 aa, Mycobacterium
ALLDRWDRRLVMIGANLG

SEQ ID NO: 339425 - protein, 18 aa, Mycobacterium
ALLFAGILPPAWLAGTAM

SEQ ID NO: 339426 - protein, 18 aa, Mycobacterium
ALLFGGIFPPFWLAGTAM

SEQ ID NO: 339427 - protein, 19 aa, Mycobacterium
ALLFGGIFPPFWLAGTTML

SEQ ID NO: 339428 - protein, 19 aa, Mycobacterium
ALLGKWFWWPQVVRQRPAP

SEQ ID NO: 339429 - protein, 23 aa, Mycobacterium
ALLGSLLRPYRWAVVLLAVVVVV

SEQ ID NO: 339430 - protein, 24 aa, Mycobacterium
ALLGWVWRIPFLASIFLIGVAVLI

SEQ ID NO: 339431 - protein, 17 aa, Mycobacterium
ALLLATLCGAAFLEGID

SEQ ID NO: 339432 - protein, 20 aa, Mycobacterium
ALLPRLFERFARADNSRLNG

SEQ ID NO: 339433 - protein, 21 aa, Mycobacterium
ALLPVLWIFSLSLKPTSTVKD

SEQ ID NO: 339434 - protein, 17 aa, Mycobacterium
ALLRLPYTFAVPIFGGR

SEQ ID NO: 339435 - protein, 18 aa, Mycobacterium
ALLVFTVLLGVGYPLLIW

SEQ ID NO: 339436 - protein, 20 aa, Mycobacterium
ALLWLIKRLEILFVPVALAT

SEQ ID NO: 339437 - protein, 23 aa, Mycobacterium
ALLWSYNGGRTFQELGLASSDNL

SEQ ID NO: 339438 - protein, 19 aa, Mycobacterium
ALMAGVWFLHWPTRAESIA

SEQ ID NO: 339439 - protein, 18 aa, Mycobacterium
ALMLRAGVVLVRAATLVF

SEQ ID NO: 339440 - protein, 22 aa, Mycobacterium
ALMWAAAVLGIFAIIIAALILL

SEQ ID NO: 339441 - protein, 19 aa, Mycobacterium
ALNAGWSWVFFNRRQLGPA

SEQ ID NO: 339442 - protein, 17 aa, Mycobacterium
ALPAFLVPFAFVLTENG

SEQ ID NO: 339443 - protein, 19 aa, Mycobacterium
ALPAGWAWLENGWVMAIVA

SEQ ID NO: 339444 - protein, 23 aa, Mycobacterium
ALPKAGTSFARWAALLEEHAYDR

SEQ ID NO: 339445 - protein, 18 aa, Mycobacterium
ALPPLAYFFLLVIWLGID

SEQ ID NO: 339446 - protein, 24 aa, Mycobacterium
ALPRRPSVLAGKWVFYGLLGAVLS

SEQ ID NO: 339447 - protein, 17 aa, Mycobacterium
ALQRWGLQPDFVMGHSV

SEQ ID NO: 339448 - protein, 23 aa, Mycobacterium
ALQWPLFAAFVIWAYRRFVQYED

SEQ ID NO: 339449 - protein, 19 aa, Mycobacterium
ALREYDLKLILAFGTVSQL

SEQ ID NO: 339450 - protein, 20 aa, Mycobacterium
ALRHVWRDRPLLLALLAVST

SEQ ID NO: 339451 - protein, 17 aa, Mycobacterium
ALRPDWSRTPAARRVLA

SEQ ID NO: 339452 - protein, 23 aa, Mycobacterium
ALRQCLRLLPLTCAFIGVAVAGC

SEQ ID NO: 339453 - protein, 17 aa, Mycobacterium
ALRQMGIGWAFGFPAAT

SEQ ID NO: 339454 - protein, 19 aa, Mycobacterium
ALRRPQVWLALAVGMIGFG

SEQ ID NO: 339455 - protein, 19 aa, Mycobacterium
ALRWPRLPSSVLAGVVAFD

SEQ ID NO: 339456 - protein, 22 aa, Mycobacterium
ALSFSWRLSVCTIRPDDEVDTA

SEQ ID NO: 339457 - protein, 26 aa, Mycobacterium
ALSGTPAWEVFKPWAITSIAVAVAVA

SEQ ID NO: 339458 - protein, 24 aa, Mycobacterium
ALSKSAIVPLHFWLPGAMAAPTPV

SEQ ID NO: 339459 - protein, 25 aa, Mycobacterium
ALSKSAIVPLHFWLPGAMAAPTPVS

SEQ ID NO: 339460 - protein, 17 aa, Mycobacterium
ALSLPPLLLGMLGSLAY

SEQ ID NO: 339461 - protein, 20 aa, Mycobacterium
ALSPRVAMVLARLPLPPVPT

SEQ ID NO: 339462 - protein, 21 aa, Mycobacterium
ALSRLPAWIPDALRGAAAGVI

SEQ ID NO: 339463 - protein, 21 aa, Mycobacterium
ALTEVSWRLAFLVNVPIGLIM

SEQ ID NO: 339464 - protein, 22 aa, Mycobacterium
ALTGVVCFVGFFASYMFNVYFQ

SEQ ID NO: 339465 - protein, 17 aa, Mycobacterium
ALTRPPAVREFFRQAGA

SEQ ID NO: 339466 - protein, 20 aa, Mycobacterium
ALVAACFWALYILAGKRITG

SEQ ID NO: 339467 - protein, 36 aa, Mycobacterium
ALVFVRWWGQPAWSWLVLWRRGRRPISWDAPITVAN

SEQ ID NO: 339468 - protein, 20 aa, Mycobacterium
ALVGYCAGWLPWFANIDRQM

SEQ ID NO: 339469 - protein, 18 aa, Mycobacterium
ALVLDILTAFPILVQILA

SEQ ID NO: 339470 - protein, 26 aa, Mycobacterium
ALVLGRWGGQTVRHWAVTGFKYLTGR

SEQ ID NO: 339471 - protein, 17 aa, Mycobacterium
ALVLLIPVLMYLVMTSS

SEQ ID NO: 339472 - protein, 23 aa, Mycobacterium
ALVLSLIGVWAIRRRLLRQTHGL

SEQ ID NO: 339473 - protein, 25 aa, Mycobacterium
ALVQRLGERWVYMSGLLIVAASTGI

SEQ ID NO: 339474 - protein, 24 aa, Mycobacterium
ALVRLTARWPRRRALLVTMVCLTV

SEQ ID NO: 339475 - protein, 26 aa, Mycobacterium
ALWLLRFAMSSSWLLALVQIGRPVFA

SEQ ID NO: 339476 - protein, 20 aa, Mycobacterium
ALWLPWGWVAHRLLSAPLSA

SEQ ID NO: 339477 - protein, 19 aa, Mycobacterium
ALWLWNNAISPAWEGIKTA

SEQ ID NO: 339478 - protein, 23 aa, Mycobacterium
ALWPAARQRLVWMTLALAVITLI

SEQ ID NO: 339479 - protein, 17 aa, Mycobacterium
ALWRYAPLTPIRGPPRS

SEQ ID NO: 339480 - protein, 22 aa, Mycobacterium
AMALFPMYFLKSFAYAGVAVVA

SEQ ID NO: 339481 - protein, 21 aa, Mycobacterium
AMELGCDAVLLATAVTRAADP

SEQ ID NO: 339482 - protein, 24 aa, Mycobacterium
AMFFPEPRCRVVTGVGAFDPGLRR

SEQ ID NO: 339483 - protein, 18 aa, Mycobacterium
AMFIFFGLWTLRGDSLSD

SEQ ID NO: 339484 - protein, 17 aa, Mycobacterium
AMIRFEYALVVSTATAA

SEQ ID NO: 339485 - protein, 18 aa, Mycobacterium
AMLLPAFIALFGVVAALF

SEQ ID NO: 339486 - protein, 21 aa, Mycobacterium
AMNAYGWRLPFFIAGVLGGVG

SEQ ID NO: 339487 - protein, 20 aa, Mycobacterium
AMNFVICLVLIYGIALVWGL

SEQ ID NO: 339488 - protein, 25 aa, Mycobacterium
AMPLALRLLLPIAFVLISAGIGVAF

SEQ ID NO: 339489 - protein, 22 aa, Mycobacterium
AMRASDRWRDISSRVPGGTVAR

SEQ ID NO: 339490 - protein, 19 aa, Mycobacterium
AMRFRPFIRLTVEWVEVLA

SEQ ID NO: 339491 - protein, 29 aa, Mycobacterium
AMRIRGWRRLGAFVVRWPGAVLMATVLLS

SEQ ID NO: 339492 - protein, 25 aa, Mycobacterium
AMRNWMWFIGGIVFTFVLLNTMFGW

SEQ ID NO: 339493 - protein, 32 aa, Mycobacterium
AMSNTWLVWLATWFRPVFETIRVILADLWVFP

SEQ ID NO: 339494 - protein, 18 aa, Mycobacterium
AMTLPWIAAIVVEFLLLR

SEQ ID NO: 339495 - protein, 18 aa, Mycobacterium
ANALCGIGIFALVIFATG

SEQ ID NO: 339496 - protein, 17 aa, Mycobacterium
ANALRLLGMPMQSINPA

SEQ ID NO: 339497 - protein, 18 aa, Mycobacterium
ANLFWAFAYNTAAIPLAA

SEQ ID NO: 339498 - protein, 17 aa, Mycobacterium
ANLGANCQYPPSPDKAA

SEQ ID NO: 339499 - protein, 19 aa, Mycobacterium
ANLRIGYDTVVWVTSAYLL

SEQ ID NO: 339500 - protein, 26 aa, Mycobacterium
ANTSWFGVEAWRWMLLVGLVPAVVYA

SEQ ID NO: 339501 - protein, 24 aa, Mycobacterium
ANTWWWRALSGWWAWAHTPNGPGG

SEQ ID NO: 339502 - protein, 18 aa, Mycobacterium
ANWLPTFIALIVLSCVAA

SEQ ID NO: 339503 - protein, 18 aa, Mycobacterium
ANYGTWWFWLGLALIVGI

SEQ ID NO: 339504 - protein, 19 aa, Mycobacterium
APAAWLLDMGMLAVLSVGY

SEQ ID NO: 339505 - protein, 17 aa, Mycobacterium
APADSWPAAVAVGLAAM

SEQ ID NO: 339506 - protein, 25 aa, Mycobacterium
APATARRSWGWVIAVVLVIAALVAI

SEQ ID NO: 339507 - protein, 17 aa, Mycobacterium
APAYWSEGQFAALRGAL

SEQ ID NO: 339508 - protein, 18 aa, Mycobacterium
APCAIGMLVAVFAALTLG

SEQ ID NO: 339509 - protein, 17 aa, Mycobacterium
APCSIALLVTIAASLTL

SEQ ID NO: 339510 - protein, 20 aa, Mycobacterium
APDRVCAVLSRVARALPQLK

SEQ ID NO: 339511 - protein, 18 aa, Mycobacterium
APDYFRRAELCRERLGPV

SEQ ID NO: 339512 - protein, 17 aa, Mycobacterium
APEEIFLMLSVAGLAAY

SEQ ID NO: 339513 - protein, 18 aa, Mycobacterium
APEGLAFDLDWFNPFTNL

SEQ ID NO: 339514 - protein, 20 aa, Mycobacterium
APEGMAIWIIGMVAAIGLAL

SEQ ID NO: 339515 - protein, 18 aa, Mycobacterium
APEHVRFGLFIAIALADM

SEQ ID NO: 339516 - protein, 17 aa, Mycobacterium
APFDWYLGVLARLASVS

SEQ ID NO: 339517 - protein, 17 aa, Mycobacterium
APFGYLTWLGWFAYTVV

SEQ ID NO: 339518 - protein, 21 aa, Mycobacterium
APFRLWLWIGVFATSVAVAAV

SEQ ID NO: 339519 - protein, 18 aa, Mycobacterium
APFRRSRLALAMTALGLY

SEQ ID NO: 339520 - protein, 25 aa, Mycobacterium
APKRLGMQYARRWAGLVAPLLRFLA

SEQ ID NO: 339521 - protein, 27 aa, Mycobacterium
APKRPPKWRHVPAILLVASLVLLTIAM

SEQ ID NO: 339522 - protein, 18 aa, Mycobacterium
APLACWICGLYGAVRGMN

SEQ ID NO: 339523 - protein, 22 aa, Mycobacterium
APLAERRCMVFAGTTVVAGTAL

SEQ ID NO: 339524 - protein, 17 aa, Mycobacterium
APLAIAVMWRWILAPTD

SEQ ID NO: 339525 - protein, 17 aa, Mycobacterium
APLAIGVLWHWMLAPTD

SEQ ID NO: 339526 - protein, 20 aa, Mycobacterium
APLKFAQLVGFVFAALSTLG

SEQ ID NO: 339527 - protein, 17 aa, Mycobacterium
APLLVVWVIAAALHVAV

SEQ ID NO: 339528 - protein, 17 aa, Mycobacterium
APLLYRRFKGWPAQRNQ

SEQ ID NO: 339529 - protein, 18 aa, Mycobacterium
APLPVAGWAVRSDPDGTS

SEQ ID NO: 339530 - protein, 17 aa, Mycobacterium
APLRPGRAVPVAARGAV

SEQ ID NO: 339531 - protein, 21 aa, Mycobacterium
APLWLPLLILAAWQYLQPPAV

SEQ ID NO: 339532 - protein, 21 aa, Mycobacterium
APLWREFLRFWTVSFPVVAYR

SEQ ID NO: 339533 - protein, 18 aa, Mycobacterium
APMVFGMVLAAYFTTRAI

SEQ ID NO: 339534 - protein, 17 aa, Mycobacterium
APPARRRVKVVPAILIA

SEQ ID NO: 339535 - protein, 25 aa, Mycobacterium
APPPPRMLLVGSALTFVAVSFATLA

SEQ ID NO: 339536 - protein, 19 aa, Mycobacterium
APPWLWLWIAGIGLSAGLT

SEQ ID NO: 339537 - protein, 18 aa, Mycobacterium
APQALAWSDADDVPDVAP

SEQ ID NO: 339538 - protein, 21 aa, Mycobacterium
APQTVRWTLRLDVTDVDGELK

SEQ ID NO: 339539 - protein, 18 aa, Mycobacterium
APRFARRRVGSAVDVVAL

SEQ ID NO: 339540 - protein, 21 aa, Mycobacterium
APRFLTRIHRRLGFSDDPPTH

SEQ ID NO: 339541 - protein, 23 aa, Mycobacterium
APRGKYWWVRWVILGIVAIVLAV

SEQ ID NO: 339542 - protein, 23 aa, Mycobacterium
APRIEFDCVTFGYGDHPVLDDVS

SEQ ID NO: 339543 - protein, 23 aa, Mycobacterium
APRNWRLSVDLRRDGDQIKMAKV

SEQ ID NO: 339544 - protein, 17 aa, Mycobacterium
APRRWSKRPARRARARW

SEQ ID NO: 339545 - protein, 20 aa, Mycobacterium
APRTNWWAIVSLIFGVIGGV

SEQ ID NO: 339546 - protein, 18 aa, Mycobacterium
APRWMKRVQEKLGLGETE

SEQ ID NO: 339547 - protein, 24 aa, Mycobacterium
APSGRFPWVAAIVFAFGLVLVACR

SEQ ID NO: 339548 - protein, 17 aa, Mycobacterium
APSWWPLNMTWGGLPSS

SEQ ID NO: 339549 - protein, 20 aa, Mycobacterium
APTKLSRRSLVIGNAVIAFA

SEQ ID NO: 339550 - protein, 24 aa, Mycobacterium
APTLTRLNSVIAMLEKNRDNLSQA

SEQ ID NO: 339551 - protein, 18 aa, Mycobacterium
APTPRPASVITIAPAGTA

SEQ ID NO: 339552 - protein, 28 aa, Mycobacterium
APTRHFPHLPPLPSVITIPGMPSPITLP

SEQ ID NO: 339553 - protein, 18 aa, Mycobacterium
APTTRLGSMFGYGVGYAV

SEQ ID NO: 339554 - protein, 18 aa, Mycobacterium
APVAPRITTEFVEVGGMT

SEQ ID NO: 339555 - protein, 25 aa, Mycobacterium
APVLRPPRTWSLRTRLILTQLLLLA

SEQ ID NO: 339556 - protein, 19 aa, Mycobacterium
APVSGRWRALLLAAVAACA

SEQ ID NO: 339557 - protein, 17 aa, Mycobacterium
APVVVWGAWPFHRAGWA

SEQ ID NO: 339558 - protein, 19 aa, Mycobacterium
APWLARKLGLGWAISLAMG

SEQ ID NO: 339559 - protein, 20 aa, Mycobacterium
APYLRIALRSAISPQIETTK

SEQ ID NO: 339560 - protein, 17 aa, Mycobacterium
APYPWPAVAAMFVIGVA

SEQ ID NO: 339561 - protein, 17 aa, Mycobacterium
AQAFSIQLICRILGMLA

SEQ ID NO: 339562 - protein, 19 aa, Mycobacterium
AQALARWRLAEAYEEIGQR

SEQ ID NO: 339563 - protein, 24 aa, Mycobacterium
AQAMRQGYRWARRALAISGAVTFG

SEQ ID NO: 339564 - protein, 23 aa, Mycobacterium
AQANRIAHRWMFTGAVPSGNSTD

SEQ ID NO: 339565 - protein, 22 aa, Mycobacterium
AQCSVGFGVGRGCDGLTVDGNR

SEQ ID NO: 339566 - protein, 22 aa, Mycobacterium
AQEWLKSIVPFGGFPWGSVAFG

SEQ ID NO: 339567 - protein, 19 aa, Mycobacterium
AQEWLKSLVPFGGFPWGSV

SEQ ID NO: 339568 - protein, 17 aa, Mycobacterium
AQFKVILTRLWESGLKP

SEQ ID NO: 339569 - protein, 22 aa, Mycobacterium
AQFWRRSGIRIVRRPIPHLVAS

SEQ ID NO: 339570 - protein, 22 aa, Mycobacterium
AQFWRRSGIRIVRRPVPHLVAS

SEQ ID NO: 339571 - protein, 18 aa, Mycobacterium
AQGTFPAMAIVLLLLGLQ

SEQ ID NO: 339572 - protein, 17 aa, Mycobacterium
AQIAALVPDSGWQGSAA

SEQ ID NO: 339573 - protein, 18 aa, Mycobacterium
AQIKLHFHLADPDGVALD

SEQ ID NO: 339574 - protein, 18 aa, Mycobacterium
AQIPLSFAQARLWFLDQL

SEQ ID NO: 339575 - protein, 17 aa, Mycobacterium
AQIPMYLGYAFRAMNTH

SEQ ID NO: 339576 - protein, 22 aa, Mycobacterium
AQKRFPALCGHLTTRGDYCINP

SEQ ID NO: 339577 - protein, 20 aa, Mycobacterium
AQLAALGPDGGWRGNAAQAY

SEQ ID NO: 339578 - protein, 20 aa, Mycobacterium
AQLSALWARFPLPVIPAPGD

SEQ ID NO: 339579 - protein, 26 aa, Mycobacterium
AQNLLRAGEKFTWLGRGMEVAKAGVD

SEQ ID NO: 339580 - protein, 20 aa, Mycobacterium
AQPDHYHWLSGYLGDRNLQG

SEQ ID NO: 339581 - protein, 17 aa, Mycobacterium
AQPRIYFGPVIASAADD

SEQ ID NO: 339582 - protein, 18 aa, Mycobacterium
AQRAIQMMIGVTLGIGLG

SEQ ID NO: 339583 - protein, 17 aa, Mycobacterium
AQRPRVWWAVAIGNSGA

SEQ ID NO: 339584 - protein, 21 aa, Mycobacterium
AQRWKAIRGELGWMTTYAYPA

SEQ ID NO: 339585 - protein, 18 aa, Mycobacterium
AQVPRRLPTITVDDPNPA

SEQ ID NO: 339586 - protein, 27 aa, Mycobacterium
ARAHVWPIPAFMLGIAMAARIEAGHAR

SEQ ID NO: 339587 - protein, 19 aa, Mycobacterium
ARAKGLGAHGVYFNHALSA

SEQ ID NO: 339588 - protein, 17 aa, Mycobacterium
ARALKLRREAELAEAKK

SEQ ID NO: 339589 - protein, 19 aa, Mycobacterium
ARALLGLAVGWLVGSLVVL

SEQ ID NO: 339590 - protein, 18 aa, Mycobacterium
ARARWPLRAPRAAMVLWQ

SEQ ID NO: 339591 - protein, 21 aa, Mycobacterium
ARATFLRWIWYAARREKLHLD

SEQ ID NO: 339592 - protein, 18 aa, Mycobacterium
ARDALRLAGITASDRVLT

SEQ ID NO: 339593 - protein, 19 aa, Mycobacterium
ARDGLGWLVVAGFAVAVSA

SEQ ID NO: 339594 - protein, 18 aa, Mycobacterium
ARDLRPGSALTYNDIRLE

SEQ ID NO: 339595 - protein, 23 aa, Mycobacterium
ARDRMPIELAIAVLVLVVLLMIY

SEQ ID NO: 339596 - protein, 19 aa, Mycobacterium
AREEPWTPIVLIVVITIVK

SEQ ID NO: 339597 - protein, 25 aa, Mycobacterium
ARELPNLRAAFRWTADRNDMDTCAP

SEQ ID NO: 339598 - protein, 19 aa, Mycobacterium
AREQWPILVVSAVFLAALG

SEQ ID NO: 339599 - protein, 19 aa, Mycobacterium
ARFIAWPPSRWGGISDVNP

SEQ ID NO: 339600 - protein, 19 aa, Mycobacterium
ARFNARTGYHLALRAGINT

SEQ ID NO: 339601 - protein, 17 aa, Mycobacterium
ARFVNWVAQQVTRQLNL

SEQ ID NO: 339602 - protein, 17 aa, Mycobacterium
ARFVNWVAQQVTRRVSL

SEQ ID NO: 339603 - protein, 23 aa, Mycobacterium
ARFWRRSGIRIVRRPRAHLVASM

SEQ ID NO: 339604 - protein, 19 aa, Mycobacterium
ARGPRLFRISVTTAFAGST

SEQ ID NO: 339605 - protein, 17 aa, Mycobacterium
ARHEILGIDGWRWLLIL

SEQ ID NO: 339606 - protein, 20 aa, Mycobacterium
ARIPEWILKALFVFVLLATA

SEQ ID NO: 339607 - protein, 24 aa, Mycobacterium
ARIPLGVAVTIEFAGPLMLAAAFS

SEQ ID NO: 339608 - protein, 20 aa, Mycobacterium
ARIRCLWVTFAGCAVLMSST

SEQ ID NO: 339609 - protein, 17 aa, Mycobacterium
ARIREFWLRSGRSAADL

SEQ ID NO: 339610 - protein, 21 aa, Mycobacterium
ARIREVIKLSGPDIYRDPAPV

SEQ ID NO: 339611 - protein, 19 aa, Mycobacterium
ARKRIAWLLLLGNMILAAG

SEQ ID NO: 339612 - protein, 20 aa, Mycobacterium
ARKRIAWLLLLGNMVLAAFL

SEQ ID NO: 339613 - protein, 19 aa, Mycobacterium
ARKRIAWLVLLGQIILAAG

SEQ ID NO: 339614 - protein, 21 aa, Mycobacterium
ARLAFVIAVIWVFLRRRGHHQ

SEQ ID NO: 339615 - protein, 17 aa, Mycobacterium
ARLDPPGGHLVSRDVVR

SEQ ID NO: 339616 - protein, 20 aa, Mycobacterium
ARLLKPWARIVVTLWVVTVV

SEQ ID NO: 339617 - protein, 19 aa, Mycobacterium
ARLLLPIVLGVLLGGSAAA

SEQ ID NO: 339618 - protein, 18 aa, Mycobacterium
ARLLTWRASWMAANGVSF

SEQ ID NO: 339619 - protein, 19 aa, Mycobacterium
ARLPFAFAAGLGINSFLAT

SEQ ID NO: 339620 - protein, 18 aa, Mycobacterium
ARLPGLWAATRPRLVRLV

SEQ ID NO: 339621 - protein, 23 aa, Mycobacterium
ARLPSWFPSWGFLSAVIAIGGMQ

SEQ ID NO: 339622 - protein, 18 aa, Mycobacterium
ARLRNPWMLLGAAALVAL

SEQ ID NO: 339623 - protein, 22 aa, Mycobacterium
ARLRPGVLHARRYVAIMGVAWL

SEQ ID NO: 339624 - protein, 19 aa, Mycobacterium
ARLRPRFASMVGLSEVMFA

SEQ ID NO: 339625 - protein, 19 aa, Mycobacterium
ARLTWVLAAAMLFVAVAFA

SEQ ID NO: 339626 - protein, 26 aa, Mycobacterium
ARLVLLWFLCSAFPIGVIATLVMLRS

SEQ ID NO: 339627 - protein, 20 aa, Mycobacterium
ARLYIRPVIHAMAAQPPTED

SEQ ID NO: 339628 - protein, 17 aa, Mycobacterium
ARLYPFQVFMDLYGLPL

SEQ ID NO: 339629 - protein, 27 aa, Mycobacterium
ARLYRRIGASVVRWPKPILVASAAAVL

SEQ ID NO: 339630 - protein, 20 aa, Mycobacterium
ARMDLAFSLAESWTEAGEAA

SEQ ID NO: 339631 - protein, 17 aa, Mycobacterium
ARNGFASLWSWIFGLVV

SEQ ID NO: 339632 - protein, 17 aa, Mycobacterium
ARNYPCIEHPGKRAPTV

SEQ ID NO: 339633 - protein, 18 aa, Mycobacterium
ARNYPCIEHPGKRAPTVE

SEQ ID NO: 339634 - protein, 18 aa, Mycobacterium
ARNYPCMGHPGKRAPTVE

SEQ ID NO: 339635 - protein, 18 aa, Mycobacterium
ARPKLAISDDALVYRGWF

SEQ ID NO: 339636 - protein, 20 aa, Mycobacterium
ARPLRVAFVLGVGMLADLRF

SEQ ID NO: 339637 - protein, 21 aa, Mycobacterium
ARPLWFVCIALGLVILAVGFF

SEQ ID NO: 339638 - protein, 19 aa, Mycobacterium
ARPPVAFAPGDDGYSDDLP

SEQ ID NO: 339639 - protein, 18 aa, Mycobacterium
ARPRLILGSAMVALPAFG

SEQ ID NO: 339640 - protein, 19 aa, Mycobacterium
ARPSIDWPLSADTWSLQPA

SEQ ID NO: 339641 - protein, 23 aa, Mycobacterium
ARPYQWWRLGLVMASGAAYLAIF

SEQ ID NO: 339642 - protein, 30 aa, Mycobacterium
ARPYRWWRLGLVIACGLAYVAIFSLPLAQR

SEQ ID NO: 339643 - protein, 17 aa, Mycobacterium
ARQAWQWLVTEVPQRSL

SEQ ID NO: 339644 - protein, 23 aa, Mycobacterium
ARQILRLGVPISLTYGSEAGITS

SEQ ID NO: 339645 - protein, 22 aa, Mycobacterium
ARRFSALALWCFIAMGVSGVIN

SEQ ID NO: 339646 - protein, 21 aa, Mycobacterium
ARRFSGLALWCFAAMAVSGFV

SEQ ID NO: 339647 - protein, 23 aa, Mycobacterium
ARRISTNGPRHWIEVRGLGCKHS

SEQ ID NO: 339648 - protein, 18 aa, Mycobacterium
ARRLAWSLLRTGLERTGS

SEQ ID NO: 339649 - protein, 21 aa, Mycobacterium
ARRPLIGVVWAWMTGRDDTWR

SEQ ID NO: 339650 - protein, 27 aa, Mycobacterium
ARRWRRIGTAIVRWPAPILVASLAVAL

SEQ ID NO: 339651 - protein, 20 aa, Mycobacterium
ARSLLGLAVGWFVGALVVLV

SEQ ID NO: 339652 - protein, 20 aa, Mycobacterium
ARSLLGLAVGWFVGALVVWV

SEQ ID NO: 339653 - protein, 19 aa, Mycobacterium
ARTGARFTAKVAWLTVGAG

SEQ ID NO: 339654 - protein, 20 aa, Mycobacterium
ARTIAWSRVLVFAVIPAVAL

SEQ ID NO: 339655 - protein, 20 aa, Mycobacterium
ARTQLWLSLLSWSVVVAVYF

SEQ ID NO: 339656 - protein, 19 aa, Mycobacterium
ARTTMLWGLGLLTLASCMF

SEQ ID NO: 339657 - protein, 23 aa, Mycobacterium
ARTWKTRLLTLLAIVGPGIIVMV

SEQ ID NO: 339658 - protein, 22 aa, Mycobacterium
ARVAQKLLLLWGVGAVLLTVLY

SEQ ID NO: 339659 - protein, 20 aa, Mycobacterium
ARVGEPFGSLVLAAAVTVIE

SEQ ID NO: 339660 - protein, 18 aa, Mycobacterium
ARVPARWAARKDGPPILL

SEQ ID NO: 339661 - protein, 17 aa, Mycobacterium
ARVPLVWPAAIVAIVSM

SEQ ID NO: 339662 - protein, 18 aa, Mycobacterium
ARVPMPIIPVSSLLRSHA

SEQ ID NO: 339663 - protein, 17 aa, Mycobacterium
ARVPRRVAVIAGATVLV

SEQ ID NO: 339664 - protein, 19 aa, Mycobacterium
ARWPGIKGVALVAMPGQDP

SEQ ID NO: 339665 - protein, 17 aa, Mycobacterium
ARWRRLWSRSAPVLAAY

SEQ ID NO: 339666 - protein, 17 aa, Mycobacterium
ARWSRRIAVQSAIVGMV

SEQ ID NO: 339667 - protein, 17 aa, Mycobacterium
ARWSRRIAVQSAVVGMS

SEQ ID NO: 339668 - protein, 17 aa, Mycobacterium
ARWWSIGALDALVIAVL

SEQ ID NO: 339669 - protein, 20 aa, Mycobacterium
ARYGYTFGIVGCVLLAIPAL

SEQ ID NO: 339670 - protein, 18 aa, Mycobacterium
ARYLSVFLLLLVGVYLLV

SEQ ID NO: 339671 - protein, 17 aa, Mycobacterium
ASAALWVRRWPTRGQSA

SEQ ID NO: 339672 - protein, 24 aa, Mycobacterium
ASALCFLPGLILGIFAQFTIPFAI

SEQ ID NO: 339673 - protein, 17 aa, Mycobacterium
ASARFGFLLAIPAVLAS

SEQ ID NO: 339674 - protein, 17 aa, Mycobacterium
ASARGAGRLGFAGTAPA

SEQ ID NO: 339675 - protein, 20 aa, Mycobacterium
ASASRWTPSRVQPVRRTTTA

SEQ ID NO: 339676 - protein, 17 aa, Mycobacterium
ASAWLSQLYPLWRDITK

SEQ ID NO: 339677 - protein, 18 aa, Mycobacterium
ASDGWAFTCVALVVAAVV

SEQ ID NO: 339678 - protein, 26 aa, Mycobacterium
ASDPSARCLRCWLGSLLILSALWALR

SEQ ID NO: 339679 - protein, 29 aa, Mycobacterium
ASESHSDWGWLWWFGGAWAVLAVAGAAVI

SEQ ID NO: 339680 - protein, 19 aa, Mycobacterium
ASFAWQFVFYLGQIVVAYG

SEQ ID NO: 339681 - protein, 20 aa, Mycobacterium
ASFMGFYWMDHRVVGGIGFE

SEQ ID NO: 339682 - protein, 21 aa, Mycobacterium
ASFMLCAAFNVLLRGLCGRDT

SEQ ID NO: 339683 - protein, 24 aa, Mycobacterium
ASFYRCLFALRLLAPLAVAEWRGG

SEQ ID NO: 339684 - protein, 17 aa, Mycobacterium
ASGLTKWSVVIDAPPSS

SEQ ID NO: 339685 - protein, 20 aa, Mycobacterium
ASGPAWRLIGTTAFGLLLLT

SEQ ID NO: 339686 - protein, 18 aa, Mycobacterium
ASGPAWRLIGTTAIGLLL

SEQ ID NO: 339687 - protein, 20 aa, Mycobacterium
ASHLGVWFGHFPWWIPLGML

SEQ ID NO: 339688 - protein, 17 aa, Mycobacterium
ASHMPLLLGLAFALLVA

SEQ ID NO: 339689 - protein, 19 aa, Mycobacterium
ASICACVWLMVNLTALTWV

SEQ ID NO: 339690 - protein, 17 aa, Mycobacterium
ASISDWFLVATIPLAVM

SEQ ID NO: 339691 - protein, 18 aa, Mycobacterium
ASISDWFLVATIPLAVMN

SEQ ID NO: 339692 - protein, 20 aa, Mycobacterium
ASLCACLWLMVNLTALTWIR

SEQ ID NO: 339693 - protein, 23 aa, Mycobacterium
ASLGLRFYLNWITGTGYTYGALA

SEQ ID NO: 339694 - protein, 17 aa, Mycobacterium
ASLHAWAGVAMVLGPLL

SEQ ID NO: 339695 - protein, 17 aa, Mycobacterium
ASLWCVYAAMLSILVLV

SEQ ID NO: 339696 - protein, 22 aa, Mycobacterium
ASLWVTRWITRRSQPLFVAQWR

SEQ ID NO: 339697 - protein, 23 aa, Mycobacterium
ASMGRTFVWAGLWFYPIPIVLGL

SEQ ID NO: 339698 - protein, 18 aa, Mycobacterium
ASMPPLWVIVSCALAMAT

SEQ ID NO: 339699 - protein, 29 aa, Mycobacterium
ASMSPLIRWIIKVPREFINSYLFNFPDTS

SEQ ID NO: 339700 - protein, 17 aa, Mycobacterium
ASPRPVLFISPSARLAR

SEQ ID NO: 339701 - protein, 30 aa, Mycobacterium
ASQLPGHWQRLAVCWRLAQTHGLALGTLMR

SEQ ID NO: 339702 - protein, 17 aa, Mycobacterium
ASQMLRPYGPRTAVRQL

SEQ ID NO: 339703 - protein, 19 aa, Mycobacterium
ASRGASFVFRHRAGNAVIL

SEQ ID NO: 339704 - protein, 18 aa, Mycobacterium
ASRGWRAAAPLSRDDAWI

SEQ ID NO: 339705 - protein, 19 aa, Mycobacterium
ASRVEIYWLPAGIAAILVL

SEQ ID NO: 339706 - protein, 19 aa, Mycobacterium
ASSVAVIWFGGLRIDNGQM

SEQ ID NO: 339707 - protein, 18 aa, Mycobacterium
ASVLPVWLLLAPRDYLST

SEQ ID NO: 339708 - protein, 19 aa, Mycobacterium
ASVLPVWLLLAPRDYLSTF

SEQ ID NO: 339709 - protein, 22 aa, Mycobacterium
ASVMTHYRWLRALAGFGGLGMR

SEQ ID NO: 339710 - protein, 17 aa, Mycobacterium
ASVRFGRWIFLVGAAAR

SEQ ID NO: 339711 - protein, 17 aa, Mycobacterium
ASVRINYPLSRVVVDID

SEQ ID NO: 339712 - protein, 20 aa, Mycobacterium
ASVVAWEWLCARSERSGGQQ

SEQ ID NO: 339713 - protein, 24 aa, Mycobacterium
ASWQARAGAFAIDMLPGAGIIVTL

SEQ ID NO: 339714 - protein, 25 aa, Mycobacterium
ATAALAALRGRPGFPTTGVVALCDF

SEQ ID NO: 339715 - protein, 22 aa, Mycobacterium
ATARIGFDLGFAVLDHSQHDVA

SEQ ID NO: 339716 - protein, 22 aa, Mycobacterium
ATARIGFNLGFAVLDHSQHDVA

SEQ ID NO: 339717 - protein, 19 aa, Mycobacterium
ATARWTWPALGLAIVIVTY

SEQ ID NO: 339718 - protein, 17 aa, Mycobacterium
ATCKAWLLAQPHLVAGI

SEQ ID NO: 339719 - protein, 33 aa, Mycobacterium
ATCLLWITAEWKLRYALTLALFVSFGVTWFLAH

SEQ ID NO: 339720 - protein, 18 aa, Mycobacterium
ATCLPPGTVVRHRSAVLC

SEQ ID NO: 339721 - protein, 19 aa, Mycobacterium
ATCTVLAPLAMESRTIAST

SEQ ID NO: 339722 - protein, 23 aa, Mycobacterium
ATEATFLRWVWYAARRARLRLDG

SEQ ID NO: 339723 - protein, 24 aa, Mycobacterium
ATEIAKWGEFGMLPSFNARRHPHR

SEQ ID NO: 339724 - protein, 17 aa, Mycobacterium
ATFAIWWAWMNFTWFAS

SEQ ID NO: 339725 - protein, 28 aa, Mycobacterium
ATFRTPFQWREFILQSWFLLRVAFLPTV

SEQ ID NO: 339726 - protein, 24 aa, Mycobacterium
ATGARLRWVPLRGPSATPAQGLEH

SEQ ID NO: 339727 - protein, 19 aa, Mycobacterium
ATGCPFCRVMMTDGVDDVS

SEQ ID NO: 339728 - protein, 24 aa, Mycobacterium
ATGFLGRYLLLEWLRQLRRVDDKV

SEQ ID NO: 339729 - protein, 18 aa, Mycobacterium
ATGNLAWWVFVVAALVNR

SEQ ID NO: 339730 - protein, 17 aa, Mycobacterium
ATGRGTGPLGFAGTAPA

SEQ ID NO: 339731 - protein, 22 aa, Mycobacterium
ATGRWELSFGFLLVPLIALLAG

SEQ ID NO: 339732 - protein, 18 aa, Mycobacterium
ATGSWRWAFIIAGAVTVL

SEQ ID NO: 339733 - protein, 19 aa, Mycobacterium
ATGTACWYALFFAITQIPL

SEQ ID NO: 339734 - protein, 20 aa, Mycobacterium
ATGVRIGYRQAKARVTLHDM

SEQ ID NO: 339735 - protein, 23 aa, Mycobacterium
ATIIRMFLVPAVMKLLGDDCWWA

SEQ ID NO: 339736 - protein, 25 aa, Mycobacterium
ATIMIAKFFLCFAIIQQIVDFTQNI

SEQ ID NO: 339737 - protein, 19 aa, Mycobacterium
ATIPVQFIAGWPFLVGAVQ

SEQ ID NO: 339738 - protein, 18 aa, Mycobacterium
ATLAFLRYRWLRGEPLPP

SEQ ID NO: 339739 - protein, 17 aa, Mycobacterium
ATLGLRFYLGWITHTGY

SEQ ID NO: 339740 - protein, 17 aa, Mycobacterium
ATLGLRFYLRWITSTGY

SEQ ID NO: 339741 - protein, 24 aa, Mycobacterium
ATLILCLVCGLVLTRAAKTLSPAT

SEQ ID NO: 339742 - protein, 19 aa, Mycobacterium
ATLILSFLGGFFVEDNRGA

SEQ ID NO: 339743 - protein, 18 aa, Mycobacterium
ATLLFFRYRWLRAEPLPT

SEQ ID NO: 339744 - protein, 22 aa, Mycobacterium
ATLLGRANWWPSRVAAPARERV

SEQ ID NO: 339745 - protein, 17 aa, Mycobacterium
ATLLGRWFWWPLNVRTR

SEQ ID NO: 339746 - protein, 19 aa, Mycobacterium
ATLQRLLPRLGLTAQADQA

SEQ ID NO: 339747 - protein, 17 aa, Mycobacterium
ATLSRPAAAPVPYLTPA

SEQ ID NO: 339748 - protein, 25 aa, Mycobacterium
ATLVRLELPLAWPVIMTGIRVSAQM

SEQ ID NO: 339749 - protein, 17 aa, Mycobacterium
ATMIAVLGVGIFYVFVS

SEQ ID NO: 339750 - protein, 18 aa, Mycobacterium
ATMIAVLGVGVFYVFISW

SEQ ID NO: 339751 - protein, 18 aa, Mycobacterium
ATMLRMLVMFGIVTAVAL

SEQ ID NO: 339752 - protein, 17 aa, Mycobacterium
ATMPPLWVIVSCAVAMA

SEQ ID NO: 339753 - protein, 25 aa, Mycobacterium
ATNLGAWCPLAFWIAVAGLTPTGTV

SEQ ID NO: 339754 - protein, 18 aa, Mycobacterium
ATPIMRWLREVDGPTGQF

SEQ ID NO: 339755 - protein, 20 aa, Mycobacterium
ATPKCPGCLIGAAMHPSFLY

SEQ ID NO: 339756 - protein, 24 aa, Mycobacterium
ATPVWRLAVPIAFLGVGMVFAWPV

SEQ ID NO: 339757 - protein, 19 aa, Mycobacterium
ATQAFKASLPWLAGAIGTP

SEQ ID NO: 339758 - protein, 18 aa, Mycobacterium
ATRFEYRDALLLDTRGNV

SEQ ID NO: 339759 - protein, 20 aa, Mycobacterium
ATRPRLRRVTTFWFITHTLA

SEQ ID NO: 339760 - protein, 20 aa, Mycobacterium
ATSSLSLRWRVMLLAMSMVA

SEQ ID NO: 339761 - protein, 19 aa, Mycobacterium
ATSVGPWFPLAFLGAHILV

SEQ ID NO: 339762 - protein, 19 aa, Mycobacterium
ATSVGPWFPLAFLVVHIVV

SEQ ID NO: 339763 - protein, 22 aa, Mycobacterium
ATTARPELRFSHGPYADEDDYD

SEQ ID NO: 339764 - protein, 17 aa, Mycobacterium
ATTESWGSQGFYRDDLD

SEQ ID NO: 339765 - protein, 19 aa, Mycobacterium
ATTGCRWLAVTALSVVMVV

SEQ ID NO: 339766 - protein, 24 aa, Mycobacterium
ATTLWYLVMRDFRIALAGIGFALA

SEQ ID NO: 339767 - protein, 25 aa, Mycobacterium
ATTSAWRLLARFGYHLASLVLIVVL

SEQ ID NO: 339768 - protein, 17 aa, Mycobacterium
ATVAFFANFGWRALRRS

SEQ ID NO: 339769 - protein, 20 aa, Mycobacterium
ATVFLPFVFGYEVGNLVIQW

SEQ ID NO: 339770 - protein, 25 aa, Mycobacterium
ATVHRPRLWFALVFLMTIAVSFLLS

SEQ ID NO: 339771 - protein, 18 aa, Mycobacterium
ATVIRHYLGYGVAVATMG

SEQ ID NO: 339772 - protein, 21 aa, Mycobacterium
ATVLFALTGRRLWHRFRGQPD

SEQ ID NO: 339773 - protein, 19 aa, Mycobacterium
ATVPVQFVAGWPFLKAAAQ

SEQ ID NO: 339774 - protein, 19 aa, Mycobacterium
ATVPVQFVAGWPFLKEAVQ

SEQ ID NO: 339775 - protein, 19 aa, Mycobacterium
ATVPVQFVAGWPFLKGAVQ

SEQ ID NO: 339776 - protein, 19 aa, Mycobacterium
ATVPVQFVAGWPFLRGAVQ

SEQ ID NO: 339777 - protein, 19 aa, Mycobacterium
ATVPVQFVAGWPFLVGAVQ

SEQ ID NO: 339778 - protein, 19 aa, Mycobacterium
ATVPVQFVAGWPILKAAAQ

SEQ ID NO: 339779 - protein, 18 aa, Mycobacterium
ATVVLCLIWRLLSGGLTA

SEQ ID NO: 339780 - protein, 20 aa, Mycobacterium
ATYFWPVWPILGAGIGVLSH

SEQ ID NO: 339781 - protein, 17 aa, Mycobacterium
AVAARLSRVPVRDSLAL

SEQ ID NO: 339782 - protein, 20 aa, Mycobacterium
AVADRLGLRINFVGTEFSGL

SEQ ID NO: 339783 - protein, 36 aa, Mycobacterium
AVAFILMVCAFFRWGFPATMWAVPFAVFFLLSAGSW

SEQ ID NO: 339784 - protein, 17 aa, Mycobacterium
AVAFRYLIYGFTWLATG

SEQ ID NO: 339785 - protein, 25 aa, Mycobacterium
AVAGIGVGAAGLWSVLRGHAATWWA

SEQ ID NO: 339786 - protein, 25 aa, Mycobacterium
AVAGWLVHWPWFFGVSVWLIVIFGT

SEQ ID NO: 339787 - protein, 24 aa, Mycobacterium
AVAIRTVWVVLRFDPGANVDAVFR

SEQ ID NO: 339788 - protein, 17 aa, Mycobacterium
AVAIVFAVLLFPADPMT

SEQ ID NO: 339789 - protein, 17 aa, Mycobacterium
AVAKRLDCKVVQGYGMS

SEQ ID NO: 339790 - protein, 20 aa, Mycobacterium
AVALLVWRYGRLEQKWDPQS

SEQ ID NO: 339791 - protein, 17 aa, Mycobacterium
AVALRILFDVPLPVGGI

SEQ ID NO: 339792 - protein, 23 aa, Mycobacterium
AVATLLGRWFWWPRPLAWQTRKP

SEQ ID NO: 339793 - protein, 20 aa, Mycobacterium
AVCIVLRLARFNALLDVDQP

SEQ ID NO: 339794 - protein, 22 aa, Mycobacterium
AVCIVLRLARFNAMLAVDQPAY

SEQ ID NO: 339795 - protein, 20 aa, Mycobacterium
AVCIVLRLARFNTLLDDDTA

SEQ ID NO: 339796 - protein, 20 aa, Mycobacterium
AVCVVLRLARFNALQDDGSQ

SEQ ID NO: 339797 - protein, 18 aa, Mycobacterium
AVDSRLGRRVAVKVLKAE

SEQ ID NO: 339798 - protein, 17 aa, Mycobacterium
AVFALASAHSWRIKTRW

SEQ ID NO: 339799 - protein, 17 aa, Mycobacterium
AVFCVLGVLPLIALTQI

SEQ ID NO: 339800 - protein, 17 aa, Mycobacterium
AVFCVLGVLPLIVLTQV

SEQ ID NO: 339801 - protein, 18 aa, Mycobacterium
AVFGDFRIGFLFITVVTA

SEQ ID NO: 339802 - protein, 17 aa, Mycobacterium
AVFGIFAHRWLARRTRR

SEQ ID NO: 339803 - protein, 27 aa, Mycobacterium
AVFRDFPWRKVLPFSVAQLLGAFAAAL

SEQ ID NO: 339804 - protein, 17 aa, Mycobacterium
AVFWINLPICALAILLT

SEQ ID NO: 339805 - protein, 17 aa, Mycobacterium
AVGDGWVAAGSFYGGGS

SEQ ID NO: 339806 - protein, 18 aa, Mycobacterium
AVGGEWGGAVLMAVEHAP

SEQ ID NO: 339807 - protein, 19 aa, Mycobacterium
AVGLTLCWDGLNVVFASEQ

SEQ ID NO: 339808 - protein, 19 aa, Mycobacterium
AVGPEARRVLVTAPFGGEG

SEQ ID NO: 339809 - protein, 22 aa, Mycobacterium
AVGWASGLGFGWIYTLGTANVV

SEQ ID NO: 339810 - protein, 25 aa, Mycobacterium
AVHFWPADRGEAFIFAVCVVLFLTT

SEQ ID NO: 339811 - protein, 19 aa, Mycobacterium
AVICTVVILGGGDSGSVSA

SEQ ID NO: 339812 - protein, 21 aa, Mycobacterium
AVIIARLLWRWLRPKRQAEQT

SEQ ID NO: 339813 - protein, 22 aa, Mycobacterium
AVILCIFIYWGWDACLAVGEET

SEQ ID NO: 339814 - protein, 17 aa, Mycobacterium
AVILLTFHWARVVWSRT

SEQ ID NO: 339815 - protein, 18 aa, Mycobacterium
AVILWRFVGDTLSDRSDI

SEQ ID NO: 339816 - protein, 26 aa, Mycobacterium
AVIPWLFLRVRFFRRKLTVTALAATP

SEQ ID NO: 339817 - protein, 20 aa, Mycobacterium
AVIWWLAHRPNRTWWRFTAW

SEQ ID NO: 339818 - protein, 19 aa, Mycobacterium
AVLAAWGWFALLLQITGAI

SEQ ID NO: 339819 - protein, 19 aa, Mycobacterium
AVLAFALLMLFGFGMIWFG

SEQ ID NO: 339820 - protein, 22 aa, Mycobacterium
AVLARAVSRWTWLLSAVAMTAL

SEQ ID NO: 339821 - protein, 24 aa, Mycobacterium
AVLASACALALIGLLALPGYKTSY

SEQ ID NO: 339822 - protein, 18 aa, Mycobacterium
AVLCPLLVFGWLGCPELG

SEQ ID NO: 339823 - protein, 17 aa, Mycobacterium
AVLGYRTLVAIWRGRYA

SEQ ID NO: 339824 - protein, 18 aa, Mycobacterium
AVLICLGAVLLAYFKPLG

SEQ ID NO: 339825 - protein, 20 aa, Mycobacterium
AVLLCLLLGIAIVTQVRQTE

SEQ ID NO: 339826 - protein, 20 aa, Mycobacterium
AVLLCSLGFVMANRHHATGQ

SEQ ID NO: 339827 - protein, 19 aa, Mycobacterium
AVLLWEFSRGTVLQGSSAG

SEQ ID NO: 339828 - protein, 17 aa, Mycobacterium
AVLPIRLVVGWTYFSAF

SEQ ID NO: 339829 - protein, 18 aa, Mycobacterium
AVLPVAAVFLIWDEIAIA

SEQ ID NO: 339830 - protein, 17 aa, Mycobacterium
AVLPWLWQVRRLTPAGR

SEQ ID NO: 339831 - protein, 17 aa, Mycobacterium
AVLSFLFVSKWVEETRG

SEQ ID NO: 339832 - protein, 17 aa, Mycobacterium
AVLSGLFVWKWVRETKG

SEQ ID NO: 339833 - protein, 20 aa, Mycobacterium
AVLTTIFIYWGWDTAVACNE

SEQ ID NO: 339834 - protein, 34 aa, Mycobacterium
AVLVWGVGANLGWWKGLAGLWKWATDASHKAAAT

SEQ ID NO: 339835 - protein, 31 aa, Mycobacterium
AVLVWGVGANLGWWKGLAGLWQWATDASHKA

SEQ ID NO: 339836 - protein, 20 aa, Mycobacterium
AVMTKLRWVLLIVGGVGVAV

SEQ ID NO: 339837 - protein, 23 aa, Mycobacterium
AVMYIVIGAYGWVRLPTGQRLSH

SEQ ID NO: 339838 - protein, 18 aa, Mycobacterium
AVNSCIRCGLHAACGSPT

SEQ ID NO: 339839 - protein, 17 aa, Mycobacterium
AVPAHFLAGLNWPTAFL

SEQ ID NO: 339840 - protein, 17 aa, Mycobacterium
AVPAHWGERQVGALREA

SEQ ID NO: 339841 - protein, 17 aa, Mycobacterium
AVPAHWGPTTLRALRNA

SEQ ID NO: 339842 - protein, 23 aa, Mycobacterium
AVPEFYADAGWTWMAVAGVALTA

SEQ ID NO: 339843 - protein, 19 aa, Mycobacterium
AVPSMPRWLFVVLAFGGLT

SEQ ID NO: 339844 - protein, 18 aa, Mycobacterium
AVRLDLGKFFKWTGVFLI

SEQ ID NO: 339845 - protein, 18 aa, Mycobacterium
AVRPRLRGVSGRAWLSAL

SEQ ID NO: 339846 - protein, 19 aa, Mycobacterium
AVRTRGGADFGLFESGELT

SEQ ID NO: 339847 - protein, 19 aa, Mycobacterium
AVSLPLLWWRFRRDDRAAL

SEQ ID NO: 339848 - protein, 19 aa, Mycobacterium
AVSLPMLWWRFRRDDRAAL

SEQ ID NO: 339849 - protein, 19 aa, Mycobacterium
AVSSLPYWLGDSLRAASAG

SEQ ID NO: 339850 - protein, 18 aa, Mycobacterium
AVSSRAGVEIAIDDNGRG

SEQ ID NO: 339851 - protein, 18 aa, Mycobacterium
AVTDRLPLVLGLMAVITL

SEQ ID NO: 339852 - protein, 24 aa, Mycobacterium
AVTLELPASGGLYRFSNVTYRGVQ

SEQ ID NO: 339853 - protein, 20 aa, Mycobacterium
AVTMCALAAWAAYSLDSTVL

SEQ ID NO: 339854 - protein, 18 aa, Mycobacterium
AVTQGLFPVISLVLLGLG

SEQ ID NO: 339855 - protein, 23 aa, Mycobacterium
AVVAFAWRRPRFDPDKPGHPLPE

SEQ ID NO: 339856 - protein, 17 aa, Mycobacterium
AVVAGAFGWTYLRDRSH

SEQ ID NO: 339857 - protein, 18 aa, Mycobacterium
AVVAREFGFPCVVDAQGA

SEQ ID NO: 339858 - protein, 23 aa, Mycobacterium
AVVGWASGLGFGWIYTLGTANVV

SEQ ID NO: 339859 - protein, 17 aa, Mycobacterium
AVVIPFSTFVTAREMRE

SEQ ID NO: 339860 - protein, 18 aa, Mycobacterium
AVVMAGLLMLASSSSIAV

SEQ ID NO: 339861 - protein, 17 aa, Mycobacterium
AVVMPFGILLAGLLTPL

SEQ ID NO: 339862 - protein, 27 aa, Mycobacterium
AVVPAHWSEWMPAGVFFAAMALAQAGW

SEQ ID NO: 339863 - protein, 19 aa, Mycobacterium
AVVVFCVWLTALIVILKQA

SEQ ID NO: 339864 - protein, 19 aa, Mycobacterium
AVVWLLWVIFGYSMAFGTD

SEQ ID NO: 339865 - protein, 23 aa, Mycobacterium
AVWPLRWLRNAALAFTFLNALVD

SEQ ID NO: 339866 - protein, 24 aa, Mycobacterium
AWEVASDLFANWKRAMDLLGQGAL

SEQ ID NO: 339867 - protein, 17 aa, Mycobacterium
AWICSVIVVAAWGSILL

SEQ ID NO: 339868 - protein, 18 aa, Mycobacterium
AWKCTLCYDRLHDGLEPA

SEQ ID NO: 339869 - protein, 24 aa, Mycobacterium
AWLCWLVLHLVYLVGFKTKIVTLL

SEQ ID NO: 339870 - protein, 20 aa, Mycobacterium
AWLIHEMIIVAAVGISCLAL

SEQ ID NO: 339871 - protein, 17 aa, Mycobacterium
AWLRLCQTYGWSPGVMG

SEQ ID NO: 339872 - protein, 17 aa, Mycobacterium
AWLRLPLIGLIVLLGSD

SEQ ID NO: 339873 - protein, 17 aa, Mycobacterium
AWLRTWQAAVLIAVIVV

SEQ ID NO: 339874 - protein, 20 aa, Mycobacterium
AWLRYRWLRRTPLPVQRPTV

SEQ ID NO: 339875 - protein, 19 aa, Mycobacterium
AWLSWPGFVWLALVFYLVL

SEQ ID NO: 339876 - protein, 21 aa, Mycobacterium
AWLVLHLVYLVGFKTKISTLL

SEQ ID NO: 339877 - protein, 21 aa, Mycobacterium
AWLVLHLVYLVGFKTKVSTLL

SEQ ID NO: 339878 - protein, 22 aa, Mycobacterium
AWLVLHLYYLIGHRNRLAAMFA

SEQ ID NO: 339879 - protein, 23 aa, Mycobacterium
AWMGWLCVMFLRRGHEIPRRYLA

SEQ ID NO: 339880 - protein, 18 aa, Mycobacterium
AWPLVALAITAIVGVVLG

SEQ ID NO: 339881 - protein, 24 aa, Mycobacterium
AWQQGVRWARRLAWISLAVLVTEG

SEQ ID NO: 339882 - protein, 19 aa, Mycobacterium
AWRNLRFPLAWAPPEANVA

SEQ ID NO: 339883 - protein, 21 aa, Mycobacterium
AWRNLRFPLAWAPPEANVARI

SEQ ID NO: 339884 - protein, 19 aa, Mycobacterium
AWRNLRFPLTWAPPEANVA

SEQ ID NO: 339885 - protein, 21 aa, Mycobacterium
AWRNRMPPQRLALVMGSVAAV

SEQ ID NO: 339886 - protein, 18 aa, Mycobacterium
AWRRGREIYAEVAASEDV

SEQ ID NO: 339887 - protein, 22 aa, Mycobacterium
AWRYWRMVVGVVAAVAVLVIGS

SEQ ID NO: 339888 - protein, 18 aa, Mycobacterium
AWSWLKWLPHVDVPGRID

SEQ ID NO: 339889 - protein, 17 aa, Mycobacterium
AWTDWRFTQARAWLHRQ

SEQ ID NO: 339890 - protein, 20 aa, Mycobacterium
AWVMVCVLIAFPMRIAAAIG

SEQ ID NO: 339891 - protein, 18 aa, Mycobacterium
AWWLSFFPGLAIVITTVS

SEQ ID NO: 339892 - protein, 18 aa, Mycobacterium
AWYLNWGFFVAMGAILAL

SEQ ID NO: 339893 - protein, 25 aa, Mycobacterium
AYDIGLFYRYAWRNPTFADIVATRS

SEQ ID NO: 339894 - protein, 17 aa, Mycobacterium
AYDKTTCERLWKMPSSG

SEQ ID NO: 339895 - protein, 18 aa, Mycobacterium
AYEFGFWAGACLPLGLAL

SEQ ID NO: 339896 - protein, 20 aa, Mycobacterium
AYIAGLHWYLPRSAPMYADE

SEQ ID NO: 339897 - protein, 19 aa, Mycobacterium
AYLVMCGFIFVATQYLQFV

SEQ ID NO: 339898 - protein, 19 aa, Mycobacterium
AYRAGRWWLATAVAFFAVV

SEQ ID NO: 339899 - protein, 17 aa, Mycobacterium
AYRRPALFNPLNQAMTF

SEQ ID NO: 339900 - protein, 19 aa, Mycobacterium
AYTAWRFGDTQARGYLTLN

SEQ ID NO: 339901 - protein, 17 aa, Mycobacterium
AYWTTLHQLRWAILTVM

SEQ ID NO: 339902 - protein, 17 aa, Mycobacterium
AYWVSMLIVLGFQIPVD

SEQ ID NO: 339903 - protein, 21 aa, Mycobacterium
CAAVLFWLAWKSMRTAFRGKH

SEQ ID NO: 339904 - protein, 17 aa, Mycobacterium
CAGWLPWFANIDRQMYF

SEQ ID NO: 339905 - protein, 18 aa, Mycobacterium
CAIARIPLGIAVTIEVLG

SEQ ID NO: 339906 - protein, 20 aa, Mycobacterium
CAKDPGALSFSWRLSVCTIR

SEQ ID NO: 339907 - protein, 17 aa, Mycobacterium
CALAALCYAEFASTLPV

SEQ ID NO: 339908 - protein, 23 aa, Mycobacterium
CALAALCYAEFASTLPVAGSAYT

SEQ ID NO: 339909 - protein, 18 aa, Mycobacterium
CALLSRIAAELPQLHSGF

SEQ ID NO: 339910 - protein, 19 aa, Mycobacterium
CALSLPPLLLGMLGSLAYI

SEQ ID NO: 339911 - protein, 19 aa, Mycobacterium
CAPFCAVQAWPQLGRQRLS

SEQ ID NO: 339912 - protein, 20 aa, Mycobacterium
CAPLAIAVLWRWILAPTDGA

SEQ ID NO: 339913 - protein, 18 aa, Mycobacterium
CAQYLAPIMDAIKFNYLP

SEQ ID NO: 339914 - protein, 17 aa, Mycobacterium
CAVGRRLSGCLADGDTL

SEQ ID NO: 339915 - protein, 19 aa, Mycobacterium
CAVVALALFLWWEGRTPAP

SEQ ID NO: 339916 - protein, 17 aa, Mycobacterium
CAWVGGLCGIVKRKGRG

SEQ ID NO: 339917 - protein, 25 aa, Mycobacterium
CDRTRGAAFLAMFFASAGLFGVVLS

SEQ ID NO: 339918 - protein, 19 aa, Mycobacterium
CDVTARLGLLGMRNDVLVP

SEQ ID NO: 339919 - protein, 29 aa, Mycobacterium
CEIVCAALICAACLTALVLNGVRADKRTV

SEQ ID NO: 339920 - protein, 19 aa, Mycobacterium
CENWRGGYDINRRRDHDLR

SEQ ID NO: 339921 - protein, 18 aa, Mycobacterium
CESDRPFEPLAMRQHVTG

SEQ ID NO: 339922 - protein, 27 aa, Mycobacterium
CFTVPPRSVWWWPCVAVIGATVLLMLV

SEQ ID NO: 339923 - protein, 19 aa, Mycobacterium
CFVSAAAVAARFGAAALAA

SEQ ID NO: 339924 - protein, 19 aa, Mycobacterium
CFVSAGAVAARFGAAAVAA

SEQ ID NO: 339925 - protein, 18 aa, Mycobacterium
CGAEHHPAERFCPNCGKH

SEQ ID NO: 339926 - protein, 24 aa, Mycobacterium
CGDRAGGHPGDWARMLGIGEIATY

SEQ ID NO: 339927 - protein, 20 aa, Mycobacterium
CGGTLKALLLSGGAMSALAL

SEQ ID NO: 339928 - protein, 20 aa, Mycobacterium
CGIASIIQAVGFWKVGVRLP

SEQ ID NO: 339929 - protein, 23 aa, Mycobacterium
CGLAAMCYAEFASTIPVAGSAYT

SEQ ID NO: 339930 - protein, 17 aa, Mycobacterium
CGMALAFDRDKLPDLHG

SEQ ID NO: 339931 - protein, 18 aa, Mycobacterium
CGMFPVLAVFLIFTLSVD

SEQ ID NO: 339932 - protein, 21 aa, Mycobacterium
CGMWLPIWILVAIFGGGGTSA

SEQ ID NO: 339933 - protein, 33 aa, Mycobacterium
CGNGLRPAIWDDFTKRFGIDRVCEFYSASESNT

SEQ ID NO: 339934 - protein, 20 aa, Mycobacterium
CGRALRATWLMAARGTGGAA

SEQ ID NO: 339935 - protein, 18 aa, Mycobacterium
CGSAIGITLLYLGYLRRQ

SEQ ID NO: 339936 - protein, 20 aa, Mycobacterium
CGTALFVAAVALTFLAVTTS

SEQ ID NO: 339937 - protein, 17 aa, Mycobacterium
CGVAVIWWLAHRPNRTW

SEQ ID NO: 339938 - protein, 18 aa, Mycobacterium
CGVKRSWALSETNPTLDL

SEQ ID NO: 339939 - protein, 23 aa, Mycobacterium
CGVSWLYRYAVGVYRDDRGCGQV

SEQ ID NO: 339940 - protein, 20 aa, Mycobacterium
CIAAILLARVFVRPIRRLEA

SEQ ID NO: 339941 - protein, 18 aa, Mycobacterium
CIFILPGRRWVRPAEQWA

SEQ ID NO: 339942 - protein, 19 aa, Mycobacterium
CIVVLLLAIWRGRRLGPVI

SEQ ID NO: 339943 - protein, 17 aa, Mycobacterium
CIWYFRRELFTDAHNIV

SEQ ID NO: 339944 - protein, 17 aa, Mycobacterium
CKAWLLGHGYLVTTVLL

SEQ ID NO: 339945 - protein, 22 aa, Mycobacterium
CLAGGISVLIAWWMWEKRATRP

SEQ ID NO: 339946 - protein, 20 aa, Mycobacterium
CLALLAWFWPRLVEQGMAVP

SEQ ID NO: 339947 - protein, 19 aa, Mycobacterium
CLGFARLGYFNTMGPACAI

SEQ ID NO: 339948 - protein, 19 aa, Mycobacterium
CLHFTRLNYFSSMGIPSAI

SEQ ID NO: 339949 - protein, 20 aa, Mycobacterium
CLHFTRLPYFQTMGIPCAIG

SEQ ID NO: 339950 - protein, 19 aa, Mycobacterium
CLLIAFPVAYYVARLSGRR

SEQ ID NO: 339951 - protein, 20 aa, Mycobacterium
CLLLAFPLAYVIAFKAGRFK

SEQ ID NO: 339952 - protein, 20 aa, Mycobacterium
CLLVMYWPLGLVVLGSIVPI

SEQ ID NO: 339953 - protein, 18 aa, Mycobacterium
CLQHAYPLGTDDRMLVKT

SEQ ID NO: 339954 - protein, 20 aa, Mycobacterium
CLRRARALGANWVEVKKEAN

SEQ ID NO: 339955 - protein, 20 aa, Mycobacterium
CLSFARLPYFNTLGPPCAIG

SEQ ID NO: 339956 - protein, 20 aa, Mycobacterium
CLSFARLPYFQTLAAPCAIG

SEQ ID NO: 339957 - protein, 21 aa, Mycobacterium
CLSFTRLPYFQSLGVPAALGI

SEQ ID NO: 339958 - protein, 21 aa, Mycobacterium
CLSFTRLPYFQSLGVPLALGM

SEQ ID NO: 339959 - protein, 21 aa, Mycobacterium
CLSFTRLPYFQSLGVPVAIGI

SEQ ID NO: 339960 - protein, 20 aa, Mycobacterium
CLSFTRLPYFQTLGVPAALG

SEQ ID NO: 339961 - protein, 21 aa, Mycobacterium
CLSFTRLPYFQTMGIPCAVGM

SEQ ID NO: 339962 - protein, 21 aa, Mycobacterium
CLSFTRLPYFQTMGVPLAIGM

SEQ ID NO: 339963 - protein, 21 aa, Mycobacterium
CLSLARLPYFQTLGVPCAVGM

SEQ ID NO: 339964 - protein, 21 aa, Mycobacterium
CLSLTRLPLFRSMGVPCALVI

SEQ ID NO: 339965 - protein, 25 aa, Mycobacterium
CLTSWRPGTNWGDWLLKRCSRLFRP

SEQ ID NO: 339966 - protein, 17 aa, Mycobacterium
CLVAAGFVAWAPATIAL

SEQ ID NO: 339967 - protein, 17 aa, Mycobacterium
CLVLIYGIALVWGLPNL

SEQ ID NO: 339968 - protein, 23 aa, Mycobacterium
CNDPRGFVPMAIRQHITGPYPFD

SEQ ID NO: 339969 - protein, 17 aa, Mycobacterium
CPERLAWVAALAPDDRM

SEQ ID NO: 339970 - protein, 19 aa, Mycobacterium
CPRCRGTLLAPSGPAPAQG

SEQ ID NO: 339971 - protein, 19 aa, Mycobacterium
CPVWFYELWAFITPGLYKK

SEQ ID NO: 339972 - protein, 17 aa, Mycobacterium
CQRAIPHVIDWYNRYHD

SEQ ID NO: 339973 - protein, 19 aa, Mycobacterium
CRPIPRLGGHPALSPEPVS

SEQ ID NO: 339974 - protein, 19 aa, Mycobacterium
CRRFRHLLLAFTVGAEHFT

SEQ ID NO: 339975 - protein, 29 aa, Mycobacterium
CRSLTRSAWRIGFWSNRWIIFGVAAQAIA

SEQ ID NO: 339976 - protein, 19 aa, Mycobacterium
CRYYRRHGWRHGPRRDDRA

SEQ ID NO: 339977 - protein, 19 aa, Mycobacterium
CSAICRHYWPIAMIAAVLF

SEQ ID NO: 339978 - protein, 23 aa, Mycobacterium
CSGAGKGSIFWGIAGGLGPAVKS

SEQ ID NO: 339979 - protein, 17 aa, Mycobacterium
CSIGATLGNGGWATLLN

SEQ ID NO: 339980 - protein, 23 aa, Mycobacterium
CSITLGALGHRWFAGAGAEPESG

SEQ ID NO: 339981 - protein, 19 aa, Mycobacterium
CSLAGYAFARLDFRGRDAL

SEQ ID NO: 339982 - protein, 19 aa, Mycobacterium
CSLAGYAFARLHFRGRDTL

SEQ ID NO: 339983 - protein, 19 aa, Mycobacterium
CSLAGYAFARLQFRGRDTL

SEQ ID NO: 339984 - protein, 20 aa, Mycobacterium
CSLRLPGLYPPGLYNGTLHV

SEQ ID NO: 339985 - protein, 17 aa, Mycobacterium
CSTGEFRVQAGLFSSIV

SEQ ID NO: 339986 - protein, 18 aa, Mycobacterium
CSTREKLAILFTGRGLVV

SEQ ID NO: 339987 - protein, 17 aa, Mycobacterium
CSVGFLPPSSWRSPADL

SEQ ID NO: 339988 - protein, 18 aa, Mycobacterium
CSVLHAWAGVGAAGAEFV

SEQ ID NO: 339989 - protein, 18 aa, Mycobacterium
CSVLLPAIRRERISLRPL

SEQ ID NO: 339990 - protein, 18 aa, Mycobacterium
CTALSLSPYRTWRAVVLP

SEQ ID NO: 339991 - protein, 23 aa, Mycobacterium
CTVLFPLTMRWLAGEIMTPPRSF

SEQ ID NO: 339992 - protein, 21 aa, Mycobacterium
CVEVLEWLAWSALVPLACWIS

SEQ ID NO: 339993 - protein, 21 aa, Mycobacterium
CVKAEMLAASSWRVAVSAGAD

SEQ ID NO: 339994 - protein, 19 aa, Mycobacterium
CVLLFPVVQPWYLLWAIIP

SEQ ID NO: 339995 - protein, 20 aa, Mycobacterium
CVVPGFLLELMVAFFTSDLV

SEQ ID NO: 339996 - protein, 19 aa, Mycobacterium
CVVVALFALWQARRLGPLV

SEQ ID NO: 339997 - protein, 21 aa, Mycobacterium
CVYAFFLTFFVYRDIPLSGFI

SEQ ID NO: 339998 - protein, 19 aa, Mycobacterium
CWWAPRWARRLQNKIGLGE

SEQ ID NO: 339999 - protein, 22 aa, Mycobacterium
CYLCAAALTWARYVRPRSPVAS

SEQ ID NO: 340000 - protein, 17 aa, Mycobacterium
CYLPAFLCLGIVPVVAG

SEQ ID NO: 340001 - protein, 19 aa, Mycobacterium
CYTALLGICCDLYEPVTWA

SEQ ID NO: 340002 - protein, 18 aa, Mycobacterium
DAAVLEWVTQYWNQFLLW

SEQ ID NO: 340003 - protein, 20 aa, Mycobacterium
DAAVWWKALLALAVSLALIV

SEQ ID NO: 340004 - protein, 20 aa, Mycobacterium
DACPWPPPTVFLMRRGANGN

SEQ ID NO: 340005 - protein, 18 aa, Mycobacterium
DADALRWAAALEARSEHP

SEQ ID NO: 340006 - protein, 23 aa, Mycobacterium
DADSRMVFVPARFGRQDYCAMLR

SEQ ID NO: 340007 - protein, 22 aa, Mycobacterium
DAFETWGWRIPFLLSGVLVAVG

SEQ ID NO: 340008 - protein, 18 aa, Mycobacterium
DAFPASFIVKLKDPEKHA

SEQ ID NO: 340009 - protein, 24 aa, Mycobacterium
DAGERGAVCAISWTQTALATGMLA

SEQ ID NO: 340010 - protein, 18 aa, Mycobacterium
DAGPFLSYGIQWITFGIL

SEQ ID NO: 340011 - protein, 18 aa, Mycobacterium
DAGVRYGLMSSREGTSTE

SEQ ID NO: 340012 - protein, 18 aa, Mycobacterium
DAHLPFRSGRAFSASVTG

SEQ ID NO: 340013 - protein, 27 aa, Mycobacterium
DAHRRMGWPRLLAYGVLPGLALALALL

SEQ ID NO: 340014 - protein, 25 aa, Mycobacterium
DAIRARIPWVLGFIAAVTFTLLFLL

SEQ ID NO: 340015 - protein, 24 aa, Mycobacterium
DAITQRLPIVFALIALITFALLFL

SEQ ID NO: 340016 - protein, 23 aa, Mycobacterium
DAKDRFDTCHDFAVALAEANKGD

SEQ ID NO: 340017 - protein, 17 aa, Mycobacterium
DAKRALSTRGWRRVGTA

SEQ ID NO: 340018 - protein, 19 aa, Mycobacterium
DAKRIPVPLARAIVDCGVY

SEQ ID NO: 340019 - protein, 18 aa, Mycobacterium
DALAGICAHVRRGGGGLT

SEQ ID NO: 340020 - protein, 23 aa, Mycobacterium
DALELRARILGAFEAAEVATDPA

SEQ ID NO: 340021 - protein, 23 aa, Mycobacterium
DALELRGRILGAFEAAEVATDHD

SEQ ID NO: 340022 - protein, 23 aa, Mycobacterium
DALELRGRILGAFEAAEVATDPA

SEQ ID NO: 340023 - protein, 20 aa, Mycobacterium
DALELRGRILGSFEQAERSS

SEQ ID NO: 340024 - protein, 19 aa, Mycobacterium
DALPWRAPTVLLMRQSGDN

SEQ ID NO: 340025 - protein, 18 aa, Mycobacterium
DALRDWRSPIAWLSRYRP

SEQ ID NO: 340026 - protein, 20 aa, Mycobacterium
DALYGLRGMIFGEQATRDVQ

SEQ ID NO: 340027 - protein, 19 aa, Mycobacterium
DALYGLRTMLFGEQVQMRD

SEQ ID NO: 340028 - protein, 25 aa, Mycobacterium
DALYGLRTSLFGAPPAVRTDPVVLS

SEQ ID NO: 340029 - protein, 27 aa, Mycobacterium
DAMHTWGWRIPFLVALPMGLIGWYLRS

SEQ ID NO: 340030 - protein, 17 aa, Mycobacterium
DAPHCGISWGWGAHGLV

SEQ ID NO: 340031 - protein, 20 aa, Mycobacterium
DAPPGWLPDWLRPVGSRRAS

SEQ ID NO: 340032 - protein, 22 aa, Mycobacterium
DAQPRLAILLGDYAVPVEGRVA

SEQ ID NO: 340033 - protein, 21 aa, Mycobacterium
DARIAGIGAFVFAWLAMVGLI

SEQ ID NO: 340034 - protein, 24 aa, Mycobacterium
DASLRASLLWGYSHYFIFASVAAI

SEQ ID NO: 340035 - protein, 22 aa, Mycobacterium
DASLRWVDVVGMSMLAGIGFTV

SEQ ID NO: 340036 - protein, 22 aa, Mycobacterium
DATDSLLRFAVRSDATLTGLFG

SEQ ID NO: 340037 - protein, 17 aa, Mycobacterium
DAVICYIGFLLPLFTAK

SEQ ID NO: 340038 - protein, 18 aa, Mycobacterium
DAWALTVVHLRLSLVPVL

SEQ ID NO: 340039 - protein, 22 aa, Mycobacterium
DAWEGGSSWVAWVIGLISVPVD

SEQ ID NO: 340040 - protein, 18 aa, Mycobacterium
DAWLRLCQTYGWSPGVMG

SEQ ID NO: 340041 - protein, 21 aa, Mycobacterium
DAWRFGWIVSIGRAITGGVGG

SEQ ID NO: 340042 - protein, 17 aa, Mycobacterium
DCGTTFTWASRTFGPIV

SEQ ID NO: 340043 - protein, 18 aa, Mycobacterium
DCLFGLLALLAVLNAATL

SEQ ID NO: 340044 - protein, 20 aa, Mycobacterium
DCPRYGELRAPSCFTAPLVQ

SEQ ID NO: 340045 - protein, 20 aa, Mycobacterium
DCWWAPRWMRRVQTRIGLGE

SEQ ID NO: 340046 - protein, 17 aa, Mycobacterium
DDAELRSTIGFFAEDAH

SEQ ID NO: 340047 - protein, 23 aa, Mycobacterium
DDALRFAYFPVLFVALAVAVNVL

SEQ ID NO: 340048 - protein, 21 aa, Mycobacterium
DDEIRVPWTLKPRERTSTGRK

SEQ ID NO: 340049 - protein, 20 aa, Mycobacterium
DDELRWIAGTAYVGSGADPA

SEQ ID NO: 340050 - protein, 18 aa, Mycobacterium
DDGFKRKKIVDVLRESLH

SEQ ID NO: 340051 - protein, 23 aa, Mycobacterium
DDLRFAVAGIARFSETLNQRDAQ

SEQ ID NO: 340052 - protein, 27 aa, Mycobacterium
DDLSERVGWRWRLVWYRAVSELLTGAY

SEQ ID NO: 340053 - protein, 17 aa, Mycobacterium
DDPKTEFIQPLATQARP

SEQ ID NO: 340054 - protein, 23 aa, Mycobacterium
DDQMGSWGWRLPFLVAAPLGLIG

SEQ ID NO: 340055 - protein, 23 aa, Mycobacterium
DDRASALAGLWLIIELNLAVPLA

SEQ ID NO: 340056 - protein, 21 aa, Mycobacterium
DDRFERCRGFAAAVADRLGDV

SEQ ID NO: 340057 - protein, 23 aa, Mycobacterium
DDRRIKLWVVFVEDFSGQNYIGW

SEQ ID NO: 340058 - protein, 22 aa, Mycobacterium
DDRYPRCIDFAKALAAGPGSIA

SEQ ID NO: 340059 - protein, 27 aa, Mycobacterium
DDYPPLPWYRRPLVWFIAAAAVAGIAF

SEQ ID NO: 340060 - protein, 22 aa, Mycobacterium
DEADLRCAIGLFAEDAHIFATT

SEQ ID NO: 340061 - protein, 25 aa, Mycobacterium
DEARIDRRWMWIAGVAGAILFVAVI

SEQ ID NO: 340062 - protein, 24 aa, Mycobacterium
DEARSGDRWLWWNLGDVVRRASNV

SEQ ID NO: 340063 - protein, 20 aa, Mycobacterium
DEAWYAFATAVPWARQRTAM

SEQ ID NO: 340064 - protein, 20 aa, Mycobacterium
DEDLAWRDVLGLALLAGIGF

SEQ ID NO: 340065 - protein, 20 aa, Mycobacterium
DEFVRRLPFMGAKRDFSEPV

SEQ ID NO: 340066 - protein, 20 aa, Mycobacterium
DEIMAWGWRVPFLASSALLL

SEQ ID NO: 340067 - protein, 18 aa, Mycobacterium
DELLYRLAYEGSTVPGGW

SEQ ID NO: 340068 - protein, 19 aa, Mycobacterium
DENFLIVGMDSRFGENSQM

SEQ ID NO: 340069 - protein, 28 aa, Mycobacterium
DEPSTPRWPWVVGVAAIMAAIALVASVS

SEQ ID NO: 340070 - protein, 17 aa, Mycobacterium
DERARWSLGETVTLRGH

SEQ ID NO: 340071 - protein, 22 aa, Mycobacterium
DESRCVLESPGIYTPEGTALIE

SEQ ID NO: 340072 - protein, 20 aa, Mycobacterium
DEVLYFFLVESAIVFVAAYV

SEQ ID NO: 340073 - protein, 23 aa, Mycobacterium
DEWNWWLPRWLDRLLPSVDFEKP

SEQ ID NO: 340074 - protein, 21 aa, Mycobacterium
DEYAVAMMLAAWREDVGREPM

SEQ ID NO: 340075 - protein, 19 aa, Mycobacterium
DFAEFRLGSTRLRKVAMLV

SEQ ID NO: 340076 - protein, 22 aa, Mycobacterium
DFFSFYLCDVVLKLNGRGGQPV

SEQ ID NO: 340077 - protein, 23 aa, Mycobacterium
DFPGKRLLVGVALLITMFPAISL

SEQ ID NO: 340078 - protein, 17 aa, Mycobacterium
DFRLRWSWRELWIGIAF

SEQ ID NO: 340079 - protein, 22 aa, Mycobacterium
DFSKAAVVAGIYGDAGPDIATV

SEQ ID NO: 340080 - protein, 19 aa, Mycobacterium
DGALARWNWVLDGMVDTKA

SEQ ID NO: 340081 - protein, 18 aa, Mycobacterium
DGAPRWTGRVEFAHVSFA

SEQ ID NO: 340082 - protein, 18 aa, Mycobacterium
DGCGEFRKTDELQESAAP

SEQ ID NO: 340083 - protein, 20 aa, Mycobacterium
DGDARPGVEIKLGPDGEIFS

SEQ ID NO: 340084 - protein, 23 aa, Mycobacterium
DGEPRAGVVVGRARPVGKTVFVF

SEQ ID NO: 340085 - protein, 22 aa, Mycobacterium
DGESRPGWFVSRRVDILFVFGL

SEQ ID NO: 340086 - protein, 21 aa, Mycobacterium
DGFTHWAELLGLFVFAAMIAL

SEQ ID NO: 340087 - protein, 19 aa, Mycobacterium
DGGQAWLAVVVFVNSLVSL

SEQ ID NO: 340088 - protein, 17 aa, Mycobacterium
DGGTEWRAVSRHDALGG

SEQ ID NO: 340089 - protein, 17 aa, Mycobacterium
DGGWRGNAAQAYWVQNL

SEQ ID NO: 340090 - protein, 18 aa, Mycobacterium
DGHPWRWFLIGFMVIFHL

SEQ ID NO: 340091 - protein, 22 aa, Mycobacterium
DGKSAFVLLRLAGDIGQTQANK

SEQ ID NO: 340092 - protein, 21 aa, Mycobacterium
DGKTARMLVVFDVEPDSYRAL

SEQ ID NO: 340093 - protein, 23 aa, Mycobacterium
DGLNRFASVLARSSDSLGRTLDT

SEQ ID NO: 340094 - protein, 19 aa, Mycobacterium
DGLTLGQALIFWASGRDQL

SEQ ID NO: 340095 - protein, 17 aa, Mycobacterium
DGLTSWLTGMFDRSAWR

SEQ ID NO: 340096 - protein, 18 aa, Mycobacterium
DGLYRWVRHPNYAAVAAE

SEQ ID NO: 340097 - protein, 20 aa, Mycobacterium
DGMTCASCAARIERKLNKLA

SEQ ID NO: 340098 - protein, 23 aa, Mycobacterium
DGPLRLGHWLLFAVISVSSLGAM

SEQ ID NO: 340099 - protein, 24 aa, Mycobacterium
DGSCFRLTLPLVRGHKVTTSPLPM

SEQ ID NO: 340100 - protein, 17 aa, Mycobacterium
DGSIVWCALTAVIVHAP

SEQ ID NO: 340101 - protein, 28 aa, Mycobacterium
DGSVHRAEWALTEAMRVLIADAVSSANF

SEQ ID NO: 340102 - protein, 17 aa, Mycobacterium
DGTNFWTGWILQLAAIF

SEQ ID NO: 340103 - protein, 20 aa, Mycobacterium
DGTPMRRASVLRLFEHRAAE

SEQ ID NO: 340104 - protein, 23 aa, Mycobacterium
DGVAGAAGWVILLCLAFSALGKG

SEQ ID NO: 340105 - protein, 17 aa, Mycobacterium
DGVREFPGPWALVPVGA

SEQ ID NO: 340106 - protein, 18 aa, Mycobacterium
DGVVLHWVTDYWNHFSLW

SEQ ID NO: 340107 - protein, 20 aa, Mycobacterium
DGVVPRLAQRFRVIRYDNRG

SEQ ID NO: 340108 - protein, 17 aa, Mycobacterium
DGWECQRAMSVANNVIV

SEQ ID NO: 340109 - protein, 19 aa, Mycobacterium
DGWRRARVAGLGLGVAVAA

SEQ ID NO: 340110 - protein, 18 aa, Mycobacterium
DHEFGLWAGLSVDNTAET

SEQ ID NO: 340111 - protein, 24 aa, Mycobacterium
DHELRFAQMFPLARLVRDAMRGAV

SEQ ID NO: 340112 - protein, 19 aa, Mycobacterium
DHFAYLVGFGIPDASGVYM

SEQ ID NO: 340113 - protein, 17 aa, Mycobacterium
DHFRSGLLFALASAFAF

SEQ ID NO: 340114 - protein, 17 aa, Mycobacterium
DHLELGEALGLIDMERG

SEQ ID NO: 340115 - protein, 17 aa, Mycobacterium
DHPRLGSLAGYLDELDP

SEQ ID NO: 340116 - protein, 21 aa, Mycobacterium
DHPRTSVVIIRMSQLGMLDAT

SEQ ID NO: 340117 - protein, 18 aa, Mycobacterium
DHWVQLVLITPVMMYVGW

SEQ ID NO: 340118 - protein, 18 aa, Mycobacterium
DIEGLRFERGRWAVAQRT

SEQ ID NO: 340119 - protein, 25 aa, Mycobacterium
DIFLWEIFGPLSAGGRLVFPALGPG

SEQ ID NO: 340120 - protein, 18 aa, Mycobacterium
DILRHLYLPALTTFVFAG

SEQ ID NO: 340121 - protein, 21 aa, Mycobacterium
DINVALPWTKTVVLDPGVELK

SEQ ID NO: 340122 - protein, 19 aa, Mycobacterium
DIQRMAGLMPQMVVLMPPM

SEQ ID NO: 340123 - protein, 18 aa, Mycobacterium
DITVRWMYWWGLFITAAD

SEQ ID NO: 340124 - protein, 18 aa, Mycobacterium
DKALRRKGTRLGVRTLAI

SEQ ID NO: 340125 - protein, 17 aa, Mycobacterium
DKARAAVTQGLFPVISL

SEQ ID NO: 340126 - protein, 20 aa, Mycobacterium
DKGITTWLLWDGKRSQIDLA

SEQ ID NO: 340127 - protein, 24 aa, Mycobacterium
DKHCFDIPICWSIRSIFDALDGVD

SEQ ID NO: 340128 - protein, 25 aa, Mycobacterium
DKHCYDIPVCWSIRSIFDMIDNVDQ

SEQ ID NO: 340129 - protein, 20 aa, Mycobacterium
DKSIRRRSLIYLGYSSFRAA

SEQ ID NO: 340130 - protein, 24 aa, Mycobacterium
DKSRSRAAGSFGLGLSIAASIVEA

SEQ ID NO: 340131 - protein, 20 aa, Mycobacterium
DLAEAWRFGRGAGQKVAVID

SEQ ID NO: 340132 - protein, 18 aa, Mycobacterium
DLASSVLRRLPGGPALAS

SEQ ID NO: 340133 - protein, 24 aa, Mycobacterium
DLAYPRTRIEYMLRHARPTAVIAD

SEQ ID NO: 340134 - protein, 22 aa, Mycobacterium
DLCDRLWLIAAIEHYTAVLGDF

SEQ ID NO: 340135 - protein, 18 aa, Mycobacterium
DLDLSRLGAFFMALTGAV

SEQ ID NO: 340136 - protein, 18 aa, Mycobacterium
DLEGADQLLLRWRQANDR

SEQ ID NO: 340137 - protein, 17 aa, Mycobacterium
DLERGFRAPWVPWLPIA

SEQ ID NO: 340138 - protein, 18 aa, Mycobacterium
DLERMAAIMPELIALMPS

SEQ ID NO: 340139 - protein, 20 aa, Mycobacterium
DLFGQLPLPLGVAGHEGSTI

SEQ ID NO: 340140 - protein, 23 aa, Mycobacterium
DLFKRIVAILTWVWVGAFAGMTV

SEQ ID NO: 340141 - protein, 20 aa, Mycobacterium
DLGKFFKWTGVFLIVVAAGI

SEQ ID NO: 340142 - protein, 20 aa, Mycobacterium
DLGPAPSWRNLRFARSDIPE

SEQ ID NO: 340143 - protein, 18 aa, Mycobacterium
DLGSPLFLEHVWGRQVGD

SEQ ID NO: 340144 - protein, 21 aa, Mycobacterium
DLIAGIVCWLLLSREVLPRLG

SEQ ID NO: 340145 - protein, 20 aa, Mycobacterium
DLICALICWLLLSREVLPRL

SEQ ID NO: 340146 - protein, 20 aa, Mycobacterium
DLLGHLPLPLGVAGHEGSTV

SEQ ID NO: 340147 - protein, 19 aa, Mycobacterium
DLLPAFAYFAVWYLLCGCA

SEQ ID NO: 340148 - protein, 21 aa, Mycobacterium
DLPEGRWSEFLDEPRIAARVG

SEQ ID NO: 340149 - protein, 19 aa, Mycobacterium
DLPMWPFVVAVVVSVGAAL

SEQ ID NO: 340150 - protein, 29 aa, Mycobacterium
DLPPLPWYKRPPVLFGLAAAAALLAVGGL

SEQ ID NO: 340151 - protein, 21 aa, Mycobacterium
DLPVPRLAGMPSRPPLPAADE

SEQ ID NO: 340152 - protein, 17 aa, Mycobacterium
DLRNWFLIFAFVAIGLE

SEQ ID NO: 340153 - protein, 20 aa, Mycobacterium
DLRPLWGIDARLKRFGTMAA

SEQ ID NO: 340154 - protein, 18 aa, Mycobacterium
DLRPRNVALLGLGAAVLA

SEQ ID NO: 340155 - protein, 17 aa, Mycobacterium
DLTRPSWLFVLRKTARE

SEQ ID NO: 340156 - protein, 18 aa, Mycobacterium
DLVPDFIPFLGYADDAIV

SEQ ID NO: 340157 - protein, 20 aa, Mycobacterium
DLVRLLARFLIRRLRLSQEV

SEQ ID NO: 340158 - protein, 24 aa, Mycobacterium
DLWVFPICLLLGVSVGAFHILWHG

SEQ ID NO: 340159 - protein, 19 aa, Mycobacterium
DMGLALAMMLMFSTFGSVG

SEQ ID NO: 340160 - protein, 19 aa, Mycobacterium
DMIDWFWRHNAWRGVFNNP

SEQ ID NO: 340161 - protein, 23 aa, Mycobacterium
DMQAWGWRLPFLVAAPLGLVGIY

SEQ ID NO: 340162 - protein, 18 aa, Mycobacterium
DNGLRPEPIIALGSLVTY

SEQ ID NO: 340163 - protein, 20 aa, Mycobacterium
DNSRWFVTRMTTITSLDLTP

SEQ ID NO: 340164 - protein, 23 aa, Mycobacterium
DNTEGGWKLGFYASSRASQLRRM

SEQ ID NO: 340165 - protein, 23 aa, Mycobacterium
DNTESRWKLGLYAASRASQMRRL

SEQ ID NO: 340166 - protein, 21 aa, Mycobacterium
DNVQLPWAFKIVSTLPSLSGN

SEQ ID NO: 340167 - protein, 17 aa, Mycobacterium
DNWLWKWAAYLIVFGIM

SEQ ID NO: 340168 - protein, 19 aa, Mycobacterium
DNWVRRLFALPAFPDGSAD

SEQ ID NO: 340169 - protein, 23 aa, Mycobacterium
DNYHPRPVLGFGFSVLAIALTWL

SEQ ID NO: 340170 - protein, 18 aa, Mycobacterium
DPAFGVIWLLWAVLWFML

SEQ ID NO: 340171 - protein, 19 aa, Mycobacterium
DPDGGWRGNAARAYGAKNL

SEQ ID NO: 340172 - protein, 19 aa, Mycobacterium
DPFRLAIRVELAGVDAATG

SEQ ID NO: 340173 - protein, 17 aa, Mycobacterium
DPGRRWSLVALGLLTTG

SEQ ID NO: 340174 - protein, 23 aa, Mycobacterium
DPGRYALTASYAFHRRKGLPNSY

SEQ ID NO: 340175 - protein, 17 aa, Mycobacterium
DPGWKWLWWQYALADTR

SEQ ID NO: 340176 - protein, 17 aa, Mycobacterium
DPGWKWLWWQYGLADTR

SEQ ID NO: 340177 - protein, 23 aa, Mycobacterium
DPIWGPKFRKLYLRIARVGRSLH

SEQ ID NO: 340178 - protein, 23 aa, Mycobacterium
DPKGARDRWNWVLDGMVETKALS

SEQ ID NO: 340179 - protein, 33 aa, Mycobacterium
DPKRLLKVRGWRRVGTVVVRWPLPVLAATCAVA

SEQ ID NO: 340180 - protein, 18 aa, Mycobacterium
DPLRIGVASIWLSVIVLL

SEQ ID NO: 340181 - protein, 19 aa, Mycobacterium
DPNIDWVVVCMHQTAISTA

SEQ ID NO: 340182 - protein, 29 aa, Mycobacterium
DPNSKFTVSLLWPGDRAWRQSGDRRMLCG

SEQ ID NO: 340183 - protein, 26 aa, Mycobacterium
DPNSRFTMGMLWPGEKGWTEAGERRV

SEQ ID NO: 340184 - protein, 19 aa, Mycobacterium
DPRAGNMVRAVWFDAPEAS

SEQ ID NO: 340185 - protein, 21 aa, Mycobacterium
DPRAWPAWIWGALTGLGLVVA

SEQ ID NO: 340186 - protein, 26 aa, Mycobacterium
DPRDRYARCADFARALRHRLGTDADV

SEQ ID NO: 340187 - protein, 20 aa, Mycobacterium
DPRLKACLMMDAAMPADVVR

SEQ ID NO: 340188 - protein, 34 aa, Mycobacterium
DPRRMIKTRGWRRIGTATVRWPGPVFAASLVIAI

SEQ ID NO: 340189 - protein, 17 aa, Mycobacterium
DPTLCWSWQRSAGDQAP

SEQ ID NO: 340190 - protein, 24 aa, Mycobacterium
DPVFLDWLVGLAFPCQRPFGHKNG

SEQ ID NO: 340191 - protein, 24 aa, Mycobacterium
DPVFLDWLVGLAFPCQRPFGHQNG

SEQ ID NO: 340192 - protein, 18 aa, Mycobacterium
DPVFPRWVGHYSLATAAA

SEQ ID NO: 340193 - protein, 17 aa, Mycobacterium
DPWWVFLAAFAVLVVSI

SEQ ID NO: 340194 - protein, 21 aa, Mycobacterium
DQARLRLAIRSGEMHFIPSNA

SEQ ID NO: 340195 - protein, 18 aa, Mycobacterium
DQGLRLLGLVALQDPPRD

SEQ ID NO: 340196 - protein, 22 aa, Mycobacterium
DQRAAAITKRWAQWNPGLELIV

SEQ ID NO: 340197 - protein, 21 aa, Mycobacterium
DRAAGWLFWFALGTAAITAAA

SEQ ID NO: 340198 - protein, 20 aa, Mycobacterium
DRAAGWLFWFALGTAAITAV

SEQ ID NO: 340199 - protein, 21 aa, Mycobacterium
DRAAGWLFWFALVTALVTAAA

SEQ ID NO: 340200 - protein, 23 aa, Mycobacterium
DRAHPRPVIGFGFSLVSAALTWL

SEQ ID NO: 340201 - protein, 24 aa, Mycobacterium
DRAHPRPVVGFGFFVVAIALTWFS

SEQ ID NO: 340202 - protein, 19 aa, Mycobacterium
DRAHPRSVVGFGFSLMAIG

SEQ ID NO: 340203 - protein, 20 aa, Mycobacterium
DRAKAYWTRHGWAAQAPIKT

SEQ ID NO: 340204 - protein, 19 aa, Mycobacterium
DRAKAYWTRQGWAAQAPIK

SEQ ID NO: 340205 - protein, 19 aa, Mycobacterium
DRAKAYWTRQGWAARAPIK

SEQ ID NO: 340206 - protein, 21 aa, Mycobacterium
DRAVRRWRRIATHVVRWPGPV

SEQ ID NO: 340207 - protein, 21 aa, Mycobacterium
DRAYFTFLAALPFVLGALSLT

SEQ ID NO: 340208 - protein, 21 aa, Mycobacterium
DRDRYPAVMWILLAGNLLVRS

SEQ ID NO: 340209 - protein, 24 aa, Mycobacterium
DRFGTKRLFIWSVLAFTMGSVLCA

SEQ ID NO: 340210 - protein, 18 aa, Mycobacterium
DRGMPLLVLVVMAQLVLC

SEQ ID NO: 340211 - protein, 18 aa, Mycobacterium
DRGYFVFLAVLPFIMGSL

SEQ ID NO: 340212 - protein, 19 aa, Mycobacterium
DRHLRLPLRQVLWGLDEAL

SEQ ID NO: 340213 - protein, 24 aa, Mycobacterium
DRIGRSRVYLCGAFGLAVFAFPFW

SEQ ID NO: 340214 - protein, 23 aa, Mycobacterium
DRILAGACAVAWLAALGAGVAAL

SEQ ID NO: 340215 - protein, 20 aa, Mycobacterium
DRIWLLAAFGWIGWAGVQGG

SEQ ID NO: 340216 - protein, 21 aa, Mycobacterium
DRLDPGLARRFMDTYGDILYN

SEQ ID NO: 340217 - protein, 24 aa, Mycobacterium
DRLERRPPFTLAMCFLGVGLALRY

SEQ ID NO: 340218 - protein, 21 aa, Mycobacterium
DRLGPRLVLRVGLVVLLAVQI

SEQ ID NO: 340219 - protein, 23 aa, Mycobacterium
DRLGRRGPLLVGIVACLVASLLC

SEQ ID NO: 340220 - protein, 20 aa, Mycobacterium
DRLKIPFGHELKTGEIMYLD

SEQ ID NO: 340221 - protein, 17 aa, Mycobacterium
DRLKIPFGHELKTGNVM

SEQ ID NO: 340222 - protein, 17 aa, Mycobacterium
DRLLLGGCAVIWLAALG

SEQ ID NO: 340223 - protein, 18 aa, Mycobacterium
DRLLQRWTGLTVTLDISG

SEQ ID NO: 340224 - protein, 17 aa, Mycobacterium
DRLPEFDIYSPRKAAKK

SEQ ID NO: 340225 - protein, 20 aa, Mycobacterium
DRLPKLWVMRCSLAVQTALM

SEQ ID NO: 340226 - protein, 19 aa, Mycobacterium
DRLQAFDVFSSFWFTAIYV

SEQ ID NO: 340227 - protein, 17 aa, Mycobacterium
DRLRIPFGHELKTGDVM

SEQ ID NO: 340228 - protein, 17 aa, Mycobacterium
DRLRLRLSRSVTVVVGG

SEQ ID NO: 340229 - protein, 19 aa, Mycobacterium
DRLRVPIGIAVDGTPMELD

SEQ ID NO: 340230 - protein, 18 aa, Mycobacterium
DRNRLVTFIAIFLAGGVM

SEQ ID NO: 340231 - protein, 19 aa, Mycobacterium
DRNRLVTFIAIFLAGGVMF

SEQ ID NO: 340232 - protein, 22 aa, Mycobacterium
DRNRLVTFTAIFLAGGLMFSLT

SEQ ID NO: 340233 - protein, 22 aa, Mycobacterium
DRNWAWSTARGWLEVAPGAATA

SEQ ID NO: 340234 - protein, 18 aa, Mycobacterium
DRPRLVWYAPHHVEGETS

SEQ ID NO: 340235 - protein, 21 aa, Mycobacterium
DRPTPELALRFAGNRWVAIDQ

SEQ ID NO: 340236 - protein, 23 aa, Mycobacterium
DRRFGWSSVPAWLALAADVVVVV

SEQ ID NO: 340237 - protein, 24 aa, Mycobacterium
DRRSRGGGVPINWRSPIAPPQAGG

SEQ ID NO: 340238 - protein, 22 aa, Mycobacterium
DRSAWWGRLAWMPHRPVLVPGT

SEQ ID NO: 340239 - protein, 21 aa, Mycobacterium
DRSWWSGPEVFVFVDDYAMVN

SEQ ID NO: 340240 - protein, 25 aa, Mycobacterium
DRTGLKAVLPLAVHNKWVVLHDPGG

SEQ ID NO: 340241 - protein, 17 aa, Mycobacterium
DRWAPGRVMINAYGPTE

SEQ ID NO: 340242 - protein, 21 aa, Mycobacterium
DRWGHLLGCAMSLAAFAVGTV

SEQ ID NO: 340243 - protein, 17 aa, Mycobacterium
DRWPRGVLAAGFGMLTV

SEQ ID NO: 340244 - protein, 19 aa, Mycobacterium
DRWSVLWFLAYQHISLVGQ

SEQ ID NO: 340245 - protein, 30 aa, Mycobacterium
DRYARCIDFAHSFARAARCGRHPKSSASTM

SEQ ID NO: 340246 - protein, 20 aa, Mycobacterium
DRYGRRRGFFIGLGVFAAAS

SEQ ID NO: 340247 - protein, 20 aa, Mycobacterium
DRYGRRRGFFVGLALFVASS

SEQ ID NO: 340248 - protein, 23 aa, Mycobacterium
DRYHPRPVLGFGFSVLAIALTWL

SEQ ID NO: 340249 - protein, 22 aa, Mycobacterium
DRYQRCIDFARALGHRLGGGGD

SEQ ID NO: 340250 - protein, 21 aa, Mycobacterium
DRYQRCIDFARALSHRLGGVG

SEQ ID NO: 340251 - protein, 17 aa, Mycobacterium
DSAAMCFGVSGVAMVFG

SEQ ID NO: 340252 - protein, 20 aa, Mycobacterium
DSAYRIALWLALAATVLVGG

SEQ ID NO: 340253 - protein, 18 aa, Mycobacterium
DSGPFLSYGIQWIAFGIL

SEQ ID NO: 340254 - protein, 17 aa, Mycobacterium
DSLRKAFGWFVLAMSSV

SEQ ID NO: 340255 - protein, 17 aa, Mycobacterium
DSPWPVVRNPLIASTLA

SEQ ID NO: 340256 - protein, 22 aa, Mycobacterium
DSRAAIKITTLFGSRYVDLRPA

SEQ ID NO: 340257 - protein, 23 aa, Mycobacterium
DSSRWPSVKGVALVAVPGQDPVT

SEQ ID NO: 340258 - protein, 21 aa, Mycobacterium
DSYRWPIYFEYLFNERVLTVG

SEQ ID NO: 340259 - protein, 17 aa, Mycobacterium
DTILGRRNMEIEPRGSD

SEQ ID NO: 340260 - protein, 23 aa, Mycobacterium
DTKTPLSFVCYWVIPFALLGVAA

SEQ ID NO: 340261 - protein, 20 aa, Mycobacterium
DTPQDAWPWLGWLTAATAAG

SEQ ID NO: 340262 - protein, 22 aa, Mycobacterium
DTQPRLAILLGDYAVPVEGRIN

SEQ ID NO: 340263 - protein, 23 aa, Mycobacterium
DTRLYLPMPFFWVGGFGAGIVTA

SEQ ID NO: 340264 - protein, 20 aa, Mycobacterium
DTSARPAVQYVPPTGPVEEP

SEQ ID NO: 340265 - protein, 23 aa, Mycobacterium
DTSKPVGITMLWPLADRPRLAPG

SEQ ID NO: 340266 - protein, 19 aa, Mycobacterium
DTSLRFGVLCRFTAYVAGE

SEQ ID NO: 340267 - protein, 17 aa, Mycobacterium
DTSSWRWIFLINVPIGL

SEQ ID NO: 340268 - protein, 24 aa, Mycobacterium
DTTRWGLQIDHFWWTAIWAAILLS

SEQ ID NO: 340269 - protein, 17 aa, Mycobacterium
DTTVRWLAVFALALGGF

SEQ ID NO: 340270 - protein, 18 aa, Mycobacterium
DVAAALWHPHIVEIHDRG

SEQ ID NO: 340271 - protein, 19 aa, Mycobacterium
DVAGGYWLDYMVPMMSLDA

SEQ ID NO: 340272 - protein, 17 aa, Mycobacterium
DVAYDWIRSELKNFGVT

SEQ ID NO: 340273 - protein, 18 aa, Mycobacterium
DVFCTVLGPGAFRLAVLV

SEQ ID NO: 340274 - protein, 17 aa, Mycobacterium
DVFGRAGPYLARGATDL

SEQ ID NO: 340275 - protein, 18 aa, Mycobacterium
DVGWLRLPGFDWPAHPSW

SEQ ID NO: 340276 - protein, 21 aa, Mycobacterium
DVIGCALVLLGLIVTVQAAQL

SEQ ID NO: 340277 - protein, 31 aa, Mycobacterium
DVKLGLMCLVAFPVLVLLVWWFQRESSKTYR

SEQ ID NO: 340278 - protein, 21 aa, Mycobacterium
DVLHWPGYLLVVAGVIGGVGS

SEQ ID NO: 340279 - protein, 21 aa, Mycobacterium
DVLHWPGYLLVVAGVVGACGS

SEQ ID NO: 340280 - protein, 17 aa, Mycobacterium
DVLRLLIRAILRADSGV

SEQ ID NO: 340281 - protein, 25 aa, Mycobacterium
DVLRLRPAGPFFFIFAMGATATVPA

SEQ ID NO: 340282 - protein, 21 aa, Mycobacterium
DVMKYRDSWIIAFLYIGTFGS

SEQ ID NO: 340283 - protein, 17 aa, Mycobacterium
DVPGGTWARGLRARERL

SEQ ID NO: 340284 - protein, 17 aa, Mycobacterium
DVRVEFMIGDAAPTAAI

SEQ ID NO: 340285 - protein, 24 aa, Mycobacterium
DVTAWRWMYGVGVLPAVAVIVGRF

SEQ ID NO: 340286 - protein, 17 aa, Mycobacterium
DVTHGWTAPWVLFLAVF

SEQ ID NO: 340287 - protein, 23 aa, Mycobacterium
DVTLCGLALCILGAAVVAGQLRG

SEQ ID NO: 340288 - protein, 18 aa, Mycobacterium
DVTPELDAVVLKALAKNP

SEQ ID NO: 340289 - protein, 17 aa, Mycobacterium
DVVLLCFDTQSQQASEF

SEQ ID NO: 340290 - protein, 18 aa, Mycobacterium
DVVSWKLKPGVVSTMTAQ

SEQ ID NO: 340291 - protein, 21 aa, Mycobacterium
DWAESVGPWFPLAFLAAHVVA

SEQ ID NO: 340292 - protein, 22 aa, Mycobacterium
DWGIRGHMGFLFGLLNQLLLLG

SEQ ID NO: 340293 - protein, 20 aa, Mycobacterium
DWKLWLGFLLVAIPVCLSPG

SEQ ID NO: 340294 - protein, 19 aa, Mycobacterium
DWPLWWVSACSVLALLIVE

SEQ ID NO: 340295 - protein, 20 aa, Mycobacterium
DWRKPGVVQRVVDWSTRVRS

SEQ ID NO: 340296 - protein, 31 aa, Mycobacterium
DWRLGLMCLAAFPILVALVWWFRNESARTYR

SEQ ID NO: 340297 - protein, 24 aa, Mycobacterium
DWVSPVSWWWVLAGFLVFVTPPGR

SEQ ID NO: 340298 - protein, 21 aa, Mycobacterium
DYETIGGLILEKLGHIPDEGE

SEQ ID NO: 340299 - protein, 17 aa, Mycobacterium
DYFRSWPDTAMGWPEPQ

SEQ ID NO: 340300 - protein, 24 aa, Mycobacterium
DYLKLGLPVTIVFFLAAVIYTPLF

SEQ ID NO: 340301 - protein, 19 aa, Mycobacterium
DYLRSLVMRMWPQIKSIGG

SEQ ID NO: 340302 - protein, 25 aa, Mycobacterium
DYRPPRAGQWVPIYGLTSILLGGLP

SEQ ID NO: 340303 - protein, 19 aa, Mycobacterium
EAESRFTLIYGNRTKESTM

SEQ ID NO: 340304 - protein, 21 aa, Mycobacterium
EAFFIPFGFTFWGVLLSAPAW

SEQ ID NO: 340305 - protein, 22 aa, Mycobacterium
EAFFIPFGFTFWGVMLSAPLWL

SEQ ID NO: 340306 - protein, 24 aa, Mycobacterium
EAFLPRLAILVVVAFVITAGVYGV

SEQ ID NO: 340307 - protein, 18 aa, Mycobacterium
EAFLPRRIRYAGQVTLAL

SEQ ID NO: 340308 - protein, 18 aa, Mycobacterium
EAFLPRRLRYGAQVTLAL

SEQ ID NO: 340309 - protein, 19 aa, Mycobacterium
EAFLPRRMRYGAQVTLTVG

SEQ ID NO: 340310 - protein, 21 aa, Mycobacterium
EAFPAGSVDFFFLTASAAGIF

SEQ ID NO: 340311 - protein, 23 aa, Mycobacterium
EAGERRVLCGLQLPGADNQQQLF

SEQ ID NO: 340312 - protein, 17 aa, Mycobacterium
EAGIWVAFWFFLAQLNF

SEQ ID NO: 340313 - protein, 28 aa, Mycobacterium
EAGRPARWSWLWPREHHLVSWLAAVVVP

SEQ ID NO: 340314 - protein, 17 aa, Mycobacterium
EAIQFLVEVAVARRGEI

SEQ ID NO: 340315 - protein, 22 aa, Mycobacterium
EAISCVLVWQAARWRPTLQFSK

SEQ ID NO: 340316 - protein, 17 aa, Mycobacterium
EALDFIGALLLSPGVAI

SEQ ID NO: 340317 - protein, 19 aa, Mycobacterium
EALGPLILGYTFVLIGIVD

SEQ ID NO: 340318 - protein, 22 aa, Mycobacterium
EALLRWPHPRLGLLYPGAFMSL

SEQ ID NO: 340319 - protein, 29 aa, Mycobacterium
EAPHRAMVWLGWLTAATALGWVIDTATAR

SEQ ID NO: 340320 - protein, 26 aa, Mycobacterium
EAPRGKYWWLRWVILGIVAIVLAVEI

SEQ ID NO: 340321 - protein, 23 aa, Mycobacterium
EAPRRVVVCIALLTVAAGIIGFP

SEQ ID NO: 340322 - protein, 21 aa, Mycobacterium
EARLSWVLAVLAGVLGATAFT

SEQ ID NO: 340323 - protein, 31 aa, Mycobacterium
EARPRIASFIRRFSVLIILAWIVVAALATFA

SEQ ID NO: 340324 - protein, 20 aa, Mycobacterium
EARPRLILGTAMIALPALGL

SEQ ID NO: 340325 - protein, 17 aa, Mycobacterium
EARRRAAGFIGFAIGGP

SEQ ID NO: 340326 - protein, 22 aa, Mycobacterium
EASPRFVAWLAEFEPVRQAFLG

SEQ ID NO: 340327 - protein, 20 aa, Mycobacterium
EATLGFCVGCYMHKLIWGCE

SEQ ID NO: 340328 - protein, 21 aa, Mycobacterium
EATWWIRARVLGVKPQVWRRP

SEQ ID NO: 340329 - protein, 19 aa, Mycobacterium
EAVDSRLGRRVAVKVLKQE

SEQ ID NO: 340330 - protein, 17 aa, Mycobacterium
EAVEILAALSFAAVLMG

SEQ ID NO: 340331 - protein, 17 aa, Mycobacterium
EAVLLCLTSAALATLGI

SEQ ID NO: 340332 - protein, 18 aa, Mycobacterium
ECADGRYVAVGALEDAFL

SEQ ID NO: 340333 - protein, 21 aa, Mycobacterium
ECGWLHVAVIYTREATAETVR

SEQ ID NO: 340334 - protein, 18 aa, Mycobacterium
EDAPRPAPPDVIHAIETQ

SEQ ID NO: 340335 - protein, 17 aa, Mycobacterium
EDFPLAIAILFALIIAL

SEQ ID NO: 340336 - protein, 25 aa, Mycobacterium
EDFWRSAGLPEFRWPDPNGTRFPNG

SEQ ID NO: 340337 - protein, 20 aa, Mycobacterium
EDGPCWSMRLNVIDPPKEPP

SEQ ID NO: 340338 - protein, 25 aa, Mycobacterium
EDGRTRWMLLVGVFVGFGFLTKQLQ

SEQ ID NO: 340339 - protein, 24 aa, Mycobacterium
EDIIRFQAEFLWRDYFQPGITVDG

SEQ ID NO: 340340 - protein, 23 aa, Mycobacterium
EDITRFQAEFLWRDYYAPGGTID

SEQ ID NO: 340341 - protein, 24 aa, Mycobacterium
EDMQAWGWRLPFLVAAPLGLIGVY

SEQ ID NO: 340342 - protein, 21 aa, Mycobacterium
EDRSKFWIGMIAVGVVAAIIA

SEQ ID NO: 340343 - protein, 17 aa, Mycobacterium
EDSRLPTVLFQTTLSKL

SEQ ID NO: 340344 - protein, 17 aa, Mycobacterium
EEFRIGIGINTGVVIAG

SEQ ID NO: 340345 - protein, 21 aa, Mycobacterium
EEIRVRIGIHMGRSVRRGDDL

SEQ ID NO: 340346 - protein, 19 aa, Mycobacterium
EEKRSWGWVIALALVVAAL

SEQ ID NO: 340347 - protein, 21 aa, Mycobacterium
EELFFRGALYTALGRYHPVLI

SEQ ID NO: 340348 - protein, 20 aa, Mycobacterium
EEMFFRGALYTALGRFYPVA

SEQ ID NO: 340349 - protein, 24 aa, Mycobacterium
EEPLDRRWIWVAGVAGAILLVAVI

SEQ ID NO: 340350 - protein, 27 aa, Mycobacterium
EEPPPPRWPWVVGVAAIIAAITLVASV

SEQ ID NO: 340351 - protein, 21 aa, Mycobacterium
EEPRRNPLSRWLVGLAALVVL

SEQ ID NO: 340352 - protein, 19 aa, Mycobacterium
EEVFFRGALYTALGRFHPV

SEQ ID NO: 340353 - protein, 19 aa, Mycobacterium
EFAGFFAWLAWLVLHLYYL

SEQ ID NO: 340354 - protein, 27 aa, Mycobacterium
EFAPPPRWPWVVGVVAIVAAVALVVSV

SEQ ID NO: 340355 - protein, 19 aa, Mycobacterium
EFCVALWYLARVRHLSGRE

SEQ ID NO: 340356 - protein, 28 aa, Mycobacterium
EFFFPLPGLWKWVAAAVFVWGSACVIGA

SEQ ID NO: 340357 - protein, 19 aa, Mycobacterium
EFHYRYTVGMWFRRIWLFQ

SEQ ID NO: 340358 - protein, 21 aa, Mycobacterium
EFKPTGAKVWADYTSAHWQQG

SEQ ID NO: 340359 - protein, 19 aa, Mycobacterium
EFNGQLWISMDYIEGTDAA

SEQ ID NO: 340360 - protein, 17 aa, Mycobacterium
EFPRSGYRLPTFGGGPD

SEQ ID NO: 340361 - protein, 17 aa, Mycobacterium
EFRCVSVDLLARQAVVH

SEQ ID NO: 340362 - protein, 20 aa, Mycobacterium
EFVRFYWLHPELRVELADDR

SEQ ID NO: 340363 - protein, 18 aa, Mycobacterium
EGAWWGWHGAGWFLFTLM

SEQ ID NO: 340364 - protein, 19 aa, Mycobacterium
EGFFSPLFFVWLGASLHVR

SEQ ID NO: 340365 - protein, 19 aa, Mycobacterium
EGFFSPLFFVWLGASLQVR

SEQ ID NO: 340366 - protein, 17 aa, Mycobacterium
EGFGPWSATGIRGAVAA

SEQ ID NO: 340367 - protein, 22 aa, Mycobacterium
EGFPADLLYEFRLYALGTQIVV

SEQ ID NO: 340368 - protein, 22 aa, Mycobacterium
EGFSADLLYEFRLYSVGTQVVM

SEQ ID NO: 340369 - protein, 17 aa, Mycobacterium
EGGFPWAAFVVGLSSAG

SEQ ID NO: 340370 - protein, 17 aa, Mycobacterium
EGISVTAAPGWTLVNRG

SEQ ID NO: 340371 - protein, 21 aa, Mycobacterium
EGLAALIFFRYLWAFELTSAL

SEQ ID NO: 340372 - protein, 23 aa, Mycobacterium
EGLARLWPAWELYVWGHTVPAAF

SEQ ID NO: 340373 - protein, 17 aa, Mycobacterium
EGLRRLSKVDAIVVDPR

SEQ ID NO: 340374 - protein, 23 aa, Mycobacterium
EGMKAVLWTSGWTPRFEGETIFL

SEQ ID NO: 340375 - protein, 24 aa, Mycobacterium
EGPIAWPEAMRIGVKLCGALETAH

SEQ ID NO: 340376 - protein, 20 aa, Mycobacterium
EGRAAHWLILLFADRVDVAE

SEQ ID NO: 340377 - protein, 17 aa, Mycobacterium
EGRSFRSAVPRGWARAR

SEQ ID NO: 340378 - protein, 18 aa, Mycobacterium
EGRSFRSAVPRGWARARK

SEQ ID NO: 340379 - protein, 19 aa, Mycobacterium
EGRSFRSAVPRGWVRARKT

SEQ ID NO: 340380 - protein, 19 aa, Mycobacterium
EGRSYRSAVPRGWARARKT

SEQ ID NO: 340381 - protein, 18 aa, Mycobacterium
EGRWTEFLEEPRLAERVK

SEQ ID NO: 340382 - protein, 24 aa, Mycobacterium
EGSCFRLTLPLVRGHKVTTSPLPI

SEQ ID NO: 340383 - protein, 22 aa, Mycobacterium
EGSWRKRIPSIFLDVARFALIA

SEQ ID NO: 340384 - protein, 18 aa, Mycobacterium
EGTYRVDIDWAKQTENGA

SEQ ID NO: 340385 - protein, 20 aa, Mycobacterium
EGVDSRLGRRVAIKVLKAEY

SEQ ID NO: 340386 - protein, 24 aa, Mycobacterium
EHARKLLWRLLVAAVLFVPLADLS

SEQ ID NO: 340387 - protein, 26 aa, Mycobacterium
EHGAPRWPWVVGIAAIVAAIALVVSV

SEQ ID NO: 340388 - protein, 27 aa, Mycobacterium
EHGAPRWPWVVGVAAILAAIALVVSVS

SEQ ID NO: 340389 - protein, 18 aa, Mycobacterium
EHIEPLPAIALAPTATPV

SEQ ID NO: 340390 - protein, 18 aa, Mycobacterium
EHIPWRWSIGAAAVPAAI

SEQ ID NO: 340391 - protein, 27 aa, Mycobacterium
EHPPGGFPRPEVFDALETEPTPWYRKP

SEQ ID NO: 340392 - protein, 25 aa, Mycobacterium
EHRRELPALFLLASLVAVVFAGGVF

SEQ ID NO: 340393 - protein, 17 aa, Mycobacterium
EHSRLGQVVAWVVIVAG

SEQ ID NO: 340394 - protein, 20 aa, Mycobacterium
EIAMRMVAVFAHRLYGAITT

SEQ ID NO: 340395 - protein, 19 aa, Mycobacterium
EIELPPGYLPLRVPIEVHF

SEQ ID NO: 340396 - protein, 22 aa, Mycobacterium
EIFCLTFLWLVVLVRIPTIRGR

SEQ ID NO: 340397 - protein, 17 aa, Mycobacterium
EIGCWALGFVVTGAGIG

SEQ ID NO: 340398 - protein, 18 aa, Mycobacterium
EILIRVGPEPSRSQQQAA

SEQ ID NO: 340399 - protein, 18 aa, Mycobacterium
EIPSQFLLSAYAPQPRTL

SEQ ID NO: 340400 - protein, 24 aa, Mycobacterium
EIRWNLRVIIMFSVGLVIATAVAV

SEQ ID NO: 340401 - protein, 24 aa, Mycobacterium
EKHCADIPICWSLRSIFDALDGVD

SEQ ID NO: 340402 - protein, 19 aa, Mycobacterium
EKHCFDIPICQSLRSIFDV

SEQ ID NO: 340403 - protein, 25 aa, Mycobacterium
EKHCFDIPICWAFRSLWDTIDHIDH

SEQ ID NO: 340404 - protein, 24 aa, Mycobacterium
EKHCFDIPICWSIRSIFDALDGAD

SEQ ID NO: 340405 - protein, 24 aa, Mycobacterium
EKHCFDIPMCWALRSVFDALDGIS

SEQ ID NO: 340406 - protein, 24 aa, Mycobacterium
EKHCFDIPVCWSLRSVFDTLDGVD

SEQ ID NO: 340407 - protein, 25 aa, Mycobacterium
EKHCYDIPACWALRSVFNALDGIDQ

SEQ ID NO: 340408 - protein, 24 aa, Mycobacterium
EKHCYDIPACWSLRSVFDGLDGID

SEQ ID NO: 340409 - protein, 20 aa, Mycobacterium
EKHCYDIPICFSLRSIFDTL

SEQ ID NO: 340410 - protein, 24 aa, Mycobacterium
EKHCYDIPICFSLRSVFDTLDGID

SEQ ID NO: 340411 - protein, 25 aa, Mycobacterium
EKHCYDIPICWSIRSLFDSLDGFDQ

SEQ ID NO: 340412 - protein, 24 aa, Mycobacterium
EKHCYDIPICWSLRSIFDTLDGID

SEQ ID NO: 340413 - protein, 25 aa, Mycobacterium
EKHCYDIPICWSLRSLFDALDGFDL

SEQ ID NO: 340414 - protein, 23 aa, Mycobacterium
EKHCYDIPVCFALRSIYDALDGI

SEQ ID NO: 340415 - protein, 21 aa, Mycobacterium
EKHCYDIPVCIGLRSLFDTFD

SEQ ID NO: 340416 - protein, 22 aa, Mycobacterium
EKPLWSSFVWRNEVADTFVETV

SEQ ID NO: 340417 - protein, 24 aa, Mycobacterium
EKPPRLYQAAAWVVIVAGVIFIAW

SEQ ID NO: 340418 - protein, 18 aa, Mycobacterium
EKRPRLTMFDDFGGRIPS

SEQ ID NO: 340419 - protein, 19 aa, Mycobacterium
EKRPRLTVFDDFGGRIPSD

SEQ ID NO: 340420 - protein, 17 aa, Mycobacterium
EKRSDIKSVRFVNREDA

SEQ ID NO: 340421 - protein, 17 aa, Mycobacterium
EKWNFPIVLVILLAVFG

SEQ ID NO: 340422 - protein, 19 aa, Mycobacterium
EKWQIPALVLGWLIAVLIR

SEQ ID NO: 340423 - protein, 18 aa, Mycobacterium
ELAEAHWIEFSATTRMSG

SEQ ID NO: 340424 - protein, 17 aa, Mycobacterium
ELARIAALSAIFTGLGG

SEQ ID NO: 340425 - protein, 27 aa, Mycobacterium
ELEGSASLPSRRIWALVALFVVVGVTV

SEQ ID NO: 340426 - protein, 19 aa, Mycobacterium
ELFWLSLRDSRWWLGALGA

SEQ ID NO: 340427 - protein, 18 aa, Mycobacterium
ELGEILGFGGMSEVHLAR

SEQ ID NO: 340428 - protein, 20 aa, Mycobacterium
ELGLRPRLALGIHQPATDAR

SEQ ID NO: 340429 - protein, 19 aa, Mycobacterium
ELGVMPLLPVLAMVWGTAK

SEQ ID NO: 340430 - protein, 18 aa, Mycobacterium
ELKYRLGYDDSLDVVGVH

SEQ ID NO: 340431 - protein, 26 aa, Mycobacterium
ELLDTWLWRWVAFLIVFAIMLVVTGA

SEQ ID NO: 340432 - protein, 26 aa, Mycobacterium
ELLDTWLWRWVAFLIVFGLMVLTTGM

SEQ ID NO: 340433 - protein, 18 aa, Mycobacterium
ELLLRPSSVPTYLKDDWY

SEQ ID NO: 340434 - protein, 23 aa, Mycobacterium
ELLTCPFCLDMWVATALVIGLIF

SEQ ID NO: 340435 - protein, 25 aa, Mycobacterium
ELLTCPFCLDMWVATGFAIGLVFAP

SEQ ID NO: 340436 - protein, 25 aa, Mycobacterium
ELLTCPFCLDMWVATGFAIGLVFVP

SEQ ID NO: 340437 - protein, 23 aa, Mycobacterium
ELLTSLLAKVSWRRRRTRIVTWV

SEQ ID NO: 340438 - protein, 22 aa, Mycobacterium
ELPAALGKPVWDRPIGGLLATT

SEQ ID NO: 340439 - protein, 19 aa, Mycobacterium
ELPFYRLLLSYLFVAIFLA

SEQ ID NO: 340440 - protein, 22 aa, Mycobacterium
ELPGCPGSVCTGKIKQAYGLAY

SEQ ID NO: 340441 - protein, 19 aa, Mycobacterium
ELPGGAFVFARAAGMTMLS

SEQ ID NO: 340442 - protein, 25 aa, Mycobacterium
ELPGLRPGTGLTMLTWLMRIGFLGA

SEQ ID NO: 340443 - protein, 20 aa, Mycobacterium
ELPLREILPAVQRLVIPATS

SEQ ID NO: 340444 - protein, 21 aa, Mycobacterium
ELPPAVAFWLMLGIPLGTVWS

SEQ ID NO: 340445 - protein, 22 aa, Mycobacterium
ELPPGYLPLRIPIEVNFTQRVA

SEQ ID NO: 340446 - protein, 18 aa, Mycobacterium
ELPSTGGLYRFSNVTYRG

SEQ ID NO: 340447 - protein, 23 aa, Mycobacterium
ELQADCYAGIWAHYAATVNQKDG

SEQ ID NO: 340448 - protein, 23 aa, Mycobacterium
ELQADCYAGIWAHYASTVKQEST

SEQ ID NO: 340449 - protein, 23 aa, Mycobacterium
ELQADCYAGVWAYYASTVKQQST

SEQ ID NO: 340450 - protein, 20 aa, Mycobacterium
ELQKWVAVCLYKGFVDVYEA

SEQ ID NO: 340451 - protein, 20 aa, Mycobacterium
ELRGPIGGWFVWRPEERSQI

SEQ ID NO: 340452 - protein, 18 aa, Mycobacterium
ELRNRIKAATGMTLSPTL

SEQ ID NO: 340453 - protein, 19 aa, Mycobacterium
ELSDHTWATLGERLNDQQR

SEQ ID NO: 340454 - protein, 18 aa, Mycobacterium
EMGLLWPGLMGRFGDVLG

SEQ ID NO: 340455 - protein, 22 aa, Mycobacterium
EMIAWVCIAASLVGVILLIVDA

SEQ ID NO: 340456 - protein, 21 aa, Mycobacterium
EMLLLWWQRRFFAVPLPTFGL

SEQ ID NO: 340457 - protein, 23 aa, Mycobacterium
EMRRMADLMPRMVAVMPAQIQSM

SEQ ID NO: 340458 - protein, 19 aa, Mycobacterium
EMTVRLGIVTGRGHGALIR

SEQ ID NO: 340459 - protein, 19 aa, Mycobacterium
EMTVRLGIVTGRGHGSLIR

SEQ ID NO: 340460 - protein, 18 aa, Mycobacterium
EMYKYLVAVSRQPDHAKI

SEQ ID NO: 340461 - protein, 19 aa, Mycobacterium
ENDWKFKIIFGLPGIVLAS

SEQ ID NO: 340462 - protein, 20 aa, Mycobacterium
ENNGRTWLLWDGRRSAIDLA

SEQ ID NO: 340463 - protein, 18 aa, Mycobacterium
ENPWWPDRDRPRYTPPAQ

SEQ ID NO: 340464 - protein, 21 aa, Mycobacterium
ENYLRLNALGAYGSFFNIYYC

SEQ ID NO: 340465 - protein, 27 aa, Mycobacterium
EPAGGWKRLPLTVFGIAVAAVLVAVGG

SEQ ID NO: 340466 - protein, 17 aa, Mycobacterium
EPAVAWVDANLGDPKRA

SEQ ID NO: 340467 - protein, 22 aa, Mycobacterium
EPDLRVIIELGYDRTGYADVPT

SEQ ID NO: 340468 - protein, 17 aa, Mycobacterium
EPDWSITVVERLDTVAA

SEQ ID NO: 340469 - protein, 32 aa, Mycobacterium
EPEKRPGPARLLRVLAIPVVIFWVAAAAALNI

SEQ ID NO: 340470 - protein, 23 aa, Mycobacterium
EPFARITSVLTWIWIAAFAGMTV

SEQ ID NO: 340471 - protein, 19 aa, Mycobacterium
EPFTAQGARTWHIVPGTTP

SEQ ID NO: 340472 - protein, 26 aa, Mycobacterium
EPHCADIPICWMGRSMFESMDSIDGM

SEQ ID NO: 340473 - protein, 18 aa, Mycobacterium
EPHCFDIPMCAAARSLFD

SEQ ID NO: 340474 - protein, 23 aa, Mycobacterium
EPHCFDIPVCWALRSVSDSVDGI

SEQ ID NO: 340475 - protein, 25 aa, Mycobacterium
EPHCYDIPMCWSMRSIFESIDGINT

SEQ ID NO: 340476 - protein, 20 aa, Mycobacterium
EPHCYNIPICWSLRSIFDAM

SEQ ID NO: 340477 - protein, 25 aa, Mycobacterium
EPHCYNIPLCWSFRSLFDSMDGIST

SEQ ID NO: 340478 - protein, 25 aa, Mycobacterium
EPHCYNIPVCHSMRSLFDLIDGTNL

SEQ ID NO: 340479 - protein, 23 aa, Mycobacterium
EPICPPCGAFIRSYASDIDAAVA

SEQ ID NO: 340480 - protein, 23 aa, Mycobacterium
EPICPPCGAFIRSYASDIETAVA

SEQ ID NO: 340481 - protein, 17 aa, Mycobacterium
EPIISASLWRMMAGYGV

SEQ ID NO: 340482 - protein, 23 aa, Mycobacterium
EPILPRWVGHFSLATAVVMIPAA

SEQ ID NO: 340483 - protein, 18 aa, Mycobacterium
EPKGAGKARGWRRVGAAT

SEQ ID NO: 340484 - protein, 34 aa, Mycobacterium
EPKGMKRARGWRRIGAATVRWPGAVLVMAVVLAL

SEQ ID NO: 340485 - protein, 24 aa, Mycobacterium
EPKPRRRPILLAGRSLAALFAVLA

SEQ ID NO: 340486 - protein, 22 aa, Mycobacterium
EPKRRRPMLLAGRSVAALAAVL

SEQ ID NO: 340487 - protein, 19 aa, Mycobacterium
EPLIRLPLILGLAHALSRI

SEQ ID NO: 340488 - protein, 20 aa, Mycobacterium
EPLRPAPVVLPFTGLDGPTP

SEQ ID NO: 340489 - protein, 27 aa, Mycobacterium
EPPAVVRRRLRWWPAIGYGLLPALALL

SEQ ID NO: 340490 - protein, 24 aa, Mycobacterium
EPPCPACAGGDYSLCWSFADGDIK

SEQ ID NO: 340491 - protein, 18 aa, Mycobacterium
EPPRLLLFAFGWGASVAV

SEQ ID NO: 340492 - protein, 24 aa, Mycobacterium
EPPRRSNTFWLWVVGIGALVVIIA

SEQ ID NO: 340493 - protein, 18 aa, Mycobacterium
EPPVPFGYLMRLGDTLAE

SEQ ID NO: 340494 - protein, 18 aa, Mycobacterium
EPREWRLKVTVTEEDGQY

SEQ ID NO: 340495 - protein, 19 aa, Mycobacterium
EPRLPAILLGLGAEPDDRE

SEQ ID NO: 340496 - protein, 24 aa, Mycobacterium
EPRTWRLSVSLVREDGQIKMSKVE

SEQ ID NO: 340497 - protein, 20 aa, Mycobacterium
EPTEGGLVRTARWAGSTVSI

SEQ ID NO: 340498 - protein, 18 aa, Mycobacterium
EPTWSRPGWRHLKHFNGY

SEQ ID NO: 340499 - protein, 18 aa, Mycobacterium
EPTWSRPGWRRLKHFNGF

SEQ ID NO: 340500 - protein, 23 aa, Mycobacterium
EPVIRLPLALGLVHLLGRIPLPG

SEQ ID NO: 340501 - protein, 24 aa, Mycobacterium
EPVLTRSGAEWMPNFIDLLQRKLT

SEQ ID NO: 340502 - protein, 18 aa, Mycobacterium
EPVTCWQWVKAAGEQQSR

SEQ ID NO: 340503 - protein, 18 aa, Mycobacterium
EQFWRSAGLPAYQFPDPN

SEQ ID NO: 340504 - protein, 25 aa, Mycobacterium
EQHCFDIPICWSLRSLFDATDGVDK

SEQ ID NO: 340505 - protein, 20 aa, Mycobacterium
EQHCYDIPACWAARSAFDAI

SEQ ID NO: 340506 - protein, 19 aa, Mycobacterium
EQLISPPLDRFVTSLQDTL

SEQ ID NO: 340507 - protein, 28 aa, Mycobacterium
EQLLSWGWRIPFLLSFVLMLFAIWLRLN

SEQ ID NO: 340508 - protein, 22 aa, Mycobacterium
EQPRLSRRWILIAVAALVLVAG

SEQ ID NO: 340509 - protein, 20 aa, Mycobacterium
EQQLSGALGRFFAVAESYPQ

SEQ ID NO: 340510 - protein, 20 aa, Mycobacterium
EQRARPGARATLFGMTEAFG

SEQ ID NO: 340511 - protein, 21 aa, Mycobacterium
EQRGPFAIVIARFVPIVRTLA

SEQ ID NO: 340512 - protein, 26 aa, Mycobacterium
EQRNWLRRLWLAMPLALLASVSTMVF

SEQ ID NO: 340513 - protein, 18 aa, Mycobacterium
ERCRLRWMPMTAATDDEA

SEQ ID NO: 340514 - protein, 17 aa, Mycobacterium
ERDGLRFNDDWDNLGQR

SEQ ID NO: 340515 - protein, 23 aa, Mycobacterium
ERDRLPIELAIGVLVLVVLLVVY

SEQ ID NO: 340516 - protein, 19 aa, Mycobacterium
ERFPQRWRPLIGAGTSTAL

SEQ ID NO: 340517 - protein, 18 aa, Mycobacterium
ERFSRYGLRPEVVKPSYG

SEQ ID NO: 340518 - protein, 21 aa, Mycobacterium
ERGEPWPPPVPEPAFKAAIAA

SEQ ID NO: 340519 - protein, 22 aa, Mycobacterium
ERGEPWPPPVPEPAFKAAIARA

SEQ ID NO: 340520 - protein, 17 aa, Mycobacterium
ERGFSMALGRLGDPADT

SEQ ID NO: 340521 - protein, 25 aa, Mycobacterium
ERHCFDIPICWTFRSLFETIDQVDK

SEQ ID NO: 340522 - protein, 25 aa, Mycobacterium
ERHCSDIPICWSLRSLFDAIDGVDK

SEQ ID NO: 340523 - protein, 24 aa, Mycobacterium
ERHCYDIPICWSLRNIFETLDGVD

SEQ ID NO: 340524 - protein, 25 aa, Mycobacterium
ERHCYDIPICWSLRSIFDALDGIDK

SEQ ID NO: 340525 - protein, 24 aa, Mycobacterium
ERHCYDIPICWSLRSIFDALDGLD

SEQ ID NO: 340526 - protein, 25 aa, Mycobacterium
ERHCYDIPICWSLRSLFDALDGFDQ

SEQ ID NO: 340527 - protein, 24 aa, Mycobacterium
ERHCYDIPVCFGLRSLFDTLDGFD

SEQ ID NO: 340528 - protein, 24 aa, Mycobacterium
ERHCYDIPVCWSLRSVFDGLDGID

SEQ ID NO: 340529 - protein, 19 aa, Mycobacterium
ERISLRPLWGIDARLKKFG

SEQ ID NO: 340530 - protein, 17 aa, Mycobacterium
ERISLRPLWGIDDRLKK

SEQ ID NO: 340531 - protein, 20 aa, Mycobacterium
ERLGPFWGHTAGWSFIVGKT

SEQ ID NO: 340532 - protein, 22 aa, Mycobacterium
ERLPACAVVSVGHRSTIDRHHQ

SEQ ID NO: 340533 - protein, 24 aa, Mycobacterium
ERLPKRLASAIGMVLELLAGIPSV

SEQ ID NO: 340534 - protein, 29 aa, Mycobacterium
ERLRLPAVLRRPRIRPAYRKAAPGAGVWN

SEQ ID NO: 340535 - protein, 19 aa, Mycobacterium
ERMIYRLIGVDARSEQTWG

SEQ ID NO: 340536 - protein, 20 aa, Mycobacterium
ERMRIYFARLLKLFGVGFIV

SEQ ID NO: 340537 - protein, 20 aa, Mycobacterium
ERNGFDWSAVAAVVTIGGGA

SEQ ID NO: 340538 - protein, 17 aa, Mycobacterium
ERQQSRRAIFIWLVIVL

SEQ ID NO: 340539 - protein, 19 aa, Mycobacterium
ERQRLRVGVVVTMGAGAFV

SEQ ID NO: 340540 - protein, 18 aa, Mycobacterium
ERRARAPIMARFHGMWSL

SEQ ID NO: 340541 - protein, 17 aa, Mycobacterium
ERRCAAMAIELITRPSL

SEQ ID NO: 340542 - protein, 26 aa, Mycobacterium
ERRKWWRRVWLAFPLGLVAMASTMFF

SEQ ID NO: 340543 - protein, 23 aa, Mycobacterium
ERRPSRLGRGWLVGISAALVLVA

SEQ ID NO: 340544 - protein, 22 aa, Mycobacterium
ERRPSRLGRGWLVGISAVLLLA

SEQ ID NO: 340545 - protein, 21 aa, Mycobacterium
ERRVASWLAAFLVPSAICAVI

SEQ ID NO: 340546 - protein, 22 aa, Mycobacterium
ERSPDYWLGWWVIIGTIPISVI

SEQ ID NO: 340547 - protein, 22 aa, Mycobacterium
ERSRQALKIQRWRARVRNHTVV

SEQ ID NO: 340548 - protein, 19 aa, Mycobacterium
ERTWPLTAFALVFAIVIVA

SEQ ID NO: 340549 - protein, 18 aa, Mycobacterium
ERVFEVLDLVPLIRERPS

SEQ ID NO: 340550 - protein, 21 aa, Mycobacterium
ESALPRLIAKMAHLGVDKSTV

SEQ ID NO: 340551 - protein, 24 aa, Mycobacterium
ESAYKAAGLIGMFFIGVMIGAIAS

SEQ ID NO: 340552 - protein, 18 aa, Mycobacterium
ESCRRCRAWLIGAAAQSR

SEQ ID NO: 340553 - protein, 18 aa, Mycobacterium
ESCRRCRSWLIGAAAQTR

SEQ ID NO: 340554 - protein, 18 aa, Mycobacterium
ESEFPGELGVLFKNLETK

SEQ ID NO: 340555 - protein, 26 aa, Mycobacterium
ESKPFSWHWSWWWLVALIPVLLLAGL

SEQ ID NO: 340556 - protein, 19 aa, Mycobacterium
ESLGWRWALVVAPAAALIT

SEQ ID NO: 340557 - protein, 21 aa, Mycobacterium
ESLGWRWALVVAPAVALLTIP

SEQ ID NO: 340558 - protein, 23 aa, Mycobacterium
ESLNQVFLCAAFVALAGFILALF

SEQ ID NO: 340559 - protein, 22 aa, Mycobacterium
ESLYPALLGFILLSAVAATLLV

SEQ ID NO: 340560 - protein, 20 aa, Mycobacterium
ESNFPALVTFLSNAIADQQA

SEQ ID NO: 340561 - protein, 20 aa, Mycobacterium
ESPRRKWWIAAIVAAFALAL

SEQ ID NO: 340562 - protein, 25 aa, Mycobacterium
ESPSLRYAWCAGLALLTFVLLVVVV

SEQ ID NO: 340563 - protein, 21 aa, Mycobacterium
ESRLSWVLAVLAGILGATAFT

SEQ ID NO: 340564 - protein, 24 aa, Mycobacterium
ESYGWRIPFLLALPLAVFGVWIRA

SEQ ID NO: 340565 - protein, 18 aa, Mycobacterium
ESYHKAWLGTVAVVVVAV

SEQ ID NO: 340566 - protein, 19 aa, Mycobacterium
ETESRFTLIYGNRTRESTM

SEQ ID NO: 340567 - protein, 24 aa, Mycobacterium
ETGYRLRVKMAFAEGQYRISKLDQ

SEQ ID NO: 340568 - protein, 22 aa, Mycobacterium
ETGYRLRVKMAMAEGQYKISKL

SEQ ID NO: 340569 - protein, 18 aa, Mycobacterium
ETIGGLVLQELGHIPETG

SEQ ID NO: 340570 - protein, 18 aa, Mycobacterium
ETIGGLVLQELGHIPTVG

SEQ ID NO: 340571 - protein, 23 aa, Mycobacterium
ETLGIPCAVGMLVAVFAALTLGP

SEQ ID NO: 340572 - protein, 20 aa, Mycobacterium
ETLPRPGGLITLAGDQCDGD

SEQ ID NO: 340573 - protein, 20 aa, Mycobacterium
ETRLMMVLGVGFGLGVALTL

SEQ ID NO: 340574 - protein, 23 aa, Mycobacterium
ETRLYLPMPFFWVGGFGSGILSV

SEQ ID NO: 340575 - protein, 19 aa, Mycobacterium
EVANPALWILGGAVAGLVA

SEQ ID NO: 340576 - protein, 20 aa, Mycobacterium
EVEPPFRWGLPLVALVSALL

SEQ ID NO: 340577 - protein, 17 aa, Mycobacterium
EVGVLPGTDFKLQPKYM

SEQ ID NO: 340578 - protein, 19 aa, Mycobacterium
EVLASALLRDGDSLTGQVN

SEQ ID NO: 340579 - protein, 19 aa, Mycobacterium
EVLDLVPLIRERPSAVEVP

SEQ ID NO: 340580 - protein, 18 aa, Mycobacterium
EVLFFRWLLDGNRNHEWL

SEQ ID NO: 340581 - protein, 19 aa, Mycobacterium
EVLPRLGPAVIASRPALWA

SEQ ID NO: 340582 - protein, 19 aa, Mycobacterium
EVPNALPLILGGLRTSTLQ

SEQ ID NO: 340583 - protein, 17 aa, Mycobacterium
EVPPELKATVEAISAGG

SEQ ID NO: 340584 - protein, 20 aa, Mycobacterium
EVRDGWDLKLHRAVAIKLLY

SEQ ID NO: 340585 - protein, 20 aa, Mycobacterium
EVRGKVVLIDFWAYSCINCQ

SEQ ID NO: 340586 - protein, 21 aa, Mycobacterium
EVWAHYAGWWAFDIGMLVTFG

SEQ ID NO: 340587 - protein, 18 aa, Mycobacterium
EWEWVKWLPHFGDSRRYD

SEQ ID NO: 340588 - protein, 19 aa, Mycobacterium
EWLENLWILNVGVFAAGLS

SEQ ID NO: 340589 - protein, 19 aa, Mycobacterium
EWPCAVKLMTAEFSKDPVF

SEQ ID NO: 340590 - protein, 17 aa, Mycobacterium
EYHLRGAMYGHLGQGCI

SEQ ID NO: 340591 - protein, 19 aa, Mycobacterium
EYLPMPWLFSHLSAYADRA

SEQ ID NO: 340592 - protein, 20 aa, Mycobacterium
FAADHPWRWFLIGFMVLFHL

SEQ ID NO: 340593 - protein, 20 aa, Mycobacterium
FAAEVLKIWLPAWAAYLIIF

SEQ ID NO: 340594 - protein, 18 aa, Mycobacterium
FAAIAARARLGVNVDRAL

SEQ ID NO: 340595 - protein, 23 aa, Mycobacterium
FAALGVGMAMLWSPLAATASRNL

SEQ ID NO: 340596 - protein, 25 aa, Mycobacterium
FAALLAVSGVLGWMTWKQHQLTQAG

SEQ ID NO: 340597 - protein, 17 aa, Mycobacterium
FAAVAAFSRALVLVTVA

SEQ ID NO: 340598 - protein, 19 aa, Mycobacterium
FADLLPWIDAHGDARPELI

SEQ ID NO: 340599 - protein, 19 aa, Mycobacterium
FAEGAGWLAQIGVFVILGL

SEQ ID NO: 340600 - protein, 19 aa, Mycobacterium
FAEGLGWLAQIGLFVLLGL

SEQ ID NO: 340601 - protein, 18 aa, Mycobacterium
FAEKLLIPWHSSRRTVGS

SEQ ID NO: 340602 - protein, 18 aa, Mycobacterium
FAFDGPVCRELVRFGVPV

SEQ ID NO: 340603 - protein, 18 aa, Mycobacterium
FAGAAIWLGVASFLVAGI

SEQ ID NO: 340604 - protein, 21 aa, Mycobacterium
FAGDHPWRWFLIGFMVIFHLN

SEQ ID NO: 340605 - protein, 18 aa, Mycobacterium
FAGFFAWLCWLVLHLVYL

SEQ ID NO: 340606 - protein, 17 aa, Mycobacterium
FAIELMALWLAGVRWHR

SEQ ID NO: 340607 - protein, 18 aa, Mycobacterium
FAKLPAMLFGVGRYTVTM

SEQ ID NO: 340608 - protein, 17 aa, Mycobacterium
FALIAIGLIGTWLNIGL

SEQ ID NO: 340609 - protein, 22 aa, Mycobacterium
FALMSWRARPKLAISDDALVYR

SEQ ID NO: 340610 - protein, 19 aa, Mycobacterium
FALRGPWSLDYQGATAESD

SEQ ID NO: 340611 - protein, 23 aa, Mycobacterium
FALSEAFLARWIVAVSNFGIFLV

SEQ ID NO: 340612 - protein, 19 aa, Mycobacterium
FALYVAGYCVGRFCVELLR

SEQ ID NO: 340613 - protein, 18 aa, Mycobacterium
FAMPARWGYAAAASTVDL

SEQ ID NO: 340614 - protein, 25 aa, Mycobacterium
FAPRGWVAICAFAMVVATHEVVRRL

SEQ ID NO: 340615 - protein, 17 aa, Mycobacterium
FAQLRFGNELSYKARFG

SEQ ID NO: 340616 - protein, 18 aa, Mycobacterium
FAQNRLWFVDQLQGPSPV

SEQ ID NO: 340617 - protein, 18 aa, Mycobacterium
FAQSRLWFLDQLQGPSAI

SEQ ID NO: 340618 - protein, 23 aa, Mycobacterium
FAQWGLWRWAFGMLAVITAGIAA

SEQ ID NO: 340619 - protein, 20 aa, Mycobacterium
FAQWRRLRSPSRPPLGPGGV

SEQ ID NO: 340620 - protein, 25 aa, Mycobacterium
FAQYGSWRWAFGVLVILTAAMAVLV

SEQ ID NO: 340621 - protein, 18 aa, Mycobacterium
FASLRIAAYALWPFGRTI

SEQ ID NO: 340622 - protein, 17 aa, Mycobacterium
FATFILGMFWRRMTSTA

SEQ ID NO: 340623 - protein, 17 aa, Mycobacterium
FATIDVRFLPGSVGTTM

SEQ ID NO: 340624 - protein, 18 aa, Mycobacterium
FATVNGWWYVSNFGVPWS

SEQ ID NO: 340625 - protein, 19 aa, Mycobacterium
FAVGGEWGGAVLLVAEHSP

SEQ ID NO: 340626 - protein, 17 aa, Mycobacterium
FAVPVTVGFGFSRSLQP

SEQ ID NO: 340627 - protein, 20 aa, Mycobacterium
FAYRYSEGRAAHWLILLFAD

SEQ ID NO: 340628 - protein, 20 aa, Mycobacterium
FCAIGVGMAFVWSPLAATAT

SEQ ID NO: 340629 - protein, 20 aa, Mycobacterium
FCALCAALGLNIWVGYFPTV

SEQ ID NO: 340630 - protein, 18 aa, Mycobacterium
FCGTCKVKVLAGQVDRRG

SEQ ID NO: 340631 - protein, 17 aa, Mycobacterium
FCMLLPISVVPLAAPDS

SEQ ID NO: 340632 - protein, 19 aa, Mycobacterium
FCVGCYMHKLIWGCEDCEV

SEQ ID NO: 340633 - protein, 17 aa, Mycobacterium
FCVLGVLPLIALTQIGI

SEQ ID NO: 340634 - protein, 18 aa, Mycobacterium
FCYMCASGSFLGFAFAFG

SEQ ID NO: 340635 - protein, 18 aa, Mycobacterium
FDALIGRRGLWAVVGQRF

SEQ ID NO: 340636 - protein, 18 aa, Mycobacterium
FDAPCLLLGLLTVLAVVV

SEQ ID NO: 340637 - protein, 19 aa, Mycobacterium
FDDVIAWGMAKQRSTRFAS

SEQ ID NO: 340638 - protein, 20 aa, Mycobacterium
FDFSVWELWGPLLHGGRLVV

SEQ ID NO: 340639 - protein, 18 aa, Mycobacterium
FDLASGLAEVWRRGLRLW

SEQ ID NO: 340640 - protein, 19 aa, Mycobacterium
FDLMAWRITAGVAIGIASV

SEQ ID NO: 340641 - protein, 19 aa, Mycobacterium
FDMAMLAFISLCYVSFVRW

SEQ ID NO: 340642 - protein, 18 aa, Mycobacterium
FDPFRAMRPYPQVLVAGA

SEQ ID NO: 340643 - protein, 35 aa, Mycobacterium
FDPKRLIKVRGWRRVGTVVVRWPLPVLAATLAVAL

SEQ ID NO: 340644 - protein, 18 aa, Mycobacterium
FDPTFPFDVYWILPPTNY

SEQ ID NO: 340645 - protein, 25 aa, Mycobacterium
FDQLWKWNTIVALVLGVLVILGLAG

SEQ ID NO: 340646 - protein, 19 aa, Mycobacterium
FDRNRLAAFAAMFLGGGVL

SEQ ID NO: 340647 - protein, 17 aa, Mycobacterium
FDWEMYRQAIPALFSTG

SEQ ID NO: 340648 - protein, 17 aa, Mycobacterium
FDYQPWLRRRLEDRIGG

SEQ ID NO: 340649 - protein, 17 aa, Mycobacterium
FEDAGVCAIHIEDNLGG

SEQ ID NO: 340650 - protein, 18 aa, Mycobacterium
FEEAWRFSRGEGQSVAII

SEQ ID NO: 340651 - protein, 18 aa, Mycobacterium
FEGYRWQLIPAYVLAAAI

SEQ ID NO: 340652 - protein, 17 aa, Mycobacterium
FEIAESIDLRTFPGTEY

SEQ ID NO: 340653 - protein, 23 aa, Mycobacterium
FEILPRAAKFVVVAVVVIFVAGV

SEQ ID NO: 340654 - protein, 20 aa, Mycobacterium
FEIPRAMVFIAFVFSITVTV

SEQ ID NO: 340655 - protein, 22 aa, Mycobacterium
FEKRGPFAIVIARFVPIVRTLA

SEQ ID NO: 340656 - protein, 18 aa, Mycobacterium
FENARLGTLASWIGVRET

SEQ ID NO: 340657 - protein, 23 aa, Mycobacterium
FETLGIPCAVGMLVAVMVALTLG

SEQ ID NO: 340658 - protein, 20 aa, Mycobacterium
FETPMLWAFGFLVTFLLGGL

SEQ ID NO: 340659 - protein, 22 aa, Mycobacterium
FEVAGMKFVVWRSEAPREATLR

SEQ ID NO: 340660 - protein, 22 aa, Mycobacterium
FEVGSPLAVDFVWGRQLGDYTI

SEQ ID NO: 340661 - protein, 24 aa, Mycobacterium
FEWGWEVLAALAIAAVFAIAAAQV

SEQ ID NO: 340662 - protein, 17 aa, Mycobacterium
FFALWWLQQTYQPEPAR

SEQ ID NO: 340663 - protein, 20 aa, Mycobacterium
FFANFGWRALRRSAMVAAVS

SEQ ID NO: 340664 - protein, 17 aa, Mycobacterium
FFAVWWVYDTYRPEPAP

SEQ ID NO: 340665 - protein, 23 aa, Mycobacterium
FFEEVWDPASTVAHGRVNVSFTP

SEQ ID NO: 340666 - protein, 25 aa, Mycobacterium
FFEVWLARIPFFWFDWDSGKVPKAW

SEQ ID NO: 340667 - protein, 18 aa, Mycobacterium
FFINLSFAAFRKSRAAPG

SEQ ID NO: 340668 - protein, 17 aa, Mycobacterium
FFIPLLLSLLQGLLGLI

SEQ ID NO: 340669 - protein, 17 aa, Mycobacterium
FFLCPGLPELAIWSRIS

SEQ ID NO: 340670 - protein, 17 aa, Mycobacterium
FFLLEWGRSLLVDQPDA

SEQ ID NO: 340671 - protein, 17 aa, Mycobacterium
FFLQFGLLLLAATILGR

SEQ ID NO: 340672 - protein, 22 aa, Mycobacterium
FFLRRFGIKTVMLMSMVAWTLR

SEQ ID NO: 340673 - protein, 19 aa, Mycobacterium
FFMGWSYWFAWIVTGIADL

SEQ ID NO: 340674 - protein, 23 aa, Mycobacterium
FFNMVFSSWWLRRHCGYRTPVMF

SEQ ID NO: 340675 - protein, 24 aa, Mycobacterium
FFRMCVLTGKALFRRPFQWREFIL

SEQ ID NO: 340676 - protein, 33 aa, Mycobacterium; identical to SEQ ID NO: 18601

SEQ ID NO: 340677 - protein, 17 aa, Mycobacterium
FFRYRWLRAEPLPTPRP

SEQ ID NO: 340678 - protein, 21 aa, Mycobacterium
FFSFYLCEMLFKLNGKGGQPV

SEQ ID NO: 340679 - protein, 18 aa, Mycobacterium
FFTMWGFFILLTVYIEAY

SEQ ID NO: 340680 - protein, 18 aa, Mycobacterium
FFTMWGFFVLASVYLEAY

SEQ ID NO: 340681 - protein, 18 aa, Mycobacterium
FFTMWGFFVLATVYLEAF

SEQ ID NO: 340682 - protein, 18 aa, Mycobacterium
FFVLCGWMMGHILQLQQR

SEQ ID NO: 340683 - protein, 18 aa, Mycobacterium
FGAVLAWLVAGLAVSESV

SEQ ID NO: 340684 - protein, 17 aa, Mycobacterium
FGAWLLFAGLWATFVYF

SEQ ID NO: 340685 - protein, 18 aa, Mycobacterium
FGCKRPTFSNSYYRTFTK

SEQ ID NO: 340686 - protein, 17 aa, Mycobacterium
FGCSGPFAKALMTAGWS

SEQ ID NO: 340687 - protein, 22 aa, Mycobacterium
FGEYLPMPWLFRHLSGYADRAG

SEQ ID NO: 340688 - protein, 24 aa, Mycobacterium
FGFLIWVDRKFRIGHGRLFALYVA

SEQ ID NO: 340689 - protein, 22 aa, Mycobacterium
FGFYVTCFVFVFGVLGVLMRAV

SEQ ID NO: 340690 - protein, 18 aa, Mycobacterium
FGGGHGFGGFGGGHGFGG

SEQ ID NO: 340691 - protein, 20 aa, Mycobacterium
FGGLSVGMGVAWICVISAEM

SEQ ID NO: 340692 - protein, 18 aa, Mycobacterium
FGGRMRVSTVGLVLVFFA

SEQ ID NO: 340693 - protein, 17 aa, Mycobacterium
FGGRVSYLALLVLALIA

SEQ ID NO: 340694 - protein, 17 aa, Mycobacterium
FGHDPWWLILAKSLGVF

SEQ ID NO: 340695 - protein, 17 aa, Mycobacterium
FGHDPWWLMLAKAVAIF

SEQ ID NO: 340696 - protein, 17 aa, Mycobacterium
FGICLGCQIYPLITRLR

SEQ ID NO: 340697 - protein, 27 aa, Mycobacterium
FGIVFSLFCFLGFPVLLGGIIWAIVDA

SEQ ID NO: 340698 - protein, 17 aa, Mycobacterium
FGLGLALLAWFGFYLYK

SEQ ID NO: 340699 - protein, 17 aa, Mycobacterium
FGLGYTVTRGHHLEVAG

SEQ ID NO: 340700 - protein, 25 aa, Mycobacterium
FGLLLPWLGALAVLGGLGYGIRHAV

SEQ ID NO: 340701 - protein, 18 aa, Mycobacterium
FGLSGWRFMTLMTGVPAI

SEQ ID NO: 340702 - protein, 17 aa, Mycobacterium
FGLSLRDGRWWLGGAAA

SEQ ID NO: 340703 - protein, 17 aa, Mycobacterium
FGPDVPFTFTFPKPGRY

SEQ ID NO: 340704 - protein, 19 aa, Mycobacterium
FGQLAVWIFFGLTLVLAGL

SEQ ID NO: 340705 - protein, 22 aa, Mycobacterium
FGRGDIALGWAFLGAAIGSVIR

SEQ ID NO: 340706 - protein, 18 aa, Mycobacterium
FGRRGWLNSGLALFAVTS

SEQ ID NO: 340707 - protein, 18 aa, Mycobacterium
FGRRRVMLVGWAVGLFWS

SEQ ID NO: 340708 - protein, 26 aa, Mycobacterium
FGRWRRIGTAIVRWPAPILCATIAIA

SEQ ID NO: 340709 - protein, 26 aa, Mycobacterium
FGRWRRIGTAIVRWPVPILAATIAVA

SEQ ID NO: 340710 - protein, 17 aa, Mycobacterium
FGSAPQMRAALAGDPLA

SEQ ID NO: 340711 - protein, 19 aa, Mycobacterium
FGTCYFGAFGLVVAVGLIP

SEQ ID NO: 340712 - protein, 20 aa, Mycobacterium
FGTGFAPFFLPLALFIGALI

SEQ ID NO: 340713 - protein, 17 aa, Mycobacterium
FGTLLQSLGIWRVGVRL

SEQ ID NO: 340714 - protein, 22 aa, Mycobacterium
FGTRSPVVFGWVFASHQVGAAI

SEQ ID NO: 340715 - protein, 17 aa, Mycobacterium
FGVGFMWLGMVVGLMVR

SEQ ID NO: 340716 - protein, 18 aa, Mycobacterium
FGVLVVFLLPALRDGAPA

SEQ ID NO: 340717 - protein, 20 aa, Mycobacterium
FGVPQLQLWISPAMLALMAV

SEQ ID NO: 340718 - protein, 21 aa, Mycobacterium
FGWAGCLAWSFVVIPLIDTGK

SEQ ID NO: 340719 - protein, 17 aa, Mycobacterium
FGWLTFLIVFGFFTRTV

SEQ ID NO: 340720 - protein, 18 aa, Mycobacterium
FGWLTFLLVFGWFTRNAW

SEQ ID NO: 340721 - protein, 19 aa, Mycobacterium
FGWRGPFWKWIAGLDLNVV

SEQ ID NO: 340722 - protein, 24 aa, Mycobacterium
FGYGRSRYFYSFVVALLVFVLGAV

SEQ ID NO: 340723 - protein, 20 aa, Mycobacterium
FHNIAFPGFYLLLSAASTVY

SEQ ID NO: 340724 - protein, 26 aa, Mycobacterium
FHRHRWSRRRIMLVAVLAAVLVVAAL

SEQ ID NO: 340725 - protein, 18 aa, Mycobacterium
FHRNLGRGLLGRRIERSP

SEQ ID NO: 340726 - protein, 17 aa, Mycobacterium
FHYRYTVGLWFRRIWIF

SEQ ID NO: 340727 - protein, 24 aa, Mycobacterium
FIAALAGFCLWFGISATMVGLPFA

SEQ ID NO: 340728 - protein, 17 aa, Mycobacterium
FIFATAIIWFAGGLGTW

SEQ ID NO: 340729 - protein, 17 aa, Mycobacterium
FIGLWAMIATLRAGFAH

SEQ ID NO: 340730 - protein, 26 aa, Mycobacterium
FIHLLGRWTWWAPRPLVSLRERSAIG

SEQ ID NO: 340731 - protein, 18 aa, Mycobacterium
FIHQAWFVARVSIAPTIL

SEQ ID NO: 340732 - protein, 22 aa, Mycobacterium
FIPKTRLTMIAPRAGLVTDPGA

SEQ ID NO: 340733 - protein, 17 aa, Mycobacterium
FIPRMIRLFAVPIILGW

SEQ ID NO: 340734 - protein, 17 aa, Mycobacterium
FIQGFAVGGEWGGAVLL

SEQ ID NO: 340735 - protein, 18 aa, Mycobacterium
FIREADVAAALWHPNIVR

SEQ ID NO: 340736 - protein, 19 aa, Mycobacterium
FKASLPWLAGAIGTPDVPV

SEQ ID NO: 340737 - protein, 17 aa, Mycobacterium
FKGGATFLDYARAPHVA

SEQ ID NO: 340738 - protein, 17 aa, Mycobacterium
FKGGATFLGLEAVHHVS

SEQ ID NO: 340739 - protein, 20 aa, Mycobacterium
FKGPPSWNIGYKSIRSDNPV

SEQ ID NO: 340740 - protein, 20 aa, Mycobacterium
FKISPSAWWVCGSAIGITLL

SEQ ID NO: 340741 - protein, 20 aa, Mycobacterium
FKLAIIAAGIDFRRRMSDQA

SEQ ID NO: 340742 - protein, 20 aa, Mycobacterium
FKLRSAAGMIGRFPHVVAAV

SEQ ID NO: 340743 - protein, 23 aa, Mycobacterium
FKLYPRRAVLGLALFIGQAFLYN

SEQ ID NO: 340744 - protein, 17 aa, Mycobacterium
FKMSVVFNDGKEVPANL

SEQ ID NO: 340745 - protein, 18 aa, Mycobacterium
FKMTAWKASLISLAVSIA

SEQ ID NO: 340746 - protein, 17 aa, Mycobacterium
FKNGVGLILQLPQPTVI

SEQ ID NO: 340747 - protein, 17 aa, Mycobacterium
FKNRLVTLILWSIAFVT

SEQ ID NO: 340748 - protein, 28 aa, Mycobacterium
FKSATKWSGISFRDHGNWVIGAPDVLLD

SEQ ID NO: 340749 - protein, 23 aa, Mycobacterium
FKVMLANLAPYWILQPFVDAAFK

SEQ ID NO: 340750 - protein, 19 aa, Mycobacterium
FKVPTVWLLLADDANIPRG

SEQ ID NO: 340751 - protein, 17 aa, Mycobacterium
FKVPTVWLLLHSGDDVP

SEQ ID NO: 340752 - protein, 25 aa, Mycobacterium
FLAFLCLACLIAAVGVVTDSPVTIV

SEQ ID NO: 340753 - protein, 21 aa, Mycobacterium
FLALRWPRTLAFHVPTVIWGA

SEQ ID NO: 340754 - protein, 17 aa, Mycobacterium
FLAMPRIGPWSDATTLS

SEQ ID NO: 340755 - protein, 23 aa, Mycobacterium
FLAMVFSKLAIFASIGPAISISI

SEQ ID NO: 340756 - protein, 19 aa, Mycobacterium
FLAYGWRIGFLLSLLLVVI

SEQ ID NO: 340757 - protein, 22 aa, Mycobacterium
FLAYLASFGPMFTISSELGGGS

SEQ ID NO: 340758 - protein, 20 aa, Mycobacterium
FLCPACGNFERTFGPTVSRL

SEQ ID NO: 340759 - protein, 17 aa, Mycobacterium
FLEYGIASMEVFRRRRF

SEQ ID NO: 340760 - protein, 17 aa, Mycobacterium
FLFAVTFCGVLVATGSY

SEQ ID NO: 340761 - protein, 19 aa, Mycobacterium
FLFHDWRYVFWINVPLTLI

SEQ ID NO: 340762 - protein, 17 aa, Mycobacterium
FLFSMSVVGVLVATSSY

SEQ ID NO: 340763 - protein, 17 aa, Mycobacterium
FLGADARFVRYEVPTTA

SEQ ID NO: 340764 - protein, 18 aa, Mycobacterium
FLGEWAVLIFRWLLLTGT

SEQ ID NO: 340765 - protein, 28 aa, Mycobacterium
FLGGALVEWNWRAAFLINVPLAAFVIAV

SEQ ID NO: 340766 - protein, 19 aa, Mycobacterium
FLGGESWRSTAIVSVVTTA

SEQ ID NO: 340767 - protein, 18 aa, Mycobacterium
FLGWHWSLPLGVAILGAA

SEQ ID NO: 340768 - protein, 18 aa, Mycobacterium
FLGWHWSLPLGVAILLAA

SEQ ID NO: 340769 - protein, 17 aa, Mycobacterium
FLGYFWAPIPWMIEVAL

SEQ ID NO: 340770 - protein, 20 aa, Mycobacterium
FLIFAGWAWREGREDPAGAD

SEQ ID NO: 340771 - protein, 17 aa, Mycobacterium
FLIWMAIGVVIYFLYGR

SEQ ID NO: 340772 - protein, 17 aa, Mycobacterium
FLLALGCSLCYGTATVL

SEQ ID NO: 340773 - protein, 18 aa, Mycobacterium
FLLATAIIWLLGGVGTWL

SEQ ID NO: 340774 - protein, 17 aa, Mycobacterium
FLLGLAVYLCGFTLLLS

SEQ ID NO: 340775 - protein, 18 aa, Mycobacterium
FLLIMGGFMYFASRRQRK

SEQ ID NO: 340776 - protein, 19 aa, Mycobacterium
FLLIMGGFMYFASRRQRRA

SEQ ID NO: 340777 - protein, 18 aa, Mycobacterium
FLLLRFLIALPIGALIGG

SEQ ID NO: 340778 - protein, 18 aa, Mycobacterium
FLLRPGWIALALVVIAFT

SEQ ID NO: 340779 - protein, 18 aa, Mycobacterium
FLMLWDWFAVRAHAFAAS

SEQ ID NO: 340780 - protein, 22 aa, Mycobacterium
FLPWHLRLLIRLGAAVSVVLPG

SEQ ID NO: 340781 - protein, 17 aa, Mycobacterium
FLQGFAVGGEWGGAVLL

SEQ ID NO: 340782 - protein, 17 aa, Mycobacterium
FLRRPARWMQLLASHPK

SEQ ID NO: 340783 - protein, 17 aa, Mycobacterium
FLRRVPRDTVVLLDEAY

SEQ ID NO: 340784 - protein, 25 aa, Mycobacterium
FLRTFAVPIILAWVAVVAILNTVVP

SEQ ID NO: 340785 - protein, 17 aa, Mycobacterium
FLRTLVLGMVCAHPPGL

SEQ ID NO: 340786 - protein, 24 aa, Mycobacterium
FLRYWKEIIRLVAQMSLGTGALAV

SEQ ID NO: 340787 - protein, 19 aa, Mycobacterium
FLSGGAIGWVLSRGWSRPT

SEQ ID NO: 340788 - protein, 18 aa, Mycobacterium
FLSPILVIAWTWMITRHR

SEQ ID NO: 340789 - protein, 18 aa, Mycobacterium
FLSWGWRVAFWLSAVVVL

SEQ ID NO: 340790 - protein, 19 aa, Mycobacterium
FLVGLRLGLSSAWLSLIFA

SEQ ID NO: 340791 - protein, 24 aa, Mycobacterium
FLVLGCASGLCLREGLIDLEAAAP

SEQ ID NO: 340792 - protein, 17 aa, Mycobacterium
FLVRTVIIPALFTWIGP

SEQ ID NO: 340793 - protein, 20 aa, Mycobacterium
FLWHFLIIFAWIAYLLVLFQ

SEQ ID NO: 340794 - protein, 20 aa, Mycobacterium
FLYLCCSGSFLGFAFAFGQV

SEQ ID NO: 340795 - protein, 23 aa, Mycobacterium
FMGGFLIALAMQRWNLHRRIALL

SEQ ID NO: 340796 - protein, 17 aa, Mycobacterium
FMICRHLPWVPAPALPR

SEQ ID NO: 340797 - protein, 18 aa, Mycobacterium
FMILIGLIVSRQWKLLGA

SEQ ID NO: 340798 - protein, 21 aa, Mycobacterium
FMPDLPLPYAFPASPDSGESD

SEQ ID NO: 340799 - protein, 23 aa, Mycobacterium
FMPELDAWWGYPAVIGTMAIICL

SEQ ID NO: 340800 - protein, 23 aa, Mycobacterium
FMTFSEYRGGSYAGYSAVFDDAS

SEQ ID NO: 340801 - protein, 17 aa, Mycobacterium
FMTWRITAEMPRRPAGG

SEQ ID NO: 340802 - protein, 20 aa, Mycobacterium
FMVIVAWPWLEQHFTGDDAA

SEQ ID NO: 340803 - protein, 17 aa, Mycobacterium
FMVLFAFPFFWLAGANS

SEQ ID NO: 340804 - protein, 17 aa, Mycobacterium
FNEPRVSEDQIMLSAKA

SEQ ID NO: 340805 - protein, 19 aa, Mycobacterium
FNKVFALRGGNWVELPHLT

SEQ ID NO: 340806 - protein, 18 aa, Mycobacterium
FNNPDFKRGLKLFLSPDG

SEQ ID NO: 340807 - protein, 18 aa, Mycobacterium
FNVALPWSKEVSLSRSAN

SEQ ID NO: 340808 - protein, 20 aa, Mycobacterium
FNVSLPWTKAVILNPGIQNP

SEQ ID NO: 340809 - protein, 21 aa, Mycobacterium
FPADVLYEFRLASLGTQVVLW

SEQ ID NO: 340810 - protein, 17 aa, Mycobacterium
FPADVLYYFRLYALGTQ

SEQ ID NO: 340811 - protein, 19 aa, Mycobacterium
FPADVLYYFRLYALGTQVV

SEQ ID NO: 340812 - protein, 17 aa, Mycobacterium
FPALAVAVTPQYREPEE

SEQ ID NO: 340813 - protein, 18 aa, Mycobacterium
FPDQLSLLARRPDLIPSA

SEQ ID NO: 340814 - protein, 20 aa, Mycobacterium
FPGLEVCVYAAPSQTVIGGP

SEQ ID NO: 340815 - protein, 21 aa, Mycobacterium
FPGTPRWVWAVVFVAVNTVIN

SEQ ID NO: 340816 - protein, 24 aa, Mycobacterium
FPGVPRWVWVFSIIFFIGAINLLS

SEQ ID NO: 340817 - protein, 19 aa, Mycobacterium
FPGYLGFHIVERWQFHYSQ

SEQ ID NO: 340818 - protein, 17 aa, Mycobacterium
FPIGTLKTLGTVGLIVG

SEQ ID NO: 340819 - protein, 18 aa, Mycobacterium
FPIWQILWDLIKVVGTEI

SEQ ID NO: 340820 - protein, 18 aa, Mycobacterium
FPLAIAILFALIIALPLG

SEQ ID NO: 340821 - protein, 17 aa, Mycobacterium
FPMYYLRSFAYAGIATV

SEQ ID NO: 340822 - protein, 18 aa, Mycobacterium
FPNTLVLAISLVFVVIVA

SEQ ID NO: 340823 - protein, 17 aa, Mycobacterium
FPPAEFPGGIRIPSTTL

SEQ ID NO: 340824 - protein, 17 aa, Mycobacterium
FPPSWKPGPDWEPLGML

SEQ ID NO: 340825 - protein, 22 aa, Mycobacterium
FPPTCLLAILGLVFFLVVRQWW

SEQ ID NO: 340826 - protein, 21 aa, Mycobacterium
FPRHWRCWPRHWSRAPRPRSS

SEQ ID NO: 340827 - protein, 19 aa, Mycobacterium
FPVGFCLLYLLGFDLLTGV

SEQ ID NO: 340828 - protein, 18 aa, Mycobacterium
FPVIGVWVLIATLRAGLA

SEQ ID NO: 340829 - protein, 25 aa, Mycobacterium
FPVVAYRAWRWWLATAVAFFAVAAL

SEQ ID NO: 340830 - protein, 28 aa, Mycobacterium
FPVVAYRSWRWWLGTAIGFFIVTIALAM

SEQ ID NO: 340831 - protein, 23 aa, Mycobacterium
FPVVAYRTWRWWLATAAAFFAVV

SEQ ID NO: 340832 - protein, 21 aa, Mycobacterium
FPWAGLTIFLLIAVLAAAVGT

SEQ ID NO: 340833 - protein, 20 aa, Mycobacterium
FPYQSGAFFSDFMAWILRPL

SEQ ID NO: 340834 - protein, 20 aa, Mycobacterium
FQPFFDYFWGFKAYGTPGYP

SEQ ID NO: 340835 - protein, 24 aa, Mycobacterium
FQPLGIPCAIGITVAVLVALTLAP

SEQ ID NO: 340836 - protein, 20 aa, Mycobacterium
FQRAVLRIGNYLIVLAAALV

SEQ ID NO: 340837 - protein, 24 aa, Mycobacterium
FQRWDVFRPPKFVGLQNFRELFTS

SEQ ID NO: 340838 - protein, 17 aa, Mycobacterium
FQTLGVPCAVGMLVAVA

SEQ ID NO: 340839 - protein, 18 aa, Mycobacterium
FQWNWKFGYQKIAFADGS

SEQ ID NO: 340840 - protein, 17 aa, Mycobacterium
FQYSDMLQFVWAQAKFR

SEQ ID NO: 340841 - protein, 17 aa, Mycobacterium
FRDGGAMPGTWRNVKIG

SEQ ID NO: 340842 - protein, 19 aa, Mycobacterium
FRFAEVALRFIRRRYDEVM

SEQ ID NO: 340843 - protein, 19 aa, Mycobacterium
FRFEELCATPAVPRDPRDS

SEQ ID NO: 340844 - protein, 17 aa, Mycobacterium
FRFPDPNGVGFENGAPP

SEQ ID NO: 340845 - protein, 18 aa, Mycobacterium
FRGFPWKQVIPFILAQVG

SEQ ID NO: 340846 - protein, 19 aa, Mycobacterium
FRGLRSVWRRGREIYAEVV

SEQ ID NO: 340847 - protein, 19 aa, Mycobacterium
FRHPIAWARATLDGVDALL

SEQ ID NO: 340848 - protein, 17 aa, Mycobacterium
FRIGIGINTGVVIAGTI

SEQ ID NO: 340849 - protein, 19 aa, Mycobacterium
FRLGSTRLRKVAMLVVVVI

SEQ ID NO: 340850 - protein, 17 aa, Mycobacterium
FRLPALNRRQFLGSLAA

SEQ ID NO: 340851 - protein, 32 aa, Mycobacterium
FRMCVLTGRALFRWPFQWREFVLQCWFIMRVA

SEQ ID NO: 340852 - protein, 19 aa, Mycobacterium
FRRAELCRERLGPVLRRLT

SEQ ID NO: 340853 - protein, 25 aa, Mycobacterium
FRRIAAALGRPVIRLGFELAELRLV

SEQ ID NO: 340854 - protein, 23 aa, Mycobacterium
FRRRLDEYIGFLVAWQKPFTGKK

SEQ ID NO: 340855 - protein, 25 aa, Mycobacterium
FRRRNPRPAIIVVILLVVLTGVVWT

SEQ ID NO: 340856 - protein, 25 aa, Mycobacterium
FRRRNPRPAIVVVILLAIATAAAWT

SEQ ID NO: 340857 - protein, 24 aa, Mycobacterium
FRRRNPRPAIVVVVLLVVVTAVVW

SEQ ID NO: 340858 - protein, 17 aa, Mycobacterium
FRRVVLWSLGFLVLLCA

SEQ ID NO: 340859 - protein, 22 aa, Mycobacterium
FRRWLPRHRRLLVTLSVAVAIG

SEQ ID NO: 340860 - protein, 20 aa, Mycobacterium
FRSAVPRGWVRARKTIVSGN

SEQ ID NO: 340861 - protein, 20 aa, Mycobacterium
FRSGLLFALASAFAFGCSGP

SEQ ID NO: 340862 - protein, 17 aa, Mycobacterium
FRSGLLIVVALAAVLVI

SEQ ID NO: 340863 - protein, 20 aa, Mycobacterium
FRSPRWVPVLGWLLVLGSVA

SEQ ID NO: 340864 - protein, 19 aa, Mycobacterium
FRTEFFIKTGLVLLGASIN

SEQ ID NO: 340865 - protein, 25 aa, Mycobacterium
FRTLGIPCAVGMLLAVVVALTLGPA

SEQ ID NO: 340866 - protein, 21 aa, Mycobacterium
FRTPEFYGWMLVLPIGLMLQQ

SEQ ID NO: 340867 - protein, 20 aa, Mycobacterium
FRVSPVPVMRIFGTWYVNVV

SEQ ID NO: 340868 - protein, 17 aa, Mycobacterium
FSALILVAAWRMHARQA

SEQ ID NO: 340869 - protein, 17 aa, Mycobacterium
FSAVVAFASSCRHPATA

SEQ ID NO: 340870 - protein, 18 aa, Mycobacterium
FSDALPWLAAQIRTPGAT

SEQ ID NO: 340871 - protein, 18 aa, Mycobacterium
FSEPDPPPLYYIPPSSSS

SEQ ID NO: 340872 - protein, 19 aa, Mycobacterium
FSFDMSWEELFWLVEGHQV

SEQ ID NO: 340873 - protein, 18 aa, Mycobacterium
FSFDMSWEELLWLIEGHE

SEQ ID NO: 340874 - protein, 22 aa, Mycobacterium
FSGSRWFLFPALAAISDDVLTR

SEQ ID NO: 340875 - protein, 18 aa, Mycobacterium
FSHQHPWLRVFSITLMFA

SEQ ID NO: 340876 - protein, 18 aa, Mycobacterium
FSIDEIPQFINVVKRDMS

SEQ ID NO: 340877 - protein, 18 aa, Mycobacterium
FSIDELPQFINVLKGDMS

SEQ ID NO: 340878 - protein, 26 aa, Mycobacterium
FSIPPRWRTSWGWGWITIGLVAIVCN

SEQ ID NO: 340879 - protein, 17 aa, Mycobacterium
FSLPLYVMCALARRRRL

SEQ ID NO: 340880 - protein, 18 aa, Mycobacterium
FSRGEGQSVAIIDTGVKP

SEQ ID NO: 340881 - protein, 23 aa, Mycobacterium
FSRLWPTVVCLIGYAISFALLAV

SEQ ID NO: 340882 - protein, 21 aa, Mycobacterium
FSRRWAKLWLPITAGIYTANG

SEQ ID NO: 340883 - protein, 21 aa, Mycobacterium
FSTSRLKPWDARHIRRGALAA

SEQ ID NO: 340884 - protein, 28 aa, Mycobacterium
FSVALSLLWNYAMLWFGFVVLPALQIVF

SEQ ID NO: 340885 - protein, 20 aa, Mycobacterium
FSVWEIWAALLGGARVVVVP

SEQ ID NO: 340886 - protein, 20 aa, Mycobacterium
FSVWMLWSIVVVQMMAVGAP

SEQ ID NO: 340887 - protein, 17 aa, Mycobacterium
FTAAMAFEIGSTNLVAE

SEQ ID NO: 340888 - protein, 17 aa, Mycobacterium
FTAEFLQAAALRPGNIV

SEQ ID NO: 340889 - protein, 17 aa, Mycobacterium
FTAGWGCTAFTVNPDGW

SEQ ID NO: 340890 - protein, 22 aa, Mycobacterium
FTALCLFASLFIMLRRKRVPGV

SEQ ID NO: 340891 - protein, 22 aa, Mycobacterium
FTASGYVLWWAVLFPAISVPII

SEQ ID NO: 340892 - protein, 19 aa, Mycobacterium
FTDLVALPAGWAWLENGWV

SEQ ID NO: 340893 - protein, 19 aa, Mycobacterium
FTDRFQRIFVPVVLVGVVL

SEQ ID NO: 340894 - protein, 20 aa, Mycobacterium
FTDRFQRVFVPVILVGVVLL

SEQ ID NO: 340895 - protein, 17 aa, Mycobacterium
FTEPRPGDVVVFKGPPS

SEQ ID NO: 340896 - protein, 17 aa, Mycobacterium
FTGKVFIIFQRLHGRDT

SEQ ID NO: 340897 - protein, 19 aa, Mycobacterium
FTGMAIRIADVWKITRKVG

SEQ ID NO: 340898 - protein, 23 aa, Mycobacterium
FTGPEVWWLLSVARWASGMPAAT

SEQ ID NO: 340899 - protein, 24 aa, Mycobacterium
FTGPEVWWLLTVARWAARMPAATV

SEQ ID NO: 340900 - protein, 24 aa, Mycobacterium
FTIASVLCGIAWDEATLVIARLLQ

SEQ ID NO: 340901 - protein, 18 aa, Mycobacterium
FTLPFAMVETFGWTTIVD

SEQ ID NO: 340902 - protein, 21 aa, Mycobacterium
FTLRLAVGLGCGALIGIERQW

SEQ ID NO: 340903 - protein, 23 aa, Mycobacterium
FTLRLAVGVGCGALIGLERQWRA

SEQ ID NO: 340904 - protein, 17 aa, Mycobacterium
FTLRTALLMTFVLTASA

SEQ ID NO: 340905 - protein, 23 aa, Mycobacterium
FTLYPRRAVLGLALFIGQAFLYN

SEQ ID NO: 340906 - protein, 17 aa, Mycobacterium
FTPGSVLTVLGVGIFAV

SEQ ID NO: 340907 - protein, 17 aa, Mycobacterium
FTPQQIMVWALAASSVF

SEQ ID NO: 340908 - protein, 21 aa, Mycobacterium
FTSLCSVCIALIYLAYLMVTT

SEQ ID NO: 340909 - protein, 17 aa, Mycobacterium
FTTAAIWLVIAAFVVAS

SEQ ID NO: 340910 - protein, 17 aa, Mycobacterium
FTVGLAFLAGLSVLIRP

SEQ ID NO: 340911 - protein, 18 aa, Mycobacterium
FTVLALRGSWLDALGGTL

SEQ ID NO: 340912 - protein, 17 aa, Mycobacterium
FTVLVSFTLNILLSELG

SEQ ID NO: 340913 - protein, 17 aa, Mycobacterium
FTWLRRRSGSLLAPIAL

SEQ ID NO: 340914 - protein, 22 aa, Mycobacterium
FVACPWGGPGTRMYRTGDLVSW

SEQ ID NO: 340915 - protein, 24 aa, Mycobacterium
FVAGLRQGWAFAWRSLMAGELVVL

SEQ ID NO: 340916 - protein, 17 aa, Mycobacterium
FVAGWPFLKAAAQQARA

SEQ ID NO: 340917 - protein, 17 aa, Mycobacterium
FVAGWPFLVGAVQQARA

SEQ ID NO: 340918 - protein, 25 aa, Mycobacterium
FVAMVKPPFAWREFISQSWFVARVS

SEQ ID NO: 340919 - protein, 18 aa, Mycobacterium
FVCAGVLLYVDIGRRRSR

SEQ ID NO: 340920 - protein, 17 aa, Mycobacterium
FVCGIAFNYFRRSEQFH

SEQ ID NO: 340921 - protein, 21 aa, Mycobacterium
FVDLRWWPFLLLLGTTLALML

SEQ ID NO: 340922 - protein, 23 aa, Mycobacterium
FVEEILQRNGFRVTLAAVATTGG

SEQ ID NO: 340923 - protein, 20 aa, Mycobacterium
FVESVSWIPAFGMKYAVGLD

SEQ ID NO: 340924 - protein, 18 aa, Mycobacterium
FVGIVLVLMWWRRPPVRS

SEQ ID NO: 340925 - protein, 19 aa, Mycobacterium
FVGRWLPDRAILWQMVLLD

SEQ ID NO: 340926 - protein, 17 aa, Mycobacterium
FVGWQLWQTKQVIAAGN

SEQ ID NO: 340927 - protein, 17 aa, Mycobacterium
FVICVAALLVAQIFVRP

SEQ ID NO: 340928 - protein, 18 aa, Mycobacterium
FVIQKPFVVIAIWISLAA

SEQ ID NO: 340929 - protein, 18 aa, Mycobacterium
FVLGYDIANAVIYWITHL

SEQ ID NO: 340930 - protein, 17 aa, Mycobacterium
FVLRHAVAVGSSVVVLL

SEQ ID NO: 340931 - protein, 25 aa, Mycobacterium
FVPRGGVYGTWGWRGLAAYAIGIIA

SEQ ID NO: 340932 - protein, 26 aa, Mycobacterium
FVPVLLYRIWRLWRYPSLLPGKAVTG

SEQ ID NO: 340933 - protein, 24 aa, Mycobacterium
FVRRFAVPILTTWLFMTVAVNVLV

SEQ ID NO: 340934 - protein, 17 aa, Mycobacterium
FVRRQLRLPHPLIDVRL

SEQ ID NO: 340935 - protein, 25 aa, Mycobacterium
FVRTFAWPIIIGWLLLTVALNVLVP

SEQ ID NO: 340936 - protein, 18 aa, Mycobacterium
FVSAGAVAARFGASALAA

SEQ ID NO: 340937 - protein, 18 aa, Mycobacterium
FVSCAAFFVAWPTAAVYL

SEQ ID NO: 340938 - protein, 19 aa, Mycobacterium
FVSLPGLVAVTGRWDLAPG

SEQ ID NO: 340939 - protein, 24 aa, Mycobacterium
FVSMFRPPFAWREYLLQCWFVARV

SEQ ID NO: 340940 - protein, 17 aa, Mycobacterium
FVSPILDKFSEGWDALK

SEQ ID NO: 340941 - protein, 21 aa, Mycobacterium
FVSRAVGLVPWRSWRREQNGE

SEQ ID NO: 340942 - protein, 18 aa, Mycobacterium
FVSVFACALAFHNITARY

SEQ ID NO: 340943 - protein, 18 aa, Mycobacterium
FVSYQVWFIAGFLAGLAG

SEQ ID NO: 340944 - protein, 17 aa, Mycobacterium
FVTGFALAGVYPVGMKL

SEQ ID NO: 340945 - protein, 23 aa, Mycobacterium
FVVDWRLALVMFVPVLIYLVLMT

SEQ ID NO: 340946 - protein, 18 aa, Mycobacterium
FVVFTIGNGVLWLHDSVL

SEQ ID NO: 340947 - protein, 17 aa, Mycobacterium
FVVGMGIGLGLSSQLVT

SEQ ID NO: 340948 - protein, 17 aa, Mycobacterium
FVVLIGAAVLRWRAKLR

SEQ ID NO: 340949 - protein, 26 aa, Mycobacterium
FVVPCILRILGPWFWWPTLVRARPLR

SEQ ID NO: 340950 - protein, 26 aa, Mycobacterium
FVVPCILRILGPWFWWPTLVRSRPLP

SEQ ID NO: 340951 - protein, 24 aa, Mycobacterium
FVVSLLCAFGFDWAPLLWLPACAV

SEQ ID NO: 340952 - protein, 17 aa, Mycobacterium
FWIGRPIITLAFRNEKF

SEQ ID NO: 340953 - protein, 17 aa, Mycobacterium
FWLGLVVLQIFSVQLGL

SEQ ID NO: 340954 - protein, 18 aa, Mycobacterium
FWLKIGIVALGARFVLGD

SEQ ID NO: 340955 - protein, 18 aa, Mycobacterium
FWLPCLACLLALAELHLR

SEQ ID NO: 340956 - protein, 19 aa, Mycobacterium
FWRKIYRRFGVRGMLLGSA

SEQ ID NO: 340957 - protein, 17 aa, Mycobacterium
FWTWPIVFLGQYMVALN

SEQ ID NO: 340958 - protein, 17 aa, Mycobacterium
FWVCGLLLCLFVGPSQS

SEQ ID NO: 340959 - protein, 17 aa, Mycobacterium
FWWAVVVFCVWLTALIV

SEQ ID NO: 340960 - protein, 18 aa, Mycobacterium
FWWELALLIVIMLLGHWV

SEQ ID NO: 340961 - protein, 17 aa, Mycobacterium
FYAYFKFVRYEEAPPEL

SEQ ID NO: 340962 - protein, 17 aa, Mycobacterium
FYDYVPWVDRIPPYSEH

SEQ ID NO: 340963 - protein, 17 aa, Mycobacterium
FYFGYPMGFVLVAILQS

SEQ ID NO: 340964 - protein, 18 aa, Mycobacterium
FYFLTGFGALLQLGLFQL

SEQ ID NO: 340965 - protein, 24 aa, Mycobacterium
FYFVLPRWFELMGETSHALGTTLR

SEQ ID NO: 340966 - protein, 19 aa, Mycobacterium
FYHDMGFILGIVFPVLAGV

SEQ ID NO: 340967 - protein, 20 aa, Mycobacterium
FYIPFAIPWNHFVGGASSGV

SEQ ID NO: 340968 - protein, 19 aa, Mycobacterium
FYIPFAIPWNHYVGGGASG

SEQ ID NO: 340969 - protein, 19 aa, Mycobacterium
FYRQILKYSGLVIAIGPLV

SEQ ID NO: 340970 - protein, 18 aa, Mycobacterium
FYTAHYFGAWVFIAGFVV

SEQ ID NO: 340971 - protein, 18 aa, Mycobacterium
FYTAHYFGAWVFITGFVV

SEQ ID NO: 340972 - protein, 19 aa, Mycobacterium
FYVGWPIHRTGWLALAHRS

SEQ ID NO: 340973 - protein, 23 aa, Mycobacterium
FYVICAAVTWYAYVRRPMTVSVP

SEQ ID NO: 340974 - protein, 18 aa, Mycobacterium
FYWAIGIAVGFPVGLILL

SEQ ID NO: 340975 - protein, 18 aa, Mycobacterium
GAAAGWRTPFAVLAALAM

SEQ ID NO: 340976 - protein, 19 aa, Mycobacterium
GAADLPAFCAVAGAVTAAA

SEQ ID NO: 340977 - protein, 18 aa, Mycobacterium
GAAFGFFPILWIVINAIW

SEQ ID NO: 340978 - protein, 17 aa, Mycobacterium
GAARAMFDPVLSRLKEL

SEQ ID NO: 340979 - protein, 18 aa, Mycobacterium
GAATFGFAGTAGKEIVGQ

SEQ ID NO: 340980 - protein, 19 aa, Mycobacterium
GAATVRWPGAILVASVAVS

SEQ ID NO: 340981 - protein, 19 aa, Mycobacterium
GAAVLWRARKALGLLGIAV

SEQ ID NO: 340982 - protein, 17 aa, Mycobacterium
GAAWAWVAPPIKGVIAL

SEQ ID NO: 340983 - protein, 17 aa, Mycobacterium
GADQLLLRWRQANDRIT

SEQ ID NO: 340984 - protein, 19 aa, Mycobacterium
GADSWPLRAAVAGALVLTL

SEQ ID NO: 340985 - protein, 19 aa, Mycobacterium
GADVFGRGGPYLARGAADL

SEQ ID NO: 340986 - protein, 19 aa, Mycobacterium
GAEALGLPLGWTLRKIVLK

SEQ ID NO: 340987 - protein, 24 aa, Mycobacterium
GAETLRLAGYLIMCRNTTKDFEDF

SEQ ID NO: 340988 - protein, 18 aa, Mycobacterium
GAFAHRWLARRTRRRINP

SEQ ID NO: 340989 - protein, 20 aa, Mycobacterium
GAFARWVARTPWPVFTLGML

SEQ ID NO: 340990 - protein, 17 aa, Mycobacterium
GAFAWQWDPYPFILLNL

SEQ ID NO: 340991 - protein, 31 aa, Mycobacterium
GAFPRLARLVVRRPLIVIGFWVALAAALSMA

SEQ ID NO: 340992 - protein, 18 aa, Mycobacterium
GAFSHRWLARRTRRRINP

SEQ ID NO: 340993 - protein, 24 aa, Mycobacterium
GAFYKRSWRINDWMWGRLDGAGWL

SEQ ID NO: 340994 - protein, 20 aa, Mycobacterium
GAGELLVWLPYPGFAAYLQV

SEQ ID NO: 340995 - protein, 24 aa, Mycobacterium
GAGLPRWRYLVLPVIGAAVDIYLL

SEQ ID NO: 340996 - protein, 23 aa, Mycobacterium
GAGPVLRLWRSVLMFASRFWQFE

SEQ ID NO: 340997 - protein, 18 aa, Mycobacterium
GAGQWRWPLGEIDRPFDM

SEQ ID NO: 340998 - protein, 19 aa, Mycobacterium
GAGRGFCSGAGISEEDHAN

SEQ ID NO: 340999 - protein, 21 aa, Mycobacterium
GAHWRAIVVVGLLVSSAALVT

SEQ ID NO: 341000 - protein, 17 aa, Mycobacterium
GAIALALVAALAVLVTV

SEQ ID NO: 341001 - protein, 20 aa, Mycobacterium
GAIGWCVLPLMLALPTRTGA

SEQ ID NO: 341002 - protein, 17 aa, Mycobacterium
GAIPAMYLWALAGIMLI

SEQ ID NO: 341003 - protein, 18 aa, Mycobacterium
GALADWFAVTALFKHPLG

SEQ ID NO: 341004 - protein, 18 aa, Mycobacterium
GALADWFAVTALFRHPLG

SEQ ID NO: 341005 - protein, 24 aa, Mycobacterium
GALAEVSWRLAFLINVPAGALMIY

SEQ ID NO: 341006 - protein, 17 aa, Mycobacterium
GALAILVMVVWVGTALT

SEQ ID NO: 341007 - protein, 25 aa, Mycobacterium
GALAVFCAACWLIALLARNYRHEDW

SEQ ID NO: 341008 - protein, 22 aa, Mycobacterium
GALDLLQTIGFVWFELLITSCY

SEQ ID NO: 341009 - protein, 17 aa, Mycobacterium
GALFWMWMVAFLGASTS

SEQ ID NO: 341010 - protein, 17 aa, Mycobacterium
GALGVAGLVEWPVLLAV

SEQ ID NO: 341011 - protein, 22 aa, Mycobacterium
GALLEHFHWGAVFLVAVPILLP

SEQ ID NO: 341012 - protein, 23 aa, Mycobacterium
GALLFPGAHGWITYLWVPPFASE

SEQ ID NO: 341013 - protein, 24 aa, Mycobacterium
GALLRLPYTFAIPVFGGRNWTTIS

SEQ ID NO: 341014 - protein, 19 aa, Mycobacterium
GALPGIWAFFSHRVAFVFT

SEQ ID NO: 341015 - protein, 18 aa, Mycobacterium
GALRGWLLTLAQPAHHGL

SEQ ID NO: 341016 - protein, 18 aa, Mycobacterium
GALRRWLLDRGELPKQSL

SEQ ID NO: 341017 - protein, 21 aa, Mycobacterium
GALRVNWALGFQLFDYTGETS

SEQ ID NO: 341018 - protein, 23 aa, Mycobacterium
GALTEVSWRWAFLVNVPIGLVMV

SEQ ID NO: 341019 - protein, 17 aa, Mycobacterium
GALWSSLIAGFLILILL

SEQ ID NO: 341020 - protein, 21 aa, Mycobacterium
GAMLYWQFRGTFIPKTRLTMI

SEQ ID NO: 341021 - protein, 23 aa, Mycobacterium
GAMPRIALVIVIFMPLLYGAMYL

SEQ ID NO: 341022 - protein, 19 aa, Mycobacterium
GANTGWWPLLWFTAKVWGF

SEQ ID NO: 341023 - protein, 23 aa, Mycobacterium
GAPAEIWEVFTLQPGPGGAFTGE

SEQ ID NO: 341024 - protein, 20 aa, Mycobacterium
GAPCAIGMLVAVLAALTLGP

SEQ ID NO: 341025 - protein, 23 aa, Mycobacterium
GAPEAVDFSRWWAGTHQHVTDLQ

SEQ ID NO: 341026 - protein, 18 aa, Mycobacterium
GAPVAIAVPAHWGERQVG

SEQ ID NO: 341027 - protein, 18 aa, Mycobacterium
GAQPSFRLADYVTDNAGA

SEQ ID NO: 341028 - protein, 18 aa, Mycobacterium
GARWWRRGVAVLSIPLCV

SEQ ID NO: 341029 - protein, 21 aa, Mycobacterium
GASHLGVWFGHFPWWIPLGSL

SEQ ID NO: 341030 - protein, 23 aa, Mycobacterium
GATAARPPVEFSHEEEMYDAGPA

SEQ ID NO: 341031 - protein, 23 aa, Mycobacterium
GATGVFLACRWAQAHAGAGVWVG

SEQ ID NO: 341032 - protein, 18 aa, Mycobacterium
GATGWLVWQTQRAEQDQR

SEQ ID NO: 341033 - protein, 17 aa, Mycobacterium
GATPLNFFVGGLQVVTP

SEQ ID NO: 341034 - protein, 17 aa, Mycobacterium
GAVAACLPVMVGGLSIA

SEQ ID NO: 341035 - protein, 18 aa, Mycobacterium
GAVAACLPVMVGGLSIAG

SEQ ID NO: 341036 - protein, 19 aa, Mycobacterium
GAVAGMFGEFFYKDPRRIA

SEQ ID NO: 341037 - protein, 18 aa, Mycobacterium
GAVALCFQAARLQLLRGH

SEQ ID NO: 341038 - protein, 18 aa, Mycobacterium
GAVALVLLGGFAILGGIL

SEQ ID NO: 341039 - protein, 17 aa, Mycobacterium
GAVALVLLTSFSLLGGI

SEQ ID NO: 341040 - protein, 19 aa, Mycobacterium
GAVKIDWGALLIVSVLTVL

SEQ ID NO: 341041 - protein, 20 aa, Mycobacterium
GAVLFFRWLLKGGRNAELLA

SEQ ID NO: 341042 - protein, 25 aa, Mycobacterium
GAVLLFGFLLPWLGVLAVVGVVIYG

SEQ ID NO: 341043 - protein, 17 aa, Mycobacterium
GAVLPALLAHALGAEDA

SEQ ID NO: 341044 - protein, 17 aa, Mycobacterium
GAVLVMAVVLALVGLLT

SEQ ID NO: 341045 - protein, 22 aa, Mycobacterium
GAVPSVPRWLWVVLAIGGITAA

SEQ ID NO: 341046 - protein, 19 aa, Mycobacterium
GAWARFAGVAWPRGGKLAH

SEQ ID NO: 341047 - protein, 23 aa, Mycobacterium
GAWRRIAESVARRPALVAVVAIA

SEQ ID NO: 341048 - protein, 20 aa, Mycobacterium
GAWWFDIAMLVLISLFYLGF

SEQ ID NO: 341049 - protein, 17 aa, Mycobacterium
GAWWFDMGMLVLISVFY

SEQ ID NO: 341050 - protein, 17 aa, Mycobacterium
GAYAGGVLGRFIPGTAL

SEQ ID NO: 341051 - protein, 21 aa, Mycobacterium
GCARAGQSLVIFPEGRLARAP

SEQ ID NO: 341052 - protein, 17 aa, Mycobacterium
GCGGLRMTHDLLHGDIA

SEQ ID NO: 341053 - protein, 17 aa, Mycobacterium
GCGGLRMTHDLLHGDVA

SEQ ID NO: 341054 - protein, 19 aa, Mycobacterium
GCGVSWNLLAGIGRIESGH

SEQ ID NO: 341055 - protein, 18 aa, Mycobacterium
GCIAEILMFTGFLWPPVV

SEQ ID NO: 341056 - protein, 17 aa, Mycobacterium
GCIVVALTLHVWVSRRR

SEQ ID NO: 341057 - protein, 20 aa, Mycobacterium
GCLLATLGLWRWSEGTVSVT

SEQ ID NO: 341058 - protein, 21 aa, Mycobacterium
GCLLFGMAFVCLVGLLQSVAS

SEQ ID NO: 341059 - protein, 23 aa, Mycobacterium
GCSRAWMLAFSWIAMAGIGVLQY

SEQ ID NO: 341060 - protein, 23 aa, Mycobacterium
GCSSWADALALGWPRGITPQAQL

SEQ ID NO: 341061 - protein, 20 aa, Mycobacterium
GCYALEMWGGPVGQEVSLAV

SEQ ID NO: 341062 - protein, 23 aa, Mycobacterium
GDEMAAWGWRVPMLFGAAMGFFV

SEQ ID NO: 341063 - protein, 23 aa, Mycobacterium
GDFFSFYMCDLLLKLNGKGGQPI

SEQ ID NO: 341064 - protein, 19 aa, Mycobacterium
GDGRPALTVRAVCRKAALT

SEQ ID NO: 341065 - protein, 19 aa, Mycobacterium
GDGSWRLMGVLALADPPRD

SEQ ID NO: 341066 - protein, 17 aa, Mycobacterium
GDHGWRAMMLLAGLPAL

SEQ ID NO: 341067 - protein, 22 aa, Mycobacterium
GDKAWWIPAWLDRLLPDLDIEG

SEQ ID NO: 341068 - protein, 21 aa, Mycobacterium
GDKMKVVFHFNNKYKVPENAT

SEQ ID NO: 341069 - protein, 24 aa, Mycobacterium
GDLGIPRTLVWRLAADPVPDDHDA

SEQ ID NO: 341070 - protein, 17 aa, Mycobacterium
GDLRPAFDDVLPVGNGG

SEQ ID NO: 341071 - protein, 17 aa, Mycobacterium
GDLWCQAALVLAAGAAS

SEQ ID NO: 341072 - protein, 25 aa, Mycobacterium
GDNTWFSWLVVFWLWLTVIFANLAE

SEQ ID NO: 341073 - protein, 18 aa, Mycobacterium
GDPAEFWGLKGLIGGNAV

SEQ ID NO: 341074 - protein, 23 aa, Mycobacterium
GDPSGWPRLDWAMDAALLLVALA

SEQ ID NO: 341075 - protein, 22 aa, Mycobacterium
GDRGVSWLPFFHDMGLITVLLA

SEQ ID NO: 341076 - protein, 20 aa, Mycobacterium
GDRPRLVWYAPHRVEGQTSE

SEQ ID NO: 341077 - protein, 17 aa, Mycobacterium
GDSGFYFDGELFIIGRI

SEQ ID NO: 341078 - protein, 18 aa, Mycobacterium
GDSRADLFGTIRNLQILV

SEQ ID NO: 341079 - protein, 18 aa, Mycobacterium
GDSRLVFLAAFAGFAVGL

SEQ ID NO: 341080 - protein, 20 aa, Mycobacterium
GDSVSCGVKRSWALSETNPT

SEQ ID NO: 341081 - protein, 24 aa, Mycobacterium
GDSYSGDTWRMWSYAWEARDTGFH

SEQ ID NO: 341082 - protein, 17 aa, Mycobacterium
GDVFLGLITPHGLIELT

SEQ ID NO: 341083 - protein, 24 aa, Mycobacterium
GDVFRRSWKWLSVVGLVAILVICV

SEQ ID NO: 341084 - protein, 26 aa, Mycobacterium
GDVHWTQQINWLWVRRAAYLSAAVLV

SEQ ID NO: 341085 - protein, 18 aa, Mycobacterium
GDVITWWTGSQVLVLSAS

SEQ ID NO: 341086 - protein, 27 aa, Mycobacterium
GDWCYRQRWVVIAAWLVLISAVATILV

SEQ ID NO: 341087 - protein, 18 aa, Mycobacterium
GEAGRGWTMILLAIMMPA

SEQ ID NO: 341088 - protein, 22 aa, Mycobacterium
GEAIPLRFVTGFALAGVYPVGM

SEQ ID NO: 341089 - protein, 23 aa, Mycobacterium
GEALRRWAALLVMTIFVVIMPLT

SEQ ID NO: 341090 - protein, 19 aa, Mycobacterium
GEAMLFGEYIRFMALVEYS

SEQ ID NO: 341091 - protein, 22 aa, Mycobacterium
GEAPTRVMLVGQRLDLDSVAAE

SEQ ID NO: 341092 - protein, 23 aa, Mycobacterium
GEDYLRLAALGSYGAFFNIYFCT

SEQ ID NO: 341093 - protein, 23 aa, Mycobacterium
GEERAWMAIMFFAGFLILYSLGV

SEQ ID NO: 341094 - protein, 20 aa, Mycobacterium
GEFARRLPLMAAHRDFSTPT

SEQ ID NO: 341095 - protein, 21 aa, Mycobacterium
GEFEGRLWIAMDYIDGISAAQ

SEQ ID NO: 341096 - protein, 25 aa, Mycobacterium
GEFHYRYTVGLWFRRIWILQPHGEV

SEQ ID NO: 341097 - protein, 24 aa, Mycobacterium
GEFPRASIIVALVWQWTPFMMLLI

SEQ ID NO: 341098 - protein, 21 aa, Mycobacterium
GEIPTRMSFIVSGRVGVSVAG

SEQ ID NO: 341099 - protein, 20 aa, Mycobacterium
GELLCFVGMLVGVPVASLIQ

SEQ ID NO: 341100 - protein, 22 aa, Mycobacterium
GELPPGLAKPVWDRPIGGCSPR

SEQ ID NO: 341101 - protein, 20 aa, Mycobacterium
GELPRTATFKVIKRQLSAEA

SEQ ID NO: 341102 - protein, 19 aa, Mycobacterium
GELTHFFALLLWAAAVLAF

SEQ ID NO: 341103 - protein, 21 aa, Mycobacterium
GELWFKGPNVMAGYLNNEEAT

SEQ ID NO: 341104 - protein, 19 aa, Mycobacterium
GELWFKGPNVMAGYLNNER

SEQ ID NO: 341105 - protein, 21 aa, Mycobacterium
GENRIAWWVGVGIAVLVTLLS

SEQ ID NO: 341106 - protein, 22 aa, Mycobacterium
GEPQLRAAAFGTLVGLLVAVLM

SEQ ID NO: 341107 - protein, 17 aa, Mycobacterium
GEPRSGGTGDHWVVDLA

SEQ ID NO: 341108 - protein, 17 aa, Mycobacterium
GEPWPPPTPEPAFKAAI

SEQ ID NO: 341109 - protein, 17 aa, Mycobacterium
GEQLFKGLATAAGATIV

SEQ ID NO: 341110 - protein, 19 aa, Mycobacterium
GEVIGWFGGWFMILAQIVT

SEQ ID NO: 341111 - protein, 19 aa, Mycobacterium
GEVLRYLGFTLKNYRKEVL

SEQ ID NO: 341112 - protein, 20 aa, Mycobacterium
GEWPWAYAMLLGIHVVLLFV

SEQ ID NO: 341113 - protein, 21 aa, Mycobacterium
GEYRKARLLAIVTGFLGALLA

SEQ ID NO: 341114 - protein, 18 aa, Mycobacterium
GFAARPSIDWPLSADTWS

SEQ ID NO: 341115 - protein, 17 aa, Mycobacterium
GFAGFPIGGRFLRADKP

SEQ ID NO: 341116 - protein, 23 aa, Mycobacterium
GFAQLPGAPGFRLPTVASPGFPD

SEQ ID NO: 341117 - protein, 20 aa, Mycobacterium
GFCGTCKVNVLAGTVDHRDQ

SEQ ID NO: 341118 - protein, 23 aa, Mycobacterium
GFCMGGGLVWRLLAAGTPELAAA

SEQ ID NO: 341119 - protein, 26 aa, Mycobacterium
GFCTDYLHWRWAFWINLPISIVVLAV

SEQ ID NO: 341120 - protein, 24 aa, Mycobacterium
GFFRMCVLTGKALFRRPFQWRELI

SEQ ID NO: 341121 - protein, 19 aa, Mycobacterium
GFFRMCVLTGKALKQPFEW

SEQ ID NO: 341122 - protein, 18 aa, Mycobacterium
GFGRRPAWVIAEIAVVVL

SEQ ID NO: 341123 - protein, 18 aa, Mycobacterium
GFLLPWIPVLGVLVLAVV

SEQ ID NO: 341124 - protein, 18 aa, Mycobacterium
GFMLYFAVYSRHRLVANS

SEQ ID NO: 341125 - protein, 26 aa, Mycobacterium
GFPVTEFNVALPWTKMVVLNPGVQTE

SEQ ID NO: 341126 - protein, 19 aa, Mycobacterium
GFRLTCYYYRKAYYRSVWQ

SEQ ID NO: 341127 - protein, 24 aa, Mycobacterium
GFSELAVGFPVLFLTAAAIAEYVV

SEQ ID NO: 341128 - protein, 21 aa, Mycobacterium
GFSVWMLWSIVVVQMTAGAHG

SEQ ID NO: 341129 - protein, 21 aa, Mycobacterium
GFSVWMLWSIVVVQMTAGPHG

SEQ ID NO: 341130 - protein, 22 aa, Mycobacterium
GFSVYRLRGFFGYTDKGPITSG

SEQ ID NO: 341131 - protein, 19 aa, Mycobacterium
GFTCLLCAVAFTFITDKRR

SEQ ID NO: 341132 - protein, 17 aa, Mycobacterium
GFVQFSWLRFGIFYYSE

SEQ ID NO: 341133 - protein, 21 aa, Mycobacterium
GFVSVYLLICLGIELQGPEGQ

SEQ ID NO: 341134 - protein, 23 aa, Mycobacterium
GFVVYRLHGVFGVHRGSFGGGTS

SEQ ID NO: 341135 - protein, 21 aa, Mycobacterium
GFVVYRLHGVFGVHSGSFGGG

SEQ ID NO: 341136 - protein, 19 aa, Mycobacterium
GFWARLALRAIVFTIVMAG

SEQ ID NO: 341137 - protein, 19 aa, Mycobacterium
GGAAVGWFAGWFMIIAQIV

SEQ ID NO: 341138 - protein, 24 aa, Mycobacterium
GGAAWLPFLVAFAIATITAFSYLE

SEQ ID NO: 341139 - protein, 20 aa, Mycobacterium
GGAAWLPFLVAFLVATVTAF

SEQ ID NO: 341140 - protein, 19 aa, Mycobacterium
GGAGFPAAAWEFARAAAAE

SEQ ID NO: 341141 - protein, 18 aa, Mycobacterium
GGALAYACAIGLKRAGAD

SEQ ID NO: 341142 - protein, 18 aa, Mycobacterium
GGALAYACAIGLKREGAD

SEQ ID NO: 341143 - protein, 20 aa, Mycobacterium
GGAMPLIAAVAWVFAPETLG

SEQ ID NO: 341144 - protein, 18 aa, Mycobacterium
GGAPGCWQAITHDLWPAP

SEQ ID NO: 341145 - protein, 22 aa, Mycobacterium
GGAPLRRASVLHLFQHQAAEVG

SEQ ID NO: 341146 - protein, 17 aa, Mycobacterium
GGARFRLTLPLAVAGGV

SEQ ID NO: 341147 - protein, 17 aa, Mycobacterium
GGDAWVIRDGRRSRIDA

SEQ ID NO: 341148 - protein, 20 aa, Mycobacterium
GGELRLRIEYDTALFDVCGI

SEQ ID NO: 341149 - protein, 18 aa, Mycobacterium
GGGALVFLSGYVVPRVSS

SEQ ID NO: 341150 - protein, 25 aa, Mycobacterium
GGGIKLAMWGARPVIAALFDRAKER

SEQ ID NO: 341151 - protein, 22 aa, Mycobacterium
GGGKGRPSWRVLLIGLGVIVAW

SEQ ID NO: 341152 - protein, 23 aa, Mycobacterium
GGGLALVVMTAWLTPKVGPTIVG

SEQ ID NO: 341153 - protein, 25 aa, Mycobacterium
GGGVSWPALLIVLGIIAVLIGILWI

SEQ ID NO: 341154 - protein, 17 aa, Mycobacterium
GGGWDFGGGSDFGGGSD

SEQ ID NO: 341155 - protein, 17 aa, Mycobacterium
GGGWRGAAAQAYAANNL

SEQ ID NO: 341156 - protein, 18 aa, Mycobacterium
GGIAAWLYVKTYRPDQQV

SEQ ID NO: 341157 - protein, 20 aa, Mycobacterium
GGIHEIYFPYVLMKPKLIIA

SEQ ID NO: 341158 - protein, 21 aa, Mycobacterium
GGLAILVMVVWVGTALAISTA

SEQ ID NO: 341159 - protein, 18 aa, Mycobacterium
GGLLPLVGTWGFDQISWL

SEQ ID NO: 341160 - protein, 25 aa, Mycobacterium
GGLLVPILGGFVWKRATGAGALVAM

SEQ ID NO: 341161 - protein, 17 aa, Mycobacterium
GGLQFMLIIWLQGIWLP

SEQ ID NO: 341162 - protein, 22 aa, Mycobacterium
GGLRLKMWLFPWLSYATIALMA

SEQ ID NO: 341163 - protein, 17 aa, Mycobacterium
GGLRTALPITFVTFGLG

SEQ ID NO: 341164 - protein, 17 aa, Mycobacterium
GGNSGAFALFAQAGNGG

SEQ ID NO: 341165 - protein, 18 aa, Mycobacterium
GGNVNLWTGIALTVVAAA

SEQ ID NO: 341166 - protein, 18 aa, Mycobacterium
GGPLALWIAAAALFAMGL

SEQ ID NO: 341167 - protein, 18 aa, Mycobacterium
GGPLPRGRGLLMAEDTGV

SEQ ID NO: 341168 - protein, 22 aa, Mycobacterium
GGRVLRAFLWRRHGDSVRASIG

SEQ ID NO: 341169 - protein, 20 aa, Mycobacterium
GGSIGLGFAIPVDQAKRVAD

SEQ ID NO: 341170 - protein, 21 aa, Mycobacterium
GGSRRAIFLGAMRVGRDHIAS

SEQ ID NO: 341171 - protein, 17 aa, Mycobacterium
GGSWRGSAAQAYLVQNL

SEQ ID NO: 341172 - protein, 17 aa, Mycobacterium
GGTPRFGTDTAFDDAVR

SEQ ID NO: 341173 - protein, 20 aa, Mycobacterium
GGVDSRLWIAIVVLTGLLAV

SEQ ID NO: 341174 - protein, 20 aa, Mycobacterium
GGVDSRLWVGIGVLAGLLAA

SEQ ID NO: 341175 - protein, 18 aa, Mycobacterium
GGVLAYACAIGLKRLGKD

SEQ ID NO: 341176 - protein, 19 aa, Mycobacterium
GGVNWWAPRFLTRIHRRLG

SEQ ID NO: 341177 - protein, 18 aa, Mycobacterium
GGVSILWLGVAGWSLWAA

SEQ ID NO: 341178 - protein, 29 aa, Mycobacterium
GGVTARFTRKAIWWSAFRQLLFGSVAVAA

SEQ ID NO: 341179 - protein, 17 aa, Mycobacterium
GGVVMCWAILGFFVFVI

SEQ ID NO: 341180 - protein, 17 aa, Mycobacterium
GGVVMCWVVLAFFVFLV

SEQ ID NO: 341181 - protein, 17 aa, Mycobacterium
GGVYPWARRLWGRKWAW

SEQ ID NO: 341182 - protein, 18 aa, Mycobacterium
GGVYPWARRLWGRKYAWM

SEQ ID NO: 341183 - protein, 17 aa, Mycobacterium
GGWCMKKIDAIWDGKIR

SEQ ID NO: 341184 - protein, 17 aa, Mycobacterium
GGWQCQRALTARNNIVI

SEQ ID NO: 341185 - protein, 26 aa, Mycobacterium
GGWRRIGAAVVRWPGPILVVTCGIAL

SEQ ID NO: 341186 - protein, 19 aa, Mycobacterium
GGWVIMWLIMLGFPKLHAQ

SEQ ID NO: 341187 - protein, 28 aa, Mycobacterium
GGYFTDCLSWRWAFWINLPVSAVVICVA

SEQ ID NO: 341188 - protein, 26 aa, Mycobacterium
GGYFTDHFTWRWAFWINVPISVVVFF

SEQ ID NO: 341189 - protein, 18 aa, Mycobacterium
GGYGIQWVVPVLFLVLVS

SEQ ID NO: 341190 - protein, 24 aa, Mycobacterium
GHICCGRPLYDYGFLDIAERYLQR

SEQ ID NO: 341191 - protein, 22 aa, Mycobacterium
GHLHAAAALPAWSMVTAHVVAV

SEQ ID NO: 341192 - protein, 21 aa, Mycobacterium
GHPGPGWGLIVAWITVLLLIY

SEQ ID NO: 341193 - protein, 17 aa, Mycobacterium
GHPRKLLLRVFVIGATT

SEQ ID NO: 341194 - protein, 17 aa, Mycobacterium
GHRNRIAAAYSWGLAFL

SEQ ID NO: 341195 - protein, 18 aa, Mycobacterium
GHRNRIAAMFAWGISFLG

SEQ ID NO: 341196 - protein, 18 aa, Mycobacterium
GHRNRVAAAFSWGLAFLG

SEQ ID NO: 341197 - protein, 18 aa, Mycobacterium
GHRVCDWTGCGLGGVLAG

SEQ ID NO: 341198 - protein, 23 aa, Mycobacterium
GHRVSRWEWIWALVLAGALAVVI

SEQ ID NO: 341199 - protein, 21 aa, Mycobacterium
GHWEFYMALGYFKLAIIAAGI

SEQ ID NO: 341200 - protein, 21 aa, Mycobacterium
GIAGLLGRWFWWSPPAFLLGP

SEQ ID NO: 341201 - protein, 23 aa, Mycobacterium
GIALGLRFSYGWIAALAFVLVPV

SEQ ID NO: 341202 - protein, 24 aa, Mycobacterium
GIARRAGTPISFWEFTRKGVVVTA

SEQ ID NO: 341203 - protein, 25 aa, Mycobacterium
GIAVWLWRRRWFRGLVWTGVLCALA

SEQ ID NO: 341204 - protein, 24 aa, Mycobacterium
GIAWRGGLLTGRRPWLLAGASAAG

SEQ ID NO: 341205 - protein, 17 aa, Mycobacterium
GICGWWMVRSHKVGTLD

SEQ ID NO: 341206 - protein, 23 aa, Mycobacterium
GIELMDWLLAAGMQWNVGEWLGA

SEQ ID NO: 341207 - protein, 18 aa, Mycobacterium
GIFEVISAFGIRKASNSL

SEQ ID NO: 341208 - protein, 25 aa, Mycobacterium
GIIAVLIGILWIWSRRRRAKRRKAE

SEQ ID NO: 341209 - protein, 18 aa, Mycobacterium
GIKFFNWIGTMWKGQITF

SEQ ID NO: 341210 - protein, 18 aa, Mycobacterium
GILAIRWRLPSGVEIDTG

SEQ ID NO: 341211 - protein, 18 aa, Mycobacterium
GILAIRWRLPSGVELDTG

SEQ ID NO: 341212 - protein, 25 aa, Mycobacterium
GISHKRWLRWPARVYTDIFRGLPEV

SEQ ID NO: 341213 - protein, 25 aa, Mycobacterium
GISKSRWLRWPARVYTDIFRGLPEV

SEQ ID NO: 341214 - protein, 18 aa, Mycobacterium
GITPRLYVWITGPDVLPA

SEQ ID NO: 341215 - protein, 25 aa, Mycobacterium
GITVAFLFWEFFIPLLLSLLQGLLG

SEQ ID NO: 341216 - protein, 19 aa, Mycobacterium
GIVPWWFVAILLARDGLLA

SEQ ID NO: 341217 - protein, 18 aa, Mycobacterium
GIVPWWFVAVLLARDGLL

SEQ ID NO: 341218 - protein, 19 aa, Mycobacterium
GKAFGRPGIDNAVIIVMHG

SEQ ID NO: 341219 - protein, 18 aa, Mycobacterium
GKEIAWPVPLLAFIILVA

SEQ ID NO: 341220 - protein, 19 aa, Mycobacterium
GKEIWEFVTRIFPTAVRPR

SEQ ID NO: 341221 - protein, 24 aa, Mycobacterium
GKEQDVIVVWGFPFGKAKPGDEVT

SEQ ID NO: 341222 - protein, 21 aa, Mycobacterium
GKESFPASFIVKLNNPEQHAD

SEQ ID NO: 341223 - protein, 17 aa, Mycobacterium
GKFASFAVAFAFVSIAT

SEQ ID NO: 341224 - protein, 24 aa, Mycobacterium
GKGACFRLTLPLVRGHKVTSSPLP

SEQ ID NO: 341225 - protein, 24 aa, Mycobacterium
GKGACFRLTLPLVRGHKVTTSPLP

SEQ ID NO: 341226 - protein, 21 aa, Mycobacterium
GKGGVPIGNWLNRSVFAAKFA

SEQ ID NO: 341227 - protein, 17 aa, Mycobacterium
GKIGEVWLHGEHVAAGY

SEQ ID NO: 341228 - protein, 24 aa, Mycobacterium
GKKFTWHWWWLVAVVPVVLLIVMF

SEQ ID NO: 341229 - protein, 19 aa, Mycobacterium
GKLDWAGTLTFGIGLTVLL

SEQ ID NO: 341230 - protein, 21 aa, Mycobacterium
GKLSFPASVAAGWAPFSDDQS

SEQ ID NO: 341231 - protein, 17 aa, Mycobacterium
GKPFPGMEIRIVDPETG

SEQ ID NO: 341232 - protein, 17 aa, Mycobacterium
GKPFPGMEVRIVDPESG

SEQ ID NO: 341233 - protein, 18 aa, Mycobacterium
GKPLRIMILLVIVTAVAS

SEQ ID NO: 341234 - protein, 23 aa, Mycobacterium
GKPRSAVSSALWQVLAAVTIATV

SEQ ID NO: 341235 - protein, 20 aa, Mycobacterium
GKQVLPSWGLPVLAGALVAA

SEQ ID NO: 341236 - protein, 22 aa, Mycobacterium
GLAAGWRLAEYAMIATTPTHTA

SEQ ID NO: 341237 - protein, 18 aa, Mycobacterium
GLAALIFSRYVWAFELTS

SEQ ID NO: 341238 - protein, 17 aa, Mycobacterium
GLAEVFGGLLLLLPRTT

SEQ ID NO: 341239 - protein, 20 aa, Mycobacterium
GLAMCGLSSWLRAMMLGIMR

SEQ ID NO: 341240 - protein, 20 aa, Mycobacterium
GLANRYAIVVIGLWVVAAGL

SEQ ID NO: 341241 - protein, 23 aa, Mycobacterium
GLAPRWLPYLAVVEGAGVVGLVI

SEQ ID NO: 341242 - protein, 19 aa, Mycobacterium
GLARIWPPWEFYFWHHTIP

SEQ ID NO: 341243 - protein, 19 aa, Mycobacterium
GLARIWPPWEFYFWHHTVP

SEQ ID NO: 341244 - protein, 22 aa, Mycobacterium
GLARLGSIVAMFLVLRSAIPSL

SEQ ID NO: 341245 - protein, 19 aa, Mycobacterium
GLASLAILAYWVWNYGYRQ

SEQ ID NO: 341246 - protein, 24 aa, Mycobacterium
GLAVLMCWLSVAVLISRLTDTSEL

SEQ ID NO: 341247 - protein, 19 aa, Mycobacterium
GLCALCLYCESLGPLGHEV

SEQ ID NO: 341248 - protein, 17 aa, Mycobacterium
GLCALPFLIETAGASIA

SEQ ID NO: 341249 - protein, 19 aa, Mycobacterium
GLCWLSFSWPGRRAMAAFV

SEQ ID NO: 341250 - protein, 18 aa, Mycobacterium
GLDARRGWAHRPFIGSFV

SEQ ID NO: 341251 - protein, 17 aa, Mycobacterium
GLDPSWQAGLALARIDH

SEQ ID NO: 341252 - protein, 26 aa, Mycobacterium
GLEPGRLRPLATWGPWVSVGTTVLAG

SEQ ID NO: 341253 - protein, 25 aa, Mycobacterium
GLESIKMPRLRASEMGADLSDLKSL

SEQ ID NO: 341254 - protein, 19 aa, Mycobacterium
GLFDTWPGLIIPYITFALP

SEQ ID NO: 341255 - protein, 22 aa, Mycobacterium
GLFDTWPGLILPYITFALPLAI

SEQ ID NO: 341256 - protein, 17 aa, Mycobacterium
GLFESWIVIGLVVGAWL

SEQ ID NO: 341257 - protein, 24 aa, Mycobacterium
GLFFGFRELWSWNQGIALVLGVLF

SEQ ID NO: 341258 - protein, 23 aa, Mycobacterium
GLFGIRNGWWVYLTIYALFIGIH

SEQ ID NO: 341259 - protein, 17 aa, Mycobacterium
GLFPGVMLYLTYWFGRD

SEQ ID NO: 341260 - protein, 27 aa, Mycobacterium
GLFTDHLGWRWAFYINLPISVVVIMVA

SEQ ID NO: 341261 - protein, 19 aa, Mycobacterium
GLFYRYAWHNPVFADIVAT

SEQ ID NO: 341262 - protein, 19 aa, Mycobacterium
GLFYRYAWQNPTFADIVAT

SEQ ID NO: 341263 - protein, 19 aa, Mycobacterium
GLFYRYAWQNPTFANIVAT

SEQ ID NO: 341264 - protein, 19 aa, Mycobacterium
GLGCTGLLLAASVMRVLAP

SEQ ID NO: 341265 - protein, 19 aa, Mycobacterium
GLGLALAVAVTHVFPVEHG

SEQ ID NO: 341266 - protein, 22 aa, Mycobacterium
GLGLFFAFWCWMGFESTALYGE

SEQ ID NO: 341267 - protein, 23 aa, Mycobacterium
GLGLIFPRLEQWLQRPFSRIPHN

SEQ ID NO: 341268 - protein, 23 aa, Mycobacterium
GLGPLPWRAVLGIAAALCAVAAV

SEQ ID NO: 341269 - protein, 18 aa, Mycobacterium
GLGRVFRGIIPFIVADLV

SEQ ID NO: 341270 - protein, 23 aa, Mycobacterium
GLGRYRVVSALSRRGDELIVTGL

SEQ ID NO: 341271 - protein, 18 aa, Mycobacterium
GLGTRWVAMNALTFASKG

SEQ ID NO: 341272 - protein, 20 aa, Mycobacterium
GLGVFTVWLVRYMRSQNSSP

SEQ ID NO: 341273 - protein, 18 aa, Mycobacterium
GLHIPLWLGYAFSTLLIF

SEQ ID NO: 341274 - protein, 17 aa, Mycobacterium
GLIALGIGKAAHVGLLY

SEQ ID NO: 341275 - protein, 18 aa, Mycobacterium
GLIFMVLVGLSFYMWWRA

SEQ ID NO: 341276 - protein, 24 aa, Mycobacterium
GLILLLVFRSWFTAMLPLLVMGVS

SEQ ID NO: 341277 - protein, 19 aa, Mycobacterium
GLIVWSAACATVYLTGSRR

SEQ ID NO: 341278 - protein, 25 aa, Mycobacterium
GLKARLSFLLVMLFVKPLLILFPIF

SEQ ID NO: 341279 - protein, 18 aa, Mycobacterium
GLLAWLGHEFPDQGDRLD

SEQ ID NO: 341280 - protein, 18 aa, Mycobacterium
GLLGWCWRRSSPPSPAGS

SEQ ID NO: 341281 - protein, 17 aa, Mycobacterium
GLLICFWSASTFTAGHL

SEQ ID NO: 341282 - protein, 21 aa, Mycobacterium
GLLKRRWPAPVVFALFLVGAA

SEQ ID NO: 341283 - protein, 23 aa, Mycobacterium
GLLKRRWVVPAAFVFFLAATAYL

SEQ ID NO: 341284 - protein, 19 aa, Mycobacterium
GLLMLLKAVAYWFDRYELL

SEQ ID NO: 341285 - protein, 17 aa, Mycobacterium
GLLQLLGIFGFLGIGRM

SEQ ID NO: 341286 - protein, 19 aa, Mycobacterium
GLLQRPRFRMPWAPYSGYL

SEQ ID NO: 341287 - protein, 22 aa, Mycobacterium
GLLSFGAGLAWLAMERRRVREA

SEQ ID NO: 341288 - protein, 20 aa, Mycobacterium
GLMRAIVCQLAFSHGPDHVR

SEQ ID NO: 341289 - protein, 18 aa, Mycobacterium
GLNFPAGVTVDLSGNVYV

SEQ ID NO: 341290 - protein, 23 aa, Mycobacterium
GLNYLLCWGLLYQLGICWQAGLL

SEQ ID NO: 341291 - protein, 21 aa, Mycobacterium
GLPDFKWPPVPGIPDFNLPIP

SEQ ID NO: 341292 - protein, 24 aa, Mycobacterium
GLPEFEWPSIPGLPDFGLPNLPGL

SEQ ID NO: 341293 - protein, 24 aa, Mycobacterium
GLPGFRHSIGLARWWHLGVDVLWL

SEQ ID NO: 341294 - protein, 22 aa, Mycobacterium
GLPIRGVVAVCDFGAGGTSITL

SEQ ID NO: 341295 - protein, 20 aa, Mycobacterium
GLPPAIVVSAEFDPLRDEGD

SEQ ID NO: 341296 - protein, 18 aa, Mycobacterium
GLPPALWTLILLGTITGL

SEQ ID NO: 341297 - protein, 17 aa, Mycobacterium
GLPVCWLGYALMSGPIW

SEQ ID NO: 341298 - protein, 19 aa, Mycobacterium
GLPYFSIGMANNFVQSSKT

SEQ ID NO: 341299 - protein, 20 aa, Mycobacterium
GLQYWPWVLLGYFTLGIVIV

SEQ ID NO: 341300 - protein, 23 aa, Mycobacterium
GLRFVWNLRVLRALALIDLTVTA

SEQ ID NO: 341301 - protein, 21 aa, Mycobacterium
GLSFPRAMFWTVLIYVLVATI

SEQ ID NO: 341302 - protein, 20 aa, Mycobacterium
GLSRWWRVALLAAISTFLAA

SEQ ID NO: 341303 - protein, 19 aa, Mycobacterium
GLSSWLRAMMLGIMRSYRS

SEQ ID NO: 341304 - protein, 17 aa, Mycobacterium
GLSWALYAVMAMWTGFA

SEQ ID NO: 341305 - protein, 18 aa, Mycobacterium
GLSWRDWLLAVVVIAVIR

SEQ ID NO: 341306 - protein, 19 aa, Mycobacterium
GLTAFGFATFAIWWAWMNF

SEQ ID NO: 341307 - protein, 19 aa, Mycobacterium
GLTVGWWVIQRNYYVAEYN

SEQ ID NO: 341308 - protein, 19 aa, Mycobacterium
GLTWIRFLIWMAIGVVIYF

SEQ ID NO: 341309 - protein, 19 aa, Mycobacterium
GLVCAVVLVPICSITLGAL

SEQ ID NO: 341310 - protein, 29 aa, Mycobacterium
GLVGRSGLVYDMWGAAVSLAYQMQSGSSQ

SEQ ID NO: 341311 - protein, 31 aa, Mycobacterium
GLVGRSGLVYDMWGGAVSLAYQMHSGAPQAG

SEQ ID NO: 341312 - protein, 19 aa, Mycobacterium
GLVGRSSIVYDMWGAAVNL

SEQ ID NO: 341313 - protein, 18 aa, Mycobacterium
GLVGRSSVVYDMWGAAVS

SEQ ID NO: 341314 - protein, 17 aa, Mycobacterium
GLVPLVGTWGFDQIAWF

SEQ ID NO: 341315 - protein, 23 aa, Mycobacterium
GLVRLRPAPSLGLPPPLTELAVR

SEQ ID NO: 341316 - protein, 27 aa, Mycobacterium
GLVSNYPGDGWKWWAWLSIGAGCVAVI

SEQ ID NO: 341317 - protein, 17 aa, Mycobacterium
GMDLGPWLVTRDVTVVS

SEQ ID NO: 341318 - protein, 22 aa, Mycobacterium
GMKAELWTSGWTPRYKGETIYL

SEQ ID NO: 341319 - protein, 18 aa, Mycobacterium
GMLFIRRWLTAHATMGVE

SEQ ID NO: 341320 - protein, 23 aa, Mycobacterium
GMLPRRLQPLFGRLSTRSRVPVH

SEQ ID NO: 341321 - protein, 20 aa, Mycobacterium
GMNFVICLVLIYGIAVVWGL

SEQ ID NO: 341322 - protein, 18 aa, Mycobacterium
GMRYPTFLLYNAIGSAAW

SEQ ID NO: 341323 - protein, 17 aa, Mycobacterium
GMTCASCANRIERKLNK

SEQ ID NO: 341324 - protein, 17 aa, Mycobacterium
GNAARAYGAKNLAQSQH

SEQ ID NO: 341325 - protein, 18 aa, Mycobacterium
GNAWKYLRRSGFFITGSI

SEQ ID NO: 341326 - protein, 17 aa, Mycobacterium
GNQVPVWSLLVLTAAAS

SEQ ID NO: 341327 - protein, 17 aa, Mycobacterium
GNRAFWIIAAVFVVGIL

SEQ ID NO: 341328 - protein, 20 aa, Mycobacterium
GNVVAVLGMPVGKVTKINAK

SEQ ID NO: 341329 - protein, 18 aa, Mycobacterium
GNWLPMFVLLIVLTVVTA

SEQ ID NO: 341330 - protein, 17 aa, Mycobacterium
GNWTIFYWGWWISWAPF

SEQ ID NO: 341331 - protein, 20 aa, Mycobacterium
GPACAIAVFVGFAATVTLFP

SEQ ID NO: 341332 - protein, 18 aa, Mycobacterium
GPAPALTGVTGWLNTPDG

SEQ ID NO: 341333 - protein, 19 aa, Mycobacterium
GPARLGRLMSILSIPMLLA

SEQ ID NO: 341334 - protein, 17 aa, Mycobacterium
GPATVRMSLVITTAPAP

SEQ ID NO: 341335 - protein, 21 aa, Mycobacterium
GPAWLRRLWLAVIIVAPASLW

SEQ ID NO: 341336 - protein, 17 aa, Mycobacterium
GPCWSMRLNMIEPLKEP

SEQ ID NO: 341337 - protein, 18 aa, Mycobacterium
GPDAWRWMLASPAVFGVV

SEQ ID NO: 341338 - protein, 18 aa, Mycobacterium
GPDGRPTIHLPLDDPYQA

SEQ ID NO: 341339 - protein, 22 aa, Mycobacterium
GPEFGKAAPFGLLITVVLLVGT

SEQ ID NO: 341340 - protein, 17 aa, Mycobacterium
GPELWRWVDPNGASDTD

SEQ ID NO: 341341 - protein, 17 aa, Mycobacterium
GPEVFVFVDDYAMVNSA

SEQ ID NO: 341342 - protein, 17 aa, Mycobacterium
GPFCSMLLADFGADVVT

SEQ ID NO: 341343 - protein, 19 aa, Mycobacterium
GPFFKAYVVNLFPGQFVQP

SEQ ID NO: 341344 - protein, 19 aa, Mycobacterium
GPFFKVVLHNLALYQISQP

SEQ ID NO: 341345 - protein, 17 aa, Mycobacterium
GPFPPAEFPGGIRIPST

SEQ ID NO: 341346 - protein, 18 aa, Mycobacterium
GPGERVALLFARSAEAIV

SEQ ID NO: 341347 - protein, 18 aa, Mycobacterium
GPGERVALMFPRSAEAVV

SEQ ID NO: 341348 - protein, 27 aa, Mycobacterium
GPGRYGFDAGRGWARRPFVGSFVALLI

SEQ ID NO: 341349 - protein, 24 aa, Mycobacterium
GPGRYGLDAGRGWAHRPFIGSFVA

SEQ ID NO: 341350 - protein, 24 aa, Mycobacterium
GPGRYGLDAGRGWAQRPFIGSFVA

SEQ ID NO: 341351 - protein, 22 aa, Mycobacterium
GPGSKLPWLIIGGLVILAVVAL

SEQ ID NO: 341352 - protein, 18 aa, Mycobacterium
GPGWSTRATLHFLWLRLS

SEQ ID NO: 341353 - protein, 18 aa, Mycobacterium
GPIAPRRAIEIIADACQA

SEQ ID NO: 341354 - protein, 21 aa, Mycobacterium
GPIDFGWEIIDATSWQTGQLD

SEQ ID NO: 341355 - protein, 18 aa, Mycobacterium
GPLGIAILFAFAGFMGFE

SEQ ID NO: 341356 - protein, 21 aa, Mycobacterium
GPLHLGGICWRGRNQRPVITG

SEQ ID NO: 341357 - protein, 22 aa, Mycobacterium
GPLHLGGICWRGRNQRPVITGT

SEQ ID NO: 341358 - protein, 22 aa, Mycobacterium
GPLHLGGICWRGRNQRPVVTGA

SEQ ID NO: 341359 - protein, 28 aa, Mycobacterium
GPLPAQIYWRRRALAIGIAVVVVGVVAA

SEQ ID NO: 341360 - protein, 18 aa, Mycobacterium
GPLPRPAPPLPLAAPSPV

SEQ ID NO: 341361 - protein, 23 aa, Mycobacterium
GPLYGVLCVWLFGSWTAIFWVNV

SEQ ID NO: 341362 - protein, 17 aa, Mycobacterium
GPMPPKRAIEVIADACQ

SEQ ID NO: 341363 - protein, 17 aa, Mycobacterium
GPMQFLPGTWARYASDG

SEQ ID NO: 341364 - protein, 19 aa, Mycobacterium
GPPAHRVWLPPLGPAPQLH

SEQ ID NO: 341365 - protein, 19 aa, Mycobacterium
GPPRGVPVLALRDVGHEYG

SEQ ID NO: 341366 - protein, 25 aa, Mycobacterium
GPPRSLREQINWTWVRRGSLIAAVV

SEQ ID NO: 341367 - protein, 22 aa, Mycobacterium
GPRFIDTYVDWLWFGELGYRSV

SEQ ID NO: 341368 - protein, 38 aa, Mycobacterium
GPRGARAARPWPDWIQQINWKWVRRSVGLAAAVMILLP

SEQ ID NO: 341369 - protein, 23 aa, Mycobacterium
GPRGRGAAVWVLGGLAVLVVIVL

SEQ ID NO: 341370 - protein, 23 aa, Mycobacterium
GPRTRFGVWLGRPMTSFHLIIAV

SEQ ID NO: 341371 - protein, 24 aa, Mycobacterium
GPRYLVSMWPWRALLWTVFGGVLG

SEQ ID NO: 341372 - protein, 19 aa, Mycobacterium
GPSFWWGFGLVFAGQFLVA

SEQ ID NO: 341373 - protein, 20 aa, Mycobacterium
GPSFWWGFGLVFAGQFLVAL

SEQ ID NO: 341374 - protein, 17 aa, Mycobacterium
GPTFRYREFSGDEIDQL

SEQ ID NO: 341375 - protein, 21 aa, Mycobacterium
GPTLRRPAVYRGWYALPERIA

SEQ ID NO: 341376 - protein, 18 aa, Mycobacterium
GPVGAWIDTLVRTFIGAG

SEQ ID NO: 341377 - protein, 18 aa, Mycobacterium
GPVIRLPLVLGIAELLGR

SEQ ID NO: 341378 - protein, 24 aa, Mycobacterium
GPVLAATCVIAFIGLLALPSYKTT

SEQ ID NO: 341379 - protein, 23 aa, Mycobacterium
GPVLGISVAVVFFAAITLLPALL

SEQ ID NO: 341380 - protein, 21 aa, Mycobacterium
GPVRPRFWLTVPVDAGTAGRT

SEQ ID NO: 341381 - protein, 18 aa, Mycobacterium
GPWLRTGDLGVMFDDELY

SEQ ID NO: 341382 - protein, 17 aa, Mycobacterium
GPYYLKRQLGTGGMGEV

SEQ ID NO: 341383 - protein, 20 aa, Mycobacterium
GQANWWPSASVESWFRQRFS

SEQ ID NO: 341384 - protein, 17 aa, Mycobacterium
GQCFSEFEVRMGSLKSP

SEQ ID NO: 341385 - protein, 20 aa, Mycobacterium
GQEWRLVWDSALDRAEIGSG

SEQ ID NO: 341386 - protein, 20 aa, Mycobacterium
GQEWRMVWDSALDRAEIGQG

SEQ ID NO: 341387 - protein, 20 aa, Mycobacterium
GQEWRMVWDSALDRAEIGSG

SEQ ID NO: 341388 - protein, 24 aa, Mycobacterium
GQGSCFRLTLPLVRGHKVTTSPLP

SEQ ID NO: 341389 - protein, 17 aa, Mycobacterium
GQMLAELMTLFAAGKLH

SEQ ID NO: 341390 - protein, 20 aa, Mycobacterium
GQNRIRWGNLLTLPMGDGGL

SEQ ID NO: 341391 - protein, 19 aa, Mycobacterium
GQPAGAVGFELDVIAAVVV

SEQ ID NO: 341392 - protein, 18 aa, Mycobacterium
GQSAMNWGQSTFRSSELG

SEQ ID NO: 341393 - protein, 19 aa, Mycobacterium
GQSLWRVRIAPALGLIGLV

SEQ ID NO: 341394 - protein, 18 aa, Mycobacterium
GQTARLYIRPVIHAMAAQ

SEQ ID NO: 341395 - protein, 19 aa, Mycobacterium
GQVGRLWKLTAALTTDDRT

SEQ ID NO: 341396 - protein, 19 aa, Mycobacterium
GQVVLPFTGLNFRFAPGGV

SEQ ID NO: 341397 - protein, 27 aa, Mycobacterium
GQWALWWANGFSWIWMAVGLVGAAAAL

SEQ ID NO: 341398 - protein, 18 aa, Mycobacterium
GQWRPARLLVGLGGLALV

SEQ ID NO: 341399 - protein, 24 aa, Mycobacterium
GRAAARPGPSVAFAQYDPHTGSYV

SEQ ID NO: 341400 - protein, 20 aa, Mycobacterium
GRAESSVSLSGWRPDPTARY

SEQ ID NO: 341401 - protein, 19 aa, Mycobacterium
GRAGVLCVVSILLTYLLVS

SEQ ID NO: 341402 - protein, 18 aa, Mycobacterium
GRALPPWVTRSVDAPATR

SEQ ID NO: 341403 - protein, 20 aa, Mycobacterium
GRALRWVWQALAALLIATVF

SEQ ID NO: 341404 - protein, 19 aa, Mycobacterium
GRARARRALLLLSLSDFHE

SEQ ID NO: 341405 - protein, 20 aa, Mycobacterium
GRAREVRIGWLLPLSGVRLG

SEQ ID NO: 341406 - protein, 20 aa, Mycobacterium
GRAWLSAGALVFILVVAAAY

SEQ ID NO: 341407 - protein, 18 aa, Mycobacterium
GRDGFWLSMLVFSVLAVV

SEQ ID NO: 341408 - protein, 18 aa, Mycobacterium
GREHWKPGLGYALAAVAV

SEQ ID NO: 341409 - protein, 18 aa, Mycobacterium
GREHWKSGLGYALAAVLL

SEQ ID NO: 341410 - protein, 20 aa, Mycobacterium
GRELARWQPAWLRYSPLSFT

SEQ ID NO: 341411 - protein, 19 aa, Mycobacterium
GRFASCREFADALNEQAGV

SEQ ID NO: 341412 - protein, 17 aa, Mycobacterium
GRFWISLHAASTRRALL

SEQ ID NO: 341413 - protein, 18 aa, Mycobacterium
GRGAVLLAAAKRLPRGRA

SEQ ID NO: 341414 - protein, 18 aa, Mycobacterium
GRGDFFAVVRSLALFVNA

SEQ ID NO: 341415 - protein, 19 aa, Mycobacterium
GRGGPYLARGAADLVPSAQ

SEQ ID NO: 341416 - protein, 19 aa, Mycobacterium
GRGLDIWSALPILGSVSLI

SEQ ID NO: 341417 - protein, 18 aa, Mycobacterium
GRGPVIGVAGEFVQTSVT

SEQ ID NO: 341418 - protein, 21 aa, Mycobacterium
GRGRGRWAWPGLAAAGVLLLT

SEQ ID NO: 341419 - protein, 20 aa, Mycobacterium
GRGRPSWRVVLIGLAVILAW

SEQ ID NO: 341420 - protein, 18 aa, Mycobacterium
GRGRWLAFGVSISVAAAM

SEQ ID NO: 341421 - protein, 19 aa, Mycobacterium
GRGVVAFLAYHKLIGISVF

SEQ ID NO: 341422 - protein, 18 aa, Mycobacterium
GRGWQIFVGVISLIAGVV

SEQ ID NO: 341423 - protein, 17 aa, Mycobacterium
GRIGLLFAVMPFHAFFG

SEQ ID NO: 341424 - protein, 18 aa, Mycobacterium
GRIPGVASGPAWRLIGTT

SEQ ID NO: 341425 - protein, 23 aa, Mycobacterium
GRIWRRSGVHIVRKPVIHLVASL

SEQ ID NO: 341426 - protein, 23 aa, Mycobacterium
GRKRLGQRPGLLIGALVSILLLI

SEQ ID NO: 341427 - protein, 24 aa, Mycobacterium
GRKRRKWLAGKRMAVTVAVAAALF

SEQ ID NO: 341428 - protein, 20 aa, Mycobacterium
GRLARIGWRLAVADRPDLVA

SEQ ID NO: 341429 - protein, 17 aa, Mycobacterium
GRLDPRVRVVAAMVNVG

SEQ ID NO: 341430 - protein, 20 aa, Mycobacterium
GRLHPVWVALPVVVLALLAF

SEQ ID NO: 341431 - protein, 18 aa, Mycobacterium
GRLHYVYNFLGIKPEQEF

SEQ ID NO: 341432 - protein, 18 aa, Mycobacterium
GRLPRIALATIIVMPLLY

SEQ ID NO: 341433 - protein, 24 aa, Mycobacterium
GRLVQHLWRWSRMLPEDFVPQSKR

SEQ ID NO: 341434 - protein, 19 aa, Mycobacterium
GRLVWIFACICGAVFALAS

SEQ ID NO: 341435 - protein, 18 aa, Mycobacterium
GRLWPLIIAHGVINTVAY

SEQ ID NO: 341436 - protein, 18 aa, Mycobacterium
GRLWPLIIAHTLIDAVAF

SEQ ID NO: 341437 - protein, 27 aa, Mycobacterium
GRLWRRVGTAVVRWPAPILAVSGAIVL

SEQ ID NO: 341438 - protein, 17 aa, Mycobacterium
GRMKDLLIVYGRNHYPE

SEQ ID NO: 341439 - protein, 17 aa, Mycobacterium
GRMRLRITGFHVDAVRA

SEQ ID NO: 341440 - protein, 20 aa, Mycobacterium
GRNPLGWGILGLFFSILTLI

SEQ ID NO: 341441 - protein, 19 aa, Mycobacterium
GRPGWKLRLQQLFLTLVGL

SEQ ID NO: 341442 - protein, 24 aa, Mycobacterium
GRPRTENLGSLGFYRVKSHVNGSD

SEQ ID NO: 341443 - protein, 22 aa, Mycobacterium
GRPRWWCAAVGMAAALAAALPW

SEQ ID NO: 341444 - protein, 17 aa, Mycobacterium
GRPTIHLPLDDPYQAPD

SEQ ID NO: 341445 - protein, 17 aa, Mycobacterium
GRPWAWLALVVAGLVVG

SEQ ID NO: 341446 - protein, 19 aa, Mycobacterium
GRPWAWLALVVAGLVVGIF

SEQ ID NO: 341447 - protein, 21 aa, Mycobacterium
GRRAERRLAFALVAPATILML

SEQ ID NO: 341448 - protein, 19 aa, Mycobacterium
GRRAPVLAAGWVTLGVALA

SEQ ID NO: 341449 - protein, 18 aa, Mycobacterium
GRRGWLSAGLILFALTSA

SEQ ID NO: 341450 - protein, 17 aa, Mycobacterium
GRRIAALLVDWLTCYGL

SEQ ID NO: 341451 - protein, 17 aa, Mycobacterium
GRRLRILIIAALAGAGI

SEQ ID NO: 341452 - protein, 18 aa, Mycobacterium
GRRLRVRVVRALRRAGVV

SEQ ID NO: 341453 - protein, 19 aa, Mycobacterium
GRRMWAWRNGPLLERSMSN

SEQ ID NO: 341454 - protein, 18 aa, Mycobacterium
GRRRVYCAALLATAVCAV

SEQ ID NO: 341455 - protein, 17 aa, Mycobacterium
GRRSRMLLFGGMAAMVV

SEQ ID NO: 341456 - protein, 23 aa, Mycobacterium
GRRTWRWHLIWLPAAAAVGAVLA

SEQ ID NO: 341457 - protein, 18 aa, Mycobacterium
GRSLPFLILMAAIIPVTR

SEQ ID NO: 341458 - protein, 19 aa, Mycobacterium
GRTAILVGVVWFIIVVLGY

SEQ ID NO: 341459 - protein, 19 aa, Mycobacterium
GRTAQAWARRHRHLRAALT

SEQ ID NO: 341460 - protein, 20 aa, Mycobacterium
GRTLYEFVRFYWLHPELRVE

SEQ ID NO: 341461 - protein, 17 aa, Mycobacterium
GRTPLPPRRDWELDTLD

SEQ ID NO: 341462 - protein, 19 aa, Mycobacterium
GRTTFRFLLVAAAAVILTA

SEQ ID NO: 341463 - protein, 19 aa, Mycobacterium
GRVALQVPAEWTVERVTGD

SEQ ID NO: 341464 - protein, 18 aa, Mycobacterium
GRVGDFFRIEGPPGLRRA

SEQ ID NO: 341465 - protein, 17 aa, Mycobacterium
GRWFWWPQRVRPRPAST

SEQ ID NO: 341466 - protein, 19 aa, Mycobacterium
GRYPIRARVDVVARGGLLT

SEQ ID NO: 341467 - protein, 18 aa, Mycobacterium
GRYRVVAFPSHMEGEAVV

SEQ ID NO: 341468 - protein, 23 aa, Mycobacterium
GRYWFDHGWNWRGLTAWLISAAL

SEQ ID NO: 341469 - protein, 25 aa, Mycobacterium
GSAAAAVLCLGGFGAAVYGSSPGDA

SEQ ID NO: 341470 - protein, 18 aa, Mycobacterium
GSAAWWLVRLEWITILSV

SEQ ID NO: 341471 - protein, 19 aa, Mycobacterium
GSAFLKWQIAWNAESDTAR

SEQ ID NO: 341472 - protein, 18 aa, Mycobacterium
GSAFWRKIYRRFGVRGML

SEQ ID NO: 341473 - protein, 18 aa, Mycobacterium
GSAIRLARRLLPQRALTL

SEQ ID NO: 341474 - protein, 22 aa, Mycobacterium
GSALALAGVSAWLITRASQMPP

SEQ ID NO: 341475 - protein, 23 aa, Mycobacterium
GSALALTAVSAWLITRAWQMPPV

SEQ ID NO: 341476 - protein, 23 aa, Mycobacterium
GSAPDLKGIIGWLNTPGDQPLDL

SEQ ID NO: 341477 - protein, 20 aa, Mycobacterium
GSARAVAGLGWLRRNTRTIQ

SEQ ID NO: 341478 - protein, 21 aa, Mycobacterium
GSATNWARTALLLVEPTSATL

SEQ ID NO: 341479 - protein, 20 aa, Mycobacterium
GSAVWWKALLALAVALALTV

SEQ ID NO: 341480 - protein, 21 aa, Mycobacterium
GSFMLCAAFNVLLRALCGRDT

SEQ ID NO: 341481 - protein, 22 aa, Mycobacterium
GSFMLCAAFNVLLRAVSGRDTA

SEQ ID NO: 341482 - protein, 26 aa, Mycobacterium
GSGLDWRPNPGIAFPTYANYLPVTRA

SEQ ID NO: 341483 - protein, 18 aa, Mycobacterium
GSGNDWRPVAGIGALTEG

SEQ ID NO: 341484 - protein, 22 aa, Mycobacterium
GSGRWNSPCCGFDNPDGALSVI

SEQ ID NO: 341485 - protein, 18 aa, Mycobacterium
GSHSWRWILGLAAVPATL

SEQ ID NO: 341486 - protein, 21 aa, Mycobacterium
GSIDWEGYGLLGLEDSLDSAL

SEQ ID NO: 341487 - protein, 18 aa, Mycobacterium
GSINFDWGALLIVAVVAT

SEQ ID NO: 341488 - protein, 19 aa, Mycobacterium
GSITQPVKFYGVGFATASN

SEQ ID NO: 341489 - protein, 18 aa, Mycobacterium
GSLAQVFLCAAAVAAIGF

SEQ ID NO: 341490 - protein, 18 aa, Mycobacterium
GSLGRWLIAVAVLAVLTV

SEQ ID NO: 341491 - protein, 24 aa, Mycobacterium
GSLLVKHRISAFVLPHGLITVRLP

SEQ ID NO: 341492 - protein, 24 aa, Mycobacterium
GSLNYLLCWGLLYQLGIAWRGGLL

SEQ ID NO: 341493 - protein, 18 aa, Mycobacterium
GSLRLHPMLDKLLFESQF

SEQ ID NO: 341494 - protein, 25 aa, Mycobacterium
GSNENWKWVASIAGAVFAIAVIATA

SEQ ID NO: 341495 - protein, 19 aa, Mycobacterium
GSNRIPVFVFHPAGGSTVV

SEQ ID NO: 341496 - protein, 23 aa, Mycobacterium
GSPDWPGKWAIVYVDTTGQHPDA

SEQ ID NO: 341497 - protein, 18 aa, Mycobacterium
GSPLRVMILLALVTAIAS

SEQ ID NO: 341498 - protein, 22 aa, Mycobacterium
GSPNRFGAWLGRPMTSFHLIIA

SEQ ID NO: 341499 - protein, 18 aa, Mycobacterium
GSPVAIAVPSHWGPGTVG

SEQ ID NO: 341500 - protein, 23 aa, Mycobacterium
GSRELSGVFGFCYVVGCLAAVLA

SEQ ID NO: 341501 - protein, 18 aa, Mycobacterium
GSSFKVFALIAALEQGMG

SEQ ID NO: 341502 - protein, 18 aa, Mycobacterium
GSSFKVFALVAALQQGIG

SEQ ID NO: 341503 - protein, 18 aa, Mycobacterium
GSVAPGFRLPALNRRQFL

SEQ ID NO: 341504 - protein, 20 aa, Mycobacterium
GSVEEFRSGLLIVVALAAVL

SEQ ID NO: 341505 - protein, 17 aa, Mycobacterium
GSVLDWWSDPLTAPLGT

SEQ ID NO: 341506 - protein, 17 aa, Mycobacterium
GSVLDWWSDPLTVPLGT

SEQ ID NO: 341507 - protein, 21 aa, Mycobacterium
GSVRGLVGWLERLLAASGRVP

SEQ ID NO: 341508 - protein, 17 aa, Mycobacterium
GSVVLGWLVALVMAAIA

SEQ ID NO: 341509 - protein, 25 aa, Mycobacterium
GSWEHWRIFLVLMAWCVGGVIACRA

SEQ ID NO: 341510 - protein, 22 aa, Mycobacterium
GSWKPGTSWGSWLMHRCTRLYR

SEQ ID NO: 341511 - protein, 23 aa, Mycobacterium
GSWPEVIGALLLVVVAAAGIARG

SEQ ID NO: 341512 - protein, 18 aa, Mycobacterium
GTAVGLVFLWLSMTPSLL

SEQ ID NO: 341513 - protein, 18 aa, Mycobacterium
GTAVGWRGAFAVLAVLAA

SEQ ID NO: 341514 - protein, 18 aa, Mycobacterium
GTAWALTMVHLRLSLIPV

SEQ ID NO: 341515 - protein, 33 aa, Mycobacterium
GTDFRLPPKYMEMLNLTEAWQFGRGEGVKVAVI

SEQ ID NO: 341516 - protein, 18 aa, Mycobacterium
GTDLTGWIDWVVRGSHEL

SEQ ID NO: 341517 - protein, 23 aa, Mycobacterium
GTDPRPGDAIPEFSVTTTDGAVI

SEQ ID NO: 341518 - protein, 18 aa, Mycobacterium
GTFNRYWLAAGFGVTALV

SEQ ID NO: 341519 - protein, 17 aa, Mycobacterium
GTFPRLKSALIVEGAGA

SEQ ID NO: 341520 - protein, 17 aa, Mycobacterium
GTFPRLKSALIVEGTGA

SEQ ID NO: 341521 - protein, 19 aa, Mycobacterium
GTFSALAGMLGWLGHASPD

SEQ ID NO: 341522 - protein, 18 aa, Mycobacterium
GTGFAPFFLPLALFIGAL

SEQ ID NO: 341523 - protein, 27 aa, Mycobacterium
GTGMDWRPNPGIGFPGWANYFPVTRGT

SEQ ID NO: 341524 - protein, 17 aa, Mycobacterium
GTGQSRWSYARDTSLCG

SEQ ID NO: 341525 - protein, 18 aa, Mycobacterium
GTHSWRWMLGLATVPAML

SEQ ID NO: 341526 - protein, 18 aa, Mycobacterium
GTIGRLDVEVSWPTAGIT

SEQ ID NO: 341527 - protein, 17 aa, Mycobacterium
GTIQWPALVMFLIIFFW

SEQ ID NO: 341528 - protein, 25 aa, Mycobacterium
GTLDPEWRLPYAVNRVSGFATVPTE

SEQ ID NO: 341529 - protein, 17 aa, Mycobacterium
GTLLNWRSPIAWLSRYR

SEQ ID NO: 341530 - protein, 25 aa, Mycobacterium
GTLYTDRHIRLWVVYVDDFSGQGAV

SEQ ID NO: 341531 - protein, 17 aa, Mycobacterium
GTMHPMALIPVSRTSSP

SEQ ID NO: 341532 - protein, 24 aa, Mycobacterium
GTMLLRLCMLPGLALLIWAAPRLA

SEQ ID NO: 341533 - protein, 24 aa, Mycobacterium
GTMLLRLCMLPGLALLIWAAPRVA

SEQ ID NO: 341534 - protein, 24 aa, Mycobacterium
GTMLLRLCMLPGLALLIWATPRLA

SEQ ID NO: 341535 - protein, 24 aa, Mycobacterium
GTMLLRLCMLPGLALLIWATPRVA

SEQ ID NO: 341536 - protein, 24 aa, Mycobacterium
GTMLLRLCMLPGLALLVWATPRVA

SEQ ID NO: 341537 - protein, 25 aa, Mycobacterium
GTMLLRLCMLPGLLLLIWAAPRVAR

SEQ ID NO: 341538 - protein, 25 aa, Mycobacterium
GTMLWEHLFWFFGHPEVYIIALPFF

SEQ ID NO: 341539 - protein, 23 aa, Mycobacterium
GTPRGVGWLPLRMAAPFVRPVAA

SEQ ID NO: 341540 - protein, 24 aa, Mycobacterium
GTPRGVPWPGVWNGSIWTLVFEMI

SEQ ID NO: 341541 - protein, 21 aa, Mycobacterium
GTRPLRFVSMMGILFALLGFG

SEQ ID NO: 341542 - protein, 19 aa, Mycobacterium
GTSFARWSALLAEHAKTDT

SEQ ID NO: 341543 - protein, 17 aa, Mycobacterium
GTSFRSALMYPEPNHPG

SEQ ID NO: 341544 - protein, 18 aa, Mycobacterium
GTSIRAGLAIPRPLPVLI

SEQ ID NO: 341545 - protein, 22 aa, Mycobacterium
GTSLRFGVAVVWLSVIVLLPLA

SEQ ID NO: 341546 - protein, 23 aa, Mycobacterium
GTTAWEMFKPWAITSITIAVAVA

SEQ ID NO: 341547 - protein, 21 aa, Mycobacterium
GTTWGRAAALLLLGIGIAVLI

SEQ ID NO: 341548 - protein, 18 aa, Mycobacterium
GTVPWWFVLTLLARDAAL

SEQ ID NO: 341549 - protein, 19 aa, Mycobacterium
GTVTLELPAGGGWGEVAFT

SEQ ID NO: 341550 - protein, 23 aa, Mycobacterium
GTVTVRWPGRILVVSSVVVMIGS

SEQ ID NO: 341551 - protein, 23 aa, Mycobacterium
GTYFKGHLYIAGRIKDLVIIDGR

SEQ ID NO: 341552 - protein, 17 aa, Mycobacterium
GVAAVLCVIAWPMRSAP

SEQ ID NO: 341553 - protein, 27 aa, Mycobacterium
GVAEGLRFVWSLRVLRALALIDLSVTA

SEQ ID NO: 341554 - protein, 21 aa, Mycobacterium
GVAESCWFRWLASGPLDVRRR

SEQ ID NO: 341555 - protein, 26 aa, Mycobacterium
GVAGLVEWPVLLAVGGSALLLQRLSR

SEQ ID NO: 341556 - protein, 19 aa, Mycobacterium
GVAIAFLLIRVIRAPIEAR

SEQ ID NO: 341557 - protein, 22 aa, Mycobacterium
GVALCAGLWFIGRRVIATVGHN

SEQ ID NO: 341558 - protein, 17 aa, Mycobacterium
GVALGWRPPLAGLALGA

SEQ ID NO: 341559 - protein, 18 aa, Mycobacterium
GVALTFTFLWFVFVGVGD

SEQ ID NO: 341560 - protein, 22 aa, Mycobacterium
GVDPRVGLFASFTMAVTIAIVG

SEQ ID NO: 341561 - protein, 22 aa, Mycobacterium
GVDPRVGLFASFTMAVTIAVVG

SEQ ID NO: 341562 - protein, 18 aa, Mycobacterium
GVDVKRVFEFGLHYWPWL

SEQ ID NO: 341563 - protein, 19 aa, Mycobacterium
GVGFIPFVIALGIGLGVSS

SEQ ID NO: 341564 - protein, 19 aa, Mycobacterium
GVGFIPFVIGMGIGLGAAS

SEQ ID NO: 341565 - protein, 23 aa, Mycobacterium
GVGLGMSVARGFVEAMGGTIAAG

SEQ ID NO: 341566 - protein, 23 aa, Mycobacterium
GVGLGMSVARGFVEAMGGTVAAG

SEQ ID NO: 341567 - protein, 22 aa, Mycobacterium
GVKEPLLRWLAIAAISIVIALV

SEQ ID NO: 341568 - protein, 19 aa, Mycobacterium
GVLDFPYRQFVVFDAIGAV

SEQ ID NO: 341569 - protein, 17 aa, Mycobacterium
GVLGALAIVIAILIVLN

SEQ ID NO: 341570 - protein, 19 aa, Mycobacterium
GVLGHRWLSKRTRRMINPG

SEQ ID NO: 341571 - protein, 17 aa, Mycobacterium
GVLGVVIAHPWRSPGPP

SEQ ID NO: 341572 - protein, 18 aa, Mycobacterium
GVLHCIRESLVATVLALL

SEQ ID NO: 341573 - protein, 17 aa, Mycobacterium
GVLLCLLLGVAIVTQVR

SEQ ID NO: 341574 - protein, 22 aa, Mycobacterium
GVLLWNRPQWRAEIIDSAISQF

SEQ ID NO: 341575 - protein, 17 aa, Mycobacterium
GVLPRWQPVAILSVLAV

SEQ ID NO: 341576 - protein, 23 aa, Mycobacterium
GVLQRPSFRMPWSPYSGWITLAF

SEQ ID NO: 341577 - protein, 18 aa, Mycobacterium
GVLRARHPPPWGADVLVS

SEQ ID NO: 341578 - protein, 20 aa, Mycobacterium
GVLWLYCLAVGGAVTGVSAA

SEQ ID NO: 341579 - protein, 17 aa, Mycobacterium
GVMAAFFFWQSVNTREP

SEQ ID NO: 341580 - protein, 18 aa, Mycobacterium
GVMLIRWLIARRAAVFAH

SEQ ID NO: 341581 - protein, 17 aa, Mycobacterium
GVMPLFPALLMVWGTAR

SEQ ID NO: 341582 - protein, 18 aa, Mycobacterium
GVMWKRFTETGAIKAKSV

SEQ ID NO: 341583 - protein, 19 aa, Mycobacterium
GVPAALCWSTGPPGDPLSG

SEQ ID NO: 341584 - protein, 19 aa, Mycobacterium
GVPCALVILVIVAAALTLA

SEQ ID NO: 341585 - protein, 20 aa, Mycobacterium
GVPCSVGLLVGVLVSLTLGP

SEQ ID NO: 341586 - protein, 19 aa, Mycobacterium
GVPHLEWYDYPLSGVLSLV

SEQ ID NO: 341587 - protein, 19 aa, Mycobacterium
GVPHRIRWIFPPIKAASAV

SEQ ID NO: 341588 - protein, 19 aa, Mycobacterium
GVPLEWNVFFIFSLFYLFG

SEQ ID NO: 341589 - protein, 17 aa, Mycobacterium
GVPLEWNVFMIFGVLAL

SEQ ID NO: 341590 - protein, 17 aa, Mycobacterium
GVPLEWNVFMIFGVLSL

SEQ ID NO: 341591 - protein, 27 aa, Mycobacterium
GVPVPIPVIVPFPGWQPGYPRPPYNPP

SEQ ID NO: 341592 - protein, 18 aa, Mycobacterium
GVPWPAYKVFALLIGAFV

SEQ ID NO: 341593 - protein, 17 aa, Mycobacterium
GVRLRDGASLTLDDVTP

SEQ ID NO: 341594 - protein, 19 aa, Mycobacterium
GVRVMPVFAFKSGAFFAAI

SEQ ID NO: 341595 - protein, 24 aa, Mycobacterium
GVSKLPMYLSMAVAALGLLAYLAS

SEQ ID NO: 341596 - protein, 18 aa, Mycobacterium
GVSVIRRLVVPRFAAAVM

SEQ ID NO: 341597 - protein, 20 aa, Mycobacterium
GVSWVYRYAVAVYRDDRGCG

SEQ ID NO: 341598 - protein, 25 aa, Mycobacterium
GVTLTVLWRSRWVRRAVAGAAVVML

SEQ ID NO: 341599 - protein, 17 aa, Mycobacterium
GVVAKWLVGQPVPGFSR

SEQ ID NO: 341600 - protein, 20 aa, Mycobacterium
GVVIYGLIRWSRARTAPPPP

SEQ ID NO: 341601 - protein, 18 aa, Mycobacterium
GVVPEWLAYALAVLLGAA

SEQ ID NO: 341602 - protein, 17 aa, Mycobacterium
GVVPEWLAYAVAAVLGV

SEQ ID NO: 341603 - protein, 17 aa, Mycobacterium
GVVPEWLAYTLAVVLGL

SEQ ID NO: 341604 - protein, 24 aa, Mycobacterium
GVVVGGPFLPLAIILYWFANNIWT

SEQ ID NO: 341605 - protein, 18 aa, Mycobacterium
GVWFLHWPTRAESIAFSI

SEQ ID NO: 341606 - protein, 23 aa, Mycobacterium
GWAGPRGAYLLAFGAFAVGTLVC

SEQ ID NO: 341607 - protein, 22 aa, Mycobacterium
GWDPDWFKFFLGAMLLFAVIAN

SEQ ID NO: 341608 - protein, 19 aa, Mycobacterium
GWEVRDFRTARKAARIGVP

SEQ ID NO: 341609 - protein, 20 aa, Mycobacterium
GWFFDRPDLIGADGVHPNDA

SEQ ID NO: 341610 - protein, 19 aa, Mycobacterium
GWITQRLWWAVLLTVGFWG

SEQ ID NO: 341611 - protein, 17 aa, Mycobacterium
GWLAFAATVPVQFVAGW

SEQ ID NO: 341612 - protein, 18 aa, Mycobacterium
GWLAFAATVPVQFVAGWP

SEQ ID NO: 341613 - protein, 25 aa, Mycobacterium
GWLIDRFGWEWIFWINLPIGLITVG

SEQ ID NO: 341614 - protein, 21 aa, Mycobacterium
GWLLEHFWWGSIFMVNIPIAV

SEQ ID NO: 341615 - protein, 22 aa, Mycobacterium
GWLLEHFWWGSVFMVNIPIAAL

SEQ ID NO: 341616 - protein, 22 aa, Mycobacterium
GWLNRMMLYFGWNVSVSQTINP

SEQ ID NO: 341617 - protein, 17 aa, Mycobacterium
GWLTLWPFLSWLTTHFV

SEQ ID NO: 341618 - protein, 26 aa, Mycobacterium
GWPAELRWRPVTAIVGAVVAVGAIAT

SEQ ID NO: 341619 - protein, 18 aa, Mycobacterium
GWPLWWVSACSVLVLLIL

SEQ ID NO: 341620 - protein, 24 aa, Mycobacterium
GWPTWWVSVCSILCLLIVQGVVVN

SEQ ID NO: 341621 - protein, 21 aa, Mycobacterium
GWRAVWYWMRYSSVVKKHTTR

SEQ ID NO: 341622 - protein, 31 aa, Mycobacterium
GWRIPGLRTLYAFLPRRVQVIPAITSDGRFG

SEQ ID NO: 341623 - protein, 25 aa, Mycobacterium
GWRKIGAAIVRWPGPILVATMAITL

SEQ ID NO: 341624 - protein, 25 aa, Mycobacterium
GWRKVGALVVRWPGPILVLTIGVAL

SEQ ID NO: 341625 - protein, 25 aa, Mycobacterium
GWRRVGVAVVRWPGPILVGAVLVTV

SEQ ID NO: 341626 - protein, 22 aa, Mycobacterium
GWRWHARLFLGTGFCGAFTTYS

SEQ ID NO: 341627 - protein, 23 aa, Mycobacterium
GWVAERLSYGWGFVISGIVLLIA

SEQ ID NO: 341628 - protein, 18 aa, Mycobacterium
GWVNFWFAVSFVLGPITT

SEQ ID NO: 341629 - protein, 19 aa, Mycobacterium
GWWPVLWFTAKVWGFLFMY

SEQ ID NO: 341630 - protein, 18 aa, Mycobacterium
GWWTLILVAVFAVAIFVT

SEQ ID NO: 341631 - protein, 19 aa, Mycobacterium
GWYFWPVWPIMGWGIGVAS

SEQ ID NO: 341632 - protein, 23 aa, Mycobacterium
GYAGLKWKWPAPFLIAPMLVALV

SEQ ID NO: 341633 - protein, 22 aa, Mycobacterium
GYEMPRALVFLTYIYVIVTTLI

SEQ ID NO: 341634 - protein, 27 aa, Mycobacterium
GYFTDHLTWRWAFWINVPIGIVVLIVA

SEQ ID NO: 341635 - protein, 26 aa, Mycobacterium
GYFTDYLTWRWAFWINVPISVVVILV

SEQ ID NO: 341636 - protein, 25 aa, Mycobacterium
GYFTDYLTWRWAFWVNVPISVVVIF

SEQ ID NO: 341637 - protein, 19 aa, Mycobacterium
GYLKARVADMYTMIDELQH

SEQ ID NO: 341638 - protein, 20 aa, Mycobacterium
GYLLVCAMIYGWAFMQRGVP

SEQ ID NO: 341639 - protein, 27 aa, Mycobacterium
GYLYRRIGASVVRWPVPILVASSAVVM

SEQ ID NO: 341640 - protein, 19 aa, Mycobacterium
GYPQMLLRVGWAPVNADPL

SEQ ID NO: 341641 - protein, 20 aa, Mycobacterium
GYPSLYSWMVGLIVTELPLQ

SEQ ID NO: 341642 - protein, 20 aa, Mycobacterium
GYRAGWRFFVMYGATEATAR

SEQ ID NO: 341643 - protein, 23 aa, Mycobacterium
GYRGCSHACRYCFARPTHEYLEL

SEQ ID NO: 341644 - protein, 17 aa, Mycobacterium
GYRQAKARVTLHDMKFA

SEQ ID NO: 341645 - protein, 24 aa, Mycobacterium
GYSRFPVIGPRGDYLGYLHIKDVL

SEQ ID NO: 341646 - protein, 19 aa, Mycobacterium
GYSTVLVFWFGWPASEVPG

SEQ ID NO: 341647 - protein, 18 aa, Mycobacterium
GYSTVLVFWFGWPTSEVP

SEQ ID NO: 341648 - protein, 17 aa, Mycobacterium
GYVYRTPLLATRKGDVP

SEQ ID NO: 341649 - protein, 18 aa, Mycobacterium
GYWLAGGVSILWLGVAGW

SEQ ID NO: 341650 - protein, 20 aa, Mycobacterium
GYWPAAFGLFAFVWLELASP

SEQ ID NO: 341651 - protein, 19 aa, Mycobacterium
HAAVWWKALLALVVAIALT

SEQ ID NO: 341652 - protein, 23 aa, Mycobacterium
HAGLCLPALWAIRHRTIETRSGT

SEQ ID NO: 341653 - protein, 23 aa, Mycobacterium
HAILGWRPVLLIPLTFALFTPLG

SEQ ID NO: 341654 - protein, 17 aa, Mycobacterium
HALPLFGSVVLRAKTAT

SEQ ID NO: 341655 - protein, 17 aa, Mycobacterium
HAPWARWRYTSRPRKMH

SEQ ID NO: 341656 - protein, 21 aa, Mycobacterium
HARAPWEAWTLVLAVLGPAVA

SEQ ID NO: 341657 - protein, 19 aa, Mycobacterium
HAREVWWMLAAQLVIVLAL

SEQ ID NO: 341658 - protein, 27 aa, Mycobacterium
HARPLYGPGLRFLIPFVDKMIRVDQRL

SEQ ID NO: 341659 - protein, 18 aa, Mycobacterium
HARRWRRIGAIIGGCAAV

SEQ ID NO: 341660 - protein, 17 aa, Mycobacterium
HAYAGSLAQVFLCAAAV

SEQ ID NO: 341661 - protein, 22 aa, Mycobacterium
HCFDIPMCWAMRSIFDTLDKID

SEQ ID NO: 341662 - protein, 17 aa, Mycobacterium
HCVRRFGGITGDVLGAS

SEQ ID NO: 341663 - protein, 18 aa, Mycobacterium
HCVRRFGGVTGDVIGAAI

SEQ ID NO: 341664 - protein, 17 aa, Mycobacterium
HCYDIPMCHSMRSIFDA

SEQ ID NO: 341665 - protein, 17 aa, Mycobacterium
HCYDVPICWSLRSIFDA

SEQ ID NO: 341666 - protein, 22 aa, Mycobacterium
HCYDVPVCWALRSLFDALDGID

SEQ ID NO: 341667 - protein, 17 aa, Mycobacterium
HDELRFVVGHELGHALS

SEQ ID NO: 341668 - protein, 21 aa, Mycobacterium
HDRAVVIPAILVVVLIVLYVL

SEQ ID NO: 341669 - protein, 20 aa, Mycobacterium
HDRIPVLYCKTGVRSAAALA

SEQ ID NO: 341670 - protein, 24 aa, Mycobacterium
HEEQSVWFSWPFRSLAVLCAVAVA

SEQ ID NO: 341671 - protein, 19 aa, Mycobacterium
HEFPGPWALVPVGATLLFI

SEQ ID NO: 341672 - protein, 22 aa, Mycobacterium
HEGGHTLAAWAMPDIEPIYKVT

SEQ ID NO: 341673 - protein, 23 aa, Mycobacterium
HEGGHTLAAWAMPDIEPIYKVTI

SEQ ID NO: 341674 - protein, 17 aa, Mycobacterium
HEGRAAGYISFFVNFGI

SEQ ID NO: 341675 - protein, 18 aa, Mycobacterium
HEIPRRYLALVVLASLIA

SEQ ID NO: 341676 - protein, 21 aa, Mycobacterium
HEMPQLIAAYTWLDTHRNSNR

SEQ ID NO: 341677 - protein, 20 aa, Mycobacterium
HEMRVPWWFLVCQLPISGLV

SEQ ID NO: 341678 - protein, 17 aa, Mycobacterium
HEPAWVVAPGMQGVEVQ

SEQ ID NO: 341679 - protein, 22 aa, Mycobacterium
HERGELFAAVFVVSYLAFGGPA

SEQ ID NO: 341680 - protein, 24 aa, Mycobacterium
HEVWTRLIAMIAFSAVAGVTIAAL

SEQ ID NO: 341681 - protein, 20 aa, Mycobacterium
HFLGFHWSLPVGVGYLLAAV

SEQ ID NO: 341682 - protein, 21 aa, Mycobacterium
HFQRAVLRIGNYLILIAVALV

SEQ ID NO: 341683 - protein, 24 aa, Mycobacterium
HFQRAVLRIGNYLIVIAVALVALT

SEQ ID NO: 341684 - protein, 18 aa, Mycobacterium
HGAWPWVAALAMLTLGGL

SEQ ID NO: 341685 - protein, 20 aa, Mycobacterium
HGLAAWRVPLAILLTLWTIR

SEQ ID NO: 341686 - protein, 19 aa, Mycobacterium
HGLHAMFFDQPRVHEKQEM

SEQ ID NO: 341687 - protein, 17 aa, Mycobacterium
HGLLLGVAVAAVFVVAP

SEQ ID NO: 341688 - protein, 25 aa, Mycobacterium
HGLYRAGGDVVAWSVWVVELLAGMT

SEQ ID NO: 341689 - protein, 23 aa, Mycobacterium
HHELEFWWELALLIVIMLLGHWF

SEQ ID NO: 341690 - protein, 17 aa, Mycobacterium
HHLKYPMAVTVESIDEE

SEQ ID NO: 341691 - protein, 24 aa, Mycobacterium
HHRITRWEWMWAVALAAALAVVII

SEQ ID NO: 341692 - protein, 23 aa, Mycobacterium
HIATSVVRWPKPVFVASAVVVLV

SEQ ID NO: 341693 - protein, 17 aa, Mycobacterium
HIDVRWGFRERVTAIAV

SEQ ID NO: 341694 - protein, 17 aa, Mycobacterium
HIIGLALHWMVLPMAVI

SEQ ID NO: 341695 - protein, 18 aa, Mycobacterium
HILGSAFMRNALIGGTLV

SEQ ID NO: 341696 - protein, 20 aa, Mycobacterium
HKGRAVGIWAGFASAGSIMG

SEQ ID NO: 341697 - protein, 19 aa, Mycobacterium
HKLRLRVGVNTGKVISGLV

SEQ ID NO: 341698 - protein, 21 aa, Mycobacterium
HKVFFCVASILLVMALNLRGV

SEQ ID NO: 341699 - protein, 20 aa, Mycobacterium
HLAELGWICVAINYRHSPRN

SEQ ID NO: 341700 - protein, 25 aa, Mycobacterium
HLDSELAWRLPFLLSSVLIVAGMII

SEQ ID NO: 341701 - protein, 18 aa, Mycobacterium
HLFWFFGHPEVYVIALPF

SEQ ID NO: 341702 - protein, 19 aa, Mycobacterium
HLFWYFGHPEVYVIALPFF

SEQ ID NO: 341703 - protein, 19 aa, Mycobacterium
HLNELRWRRTGARIIRHAG

SEQ ID NO: 341704 - protein, 17 aa, Mycobacterium
HLPAVLMILSLVSFTIA

SEQ ID NO: 341705 - protein, 23 aa, Mycobacterium
HLPGWRLALVIAFIPMADGIGNG

SEQ ID NO: 341706 - protein, 23 aa, Mycobacterium
HLRKRLRDEFGFPKADVHAAAYW

SEQ ID NO: 341707 - protein, 21 aa, Mycobacterium
HLTTCPQCRAGVAELSGMPAL

SEQ ID NO: 341708 - protein, 19 aa, Mycobacterium
HMPELNWTFGYPLALLVMA

SEQ ID NO: 341709 - protein, 17 aa, Mycobacterium
HNRRLMIFAATVVAFHF

SEQ ID NO: 341710 - protein, 18 aa, Mycobacterium
HPAERFCPNCGKHIELPA

SEQ ID NO: 341711 - protein, 21 aa, Mycobacterium
HPAWHTLILVLLFVAAMWVTY

SEQ ID NO: 341712 - protein, 19 aa, Mycobacterium
HPHCCSVGYLLRDDRGQWR

SEQ ID NO: 341713 - protein, 21 aa, Mycobacterium
HPKMPLVPLIDGWESVAEMEA

SEQ ID NO: 341714 - protein, 20 aa, Mycobacterium
HPLMSPKLFADRNFGVANAV

SEQ ID NO: 341715 - protein, 20 aa, Mycobacterium
HPLVAWAWNLLRLDFCGIAF

SEQ ID NO: 341716 - protein, 19 aa, Mycobacterium
HPPEHEWAAAVDEHGGAHR

SEQ ID NO: 341717 - protein, 23 aa, Mycobacterium
HPRLEHRILLVLLIQADGAVVGV

SEQ ID NO: 341718 - protein, 24 aa, Mycobacterium
HPTAPRGAIGWGFGAHGLLTNIGI

SEQ ID NO: 341719 - protein, 20 aa, Mycobacterium
HPVAMLGFMVLISFAFVAAT

SEQ ID NO: 341720 - protein, 20 aa, Mycobacterium
HPVLGRWVAHFNIVVAAALT

SEQ ID NO: 341721 - protein, 18 aa, Mycobacterium
HPVYRSALVVYFVVMSCY

SEQ ID NO: 341722 - protein, 22 aa, Mycobacterium
HPYPRWLSTAGWAGFALGIAML

SEQ ID NO: 341723 - protein, 20 aa, Mycobacterium
HPYPRWVATAGWAGFALGIA

SEQ ID NO: 341724 - protein, 19 aa, Mycobacterium
HQGVDTGGIWVWRDADTVD

SEQ ID NO: 341725 - protein, 17 aa, Mycobacterium
HQLRSYRLVSVLRLGVL

SEQ ID NO: 341726 - protein, 18 aa, Mycobacterium
HRAKGGGLSSLFGGGVQS

SEQ ID NO: 341727 - protein, 18 aa, Mycobacterium
HRAKGGGLSTLFGGGVQS

SEQ ID NO: 341728 - protein, 23 aa, Mycobacterium
HRALTCWRWWLAPAALFVALGAW

SEQ ID NO: 341729 - protein, 17 aa, Mycobacterium
HRARWGFADDRILPASA

SEQ ID NO: 341730 - protein, 17 aa, Mycobacterium
HRFEIAESIDLRTFPGT

SEQ ID NO: 341731 - protein, 18 aa, Mycobacterium
HRFGWSSVPVWLSLLGDL

SEQ ID NO: 341732 - protein, 17 aa, Mycobacterium
HRFWRILGTRIVRRPRV

SEQ ID NO: 341733 - protein, 18 aa, Mycobacterium
HRGIPVFIALGVLSMLLA

SEQ ID NO: 341734 - protein, 18 aa, Mycobacterium
HRLHPALNLVSARLIAGE

SEQ ID NO: 341735 - protein, 19 aa, Mycobacterium
HRLRCFVVKAEGATIDEDA

SEQ ID NO: 341736 - protein, 26 aa, Mycobacterium
HRPNRVWWRFVAWWLPCVALAVTWWV

SEQ ID NO: 341737 - protein, 19 aa, Mycobacterium
HRRGVAWLLLIPIVLLAFV

SEQ ID NO: 341738 - protein, 18 aa, Mycobacterium
HRVGEPFGSLILAAAVTI

SEQ ID NO: 341739 - protein, 18 aa, Mycobacterium
HRVGEPFGSLVLAIAVTV

SEQ ID NO: 341740 - protein, 18 aa, Mycobacterium
HRVGEPFGSLVLAVAVTV

SEQ ID NO: 341741 - protein, 19 aa, Mycobacterium
HSAAFDFSVWELWGPLLHG

SEQ ID NO: 341742 - protein, 24 aa, Mycobacterium
HSAFRIGIFSNRWIIVGVTVQAVA

SEQ ID NO: 341743 - protein, 25 aa, Mycobacterium
HSDLGWLWWFGAGWVAVAVVGAGVI

SEQ ID NO: 341744 - protein, 21 aa, Mycobacterium
HSGPATGWWAFRSVCTTNGCA

SEQ ID NO: 341745 - protein, 18 aa, Mycobacterium
HSIGRIMLLAAVVGVVSV

SEQ ID NO: 341746 - protein, 18 aa, Mycobacterium
HSLGGPPVVQWGSRDIER

SEQ ID NO: 341747 - protein, 20 aa, Mycobacterium
HSSDAIAGWASHLAAVTTEL

SEQ ID NO: 341748 - protein, 17 aa, Mycobacterium
HTERLWAAIGLVPQRGY

SEQ ID NO: 341749 - protein, 18 aa, Mycobacterium
HTTHWGLQIDHFWWTAIW

SEQ ID NO: 341750 - protein, 18 aa, Mycobacterium
HVAVFRKLFWINLIIAIP

SEQ ID NO: 341751 - protein, 19 aa, Mycobacterium
HVCKLWPLVFARVAASLVI

SEQ ID NO: 341752 - protein, 23 aa, Mycobacterium
HVDEWRATFAVNVFGAVALTLAL

SEQ ID NO: 341753 - protein, 23 aa, Mycobacterium
HVHRRLSFRYGYLHIFVFGAIVA

SEQ ID NO: 341754 - protein, 19 aa, Mycobacterium
HVINLPGFPALGGATNPDA

SEQ ID NO: 341755 - protein, 21 aa, Mycobacterium
HVKFARDFMRIEIGIVSVVLV

SEQ ID NO: 341756 - protein, 17 aa, Mycobacterium
HVKWLKGIEFVAHYSEL

SEQ ID NO: 341757 - protein, 18 aa, Mycobacterium
HVLGHDWGSVAIWEYLTR

SEQ ID NO: 341758 - protein, 24 aa, Mycobacterium
HVLRDLREGFAFVLKTPWLLWTVL

SEQ ID NO: 341759 - protein, 18 aa, Mycobacterium
HVMGHDWGSVGIWEYLTR

SEQ ID NO: 341760 - protein, 22 aa, Mycobacterium
HVMGRWNWWAPKPLVWLHQRFG

SEQ ID NO: 341761 - protein, 20 aa, Mycobacterium
HVRWSIRVMIVILWFSAAMA

SEQ ID NO: 341762 - protein, 23 aa, Mycobacterium
HVSDLRAAFEWQRPQLDTATHGD

SEQ ID NO: 341763 - protein, 17 aa, Mycobacterium
HVSFAYRPGVPVIDDLS

SEQ ID NO: 341764 - protein, 17 aa, Mycobacterium
HVVDARFARDLRTGLLR

SEQ ID NO: 341765 - protein, 19 aa, Mycobacterium
HVVDLRFSADVRRRLLDKL

SEQ ID NO: 341766 - protein, 20 aa, Mycobacterium
HVVSGSWSFRLTVPGTGTPG

SEQ ID NO: 341767 - protein, 18 aa, Mycobacterium
HWDWLKWLPHNQHQRCVD

SEQ ID NO: 341768 - protein, 21 aa, Mycobacterium
HWLGRWTWWAPKPLERLRNRS

SEQ ID NO: 341769 - protein, 19 aa, Mycobacterium
HWQEWPASGVFFGLVAVFQ

SEQ ID NO: 341770 - protein, 18 aa, Mycobacterium
HYRGWAIPVAFVIAQGTA

SEQ ID NO: 341771 - protein, 22 aa, Mycobacterium
IAAALGRPVVRLGFEPGELQRA

SEQ ID NO: 341772 - protein, 25 aa, Mycobacterium
IAAALGRWFWWPINVFEIVRRGRET

SEQ ID NO: 341773 - protein, 21 aa, Mycobacterium
IAAALGRWFWWPLDVYQIVDR

SEQ ID NO: 341774 - protein, 22 aa, Mycobacterium
IAAALGRWFWWPLNTFEITRHG

SEQ ID NO: 341775 - protein, 22 aa, Mycobacterium
IAAALGRWFWWPLNTFEITRRG

SEQ ID NO: 341776 - protein, 18 aa, Mycobacterium
IAAAYSWGLAFLGRTRGQ

SEQ ID NO: 341777 - protein, 22 aa, Mycobacterium
IAACLFIAMFILLRRKRVPGVA

SEQ ID NO: 341778 - protein, 19 aa, Mycobacterium
IAAGFLYFFFVLPRWPELM

SEQ ID NO: 341779 - protein, 21 aa, Mycobacterium
IAAGVKLCMAYSVIATLAMEF

SEQ ID NO: 341780 - protein, 18 aa, Mycobacterium
IAAIPFVVGMGIGLGLSS

SEQ ID NO: 341781 - protein, 20 aa, Mycobacterium
IAALAVICLGVFVISVDATI

SEQ ID NO: 341782 - protein, 22 aa, Mycobacterium
IAALLGRWFWWPLLVRPRPASL

SEQ ID NO: 341783 - protein, 20 aa, Mycobacterium
IAALLGRWFWWPLNIRSRPP

SEQ ID NO: 341784 - protein, 20 aa, Mycobacterium
IAALLGRWFWWPLQVRSRPT

SEQ ID NO: 341785 - protein, 20 aa, Mycobacterium
IAALLGRWFWWPLQVRTRPT

SEQ ID NO: 341786 - protein, 22 aa, Mycobacterium
IAALLGRWFWWPLRVRSRPDRR

SEQ ID NO: 341787 - protein, 19 aa, Mycobacterium
IAALLGRWFWWPMKVRSRP

SEQ ID NO: 341788 - protein, 21 aa, Mycobacterium
IAALLGRWFWWPMRVRTRPAR

SEQ ID NO: 341789 - protein, 21 aa, Mycobacterium
IAALLGRWFWWPMVVRPRPAS

SEQ ID NO: 341790 - protein, 25 aa, Mycobacterium
IAALLGRWFWWPQIVRPRPASQMLR

SEQ ID NO: 341791 - protein, 21 aa, Mycobacterium
IAALLGRWFWWPQKVRPRPAS

SEQ ID NO: 341792 - protein, 21 aa, Mycobacterium
IAALLGRWFWWPQRIRRRPAI

SEQ ID NO: 341793 - protein, 22 aa, Mycobacterium
IAALLGRWFWWPQRVRPRPASQ

SEQ ID NO: 341794 - protein, 22 aa, Mycobacterium
IAALLGRWFWWPQRVRPRPASR

SEQ ID NO: 341795 - protein, 22 aa, Mycobacterium
IAALLGRWFWWPQRVRPRPPSA

SEQ ID NO: 341796 - protein, 21 aa, Mycobacterium
IAALLGRWFWWPQRVRQRPAS

SEQ ID NO: 341797 - protein, 22 aa, Mycobacterium
IAALLGRWFWWPQRVRTRPASY

SEQ ID NO: 341798 - protein, 20 aa, Mycobacterium
IAALLGRWFWWPQTPPRKRL

SEQ ID NO: 341799 - protein, 23 aa, Mycobacterium
IAALLGRWFWWPQVVRARPARGV

SEQ ID NO: 341800 - protein, 19 aa, Mycobacterium
IAALMGRWFWWPQQVRTRP

SEQ ID NO: 341801 - protein, 18 aa, Mycobacterium
IAALQGWSAYGYTPLPPG

SEQ ID NO: 341802 - protein, 18 aa, Mycobacterium
IAAPRAKLFTALFLILGL

SEQ ID NO: 341803 - protein, 18 aa, Mycobacterium
IAAPRLVLGMALLIAIAA

SEQ ID NO: 341804 - protein, 17 aa, Mycobacterium
IAAVGMGIAVLATLIKV

SEQ ID NO: 341805 - protein, 17 aa, Mycobacterium
IAAVLGIVAGLAVLAGP

SEQ ID NO: 341806 - protein, 18 aa, Mycobacterium
IACLLLLGWVRLTGHPLR

SEQ ID NO: 341807 - protein, 18 aa, Mycobacterium
IACRLRGIPLPAFGDAIA

SEQ ID NO: 341808 - protein, 23 aa, Mycobacterium
IADLYPRYVCDYGTPSHPPSAAD

SEQ ID NO: 341809 - protein, 18 aa, Mycobacterium
IADSGFRLAVLGLTVYTA

SEQ ID NO: 341810 - protein, 27 aa, Mycobacterium
IAEGLRFVWNLRVLRTLGLIDLTVTAL

SEQ ID NO: 341811 - protein, 23 aa, Mycobacterium
IAETRWGTRLGVRWWRFGAGVLL

SEQ ID NO: 341812 - protein, 19 aa, Mycobacterium
IAFGLCWLALPLAFRSSNF

SEQ ID NO: 341813 - protein, 18 aa, Mycobacterium
IAFGLSMDYEVFLLSRIR

SEQ ID NO: 341814 - protein, 17 aa, Mycobacterium
IAFGLSMDYEVFLVSRI

SEQ ID NO: 341815 - protein, 24 aa, Mycobacterium
IAFWIGRPIIWLAFDNEKFNAAFR

SEQ ID NO: 341816 - protein, 22 aa, Mycobacterium
IAGALGKWFWWSPVPLLRGLLF

SEQ ID NO: 341817 - protein, 20 aa, Mycobacterium
IAGAWGWRAVFAIAAAITAA

SEQ ID NO: 341818 - protein, 18 aa, Mycobacterium
IAGAWRWTALFAALVTVV

SEQ ID NO: 341819 - protein, 21 aa, Mycobacterium
IAGPIARLALVGAAAEGSAVI

SEQ ID NO: 341820 - protein, 20 aa, Mycobacterium
IAITGVWLWLDYDALLLVVA

SEQ ID NO: 341821 - protein, 17 aa, Mycobacterium
IAKFERWTVPPTVAVLV

SEQ ID NO: 341822 - protein, 19 aa, Mycobacterium
IAKNASVLISVWVTVTDID

SEQ ID NO: 341823 - protein, 17 aa, Mycobacterium
IAKRAGHPISFWQFTRY

SEQ ID NO: 341824 - protein, 21 aa, Mycobacterium
IAKRSRKLFVAQWTNTGRLNA

SEQ ID NO: 341825 - protein, 24 aa, Mycobacterium
IAKYRAGGSLTRFGMLAAQVVPPA

SEQ ID NO: 341826 - protein, 21 aa, Mycobacterium
IALALPRLAKYQVTLGETVAS

SEQ ID NO: 341827 - protein, 17 aa, Mycobacterium
IALALTILVLWQRRRRR

SEQ ID NO: 341828 - protein, 17 aa, Mycobacterium
IALATIIVMPLLYGAMY

SEQ ID NO: 341829 - protein, 36 aa, Mycobacterium
IALAVGIAVVFVRWWGQPAWSWAVLGLRGRRPVSWD

SEQ ID NO: 341830 - protein, 17 aa, Mycobacterium
IALCRRVAEALPHAEMV

SEQ ID NO: 341831 - protein, 18 aa, Mycobacterium
IALEVLWWAPGAFLEAIV

SEQ ID NO: 341832 - protein, 17 aa, Mycobacterium
IALGWAFLGAGIGSVIR

SEQ ID NO: 341833 - protein, 23 aa, Mycobacterium
IALPALGLWHLWAGSPTDPVGRR

SEQ ID NO: 341834 - protein, 19 aa, Mycobacterium
IALRWLLLLAVTIAVTVPL

SEQ ID NO: 341835 - protein, 21 aa, Mycobacterium
IALTAWRVMWFRIHAEPSGDE

SEQ ID NO: 341836 - protein, 22 aa, Mycobacterium
IALTAWRVMWFRIHAHPAGDEW

SEQ ID NO: 341837 - protein, 18 aa, Mycobacterium
IALVPLFIAEVFHRGPGI

SEQ ID NO: 341838 - protein, 19 aa, Mycobacterium
IALVVSVSLLFARTDTTKL

SEQ ID NO: 341839 - protein, 17 aa, Mycobacterium
IALYILGGWLFAMVTTE

SEQ ID NO: 341840 - protein, 17 aa, Mycobacterium
IAMAITAIATWAAESLG

SEQ ID NO: 341841 - protein, 17 aa, Mycobacterium
IAMALSFVAVFIYAGTM

SEQ ID NO: 341842 - protein, 17 aa, Mycobacterium
IAMLGGWLSALAGAWFV

SEQ ID NO: 341843 - protein, 17 aa, Mycobacterium
IAPKYAGLIALNVNAEI

SEQ ID NO: 341844 - protein, 17 aa, Mycobacterium
IAPRARRLFVEQWAVIG

SEQ ID NO: 341845 - protein, 23 aa, Mycobacterium
IAQEFADKVFIIFQRLHGRDSYG

SEQ ID NO: 341846 - protein, 19 aa, Mycobacterium
IAQNLPLLLGFYAQPATLP

SEQ ID NO: 341847 - protein, 24 aa, Mycobacterium
IARLKPRFASLVGLSEVMFAVIIA

SEQ ID NO: 341848 - protein, 23 aa, Mycobacterium
IARRAGTPISFWEFTRKGILVTT

SEQ ID NO: 341849 - protein, 23 aa, Mycobacterium
IARRAGTPISFWEFTRKGIVVTT

SEQ ID NO: 341850 - protein, 21 aa, Mycobacterium
IARTRLGAWLNRPMTSFHLVV

SEQ ID NO: 341851 - protein, 18 aa, Mycobacterium
IARWSRRIAVQSAVAGMS

SEQ ID NO: 341852 - protein, 23 aa, Mycobacterium
IARYRAGGTLTRFGMLAAQVLPP

SEQ ID NO: 341853 - protein, 17 aa, Mycobacterium
IASAVPWWAGLFTSATM

SEQ ID NO: 341854 - protein, 21 aa, Mycobacterium
IASLCACLWLMLNLTALTWIR

SEQ ID NO: 341855 - protein, 20 aa, Mycobacterium
IASLCWALVFAVRFVVQRLL

SEQ ID NO: 341856 - protein, 26 aa, Mycobacterium
IASLLGRWFWWPMVVRPRPRPQPWPQ

SEQ ID NO: 341857 - protein, 19 aa, Mycobacterium
IASLVGRANWWPGQIGTSP

SEQ ID NO: 341858 - protein, 21 aa, Mycobacterium
IASRLGWVVIRSFDGLGPPKE

SEQ ID NO: 341859 - protein, 20 aa, Mycobacterium
IASVGLWWFIRRQISRQRRG

SEQ ID NO: 341860 - protein, 24 aa, Mycobacterium
IASWSEPKGGYFISLDVLDGTAKR

SEQ ID NO: 341861 - protein, 17 aa, Mycobacterium
IATDFCYYWAHRADHRV

SEQ ID NO: 341862 - protein, 22 aa, Mycobacterium
IATGCPFCRVMITDGVDDVAAS

SEQ ID NO: 341863 - protein, 22 aa, Mycobacterium
IATGCPFCRVMLTDGVTARDDS

SEQ ID NO: 341864 - protein, 22 aa, Mycobacterium
IATGCPFCRVMVTDGVNDRQEE

SEQ ID NO: 341865 - protein, 20 aa, Mycobacterium
IATILGRWFWWPLNVRTRPL

SEQ ID NO: 341866 - protein, 21 aa, Mycobacterium
IATLGDWRWIFAVNVPIGLIG

SEQ ID NO: 341867 - protein, 22 aa, Mycobacterium
IATLLGRWFWWPQRVRERPVPS

SEQ ID NO: 341868 - protein, 25 aa, Mycobacterium
IATVVRFVLLRGWVFHPARTRRPSQ

SEQ ID NO: 341869 - protein, 17 aa, Mycobacterium
IAVAFIGMWASLVDLGV

SEQ ID NO: 341870 - protein, 18 aa, Mycobacterium
IAVGLALVGLIAFVIVVQ

SEQ ID NO: 341871 - protein, 21 aa, Mycobacterium
IAVLLGRWFWWPHHVRPRPIP

SEQ ID NO: 341872 - protein, 22 aa, Mycobacterium
IAVLLLLWARRSLVAAAVVLLT

SEQ ID NO: 341873 - protein, 19 aa, Mycobacterium
IAVPAHWKPSTVQALRDAL

SEQ ID NO: 341874 - protein, 19 aa, Mycobacterium
IAVSLPVVWWRHRHNERDA

SEQ ID NO: 341875 - protein, 21 aa, Mycobacterium
IAVVLLLGWSFFYFSDDTRGY

SEQ ID NO: 341876 - protein, 24 aa, Mycobacterium
IAWFLKFLVSHSMYWFVGYRVVLG

SEQ ID NO: 341877 - protein, 17 aa, Mycobacterium
ICALAVLLTAIFVPESK

SEQ ID NO: 341878 - protein, 20 aa, Mycobacterium
ICDSIAFGAAGARAPLVPGS

SEQ ID NO: 341879 - protein, 20 aa, Mycobacterium
ICGFAALSGIMVWQHHQTTQ

SEQ ID NO: 341880 - protein, 25 aa, Mycobacterium
ICIIGYRLIHFLNRIGTWVLGIAIV

SEQ ID NO: 341881 - protein, 18 aa, Mycobacterium
ICITIIMSLTYRSLFTAS

SEQ ID NO: 341882 - protein, 19 aa, Mycobacterium
ICIVLGIGAAWLVERSDIP

SEQ ID NO: 341883 - protein, 17 aa, Mycobacterium
ICLEFLDYFLIGFIVTF

SEQ ID NO: 341884 - protein, 19 aa, Mycobacterium
ICLGCQIYPLITRLRRTQP

SEQ ID NO: 341885 - protein, 17 aa, Mycobacterium
ICLGCQLYPLIARLTPT

SEQ ID NO: 341886 - protein, 17 aa, Mycobacterium
ICLGCQLYPLVARLRGG

SEQ ID NO: 341887 - protein, 19 aa, Mycobacterium
ICLVARWRGLRALVGILVA

SEQ ID NO: 341888 - protein, 20 aa, Mycobacterium
ICVAALLVAQIFVRPIRRLQ

SEQ ID NO: 341889 - protein, 21 aa, Mycobacterium
IDAPPRWLPDWLRPRPSSPTS

SEQ ID NO: 341890 - protein, 19 aa, Mycobacterium
IDARLKRFGTMAAAMVLYV

SEQ ID NO: 341891 - protein, 22 aa, Mycobacterium
IDAWRFGWIVSIGRAITGGVGG

SEQ ID NO: 341892 - protein, 18 aa, Mycobacterium
IDDRLKRFGAMAAAMVLY

SEQ ID NO: 341893 - protein, 17 aa, Mycobacterium
IDEGAGWDLLIVGISAM

SEQ ID NO: 341894 - protein, 17 aa, Mycobacterium
IDGRLFVDMRLIEGHDL

SEQ ID NO: 341895 - protein, 18 aa, Mycobacterium
IDLEGSPLDALRLPDLPH

SEQ ID NO: 341896 - protein, 19 aa, Mycobacterium
IDLLLKRAASLGVQIRYET

SEQ ID NO: 341897 - protein, 26 aa, Mycobacterium
IDPEEFWRNAGLPAFRFPDPNGERHE

SEQ ID NO: 341898 - protein, 23 aa, Mycobacterium
IDPYRLAIRIELAGVEAATGTYS

SEQ ID NO: 341899 - protein, 18 aa, Mycobacterium
IDQRLKRFGAMAAAMVLY

SEQ ID NO: 341900 - protein, 17 aa, Mycobacterium
IDRPECWGSVAPGTPDA

SEQ ID NO: 341901 - protein, 19 aa, Mycobacterium
IDRTRTRYGLALTAYSLVN

SEQ ID NO: 341902 - protein, 22 aa, Mycobacterium
IDVLHWPGYLLVVAGVIGGVGS

SEQ ID NO: 341903 - protein, 22 aa, Mycobacterium
IDVLHWPGYLLVVAGVIGTCGS

SEQ ID NO: 341904 - protein, 17 aa, Mycobacterium
IDVMSWPGYLFMLVGVI

SEQ ID NO: 341905 - protein, 18 aa, Mycobacterium
IDVVRHWNSPAVVLAACA

SEQ ID NO: 341906 - protein, 19 aa, Mycobacterium
IEARFPWYVQMWGGRQWAR

SEQ ID NO: 341907 - protein, 18 aa, Mycobacterium
IEDPVRWLATVIKMDGRR

SEQ ID NO: 341908 - protein, 22 aa, Mycobacterium
IEFAGFFAWLAWLLLHLLYLVG

SEQ ID NO: 341909 - protein, 31 aa, Mycobacterium
IEFSGFIAWLSWLALHLVYLVGFKNRLVTLI

SEQ ID NO: 341910 - protein, 19 aa, Mycobacterium
IEGLLTWLGGGHWGELGER

SEQ ID NO: 341911 - protein, 18 aa, Mycobacterium
IEGLLTWLGGGHWRELGE

SEQ ID NO: 341912 - protein, 18 aa, Mycobacterium
IELMALWLAGVRWHRDGV

SEQ ID NO: 341913 - protein, 18 aa, Mycobacterium
IELPPGYLPIRVPIEVNF

SEQ ID NO: 341914 - protein, 19 aa, Mycobacterium
IEMWCSYPVYGDDADDSAA

SEQ ID NO: 341915 - protein, 18 aa, Mycobacterium
IEMYRWWRSPSVGPDGAR

SEQ ID NO: 341916 - protein, 19 aa, Mycobacterium
IEYVDWRAVFWINLPICAL

SEQ ID NO: 341917 - protein, 23 aa, Mycobacterium
IFAALLFWWTWHRLETKRRSDPV

SEQ ID NO: 341918 - protein, 18 aa, Mycobacterium
IFAAMGFTGDFALLGLPA

SEQ ID NO: 341919 - protein, 18 aa, Mycobacterium
IFAAMGFTGNFALLALPA

SEQ ID NO: 341920 - protein, 17 aa, Mycobacterium
IFACLFFAVYFMQVTYS

SEQ ID NO: 341921 - protein, 18 aa, Mycobacterium
IFALLAIPFFILGGEIMA

SEQ ID NO: 341922 - protein, 18 aa, Mycobacterium
IFDAPRWLSFGLVPAYNV

SEQ ID NO: 341923 - protein, 17 aa, Mycobacterium
IFDRIWLLAAFGWIGWA

SEQ ID NO: 341924 - protein, 20 aa, Mycobacterium
IFERFGKFWGAFSVGDLLIL

SEQ ID NO: 341925 - protein, 17 aa, Mycobacterium
IFLMLSVAGLAAYAMAP

SEQ ID NO: 341926 - protein, 20 aa, Mycobacterium
IFQPFFDYFFGFRAYGAPGQ

SEQ ID NO: 341927 - protein, 21 aa, Mycobacterium
IFRKRFWRFWLGAPIADMLFM

SEQ ID NO: 341928 - protein, 20 aa, Mycobacterium
IGAFSWPWIFLVNLPIGLIA

SEQ ID NO: 341929 - protein, 20 aa, Mycobacterium
IGALCPYCMVVWSVTIPLLV

SEQ ID NO: 341930 - protein, 18 aa, Mycobacterium
IGALWAWIAPPIRAVVAL

SEQ ID NO: 341931 - protein, 18 aa, Mycobacterium
IGAYGWKWIFLINLPIGL

SEQ ID NO: 341932 - protein, 17 aa, Mycobacterium
IGDLIPVLYPPKNPDRW

SEQ ID NO: 341933 - protein, 25 aa, Mycobacterium
IGFAVIVFIIMKWVAPLVKSMMQKQ

SEQ ID NO: 341934 - protein, 22 aa, Mycobacterium
IGFEMFRILPAAVIVIGLLAFL

SEQ ID NO: 341935 - protein, 22 aa, Mycobacterium
IGFEMFRILPAAVIVIGLLALL

SEQ ID NO: 341936 - protein, 27 aa, Mycobacterium
IGFILGWPWWWISACSVLVLLVLEGVA

SEQ ID NO: 341937 - protein, 22 aa, Mycobacterium
IGFSVWMLWSIVVVHMTAVGGH

SEQ ID NO: 341938 - protein, 18 aa, Mycobacterium
IGGGCLWQPQPLVGLMSC

SEQ ID NO: 341939 - protein, 27 aa, Mycobacterium
IGGMLVDWASWRWVFLVNIPLGVVAVL

SEQ ID NO: 341940 - protein, 25 aa, Mycobacterium
IGHRNRLAAMFAWGISFLGRTRGQM

SEQ ID NO: 341941 - protein, 24 aa, Mycobacterium
IGIAPEFADKVFVIFQRLHGRDAY

SEQ ID NO: 341942 - protein, 20 aa, Mycobacterium
IGIGGEWGGAVLMVVEQDGA

SEQ ID NO: 341943 - protein, 21 aa, Mycobacterium
IGIGWAALWYLKYREPRESNA

SEQ ID NO: 341944 - protein, 20 aa, Mycobacterium
IGIWCVLDPPSFARAVGFGE

SEQ ID NO: 341945 - protein, 20 aa, Mycobacterium
IGLFDTWPGLIIPYITFALP

SEQ ID NO: 341946 - protein, 21 aa, Mycobacterium
IGLFYRYAWQNPIFADIVATR

SEQ ID NO: 341947 - protein, 17 aa, Mycobacterium
IGLPLHWLVLPLAFIIL

SEQ ID NO: 341948 - protein, 18 aa, Mycobacterium
IGMAWPHLSVRAMASVDD

SEQ ID NO: 341949 - protein, 17 aa, Mycobacterium
IGPASAIALMLQNLGGP

SEQ ID NO: 341950 - protein, 23 aa, Mycobacterium
IGPDFGKAGPFGLTVVVLLMVGT

SEQ ID NO: 341951 - protein, 18 aa, Mycobacterium
IGPEARRVLVAAPFGGEG

SEQ ID NO: 341952 - protein, 22 aa, Mycobacterium
IGPKSIRVWLMLGVLLLSVVLA

SEQ ID NO: 341953 - protein, 24 aa, Mycobacterium
IGPRLVDTYINWLWFGELGFRGVF

SEQ ID NO: 341954 - protein, 20 aa, Mycobacterium
IGPWLPFVHMYRFLDVDWLF

SEQ ID NO: 341955 - protein, 18 aa, Mycobacterium
IGQCKHWVPTIAQANKWI

SEQ ID NO: 341956 - protein, 17 aa, Mycobacterium
IGRHRVLVVTILMMTVS

SEQ ID NO: 341957 - protein, 18 aa, Mycobacterium
IGRHRVLVVTILMMTVST

SEQ ID NO: 341958 - protein, 20 aa, Mycobacterium
IGRIKDLLIVYGRNHSPDDI

SEQ ID NO: 341959 - protein, 17 aa, Mycobacterium
IGRRPVFLTMALFTILY

SEQ ID NO: 341960 - protein, 17 aa, Mycobacterium
IGSWIVATVVVWVATAV

SEQ ID NO: 341961 - protein, 21 aa, Mycobacterium
IGSWLAVLVILNLGIPQLETT

SEQ ID NO: 341962 - protein, 21 aa, Mycobacterium
IGTAVVRWPAPILVASLAVAL

SEQ ID NO: 341963 - protein, 25 aa, Mycobacterium
IGTLRWPRRRALLAFLGVFVVAHIV

SEQ ID NO: 341964 - protein, 19 aa, Mycobacterium
IGTLTLWVGFMAVMFSIYL

SEQ ID NO: 341965 - protein, 17 aa, Mycobacterium
IGVAGGWVGRTTAEVVS

SEQ ID NO: 341966 - protein, 20 aa, Mycobacterium
IGVALGWGWADAVAGIVVTG

SEQ ID NO: 341967 - protein, 19 aa, Mycobacterium
IGVFLAWRAIPALARNKEN

SEQ ID NO: 341968 - protein, 19 aa, Mycobacterium
IGVILDWPLWWVSACSVLA

SEQ ID NO: 341969 - protein, 19 aa, Mycobacterium
IGVKLCGALETAHRAGTLH

SEQ ID NO: 341970 - protein, 20 aa, Mycobacterium
IGWASGLGFGWLFTLGTANV

SEQ ID NO: 341971 - protein, 21 aa, Mycobacterium
IGWPEAVFRFVLYAFLCATAL

SEQ ID NO: 341972 - protein, 23 aa, Mycobacterium
IGWRSRRWRLLWVPVSVAFGALG

SEQ ID NO: 341973 - protein, 22 aa, Mycobacterium
IGYGLGVFAVWLVRYMGAKDHS

SEQ ID NO: 341974 - protein, 23 aa, Mycobacterium
IGYGLGVFAVWLVRYMRSQDDSP

SEQ ID NO: 341975 - protein, 24 aa, Mycobacterium
IHAFAVPIILGWIAICVALSVFIP

SEQ ID NO: 341976 - protein, 20 aa, Mycobacterium
IHALYRWFPPITVWTGLSLL

SEQ ID NO: 341977 - protein, 17 aa, Mycobacterium
IHLLVSMGMVWLATLLY

SEQ ID NO: 341978 - protein, 22 aa, Mycobacterium
IHPGLGFFAGWAMLLDYLLIPT

SEQ ID NO: 341979 - protein, 18 aa, Mycobacterium
IHRLAVPIVLLWIGLVVV

SEQ ID NO: 341980 - protein, 18 aa, Mycobacterium
IHWPESWPLVSLSPTVEP

SEQ ID NO: 341981 - protein, 19 aa, Mycobacterium
IIAFFLVWWTYDTYRPAPA

SEQ ID NO: 341982 - protein, 25 aa, Mycobacterium
IIAIQWRARPWLKRVLPVALIAAAA

SEQ ID NO: 341983 - protein, 17 aa, Mycobacterium
IIDATSWQTGQLDEAIA

SEQ ID NO: 341984 - protein, 23 aa, Mycobacterium
IIELRTALFDAFQPVGPDGQPSE

SEQ ID NO: 341985 - protein, 18 aa, Mycobacterium
IIFGLSFRDALLATLAGL

SEQ ID NO: 341986 - protein, 17 aa, Mycobacterium
IIGCVYVPYMARPIRGE

SEQ ID NO: 341987 - protein, 23 aa, Mycobacterium
IIGRSGGIYGDFFNFYACDVTLK

SEQ ID NO: 341988 - protein, 17 aa, Mycobacterium
IIGWALACSVPVVLVGA

SEQ ID NO: 341989 - protein, 21 aa, Mycobacterium
IIIACAICITIIMSLTYRSLF

SEQ ID NO: 341990 - protein, 19 aa, Mycobacterium
IIIPLPWLLQAPRLFAGQI

SEQ ID NO: 341991 - protein, 17 aa, Mycobacterium
IIIVIVALVAQWARQDR

SEQ ID NO: 341992 - protein, 19 aa, Mycobacterium
IIIWRCWRVLGFSANAPLA

SEQ ID NO: 341993 - protein, 18 aa, Mycobacterium
IIKPAVVVALLFRTLDAF

SEQ ID NO: 341994 - protein, 21 aa, Mycobacterium
IILYCVVRFALGMHAAHPVAM

SEQ ID NO: 341995 - protein, 18 aa, Mycobacterium
IIPNLTLIVVLGFGAYAA

SEQ ID NO: 341996 - protein, 18 aa, Mycobacterium
IIQFLGTFGFFYVGLQYI

SEQ ID NO: 341997 - protein, 25 aa, Mycobacterium
IIRTFAVPIILVWIALIAVLNTVVP

SEQ ID NO: 341998 - protein, 19 aa, Mycobacterium
IISGLCLLAVVLLVGVAGM

SEQ ID NO: 341999 - protein, 19 aa, Mycobacterium
IISHLPVLLGLIFALLVLR

SEQ ID NO: 342000 - protein, 18 aa, Mycobacterium
IIYCAAATLIHCYYGYFA

SEQ ID NO: 342001 - protein, 21 aa, Mycobacterium
IIYLRRIASWFAEHWPGEEMP

SEQ ID NO: 342002 - protein, 20 aa, Mycobacterium
IKAKAAFVWDKFPKFVLGFL

SEQ ID NO: 342003 - protein, 21 aa, Mycobacterium
IKANLFWAFGYNIAAIPLAAL

SEQ ID NO: 342004 - protein, 20 aa, Mycobacterium
IKAPLKLLGTFLASIPSEVF

SEQ ID NO: 342005 - protein, 20 aa, Mycobacterium
IKAPLKVLGTFLAAIPSEVF

SEQ ID NO: 342006 - protein, 24 aa, Mycobacterium
IKDLELLPTFPFHYKYLRNAVRGD

SEQ ID NO: 342007 - protein, 21 aa, Mycobacterium
IKFVFRRPFQWREFLEQSWFV

SEQ ID NO: 342008 - protein, 25 aa, Mycobacterium
IKFVKFQLTTAWGFVLIFLVCGSLG

SEQ ID NO: 342009 - protein, 21 aa, Mycobacterium
IKGNLFWAFAYNVAALPLAAA

SEQ ID NO: 342010 - protein, 21 aa, Mycobacterium
IKGNLFWAFAYNVAALPLAVA

SEQ ID NO: 342011 - protein, 28 aa, Mycobacterium
IKIRGWRRIGTVVVRWPGPVLAATIAIA

SEQ ID NO: 342012 - protein, 17 aa, Mycobacterium
IKLAASYFLATPLIVLT

SEQ ID NO: 342013 - protein, 17 aa, Mycobacterium
IKLSIFAAVSGIAAAVT

SEQ ID NO: 342014 - protein, 19 aa, Mycobacterium
IKLSMWWPDSAWIVMGIYT

SEQ ID NO: 342015 - protein, 17 aa, Mycobacterium
IKNVIGAVWGWLSTTVF

SEQ ID NO: 342016 - protein, 17 aa, Mycobacterium
IKPAVVVALLFRTLDAF

SEQ ID NO: 342017 - protein, 24 aa, Mycobacterium
IKRFPRLRAALLYYASRPTPASIT

SEQ ID NO: 342018 - protein, 20 aa, Mycobacterium
IKRRKMIGLSLGIGFGAFGL

SEQ ID NO: 342019 - protein, 20 aa, Mycobacterium
IKTNLFWAFGYNVAALPLAA

SEQ ID NO: 342020 - protein, 18 aa, Mycobacterium
IKVPREFINSYLFNFPDT

SEQ ID NO: 342021 - protein, 17 aa, Mycobacterium
IKYKVGPTIAWYQDFLR

SEQ ID NO: 342022 - protein, 17 aa, Mycobacterium
IKYKVGPTIAWYQDWLR

SEQ ID NO: 342023 - protein, 19 aa, Mycobacterium
IKYLWPVRRMRAAEVGTWS

SEQ ID NO: 342024 - protein, 21 aa, Mycobacterium
IKYTWPVKRMRAADVRTSVLV

SEQ ID NO: 342025 - protein, 19 aa, Mycobacterium
ILAAFPILIPILIGLMALA

SEQ ID NO: 342026 - protein, 21 aa, Mycobacterium
ILAELRLHFPALRDGVSARQA

SEQ ID NO: 342027 - protein, 20 aa, Mycobacterium
ILALRFHRATAWALLALFVV

SEQ ID NO: 342028 - protein, 17 aa, Mycobacterium
ILAVPALAIFTLMMAFY

SEQ ID NO: 342029 - protein, 18 aa, Mycobacterium
ILAWIWRLGGPRGAFLGG

SEQ ID NO: 342030 - protein, 18 aa, Mycobacterium
ILAYWVWNYGYRQGTTGS

SEQ ID NO: 342031 - protein, 19 aa, Mycobacterium
ILELATPYALDAVSQEERS

SEQ ID NO: 342032 - protein, 22 aa, Mycobacterium
ILGDLPWWVTVVILVREVAVTV

SEQ ID NO: 342033 - protein, 20 aa, Mycobacterium
ILGMFWRRMTATAGWAGLVS

SEQ ID NO: 342034 - protein, 20 aa, Mycobacterium
ILGMFWRRMTSTAGWTGLVA

SEQ ID NO: 342035 - protein, 25 aa, Mycobacterium
ILGRSRIHGIKNWKTAILAATLVLF

SEQ ID NO: 342036 - protein, 17 aa, Mycobacterium
ILLAWSVVLLLLMRWVS

SEQ ID NO: 342037 - protein, 17 aa, Mycobacterium
ILLCAGGYVVFFHGPRL

SEQ ID NO: 342038 - protein, 18 aa, Mycobacterium
ILLCLAFSALGKGITLLR

SEQ ID NO: 342039 - protein, 18 aa, Mycobacterium
ILLLCLFGTLAVLLRRGV

SEQ ID NO: 342040 - protein, 18 aa, Mycobacterium
ILLNLGAFAWQWDPYPFI

SEQ ID NO: 342041 - protein, 18 aa, Mycobacterium
ILLPHARPAVMVLAVLTW

SEQ ID NO: 342042 - protein, 18 aa, Mycobacterium
ILLPHARPAVMVLGVLTW

SEQ ID NO: 342043 - protein, 19 aa, Mycobacterium
ILLRIDWPDFVPLITSESS

SEQ ID NO: 342044 - protein, 24 aa, Mycobacterium
ILLVKRIWWPLALWLLLIVVNVDA

SEQ ID NO: 342045 - protein, 22 aa, Mycobacterium
ILMRQGYRWTRTVLTGGAIAAV

SEQ ID NO: 342046 - protein, 17 aa, Mycobacterium
ILPFVGRIAGVIVLITG

SEQ ID NO: 342047 - protein, 17 aa, Mycobacterium
ILPPAWLAGTAMLGLSK

SEQ ID NO: 342048 - protein, 17 aa, Mycobacterium
ILPPRLFRDPVFTICCV

SEQ ID NO: 342049 - protein, 18 aa, Mycobacterium
ILPVLPVVFFSGAHGGAT

SEQ ID NO: 342050 - protein, 18 aa, Mycobacterium
ILRILVRRHRLVGTWPLV

SEQ ID NO: 342051 - protein, 18 aa, Mycobacterium
ILSLRLIPAVPFSAINYA

SEQ ID NO: 342052 - protein, 24 aa, Mycobacterium
ILTFFFCWNDFLFAISLTSTDSAR

SEQ ID NO: 342053 - protein, 18 aa, Mycobacterium
ILVAWRWAPARVAGIPGP

SEQ ID NO: 342054 - protein, 19 aa, Mycobacterium
ILVAWRWVPAKVRRVPGPL

SEQ ID NO: 342055 - protein, 19 aa, Mycobacterium
ILVCLGIWLLAGRRLGVLM

SEQ ID NO: 342056 - protein, 26 aa, Mycobacterium
ILVDRRFKIGHGRLFALYVAGYCAGR

SEQ ID NO: 342057 - protein, 18 aa, Mycobacterium
ILVGYGFDGIWIGVLIVK

SEQ ID NO: 342058 - protein, 31 aa, Mycobacterium
ILVLIGRRGWIKPRRDLTHRFWRILGTRIVR

SEQ ID NO: 342059 - protein, 18 aa, Mycobacterium
ILVRVEWSQFISLITSES

SEQ ID NO: 342060 - protein, 18 aa, Mycobacterium
IMAMPLVSLLLVALVLAL

SEQ ID NO: 342061 - protein, 20 aa, Mycobacterium
IMGLLGRWFWWSPPPFLRAS

SEQ ID NO: 342062 - protein, 19 aa, Mycobacterium
IMVAWRWVPAKARRVPGPL

SEQ ID NO: 342063 - protein, 17 aa, Mycobacterium
IMVVGALHFKESRGRGN

SEQ ID NO: 342064 - protein, 19 aa, Mycobacterium
IMWVWYKLFALIFGPSNFF

SEQ ID NO: 342065 - protein, 23 aa, Mycobacterium
INAPRAKLFAALFLILGLVVVGE

SEQ ID NO: 342066 - protein, 18 aa, Mycobacterium
INARPGIVLVVPADTPHN

SEQ ID NO: 342067 - protein, 19 aa, Mycobacterium
INARPGLLLVVPGDGPDTV

SEQ ID NO: 342068 - protein, 17 aa, Mycobacterium
INARPGVLLVLAGDAPA

SEQ ID NO: 342069 - protein, 17 aa, Mycobacterium
INAVFGIITVHTQYQYL

SEQ ID NO: 342070 - protein, 19 aa, Mycobacterium
INERFGRGWGWFSVGDLFI

SEQ ID NO: 342071 - protein, 17 aa, Mycobacterium
INGRLFVDMRLIEGRDL

SEQ ID NO: 342072 - protein, 19 aa, Mycobacterium
INGVREFPGPLALVPVVAT

SEQ ID NO: 342073 - protein, 20 aa, Mycobacterium
INLRCVCLAPLNAHHDTLAM

SEQ ID NO: 342074 - protein, 22 aa, Mycobacterium
INNEFYYWVSIALMFLIHAGFL

SEQ ID NO: 342075 - protein, 26 aa, Mycobacterium
INPEEFWRNAGLPAFRFPDPNGVGFE

SEQ ID NO: 342076 - protein, 17 aa, Mycobacterium
INVRLAIEWLDKYSDGL

SEQ ID NO: 342077 - protein, 18 aa, Mycobacterium
IPAIPAWVFILIAIAIVT

SEQ ID NO: 342078 - protein, 25 aa, Mycobacterium
IPALFALIGDRIWWPTAPQHAKAVA

SEQ ID NO: 342079 - protein, 23 aa, Mycobacterium
IPALFALIGDRIWWPTSPANAEP

SEQ ID NO: 342080 - protein, 22 aa, Mycobacterium
IPALFTLIGDRIWWPSDPKTTA

SEQ ID NO: 342081 - protein, 26 aa, Mycobacterium
IPALFTLIGDRIWWPTFPNIARYQPD

SEQ ID NO: 342082 - protein, 25 aa, Mycobacterium
IPALVLCVIWLRFLGGESWRSTAIV

SEQ ID NO: 342083 - protein, 21 aa, Mycobacterium
IPARVSLAVLFVWGFGMALWT

SEQ ID NO: 342084 - protein, 18 aa, Mycobacterium
IPCAVGMLVAVAAALTLG

SEQ ID NO: 342085 - protein, 17 aa, Mycobacterium
IPFLLGGVFGLVAIYMR

SEQ ID NO: 342086 - protein, 17 aa, Mycobacterium
IPFQFFLEAGWIFIVGL

SEQ ID NO: 342087 - protein, 18 aa, Mycobacterium
IPGAPWWGAVLIAVSTTA

SEQ ID NO: 342088 - protein, 22 aa, Mycobacterium
IPGDSLVAWWVRLIVPALAVVL

SEQ ID NO: 342089 - protein, 17 aa, Mycobacterium
IPGSRPALFTVLIAVTA

SEQ ID NO: 342090 - protein, 17 aa, Mycobacterium
IPIALALALAAVFEAFY

SEQ ID NO: 342091 - protein, 22 aa, Mycobacterium
IPLCVLCAGMALNGWVGYFPTA

SEQ ID NO: 342092 - protein, 17 aa, Mycobacterium
IPLFLAMRIPLRAFLIR

SEQ ID NO: 342093 - protein, 25 aa, Mycobacterium
IPLITARLSQRFGVPVRSAAQPASL

SEQ ID NO: 342094 - protein, 18 aa, Mycobacterium
IPLNRAVVMLVIDVSESM

SEQ ID NO: 342095 - protein, 24 aa, Mycobacterium
IPLPGSAPRAVWVSAFAHPERDKR

SEQ ID NO: 342096 - protein, 22 aa, Mycobacterium
IPLPGSAPRSEWLRAVAHPERD

SEQ ID NO: 342097 - protein, 25 aa, Mycobacterium
IPLPGSVARPVWRDAFAHPENDRRV

SEQ ID NO: 342098 - protein, 20 aa, Mycobacterium
IPLTALWLAQSWHRRILDEE

SEQ ID NO: 342099 - protein, 17 aa, Mycobacterium
IPLWLGYAFSTLLIFPL

SEQ ID NO: 342100 - protein, 18 aa, Mycobacterium
IPMCWAMRSLNESVDNID

SEQ ID NO: 342101 - protein, 19 aa, Mycobacterium
IPMLAAWLVVRRARGASPL

SEQ ID NO: 342102 - protein, 19 aa, Mycobacterium
IPMYLGYAFRAMNTHGRAL

SEQ ID NO: 342103 - protein, 17 aa, Mycobacterium
IPPSLLRRAMPYLMGIL

SEQ ID NO: 342104 - protein, 24 aa, Mycobacterium
IPPTLRMLFVFGVLTLLAMAGSLT

SEQ ID NO: 342105 - protein, 17 aa, Mycobacterium
IPRNRAVVMLVIDVSQS

SEQ ID NO: 342106 - protein, 20 aa, Mycobacterium
IPRNRAVVVLVIDMSQSMRA

SEQ ID NO: 342107 - protein, 22 aa, Mycobacterium
IPRPWRPVWIGWWLGVAASVAA

SEQ ID NO: 342108 - protein, 17 aa, Mycobacterium
IPRRWVGRSIRFRHNTL

SEQ ID NO: 342109 - protein, 21 aa, Mycobacterium
IPRVYWKLARSVRAGRWQTLT

SEQ ID NO: 342110 - protein, 20 aa, Mycobacterium
IPSVPRWVWLLVVAGSLFTI

SEQ ID NO: 342111 - protein, 19 aa, Mycobacterium
IPTDIRTATNFDQASGADK

SEQ ID NO: 342112 - protein, 17 aa, Mycobacterium
IPTGFPWQAPVLTAGTQ

SEQ ID NO: 342113 - protein, 18 aa, Mycobacterium
IPTRITIVDAIPRTPSGK

SEQ ID NO: 342114 - protein, 19 aa, Mycobacterium
IPVAKWLGAPLARGGSTTT

SEQ ID NO: 342115 - protein, 17 aa, Mycobacterium
IPVCIGLRSLFDTFDGF

SEQ ID NO: 342116 - protein, 17 aa, Mycobacterium
IPVCWTMRSVFDTLDGI

SEQ ID NO: 342117 - protein, 19 aa, Mycobacterium
IPVIGHWDALGFLQDFFAT

SEQ ID NO: 342118 - protein, 18 aa, Mycobacterium
IPVLRWSWTPVLLASSLI

SEQ ID NO: 342119 - protein, 18 aa, Mycobacterium
IPVPLARAIVDCGVYVDG

SEQ ID NO: 342120 - protein, 17 aa, Mycobacterium
IPWYRLPAVIIVSTVVA

SEQ ID NO: 342121 - protein, 23 aa, Mycobacterium
IPWYRLPGVIIVATVVAVLLVGA

SEQ ID NO: 342122 - protein, 24 aa, Mycobacterium
IQAAQLSAVWARFPLPVIPAPGDP

SEQ ID NO: 342123 - protein, 17 aa, Mycobacterium
IQARRGVTVFGEEPATK

SEQ ID NO: 342124 - protein, 17 aa, Mycobacterium
IQFWSMLITFVLLLTVF

SEQ ID NO: 342125 - protein, 18 aa, Mycobacterium
IQLLIGFMCVALIVYFVM

SEQ ID NO: 342126 - protein, 18 aa, Mycobacterium
IRAAALAGVLLLAGLIVG

SEQ ID NO: 342127 - protein, 18 aa, Mycobacterium
IRAFSVPIVLFWLAVCVV

SEQ ID NO: 342128 - protein, 21 aa, Mycobacterium
IRAGLAIPRPLPVLIAEAGTT

SEQ ID NO: 342129 - protein, 17 aa, Mycobacterium
IRAKRTLDALAIVGQAK

SEQ ID NO: 342130 - protein, 27 aa, Mycobacterium
IRAWRRIGTMVVRWPGPILVASLALAL

SEQ ID NO: 342131 - protein, 17 aa, Mycobacterium
IREADMAATLWHPHIVG

SEQ ID NO: 342132 - protein, 21 aa, Mycobacterium
IREFKRLGLTPVLLTGDNPTV

SEQ ID NO: 342133 - protein, 20 aa, Mycobacterium
IREGHRWARNALLISGTVSF

SEQ ID NO: 342134 - protein, 18 aa, Mycobacterium
IREYDLKLILAFGTVSQL

SEQ ID NO: 342135 - protein, 20 aa, Mycobacterium
IRGREWIRLPAIFGAGMVVR

SEQ ID NO: 342136 - protein, 25 aa, Mycobacterium
IRHQRRWNLDLGFRAGGPDEGVRAA

SEQ ID NO: 342137 - protein, 19 aa, Mycobacterium
IRIADVWKITRKVGVQESY

SEQ ID NO: 342138 - protein, 18 aa, Mycobacterium
IRIADVWNMTRKVGVEEG

SEQ ID NO: 342139 - protein, 24 aa, Mycobacterium
IRIFAVPIILAWVVLTVIVNVAVP

SEQ ID NO: 342140 - protein, 18 aa, Mycobacterium
IRIFAVPIILIWVAVTVL

SEQ ID NO: 342141 - protein, 20 aa, Mycobacterium
IRIGFCLLLILLGGAALTNG

SEQ ID NO: 342142 - protein, 24 aa, Mycobacterium
IRILAVPIILGWVLLTVLVNVVVP

SEQ ID NO: 342143 - protein, 20 aa, Mycobacterium
IRLGHMLVFFFRALAGVPIA

SEQ ID NO: 342144 - protein, 21 aa, Mycobacterium
IRLGLWAGIAIFVADLVVTVS

SEQ ID NO: 342145 - protein, 17 aa, Mycobacterium
IRLGWPLWAAYITVFAL

SEQ ID NO: 342146 - protein, 22 aa, Mycobacterium
IRLLSVPIIVFWLALAAVTNTV

SEQ ID NO: 342147 - protein, 17 aa, Mycobacterium
IRLSQWFLLTAAFGSLF

SEQ ID NO: 342148 - protein, 27 aa, Mycobacterium
IRMLLVPSFMRLLGRFNWWAPKPLVTL

SEQ ID NO: 342149 - protein, 22 aa, Mycobacterium
IRNWPAWLAIYGFMTLDRWLLF

SEQ ID NO: 342150 - protein, 22 aa, Mycobacterium
IRNWPAWLGIYGFMTLDDWLIY

SEQ ID NO: 342151 - protein, 22 aa, Mycobacterium
IRNWPAWLGIYGFMTLDRWLLF

SEQ ID NO: 342152 - protein, 18 aa, Mycobacterium
IRPGKILAGIAGFCAAVA

SEQ ID NO: 342153 - protein, 19 aa, Mycobacterium
IRPLMPPFVARVIDNTTQP

SEQ ID NO: 342154 - protein, 21 aa, Mycobacterium
IRPNPGIGHPCWADYLPVTRA

SEQ ID NO: 342155 - protein, 20 aa, Mycobacterium
IRPNPGIGHPCYADYLPVTR

SEQ ID NO: 342156 - protein, 19 aa, Mycobacterium
IRPSFPMLAANLANFGRIG

SEQ ID NO: 342157 - protein, 17 aa, Mycobacterium
IRQTVQFERAIRTAFNS

SEQ ID NO: 342158 - protein, 22 aa, Mycobacterium
IRRLALPILLFWVGLAALTNIA

SEQ ID NO: 342159 - protein, 23 aa, Mycobacterium
IRRLSIPIVIGWIALSAYLTVGL

SEQ ID NO: 342160 - protein, 18 aa, Mycobacterium
IRRVDPWSTLKVSLLLSV

SEQ ID NO: 342161 - protein, 22 aa, Mycobacterium
IRTANYFFCWAAIYQLGIAWHD

SEQ ID NO: 342162 - protein, 17 aa, Mycobacterium
IRTSRAFLWTFASLIVV

SEQ ID NO: 342163 - protein, 29 aa, Mycobacterium
IRTWRRIGAAITRWPGPILAASMAIAIIG

SEQ ID NO: 342164 - protein, 24 aa, Mycobacterium
IRVLAVPIILVWVAIIAVLNTVVP

SEQ ID NO: 342165 - protein, 23 aa, Mycobacterium
IRVLAVPIVLGWVLLTVLTNVAV

SEQ ID NO: 342166 - protein, 17 aa, Mycobacterium
IRVRARRSPTMTAPIWI

SEQ ID NO: 342167 - protein, 17 aa, Mycobacterium
IRYSMIVFNWFGVCLVP

SEQ ID NO: 342168 - protein, 23 aa, Mycobacterium
ISADRPRRIWGIYAGVIGVPLSA

SEQ ID NO: 342169 - protein, 18 aa, Mycobacterium
ISAMLIYRAVSWVFISAI

SEQ ID NO: 342170 - protein, 22 aa, Mycobacterium
ISASLWRMMAGYGVAIAVSTLL

SEQ ID NO: 342171 - protein, 18 aa, Mycobacterium
ISDRGYFIFLALLPFIMG

SEQ ID NO: 342172 - protein, 18 aa, Mycobacterium
ISEDCPPVPFAVNYYIYP

SEQ ID NO: 342173 - protein, 20 aa, Mycobacterium
ISFEVGHHRGIIGLLPQTGF

SEQ ID NO: 342174 - protein, 17 aa, Mycobacterium
ISFLPAMRYYAGNWASS

SEQ ID NO: 342175 - protein, 24 aa, Mycobacterium
ISGRWPRRRALVLFLSVFIAAHIV

SEQ ID NO: 342176 - protein, 21 aa, Mycobacterium
ISGWRSGALGSMLSFAGVLLG

SEQ ID NO: 342177 - protein, 24 aa, Mycobacterium
ISHQRWLRWPARVYTDIFRGLPEV

SEQ ID NO: 342178 - protein, 24 aa, Mycobacterium
ISLPGSRTEFYWVFTGIAMVLMFY

SEQ ID NO: 342179 - protein, 20 aa, Mycobacterium
ISMGIALRMFLSFMGSALWR

SEQ ID NO: 342180 - protein, 30 aa, Mycobacterium
ISMWGWRRGQRWVWWCLLLGCACATVPVVV

SEQ ID NO: 342181 - protein, 23 aa, Mycobacterium
ISNLLLTLLFEWGVAIHDMDIEA

SEQ ID NO: 342182 - protein, 20 aa, Mycobacterium
ISPLWFAIRAYRQMKTQDGT

SEQ ID NO: 342183 - protein, 25 aa, Mycobacterium
ISPRRLGWEVAWKPVLVLVVLMYAI

SEQ ID NO: 342184 - protein, 23 aa, Mycobacterium
ISQSRWLRWPARVYTDVFRGLPE

SEQ ID NO: 342185 - protein, 18 aa, Mycobacterium
ISSFGHWIRRCLSRWRSI

SEQ ID NO: 342186 - protein, 18 aa, Mycobacterium
ISSVNGWAAIAPPAGWTP

SEQ ID NO: 342187 - protein, 24 aa, Mycobacterium
ISVAGVPWPAYKLIALAVGAVVLL

SEQ ID NO: 342188 - protein, 20 aa, Mycobacterium
ISVDGARIGPNVTIRQAGGA

SEQ ID NO: 342189 - protein, 21 aa, Mycobacterium
ISVIWRLRLALAMSIASAIVF

SEQ ID NO: 342190 - protein, 17 aa, Mycobacterium
ISVTAAPGWTLVNRGPN

SEQ ID NO: 342191 - protein, 17 aa, Mycobacterium
ITARLPLVLGLIAAITF

SEQ ID NO: 342192 - protein, 23 aa, Mycobacterium
ITDPEFGKDLGFYAFDLPFYRLV

SEQ ID NO: 342193 - protein, 21 aa, Mycobacterium
ITEYAGWRWLFLINVPICAFA

SEQ ID NO: 342194 - protein, 18 aa, Mycobacterium
ITIALARLSPSRPAVDDE

SEQ ID NO: 342195 - protein, 18 aa, Mycobacterium
ITIPMLRPTTFFVLVTGI

SEQ ID NO: 342196 - protein, 17 aa, Mycobacterium
ITLPMLRPTTFFVLVTG

SEQ ID NO: 342197 - protein, 18 aa, Mycobacterium
ITLPMLRPTTFFVLVTGI

SEQ ID NO: 342198 - protein, 23 aa, Mycobacterium
ITRLRLHPFLALLLGSGTLAAAA

SEQ ID NO: 342199 - protein, 19 aa, Mycobacterium
ITRLVAWGALAVYLLWRSG

SEQ ID NO: 342200 - protein, 17 aa, Mycobacterium
ITRPRWVALEKSISEIV

SEQ ID NO: 342201 - protein, 18 aa, Mycobacterium
ITRREWLSAVLLAAALAT

SEQ ID NO: 342202 - protein, 17 aa, Mycobacterium
ITSRLPLVLAVIAAITF

SEQ ID NO: 342203 - protein, 20 aa, Mycobacterium
ITTRLSEHFRAPVVTSPRPQ

SEQ ID NO: 342204 - protein, 20 aa, Mycobacterium
ITVRYEWSMALAALATLVFD

SEQ ID NO: 342205 - protein, 18 aa, Mycobacterium
ITYRVIAFIKHREPTYQS

SEQ ID NO: 342206 - protein, 18 aa, Mycobacterium
IVAALLIALRPWWPRVSA

SEQ ID NO: 342207 - protein, 18 aa, Mycobacterium
IVAAPSFRAARAGDGVKL

SEQ ID NO: 342208 - protein, 19 aa, Mycobacterium
IVAVARWRGLLALVGILVA

SEQ ID NO: 342209 - protein, 20 aa, Mycobacterium
IVAVARWRGLLALVGIVVAF

SEQ ID NO: 342210 - protein, 18 aa, Mycobacterium
IVAVAVSLLAILLIRQLR

SEQ ID NO: 342211 - protein, 17 aa, Mycobacterium
IVAVPGWAYLALPVVAT

SEQ ID NO: 342212 - protein, 23 aa, Mycobacterium
IVCAAVLFSARWIGPRAAAALAG

SEQ ID NO: 342213 - protein, 23 aa, Mycobacterium
IVCGAVLFSARWVGPRAAVALAG

SEQ ID NO: 342214 - protein, 18 aa, Mycobacterium
IVEAFGWGLGTLAASDAA

SEQ ID NO: 342215 - protein, 18 aa, Mycobacterium
IVFGFTWWLGGRLGLEDK

SEQ ID NO: 342216 - protein, 23 aa, Mycobacterium
IVGAFALRRVWWLYKLIMSGQPA

SEQ ID NO: 342217 - protein, 17 aa, Mycobacterium
IVHLRLSLVPVVIGLAI

SEQ ID NO: 342218 - protein, 17 aa, Mycobacterium
IVHSARVPARWAARKDG

SEQ ID NO: 342219 - protein, 23 aa, Mycobacterium
IVIAAPCYPMFGAWSDRVGRSRV

SEQ ID NO: 342220 - protein, 23 aa, Mycobacterium
IVIICVFSMLIAQLMVRPIRRLE

SEQ ID NO: 342221 - protein, 19 aa, Mycobacterium
IVIPCWLLPLLASVPVFSR

SEQ ID NO: 342222 - protein, 21 aa, Mycobacterium
IVLAVLFFWVPGWAVTTELDI

SEQ ID NO: 342223 - protein, 22 aa, Mycobacterium
IVLGLRAAWLAWRDRRTQPAPT

SEQ ID NO: 342224 - protein, 19 aa, Mycobacterium
IVLRLHFYAGLLVGPFLLI

SEQ ID NO: 342225 - protein, 23 aa, Mycobacterium
IVLYEIVDILPFPVGSLVGPAAV

SEQ ID NO: 342226 - protein, 18 aa, Mycobacterium
IVMLLTFYWARVVWQRTI

SEQ ID NO: 342227 - protein, 20 aa, Mycobacterium
IVRLRHWGRWVGAAVIVAAL

SEQ ID NO: 342228 - protein, 21 aa, Mycobacterium
IVRRPRIHLVASLVVLAILAG

SEQ ID NO: 342229 - protein, 25 aa, Mycobacterium
IVSAVVLGFVWLQFRGRLTPTTQLT

SEQ ID NO: 342230 - protein, 19 aa, Mycobacterium
IVTDVLTWIGLRPSVDDSP

SEQ ID NO: 342231 - protein, 18 aa, Mycobacterium
IVTRSGFDDALLLDTRGN

SEQ ID NO: 342232 - protein, 17 aa, Mycobacterium
IVTTRPGVVNTPVITAP

SEQ ID NO: 342233 - protein, 17 aa, Mycobacterium
IVVKVAALLIVFGFAGL

SEQ ID NO: 342234 - protein, 19 aa, Mycobacterium
IVVLCCWAALGTVMVVIAA

SEQ ID NO: 342235 - protein, 18 aa, Mycobacterium
IVWMWDRTETALWVGAAV

SEQ ID NO: 342236 - protein, 17 aa, Mycobacterium
IVYRPSFRMWGAPYTGY

SEQ ID NO: 342237 - protein, 20 aa, Mycobacterium
IWATLGFKWFEELGGREYIA

SEQ ID NO: 342238 - protein, 22 aa, Mycobacterium
IWIGRPIIRLTFRNELTNAAFR

SEQ ID NO: 342239 - protein, 18 aa, Mycobacterium
IWQLCIVVLLLAIWRGRR

SEQ ID NO: 342240 - protein, 18 aa, Mycobacterium
IWRGRRLGPVIAEKLPVI

SEQ ID NO: 342241 - protein, 18 aa, Mycobacterium
IWRLAAFMVVCTLGLAAM

SEQ ID NO: 342242 - protein, 18 aa, Mycobacterium
IWVTRVIAPRARRLFVEQ

SEQ ID NO: 342243 - protein, 19 aa, Mycobacterium
IYFGIPSALGFQMSALTAG

SEQ ID NO: 342244 - protein, 26 aa, Mycobacterium
IYITWRYERYMAISALATMVFDIVVT

SEQ ID NO: 342245 - protein, 27 aa, Mycobacterium
IYLDRRFTIGHGRLFASYVALYCVGRF

SEQ ID NO: 342246 - protein, 25 aa, Mycobacterium
IYLDRRFTIGHGRLFGLYVALYCVG

SEQ ID NO: 342247 - protein, 18 aa, Mycobacterium
IYLRRVVFVGVFFTAHVI

SEQ ID NO: 342248 - protein, 23 aa, Mycobacterium
IYLTNTWLPYLFKVAGFATGSIS

SEQ ID NO: 342249 - protein, 22 aa, Mycobacterium
IYLWHWPIFLALNGERTGWTGF

SEQ ID NO: 342250 - protein, 22 aa, Mycobacterium
IYLWHWPIFLALNGERTGWTGM

SEQ ID NO: 342251 - protein, 22 aa, Mycobacterium
IYPPCPFRWLTGWNCPFCGGLR

SEQ ID NO: 342252 - protein, 18 aa, Mycobacterium
IYRKLARVGSYGAWFPYY

SEQ ID NO: 342253 - protein, 18 aa, Mycobacterium
IYRLISWLLIAAVGWVVF

SEQ ID NO: 342254 - protein, 19 aa, Mycobacterium
IYRLISWLLISAIGWVVFF

SEQ ID NO: 342255 - protein, 18 aa, Mycobacterium
IYYITYRWCIGLQRGDRA

SEQ ID NO: 342256 - protein, 19 aa, Mycobacterium
KAAARWIRPLMPPFVARVI

SEQ ID NO: 342257 - protein, 17 aa, Mycobacterium
KAAARWIRPLVPPFVGR

SEQ ID NO: 342258 - protein, 23 aa, Mycobacterium
KAAEARAGALAWQHHEPELAQYA

SEQ ID NO: 342259 - protein, 19 aa, Mycobacterium
KAAEAWIDYVYDRANYAKL

SEQ ID NO: 342260 - protein, 20 aa, Mycobacterium
KAASLPGGWLTATVLVILLG

SEQ ID NO: 342261 - protein, 19 aa, Mycobacterium
KAETLRLIATMSLGIGALA

SEQ ID NO: 342262 - protein, 18 aa, Mycobacterium
KAGECLNWPAPASTNDVN

SEQ ID NO: 342263 - protein, 26 aa, Mycobacterium
KAIYLRVGLLLALWAAVIASFAALTY

SEQ ID NO: 342264 - protein, 17 aa, Mycobacterium
KALKEFRTALRIDPGNA

SEQ ID NO: 342265 - protein, 21 aa, Mycobacterium
KANKRPGWALLLLALVALVGV

SEQ ID NO: 342266 - protein, 21 aa, Mycobacterium
KAPRARRRRLLAIAMLLLLVP

SEQ ID NO: 342267 - protein, 17 aa, Mycobacterium
KAPRWAWVALVVVGIVG

SEQ ID NO: 342268 - protein, 17 aa, Mycobacterium
KASLDWPLSDDVWSLKP

SEQ ID NO: 342269 - protein, 27 aa, Mycobacterium
KATVWRFFKHPIEVMVFVTFVSVMGLA

SEQ ID NO: 342270 - protein, 23 aa, Mycobacterium
KDAKAIIMSPNLVAARFIQLTPA

SEQ ID NO: 342271 - protein, 17 aa, Mycobacterium
KDIPLVFGYDYQTVERS

SEQ ID NO: 342272 - protein, 17 aa, Mycobacterium
KDNFYWPGLILLVVAAS

SEQ ID NO: 342273 - protein, 24 aa, Mycobacterium
KDPRKYRLIVTITRDGDQLKMSKV

SEQ ID NO: 342274 - protein, 19 aa, Mycobacterium
KDRALEVFEILPPSLQGDL

SEQ ID NO: 342275 - protein, 19 aa, Mycobacterium
KDSFPASFIVKLNNPEQHA

SEQ ID NO: 342276 - protein, 18 aa, Mycobacterium
KEFRCVSVDLIARQPVVH

SEQ ID NO: 342277 - protein, 18 aa, Mycobacterium
KEIIRLIAEISMGAGTLA

SEQ ID NO: 342278 - protein, 19 aa, Mycobacterium
KEIQKLSGLSINRFIAIDF

SEQ ID NO: 342279 - protein, 19 aa, Mycobacterium
KEIQKLSGLSINRFIAVDF

SEQ ID NO: 342280 - protein, 20 aa, Mycobacterium
KELRAVVLPTVLIIQIDGVT

SEQ ID NO: 342281 - protein, 17 aa, Mycobacterium
KEMLRLIAEIGMGTGAM

SEQ ID NO: 342282 - protein, 25 aa, Mycobacterium
KEPAWRRFRVSQVLIGLSAVVAMTA

SEQ ID NO: 342283 - protein, 19 aa, Mycobacterium
KERRFAVGFVVPAAVLFVA

SEQ ID NO: 342284 - protein, 19 aa, Mycobacterium
KERSTHRALLLVTFGGLFI

SEQ ID NO: 342285 - protein, 17 aa, Mycobacterium
KEVLPSWGVPVLIAALI

SEQ ID NO: 342286 - protein, 18 aa, Mycobacterium
KEVLRLIAEIGMGTGAMA

SEQ ID NO: 342287 - protein, 22 aa, Mycobacterium
KFERRPLGVSWLIGVVVIPLLL

SEQ ID NO: 342288 - protein, 19 aa, Mycobacterium
KFIRWPVIIALAVVVGAMY

SEQ ID NO: 342289 - protein, 26 aa, Mycobacterium
KFSISALARRFWIPLLIGAVVFVGAF

SEQ ID NO: 342290 - protein, 20 aa, Mycobacterium
KFVFRRPFQWREFLEQSWFV

SEQ ID NO: 342291 - protein, 19 aa, Mycobacterium
KGADFTAAMAFEIGSTNLV

SEQ ID NO: 342292 - protein, 17 aa, Mycobacterium
KGALIFDVGICLVLIAL

SEQ ID NO: 342293 - protein, 19 aa, Mycobacterium
KGANFTAAMAFEIGSTNLV

SEQ ID NO: 342294 - protein, 21 aa, Mycobacterium
KGDASLAWMLLGAVVMAGAVL

SEQ ID NO: 342295 - protein, 21 aa, Mycobacterium
KGDASLAWMLLGTVAMAGAVL

SEQ ID NO: 342296 - protein, 20 aa, Mycobacterium
KGFWIRRARRLLPALLVMTL

SEQ ID NO: 342297 - protein, 21 aa, Mycobacterium
KGFWIRRARRLLPALVVMVLA

SEQ ID NO: 342298 - protein, 26 aa, Mycobacterium
KGHLKWAWIPGVPLLWDLAVTLTASW

SEQ ID NO: 342299 - protein, 24 aa, Mycobacterium
KGHLKWAWIPGVPLLWDLIVTLTA

SEQ ID NO: 342300 - protein, 21 aa, Mycobacterium
KGIPATILWRLSRALPEDVKA

SEQ ID NO: 342301 - protein, 24 aa, Mycobacterium
KGKAFLVALGLRFGQAGNSGLVQT

SEQ ID NO: 342302 - protein, 19 aa, Mycobacterium
KGKWKGHWMPKGRGFLLNT

SEQ ID NO: 342303 - protein, 21 aa, Mycobacterium
KGLLARFWLVLTIAAVVALSG

SEQ ID NO: 342304 - protein, 20 aa, Mycobacterium
KGLLKWAWIPGLPLLWDLAV

SEQ ID NO: 342305 - protein, 19 aa, Mycobacterium
KGPFRLAMAAGIPIVPIVI

SEQ ID NO: 342306 - protein, 18 aa, Mycobacterium
KGPLVFDLGICLVLITLP

SEQ ID NO: 342307 - protein, 20 aa, Mycobacterium
KGPPPWNLGYKSIRSNNTVL

SEQ ID NO: 342308 - protein, 24 aa, Mycobacterium
KGQLRQGFSYVWRRRDLFMIMLTV

SEQ ID NO: 342309 - protein, 20 aa, Mycobacterium
KGRDYKSLVLIAVIVVAVAL

SEQ ID NO: 342310 - protein, 23 aa, Mycobacterium
KGVLGRFWLVLTIAAVVALSGFV

SEQ ID NO: 342311 - protein, 24 aa, Mycobacterium
KHCFDIPMCWSMRSLFDALDGIDK

SEQ ID NO: 342312 - protein, 22 aa, Mycobacterium
KHCFDIPVCQAFRSIFEVLDKI

SEQ ID NO: 342313 - protein, 24 aa, Mycobacterium
KHCFDVPLCWSIRQIFDMFDSVDQ

SEQ ID NO: 342314 - protein, 23 aa, Mycobacterium
KHCYDIPICWSFRSIFDALDGLD

SEQ ID NO: 342315 - protein, 23 aa, Mycobacterium
KHCYDIPICWSFRSVFDALDGVD

SEQ ID NO: 342316 - protein, 22 aa, Mycobacterium
KHPRGGLSGMLRGGRSRLGFGT

SEQ ID NO: 342317 - protein, 22 aa, Mycobacterium
KHQDFAWAWVCRLLVTMSVLLV

SEQ ID NO: 342318 - protein, 24 aa, Mycobacterium
KHVRKRLRDAFGFPKSVVHAQAYW

SEQ ID NO: 342319 - protein, 20 aa, Mycobacterium
KIALYVLGGWVFGWCTTGIG

SEQ ID NO: 342320 - protein, 19 aa, Mycobacterium
KICSHLGCPTSLFEQQTYR

SEQ ID NO: 342321 - protein, 18 aa, Mycobacterium
KIEAFAMFNIFYQAGILL

SEQ ID NO: 342322 - protein, 21 aa, Mycobacterium
KIGTTIVRWPGPVLAAAMAIA

SEQ ID NO: 342323 - protein, 25 aa, Mycobacterium
KIHAFAVPIVLGWLAICVALTVFVP

SEQ ID NO: 342324 - protein, 24 aa, Mycobacterium
KIPELRPGGFLGVQGFWGMAHDAR

SEQ ID NO: 342325 - protein, 18 aa, Mycobacterium
KIQAFVLLCGIVGPIFLV

SEQ ID NO: 342326 - protein, 17 aa, Mycobacterium
KIRGRLVPLLGLAVLEG

SEQ ID NO: 342327 - protein, 23 aa, Mycobacterium
KISRFQTLLLKWAIMVLLGLFTS

SEQ ID NO: 342328 - protein, 22 aa, Mycobacterium
KIVRRLAVPIVLFWVAIAAVTN

SEQ ID NO: 342329 - protein, 17 aa, Mycobacterium
KKAAAALAWLVEEMEQR

SEQ ID NO: 342330 - protein, 17 aa, Mycobacterium
KKAAAALGWLVEEMEQR

SEQ ID NO: 342331 - protein, 22 aa, Mycobacterium
KKFTWHWWWLAAAIPVLLLVVF

SEQ ID NO: 342332 - protein, 17 aa, Mycobacterium
KKVPGRAGVLCVVSILL

SEQ ID NO: 342333 - protein, 18 aa, Mycobacterium
KLAALWRGTLVVLQSILA

SEQ ID NO: 342334 - protein, 19 aa, Mycobacterium
KLAIIAAGIDFRRRMSDQA

SEQ ID NO: 342335 - protein, 19 aa, Mycobacterium
KLALIAGLVGVLALAGLAG

SEQ ID NO: 342336 - protein, 27 aa, Mycobacterium
KLEPLLRLPLALGLIYLLGRIPLPGSV

SEQ ID NO: 342337 - protein, 20 aa, Mycobacterium
KLGTAIAKWPAAMIAVAALV

SEQ ID NO: 342338 - protein, 22 aa, Mycobacterium
KLHRAVAIKLLYPGVADRPDSR

SEQ ID NO: 342339 - protein, 21 aa, Mycobacterium
KLIRNGFWRVLGIRTLTFLVA

SEQ ID NO: 342340 - protein, 17 aa, Mycobacterium
KLLEVGQTFALSRRETI

SEQ ID NO: 342341 - protein, 19 aa, Mycobacterium
KLLKGHTWVTAFINPIEEL

SEQ ID NO: 342342 - protein, 19 aa, Mycobacterium
KLLKWSIPGLAHFFTMWGF

SEQ ID NO: 342343 - protein, 17 aa, Mycobacterium
KLLQCIVAGPGYANAQP

SEQ ID NO: 342344 - protein, 20 aa, Mycobacterium
KLLRDGRWWLGSGVAAMGFA

SEQ ID NO: 342345 - protein, 19 aa, Mycobacterium
KLNSAFAFGGPKCLVKEIQ

SEQ ID NO: 342346 - protein, 20 aa, Mycobacterium
KLPPTVCRQNPDLPRDQPQL

SEQ ID NO: 342347 - protein, 17 aa, Mycobacterium
KLRIEWRDLPIFGTQSV

SEQ ID NO: 342348 - protein, 17 aa, Mycobacterium
KLRVGFAKAGRLMDLME

SEQ ID NO: 342349 - protein, 24 aa, Mycobacterium
KLSFPISAAPGWSVFGDDQSPNLI

SEQ ID NO: 342350 - protein, 18 aa, Mycobacterium
KLSRLPLGWFTARGSGSI

SEQ ID NO: 342351 - protein, 24 aa, Mycobacterium
KLTGKRVAQAWARRHRTLRAALQQ

SEQ ID NO: 342352 - protein, 18 aa, Mycobacterium
KLYEAQRGLAHQVHHDAL

SEQ ID NO: 342353 - protein, 19 aa, Mycobacterium
KMMRFFPPVVIGTTILLIG

SEQ ID NO: 342354 - protein, 18 aa, Mycobacterium
KMNMPWLFFFSGLAIPTF

SEQ ID NO: 342355 - protein, 17 aa, Mycobacterium
KMSGEWSKDAVLQAYLN

SEQ ID NO: 342356 - protein, 24 aa, Mycobacterium
KMTRPSRPWWRRKAVVITAAALLT

SEQ ID NO: 342357 - protein, 18 aa, Mycobacterium
KMTTEWLHVPLLPIPIPI

SEQ ID NO: 342358 - protein, 18 aa, Mycobacterium
KMTTEWLHVPLLPVPIPI

SEQ ID NO: 342359 - protein, 23 aa, Mycobacterium
KNDLRPGWHPVPGISSGTRESGV

SEQ ID NO: 342360 - protein, 19 aa, Mycobacterium
KNFPLRYLVTNTGWGRGLD

SEQ ID NO: 342361 - protein, 22 aa, Mycobacterium
KNIPLLIAMGVVFFVVYYLMFR

SEQ ID NO: 342362 - protein, 18 aa, Mycobacterium
KNPDRWNILLAPLPGPTP

SEQ ID NO: 342363 - protein, 17 aa, Mycobacterium
KPAPPRDMVPVWVAAGG

SEQ ID NO: 342364 - protein, 23 aa, Mycobacterium
KPARLTLDPGLRFSSLQTVFNRG

SEQ ID NO: 342365 - protein, 19 aa, Mycobacterium
KPGATVAFLIPRSGEAILS

SEQ ID NO: 342366 - protein, 18 aa, Mycobacterium
KPGPDWEPLGMLVAGAVL

SEQ ID NO: 342367 - protein, 20 aa, Mycobacterium
KPGRYLAWIQAQRDYRVLTI

SEQ ID NO: 342368 - protein, 25 aa, Mycobacterium
KPLARKGFLSIWSWMFGLVVTEFPL

SEQ ID NO: 342369 - protein, 17 aa, Mycobacterium
KPLLLCFLITMGGTLAF

SEQ ID NO: 342370 - protein, 24 aa, Mycobacterium
KPPFSVGEAISWAWNRFTQNAMAL

SEQ ID NO: 342371 - protein, 18 aa, Mycobacterium
KPPGWVDNSGFARGHLFA

SEQ ID NO: 342372 - protein, 21 aa, Mycobacterium
KPVARPAHRWVMVPDDGAPAP

SEQ ID NO: 342373 - protein, 32 aa, Mycobacterium
KPWYRKPATLIGWALLCLILIALIIYGITQLM

SEQ ID NO: 342374 - protein, 17 aa, Mycobacterium
KQDVWKRVAVLFAGPAM

SEQ ID NO: 342375 - protein, 19 aa, Mycobacterium
KQFRCVSVDLIARRAVVHR

SEQ ID NO: 342376 - protein, 21 aa, Mycobacterium
KQLKSRFDAIIANFWQLVYRS

SEQ ID NO: 342377 - protein, 18 aa, Mycobacterium
KQPTRWRHLPAILMVCSL

SEQ ID NO: 342378 - protein, 18 aa, Mycobacterium
KQVRCWREQGITLTVAVN

SEQ ID NO: 342379 - protein, 17 aa, Mycobacterium
KQYRSGRGMAIAGIVLA

SEQ ID NO: 342380 - protein, 21 aa, Mycobacterium
KRADNPISFWEFTRKGIVVTT

SEQ ID NO: 342381 - protein, 26 aa, Mycobacterium
KRAEICRQRMGPVFKRITMNYPPLLF

SEQ ID NO: 342382 - protein, 21 aa, Mycobacterium
KRAKGPLVFDLGICLVLVTLP

SEQ ID NO: 342383 - protein, 20 aa, Mycobacterium
KRAPLALAVASLFYAFPIFL

SEQ ID NO: 342384 - protein, 22 aa, Mycobacterium
KRDFSEPVALNWASGGTDVDFG

SEQ ID NO: 342385 - protein, 17 aa, Mycobacterium
KRFAVGTSQTWARDESS

SEQ ID NO: 342386 - protein, 19 aa, Mycobacterium
KRFGDTMGYRMVIYPEYAV

SEQ ID NO: 342387 - protein, 17 aa, Mycobacterium
KRFTPQQIMVWALAASS

SEQ ID NO: 342388 - protein, 25 aa, Mycobacterium
KRGLLKWAWIPGVPLLWDLIVTMTA

SEQ ID NO: 342389 - protein, 21 aa, Mycobacterium
KRHLPRQIPIYGLQSPLFTGT

SEQ ID NO: 342390 - protein, 20 aa, Mycobacterium
KRIRIAIVVGTVLTILVAVG

SEQ ID NO: 342391 - protein, 19 aa, Mycobacterium
KRKVPGWLAPAAVVAALLI

SEQ ID NO: 342392 - protein, 18 aa, Mycobacterium
KRLALAMLLAALVNAGTF

SEQ ID NO: 342393 - protein, 20 aa, Mycobacterium
KRLFWPFIPKVGATALTESG

SEQ ID NO: 342394 - protein, 17 aa, Mycobacterium
KRLGRLMAAIGIPMLLG

SEQ ID NO: 342395 - protein, 18 aa, Mycobacterium
KRLLVYQVLKSGAKLITD

SEQ ID NO: 342396 - protein, 20 aa, Mycobacterium
KRLPTALGLIALVTFVLLFL

SEQ ID NO: 342397 - protein, 17 aa, Mycobacterium
KRLRGALVGAFYVVTYV

SEQ ID NO: 342398 - protein, 17 aa, Mycobacterium
KRLRPGDIIEVHADEVV

SEQ ID NO: 342399 - protein, 18 aa, Mycobacterium
KRLRTVRNIGVFGVNLIG

SEQ ID NO: 342400 - protein, 20 aa, Mycobacterium
KRLTPRWIRYERVDLAVGIV

SEQ ID NO: 342401 - protein, 19 aa, Mycobacterium
KRLYEEPGNFIGDKMVELP

SEQ ID NO: 342402 - protein, 20 aa, Mycobacterium
KRPADPWARPRIVYLQHASD

SEQ ID NO: 342403 - protein, 27 aa, Mycobacterium
KRPFIPRMVRAFAIPIIFFWGLLAVTT

SEQ ID NO: 342404 - protein, 25 aa, Mycobacterium
KRPSRWRHVPAILLALSLVLLTTAM

SEQ ID NO: 342405 - protein, 19 aa, Mycobacterium
KRPTFSNSYYRTFTKPHVH

SEQ ID NO: 342406 - protein, 18 aa, Mycobacterium
KRRIKLLLIVASVVLVLD

SEQ ID NO: 342407 - protein, 18 aa, Mycobacterium
KRRRWPKVLAAVLAVAVL

SEQ ID NO: 342408 - protein, 19 aa, Mycobacterium
KRTAYPYDKARIIVTAALE

SEQ ID NO: 342409 - protein, 17 aa, Mycobacterium
KRVAGFIGQEAMHGREH

SEQ ID NO: 342410 - protein, 19 aa, Mycobacterium
KRWGEYFAVIATSVFLPLE

SEQ ID NO: 342411 - protein, 19 aa, Mycobacterium
KRWGEYFAVVATSLFLPLE

SEQ ID NO: 342412 - protein, 19 aa, Mycobacterium
KRWGEYFAVVATSVFLPLE

SEQ ID NO: 342413 - protein, 22 aa, Mycobacterium
KRWSGDLAMTWDLLCRSITHGI

SEQ ID NO: 342414 - protein, 21 aa, Mycobacterium
KRWSTDLSMTWSLLQRSFTHG

SEQ ID NO: 342415 - protein, 21 aa, Mycobacterium
KSAIVPMHFWLPGAMAAPTPV

SEQ ID NO: 342416 - protein, 24 aa, Mycobacterium
KSERRDALKWVWIGVGAAVVMTVT

SEQ ID NO: 342417 - protein, 17 aa, Mycobacterium
KSGFNVGEAISWAWNKF

SEQ ID NO: 342418 - protein, 23 aa, Mycobacterium
KSILSLRGGEFFAPELAALASDP

SEQ ID NO: 342419 - protein, 17 aa, Mycobacterium
KSLRAGDVIDLAAPEVV

SEQ ID NO: 342420 - protein, 19 aa, Mycobacterium
KSNLFWAFAYNVAALPLAA

SEQ ID NO: 342421 - protein, 17 aa, Mycobacterium
KSPRWLWIVAGVAVVMV

SEQ ID NO: 342422 - protein, 20 aa, Mycobacterium
KSRASACLHGVWILLFTIPF

SEQ ID NO: 342423 - protein, 19 aa, Mycobacterium
KSRKGRAFAIVAALLAIAA

SEQ ID NO: 342424 - protein, 19 aa, Mycobacterium
KSTILALLCRFHDPSTGTV

SEQ ID NO: 342425 - protein, 19 aa, Mycobacterium
KSYPLLLRRLVTLVPALLV

SEQ ID NO: 342426 - protein, 21 aa, Mycobacterium
KTARWFGGIGLILGAVALVLA

SEQ ID NO: 342427 - protein, 20 aa, Mycobacterium
KTGILPLMWFVLLCTAGINI

SEQ ID NO: 342428 - protein, 21 aa, Mycobacterium
KTGMLPLMWLSLGISAGVSLF

SEQ ID NO: 342429 - protein, 18 aa, Mycobacterium
KTNLFWAFAYNVAAIPVA

SEQ ID NO: 342430 - protein, 18 aa, Mycobacterium
KTPVEFDRVLGMLDKLSV

SEQ ID NO: 342431 - protein, 23 aa, Mycobacterium
KTVWLRPGNRLGFFTHMGTQFSV

SEQ ID NO: 342432 - protein, 21 aa, Mycobacterium
KTVWLRPGTRLGFFTHMGTQF

SEQ ID NO: 342433 - protein, 18 aa, Mycobacterium
KVCSHLGCPASLYEEQSY

SEQ ID NO: 342434 - protein, 19 aa, Mycobacterium
KVCSHLGCPASLYEEQSYR

SEQ ID NO: 342435 - protein, 18 aa, Mycobacterium
KVCSHLGCPASLYEQQTY

SEQ ID NO: 342436 - protein, 23 aa, Mycobacterium
KVGAAVVRWPGPILVAAVGLSMI

SEQ ID NO: 342437 - protein, 22 aa, Mycobacterium
KVGTAIVRWPGPILAVTMIIAL

SEQ ID NO: 342438 - protein, 21 aa, Mycobacterium
KVGTSVVRWPIPIIVLTSLIA

SEQ ID NO: 342439 - protein, 19 aa, Mycobacterium
KVLMWAALVSVLAVALGLL

SEQ ID NO: 342440 - protein, 17 aa, Mycobacterium
KVLSSWLPPGPVAIADY

SEQ ID NO: 342441 - protein, 20 aa, Mycobacterium
KVPIIRLGHLLVFFVRAAVA

SEQ ID NO: 342442 - protein, 20 aa, Mycobacterium
KVPIIRLGHLLVFFVRALAA

SEQ ID NO: 342443 - protein, 28 aa, Mycobacterium
KVRGWRRIGTATVRWPGPIFVASLLIAL

SEQ ID NO: 342444 - protein, 27 aa, Mycobacterium
KVRGWRRIGTATVRWPGPVFVASLLIA

SEQ ID NO: 342445 - protein, 20 aa, Mycobacterium
KVSLVLSVVLFFVWMIAVAF

SEQ ID NO: 342446 - protein, 23 aa, Mycobacterium
KVVNLRSAPGFSFVGEDLDRLRS

SEQ ID NO: 342447 - protein, 19 aa, Mycobacterium
KVVNLRSAPGFSFVGEDQD

SEQ ID NO: 342448 - protein, 21 aa, Mycobacterium
KVVNLRSAPGFSFVSEDLDRV

SEQ ID NO: 342449 - protein, 22 aa, Mycobacterium
KVWTFMFLYFWLRATLPRLRYD

SEQ ID NO: 342450 - protein, 18 aa, Mycobacterium
KWGRGRQRLFEWLFLLVA

SEQ ID NO: 342451 - protein, 20 aa, Mycobacterium
KWHWSNDVLNAWAMSVVFYG

SEQ ID NO: 342452 - protein, 25 aa, Mycobacterium
KWIRRLSIPIVIGWLAIVFALNTFV

SEQ ID NO: 342453 - protein, 19 aa, Mycobacterium
KWSKARGGVEFGAGHYPVM

SEQ ID NO: 342454 - protein, 17 aa, Mycobacterium
KYGPWAIILARFAPFVR

SEQ ID NO: 342455 - protein, 17 aa, Mycobacterium
KYLDHWPDAFKILNRQG

SEQ ID NO: 342456 - protein, 22 aa, Mycobacterium
KYPKRAVLGLALFIGQAFIYNA

SEQ ID NO: 342457 - protein, 23 aa, Mycobacterium
KYRFRKRVLALFALILVASAAAA

SEQ ID NO: 342458 - protein, 22 aa, Mycobacterium
KYRWLVFTGWLLALVPAVYLAL

SEQ ID NO: 342459 - protein, 17 aa, Mycobacterium
LAAAAGRDLPIALLEDA

SEQ ID NO: 342460 - protein, 18 aa, Mycobacterium
LAAAFAAVLWTCPSALAI

SEQ ID NO: 342461 - protein, 17 aa, Mycobacterium
LAAALLLRYRSQAPQIT

SEQ ID NO: 342462 - protein, 22 aa, Mycobacterium
LAAAVCWACYILLTQRVGDEVA

SEQ ID NO: 342463 - protein, 17 aa, Mycobacterium
LAAEFVEALGLLARTPG

SEQ ID NO: 342464 - protein, 17 aa, Mycobacterium
LAAFAAMFLGGGVLFSL

SEQ ID NO: 342465 - protein, 18 aa, Mycobacterium
LAAFMVIVAWPWLEQHFT

SEQ ID NO: 342466 - protein, 18 aa, Mycobacterium
LAAGGWEWFVLAVTAVVV

SEQ ID NO: 342467 - protein, 18 aa, Mycobacterium
LAAGLILLVFLSRSPRVN

SEQ ID NO: 342468 - protein, 20 aa, Mycobacterium
LAAGVFFVWWELRTDHPALD

SEQ ID NO: 342469 - protein, 17 aa, Mycobacterium
LAAILGFIGVKLMLEAL

SEQ ID NO: 342470 - protein, 17 aa, Mycobacterium
LAALCAVGFSALPRLFT

SEQ ID NO: 342471 - protein, 20 aa, Mycobacterium
LAALCYAEFASTLPVAGSAY

SEQ ID NO: 342472 - protein, 22 aa, Mycobacterium
LAALLCLLLGIAIVTQVRQNES

SEQ ID NO: 342473 - protein, 24 aa, Mycobacterium
LAALLFTLALCWATTNGWWYVSSY

SEQ ID NO: 342474 - protein, 18 aa, Mycobacterium
LAALMFILALCFATTNGW

SEQ ID NO: 342475 - protein, 19 aa, Mycobacterium
LAAMAALLHWARAVPPVVA

SEQ ID NO: 342476 - protein, 18 aa, Mycobacterium
LAAPVIVWAAWPFHRAAW

SEQ ID NO: 342477 - protein, 18 aa, Mycobacterium
LAARFGFLLAIPAVFASG

SEQ ID NO: 342478 - protein, 22 aa, Mycobacterium
LAARKRIAWLLLLTNVVLAAFL

SEQ ID NO: 342479 - protein, 17 aa, Mycobacterium
LAARLRNPWMLLGAAAL

SEQ ID NO: 342480 - protein, 18 aa, Mycobacterium
LAATAVLISPAWKRDEVD

SEQ ID NO: 342481 - protein, 19 aa, Mycobacterium
LAAVAVEFALLSWLFSAEL

SEQ ID NO: 342482 - protein, 17 aa, Mycobacterium
LAAVCWLPAADRLERRQ

SEQ ID NO: 342483 - protein, 18 aa, Mycobacterium
LAAWVAVAPLVCWTCGVF

SEQ ID NO: 342484 - protein, 21 aa, Mycobacterium
LACALLRPRLQAIVAGLAAAL

SEQ ID NO: 342485 - protein, 25 aa, Mycobacterium
LACGIPAWFVSGVVWGAWIGKRVHV

SEQ ID NO: 342486 - protein, 17 aa, Mycobacterium
LACGRALRATWLMAARG

SEQ ID NO: 342487 - protein, 17 aa, Mycobacterium
LACLLALAELHLHTGRL

SEQ ID NO: 342488 - protein, 19 aa, Mycobacterium
LACPVWFYQLWAFITPGLY

SEQ ID NO: 342489 - protein, 19 aa, Mycobacterium
LACPVWLYQIWRFITPGLY

SEQ ID NO: 342490 - protein, 17 aa, Mycobacterium
LACVPALLLAPLVIRMP

SEQ ID NO: 342491 - protein, 20 aa, Mycobacterium
LADENHRLVGTRVCWNDDLR

SEQ ID NO: 342492 - protein, 24 aa, Mycobacterium
LADGRAVTIGSFFRPRNVGMVFLA

SEQ ID NO: 342493 - protein, 17 aa, Mycobacterium
LADGRVVIWGTTDRAEE

SEQ ID NO: 342494 - protein, 23 aa, Mycobacterium
LADRFGLVRVMLCGAIFQVLWAY

SEQ ID NO: 342495 - protein, 23 aa, Mycobacterium
LADVPRLSGWLAVRGDGQVWLER

SEQ ID NO: 342496 - protein, 18 aa, Mycobacterium
LAEAEVLYWGDIDTHGFA

SEQ ID NO: 342497 - protein, 28 aa, Mycobacterium
LAELLDSWLWRWVAFLIVFALMVVTTVV

SEQ ID NO: 342498 - protein, 19 aa, Mycobacterium
LAFGAEWGGAILMTYEHAP

SEQ ID NO: 342499 - protein, 21 aa, Mycobacterium
LAFGAGLAWLAMDRRRIRDAE

SEQ ID NO: 342500 - protein, 26 aa, Mycobacterium
LAFGYPSRHWWLVWMFAGVFAASLAA

SEQ ID NO: 342501 - protein, 20 aa, Mycobacterium
LAFISLCYVSFVRWKIRLKG

SEQ ID NO: 342502 - protein, 18 aa, Mycobacterium
LAFLPRLVVLIVVALVIT

SEQ ID NO: 342503 - protein, 19 aa, Mycobacterium
LAFQACFVSAAAVAARFGA

SEQ ID NO: 342504 - protein, 18 aa, Mycobacterium
LAFRRTRIVGSLGGLAYV

SEQ ID NO: 342505 - protein, 17 aa, Mycobacterium
LAFSAFDLMAWRITAGV

SEQ ID NO: 342506 - protein, 18 aa, Mycobacterium
LAFSNGILFLAFGAVAFV

SEQ ID NO: 342507 - protein, 18 aa, Mycobacterium
LAFTAIGTAATWLWNNAI

SEQ ID NO: 342508 - protein, 25 aa, Mycobacterium
LAFTVFCLIGFPFLIAAVLWGIVDA

SEQ ID NO: 342509 - protein, 20 aa, Mycobacterium
LAFWIGRPLVRLNFLNERYG

SEQ ID NO: 342510 - protein, 23 aa, Mycobacterium
LAFYVVCAFVTWFVFLRLQEHRA

SEQ ID NO: 342511 - protein, 23 aa, Mycobacterium
LAGALALSAFLGWQQWQQHQVKL

SEQ ID NO: 342512 - protein, 18 aa, Mycobacterium
LAGFAILCSVVIAPSWAD

SEQ ID NO: 342513 - protein, 18 aa, Mycobacterium
LAGFNFGEQGVWAFARPG

SEQ ID NO: 342514 - protein, 24 aa, Mycobacterium
LAGGLALLLMVVWVGIALAVSASL

SEQ ID NO: 342515 - protein, 20 aa, Mycobacterium
LAGGWLIMWLVMTAYPKLHE

SEQ ID NO: 342516 - protein, 17 aa, Mycobacterium
LAGIVIGRTGFGWIDAF

SEQ ID NO: 342517 - protein, 22 aa, Mycobacterium
LAGIWCGLTLFLVLRLVLVGWR

SEQ ID NO: 342518 - protein, 18 aa, Mycobacterium
LAGLKMTIILTVVSIFFA

SEQ ID NO: 342519 - protein, 18 aa, Mycobacterium
LAGLLAVGWVWRSARFRR

SEQ ID NO: 342520 - protein, 21 aa, Mycobacterium
LAGLVAAGWAWRRYRWLARLG

SEQ ID NO: 342521 - protein, 19 aa, Mycobacterium
LAGLVATGWVWRRGHRLIA

SEQ ID NO: 342522 - protein, 21 aa, Mycobacterium
LAGQEAFVWIGLHEPDEKQMQ

SEQ ID NO: 342523 - protein, 19 aa, Mycobacterium
LAGREIPAAVPLVSFAILA

SEQ ID NO: 342524 - protein, 20 aa, Mycobacterium
LAGVLLKWVDLSTLYLIDAI

SEQ ID NO: 342525 - protein, 19 aa, Mycobacterium
LAGVPGMLVAPFVGSWVGR

SEQ ID NO: 342526 - protein, 20 aa, Mycobacterium
LAGVREFFDTMVIVENFPST

SEQ ID NO: 342527 - protein, 19 aa, Mycobacterium
LAGWCSIAGHRQMGMTLTI

SEQ ID NO: 342528 - protein, 17 aa, Mycobacterium
LAGWLFGWLAERSGSLA

SEQ ID NO: 342529 - protein, 27 aa, Mycobacterium
LAHRPNRTWWRFTAWWIPCLALASTWW

SEQ ID NO: 342530 - protein, 18 aa, Mycobacterium
LAICYRPLLFATVDPEVA

SEQ ID NO: 342531 - protein, 21 aa, Mycobacterium
LAIFMVVCTLGLIAMLAIFAD

SEQ ID NO: 342532 - protein, 17 aa, Mycobacterium
LAIFTSVVIGYFVALAR

SEQ ID NO: 342533 - protein, 17 aa, Mycobacterium
LAIFWKRMTSTAFVASL

SEQ ID NO: 342534 - protein, 17 aa, Mycobacterium
LAILVMVVWVGTALTIS

SEQ ID NO: 342535 - protein, 17 aa, Mycobacterium
LAIPVGFGIIFAIGGMI

SEQ ID NO: 342536 - protein, 20 aa, Mycobacterium
LAIVSLRLIPAVPFSALNYA

SEQ ID NO: 342537 - protein, 17 aa, Mycobacterium
LAKDIFRSPGIAMVQSI

SEQ ID NO: 342538 - protein, 18 aa, Mycobacterium
LAKLLPFNLARTWHVQLS

SEQ ID NO: 342539 - protein, 18 aa, Mycobacterium
LAKRVEWGAVLPYWIVQV

SEQ ID NO: 342540 - protein, 23 aa, Mycobacterium
LALATPVVRSWLFGDADHPGLLG

SEQ ID NO: 342541 - protein, 18 aa, Mycobacterium
LALFPMYYLRSFAYAGIA

SEQ ID NO: 342542 - protein, 20 aa, Mycobacterium
LALGCSLCYGTATVLQAAGT

SEQ ID NO: 342543 - protein, 20 aa, Mycobacterium
LALGLWAAWKAWRGNDDDDD

SEQ ID NO: 342544 - protein, 25 aa, Mycobacterium
LALLANLFFPWGIAGDRPSLVGVGI

SEQ ID NO: 342545 - protein, 19 aa, Mycobacterium
LALLAWFGFYLYKLSHGEV

SEQ ID NO: 342546 - protein, 17 aa, Mycobacterium
LALLWLADQVDAALAKY

SEQ ID NO: 342547 - protein, 23 aa, Mycobacterium
LALRLLIPVIRWQRRETVLSEGD

SEQ ID NO: 342548 - protein, 17 aa, Mycobacterium
LALSLAVAAGFLKWQGG

SEQ ID NO: 342549 - protein, 20 aa, Mycobacterium
LALSWARLTTVFVIDLLILI

SEQ ID NO: 342550 - protein, 19 aa, Mycobacterium
LALTELWRAYGVHPDAVIG

SEQ ID NO: 342551 - protein, 20 aa, Mycobacterium
LALTILVLWQRRRRRKRREA

SEQ ID NO: 342552 - protein, 20 aa, Mycobacterium
LALTISRLTLRHAFQALRES

SEQ ID NO: 342553 - protein, 18 aa, Mycobacterium
LALYWRKARPDLYDRIGS

SEQ ID NO: 342554 - protein, 22 aa, Mycobacterium
LAMALTCWWVISREVIPRLGHA

SEQ ID NO: 342555 - protein, 25 aa, Mycobacterium
LANAKRWGVLHVIWRQGLYPGIGAP

SEQ ID NO: 342556 - protein, 19 aa, Mycobacterium
LANHPSFGRRDLSSMRRGN

SEQ ID NO: 342557 - protein, 24 aa, Mycobacterium
LANVLRYGYYPALILGLLVGVVIL

SEQ ID NO: 342558 - protein, 18 aa, Mycobacterium
LAPEYSVDTWRQWWFAWQ

SEQ ID NO: 342559 - protein, 17 aa, Mycobacterium
LAPLRWALILSGLLQAV

SEQ ID NO: 342560 - protein, 17 aa, Mycobacterium
LAPNISALIAFRVIQGL

SEQ ID NO: 342561 - protein, 18 aa, Mycobacterium
LAPRAFYDYVPWVDRIPP

SEQ ID NO: 342562 - protein, 17 aa, Mycobacterium
LAPRAQIIAAVRETDNE

SEQ ID NO: 342563 - protein, 20 aa, Mycobacterium
LAPRSWRIVMTLQRDGGQLK

SEQ ID NO: 342564 - protein, 17 aa, Mycobacterium
LAPTWSFHFGLLLLGWG

SEQ ID NO: 342565 - protein, 17 aa, Mycobacterium
LAQAAGVPVVFLTAFYG

SEQ ID NO: 342566 - protein, 17 aa, Mycobacterium
LAQDLLEALAFGVGQLA

SEQ ID NO: 342567 - protein, 18 aa, Mycobacterium
LAQFLGWPWGKFRRPAQA

SEQ ID NO: 342568 - protein, 23 aa, Mycobacterium
LAQLTVRGWLALVLWIMGATVLL

SEQ ID NO: 342569 - protein, 17 aa, Mycobacterium
LAQRFRVIRYDNRGVGL

SEQ ID NO: 342570 - protein, 22 aa, Mycobacterium
LARARKAGVSAVIFVWCNISDD

SEQ ID NO: 342571 - protein, 20 aa, Mycobacterium
LARARWPYRAPRAAMVLWQA

SEQ ID NO: 342572 - protein, 26 aa, Mycobacterium
LARFCGPELWWLLRVADYASAGGTTA

SEQ ID NO: 342573 - protein, 20 aa, Mycobacterium
LARFPCEPFRPDAFFAEAAQ

SEQ ID NO: 342574 - protein, 25 aa, Mycobacterium
LARGGRSRLAFGLLAALLCLLLGIA

SEQ ID NO: 342575 - protein, 18 aa, Mycobacterium
LARIWPPWEFYFWHHTIP

SEQ ID NO: 342576 - protein, 17 aa, Mycobacterium
LARIWRFAARHHRRLAV

SEQ ID NO: 342577 - protein, 18 aa, Mycobacterium
LARLEWEVVLSLVTAVEM

SEQ ID NO: 342578 - protein, 17 aa, Mycobacterium
LARRTAMALTRWRVRME

SEQ ID NO: 342579 - protein, 18 aa, Mycobacterium
LARYEIPTRITIVDAIPR

SEQ ID NO: 342580 - protein, 20 aa, Mycobacterium
LASGRAMRALGWLRRNARRI

SEQ ID NO: 342581 - protein, 21 aa, Mycobacterium
LASLRKRVCAAMRTGMERTST

SEQ ID NO: 342582 - protein, 23 aa, Mycobacterium
LASRGIDGVEFFSALHAGGALAK

SEQ ID NO: 342583 - protein, 18 aa, Mycobacterium
LASVFPWFAGIVSAACLG

SEQ ID NO: 342584 - protein, 18 aa, Mycobacterium
LATAFGIFFLRQFFLTVP

SEQ ID NO: 342585 - protein, 21 aa, Mycobacterium
LATAGLLAWFWPRLGKLTLPV

SEQ ID NO: 342586 - protein, 22 aa, Mycobacterium
LATGCLRVRASITISPDDLVSG

SEQ ID NO: 342587 - protein, 21 aa, Mycobacterium
LATGCLRVRASITISPEDLVS

SEQ ID NO: 342588 - protein, 19 aa, Mycobacterium
LATRAGAGFPDFGAPQLPI

SEQ ID NO: 342589 - protein, 24 aa, Mycobacterium
LATVVRFVLLRGWVFHPRRTTTGG

SEQ ID NO: 342590 - protein, 17 aa, Mycobacterium
LAVAVGMTWATASDLEL

SEQ ID NO: 342591 - protein, 18 aa, Mycobacterium
LAVDLAWALWVAGTLGGL

SEQ ID NO: 342592 - protein, 21 aa, Mycobacterium
LAVGLKFKLGFDDSLDVVGVH

SEQ ID NO: 342593 - protein, 22 aa, Mycobacterium
LAVGLKFRLGFDDSLDVVGVHL

SEQ ID NO: 342594 - protein, 19 aa, Mycobacterium
LAVGVGCGALIGLERQWRA

SEQ ID NO: 342595 - protein, 19 aa, Mycobacterium
LAVIVAWLLIVMLLSRLLA

SEQ ID NO: 342596 - protein, 20 aa, Mycobacterium
LAVKVRWPWPRTIGTLLAGT

SEQ ID NO: 342597 - protein, 26 aa, Mycobacterium
LAVLVLLRFLTPWGRQYWRITREYFV

SEQ ID NO: 342598 - protein, 17 aa, Mycobacterium
LAVPGVLARLVLLWFLC

SEQ ID NO: 342599 - protein, 17 aa, Mycobacterium
LAVPIWWVYATSLLLIT

SEQ ID NO: 342600 - protein, 19 aa, Mycobacterium
LAVPLEWNVLFAYATIFLF

SEQ ID NO: 342601 - protein, 23 aa, Mycobacterium
LAVSDWKAAWWAAAGVAAVLCVI

SEQ ID NO: 342602 - protein, 19 aa, Mycobacterium
LAVVGVCRLRRARQSPSAP

SEQ ID NO: 342603 - protein, 21 aa, Mycobacterium
LAVWPFLNWWTTHFVITDRRV

SEQ ID NO: 342604 - protein, 17 aa, Mycobacterium
LAWFWPRLGKLTLPVTF

SEQ ID NO: 342605 - protein, 17 aa, Mycobacterium
LAWLPLFVVFGVLTGLL

SEQ ID NO: 342606 - protein, 18 aa, Mycobacterium
LAWVPRLAWIGVTVWLLI

SEQ ID NO: 342607 - protein, 23 aa, Mycobacterium
LAYDMWGAAVSLAYQMHSGSPQP

SEQ ID NO: 342608 - protein, 17 aa, Mycobacterium
LAYFKALGIPSALGLLV

SEQ ID NO: 342609 - protein, 21 aa, Mycobacterium
LCALCAALVLNLWVGYFPTVQ

SEQ ID NO: 342610 - protein, 17 aa, Mycobacterium
LCALGALYAGSRASIGF

SEQ ID NO: 342611 - protein, 19 aa, Mycobacterium
LCALLPFALPFVVLAYGIK

SEQ ID NO: 342612 - protein, 20 aa, Mycobacterium
LCALWCAGVAMLWAHGPNTG

SEQ ID NO: 342613 - protein, 20 aa, Mycobacterium
LCAMILRIVAIEWRGKIDDP

SEQ ID NO: 342614 - protein, 21 aa, Mycobacterium
LCASFPPWGFWWAAFPALSVL

SEQ ID NO: 342615 - protein, 23 aa, Mycobacterium
LCAWLKDFRGFFGIGFAVLAALL

SEQ ID NO: 342616 - protein, 17 aa, Mycobacterium
LCCSGSFLGFAFAFGQV

SEQ ID NO: 342617 - protein, 25 aa, Mycobacterium
LCGAVLIHGLCRWFFLNRAGAVRLT

SEQ ID NO: 342618 - protein, 22 aa, Mycobacterium
LCGELACGILAIRLSARRLAMG

SEQ ID NO: 342619 - protein, 17 aa, Mycobacterium
LCGIGIFALVIFATGLP

SEQ ID NO: 342620 - protein, 20 aa, Mycobacterium
LCGLPPPMLVIFVLTPVVAS

SEQ ID NO: 342621 - protein, 17 aa, Mycobacterium
LCGVCSIPGRHTITDPY

SEQ ID NO: 342622 - protein, 18 aa, Mycobacterium
LCILLGYLAAVLMHGLWN

SEQ ID NO: 342623 - protein, 19 aa, Mycobacterium
LCLMPIFPLALWLMNVYAA

SEQ ID NO: 342624 - protein, 19 aa, Mycobacterium
LCLVSLPWVVRGCALLDAG

SEQ ID NO: 342625 - protein, 18 aa, Mycobacterium
LCMLPGLALLIWAAPRLA

SEQ ID NO: 342626 - protein, 19 aa, Mycobacterium
LCPLGELLAPLTFVTFAYM

SEQ ID NO: 342627 - protein, 20 aa, Mycobacterium
LCRHYWPLALFAAALSRRSR

SEQ ID NO: 342628 - protein, 18 aa, Mycobacterium
LCRHYWPLALMAATMSRH

SEQ ID NO: 342629 - protein, 20 aa, Mycobacterium
LCRLVRLLLWLSVIPVIECS

SEQ ID NO: 342630 - protein, 19 aa, Mycobacterium
LCRRRWRPGLLMTGLVVAA

SEQ ID NO: 342631 - protein, 20 aa, Mycobacterium
LCVICAGLSINVWIGYLPTV

SEQ ID NO: 342632 - protein, 21 aa, Mycobacterium
LCVILAFPLAYVIAFKAGRFK

SEQ ID NO: 342633 - protein, 20 aa, Mycobacterium
LCVLCAGLALNGWVGYFPTA

SEQ ID NO: 342634 - protein, 17 aa, Mycobacterium
LCYIAAAALTWVRYARP

SEQ ID NO: 342635 - protein, 24 aa, Mycobacterium
LDAEPRLSALLSDYTTPAEGRVAL

SEQ ID NO: 342636 - protein, 17 aa, Mycobacterium
LDAERWKRAGWRVFRLG

SEQ ID NO: 342637 - protein, 17 aa, Mycobacterium
LDAGLFFIAFVRNPVTQ

SEQ ID NO: 342638 - protein, 20 aa, Mycobacterium
LDAGPFLSYGIQWIAFGILA

SEQ ID NO: 342639 - protein, 17 aa, Mycobacterium
LDALAGRERFSLNDPDD

SEQ ID NO: 342640 - protein, 17 aa, Mycobacterium
LDALFARALATEPAGRF

SEQ ID NO: 342641 - protein, 24 aa, Mycobacterium
LDALRRCGLGRWLAGLSDGLSTVL

SEQ ID NO: 342642 - protein, 17 aa, Mycobacterium
LDARRGWAHRPFIGSFV

SEQ ID NO: 342643 - protein, 19 aa, Mycobacterium
LDASHSWALAPRRQSPPPY

SEQ ID NO: 342644 - protein, 17 aa, Mycobacterium
LDGAGWLVHVLLNPRRV

SEQ ID NO: 342645 - protein, 20 aa, Mycobacterium
LDGLRRFHRNLGRGLLGRRI

SEQ ID NO: 342646 - protein, 25 aa, Mycobacterium
LDHPLRWLSLRSIVILSQLGVTILV

SEQ ID NO: 342647 - protein, 20 aa, Mycobacterium
LDIGAAFSWSFNKFSKNAVP

SEQ ID NO: 342648 - protein, 20 aa, Mycobacterium
LDIGCVLILIALLITVQAAQ

SEQ ID NO: 342649 - protein, 23 aa, Mycobacterium
LDIGLPDMAGWVVLDVLKHDLAT

SEQ ID NO: 342650 - protein, 20 aa, Mycobacterium
LDIIEIILAILINLIAITFF

SEQ ID NO: 342651 - protein, 17 aa, Mycobacterium
LDIPGLILSAAGITTLV

SEQ ID NO: 342652 - protein, 22 aa, Mycobacterium
LDIRPNPGIAFPGYADYLPVTR

SEQ ID NO: 342653 - protein, 23 aa, Mycobacterium
LDIRPNPGIGFPGWANYFPVTRG

SEQ ID NO: 342654 - protein, 17 aa, Mycobacterium
LDIRPNPGIGHPCYADY

SEQ ID NO: 342655 - protein, 17 aa, Mycobacterium
LDKLSRVPLGWFTQRGS

SEQ ID NO: 342656 - protein, 19 aa, Mycobacterium
LDLGCGRGAVLLAAAKRLP

SEQ ID NO: 342657 - protein, 19 aa, Mycobacterium
LDLPAGGGLYRFSNVTYRG

SEQ ID NO: 342658 - protein, 20 aa, Mycobacterium
LDLPCLLALTMTDELSARGG

SEQ ID NO: 342659 - protein, 18 aa, Mycobacterium
LDLPLVWQLSRGAGQTVA

SEQ ID NO: 342660 - protein, 24 aa, Mycobacterium
LDLPRLFQILLIIGMFVWIAIIFR

SEQ ID NO: 342661 - protein, 18 aa, Mycobacterium
LDLPRLWQILLIVGMFVW

SEQ ID NO: 342662 - protein, 17 aa, Mycobacterium
LDLPRLWQILLTVGLFL

SEQ ID NO: 342663 - protein, 17 aa, Mycobacterium
LDLPRLWQVLLIVGMFL

SEQ ID NO: 342664 - protein, 19 aa, Mycobacterium
LDLSWRWLFGLSIIPALIS

SEQ ID NO: 342665 - protein, 23 aa, Mycobacterium
LDMRPNPGIGFPGYVDYLPATRG

SEQ ID NO: 342666 - protein, 23 aa, Mycobacterium
LDMVRRYGADFGFVSYDQAWLDG

SEQ ID NO: 342667 - protein, 18 aa, Mycobacterium
LDNFVAWAVAKENQPLID

SEQ ID NO: 342668 - protein, 17 aa, Mycobacterium
LDNKRLWSNLDCAPSNE

SEQ ID NO: 342669 - protein, 18 aa, Mycobacterium
LDNKRLWSNLDCAPSNET

SEQ ID NO: 342670 - protein, 18 aa, Mycobacterium
LDNTRLWSNLDCAPSNET

SEQ ID NO: 342671 - protein, 18 aa, Mycobacterium
LDPAAGVMLSALWVTSTS

SEQ ID NO: 342672 - protein, 19 aa, Mycobacterium
LDPAAGVMLSGLWVAATGQ

SEQ ID NO: 342673 - protein, 21 aa, Mycobacterium
LDPLLPFPRWHEHAAVLEEPV

SEQ ID NO: 342674 - protein, 21 aa, Mycobacterium
LDPLLPFPRWHEHAAVVEEPV

SEQ ID NO: 342675 - protein, 17 aa, Mycobacterium
LDPPGGHLVSRDVVRTI

SEQ ID NO: 342676 - protein, 20 aa, Mycobacterium
LDQPRIYFGPVISNTPADYA

SEQ ID NO: 342677 - protein, 17 aa, Mycobacterium
LDRLDGHRMRRWIPQNW

SEQ ID NO: 342678 - protein, 25 aa, Mycobacterium
LDRLPWGRFHWRVVIGLGGVWILDG

SEQ ID NO: 342679 - protein, 25 aa, Mycobacterium
LDRLPWGRFHWRVVIGLGGVWVLDG

SEQ ID NO: 342680 - protein, 25 aa, Mycobacterium
LDRLPWSRFHWRVVLGLGGVWILDG

SEQ ID NO: 342681 - protein, 25 aa, Mycobacterium
LDRLPWSRFHWRVVVGLGGVWILDG

SEQ ID NO: 342682 - protein, 26 aa, Mycobacterium
LDRLPWSRFHWRVVVGLGGVWVLDGL

SEQ ID NO: 342683 - protein, 21 aa, Mycobacterium
LDRLQAFDVFSSFWFTAIYVL

SEQ ID NO: 342684 - protein, 20 aa, Mycobacterium
LDRLQAFNVFSSFWFTAIYV

SEQ ID NO: 342685 - protein, 23 aa, Mycobacterium
LDRLRARHGWFDHAVRAYKRFSE

SEQ ID NO: 342686 - protein, 23 aa, Mycobacterium
LDRLRARYGWFDHVLRAYQRFDG

SEQ ID NO: 342687 - protein, 23 aa, Mycobacterium
LDRRLDEAAGFVIPFLPRGLDEI

SEQ ID NO: 342688 - protein, 18 aa, Mycobacterium
LDRYGPRWIMTIGSVLGV

SEQ ID NO: 342689 - protein, 18 aa, Mycobacterium
LDSSCLVARVLTRSALGT

SEQ ID NO: 342690 - protein, 23 aa, Mycobacterium
LDTLAVFVGWLWPLWDARNRTFA

SEQ ID NO: 342691 - protein, 18 aa, Mycobacterium
LDTSLRWQATVIRMDGRR

SEQ ID NO: 342692 - protein, 23 aa, Mycobacterium
LDVAQPLAYCLPGVRSRVVVSEG

SEQ ID NO: 342693 - protein, 20 aa, Mycobacterium
LDVLRRVAIDFDRSDDAASV

SEQ ID NO: 342694 - protein, 20 aa, Mycobacterium
LDVLRRVAIDFDRTEKAASV

SEQ ID NO: 342695 - protein, 17 aa, Mycobacterium
LDWRSARWWGRGASLMA

SEQ ID NO: 342696 - protein, 18 aa, Mycobacterium
LDWVAWRGLGFAADAQIV

SEQ ID NO: 342697 - protein, 18 aa, Mycobacterium
LEALLDFLTLHFAAGFFM

SEQ ID NO: 342698 - protein, 26 aa, Mycobacterium
LEATWKYVVICSVGIAVAFLGTAMLY

SEQ ID NO: 342699 - protein, 22 aa, Mycobacterium
LEFGGFIAWLAWLLLHLYYLIG

SEQ ID NO: 342700 - protein, 24 aa, Mycobacterium
LEIFRSRWARWVAWSLPVVGLVVL

SEQ ID NO: 342701 - protein, 17 aa, Mycobacterium
LELARFAALSAIFTGLG

SEQ ID NO: 342702 - protein, 20 aa, Mycobacterium
LELLPRASVCAGRLGEVLST

SEQ ID NO: 342703 - protein, 20 aa, Mycobacterium
LELLRSAFIPWLVTINPEDH

SEQ ID NO: 342704 - protein, 19 aa, Mycobacterium
LELPATGGLYRFSNVTYRG

SEQ ID NO: 342705 - protein, 18 aa, Mycobacterium
LELPVRMGIATGEAELRG

SEQ ID NO: 342706 - protein, 19 aa, Mycobacterium
LELSWRWLFGLSIVPALIS

SEQ ID NO: 342707 - protein, 19 aa, Mycobacterium
LELYLVFPLSNEESTISLV

SEQ ID NO: 342708 - protein, 39 aa, Mycobacterium
LEPRPSRTARRWRRVGTAVARWPGPILVAALGLTLLAAL

SEQ ID NO: 342709 - protein, 24 aa, Mycobacterium
LEPTWSRPGWRHLKHFNGFVTSFW

SEQ ID NO: 342710 - protein, 20 aa, Mycobacterium
LEPYPSWAWTDERIAGYFAG

SEQ ID NO: 342711 - protein, 18 aa, Mycobacterium
LERFLARRLLIKDLRDGE

SEQ ID NO: 342712 - protein, 18 aa, Mycobacterium
LESRSFLLGEDWFDQDES

SEQ ID NO: 342713 - protein, 20 aa, Mycobacterium
LETRMMALFGIFFGLGAALT

SEQ ID NO: 342714 - protein, 20 aa, Mycobacterium
LEVPAAGGLYRFSNVTYRGV

SEQ ID NO: 342715 - protein, 23 aa, Mycobacterium
LEVYRLTGLWPKLGAPWYAFWRL

SEQ ID NO: 342716 - protein, 18 aa, Mycobacterium
LEWARLVGIGHGFDSDDF

SEQ ID NO: 342717 - protein, 17 aa, Mycobacterium
LEYEAWFLAAAVRRGWV

SEQ ID NO: 342718 - protein, 20 aa, Mycobacterium
LEYIARLALLERAERDGQIE

SEQ ID NO: 342719 - protein, 18 aa, Mycobacterium
LFARANRVAHGWLFGEPR

SEQ ID NO: 342720 - protein, 18 aa, Mycobacterium
LFASMVVGLLMFLLLGRP

SEQ ID NO: 342721 - protein, 18 aa, Mycobacterium
LFDACGFRRLVFATPEEL

SEQ ID NO: 342722 - protein, 19 aa, Mycobacterium
LFDACGWRRLIFATPEELE

SEQ ID NO: 342723 - protein, 24 aa, Mycobacterium
LFEVFGAAAAVCFLSVSALYVADR

SEQ ID NO: 342724 - protein, 18 aa, Mycobacterium
LFFISWKLGVAAAITLPL

SEQ ID NO: 342725 - protein, 22 aa, Mycobacterium
LFFPEPRCRVVTAVGPYDPGER

SEQ ID NO: 342726 - protein, 17 aa, Mycobacterium
LFFRGALYSALGKFYPV

SEQ ID NO: 342727 - protein, 19 aa, Mycobacterium
LFFWRDWLRILSGFFSSLR

SEQ ID NO: 342728 - protein, 23 aa, Mycobacterium
LFGAEIALGFALTAPVVGAVAAT

SEQ ID NO: 342729 - protein, 18 aa, Mycobacterium
LFGFKIHWIVAALSVIIL

SEQ ID NO: 342730 - protein, 23 aa, Mycobacterium
LFGKSAYHALTFGWLMSGLGRAV

SEQ ID NO: 342731 - protein, 18 aa, Mycobacterium
LFGQLPLPLGVAGHEGST

SEQ ID NO: 342732 - protein, 18 aa, Mycobacterium
LFGTLAVLLRRGVLPGLA

SEQ ID NO: 342733 - protein, 17 aa, Mycobacterium
LFHDWRDVFWINVPLTA

SEQ ID NO: 342734 - protein, 17 aa, Mycobacterium
LFICSATGFLILSTGAY

SEQ ID NO: 342735 - protein, 23 aa, Mycobacterium
LFIPRFLIAVGICGILVATGSYL

SEQ ID NO: 342736 - protein, 17 aa, Mycobacterium
LFIVMGIFAVRAGLAQA

SEQ ID NO: 342737 - protein, 22 aa, Mycobacterium
LFKKPLRLWVAVSLYGGTALTV

SEQ ID NO: 342738 - protein, 18 aa, Mycobacterium
LFLGITFLFLVSSAFTLA

SEQ ID NO: 342739 - protein, 18 aa, Mycobacterium
LFLGTGFCGAFTTYSALA

SEQ ID NO: 342740 - protein, 17 aa, Mycobacterium
LFLKLLRDGRWWLGSGV

SEQ ID NO: 342741 - protein, 18 aa, Mycobacterium
LFLVLALFTLFSGTPVAL

SEQ ID NO: 342742 - protein, 22 aa, Mycobacterium
LFLVVLWCGRFPRHWRCWPRHW

SEQ ID NO: 342743 - protein, 19 aa, Mycobacterium
LFNIIWRIFEAIISIVIAA

SEQ ID NO: 342744 - protein, 24 aa, Mycobacterium
LFNRLRPTLPIVLANLVSVGEVAV

SEQ ID NO: 342745 - protein, 18 aa, Mycobacterium
LFPLLMLSVGGMLVFPAS

SEQ ID NO: 342746 - protein, 21 aa, Mycobacterium
LFRAPEFYVWIAAALGGMIFQ

SEQ ID NO: 342747 - protein, 18 aa, Mycobacterium
LFRDPVFTICCVLSFVVG

SEQ ID NO: 342748 - protein, 17 aa, Mycobacterium
LFRRPFQWREFILQCWF

SEQ ID NO: 342749 - protein, 18 aa, Mycobacterium
LFRSPVFTVCCVLAFVVG

SEQ ID NO: 342750 - protein, 19 aa, Mycobacterium
LFRVPELLAGSFLLALLAV

SEQ ID NO: 342751 - protein, 21 aa, Mycobacterium
LFRYLTPWGRQFWRITRGYFV

SEQ ID NO: 342752 - protein, 18 aa, Mycobacterium
LFSGRWGNSAAMAFAAGL

SEQ ID NO: 342753 - protein, 17 aa, Mycobacterium
LFSGVLGAFAMRRAALP

SEQ ID NO: 342754 - protein, 19 aa, Mycobacterium
LFTSFAFAFAFYFATMERQ

SEQ ID NO: 342755 - protein, 17 aa, Mycobacterium
LFWFFGHPEVYILALPF

SEQ ID NO: 342756 - protein, 17 aa, Mycobacterium
LFWFFGHPEVYVIALPF

SEQ ID NO: 342757 - protein, 17 aa, Mycobacterium
LFWFFGHPEVYVLALPF

SEQ ID NO: 342758 - protein, 18 aa, Mycobacterium
LFYSGFYLPMYWSSRAKL

SEQ ID NO: 342759 - protein, 19 aa, Mycobacterium
LFYSGFYLPMYWSSRGKLT

SEQ ID NO: 342760 - protein, 17 aa, Mycobacterium
LGAFGFYLAFIAELPPP

SEQ ID NO: 342761 - protein, 17 aa, Mycobacterium
LGAILGFIGVKLILHAL

SEQ ID NO: 342762 - protein, 17 aa, Mycobacterium
LGALAIVIAILIVLNAQ

SEQ ID NO: 342763 - protein, 17 aa, Mycobacterium
LGALAIVIAILIVLNHQ

SEQ ID NO: 342764 - protein, 18 aa, Mycobacterium
LGALCLLGTLWLVIRARS

SEQ ID NO: 342765 - protein, 19 aa, Mycobacterium
LGALGAVLIALIVFGLAKA

SEQ ID NO: 342766 - protein, 17 aa, Mycobacterium
LGALLVLAAAFVGLVIN

SEQ ID NO: 342767 - protein, 23 aa, Mycobacterium
LGALRGALRNKPAFAPDGIPAAL

SEQ ID NO: 342768 - protein, 27 aa, Mycobacterium
LGDDCWWAPAWMKRIQVKLGLGEVTLP

SEQ ID NO: 342769 - protein, 21 aa, Mycobacterium
LGDDCWWAPRWMKRIQEKLGL

SEQ ID NO: 342770 - protein, 22 aa, Mycobacterium
LGDDCWWAPRWMKRVQEKLGLG

SEQ ID NO: 342771 - protein, 23 aa, Mycobacterium
LGDDCWWAPRWMRRLQTRIGLGE

SEQ ID NO: 342772 - protein, 23 aa, Mycobacterium
LGDFWGYLAGWGFVVGKTASCAA

SEQ ID NO: 342773 - protein, 18 aa, Mycobacterium
LGDLRWFYVYSGVMWAIV

SEQ ID NO: 342774 - protein, 17 aa, Mycobacterium
LGDLSWWVTAVILVREI

SEQ ID NO: 342775 - protein, 18 aa, Mycobacterium
LGDQRLGGGIAWAAGELP

SEQ ID NO: 342776 - protein, 18 aa, Mycobacterium
LGDQRLGGGIAWSAGEFP

SEQ ID NO: 342777 - protein, 25 aa, Mycobacterium
LGDRFGRRYVIVWAIGSFAATTLLT

SEQ ID NO: 342778 - protein, 25 aa, Mycobacterium
LGDRWGRRRLMLWGATLFAAASVLA

SEQ ID NO: 342779 - protein, 18 aa, Mycobacterium
LGEALGLIDMERGAKVSG

SEQ ID NO: 342780 - protein, 18 aa, Mycobacterium
LGETLPLDAGKILGAGLA

SEQ ID NO: 342781 - protein, 18 aa, Mycobacterium
LGETLPLDAGKILGTGLG

SEQ ID NO: 342782 - protein, 18 aa, Mycobacterium
LGFLRFGLPPSDRVELTE

SEQ ID NO: 342783 - protein, 21 aa, Mycobacterium
LGFRLTCYYYRKAYYRSVWQS

SEQ ID NO: 342784 - protein, 25 aa, Mycobacterium
LGGARWDNLWLPLAVVGAGLVVLMA

SEQ ID NO: 342785 - protein, 28 aa, Mycobacterium
LGGFFTDHMSWRWAFWINVPVGILVLVI

SEQ ID NO: 342786 - protein, 27 aa, Mycobacterium
LGGKLRTSRQFNWGWILAIVVIVLALA

SEQ ID NO: 342787 - protein, 26 aa, Mycobacterium
LGGKLRTSRQFNWGWVLALVLVVLAL

SEQ ID NO: 342788 - protein, 17 aa, Mycobacterium
LGGLIVFWQSRRHRRKN

SEQ ID NO: 342789 - protein, 24 aa, Mycobacterium
LGGPRTPMFLAFPIMLLASSMATS

SEQ ID NO: 342790 - protein, 17 aa, Mycobacterium
LGGRQSLILVGAWAASG

SEQ ID NO: 342791 - protein, 18 aa, Mycobacterium
LGGVGAWIGCRRHGIPLP

SEQ ID NO: 342792 - protein, 18 aa, Mycobacterium
LGGWRIIQTMGHKLVRIE

SEQ ID NO: 342793 - protein, 18 aa, Mycobacterium
LGGWRIIRTLGKGLVEIK

SEQ ID NO: 342794 - protein, 25 aa, Mycobacterium
LGIAWRGGLLAGRRPVLLAAGSVVA

SEQ ID NO: 342795 - protein, 20 aa, Mycobacterium
LGIDGWRWLLILGGLAAVFV

SEQ ID NO: 342796 - protein, 18 aa, Mycobacterium
LGIGLGWAAALLMGTITA

SEQ ID NO: 342797 - protein, 20 aa, Mycobacterium
LGIPCSVGMLVALLVALTLA

SEQ ID NO: 342798 - protein, 17 aa, Mycobacterium
LGIPGWITQRLWWAVLL

SEQ ID NO: 342799 - protein, 22 aa, Mycobacterium
LGIPSFVVTLAFFLGLQGVTLK

SEQ ID NO: 342800 - protein, 17 aa, Mycobacterium
LGIRICIVAAVVAALVV

SEQ ID NO: 342801 - protein, 21 aa, Mycobacterium
LGKPYMWWAAALVPLYWMLQS

SEQ ID NO: 342802 - protein, 17 aa, Mycobacterium
LGLACVPALLLAPLVIR

SEQ ID NO: 342803 - protein, 18 aa, Mycobacterium
LGLALAVTVTHVFPVEHG

SEQ ID NO: 342804 - protein, 25 aa, Mycobacterium
LGLAVARRLDCRVVQGYGMSELSPV

SEQ ID NO: 342805 - protein, 17 aa, Mycobacterium
LGLAVGVALTFTFLWFV

SEQ ID NO: 342806 - protein, 17 aa, Mycobacterium
LGLDTAWLSSFHDDTQT

SEQ ID NO: 342807 - protein, 17 aa, Mycobacterium
LGLERQVLWAATRALVQ

SEQ ID NO: 342808 - protein, 19 aa, Mycobacterium
LGLIALVIGVAGGWVGRTT

SEQ ID NO: 342809 - protein, 17 aa, Mycobacterium
LGLLASGLTMFFGAYAW

SEQ ID NO: 342810 - protein, 21 aa, Mycobacterium
LGLLASWLLSRRIKRQTGGLE

SEQ ID NO: 342811 - protein, 21 aa, Mycobacterium
LGLRFYLRWITSTGYTYGALS

SEQ ID NO: 342812 - protein, 19 aa, Mycobacterium
LGLSPPRLWAGLRLGSAAG

SEQ ID NO: 342813 - protein, 23 aa, Mycobacterium
LGLTLFCLWPFTRLVHAFSAPIG

SEQ ID NO: 342814 - protein, 21 aa, Mycobacterium
LGMAVLWLSGWPTRRQSIFYI

SEQ ID NO: 342815 - protein, 20 aa, Mycobacterium
LGMPIDLGWQLWAYGVFAIA

SEQ ID NO: 342816 - protein, 21 aa, Mycobacterium
LGMPIPAGWKLWLYGVFAITA

SEQ ID NO: 342817 - protein, 20 aa, Mycobacterium
LGNQRWRWGALMLVVSIVLQ

SEQ ID NO: 342818 - protein, 21 aa, Mycobacterium
LGPACAIAVFVGFAATVTLFP

SEQ ID NO: 342819 - protein, 22 aa, Mycobacterium
LGPACAIAVFVGFAATVTLFPP

SEQ ID NO: 342820 - protein, 20 aa, Mycobacterium
LGPDGGWRGNAAQAYGARNL

SEQ ID NO: 342821 - protein, 17 aa, Mycobacterium
LGPFPLRAYALCIIVGI

SEQ ID NO: 342822 - protein, 20 aa, Mycobacterium
LGPGPRWWGLALMVAGGVSA

SEQ ID NO: 342823 - protein, 17 aa, Mycobacterium
LGPLYGVQPAMWRQFRI

SEQ ID NO: 342824 - protein, 24 aa, Mycobacterium
LGPRLIDTYVDWLWFGELGYRSVF

SEQ ID NO: 342825 - protein, 24 aa, Mycobacterium
LGPRVDALGVRWLLKFVNNEVSSD

SEQ ID NO: 342826 - protein, 19 aa, Mycobacterium
LGPSPAWRNLRMSRDAIPT

SEQ ID NO: 342827 - protein, 24 aa, Mycobacterium
LGPVLRRLTANYPPIMFHPLNTIT

SEQ ID NO: 342828 - protein, 19 aa, Mycobacterium
LGQPMFAEYVWGRQVGENT

SEQ ID NO: 342829 - protein, 18 aa, Mycobacterium
LGQPMFIEYVWGRQVGEN

SEQ ID NO: 342830 - protein, 19 aa, Mycobacterium
LGQQCARRPLPLLPAMAKV

SEQ ID NO: 342831 - protein, 19 aa, Mycobacterium
LGQQCARRPLPLVTALAKV

SEQ ID NO: 342832 - protein, 18 aa, Mycobacterium
LGQVVAWVVIVAGVVFVA

SEQ ID NO: 342833 - protein, 23 aa, Mycobacterium
LGRLKTGIGLLCFVIVFLQGVTQ

SEQ ID NO: 342834 - protein, 22 aa, Mycobacterium
LGRLRFGALYALSGLGGSVLVY

SEQ ID NO: 342835 - protein, 22 aa, Mycobacterium
LGRLRFGGLYALSALGGSVLVY

SEQ ID NO: 342836 - protein, 17 aa, Mycobacterium
LGRRFSRPQIVRIAEVS

SEQ ID NO: 342837 - protein, 19 aa, Mycobacterium
LGRRRLLLIGGAGFAVVSA

SEQ ID NO: 342838 - protein, 25 aa, Mycobacterium
LGRSRLHGIKKWKAAILATTLLLFL

SEQ ID NO: 342839 - protein, 25 aa, Mycobacterium
LGRVELRLVWPAILSAMRLSTQMSM

SEQ ID NO: 342840 - protein, 17 aa, Mycobacterium
LGSIIARNSLDAPVPGL

SEQ ID NO: 342841 - protein, 19 aa, Mycobacterium
LGSLFLAPAMTGFVGAVAV

SEQ ID NO: 342842 - protein, 18 aa, Mycobacterium
LGSMFGYGVGYAVASLSC

SEQ ID NO: 342843 - protein, 17 aa, Mycobacterium
LGSVSWRGPFFGVSVLM

SEQ ID NO: 342844 - protein, 19 aa, Mycobacterium
LGSYGAWFPYYLCGLALRV

SEQ ID NO: 342845 - protein, 27 aa, Mycobacterium
LGSYGSWIMYYVCGISIRVTDLQGRTA

SEQ ID NO: 342846 - protein, 18 aa, Mycobacterium
LGTLASWIGVRETWRVIG

SEQ ID NO: 342847 - protein, 23 aa, Mycobacterium
LGTMLGWRATFWAIALLCLPAVV

SEQ ID NO: 342848 - protein, 18 aa, Mycobacterium
LGTWATACGWAFALAMID

SEQ ID NO: 342849 - protein, 19 aa, Mycobacterium
LGVAFGWSMFNWVADVACL

SEQ ID NO: 342850 - protein, 20 aa, Mycobacterium
LGVAHPWRLLGLVMLPLIAK

SEQ ID NO: 342851 - protein, 17 aa, Mycobacterium
LGVAVGMLWPGFGRSVG

SEQ ID NO: 342852 - protein, 17 aa, Mycobacterium
LGVFSAFGLVFVQFPGK

SEQ ID NO: 342853 - protein, 19 aa, Mycobacterium
LGVGVGCGALIGLERQWRA

SEQ ID NO: 342854 - protein, 25 aa, Mycobacterium
LGVILRWPVWWVVVCTAVCVLIVEG

SEQ ID NO: 342855 - protein, 18 aa, Mycobacterium
LGVLPLLPVLLMIWATAR

SEQ ID NO: 342856 - protein, 19 aa, Mycobacterium
LGVLVTWILVERAIALQRL

SEQ ID NO: 342857 - protein, 20 aa, Mycobacterium
LGVLVTWMLVERAIALRRLA

SEQ ID NO: 342858 - protein, 18 aa, Mycobacterium
LGVMPLLPVLLMVWATAR

SEQ ID NO: 342859 - protein, 18 aa, Mycobacterium
LGVMPLLPVLLMVWGTAR

SEQ ID NO: 342860 - protein, 20 aa, Mycobacterium
LGVPCAVGMLVAVAVALTLG

SEQ ID NO: 342861 - protein, 17 aa, Mycobacterium
LGVRIWLTNHVDFSKPV

SEQ ID NO: 342862 - protein, 23 aa, Mycobacterium
LGVSAAYLWSLWALFIGHAGMPG

SEQ ID NO: 342863 - protein, 25 aa, Mycobacterium
LGVVVGGPFLPIAIILYWVSNNIWT

SEQ ID NO: 342864 - protein, 26 aa, Mycobacterium
LGVVVGGPFLPLAIILYWFANNIWTF

SEQ ID NO: 342865 - protein, 29 aa, Mycobacterium
LGVVVGGPFLPLAIIMYWLANNIWTFGQQ

SEQ ID NO: 342866 - protein, 30 aa, Mycobacterium
LGVVVGGPFLPLAVIMYWLANNIWTYGQQH

SEQ ID NO: 342867 - protein, 17 aa, Mycobacterium
LGWEPFQPVDAGVFFGR

SEQ ID NO: 342868 - protein, 22 aa, Mycobacterium
LGWHWSLPLGVAILFAAVAGGL

SEQ ID NO: 342869 - protein, 23 aa, Mycobacterium
LGWHYLRLPSVVGMGQYSLEVDL

SEQ ID NO: 342870 - protein, 19 aa, Mycobacterium
LGWKLLIPVSLAWIAIVAT

SEQ ID NO: 342871 - protein, 17 aa, Mycobacterium
LGWLRRHTRAIQVFGGV

SEQ ID NO: 342872 - protein, 19 aa, Mycobacterium
LGWLRRHTRAIQVFGGVLL

SEQ ID NO: 342873 - protein, 17 aa, Mycobacterium
LGWPWGKFRRPAQAARF

SEQ ID NO: 342874 - protein, 17 aa, Mycobacterium
LGWWQWTRFQSVSGTFQ

SEQ ID NO: 342875 - protein, 22 aa, Mycobacterium
LGYDPFPLWSLLWGLVETMLIE

SEQ ID NO: 342876 - protein, 20 aa, Mycobacterium
LGYFWGWRAALWAVVLVSVP

SEQ ID NO: 342877 - protein, 24 aa, Mycobacterium
LGYGRTGYIWSMFAAFGLFTVGAV

SEQ ID NO: 342878 - protein, 24 aa, Mycobacterium
LHARARLVIMPSFDLGDFLGNIAE

SEQ ID NO: 342879 - protein, 18 aa, Mycobacterium
LHASLAIGDRVHTTSGLQ

SEQ ID NO: 342880 - protein, 18 aa, Mycobacterium
LHFARLAYFKALGIPSAL

SEQ ID NO: 342881 - protein, 20 aa, Mycobacterium
LHFTRLPYFNTMGFPLSIGM

SEQ ID NO: 342882 - protein, 19 aa, Mycobacterium
LHFTRLPYFQTMGVPLAIG

SEQ ID NO: 342883 - protein, 19 aa, Mycobacterium
LHGAWPWLFILGLVAVGAA

SEQ ID NO: 342884 - protein, 17 aa, Mycobacterium
LHGMTCASCASRVEKGL

SEQ ID NO: 342885 - protein, 21 aa, Mycobacterium
LHGRLGPIGVVFMVVAAAAPL

SEQ ID NO: 342886 - protein, 21 aa, Mycobacterium
LHHELEFWWELALLIVIMLLG

SEQ ID NO: 342887 - protein, 24 aa, Mycobacterium
LHHELEFWWELALLIVIMLLGHWV

SEQ ID NO: 342888 - protein, 19 aa, Mycobacterium
LHLARLSYFKALGIPSALG

SEQ ID NO: 342889 - protein, 23 aa, Mycobacterium
LHPLSLLKLVAWVIFQLLSSSVQ

SEQ ID NO: 342890 - protein, 18 aa, Mycobacterium
LHSTFRWLLSAAAALWIV

SEQ ID NO: 342891 - protein, 24 aa, Mycobacterium
LHTRICLWLGLLCGMFPVLAVFLI

SEQ ID NO: 342892 - protein, 20 aa, Mycobacterium
LHVAQPLAYCLPGVRSRVVV

SEQ ID NO: 342893 - protein, 19 aa, Mycobacterium
LHVVDARFARGLRARLLGK

SEQ ID NO: 342894 - protein, 23 aa, Mycobacterium
LHWKISEAPLFYGGYAALLAISA

SEQ ID NO: 342895 - protein, 20 aa, Mycobacterium
LHWRVFWICSGVILTTMLVG

SEQ ID NO: 342896 - protein, 18 aa, Mycobacterium
LHWSLPGLSFILLVAVGA

SEQ ID NO: 342897 - protein, 19 aa, Mycobacterium
LHWYLPRSAPMYADERIAI

SEQ ID NO: 342898 - protein, 19 aa, Mycobacterium
LHWYTWIAFTAWVAAALLF

SEQ ID NO: 342899 - protein, 17 aa, Mycobacterium
LHWYTWVAFSGWVVLAL

SEQ ID NO: 342900 - protein, 21 aa, Mycobacterium
LHYACGISWFPAVLVATAVAP

SEQ ID NO: 342901 - protein, 22 aa, Mycobacterium
LIAITFFLVFAIIAYTIIFAIL

SEQ ID NO: 342902 - protein, 17 aa, Mycobacterium
LICLVAFRVTTARDLTY

SEQ ID NO: 342903 - protein, 20 aa, Mycobacterium
LIDIRFIPKYLFSVSFCGIL

SEQ ID NO: 342904 - protein, 32 aa, Mycobacterium
LIEPDLRVLVNLGYGDPRFGYSTSPANVPTPF

SEQ ID NO: 342905 - protein, 20 aa, Mycobacterium
LIEVPIRIVVYIAVALVIRY

SEQ ID NO: 342906 - protein, 17 aa, Mycobacterium
LIFGCVLMWILAWLTAT

SEQ ID NO: 342907 - protein, 18 aa, Mycobacterium
LIFPLVMVLSFYFFFAGH

SEQ ID NO: 342908 - protein, 19 aa, Mycobacterium
LIGAGVGWWLARRRRDATN

SEQ ID NO: 342909 - protein, 19 aa, Mycobacterium
LIGALALLCAACWLIEILA

SEQ ID NO: 342910 - protein, 17 aa, Mycobacterium
LIGLCLAAVIGVPAGLL

SEQ ID NO: 342911 - protein, 23 aa, Mycobacterium
LIGWSAACAVAYLRGFGRRPSWV

SEQ ID NO: 342912 - protein, 25 aa, Mycobacterium
LIGYAMGFFAIWWAWMNFTWFASAF

SEQ ID NO: 342913 - protein, 17 aa, Mycobacterium
LIIAIGVFLAWRAIPAL

SEQ ID NO: 342914 - protein, 17 aa, Mycobacterium
LIIGTAWLIRRARRRAG

SEQ ID NO: 342915 - protein, 21 aa, Mycobacterium
LIIGVVRWYWGIFSGRPARDK

SEQ ID NO: 342916 - protein, 21 aa, Mycobacterium
LIKCGVVLLAVFATFIAHPVL

SEQ ID NO: 342917 - protein, 22 aa, Mycobacterium
LILGCASGLCLREGLIDLEAAA

SEQ ID NO: 342918 - protein, 22 aa, Mycobacterium
LILMRQGYRWTRTILTSGGLVS

SEQ ID NO: 342919 - protein, 21 aa, Mycobacterium
LILNASWSWIFFNRGKLGTAA

SEQ ID NO: 342920 - protein, 18 aa, Mycobacterium
LILVMGAFLFFANRRQRK

SEQ ID NO: 342921 - protein, 23 aa, Mycobacterium
LIMGWGHRLLRGLALVAVSAMVA

SEQ ID NO: 342922 - protein, 17 aa, Mycobacterium
LINCGYPLIERFPLMLG

SEQ ID NO: 342923 - protein, 19 aa, Mycobacterium
LIPARRIGAAMARLSREAA

SEQ ID NO: 342924 - protein, 17 aa, Mycobacterium
LIPAVPFSALNYAAGAS

SEQ ID NO: 342925 - protein, 20 aa, Mycobacterium
LIRAGFIGAVLVVLVIAVGL

SEQ ID NO: 342926 - protein, 20 aa, Mycobacterium
LIRAGFIGVILIILVIAVGL

SEQ ID NO: 342927 - protein, 20 aa, Mycobacterium
LIRARWRRWIAWVLPVFGLA

SEQ ID NO: 342928 - protein, 25 aa, Mycobacterium
LIRRLSVPIILGWLGMIAIVTFAVP

SEQ ID NO: 342929 - protein, 25 aa, Mycobacterium
LIRTLAVPIILVWVALIAVLNTIVP

SEQ ID NO: 342930 - protein, 17 aa, Mycobacterium
LISCVWLAIIMVPIYWI

SEQ ID NO: 342931 - protein, 26 aa, Mycobacterium
LISMWGWRRGERWVWWSLLLGCAFGT

SEQ ID NO: 342932 - protein, 18 aa, Mycobacterium
LISVFYVGFVRWKIRLPR

SEQ ID NO: 342933 - protein, 18 aa, Mycobacterium
LITLCPALVILAVGFDPT

SEQ ID NO: 342934 - protein, 18 aa, Mycobacterium
LIVAFFALWWLQQTYQPE

SEQ ID NO: 342935 - protein, 18 aa, Mycobacterium
LIVSWIAVILLTFHWARV

SEQ ID NO: 342936 - protein, 22 aa, Mycobacterium
LIWQWREHRGPAMVAAFAAGLV

SEQ ID NO: 342937 - protein, 18 aa, Mycobacterium
LIYFEAITTFALLFGLVV

SEQ ID NO: 342938 - protein, 19 aa, Mycobacterium
LKAAIAAGIGCFIAFIGFV

SEQ ID NO: 342939 - protein, 19 aa, Mycobacterium
LKAAVQGVARFSQTLDERD

SEQ ID NO: 342940 - protein, 17 aa, Mycobacterium
LKAFWYHFAIMFEALFI

SEQ ID NO: 342941 - protein, 23 aa, Mycobacterium
LKALSRAVGFTWRRSLQVRVVVS

SEQ ID NO: 342942 - protein, 17 aa, Mycobacterium
LKFAQLVGLIFALAGVA

SEQ ID NO: 342943 - protein, 17 aa, Mycobacterium
LKFAQLVGLIFAVLGTA

SEQ ID NO: 342944 - protein, 20 aa, Mycobacterium
LKFTRLPYFSSLAFPCAVGL

SEQ ID NO: 342945 - protein, 17 aa, Mycobacterium
LKGWFQRWFFTAVGQVP

SEQ ID NO: 342946 - protein, 17 aa, Mycobacterium
LKHAKSRLRAIDRMSGT

SEQ ID NO: 342947 - protein, 17 aa, Mycobacterium
LKHFNGFVTSLWLTPSD

SEQ ID NO: 342948 - protein, 18 aa, Mycobacterium
LKHLVAVPIHAPDDAELA

SEQ ID NO: 342949 - protein, 21 aa, Mycobacterium
LKKPILVWWIAWVVSTATSLF

SEQ ID NO: 342950 - protein, 17 aa, Mycobacterium
LKLASLISEAEYGDKRT

SEQ ID NO: 342951 - protein, 21 aa, Mycobacterium
LKLAVVLALWAAVAGAFVSVL

SEQ ID NO: 342952 - protein, 17 aa, Mycobacterium
LKLGPFVVMHAIADYVV

SEQ ID NO: 342953 - protein, 17 aa, Mycobacterium
LKLGRPALLVVRCASAV

SEQ ID NO: 342954 - protein, 23 aa, Mycobacterium
LKLPSWGSLRLALPVGGNGDATF

SEQ ID NO: 342955 - protein, 17 aa, Mycobacterium
LKLTRWQSFRLILLPSA

SEQ ID NO: 342956 - protein, 19 aa, Mycobacterium
LKPWVIPVMGGLLFFVLVY

SEQ ID NO: 342957 - protein, 19 aa, Mycobacterium
LKQFGGMAAAMFAYVAISQ

SEQ ID NO: 342958 - protein, 20 aa, Mycobacterium
LKQPFEWREFIWNGWFLMRV

SEQ ID NO: 342959 - protein, 19 aa, Mycobacterium
LKRLLPYLIPYRTRWIVIV

SEQ ID NO: 342960 - protein, 17 aa, Mycobacterium
LKRRKVIGLSLGIGLGA

SEQ ID NO: 342961 - protein, 20 aa, Mycobacterium
LKSAVSFLVLVWVILQSLAI

SEQ ID NO: 342962 - protein, 17 aa, Mycobacterium
LKSWRRGLIFAMFVFAA

SEQ ID NO: 342963 - protein, 18 aa, Mycobacterium
LKTFLLLVVMSAMIVFVG

SEQ ID NO: 342964 - protein, 17 aa, Mycobacterium
LKTSWYLLGPAFVAAIA

SEQ ID NO: 342965 - protein, 20 aa, Mycobacterium
LKVAAYWLDRYELLSHTRAG

SEQ ID NO: 342966 - protein, 21 aa, Mycobacterium
LKVSLLLSVALFFVWMISVAF

SEQ ID NO: 342967 - protein, 17 aa, Mycobacterium
LKYKFGYDDSLDVVGVH

SEQ ID NO: 342968 - protein, 19 aa, Mycobacterium
LKYLSYRLFMKRQKSRWLV

SEQ ID NO: 342969 - protein, 18 aa, Mycobacterium
LLAAWGWFALLLEITGAV

SEQ ID NO: 342970 - protein, 17 aa, Mycobacterium
LLAFPMGVPLEWNVFMI

SEQ ID NO: 342971 - protein, 23 aa, Mycobacterium
LLAGLAWYWYLKRTRPEIAQRIG

SEQ ID NO: 342972 - protein, 17 aa, Mycobacterium
LLAGSFLLALLAVVAAN

SEQ ID NO: 342973 - protein, 19 aa, Mycobacterium
LLAKICVYTVFAVVQSAIV

SEQ ID NO: 342974 - protein, 19 aa, Mycobacterium
LLAKVCVYTVFAIVQSAIV

SEQ ID NO: 342975 - protein, 17 aa, Mycobacterium
LLALCGKRLFWPFIPKV

SEQ ID NO: 342976 - protein, 17 aa, Mycobacterium
LLALLGLGFPDQGDGLH

SEQ ID NO: 342977 - protein, 25 aa, Mycobacterium
LLALLRWRGAALLTLAWRSVSKRHV

SEQ ID NO: 342978 - protein, 19 aa, Mycobacterium
LLALWAIRALTHWLQARLG

SEQ ID NO: 342979 - protein, 22 aa, Mycobacterium
LLANRWFLRLSVITGPLAVLAV

SEQ ID NO: 342980 - protein, 17 aa, Mycobacterium
LLARAAVPPRHWRWPLG

SEQ ID NO: 342981 - protein, 24 aa, Mycobacterium
LLARREVRLLLAHRSYFAFLAILP

SEQ ID NO: 342982 - protein, 18 aa, Mycobacterium
LLAVLPFFHIYGMTVLLN

SEQ ID NO: 342983 - protein, 26 aa, Mycobacterium
LLAVPILPAFGWRPMFFVGAGTGLII

SEQ ID NO: 342984 - protein, 18 aa, Mycobacterium
LLAVPIWWAYAASLLLIT

SEQ ID NO: 342985 - protein, 22 aa, Mycobacterium
LLAYLASFGPMFTVSSELGGAG

SEQ ID NO: 342986 - protein, 19 aa, Mycobacterium
LLCAACWLIEILARHHSQP

SEQ ID NO: 342987 - protein, 18 aa, Mycobacterium
LLCGLPILLVVALAVKLS

SEQ ID NO: 342988 - protein, 19 aa, Mycobacterium
LLCTILGCWIMRKAQQRWP

SEQ ID NO: 342989 - protein, 18 aa, Mycobacterium
LLDGVGIIVGIDRFMSEA

SEQ ID NO: 342990 - protein, 24 aa, Mycobacterium
LLDPGGWPRLDWSMDAALLLAALA

SEQ ID NO: 342991 - protein, 17 aa, Mycobacterium
LLDRLGAHLTRHIGPGV

SEQ ID NO: 342992 - protein, 25 aa, Mycobacterium
LLDRLKARWPWFDHVMRAQERYNDS

SEQ ID NO: 342993 - protein, 24 aa, Mycobacterium
LLDTARIAFGWIRRPAAPGRLVVI

SEQ ID NO: 342994 - protein, 24 aa, Mycobacterium
LLDTLPLLIGWLWPLWDSRRRTFA

SEQ ID NO: 342995 - protein, 25 aa, Mycobacterium
LLDTLSLFVGWLWPLWDSRRRTFAD

SEQ ID NO: 342996 - protein, 24 aa, Mycobacterium
LLDTRWMPLPAFVIAMVLLRSSLA

SEQ ID NO: 342997 - protein, 24 aa, Mycobacterium
LLDTWLWRWAAFLIVFGAQVVVGA

SEQ ID NO: 342998 - protein, 24 aa, Mycobacterium
LLDTWLWRWVAYLIVFGIMVVVGA

SEQ ID NO: 342999 - protein, 18 aa, Mycobacterium
LLEGIGRRVLAWVNSIRG

SEQ ID NO: 343000 - protein, 19 aa, Mycobacterium
LLEHFSWGSIFLVNVPIAV

SEQ ID NO: 343001 - protein, 21 aa, Mycobacterium
LLEHFWWGSVFLINIPVMVIL

SEQ ID NO: 343002 - protein, 18 aa, Mycobacterium
LLESFLFYSGFYLPMYWS

SEQ ID NO: 343003 - protein, 19 aa, Mycobacterium
LLFGWPWWAALLIAIVSLA

SEQ ID NO: 343004 - protein, 19 aa, Mycobacterium
LLFRLTCYYYRGAYYRTVW

SEQ ID NO: 343005 - protein, 20 aa, Mycobacterium
LLFRRCRRVVLVAAIVDGVV

SEQ ID NO: 343006 - protein, 17 aa, Mycobacterium
LLFWQWRTMPAVIWDVQ

SEQ ID NO: 343007 - protein, 18 aa, Mycobacterium
LLGDRYGRRRGFFIGLGV

SEQ ID NO: 343008 - protein, 18 aa, Mycobacterium
LLGDRYGRRRGFFVGLAL

SEQ ID NO: 343009 - protein, 18 aa, Mycobacterium
LLGERRFELALAHSPIGM

SEQ ID NO: 343010 - protein, 18 aa, Mycobacterium
LLGFPVWMIFVLNTAGLL

SEQ ID NO: 343011 - protein, 17 aa, Mycobacterium
LLGGPALPWWLFAAAAF

SEQ ID NO: 343012 - protein, 19 aa, Mycobacterium
LLGHLPLPLGVAGHEGSTV

SEQ ID NO: 343013 - protein, 18 aa, Mycobacterium
LLGILAIVVAVAARRDAP

SEQ ID NO: 343014 - protein, 17 aa, Mycobacterium
LLGKWAFAALKDYHRQF

SEQ ID NO: 343015 - protein, 20 aa, Mycobacterium
LLGKWFWWPQMVRRRPKPSP

SEQ ID NO: 343016 - protein, 17 aa, Mycobacterium
LLGLFVFAAMIALLYRY

SEQ ID NO: 343017 - protein, 21 aa, Mycobacterium
LLGRWNWWAPPPLARLHARIG

SEQ ID NO: 343018 - protein, 17 aa, Mycobacterium
LLGTLWLVIRARSSTRA

SEQ ID NO: 343019 - protein, 25 aa, Mycobacterium
LLGVFAFVCVLAFVMLLATLRSPVL

SEQ ID NO: 343020 - protein, 17 aa, Mycobacterium
LLGVLALADPARNDSAA

SEQ ID NO: 343021 - protein, 19 aa, Mycobacterium
LLGWCWRGGAAPRPPVSDF

SEQ ID NO: 343022 - protein, 19 aa, Mycobacterium
LLHASVIWFYLVRNKSTNY

SEQ ID NO: 343023 - protein, 19 aa, Mycobacterium
LLHHWPVLMLLMGISSITM

SEQ ID NO: 343024 - protein, 21 aa, Mycobacterium
LLHRTPIRFIRAFSGAARVSG

SEQ ID NO: 343025 - protein, 24 aa, Mycobacterium
LLICGACGLLGLWYAGRGLDRNPR

SEQ ID NO: 343026 - protein, 20 aa, Mycobacterium
LLIGEWGWRGALFGLGGLWG

SEQ ID NO: 343027 - protein, 19 aa, Mycobacterium
LLIIMGAFMYFASRRQKKA

SEQ ID NO: 343028 - protein, 20 aa, Mycobacterium
LLIKKIWWPLAVWVLLVVMN

SEQ ID NO: 343029 - protein, 19 aa, Mycobacterium
LLILFAFPMFWLVNTGSTV

SEQ ID NO: 343030 - protein, 19 aa, Mycobacterium
LLLAAGLSWAAIQLAHLTG

SEQ ID NO: 343031 - protein, 18 aa, Mycobacterium
LLLCGLVMAVVAALVGTA

SEQ ID NO: 343032 - protein, 17 aa, Mycobacterium
LLLCLAIALGADALGSS

SEQ ID NO: 343033 - protein, 22 aa, Mycobacterium
LLLCLFGMLVILLRRGHVPGVA

SEQ ID NO: 343034 - protein, 19 aa, Mycobacterium
LLLEVAWEALEHAGIAPSA

SEQ ID NO: 343035 - protein, 20 aa, Mycobacterium
LLLGLALAFRRTRIVGSLGG

SEQ ID NO: 343036 - protein, 17 aa, Mycobacterium
LLLGVAFALLVARERVR

SEQ ID NO: 343037 - protein, 24 aa, Mycobacterium
LLLLPRADWRWRVARAAVRLLARL

SEQ ID NO: 343038 - protein, 24 aa, Mycobacterium
LLLLPRERWRWWAVRRSIRLLARL

SEQ ID NO: 343039 - protein, 20 aa, Mycobacterium
LLLLRLGEPFAISAMASTTA

SEQ ID NO: 343040 - protein, 18 aa, Mycobacterium
LLLLVALFVLFSRMQSGG

SEQ ID NO: 343041 - protein, 19 aa, Mycobacterium
LLLLVALFVMFSRMQTGGR

SEQ ID NO: 343042 - protein, 17 aa, Mycobacterium
LLLRASVMPTYLSNDWG

SEQ ID NO: 343043 - protein, 18 aa, Mycobacterium
LLMGIGMAFIWSPLAATA

SEQ ID NO: 343044 - protein, 18 aa, Mycobacterium
LLMLFGFGMIWFGILIGS

SEQ ID NO: 343045 - protein, 17 aa, Mycobacterium
LLMTGSFACGMAFHNCA

SEQ ID NO: 343046 - protein, 26 aa, Mycobacterium
LLPDDAFHTWGWRVPFLLGAVLLVVG

SEQ ID NO: 343047 - protein, 26 aa, Mycobacterium
LLPDEAFVSWGWRVPFLLSVVLLAIG

SEQ ID NO: 343048 - protein, 26 aa, Mycobacterium
LLPEEQFLSWGWRIPFILGAVLMLVG

SEQ ID NO: 343049 - protein, 18 aa, Mycobacterium
LLQTEFNVMLPWTKEVAL

SEQ ID NO: 343050 - protein, 25 aa, Mycobacterium
LLQTKRLLIRWARDYVTVIGAIVLP

SEQ ID NO: 343051 - protein, 23 aa, Mycobacterium
LLRELRVGLSLGLLLGGLAFAVT

SEQ ID NO: 343052 - protein, 18 aa, Mycobacterium
LLRKLSRLPLGWFTERGS

SEQ ID NO: 343053 - protein, 23 aa, Mycobacterium
LLRPQWLALFVVVAAFAYLCFTV

SEQ ID NO: 343054 - protein, 17 aa, Mycobacterium
LLRPYRWIVAVLALVVI

SEQ ID NO: 343055 - protein, 17 aa, Mycobacterium
LLRQDWRGLAVVIGIAL

SEQ ID NO: 343056 - protein, 18 aa, Mycobacterium
LLRRIRLITAERRYLRMR

SEQ ID NO: 343057 - protein, 19 aa, Mycobacterium
LLRRPGWASVGVALVLVIA

SEQ ID NO: 343058 - protein, 20 aa, Mycobacterium
LLRRSVPLLARRLITLLPAL

SEQ ID NO: 343059 - protein, 22 aa, Mycobacterium
LLRRVLPFLIVILIVGMIVALF

SEQ ID NO: 343060 - protein, 18 aa, Mycobacterium
LLRVEVPNALPLILGGLR

SEQ ID NO: 343061 - protein, 20 aa, Mycobacterium
LLRVTRFDVGLAMLVAGAVN

SEQ ID NO: 343062 - protein, 17 aa, Mycobacterium
LLRWPHPELGLLYPGTF

SEQ ID NO: 343063 - protein, 25 aa, Mycobacterium
LLSDEAFTSWGWRVPFLVSAPIVLV

SEQ ID NO: 343064 - protein, 20 aa, Mycobacterium
LLSIAAWLAVMVSVSFVLMQ

SEQ ID NO: 343065 - protein, 17 aa, Mycobacterium
LLSRLWVLPVHRMSGLM

SEQ ID NO: 343066 - protein, 17 aa, Mycobacterium
LLSSMVVLFAFSGNTAM

SEQ ID NO: 343067 - protein, 21 aa, Mycobacterium
LLTGMAIRIADVWNMTRKVGV

SEQ ID NO: 343068 - protein, 17 aa, Mycobacterium
LLTGPSLLILDEPTSGL

SEQ ID NO: 343069 - protein, 17 aa, Mycobacterium
LLTHWKLALGALLACTI

SEQ ID NO: 343070 - protein, 19 aa, Mycobacterium
LLTNRSWRAAASMGAPTAG

SEQ ID NO: 343071 - protein, 26 aa, Mycobacterium
LLTPEWLSGLSWRAWVFAVIVIAAIR

SEQ ID NO: 343072 - protein, 18 aa, Mycobacterium
LLVACSMLAYVLIFSIPL

SEQ ID NO: 343073 - protein, 20 aa, Mycobacterium
LLVAIPFTVLVSFTLNILLR

SEQ ID NO: 343074 - protein, 26 aa, Mycobacterium
LLVASAWWLFEWEISRGASLPEARAT

SEQ ID NO: 343075 - protein, 24 aa, Mycobacterium
LLVASAWWLFEWEVGKGASVEAAR

SEQ ID NO: 343076 - protein, 23 aa, Mycobacterium
LLVFFWRDWLRIVAGFVSSLRHR

SEQ ID NO: 343077 - protein, 20 aa, Mycobacterium
LLVGWWLWERRITHPLVSTR

SEQ ID NO: 343078 - protein, 19 aa, Mycobacterium
LLVKKIWWPLAVWLLLVVM

SEQ ID NO: 343079 - protein, 18 aa, Mycobacterium
LLVQAGYMLIGWQAGLAF

SEQ ID NO: 343080 - protein, 23 aa, Mycobacterium
LLVRPRPASLLLRSVGTRPSVRT

SEQ ID NO: 343081 - protein, 21 aa, Mycobacterium
LLVVVAWALFGWRRRRSGADG

SEQ ID NO: 343082 - protein, 24 aa, Mycobacterium
LLVWLQRIGQLWVFPAYTATLAAI

SEQ ID NO: 343083 - protein, 23 aa, Mycobacterium
LLWFLCSALPIGVIGTFIVLRSY

SEQ ID NO: 343084 - protein, 23 aa, Mycobacterium
LLWGSAGAFGFVERDLGFKIIFG

SEQ ID NO: 343085 - protein, 20 aa, Mycobacterium
LLWLWCYHLGWVVIALAIVA

SEQ ID NO: 343086 - protein, 23 aa, Mycobacterium
LLWQHIVGIPLHWMVLPMSVIVL

SEQ ID NO: 343087 - protein, 19 aa, Mycobacterium
LLWRRGRRTLARLGALAFI

SEQ ID NO: 343088 - protein, 19 aa, Mycobacterium
LLYGLSIPIVILWVLLACG

SEQ ID NO: 343089 - protein, 19 aa, Mycobacterium
LLYRRWIARPGCATESISM

SEQ ID NO: 343090 - protein, 17 aa, Mycobacterium
LMAIAFRLLSPIEHRPL

SEQ ID NO: 343091 - protein, 18 aa, Mycobacterium
LMFFAGLFAMYFTARAQS

SEQ ID NO: 343092 - protein, 18 aa, Mycobacterium
LMFFAGLFAMYFTARSQA

SEQ ID NO: 343093 - protein, 19 aa, Mycobacterium
LMGCTLFAVIGGFLAYFHS

SEQ ID NO: 343094 - protein, 20 aa, Mycobacterium
LMGLACWWVISREVIPRLGA

SEQ ID NO: 343095 - protein, 17 aa, Mycobacterium
LMGLGWPVVVLLALAVA

SEQ ID NO: 343096 - protein, 17 aa, Mycobacterium
LMIFWPFIQLAIQMAVV

SEQ ID NO: 343097 - protein, 19 aa, Mycobacterium
LMIGLRMTLILTVVSIAIA

SEQ ID NO: 343098 - protein, 17 aa, Mycobacterium
LMLLFEWGVAVHDTDIE

SEQ ID NO: 343099 - protein, 23 aa, Mycobacterium
LMLRDVWHAETWRGRIGYLLRPP

SEQ ID NO: 343100 - protein, 18 aa, Mycobacterium
LMMAWTVLDNKIWIMGGV

SEQ ID NO: 343101 - protein, 18 aa, Mycobacterium
LMMPRYRVVWGIVINVVG

SEQ ID NO: 343102 - protein, 18 aa, Mycobacterium
LMPKRGRIAILLFGLSQF

SEQ ID NO: 343103 - protein, 22 aa, Mycobacterium
LMPLRLFPRWIHPFVRNQPISQ

SEQ ID NO: 343104 - protein, 24 aa, Mycobacterium
LMRAAGRPGAALVMDGATATLSVP

SEQ ID NO: 343105 - protein, 19 aa, Mycobacterium
LMRAIICQLAFSHGPDHVQ

SEQ ID NO: 343106 - protein, 18 aa, Mycobacterium
LMRLGPRVAYLVALTVFG

SEQ ID NO: 343107 - protein, 24 aa, Mycobacterium
LMRRSRLPAVRWVAGVYIWVIRGT

SEQ ID NO: 343108 - protein, 17 aa, Mycobacterium
LMSHLAELGWICVAINY

SEQ ID NO: 343109 - protein, 19 aa, Mycobacterium
LMTAWAVVGDKIWIVGGLR

SEQ ID NO: 343110 - protein, 19 aa, Mycobacterium
LMTAWTVLGDKIWIMGGLR

SEQ ID NO: 343111 - protein, 19 aa, Mycobacterium
LMTGVLFVIFGEYRSGSAN

SEQ ID NO: 343112 - protein, 17 aa, Mycobacterium
LMVLAGFALLIWVPALR

SEQ ID NO: 343113 - protein, 17 aa, Mycobacterium
LMVLGLIALVIGVAGGW

SEQ ID NO: 343114 - protein, 22 aa, Mycobacterium
LMWLVLHLVYLVGFKTKVSTLL

SEQ ID NO: 343115 - protein, 21 aa, Mycobacterium
LNAAWSWLFFRFHKLGASAAG

SEQ ID NO: 343116 - protein, 20 aa, Mycobacterium
LNAGWSWLFFRFHRLGASAL

SEQ ID NO: 343117 - protein, 17 aa, Mycobacterium
LNFGPTFTIGAELGPGV

SEQ ID NO: 343118 - protein, 17 aa, Mycobacterium
LNLAWAFGYNIAAIPIA

SEQ ID NO: 343119 - protein, 23 aa, Mycobacterium
LNLKLLVPVFRWQRRDNLVAAAD

SEQ ID NO: 343120 - protein, 17 aa, Mycobacterium
LNLNWPPPCTTGFLPIQ

SEQ ID NO: 343121 - protein, 17 aa, Mycobacterium
LNLPAAWQFSRGDGQLV

SEQ ID NO: 343122 - protein, 18 aa, Mycobacterium
LNLSKDWARAVVDIPVSV

SEQ ID NO: 343123 - protein, 17 aa, Mycobacterium
LNPPEFLTGALANLSGQ

SEQ ID NO: 343124 - protein, 17 aa, Mycobacterium
LNRDVAIKVLRADLARD

SEQ ID NO: 343125 - protein, 17 aa, Mycobacterium
LNRLLALQIPPARKVVT

SEQ ID NO: 343126 - protein, 18 aa, Mycobacterium
LNSAFSFGGPKCLVKVIQ

SEQ ID NO: 343127 - protein, 17 aa, Mycobacterium
LNTMIGVLPRWQPVAIL

SEQ ID NO: 343128 - protein, 27 aa, Mycobacterium
LNTRLRIPVVIGELLAGIVIGRTGFGW

SEQ ID NO: 343129 - protein, 23 aa, Mycobacterium
LNVFWALSWCTRPWPSLRRSRMF

SEQ ID NO: 343130 - protein, 18 aa, Mycobacterium
LNVPLPWSIVLSSTKPGI

SEQ ID NO: 343131 - protein, 18 aa, Mycobacterium
LNWTFGYPLALLVMATVC

SEQ ID NO: 343132 - protein, 17 aa, Mycobacterium
LPAAWQFSRGDGQLVAV

SEQ ID NO: 343133 - protein, 19 aa, Mycobacterium
LPAFRYAAAIAYIGLLCTW

SEQ ID NO: 343134 - protein, 17 aa, Mycobacterium
LPAGPGAVWSQWHSLVF

SEQ ID NO: 343135 - protein, 21 aa, Mycobacterium
LPAIMSVVLALGMRRMAGQNA

SEQ ID NO: 343136 - protein, 20 aa, Mycobacterium
LPAKLKRIFSDPVSVVLVVV

SEQ ID NO: 343137 - protein, 19 aa, Mycobacterium
LPALCFAGAGLAAPWVASR

SEQ ID NO: 343138 - protein, 18 aa, Mycobacterium
LPALNRRQFLGSLAASVV

SEQ ID NO: 343139 - protein, 20 aa, Mycobacterium
LPALQFRYWQWASLALAAPV

SEQ ID NO: 343140 - protein, 26 aa, Mycobacterium
LPALVAFGVVCWWVFFEKGLASAAYD

SEQ ID NO: 343141 - protein, 20 aa, Mycobacterium
LPALVWVLAALRRGRFGVDL

SEQ ID NO: 343142 - protein, 19 aa, Mycobacterium
LPAPMMWAGVSAFDADLMP

SEQ ID NO: 343143 - protein, 17 aa, Mycobacterium
LPARFGVEQVRELAARD

SEQ ID NO: 343144 - protein, 20 aa, Mycobacterium
LPARGIVALCDFGATGTSLT

SEQ ID NO: 343145 - protein, 24 aa, Mycobacterium
LPASTAVAYPAHWTTSAVDALGAA

SEQ ID NO: 343146 - protein, 18 aa, Mycobacterium
LPAVVRWARMPDDVTRAD

SEQ ID NO: 343147 - protein, 17 aa, Mycobacterium
LPAWKIVLILLLLAVLG

SEQ ID NO: 343148 - protein, 18 aa, Mycobacterium
LPCAIGILATMVAALTLT

SEQ ID NO: 343149 - protein, 18 aa, Mycobacterium
LPCSIGLFVVVLASLTFA

SEQ ID NO: 343150 - protein, 17 aa, Mycobacterium
LPCVMFGGQSPATLRRI

SEQ ID NO: 343151 - protein, 24 aa, Mycobacterium
LPDDQFLAWGWRIPFLVSAILIVI

SEQ ID NO: 343152 - protein, 21 aa, Mycobacterium
LPDDRLLLWAGIVTAISMQTK

SEQ ID NO: 343153 - protein, 29 aa, Mycobacterium
LPDEAFLTYGWRIAFLFSIVLVVFGVVVR

SEQ ID NO: 343154 - protein, 23 aa, Mycobacterium
LPDLFAGLVCWLLLSREVLPRLG

SEQ ID NO: 343155 - protein, 19 aa, Mycobacterium
LPDLHAWRPYTVAGLGVGV

SEQ ID NO: 343156 - protein, 24 aa, Mycobacterium
LPEATRAAARWIRPLVPPFVARVI

SEQ ID NO: 343157 - protein, 17 aa, Mycobacterium
LPEPLLRSAMVTLAGTE

SEQ ID NO: 343158 - protein, 18 aa, Mycobacterium
LPERRWAALIKIHHCIAD

SEQ ID NO: 343159 - protein, 19 aa, Mycobacterium
LPESPRWLEIRGRHAEARV

SEQ ID NO: 343160 - protein, 20 aa, Mycobacterium
LPETRWIPVVTFLQVSADMA

SEQ ID NO: 343161 - protein, 20 aa, Mycobacterium
LPEWGTNALYHWPTVILGAV

SEQ ID NO: 343162 - protein, 20 aa, Mycobacterium
LPFDPRLRRMAVVAADQILV

SEQ ID NO: 343163 - protein, 17 aa, Mycobacterium
LPFLLGHPFNLWTATTD

SEQ ID NO: 343164 - protein, 19 aa, Mycobacterium
LPGAIRWTAGAVRQARDYI

SEQ ID NO: 343165 - protein, 23 aa, Mycobacterium
LPGFRHSIGLARWWHLGVDVLWL

SEQ ID NO: 343166 - protein, 20 aa, Mycobacterium
LPGHSWYAFDLSPRISADSW

SEQ ID NO: 343167 - protein, 22 aa, Mycobacterium
LPGMAVFRAVFYFAVEKDFAAG

SEQ ID NO: 343168 - protein, 18 aa, Mycobacterium
LPGWPLWFAGLWSAQEWL

SEQ ID NO: 343169 - protein, 17 aa, Mycobacterium
LPICAAAIILTAVFVPE

SEQ ID NO: 343170 - protein, 18 aa, Mycobacterium
LPIIVFWVLVAVGLGILT

SEQ ID NO: 343171 - protein, 28 aa, Mycobacterium
LPILGLRNEFRWILLVAGFTLFAAADTL

SEQ ID NO: 343172 - protein, 28 aa, Mycobacterium
LPILGWRNDFRWALLMTGLVVFAVADVA

SEQ ID NO: 343173 - protein, 27 aa, Mycobacterium
LPILGWRSEFRWGFLVVGLVGFAVADT

SEQ ID NO: 343174 - protein, 24 aa, Mycobacterium
LPILRLSERLMIWTIFEFLALALV

SEQ ID NO: 343175 - protein, 18 aa, Mycobacterium
LPIPRFVAAQSFWRTPSI

SEQ ID NO: 343176 - protein, 17 aa, Mycobacterium
LPISWPLGIAALGGVPL

SEQ ID NO: 343177 - protein, 24 aa, Mycobacterium
LPKIAWPSVFLIVGIVTYVGLLQE

SEQ ID NO: 343178 - protein, 18 aa, Mycobacterium
LPLACWTCGVFSAVGGLG

SEQ ID NO: 343179 - protein, 17 aa, Mycobacterium
LPLALPVLIASLRVVAV

SEQ ID NO: 343180 - protein, 17 aa, Mycobacterium
LPLFAIGVFIGFTISQT

SEQ ID NO: 343181 - protein, 22 aa, Mycobacterium
LPLGFSGAFAWFAGLSLLAGAV

SEQ ID NO: 343182 - protein, 17 aa, Mycobacterium
LPLGLVFGWLGKRLAVA

SEQ ID NO: 343183 - protein, 17 aa, Mycobacterium
LPLGTAVAIEFLGPIGV

SEQ ID NO: 343184 - protein, 21 aa, Mycobacterium
LPLKRAVVLRGLLSWPEDSAA

SEQ ID NO: 343185 - protein, 24 aa, Mycobacterium
LPLLFAVGVAIGFARKADGSTALA

SEQ ID NO: 343186 - protein, 18 aa, Mycobacterium
LPLLIAWRSVGGVAAAAF

SEQ ID NO: 343187 - protein, 18 aa, Mycobacterium
LPLRAMVMVLLFLGVIFL

SEQ ID NO: 343188 - protein, 17 aa, Mycobacterium
LPLREILPAVQRIVQPA

SEQ ID NO: 343189 - protein, 17 aa, Mycobacterium
LPLVLGIAELLGRIPLP

SEQ ID NO: 343190 - protein, 17 aa, Mycobacterium
LPLVLGLIAAITFTLLF

SEQ ID NO: 343191 - protein, 20 aa, Mycobacterium
LPLVYGALYLWAFWDPFGHT

SEQ ID NO: 343192 - protein, 19 aa, Mycobacterium
LPNRFMLVGPYSWTGTSFH

SEQ ID NO: 343193 - protein, 20 aa, Mycobacterium
LPPEARRPAGLKAFAGSAAS

SEQ ID NO: 343194 - protein, 23 aa, Mycobacterium
LPPEVFKNPDFIRGLKMFVSPDG

SEQ ID NO: 343195 - protein, 21 aa, Mycobacterium
LPPHFLNWLFGLFGALALIAA

SEQ ID NO: 343196 - protein, 18 aa, Mycobacterium
LPPLCTWFAAMLFAVVPL

SEQ ID NO: 343197 - protein, 20 aa, Mycobacterium
LPPRWWSIGALDGLVTAVLV

SEQ ID NO: 343198 - protein, 17 aa, Mycobacterium
LPPSAWRSPADESDMDT

SEQ ID NO: 343199 - protein, 18 aa, Mycobacterium
LPPSEWRSPADLTDVDTP

SEQ ID NO: 343200 - protein, 19 aa, Mycobacterium
LPPSEWRSPADLTIADTPD

SEQ ID NO: 343201 - protein, 18 aa, Mycobacterium
LPPSSWRSPADLTDVDTP

SEQ ID NO: 343202 - protein, 20 aa, Mycobacterium
LPPTSVVGLWTFDGHEGRSE

SEQ ID NO: 343203 - protein, 21 aa, Mycobacterium
LPQPHCPAGFDVADETARGPH

SEQ ID NO: 343204 - protein, 19 aa, Mycobacterium
LPQTRWIPLVTFLQVSADM

SEQ ID NO: 343205 - protein, 19 aa, Mycobacterium
LPQTRWIPVVTFLQVSADM

SEQ ID NO: 343206 - protein, 20 aa, Mycobacterium
LPQTRWIPVVTFLQVTADMA

SEQ ID NO: 343207 - protein, 20 aa, Mycobacterium
LPRGRQWLRLGVVAAGVVAG

SEQ ID NO: 343208 - protein, 24 aa, Mycobacterium
LPRKRLRVAGMTFGAVAVAVVASA

SEQ ID NO: 343209 - protein, 21 aa, Mycobacterium
LPRLLRSLAVLIGMIAGTVIA

SEQ ID NO: 343210 - protein, 21 aa, Mycobacterium
LPRPWSLRARLLAVQAALLAF

SEQ ID NO: 343211 - protein, 21 aa, Mycobacterium
LPRRKRFWLSLYVPVIMRVAC

SEQ ID NO: 343212 - protein, 18 aa, Mycobacterium
LPRTRVGAWLGRPMTSFH

SEQ ID NO: 343213 - protein, 30 aa, Mycobacterium
LPSESFDSWGWRLPFLAAFPLLGVALWIRL

SEQ ID NO: 343214 - protein, 18 aa, Mycobacterium
LPSIPGWLWFLLLLGAVT

SEQ ID NO: 343215 - protein, 17 aa, Mycobacterium
LPSIPRWLWILLALGFG

SEQ ID NO: 343216 - protein, 17 aa, Mycobacterium
LPSPRRWIWIVLAVGGI

SEQ ID NO: 343217 - protein, 18 aa, Mycobacterium
LPSSVLAGVVAFDYQPRL

SEQ ID NO: 343218 - protein, 29 aa, Mycobacterium
LPTIIYSLYWKRFNTRGALWSMYGGLIST

SEQ ID NO: 343219 - protein, 24 aa, Mycobacterium
LPTLAMALTCWWLISREVIPRLGH

SEQ ID NO: 343220 - protein, 18 aa, Mycobacterium
LPTLGLWVSIPMALGRKK

SEQ ID NO: 343221 - protein, 24 aa, Mycobacterium
LPTYRYGWWPATAITVVALILLAV

SEQ ID NO: 343222 - protein, 19 aa, Mycobacterium
LPVAVFRSGMIMVDPTYAG

SEQ ID NO: 343223 - protein, 19 aa, Mycobacterium
LPVDFGIGVSAGRVFAGNV

SEQ ID NO: 343224 - protein, 17 aa, Mycobacterium
LPVFFLLPVSVAFQERP

SEQ ID NO: 343225 - protein, 17 aa, Mycobacterium
LPVILLWIALTVGANLL

SEQ ID NO: 343226 - protein, 18 aa, Mycobacterium
LPVLLAWAIVRRRSGKPV

SEQ ID NO: 343227 - protein, 19 aa, Mycobacterium
LPVLLGLIFALLVLRDYRA

SEQ ID NO: 343228 - protein, 17 aa, Mycobacterium
LPVLWIFSLSLKPTSTV

SEQ ID NO: 343229 - protein, 21 aa, Mycobacterium
LPVSVALAWVFGKLGWNAATP

SEQ ID NO: 343230 - protein, 17 aa, Mycobacterium
LPWEVYAVIGLVAIAAL

SEQ ID NO: 343231 - protein, 18 aa, Mycobacterium
LPWVLIDTAVTWGFGIID

SEQ ID NO: 343232 - protein, 23 aa, Mycobacterium
LPYPGRIGLLFAVMPFHAFFGIA

SEQ ID NO: 343233 - protein, 18 aa, Mycobacterium
LPYTFAVPIFGGRNWTII

SEQ ID NO: 343234 - protein, 19 aa, Mycobacterium
LPYTFAVPIFGGRNWTTIS

SEQ ID NO: 343235 - protein, 18 aa, Mycobacterium
LPYTFAVPLFGGRNWTTI

SEQ ID NO: 343236 - protein, 19 aa, Mycobacterium
LQAAALRPGNIVTVAGVQV

SEQ ID NO: 343237 - protein, 20 aa, Mycobacterium
LQACVFWRGMEAIRKFIDFC

SEQ ID NO: 343238 - protein, 19 aa, Mycobacterium
LQACVFWRGMESIRKFIDF

SEQ ID NO: 343239 - protein, 22 aa, Mycobacterium
LQADCYAGVWAHYAAITKQEGT

SEQ ID NO: 343240 - protein, 21 aa, Mycobacterium
LQADCYAGVWAHYASITRQES

SEQ ID NO: 343241 - protein, 20 aa, Mycobacterium
LQADCYAGVWAHYASTVRQE

SEQ ID NO: 343242 - protein, 21 aa, Mycobacterium
LQADCYAGVWAKHASTTVQEG

SEQ ID NO: 343243 - protein, 20 aa, Mycobacterium
LQATMSWHWVFIVTGAIGIG

SEQ ID NO: 343244 - protein, 25 aa, Mycobacterium
LQDGIVWELRLPRVLLAAACGSGLA

SEQ ID NO: 343245 - protein, 23 aa, Mycobacterium
LQDRFPTVPFWTWIVGFAALTTV

SEQ ID NO: 343246 - protein, 23 aa, Mycobacterium
LQEPYRLGCLNARNELSLIGANE

SEQ ID NO: 343247 - protein, 17 aa, Mycobacterium
LQGADQLLVRWQQANDR

SEQ ID NO: 343248 - protein, 17 aa, Mycobacterium
LQIDHFWWSAIWAAILL

SEQ ID NO: 343249 - protein, 17 aa, Mycobacterium
LQIDHFWWTAIWAAIAL

SEQ ID NO: 343250 - protein, 17 aa, Mycobacterium
LQIDHFWWTAIWAAIVL

SEQ ID NO: 343251 - protein, 17 aa, Mycobacterium
LQKAASLPGGWLTATVL

SEQ ID NO: 343252 - protein, 24 aa, Mycobacterium
LQKLVFRILIGVLWLAPIGAFGAI

SEQ ID NO: 343253 - protein, 18 aa, Mycobacterium
LQLFGVVCPIELLHTQLI

SEQ ID NO: 343254 - protein, 18 aa, Mycobacterium
LQLFISCVEEVLQRNQIP

SEQ ID NO: 343255 - protein, 17 aa, Mycobacterium
LQLPGWITQRLWWALLL

SEQ ID NO: 343256 - protein, 20 aa, Mycobacterium
LQMAFRFWAFRRWVFPDEFA

SEQ ID NO: 343257 - protein, 21 aa, Mycobacterium
LQMAFRFWAFRRWVFPDQFAR

SEQ ID NO: 343258 - protein, 17 aa, Mycobacterium
LQNPGWRPGVWACSLAM

SEQ ID NO: 343259 - protein, 17 aa, Mycobacterium
LQPPPGYKDTTVPGIWS

SEQ ID NO: 343260 - protein, 18 aa, Mycobacterium
LQRMAFRFNECSTQAVAA

SEQ ID NO: 343261 - protein, 23 aa, Mycobacterium
LQSWTIFYWAWWVSWTPFVGMFI

SEQ ID NO: 343262 - protein, 20 aa, Mycobacterium
LQTRAVWRLVNFLLEGLVFL

SEQ ID NO: 343263 - protein, 18 aa, Mycobacterium
LQVCDAYGWAPAVMGASA

SEQ ID NO: 343264 - protein, 24 aa, Mycobacterium
LQVILGWRPVLLIPLTFALFTPLG

SEQ ID NO: 343265 - protein, 23 aa, Mycobacterium
LQWPMFAGFCFYAYYKFVRYEEA

SEQ ID NO: 343266 - protein, 20 aa, Mycobacterium
LRAAGIPVLRRLMTRDVTTE

SEQ ID NO: 343267 - protein, 19 aa, Mycobacterium
LRAALPVTFVTFGLAYLAI

SEQ ID NO: 343268 - protein, 20 aa, Mycobacterium
LRAALPVTFVTFGLGYLAII

SEQ ID NO: 343269 - protein, 19 aa, Mycobacterium
LRAAMQIRRIDPWATLKVS

SEQ ID NO: 343270 - protein, 17 aa, Mycobacterium
LRAGHWLMFAVISLSTF

SEQ ID NO: 343271 - protein, 17 aa, Mycobacterium
LRAIVAALLEWQRKSEL

SEQ ID NO: 343272 - protein, 18 aa, Mycobacterium
LRALRVAILPAPPPPGPA

SEQ ID NO: 343273 - protein, 18 aa, Mycobacterium
LRAQVLLGLRERELCPAA

SEQ ID NO: 343274 - protein, 19 aa, Mycobacterium
LRARLCALHAFIGAPQSRA

SEQ ID NO: 343275 - protein, 19 aa, Mycobacterium
LRASDGFRRRAWIVPVVIG

SEQ ID NO: 343276 - protein, 19 aa, Mycobacterium
LRASIGMVLQDTWLFAGTI

SEQ ID NO: 343277 - protein, 22 aa, Mycobacterium
LRATMLAHWVWLCLLLAGAAGM

SEQ ID NO: 343278 - protein, 20 aa, Mycobacterium
LRAVLPLAVHGKWVVLHNPN

SEQ ID NO: 343279 - protein, 20 aa, Mycobacterium
LRAVRQWRYLVGIGLDVVGF

SEQ ID NO: 343280 - protein, 18 aa, Mycobacterium
LRCAARCVSMCGMREHGA

SEQ ID NO: 343281 - protein, 19 aa, Mycobacterium
LRESHDWSLADLAAATGVS

SEQ ID NO: 343282 - protein, 18 aa, Mycobacterium
LRESLALRWIMSGASPVP

SEQ ID NO: 343283 - protein, 21 aa, Mycobacterium
LREVLPLVVPVILASLLFAGG

SEQ ID NO: 343284 - protein, 17 aa, Mycobacterium
LRFAARALNLWSSDLPF

SEQ ID NO: 343285 - protein, 17 aa, Mycobacterium
LRFAQLVGLVFAAAGVV

SEQ ID NO: 343286 - protein, 24 aa, Mycobacterium
LRFAYLRPPGMTWLDALYFSTETI

SEQ ID NO: 343287 - protein, 20 aa, Mycobacterium
LRFFGERLVRVMNENDMLEG

SEQ ID NO: 343288 - protein, 20 aa, Mycobacterium
LRFIITVTLIVVFLILAALL

SEQ ID NO: 343289 - protein, 17 aa, Mycobacterium
LRFLIPLADKMIRVDQR

SEQ ID NO: 343290 - protein, 21 aa, Mycobacterium
LRFLNDWQRPFIGRKTFMDLV

SEQ ID NO: 343291 - protein, 25 aa, Mycobacterium
LRFPFDPRLRRMAVVLAEEVVVKGA

SEQ ID NO: 343292 - protein, 17 aa, Mycobacterium
LRFPLAWAPPEANVARI

SEQ ID NO: 343293 - protein, 18 aa, Mycobacterium
LRFSTVLIRVLRDGGIML

SEQ ID NO: 343294 - protein, 17 aa, Mycobacterium
LRFYGWRIPGLRTLYAF

SEQ ID NO: 343295 - protein, 19 aa, Mycobacterium
LRFYLGWITHTGYTYGALS

SEQ ID NO: 343296 - protein, 18 aa, Mycobacterium
LRFYLTWITSTGYTYGAL

SEQ ID NO: 343297 - protein, 18 aa, Mycobacterium
LRGAIGFSSFAVLLYYAI

SEQ ID NO: 343298 - protein, 18 aa, Mycobacterium
LRGAIGFSSFAVLVYYAV

SEQ ID NO: 343299 - protein, 17 aa, Mycobacterium
LRGAMLLGVALGLMTLG

SEQ ID NO: 343300 - protein, 19 aa, Mycobacterium
LRGAVAFNNVHFGYVPGRP

SEQ ID NO: 343301 - protein, 18 aa, Mycobacterium
LRHPWLYFVSSLFTSFAF

SEQ ID NO: 343302 - protein, 17 aa, Mycobacterium
LRHTLWWLGSLAALGSF

SEQ ID NO: 343303 - protein, 19 aa, Mycobacterium
LRIAWDKHRVALFAGAPTA

SEQ ID NO: 343304 - protein, 18 aa, Mycobacterium
LRIFAVGLMFAGVTTTAL

SEQ ID NO: 343305 - protein, 19 aa, Mycobacterium
LRILFDLPLLLGGIITGLV

SEQ ID NO: 343306 - protein, 18 aa, Mycobacterium
LRIPAIGVALLLLSSLVV

SEQ ID NO: 343307 - protein, 17 aa, Mycobacterium
LRIPFGHELKTGDVMYL

SEQ ID NO: 343308 - protein, 19 aa, Mycobacterium
LRIPLSVGDIVKRVFLGKP

SEQ ID NO: 343309 - protein, 22 aa, Mycobacterium
LRISNWPLYMADGFVAAFQTAS

SEQ ID NO: 343310 - protein, 18 aa, Mycobacterium
LRITRWDVGIAMLVAGAV

SEQ ID NO: 343311 - protein, 17 aa, Mycobacterium
LRKAFGWFVLAMSSVIL

SEQ ID NO: 343312 - protein, 20 aa, Mycobacterium
LRKAGYRPALIVGDPDKIST

SEQ ID NO: 343313 - protein, 19 aa, Mycobacterium
LRKDLTWKDLVVFGVSVVI

SEQ ID NO: 343314 - protein, 17 aa, Mycobacterium
LRKDLTWWDLTVFGVSV

SEQ ID NO: 343315 - protein, 21 aa, Mycobacterium
LRKLKDPSWRVGAWVCSVIVV

SEQ ID NO: 343316 - protein, 26 aa, Mycobacterium
LRKRRWALRFAVFFTFATGFWVFVTA

SEQ ID NO: 343317 - protein, 17 aa, Mycobacterium
LRLALPMKGNGDAAFLA

SEQ ID NO: 343318 - protein, 17 aa, Mycobacterium
LRLAMPLGDDSDASFLA

SEQ ID NO: 343319 - protein, 22 aa, Mycobacterium
LRLAPWDVICTVALLVALVVLA

SEQ ID NO: 343320 - protein, 17 aa, Mycobacterium
LRLFGIGVPVFIGLLAG

SEQ ID NO: 343321 - protein, 17 aa, Mycobacterium
LRLGWLVLPASLLDAVV

SEQ ID NO: 343322 - protein, 19 aa, Mycobacterium
LRLIISDRGYFIFLALLPF

SEQ ID NO: 343323 - protein, 19 aa, Mycobacterium
LRLKGRLLFEPNVMVTSVP

SEQ ID NO: 343324 - protein, 19 aa, Mycobacterium
LRLKGRLLFVPNVMVTSVP

SEQ ID NO: 343325 - protein, 23 aa, Mycobacterium
LRLKVELPFIGLYVHTGGVAVDT

SEQ ID NO: 343326 - protein, 21 aa, Mycobacterium
LRLLAGLIWLYNVVWKLPPDF

SEQ ID NO: 343327 - protein, 19 aa, Mycobacterium
LRLLQGFAVGGEWAGSALL

SEQ ID NO: 343328 - protein, 21 aa, Mycobacterium
LRLLYGIGMGGEWGLGAALAM

SEQ ID NO: 343329 - protein, 17 aa, Mycobacterium
LRLPFVFSGVTLYATAA

SEQ ID NO: 343330 - protein, 18 aa, Mycobacterium
LRLPNWGTLKLALPKLDN

SEQ ID NO: 343331 - protein, 20 aa, Mycobacterium
LRLPRMTRATVIVGTLIVVL

SEQ ID NO: 343332 - protein, 18 aa, Mycobacterium
LRLRLSRSVTVVVGGDDD

SEQ ID NO: 343333 - protein, 20 aa, Mycobacterium
LRLTIFQPYSWVAAAAVLVL

SEQ ID NO: 343334 - protein, 17 aa, Mycobacterium
LRLVLIGSVIGTVLGVV

SEQ ID NO: 343335 - protein, 20 aa, Mycobacterium
LRMAFLLGAAMLIDFRFLAA

SEQ ID NO: 343336 - protein, 19 aa, Mycobacterium
LRMFLSFMGSALWRAPSAW

SEQ ID NO: 343337 - protein, 18 aa, Mycobacterium
LRMSVRFIRRVAFTGYVV

SEQ ID NO: 343338 - protein, 21 aa, Mycobacterium
LRNWPAWLAVYGFFSMDRWLL

SEQ ID NO: 343339 - protein, 19 aa, Mycobacterium
LRPAASYRSFVTWLSERDQ

SEQ ID NO: 343340 - protein, 20 aa, Mycobacterium
LRPAESGPRRQRRLSPVGGP

SEQ ID NO: 343341 - protein, 20 aa, Mycobacterium
LRPGIPAAFDAVIARGMAKR

SEQ ID NO: 343342 - protein, 20 aa, Mycobacterium
LRPGIPATFDAVIARGMAKR

SEQ ID NO: 343343 - protein, 17 aa, Mycobacterium
LRPGQPITVAGIPVGNV

SEQ ID NO: 343344 - protein, 18 aa, Mycobacterium
LRPGRAVPVAARGAVTTY

SEQ ID NO: 343345 - protein, 19 aa, Mycobacterium
LRPGSALTYNDIRLETRSA

SEQ ID NO: 343346 - protein, 17 aa, Mycobacterium
LRPGWIVLALVVIAFAY

SEQ ID NO: 343347 - protein, 17 aa, Mycobacterium
LRPLLAIIVFTAMLGPK

SEQ ID NO: 343348 - protein, 17 aa, Mycobacterium
LRPRALRALDRVDAIMI

SEQ ID NO: 343349 - protein, 19 aa, Mycobacterium
LRPRVLRTLDRIDAIMIDP

SEQ ID NO: 343350 - protein, 17 aa, Mycobacterium
LRPSALAGFIAHFSTAV

SEQ ID NO: 343351 - protein, 22 aa, Mycobacterium
LRPSGVLRRLGLVAALPLSLVA

SEQ ID NO: 343352 - protein, 19 aa, Mycobacterium
LRPTPGFPASGVVALCDFG

SEQ ID NO: 343353 - protein, 20 aa, Mycobacterium
LRPVLICVLVAVLAIGAYLV

SEQ ID NO: 343354 - protein, 17 aa, Mycobacterium
LRPVMRVLSLRTIVIVA

SEQ ID NO: 343355 - protein, 26 aa, Mycobacterium
LRQQLRWKKSWLREAPRAMCAVRRKN

SEQ ID NO: 343356 - protein, 26 aa, Mycobacterium
LRRDRFRICMWVGWLTLLMTYTPLAF

SEQ ID NO: 343357 - protein, 25 aa, Mycobacterium
LRRDRIRLSIWIAMLSLLMIYTPNA

SEQ ID NO: 343358 - protein, 18 aa, Mycobacterium
LRRHFDWVRSWYDFAAPD

SEQ ID NO: 343359 - protein, 18 aa, Mycobacterium
LRRLGWVLLIVGGVGVAV

SEQ ID NO: 343360 - protein, 21 aa, Mycobacterium
LRRPIAVWWIVWVLSAIVATW

SEQ ID NO: 343361 - protein, 21 aa, Mycobacterium
LRRRLIICVALSVPVIAMAMA

SEQ ID NO: 343362 - protein, 19 aa, Mycobacterium
LRRRVFRHFGRLDIAFHDR

SEQ ID NO: 343363 - protein, 18 aa, Mycobacterium
LRRSATRFMFEFADDLQN

SEQ ID NO: 343364 - protein, 19 aa, Mycobacterium
LRSAAPVRSRVVAWALWDC

SEQ ID NO: 343365 - protein, 19 aa, Mycobacterium
LRSATFYKLLVAAGLFAFT

SEQ ID NO: 343366 - protein, 19 aa, Mycobacterium
LRSAVPLVALLGCGGALGA

SEQ ID NO: 343367 - protein, 17 aa, Mycobacterium
LRSGMPVATAALVVAAA

SEQ ID NO: 343368 - protein, 21 aa, Mycobacterium
LRSRMGMVLQDTWLFGGTIVE

SEQ ID NO: 343369 - protein, 28 aa, Mycobacterium
LRSRWMTVCVTMVFAVMGAIAYTLLITP

SEQ ID NO: 343370 - protein, 19 aa, Mycobacterium
LRSYFYWEQHCFDIPICWS

SEQ ID NO: 343371 - protein, 20 aa, Mycobacterium
LRTALPITFVTFGLGYLAII

SEQ ID NO: 343372 - protein, 22 aa, Mycobacterium
LRTIRMNMVWAFGYNVAAIPIA

SEQ ID NO: 343373 - protein, 21 aa, Mycobacterium
LRTPELYGWVLAALGGMIFQQ

SEQ ID NO: 343374 - protein, 17 aa, Mycobacterium
LRTPLTFGARGASHSTK

SEQ ID NO: 343375 - protein, 17 aa, Mycobacterium
LRTPRPYLYAGILFFAT

SEQ ID NO: 343376 - protein, 18 aa, Mycobacterium
LRTPRPYLYAGILFFATL

SEQ ID NO: 343377 - protein, 19 aa, Mycobacterium
LRTRSEMIAQLVFAMGGRA

SEQ ID NO: 343378 - protein, 19 aa, Mycobacterium
LRVGGLLPHQLEVARHRRG

SEQ ID NO: 343379 - protein, 19 aa, Mycobacterium
LRVIAEWNPLSSLALALRK

SEQ ID NO: 343380 - protein, 17 aa, Mycobacterium
LRVLPPFLSRKHLPSRL

SEQ ID NO: 343381 - protein, 17 aa, Mycobacterium
LRVLSWLLMPLSRLLVV

SEQ ID NO: 343382 - protein, 25 aa, Mycobacterium
LRVMLGWRPVLLIPLTFALFTPLAV

SEQ ID NO: 343383 - protein, 17 aa, Mycobacterium
LRVNWALGLQLFDYTGE

SEQ ID NO: 343384 - protein, 18 aa, Mycobacterium
LRVTRWDVGLAMIVAGGV

SEQ ID NO: 343385 - protein, 18 aa, Mycobacterium
LRVTRWDVGLAMVLAGGV

SEQ ID NO: 343386 - protein, 17 aa, Mycobacterium
LRVVCAIPSSTSPLDPF

SEQ ID NO: 343387 - protein, 24 aa, Mycobacterium
LRYCNPRTSAVLARLGTPQLLFNY

SEQ ID NO: 343388 - protein, 17 aa, Mycobacterium
LRYITLWAGLTVGAVLG

SEQ ID NO: 343389 - protein, 25 aa, Mycobacterium
LSAFFTPRFVRWFGLINTHVIIAAA

SEQ ID NO: 343390 - protein, 18 aa, Mycobacterium
LSAFKVPTVWLLLHSGDD

SEQ ID NO: 343391 - protein, 17 aa, Mycobacterium
LSALRRLVCPLFEEPTV

SEQ ID NO: 343392 - protein, 20 aa, Mycobacterium
LSAPRLSARIGVGRHIAIAL

SEQ ID NO: 343393 - protein, 23 aa, Mycobacterium
LSARRGLHIVGMFIAVQPLITLV

SEQ ID NO: 343394 - protein, 20 aa, Mycobacterium
LSATCYFFAELMLRPAATIA

SEQ ID NO: 343395 - protein, 18 aa, Mycobacterium
LSAVGGWLYWKGVELDGE

SEQ ID NO: 343396 - protein, 20 aa, Mycobacterium
LSERELRAVLGHELSHVYNR

SEQ ID NO: 343397 - protein, 20 aa, Mycobacterium
LSEWDWRAIFWVGVPLGLLG

SEQ ID NO: 343398 - protein, 17 aa, Mycobacterium
LSFARLNYFHTMGPAVA

SEQ ID NO: 343399 - protein, 20 aa, Mycobacterium
LSFPASAVPPNWTVFSDDQD

SEQ ID NO: 343400 - protein, 19 aa, Mycobacterium
LSFTRLPFFQPLGIPCAVG

SEQ ID NO: 343401 - protein, 18 aa, Mycobacterium
LSFTRLPYFQPLGIPGAV

SEQ ID NO: 343402 - protein, 18 aa, Mycobacterium
LSFTRLPYFQTLALPCSI

SEQ ID NO: 343403 - protein, 19 aa, Mycobacterium
LSFTRLPYFQTLGAPCAIG

SEQ ID NO: 343404 - protein, 18 aa, Mycobacterium
LSFTRLPYFQTLGAPCAV

SEQ ID NO: 343405 - protein, 18 aa, Mycobacterium
LSFTRLPYFQTLGSPCSI

SEQ ID NO: 343406 - protein, 19 aa, Mycobacterium
LSFTRLPYFQTLGVPLAIG

SEQ ID NO: 343407 - protein, 20 aa, Mycobacterium
LSFTRLPYFQTMGIPAAIGM

SEQ ID NO: 343408 - protein, 20 aa, Mycobacterium
LSFTRLPYFQTMGVPCAVGT

SEQ ID NO: 343409 - protein, 20 aa, Mycobacterium
LSFWDWKSIFWALGAAGALV

SEQ ID NO: 343410 - protein, 17 aa, Mycobacterium
LSGAYGQLLAWTRVLGA

SEQ ID NO: 343411 - protein, 18 aa, Mycobacterium
LSGFEHAWFFLFLLVVAG

SEQ ID NO: 343412 - protein, 23 aa, Mycobacterium
LSGMAVGWWVIQRNYYVTEYDGK

SEQ ID NO: 343413 - protein, 23 aa, Mycobacterium
LSIIACLFVLYGLPAVTWLWFSV

SEQ ID NO: 343414 - protein, 19 aa, Mycobacterium
LSLARLPYFRTLGIPCAVG

SEQ ID NO: 343415 - protein, 20 aa, Mycobacterium
LSLAVAAGFLKWQGGSARTA

SEQ ID NO: 343416 - protein, 25 aa, Mycobacterium
LSLFMAIAIAVTWMVYATLRRDVAG

SEQ ID NO: 343417 - protein, 17 aa, Mycobacterium
LSLGETGSRGMLSAGSV

SEQ ID NO: 343418 - protein, 17 aa, Mycobacterium
LSLIIAKRYPNMPVPNL

SEQ ID NO: 343419 - protein, 17 aa, Mycobacterium
LSLIPVLIGMAIAVPLG

SEQ ID NO: 343420 - protein, 17 aa, Mycobacterium
LSLSWPRVTAVFLVDIA

SEQ ID NO: 343421 - protein, 18 aa, Mycobacterium
LSLTPSLMPRTWLFQGLI

SEQ ID NO: 343422 - protein, 25 aa, Mycobacterium
LSMLGELPWWVTVVILVREFGVTVL

SEQ ID NO: 343423 - protein, 18 aa, Mycobacterium
LSNLLPYWILQPFVDAAF

SEQ ID NO: 343424 - protein, 20 aa, Mycobacterium
LSPAEANGWCDANRLGVDDC

SEQ ID NO: 343425 - protein, 18 aa, Mycobacterium
LSPDRFVAWATMVRYQAL

SEQ ID NO: 343426 - protein, 18 aa, Mycobacterium
LSPFKVPSVWALLDDEAA

SEQ ID NO: 343427 - protein, 24 aa, Mycobacterium
LSPLRMPLWLGMLVGNLLSSFVMS

SEQ ID NO: 343428 - protein, 17 aa, Mycobacterium
LSPRAGLVMDVDAKVKY

SEQ ID NO: 343429 - protein, 18 aa, Mycobacterium
LSPVGGPGNRHRRRRRKW

SEQ ID NO: 343430 - protein, 18 aa, Mycobacterium
LSPWWSWRRRPTVADNFM

SEQ ID NO: 343431 - protein, 18 aa, Mycobacterium
LSQAWLAGVGVDWSAVFA

SEQ ID NO: 343432 - protein, 23 aa, Mycobacterium
LSRATLRRHCWRGNGRAWIEVRG

SEQ ID NO: 343433 - protein, 17 aa, Mycobacterium
LSRNWFRRWQLVLCDQA

SEQ ID NO: 343434 - protein, 17 aa, Mycobacterium
LSRRFTVGLAFLAGLSV

SEQ ID NO: 343435 - protein, 18 aa, Mycobacterium
LSRRLLALLIDWLIAGGL

SEQ ID NO: 343436 - protein, 18 aa, Mycobacterium
LSRSEWRLRIHGMVDREV

SEQ ID NO: 343437 - protein, 17 aa, Mycobacterium
LSSAYGQLMAWNRVLGE

SEQ ID NO: 343438 - protein, 18 aa, Mycobacterium
LSSLRAGLIAGAIGLAAV

SEQ ID NO: 343439 - protein, 19 aa, Mycobacterium
LSSLRGRVVLVDFWAYSCI

SEQ ID NO: 343440 - protein, 20 aa, Mycobacterium
LSTPELYAWAVVGILGTSTQ

SEQ ID NO: 343441 - protein, 17 aa, Mycobacterium
LSVLFSFQGNDMMTSFQ

SEQ ID NO: 343442 - protein, 17 aa, Mycobacterium
LSVPPSWAQALPDVESI

SEQ ID NO: 343443 - protein, 25 aa, Mycobacterium
LSVTWKVAVILLICAFVAASGYMMW

SEQ ID NO: 343444 - protein, 20 aa, Mycobacterium
LSWASAAGWWYVSSFGIPFN

SEQ ID NO: 343445 - protein, 20 aa, Mycobacterium
LSWPLWWVAVCSVLCLLIVE

SEQ ID NO: 343446 - protein, 25 aa, Mycobacterium
LSWRAALWSVMSVRWAAFALALFLA

SEQ ID NO: 343447 - protein, 17 aa, Mycobacterium
LSWVLAGLAGVLGATAF

SEQ ID NO: 343448 - protein, 18 aa, Mycobacterium
LSYFKALGIPSALGLLVV

SEQ ID NO: 343449 - protein, 20 aa, Mycobacterium
LSYLCYWLIPFTLFGLAALA

SEQ ID NO: 343450 - protein, 24 aa, Mycobacterium
LSYPRLLAWFTLFLRLCLGGQMLF

SEQ ID NO: 343451 - protein, 22 aa, Mycobacterium
LTAALSLMWGWRLAAVCVTVAA

SEQ ID NO: 343452 - protein, 17 aa, Mycobacterium
LTAFPILVQILAWLIAL

SEQ ID NO: 343453 - protein, 19 aa, Mycobacterium
LTAGEIFAGYTILRLLGSG

SEQ ID NO: 343454 - protein, 18 aa, Mycobacterium
LTAGPVYGRVRIDADGRF

SEQ ID NO: 343455 - protein, 19 aa, Mycobacterium
LTAGVGLWAFLTRFALNCR

SEQ ID NO: 343456 - protein, 18 aa, Mycobacterium
LTAHGALVRAPRTIEALG

SEQ ID NO: 343457 - protein, 23 aa, Mycobacterium
LTAICACMAWSAFLFTMSLYLQG

SEQ ID NO: 343458 - protein, 19 aa, Mycobacterium
LTAIPLWIAFALSTKAATR

SEQ ID NO: 343459 - protein, 24 aa, Mycobacterium
LTALLLAAGFSWAAIQLAHLTGLS

SEQ ID NO: 343460 - protein, 23 aa, Mycobacterium
LTALRRYGCTITQGFVHSPPLPP

SEQ ID NO: 343461 - protein, 17 aa, Mycobacterium
LTALTWPVMANFAVDSA

SEQ ID NO: 343462 - protein, 18 aa, Mycobacterium
LTAMACILGFLLAGVAYL

SEQ ID NO: 343463 - protein, 18 aa, Mycobacterium
LTAVFGWQVLPFLIIQAF

SEQ ID NO: 343464 - protein, 18 aa, Mycobacterium
LTAVFGWQVLPFLIIQGL

SEQ ID NO: 343465 - protein, 18 aa, Mycobacterium
LTAVPLWIAFALGRRAAT

SEQ ID NO: 343466 - protein, 18 aa, Mycobacterium
LTAVPLWIAFALGTRAAT

SEQ ID NO: 343467 - protein, 18 aa, Mycobacterium
LTAVPLWIAFALSTKAAT

SEQ ID NO: 343468 - protein, 23 aa, Mycobacterium
LTAVVCFVGFLGAYLFNVYWQGG

SEQ ID NO: 343469 - protein, 22 aa, Mycobacterium
LTDPRYTAVLGHLISENGRAAY

SEQ ID NO: 343470 - protein, 18 aa, Mycobacterium
LTDVSWRLAFLVNVPIGL

SEQ ID NO: 343471 - protein, 19 aa, Mycobacterium
LTEPIPLRWAKGARLHAEI

SEQ ID NO: 343472 - protein, 21 aa, Mycobacterium
LTEVSWRLAFMVNVPIGLVMI

SEQ ID NO: 343473 - protein, 17 aa, Mycobacterium
LTFETPMLWAFGFLVTF

SEQ ID NO: 343474 - protein, 17 aa, Mycobacterium
LTFFSAVGALVWGTLLA

SEQ ID NO: 343475 - protein, 17 aa, Mycobacterium
LTFHWARVVWQRTIVQL

SEQ ID NO: 343476 - protein, 26 aa, Mycobacterium
LTFRERTVWQWAWRAMSWTRRRVRRL

SEQ ID NO: 343477 - protein, 17 aa, Mycobacterium
LTFWDYPLAAAISVVTL

SEQ ID NO: 343478 - protein, 25 aa, Mycobacterium
LTGGRFRLGVGLGWNAVEYEALGET

SEQ ID NO: 343479 - protein, 25 aa, Mycobacterium
LTGGRLRLGVGLGWNAVEYEALGET

SEQ ID NO: 343480 - protein, 23 aa, Mycobacterium
LTGNRTAQAWARRHRELRAALTP

SEQ ID NO: 343481 - protein, 25 aa, Mycobacterium
LTGPEAFLAFGWRIPFLSSIVLVVV

SEQ ID NO: 343482 - protein, 22 aa, Mycobacterium
LTGVVCFVGFIASFLFNVYFQD

SEQ ID NO: 343483 - protein, 21 aa, Mycobacterium
LTGVVCFVGFLASYLFNVYFQ

SEQ ID NO: 343484 - protein, 23 aa, Mycobacterium
LTGVVCFVGFLGAYLFNVYWQNG

SEQ ID NO: 343485 - protein, 18 aa, Mycobacterium
LTIPRLGSIIARNSLDAP

SEQ ID NO: 343486 - protein, 17 aa, Mycobacterium
LTIPVLLTHQWQLVFVA

SEQ ID NO: 343487 - protein, 17 aa, Mycobacterium
LTKVILPMIKPAILVAL

SEQ ID NO: 343488 - protein, 20 aa, Mycobacterium
LTLGDGRVVIWGTTDRTDEK

SEQ ID NO: 343489 - protein, 20 aa, Mycobacterium
LTLGSWATSCAWAFSLAMID

SEQ ID NO: 343490 - protein, 25 aa, Mycobacterium
LTLLLCLAVMAWLSLPLALLVVLLV

SEQ ID NO: 343491 - protein, 18 aa, Mycobacterium
LTLRHAFQALRESENVSS

SEQ ID NO: 343492 - protein, 17 aa, Mycobacterium
LTLVIGIAPILAPSLGA

SEQ ID NO: 343493 - protein, 18 aa, Mycobacterium
LTLVRSDGDWRITQMPAL

SEQ ID NO: 343494 - protein, 19 aa, Mycobacterium
LTMDRWLLWQLPSTGRAFE

SEQ ID NO: 343495 - protein, 20 aa, Mycobacterium
LTMVHLRLSLIPVLIGTAIA

SEQ ID NO: 343496 - protein, 27 aa, Mycobacterium
LTPEAFLSYGWRIAFLVSIVLVIFGVV

SEQ ID NO: 343497 - protein, 18 aa, Mycobacterium
LTPFPWNQLHQFLELFMK

SEQ ID NO: 343498 - protein, 26 aa, Mycobacterium
LTPPEWWRLGAMFAFIAALHVVGWGT

SEQ ID NO: 343499 - protein, 22 aa, Mycobacterium
LTPPRLARYVKLEVTGPAQQHV

SEQ ID NO: 343500 - protein, 19 aa, Mycobacterium
LTPSLAWNTAVSFVTNTNW

SEQ ID NO: 343501 - protein, 17 aa, Mycobacterium
LTPVFCMLLPISVVPLA

SEQ ID NO: 343502 - protein, 17 aa, Mycobacterium
LTPWIVVGVFAFGAAMA

SEQ ID NO: 343503 - protein, 25 aa, Mycobacterium
LTRLTARWRLPAVIQLAVRSLTRSR

SEQ ID NO: 343504 - protein, 17 aa, Mycobacterium
LTRSSPRLLPWAVASIA

SEQ ID NO: 343505 - protein, 19 aa, Mycobacterium
LTRWQSFRLILLPSAMPDI

SEQ ID NO: 343506 - protein, 19 aa, Mycobacterium
LTSCWRLFVPGGFLDASHG

SEQ ID NO: 343507 - protein, 18 aa, Mycobacterium
LTSMYGYGVGYAIASLSC

SEQ ID NO: 343508 - protein, 22 aa, Mycobacterium
LTSPEFIPWLLVALTGMVFQQS

SEQ ID NO: 343509 - protein, 21 aa, Mycobacterium
LTSPEFVPWLLVALAGMIFQQ

SEQ ID NO: 343510 - protein, 23 aa, Mycobacterium
LTSRPGPEPDLGFSQPSSRASLW

SEQ ID NO: 343511 - protein, 25 aa, Mycobacterium
LTTRFWRRSGIRIVRRPKVNLIASV

SEQ ID NO: 343512 - protein, 24 aa, Mycobacterium
LTTRFWRRSGIRIVRRPVPHLVGS

SEQ ID NO: 343513 - protein, 17 aa, Mycobacterium
LTVEAWAFLQLGSRQQS

SEQ ID NO: 343514 - protein, 23 aa, Mycobacterium
LTVLRWSWTPALLAGGLMTLMPL

SEQ ID NO: 343515 - protein, 20 aa, Mycobacterium
LTVVHLRLSLVPVLVGLALA

SEQ ID NO: 343516 - protein, 22 aa, Mycobacterium
LTWVASPGRRLWMKLEYRPDVV

SEQ ID NO: 343517 - protein, 19 aa, Mycobacterium
LTYGWRIPLLLGAPFGLFA

SEQ ID NO: 343518 - protein, 23 aa, Mycobacterium
LTYGWRIPLLLGLPFGLVALFLR

SEQ ID NO: 343519 - protein, 19 aa, Mycobacterium
LTYTGSILGTWGYMAPERF

SEQ ID NO: 343520 - protein, 25 aa, Mycobacterium
LVAACLRIPYSLGIATFGGRNWTVF

SEQ ID NO: 343521 - protein, 18 aa, Mycobacterium
LVAAIVLQAIAAVVVVLL

SEQ ID NO: 343522 - protein, 17 aa, Mycobacterium
LVADALRALAYTATGGH

SEQ ID NO: 343523 - protein, 17 aa, Mycobacterium
LVAFAWRQPRFDPLKPG

SEQ ID NO: 343524 - protein, 25 aa, Mycobacterium
LVAGWPRSRWWRRGASALAIPMSVL

SEQ ID NO: 343525 - protein, 25 aa, Mycobacterium
LVALRFGVTIALAWVSWRFVEQPVR

SEQ ID NO: 343526 - protein, 25 aa, Mycobacterium
LVAMFKWPFPWREFLLQSWFVARVS

SEQ ID NO: 343527 - protein, 18 aa, Mycobacterium
LVCLLALGELIWRGRGLL

SEQ ID NO: 343528 - protein, 17 aa, Mycobacterium
LVCLRLVPPATLTRRDE

SEQ ID NO: 343529 - protein, 17 aa, Mycobacterium
LVCSGALGYGKSYAAKR

SEQ ID NO: 343530 - protein, 20 aa, Mycobacterium
LVDRPLRVVVAGQLKQGKSQ

SEQ ID NO: 343531 - protein, 17 aa, Mycobacterium
LVDRWAPGRVMINAYGP

SEQ ID NO: 343532 - protein, 17 aa, Mycobacterium
LVDRWAPGRVMVNAYGP

SEQ ID NO: 343533 - protein, 26 aa, Mycobacterium
LVDVRSFRALARFRRSEVVLAALTAI

SEQ ID NO: 343534 - protein, 29 aa, Mycobacterium
LVEGPPPRWPWVVGVTAIIAAIALVASVA

SEQ ID NO: 343535 - protein, 19 aa, Mycobacterium
LVEIIKEFAFFLVVAGLAA

SEQ ID NO: 343536 - protein, 20 aa, Mycobacterium
LVETLLRWFGAKRMPYAMSL

SEQ ID NO: 343537 - protein, 18 aa, Mycobacterium
LVFARVAASLVIFAMAAT

SEQ ID NO: 343538 - protein, 17 aa, Mycobacterium
LVFGRAAAVVVVLIAAV

SEQ ID NO: 343539 - protein, 18 aa, Mycobacterium
LVFVRWWGLPAWSWAVLW

SEQ ID NO: 343540 - protein, 21 aa, Mycobacterium
LVGGLGWEWIFFVNIPIGVLG

SEQ ID NO: 343541 - protein, 23 aa, Mycobacterium
LVGLAVGCVNGFLVSRINVPPFI

SEQ ID NO: 343542 - protein, 20 aa, Mycobacterium
LVGLLMRWRNRYGWSAFVFG

SEQ ID NO: 343543 - protein, 17 aa, Mycobacterium
LVGLRLGLSSAWLSLIF

SEQ ID NO: 343544 - protein, 24 aa, Mycobacterium
LVGRPRTWPAIALSAIAALLAVGA

SEQ ID NO: 343545 - protein, 24 aa, Mycobacterium
LVGVLALAGLAGWLGYQTYESHQA

SEQ ID NO: 343546 - protein, 22 aa, Mycobacterium
LVGWLSLWPFLNWLTTHFVITD

SEQ ID NO: 343547 - protein, 21 aa, Mycobacterium
LVIALFRWFPQITVWTGLSLL

SEQ ID NO: 343548 - protein, 21 aa, Mycobacterium
LVIFPMYFLRSFAYAGVAVVA

SEQ ID NO: 343549 - protein, 30 aa, Mycobacterium
LVIGFVLGWPWWWISACSVLVLLIAEGVAV

SEQ ID NO: 343550 - protein, 20 aa, Mycobacterium
LVIGLAFAWGRRLLRRLPHD

SEQ ID NO: 343551 - protein, 17 aa, Mycobacterium
LVLACIVLAGLVGMCSF

SEQ ID NO: 343552 - protein, 17 aa, Mycobacterium
LVLACWLWSGGAHIPMS

SEQ ID NO: 343553 - protein, 17 aa, Mycobacterium
LVLAIGVVFWHSWPLTG

SEQ ID NO: 343554 - protein, 20 aa, Mycobacterium
LVLGIWWRRLTVVGAASGLV

SEQ ID NO: 343555 - protein, 23 aa, Mycobacterium
LVLGWRGARSWRRGAGLLAVPLC

SEQ ID NO: 343556 - protein, 17 aa, Mycobacterium
LVLIGSVIGTVLGVVAG

SEQ ID NO: 343557 - protein, 25 aa, Mycobacterium
LVLMAWGAFRLWRWRRRRAKSTHPS

SEQ ID NO: 343558 - protein, 20 aa, Mycobacterium
LVLMWWRRPPVRSDYPPERA

SEQ ID NO: 343559 - protein, 18 aa, Mycobacterium
LVLVPVFLLALFAGDGQE

SEQ ID NO: 343560 - protein, 17 aa, Mycobacterium
LVLYCFTLPFAMVETFG

SEQ ID NO: 343561 - protein, 19 aa, Mycobacterium
LVMGVSLLIARGVIAGLAE

SEQ ID NO: 343562 - protein, 23 aa, Mycobacterium
LVNFGALFGFCLLHASVIWFYLV

SEQ ID NO: 343563 - protein, 17 aa, Mycobacterium
LVNMYGITETTVHASFR

SEQ ID NO: 343564 - protein, 18 aa, Mycobacterium
LVPLPLFFCHGGWPVTVA

SEQ ID NO: 343565 - protein, 18 aa, Mycobacterium
LVPLPLFFCHSGWPITVA

SEQ ID NO: 343566 - protein, 24 aa, Mycobacterium
LVPQEGFCVYPWSPLRLINGTVGY

SEQ ID NO: 343567 - protein, 18 aa, Mycobacterium
LVPRDARLNPALMLLSVF

SEQ ID NO: 343568 - protein, 23 aa, Mycobacterium
LVPRFRLGTLTIWVGFIAAFFIV

SEQ ID NO: 343569 - protein, 17 aa, Mycobacterium
LVQMVAWALFKNPWIMP

SEQ ID NO: 343570 - protein, 25 aa, Mycobacterium
LVRKGFWRLLGILVLTGFIVGFVSM

SEQ ID NO: 343571 - protein, 17 aa, Mycobacterium
LVRPRPASTMLRPTGPR

SEQ ID NO: 343572 - protein, 24 aa, Mycobacterium
LVSPWPVRLFWLLLLALALLIAVD

SEQ ID NO: 343573 - protein, 18 aa, Mycobacterium
LVTLCPAVAILAIGFDPT

SEQ ID NO: 343574 - protein, 18 aa, Mycobacterium
LVTLCPAVAILALGLDPT

SEQ ID NO: 343575 - protein, 17 aa, Mycobacterium
LVTPRLAAILFVSPLLC

SEQ ID NO: 343576 - protein, 18 aa, Mycobacterium
LVTSPGFAGVWVAAAAAS

SEQ ID NO: 343577 - protein, 24 aa, Mycobacterium
LVVALWRFRWIRLAMISALLATLG

SEQ ID NO: 343578 - protein, 19 aa, Mycobacterium
LVVGAGWPLIVEQFSVKPN

SEQ ID NO: 343579 - protein, 20 aa, Mycobacterium
LVVGAGWPLIVEQFSVKPNA

SEQ ID NO: 343580 - protein, 20 aa, Mycobacterium
LVVGAGWPLVVEQISVRPNA

SEQ ID NO: 343581 - protein, 17 aa, Mycobacterium
LVVLTCRAVAISPYDRA

SEQ ID NO: 343582 - protein, 18 aa, Mycobacterium
LVVPRLLAAMVIGVALCG

SEQ ID NO: 343583 - protein, 17 aa, Mycobacterium
LVVSEWVRGGSLQEVAD

SEQ ID NO: 343584 - protein, 18 aa, Mycobacterium
LVVWEIFSDLTFVIPSPV

SEQ ID NO: 343585 - protein, 24 aa, Mycobacterium
LVWEYLFGIKLYWVVLALAVILLL

SEQ ID NO: 343586 - protein, 17 aa, Mycobacterium
LVWPALILGVAWWLRRR

SEQ ID NO: 343587 - protein, 17 aa, Mycobacterium
LVWQHFLGIPLSWLNLP

SEQ ID NO: 343588 - protein, 18 aa, Mycobacterium
LVYLQFRGDFLPRTQLTM

SEQ ID NO: 343589 - protein, 24 aa, Mycobacterium
LVYLVYRSGWRWSDPEDRPGVLDW

SEQ ID NO: 343590 - protein, 17 aa, Mycobacterium
LVYMASYWSWFASETGI

SEQ ID NO: 343591 - protein, 18 aa, Mycobacterium
LWAAMAMWLVLWVLYLSI

SEQ ID NO: 343592 - protein, 17 aa, Mycobacterium
LWAFELTSALLITAAIG

SEQ ID NO: 343593 - protein, 19 aa, Mycobacterium
LWAFSLAMIDGWQRGFAGR

SEQ ID NO: 343594 - protein, 17 aa, Mycobacterium
LWALALAFRRSRPMVSL

SEQ ID NO: 343595 - protein, 18 aa, Mycobacterium
LWFFLTWFPTYLVEYRGM

SEQ ID NO: 343596 - protein, 17 aa, Mycobacterium
LWGSFGMLVFVFVAGGL

SEQ ID NO: 343597 - protein, 17 aa, Mycobacterium
LWHVPGVRRRLVVGWLV

SEQ ID NO: 343598 - protein, 24 aa, Mycobacterium
LWLMKRWGEYFAVIATSIFLPLEI

SEQ ID NO: 343599 - protein, 17 aa, Mycobacterium
LWLPTYLAWFVAGMMLA

SEQ ID NO: 343600 - protein, 17 aa, Mycobacterium
LWPAFDAIRRVPKAAQN

SEQ ID NO: 343601 - protein, 18 aa, Mycobacterium
LWPFHRWLPDAAVEATPA

SEQ ID NO: 343602 - protein, 19 aa, Mycobacterium
LWPTVVCLTGYAISFALLA

SEQ ID NO: 343603 - protein, 20 aa, Mycobacterium
LWQYILGINLHWMVLAMAII

SEQ ID NO: 343604 - protein, 22 aa, Mycobacterium
LWQYILGLKLHWMVLAMAVILL

SEQ ID NO: 343605 - protein, 22 aa, Mycobacterium
LWQYIVGLPLQWMVMSMAVIIL

SEQ ID NO: 343606 - protein, 19 aa, Mycobacterium
LWRIHFASALLMVPQTVVL

SEQ ID NO: 343607 - protein, 17 aa, Mycobacterium
LWRRGRRPIDWSAPITV

SEQ ID NO: 343608 - protein, 17 aa, Mycobacterium
LWSGFQIIGDGSGTYDY

SEQ ID NO: 343609 - protein, 23 aa, Mycobacterium
LWSQWRFTFEPMFVVALSALLRS

SEQ ID NO: 343610 - protein, 19 aa, Mycobacterium
LWVEARNAMPLILGGLRSA

SEQ ID NO: 343611 - protein, 18 aa, Mycobacterium
LWVPLWWWLPGLGLAALI

SEQ ID NO: 343612 - protein, 17 aa, Mycobacterium
LWWALLIVAGFWGLIRV

SEQ ID NO: 343613 - protein, 18 aa, Mycobacterium
LWWALLLTIGFWGLLRVA

SEQ ID NO: 343614 - protein, 18 aa, Mycobacterium
LWWALLLVVGFWGVLRVS

SEQ ID NO: 343615 - protein, 17 aa, Mycobacterium
LWWAVLLTVGFWGLLRV

SEQ ID NO: 343616 - protein, 20 aa, Mycobacterium
LWWMMVCWAQPLRVRPHGRV

SEQ ID NO: 343617 - protein, 17 aa, Mycobacterium
LWWSWAWIAGMIGYAGD

SEQ ID NO: 343618 - protein, 22 aa, Mycobacterium
LWWVLRVARWSARVPAATVPVP

SEQ ID NO: 343619 - protein, 17 aa, Mycobacterium
LYAAGFLLGRGYVNAPS

SEQ ID NO: 343620 - protein, 17 aa, Mycobacterium
LYAAWGIVVKGTLGVAA

SEQ ID NO: 343621 - protein, 18 aa, Mycobacterium
LYAAWTWAPSVLDEVQAA

SEQ ID NO: 343622 - protein, 20 aa, Mycobacterium
LYADRWCAWAMLAAAVVIPT

SEQ ID NO: 343623 - protein, 17 aa, Mycobacterium
LYAIPALIAAGIAAAGY

SEQ ID NO: 343624 - protein, 18 aa, Mycobacterium
LYALWTWLAIFLMAGNRR

SEQ ID NO: 343625 - protein, 19 aa, Mycobacterium
LYCIGLWMSFYAARFATTS

SEQ ID NO: 343626 - protein, 19 aa, Mycobacterium
LYCVGRFGVELMRDDTATH

SEQ ID NO: 343627 - protein, 18 aa, Mycobacterium
LYDRVGFAAAGKFNEFDN

SEQ ID NO: 343628 - protein, 18 aa, Mycobacterium
LYEAPALNQAWFVYPPFA

SEQ ID NO: 343629 - protein, 27 aa, Mycobacterium
LYGEVLRFLFEPIFNFLRDPIGNTFAL

SEQ ID NO: 343630 - protein, 18 aa, Mycobacterium
LYGLHAMMFNEPRVSDDP

SEQ ID NO: 343631 - protein, 17 aa, Mycobacterium
LYGLYALLRLHFVQEEE

SEQ ID NO: 343632 - protein, 20 aa, Mycobacterium
LYIEGALGPAGWRLSQNIAG

SEQ ID NO: 343633 - protein, 22 aa, Mycobacterium
LYKKERRFAVAFVIPAAVLFVA

SEQ ID NO: 343634 - protein, 17 aa, Mycobacterium
LYLCCSGSFLGFAFAFG

SEQ ID NO: 343635 - protein, 18 aa, Mycobacterium
LYLDGGLQFSTRDEYRYT

SEQ ID NO: 343636 - protein, 19 aa, Mycobacterium
LYLMCGLARHRRLLSQEAA

SEQ ID NO: 343637 - protein, 22 aa, Mycobacterium
LYLPKVGLRFAVTGGLLLLAGG

SEQ ID NO: 343638 - protein, 17 aa, Mycobacterium
LYMADGFVAAFQTASGI

SEQ ID NO: 343639 - protein, 21 aa, Mycobacterium
LYMCASGSFLGFAFAFGQVLQ

SEQ ID NO: 343640 - protein, 20 aa, Mycobacterium
LYQPGLRFLIPLADKMIRVD

SEQ ID NO: 343641 - protein, 20 aa, Mycobacterium
LYRLRLSYFDGHQRGELLSR

SEQ ID NO: 343642 - protein, 25 aa, Mycobacterium
LYRRIGASVVRWPVPILAASSAVVM

SEQ ID NO: 343643 - protein, 26 aa, Mycobacterium
LYRRIGTSVVRWPKPIFVASAAVVMV

SEQ ID NO: 343644 - protein, 23 aa, Mycobacterium
LYRRLKRWLSLFERSAIREPESQ

SEQ ID NO: 343645 - protein, 23 aa, Mycobacterium
LYTDFRPAGVLDWEMTALGPREL

SEQ ID NO: 343646 - protein, 18 aa, Mycobacterium
LYVNRDWTATFEVTGTGT

SEQ ID NO: 343647 - protein, 17 aa, Mycobacterium
LYYKGGAIPAMYLWALA

SEQ ID NO: 343648 - protein, 18 aa, Mycobacterium
MAATLWHPHIVGVHDRGE

SEQ ID NO: 343649 - protein, 32 aa, Mycobacterium
MAAVCLYCAYELWRFDSIRSWLLVAVMNIAMI

SEQ ID NO: 343650 - protein, 17 aa, Mycobacterium
MACPVWLYQVWAFITPG

SEQ ID NO: 343651 - protein, 23 aa, Mycobacterium
MAGMLPTVLAWVFAPRYAAGAAV

SEQ ID NO: 343652 - protein, 17 aa, Mycobacterium
MAICLGGLVGALGYATV

SEQ ID NO: 343653 - protein, 24 aa, Mycobacterium
MAIFYLRLPATFGIGTYGVSADFV

SEQ ID NO: 343654 - protein, 19 aa, Mycobacterium
MALACWWVISREVIPRLGT

SEQ ID NO: 343655 - protein, 19 aa, Mycobacterium
MALARILAWYVFRVGRRRL

SEQ ID NO: 343656 - protein, 23 aa, Mycobacterium
MALGRKKFLPPFVSWFAAMLFAV

SEQ ID NO: 343657 - protein, 17 aa, Mycobacterium
MALGYFKLAIIAAGIDF

SEQ ID NO: 343658 - protein, 20 aa, Mycobacterium
MALPCAISILVIVIAALTLA

SEQ ID NO: 343659 - protein, 19 aa, Mycobacterium
MANEIVKWGEFGMLPSLNA

SEQ ID NO: 343660 - protein, 17 aa, Mycobacterium
MATFAFSPLRVMAQVGT

SEQ ID NO: 343661 - protein, 18 aa, Mycobacterium
MATLRISFLSALVLELLA

SEQ ID NO: 343662 - protein, 24 aa, Mycobacterium
MAVFYLRLPATFGLGTYGVSADFV

SEQ ID NO: 343663 - protein, 20 aa, Mycobacterium
MCASGSFIGFAFVFGQVLQF

SEQ ID NO: 343664 - protein, 19 aa, Mycobacterium
MCGVCSLAGLWYVGATLDR

SEQ ID NO: 343665 - protein, 17 aa, Mycobacterium
MCIAGAWLYTGGSKPYG

SEQ ID NO: 343666 - protein, 20 aa, Mycobacterium
MCVLTGKALKQPFEWREFIW

SEQ ID NO: 343667 - protein, 24 aa, Mycobacterium
MDDETFLSWGWRIPFLLSAIVIVV

SEQ ID NO: 343668 - protein, 18 aa, Mycobacterium
MDGLRLPNWGTLKLALPK

SEQ ID NO: 343669 - protein, 24 aa, Mycobacterium
MDLSRLQHEWGFRPAWESTECIDD

SEQ ID NO: 343670 - protein, 24 aa, Mycobacterium
MDTSRLHDEWGFRPAWTAEEAVQD

SEQ ID NO: 343671 - protein, 20 aa, Mycobacterium
MDTYGWRIPFLIAAPLGLVG

SEQ ID NO: 343672 - protein, 21 aa, Mycobacterium
MELDWRPKWTLDDGLPALLDW

SEQ ID NO: 343673 - protein, 19 aa, Mycobacterium
MELRISLAIVFGLAALAVE

SEQ ID NO: 343674 - protein, 22 aa, Mycobacterium
MEMLNINEAWQFGRGAGVKVAV

SEQ ID NO: 343675 - protein, 21 aa, Mycobacterium
MERAPGRFALLQALSAGAIGA

SEQ ID NO: 343676 - protein, 20 aa, Mycobacterium
MESYGWRIPFLIAGPLGLVG

SEQ ID NO: 343677 - protein, 23 aa, Mycobacterium
MFDKRNWWLPGWLDHVLPTVDFE

SEQ ID NO: 343678 - protein, 17 aa, Mycobacterium
MFDPVFGALFWGKIFSV

SEQ ID NO: 343679 - protein, 25 aa, Mycobacterium
MFFYPGYYPYAFWGPGWGWALTDVL

SEQ ID NO: 343680 - protein, 18 aa, Mycobacterium
MFGVCLRSGMPVATAALV

SEQ ID NO: 343681 - protein, 17 aa, Mycobacterium
MFIPFVVVIPGMIAGAV

SEQ ID NO: 343682 - protein, 22 aa, Mycobacterium
MFKLPFPWREFLLQTWFVARVS

SEQ ID NO: 343683 - protein, 19 aa, Mycobacterium
MFKQAVWKRVAVLFAGPAA

SEQ ID NO: 343684 - protein, 21 aa, Mycobacterium
MFLHMRYWWVGIALVALGVIV

SEQ ID NO: 343685 - protein, 18 aa, Mycobacterium
MFNRAGIFLGPLIGLAFV

SEQ ID NO: 343686 - protein, 17 aa, Mycobacterium
MFTEFGIDVPESLQIRA

SEQ ID NO: 343687 - protein, 20 aa, Mycobacterium
MGASRLARRGAIIKQLSAVE

SEQ ID NO: 343688 - protein, 21 aa, Mycobacterium
MGIAVLCARILLRKVTPGSYP

SEQ ID NO: 343689 - protein, 24 aa, Mycobacterium
MGIFYLRLPATFGIGTYEVSADFV

SEQ ID NO: 343690 - protein, 20 aa, Mycobacterium
MGIPCAIGMLAAVAVAVTLV

SEQ ID NO: 343691 - protein, 19 aa, Mycobacterium
MGLGAWAFGARWFARADPF

SEQ ID NO: 343692 - protein, 22 aa, Mycobacterium
MGLPCSLGMLISVLIALTLVPA

SEQ ID NO: 343693 - protein, 17 aa, Mycobacterium
MGLRSGGPIAIIFSLVC

SEQ ID NO: 343694 - protein, 22 aa, Mycobacterium
MGPQFLAAFGWERSDFALTGVI

SEQ ID NO: 343695 - protein, 17 aa, Mycobacterium
MGQAIGRLGNYFNQELY

SEQ ID NO: 343696 - protein, 18 aa, Mycobacterium
MGQWNWWAPAPLARLHQR

SEQ ID NO: 343697 - protein, 23 aa, Mycobacterium
MGRRLGALTIDWLIALGLAALAM

SEQ ID NO: 343698 - protein, 26 aa, Mycobacterium
MGRWFWWPKRVRVRPASLMLRSVGPR

SEQ ID NO: 343699 - protein, 18 aa, Mycobacterium
MGSALWRAPSAWIASALG

SEQ ID NO: 343700 - protein, 17 aa, Mycobacterium
MGTRLYCAGGWYTGDTL

SEQ ID NO: 343701 - protein, 20 aa, Mycobacterium
MGVAFGWSMFNWVADVACLG

SEQ ID NO: 343702 - protein, 26 aa, Mycobacterium
MGVNIVRHPWPFFGVATVILLAAASF

SEQ ID NO: 343703 - protein, 19 aa, Mycobacterium
MGVSVIRRLVVPRFAAAIM

SEQ ID NO: 343704 - protein, 18 aa, Mycobacterium
MGWLRLGALVLVAAALAA

SEQ ID NO: 343705 - protein, 24 aa, Mycobacterium
MHVMGRWNWWAPRPLAWLHDRFGI

SEQ ID NO: 343706 - protein, 25 aa, Mycobacterium
MHVMGRWNWWAPRPLAWLHDRFGIS

SEQ ID NO: 343707 - protein, 22 aa, Mycobacterium
MHVMGSWNWWAPKPLVWLHERF

SEQ ID NO: 343708 - protein, 25 aa, Mycobacterium
MIHAFAVPIILAWVAVCVALSVFIP

SEQ ID NO: 343709 - protein, 18 aa, Mycobacterium
MILVPAFMYLMGQWNWWA

SEQ ID NO: 343710 - protein, 24 aa, Mycobacterium
MIRRLALPIIVVWIAVIAALNIFV

SEQ ID NO: 343711 - protein, 25 aa, Mycobacterium
MIRTFAVPLILGWVLLIAVLNSVVP

SEQ ID NO: 343712 - protein, 18 aa, Mycobacterium
MIRTRWGRRAARILPLLG

SEQ ID NO: 343713 - protein, 23 aa, Mycobacterium
MISRPRPGPSLLAYWIGGLTVCV

SEQ ID NO: 343714 - protein, 23 aa, Mycobacterium
MIVACLWCARDLWRRGTPAVWCT

SEQ ID NO: 343715 - protein, 19 aa, Mycobacterium
MKLLGRFNWWAPRLPTRAV

SEQ ID NO: 343716 - protein, 18 aa, Mycobacterium
MLCAHAMFKAALFMVVGI

SEQ ID NO: 343717 - protein, 18 aa, Mycobacterium
MLFAKPSYYGQFTDSGGI

SEQ ID NO: 343718 - protein, 22 aa, Mycobacterium
MLFQHLFWFFGHPEVYVIALPF

SEQ ID NO: 343719 - protein, 19 aa, Mycobacterium
MLGDLPWWVTAVVLAREIG

SEQ ID NO: 343720 - protein, 21 aa, Mycobacterium
MLGFFSSIWIWNIFITFLPLF

SEQ ID NO: 343721 - protein, 20 aa, Mycobacterium
MLGHEAFVWVGLREPDQAEM

SEQ ID NO: 343722 - protein, 17 aa, Mycobacterium
MLHRVFGGMDLKAFWYH

SEQ ID NO: 343723 - protein, 17 aa, Mycobacterium
MLIYRLISWLLIAAVGW

SEQ ID NO: 343724 - protein, 25 aa, Mycobacterium
MLKHKRIAAIIGVMVLVVASSVVAV

SEQ ID NO: 343725 - protein, 20 aa, Mycobacterium
MLLFCIAFGLAMDYEVFLVS

SEQ ID NO: 343726 - protein, 22 aa, Mycobacterium
MLLPLVYGALYLWAFWDPFGHT

SEQ ID NO: 343727 - protein, 19 aa, Mycobacterium
MLLPLVYGALYLWAYWDPF

SEQ ID NO: 343728 - protein, 17 aa, Mycobacterium
MLLRPDWTRTVLARRIA

SEQ ID NO: 343729 - protein, 18 aa, Mycobacterium
MLLYAAAMGVAWLLDVPA

SEQ ID NO: 343730 - protein, 17 aa, Mycobacterium
MLRKFGLGQRTNVGLPG

SEQ ID NO: 343731 - protein, 18 aa, Mycobacterium
MLRVRWLIEPTLVVLTVG

SEQ ID NO: 343732 - protein, 17 aa, Mycobacterium
MLRYCLQLFPGASTYFR

SEQ ID NO: 343733 - protein, 20 aa, Mycobacterium
MLSRIPAHYPLRGVVHAAGI

SEQ ID NO: 343734 - protein, 17 aa, Mycobacterium
MLVAPFVGSWVGRVGTE

SEQ ID NO: 343735 - protein, 25 aa, Mycobacterium
MLVATAWWLFEWEIGKGASVEVART

SEQ ID NO: 343736 - protein, 17 aa, Mycobacterium
MLVMFGIVTAVALLAAT

SEQ ID NO: 343737 - protein, 17 aa, Mycobacterium
MLWLYQRVMTGPVAAGN

SEQ ID NO: 343738 - protein, 22 aa, Mycobacterium
MMFALRYRWWVVLSAITVATTA

SEQ ID NO: 343739 - protein, 20 aa, Mycobacterium
MMHLMRLARSFGVVPVGGWA

SEQ ID NO: 343740 - protein, 20 aa, Mycobacterium
MMPWLFLRVRFFRRKWTAVT

SEQ ID NO: 343741 - protein, 21 aa, Mycobacterium
MNAKCPLTSYVLMGFSQGAVI

SEQ ID NO: 343742 - protein, 25 aa, Mycobacterium
MNFRFMPELTWTWGYPGVMAVMVVV

SEQ ID NO: 343743 - protein, 19 aa, Mycobacterium
MNFVICLVLIYAIAVMWGL

SEQ ID NO: 343744 - protein, 24 aa, Mycobacterium
MNGWPEAIFRFGLYAFLCATALMV

SEQ ID NO: 343745 - protein, 25 aa, Mycobacterium
MNRGWCLLRTRWGRRMARVLPVIGV

SEQ ID NO: 343746 - protein, 18 aa, Mycobacterium
MPAPQLLAVWLFGAFIVA

SEQ ID NO: 343747 - protein, 21 aa, Mycobacterium
MPEGWWKPRPLDALVGAVLVW

SEQ ID NO: 343748 - protein, 23 aa, Mycobacterium
MPLARLLGPWFWWPQKLPRRQPV

SEQ ID NO: 343749 - protein, 18 aa, Mycobacterium
MPNIRLDWLTAENTATAR

SEQ ID NO: 343750 - protein, 22 aa, Mycobacterium
MPPERWVGFVLIWAALVIFTAD

SEQ ID NO: 343751 - protein, 20 aa, Mycobacterium
MPWLYLRVRFFRRKWTAITL

SEQ ID NO: 343752 - protein, 18 aa, Mycobacterium
MQAGCRFTAQLGAQRINE

SEQ ID NO: 343753 - protein, 17 aa, Mycobacterium
MQAGCRFTAQLGSMRIA

SEQ ID NO: 343754 - protein, 18 aa, Mycobacterium
MQAGCRFTAQLGSMRIAE

SEQ ID NO: 343755 - protein, 17 aa, Mycobacterium
MQLCALLPFALPFVVLA

SEQ ID NO: 343756 - protein, 19 aa, Mycobacterium
MQVGSLIAFLSYFMQILMS

SEQ ID NO: 343757 - protein, 24 aa, Mycobacterium
MQWPLFAGFCFYAYFKFVRYEEAP

SEQ ID NO: 343758 - protein, 17 aa, Mycobacterium
MQWRKRRLFIAVLSTGL

SEQ ID NO: 343759 - protein, 18 aa, Mycobacterium
MQWRKRRLVIAIISTGII

SEQ ID NO: 343760 - protein, 23 aa, Mycobacterium
MRAGEPRLSAWVRYHSDERLPKE

SEQ ID NO: 343761 - protein, 23 aa, Mycobacterium
MRKRFGDTMGYRLVIYPTYAALD

SEQ ID NO: 343762 - protein, 21 aa, Mycobacterium
MRLLFPLLIVWVTAGLDPVRA

SEQ ID NO: 343763 - protein, 17 aa, Mycobacterium
MRLRAGSPILFYPAGAL

SEQ ID NO: 343764 - protein, 24 aa, Mycobacterium
MRNPLEALVAWGPLLFFIAYEAFF

SEQ ID NO: 343765 - protein, 25 aa, Mycobacterium
MRPDCRLDVAGLWGLLRINRYQQFF

SEQ ID NO: 343766 - protein, 23 aa, Mycobacterium
MRPDCRLDVAGLWGVLRINRYEQ

SEQ ID NO: 343767 - protein, 24 aa, Mycobacterium
MRPDCRLDVAGLWGVLRINRYTQM

SEQ ID NO: 343768 - protein, 24 aa, Mycobacterium
MRVLALPIIVVWLLIAIGVNVFVP

SEQ ID NO: 343769 - protein, 18 aa, Mycobacterium
MRVLSLRTIVIVAALSVV

SEQ ID NO: 343770 - protein, 29 aa, Mycobacterium
MRVSTVGLVLVFFALYWVNQNYQPEPPAP

SEQ ID NO: 343771 - protein, 23 aa, Mycobacterium
MSFVIQEFVHWVLPKIAKGYGGS

SEQ ID NO: 343772 - protein, 18 aa, Mycobacterium
MSGCRFFDVMLGAAPHYR

SEQ ID NO: 343773 - protein, 17 aa, Mycobacterium
MSGMLTRLAAAQRATTN

SEQ ID NO: 343774 - protein, 21 aa, Mycobacterium
MSHKQWHDWVFPDIDYIRLCP

SEQ ID NO: 343775 - protein, 19 aa, Mycobacterium
MSHMLPLFRRMQGLIDGIN

SEQ ID NO: 343776 - protein, 17 aa, Mycobacterium
MSLHLAVTVAYFAVGLT

SEQ ID NO: 343777 - protein, 19 aa, Mycobacterium
MSLKDTRWWLGGMAAVTNY

SEQ ID NO: 343778 - protein, 19 aa, Mycobacterium
MSLWLLRFAMSNTWLVWLA

SEQ ID NO: 343779 - protein, 17 aa, Mycobacterium
MSWITGVGFGWLTAFAG

SEQ ID NO: 343780 - protein, 24 aa, Mycobacterium
MTEEQFLAWGWRVPFLLSAPLVLV

SEQ ID NO: 343781 - protein, 18 aa, Mycobacterium
MTGARPGGFGALDGKTNE

SEQ ID NO: 343782 - protein, 18 aa, Mycobacterium
MTGARPGGFGALDSRTNE

SEQ ID NO: 343783 - protein, 23 aa, Mycobacterium
MTGRAVAFLAPWLFSVFVDVFGA

SEQ ID NO: 343784 - protein, 23 aa, Mycobacterium
MTGRAVAFLGPWLFSIFVDIFSA

SEQ ID NO: 343785 - protein, 24 aa, Mycobacterium
MTGRAVAFLGPWSFSVFVDAFSAV

SEQ ID NO: 343786 - protein, 19 aa, Mycobacterium
MTIASWWLHRQCDYRTPVL

SEQ ID NO: 343787 - protein, 18 aa, Mycobacterium
MVALCLGGGVYGISLGNH

SEQ ID NO: 343788 - protein, 25 aa, Mycobacterium
MVALPAFGLWHLWAGAPADPVERRH

SEQ ID NO: 343789 - protein, 17 aa, Mycobacterium
MVFDMVYQPGKLPDSFA

SEQ ID NO: 343790 - protein, 19 aa, Mycobacterium
MVFPALLVYSVWRMLNWLN

SEQ ID NO: 343791 - protein, 27 aa, Mycobacterium
MVGALVFSGIFGWKVWQQHQIDAAGEQ

SEQ ID NO: 343792 - protein, 17 aa, Mycobacterium
MVIGWQAGVAFTRESLR

SEQ ID NO: 343793 - protein, 23 aa, Mycobacterium
MVPPPALSPIDWTKIPPPQLPPI

SEQ ID NO: 343794 - protein, 19 aa, Mycobacterium
MVRVLAVPIVVFWAIVAVT

SEQ ID NO: 343795 - protein, 20 aa, Mycobacterium
MVSIMAICFEKMIVSTVREA

SEQ ID NO: 343796 - protein, 21 aa, Mycobacterium
MVSSLIGWWALSRLLDRMGNV

SEQ ID NO: 343797 - protein, 24 aa, Mycobacterium
MVVRPRPASALLRPTGPRPAVRAL

SEQ ID NO: 343798 - protein, 19 aa, Mycobacterium
MWEALRIAAADGFVAAHPD

SEQ ID NO: 343799 - protein, 17 aa, Mycobacterium
MWVWYKLFASMLGPSNF

SEQ ID NO: 343800 - protein, 17 aa, Mycobacterium
MYGEIFTITAFVCVFGA

SEQ ID NO: 343801 - protein, 18 aa, Mycobacterium
MYGHLRWLTTGTHDDMAM

SEQ ID NO: 343802 - protein, 17 aa, Mycobacterium
MYLMAVAAVLAFTVAAL

SEQ ID NO: 343803 - protein, 19 aa, Mycobacterium
MYVGWPIHRTGWLALAHRS

SEQ ID NO: 343804 - protein, 17 aa, Mycobacterium
MYYLRSFAYAGIATVAF

SEQ ID NO: 343805 - protein, 24 aa, Mycobacterium
NAASPWRAIGKRILIAVGTLFAAV

SEQ ID NO: 343806 - protein, 18 aa, Mycobacterium
NAGLRYALVRVRDAGSAI

SEQ ID NO: 343807 - protein, 24 aa, Mycobacterium
NAGRPWWRPSFKALVRVYDPHEPT

SEQ ID NO: 343808 - protein, 18 aa, Mycobacterium
NAISPAWEGIKTAISAAW

SEQ ID NO: 343809 - protein, 18 aa, Mycobacterium
NAITPAWNGIKAVIGVAW

SEQ ID NO: 343810 - protein, 18 aa, Mycobacterium
NALVAIAITGVWLWLDYD

SEQ ID NO: 343811 - protein, 18 aa, Mycobacterium
NAPGCAGCCQCAIGCPRN

SEQ ID NO: 343812 - protein, 18 aa, Mycobacterium
NARSHRGIIMAFAMLAGV

SEQ ID NO: 343813 - protein, 22 aa, Mycobacterium
NASWPQVMPWTALWLGALSTAI

SEQ ID NO: 343814 - protein, 23 aa, Mycobacterium
NAWRLALAVSVIFWHSWPLTGRT

SEQ ID NO: 343815 - protein, 23 aa, Mycobacterium
NCQRAIPHVVDWYDRYHDAGFVV

SEQ ID NO: 343816 - protein, 24 aa, Mycobacterium
NCQRAIPHVVGWYNAYKDQGFEVI

SEQ ID NO: 343817 - protein, 24 aa, Mycobacterium
NCQRAIPHVVGWYRAYKDSGLEVI

SEQ ID NO: 343818 - protein, 24 aa, Mycobacterium
NDEAGIPMALRWGYYAREELVDAP

SEQ ID NO: 343819 - protein, 21 aa, Mycobacterium
NDFKKMLTFFCAKYREAFKDI

SEQ ID NO: 343820 - protein, 25 aa, Mycobacterium
NDMGWNFSAAKDMFGWINPVLAALQ

SEQ ID NO: 343821 - protein, 17 aa, Mycobacterium
NDPRWWFGLPAVIALIC

SEQ ID NO: 343822 - protein, 18 aa, Mycobacterium
NDVLNAWAMSVVFYGALI

SEQ ID NO: 343823 - protein, 18 aa, Mycobacterium
NDVLNAWAMSVVFYGVLI

SEQ ID NO: 343824 - protein, 19 aa, Mycobacterium
NDWMWGRLDGAGWLVHVLL

SEQ ID NO: 343825 - protein, 18 aa, Mycobacterium
NEFGWIWRHCRHVLFDDW

SEQ ID NO: 343826 - protein, 17 aa, Mycobacterium
NEIAHTWLFTDRIRRDE

SEQ ID NO: 343827 - protein, 17 aa, Mycobacterium
NELVAWVCIGASVLGVV

SEQ ID NO: 343828 - protein, 25 aa, Mycobacterium
NELYADRHIRLWVVYVDNFSGQSAM

SEQ ID NO: 343829 - protein, 17 aa, Mycobacterium
NERTLVFALVAAKPPGP

SEQ ID NO: 343830 - protein, 17 aa, Mycobacterium
NETWRLWRFPWQAKSPG

SEQ ID NO: 343831 - protein, 20 aa, Mycobacterium
NEVFPKWFAYVSIWQIITEV

SEQ ID NO: 343832 - protein, 17 aa, Mycobacterium
NFIPKVLLGISFPGIVV

SEQ ID NO: 343833 - protein, 22 aa, Mycobacterium
NFKLLVPVFRWQRRDNLLAEAD

SEQ ID NO: 343834 - protein, 19 aa, Mycobacterium
NFLLCIGYLFLTLTQQASS

SEQ ID NO: 343835 - protein, 23 aa, Mycobacterium
NFRAVRDMFAWIGPVLTALQGNR

SEQ ID NO: 343836 - protein, 19 aa, Mycobacterium
NGALFRLTVPLVRGHKVTT

SEQ ID NO: 343837 - protein, 18 aa, Mycobacterium
NGCFLKFRVDDVPSGARF

SEQ ID NO: 343838 - protein, 20 aa, Mycobacterium
NGFASLWSWIFGLVVTEFPL

SEQ ID NO: 343839 - protein, 23 aa, Mycobacterium
NGGIFARFPWLKIPLADIESNGA

SEQ ID NO: 343840 - protein, 22 aa, Mycobacterium
NGGSVGLFAIFATAGAGGAGGA

SEQ ID NO: 343841 - protein, 19 aa, Mycobacterium
NGIRVRIGIHMGRSVRRGD

SEQ ID NO: 343842 - protein, 25 aa, Mycobacterium
NGITSRLPMVFGFIAIVTLVLLFLL

SEQ ID NO: 343843 - protein, 25 aa, Mycobacterium
NGITSRLPVVFGFIAAVTVVLLFLM

SEQ ID NO: 343844 - protein, 18 aa, Mycobacterium
NGLNRFRTFFGFTLNDPA

SEQ ID NO: 343845 - protein, 23 aa, Mycobacterium
NGLRLGLANAWLFLVAAELIASS

SEQ ID NO: 343846 - protein, 25 aa, Mycobacterium
NGLRPEPIIALGILLTWCSVERAVA

SEQ ID NO: 343847 - protein, 24 aa, Mycobacterium
NGLRPEPIIALGILLTWCSVERGV

SEQ ID NO: 343848 - protein, 25 aa, Mycobacterium
NGLRPEPIIALGILLTWCSVERGVA

SEQ ID NO: 343849 - protein, 24 aa, Mycobacterium
NGLRPEPIIALGILLTWCSVERSI

SEQ ID NO: 343850 - protein, 25 aa, Mycobacterium
NGLRPEPLIALGVLVTWALVERAIA

SEQ ID NO: 343851 - protein, 25 aa, Mycobacterium
NGLRPEPLIALGVLVTWILVERAIA

SEQ ID NO: 343852 - protein, 25 aa, Mycobacterium
NGLRPEPLIALGVLVTWMLVERAIA

SEQ ID NO: 343853 - protein, 25 aa, Mycobacterium
NGLRPEPLIALGVLVTWVLVERSIA

SEQ ID NO: 343854 - protein, 23 aa, Mycobacterium
NGPSLRASWTWAPSAFDEEQATR

SEQ ID NO: 343855 - protein, 23 aa, Mycobacterium
NGYLASCGLNFPRLDSVHRTVEF

SEQ ID NO: 343856 - protein, 18 aa, Mycobacterium
NHDGRRLVAVLLHGTRQP

SEQ ID NO: 343857 - protein, 24 aa, Mycobacterium
NHDLRFIIAMTICVVLLILIALLR

SEQ ID NO: 343858 - protein, 23 aa, Mycobacterium
NHLCDRLWLIAAIEHYTAVMGDF

SEQ ID NO: 343859 - protein, 17 aa, Mycobacterium
NHPLRLGGDRVYLQGHG

SEQ ID NO: 343860 - protein, 18 aa, Mycobacterium
NHVWLIYILVIWWTGFPR

SEQ ID NO: 343861 - protein, 22 aa, Mycobacterium
NIPADLNALLGIYYAHGTYQEL

SEQ ID NO: 343862 - protein, 18 aa, Mycobacterium
NIPGVPWWAAVLIAVTAT

SEQ ID NO: 343863 - protein, 24 aa, Mycobacterium
NIRMPEIFAALSIGAVVVGLGMAW

SEQ ID NO: 343864 - protein, 21 aa, Mycobacterium
NISEVRWLPAILLFSYIDLVG

SEQ ID NO: 343865 - protein, 18 aa, Mycobacterium
NITLGWRTSLLILAAAFA

SEQ ID NO: 343866 - protein, 24 aa, Mycobacterium
NIVKRPGAHLAVSLVVLVILATCG

SEQ ID NO: 343867 - protein, 17 aa, Mycobacterium
NIYWLGEQWWRPLIAVG

SEQ ID NO: 343868 - protein, 23 aa, Mycobacterium
NKDRWSMFHSIAFDFSVWELWGA

SEQ ID NO: 343869 - protein, 25 aa, Mycobacterium
NKLYTDRHIRLWVVYVDDFSGQSPT

SEQ ID NO: 343870 - protein, 22 aa, Mycobacterium
NLAGRSAHLVWYVPERPKVGAS

SEQ ID NO: 343871 - protein, 22 aa, Mycobacterium
NLKLLMPVFRWQRRDNMLAETD

SEQ ID NO: 343872 - protein, 18 aa, Mycobacterium
NLLRRQCDAVSRRFAAFL

SEQ ID NO: 343873 - protein, 18 aa, Mycobacterium
NLPHPWFDAIGISDRAAD

SEQ ID NO: 343874 - protein, 19 aa, Mycobacterium
NLSCKYLKVSDLRPSERQQ

SEQ ID NO: 343875 - protein, 18 aa, Mycobacterium
NLYICGVSIRVSDLQGRT

SEQ ID NO: 343876 - protein, 19 aa, Mycobacterium
NLYLRNAVFAEWIEKVDAL

SEQ ID NO: 343877 - protein, 26 aa, Mycobacterium
NNGLRPEPLIAFAVITVWMLVENSIG

SEQ ID NO: 343878 - protein, 30 aa, Mycobacterium
NNGLRPEPLIAFGVVAAWMLTELAIGRRRL

SEQ ID NO: 343879 - protein, 17 aa, Mycobacterium
NNLFGGGGLQGGSTITQ

SEQ ID NO: 343880 - protein, 18 aa, Mycobacterium
NNLRFGIRDLFMVTVLSA

SEQ ID NO: 343881 - protein, 23 aa, Mycobacterium
NNPSGVVLTGFVDRVGDPVPLIA

SEQ ID NO: 343882 - protein, 18 aa, Mycobacterium
NNRCPLTSYVLVGFSQGA

SEQ ID NO: 343883 - protein, 24 aa, Mycobacterium
NNTEGRWKLGLYAAGRASQMRRMR

SEQ ID NO: 343884 - protein, 18 aa, Mycobacterium
NPATCWWWQKTSGENRAR

SEQ ID NO: 343885 - protein, 23 aa, Mycobacterium
NPDLRRPALGWVLFTVLIGWSAA

SEQ ID NO: 343886 - protein, 26 aa, Mycobacterium
NPGLDRRGVAVLLDFGGSGTSITAVD

SEQ ID NO: 343887 - protein, 17 aa, Mycobacterium
NPLGWGLLGLFFSILTL

SEQ ID NO: 343888 - protein, 23 aa, Mycobacterium
NPNCGIALHCGRSGAGVFDYDMN

SEQ ID NO: 343889 - protein, 22 aa, Mycobacterium
NPPRNRPAPLMLRGPDQQEPAG

SEQ ID NO: 343890 - protein, 21 aa, Mycobacterium
NPRGRGGLRLPGLGRIPNPGR

SEQ ID NO: 343891 - protein, 20 aa, Mycobacterium
NPRYVWAWRLLRLDFTGVAL

SEQ ID NO: 343892 - protein, 22 aa, Mycobacterium
NPSWPGQWAIVYVDTTGKHPGA

SEQ ID NO: 343893 - protein, 20 aa, Mycobacterium
NPVFIPRFLFSMSVVGVLVA

SEQ ID NO: 343894 - protein, 18 aa, Mycobacterium
NQALGWLVGLALSGALSY

SEQ ID NO: 343895 - protein, 17 aa, Mycobacterium
NQFRLGLLFAVGSALAF

SEQ ID NO: 343896 - protein, 22 aa, Mycobacterium
NQFRPGLLRAFRTADFAGIMPR

SEQ ID NO: 343897 - protein, 19 aa, Mycobacterium
NQLVAWVCIGASALGVVLL

SEQ ID NO: 343898 - protein, 18 aa, Mycobacterium
NQPLRPGASLPLGQSTTP

SEQ ID NO: 343899 - protein, 23 aa, Mycobacterium
NQRYPTCTAFALALTQHGPHRDA

SEQ ID NO: 343900 - protein, 17 aa, Mycobacterium
NRDAWMVGFTPSLSTAV

SEQ ID NO: 343901 - protein, 17 aa, Mycobacterium
NREADIAAGLWHPHIVG

SEQ ID NO: 343902 - protein, 19 aa, Mycobacterium
NRFGWLDADGNVWVPTGKG

SEQ ID NO: 343903 - protein, 18 aa, Mycobacterium
NRHLGWFFLFKQGNVSLA

SEQ ID NO: 343904 - protein, 18 aa, Mycobacterium
NRIRERFGLVGLFAGSAI

SEQ ID NO: 343905 - protein, 21 aa, Mycobacterium
NRLKVKVVRPMTGFTPAQVLD

SEQ ID NO: 343906 - protein, 17 aa, Mycobacterium
NRLRALAHRTCVAPLPY

SEQ ID NO: 343907 - protein, 20 aa, Mycobacterium
NRLWWPLSPRLRKALKTVTV

SEQ ID NO: 343908 - protein, 22 aa, Mycobacterium
NRRAEQRLAFILVAPAALLMLA

SEQ ID NO: 343909 - protein, 21 aa, Mycobacterium
NRRDALRWVWLGVAGAVAMTL

SEQ ID NO: 343910 - protein, 25 aa, Mycobacterium
NRRELSEGFDLLPLMADNVYNIIDP

SEQ ID NO: 343911 - protein, 18 aa, Mycobacterium
NRRSKLFGALPLVAPLFA

SEQ ID NO: 343912 - protein, 24 aa, Mycobacterium
NRTPDWWPALRWVVLIGSVVVAVL

SEQ ID NO: 343913 - protein, 20 aa, Mycobacterium
NRYGYDFMGFDRWGYDRWGY

SEQ ID NO: 343914 - protein, 20 aa, Mycobacterium
NSDLRWAILATRDDWDAYER

SEQ ID NO: 343915 - protein, 22 aa, Mycobacterium
NSFPKWRWSLTTALLELSVVVL

SEQ ID NO: 343916 - protein, 19 aa, Mycobacterium
NSLFRLDHLAARMRRNGAN

SEQ ID NO: 343917 - protein, 19 aa, Mycobacterium
NSLLPRWLPEAGDGSGLLS

SEQ ID NO: 343918 - protein, 22 aa, Mycobacterium
NSPFCWIGGFAFGLLATLLAGS

SEQ ID NO: 343919 - protein, 20 aa, Mycobacterium
NSREGVHILALFSSAVLILM

SEQ ID NO: 343920 - protein, 21 aa, Mycobacterium
NSYGWRIPFMIAGLLGAVGLY

SEQ ID NO: 343921 - protein, 21 aa, Mycobacterium
NTALMPARWSVAGVEHTGAVD

SEQ ID NO: 343922 - protein, 23 aa, Mycobacterium
NTESRWKLGLYAAGRASQMRRLR

SEQ ID NO: 343923 - protein, 22 aa, Mycobacterium
NTESRWKLGLYAAGRASQMRRM

SEQ ID NO: 343924 - protein, 18 aa, Mycobacterium
NTHKYSWVSLGVCWLIWV

SEQ ID NO: 343925 - protein, 17 aa, Mycobacterium
NTIKTNLFWAFGYNVAA

SEQ ID NO: 343926 - protein, 20 aa, Mycobacterium
NTLFIPRFLLVVSFGGVVVA

SEQ ID NO: 343927 - protein, 19 aa, Mycobacterium
NTMFGWWVLSRVIRRLSVI

SEQ ID NO: 343928 - protein, 18 aa, Mycobacterium
NTVAREFVAYTAAIETAT

SEQ ID NO: 343929 - protein, 18 aa, Mycobacterium
NVFKSWRFGEPVLVDDPW

SEQ ID NO: 343930 - protein, 23 aa, Mycobacterium
NVFMIFCVATLFVGHADVGITDL

SEQ ID NO: 343931 - protein, 19 aa, Mycobacterium
NVIGAVWGWLSTTVFPALK

SEQ ID NO: 343932 - protein, 18 aa, Mycobacterium
NVKLPWRKEVKLNTEQVT

SEQ ID NO: 343933 - protein, 24 aa, Mycobacterium
NVLQMIISVGLDWNIRSVSWLPLF

SEQ ID NO: 343934 - protein, 20 aa, Mycobacterium
NVMWVVWQLWLVVLLAALWK

SEQ ID NO: 343935 - protein, 18 aa, Mycobacterium
NVPFPGVWDGVLWTLVFE

SEQ ID NO: 343936 - protein, 23 aa, Mycobacterium
NVSWIVWQLWLAVILVALWKGRR

SEQ ID NO: 343937 - protein, 20 aa, Mycobacterium
NVTLCKFGFVSGETCGKVIG

SEQ ID NO: 343938 - protein, 21 aa, Mycobacterium
NVVSSIPWLGSPFKTGQQVTE

SEQ ID NO: 343939 - protein, 23 aa, Mycobacterium
NYFGDACVWWGLWLITITGWVPL

SEQ ID NO: 343940 - protein, 23 aa, Mycobacterium
NYFGDACVWWGLWLVTITGWVPL

SEQ ID NO: 343941 - protein, 20 aa, Mycobacterium
NYFHWEPHCFDIPVCWALRS

SEQ ID NO: 343942 - protein, 30 aa, Mycobacterium
NYFYWEPHCFDIPVCQSFRSLFDMLDSIDK

SEQ ID NO: 343943 - protein, 18 aa, Mycobacterium
NYIWKARTLGVGYLDLTG

SEQ ID NO: 343944 - protein, 23 aa, Mycobacterium
NYLSLAGPYAFLGLNFFNTMEYQ

SEQ ID NO: 343945 - protein, 17 aa, Mycobacterium
NYNVHWLFWLVPLMPLF

SEQ ID NO: 343946 - protein, 18 aa, Mycobacterium
NYRGSVFDALMSIMHEGG

SEQ ID NO: 343947 - protein, 21 aa, Mycobacterium
PAAACALALVALAYWLSRFGY

SEQ ID NO: 343948 - protein, 23 aa, Mycobacterium
PAAAFYLGWSYWFAWVVTGIADL

SEQ ID NO: 343949 - protein, 18 aa, Mycobacterium
PAAARWLRVLAIPVVLFW

SEQ ID NO: 343950 - protein, 21 aa, Mycobacterium
PAAAVLRFLRRVPRDTVVLLD

SEQ ID NO: 343951 - protein, 19 aa, Mycobacterium
PAAILGCWVVLLAAVGLFF

SEQ ID NO: 343952 - protein, 18 aa, Mycobacterium
PAALPWYYSWPLAIVAPL

SEQ ID NO: 343953 - protein, 18 aa, Mycobacterium
PAALPWYYSWPLAVVAPL

SEQ ID NO: 343954 - protein, 18 aa, Mycobacterium
PAALQLMNMPEAWKESTG

SEQ ID NO: 343955 - protein, 25 aa, Mycobacterium
PAANFVICLVLLYGIALVWGLPDLH

SEQ ID NO: 343956 - protein, 19 aa, Mycobacterium
PAAPAVWAAVLALLFFAFF

SEQ ID NO: 343957 - protein, 17 aa, Mycobacterium
PACGNFERSFGPTISKL

SEQ ID NO: 343958 - protein, 18 aa, Mycobacterium
PADRLHWSGVRMWRGASD

SEQ ID NO: 343959 - protein, 17 aa, Mycobacterium
PADWPRYGGYALAGVSS

SEQ ID NO: 343960 - protein, 23 aa, Mycobacterium
PAEPAHPRWWFISTTPGRILTIG

SEQ ID NO: 343961 - protein, 17 aa, Mycobacterium
PAEVRWAILTAVAAELP

SEQ ID NO: 343962 - protein, 23 aa, Mycobacterium
PAEYWMAAPWQWRVDGRDHSGVR

SEQ ID NO: 343963 - protein, 25 aa, Mycobacterium
PAFMRVMGRWNWWAPAPLARLHERI

SEQ ID NO: 343964 - protein, 17 aa, Mycobacterium
PAFSPACRWRWASRGSA

SEQ ID NO: 343965 - protein, 27 aa, Mycobacterium
PAGALATWWPFLFGVAYQVFFNLVGWP

SEQ ID NO: 343966 - protein, 18 aa, Mycobacterium
PAGLRLVIDNAIANAVKH

SEQ ID NO: 343967 - protein, 18 aa, Mycobacterium
PAGLTVFGGSEFSAGTRV

SEQ ID NO: 343968 - protein, 18 aa, Mycobacterium
PAGTRLSSRSLLISNAVV

SEQ ID NO: 343969 - protein, 24 aa, Mycobacterium
PAGVWRLILIIAFFGGVEILAQSG

SEQ ID NO: 343970 - protein, 20 aa, Mycobacterium
PAHWQEWMPAGLFFVAVALF

SEQ ID NO: 343971 - protein, 27 aa, Mycobacterium
PAIATLLGRWFWWPAVVHDRAASRDTV

SEQ ID NO: 343972 - protein, 20 aa, Mycobacterium
PAIRWPMWLRTLLATVALAA

SEQ ID NO: 343973 - protein, 18 aa, Mycobacterium
PAIVGQALITPVVDTDQA

SEQ ID NO: 343974 - protein, 17 aa, Mycobacterium
PAKELPGYWVAQVLGGL

SEQ ID NO: 343975 - protein, 31 aa, Mycobacterium
PALLARWIRRLAIPIMLGWLAIIVLINILVP

SEQ ID NO: 343976 - protein, 20 aa, Mycobacterium
PALRDDWRPVLWAIAILTMV

SEQ ID NO: 343977 - protein, 26 aa, Mycobacterium
PALRFRPLIRLAVEWLEVLAMIVFLP

SEQ ID NO: 343978 - protein, 17 aa, Mycobacterium
PALRFYIAFFLALLGVT

SEQ ID NO: 343979 - protein, 19 aa, Mycobacterium
PALRLKGAYFAIATWALAE

SEQ ID NO: 343980 - protein, 18 aa, Mycobacterium
PALSRRGKPVIDYAGIVL

SEQ ID NO: 343981 - protein, 23 aa, Mycobacterium
PALVRLLGTWFWWPTRVLARPRR

SEQ ID NO: 343982 - protein, 17 aa, Mycobacterium
PAMKYLSYRLIMKRDNS

SEQ ID NO: 343983 - protein, 24 aa, Mycobacterium
PANFAGGLSLFFAVVIATSLSMVF

SEQ ID NO: 343984 - protein, 19 aa, Mycobacterium
PANLPLAWSEDANTGNEPV

SEQ ID NO: 343985 - protein, 18 aa, Mycobacterium
PAPPLPLAAPSPVRGAPP

SEQ ID NO: 343986 - protein, 21 aa, Mycobacterium
PAPRPIALGLFNAIPEAPPLT

SEQ ID NO: 343987 - protein, 18 aa, Mycobacterium
PAPVPWYRTRGAAVALTA

SEQ ID NO: 343988 - protein, 20 aa, Mycobacterium
PARGLHAWWGPLSLLLALWV

SEQ ID NO: 343989 - protein, 20 aa, Mycobacterium
PARGVWWWVSICVMGLAVLA

SEQ ID NO: 343990 - protein, 18 aa, Mycobacterium
PARIGLARIRWRQDILGG

SEQ ID NO: 343991 - protein, 18 aa, Mycobacterium
PARPIAVNVIDFGDDSDR

SEQ ID NO: 343992 - protein, 21 aa, Mycobacterium
PARRWDLPVLRWVDGTRPGRR

SEQ ID NO: 343993 - protein, 17 aa, Mycobacterium
PASAMLRSVGPRPLVRS

SEQ ID NO: 343994 - protein, 19 aa, Mycobacterium
PASEMLRPFGPRSLVRSLL

SEQ ID NO: 343995 - protein, 18 aa, Mycobacterium
PASTMLRPYGPRPAVRQL

SEQ ID NO: 343996 - protein, 24 aa, Mycobacterium
PASWRPGADWEPLALLLGGSILIT

SEQ ID NO: 343997 - protein, 19 aa, Mycobacterium
PATILGCWVALIATVGLFF

SEQ ID NO: 343998 - protein, 19 aa, Mycobacterium
PATILGCWVTLVAAVALFF

SEQ ID NO: 343999 - protein, 19 aa, Mycobacterium
PATLAWLRYRWLRRTPLPV

SEQ ID NO: 344000 - protein, 17 aa, Mycobacterium
PATRSPVFLAFPAMTVA

SEQ ID NO: 344001 - protein, 24 aa, Mycobacterium
PAVLRPGVLVQRVWTRSAPALAAL

SEQ ID NO: 344002 - protein, 25 aa, Mycobacterium
PAVLRWSRNRMAFLAAVLFLMALCF

SEQ ID NO: 344003 - protein, 18 aa, Mycobacterium
PAVLSISVLVLRYGLDKL

SEQ ID NO: 344004 - protein, 20 aa, Mycobacterium
PAVLVGRLMFLLGLPATGLT

SEQ ID NO: 344005 - protein, 22 aa, Mycobacterium
PAVMFFPAMMAMSVLATLAYSL

SEQ ID NO: 344006 - protein, 22 aa, Mycobacterium
PAWGSLRLALPMGGNGDASFLA

SEQ ID NO: 344007 - protein, 19 aa, Mycobacterium
PAWLRRWWLAVVAAAAATV

SEQ ID NO: 344008 - protein, 17 aa, Mycobacterium
PAWLRWQHFFNIVFMMF

SEQ ID NO: 344009 - protein, 20 aa, Mycobacterium
PAWMRRAWLAAAMVAPAVIY

SEQ ID NO: 344010 - protein, 22 aa, Mycobacterium
PAWREAHPYLPFIFTGSAAASG

SEQ ID NO: 344011 - protein, 20 aa, Mycobacterium
PAWRNLRFPLTWAPPEADVA

SEQ ID NO: 344012 - protein, 20 aa, Mycobacterium
PAWVRRLWLAMIIVAPASIW

SEQ ID NO: 344013 - protein, 17 aa, Mycobacterium
PAYRFPSYLGFHIVERW

SEQ ID NO: 344014 - protein, 17 aa, Mycobacterium
PCGLPVVAATALALGFV

SEQ ID NO: 344015 - protein, 19 aa, Mycobacterium
PCMTGFLPASEWRSPADTS

SEQ ID NO: 344016 - protein, 23 aa, Mycobacterium
PDAASGPSWWAAGGIAVVAAALG

SEQ ID NO: 344017 - protein, 19 aa, Mycobacterium
PDAGLLIGNGFSYTAETCP

SEQ ID NO: 344018 - protein, 17 aa, Mycobacterium
PDALGIAVEALRAGSAE

SEQ ID NO: 344019 - protein, 19 aa, Mycobacterium
PDARGAVLVIHENKGLTDH

SEQ ID NO: 344020 - protein, 21 aa, Mycobacterium
PDEVYGWAGWLRAPTTTDPTV

SEQ ID NO: 344021 - protein, 26 aa, Mycobacterium
PDFAEFRLGSVWLRKVAMLVVVVICV

SEQ ID NO: 344022 - protein, 17 aa, Mycobacterium
PDGPIDFGWEIIDATSW

SEQ ID NO: 344023 - protein, 21 aa, Mycobacterium
PDGRFPWVIAVVFAAGAHFAA

SEQ ID NO: 344024 - protein, 17 aa, Mycobacterium
PDKLVWTRVAGDVLDMA

SEQ ID NO: 344025 - protein, 19 aa, Mycobacterium
PDLARLDALFARALATEPA

SEQ ID NO: 344026 - protein, 22 aa, Mycobacterium
PDLEGADQLLLRWRQANDRISS

SEQ ID NO: 344027 - protein, 22 aa, Mycobacterium
PDLFAGIVCWLLLSREVLPRLG

SEQ ID NO: 344028 - protein, 22 aa, Mycobacterium
PDLFAGLVCWLLLSREVLPRLG

SEQ ID NO: 344029 - protein, 17 aa, Mycobacterium
PDLKVFICGGASVSPSL

SEQ ID NO: 344030 - protein, 23 aa, Mycobacterium
PDLRARGSLWLIVVGFSAGVAVL

SEQ ID NO: 344031 - protein, 36 aa, Mycobacterium
PDPGWAPRPNPIVPVPIPIPIPIPGWQPPYNPPYNP

SEQ ID NO: 344032 - protein, 19 aa, Mycobacterium
PDPPHARRAAESGATHDNA

SEQ ID NO: 344033 - protein, 32 aa, Mycobacterium
PDQPPAPEPVPWYRKPAALVGLGALGALIVAL

SEQ ID NO: 344034 - protein, 19 aa, Mycobacterium
PDRFPLKGVFHAAGVLDDA

SEQ ID NO: 344035 - protein, 18 aa, Mycobacterium
PDRNIYVPLAFHLGYHSL

SEQ ID NO: 344036 - protein, 19 aa, Mycobacterium
PDRPVAVNVIDFGDDADRP

SEQ ID NO: 344037 - protein, 19 aa, Mycobacterium
PDSLLWRIGDIAAQPPNRI

SEQ ID NO: 344038 - protein, 25 aa, Mycobacterium
PDTSKPVWITMLWPLADRPRLAPGV

SEQ ID NO: 344039 - protein, 24 aa, Mycobacterium
PDTTRPVGLTMFWPLADRPRLAAG

SEQ ID NO: 344040 - protein, 20 aa, Mycobacterium
PDVLGGLLITVGDEVIDGSI

SEQ ID NO: 344041 - protein, 18 aa, Mycobacterium
PDVLRPDLTIAYTDTDGD

SEQ ID NO: 344042 - protein, 18 aa, Mycobacterium
PDVLRPDLTIAYTDTDGN

SEQ ID NO: 344043 - protein, 18 aa, Mycobacterium
PDVLRPDLTIAYTDTDGY

SEQ ID NO: 344044 - protein, 28 aa, Mycobacterium
PEAKAFFWLNIRRFCLLAGINIAVVVTD

SEQ ID NO: 344045 - protein, 17 aa, Mycobacterium
PEAKWAVFYSMGLGATG

SEQ ID NO: 344046 - protein, 18 aa, Mycobacterium
PEAMVWVALFWAFAALPA

SEQ ID NO: 344047 - protein, 25 aa, Mycobacterium
PEDFWRSAGLPAYRFPDPNGTRFPN

SEQ ID NO: 344048 - protein, 25 aa, Mycobacterium
PEEAELAFLLAGWRDDVRQAPMTGI

SEQ ID NO: 344049 - protein, 19 aa, Mycobacterium
PEFGCLFKGIGRGIKEFAP

SEQ ID NO: 344050 - protein, 19 aa, Mycobacterium
PEFGCLFKGVARGVKEFAP

SEQ ID NO: 344051 - protein, 17 aa, Mycobacterium
PEFRALMRLDWSAAQQR

SEQ ID NO: 344052 - protein, 19 aa, Mycobacterium
PEGRSIVVFAKREFGLRAR

SEQ ID NO: 344053 - protein, 19 aa, Mycobacterium
PEGRWAEFLEEPRLAERMA

SEQ ID NO: 344054 - protein, 19 aa, Mycobacterium
PEHHFPRRGAIDITVGRPI

SEQ ID NO: 344055 - protein, 21 aa, Mycobacterium
PEIRYSMILFNWFGVCLVPIL

SEQ ID NO: 344056 - protein, 17 aa, Mycobacterium
PELCQSVGVAMEPGKPT

SEQ ID NO: 344057 - protein, 19 aa, Mycobacterium
PELDVPAVLARRPQVVLVD

SEQ ID NO: 344058 - protein, 20 aa, Mycobacterium
PELHWAWGYPAVLCVMAVVC

SEQ ID NO: 344059 - protein, 20 aa, Mycobacterium
PELKTALGQQNWQKLPELQS

SEQ ID NO: 344060 - protein, 20 aa, Mycobacterium
PELLGGLSITVGDEVIDGSI

SEQ ID NO: 344061 - protein, 17 aa, Mycobacterium
PELPCVMFGGQSPATLR

SEQ ID NO: 344062 - protein, 18 aa, Mycobacterium
PELPWWLWAIVTLGLVAY

SEQ ID NO: 344063 - protein, 21 aa, Mycobacterium
PELQPALAGQNWAALPGLQTN

SEQ ID NO: 344064 - protein, 19 aa, Mycobacterium
PELRTGGLGVREIKRLAKA

SEQ ID NO: 344065 - protein, 17 aa, Mycobacterium
PELSLSLLSVSRSGNTL

SEQ ID NO: 344066 - protein, 18 aa, Mycobacterium
PELVSSIGSLARVLERLS

SEQ ID NO: 344067 - protein, 18 aa, Mycobacterium
PEMWWVLRVAHWAAGVPM

SEQ ID NO: 344068 - protein, 17 aa, Mycobacterium
PENGVVVVAVWFDRGTD

SEQ ID NO: 344069 - protein, 18 aa, Mycobacterium
PEPIIALGSLVTYVLIER

SEQ ID NO: 344070 - protein, 20 aa, Mycobacterium
PEPMIKVLVYLGFGAERYRY

SEQ ID NO: 344071 - protein, 19 aa, Mycobacterium
PEPPARWGKYVPGEPQLRA

SEQ ID NO: 344072 - protein, 17 aa, Mycobacterium
PEPPWWLEILAWLQKFA

SEQ ID NO: 344073 - protein, 19 aa, Mycobacterium
PEPVFARWVAHFNVATAVL

SEQ ID NO: 344074 - protein, 18 aa, Mycobacterium
PEQRRIAALVLGYTLIIV

SEQ ID NO: 344075 - protein, 18 aa, Mycobacterium
PERFRMLMTLMVESPFLL

SEQ ID NO: 344076 - protein, 18 aa, Mycobacterium
PERFRQALFRGISGFIEI

SEQ ID NO: 344077 - protein, 21 aa, Mycobacterium
PERFYEMLRKFGLGQRTNVGL

SEQ ID NO: 344078 - protein, 21 aa, Mycobacterium
PERFYEMVRKFGLGQRTGVGL

SEQ ID NO: 344079 - protein, 18 aa, Mycobacterium
PERLWEVSELRFAAVAGV

SEQ ID NO: 344080 - protein, 20 aa, Mycobacterium
PESRSQWFLRQLKALGAAEF

SEQ ID NO: 344081 - protein, 26 aa, Mycobacterium
PESTQSRFWARWVGWVMRRPWITALS

SEQ ID NO: 344082 - protein, 25 aa, Mycobacterium
PETTKPVWITMLWPLADRPRLAPGV

SEQ ID NO: 344083 - protein, 20 aa, Mycobacterium
PEVANPALWILAGAVAGLIA

SEQ ID NO: 344084 - protein, 20 aa, Mycobacterium
PEVRAAGTLSRGAKTGGKPR

SEQ ID NO: 344085 - protein, 21 aa, Mycobacterium
PEVRPRLILGASLITLSVLGL

SEQ ID NO: 344086 - protein, 28 aa, Mycobacterium
PEVTAVAYPAHWRPTAVDALRAALSRVP

SEQ ID NO: 344087 - protein, 19 aa, Mycobacterium
PFAGISFLWFIGVVRDGFG

SEQ ID NO: 344088 - protein, 17 aa, Mycobacterium
PFEPLAMRQHVTGPYPI

SEQ ID NO: 344089 - protein, 23 aa, Mycobacterium
PFGEYLPMPWLFKHLSGYAGRAG

SEQ ID NO: 344090 - protein, 17 aa, Mycobacterium
PFGSLVLAAAVTVIEVA

SEQ ID NO: 344091 - protein, 26 aa, Mycobacterium
PFGYGRSRFFYSFVVALVLFTLGSVF

SEQ ID NO: 344092 - protein, 18 aa, Mycobacterium
PFISPSRKIAMRLLYATG

SEQ ID NO: 344093 - protein, 26 aa, Mycobacterium
PFLPRMIHRLALPIVLVWLGIVFVTN

SEQ ID NO: 344094 - protein, 17 aa, Mycobacterium
PFLYAGYCRDDDPAVLV

SEQ ID NO: 344095 - protein, 19 aa, Mycobacterium
PFRCFYLSAPFVVPKKKEV

SEQ ID NO: 344096 - protein, 19 aa, Mycobacterium
PFRCFYLSAPFVVPKTKEV

SEQ ID NO: 344097 - protein, 18 aa, Mycobacterium
PFRCFYLSAPFVVPKVKE

SEQ ID NO: 344098 - protein, 18 aa, Mycobacterium
PFRVHGLLGLLGITRPTE

SEQ ID NO: 344099 - protein, 18 aa, Mycobacterium
PFTATWTCTAFVVNPDGW

SEQ ID NO: 344100 - protein, 17 aa, Mycobacterium
PGAEDFRALPGRGVRAS

SEQ ID NO: 344101 - protein, 18 aa, Mycobacterium
PGDTLYGLHAMMFNEPRV

SEQ ID NO: 344102 - protein, 18 aa, Mycobacterium
PGDVIVFKGPPNWNLGYK

SEQ ID NO: 344103 - protein, 19 aa, Mycobacterium
PGDVVVFKGPPSWNIGYKS

SEQ ID NO: 344104 - protein, 18 aa, Mycobacterium
PGEFRKALREALAENRIA

SEQ ID NO: 344105 - protein, 17 aa, Mycobacterium
PGFPADVLYEFRLASLG

SEQ ID NO: 344106 - protein, 18 aa, Mycobacterium
PGGWPFPPVPWVNSLASF

SEQ ID NO: 344107 - protein, 20 aa, Mycobacterium
PGHATLRMSLTITTAAATDR

SEQ ID NO: 344108 - protein, 17 aa, Mycobacterium
PGIAHFFTMWGFFILLT

SEQ ID NO: 344109 - protein, 18 aa, Mycobacterium
PGIAHFFTMWGFFVLATV

SEQ ID NO: 344110 - protein, 19 aa, Mycobacterium
PGIGAPVRRVWAATSAAAA

SEQ ID NO: 344111 - protein, 17 aa, Mycobacterium
PGIKAKAAFVWDKFPKF

SEQ ID NO: 344112 - protein, 19 aa, Mycobacterium
PGILSLFWEGILLLLQVPG

SEQ ID NO: 344113 - protein, 20 aa, Mycobacterium
PGIPARGIVAVCDFGGSGTS

SEQ ID NO: 344114 - protein, 17 aa, Mycobacterium
PGLPVWWIVAVLVFAGV

SEQ ID NO: 344115 - protein, 20 aa, Mycobacterium
PGLRDDWRPVLWAIAILTMV

SEQ ID NO: 344116 - protein, 18 aa, Mycobacterium
PGLRRLAKWTGLVVGVAT

SEQ ID NO: 344117 - protein, 17 aa, Mycobacterium
PGLRRLAKWTGVIVSVA

SEQ ID NO: 344118 - protein, 20 aa, Mycobacterium
PGMAVFRAVYFFAVEDRFGD

SEQ ID NO: 344119 - protein, 18 aa, Mycobacterium
PGMGPPGRHLRVFDPEQG

SEQ ID NO: 344120 - protein, 20 aa, Mycobacterium
PGPEHPAEWVGPPQEAAPVQ

SEQ ID NO: 344121 - protein, 19 aa, Mycobacterium
PGPILVVTCGIALVGLLTL

SEQ ID NO: 344122 - protein, 22 aa, Mycobacterium
PGPLARWHQRWGLVEEQEIPAE

SEQ ID NO: 344123 - protein, 19 aa, Mycobacterium
PGPPAGSVVQQWDLGTELL

SEQ ID NO: 344124 - protein, 21 aa, Mycobacterium
PGPVLVVACALALVGLLALPG

SEQ ID NO: 344125 - protein, 20 aa, Mycobacterium
PGRGWEIFFGVISLLAGVVM

SEQ ID NO: 344126 - protein, 20 aa, Mycobacterium
PGRGWEIFIGVISLIAGVIM

SEQ ID NO: 344127 - protein, 32 aa, Mycobacterium
PGRPPLARFLYRFSIPILVLWLGAAGLLNLAV

SEQ ID NO: 344128 - protein, 24 aa, Mycobacterium
PGRPWPRVVGALALAVLGACGVML

SEQ ID NO: 344129 - protein, 28 aa, Mycobacterium
PGRQFRINWKWVRRGSAIAVAVMVLLPL

SEQ ID NO: 344130 - protein, 23 aa, Mycobacterium
PGRYAGGHWAWFRAARATHSGAA

SEQ ID NO: 344131 - protein, 25 aa, Mycobacterium
PGRYGFDAGRGWARRPFIGSFAAVV

SEQ ID NO: 344132 - protein, 25 aa, Mycobacterium
PGRYGLDAGRGWARRPFVGSIAALI

SEQ ID NO: 344133 - protein, 17 aa, Mycobacterium
PGRYGLDARRGWAHRPF

SEQ ID NO: 344134 - protein, 18 aa, Mycobacterium
PGSEWARFTVKEMPVNKL

SEQ ID NO: 344135 - protein, 18 aa, Mycobacterium
PGSLEALLPHELRAQPGA

SEQ ID NO: 344136 - protein, 20 aa, Mycobacterium
PGSMSLRLAARVAVAVAISG

SEQ ID NO: 344137 - protein, 19 aa, Mycobacterium
PGSWWKNFGPKMHYRASAM

SEQ ID NO: 344138 - protein, 17 aa, Mycobacterium
PGTCERLGIGPDDCAAA

SEQ ID NO: 344139 - protein, 19 aa, Mycobacterium
PGTCERLGIGPKECEAVNP

SEQ ID NO: 344140 - protein, 18 aa, Mycobacterium
PGTCRAFLPAKDSLARVT

SEQ ID NO: 344141 - protein, 20 aa, Mycobacterium
PGWGSLRLALPMKGNGDAAF

SEQ ID NO: 344142 - protein, 17 aa, Mycobacterium
PGWRYRLAINLSAGILS

SEQ ID NO: 344143 - protein, 18 aa, Mycobacterium
PGWSRLRHAGGYVQTYWM

SEQ ID NO: 344144 - protein, 20 aa, Mycobacterium
PGYSAIWLWLGIALLGAVIL

SEQ ID NO: 344145 - protein, 25 aa, Mycobacterium
PHAPEFWGLLALRAVVFAVLMAIAF

SEQ ID NO: 344146 - protein, 18 aa, Mycobacterium
PHAPWARWRYTKRPRKMH

SEQ ID NO: 344147 - protein, 24 aa, Mycobacterium
PHCADIPMCWAMRSLFDMTDQVDS

SEQ ID NO: 344148 - protein, 19 aa, Mycobacterium
PHCFDIPMCWAMRSLNESL

SEQ ID NO: 344149 - protein, 20 aa, Mycobacterium
PHCFDIPMCWAMRSLNESVD

SEQ ID NO: 344150 - protein, 20 aa, Mycobacterium
PHCGISWGWGAHGLVTNICV

SEQ ID NO: 344151 - protein, 19 aa, Mycobacterium
PHEGGAQFRLVLPINARRS

SEQ ID NO: 344152 - protein, 20 aa, Mycobacterium
PHGPGTLGYRIWGVLASLCF

SEQ ID NO: 344153 - protein, 17 aa, Mycobacterium
PHLRPLLAIIVFTAMLG

SEQ ID NO: 344154 - protein, 22 aa, Mycobacterium
PHPIPALAVICLSVFVISVDAT

SEQ ID NO: 344155 - protein, 17 aa, Mycobacterium
PHPSRWRHVPTILLATS

SEQ ID NO: 344156 - protein, 22 aa, Mycobacterium
PHRALVVWISFAAALVAVGALA

SEQ ID NO: 344157 - protein, 19 aa, Mycobacterium
PHRLLEVYLGFFAGFLMYL

SEQ ID NO: 344158 - protein, 26 aa, Mycobacterium
PHRPRWSRRRMVVVAALAVLLVVAGL

SEQ ID NO: 344159 - protein, 19 aa, Mycobacterium
PHSQFSYFLPDGHEYQITL

SEQ ID NO: 344160 - protein, 17 aa, Mycobacterium
PHSSWLVVRWVVASALG

SEQ ID NO: 344161 - protein, 19 aa, Mycobacterium
PHYLGFHIVERWQFHYSQV

SEQ ID NO: 344162 - protein, 17 aa, Mycobacterium
PHYRLLGGIPLAYAVIV

SEQ ID NO: 344163 - protein, 17 aa, Mycobacterium
PICWSLRSIFDAMDGVD

SEQ ID NO: 344164 - protein, 17 aa, Mycobacterium
PIGSTWQVYAFRDTALA

SEQ ID NO: 344165 - protein, 32 aa, Mycobacterium
PIHRRWRRIGTMVARWPGPVLVAAALVLLICT

SEQ ID NO: 344166 - protein, 17 aa, Mycobacterium
PIISFGFVVLAASMVTF

SEQ ID NO: 344167 - protein, 23 aa, Mycobacterium
PILPQAWRAWAWVIIVVGVVSVL

SEQ ID NO: 344168 - protein, 21 aa, Mycobacterium
PILQPFLDYAFGFRRGVDAGQ

SEQ ID NO: 344169 - protein, 19 aa, Mycobacterium
PILRIVMRRRRLVGTWPLI

SEQ ID NO: 344170 - protein, 22 aa, Mycobacterium
PILTRSGAEWMPNFIALLQRKL

SEQ ID NO: 344171 - protein, 17 aa, Mycobacterium
PIMARFHGMWSVGTLVG

SEQ ID NO: 344172 - protein, 18 aa, Mycobacterium
PIRWPAFPYDPWVRISLW

SEQ ID NO: 344173 - protein, 17 aa, Mycobacterium
PISGAIYQWSRRMGGEV

SEQ ID NO: 344174 - protein, 28 aa, Mycobacterium
PKEPPWRRLRFSQLLIGFSAVVAMTAIG

SEQ ID NO: 344175 - protein, 20 aa, Mycobacterium
PKGRKLWIAALVAIVGVIVL

SEQ ID NO: 344176 - protein, 24 aa, Mycobacterium
PKHARPGGIAKWIRVLAVPIILVW

SEQ ID NO: 344177 - protein, 21 aa, Mycobacterium
PKKRRLRWLIAAVLVVLIALA

SEQ ID NO: 344178 - protein, 24 aa, Mycobacterium
PKLGLRLVLLVGMLVMSVGFLCMR

SEQ ID NO: 344179 - protein, 24 aa, Mycobacterium
PKPQWPGSGPGGWDPGPGRGSDNG

SEQ ID NO: 344180 - protein, 21 aa, Mycobacterium
PKPRIAAVVAMCLATAGLLAW

SEQ ID NO: 344181 - protein, 17 aa, Mycobacterium
PKPRLCVHYDAEAASAT

SEQ ID NO: 344182 - protein, 18 aa, Mycobacterium
PKPRRWKSWGATLETSVA

SEQ ID NO: 344183 - protein, 20 aa, Mycobacterium
PKRAEVLGVIHLKDVVKQGM

SEQ ID NO: 344184 - protein, 32 aa, Mycobacterium
PKRAIRTRGWRRIGTAIVRWPGAVLASACALA

SEQ ID NO: 344185 - protein, 23 aa, Mycobacterium
PKRELWLAWGILVVFYNLFFPMF

SEQ ID NO: 344186 - protein, 23 aa, Mycobacterium
PKRLEAVGATGGWMIVGLGAGVA

SEQ ID NO: 344187 - protein, 19 aa, Mycobacterium
PKTPRWLWIAAGAAVVLVI

SEQ ID NO: 344188 - protein, 18 aa, Mycobacterium
PKTRRISFRFGESESEDR

SEQ ID NO: 344189 - protein, 24 aa, Mycobacterium
PKYRGRLVLCFQIAIGVGIVIATI

SEQ ID NO: 344190 - protein, 22 aa, Mycobacterium
PLADRTRRFWAWTVAGYALTLI

SEQ ID NO: 344191 - protein, 19 aa, Mycobacterium
PLAFAVCALFPLLALPVVP

SEQ ID NO: 344192 - protein, 25 aa, Mycobacterium
PLATWATACGWAFSLAMIDGFERGF

SEQ ID NO: 344193 - protein, 20 aa, Mycobacterium
PLDMTWGGLPLFVPVGYISY

SEQ ID NO: 344194 - protein, 21 aa, Mycobacterium
PLDRTRTPVGFDRVLATVDKL

SEQ ID NO: 344195 - protein, 25 aa, Mycobacterium
PLEFGGFIAWLSWLVLHLVYLVGFK

SEQ ID NO: 344196 - protein, 18 aa, Mycobacterium
PLEQFFWYRSSKIVLRYR

SEQ ID NO: 344197 - protein, 24 aa, Mycobacterium
PLFIPRFLFTVSICGVLVATGAYL

SEQ ID NO: 344198 - protein, 20 aa, Mycobacterium
PLFPELRSISLLQVLTGIAS

SEQ ID NO: 344199 - protein, 17 aa, Mycobacterium
PLFPPVWEPPRRQENPW

SEQ ID NO: 344200 - protein, 19 aa, Mycobacterium
PLFREHLHRAGVPMNSPEE

SEQ ID NO: 344201 - protein, 17 aa, Mycobacterium
PLGEIISAGKLSFPISA

SEQ ID NO: 344202 - protein, 18 aa, Mycobacterium
PLGVAIGWYRPVADFLNP

SEQ ID NO: 344203 - protein, 23 aa, Mycobacterium
PLGWRWAALVWAYALFWFLIEDR

SEQ ID NO: 344204 - protein, 25 aa, Mycobacterium
PLGWVLSVVVARGWYAVTRATWWTH

SEQ ID NO: 344205 - protein, 25 aa, Mycobacterium
PLHWAVAPCSFIFLVAVGADYNLLL

SEQ ID NO: 344206 - protein, 18 aa, Mycobacterium
PLIGLIAVLVWIWEVNHW

SEQ ID NO: 344207 - protein, 17 aa, Mycobacterium
PLIPLAVSGFLTSRKKA

SEQ ID NO: 344208 - protein, 19 aa, Mycobacterium
PLIRYLIKVPREFINDYLF

SEQ ID NO: 344209 - protein, 18 aa, Mycobacterium
PLKAELPASGGLYPTANV

SEQ ID NO: 344210 - protein, 19 aa, Mycobacterium
PLKFAQLVGFVFAICGIIG

SEQ ID NO: 344211 - protein, 18 aa, Mycobacterium
PLKVGGIMRTYGRLLHDA

SEQ ID NO: 344212 - protein, 18 aa, Mycobacterium
PLLACIAYALAIDYEIFV

SEQ ID NO: 344213 - protein, 18 aa, Mycobacterium
PLLALCGRRLFWPFIPRA

SEQ ID NO: 344214 - protein, 19 aa, Mycobacterium
PLLALCGRRLFWPFIPRPE

SEQ ID NO: 344215 - protein, 20 aa, Mycobacterium
PLLALSGRRLFWPFIPEPDA

SEQ ID NO: 344216 - protein, 17 aa, Mycobacterium
PLLEPALTILTVGALGA

SEQ ID NO: 344217 - protein, 19 aa, Mycobacterium
PLLGLRLTAFLGLLVTAVG

SEQ ID NO: 344218 - protein, 17 aa, Mycobacterium
PLLKKLRIDPAIVSGPL

SEQ ID NO: 344219 - protein, 17 aa, Mycobacterium
PLLPLSLFTARNFAAVN

SEQ ID NO: 344220 - protein, 28 aa, Mycobacterium
PLLPRLIHRFSVLILLVWLGLTAIVNLA

SEQ ID NO: 344221 - protein, 19 aa, Mycobacterium
PLLRELRSALVAGEPMGLV

SEQ ID NO: 344222 - protein, 17 aa, Mycobacterium
PLLRPGYLLLRDAVSTP

SEQ ID NO: 344223 - protein, 19 aa, Mycobacterium
PLMLGALWASARLARRADS

SEQ ID NO: 344224 - protein, 23 aa, Mycobacterium
PLPGSAPKPVWLGAFAHPERDKR

SEQ ID NO: 344225 - protein, 26 aa, Mycobacterium
PLPTEIYWRRRGLALGIAVVVIGIAV

SEQ ID NO: 344226 - protein, 24 aa, Mycobacterium
PLPTFPELPAAVLDQATTSSETTA

SEQ ID NO: 344227 - protein, 18 aa, Mycobacterium
PLPVPWSVLSQFAAGPAL

SEQ ID NO: 344228 - protein, 18 aa, Mycobacterium
PLPVRAFDVRCAQQAYRY

SEQ ID NO: 344229 - protein, 24 aa, Mycobacterium
PLPWYKRAAVVFSLAAAGLAILVA

SEQ ID NO: 344230 - protein, 22 aa, Mycobacterium
PLPWYKRTALVLSVAGAAAAVL

SEQ ID NO: 344231 - protein, 22 aa, Mycobacterium
PLQKRFSAMTVIGPDDKTDQWQ

SEQ ID NO: 344232 - protein, 17 aa, Mycobacterium
PLRARWVLWVGGGALVG

SEQ ID NO: 344233 - protein, 21 aa, Mycobacterium
PLRHPWRWVAAAVIIVLVGLF

SEQ ID NO: 344234 - protein, 17 aa, Mycobacterium
PLRIGMAMGPVVAGVVG

SEQ ID NO: 344235 - protein, 17 aa, Mycobacterium
PLRLLRLVTLIAVLQRV

SEQ ID NO: 344236 - protein, 21 aa, Mycobacterium
PLRYRAGRVGDFFRIEGPPGL

SEQ ID NO: 344237 - protein, 27 aa, Mycobacterium
PLSASQWLVCFAVASTVLWVSEIRKLV

SEQ ID NO: 344238 - protein, 23 aa, Mycobacterium
PLTAALSLMWGWRLAVVCVTVAA

SEQ ID NO: 344239 - protein, 23 aa, Mycobacterium
PLTAVMSLMWGWRLAAVCVTVAA

SEQ ID NO: 344240 - protein, 18 aa, Mycobacterium
PLTIPWSVLSLFAAGPTL

SEQ ID NO: 344241 - protein, 25 aa, Mycobacterium
PLTLFAIAGMMLFPACNDLLTMFVA

SEQ ID NO: 344242 - protein, 23 aa, Mycobacterium
PLVISGWMLVVWMLVAVGSGIGY

SEQ ID NO: 344243 - protein, 17 aa, Mycobacterium
PLVRKTAAWSWRLLVIL

SEQ ID NO: 344244 - protein, 20 aa, Mycobacterium
PLVRWIIKVPREFINSYLFN

SEQ ID NO: 344245 - protein, 21 aa, Mycobacterium
PLWLCSLCLMVLMTTTNLFSV

SEQ ID NO: 344246 - protein, 20 aa, Mycobacterium
PLWRKFIRFWTVSFPVVVYR

SEQ ID NO: 344247 - protein, 18 aa, Mycobacterium
PLYDYNWVVAFLVAMFVY

SEQ ID NO: 344248 - protein, 18 aa, Mycobacterium
PLYRRLRTRMGTGGAAAT

SEQ ID NO: 344249 - protein, 18 aa, Mycobacterium
PMFAWFCIYAYRKFVRYE

SEQ ID NO: 344250 - protein, 19 aa, Mycobacterium
PMGRRLGALMIDWLISYGL

SEQ ID NO: 344251 - protein, 17 aa, Mycobacterium
PMHQVFLGVRSLLYLNG

SEQ ID NO: 344252 - protein, 18 aa, Mycobacterium
PMIACLVAGCGTWLVYRL

SEQ ID NO: 344253 - protein, 18 aa, Mycobacterium
PMIAWRYLDLRGDDLTPD

SEQ ID NO: 344254 - protein, 21 aa, Mycobacterium
PMLLFCIAFGLSMDYEVFLIS

SEQ ID NO: 344255 - protein, 20 aa, Mycobacterium
PMMLMFPLMFLMAAGGMMAG

SEQ ID NO: 344256 - protein, 23 aa, Mycobacterium
PMRWFQRPVLWFFAAAVFSAAVF

SEQ ID NO: 344257 - protein, 17 aa, Mycobacterium
PMTKMSIAGPWVSIAAP

SEQ ID NO: 344258 - protein, 27 aa, Mycobacterium
PMYGIALVWLFNHWQAVFWVNVPLAVI

SEQ ID NO: 344259 - protein, 21 aa, Mycobacterium
PNCGVSWNLLAGIGRIESGHA

SEQ ID NO: 344260 - protein, 24 aa, Mycobacterium
PNEPLWLGMDAWRWMFLAMAVPAV

SEQ ID NO: 344261 - protein, 24 aa, Mycobacterium
PNGKFTIGLLWSGEKAWKQSGERR

SEQ ID NO: 344262 - protein, 20 aa, Mycobacterium
PNIDGCWGFPFGPVKVPEGK

SEQ ID NO: 344263 - protein, 17 aa, Mycobacterium
PNINVRLAIEWLDKYSD

SEQ ID NO: 344264 - protein, 26 aa, Mycobacterium
PNPEERPRLLLGFAMVALPILGLWHL

SEQ ID NO: 344265 - protein, 18 aa, Mycobacterium
PNPGDWLLWDGKRSPIDL

SEQ ID NO: 344266 - protein, 18 aa, Mycobacterium
PNSLLPRWLPATTGSHGW

SEQ ID NO: 344267 - protein, 23 aa, Mycobacterium
PNTPSRIALRWARIAVLIVTGLV

SEQ ID NO: 344268 - protein, 20 aa, Mycobacterium
PNVYIPWSITVTPISNSEIG

SEQ ID NO: 344269 - protein, 18 aa, Mycobacterium
PNYACFVAAWILAGVAMS

SEQ ID NO: 344270 - protein, 17 aa, Mycobacterium
PPAAAAWRRGQDSVIAR

SEQ ID NO: 344271 - protein, 26 aa, Mycobacterium
PPADEPRPRVPLTLTGILAAVALLAV

SEQ ID NO: 344272 - protein, 24 aa, Mycobacterium
PPAPRWAWKVLIPIGALGMVLMAI

SEQ ID NO: 344273 - protein, 22 aa, Mycobacterium
PPAPRWAWPTLVTVGLIGLIVM

SEQ ID NO: 344274 - protein, 17 aa, Mycobacterium
PPAPWPGYAEDFPAPPR

SEQ ID NO: 344275 - protein, 18 aa, Mycobacterium
PPASSLISLAPKERNVAV

SEQ ID NO: 344276 - protein, 22 aa, Mycobacterium
PPAWALCALFPLAAVPLVPAEP

SEQ ID NO: 344277 - protein, 19 aa, Mycobacterium
PPCAIGMLVAVFAALTLGP

SEQ ID NO: 344278 - protein, 19 aa, Mycobacterium
PPCIMMFLHMRYWWVGIAL

SEQ ID NO: 344279 - protein, 33 aa, Mycobacterium
PPDAEPPVPWYRKPAALVGLGALGAVLIALIVF

SEQ ID NO: 344280 - protein, 18 aa, Mycobacterium
PPDRLERVLSLVPGNPRI

SEQ ID NO: 344281 - protein, 24 aa, Mycobacterium
PPDSVWWWVCVSLLALVVLVMAAN

SEQ ID NO: 344282 - protein, 19 aa, Mycobacterium
PPEPEWGLLVSDGRKYIAT

SEQ ID NO: 344283 - protein, 18 aa, Mycobacterium
PPERRGTALSVWGATAGI

SEQ ID NO: 344284 - protein, 20 aa, Mycobacterium
PPFAWREFIHQAWFVARVSI

SEQ ID NO: 344285 - protein, 17 aa, Mycobacterium
PPFAWREYIAQAWFVAR

SEQ ID NO: 344286 - protein, 17 aa, Mycobacterium
PPFEIAVVLILVMFLAG

SEQ ID NO: 344287 - protein, 27 aa, Mycobacterium
PPFLPRMIHKLALPIVLVWLGIVFVTN

SEQ ID NO: 344288 - protein, 19 aa, Mycobacterium
PPFRTAGHRGLGNWQGGHR

SEQ ID NO: 344289 - protein, 17 aa, Mycobacterium
PPFSTWYAAMLFAVVPL

SEQ ID NO: 344290 - protein, 19 aa, Mycobacterium
PPGDETFIWLTLALAGVWA

SEQ ID NO: 344291 - protein, 22 aa, Mycobacterium
PPGRRAAVIAAHLVWIALLAAG

SEQ ID NO: 344292 - protein, 18 aa, Mycobacterium
PPKLPALFVGAAIIGPTV

SEQ ID NO: 344293 - protein, 24 aa, Mycobacterium
PPKTGRRNWGWVIAIILVIAALAA

SEQ ID NO: 344294 - protein, 20 aa, Mycobacterium
PPKYCLSEFDLAEDTGPTPP

SEQ ID NO: 344295 - protein, 24 aa, Mycobacterium
PPLKFAQLVGFVFAAVGAVGFAFG

SEQ ID NO: 344296 - protein, 21 aa, Mycobacterium
PPLLRRVWEAIIGEFTPPSTP

SEQ ID NO: 344297 - protein, 21 aa, Mycobacterium
PPLWPHSWPFIAQVLAAILVA

SEQ ID NO: 344298 - protein, 18 aa, Mycobacterium
PPPARIVLMSDGKETVPS

SEQ ID NO: 344299 - protein, 19 aa, Mycobacterium
PPPDVFSALTFITLAIFLG

SEQ ID NO: 344300 - protein, 21 aa, Mycobacterium
PPPGWRLLNLDAVRPFATGAG

SEQ ID NO: 344301 - protein, 23 aa, Mycobacterium
PPPKPGTVYQMWLLGDQGATSAG

SEQ ID NO: 344302 - protein, 24 aa, Mycobacterium
PPPLFRVAGHRGLRGWQGGHRSAD

SEQ ID NO: 344303 - protein, 17 aa, Mycobacterium
PPPPGYGPPPGWQPPGY

SEQ ID NO: 344304 - protein, 20 aa, Mycobacterium
PPPPRWVWLPLIAVGAVGMV

SEQ ID NO: 344305 - protein, 21 aa, Mycobacterium
PPPRWVWPPLIAVGGVGIVLM

SEQ ID NO: 344306 - protein, 17 aa, Mycobacterium
PPPSPSGNRVWWILGTV

SEQ ID NO: 344307 - protein, 18 aa, Mycobacterium
PPPTMPPALAWWAASLQL

SEQ ID NO: 344308 - protein, 25 aa, Mycobacterium
PPQRPSGNRMWWIMGTVIAVGVLAL

SEQ ID NO: 344309 - protein, 19 aa, Mycobacterium
PPQRSGWDIALSIALLVLT

SEQ ID NO: 344310 - protein, 18 aa, Mycobacterium
PPRFTGWVAGAGFLAAII

SEQ ID NO: 344311 - protein, 18 aa, Mycobacterium
PPRLPVVMMIAGEFNTPA

SEQ ID NO: 344312 - protein, 18 aa, Mycobacterium
PPRLPVVMMIGGQFNTPA

SEQ ID NO: 344313 - protein, 18 aa, Mycobacterium
PPRLYTAAAWVVIVAGIV

SEQ ID NO: 344314 - protein, 23 aa, Mycobacterium
PPRRPAHRKLVGWLSAAAGLVLA

SEQ ID NO: 344315 - protein, 25 aa, Mycobacterium
PPRRRARGRLVAWISLAAAVVVIAA

SEQ ID NO: 344316 - protein, 20 aa, Mycobacterium
PPRRRWPALAATAVVAAAIG

SEQ ID NO: 344317 - protein, 19 aa, Mycobacterium
PPRSHRWWLGLNVAGALAL

SEQ ID NO: 344318 - protein, 26 aa, Mycobacterium
PPTHRFPHLPPLPSVITIPGVPTTIT

SEQ ID NO: 344319 - protein, 18 aa, Mycobacterium
PPTPAWRKLLAQFHSPLI

SEQ ID NO: 344320 - protein, 17 aa, Mycobacterium
PPTTIRIALAVLTIGVV

SEQ ID NO: 344321 - protein, 23 aa, Mycobacterium
PPVAWRILVVLGLIGTVLMIVWF

SEQ ID NO: 344322 - protein, 20 aa, Mycobacterium
PPVFFGWRPSLVAATLLSPA

SEQ ID NO: 344323 - protein, 23 aa, Mycobacterium
PPVLSASIPAHWSPQTVSTLRDA

SEQ ID NO: 344324 - protein, 17 aa, Mycobacterium
PPVPRLPPRLPIHKAAL

SEQ ID NO: 344325 - protein, 25 aa, Mycobacterium
PPVTSRWRWVPAFFGWFVGIQAILN

SEQ ID NO: 344326 - protein, 17 aa, Mycobacterium
PQAALWLSLTTLFGLLA

SEQ ID NO: 344327 - protein, 19 aa, Mycobacterium
PQCPFKWLTGWNCPFCGGL

SEQ ID NO: 344328 - protein, 21 aa, Mycobacterium
PQGVWYLGPFPLRAYALCIIV

SEQ ID NO: 344329 - protein, 18 aa, Mycobacterium
PQIRRLDVTLARLGPALD

SEQ ID NO: 344330 - protein, 22 aa, Mycobacterium
PQLDAGPFLSYGIQWIAFGILA

SEQ ID NO: 344331 - protein, 18 aa, Mycobacterium
PQLHLAIGIGVRALTMAA

SEQ ID NO: 344332 - protein, 18 aa, Mycobacterium
PQMTWPEAMGLVIVDGLI

SEQ ID NO: 344333 - protein, 17 aa, Mycobacterium
PQPPHGFEQPQGFDPFD

SEQ ID NO: 344334 - protein, 23 aa, Mycobacterium
PQPPRRAAVHGGWEQLLRRLATN

SEQ ID NO: 344335 - protein, 17 aa, Mycobacterium
PQQRLLLEVAWEALEHA

SEQ ID NO: 344336 - protein, 19 aa, Mycobacterium
PQRLRRWWWGLLLAFVPIH

SEQ ID NO: 344337 - protein, 19 aa, Mycobacterium
PRADWLRALRRAFQVTPHS

SEQ ID NO: 344338 - protein, 20 aa, Mycobacterium
PRAGEFPAHIGTGPASEFYR

SEQ ID NO: 344339 - protein, 20 aa, Mycobacterium
PRAKLFTALFLILGLVVVGE

SEQ ID NO: 344340 - protein, 20 aa, Mycobacterium
PRARLRILPGDRVHAASLAG

SEQ ID NO: 344341 - protein, 21 aa, Mycobacterium
PRATLPWPYTWDRVLGQSVSG

SEQ ID NO: 344342 - protein, 17 aa, Mycobacterium
PRAVAGFGFSVVAISLI

SEQ ID NO: 344343 - protein, 19 aa, Mycobacterium
PRDLGPLLAIWGISVGVMV

SEQ ID NO: 344344 - protein, 24 aa, Mycobacterium
PRDPIPRWLRYVLMADRAGSAWYV

SEQ ID NO: 344345 - protein, 20 aa, Mycobacterium
PREMKLAAGYFLVTPLIVLV

SEQ ID NO: 344346 - protein, 23 aa, Mycobacterium
PREVLPLLVPVVLVSALFNGSLV

SEQ ID NO: 344347 - protein, 17 aa, Mycobacterium
PRFLFSMSVVGVLVATS

SEQ ID NO: 344348 - protein, 18 aa, Mycobacterium
PRFMRFVRTFAWPIIIGW

SEQ ID NO: 344349 - protein, 18 aa, Mycobacterium
PRGHRLRTQLALATVGIL

SEQ ID NO: 344350 - protein, 17 aa, Mycobacterium
PRGKWSVPTPYGGPQWP

SEQ ID NO: 344351 - protein, 21 aa, Mycobacterium
PRGKYWWVRWVILGMVAIVLA

SEQ ID NO: 344352 - protein, 29 aa, Mycobacterium
PRGPLPTEIYWRRRGLALGIAVVVIGVAV

SEQ ID NO: 344353 - protein, 21 aa, Mycobacterium
PRGPLPTEIYWRRRGLAVGVA

SEQ ID NO: 344354 - protein, 19 aa, Mycobacterium
PRGPLVFRVAERMSLISDA

SEQ ID NO: 344355 - protein, 18 aa, Mycobacterium
PRHRVVIIGSGFGGLNAA

SEQ ID NO: 344356 - protein, 19 aa, Mycobacterium
PRLATFKVFKRIDGSVDET

SEQ ID NO: 344357 - protein, 20 aa, Mycobacterium
PRLDFSELVLRSGAPDPIVS

SEQ ID NO: 344358 - protein, 17 aa, Mycobacterium
PRLFRSPVFTVCCVLAF

SEQ ID NO: 344359 - protein, 21 aa, Mycobacterium
PRLGALPLWTWLATLLVLMTI

SEQ ID NO: 344360 - protein, 19 aa, Mycobacterium
PRLLVCVGAGLLLYASFPP

SEQ ID NO: 344361 - protein, 19 aa, Mycobacterium
PRLPVTIAAGITFFDYQPW

SEQ ID NO: 344362 - protein, 19 aa, Mycobacterium
PRLRALGWTGILDKGADVD

SEQ ID NO: 344363 - protein, 33 aa, Mycobacterium
PRLRECRSLRYVFCGGEPLPIALCRRVAEALPH

SEQ ID NO: 344364 - protein, 22 aa, Mycobacterium
PRLRSYGGFAYRARWLIVAVVA

SEQ ID NO: 344365 - protein, 21 aa, Mycobacterium
PRLVIVPALFLSAAVLGFIMV

SEQ ID NO: 344366 - protein, 19 aa, Mycobacterium
PRLVSLYGTEIWDEMTREQ

SEQ ID NO: 344367 - protein, 17 aa, Mycobacterium
PRLWACYALALMLAILL

SEQ ID NO: 344368 - protein, 27 aa, Mycobacterium
PRMIRLFAVPIILGWIALIVVVNVTVP

SEQ ID NO: 344369 - protein, 17 aa, Mycobacterium
PRMTVLQVLAWVGYLVM

SEQ ID NO: 344370 - protein, 20 aa, Mycobacterium
PRNYRLIVTVARDGRQLKMS

SEQ ID NO: 344371 - protein, 19 aa, Mycobacterium
PRPEVVLRFTGTQWVAIDL

SEQ ID NO: 344372 - protein, 20 aa, Mycobacterium
PRPFIPRMIRTFAVPLILGW

SEQ ID NO: 344373 - protein, 17 aa, Mycobacterium
PRPLPPVAPSLSPETVT

SEQ ID NO: 344374 - protein, 17 aa, Mycobacterium
PRPLRPDWVITRPRLTG

SEQ ID NO: 344375 - protein, 26 aa, Mycobacterium
PRPRKRRIGWSRLLVFGVLPISALLI

SEQ ID NO: 344376 - protein, 19 aa, Mycobacterium
PRPSAWPLVALAITAIVGV

SEQ ID NO: 344377 - protein, 18 aa, Mycobacterium
PRPVQNLLAFWVGALVVN

SEQ ID NO: 344378 - protein, 17 aa, Mycobacterium
PRQRLRVPIGISDHGVR

SEQ ID NO: 344379 - protein, 25 aa, Mycobacterium
PRRFAEISPRFLVPRFSTIVSSAVT

SEQ ID NO: 344380 - protein, 18 aa, Mycobacterium
PRRFDVLIAAVAVALGIP

SEQ ID NO: 344381 - protein, 18 aa, Mycobacterium
PRRLISSFGHWIRRCLSR

SEQ ID NO: 344382 - protein, 19 aa, Mycobacterium
PRRRILRRLLITSLGLATV

SEQ ID NO: 344383 - protein, 22 aa, Mycobacterium
PRRRLGRGAAIAIVLASVATLA

SEQ ID NO: 344384 - protein, 18 aa, Mycobacterium
PRRRVWWPPVGVRIALAL

SEQ ID NO: 344385 - protein, 21 aa, Mycobacterium
PRSEFAVSLALVLLMLPVIVR

SEQ ID NO: 344386 - protein, 18 aa, Mycobacterium
PRSLDWFGLLTLGSGIAA

SEQ ID NO: 344387 - protein, 18 aa, Mycobacterium
PRSLRGQLLLGVLAVVTV

SEQ ID NO: 344388 - protein, 20 aa, Mycobacterium
PRSRSGIEYIYLLKREVVEM

SEQ ID NO: 344389 - protein, 20 aa, Mycobacterium
PRSVTVLALVPFFSTVIGTV

SEQ ID NO: 344390 - protein, 18 aa, Mycobacterium
PRSVVGFGFSLMAIGVTW

SEQ ID NO: 344391 - protein, 17 aa, Mycobacterium
PRTKLFATLFLILVLVV

SEQ ID NO: 344392 - protein, 17 aa, Mycobacterium
PRTRGRAGLWTWITDTG

SEQ ID NO: 344393 - protein, 20 aa, Mycobacterium
PRTVRWNLRLDVADVDGQLM

SEQ ID NO: 344394 - protein, 21 aa, Mycobacterium
PRVVPPSFLRRAMPVVIVILI

SEQ ID NO: 344395 - protein, 20 aa, Mycobacterium
PRWLGVPLYIVLGWVAVWFC

SEQ ID NO: 344396 - protein, 20 aa, Mycobacterium
PRWVWLRYITLWAGLTVGAV

SEQ ID NO: 344397 - protein, 20 aa, Mycobacterium
PRYMAVCLLAGYTWLLVPAV

SEQ ID NO: 344398 - protein, 23 aa, Mycobacterium
PRYNKKIAVGFAVITVAATVLVS

SEQ ID NO: 344399 - protein, 18 aa, Mycobacterium
PSAALWAALSTRWSNPAL

SEQ ID NO: 344400 - protein, 17 aa, Mycobacterium
PSAPRWVGIPLYLMLGY

SEQ ID NO: 344401 - protein, 17 aa, Mycobacterium
PSARWGWSRINYRTWHI

SEQ ID NO: 344402 - protein, 22 aa, Mycobacterium
PSEIYWRRRALAIGVVVVVVAI

SEQ ID NO: 344403 - protein, 25 aa, Mycobacterium
PSIAALLGRWFWWPRRVYSRPVNTA

SEQ ID NO: 344404 - protein, 17 aa, Mycobacterium
PSLAAQVQFSDPWRDPN

SEQ ID NO: 344405 - protein, 22 aa, Mycobacterium
PSLICALTVAWLDRFLAVGGES

SEQ ID NO: 344406 - protein, 17 aa, Mycobacterium
PSLNLLAVQTFPDRAGK

SEQ ID NO: 344407 - protein, 17 aa, Mycobacterium
PSLPLLIAWRSVGGVAA

SEQ ID NO: 344408 - protein, 20 aa, Mycobacterium
PSLRCWTRFERLQAVVLPFV

SEQ ID NO: 344409 - protein, 17 aa, Mycobacterium
PSLSGRLRNPWILLAAA

SEQ ID NO: 344410 - protein, 23 aa, Mycobacterium
PSLSLRWRVMLLAMSMVAMVVVL

SEQ ID NO: 344411 - protein, 17 aa, Mycobacterium
PSLSRYAWHRVRRIMPA

SEQ ID NO: 344412 - protein, 26 aa, Mycobacterium
PSPPRGVWHLGPLPIRAYAFFIIIGI

SEQ ID NO: 344413 - protein, 26 aa, Mycobacterium
PSPSGNRVWWILGTVIVIGVIALAGG

SEQ ID NO: 344414 - protein, 21 aa, Mycobacterium
PSRMLMPLAFAAKVGPLLILV

SEQ ID NO: 344415 - protein, 19 aa, Mycobacterium
PSRRCWKRRSASREGDSTS

SEQ ID NO: 344416 - protein, 20 aa, Mycobacterium
PSTPELLGILAIVVAVAARR

SEQ ID NO: 344417 - protein, 18 aa, Mycobacterium
PSVGRWVAVVAVLAVLTI

SEQ ID NO: 344418 - protein, 20 aa, Mycobacterium
PSVRIGRHWVSFAWLAVGAL

SEQ ID NO: 344419 - protein, 24 aa, Mycobacterium
PSVVSLVWFCVFGGAAIHEQQNGV

SEQ ID NO: 344420 - protein, 18 aa, Mycobacterium
PTAPRWVGVPLYLLLGWV

SEQ ID NO: 344421 - protein, 24 aa, Mycobacterium
PTAPSHPRWWFLWTTPGRILSIGM

SEQ ID NO: 344422 - protein, 20 aa, Mycobacterium
PTAQCLVAWEAQRIRDARGG

SEQ ID NO: 344423 - protein, 23 aa, Mycobacterium
PTDFRFLGWHWTLPLGVAILLAA

SEQ ID NO: 344424 - protein, 18 aa, Mycobacterium
PTEAPVFYLGYAMLLVVA

SEQ ID NO: 344425 - protein, 18 aa, Mycobacterium
PTFALARGAAMAAAGAGS

SEQ ID NO: 344426 - protein, 23 aa, Mycobacterium
PTFLRHIRPILGLGVGLVVVSAF

SEQ ID NO: 344427 - protein, 17 aa, Mycobacterium
PTGLRLVIDNAIANAVK

SEQ ID NO: 344428 - protein, 18 aa, Mycobacterium
PTGLRLVIDNAIANAVKH

SEQ ID NO: 344429 - protein, 20 aa, Mycobacterium
PTGWAVAFSTPFQMFKRYSQ

SEQ ID NO: 344430 - protein, 17 aa, Mycobacterium
PTLIPWLSGFLILTIAG

SEQ ID NO: 344431 - protein, 17 aa, Mycobacterium
PTPRPATVITIAPAGVR

SEQ ID NO: 344432 - protein, 28 aa, Mycobacterium
PTPWYRRPAMLIAWLISVVILIGLIVFG

SEQ ID NO: 344433 - protein, 17 aa, Mycobacterium
PTRPKRFAWLLGAALAA

SEQ ID NO: 344434 - protein, 22 aa, Mycobacterium
PTRRPSLWKVLAVLCTGIAIVG

SEQ ID NO: 344435 - protein, 22 aa, Mycobacterium
PTSFVRRTWLVLRMNPQRNIAA

SEQ ID NO: 344436 - protein, 18 aa, Mycobacterium
PTSFYTLPISDFGADSNG

SEQ ID NO: 344437 - protein, 17 aa, Mycobacterium
PTTRLTSMYGYGVGYAI

SEQ ID NO: 344438 - protein, 25 aa, Mycobacterium
PTTSTRPSVVVPIPGGGNIQVPVGG

SEQ ID NO: 344439 - protein, 17 aa, Mycobacterium
PTVICLTVYGFSFAMLA

SEQ ID NO: 344440 - protein, 19 aa, Mycobacterium
PTWFAWLIVTWLWLTVLFA

SEQ ID NO: 344441 - protein, 18 aa, Mycobacterium
PTWFGWLIVAWLWLTVVF

SEQ ID NO: 344442 - protein, 21 aa, Mycobacterium
PTWREGHWYTRLIGIDHVLTR

SEQ ID NO: 344443 - protein, 17 aa, Mycobacterium
PVAATPIMRWLRDVEGT

SEQ ID NO: 344444 - protein, 22 aa, Mycobacterium
PVALRLLWTVPLLSFFAAGAGI

SEQ ID NO: 344445 - protein, 17 aa, Mycobacterium
PVAMSGLAQVNRDSVDA

SEQ ID NO: 344446 - protein, 19 aa, Mycobacterium
PVAPEAYALYGFSRIAPQG

SEQ ID NO: 344447 - protein, 19 aa, Mycobacterium
PVAPEAYALYGISRVLPPA

SEQ ID NO: 344448 - protein, 19 aa, Mycobacterium
PVAPEAYALYGISRVLPQA

SEQ ID NO: 344449 - protein, 20 aa, Mycobacterium
PVAPEAYALYGLSRVAPQGL

SEQ ID NO: 344450 - protein, 27 aa, Mycobacterium
PVARLWRWLLIFFSRWWQIETLYRSNQ

SEQ ID NO: 344451 - protein, 27 aa, Mycobacterium
PVARLWRWLLVFFSRWWQIETLYRSNQ

SEQ ID NO: 344452 - protein, 28 aa, Mycobacterium
PVARLWRWLLVFFSRWWQLETLYRSNMK

SEQ ID NO: 344453 - protein, 17 aa, Mycobacterium
PVASSYRRFVTWLIERD

SEQ ID NO: 344454 - protein, 21 aa, Mycobacterium
PVAVEAYGLFVFRDAIAACGV

SEQ ID NO: 344455 - protein, 22 aa, Mycobacterium
PVDALVCALRLAGLRGSVGGGD

SEQ ID NO: 344456 - protein, 25 aa, Mycobacterium
PVEFSGLFAWFAWLVLHLVYLVGFK

SEQ ID NO: 344457 - protein, 18 aa, Mycobacterium
PVFGRWVAHFNLLIAAAL

SEQ ID NO: 344458 - protein, 18 aa, Mycobacterium
PVFKRWVAHFNVLVAAML

SEQ ID NO: 344459 - protein, 25 aa, Mycobacterium
PVFRARLPLIRDLFVVLAYAASATS

SEQ ID NO: 344460 - protein, 18 aa, Mycobacterium
PVFVDGRLRKQILRLDSS

SEQ ID NO: 344461 - protein, 17 aa, Mycobacterium
PVGHRWARIDLPDDEYI

SEQ ID NO: 344462 - protein, 20 aa, Mycobacterium
PVGLPHRWARRRVVMAAVAA

SEQ ID NO: 344463 - protein, 20 aa, Mycobacterium
PVLGCAFATVAVALAWLSFE

SEQ ID NO: 344464 - protein, 23 aa, Mycobacterium
PVLGELWAPLGLRLHAVHHLFPK

SEQ ID NO: 344465 - protein, 18 aa, Mycobacterium
PVLIPWSVLSLFAPGPTL

SEQ ID NO: 344466 - protein, 23 aa, Mycobacterium
PVLLDWLVGLAFPCQRPFDHRNG

SEQ ID NO: 344467 - protein, 21 aa, Mycobacterium
PVLLFCIAFGLSMDYEVFLIS

SEQ ID NO: 344468 - protein, 24 aa, Mycobacterium
PVLLFCIAFGLSMDYEVFLVSRIR

SEQ ID NO: 344469 - protein, 24 aa, Mycobacterium
PVLMFCIAFGLSMDYEVFLLARIR

SEQ ID NO: 344470 - protein, 21 aa, Mycobacterium
PVLMFCIAFGLSMDYEVFLLS

SEQ ID NO: 344471 - protein, 18 aa, Mycobacterium
PVLMIGMIYIWMPLAMGS

SEQ ID NO: 344472 - protein, 19 aa, Mycobacterium
PVLPPRLFRSPVFTVCCVL

SEQ ID NO: 344473 - protein, 17 aa, Mycobacterium
PVLPRLAKPAGLEFLGV

SEQ ID NO: 344474 - protein, 20 aa, Mycobacterium
PVLPRLVNMYGITETTVHAS

SEQ ID NO: 344475 - protein, 19 aa, Mycobacterium
PVLTGRWLFYGALGAAAAA

SEQ ID NO: 344476 - protein, 22 aa, Mycobacterium
PVLTRSGADWMPNFIDLLQRKL

SEQ ID NO: 344477 - protein, 18 aa, Mycobacterium
PVLTRSGAEWMPNFIELL

SEQ ID NO: 344478 - protein, 17 aa, Mycobacterium
PVLVRWFGLWRVIAAGM

SEQ ID NO: 344479 - protein, 22 aa, Mycobacterium
PVMPSARIDFMLDDAAPTAVVT

SEQ ID NO: 344480 - protein, 17 aa, Mycobacterium
PVPAAPGAPGFVPNPNP

SEQ ID NO: 344481 - protein, 17 aa, Mycobacterium
PVPARLRGWGPLAAAFV

SEQ ID NO: 344482 - protein, 18 aa, Mycobacterium
PVPEADLARAKRGPLLGI

SEQ ID NO: 344483 - protein, 18 aa, Mycobacterium
PVPTPWAGVPGWGVGHTG

SEQ ID NO: 344484 - protein, 17 aa, Mycobacterium
PVQYAKRMVGRKMYGGT

SEQ ID NO: 344485 - protein, 18 aa, Mycobacterium
PVQYAKRMVGRKMYGGTS

SEQ ID NO: 344486 - protein, 19 aa, Mycobacterium
PVSRWRWLLGATVAAVLGS

SEQ ID NO: 344487 - protein, 19 aa, Mycobacterium
PVVAAVLFLASAVFAVTQF

SEQ ID NO: 344488 - protein, 23 aa, Mycobacterium
PVWFSLFCTVFFGLGWLVTLRNG

SEQ ID NO: 344489 - protein, 17 aa, Mycobacterium
PWAWLALVVAGLVVGIF

SEQ ID NO: 344490 - protein, 18 aa, Mycobacterium
PWGAWLFRRAQRLCRPVF

SEQ ID NO: 344491 - protein, 18 aa, Mycobacterium
PWIMPAFGFAVGFISDYI

SEQ ID NO: 344492 - protein, 19 aa, Mycobacterium
PWLPARLAPEYSVDTWRQW

SEQ ID NO: 344493 - protein, 23 aa, Mycobacterium
PWLPARWRHWWWALLLAFVPIHL

SEQ ID NO: 344494 - protein, 24 aa, Mycobacterium
PWLPARWRHWWWTLLWAFVPIHLV

SEQ ID NO: 344495 - protein, 19 aa, Mycobacterium
PWLPLAVLICVAWGVQAYF

SEQ ID NO: 344496 - protein, 20 aa, Mycobacterium
PWLRTGDLGFEWDGGFYIVG

SEQ ID NO: 344497 - protein, 20 aa, Mycobacterium
PWQVFGVLWLYCLAVGGAVT

SEQ ID NO: 344498 - protein, 20 aa, Mycobacterium
PWREKMFLSWAGLRGAVPIV

SEQ ID NO: 344499 - protein, 17 aa, Mycobacterium
PWSNAFPAWHYAFATAL

SEQ ID NO: 344500 - protein, 23 aa, Mycobacterium
PWSNSFPRLRWSLTTALLELSVI

SEQ ID NO: 344501 - protein, 18 aa, Mycobacterium
PWSSWYYRLGAITVGPEQ

SEQ ID NO: 344502 - protein, 19 aa, Mycobacterium
PWSTLKVSLLLSVALFFVW

SEQ ID NO: 344503 - protein, 25 aa, Mycobacterium
PWSTLKVSLLLSVVLFFVWMIAVAF

SEQ ID NO: 344504 - protein, 18 aa, Mycobacterium
PWSWLPRIVMQFTAGALA

SEQ ID NO: 344505 - protein, 19 aa, Mycobacterium
PWTGLTIFLLIGVLAAAVG

SEQ ID NO: 344506 - protein, 19 aa, Mycobacterium
PWTVLKVSLVLSVVLFFVW

SEQ ID NO: 344507 - protein, 19 aa, Mycobacterium
PWTVSVNWWLIVVAFVAFV

SEQ ID NO: 344508 - protein, 22 aa, Mycobacterium
PWYQEFLRYYFLTVEDSVDGSL

SEQ ID NO: 344509 - protein, 23 aa, Mycobacterium
PWYQEFLRYYWLTVEESVDGSLA

SEQ ID NO: 344510 - protein, 20 aa, Mycobacterium
PYAIFLLREYFRGIPGDLIN

SEQ ID NO: 344511 - protein, 17 aa, Mycobacterium
PYARADLVLGIVVVIVG

SEQ ID NO: 344512 - protein, 17 aa, Mycobacterium
PYLYAGILFFATLGAFA

SEQ ID NO: 344513 - protein, 18 aa, Mycobacterium
PYLYAGILFFATLGALAV

SEQ ID NO: 344514 - protein, 18 aa, Mycobacterium
PYMTFRWSSQGPGGQVGS

SEQ ID NO: 344515 - protein, 18 aa, Mycobacterium
PYPGPGFGLIIAWLTAIV

SEQ ID NO: 344516 - protein, 17 aa, Mycobacterium
PYQWWRVALVIVSGLAY

SEQ ID NO: 344517 - protein, 18 aa, Mycobacterium
PYQWWRVALVVGSGLAYV

SEQ ID NO: 344518 - protein, 17 aa, Mycobacterium
PYSSWLVVRWVIASALG

SEQ ID NO: 344519 - protein, 20 aa, Mycobacterium
PYVREGWAFVAMRLTSTVPI

SEQ ID NO: 344520 - protein, 32 aa, Mycobacterium
PYVRKGAAWAWRLLVLLAFGLTVLWLFWHLKT

SEQ ID NO: 344521 - protein, 17 aa, Mycobacterium
QAAALRAGNPIAIAGIP

SEQ ID NO: 344522 - protein, 18 aa, Mycobacterium
QAAAVEWLDRLRALAQRT

SEQ ID NO: 344523 - protein, 22 aa, Mycobacterium
QAAEPRGGILVIHENKGLNDWT

SEQ ID NO: 344524 - protein, 22 aa, Mycobacterium
QAAQLSALWARFPLPVIPAPGD

SEQ ID NO: 344525 - protein, 19 aa, Mycobacterium
QAASLRAGQPITVAGIPMG

SEQ ID NO: 344526 - protein, 19 aa, Mycobacterium
QAASLRPGQPITVAGIPVG

SEQ ID NO: 344527 - protein, 34 aa, Mycobacterium
QAEAALDRVTRPAAPRRRFSLAVVGSAAAAVLAI

SEQ ID NO: 344528 - protein, 22 aa, Mycobacterium
QAEPAAWLRFWFPDPKGSNTEY

SEQ ID NO: 344529 - protein, 19 aa, Mycobacterium
QAGSFGFFCSMNMINGTLV

SEQ ID NO: 344530 - protein, 21 aa, Mycobacterium
QAGSIGLGFAIPVDQAKRIAD

SEQ ID NO: 344531 - protein, 23 aa, Mycobacterium
QAHTRFDVLFARDIIDHSAQAVA

SEQ ID NO: 344532 - protein, 22 aa, Mycobacterium
QALGWRSAFGLVVFVGVLTLAA

SEQ ID NO: 344533 - protein, 19 aa, Mycobacterium
QALRLTYMIFFSIPVVAPL

SEQ ID NO: 344534 - protein, 17 aa, Mycobacterium
QALSRQGIYGDFFSFYL

SEQ ID NO: 344535 - protein, 17 aa, Mycobacterium
QAPVHWKPITNARVARD

SEQ ID NO: 344536 - protein, 20 aa, Mycobacterium
QARKRLAAAAGRDLPIALLE

SEQ ID NO: 344537 - protein, 21 aa, Mycobacterium
QARPTVKLGVPLVNPEVTTSS

SEQ ID NO: 344538 - protein, 17 aa, Mycobacterium
QARYSALIERLRGNTEY

SEQ ID NO: 344539 - protein, 20 aa, Mycobacterium
QASDRFGRRLILQLALAGFA

SEQ ID NO: 344540 - protein, 24 aa, Mycobacterium
QATFLRWLWYAARREGLRLDGTED

SEQ ID NO: 344541 - protein, 18 aa, Mycobacterium
QAVAALMRAAGRPGAALV

SEQ ID NO: 344542 - protein, 23 aa, Mycobacterium
QAYRPELLGGVALVAGTDTFMKE

SEQ ID NO: 344543 - protein, 22 aa, Mycobacterium
QCVKAEMLAAGSWRVAVNAGAD

SEQ ID NO: 344544 - protein, 18 aa, Mycobacterium
QDAIRWVALVALVAIGLG

SEQ ID NO: 344545 - protein, 20 aa, Mycobacterium
QDARLGLDVVVFGGEALEPA

SEQ ID NO: 344546 - protein, 20 aa, Mycobacterium
QDLLEALAFGVGQLAADPGR

SEQ ID NO: 344547 - protein, 21 aa, Mycobacterium
QDPELRKALMPSYGILARRTI

SEQ ID NO: 344548 - protein, 23 aa, Mycobacterium
QDPRKFRLIVTITRDGDQLKMSK

SEQ ID NO: 344549 - protein, 21 aa, Mycobacterium
QDTFLRWVWYAARREGLALDG

SEQ ID NO: 344550 - protein, 19 aa, Mycobacterium
QEFIIRWRVWLTHRLMGDW

SEQ ID NO: 344551 - protein, 20 aa, Mycobacterium
QELFDYLWGFRTFDTSKGPG

SEQ ID NO: 344552 - protein, 24 aa, Mycobacterium
QESAKPQWWAGLKEGLKERSTHRA

SEQ ID NO: 344553 - protein, 22 aa, Mycobacterium
QEWLKSLMPFGGFPWGSVAFGQ

SEQ ID NO: 344554 - protein, 23 aa, Mycobacterium
QEWLKSVFPFGGFPWGSVAFGQT

SEQ ID NO: 344555 - protein, 17 aa, Mycobacterium
QEWRMVWDSALDRAEIG

SEQ ID NO: 344556 - protein, 21 aa, Mycobacterium
QFLAWGWRLPFLFSAALIVIG

SEQ ID NO: 344557 - protein, 18 aa, Mycobacterium
QFPWLKARFRSIADPWNQ

SEQ ID NO: 344558 - protein, 22 aa, Mycobacterium
QFRMPNIMGKFWTDAEPMLYQA

SEQ ID NO: 344559 - protein, 23 aa, Mycobacterium
QGACFRLTLPLVRGHKVTTSPLP

SEQ ID NO: 344560 - protein, 17 aa, Mycobacterium
QGFPADVLYEFRLVSLG

SEQ ID NO: 344561 - protein, 21 aa, Mycobacterium
QGGMVLRGFVERVGDRSPLVA

SEQ ID NO: 344562 - protein, 17 aa, Mycobacterium
QGHVLWLLGLALGLANI

SEQ ID NO: 344563 - protein, 18 aa, Mycobacterium
QGLAVAWLDRLRAMAKHT

SEQ ID NO: 344564 - protein, 23 aa, Mycobacterium
QGLGDEVRRVWGLTAALTVDART

SEQ ID NO: 344565 - protein, 18 aa, Mycobacterium
QGMSMDWRTVFTGLGAER

SEQ ID NO: 344566 - protein, 21 aa, Mycobacterium
QHAPKTWLLDMAMLAALSLLY

SEQ ID NO: 344567 - protein, 18 aa, Mycobacterium
QHCFDLPACSAIRSVFDA

SEQ ID NO: 344568 - protein, 23 aa, Mycobacterium
QHCFNIPICWAMRSVFDGLDGVD

SEQ ID NO: 344569 - protein, 18 aa, Mycobacterium
QHKRRWILGIGMVGSAPR

SEQ ID NO: 344570 - protein, 24 aa, Mycobacterium
QHTPARWWFDVGMLALISAVYLGF

SEQ ID NO: 344571 - protein, 21 aa, Mycobacterium
QKSRWLVTRMTTITSLDLTPK

SEQ ID NO: 344572 - protein, 23 aa, Mycobacterium
QKVRPRPASALLEPYGPRPLVRA

SEQ ID NO: 344573 - protein, 21 aa, Mycobacterium
QLDAGPFLSYGIQWISFGIVA

SEQ ID NO: 344574 - protein, 25 aa, Mycobacterium
QLFDRLRPTLPIMLANLVSIGQVAV

SEQ ID NO: 344575 - protein, 17 aa, Mycobacterium
QLFTVRIGLRMTEATQT

SEQ ID NO: 344576 - protein, 24 aa, Mycobacterium
QLGDLRWFYIYSGVIWCCVFMRTG

SEQ ID NO: 344577 - protein, 19 aa, Mycobacterium
QLGICWQAGLLSGRRPIVL

SEQ ID NO: 344578 - protein, 17 aa, Mycobacterium
QLLKWLSAVVIVAATAV

SEQ ID NO: 344579 - protein, 23 aa, Mycobacterium
QLLSFKIAIPICGAALAVAAGFL

SEQ ID NO: 344580 - protein, 21 aa, Mycobacterium
QLLVWRWVMYISVLMTMTALA

SEQ ID NO: 344581 - protein, 24 aa, Mycobacterium
QLMHARYAYFAGFLTAAVVLVNAE

SEQ ID NO: 344582 - protein, 21 aa, Mycobacterium
QLNLPRLWSGFQIIGDGSGTY

SEQ ID NO: 344583 - protein, 19 aa, Mycobacterium
QLPPIDWTKIPPPQIPQFQ

SEQ ID NO: 344584 - protein, 17 aa, Mycobacterium
QLRTEFDAAALASIGDN

SEQ ID NO: 344585 - protein, 18 aa, Mycobacterium
QLRTRLDAVGARLQQVTR

SEQ ID NO: 344586 - protein, 21 aa, Mycobacterium
QLSFLFPSRWGFAATAATCDL

SEQ ID NO: 344587 - protein, 17 aa, Mycobacterium
QLVMFAVLTAITAVALG

SEQ ID NO: 344588 - protein, 28 aa, Mycobacterium
QLYRRIGASVVRWPVPIFVASSIIVMVG

SEQ ID NO: 344589 - protein, 23 aa, Mycobacterium
QLYTERHVRLWVVYVDDFSGQSA

SEQ ID NO: 344590 - protein, 17 aa, Mycobacterium
QMVRRRPKPSPWPKPIQ

SEQ ID NO: 344591 - protein, 21 aa, Mycobacterium
QNPDRWAWLWSLLVFLAVASS

SEQ ID NO: 344592 - protein, 18 aa, Mycobacterium
QPGPPYCHTRLWPPVIVG

SEQ ID NO: 344593 - protein, 19 aa, Mycobacterium
QPGYPRPPYNPPYTPPSTT

SEQ ID NO: 344594 - protein, 24 aa, Mycobacterium
QPHTRFDVLFAFDIIDHSGQAVAL

SEQ ID NO: 344595 - protein, 22 aa, Mycobacterium
QPKRRLRLLLTVAAVVLFLDVV

SEQ ID NO: 344596 - protein, 20 aa, Mycobacterium
QPLARFGHMIAFYLHTVLAI

SEQ ID NO: 344597 - protein, 25 aa, Mycobacterium
QPNPWYKQPAVLIALAGAGVAVVAV

SEQ ID NO: 344598 - protein, 20 aa, Mycobacterium
QPNREALVFIGLALLIWLPA

SEQ ID NO: 344599 - protein, 22 aa, Mycobacterium
QPPVRRRLRLLLGVAAVVLVAD

SEQ ID NO: 344600 - protein, 19 aa, Mycobacterium
QPRAWRMRISVQEIDGDAK

SEQ ID NO: 344601 - protein, 17 aa, Mycobacterium
QPRGWRFWHRPRRQLQT

SEQ ID NO: 344602 - protein, 18 aa, Mycobacterium
QPSSRASLWLPYLPVLLA

SEQ ID NO: 344603 - protein, 20 aa, Mycobacterium
QPVREWRPAFVPMLPLAGAT

SEQ ID NO: 344604 - protein, 23 aa, Mycobacterium
QQDRLPIEIAIAVLVLAVLLLVY

SEQ ID NO: 344605 - protein, 20 aa, Mycobacterium
QQIVRWCLSLALIPAVVLLV

SEQ ID NO: 344606 - protein, 17 aa, Mycobacterium
QQLDRFMMAPAFMAAFT

SEQ ID NO: 344607 - protein, 17 aa, Mycobacterium
QQQLGVAAARVNEVGDA

SEQ ID NO: 344608 - protein, 23 aa, Mycobacterium
QQRANRSFFWWVLALAAMASVGS

SEQ ID NO: 344609 - protein, 17 aa, Mycobacterium
QQRRFSTGMLVGSGLLG

SEQ ID NO: 344610 - protein, 23 aa, Mycobacterium
QQRWSFDLSMTWDLLRRSFTHGI

SEQ ID NO: 344611 - protein, 19 aa, Mycobacterium
QRAEALAADVARTFTEAGL

SEQ ID NO: 344612 - protein, 22 aa, Mycobacterium
QRARSQLWLGLLSWAVVIGLYV

SEQ ID NO: 344613 - protein, 28 aa, Mycobacterium
QRDWLRRINWKWVRRSAYLAAAVVILLP

SEQ ID NO: 344614 - protein, 18 aa, Mycobacterium
QRFMMRWRVWLTRRFIDD

SEQ ID NO: 344615 - protein, 23 aa, Mycobacterium
QRFWELPPRFWLYCGFTAITMSG

SEQ ID NO: 344616 - protein, 20 aa, Mycobacterium
QRGPFAIVIARFVPIVRTLA

SEQ ID NO: 344617 - protein, 18 aa, Mycobacterium
QRGQVMWSFLIGAAVMAI

SEQ ID NO: 344618 - protein, 17 aa, Mycobacterium
QRLFLGITFLFLVSSAF

SEQ ID NO: 344619 - protein, 24 aa, Mycobacterium
QRLGEFWGYLAGWGFVVGKTASCA

SEQ ID NO: 344620 - protein, 19 aa, Mycobacterium
QRLGGGIAWAAGELPLVIV

SEQ ID NO: 344621 - protein, 23 aa, Mycobacterium
QRLRAEKRLSYLLAQQTPPARKV

SEQ ID NO: 344622 - protein, 20 aa, Mycobacterium
QRLRVPIGISDHGVRVDLDL

SEQ ID NO: 344623 - protein, 24 aa, Mycobacterium
QRPNLRFRIVSAWRALRPTLASTA

SEQ ID NO: 344624 - protein, 18 aa, Mycobacterium
QRRHAWISWMRRYGTRTP

SEQ ID NO: 344625 - protein, 19 aa, Mycobacterium
QRRLLRWSIPGIAHFFTMW

SEQ ID NO: 344626 - protein, 22 aa, Mycobacterium
QRRRGWRSWALYAAMPAVGVVL

SEQ ID NO: 344627 - protein, 19 aa, Mycobacterium
QRSQVFWSFLIGAVVMAAA

SEQ ID NO: 344628 - protein, 28 aa, Mycobacterium
QRTMGAAWARFVVRFRKPLLVGGSAALI

SEQ ID NO: 344629 - protein, 23 aa, Mycobacterium
QRTRLTEILSRIYGTPVSVQLDV

SEQ ID NO: 344630 - protein, 25 aa, Mycobacterium
QRVGYRLRATMAWDEAQYRISSLEQ

SEQ ID NO: 344631 - protein, 18 aa, Mycobacterium
QRVRPRPASTMLRPYGPR

SEQ ID NO: 344632 - protein, 17 aa, Mycobacterium
QRWDVFTPPKFVGLKNF

SEQ ID NO: 344633 - protein, 18 aa, Mycobacterium
QRWKAIRGEAGWLTTYAY

SEQ ID NO: 344634 - protein, 17 aa, Mycobacterium
QRWKAIRGEAGWMTTYA

SEQ ID NO: 344635 - protein, 22 aa, Mycobacterium
QRYRGKPVLTWWQGRKQSGHGL

SEQ ID NO: 344636 - protein, 23 aa, Mycobacterium
QSGERRMLCGLQLLGPGDTQLEF

SEQ ID NO: 344637 - protein, 20 aa, Mycobacterium
QSGFPRYFLNSVVVAAGTVV

SEQ ID NO: 344638 - protein, 19 aa, Mycobacterium
QSHFRSGRWLLLVDAVLLI

SEQ ID NO: 344639 - protein, 17 aa, Mycobacterium
QSHSLAFDFSVWEIFGA

SEQ ID NO: 344640 - protein, 23 aa, Mycobacterium
QSIRRLGHMLAFFVEAIASIPNA

SEQ ID NO: 344641 - protein, 17 aa, Mycobacterium
QSLGPWFPLAFLVAHIV

SEQ ID NO: 344642 - protein, 17 aa, Mycobacterium
QSLLRVLHDWVRTYHRQ

SEQ ID NO: 344643 - protein, 20 aa, Mycobacterium
QSPMPLLVALAVSLLAILLI

SEQ ID NO: 344644 - protein, 20 aa, Mycobacterium
QSPVPLIVAVAVSLLAILLI

SEQ ID NO: 344645 - protein, 21 aa, Mycobacterium
QSRFWNRWIGWVMRRPWMSAL

SEQ ID NO: 344646 - protein, 19 aa, Mycobacterium
QSRGWRAAAPLGRDDAWII

SEQ ID NO: 344647 - protein, 29 aa, Mycobacterium
QSVRWSVAWRMLLAWCFTLPASGIVGGIA

SEQ ID NO: 344648 - protein, 18 aa, Mycobacterium
QSWFLIRVAFLPTLAVSI

SEQ ID NO: 344649 - protein, 27 aa, Mycobacterium
QTFWRITLPSIRWGLTYGIVLTVARTL

SEQ ID NO: 344650 - protein, 29 aa, Mycobacterium
QTGAPGGLWARRKWEIVRIASPLALLALW

SEQ ID NO: 344651 - protein, 23 aa, Mycobacterium
QTLGVPCAVGMLVAVLAALTLGP

SEQ ID NO: 344652 - protein, 17 aa, Mycobacterium
QTLRLKVELPFIGLYVH

SEQ ID NO: 344653 - protein, 20 aa, Mycobacterium
QTPLSFIFYWVVPFALLGVA

SEQ ID NO: 344654 - protein, 23 aa, Mycobacterium
QTRARRGRLFTRFCTVVAAGMLT

SEQ ID NO: 344655 - protein, 17 aa, Mycobacterium
QTRAVWRLANFLLEGLV

SEQ ID NO: 344656 - protein, 22 aa, Mycobacterium
QTRLRAGSPILFYPAGALAMTV

SEQ ID NO: 344657 - protein, 22 aa, Mycobacterium
QTRLRAGSPILFYPAGALATTV

SEQ ID NO: 344658 - protein, 24 aa, Mycobacterium
QTWLGRFISTYGWRAYAIPLLVAL

SEQ ID NO: 344659 - protein, 19 aa, Mycobacterium
QVHEFGWRIAFATGGVAAI

SEQ ID NO: 344660 - protein, 17 aa, Mycobacterium
QVIKYTWPVKRMRAADV

SEQ ID NO: 344661 - protein, 22 aa, Mycobacterium
QVLKRLGTVLLIVGGIGVVVAA

SEQ ID NO: 344662 - protein, 23 aa, Mycobacterium
QVLRLPARFVLGALAGLRMVGLL

SEQ ID NO: 344663 - protein, 18 aa, Mycobacterium
QVLVWSFFCMVMFGICMI

SEQ ID NO: 344664 - protein, 22 aa, Mycobacterium
QVRLILRRQVRVFLASRLYLVF

SEQ ID NO: 344665 - protein, 19 aa, Mycobacterium
QVSEIRAAALAGVLLLAGL

SEQ ID NO: 344666 - protein, 21 aa, Mycobacterium
QVVAGFGWRAVFLALAGLNLV

SEQ ID NO: 344667 - protein, 19 aa, Mycobacterium
QWFSAKWPGFFATNRQPQP

SEQ ID NO: 344668 - protein, 22 aa, Mycobacterium
QWPLFAWFCVYAYRKYVRYEEM

SEQ ID NO: 344669 - protein, 18 aa, Mycobacterium
QWRAHRGPGMVVALSTGM

SEQ ID NO: 344670 - protein, 18 aa, Mycobacterium
QWSTLPRVAKWAVGVIGF

SEQ ID NO: 344671 - protein, 19 aa, Mycobacterium
QYGGFGARGYPPAGRPPPN

SEQ ID NO: 344672 - protein, 21 aa, Mycobacterium
QYIFGIPLYWVIFPLAVIILL

SEQ ID NO: 344673 - protein, 17 aa, Mycobacterium
QYLSFAWAFGISGGMLL

SEQ ID NO: 344674 - protein, 22 aa, Mycobacterium
QYPRARFEVISFAAKASLDWPL

SEQ ID NO: 344675 - protein, 18 aa, Mycobacterium
QYTSYGWAFLVSGIILAV

SEQ ID NO: 344676 - protein, 20 aa, Mycobacterium
RAAAPFQLLFSLIFTPVIRL

SEQ ID NO: 344677 - protein, 18 aa, Mycobacterium
RAAAPLSRDDAWIIFTSG

SEQ ID NO: 344678 - protein, 18 aa, Mycobacterium
RAAGYISFFVNFGILLAS

SEQ ID NO: 344679 - protein, 32 aa, Mycobacterium
RAAKGRFWRRVGTAVVRWPAPILVASAFIVLI

SEQ ID NO: 344680 - protein, 17 aa, Mycobacterium
RAALIIWGGWLVVTAVV

SEQ ID NO: 344681 - protein, 18 aa, Mycobacterium
RAAQGFRLLSCLYALGFH

SEQ ID NO: 344682 - protein, 21 aa, Mycobacterium
RAASFTGHFLAGVLIVGTAIA

SEQ ID NO: 344683 - protein, 19 aa, Mycobacterium
RAASPFVFVYNYLKQVVAE

SEQ ID NO: 344684 - protein, 23 aa, Mycobacterium
RAEGRYALMPGIIGALAESGTPL

SEQ ID NO: 344685 - protein, 18 aa, Mycobacterium
RAELSRRAWLPLVVASAT

SEQ ID NO: 344686 - protein, 18 aa, Mycobacterium
RAEPKAAVRWGLPVLSAL

SEQ ID NO: 344687 - protein, 18 aa, Mycobacterium
RAGLLCVLSILLTYLLVA

SEQ ID NO: 344688 - protein, 17 aa, Mycobacterium
RAGSVVLGWLVALVMAA

SEQ ID NO: 344689 - protein, 23 aa, Mycobacterium
RAHFGDDLLYVWRHFPLERAHPR

SEQ ID NO: 344690 - protein, 20 aa, Mycobacterium
RAHPGFVRRVMTAALPSGVV

SEQ ID NO: 344691 - protein, 18 aa, Mycobacterium
RAIGSVRGLVGWLERLLA

SEQ ID NO: 344692 - protein, 17 aa, Mycobacterium
RAIPHVIDWYNRYHDAG

SEQ ID NO: 344693 - protein, 20 aa, Mycobacterium
RALMYLGFIPPVWLAAVGAL

SEQ ID NO: 344694 - protein, 17 aa, Mycobacterium
RALRLARDFGAVVFGKY

SEQ ID NO: 344695 - protein, 19 aa, Mycobacterium
RALYTLAFIDVWQWTPFMV

SEQ ID NO: 344696 - protein, 17 aa, Mycobacterium
RAMAGAIALMIGAGIGL

SEQ ID NO: 344697 - protein, 18 aa, Mycobacterium
RAMMLGIMRSYRSDEATI

SEQ ID NO: 344698 - protein, 31 aa, Mycobacterium
RAMRTRGWRKLGAAVVRWPAPILVTTIALSV

SEQ ID NO: 344699 - protein, 17 aa, Mycobacterium
RANARIIVFLSVALVIA

SEQ ID NO: 344700 - protein, 26 aa, Mycobacterium
RANGPYPRWVCVWDHSRMTQNPETSA

SEQ ID NO: 344701 - protein, 25 aa, Mycobacterium
RANPGIPARGVVAVCDFGGSGTSIT

SEQ ID NO: 344702 - protein, 21 aa, Mycobacterium
RANRVAHGWLFGEPRSGGTGD

SEQ ID NO: 344703 - protein, 17 aa, Mycobacterium
RANWWRPSGWESAIRWP

SEQ ID NO: 344704 - protein, 18 aa, Mycobacterium
RAPGALVALWRGTVVVLQ

SEQ ID NO: 344705 - protein, 19 aa, Mycobacterium
RAPIMARFHGMWSLGALLG

SEQ ID NO: 344706 - protein, 31 aa, Mycobacterium
RAPRAGPLRLRWRPLLIAAAILLAWSVVLLL

SEQ ID NO: 344707 - protein, 17 aa, Mycobacterium
RAPRRWTARNTLLGIEQ

SEQ ID NO: 344708 - protein, 19 aa, Mycobacterium
RAPTIQLCRDPRGYVPLGS

SEQ ID NO: 344709 - protein, 23 aa, Mycobacterium
RAPWAKGLVEFLCLLPLTIPALV

SEQ ID NO: 344710 - protein, 20 aa, Mycobacterium
RAQLCFLTFVVVVGTLLLHG

SEQ ID NO: 344711 - protein, 21 aa, Mycobacterium
RARFLAICGGGGFLLYLQMHD

SEQ ID NO: 344712 - protein, 18 aa, Mycobacterium
RARVPVAIFVKEPSPALV

SEQ ID NO: 344713 - protein, 18 aa, Mycobacterium
RARWARRIVEFLCLLPLT

SEQ ID NO: 344714 - protein, 20 aa, Mycobacterium
RARWLLWALISWPRVAKACG

SEQ ID NO: 344715 - protein, 18 aa, Mycobacterium
RASCLSGLGYPASTQILG

SEQ ID NO: 344716 - protein, 21 aa, Mycobacterium
RASDVAMGLAMHAGLRGAGSA

SEQ ID NO: 344717 - protein, 17 aa, Mycobacterium
RASICLSLGLGVGPLCA

SEQ ID NO: 344718 - protein, 27 aa, Mycobacterium
RASLRWRDWRFAVIVTLAWFAVTFTFN

SEQ ID NO: 344719 - protein, 20 aa, Mycobacterium
RASRGECLMWPDATPESAKI

SEQ ID NO: 344720 - protein, 20 aa, Mycobacterium
RATFLRWIWYAARREGLHLN

SEQ ID NO: 344721 - protein, 18 aa, Mycobacterium
RATLHFLWLRLARVWPVY

SEQ ID NO: 344722 - protein, 18 aa, Mycobacterium
RATLHFLWLRLSRVWPVY

SEQ ID NO: 344723 - protein, 22 aa, Mycobacterium
RATSSLSLRWRVMLLAMSMVAM

SEQ ID NO: 344724 - protein, 18 aa, Mycobacterium
RATVHFLWLRLARVWPVY

SEQ ID NO: 344725 - protein, 20 aa, Mycobacterium
RATVRAVWGAAVWAATLAVV

SEQ ID NO: 344726 - protein, 17 aa, Mycobacterium
RATYQAGLVGTRLADGS

SEQ ID NO: 344727 - protein, 17 aa, Mycobacterium
RAVARLRHPGLVAVFDQ

SEQ ID NO: 344728 - protein, 28 aa, Mycobacterium
RAVARNRPRLPLALVGSAAAAVLCLGGF

SEQ ID NO: 344729 - protein, 21 aa, Mycobacterium
RAVEIADVVLLCFDTQSQQAS

SEQ ID NO: 344730 - protein, 24 aa, Mycobacterium
RAVFLRWLWYAARRAELHLDGETD

SEQ ID NO: 344731 - protein, 17 aa, Mycobacterium
RAVFPLIDLQLFTHPVY

SEQ ID NO: 344732 - protein, 20 aa, Mycobacterium
RAVGALARMAATSATVIRDG

SEQ ID NO: 344733 - protein, 20 aa, Mycobacterium
RAVGPFDVLPFLLAVPGLIL

SEQ ID NO: 344734 - protein, 19 aa, Mycobacterium
RAVVFAVLMAIAFRLLSPI

SEQ ID NO: 344735 - protein, 21 aa, Mycobacterium
RAWKCTLCYDRLRDGLEPACA

SEQ ID NO: 344736 - protein, 19 aa, Mycobacterium
RAYALPVLIVLTVVVVYQT

SEQ ID NO: 344737 - protein, 23 aa, Mycobacterium
RCVNRGRLTPAWRDYRTAWATNF

SEQ ID NO: 344738 - protein, 21 aa, Mycobacterium
RCWRIARVFGRNPLLRRADRI

SEQ ID NO: 344739 - protein, 19 aa, Mycobacterium
RCWRLARLVGRNPLLRRTD

SEQ ID NO: 344740 - protein, 19 aa, Mycobacterium
RDAFPASFVVKLDDPEQHQ

SEQ ID NO: 344741 - protein, 22 aa, Mycobacterium
RDDLRWPPASALVSPDEAVEAL

SEQ ID NO: 344742 - protein, 20 aa, Mycobacterium
RDDLRWPPASALVSQNEAVD

SEQ ID NO: 344743 - protein, 25 aa, Mycobacterium
RDDVELAQLLAGWRDDIRETPMGHV

SEQ ID NO: 344744 - protein, 18 aa, Mycobacterium
RDFMGVPRLKFWDHPLTA

SEQ ID NO: 344745 - protein, 18 aa, Mycobacterium
RDGLLPSMFARVNSHTMT

SEQ ID NO: 344746 - protein, 17 aa, Mycobacterium
RDGVEFEMLLGMADAQA

SEQ ID NO: 344747 - protein, 20 aa, Mycobacterium
RDHLFCFGCMLAFLILWVAN

SEQ ID NO: 344748 - protein, 18 aa, Mycobacterium
RDIRFIIVVTLVIVMLVL

SEQ ID NO: 344749 - protein, 18 aa, Mycobacterium
RDIVPWWIVITLLARDLI

SEQ ID NO: 344750 - protein, 17 aa, Mycobacterium
RDKRFDIVAGFIMLMHG

SEQ ID NO: 344751 - protein, 20 aa, Mycobacterium
RDLGPWFPLAFLGAHTIVTV

SEQ ID NO: 344752 - protein, 25 aa, Mycobacterium
RDLLSAEIWIVLVLLVVCIGLELHG

SEQ ID NO: 344753 - protein, 17 aa, Mycobacterium
RDNIERWARNLNRLAAQ

SEQ ID NO: 344754 - protein, 19 aa, Mycobacterium
RDPAWRFGQAAAMRAALAG

SEQ ID NO: 344755 - protein, 19 aa, Mycobacterium
RDPEALAFIIGHEVGHIAA

SEQ ID NO: 344756 - protein, 19 aa, Mycobacterium
RDPLSILLVCIIVVCLVIA

SEQ ID NO: 344757 - protein, 19 aa, Mycobacterium
RDPRLRFGSAPQMRAALAG

SEQ ID NO: 344758 - protein, 23 aa, Mycobacterium
RDRARAGVALSYSFIAVAVVALV

SEQ ID NO: 344759 - protein, 22 aa, Mycobacterium
RDRAVVIPAILVVVLAVLYILL

SEQ ID NO: 344760 - protein, 22 aa, Mycobacterium
RDRIADVFLRLAAVFFYAAPVF

SEQ ID NO: 344761 - protein, 17 aa, Mycobacterium
RDRICKRGKTASQRVKP

SEQ ID NO: 344762 - protein, 17 aa, Mycobacterium
RDRLRLVQRQLRDHFRE

SEQ ID NO: 344763 - protein, 17 aa, Mycobacterium
REALGLSLAPSMAPWVA

SEQ ID NO: 344764 - protein, 22 aa, Mycobacterium
REEAARFGVEWLAPKSFVADRL

SEQ ID NO: 344765 - protein, 20 aa, Mycobacterium
REFPGPLALVPVVATLLLIL

SEQ ID NO: 344766 - protein, 20 aa, Mycobacterium
REFPGPWALVPVGAAMLLIL

SEQ ID NO: 344767 - protein, 18 aa, Mycobacterium
REHHLVSWLAAVVVPSLI

SEQ ID NO: 344768 - protein, 17 aa, Mycobacterium
REIGSWLVLSVIVAVVL

SEQ ID NO: 344769 - protein, 19 aa, Mycobacterium
REIIELKGPDIYRSITVTR

SEQ ID NO: 344770 - protein, 20 aa, Mycobacterium
REIILRLGPTISEHFDFSPD

SEQ ID NO: 344771 - protein, 17 aa, Mycobacterium
REIKLAASYFLATPLIV

SEQ ID NO: 344772 - protein, 28 aa, Mycobacterium
REKTARPNRSWARYLRRGAMPLLLAGAL

SEQ ID NO: 344773 - protein, 18 aa, Mycobacterium
RELARWQPSWLRYSPLTF

SEQ ID NO: 344774 - protein, 22 aa, Mycobacterium
RELGRPEFLWVLLTVIGMLSAA

SEQ ID NO: 344775 - protein, 17 aa, Mycobacterium
RELLRLPGVSKIVQVEL

SEQ ID NO: 344776 - protein, 17 aa, Mycobacterium
RELPAWVSRAVDSPTAR

SEQ ID NO: 344777 - protein, 20 aa, Mycobacterium
RELRRPVDVAGRLGDHTSFY

SEQ ID NO: 344778 - protein, 17 aa, Mycobacterium
RELTGFFAWTAWAAAAE

SEQ ID NO: 344779 - protein, 22 aa, Mycobacterium
REPRGVLEIAYRCPNGEPGVVK

SEQ ID NO: 344780 - protein, 17 aa, Mycobacterium
RERPAAISLAWGYWQPS

SEQ ID NO: 344781 - protein, 23 aa, Mycobacterium
RERPARVPLSFAQSRLWFLDQLQ

SEQ ID NO: 344782 - protein, 17 aa, Mycobacterium
RESRDWSLADLAAATGV

SEQ ID NO: 344783 - protein, 17 aa, Mycobacterium
RETLHFLWLRLARVWPV

SEQ ID NO: 344784 - protein, 21 aa, Mycobacterium
REVAARFGFLLAIPAVLASGL

SEQ ID NO: 344785 - protein, 19 aa, Mycobacterium
REVCAALTLDSRPGRNQPP

SEQ ID NO: 344786 - protein, 18 aa, Mycobacterium
REVIELNGPDIYRSTTVT

SEQ ID NO: 344787 - protein, 24 aa, Mycobacterium
REVLPRLGPAVARSKPAAWAAGFV

SEQ ID NO: 344788 - protein, 23 aa, Mycobacterium
REVPSWLRRVIDAVFHLPIAIPS

SEQ ID NO: 344789 - protein, 19 aa, Mycobacterium
REVWIRYAAAVVFSGLAGI

SEQ ID NO: 344790 - protein, 22 aa, Mycobacterium
RFAEAFPGVPLHNLYGPTEAAV

SEQ ID NO: 344791 - protein, 17 aa, Mycobacterium
RFAFYIKVHHTVIDGVA

SEQ ID NO: 344792 - protein, 20 aa, Mycobacterium
RFAPELMVIVPLFVIYNQIG

SEQ ID NO: 344793 - protein, 17 aa, Mycobacterium
RFDVGLGVGRRDDDYVA

SEQ ID NO: 344794 - protein, 19 aa, Mycobacterium
RFEKAWPLLWFVVIGVVAA

SEQ ID NO: 344795 - protein, 20 aa, Mycobacterium
RFGAGAKKLRSGKFSDSLAG

SEQ ID NO: 344796 - protein, 17 aa, Mycobacterium
RFGDRIIAVIGMLIAAF

SEQ ID NO: 344797 - protein, 20 aa, Mycobacterium
RFGETFWGFWPRSVWGALRS

SEQ ID NO: 344798 - protein, 23 aa, Mycobacterium
RFGFLRLGRRSAPAAVTPVAETS

SEQ ID NO: 344799 - protein, 19 aa, Mycobacterium
RFGYHFSSLIAIVVLLAVG

SEQ ID NO: 344800 - protein, 17 aa, Mycobacterium
RFLLRRVEHAIVRRDTR

SEQ ID NO: 344801 - protein, 25 aa, Mycobacterium
RFLLYAFLCCAAFLVVRIEERHTRS

SEQ ID NO: 344802 - protein, 17 aa, Mycobacterium
RFLVRRMEHALVRRDVR

SEQ ID NO: 344803 - protein, 17 aa, Mycobacterium
RFMPEGWWKPRPLDALV

SEQ ID NO: 344804 - protein, 17 aa, Mycobacterium
RFPHLIPGGDYVMGGDG

SEQ ID NO: 344805 - protein, 24 aa, Mycobacterium
RFPRAWKLGAGWVGAPGRALDASG

SEQ ID NO: 344806 - protein, 18 aa, Mycobacterium
RFPWDFRRLYGLDPDEQP

SEQ ID NO: 344807 - protein, 20 aa, Mycobacterium
RFRGELLLGIVLIGLAYFPL

SEQ ID NO: 344808 - protein, 20 aa, Mycobacterium
RFRHIPAMLLALSLVLFTVA

SEQ ID NO: 344809 - protein, 22 aa, Mycobacterium
RFRPFLPRLKQLIVEVVAHTRM

SEQ ID NO: 344810 - protein, 23 aa, Mycobacterium
RFRRHPLGVAWLIALAVIPLLMA

SEQ ID NO: 344811 - protein, 18 aa, Mycobacterium
RFSHVHPRFLVPSFSTLI

SEQ ID NO: 344812 - protein, 18 aa, Mycobacterium
RFSWIALVVAIVFGLIAA

SEQ ID NO: 344813 - protein, 17 aa, Mycobacterium
RFTFAFPVTEGEDLYIV

SEQ ID NO: 344814 - protein, 19 aa, Mycobacterium
RFTHGWPAALLFLLTPSIV

SEQ ID NO: 344815 - protein, 17 aa, Mycobacterium
RFVACGRPLPGHEIRIL

SEQ ID NO: 344816 - protein, 18 aa, Mycobacterium
RFVACGRPLPGHEIRIVD

SEQ ID NO: 344817 - protein, 18 aa, Mycobacterium
RFVKIYGLRIDLQRLETS

SEQ ID NO: 344818 - protein, 17 aa, Mycobacterium
RFVMRRIASGIALHDTR

SEQ ID NO: 344819 - protein, 21 aa, Mycobacterium
RFWLRHQKWWPLRDRVMITVK

SEQ ID NO: 344820 - protein, 26 aa, Mycobacterium
RFWRRIGTAVVRWPAPILLASLAAAL

SEQ ID NO: 344821 - protein, 20 aa, Mycobacterium
RFWRRSGIRIVRRPVTNLVA

SEQ ID NO: 344822 - protein, 20 aa, Mycobacterium
RGAALVSARRGRFMFPDKAD

SEQ ID NO: 344823 - protein, 17 aa, Mycobacterium
RGAFGLMFDRVFGALFW

SEQ ID NO: 344824 - protein, 20 aa, Mycobacterium
RGAGPMGFAGTVSRGDEQAG

SEQ ID NO: 344825 - protein, 19 aa, Mycobacterium
RGAIKINLGKFFKYTGAFL

SEQ ID NO: 344826 - protein, 17 aa, Mycobacterium
RGAMKAAWDKLRGPAGK

SEQ ID NO: 344827 - protein, 20 aa, Mycobacterium
RGARNYPCMAHPGKRAPTVE

SEQ ID NO: 344828 - protein, 17 aa, Mycobacterium
RGDAWPPGRTVAWLLGC

SEQ ID NO: 344829 - protein, 17 aa, Mycobacterium
RGDGVAGAAGWVILLCL

SEQ ID NO: 344830 - protein, 17 aa, Mycobacterium
RGDRAVRRWRRIATHVV

SEQ ID NO: 344831 - protein, 21 aa, Mycobacterium
RGEFEGRLWISMDYVDGHDAA

SEQ ID NO: 344832 - protein, 22 aa, Mycobacterium
RGEPWPPPVPEPAFKKAIAEQA

SEQ ID NO: 344833 - protein, 19 aa, Mycobacterium
RGGARFKMPGIERVDIMSL

SEQ ID NO: 344834 - protein, 24 aa, Mycobacterium
RGGFVTGWMYWYFFVVVVAVETVA

SEQ ID NO: 344835 - protein, 17 aa, Mycobacterium
RGGIYMKNLLRRQCDAV

SEQ ID NO: 344836 - protein, 17 aa, Mycobacterium
RGGLFVRQVHHWAALLF

SEQ ID NO: 344837 - protein, 17 aa, Mycobacterium
RGGLFVRQVHHWAALMF

SEQ ID NO: 344838 - protein, 18 aa, Mycobacterium
RGGLLLRILRQFHHPLIY

SEQ ID NO: 344839 - protein, 23 aa, Mycobacterium
RGGRFRCTFGFTFEVTEGQDRYV

SEQ ID NO: 344840 - protein, 18 aa, Mycobacterium
RGGYAEWWQHLSGETSWT

SEQ ID NO: 344841 - protein, 17 aa, Mycobacterium
RGIGSWIVATVVVWVAT

SEQ ID NO: 344842 - protein, 17 aa, Mycobacterium
RGIWRYCERLAGHDIAL

SEQ ID NO: 344843 - protein, 17 aa, Mycobacterium
RGKFHLCNYVTAVTDGA

SEQ ID NO: 344844 - protein, 19 aa, Mycobacterium
RGKLILCAAVGVLSVVVRA

SEQ ID NO: 344845 - protein, 17 aa, Mycobacterium
RGKVKRPSGKRVAAAVA

SEQ ID NO: 344846 - protein, 20 aa, Mycobacterium
RGKYWWLRWVVIAVAVIVLA

SEQ ID NO: 344847 - protein, 17 aa, Mycobacterium
RGLFAPRLILAAMSAVT

SEQ ID NO: 344848 - protein, 17 aa, Mycobacterium
RGLLFRWSKARSPRTAG

SEQ ID NO: 344849 - protein, 19 aa, Mycobacterium
RGLLGRLAIFTSVVIGYFV

SEQ ID NO: 344850 - protein, 20 aa, Mycobacterium
RGLPGWPIWFAVLWAAQEWL

SEQ ID NO: 344851 - protein, 21 aa, Mycobacterium
RGLPGWPVWFALVWAAQEWLK

SEQ ID NO: 344852 - protein, 19 aa, Mycobacterium
RGLPRGGAVALVLLGGFAI

SEQ ID NO: 344853 - protein, 19 aa, Mycobacterium
RGLPRGGAVALVLLTSFSL

SEQ ID NO: 344854 - protein, 23 aa, Mycobacterium
RGLRRLAIERGWQVLSFSRPVSL

SEQ ID NO: 344855 - protein, 17 aa, Mycobacterium
RGMKLRWFVVLVGVTLM

SEQ ID NO: 344856 - protein, 21 aa, Mycobacterium
RGPKPPPRWLWIVAGAAVLLV

SEQ ID NO: 344857 - protein, 18 aa, Mycobacterium
RGPLRAAMQIRRIDPWAT

SEQ ID NO: 344858 - protein, 18 aa, Mycobacterium
RGPLVFRVAERMSLISDA

SEQ ID NO: 344859 - protein, 23 aa, Mycobacterium
RGPRARLRWRWVLLGLAVLMCWL

SEQ ID NO: 344860 - protein, 21 aa, Mycobacterium
RGPVLQWWIAWVCSYAVSIAA

SEQ ID NO: 344861 - protein, 19 aa, Mycobacterium
RGQEVPFRLAYPLRSDNGP

SEQ ID NO: 344862 - protein, 17 aa, Mycobacterium
RGQRLRPAASYRSFVTW

SEQ ID NO: 344863 - protein, 17 aa, Mycobacterium
RGREEVFTRDGYYPTGD

SEQ ID NO: 344864 - protein, 21 aa, Mycobacterium
RGRNPWPIVAAVAIVLVLIVG

SEQ ID NO: 344865 - protein, 21 aa, Mycobacterium
RGRQRLFEWLFLLVALGNRFL

SEQ ID NO: 344866 - protein, 17 aa, Mycobacterium
RGRRLRFRPGRAAGGVV

SEQ ID NO: 344867 - protein, 19 aa, Mycobacterium
RGRRLRFRPGRAVTGVALL

SEQ ID NO: 344868 - protein, 21 aa, Mycobacterium
RGRWALCLVDGTPLRATQSLT

SEQ ID NO: 344869 - protein, 18 aa, Mycobacterium
RGSSMPFLATWNCTAFVV

SEQ ID NO: 344870 - protein, 18 aa, Mycobacterium
RGSVFEWLGYAMLYLSFV

SEQ ID NO: 344871 - protein, 19 aa, Mycobacterium
RGSYGGVIMFGMLTSVAGL

SEQ ID NO: 344872 - protein, 21 aa, Mycobacterium
RGTEWLWLLGVTVSGLVLFNV

SEQ ID NO: 344873 - protein, 18 aa, Mycobacterium
RGTGFWGPPFRVFAPSEI

SEQ ID NO: 344874 - protein, 18 aa, Mycobacterium
RGTLAFDVGICLVLITLP

SEQ ID NO: 344875 - protein, 25 aa, Mycobacterium
RGVAVPRLWLSYGLTATSTAALLGT

SEQ ID NO: 344876 - protein, 19 aa, Mycobacterium
RGVEAVSFLGGLWIGATLI

SEQ ID NO: 344877 - protein, 17 aa, Mycobacterium
RGWAFVFDELFQPRTAA

SEQ ID NO: 344878 - protein, 20 aa, Mycobacterium
RGWGSLRLAMPLGDDSDASF

SEQ ID NO: 344879 - protein, 26 aa, Mycobacterium
RGWRKIGALVVRWPGPILVVTIGIAL

SEQ ID NO: 344880 - protein, 27 aa, Mycobacterium
RGWRRIGTAIVRWPGPILTVACAVALI

SEQ ID NO: 344881 - protein, 26 aa, Mycobacterium
RGWRRIGTAVVRWPAPILAVTIGIAL

SEQ ID NO: 344882 - protein, 25 aa, Mycobacterium
RGWRRIGTAVVRWPAPILTATCAVS

SEQ ID NO: 344883 - protein, 26 aa, Mycobacterium
RGWRRVGAATVRWPGAILVAAVTMAL

SEQ ID NO: 344884 - protein, 27 aa, Mycobacterium
RGWRRVGTIVVRWPKPVLVASSAAVLV

SEQ ID NO: 344885 - protein, 21 aa, Mycobacterium
RGWVAICALAMAVASHEVVRR

SEQ ID NO: 344886 - protein, 19 aa, Mycobacterium
RHCVRRFGGITGDVLGCAI

SEQ ID NO: 344887 - protein, 18 aa, Mycobacterium
RHCYDIPICFSLRSIFDA

SEQ ID NO: 344888 - protein, 23 aa, Mycobacterium
RHCYDIPVCWAVRSAFDATDGVD

SEQ ID NO: 344889 - protein, 17 aa, Mycobacterium
RHDWREWISPDVDYIAL

SEQ ID NO: 344890 - protein, 17 aa, Mycobacterium
RHLVRLALFAGFLLGMF

SEQ ID NO: 344891 - protein, 17 aa, Mycobacterium
RHMPAMTSVPVAPANPG

SEQ ID NO: 344892 - protein, 20 aa, Mycobacterium
RHPLLRWAWSLLRLDFAGVA

SEQ ID NO: 344893 - protein, 23 aa, Mycobacterium
RHQTLRHAVQWSYDLLEDDEKTV

SEQ ID NO: 344894 - protein, 19 aa, Mycobacterium
RHSRAYLFGGRMRVSTVGL

SEQ ID NO: 344895 - protein, 24 aa, Mycobacterium
RHTELRVRIGIHMGRSVRRGDDLF

SEQ ID NO: 344896 - protein, 22 aa, Mycobacterium
RIAALLVDWLTCYGLTALAVAF

SEQ ID NO: 344897 - protein, 19 aa, Mycobacterium
RIAAMFAWGISFLGRTRGQ

SEQ ID NO: 344898 - protein, 19 aa, Mycobacterium
RIAAWAAFDWGSAAFNTVI

SEQ ID NO: 344899 - protein, 18 aa, Mycobacterium
RIAHDFTLIPAFIEEILR

SEQ ID NO: 344900 - protein, 18 aa, Mycobacterium
RIAKEVFRAPGIARVQSI

SEQ ID NO: 344901 - protein, 23 aa, Mycobacterium
RIAKEVFRSPGIAMVQSITRPLG

SEQ ID NO: 344902 - protein, 24 aa, Mycobacterium
RIALGFGLGCAIGIERQWRAKNAG

SEQ ID NO: 344903 - protein, 20 aa, Mycobacterium
RIATTAGMLAEWLAGDGADV

SEQ ID NO: 344904 - protein, 25 aa, Mycobacterium
RIDRLRAALPYDLPASLVVFLVALP

SEQ ID NO: 344905 - protein, 22 aa, Mycobacterium
RIGALCPYCMLVWVVTITLLVV

SEQ ID NO: 344906 - protein, 18 aa, Mycobacterium
RIGVSLRLLLLGSILGTV

SEQ ID NO: 344907 - protein, 22 aa, Mycobacterium
RIKPAWWTWILIAALGVFFFTT

SEQ ID NO: 344908 - protein, 33 aa, Mycobacterium
RIKPTLLGVLPWRWGDPQARLLKPWARIVVTLW

SEQ ID NO: 344909 - protein, 17 aa, Mycobacterium
RILGPWFWWPQKLPTPK

SEQ ID NO: 344910 - protein, 26 aa, Mycobacterium
RILGPWFWWPRVVRWRPAHASGAVLT

SEQ ID NO: 344911 - protein, 19 aa, Mycobacterium
RILLPHARPAVMVLAVLTW

SEQ ID NO: 344912 - protein, 18 aa, Mycobacterium
RILWAASWVAWSVFVVDY

SEQ ID NO: 344913 - protein, 22 aa, Mycobacterium
RIPDKRWFGWFALLTIPTPFLA

SEQ ID NO: 344914 - protein, 19 aa, Mycobacterium
RIPLNRAVVMLVIDVSESM

SEQ ID NO: 344915 - protein, 21 aa, Mycobacterium
RIPRNRAVIMLVIDMSQSMRA

SEQ ID NO: 344916 - protein, 17 aa, Mycobacterium
RIPSLFVVELFPPSVKE

SEQ ID NO: 344917 - protein, 19 aa, Mycobacterium
RIQLLIGFMCVALVVYFVL

SEQ ID NO: 344918 - protein, 21 aa, Mycobacterium
RIRAEPRWRHLPIVALTAKAM

SEQ ID NO: 344919 - protein, 19 aa, Mycobacterium
RIREAIKLSGPDIYRNPQP

SEQ ID NO: 344920 - protein, 20 aa, Mycobacterium
RIRELIKLSGPDIYRDPAPV

SEQ ID NO: 344921 - protein, 20 aa, Mycobacterium
RIRGRHWALTAAAIVAIAIV

SEQ ID NO: 344922 - protein, 20 aa, Mycobacterium
RIRGRLPALLGLALVEAVVV

SEQ ID NO: 344923 - protein, 20 aa, Mycobacterium
RIRLWLPYLPLVLAAAIGLG

SEQ ID NO: 344924 - protein, 17 aa, Mycobacterium
RIRLWVVYVEDFSGQSA

SEQ ID NO: 344925 - protein, 20 aa, Mycobacterium
RIRPAVLIPVVLAVLLVAAV

SEQ ID NO: 344926 - protein, 24 aa, Mycobacterium
RISRFQTLLLKWAMMVLLGLLTSA

SEQ ID NO: 344927 - protein, 19 aa, Mycobacterium
RITGWVRAIFSWRRRHRST

SEQ ID NO: 344928 - protein, 19 aa, Mycobacterium
RIVICSGFTQGLRLVCDAL

SEQ ID NO: 344929 - protein, 18 aa, Mycobacterium
RIVQGFALGGEWAGAVLL

SEQ ID NO: 344930 - protein, 20 aa, Mycobacterium
RIVWVYGCTYLGRLFTKNHE

SEQ ID NO: 344931 - protein, 19 aa, Mycobacterium
RKAGYRPALIVGDPDKMSV

SEQ ID NO: 344932 - protein, 22 aa, Mycobacterium
RKELWLRAANAVAFILMVCAFF

SEQ ID NO: 344933 - protein, 19 aa, Mycobacterium
RKETIRLIAEMTMGAGALV

SEQ ID NO: 344934 - protein, 19 aa, Mycobacterium
RKGPNWGRWISAFALLGFF

SEQ ID NO: 344935 - protein, 20 aa, Mycobacterium
RKLEAFAMFNIFYQAGILLG

SEQ ID NO: 344936 - protein, 18 aa, Mycobacterium
RKLFWPFIPAVGDQPLTD

SEQ ID NO: 344937 - protein, 18 aa, Mycobacterium
RKLRVGFAKAGRLMDLME

SEQ ID NO: 344938 - protein, 20 aa, Mycobacterium
RKPFPLLASIVTSIFVIGVA

SEQ ID NO: 344939 - protein, 17 aa, Mycobacterium
RKPMWWFSVVGLFVAGV

SEQ ID NO: 344940 - protein, 26 aa, Mycobacterium
RKRFGDTVGYRLVIYPTYAVLDRPDP

SEQ ID NO: 344941 - protein, 17 aa, Mycobacterium
RKRIAWWILTGYMVAAA

SEQ ID NO: 344942 - protein, 19 aa, Mycobacterium
RKRLPAIFVDVARFGVIGV

SEQ ID NO: 344943 - protein, 20 aa, Mycobacterium
RKRLPAPVARKGTITIEPPP

SEQ ID NO: 344944 - protein, 18 aa, Mycobacterium
RKRLPTIFIDVARIALIC

SEQ ID NO: 344945 - protein, 22 aa, Mycobacterium
RKRMSWQRWALLFVGIAQVAVG

SEQ ID NO: 344946 - protein, 17 aa, Mycobacterium
RKRVLAMTILLMAGATF

SEQ ID NO: 344947 - protein, 18 aa, Mycobacterium
RKRVVAVSFPRDLAITPI

SEQ ID NO: 344948 - protein, 35 aa, Mycobacterium
RKTGLRWRRVGALVARWPAPMLVASALVLAICALP

SEQ ID NO: 344949 - protein, 19 aa, Mycobacterium
RKVEAFAMFNVFYQAGILL

SEQ ID NO: 344950 - protein, 24 aa, Mycobacterium
RKWLRRVWLALPLGLLSMAAPMLF

SEQ ID NO: 344951 - protein, 23 aa, Mycobacterium
RKYRWLVFTGWLLALVPAVYLAL

SEQ ID NO: 344952 - protein, 19 aa, Mycobacterium
RLAAGVLRPDLQRVYLEEE

SEQ ID NO: 344953 - protein, 18 aa, Mycobacterium
RLAAGVVRPDMRRVYLEE

SEQ ID NO: 344954 - protein, 25 aa, Mycobacterium
RLAEPRWMPLWAFVIAMVLLRSSLV

SEQ ID NO: 344955 - protein, 19 aa, Mycobacterium
RLALAMSIASAIVFDCIRN

SEQ ID NO: 344956 - protein, 18 aa, Mycobacterium
RLAPTFPPLETVGAAVDG

SEQ ID NO: 344957 - protein, 18 aa, Mycobacterium
RLAQGFAVGGEWGGATLM

SEQ ID NO: 344958 - protein, 17 aa, Mycobacterium
RLARPTSPWARWRYSPR

SEQ ID NO: 344959 - protein, 20 aa, Mycobacterium
RLAVPGVFARLVLLWFLCSA

SEQ ID NO: 344960 - protein, 20 aa, Mycobacterium
RLCPQRDVLLISVGDGPAPA

SEQ ID NO: 344961 - protein, 17 aa, Mycobacterium
RLCSTREKLAILFTGRG

SEQ ID NO: 344962 - protein, 19 aa, Mycobacterium
RLDDARFLLPVLGVPPDQP

SEQ ID NO: 344963 - protein, 18 aa, Mycobacterium
RLDDARFLLPVLGVPPPN

SEQ ID NO: 344964 - protein, 19 aa, Mycobacterium
RLDEYVGFLVAWQRPLAGK

SEQ ID NO: 344965 - protein, 19 aa, Mycobacterium
RLDPVFARAMAKKPAERFA

SEQ ID NO: 344966 - protein, 19 aa, Mycobacterium
RLDTWRYGWVLNIGAAIAG

SEQ ID NO: 344967 - protein, 19 aa, Mycobacterium
RLEALWRGSLVVFQSILAV

SEQ ID NO: 344968 - protein, 19 aa, Mycobacterium
RLFASYVALYCVGRFCVEL

SEQ ID NO: 344969 - protein, 17 aa, Mycobacterium
RLFPRAMLHFEDFGPTN

SEQ ID NO: 344970 - protein, 17 aa, Mycobacterium
RLFYLLIHLLDPFISLE

SEQ ID NO: 344971 - protein, 20 aa, Mycobacterium
RLGALIVDWLIAYGLAALLM

SEQ ID NO: 344972 - protein, 20 aa, Mycobacterium
RLGALMIDWLISYGLAALAL

SEQ ID NO: 344973 - protein, 23 aa, Mycobacterium
RLGEFWGYLAGWSFAVGKTASCA

SEQ ID NO: 344974 - protein, 18 aa, Mycobacterium
RLGGAWPPQRGFEILSDR

SEQ ID NO: 344975 - protein, 18 aa, Mycobacterium
RLGGGIAWSAGEFPLVIV

SEQ ID NO: 344976 - protein, 17 aa, Mycobacterium
RLGGPRGAFLGGVAQTL

SEQ ID NO: 344977 - protein, 19 aa, Mycobacterium
RLGLLFAVGSALAFGSSGP

SEQ ID NO: 344978 - protein, 20 aa, Mycobacterium
RLGRWRWPALAVPAVVLTAA

SEQ ID NO: 344979 - protein, 17 aa, Mycobacterium
RLGWPLWAAYVSVFALT

SEQ ID NO: 344980 - protein, 18 aa, Mycobacterium
RLHDEWKFQPAFTAEESV

SEQ ID NO: 344981 - protein, 23 aa, Mycobacterium
RLHRLRVALLLAVFVLLTLGVTR

SEQ ID NO: 344982 - protein, 19 aa, Mycobacterium
RLIAFASLFVGWLRGGLAM

SEQ ID NO: 344983 - protein, 19 aa, Mycobacterium
RLIFSDRGYFVFLAVLPFI

SEQ ID NO: 344984 - protein, 17 aa, Mycobacterium
RLIINWLAAILVPPATA

SEQ ID NO: 344985 - protein, 18 aa, Mycobacterium
RLILADRGYFIFLALLPF

SEQ ID NO: 344986 - protein, 18 aa, Mycobacterium
RLILCGVYGVLAIAGLIV

SEQ ID NO: 344987 - protein, 18 aa, Mycobacterium
RLIQGIGIGGEWGGAVLM

SEQ ID NO: 344988 - protein, 23 aa, Mycobacterium
RLIRPSPRYALAMFADRGVRLTN

SEQ ID NO: 344989 - protein, 26 aa, Mycobacterium
RLIRTFAVPIILGWIAIIAVLNVSVP

SEQ ID NO: 344990 - protein, 18 aa, Mycobacterium
RLIVCYYLALSVLTFGAA

SEQ ID NO: 344991 - protein, 20 aa, Mycobacterium
RLLALLIDWLIAGGLALLFV

SEQ ID NO: 344992 - protein, 17 aa, Mycobacterium
RLLFPLVIVWATAGIGP

SEQ ID NO: 344993 - protein, 18 aa, Mycobacterium
RLLGFRPGRERPSTVYAD

SEQ ID NO: 344994 - protein, 19 aa, Mycobacterium
RLLHDARFVILVLVAALGM

SEQ ID NO: 344995 - protein, 17 aa, Mycobacterium
RLLLMWLACTALPGSAI

SEQ ID NO: 344996 - protein, 18 aa, Mycobacterium
RLLPEFAGAVAKTGLTIG

SEQ ID NO: 344997 - protein, 18 aa, Mycobacterium
RLLPYLLPYRARWVTMVV

SEQ ID NO: 344998 - protein, 20 aa, Mycobacterium
RLLRDGRWWLGSGVAAAGFA

SEQ ID NO: 344999 - protein, 18 aa, Mycobacterium
RLLRTFARDRFVQTTMAL

SEQ ID NO: 345000 - protein, 18 aa, Mycobacterium
RLLTRLGLTVAMLTGDNA

SEQ ID NO: 345001 - protein, 18 aa, Mycobacterium
RLLVPGGYFIEMGKTDLR

SEQ ID NO: 345002 - protein, 17 aa, Mycobacterium
RLMAVLLHGTRQPIAPW

SEQ ID NO: 345003 - protein, 24 aa, Mycobacterium
RLMPKLQAALGIPVFTPADGDLAL

SEQ ID NO: 345004 - protein, 17 aa, Mycobacterium
RLPEPRNVAGIRLTPSS

SEQ ID NO: 345005 - protein, 17 aa, Mycobacterium
RLPGFDWPAHPSWLYRL

SEQ ID NO: 345006 - protein, 19 aa, Mycobacterium
RLPGWPIWVAAVWAVQEWA

SEQ ID NO: 345007 - protein, 20 aa, Mycobacterium
RLPLVLAVIAAITFVLLFVL

SEQ ID NO: 345008 - protein, 17 aa, Mycobacterium
RLPLWAAMLVWVLLWVL

SEQ ID NO: 345009 - protein, 17 aa, Mycobacterium
RLPRPAVGISIVVATVL

SEQ ID NO: 345010 - protein, 20 aa, Mycobacterium
RLQALLVEWTLLSLLALPTS

SEQ ID NO: 345011 - protein, 26 aa, Mycobacterium
RLRAKRWSIRWALACVAGLLVTTVLA

SEQ ID NO: 345012 - protein, 19 aa, Mycobacterium
RLRDSFFDWEMYRRAIPVL

SEQ ID NO: 345013 - protein, 18 aa, Mycobacterium
RLRFPGRDGLFWIYLATL

SEQ ID NO: 345014 - protein, 17 aa, Mycobacterium
RLRGEYFLITTLAFAEV

SEQ ID NO: 345015 - protein, 17 aa, Mycobacterium
RLRGRLLALIGLTLLEA

SEQ ID NO: 345016 - protein, 18 aa, Mycobacterium
RLRGRPGGRIGAIALAAT

SEQ ID NO: 345017 - protein, 20 aa, Mycobacterium
RLRIPLVVRIDDPWQAAAWR

SEQ ID NO: 345018 - protein, 20 aa, Mycobacterium
RLRKDLTWRDLVVFGVSVVI

SEQ ID NO: 345019 - protein, 21 aa, Mycobacterium
RLRKGAAAAVVDWVRGEGGTV

SEQ ID NO: 345020 - protein, 18 aa, Mycobacterium
RLRLALRSPFMVQGSSVR

SEQ ID NO: 345021 - protein, 24 aa, Mycobacterium
RLRLVPALCRLIDPPLIVLIREGE

SEQ ID NO: 345022 - protein, 17 aa, Mycobacterium
RLRRMGRSWPWWSTVCF

SEQ ID NO: 345023 - protein, 22 aa, Mycobacterium
RLRTKLRLFGFEVIETVSEEAA

SEQ ID NO: 345024 - protein, 20 aa, Mycobacterium
RLRWQIPASLIGAIIGAWLL

SEQ ID NO: 345025 - protein, 18 aa, Mycobacterium
RLRWSWRELWIGIAFGFG

SEQ ID NO: 345026 - protein, 18 aa, Mycobacterium
RLSEEFRMPVTTVVQSQV

SEQ ID NO: 345027 - protein, 18 aa, Mycobacterium
RLSLIPVLIGTAIAIPLG

SEQ ID NO: 345028 - protein, 21 aa, Mycobacterium
RLSLPFQRARMDDMLKQADDM

SEQ ID NO: 345029 - protein, 20 aa, Mycobacterium
RLSRAAVIIGALVVAAALVA

SEQ ID NO: 345030 - protein, 18 aa, Mycobacterium
RLSRLWFDALAGICAHVR

SEQ ID NO: 345031 - protein, 17 aa, Mycobacterium
RLSRNLRRFRWLVFTGW

SEQ ID NO: 345032 - protein, 18 aa, Mycobacterium
RLSWPALFSGRWGNSAAM

SEQ ID NO: 345033 - protein, 18 aa, Mycobacterium
RLSWVLAALAGVVGAISF

SEQ ID NO: 345034 - protein, 24 aa, Mycobacterium
RLTAMVAALPRWCDIIPGAPEVAL

SEQ ID NO: 345035 - protein, 17 aa, Mycobacterium
RLTERFGARRVYLVGIA

SEQ ID NO: 345036 - protein, 24 aa, Mycobacterium
RLTGRYAVLVVGLWVLAAAAANLA

SEQ ID NO: 345037 - protein, 24 aa, Mycobacterium
RLVAELPRLAAIPFSSERQFMATL

SEQ ID NO: 345038 - protein, 17 aa, Mycobacterium
RLVIVGANIGRLILIAG

SEQ ID NO: 345039 - protein, 25 aa, Mycobacterium
RLVLLWFLCSAIPIGVIAAFVVLRS

SEQ ID NO: 345040 - protein, 19 aa, Mycobacterium
RLVPRRLLAVSGWGPVLST

SEQ ID NO: 345041 - protein, 19 aa, Mycobacterium
RLVTLILWSIAFVTRSRGQ

SEQ ID NO: 345042 - protein, 23 aa, Mycobacterium
RLVVPRFLALVLIAPILCTIVIA

SEQ ID NO: 345043 - protein, 18 aa, Mycobacterium
RLVWRQLLLFAHNIIIFL

SEQ ID NO: 345044 - protein, 23 aa, Mycobacterium
RLWRGLLLFFSRWWQLETLYRSN

SEQ ID NO: 345045 - protein, 17 aa, Mycobacterium
RLWSFPWQAKSPGKHTI

SEQ ID NO: 345046 - protein, 21 aa, Mycobacterium
RLWWRYTAWWLVALVLATLWW

SEQ ID NO: 345047 - protein, 23 aa, Mycobacterium
RLYAERWCAWALLAATVAVPTGL

SEQ ID NO: 345048 - protein, 23 aa, Mycobacterium
RLYVERWCAWALMAAAVAIPSGI

SEQ ID NO: 345049 - protein, 19 aa, Mycobacterium
RLYVPAGIEQMWFGDAVAA

SEQ ID NO: 345050 - protein, 20 aa, Mycobacterium
RMDLTFSLGERWTMAGEPAG

SEQ ID NO: 345051 - protein, 18 aa, Mycobacterium
RMIGQWRGTVIIDGPASD

SEQ ID NO: 345052 - protein, 18 aa, Mycobacterium
RMLFGAELWEWVNPNNVT

SEQ ID NO: 345053 - protein, 18 aa, Mycobacterium
RMLLAVAVVIAFIAAVTG

SEQ ID NO: 345054 - protein, 18 aa, Mycobacterium
RMLLIPAVMKLLGDDCWW

SEQ ID NO: 345055 - protein, 17 aa, Mycobacterium
RMLMAMALVLVGSAVAA

SEQ ID NO: 345056 - protein, 21 aa, Mycobacterium
RMPRRFHLRSVLLAAVTAVAG

SEQ ID NO: 345057 - protein, 18 aa, Mycobacterium
RMRGRSRLLLGMVRVNRP

SEQ ID NO: 345058 - protein, 19 aa, Mycobacterium
RMRTWRNSVLIAMIVAFFA

SEQ ID NO: 345059 - protein, 23 aa, Mycobacterium
RMTCGPLRWLIATPQFHHWHHAR

SEQ ID NO: 345060 - protein, 23 aa, Mycobacterium
RMVLVPAFIHWLGRWTWWAPKPL

SEQ ID NO: 345061 - protein, 17 aa, Mycobacterium
RMVWRICKINGKPSRYR

SEQ ID NO: 345062 - protein, 22 aa, Mycobacterium
RNELPVPIRVSLRVETPAGMSA

SEQ ID NO: 345063 - protein, 32 aa, Mycobacterium
RNFLPGAVMFACLAVAALLVWMIALSRPPEVV

SEQ ID NO: 345064 - protein, 19 aa, Mycobacterium
RNGLGIAALIAAIAGLVLC

SEQ ID NO: 345065 - protein, 17 aa, Mycobacterium
RNLPGWPLWFAAAWSAT

SEQ ID NO: 345066 - protein, 26 aa, Mycobacterium
RNLRRFRWLVFTGWFLALVPAIYLAM

SEQ ID NO: 345067 - protein, 17 aa, Mycobacterium
RNRAVVMLVIDVSQSMR

SEQ ID NO: 345068 - protein, 19 aa, Mycobacterium
RNRAVVMLVIDVSRSMEST

SEQ ID NO: 345069 - protein, 17 aa, Mycobacterium
RNRLVTFAAIFLAGGLM

SEQ ID NO: 345070 - protein, 18 aa, Mycobacterium
RNRMAFLAALMFILALCF

SEQ ID NO: 345071 - protein, 22 aa, Mycobacterium
RNRPGWEWLKWLPHNQHPSHHD

SEQ ID NO: 345072 - protein, 24 aa, Mycobacterium
RNRPRWWICYALALALSILLNVNL

SEQ ID NO: 345073 - protein, 22 aa, Mycobacterium
RNWKVSRAYLNWLADRLQKTKT

SEQ ID NO: 345074 - protein, 21 aa, Mycobacterium
RNWPAWLGIYGFMTLDRWLLF

SEQ ID NO: 345075 - protein, 17 aa, Mycobacterium
RNYFYWEPHCADIPMCW

SEQ ID NO: 345076 - protein, 24 aa, Mycobacterium
RNYFYWEPHCFDIPFCAALRSVFD

SEQ ID NO: 345077 - protein, 19 aa, Mycobacterium
RNYFYWEPHCFDIPMCAAA

SEQ ID NO: 345078 - protein, 19 aa, Mycobacterium
RNYFYWEPHCFNIPICWAL

SEQ ID NO: 345079 - protein, 18 aa, Mycobacterium
RNYFYWEPHCYNIPLCWS

SEQ ID NO: 345080 - protein, 19 aa, Mycobacterium
RPAAISLAWGYWQPSSGMT

SEQ ID NO: 345081 - protein, 19 aa, Mycobacterium
RPADRPLWLGSIKSNMGHT

SEQ ID NO: 345082 - protein, 18 aa, Mycobacterium
RPAQLGGLVFVSAFTVVT

SEQ ID NO: 345083 - protein, 19 aa, Mycobacterium
RPASLAFLGGWLVGLVAFT

SEQ ID NO: 345084 - protein, 20 aa, Mycobacterium
RPASSMLRPSGPRPLVRSLL

SEQ ID NO: 345085 - protein, 19 aa, Mycobacterium
RPASTMLRPTGPRPLVRSL

SEQ ID NO: 345086 - protein, 19 aa, Mycobacterium
RPASTMLRPYGPRPAVRQL

SEQ ID NO: 345087 - protein, 20 aa, Mycobacterium
RPATILGCWVVLVATVGLFF

SEQ ID NO: 345088 - protein, 18 aa, Mycobacterium
RPAVMVLAVLTWVNVWND

SEQ ID NO: 345089 - protein, 18 aa, Mycobacterium
RPAVMVLGVLTWVNVWND

SEQ ID NO: 345090 - protein, 17 aa, Mycobacterium
RPEELPRVWALINATSA

SEQ ID NO: 345091 - protein, 20 aa, Mycobacterium
RPEPIIVFGTVLTWILVERA

SEQ ID NO: 345092 - protein, 24 aa, Mycobacterium
RPFPQRLGPRWTLLYKLVTTTDHK

SEQ ID NO: 345093 - protein, 23 aa, Mycobacterium
RPGCADSPVGVRCAAAMALASEE

SEQ ID NO: 345094 - protein, 20 aa, Mycobacterium
RPGDLPRVWALIQATRDDPL

SEQ ID NO: 345095 - protein, 20 aa, Mycobacterium
RPGLELFADVALTCVASAML

SEQ ID NO: 345096 - protein, 19 aa, Mycobacterium
RPGMGWLVAVAFLGAVVSA

SEQ ID NO: 345097 - protein, 18 aa, Mycobacterium
RPGMPAWGPVPGSPPPGF

SEQ ID NO: 345098 - protein, 19 aa, Mycobacterium
RPGPPPGWEGAWREPPTPG

SEQ ID NO: 345099 - protein, 20 aa, Mycobacterium
RPGPRIAFRPDIEGLRAIAV

SEQ ID NO: 345100 - protein, 24 aa, Mycobacterium
RPGSLEWWAGVGFVGAILAGVAAP

SEQ ID NO: 345101 - protein, 17 aa, Mycobacterium
RPGWRRLKHFNGFTTSF

SEQ ID NO: 345102 - protein, 18 aa, Mycobacterium
RPHWCEWRTAGAAATAAA

SEQ ID NO: 345103 - protein, 18 aa, Mycobacterium
RPIAAGLFNAVPAAPALT

SEQ ID NO: 345104 - protein, 18 aa, Mycobacterium
RPIALGLFNAIPEAPPLT

SEQ ID NO: 345105 - protein, 18 aa, Mycobacterium
RPILAYAVGLVMLAAAAT

SEQ ID NO: 345106 - protein, 17 aa, Mycobacterium
RPLAVGFFFSLGHSTVV

SEQ ID NO: 345107 - protein, 18 aa, Mycobacterium
RPLHVLRRGWRTDVVHYL

SEQ ID NO: 345108 - protein, 18 aa, Mycobacterium
RPLIPRMVRVLAVPIVVF

SEQ ID NO: 345109 - protein, 17 aa, Mycobacterium
RPLPRLHGSVPLPEALS

SEQ ID NO: 345110 - protein, 19 aa, Mycobacterium
RPLPSHRLWIGALLAVTFF

SEQ ID NO: 345111 - protein, 25 aa, Mycobacterium
RPLTWRAALWSVMSVRWAGIALALF

SEQ ID NO: 345112 - protein, 22 aa, Mycobacterium
RPLVLRLGRWDVPMMSGLTGLI

SEQ ID NO: 345113 - protein, 18 aa, Mycobacterium
RPLVPAMFSGVLSRLRRT

SEQ ID NO: 345114 - protein, 17 aa, Mycobacterium
RPLVPPFVARVIDTTTQ

SEQ ID NO: 345115 - protein, 17 aa, Mycobacterium
RPLVPPFVGRVIGTTTA

SEQ ID NO: 345116 - protein, 19 aa, Mycobacterium
RPLVRALLYHPQRGVPSDA

SEQ ID NO: 345117 - protein, 20 aa, Mycobacterium
RPNLFVTYWSFRAMIGLAAG

SEQ ID NO: 345118 - protein, 23 aa, Mycobacterium
RPNMFVTYWSFRAMIGFLAIPLL

SEQ ID NO: 345119 - protein, 27 aa, Mycobacterium
RPNRLWWRFTAWWLLCGALAVTWWVVA

SEQ ID NO: 345120 - protein, 23 aa, Mycobacterium
RPNRRWWRHTAWFMLALLLATLW

SEQ ID NO: 345121 - protein, 19 aa, Mycobacterium
RPNWTLLRKTVRDLRRRPA

SEQ ID NO: 345122 - protein, 17 aa, Mycobacterium
RPPGSNENWKWVASIAG

SEQ ID NO: 345123 - protein, 19 aa, Mycobacterium
RPPLGPVWVALLIIGASSG

SEQ ID NO: 345124 - protein, 19 aa, Mycobacterium
RPPLLAGLIRRLSVPIILG

SEQ ID NO: 345125 - protein, 19 aa, Mycobacterium
RPPYLGWEPFQPVDAGVFF

SEQ ID NO: 345126 - protein, 19 aa, Mycobacterium
RPQPAPGYRLPEKSEPDSD

SEQ ID NO: 345127 - protein, 22 aa, Mycobacterium
RPRLRPLASYNKTWLGFVGLSL

SEQ ID NO: 345128 - protein, 23 aa, Mycobacterium
RPRLRPTRVLAMVIGVGAVLAAI

SEQ ID NO: 345129 - protein, 18 aa, Mycobacterium
RPRRAGVSSFGISGTNAH

SEQ ID NO: 345130 - protein, 17 aa, Mycobacterium
RPRRFRVGLSRPRWTTV

SEQ ID NO: 345131 - protein, 18 aa, Mycobacterium
RPRVFRLRADLPVPQALH

SEQ ID NO: 345132 - protein, 18 aa, Mycobacterium
RPSAFTMAGPWVGIAAPG

SEQ ID NO: 345133 - protein, 20 aa, Mycobacterium
RPSGGIPLLVVLSVLAVAVA

SEQ ID NO: 345134 - protein, 24 aa, Mycobacterium
RPSGKRVAAAVAVVGVLLFVGSAA

SEQ ID NO: 345135 - protein, 17 aa, Mycobacterium
RPSGPRPLVRSLLLKQP

SEQ ID NO: 345136 - protein, 23 aa, Mycobacterium
RPSGWESAIRWPLRRRRRPAKRK

SEQ ID NO: 345137 - protein, 22 aa, Mycobacterium
RPSTRVAFRFCVVYFGLFCVLL

SEQ ID NO: 345138 - protein, 18 aa, Mycobacterium
RPTFSAGRVRRVDVADLV

SEQ ID NO: 345139 - protein, 19 aa, Mycobacterium
RPTGLAFLGGWLVGMAALT

SEQ ID NO: 345140 - protein, 17 aa, Mycobacterium
RPTGPRPLVRSLLLKQS

SEQ ID NO: 345141 - protein, 24 aa, Mycobacterium
RPTHPRKFLGLFPFQGLLHAQREQ

SEQ ID NO: 345142 - protein, 19 aa, Mycobacterium
RPTSPWARWRYSPRRLTRA

SEQ ID NO: 345143 - protein, 17 aa, Mycobacterium
RPWAWTAGRGWLQVLPG

SEQ ID NO: 345144 - protein, 20 aa, Mycobacterium
RPWMAVMFFAGFLILYCLGV

SEQ ID NO: 345145 - protein, 22 aa, Mycobacterium
RPWRRLRISQLIIGMSAVVAMT

SEQ ID NO: 345146 - protein, 17 aa, Mycobacterium
RPYGPRPAVRELILNDV

SEQ ID NO: 345147 - protein, 19 aa, Mycobacterium
RPYGPRPAVRELLLKNVEE

SEQ ID NO: 345148 - protein, 18 aa, Mycobacterium
RPYGPRPAVRQLLLWDDD

SEQ ID NO: 345149 - protein, 17 aa, Mycobacterium
RPYLRGLRRSVLPTQLV

SEQ ID NO: 345150 - protein, 18 aa, Mycobacterium
RPYQWWRVALVALSGLGY

SEQ ID NO: 345151 - protein, 21 aa, Mycobacterium
RQARCRPDHPFLVCDSDRISY

SEQ ID NO: 345152 - protein, 21 aa, Mycobacterium
RQEAALTWLLLVSVPVMAVAN

SEQ ID NO: 345153 - protein, 18 aa, Mycobacterium
RQGASWLGALMVAAMIAL

SEQ ID NO: 345154 - protein, 17 aa, Mycobacterium
RQGRLAPTWSFHFGLLL

SEQ ID NO: 345155 - protein, 19 aa, Mycobacterium
RQHARRMVLIWVAVVLAIT

SEQ ID NO: 345156 - protein, 19 aa, Mycobacterium
RQHGRRMVLIWVAAVLALT

SEQ ID NO: 345157 - protein, 17 aa, Mycobacterium
RQLSWLPQRSVLIPGTV

SEQ ID NO: 345158 - protein, 19 aa, Mycobacterium
RQPRFWRLAIAFLTLALAV

SEQ ID NO: 345159 - protein, 18 aa, Mycobacterium
RQQIPLRPLWGLDDRLKQ

SEQ ID NO: 345160 - protein, 17 aa, Mycobacterium
RQQWRSAALFAVALAGM

SEQ ID NO: 345161 - protein, 18 aa, Mycobacterium
RQRCCCADSARICRKQSD

SEQ ID NO: 345162 - protein, 20 aa, Mycobacterium
RQRLAGVPGRALRLAAAALG

SEQ ID NO: 345163 - protein, 17 aa, Mycobacterium
RQRNWGWVLAIVVIVLA

SEQ ID NO: 345164 - protein, 24 aa, Mycobacterium
RQTPRPALVAVLSLLGFLIALATL

SEQ ID NO: 345165 - protein, 17 aa, Mycobacterium
RRAAVVLAFTLVGFALA

SEQ ID NO: 345166 - protein, 21 aa, Mycobacterium
RRADLAMTWLVAGLVAGILSG

SEQ ID NO: 345167 - protein, 19 aa, Mycobacterium
RRAILPACCALGGLVVPVV

SEQ ID NO: 345168 - protein, 18 aa, Mycobacterium
RRALRWALIFSAGCVFWA

SEQ ID NO: 345169 - protein, 24 aa, Mycobacterium
RRALRWGLIFAVGCVFWAAVTMLL

SEQ ID NO: 345170 - protein, 19 aa, Mycobacterium
RRAMMLAHWAWLSMLLAGG

SEQ ID NO: 345171 - protein, 18 aa, Mycobacterium
RRAPRRWAARDAIADIER

SEQ ID NO: 345172 - protein, 20 aa, Mycobacterium
RRASCLSGLGYPASTPILGA

SEQ ID NO: 345173 - protein, 21 aa, Mycobacterium
RRASVLRLFEHRAAEVGLPEE

SEQ ID NO: 345174 - protein, 17 aa, Mycobacterium
RRAVPLDSVYNWSPLAG

SEQ ID NO: 345175 - protein, 19 aa, Mycobacterium
RRCLSRWRSIVLMLLLIST

SEQ ID NO: 345176 - protein, 23 aa, Mycobacterium
RRCLTRWRPILLGLLVIATTGFA

SEQ ID NO: 345177 - protein, 17 aa, Mycobacterium
RRDRTSFIIAHRLSTIR

SEQ ID NO: 345178 - protein, 19 aa, Mycobacterium
RREALRRLALLGVGGAAAT

SEQ ID NO: 345179 - protein, 18 aa, Mycobacterium
RREALRRLGLLGLSTAAA

SEQ ID NO: 345180 - protein, 18 aa, Mycobacterium
RREFSLGSAFAFAFAFIS

SEQ ID NO: 345181 - protein, 17 aa, Mycobacterium
RRELAYLGSDTASAPEV

SEQ ID NO: 345182 - protein, 20 aa, Mycobacterium
RRFAARGGERGVIYDIALWM

SEQ ID NO: 345183 - protein, 21 aa, Mycobacterium
RRFASVHPRYMTPAFGTIVMG

SEQ ID NO: 345184 - protein, 23 aa, Mycobacterium
RRFGRDPVSVLLIFIIVFALIIA

SEQ ID NO: 345185 - protein, 23 aa, Mycobacterium
RRFRVGLSRPRWTTVAAAVALLC

SEQ ID NO: 345186 - protein, 23 aa, Mycobacterium
RRFRWLVFTGWMLALVPAIYLAL

SEQ ID NO: 345187 - protein, 21 aa, Mycobacterium
RRFSAIALWCWVAMALSGVMN

SEQ ID NO: 345188 - protein, 19 aa, Mycobacterium
RRGDAWPTGRVVAWLLGCL

SEQ ID NO: 345189 - protein, 18 aa, Mycobacterium
RRGIPLPAFLDAVAPGVV

SEQ ID NO: 345190 - protein, 17 aa, Mycobacterium
RRGLRIAMRGRRDPATG

SEQ ID NO: 345191 - protein, 23 aa, Mycobacterium
RRGSSVCGWTMRLMTALELSLGD

SEQ ID NO: 345192 - protein, 17 aa, Mycobacterium
RRIALLTVRAMGTSATR

SEQ ID NO: 345193 - protein, 22 aa, Mycobacterium
RRIEATAVRPPRGWDAAVGSGV

SEQ ID NO: 345194 - protein, 19 aa, Mycobacterium
RRIGAAMARLSREAAAHNA

SEQ ID NO: 345195 - protein, 17 aa, Mycobacterium
RRILRRLIVLLALVCAQ

SEQ ID NO: 345196 - protein, 17 aa, Mycobacterium
RRIPIEIDEAAVIDGLS

SEQ ID NO: 345197 - protein, 21 aa, Mycobacterium
RRITGWIAALFAWRRRHRQPP

SEQ ID NO: 345198 - protein, 17 aa, Mycobacterium
RRKFLPPFITWYAAMLF

SEQ ID NO: 345199 - protein, 17 aa, Mycobacterium
RRKGTRLGVRTLAIGSG

SEQ ID NO: 345200 - protein, 31 aa, Mycobacterium
RRKRKSNGWKIFRNVMIALVLLAIVIPLATF

SEQ ID NO: 345201 - protein, 17 aa, Mycobacterium
RRKVIGLSLGIGLGAFG

SEQ ID NO: 345202 - protein, 26 aa, Mycobacterium
RRKWLRRVWLTWPLALLATASTMVFG

SEQ ID NO: 345203 - protein, 26 aa, Mycobacterium
RRLARIVRRFAIPIILFWVAITALLN

SEQ ID NO: 345204 - protein, 21 aa, Mycobacterium
RRLDEAAGFAIPFLPRGLDDI

SEQ ID NO: 345205 - protein, 21 aa, Mycobacterium
RRLDEAAGFAIPFLPRGLDEI

SEQ ID NO: 345206 - protein, 21 aa, Mycobacterium
RRLDEAAGFAIPFLPRGLDQI

SEQ ID NO: 345207 - protein, 17 aa, Mycobacterium
RRLEGLIAPGTWNIDPS

SEQ ID NO: 345208 - protein, 17 aa, Mycobacterium
RRLGRLMSILSIPMLLA

SEQ ID NO: 345209 - protein, 20 aa, Mycobacterium
RRLLAHYALGLAIAYVLAVL

SEQ ID NO: 345210 - protein, 17 aa, Mycobacterium
RRLLPALILVLAACAVL

SEQ ID NO: 345211 - protein, 18 aa, Mycobacterium
RRLLPQRALTLAVILLGV

SEQ ID NO: 345212 - protein, 20 aa, Mycobacterium
RRLLPYTWLGAGAVALGVGA

SEQ ID NO: 345213 - protein, 26 aa, Mycobacterium
RRLLRITRWDVCLAMVFAGAVNMAML

SEQ ID NO: 345214 - protein, 18 aa, Mycobacterium
RRLMAVLLHGTRQPIAPW

SEQ ID NO: 345215 - protein, 22 aa, Mycobacterium
RRLPAWPIWFALLWAAQEWLKS

SEQ ID NO: 345216 - protein, 22 aa, Mycobacterium
RRLPGWPIWFAVLWGAQEWLKS

SEQ ID NO: 345217 - protein, 24 aa, Mycobacterium
RRLRLRPRWLRRPGRTGLAAMAAA

SEQ ID NO: 345218 - protein, 20 aa, Mycobacterium
RRLRMPPLSVTWKVAVILLI

SEQ ID NO: 345219 - protein, 17 aa, Mycobacterium
RRLRYGAQVTLALSGLV

SEQ ID NO: 345220 - protein, 22 aa, Mycobacterium
RRLSGRFRRPKWSTLAASLAVL

SEQ ID NO: 345221 - protein, 20 aa, Mycobacterium
RRLTKFGALVRVPRSVEALG

SEQ ID NO: 345222 - protein, 18 aa, Mycobacterium
RRLVAVLLHGTRQPIAPW

SEQ ID NO: 345223 - protein, 19 aa, Mycobacterium
RRLWPRSAPMLAAYATLQA

SEQ ID NO: 345224 - protein, 21 aa, Mycobacterium
RRMGRSWPWWSTVCFLSGCAI

SEQ ID NO: 345225 - protein, 22 aa, Mycobacterium
RRMGTAVVRWPAPVLAVTIAVA

SEQ ID NO: 345226 - protein, 18 aa, Mycobacterium
RRMLCGLQLPGPNNQQTA

SEQ ID NO: 345227 - protein, 29 aa, Mycobacterium
RRMPAWRRLLAEMVHFFALLFWVAGGLAF

SEQ ID NO: 345228 - protein, 21 aa, Mycobacterium
RRNGIPKARLAAVATAGGGAS

SEQ ID NO: 345229 - protein, 17 aa, Mycobacterium
RRNSLRTLIPVSVRTPD

SEQ ID NO: 345230 - protein, 19 aa, Mycobacterium
RRNYIPGIVLFVALAVVTL

SEQ ID NO: 345231 - protein, 18 aa, Mycobacterium
RRNYLPALILGIALLAVT

SEQ ID NO: 345232 - protein, 22 aa, Mycobacterium
RRPAVGVLWSWAAGRDRGWRDV

SEQ ID NO: 345233 - protein, 27 aa, Mycobacterium
RRPHPKSSWAAVLAWVVLPSLALLLAI

SEQ ID NO: 345234 - protein, 20 aa, Mycobacterium
RRPHPLVAWLSRMPTTRGFQ

SEQ ID NO: 345235 - protein, 17 aa, Mycobacterium
RRPISWDAPITVANNRS

SEQ ID NO: 345236 - protein, 17 aa, Mycobacterium
RRPIVVWWITWAVSNAV

SEQ ID NO: 345237 - protein, 17 aa, Mycobacterium
RRQGIVCAAALSGIAGL

SEQ ID NO: 345238 - protein, 18 aa, Mycobacterium
RRQVLVLSLTCLTLSQVI

SEQ ID NO: 345239 - protein, 21 aa, Mycobacterium
RRRAKRRKAEFEAAKRVDPTD

SEQ ID NO: 345240 - protein, 22 aa, Mycobacterium
RRRFRWCCGAAYTAALSTVTSL

SEQ ID NO: 345241 - protein, 21 aa, Mycobacterium
RRRIMLFGWAGCLAWSFVVIP

SEQ ID NO: 345242 - protein, 27 aa, Mycobacterium
RRRKELWLRVANLFAFIAALAGFCLWF

SEQ ID NO: 345243 - protein, 23 aa, Mycobacterium
RRRRFRWCVAAAYLSGVSTVAGV

SEQ ID NO: 345244 - protein, 17 aa, Mycobacterium
RRRTLVVALVCLTVSQL

SEQ ID NO: 345245 - protein, 17 aa, Mycobacterium
RRSGVNIVRRPKAHLLA

SEQ ID NO: 345246 - protein, 17 aa, Mycobacterium
RRSRFVKIYGLRIDLQR

SEQ ID NO: 345247 - protein, 17 aa, Mycobacterium
RRSRRAAPDVAPWERDI

SEQ ID NO: 345248 - protein, 21 aa, Mycobacterium
RRSRRRPMLLAGRSLAAMFAV

SEQ ID NO: 345249 - protein, 21 aa, Mycobacterium
RRSVELMYFLAIPVAVVGALL

SEQ ID NO: 345250 - protein, 23 aa, Mycobacterium
RRSWRWVVVILLVLAVIAGVDAY

SEQ ID NO: 345251 - protein, 23 aa, Mycobacterium
RRTAIALTRWRVRMEVEPGRRQN

SEQ ID NO: 345252 - protein, 25 aa, Mycobacterium
RRTAMALTRWRVRMEVEPGRRQTLA

SEQ ID NO: 345253 - protein, 20 aa, Mycobacterium
RRTDWVRLILPYAGFFGTAV

SEQ ID NO: 345254 - protein, 17 aa, Mycobacterium
RRTGIKVTRHLIAVYAL

SEQ ID NO: 345255 - protein, 25 aa, Mycobacterium
RRTLRNVYIPWTFTMTPISNSDVGS

SEQ ID NO: 345256 - protein, 22 aa, Mycobacterium
RRTRLRLPFSPWHLVLIPVTFL

SEQ ID NO: 345257 - protein, 21 aa, Mycobacterium
RRTVWIPWALGPAAAVMRLLP

SEQ ID NO: 345258 - protein, 24 aa, Mycobacterium
RRTWLRRVLLAFPLGLVAMASTMF

SEQ ID NO: 345259 - protein, 26 aa, Mycobacterium
RRTWLRRVWLAWPFGLLSAGLTMMAA

SEQ ID NO: 345260 - protein, 17 aa, Mycobacterium
RRVAGPLAYLVDLLAAV

SEQ ID NO: 345261 - protein, 19 aa, Mycobacterium
RRVAVIFALAALSWITLPL

SEQ ID NO: 345262 - protein, 23 aa, Mycobacterium
RRVGTAIVRWPLPILAVTCAVAL

SEQ ID NO: 345263 - protein, 26 aa, Mycobacterium
RRVGTAVTRWPVPIIVATSMIAIIGF

SEQ ID NO: 345264 - protein, 23 aa, Mycobacterium
RRVPEGLWHPGLVAALVGGGLAL

SEQ ID NO: 345265 - protein, 20 aa, Mycobacterium
RRVSDGWAFLCIAVVVAAVV

SEQ ID NO: 345266 - protein, 21 aa, Mycobacterium
RRVTRWEWIWAVLLAGAVAVI

SEQ ID NO: 345267 - protein, 19 aa, Mycobacterium
RRVTSWLAALIVPSIICAI

SEQ ID NO: 345268 - protein, 18 aa, Mycobacterium
RRWIARIALTWGALSALM

SEQ ID NO: 345269 - protein, 20 aa, Mycobacterium
RRWILGIGMVGSAPREGAAT

SEQ ID NO: 345270 - protein, 21 aa, Mycobacterium
RRWLARIAVSWGIVVVATGFA

SEQ ID NO: 345271 - protein, 20 aa, Mycobacterium
RRWLLRTGIVLKFVLAAALT

SEQ ID NO: 345272 - protein, 19 aa, Mycobacterium
RRWLPGQLLQGIGVGATLP

SEQ ID NO: 345273 - protein, 17 aa, Mycobacterium
RRWPHYMFGGRVRTSTL

SEQ ID NO: 345274 - protein, 17 aa, Mycobacterium
RRWQLQYSRRLRVTDSA

SEQ ID NO: 345275 - protein, 22 aa, Mycobacterium
RRWRDVRPALRLRCASKPRRAD

SEQ ID NO: 345276 - protein, 25 aa, Mycobacterium
RRWRRIGTAVVRWPGAVLAAALAVS

SEQ ID NO: 345277 - protein, 26 aa, Mycobacterium
RRWRRIGTIVVRWPGPVLVAAALISL

SEQ ID NO: 345278 - protein, 25 aa, Mycobacterium
RRWRRIGTIVVRWPGPVLVATLLIS

SEQ ID NO: 345279 - protein, 26 aa, Mycobacterium
RRWRRVGAMVSRWPGPVLAGSLLVLV

SEQ ID NO: 345280 - protein, 19 aa, Mycobacterium
RRYWNWIAVAVVRRPVPLL

SEQ ID NO: 345281 - protein, 20 aa, Mycobacterium
RRYWNWIAVAVVRRPVPLLV

SEQ ID NO: 345282 - protein, 23 aa, Mycobacterium
RRYWNWIAVAVVRRPVPLLVASL

SEQ ID NO: 345283 - protein, 17 aa, Mycobacterium
RSAACLLVPLPAVLIEM

SEQ ID NO: 345284 - protein, 20 aa, Mycobacterium
RSAARPGNWSLFDGGYTFAS

SEQ ID NO: 345285 - protein, 19 aa, Mycobacterium
RSAGLVGVFISVYTVTAAG

SEQ ID NO: 345286 - protein, 17 aa, Mycobacterium
RSANWWWALVGLAVSAL

SEQ ID NO: 345287 - protein, 17 aa, Mycobacterium
RSAPMLAAYATLQACIL

SEQ ID NO: 345288 - protein, 19 aa, Mycobacterium
RSARRWTDRLGYVFGPPGW

SEQ ID NO: 345289 - protein, 23 aa, Mycobacterium
RSDRILPGLLWRRDTIGAAVAAS

SEQ ID NO: 345290 - protein, 23 aa, Mycobacterium
RSELPGCTLVSVGHRSTIDQHHN

SEQ ID NO: 345291 - protein, 21 aa, Mycobacterium
RSFAEGVGWLAQIGLFVLLGL

SEQ ID NO: 345292 - protein, 18 aa, Mycobacterium
RSGALGSLMSFIGVVLGA

SEQ ID NO: 345293 - protein, 29 aa, Mycobacterium
RSGIRFWSRRAWLAWPLGLLASGLTMFFG

SEQ ID NO: 345294 - protein, 21 aa, Mycobacterium
RSGSLLAPIALHWSLNGMGAL

SEQ ID NO: 345295 - protein, 21 aa, Mycobacterium
RSGSLLAPIALHWSLNGMGVL

SEQ ID NO: 345296 - protein, 25 aa, Mycobacterium
RSGYPAELAKLWPVIVDLTIVLATV

SEQ ID NO: 345297 - protein, 17 aa, Mycobacterium
RSHYRRWGLIAVGLFQV

SEQ ID NO: 345298 - protein, 25 aa, Mycobacterium
RSIYKFAVPIALFWLAVCAIIAAFV

SEQ ID NO: 345299 - protein, 17 aa, Mycobacterium
RSLELFLSMAATTVTAA

SEQ ID NO: 345300 - protein, 21 aa, Mycobacterium
RSLLISLLRPYRWIVAVLALV

SEQ ID NO: 345301 - protein, 23 aa, Mycobacterium
RSLLRVVLIIGVLYILATYPQIL

SEQ ID NO: 345302 - protein, 17 aa, Mycobacterium
RSLLRYSVIAAMCGGAL

SEQ ID NO: 345303 - protein, 18 aa, Mycobacterium
RSLNPWPALWAMLVGYFM

SEQ ID NO: 345304 - protein, 29 aa, Mycobacterium
RSLVVPCLLRLLGPWFWWPTFIRQRPLRQ

SEQ ID NO: 345305 - protein, 29 aa, Mycobacterium
RSLVVPCLLRLLGPWFWWPTFIRQRPLRT

SEQ ID NO: 345306 - protein, 23 aa, Mycobacterium
RSPDFRRLWLAGIPTVIGANLTI

SEQ ID NO: 345307 - protein, 19 aa, Mycobacterium
RSPLPFGRHRWVVDARAPD

SEQ ID NO: 345308 - protein, 21 aa, Mycobacterium
RSRAGGVVFAMLLVLTFSTAF

SEQ ID NO: 345309 - protein, 22 aa, Mycobacterium
RSRELPVLRWADARSNRRMIEG

SEQ ID NO: 345310 - protein, 22 aa, Mycobacterium
RSRGVHGWALLRGHIAPVSVLP

SEQ ID NO: 345311 - protein, 22 aa, Mycobacterium
RSRIGMVLQDTWLFDGTIAENI

SEQ ID NO: 345312 - protein, 22 aa, Mycobacterium
RSRIGMVLQDTWLFDGTIAQNI

SEQ ID NO: 345313 - protein, 20 aa, Mycobacterium
RSRIGMVLQDTWLFEGTIAD

SEQ ID NO: 345314 - protein, 20 aa, Mycobacterium
RSRIPLVYLVSGLCGVAVLL

SEQ ID NO: 345315 - protein, 17 aa, Mycobacterium
RSRIWVFRTPRRNELMV

SEQ ID NO: 345316 - protein, 21 aa, Mycobacterium
RSRLAEWGWQAIAAIAIAVVF

SEQ ID NO: 345317 - protein, 25 aa, Mycobacterium
RSRLSRIPRRWVIVALGVLVVAAGL

SEQ ID NO: 345318 - protein, 18 aa, Mycobacterium
RSRVGRLRTSTVVLIVAF

SEQ ID NO: 345319 - protein, 19 aa, Mycobacterium
RSRWLRPVLICVLVAVLAI

SEQ ID NO: 345320 - protein, 17 aa, Mycobacterium
RSSNRFAFFFGLTAINP

SEQ ID NO: 345321 - protein, 18 aa, Mycobacterium
RSSWLPMFILLIVLSSVA

SEQ ID NO: 345322 - protein, 17 aa, Mycobacterium
RSTRFVLRHAVAVGSSV

SEQ ID NO: 345323 - protein, 29 aa, Mycobacterium
RSVARWIRRLAVPIILGWLLLAVALNALV

SEQ ID NO: 345324 - protein, 20 aa, Mycobacterium
RSVSWLPLYHDMGLIMILFP

SEQ ID NO: 345325 - protein, 19 aa, Mycobacterium
RSWSTRATLHFLWLRLARV

SEQ ID NO: 345326 - protein, 20 aa, Mycobacterium
RTADMKALFAAIINDDPLPL

SEQ ID NO: 345327 - protein, 19 aa, Mycobacterium
RTAGTWAYMAPERMMSDVI

SEQ ID NO: 345328 - protein, 24 aa, Mycobacterium
RTDQLFCVAVGFLTAVSAAATIGG

SEQ ID NO: 345329 - protein, 22 aa, Mycobacterium
RTDRWGHWLGCATALAAFALGL

SEQ ID NO: 345330 - protein, 17 aa, Mycobacterium
RTEFQAVQFIPLVMVPQ

SEQ ID NO: 345331 - protein, 17 aa, Mycobacterium
RTEWPLAVVAVAFLAIY

SEQ ID NO: 345332 - protein, 20 aa, Mycobacterium
RTGAFTVVTIFAVFGFAAAV

SEQ ID NO: 345333 - protein, 19 aa, Mycobacterium
RTGSLLGERVLTLEPAGSG

SEQ ID NO: 345334 - protein, 17 aa, Mycobacterium
RTGWRPLVVAVIGLTVV

SEQ ID NO: 345335 - protein, 18 aa, Mycobacterium
RTLLRRKLWWAGTISAVM

SEQ ID NO: 345336 - protein, 21 aa, Mycobacterium
RTLPELWKLLGHIDAVHGFYY

SEQ ID NO: 345337 - protein, 17 aa, Mycobacterium
RTNTALMPARWSVAGVE

SEQ ID NO: 345338 - protein, 19 aa, Mycobacterium
RTPELYAWLVVALAGFAWE

SEQ ID NO: 345339 - protein, 17 aa, Mycobacterium
RTPGELAEAHWIEFSAT

SEQ ID NO: 345340 - protein, 22 aa, Mycobacterium
RTPGELTHAHWVEFSAATRMSG

SEQ ID NO: 345341 - protein, 20 aa, Mycobacterium
RTPLNWRVLVGAFFVAAAFA

SEQ ID NO: 345342 - protein, 18 aa, Mycobacterium
RTPWLVPGWLFISAVVYV

SEQ ID NO: 345343 - protein, 23 aa, Mycobacterium
RTQRNVYIPWSLTVTPISQSEVG

SEQ ID NO: 345344 - protein, 19 aa, Mycobacterium
RTRLMLGFALLPTTLAGSA

SEQ ID NO: 345345 - protein, 22 aa, Mycobacterium
RTRLTEVLSRIYGRPVSVQLHV

SEQ ID NO: 345346 - protein, 24 aa, Mycobacterium
RTRLYLPMPFFWVGGFGGGLLSAL

SEQ ID NO: 345347 - protein, 17 aa, Mycobacterium
RTRRWRRVWVPWAASIG

SEQ ID NO: 345348 - protein, 19 aa, Mycobacterium
RTSALVIRYGDVPSRPLVE

SEQ ID NO: 345349 - protein, 18 aa, Mycobacterium
RTSFIGAYRKLWSEVRSE

SEQ ID NO: 345350 - protein, 17 aa, Mycobacterium
RTVEIIEYIALSLIVPI

SEQ ID NO: 345351 - protein, 19 aa, Mycobacterium
RTVFVDAWRSRLWPVPALG

SEQ ID NO: 345352 - protein, 26 aa, Mycobacterium
RTVHKLAVPVVFAWVGLVVVLSVLVP

SEQ ID NO: 345353 - protein, 21 aa, Mycobacterium
RTVIIPALFTLIGPKIWWPAL

SEQ ID NO: 345354 - protein, 23 aa, Mycobacterium
RTVIIPALFTWIGPKIWWPGLRA

SEQ ID NO: 345355 - protein, 25 aa, Mycobacterium
RTVSRFSWRRPWLVIGSWLAVLVIL

SEQ ID NO: 345356 - protein, 22 aa, Mycobacterium
RTWPNHVFDFLAPRFAALEFSG

SEQ ID NO: 345357 - protein, 17 aa, Mycobacterium
RTWRGVLVTGFFGGTEV

SEQ ID NO: 345358 - protein, 21 aa, Mycobacterium
RTWVGALVRWLARPAGLSAAA

SEQ ID NO: 345359 - protein, 19 aa, Mycobacterium
RTWWPPPNWVLLWAKTLIV

SEQ ID NO: 345360 - protein, 20 aa, Mycobacterium
RVAAAFSWGLAFLGRTRGQM

SEQ ID NO: 345361 - protein, 23 aa, Mycobacterium
RVAFKLYPRRAFLGLALFTGQAF

SEQ ID NO: 345362 - protein, 18 aa, Mycobacterium
RVALIGIAVCAAFLAAAL

SEQ ID NO: 345363 - protein, 24 aa, Mycobacterium
RVDRCARAVWPLCLAASAAIPFVT

SEQ ID NO: 345364 - protein, 26 aa, Mycobacterium
RVELLRLAVILALWAAVVAAFVSVIY

SEQ ID NO: 345365 - protein, 22 aa, Mycobacterium
RVEVPNALPLMLGGLRNATLQV

SEQ ID NO: 345366 - protein, 18 aa, Mycobacterium
RVEVVIDDAMRWLRAPHP

SEQ ID NO: 345367 - protein, 20 aa, Mycobacterium
RVGRGWLAAIAVLLALCAGA

SEQ ID NO: 345368 - protein, 24 aa, Mycobacterium
RVGSRFGPYHLVRLIGRGGMGEVY

SEQ ID NO: 345369 - protein, 18 aa, Mycobacterium
RVGTRFGPYYLKRQLGTG

SEQ ID NO: 345370 - protein, 20 aa, Mycobacterium
RVGVSVVWLSIIVLLPLAAI

SEQ ID NO: 345371 - protein, 25 aa, Mycobacterium
RVIPPSMLRRAMPVLIVILIVGMII

SEQ ID NO: 345372 - protein, 29 aa, Mycobacterium
RVKRPFIPRMVRAFAIPIIFFWGLLAVAT

SEQ ID NO: 345373 - protein, 17 aa, Mycobacterium
RVLAAIARRAADGATVI

SEQ ID NO: 345374 - protein, 25 aa, Mycobacterium
RVLEMPDRFPGWVAVVGYGVQSAGL

SEQ ID NO: 345375 - protein, 20 aa, Mycobacterium
RVLFDWRFDLLFGTAAIVGA

SEQ ID NO: 345376 - protein, 18 aa, Mycobacterium
RVLIAFALVAVLLLLLGP

SEQ ID NO: 345377 - protein, 21 aa, Mycobacterium
RVLISRLFLRTSIGELFTTAG

SEQ ID NO: 345378 - protein, 19 aa, Mycobacterium
RVLLIGLGVIVAWLLVATL

SEQ ID NO: 345379 - protein, 17 aa, Mycobacterium
RVLPALFPTKVRYGAMS

SEQ ID NO: 345380 - protein, 17 aa, Mycobacterium
RVLPLPRRLAGLLEAES

SEQ ID NO: 345381 - protein, 18 aa, Mycobacterium
RVLPLPRRLAGLLEAESG

SEQ ID NO: 345382 - protein, 17 aa, Mycobacterium
RVLPLPRRVAGLLEAES

SEQ ID NO: 345383 - protein, 21 aa, Mycobacterium
RVLRPVAIQALRRGVPENVTA

SEQ ID NO: 345384 - protein, 24 aa, Mycobacterium
RVLTCWLPVFAGWPVMRWLTKNEM

SEQ ID NO: 345385 - protein, 20 aa, Mycobacterium
RVLVEWRFDLIFGTAAVVMA

SEQ ID NO: 345386 - protein, 17 aa, Mycobacterium
RVLVKFTVDKHIRLGDH

SEQ ID NO: 345387 - protein, 18 aa, Mycobacterium
RVNPNVYIPWSITVTPIS

SEQ ID NO: 345388 - protein, 23 aa, Mycobacterium
RVPDLRGASLLAIALGLLTLGLI

SEQ ID NO: 345389 - protein, 22 aa, Mycobacterium
RVPRPWLGMLRRDLIPTGYALA

SEQ ID NO: 345390 - protein, 19 aa, Mycobacterium
RVRFFRRKWTAITLASTAA

SEQ ID NO: 345391 - protein, 19 aa, Mycobacterium
RVRGYLRTGAFTVVTIFAV

SEQ ID NO: 345392 - protein, 17 aa, Mycobacterium
RVRPRPASQMLRPYGPR

SEQ ID NO: 345393 - protein, 17 aa, Mycobacterium
RVRPRPASYMLRPFGPR

SEQ ID NO: 345394 - protein, 17 aa, Mycobacterium
RVRQRPASSMLRPSGPR

SEQ ID NO: 345395 - protein, 22 aa, Mycobacterium
RVRRYLTIMAFRIPALIGAAWA

SEQ ID NO: 345396 - protein, 23 aa, Mycobacterium
RVRVRLKPMYARSIPATVTARVV

SEQ ID NO: 345397 - protein, 18 aa, Mycobacterium
RVSRLQALLVEWTLLSLL

SEQ ID NO: 345398 - protein, 19 aa, Mycobacterium
RVSWPRGGGGPAYGEEMPP

SEQ ID NO: 345399 - protein, 19 aa, Mycobacterium
RVSYFYDFRGPSVAIDTAC

SEQ ID NO: 345400 - protein, 19 aa, Mycobacterium
RVSYFYDFRGPSVALDTAC

SEQ ID NO: 345401 - protein, 18 aa, Mycobacterium
RVTDLGWFRALACFKSAA

SEQ ID NO: 345402 - protein, 20 aa, Mycobacterium
RVTRWEWMWAALLAGAVAVI

SEQ ID NO: 345403 - protein, 23 aa, Mycobacterium
RVTRWEWTWAVLLAVSLAVVVIV

SEQ ID NO: 345404 - protein, 20 aa, Mycobacterium
RVTVELPEAGGLYPRSNVTY

SEQ ID NO: 345405 - protein, 17 aa, Mycobacterium
RVVAVSFPRDLAITPMK

SEQ ID NO: 345406 - protein, 18 aa, Mycobacterium
RVVLRWSWTPLLVLGSVA

SEQ ID NO: 345407 - protein, 17 aa, Mycobacterium
RVWAFPWIMFVLAAGLA

SEQ ID NO: 345408 - protein, 18 aa, Mycobacterium
RWAFTPPRTWLMGVVANV

SEQ ID NO: 345409 - protein, 20 aa, Mycobacterium
RWAGIVWAYALFWFLIEDRV

SEQ ID NO: 345410 - protein, 21 aa, Mycobacterium
RWARLRTLMVISGPGLIVMVG

SEQ ID NO: 345411 - protein, 17 aa, Mycobacterium
RWEIVRFLSPLAVLLIW

SEQ ID NO: 345412 - protein, 18 aa, Mycobacterium
RWFFWAAFAVATLLIAGV

SEQ ID NO: 345413 - protein, 19 aa, Mycobacterium
RWLGVPLYILLGWVAAWFI

SEQ ID NO: 345414 - protein, 19 aa, Mycobacterium
RWLGVPLYILLGWVAVWFI

SEQ ID NO: 345415 - protein, 18 aa, Mycobacterium
RWLPATTGSHGWLAKVRA

SEQ ID NO: 345416 - protein, 19 aa, Mycobacterium
RWLPEAGDGSGLLSRVRAD

SEQ ID NO: 345417 - protein, 22 aa, Mycobacterium
RWLRVLAIPVVLFWVIAAAVLN

SEQ ID NO: 345418 - protein, 19 aa, Mycobacterium
RWNSIVALVLSVLVILGLV

SEQ ID NO: 345419 - protein, 20 aa, Mycobacterium
RWNSIVALVLSVLVILGLVV

SEQ ID NO: 345420 - protein, 22 aa, Mycobacterium
RWPMAGGVYQWSRRLLGSAYGW

SEQ ID NO: 345421 - protein, 19 aa, Mycobacterium
RWQRLRTLMVISGPGLIVM

SEQ ID NO: 345422 - protein, 20 aa, Mycobacterium
RWRFEILRLGAWFIIFQVTF

SEQ ID NO: 345423 - protein, 18 aa, Mycobacterium
RWRGLRALVGIVIAFGVL

SEQ ID NO: 345424 - protein, 18 aa, Mycobacterium
RWRHLPAILMVCSLVLFT

SEQ ID NO: 345425 - protein, 22 aa, Mycobacterium
RWRLSDEMALFFGTAVVVILVI

SEQ ID NO: 345426 - protein, 24 aa, Mycobacterium
RWRRVGTAIVRWPGPILAATVAVA

SEQ ID NO: 345427 - protein, 23 aa, Mycobacterium
RWRRVGTAIVRWPGPVLAATCVI

SEQ ID NO: 345428 - protein, 19 aa, Mycobacterium
RWVGVPLYLLLGWVAVWYT

SEQ ID NO: 345429 - protein, 27 aa, Mycobacterium
RYAEFPFRFDGEWLWTWQFEDLGPALI

SEQ ID NO: 345430 - protein, 22 aa, Mycobacterium
RYGGGWKRARFQVPLVIGYTAL

SEQ ID NO: 345431 - protein, 20 aa, Mycobacterium
RYGPMSVRLLFLVFGVGLIA

SEQ ID NO: 345432 - protein, 17 aa, Mycobacterium
RYLLACWVLAFVISLPI

SEQ ID NO: 345433 - protein, 18 aa, Mycobacterium
RYLTTMMLMWGLGSIPLV

SEQ ID NO: 345434 - protein, 17 aa, Mycobacterium
RYPLKGIFHAAGVLDDA

SEQ ID NO: 345435 - protein, 19 aa, Mycobacterium
RYQRLMFWVVGVVFLLLMV

SEQ ID NO: 345436 - protein, 22 aa, Mycobacterium
RYRARFPWFDHIMRMQERYGKV

SEQ ID NO: 345437 - protein, 19 aa, Mycobacterium
RYRLCMIVGVQPLRAAPIF

SEQ ID NO: 345438 - protein, 24 aa, Mycobacterium
SAAASFRVPVKWETNRGVRTAETS

SEQ ID NO: 345439 - protein, 19 aa, Mycobacterium
SAAIGAAFDWLSVDPPPNP

SEQ ID NO: 345440 - protein, 23 aa, Mycobacterium
SAARVPFYIGVGVVTVLLAGVLG

SEQ ID NO: 345441 - protein, 25 aa, Mycobacterium
SADLDWRSVWDRGWSAAAEAQDTPV

SEQ ID NO: 345442 - protein, 20 aa, Mycobacterium
SADWGHAVVLVFVDQTTVIG

SEQ ID NO: 345443 - protein, 20 aa, Mycobacterium
SAEVGANCQYPATPEPAAKQ

SEQ ID NO: 345444 - protein, 25 aa, Mycobacterium
SAFFTPRFVNWFGLFTTHLIVAIAL

SEQ ID NO: 345445 - protein, 25 aa, Mycobacterium
SAFFTPRFVNWFGLFTTHVIIAVAL

SEQ ID NO: 345446 - protein, 20 aa, Mycobacterium
SAFLQWGWRVPFLLSALLIA

SEQ ID NO: 345447 - protein, 22 aa, Mycobacterium
SAFMHWGWRIPFLLSAVLVVIA

SEQ ID NO: 345448 - protein, 22 aa, Mycobacterium
SAFRLKTRLLFMPGVMVTSVPW

SEQ ID NO: 345449 - protein, 18 aa, Mycobacterium
SAGLPAYQFPDPNGTRFP

SEQ ID NO: 345450 - protein, 18 aa, Mycobacterium
SAGLWTWLTDAAVIGGLL

SEQ ID NO: 345451 - protein, 21 aa, Mycobacterium
SAGWLRLGVLTALIATALALV

SEQ ID NO: 345452 - protein, 18 aa, Mycobacterium
SAIPRQALVPGFWGNVVH

SEQ ID NO: 345453 - protein, 17 aa, Mycobacterium
SALASWLPPGPAPVADY

SEQ ID NO: 345454 - protein, 17 aa, Mycobacterium
SALASWLPPGPVPVADY

SEQ ID NO: 345455 - protein, 19 aa, Mycobacterium
SALCFVCAGVLLYVDIGRR

SEQ ID NO: 345456 - protein, 18 aa, Mycobacterium
SALCFVGAAVLLYVDIDR

SEQ ID NO: 345457 - protein, 18 aa, Mycobacterium
SALCFVGAAVLLYVDLDR

SEQ ID NO: 345458 - protein, 18 aa, Mycobacterium
SALCFVGAVVLLYVDIDR

SEQ ID NO: 345459 - protein, 18 aa, Mycobacterium
SALCFVSAVVLLYVDIDR

SEQ ID NO: 345460 - protein, 18 aa, Mycobacterium
SALERLRDFAVFKAIGTP

SEQ ID NO: 345461 - protein, 18 aa, Mycobacterium
SALGRWAGFSVAWLYWYF

SEQ ID NO: 345462 - protein, 18 aa, Mycobacterium
SALILGRSVDNWVRRMLA

SEQ ID NO: 345463 - protein, 20 aa, Mycobacterium
SALLCPLLVYGWLGLPRLGL

SEQ ID NO: 345464 - protein, 17 aa, Mycobacterium
SALLSVALFFIWMIAVA

SEQ ID NO: 345465 - protein, 17 aa, Mycobacterium
SALPICGTALFVAAVAL

SEQ ID NO: 345466 - protein, 18 aa, Mycobacterium
SALPRWLWTRGSALVSAM

SEQ ID NO: 345467 - protein, 25 aa, Mycobacterium
SALRLKGRLLFMPGVMVTSVPWQLS

SEQ ID NO: 345468 - protein, 23 aa, Mycobacterium
SALRLKGRLLFMPNVMVTSVPWQ

SEQ ID NO: 345469 - protein, 17 aa, Mycobacterium
SALRPGSLEALLPPEQR

SEQ ID NO: 345470 - protein, 17 aa, Mycobacterium
SALRWAVATIFGLSIAG

SEQ ID NO: 345471 - protein, 18 aa, Mycobacterium
SALWTLAGGRRMWERRPG

SEQ ID NO: 345472 - protein, 17 aa, Mycobacterium
SAMLIYRLISWLLISAI

SEQ ID NO: 345473 - protein, 17 aa, Mycobacterium
SAPGFSFVSEDLDRVRS

SEQ ID NO: 345474 - protein, 20 aa, Mycobacterium
SAPMLEFWGLTSSQQLTVPV

SEQ ID NO: 345475 - protein, 24 aa, Mycobacterium
SAPPRPRLPWFLRTFAVPIILAWV

SEQ ID NO: 345476 - protein, 19 aa, Mycobacterium
SAPRWGRYPIRARVDVVAR

SEQ ID NO: 345477 - protein, 19 aa, Mycobacterium
SAPVPFILAEAAAMPPPVE

SEQ ID NO: 345478 - protein, 20 aa, Mycobacterium
SAQIEALVPGGGWQGSAAQA

SEQ ID NO: 345479 - protein, 23 aa, Mycobacterium
SARARWAVALVCAMLVAVAATCS

SEQ ID NO: 345480 - protein, 24 aa, Mycobacterium
SARKVLEPRGWRIWRVWPDTTTLL

SEQ ID NO: 345481 - protein, 20 aa, Mycobacterium
SARMSWRAVIAVVALLVGAF

SEQ ID NO: 345482 - protein, 20 aa, Mycobacterium
SARPNHRWLDVVAVAVVAAL

SEQ ID NO: 345483 - protein, 20 aa, Mycobacterium
SARTRAALCAQADRLHQLLV

SEQ ID NO: 345484 - protein, 24 aa, Mycobacterium
SASIPWKPVLGALAFGAVLVGAFM

SEQ ID NO: 345485 - protein, 17 aa, Mycobacterium
SASLGTWAVVAVVLGPV

SEQ ID NO: 345486 - protein, 22 aa, Mycobacterium
SATNCARTALLLVEPTTATMAV

SEQ ID NO: 345487 - protein, 20 aa, Mycobacterium
SAVAFLLAWATFRIGDRVRP

SEQ ID NO: 345488 - protein, 21 aa, Mycobacterium
SAVAIGVFWWLKRELGDHTRQ

SEQ ID NO: 345489 - protein, 19 aa, Mycobacterium
SAVCKAWLLAVPFLVSTAL

SEQ ID NO: 345490 - protein, 19 aa, Mycobacterium
SAVNWFWLLAFAIAAIIWA

SEQ ID NO: 345491 - protein, 18 aa, Mycobacterium
SAVPPNWTVFSDDQDPNL

SEQ ID NO: 345492 - protein, 17 aa, Mycobacterium
SAVPRGWARARKTIVSG

SEQ ID NO: 345493 - protein, 20 aa, Mycobacterium
SAVQAPWPLLRTFASGPALS

SEQ ID NO: 345494 - protein, 17 aa, Mycobacterium
SAVRELSQTAGRLGDSR

SEQ ID NO: 345495 - protein, 19 aa, Mycobacterium
SAVWWKALLALAVAVALTV

SEQ ID NO: 345496 - protein, 18 aa, Mycobacterium
SAVWWKALLALAVSVCMI

SEQ ID NO: 345497 - protein, 17 aa, Mycobacterium
SAVWWKVTLPLLMPGLV

SEQ ID NO: 345498 - protein, 17 aa, Mycobacterium
SCAAVLCDLVNYRLGYR

SEQ ID NO: 345499 - protein, 22 aa, Mycobacterium
SCLPIAVAITACFGLILGTPTL

SEQ ID NO: 345500 - protein, 19 aa, Mycobacterium
SCTVGFLPPSAWRSPADES

SEQ ID NO: 345501 - protein, 24 aa, Mycobacterium
SDETKLPFCWRGVSLHAGGAGRVR

SEQ ID NO: 345502 - protein, 21 aa, Mycobacterium
SDGDWRITQMPALTQLDLSPQ

SEQ ID NO: 345503 - protein, 22 aa, Mycobacterium
SDGHSAMAMVWLVGQAGSTQAR

SEQ ID NO: 345504 - protein, 19 aa, Mycobacterium
SDGTWGWYVVHSRRTEDGL

SEQ ID NO: 345505 - protein, 17 aa, Mycobacterium
SDLIGWRGILLLTGASG

SEQ ID NO: 345506 - protein, 18 aa, Mycobacterium
SDLRELPAALQLMNMPEA

SEQ ID NO: 345507 - protein, 28 aa, Mycobacterium
SDLWRMMPYLLPYRGRWIVMIVVALASL

SEQ ID NO: 345508 - protein, 22 aa, Mycobacterium
SDNVLRAWPGLFGVAVPVLEVA

SEQ ID NO: 345509 - protein, 25 aa, Mycobacterium
SDPHRAHWEWLKWLPHNQHPGDSDA

SEQ ID NO: 345510 - protein, 23 aa, Mycobacterium
SDPRFKPYLKMMFSEDGTTTRMI

SEQ ID NO: 345511 - protein, 25 aa, Mycobacterium
SDPVMLDWLVGLAFPCQRPFDHRYG

SEQ ID NO: 345512 - protein, 22 aa, Mycobacterium
SDRLGRRVPFLVGGVGMAVWAF

SEQ ID NO: 345513 - protein, 22 aa, Mycobacterium
SDSIKRWLVRRFNKDDKASAQA

SEQ ID NO: 345514 - protein, 21 aa, Mycobacterium
SDTFFREVWDPELATAKGRVN

SEQ ID NO: 345515 - protein, 24 aa, Mycobacterium
SDTVPGRYLPPVPHEPDPVALPVT

SEQ ID NO: 345516 - protein, 18 aa, Mycobacterium
SDVLRPAADVGLTIAPDR

SEQ ID NO: 345517 - protein, 20 aa, Mycobacterium
SEAYPSVWGLLSGAGESLLV

SEQ ID NO: 345518 - protein, 21 aa, Mycobacterium
SEEKTRPSVVLALSGLVAVLV

SEQ ID NO: 345519 - protein, 17 aa, Mycobacterium
SEFAVSLALVLLMLPVI

SEQ ID NO: 345520 - protein, 17 aa, Mycobacterium
SEFPGELGVLFKNLETK

SEQ ID NO: 345521 - protein, 20 aa, Mycobacterium
SEGAFAFGVFMLAMTVGRFT

SEQ ID NO: 345522 - protein, 17 aa, Mycobacterium
SEIKRFGRSRMTRAAIV

SEQ ID NO: 345523 - protein, 20 aa, Mycobacterium
SEIPAIISLIFSSAFGLDSA

SEQ ID NO: 345524 - protein, 17 aa, Mycobacterium
SEISIAVPAHWKPSTVQ

SEQ ID NO: 345525 - protein, 22 aa, Mycobacterium
SELHPGSAVVLVFVDQSTTTKD

SEQ ID NO: 345526 - protein, 21 aa, Mycobacterium
SELMFFAGLFAFYFTARAQSG

SEQ ID NO: 345527 - protein, 18 aa, Mycobacterium
SELRRLPVDFGIGISAGP

SEQ ID NO: 345528 - protein, 17 aa, Mycobacterium
SELSWGVVGAWTGSAAA

SEQ ID NO: 345529 - protein, 17 aa, Mycobacterium
SELWGWRQAVVAVAIAA

SEQ ID NO: 345530 - protein, 20 aa, Mycobacterium
SELWMWVQEALLVFQEIMTA

SEQ ID NO: 345531 - protein, 17 aa, Mycobacterium
SEPRLQPPNGYKDTTVP

SEQ ID NO: 345532 - protein, 25 aa, Mycobacterium
SEQRSGSGWIWWFGGAWLVAAVVGA

SEQ ID NO: 345533 - protein, 17 aa, Mycobacterium
SERARWSLGESVTLRGL

SEQ ID NO: 345534 - protein, 19 aa, Mycobacterium
SERQYPFLVMELIEGGTLR

SEQ ID NO: 345535 - protein, 23 aa, Mycobacterium
SERRDALRWVWLGVSCAIAVTVT

SEQ ID NO: 345536 - protein, 17 aa, Mycobacterium
SETFWLLAIWALFQAGI

SEQ ID NO: 345537 - protein, 26 aa, Mycobacterium
SEVARFGVQMLFDLLQLVVAYVVLLA

SEQ ID NO: 345538 - protein, 19 aa, Mycobacterium
SEWDWRAIFWVGVPVGILG

SEQ ID NO: 345539 - protein, 19 aa, Mycobacterium
SFAQARLWFLDQLQGPSPV

SEQ ID NO: 345540 - protein, 19 aa, Mycobacterium
SFPARIGLMTGIYTAALQG

SEQ ID NO: 345541 - protein, 20 aa, Mycobacterium
SFPARIGMMTGIYTAALQGG

SEQ ID NO: 345542 - protein, 23 aa, Mycobacterium
SFPELRNHLGLAYGFYALCAVLS

SEQ ID NO: 345543 - protein, 22 aa, Mycobacterium
SFPEMRKPAVAINIYRGDTGLD

SEQ ID NO: 345544 - protein, 23 aa, Mycobacterium
SFPVVAYRSWRWWLGATLGSMAV

SEQ ID NO: 345545 - protein, 19 aa, Mycobacterium
SFQRARDALRLAGITASDR

SEQ ID NO: 345546 - protein, 17 aa, Mycobacterium
SFQRARESLTLAGITPS

SEQ ID NO: 345547 - protein, 28 aa, Mycobacterium
SFRELRWNLRIVIMFSIGLVIATAVAVS

SEQ ID NO: 345548 - protein, 24 aa, Mycobacterium
SFTRFTLLMALPWVGVVVTLYAVF

SEQ ID NO: 345549 - protein, 20 aa, Mycobacterium
SFVLQEFVHFVLPKLMKGYG

SEQ ID NO: 345550 - protein, 25 aa, Mycobacterium
SFVTWGWRVPFLFGIALSVVGLFIR

SEQ ID NO: 345551 - protein, 22 aa, Mycobacterium
SFYWGHHFGRLFAHPDSEQLLL

SEQ ID NO: 345552 - protein, 25 aa, Mycobacterium
SGACLRIPYTLGIATFGGRNWTTFS

SEQ ID NO: 345553 - protein, 18 aa, Mycobacterium
SGASRFFINLSFAAFRKS

SEQ ID NO: 345554 - protein, 19 aa, Mycobacterium
SGCLRVRASLTISPDDLVS

SEQ ID NO: 345555 - protein, 17 aa, Mycobacterium
SGCPACRQAVAELSGVP

SEQ ID NO: 345556 - protein, 17 aa, Mycobacterium
SGDRLDPGLARRFMDTY

SEQ ID NO: 345557 - protein, 21 aa, Mycobacterium
SGESQWSLSLGVGQMLVAVLA

SEQ ID NO: 345558 - protein, 22 aa, Mycobacterium
SGGALWRFAALMFLSSMVASIG

SEQ ID NO: 345559 - protein, 17 aa, Mycobacterium
SGGPNCRGLPDVPSKQY

SEQ ID NO: 345560 - protein, 23 aa, Mycobacterium
SGGSPLIKWMFWTGLLITALDVL

SEQ ID NO: 345561 - protein, 18 aa, Mycobacterium
SGHGWWWAVALGVLGLGL

SEQ ID NO: 345562 - protein, 17 aa, Mycobacterium
SGHRVVTGLARIYISVI

SEQ ID NO: 345563 - protein, 24 aa, Mycobacterium
SGIFPRWFPSSLRRQLLLGVLAVV

SEQ ID NO: 345564 - protein, 17 aa, Mycobacterium
SGIGKWGTLPTWTDLAA

SEQ ID NO: 345565 - protein, 17 aa, Mycobacterium
SGLALAGVSAWLITRAW

SEQ ID NO: 345566 - protein, 20 aa, Mycobacterium
SGLAVPRPLPAVIADASSHT

SEQ ID NO: 345567 - protein, 23 aa, Mycobacterium
SGLPRALVPLALSLYGIGMVTGN

SEQ ID NO: 345568 - protein, 19 aa, Mycobacterium
SGLRAGWRKVSGISSGRSG

SEQ ID NO: 345569 - protein, 17 aa, Mycobacterium
SGLVAGWNRVGIQVAFY

SEQ ID NO: 345570 - protein, 19 aa, Mycobacterium
SGMDLGPWLVSRDVTVVST

SEQ ID NO: 345571 - protein, 19 aa, Mycobacterium
SGPFAWNGVVGFWIPAILF

SEQ ID NO: 345572 - protein, 24 aa, Mycobacterium
SGPGIWKWIAIGLLALGIIGALLG

SEQ ID NO: 345573 - protein, 17 aa, Mycobacterium
SGPRTKLFATLFLILVL

SEQ ID NO: 345574 - protein, 25 aa, Mycobacterium
SGRRFLLRRVECALLGGDIHTLSAR

SEQ ID NO: 345575 - protein, 20 aa, Mycobacterium
SGSILSWFSPIAWAQQMRPF

SEQ ID NO: 345576 - protein, 18 aa, Mycobacterium
SGSIWPAVMVHIAYNSAG

SEQ ID NO: 345577 - protein, 19 aa, Mycobacterium
SGSLTSVWLLLGLLAISAV

SEQ ID NO: 345578 - protein, 18 aa, Mycobacterium
SGTPEYGSWILGRVTESQ

SEQ ID NO: 345579 - protein, 19 aa, Mycobacterium
SGTVPLFFILWALSNFVGP

SEQ ID NO: 345580 - protein, 18 aa, Mycobacterium
SGVAGFWASMRVFAVLAV

SEQ ID NO: 345581 - protein, 25 aa, Mycobacterium
SGVLTYEFWLKVGIVALGSRFVLGD

SEQ ID NO: 345582 - protein, 17 aa, Mycobacterium
SGWRSGALGSLLSFVGV

SEQ ID NO: 345583 - protein, 26 aa, Mycobacterium
SHANKFGWHSWWWLAAIPVLVLLVVV

SEQ ID NO: 345584 - protein, 17 aa, Mycobacterium
SHGGGWGHHGGWHRSWD

SEQ ID NO: 345585 - protein, 28 aa, Mycobacterium
SHRRLLLRITRWDVVLAMAVAGTVNAAM

SEQ ID NO: 345586 - protein, 24 aa, Mycobacterium
SHRSRIPFRIAMVVLVAGLVVCAY

SEQ ID NO: 345587 - protein, 23 aa, Mycobacterium
SHRWVLLKGRLVAGIASAFVMAI

SEQ ID NO: 345588 - protein, 26 aa, Mycobacterium
SHSDLDWLWWFGAGWVAVAIVGAGVI

SEQ ID NO: 345589 - protein, 23 aa, Mycobacterium
SHSPRLVNMYGITETCVHVSHRA

SEQ ID NO: 345590 - protein, 20 aa, Mycobacterium
SHVFTEFRWLSVALLAGGLA

SEQ ID NO: 345591 - protein, 23 aa, Mycobacterium
SHWDVAFIRRFMLIFGPISSLFD

SEQ ID NO: 345592 - protein, 18 aa, Mycobacterium
SIAACVWLMLNLTALTWV

SEQ ID NO: 345593 - protein, 21 aa, Mycobacterium
SIAALLGRWFWWPINVRTRPA

SEQ ID NO: 345594 - protein, 24 aa, Mycobacterium
SIAALLGRWFWWPIRVRPRPASEM

SEQ ID NO: 345595 - protein, 25 aa, Mycobacterium
SIAALLGRWFWWPQIVRSRPASQLL

SEQ ID NO: 345596 - protein, 23 aa, Mycobacterium
SIAALLGRWFWWPQKIRTRPVPV

SEQ ID NO: 345597 - protein, 24 aa, Mycobacterium
SIAALLGRWFWWPQRVRPRPASRM

SEQ ID NO: 345598 - protein, 23 aa, Mycobacterium
SIATLLGRWFWWPLVVRSRPLRP

SEQ ID NO: 345599 - protein, 24 aa, Mycobacterium
SIATLLGRWFWWPMRVPCRAFRET

SEQ ID NO: 345600 - protein, 24 aa, Mycobacterium
SIATLLGRWFWWPQVVHPRGHNAR

SEQ ID NO: 345601 - protein, 25 aa, Mycobacterium
SIATLLGRWFWWPQVVYPRGDNHFR

SEQ ID NO: 345602 - protein, 23 aa, Mycobacterium
SIAVLLGRWFWWPHHVRPRPIPQ

SEQ ID NO: 345603 - protein, 25 aa, Mycobacterium
SICDMAVPRFCRLVFVIGLLLSVTM

SEQ ID NO: 345604 - protein, 23 aa, Mycobacterium
SIDRPECWGSIAAGSPDAYTPGS

SEQ ID NO: 345605 - protein, 17 aa, Mycobacterium
SIGSFLCGLSWGYWSLF

SEQ ID NO: 345606 - protein, 18 aa, Mycobacterium
SIHPPRFLVGLSQQNHTF

SEQ ID NO: 345607 - protein, 17 aa, Mycobacterium
SIIACVWLMLNLTGLTW

SEQ ID NO: 345608 - protein, 26 aa, Mycobacterium
SIPARWRPAWIGWWLGIAVAATVDAD

SEQ ID NO: 345609 - protein, 23 aa, Mycobacterium
SIPLLTARLAERFQVPVHTAPQP

SEQ ID NO: 345610 - protein, 18 aa, Mycobacterium
SIQLPAWLSRTGADVLKA

SEQ ID NO: 345611 - protein, 19 aa, Mycobacterium
SIRSSNTLVRWVQNALSFI

SEQ ID NO: 345612 - protein, 21 aa, Mycobacterium
SISIPSWWQPYVLSVASLTPD

SEQ ID NO: 345613 - protein, 18 aa, Mycobacterium
SIYAEYRLSTSVRKAAHL

SEQ ID NO: 345614 - protein, 25 aa, Mycobacterium
SIYKMPGGVSMCWAVLAFFAFVIWT

SEQ ID NO: 345615 - protein, 20 aa, Mycobacterium
SKFTTSMLWSGDRAWRQAGE

SEQ ID NO: 345616 - protein, 23 aa, Mycobacterium
SKIVLRYRIPIGLAAVALLLLLG

SEQ ID NO: 345617 - protein, 18 aa, Mycobacterium
SKRKGRRVNVARWAAALI

SEQ ID NO: 345618 - protein, 22 aa, Mycobacterium
SKSYFPGIVEAFGWGLGTLAAS

SEQ ID NO: 345619 - protein, 21 aa, Mycobacterium
SLAGMLCCLPGLAGLVLGILG

SEQ ID NO: 345620 - protein, 18 aa, Mycobacterium
SLAGYAFARLEFRGRDTL

SEQ ID NO: 345621 - protein, 21 aa, Mycobacterium
SLCIALGVWVTRIFGDVGPLD

SEQ ID NO: 345622 - protein, 23 aa, Mycobacterium
SLCKALGYLLWWAVLFPAVSIPI

SEQ ID NO: 345623 - protein, 17 aa, Mycobacterium
SLGRRKPLFAGIVLHMV

SEQ ID NO: 345624 - protein, 19 aa, Mycobacterium
SLHKYLGLVGPVGFSTVLS

SEQ ID NO: 345625 - protein, 18 aa, Mycobacterium
SLHWKIGEAPVFYGGYAV

SEQ ID NO: 345626 - protein, 23 aa, Mycobacterium
SLHWKVSEAPLFYGGYAVLLAVS

SEQ ID NO: 345627 - protein, 19 aa, Mycobacterium
SLICAFSVAILDPFLDVGG

SEQ ID NO: 345628 - protein, 19 aa, Mycobacterium
SLIHMCLFLGALTFMYISA

SEQ ID NO: 345629 - protein, 22 aa, Mycobacterium
SLLGWGGFLLMWVLQAAVFWNG

SEQ ID NO: 345630 - protein, 19 aa, Mycobacterium
SLLLCLAVALGADALGSSA

SEQ ID NO: 345631 - protein, 19 aa, Mycobacterium
SLLLFLLFWQWRTMPAVIW

SEQ ID NO: 345632 - protein, 19 aa, Mycobacterium
SLLPAILVLIGRRGWIKPR

SEQ ID NO: 345633 - protein, 18 aa, Mycobacterium
SLLPRDWLFAGLIGGVNA

SEQ ID NO: 345634 - protein, 20 aa, Mycobacterium
SLLRLGRLMTLVWAVLMAVF

SEQ ID NO: 345635 - protein, 17 aa, Mycobacterium
SLLRVVILLGVLYIFAT

SEQ ID NO: 345636 - protein, 18 aa, Mycobacterium
SLLVCNWIALFENHRARV

SEQ ID NO: 345637 - protein, 17 aa, Mycobacterium
SLLVGYGCLPWVATAML

SEQ ID NO: 345638 - protein, 20 aa, Mycobacterium
SLLYQWDELAGWLRAERQNL

SEQ ID NO: 345639 - protein, 18 aa, Mycobacterium
SLMPRTWLFQGLIGGATA

SEQ ID NO: 345640 - protein, 25 aa, Mycobacterium
SLNRGWCLIRTRWARRVARILPPAG

SEQ ID NO: 345641 - protein, 22 aa, Mycobacterium
SLPLCVLCVAAVGVGQGVGVIA

SEQ ID NO: 345642 - protein, 20 aa, Mycobacterium
SLPVLRWGWTPVLFAGSLVT

SEQ ID NO: 345643 - protein, 23 aa, Mycobacterium
SLPVLRWSWTPALLAGALATLMP

SEQ ID NO: 345644 - protein, 22 aa, Mycobacterium
SLPVQFGRDWFWLHAARTAAVT

SEQ ID NO: 345645 - protein, 17 aa, Mycobacterium
SLQPGIFAVHWYAGEQT

SEQ ID NO: 345646 - protein, 18 aa, Mycobacterium
SLQRLKVPLGNRMDNNEL

SEQ ID NO: 345647 - protein, 17 aa, Mycobacterium
SLRLRLLVGQIVVLAIV

SEQ ID NO: 345648 - protein, 22 aa, Mycobacterium
SLRLWERHGLLAPSRTEGGTRR

SEQ ID NO: 345649 - protein, 25 aa, Mycobacterium
SLRRWRPRYAYAFGFIDQAARLASA

SEQ ID NO: 345650 - protein, 17 aa, Mycobacterium
SLSIPAFLWGIRYARAR

SEQ ID NO: 345651 - protein, 17 aa, Mycobacterium
SLTPSLLPRDWLFAGLI

SEQ ID NO: 345652 - protein, 17 aa, Mycobacterium
SLTPSLLPRDWLFQGLI

SEQ ID NO: 345653 - protein, 19 aa, Mycobacterium
SLTRLNYFNSLGIPAGIGL

SEQ ID NO: 345654 - protein, 24 aa, Mycobacterium
SLTVLRWSWTPALLAGGLMTLMPL

SEQ ID NO: 345655 - protein, 17 aa, Mycobacterium
SLVPTLLVAIPFTVLVA

SEQ ID NO: 345656 - protein, 17 aa, Mycobacterium
SLVPTLLVSIPFTVLVA

SEQ ID NO: 345657 - protein, 23 aa, Mycobacterium
SLVRLFGTWFWWPTRVFARPLRR

SEQ ID NO: 345658 - protein, 18 aa, Mycobacterium
SLVRSGMDLGPWLVSRDV

SEQ ID NO: 345659 - protein, 17 aa, Mycobacterium
SLVTFSVVVSWWAAALG

SEQ ID NO: 345660 - protein, 17 aa, Mycobacterium
SLVVHWGTMHDLFAITD

SEQ ID NO: 345661 - protein, 17 aa, Mycobacterium
SLWGLFAVLTKGVVDQL

SEQ ID NO: 345662 - protein, 20 aa, Mycobacterium
SLWYPDRAWWVLGIYTVAAA

SEQ ID NO: 345663 - protein, 25 aa, Mycobacterium
SMFIPRFLFALSFCGLGVTTASYMF

SEQ ID NO: 345664 - protein, 21 aa, Mycobacterium
SMIFFWGWGRLTALMIFGSVR

SEQ ID NO: 345665 - protein, 24 aa, Mycobacterium
SMLFKLEIARGFLVIALPVGVVVL

SEQ ID NO: 345666 - protein, 22 aa, Mycobacterium
SMLGDLPWWVTVLILAREIGVT

SEQ ID NO: 345667 - protein, 24 aa, Mycobacterium
SMLGELPWWVTIVILVREFGVTVL

SEQ ID NO: 345668 - protein, 19 aa, Mycobacterium
SMRFMWGAFARKGLPEPSA

SEQ ID NO: 345669 - protein, 21 aa, Mycobacterium
SNPASCQWCQYLVARYHTSNV

SEQ ID NO: 345670 - protein, 22 aa, Mycobacterium
SNPDCQGALYAMQGPAYAGSGQ

SEQ ID NO: 345671 - protein, 21 aa, Mycobacterium
SNSFPEWKFGFTTMLLGLSVL

SEQ ID NO: 345672 - protein, 18 aa, Mycobacterium
SNTLVRWVQNALSFIGFV

SEQ ID NO: 345673 - protein, 22 aa, Mycobacterium
SNVLRYGYYPALIIGLTLGVMI

SEQ ID NO: 345674 - protein, 18 aa, Mycobacterium
SNWLPTFILLIVLSVVAA

SEQ ID NO: 345675 - protein, 18 aa, Mycobacterium
SNYTEVFALLPFGRMFFN

SEQ ID NO: 345676 - protein, 17 aa, Mycobacterium
SPAEWARHLLLPWTTLV

SEQ ID NO: 345677 - protein, 24 aa, Mycobacterium
SPAPRPAPKLKPVRVARRRPHRRL

SEQ ID NO: 345678 - protein, 17 aa, Mycobacterium
SPAVWLNPWRWYSVPRA

SEQ ID NO: 345679 - protein, 17 aa, Mycobacterium
SPCSIGLLAVILASLTL

SEQ ID NO: 345680 - protein, 25 aa, Mycobacterium
SPDLDWRSVWDRGWSAAAQAQDKPV

SEQ ID NO: 345681 - protein, 18 aa, Mycobacterium
SPDRVCALLSRIAAELPQ

SEQ ID NO: 345682 - protein, 25 aa, Mycobacterium
SPIGVRGARNFPCMGQPGKRAPTVE

SEQ ID NO: 345683 - protein, 17 aa, Mycobacterium
SPIGVRGTRNFPCMEQP

SEQ ID NO: 345684 - protein, 17 aa, Mycobacterium
SPLECVYYTAGIASIVL

SEQ ID NO: 345685 - protein, 17 aa, Mycobacterium
SPLGCWPGSSALPTVSV

SEQ ID NO: 345686 - protein, 20 aa, Mycobacterium
SPLRRILGLQTFWILGVLVL

SEQ ID NO: 345687 - protein, 25 aa, Mycobacterium
SPLTAAMSLMWGWRLAVVCVTVAAA

SEQ ID NO: 345688 - protein, 25 aa, Mycobacterium
SPLVRKAAAWSWRLLIIGGAIVALL

SEQ ID NO: 345689 - protein, 17 aa, Mycobacterium
SPPATRLGRAWLITVLG

SEQ ID NO: 345690 - protein, 24 aa, Mycobacterium
SPPPPRWAWKVLIPIGVVGQVLMA

SEQ ID NO: 345691 - protein, 23 aa, Mycobacterium
SPPRGVWHLGPLPIRAYALFIIT

SEQ ID NO: 345692 - protein, 17 aa, Mycobacterium
SPQIPRKYVVLVGVTTV

SEQ ID NO: 345693 - protein, 18 aa, Mycobacterium
SPREAGWHRAWLGGLLVG

SEQ ID NO: 345694 - protein, 19 aa, Mycobacterium
SPRHWWVWVACLIATDFCY

SEQ ID NO: 345695 - protein, 20 aa, Mycobacterium
SPRRLPIMMVRKFIDDLAAS

SEQ ID NO: 345696 - protein, 24 aa, Mycobacterium
SPRYLRFGWAAARFDDVLNYVPAR

SEQ ID NO: 345697 - protein, 23 aa, Mycobacterium
SPRYLRFGWAAARLDDLANYFGA

SEQ ID NO: 345698 - protein, 22 aa, Mycobacterium
SPRYLRFGWAAARLDDVANYAG

SEQ ID NO: 345699 - protein, 18 aa, Mycobacterium
SPVAWWRDPWRPPRILVG

SEQ ID NO: 345700 - protein, 19 aa, Mycobacterium
SPVPIPWSVLSLFASGPTL

SEQ ID NO: 345701 - protein, 24 aa, Mycobacterium
SPWAACKIFFSFLWAALRNAPSVW

SEQ ID NO: 345702 - protein, 17 aa, Mycobacterium
SPYEILTVASLVQRESK

SEQ ID NO: 345703 - protein, 18 aa, Mycobacterium
SPYLWRGAPDWPDTPRPP

SEQ ID NO: 345704 - protein, 29 aa, Mycobacterium
SQAALGRHARYVGRVGALAVALGIGLALG

SEQ ID NO: 345705 - protein, 21 aa, Mycobacterium
SQAELRYAQALQRPILPVQVG

SEQ ID NO: 345706 - protein, 23 aa, Mycobacterium
SQCHMLWYLALCAQAGIVVTAYR

SEQ ID NO: 345707 - protein, 24 aa, Mycobacterium
SQFSVRLLRTFLRDMPNQMVLAIF

SEQ ID NO: 345708 - protein, 23 aa, Mycobacterium
SQFSVRLLRTFLRDVPNQVVLAV

SEQ ID NO: 345709 - protein, 18 aa, Mycobacterium
SQGYGYGSGYGRGAYAGD

SEQ ID NO: 345710 - protein, 17 aa, Mycobacterium
SQLRPGIPAAFDAVIAR

SEQ ID NO: 345711 - protein, 18 aa, Mycobacterium
SQLWLSLLSWAVVIGLYL

SEQ ID NO: 345712 - protein, 27 aa, Mycobacterium
SQRRWRRIATYVVRWPGPVLAGSMAVL

SEQ ID NO: 345713 - protein, 24 aa, Mycobacterium
SQTDFPGDVPVRFEGDSYNEDGPC

SEQ ID NO: 345714 - protein, 18 aa, Mycobacterium
SQTLRPGAVLPLGQSTTP

SEQ ID NO: 345715 - protein, 21 aa, Mycobacterium
SQTRLATWVAEPGRTATPAGS

SEQ ID NO: 345716 - protein, 22 aa, Mycobacterium
SQTRLATWVAVPGHTATPVGAI

SEQ ID NO: 345717 - protein, 18 aa, Mycobacterium
SRAAVKFLLYNLFGGLIM

SEQ ID NO: 345718 - protein, 25 aa, Mycobacterium
SRFNYRIPVSLAWTRTSGPAKSDGT

SEQ ID NO: 345719 - protein, 17 aa, Mycobacterium
SRFYFLTGFGALLQLGL

SEQ ID NO: 345720 - protein, 17 aa, Mycobacterium
SRGEPFWTISGGLAGVI

SEQ ID NO: 345721 - protein, 21 aa, Mycobacterium
SRIGMVLQDTWLFAGTIYDNI

SEQ ID NO: 345722 - protein, 20 aa, Mycobacterium
SRIGMVLQDTWLFDGTIADN

SEQ ID NO: 345723 - protein, 21 aa, Mycobacterium
SRIGMVLQDTWLLAGTIAENI

SEQ ID NO: 345724 - protein, 17 aa, Mycobacterium
SRLGQVVAWVVIVAGVV

SEQ ID NO: 345725 - protein, 17 aa, Mycobacterium
SRLRRPGAVVLEIDDED

SEQ ID NO: 345726 - protein, 20 aa, Mycobacterium
SRLTEVLGRIYGHPVTVQLQ

SEQ ID NO: 345727 - protein, 18 aa, Mycobacterium
SRLYLVFLALLPFALGAL

SEQ ID NO: 345728 - protein, 19 aa, Mycobacterium
SRPGWRRLKHFNGFVTSLW

SEQ ID NO: 345729 - protein, 19 aa, Mycobacterium
SRPRVVAVHILRNSLIPVV

SEQ ID NO: 345730 - protein, 20 aa, Mycobacterium
SRPRWLSALRQLTFGAIAIG

SEQ ID NO: 345731 - protein, 19 aa, Mycobacterium
SRPTVWRGIGLRMAENGGS

SEQ ID NO: 345732 - protein, 18 aa, Mycobacterium
SRPWWRRKAVAISAAALL

SEQ ID NO: 345733 - protein, 19 aa, Mycobacterium
SRQALKIQRWRSKVRNHTV

SEQ ID NO: 345734 - protein, 20 aa, Mycobacterium
SRRIRWPAVAIGVAGVAVIL

SEQ ID NO: 345735 - protein, 19 aa, Mycobacterium
SRSLCPRCVPRSSISQHRR

SEQ ID NO: 345736 - protein, 23 aa, Mycobacterium
SRSRDARFGRWWHGGQPVRAAGV

SEQ ID NO: 345737 - protein, 19 aa, Mycobacterium
SRSRTAWVLGTACLSMAKI

SEQ ID NO: 345738 - protein, 19 aa, Mycobacterium
SRSRWRAMCEDLVDAVLAL

SEQ ID NO: 345739 - protein, 21 aa, Mycobacterium
SRTRLWLPYLPLLVAAAVGLG

SEQ ID NO: 345740 - protein, 19 aa, Mycobacterium
SRVFLPFGLDPSRTPVMGS

SEQ ID NO: 345741 - protein, 22 aa, Mycobacterium
SRVSQLPNIIAIRGLTRPNGEP

SEQ ID NO: 345742 - protein, 20 aa, Mycobacterium
SRWPGSLGWFTNRLLVPAVL

SEQ ID NO: 345743 - protein, 20 aa, Mycobacterium
SRWTWSSAPPIWVAAVAPRQ

SEQ ID NO: 345744 - protein, 17 aa, Mycobacterium
SRWWSLSGLDALVVAVL

SEQ ID NO: 345745 - protein, 19 aa, Mycobacterium
SSAPPWPAYAPHGAAAPVN

SEQ ID NO: 345746 - protein, 28 aa, Mycobacterium
SSEIAIAVPAYWKPGTVQALRNALRTHV

SEQ ID NO: 345747 - protein, 21 aa, Mycobacterium
SSFIKRMFTEFGIDVPESLQI

SEQ ID NO: 345748 - protein, 23 aa, Mycobacterium
SSFNCARPGPLQWAFNVPGDVVP

SEQ ID NO: 345749 - protein, 21 aa, Mycobacterium
SSGWLRLGVLAALIATALALL

SEQ ID NO: 345750 - protein, 23 aa, Mycobacterium
SSIVEWKLRPGVVSTMNAQARYT

SEQ ID NO: 345751 - protein, 24 aa, Mycobacterium
SSQFGVSIPDFWMGILLIALFSTV

SEQ ID NO: 345752 - protein, 25 aa, Mycobacterium
SSRDELWLGLPAWRWMFLAMALPAL

SEQ ID NO: 345753 - protein, 27 aa, Mycobacterium
SSRGWRRIGVSVVRWPGPVLAATLALA

SEQ ID NO: 345754 - protein, 24 aa, Mycobacterium
SSRPARGSYTFGLKRAEILSAQAN

SEQ ID NO: 345755 - protein, 19 aa, Mycobacterium
SSSKPIWPLVAIGVIVVVV

SEQ ID NO: 345756 - protein, 26 aa, Mycobacterium
SSSRRRVRGLTRMRLGAAVVGAAAAA

SEQ ID NO: 345757 - protein, 22 aa, Mycobacterium
SSTTWRCSFEFDEPNPVQNGQK

SEQ ID NO: 345758 - protein, 18 aa, Mycobacterium
SSVGRLWMCAAILVPLGR

SEQ ID NO: 345759 - protein, 18 aa, Mycobacterium
SSVQIDWSLALAVTAAAV

SEQ ID NO: 345760 - protein, 22 aa, Mycobacterium
SSVVEWKLRPGVVSTMNAQARY

SEQ ID NO: 345761 - protein, 17 aa, Mycobacterium
SSWRWVFLVNLPLGIIA

SEQ ID NO: 345762 - protein, 19 aa, Mycobacterium
STARINGRYGPLAPGPQNS

SEQ ID NO: 345763 - protein, 20 aa, Mycobacterium
STDSLLRFALRADATVCAGV

SEQ ID NO: 345764 - protein, 20 aa, Mycobacterium
STDSLLRFAMRADATLTGLL

SEQ ID NO: 345765 - protein, 17 aa, Mycobacterium
STFPILMIGLRMTLILT

SEQ ID NO: 345766 - protein, 17 aa, Mycobacterium
STFPLAVPLEWNVLFAY

SEQ ID NO: 345767 - protein, 26 aa, Mycobacterium
STGLFCDLGWFGVWAILDAVVPRGSA

SEQ ID NO: 345768 - protein, 27 aa, Mycobacterium
STGTPRPSYRFMREVYDLFVAPHYFGD

SEQ ID NO: 345769 - protein, 25 aa, Mycobacterium
STLLRLEIPLAWPVIMTGVRVSAQM

SEQ ID NO: 345770 - protein, 25 aa, Mycobacterium
STPRLPRWWPPAAIGLAAAIVVTGV

SEQ ID NO: 345771 - protein, 17 aa, Mycobacterium
STPRLVIVPALFLSAAV

SEQ ID NO: 345772 - protein, 17 aa, Mycobacterium
STPRPLPPVAPSLSPET

SEQ ID NO: 345773 - protein, 25 aa, Mycobacterium
STQSRFWTRWVGWVMHRPWITALSA

SEQ ID NO: 345774 - protein, 23 aa, Mycobacterium
STRFPVGPTIAAAVMIVLLVLAA

SEQ ID NO: 345775 - protein, 28 aa, Mycobacterium
STRLWRRVGIRVARWPKPIFVTTFAALI

SEQ ID NO: 345776 - protein, 21 aa, Mycobacterium
STTRFEWLRTFIRSIPPLFSA

SEQ ID NO: 345777 - protein, 17 aa, Mycobacterium
STVARLANHPSFGRRDL

SEQ ID NO: 345778 - protein, 20 aa, Mycobacterium
STVPLVVAIALSLLAMLLIR

SEQ ID NO: 345779 - protein, 17 aa, Mycobacterium
STVWWRVTLPLLRPGLM

SEQ ID NO: 345780 - protein, 22 aa, Mycobacterium
SVAALLGRWFWWPQQVRTRPAS

SEQ ID NO: 345781 - protein, 29 aa, Mycobacterium
SVAFLANTWWWRALSGWWTWAHTPNGPGG

SEQ ID NO: 345782 - protein, 23 aa, Mycobacterium
SVARLLGRWFWWPQRVRPRPAST

SEQ ID NO: 345783 - protein, 18 aa, Mycobacterium
SVAVPMFHGFGLGMLMLT

SEQ ID NO: 345784 - protein, 17 aa, Mycobacterium
SVCKGKVKQAYGFAYQQ

SEQ ID NO: 345785 - protein, 18 aa, Mycobacterium
SVCTGKIKQAYGLAYQQS

SEQ ID NO: 345786 - protein, 20 aa, Mycobacterium
SVDSPQWWTWTLAQRTSTLI

SEQ ID NO: 345787 - protein, 17 aa, Mycobacterium
SVFGVFWGAFGLVAGAA

SEQ ID NO: 345788 - protein, 17 aa, Mycobacterium
SVFGVFWGAFGLVSGAA

SEQ ID NO: 345789 - protein, 19 aa, Mycobacterium
SVFHCPFCHGWEVRDAPLA

SEQ ID NO: 345790 - protein, 17 aa, Mycobacterium
SVFWINLPICAAAIILT

SEQ ID NO: 345791 - protein, 20 aa, Mycobacterium
SVGLCAIGVVIGRFQRWNSW

SEQ ID NO: 345792 - protein, 21 aa, Mycobacterium
SVGWLRLGALLVLAAAFVGLV

SEQ ID NO: 345793 - protein, 18 aa, Mycobacterium
SVLACGYILFSLPWYTWL

SEQ ID NO: 345794 - protein, 23 aa, Mycobacterium
SVLACGYLLYSLHWYTWIAFTAW

SEQ ID NO: 345795 - protein, 19 aa, Mycobacterium
SVLFFLLGCFTIVGTRQIA

SEQ ID NO: 345796 - protein, 18 aa, Mycobacterium
SVLICLGAALMAYFKPLG

SEQ ID NO: 345797 - protein, 19 aa, Mycobacterium
SVLLLFGLLLPWLGALAVL

SEQ ID NO: 345798 - protein, 17 aa, Mycobacterium
SVLPLAAGQIWLAVRGR

SEQ ID NO: 345799 - protein, 21 aa, Mycobacterium
SVMARPWFKSRWTRLVPATVE

SEQ ID NO: 345800 - protein, 22 aa, Mycobacterium
SVMEIVGWRALWGLGNALFIAT

SEQ ID NO: 345801 - protein, 23 aa, Mycobacterium
SVMRPGHHFPRRGAIDVVIGMPI

SEQ ID NO: 345802 - protein, 18 aa, Mycobacterium
SVPEGRRGRRRWMVAAAV

SEQ ID NO: 345803 - protein, 20 aa, Mycobacterium
SVPIILGWLGIAVLISVAVP

SEQ ID NO: 345804 - protein, 20 aa, Mycobacterium
SVPIVVGWVALVVILALAAP

SEQ ID NO: 345805 - protein, 18 aa, Mycobacterium
SVPRCVGNTLLLHGRTYS

SEQ ID NO: 345806 - protein, 21 aa, Mycobacterium
SVSIPSWWQPYVLSVGAVDST

SEQ ID NO: 345807 - protein, 21 aa, Mycobacterium
SVSVPSWWQPYVLSVGSVGID

SEQ ID NO: 345808 - protein, 25 aa, Mycobacterium
SVTWIIGAAWGWHGAGWMLTKLGFH

SEQ ID NO: 345809 - protein, 24 aa, Mycobacterium
SVVWIIGASWGWHGAGWMLTELGF

SEQ ID NO: 345810 - protein, 24 aa, Mycobacterium
SVVYDMWGAAVSLAYQTHSGSPQP

SEQ ID NO: 345811 - protein, 17 aa, Mycobacterium
SVWYLLWLVAAAALGYV

SEQ ID NO: 345812 - protein, 17 aa, Mycobacterium
SVWYLWSVMVLFMPQSI

SEQ ID NO: 345813 - protein, 18 aa, Mycobacterium
SWALRLARRRVLLAGVAL

SEQ ID NO: 345814 - protein, 18 aa, Mycobacterium
SWFLLRVAFLPTVAVSIP

SEQ ID NO: 345815 - protein, 25 aa, Mycobacterium
SWFLRFLLRHSMYWFVGYRVVVGVV

SEQ ID NO: 345816 - protein, 23 aa, Mycobacterium
SWLGRFVSTYGWRAYALPVLMVL

SEQ ID NO: 345817 - protein, 21 aa, Mycobacterium
SWLVLHLVYLVGFKTKIVTLL

SEQ ID NO: 345818 - protein, 18 aa, Mycobacterium
SWPAPAWLALLAAVSLLC

SEQ ID NO: 345819 - protein, 23 aa, Mycobacterium
SWRPGTAWGGWLLRRCTRLYRPV

SEQ ID NO: 345820 - protein, 24 aa, Mycobacterium
SWRRGRLAPNWSFHFGLLLAGWGI

SEQ ID NO: 345821 - protein, 23 aa, Mycobacterium
SWRRVGTVVVRWPVPVLTATLAI

SEQ ID NO: 345822 - protein, 17 aa, Mycobacterium
SWSTRATLHFLWLRLAR

SEQ ID NO: 345823 - protein, 17 aa, Mycobacterium
SWTLLPIVPFVGGLLGV

SEQ ID NO: 345824 - protein, 20 aa, Mycobacterium
SWVWCGALFNVLAVVVFLGV

SEQ ID NO: 345825 - protein, 27 aa, Mycobacterium
SYGAWFPYYICGISFRASDLEGRTVVF

SEQ ID NO: 345826 - protein, 25 aa, Mycobacterium
SYMRYPVFLAFDIVGGIAWGAGATL

SEQ ID NO: 345827 - protein, 24 aa, Mycobacterium
SYSNETWRLWSFPWEAKTPGRHTI

SEQ ID NO: 345828 - protein, 18 aa, Mycobacterium
SYWQPRCPVHVIPHGAEP

SEQ ID NO: 345829 - protein, 30 aa, Mycobacterium
TAAAPTRRVEWSRVVAFLVLPALALVLAAG

SEQ ID NO: 345830 - protein, 18 aa, Mycobacterium
TAAFKISPSAWWVCGSAI

SEQ ID NO: 345831 - protein, 17 aa, Mycobacterium
TAAGFPFYTAIKKLLLD

SEQ ID NO: 345832 - protein, 20 aa, Mycobacterium
TAAGLSWYLAHDVLAHPQPF

SEQ ID NO: 345833 - protein, 22 aa, Mycobacterium
TAALRSPLTWGIVAGLVVGKFV

SEQ ID NO: 345834 - protein, 17 aa, Mycobacterium
TAAREFLPYQALTGLRS

SEQ ID NO: 345835 - protein, 20 aa, Mycobacterium
TAATRLQVWLTRTGDDTFTL

SEQ ID NO: 345836 - protein, 18 aa, Mycobacterium
TADMKALFSAIIDDEPLP

SEQ ID NO: 345837 - protein, 18 aa, Mycobacterium
TAEQVGAVALCFQAARLQ

SEQ ID NO: 345838 - protein, 25 aa, Mycobacterium
TAGPWPRWWCAAAALGVALVAALPW

SEQ ID NO: 345839 - protein, 19 aa, Mycobacterium
TAGVLRWQYDTMRYAQIAG

SEQ ID NO: 345840 - protein, 21 aa, Mycobacterium
TAGYWLCCLLLTMTLGLLFSA

SEQ ID NO: 345841 - protein, 18 aa, Mycobacterium
TAHAVLNLFGWVGLTVLG

SEQ ID NO: 345842 - protein, 19 aa, Mycobacterium
TAHLPRRQVLVLSLTCLTL

SEQ ID NO: 345843 - protein, 18 aa, Mycobacterium
TAHLPRRRVLVASLTCLT

SEQ ID NO: 345844 - protein, 17 aa, Mycobacterium
TAIAVVVLLGWSFFYFS

SEQ ID NO: 345845 - protein, 21 aa, Mycobacterium
TALCLFTAVFIMLRRKRIPGV

SEQ ID NO: 345846 - protein, 20 aa, Mycobacterium
TALCLFTAVFIMLRRKRVAG

SEQ ID NO: 345847 - protein, 21 aa, Mycobacterium
TALCLFTAVFIMLRRKRVPGV

SEQ ID NO: 345848 - protein, 18 aa, Mycobacterium
TALCSPTRSCLLTGRNHH

SEQ ID NO: 345849 - protein, 19 aa, Mycobacterium
TALFCIACLALVATAIWTV

SEQ ID NO: 345850 - protein, 18 aa, Mycobacterium
TALMSWCIVAAQVVMVPV

SEQ ID NO: 345851 - protein, 23 aa, Mycobacterium
TALPPRWQRWLPRAAALMAGFAT

SEQ ID NO: 345852 - protein, 22 aa, Mycobacterium
TALVPVCTLIGIRIERRSKNTH

SEQ ID NO: 345853 - protein, 23 aa, Mycobacterium
TANFPPDIGWRLAFGIGAILGIF

SEQ ID NO: 345854 - protein, 22 aa, Mycobacterium
TANSIFARWFPPRERGKATSLM

SEQ ID NO: 345855 - protein, 18 aa, Mycobacterium
TAPPPRRRWPALAATAVV

SEQ ID NO: 345856 - protein, 17 aa, Mycobacterium
TAPSLPLLIAWRSVGGV

SEQ ID NO: 345857 - protein, 19 aa, Mycobacterium
TAPVLVVGWVWAVTKRRPS

SEQ ID NO: 345858 - protein, 20 aa, Mycobacterium
TAQIAGQVGRLWKLTAALTT

SEQ ID NO: 345859 - protein, 19 aa, Mycobacterium
TAQRWGRYRIAARVEVIAR

SEQ ID NO: 345860 - protein, 17 aa, Mycobacterium
TAREWMWAVLLAGAVAV

SEQ ID NO: 345861 - protein, 22 aa, Mycobacterium
TARMWRVWLFTVIGCNPVLFTL

SEQ ID NO: 345862 - protein, 18 aa, Mycobacterium
TASGRWRALLLAAVAACA

SEQ ID NO: 345863 - protein, 20 aa, Mycobacterium
TASLDWVAWRGLGFGSDAQV

SEQ ID NO: 345864 - protein, 18 aa, Mycobacterium
TASSARPDLIFAEPPEAA

SEQ ID NO: 345865 - protein, 25 aa, Mycobacterium
TATASFKSATKWSGASFHDHGNWVI

SEQ ID NO: 345866 - protein, 21 aa, Mycobacterium
TATDWTLNWARGLITNAPYPK

SEQ ID NO: 345867 - protein, 23 aa, Mycobacterium
TATFLRWAWYAARRENLHLDDAD

SEQ ID NO: 345868 - protein, 21 aa, Mycobacterium
TATLQRLLPRLGIGSSADPQA

SEQ ID NO: 345869 - protein, 21 aa, Mycobacterium
TATLQRLLPRLGISPGTDPPA

SEQ ID NO: 345870 - protein, 20 aa, Mycobacterium
TATVRWPGPILAAACAVGLV

SEQ ID NO: 345871 - protein, 17 aa, Mycobacterium
TAVGLVFLFLSLTPSLL

SEQ ID NO: 345872 - protein, 21 aa, Mycobacterium
TAVLAAWGWFALLLQITGAIA

SEQ ID NO: 345873 - protein, 17 aa, Mycobacterium
TAVLACRRSVPAAEGSV

SEQ ID NO: 345874 - protein, 19 aa, Mycobacterium
TAVQLPWGVLLLFGGGLAL

SEQ ID NO: 345875 - protein, 18 aa, Mycobacterium
TAVTLGMMLSCLILVAAL

SEQ ID NO: 345876 - protein, 19 aa, Mycobacterium
TAVVRWPVPILAGAIAVAL

SEQ ID NO: 345877 - protein, 23 aa, Mycobacterium
TAWWLELFPGLAIVGCTLAVTVV

SEQ ID NO: 345878 - protein, 17 aa, Mycobacterium
TAYPMVWWLLAKEATKA

SEQ ID NO: 345879 - protein, 19 aa, Mycobacterium
TCPWPPPTVFLMRRGANGN

SEQ ID NO: 345880 - protein, 34 aa, Mycobacterium
TCWAVTAGGIWWPIGRALAWCCVVLIGASAALAW

SEQ ID NO: 345881 - protein, 20 aa, Mycobacterium
TCYRPPAAVHRRWRDEFGLA

SEQ ID NO: 345882 - protein, 27 aa, Mycobacterium
TDAGVGRPWASWMMPKMISPIRTAINT

SEQ ID NO: 345883 - protein, 24 aa, Mycobacterium
TDALARRIALVLGYRTTAVCVIEP

SEQ ID NO: 345884 - protein, 20 aa, Mycobacterium
TDALLRFVMRADATLTGLMG

SEQ ID NO: 345885 - protein, 25 aa, Mycobacterium
TDDASPRLAWRVVVHVPDTGEMAPS

SEQ ID NO: 345886 - protein, 20 aa, Mycobacterium
TDGVPAWPFVAAVTVIVAAG

SEQ ID NO: 345887 - protein, 18 aa, Mycobacterium
TDILFKKPLRLWVAVSLY

SEQ ID NO: 345888 - protein, 17 aa, Mycobacterium
TDILQRWTRGVMSTVGE

SEQ ID NO: 345889 - protein, 17 aa, Mycobacterium
TDIRLSQWFLLTAAFGS

SEQ ID NO: 345890 - protein, 22 aa, Mycobacterium
TDKPVWITMLWPLADRPRLAPG

SEQ ID NO: 345891 - protein, 19 aa, Mycobacterium
TDLKLHWSWHGVGLGLLFG

SEQ ID NO: 345892 - protein, 22 aa, Mycobacterium
TDLPEGRWSEFLSEPRIAERVA

SEQ ID NO: 345893 - protein, 23 aa, Mycobacterium
TDPLFCVAMGFLAAVSAAASISG

SEQ ID NO: 345894 - protein, 17 aa, Mycobacterium
TDPVGWSAKCLQMARAD

SEQ ID NO: 345895 - protein, 18 aa, Mycobacterium
TDRFQRVFVPVILVGVVL

SEQ ID NO: 345896 - protein, 18 aa, Mycobacterium
TDRVDPRVLLLVYYAGRG

SEQ ID NO: 345897 - protein, 18 aa, Mycobacterium
TDSLLRFAMRADATLTGL

SEQ ID NO: 345898 - protein, 20 aa, Mycobacterium
TDTFARLGLRRDTLVPCYGM

SEQ ID NO: 345899 - protein, 18 aa, Mycobacterium
TDVYGLRIGDDVRMAGVR

SEQ ID NO: 345900 - protein, 21 aa, Mycobacterium
TDWECARRVTLPWVSSGIVGA

SEQ ID NO: 345901 - protein, 18 aa, Mycobacterium
TDWTLNWAHGLIANAPQP

SEQ ID NO: 345902 - protein, 19 aa, Mycobacterium
TEAGVLLNADWTWARSALD

SEQ ID NO: 345903 - protein, 23 aa, Mycobacterium
TEAIPSRLSRRSLVVGNAVIAFA

SEQ ID NO: 345904 - protein, 27 aa, Mycobacterium
TEATMLWLRNWLRAHRRQIIAVAVGLA

SEQ ID NO: 345905 - protein, 17 aa, Mycobacterium
TEDGSLEFLGRADNQVK

SEQ ID NO: 345906 - protein, 19 aa, Mycobacterium
TEFALRPVAAMALAAGPPL

SEQ ID NO: 345907 - protein, 24 aa, Mycobacterium
TEFRARLWLPYLPLILAAAAGWAH

SEQ ID NO: 345908 - protein, 20 aa, Mycobacterium
TEGFPNLFLIAGPHSPSVLS

SEQ ID NO: 345909 - protein, 22 aa, Mycobacterium
TEGQRPAWLNVIRADPGRVGVL

SEQ ID NO: 345910 - protein, 25 aa, Mycobacterium
TELFGRMVAVLSWVWVATAAAMTVS

SEQ ID NO: 345911 - protein, 24 aa, Mycobacterium
TELFKRMTMILTWIWVAAFAGMTL

SEQ ID NO: 345912 - protein, 17 aa, Mycobacterium
TELFPLLMLSVGGMLVF

SEQ ID NO: 345913 - protein, 17 aa, Mycobacterium
TELIRLIATMGLGAGAL

SEQ ID NO: 345914 - protein, 19 aa, Mycobacterium
TELRRGRTCFVIAHRLSTI

SEQ ID NO: 345915 - protein, 24 aa, Mycobacterium
TELVTLPAGWAWLENGWVMTIVAA

SEQ ID NO: 345916 - protein, 22 aa, Mycobacterium
TELWRSLVWIGWVWPLTAAIFV

SEQ ID NO: 345917 - protein, 18 aa, Mycobacterium
TESMPGWTARLDRDAASG

SEQ ID NO: 345918 - protein, 32 aa, Mycobacterium
TETINLPAGFAIGWAMWPLVAAIVLQAIAAVV

SEQ ID NO: 345919 - protein, 36 aa, Mycobacterium
TETINLPAGFAIGWAMWPLVACSVLQAIAAVVVVLL

SEQ ID NO: 345920 - protein, 17 aa, Mycobacterium
TETKLNSAFAFGGPKCL

SEQ ID NO: 345921 - protein, 17 aa, Mycobacterium
TETRRAVALPVMSTPIS

SEQ ID NO: 345922 - protein, 19 aa, Mycobacterium
TEVGVLPGTDFRLQPKYMD

SEQ ID NO: 345923 - protein, 18 aa, Mycobacterium
TFAALPLGVLAARYRDRV

SEQ ID NO: 345924 - protein, 20 aa, Mycobacterium
TFALRYRWWVVLGGITLATT

SEQ ID NO: 345925 - protein, 17 aa, Mycobacterium
TFFVYRDIPLSGFIPIL

SEQ ID NO: 345926 - protein, 17 aa, Mycobacterium
TFGWVWLIKRVLAGLRW

SEQ ID NO: 345927 - protein, 19 aa, Mycobacterium
TFKDLRDGSAYDLLIAGVA

SEQ ID NO: 345928 - protein, 17 aa, Mycobacterium
TFLRPSVPKVQAPVPRQ

SEQ ID NO: 345929 - protein, 19 aa, Mycobacterium
TFLYELLWNLLVFAVLILV

SEQ ID NO: 345930 - protein, 17 aa, Mycobacterium
TFRALAWSEDEPADDVV

SEQ ID NO: 345931 - protein, 17 aa, Mycobacterium
TFTRLPYFHTMGVPCAI

SEQ ID NO: 345932 - protein, 18 aa, Mycobacterium
TFVALALPRSIDMVVALF

SEQ ID NO: 345933 - protein, 20 aa, Mycobacterium
TFVSLVGWWALSRVLKRLAG

SEQ ID NO: 345934 - protein, 17 aa, Mycobacterium
TFWLLAIWALFQAGIAF

SEQ ID NO: 345935 - protein, 17 aa, Mycobacterium
TFWRITLPSIRWGLTYG

SEQ ID NO: 345936 - protein, 24 aa, Mycobacterium
TGAEGRLDWQISRRAPADSLLAPY

SEQ ID NO: 345937 - protein, 18 aa, Mycobacterium
TGAGSFFPLLMVGGLVAM

SEQ ID NO: 345938 - protein, 24 aa, Mycobacterium
TGAWLSRLVKAWVPTPVRAGRGYS

SEQ ID NO: 345939 - protein, 18 aa, Mycobacterium
TGCVSIGGGCLWQPQPLV

SEQ ID NO: 345940 - protein, 23 aa, Mycobacterium
TGFACAWFYRKRLTTSFRDLMMR

SEQ ID NO: 345941 - protein, 17 aa, Mycobacterium
TGFARIVLLAAILGAAL

SEQ ID NO: 345942 - protein, 20 aa, Mycobacterium
TGFARIVLLAAILGAALSSA

SEQ ID NO: 345943 - protein, 20 aa, Mycobacterium
TGFDWTRWLTIVAFDVAIVF

SEQ ID NO: 345944 - protein, 17 aa, Mycobacterium
TGFIKLLLITAALGAAS

SEQ ID NO: 345945 - protein, 18 aa, Mycobacterium
TGFIRIVLLAAILGAALS

SEQ ID NO: 345946 - protein, 27 aa, Mycobacterium
TGFLWWRCWPRLIGIWLAGWLVRHWLI

SEQ ID NO: 345947 - protein, 18 aa, Mycobacterium
TGGAWEWSSSKNNRLNTV

SEQ ID NO: 345948 - protein, 19 aa, Mycobacterium
TGGLPLVFSGGNWTVDVED

SEQ ID NO: 345949 - protein, 17 aa, Mycobacterium
TGGPQCYDLPLVPFDKA

SEQ ID NO: 345950 - protein, 22 aa, Mycobacterium
TGGRTAQAWARRHRHLRAALTP

SEQ ID NO: 345951 - protein, 17 aa, Mycobacterium
TGIALSIAALAPVGAAL

SEQ ID NO: 345952 - protein, 31 aa, Mycobacterium
TGIARWIRRLAIPIILGWIALLGVLGATVPS

SEQ ID NO: 345953 - protein, 18 aa, Mycobacterium
TGIGVWRLSSSHGENLPQ

SEQ ID NO: 345954 - protein, 18 aa, Mycobacterium
TGIKVTRHLIAVYALAGT

SEQ ID NO: 345955 - protein, 18 aa, Mycobacterium
TGIPLLLAMWAFLIRGRR

SEQ ID NO: 345956 - protein, 22 aa, Mycobacterium
TGLDFPWGLAVDNMGTVYVGSR

SEQ ID NO: 345957 - protein, 19 aa, Mycobacterium
TGLMIKLSMWWPDSAWIVM

SEQ ID NO: 345958 - protein, 18 aa, Mycobacterium
TGMAPFFVTLALFFGALV

SEQ ID NO: 345959 - protein, 19 aa, Mycobacterium
TGMSVDWPAVFAGSGATRV

SEQ ID NO: 345960 - protein, 22 aa, Mycobacterium
TGNLWSTIGFHWAFQITAQFLG

SEQ ID NO: 345961 - protein, 17 aa, Mycobacterium
TGNPLWLIVVVLVLAGI

SEQ ID NO: 345962 - protein, 24 aa, Mycobacterium
TGPLLEMLDRVGAVGLNPDDVAVA

SEQ ID NO: 345963 - protein, 27 aa, Mycobacterium
TGRGRPSWRVLLVGLAVIVAWLLIVML

SEQ ID NO: 345964 - protein, 24 aa, Mycobacterium
TGRKWNKWWLLAVVPLLLLAGLVA

SEQ ID NO: 345965 - protein, 18 aa, Mycobacterium
TGRRLGALIVDWLIAYGL

SEQ ID NO: 345966 - protein, 18 aa, Mycobacterium
TGRVEFAHVSFAYRPGVP

SEQ ID NO: 345967 - protein, 23 aa, Mycobacterium
TGRYLRVVLRWGALTAAGLLLVL

SEQ ID NO: 345968 - protein, 18 aa, Mycobacterium
TGSLAVAVGMTWATASDL

SEQ ID NO: 345969 - protein, 25 aa, Mycobacterium
TGSPAWEMFKPWAITSIAVAVAVAL

SEQ ID NO: 345970 - protein, 19 aa, Mycobacterium
TGSSFKVFALVAALQQGIG

SEQ ID NO: 345971 - protein, 17 aa, Mycobacterium
TGSVVVWYSPRRCDRSA

SEQ ID NO: 345972 - protein, 17 aa, Mycobacterium
TGSVVVWYSPRRCDRSS

SEQ ID NO: 345973 - protein, 17 aa, Mycobacterium
TGSVVVWYSPRRCNRSA

SEQ ID NO: 345974 - protein, 25 aa, Mycobacterium
TGTPAWEMFKPWSIISITIAIVLAF

SEQ ID NO: 345975 - protein, 25 aa, Mycobacterium
TGTPAWEMFKPWSIVSITIAVALAL

SEQ ID NO: 345976 - protein, 19 aa, Mycobacterium
TGVVCFVGFLASYLFNVFV

SEQ ID NO: 345977 - protein, 19 aa, Mycobacterium
TGYLLAGIHGWRWMLGLAT

SEQ ID NO: 345978 - protein, 19 aa, Mycobacterium
THFPLTWVLTPGRELAIKL

SEQ ID NO: 345979 - protein, 23 aa, Mycobacterium
THGPRPGLIIGIAFAATYAGWAW

SEQ ID NO: 345980 - protein, 17 aa, Mycobacterium
THIPLGWFSAERTALAR

SEQ ID NO: 345981 - protein, 22 aa, Mycobacterium
THPHHWSMYLAGWIDDLVPGTA

SEQ ID NO: 345982 - protein, 19 aa, Mycobacterium
THPHHWSMYLAGWIDNLVP

SEQ ID NO: 345983 - protein, 21 aa, Mycobacterium
THRARPRPVAGLTTLPDDMSP

SEQ ID NO: 345984 - protein, 19 aa, Mycobacterium
THRRKILIAMCMVAGISLL

SEQ ID NO: 345985 - protein, 27 aa, Mycobacterium
THRWRRIGTAIVRWPAPILITTLAVAL

SEQ ID NO: 345986 - protein, 25 aa, Mycobacterium
THSAWRIGVLSNRWIILGVTAQGLA

SEQ ID NO: 345987 - protein, 22 aa, Mycobacterium
THSELLSGLGLMLNPTSLVPLL

SEQ ID NO: 345988 - protein, 21 aa, Mycobacterium
THSRPAWLFDMAMLATLSVAY

SEQ ID NO: 345989 - protein, 19 aa, Mycobacterium
THWQEWMPAGLFFAAVAVF

SEQ ID NO: 345990 - protein, 18 aa, Mycobacterium
THWYGRSSVLISVTGAAA

SEQ ID NO: 345991 - protein, 19 aa, Mycobacterium
THYSGWWAFDMAMLVILGA

SEQ ID NO: 345992 - protein, 18 aa, Mycobacterium
TIAPRTGYTDYLRLTKTS

SEQ ID NO: 345993 - protein, 22 aa, Mycobacterium
TIASVLCGIAWNETTLVTARLL

SEQ ID NO: 345994 - protein, 19 aa, Mycobacterium
TIFYWGWWISWAPFVGMFI

SEQ ID NO: 345995 - protein, 22 aa, Mycobacterium
TIIRMFLVPAIMKLLGDDCWWA

SEQ ID NO: 345996 - protein, 22 aa, Mycobacterium
TIKGNLFWAFAYNVAALPLAAL

SEQ ID NO: 345997 - protein, 18 aa, Mycobacterium
TILYCVVRFALGVHAVHP

SEQ ID NO: 345998 - protein, 21 aa, Mycobacterium
TIQKFSLPVILLWIALTVGAN

SEQ ID NO: 345999 - protein, 23 aa, Mycobacterium
TIRRFAVLVLLLWLAYTAIVNLA

SEQ ID NO: 346000 - protein, 23 aa, Mycobacterium
TIWEIGRPWYLAWAGLVYIVATL

SEQ ID NO: 346001 - protein, 19 aa, Mycobacterium
TKAALWLSVTAFLALAVLY

SEQ ID NO: 346002 - protein, 20 aa, Mycobacterium
TKLNSAFAFGGPKCLVKEIQ

SEQ ID NO: 346003 - protein, 17 aa, Mycobacterium
TKMSQSWSKDQVMEAYL

SEQ ID NO: 346004 - protein, 17 aa, Mycobacterium
TKMTAMPQLVAFFNGVG

SEQ ID NO: 346005 - protein, 22 aa, Mycobacterium
TKPRLSWLDAMYFTAETITTVG

SEQ ID NO: 346006 - protein, 19 aa, Mycobacterium
TKRALPWQPLPDVVMLEAK

SEQ ID NO: 346007 - protein, 23 aa, Mycobacterium
TKTPLSFLCYWIIPFGLVGLAAV

SEQ ID NO: 346008 - protein, 21 aa, Mycobacterium
TKVWLPECLQMAQQKTGALFG

SEQ ID NO: 346009 - protein, 18 aa, Mycobacterium
TLAVLLFRLMWRGWRARA

SEQ ID NO: 346010 - protein, 17 aa, Mycobacterium
TLCGIAWDGGTLITARL

SEQ ID NO: 346011 - protein, 18 aa, Mycobacterium
TLCPLLVLGIWWRGLTAR

SEQ ID NO: 346012 - protein, 19 aa, Mycobacterium
TLCPLLVLGIWWRRLTVVG

SEQ ID NO: 346013 - protein, 18 aa, Mycobacterium
TLFILAIPFFLRRFGIKT

SEQ ID NO: 346014 - protein, 24 aa, Mycobacterium
TLGLRPAPEFEQWLHAIGMVDDDG

SEQ ID NO: 346015 - protein, 24 aa, Mycobacterium
TLGRLLFDWRFDLVLGTAAIVLAL

SEQ ID NO: 346016 - protein, 23 aa, Mycobacterium
TLGRRLSARFGWLAGNKRPITLL

SEQ ID NO: 346017 - protein, 20 aa, Mycobacterium
TLIAALLFRRCRRVVLVAAI

SEQ ID NO: 346018 - protein, 22 aa, Mycobacterium
TLIGAPMWVVWGALPKYLAESF

SEQ ID NO: 346019 - protein, 17 aa, Mycobacterium
TLLFKLTPWIVVGVFAF

SEQ ID NO: 346020 - protein, 25 aa, Mycobacterium
TLLMAVGFACMYRLNLHSSYLEFAW

SEQ ID NO: 346021 - protein, 17 aa, Mycobacterium
TLLPAILVLAGRRGWVK

SEQ ID NO: 346022 - protein, 18 aa, Mycobacterium
TLLPSILVLIGRRGWIKP

SEQ ID NO: 346023 - protein, 18 aa, Mycobacterium
TLMREIRRVYAPGADGAT

SEQ ID NO: 346024 - protein, 17 aa, Mycobacterium
TLPMCRPTIVAAVLLTC

SEQ ID NO: 346025 - protein, 24 aa, Mycobacterium
TLQWRPDDQFTFLSSGAMRFDPPA

SEQ ID NO: 346026 - protein, 18 aa, Mycobacterium
TLRAEPFAAWIIGAACAY

SEQ ID NO: 346027 - protein, 23 aa, Mycobacterium
TLRTIRTNMIWAFGYNVAAIPIA

SEQ ID NO: 346028 - protein, 24 aa, Mycobacterium
TLSALRRYGCTITQGFVHSPPLPA

SEQ ID NO: 346029 - protein, 25 aa, Mycobacterium
TLSDSAFMAWGWRVGFWLSVIIVAI

SEQ ID NO: 346030 - protein, 19 aa, Mycobacterium
TLVALAWFPLWLILLAVGW

SEQ ID NO: 346031 - protein, 24 aa, Mycobacterium
TLVRLELPLAWPVIMTGVRVSAQM

SEQ ID NO: 346032 - protein, 24 aa, Mycobacterium
TLWLKSQVVALTFDDSGQVDGATI

SEQ ID NO: 346033 - protein, 22 aa, Mycobacterium
TMFCFVGFPILVGVVVWTFVDA

SEQ ID NO: 346034 - protein, 25 aa, Mycobacterium
TMFIPRFLFAVSFCGLLVATGSYLL

SEQ ID NO: 346035 - protein, 19 aa, Mycobacterium
TMFIPRFLFAVTFCGVLVA

SEQ ID NO: 346036 - protein, 20 aa, Mycobacterium
TMGALTSWLGFQTHQAHQAS

SEQ ID NO: 346037 - protein, 20 aa, Mycobacterium
TMITALLLYFGWARSDAQSQ

SEQ ID NO: 346038 - protein, 24 aa, Mycobacterium
TMSGPRPGGFGLLNNRTFEICARG

SEQ ID NO: 346039 - protein, 20 aa, Mycobacterium
TMTGPRPGGFGALDNRTNQI

SEQ ID NO: 346040 - protein, 20 aa, Mycobacterium
TMWLCASAPLAPGLGAPPIG

SEQ ID NO: 346041 - protein, 20 aa, Mycobacterium
TNAGLFLRYVIFGGENLSFA

SEQ ID NO: 346042 - protein, 22 aa, Mycobacterium
TNAPVWKWIAAGVTVVIILGLL

SEQ ID NO: 346043 - protein, 19 aa, Mycobacterium
TNPSLSHGGMPARLVPDAV

SEQ ID NO: 346044 - protein, 23 aa, Mycobacterium
TNRLRLGLNIPYLLLLLAFVVYD

SEQ ID NO: 346045 - protein, 17 aa, Mycobacterium
TPAFCIFLACYVVAALL

SEQ ID NO: 346046 - protein, 23 aa, Mycobacterium
TPARILFDWRFDLIFGSAAIVFA

SEQ ID NO: 346047 - protein, 21 aa, Mycobacterium
TPAWEVYKPWAVTSIAVAVAV

SEQ ID NO: 346048 - protein, 17 aa, Mycobacterium
TPDGLYCKLPQDSPIGV

SEQ ID NO: 346049 - protein, 18 aa, Mycobacterium
TPEFPWAGLTIFLLIAVL

SEQ ID NO: 346050 - protein, 23 aa, Mycobacterium
TPEFPWTGLTIFLLIAVFAAAVG

SEQ ID NO: 346051 - protein, 18 aa, Mycobacterium
TPEFPWTGLTIFLLIGVL

SEQ ID NO: 346052 - protein, 23 aa, Mycobacterium
TPEFPWTGLTIFLLLAVFAAAVA

SEQ ID NO: 346053 - protein, 25 aa, Mycobacterium
TPGRLMFDWRFDLIFGTAAIVFAIA

SEQ ID NO: 346054 - protein, 23 aa, Mycobacterium
TPIIRLGHMLVFFVRALLGIPVA

SEQ ID NO: 346055 - protein, 17 aa, Mycobacterium
TPKFTRMVVAALFGVLF

SEQ ID NO: 346056 - protein, 19 aa, Mycobacterium
TPLGWRWAGIVWAYALFWF

SEQ ID NO: 346057 - protein, 21 aa, Mycobacterium
TPLIKRPILFGALAGLGVGTA

SEQ ID NO: 346058 - protein, 18 aa, Mycobacterium
TPLRRFDLLIAYGTAFST

SEQ ID NO: 346059 - protein, 18 aa, Mycobacterium
TPLRRLDLLIAYGTAFST

SEQ ID NO: 346060 - protein, 18 aa, Mycobacterium
TPLRRLDMLAGYGTAFSL

SEQ ID NO: 346061 - protein, 30 aa, Mycobacterium
TPLVRMAAAWSWRLLVIFAAIVTLLWLVLR

SEQ ID NO: 346062 - protein, 19 aa, Mycobacterium
TPMLFAIGFLLTFLIGGLT

SEQ ID NO: 346063 - protein, 18 aa, Mycobacterium
TPPAPVIIKPGADAAAQF

SEQ ID NO: 346064 - protein, 17 aa, Mycobacterium
TPPRAVAIITQIASALD

SEQ ID NO: 346065 - protein, 18 aa, Mycobacterium
TPQARLGLIGAITAAGLN

SEQ ID NO: 346066 - protein, 18 aa, Mycobacterium
TPRLFEHFRSLRATPVPA

SEQ ID NO: 346067 - protein, 21 aa, Mycobacterium
TPRPFDWRGLLLLGAGIGAAL

SEQ ID NO: 346068 - protein, 23 aa, Mycobacterium
TPSALRQSFLWGLAGVIAAEHPE

SEQ ID NO: 346069 - protein, 19 aa, Mycobacterium
TPSVGRWVAVVAVLAVLTI

SEQ ID NO: 346070 - protein, 19 aa, Mycobacterium
TPTEFWLVMTLHHRPDGNL

SEQ ID NO: 346071 - protein, 23 aa, Mycobacterium
TPTTRLGSMYGYGVGYAVASLSC

SEQ ID NO: 346072 - protein, 18 aa, Mycobacterium
TPVLCLLPIIATGVLYGL

SEQ ID NO: 346073 - protein, 26 aa, Mycobacterium
TPWYRKPPLLIAWLVFVAVLIGLIVY

SEQ ID NO: 346074 - protein, 17 aa, Mycobacterium
TQLLGVTAAGVWQGSSA

SEQ ID NO: 346075 - protein, 20 aa, Mycobacterium
TQLRRLPVDFGIGVSAGRVF

SEQ ID NO: 346076 - protein, 20 aa, Mycobacterium
TQRFLIRWRVWLTDRLTADW

SEQ ID NO: 346077 - protein, 23 aa, Mycobacterium
TQRRLRDTLLRFGGYPVDAMPTA

SEQ ID NO: 346078 - protein, 22 aa, Mycobacterium
TQSRFWNRWIGWVMRRPWMSAL

SEQ ID NO: 346079 - protein, 17 aa, Mycobacterium
TQWTLEWARNLVENAPH

SEQ ID NO: 346080 - protein, 19 aa, Mycobacterium
TRAAIKITTIFGSRYIDLH

SEQ ID NO: 346081 - protein, 18 aa, Mycobacterium
TRAAIRFADLTGGRYVAL

SEQ ID NO: 346082 - protein, 19 aa, Mycobacterium
TRADCPRYGELKGPSCFTA

SEQ ID NO: 346083 - protein, 23 aa, Mycobacterium
TRADCPRYGQLLGPSCYTAPTIA

SEQ ID NO: 346084 - protein, 28 aa, Mycobacterium
TRAVCGPEAFLAYGWRIPFLLSAVLVVI

SEQ ID NO: 346085 - protein, 19 aa, Mycobacterium
TRGASFVFRHRAGNAAIGV

SEQ ID NO: 346086 - protein, 28 aa, Mycobacterium
TRGWRRIGTAIVRWPGPILVVSCIATLV

SEQ ID NO: 346087 - protein, 27 aa, Mycobacterium
TRGWRRIGTAIVRWPGPVLVVACALAL

SEQ ID NO: 346088 - protein, 20 aa, Mycobacterium
TRHIWVRFTVVLALTLAQAL

SEQ ID NO: 346089 - protein, 19 aa, Mycobacterium
TRHLGRWLGPLAILLALWA

SEQ ID NO: 346090 - protein, 24 aa, Mycobacterium
TRIAPAHPWWWFLKSTPGKILMLG

SEQ ID NO: 346091 - protein, 25 aa, Mycobacterium
TRILAIPILIGWLLITAALNVIAPQ

SEQ ID NO: 346092 - protein, 18 aa, Mycobacterium
TRIRWPMWLRTALATVAL

SEQ ID NO: 346093 - protein, 25 aa, Mycobacterium
TRKRFGDTMGYRLVIYPTYAVLDRK

SEQ ID NO: 346094 - protein, 19 aa, Mycobacterium
TRKRLLRRPGWASVGVALV

SEQ ID NO: 346095 - protein, 19 aa, Mycobacterium
TRLAQVLGQIYGRTIAVQL

SEQ ID NO: 346096 - protein, 17 aa, Mycobacterium
TRLATWVAEPGHTATPA

SEQ ID NO: 346097 - protein, 18 aa, Mycobacterium
TRLATWVAEPGHTATPAG

SEQ ID NO: 346098 - protein, 17 aa, Mycobacterium
TRLGSMFGYGVGYAVAS

SEQ ID NO: 346099 - protein, 17 aa, Mycobacterium
TRLRDEFGFPKSVIHAQ

SEQ ID NO: 346100 - protein, 21 aa, Mycobacterium
TRLTEVLSRIYGHPVAVQLQI

SEQ ID NO: 346101 - protein, 18 aa, Mycobacterium
TRLWLRFAADTEARINVV

SEQ ID NO: 346102 - protein, 20 aa, Mycobacterium
TRLYCAGGWYTGDTLDITAA

SEQ ID NO: 346103 - protein, 22 aa, Mycobacterium
TRLYLPMPFFWVGGFGGGILSA

SEQ ID NO: 346104 - protein, 19 aa, Mycobacterium
TRMVAAWVITLPLAGLVGA

SEQ ID NO: 346105 - protein, 24 aa, Mycobacterium
TRNRLVWCALAICLGLIAAAFTIP

SEQ ID NO: 346106 - protein, 20 aa, Mycobacterium
TRPGLPLYFWVYLAALIAAC

SEQ ID NO: 346107 - protein, 23 aa, Mycobacterium
TRPMMLCALGFTAAAMLVGFWQL

SEQ ID NO: 346108 - protein, 25 aa, Mycobacterium
TRPRWPRRRMFFVVTLAVLFVLSGM

SEQ ID NO: 346109 - protein, 24 aa, Mycobacterium
TRQPRSRFRFGIQSKILITMLLSS

SEQ ID NO: 346110 - protein, 19 aa, Mycobacterium
TRRLWPAAVAIVIAMFSVT

SEQ ID NO: 346111 - protein, 18 aa, Mycobacterium
TRRWFRRWVPVAVGIGVA

SEQ ID NO: 346112 - protein, 27 aa, Mycobacterium
TRRWRRIGTAVVRWPAPILIATIAVAV

SEQ ID NO: 346113 - protein, 23 aa, Mycobacterium
TRSFAEGVGWLAQIGLFVLLGLL

SEQ ID NO: 346114 - protein, 25 aa, Mycobacterium
TRVARGWPGWGLALWLICPIWLAHS

SEQ ID NO: 346115 - protein, 19 aa, Mycobacterium
TRVGFPSMLLFLLVGVAVG

SEQ ID NO: 346116 - protein, 17 aa, Mycobacterium
TRWFPTHFVTLWMVDTP

SEQ ID NO: 346117 - protein, 20 aa, Mycobacterium
TRWHTARAVLALPFTVAVLV

SEQ ID NO: 346118 - protein, 18 aa, Mycobacterium
TRWLGCLLACALAGAVLV

SEQ ID NO: 346119 - protein, 19 aa, Mycobacterium
TRWPRWLRQLLSFVAVVAI

SEQ ID NO: 346120 - protein, 23 aa, Mycobacterium
TRWTNWLEIFLLLVISFSLPRTF

SEQ ID NO: 346121 - protein, 19 aa, Mycobacterium
TSAQWLFAIAVGSSVLVVD

SEQ ID NO: 346122 - protein, 21 aa, Mycobacterium
TSEALLRLAMRTDAVLVGISG

SEQ ID NO: 346123 - protein, 18 aa, Mycobacterium
TSFAERWVLVPAPSGTTV

SEQ ID NO: 346124 - protein, 24 aa, Mycobacterium
TSFGWRVLTPVLRRLEEVTDLASV

SEQ ID NO: 346125 - protein, 20 aa, Mycobacterium
TSGWEMYKPWAITSLAIAVC

SEQ ID NO: 346126 - protein, 18 aa, Mycobacterium
TSLIKILLILGVVGCVIG

SEQ ID NO: 346127 - protein, 19 aa, Mycobacterium
TSLLWLAVAGWSLWAAHSP

SEQ ID NO: 346128 - protein, 17 aa, Mycobacterium
TSLRIGYDTVVWVTSAY

SEQ ID NO: 346129 - protein, 21 aa, Mycobacterium
TSLRMSVRFIRRVAFTGYVVT

SEQ ID NO: 346130 - protein, 17 aa, Mycobacterium
TSMSRWVRASAWLSQLY

SEQ ID NO: 346131 - protein, 23 aa, Mycobacterium
TSNFPPNIGWRLAFGVGAIFGIF

SEQ ID NO: 346132 - protein, 24 aa, Mycobacterium
TSNRLAKIPLDWDATLVSEGKGRA

SEQ ID NO: 346133 - protein, 23 aa, Mycobacterium
TSPPRLRVLPARFVGGVLGIGSG

SEQ ID NO: 346134 - protein, 24 aa, Mycobacterium
TSRLWRRSGVHIVRRPIAHLTASL

SEQ ID NO: 346135 - protein, 19 aa, Mycobacterium
TSRRSRWARMFDEGIGATV

SEQ ID NO: 346136 - protein, 21 aa, Mycobacterium
TSVLCATGFRQAALMWLPAVA

SEQ ID NO: 346137 - protein, 19 aa, Mycobacterium
TTAGWKLLALLGYAVLYAY

SEQ ID NO: 346138 - protein, 18 aa, Mycobacterium
TTALSYLCYWLIPFTLFG

SEQ ID NO: 346139 - protein, 22 aa, Mycobacterium
TTFARLSMRAQFALEARPLRMA

SEQ ID NO: 346140 - protein, 18 aa, Mycobacterium
TTGEFRKSIVVQRNTADE

SEQ ID NO: 346141 - protein, 18 aa, Mycobacterium
TTGLAKWSVVIDAPPASK

SEQ ID NO: 346142 - protein, 17 aa, Mycobacterium
TTHWGLAIDDFWWTAIW

SEQ ID NO: 346143 - protein, 17 aa, Mycobacterium
TTHWGLHIDDFWWTAIW

SEQ ID NO: 346144 - protein, 17 aa, Mycobacterium
TTHWGLQIDHFWWTAIW

SEQ ID NO: 346145 - protein, 19 aa, Mycobacterium
TTLDWRLGLAGALAIPAYI

SEQ ID NO: 346146 - protein, 19 aa, Mycobacterium
TTLPPVAPWCAGPAAGVAV

SEQ ID NO: 346147 - protein, 19 aa, Mycobacterium
TTMRDLRALLLILHSTLSG

SEQ ID NO: 346148 - protein, 23 aa, Mycobacterium
TTPAHPRWWFLWTTPGRILTIGL

SEQ ID NO: 346149 - protein, 19 aa, Mycobacterium
TTPLRRFDLLAAYGTAFSL

SEQ ID NO: 346150 - protein, 19 aa, Mycobacterium
TTPLRRIDLLAGYGTAFSI

SEQ ID NO: 346151 - protein, 23 aa, Mycobacterium
TTSRLGFDLGFAVLDHTQHDVAD

SEQ ID NO: 346152 - protein, 23 aa, Mycobacterium
TTTRAGDLVTWWTGDSVMVFDAA

SEQ ID NO: 346153 - protein, 24 aa, Mycobacterium
TTVGWRIPFVASFALVAVGLWIRA

SEQ ID NO: 346154 - protein, 17 aa, Mycobacterium
TTVMARLRLFGIGVPVF

SEQ ID NO: 346155 - protein, 23 aa, Mycobacterium
TTVSACLLVFVTVWFALRDTARA

SEQ ID NO: 346156 - protein, 18 aa, Mycobacterium
TVAFAFLAMVFAKLSVFA

SEQ ID NO: 346157 - protein, 17 aa, Mycobacterium
TVALCLLGGVFGISLGK

SEQ ID NO: 346158 - protein, 18 aa, Mycobacterium
TVARRFGGSLLLYAFPAA

SEQ ID NO: 346159 - protein, 23 aa, Mycobacterium
TVGELPIIIVILIQIILISLEIL

SEQ ID NO: 346160 - protein, 18 aa, Mycobacterium
TVGLCLYGLLVGSVVHGI

SEQ ID NO: 346161 - protein, 26 aa, Mycobacterium
TVHRPRWSWRRMALVATLVVLLVVAG

SEQ ID NO: 346162 - protein, 25 aa, Mycobacterium
TVIAFAVSIPMWWLLAGQQLGNLPV

SEQ ID NO: 346163 - protein, 19 aa, Mycobacterium
TVIHLRLSLIPVLIGMAIA

SEQ ID NO: 346164 - protein, 18 aa, Mycobacterium
TVISRLTLVIGIAPILAP

SEQ ID NO: 346165 - protein, 26 aa, Mycobacterium
TVLAIVLWRWRPFRLVSGVAALAGLA

SEQ ID NO: 346166 - protein, 20 aa, Mycobacterium
TVLFFLRWVGLFWSVPSILG

SEQ ID NO: 346167 - protein, 18 aa, Mycobacterium
TVLFGWGAWQRRWIADDG

SEQ ID NO: 346168 - protein, 18 aa, Mycobacterium
TVLGASLPWTMIVTPSPG

SEQ ID NO: 346169 - protein, 21 aa, Mycobacterium
TVLLGIWAWRAIRDTPEEHPK

SEQ ID NO: 346170 - protein, 18 aa, Mycobacterium
TVLPFSWQHLSLHGSGAS

SEQ ID NO: 346171 - protein, 17 aa, Mycobacterium
TVLSWLRLFAVGRVEPA

SEQ ID NO: 346172 - protein, 27 aa, Mycobacterium
TVMGRWFWWPKRVRVRPASQMLRSVGP

SEQ ID NO: 346173 - protein, 23 aa, Mycobacterium
TVNMGGRTIIIWKKKPSTSTHTP

SEQ ID NO: 346174 - protein, 24 aa, Mycobacterium
TVRWTVAFTPQWIGWFPLRWTAFA

SEQ ID NO: 346175 - protein, 24 aa, Mycobacterium
TVSDRWGRRRVILMSLCAFVVLTI

SEQ ID NO: 346176 - protein, 19 aa, Mycobacterium
TVTDWPRYGGYAVAGVSSF

SEQ ID NO: 346177 - protein, 17 aa, Mycobacterium
TVVLGMWQHLLHRYSGQ

SEQ ID NO: 346178 - protein, 17 aa, Mycobacterium
TVVRMFLVPSVMKLLGD

SEQ ID NO: 346179 - protein, 24 aa, Mycobacterium
TVVSWRVAYQWLRQRSRSLLHAST

SEQ ID NO: 346180 - protein, 23 aa, Mycobacterium
TVWGWRNRPVWRWFVLGSAVGVV

SEQ ID NO: 346181 - protein, 19 aa, Mycobacterium
TVWSRPGTRLGFFTHMTTQ

SEQ ID NO: 346182 - protein, 20 aa, Mycobacterium
TWHWSNDVLNAWAMSVVFYG

SEQ ID NO: 346183 - protein, 24 aa, Mycobacterium
TWIGRFVSTYGWRAYALPLLVVLT

SEQ ID NO: 346184 - protein, 17 aa, Mycobacterium
TWIRFSVWMAIGVVLYF

SEQ ID NO: 346185 - protein, 23 aa, Mycobacterium
TWLGRFVSTYGWRAYALPVLIVL

SEQ ID NO: 346186 - protein, 18 aa, Mycobacterium
TWLIYRITRNVAQKRREQ

SEQ ID NO: 346187 - protein, 17 aa, Mycobacterium
TWLMIVLGVGFGLGVAL

SEQ ID NO: 346188 - protein, 17 aa, Mycobacterium
TWLRLFSIMLMFAGVTT

SEQ ID NO: 346189 - protein, 18 aa, Mycobacterium
TWLSCVGLLLTLVVSVAY

SEQ ID NO: 346190 - protein, 24 aa, Mycobacterium
TWQPWLRWVLLIGGLVVAIALTLG

SEQ ID NO: 346191 - protein, 19 aa, Mycobacterium
TWRLWRFPWQAKSPGRETI

SEQ ID NO: 346192 - protein, 19 aa, Mycobacterium
TWTLPVLGAWVIVSTWILP

SEQ ID NO: 346193 - protein, 22 aa, Mycobacterium
TWYRAGLFGGLALLPILACLAL

SEQ ID NO: 346194 - protein, 21 aa, Mycobacterium
TYALRFRWWVVIAGVAIASFT

SEQ ID NO: 346195 - protein, 25 aa, Mycobacterium
TYFTARCLRIFPGLWVCLLITAFVI

SEQ ID NO: 346196 - protein, 20 aa, Mycobacterium
TYLLLPVLRWQYRSPDFESE

SEQ ID NO: 346197 - protein, 17 aa, Mycobacterium
TYNRYWLAAAFGVTALV

SEQ ID NO: 346198 - protein, 23 aa, Mycobacterium
TYSYVMVCCAAFVNALMSIVAAA

SEQ ID NO: 346199 - protein, 18 aa, Mycobacterium
VAAACPWLVAAFVSGAVS

SEQ ID NO: 346200 - protein, 18 aa, Mycobacterium
VAAALAWYLILRRRSPHV

SEQ ID NO: 346201 - protein, 19 aa, Mycobacterium
VAACKLIMLCLWWGAAVSK

SEQ ID NO: 346202 - protein, 24 aa, Mycobacterium
VAACLRIPYSLGIATFGGRNWTVF

SEQ ID NO: 346203 - protein, 24 aa, Mycobacterium
VAAFAATVPVCWLLMGQPLGNLPT

SEQ ID NO: 346204 - protein, 21 aa, Mycobacterium
VAAFFAWFPLLFFIAYEAFFI

SEQ ID NO: 346205 - protein, 17 aa, Mycobacterium
VAAGGLLIALGFLFGGY

SEQ ID NO: 346206 - protein, 28 aa, Mycobacterium
VAAIGDRARPEWEWLKWLPHNQHPAAAD

SEQ ID NO: 346207 - protein, 21 aa, Mycobacterium
VAAILACVWLMLNLTGLTWIR

SEQ ID NO: 346208 - protein, 22 aa, Mycobacterium
VAAKRGWPILRFTSRSGSSPMA

SEQ ID NO: 346209 - protein, 22 aa, Mycobacterium
VAALLGRWFWWPLRVRPRPASY

SEQ ID NO: 346210 - protein, 26 aa, Mycobacterium
VAALLGRWFWWPQKFRSAASERRLAR

SEQ ID NO: 346211 - protein, 25 aa, Mycobacterium
VAALLGRWFWWPQLVRPRPASTMLR

SEQ ID NO: 346212 - protein, 22 aa, Mycobacterium
VAALLGRWFWWPQRVRQRPARA

SEQ ID NO: 346213 - protein, 22 aa, Mycobacterium
VAALLGRWFWWPQRVRQRPASS

SEQ ID NO: 346214 - protein, 18 aa, Mycobacterium
VAALLIVFGFAGLSAYFV

SEQ ID NO: 346215 - protein, 18 aa, Mycobacterium
VAALRLLTRFWPGPEKPG

SEQ ID NO: 346216 - protein, 24 aa, Mycobacterium
VAAPSWFAWLAVIWLWLTVLFANL

SEQ ID NO: 346217 - protein, 21 aa, Mycobacterium
VAARGGLLVRILRQFHHPLIY

SEQ ID NO: 346218 - protein, 20 aa, Mycobacterium
VAASLRWRAVLLAAVAACAA

SEQ ID NO: 346219 - protein, 18 aa, Mycobacterium
VAAVFAGAVLVVAAVTGL

SEQ ID NO: 346220 - protein, 17 aa, Mycobacterium
VACAVAIAVDATIVRLI

SEQ ID NO: 346221 - protein, 19 aa, Mycobacterium
VADETAWLWAARLGQGIGA

SEQ ID NO: 346222 - protein, 23 aa, Mycobacterium
VADVPWLLLRLRFFRRKLTVTAL

SEQ ID NO: 346223 - protein, 21 aa, Mycobacterium
VAEFWRFWVVHLWVEDFLELF

SEQ ID NO: 346224 - protein, 21 aa, Mycobacterium
VAFAARLAHRMGRVLPDGNSV

SEQ ID NO: 346225 - protein, 19 aa, Mycobacterium
VAFALAVLWLTRAGRTPKG

SEQ ID NO: 346226 - protein, 21 aa, Mycobacterium
VAFCAAVARTLVRWEPQAAGS

SEQ ID NO: 346227 - protein, 26 aa, Mycobacterium
VAFDELWRWNSIVALVLSVLVILGLV

SEQ ID NO: 346228 - protein, 27 aa, Mycobacterium
VAFDQLWKWNNIIALVLSVLVILGLVV

SEQ ID NO: 346229 - protein, 19 aa, Mycobacterium
VAFGMSWGPVVWVLLGEIF

SEQ ID NO: 346230 - protein, 19 aa, Mycobacterium
VAFGMSWGPVVWVLLGEMF

SEQ ID NO: 346231 - protein, 18 aa, Mycobacterium
VAFLCFVPLAGVSAVPAL

SEQ ID NO: 346232 - protein, 17 aa, Mycobacterium
VAFLSAMVLEMIATLSV

SEQ ID NO: 346233 - protein, 25 aa, Mycobacterium
VAFNLYWRLRYLFVTEVAFGSHDVA

SEQ ID NO: 346234 - protein, 18 aa, Mycobacterium
VAFSGMFAMLVGYDVPDV

SEQ ID NO: 346235 - protein, 18 aa, Mycobacterium
VAFSTPFQMFKRYSQFSG

SEQ ID NO: 346236 - protein, 18 aa, Mycobacterium
VAGCPIRIFDRNGRPVGP

SEQ ID NO: 346237 - protein, 26 aa, Mycobacterium
VAGIVEWPILLAVGGSALLLRRMSQR

SEQ ID NO: 346238 - protein, 17 aa, Mycobacterium
VAGLCWLSFSWPGRRAM

SEQ ID NO: 346239 - protein, 20 aa, Mycobacterium
VAGLDIFALLAIPFFILGGE

SEQ ID NO: 346240 - protein, 17 aa, Mycobacterium
VAGPLAYLVDLLAAVPS

SEQ ID NO: 346241 - protein, 19 aa, Mycobacterium
VAGPWRWNAKFLTEAVPEF

SEQ ID NO: 346242 - protein, 17 aa, Mycobacterium
VAGRALMYLGFIPPVWL

SEQ ID NO: 346243 - protein, 20 aa, Mycobacterium
VAGRPGWWAGAALALVVSLL

SEQ ID NO: 346244 - protein, 20 aa, Mycobacterium
VAGWFAGWVYMWALVIIMAT

SEQ ID NO: 346245 - protein, 20 aa, Mycobacterium
VAHCVRRFGGITGDVLGAAV

SEQ ID NO: 346246 - protein, 19 aa, Mycobacterium
VAHLRRARGRAVKPVVQLV

SEQ ID NO: 346247 - protein, 17 aa, Mycobacterium
VAIAITGVWLWLDYDAL

SEQ ID NO: 346248 - protein, 17 aa, Mycobacterium
VAIALPRSADLIVAVLA

SEQ ID NO: 346249 - protein, 19 aa, Mycobacterium
VAIATIWGWIFNDPIDVAG

SEQ ID NO: 346250 - protein, 17 aa, Mycobacterium
VAIAVLWLAALAINHSR

SEQ ID NO: 346251 - protein, 17 aa, Mycobacterium
VAIELLTGPSLVLFEDA

SEQ ID NO: 346252 - protein, 21 aa, Mycobacterium
VAIGVVLGWPLWWVSACSVLV

SEQ ID NO: 346253 - protein, 24 aa, Mycobacterium
VAILSIVGFLFVLGGLFGNPFAAA

SEQ ID NO: 346254 - protein, 23 aa, Mycobacterium
VAIMSFLFNHGWWDPARDEQPFL

SEQ ID NO: 346255 - protein, 18 aa, Mycobacterium
VAIPAVWTQWNVIGEDGY

SEQ ID NO: 346256 - protein, 19 aa, Mycobacterium
VAITLTWLVYVTLRRDVAG

SEQ ID NO: 346257 - protein, 22 aa, Mycobacterium
VAIWLGRPLIWLSFNNEKLNAA

SEQ ID NO: 346258 - protein, 20 aa, Mycobacterium
VALAGRFAGFRGLELINLGI

SEQ ID NO: 346259 - protein, 19 aa, Mycobacterium
VALCGAAVLAARSLRRRHT

SEQ ID NO: 346260 - protein, 24 aa, Mycobacterium
VALCRQRWGLVTGMVILAALLKPQ

SEQ ID NO: 346261 - protein, 17 aa, Mycobacterium
VALGVAVGMLWPGFGRS

SEQ ID NO: 346262 - protein, 19 aa, Mycobacterium
VALLAGWAIDCNTLEVLVA

SEQ ID NO: 346263 - protein, 19 aa, Mycobacterium
VALPRAWRTPKACAAVAAQ

SEQ ID NO: 346264 - protein, 17 aa, Mycobacterium
VALPVLLAWAIVRRRSG

SEQ ID NO: 346265 - protein, 20 aa, Mycobacterium
VALRCWPFALLVLLAVALIA

SEQ ID NO: 346266 - protein, 19 aa, Mycobacterium
VALWSAFRLIWALYIGMTF

SEQ ID NO: 346267 - protein, 20 aa, Mycobacterium
VAMCALALAFSRTRRWLGRG

SEQ ID NO: 346268 - protein, 18 aa, Mycobacterium
VAMLLEFLSPILVIAWTW

SEQ ID NO: 346269 - protein, 23 aa, Mycobacterium
VAMLLYIVCWWRHLRPETAAPPA

SEQ ID NO: 346270 - protein, 23 aa, Mycobacterium
VAMPWLFLRLRFFRRKWTVTALA

SEQ ID NO: 346271 - protein, 23 aa, Mycobacterium
VAMPWLFLRLRFFRRKWTVTTLA

SEQ ID NO: 346272 - protein, 17 aa, Mycobacterium
VAMVLARLPLPPVPTQG

SEQ ID NO: 346273 - protein, 24 aa, Mycobacterium
VAPADLGANCQYPAAGEASKPVEP

SEQ ID NO: 346274 - protein, 19 aa, Mycobacterium
VAPCLPGATLLDVDGDEFT

SEQ ID NO: 346275 - protein, 19 aa, Mycobacterium
VAPLVCWTCGVFGAVRGLE

SEQ ID NO: 346276 - protein, 17 aa, Mycobacterium
VAPRIRNALGFNGYSLG

SEQ ID NO: 346277 - protein, 17 aa, Mycobacterium
VAPRLGAWVVAAWLAGI

SEQ ID NO: 346278 - protein, 17 aa, Mycobacterium
VAQLGVACAVAIAVDAT

SEQ ID NO: 346279 - protein, 18 aa, Mycobacterium
VAQLGVACAVAIAVDATI

SEQ ID NO: 346280 - protein, 18 aa, Mycobacterium
VAQLGVACAVAIAVDATV

SEQ ID NO: 346281 - protein, 20 aa, Mycobacterium
VAQPCPFGWPAPGPDEQGGL

SEQ ID NO: 346282 - protein, 17 aa, Mycobacterium
VARELLRLPGVSKIVQV

SEQ ID NO: 346283 - protein, 24 aa, Mycobacterium
VARLTRWTAVFPWAAMHSLRGTKG

SEQ ID NO: 346284 - protein, 26 aa, Mycobacterium
VARLWRGFLLFFSRWWQLETLYRSNM

SEQ ID NO: 346285 - protein, 18 aa, Mycobacterium
VARRHPWLLAFVGLALGY

SEQ ID NO: 346286 - protein, 23 aa, Mycobacterium
VASLAVSGFLGWRQWQDHQVKLA

SEQ ID NO: 346287 - protein, 23 aa, Mycobacterium
VASLAVSGFLGWRQWQDHRVRLA

SEQ ID NO: 346288 - protein, 17 aa, Mycobacterium
VASPILKSGLCLVDTPG

SEQ ID NO: 346289 - protein, 18 aa, Mycobacterium
VASTVLWVSEIRKLVLRR

SEQ ID NO: 346290 - protein, 19 aa, Mycobacterium
VATICAVLLLLAGGAVAAG

SEQ ID NO: 346291 - protein, 18 aa, Mycobacterium
VATLGSWIVVGGSIGAAF

SEQ ID NO: 346292 - protein, 23 aa, Mycobacterium
VATLLGRWFWWPLRVRPRPASQM

SEQ ID NO: 346293 - protein, 18 aa, Mycobacterium
VATLWLFAIGWAAARATR

SEQ ID NO: 346294 - protein, 19 aa, Mycobacterium
VATSVVWWGWRERRDLFSG

SEQ ID NO: 346295 - protein, 18 aa, Mycobacterium
VAVALATVMLSRRGRQGI

SEQ ID NO: 346296 - protein, 17 aa, Mycobacterium
VAVALGAVWLGRIRPAP

SEQ ID NO: 346297 - protein, 23 aa, Mycobacterium
VAVARWRGLRALIGIVVAFGVLV

SEQ ID NO: 346298 - protein, 17 aa, Mycobacterium
VAVARWRGLRALVGIVI

SEQ ID NO: 346299 - protein, 19 aa, Mycobacterium
VAVAVLVDFAAKRTREARR

SEQ ID NO: 346300 - protein, 20 aa, Mycobacterium
VAVGGVWAWIAPPIHAVVAL

SEQ ID NO: 346301 - protein, 17 aa, Mycobacterium
VAVGLWVENNRTVDDIP

SEQ ID NO: 346302 - protein, 19 aa, Mycobacterium
VAVGMLWPGFGRSVGVLGE

SEQ ID NO: 346303 - protein, 17 aa, Mycobacterium
VAVGMTWATASDLELPP

SEQ ID NO: 346304 - protein, 19 aa, Mycobacterium
VAVGYALSRWVNRHLDRNR

SEQ ID NO: 346305 - protein, 27 aa, Mycobacterium
VAVIAGALGMWWTLRGGYAEWWQHLSG

SEQ ID NO: 346306 - protein, 19 aa, Mycobacterium
VAVIFCWIGMVLAISFLEA

SEQ ID NO: 346307 - protein, 24 aa, Mycobacterium
VAVKVDWPHFWSLITSPSSLTALA

SEQ ID NO: 346308 - protein, 18 aa, Mycobacterium
VAVLLAWIALYVRVSAPI

SEQ ID NO: 346309 - protein, 18 aa, Mycobacterium
VAVLLSFFSAQLVTTLFY

SEQ ID NO: 346310 - protein, 17 aa, Mycobacterium
VAVPAAKTWEVLTDVRR

SEQ ID NO: 346311 - protein, 19 aa, Mycobacterium
VAVPSAKVWEMFTDGERVA

SEQ ID NO: 346312 - protein, 19 aa, Mycobacterium
VAVSREFSAIIAGGIAPFV

SEQ ID NO: 346313 - protein, 18 aa, Mycobacterium
VAVTPKWVGWLPLRWTAF

SEQ ID NO: 346314 - protein, 19 aa, Mycobacterium
VAWLRLAWAGILFLIIVRP

SEQ ID NO: 346315 - protein, 17 aa, Mycobacterium
VAWRLFGHIPYRIDIDI

SEQ ID NO: 346316 - protein, 20 aa, Mycobacterium
VAYAGIWWPGGVVRWVAADG

SEQ ID NO: 346317 - protein, 17 aa, Mycobacterium
VAYCHRHRIDVINVTPT

SEQ ID NO: 346318 - protein, 18 aa, Mycobacterium
VCALAALLCAVWVRDPSR

SEQ ID NO: 346319 - protein, 17 aa, Mycobacterium
VCALFPLLALPVVPSEA

SEQ ID NO: 346320 - protein, 20 aa, Mycobacterium
VCAPLAIAVMWRWILAPTDG

SEQ ID NO: 346321 - protein, 23 aa, Mycobacterium
VCGARWARTGLRDFDGLYRAAVY

SEQ ID NO: 346322 - protein, 17 aa, Mycobacterium
VCGLFPLLAWPIVPQHT

SEQ ID NO: 346323 - protein, 17 aa, Mycobacterium
VCLIGLSGGYVFSVFLQ

SEQ ID NO: 346324 - protein, 17 aa, Mycobacterium
VCMIWRLLSQGLGSQPV

SEQ ID NO: 346325 - protein, 17 aa, Mycobacterium
VCRRWQLQYSRRLRVTD

SEQ ID NO: 346326 - protein, 17 aa, Mycobacterium
VCTFGSWIGFSFAFGQV

SEQ ID NO: 346327 - protein, 18 aa, Mycobacterium
VCTLGLIAMLAIFADLRF

SEQ ID NO: 346328 - protein, 18 aa, Mycobacterium
VCVLAVLVLLRFLTPWGR

SEQ ID NO: 346329 - protein, 18 aa, Mycobacterium
VCVVLRLARFNALLDDGT

SEQ ID NO: 346330 - protein, 18 aa, Mycobacterium
VCVVLRLARYNALLEDGS

SEQ ID NO: 346331 - protein, 17 aa, Mycobacterium
VCVVLRLARYNAQLDDG

SEQ ID NO: 346332 - protein, 19 aa, Mycobacterium
VDAGLWVAFWFFLAQLNFV

SEQ ID NO: 346333 - protein, 21 aa, Mycobacterium
VDAIICFIGFLFPLWDAKRQT

SEQ ID NO: 346334 - protein, 21 aa, Mycobacterium
VDAIICFIGFLFPLWDSKRQT

SEQ ID NO: 346335 - protein, 23 aa, Mycobacterium
VDALEWLALIAMAPLACWICGLY

SEQ ID NO: 346336 - protein, 21 aa, Mycobacterium
VDALVCARLLAAYGAGDGTDR

SEQ ID NO: 346337 - protein, 19 aa, Mycobacterium
VDASWRFRYRRSRSVANSF

SEQ ID NO: 346338 - protein, 26 aa, Mycobacterium
VDAWRSRLWPVPALGVVFAIVAGVAL

SEQ ID NO: 346339 - protein, 17 aa, Mycobacterium
VDDMLAWTTLFIVAMVL

SEQ ID NO: 346340 - protein, 21 aa, Mycobacterium
VDFKGGATFLGLDRAQHVAAI

SEQ ID NO: 346341 - protein, 18 aa, Mycobacterium
VDGFTRWQAFRMVVLPQV

SEQ ID NO: 346342 - protein, 18 aa, Mycobacterium
VDGGSLWGGVGFVAGQWM

SEQ ID NO: 346343 - protein, 17 aa, Mycobacterium
VDGREVWNTYGPTEATV

SEQ ID NO: 346344 - protein, 17 aa, Mycobacterium
VDHRLHPALNLVSARLI

SEQ ID NO: 346345 - protein, 19 aa, Mycobacterium
VDIMPTWLRWLSAVNPLSY

SEQ ID NO: 346346 - protein, 17 aa, Mycobacterium
VDIPGLGWYRVVSHPGD

SEQ ID NO: 346347 - protein, 20 aa, Mycobacterium
VDLREGAVVRALRLEDVTPV

SEQ ID NO: 346348 - protein, 19 aa, Mycobacterium
VDLRHPAVVRALRLDGVVP

SEQ ID NO: 346349 - protein, 25 aa, Mycobacterium
VDLRPGVLCAIALNLLAGVRMVEDD

SEQ ID NO: 346350 - protein, 17 aa, Mycobacterium
VDLRPHVWITRVPFVVF

SEQ ID NO: 346351 - protein, 19 aa, Mycobacterium
VDLRWWPLALLIGLTLALV

SEQ ID NO: 346352 - protein, 17 aa, Mycobacterium
VDMGEGFGMPNSVSPDK

SEQ ID NO: 346353 - protein, 18 aa, Mycobacterium
VDNKRIWANLDCAPSQES

SEQ ID NO: 346354 - protein, 20 aa, Mycobacterium
VDNWVRRLLALPAFPDGSAD

SEQ ID NO: 346355 - protein, 17 aa, Mycobacterium
VDPELLGGLSITVGDEV

SEQ ID NO: 346356 - protein, 20 aa, Mycobacterium
VDPVPDWPAPVAPPLTPNLL

SEQ ID NO: 346357 - protein, 17 aa, Mycobacterium
VDPVRRLAAPRVLAATV

SEQ ID NO: 346358 - protein, 23 aa, Mycobacterium
VDTVPLVVGWLWPLWDPDRRTFA

SEQ ID NO: 346359 - protein, 19 aa, Mycobacterium
VDTWRQWWFAWQATAGEHI

SEQ ID NO: 346360 - protein, 18 aa, Mycobacterium
VDVAEIWDIRNRGVIPPG

SEQ ID NO: 346361 - protein, 18 aa, Mycobacterium
VDWLQAWWAHYGRQRNFV

SEQ ID NO: 346362 - protein, 18 aa, Mycobacterium
VEARLALGLPSRQAAAPY

SEQ ID NO: 346363 - protein, 22 aa, Mycobacterium
VEDRARKGLSIVIAPEGTRVDT

SEQ ID NO: 346364 - protein, 25 aa, Mycobacterium
VEFSAYMAIPWLAAVAVEFALLSWL

SEQ ID NO: 346365 - protein, 23 aa, Mycobacterium
VEFSGLIAWFAWLVLHLVYLVGF

SEQ ID NO: 346366 - protein, 24 aa, Mycobacterium
VEGPLRLGHWVLFAAVSVPAVGAM

SEQ ID NO: 346367 - protein, 23 aa, Mycobacterium
VEISGFIAWLAWLVLHLVYLVGF

SEQ ID NO: 346368 - protein, 20 aa, Mycobacterium
VELPRAMFFIGILYVVVATV

SEQ ID NO: 346369 - protein, 20 aa, Mycobacterium
VEMPNALPLILGGLRSATLQ

SEQ ID NO: 346370 - protein, 22 aa, Mycobacterium
VESACALFACLALLIVASSQLS

SEQ ID NO: 346371 - protein, 23 aa, Mycobacterium
VETCRIIPIIVTFGIGVGVLLTL

SEQ ID NO: 346372 - protein, 22 aa, Mycobacterium
VEVVDGIVLRDGRPFEMADTDL

SEQ ID NO: 346373 - protein, 19 aa, Mycobacterium
VFCGLLWWAAFGLQSAELV

SEQ ID NO: 346374 - protein, 19 aa, Mycobacterium
VFCGLLWWIAFGLHDKLLA

SEQ ID NO: 346375 - protein, 19 aa, Mycobacterium
VFFPWNLYFGFRIPGSSNY

SEQ ID NO: 346376 - protein, 19 aa, Mycobacterium
VFGAYPWAGWLAFAATVPV

SEQ ID NO: 346377 - protein, 20 aa, Mycobacterium
VFGQIRFDRTYAYSAEFSNA

SEQ ID NO: 346378 - protein, 22 aa, Mycobacterium
VFGSRLRRGWQFIGLIIVGAAF

SEQ ID NO: 346379 - protein, 21 aa, Mycobacterium
VFKPLRLRATASIAEFDERRR

SEQ ID NO: 346380 - protein, 17 aa, Mycobacterium
VFLFWPWEYKPFGDPGN

SEQ ID NO: 346381 - protein, 18 aa, Mycobacterium
VFLKLMLRWLNAFVPKPG

SEQ ID NO: 346382 - protein, 20 aa, Mycobacterium
VFMGYPFFRGALRSIRSGRA

SEQ ID NO: 346383 - protein, 25 aa, Mycobacterium
VFQWGLGHEIAWPVPLLAFIILVAV

SEQ ID NO: 346384 - protein, 17 aa, Mycobacterium
VFRGEFFSSALINSIGV

SEQ ID NO: 346385 - protein, 18 aa, Mycobacterium
VFSALTFITLAIFLGAGT

SEQ ID NO: 346386 - protein, 19 aa, Mycobacterium
VFSGLRWVALVALAAAVAG

SEQ ID NO: 346387 - protein, 23 aa, Mycobacterium
VFSRRWAKLWLPITAGVYTANGL

SEQ ID NO: 346388 - protein, 19 aa, Mycobacterium
VFTEAPWWITFVVVPSYIV

SEQ ID NO: 346389 - protein, 22 aa, Mycobacterium
VFVPEIPRLPSGKVLRRVLKER

SEQ ID NO: 346390 - protein, 20 aa, Mycobacterium
VGAAGWPWLAGLGFAQLFSQ

SEQ ID NO: 346391 - protein, 20 aa, Mycobacterium
VGAALAFLVARSFSSGCAAL

SEQ ID NO: 346392 - protein, 20 aa, Mycobacterium
VGAAVVWWGWRERRDLFSGF

SEQ ID NO: 346393 - protein, 20 aa, Mycobacterium
VGAFMLFSWFRTRSRRRAEI

SEQ ID NO: 346394 - protein, 20 aa, Mycobacterium
VGAFVLRFLLKVKPIKERLP

SEQ ID NO: 346395 - protein, 26 aa, Mycobacterium
VGALAVFCAACWLIALLAHNYRHEDW

SEQ ID NO: 346396 - protein, 24 aa, Mycobacterium
VGALSLVQCLNWPSGSAPQDPKEL

SEQ ID NO: 346397 - protein, 19 aa, Mycobacterium
VGAVPFHFWVPDVYQGAPT

SEQ ID NO: 346398 - protein, 18 aa, Mycobacterium
VGAWFRSGYSLLFLAVPL

SEQ ID NO: 346399 - protein, 20 aa, Mycobacterium
VGAWLNWKFVAPRLRAYTEI

SEQ ID NO: 346400 - protein, 17 aa, Mycobacterium
VGCGALIGLERQWRARM

SEQ ID NO: 346401 - protein, 18 aa, Mycobacterium
VGCGFAFAPLGPVAGPWS

SEQ ID NO: 346402 - protein, 18 aa, Mycobacterium
VGCGVDIVALKPVLEVAT

SEQ ID NO: 346403 - protein, 18 aa, Mycobacterium
VGDAFSWAWNKFSKHAVE

SEQ ID NO: 346404 - protein, 21 aa, Mycobacterium
VGDGRTAITFVLRDDNADANS

SEQ ID NO: 346405 - protein, 19 aa, Mycobacterium
VGDRYGRRGALLIGLAIFS

SEQ ID NO: 346406 - protein, 18 aa, Mycobacterium
VGEAISWAWNKFTKNVAA

SEQ ID NO: 346407 - protein, 17 aa, Mycobacterium
VGFIPFVIAMGIGLGIS

SEQ ID NO: 346408 - protein, 18 aa, Mycobacterium
VGFIPFVIAMGIGLGISS

SEQ ID NO: 346409 - protein, 17 aa, Mycobacterium
VGFIPFVIAMGIGLGVS

SEQ ID NO: 346410 - protein, 17 aa, Mycobacterium
VGFVCLFILSGVGNGSI

SEQ ID NO: 346411 - protein, 25 aa, Mycobacterium
VGGCARIPYTLGIAAFGGRNWTTFS

SEQ ID NO: 346412 - protein, 20 aa, Mycobacterium
VGGLLIQWVGWRAVFWINLP

SEQ ID NO: 346413 - protein, 19 aa, Mycobacterium
VGGTRWWSPRTWPLRARLV

SEQ ID NO: 346414 - protein, 20 aa, Mycobacterium
VGGWVIMWLIMTGFPELHAQ

SEQ ID NO: 346415 - protein, 17 aa, Mycobacterium
VGHPWQVFGVLWLYCLA

SEQ ID NO: 346416 - protein, 17 aa, Mycobacterium
VGIALVFLVARSFSSGC

SEQ ID NO: 346417 - protein, 25 aa, Mycobacterium
VGIGISEAVLWFIRRWLVARATMGV

SEQ ID NO: 346418 - protein, 19 aa, Mycobacterium
VGLAFALGMLLTFTLMVGP

SEQ ID NO: 346419 - protein, 19 aa, Mycobacterium
VGLALGVAVAVCFVTGLIS

SEQ ID NO: 346420 - protein, 18 aa, Mycobacterium
VGLDIYWRNARTHTTHDP

SEQ ID NO: 346421 - protein, 23 aa, Mycobacterium
VGLFDTWPGLILPYITFALPLAI

SEQ ID NO: 346422 - protein, 19 aa, Mycobacterium
VGLGCGFGPLNNRFFPPLG

SEQ ID NO: 346423 - protein, 22 aa, Mycobacterium
VGLGMSVARGFVEAMGGTITAT

SEQ ID NO: 346424 - protein, 19 aa, Mycobacterium
VGLKYRLGFDDSLDVVGVH

SEQ ID NO: 346425 - protein, 24 aa, Mycobacterium
VGLMLVALFGWHAWHRADHPLLDL

SEQ ID NO: 346426 - protein, 23 aa, Mycobacterium
VGLPCRGDAAADVFAFLLRGIGF

SEQ ID NO: 346427 - protein, 18 aa, Mycobacterium
VGLPLHWLILPLTFIILV

SEQ ID NO: 346428 - protein, 19 aa, Mycobacterium
VGLQAGLGCLLVWLTRAPV

SEQ ID NO: 346429 - protein, 21 aa, Mycobacterium
VGLRMSVQFLRRIAFSAFAFT

SEQ ID NO: 346430 - protein, 22 aa, Mycobacterium
VGLRMSVSFLRRIAFSGFAFTI

SEQ ID NO: 346431 - protein, 18 aa, Mycobacterium
VGLTLLWPLADRPRLAPG

SEQ ID NO: 346432 - protein, 18 aa, Mycobacterium
VGLVVLWRLLSRSRQEVE

SEQ ID NO: 346433 - protein, 17 aa, Mycobacterium
VGMAFVWSPLAATATRN

SEQ ID NO: 346434 - protein, 17 aa, Mycobacterium
VGMAFVWSPLTATATRN

SEQ ID NO: 346435 - protein, 17 aa, Mycobacterium
VGMCSFAPGSHRGAVPT

SEQ ID NO: 346436 - protein, 17 aa, Mycobacterium
VGMGVAWICVISAEMIS

SEQ ID NO: 346437 - protein, 19 aa, Mycobacterium
VGNTVGWRFALAGWIVTAG

SEQ ID NO: 346438 - protein, 20 aa, Mycobacterium
VGPAWRPASTVAVWAAAAAL

SEQ ID NO: 346439 - protein, 18 aa, Mycobacterium
VGPPRFGAGAKKLRSGKF

SEQ ID NO: 346440 - protein, 17 aa, Mycobacterium
VGPRPLVRALLYHPQRG

SEQ ID NO: 346441 - protein, 19 aa, Mycobacterium
VGQFIRRLFSFLVRQLDRI

SEQ ID NO: 346442 - protein, 19 aa, Mycobacterium
VGQQCARRALPPAAAMVKL

SEQ ID NO: 346443 - protein, 25 aa, Mycobacterium
VGQVWRSPLAWGMAGMFGMTSLVTY

SEQ ID NO: 346444 - protein, 22 aa, Mycobacterium
VGRAVSFLAPWLFFMFIDIFGT

SEQ ID NO: 346445 - protein, 17 aa, Mycobacterium
VGRNWPVLHAFRTVGVS

SEQ ID NO: 346446 - protein, 18 aa, Mycobacterium
VGSAVAWGIVTVSIKPVA

SEQ ID NO: 346447 - protein, 21 aa, Mycobacterium
VGSCLRIPYTLATATFGGRNW

SEQ ID NO: 346448 - protein, 17 aa, Mycobacterium
VGSFPFVCSMNMISGTL

SEQ ID NO: 346449 - protein, 24 aa, Mycobacterium
VGSLRPSLSWLWPSGLDFGTQMAP

SEQ ID NO: 346450 - protein, 22 aa, Mycobacterium
VGSRFGPYELVRLIGRGGMGEV

SEQ ID NO: 346451 - protein, 23 aa, Mycobacterium
VGSRRIRWPAVAIGVAGVAVILV

SEQ ID NO: 346452 - protein, 21 aa, Mycobacterium
VGTAVVRWPIPIILVTGLVAA

SEQ ID NO: 346453 - protein, 23 aa, Mycobacterium
VGTGIPFLLGLAFGPQLIRPSLA

SEQ ID NO: 346454 - protein, 17 aa, Mycobacterium
VGTRVCWNDDLRAGQLR

SEQ ID NO: 346455 - protein, 17 aa, Mycobacterium
VGVDVAEIWDIRNRGVI

SEQ ID NO: 346456 - protein, 17 aa, Mycobacterium
VGVGLTAFILADYCWAM

SEQ ID NO: 346457 - protein, 18 aa, Mycobacterium
VGVRLPMVIGASYTGIAP

SEQ ID NO: 346458 - protein, 22 aa, Mycobacterium
VGVTEAVLWFIRRWLVARATMG

SEQ ID NO: 346459 - protein, 19 aa, Mycobacterium
VGWGTLWPFLSWLTTHFVV

SEQ ID NO: 346460 - protein, 17 aa, Mycobacterium
VGWLYWYFWVIVVGFEA

SEQ ID NO: 346461 - protein, 20 aa, Mycobacterium
VGWSCCLLWSFLVMPLLNTG

SEQ ID NO: 346462 - protein, 18 aa, Mycobacterium
VGYKWLIVSGCLLRTAGF

SEQ ID NO: 346463 - protein, 18 aa, Mycobacterium
VHAAVPFYGVYDFTRFDD

SEQ ID NO: 346464 - protein, 24 aa, Mycobacterium
VHIAIKIPTMWSGLRSISPRDVLR

SEQ ID NO: 346465 - protein, 17 aa, Mycobacterium
VHTWRAAALRNRQQAGS

SEQ ID NO: 346466 - protein, 19 aa, Mycobacterium
VIACGLLLLIWVTRVPVPV

SEQ ID NO: 346467 - protein, 17 aa, Mycobacterium
VIACGYILFSLPWITWI

SEQ ID NO: 346468 - protein, 18 aa, Mycobacterium
VIAIAVTTLGVWLGAGYP

SEQ ID NO: 346469 - protein, 17 aa, Mycobacterium
VIALAVATLGFWLGTGG

SEQ ID NO: 346470 - protein, 22 aa, Mycobacterium
VIALCLFAWVESRAAAPILPTR

SEQ ID NO: 346471 - protein, 18 aa, Mycobacterium
VIALSVATLGSWIVVGGS

SEQ ID NO: 346472 - protein, 17 aa, Mycobacterium
VIALVFWGPYLVAVAHA

SEQ ID NO: 346473 - protein, 22 aa, Mycobacterium
VIARSYLRLRVHRWEFNEVALY

SEQ ID NO: 346474 - protein, 23 aa, Mycobacterium
VIAWYDWRSAVIVAIALPLIPIF

SEQ ID NO: 346475 - protein, 18 aa, Mycobacterium
VIEFAEKLLIPWHSSRRT

SEQ ID NO: 346476 - protein, 18 aa, Mycobacterium
VIFAIRWRRDEELESVKR

SEQ ID NO: 346477 - protein, 24 aa, Mycobacterium
VIFLPLLIIMGAFMFFASRRQKKA

SEQ ID NO: 346478 - protein, 18 aa, Mycobacterium
VIGCTTWLPFLVRAARSP

SEQ ID NO: 346479 - protein, 18 aa, Mycobacterium
VIGSLTFFDLIFVLTGGG

SEQ ID NO: 346480 - protein, 18 aa, Mycobacterium
VIIKRGLLKWAWIPGVPL

SEQ ID NO: 346481 - protein, 17 aa, Mycobacterium
VIIRFWLLTAIACGLGV

SEQ ID NO: 346482 - protein, 17 aa, Mycobacterium
VIIRFWLLTAISCGLGV

SEQ ID NO: 346483 - protein, 17 aa, Mycobacterium
VIIRFWLLTAITCGLGV

SEQ ID NO: 346484 - protein, 25 aa, Mycobacterium
VIKRRGKYWWIRWAILIVLAIVLAV

SEQ ID NO: 346485 - protein, 21 aa, Mycobacterium
VILAHFMWRRRVPDAEPRIVG

SEQ ID NO: 346486 - protein, 19 aa, Mycobacterium
VILDVCWVPLLAVLAPALI

SEQ ID NO: 346487 - protein, 19 aa, Mycobacterium
VILGWRPVLLVPLTFALFT

SEQ ID NO: 346488 - protein, 18 aa, Mycobacterium
VILTRLWESGLKPKGGPK

SEQ ID NO: 346489 - protein, 20 aa, Mycobacterium
VILYCVVRFALGMHAVHPAA

SEQ ID NO: 346490 - protein, 18 aa, Mycobacterium
VIMSPNLVAARFIQLTPA

SEQ ID NO: 346491 - protein, 17 aa, Mycobacterium
VIPAVAGLLSWLLLGQR

SEQ ID NO: 346492 - protein, 20 aa, Mycobacterium
VIPRWPELMGETSPTLGTVL

SEQ ID NO: 346493 - protein, 17 aa, Mycobacterium
VIQGIAIGGEWGGATLM

SEQ ID NO: 346494 - protein, 24 aa, Mycobacterium
VIQRCARTPLATGLEVRAAGFIAI

SEQ ID NO: 346495 - protein, 17 aa, Mycobacterium
VIRLRLAPWDVICTVAL

SEQ ID NO: 346496 - protein, 24 aa, Mycobacterium
VISDRGYFAFLMLLPFIMGILSLS

SEQ ID NO: 346497 - protein, 17 aa, Mycobacterium
VIVAHAFSNEGFVAYAV

SEQ ID NO: 346498 - protein, 19 aa, Mycobacterium
VIVAIRIARRAMRSSRGGD

SEQ ID NO: 346499 - protein, 28 aa, Mycobacterium
VIVGALGMWWTFRGGYAGWWQQLSGESQ

SEQ ID NO: 346500 - protein, 17 aa, Mycobacterium
VIWKGLVSHVLIPAVVA

SEQ ID NO: 346501 - protein, 18 aa, Mycobacterium
VIWLLWAVLWFMLFLLLG

SEQ ID NO: 346502 - protein, 23 aa, Mycobacterium
VKAEVFRPLSFRRRITNGAATIF

SEQ ID NO: 346503 - protein, 17 aa, Mycobacterium
VKKGATFTCDVSIDGTK

SEQ ID NO: 346504 - protein, 23 aa, Mycobacterium
VKPPRLYKAAAWVVIVAGIVFII

SEQ ID NO: 346505 - protein, 25 aa, Mycobacterium
VKQARTALWAAIGFVSVYLLICLGI

SEQ ID NO: 346506 - protein, 17 aa, Mycobacterium
VKRALAWVKAHIAEYGG

SEQ ID NO: 346507 - protein, 18 aa, Mycobacterium
VKRALAWVKQHIAEYGGD

SEQ ID NO: 346508 - protein, 18 aa, Mycobacterium
VKRPLVFGAVSGLAVATV

SEQ ID NO: 346509 - protein, 22 aa, Mycobacterium
VKSAWDLLWRYGGQYVATVLAP

SEQ ID NO: 346510 - protein, 22 aa, Mycobacterium
VKSSDAIERWARNLNRLGAQSA

SEQ ID NO: 346511 - protein, 17 aa, Mycobacterium
VKVDWPNFWSLITSSSS

SEQ ID NO: 346512 - protein, 19 aa, Mycobacterium
VKVVPAILIALLLLSGGGA

SEQ ID NO: 346513 - protein, 18 aa, Mycobacterium
VLAACLGFIYGPVAPIAN

SEQ ID NO: 346514 - protein, 18 aa, Mycobacterium
VLAAMPWLVASGLGAAVP

SEQ ID NO: 346515 - protein, 22 aa, Mycobacterium
VLACPVWFYELWAFITPGLYQK

SEQ ID NO: 346516 - protein, 18 aa, Mycobacterium
VLAFRGAGAWALVSQLVI

SEQ ID NO: 346517 - protein, 17 aa, Mycobacterium
VLAGLVGMCSFAPGSHR

SEQ ID NO: 346518 - protein, 18 aa, Mycobacterium
VLAGYLARIPDCKVTIGE

SEQ ID NO: 346519 - protein, 17 aa, Mycobacterium
VLALSVATLAVWLLTGH

SEQ ID NO: 346520 - protein, 25 aa, Mycobacterium
VLAPRLEPVAAFLNRHLGWFFLFKQ

SEQ ID NO: 346521 - protein, 23 aa, Mycobacterium
VLARISPLLSRHPWAIDQFVTRF

SEQ ID NO: 346522 - protein, 18 aa, Mycobacterium
VLASLCFMIGWGGVMLVV

SEQ ID NO: 346523 - protein, 28 aa, Mycobacterium
VLAVALWRFRWFRLATSWALVAALGCLL

SEQ ID NO: 346524 - protein, 17 aa, Mycobacterium
VLAVGGWMAAQGTITVG

SEQ ID NO: 346525 - protein, 18 aa, Mycobacterium
VLAVIWFWLLKRYIVEGP

SEQ ID NO: 346526 - protein, 18 aa, Mycobacterium
VLAVIWFWLLKRYVVEGP

SEQ ID NO: 346527 - protein, 20 aa, Mycobacterium
VLCRRRWRPALLMAGLTALA

SEQ ID NO: 346528 - protein, 18 aa, Mycobacterium
VLCVIAWPMRSAPASAPT

SEQ ID NO: 346529 - protein, 22 aa, Mycobacterium
VLDHFPGWDFGWLDLDKMIRGA

SEQ ID NO: 346530 - protein, 18 aa, Mycobacterium
VLDNKIWIMGGVREGVGL

SEQ ID NO: 346531 - protein, 24 aa, Mycobacterium
VLEGLRFFWNIKILRTIALVDMAI

SEQ ID NO: 346532 - protein, 17 aa, Mycobacterium
VLEPSSFSRWVTNPVRQ

SEQ ID NO: 346533 - protein, 17 aa, Mycobacterium
VLFAFPLVLLAIALSAV

SEQ ID NO: 346534 - protein, 21 aa, Mycobacterium
VLFGGRVSWIALLTLALVAVL

SEQ ID NO: 346535 - protein, 23 aa, Mycobacterium
VLFGRLGDMYGRVRIYNIGFVVF

SEQ ID NO: 346536 - protein, 24 aa, Mycobacterium
VLFGRLGDMYGRVRIYNMGFVVFT

SEQ ID NO: 346537 - protein, 17 aa, Mycobacterium
VLFPIVWIALASVKTPE

SEQ ID NO: 346538 - protein, 18 aa, Mycobacterium
VLFRKELRANHVHIEEVM

SEQ ID NO: 346539 - protein, 17 aa, Mycobacterium
VLFTIVWWNIDHDRTNW

SEQ ID NO: 346540 - protein, 18 aa, Mycobacterium
VLGAEIALGFALTAPIVH

SEQ ID NO: 346541 - protein, 18 aa, Mycobacterium
VLGDKIWIMGGLRDGVAL

SEQ ID NO: 346542 - protein, 22 aa, Mycobacterium
VLGLAGLVAFLGYRVHQSQQTE

SEQ ID NO: 346543 - protein, 24 aa, Mycobacterium
VLGLRGRRPVSWDAPITVANNRSG

SEQ ID NO: 346544 - protein, 19 aa, Mycobacterium
VLGSISWRGPFFGVSALMA

SEQ ID NO: 346545 - protein, 18 aa, Mycobacterium
VLGVLPLIALTQIGIIVG

SEQ ID NO: 346546 - protein, 18 aa, Mycobacterium
VLGVLPLIVLTQLGTIVG

SEQ ID NO: 346547 - protein, 18 aa, Mycobacterium
VLGVLPLIVLTQVGIIVG

SEQ ID NO: 346548 - protein, 19 aa, Mycobacterium
VLGVPGWVTQRLWWALLLT

SEQ ID NO: 346549 - protein, 18 aa, Mycobacterium
VLIALAITGFGARSAAKK

SEQ ID NO: 346550 - protein, 17 aa, Mycobacterium
VLIELAFSFVVLFVPPV

SEQ ID NO: 346551 - protein, 17 aa, Mycobacterium
VLIFRWLLLTGTFACAM

SEQ ID NO: 346552 - protein, 23 aa, Mycobacterium
VLIGWASGLGFGWIYTLGTANAV

SEQ ID NO: 346553 - protein, 25 aa, Mycobacterium
VLIGWSAACAFAYLRGFGRRPAWVI

SEQ ID NO: 346554 - protein, 24 aa, Mycobacterium
VLIGWSAACAVAYLRGFGRRPAWV

SEQ ID NO: 346555 - protein, 20 aa, Mycobacterium
VLILLRIPIALALALAAVFE

SEQ ID NO: 346556 - protein, 20 aa, Mycobacterium
VLILPFIGLWAMIATLRAGF

SEQ ID NO: 346557 - protein, 18 aa, Mycobacterium
VLKKRVAGFIGQEAMHGR

SEQ ID NO: 346558 - protein, 19 aa, Mycobacterium
VLLCGGLVGPIFLVVYFVM

SEQ ID NO: 346559 - protein, 18 aa, Mycobacterium
VLLCIAEARPFVLLPKFE

SEQ ID NO: 346560 - protein, 20 aa, Mycobacterium
VLLFCIAFGLAMDYEVFLVS

SEQ ID NO: 346561 - protein, 23 aa, Mycobacterium
VLLFCIAFGLSMDYEVFLIARIR

SEQ ID NO: 346562 - protein, 20 aa, Mycobacterium
VLLGECGMALAFDRDKLPDL

SEQ ID NO: 346563 - protein, 23 aa, Mycobacterium
VLLHLAAEGWTRWSATVCAALAE

SEQ ID NO: 346564 - protein, 17 aa, Mycobacterium
VLLNADWTWARSALDQT

SEQ ID NO: 346565 - protein, 17 aa, Mycobacterium
VLLRFSLRTPPVFRSGA

SEQ ID NO: 346566 - protein, 19 aa, Mycobacterium
VLLRFWDWHAIFWSLGAAG

SEQ ID NO: 346567 - protein, 19 aa, Mycobacterium
VLLSYSGSLAFIAGFVNAV

SEQ ID NO: 346568 - protein, 18 aa, Mycobacterium
VLLTHQWQLVFVAAALLG

SEQ ID NO: 346569 - protein, 21 aa, Mycobacterium
VLLVTSWLLAKSMGYLDRGVQ

SEQ ID NO: 346570 - protein, 19 aa, Mycobacterium
VLLYLLPLILGRWRGETTH

SEQ ID NO: 346571 - protein, 18 aa, Mycobacterium
VLMMLWRVAAPPFFQGQT

SEQ ID NO: 346572 - protein, 18 aa, Mycobacterium
VLMSVWWWRRKWPSRNQS

SEQ ID NO: 346573 - protein, 22 aa, Mycobacterium
VLNGAWSWLFFRFHKLGASALG

SEQ ID NO: 346574 - protein, 17 aa, Mycobacterium
VLPALQFGFWLLQDSSM

SEQ ID NO: 346575 - protein, 18 aa, Mycobacterium
VLPIASICACVWLMVNLT

SEQ ID NO: 346576 - protein, 18 aa, Mycobacterium
VLPLLPLQEGMYFHSMFG

SEQ ID NO: 346577 - protein, 17 aa, Mycobacterium
VLPRLGPAVAGSRAAMW

SEQ ID NO: 346578 - protein, 28 aa, Mycobacterium
VLPRPQWNPPRPAWTWPNQRPDVDDDSD

SEQ ID NO: 346579 - protein, 20 aa, Mycobacterium
VLPSMEWIPFVTFLQVSADM

SEQ ID NO: 346580 - protein, 20 aa, Mycobacterium
VLQPWLGMLGHLVVAGPIPR

SEQ ID NO: 346581 - protein, 23 aa, Mycobacterium
VLRAPEFYPWLLAALAGMIFQQS

SEQ ID NO: 346582 - protein, 23 aa, Mycobacterium
VLRNWPAWLAIYGFMTMDRWLLG

SEQ ID NO: 346583 - protein, 18 aa, Mycobacterium
VLRRACLDAQWIQRQVTD

SEQ ID NO: 346584 - protein, 19 aa, Mycobacterium
VLRRLGTVLLIVGGIGVAV

SEQ ID NO: 346585 - protein, 24 aa, Mycobacterium
VLRWSRNRMAFLAALLFTLALCWA

SEQ ID NO: 346586 - protein, 20 aa, Mycobacterium
VLRWSRNRMAFLAALMFILA

SEQ ID NO: 346587 - protein, 23 aa, Mycobacterium
VLRWSRNRMAFLAAVLFMLALCW

SEQ ID NO: 346588 - protein, 19 aa, Mycobacterium
VLSSFKVPSVWALLPDEAA

SEQ ID NO: 346589 - protein, 20 aa, Mycobacterium
VLSSFWGWRGPYGTHPINGF

SEQ ID NO: 346590 - protein, 17 aa, Mycobacterium
VLSVIIGWVYRYTHKNV

SEQ ID NO: 346591 - protein, 25 aa, Mycobacterium
VLSVLAVAVAIFWIVMRYRASRRRT

SEQ ID NO: 346592 - protein, 20 aa, Mycobacterium
VLTAFGWRWVFFAPVVLASV

SEQ ID NO: 346593 - protein, 18 aa, Mycobacterium
VLTPSWWAKLVVLGLILF

SEQ ID NO: 346594 - protein, 26 aa, Mycobacterium
VLTSWLWPMWAGIGVIVAGTLVAVLP

SEQ ID NO: 346595 - protein, 18 aa, Mycobacterium
VLVAFLAWWFPRQAGGGA

SEQ ID NO: 346596 - protein, 17 aa, Mycobacterium
VLVAVAWIARGIFLGRP

SEQ ID NO: 346597 - protein, 26 aa, Mycobacterium
VLVAVLAIGAYLVWPSRTGQKVTAYF

SEQ ID NO: 346598 - protein, 18 aa, Mycobacterium
VLVGLSFYMWWRAQQQKV

SEQ ID NO: 346599 - protein, 19 aa, Mycobacterium
VLVLICLFFSVLAGDRFLS

SEQ ID NO: 346600 - protein, 19 aa, Mycobacterium
VLVLTEWSEFVGMHPDELS

SEQ ID NO: 346601 - protein, 20 aa, Mycobacterium
VLVPRFGWQAAFIVAIIPAV

SEQ ID NO: 346602 - protein, 17 aa, Mycobacterium
VLVSMWWYWGLYVRAMR

SEQ ID NO: 346603 - protein, 17 aa, Mycobacterium
VLVTWDLLGHLPLPLGV

SEQ ID NO: 346604 - protein, 19 aa, Mycobacterium
VLVVCTRGAMGLAGEAITD

SEQ ID NO: 346605 - protein, 23 aa, Mycobacterium
VLWTRTLPAWAFFSLPTRAWELA

SEQ ID NO: 346606 - protein, 17 aa, Mycobacterium
VLYFCLAQLILAIFAHS

SEQ ID NO: 346607 - protein, 22 aa, Mycobacterium
VLYRPGSAVFWVFVIALAAGAF

SEQ ID NO: 346608 - protein, 19 aa, Mycobacterium
VMAALLWRRDETLGDLRPL

SEQ ID NO: 346609 - protein, 17 aa, Mycobacterium
VMALFPMYFLKSSAYTI

SEQ ID NO: 346610 - protein, 21 aa, Mycobacterium
VMARLMAVAVLQWVANSAEFL

SEQ ID NO: 346611 - protein, 19 aa, Mycobacterium
VMATLRVAFLSAMVLEMIA

SEQ ID NO: 346612 - protein, 17 aa, Mycobacterium
VMCALARRRRLLSQESA

SEQ ID NO: 346613 - protein, 17 aa, Mycobacterium
VMGCLLFGMAFVCLVGL

SEQ ID NO: 346614 - protein, 22 aa, Mycobacterium
VMGGCMLGMIAIMVFTGVRQLS

SEQ ID NO: 346615 - protein, 21 aa, Mycobacterium
VMGIVGWRALWGLGNALFIAT

SEQ ID NO: 346616 - protein, 23 aa, Mycobacterium
VMLLCLFGMLFVLLRRGRVPGLA

SEQ ID NO: 346617 - protein, 19 aa, Mycobacterium
VMNKLRWVLLIVGGVGVAV

SEQ ID NO: 346618 - protein, 18 aa, Mycobacterium
VMRMWPQIKSIGGRRSED

SEQ ID NO: 346619 - protein, 17 aa, Mycobacterium
VMRWRWRVAFYALTVLG

SEQ ID NO: 346620 - protein, 21 aa, Mycobacterium
VMSHMLPLFRRMQGLIDGINR

SEQ ID NO: 346621 - protein, 17 aa, Mycobacterium
VMSRLMLVLGVAPVLAP

SEQ ID NO: 346622 - protein, 24 aa, Mycobacterium
VMSYCAAGSLGLRVQREGPIAWPE

SEQ ID NO: 346623 - protein, 17 aa, Mycobacterium
VMTLPWLLAIAAVYVIF

SEQ ID NO: 346624 - protein, 19 aa, Mycobacterium
VMVFCKLPVFSTVGPAISV

SEQ ID NO: 346625 - protein, 23 aa, Mycobacterium
VMVLFPMHFLKSFAYAGVATVAF

SEQ ID NO: 346626 - protein, 18 aa, Mycobacterium
VMWLRRRPPRLPDTVHAW

SEQ ID NO: 346627 - protein, 19 aa, Mycobacterium
VMWSNERTLVFALVAAKPP

SEQ ID NO: 346628 - protein, 18 aa, Mycobacterium
VNAALPWTKTVVLNPGVT

SEQ ID NO: 346629 - protein, 23 aa, Mycobacterium
VNAKLIFPGLITFSATQQGQTIP

SEQ ID NO: 346630 - protein, 19 aa, Mycobacterium
VNGLYRWFPPITVLTGLSL

SEQ ID NO: 346631 - protein, 18 aa, Mycobacterium
VNGSRVFLPFGLDPQTTP

SEQ ID NO: 346632 - protein, 25 aa, Mycobacterium
VNLKLLMPVFRWQRRDNLLAEADPA

SEQ ID NO: 346633 - protein, 17 aa, Mycobacterium
VNNEFFYWMSIALMMLI

SEQ ID NO: 346634 - protein, 24 aa, Mycobacterium
VPAARLTRWFVWLLVAVACYTAAQ

SEQ ID NO: 346635 - protein, 18 aa, Mycobacterium
VPAATRWYLAVPLIITLG

SEQ ID NO: 346636 - protein, 31 aa, Mycobacterium
VPAPIPLPIPIIIPPWPNWSPGMPTPSTVTV

SEQ ID NO: 346637 - protein, 22 aa, Mycobacterium
VPARLRRPGAVVLDIDDEDPIF

SEQ ID NO: 346638 - protein, 18 aa, Mycobacterium
VPCAVGMLVAVFAALTLG

SEQ ID NO: 346639 - protein, 19 aa, Mycobacterium
VPDCHGLSFGDAVKKLQAA

SEQ ID NO: 346640 - protein, 17 aa, Mycobacterium
VPDKMTFLLAGGVRLTA

SEQ ID NO: 346641 - protein, 20 aa, Mycobacterium
VPDLPLAYSFPAVPAAESPP

SEQ ID NO: 346642 - protein, 18 aa, Mycobacterium
VPELYVWILVAIAGTVVQ

SEQ ID NO: 346643 - protein, 19 aa, Mycobacterium
VPFAAAFGIAAVDVVLLVV

SEQ ID NO: 346644 - protein, 20 aa, Mycobacterium
VPFPGFKNGVGLILQLPQPT

SEQ ID NO: 346645 - protein, 22 aa, Mycobacterium
VPFPNFKNGVGLMLQLSEPARI

SEQ ID NO: 346646 - protein, 17 aa, Mycobacterium
VPGELLALLLAGQFLPA

SEQ ID NO: 346647 - protein, 20 aa, Mycobacterium
VPGIAHFFTMWGFFVLASVY

SEQ ID NO: 346648 - protein, 21 aa, Mycobacterium
VPICAGIFGVVFGFISLNQIK

SEQ ID NO: 346649 - protein, 17 aa, Mycobacterium
VPICALAVLLTAIFVPE

SEQ ID NO: 346650 - protein, 18 aa, Mycobacterium
VPIIVAWLLLTIAVNVLV

SEQ ID NO: 346651 - protein, 18 aa, Mycobacterium
VPIIVFWGLLAVTTNTFI

SEQ ID NO: 346652 - protein, 18 aa, Mycobacterium
VPIVLFWLAVCVVVSVFV

SEQ ID NO: 346653 - protein, 21 aa, Mycobacterium
VPKAEAFAGYNLENKNVIFGP

SEQ ID NO: 346654 - protein, 18 aa, Mycobacterium
VPLMLRWDHYLRRGHSRR

SEQ ID NO: 346655 - protein, 21 aa, Mycobacterium
VPLRVGVAVTLVFVAGGVFGH

SEQ ID NO: 346656 - protein, 18 aa, Mycobacterium
VPLVCALAGFLLAATHTV

SEQ ID NO: 346657 - protein, 20 aa, Mycobacterium
VPLVLACVFGGLRISASTVE

SEQ ID NO: 346658 - protein, 17 aa, Mycobacterium
VPLVMVLVIAIASFAVV

SEQ ID NO: 346659 - protein, 17 aa, Mycobacterium
VPLWIAFALGRRAATRR

SEQ ID NO: 346660 - protein, 21 aa, Mycobacterium
VPLWLRLWRALGIERAARIRT

SEQ ID NO: 346661 - protein, 18 aa, Mycobacterium
VPNALPLILSGLRTATLQ

SEQ ID NO: 346662 - protein, 17 aa, Mycobacterium
VPPEFRATYQAGLVGTR

SEQ ID NO: 346663 - protein, 17 aa, Mycobacterium
VPRGARLDPALMLLAVF

SEQ ID NO: 346664 - protein, 26 aa, Mycobacterium
VPRPTATRFRLLWLRQLSDAVRTFRN

SEQ ID NO: 346665 - protein, 17 aa, Mycobacterium
VPRRFAVIHSDELPVKS

SEQ ID NO: 346666 - protein, 23 aa, Mycobacterium
VPRSVEALGRIEVVCFDKTGTLS

SEQ ID NO: 346667 - protein, 22 aa, Mycobacterium
VPRTRFGTWLGRPMTSFHLIIA

SEQ ID NO: 346668 - protein, 22 aa, Mycobacterium
VPSDSSWWWVCVAILALVTLLM

SEQ ID NO: 346669 - protein, 19 aa, Mycobacterium
VPSIFRPPWEPQRPPQQNP

SEQ ID NO: 346670 - protein, 29 aa, Mycobacterium
VPSIVALLGRWFWWPSRPPRRAMAEAVKT

SEQ ID NO: 346671 - protein, 20 aa, Mycobacterium
VPSLREWLRLVFIVLGGYAV

SEQ ID NO: 346672 - protein, 18 aa, Mycobacterium
VPTLRRWLSTEVRPKLNE

SEQ ID NO: 346673 - protein, 20 aa, Mycobacterium
VPTWWPGQRVDVIVAAATCL

SEQ ID NO: 346674 - protein, 20 aa, Mycobacterium
VPVFRVRLAFAVLGAASGMG

SEQ ID NO: 346675 - protein, 21 aa, Mycobacterium
VPWRDCLHFLWAGASGGSVPA

SEQ ID NO: 346676 - protein, 17 aa, Mycobacterium
VPWWWWPLGFAAAALIA

SEQ ID NO: 346677 - protein, 18 aa, Mycobacterium
VPYIRWPMWLRTVTATAA

SEQ ID NO: 346678 - protein, 33 aa, Mycobacterium
VPYLRASPWLLWRKRIVWLLVLFAAEAYTGTVL

SEQ ID NO: 346679 - protein, 32 aa, Mycobacterium
VPYLRASPWLLWRKRVVWLLVLFVAEAYTGSV

SEQ ID NO: 346680 - protein, 24 aa, Mycobacterium
VQAAQLSAMWARFPLPVIPAPGDP

SEQ ID NO: 346681 - protein, 18 aa, Mycobacterium
VQAAVPFYGIYDFTRFDK

SEQ ID NO: 346682 - protein, 18 aa, Mycobacterium
VQAAVPFYGVYDFTRFDD

SEQ ID NO: 346683 - protein, 18 aa, Mycobacterium
VQAAVPFYGVYDFTRFND

SEQ ID NO: 346684 - protein, 17 aa, Mycobacterium
VQLGKDWIWLHAARIAA

SEQ ID NO: 346685 - protein, 24 aa, Mycobacterium
VQPFRFLFMAFLWTIALTFEAGYY

SEQ ID NO: 346686 - protein, 17 aa, Mycobacterium
VQREVCAALTLDSRPGR

SEQ ID NO: 346687 - protein, 17 aa, Mycobacterium
VQRMPVAFFTRTRTGAL

SEQ ID NO: 346688 - protein, 20 aa, Mycobacterium
VQTYEFWLKIGIVALGARFV

SEQ ID NO: 346689 - protein, 18 aa, Mycobacterium
VRAALRHVWRDRPLLLAL

SEQ ID NO: 346690 - protein, 20 aa, Mycobacterium
VRAPEFYAWMTVLPIGLMLQ

SEQ ID NO: 346691 - protein, 23 aa, Mycobacterium
VRASALWLMRGWLPALVAVIAVC

SEQ ID NO: 346692 - protein, 19 aa, Mycobacterium
VRASWPWAVAVFIVVVFVG

SEQ ID NO: 346693 - protein, 18 aa, Mycobacterium
VREYDLKLILAFGTVSQL

SEQ ID NO: 346694 - protein, 17 aa, Mycobacterium
VRFFRRKWTAVTLSSTW

SEQ ID NO: 346695 - protein, 17 aa, Mycobacterium
VRFPRTSALVIRYGDVP

SEQ ID NO: 346696 - protein, 18 aa, Mycobacterium
VRGAMKVAWDKLKGATGK

SEQ ID NO: 346697 - protein, 21 aa, Mycobacterium
VRGARNYPCLEHPGKRAPTVE

SEQ ID NO: 346698 - protein, 17 aa, Mycobacterium
VRGARNYPCQEFPGKRA

SEQ ID NO: 346699 - protein, 20 aa, Mycobacterium
VRGGARFRMPGIERVDIMSL

SEQ ID NO: 346700 - protein, 19 aa, Mycobacterium
VRGGLFVRQVHHWAALMFA

SEQ ID NO: 346701 - protein, 19 aa, Mycobacterium
VRGGLMGIILLVVVIGVGQ

SEQ ID NO: 346702 - protein, 20 aa, Mycobacterium
VRGLKMLMWTAVIAVVVVGL

SEQ ID NO: 346703 - protein, 18 aa, Mycobacterium
VRGLPDFWRLLQVRMASQ

SEQ ID NO: 346704 - protein, 24 aa, Mycobacterium
VRGNLRILLPLAIVGALLLVAGGA

SEQ ID NO: 346705 - protein, 23 aa, Mycobacterium
VRGRGGVSLGEFWATEGPLSYLG

SEQ ID NO: 346706 - protein, 25 aa, Mycobacterium
VRGSLRILLPLSFAVALILLSQGTI

SEQ ID NO: 346707 - protein, 23 aa, Mycobacterium
VRGTLRILLPIAVLGAVVLVMGG

SEQ ID NO: 346708 - protein, 21 aa, Mycobacterium
VRGTRNFPCMEQPGKRAPTVE

SEQ ID NO: 346709 - protein, 20 aa, Mycobacterium
VRHGIFWAGFVLYFTTYHTW

SEQ ID NO: 346710 - protein, 25 aa, Mycobacterium
VRIFAVPIILGWVFVAVALAVVTPS

SEQ ID NO: 346711 - protein, 22 aa, Mycobacterium
VRKTAAWAWRLLVILAAAVALL

SEQ ID NO: 346712 - protein, 22 aa, Mycobacterium
VRKTAAWAWRLLVILFALLALL

SEQ ID NO: 346713 - protein, 28 aa, Mycobacterium
VRKTAAWSWRLLVIFAAALAVIWVISKL

SEQ ID NO: 346714 - protein, 23 aa, Mycobacterium
VRKTAAWSWRLLVILAALVALLL

SEQ ID NO: 346715 - protein, 22 aa, Mycobacterium
VRLPGWPLWFATLWVAAEWAKS

SEQ ID NO: 346716 - protein, 17 aa, Mycobacterium
VRNLPCMDVPGKRAPTV

SEQ ID NO: 346717 - protein, 20 aa, Mycobacterium
VRNYFYWEPHCYDIPVCWTM

SEQ ID NO: 346718 - protein, 24 aa, Mycobacterium
VRQDCLRRGIVFAMARVKQDLREA

SEQ ID NO: 346719 - protein, 17 aa, Mycobacterium
VRQHFWLPGGSTGSSDA

SEQ ID NO: 346720 - protein, 18 aa, Mycobacterium
VRRAPVIVIGLWIGLAAV

SEQ ID NO: 346721 - protein, 18 aa, Mycobacterium
VRRASCLTGLGYPASTQV

SEQ ID NO: 346722 - protein, 25 aa, Mycobacterium
VRRLLGELTHFFALLLWAAAVLAFF

SEQ ID NO: 346723 - protein, 20 aa, Mycobacterium
VRRLPGVIAIVVLLFLACAP

SEQ ID NO: 346724 - protein, 22 aa, Mycobacterium
VRRLRWRLATMLAIAAGTYAVL

SEQ ID NO: 346725 - protein, 18 aa, Mycobacterium
VRRLRYGRFTPIAVLAAS

SEQ ID NO: 346726 - protein, 28 aa, Mycobacterium
VRRWRKLGAAIARWPGPILITASVLALG

SEQ ID NO: 346727 - protein, 30 aa, Mycobacterium
VRRWRKLGAAIARWPGPILITASVLALGGL

SEQ ID NO: 346728 - protein, 27 aa, Mycobacterium
VRRWRRIGAAIVRWPAPILVATCAVAL

SEQ ID NO: 346729 - protein, 26 aa, Mycobacterium
VRRWRRIGTATVRWPGAVFAASSAIA

SEQ ID NO: 346730 - protein, 18 aa, Mycobacterium
VRSLPDFWRLLQVRIASQ

SEQ ID NO: 346731 - protein, 18 aa, Mycobacterium
VRSLPDFWRLLQVRMASQ

SEQ ID NO: 346732 - protein, 23 aa, Mycobacterium
VRSRAAEILRHWNTRRRNAAWER

SEQ ID NO: 346733 - protein, 19 aa, Mycobacterium
VRSYFYWEKHCYDIPACFA

SEQ ID NO: 346734 - protein, 20 aa, Mycobacterium
VRSYFYWERHCFDIPACFAF

SEQ ID NO: 346735 - protein, 18 aa, Mycobacterium
VRSYFYWERHCYDIPVCF

SEQ ID NO: 346736 - protein, 18 aa, Mycobacterium
VRTGPNWGDLLLRVAAGL

SEQ ID NO: 346737 - protein, 17 aa, Mycobacterium
VRTLVWQRWPTTGLAPP

SEQ ID NO: 346738 - protein, 17 aa, Mycobacterium
VRTRLRDEFGFPKSVIH

SEQ ID NO: 346739 - protein, 21 aa, Mycobacterium
VRWFGEFEFWFSGIKVAAIVS

SEQ ID NO: 346740 - protein, 17 aa, Mycobacterium
VRWMYWWGLFITAADIL

SEQ ID NO: 346741 - protein, 18 aa, Mycobacterium
VRWPWAVIGVWIALAVAL

SEQ ID NO: 346742 - protein, 21 aa, Mycobacterium
VRWPWVVIGAWVALAIALPLT

SEQ ID NO: 346743 - protein, 21 aa, Mycobacterium
VRWRHRICLAAAIIAMLATPA

SEQ ID NO: 346744 - protein, 19 aa, Mycobacterium
VSAIMWVWYKAFSFLLGPT

SEQ ID NO: 346745 - protein, 17 aa, Mycobacterium
VSALHRPVPLSGEGSDT

SEQ ID NO: 346746 - protein, 18 aa, Mycobacterium
VSCQRCMFYVNAYHTANV

SEQ ID NO: 346747 - protein, 19 aa, Mycobacterium
VSDRIGRRPVFLTMALFTI

SEQ ID NO: 346748 - protein, 19 aa, Mycobacterium
VSESVSWPGWAVVGVTLVF

SEQ ID NO: 346749 - protein, 23 aa, Mycobacterium
VSFGYRPGVPVIHDLSMVAEPGS

SEQ ID NO: 346750 - protein, 19 aa, Mycobacterium
VSFGYRPGVPVIRDVSLQL

SEQ ID NO: 346751 - protein, 20 aa, Mycobacterium
VSFPRAMFWTVLGYVLVATV

SEQ ID NO: 346752 - protein, 25 aa, Mycobacterium
VSFPVVAYRSWRWWLGTAAGFFAVV

SEQ ID NO: 346753 - protein, 18 aa, Mycobacterium
VSGLGWEWIFFVNIPIGL

SEQ ID NO: 346754 - protein, 20 aa, Mycobacterium
VSGRIAALVPEDRWQGLAAQ

SEQ ID NO: 346755 - protein, 18 aa, Mycobacterium
VSGSEDWSLVGRTFDHIR

SEQ ID NO: 346756 - protein, 18 aa, Mycobacterium
VSGSRFYFLTGFGALLQL

SEQ ID NO: 346757 - protein, 17 aa, Mycobacterium
VSGWRSGALGSLMSFVG

SEQ ID NO: 346758 - protein, 21 aa, Mycobacterium
VSGWRSGALGSMLSFAGVLLG

SEQ ID NO: 346759 - protein, 19 aa, Mycobacterium
VSIGLWWYFDRRTSDNQAE

SEQ ID NO: 346760 - protein, 20 aa, Mycobacterium
VSIPDFRLGILLIGLFASVL

SEQ ID NO: 346761 - protein, 19 aa, Mycobacterium
VSIPSLWQPYVLSVASLTA

SEQ ID NO: 346762 - protein, 23 aa, Mycobacterium
VSKARWSHAFPREGADAGGGDDA

SEQ ID NO: 346763 - protein, 19 aa, Mycobacterium
VSLAELWRSAGVLPDAVIG

SEQ ID NO: 346764 - protein, 19 aa, Mycobacterium
VSLAGRFAGFRGLDLINLA

SEQ ID NO: 346765 - protein, 20 aa, Mycobacterium
VSLAGRFAGFRGLDLINLAV

SEQ ID NO: 346766 - protein, 23 aa, Mycobacterium
VSLLKRLGITVAMLTGDNTRTAN

SEQ ID NO: 346767 - protein, 19 aa, Mycobacterium
VSLLPTLLVAIPFTVLVAF

SEQ ID NO: 346768 - protein, 17 aa, Mycobacterium
VSLPLLWWRFRRDDRAA

SEQ ID NO: 346769 - protein, 25 aa, Mycobacterium
VSLTYCAMCRSIIPFDVTDIGPLFV

SEQ ID NO: 346770 - protein, 18 aa, Mycobacterium
VSLVPTLLVAIPFTVLVA

SEQ ID NO: 346771 - protein, 18 aa, Mycobacterium
VSMALGFLGCPKFVAVPA

SEQ ID NO: 346772 - protein, 23 aa, Mycobacterium
VSMLLYIMCWWRHLRPEVPAPAD

SEQ ID NO: 346773 - protein, 27 aa, Mycobacterium
VSPAIRWLIKVPREFINDYLFNFPDTS

SEQ ID NO: 346774 - protein, 18 aa, Mycobacterium
VSSRRAAVVLAFTLVGFA

SEQ ID NO: 346775 - protein, 29 aa, Mycobacterium
VSTEALIEWAWRLPFLMSLILVGLALYVH

SEQ ID NO: 346776 - protein, 20 aa, Mycobacterium
VSVAVAWPLAAMVPRSSTAL

SEQ ID NO: 346777 - protein, 20 aa, Mycobacterium
VSVLVSWLLFTWIIARLPRE

SEQ ID NO: 346778 - protein, 19 aa, Mycobacterium
VSVPARWVVGGVEHAGPVD

SEQ ID NO: 346779 - protein, 20 aa, Mycobacterium
VSWAGGIGFRVVQLMGPEAL

SEQ ID NO: 346780 - protein, 19 aa, Mycobacterium
VSWLRFPIGTLKTLGTVGL

SEQ ID NO: 346781 - protein, 18 aa, Mycobacterium
VSYFYDFRGPSMAIDTAC

SEQ ID NO: 346782 - protein, 17 aa, Mycobacterium
VTAAPGWTLVNRGPNWV

SEQ ID NO: 346783 - protein, 17 aa, Mycobacterium
VTAAVGWWAARRTAAEA

SEQ ID NO: 346784 - protein, 21 aa, Mycobacterium
VTALCLFTALFIMLRRKRIPG

SEQ ID NO: 346785 - protein, 18 aa, Mycobacterium
VTALELYLVFPLSNEEST

SEQ ID NO: 346786 - protein, 20 aa, Mycobacterium
VTALSFATVNGWWYVSNFGV

SEQ ID NO: 346787 - protein, 23 aa, Mycobacterium
VTASMSCILAWLGQHPHERRRLV

SEQ ID NO: 346788 - protein, 23 aa, Mycobacterium
VTCLRPKPARRPVFVDGRLRKQI

SEQ ID NO: 346789 - protein, 18 aa, Mycobacterium
VTFIPWPVIEGFTLGIAA

SEQ ID NO: 346790 - protein, 19 aa, Mycobacterium
VTFIPWPVIEGFTLGIAAI

SEQ ID NO: 346791 - protein, 25 aa, Mycobacterium
VTGIVEWPILLAVGGGALLLRRMNK

SEQ ID NO: 346792 - protein, 19 aa, Mycobacterium
VTGQFPWSRVPAYIAAQVL

SEQ ID NO: 346793 - protein, 18 aa, Mycobacterium
VTHAFPVWVSSALALGVV

SEQ ID NO: 346794 - protein, 17 aa, Mycobacterium
VTLALGVLFGLREFTLE

SEQ ID NO: 346795 - protein, 21 aa, Mycobacterium
VTLPSIRWGLTYGVVLTVART

SEQ ID NO: 346796 - protein, 18 aa, Mycobacterium
VTPKFTRMIIAGIFGVVA

SEQ ID NO: 346797 - protein, 18 aa, Mycobacterium
VTPKFTRMIVAGLFGVVA

SEQ ID NO: 346798 - protein, 22 aa, Mycobacterium
VTRFEYPDALLLDMQGNVIFSV

SEQ ID NO: 346799 - protein, 17 aa, Mycobacterium
VTRLGAFNGVLAAAGAY

SEQ ID NO: 346800 - protein, 18 aa, Mycobacterium
VTTLNLWVGVGFVLSPLL

SEQ ID NO: 346801 - protein, 17 aa, Mycobacterium
VTTRLSERLQVPVFTTP

SEQ ID NO: 346802 - protein, 17 aa, Mycobacterium
VTVLAFWIGRPLVRLNF

SEQ ID NO: 346803 - protein, 18 aa, Mycobacterium
VTVPARWSVDGIEHTGDV

SEQ ID NO: 346804 - protein, 19 aa, Mycobacterium
VTVPVQFVAGWSILKEAVA

SEQ ID NO: 346805 - protein, 18 aa, Mycobacterium
VTVSHLFRRVPPVGSAPA

SEQ ID NO: 346806 - protein, 22 aa, Mycobacterium
VTWVCASLGFGFYVANFGNYNK

SEQ ID NO: 346807 - protein, 19 aa, Mycobacterium
VTWVYRYAVAVYRDDRGCG

SEQ ID NO: 346808 - protein, 21 aa, Mycobacterium
VVACLVCFLIGFAGLLWLPMH

SEQ ID NO: 346809 - protein, 17 aa, Mycobacterium
VVAEFSWFIGAGLGAIV

SEQ ID NO: 346810 - protein, 20 aa, Mycobacterium
VVAFGMSWGPVVWVLLGEMF

SEQ ID NO: 346811 - protein, 18 aa, Mycobacterium
VVAFKLYVNRDWTATFEV

SEQ ID NO: 346812 - protein, 20 aa, Mycobacterium
VVAGLFPRLAATPDTDPAET

SEQ ID NO: 346813 - protein, 18 aa, Mycobacterium
VVALRLGRCLARLRTRSH

SEQ ID NO: 346814 - protein, 19 aa, Mycobacterium
VVAPVQWVAVLALGAGCLV

SEQ ID NO: 346815 - protein, 19 aa, Mycobacterium
VVARLIAAVVMPFGILLAG

SEQ ID NO: 346816 - protein, 17 aa, Mycobacterium
VVATPIMRWLREVDGPT

SEQ ID NO: 346817 - protein, 18 aa, Mycobacterium
VVAVIAALIITRSDDKPA

SEQ ID NO: 346818 - protein, 18 aa, Mycobacterium
VVCMFWRLFMQDNRPHDG

SEQ ID NO: 346819 - protein, 18 aa, Mycobacterium
VVCPIELLHTQLIQASGI

SEQ ID NO: 346820 - protein, 24 aa, Mycobacterium
VVCTVLWPPVRWLRNKGVPPAAAV

SEQ ID NO: 346821 - protein, 17 aa, Mycobacterium
VVDLLPMPSLRAQRLIA

SEQ ID NO: 346822 - protein, 23 aa, Mycobacterium
VVDPSWFAGLIVAWLWLTVIFAN

SEQ ID NO: 346823 - protein, 17 aa, Mycobacterium
VVFLAWASFFFVGGGPA

SEQ ID NO: 346824 - protein, 23 aa, Mycobacterium
VVFRIGRALGRMRSHTFAHADAV

SEQ ID NO: 346825 - protein, 22 aa, Mycobacterium
VVFRIGRALGRMRTHTFAHADA

SEQ ID NO: 346826 - protein, 18 aa, Mycobacterium
VVGDKIWIVGGLRNGVAL

SEQ ID NO: 346827 - protein, 20 aa, Mycobacterium
VVGVIGWRFFGDVLSNRSQT

SEQ ID NO: 346828 - protein, 22 aa, Mycobacterium
VVGWASGLGFGWMFTLGTANVV

SEQ ID NO: 346829 - protein, 24 aa, Mycobacterium
VVHRSKCGYLWSHHLPIAARAGLS

SEQ ID NO: 346830 - protein, 17 aa, Mycobacterium
VVICILAGFVPLSYLAD

SEQ ID NO: 346831 - protein, 20 aa, Mycobacterium
VVIRLAVCWLLSRHGLAAGI

SEQ ID NO: 346832 - protein, 17 aa, Mycobacterium
VVISALGGLRCRASRIV

SEQ ID NO: 346833 - protein, 23 aa, Mycobacterium
VVLAGAGYEGWLLFQHHQKDVAA

SEQ ID NO: 346834 - protein, 18 aa, Mycobacterium
VVLAGLFWSGHRADTDEL

SEQ ID NO: 346835 - protein, 23 aa, Mycobacterium
VVLAGLLGMCSFQLDSRRGPIPS

SEQ ID NO: 346836 - protein, 19 aa, Mycobacterium
VVLALVFYFVWGRHHSALN

SEQ ID NO: 346837 - protein, 23 aa, Mycobacterium
VVLEWRMPRMLMALLIGAALGVS

SEQ ID NO: 346838 - protein, 19 aa, Mycobacterium
VVLLLGWSFFYFSDDTRGY

SEQ ID NO: 346839 - protein, 17 aa, Mycobacterium
VVLPQWLFSALFTPAIR

SEQ ID NO: 346840 - protein, 23 aa, Mycobacterium
VVLVTGFWKPGFFVTTKLDVDAA

SEQ ID NO: 346841 - protein, 17 aa, Mycobacterium
VVMLISWLVARRREAYS

SEQ ID NO: 346842 - protein, 18 aa, Mycobacterium
VVMLRISWQITLLALVLV

SEQ ID NO: 346843 - protein, 24 aa, Mycobacterium
VVPEIPRWEFVVLVGTAAVILVVV

SEQ ID NO: 346844 - protein, 17 aa, Mycobacterium
VVPFDFVTFLLAISLSA

SEQ ID NO: 346845 - protein, 24 aa, Mycobacterium
VVPHLGWRWMFFIGLVPAFVAWWM

SEQ ID NO: 346846 - protein, 17 aa, Mycobacterium
VVQAKLWLQDAIAGMPK

SEQ ID NO: 346847 - protein, 18 aa, Mycobacterium
VVQAKLWLQDAITGMPRF

SEQ ID NO: 346848 - protein, 17 aa, Mycobacterium
VVRGCALLDAGLARTLL

SEQ ID NO: 346849 - protein, 20 aa, Mycobacterium
VVRPSIWYRLRRSVRFRSHA

SEQ ID NO: 346850 - protein, 24 aa, Mycobacterium
VVRSHLRWTSPILRHAVRLSAATA

SEQ ID NO: 346851 - protein, 18 aa, Mycobacterium
VVSAFGIRSGVRKLGAAL

SEQ ID NO: 346852 - protein, 18 aa, Mycobacterium
VVSGLKLNIGFALVGAIV

SEQ ID NO: 346853 - protein, 19 aa, Mycobacterium
VVSLIGWWALSRLLERMRG

SEQ ID NO: 346854 - protein, 17 aa, Mycobacterium
VVSYRWGHHVTRFVSHP

SEQ ID NO: 346855 - protein, 17 aa, Mycobacterium
VVTLVLWGYVLDRVGER

SEQ ID NO: 346856 - protein, 21 aa, Mycobacterium
VVTLWRGRGLFAPRLILAAMS

SEQ ID NO: 346857 - protein, 25 aa, Mycobacterium
VVTSNELIAWVCIGASVLGVVLLIV

SEQ ID NO: 346858 - protein, 24 aa, Mycobacterium
VVVHPTFLYELLWNVLVFAMLIYL

SEQ ID NO: 346859 - protein, 17 aa, Mycobacterium
VVVICAMFVRGGPVIPR

SEQ ID NO: 346860 - protein, 25 aa, Mycobacterium
VVVIKRGLIKWAWIPALPLMWDLTV

SEQ ID NO: 346861 - protein, 18 aa, Mycobacterium
VVVPPLLPFLVPPVLATG

SEQ ID NO: 346862 - protein, 28 aa, Mycobacterium
VVVTDFYLLQAFIIRWRVWLTERITVDW

SEQ ID NO: 346863 - protein, 17 aa, Mycobacterium
VVVVVAGVIVWRFFGEA

SEQ ID NO: 346864 - protein, 20 aa, Mycobacterium
VVYLAYLAWRQWRSVAVDLH

SEQ ID NO: 346865 - protein, 17 aa, Mycobacterium
VWAWLKWLPHLQHQTDT

SEQ ID NO: 346866 - protein, 24 aa, Mycobacterium
VWELARPPVWLFFLFLVTATGAHA

SEQ ID NO: 346867 - protein, 19 aa, Mycobacterium
VWGPGGWLARLGVLDYAGG

SEQ ID NO: 346868 - protein, 20 aa, Mycobacterium
VWIPWALRPMFFVLRLLPQF

SEQ ID NO: 346869 - protein, 22 aa, Mycobacterium
VWKPPRGRVASWFAEPDKKRNR

SEQ ID NO: 346870 - protein, 18 aa, Mycobacterium
VWLFLFFFMWLRATLPRM

SEQ ID NO: 346871 - protein, 21 aa, Mycobacterium
VWLLLRFDPFRAMRPYPQVLV

SEQ ID NO: 346872 - protein, 21 aa, Mycobacterium
VWLYHCATMPMSVHIANGMFG

SEQ ID NO: 346873 - protein, 23 aa, Mycobacterium
VWQAARWRPTLQFSKSEFFDMAK

SEQ ID NO: 346874 - protein, 23 aa, Mycobacterium
VWQTRIAPVLACLGLVGALLLVL

SEQ ID NO: 346875 - protein, 18 aa, Mycobacterium
VWRLVNFLLEGLVFLLIG

SEQ ID NO: 346876 - protein, 18 aa, Mycobacterium
VWRRGRDVFAEVGLPNDD

SEQ ID NO: 346877 - protein, 18 aa, Mycobacterium
VWVPRMYYLLGIENKGLP

SEQ ID NO: 346878 - protein, 17 aa, Mycobacterium
VWWAASRQLLFGAAAVA

SEQ ID NO: 346879 - protein, 23 aa, Mycobacterium
VWWRVTLPLLRPGLMSGAVLAFA

SEQ ID NO: 346880 - protein, 17 aa, Mycobacterium
VYAPLALVFLFTGADSI

SEQ ID NO: 346881 - protein, 19 aa, Mycobacterium
VYAVFRWFFARDLRVAPDP

SEQ ID NO: 346882 - protein, 18 aa, Mycobacterium
VYFGPNFANFVAVTGNNP

SEQ ID NO: 346883 - protein, 18 aa, Mycobacterium
VYLSGWKPSFVLPGPGTV

SEQ ID NO: 346884 - protein, 22 aa, Mycobacterium
VYLWHWPIFLALNGERTGWSGL

SEQ ID NO: 346885 - protein, 19 aa, Mycobacterium
VYRREWEELITPRSVHTVH

SEQ ID NO: 346886 - protein, 23 aa, Mycobacterium
VYRYRFIVVAAFVTVCLGSGLFG

SEQ ID NO: 346887 - protein, 19 aa, Mycobacterium
VYTEYKLNSAFAVGGPKCL

SEQ ID NO: 346888 - protein, 18 aa, Mycobacterium
VYTTRWWLSGLLVGAAAG

SEQ ID NO: 346889 - protein, 17 aa, Mycobacterium
VYVLPLLLLVGLFVMFS

SEQ ID NO: 346890 - protein, 24 aa, Mycobacterium
VYYWVICLVLSFGQARFEHRLERY

SEQ ID NO: 346891 - protein, 23 aa, Mycobacterium
VYYWVICLVLSFGQSRIERRLER

SEQ ID NO: 346892 - protein, 17 aa, Mycobacterium
WAADACDDWASAPEVDA

SEQ ID NO: 346893 - protein, 20 aa, Mycobacterium
WAAVMLVHWFGVARRQVDPA

SEQ ID NO: 346894 - protein, 20 aa, Mycobacterium
WAGGVGFRVALLMGPEALET

SEQ ID NO: 346895 - protein, 20 aa, Mycobacterium
WAGWLAFAATIPVQFIAGWP

SEQ ID NO: 346896 - protein, 17 aa, Mycobacterium
WAIDVMTAWLDDRDDDL

SEQ ID NO: 346897 - protein, 18 aa, Mycobacterium
WAIVALVAAVLFVGSAGF

SEQ ID NO: 346898 - protein, 17 aa, Mycobacterium
WALFMVTVTYVWKNLGY

SEQ ID NO: 346899 - protein, 20 aa, Mycobacterium
WAMPELVARVALAGLAVRAV

SEQ ID NO: 346900 - protein, 20 aa, Mycobacterium
WAQHAHWMWWTWPAAAAAGI

SEQ ID NO: 346901 - protein, 20 aa, Mycobacterium
WAQLCFPNFGGFAGSTFHKA

SEQ ID NO: 346902 - protein, 20 aa, Mycobacterium
WARAHLRSGAQLRLPAVTFA

SEQ ID NO: 346903 - protein, 25 aa, Mycobacterium
WARQRAKRMVLMWVIAVLTVTGLTA

SEQ ID NO: 346904 - protein, 25 aa, Mycobacterium
WARQRARRALLFWVIAVITLAGLAA

SEQ ID NO: 346905 - protein, 19 aa, Mycobacterium
WARRLAWASLLWMCAEGAL

SEQ ID NO: 346906 - protein, 19 aa, Mycobacterium
WARVRGRILALIGLALLEG

SEQ ID NO: 346907 - protein, 19 aa, Mycobacterium
WARVRGRVLALIGLALLEA

SEQ ID NO: 346908 - protein, 20 aa, Mycobacterium
WARWESVSFWLLLLGGICVF

SEQ ID NO: 346909 - protein, 18 aa, Mycobacterium
WASARTAAGFALAVVLLA

SEQ ID NO: 346910 - protein, 20 aa, Mycobacterium
WASVHLFGFPALDNTAPLFA

SEQ ID NO: 346911 - protein, 24 aa, Mycobacterium
WATACGWAFALAMIDGWQRGFAGR

SEQ ID NO: 346912 - protein, 24 aa, Mycobacterium
WATLKVSLVLSVVFFFVWMIAVAM

SEQ ID NO: 346913 - protein, 22 aa, Mycobacterium
WATSCAWAFSLAMIDGWQQGFA

SEQ ID NO: 346914 - protein, 20 aa, Mycobacterium
WAVDLFKILLMTGSFACGMA

SEQ ID NO: 346915 - protein, 25 aa, Mycobacterium
WAVIPGCWVFTLGVFLFWLLTTSRA

SEQ ID NO: 346916 - protein, 17 aa, Mycobacterium
WAVMFLVAVGFWNFLGA

SEQ ID NO: 346917 - protein, 19 aa, Mycobacterium
WAVMFLVAVGFWNFVGAGI

SEQ ID NO: 346918 - protein, 20 aa, Mycobacterium
WAVNLFKVLLMTGSFACGMA

SEQ ID NO: 346919 - protein, 17 aa, Mycobacterium
WAVPFGLAGGRIYHVIT

SEQ ID NO: 346920 - protein, 23 aa, Mycobacterium
WAVSRVSIFRLVRYLAREYLLIV

SEQ ID NO: 346921 - protein, 20 aa, Mycobacterium
WAWIPGLPLLWDLAVTLTAS

SEQ ID NO: 346922 - protein, 17 aa, Mycobacterium
WCILAVVLAVYRNSPVM

SEQ ID NO: 346923 - protein, 20 aa, Mycobacterium
WCLVRTRWGRRVARFLPVIG

SEQ ID NO: 346924 - protein, 18 aa, Mycobacterium
WCSYICWRCFARTRSSPL

SEQ ID NO: 346925 - protein, 20 aa, Mycobacterium
WCTRPWPSLRRSRMFITSAD

SEQ ID NO: 346926 - protein, 18 aa, Mycobacterium
WDELAGWLRAERQNLATA

SEQ ID NO: 346927 - protein, 22 aa, Mycobacterium
WDGVVPRLAERFRILRYDNRGV

SEQ ID NO: 346928 - protein, 17 aa, Mycobacterium
WDLGRPAPIGSVLSVHD

SEQ ID NO: 346929 - protein, 20 aa, Mycobacterium
WDRFGPRYLLACWVLAFVIS

SEQ ID NO: 346930 - protein, 23 aa, Mycobacterium
WDRLRWQLPASFIGAAGGAWLLL

SEQ ID NO: 346931 - protein, 20 aa, Mycobacterium
WEFLVLLLIGGSLALLIMQM

SEQ ID NO: 346932 - protein, 18 aa, Mycobacterium
WEFYMALAYFKLAIIAAG

SEQ ID NO: 346933 - protein, 19 aa, Mycobacterium
WEHILGLQLHWFVLPFTVI

SEQ ID NO: 346934 - protein, 26 aa, Mycobacterium
WEKHCYDIPACFAFRSLFDAIDGIDQ

SEQ ID NO: 346935 - protein, 17 aa, Mycobacterium
WELLRLALTTHRKSFHL

SEQ ID NO: 346936 - protein, 25 aa, Mycobacterium
WEPHCFNIPICWALRSVFDSLDGIN

SEQ ID NO: 346937 - protein, 26 aa, Mycobacterium
WEPHCYDIPLCWSIRSLFDGLDGINE

SEQ ID NO: 346938 - protein, 20 aa, Mycobacterium
WEPHCYDIPVCQSLRSVFDT

SEQ ID NO: 346939 - protein, 25 aa, Mycobacterium
WEPHCYNIPVCWALRSVFDTLDGIN

SEQ ID NO: 346940 - protein, 22 aa, Mycobacterium
WEQRTEWPLAMVAIAFLAMYSI

SEQ ID NO: 346941 - protein, 26 aa, Mycobacterium
WERHCFDIPACFAFRSLFDALDGIDQ

SEQ ID NO: 346942 - protein, 19 aa, Mycobacterium
WETGSLWVAFAIGLLLGGI

SEQ ID NO: 346943 - protein, 22 aa, Mycobacterium
WEVSELRFAAVAGVVLLAGYVV

SEQ ID NO: 346944 - protein, 17 aa, Mycobacterium
WEVVRTIVLPFGRSGYI

SEQ ID NO: 346945 - protein, 21 aa, Mycobacterium
WFGELGFRGVFTTVLLTRLAL

SEQ ID NO: 346946 - protein, 19 aa, Mycobacterium
WFLRFLVRHSMYWFVGYRI

SEQ ID NO: 346947 - protein, 18 aa, Mycobacterium
WFLRKAHQLCPAGVVVAT

SEQ ID NO: 346948 - protein, 24 aa, Mycobacterium
WFPYYLCGLALRVSDLQYRTVEVG

SEQ ID NO: 346949 - protein, 20 aa, Mycobacterium
WFVARVSLVPALMLTVPYTV

SEQ ID NO: 346950 - protein, 17 aa, Mycobacterium
WFWLLKRYVVEGPQEHD

SEQ ID NO: 346951 - protein, 24 aa, Mycobacterium
WGAIALGAVGAWIACRRRGIPLPA

SEQ ID NO: 346952 - protein, 17 aa, Mycobacterium
WGAMLGWIDVADKWSEW

SEQ ID NO: 346953 - protein, 25 aa, Mycobacterium
WGAVAFGAVGAWIACRLRGIPLPAF

SEQ ID NO: 346954 - protein, 17 aa, Mycobacterium
WGAVAGYLRARFDVPSF

SEQ ID NO: 346955 - protein, 23 aa, Mycobacterium
WGDRAERRWPFGVAAAFLALGMA

SEQ ID NO: 346956 - protein, 17 aa, Mycobacterium
WGITCFITAVAGLMQIL

SEQ ID NO: 346957 - protein, 17 aa, Mycobacterium
WGLTYGIVLTVARTLGE

SEQ ID NO: 346958 - protein, 24 aa, Mycobacterium
WGNCTIKVMVGFLFLYPAFVAKAH

SEQ ID NO: 346959 - protein, 25 aa, Mycobacterium
WGNCTIKVMVGFLFLYPAFVAKAHQ

SEQ ID NO: 346960 - protein, 25 aa, Mycobacterium
WGNCTIKVMVGFLFLYPAFVAKSHD

SEQ ID NO: 346961 - protein, 24 aa, Mycobacterium
WGNCTVKVMVGFLFLYPAFVAKAH

SEQ ID NO: 346962 - protein, 22 aa, Mycobacterium
WGRGTWRTWALLAFVMWHTVYM

SEQ ID NO: 346963 - protein, 17 aa, Mycobacterium
WGRRGAPLLLVFSVAAR

SEQ ID NO: 346964 - protein, 17 aa, Mycobacterium
WGVVGAWTGSAAAGLLV

SEQ ID NO: 346965 - protein, 29 aa, Mycobacterium
WHHTRVGYLKSWRLALGAVWSTYRHTISE

SEQ ID NO: 346966 - protein, 17 aa, Mycobacterium
WHLPALIVINGFAAYAL

SEQ ID NO: 346967 - protein, 22 aa, Mycobacterium
WHRIAAAVARRPARVAIVSIGG

SEQ ID NO: 346968 - protein, 19 aa, Mycobacterium
WHRSIRQTVQFERAIRTAF

SEQ ID NO: 346969 - protein, 17 aa, Mycobacterium
WHTRPDLRQALAQLPAC

SEQ ID NO: 346970 - protein, 18 aa, Mycobacterium
WHVPAGYQPRMTWGTGPT

SEQ ID NO: 346971 - protein, 17 aa, Mycobacterium
WHWDRWAPASPWGTPPP

SEQ ID NO: 346972 - protein, 17 aa, Mycobacterium
WHWPIFLILNGERTGAS

SEQ ID NO: 346973 - protein, 17 aa, Mycobacterium
WHWPLLIFWFAYSNDDT

SEQ ID NO: 346974 - protein, 18 aa, Mycobacterium
WHWPLLIFWLSFTGHRHA

SEQ ID NO: 346975 - protein, 19 aa, Mycobacterium
WHWSLPLGVAILLAAVVGG

SEQ ID NO: 346976 - protein, 19 aa, Mycobacterium
WHYMTRWALLFGITEQMCP

SEQ ID NO: 346977 - protein, 18 aa, Mycobacterium
WIADRFGIRPVFLTAIAV

SEQ ID NO: 346978 - protein, 17 aa, Mycobacterium
WIAGTAYVGSGADPAAI

SEQ ID NO: 346979 - protein, 21 aa, Mycobacterium
WIAVILLTFHWARVVWQRTIV

SEQ ID NO: 346980 - protein, 25 aa, Mycobacterium
WIGAVYRYPWPVSMWPEALAMAVPA

SEQ ID NO: 346981 - protein, 19 aa, Mycobacterium
WIGYRQDWGWLHAMDWSLL

SEQ ID NO: 346982 - protein, 18 aa, Mycobacterium
WILREFIETLKIGWAGLA

SEQ ID NO: 346983 - protein, 17 aa, Mycobacterium
WIPVAAFAVWLVIWRVK

SEQ ID NO: 346984 - protein, 18 aa, Mycobacterium
WIPVFPLWVAVVLVLNQL

SEQ ID NO: 346985 - protein, 23 aa, Mycobacterium
WIPYYLCELSLRVSDLQYRTVVS

SEQ ID NO: 346986 - protein, 21 aa, Mycobacterium
WIPYYLCELSMRVSDLQYRTV

SEQ ID NO: 346987 - protein, 17 aa, Mycobacterium
WIRLPAIFGAGMVVRAT

SEQ ID NO: 346988 - protein, 18 aa, Mycobacterium
WIRRARRLLPALVLMVLT

SEQ ID NO: 346989 - protein, 18 aa, Mycobacterium
WISWPSYAVVEFIRSTPI

SEQ ID NO: 346990 - protein, 19 aa, Mycobacterium
WITQRLWWALLLTIGFWGL

SEQ ID NO: 346991 - protein, 20 aa, Mycobacterium
WKAGMFHLLIAVAVILTVIR

SEQ ID NO: 346992 - protein, 20 aa, Mycobacterium
WKEFVLQSWFLIRVAFLPTL

SEQ ID NO: 346993 - protein, 21 aa, Mycobacterium
WKIGEAPVFYGGYAVLLAVSA

SEQ ID NO: 346994 - protein, 17 aa, Mycobacterium
WKLGVAAAITLPLLLGA

SEQ ID NO: 346995 - protein, 17 aa, Mycobacterium
WKLKPGVVSTMTAQARY

SEQ ID NO: 346996 - protein, 17 aa, Mycobacterium
WKLLIPVSLLWIMIAAV

SEQ ID NO: 346997 - protein, 17 aa, Mycobacterium
WKLLIPVSLVWVLIAAV

SEQ ID NO: 346998 - protein, 25 aa, Mycobacterium
WKRLRPRFWPLIGFTVLKMLVFLVG

SEQ ID NO: 346999 - protein, 20 aa, Mycobacterium
WKVSRAYLNWLADRLQKTKT

SEQ ID NO: 347000 - protein, 21 aa, Mycobacterium
WLAAITWRLSFLWLAVAGLLL

SEQ ID NO: 347001 - protein, 21 aa, Mycobacterium
WLAKFEPMHQVFLGVRSLLYL

SEQ ID NO: 347002 - protein, 17 aa, Mycobacterium
WLARLEWELVLAVVTAA

SEQ ID NO: 347003 - protein, 18 aa, Mycobacterium
WLAVPVLLYACWRAFVRR

SEQ ID NO: 347004 - protein, 19 aa, Mycobacterium
WLDRLRALAQRTCVVPLPY

SEQ ID NO: 347005 - protein, 17 aa, Mycobacterium
WLDRWEPEPSRLLVLAF

SEQ ID NO: 347006 - protein, 18 aa, Mycobacterium
WLFGCGFLLIATSSGVGR

SEQ ID NO: 347007 - protein, 19 aa, Mycobacterium
WLFHDWRDVFWINVPLTAI

SEQ ID NO: 347008 - protein, 20 aa, Mycobacterium
WLFLHLLYLVGHRNRVAAAF

SEQ ID NO: 347009 - protein, 22 aa, Mycobacterium
WLGLSWRWLFALSIVPALVSLI

SEQ ID NO: 347010 - protein, 22 aa, Mycobacterium
WLGLSWRWLFGLSIIPALISLI

SEQ ID NO: 347011 - protein, 17 aa, Mycobacterium
WLGRFVSTYGWRAYALP

SEQ ID NO: 347012 - protein, 24 aa, Mycobacterium
WLGRLRFGALYAMSGLGGSVLVYL

SEQ ID NO: 347013 - protein, 20 aa, Mycobacterium
WLGSLLILSALWALRAVTHW

SEQ ID NO: 347014 - protein, 17 aa, Mycobacterium
WLGVPLYLLLGWVAIWY

SEQ ID NO: 347015 - protein, 19 aa, Mycobacterium
WLHDPRFLLGLAVYLCGFT

SEQ ID NO: 347016 - protein, 19 aa, Mycobacterium
WLHRFGDLIAPLTFIGAAY

SEQ ID NO: 347017 - protein, 18 aa, Mycobacterium
WLHVPLLPIPIPIRVPAS

SEQ ID NO: 347018 - protein, 18 aa, Mycobacterium
WLHVPLLPVPIPIQLPAN

SEQ ID NO: 347019 - protein, 21 aa, Mycobacterium
WLISSFGWHWIFLVNLPIGLA

SEQ ID NO: 347020 - protein, 18 aa, Mycobacterium
WLKARFRSIADPWNQVGV

SEQ ID NO: 347021 - protein, 19 aa, Mycobacterium
WLKDDPRGWSRLRGNAVVS

SEQ ID NO: 347022 - protein, 18 aa, Mycobacterium
WLLAKSMGYLDRGVQVVA

SEQ ID NO: 347023 - protein, 17 aa, Mycobacterium
WLLGERGMADGCWIAGT

SEQ ID NO: 347024 - protein, 18 aa, Mycobacterium
WLLKRWGEYFAVIATSVF

SEQ ID NO: 347025 - protein, 22 aa, Mycobacterium
WLLKRWGEYFAVIATSVFLPLE

SEQ ID NO: 347026 - protein, 18 aa, Mycobacterium
WLLKRWGEYFAVVATSLF

SEQ ID NO: 347027 - protein, 21 aa, Mycobacterium
WLLLHLLYLVGHRNRIAAAYS

SEQ ID NO: 347028 - protein, 17 aa, Mycobacterium
WLLLLAVTIAVTVPLTL

SEQ ID NO: 347029 - protein, 18 aa, Mycobacterium
WLLTAIACGLGLALFYGE

SEQ ID NO: 347030 - protein, 19 aa, Mycobacterium
WLNRLRALAHRTCVAPLPY

SEQ ID NO: 347031 - protein, 24 aa, Mycobacterium
WLNYLFCWGMLYQLGIAWQTGLLT

SEQ ID NO: 347032 - protein, 18 aa, Mycobacterium
WLNYLLGWGALYQLGIAW

SEQ ID NO: 347033 - protein, 21 aa, Mycobacterium
WLPARWRHWWWGLLLAFVPIH

SEQ ID NO: 347034 - protein, 20 aa, Mycobacterium
WLPDWLRPRPSSPTSLAPAG

SEQ ID NO: 347035 - protein, 18 aa, Mycobacterium
WLPVLIVVAVAAGALIVM

SEQ ID NO: 347036 - protein, 23 aa, Mycobacterium
WLQSWTIFYWAWWISWTPFVGMF

SEQ ID NO: 347037 - protein, 17 aa, Mycobacterium
WLRPRSWLLRRATTEAT

SEQ ID NO: 347038 - protein, 17 aa, Mycobacterium
WLRRHTRAIQVFGGVLL

SEQ ID NO: 347039 - protein, 17 aa, Mycobacterium
WLRTFIRSIPPLFSAIP

SEQ ID NO: 347040 - protein, 20 aa, Mycobacterium
WLRTHRRQILSIAFAAAGVA

SEQ ID NO: 347041 - protein, 17 aa, Mycobacterium
WLRVFSITLMFAGVTTT

SEQ ID NO: 347042 - protein, 18 aa, Mycobacterium
WLRWPARIYTDIFRGLPE

SEQ ID NO: 347043 - protein, 21 aa, Mycobacterium
WLSLCRWDLLGPIEFVGLDNW

SEQ ID NO: 347044 - protein, 20 aa, Mycobacterium
WLSLCRWDLLGPLRFVGLSN

SEQ ID NO: 347045 - protein, 25 aa, Mycobacterium
WLTGMFDRSAWRPAAVVVVGSDLDI

SEQ ID NO: 347046 - protein, 20 aa, Mycobacterium
WLTYRAIRWARGRRESDATD

SEQ ID NO: 347047 - protein, 20 aa, Mycobacterium
WLVALCVLTSLALCIYALAP

SEQ ID NO: 347048 - protein, 19 aa, Mycobacterium
WLVLHLVYLVGFKTKVSTL

SEQ ID NO: 347049 - protein, 17 aa, Mycobacterium
WLYKRTQTLSSREVGAK

SEQ ID NO: 347050 - protein, 19 aa, Mycobacterium
WMGTSLLYWINGIVYATFA

SEQ ID NO: 347051 - protein, 19 aa, Mycobacterium
WMMQAEVAITNFVSSMDVS

SEQ ID NO: 347052 - protein, 18 aa, Mycobacterium
WMPFKRPAGDWVFENGPP

SEQ ID NO: 347053 - protein, 19 aa, Mycobacterium
WNFPIVLVILLAVFGSLAA

SEQ ID NO: 347054 - protein, 19 aa, Mycobacterium
WNFSAAKNVFAWIGPVLAA

SEQ ID NO: 347055 - protein, 20 aa, Mycobacterium
WNIARWPLLLVLVVFGVAML

SEQ ID NO: 347056 - protein, 24 aa, Mycobacterium
WNIRSVSWLPLFHDMGLLMIMFPA

SEQ ID NO: 347057 - protein, 18 aa, Mycobacterium
WNLYFGFRIPGSSNYVLA

SEQ ID NO: 347058 - protein, 18 aa, Mycobacterium
WNLYFGFRIPGSSRILFG

SEQ ID NO: 347059 - protein, 17 aa, Mycobacterium
WNPLPCMGLGAGPFGGP

SEQ ID NO: 347060 - protein, 18 aa, Mycobacterium
WNSIVALVLSVLVILGLV

SEQ ID NO: 347061 - protein, 17 aa, Mycobacterium
WNVFFIFSLFYLFGHYA

SEQ ID NO: 347062 - protein, 17 aa, Mycobacterium
WNVFFIFSLFYLFGHYG

SEQ ID NO: 347063 - protein, 19 aa, Mycobacterium
WNVFKSWRYGEVVTVDDPW

SEQ ID NO: 347064 - protein, 19 aa, Mycobacterium
WNWWLPRWLARMLPSVDFD

SEQ ID NO: 347065 - protein, 19 aa, Mycobacterium
WNWWLPRWLDKILPEVDFE

SEQ ID NO: 347066 - protein, 18 aa, Mycobacterium
WPAFLAYLVSFVFIGSSW

SEQ ID NO: 347067 - protein, 20 aa, Mycobacterium
WPALILGVAWWLRRRSAGGG

SEQ ID NO: 347068 - protein, 17 aa, Mycobacterium
WPALLVVVCQVFVMYVV

SEQ ID NO: 347069 - protein, 19 aa, Mycobacterium
WPASGVFFGLVAVFQLGWA

SEQ ID NO: 347070 - protein, 19 aa, Mycobacterium
WPEAMGLVIVDGLIIVALG

SEQ ID NO: 347071 - protein, 19 aa, Mycobacterium
WPEKLARISFWCMNIGLAW

SEQ ID NO: 347072 - protein, 18 aa, Mycobacterium
WPGALGWGTNRLLVPAVL

SEQ ID NO: 347073 - protein, 17 aa, Mycobacterium
WPGPAAAVLLALASSAV

SEQ ID NO: 347074 - protein, 17 aa, Mycobacterium
WPGPILITASVLALGGL

SEQ ID NO: 347075 - protein, 19 aa, Mycobacterium
WPGPILVVSCIATLVGLLA

SEQ ID NO: 347076 - protein, 17 aa, Mycobacterium
WPGPVFAASLVIAIVGI

SEQ ID NO: 347077 - protein, 17 aa, Mycobacterium
WPGWAVVGVTLVFGLLI

SEQ ID NO: 347078 - protein, 17 aa, Mycobacterium
WPIWFAVLWAAQEWLKS

SEQ ID NO: 347079 - protein, 18 aa, Mycobacterium
WPKLKSFMADLVWIENIG

SEQ ID NO: 347080 - protein, 21 aa, Mycobacterium
WPLFAWFCVYAYRKFVRYEEE

SEQ ID NO: 347081 - protein, 17 aa, Mycobacterium
WPLRAVTAAGVYLAGGS

SEQ ID NO: 347082 - protein, 21 aa, Mycobacterium
WPMFAWFCVYAYRKFVRYEET

SEQ ID NO: 347083 - protein, 17 aa, Mycobacterium
WPPASALVSQNEAVDAL

SEQ ID NO: 347084 - protein, 18 aa, Mycobacterium
WPPPCTTGFLPIQQQRAA

SEQ ID NO: 347085 - protein, 17 aa, Mycobacterium
WPPVPGIPDFNLPIPGL

SEQ ID NO: 347086 - protein, 19 aa, Mycobacterium
WPRGGFVGIDIFFVIAGFF

SEQ ID NO: 347087 - protein, 17 aa, Mycobacterium
WPRREGFDRISIAVCVG

SEQ ID NO: 347088 - protein, 21 aa, Mycobacterium
WPRVPVRWLLLYGLGFGTIQF

SEQ ID NO: 347089 - protein, 21 aa, Mycobacterium
WPRYGGYAVAGVSSFGFGGAN

SEQ ID NO: 347090 - protein, 19 aa, Mycobacterium
WPSAPRWLGVPLYILLGWV

SEQ ID NO: 347091 - protein, 19 aa, Mycobacterium
WPSSPRWLGVPLYILLGWV

SEQ ID NO: 347092 - protein, 19 aa, Mycobacterium
WPTAPRWLGVPLYIVLGWV

SEQ ID NO: 347093 - protein, 19 aa, Mycobacterium
WPTWAVVAVTLVFALLVGA

SEQ ID NO: 347094 - protein, 21 aa, Mycobacterium
WPVPPRRGGLLALKPLELAIL

SEQ ID NO: 347095 - protein, 17 aa, Mycobacterium
WPYILVAVIFRFMDNLK

SEQ ID NO: 347096 - protein, 18 aa, Mycobacterium
WQDPRFQRAAGLYFGPDG

SEQ ID NO: 347097 - protein, 23 aa, Mycobacterium
WQGEYRVAWWVGVGLAVVLTLLS

SEQ ID NO: 347098 - protein, 19 aa, Mycobacterium
WQGTYRVAFWVGVGLAVLV

SEQ ID NO: 347099 - protein, 17 aa, Mycobacterium
WQHICGIQINWVVLAMS

SEQ ID NO: 347100 - protein, 22 aa, Mycobacterium
WQHIFGIQLYWIVLALAVIVLL

SEQ ID NO: 347101 - protein, 17 aa, Mycobacterium
WQHIIGLALHWMVLPMA

SEQ ID NO: 347102 - protein, 20 aa, Mycobacterium
WQHLFWFFGHPEVYIIALPF

SEQ ID NO: 347103 - protein, 22 aa, Mycobacterium
WQHLIGIPLHWMVLPMAVIVLL

SEQ ID NO: 347104 - protein, 18 aa, Mycobacterium
WQLIPAYVLAAAIGAWEV

SEQ ID NO: 347105 - protein, 20 aa, Mycobacterium
WQLSGPLLLWGFEIPRAMVF

SEQ ID NO: 347106 - protein, 20 aa, Mycobacterium
WQLTEGPAWHYALRRQPGKR

SEQ ID NO: 347107 - protein, 17 aa, Mycobacterium
WQPAWLRYSPLSFTGLA

SEQ ID NO: 347108 - protein, 17 aa, Mycobacterium
WQPSWLRYSPLTFTGLI

SEQ ID NO: 347109 - protein, 21 aa, Mycobacterium
WQPWLRWVVLVGSIAVAVVFS

SEQ ID NO: 347110 - protein, 17 aa, Mycobacterium
WQRLKGVAVVSAPGGQE

SEQ ID NO: 347111 - protein, 20 aa, Mycobacterium
WQRLKGVAVVSVPGQEPVTV

SEQ ID NO: 347112 - protein, 17 aa, Mycobacterium
WQSARFALRQEAAAPAC

SEQ ID NO: 347113 - protein, 28 aa, Mycobacterium
WQTFWRITLPSIRWGLTYGIVLTIARTL

SEQ ID NO: 347114 - protein, 19 aa, Mycobacterium
WRAAAPLGRDDAWIIFTSG

SEQ ID NO: 347115 - protein, 23 aa, Mycobacterium
WRAARIPLRWILPRMLIEAPFLV

SEQ ID NO: 347116 - protein, 18 aa, Mycobacterium
WRALLVFFSKWWQLESLY

SEQ ID NO: 347117 - protein, 17 aa, Mycobacterium
WRARVAGMDGRRIDQIE

SEQ ID NO: 347118 - protein, 17 aa, Mycobacterium
WRARVVQMDGRRIDLLE

SEQ ID NO: 347119 - protein, 19 aa, Mycobacterium
WRATIAVAMSNYIEAGSII

SEQ ID NO: 347120 - protein, 18 aa, Mycobacterium
WRAVWIPAVVVLIGVVVL

SEQ ID NO: 347121 - protein, 20 aa, Mycobacterium
WRDISSRVPGGTVARVAAGF

SEQ ID NO: 347122 - protein, 24 aa, Mycobacterium
WREAARWARRLAWVSMIAMLTEGA

SEQ ID NO: 347123 - protein, 20 aa, Mycobacterium
WRFGDTQARGYLTLNPLQYT

SEQ ID NO: 347124 - protein, 24 aa, Mycobacterium
WRFLLRRLEHAIVRRDTRMFDDPL

SEQ ID NO: 347125 - protein, 18 aa, Mycobacterium
WRFLLRRVEHAIVRRDTR

SEQ ID NO: 347126 - protein, 24 aa, Mycobacterium
WRGIGTAIVRWPAPILVASLAVAL

SEQ ID NO: 347127 - protein, 17 aa, Mycobacterium
WRGRRVGPLVAEQLPVV

SEQ ID NO: 347128 - protein, 18 aa, Mycobacterium
WRGWQLTEGPAWHYALRR

SEQ ID NO: 347129 - protein, 20 aa, Mycobacterium
WRHVPAILLVASLVLFTIAM

SEQ ID NO: 347130 - protein, 17 aa, Mycobacterium
WRIPFLIAAPLGLVGLY

SEQ ID NO: 347131 - protein, 17 aa, Mycobacterium
WRIPFLIAGPLGLVGLY

SEQ ID NO: 347132 - protein, 17 aa, Mycobacterium
WRIPFLLGGVFGLVAIY

SEQ ID NO: 347133 - protein, 17 aa, Mycobacterium
WRIPFLLSGVLVAVGLF

SEQ ID NO: 347134 - protein, 21 aa, Mycobacterium
WRITAEMPRRPAGGGIDEDAA

SEQ ID NO: 347135 - protein, 23 aa, Mycobacterium
WRITLPSIRWGLTYGIVLTIART

SEQ ID NO: 347136 - protein, 23 aa, Mycobacterium
WRITLPSIRWGLTYGIVLTVART

SEQ ID NO: 347137 - protein, 24 aa, Mycobacterium
WRKIGAAIVRWPGPILIGAVALAL

SEQ ID NO: 347138 - protein, 23 aa, Mycobacterium
WRKLGTAIAKWPAAMIAVAALVI

SEQ ID NO: 347139 - protein, 21 aa, Mycobacterium
WRKRLPTIFLDVARFALIGIG

SEQ ID NO: 347140 - protein, 21 aa, Mycobacterium
WRKRLPTIFLDVARFALIGVG

SEQ ID NO: 347141 - protein, 22 aa, Mycobacterium
WRKRLPVIFLDVARFVLIGAGL

SEQ ID NO: 347142 - protein, 27 aa, Mycobacterium
WRKVGTSVVRWPIPIVLVTCVIAVVGF

SEQ ID NO: 347143 - protein, 20 aa, Mycobacterium
WRLFGHIPYRIDIDIYQMGG

SEQ ID NO: 347144 - protein, 20 aa, Mycobacterium
WRLGLAGALAIPAYIAGLHW

SEQ ID NO: 347145 - protein, 17 aa, Mycobacterium
WRLLGVLALADPARNDS

SEQ ID NO: 347146 - protein, 17 aa, Mycobacterium
WRLNRLVPHGAVDRLDE

SEQ ID NO: 347147 - protein, 17 aa, Mycobacterium
WRLPFFIAGVLGGVGLY

SEQ ID NO: 347148 - protein, 17 aa, Mycobacterium
WRLPFLVAAPLGLIGVY

SEQ ID NO: 347149 - protein, 17 aa, Mycobacterium
WRLRIHGMVNREATYSL

SEQ ID NO: 347150 - protein, 17 aa, Mycobacterium
WRLSFLWLAVAGLLLTL

SEQ ID NO: 347151 - protein, 17 aa, Mycobacterium
WRLVLAIGVVFWHSWPL

SEQ ID NO: 347152 - protein, 23 aa, Mycobacterium
WRNILRIIALRLAESGGFYVIVT

SEQ ID NO: 347153 - protein, 20 aa, Mycobacterium
WRNLRFPLAWAPPEANVARI

SEQ ID NO: 347154 - protein, 17 aa, Mycobacterium
WRPFALGVLCWAVPAAV

SEQ ID NO: 347155 - protein, 20 aa, Mycobacterium
WRPGTNWGGWLMKRAARLFR

SEQ ID NO: 347156 - protein, 17 aa, Mycobacterium
WRPLLEPALTILTVGAL

SEQ ID NO: 347157 - protein, 20 aa, Mycobacterium
WRPMLICAALVLTSQVADFM

SEQ ID NO: 347158 - protein, 20 aa, Mycobacterium
WRPTLLLTRSFIADYVRNPV

SEQ ID NO: 347159 - protein, 24 aa, Mycobacterium
WRRASDWWLLLGLFVLFPMTFFGA

SEQ ID NO: 347160 - protein, 19 aa, Mycobacterium
WRRDAGWARRLAWISLAAL

SEQ ID NO: 347161 - protein, 17 aa, Mycobacterium
WRRGLIFAMFVFAAVFT

SEQ ID NO: 347162 - protein, 23 aa, Mycobacterium
WRRIATHVVRWPGPVLAGSLAVL

SEQ ID NO: 347163 - protein, 17 aa, Mycobacterium
WRRPRWGRRLQPGPVAD

SEQ ID NO: 347164 - protein, 19 aa, Mycobacterium
WRRRLPVIFVDVARFVLIG

SEQ ID NO: 347165 - protein, 24 aa, Mycobacterium
WRRVGTAIVRWPGPILAVSVAIAL

SEQ ID NO: 347166 - protein, 22 aa, Mycobacterium
WRRVGTAIVRWPGPVLAATCLV

SEQ ID NO: 347167 - protein, 24 aa, Mycobacterium
WRRVGTAVVRWPAPILALSGAIVL

SEQ ID NO: 347168 - protein, 25 aa, Mycobacterium
WRRVGTAVVRWPAPILAVSAAIVLV

SEQ ID NO: 347169 - protein, 25 aa, Mycobacterium
WRRVGTAVVRWPAPILAVSAAVVLV

SEQ ID NO: 347170 - protein, 23 aa, Mycobacterium
WRRVGTVVVRWPAPVLAAACAIA

SEQ ID NO: 347171 - protein, 17 aa, Mycobacterium
WRSAGLPAYQFPDPNGT

SEQ ID NO: 347172 - protein, 19 aa, Mycobacterium
WRSARWWGRGASLMAVPLC

SEQ ID NO: 347173 - protein, 25 aa, Mycobacterium
WRSDRLFCIAVAFLALVFAATTISG

SEQ ID NO: 347174 - protein, 26 aa, Mycobacterium
WRSDRLFCIAVGFLALVFASSTTAGV

SEQ ID NO: 347175 - protein, 20 aa, Mycobacterium
WRSGALGSLMSFVGVILGAV

SEQ ID NO: 347176 - protein, 18 aa, Mycobacterium
WRSNHLWAAFVFGLPILP

SEQ ID NO: 347177 - protein, 25 aa, Mycobacterium
WRTDRLFCIAVAFLALVFGATTVTG

SEQ ID NO: 347178 - protein, 25 aa, Mycobacterium
WRTDRLFCIAVGFLALVFAAATVTG

SEQ ID NO: 347179 - protein, 18 aa, Mycobacterium
WRVALLAAISTFLAAESL

SEQ ID NO: 347180 - protein, 18 aa, Mycobacterium
WRVAPGYRPLMTWGTGPT

SEQ ID NO: 347181 - protein, 20 aa, Mycobacterium
WRVNAPFFWGRGTWRTWALL

SEQ ID NO: 347182 - protein, 17 aa, Mycobacterium
WRVPFLLGAVLLVVGYF

SEQ ID NO: 347183 - protein, 17 aa, Mycobacterium
WRVPFLLSVVLLAIGVY

SEQ ID NO: 347184 - protein, 18 aa, Mycobacterium
WRVPMLFGAAMGFFVLYL

SEQ ID NO: 347185 - protein, 17 aa, Mycobacterium
WRWDRWVPSSPWAEPSS

SEQ ID NO: 347186 - protein, 17 aa, Mycobacterium
WRWIFAVNVPIGLIGIL

SEQ ID NO: 347187 - protein, 17 aa, Mycobacterium
WRWIFLINLPIGLVTIV

SEQ ID NO: 347188 - protein, 17 aa, Mycobacterium
WRWVFLVNLPLGIVAVL

SEQ ID NO: 347189 - protein, 20 aa, Mycobacterium
WRWVLLGLAVLMCWLSVAVL

SEQ ID NO: 347190 - protein, 19 aa, Mycobacterium
WSAANARFNGYFREIVTRF

SEQ ID NO: 347191 - protein, 27 aa, Mycobacterium
WSGMPVALRLLLPIAMVLTLVGIGFAF

SEQ ID NO: 347192 - protein, 17 aa, Mycobacterium
WSGVLGFLLGSITVTVL

SEQ ID NO: 347193 - protein, 18 aa, Mycobacterium
WSKRPARRARARWFPWFR

SEQ ID NO: 347194 - protein, 17 aa, Mycobacterium
WSLGNWPVGWKVVAIAV

SEQ ID NO: 347195 - protein, 19 aa, Mycobacterium
WSLLVGYGCLPWVATAMLR

SEQ ID NO: 347196 - protein, 18 aa, Mycobacterium
WSLLVGYGCLPWVAVSML

SEQ ID NO: 347197 - protein, 18 aa, Mycobacterium
WSLLVGYGCLPWVAVSVL

SEQ ID NO: 347198 - protein, 17 aa, Mycobacterium
WSLTVLVAVAWIARGIF

SEQ ID NO: 347199 - protein, 18 aa, Mycobacterium
WSMIGWLPQRPVLIPGTV

SEQ ID NO: 347200 - protein, 19 aa, Mycobacterium
WSPPGGGVWVRLRQLDQLT

SEQ ID NO: 347201 - protein, 19 aa, Mycobacterium
WSPRTWPLRARLVGTQVAL

SEQ ID NO: 347202 - protein, 18 aa, Mycobacterium
WSPSWWAQKFASRGSKPG

SEQ ID NO: 347203 - protein, 21 aa, Mycobacterium
WSRNRMAVVATVLFVLALSWA

SEQ ID NO: 347204 - protein, 20 aa, Mycobacterium
WSSDLSMTWNLLCRSITHGI

SEQ ID NO: 347205 - protein, 18 aa, Mycobacterium
WSSFVWRNEVADTFVETV

SEQ ID NO: 347206 - protein, 18 aa, Mycobacterium
WSSPFWQTWDLLLLWLAQ

SEQ ID NO: 347207 - protein, 20 aa, Mycobacterium
WSSPFWQTWDLLLLWLAQLH

SEQ ID NO: 347208 - protein, 25 aa, Mycobacterium
WSTESRWRPVAAILGVVVALGAVAT

SEQ ID NO: 347209 - protein, 17 aa, Mycobacterium
WSTRATVHFLWLRLARV

SEQ ID NO: 347210 - protein, 23 aa, Mycobacterium
WSYARRNLDLCGAIGFIDDAVAV

SEQ ID NO: 347211 - protein, 20 aa, Mycobacterium
WTAHWPRRRTLVVALVCLTV

SEQ ID NO: 347212 - protein, 18 aa, Mycobacterium
WTARLGAISVDWWATAVA

SEQ ID NO: 347213 - protein, 18 aa, Mycobacterium
WTGSKWSVPIGMYEKDLS

SEQ ID NO: 347214 - protein, 18 aa, Mycobacterium
WTIDAHMGLLFGVVNQII

SEQ ID NO: 347215 - protein, 17 aa, Mycobacterium
WTLPLGVAILLAAVVGG

SEQ ID NO: 347216 - protein, 20 aa, Mycobacterium
WTMALRFGGFAVVVGLVAWL

SEQ ID NO: 347217 - protein, 20 aa, Mycobacterium
WTNWVEIFLLLVISFSLPRT

SEQ ID NO: 347218 - protein, 19 aa, Mycobacterium
WTNWVEIFLLLVISSALPR

SEQ ID NO: 347219 - protein, 26 aa, Mycobacterium
WTTLHQLRWAILTVMAVLALAFVMNL

SEQ ID NO: 347220 - protein, 17 aa, Mycobacterium
WVAALAMLTLGGLAGAW

SEQ ID NO: 347221 - protein, 17 aa, Mycobacterium
WVATMFVWLRRRRKPPD

SEQ ID NO: 347222 - protein, 17 aa, Mycobacterium
WVFARFGLALSMIVYGM

SEQ ID NO: 347223 - protein, 18 aa, Mycobacterium
WVFLAFYVVCAFVTWFVF

SEQ ID NO: 347224 - protein, 17 aa, Mycobacterium
WVGASLWAFVATAMVLL

SEQ ID NO: 347225 - protein, 22 aa, Mycobacterium
WVGDLPWFIPMAFISLPFLLAF

SEQ ID NO: 347226 - protein, 22 aa, Mycobacterium
WVGELPWFIPMAFISLPFLLAF

SEQ ID NO: 347227 - protein, 18 aa, Mycobacterium
WVGVPLYLLLGWVAVGFF

SEQ ID NO: 347228 - protein, 18 aa, Mycobacterium
WVGVPLYLLLGWVAVWYT

SEQ ID NO: 347229 - protein, 21 aa, Mycobacterium
WVILLCLAFSALGKGIGLLRR

SEQ ID NO: 347230 - protein, 17 aa, Mycobacterium
WVLSRVIRRLSVIPDVH

SEQ ID NO: 347231 - protein, 18 aa, Mycobacterium
WVPAKARRVPGPLVAIVA

SEQ ID NO: 347232 - protein, 23 aa, Mycobacterium
WVPELWMDFTLRFDALAAIMSVL

SEQ ID NO: 347233 - protein, 18 aa, Mycobacterium
WVPVLGWLLVLGSVAGVL

SEQ ID NO: 347234 - protein, 20 aa, Mycobacterium
WVRRPRFALGSAVVLLAVSL

SEQ ID NO: 347235 - protein, 19 aa, Mycobacterium
WVSLPGLVAVTARWDFAPG

SEQ ID NO: 347236 - protein, 18 aa, Mycobacterium
WVSWRFVEQPVRRWRPQH

SEQ ID NO: 347237 - protein, 19 aa, Mycobacterium
WVTHGRLGIAILKNLLLAA

SEQ ID NO: 347238 - protein, 17 aa, Mycobacterium
WVTLVAAVALFFTGDAQ

SEQ ID NO: 347239 - protein, 20 aa, Mycobacterium
WVTQRLWWALLIVAGFWGLI

SEQ ID NO: 347240 - protein, 19 aa, Mycobacterium
WVTQRLWWALLLTVGFWGV

SEQ ID NO: 347241 - protein, 28 aa, Mycobacterium
WVVLPWPRRRVAIAFVWWADISMVVGAC

SEQ ID NO: 347242 - protein, 23 aa, Mycobacterium
WWGLPAWSWAVLWRRGRRPIDWS

SEQ ID NO: 347243 - protein, 17 aa, Mycobacterium
WWIAWVCSYAVSIAAIV

SEQ ID NO: 347244 - protein, 19 aa, Mycobacterium
WWITLCVVFALVGLYLTYV

SEQ ID NO: 347245 - protein, 20 aa, Mycobacterium
WWLAAIPVLVLLVVVAWALF

SEQ ID NO: 347246 - protein, 17 aa, Mycobacterium
WWMMVCWSQALRAYPAD

SEQ ID NO: 347247 - protein, 19 aa, Mycobacterium
WWPDIPAWLPVVITVSLIL

SEQ ID NO: 347248 - protein, 20 aa, Mycobacterium
WWPDRDRPRYTPPAQTQQPP

SEQ ID NO: 347249 - protein, 20 aa, Mycobacterium
WWPKERRGFALGAHHTGYPV

SEQ ID NO: 347250 - protein, 21 aa, Mycobacterium
WWRDPWRPPRILVGVTVIYLV

SEQ ID NO: 347251 - protein, 17 aa, Mycobacterium
WWRIPVLLLLAFGNGWA

SEQ ID NO: 347252 - protein, 18 aa, Mycobacterium
WWSLLSLLLFNWIALISN

SEQ ID NO: 347253 - protein, 24 aa, Mycobacterium
WWVPEPRWAGGWLGLERAAHILVV

SEQ ID NO: 347254 - protein, 20 aa, Mycobacterium
WWVSACSVLALLIVEGVVVN

SEQ ID NO: 347255 - protein, 20 aa, Mycobacterium
WYAIICLPVLFAAGMCLLDT

SEQ ID NO: 347256 - protein, 19 aa, Mycobacterium
WYAIVCLPVLFTAGMCLLD

SEQ ID NO: 347257 - protein, 19 aa, Mycobacterium
WYFWPVWPILGAGIGVLVH

SEQ ID NO: 347258 - protein, 23 aa, Mycobacterium
WYLLCGCAFLLLGFETRGKNLET

SEQ ID NO: 347259 - protein, 20 aa, Mycobacterium
WYNTALGLAMVFGRLLPIIL

SEQ ID NO: 347260 - protein, 21 aa, Mycobacterium
WYQEFLRYYFLTVESNVDGSL

SEQ ID NO: 347261 - protein, 21 aa, Mycobacterium
WYRNIRQTVRFDRAVRYCHEQ

SEQ ID NO: 347262 - protein, 17 aa, Mycobacterium
WYVIRWVIASALAGPLL

SEQ ID NO: 347263 - protein, 23 aa, Mycobacterium
WYYGFLWYHFVVMPAWQFVIDPL

SEQ ID NO: 347264 - protein, 20 aa, Mycobacterium
YADEISRAVVLIAVTVLLVG

SEQ ID NO: 347265 - protein, 21 aa, Mycobacterium
YADPWCAWALLAATVAIPTGL

SEQ ID NO: 347266 - protein, 25 aa, Mycobacterium
YADRRFGLGHGRLFALYVAAYCVGR

SEQ ID NO: 347267 - protein, 29 aa, Mycobacterium
YAEAAPLPWYKRAAVVFSLAAAGLAILVA

SEQ ID NO: 347268 - protein, 17 aa, Mycobacterium
YAGSLAQVFLCAAAVAA

SEQ ID NO: 347269 - protein, 18 aa, Mycobacterium
YAIFLLREHFRIIPNDLI

SEQ ID NO: 347270 - protein, 18 aa, Mycobacterium
YAIFLLREHFRIIPNDLV

SEQ ID NO: 347271 - protein, 17 aa, Mycobacterium
YALCIIVGIVAALVIGD

SEQ ID NO: 347272 - protein, 21 aa, Mycobacterium
YALGVLVVWLVRYMRSQDSSP

SEQ ID NO: 347273 - protein, 24 aa, Mycobacterium
YALQEFWPTWLFAVTVSVGGPLSY

SEQ ID NO: 347274 - protein, 18 aa, Mycobacterium
YALRIAIDMLWHDLPQPH

SEQ ID NO: 347275 - protein, 18 aa, Mycobacterium
YALTWDWRTDSGYQQVTV

SEQ ID NO: 347276 - protein, 21 aa, Mycobacterium
YANAMWDPTIRQFAYGDKGYF

SEQ ID NO: 347277 - protein, 23 aa, Mycobacterium
YAPRRLAGPLAYMVDLLAAVPSI

SEQ ID NO: 347278 - protein, 18 aa, Mycobacterium
YAQSRLWFIDQLHGPSPV

SEQ ID NO: 347279 - protein, 18 aa, Mycobacterium
YARFGWAAARLDDAANYV

SEQ ID NO: 347280 - protein, 24 aa, Mycobacterium
YARIRRLIVRWWIAWVASYLVSVF

SEQ ID NO: 347281 - protein, 17 aa, Mycobacterium
YARLAMRYVQAHAEQGA

SEQ ID NO: 347282 - protein, 28 aa, Mycobacterium
YARLVLLWFLCSAFPIAVIASLVVLRSY

SEQ ID NO: 347283 - protein, 17 aa, Mycobacterium
YATLKWARIDPEMYPEL

SEQ ID NO: 347284 - protein, 20 aa, Mycobacterium
YAWPFYWLVDMRAMAWLVVA

SEQ ID NO: 347285 - protein, 22 aa, Mycobacterium
YAWPYRWLIAVVAGLQLISTLT

SEQ ID NO: 347286 - protein, 18 aa, Mycobacterium
YCHTRLWPPVIVGLHHIV

SEQ ID NO: 347287 - protein, 22 aa, Mycobacterium
YCLSFARLPYFSTMGAPVAIGM

SEQ ID NO: 347288 - protein, 30 aa, Mycobacterium
YDAGPAPLPWYKRPPILFGAAAVAALLAAG

SEQ ID NO: 347289 - protein, 17 aa, Mycobacterium
YDAPRPVLGAAIAELVP

SEQ ID NO: 347290 - protein, 19 aa, Mycobacterium
YDGRLYLVMPIVDGVDLNK

SEQ ID NO: 347291 - protein, 22 aa, Mycobacterium
YDHPRLGSLAGFLDELGPPPQV

SEQ ID NO: 347292 - protein, 18 aa, Mycobacterium
YDHPRLGSLAGYLDELSP

SEQ ID NO: 347293 - protein, 18 aa, Mycobacterium
YDKARIIVTAALEHYCPK

SEQ ID NO: 347294 - protein, 23 aa, Mycobacterium
YDRNSGAFILEWTSQIVGGPFND

SEQ ID NO: 347295 - protein, 23 aa, Mycobacterium
YDTEELWSAIGLVPQRGYLFSGT

SEQ ID NO: 347296 - protein, 17 aa, Mycobacterium
YEAWFLAAAVRRGWVVA

SEQ ID NO: 347297 - protein, 19 aa, Mycobacterium
YECVNCLTYALARQLFVTL

SEQ ID NO: 347298 - protein, 18 aa, Mycobacterium
YEFAKFVGVDTRRRDAST

SEQ ID NO: 347299 - protein, 18 aa, Mycobacterium
YEGFPADVLYYFRLYALG

SEQ ID NO: 347300 - protein, 23 aa, Mycobacterium
YEGFPADVLYYFRLYALGTQVVI

SEQ ID NO: 347301 - protein, 25 aa, Mycobacterium
YEIRCLKPRFGTVLTVVGHTILTLG

SEQ ID NO: 347302 - protein, 19 aa, Mycobacterium
YELDPALFLRYPGVTDVTR

SEQ ID NO: 347303 - protein, 17 aa, Mycobacterium
YELPFLLGHPFNLWTAT

SEQ ID NO: 347304 - protein, 24 aa, Mycobacterium
YERDSALCGVSWVYHYAVAVYRDD

SEQ ID NO: 347305 - protein, 22 aa, Mycobacterium
YESNVVAVLGMPVGKITKITPQ

SEQ ID NO: 347306 - protein, 21 aa, Mycobacterium
YETIGGLALREFGHIPVAGET

SEQ ID NO: 347307 - protein, 22 aa, Mycobacterium
YETIGGLVLREIGHIPAAGDTV

SEQ ID NO: 347308 - protein, 20 aa, Mycobacterium
YETIGGLVLRELGHIPVAGE

SEQ ID NO: 347309 - protein, 24 aa, Mycobacterium
YFAEGLHYWPWVLLGYFTVAIMVV

SEQ ID NO: 347310 - protein, 23 aa, Mycobacterium
YFDGTNWTTEWAFSTDPPKERTS

SEQ ID NO: 347311 - protein, 25 aa, Mycobacterium
YFESLGVPCAIGMLVVVAASLTIGP

SEQ ID NO: 347312 - protein, 17 aa, Mycobacterium
YFGAFGLVVAVGLIPVV

SEQ ID NO: 347313 - protein, 25 aa, Mycobacterium
YFGVLKILLEWVIGNLFGFSPLLAG

SEQ ID NO: 347314 - protein, 17 aa, Mycobacterium
YFLLCPMLIVFGIAVIG

SEQ ID NO: 347315 - protein, 18 aa, Mycobacterium
YFLLCPMLIVFGVAVVGV

SEQ ID NO: 347316 - protein, 19 aa, Mycobacterium
YFMGWSYWFAWIVAGIADL

SEQ ID NO: 347317 - protein, 18 aa, Mycobacterium
YFPLPGHFNAERAARAVE

SEQ ID NO: 347318 - protein, 19 aa, Mycobacterium
YFTGTGIKGRFLAWFYTVV

SEQ ID NO: 347319 - protein, 19 aa, Mycobacterium
YFTGTGLKGWFQRWFFTAV

SEQ ID NO: 347320 - protein, 23 aa, Mycobacterium
YFVAFEVSQGWTLGKKLLGMRVH

SEQ ID NO: 347321 - protein, 20 aa, Mycobacterium
YFVRRGRYAIGEIFVPRGGV

SEQ ID NO: 347322 - protein, 21 aa, Mycobacterium
YFWLPCLACLLALAELHLHTG

SEQ ID NO: 347323 - protein, 24 aa, Mycobacterium
YFYLKWWKLLLVLLGVWSAAAVAG

SEQ ID NO: 347324 - protein, 29 aa, Mycobacterium
YFYWEPHCFDIPACWAFRSLFDMLDSVDK

SEQ ID NO: 347325 - protein, 28 aa, Mycobacterium
YFYWEPHCFDIPVCFAIRSLFDSLDGID

SEQ ID NO: 347326 - protein, 27 aa, Mycobacterium
YFYWEPHCFDIPVCFAMRSLFDSLDGI

SEQ ID NO: 347327 - protein, 17 aa, Mycobacterium
YFYWEPHCYNIPVCHSM

SEQ ID NO: 347328 - protein, 21 aa, Mycobacterium
YGAICYLIFVAAFLYAIGFVG

SEQ ID NO: 347329 - protein, 21 aa, Mycobacterium
YGAPITVAAPAYWSEGQFAAL

SEQ ID NO: 347330 - protein, 17 aa, Mycobacterium
YGLGLWWGVLRERNVRA

SEQ ID NO: 347331 - protein, 21 aa, Mycobacterium
YGLGVFSVWLVRFMREKDHSP

SEQ ID NO: 347332 - protein, 25 aa, Mycobacterium
YGLGWRPRLLVAMLVATALALVGTN

SEQ ID NO: 347333 - protein, 17 aa, Mycobacterium
YGLHAMFFDQPRVNEKH

SEQ ID NO: 347334 - protein, 17 aa, Mycobacterium
YGLPMWLILLLRVVFLL

SEQ ID NO: 347335 - protein, 17 aa, Mycobacterium
YGRERLGPFWGHTAGWS

SEQ ID NO: 347336 - protein, 19 aa, Mycobacterium
YGRRGWLTIGLVIVGASSA

SEQ ID NO: 347337 - protein, 17 aa, Mycobacterium
YGSGYGRGAYAGDYQDY

SEQ ID NO: 347338 - protein, 21 aa, Mycobacterium
YGTPISIAVPAYWSDEQFAAL

SEQ ID NO: 347339 - protein, 24 aa, Mycobacterium
YGVGDLQTAGWLPGHSWYAFDLSP

SEQ ID NO: 347340 - protein, 23 aa, Mycobacterium
YHEAGHTLAAWAMPDIERVYKVT

SEQ ID NO: 347341 - protein, 20 aa, Mycobacterium
YHTERLWSAIGLVPQRGYLF

SEQ ID NO: 347342 - protein, 18 aa, Mycobacterium
YIAAAALTWVRYARPRGV

SEQ ID NO: 347343 - protein, 18 aa, Mycobacterium
YILGGWLFAWSTRGIGGF

SEQ ID NO: 347344 - protein, 17 aa, Mycobacterium
YIRAARPFIAFYNWCAN

SEQ ID NO: 347345 - protein, 19 aa, Mycobacterium
YISRGVGGHGWFQGSVSNP

SEQ ID NO: 347346 - protein, 20 aa, Mycobacterium
YKLNSAFAVGGPKCLVKVIQ

SEQ ID NO: 347347 - protein, 20 aa, Mycobacterium
YKTPRVFIAAAWVAIVAGVV

SEQ ID NO: 347348 - protein, 26 aa, Mycobacterium
YKYFLEFFQRMGFSPAVAVILAIIAL

SEQ ID NO: 347349 - protein, 20 aa, Mycobacterium
YKYMATFCARSDLDGSGGHR

SEQ ID NO: 347350 - protein, 21 aa, Mycobacterium
YLAGYRLSLIIAKRYPNMPVP

SEQ ID NO: 347351 - protein, 21 aa, Mycobacterium
YLCLMPIFPLAFWLMNVYAAI

SEQ ID NO: 347352 - protein, 20 aa, Mycobacterium
YLCLMPIFPLALWLMNVYAA

SEQ ID NO: 347353 - protein, 21 aa, Mycobacterium
YLCLMPIFPLALWLMNVYAAI

SEQ ID NO: 347354 - protein, 19 aa, Mycobacterium
YLFHDWRYVFWINVPLTLI

SEQ ID NO: 347355 - protein, 26 aa, Mycobacterium
YLGAFGLAGGLGWKLWDEHTVTQAGQ

SEQ ID NO: 347356 - protein, 19 aa, Mycobacterium
YLGRWAADACDDWASAPEV

SEQ ID NO: 347357 - protein, 22 aa, Mycobacterium
YLKRAEICRERMGPVLRRATFN

SEQ ID NO: 347358 - protein, 18 aa, Mycobacterium
YLKTHIEYAADKCHGDTR

SEQ ID NO: 347359 - protein, 24 aa, Mycobacterium
YLLGPKNFFAWALSVMFLVFTLRA

SEQ ID NO: 347360 - protein, 17 aa, Mycobacterium
YLLNFGPTFTIGAELGP

SEQ ID NO: 347361 - protein, 17 aa, Mycobacterium
YLLNFGPTFTISADLGP

SEQ ID NO: 347362 - protein, 17 aa, Mycobacterium
YLMCGLARHRRLLSQEA

SEQ ID NO: 347363 - protein, 18 aa, Mycobacterium
YLMCGLARHRRLLSQEAA

SEQ ID NO: 347364 - protein, 19 aa, Mycobacterium
YLPLVVRRRITFLAKAEYF

SEQ ID NO: 347365 - protein, 18 aa, Mycobacterium
YLPMPWLFRHLSGYASRA

SEQ ID NO: 347366 - protein, 18 aa, Mycobacterium
YLPPEVFNNPDFKRGLKL

SEQ ID NO: 347367 - protein, 22 aa, Mycobacterium
YLREVQDVWTWVRPYFDDRATA

SEQ ID NO: 347368 - protein, 22 aa, Mycobacterium
YLRKRYEALVGNPLFGTMEFID

SEQ ID NO: 347369 - protein, 18 aa, Mycobacterium
YLSLFSWMFGLVVTELPL

SEQ ID NO: 347370 - protein, 18 aa, Mycobacterium
YLTLRFSTVLIRVLRDGG

SEQ ID NO: 347371 - protein, 21 aa, Mycobacterium
YLWHWPALLLAPALIGADLGL

SEQ ID NO: 347372 - protein, 17 aa, Mycobacterium
YLWHWPIFLILNGERTG

SEQ ID NO: 347373 - protein, 20 aa, Mycobacterium
YLWHWPIFLVLNGERTGWTG

SEQ ID NO: 347374 - protein, 19 aa, Mycobacterium
YLWHWPVLLLLPPLLGDPA

SEQ ID NO: 347375 - protein, 18 aa, Mycobacterium
YMLIGWQAGLAFTRASLR

SEQ ID NO: 347376 - protein, 19 aa, Mycobacterium
YMLWLYQRVMTGPVATGNE

SEQ ID NO: 347377 - protein, 18 aa, Mycobacterium
YMRYPLFLGFDIVGGIAW

SEQ ID NO: 347378 - protein, 23 aa, Mycobacterium
YMRYPVFLAFDIVGGISWGAGVT

SEQ ID NO: 347379 - protein, 20 aa, Mycobacterium
YMRYPVFLGFDIVGGILWGG

SEQ ID NO: 347380 - protein, 18 aa, Mycobacterium
YMWFCPGANHAPHHSPAE

SEQ ID NO: 347381 - protein, 18 aa, Mycobacterium
YNGRVSIVRGIQGTLLGV

SEQ ID NO: 347382 - protein, 23 aa, Mycobacterium
YNHDLRFIIVLTVIVVLLILVAL

SEQ ID NO: 347383 - protein, 17 aa, Mycobacterium
YNIGAALTRWLRLANTC

SEQ ID NO: 347384 - protein, 17 aa, Mycobacterium
YNMPLELALTVTPFLII

SEQ ID NO: 347385 - protein, 18 aa, Mycobacterium
YNMPLELTLTVIPFIIIS

SEQ ID NO: 347386 - protein, 18 aa, Mycobacterium
YNMPLELTLTVIPFLIIS

SEQ ID NO: 347387 - protein, 25 aa, Mycobacterium
YNRIRRPLMRFGHMVAFFFRALSGI

SEQ ID NO: 347388 - protein, 17 aa, Mycobacterium
YNSGPFGHQWFTVQRTI

SEQ ID NO: 347389 - protein, 21 aa, Mycobacterium
YNVLDWFNWGLSGFNRYGYDF

SEQ ID NO: 347390 - protein, 25 aa, Mycobacterium
YPEQGGLPWYKRTALVLTVAGAGVA

SEQ ID NO: 347391 - protein, 20 aa, Mycobacterium
YPEYSRPGGYYGPAADPSAP

SEQ ID NO: 347392 - protein, 24 aa, Mycobacterium
YPGFPADVLYEFRLLALATQLVLW

SEQ ID NO: 347393 - protein, 17 aa, Mycobacterium
YPHRRKGFALGFNAGAG

SEQ ID NO: 347394 - protein, 18 aa, Mycobacterium
YPHRRSWIVLGIIASNAL

SEQ ID NO: 347395 - protein, 17 aa, Mycobacterium
YPIGRRLAAPSVTNPPP

SEQ ID NO: 347396 - protein, 19 aa, Mycobacterium
YPISGAIYQWARRLGGAAV

SEQ ID NO: 347397 - protein, 21 aa, Mycobacterium
YPLAFAVCGLFPLLAWPIVPQ

SEQ ID NO: 347398 - protein, 20 aa, Mycobacterium
YPLFLGFDIVGGIAWGGGAT

SEQ ID NO: 347399 - protein, 17 aa, Mycobacterium
YPLGSLFGGPSVDDDLD

SEQ ID NO: 347400 - protein, 20 aa, Mycobacterium
YPLIERFPLMLGTAGAVLAI

SEQ ID NO: 347401 - protein, 18 aa, Mycobacterium
YPLPARASALGWSNGTSF

SEQ ID NO: 347402 - protein, 17 aa, Mycobacterium
YPLTWVASPGRRLWMKL

SEQ ID NO: 347403 - protein, 17 aa, Mycobacterium
YPLWSSFVWRNELADTF

SEQ ID NO: 347404 - protein, 20 aa, Mycobacterium
YPRERLEYMVSDARPITVLD

SEQ ID NO: 347405 - protein, 17 aa, Mycobacterium
YPRYTCDYGTPKLPPSS

SEQ ID NO: 347406 - protein, 19 aa, Mycobacterium
YPSTLKISIVERVPVVVKD

SEQ ID NO: 347407 - protein, 18 aa, Mycobacterium
YPVSLAVGGLRWTQVVAG

SEQ ID NO: 347408 - protein, 18 aa, Mycobacterium
YQHYEWLSTVAIIALLAT

SEQ ID NO: 347409 - protein, 18 aa, Mycobacterium
YQKLMFWIVGVVFLLLMV

SEQ ID NO: 347410 - protein, 18 aa, Mycobacterium
YQRLMLWIIGAVWFVVMV

SEQ ID NO: 347411 - protein, 25 aa, Mycobacterium
YQYLKWWKLLLVILGVWFGAAEVGL

SEQ ID NO: 347412 - protein, 17 aa, Mycobacterium
YRAEILVGLVVSVLAAT

SEQ ID NO: 347413 - protein, 17 aa, Mycobacterium
YRARPVFVPAKGPGDAL

SEQ ID NO: 347414 - protein, 17 aa, Mycobacterium
YRASAGLRRQLNKVFPT

SEQ ID NO: 347415 - protein, 21 aa, Mycobacterium
YRAVINFKFGWDIYNEHFDHV

SEQ ID NO: 347416 - protein, 25 aa, Mycobacterium
YRDAVPFPKFIEGMGLLLHLAQPTA

SEQ ID NO: 347417 - protein, 17 aa, Mycobacterium
YRFLPAVGVVLYVVFVA

SEQ ID NO: 347418 - protein, 25 aa, Mycobacterium
YRFLVRRLECALLRGGLDPADGRPR

SEQ ID NO: 347419 - protein, 21 aa, Mycobacterium
YRFPGYLGFHIVERWQFHYSQ

SEQ ID NO: 347420 - protein, 21 aa, Mycobacterium
YRFPSYLGFHIVERWQFHYSQ

SEQ ID NO: 347421 - protein, 17 aa, Mycobacterium
YRGVEWVAIAAIAGPTL

SEQ ID NO: 347422 - protein, 22 aa, Mycobacterium
YRIGALCPYCMVVWAVTIPLAV

SEQ ID NO: 347423 - protein, 22 aa, Mycobacterium
YRIGALCPYCMVVWAVTIPLLV

SEQ ID NO: 347424 - protein, 22 aa, Mycobacterium
YRIGALCPYCMVVWAVTMSLLV

SEQ ID NO: 347425 - protein, 23 aa, Mycobacterium
YRIGSLCPYCMVVWIITATLLVV

SEQ ID NO: 347426 - protein, 17 aa, Mycobacterium
YRIIPNFKQMVVSSNQW

SEQ ID NO: 347427 - protein, 18 aa, Mycobacterium
YRIVGALPLAYGIIASGI

SEQ ID NO: 347428 - protein, 20 aa, Mycobacterium
YRKEILRLIAQIGMGTGAMA

SEQ ID NO: 347429 - protein, 22 aa, Mycobacterium
YRLADRVRVSWFRTLLLKWMLV

SEQ ID NO: 347430 - protein, 20 aa, Mycobacterium
YRLFLKRAGSHWLVTRMTTI

SEQ ID NO: 347431 - protein, 21 aa, Mycobacterium
YRLLEKPMRIFSLRTLVAIAA

SEQ ID NO: 347432 - protein, 17 aa, Mycobacterium
YRLLGGIPLAYAVIVSG

SEQ ID NO: 347433 - protein, 18 aa, Mycobacterium
YRLPVVYSNYGLRASALP

SEQ ID NO: 347434 - protein, 17 aa, Mycobacterium
YRLVELLGRGGMGEVWR

SEQ ID NO: 347435 - protein, 21 aa, Mycobacterium
YRNHLRLPAAVPQQAAGTIRE

SEQ ID NO: 347436 - protein, 19 aa, Mycobacterium
YRPNLFVTYWSFRAMIGFL

SEQ ID NO: 347437 - protein, 20 aa, Mycobacterium
YRPNLFVTYWSFRAMIGFLA

SEQ ID NO: 347438 - protein, 21 aa, Mycobacterium
YRPNLFVTYWSFRAMIGFLAI

SEQ ID NO: 347439 - protein, 20 aa, Mycobacterium
YRPNLFVTYWSFRAMIGLLL

SEQ ID NO: 347440 - protein, 21 aa, Mycobacterium
YRPNLFVTYWSFRLMIGFLVF

SEQ ID NO: 347441 - protein, 18 aa, Mycobacterium
YRRNGWKYGTPRDDSRRI

SEQ ID NO: 347442 - protein, 20 aa, Mycobacterium
YRSATPIAWYLAAAASVSAV

SEQ ID NO: 347443 - protein, 20 aa, Mycobacterium
YRSAVPRGWARARKTILSGN

SEQ ID NO: 347444 - protein, 18 aa, Mycobacterium
YRSTRYVLRHAIPIGLSV

SEQ ID NO: 347445 - protein, 25 aa, Mycobacterium
YRTAVMARLRLIGIGVPLAIGVLAG

SEQ ID NO: 347446 - protein, 17 aa, Mycobacterium
YRTGLIIVGLARCIAMV

SEQ ID NO: 347447 - protein, 17 aa, Mycobacterium
YRTPVLFLLRLSVPTAA

SEQ ID NO: 347448 - protein, 18 aa, Mycobacterium
YRTVVAFVALIIVLLVRP

SEQ ID NO: 347449 - protein, 17 aa, Mycobacterium
YRVDIDWAKQTENGAPA

SEQ ID NO: 347450 - protein, 20 aa, Mycobacterium
YSAMFTDVFGLREGDDVRMA

SEQ ID NO: 347451 - protein, 21 aa, Mycobacterium
YSDMLQFVWAQAKFRLTGREN

SEQ ID NO: 347452 - protein, 21 aa, Mycobacterium
YSEERLRPPPGYKDTTVPGIF

SEQ ID NO: 347453 - protein, 18 aa, Mycobacterium
YSEKRLQPPPGYKDTTVP

SEQ ID NO: 347454 - protein, 19 aa, Mycobacterium
YSEPRLQPPNGYKDTTVPG

SEQ ID NO: 347455 - protein, 19 aa, Mycobacterium
YSHNFYLWWLAKAGAVGMA

SEQ ID NO: 347456 - protein, 19 aa, Mycobacterium
YSIDELPQFINVLKGDMSV

SEQ ID NO: 347457 - protein, 19 aa, Mycobacterium
YSKSTWRLWSFPWQAKSPG

SEQ ID NO: 347458 - protein, 22 aa, Mycobacterium
YSLGCALFRLLTSHTPYEDNSL

SEQ ID NO: 347459 - protein, 18 aa, Mycobacterium
YSLPLRRLLGFLAAGLDA

SEQ ID NO: 347460 - protein, 18 aa, Mycobacterium
YSLPVRRLVGFAAAGLDA

SEQ ID NO: 347461 - protein, 24 aa, Mycobacterium
YSLYWKRFNTRGALWSMYGGLIST

SEQ ID NO: 347462 - protein, 18 aa, Mycobacterium
YSNPGFSWTGFLRAIKNN

SEQ ID NO: 347463 - protein, 18 aa, Mycobacterium
YSVLKCVVFVWLSSTVQC

SEQ ID NO: 347464 - protein, 17 aa, Mycobacterium
YTAEFLQAAALRAGNPI

SEQ ID NO: 347465 - protein, 18 aa, Mycobacterium
YTETKLNSAFAFGGPKCL

SEQ ID NO: 347466 - protein, 17 aa, Mycobacterium
YTGHYFGAWVFIAGFLM

SEQ ID NO: 347467 - protein, 17 aa, Mycobacterium
YTLDGWVAGWRRIGAQA

SEQ ID NO: 347468 - protein, 24 aa, Mycobacterium
YTPWLTRLAAFIIDILPYAVVHGI

SEQ ID NO: 347469 - protein, 24 aa, Mycobacterium
YTRADCPRYGDLKGPSCFTAPELV

SEQ ID NO: 347470 - protein, 21 aa, Mycobacterium
YTVGLWFRRIWIFQPHGEVMI

SEQ ID NO: 347471 - protein, 19 aa, Mycobacterium
YTVGMWFRRIWLFQPHGEV

SEQ ID NO: 347472 - protein, 21 aa, Mycobacterium
YVFCALCAGIAGLMIASNISA

SEQ ID NO: 347473 - protein, 20 aa, Mycobacterium
YVILGWRPVLLVPLTFALFT

SEQ ID NO: 347474 - protein, 17 aa, Mycobacterium
YVKWWKLALMLLGVWAA

SEQ ID NO: 347475 - protein, 24 aa, Mycobacterium
YVLFAQVFWLFWAALLSAPLWLPL

SEQ ID NO: 347476 - protein, 17 aa, Mycobacterium
YVPLRLITLTGFLLSAV

SEQ ID NO: 347477 - protein, 18 aa, Mycobacterium
YVVMGAGWVWYRGLQGEP

SEQ ID NO: 347478 - protein, 18 aa, Mycobacterium
YWAVVSFLVLFSIANFPD

SEQ ID NO: 347479 - protein, 27 aa, Mycobacterium
YWEKHCFDIPGCWSLRSLFDALDGLDQ

SEQ ID NO: 347480 - protein, 23 aa, Mycobacterium
YWEPHCYDIPVCWTMRSVFDTLD

SEQ ID NO: 347481 - protein, 22 aa, Mycobacterium
YWFRSIRQTVQFERAVRGACDA

SEQ ID NO: 347482 - protein, 21 aa, Mycobacterium
YWLGEQWWRPLIAVGAVALGI

SEQ ID NO: 347483 - protein, 19 aa, Mycobacterium
YWMDHRVVGGIGFELTQRL

SEQ ID NO: 347484 - protein, 22 aa, Mycobacterium
YWRRSGLTAARFMACPFGEPGS

SEQ ID NO: 347485 - protein, 20 aa, Mycobacterium
YYLAAFVVGSAVAWGIVTVS

SEQ ID NO: 347486 - protein, 22 aa, Mycobacterium
YYMAETNLRFMLGRFATIDVRF

SEQ ID NO: 347487 - protein, 22 aa, Mycobacterium
YYPVSAIMWVWYKAFAFLLGPT

SEQ ID NO: 347488 - protein, 22 aa, Mycobacterium
YYPVSGIMWVWYKLFAYLLGPK

SEQ ID NO: 347489 - protein, 24 aa, Mycobacterium
AVLLPFFSFMTFLIAVPTGIKFFN

SEQ ID NO: 347490 - protein, 26 aa, Mycobacterium
GGVLLWQHLFWFFGHPEVYIIALPFF

SEQ ID NO: 347491 - protein, 27 aa, Mycobacterium
ATAGACIGFLWWNAAPAKIFMGDTGSL

SEQ ID NO: 347492 - protein, 20 aa, Mycobacterium
IDDRWGLDALTKFAGQITAA

SEQ ID NO: 347493 - protein, 18 aa, Mycobacterium
LQRKLRVGFAKAGRLMDL

SEQ ID NO: 347494 - protein, 29 aa, Mycobacterium
AMGYEPEDLPWEVPLIELGLDSLMAVRIK

SEQ ID NO: 347495 - protein, 18 aa, Mycobacterium
ECGHMWVARATGMKVRRY

SEQ ID NO: 347496 - protein, 23 aa, Mycobacterium
GFALFIFWLLLIARVVVEFIRSF

SEQ ID NO: 347497 - protein, 20 aa, Mycobacterium
HMWVARATGMKVRRYFVGFG

SEQ ID NO: 347498 - protein, 17 aa, Mycobacterium
IIALPFFGIVSEIFPVF

SEQ ID NO: 347499 - protein, 25 aa, Mycobacterium
ITAYVLTFGGLMLLGGRLGDTIGRK

SEQ ID NO: 347500 - protein, 23 aa, Mycobacterium
KGRSFRIHILFASQTLDVGKIKD

SEQ ID NO: 347501 - protein, 25 aa, Mycobacterium
KQLITIARAFLARPQLLILDEATSS

SEQ ID NO: 347502 - protein, 19 aa, Mycobacterium
LGFGGMSEVHLARDLRLHR

SEQ ID NO: 347503 - protein, 18 aa, Mycobacterium
TAAVAVLIIACPCALGLA

SEQ ID NO: 347504 - protein, 24 aa, Mycobacterium
AAGFVFSWLRRRSGSLIAPIALHW

SEQ ID NO: 347505 - protein, 19 aa, Mycobacterium
AERVTFATWAIVTGKSPGG

SEQ ID NO: 347506 - protein, 24 aa, Mycobacterium
AVLLPFFSFMTYLIAVPTGIKFFN

SEQ ID NO: 347507 - protein, 22 aa, Mycobacterium
DPQQRMALELTWEALEHARIPA

SEQ ID NO: 347508 - protein, 24 aa, Mycobacterium
ERVLWAVDLTTVYAALLLTVLADA

SEQ ID NO: 347509 - protein, 24 aa, Mycobacterium
EVGEAAMLAFLFSISEGLEEYSLA

SEQ ID NO: 347510 - protein, 31 aa, Mycobacterium; identical to SEQ ID NO: 20533

SEQ ID NO: 347511 - protein, 32 aa, Mycobacterium; identical to SEQ ID NO: 20584

SEQ ID NO: 347512 - protein, 17 aa, Mycobacterium
GLRRWYVITFLMGLFFV

SEQ ID NO: 347513 - protein, 29 aa, Mycobacterium
IADFDDFWRPIRSYFYWEKHCYDIPICWS

SEQ ID NO: 347514 - protein, 21 aa, Mycobacterium
IVSMQYSFLPSWLSFLVDKEN

SEQ ID NO: 347515 - protein, 18 aa, Mycobacterium
KLARVLVADGRRVVLGAA

SEQ ID NO: 347516 - protein, 18 aa, Mycobacterium
KTSINSVLLIFTIGVTWS

SEQ ID NO: 347517 - protein, 23 aa, Mycobacterium
KTTTHLFQPLLYQVATGILSEGD

SEQ ID NO: 347518 - protein, 25 aa, Mycobacterium
LSQDRGWVVLLARYQRPKAIRQSGV

SEQ ID NO: 347519 - protein, 25 aa, Mycobacterium
MGEGEAMLFGEYIRLMALVEYSADE

SEQ ID NO: 347520 - protein, 17 aa, Mycobacterium
NEAWRSDQFVLDATRVT

SEQ ID NO: 347521 - protein, 25 aa, Mycobacterium
RAAVKFLLYNLFGGLIMLAAVIGLY

SEQ ID NO: 347522 - protein, 18 aa, Mycobacterium
RDRTSFIIAHRLSTIRDA

SEQ ID NO: 347523 - protein, 25 aa, Mycobacterium
RPGEEKLVFSRFWRADPSRVRRSGG

SEQ ID NO: 347524 - protein, 18 aa, Mycobacterium
SRAQLLIASGSLAADPGK

SEQ ID NO: 347525 - protein, 18 aa, Mycobacterium
TSPLLPTADELADRYSLV

SEQ ID NO: 347526 - protein, 24 aa, Mycobacterium
VTAAILVFIFAWNDLLLALSLTAT

SEQ ID NO: 347527 - protein, 22 aa, Mycobacterium
YMANYYRWFGTPEAPFGWYYDL

SEQ ID NO: 347528 - protein, 18 aa, Mycobacterium
YMMWTEGLARIWPPWEFY

SEQ ID NO: 347529 - protein, 24 aa, Mycobacterium
AASVLPVWLLLAPRDYLSTFMKVG

SEQ ID NO: 347530 - protein, 28 aa, Mycobacterium
AAWTAAGMFLAVWLPLNNGLRPEPIIAL

SEQ ID NO: 347531 - protein, 26 aa, Mycobacterium
AEELLSRSWWSGPEIFLIVDDIQQLP

SEQ ID NO: 347532 - protein, 37 aa, Mycobacterium
AGLIAMILLVVYRSVFTALLPLLVIGVSLAVGRGVLS

SEQ ID NO: 347533 - protein, 20 aa, Mycobacterium
AGYLAGPLGLAAWAVGLVLG

SEQ ID NO: 347534 - protein, 25 aa, Mycobacterium
AQDRVWYVFLLLPSFVIYLISMVGE

SEQ ID NO: 347535 - protein, 23 aa, Mycobacterium
AQGRLFTPFFITVGLVEAAYFIN

SEQ ID NO: 347536 - protein, 20 aa, Mycobacterium
ARRRTNVLYALIRDNRTWQP

SEQ ID NO: 347537 - protein, 25 aa, Mycobacterium
ARTTHHLFQPLLYQVATGIISEGEI

SEQ ID NO: 347538 - protein, 25 aa, Mycobacterium
ARTTHHLFQPLLYQVATGIVSEGDI

SEQ ID NO: 347539 - protein, 31 aa, Mycobacterium; identical to SEQ ID NO: 21911

SEQ ID NO: 347540 - protein, 27 aa, Mycobacterium
ATVAFAFLAMVFAKLSVFAALGPACAI

SEQ ID NO: 347541 - protein, 21 aa, Mycobacterium
ATVTLFPPVLALAAKRGIGEP

SEQ ID NO: 347542 - protein, 17 aa, Mycobacterium
ATWAIVTGKSPGGIFNP

SEQ ID NO: 347543 - protein, 23 aa, Mycobacterium
CAGIGLAIVMPALALSAIGQAAS

SEQ ID NO: 347544 - protein, 25 aa, Mycobacterium
CSGLTRFAFAGVGVLLPRWSGDQYD

SEQ ID NO: 347545 - protein, 18 aa, Mycobacterium
CVLTLTIAGPVRTYFAQR

SEQ ID NO: 347546 - protein, 25 aa, Mycobacterium
DDATSWLVRRPPLHGLTPSAHDMAR

SEQ ID NO: 347547 - protein, 43 aa, Mycobacterium
DFHQLAFATLVIVGLILVVLLRALVAPLYLLGTVVLNYGAALG

SEQ ID NO: 347548 - protein, 18 aa, Mycobacterium
DIIALKFHISLNATTWIG

SEQ ID NO: 347549 - protein, 18 aa, Mycobacterium
DLPPIPTLFVVADEFTLM

SEQ ID NO: 347550 - protein, 31 aa, Mycobacterium
DVAFPRLNAFSFWLFLFGALIATAGFITPGG

SEQ ID NO: 347551 - protein, 25 aa, Mycobacterium
EIAMYSFIVLLLTGVYLTLFFDPSM

SEQ ID NO: 347552 - protein, 24 aa, Mycobacterium
ELAATIARRLGLTGALGTVAESVD

SEQ ID NO: 347553 - protein, 19 aa, Mycobacterium
ELPRNPTGKILKRELREME

SEQ ID NO: 347554 - protein, 22 aa, Mycobacterium
EQIMPLLVVAVMSQLVFSGGMI

SEQ ID NO: 347555 - protein, 19 aa, Mycobacterium
FAAGRLYTTLSVADAAAAT

SEQ ID NO: 347556 - protein, 27 aa, Mycobacterium
FAIMHLLTHGFFKAGLFLGSGAVIHAM

SEQ ID NO: 347557 - protein, 25 aa, Mycobacterium
FLAMTMIILAVFYMIQDALFLGVVQ

SEQ ID NO: 347558 - protein, 17 aa, Mycobacterium
GAPARLDNARFLLPVVG

SEQ ID NO: 347559 - protein, 17 aa, Mycobacterium
GFIIGCGLLLDTFVVRT

SEQ ID NO: 347560 - protein, 19 aa, Mycobacterium
GIALAAIALGSWAGGRLAD

SEQ ID NO: 347561 - protein, 23 aa, Mycobacterium
GIVFRVQQELGVPVKLVGLGEGP

SEQ ID NO: 347562 - protein, 26 aa, Mycobacterium
GLSAFYYALLLLLAGFTGSIVVSTLV

SEQ ID NO: 347563 - protein, 18 aa, Mycobacterium
GPACAIAVFVGFAATVTL

SEQ ID NO: 347564 - protein, 35 aa, Mycobacterium; identical to SEQ ID NO: 20695

SEQ ID NO: 347565 - protein, 21 aa, Mycobacterium
GRLHTPKRYSRRLRRVMYMSA

SEQ ID NO: 347566 - protein, 24 aa, Mycobacterium
GSGWWQTFWRITLPSIRWGLTYGI

SEQ ID NO: 347567 - protein, 21 aa, Mycobacterium
GSLFPFLFITIACGALSGFHA

SEQ ID NO: 347568 - protein, 20 aa, Mycobacterium
GTYLGGWRIIRTLGKGLVEI

SEQ ID NO: 347569 - protein, 26 aa, Mycobacterium
GYFTTRLLERLPLSSYRRPLLGTGLC

SEQ ID NO: 347570 - protein, 17 aa, Mycobacterium
IIVVITALAFDFTNGFH

SEQ ID NO: 347571 - protein, 25 aa, Mycobacterium
KDPVFLDWLVGLAFPCQRPFGHQNG

SEQ ID NO: 347572 - protein, 20 aa, Mycobacterium
LATDLGRNLLLEQLHYRHEL

SEQ ID NO: 347573 - protein, 18 aa, Mycobacterium
LGETVAVLIILRSAARPG

SEQ ID NO: 347574 - protein, 21 aa, Mycobacterium
LLVAIPFTVLVSFTLNILLRE

SEQ ID NO: 347575 - protein, 27 aa, Mycobacterium
LSAFTLIPYGLVLLQLRVFYAREQPWT

SEQ ID NO: 347576 - protein, 25 aa, Mycobacterium
LTLGLSLAVILALGFVLTSQVTNRV

SEQ ID NO: 347577 - protein, 18 aa, Mycobacterium
LTNLPFHGFDQNQLWLEI

SEQ ID NO: 347578 - protein, 24 aa, Mycobacterium
LVPSPTCIIVGLPAGLRLAVDNAI

SEQ ID NO: 347579 - protein, 18 aa, Mycobacterium
LWLEITLLAADLLVWTQV

SEQ ID NO: 347580 - protein, 28 aa, Mycobacterium
MFRMPIFTWNILVTSILVLLAFPLLTAA

SEQ ID NO: 347581 - protein, 19 aa, Mycobacterium
NAQAAWTSPLLPTADELAD

SEQ ID NO: 347582 - protein, 17 aa, Mycobacterium
NNFMWPLVITSGHKWRV

SEQ ID NO: 347583 - protein, 17 aa, Mycobacterium
NQLWLEITLLAADLLVW

SEQ ID NO: 347584 - protein, 19 aa, Mycobacterium
PFHGFDQNQLWLEITLLAA

SEQ ID NO: 347585 - protein, 20 aa, Mycobacterium
PLEHCYAYSDSITDLPMLES

SEQ ID NO: 347586 - protein, 22 aa, Mycobacterium
PNFTVLVILRLLYGIGMGGEWG

SEQ ID NO: 347587 - protein, 17 aa, Mycobacterium
PPVLALAAKRGIGEPKA

SEQ ID NO: 347588 - protein, 21 aa, Mycobacterium
QGRLFTPFFITVGLVEAAYFI

SEQ ID NO: 347589 - protein, 20 aa, Mycobacterium
QMHLDAGQQVWLITATPYEL

SEQ ID NO: 347590 - protein, 19 aa, Mycobacterium
QQVWLITATPYELAATIAR

SEQ ID NO: 347591 - protein, 20 aa, Mycobacterium
RADLARDPSFYLRFRREAQN

SEQ ID NO: 347592 - protein, 22 aa, Mycobacterium
RAGDRWLGAIGLMDLPRPEASA

SEQ ID NO: 347593 - protein, 18 aa, Mycobacterium
RDPSFYLRFRREAQNAAA

SEQ ID NO: 347594 - protein, 34 aa, Mycobacterium; identical to SEQ ID NO: 163488

SEQ ID NO: 347595 - protein, 19 aa, Mycobacterium
RGADLPPLPTLFVVVDEFA

SEQ ID NO: 347596 - protein, 32 aa, Mycobacterium
RIIHTGRRRLLRLPRGWPWSDLIETGWTALQT

SEQ ID NO: 347597 - protein, 19 aa, Mycobacterium
RVGDRLYPALNLASARLIT

SEQ ID NO: 347598 - protein, 25 aa, Mycobacterium
RYSRRLRRVMYMSALTAIRCDPDSK

SEQ ID NO: 347599 - protein, 28 aa, Mycobacterium
SDVYSLGCVLYEILTGEPPFTGDSPVAV

SEQ ID NO: 347600 - protein, 19 aa, Mycobacterium
SVLLIFTIGVTWSSVHYLL

SEQ ID NO: 347601 - protein, 24 aa, Mycobacterium
TAAYVVAALLFILALAGLSKHETS

SEQ ID NO: 347602 - protein, 25 aa, Mycobacterium
TIGLGLLFDTLIVRSFMTPSIAALL

SEQ ID NO: 347603 - protein, 25 aa, Mycobacterium
TIGLGLLFDTLIVRSLMTPSIAALL

SEQ ID NO: 347604 - protein, 25 aa, Mycobacterium
TLTVPAIATLLREASWWPQRKPLTH

SEQ ID NO: 347605 - protein, 18 aa, Mycobacterium
TMHGTVMLLFYATPIVFG

SEQ ID NO: 347606 - protein, 21 aa, Mycobacterium
TRGGYLKDIKGFDSEFFAVAK

SEQ ID NO: 347607 - protein, 22 aa, Mycobacterium
TSILVLLAFPLLTAALFALAAD

SEQ ID NO: 347608 - protein, 26 aa, Mycobacterium
VAVLVVATPCPLLLAAPVAIVSGLSR

SEQ ID NO: 347609 - protein, 29 aa, Mycobacterium
VAVVRRPVPLLVASLALVLGLAAVALTMH

SEQ ID NO: 347610 - protein, 24 aa, Mycobacterium
VGFYGMPPIVEALNRVPPQAWRAA

SEQ ID NO: 347611 - protein, 17 aa, Mycobacterium
VLLMTPGLAFFYGGMVR

SEQ ID NO: 347612 - protein, 23 aa, Mycobacterium
VMVSLLVCLIPTTIGALLSAIGI

SEQ ID NO: 347613 - protein, 34 aa, Mycobacterium; identical to SEQ ID NO: 164112

SEQ ID NO: 347614 - protein, 17 aa, Mycobacterium
VVLLVLLHRAKGGGLST

SEQ ID NO: 347615 - protein, 25 aa, Mycobacterium
YTENLRYYYLILPTVDGSLSRRFGF

SEQ ID NO: 347616 - protein, 23 aa, Mycobacterium
AASYFLVTPLIVLTGTAIAMALP

SEQ ID NO: 347617 - protein, 21 aa, Mycobacterium
AATFAGWTLLAANPVAGMTAA

SEQ ID NO: 347618 - protein, 17 aa, Mycobacterium
AAVAVLIIACPCALGLA

SEQ ID NO: 347619 - protein, 27 aa, Mycobacterium
ADVVVAVLVALWVLPRAIALARAALRI

SEQ ID NO: 347620 - protein, 17 aa, Mycobacterium
AETNLRFLLGKSATIPV

SEQ ID NO: 347621 - protein, 21 aa, Mycobacterium
AFDFSVWEIFGALLHGGRLVV

SEQ ID NO: 347622 - protein, 29 aa, Mycobacterium
AFGGPGAMFWMWAVAFLGASTSFVECTLG

SEQ ID NO: 347623 - protein, 19 aa, Mycobacterium
AFTMLAMLASDLRTIGQVG

SEQ ID NO: 347624 - protein, 30 aa, Mycobacterium
AGISALCLIFLIMLLITRSFVASLVIVGTV

SEQ ID NO: 347625 - protein, 24 aa, Mycobacterium
AGQRRRLLLARAVLSPARIVLLDE

SEQ ID NO: 347626 - protein, 20 aa, Mycobacterium
AGVLLLALMLRAGGATLPHA

SEQ ID NO: 347627 - protein, 24 aa, Mycobacterium
AGVTTFILAGRYFEKRSKRQAGAA

SEQ ID NO: 347628 - protein, 17 aa, Mycobacterium
AGWAWLDPRSFHGWVTE

SEQ ID NO: 347629 - protein, 28 aa, Mycobacterium
AIEVGDDEFWMLLAGRKLSARDRRVLSA

SEQ ID NO: 347630 - protein, 18 aa, Mycobacterium
AIFLITIYGGYFGAAAGV

SEQ ID NO: 347631 - protein, 23 aa, Mycobacterium
AKRGRLWRRVGTAVVRWPAPILA

SEQ ID NO: 347632 - protein, 23 aa, Mycobacterium
AKTTESLWWLTDAGARFGVDDTR

SEQ ID NO: 347633 - protein, 21 aa, Mycobacterium
AKVVLALQHDKLPPSINFAGP

SEQ ID NO: 347634 - protein, 26 aa, Mycobacterium
ALGNAILVIPLGLVPSWLALASTGFD

SEQ ID NO: 347635 - protein, 18 aa, Mycobacterium
ALHFAKPIFGPAARALAQ

SEQ ID NO: 347636 - protein, 19 aa, Mycobacterium
ALMNQFISLLKASSLVYFL

SEQ ID NO: 347637 - protein, 30 aa, Mycobacterium
ALMTPSIAVLLGRWFWWPHHVRPRPIPQRW

SEQ ID NO: 347638 - protein, 23 aa, Mycobacterium
ALWAVYTTRWWLSGLLVGVAAGI

SEQ ID NO: 347639 - protein, 20 aa, Mycobacterium
AMVFNLFFINLVTVGLHSYA

SEQ ID NO: 347640 - protein, 17 aa, Mycobacterium
APDVYWPLRRIGVEFHA

SEQ ID NO: 347641 - protein, 17 aa, Mycobacterium
APIGIVLLLLTLGLEFS

SEQ ID NO: 347642 - protein, 19 aa, Mycobacterium
APVLFQIPGGAWTTGNKRG

SEQ ID NO: 347643 - protein, 26 aa, Mycobacterium
ASAIFVVFAPVYWPAVVPLGIGCLIG

SEQ ID NO: 347644 - protein, 24 aa, Mycobacterium
ASAYFAGGLSLRDATRTICSRSHL

SEQ ID NO: 347645 - protein, 24 aa, Mycobacterium
ASDNPVIFWTPDHGAFVVRGAMNA

SEQ ID NO: 347646 - protein, 25 aa, Mycobacterium
ASFGNKWMWSPIVVTPPVVVAGVGG

SEQ ID NO: 347647 - protein, 20 aa, Mycobacterium
ASHAPYLAWLTQQSAMSATN

SEQ ID NO: 347648 - protein, 26 aa, Mycobacterium
ASPFWQFWDLALLWLAQLHGGNGLRT

SEQ ID NO: 347649 - protein, 26 aa, Mycobacterium
ATPIAFLLFAFFLGFAIMIGAELNAA

SEQ ID NO: 347650 - protein, 36 aa, Mycobacterium
ATSGVVALLMFSAGGLGLGWFTPATVPQAHAQCPPD

SEQ ID NO: 347651 - protein, 22 aa, Mycobacterium
ATVAFPMYFLKSFAYAGVATVA

SEQ ID NO: 347652 - protein, 25 aa, Mycobacterium
AVASLTVLRWSWTPALLAGGLMTLM

SEQ ID NO: 347653 - protein, 33 aa, Mycobacterium
AVATAFALQIKWLVPILWICVGLSVLLVGPREL

SEQ ID NO: 347654 - protein, 26 aa, Mycobacterium
AVFFGRFIALLRILAGPLAGALKMHY

SEQ ID NO: 347655 - protein, 18 aa, Mycobacterium
AVLIILRSAARPGNWSLF

SEQ ID NO: 347656 - protein, 24 aa, Mycobacterium
AVLLPFFSFMTFLIAVPTGLKFFN

SEQ ID NO: 347657 - protein, 20 aa, Mycobacterium
AVMFLVAVGFWNFLGAGIFG

SEQ ID NO: 347658 - protein, 22 aa, Mycobacterium
AWLNIIGIIILQRPALAALKDY

SEQ ID NO: 347659 - protein, 19 aa, Mycobacterium
AWQWLVTEVPQRSLHNWQN

SEQ ID NO: 347660 - protein, 27 aa, Mycobacterium
AWTAAGLFLAFWLPLNNGLRPEPIIAL

SEQ ID NO: 347661 - protein, 19 aa, Mycobacterium
CDQVLLMAPGGKTAFLGPP

SEQ ID NO: 347662 - protein, 27 aa, Mycobacterium
CGALIGLERQWRARRAGLRTNALVAGG

SEQ ID NO: 347663 - protein, 30 aa, Mycobacterium
CGIIGLGAALLIAALLLSTYTTSRITKVPL

SEQ ID NO: 347664 - protein, 18 aa, Mycobacterium
CRAAFPMVEQLRAEYGDR

SEQ ID NO: 347665 - protein, 19 aa, Mycobacterium
DAHAPYLAWLTTTSADYAA

SEQ ID NO: 347666 - protein, 21 aa, Mycobacterium
DDAIMFEPRYAVRQPDGGWGE

SEQ ID NO: 347667 - protein, 17 aa, Mycobacterium
DDLRPIPVFGSDELARL

SEQ ID NO: 347668 - protein, 27 aa, Mycobacterium
DDVLQAYLNIIYFGRGAYGISAASKAY

SEQ ID NO: 347669 - protein, 25 aa, Mycobacterium
DEAAQILALLMPAAAFMGTALTIRD

SEQ ID NO: 347670 - protein, 22 aa, Mycobacterium
DGDRLWIRFIPDTEHRSQVIEH

SEQ ID NO: 347671 - protein, 21 aa, Mycobacterium
DGKVHRHWGFGGGPHRCLGSH

SEQ ID NO: 347672 - protein, 24 aa, Mycobacterium
DHGKYYFMVELPPDFSAAIASPVT

SEQ ID NO: 347673 - protein, 23 aa, Mycobacterium
DKLTKPVWLVILGAAVALTSILG

SEQ ID NO: 347674 - protein, 20 aa, Mycobacterium
DLVYQFIPVLKANGYRLVTV

SEQ ID NO: 347675 - protein, 28 aa, Mycobacterium
DPTGLSLPMFMEELFWGCAGIGLAIVMP

SEQ ID NO: 347676 - protein, 19 aa, Mycobacterium
DRISWPAAGLIAAGSLVGG

SEQ ID NO: 347677 - protein, 26 aa, Mycobacterium
DSIGWTWMHYLPPTPGFAFLDHTVIG

SEQ ID NO: 347678 - protein, 30 aa, Mycobacterium; identical to SEQ ID NO: 20470

SEQ ID NO: 347679 - protein, 34 aa, Mycobacterium
DVAFPRLNALSFWLFLFGALIALAGFITPGGAAD

SEQ ID NO: 347680 - protein, 18 aa, Mycobacterium
DVALTCVASAMLGLALSA

SEQ ID NO: 347681 - protein, 27 aa, Mycobacterium
DVDAEPAAWLRFWFPDPDGSKTEFQRA

SEQ ID NO: 347682 - protein, 40 aa, Mycobacterium
DWITDLILSLFKAAGYLLWWAVLFPAISIPIIASVAMAIT

SEQ ID NO: 347683 - protein, 22 aa, Mycobacterium
DYITEALKRLPAYATTLGEVVG

SEQ ID NO: 347684 - protein, 23 aa, Mycobacterium
DYSFLSYYPYWGFQGLTSHYANP

SEQ ID NO: 347685 - protein, 18 aa, Mycobacterium
EFVVAVRQLTIGQDAPVE

SEQ ID NO: 347686 - protein, 25 aa, Mycobacterium
EGMGTTLTAILFAGNRLGLVHIGDS

SEQ ID NO: 347687 - protein, 27 aa, Mycobacterium
EGYPIKASARFGLYYTPSSALYYDTLA

SEQ ID NO: 347688 - protein, 24 aa, Mycobacterium
EHYFRTFLRPDDVFWSFLEAIIIT

SEQ ID NO: 347689 - protein, 24 aa, Mycobacterium
ELSDPLTPMLALGATASAVLGSPV

SEQ ID NO: 347690 - protein, 22 aa, Mycobacterium
EPRLRALGWTGVLDKGPDVDAG

SEQ ID NO: 347691 - protein, 26 aa, Mycobacterium
EREPRNIWVMIGVPALIVALIGTIVM

SEQ ID NO: 347692 - protein, 23 aa, Mycobacterium
ERTLLYVLMVVLSGALLIGAVVL

SEQ ID NO: 347693 - protein, 23 aa, Mycobacterium
ESEARRMALLVDELLLLSRLGEG

SEQ ID NO: 347694 - protein, 23 aa, Mycobacterium
EVLVGLGMRTWADGRTLLLGSPS

SEQ ID NO: 347695 - protein, 17 aa, Mycobacterium
EVPVLVALVYVSLALRG

SEQ ID NO: 347696 - protein, 26 aa, Mycobacterium
EYGDRVNFVIRYFPIQSHFNAERAAR

SEQ ID NO: 347697 - protein, 26 aa, Mycobacterium
FAIMHLLTHGFFKAGLFLGAGSVMHA

SEQ ID NO: 347698 - protein, 26 aa, Mycobacterium
FAWALSVMFLVFTLRAILYKPFVKQI

SEQ ID NO: 347699 - protein, 18 aa, Mycobacterium
FDAGYFWHYNELWVGGAA

SEQ ID NO: 347700 - protein, 18 aa, Mycobacterium
FDTLIVRSFMTPSIAALL

SEQ ID NO: 347701 - protein, 17 aa, Mycobacterium
FECEACRAAFPMVEQLR

SEQ ID NO: 347702 - protein, 19 aa, Mycobacterium
FFIAALVVLFYSTFFFFFF

SEQ ID NO: 347703 - protein, 23 aa, Mycobacterium
FGALLRVVYVALPPLHDQWRPVL

SEQ ID NO: 347704 - protein, 24 aa, Mycobacterium
FGARRRGLLAVYAREHRSLSPLAT

SEQ ID NO: 347705 - protein, 22 aa, Mycobacterium
FGGMFLLMLFLDFVFHDRDIKW

SEQ ID NO: 347706 - protein, 24 aa, Mycobacterium
FGITTVYHFIFVPLTIGLAPLLAV

SEQ ID NO: 347707 - protein, 25 aa, Mycobacterium
FGRGWAWLSAFTLFASAIGALLTEF

SEQ ID NO: 347708 - protein, 28 aa, Mycobacterium
FINDYLFNFPDTSIAWSFVLALLAAALT

SEQ ID NO: 347709 - protein, 21 aa, Mycobacterium
FIPLFVANAVFWSLFQQIFTV

SEQ ID NO: 347710 - protein, 19 aa, Mycobacterium
FLPIIMTVARRFGGSLLLY

SEQ ID NO: 347711 - protein, 17 aa, Mycobacterium
FMSLGWMLVRVPRADWR

SEQ ID NO: 347712 - protein, 23 aa, Mycobacterium
FMTLDRWLLFNWMRWGRALEYLK

SEQ ID NO: 347713 - protein, 19 aa, Mycobacterium
FPIGIIDRPFKHDQPPWTV

SEQ ID NO: 347714 - protein, 35 aa, Mycobacterium; identical to SEQ ID NO: 20588

SEQ ID NO: 347715 - protein, 32 aa, Mycobacterium
FTHNLFKPLLLFFYFGFLIPILKVRFEFPYVI

SEQ ID NO: 347716 - protein, 19 aa, Mycobacterium
FVFNVFVAALIVYVGDQLG

SEQ ID NO: 347717 - protein, 17 aa, Mycobacterium
FVGVQIPGALRGIAGVD

SEQ ID NO: 347718 - protein, 17 aa, Mycobacterium
FWAFRRFVFPDEFARNP

SEQ ID NO: 347719 - protein, 20 aa, Mycobacterium
FYMTRVMLMTFFGKKRWAPG

SEQ ID NO: 347720 - protein, 21 aa, Mycobacterium
GAAIPVLIVGTVVWVGITNDR

SEQ ID NO: 347721 - protein, 17 aa, Mycobacterium
GAIFPIFMIGGVAMMMF

SEQ ID NO: 347722 - protein, 23 aa, Mycobacterium
GATAAWAIGRWTPGTERRTSTMG

SEQ ID NO: 347723 - protein, 27 aa, Mycobacterium
GATFCLHFTNLPYFQTLGIPLAIGMVV

SEQ ID NO: 347724 - protein, 23 aa, Mycobacterium
GAVVAMLSLVPWGTTGVSLDLMR

SEQ ID NO: 347725 - protein, 23 aa, Mycobacterium
GDPATWIERALVVLVAASPCALA

SEQ ID NO: 347726 - protein, 19 aa, Mycobacterium
GDVYLVIDNYRALAEENEV

SEQ ID NO: 347727 - protein, 27 aa, Mycobacterium
GGLTYNWIIFMILPLYVSLEKIDPRLI

SEQ ID NO: 347728 - protein, 27 aa, Mycobacterium
GGPILWQHLFWFFGHPEVYIVALPFFG

SEQ ID NO: 347729 - protein, 24 aa, Mycobacterium
GGRPAFVPLALFIAGLLGGVLLLC

SEQ ID NO: 347730 - protein, 26 aa, Mycobacterium
GGVILFQHLFWFFGHPEVYVIALPFF

SEQ ID NO: 347731 - protein, 21 aa, Mycobacterium
GGWWFTLFTAILGSVILLWIV

SEQ ID NO: 347732 - protein, 17 aa, Mycobacterium
GIGLALVRLVTAQHGGT

SEQ ID NO: 347733 - protein, 23 aa, Mycobacterium
GINTLFPLFGIANQLLAAIALTV

SEQ ID NO: 347734 - protein, 24 aa, Mycobacterium
GINVGFYMLMPYLADYLAGPLGLA

SEQ ID NO: 347735 - protein, 29 aa, Mycobacterium
GISSLCLIFIIMLILTRAFVAAAVIVGTV

SEQ ID NO: 347736 - protein, 18 aa, Mycobacterium
GKLHFWLTFIGFHTTFLV

SEQ ID NO: 347737 - protein, 22 aa, Mycobacterium
GKSEFFLSLVYGIALTHSPETF

SEQ ID NO: 347738 - protein, 18 aa, Mycobacterium
GLSRAVLNLLDNAAKWSP

SEQ ID NO: 347739 - protein, 25 aa, Mycobacterium
GLVGGVWLAFIGWFIFAAAREEETR

SEQ ID NO: 347740 - protein, 17 aa, Mycobacterium
GMALIVATFFRFVARRL

SEQ ID NO: 347741 - protein, 17 aa, Mycobacterium
GMLPSLNARRHPDRAAC

SEQ ID NO: 347742 - protein, 31 aa, Mycobacterium; identical to SEQ ID NO: 23910

SEQ ID NO: 347743 - protein, 26 aa, Mycobacterium
GPFLPLAIILYWFANNIWTFGQQHYV

SEQ ID NO: 347744 - protein, 22 aa, Mycobacterium
GQALRDFILEQRKIRDIAKVVN

SEQ ID NO: 347745 - protein, 24 aa, Mycobacterium
GQFAEAALLGILFSIAEGLEHYAV

SEQ ID NO: 347746 - protein, 23 aa, Mycobacterium
GQGAWLKRIIPVAALGGVAGAAL

SEQ ID NO: 347747 - protein, 26 aa, Mycobacterium
GQIELPPGYLPLRVPIEVNFTQRVAI

SEQ ID NO: 347748 - protein, 31 aa, Mycobacterium
GQITKKAVIALVVFLVLVAIYITVRYERYMT

SEQ ID NO: 347749 - protein, 24 aa, Mycobacterium
GRGANVFFMLGGQRLDLSSLQKVK

SEQ ID NO: 347750 - protein, 23 aa, Mycobacterium
GRQPLLAGLLTLSGATTPAHGLA

SEQ ID NO: 347751 - protein, 26 aa, Mycobacterium
GRVVTLAFLMLQLVSAGGIYPVETTA

SEQ ID NO: 347752 - protein, 22 aa, Mycobacterium
GSIYAFECPLLLGTTAVLMDRW

SEQ ID NO: 347753 - protein, 20 aa, Mycobacterium
GSLFVLRLPAVLATAAAIVI

SEQ ID NO: 347754 - protein, 18 aa, Mycobacterium
GSLWVFVGVQIPGALRGI

SEQ ID NO: 347755 - protein, 19 aa, Mycobacterium
GSMLSFAGVLLGAIAGVLL

SEQ ID NO: 347756 - protein, 34 aa, Mycobacterium
GSQPDFYMMWTDGLIRLWPAWEFYPFGHTIPQGV

SEQ ID NO: 347757 - protein, 18 aa, Mycobacterium
GTANWILRRLGIEPAEEL

SEQ ID NO: 347758 - protein, 22 aa, Mycobacterium
GTKLAIAALLLHVLAHGIGKTV

SEQ ID NO: 347759 - protein, 38 aa, Mycobacterium
GTLVFQYGLGKEIAWPVPLLAFIILVAVGADYNMLLIS

SEQ ID NO: 347760 - protein, 47 aa, Mycobacterium
GTTIALGLLFDTLIVRSFMTPSLATLLGRWFWWPQHVRPRPASTMLR

SEQ ID NO: 347761 - protein, 21 aa, Mycobacterium
GTVMLLFYATPIVFGFANLVL

SEQ ID NO: 347762 - protein, 29 aa, Mycobacterium
GVAILARNTRWFLIANYGAARVGARIILL

SEQ ID NO: 347763 - protein, 26 aa, Mycobacterium
GVFDNLTKFITWTLPTNIGEGLVILV

SEQ ID NO: 347764 - protein, 26 aa, Mycobacterium
GVGGDGAFFLLLDEPEVYGLPPDPVV

SEQ ID NO: 347765 - protein, 25 aa, Mycobacterium
GVQLVVVLTAAWLLATPLTQSKDQP

SEQ ID NO: 347766 - protein, 25 aa, Mycobacterium
GVVVGIFWMGRRLVSPWWAVGLGMI

SEQ ID NO: 347767 - protein, 25 aa, Mycobacterium
GWTAIPMWVLGILTFLVPAGMAVVE

SEQ ID NO: 347768 - protein, 18 aa, Mycobacterium
GYFREIVTRFDYDDAVLL

SEQ ID NO: 347769 - protein, 30 aa, Mycobacterium; identical to SEQ ID NO: 20764

SEQ ID NO: 347770 - protein, 17 aa, Mycobacterium
HIGDSRGYLLRDGELTQ

SEQ ID NO: 347771 - protein, 18 aa, Mycobacterium
HIGDSRGYLLRDGELTQI

SEQ ID NO: 347772 - protein, 28 aa, Mycobacterium
HINTYDMDLFLRIAPELYLKRLCVGGVE

SEQ ID NO: 347773 - protein, 20 aa, Mycobacterium
HLHSSLLVSYLALLVGLGFG

SEQ ID NO: 347774 - protein, 24 aa, Mycobacterium
HPSLAVQIILFVAVVFGTLNVIGG

SEQ ID NO: 347775 - protein, 23 aa, Mycobacterium
HREELVYLPPAWFASSPPPELPA

SEQ ID NO: 347776 - protein, 30 aa, Mycobacterium
IAAIAAFVLIFLIMMFITRSLVAALVIPGT

SEQ ID NO: 347777 - protein, 25 aa, Mycobacterium
IAGAPNPYIWPENLPRTNARGGPGG

SEQ ID NO: 347778 - protein, 30 aa, Mycobacterium
IAGIAALCLIFIIMLIITRAVVASAVIVGT

SEQ ID NO: 347779 - protein, 27 aa, Mycobacterium
IAMTIPIAIFMGLYLRFLRPGRVSEVS

SEQ ID NO: 347780 - protein, 38 aa, Mycobacterium; identical to SEQ ID NO: 22277

SEQ ID NO: 347781 - protein, 20 aa, Mycobacterium
IDAARLLTWRASWMAANNVP

SEQ ID NO: 347782 - protein, 17 aa, Mycobacterium
IDKLEPNLTYRIALRTT

SEQ ID NO: 347783 - protein, 49 aa, Mycobacterium
IGALIVFAVLTVWFVIDPQLWLLVVVTVLALLLGWHLVASIGGGDMPVV

SEQ ID NO: 347784 - protein, 21 aa, Mycobacterium
IGLGLLFDTLIVRSFMTPSVA

SEQ ID NO: 347785 - protein, 20 aa, Mycobacterium
IGLGLLFDTLVVRSLMTPSI

SEQ ID NO: 347786 - protein, 27 aa, Mycobacterium
IGSPVLFPVAIWWFIIRPWRRERRITL

SEQ ID NO: 347787 - protein, 30 aa, Mycobacterium; identical to SEQ ID NO: 20812

SEQ ID NO: 347788 - protein, 18 aa, Mycobacterium
IIALPFFGIVSEIFPVFS

SEQ ID NO: 347789 - protein, 25 aa, Mycobacterium
IIGNLLQMAFRFWAFRRFVFPDEFA

SEQ ID NO: 347790 - protein, 28 aa, Mycobacterium
IIGNLLQMAFRFWAFRRWVFPDEFARNP

SEQ ID NO: 347791 - protein, 27 aa, Mycobacterium
IIPRMYALHILLLPGIILALIGLHLAM

SEQ ID NO: 347792 - protein, 27 aa, Mycobacterium
IMVSIPLTVLLIFTLNVLLAQFGAADL

SEQ ID NO: 347793 - protein, 23 aa, Mycobacterium
INVGFYMLMPYLAGYLAGPLGLA

SEQ ID NO: 347794 - protein, 25 aa, Mycobacterium
IPVAALGMLNPMLAGAAMAFSSVFV

SEQ ID NO: 347795 - protein, 17 aa, Mycobacterium
IPVLKANGYRLVTVSEL

SEQ ID NO: 347796 - protein, 23 aa, Mycobacterium
IRANARIIVFLSVALVIATAVAV

SEQ ID NO: 347797 - protein, 25 aa, Mycobacterium
ISKYYPAWLPSRRFIAAVIAIGGMQ

SEQ ID NO: 347798 - protein, 27 aa, Mycobacterium
ITETRHWWQVPLLGHHVLIAGATGAGK

SEQ ID NO: 347799 - protein, 23 aa, Mycobacterium
ITGATIFFFLFVHVLDTALVRVS

SEQ ID NO: 347800 - protein, 24 aa, Mycobacterium
ITHGLLWSVIAPIATRLVPPSHAG

SEQ ID NO: 347801 - protein, 18 aa, Mycobacterium
IVLLLLTLGLEFSATEFA

SEQ ID NO: 347802 - protein, 18 aa, Mycobacterium
IVSIPLAFILGIVGTLTS

SEQ ID NO: 347803 - protein, 17 aa, Mycobacterium
IWNPYVAERLLQGHWSL

SEQ ID NO: 347804 - protein, 20 aa, Mycobacterium
KFVTALFFDLGVYLIVVGLV

SEQ ID NO: 347805 - protein, 23 aa, Mycobacterium
KGRSFRIHLLFASQTLDVGRIKD

SEQ ID NO: 347806 - protein, 21 aa, Mycobacterium
KIRGQRFGRLPAGRAILLGDS

SEQ ID NO: 347807 - protein, 17 aa, Mycobacterium
KLLPVRMPARSSSPHAV

SEQ ID NO: 347808 - protein, 21 aa, Mycobacterium
KLSHTLLPKRIALPVFASDAL

SEQ ID NO: 347809 - protein, 22 aa, Mycobacterium
KMRTRGWRRVGTAIVRWPGPIL

SEQ ID NO: 347810 - protein, 22 aa, Mycobacterium
KSSYAQFIYLLSGADHDQMDRM

SEQ ID NO: 347811 - protein, 26 aa, Mycobacterium
KTLVSTTFVVPYPPGFPVLVPGQVVS

SEQ ID NO: 347812 - protein, 27 aa, Mycobacterium
KVSFAFFIPVYFAIVGLKLDLIRGVSL

SEQ ID NO: 347813 - protein, 23 aa, Mycobacterium
KVWSPQFSLWLVPLAVLALPHRR

SEQ ID NO: 347814 - protein, 19 aa, Mycobacterium
KVYIALAWLWVAVPFAYGV

SEQ ID NO: 347815 - protein, 17 aa, Mycobacterium
LAAPWFIGAAMGLQVLG

SEQ ID NO: 347816 - protein, 24 aa, Mycobacterium
LAFGGYFYWDDLILIGKAGTHNLL

SEQ ID NO: 347817 - protein, 26 aa, Mycobacterium
LAFSKPFFAQGLLNRRAVLKSSYAQF

SEQ ID NO: 347818 - protein, 19 aa, Mycobacterium
LAILVLSGFVGFAVISKVP

SEQ ID NO: 347819 - protein, 20 aa, Mycobacterium
LAKITLFTLGAIAIMLLLVY

SEQ ID NO: 347820 - protein, 25 aa, Mycobacterium
LALGQYWIVLLGYGVLGGIGWGIGY

SEQ ID NO: 347821 - protein, 17 aa, Mycobacterium
LALMLRAGGATLPHANA

SEQ ID NO: 347822 - protein, 17 aa, Mycobacterium
LALWCFAAMAVSGIVNA

SEQ ID NO: 347823 - protein, 20 aa, Mycobacterium
LAMILSYVWGVRVGGIFTAL

SEQ ID NO: 347824 - protein, 25 aa, Mycobacterium
LANPGLPLWPYLVCAALTGLGGGNY

SEQ ID NO: 347825 - protein, 21 aa, Mycobacterium
LAPQHWIALTPPRIPRLRTLQ

SEQ ID NO: 347826 - protein, 20 aa, Mycobacterium
LAVVYLGIGLLLACIVLRGL

SEQ ID NO: 347827 - protein, 25 aa, Mycobacterium
LDNSTPLFAFLFLAALGVDYTIFLV

SEQ ID NO: 347828 - protein, 18 aa, Mycobacterium
LDPGALRRLDRVKVVVID

SEQ ID NO: 347829 - protein, 18 aa, Mycobacterium
LELAPNPVALMQVGLTTA

SEQ ID NO: 347830 - protein, 26 aa, Mycobacterium
LGALGGVLGNPWLIGATAVLVIAAVG

SEQ ID NO: 347831 - protein, 28 aa, Mycobacterium
LGEIAEGALLLFLFSVGHALEGYAMGRA

SEQ ID NO: 347832 - protein, 36 aa, Mycobacterium
LGLLHHELEFWWELALLIVIMLLGHWVEMRSLAQTT

SEQ ID NO: 347833 - protein, 30 aa, Mycobacterium
LGQTLLDSHDWLVVLTALGSLAAMGTLISI

SEQ ID NO: 347834 - protein, 18 aa, Mycobacterium
LGYAVVLLVAGRLGDRFG

SEQ ID NO: 347835 - protein, 29 aa, Mycobacterium
LGYIAIYFGLIIFFTYFYVSITFNPDERA

SEQ ID NO: 347836 - protein, 17 aa, Mycobacterium
LHDQWRPVLWAISILTM

SEQ ID NO: 347837 - protein, 19 aa, Mycobacterium
LIMIAVFCGFAFAGMPLVA

SEQ ID NO: 347838 - protein, 17 aa, Mycobacterium
LINLPIVSYYQIGTALT

SEQ ID NO: 347839 - protein, 20 aa, Mycobacterium
LKGRLLFMPGVMVTSVPWQL

SEQ ID NO: 347840 - protein, 17 aa, Mycobacterium
LLCWRDTGHPQGGGSET

SEQ ID NO: 347841 - protein, 18 aa, Mycobacterium
LLGYVGLADTARPSARPL

SEQ ID NO: 347842 - protein, 22 aa, Mycobacterium
LLLAIWIGIGFIFRGVATTVSA

SEQ ID NO: 347843 - protein, 29 aa, Mycobacterium
LPVVGWWLYDIFYITPFLAIPYLHTVNRE

SEQ ID NO: 347844 - protein, 25 aa, Mycobacterium
LQRITWIITMYLLGYIAAMPLLGRA

SEQ ID NO: 347845 - protein, 24 aa, Mycobacterium
LRADLARDPSFYLRFRREAQNAAA

SEQ ID NO: 347846 - protein, 18 aa, Mycobacterium
LRDALFDAFHPKGADGKP

SEQ ID NO: 347847 - protein, 25 aa, Mycobacterium
LREFGNIVFHFSLLGLLVAVAVGKL

SEQ ID NO: 347848 - protein, 20 aa, Mycobacterium
LRELCDAAMTELLAGARRAT

SEQ ID NO: 347849 - protein, 23 aa, Mycobacterium
LRLKGYLIMCRNSRRDYADFADM

SEQ ID NO: 347850 - protein, 24 aa, Mycobacterium
LRNTFWALVLPFMFGSPYAIFLLR

SEQ ID NO: 347851 - protein, 17 aa, Mycobacterium
LRYVVAGFGLSALLCPL

SEQ ID NO: 347852 - protein, 25 aa, Mycobacterium
LSGDQYFGFLINLLLVFGISFEFPL

SEQ ID NO: 347853 - protein, 25 aa, Mycobacterium
LSKSAIVPLHFWLPGAMAAPTPVSA

SEQ ID NO: 347854 - protein, 21 aa, Mycobacterium
LSLGSILLLAALGLSLTFGQM

SEQ ID NO: 347855 - protein, 24 aa, Mycobacterium
LTNNNPYPLGIAALGLMAGAYVGE

SEQ ID NO: 347856 - protein, 26 aa, Mycobacterium
LTTAFAYLLLPQVLVYGLSSVFMAIL

SEQ ID NO: 347857 - protein, 18 aa, Mycobacterium
LTVLLLAPDVYWPLRRIG

SEQ ID NO: 347858 - protein, 19 aa, Mycobacterium
LTVLLLAPDVYWPLRRIGV

SEQ ID NO: 347859 - protein, 20 aa, Mycobacterium
LTVSLFYLLAQMAGAGGLVA

SEQ ID NO: 347860 - protein, 34 aa, Mycobacterium
LVAGLPLAHWEFYMALAYFKLAIIAAGIDFRRRM

SEQ ID NO: 347861 - protein, 19 aa, Mycobacterium
LVAIPFTVLVSFTLNILLR

SEQ ID NO: 347862 - protein, 28 aa, Mycobacterium
LVALIALFPPYIMWAPNAIWKAFDLFVG

SEQ ID NO: 347863 - protein, 18 aa, Mycobacterium
LVFAFTMMSMIVSDLRVV

SEQ ID NO: 347864 - protein, 17 aa, Mycobacterium
LVLAYAGSALPLLLLFS

SEQ ID NO: 347865 - protein, 24 aa, Mycobacterium
LVLGATILVLLRAFANGGSSLTGV

SEQ ID NO: 347866 - protein, 25 aa, Mycobacterium
LVLGWMSARWWRRIVSVAAVGACLL

SEQ ID NO: 347867 - protein, 24 aa, Mycobacterium
LVPTLLVAIPFTVLVAFTLNILLR

SEQ ID NO: 347868 - protein, 20 aa, Mycobacterium
LVRAYLWRRHGDIVRAGIGA

SEQ ID NO: 347869 - protein, 18 aa, Mycobacterium
LWNPGTWWQSIAVWFAAA

SEQ ID NO: 347870 - protein, 19 aa, Mycobacterium
LWTGVGLMLIAWLGLGRRV

SEQ ID NO: 347871 - protein, 20 aa, Mycobacterium
LWVGFTAVTALLILGLAQTL

SEQ ID NO: 347872 - protein, 28 aa, Mycobacterium
MAIARAFAVLFLPYSLLGPFAGALMDRW

SEQ ID NO: 347873 - protein, 19 aa, Mycobacterium
MFAFAIKAPLWPFHRWLPD

SEQ ID NO: 347874 - protein, 19 aa, Mycobacterium
MFHALGFLHATIAMMLGST

SEQ ID NO: 347875 - protein, 37 aa, Mycobacterium; identical to SEQ ID NO: 21020

SEQ ID NO: 347876 - protein, 22 aa, Mycobacterium
MFRMPIFTWNILVTSILVLIAF

SEQ ID NO: 347877 - protein, 19 aa, Mycobacterium
MGVVTVLWVLYGYSMAFGD

SEQ ID NO: 347878 - protein, 22 aa, Mycobacterium
MIHGVLLATNFFGINTIPIALN

SEQ ID NO: 347879 - protein, 17 aa, Mycobacterium
MLVLVVVGLVVLGPERL

SEQ ID NO: 347880 - protein, 18 aa, Mycobacterium
MLVPLATGCLRVRASITI

SEQ ID NO: 347881 - protein, 24 aa, Mycobacterium
MRKMAAWAGILAVPTMVAAIYGMN

SEQ ID NO: 347882 - protein, 17 aa, Mycobacterium
MSEVHLARDLRLHRDVA

SEQ ID NO: 347883 - protein, 19 aa, Mycobacterium
MTRSEMIARLVFAMGGRAA

SEQ ID NO: 347884 - protein, 23 aa, Mycobacterium
MTRYYAAQRTFWVDPVSGTIVKQ

SEQ ID NO: 347885 - protein, 31 aa, Mycobacterium
MVGALADWFAVTALFKHPLGIPIPHTAIIKR

SEQ ID NO: 347886 - protein, 36 aa, Mycobacterium
MVGALADWFAVTALFRHPLGIPIPHTAIIKRKKDQL

SEQ ID NO: 347887 - protein, 25 aa, Mycobacterium
MVNELDRFETLLADLLEISRHDAGV

SEQ ID NO: 347888 - protein, 25 aa, Mycobacterium
NAGPPRLWVWIALTVLACGVLVLGW

SEQ ID NO: 347889 - protein, 17 aa, Mycobacterium
NAGVTALVLLFVGGALY

SEQ ID NO: 347890 - protein, 29 aa, Mycobacterium
NAIKTPQFWLLWIVLCFNVTAGIGILEKA

SEQ ID NO: 347891 - protein, 18 aa, Mycobacterium
NAVFWSLFQQIFTVLAVY

SEQ ID NO: 347892 - protein, 25 aa, Mycobacterium
NFFAWALSVMFLVFSLRALLYKPFV

SEQ ID NO: 347893 - protein, 20 aa, Mycobacterium
NIQYDYIFGFSFYTAHYFGA

SEQ ID NO: 347894 - protein, 17 aa, Mycobacterium
NLLLEQLHYRHELLYYK

SEQ ID NO: 347895 - protein, 25 aa, Mycobacterium
NLWASLGIVAVLIPATVFGLGIGPA

SEQ ID NO: 347896 - protein, 27 aa, Mycobacterium
NSFDIPLWVLITWLLVRWARTRDDRLL

SEQ ID NO: 347897 - protein, 27 aa, Mycobacterium
NSYVWSSWLVYLCLAAGVYFSIRTRLL

SEQ ID NO: 347898 - protein, 27 aa, Mycobacterium
PDRRRFFGYLNLFLASMLLLVVADNYV

SEQ ID NO: 347899 - protein, 28 aa, Mycobacterium
PDSYRLLNIVFMLVVVFTLVQGPSLRPI

SEQ ID NO: 347900 - protein, 35 aa, Mycobacterium
PERLWQITELQFAALSGVLLLAALIANLVGAADPV

SEQ ID NO: 347901 - protein, 24 aa, Mycobacterium
PHVFLNAIFGLFGALALIMATIVL

SEQ ID NO: 347902 - protein, 20 aa, Mycobacterium
PITFATFGLGYLAIIGVPPF

SEQ ID NO: 347903 - protein, 20 aa, Mycobacterium
PLEHCYAYSDSITDLPMLEA

SEQ ID NO: 347904 - protein, 22 aa, Mycobacterium
PLPTEIYWRRRGLALGIAVVVI

SEQ ID NO: 347905 - protein, 27 aa, Mycobacterium
PLTDGWFPVVVQLIGALLLGAAVGWRT

SEQ ID NO: 347906 - protein, 17 aa, Mycobacterium
PPMTTWYAAMLFAVVPL

SEQ ID NO: 347907 - protein, 34 aa, Mycobacterium
PPNAYDEYPVLPPIGLQAPVPIQPPPPGPEVIPG

SEQ ID NO: 347908 - protein, 18 aa, Mycobacterium
PQFSLWLVPLAVLALPHR

SEQ ID NO: 347909 - protein, 20 aa, Mycobacterium
PRKVSFLPGMRYYAGNWDTT

SEQ ID NO: 347910 - protein, 31 aa, Mycobacterium
PRSAEVVVYGLAFFFGAFFTVQEAFASVRQG

SEQ ID NO: 347911 - protein, 27 aa, Mycobacterium
PSIAALLGRWFWWPQRVRPRPASRMLR

SEQ ID NO: 347912 - protein, 25 aa, Mycobacterium
PTQPQYIMVLLNIGAVFMGTALTIR

SEQ ID NO: 347913 - protein, 19 aa, Mycobacterium
PTTLFRPHNLPFVMLGAGL

SEQ ID NO: 347914 - protein, 17 aa, Mycobacterium
PVALMQVGLTTAAAGLH

SEQ ID NO: 347915 - protein, 23 aa, Mycobacterium
PVFKPLGFDWHINVALLGSFSAR

SEQ ID NO: 347916 - protein, 24 aa, Mycobacterium
PVTNGPVWVLAGFGAQHRKMGKSL

SEQ ID NO: 347917 - protein, 26 aa, Mycobacterium
QEAAMKYFLLGAFSSAFFLYGVALLY

SEQ ID NO: 347918 - protein, 24 aa, Mycobacterium
QFTIAFMTVILLGAGTDYSVFLIS

SEQ ID NO: 347919 - protein, 25 aa, Mycobacterium
QGKSQLLNALLNLPVARVGDDEATV

SEQ ID NO: 347920 - protein, 18 aa, Mycobacterium
QGRAYWIHLMMASQTIES

SEQ ID NO: 347921 - protein, 24 aa, Mycobacterium
QIFDGALLIVIFATSGALDDVATK

SEQ ID NO: 347922 - protein, 35 aa, Mycobacterium
QNVGLSLGLIIVLMPLALFGVLGLAAVVLVHELAE

SEQ ID NO: 347923 - protein, 24 aa, Mycobacterium
QQFVGINVIFYYSNVLWQAVGFSA

SEQ ID NO: 347924 - protein, 32 aa, Mycobacterium
QQINPACGCYFDNVYWITFAGMATVDNPRYVI

SEQ ID NO: 347925 - protein, 24 aa, Mycobacterium
QRATIWFFAIVSVLFLAQTLLGAA

SEQ ID NO: 347926 - protein, 26 aa, Mycobacterium
QREALLLTQLLGLPYADAAAVCGCPV

SEQ ID NO: 347927 - protein, 18 aa, Mycobacterium
QRGLKLFLSPDGKAARFI

SEQ ID NO: 347928 - protein, 31 aa, Mycobacterium
QRRMEVLALPLVAVVLFLVFGGAVAACLPVM

SEQ ID NO: 347929 - protein, 31 aa, Mycobacterium
QTVSLGIILLALLWYAGLPLRVFATSLLAVF

SEQ ID NO: 347930 - protein, 31 aa, Mycobacterium
QVGSLTAFLAYFTQILMAVLMATMTLVVLPR

SEQ ID NO: 347931 - protein, 19 aa, Mycobacterium
RADYLRYLSVVRDNVRAHA

SEQ ID NO: 347932 - protein, 24 aa, Mycobacterium
RALMWLVDLLLVVPSFILIAIVTP

SEQ ID NO: 347933 - protein, 30 aa, Mycobacterium; identical to SEQ ID NO: 21258

SEQ ID NO: 347934 - protein, 23 aa, Mycobacterium
RDHVVHGWVLASGSFMLCAAFNV

SEQ ID NO: 347935 - protein, 24 aa, Mycobacterium
RFGFLLAIPAVFASGLFSLPDAFH

SEQ ID NO: 347936 - protein, 25 aa, Mycobacterium
RFGGSLLLYAFPAAGAFAAMHALVP

SEQ ID NO: 347937 - protein, 20 aa, Mycobacterium
RFWLNSLLLLSMGFTLVLGT

SEQ ID NO: 347938 - protein, 17 aa, Mycobacterium
RGYLLRDGELTQITKDD

SEQ ID NO: 347939 - protein, 24 aa, Mycobacterium
RHHEALLFFAFSGVGVLLSMAPLW

SEQ ID NO: 347940 - protein, 24 aa, Mycobacterium
RIAKPLVPAVMIAAALIAVAGSLL

SEQ ID NO: 347941 - protein, 30 aa, Mycobacterium; identical to SEQ ID NO: 24984

SEQ ID NO: 347942 - protein, 26 aa, Mycobacterium
RISRAHLILRFDQGRWLAIDNGSLNG

SEQ ID NO: 347943 - protein, 19 aa, Mycobacterium
RKISFLPGMRYYAGNWDTT

SEQ ID NO: 347944 - protein, 18 aa, Mycobacterium
RKRWDRYARFAEKTFNVT

SEQ ID NO: 347945 - protein, 26 aa, Mycobacterium
RLKVFPLAISLPWGIAPAALPQLPLP

SEQ ID NO: 347946 - protein, 18 aa, Mycobacterium
RLSRRTLSTIKTNLFWAF

SEQ ID NO: 347947 - protein, 17 aa, Mycobacterium
RLTIARAILADTPVLIL

SEQ ID NO: 347948 - protein, 33 aa, Mycobacterium
RMVVVPAFMHVMGRWNWWAPRPLAWLHDRFGIS

SEQ ID NO: 347949 - protein, 17 aa, Mycobacterium
RPLRYVVAGFGLSALLC

SEQ ID NO: 347950 - protein, 21 aa, Mycobacterium
RRARRIMLQNVGLSLGLIIVL

SEQ ID NO: 347951 - protein, 32 aa, Mycobacterium
RRPQFRALWVFVLIPVLILLAVSGKWLYADAA

SEQ ID NO: 347952 - protein, 21 aa, Mycobacterium
RRRRRALRWALIFSAGCVFWA

SEQ ID NO: 347953 - protein, 19 aa, Mycobacterium
RRVMGPGLLLLFVVGDILG

SEQ ID NO: 347954 - protein, 18 aa, Mycobacterium
RRWDSEHLGLLVLVPLIG

SEQ ID NO: 347955 - protein, 22 aa, Mycobacterium
RRWRLRILPALVAAAAVLAGVM

SEQ ID NO: 347956 - protein, 22 aa, Mycobacterium
RRWYVITFLMGLFFVLGQGYEY

SEQ ID NO: 347957 - protein, 22 aa, Mycobacterium
RRYWNWIAVAVVRRPVPLLVAS

SEQ ID NO: 347958 - protein, 21 aa, Mycobacterium
RSGGALRQLWWKLRLRGSETA

SEQ ID NO: 347959 - protein, 26 aa, Mycobacterium
RTLVSTTFVVPYPPGFPVLVPGQVVS

SEQ ID NO: 347960 - protein, 22 aa, Mycobacterium
RVFAWLALVFGVGFSMLALMTR

SEQ ID NO: 347961 - protein, 19 aa, Mycobacterium
RVLTIGGGILLFWAMLYGW

SEQ ID NO: 347962 - protein, 19 aa, Mycobacterium
RVVNSRWVELPHLLQPRAA

SEQ ID NO: 347963 - protein, 22 aa, Mycobacterium
SAAFIMFAGIFYGGMYGGSTTS

SEQ ID NO: 347964 - protein, 24 aa, Mycobacterium
SADAIKFVFRRPFQWREFLEQSWF

SEQ ID NO: 347965 - protein, 17 aa, Mycobacterium
SALPFTIGIVMLGLSAA

SEQ ID NO: 347966 - protein, 24 aa, Mycobacterium
SATVAFPMYFLKSFAYAGVATVAF

SEQ ID NO: 347967 - protein, 23 aa, Mycobacterium
SDRLSHTLLPKRIALPVFASDAM

SEQ ID NO: 347968 - protein, 20 aa, Mycobacterium
SFKVFALVAALEQGIGLGYQ

SEQ ID NO: 347969 - protein, 28 aa, Mycobacterium
SFWTFGIIAMVTLLAKVDLARGYLAIAL

SEQ ID NO: 347970 - protein, 20 aa, Mycobacterium
SGHTTFLELAPNPVALMQVG

SEQ ID NO: 347971 - protein, 17 aa, Mycobacterium
SGLALWCFAAMAVSGIV

SEQ ID NO: 347972 - protein, 25 aa, Mycobacterium
SIVVPFMAVVYIVLALIIVVVNVSA

SEQ ID NO: 347973 - protein, 24 aa, Mycobacterium
SLARTRRGLRALLSLVPDEATVRR

SEQ ID NO: 347974 - protein, 21 aa, Mycobacterium
SLIVIIMMLITRSVVAAAVIV

SEQ ID NO: 347975 - protein, 20 aa, Mycobacterium
SLIVVVVITLFISLAVYGAS

SEQ ID NO: 347976 - protein, 23 aa, Mycobacterium
SLLGLAVGWFVGALVVLVVGTPA

SEQ ID NO: 347977 - protein, 29 aa, Mycobacterium
SLLLSVALFFVWMIAVAFLYLVLGGMGVW

SEQ ID NO: 347978 - protein, 25 aa, Mycobacterium
SLVPTLLVSIPFTVLVAFTLNILLR

SEQ ID NO: 347979 - protein, 25 aa, Mycobacterium
SMDYEIFLLTRIRERFLHSGNTRDA

SEQ ID NO: 347980 - protein, 25 aa, Mycobacterium
SMDYEVFLVARIREYWLASGAARPA

SEQ ID NO: 347981 - protein, 17 aa, Mycobacterium
SMLAFSGRFGRARKITW

SEQ ID NO: 347982 - protein, 18 aa, Mycobacterium
SMQYSYLPSWLSFLVDKE

SEQ ID NO: 347983 - protein, 34 aa, Mycobacterium
SPAALQVHLVVFALAIVIGYYVIGNVHHALHTPL

SEQ ID NO: 347984 - protein, 24 aa, Mycobacterium
SRSQFIQLVLIGALVYVAYPFIST

SEQ ID NO: 347985 - protein, 17 aa, Mycobacterium
SSIYFATPLLVSLRERT

SEQ ID NO: 347986 - protein, 20 aa, Mycobacterium
STFAGIYFWFPKMTGRLLDE

SEQ ID NO: 347987 - protein, 26 aa, Mycobacterium
STRATLHFLWLRLARVWPVYLVTLHL

SEQ ID NO: 347988 - protein, 24 aa, Mycobacterium
STVTHGIISALHRPVPLSGEGSDT

SEQ ID NO: 347989 - protein, 18 aa, Mycobacterium
SVFAALGPACAIAVFVGF

SEQ ID NO: 347990 - protein, 23 aa, Mycobacterium
SVGWVRLGALVLALAALAALLIN

SEQ ID NO: 347991 - protein, 26 aa, Mycobacterium
SVRQGRFEIDFLMLVSAAGAAALGEI

SEQ ID NO: 347992 - protein, 18 aa, Mycobacterium
SVTLGVLVIACPCALGLA

SEQ ID NO: 347993 - protein, 20 aa, Mycobacterium
SWRRGLIFAMFVFAAVFTPG

SEQ ID NO: 347994 - protein, 22 aa, Mycobacterium
TAGAVFVAAWLPFNNGLRPEPL

SEQ ID NO: 347995 - protein, 26 aa, Mycobacterium
TAGYLGLLLFVAAPLRRSGAYTVPDF

SEQ ID NO: 347996 - protein, 21 aa, Mycobacterium
TDDLRPIPVFGSDELARLTEA

SEQ ID NO: 347997 - protein, 32 aa, Mycobacterium; identical to SEQ ID NO: 21472

SEQ ID NO: 347998 - protein, 24 aa, Mycobacterium
TEVSWRLAFLVNVPIGLVMIYLAR

SEQ ID NO: 347999 - protein, 19 aa, Mycobacterium
TFLTVEAWAFLQLGARQQS

SEQ ID NO: 348000 - protein, 25 aa, Mycobacterium
TGDVRRAMTMLLIACPCAVGLSTPT

SEQ ID NO: 348001 - protein, 41 aa, Mycobacterium
TGNFWTLAVVFLIPQRIGLTVLAWWFDWLPHHGLEDTQRTN

SEQ ID NO: 348002 - protein, 22 aa, Mycobacterium
TGPLPYIVMEYVDGVTLRDIVH

SEQ ID NO: 348003 - protein, 25 aa, Mycobacterium
TGVTIFTGYPFLRGALRSLRSGKAG

SEQ ID NO: 348004 - protein, 29 aa, Mycobacterium
THINAYDLDLYLRIAPELYLKRLCVGGVE

SEQ ID NO: 348005 - protein, 22 aa, Mycobacterium
TIGLGLLFDTLIVRSFMTPSIA

SEQ ID NO: 348006 - protein, 18 aa, Mycobacterium
TLAALWPAEALESVRLLI

SEQ ID NO: 348007 - protein, 28 aa, Mycobacterium
TLRRGMPFALTWWSLTFPVGTFVTGTSQ

SEQ ID NO: 348008 - protein, 23 aa, Mycobacterium
TMGLPHVLVRFYTNPDGRAARRT

SEQ ID NO: 348009 - protein, 17 aa, Mycobacterium
TMMAMIVSDLRVVGQLG

SEQ ID NO: 348010 - protein, 23 aa, Mycobacterium
TNGSQFFMVYKDSQLPPQYTVFG

SEQ ID NO: 348011 - protein, 21 aa, Mycobacterium
TPDFPLPFTYPPFAAVVFYPL

SEQ ID NO: 348012 - protein, 26 aa, Mycobacterium
TPEAPFGWYYDLLAMWAHVSTASVWM

SEQ ID NO: 348013 - protein, 25 aa, Mycobacterium
TPIDPRFPTFLATNLSEALPGPFSP

SEQ ID NO: 348014 - protein, 26 aa, Mycobacterium
TQAAGLLLWFLIALPIGAVLGGWIAT

SEQ ID NO: 348015 - protein, 22 aa, Mycobacterium
TQHNVYIPWSMTVTPISQSDVG

SEQ ID NO: 348016 - protein, 23 aa, Mycobacterium
TSAALIMIAVFIGFAFAGMPLVA

SEQ ID NO: 348017 - protein, 23 aa, Mycobacterium
TSAALIMIAVFVGFAFAGMPLVA

SEQ ID NO: 348018 - protein, 21 aa, Mycobacterium
TSRRPLLRLALTEAALFGVAI

SEQ ID NO: 348019 - protein, 27 aa, Mycobacterium
TTDLRGQFWIWAGANIAPINWILGALG

SEQ ID NO: 348020 - protein, 18 aa, Mycobacterium
TTMLVRAGDRWLGAIGLM

SEQ ID NO: 348021 - protein, 24 aa, Mycobacterium
TVSWLIGCLALLFATSSGLGMYMA

SEQ ID NO: 348022 - protein, 32 aa, Mycobacterium
TVVVGWVISLIMVNPFLLLAQQARAINAQSSP

SEQ ID NO: 348023 - protein, 23 aa, Mycobacterium
TVVYAFICLFVINVVMTAIGVRI

SEQ ID NO: 348024 - protein, 28 aa, Mycobacterium
TYTSVVLAFLAFMVALVGLADFGLTKLV

SEQ ID NO: 348025 - protein, 30 aa, Mycobacterium
VAAAPVNYLKLMPATYVVLVFVVGYMLLTV

SEQ ID NO: 348026 - protein, 32 aa, Mycobacterium
VAFPRLNALSFWLFLFGALIAIAGFITPGGAA

SEQ ID NO: 348027 - protein, 28 aa, Mycobacterium
VAGILGLVGIGVLPLLCCAGPALIAGGA

SEQ ID NO: 348028 - protein, 24 aa, Mycobacterium
VAGLGLFNPVSVGAGLILGRMAYK

SEQ ID NO: 348029 - protein, 17 aa, Mycobacterium
VAGPVLGRLGWFVESKL

SEQ ID NO: 348030 - protein, 17 aa, Mycobacterium
VAHLCFLAALLPLARRT

SEQ ID NO: 348031 - protein, 23 aa, Mycobacterium
VASYSWYYAWTPGTGYLANLLPH

SEQ ID NO: 348032 - protein, 29 aa, Mycobacterium
VATAFAFAPWYFFLTRFFTGSGIGGEYAA

SEQ ID NO: 348033 - protein, 23 aa, Mycobacterium
VAVFFALSGFLLWRGHAAAARGL

SEQ ID NO: 348034 - protein, 22 aa, Mycobacterium
VDSFDGYEYLFWVGCAGAYDDK

SEQ ID NO: 348035 - protein, 22 aa, Mycobacterium
VEITALRLLAPYLGLTLETSTL

SEQ ID NO: 348036 - protein, 21 aa, Mycobacterium
VFLIATIVILSFYGAGFATVP

SEQ ID NO: 348037 - protein, 25 aa, Mycobacterium
VFVAFQLMFAIITVALISGAVADRL

SEQ ID NO: 348038 - protein, 19 aa, Mycobacterium
VFVEWRFDLIFGTAAFVIA

SEQ ID NO: 348039 - protein, 23 aa, Mycobacterium
VGAEWLFTPVLLSQNYHLVHHLH

SEQ ID NO: 348040 - protein, 25 aa, Mycobacterium
VGLASYLLIGFWYHKPSAATAAKKA

SEQ ID NO: 348041 - protein, 25 aa, Mycobacterium
VGLASYLLIGFWYHKPTAATAAKKA

SEQ ID NO: 348042 - protein, 19 aa, Mycobacterium
VGLFVMFSRMQGGARMGFG

SEQ ID NO: 348043 - protein, 20 aa, Mycobacterium
VGLFVMFSRMQGGARMGFGF

SEQ ID NO: 348044 - protein, 28 aa, Mycobacterium
VGLSVLLWQHLIGIELHWLVLSMSVIVL

SEQ ID NO: 348045 - protein, 18 aa, Mycobacterium
VIDEFYEWFRIMPTAVDV

SEQ ID NO: 348046 - protein, 24 aa, Mycobacterium
VIFATFTFIFFALEGSIMAQGLNL

SEQ ID NO: 348047 - protein, 22 aa, Mycobacterium
VIGTFVVPPILKVLRERDAMVA

SEQ ID NO: 348048 - protein, 31 aa, Mycobacterium; identical to SEQ ID NO: 21606

SEQ ID NO: 348049 - protein, 18 aa, Mycobacterium
VLIIMVMRMLAEMAVANP

SEQ ID NO: 348050 - protein, 25 aa, Mycobacterium
VLKSSYAQFIFLLSGADHDQMDRMR

SEQ ID NO: 348051 - protein, 32 aa, Mycobacterium
VLLLCGVWALLRWEPLRPFRFVGVTVVLTFVV

SEQ ID NO: 348052 - protein, 18 aa, Mycobacterium
VLLMTPGLAFFYGGMVRA

SEQ ID NO: 348053 - protein, 31 aa, Mycobacterium; identical to SEQ ID NO: 23023

SEQ ID NO: 348054 - protein, 25 aa, Mycobacterium
VLVGTLLSWYALVAALTTIPLVRWT

SEQ ID NO: 348055 - protein, 20 aa, Mycobacterium
VLVIAAVGYALRRHRRQDCH

SEQ ID NO: 348056 - protein, 30 aa, Mycobacterium; identical to SEQ ID NO: 21620

SEQ ID NO: 348057 - protein, 18 aa, Mycobacterium
VLVPPMALSRILLGVHYP

SEQ ID NO: 348058 - protein, 18 aa, Mycobacterium
VMSLQVTALLFALPIYAR

SEQ ID NO: 348059 - protein, 17 aa, Mycobacterium
VPGIWVPDTPLSHRNTQ

SEQ ID NO: 348060 - protein, 23 aa, Mycobacterium
VPSPTVLMVGLPTGLRLVIDNAI

SEQ ID NO: 348061 - protein, 18 aa, Mycobacterium
VRQVYDMALVFRHRVRKD

SEQ ID NO: 348062 - protein, 19 aa, Mycobacterium
VRSGMDLGPWLVSRDITVV

SEQ ID NO: 348063 - protein, 21 aa, Mycobacterium
VSKEIVYFLAQLDVKEIHGYN

SEQ ID NO: 348064 - protein, 22 aa, Mycobacterium
VSKEIVYFLAQLDVKEIHGYNP

SEQ ID NO: 348065 - protein, 17 aa, Mycobacterium
VSYLALLVGLGFGLLAV

SEQ ID NO: 348066 - protein, 21 aa, Mycobacterium
VTIFVFILISNWLSVLPVQYT

SEQ ID NO: 348067 - protein, 24 aa, Mycobacterium
VTMLVFATAFFGAGLLLPSYFQQV

SEQ ID NO: 348068 - protein, 19 aa, Mycobacterium
VVAPLYLVASVVISYLSAV

SEQ ID NO: 348069 - protein, 25 aa, Mycobacterium
VVEGVGLWLLKRWGEYFAVIATSVF

SEQ ID NO: 348070 - protein, 26 aa, Mycobacterium
VVFTIPSLALFVVLPMIIGTRILDEA

SEQ ID NO: 348071 - protein, 18 aa, Mycobacterium
VVLLVLLHRAKGGGLSTL

SEQ ID NO: 348072 - protein, 17 aa, Mycobacterium
VVLTLEAAALLAGAYTF

SEQ ID NO: 348073 - protein, 19 aa, Mycobacterium
VVLVLVAIVLFGAASLLFG

SEQ ID NO: 348074 - protein, 28 aa, Mycobacterium
VVYTGAVMMLFLFVLMLIGVDSAESLKE

SEQ ID NO: 348075 - protein, 18 aa, Mycobacterium
VWAIALIGAFYLFTLVLG

SEQ ID NO: 348076 - protein, 30 aa, Mycobacterium; identical to SEQ ID NO: 21678

SEQ ID NO: 348077 - protein, 25 aa, Mycobacterium
VYEGFPADVLYYFRLYALGTQVVIY

SEQ ID NO: 348078 - protein, 25 aa, Mycobacterium
VYTDIFRGLPEVVIILIIGLGVGPI

SEQ ID NO: 348079 - protein, 25 aa, Mycobacterium
WAETTVIIRFWLLTAITCGLGVALF

SEQ ID NO: 348080 - protein, 29 aa, Mycobacterium
WAGFSVAWLYWYFWVIVVGFEAVAGGKVL

SEQ ID NO: 348081 - protein, 22 aa, Mycobacterium
WAILAVVVIVLFGAKKLPDAAR

SEQ ID NO: 348082 - protein, 19 aa, Mycobacterium
WFTIGIPSFILSLAPNNER

SEQ ID NO: 348083 - protein, 18 aa, Mycobacterium
WIHHFGLFAAVGGAMAAL

SEQ ID NO: 348084 - protein, 17 aa, Mycobacterium
WKRFNTRGALWSMYGGL

SEQ ID NO: 348085 - protein, 24 aa, Mycobacterium
WSQWHSLVFDVSVWEIWGALLHGG

SEQ ID NO: 348086 - protein, 31 aa, Mycobacterium
YAFGIGPLVQLFLRLTPRRILFHDFGAPGRN

SEQ ID NO: 348087 - protein, 24 aa, Mycobacterium
YAGSALPLLLLFSVANRSLGDVLT

SEQ ID NO: 348088 - protein, 18 aa, Mycobacterium
YCLSFTRMPYFQTLGVPC

SEQ ID NO: 348089 - protein, 30 aa, Mycobacterium
YFTTFLNPIDLLWSFLQAVLMAITILLIHT

SEQ ID NO: 348090 - protein, 24 aa, Mycobacterium
YGSLVMVFQWGWLKDLGFAQISSI

SEQ ID NO: 348091 - protein, 19 aa, Mycobacterium
YGTNLVNLLKLLTPEKDGK

SEQ ID NO: 348092 - protein, 24 aa, Mycobacterium
YIISFALFIYGLMGLTGPKTAVRG

SEQ ID NO: 348093 - protein, 22 aa, Mycobacterium
YLINRRWTFQAPPSKARFIAVC

SEQ ID NO: 348094 - protein, 33 aa, Mycobacterium; identical to SEQ ID NO: 21734

SEQ ID NO: 348095 - protein, 17 aa, Mycobacterium
YPALNLTSARLATGTAN

SEQ ID NO: 348096 - protein, 24 aa, Mycobacterium
YRTTIFAFPVFGFGVIFGAIWAEE

SEQ ID NO: 348097 - protein, 26 aa, Mycobacterium
YVIYQGLTMYLLLAIGWHGGEELAKI

SEQ ID NO: 348098 - protein, 24 aa, Mycobacterium
AAAAAAFGGLLLTSGSATQVEQTA

SEQ ID NO: 348099 - protein, 25 aa, Mycobacterium
AAAAALIAVLLLLRSRQSPRSVAMV

SEQ ID NO: 348100 - protein, 21 aa, Mycobacterium
AAAAALWLVAPCTELFQDGRT

SEQ ID NO: 348101 - protein, 25 aa, Mycobacterium
AAAAFAILVFLVRYGAYSSSSWPHS

SEQ ID NO: 348102 - protein, 28 aa, Mycobacterium
AAAALGTPALIPPPPHSALGQRGKLGVR

SEQ ID NO: 348103 - protein, 25 aa, Mycobacterium
AAAALGWDAAPIPRNAPGCAGCCQC

SEQ ID NO: 348104 - protein, 28 aa, Mycobacterium
AAAAMIAALTLVLTGGAWQWQSSKNDSL

SEQ ID NO: 348105 - protein, 19 aa, Mycobacterium
AAAAQPWYRRRGAVVGAGA

SEQ ID NO: 348106 - protein, 32 aa, Mycobacterium
AAAATLFLLTTTLLDGFWYVASAPLAADQFGL

SEQ ID NO: 348107 - protein, 25 aa, Mycobacterium
AAAAVLVAIVLALTLGHPAPKSVNP

SEQ ID NO: 348108 - protein, 18 aa, Mycobacterium
AAAAVWLVAPCTELFHDS

SEQ ID NO: 348109 - protein, 27 aa, Mycobacterium
AAAEKWNMPIVLIVLLAVFGSLAAAAL

SEQ ID NO: 348110 - protein, 17 aa, Mycobacterium
AAAELLEWAMQLGGDSV

SEQ ID NO: 348111 - protein, 50 aa, Mycobacterium
AAAELPIIIVILIQIILVLLEILYAIVAYTIILSIILPIIVVVEAFVLSV

SEQ ID NO: 348112 - protein, 18 aa, Mycobacterium
AAAFIWQMLQWFGAGYVA

SEQ ID NO: 348113 - protein, 21 aa, Mycobacterium
AAAFMGFIVWTQGLSSSIALA

SEQ ID NO: 348114 - protein, 19 aa, Mycobacterium
AAAFRQRAERLPAGARVLL

SEQ ID NO: 348115 - protein, 21 aa, Mycobacterium
AAAGIEHPLIRAPLAAAACGL

SEQ ID NO: 348116 - protein, 27 aa, Mycobacterium
AAAGLPWYAILCLPVLFTAGMCLLDTI

SEQ ID NO: 348117 - protein, 25 aa, Mycobacterium
AAAGLPWYAIVCLPVLFTAGMCLLD

SEQ ID NO: 348118 - protein, 25 aa, Mycobacterium
AAAGPPLFGALIAAAKYPPAWLLCA

SEQ ID NO: 348119 - protein, 25 aa, Mycobacterium
AAAGVIMILLGFLPKVAAVVSSIPQ

SEQ ID NO: 348120 - protein, 24 aa, Mycobacterium
AAAGVLVWLIALSAFDIRHRRLPN

SEQ ID NO: 348121 - protein, 20 aa, Mycobacterium
AAAHFFAFKISARLIGAGKV

SEQ ID NO: 348122 - protein, 20 aa, Mycobacterium
AAAHHITLPTPPTPVDACCA

SEQ ID NO: 348123 - protein, 39 aa, Mycobacterium
AAAIAALVYIGVALSWPLWWVAVCSVLCLLIVEGVVVNL

SEQ ID NO: 348124 - protein, 24 aa, Mycobacterium
AAAIALGPVLLWYDRDYLGQSVHD

SEQ ID NO: 348125 - protein, 19 aa, Mycobacterium
AAAIFGFTLSWNDLFYGLI

SEQ ID NO: 348126 - protein, 26 aa, Mycobacterium
AAAIGLFILPRTWQLMRQALRIIMEI

SEQ ID NO: 348127 - protein, 19 aa, Mycobacterium
AAAILVFAPALDAAIDRWL

SEQ ID NO: 348128 - protein, 37 aa, Mycobacterium
AAAISAMLIYRLISWIFISAIGWVVFFFMFRTEQQID

SEQ ID NO: 348129 - protein, 21 aa, Mycobacterium
AAAITMFRLLAGPSTLDRLVA

SEQ ID NO: 348130 - protein, 29 aa, Mycobacterium
AAAIVLANLLLRPLGHLLDRQPAIGREAA

SEQ ID NO: 348131 - protein, 23 aa, Mycobacterium
AAAKLYPLLFLGVLAVLGIRSGR

SEQ ID NO: 348132 - protein, 20 aa, Mycobacterium
AAALAAVWPAGAGLLIRFTG

SEQ ID NO: 348133 - protein, 20 aa, Mycobacterium
AAALALLFPQLETVVRQQSV

SEQ ID NO: 348134 - protein, 28 aa, Mycobacterium
AAALALVFLIVLLMLRSPVAAAVVIGAV

SEQ ID NO: 348135 - protein, 19 aa, Mycobacterium
AAALAQAVGHRTNYAQTAL

SEQ ID NO: 348136 - protein, 20 aa, Mycobacterium
AAALGARYRLRDRRVGGAAM

SEQ ID NO: 348137 - protein, 23 aa, Mycobacterium
AAALIRPSIMYLAGEGYGLVRLP

SEQ ID NO: 348138 - protein, 45 aa, Mycobacterium; identical to SEQ ID NO: 21750

SEQ ID NO: 348139 - protein, 45 aa, Mycobacterium
AAALLVPTVRFRPFIRLTVEWVEVLAFIVLLPAAAALGGLFTWIR

SEQ ID NO: 348140 - protein, 19 aa, Mycobacterium
AAALPFGLAAGAGAAWLFL

SEQ ID NO: 348141 - protein, 23 aa, Mycobacterium
AAALPMLPLMRRAPAMVRLMVEL

SEQ ID NO: 348142 - protein, 19 aa, Mycobacterium
AAALTLAPALLTLGSRRGL

SEQ ID NO: 348143 - protein, 18 aa, Mycobacterium
AAAMFLRVLAIALPSVCL

SEQ ID NO: 348144 - protein, 20 aa, Mycobacterium
AAAMFPGFVAPAISLSPVAR

SEQ ID NO: 348145 - protein, 20 aa, Mycobacterium
AAAMGWLPPAVGALLQEAID

SEQ ID NO: 348146 - protein, 24 aa, Mycobacterium
AAAPARPWNPGPVLTGAAALVAGT

SEQ ID NO: 348147 - protein, 20 aa, Mycobacterium
AAAPPLTIGFPREKLRHTAV

SEQ ID NO: 348148 - protein, 23 aa, Mycobacterium
AAAPTFEFFALYGTAAVYYWVIC

SEQ ID NO: 348149 - protein, 26 aa, Mycobacterium
AAAPTPLLGPVWVALLIIGASSGVAV

SEQ ID NO: 348150 - protein, 31 aa, Mycobacterium
AAAPVNYLKLMPLTYVVIIVMVGFTLLTVTA

SEQ ID NO: 348151 - protein, 24 aa, Mycobacterium
AAARALVQLLLVGGALTLLFEPGR

SEQ ID NO: 348152 - protein, 25 aa, Mycobacterium
AAASAAMTLLPWVDVSPLGLPMRWN

SEQ ID NO: 348153 - protein, 27 aa, Mycobacterium
AAASLILIIMLIITRSLVAAVTIVGTV

SEQ ID NO: 348154 - protein, 24 aa, Mycobacterium
AAASPLLAFVFVVPALNLGGIPPF

SEQ ID NO: 348155 - protein, 17 aa, Mycobacterium
AAATFMLIRQEDDRRAA

SEQ ID NO: 348156 - protein, 22 aa, Mycobacterium
AAATLCLLFARLPSFQTLAIPC

SEQ ID NO: 348157 - protein, 33 aa, Mycobacterium
AAATRWAQHAHWMWWTWPAAAAAGIAGLTLLVL

SEQ ID NO: 348158 - protein, 33 aa, Mycobacterium
AAATVWSLSLLDIGCVLILIALLITVQAAQLSA

SEQ ID NO: 348159 - protein, 25 aa, Mycobacterium
AAAVAVLLFLIIKVKLHAFVALVLV

SEQ ID NO: 348160 - protein, 24 aa, Mycobacterium
AAAVFIVAVVFFSGFFIGRATDGF

SEQ ID NO: 348161 - protein, 25 aa, Mycobacterium
AAAVFIVAVVFFSGFFIGRATDGFG

SEQ ID NO: 348162 - protein, 26 aa, Mycobacterium
AAAVGLLLYQNWFATLLPHDRIVAVE

SEQ ID NO: 348163 - protein, 24 aa, Mycobacterium
AAAVHWLLGMNWQLALLLGAVISS

SEQ ID NO: 348164 - protein, 20 aa, Mycobacterium
AAAVLAIGGFGAVVAGSGPG

SEQ ID NO: 348165 - protein, 25 aa, Mycobacterium
AAAVLAIGVFVGLQAWSSTPAQQVT

SEQ ID NO: 348166 - protein, 26 aa, Mycobacterium
AAAVLALSAIIMLALSHGSTGTPVTP

SEQ ID NO: 348167 - protein, 26 aa, Mycobacterium
AAAVLTMCFIVAGIIAPSLARRAAQS

SEQ ID NO: 348168 - protein, 24 aa, Mycobacterium
AAAVLVALAGRRLWHRFRGQPDRA

SEQ ID NO: 348169 - protein, 20 aa, Mycobacterium
AAAVLVTLAGRRLWHRFRGQ

SEQ ID NO: 348170 - protein, 24 aa, Mycobacterium
AAAVLWLVVVIRGPMPRWAEWAST

SEQ ID NO: 348171 - protein, 17 aa, Mycobacterium
AAAVLWSVGGWSAITVA

SEQ ID NO: 348172 - protein, 18 aa, Mycobacterium
AAAVPFYGPTPDDPDFAG

SEQ ID NO: 348173 - protein, 17 aa, Mycobacterium
AAAVRILSAIPVARASS

SEQ ID NO: 348174 - protein, 42 aa, Mycobacterium
AAAVVLLGLPLALAMLALLVYLYTVVLFAPVLIVLERLPVLD

SEQ ID NO: 348175 - protein, 25 aa, Mycobacterium
AAAVYALMWVGYRQRWAWLYRVDWS

SEQ ID NO: 348176 - protein, 30 aa, Mycobacterium
AAAWLDAAVWWKALLALAVSLALIVGVNFA

SEQ ID NO: 348177 - protein, 26 aa, Mycobacterium
AAAWLDGASWWKALLALVVAVALIIG

SEQ ID NO: 348178 - protein, 29 aa, Mycobacterium
AAAWLGSAVWWKALLALAVALALTVGVNY

SEQ ID NO: 348179 - protein, 27 aa, Mycobacterium
AAAYLLFLAAFLYLVAFLGNFWVPRTV

SEQ ID NO: 348180 - protein, 23 aa, Mycobacterium
AAAYRFLIERFLPAEPPVLDDET

SEQ ID NO: 348181 - protein, 33 aa, Mycobacterium
AACALALVALAYWLSRFGYLAVGVPLGAALMFF

SEQ ID NO: 348182 - protein, 25 aa, Mycobacterium
AACERPMIFPLSNPTSRMEAMPADV

SEQ ID NO: 348183 - protein, 28 aa, Mycobacterium
AACLHFTRLPYFNTMGFPLSIGMVVVVA

SEQ ID NO: 348184 - protein, 17 aa, Mycobacterium
AADAIRLSRRTLATIKG

SEQ ID NO: 348185 - protein, 26 aa, Mycobacterium
AADAITLSVLILFGLAGATLTVLVLT

SEQ ID NO: 348186 - protein, 20 aa, Mycobacterium
AADAPLVLSLERHGRDGWPD

SEQ ID NO: 348187 - protein, 29 aa, Mycobacterium
AADIPLSQWFLLTAAFGSLFMVAGKRYAE

SEQ ID NO: 348188 - protein, 17 aa, Mycobacterium
AADIYKWGEFGMLPALN

SEQ ID NO: 348189 - protein, 53 aa, Mycobacterium
AADLKRYFADGLQYWPWVLLGYFTLGIVIVSLIGWWALSRLLERMRGIPDVHK

SEQ ID NO: 348190 - protein, 32 aa, Mycobacterium
AADLLRESLPLMGFLVVGLLYCRADGVILSLL

SEQ ID NO: 348191 - protein, 22 aa, Mycobacterium
AADLSVWPPIGATAVEVSGAYA

SEQ ID NO: 348192 - protein, 24 aa, Mycobacterium
AADPLYWRGAQLVGNYPLSIALDG

SEQ ID NO: 348193 - protein, 25 aa, Mycobacterium
AADQLALPFSWQGVSLHAAGASRVR

SEQ ID NO: 348194 - protein, 31 aa, Mycobacterium
AADRLGWPLWAAYIGVFALTVLVGARLMVAL

SEQ ID NO: 348195 - protein, 32 aa, Mycobacterium
AADRNALMAIPLWIIIVLPVAKILATSLSIGT

SEQ ID NO: 348196 - protein, 34 aa, Mycobacterium
AADRQYAVFLLVLPLLLSLFAHAVPGKAGLSLAK

SEQ ID NO: 348197 - protein, 18 aa, Mycobacterium
AADVGLTIAPDRLYRDGR

SEQ ID NO: 348198 - protein, 25 aa, Mycobacterium
AADWAPWIWAVLVAGVGFMAMFVYW

SEQ ID NO: 348199 - protein, 36 aa, Mycobacterium
AAEDKPVIFWTPDHGAFIVRGPIVAAWDKLGGATGE

SEQ ID NO: 348200 - protein, 18 aa, Mycobacterium
AAEIAFIGPLLGSLARIV

SEQ ID NO: 348201 - protein, 29 aa, Mycobacterium
AAEIALLWWARRIFAAPLPLLGVPLSERR

SEQ ID NO: 348202 - protein, 18 aa, Mycobacterium
AAELAFIGPLLGSLSRIY

SEQ ID NO: 348203 - protein, 21 aa, Mycobacterium
AAELAFLGPLLAAVARIYGGR

SEQ ID NO: 348204 - protein, 25 aa, Mycobacterium
AAELDAHLRLPLRQVMWGTDEGLLE

SEQ ID NO: 348205 - protein, 29 aa, Mycobacterium
AAELGVDLPWWVYTFTLIAVIAVLTYFEI

SEQ ID NO: 348206 - protein, 25 aa, Mycobacterium
AAELPGLIRFFAEDAHLFATTVRDN

SEQ ID NO: 348207 - protein, 33 aa, Mycobacterium
AAEMFYLLNNRFLLEPVLNRIGLFGNKIAFATV

SEQ ID NO: 348208 - protein, 30 aa, Mycobacterium
AAENPEPGDWLYFVTIDLQGTTLFTREYEQ

SEQ ID NO: 348209 - protein, 25 aa, Mycobacterium
AAENQTWPTTLWASNPTISAAIQFG

SEQ ID NO: 348210 - protein, 19 aa, Mycobacterium
AAEPLVVLLIDELAGLTAY

SEQ ID NO: 348211 - protein, 19 aa, Mycobacterium
AAERWFLDRGLPAVLRPGV

SEQ ID NO: 348212 - protein, 29 aa, Mycobacterium
AAERWNLPIILIVLLAVFGSLTAAAIPLA

SEQ ID NO: 348213 - protein, 27 aa, Mycobacterium
AAERWNLPVILIVLLAVFGSLAAAAIP

SEQ ID NO: 348214 - protein, 28 aa, Mycobacterium
AAERWNLPVILIVLLAVFGSLAAAAIPL

SEQ ID NO: 348215 - protein, 26 aa, Mycobacterium
AAEVGLSLFYWWYHTLDKTAAVFVVL

SEQ ID NO: 348216 - protein, 31 aa, Mycobacterium
AAEWAPATLLLVATLTILAPGALLSAVTPMV

SEQ ID NO: 348217 - protein, 18 aa, Mycobacterium
AAFALHVWINNSWVAAQC

SEQ ID NO: 348218 - protein, 17 aa, Mycobacterium
AAFALLGALAVSLPMLL

SEQ ID NO: 348219 - protein, 18 aa, Mycobacterium
AAFAVRPLKRLAEQTREI

SEQ ID NO: 348220 - protein, 28 aa, Mycobacterium
AAFGALLRVIYVALPPLHDQWRPVLWTI

SEQ ID NO: 348221 - protein, 21 aa, Mycobacterium
AAFGFIFTFRDIPTPPHTPGP

SEQ ID NO: 348222 - protein, 25 aa, Mycobacterium
AAFGHWWVIVVYLAVLTLLTLVALA

SEQ ID NO: 348223 - protein, 26 aa, Mycobacterium
AAFGLALAWLATIWATSRMAGRRVWD

SEQ ID NO: 348224 - protein, 26 aa, Mycobacterium
AAFGLALAWLGTIWATAGLAGRRVWD

SEQ ID NO: 348225 - protein, 32 aa, Mycobacterium
AAFGLTMVVLTAGLFMIFGEYRSGAANRYSAV

SEQ ID NO: 348226 - protein, 21 aa, Mycobacterium
AAFGMLSVALILAAIALPAAV

SEQ ID NO: 348227 - protein, 17 aa, Mycobacterium
AAFGRAAARLERVTYRD

SEQ ID NO: 348228 - protein, 30 aa, Mycobacterium
AAFIAWGLITALFIEQGWLQGIFAGLKDPD

SEQ ID NO: 348229 - protein, 24 aa, Mycobacterium
AAFIGANFMLVPRLLVGAGDNGAS

SEQ ID NO: 348230 - protein, 18 aa, Mycobacterium
AAFILAIAPGWFGILAAI

SEQ ID NO: 348231 - protein, 40 aa, Mycobacterium
AAFKISPSAWWVCGSAIGITLLYLGYLRRQTRIEEKVRRR

SEQ ID NO: 348232 - protein, 27 aa, Mycobacterium
AAFLGANFMLLPRWLAGGGDHGAAVVV

SEQ ID NO: 348233 - protein, 28 aa, Mycobacterium
AAFLGANFMLLPRWLFGAGDAGASVVIF

SEQ ID NO: 348234 - protein, 26 aa, Mycobacterium
AAFLNRNLGWFFLFKQGNVSLAGGGT

SEQ ID NO: 348235 - protein, 31 aa, Mycobacterium
AAFLRSRGMKLRWFVVLVGVTLMAFGAVIPV

SEQ ID NO: 348236 - protein, 17 aa, Mycobacterium
AAFLWYRVNRKWRPLLV

SEQ ID NO: 348237 - protein, 32 aa, Mycobacterium
AAFMQDPRKEILPMRGLFTQTVALRLRSRDEV

SEQ ID NO: 348238 - protein, 31 aa, Mycobacterium
AAFPATLAWLRYRWLRRTPLPVQRPTVGRRL

SEQ ID NO: 348239 - protein, 18 aa, Mycobacterium
AAFPVWYATLFSALYLPL

SEQ ID NO: 348240 - protein, 23 aa, Mycobacterium
AAFRIPWHDQVFLSLAGLRGAVP

SEQ ID NO: 348241 - protein, 18 aa, Mycobacterium
AAFSKALVLVTVAMIVII

SEQ ID NO: 348242 - protein, 24 aa, Mycobacterium
AAFVAWVMHFAYMAPIAGLAAVAA

SEQ ID NO: 348243 - protein, 21 aa, Mycobacterium
AAFVLLAFSFSAVMIGTTMPT

SEQ ID NO: 348244 - protein, 27 aa, Mycobacterium
AAFVRKPIRWMRMLAERDQPFTAAPNF

SEQ ID NO: 348245 - protein, 24 aa, Mycobacterium
AAFVVSVLLGMGIGWGLYGNTRSP

SEQ ID NO: 348246 - protein, 20 aa, Mycobacterium
AAFWCALSLPPLLLGMLGSL

SEQ ID NO: 348247 - protein, 23 aa, Mycobacterium
AAFWVVLFHFRPLLEQAAPEFRT

SEQ ID NO: 348248 - protein, 25 aa, Mycobacterium
AAGAFALYRRDPADRWIAITAGVLA

SEQ ID NO: 348249 - protein, 24 aa, Mycobacterium
AAGAGLYYWWFHGADKSLPVFAVL

SEQ ID NO: 348250 - protein, 26 aa, Mycobacterium
AAGAIQLLAYLALAAKFAVALGAVVL

SEQ ID NO: 348251 - protein, 25 aa, Mycobacterium
AAGALYFFFVLPRWPELMGDTTHTL

SEQ ID NO: 348252 - protein, 24 aa, Mycobacterium
AAGAPKFWLVAILAVAIATGFLVE

SEQ ID NO: 348253 - protein, 26 aa, Mycobacterium
AAGASLSPLPALFIIVDEFSELLSQH

SEQ ID NO: 348254 - protein, 27 aa, Mycobacterium
AAGAVFIVAVVFFAGFLLGQNVDGGGR

SEQ ID NO: 348255 - protein, 29 aa, Mycobacterium
AAGAVVYAILVLLGRYIGYTLDLAGIAGL

SEQ ID NO: 348256 - protein, 27 aa, Mycobacterium
AAGDYLLAMPWWEPSFVLGLAAFLVAH

SEQ ID NO: 348257 - protein, 20 aa, Mycobacterium
AAGFAYPFMAFHVAGRGHTA

SEQ ID NO: 348258 - protein, 17 aa, Mycobacterium
AAGFPFYTAIKKLLLDQ

SEQ ID NO: 348259 - protein, 23 aa, Mycobacterium
AAGFVFSWLRRRSGSLIAPIALH

SEQ ID NO: 348260 - protein, 30 aa, Mycobacterium
AAGGLFAQWGLWRWAFGMLAVITAGIAAMV

SEQ ID NO: 348261 - protein, 24 aa, Mycobacterium
AAGGLLIALGFLLAGYEIGNTPDG

SEQ ID NO: 348262 - protein, 17 aa, Mycobacterium
AAGHITFVTVPTGITDE

SEQ ID NO: 348263 - protein, 24 aa, Mycobacterium
AAGIFDFSAAPLTMKPGETARRTL

SEQ ID NO: 348264 - protein, 18 aa, Mycobacterium
AAGIGCAQGFYLSRPKAH

SEQ ID NO: 348265 - protein, 28 aa, Mycobacterium
AAGINQFFYWISNPVWIGGTLCIVAVVT

SEQ ID NO: 348266 - protein, 27 aa, Mycobacterium
AAGITFFDYQPWLRRRLEDRIGGPATD

SEQ ID NO: 348267 - protein, 32 aa, Mycobacterium
AAGITYFTIFALFPLLMLGFSVAGFVLANQPE

SEQ ID NO: 348268 - protein, 27 aa, Mycobacterium
AAGITYFTIFALFPLLMVGFAVGGFVL

SEQ ID NO: 348269 - protein, 31 aa, Mycobacterium
AAGITYFTVFALFPLMMVAFAVMGFVLSRRP

SEQ ID NO: 348270 - protein, 24 aa, Mycobacterium
AAGIVWPVGRACASGCLLLALGAG

SEQ ID NO: 348271 - protein, 27 aa, Mycobacterium
AAGLAILVAVVLGLILSPGKSRPVNTT

SEQ ID NO: 348272 - protein, 32 aa, Mycobacterium
AAGLGLAVSGRALRWPRLPSSVLAGVVAFDYQ

SEQ ID NO: 348273 - protein, 18 aa, Mycobacterium
AAGLIFAASMCGLLFSSI

SEQ ID NO: 348274 - protein, 19 aa, Mycobacterium
AAGLIFAASMWGLVFSSIG

SEQ ID NO: 348275 - protein, 34 aa, Mycobacterium
AAGLLCLVSLPWVVRGCALLDAGLARTLLCGVSE

SEQ ID NO: 348276 - protein, 23 aa, Mycobacterium
AAGLLIGTWLGGYALLLPAAACA

SEQ ID NO: 348277 - protein, 38 aa, Mycobacterium
AAGLLLCVSFPPFGWWYTAIVAFALLAWVLTHKSTTQI

SEQ ID NO: 348278 - protein, 18 aa, Mycobacterium
AAGLLSGYLLARGVLGAD

SEQ ID NO: 348279 - protein, 17 aa, Mycobacterium
AAGLLYPPTRVAAAVCL

SEQ ID NO: 348280 - protein, 23 aa, Mycobacterium
AAGLNAYIPLLALGLLGRFTELV

SEQ ID NO: 348281 - protein, 25 aa, Mycobacterium
AAGLPWYAIICLPVLFAAGMCLLDT

SEQ ID NO: 348282 - protein, 25 aa, Mycobacterium
AAGLPWYAILCLPVLFTAGMCLLDT

SEQ ID NO: 348283 - protein, 30 aa, Mycobacterium
AAGLTYYTIFALFPLLMVGFAAFGFVLSRR

SEQ ID NO: 348284 - protein, 31 aa, Mycobacterium
AAGLTYYTIFALFPLLMVGFAVFGFVLARRP

SEQ ID NO: 348285 - protein, 28 aa, Mycobacterium
AAGLTYYTIFALFPLLMVGFAVVGFTLS

SEQ ID NO: 348286 - protein, 18 aa, Mycobacterium
AAGLVLAAALGTGVAVLM

SEQ ID NO: 348287 - protein, 25 aa, Mycobacterium
AAGMAFIFRPLLFTSVNSRVAEAKG

SEQ ID NO: 348288 - protein, 25 aa, Mycobacterium
AAGMLLWFLIALPIGAVTGGWIATR

SEQ ID NO: 348289 - protein, 24 aa, Mycobacterium
AAGMLLWFLIALPIGAVVGGWVAT

SEQ ID NO: 348290 - protein, 26 aa, Mycobacterium
AAGMRLTVLLALLANLFAPWGIAGDK

SEQ ID NO: 348291 - protein, 23 aa, Mycobacterium
AAGPGFWWALVVVLIGQVLIGVT

SEQ ID NO: 348292 - protein, 23 aa, Mycobacterium
AAGPGHFRHAPAGLGWALLGVVA

SEQ ID NO: 348293 - protein, 23 aa, Mycobacterium
AAGPLALGLFFLAAGSGSKVLVV

SEQ ID NO: 348294 - protein, 24 aa, Mycobacterium
AAGPPIFGALITTAAYPLAWGLCG

SEQ ID NO: 348295 - protein, 25 aa, Mycobacterium
AAGPPLFGALITTAAYPLAWALCGL

SEQ ID NO: 348296 - protein, 23 aa, Mycobacterium
AAGPPLFGGLIVAAGYPPAWALC

SEQ ID NO: 348297 - protein, 22 aa, Mycobacterium
AAGPPLLRWAPGIRGRTIVVWL

SEQ ID NO: 348298 - protein, 25 aa, Mycobacterium
AAGQYLELMIRQHRFTISAARDQLE

SEQ ID NO: 348299 - protein, 23 aa, Mycobacterium
AAGRLSWSLTMLAAVALIARGIF

SEQ ID NO: 348300 - protein, 25 aa, Mycobacterium
AAGRTWVLWVLLGTGQLLSHLLLTS

SEQ ID NO: 348301 - protein, 27 aa, Mycobacterium
AAGSIFAALLFWWTWHRLETKRRSDPV

SEQ ID NO: 348302 - protein, 23 aa, Mycobacterium
AAGSLLFGLWHIATSLGLTASNA

SEQ ID NO: 348303 - protein, 24 aa, Mycobacterium
AAGSWLPAILWGVAFAILVRGLPV

SEQ ID NO: 348304 - protein, 24 aa, Mycobacterium
AAGSWLPAVLWGVAFAILVHGLPV

SEQ ID NO: 348305 - protein, 25 aa, Mycobacterium
AAGTVYWLVLLLYHFVANSWCSYIC

SEQ ID NO: 348306 - protein, 28 aa, Mycobacterium
AAGVAILTAPLLLARTPALHGVGVAALG

SEQ ID NO: 348307 - protein, 22 aa, Mycobacterium
AAGVFFVWWELRTDHPALDLRI

SEQ ID NO: 348308 - protein, 22 aa, Mycobacterium
AAGVIAFLIAGLGGFMGVVHSA

SEQ ID NO: 348309 - protein, 22 aa, Mycobacterium
AAGVLAPIGFVLPMSVGAILMS

SEQ ID NO: 348310 - protein, 21 aa, Mycobacterium
AAGVLAPVGFILPMSVGAVLM

SEQ ID NO: 348311 - protein, 17 aa, Mycobacterium
AAGVLRPDLQRVYLEEE

SEQ ID NO: 348312 - protein, 23 aa, Mycobacterium
AAGVMLSALWVTSTSQLVMIVHH

SEQ ID NO: 348313 - protein, 29 aa, Mycobacterium
AAGVMTILFGLIARLPFALAAGLGINSFL

SEQ ID NO: 348314 - protein, 29 aa, Mycobacterium
AAGVMTILFGLVARLPFAFAAGLGINSFL

SEQ ID NO: 348315 - protein, 24 aa, Mycobacterium
AAGVSLFRWLDPASVAWLRICGAA

SEQ ID NO: 348316 - protein, 24 aa, Mycobacterium
AAGVVIGLPLLLIALTEWHQSLVR

SEQ ID NO: 348317 - protein, 21 aa, Mycobacterium
AAGWLYFINWAMTGVVDTTAI

SEQ ID NO: 348318 - protein, 24 aa, Mycobacterium
AAGYFLVTPLIVLVGTAVAMALPG

SEQ ID NO: 348319 - protein, 23 aa, Mycobacterium
AAGYLNLPAIILIGLCALLLIRG

SEQ ID NO: 348320 - protein, 19 aa, Mycobacterium
AAHAPYLAWLTQISADSAV

SEQ ID NO: 348321 - protein, 31 aa, Mycobacterium
AAHDLGLPAPVPAPWPILRTLPAGPELGREQ

SEQ ID NO: 348322 - protein, 25 aa, Mycobacterium
AAHFLFVPQLLLFMLSTGIAPEKTF

SEQ ID NO: 348323 - protein, 24 aa, Mycobacterium
AAHKVPVWSLLLMGAAALAVSVAE

SEQ ID NO: 348324 - protein, 23 aa, Mycobacterium
AAHPWAFLMRSLVGGVMVAFGAL

SEQ ID NO: 348325 - protein, 18 aa, Mycobacterium
AAHQPYVAWLMRNGAEAE

SEQ ID NO: 348326 - protein, 37 aa, Mycobacterium
AAHRRKMLLSGIALAAVLLIAIGYLTVGALRVSPFSG

SEQ ID NO: 348327 - protein, 19 aa, Mycobacterium
AAHTPYLAWLAQQSAVSAA

SEQ ID NO: 348328 - protein, 26 aa, Mycobacterium
AAHWEPWIWALIVAGFGFMTVFVFWQ

SEQ ID NO: 348329 - protein, 26 aa, Mycobacterium
AAHWEPWIWAMIVAGIGFMTVFVFWQ

SEQ ID NO: 348330 - protein, 32 aa, Mycobacterium
AAIAHPYIALSNWLLIHLLGLGAASNAILIWS

SEQ ID NO: 348331 - protein, 30 aa, Mycobacterium
AAIASFTLIFVIMLIITRSLIAACTIIGTV

SEQ ID NO: 348332 - protein, 26 aa, Mycobacterium
AAIDRWIPVFPLWVAVVLVLNQLAAE

SEQ ID NO: 348333 - protein, 25 aa, Mycobacterium
AAIEAIGLVVLWQLLARSQRELDEL

SEQ ID NO: 348334 - protein, 20 aa, Mycobacterium
AAIGILLLLTGRQQTWDRLS

SEQ ID NO: 348335 - protein, 24 aa, Mycobacterium
AAIGMWAPFLLVLLRMIQGFSTGG

SEQ ID NO: 348336 - protein, 59 aa, Mycobacterium
AAIKTAISAVWNWLSTTVFPGLKLAFTAIGTAATWLWNNAITPAWNGIKAVIGVAWEVV

SEQ ID NO: 348337 - protein, 25 aa, Mycobacterium
AAILACVWLMLNLTGLTWIRFLIWM

SEQ ID NO: 348338 - protein, 18 aa, Mycobacterium
AAILGLVTGYLMCAVLLA

SEQ ID NO: 348339 - protein, 22 aa, Mycobacterium
AAILMLYTIVIIRGLRTAIATR

SEQ ID NO: 348340 - protein, 17 aa, Mycobacterium
AAILRALQRVRRDLADA

SEQ ID NO: 348341 - protein, 20 aa, Mycobacterium
AAILVLLPAAGLTAAAVVPN

SEQ ID NO: 348342 - protein, 17 aa, Mycobacterium
AAILWNLSGDFNLFGVN

SEQ ID NO: 348343 - protein, 29 aa, Mycobacterium
AAIPLVAVVLFFVFGTVIAAALPAIIGGL

SEQ ID NO: 348344 - protein, 23 aa, Mycobacterium
AAIPVLIVGVVVWVGITNDRKER

SEQ ID NO: 348345 - protein, 25 aa, Mycobacterium
AAIRKPWQMYPVGLLFGLGFDTVTE

SEQ ID NO: 348346 - protein, 17 aa, Mycobacterium
AAIRRPADQRRCLDIGS

SEQ ID NO: 348347 - protein, 19 aa, Mycobacterium
AAISLAWGYWQPSSGMTGD

SEQ ID NO: 348348 - protein, 22 aa, Mycobacterium
AAITFTLLFLLTGSVVLPLKAL

SEQ ID NO: 348349 - protein, 24 aa, Mycobacterium
AAITLLFMAALDRIPLGTASALEF

SEQ ID NO: 348350 - protein, 20 aa, Mycobacterium
AAITRWPGPILAASMAIAII

SEQ ID NO: 348351 - protein, 28 aa, Mycobacterium
AAIVVGLLLLLIARPLSVVASLAAFRIP

SEQ ID NO: 348352 - protein, 29 aa, Mycobacterium
AAIVVGLLLLLVARPLSVVLSLSGFRIPW

SEQ ID NO: 348353 - protein, 29 aa, Mycobacterium
AAIYGMNFHFMPELNWTWGYPGVMAAMTL

SEQ ID NO: 348354 - protein, 20 aa, Mycobacterium
AAIYLYNFLGLTSLAESVPA

SEQ ID NO: 348355 - protein, 19 aa, Mycobacterium
AAKFLLPRLMGFSVDGSEA

SEQ ID NO: 348356 - protein, 23 aa, Mycobacterium
AAKGLFLLLMMTGARRRELNSLT

SEQ ID NO: 348357 - protein, 24 aa, Mycobacterium
AAKLLSRNLYIYGLGGIIAPFLGI

SEQ ID NO: 348358 - protein, 24 aa, Mycobacterium
AAKSPVMCAYWSKPAKAASSSVNL

SEQ ID NO: 348359 - protein, 21 aa, Mycobacterium
AAKTVFVFPGQGGQYPGMAAQ

SEQ ID NO: 348360 - protein, 21 aa, Mycobacterium
AALAAFWLGLVVAISFIEAPL

SEQ ID NO: 348361 - protein, 42 aa, Mycobacterium
AALAAIAAILSVAFLANTWWWRALSGWWTWAHTPNGPGGATP

SEQ ID NO: 348362 - protein, 48 aa, Mycobacterium
AALAAMLLFVVARRWVLALLAVALTVALMWVYVPRFLPGPSEQTDAVD

SEQ ID NO: 348363 - protein, 31 aa, Mycobacterium
AALAARKRIAWWVLVLYLVGAIGWNVGDLAA

SEQ ID NO: 348364 - protein, 19 aa, Mycobacterium
AALAASAMWLRRAERRPRF

SEQ ID NO: 348365 - protein, 24 aa, Mycobacterium
AALADTWWQLAILRFIAGVGSGVE

SEQ ID NO: 348366 - protein, 18 aa, Mycobacterium
AALAGLRLSRTVALGVCG

SEQ ID NO: 348367 - protein, 24 aa, Mycobacterium
AALAGVLLLAGLIVGWAGGPGPVT

SEQ ID NO: 348368 - protein, 27 aa, Mycobacterium
AALAGVPLLLGALWASGRFARRADKVA

SEQ ID NO: 348369 - protein, 19 aa, Mycobacterium
AALALTDWLSSPVSIALMV

SEQ ID NO: 348370 - protein, 17 aa, Mycobacterium
AALANYFRTGNLTALRE

SEQ ID NO: 348371 - protein, 27 aa, Mycobacterium
AALARTLRFGDGWLPFAELSTPADVAR

SEQ ID NO: 348372 - protein, 25 aa, Mycobacterium
AALAVRGWMLRLLAILVAAASAGMG

SEQ ID NO: 348373 - protein, 29 aa, Mycobacterium
AALAYAEAGWYLLPTHPADIKNPGSVVGG

SEQ ID NO: 348374 - protein, 26 aa, Mycobacterium
AALCFLILMLAMFPANIYAARMPSPP

SEQ ID NO: 348375 - protein, 22 aa, Mycobacterium
AALDIVLVKLFPALAPYAVVDD

SEQ ID NO: 348376 - protein, 26 aa, Mycobacterium
AALEAAALIALWRLLARARQENDELR

SEQ ID NO: 348377 - protein, 24 aa, Mycobacterium
AALEALARWTAPNGILIAPETFVA

SEQ ID NO: 348378 - protein, 32 aa, Mycobacterium
AALETFTVPLPRTLLARLFSRNPLVRASDRLE

SEQ ID NO: 348379 - protein, 31 aa, Mycobacterium
AALFRRVFLINGLIFALGTLILAVSPATVSP

SEQ ID NO: 348380 - protein, 20 aa, Mycobacterium
AALGAAIRYAAVDKDVVIVA

SEQ ID NO: 348381 - protein, 25 aa, Mycobacterium
AALGCLALAWWQWTRYESTSGSFQN

SEQ ID NO: 348382 - protein, 20 aa, Mycobacterium
AALGGWFYWDRVEARGEAAA

SEQ ID NO: 348383 - protein, 18 aa, Mycobacterium
AALGLLVTLLVHARDIET

SEQ ID NO: 348384 - protein, 25 aa, Mycobacterium
AALGLPLLFLIYLQESDAFSDLPKS

SEQ ID NO: 348385 - protein, 32 aa, Mycobacterium
AALGRALSLAWRRSLQLRVVTLTLGLSLAVIL

SEQ ID NO: 348386 - protein, 35 aa, Mycobacterium
AALGRVPEWSPAGQPLLLIPDAAAALFAARANPGI

SEQ ID NO: 348387 - protein, 24 aa, Mycobacterium
AALGSLLALILGVSRTTLAMARDH

SEQ ID NO: 348388 - protein, 22 aa, Mycobacterium
AALHHCVVALAALGWQAKIHRF

SEQ ID NO: 348389 - protein, 21 aa, Mycobacterium
AALIAGVLGVLLVAAIVVAAV

SEQ ID NO: 348390 - protein, 27 aa, Mycobacterium
AALIFSRYLWAFELTSALLITAAIGAM

SEQ ID NO: 348391 - protein, 27 aa, Mycobacterium
AALIFSRYLWAFELTSALLITAAVGAM

SEQ ID NO: 348392 - protein, 24 aa, Mycobacterium
AALIIQFLGTFGFFYVGLQYIQLM

SEQ ID NO: 348393 - protein, 23 aa, Mycobacterium
AALIPIISFWVAPVATRAAVERT

SEQ ID NO: 348394 - protein, 17 aa, Mycobacterium
AALIQRPSVLDPAVDPD

SEQ ID NO: 348395 - protein, 32 aa, Mycobacterium
AALLAIGVILDWPLWWVSACSVLALLIVEGVV

SEQ ID NO: 348396 - protein, 19 aa, Mycobacterium
AALLALATVLLAAPAGAEP

SEQ ID NO: 348397 - protein, 20 aa, Mycobacterium
AALLALLRPRVPLDGVPLVM

SEQ ID NO: 348398 - protein, 25 aa, Mycobacterium
AALLAQLPDRYPLKGIFHAAGVLDD

SEQ ID NO: 348399 - protein, 17 aa, Mycobacterium
AALLAVSGYMRLEHRDA

SEQ ID NO: 348400 - protein, 38 aa, Mycobacterium
AALLGFPLVLLVGLLVAYLYTVLMFAPVLIVLERLPLV

SEQ ID NO: 348401 - protein, 23 aa, Mycobacterium
AALLGLLTRRAVTRPLAALARAC

SEQ ID NO: 348402 - protein, 23 aa, Mycobacterium
AALLLALPVPLILAGLAVGILFL

SEQ ID NO: 348403 - protein, 33 aa, Mycobacterium
AALLLARPTGLPLPALLIPPMALSRLVLGVHYP

SEQ ID NO: 348404 - protein, 24 aa, Mycobacterium
AALLLLFIPGWLIGRALGLPTHSA

SEQ ID NO: 348405 - protein, 17 aa, Mycobacterium
AALLLPRGRSRGNGPND

SEQ ID NO: 348406 - protein, 20 aa, Mycobacterium
AALLLVLVTAPPAGAVEQPV

SEQ ID NO: 348407 - protein, 17 aa, Mycobacterium
AALLMTFGVISFPLLST

SEQ ID NO: 348408 - protein, 20 aa, Mycobacterium
AALLSITFLPACLGILGRHV

SEQ ID NO: 348409 - protein, 17 aa, Mycobacterium
AALLVLLGGVQRKPWAI

SEQ ID NO: 348410 - protein, 20 aa, Mycobacterium
AALLVVAFVAAVAAAARPTG

SEQ ID NO: 348411 - protein, 18 aa, Mycobacterium
AALLVVLVLARWGSRHRP

SEQ ID NO: 348412 - protein, 21 aa, Mycobacterium
AALLWLRHRIGRPGELFVLYV

SEQ ID NO: 348413 - protein, 25 aa, Mycobacterium
AALNSGWVPSPAYLADMMRAPGYAE

SEQ ID NO: 348414 - protein, 33 aa, Mycobacterium
AALNWQPLALLIDTLLRWPNLAVGLSQVALVAC

SEQ ID NO: 348415 - protein, 17 aa, Mycobacterium
AALPLLAYVLLVVLCRR

SEQ ID NO: 348416 - protein, 17 aa, Mycobacterium
AALPLLSVVVFGVVWQL

SEQ ID NO: 348417 - protein, 24 aa, Mycobacterium
AALPPLLGELAARPKRRVISDADA

SEQ ID NO: 348418 - protein, 23 aa, Mycobacterium
AALPVLVVILTEVQRLLRRRQSA

SEQ ID NO: 348419 - protein, 24 aa, Mycobacterium
AALPWLRIAIFGAPAILVSLAGNG

SEQ ID NO: 348420 - protein, 24 aa, Mycobacterium
AALPWLRIAILGVPAILVSLAGNG

SEQ ID NO: 348421 - protein, 26 aa, Mycobacterium
AALQIGHFFGHKFKPWGAIKAGKAVG

SEQ ID NO: 348422 - protein, 28 aa, Mycobacterium
AALQVKWLIPIFWIATLIAVGCLGPREL

SEQ ID NO: 348423 - protein, 28 aa, Mycobacterium
AALRHVMPQLLGIGPWQSLAIASPGLQR

SEQ ID NO: 348424 - protein, 24 aa, Mycobacterium
AALRIGSYRYLVLGLAAGLMLGAV

SEQ ID NO: 348425 - protein, 20 aa, Mycobacterium
AALRSPLTWGIVAGLVVGKF

SEQ ID NO: 348426 - protein, 20 aa, Mycobacterium
AALSAQYRRAYVSALVTYSP

SEQ ID NO: 348427 - protein, 20 aa, Mycobacterium
AALSLFAIPTHYGLAANPGS

SEQ ID NO: 348428 - protein, 27 aa, Mycobacterium
AALSLILLIMMFLTRSLVAALVIVGTV

SEQ ID NO: 348429 - protein, 26 aa, Mycobacterium
AALSLILLIMMIITRSLIAALVIVGT

SEQ ID NO: 348430 - protein, 27 aa, Mycobacterium
AALSNTCAMGMLLSKLPYNRGASCDAE

SEQ ID NO: 348431 - protein, 38 aa, Mycobacterium
AALSTLLILVSPWPVRLFWLLLLALALLIAVDIAAAAS

SEQ ID NO: 348432 - protein, 24 aa, Mycobacterium
AALSWITLPLIWDDPPISDAGIAI

SEQ ID NO: 348433 - protein, 26 aa, Mycobacterium
AALTALALHLGFIAPTRPPSPIACRL

SEQ ID NO: 348434 - protein, 24 aa, Mycobacterium
AALTLIFVVMVIITRALVASLVIV

SEQ ID NO: 348435 - protein, 21 aa, Mycobacterium
AALTPLMTPWLSKQLAVGPRL

SEQ ID NO: 348436 - protein, 18 aa, Mycobacterium
AALTWKVYVRRPVGYLPA

SEQ ID NO: 348437 - protein, 25 aa, Mycobacterium
AALVARVRPPLAWAVPAVLAVRVEP

SEQ ID NO: 348438 - protein, 29 aa, Mycobacterium
AALVIAGLAWYFFAPRRAHAASLSEGVQR

SEQ ID NO: 348439 - protein, 18 aa, Mycobacterium
AALVKDQAEWVTHGRLGI

SEQ ID NO: 348440 - protein, 21 aa, Mycobacterium
AALVLAIIVGRRRNFGKMAFR

SEQ ID NO: 348441 - protein, 22 aa, Mycobacterium
AALVLIALLKLPDTARWYMMRG

SEQ ID NO: 348442 - protein, 26 aa, Mycobacterium
AALVLKPLFFPSVSPTAGTLASFATY

SEQ ID NO: 348443 - protein, 20 aa, Mycobacterium
AALVLLLRLIRRESTQPAIS

SEQ ID NO: 348444 - protein, 17 aa, Mycobacterium
AALVPGWTRVRDALLGC

SEQ ID NO: 348445 - protein, 24 aa, Mycobacterium
AALVRSRFPALTGPQVRERLTGTA

SEQ ID NO: 348446 - protein, 37 aa, Mycobacterium
AALVVFAIGIALWLLRFAMSSSWLLALVQIGRPVFAT

SEQ ID NO: 348447 - protein, 26 aa, Mycobacterium
AALVYLYTVVLFAPVLIVLERLPVLD

SEQ ID NO: 348448 - protein, 36 aa, Mycobacterium
AAMALLVIGFVLGWPWWWISACSVLVLLIAEGVAVN

SEQ ID NO: 348449 - protein, 24 aa, Mycobacterium
AAMARPLDLWPKASVTAALVVLAA

SEQ ID NO: 348450 - protein, 31 aa, Mycobacterium
AAMAYPWHSTRDYWVLGIAAAVVLALFGCWR

SEQ ID NO: 348451 - protein, 20 aa, Mycobacterium
AAMGFFVLYLRRTLPETLHD

SEQ ID NO: 348452 - protein, 28 aa, Mycobacterium
AAMGVAWLLDVPALIRKRFDTVPGTRKD

SEQ ID NO: 348453 - protein, 23 aa, Mycobacterium
AAMIFSTSRLKPWDARHIRRGAL

SEQ ID NO: 348454 - protein, 23 aa, Mycobacterium
AAMLGGWLAVLAGAWFVVGGDVA

SEQ ID NO: 348455 - protein, 31 aa, Mycobacterium
AAMLLAAAWLALLALPLLFVAHRLPDSVGVP

SEQ ID NO: 348456 - protein, 24 aa, Mycobacterium
AAMMAGVAFVPLDPSWPAHRRRQV

SEQ ID NO: 348457 - protein, 21 aa, Mycobacterium
AAMVIVGIALPILGAVQLLGA

SEQ ID NO: 348458 - protein, 28 aa, Mycobacterium
AANARFDFFLRGIVTRFDYRDALLLDMQ

SEQ ID NO: 348459 - protein, 24 aa, Mycobacterium
AANARFNDYFREIATRFEYRDALL

SEQ ID NO: 348460 - protein, 23 aa, Mycobacterium
AANGLLVDSWMCAISGRAKQFGM

SEQ ID NO: 348461 - protein, 24 aa, Mycobacterium
AANRRRTWLVLRMDPQRNVAAVAS

SEQ ID NO: 348462 - protein, 33 aa, Mycobacterium
AANTSWFGVEAWRWMLLVGLVPAVVYAIIARRI

SEQ ID NO: 348463 - protein, 17 aa, Mycobacterium
AANVVDFRPLGKGDAAL

SEQ ID NO: 348464 - protein, 26 aa, Mycobacterium
AAPAGPPPPFAPPAPFAQPPFAPPPP

SEQ ID NO: 348465 - protein, 27 aa, Mycobacterium
AAPDKVEVLLFIDQAVSNVAIPDARMD

SEQ ID NO: 348466 - protein, 20 aa, Mycobacterium
AAPDPLFDDVFLAVSTFRTV

SEQ ID NO: 348467 - protein, 29 aa, Mycobacterium
AAPESLFNPILLLALTALGVGLISTLLVA

SEQ ID NO: 348468 - protein, 24 aa, Mycobacterium
AAPFGLLITVVLLVGTFALVWSMN

SEQ ID NO: 348469 - protein, 19 aa, Mycobacterium
AAPFLLMFTVGEVGAMASV

SEQ ID NO: 348470 - protein, 32 aa, Mycobacterium
AAPGFPDFGAPYLPIPQLAGMPTVPDLSAIVA

SEQ ID NO: 348471 - protein, 22 aa, Mycobacterium
AAPGRLLGKPAYHALTFGWLMS

SEQ ID NO: 348472 - protein, 23 aa, Mycobacterium
AAPGWLPNWLRPGASRPGLTAPA

SEQ ID NO: 348473 - protein, 26 aa, Mycobacterium
AAPHPPPPPVLPPPPAAPPPAPAPDK

SEQ ID NO: 348474 - protein, 18 aa, Mycobacterium
AAPILPTRLFGSPVFTVC

SEQ ID NO: 348475 - protein, 47 aa, Mycobacterium
AAPLAAIAALVYLGAALGWPTWWVSVCSILCLLIVQGVVVNVVLACR

SEQ ID NO: 348476 - protein, 31 aa, Mycobacterium
AAPLFYPTRFLIWNLFLAWLPVFAALAFSAV

SEQ ID NO: 348477 - protein, 18 aa, Mycobacterium
AAPLLQLGGMITPIPVLH

SEQ ID NO: 348478 - protein, 30 aa, Mycobacterium
AAPLWRAAQLFRLLSCVYALGFQIAVNSDL

SEQ ID NO: 348479 - protein, 20 aa, Mycobacterium
AAPNFAYELAAHRGLPPAGD

SEQ ID NO: 348480 - protein, 18 aa, Mycobacterium
AAPNIAPAPWILVPGGEA

SEQ ID NO: 348481 - protein, 18 aa, Mycobacterium
AAPPLVWLGTISYGVYLW

SEQ ID NO: 348482 - protein, 24 aa, Mycobacterium
AAPQFIFTPLAPWLAEQAGFGLVF

SEQ ID NO: 348483 - protein, 20 aa, Mycobacterium
AAPQLSPQLLPSLLATVRWR

SEQ ID NO: 348484 - protein, 21 aa, Mycobacterium
AAPQVLFNYLGRFGTADRPWA

SEQ ID NO: 348485 - protein, 29 aa, Mycobacterium
AAPSVPGLWELAWPPLSTAAAAAADRPHW

SEQ ID NO: 348486 - protein, 34 aa, Mycobacterium
AAPTERIRRPVPPSSLPLPPPSPPALRDNRGGRG

SEQ ID NO: 348487 - protein, 23 aa, Mycobacterium
AAPTHRWIKDLPDEPVWINGDHA

SEQ ID NO: 348488 - protein, 26 aa, Mycobacterium
AAPTQWDWAKWLPHMQHSRLRDGCGE

SEQ ID NO: 348489 - protein, 24 aa, Mycobacterium
AAPTQYLLVWISTLGTVDGKSKTD

SEQ ID NO: 348490 - protein, 33 aa, Mycobacterium
AAPVNYLKLMPATYVVLFFVVGYMLLTVTADLV

SEQ ID NO: 348491 - protein, 28 aa, Mycobacterium
AAPVNYLKLMPATYVVLVFVVGYMLLTV

SEQ ID NO: 348492 - protein, 27 aa, Mycobacterium
AAQAAAVQILILIALLLSQTCAVAVTI

SEQ ID NO: 348493 - protein, 25 aa, Mycobacterium
AAQAGDVITWWTGSQVLVLSASDLS

SEQ ID NO: 348494 - protein, 32 aa, Mycobacterium
AAQAPLWIGPFLVYILLPLLDLRFGPDGQNPP

SEQ ID NO: 348495 - protein, 25 aa, Mycobacterium
AAQARLFLVDFRRELLGLSESEYLG

SEQ ID NO: 348496 - protein, 27 aa, Mycobacterium
AAQATFLRWLWYAARREGLRLDGTEDD

SEQ ID NO: 348497 - protein, 26 aa, Mycobacterium
AAQDRTWFVFLLLPSFLVYVVSMVGE

SEQ ID NO: 348498 - protein, 26 aa, Mycobacterium
AAQDRVWYIFLLLPSFVIYLISMVGE

SEQ ID NO: 348499 - protein, 24 aa, Mycobacterium
AAQDTFLRWVWYAARREGLALDGA

SEQ ID NO: 348500 - protein, 27 aa, Mycobacterium
AAQEGRWYLFLLLPSFLVYVTAMVGET

SEQ ID NO: 348501 - protein, 24 aa, Mycobacterium
AAQEWLKSLMPFGGFPWGSVAFGQ

SEQ ID NO: 348502 - protein, 24 aa, Mycobacterium
AAQEWLKSLVPFGGFPWGSVAFGQ

SEQ ID NO: 348503 - protein, 20 aa, Mycobacterium
AAQGIWLSFRPKSESASTSP

SEQ ID NO: 348504 - protein, 24 aa, Mycobacterium
AAQGLRWWCIKTLGPQWNTRVIVV

SEQ ID NO: 348505 - protein, 18 aa, Mycobacterium
AAQIAFIGPLLGSLARIV

SEQ ID NO: 348506 - protein, 18 aa, Mycobacterium
AAQIAFVGPLLGSLARIY

SEQ ID NO: 348507 - protein, 26 aa, Mycobacterium
AAQNDVWFIFLLLPSFLVYLTSMVGE

SEQ ID NO: 348508 - protein, 25 aa, Mycobacterium
AAQRFWSTYLLVAGLVLIVGAAAIM

SEQ ID NO: 348509 - protein, 17 aa, Mycobacterium
AAQRLRAEKRLSYLLAQ

SEQ ID NO: 348510 - protein, 24 aa, Mycobacterium
AAQTALTPFPFLEILNLIVETIIG

SEQ ID NO: 348511 - protein, 25 aa, Mycobacterium
AAQTLQRWFGLAGLDPRLLHTLSFV

SEQ ID NO: 348512 - protein, 27 aa, Mycobacterium
AAQVGLSLFYWWFHTIDKTLPVFVVLV

SEQ ID NO: 348513 - protein, 32 aa, Mycobacterium
AAQVPFWIGPILLYVLLPLLDLKFGPDGQNPP

SEQ ID NO: 348514 - protein, 25 aa, Mycobacterium
AARAALPQIIPLLRSGPAGQTTGRA

SEQ ID NO: 348515 - protein, 22 aa, Mycobacterium
AARALVQLLLVGGALTLLFEPG

SEQ ID NO: 348516 - protein, 22 aa, Mycobacterium
AARARIYHRLAVGPAAEAVRLH

SEQ ID NO: 348517 - protein, 17 aa, Mycobacterium
AARASRLTGRPLSLYTL

SEQ ID NO: 348518 - protein, 26 aa, Mycobacterium
AARATFLRWIWYAARREGLHLNGADD

SEQ ID NO: 348519 - protein, 37 aa, Mycobacterium
AARAVLFSGLLSPPAPVALLRLVRELYRGGMNLYTLL

SEQ ID NO: 348520 - protein, 21 aa, Mycobacterium
AARAWHYHEPLLARHADQAPI

SEQ ID NO: 348521 - protein, 31 aa, Mycobacterium
AARAYVFIALPLLPLLVPWGILMLEPRGARL

SEQ ID NO: 348522 - protein, 17 aa, Mycobacterium
AARDFQFALPPGAAPES

SEQ ID NO: 348523 - protein, 19 aa, Mycobacterium
AARFPLPTIPAPGDATPSA

SEQ ID NO: 348524 - protein, 23 aa, Mycobacterium
AARGLAISLFLLAILFTGIEFDD

SEQ ID NO: 348525 - protein, 25 aa, Mycobacterium
AARGLPVSALWLDATMPALVVVGLA

SEQ ID NO: 348526 - protein, 29 aa, Mycobacterium
AARHYFTYRDVLGFVYAQAKFQLLGTENS

SEQ ID NO: 348527 - protein, 30 aa, Mycobacterium
AARHYFTYRDVLGFVYAQAKFQLLGVENSD

SEQ ID NO: 348528 - protein, 20 aa, Mycobacterium
AARIGMGWPLTVLAALATYA

SEQ ID NO: 348529 - protein, 19 aa, Mycobacterium
AARLFIFHRGNAAGYEGIS

SEQ ID NO: 348530 - protein, 19 aa, Mycobacterium
AARLLTWRASWMAATGVPF

SEQ ID NO: 348531 - protein, 24 aa, Mycobacterium
AARLPSWFPSWGFLSAVIAIGGMQ

SEQ ID NO: 348532 - protein, 18 aa, Mycobacterium
AARLRRIPVIRGVHSYLL

SEQ ID NO: 348533 - protein, 25 aa, Mycobacterium
AARLTRWFVWLLVAVACYTAAQSIL

SEQ ID NO: 348534 - protein, 22 aa, Mycobacterium
AARPLQPLLPVMAAIMGLTQGV

SEQ ID NO: 348535 - protein, 24 aa, Mycobacterium
AARPNLAFLPFGAGPHRCFGAAMG

SEQ ID NO: 348536 - protein, 21 aa, Mycobacterium
AARPPFWRGAPGLVAGWATTG

SEQ ID NO: 348537 - protein, 28 aa, Mycobacterium
AARPRTLLRSWMLIPALAAAGLLTGICS

SEQ ID NO: 348538 - protein, 25 aa, Mycobacterium
AARQYRVLAIAAWLAVLVCVDFVAL

SEQ ID NO: 348539 - protein, 27 aa, Mycobacterium
AARRFALSPIPLYLVAGLALGEGGLAP

SEQ ID NO: 348540 - protein, 29 aa, Mycobacterium
AARRGLSFTLTWWSFTFPVGTCVTGASAL

SEQ ID NO: 348541 - protein, 17 aa, Mycobacterium
AARRRGFVVPLCALALL

SEQ ID NO: 348542 - protein, 28 aa, Mycobacterium
AARRRRFLFVVMPLAPWVFGSAAVAYAV

SEQ ID NO: 348543 - protein, 21 aa, Mycobacterium
AARVLALSWTVGALVLAVLVV

SEQ ID NO: 348544 - protein, 28 aa, Mycobacterium
AARVLSVLLLFGVLVWLTALGAREYLGY

SEQ ID NO: 348545 - protein, 25 aa, Mycobacterium
AARVPFYIGVGVVTVLLAGVLGWLL

SEQ ID NO: 348546 - protein, 27 aa, Mycobacterium
AARWARRLAWASLLWMCAEGALGLWQG

SEQ ID NO: 348547 - protein, 23 aa, Mycobacterium
AASALCFLVGFAGLLWAPLTAPI

SEQ ID NO: 348548 - protein, 18 aa, Mycobacterium
AASALGYGLTLGAGYLGG

SEQ ID NO: 348549 - protein, 25 aa, Mycobacterium
AASALLPFLPMLPSQILLNNLLYDS

SEQ ID NO: 348550 - protein, 24 aa, Mycobacterium
AASARGLLRLLEDLRRNNGMTVVV

SEQ ID NO: 348551 - protein, 25 aa, Mycobacterium
AASEHRWLLNLPEDPVIVCGDTPRL

SEQ ID NO: 348552 - protein, 26 aa, Mycobacterium
AASELLYPLLPIYLTTVLGAPPSVVG

SEQ ID NO: 348553 - protein, 41 aa, Mycobacterium
AASFGMSVVVWQYIFGIPLYWVIFPLAVIILLAVGADYNLL

SEQ ID NO: 348554 - protein, 17 aa, Mycobacterium
AASGTIMQNWWLRGLGA

SEQ ID NO: 348555 - protein, 29 aa, Mycobacterium
AASHNPWTALLALFGIGLTGSAVGPALQT

SEQ ID NO: 348556 - protein, 17 aa, Mycobacterium
AASIMLLPLVIDLQRAP

SEQ ID NO: 348557 - protein, 36 aa, Mycobacterium
AASKLPMYLNVAVAVLGFLAYLASFGPMFTISSELG

SEQ ID NO: 348558 - protein, 23 aa, Mycobacterium
AASLAALLVAMFPANVYAASQRS

SEQ ID NO: 348559 - protein, 23 aa, Mycobacterium
AASLIFIIMLVITRSVVAAFTIV

SEQ ID NO: 348560 - protein, 17 aa, Mycobacterium
AASLLFVVVFRDQTLAT

SEQ ID NO: 348561 - protein, 20 aa, Mycobacterium
AASLLVVFVVLPLGRSAHIA

SEQ ID NO: 348562 - protein, 20 aa, Mycobacterium
AASLSRLAGLWGAAGGFSQL

SEQ ID NO: 348563 - protein, 21 aa, Mycobacterium
AASNLSCKYLKVSDLRPSERQ

SEQ ID NO: 348564 - protein, 26 aa, Mycobacterium
AASPDLDWRSVWDRGWSAAAQAQDKP

SEQ ID NO: 348565 - protein, 23 aa, Mycobacterium
AASPLLAFVFVVPALNLGGIPPF

SEQ ID NO: 348566 - protein, 27 aa, Mycobacterium
AASPTTLLLALLSVLLASSIVAALTFK

SEQ ID NO: 348567 - protein, 22 aa, Mycobacterium
AASRLPWVVIRSFDGLGPPREV

SEQ ID NO: 348568 - protein, 20 aa, Mycobacterium
AASRPLWLICTALGVVIVAI

SEQ ID NO: 348569 - protein, 18 aa, Mycobacterium
AASYFLATPLIVLTGSAI

SEQ ID NO: 348570 - protein, 19 aa, Mycobacterium
AASYSWYYAWTPGTGYLAN

SEQ ID NO: 348571 - protein, 23 aa, Mycobacterium
AASYSWYYAWTPGTGYLANLLPE

SEQ ID NO: 348572 - protein, 23 aa, Mycobacterium
AATAKLFLFDLATLDGIFRVAAF

SEQ ID NO: 348573 - protein, 23 aa, Mycobacterium
AATALGGFLLLTSGNRLSAMLGG

SEQ ID NO: 348574 - protein, 25 aa, Mycobacterium
AATALLVVGLMVLTIALAGPTHDVR

SEQ ID NO: 348575 - protein, 18 aa, Mycobacterium
AATAQRWGRYRIAARVEV

SEQ ID NO: 348576 - protein, 24 aa, Mycobacterium
AATATFLRWAWYAARRENLHLDDA

SEQ ID NO: 348577 - protein, 25 aa, Mycobacterium
AATAVLALLAIYFVGIDQGAVSLVG

SEQ ID NO: 348578 - protein, 27 aa, Mycobacterium
AATDAFWIFMVFYAGAAALTWKVYVRR

SEQ ID NO: 348579 - protein, 17 aa, Mycobacterium
AATFGLGSRYFRLLPRR

SEQ ID NO: 348580 - protein, 24 aa, Mycobacterium
AATGTPVMNLWLRALGASIGRGVW

SEQ ID NO: 348581 - protein, 37 aa, Mycobacterium
AATIFFLTSFLIALVPLFWVLSIVVARGWYAVTRSGW

SEQ ID NO: 348582 - protein, 27 aa, Mycobacterium
AATIGIFQAIILYCVVRFALGMHAAHP

SEQ ID NO: 348583 - protein, 24 aa, Mycobacterium
AATLIFVIMLVITRSVVAAVVIVG

SEQ ID NO: 348584 - protein, 22 aa, Mycobacterium
AATLLALSGFGALVADARPGDT

SEQ ID NO: 348585 - protein, 17 aa, Mycobacterium
AATLLLPAAIGSLVYAL

SEQ ID NO: 348586 - protein, 22 aa, Mycobacterium
AATLLLVACGLLASGIAVTTIM

SEQ ID NO: 348587 - protein, 19 aa, Mycobacterium
AATLQLLFSIGVDGFFAIS

SEQ ID NO: 348588 - protein, 24 aa, Mycobacterium
AATLVFVGGVVALALALAVDIRPH

SEQ ID NO: 348589 - protein, 29 aa, Mycobacterium
AATPARQPPLPPPPTLAPIDLPAASAIGP

SEQ ID NO: 348590 - protein, 27 aa, Mycobacterium
AATQAAPAPMPWYPTAPAPARPRRQVS

SEQ ID NO: 348591 - protein, 20 aa, Mycobacterium
AATRLLLMTQIKPGSVVLFH

SEQ ID NO: 348592 - protein, 22 aa, Mycobacterium
AATRMFFAVPGQRIAVVVLVGV

SEQ ID NO: 348593 - protein, 26 aa, Mycobacterium
AATTLLLMLMAGVALFWIVTLVVTAA

SEQ ID NO: 348594 - protein, 25 aa, Mycobacterium
AATVLFALTGRRLWHRFRGQPDRAD

SEQ ID NO: 348595 - protein, 20 aa, Mycobacterium
AATVRWPGAILVAAVTMALV

SEQ ID NO: 348596 - protein, 33 aa, Mycobacterium
AATVTIALLLFAPLLRYIPQAALAGLLLVTAVR

SEQ ID NO: 348597 - protein, 40 aa, Mycobacterium
AATVWLSLITFTLLYGALGVVWFWLIRRYTIEGPLEHDAE

SEQ ID NO: 348598 - protein, 25 aa, Mycobacterium
AATWYTLLFAYSAFTVALMALLLAG

SEQ ID NO: 348599 - protein, 22 aa, Mycobacterium
AATYIVLFTIYGAVLELSGGAR

SEQ ID NO: 348600 - protein, 27 aa, Mycobacterium
AAVAAIAVVAVAGWWFLRSDEDTITVT

SEQ ID NO: 348601 - protein, 26 aa, Mycobacterium
AAVAAKRGWPILRFTSRSGSSPMAQL

SEQ ID NO: 348602 - protein, 30 aa, Mycobacterium
AAVAALILIFLIMVLLTRAVVAAAVIVGTV

SEQ ID NO: 348603 - protein, 21 aa, Mycobacterium
AAVAALLWKFAGNDKARLRGK

SEQ ID NO: 348604 - protein, 19 aa, Mycobacterium
AAVAGFLVMSAPAAPAAPG

SEQ ID NO: 348605 - protein, 17 aa, Mycobacterium
AAVAGVPGVLVYRGANT

SEQ ID NO: 348606 - protein, 28 aa, Mycobacterium
AAVALALVFLIVLVMLRSPVAATAVIGT

SEQ ID NO: 348607 - protein, 25 aa, Mycobacterium
AAVALGVLLLLRDFAHALADNVTSL

SEQ ID NO: 348608 - protein, 29 aa, Mycobacterium
AAVASLILIFLIMVVLTRAIVAAAVIVGT

SEQ ID NO: 348609 - protein, 18 aa, Mycobacterium
AAVATLFPLDIQAFGACL

SEQ ID NO: 348610 - protein, 24 aa, Mycobacterium
AAVAVQFFYLLIAGLFDSPGIASL

SEQ ID NO: 348611 - protein, 17 aa, Mycobacterium
AAVAVVCLLFDSGIITP

SEQ ID NO: 348612 - protein, 28 aa, Mycobacterium
AAVAVVGVLLFVGSAAFAGATLQPYLAD

SEQ ID NO: 348613 - protein, 25 aa, Mycobacterium
AAVAWLLRFISNHSMYWFVGYRVIL

SEQ ID NO: 348614 - protein, 19 aa, Mycobacterium
AAVDAIRLSRRTLATIKTN

SEQ ID NO: 348615 - protein, 27 aa, Mycobacterium
AAVFALGSAGLYWLGTRWSKGTVVAAE

SEQ ID NO: 348616 - protein, 30 aa, Mycobacterium
AAVGFCMGGGLVWRLLAAGTPQLAAAVPFY

SEQ ID NO: 348617 - protein, 35 aa, Mycobacterium
AAVGFGFLAKMLQAFLVLPAFCAAALLAGDRPLRA

SEQ ID NO: 348618 - protein, 27 aa, Mycobacterium
AAVGFVGLLFLGVWLLIWYMRNQVRDR

SEQ ID NO: 348619 - protein, 24 aa, Mycobacterium
AAVGFVLALFLKEVPLRGADTSLA

SEQ ID NO: 348620 - protein, 37 aa, Mycobacterium
AAVGGFMLLVKKIWWPLAVWLLLVVMNVNAGTPLGGP

SEQ ID NO: 348621 - protein, 22 aa, Mycobacterium
AAVGLLLFWVYVVEIAVGYLPS

SEQ ID NO: 348622 - protein, 25 aa, Mycobacterium
AAVGPSPWWLFTGALVVAALWQLTP

SEQ ID NO: 348623 - protein, 20 aa, Mycobacterium
AAVHIAIGFLLKVGSTGVVF

SEQ ID NO: 348624 - protein, 17 aa, Mycobacterium
AAVHRYAFAPFGGGVHK

SEQ ID NO: 348625 - protein, 20 aa, Mycobacterium
AAVIATGAWLSRLVKAWVPT

SEQ ID NO: 348626 - protein, 19 aa, Mycobacterium
AAVIFFLAPFQILTGAAQS

SEQ ID NO: 348627 - protein, 24 aa, Mycobacterium
AAVIIGVSAYWLGTRRRRTGDGPK

SEQ ID NO: 348628 - protein, 19 aa, Mycobacterium
AAVILLWVYAAESAAGYLP

SEQ ID NO: 348629 - protein, 27 aa, Mycobacterium
AAVILVLKPLLTALFLRAGGAGGLLTP

SEQ ID NO: 348630 - protein, 25 aa, Mycobacterium
AAVILVLKPLLTALFLRVGGAGGML

SEQ ID NO: 348631 - protein, 19 aa, Mycobacterium
AAVIPFVAFAVAALWCHVG

SEQ ID NO: 348632 - protein, 19 aa, Mycobacterium
AAVIPLTGWLANRLGTKRL

SEQ ID NO: 348633 - protein, 21 aa, Mycobacterium
AAVIVLAAVIISRTSTPKASQ

SEQ ID NO: 348634 - protein, 17 aa, Mycobacterium
AAVIVLQVLVVQLDVLQ

SEQ ID NO: 348635 - protein, 20 aa, Mycobacterium
AAVLAALVWTVFRDPIDDLV

SEQ ID NO: 348636 - protein, 19 aa, Mycobacterium
AAVLAAVVCVLTLTIAGPV

SEQ ID NO: 348637 - protein, 28 aa, Mycobacterium
AAVLAGTAALGWLWKEQRDTEIAGRQAL

SEQ ID NO: 348638 - protein, 33 aa, Mycobacterium
AAVLFAPLTGLPLPALLIPPMALSRLVLGVHYP

SEQ ID NO: 348639 - protein, 22 aa, Mycobacterium
AAVLFFLMGCFTIVGTRQIAIV

SEQ ID NO: 348640 - protein, 20 aa, Mycobacterium
AAVLFLGFGFFMLLENIWHA

SEQ ID NO: 348641 - protein, 17 aa, Mycobacterium
AAVLIWQWREHRGPAMV

SEQ ID NO: 348642 - protein, 35 aa, Mycobacterium
AAVLIWRRASDWWLLLGLFVLFPMTFFGANFGLGY

SEQ ID NO: 348643 - protein, 25 aa, Mycobacterium
AAVLLIGLARWYFAKSHPAGESQPA

SEQ ID NO: 348644 - protein, 17 aa, Mycobacterium
AAVLLIWRRASDGFAFL

SEQ ID NO: 348645 - protein, 20 aa, Mycobacterium
AAVLLVWRRVSDGWAFLCIA

SEQ ID NO: 348646 - protein, 33 aa, Mycobacterium
AAVLNMVSVGAFIFAPMLSIYASMKAAMMSFTR

SEQ ID NO: 348647 - protein, 22 aa, Mycobacterium
AAVLRFLRRVPRDTVVLLDEAY

SEQ ID NO: 348648 - protein, 31 aa, Mycobacterium
AAVLRRTHILAAIVLGLILPKRRGRYLSADP

SEQ ID NO: 348649 - protein, 18 aa, Mycobacterium
AAVLSLVLLVLAVLLVTA

SEQ ID NO: 348650 - protein, 24 aa, Mycobacterium
AAVLTHGFGLWSTSEPGPVVKAQQ

SEQ ID NO: 348651 - protein, 40 aa, Mycobacterium
AAVLVGIPLLLLVGLLLAYLYTMLVFAPVLIVLERLPLVD

SEQ ID NO: 348652 - protein, 24 aa, Mycobacterium
AAVLVLAFFVSLIALPVAGAVGTA

SEQ ID NO: 348653 - protein, 37 aa, Mycobacterium
AAVLVPACILIFAQLNLLWLGITLAVLIALCALVTIR

SEQ ID NO: 348654 - protein, 30 aa, Mycobacterium
AAVMILLTVFLFFIFGQYRTGSTNGYSALF

SEQ ID NO: 348655 - protein, 25 aa, Mycobacterium
AAVPFAIWLFLAIEGVPLAAEEARE

SEQ ID NO: 348656 - protein, 21 aa, Mycobacterium
AAVPFVLFVPPAMKLHHSVCT

SEQ ID NO: 348657 - protein, 18 aa, Mycobacterium
AAVPLLPVSAGAGAAAAA

SEQ ID NO: 348658 - protein, 34 aa, Mycobacterium
AAVPLVSFAILAACGLPYLLDRTATPISTEAPIT

SEQ ID NO: 348659 - protein, 18 aa, Mycobacterium
AAVPVRWLALGMMALITA

SEQ ID NO: 348660 - protein, 19 aa, Mycobacterium
AAVRPWVPGPLAAVAVLAA

SEQ ID NO: 348661 - protein, 19 aa, Mycobacterium
AAVRQLPPALPAAPPPPPQ

SEQ ID NO: 348662 - protein, 30 aa, Mycobacterium
AAVRVLFQWRWSIATLWLTAVFLLIMVRFW

SEQ ID NO: 348663 - protein, 26 aa, Mycobacterium
AAVRYVLADRPLLLALLAVTTVGIVS

SEQ ID NO: 348664 - protein, 31 aa, Mycobacterium
AAVSARKYAFRKRMLMAMALVLVGSAVAAFE

SEQ ID NO: 348665 - protein, 26 aa, Mycobacterium
AAVSLILIIMLIITRSLVAAVVIVGT

SEQ ID NO: 348666 - protein, 27 aa, Mycobacterium
AAVSLLPAILVLIGRRGWIKPRRDLTH

SEQ ID NO: 348667 - protein, 25 aa, Mycobacterium
AAVSSWLVIVPLTFGTALVLGAIVA

SEQ ID NO: 348668 - protein, 17 aa, Mycobacterium
AAVSWWLLEQPIRRWRP

SEQ ID NO: 348669 - protein, 29 aa, Mycobacterium
AAVTALALLLAWLALYLRVSAPVNRQLTA

SEQ ID NO: 348670 - protein, 31 aa, Mycobacterium
AAVTAVLAAWGWFALLLQITGAIAVVQVIPA

SEQ ID NO: 348671 - protein, 21 aa, Mycobacterium
AAVTIVWMWDRTETALWVGAA

SEQ ID NO: 348672 - protein, 26 aa, Mycobacterium
AAVTLIFVIMLVITRSVVAAAVIVGT

SEQ ID NO: 348673 - protein, 23 aa, Mycobacterium
AAVVAAWLAVLVAASLPAGPRPW

SEQ ID NO: 348674 - protein, 30 aa, Mycobacterium
AAVVFYPLHLLPFGLLALLWQLATMAALYG

SEQ ID NO: 348675 - protein, 19 aa, Mycobacterium
AAVVGFVMAFQATREANRN

SEQ ID NO: 348676 - protein, 20 aa, Mycobacterium
AAVVLLLTLATRGGPRKRAE

SEQ ID NO: 348677 - protein, 19 aa, Mycobacterium
AAVVLLSHVPVIVARKTVA

SEQ ID NO: 348678 - protein, 29 aa, Mycobacterium
AAWRHVDVFQFFYLVLPLFCGAFEGAGLF

SEQ ID NO: 348679 - protein, 24 aa, Mycobacterium
AAWSFFRLVWLLYVSMTFGWFMGA

SEQ ID NO: 348680 - protein, 21 aa, Mycobacterium
AAWVTTAVLIVALLVSGVSSA

SEQ ID NO: 348681 - protein, 19 aa, Mycobacterium
AAWYYPRPSPLARRIKNHV

SEQ ID NO: 348682 - protein, 25 aa, Mycobacterium
AAYLAIFSLPLAQQKFFLDPSNLVV

SEQ ID NO: 348683 - protein, 18 aa, Mycobacterium
AAYLLVIVLEPLADLAVL

SEQ ID NO: 348684 - protein, 27 aa, Mycobacterium
AAYPHTFSLSFQTPINMTPACLTGFLP

SEQ ID NO: 348685 - protein, 18 aa, Mycobacterium
AAYRLIELALRGGGPDNV

SEQ ID NO: 348686 - protein, 17 aa, Mycobacterium
AAYSFMRFCGAAVAPWL

SEQ ID NO: 348687 - protein, 20 aa, Mycobacterium
AAYTLTMVITRFGAPRLHAR

SEQ ID NO: 348688 - protein, 21 aa, Mycobacterium
AAYVIPDRWPAEDAAFITGLR

SEQ ID NO: 348689 - protein, 21 aa, Mycobacterium
AAYVLITFWQYRNACATAPGL

SEQ ID NO: 348690 - protein, 27 aa, Mycobacterium
ACAFAETYWQLLLFRSLGGVGSAMFTV

SEQ ID NO: 348691 - protein, 27 aa, Mycobacterium
ACAFAQTYWQLLLFRSLGGIGSTMFFV

SEQ ID NO: 348692 - protein, 18 aa, Mycobacterium
ACALALIGLLALPGYKTS

SEQ ID NO: 348693 - protein, 25 aa, Mycobacterium
ACATKWSGLYFVLFFGVMTLVFDAI

SEQ ID NO: 348694 - protein, 20 aa, Mycobacterium
ACAVAYLRGFGRRPSWVLAE

SEQ ID NO: 348695 - protein, 17 aa, Mycobacterium
ACAVWLVVWGGSRMPRR

SEQ ID NO: 348696 - protein, 24 aa, Mycobacterium
ACGATAFVLLAWATARYGQIRQPA

SEQ ID NO: 348697 - protein, 34 aa, Mycobacterium
ACGLLGLGAALLIAALLLTTYTKGKIAKIPLDID

SEQ ID NO: 348698 - protein, 19 aa, Mycobacterium
ACGTKWSGLYFIAFFGVLC

SEQ ID NO: 348699 - protein, 55 aa, Mycobacterium
ACGVAVIWWLAHRPNRTWWRFTAWWIPCLALASTWWIVALLIFGKISPKFLDFIE

SEQ ID NO: 348700 - protein, 33 aa, Mycobacterium
ACGWLMLNLAVRTWLFALSWMVIGVIVYFAYSR

SEQ ID NO: 348701 - protein, 17 aa, Mycobacterium
ACHALLTALPQRLGDYQ

SEQ ID NO: 348702 - protein, 31 aa, Mycobacterium
ACIAICMHFDLLWLGITLGALIALFSVLTIR

SEQ ID NO: 348703 - protein, 19 aa, Mycobacterium
ACIWYFRRELFTDAHNIVF

SEQ ID NO: 348704 - protein, 30 aa, Mycobacterium
ACLKFTRLPYFSSLAFPCAVGLLVVVAAGV

SEQ ID NO: 348705 - protein, 24 aa, Mycobacterium
ACPVWFYELWAFITPGLYQKERRF

SEQ ID NO: 348706 - protein, 24 aa, Mycobacterium
ACPVWLYQLWAFITPGLYKKERRF

SEQ ID NO: 348707 - protein, 23 aa, Mycobacterium
ACQGFGWVYVRHFLRHTGYSPLV

SEQ ID NO: 348708 - protein, 17 aa, Mycobacterium
ACVLSFHNVIARYQFAL

SEQ ID NO: 348709 - protein, 18 aa, Mycobacterium
ACVMVFVAVWFALRDTQR

SEQ ID NO: 348710 - protein, 29 aa, Mycobacterium
ACVPAAIMLWLLLRLPESPRWLVKQGDRN

SEQ ID NO: 348711 - protein, 17 aa, Mycobacterium
ACYAAMEQGLAYAPEAV

SEQ ID NO: 348712 - protein, 25 aa, Mycobacterium
ACYGLLGAVFAFFVCYVTYSYVMVC

SEQ ID NO: 348713 - protein, 26 aa, Mycobacterium
ADAATLGFPIRLPKLPAGWQANSGGR

SEQ ID NO: 348714 - protein, 29 aa, Mycobacterium
ADAATLGFPIRLPVLPAGWQPNSGGRGGI

SEQ ID NO: 348715 - protein, 29 aa, Mycobacterium
ADAEPAVLRLPFVFSGVTLYATAATRLQV

SEQ ID NO: 348716 - protein, 37 aa, Mycobacterium
ADAISAYFVPVVIAIAIATFAVWFVAGPTPELTQALV

SEQ ID NO: 348717 - protein, 29 aa, Mycobacterium
ADALAQWAWRLPFLLGGLLGVVGLYLRRS

SEQ ID NO: 348718 - protein, 33 aa, Mycobacterium
ADALDRHLRLPLRQVLWGLDEALLESTEFAQPA

SEQ ID NO: 348719 - protein, 25 aa, Mycobacterium
ADAPENLLMRLVWSTPGAGLHRAAP

SEQ ID NO: 348720 - protein, 26 aa, Mycobacterium
ADAPTPPPRWWFTIGGATQLGESLAQ

SEQ ID NO: 348721 - protein, 26 aa, Mycobacterium
ADARAVLREVLVKELQPIMDRSIRAL

SEQ ID NO: 348722 - protein, 25 aa, Mycobacterium
ADATFLDIMWPLLLAASGIGLCTAP

SEQ ID NO: 348723 - protein, 42 aa, Mycobacterium
ADATLVRMFLVPAFIHLLGPWSWWAPKPLAWLHDRLTTGEAA

SEQ ID NO: 348724 - protein, 24 aa, Mycobacterium
ADAVFLLSRFLVALPIGAVIGGWL

SEQ ID NO: 348725 - protein, 23 aa, Mycobacterium
ADAWLGLCQTYGWAPGVMGASTQ

SEQ ID NO: 348726 - protein, 29 aa, Mycobacterium
ADDEHGAPRWPWVVGVAAILAAIALVVSV

SEQ ID NO: 348727 - protein, 17 aa, Mycobacterium
ADDFAYLVDFGIASATT

SEQ ID NO: 348728 - protein, 25 aa, Mycobacterium
ADDSVPPLPAFKPSANLGANCQYPA

SEQ ID NO: 348729 - protein, 17 aa, Mycobacterium
ADDTWPVLPVHPRNPEK

SEQ ID NO: 348730 - protein, 21 aa, Mycobacterium
ADEMIVAVRQLKIGQPSPVEV

SEQ ID NO: 348731 - protein, 23 aa, Mycobacterium
ADEQLWPVAPLDTQSGVNSSAAA

SEQ ID NO: 348732 - protein, 29 aa, Mycobacterium
ADFDDFFRPIRNYFYWEPHCFNIPICWAL

SEQ ID NO: 348733 - protein, 27 aa, Mycobacterium
ADFDDFFRPIRSYFYWEKHCFDIPVCW

SEQ ID NO: 348734 - protein, 24 aa, Mycobacterium
ADFDDFFRPMRNYLYWEPHCYDIP

SEQ ID NO: 348735 - protein, 28 aa, Mycobacterium
ADFDDFFRPVRNYFYWEPHCYDIPVCWT

SEQ ID NO: 348736 - protein, 28 aa, Mycobacterium
ADFEDFFRPIRSYFYWDKHCYDIPVCWS

SEQ ID NO: 348737 - protein, 28 aa, Mycobacterium
ADFEDFFRPIRSYFYWEKHCYDIPICFS

SEQ ID NO: 348738 - protein, 40 aa, Mycobacterium
ADFEDFFRPIRSYLYWERHCYDIPVCWSLRSVFDGLDGID

SEQ ID NO: 348739 - protein, 27 aa, Mycobacterium
ADFEDFFRPMRSYFYWEKHCYDIPACW

SEQ ID NO: 348740 - protein, 25 aa, Mycobacterium
ADGFAQVFPEHKYRIVRLLQGRGHI

SEQ ID NO: 348741 - protein, 29 aa, Mycobacterium
ADGFIKLIKMLIAPIIFCTVVLGIAHVGD

SEQ ID NO: 348742 - protein, 24 aa, Mycobacterium
ADGGFGIHPVLLDAALHAIGAAGE

SEQ ID NO: 348743 - protein, 25 aa, Mycobacterium
ADGIVFLIVSVLLLVGVRPALKRRM

SEQ ID NO: 348744 - protein, 22 aa, Mycobacterium
ADGPYRLQLRRSLSTAAFAIVI

SEQ ID NO: 348745 - protein, 20 aa, Mycobacterium
ADGQLPPFVAPADLGANCQY

SEQ ID NO: 348746 - protein, 22 aa, Mycobacterium
ADGQLWIAMDYVDGTDAARLVR

SEQ ID NO: 348747 - protein, 20 aa, Mycobacterium
ADGTLLAWLTAAAVAIAMLT

SEQ ID NO: 348748 - protein, 21 aa, Mycobacterium
ADGTPMRRASVLRLFEHRAAE

SEQ ID NO: 348749 - protein, 31 aa, Mycobacterium
ADGVVFLVVSVLLLVLVRPALRRRITPGKGL

SEQ ID NO: 348750 - protein, 27 aa, Mycobacterium
ADHETDWLAIVLTAIAGAALGLALGRT

SEQ ID NO: 348751 - protein, 20 aa, Mycobacterium
ADHGWICVSIDYRVSPRNTW

SEQ ID NO: 348752 - protein, 20 aa, Mycobacterium
ADHVAQWRLQVSVAGWRHRD

SEQ ID NO: 348753 - protein, 23 aa, Mycobacterium
ADIDRQMYFFYAATMAPFLVMAI

SEQ ID NO: 348754 - protein, 24 aa, Mycobacterium
ADIDRQMYFFYAATMAPFLVMAIA

SEQ ID NO: 348755 - protein, 24 aa, Mycobacterium
ADIDRQMYFFYAATMAPFLVMGLA

SEQ ID NO: 348756 - protein, 24 aa, Mycobacterium
ADIDRQMYFFYASTMAPFLVLMIA

SEQ ID NO: 348757 - protein, 29 aa, Mycobacterium
ADINNLHRRVLIICTLAIGAATLGGWVLA

SEQ ID NO: 348758 - protein, 29 aa, Mycobacterium
ADIYALACLVYESLIGRPPYEAGDLRQLM

SEQ ID NO: 348759 - protein, 23 aa, Mycobacterium
ADKDAWMVGYTPSLSTAVWVGTA

SEQ ID NO: 348760 - protein, 24 aa, Mycobacterium
ADKLALAVMVLLTIAAIAAVAGLA

SEQ ID NO: 348761 - protein, 25 aa, Mycobacterium
ADKLTKPVWLLILAGAVALTSILGF

SEQ ID NO: 348762 - protein, 26 aa, Mycobacterium
ADKPVPPVTLLPRRKPGSSGITDIPA

SEQ ID NO: 348763 - protein, 26 aa, Mycobacterium
ADLAFLPRLVVLIVVALVITGAVYGV

SEQ ID NO: 348764 - protein, 27 aa, Mycobacterium
ADLASLYPFQVFLDLYGLPLEDRDRLI

SEQ ID NO: 348765 - protein, 32 aa, Mycobacterium
ADLATIDPFGLLFGNPFRESLRIYGVRTNEGR

SEQ ID NO: 348766 - protein, 22 aa, Mycobacterium
ADLELPQLWQLTRGAGQRVAVI

SEQ ID NO: 348767 - protein, 26 aa, Mycobacterium
ADLEPAAWWRQLSWLPQRPVLVPGTV

SEQ ID NO: 348768 - protein, 22 aa, Mycobacterium
ADLLKRDWATGRTIDLPIVEPE

SEQ ID NO: 348769 - protein, 20 aa, Mycobacterium
ADLLVVGYLGTGTLRGRHLG

SEQ ID NO: 348770 - protein, 17 aa, Mycobacterium
ADLMERRLDRDHPLWEC

SEQ ID NO: 348771 - protein, 22 aa, Mycobacterium
ADLRHWLVDYLVTNIGCTPDEV

SEQ ID NO: 348772 - protein, 30 aa, Mycobacterium; identical to SEQ ID NO: 20265

SEQ ID NO: 348773 - protein, 23 aa, Mycobacterium
ADLTPLRYSPTVSVAPFDPAVGA

SEQ ID NO: 348774 - protein, 24 aa, Mycobacterium
ADNDAVLVTTLLSLGFCLGMTGSF

SEQ ID NO: 348775 - protein, 23 aa, Mycobacterium
ADNGMFAAFKPRDPEAVRASISS

SEQ ID NO: 348776 - protein, 29 aa, Mycobacterium
ADNPLQVALTLLWPAAIAALVYAVLAAAD

SEQ ID NO: 348777 - protein, 25 aa, Mycobacterium
ADNPLRALWVVAVVLGAGVGAMWWS

SEQ ID NO: 348778 - protein, 35 aa, Mycobacterium
ADPAFGVIWLLWAVLWFMLFLLLGLGHDALGPAVG

SEQ ID NO: 348779 - protein, 42 aa, Mycobacterium
ADPGRVGVLALATLGVLAVLITVFVVLRDRPAPVMSANLPPV

SEQ ID NO: 348780 - protein, 19 aa, Mycobacterium
ADPLLLPVVALLNGLGLVM

SEQ ID NO: 348781 - protein, 29 aa, Mycobacterium
ADPNLDAIFEPAFAPMPFAGVTAAHPDLD

SEQ ID NO: 348782 - protein, 23 aa, Mycobacterium
ADPPFRIPGYVTDRAGALKNPAK

SEQ ID NO: 348783 - protein, 23 aa, Mycobacterium
ADPPTQLVPLAVSGFLSSRKKAT

SEQ ID NO: 348784 - protein, 26 aa, Mycobacterium
ADPRPMLAMHRISAFVLARGLITVRL

SEQ ID NO: 348785 - protein, 25 aa, Mycobacterium
ADPVFLDWLVGLAFPCQRPFGHQNG

SEQ ID NO: 348786 - protein, 17 aa, Mycobacterium
ADPYPTVEFTRAGFRYP

SEQ ID NO: 348787 - protein, 22 aa, Mycobacterium
ADQEPRTWRLSVSLVREDGQIK

SEQ ID NO: 348788 - protein, 27 aa, Mycobacterium
ADQPWLADHVIGGVVLFPGAGFVELAI

SEQ ID NO: 348789 - protein, 26 aa, Mycobacterium
ADQRALGAALWYAATVKDAVVVAAAG

SEQ ID NO: 348790 - protein, 25 aa, Mycobacterium
ADQRGATIAVNWPVELQRQIAELAA

SEQ ID NO: 348791 - protein, 27 aa, Mycobacterium
ADQSFLPRLIILLVVAVVITIAVYGVV

SEQ ID NO: 348792 - protein, 27 aa, Mycobacterium
ADQSQELFLKFHSVLYDPSKQPDEVNS

SEQ ID NO: 348793 - protein, 23 aa, Mycobacterium
ADQVRTVASPAWYDDYVLTVGSV

SEQ ID NO: 348794 - protein, 29 aa, Mycobacterium
ADQYALACTAFQLLTGMPPYAGSNSAVVI

SEQ ID NO: 348795 - protein, 23 aa, Mycobacterium
ADREPLVPPVPIPVRDGLTDTGR

SEQ ID NO: 348796 - protein, 30 aa, Mycobacterium
ADRGSLMSIPLWIIVVLPIAKIIATSLSIG

SEQ ID NO: 348797 - protein, 23 aa, Mycobacterium
ADRGYLVVMAVLPVVFGALSLVV

SEQ ID NO: 348798 - protein, 22 aa, Mycobacterium
ADRHLPPNLLNPNLLFVESDHD

SEQ ID NO: 348799 - protein, 36 aa, Mycobacterium
ADRKRNLLIQIGLTAVVVIFAVALVLYIVGSADDKP

SEQ ID NO: 348800 - protein, 19 aa, Mycobacterium
ADRLKHLVLPSLTLALGAA

SEQ ID NO: 348801 - protein, 19 aa, Mycobacterium
ADRLLGWVIALVVCVPAAL

SEQ ID NO: 348802 - protein, 35 aa, Mycobacterium
ADRQPGLMVILLSVAFVLLWFFVQHERRAVFPLID

SEQ ID NO: 348803 - protein, 25 aa, Mycobacterium
ADRVEALVVLIALAASLVAIPVAAV

SEQ ID NO: 348804 - protein, 17 aa, Mycobacterium
ADRYVLIPVIIGLVLIT

SEQ ID NO: 348805 - protein, 30 aa, Mycobacterium
ADSLAPAMFVFLPIALLTNLLAGQARSQTQ

SEQ ID NO: 348806 - protein, 25 aa, Mycobacterium
ADSLLAPYEAQLLDILLPAKTETVY

SEQ ID NO: 348807 - protein, 27 aa, Mycobacterium
ADSLTEVFLWAAPVAVVGFVLALFLRE

SEQ ID NO: 348808 - protein, 32 aa, Mycobacterium
ADSSAFMHWGWRIPFLLSAVLVVIALFVRLKI

SEQ ID NO: 348809 - protein, 26 aa, Mycobacterium
ADSYRLLNIVFILVVVFTLIQGPGLS

SEQ ID NO: 348810 - protein, 34 aa, Mycobacterium
ADTEARLRWLHRSILLWWVVWVVSTAVSIFSIAT

SEQ ID NO: 348811 - protein, 30 aa, Mycobacterium
ADTLPLLSLTLAWLYRDYGSTGRLTLEPYA

SEQ ID NO: 348812 - protein, 28 aa, Mycobacterium
ADTNNLHRRVLVICVFAVGAATVLGWVL

SEQ ID NO: 348813 - protein, 23 aa, Mycobacterium
ADVALFTVLFTDGQRANLQELRE

SEQ ID NO: 348814 - protein, 33 aa, Mycobacterium
ADVGLVFWFVFSLFPIFWMLMLALKNAEEQTTT

SEQ ID NO: 348815 - protein, 44 aa, Mycobacterium
ADVLPVYLAIVVGLSLVILLLVFRSILIPLKATLGFLLSIGAAF

SEQ ID NO: 348816 - protein, 25 aa, Mycobacterium
ADVPWLLLRLRFFRRKLTVTALAAT

SEQ ID NO: 348817 - protein, 24 aa, Mycobacterium
ADVPWRDCLHFLWAGASGGSVPAV

SEQ ID NO: 348818 - protein, 24 aa, Mycobacterium
ADVQLAFPAILLALAVVAFLGNGL

SEQ ID NO: 348819 - protein, 17 aa, Mycobacterium
ADVRIAHPLISRAHLVL

SEQ ID NO: 348820 - protein, 24 aa, Mycobacterium
ADVRPDDLYMLIFTSGTSGDPKAV

SEQ ID NO: 348821 - protein, 20 aa, Mycobacterium
ADVTVIFGFVLWHVIGANSS

SEQ ID NO: 348822 - protein, 20 aa, Mycobacterium
ADVVPRWLRVTTGAAAVTIF

SEQ ID NO: 348823 - protein, 27 aa, Mycobacterium
ADVVVAVLVALWVLPRAIALARDALRI

SEQ ID NO: 348824 - protein, 27 aa, Mycobacterium
ADVVVAVLVALWVLPRAISLARDALRI

SEQ ID NO: 348825 - protein, 40 aa, Mycobacterium
ADVYTTYMLLPSEHLPLLEPLRGIVPAPLLDLVEPDLRVI

SEQ ID NO: 348826 - protein, 26 aa, Mycobacterium
ADWMPNFIDLLQRKLSQIADPVLQKL

SEQ ID NO: 348827 - protein, 18 aa, Mycobacterium
ADWPRYGGYALAGVSSFG

SEQ ID NO: 348828 - protein, 23 aa, Mycobacterium
ADYNLLLVARLKEELPAGINTGI

SEQ ID NO: 348829 - protein, 17 aa, Mycobacterium
ADYPTVLLSGSWLTQEQ

SEQ ID NO: 348830 - protein, 19 aa, Mycobacterium
ADYPTVLLSGSWLTREQAT

SEQ ID NO: 348831 - protein, 24 aa, Mycobacterium
ADYSFLSFYPYWGFQGLTSHYANP

SEQ ID NO: 348832 - protein, 28 aa, Mycobacterium
AEAAKILLLIFFAAFLMTKRTLFRTAGR

SEQ ID NO: 348833 - protein, 24 aa, Mycobacterium
AEAGLFPGVIYYLSRWFPRDYRAR

SEQ ID NO: 348834 - protein, 24 aa, Mycobacterium
AEAIALIVVIVRYLEPFTTISELA

SEQ ID NO: 348835 - protein, 20 aa, Mycobacterium
AEAISQLRALGLTPIMLTGD

SEQ ID NO: 348836 - protein, 29 aa, Mycobacterium
AEARQLFDRLSPTLPIVLANLVSVGQVGV

SEQ ID NO: 348837 - protein, 22 aa, Mycobacterium
AEARTSFRWLMSSDVCKHCTHA

SEQ ID NO: 348838 - protein, 23 aa, Mycobacterium
AEASLFIYLTHYQVYPLFGEQKL

SEQ ID NO: 348839 - protein, 25 aa, Mycobacterium
AEATAAAWLVSALPSVVVGGVVNGA

SEQ ID NO: 348840 - protein, 22 aa, Mycobacterium
AEAVKPTPIAKLFVLASRSARR

SEQ ID NO: 348841 - protein, 22 aa, Mycobacterium
AEAVLRDLLVPGPGPILGDRTV

SEQ ID NO: 348842 - protein, 28 aa, Mycobacterium
AEDEHGAPRWPWVVGIAAIVAAIALVVS

SEQ ID NO: 348843 - protein, 42 aa, Mycobacterium
AEDESKPFSWHWSWWWLVALIPVLLLAGLVVGAALWHRRRNR

SEQ ID NO: 348844 - protein, 17 aa, Mycobacterium
AEDLLLVVLTNEKGLGP

SEQ ID NO: 348845 - protein, 21 aa, Mycobacterium
AEDLRRALDDSGVLDVAVLSE

SEQ ID NO: 348846 - protein, 25 aa, Mycobacterium
AEFAFLGWHWSLPLGVAILGAAVAG

SEQ ID NO: 348847 - protein, 18 aa, Mycobacterium
AEFAGILILFGVGVVAQV

SEQ ID NO: 348848 - protein, 17 aa, Mycobacterium
AEFLPYAQDLGLHLVVA

SEQ ID NO: 348849 - protein, 27 aa, Mycobacterium
AEFPFRFDGEWLWTWQFEDLGPALIED

SEQ ID NO: 348850 - protein, 27 aa, Mycobacterium
AEFPIVDALFGTLYLPTGRWPAEYGID

SEQ ID NO: 348851 - protein, 36 aa, Mycobacterium
AEFSLVDWVSPVSWWWVLAGFLVFVTPPGRMSIAVF

SEQ ID NO: 348852 - protein, 27 aa, Mycobacterium
AEFVGTFILVFTVFGVIHRRAAAGFAG

SEQ ID NO: 348853 - protein, 23 aa, Mycobacterium
AEFVGTLILILFGVGVVAQVVTA

SEQ ID NO: 348854 - protein, 25 aa, Mycobacterium
AEFVLYSALMLLFAYLGWRTKPSGA

SEQ ID NO: 348855 - protein, 24 aa, Mycobacterium
AEGALLAWLTVAAVAIALLTLTGA

SEQ ID NO: 348856 - protein, 25 aa, Mycobacterium
AEGLRFVWSLRVLRALALIDLSVTA

SEQ ID NO: 348857 - protein, 24 aa, Mycobacterium
AEGPLLPLVQLGGVALLSAGIVLV

SEQ ID NO: 348858 - protein, 26 aa, Mycobacterium
AEGRLGWPLWAAYVSVFALTVLVGVR

SEQ ID NO: 348859 - protein, 31 aa, Mycobacterium
AEGRRALWVFVLIPVLILLAVSGRYLYTYAA

SEQ ID NO: 348860 - protein, 29 aa, Mycobacterium
AEGRSYLATAWWLTSLPGAVILVVIVALG

SEQ ID NO: 348861 - protein, 23 aa, Mycobacterium
AEHDLLLISIATAGVIALILLIV

SEQ ID NO: 348862 - protein, 40 aa, Mycobacterium
AEHPPRPFIPRMIRTFAVPLILGWVLLIAVLNSVVPQLEV

SEQ ID NO: 348863 - protein, 28 aa, Mycobacterium
AEHPQPGDWLYFVTIDSQGTTLFTRDYQ

SEQ ID NO: 348864 - protein, 23 aa, Mycobacterium
AEHPRRQWWAFLRRGRDLGESDR

SEQ ID NO: 348865 - protein, 32 aa, Mycobacterium
AEHRRELPALFLLASLVAVVFAGGVFPLAHRV

SEQ ID NO: 348866 - protein, 35 aa, Mycobacterium
AEIALIATTLLYLVFHWSWLALTGVALAAATAVFV

SEQ ID NO: 348867 - protein, 19 aa, Mycobacterium
AEIGAWASLILLLARIVQG

SEQ ID NO: 348868 - protein, 25 aa, Mycobacterium
AEILETFLSELWMWVQEALLVFQEI

SEQ ID NO: 348869 - protein, 18 aa, Mycobacterium
AELAAMAALLHWARAVPP

SEQ ID NO: 348870 - protein, 17 aa, Mycobacterium
AELAFLGPLLAAVARVY

SEQ ID NO: 348871 - protein, 21 aa, Mycobacterium
AELCAAAYAPYLAWLMQASTD

SEQ ID NO: 348872 - protein, 27 aa, Mycobacterium
AELERRYPGLTDLLPLTPTQQGIYFHS

SEQ ID NO: 348873 - protein, 22 aa, Mycobacterium
AELGWICVAINYRHSPRNTWPD

SEQ ID NO: 348874 - protein, 21 aa, Mycobacterium
AELHFPMFSLTLHGALCMLGT

SEQ ID NO: 348875 - protein, 21 aa, Mycobacterium
AELLDWIHRAADAGQPVILNA

SEQ ID NO: 348876 - protein, 19 aa, Mycobacterium
AELLLLGFAAFLTTIALLL

SEQ ID NO: 348877 - protein, 21 aa, Mycobacterium
AELLTLFAGSVLRGADLETLL

SEQ ID NO: 348878 - protein, 34 aa, Mycobacterium
AELMPPALRRTWVGALVRWLARPAGLSAAAVAPG

SEQ ID NO: 348879 - protein, 18 aa, Mycobacterium
AELRAQVLLGLRERELCP

SEQ ID NO: 348880 - protein, 20 aa, Mycobacterium
AELRRRNPGIPGLHLDVVGG

SEQ ID NO: 348881 - protein, 23 aa, Mycobacterium
AELTFPMLQFTLLGVVAMIGTLW

SEQ ID NO: 348882 - protein, 25 aa, Mycobacterium
AELVDQLERLLADPVLRDQLGAKAQ

SEQ ID NO: 348883 - protein, 22 aa, Mycobacterium
AELVLHAILGETPDLAPFSGTD

SEQ ID NO: 348884 - protein, 19 aa, Mycobacterium
AELVVLVLLIITALAFDFT

SEQ ID NO: 348885 - protein, 19 aa, Mycobacterium
AELWAIREAGLGSTAFPID

SEQ ID NO: 348886 - protein, 20 aa, Mycobacterium
AEMVRPLPPLPKALPLADAL

SEQ ID NO: 348887 - protein, 18 aa, Mycobacterium
AENILYYMVVTFSITYLK

SEQ ID NO: 348888 - protein, 24 aa, Mycobacterium
AENMAGAPWLVYYARALGADIGKG

SEQ ID NO: 348889 - protein, 24 aa, Mycobacterium
AENPIVPFGLFFDRNRLAAFAAMF

SEQ ID NO: 348890 - protein, 18 aa, Mycobacterium
AENYLRLNALGAYGSFFN

SEQ ID NO: 348891 - protein, 27 aa, Mycobacterium
AEPHRALVWLGWLTTATAAGWAIDTAT

SEQ ID NO: 348892 - protein, 26 aa, Mycobacterium
AEPIGLLTYLLLKRIDDLAYGLGLWW

SEQ ID NO: 348893 - protein, 25 aa, Mycobacterium
AEPPLRLPTYLTDRAGALDAAGESE

SEQ ID NO: 348894 - protein, 26 aa, Mycobacterium
AEPPPRGAYGVMLAMGPGFSFELLLL

SEQ ID NO: 348895 - protein, 34 aa, Mycobacterium
AEPRDVPLIFIPWPTLLWLLPVATAVALVAFPRP

SEQ ID NO: 348896 - protein, 32 aa, Mycobacterium
AEPSSRLGLGRWLIQPLVCVAAVAGSLLYVEV

SEQ ID NO: 348897 - protein, 29 aa, Mycobacterium
AEPSTWVFVVFYGLDWVATVPPTIVLCRD

SEQ ID NO: 348898 - protein, 17 aa, Mycobacterium
AEPTLADVAPVSAAMPA

SEQ ID NO: 348899 - protein, 21 aa, Mycobacterium
AEQALRCAIDIQDALHREAKR

SEQ ID NO: 348900 - protein, 22 aa, Mycobacterium
AEQIMPLLVVAIMSQLVFSGGM

SEQ ID NO: 348901 - protein, 18 aa, Mycobacterium
AEQLLVEALETMAGLATS

SEQ ID NO: 348902 - protein, 26 aa, Mycobacterium
AEQTRGVLFWLLGSLAGVAWSDVVTC

SEQ ID NO: 348903 - protein, 24 aa, Mycobacterium
AERALFEPLLASLRDLGCLTLMMS

SEQ ID NO: 348904 - protein, 25 aa, Mycobacterium
AERARKQRIWAISGVAVLAVVVAVA

SEQ ID NO: 348905 - protein, 23 aa, Mycobacterium
AERDLVFERFYRATPARGMPGSG

SEQ ID NO: 348906 - protein, 24 aa, Mycobacterium
AERILNRLLAVQDPPARRRLGPLD

SEQ ID NO: 348907 - protein, 17 aa, Mycobacterium
AERILWTVLGALAVAAV

SEQ ID NO: 348908 - protein, 23 aa, Mycobacterium
AERVDIAIVGLATRLPGEMNSPE

SEQ ID NO: 348909 - protein, 32 aa, Mycobacterium
AERVELPTYAFMRRRFWLQDLGVDQTTLSGVG

SEQ ID NO: 348910 - protein, 19 aa, Mycobacterium
AERVVFATWAIVTGKSAGG

SEQ ID NO: 348911 - protein, 17 aa, Mycobacterium
AERYPTCSDFAAALAGQ

SEQ ID NO: 348912 - protein, 51 aa, Mycobacterium
AESAPPKRPPAWSLGNWPVGWKVVAIAVVPLLLAMVLGGLRIHGGMANSSG

SEQ ID NO: 348913 - protein, 17 aa, Mycobacterium
AESFYRSLQLPWHTDLL

SEQ ID NO: 348914 - protein, 28 aa, Mycobacterium
AESGWLGLFGWAVVILGFLTVVILGIIA

SEQ ID NO: 348915 - protein, 20 aa, Mycobacterium
AESLWQVRELQFAAVAGVFL

SEQ ID NO: 348916 - protein, 21 aa, Mycobacterium
AESLYLILDTGVRFGIGNLEA

SEQ ID NO: 348917 - protein, 29 aa, Mycobacterium
AESQLRQLLAEYLLPTCPSPRATSPPGSP

SEQ ID NO: 348918 - protein, 26 aa, Mycobacterium
AESRLNRLLALQVPPARKVVAGPDGQ

SEQ ID NO: 348919 - protein, 26 aa, Mycobacterium
AESSMHLWLNYTLLAGVGLVVIGALG

SEQ ID NO: 348920 - protein, 24 aa, Mycobacterium
AESSVGLAFPPLGRGPLIDRIRRD

SEQ ID NO: 348921 - protein, 29 aa, Mycobacterium
AETERIWLPFTIWLTAAPALLPERSARLW

SEQ ID NO: 348922 - protein, 26 aa, Mycobacterium
AETERIWLPFTVWLTAAGALLPPRSH

SEQ ID NO: 348923 - protein, 29 aa, Mycobacterium
AETERIWLPFTVWLTTAPALLRPRSDRLW

SEQ ID NO: 348924 - protein, 25 aa, Mycobacterium
AETLWPLTGLIVGVLIAVAIAYGMY

SEQ ID NO: 348925 - protein, 25 aa, Mycobacterium
AETVVLLLLVVFLSANVSVLVLRRD

SEQ ID NO: 348926 - protein, 25 aa, Mycobacterium
AEVAPLLWATIGGAPAVLIYRAVNT

SEQ ID NO: 348927 - protein, 44 aa, Mycobacterium
AEVFGQRRLLRWSIPGIAHFFTMWGFFILLTVYIEAYGFLFVEN

SEQ ID NO: 348928 - protein, 21 aa, Mycobacterium
AEVFPEHKYRIVRLLQAGGHI

SEQ ID NO: 348929 - protein, 21 aa, Mycobacterium
AEVLPLWRELVTRPSRRVIDS

SEQ ID NO: 348930 - protein, 24 aa, Mycobacterium
AEVLWNEQHWTLAALPINSNREQW

SEQ ID NO: 348931 - protein, 21 aa, Mycobacterium
AEVMLWHCWPATGRIPPAPIL

SEQ ID NO: 348932 - protein, 21 aa, Mycobacterium
AEVMLWHCWPITGRMPPAATL

SEQ ID NO: 348933 - protein, 25 aa, Mycobacterium
AEVSWRLAFLINVPAGALMIYLAVR

SEQ ID NO: 348934 - protein, 23 aa, Mycobacterium
AEVYLPRTVLVDGQRPGPAAGQP

SEQ ID NO: 348935 - protein, 26 aa, Mycobacterium
AEWLAYLLFGALILVVFRIARATRAR

SEQ ID NO: 348936 - protein, 25 aa, Mycobacterium
AEWMPNFIDLLQRKLTRIADPVRQA

SEQ ID NO: 348937 - protein, 24 aa, Mycobacterium
AEWMPNFIELLQRKLSRIVDPVVQ

SEQ ID NO: 348938 - protein, 39 aa, Mycobacterium
AEWVTHGRLGIAILKNLLLAAFAVEMALMFAVPAGPAMA

SEQ ID NO: 348939 - protein, 34 aa, Mycobacterium
AEYLYAVCASVLHWLRLFILQSPRPMPRARRRAT

SEQ ID NO: 348940 - protein, 32 aa, Mycobacterium
AFAAAAILIRWKLSIAFLPNVGIAAAAAIVAA

SEQ ID NO: 348941 - protein, 18 aa, Mycobacterium
AFAAACAMTVLLVLADLA

SEQ ID NO: 348942 - protein, 30 aa, Mycobacterium
AFAAPILIGMILLILPLGQLALGGISEKYL

SEQ ID NO: 348943 - protein, 22 aa, Mycobacterium
AFAATFCWGLLLLAVTANDTRL

SEQ ID NO: 348944 - protein, 32 aa, Mycobacterium
AFAAVMIVLTVFLFFIFGQYRTGSTNGYSALF

SEQ ID NO: 348945 - protein, 27 aa, Mycobacterium
AFAENALLQVLFFAVLFGLALAKFGES

SEQ ID NO: 348946 - protein, 27 aa, Mycobacterium
AFAENALLQVLFFAVLFGLGLAKFGEH

SEQ ID NO: 348947 - protein, 26 aa, Mycobacterium
AFAGITVPLFLLFAGGWWLPKTVDAG

SEQ ID NO: 348948 - protein, 18 aa, Mycobacterium
AFAKCLLLEGTWASFLAS

SEQ ID NO: 348949 - protein, 17 aa, Mycobacterium
AFALFFIANCRVALDPR

SEQ ID NO: 348950 - protein, 27 aa, Mycobacterium
AFALLMLFGFGMIWFGILIGSLMRSVE

SEQ ID NO: 348951 - protein, 17 aa, Mycobacterium
AFALQIWVNNSWVSAQC

SEQ ID NO: 348952 - protein, 17 aa, Mycobacterium
AFAMLRFSTFTTAIFEQ

SEQ ID NO: 348953 - protein, 28 aa, Mycobacterium
AFATLISRLTGFARIVLLAAILGAALSS

SEQ ID NO: 348954 - protein, 20 aa, Mycobacterium
AFAVLGLLAARRSAPVAAVL

SEQ ID NO: 348955 - protein, 18 aa, Mycobacterium
AFAVWLHWAPVSIARASD

SEQ ID NO: 348956 - protein, 30 aa, Mycobacterium
AFDDQAPPWLWFLFAPLGAAFILLLAGAWS

SEQ ID NO: 348957 - protein, 20 aa, Mycobacterium
AFDILAPLAAIAALLAIGVI

SEQ ID NO: 348958 - protein, 21 aa, Mycobacterium
AFDILAPLVAIAALVMIGFIL

SEQ ID NO: 348959 - protein, 19 aa, Mycobacterium
AFDLGICLVLIALPAMAMI

SEQ ID NO: 348960 - protein, 20 aa, Mycobacterium
AFDLSEVWRLTRGAGQRIAV

SEQ ID NO: 348961 - protein, 30 aa, Mycobacterium
AFDQNNPLPPPWYPQPGPPPAPAPGVVPGN

SEQ ID NO: 348962 - protein, 17 aa, Mycobacterium
AFDTAALFRSFRPDLVL

SEQ ID NO: 348963 - protein, 28 aa, Mycobacterium
AFDVHTPWFWCLLALRAVVFTLVMAATF

SEQ ID NO: 348964 - protein, 27 aa, Mycobacterium
AFERSPGMARMRLLQKSYGIRLTLATQ

SEQ ID NO: 348965 - protein, 27 aa, Mycobacterium
AFESYGWRIPFLLALPLAVFGVWIRAK

SEQ ID NO: 348966 - protein, 21 aa, Mycobacterium
AFEVVGRRKLWYGISGAIMAI

SEQ ID NO: 348967 - protein, 20 aa, Mycobacterium
AFEVVGRRKLWYGISGGIVT

SEQ ID NO: 348968 - protein, 19 aa, Mycobacterium
AFEYRAVVLGEDRQQLISG

SEQ ID NO: 348969 - protein, 38 aa, Mycobacterium
AFFFESTFIGLWIFGWSRLPKLLHLACIWIVAIGVNAS

SEQ ID NO: 348970 - protein, 22 aa, Mycobacterium
AFFGPIFFATIGLQLDLGRLLS

SEQ ID NO: 348971 - protein, 24 aa, Mycobacterium
AFFPLSLVPLGSLVWVALNWPSPD

SEQ ID NO: 348972 - protein, 20 aa, Mycobacterium
AFFQGLLPMFLIMLEGSAGV

SEQ ID NO: 348973 - protein, 18 aa, Mycobacterium
AFFRHPPRVPPTRPGVVV

SEQ ID NO: 348974 - protein, 26 aa, Mycobacterium
AFFSHPIIAFILFVASPYIVYFTPLF

SEQ ID NO: 348975 - protein, 17 aa, Mycobacterium
AFFSWFAAGMVLAELTV

SEQ ID NO: 348976 - protein, 21 aa, Mycobacterium
AFGAFAHRWLARRTRRRINPG

SEQ ID NO: 348977 - protein, 23 aa, Mycobacterium
AFGAFGVPLWQMAAGAFIGSMPR

SEQ ID NO: 348978 - protein, 23 aa, Mycobacterium
AFGAFGVPLWQMAAGAFIGSVPR

SEQ ID NO: 348979 - protein, 19 aa, Mycobacterium
AFGALVWIFQDGHLGAFGT

SEQ ID NO: 348980 - protein, 25 aa, Mycobacterium
AFGAMLRIFYVAVPALRDDWRPVLW

SEQ ID NO: 348981 - protein, 34 aa, Mycobacterium
AFGASAWFWLLIYSDWVWPSLPPVVHAVSVAGWP

SEQ ID NO: 348982 - protein, 28 aa, Mycobacterium
AFGFDWAPLLWLPACAVFFPLWLVLQIV

SEQ ID NO: 348983 - protein, 31 aa, Mycobacterium
AFGFSFGGPAFFWTWPIVFLGQYMVALNFAE

SEQ ID NO: 348984 - protein, 28 aa, Mycobacterium
AFGGPGALFWMWMVAFLGASTSFVECTL

SEQ ID NO: 348985 - protein, 21 aa, Mycobacterium
AFGGYFYWDDLILVGKAGTQG

SEQ ID NO: 348986 - protein, 19 aa, Mycobacterium
AFGGYFYWDDLILVGRAGT

SEQ ID NO: 348987 - protein, 27 aa, Mycobacterium
AFGIGPLIQLVLRLVPRRLLAVSGWGP

SEQ ID NO: 348988 - protein, 29 aa, Mycobacterium
AFGIKAAVFPLSAWLPDSYPTAPAPVTAV

SEQ ID NO: 348989 - protein, 30 aa, Mycobacterium
AFGIKAAVFPLSAWLPDSYPTAPAPVTAVF

SEQ ID NO: 348990 - protein, 21 aa, Mycobacterium
AFGLAWRLDRGALLLWTVGLC

SEQ ID NO: 348991 - protein, 25 aa, Mycobacterium
AFGLGLAVLFIHLYPGRTATSFALL

SEQ ID NO: 348992 - protein, 26 aa, Mycobacterium
AFGLGLAVLFIYLYPGRTTTSFALLT

SEQ ID NO: 348993 - protein, 21 aa, Mycobacterium
AFGLTWRLDRAALLLWTVGLC

SEQ ID NO: 348994 - protein, 24 aa, Mycobacterium
AFGMGLAVLFIHLYPGRTGTSFAL

SEQ ID NO: 348995 - protein, 31 aa, Mycobacterium
AFGMPVPHPWALWLFGVFIMLTVGVASTSLI

SEQ ID NO: 348996 - protein, 35 aa, Mycobacterium
AFGPDVPFTFTFPKPGRYLAWIQAQRDYRVLTIPV

SEQ ID NO: 348997 - protein, 30 aa, Mycobacterium
AFGTVTAALFLLRCRSGAGAGLLSFAVGGT

SEQ ID NO: 348998 - protein, 22 aa, Mycobacterium
AFGVSVLLGVGIGWGLYGNTSS

SEQ ID NO: 348999 - protein, 27 aa, Mycobacterium
AFGVWSLWSVLVLFMPESVYGFSASDK

SEQ ID NO: 349000 - protein, 27 aa, Mycobacterium
AFGVWTLWSVLVLFMPESMYGFGASDK

SEQ ID NO: 349001 - protein, 36 aa, Mycobacterium
AFGVYMGFWFPGVPRWVWVFSIIFFIGAINLLSVKV

SEQ ID NO: 349002 - protein, 39 aa, Mycobacterium
AFGYSTYGLFAGGPLFFDTAALIIAFVVLGRYFEARATG

SEQ ID NO: 349003 - protein, 39 aa, Mycobacterium
AFGYSTYQLFAGGPLFFDTAALIIAFVVLGRYFEARATG

SEQ ID NO: 349004 - protein, 19 aa, Mycobacterium
AFHCWTFPLFLITNGEDVN

SEQ ID NO: 349005 - protein, 34 aa, Mycobacterium
AFHESLNMAALWNLPVLFLCENNLYAMGTALDRA

SEQ ID NO: 349006 - protein, 19 aa, Mycobacterium
AFHNCASRYLYALGREGLS

SEQ ID NO: 349007 - protein, 25 aa, Mycobacterium
AFIDDESMWMLALGTALIGGLVGAE

SEQ ID NO: 349008 - protein, 24 aa, Mycobacterium
AFIDIFVQMIVLYGGIFVVAFSLS

SEQ ID NO: 349009 - protein, 29 aa, Mycobacterium
AFIFAVCVVLFLTTLARHILLLERKQRLL

SEQ ID NO: 349010 - protein, 22 aa, Mycobacterium
AFILTFFVTRTFVRVIRGRPDG

SEQ ID NO: 349011 - protein, 23 aa, Mycobacterium
AFITHAHWLAFSGAMIYLAGLIV

SEQ ID NO: 349012 - protein, 24 aa, Mycobacterium
AFKLYPRRAVLGLALFIGQAFLYN

SEQ ID NO: 349013 - protein, 18 aa, Mycobacterium
AFKRWWARFVPPSIERST

SEQ ID NO: 349014 - protein, 17 aa, Mycobacterium
AFLASWGASLGLLHHEL

SEQ ID NO: 349015 - protein, 18 aa, Mycobacterium
AFLFAPAGIVFGHLSLSQ

SEQ ID NO: 349016 - protein, 19 aa, Mycobacterium
AFLGGWLLGLAAVTAIFIA

SEQ ID NO: 349017 - protein, 19 aa, Mycobacterium
AFLILFATLAACAGNGISI

SEQ ID NO: 349018 - protein, 29 aa, Mycobacterium
AFLLGAAMLIDFRFLAALTAILASGAAAG

SEQ ID NO: 349019 - protein, 17 aa, Mycobacterium
AFLLLIAGCTFLFRRLL

SEQ ID NO: 349020 - protein, 17 aa, Mycobacterium
AFLLLMLTGRRRHELNS

SEQ ID NO: 349021 - protein, 26 aa, Mycobacterium
AFLLRPGWIALALVVIAFTYLCFTVL

SEQ ID NO: 349022 - protein, 19 aa, Mycobacterium
AFLLVGLVHFLASAAFAVV

SEQ ID NO: 349023 - protein, 17 aa, Mycobacterium
AFLPGYLGLVIAGSDGT

SEQ ID NO: 349024 - protein, 17 aa, Mycobacterium
AFLPTIMVSIPLTVLLI

SEQ ID NO: 349025 - protein, 18 aa, Mycobacterium
AFLSTPLFNNLRAMLYVA

SEQ ID NO: 349026 - protein, 28 aa, Mycobacterium
AFLTYALCGLLILLVMRMLAEMAAANPS

SEQ ID NO: 349027 - protein, 26 aa, Mycobacterium
AFMAWGWRVGFWLSVIIVAIGYYIRT

SEQ ID NO: 349028 - protein, 21 aa, Mycobacterium
AFMCVALLVYFALLGRVAVAM

SEQ ID NO: 349029 - protein, 26 aa, Mycobacterium
AFMCVAMVVYFLILGKMGIALVQTGK

SEQ ID NO: 349030 - protein, 17 aa, Mycobacterium
AFMLFFTFIVGRSISEN

SEQ ID NO: 349031 - protein, 33 aa, Mycobacterium
AFMTPAIAALLGRWFWWPLQVSPRPVGAVRGWR

SEQ ID NO: 349032 - protein, 34 aa, Mycobacterium
AFMTPAIAALLGRWFWWPLRVRSRPDRRAIQRAA

SEQ ID NO: 349033 - protein, 17 aa, Mycobacterium
AFNEVRARRGLPGPAVV

SEQ ID NO: 349034 - protein, 29 aa, Mycobacterium
AFNGYAPVRPQYPPPPTPPPAGKRPGRRP

SEQ ID NO: 349035 - protein, 18 aa, Mycobacterium
AFNLQRREDKRLLPYMIG

SEQ ID NO: 349036 - protein, 17 aa, Mycobacterium
AFNSGCQVFIESSPHPV

SEQ ID NO: 349037 - protein, 21 aa, Mycobacterium
AFNVRRFLRRMLRRPEPAPKP

SEQ ID NO: 349038 - protein, 28 aa, Mycobacterium
AFPMGVPLEWNVFMIFGVLSLFVAHAGL

SEQ ID NO: 349039 - protein, 17 aa, Mycobacterium
AFPPLGRGPLIDRIRRD

SEQ ID NO: 349040 - protein, 20 aa, Mycobacterium
AFPVFEWIIHVAILHWRPRS

SEQ ID NO: 349041 - protein, 17 aa, Mycobacterium
AFQKALAKSPADRYDRC

SEQ ID NO: 349042 - protein, 29 aa, Mycobacterium
AFQLGLGVTLLLALIWADALATALAGFVV

SEQ ID NO: 349043 - protein, 18 aa, Mycobacterium
AFRDLIVEYWRPILRLAG

SEQ ID NO: 349044 - protein, 19 aa, Mycobacterium
AFRRILPFVGRIAGVIVLI

SEQ ID NO: 349045 - protein, 20 aa, Mycobacterium
AFRVPFLRNWKVSRAYLNWL

SEQ ID NO: 349046 - protein, 21 aa, Mycobacterium
AFSAAIAVLVIACPCALGLAT

SEQ ID NO: 349047 - protein, 26 aa, Mycobacterium
AFSAVSVIFLFALQLVQDKLPLHLAH

SEQ ID NO: 349048 - protein, 18 aa, Mycobacterium
AFSGWLLAGPVAIGVLAE

SEQ ID NO: 349049 - protein, 25 aa, Mycobacterium
AFSIWALWSVMVLFMPASVYGFSPA

SEQ ID NO: 349050 - protein, 21 aa, Mycobacterium
AFSKPFFDQGLINRRAVLKSS

SEQ ID NO: 349051 - protein, 21 aa, Mycobacterium
AFSKPFFSQGLINRRAVLKST

SEQ ID NO: 349052 - protein, 24 aa, Mycobacterium
AFSNGILFLAFGAVAFVVAFQAEV

SEQ ID NO: 349053 - protein, 28 aa, Mycobacterium
AFSSISILFLFFFQLVQGRLPLHLHDPA

SEQ ID NO: 349054 - protein, 17 aa, Mycobacterium
AFSTMFAMLLGYEVPDV

SEQ ID NO: 349055 - protein, 25 aa, Mycobacterium
AFTDKYGIPVLTSYAATEFGGGVAG

SEQ ID NO: 349056 - protein, 25 aa, Mycobacterium
AFTEKFGIPVLTSYAATEFGGGVAG

SEQ ID NO: 349057 - protein, 24 aa, Mycobacterium
AFTGDNLPLLLKGFARALSEGSYG

SEQ ID NO: 349058 - protein, 21 aa, Mycobacterium
AFTGYFLVLELNVVVPLAIQV

SEQ ID NO: 349059 - protein, 21 aa, Mycobacterium
AFTIEARALTFQPKKIREQLN

SEQ ID NO: 349060 - protein, 24 aa, Mycobacterium
AFTIEARALTFQPKRIRKQLEEAK

SEQ ID NO: 349061 - protein, 19 aa, Mycobacterium
AFTIEARALTFQPTRVRKQ

SEQ ID NO: 349062 - protein, 24 aa, Mycobacterium
AFTIESRALTFQPKRIRKQLDEAR

SEQ ID NO: 349063 - protein, 20 aa, Mycobacterium
AFTLTNVAMFFYIVSTFGAG

SEQ ID NO: 349064 - protein, 26 aa, Mycobacterium
AFTSWGWRVPFLVSAPIVLVATLIRL

SEQ ID NO: 349065 - protein, 25 aa, Mycobacterium
AFTVVTIFAVFGFAAAVKVFFTASH

SEQ ID NO: 349066 - protein, 35 aa, Mycobacterium
AFVALANFVPFVLSAWTVRLLARLPQRSVVTLATN

SEQ ID NO: 349067 - protein, 24 aa, Mycobacterium
AFVALIIVLLVRPSGLFSVRQRKQ

SEQ ID NO: 349068 - protein, 18 aa, Mycobacterium
AFVAVLVCLYPVLAPAIG

SEQ ID NO: 349069 - protein, 20 aa, Mycobacterium
AFVDSLYWIGKAWAISAVCV

SEQ ID NO: 349070 - protein, 18 aa, Mycobacterium
AFVFSITVTVLAFWIGRP

SEQ ID NO: 349071 - protein, 26 aa, Mycobacterium
AFVGANFMLLPRWLAGGGDHGAAAVI

SEQ ID NO: 349072 - protein, 17 aa, Mycobacterium
AFVGYVVYFGRRAVAAG

SEQ ID NO: 349073 - protein, 19 aa, Mycobacterium
AFVIAVIWVFLRRRGHHQP

SEQ ID NO: 349074 - protein, 19 aa, Mycobacterium
AFVLARGLITVRLTPDFDM

SEQ ID NO: 349075 - protein, 18 aa, Mycobacterium
AFVLHRAWVGPMVLVVLD

SEQ ID NO: 349076 - protein, 18 aa, Mycobacterium
AFVLSTVGYINGWLPFWV

SEQ ID NO: 349077 - protein, 19 aa, Mycobacterium
AFVMLVFHFGILSAIPMGV

SEQ ID NO: 349078 - protein, 20 aa, Mycobacterium
AFVNSVLPYSELFGPNVVGT

SEQ ID NO: 349079 - protein, 23 aa, Mycobacterium
AFVRRLVTLTTALLLLATALSVL

SEQ ID NO: 349080 - protein, 27 aa, Mycobacterium
AFVTDAGPIYLWLPGLMSILALAELQW

SEQ ID NO: 349081 - protein, 20 aa, Mycobacterium
AFVVAMLALGWRPGAPFPHG

SEQ ID NO: 349082 - protein, 18 aa, Mycobacterium
AFVVLFVINIVVTAVGIP

SEQ ID NO: 349083 - protein, 17 aa, Mycobacterium
AFVVRWPGAVLMATVLL

SEQ ID NO: 349084 - protein, 17 aa, Mycobacterium
AFVWMELASPNSASLPW

SEQ ID NO: 349085 - protein, 21 aa, Mycobacterium
AFVYIGEICAYLLNQPEKPTD

SEQ ID NO: 349086 - protein, 27 aa, Mycobacterium
AFWWAVVVFCVWLTALIVILKQAAERQ

SEQ ID NO: 349087 - protein, 25 aa, Mycobacterium
AFYDAMFGWLGYMSFWTLDIEYRST

SEQ ID NO: 349088 - protein, 39 aa, Mycobacterium
AFYLFSCRSLTRSAWRIGFWSNRWIIFGVAAQAIAQLAI

SEQ ID NO: 349089 - protein, 22 aa, Mycobacterium
AFYMTRVMLLTFFGKRRWHRDV

SEQ ID NO: 349090 - protein, 18 aa, Mycobacterium
AFYVFGLTLLIMAGNLAK

SEQ ID NO: 349091 - protein, 27 aa, Mycobacterium
AGAACGVLLLRVLMRRFWPDAEDPNGS

SEQ ID NO: 349092 - protein, 25 aa, Mycobacterium
AGAAGLLALVTRAPLGLSPPRLWAG

SEQ ID NO: 349093 - protein, 32 aa, Mycobacterium
AGAAITTLVLWDLFGQLPLPLGVAGHEGSTIL

SEQ ID NO: 349094 - protein, 29 aa, Mycobacterium
AGACLCLRFTTLPYFQSMALPCAISLVVI

SEQ ID NO: 349095 - protein, 25 aa, Mycobacterium
AGACVGFLWWNAAPAKIFMGDTGSL

SEQ ID NO: 349096 - protein, 18 aa, Mycobacterium
AGAFGQLLIFYRPPARQA

SEQ ID NO: 349097 - protein, 26 aa, Mycobacterium
AGAGAWLILLLTAPAARVAARQVTAG

SEQ ID NO: 349098 - protein, 23 aa, Mycobacterium
AGAGLDAILYRSLLAGVDYASAE

SEQ ID NO: 349099 - protein, 26 aa, Mycobacterium
AGAGLLLLAMVVTVLHFATVFGLAAL

SEQ ID NO: 349100 - protein, 24 aa, Mycobacterium
AGAHLLLGINWQLSLLLGAIVSPT

SEQ ID NO: 349101 - protein, 28 aa, Mycobacterium
AGAIFCLSFTRLPYFQTMGIPAAIGMAV

SEQ ID NO: 349102 - protein, 24 aa, Mycobacterium
AGAIFCLTFTRLPYFHTMGVPCAI

SEQ ID NO: 349103 - protein, 18 aa, Mycobacterium
AGAIGQLLIFYRPPVQRT

SEQ ID NO: 349104 - protein, 24 aa, Mycobacterium
AGAIIGYLLLRHTLLPAGGHLIGR

SEQ ID NO: 349105 - protein, 22 aa, Mycobacterium
AGAILCLLACWRAGNDPELLAI

SEQ ID NO: 349106 - protein, 19 aa, Mycobacterium
AGAIMYVACWLLMPTARYT

SEQ ID NO: 349107 - protein, 28 aa, Mycobacterium
AGAIPSFGLILIWIASWLMATPVKEVQT

SEQ ID NO: 349108 - protein, 22 aa, Mycobacterium
AGAIQFDGQWSCWGQIAALAGH

SEQ ID NO: 349109 - protein, 25 aa, Mycobacterium
AGAISLGVLKRCAQLMYRFASRRQV

SEQ ID NO: 349110 - protein, 33 aa, Mycobacterium
AGAKIIQFWIDVPLWLTALILLIAMTATNLFSV

SEQ ID NO: 349111 - protein, 35 aa, Mycobacterium
AGAKIVQYWMDVPLWLSALIFMVLMTATNLFSVAS

SEQ ID NO: 349112 - protein, 21 aa, Mycobacterium
AGALAFLINGLLAMVSARPHS

SEQ ID NO: 349113 - protein, 24 aa, Mycobacterium
AGALGILRLVAVFGPVHFFAQPVV

SEQ ID NO: 349114 - protein, 31 aa, Mycobacterium
AGALIGLITPLYLWHVRSVVPSLFVSELTFV

SEQ ID NO: 349115 - protein, 24 aa, Mycobacterium
AGALLLPFYIGTVPFPLSGLISGL

SEQ ID NO: 349116 - protein, 25 aa, Mycobacterium
AGALVIICASLSASGFLLWHHHNAV

SEQ ID NO: 349117 - protein, 19 aa, Mycobacterium
AGAMIIRRALAPLRRVAQT

SEQ ID NO: 349118 - protein, 23 aa, Mycobacterium
AGAMLCLSFTRLPYFQTMGVPCA

SEQ ID NO: 349119 - protein, 23 aa, Mycobacterium
AGAMLCLSFTRMPYFQSMGIPCA

SEQ ID NO: 349120 - protein, 23 aa, Mycobacterium
AGAMYCLSFARLPYFQTLAAPCA

SEQ ID NO: 349121 - protein, 24 aa, Mycobacterium
AGAMYCLSFCRLPYFQTLGVPCAV

SEQ ID NO: 349122 - protein, 23 aa, Mycobacterium
AGAMYCLSFCRLPYFQTMGVPCA

SEQ ID NO: 349123 - protein, 23 aa, Mycobacterium
AGAMYCLTFTRMPYFQSMGIPCA

SEQ ID NO: 349124 - protein, 40 aa, Mycobacterium; identical to SEQ ID NO: 20285

SEQ ID NO: 349125 - protein, 41 aa, Mycobacterium
AGANTGWWPVLWFTAKMWTFLFIYFWLRASLPRLRYDQFMG

SEQ ID NO: 349126 - protein, 32 aa, Mycobacterium
AGAPTRIPVPSLLRSLLSEHLDPGYAAAAEER

SEQ ID NO: 349127 - protein, 19 aa, Mycobacterium
AGAPWMVYYARALGNSVGK

SEQ ID NO: 349128 - protein, 24 aa, Mycobacterium
AGAQLLIRFTGPQVWWVLHVARWA

SEQ ID NO: 349129 - protein, 20 aa, Mycobacterium
AGAQLWTHIGRRLRGQPRAE

SEQ ID NO: 349130 - protein, 23 aa, Mycobacterium
AGARLWVAALALTAAWVVLYLAV

SEQ ID NO: 349131 - protein, 23 aa, Mycobacterium
AGARSKMTGDFLTYYGKFTSDVV

SEQ ID NO: 349132 - protein, 24 aa, Mycobacterium
AGARVLHELFPTDSVDFLYLTASA

SEQ ID NO: 349133 - protein, 25 aa, Mycobacterium
AGASFCLHFARLAYFKALGIPSALG

SEQ ID NO: 349134 - protein, 32 aa, Mycobacterium
AGASVGMLLVWLLLYLRVSAPINHQLIAAVDR

SEQ ID NO: 349135 - protein, 22 aa, Mycobacterium
AGATFCLSLARLPYFQTLGVPC

SEQ ID NO: 349136 - protein, 24 aa, Mycobacterium
AGATHLLGWVLLAATVIPLADTAI

SEQ ID NO: 349137 - protein, 27 aa, Mycobacterium
AGATLCLHFTRMPYFQSLGIPLAIGMS

SEQ ID NO: 349138 - protein, 27 aa, Mycobacterium
AGATLCLHFTRMPYFQSLGIPLAIGMT

SEQ ID NO: 349139 - protein, 25 aa, Mycobacterium
AGATLLHSGFFTPLYRIAATFVGPD

SEQ ID NO: 349140 - protein, 25 aa, Mycobacterium
AGATVLVAALLSVGMWQLRDGNSAG

SEQ ID NO: 349141 - protein, 26 aa, Mycobacterium
AGATYCLSFARLPWFNTMGAPVAIGM

SEQ ID NO: 349142 - protein, 27 aa, Mycobacterium
AGATYCLSFARLPWFNTMGAPVAIGML

SEQ ID NO: 349143 - protein, 20 aa, Mycobacterium
AGAVALQRSPGGRVPLVVTA

SEQ ID NO: 349144 - protein, 26 aa, Mycobacterium
AGAVCLYIEGALGPAGWRLSQNIAGV

SEQ ID NO: 349145 - protein, 24 aa, Mycobacterium
AGAVFVHWLIFQSLYRIGALCPYC

SEQ ID NO: 349146 - protein, 26 aa, Mycobacterium
AGAVGPWLLRFAFGPQYHASSALLAW

SEQ ID NO: 349147 - protein, 28 aa, Mycobacterium
AGAVIAVILLWIGWMHRTRKITWLARLG

SEQ ID NO: 349148 - protein, 30 aa, Mycobacterium
AGAVVPLLALVFVLATLLLEALPAIRVNGL

SEQ ID NO: 349149 - protein, 25 aa, Mycobacterium
AGAYPPGGPRPVPAPPPPAAQSRPA

SEQ ID NO: 349150 - protein, 28 aa, Mycobacterium
AGAYVMWGLFPAFFPLLKPAGALEILAH

SEQ ID NO: 349151 - protein, 27 aa, Mycobacterium
AGCNFLVMWAGIALTPILLCGIMFGGD

SEQ ID NO: 349152 - protein, 24 aa, Mycobacterium
AGCSVPFANLLWAPVYVIELAILE

SEQ ID NO: 349153 - protein, 19 aa, Mycobacterium
AGCVFTVLALAGCALLGLL

SEQ ID NO: 349154 - protein, 35 aa, Mycobacterium
AGDDVIMAMPLVSLLLVALVLALRKVGKGLVAVRN

SEQ ID NO: 349155 - protein, 28 aa, Mycobacterium
AGDFWAWALQFIVTLWVSTFLVVASHEF

SEQ ID NO: 349156 - protein, 25 aa, Mycobacterium
AGDGLIFVILVGLSAFMWWRAQQQK

SEQ ID NO: 349157 - protein, 26 aa, Mycobacterium
AGDLIHLLAELLDNALRYSPPTSQVR

SEQ ID NO: 349158 - protein, 26 aa, Mycobacterium
AGDLLLLFVALLANGLARFVASGLSA

SEQ ID NO: 349159 - protein, 33 aa, Mycobacterium
AGDPLFATTLAFTTFVFYQVFNLLNVRSDTGSA

SEQ ID NO: 349160 - protein, 26 aa, Mycobacterium
AGDPQARLLSYLPSGYASGVCTATTP

SEQ ID NO: 349161 - protein, 27 aa, Mycobacterium
AGDVVVVVPTWWPGQRVDVIVAAATCL

SEQ ID NO: 349162 - protein, 26 aa, Mycobacterium
AGEARRLAWSLLRTGLERTGSDSPEV

SEQ ID NO: 349163 - protein, 22 aa, Mycobacterium
AGEGYGLVRLPTGEILSQFGRG

SEQ ID NO: 349164 - protein, 17 aa, Mycobacterium
AGEIDGRHYLVMPAVPD

SEQ ID NO: 349165 - protein, 30 aa, Mycobacterium
AGEPAPPWLWLWIAGIGLSAGLTGADWRGV

SEQ ID NO: 349166 - protein, 19 aa, Mycobacterium
AGERIALIALASGLEIGIV

SEQ ID NO: 349167 - protein, 25 aa, Mycobacterium
AGESLIDVLHWPGYLLVVAGVIGGV

SEQ ID NO: 349168 - protein, 24 aa, Mycobacterium
AGESLIDVLHWPGYLLVVAGVIGT

SEQ ID NO: 349169 - protein, 24 aa, Mycobacterium
AGESLIDVLHWPGYLLVVAGVVGA

SEQ ID NO: 349170 - protein, 25 aa, Mycobacterium
AGFAAALRIWDGGLGIWGAIALGAV

SEQ ID NO: 349171 - protein, 19 aa, Mycobacterium
AGFANGWTYWAVWATTCMA

SEQ ID NO: 349172 - protein, 18 aa, Mycobacterium
AGFAVPVFAFFAAGVTVG

SEQ ID NO: 349173 - protein, 22 aa, Mycobacterium
AGFCLWFGISATMVGLPFAAFF

SEQ ID NO: 349174 - protein, 22 aa, Mycobacterium
AGFFAVVLLMAFWVAGSPEVQS

SEQ ID NO: 349175 - protein, 17 aa, Mycobacterium
AGFFIVVAVLYGVLTAL

SEQ ID NO: 349176 - protein, 24 aa, Mycobacterium
AGFGLAAPFLIYGAALLVAATVVF

SEQ ID NO: 349177 - protein, 26 aa, Mycobacterium
AGFGLDHVALLLFPGDGTSTVLASRD

SEQ ID NO: 349178 - protein, 24 aa, Mycobacterium
AGFHHGFFIFAVLLTALSIIPLGG

SEQ ID NO: 349179 - protein, 26 aa, Mycobacterium
AGFIGKWPSELGGQPGLWIPGSSVSA

SEQ ID NO: 349180 - protein, 17 aa, Mycobacterium
AGFLIDLAVRTSGKASS

SEQ ID NO: 349181 - protein, 19 aa, Mycobacterium
AGFMLFMYLEVLDASFSFD

SEQ ID NO: 349182 - protein, 17 aa, Mycobacterium
AGFPFAHRIAGFSALPA

SEQ ID NO: 349183 - protein, 21 aa, Mycobacterium
AGFTAITAILILGLAQTVLSY

SEQ ID NO: 349184 - protein, 21 aa, Mycobacterium
AGFTLFLYLEVLDAAFSFDGV

SEQ ID NO: 349185 - protein, 20 aa, Mycobacterium
AGFTLFLYLEVLDASFSFDG

SEQ ID NO: 349186 - protein, 24 aa, Mycobacterium
AGFTTPWIVPVIALALIPTAIAYT

SEQ ID NO: 349187 - protein, 21 aa, Mycobacterium
AGFVFTWLRRRSGSLLAPIAL

SEQ ID NO: 349188 - protein, 18 aa, Mycobacterium
AGFVILILLLIFITQNTA

SEQ ID NO: 349189 - protein, 20 aa, Mycobacterium
AGFVLFALTFVVNALARAAA

SEQ ID NO: 349190 - protein, 33 aa, Mycobacterium
AGFYCYVLTHVLYLNYVWGYSLLKAGFAIAPAA

SEQ ID NO: 349191 - protein, 18 aa, Mycobacterium
AGGAVAFSIVRRSVRAKP

SEQ ID NO: 349192 - protein, 18 aa, Mycobacterium
AGGAVAFSLVRRSVRAKP

SEQ ID NO: 349193 - protein, 23 aa, Mycobacterium
AGGAVAFTIVRRSSRPEPSPRPP

SEQ ID NO: 349194 - protein, 24 aa, Mycobacterium
AGGAVTFSILRRSAQPDPSPLPPS

SEQ ID NO: 349195 - protein, 28 aa, Mycobacterium
AGGDIPFYEPGLRKLLNENLAAGRLRFT

SEQ ID NO: 349196 - protein, 26 aa, Mycobacterium
AGGDIPFYEPGLRKLLTDNLTAGRLQ

SEQ ID NO: 349197 - protein, 42 aa, Mycobacterium
AGGFFDKLSRFVIQKPFVVIAIWISLAAIPALMFPPLMEAAA

SEQ ID NO: 349198 - protein, 33 aa, Mycobacterium
AGGFYLAFLFPLVGFLVVLLRRTWTPATFSLKG

SEQ ID NO: 349199 - protein, 24 aa, Mycobacterium
AGGGGLLEVVWSPLARPGDDTADI

SEQ ID NO: 349200 - protein, 25 aa, Mycobacterium
AGGHVMPVIPRALRALSRSPITTFD

SEQ ID NO: 349201 - protein, 23 aa, Mycobacterium
AGGIIFGVILWAASITSVIGAAY

SEQ ID NO: 349202 - protein, 26 aa, Mycobacterium
AGGLAVLIMLIWVSTALVISTSDSRS

SEQ ID NO: 349203 - protein, 23 aa, Mycobacterium
AGGLIAFAVGHWLHRLELPITVL

SEQ ID NO: 349204 - protein, 17 aa, Mycobacterium
AGGLLGWCWRRSSPPSP

SEQ ID NO: 349205 - protein, 17 aa, Mycobacterium
AGGLLIALGFLFGGYEI

SEQ ID NO: 349206 - protein, 27 aa, Mycobacterium
AGGLTMITLIIFGVVLGALVAFIIFGR

SEQ ID NO: 349207 - protein, 34 aa, Mycobacterium
AGGLTYYTIFALFPLLMVGFAVFGFVLASHPDLL

SEQ ID NO: 349208 - protein, 27 aa, Mycobacterium
AGGMLLSLYIVPSLKYPASPPALSLDE

SEQ ID NO: 349209 - protein, 19 aa, Mycobacterium
AGGPLLGWLTAGAVMIALL

SEQ ID NO: 349210 - protein, 20 aa, Mycobacterium
AGGRPYIVMSYCAAGSLGLR

SEQ ID NO: 349211 - protein, 27 aa, Mycobacterium
AGGRYSVYVWALLAMVAARMGLGPLRR

SEQ ID NO: 349212 - protein, 34 aa, Mycobacterium
AGGSDPWQLLWQLLQYLWNAYTGFNTWMFDLIWE

SEQ ID NO: 349213 - protein, 26 aa, Mycobacterium
AGGVLLIGLIRWYFGMTQRTTTAAKA

SEQ ID NO: 349214 - protein, 23 aa, Mycobacterium
AGGWGLTVLFVGALLAIALVLAA

SEQ ID NO: 349215 - protein, 23 aa, Mycobacterium
AGGWWFTLFTAILGSVILLWLVG

SEQ ID NO: 349216 - protein, 25 aa, Mycobacterium
AGHASYWRQLMQLAMRVPLLGPTLS

SEQ ID NO: 349217 - protein, 21 aa, Mycobacterium
AGHLDYPYWVPRDESQLPLTV

SEQ ID NO: 349218 - protein, 26 aa, Mycobacterium
AGHLIATVCWIGMAAALFGYALHHAG

SEQ ID NO: 349219 - protein, 21 aa, Mycobacterium
AGHMAATICWIAVAAALFVYA

SEQ ID NO: 349220 - protein, 28 aa, Mycobacterium
AGHNLFDVAYAWILAGRRGVRDGVEFEM

SEQ ID NO: 349221 - protein, 28 aa, Mycobacterium
AGHRVSRWEWIWALVLAGALAVVIMVGD

SEQ ID NO: 349222 - protein, 25 aa, Mycobacterium
AGHSWPAPAWLALLAAVSLLCVLVL

SEQ ID NO: 349223 - protein, 23 aa, Mycobacterium
AGIAIPVFAFFAAGVSIGGLDGF

SEQ ID NO: 349224 - protein, 29 aa, Mycobacterium
AGIASLCLIFIIMLLITRGVVASAVIVGT

SEQ ID NO: 349225 - protein, 23 aa, Mycobacterium
AGIENPLFFQPQTSMLFGDAKKS

SEQ ID NO: 349226 - protein, 20 aa, Mycobacterium
AGIFGIPGQGSYAAANAYLD

SEQ ID NO: 349227 - protein, 18 aa, Mycobacterium
AGIFRLTASVWRLPLTAS

SEQ ID NO: 349228 - protein, 28 aa, Mycobacterium
AGIGCWLLISHFALRRLGPGKGGLASNR

SEQ ID NO: 349229 - protein, 27 aa, Mycobacterium
AGIGLKAFWYHFAIMFEALFILTTVDA

SEQ ID NO: 349230 - protein, 23 aa, Mycobacterium
AGIGTWYILRKKMLPRLGEQLAA

SEQ ID NO: 349231 - protein, 29 aa, Mycobacterium
AGIHNGFFMFVIFLTVLSFIPLGSGIVVI

SEQ ID NO: 349232 - protein, 27 aa, Mycobacterium
AGIIKGIPATILWRLSRALPEDVKAQL

SEQ ID NO: 349233 - protein, 20 aa, Mycobacterium
AGILDRLAFAKSPALREDRA

SEQ ID NO: 349234 - protein, 23 aa, Mycobacterium
AGIMLITLLAIRLLGGSFRSMRP

SEQ ID NO: 349235 - protein, 27 aa, Mycobacterium
AGIMSATLCALLRLLEPNWSMTLVERL

SEQ ID NO: 349236 - protein, 20 aa, Mycobacterium
AGIPMALRWGYYAREELVDA

SEQ ID NO: 349237 - protein, 30 aa, Mycobacterium
AGISALCLIFIIMLLITRSVVAAAVIVGTV

SEQ ID NO: 349238 - protein, 22 aa, Mycobacterium
AGISIQLLWFLGAYVLVLAAMP

SEQ ID NO: 349239 - protein, 29 aa, Mycobacterium
AGISSLCLIFIIMLLITRGVVASAVIVGT

SEQ ID NO: 349240 - protein, 24 aa, Mycobacterium
AGITFIASTLFFAGALVFGHGACH

SEQ ID NO: 349241 - protein, 25 aa, Mycobacterium
AGITILFWQHIIGVDVDWSVFPVSF

SEQ ID NO: 349242 - protein, 32 aa, Mycobacterium
AGITLFICVVSMVLAKLLVRPIRRLEAGTEKI

SEQ ID NO: 349243 - protein, 24 aa, Mycobacterium
AGIVFIIATVFFAGAFVYGHYHHC

SEQ ID NO: 349244 - protein, 26 aa, Mycobacterium
AGIVGPMITFLLPILIGYTGGRMIHG

SEQ ID NO: 349245 - protein, 35 aa, Mycobacterium
AGIVVLRRGPRVTLWQFHWVVIVATLQITLAVSVS

SEQ ID NO: 349246 - protein, 20 aa, Mycobacterium
AGIVVMFVAAAVLALVLVFT

SEQ ID NO: 349247 - protein, 20 aa, Mycobacterium
AGIYLVAVYRLSRRGAPWST

SEQ ID NO: 349248 - protein, 17 aa, Mycobacterium
AGKAPVLFQIPGGAWTT

SEQ ID NO: 349249 - protein, 24 aa, Mycobacterium
AGKIEGVMALPLPISKINDIMNAH

SEQ ID NO: 349250 - protein, 25 aa, Mycobacterium
AGKLAVLVGPIWWAAGHSALAVAVA

SEQ ID NO: 349251 - protein, 17 aa, Mycobacterium
AGKPWYLRATPLAAVAL

SEQ ID NO: 349252 - protein, 23 aa, Mycobacterium
AGKRVPIFSRELFQEVFLNPGLV

SEQ ID NO: 349253 - protein, 20 aa, Mycobacterium
AGKWPRMLFIVNRCDELGVD

SEQ ID NO: 349254 - protein, 25 aa, Mycobacterium
AGLAELVLIALWSGGLGSVIATGCA

SEQ ID NO: 349255 - protein, 17 aa, Mycobacterium
AGLAIGLSLLPVLVLLV

SEQ ID NO: 349256 - protein, 34 aa, Mycobacterium
AGLALCVSFPPFGWWYIAILAFAVLGWVLTRERT

SEQ ID NO: 349257 - protein, 23 aa, Mycobacterium
AGLALFVLTFLVDALARGAAAGT

SEQ ID NO: 349258 - protein, 30 aa, Mycobacterium
AGLALKTLLGTPVWLGPLAVGAIVIMNVVA

SEQ ID NO: 349259 - protein, 23 aa, Mycobacterium
AGLALPFLVWIWMRRLASDHVDG

SEQ ID NO: 349260 - protein, 21 aa, Mycobacterium
AGLAVVGFRADLADGGASATV

SEQ ID NO: 349261 - protein, 17 aa, Mycobacterium
AGLAVVYLGIGLLLACI

SEQ ID NO: 349262 - protein, 20 aa, Mycobacterium
AGLCLLVFAGFMLYFAVYSR

SEQ ID NO: 349263 - protein, 26 aa, Mycobacterium
AGLDADYWFRSIRQTVQFERAVRGAC

SEQ ID NO: 349264 - protein, 20 aa, Mycobacterium
AGLDALIKDMRDFTALMSAH

SEQ ID NO: 349265 - protein, 27 aa, Mycobacterium
AGLEQLSFLFPSRWGFAATAATCDLRK

SEQ ID NO: 349266 - protein, 26 aa, Mycobacterium
AGLFFGFRELWSWNQGIALVLGVLFI

SEQ ID NO: 349267 - protein, 18 aa, Mycobacterium
AGLFLFYGAVFVALKTAG

SEQ ID NO: 349268 - protein, 18 aa, Mycobacterium
AGLFLIAILVTSGANTAT

SEQ ID NO: 349269 - protein, 34 aa, Mycobacterium
AGLFTILIAPIFTKLLRFFPPVVTGTLITIIGLC

SEQ ID NO: 349270 - protein, 25 aa, Mycobacterium
AGLGAALRIWDGGLGIWGAVTLGTV

SEQ ID NO: 349271 - protein, 29 aa, Mycobacterium
AGLGAVAFRYLIYGFTWLATGRDEFGQDG

SEQ ID NO: 349272 - protein, 24 aa, Mycobacterium
AGLGLLAYFYLALAVIAKMASGSP

SEQ ID NO: 349273 - protein, 28 aa, Mycobacterium
AGLGRLWVSVVLLLFGFGSFIGVTVAGR

SEQ ID NO: 349274 - protein, 23 aa, Mycobacterium
AGLGWWLLRRRTDVPPLAGTIAD

SEQ ID NO: 349275 - protein, 25 aa, Mycobacterium
AGLHQWLNVTLLAGAALVGLGVVVA

SEQ ID NO: 349276 - protein, 18 aa, Mycobacterium
AGLIAIAAAMLRAGKPVR

SEQ ID NO: 349277 - protein, 25 aa, Mycobacterium
AGLIAVRAYRLKADRLAWSLIAAGM

SEQ ID NO: 349278 - protein, 30 aa, Mycobacterium
AGLIGGILWNLLTWLFGIPSSSSHALFGGL

SEQ ID NO: 349279 - protein, 29 aa, Mycobacterium
AGLIIGFGLLLDTFLVRTLTVPAIATLLR

SEQ ID NO: 349280 - protein, 19 aa, Mycobacterium
AGLIPWLITGWHCHQPLPH

SEQ ID NO: 349281 - protein, 18 aa, Mycobacterium
AGLKEGLKERSTHRALLL

SEQ ID NO: 349282 - protein, 24 aa, Mycobacterium
AGLKVAFFALALPIAITGLMCIRL

SEQ ID NO: 349283 - protein, 17 aa, Mycobacterium
AGLLAALSAAAFLRAPH

SEQ ID NO: 349284 - protein, 19 aa, Mycobacterium
AGLLAVASLVISWWLTANL

SEQ ID NO: 349285 - protein, 21 aa, Mycobacterium
AGLLAWFWPRLGKLTLPVTFY

SEQ ID NO: 349286 - protein, 18 aa, Mycobacterium
AGLLIVIGIQLLQPAHIE

SEQ ID NO: 349287 - protein, 26 aa, Mycobacterium
AGLLKRRWVVPAAFVFFLAATAYLSY

SEQ ID NO: 349288 - protein, 17 aa, Mycobacterium
AGLLLPAALVAACTLVP

SEQ ID NO: 349289 - protein, 18 aa, Mycobacterium
AGLLLVLAAARPGLPQGD

SEQ ID NO: 349290 - protein, 17 aa, Mycobacterium
AGLLLVTGDPRTLSPFA

SEQ ID NO: 349291 - protein, 20 aa, Mycobacterium
AGLLRIAAVLGIVAGLAVLA

SEQ ID NO: 349292 - protein, 24 aa, Mycobacterium
AGLLSGYLLARKVVGARPPRPAAF

SEQ ID NO: 349293 - protein, 24 aa, Mycobacterium
AGLLSVPLVARPLDHRPKGAVILC

SEQ ID NO: 349294 - protein, 17 aa, Mycobacterium
AGLLWLPMHGTAVWVVA

SEQ ID NO: 349295 - protein, 22 aa, Mycobacterium
AGLNLVMLLGALFMAGESLPPE

SEQ ID NO: 349296 - protein, 23 aa, Mycobacterium
AGLPLLLGALLDGIPEQAVLGIG

SEQ ID NO: 349297 - protein, 24 aa, Mycobacterium
AGLRHWWRQADHYDWFADYLSARG

SEQ ID NO: 349298 - protein, 19 aa, Mycobacterium
AGLRYKYTVSPAGPHAPVG

SEQ ID NO: 349299 - protein, 23 aa, Mycobacterium
AGLSAWLMISAVTAVLLAGVWTV

SEQ ID NO: 349300 - protein, 44 aa, Mycobacterium
AGLSFLHFAAAMTLPWIAAIVVEFLLLRWLFAKDLATEPQRAVS

SEQ ID NO: 349301 - protein, 23 aa, Mycobacterium
AGLSRFVWATAIVWILGGLGTWL

SEQ ID NO: 349302 - protein, 29 aa, Mycobacterium
AGLSSLCLIFIIMLLITRGFVAALVIVGT

SEQ ID NO: 349303 - protein, 23 aa, Mycobacterium
AGLTLFALTFLVDALARGAVAGA

SEQ ID NO: 349304 - protein, 24 aa, Mycobacterium
AGLTNFVIVWLIPVVIGVGYAQRL

SEQ ID NO: 349305 - protein, 25 aa, Mycobacterium
AGLTTGVRLLFAATLLMAIHRPRAF

SEQ ID NO: 349306 - protein, 26 aa, Mycobacterium
AGLTVWVVGYTLRPLRRLAGIAAEVA

SEQ ID NO: 349307 - protein, 25 aa, Mycobacterium
AGLVFALTMFALMSGSVINLLQIGF

SEQ ID NO: 349308 - protein, 21 aa, Mycobacterium
AGLVFLSPPIAWLLAVIAVAA

SEQ ID NO: 349309 - protein, 23 aa, Mycobacterium
AGLVGAVPQVWWGPAEQSYAAAN

SEQ ID NO: 349310 - protein, 19 aa, Mycobacterium
AGLVLLGAWMPFNNGLRPE

SEQ ID NO: 349311 - protein, 26 aa, Mycobacterium
AGLVPGYWLVWTMLLVSGLGVAAFHP

SEQ ID NO: 349312 - protein, 34 aa, Mycobacterium
AGLVQITLSLLGVARLMRFIPRSVMVGFVNALAI

SEQ ID NO: 349313 - protein, 25 aa, Mycobacterium
AGLVVSLVIKRRRVWARLSPGAAAG

SEQ ID NO: 349314 - protein, 26 aa, Mycobacterium
AGLVVVPLNWRLVANELAFMLRDSGA

SEQ ID NO: 349315 - protein, 17 aa, Mycobacterium
AGLVWWAAFGWGSTSLV

SEQ ID NO: 349316 - protein, 23 aa, Mycobacterium
AGLWAGFLWGVDGRLPLLISGGA

SEQ ID NO: 349317 - protein, 21 aa, Mycobacterium
AGMDLPTVWALTRGAGQTVAV

SEQ ID NO: 349318 - protein, 18 aa, Mycobacterium
AGMFGFTAAALLEIPPDR

SEQ ID NO: 349319 - protein, 23 aa, Mycobacterium
AGMLMLAFVFQRLATRKPDLDAG

SEQ ID NO: 349320 - protein, 26 aa, Mycobacterium
AGMVILVVTVLVLTWMQFRGDFEDKA

SEQ ID NO: 349321 - protein, 18 aa, Mycobacterium
AGMVPACTTPPLVQAESV

SEQ ID NO: 349322 - protein, 21 aa, Mycobacterium
AGMVPPLAMALATTIRPGLFS

SEQ ID NO: 349323 - protein, 43 aa, Mycobacterium
AGMYAYQAFAPNFLIPQLFQELFDYLWGFRTFDTSKGPGFPSP

SEQ ID NO: 349324 - protein, 21 aa, Mycobacterium
AGNALLYMYATRSGKFVVWDR

SEQ ID NO: 349325 - protein, 36 aa, Mycobacterium
AGNRSVVLFELGPPPPLSLPRPLANGWRPTDGPGPA

SEQ ID NO: 349326 - protein, 27 aa, Mycobacterium
AGNTELLPVFFLLPVSVAFQERPAITA

SEQ ID NO: 349327 - protein, 33 aa, Mycobacterium
AGNYKAFEMWLIVGVIYFIVIMALTKLSDRLER

SEQ ID NO: 349328 - protein, 25 aa, Mycobacterium
AGPAAFWVCGLLLCMFIGPTQSSSR

SEQ ID NO: 349329 - protein, 24 aa, Mycobacterium
AGPAMNFVICLVLIYGIALVWGLP

SEQ ID NO: 349330 - protein, 26 aa, Mycobacterium
AGPGIPVWLRAPRAIPGALVLPGVLV

SEQ ID NO: 349331 - protein, 33 aa, Mycobacterium
AGPGLFLVYAVCGVFVFFILRALGELILHRPSS

SEQ ID NO: 349332 - protein, 25 aa, Mycobacterium
AGPGMNFVICLVLIYGIAVVWGLPN

SEQ ID NO: 349333 - protein, 25 aa, Mycobacterium
AGPGRLEALWRGSLVVFQSILAVAF

SEQ ID NO: 349334 - protein, 18 aa, Mycobacterium
AGPLAYMVDLLAAVPSIV

SEQ ID NO: 349335 - protein, 23 aa, Mycobacterium
AGPLPYIVMEYVDGVTLRDIVHT

SEQ ID NO: 349336 - protein, 25 aa, Mycobacterium
AGPRAQLPFPVNSLPQPGDLPNDGN

SEQ ID NO: 349337 - protein, 21 aa, Mycobacterium
AGPSGPIPRPPAAGQPGWQQA

SEQ ID NO: 349338 - protein, 26 aa, Mycobacterium
AGPTPPVPPLPAFKPSADLGANCQYP

SEQ ID NO: 349339 - protein, 17 aa, Mycobacterium
AGPTQPDYGAPAGWHAP

SEQ ID NO: 349340 - protein, 28 aa, Mycobacterium
AGPVDYVLIAIYFVFVLGIGLLARRGVS

SEQ ID NO: 349341 - protein, 48 aa, Mycobacterium
AGPVILMAMLPALQFRYWQWASLALAAPVIVWAGRPFHQAAWVNLKHG

SEQ ID NO: 349342 - protein, 31 aa, Mycobacterium
AGPVLRLWRSVLMFASRFWQFEQLYRSNVKY

SEQ ID NO: 349343 - protein, 23 aa, Mycobacterium
AGPVPPPSTFAPGLPPGPPAPPG

SEQ ID NO: 349344 - protein, 29 aa, Mycobacterium
AGPVRRPMTLALRTVTLAAYSALLAGLVT

SEQ ID NO: 349345 - protein, 30 aa, Mycobacterium
AGQDYGMKLLWTLTLLIPVLYVNQEMVLRL

SEQ ID NO: 349346 - protein, 39 aa, Mycobacterium
AGQGEPCEKLWLPPLLRPRPLGRLIADSGLRAGAKAVLD

SEQ ID NO: 349347 - protein, 19 aa, Mycobacterium
AGQLLLEALAHFQLDRTGE

SEQ ID NO: 349348 - protein, 29 aa, Mycobacterium
AGQLPLPRTRPFPAVALPDTGPGDDAPEP

SEQ ID NO: 349349 - protein, 22 aa, Mycobacterium
AGQMVSALWVASTGQLVLVIHH

SEQ ID NO: 349350 - protein, 31 aa, Mycobacterium
AGQPLWTAFLLAVLCTWFLQTAMCMYYKARS

SEQ ID NO: 349351 - protein, 23 aa, Mycobacterium
AGQPSPWDLGRPAPIGSVLSVHD

SEQ ID NO: 349352 - protein, 28 aa, Mycobacterium
AGQRATLLLFVLPLCTPVGPIADRLLGW

SEQ ID NO: 349353 - protein, 23 aa, Mycobacterium
AGQRRRLLLARAALSPAQIVLLD

SEQ ID NO: 349354 - protein, 26 aa, Mycobacterium
AGQTVFRIRLPLIDAPLNASAPGRPR

SEQ ID NO: 349355 - protein, 20 aa, Mycobacterium
AGRDLPPVPVLLVIVDEYLE

SEQ ID NO: 349356 - protein, 23 aa, Mycobacterium
AGRFRVALFILSAAMTGCFVSIC

SEQ ID NO: 349357 - protein, 26 aa, Mycobacterium
AGRGGLLLGLLIPHGLLELTAVFLAA

SEQ ID NO: 349358 - protein, 26 aa, Mycobacterium
AGRGWARRPFVGSFVALLIGIGAGIG

SEQ ID NO: 349359 - protein, 23 aa, Mycobacterium
AGRGWLQVLPGLVAVLGGLLLFA

SEQ ID NO: 349360 - protein, 26 aa, Mycobacterium
AGRHARQLALLKRIAPAAVLDNGIRK

SEQ ID NO: 349361 - protein, 26 aa, Mycobacterium
AGRKQILLITLLLMGISTFAVGVIPS

SEQ ID NO: 349362 - protein, 27 aa, Mycobacterium
AGRLALWTLFWLGWAIALAATFMVSHF

SEQ ID NO: 349363 - protein, 23 aa, Mycobacterium
AGRLLPVVGFLAAVLVLAHLCDD

SEQ ID NO: 349364 - protein, 26 aa, Mycobacterium
AGRMAVAWLITLPAAGLVGALTYWLS

SEQ ID NO: 349365 - protein, 27 aa, Mycobacterium
AGRMVAAWLITLPLAGLVGAITYELVH

SEQ ID NO: 349366 - protein, 48 aa, Mycobacterium
AGRPGWWAGAALALVVSLLALLRWRGAALLTLAWRSVSKRHVADLPGG

SEQ ID NO: 349367 - protein, 26 aa, Mycobacterium
AGRRRWGWLALTTALAGWAIGEVICA

SEQ ID NO: 349368 - protein, 23 aa, Mycobacterium
AGRTRLELWRSDMVRMLSYGETD

SEQ ID NO: 349369 - protein, 22 aa, Mycobacterium
AGRVVAFILIGLGLAEFLLGGM

SEQ ID NO: 349370 - protein, 25 aa, Mycobacterium
AGRVVALILIILGLAEFVAGGLVGG

SEQ ID NO: 349371 - protein, 17 aa, Mycobacterium
AGRWELVAFAAPLAGAL

SEQ ID NO: 349372 - protein, 24 aa, Mycobacterium
AGSARVRVAAPGGLPALHVTQSLG

SEQ ID NO: 349373 - protein, 29 aa, Mycobacterium
AGSFVVAMIPLVWLLYTVVAKGISAIGSS

SEQ ID NO: 349374 - protein, 27 aa, Mycobacterium
AGSGSFFGLAFWIALAGLTPTGLLLAA

SEQ ID NO: 349375 - protein, 22 aa, Mycobacterium
AGSGYPWAFLAAGLMAAYVLVG

SEQ ID NO: 349376 - protein, 22 aa, Mycobacterium
AGSIAVVAWLGAAALLVALALL

SEQ ID NO: 349377 - protein, 25 aa, Mycobacterium
AGSIAVVCWLVAAALLVGLALLDKL

SEQ ID NO: 349378 - protein, 23 aa, Mycobacterium
AGSIGLGFAIPVDQAKRIADELV

SEQ ID NO: 349379 - protein, 17 aa, Mycobacterium
AGSLFFRPKQPAPVPPT

SEQ ID NO: 349380 - protein, 17 aa, Mycobacterium
AGSLFLVNVLFIGAVSA

SEQ ID NO: 349381 - protein, 21 aa, Mycobacterium
AGSLLFGLWHVATSLGLTSTN

SEQ ID NO: 349382 - protein, 22 aa, Mycobacterium
AGSLLFGMWHIATSLGLTSSNV

SEQ ID NO: 349383 - protein, 24 aa, Mycobacterium
AGSLPLIFIGFTGHVWMIAVAMII

SEQ ID NO: 349384 - protein, 26 aa, Mycobacterium
AGSLPREFVPPKDGPKWVPNPNPKGN

SEQ ID NO: 349385 - protein, 23 aa, Mycobacterium
AGSNTQFELPFTGLSDPTGLVVD

SEQ ID NO: 349386 - protein, 18 aa, Mycobacterium
AGSQPRMIWYAPQFNEGD

SEQ ID NO: 349387 - protein, 26 aa, Mycobacterium
AGSSFLLDWPIWADGIVFLIVSVLLL

SEQ ID NO: 349388 - protein, 24 aa, Mycobacterium
AGSSLPLLLLFSVANRSLADVLTS

SEQ ID NO: 349389 - protein, 24 aa, Mycobacterium
AGSSLPLLLLFSVANRSLTDVLTG

SEQ ID NO: 349390 - protein, 26 aa, Mycobacterium
AGSSWLMDWPLWADGVVFLVVSVLLL

SEQ ID NO: 349391 - protein, 23 aa, Mycobacterium
AGSTSQVVLPFNGLKNPDGVAVD

SEQ ID NO: 349392 - protein, 30 aa, Mycobacterium
AGSTTQIELPFTGLDFPWGLAVDNMGTVYV

SEQ ID NO: 349393 - protein, 22 aa, Mycobacterium
AGSVLVILLPPGLRRLAKWTGL

SEQ ID NO: 349394 - protein, 25 aa, Mycobacterium
AGSVSWLILLLASPVARATARLLTP

SEQ ID NO: 349395 - protein, 22 aa, Mycobacterium
AGSWLPAVLWGVAFAILLRGLP

SEQ ID NO: 349396 - protein, 18 aa, Mycobacterium
AGSWLPAVLWGVAFAILV

SEQ ID NO: 349397 - protein, 17 aa, Mycobacterium
AGSWLPAVLWGVAFAVL

SEQ ID NO: 349398 - protein, 23 aa, Mycobacterium
AGSYPLLLVCGFFLGVAGTIFAV

SEQ ID NO: 349399 - protein, 28 aa, Mycobacterium
AGSYRMGTWFDALWPASSLLVAMASWAP

SEQ ID NO: 349400 - protein, 29 aa, Mycobacterium
AGTALLILFAFPMFWLVNTGSTVLIVLVY

SEQ ID NO: 349401 - protein, 24 aa, Mycobacterium
AGTAWLWGLHLIPLYRHTIHVVEV

SEQ ID NO: 349402 - protein, 31 aa, Mycobacterium
AGTFISVLVLWDLFGQLPLPLGVAGHEGSTV

SEQ ID NO: 349403 - protein, 24 aa, Mycobacterium
AGTGPFLFGLLHDVTHGWTAPWVL

SEQ ID NO: 349404 - protein, 24 aa, Mycobacterium
AGTGWRVSGLLRIDEVAAATGFRA

SEQ ID NO: 349405 - protein, 21 aa, Mycobacterium
AGTIIRLAPLDWTWPAVSLVA

SEQ ID NO: 349406 - protein, 17 aa, Mycobacterium
AGTLLIRRQFAPLARVS

SEQ ID NO: 349407 - protein, 29 aa, Mycobacterium
AGTLWLTAAQWLMRLTGLATIAILTRLLT

SEQ ID NO: 349408 - protein, 31 aa, Mycobacterium
AGTMLLRLCMLPGLALLIWAAPRVARHVGAS

SEQ ID NO: 349409 - protein, 31 aa, Mycobacterium
AGTMLLRLCMLPGLLLLIWAAPRVARHVGAN

SEQ ID NO: 349410 - protein, 17 aa, Mycobacterium
AGTPRILFRHILSNVTS

SEQ ID NO: 349411 - protein, 31 aa, Mycobacterium
AGTQPISVLVAWLAVLLFASLAAAPRPWQGP

SEQ ID NO: 349412 - protein, 21 aa, Mycobacterium
AGTRWPRWLRQLLSFVAVVAI

SEQ ID NO: 349413 - protein, 25 aa, Mycobacterium
AGTTGWLAGMWRDLLGAAISGPEAD

SEQ ID NO: 349414 - protein, 25 aa, Mycobacterium
AGTVLAWGLLELFPRTLVPGDRFWW

SEQ ID NO: 349415 - protein, 18 aa, Mycobacterium
AGTVLDPLPRWLRADVLT

SEQ ID NO: 349416 - protein, 34 aa, Mycobacterium
AGTVLGRRYRVGPPVLLILLGALLGLIPRFGSVE

SEQ ID NO: 349417 - protein, 25 aa, Mycobacterium
AGTVLLIGLIRWYIGMAQRTSALAT

SEQ ID NO: 349418 - protein, 21 aa, Mycobacterium
AGTYLGGWRIIRTLGKGLVEI

SEQ ID NO: 349419 - protein, 17 aa, Mycobacterium
AGVAFALVAACFWALYI

SEQ ID NO: 349420 - protein, 27 aa, Mycobacterium
AGVATVLIGLWLLLVHLRPTSVHSLGD

SEQ ID NO: 349421 - protein, 18 aa, Mycobacterium
AGVAVLLIAILHNGRFAP

SEQ ID NO: 349422 - protein, 19 aa, Mycobacterium
AGVAYIRDKGRPWPEAHST

SEQ ID NO: 349423 - protein, 20 aa, Mycobacterium
AGVGAFWWSRTGFAGPILEA

SEQ ID NO: 349424 - protein, 38 aa, Mycobacterium
AGVGGAIALLLIAVVLVLGFWQPGFFVTTKLDVNKAQA

SEQ ID NO: 349425 - protein, 29 aa, Mycobacterium
AGVGLASLLWQLLLVWIGAVVGAGSTART

SEQ ID NO: 349426 - protein, 19 aa, Mycobacterium
AGVGLLPRQTPRPALVAVL

SEQ ID NO: 349427 - protein, 29 aa, Mycobacterium
AGVGLWAFLTRFALNCRLSSWTRAAKANL

SEQ ID NO: 349428 - protein, 25 aa, Mycobacterium
AGVGRFLLATAIIWLLGGVGTWLIG

SEQ ID NO: 349429 - protein, 37 aa, Mycobacterium
AGVIALILLIVYRSVFTALLPLLVIGLSLAVGRGVLS

SEQ ID NO: 349430 - protein, 21 aa, Mycobacterium
AGVIVVIPLYCVAVIMSFISS

SEQ ID NO: 349431 - protein, 22 aa, Mycobacterium
AGVIVWVLVLLSLSLTAATFFP

SEQ ID NO: 349432 - protein, 33 aa, Mycobacterium
AGVKAAGQLLWWAILFPVLSIPATVALCVTVSH

SEQ ID NO: 349433 - protein, 26 aa, Mycobacterium
AGVLTSPAAFLQRPARWMQLTASNSS

SEQ ID NO: 349434 - protein, 20 aa, Mycobacterium
AGVNLFLLATVINVLLGWNQ

SEQ ID NO: 349435 - protein, 30 aa, Mycobacterium
AGVPDSWRLLHIVFILVVLYTAIQGPSLRR

SEQ ID NO: 349436 - protein, 28 aa, Mycobacterium
AGVPSIVAALFVFALWIATLGFEQSAFA

SEQ ID NO: 349437 - protein, 25 aa, Mycobacterium
AGVQDILLIGYALALTEFLGVTLPV

SEQ ID NO: 349438 - protein, 25 aa, Mycobacterium
AGVSSTLFYLFAYGFSTLGAFAVVG

SEQ ID NO: 349439 - protein, 28 aa, Mycobacterium
AGVSVLAGTTWWSPWTAYLATVDPRHVV

SEQ ID NO: 349440 - protein, 23 aa, Mycobacterium
AGVTGLPRRASTVGLVALVSAQL

SEQ ID NO: 349441 - protein, 33 aa, Mycobacterium; identical to SEQ ID NO: 23261

SEQ ID NO: 349442 - protein, 25 aa, Mycobacterium
AGVVIGWLWPGLGADLRPLADGFIK

SEQ ID NO: 349443 - protein, 25 aa, Mycobacterium
AGVVLALFSAPWLIAVGAACIAGAW

SEQ ID NO: 349444 - protein, 21 aa, Mycobacterium
AGVVLLVIVAVVTVLRGRESQ

SEQ ID NO: 349445 - protein, 18 aa, Mycobacterium
AGVVRPQLRRVYLEETVQ

SEQ ID NO: 349446 - protein, 25 aa, Mycobacterium
AGVVTAIFCYFFVSAAYGSLPPIPL

SEQ ID NO: 349447 - protein, 24 aa, Mycobacterium
AGVWMRLPAILAGIACWLVISHWV

SEQ ID NO: 349448 - protein, 18 aa, Mycobacterium
AGVWMRLPATLAGIGCWL

SEQ ID NO: 349449 - protein, 20 aa, Mycobacterium
AGVYLAAVYRLARRGAPWST

SEQ ID NO: 349450 - protein, 30 aa, Mycobacterium
AGWALGYVYFLFWLWVLRPVPVAEQEPAEL

SEQ ID NO: 349451 - protein, 27 aa, Mycobacterium
AGWAMLLDYLLIPTLLYVFAAESMVGL

SEQ ID NO: 349452 - protein, 30 aa, Mycobacterium
AGWGPRLLWRLFQLLTLAALVIAASRLLGH

SEQ ID NO: 349453 - protein, 31 aa, Mycobacterium
AGWLLGYVYFLVCLWVFRPLPITGAEPARLA

SEQ ID NO: 349454 - protein, 24 aa, Mycobacterium
AGWSPWIWAMIAVGVGFVTVFVYW

SEQ ID NO: 349455 - protein, 20 aa, Mycobacterium
AGWVFGWLAERSGSLAAPIL

SEQ ID NO: 349456 - protein, 50 aa, Mycobacterium
AGWVPAVLLHHWLQLALITPVMFYVGWPIHRTGWLALAHRSADMNSLITL

SEQ ID NO: 349457 - protein, 19 aa, Mycobacterium
AGWWPAHVDPRQWAFDKTL

SEQ ID NO: 349458 - protein, 20 aa, Mycobacterium
AGYELLRPRLGRVLAAIVLA

SEQ ID NO: 349459 - protein, 20 aa, Mycobacterium
AGYFVCFIALFILSGLGNGS

SEQ ID NO: 349460 - protein, 28 aa, Mycobacterium
AGYHQPYWVCGLYLLLLTVVAVGAARQM

SEQ ID NO: 349461 - protein, 25 aa, Mycobacterium
AGYIVCLLVLFLLAGLGKGSVFKLI

SEQ ID NO: 349462 - protein, 24 aa, Mycobacterium
AGYPMVLVLFRSFPPLTVWTGLSL

SEQ ID NO: 349463 - protein, 26 aa, Mycobacterium
AGYPPAWALCALFPLAAVPLVPAEPG

SEQ ID NO: 349464 - protein, 24 aa, Mycobacterium
AGYTLYVYVLYRFSQPRLAQRGGT

SEQ ID NO: 349465 - protein, 24 aa, Mycobacterium
AGYVWYHLFGPPPADDHDLLQLAR

SEQ ID NO: 349466 - protein, 20 aa, Mycobacterium
AGYYAVMTQLGFATLLLGLM

SEQ ID NO: 349467 - protein, 24 aa, Mycobacterium
AHALLLHFVLVLVPLTAALEIVCG

SEQ ID NO: 349468 - protein, 24 aa, Mycobacterium
AHAPRYGGVPWVGAAALPDVGDPD

SEQ ID NO: 349469 - protein, 38 aa, Mycobacterium
AHARRFRRHPLGVAWLIALAVIPLLMAAIGYGAFGRPT

SEQ ID NO: 349470 - protein, 19 aa, Mycobacterium
AHDFTLIPAFIEEILRVDG

SEQ ID NO: 349471 - protein, 23 aa, Mycobacterium
AHDLYLFRLYSFTTQAIMWATIG

SEQ ID NO: 349472 - protein, 26 aa, Mycobacterium
AHDVLAHPQPFFAPIAAAVSLSTSNV

SEQ ID NO: 349473 - protein, 17 aa, Mycobacterium
AHDWGSVGVWHYLKRPG

SEQ ID NO: 349474 - protein, 27 aa, Mycobacterium
AHEDAALSWVLLVAVPVLAALTSWIMS

SEQ ID NO: 349475 - protein, 25 aa, Mycobacterium
AHEIAWRPWTAPSETAPAGASLAVV

SEQ ID NO: 349476 - protein, 24 aa, Mycobacterium
AHEKYSAAWWALGVLAVLVAAWAV

SEQ ID NO: 349477 - protein, 27 aa, Mycobacterium
AHFTFGLALLTGLYVAASPWIVGFSAT

SEQ ID NO: 349478 - protein, 24 aa, Mycobacterium
AHGMWWPFVLIGVAYNLLIAWALL

SEQ ID NO: 349479 - protein, 31 aa, Mycobacterium
AHGSLLLIQPLLVSSLLFALPLSARLCHQRI

SEQ ID NO: 349480 - protein, 27 aa, Mycobacterium
AHGTAGLVLWIALAFLAVGGAADMVSA

SEQ ID NO: 349481 - protein, 23 aa, Mycobacterium
AHGVLLTVFAFSVGGAATVGVVT

SEQ ID NO: 349482 - protein, 24 aa, Mycobacterium
AHHGLLWALLLVVVVAVAGTLMVI

SEQ ID NO: 349483 - protein, 28 aa, Mycobacterium
AHIAFSVWYLWSVMVLFMPQSIYGFTTG

SEQ ID NO: 349484 - protein, 23 aa, Mycobacterium
AHILLNHLVVVLGPLTAILAIMC

SEQ ID NO: 349485 - protein, 18 aa, Mycobacterium
AHILTTAKPRVFVTTAQF

SEQ ID NO: 349486 - protein, 17 aa, Mycobacterium
AHKASVGSWRLVRDFAD

SEQ ID NO: 349487 - protein, 24 aa, Mycobacterium
AHKLENVMLVSAFLAAAALGQAVG

SEQ ID NO: 349488 - protein, 27 aa, Mycobacterium
AHKVENVMLVSAFLAAAALAQAVGHRT

SEQ ID NO: 349489 - protein, 24 aa, Mycobacterium
AHLAIRRFAPFTDPLLLPVVALLN

SEQ ID NO: 349490 - protein, 37 aa, Mycobacterium
AHLGRWATISCGVIVALITLATALFNGTFRSFVPLTL

SEQ ID NO: 349491 - protein, 22 aa, Mycobacterium
AHLLERPFELLGAPAAVTHTVA

SEQ ID NO: 349492 - protein, 31 aa, Mycobacterium
AHLLVAALTMAPLWMTPPAHAVSPPRVDEKW

SEQ ID NO: 349493 - protein, 22 aa, Mycobacterium
AHLQSPLLIALLICVIGAVVSA

SEQ ID NO: 349494 - protein, 28 aa, Mycobacterium
AHLSGAGWLWTVLAGLLAPVLVVAAPSF

SEQ ID NO: 349495 - protein, 20 aa, Mycobacterium
AHLVASMLVLIVLAGCAGLV

SEQ ID NO: 349496 - protein, 20 aa, Mycobacterium
AHMMLSMLVPVLLVLGGPVT

SEQ ID NO: 349497 - protein, 26 aa, Mycobacterium
AHNEVLFLFFAFLVGFGGGAFYPMFA

SEQ ID NO: 349498 - protein, 24 aa, Mycobacterium
AHNGSVHLYLGYGALGVLIILVVA

SEQ ID NO: 349499 - protein, 25 aa, Mycobacterium
AHNLVYKFLFPLLGGLMLAAVFVIS

SEQ ID NO: 349500 - protein, 26 aa, Mycobacterium
AHPESSHRWVPAAAGWIVGVIATLSL

SEQ ID NO: 349501 - protein, 30 aa, Mycobacterium; identical to SEQ ID NO: 21823

SEQ ID NO: 349502 - protein, 30 aa, Mycobacterium
AHPGTGGASLWWMIGLLAAAGVLGLMVVLP

SEQ ID NO: 349503 - protein, 31 aa, Mycobacterium
AHPGTGGASLWWMIGLLVAAGVLGLMVVLPI

SEQ ID NO: 349504 - protein, 19 aa, Mycobacterium
AHPLTLWRALGGAFLVCGV

SEQ ID NO: 349505 - protein, 26 aa, Mycobacterium
AHPTKVSRLVLDSPLPLAIGAEAAAE

SEQ ID NO: 349506 - protein, 18 aa, Mycobacterium
AHQAGLIHRDVKPSNILI

SEQ ID NO: 349507 - protein, 32 aa, Mycobacterium
AHQPNEMLAGLPLIPFTPRWLVRRAEGIAMSS

SEQ ID NO: 349508 - protein, 21 aa, Mycobacterium
AHRRELVYLPPAWFNSNPPPR

SEQ ID NO: 349509 - protein, 17 aa, Mycobacterium
AHRRLVAVVSIAVTLVA

SEQ ID NO: 349510 - protein, 29 aa, Mycobacterium
AHRVAPSARLLVIGPPWPTPDVPIPVLQI

SEQ ID NO: 349511 - protein, 26 aa, Mycobacterium
AHRVWLELTYFSGLGALIIFLAALAA

SEQ ID NO: 349512 - protein, 39 aa, Mycobacterium
AHRWMLRVRWLIEPTLVVLTVGLLVIGGLAWLFGARVVA

SEQ ID NO: 349513 - protein, 23 aa, Mycobacterium
AHSLVLMSVYLFLGGMAAASCNT

SEQ ID NO: 349514 - protein, 17 aa, Mycobacterium
AHTALLFIEPETATLAV

SEQ ID NO: 349515 - protein, 26 aa, Mycobacterium
AHTGRILMILVAVAVFLITTGIAAFL

SEQ ID NO: 349516 - protein, 22 aa, Mycobacterium
AHTRFDVLFARDIIDHSAQAVA

SEQ ID NO: 349517 - protein, 31 aa, Mycobacterium
AHTVSFSFDMSWEELFWLVEGHQVHVCDEEL

SEQ ID NO: 349518 - protein, 23 aa, Mycobacterium
AHVLLAVAGYNFGRFCLTPLPRE

SEQ ID NO: 349519 - protein, 20 aa, Mycobacterium
AHVLLRMDWQLALLLGAIVS

SEQ ID NO: 349520 - protein, 18 aa, Mycobacterium
AHWKPSTVQALRDALRTH

SEQ ID NO: 349521 - protein, 18 aa, Mycobacterium
AHWKPTAVQALRNGLRTH

SEQ ID NO: 349522 - protein, 24 aa, Mycobacterium
AHWPSSWWFDPAVGLAIAIVAVWQ

SEQ ID NO: 349523 - protein, 17 aa, Mycobacterium
AHWVWAPSGWLLKMGVL

SEQ ID NO: 349524 - protein, 18 aa, Mycobacterium
AHYPSFGVIVYAGALIFL

SEQ ID NO: 349525 - protein, 19 aa, Mycobacterium
AIAAAVVSFTAWLNAVAAR

SEQ ID NO: 349526 - protein, 21 aa, Mycobacterium
AIAAFVMVVFHLNILLAFPMG

SEQ ID NO: 349527 - protein, 38 aa, Mycobacterium
AIAAGALLFPGAHGWITYLWVPPFASEKVRRRLRPMAR

SEQ ID NO: 349528 - protein, 26 aa, Mycobacterium
AIAALALVLPVWAAALIVAVVLFAIA

SEQ ID NO: 349529 - protein, 27 aa, Mycobacterium
AIAALLGRWFWWPQRIRRRPAITSQAP

SEQ ID NO: 349530 - protein, 18 aa, Mycobacterium
AIAALQNRGFKTRTLLKP

SEQ ID NO: 349531 - protein, 17 aa, Mycobacterium
AIAALRKLGLQVVMITG

SEQ ID NO: 349532 - protein, 27 aa, Mycobacterium
AIAALSLIFLIMLNITRSAIAALVIVG

SEQ ID NO: 349533 - protein, 34 aa, Mycobacterium
AIAALVMIGFILGWPWWWISACSVLVLLVLEGVA

SEQ ID NO: 349534 - protein, 23 aa, Mycobacterium
AIAALWAFWLHLTRRTESRVVDR

SEQ ID NO: 349535 - protein, 43 aa, Mycobacterium
AIAAPRHSAPPRPRLPWFLRTFAVPIILAWVAVVAILNTVVPT

SEQ ID NO: 349536 - protein, 25 aa, Mycobacterium
AIAAPRRIIAIAVLLLVGAAVFGLP

SEQ ID NO: 349537 - protein, 28 aa, Mycobacterium
AIAAPRRIIGVALLVFIAAAVFGIPVAN

SEQ ID NO: 349538 - protein, 21 aa, Mycobacterium
AIAAPRRVLMAALLVAIACGV

SEQ ID NO: 349539 - protein, 23 aa, Mycobacterium
AIAAQWLVPIGVLITLLVGGVMS

SEQ ID NO: 349540 - protein, 28 aa, Mycobacterium
AIACLHFTRLPYFKPLGIPGAVGILVAV

SEQ ID NO: 349541 - protein, 20 aa, Mycobacterium
AIADLYPRYVCDYGTPSHPP

SEQ ID NO: 349542 - protein, 22 aa, Mycobacterium
AIADYPAVLLNGSWLSQEQTTA

SEQ ID NO: 349543 - protein, 23 aa, Mycobacterium
AIAFAPFAWLSLPLASSAITATT

SEQ ID NO: 349544 - protein, 29 aa, Mycobacterium
AIAGAFAALFLPYSLLGPFAGALLDRWDR

SEQ ID NO: 349545 - protein, 22 aa, Mycobacterium
AIAGLIGILFKNVLYKTEDLCD

SEQ ID NO: 349546 - protein, 21 aa, Mycobacterium
AIAGWLLDLGAVGILALAGVT

SEQ ID NO: 349547 - protein, 17 aa, Mycobacterium
AIAILGTVLFTRGKHSK

SEQ ID NO: 349548 - protein, 26 aa, Mycobacterium
AIAIMILLYAVVFAVSLYVGACLISA

SEQ ID NO: 349549 - protein, 34 aa, Mycobacterium
AIALALVAALAVLVTVFTLLRDRPAPVMSAKLPA

SEQ ID NO: 349550 - protein, 22 aa, Mycobacterium
AIALHLLFGLPLLLGGVITGIV

SEQ ID NO: 349551 - protein, 23 aa, Mycobacterium
AIALILGVLIYNSPLGVAAGNAV

SEQ ID NO: 349552 - protein, 27 aa, Mycobacterium
AIALLILAVLVAVITMLWVTSAGDSAA

SEQ ID NO: 349553 - protein, 17 aa, Mycobacterium
AIALPRWGTTEVVSEVV

SEQ ID NO: 349554 - protein, 30 aa, Mycobacterium
AIALSAFTLIPYALVLLGLRVFYAREQPWT

SEQ ID NO: 349555 - protein, 24 aa, Mycobacterium
AIANHQPWLRRALGGGIGPGATDT

SEQ ID NO: 349556 - protein, 23 aa, Mycobacterium
AIAPWYLLTALANCSWLFAWHHN

SEQ ID NO: 349557 - protein, 17 aa, Mycobacterium
AIARRFALSPIPVYLLA

SEQ ID NO: 349558 - protein, 38 aa, Mycobacterium
AIASAGFYAYLLTHVLFLNYVWGYTLLQAGLAVCPAAI

SEQ ID NO: 349559 - protein, 27 aa, Mycobacterium
AIASGPFFKVVLHNLALYQISQPWVDA

SEQ ID NO: 349560 - protein, 17 aa, Mycobacterium
AIASLISSFTGVFCCCL

SEQ ID NO: 349561 - protein, 24 aa, Mycobacterium
AIASPGLQRRRPWRTLQRNLAEAD

SEQ ID NO: 349562 - protein, 31 aa, Mycobacterium
AIATPPAPPVLAPLAPVVPPTPPVVTVKQAE

SEQ ID NO: 349563 - protein, 32 aa, Mycobacterium
AIATRLPMVLTFIVLITVVLVFLLTGSAVLPV

SEQ ID NO: 349564 - protein, 26 aa, Mycobacterium
AIAVLLFLIIKVRLHAFFSLIVVSVL

SEQ ID NO: 349565 - protein, 19 aa, Mycobacterium
AIAVLLMWSNTVVATPHWA

SEQ ID NO: 349566 - protein, 20 aa, Mycobacterium
AIAVLVLIGYGLDIGRLVAD

SEQ ID NO: 349567 - protein, 21 aa, Mycobacterium
AIAVWCVTAIIGAFAAHRGYR

SEQ ID NO: 349568 - protein, 19 aa, Mycobacterium
AICFVAVALGAVWLGRIRP

SEQ ID NO: 349569 - protein, 19 aa, Mycobacterium
AICIRLLVGLVFLSEGIQK

SEQ ID NO: 349570 - protein, 28 aa, Mycobacterium
AICITIIMSLTYRSLFTASMPLLVVAVA

SEQ ID NO: 349571 - protein, 29 aa, Mycobacterium
AICLGLLFDTFIIRAFMTPAIAALMGRWF

SEQ ID NO: 349572 - protein, 43 aa, Mycobacterium
AIDYLALAIRHYLDSGSFLMMAGPLAMIAVLLDRFGRHEQAAT

SEQ ID NO: 349573 - protein, 23 aa, Mycobacterium
AIEPQFFAALLAGLGLKADDVPN

SEQ ID NO: 349574 - protein, 28 aa, Mycobacterium
AIEQFSWVFYLFGAFLLYTAIKLVKDTD

SEQ ID NO: 349575 - protein, 23 aa, Mycobacterium
AIEWYDFFIFGTAAGLVFGVAFF

SEQ ID NO: 349576 - protein, 19 aa, Mycobacterium
AIFATYPFFIKMGRRLARL

SEQ ID NO: 349577 - protein, 20 aa, Mycobacterium
AIFAVLLVGFAIKAAVFPLS

SEQ ID NO: 349578 - protein, 19 aa, Mycobacterium
AIFGLFGAFALIAATIVLF

SEQ ID NO: 349579 - protein, 20 aa, Mycobacterium
AIGAFLLWRAIPALARNKEN

SEQ ID NO: 349580 - protein, 25 aa, Mycobacterium
AIGAYTFVPSTLRRLARGKIGVGTL

SEQ ID NO: 349581 - protein, 27 aa, Mycobacterium
AIGERLRDMLWAAIFPSIDLKTDSSRE

SEQ ID NO: 349582 - protein, 17 aa, Mycobacterium
AIGFAWLGIGTSYLAVL

SEQ ID NO: 349583 - protein, 23 aa, Mycobacterium
AIGFGWALVVLLATFVLGLVLWA

SEQ ID NO: 349584 - protein, 17 aa, Mycobacterium
AIGFLLKVGSTGVVFQT

SEQ ID NO: 349585 - protein, 29 aa, Mycobacterium
AIGFPWAVLVLLASFVLGLVLWAPMGGWQ

SEQ ID NO: 349586 - protein, 26 aa, Mycobacterium
AIGFSSFAVLLYYAIANASAATLGGR

SEQ ID NO: 349587 - protein, 30 aa, Mycobacterium
AIGGPLNVLLWLSYFVMLGLYAVAFGSYGA

SEQ ID NO: 349588 - protein, 31 aa, Mycobacterium
AIGGPLNVLLWLSYFVMLGLYAVAFGSYGAV

SEQ ID NO: 349589 - protein, 34 aa, Mycobacterium
AIGGVILLVKRIWWPLALWLLLIVVNVDAGNPIG

SEQ ID NO: 349590 - protein, 24 aa, Mycobacterium
AIGIFVFFLVVAPPFREASSLATV

SEQ ID NO: 349591 - protein, 29 aa, Mycobacterium
AIGLSLLPVLVLLVLWRARRRGPDDPPAR

SEQ ID NO: 349592 - protein, 30 aa, Mycobacterium
AIGLVLVLLYSLLYYRVLGLLTALSLAASG

SEQ ID NO: 349593 - protein, 33 aa, Mycobacterium
AIGMTIPIAALEIMRARLTPAAFERSAALASTY

SEQ ID NO: 349594 - protein, 25 aa, Mycobacterium
AIGRIQEMLALPFDLSDAPPVRVLL

SEQ ID NO: 349595 - protein, 20 aa, Mycobacterium
AIGRRPMLLAGVAAALISAG

SEQ ID NO: 349596 - protein, 26 aa, Mycobacterium
AIGSLVTSLLALPLNIACFSGTIASI

SEQ ID NO: 349597 - protein, 23 aa, Mycobacterium
AIGSVIFIVASWSVARYAAPVVA

SEQ ID NO: 349598 - protein, 24 aa, Mycobacterium
AIGSWIPALLWGVAFSSLLAGLPV

SEQ ID NO: 349599 - protein, 18 aa, Mycobacterium
AIGTYYYMAPERFTDDTV

SEQ ID NO: 349600 - protein, 18 aa, Mycobacterium
AIGVIALPVWMVLTVPQR

SEQ ID NO: 349601 - protein, 24 aa, Mycobacterium
AIGWRIRNGVGEAVLAFALLMLFG

SEQ ID NO: 349602 - protein, 18 aa, Mycobacterium
AIGWYRPVADFLNPILEL

SEQ ID NO: 349603 - protein, 18 aa, Mycobacterium
AIHMLDPLIALESLYRYL

SEQ ID NO: 349604 - protein, 28 aa, Mycobacterium
AIHQEAALTWLLLVSVPIMAVANYWVMS

SEQ ID NO: 349605 - protein, 29 aa, Mycobacterium
AIHQEAALTWLLLVSVPVLAVANYWIMTH

SEQ ID NO: 349606 - protein, 29 aa, Mycobacterium
AIHQNAGLSWLLMVSMPALGLANWYIVHS

SEQ ID NO: 349607 - protein, 23 aa, Mycobacterium
AIHRPRAFGWDRQQWRSAALFAV

SEQ ID NO: 349608 - protein, 19 aa, Mycobacterium
AIIAGIFAAGLGLITLIIV

SEQ ID NO: 349609 - protein, 24 aa, Mycobacterium
AIIASMLLYRQIGFGYTRYQAEFA

SEQ ID NO: 349610 - protein, 33 aa, Mycobacterium
AIIFVLPALIMIGWWSGFPYWTTVAVCGFGGLL

SEQ ID NO: 349611 - protein, 33 aa, Mycobacterium
AIIIRVLAVERLFRAVVLGLAAWAVWEFRGARG

SEQ ID NO: 349612 - protein, 19 aa, Mycobacterium
AIIPLYIACLTISYLSCQL

SEQ ID NO: 349613 - protein, 32 aa, Mycobacterium
AIIQALLLISIVFGFTWWLGGRLGLEDKLRAL

SEQ ID NO: 349614 - protein, 24 aa, Mycobacterium
AIIRKPVLTLYRQRPPEVGLPSEN

SEQ ID NO: 349615 - protein, 23 aa, Mycobacterium
AIIVLVLIALTYHRLPWQGLPMG

SEQ ID NO: 349616 - protein, 26 aa, Mycobacterium
AIKAPLWPFHRWLPDAAVEATPATAV

SEQ ID NO: 349617 - protein, 31 aa, Mycobacterium
AIKNVIGAVWGWLSTTVFPALKTAFTAIGTG

SEQ ID NO: 349618 - protein, 50 aa, Mycobacterium
AIKQLHLRVLLICGGFVVGTFLVGSWMWSIMIKPFRLLAQHARAINAQSS

SEQ ID NO: 349619 - protein, 17 aa, Mycobacterium
AIKTGILPLMWFVLLCT

SEQ ID NO: 349620 - protein, 25 aa, Mycobacterium
AIKTGMLPLMWLSLGISAGVSLFGS

SEQ ID NO: 349621 - protein, 18 aa, Mycobacterium
AILAIMCALWPAARQRLV

SEQ ID NO: 349622 - protein, 23 aa, Mycobacterium
AILAPYPLWCTFATVLSTRIWML

SEQ ID NO: 349623 - protein, 25 aa, Mycobacterium
AILATWALIARALWPTGRTLCHVIV

SEQ ID NO: 349624 - protein, 19 aa, Mycobacterium
AILAVIKYRGVTTPGPVLE

SEQ ID NO: 349625 - protein, 18 aa, Mycobacterium
AILAVPHLPPAPLVFAQE

SEQ ID NO: 349626 - protein, 17 aa, Mycobacterium
AILAVPNLPPQPLTFAQ

SEQ ID NO: 349627 - protein, 18 aa, Mycobacterium
AILAVVGALLGAALGAVV

SEQ ID NO: 349628 - protein, 21 aa, Mycobacterium
AILDQLPSPVSWFGRPGSMAT

SEQ ID NO: 349629 - protein, 24 aa, Mycobacterium
AILGRYGLVIVIGWIGALKFADFE

SEQ ID NO: 349630 - protein, 26 aa, Mycobacterium
AILIDIFAIFIFYVVGVLLWSITLTQ

SEQ ID NO: 349631 - protein, 25 aa, Mycobacterium
AILLGLPIPYILFQNAANLGLIAGL

SEQ ID NO: 349632 - protein, 20 aa, Mycobacterium
AILLGLPIPYVLFMNAANVG

SEQ ID NO: 349633 - protein, 23 aa, Mycobacterium
AILLLAIWIGIGFIFRGVGTTVS

SEQ ID NO: 349634 - protein, 21 aa, Mycobacterium
AILNGNYFLDAGYTLKDALIV

SEQ ID NO: 349635 - protein, 19 aa, Mycobacterium
AILVFTSSAAVLVVEITAL

SEQ ID NO: 349636 - protein, 17 aa, Mycobacterium
AILVLALYRSGVGLERI

SEQ ID NO: 349637 - protein, 19 aa, Mycobacterium
AILVMGFPVLLKATSADLG

SEQ ID NO: 349638 - protein, 21 aa, Mycobacterium
AIMFAFRRPFQGREFLDQCWF

SEQ ID NO: 349639 - protein, 24 aa, Mycobacterium
AIMHLLTHGFFKAGLFLGAGSVMH

SEQ ID NO: 349640 - protein, 22 aa, Mycobacterium
AIMLPTCRAYFTTFAGVVLAGA

SEQ ID NO: 349641 - protein, 19 aa, Mycobacterium
AIMPTILVALPIGATLSIQ

SEQ ID NO: 349642 - protein, 18 aa, Mycobacterium
AIMTWMVYVRRPVTAPGR

SEQ ID NO: 349643 - protein, 19 aa, Mycobacterium
AINAARRAAGGPLGPLGAV

SEQ ID NO: 349644 - protein, 29 aa, Mycobacterium
AINAKLALLIFATLPMLGLATWQFRRASS

SEQ ID NO: 349645 - protein, 20 aa, Mycobacterium
AINFLIVAAVIYFVIVVPFK

SEQ ID NO: 349646 - protein, 31 aa, Mycobacterium
AINFLIVAAVLYFVIMLPYKKLRERGEVEQA

SEQ ID NO: 349647 - protein, 24 aa, Mycobacterium
AINFWAWNMIGPLSTTYAGDMRLS

SEQ ID NO: 349648 - protein, 24 aa, Mycobacterium
AINFWAWNMIGPLSTTYAGDMSLS

SEQ ID NO: 349649 - protein, 25 aa, Mycobacterium
AINHIPLRMQVWQGAVIAAAAALIA

SEQ ID NO: 349650 - protein, 18 aa, Mycobacterium
AINMAWRAAGGAAGPLGA

SEQ ID NO: 349651 - protein, 17 aa, Mycobacterium
AINPIYGPSLDGTLPGN

SEQ ID NO: 349652 - protein, 17 aa, Mycobacterium
AINPLRFAARALNLWSS

SEQ ID NO: 349653 - protein, 27 aa, Mycobacterium
AINQFSWIFYLFGAFLVYTAINLARDT

SEQ ID NO: 349654 - protein, 25 aa, Mycobacterium
AINQFSWVFYIFGAFLVYTAVNLVR

SEQ ID NO: 349655 - protein, 23 aa, Mycobacterium
AINTLVLSVFFLKSTLSTATELY

SEQ ID NO: 349656 - protein, 26 aa, Mycobacterium
AIPATYLLVRYRYLKAEPLPPPRPGV

SEQ ID NO: 349657 - protein, 23 aa, Mycobacterium
AIPDLFKTGLPNTLILTICASII

SEQ ID NO: 349658 - protein, 26 aa, Mycobacterium
AIPFVYDHKVFFAVAAILLVTALNLR

SEQ ID NO: 349659 - protein, 18 aa, Mycobacterium
AIPGLPDVPAAPSPITGP

SEQ ID NO: 349660 - protein, 31 aa, Mycobacterium
AIPISFVVLVWIFGGLYAALLPLVVGVFSIV

SEQ ID NO: 349661 - protein, 25 aa, Mycobacterium
AIPLAALGMLNPMLAGAAMALSSVL

SEQ ID NO: 349662 - protein, 27 aa, Mycobacterium
AIPLIVVKLWSVWPKLFERPVIGGFVR

SEQ ID NO: 349663 - protein, 26 aa, Mycobacterium
AIPLLAAIVPAPRLWPHSWPFVAQVL

SEQ ID NO: 349664 - protein, 24 aa, Mycobacterium
AIPLSFVVLVWAFGGLLAALLPVT

SEQ ID NO: 349665 - protein, 30 aa, Mycobacterium
AIPLSFVVLVWVFGGLLAAALPLAVGGFAI

SEQ ID NO: 349666 - protein, 30 aa, Mycobacterium
AIPLSFVVLVWVFGGLLAAALPLAVGVFAI

SEQ ID NO: 349667 - protein, 24 aa, Mycobacterium
AIPTLFKTGLPNTLILTLSASIIG

SEQ ID NO: 349668 - protein, 26 aa, Mycobacterium
AIPTYAFIIGISAMLGWGLFRIYVLG

SEQ ID NO: 349669 - protein, 34 aa, Mycobacterium
AIPVGLAIIVLLIALGIPFLNIKWGYPDDRVLPP

SEQ ID NO: 349670 - protein, 18 aa, Mycobacterium
AIQFGAFASLAGALGAVT

SEQ ID NO: 349671 - protein, 17 aa, Mycobacterium
AIQFGIFAGLSGALGAV

SEQ ID NO: 349672 - protein, 20 aa, Mycobacterium
AIQRYFHGSSISSLSWVLNA

SEQ ID NO: 349673 - protein, 28 aa, Mycobacterium
AIQTIVVIVWILLNLGAFAWQWDPYPFI

SEQ ID NO: 349674 - protein, 36 aa, Mycobacterium
AIRARIPWVLGFIAAVTFTLLFLLTGSVVLPVKAVI

SEQ ID NO: 349675 - protein, 24 aa, Mycobacterium
AIRDPRLLVTCGIVLLAVFTAFIA

SEQ ID NO: 349676 - protein, 17 aa, Mycobacterium
AIRDTHLQAFLAAKAAA

SEQ ID NO: 349677 - protein, 24 aa, Mycobacterium
AIRGWLRTQLLRPASIKIIRINEF

SEQ ID NO: 349678 - protein, 24 aa, Mycobacterium
AIRIRFWRRIGTAVVRWPAPILLA

SEQ ID NO: 349679 - protein, 27 aa, Mycobacterium
AIRLGTFLLVCFLGVIGLFAVFGQLRF

SEQ ID NO: 349680 - protein, 21 aa, Mycobacterium
AIRNWLVDYLVTNIGCSPDEI

SEQ ID NO: 349681 - protein, 19 aa, Mycobacterium
AIRPIPFLVTTRLVASIVA

SEQ ID NO: 349682 - protein, 21 aa, Mycobacterium
AIRRHPHPDTLWTLVGGARMW

SEQ ID NO: 349683 - protein, 40 aa, Mycobacterium
AIRRQLRLFVARRVSFLFLLLLPFALGGLTLLIPGDSGFD

SEQ ID NO: 349684 - protein, 19 aa, Mycobacterium
AIRSLWYYTAKAFHFHATL

SEQ ID NO: 349685 - protein, 27 aa, Mycobacterium
AIRTVRFWAAPLIITLALMSALCALYL

SEQ ID NO: 349686 - protein, 20 aa, Mycobacterium
AIRVTTILGSRYLDLQPEGP

SEQ ID NO: 349687 - protein, 24 aa, Mycobacterium
AISAAWDFVSPILDKFSAGWDALK

SEQ ID NO: 349688 - protein, 26 aa, Mycobacterium
AISEVLLDTYFQPGKLPDSLADMLRG

SEQ ID NO: 349689 - protein, 24 aa, Mycobacterium
AISFFLGTAFLVGAPLPLVGDILV

SEQ ID NO: 349690 - protein, 22 aa, Mycobacterium
AISFPDLLHFGAPRFDVLAICS

SEQ ID NO: 349691 - protein, 17 aa, Mycobacterium
AISFVVLFILRGLGSRA

SEQ ID NO: 349692 - protein, 22 aa, Mycobacterium
AISLALALIIATSISMIFGELV

SEQ ID NO: 349693 - protein, 23 aa, Mycobacterium
AISLLVLQLLASLALLRALRVML

SEQ ID NO: 349694 - protein, 17 aa, Mycobacterium
AISLVTAPLYLLAERSG

SEQ ID NO: 349695 - protein, 21 aa, Mycobacterium
AISMLFTIAAALTLAPALLTL

SEQ ID NO: 349696 - protein, 42 aa, Mycobacterium
AISQALRLTYMIFFSIPVVAPLLLRLTLSIPALRRNAVDNIP

SEQ ID NO: 349697 - protein, 28 aa, Mycobacterium
AISRRWRPAWIGWWVALGLAAAVAGGDF

SEQ ID NO: 349698 - protein, 23 aa, Mycobacterium
AISTLMIFPLVMYGMKVLSQLQL

SEQ ID NO: 349699 - protein, 28 aa, Mycobacterium
AISVVLTPISRLLVLIGNALTPGRGFRN

SEQ ID NO: 349700 - protein, 23 aa, Mycobacterium
AISYAIPGLVPPGVSFGPKSTEK

SEQ ID NO: 349701 - protein, 26 aa, Mycobacterium
AISYEPFPIWQILWDLIKVVGTEILA

SEQ ID NO: 349702 - protein, 29 aa, Mycobacterium
AISYGVYLWHWPIFLILNGERTGASGWQL

SEQ ID NO: 349703 - protein, 33 aa, Mycobacterium
AITAGVLALVLLVWWRGTFLTDILGRLTKMLAR

SEQ ID NO: 349704 - protein, 22 aa, Mycobacterium
AITAWLAAIVSVLGTWISAAAL

SEQ ID NO: 349705 - protein, 18 aa, Mycobacterium
AITILLMAGATLCVGLVP

SEQ ID NO: 349706 - protein, 32 aa, Mycobacterium
AITLRDLRIPAIGLALLLLSSVIVGAAWPMIV

SEQ ID NO: 349707 - protein, 37 aa, Mycobacterium
AITQRLPIVFALIALITFALLFLLTGSAVLPLQALVC

SEQ ID NO: 349708 - protein, 25 aa, Mycobacterium
AITSRLPWLFGFVACVTLVLLFALT

SEQ ID NO: 349709 - protein, 17 aa, Mycobacterium
AITVCSLMFASHVTRYH

SEQ ID NO: 349710 - protein, 45 aa, Mycobacterium
AIVAYTIILAFVLPFLILVEAFVFTILGLMFSIFVGFLGLLFGPP

SEQ ID NO: 349711 - protein, 23 aa, Mycobacterium
AIVCDVALAGSPRALRLTRGGPT

SEQ ID NO: 349712 - protein, 25 aa, Mycobacterium
AIVCTVIALLALWRLDRLDGRRMHR

SEQ ID NO: 349713 - protein, 19 aa, Mycobacterium
AIVDFGLYVALLAAGLHVN

SEQ ID NO: 349714 - protein, 23 aa, Mycobacterium
AIVDFGLYVLLLAAGLHVNVAKT

SEQ ID NO: 349715 - protein, 26 aa, Mycobacterium
AIVEPIYYPRYLILTAPAAAVILAVC

SEQ ID NO: 349716 - protein, 24 aa, Mycobacterium
AIVGAITFFFIQREQKLLIEKELV

SEQ ID NO: 349717 - protein, 32 aa, Mycobacterium
AIVGGLVLLGPTLLVVLKVLDAAPAAIISACS

SEQ ID NO: 349718 - protein, 28 aa, Mycobacterium
AIVGGSLGVFLIALLVLGLTTNNSSTES

SEQ ID NO: 349719 - protein, 50 aa, Mycobacterium
AIVIALITPLLIFTYAIVFAILALILGPPLLLIASPFLLGGSLLALPAAA

SEQ ID NO: 349720 - protein, 23 aa, Mycobacterium
AIVIALPLLWWRYRHTDREALTG

SEQ ID NO: 349721 - protein, 29 aa, Mycobacterium
AIVLFIASIVVLVIALRRPKQPGPPRGRQ

SEQ ID NO: 349722 - protein, 29 aa, Mycobacterium
AIVLFIASIVVLVIALRRPKRPAERAGRP

SEQ ID NO: 349723 - protein, 21 aa, Mycobacterium
AIVLIALYEALTGRRTRTRLP

SEQ ID NO: 349724 - protein, 17 aa, Mycobacterium
AIVLITMAMLWTAGGEN

SEQ ID NO: 349725 - protein, 35 aa, Mycobacterium
AIVLRDLRIPAIGLVLLLLSSLIVGAAWPMIVEQI

SEQ ID NO: 349726 - protein, 20 aa, Mycobacterium
AIVPLPWVIQAPRLFAGQID

SEQ ID NO: 349727 - protein, 17 aa, Mycobacterium
AIVRRWLAKADSHDIAS

SEQ ID NO: 349728 - protein, 26 aa, Mycobacterium
AIVSTYLLLPVLRWQYRSPDFESEGS

SEQ ID NO: 349729 - protein, 23 aa, Mycobacterium
AIVVVVFVAAWWVLAPLSRYPGT

SEQ ID NO: 349730 - protein, 22 aa, Mycobacterium
AIVVYALMWIGYRQDWGWLHAM

SEQ ID NO: 349731 - protein, 26 aa, Mycobacterium
AIVVYVLMAILLLMPLVLKLMHRSEE

SEQ ID NO: 349732 - protein, 22 aa, Mycobacterium
AIVWGLIFWTSAFHRKKATDTE

SEQ ID NO: 349733 - protein, 20 aa, Mycobacterium
AIYCGGLAALLLAAAAIILA

SEQ ID NO: 349734 - protein, 28 aa, Mycobacterium
AIYGMNFRFMPELTWTWGYPGVMAVMVV

SEQ ID NO: 349735 - protein, 17 aa, Mycobacterium
AIYLAYVAGLTLVVGVL

SEQ ID NO: 349736 - protein, 24 aa, Mycobacterium
AKAAFDKLPGYAVPLFVRIVEELA

SEQ ID NO: 349737 - protein, 24 aa, Mycobacterium
AKAPILQVLRYAPKMILLVVLLGL

SEQ ID NO: 349738 - protein, 23 aa, Mycobacterium
AKATLYYYFAGKEEILAFLLEDV

SEQ ID NO: 349739 - protein, 28 aa, Mycobacterium
AKDIGRIIKSWFLGLRAPEHRDADYRLG

SEQ ID NO: 349740 - protein, 17 aa, Mycobacterium
AKDPAERYPTCADFAAA

SEQ ID NO: 349741 - protein, 24 aa, Mycobacterium
AKELFNIFLIIAIVTAMLGALREM

SEQ ID NO: 349742 - protein, 21 aa, Mycobacterium
AKFAAWMVFVPVWAVVVYSVV

SEQ ID NO: 349743 - protein, 23 aa, Mycobacterium
AKFAYGPILEKYEMLGGPAGSDL

SEQ ID NO: 349744 - protein, 19 aa, Mycobacterium
AKFFTYTGVFLIVVAAGIL

SEQ ID NO: 349745 - protein, 24 aa, Mycobacterium
AKFWTLLEIIPNLTLIVVLGFGAY

SEQ ID NO: 349746 - protein, 24 aa, Mycobacterium
AKFWTLLEVIPNLTLIVVLGFGAY

SEQ ID NO: 349747 - protein, 26 aa, Mycobacterium
AKGASWVRYAALGAVAAIMVGALVFS

SEQ ID NO: 349748 - protein, 24 aa, Mycobacterium
AKGPLVFDLGICLVLVTLPTLALF

SEQ ID NO: 349749 - protein, 20 aa, Mycobacterium
AKHPRLPRYDALKVLSASVS

SEQ ID NO: 349750 - protein, 24 aa, Mycobacterium
AKHQAKVYGLPPLGAPPMSVPHLD

SEQ ID NO: 349751 - protein, 17 aa, Mycobacterium
AKIAVFCVFAVVQAAIA

SEQ ID NO: 349752 - protein, 43 aa, Mycobacterium
AKIFGTDPLLFPFQPIHVTIAAWFTIGIPAFILSLAPNNERAK

SEQ ID NO: 349753 - protein, 50 aa, Mycobacterium
AKIGPVEISGFIAWLAWLVLHLVYLVGFKTKVSTLLSWTVTFLSTRRGQL

SEQ ID NO: 349754 - protein, 18 aa, Mycobacterium
AKILLEVNPKYLKLIPRN

SEQ ID NO: 349755 - protein, 22 aa, Mycobacterium
AKIMVTTILGSRYLSLEPAGDG

SEQ ID NO: 349756 - protein, 30 aa, Mycobacterium
AKLDTRRMWAIPIGVLSFVIALCAAGHLWK

SEQ ID NO: 349757 - protein, 23 aa, Mycobacterium
AKLGMPLLVALLLCYLGGIVSAF

SEQ ID NO: 349758 - protein, 30 aa, Mycobacterium
AKLRLFRVPELLAGSFLLALLAVTSANFFT

SEQ ID NO: 349759 - protein, 32 aa, Mycobacterium
AKLRLFRVPELLAGSFLLALLAVVAANFFAVP

SEQ ID NO: 349760 - protein, 34 aa, Mycobacterium
AKLVARIPEWILKALFVFVLLATAAKLLLSAAGI

SEQ ID NO: 349761 - protein, 29 aa, Mycobacterium
AKNNPFSLLFTLGGFIALLLLAQAVASRP

SEQ ID NO: 349762 - protein, 26 aa, Mycobacterium
AKNNPFSLLFTLGGFVALLILAQAVA

SEQ ID NO: 349763 - protein, 41 aa, Mycobacterium
AKPARSLTAVRPPPRRPAHRKLVGWLSAAAGLVLAAALGTG

SEQ ID NO: 349764 - protein, 26 aa, Mycobacterium
AKPEAMVWVALFWAFAALPADLHVGK

SEQ ID NO: 349765 - protein, 22 aa, Mycobacterium
AKPKIYRHFADKSDLFVAIGER

SEQ ID NO: 349766 - protein, 23 aa, Mycobacterium
AKPSTLALITFMLAAYAVLQVVE

SEQ ID NO: 349767 - protein, 24 aa, Mycobacterium
AKPSTLALITFMLAAYAVLQVVEG

SEQ ID NO: 349768 - protein, 32 aa, Mycobacterium
AKQLFGFTEGFFSPLFFVWLGASLHVRELGEN

SEQ ID NO: 349769 - protein, 19 aa, Mycobacterium
AKRWLLLGPAFVAAIAYVD

SEQ ID NO: 349770 - protein, 19 aa, Mycobacterium
AKSSTLAFSKPFFAQGLLN

SEQ ID NO: 349771 - protein, 31 aa, Mycobacterium
AKVDYADILYYSAPWMLFLGLAMSGVTAYVT

SEQ ID NO: 349772 - protein, 32 aa, Mycobacterium
AKVFALLVPLVYLAFIVYLLLGKFTNVVPPLQ

SEQ ID NO: 349773 - protein, 40 aa, Mycobacterium
AKVGKLEFGGFIAWLAWLLLHLYYLIGHRNRIAAMFAWGI

SEQ ID NO: 349774 - protein, 27 aa, Mycobacterium
AKVIVFVIIVIFLQVRPQGLFTVRTRS

SEQ ID NO: 349775 - protein, 18 aa, Mycobacterium
AKVRPLPGLPRSLPLAEA

SEQ ID NO: 349776 - protein, 26 aa, Mycobacterium
AKVSLVVPAIFFVLVSAFVGLQVKAA

SEQ ID NO: 349777 - protein, 17 aa, Mycobacterium
AKYDLMIAVLAALGLIT

SEQ ID NO: 349778 - protein, 24 aa, Mycobacterium
AKYGFLLVWVIVTANVMAGLVQYL

SEQ ID NO: 349779 - protein, 19 aa, Mycobacterium
ALAAFVMIVFHLNILLAFP

SEQ ID NO: 349780 - protein, 35 aa, Mycobacterium
ALAAGMLPILGWRNDFRWALLMTGLVVFAVADVAY

SEQ ID NO: 349781 - protein, 20 aa, Mycobacterium
ALAAGRWQALMLPATSLVIN

SEQ ID NO: 349782 - protein, 18 aa, Mycobacterium
ALAAILVGPYTGALCIAI

SEQ ID NO: 349783 - protein, 27 aa, Mycobacterium
ALAALLALFVLLLGPTLFLLQSWVQNL

SEQ ID NO: 349784 - protein, 25 aa, Mycobacterium
ALAALNFDKLPLLSSTKGYSAYFAD

SEQ ID NO: 349785 - protein, 28 aa, Mycobacterium
ALAARKRIAWLLLLTNVVLAAFLNAADI

SEQ ID NO: 349786 - protein, 20 aa, Mycobacterium
ALAATAFQLLTGKAPFQHSN

SEQ ID NO: 349787 - protein, 23 aa, Mycobacterium
ALAATILVLLAVSPGLAVDIGFA

SEQ ID NO: 349788 - protein, 25 aa, Mycobacterium
ALACFAWLTLLIRRPFTMAYAKDTT

SEQ ID NO: 349789 - protein, 19 aa, Mycobacterium
ALADLLYPRPTCDYVTPRK

SEQ ID NO: 349790 - protein, 22 aa, Mycobacterium
ALAERLFNRWGVRAVFFGRFIA

SEQ ID NO: 349791 - protein, 22 aa, Mycobacterium
ALAFKVWTRWPLRAVTAAGVYL

SEQ ID NO: 349792 - protein, 26 aa, Mycobacterium
ALAFTVVYLVPFVKYPPNPPAVGQAD

SEQ ID NO: 349793 - protein, 28 aa, Mycobacterium
ALAGALVGFVRWPMWLRTVVSVVSLAAI

SEQ ID NO: 349794 - protein, 19 aa, Mycobacterium
ALAGIALVAFVIVVQPTAS

SEQ ID NO: 349795 - protein, 60 aa, Mycobacterium
ALAGIFVCLFCAFYFMTVTYSLMTFWITTMLALLYGLLGQLSFGVLMLRIEETALGAVIG

SEQ ID NO: 349796 - protein, 32 aa, Mycobacterium
ALAGLRLLAGLIWLYNVVWKLPPDFGQRSNSG

SEQ ID NO: 349797 - protein, 25 aa, Mycobacterium
ALAGLWLIIELNLAVPLAIQTVVRT

SEQ ID NO: 349798 - protein, 24 aa, Mycobacterium
ALAGSLLFGLWHVATSFGLTSSNV

SEQ ID NO: 349799 - protein, 24 aa, Mycobacterium
ALAGSLLFGLWHVATSLGLTSGNV

SEQ ID NO: 349800 - protein, 24 aa, Mycobacterium
ALAGSLLFGLWHVATSLGLTSSNV

SEQ ID NO: 349801 - protein, 21 aa, Mycobacterium
ALAGTLLPIRTARGHLLVAHV

SEQ ID NO: 349802 - protein, 21 aa, Mycobacterium
ALAGVVVLLGAMWASNRLSRK

SEQ ID NO: 349803 - protein, 17 aa, Mycobacterium
ALAHARRSRQIMVQNVG

SEQ ID NO: 349804 - protein, 29 aa, Mycobacterium
ALAHRPWAPLWMVVLILVAIGLSFLAERV

SEQ ID NO: 349805 - protein, 23 aa, Mycobacterium
ALAHRTCVAPLPYAQADLDALQR

SEQ ID NO: 349806 - protein, 38 aa, Mycobacterium
ALAIFTLMMAFYTPIVLLFVGYLLLIGNTHLALEALTY

SEQ ID NO: 349807 - protein, 28 aa, Mycobacterium
ALAIIKPKFPARVRLFLLTLAVVDDVGA

SEQ ID NO: 349808 - protein, 28 aa, Mycobacterium
ALAILALKPLLTALFLRAGGTGGLLTPS

SEQ ID NO: 349809 - protein, 21 aa, Mycobacterium
ALAIVIAILIVLNHQDQQNSP

SEQ ID NO: 349810 - protein, 19 aa, Mycobacterium
ALAIYALVPAAPPWAAARC

SEQ ID NO: 349811 - protein, 29 aa, Mycobacterium
ALALAALVIFPMYFLRSFAYAGVAVVAFA

SEQ ID NO: 349812 - protein, 27 aa, Mycobacterium
ALALALLVLLPLLRPGYLLLRDAVSTP

SEQ ID NO: 349813 - protein, 31 aa, Mycobacterium
ALALFMVVSLTLTWLVYVSLRRDVAGDTARY

SEQ ID NO: 349814 - protein, 18 aa, Mycobacterium
ALALLHQGTLRQAVADGV

SEQ ID NO: 349815 - protein, 17 aa, Mycobacterium
ALALLITGAGIGIAWPH

SEQ ID NO: 349816 - protein, 18 aa, Mycobacterium
ALALLMLLSGWSSPTNGA

SEQ ID NO: 349817 - protein, 20 aa, Mycobacterium
ALALMLMPILGWANHRVGAR

SEQ ID NO: 349818 - protein, 27 aa, Mycobacterium
ALALNARWLALVFGSYLVFIAVREIVR

SEQ ID NO: 349819 - protein, 23 aa, Mycobacterium
ALALPMLCFPQVLFGGAIVPVDQ

SEQ ID NO: 349820 - protein, 17 aa, Mycobacterium
ALALTLPGCRRLRLPST

SEQ ID NO: 349821 - protein, 28 aa, Mycobacterium
ALALVAKLTHLYRPIPVRIDVTAAAQLP

SEQ ID NO: 349822 - protein, 22 aa, Mycobacterium
ALALVFALWAVSAGIWGPQSET

SEQ ID NO: 349823 - protein, 21 aa, Mycobacterium
ALALVPLWFVTLTGGWLMVRR

SEQ ID NO: 349824 - protein, 19 aa, Mycobacterium
ALALVRYLPKARGPAYAVL

SEQ ID NO: 349825 - protein, 22 aa, Mycobacterium
ALALVSAPWLIAVGAMCIAGAW

SEQ ID NO: 349826 - protein, 19 aa, Mycobacterium
ALALVYFGIAYGLYALTFF

SEQ ID NO: 349827 - protein, 17 aa, Mycobacterium
ALAMMVFSKSFSVLRSA

SEQ ID NO: 349828 - protein, 22 aa, Mycobacterium
ALAPTHTLLLAGRPSERLDAIA

SEQ ID NO: 349829 - protein, 25 aa, Mycobacterium
ALAQTRPELAAFDPVLAVALAKNPA

SEQ ID NO: 349830 - protein, 23 aa, Mycobacterium
ALARDWPVLTFTKPVSLRDRFPA

SEQ ID NO: 349831 - protein, 17 aa, Mycobacterium
ALARFPCEPFRPDAFFA

SEQ ID NO: 349832 - protein, 34 aa, Mycobacterium
ALARPFQWREFILQGWFLLGVSFLPTVMVAIPLT

SEQ ID NO: 349833 - protein, 49 aa, Mycobacterium
ALARRPVLRPIRWPAFPYDPWVRISLWIGVAIIALLFGWGAWQRRWIAD

SEQ ID NO: 349834 - protein, 18 aa, Mycobacterium
ALARRWVATLGAFNGRLA

SEQ ID NO: 349835 - protein, 22 aa, Mycobacterium
ALASAKLLIGGALFAVAEEKSG

SEQ ID NO: 349836 - protein, 27 aa, Mycobacterium
ALATLGSWRWIFIVNIPIGIVGFVLAL

SEQ ID NO: 349837 - protein, 23 aa, Mycobacterium
ALATLLWPTVGYPLLGAALLALT

SEQ ID NO: 349838 - protein, 17 aa, Mycobacterium
ALATVLLAAPAGAEPFV

SEQ ID NO: 349839 - protein, 26 aa, Mycobacterium
ALATVRALVGFPVKLGRLLRASRDGY

SEQ ID NO: 349840 - protein, 27 aa, Mycobacterium
ALAVAALVLLWRLIRRDSPQPAFSGFF

SEQ ID NO: 349841 - protein, 27 aa, Mycobacterium
ALAVCVPAALFLLPPRHHGQLRRRAAR

SEQ ID NO: 349842 - protein, 22 aa, Mycobacterium
ALAVFACPRPWQGPLAVLVAIG

SEQ ID NO: 349843 - protein, 36 aa, Mycobacterium
ALAVGFFGTLWTIQFFVYWLPYYLQHALAVPFSAVG

SEQ ID NO: 349844 - protein, 30 aa, Mycobacterium
ALAVIALLSLFYLFPTLLGVFSRLYVPQLL

SEQ ID NO: 349845 - protein, 29 aa, Mycobacterium
ALAVIALLSLFYLFPTLLGVFSRWYVPQL

SEQ ID NO: 349846 - protein, 21 aa, Mycobacterium
ALAVLLPVALLVACFGIVWNF

SEQ ID NO: 349847 - protein, 17 aa, Mycobacterium
ALAVPATLFFLGCFYVF

SEQ ID NO: 349848 - protein, 37 aa, Mycobacterium
ALAVPILAFLVVLVLLAGLGWLTYRAIRWARGRRESD

SEQ ID NO: 349849 - protein, 18 aa, Mycobacterium
ALAVPIWWAYAAAEILIT

SEQ ID NO: 349850 - protein, 18 aa, Mycobacterium
ALAVRRLVAVLAAAFSPR

SEQ ID NO: 349851 - protein, 25 aa, Mycobacterium
ALAVSLPMLLTARLLLGVTLGVAVV

SEQ ID NO: 349852 - protein, 27 aa, Mycobacterium
ALAVSRLLAGAAPRLAVTGLAVGALVG

SEQ ID NO: 349853 - protein, 29 aa, Mycobacterium
ALAVVLLAVFLWLERRTWHPILDLSIFAN

SEQ ID NO: 349854 - protein, 36 aa, Mycobacterium
ALCAGQWALWWANGFSWIWMAVGLVGAAAALIGMTS

SEQ ID NO: 349855 - protein, 17 aa, Mycobacterium
ALCLFTAVFIMLRRKRV

SEQ ID NO: 349856 - protein, 19 aa, Mycobacterium
ALCLPLARALRRSASVPAL

SEQ ID NO: 349857 - protein, 21 aa, Mycobacterium
ALCLPVFIDAYDQYGWQVKCG

SEQ ID NO: 349858 - protein, 25 aa, Mycobacterium
ALCLVLVIMLVLTRSLVAAVVIVGT

SEQ ID NO: 349859 - protein, 25 aa, Mycobacterium
ALDALAIRPIPYLVTTRLLASTVAV

SEQ ID NO: 349860 - protein, 20 aa, Mycobacterium
ALDEGLLPVLPQLSAKHQVV

SEQ ID NO: 349861 - protein, 18 aa, Mycobacterium
ALDGMAIVPGLGAIGRGL

SEQ ID NO: 349862 - protein, 25 aa, Mycobacterium
ALDGTPPQILFNYLGRFTGGSGNDW

SEQ ID NO: 349863 - protein, 25 aa, Mycobacterium
ALDHGYTYGLLWIAGAAVIVGGAAV

SEQ ID NO: 349864 - protein, 20 aa, Mycobacterium
ALDLDALIGGFRPVFQSLDP

SEQ ID NO: 349865 - protein, 32 aa, Mycobacterium
ALDLLQTIGFVWFELLITSCYLGAATALAERV

SEQ ID NO: 349866 - protein, 30 aa, Mycobacterium
ALDPDLVLFVILPPLLWSAGMESSYVALRR

SEQ ID NO: 349867 - protein, 35 aa, Mycobacterium
ALDQDFLFSWGWRIPFFFSLVLVAVALVIRFRLDD

SEQ ID NO: 349868 - protein, 30 aa, Mycobacterium
ALDRVTRPAAPRRRFSLAVVGSAAAAVLAI

SEQ ID NO: 349869 - protein, 18 aa, Mycobacterium
ALDSGFWHAVAQRVARRP

SEQ ID NO: 349870 - protein, 29 aa, Mycobacterium
ALDTVRGMRLSGVTSMFVVLGPSGTGKSS

SEQ ID NO: 349871 - protein, 31 aa, Mycobacterium
ALDVLLFYVFFEAMLIPMYFLIGGFGGGSGR

SEQ ID NO: 349872 - protein, 18 aa, Mycobacterium
ALEGYWRDQLCGAPPEID

SEQ ID NO: 349873 - protein, 23 aa, Mycobacterium
ALEHLMDTGEYRTIATMWGVEKG

SEQ ID NO: 349874 - protein, 20 aa, Mycobacterium
ALEHLMETGEYRAIATMWGV

SEQ ID NO: 349875 - protein, 22 aa, Mycobacterium
ALEIFPKLLDAFWLTIRLTIVG

SEQ ID NO: 349876 - protein, 24 aa, Mycobacterium
ALEILAHRMIWTLLLMAVVVAVSR

SEQ ID NO: 349877 - protein, 32 aa, Mycobacterium
ALELTRFDRAQAYWTRLGWSARGPIKTASRVD

SEQ ID NO: 349878 - protein, 30 aa, Mycobacterium
ALERFLAVAIPLFALPITAVAMRAWWQTGR

SEQ ID NO: 349879 - protein, 25 aa, Mycobacterium
ALERSLYVFMTSLAVWVLCLGWQPL

SEQ ID NO: 349880 - protein, 20 aa, Mycobacterium
ALESLYRYLRKFHALGERRY

SEQ ID NO: 349881 - protein, 31 aa, Mycobacterium
ALEVGGRVLLFLPPAWLLGTAMLGVSKILDN

SEQ ID NO: 349882 - protein, 31 aa, Mycobacterium
ALEVGGRVLLFLPPAWLLGTGMLGIAKILDN

SEQ ID NO: 349883 - protein, 25 aa, Mycobacterium
ALFAYVAPWHLSAARWYTWVIALVG

SEQ ID NO: 349884 - protein, 17 aa, Mycobacterium
ALFGAFLCGTRLLLGGC

SEQ ID NO: 349885 - protein, 20 aa, Mycobacterium
ALFIITGIVVALLIGDRRWA

SEQ ID NO: 349886 - protein, 17 aa, Mycobacterium
ALFIVTWAAAALGWRYT

SEQ ID NO: 349887 - protein, 18 aa, Mycobacterium
ALFLGGLVLLASIAATRL

SEQ ID NO: 349888 - protein, 32 aa, Mycobacterium
ALFVAILVMIGLLYLLCRLIYVIVDEAWVAKN

SEQ ID NO: 349889 - protein, 57 aa, Mycobacterium
ALFVIPAAMAYPWQTTFDRWLLGVAVAVVVILFAWWRGLFVTTLVARRIRLLTRRGR

SEQ ID NO: 349890 - protein, 25 aa, Mycobacterium
ALFVLAYFLFPVFSAPLSPTMTPEQ

SEQ ID NO: 349891 - protein, 26 aa, Mycobacterium
ALFVMLPIVWGLNQLGWHAAAQAPLW

SEQ ID NO: 349892 - protein, 26 aa, Mycobacterium
ALFVMLPLVWALNRLGWHAAAQAPLW

SEQ ID NO: 349893 - protein, 24 aa, Mycobacterium
ALGAKIPRGVLLYGPPGTGKTLLA

SEQ ID NO: 349894 - protein, 19 aa, Mycobacterium
ALGALLAALTRGRPAGPVV

SEQ ID NO: 349895 - protein, 25 aa, Mycobacterium
ALGAMLWRSLWGEAAPRTQILVPPT

SEQ ID NO: 349896 - protein, 31 aa, Mycobacterium
ALGATVLLIAGLITGSLLLKSTGRLNDYIRV

SEQ ID NO: 349897 - protein, 23 aa, Mycobacterium
ALGAWPHWTFSALGAGVIGAVLG

SEQ ID NO: 349898 - protein, 23 aa, Mycobacterium
ALGAWPHWTFTALGAGVIGAVLG

SEQ ID NO: 349899 - protein, 18 aa, Mycobacterium
ALGCTAFHLLAGSAPFQH

SEQ ID NO: 349900 - protein, 19 aa, Mycobacterium
ALGCTAFHLLAGSAPFQHT

SEQ ID NO: 349901 - protein, 27 aa, Mycobacterium
ALGDRRPELAPLDRVFAAALAKQPNER

SEQ ID NO: 349902 - protein, 24 aa, Mycobacterium
ALGDWVLAIPWWTLSFEIGLAAFL

SEQ ID NO: 349903 - protein, 20 aa, Mycobacterium
ALGFTAPPAVRPVTTRLLNA

SEQ ID NO: 349904 - protein, 18 aa, Mycobacterium
ALGGLLVLPGYRASFDDR

SEQ ID NO: 349905 - protein, 25 aa, Mycobacterium
ALGGTLLPHYRLLGGIPLAYAVIVS

SEQ ID NO: 349906 - protein, 20 aa, Mycobacterium
ALGIAYGCYALCAVLSLLFV

SEQ ID NO: 349907 - protein, 35 aa, Mycobacterium
ALGICVLLFPVVQPWYLLWAIIPLACWATRAGFRV

SEQ ID NO: 349908 - protein, 27 aa, Mycobacterium
ALGIFAGSAAMIMLLAAPGLRGADELS

SEQ ID NO: 349909 - protein, 17 aa, Mycobacterium
ALGIFGAALFFGDSMIT

SEQ ID NO: 349910 - protein, 19 aa, Mycobacterium
ALGILLGVMLIGLSVLIKA

SEQ ID NO: 349911 - protein, 25 aa, Mycobacterium
ALGLAGVYLVFAYSAFGFARGAGRP

SEQ ID NO: 349912 - protein, 24 aa, Mycobacterium
ALGLALAWLTTLWATAMLAGPRRI

SEQ ID NO: 349913 - protein, 23 aa, Mycobacterium
ALGLGGVFLFLLLNLSGFMGEKT

SEQ ID NO: 349914 - protein, 31 aa, Mycobacterium
ALGLKTKPALAPWVALRLLPQGPTLSRSDAL

SEQ ID NO: 349915 - protein, 21 aa, Mycobacterium
ALGLLAALFVFSYRPDREVDA

SEQ ID NO: 349916 - protein, 23 aa, Mycobacterium
ALGLLLWYSQFVADLTAPFIAAI

SEQ ID NO: 349917 - protein, 20 aa, Mycobacterium
ALGLLVGASLHRGMRYALTV

SEQ ID NO: 349918 - protein, 26 aa, Mycobacterium
ALGMSLLLDWKALWRHCATVAAFAAT

SEQ ID NO: 349919 - protein, 26 aa, Mycobacterium
ALGNAILIIPLGLVPSWLALASTGFD

SEQ ID NO: 349920 - protein, 22 aa, Mycobacterium
ALGNFYAFISLPDAARLLRAGN

SEQ ID NO: 349921 - protein, 34 aa, Mycobacterium
ALGNWAGFSVGWLYWYFWVIVVGFEAIAGAKIIQ

SEQ ID NO: 349922 - protein, 21 aa, Mycobacterium
ALGPFGAYLTGVSLLIGCFGI

SEQ ID NO: 349923 - protein, 20 aa, Mycobacterium
ALGPWPFYLLVEVTIVVAVW

SEQ ID NO: 349924 - protein, 35 aa, Mycobacterium
ALGSMAYPLYLWHWPLLIFWFAYSNDDTAGLTAGT

SEQ ID NO: 349925 - protein, 18 aa, Mycobacterium
ALGTFWYIQSEGLAGNPA

SEQ ID NO: 349926 - protein, 31 aa, Mycobacterium
ALGTIGLGAALLMAALLLSTYTSSRIAKIPL

SEQ ID NO: 349927 - protein, 27 aa, Mycobacterium
ALGVAALVLLWRLIRRDSPQPALSGFF

SEQ ID NO: 349928 - protein, 25 aa, Mycobacterium
ALGVAIYKLVWLKHTTSQNAHNLQG

SEQ ID NO: 349929 - protein, 19 aa, Mycobacterium
ALGVFQSLPKRVHERFDLV

SEQ ID NO: 349930 - protein, 20 aa, Mycobacterium
ALGVLIIGVVRWYWGIFSGR

SEQ ID NO: 349931 - protein, 23 aa, Mycobacterium
ALGVLSFSLSFPATAWALEGFGP

SEQ ID NO: 349932 - protein, 26 aa, Mycobacterium
ALGVPVWTILRWLWIGGSDVWALGEI

SEQ ID NO: 349933 - protein, 28 aa, Mycobacterium
ALGVRPIQLCRTVLAQAALIAGLGYLAG

SEQ ID NO: 349934 - protein, 33 aa, Mycobacterium
ALGVWFAVTGLGVATWMLLRLRLDHLRSQNWDR

SEQ ID NO: 349935 - protein, 21 aa, Mycobacterium
ALGWAAFLSLWTVQLLILNYG

SEQ ID NO: 349936 - protein, 30 aa, Mycobacterium
ALGWAIFHTLMIFWPFMQAAIQMAVVLAPM

SEQ ID NO: 349937 - protein, 17 aa, Mycobacterium
ALGWKVLIPVSLLWIMV

SEQ ID NO: 349938 - protein, 20 aa, Mycobacterium
ALGWRPPLAGLALGALIIAL

SEQ ID NO: 349939 - protein, 25 aa, Mycobacterium
ALGWRSAFGLVVFVGVLTLAALWFW

SEQ ID NO: 349940 - protein, 18 aa, Mycobacterium
ALGWWLLRRRTDVPPLAE

SEQ ID NO: 349941 - protein, 24 aa, Mycobacterium
ALGYAYFLVCLRLVPPATLTRRDE

SEQ ID NO: 349942 - protein, 19 aa, Mycobacterium
ALGYLNLAVWLIPGMFGVA

SEQ ID NO: 349943 - protein, 17 aa, Mycobacterium
ALHAWLCVGGFGGDGEA

SEQ ID NO: 349944 - protein, 32 aa, Mycobacterium
ALHDMTYIGLPPFYPPGWFWIGGRAAALTGSP

SEQ ID NO: 349945 - protein, 20 aa, Mycobacterium
ALHILFGLPLMVGGLITGVV

SEQ ID NO: 349946 - protein, 18 aa, Mycobacterium
ALHLFYVVKICLYVLGAW

SEQ ID NO: 349947 - protein, 19 aa, Mycobacterium
ALHLKVWATVLGVTVLCLA

SEQ ID NO: 349948 - protein, 42 aa, Mycobacterium
ALHLPQDAIRWAALVVLVLIGAGLIFPPLQHLIERPFAYLPQ

SEQ ID NO: 349949 - protein, 29 aa, Mycobacterium
ALHPRPPLWPLIITAYWAVALSPPLLILA

SEQ ID NO: 349950 - protein, 17 aa, Mycobacterium
ALHRSGYRVAMLTGDNA

SEQ ID NO: 349951 - protein, 20 aa, Mycobacterium
ALHSTFRWLLSAAAALWIVA

SEQ ID NO: 349952 - protein, 25 aa, Mycobacterium
ALHVLGWGMLIFLVAPAHFTVQGSV

SEQ ID NO: 349953 - protein, 31 aa, Mycobacterium
ALHYGYYPALFFAVALFVTVLYRVSLPEPLP

SEQ ID NO: 349954 - protein, 26 aa, Mycobacterium
ALIAFGLCWLALPLAFRSSNFRSTYM

SEQ ID NO: 349955 - protein, 17 aa, Mycobacterium
ALIAGNAAHERKKGEDL

SEQ ID NO: 349956 - protein, 17 aa, Mycobacterium
ALIAGSAAHERKKGEDL

SEQ ID NO: 349957 - protein, 26 aa, Mycobacterium
ALIAKGWIYALITLGLIIAVQQLEGH

SEQ ID NO: 349958 - protein, 27 aa, Mycobacterium
ALIALFPPYVMWLPNAIWKSFDLFVGA

SEQ ID NO: 349959 - protein, 26 aa, Mycobacterium
ALIAMFPWYIQWFPNAVWKTFDLFVG

SEQ ID NO: 349960 - protein, 26 aa, Mycobacterium
ALIAMFPWYIQWLPNAVWKTFDLFVG

SEQ ID NO: 349961 - protein, 29 aa, Mycobacterium
ALIAVAIVVAVLVLGSGVYVLLTHGKRHP

SEQ ID NO: 349962 - protein, 24 aa, Mycobacterium
ALIGAFYLFTLVLGYGAAALVGPD

SEQ ID NO: 349963 - protein, 21 aa, Mycobacterium
ALIGFVVLGFALYWAARGQAD

SEQ ID NO: 349964 - protein, 23 aa, Mycobacterium
ALIGIPVWMIFLCQAIVLVYQFP

SEQ ID NO: 349965 - protein, 18 aa, Mycobacterium
ALIGLVALVFAVITSNEL

SEQ ID NO: 349966 - protein, 19 aa, Mycobacterium
ALIGLVALVFAVVTSNQLV

SEQ ID NO: 349967 - protein, 18 aa, Mycobacterium
ALIGLVALVFAVVTSNVL

SEQ ID NO: 349968 - protein, 21 aa, Mycobacterium
ALIGLVNIVLLTAGATIGAFI

SEQ ID NO: 349969 - protein, 18 aa, Mycobacterium
ALIGSVGLMIAFYYGLTG

SEQ ID NO: 349970 - protein, 25 aa, Mycobacterium
ALIGSVGLVIAFYYGLTGYACAHYY

SEQ ID NO: 349971 - protein, 21 aa, Mycobacterium
ALIIAIGVFLAWRAIPALARN

SEQ ID NO: 349972 - protein, 17 aa, Mycobacterium
ALILGFVLGVGRLSTHT

SEQ ID NO: 349973 - protein, 17 aa, Mycobacterium
ALILLIAPGTLIARIAQ

SEQ ID NO: 349974 - protein, 18 aa, Mycobacterium
ALILLIASLTAQVGRNWP

SEQ ID NO: 349975 - protein, 23 aa, Mycobacterium
ALIMFGVFIAFLAAGDPIIKSVG

SEQ ID NO: 349976 - protein, 24 aa, Mycobacterium
ALIQLLCDRAFQWSLNAGEVIERV

SEQ ID NO: 349977 - protein, 19 aa, Mycobacterium
ALIQSLYLVILGAGIGLSM

SEQ ID NO: 349978 - protein, 32 aa, Mycobacterium
ALITYYALVSLFPLLLLLTTALGVVLAGRPDL

SEQ ID NO: 349979 - protein, 32 aa, Mycobacterium
ALITYYGFVSLFPLLLLLTTGLGVVLAGHPDL

SEQ ID NO: 349980 - protein, 25 aa, Mycobacterium
ALKCLTLIAFWGFAAAALRIVDYAV

SEQ ID NO: 349981 - protein, 18 aa, Mycobacterium
ALKDLGPIVYNLYGSTEV

SEQ ID NO: 349982 - protein, 25 aa, Mycobacterium
ALKRTWIALVILAVVVIAAFSVNRL

SEQ ID NO: 349983 - protein, 24 aa, Mycobacterium
ALKRVWIPLVIVAVVAVAGFSVYR

SEQ ID NO: 349984 - protein, 22 aa, Mycobacterium
ALLAFMLLTAGTAVFVAAEFSL

SEQ ID NO: 349985 - protein, 18 aa, Mycobacterium
ALLAIYFVGFDQGAVSLF

SEQ ID NO: 349986 - protein, 20 aa, Mycobacterium
ALLALAWLIYAVVLVVIAFA

SEQ ID NO: 349987 - protein, 31 aa, Mycobacterium
ALLALGMGALWLPWGWVAHRLLSAPLSAARA

SEQ ID NO: 349988 - protein, 18 aa, Mycobacterium
ALLALTGWLAWHDIARRT

SEQ ID NO: 349989 - protein, 17 aa, Mycobacterium
ALLALWLTRGGRIPGRR

SEQ ID NO: 349990 - protein, 28 aa, Mycobacterium
ALLANPGLPLWLFVLCAALTGLGGGNYA

SEQ ID NO: 349991 - protein, 38 aa, Mycobacterium
ALLAPLLVYRWGRLAFYPLALVPLGSLVWVVLNWPAKG

SEQ ID NO: 349992 - protein, 37 aa, Mycobacterium
ALLAVIAVVLYYVMLTFVARPYLIPSESMEPTLHGCT

SEQ ID NO: 349993 - protein, 32 aa, Mycobacterium
ALLAVPILPAFGWRPMFFVGAGTGLIILVTVV

SEQ ID NO: 349994 - protein, 33 aa, Mycobacterium
ALLAYYAFVSLFPLLLLLTTTLGVLLWNRPQWR

SEQ ID NO: 349995 - protein, 21 aa, Mycobacterium
ALLDLPPMESLPPEQARALMN

SEQ ID NO: 349996 - protein, 24 aa, Mycobacterium
ALLGAFAASFYWGHHFGRLFAHPD

SEQ ID NO: 349997 - protein, 25 aa, Mycobacterium
ALLGAFGFYLAFIAELPPPPPKPVK

SEQ ID NO: 349998 - protein, 21 aa, Mycobacterium
ALLGGLPMPVAVGTSLIVIAM

SEQ ID NO: 349999 - protein, 20 aa, Mycobacterium
ALLGLLSRAAITRPIASLAA

SEQ ID NO: 350000 - protein, 38 aa, Mycobacterium
ALLGPVFFVVRFLVLAPLSWLVPPLRRYVLTRASALMI

SEQ ID NO: 350001 - protein, 27 aa, Mycobacterium
ALLGSLLRPYRWAVVLLAVVVVVENAA

SEQ ID NO: 350002 - protein, 28 aa, Mycobacterium
ALLGSPLDAFLVSSVLLLNAALSAEQQL

SEQ ID NO: 350003 - protein, 24 aa, Mycobacterium
ALLGSPLDAVLVAGVLLVNAGLSA

SEQ ID NO: 350004 - protein, 23 aa, Mycobacterium
ALLGSPLDAVLVGSVLLVNAALS

SEQ ID NO: 350005 - protein, 29 aa, Mycobacterium
ALLGTLTALFLAALLSWAAIELAHLTGLA

SEQ ID NO: 350006 - protein, 17 aa, Mycobacterium
ALLGYRIMAWTTGLWLI

SEQ ID NO: 350007 - protein, 21 aa, Mycobacterium
ALLIELPLAAFLIFSAQRLMR

SEQ ID NO: 350008 - protein, 17 aa, Mycobacterium
ALLIGGLVLLASIVGTR

SEQ ID NO: 350009 - protein, 21 aa, Mycobacterium
ALLIGLVNIVLMTAAATIGAF

SEQ ID NO: 350010 - protein, 17 aa, Mycobacterium
ALLILLPTPAAAGEILG

SEQ ID NO: 350011 - protein, 19 aa, Mycobacterium
ALLLAVVCTWFLQTSMCMF

SEQ ID NO: 350012 - protein, 31 aa, Mycobacterium
ALLLDATIIRMFLVPAIMKLLGDDCWWAPRW

SEQ ID NO: 350013 - protein, 31 aa, Mycobacterium
ALLLDATIIRMFLVPAVMKLLGDDCWWAPRW

SEQ ID NO: 350014 - protein, 21 aa, Mycobacterium
ALLLDAVLALAVWLSAPGTGR

SEQ ID NO: 350015 - protein, 18 aa, Mycobacterium
ALLLIRAAGWQLSRLVSH

SEQ ID NO: 350016 - protein, 33 aa, Mycobacterium
ALLLLRARAHRHRTRWLLLVISGIVTGTTAFLI

SEQ ID NO: 350017 - protein, 17 aa, Mycobacterium
ALLLPYTAYREHVSPFV

SEQ ID NO: 350018 - protein, 30 aa, Mycobacterium
ALLLQVYVVMGAAWVWYRGLQGEPVPVFGS

SEQ ID NO: 350019 - protein, 17 aa, Mycobacterium
ALLLRSSLAPLNRLAES

SEQ ID NO: 350020 - protein, 20 aa, Mycobacterium
ALLMAVLLPISGRLTERFGA

SEQ ID NO: 350021 - protein, 17 aa, Mycobacterium
ALLPGRVVPSRALWAAL

SEQ ID NO: 350022 - protein, 18 aa, Mycobacterium
ALLPQLLAEFPPIIAVAK

SEQ ID NO: 350023 - protein, 51 aa, Mycobacterium
ALLRALQVILGWRPVLLIPLTFALFTPLGVPGFAWWAAALNSLPMLAALAW

SEQ ID NO: 350024 - protein, 32 aa, Mycobacterium
ALLRALWAILGWRPVLVVPLTFTLFTPLAVPG

SEQ ID NO: 350025 - protein, 26 aa, Mycobacterium
ALLRIPEVYVWVVVAIAATAWEQSAF

SEQ ID NO: 350026 - protein, 21 aa, Mycobacterium
ALLTFQVLVGRGIDPLFASTY

SEQ ID NO: 350027 - protein, 23 aa, Mycobacterium
ALLTFVWLDRIGLGGGAWAGFLC

SEQ ID NO: 350028 - protein, 23 aa, Mycobacterium
ALLTFVWLDRIGLGGGAWAGLLC

SEQ ID NO: 350029 - protein, 20 aa, Mycobacterium
ALLTLALTDVAAVFGFKLLS

SEQ ID NO: 350030 - protein, 18 aa, Mycobacterium
ALLVACFGIVWNFTRLGR

SEQ ID NO: 350031 - protein, 19 aa, Mycobacterium
ALLVTLVGSLWLLTGEHDD

SEQ ID NO: 350032 - protein, 28 aa, Mycobacterium
ALLWLVDIGVPTLIPWLSGFLILTIAGE

SEQ ID NO: 350033 - protein, 18 aa, Mycobacterium
ALMDLLFVAGIVTAILLV

SEQ ID NO: 350034 - protein, 21 aa, Mycobacterium
ALMFALAWLLLPDLPEYRTGL

SEQ ID NO: 350035 - protein, 19 aa, Mycobacterium
ALMFALAWLLVPDLPEYRT

SEQ ID NO: 350036 - protein, 20 aa, Mycobacterium
ALMFTLAWLLLPDLPEYRTG

SEQ ID NO: 350037 - protein, 21 aa, Mycobacterium
ALMFTLAWLLLPDLPEYRTGL

SEQ ID NO: 350038 - protein, 24 aa, Mycobacterium
ALMGEWRDDLRWPPASALVSQNEA

SEQ ID NO: 350039 - protein, 18 aa, Mycobacterium
ALMHYRGWAIPVAFVIAQ

SEQ ID NO: 350040 - protein, 17 aa, Mycobacterium
ALMLFNVVAFALVEIPL

SEQ ID NO: 350041 - protein, 28 aa, Mycobacterium
ALMLHYACGISWFPAVLVATAVAPTDPA

SEQ ID NO: 350042 - protein, 17 aa, Mycobacterium
ALMLLGIPPLLAGTYSG

SEQ ID NO: 350043 - protein, 24 aa, Mycobacterium
ALMNMSFYLAIDRLPLGTAVAIEF

SEQ ID NO: 350044 - protein, 18 aa, Mycobacterium
ALMRPQVGRIIIDQLRRI

SEQ ID NO: 350045 - protein, 20 aa, Mycobacterium
ALMTNPLLRRFNDLQATTLM

SEQ ID NO: 350046 - protein, 25 aa, Mycobacterium
ALMVPSLICAFSVAILDPFLDVGGK

SEQ ID NO: 350047 - protein, 26 aa, Mycobacterium
ALNAMAIRPIPYLVTTRLLASAVAII

SEQ ID NO: 350048 - protein, 25 aa, Mycobacterium
ALNFSLSWFATWLEKRMRRSRKGPA

SEQ ID NO: 350049 - protein, 17 aa, Mycobacterium
ALNLLGAFLSTAVAATI

SEQ ID NO: 350050 - protein, 20 aa, Mycobacterium
ALNLLHMIYSLVMVAMAVEI

SEQ ID NO: 350051 - protein, 19 aa, Mycobacterium
ALNLWVGYFPTVQAAWNQL

SEQ ID NO: 350052 - protein, 33 aa, Mycobacterium
ALNPPELPVIGFPPYIQQILPPSPGPVPATPAN

SEQ ID NO: 350053 - protein, 26 aa, Mycobacterium
ALNRWFFELVYWFFDFSGVSSYLVSA

SEQ ID NO: 350054 - protein, 24 aa, Mycobacterium
ALPAAIAGWAGLALILLGCTVLSV

SEQ ID NO: 350055 - protein, 20 aa, Mycobacterium
ALPAGWAWLENGWVMAIVAV

SEQ ID NO: 350056 - protein, 17 aa, Mycobacterium
ALPAIALLMRRAPVGWR

SEQ ID NO: 350057 - protein, 26 aa, Mycobacterium
ALPGAAALALLLWLRVRVPHPDSYEA

SEQ ID NO: 350058 - protein, 23 aa, Mycobacterium
ALPGVFYVLLWVGVVAASLLCGP

SEQ ID NO: 350059 - protein, 23 aa, Mycobacterium
ALPHLINGLGPLPWRAVLGIAAA

SEQ ID NO: 350060 - protein, 17 aa, Mycobacterium
ALPHRLWTRGSALVSAM

SEQ ID NO: 350061 - protein, 25 aa, Mycobacterium
ALPIDLIVGLFWGSAGMLVGRYLTA

SEQ ID NO: 350062 - protein, 17 aa, Mycobacterium
ALPIGLMVDRLGPRRVG

SEQ ID NO: 350063 - protein, 27 aa, Mycobacterium
ALPILPTQILWINMTTAIALGLMLAFE

SEQ ID NO: 350064 - protein, 17 aa, Mycobacterium
ALPKPIDHFLVQADLTV

SEQ ID NO: 350065 - protein, 17 aa, Mycobacterium
ALPLIAEDFRPSATTQL

SEQ ID NO: 350066 - protein, 19 aa, Mycobacterium
ALPLLAYFAIMWGGGYLLG

SEQ ID NO: 350067 - protein, 26 aa, Mycobacterium
ALPTYGFQHRRFWLGQLDAGRTDVGG

SEQ ID NO: 350068 - protein, 47 aa, Mycobacterium
ALPWVMGGCMLGMIAILIFGGLRNFSPYMLMMPMMVVMGAVGMMASG

SEQ ID NO: 350069 - protein, 25 aa, Mycobacterium
ALPWVMGGCMLGMIAIMVFTGVRQL

SEQ ID NO: 350070 - protein, 29 aa, Mycobacterium
ALQALVLRFGYLWAALASGLVLLAAGALA

SEQ ID NO: 350071 - protein, 29 aa, Mycobacterium
ALQASATRRGLLLTALGGLLIAGLITAIP

SEQ ID NO: 350072 - protein, 20 aa, Mycobacterium
ALQDWAYGRRFRYSETMSLG

SEQ ID NO: 350073 - protein, 17 aa, Mycobacterium
ALQIWEGGLGIWGAVAF

SEQ ID NO: 350074 - protein, 23 aa, Mycobacterium
ALQLAAALLLRYRSQAPQITLVP

SEQ ID NO: 350075 - protein, 36 aa, Mycobacterium
ALQLCSAICRHYWPIAMIAAVLFRRARHAVLVAAVV

SEQ ID NO: 350076 - protein, 25 aa, Mycobacterium
ALQLLAYFTTVFIAAPLALISGLGM

SEQ ID NO: 350077 - protein, 25 aa, Mycobacterium
ALQNRGFKTRTLLKPDSTIPPDHVI

SEQ ID NO: 350078 - protein, 31 aa, Mycobacterium
ALQPAILDVLPSWLSWFGRPGSMATIAVVVS

SEQ ID NO: 350079 - protein, 24 aa, Mycobacterium
ALQTDINVALPWTKTVVLDPGVEL

SEQ ID NO: 350080 - protein, 31 aa, Mycobacterium
ALQVHLTVFALAIVIGYYVIGNVHHALHTPL

SEQ ID NO: 350081 - protein, 20 aa, Mycobacterium
ALQVIVVAVVVLAGSVLAVY

SEQ ID NO: 350082 - protein, 17 aa, Mycobacterium
ALQVVLPTIWPGFQIIG

SEQ ID NO: 350083 - protein, 18 aa, Mycobacterium
ALRAFPLLIEEFQVLYAA

SEQ ID NO: 350084 - protein, 35 aa, Mycobacterium
ALRARVWDSSACKAWLLGHGYLVTTVLLVLSAAHE

SEQ ID NO: 350085 - protein, 31 aa, Mycobacterium
ALRCVEVLEWLAWSALVPLACWISELYSAVR

SEQ ID NO: 350086 - protein, 17 aa, Mycobacterium
ALRDFILEQRKIRDIAK

SEQ ID NO: 350087 - protein, 33 aa, Mycobacterium
ALRDMTYLGLPPFYPPGWFWIGGRAAALSGTPA

SEQ ID NO: 350088 - protein, 32 aa, Mycobacterium
ALRDMTYLGLPPFYPPGWFWIGGRAAALTGTP

SEQ ID NO: 350089 - protein, 20 aa, Mycobacterium
ALRERPLVRMLRLGGTASLP

SEQ ID NO: 350090 - protein, 26 aa, Mycobacterium
ALRFGGVWWAFVFPLGMYSAATEATA

SEQ ID NO: 350091 - protein, 17 aa, Mycobacterium
ALRGRVFGFHRAMDTFG

SEQ ID NO: 350092 - protein, 20 aa, Mycobacterium
ALRHIFGTRLFQRDYLEDHE

SEQ ID NO: 350093 - protein, 19 aa, Mycobacterium
ALRHRGLALDALAAAEPEP

SEQ ID NO: 350094 - protein, 20 aa, Mycobacterium
ALRIVAFSFFGLATYVAVDA

SEQ ID NO: 350095 - protein, 33 aa, Mycobacterium
ALRIWTAVVLVFLYIPLLLVLINAFNASRTFAF

SEQ ID NO: 350096 - protein, 27 aa, Mycobacterium
ALRMPFYRTLISMVAWLIGGVVFIIAS

SEQ ID NO: 350097 - protein, 39 aa, Mycobacterium
ALRPMRAIGRLSYSWYLWHWPVLLLAAPLLGRPLGPIDG

SEQ ID NO: 350098 - protein, 19 aa, Mycobacterium
ALRRKFSASGFLDDVREYG

SEQ ID NO: 350099 - protein, 25 aa, Mycobacterium
ALRRRLIICVALSVPVIAMAMAPPL

SEQ ID NO: 350100 - protein, 19 aa, Mycobacterium
ALRRRLTAGPVLHTNAKAL

SEQ ID NO: 350101 - protein, 24 aa, Mycobacterium
ALRTATLQRLLPRLGLTAQADQAA

SEQ ID NO: 350102 - protein, 32 aa, Mycobacterium
ALSAFFTPRFVNWFGLFTTHLIVAIALALTAV

SEQ ID NO: 350103 - protein, 31 aa, Mycobacterium
ALSAVLILAVSDWKAAWWAAAGVAAVLCVIA

SEQ ID NO: 350104 - protein, 48 aa, Mycobacterium
ALSDALVPAPLFLWETILAIIAFIAKLAEFIYLFVSELIALLIAGELL

SEQ ID NO: 350105 - protein, 26 aa, Mycobacterium
ALSILFCFAFFLLVFIGGGPYSLDAA

SEQ ID NO: 350106 - protein, 17 aa, Mycobacterium
ALSLGLLLLSGLLPNYR

SEQ ID NO: 350107 - protein, 28 aa, Mycobacterium
ALSLVAMVAFPMYFLKSFAYAGIAVVVF

SEQ ID NO: 350108 - protein, 18 aa, Mycobacterium
ALSLVQCLNWPSGSAPQD

SEQ ID NO: 350109 - protein, 22 aa, Mycobacterium
ALSNIFFLVAAFRPDRNPELIM

SEQ ID NO: 350110 - protein, 30 aa, Mycobacterium
ALSRAVGVAWRRSLQLRVVALTLGLSLAVV

SEQ ID NO: 350111 - protein, 22 aa, Mycobacterium
ALSRRWLAVAAAVSLLLTFSQS

SEQ ID NO: 350112 - protein, 37 aa, Mycobacterium
ALSTLAHHPALAKAFLRFNVHLLTSSTLPPRIRELAI

SEQ ID NO: 350113 - protein, 39 aa, Mycobacterium
ALSTLARHPALAKAFLRFNVHLLTSSTLPPRVRELAILR

SEQ ID NO: 350114 - protein, 21 aa, Mycobacterium
ALTALPVVFTLLRTRRPELGT

SEQ ID NO: 350115 - protein, 26 aa, Mycobacterium
ALTAVAGIFLVMAISRGVRARRGTAR

SEQ ID NO: 350116 - protein, 19 aa, Mycobacterium
ALTAVFGLGLVLVSAGSLG

SEQ ID NO: 350117 - protein, 27 aa, Mycobacterium
ALTAVLGLLLMRGQFIPGLNALDNPGQ

SEQ ID NO: 350118 - protein, 20 aa, Mycobacterium
ALTAVVCFVGFLGAYLFNVY

SEQ ID NO: 350119 - protein, 23 aa, Mycobacterium
ALTCGMFFIHDRPGYLWAGLVLM

SEQ ID NO: 350120 - protein, 21 aa, Mycobacterium
ALTDYLYLVTAIAGGVVAFLV

SEQ ID NO: 350121 - protein, 19 aa, Mycobacterium
ALTERYFYESFSDRDHFVR

SEQ ID NO: 350122 - protein, 18 aa, Mycobacterium
ALTFVPMYLRYVDGASAT

SEQ ID NO: 350123 - protein, 19 aa, Mycobacterium
ALTGLIELAIAMVSGSVAL

SEQ ID NO: 350124 - protein, 34 aa, Mycobacterium
ALTGVVCFVGFIASFLFNVYFQDGAPGSFVATFA

SEQ ID NO: 350125 - protein, 24 aa, Mycobacterium
ALTGVVCFVGFLASYLFNVFVQGG

SEQ ID NO: 350126 - protein, 22 aa, Mycobacterium
ALTGVVCFVGFLASYLFNVYFQ

SEQ ID NO: 350127 - protein, 20 aa, Mycobacterium
ALTHEGILAIRWRLPSGTEI

SEQ ID NO: 350128 - protein, 24 aa, Mycobacterium
ALTLAAGLVMLLLPISKGATWGWG

SEQ ID NO: 350129 - protein, 26 aa, Mycobacterium
ALTLAYVLRFFGPAASRRASVRLGII

SEQ ID NO: 350130 - protein, 27 aa, Mycobacterium
ALTLFMVVSLTLTWLVYVSLRRDVAGN

SEQ ID NO: 350131 - protein, 28 aa, Mycobacterium
ALTLLNRMRTLLFDALRASLEGLFKMIG

SEQ ID NO: 350132 - protein, 17 aa, Mycobacterium
ALTLLVTFCVPWLETVG

SEQ ID NO: 350133 - protein, 18 aa, Mycobacterium
ALTMQQWRRLPLVPATIV

SEQ ID NO: 350134 - protein, 25 aa, Mycobacterium
ALTNTCAMGMALAKLPYNRGTACDA

SEQ ID NO: 350135 - protein, 19 aa, Mycobacterium
ALTPFALLLVDFAGALRFD

SEQ ID NO: 350136 - protein, 32 aa, Mycobacterium
ALTTVLPLQAISWLLMPISRLLVVLGNAVTPG

SEQ ID NO: 350137 - protein, 17 aa, Mycobacterium
ALTVLLLLFSPPSLRWA

SEQ ID NO: 350138 - protein, 30 aa, Mycobacterium
ALTVPPNVSVWLPYVPFMIAGTVGPLVVMS

SEQ ID NO: 350139 - protein, 17 aa, Mycobacterium
ALTWMQFRGQFEDKVQL

SEQ ID NO: 350140 - protein, 18 aa, Mycobacterium
ALTYHRLPWQGLPMGNGE

SEQ ID NO: 350141 - protein, 20 aa, Mycobacterium
ALTYTRLPWRRLPAEGAEMP

SEQ ID NO: 350142 - protein, 17 aa, Mycobacterium
ALTYYWGLVLSSQALIS

SEQ ID NO: 350143 - protein, 25 aa, Mycobacterium
ALVAACFWALYILAGKRITGQQTGH

SEQ ID NO: 350144 - protein, 26 aa, Mycobacterium
ALVAAGITVWLGLVAQFGGVLGSSAP

SEQ ID NO: 350145 - protein, 27 aa, Mycobacterium
ALVAFGVVCWWVFFEKGLASAAYDAFQ

SEQ ID NO: 350146 - protein, 23 aa, Mycobacterium
ALVAFLIFGIVFLAGRFTVDGST

SEQ ID NO: 350147 - protein, 30 aa, Mycobacterium
ALVAIAITGVWLWLDYDALLLVVATQILQM

SEQ ID NO: 350148 - protein, 35 aa, Mycobacterium
ALVAIGLGLIFPRLEQWLQRPFSRIPHNSISAGGT

SEQ ID NO: 350149 - protein, 33 aa, Mycobacterium
ALVAIGVVLGWPLWWVSACSVLVLLILEGVAVN

SEQ ID NO: 350150 - protein, 20 aa, Mycobacterium
ALVALTMALALLLAPRASAD

SEQ ID NO: 350151 - protein, 20 aa, Mycobacterium
ALVASMAWLDRDQSPRFTPE

SEQ ID NO: 350152 - protein, 34 aa, Mycobacterium
ALVAVILAVVLVTGFWKPGFFVTTKLDVDAAQTG

SEQ ID NO: 350153 - protein, 17 aa, Mycobacterium
ALVAVLVLVNGLLSGSE

SEQ ID NO: 350154 - protein, 25 aa, Mycobacterium
ALVDLRPGVLCAIALNLLAGVRMVE

SEQ ID NO: 350155 - protein, 26 aa, Mycobacterium
ALVEWNWRAAFLINVPLAAFVIAVTL

SEQ ID NO: 350156 - protein, 17 aa, Mycobacterium
ALVFLFVADMWNGTCTG

SEQ ID NO: 350157 - protein, 23 aa, Mycobacterium
ALVFPKLFFPNASPAAGILLSFA

SEQ ID NO: 350158 - protein, 23 aa, Mycobacterium
ALVFPKLFFPQASPAAGILLSFA

SEQ ID NO: 350159 - protein, 22 aa, Mycobacterium
ALVFPMVFFPHLSPSGATIASM

SEQ ID NO: 350160 - protein, 26 aa, Mycobacterium
ALVGALGLLRRLPLQHAVGSAIAIAV

SEQ ID NO: 350161 - protein, 29 aa, Mycobacterium
ALVGALVPYIRWPMWLRTIAATVGLAIVL

SEQ ID NO: 350162 - protein, 17 aa, Mycobacterium
ALVGFMFIGRMIGDRLV

SEQ ID NO: 350163 - protein, 25 aa, Mycobacterium
ALVGGMLLVKAIGFGYTTYTAEFAQ

SEQ ID NO: 350164 - protein, 28 aa, Mycobacterium
ALVGHPWQVFGVLWLYCLAVGGAVTGVS

SEQ ID NO: 350165 - protein, 33 aa, Mycobacterium
ALVGILVAFLVLAVFLLPALRDGGPALPLALIA

SEQ ID NO: 350166 - protein, 25 aa, Mycobacterium
ALVGIVVSILLWPRGARASVTKAID

SEQ ID NO: 350167 - protein, 18 aa, Mycobacterium
ALVGLVALVFAVVTSNEL

SEQ ID NO: 350168 - protein, 28 aa, Mycobacterium
ALVIEGAFTLPFMAVYYGYPTLSLTEIC

SEQ ID NO: 350169 - protein, 29 aa, Mycobacterium
ALVIEGAFTLPFMAVYYGYPTLSLTEICS

SEQ ID NO: 350170 - protein, 28 aa, Mycobacterium
ALVIEGAFTLPFMAVYYGYPTLSLTQIC

SEQ ID NO: 350171 - protein, 22 aa, Mycobacterium
ALVIIAAIVLLQLLIANSDMTG

SEQ ID NO: 350172 - protein, 17 aa, Mycobacterium
ALVLAICYLIPLVRPRV

SEQ ID NO: 350173 - protein, 25 aa, Mycobacterium
ALVLALLVVGPLLGPGYLLLRDAVS

SEQ ID NO: 350174 - protein, 25 aa, Mycobacterium
ALVLDGLLALLVWASVPGTGRLRRT

SEQ ID NO: 350175 - protein, 26 aa, Mycobacterium
ALVLEIPLFLAMRIPLRAFLIRGAFI

SEQ ID NO: 350176 - protein, 18 aa, Mycobacterium
ALVLFAHVTIMHAALRIY

SEQ ID NO: 350177 - protein, 18 aa, Mycobacterium
ALVLFTLGSVFALYEGYH

SEQ ID NO: 350178 - protein, 25 aa, Mycobacterium
ALVLGWWIGVLVYLLPRRSWQRVAV

SEQ ID NO: 350179 - protein, 19 aa, Mycobacterium
ALVLIPWTVFLGLTLPGNY

SEQ ID NO: 350180 - protein, 17 aa, Mycobacterium
ALVLLGAPWSVPRAQAY

SEQ ID NO: 350181 - protein, 35 aa, Mycobacterium
ALVLRDLRIPAIGVALLLLSSLVVGAGWPLIVEQF

SEQ ID NO: 350182 - protein, 25 aa, Mycobacterium
ALVLSAIYMLWLYQRVMTGPVAKGN

SEQ ID NO: 350183 - protein, 21 aa, Mycobacterium
ALVLSTMPPLLAAIANAGRHG

SEQ ID NO: 350184 - protein, 17 aa, Mycobacterium
ALVLVVWALMTWPWESR

SEQ ID NO: 350185 - protein, 18 aa, Mycobacterium
ALVLWWRMVRFEYALIVT

SEQ ID NO: 350186 - protein, 23 aa, Mycobacterium
ALVNGLRLGLANAWLFLVAAELI

SEQ ID NO: 350187 - protein, 19 aa, Mycobacterium
ALVPDSMAALAALKADPGL

SEQ ID NO: 350188 - protein, 22 aa, Mycobacterium
ALVPVTAFGYGLRRGLSDDAVA

SEQ ID NO: 350189 - protein, 18 aa, Mycobacterium
ALVPVVATLLLILSAANL

SEQ ID NO: 350190 - protein, 30 aa, Mycobacterium
ALVQASSWRWVFLVNLPLGIIAVVVARRGL

SEQ ID NO: 350191 - protein, 26 aa, Mycobacterium
ALVQRLGERWVYMSGLLIVAASTGIC

SEQ ID NO: 350192 - protein, 17 aa, Mycobacterium
ALVRKSLLLTERSSART

SEQ ID NO: 350193 - protein, 26 aa, Mycobacterium
ALVSALLVGTGWIWSLSGDSLSTATR

SEQ ID NO: 350194 - protein, 23 aa, Mycobacterium
ALVSLLMLFIIQHTTNRDTNAVL

SEQ ID NO: 350195 - protein, 25 aa, Mycobacterium
ALVSLTQIVPLLLVLLSLEFMPRRR

SEQ ID NO: 350196 - protein, 20 aa, Mycobacterium
ALVTLAISPLPPLLPRRGEK

SEQ ID NO: 350197 - protein, 21 aa, Mycobacterium
ALVTMFRMLLGPTTLDRLVAL

SEQ ID NO: 350198 - protein, 19 aa, Mycobacterium
ALVTVNSQMYLLYDGKRAA

SEQ ID NO: 350199 - protein, 20 aa, Mycobacterium
ALVVFGAVMLLLYPLAAVWP

SEQ ID NO: 350200 - protein, 24 aa, Mycobacterium
ALVVGAPALLWPRQRQLLAARRVE

SEQ ID NO: 350201 - protein, 22 aa, Mycobacterium
ALVVGVLIYRSPWASAIGNTLT

SEQ ID NO: 350202 - protein, 20 aa, Mycobacterium
ALVVIAPAWSRRLTERGWPK

SEQ ID NO: 350203 - protein, 23 aa, Mycobacterium
ALVVIIALIITLVLLIQREDQQP

SEQ ID NO: 350204 - protein, 36 aa, Mycobacterium
ALVVQPTFLYELLWNLLIFAVLIYADRRFTLGHGRL

SEQ ID NO: 350205 - protein, 20 aa, Mycobacterium
ALVVRWPGPILVVTIGIALV

SEQ ID NO: 350206 - protein, 18 aa, Mycobacterium
ALVVSLAIAIRPTANVRP

SEQ ID NO: 350207 - protein, 28 aa, Mycobacterium
ALVVTLVFAPRFWVPIVAMAILVATHEV

SEQ ID NO: 350208 - protein, 21 aa, Mycobacterium
ALVVVVLHVNLLIGDTAALQA

SEQ ID NO: 350209 - protein, 20 aa, Mycobacterium
ALVWFWPAISVFVAAVFFAA

SEQ ID NO: 350210 - protein, 17 aa, Mycobacterium
ALWAIRHRTIETRSGTP

SEQ ID NO: 350211 - protein, 23 aa, Mycobacterium
ALWARFPLPVIPAPGDPTPSAPS

SEQ ID NO: 350212 - protein, 19 aa, Mycobacterium
ALWGQLLMIAVGGGLFVAG

SEQ ID NO: 350213 - protein, 19 aa, Mycobacterium
ALWNPGVWWQSIIVWFAAA

SEQ ID NO: 350214 - protein, 24 aa, Mycobacterium
ALWSSAWWIDPAMGLAIAGVAVWQ

SEQ ID NO: 350215 - protein, 18 aa, Mycobacterium
ALWVAFVFGLCGLPPPML

SEQ ID NO: 350216 - protein, 26 aa, Mycobacterium
ALWVVFLILFPWLTALVYVIARGKGM

SEQ ID NO: 350217 - protein, 26 aa, Mycobacterium
ALYALLIIPFLVYMASYWSWFASETG

SEQ ID NO: 350218 - protein, 18 aa, Mycobacterium
ALYALLVNQWPLPESGTR

SEQ ID NO: 350219 - protein, 26 aa, Mycobacterium
ALYIGNYWFVFHGIDYQLAYTPPSPF

SEQ ID NO: 350220 - protein, 17 aa, Mycobacterium
ALYLIGSLARFPQWLLD

SEQ ID NO: 350221 - protein, 17 aa, Mycobacterium
ALYLLGSLAGFPQWLLD

SEQ ID NO: 350222 - protein, 23 aa, Mycobacterium
ALYMQSWWDRRKGRHGRGIVLTA

SEQ ID NO: 350223 - protein, 23 aa, Mycobacterium
ALYSWSFLLLVFTGGGSLSLDRF

SEQ ID NO: 350224 - protein, 20 aa, Mycobacterium
ALYVAVCLLAALLALPEAAR

SEQ ID NO: 350225 - protein, 19 aa, Mycobacterium
AMAALLHWARAVPPVVAVA

SEQ ID NO: 350226 - protein, 21 aa, Mycobacterium
AMAAYLPLLAVLAAGGTLLHA

SEQ ID NO: 350227 - protein, 29 aa, Mycobacterium
AMAEFARLYPFQVFLDLYGLPLQDRDRVI

SEQ ID NO: 350228 - protein, 21 aa, Mycobacterium
AMAGLLWPVVAVATFAGLGLA

SEQ ID NO: 350229 - protein, 30 aa, Mycobacterium
AMALSYFGLPRWISVPLSAVLLFAVVAGGS

SEQ ID NO: 350230 - protein, 50 aa, Mycobacterium
AMAMIPALQFTYWQWASLTLAAPVIVWAAWPFHRAAWANLRHGTATMDTL

SEQ ID NO: 350231 - protein, 18 aa, Mycobacterium
AMAPFDALARRQAKIRIT

SEQ ID NO: 350232 - protein, 27 aa, Mycobacterium
AMAPNYGWFLAAWLMAGIAMAAVFYPP

SEQ ID NO: 350233 - protein, 20 aa, Mycobacterium
AMATLRVAFLSALVLELLAT

SEQ ID NO: 350234 - protein, 23 aa, Mycobacterium
AMATMRIAFLSALVLELLATLGV

SEQ ID NO: 350235 - protein, 26 aa, Mycobacterium
AMATTLFHWTLHPWAIYAVVGLAIAY

SEQ ID NO: 350236 - protein, 27 aa, Mycobacterium
AMATTLFHWTLHPWAIYAVVGLAIAYG

SEQ ID NO: 350237 - protein, 23 aa, Mycobacterium
AMAVAALGWLPPAVGALVQEGID

SEQ ID NO: 350238 - protein, 28 aa, Mycobacterium
AMAVFRDFPWRKVLPFSVAQLLGAFAAA

SEQ ID NO: 350239 - protein, 22 aa, Mycobacterium
AMAVIILRYPVDIAQAVNGLMA

SEQ ID NO: 350240 - protein, 19 aa, Mycobacterium
AMAVLIVVGVIGYRMIQNN

SEQ ID NO: 350241 - protein, 17 aa, Mycobacterium
AMAYIIVLNPIILSGSE

SEQ ID NO: 350242 - protein, 24 aa, Mycobacterium
AMCAVFLGVLIYRSPWGVASGNAL

SEQ ID NO: 350243 - protein, 24 aa, Mycobacterium
AMDPQQRLMLEVSWEALEHAGIDP

SEQ ID NO: 350244 - protein, 29 aa, Mycobacterium
AMDSLAIRPIPYLVTTRLLASVVAIIPLY

SEQ ID NO: 350245 - protein, 17 aa, Mycobacterium
AMDVMVWAFVWLAGWGP

SEQ ID NO: 350246 - protein, 25 aa, Mycobacterium
AMDYEVFLVSRIHEYWLASQAVEET

SEQ ID NO: 350247 - protein, 22 aa, Mycobacterium
AMERGWPVLSFSRPVSLRDRIP

SEQ ID NO: 350248 - protein, 25 aa, Mycobacterium
AMESFTVPLPRRLSSRLFGRNPLIR

SEQ ID NO: 350249 - protein, 21 aa, Mycobacterium
AMFFVVELTTAWLINSIALLA

SEQ ID NO: 350250 - protein, 25 aa, Mycobacterium
AMFGRNIMFLAVLFALGMNAYVYFN

SEQ ID NO: 350251 - protein, 25 aa, Mycobacterium
AMFTGLIYLPIAIGALIFSPLSGRM

SEQ ID NO: 350252 - protein, 23 aa, Mycobacterium
AMGAFFVIYGLVVFSLGAMPDVR

SEQ ID NO: 350253 - protein, 22 aa, Mycobacterium
AMGAVLLVTGLAGCFVFSLIRP

SEQ ID NO: 350254 - protein, 29 aa, Mycobacterium
AMGIGWAFIGIIFVAFYTANLTAALTVEK

SEQ ID NO: 350255 - protein, 20 aa, Mycobacterium
AMGLVTVLWVLYGYSMAFGN

SEQ ID NO: 350256 - protein, 19 aa, Mycobacterium
AMGSLFMIPGVRGNLGSET

SEQ ID NO: 350257 - protein, 23 aa, Mycobacterium
AMGSSRRFTLRMVLAEAAGIGVV

SEQ ID NO: 350258 - protein, 35 aa, Mycobacterium
AMGTLISIPLVSQLLGCTPLGPVGWAQGLGSAAAA

SEQ ID NO: 350259 - protein, 18 aa, Mycobacterium
AMGWPEPQDWTALAVFVV

SEQ ID NO: 350260 - protein, 22 aa, Mycobacterium
AMHLWFLAVYLVVVSLTPVAMA

SEQ ID NO: 350261 - protein, 23 aa, Mycobacterium
AMHLWFLAVYLVVVSLTPVGIAA

SEQ ID NO: 350262 - protein, 24 aa, Mycobacterium
AMIAPVLINPIGLPGALGIFAGSA

SEQ ID NO: 350263 - protein, 18 aa, Mycobacterium
AMIFSTSRLRPWDARHLQ

SEQ ID NO: 350264 - protein, 20 aa, Mycobacterium
AMILPLMFYLQTVCGLSPIR

SEQ ID NO: 350265 - protein, 23 aa, Mycobacterium
AMILSVDWFGLIVLAAWGTLAAL

SEQ ID NO: 350266 - protein, 19 aa, Mycobacterium
AMILTPRFIALTGHARDLE

SEQ ID NO: 350267 - protein, 20 aa, Mycobacterium
AMIVFVGRLFGTTAMWLAVL

SEQ ID NO: 350268 - protein, 27 aa, Mycobacterium
AMLCLSFTRLPYLQTLGVPLAVGMTVG

SEQ ID NO: 350269 - protein, 23 aa, Mycobacterium
AMLGGWLAVLGGAWFVVGRALAG

SEQ ID NO: 350270 - protein, 18 aa, Mycobacterium
AMLLIAYRSITRAIIPLF

SEQ ID NO: 350271 - protein, 30 aa, Mycobacterium
AMLLVAAWFALFALPLLISAPRHTGPETAP

SEQ ID NO: 350272 - protein, 28 aa, Mycobacterium
AMLPLLSLPILIFGLLSVGLMPLKLFPH

SEQ ID NO: 350273 - protein, 29 aa, Mycobacterium
AMLPLLTLPILIFGLLSVGLMPLRLFPRW

SEQ ID NO: 350274 - protein, 32 aa, Mycobacterium
AMLSTVVLVIWLLMGVLAVRLFGFTPGQLMLG

SEQ ID NO: 350275 - protein, 18 aa, Mycobacterium
AMLTLYFMLAVAAHVRVR

SEQ ID NO: 350276 - protein, 30 aa, Mycobacterium
AMLVAAAWLAIFALPLLFVAHRLPDSGEVH

SEQ ID NO: 350277 - protein, 19 aa, Mycobacterium
AMMDLRRQLDLLHGADSAG

SEQ ID NO: 350278 - protein, 26 aa, Mycobacterium
AMMFALRYRWWVVLSAITVATTAVHV

SEQ ID NO: 350279 - protein, 19 aa, Mycobacterium
AMMLVFFFVAAIASYIAHG

SEQ ID NO: 350280 - protein, 21 aa, Mycobacterium
AMNFVIGLVLIYGIAIVWGLP

SEQ ID NO: 350281 - protein, 26 aa, Mycobacterium
AMNLAGARPRLIWYAPHLVEGATSSP

SEQ ID NO: 350282 - protein, 27 aa, Mycobacterium
AMNVLAALAFWATVYLPAADFYPNQEH

SEQ ID NO: 350283 - protein, 24 aa, Mycobacterium
AMPDLLFAVLFVRALGIGVLPGVL

SEQ ID NO: 350284 - protein, 17 aa, Mycobacterium
AMPDLMIMLRAAQPEPP

SEQ ID NO: 350285 - protein, 39 aa, Mycobacterium
AMPRIALVIVIFMPLLYGAMYLWAFWNPFNEVDKVPVAL

SEQ ID NO: 350286 - protein, 45 aa, Mycobacterium
AMPSHANKFGWHSWWWLAAIPVLVLLVVVAWALFGWRRRRSGADG

SEQ ID NO: 350287 - protein, 18 aa, Mycobacterium
AMPTAVFTGALYGDELAA

SEQ ID NO: 350288 - protein, 24 aa, Mycobacterium
AMQLPRAVLVVVLLAVLLISVREG

SEQ ID NO: 350289 - protein, 18 aa, Mycobacterium
AMQRSFMYRDMATVGVDI

SEQ ID NO: 350290 - protein, 24 aa, Mycobacterium
AMQTGLIYLPIALGALFCSPLSGR

SEQ ID NO: 350291 - protein, 24 aa, Mycobacterium
AMRAAITLVIIINMLLTMALWSVD

SEQ ID NO: 350292 - protein, 18 aa, Mycobacterium
AMRDGLGLRLELKLHDAR

SEQ ID NO: 350293 - protein, 17 aa, Mycobacterium
AMRDGLGLRLELKLHDS

SEQ ID NO: 350294 - protein, 26 aa, Mycobacterium
AMRILRLTMMRLWLLRPGMRLWELPL

SEQ ID NO: 350295 - protein, 25 aa, Mycobacterium
AMRKSWSVLYLLLAAIAGALPGIWA

SEQ ID NO: 350296 - protein, 18 aa, Mycobacterium
AMRLAPVPMLNWIGTAYV

SEQ ID NO: 350297 - protein, 18 aa, Mycobacterium
AMRMALLAERITADEAYA

SEQ ID NO: 350298 - protein, 31 aa, Mycobacterium
AMRTRGWRRIGTAIVRWPGPILVVSCIATLV

SEQ ID NO: 350299 - protein, 33 aa, Mycobacterium
AMRTRGWRRIGTAIVRWPGPVLVVACALALVGL

SEQ ID NO: 350300 - protein, 26 aa, Mycobacterium
AMSPMALLVFRFSLAAAILGAWARFA

SEQ ID NO: 350301 - protein, 20 aa, Mycobacterium
AMSTIIIIPLVIYGMKALSV

SEQ ID NO: 350302 - protein, 24 aa, Mycobacterium
AMTGVYVLCLWAVVAAPKASAAVG

SEQ ID NO: 350303 - protein, 26 aa, Mycobacterium
AMTIPIALFMGCYLRFLRPGRVMEVS

SEQ ID NO: 350304 - protein, 25 aa, Mycobacterium
AMTKFQVLLLCAVLLLGIAWCGPRA

SEQ ID NO: 350305 - protein, 18 aa, Mycobacterium
AMTLIIFLTIHLGSNTIS

SEQ ID NO: 350306 - protein, 21 aa, Mycobacterium
AMTLWAPRFVAPLGLLRGSVA

SEQ ID NO: 350307 - protein, 21 aa, Mycobacterium
AMTLYLWHIPSIAVAAVALHA

SEQ ID NO: 350308 - protein, 22 aa, Mycobacterium
AMTLYLWHMPALLGMHLAFDFL

SEQ ID NO: 350309 - protein, 20 aa, Mycobacterium
AMTMLQMVGVIILALGLPAT

SEQ ID NO: 350310 - protein, 17 aa, Mycobacterium
AMTWLLAGLVAGVLSGA

SEQ ID NO: 350311 - protein, 24 aa, Mycobacterium
AMVASIVPLLLWITSVFDMVRNIR

SEQ ID NO: 350312 - protein, 24 aa, Mycobacterium
AMVFLGIVMMPFYYGSKVRSVPEF

SEQ ID NO: 350313 - protein, 20 aa, Mycobacterium
AMVFNLFFINLVIAGLHSYA

SEQ ID NO: 350314 - protein, 25 aa, Mycobacterium
AMVIALMIRGWRRRARLQSELIGAL

SEQ ID NO: 350315 - protein, 24 aa, Mycobacterium
AMVLTLGLFLTRTVILLASIVTDP

SEQ ID NO: 350316 - protein, 17 aa, Mycobacterium
AMVLWRFTGDRTLSPTA

SEQ ID NO: 350317 - protein, 32 aa, Mycobacterium
AMVPALQFTNWQWLSLTLAAPVVVWGALPFHR

SEQ ID NO: 350318 - protein, 27 aa, Mycobacterium
AMVSRWPGPVLAGSLLVLVVCALPVAG

SEQ ID NO: 350319 - protein, 28 aa, Mycobacterium
AMVVATLALIVIPLMLGAPLQPVLLRAM

SEQ ID NO: 350320 - protein, 23 aa, Mycobacterium
AMVVIVLTVWLAVGLGSGGWYFW

SEQ ID NO: 350321 - protein, 26 aa, Mycobacterium
AMVVVLMSFAVYAVISAALYNDIDNQ

SEQ ID NO: 350322 - protein, 21 aa, Mycobacterium
AMVVVPVMLSRILDAIEKMHK

SEQ ID NO: 350323 - protein, 17 aa, Mycobacterium
AMVWTAVAIWIEPLRST

SEQ ID NO: 350324 - protein, 25 aa, Mycobacterium
AMWARFPLPVIPAPGDPTPAARPLS

SEQ ID NO: 350325 - protein, 25 aa, Mycobacterium
AMWDPTIRQFAYGDKGYFQAALDIV

SEQ ID NO: 350326 - protein, 22 aa, Mycobacterium
AMYCLSFTRLPYFQTMGIPCAV

SEQ ID NO: 350327 - protein, 31 aa, Mycobacterium
AMYYAVMTQLGFAAILLALMVLTAAAGTDRF

SEQ ID NO: 350328 - protein, 17 aa, Mycobacterium
ANALLLRSSLAPLNRLA

SEQ ID NO: 350329 - protein, 20 aa, Mycobacterium
ANALRLLGMPMQSVTPAAPR

SEQ ID NO: 350330 - protein, 26 aa, Mycobacterium
ANATRFLFAVTFFGSCLLFPAYFQQV

SEQ ID NO: 350331 - protein, 45 aa, Mycobacterium
ANAVAFILMVCAFFRWGFPATMWAVPFAVFFLLSAGSWRDGVGTR

SEQ ID NO: 350332 - protein, 18 aa, Mycobacterium
ANDFAYLVDFGIARAAHD

SEQ ID NO: 350333 - protein, 23 aa, Mycobacterium
ANDFYLYYVILTGLHLFHVCLGL

SEQ ID NO: 350334 - protein, 33 aa, Mycobacterium
ANDIAKYFAIIPALFVGLFPGLDLLNIMRLHSP

SEQ ID NO: 350335 - protein, 26 aa, Mycobacterium
ANDLAKYFAILPALFSGIYPQLGALN

SEQ ID NO: 350336 - protein, 23 aa, Mycobacterium
ANDLFQTFFQVDVPWVVFAVAML

SEQ ID NO: 350337 - protein, 24 aa, Mycobacterium
ANDPFGDVFFIIDGWSTVRQEFEA

SEQ ID NO: 350338 - protein, 29 aa, Mycobacterium
ANFDDFFKPLRNYLYWEKHCETIPICFAI

SEQ ID NO: 350339 - protein, 29 aa, Mycobacterium
ANFDDFFRPIRNYFYWEPHCYNIPVCWAL

SEQ ID NO: 350340 - protein, 25 aa, Mycobacterium
ANFDDFFRPIRSYFYWEKHCFDIPG

SEQ ID NO: 350341 - protein, 24 aa, Mycobacterium
ANFDDFFRPIRSYFYWEKHCYDIP

SEQ ID NO: 350342 - protein, 28 aa, Mycobacterium
ANFDDFFRPIRSYFYWEKHCYDIPVCFA

SEQ ID NO: 350343 - protein, 28 aa, Mycobacterium
ANFDDFFRPIRSYFYWERHCYDVPVCWA

SEQ ID NO: 350344 - protein, 24 aa, Mycobacterium
ANFDDFFRPLRNYFYWEKHCFDIP

SEQ ID NO: 350345 - protein, 28 aa, Mycobacterium
ANFDDFFRPVRSYFYWEKHCYDIPACFA

SEQ ID NO: 350346 - protein, 28 aa, Mycobacterium
ANFEDFFHPIRSYFYWEPHCFDIPVCWS

SEQ ID NO: 350347 - protein, 29 aa, Mycobacterium
ANFEDFFHPIRSYFYWEPHCFDIPVCWSL

SEQ ID NO: 350348 - protein, 23 aa, Mycobacterium
ANFEDFFRPIRSYFYWEKHCFDV

SEQ ID NO: 350349 - protein, 17 aa, Mycobacterium
ANFILMTFQLLILAFFV

SEQ ID NO: 350350 - protein, 24 aa, Mycobacterium
ANFKLLVPVFRWQRRDNLLAEADP

SEQ ID NO: 350351 - protein, 25 aa, Mycobacterium
ANFQLWQLLVFIPIAAILGGQVGYI

SEQ ID NO: 350352 - protein, 24 aa, Mycobacterium
ANGFELTLAAPTFTWDQATYSDKY

SEQ ID NO: 350353 - protein, 35 aa, Mycobacterium
ANGIHHWQLLIFPYMVLLVVIVSFISWSALSRLLE

SEQ ID NO: 350354 - protein, 20 aa, Mycobacterium
ANGRRRLLSNTVLITGGAGF

SEQ ID NO: 350355 - protein, 26 aa, Mycobacterium
ANGSLLLVQPILVSALLFALPLSARL

SEQ ID NO: 350356 - protein, 25 aa, Mycobacterium
ANGSPLRIMILLVLVMAFGSALLDN

SEQ ID NO: 350357 - protein, 20 aa, Mycobacterium
ANGWANRPPPPPPAFETTRH

SEQ ID NO: 350358 - protein, 24 aa, Mycobacterium
ANHDAMLAVILFLIGLIVLYNGIR

SEQ ID NO: 350359 - protein, 20 aa, Mycobacterium
ANHEKWINLIIHIGQEGRGA

SEQ ID NO: 350360 - protein, 36 aa, Mycobacterium
ANHPALAKAFLRFNLHLLFASTLPPRVRELAILRIA

SEQ ID NO: 350361 - protein, 21 aa, Mycobacterium
ANIDNAWFWRDADRALRCGLM

SEQ ID NO: 350362 - protein, 23 aa, Mycobacterium
ANIDNAWFWRDTGGTLHCGLMDW

SEQ ID NO: 350363 - protein, 26 aa, Mycobacterium
ANILQYLSLTWFAIAVMALAFMMMPF

SEQ ID NO: 350364 - protein, 22 aa, Mycobacterium
ANILSGLPLLGVLLGQLIGARP

SEQ ID NO: 350365 - protein, 22 aa, Mycobacterium
ANILTVLRIVLVPVFVVVLFTE

SEQ ID NO: 350366 - protein, 19 aa, Mycobacterium
ANIPPTRFKRKEHWLDVHF

SEQ ID NO: 350367 - protein, 19 aa, Mycobacterium
ANIVMLVLLLAGFGWMVSS

SEQ ID NO: 350368 - protein, 24 aa, Mycobacterium
ANKDAWMVGYTPSLSTAVWVGTVK

SEQ ID NO: 350369 - protein, 24 aa, Mycobacterium
ANKRPGWALLLLALVALVGVVLGA

SEQ ID NO: 350370 - protein, 23 aa, Mycobacterium
ANLALAMPLTLIGALGGLGLVLV

SEQ ID NO: 350371 - protein, 27 aa, Mycobacterium
ANLDDFLRPIRSYFYWEQHCYDIPACW

SEQ ID NO: 350372 - protein, 18 aa, Mycobacterium
ANLLILGALRVNWALGFQ

SEQ ID NO: 350373 - protein, 53 aa, Mycobacterium
ANLLTPLIGAALLPAALTAGLFFISWKLGVAAAITLPLLLGALLAGIRIVRSA

SEQ ID NO: 350374 - protein, 17 aa, Mycobacterium
ANLPAVIRGLIAVAWYG

SEQ ID NO: 350375 - protein, 17 aa, Mycobacterium
ANLPAVMRGLVACGWFG

SEQ ID NO: 350376 - protein, 26 aa, Mycobacterium
ANLPRSRIWVFRTPRRNELMVNATRV

SEQ ID NO: 350377 - protein, 25 aa, Mycobacterium
ANLVGGWVIMWLIMTGFPELHAQTI

SEQ ID NO: 350378 - protein, 20 aa, Mycobacterium
ANLVPGQFIQPFVDAAFSDL

SEQ ID NO: 350379 - protein, 26 aa, Mycobacterium
ANLVTTARIIYVRVPALNAVFPNYRG

SEQ ID NO: 350380 - protein, 19 aa, Mycobacterium
ANMLSKPVLVGYMLGVALA

SEQ ID NO: 350381 - protein, 27 aa, Mycobacterium
ANNMDLLFAVLPGMAGLVLLTAAGGAI

SEQ ID NO: 350382 - protein, 21 aa, Mycobacterium
ANNVLVFPGIGLGVVVAGARL

SEQ ID NO: 350383 - protein, 17 aa, Mycobacterium
ANPGIVSIPLAFILGIV

SEQ ID NO: 350384 - protein, 24 aa, Mycobacterium
ANPGQVWLTVLVSMLVGLAVGCVN

SEQ ID NO: 350385 - protein, 20 aa, Mycobacterium
ANPLPEVWVDPLRLAQVIGN

SEQ ID NO: 350386 - protein, 20 aa, Mycobacterium
ANPSAVYELAFKGGPSAACP

SEQ ID NO: 350387 - protein, 25 aa, Mycobacterium
ANPVLGWIIGWISFTFLAVVVCAVD

SEQ ID NO: 350388 - protein, 22 aa, Mycobacterium
ANPVQFPNALLHKVTAAITQEF

SEQ ID NO: 350389 - protein, 24 aa, Mycobacterium
ANQADLRLVLLRPGKDDDEPQQHV

SEQ ID NO: 350390 - protein, 22 aa, Mycobacterium
ANQTVVSAILVLALYRSGVGLE

SEQ ID NO: 350391 - protein, 24 aa, Mycobacterium
ANQYTLPFLTFVGSIIISLFVPSG

SEQ ID NO: 350392 - protein, 25 aa, Mycobacterium
ANRGRLWRRVGTAVVRWPAPILALS

SEQ ID NO: 350393 - protein, 20 aa, Mycobacterium
ANRLAWAVEAWPAATRIAKS

SEQ ID NO: 350394 - protein, 23 aa, Mycobacterium
ANRRRTWLILRMNPQRNVAAIAS

SEQ ID NO: 350395 - protein, 26 aa, Mycobacterium
ANSADLDWRSVWDRGWSAAAEAQDTP

SEQ ID NO: 350396 - protein, 39 aa, Mycobacterium
ANSDWWPLLWFTAKVWLFLFFFMWLRATLPRMRYDQFMR

SEQ ID NO: 350397 - protein, 39 aa, Mycobacterium
ANSGWWPLLWFTAKVWTFMFLYFWLRATLPRLRYDQFMA

SEQ ID NO: 350398 - protein, 28 aa, Mycobacterium
ANSLRLNDPWYQQLWYYVVRGPEIKGTP

SEQ ID NO: 350399 - protein, 24 aa, Mycobacterium
ANSSPAFLLAYFGAAILALAVGVV

SEQ ID NO: 350400 - protein, 22 aa, Mycobacterium
ANSTAFVITPVSTIAWVIAFTC

SEQ ID NO: 350401 - protein, 26 aa, Mycobacterium
ANSVDFVWITDFAPYQAQLGQPIAWL

SEQ ID NO: 350402 - protein, 31 aa, Mycobacterium
ANTLTLLRLVLVPIFLLALFAKDGHEIAFRI

SEQ ID NO: 350403 - protein, 18 aa, Mycobacterium
ANTPCHRLTTSDSLGVLQ

SEQ ID NO: 350404 - protein, 39 aa, Mycobacterium
ANTSWLPALWFVAKVWGFMFLFMWLRATLPRLRYDQFMR

SEQ ID NO: 350405 - protein, 17 aa, Mycobacterium
ANTVLQAAWAQVLMWLT

SEQ ID NO: 350406 - protein, 31 aa, Mycobacterium
ANVFTRINAILGVLLLIVLATGSLINGMFGL

SEQ ID NO: 350407 - protein, 34 aa, Mycobacterium
ANVLTGLRFVLVPIFLYLLFYDGGHQTTFRIAAW

SEQ ID NO: 350408 - protein, 23 aa, Mycobacterium
ANVPTPFGLFPDVPPGVIVDALV

SEQ ID NO: 350409 - protein, 19 aa, Mycobacterium
ANVWRLLSLGLIVAGIIGL

SEQ ID NO: 350410 - protein, 21 aa, Mycobacterium
ANWSWALVGLLVSALTYVGAA

SEQ ID NO: 350411 - protein, 24 aa, Mycobacterium
ANYFSIALMVITFLVVPAIAYLHY

SEQ ID NO: 350412 - protein, 19 aa, Mycobacterium
ANYRKLNRLGASGSWIPYY

SEQ ID NO: 350413 - protein, 18 aa, Mycobacterium
APAAPLLAVPADESAWRL

SEQ ID NO: 350414 - protein, 27 aa, Mycobacterium
APADFWLLAYWLVLGALMIYLLSYAGR

SEQ ID NO: 350415 - protein, 29 aa, Mycobacterium
APADRLITTILLLAIVALIIGLSSTVLVA

SEQ ID NO: 350416 - protein, 26 aa, Mycobacterium
APAELDRLLRWLKDDPRGWSRLRGNA

SEQ ID NO: 350417 - protein, 42 aa, Mycobacterium
APAGPARPRRRRLLWTLIAAPFALLAVAYIGDLLYSKDRVVR

SEQ ID NO: 350418 - protein, 22 aa, Mycobacterium
APAGWHAPGWPPPPGGPQQQQP

SEQ ID NO: 350419 - protein, 24 aa, Mycobacterium
APAHKVPVWSLLLMGAAALAVSVA

SEQ ID NO: 350420 - protein, 25 aa, Mycobacterium
APAHPSRWRHVPTILLATSLVLLTT

SEQ ID NO: 350421 - protein, 25 aa, Mycobacterium
APAIEPPRIPGLGAPAPGALRNRTV

SEQ ID NO: 350422 - protein, 23 aa, Mycobacterium
APALLILMVLVVATLASVLAGLL

SEQ ID NO: 350423 - protein, 17 aa, Mycobacterium
APALLTLGSRRGLFDPR

SEQ ID NO: 350424 - protein, 24 aa, Mycobacterium
APALMTWPMILLAFGSVFSGGLLA

SEQ ID NO: 350425 - protein, 24 aa, Mycobacterium
APAPKPPRPPLTPQQKALAIVGGS

SEQ ID NO: 350426 - protein, 44 aa, Mycobacterium
APARGWAQDLWRRKINLKPVPVILIVLILISGGITAWLYAKLYR

SEQ ID NO: 350427 - protein, 17 aa, Mycobacterium
APAVLPPMGTKLGLKAQ

SEQ ID NO: 350428 - protein, 33 aa, Mycobacterium
APAVPEPVVAVPPLVPIVVPPVRVPSGTDTFLR

SEQ ID NO: 350429 - protein, 32 aa, Mycobacterium
APAVWAAVLALLFFAFFTRGIPEYYSVVMGNY

SEQ ID NO: 350430 - protein, 21 aa, Mycobacterium
APCSIALLVTIAASLTLAPAV

SEQ ID NO: 350431 - protein, 17 aa, Mycobacterium
APDFTPGIAPPPPAITG

SEQ ID NO: 350432 - protein, 24 aa, Mycobacterium
APDGAAWFRTGDLGMYLGGELYIT

SEQ ID NO: 350433 - protein, 26 aa, Mycobacterium
APDGTPLWPGLPPAPPPGAPRDPGPR

SEQ ID NO: 350434 - protein, 26 aa, Mycobacterium
APDGTPLWPGLPPAPPPGAPRESGPT

SEQ ID NO: 350435 - protein, 25 aa, Mycobacterium
APDQGPLDVIWSPIPLSGSGTNGSA

SEQ ID NO: 350436 - protein, 22 aa, Mycobacterium
APEAVDFSRWWAGTHQHVTDLQ

SEQ ID NO: 350437 - protein, 22 aa, Mycobacterium
APEHGFLYRLYTGTGAVDVVGK

SEQ ID NO: 350438 - protein, 21 aa, Mycobacterium
APELAGFWTGGFVQGPFNTRI

SEQ ID NO: 350439 - protein, 26 aa, Mycobacterium
APEQRPRLWRMRIDVQRVGDVAKVTN

SEQ ID NO: 350440 - protein, 25 aa, Mycobacterium
APESLLYQWDELAGWLRAERQNLAT

SEQ ID NO: 350441 - protein, 31 aa, Mycobacterium
APESTFGTVFLLGVLVVSAGWDMRLSVATSL

SEQ ID NO: 350442 - protein, 17 aa, Mycobacterium
APEVLWITEGVLPVYVV

SEQ ID NO: 350443 - protein, 24 aa, Mycobacterium
APEVRLLPTRLSPRAFASLYPAPE

SEQ ID NO: 350444 - protein, 23 aa, Mycobacterium
APFGSIYHFFPGGKAQLADEAIR

SEQ ID NO: 350445 - protein, 23 aa, Mycobacterium
APFGYLTWLGWFAYTVVGNMVGG

SEQ ID NO: 350446 - protein, 23 aa, Mycobacterium
APFRRSRLALAMTALGLYAVTLN

SEQ ID NO: 350447 - protein, 17 aa, Mycobacterium
APFRRWIGMGRLVAIGR

SEQ ID NO: 350448 - protein, 25 aa, Mycobacterium
APFVALLVPRFRLGTLTIWVGFIAA

SEQ ID NO: 350449 - protein, 22 aa, Mycobacterium
APGALVALWRGTVVVLQSIMAV

SEQ ID NO: 350450 - protein, 21 aa, Mycobacterium
APGAPVLDPLPRWLRADVLST

SEQ ID NO: 350451 - protein, 24 aa, Mycobacterium
APGPAWLPYATLFAVAAGALWWLG

SEQ ID NO: 350452 - protein, 20 aa, Mycobacterium
APGPIPYPGAPPYGAPRYAP

SEQ ID NO: 350453 - protein, 24 aa, Mycobacterium
APGPTVVFLVAMLASLGGLGWATK

SEQ ID NO: 350454 - protein, 24 aa, Mycobacterium
APGRILIGFAAVGLIVFALMSWRA

SEQ ID NO: 350455 - protein, 20 aa, Mycobacterium
APGRLFGKSAYHALTFGWLM

SEQ ID NO: 350456 - protein, 23 aa, Mycobacterium
APGRSLWWSLAWTAGMIAYAGDV

SEQ ID NO: 350457 - protein, 24 aa, Mycobacterium
APGTSMHVLLPGRPGPIVRPNMGD

SEQ ID NO: 350458 - protein, 27 aa, Mycobacterium
APGVRARLLLMWLACTALPGSAIAVLL

SEQ ID NO: 350459 - protein, 20 aa, Mycobacterium
APGVVPPHQGSCRPGKVFVY

SEQ ID NO: 350460 - protein, 17 aa, Mycobacterium
APGWWHQSAPRTMAAPP

SEQ ID NO: 350461 - protein, 22 aa, Mycobacterium
APHGDLVVRHLQWLATDGDPQA

SEQ ID NO: 350462 - protein, 22 aa, Mycobacterium
APHLPIPTLAGLAILPTADELA

SEQ ID NO: 350463 - protein, 24 aa, Mycobacterium
APHLPPANVPPPAAPAPAGPVPPE

SEQ ID NO: 350464 - protein, 23 aa, Mycobacterium
APHPLRTPYAVVAVICLIVGVGV

SEQ ID NO: 350465 - protein, 17 aa, Mycobacterium
APHPQLAVAFGAAFMAG

SEQ ID NO: 350466 - protein, 18 aa, Mycobacterium
APHTVFLFLLNSSGAVIL

SEQ ID NO: 350467 - protein, 27 aa, Mycobacterium
APIAEVLLDTYFQPGKLPDSLSDMLRG

SEQ ID NO: 350468 - protein, 22 aa, Mycobacterium
APIAFIALIAVGADYNLLLALR

SEQ ID NO: 350469 - protein, 18 aa, Mycobacterium
APIGFRLAAFALPGTVIG

SEQ ID NO: 350470 - protein, 31 aa, Mycobacterium
APIKLRTTTLTLIYPTLSLPSWSAGSREVAC

SEQ ID NO: 350471 - protein, 30 aa, Mycobacterium
APILFVAMPWLYLRVRFFRRKWTAITLAST

SEQ ID NO: 350472 - protein, 27 aa, Mycobacterium
APIVIVIFALFVVFTRVLFRKELRANH

SEQ ID NO: 350473 - protein, 36 aa, Mycobacterium
APIVLRLHFYAGLLVGPFLLIAALTGLAYALVGQVD

SEQ ID NO: 350474 - protein, 17 aa, Mycobacterium
APKLKWVAGAVGGGLTF

SEQ ID NO: 350475 - protein, 39 aa, Mycobacterium
APKRLGMQYARRWAGLVAPLLRFLAIVTKPVIWGLGQST

SEQ ID NO: 350476 - protein, 39 aa, Mycobacterium
APKRPLLPRLIHRFSVLILLVWLGLTAIVNLAVPQLEAV

SEQ ID NO: 350477 - protein, 32 aa, Mycobacterium
APKRPSTWRHVPAILLVASLVLFTIAMAGPTN

SEQ ID NO: 350478 - protein, 27 aa, Mycobacterium
APKTRSQLMFGALGVLLCLLLGVAIVT

SEQ ID NO: 350479 - protein, 25 aa, Mycobacterium
APLAAFFVTLIPFIVDGGVALTAVL

SEQ ID NO: 350480 - protein, 25 aa, Mycobacterium
APLDPDKFYLPPRLVSLYGTEIWDE

SEQ ID NO: 350481 - protein, 26 aa, Mycobacterium
APLDPDKFYLPPRLVSLYGTPMWDEM

SEQ ID NO: 350482 - protein, 24 aa, Mycobacterium
APLDTAWSALTDIPLVIGCVPGAE

SEQ ID NO: 350483 - protein, 40 aa, Mycobacterium
APLEVPYLRASPWLLWRKRVVWLLVLFVAEAYTGSVLRAF

SEQ ID NO: 350484 - protein, 19 aa, Mycobacterium
APLFHNIAAWLMQRENVPL

SEQ ID NO: 350485 - protein, 26 aa, Mycobacterium
APLGFLIAGLLLMAFAVGFVTMTPFV

SEQ ID NO: 350486 - protein, 20 aa, Mycobacterium
APLIAKYRLAGDHRPFSQAV

SEQ ID NO: 350487 - protein, 23 aa, Mycobacterium
APLKFAQLVGLIFALAGVAAFAA

SEQ ID NO: 350488 - protein, 17 aa, Mycobacterium
APLLAVPADESAWRLAA

SEQ ID NO: 350489 - protein, 17 aa, Mycobacterium
APLLWSVLVGLGMSVFS

SEQ ID NO: 350490 - protein, 30 aa, Mycobacterium
APLPIFGYLLTLVGFVFLGSFTAALALGST

SEQ ID NO: 350491 - protein, 36 aa, Mycobacterium
APLPQWALPSVVLSLAWMGWLCVMFLRRGHEIPRRY

SEQ ID NO: 350492 - protein, 29 aa, Mycobacterium
APLSRRLLALLIDWLIAGGLALLFVKGNL

SEQ ID NO: 350493 - protein, 23 aa, Mycobacterium
APLTFVTFAYMSVTFFCYTIGTG

SEQ ID NO: 350494 - protein, 28 aa, Mycobacterium
APLTLAQQRIWLLDRLNLGGPELCSQRY

SEQ ID NO: 350495 - protein, 26 aa, Mycobacterium
APLVSFALVLLAFSLGALVLGVADWW

SEQ ID NO: 350496 - protein, 20 aa, Mycobacterium
APLWVLVVLVAVISVGGPGS

SEQ ID NO: 350497 - protein, 22 aa, Mycobacterium
APMADGWMDRGRLVCPWHGSWF

SEQ ID NO: 350498 - protein, 20 aa, Mycobacterium
APMLPQIVPGALRDLFGAAL

SEQ ID NO: 350499 - protein, 22 aa, Mycobacterium
APMLTHFFWGLAMVLALPPIFG

SEQ ID NO: 350500 - protein, 18 aa, Mycobacterium
APNAPIALPEREPRNIWV

SEQ ID NO: 350501 - protein, 21 aa, Mycobacterium
APNCPLPRPAIGPGTYSLVVQ

SEQ ID NO: 350502 - protein, 19 aa, Mycobacterium
APNSSAFAVAFHGILRAGA

SEQ ID NO: 350503 - protein, 20 aa, Mycobacterium
APPDIPAERLNLDPIPLPDV

SEQ ID NO: 350504 - protein, 32 aa, Mycobacterium
APPDTTVVSWLPFFHDMGLVLGIAIPILGGFA

SEQ ID NO: 350505 - protein, 39 aa, Mycobacterium
APPDTTVVSWLPFYHDMGFILGIVFPVLAGVPAVLTSPV

SEQ ID NO: 350506 - protein, 26 aa, Mycobacterium
APPLVMLWLVRWLLFRVEFGAGLIKM

SEQ ID NO: 350507 - protein, 21 aa, Mycobacterium
APPPRPSRIKPGLPAGLDTVI

SEQ ID NO: 350508 - protein, 17 aa, Mycobacterium
APPPVYVEPLAPAPYVP

SEQ ID NO: 350509 - protein, 34 aa, Mycobacterium
APPRDMVPVWVAAGGLFVALLIGGGVFGTAMLMK

SEQ ID NO: 350510 - protein, 20 aa, Mycobacterium
APPTAHLPFRSGRSFSASVT

SEQ ID NO: 350511 - protein, 25 aa, Mycobacterium
APPTWASWLRVVLGSALIALGAYHW

SEQ ID NO: 350512 - protein, 24 aa, Mycobacterium
APQAFAPLAPYWGNAHSLGLHAVV

SEQ ID NO: 350513 - protein, 48 aa, Mycobacterium
APQFDRLPGPQLLSYSAVTVVVALALLFGVGDAWRISLDRPTPPAPGE

SEQ ID NO: 350514 - protein, 17 aa, Mycobacterium
APQGIEYIVGFLGALFA

SEQ ID NO: 350515 - protein, 20 aa, Mycobacterium
APQIPYPKTLPPPPPPVGVG

SEQ ID NO: 350516 - protein, 20 aa, Mycobacterium
APQIYRPPAASPAPPAPLVV

SEQ ID NO: 350517 - protein, 24 aa, Mycobacterium
APQQPPRQWTPQPVAPVAPVAVPA

SEQ ID NO: 350518 - protein, 28 aa, Mycobacterium
APQRRRTWRWVILTLIVLAVVAGVDAYL

SEQ ID NO: 350519 - protein, 17 aa, Mycobacterium
APRARRLFVEQWAVIGR

SEQ ID NO: 350520 - protein, 25 aa, Mycobacterium
APRDSVCVSWLPFYHDMGLMQGVIA

SEQ ID NO: 350521 - protein, 28 aa, Mycobacterium
APRGKYWWLRWVILGIVAIVLAVEIALV

SEQ ID NO: 350522 - protein, 27 aa, Mycobacterium
APRGKYWWVRWVILGIVAIVLAVEVAL

SEQ ID NO: 350523 - protein, 32 aa, Mycobacterium
APRKRRLAGKAWAIVALVAAVLFVGSAGFAGA

SEQ ID NO: 350524 - protein, 17 aa, Mycobacterium
APRLAITAWLAAIVSVL

SEQ ID NO: 350525 - protein, 19 aa, Mycobacterium
APRRLSPQVAVAPFDPAVG

SEQ ID NO: 350526 - protein, 18 aa, Mycobacterium
APRVRLLPRHVAGDDLVG

SEQ ID NO: 350527 - protein, 49 aa, Mycobacterium
APSAMVHHWLYSVFLTIIGLAMWLIDNVLSFQWLSIIATPIDFVGQKVA

SEQ ID NO: 350528 - protein, 23 aa, Mycobacterium
APSAPVPTPWAGVPGWGVGHTGT

SEQ ID NO: 350529 - protein, 30 aa, Mycobacterium
APSESLLSRHFAWRVLLVSVLMAGGALGMF

SEQ ID NO: 350530 - protein, 19 aa, Mycobacterium
APSFAFLNIDTWQLVINTL

SEQ ID NO: 350531 - protein, 27 aa, Mycobacterium
APSGPVRLLGWSFGGSMALLIAQELSR

SEQ ID NO: 350532 - protein, 24 aa, Mycobacterium
APSLPLLIAWRSVGGVAAAAFAPA

SEQ ID NO: 350533 - protein, 22 aa, Mycobacterium
APSNAMFFPEPRCRVVTGVGAF

SEQ ID NO: 350534 - protein, 29 aa, Mycobacterium
APSTLVSLRLWRHLGRLYLMSPDPATNLM

SEQ ID NO: 350535 - protein, 21 aa, Mycobacterium
APSVWLGGMLSSVSSVLATTV

SEQ ID NO: 350536 - protein, 17 aa, Mycobacterium
APSWWPLNMTWGGLPSS

SEQ ID NO: 350537 - protein, 25 aa, Mycobacterium
APTAQPLLWSVLLGTGLSGFSLALA

SEQ ID NO: 350538 - protein, 26 aa, Mycobacterium
APTFQFFTLYVTAGVYYWIVCMAMSA

SEQ ID NO: 350539 - protein, 25 aa, Mycobacterium
APTFTLSVLPLFLPAVVALVAENIG

SEQ ID NO: 350540 - protein, 21 aa, Mycobacterium
APTLLVILRFIQGFAVGGEWG

SEQ ID NO: 350541 - protein, 35 aa, Mycobacterium
APTSTPPRWSPTAPYPTIPGLPWVPAPQVPGGQAG

SEQ ID NO: 350542 - protein, 21 aa, Mycobacterium
APTSYPLPVAAPIGSVLVSYS

SEQ ID NO: 350543 - protein, 28 aa, Mycobacterium
APTTDPGWKWLWWQYALADTRYVSGNPW

SEQ ID NO: 350544 - protein, 22 aa, Mycobacterium
APTTPVWRLALPIASLGMGMVF

SEQ ID NO: 350545 - protein, 18 aa, Mycobacterium
APTTVFIFLLNSSGAVLL

SEQ ID NO: 350546 - protein, 21 aa, Mycobacterium
APTVPTLLRLIGDADPATCAV

SEQ ID NO: 350547 - protein, 18 aa, Mycobacterium
APTWFRRASVTLGGFGLV

SEQ ID NO: 350548 - protein, 20 aa, Mycobacterium
APTWLKTVPKRLSALLNTSG

SEQ ID NO: 350549 - protein, 25 aa, Mycobacterium
APTWRILLRHILPNALAPVLVYATI

SEQ ID NO: 350550 - protein, 24 aa, Mycobacterium
APVALWLNRNLGFIPLFADSPVNI

SEQ ID NO: 350551 - protein, 49 aa, Mycobacterium
APVAPPPAVVPVPIPLFPPVWEPPRRQENPWWPDRDRPRYTPPAQTQQP

SEQ ID NO: 350552 - protein, 25 aa, Mycobacterium
APVAPSPLLPAPQAAPPPAAAAPGT

SEQ ID NO: 350553 - protein, 26 aa, Mycobacterium
APVAVVTVLIIVKLLSVVVAGRSVTS

SEQ ID NO: 350554 - protein, 32 aa, Mycobacterium
APVGLAVVGLLLLLGLPFFSVKWGFPDDRVLP

SEQ ID NO: 350555 - protein, 30 aa, Mycobacterium
APVIFAHLSFVLPLVTWFLIGFFEAVPPSL

SEQ ID NO: 350556 - protein, 19 aa, Mycobacterium
APVLFFGIALNISAIVLWA

SEQ ID NO: 350557 - protein, 18 aa, Mycobacterium
APVLLQVPGGAWMIGMRR

SEQ ID NO: 350558 - protein, 21 aa, Mycobacterium
APVLYAVMAQPLGAGWVPAVL

SEQ ID NO: 350559 - protein, 26 aa, Mycobacterium
APVPGAALFVLDKWLRPAPEGVVGEL

SEQ ID NO: 350560 - protein, 26 aa, Mycobacterium
APVQMLSNLLFLWERHRVGELLDAAL

SEQ ID NO: 350561 - protein, 27 aa, Mycobacterium
APVTKFTRTLVLSTVAMIFAVCIAAIL

SEQ ID NO: 350562 - protein, 31 aa, Mycobacterium
APVVIQFCLLLLLAAMWLLGKWAFPTESGRS

SEQ ID NO: 350563 - protein, 32 aa, Mycobacterium
APVVISGWALMTWTLMAFGSTLSRLASIVLAV

SEQ ID NO: 350564 - protein, 24 aa, Mycobacterium
APVVLIVLVIFVALLPRLFGSVTV

SEQ ID NO: 350565 - protein, 18 aa, Mycobacterium
APWAPFTIDFNLANIGGP

SEQ ID NO: 350566 - protein, 17 aa, Mycobacterium
APWEQAAHLLDYGFATP

SEQ ID NO: 350567 - protein, 26 aa, Mycobacterium
APYAAFGALYFLISAVWLLVAEARRR

SEQ ID NO: 350568 - protein, 24 aa, Mycobacterium
APYHLRLDWLMWFAAISPGYALPW

SEQ ID NO: 350569 - protein, 25 aa, Mycobacterium
APYILIWVIIISYVCHIPFAVRSKR

SEQ ID NO: 350570 - protein, 17 aa, Mycobacterium
APYNTRIVRRSNALLDW

SEQ ID NO: 350571 - protein, 29 aa, Mycobacterium
APYQAQLGQPIAWLTAPIGPPGNAAGVLA

SEQ ID NO: 350572 - protein, 20 aa, Mycobacterium
APYVAWLMQASADSAAAAAA

SEQ ID NO: 350573 - protein, 26 aa, Mycobacterium
APYWVCAIYLVLLTIGGIGAALFMDD

SEQ ID NO: 350574 - protein, 21 aa, Mycobacterium
AQAAGRLLAPLRPALILSGVL

SEQ ID NO: 350575 - protein, 27 aa, Mycobacterium
AQAEKWNFPIVLVILLAVFGSLAAAAM
